United States Patent 11,640,849 (METHODS FOR HISTOLOGICAL DIAGNOSIS AND TREATMENT OF DISEASES) - sequence listing, part 39

SEQ ID NO: 1507312 - protein, 24 aa, Mycobacterium tuberculosis
GFLGPRVYELLYGDPFPSGVQTAE

SEQ ID NO: 1507313 - protein, 32 aa, Mycobacterium tuberculosis; identical to SEQ ID NO: 218359

SEQ ID NO: 1507314 - protein, 20 aa, Mycobacterium tuberculosis
GFLMMAHTIAPEKLAAQARI

SEQ ID NO: 1507315 - protein, 26 aa, Mycobacterium tuberculosis
GFSYDVLHAFNPRIVLAGSSAFGNRG

SEQ ID NO: 1507316 - protein, 19 aa, Mycobacterium tuberculosis
GGDTAVQLGLPRLAARINN

SEQ ID NO: 1507317 - protein, 24 aa, Mycobacterium tuberculosis
GGFEYFYGFIGGEANQWYPSLYEG

SEQ ID NO: 1507318 - protein, 25 aa, Mycobacterium tuberculosis
GGFTPRTWVALATEYFLAGRARVLV

SEQ ID NO: 1507319 - protein, 26 aa, Mycobacterium tuberculosis
GGGGLLRLPERIPYAIAMELALTGDN

SEQ ID NO: 1507320 - protein, 26 aa, Mycobacterium tuberculosis
GGGTMTHAWLLTGPPGSGRSVAALCF

SEQ ID NO: 1507321 - protein, 24 aa, Mycobacterium tuberculosis
GGHEAVLPSAFFFEIAQWADGDGE

SEQ ID NO: 1507322 - protein, 27 aa, Mycobacterium tuberculosis
GGLYRQWALARRAQGDLWAAPSGWRGG

SEQ ID NO: 1507323 - protein, 25 aa, Mycobacterium tuberculosis
GGNQDWWPNRLNLKVLHQNPAVADP

SEQ ID NO: 1507324 - protein, 37 aa, Mycobacterium tuberculosis; identical to SEQ ID NO: 218439

SEQ ID NO: 1507325 - protein, 24 aa, Mycobacterium tuberculosis
GGSGFLVDYPLEQYIRDAKIDSLY

SEQ ID NO: 1507326 - protein, 20 aa, Mycobacterium tuberculosis
GGTRNGTIVHWPNGIAAKGE

SEQ ID NO: 1507327 - protein, 27 aa, Mycobacterium tuberculosis
GGVVLLMWAGILAYLDRYGYDYVTGCV

SEQ ID NO: 1507328 - protein, 18 aa, Mycobacterium tuberculosis
GGYFESRSLTRLAGRLLG

SEQ ID NO: 1507329 - protein, 19 aa, Mycobacterium tuberculosis
GGYGYMREYPVARAYLDSR

SEQ ID NO: 1507330 - protein, 33 aa, Mycobacterium tuberculosis; identical to SEQ ID NO: 218480

SEQ ID NO: 1507331 - protein, 20 aa, Mycobacterium tuberculosis
GHPLGYIATDVYARYFRMVG

SEQ ID NO: 1507332 - protein, 17 aa, Mycobacterium tuberculosis
GHQWLTGLRIEDGLLKK

SEQ ID NO: 1507333 - protein, 41 aa, Mycobacterium tuberculosis
GHRLLETWHPLGVVGVITAFNFPVAVWAWNTAVALVCGDTV

SEQ ID NO: 1507334 - protein, 25 aa, Mycobacterium tuberculosis
GHRLRADAILLRRTDRLPFAEPPDW

SEQ ID NO: 1507335 - protein, 22 aa, Mycobacterium tuberculosis
GHRYRWLRGTGLLAAAACAGFF

SEQ ID NO: 1507336 - protein, 27 aa, Mycobacterium tuberculosis
GHSSLTLYIQLYLGGFGLELSDIESLR

SEQ ID NO: 1507337 - protein, 19 aa, Mycobacterium tuberculosis
GIATWPARAGLAAADTGLN

SEQ ID NO: 1507338 - protein, 27 aa, Mycobacterium tuberculosis
GIGCSSRFPYYLETYGFHSIHGRAPAI

SEQ ID NO: 1507339 - protein, 23 aa, Mycobacterium tuberculosis
GILAAVKRLYLLGKNDRPTGTFT

SEQ ID NO: 1507340 - protein, 18 aa, Mycobacterium tuberculosis
GILMGYGWHRGRDEGQLL

SEQ ID NO: 1507341 - protein, 24 aa, Mycobacterium tuberculosis
GIVSRRRYHTLRGARPTRPPPPML

SEQ ID NO: 1507342 - protein, 28 aa, Mycobacterium tuberculosis
GKNTVLWCGYTWQYWLTTRSVNPAEYRF

SEQ ID NO: 1507343 - protein, 33 aa, Mycobacterium tuberculosis; identical to SEQ ID NO: 218536

SEQ ID NO: 1507344 - protein, 30 aa, Mycobacterium tuberculosis; identical to SEQ ID NO: 218543

SEQ ID NO: 1507345 - protein, 27 aa, Mycobacterium tuberculosis
GLDVTIVRPFNIFGVRQKAGRFGALIP

SEQ ID NO: 1507346 - protein, 24 aa, Mycobacterium tuberculosis
GLERIGLRFVLEIRVPAGVDGRIT

SEQ ID NO: 1507347 - protein, 19 aa, Mycobacterium tuberculosis
GLEWDAVFLVGLADGTLPI

SEQ ID NO: 1507348 - protein, 24 aa, Mycobacterium tuberculosis
GLFSGFMSGFGNTGFLQSGFGNLE

SEQ ID NO: 1507349 - protein, 24 aa, Mycobacterium tuberculosis
GLHFICRDVWLRVASTSTAWTSRF

SEQ ID NO: 1507350 - protein, 23 aa, Mycobacterium tuberculosis
GLIKTILCLKNKALPATLHYTSP

SEQ ID NO: 1507351 - protein, 25 aa, Mycobacterium tuberculosis
GLNAKWPVYLSTKNTILKAYDGMFK

SEQ ID NO: 1507352 - protein, 23 aa, Mycobacterium tuberculosis
GLNLSIRDGWWDEWYDGENGWEI

SEQ ID NO: 1507353 - protein, 17 aa, Mycobacterium tuberculosis
GLPSSPWHERAKRLAPK

SEQ ID NO: 1507354 - protein, 30 aa, Mycobacterium tuberculosis; identical to SEQ ID NO: 114827

SEQ ID NO: 1507355 - protein, 30 aa, Mycobacterium tuberculosis; identical to SEQ ID NO: 218597

SEQ ID NO: 1507356 - protein, 19 aa, Mycobacterium tuberculosis
GLTSKPWVKTTIAPGSQVV

SEQ ID NO: 1507357 - protein, 19 aa, Mycobacterium tuberculosis
GLVAIDTLLARMENDRDRL

SEQ ID NO: 1507358 - protein, 23 aa, Mycobacterium tuberculosis
GMESLLGAIYLQHGMEKAREVIL

SEQ ID NO: 1507359 - protein, 26 aa, Mycobacterium tuberculosis
GMGLDWASVFSGYRPKRVELPTYAFQ

SEQ ID NO: 1507360 - protein, 23 aa, Mycobacterium tuberculosis
GMGWVSLFDPQRLAALLAMPADA

SEQ ID NO: 1507361 - protein, 17 aa, Mycobacterium tuberculosis
GMIGITQALAPGLAAKG

SEQ ID NO: 1507362 - protein, 20 aa, Mycobacterium tuberculosis
GMLTTPQLKAFYLDLQDERL

SEQ ID NO: 1507363 - protein, 34 aa, Mycobacterium tuberculosis; identical to SEQ ID NO: 218633

SEQ ID NO: 1507364 - protein, 18 aa, Mycobacterium tuberculosis
GNPPLACGLPALPQGNNP

SEQ ID NO: 1507365 - protein, 21 aa, Mycobacterium tuberculosis
GNQVPLTYPFALTFPSVMSLV

SEQ ID NO: 1507366 - protein, 20 aa, Mycobacterium tuberculosis
GPDVWLAALATLPLVHQPGD

SEQ ID NO: 1507367 - protein, 23 aa, Mycobacterium tuberculosis
GPGEFLDPLGGLAALRAKVLDTP

SEQ ID NO: 1507368 - protein, 19 aa, Mycobacterium tuberculosis
GPHRVLRGDLAFAGLPGVV

SEQ ID NO: 1507369 - protein, 25 aa, Mycobacterium tuberculosis
GPPASHHLRWLASANGLLDIPEDVV

SEQ ID NO: 1507370 - protein, 17 aa, Mycobacterium tuberculosis
GPSLWHRDFHDAVIVEC

SEQ ID NO: 1507371 - protein, 25 aa, Mycobacterium tuberculosis
GPVNTPLLQELFAKNPERAARRMVH

SEQ ID NO: 1507372 - protein, 25 aa, Mycobacterium tuberculosis
GPYFGDRRKAFLEDLAVVTGGQVVN

SEQ ID NO: 1507373 - protein, 24 aa, Mycobacterium tuberculosis
GQGKTRLLRALAGLLDEWTPVIAG

SEQ ID NO: 1507374 - protein, 24 aa, Mycobacterium tuberculosis
GQGSVLVPFSWQGVSLHAAGASAV

SEQ ID NO: 1507375 - protein, 29 aa, Mycobacterium tuberculosis
GQNARLAARLTGWRIDIRGDAPPPPPGQP

SEQ ID NO: 1507376 - protein, 26 aa, Mycobacterium tuberculosis
GQQVLSRFLHDFAGLGAQWTPANIAN

SEQ ID NO: 1507377 - protein, 24 aa, Mycobacterium tuberculosis
GQTRGWFYTLHVLATALFDRPAFK

SEQ ID NO: 1507378 - protein, 33 aa, Mycobacterium tuberculosis; identical to SEQ ID NO: 218747

SEQ ID NO: 1507379 - protein, 19 aa, Mycobacterium tuberculosis
GREHPLIARSSLGSAPRQA

SEQ ID NO: 1507380 - protein, 26 aa, Mycobacterium tuberculosis
GRFNDMILGLRMITPVGVLDLGRVPA

SEQ ID NO: 1507381 - protein, 23 aa, Mycobacterium tuberculosis
GRIQRELPDWLSADVAILGEPTA

SEQ ID NO: 1507382 - protein, 23 aa, Mycobacterium tuberculosis
GRLPLFEPPGDEFFGRYRDIVTA

SEQ ID NO: 1507383 - protein, 19 aa, Mycobacterium tuberculosis
GRNRIVRRLLAAAGFPVEA

SEQ ID NO: 1507384 - protein, 26 aa, Mycobacterium tuberculosis
GRNTLKWNYFGPDVVPLWLAEMDFPT

SEQ ID NO: 1507385 - protein, 19 aa, Mycobacterium tuberculosis
GRPLDGLNQIVLHLGNGAS

SEQ ID NO: 1507386 - protein, 23 aa, Mycobacterium tuberculosis
GRQVFKDYVAFPALTSLSPGATY

SEQ ID NO: 1507387 - protein, 25 aa, Mycobacterium tuberculosis
GRSAACWARRLVFVNGHGGNVGALT

SEQ ID NO: 1507388 - protein, 23 aa, Mycobacterium tuberculosis
GRTRYRLLETVRRYALEKLGDSG

SEQ ID NO: 1507389 - protein, 23 aa, Mycobacterium tuberculosis
GRVAGVHFLMKKNKITEIHGYGT

SEQ ID NO: 1507390 - protein, 27 aa, Mycobacterium tuberculosis
GRWAQAYGFPLMPIDGILVGTAAMATK

SEQ ID NO: 1507391 - protein, 17 aa, Mycobacterium tuberculosis
GRYRQRCWLRQLTPHAN

SEQ ID NO: 1507392 - protein, 23 aa, Mycobacterium tuberculosis
GSAPRQAFVFPGQGGHWPGMGAV

SEQ ID NO: 1507393 - protein, 23 aa, Mycobacterium tuberculosis
GSDFELVQGFLLAEGVVAHREDV

SEQ ID NO: 1507394 - protein, 19 aa, Mycobacterium tuberculosis
GSDRRLWQRLCTELELPAL

SEQ ID NO: 1507395 - protein, 21 aa, Mycobacterium tuberculosis
GSFGDDPLRMLRAARFVSQLG

SEQ ID NO: 1507396 - protein, 34 aa, Mycobacterium tuberculosis; identical to SEQ ID NO: 218829

SEQ ID NO: 1507397 - protein, 19 aa, Mycobacterium tuberculosis
GSLTHGFLNLFQLGGGSAA

SEQ ID NO: 1507398 - protein, 31 aa, Mycobacterium tuberculosis; identical to SEQ ID NO: 218839

SEQ ID NO: 1507399 - protein, 24 aa, Mycobacterium tuberculosis
GSNVLRAFTFPFDNVRVLIVGQDP

SEQ ID NO: 1507400 - protein, 17 aa, Mycobacterium tuberculosis
GSWNGPRRSRAIGPSAA

SEQ ID NO: 1507401 - protein, 19 aa, Mycobacterium tuberculosis
GTADGRILRVRGRGVPKRS

SEQ ID NO: 1507402 - protein, 19 aa, Mycobacterium tuberculosis
GTMSAILLGLEGCQPETIT

SEQ ID NO: 1507403 - protein, 32 aa, Mycobacterium tuberculosis; identical to SEQ ID NO: 218898

SEQ ID NO: 1507404 - protein, 35 aa, Mycobacterium tuberculosis; identical to SEQ ID NO: 218904

SEQ ID NO: 1507405 - protein, 25 aa, Mycobacterium tuberculosis
GVACYPARFQLVLAANPCPCAPADP

SEQ ID NO: 1507406 - protein, 17 aa, Mycobacterium tuberculosis
GVGFRWWTRCRALELGL

SEQ ID NO: 1507407 - protein, 24 aa, Mycobacterium tuberculosis
GVHWSRIRLADRAHLEPWEPSADG

SEQ ID NO: 1507408 - protein, 31 aa, Mycobacterium tuberculosis; identical to SEQ ID NO: 218946

SEQ ID NO: 1507409 - protein, 34 aa, Mycobacterium tuberculosis; identical to SEQ ID NO: 218957

SEQ ID NO: 1507410 - protein, 17 aa, Mycobacterium tuberculosis
GVQGITDLITTPGLINV

SEQ ID NO: 1507411 - protein, 23 aa, Mycobacterium tuberculosis
GVSNYSLARWRKADAALGRPVVS

SEQ ID NO: 1507412 - protein, 28 aa, Mycobacterium tuberculosis
GVSRAELIRLLLNRALTTAGDDLASDLQ

SEQ ID NO: 1507413 - protein, 24 aa, Mycobacterium tuberculosis
GVTDAFLRAVERNGLHRLVNPRTG

SEQ ID NO: 1507414 - protein, 18 aa, Mycobacterium tuberculosis
GVVHPAVVQANRVRTWLL

SEQ ID NO: 1507415 - protein, 24 aa, Mycobacterium tuberculosis
GVWRSLNWITVPKVKRFAAKDATL

SEQ ID NO: 1507416 - protein, 17 aa, Mycobacterium tuberculosis
GWGLWDQASAMTGGLAT

SEQ ID NO: 1507417 - protein, 19 aa, Mycobacterium tuberculosis
GWSGVRWRNLTGGIVALHA

SEQ ID NO: 1507418 - protein, 21 aa, Mycobacterium tuberculosis
GYIETWPVARLLRDAQVNTIW

SEQ ID NO: 1507419 - protein, 32 aa, Mycobacterium tuberculosis; identical to SEQ ID NO: 219007

SEQ ID NO: 1507420 - protein, 25 aa, Mycobacterium tuberculosis
HAAAAPFIAAVIPPGSDSVSVCNAV

SEQ ID NO: 1507421 - protein, 19 aa, Mycobacterium tuberculosis
HALDLLLGSWPGENRTLAC

SEQ ID NO: 1507422 - protein, 22 aa, Mycobacterium tuberculosis
HASHGYIRYHDVRVPADHVLGG

SEQ ID NO: 1507423 - protein, 18 aa, Mycobacterium tuberculosis
HDAPKGEFLLFDGRVHTY

SEQ ID NO: 1507424 - protein, 26 aa, Mycobacterium tuberculosis
HDLVSIVTSMLFSMHGELYKAIARQA

SEQ ID NO: 1507425 - protein, 32 aa, Mycobacterium tuberculosis; identical to SEQ ID NO: 219059

SEQ ID NO: 1507426 - protein, 20 aa, Mycobacterium tuberculosis
HEGVDWLLAQPDKPDLVFEA

SEQ ID NO: 1507427 - protein, 28 aa, Mycobacterium tuberculosis
HFESILIRGLMNYTFWMPNGSPEYRYCL

SEQ ID NO: 1507428 - protein, 22 aa, Mycobacterium tuberculosis
HGRIWHRLAHHLPEIPIAAPDL

SEQ ID NO: 1507429 - protein, 25 aa, Mycobacterium tuberculosis
HGTVMLRMPLHPVAIELLREVGPMA

SEQ ID NO: 1507430 - protein, 26 aa, Mycobacterium tuberculosis
HHELGWFARQALRLFDDLRLEHGRLD

SEQ ID NO: 1507431 - protein, 33 aa, Mycobacterium tuberculosis; identical to SEQ ID NO: 219128

SEQ ID NO: 1507432 - protein, 19 aa, Mycobacterium tuberculosis
HLAGRLAGLARDLTAPPVW

SEQ ID NO: 1507433 - protein, 18 aa, Mycobacterium tuberculosis
HLATLRLQPAYEQALETG

SEQ ID NO: 1507434 - protein, 25 aa, Mycobacterium tuberculosis
HLIHALRRNINVTILLFNNRIYGLT

SEQ ID NO: 1507435 - protein, 23 aa, Mycobacterium tuberculosis
HLPGGLPDLLMLAGGGLVGWMTY

SEQ ID NO: 1507436 - protein, 26 aa, Mycobacterium tuberculosis
HNAGFDIGFLRAAARRCDITWPQPQV

SEQ ID NO: 1507437 - protein, 24 aa, Mycobacterium tuberculosis
HNAVEYFVSYYDYYQPEAYIAQTD

SEQ ID NO: 1507438 - protein, 19 aa, Mycobacterium tuberculosis
HPAGAYWVPRRLGGGAPTL

SEQ ID NO: 1507439 - protein, 22 aa, Mycobacterium tuberculosis
HPARIRILELLVERDRSVGELL

SEQ ID NO: 1507440 - protein, 18 aa, Mycobacterium tuberculosis
HPGSFYALPQSPQLFKQL

SEQ ID NO: 1507441 - protein, 25 aa, Mycobacterium tuberculosis
HPLWIVRRTMVDLIRPIEFGDMLRC

SEQ ID NO: 1507442 - protein, 23 aa, Mycobacterium tuberculosis
HPQYPKVVLVTGACRFLGGYLTA

SEQ ID NO: 1507443 - protein, 21 aa, Mycobacterium tuberculosis
HQAKFHLDRLTAEGLLDTEYA

SEQ ID NO: 1507444 - protein, 27 aa, Mycobacterium tuberculosis
HRHIAYVPGDVTLWPSLTGGETIDLLA

SEQ ID NO: 1507445 - protein, 24 aa, Mycobacterium tuberculosis
HSDRLPYAWNPSYPARVGVMPREG

SEQ ID NO: 1507446 - protein, 26 aa, Mycobacterium tuberculosis
HTARAFGRALGCPQPLIAVASAATRW

SEQ ID NO: 1507447 - protein, 17 aa, Mycobacterium tuberculosis
HTPIGPLFESLITSELR

SEQ ID NO: 1507448 - protein, 29 aa, Mycobacterium tuberculosis
HTPPVLLRNIIENPAWYTAYTPYQPEISQ

SEQ ID NO: 1507449 - protein, 31 aa, Mycobacterium tuberculosis; identical to SEQ ID NO: 219226

SEQ ID NO: 1507450 - protein, 24 aa, Mycobacterium tuberculosis
HVGRRRAGRFLAEGPNLVAAALAR

SEQ ID NO: 1507451 - protein, 17 aa, Mycobacterium tuberculosis
HVGWLDDRKWAYVRLEG

SEQ ID NO: 1507452 - protein, 23 aa, Mycobacterium tuberculosis
HVRAWARLWERCAIDLTGNTEEL

SEQ ID NO: 1507453 - protein, 27 aa, Mycobacterium tuberculosis
HYLAVAIEYLYTHRPSWPAGIAVGKTV

SEQ ID NO: 1507454 - protein, 31 aa, Mycobacterium tuberculosis; identical to SEQ ID NO: 219246

SEQ ID NO: 1507455 - protein, 23 aa, Mycobacterium tuberculosis
IADAILDGVFPPGSTLPPERDLA

SEQ ID NO: 1507456 - protein, 23 aa, Mycobacterium tuberculosis
IAELEASLLLYFGGVSRLSSEVI

SEQ ID NO: 1507457 - protein, 24 aa, Mycobacterium tuberculosis
IAHGGLGWIYLALDRNVNGRPVVL

SEQ ID NO: 1507458 - protein, 25 aa, Mycobacterium tuberculosis
IARALPGMIVGEIALLRDSPRSATV

SEQ ID NO: 1507459 - protein, 17 aa, Mycobacterium tuberculosis
ICSHWYGLIPPIKEVRD

SEQ ID NO: 1507460 - protein, 24 aa, Mycobacterium tuberculosis
IDALRARFPTLGQPPSEDICYATT

SEQ ID NO: 1507461 - protein, 20 aa, Mycobacterium tuberculosis
IDDMAWMRQLLDWQREAADP

SEQ ID NO: 1507462 - protein, 20 aa, Mycobacterium tuberculosis
IDFHIRRIGVPAPGGRRELE

SEQ ID NO: 1507463 - protein, 19 aa, Mycobacterium tuberculosis
IDRMGRRPGVRWAADLLSA

SEQ ID NO: 1507464 - protein, 30 aa, Mycobacterium tuberculosis; identical to SEQ ID NO: 219316

SEQ ID NO: 1507465 - protein, 23 aa, Mycobacterium tuberculosis
IEAGRALVLAYNKWDLVDEDRRE

SEQ ID NO: 1507466 - protein, 22 aa, Mycobacterium tuberculosis
IEALWHGQRLRALAALPELIAA

SEQ ID NO: 1507467 - protein, 18 aa, Mycobacterium tuberculosis
IERVLRPAAQRLGRPLRI

SEQ ID NO: 1507468 - protein, 22 aa, Mycobacterium tuberculosis
IETAYCAPPPVRRDRVPINATV

SEQ ID NO: 1507469 - protein, 25 aa, Mycobacterium tuberculosis
IEVIPDVLRHRLVLTYDALADEISP

SEQ ID NO: 1507470 - protein, 22 aa, Mycobacterium tuberculosis
IFEGELFITGRIKELLVVDGAN

SEQ ID NO: 1507471 - protein, 17 aa, Mycobacterium tuberculosis
IFVKDKPAWLDRAWRRI

SEQ ID NO: 1507472 - protein, 20 aa, Mycobacterium tuberculosis
IFVPSVPNLLQLASALEVQR

SEQ ID NO: 1507473 - protein, 19 aa, Mycobacterium tuberculosis
IGEPASWLEMPIQAGVGIT

SEQ ID NO: 1507474 - protein, 26 aa, Mycobacterium tuberculosis
IGGQEILFPALLPRAPYETTNRWTQY

SEQ ID NO: 1507475 - protein, 17 aa, Mycobacterium tuberculosis
IGGSFWPRGIYSVVNHA

SEQ ID NO: 1507476 - protein, 18 aa, Mycobacterium tuberculosis
IGLWGYSGGGLASAWAAE

SEQ ID NO: 1507477 - protein, 23 aa, Mycobacterium tuberculosis
IGQLVAQRIAAFGAYVVAYDPYV

SEQ ID NO: 1507478 - protein, 23 aa, Mycobacterium tuberculosis
IGRRIVARLNWIKQGPAPAPVTE

SEQ ID NO: 1507479 - protein, 23 aa, Mycobacterium tuberculosis
IGSITIPIIDIPATSGFGNSTTS

SEQ ID NO: 1507480 - protein, 17 aa, Mycobacterium tuberculosis
IGVSLLVDRQSGRCIAT

SEQ ID NO: 1507481 - protein, 27 aa, Mycobacterium tuberculosis
IHERGLPMSFTFARFLKFIVTEIFPGG

SEQ ID NO: 1507482 - protein, 18 aa, Mycobacterium tuberculosis
IHLTATGLMLSGLDLRPA

SEQ ID NO: 1507483 - protein, 26 aa, Mycobacterium tuberculosis
IIGHTDAVLWDVDRPQPALLTPGMWV

SEQ ID NO: 1507484 - protein, 24 aa, Mycobacterium tuberculosis
IKDSLSPQLLFTDLGLKYVGPVDG

SEQ ID NO: 1507485 - protein, 21 aa, Mycobacterium tuberculosis
IKGMWTVPVFGNPSGVTYSWE

SEQ ID NO: 1507486 - protein, 21 aa, Mycobacterium tuberculosis
ILPPSIFHWLNYSVTAYQTGA

SEQ ID NO: 1507487 - protein, 19 aa, Mycobacterium tuberculosis
INAQRLPAVLDAGARRIVV

SEQ ID NO: 1507488 - protein, 20 aa, Mycobacterium tuberculosis
INATQLLKLLAKLAELVAAA

SEQ ID NO: 1507489 - protein, 18 aa, Mycobacterium tuberculosis
INEAFASVVLSWARVHEP

SEQ ID NO: 1507490 - protein, 18 aa, Mycobacterium tuberculosis
INVDFADVKGIMSGAGTA

SEQ ID NO: 1507491 - protein, 17 aa, Mycobacterium tuberculosis
IPARTTAGYLALLEAAF

SEQ ID NO: 1507492 - protein, 26 aa, Mycobacterium tuberculosis
IPPFPANLTTLFFGPTGIPLPPPSML

SEQ ID NO: 1507493 - protein, 18 aa, Mycobacterium tuberculosis
IQGGWLEFDAAIATPDQM

SEQ ID NO: 1507494 - protein, 27 aa, Mycobacterium tuberculosis
IRADFPILKRIMRGGNPLAYLDSGATS

SEQ ID NO: 1507495 - protein, 23 aa, Mycobacterium tuberculosis
IREAGLAGGWLRANLPAVDAVLC

SEQ ID NO: 1507496 - protein, 27 aa, Mycobacterium tuberculosis
IRVLAAALRLRRTHPESFLGGAYHPVF

SEQ ID NO: 1507497 - protein, 18 aa, Mycobacterium tuberculosis
ISPTTIYDKFPTLTPDQA

SEQ ID NO: 1507498 - protein, 29 aa, Mycobacterium tuberculosis
ISTDLLYKLLRSEWLEPRWMVGIDPESDG

SEQ ID NO: 1507499 - protein, 22 aa, Mycobacterium tuberculosis
ISVGYLRWDFFPKPGSAPDFLT

SEQ ID NO: 1507500 - protein, 18 aa, Mycobacterium tuberculosis
ITAPRGWELVRHAGPLPS

SEQ ID NO: 1507501 - protein, 20 aa, Mycobacterium tuberculosis
ITDITPYWRPASWAAGVAVV

SEQ ID NO: 1507502 - protein, 17 aa, Mycobacterium tuberculosis
ITGYRFDRTARDLHLLL

SEQ ID NO: 1507503 - protein, 19 aa, Mycobacterium tuberculosis
ITIAIERIAPLFNLINGDL

SEQ ID NO: 1507504 - protein, 29 aa, Mycobacterium tuberculosis
ITITGGGAIRIPLISIPAAPGFGNSTTNP

SEQ ID NO: 1507505 - protein, 26 aa, Mycobacterium tuberculosis
ITKHPIRVLTLAALAPRPGQRLWDVG

SEQ ID NO: 1507506 - protein, 19 aa, Mycobacterium tuberculosis
ITPFRPRALSARGVEATIA

SEQ ID NO: 1507507 - protein, 26 aa, Mycobacterium tuberculosis
ITPRTRLIWVETPTNPLLSIADITAI

SEQ ID NO: 1507508 - protein, 24 aa, Mycobacterium tuberculosis
ITRARVHLALSWALSRSPGGRQSR

SEQ ID NO: 1507509 - protein, 24 aa, Mycobacterium tuberculosis
ITWEHDMHLYFKRAHGSAQLLESP

SEQ ID NO: 1507510 - protein, 17 aa, Mycobacterium tuberculosis
IVAPYLLALATEEQKRR

SEQ ID NO: 1507511 - protein, 26 aa, Mycobacterium tuberculosis
IVELLRSRVFFDWFDAMGVDDIPAVF

SEQ ID NO: 1507512 - protein, 18 aa, Mycobacterium tuberculosis
IVEYIGQTRGWFYTLHVL

SEQ ID NO: 1507513 - protein, 33 aa, Mycobacterium tuberculosis; identical to SEQ ID NO: 219581

SEQ ID NO: 1507514 - protein, 25 aa, Mycobacterium tuberculosis
KAAAAGRPWWEWAATHERAFTAAYD

SEQ ID NO: 1507515 - protein, 19 aa, Mycobacterium tuberculosis
KAAEIAINSPLLEASMEGA

SEQ ID NO: 1507516 - protein, 20 aa, Mycobacterium tuberculosis
KAARFIRFSDAFDIPLVFVV

SEQ ID NO: 1507517 - protein, 25 aa, Mycobacterium tuberculosis
KAEAASVPSWPQILGRLTDNRDLAR

SEQ ID NO: 1507518 - protein, 17 aa, Mycobacterium tuberculosis
KAFYLDLQDERLTSALG

SEQ ID NO: 1507519 - protein, 25 aa, Mycobacterium tuberculosis
KAQHGVMELLLINHPLDCPMCDKGG

SEQ ID NO: 1507520 - protein, 26 aa, Mycobacterium tuberculosis
KAYAEGLRALYLYTATFQDAAVAEVV

SEQ ID NO: 1507521 - protein, 38 aa, Mycobacterium tuberculosis; identical to SEQ ID NO: 219629

SEQ ID NO: 1507522 - protein, 27 aa, Mycobacterium tuberculosis
KEFMVRNTYIYPPKPSMRIISDIFAYT

SEQ ID NO: 1507523 - protein, 29 aa, Mycobacterium tuberculosis
KELAAMGFKFQFITLAGFHALNYSMFDLA

SEQ ID NO: 1507524 - protein, 24 aa, Mycobacterium tuberculosis
KENNVAYIQWAIRLARRGAVIVVD

SEQ ID NO: 1507525 - protein, 17 aa, Mycobacterium tuberculosis
KEYVGVARALGLTKSDA

SEQ ID NO: 1507526 - protein, 30 aa, Mycobacterium tuberculosis; identical to SEQ ID NO: 219646

SEQ ID NO: 1507527 - protein, 24 aa, Mycobacterium tuberculosis
KGAPPAPLDARIGWRRATLAVCEA

SEQ ID NO: 1507528 - protein, 24 aa, Mycobacterium tuberculosis
KGEVKDVLLLDVTPLSLGIETKGG

SEQ ID NO: 1507529 - protein, 21 aa, Mycobacterium tuberculosis
KGMMLSGIPNMAYTVGYTNAS

SEQ ID NO: 1507530 - protein, 17 aa, Mycobacterium tuberculosis
KHRGLSFLLVPMDQPGV

SEQ ID NO: 1507531 - protein, 18 aa, Mycobacterium tuberculosis
KKKFLPAILAGEAHFAIG

SEQ ID NO: 1507532 - protein, 18 aa, Mycobacterium tuberculosis
KKQVRCVYVAIGQKGTTI

SEQ ID NO: 1507533 - protein, 19 aa, Mycobacterium tuberculosis
KLEVLPVTAFSLHDAADAF

SEQ ID NO: 1507534 - protein, 25 aa, Mycobacterium tuberculosis
KLGPDFLVELLEIRAALGPLIGRLA

SEQ ID NO: 1507535 - protein, 26 aa, Mycobacterium tuberculosis
KLNAQLIDELPLPRPRYEIFVYSPRV

SEQ ID NO: 1507536 - protein, 19 aa, Mycobacterium tuberculosis
KLRQAPILALGGRPEELRE

SEQ ID NO: 1507537 - protein, 21 aa, Mycobacterium tuberculosis
KLTPDRFIHELLVEHLHVVEV

SEQ ID NO: 1507538 - protein, 22 aa, Mycobacterium tuberculosis
KMVRKRMRALKYSKQMIDDISQ

SEQ ID NO: 1507539 - protein, 24 aa, Mycobacterium tuberculosis
KNNPGLVVLLTFGTGIGSAVIHNG

SEQ ID NO: 1507540 - protein, 18 aa, Mycobacterium tuberculosis
KPFALEELLARMRALLRR

SEQ ID NO: 1507541 - protein, 17 aa, Mycobacterium tuberculosis
KQLVAYVGLERFLAGLR

SEQ ID NO: 1507542 - protein, 23 aa, Mycobacterium tuberculosis
KRVPDFFRIPYDPHLATGLAVDF

SEQ ID NO: 1507543 - protein, 26 aa, Mycobacterium tuberculosis
KRVRRWMRRRYLLLEVPQLPGRGWVE

SEQ ID NO: 1507544 - protein, 21 aa, Mycobacterium tuberculosis
KSLPPKWFYDTVGSELFDQIT

SEQ ID NO: 1507545 - protein, 23 aa, Mycobacterium tuberculosis
KSTIAAALALTLAAGGRKVLLVE

SEQ ID NO: 1507546 - protein, 25 aa, Mycobacterium tuberculosis
KSVYLCCRAALRHMVLAGKGSIVNT

SEQ ID NO: 1507547 - protein, 21 aa, Mycobacterium tuberculosis
KTAAFAIPMLSKIDITSKVPQ

SEQ ID NO: 1507548 - protein, 18 aa, Mycobacterium tuberculosis
KTAGAVEFGIKRGRKTVS

SEQ ID NO: 1507549 - protein, 24 aa, Mycobacterium tuberculosis
KTLDLAYMESVIWAFKQLWDKGLA

SEQ ID NO: 1507550 - protein, 29 aa, Mycobacterium tuberculosis
KTRGFPLGPGYLLDGLPVILTAPRCAAAA

SEQ ID NO: 1507551 - protein, 24 aa, Mycobacterium tuberculosis
KTVPPRWLPGPRELRAWTLAAGSP

SEQ ID NO: 1507552 - protein, 39 aa, Mycobacterium tuberculosis; identical to SEQ ID NO: 219782

SEQ ID NO: 1507553 - protein, 26 aa, Mycobacterium tuberculosis
KVHLYGGYHVLRAAWPHFREQSYGRV

SEQ ID NO: 1507554 - protein, 22 aa, Mycobacterium tuberculosis
KVPHRFAVVDRLPRTPNGKLVR

SEQ ID NO: 1507555 - protein, 36 aa, Mycobacterium tuberculosis; identical to SEQ ID NO: 219801

SEQ ID NO: 1507556 - protein, 19 aa, Mycobacterium tuberculosis
KYRDTVRDYWRGEPATLGE

SEQ ID NO: 1507557 - protein, 24 aa, Mycobacterium tuberculosis
LAAAVAWDGLAAELGMAAASFSLL

SEQ ID NO: 1507558 - protein, 17 aa, Mycobacterium tuberculosis
LAALRRAVPATKGNTRR

SEQ ID NO: 1507559 - protein, 19 aa, Mycobacterium tuberculosis
LAAYRALGLHDWTYERIEC

SEQ ID NO: 1507560 - protein, 20 aa, Mycobacterium tuberculosis
LADLELGFAAARRFSADPQS

SEQ ID NO: 1507561 - protein, 21 aa, Mycobacterium tuberculosis
LAEARLFPLAQFMGDVYAGAL

SEQ ID NO: 1507562 - protein, 31 aa, Mycobacterium tuberculosis; identical to SEQ ID NO: 219846

SEQ ID NO: 1507563 - protein, 26 aa, Mycobacterium tuberculosis
LAEFKAMFQMKFYAVALFRSRGVPPT

SEQ ID NO: 1507564 - protein, 17 aa, Mycobacterium tuberculosis
LAEGLFQERLRASGADV

SEQ ID NO: 1507565 - protein, 18 aa, Mycobacterium tuberculosis
LAEMDFPTAPAVLDGVRA

SEQ ID NO: 1507566 - protein, 20 aa, Mycobacterium tuberculosis
LAGRVAILDLWPLSVAERSG

SEQ ID NO: 1507567 - protein, 27 aa, Mycobacterium tuberculosis
LAGSDPLLAVPFSYPASLPTPFGPVTM

SEQ ID NO: 1507568 - protein, 34 aa, Mycobacterium tuberculosis; identical to SEQ ID NO: 219875

SEQ ID NO: 1507569 - protein, 20 aa, Mycobacterium tuberculosis
LAIKAALTLGSPYTAMLFMG

SEQ ID NO: 1507570 - protein, 22 aa, Mycobacterium tuberculosis
LALCQATRQVIANGLAIIGVTA

SEQ ID NO: 1507571 - protein, 18 aa, Mycobacterium tuberculosis
LALDNWLSSPYSHWAFQH

SEQ ID NO: 1507572 - protein, 19 aa, Mycobacterium tuberculosis
LALSLGFRVRVAATVASPA

SEQ ID NO: 1507573 - protein, 21 aa, Mycobacterium tuberculosis
LALYHTKRLASPGQRIVLYAK

SEQ ID NO: 1507574 - protein, 17 aa, Mycobacterium tuberculosis
LAPECCAVVAYGALLGG

SEQ ID NO: 1507575 - protein, 28 aa, Mycobacterium tuberculosis
LASGLGAGFLGQGGLALAASSGGFGGQV

SEQ ID NO: 1507576 - protein, 17 aa, Mycobacterium tuberculosis
LASRLIDVTGWLATQPD

SEQ ID NO: 1507577 - protein, 21 aa, Mycobacterium tuberculosis
LATQRIQMPLPAAQARLLATI

SEQ ID NO: 1507578 - protein, 19 aa, Mycobacterium tuberculosis
LAVFITHYVGFPLGSRLNS

SEQ ID NO: 1507579 - protein, 32 aa, Mycobacterium tuberculosis; identical to SEQ ID NO: 219938

SEQ ID NO: 1507580 - protein, 18 aa, Mycobacterium tuberculosis
LDAGKPFGLRPSAILPAY

SEQ ID NO: 1507581 - protein, 18 aa, Mycobacterium tuberculosis
LDAKLARQAQLRTLTRKY

SEQ ID NO: 1507582 - protein, 26 aa, Mycobacterium tuberculosis
LDASTFLGRLALIRIYNGRIRKGQQV

SEQ ID NO: 1507583 - protein, 22 aa, Mycobacterium tuberculosis
LDDDGYLFLTGRRHHMIISGGV

SEQ ID NO: 1507584 - protein, 25 aa, Mycobacterium tuberculosis
LDDVARVYIIYRQRRAELRTAKALL

SEQ ID NO: 1507585 - protein, 24 aa, Mycobacterium tuberculosis
LDGRFRVPFVMRAEEKLLSYNRNQ

SEQ ID NO: 1507586 - protein, 21 aa, Mycobacterium tuberculosis
LDHGQPRINRYHHPEKILCEP

SEQ ID NO: 1507587 - protein, 25 aa, Mycobacterium tuberculosis
LDRLYVVALPMRVRFRGITTREVAL

SEQ ID NO: 1507588 - protein, 24 aa, Mycobacterium tuberculosis
LDTSAIEAVFYKGAYTGAYSGFEG

SEQ ID NO: 1507589 - protein, 18 aa, Mycobacterium tuberculosis
LDVFRPGDRRAARAALGL

SEQ ID NO: 1507590 - protein, 23 aa, Mycobacterium tuberculosis
LEEQLLSHPAIFSAAAVGLPDQY

SEQ ID NO: 1507591 - protein, 25 aa, Mycobacterium tuberculosis
LEFRPKVIIAGWSAYPRVLDFAAFR

SEQ ID NO: 1507592 - protein, 25 aa, Mycobacterium tuberculosis
LEFYDLSHPWGHGAPAWPYFEDVQI

SEQ ID NO: 1507593 - protein, 21 aa, Mycobacterium tuberculosis
LELSLMTERVLRRLPDLRLVA

SEQ ID NO: 1507594 - protein, 18 aa, Mycobacterium tuberculosis
LEPALAKQMLRHFGVLLD

SEQ ID NO: 1507595 - protein, 18 aa, Mycobacterium tuberculosis
LFEFAIRAAIAEMDLDSA

SEQ ID NO: 1507596 - protein, 20 aa, Mycobacterium tuberculosis
LGALPMLHAAFERAGRDPAT

SEQ ID NO: 1507597 - protein, 23 aa, Mycobacterium tuberculosis
LGCELRHAHRLVYSEGLDLSGDP

SEQ ID NO: 1507598 - protein, 24 aa, Mycobacterium tuberculosis
LGFDVDTPWRKLPAKARKAILEGA

SEQ ID NO: 1507599 - protein, 22 aa, Mycobacterium tuberculosis
LGIEFPIFAFTHCRDVVVAVSK

SEQ ID NO: 1507600 - protein, 33 aa, Mycobacterium tuberculosis; identical to SEQ ID NO: 225284

SEQ ID NO: 1507601 - protein, 29 aa, Mycobacterium tuberculosis
LGLPEEIVARQPFPGPGLGIRIVGEVTAK

SEQ ID NO: 1507602 - protein, 24 aa, Mycobacterium tuberculosis
LGNSGLLNFGALQSGLANLGNTIS

SEQ ID NO: 1507603 - protein, 28 aa, Mycobacterium tuberculosis
LGQEGMGFIYLMQNLPQERISIAIMAAA

SEQ ID NO: 1507604 - protein, 27 aa, Mycobacterium tuberculosis
LGRDGVPTFLLPANPVSALVVFEVMVR

SEQ ID NO: 1507605 - protein, 25 aa, Mycobacterium tuberculosis
LGRLTTMRKAVLAVGSVCWLVGCSS

SEQ ID NO: 1507606 - protein, 27 aa, Mycobacterium tuberculosis
LGSKMNRFFLRGALVARLLSQSAWKQY

SEQ ID NO: 1507607 - protein, 35 aa, Mycobacterium tuberculosis; identical to SEQ ID NO: 220129

SEQ ID NO: 1507608 - protein, 20 aa, Mycobacterium tuberculosis
LGTRGIWHEGWFANTIHAAT

SEQ ID NO: 1507609 - protein, 21 aa, Mycobacterium tuberculosis
LGVPEVIWMRQPAEYHDAARR

SEQ ID NO: 1507610 - protein, 20 aa, Mycobacterium tuberculosis
LGYDTPTGLTCPYTTPLDVT

SEQ ID NO: 1507611 - protein, 25 aa, Mycobacterium tuberculosis
LHAGRYAYHPLAVSASPIKAPITPF

SEQ ID NO: 1507612 - protein, 31 aa, Mycobacterium tuberculosis; identical to SEQ ID NO: 220141

SEQ ID NO: 1507613 - protein, 37 aa, Mycobacterium tuberculosis; identical to SEQ ID NO: 220144

SEQ ID NO: 1507614 - protein, 19 aa, Mycobacterium tuberculosis
LHLVDFPVTLGIRPNIPQE

SEQ ID NO: 1507615 - protein, 23 aa, Mycobacterium tuberculosis
LHNSQPWRWIAEDHTVALFLDKD

SEQ ID NO: 1507616 - protein, 22 aa, Mycobacterium tuberculosis
LHQKWFNLYDEATRVPFVIARI

SEQ ID NO: 1507617 - protein, 19 aa, Mycobacterium tuberculosis
LHRLPLAIMRLRMLRRRSV

SEQ ID NO: 1507618 - protein, 20 aa, Mycobacterium tuberculosis
LHTYGASVLSRPVAKIMSTT

SEQ ID NO: 1507619 - protein, 18 aa, Mycobacterium tuberculosis
LIAMPAMVPPYANARDDY

SEQ ID NO: 1507620 - protein, 18 aa, Mycobacterium tuberculosis
LIDFRDITVRPVAFDPDA

SEQ ID NO: 1507621 - protein, 20 aa, Mycobacterium tuberculosis
LIDFVLSNLVNARYLRICVL

SEQ ID NO: 1507622 - protein, 23 aa, Mycobacterium tuberculosis
LIDGMDLVVLGLGGRRVTRARAR

SEQ ID NO: 1507623 - protein, 18 aa, Mycobacterium tuberculosis
LIERPRGMSYLVVRGRRG

SEQ ID NO: 1507624 - protein, 26 aa, Mycobacterium tuberculosis
LIGPEWFPDSYPWVPSINPGLNFYFG

SEQ ID NO: 1507625 - protein, 18 aa, Mycobacterium tuberculosis
LIIDLSRFAVNPRVHLFF

SEQ ID NO: 1507626 - protein, 19 aa, Mycobacterium tuberculosis
LIQQTLPYVQWLTTTAEHA

SEQ ID NO: 1507627 - protein, 19 aa, Mycobacterium tuberculosis
LIQVMLAWQDNPVGQLNLG

SEQ ID NO: 1507628 - protein, 17 aa, Mycobacterium tuberculosis
LKAEFFKTLAHPARIRI

SEQ ID NO: 1507629 - protein, 19 aa, Mycobacterium tuberculosis
LKCAKGFRYYAENAEALLA

SEQ ID NO: 1507630 - protein, 23 aa, Mycobacterium tuberculosis
LKGHPLFAHITLLRSERSPIAAL

SEQ ID NO: 1507631 - protein, 18 aa, Mycobacterium tuberculosis
LKGTWNGTRLAAAIMRER

SEQ ID NO: 1507632 - protein, 18 aa, Mycobacterium tuberculosis
LKLLAKLAELVAAAIADI

SEQ ID NO: 1507633 - protein, 41 aa, Mycobacterium tuberculosis; identical to SEQ ID NO: 220208

SEQ ID NO: 1507634 - protein, 27 aa, Mycobacterium tuberculosis
LLAELDRVWGHLPFGAQWYSANELARH

SEQ ID NO: 1507635 - protein, 19 aa, Mycobacterium tuberculosis
LLAGHYRADRFWSQQVLDE

SEQ ID NO: 1507636 - protein, 27 aa, Mycobacterium tuberculosis
LLDLGLRNYWGYNTFGFFAPHHQYAST

SEQ ID NO: 1507637 - protein, 18 aa, Mycobacterium tuberculosis
LLFSVFEGGLRHGLFHGD

SEQ ID NO: 1507638 - protein, 17 aa, Mycobacterium tuberculosis
LLGFIKFGDRKWHEAEL

SEQ ID NO: 1507639 - protein, 17 aa, Mycobacterium tuberculosis
LLPQHRALRHQIPQVYQ

SEQ ID NO: 1507640 - protein, 28 aa, Mycobacterium tuberculosis
LLPVYDKPMIYYPLTTLMMAGIRDIQLI

SEQ ID NO: 1507641 - protein, 21 aa, Mycobacterium tuberculosis
LLRKELAWLRRGAPARTCKPK

SEQ ID NO: 1507642 - protein, 31 aa, Mycobacterium tuberculosis; identical to SEQ ID NO: 220263

SEQ ID NO: 1507643 - protein, 17 aa, Mycobacterium tuberculosis
LMRHTGPAMSAFNAWVL

SEQ ID NO: 1507644 - protein, 18 aa, Mycobacterium tuberculosis
LNLEYKLEVWDSPNSAGV

SEQ ID NO: 1507645 - protein, 19 aa, Mycobacterium tuberculosis
LNRVPVGVFDIGLNKAMIA

SEQ ID NO: 1507646 - protein, 18 aa, Mycobacterium tuberculosis
LPAAWAYKRFRDLDDKES

SEQ ID NO: 1507647 - protein, 19 aa, Mycobacterium tuberculosis
LPAGLALAASFNPVLARSS

SEQ ID NO: 1507648 - protein, 20 aa, Mycobacterium tuberculosis
LPAQRRALTVHSARWRPWRS

SEQ ID NO: 1507649 - protein, 19 aa, Mycobacterium tuberculosis
LPAVGINWGPWADVGRAQF

SEQ ID NO: 1507650 - protein, 32 aa, Mycobacterium tuberculosis; identical to SEQ ID NO: 220300

SEQ ID NO: 1507651 - protein, 28 aa, Mycobacterium tuberculosis
LPPPRPAVPPLMRGYLRLGARACGEPAH

SEQ ID NO: 1507652 - protein, 20 aa, Mycobacterium tuberculosis
LPQSALPNTYPYLPSANPGL

SEQ ID NO: 1507653 - protein, 25 aa, Mycobacterium tuberculosis
LPSTALMDVLLRRPPRTRSGAALPR

SEQ ID NO: 1507654 - protein, 25 aa, Mycobacterium tuberculosis
LPTLADAVLPLRWTDGGMSRVRVLR

SEQ ID NO: 1507655 - protein, 31 aa, Mycobacterium tuberculosis; identical to SEQ ID NO: 220316

SEQ ID NO: 1507656 - protein, 18 aa, Mycobacterium tuberculosis
LPVTFDPMQVVPASVPRW

SEQ ID NO: 1507657 - protein, 24 aa, Mycobacterium tuberculosis
LQHISSGVFLLKASVRELRECVGS

SEQ ID NO: 1507658 - protein, 18 aa, Mycobacterium tuberculosis
LQIDYPPLADFRKRVRMA

SEQ ID NO: 1507659 - protein, 50 aa, Mycobacterium tuberculosis; identical to SEQ ID NO: 220333

SEQ ID NO: 1507660 - protein, 18 aa, Mycobacterium tuberculosis
LQNKTRALQVLAARLQAM

SEQ ID NO: 1507661 - protein, 21 aa, Mycobacterium tuberculosis
LQPIWFGRAHLREGLSWFNSI

SEQ ID NO: 1507662 - protein, 26 aa, Mycobacterium tuberculosis
LQPQQWGGLQCDPALFFEATRRLASV

SEQ ID NO: 1507663 - protein, 23 aa, Mycobacterium tuberculosis
LQSLPAHLRPGLDELSFTLTGNP

SEQ ID NO: 1507664 - protein, 17 aa, Mycobacterium tuberculosis
LQVAMPILPQQALLYRL

SEQ ID NO: 1507665 - protein, 18 aa, Mycobacterium tuberculosis
LQVLAARLQAMAEEQALA

SEQ ID NO: 1507666 - protein, 18 aa, Mycobacterium tuberculosis
LRAIVESPLPVVGAINGH

SEQ ID NO: 1507667 - protein, 25 aa, Mycobacterium tuberculosis
LRAQGRHCVAVKWGLWQAPKAGEPA

SEQ ID NO: 1507668 - protein, 31 aa, Mycobacterium tuberculosis; identical to SEQ ID NO: 220354

SEQ ID NO: 1507669 - protein, 26 aa, Mycobacterium tuberculosis
LRDWRQWWDWVPGACWRHPFGRDSDI

SEQ ID NO: 1507670 - protein, 22 aa, Mycobacterium tuberculosis
LRDYLLTLRRKSAHGGPFEYRS

SEQ ID NO: 1507671 - protein, 18 aa, Mycobacterium tuberculosis
LRIVAAMRREGMGFTAGF

SEQ ID NO: 1507672 - protein, 26 aa, Mycobacterium tuberculosis
LRMPKVARSLLDYRYRRLPAARRAAH

SEQ ID NO: 1507673 - protein, 32 aa, Mycobacterium tuberculosis; identical to SEQ ID NO: 220379

SEQ ID NO: 1507674 - protein, 17 aa, Mycobacterium tuberculosis
LRPAPLRNPRFVVDVNL

SEQ ID NO: 1507675 - protein, 19 aa, Mycobacterium tuberculosis
LRRRWSPDGKPIVGFVGRL

SEQ ID NO: 1507676 - protein, 18 aa, Mycobacterium tuberculosis
LRVFGKVVELAFLAVPDE

SEQ ID NO: 1507677 - protein, 23 aa, Mycobacterium tuberculosis
LSALAARFYGDASLYPLIAAVNG

SEQ ID NO: 1507678 - protein, 24 aa, Mycobacterium tuberculosis
LSALALRFYGDAELNWLIAAASGI

SEQ ID NO: 1507679 - protein, 30 aa, Mycobacterium tuberculosis; identical to SEQ ID NO: 220416

SEQ ID NO: 1507680 - protein, 19 aa, Mycobacterium tuberculosis
LSELDTLREAATTARATLC

SEQ ID NO: 1507681 - protein, 25 aa, Mycobacterium tuberculosis
LSLPQPRQMAYRRLDLWLDDYLGTH

SEQ ID NO: 1507682 - protein, 25 aa, Mycobacterium tuberculosis
LSRGMLEVLPLTHIRGRSLHDSFVI

SEQ ID NO: 1507683 - protein, 20 aa, Mycobacterium tuberculosis
LSRYLAGPLVPTIFGRDARL

SEQ ID NO: 1507684 - protein, 25 aa, Mycobacterium tuberculosis
LSWVDFRALALPSEPAEYLLSKAKV

SEQ ID NO: 1507685 - protein, 18 aa, Mycobacterium tuberculosis
LTAAMRLPTGLGALSRRY

SEQ ID NO: 1507686 - protein, 31 aa, Mycobacterium tuberculosis; identical to SEQ ID NO: 220474

SEQ ID NO: 1507687 - protein, 19 aa, Mycobacterium tuberculosis
LTFIHWPVLPESVAGSYPP

SEQ ID NO: 1507688 - protein, 19 aa, Mycobacterium tuberculosis
LTHHPLIQVMLAWQDNPVG

SEQ ID NO: 1507689 - protein, 24 aa, Mycobacterium tuberculosis
LTPQALIDLVASRSYCITSPAQVR

SEQ ID NO: 1507690 - protein, 18 aa, Mycobacterium tuberculosis
LTTIFRTPVRLRAAGRTD

SEQ ID NO: 1507691 - protein, 21 aa, Mycobacterium tuberculosis
LTVTPPSWRPDLRQPADLVEE

SEQ ID NO: 1507692 - protein, 26 aa, Mycobacterium tuberculosis
LTVVNPLVDATWRFMTLDTDGKIRMD

SEQ ID NO: 1507693 - protein, 19 aa, Mycobacterium tuberculosis
LVAQAWHWVDPARAIPEVA

SEQ ID NO: 1507694 - protein, 21 aa, Mycobacterium tuberculosis
LVAYVGLERFLAGLRDYFRTH

SEQ ID NO: 1507695 - protein, 18 aa, Mycobacterium tuberculosis
LVEMYREAKTRLGDPVLA

SEQ ID NO: 1507696 - protein, 23 aa, Mycobacterium tuberculosis
LVFVADGILGGAISFGGHVWDHA

SEQ ID NO: 1507697 - protein, 19 aa, Mycobacterium tuberculosis
LVPDDFVGAVLGDLSSRRG

SEQ ID NO: 1507698 - protein, 17 aa, Mycobacterium tuberculosis
LVQLLLACLARGVMAFL

SEQ ID NO: 1507699 - protein, 18 aa, Mycobacterium tuberculosis
LVRQLLTQQYHLLASVEQ

SEQ ID NO: 1507700 - protein, 19 aa, Mycobacterium tuberculosis
LVRTDELLDLWAAAYPGGL

SEQ ID NO: 1507701 - protein, 27 aa, Mycobacterium tuberculosis
LVRWQHPTRGLLAPGCFIPVAESINLA

SEQ ID NO: 1507702 - protein, 28 aa, Mycobacterium tuberculosis
LVSQIVPLLGPMIQDMLFMQLRHMMETE

SEQ ID NO: 1507703 - protein, 27 aa, Mycobacterium tuberculosis
LVVSHVTPIKMLLRLALDAGSGVLYRL

SEQ ID NO: 1507704 - protein, 17 aa, Mycobacterium tuberculosis
LVYKGMLTTPQLKAFYL

SEQ ID NO: 1507705 - protein, 25 aa, Mycobacterium tuberculosis
LWGDRYGVVADPFGHHWSLGQPVRE

SEQ ID NO: 1507706 - protein, 28 aa, Mycobacterium tuberculosis
LYDSSYHAELFWWTGAFETSEGIPHSSL

SEQ ID NO: 1507707 - protein, 25 aa, Mycobacterium tuberculosis
LYLRFRATGPDDFHLAYAAALASTG

SEQ ID NO: 1507708 - protein, 18 aa, Mycobacterium tuberculosis
LYVDTPAPGLPADLLIHN

SEQ ID NO: 1507709 - protein, 18 aa, Mycobacterium tuberculosis
LYYEAYPAMVHRTLMDII

SEQ ID NO: 1507710 - protein, 17 aa, Mycobacterium tuberculosis
MACLVGDELLQIRGGRG

SEQ ID NO: 1507711 - protein, 26 aa, Mycobacterium tuberculosis
MADLFHARVALWFIREVFEVMRATPQ

SEQ ID NO: 1507712 - protein, 26 aa, Mycobacterium tuberculosis
MADLQARVDLLRYALHGIAEQGRLEL

SEQ ID NO: 1507713 - protein, 30 aa, Mycobacterium tuberculosis; identical to SEQ ID NO: 220617

SEQ ID NO: 1507714 - protein, 24 aa, Mycobacterium tuberculosis
MALSPLQQGLFSRATLVAAESGSE

SEQ ID NO: 1507715 - protein, 23 aa, Mycobacterium tuberculosis
MANTWQGRFPYRNDGALGWVGTS

SEQ ID NO: 1507716 - protein, 24 aa, Mycobacterium tuberculosis
MAPRQWRGLRRWLGEPEDFQDPKY

SEQ ID NO: 1507717 - protein, 27 aa, Mycobacterium tuberculosis
MASNAHHYLALFDGAKPLALYHTKRLA

SEQ ID NO: 1507718 - protein, 21 aa, Mycobacterium tuberculosis
MDDWLDASRALLTRIGDHAFG

SEQ ID NO: 1507719 - protein, 19 aa, Mycobacterium tuberculosis
MDYLKEGIGLRAMAQRDPL

SEQ ID NO: 1507720 - protein, 21 aa, Mycobacterium tuberculosis
MFSLHVKATMMKVSHPIVFGH

SEQ ID NO: 1507721 - protein, 20 aa, Mycobacterium tuberculosis
MGNTVIWKPSITQTLAAYLT

SEQ ID NO: 1507722 - protein, 24 aa, Mycobacterium tuberculosis
MGSEGYLLNQFLAPRTNKRTDSWG

SEQ ID NO: 1507723 - protein, 20 aa, Mycobacterium tuberculosis
MISTLFLTLADYPDQLTLLA

SEQ ID NO: 1507724 - protein, 23 aa, Mycobacterium tuberculosis
MLARFPDLTLPTLDLTFYGATPS

SEQ ID NO: 1507725 - protein, 17 aa, Mycobacterium tuberculosis
MLKPCTLELGGKSAAII

SEQ ID NO: 1507726 - protein, 29 aa, Mycobacterium tuberculosis
MLPADRVLAALHGWLAPLPPEGASAIVFR

SEQ ID NO: 1507727 - protein, 25 aa, Mycobacterium tuberculosis
MLQAFIGRMSGVPPSVWGGLAAARF

SEQ ID NO: 1507728 - protein, 17 aa, Mycobacterium tuberculosis
MPAVITAADRRLRQLRA

SEQ ID NO: 1507729 - protein, 21 aa, Mycobacterium tuberculosis
MPDGRNYLWVARTVELRAARY

SEQ ID NO: 1507730 - protein, 25 aa, Mycobacterium tuberculosis
MPGFTTISMYPRMWAASGVDYPTLL

SEQ ID NO: 1507731 - protein, 23 aa, Mycobacterium tuberculosis
MPYAQVHYPFENLDWFQGHYPGD

SEQ ID NO: 1507732 - protein, 25 aa, Mycobacterium tuberculosis
MQAGGLTVYSGEWWHFDGPGAGVDR

SEQ ID NO: 1507733 - protein, 22 aa, Mycobacterium tuberculosis
MRNDMLRVYPSLDPNLVHVIRN

SEQ ID NO: 1507734 - protein, 26 aa, Mycobacterium tuberculosis
MSATFKLPLGEVPGQVFIGLRTTDVL

SEQ ID NO: 1507735 - protein, 25 aa, Mycobacterium tuberculosis
MSRGAIFHHFRDKDALFFALAREDT

SEQ ID NO: 1507736 - protein, 20 aa, Mycobacterium tuberculosis
MSRRQFGQTLFEHQALRLRM

SEQ ID NO: 1507737 - protein, 25 aa, Mycobacterium tuberculosis
MTAAPNFAYALLAKRLRRQAKPGDF

SEQ ID NO: 1507738 - protein, 23 aa, Mycobacterium tuberculosis
MTDFTFYIPLAKAAEAAGYSSMT

SEQ ID NO: 1507739 - protein, 18 aa, Mycobacterium tuberculosis
MTLRWLTDRFAGKPLTDH

SEQ ID NO: 1507740 - protein, 19 aa, Mycobacterium tuberculosis
MVAACLKWEGGYVWACKNY

SEQ ID NO: 1507741 - protein, 21 aa, Mycobacterium tuberculosis
MVAAITVGLSRGWSLIKSVRL

SEQ ID NO: 1507742 - protein, 29 aa, Mycobacterium tuberculosis
MVDHGLPLTLWLARFLKFIATEIFPGGQP

SEQ ID NO: 1507743 - protein, 17 aa, Mycobacterium tuberculosis
MYAGPGSGPMLAAAAAW

SEQ ID NO: 1507744 - protein, 24 aa, Mycobacterium tuberculosis
NAAGPYASWLTAAGAQAELAARQA

SEQ ID NO: 1507745 - protein, 19 aa, Mycobacterium tuberculosis
NAGGPRKVSPLAVQMIMPN

SEQ ID NO: 1507746 - protein, 21 aa, Mycobacterium tuberculosis
NAPEIRYMLDRRRALGGFVPE

SEQ ID NO: 1507747 - protein, 26 aa, Mycobacterium tuberculosis
NAPTIDAVLPMFFEFAGDSVLVAHNA

SEQ ID NO: 1507748 - protein, 24 aa, Mycobacterium tuberculosis
NDAARPWLTRLCDERTVVAVLQNG

SEQ ID NO: 1507749 - protein, 24 aa, Mycobacterium tuberculosis
NDAEKRWVLKNPSHLFALDALMAT

SEQ ID NO: 1507750 - protein, 23 aa, Mycobacterium tuberculosis
NDSRGFFTSRVIGTFVNEALAML

SEQ ID NO: 1507751 - protein, 24 aa, Mycobacterium tuberculosis
NDYDLSSLFLLASTAALFSPSIKE

SEQ ID NO: 1507752 - protein, 24 aa, Mycobacterium tuberculosis
NEGVKGAWVLARYDDGRPSQVRLD

SEQ ID NO: 1507753 - protein, 27 aa, Mycobacterium tuberculosis
NENDPRLWYYRFQTSAIGWNPGVNVLL

SEQ ID NO: 1507754 - protein, 19 aa, Mycobacterium tuberculosis
NFVAPLLYITDRNNVIVVA

SEQ ID NO: 1507755 - protein, 20 aa, Mycobacterium tuberculosis
NGETWPLQDTVRPWDSLSDE

SEQ ID NO: 1507756 - protein, 26 aa, Mycobacterium tuberculosis
NGLKELWDKLTGWVTGLFSRGWSNLE

SEQ ID NO: 1507757 - protein, 20 aa, Mycobacterium tuberculosis
NKFGRMIFIGSVSGSWGIGN

SEQ ID NO: 1507758 - protein, 27 aa, Mycobacterium tuberculosis
NKGGEVRYFIDRLAGWYVITSSDRMSR

SEQ ID NO: 1507759 - protein, 25 aa, Mycobacterium tuberculosis
NKLLGSFELTGIPPAPRGIPQIEVT

SEQ ID NO: 1507760 - protein, 26 aa, Mycobacterium tuberculosis
NLPDMFTRLMLSLAATGIAPGSFYEL

SEQ ID NO: 1507761 - protein, 24 aa, Mycobacterium tuberculosis
NLQGFRSMLWPRVYADLRTAGVRG

SEQ ID NO: 1507762 - protein, 18 aa, Mycobacterium tuberculosis
NMGVVPPGPGFNAALRAI

SEQ ID NO: 1507763 - protein, 35 aa, Mycobacterium tuberculosis; identical to SEQ ID NO: 220925

SEQ ID NO: 1507764 - protein, 31 aa, Mycobacterium tuberculosis; identical to SEQ ID NO: 220926

SEQ ID NO: 1507765 - protein, 21 aa, Mycobacterium tuberculosis
NPNLRLLGALPTLYDSRTTHT

SEQ ID NO: 1507766 - protein, 21 aa, Mycobacterium tuberculosis
NPVCAAAALAVLRVLASDGLV

SEQ ID NO: 1507767 - protein, 22 aa, Mycobacterium tuberculosis
NQRQKFNPLVRLDSINGGSVED

SEQ ID NO: 1507768 - protein, 27 aa, Mycobacterium tuberculosis
NRGAKPSIGVLLLRDIRRVFSDRDRMR

SEQ ID NO: 1507769 - protein, 19 aa, Mycobacterium tuberculosis
NRIEIVIAMLGIVKAGAIL

SEQ ID NO: 1507770 - protein, 19 aa, Mycobacterium tuberculosis
NRMVSWPYTKLMNSNNMVD

SEQ ID NO: 1507771 - protein, 23 aa, Mycobacterium tuberculosis
NRPRIFDRRIVLPEMLYERVVEV

SEQ ID NO: 1507772 - protein, 20 aa, Mycobacterium tuberculosis
NRVKVDGLWLAGSHGFELVA

SEQ ID NO: 1507773 - protein, 17 aa, Mycobacterium tuberculosis
NRVRAMFPHAIGLSAGM

SEQ ID NO: 1507774 - protein, 22 aa, Mycobacterium tuberculosis
NSARLRLLRDRLVEGVLAEIDD

SEQ ID NO: 1507775 - protein, 18 aa, Mycobacterium tuberculosis
NVMTFRYVIKEVALEEGA

SEQ ID NO: 1507776 - protein, 21 aa, Mycobacterium tuberculosis
NVNVPLMIIAVGTPAQVAVAA

SEQ ID NO: 1507777 - protein, 26 aa, Mycobacterium tuberculosis
NYGAAKLGLVGLINTLALEGAKYNIH

SEQ ID NO: 1507778 - protein, 17 aa, Mycobacterium tuberculosis
NYHLRRITPAQTGPFFL

SEQ ID NO: 1507779 - protein, 25 aa, Mycobacterium tuberculosis
NYIPWRGYFDLIAFVDEFIIYDDMQ

SEQ ID NO: 1507780 - protein, 24 aa, Mycobacterium tuberculosis
PADAKPFDFVFHGGSGSLKSEIEE

SEQ ID NO: 1507781 - protein, 18 aa, Mycobacterium tuberculosis
PAGALYAFPRLDPEVYDI

SEQ ID NO: 1507782 - protein, 20 aa, Mycobacterium tuberculosis
PAGLFLARYPDQYGKRLKRA

SEQ ID NO: 1507783 - protein, 17 aa, Mycobacterium tuberculosis
PAILAGEAHFAIGYTEP

SEQ ID NO: 1507784 - protein, 25 aa, Mycobacterium tuberculosis
PALASLRRLIESPSHDVIAVLTRPD

SEQ ID NO: 1507785 - protein, 25 aa, Mycobacterium tuberculosis
PAMSAFNAWVLLKGLETLAIRVQHS

SEQ ID NO: 1507786 - protein, 25 aa, Mycobacterium tuberculosis
PAPDHLRLVTLPWSRDLAAAIERLG

SEQ ID NO: 1507787 - protein, 24 aa, Mycobacterium tuberculosis
PAQLLDVWRRKDMPTKPAPVLIFV

SEQ ID NO: 1507788 - protein, 18 aa, Mycobacterium tuberculosis
PAREALAWGLISAVYPDS

SEQ ID NO: 1507789 - protein, 18 aa, Mycobacterium tuberculosis
PAVISVNEKINEPRFPSF

SEQ ID NO: 1507790 - protein, 29 aa, Mycobacterium tuberculosis
PAVVQANRVRTWLLAVSNVFGQNAPAIAA

SEQ ID NO: 1507791 - protein, 24 aa, Mycobacterium tuberculosis
PCAELSMLLLDTAAMADLHMRWMD

SEQ ID NO: 1507792 - protein, 26 aa, Mycobacterium tuberculosis
PDALQVYSQLKRLLTGRRPAVFLDFD

SEQ ID NO: 1507793 - protein, 26 aa, Mycobacterium tuberculosis
PDDGDIGLIIAVKRLAAAKTRLAPVF

SEQ ID NO: 1507794 - protein, 18 aa, Mycobacterium tuberculosis
PDFVSSQWQWQTGMWVGG

SEQ ID NO: 1507795 - protein, 28 aa, Mycobacterium tuberculosis
PDGISRLRFRLRWRGFRLIVDANHTDVT

SEQ ID NO: 1507796 - protein, 18 aa, Mycobacterium tuberculosis
PDGVWSRMKFEGGVHRVQ

SEQ ID NO: 1507797 - protein, 18 aa, Mycobacterium tuberculosis
PDLVLRWAALLHDIGKPA

SEQ ID NO: 1507798 - protein, 27 aa, Mycobacterium tuberculosis
PDQDVFASRLPRYFPTALRERFTPEIR

SEQ ID NO: 1507799 - protein, 17 aa, Mycobacterium tuberculosis
PDQLRIRELLSRIGERV

SEQ ID NO: 1507800 - protein, 21 aa, Mycobacterium tuberculosis
PDRVLAYGDCAIIPNPTVEQL

SEQ ID NO: 1507801 - protein, 28 aa, Mycobacterium tuberculosis
PEELVPVAMPNWHYLHIHNDVIPALKQH

SEQ ID NO: 1507802 - protein, 25 aa, Mycobacterium tuberculosis
PEFVENFFMFIAEEVREYLAQLGFR

SEQ ID NO: 1507803 - protein, 25 aa, Mycobacterium tuberculosis
PEINSGRMFFGAGSGPMLAAAAAWD

SEQ ID NO: 1507804 - protein, 18 aa, Mycobacterium tuberculosis
PEINSTRIYLGPGSGPIL

SEQ ID NO: 1507805 - protein, 17 aa, Mycobacterium tuberculosis
PELPDLAEVWFGTGRNA

SEQ ID NO: 1507806 - protein, 25 aa, Mycobacterium tuberculosis
PERSASWVVPLLWRRWSPGYHAEED

SEQ ID NO: 1507807 - protein, 23 aa, Mycobacterium tuberculosis
PETRERLRRHLEACPGCLRHYGL

SEQ ID NO: 1507808 - protein, 21 aa, Mycobacterium tuberculosis
PETYQQAFYARDLAGTVVLVG

SEQ ID NO: 1507809 - protein, 24 aa, Mycobacterium tuberculosis
PEYKQVALFSATMPPAIRKLSAKY

SEQ ID NO: 1507810 - protein, 18 aa, Mycobacterium tuberculosis
PFAFEGVFGHLAATAVPG

SEQ ID NO: 1507811 - protein, 19 aa, Mycobacterium tuberculosis
PFLSIERAVYRLTGELAEW

SEQ ID NO: 1507812 - protein, 38 aa, Mycobacterium tuberculosis; identical to SEQ ID NO: 221190

SEQ ID NO: 1507813 - protein, 23 aa, Mycobacterium tuberculosis
PGDYFGEIGVLFHLPRSATVRAR

SEQ ID NO: 1507814 - protein, 25 aa, Mycobacterium tuberculosis
PGEPSWPTPWGRGRPGWHLECSAMA

SEQ ID NO: 1507815 - protein, 24 aa, Mycobacterium tuberculosis
PGGLPLSGLLRGVGDEPELTDFDE

SEQ ID NO: 1507816 - protein, 22 aa, Mycobacterium tuberculosis
PGGTEVTLRFPDGEVVTMHVIS

SEQ ID NO: 1507817 - protein, 25 aa, Mycobacterium tuberculosis
PGLGADLLAVVARLNRLATQRIQMP

SEQ ID NO: 1507818 - protein, 20 aa, Mycobacterium tuberculosis
PGLRAIFAELLGIAVPNLIA

SEQ ID NO: 1507819 - protein, 26 aa, Mycobacterium tuberculosis
PGPFDAYLTMRGLKTLVLRMQRHSEN

SEQ ID NO: 1507820 - protein, 20 aa, Mycobacterium tuberculosis
PGYSWTPIILADGAHHTNAT

SEQ ID NO: 1507821 - protein, 24 aa, Mycobacterium tuberculosis
PHGDKLFQLVRRVPVTTIIVDTPQ

SEQ ID NO: 1507822 - protein, 28 aa, Mycobacterium tuberculosis
PHPATVALFRLPRALKYKAKPGRSVDLL

SEQ ID NO: 1507823 - protein, 18 aa, Mycobacterium tuberculosis
PIAAIERFCQITDPAAAL

SEQ ID NO: 1507824 - protein, 19 aa, Mycobacterium tuberculosis
PIAPHSGLGYAQNFLHMCF

SEQ ID NO: 1507825 - protein, 20 aa, Mycobacterium tuberculosis
PIGKRNGWLSGLHATELLGA

SEQ ID NO: 1507826 - protein, 20 aa, Mycobacterium tuberculosis
PIHRALVHRLMQSETARGAT

SEQ ID NO: 1507827 - protein, 19 aa, Mycobacterium tuberculosis
PITTPPWDTKAPKDNVIGW

SEQ ID NO: 1507828 - protein, 24 aa, Mycobacterium tuberculosis
PIVPGAVIFDLPVGGWNCRPTADF

SEQ ID NO: 1507829 - protein, 18 aa, Mycobacterium tuberculosis
PIVWQRHTLDFWDHVVDS

SEQ ID NO: 1507830 - protein, 24 aa, Mycobacterium tuberculosis
PKDDPLGPIIKLFDDAGYIGVVAT

SEQ ID NO: 1507831 - protein, 17 aa, Mycobacterium tuberculosis
PKGQWYLRQMLGSANFN

SEQ ID NO: 1507832 - protein, 23 aa, Mycobacterium tuberculosis
PKRGPDLPATLRDYLLTLRRKSA

SEQ ID NO: 1507833 - protein, 23 aa, Mycobacterium tuberculosis
PLASALMRVGIAPTLIGTRGTRP

SEQ ID NO: 1507834 - protein, 25 aa, Mycobacterium tuberculosis
PLATMAGYHLGWWNADRSTAAGSSG

SEQ ID NO: 1507835 - protein, 26 aa, Mycobacterium tuberculosis
PLAVDPAHPFPFVSGLSLNLAVTVRQ

SEQ ID NO: 1507836 - protein, 23 aa, Mycobacterium tuberculosis
PLDARVLLRRLVVADPTAYGYLV

SEQ ID NO: 1507837 - protein, 17 aa, Mycobacterium tuberculosis
PLHPMRVYAELAALLER

SEQ ID NO: 1507838 - protein, 19 aa, Mycobacterium tuberculosis
PLKIALSTHFPYTGFRAKL

SEQ ID NO: 1507839 - protein, 20 aa, Mycobacterium tuberculosis
PLQWDCFLFGIIQSDDHFTF

SEQ ID NO: 1507840 - protein, 21 aa, Mycobacterium tuberculosis
PLTGSLLIGGAGRVVEPLRAA

SEQ ID NO: 1507841 - protein, 17 aa, Mycobacterium tuberculosis
PLVAVAAILAPLMQDAE

SEQ ID NO: 1507842 - protein, 23 aa, Mycobacterium tuberculosis
PLVGRLLMYEALDATYHQIRIAK

SEQ ID NO: 1507843 - protein, 17 aa, Mycobacterium tuberculosis
PMVGAELPGDPLALIAP

SEQ ID NO: 1507844 - protein, 23 aa, Mycobacterium tuberculosis
PNGPAQQALLAKALTSSKLTAAD

SEQ ID NO: 1507845 - protein, 22 aa, Mycobacterium tuberculosis
PNVLLILLDDVGFGASSAFGGP

SEQ ID NO: 1507846 - protein, 31 aa, Mycobacterium tuberculosis; identical to SEQ ID NO: 226688

SEQ ID NO: 1507847 - protein, 18 aa, Mycobacterium tuberculosis
PPALRRLVLEGQAAVQRS

SEQ ID NO: 1507848 - protein, 39 aa, Mycobacterium tuberculosis; identical to SEQ ID NO: 221365

SEQ ID NO: 1507849 - protein, 22 aa, Mycobacterium tuberculosis
PPTLEELFLRHYSLGPEVAAEQ

SEQ ID NO: 1507850 - protein, 25 aa, Mycobacterium tuberculosis
PQATQAIPAYEPEPGKPAPAAVSAG

SEQ ID NO: 1507851 - protein, 23 aa, Mycobacterium tuberculosis
PQDRLDFILADCDAKLVLRTPVR

SEQ ID NO: 1507852 - protein, 21 aa, Mycobacterium tuberculosis
PQELHELLTLPFRSASEFIDA

SEQ ID NO: 1507853 - protein, 19 aa, Mycobacterium tuberculosis
PQILGRLTDNRDLARGQAA

SEQ ID NO: 1507854 - protein, 23 aa, Mycobacterium tuberculosis
PRRMRKMFLSLIQRQLPEGYDVR

SEQ ID NO: 1507855 - protein, 22 aa, Mycobacterium tuberculosis
PRSDILAFALPGFATGEHTKNN

SEQ ID NO: 1507856 - protein, 19 aa, Mycobacterium tuberculosis
PRTMKEGWIVYARSTTIQA

SEQ ID NO: 1507857 - protein, 19 aa, Mycobacterium tuberculosis
PRVEVEVGFILAADLPGAG

SEQ ID NO: 1507858 - protein, 27 aa, Mycobacterium tuberculosis
PSASFGTLWIKSPANMLGYWNNPERTA

SEQ ID NO: 1507859 - protein, 32 aa, Mycobacterium tuberculosis; identical to SEQ ID NO: 221440

SEQ ID NO: 1507860 - protein, 33 aa, Mycobacterium tuberculosis; identical to SEQ ID NO: 221442

SEQ ID NO: 1507861 - protein, 17 aa, Mycobacterium tuberculosis
PTARFLEKEQRIIAALR

SEQ ID NO: 1507862 - protein, 20 aa, Mycobacterium tuberculosis
PTGIPLPPPSMLTPPIRCRS

SEQ ID NO: 1507863 - protein, 25 aa, Mycobacterium tuberculosis
PTGQRGFFCWFRVGSDVLVDNAFRV

SEQ ID NO: 1507864 - protein, 22 aa, Mycobacterium tuberculosis
PTIPPVLVRPEVMVGTGFLGAH

SEQ ID NO: 1507865 - protein, 32 aa, Mycobacterium tuberculosis; identical to SEQ ID NO: 221462

SEQ ID NO: 1507866 - protein, 19 aa, Mycobacterium tuberculosis
PTLYIFPHAGGTAKDYVAF

SEQ ID NO: 1507867 - protein, 25 aa, Mycobacterium tuberculosis
PTMYVNQPWTIRQYAGFSTAADSNA

SEQ ID NO: 1507868 - protein, 20 aa, Mycobacterium tuberculosis
PTQYDTLRRALYTTLRDYLG

SEQ ID NO: 1507869 - protein, 22 aa, Mycobacterium tuberculosis
PTYLYRYDYAPRTLRWSGFGAT

SEQ ID NO: 1507870 - protein, 17 aa, Mycobacterium tuberculosis
PVANWPALGGMGNASWT

SEQ ID NO: 1507871 - protein, 24 aa, Mycobacterium tuberculosis
PVAVLRELVLLYDAGRREPLPLPL

SEQ ID NO: 1507872 - protein, 20 aa, Mycobacterium tuberculosis
PVEGGLLISFDRMNKVLEVD

SEQ ID NO: 1507873 - protein, 33 aa, Mycobacterium tuberculosis; identical to SEQ ID NO: 221497

SEQ ID NO: 1507874 - protein, 19 aa, Mycobacterium tuberculosis
PVLEPLVAVHREIYPKADL

SEQ ID NO: 1507875 - protein, 17 aa, Mycobacterium tuberculosis
PVLGVSVITAVLRGFGE

SEQ ID NO: 1507876 - protein, 35 aa, Mycobacterium tuberculosis; identical to SEQ ID NO: 221515

SEQ ID NO: 1507877 - protein, 27 aa, Mycobacterium tuberculosis
PVSGAALFVLDSWLRPVPAGVAGELYI

SEQ ID NO: 1507878 - protein, 20 aa, Mycobacterium tuberculosis
PVVEQALVKVPYMPTDLPAW

SEQ ID NO: 1507879 - protein, 17 aa, Mycobacterium tuberculosis
PWDTLADAKALAGAHPD

SEQ ID NO: 1507880 - protein, 28 aa, Mycobacterium tuberculosis
PWGGSYYVEWLTHRLARRARAHIAEVAE

SEQ ID NO: 1507881 - protein, 18 aa, Mycobacterium tuberculosis
PWHERAKRLAPKGTGAVL

SEQ ID NO: 1507882 - protein, 34 aa, Mycobacterium tuberculosis; identical to SEQ ID NO: 221533

SEQ ID NO: 1507883 - protein, 17 aa, Mycobacterium tuberculosis
PYRPPDAARRHNGGKPR

SEQ ID NO: 1507884 - protein, 24 aa, Mycobacterium tuberculosis
QADYRAVLAAVNPPGANQREIATT

SEQ ID NO: 1507885 - protein, 34 aa, Mycobacterium tuberculosis; identical to SEQ ID NO: 221554

SEQ ID NO: 1507886 - protein, 22 aa, Mycobacterium tuberculosis
QAGLIAVPLPVPQFGIHDERIS

SEQ ID NO: 1507887 - protein, 24 aa, Mycobacterium tuberculosis
QAGLRTDYLFRIANQRGGIVLGTG

SEQ ID NO: 1507888 - protein, 24 aa, Mycobacterium tuberculosis
QAKALARHFGARRKAYNWTVATLK

SEQ ID NO: 1507889 - protein, 32 aa, Mycobacterium tuberculosis; identical to SEQ ID NO: 221564

SEQ ID NO: 1507890 - protein, 17 aa, Mycobacterium tuberculosis
QALLFGNGGLGGAGGAG

SEQ ID NO: 1507891 - protein, 21 aa, Mycobacterium tuberculosis
QALLGDARWLASIATPGRDEV

SEQ ID NO: 1507892 - protein, 19 aa, Mycobacterium tuberculosis
QALTFHAAAYRQLRYFWSR

SEQ ID NO: 1507893 - protein, 23 aa, Mycobacterium tuberculosis
QANHLIAGLIAAGAIDVGIACGI

SEQ ID NO: 1507894 - protein, 22 aa, Mycobacterium tuberculosis
QANSWQSLAGIGPKTAKVIAQA

SEQ ID NO: 1507895 - protein, 27 aa, Mycobacterium tuberculosis
QAREKLFPLICRYAVAYHVVFIPSAEV

SEQ ID NO: 1507896 - protein, 37 aa, Mycobacterium tuberculosis; identical to SEQ ID NO: 221582

SEQ ID NO: 1507897 - protein, 20 aa, Mycobacterium tuberculosis
QATFPVDRMLARLSSTVAVV

SEQ ID NO: 1507898 - protein, 24 aa, Mycobacterium tuberculosis
QCAAGSLFVFDSTLWHAAGRNTSG

SEQ ID NO: 1507899 - protein, 18 aa, Mycobacterium tuberculosis
QDYQLQLVPKMLRMLRPD

SEQ ID NO: 1507900 - protein, 26 aa, Mycobacterium tuberculosis
QEDIYNPLRFLRAAMKWCRKAQELGT

SEQ ID NO: 1507901 - protein, 34 aa, Mycobacterium tuberculosis; identical to SEQ ID NO: 221620

SEQ ID NO: 1507902 - protein, 24 aa, Mycobacterium tuberculosis
QERARIMFMIGTLTPDRVTRDADA

SEQ ID NO: 1507903 - protein, 27 aa, Mycobacterium tuberculosis
QGALFDTPILVPPQAAMLGTGAIVKRP

SEQ ID NO: 1507904 - protein, 21 aa, Mycobacterium tuberculosis
QGDPRRFFQMVYNERWARATE

SEQ ID NO: 1507905 - protein, 20 aa, Mycobacterium tuberculosis
QGGLLPIAYTQGIDFRPAKR

SEQ ID NO: 1507906 - protein, 21 aa, Mycobacterium tuberculosis
QGITDLITTPGLINVDFADVK

SEQ ID NO: 1507907 - protein, 27 aa, Mycobacterium tuberculosis
QGLEYIIAFMGVLQAGLIAVPLPVPQF

SEQ ID NO: 1507908 - protein, 33 aa, Mycobacterium tuberculosis; identical to SEQ ID NO: 221659

SEQ ID NO: 1507909 - protein, 19 aa, Mycobacterium tuberculosis
QHTVVVLNAIQKTRSLVDC

SEQ ID NO: 1507910 - protein, 27 aa, Mycobacterium tuberculosis
QICASFDIPWLVIRALSDLAGADSGVD

SEQ ID NO: 1507911 - protein, 20 aa, Mycobacterium tuberculosis
QILRALRINLTVRGYQVITA

SEQ ID NO: 1507912 - protein, 20 aa, Mycobacterium tuberculosis
QIWMRPHAVPGLRRLTEAIH

SEQ ID NO: 1507913 - protein, 18 aa, Mycobacterium tuberculosis
QLAWSLRNDPRVVVLERT

SEQ ID NO: 1507914 - protein, 20 aa, Mycobacterium tuberculosis
QLRPPRTPLLSNLTGSWMSD

SEQ ID NO: 1507915 - protein, 18 aa, Mycobacterium tuberculosis
QMFGIDYPIVSAPMDLIA

SEQ ID NO: 1507916 - protein, 19 aa, Mycobacterium tuberculosis
QMRTAAPDFRLFWDNAYAV

SEQ ID NO: 1507917 - protein, 34 aa, Mycobacterium tuberculosis; identical to SEQ ID NO: 221757

SEQ ID NO: 1507918 - protein, 18 aa, Mycobacterium tuberculosis
QPLLNGVNIIFDGFLRGR

SEQ ID NO: 1507919 - protein, 23 aa, Mycobacterium tuberculosis
QQTRQVRFKIWDAGYQASVTALR

SEQ ID NO: 1507920 - protein, 25 aa, Mycobacterium tuberculosis
QQVRAGLKAIYLSGWQVAGDANLSG

SEQ ID NO: 1507921 - protein, 18 aa, Mycobacterium tuberculosis
QRTGLPHVTWKYATSIDG

SEQ ID NO: 1507922 - protein, 29 aa, Mycobacterium tuberculosis
QRVSARVYPALVPLSHPLAAVNGAFNAVV

SEQ ID NO: 1507923 - protein, 23 aa, Mycobacterium tuberculosis
QRVVDWLVDKFKGTSGIDLTKDK

SEQ ID NO: 1507924 - protein, 27 aa, Mycobacterium tuberculosis
QSAPGRWTLIRWGPAGSLVLRITLCRV

SEQ ID NO: 1507925 - protein, 28 aa, Mycobacterium tuberculosis
QSDSRTKLLRLFPTIFKGAHVELDEVST

SEQ ID NO: 1507926 - protein, 17 aa, Mycobacterium tuberculosis
QSEHLRRWFDDKVLRIF

SEQ ID NO: 1507927 - protein, 25 aa, Mycobacterium tuberculosis
QSGLSWLIILRKRENFRRAFSGFDI

SEQ ID NO: 1507928 - protein, 24 aa, Mycobacterium tuberculosis
QSNNISRVAWLTAGLPEHVGATTV

SEQ ID NO: 1507929 - protein, 18 aa, Mycobacterium tuberculosis
QTGAPLPTLADAVLPLRW

SEQ ID NO: 1507930 - protein, 26 aa, Mycobacterium tuberculosis
QTTSRQAYALLLLGSLTVADALPLLG

SEQ ID NO: 1507931 - protein, 23 aa, Mycobacterium tuberculosis
QVAVAISALQWRGSQTSDPVETP

SEQ ID NO: 1507932 - protein, 24 aa, Mycobacterium tuberculosis
QVTGWAAYAAGAIWALRGAGHPVP

SEQ ID NO: 1507933 - protein, 35 aa, Mycobacterium tuberculosis; identical to SEQ ID NO: 221879

SEQ ID NO: 1507934 - protein, 18 aa, Mycobacterium tuberculosis
QWRLSPKAMRRLGETALR

SEQ ID NO: 1507935 - protein, 21 aa, Mycobacterium tuberculosis
QWWQQQVVLGLQRSGFPRLAI

SEQ ID NO: 1507936 - protein, 21 aa, Mycobacterium tuberculosis
RAAKPGAYLRVIAPGTVRAGD

SEQ ID NO: 1507937 - protein, 33 aa, Mycobacterium tuberculosis; identical to SEQ ID NO: 221905

SEQ ID NO: 1507938 - protein, 28 aa, Mycobacterium tuberculosis
RAERARAIGLFRYQLIWEAADAAHSTKQ

SEQ ID NO: 1507939 - protein, 24 aa, Mycobacterium tuberculosis
RAHDLVDLQLLEGLLLDADLMPTR

SEQ ID NO: 1507940 - protein, 24 aa, Mycobacterium tuberculosis
RAIDPGFFSARKLPDGLSFDPANC

SEQ ID NO: 1507941 - protein, 17 aa, Mycobacterium tuberculosis
RAKWLVAADGLHSAVRR

SEQ ID NO: 1507942 - protein, 17 aa, Mycobacterium tuberculosis
RALPSTFATWRERRKLI

SEQ ID NO: 1507943 - protein, 23 aa, Mycobacterium tuberculosis
RARFGDVLPFLVKVLAADEPLSL

SEQ ID NO: 1507944 - protein, 24 aa, Mycobacterium tuberculosis
RARQKGCTLLVTDGDWQGVSTRLA

SEQ ID NO: 1507945 - protein, 28 aa, Mycobacterium tuberculosis
RASFELTQKALMAGIPVLAAVSAPSSLA

SEQ ID NO: 1507946 - protein, 18 aa, Mycobacterium tuberculosis
RASTGSIFAIPVVVAPDV

SEQ ID NO: 1507947 - protein, 20 aa, Mycobacterium tuberculosis
RAVGLAQRWGSRNPIPWSGL

SEQ ID NO: 1507948 - protein, 27 aa, Mycobacterium tuberculosis
RCGGKRLDRPGWFYPPTVITDISKDMA

SEQ ID NO: 1507949 - protein, 17 aa, Mycobacterium tuberculosis
RDATRVFRLSRIGAQVT

SEQ ID NO: 1507950 - protein, 18 aa, Mycobacterium tuberculosis
RDCFARIAPGLPSSVIRI

SEQ ID NO: 1507951 - protein, 18 aa, Mycobacterium tuberculosis
RDFTLWKGEKPGEPSWPT

SEQ ID NO: 1507952 - protein, 32 aa, Mycobacterium tuberculosis; identical to SEQ ID NO: 222031

SEQ ID NO: 1507953 - protein, 25 aa, Mycobacterium tuberculosis
RDICRRYEVLLIFDEIATGFGRTGA

SEQ ID NO: 1507954 - protein, 26 aa, Mycobacterium tuberculosis
RDLHRGLLNRLSAFKVPHRFAVVDRL

SEQ ID NO: 1507955 - protein, 17 aa, Mycobacterium tuberculosis
RDLWWHHVVGSASPAHT

SEQ ID NO: 1507956 - protein, 51 aa, Mycobacterium tuberculosis; identical to SEQ ID NO: 222043

SEQ ID NO: 1507957 - protein, 27 aa, Mycobacterium tuberculosis
RDQLQRLWTPYRMNYLAEAPVKRDPNS

SEQ ID NO: 1507958 - protein, 20 aa, Mycobacterium tuberculosis
RDRLVVIIAGYRADLDKFLD

SEQ ID NO: 1507959 - protein, 18 aa, Mycobacterium tuberculosis
RDTAFFWDGVKAHELRIQ

SEQ ID NO: 1507960 - protein, 24 aa, Mycobacterium tuberculosis
REAIRRRVARLRAQRAHVLTARRR

SEQ ID NO: 1507961 - protein, 19 aa, Mycobacterium tuberculosis
REALFDAFRRGEVATLVVS

SEQ ID NO: 1507962 - protein, 21 aa, Mycobacterium tuberculosis
REGYFQIAYLGPKGTDAQLRE

SEQ ID NO: 1507963 - protein, 18 aa, Mycobacterium tuberculosis
RELTADWDYSVVGGLTLG

SEQ ID NO: 1507964 - protein, 17 aa, Mycobacterium tuberculosis
RFEHPAMLSADRAFAAV

SEQ ID NO: 1507965 - protein, 17 aa, Mycobacterium tuberculosis
RFGALIPRLVRQGINGE

SEQ ID NO: 1507966 - protein, 26 aa, Mycobacterium tuberculosis
RFGDYQVIVIANPLVIPGRPVARVDT

SEQ ID NO: 1507967 - protein, 25 aa, Mycobacterium tuberculosis
RFLERRLRETFGFDGSPIRVNVRVR

SEQ ID NO: 1507968 - protein, 29 aa, Mycobacterium tuberculosis
RFSTNTFPSWPLAHPFRRIAHNGEINTVT

SEQ ID NO: 1507969 - protein, 18 aa, Mycobacterium tuberculosis
RFTSMYRRIVGSAGPITD

SEQ ID NO: 1507970 - protein, 27 aa, Mycobacterium tuberculosis
RGARRVVVASFLLAEGLFQERLRASGA

SEQ ID NO: 1507971 - protein, 18 aa, Mycobacterium tuberculosis
RGASALSLSLLSISRSGN

SEQ ID NO: 1507972 - protein, 18 aa, Mycobacterium tuberculosis
RGDLAQFAEAALAGGVDI

SEQ ID NO: 1507973 - protein, 18 aa, Mycobacterium tuberculosis
RGEFEERLKAVLDDIKNS

SEQ ID NO: 1507974 - protein, 19 aa, Mycobacterium tuberculosis
RGERIWVAGYAVRDPSPRA

SEQ ID NO: 1507975 - protein, 18 aa, Mycobacterium tuberculosis
RGFHRDRDLAAEWTRLAA

SEQ ID NO: 1507976 - protein, 19 aa, Mycobacterium tuberculosis
RGIDWRAIYAGRGREYMPF

SEQ ID NO: 1507977 - protein, 26 aa, Mycobacterium tuberculosis
RGIESDALRLVYLPEVDLRTGDIVGT

SEQ ID NO: 1507978 - protein, 27 aa, Mycobacterium tuberculosis
RGITVANMPNLFFLLGPNTGLGHNSVV

SEQ ID NO: 1507979 - protein, 26 aa, Mycobacterium tuberculosis
RGLIFVIQVYRHMLSPLRPASCRFVP

SEQ ID NO: 1507980 - protein, 30 aa, Mycobacterium tuberculosis; identical to SEQ ID NO: 222159

SEQ ID NO: 1507981 - protein, 20 aa, Mycobacterium tuberculosis
RGNWPPGFPKSERPSYSLAE

SEQ ID NO: 1507982 - protein, 32 aa, Mycobacterium tuberculosis; identical to SEQ ID NO: 222162

SEQ ID NO: 1507983 - protein, 18 aa, Mycobacterium tuberculosis
RGPETTAVVLVDLLVGEM

SEQ ID NO: 1507984 - protein, 18 aa, Mycobacterium tuberculosis
RGRRKTRIGYVVSDKMQK

SEQ ID NO: 1507985 - protein, 33 aa, Mycobacterium tuberculosis; identical to SEQ ID NO: 222180

SEQ ID NO: 1507986 - protein, 18 aa, Mycobacterium tuberculosis
RHERLWEVLGAHPRSFTT

SEQ ID NO: 1507987 - protein, 17 aa, Mycobacterium tuberculosis
RHHDELMRLGATAPGAT

SEQ ID NO: 1507988 - protein, 18 aa, Mycobacterium tuberculosis
RHPDLRWVDLGRRRSHRA

SEQ ID NO: 1507989 - protein, 18 aa, Mycobacterium tuberculosis
RHTRIRRLVSSGLTPRMI

SEQ ID NO: 1507990 - protein, 17 aa, Mycobacterium tuberculosis
RHVGVQLLRLHDAIYRG

SEQ ID NO: 1507991 - protein, 18 aa, Mycobacterium tuberculosis
RICMDQFMVDLGPGPLDV

SEQ ID NO: 1507992 - protein, 19 aa, Mycobacterium tuberculosis
RIDVLINNAGVMWTPKQVT

SEQ ID NO: 1507993 - protein, 18 aa, Mycobacterium tuberculosis
RILLTRDRGLLKRRAITH

SEQ ID NO: 1507994 - protein, 17 aa, Mycobacterium tuberculosis
RIPMLAGRRSLNLSNAA

SEQ ID NO: 1507995 - protein, 22 aa, Mycobacterium tuberculosis
RIQEEMFYQLEAPVLRACGFDT

SEQ ID NO: 1507996 - protein, 17 aa, Mycobacterium tuberculosis
RIQPWMQAIADATGRPV

SEQ ID NO: 1507997 - protein, 32 aa, Mycobacterium tuberculosis; identical to SEQ ID NO: 222242

SEQ ID NO: 1507998 - protein, 18 aa, Mycobacterium tuberculosis
RITQDLLDRTRKPFQSVI

SEQ ID NO: 1507999 - protein, 31 aa, Mycobacterium tuberculosis; identical to SEQ ID NO: 222251

SEQ ID NO: 1508000 - protein, 24 aa, Mycobacterium tuberculosis
RKEIRDIVAYLRVLDNPGDAVSLR

SEQ ID NO: 1508001 - protein, 25 aa, Mycobacterium tuberculosis
RKHKGACIFLNRPGFAGGAGCALHS

SEQ ID NO: 1508002 - protein, 25 aa, Mycobacterium tuberculosis
RKLPKRRPVPLRLRDWREVYEEFDN

SEQ ID NO: 1508003 - protein, 23 aa, Mycobacterium tuberculosis
RKPAPHEFIPFSGGLHRCIGAVM

SEQ ID NO: 1508004 - protein, 17 aa, Mycobacterium tuberculosis
RKRRRGRIGTKRSSISD

SEQ ID NO: 1508005 - protein, 26 aa, Mycobacterium tuberculosis
RLAERPANLAFFLRALTDRRRARGCA

SEQ ID NO: 1508006 - protein, 21 aa, Mycobacterium tuberculosis
RLCPAPCEPACVLGINQDPVT

SEQ ID NO: 1508007 - protein, 18 aa, Mycobacterium tuberculosis
RLDRQIVRASAQWCPRPW

SEQ ID NO: 1508008 - protein, 22 aa, Mycobacterium tuberculosis
RLFPTLNYAVSVAEACERADAV

SEQ ID NO: 1508009 - protein, 17 aa, Mycobacterium tuberculosis
RLGIALPAAVAADLLAP

SEQ ID NO: 1508010 - protein, 18 aa, Mycobacterium tuberculosis
RLHMLRHQQILAPKFALV

SEQ ID NO: 1508011 - protein, 29 aa, Mycobacterium tuberculosis
RLNIPDPDPLRLIYFADADPVFALCEHAK

SEQ ID NO: 1508012 - protein, 18 aa, Mycobacterium tuberculosis
RLPFHKPVDDMTGLSQAI

SEQ ID NO: 1508013 - protein, 20 aa, Mycobacterium tuberculosis
RLQYFVSCLVYMPRDRYTTA

SEQ ID NO: 1508014 - protein, 21 aa, Mycobacterium tuberculosis
RLTALLSGVYLNLAPVILDAG

SEQ ID NO: 1508015 - protein, 19 aa, Mycobacterium tuberculosis
RLTGRSPILLAGMTPTTVD

SEQ ID NO: 1508016 - protein, 32 aa, Mycobacterium tuberculosis; identical to SEQ ID NO: 222368

SEQ ID NO: 1508017 - protein, 18 aa, Mycobacterium tuberculosis
RLVELLKQPQSQPMPVEE

SEQ ID NO: 1508018 - protein, 27 aa, Mycobacterium tuberculosis
RMASHANHYLALFDGAKPLALYHTKRL

SEQ ID NO: 1508019 - protein, 32 aa, Mycobacterium tuberculosis; identical to SEQ ID NO: 222397

SEQ ID NO: 1508020 - protein, 19 aa, Mycobacterium tuberculosis
RNHQLPPVGDVTSPVKQRL

SEQ ID NO: 1508021 - protein, 20 aa, Mycobacterium tuberculosis
RNTDQLLFDGLPWVSRAQDE

SEQ ID NO: 1508022 - protein, 28 aa, Mycobacterium tuberculosis
RNWETFHIAQLLPWIEANFRTYAEYDGR

SEQ ID NO: 1508023 - protein, 17 aa, Mycobacterium tuberculosis
RPFLVAANAWKNLSNEL

SEQ ID NO: 1508024 - protein, 26 aa, Mycobacterium tuberculosis
RPGPKGFIGQPIPIAGLYLGSAGCHG

SEQ ID NO: 1508025 - protein, 36 aa, Mycobacterium tuberculosis; identical to SEQ ID NO: 222451

SEQ ID NO: 1508026 - protein, 24 aa, Mycobacterium tuberculosis
RPPADPVIFLKPNTAIIGPNTPIR

SEQ ID NO: 1508027 - protein, 20 aa, Mycobacterium tuberculosis
RPQVLDLLHHTPDYGPPGGP

SEQ ID NO: 1508028 - protein, 21 aa, Mycobacterium tuberculosis
RPRPTRELSWVRGAPADAGSF

SEQ ID NO: 1508029 - protein, 17 aa, Mycobacterium tuberculosis
RPSAWIAEGLLVYLSAE

SEQ ID NO: 1508030 - protein, 17 aa, Mycobacterium tuberculosis
RPSHEKLAWARRVLAAS

SEQ ID NO: 1508031 - protein, 29 aa, Mycobacterium tuberculosis
RQAGTLGYFPLWGYATPPAIELAERLARY

SEQ ID NO: 1508032 - protein, 17 aa, Mycobacterium tuberculosis
RQAQLRTLTRKYAADID

SEQ ID NO: 1508033 - protein, 26 aa, Mycobacterium tuberculosis
RQGIAQLFDVPPLPYQELKIATAERG

SEQ ID NO: 1508034 - protein, 18 aa, Mycobacterium tuberculosis
RQQRVPLGVVGMIYEGRP

SEQ ID NO: 1508035 - protein, 17 aa, Mycobacterium tuberculosis
RQYFGSKVLRTVIPRSV

SEQ ID NO: 1508036 - protein, 23 aa, Mycobacterium tuberculosis
RQYNPGWNLSIDLRNMLLVSECV

SEQ ID NO: 1508037 - protein, 23 aa, Mycobacterium tuberculosis
RRAEVTSLLRFAGGLHIVGGRVV

SEQ ID NO: 1508038 - protein, 25 aa, Mycobacterium tuberculosis
RRALGIQRLLAARSQRGRKIPDLLI

SEQ ID NO: 1508039 - protein, 23 aa, Mycobacterium tuberculosis
RRASWVYYAVVPEALTVLSNLLS

SEQ ID NO: 1508040 - protein, 23 aa, Mycobacterium tuberculosis
RRCGWSLGISAETLRRWAGQAEV

SEQ ID NO: 1508041 - protein, 20 aa, Mycobacterium tuberculosis
RRDIAPRRILPDSAIIDAAI

SEQ ID NO: 1508042 - protein, 23 aa, Mycobacterium tuberculosis
RREKNAYYFQDGNALVGMVVSGG

SEQ ID NO: 1508043 - protein, 25 aa, Mycobacterium tuberculosis
RRGQPRLRPPFPAVAGLYGCPTVIN

SEQ ID NO: 1508044 - protein, 18 aa, Mycobacterium tuberculosis
RRITPIDVPLIVRGRVTN

SEQ ID NO: 1508045 - protein, 25 aa, Mycobacterium tuberculosis
RRLVTRARDMLWVNRFRWNRCTTGD

SEQ ID NO: 1508046 - protein, 22 aa, Mycobacterium tuberculosis
RRSAAVWWAALAAARESPDPPE

SEQ ID NO: 1508047 - protein, 22 aa, Mycobacterium tuberculosis
RRSRVVGIFPNPAAVIRLVGAV

SEQ ID NO: 1508048 - protein, 22 aa, Mycobacterium tuberculosis
RRTEEVQTVLRWASANQVPVVT

SEQ ID NO: 1508049 - protein, 26 aa, Mycobacterium tuberculosis
RRTGIEMAWSEGRDLWWHHVVGSASP

SEQ ID NO: 1508050 - protein, 18 aa, Mycobacterium tuberculosis
RRVFAPKVTGSWRLHVAT

SEQ ID NO: 1508051 - protein, 31 aa, Mycobacterium tuberculosis; identical to SEQ ID NO: 222561

SEQ ID NO: 1508052 - protein, 37 aa, Mycobacterium tuberculosis; identical to SEQ ID NO: 222566

SEQ ID NO: 1508053 - protein, 27 aa, Mycobacterium tuberculosis
RSGQPVPRLVWFYFDGTDLTVYSMPQA

SEQ ID NO: 1508054 - protein, 17 aa, Mycobacterium tuberculosis
RSLAADGIINAGALIAF

SEQ ID NO: 1508055 - protein, 17 aa, Mycobacterium tuberculosis
RSPAPLWGDTSFHSVAP

SEQ ID NO: 1508056 - protein, 23 aa, Mycobacterium tuberculosis
RSQRLSVFELQARAILGLAVDTL

SEQ ID NO: 1508057 - protein, 20 aa, Mycobacterium tuberculosis
RSSRVLLAGHLDTVPVAGNL

SEQ ID NO: 1508058 - protein, 23 aa, Mycobacterium tuberculosis
RTAGYLAIGLAIGAGAPVCVAMT

SEQ ID NO: 1508059 - protein, 24 aa, Mycobacterium tuberculosis
RTARQRLAAFVSPIPVRLADGTQL

SEQ ID NO: 1508060 - protein, 21 aa, Mycobacterium tuberculosis
RTHARSWHRYPEPSPGAIAMV

SEQ ID NO: 1508061 - protein, 26 aa, Mycobacterium tuberculosis
RTHRPKMIIAGWSAYPRQLDFARFRA

SEQ ID NO: 1508062 - protein, 26 aa, Mycobacterium tuberculosis
RTICRRAGLSVRYFYESFTDKDEFVG

SEQ ID NO: 1508063 - protein, 24 aa, Mycobacterium tuberculosis
RTITDACEILLILKDNLAGHHREL

SEQ ID NO: 1508064 - protein, 21 aa, Mycobacterium tuberculosis
RTLTRCDIRVPRFAAVDLTGE

SEQ ID NO: 1508065 - protein, 21 aa, Mycobacterium tuberculosis
RTNLYTPLQAAKLAKETSSTK

SEQ ID NO: 1508066 - protein, 19 aa, Mycobacterium tuberculosis
RTWQVGAMRELLLAHRDPG

SEQ ID NO: 1508067 - protein, 23 aa, Mycobacterium tuberculosis
RTYEKMSLFIVPADTPGIEIVRN

SEQ ID NO: 1508068 - protein, 18 aa, Mycobacterium tuberculosis
RVAMFPAVEPDDVSALTE

SEQ ID NO: 1508069 - protein, 23 aa, Mycobacterium tuberculosis
RVDHPLFARIWPVVAAHEAEAIR

SEQ ID NO: 1508070 - protein, 22 aa, Mycobacterium tuberculosis
RVDLILPGFRYRAAMADGTVEN

SEQ ID NO: 1508071 - protein, 27 aa, Mycobacterium tuberculosis
RVIEPIDMDAYRQFLTEIGYLLPEPDD

SEQ ID NO: 1508072 - protein, 25 aa, Mycobacterium tuberculosis
RVLRRLPDLRLVADDSVLPLRPANF

SEQ ID NO: 1508073 - protein, 22 aa, Mycobacterium tuberculosis
RVQLLRDYGSAASPFNAFLVAQ

SEQ ID NO: 1508074 - protein, 26 aa, Mycobacterium tuberculosis
RVQTTVLKAINWFGQFSTRIADKEAD

SEQ ID NO: 1508075 - protein, 26 aa, Mycobacterium tuberculosis
RVSSKYALVIYAAKRARQINDYYNQL

SEQ ID NO: 1508076 - protein, 40 aa, Mycobacterium tuberculosis; identical to SEQ ID NO: 222731

SEQ ID NO: 1508077 - protein, 27 aa, Mycobacterium tuberculosis
RWTLLIVRELLFGPLRFTEIERGLPGI

SEQ ID NO: 1508078 - protein, 20 aa, Mycobacterium tuberculosis
RYGIVWGAMGAARSAWQCAL

SEQ ID NO: 1508079 - protein, 27 aa, Mycobacterium tuberculosis
RYTGRGMPLLDLIQEGNLGLIRAMEKF

SEQ ID NO: 1508080 - protein, 19 aa, Mycobacterium tuberculosis
RYVAAMLAVLKAGGMIVPL

SEQ ID NO: 1508081 - protein, 24 aa, Mycobacterium tuberculosis
SAAKLATALQSAAPWLAKSGGEFI

SEQ ID NO: 1508082 - protein, 27 aa, Mycobacterium tuberculosis
SADSAHAAILPLYYLRRAGIAESDLQV

SEQ ID NO: 1508083 - protein, 20 aa, Mycobacterium tuberculosis
SAEVLAWRQRSLTGRRWFDE

SEQ ID NO: 1508084 - protein, 19 aa, Mycobacterium tuberculosis
SAGIWNRPFDVDLDGDGRL

SEQ ID NO: 1508085 - protein, 25 aa, Mycobacterium tuberculosis
SAKRITAVMPFYPYARQDKKHRGRE

SEQ ID NO: 1508086 - protein, 20 aa, Mycobacterium tuberculosis
SALTCEFLFLCSGYYNYDEG

SEQ ID NO: 1508087 - protein, 35 aa, Mycobacterium tuberculosis; identical to SEQ ID NO: 222793

SEQ ID NO: 1508088 - protein, 21 aa, Mycobacterium tuberculosis
SAMARSYLGPEFDIHCGGMDL

SEQ ID NO: 1508089 - protein, 22 aa, Mycobacterium tuberculosis
SAMLPYLPVEYDDPVRRLRTVH

SEQ ID NO: 1508090 - protein, 22 aa, Mycobacterium tuberculosis
SAQACAWLASAIETAYCAPPPV

SEQ ID NO: 1508091 - protein, 19 aa, Mycobacterium tuberculosis
SATAWYGLQDLARIKAGDK

SEQ ID NO: 1508092 - protein, 20 aa, Mycobacterium tuberculosis
SAVAQDYLKVIWTAQEWSQD

SEQ ID NO: 1508093 - protein, 26 aa, Mycobacterium tuberculosis
SCIYPKLAPQPIPESALLTGPLEPTN

SEQ ID NO: 1508094 - protein, 18 aa, Mycobacterium tuberculosis
SCPGPEAALALVGAARRL

SEQ ID NO: 1508095 - protein, 25 aa, Mycobacterium tuberculosis
SDALPEPTFVPVLGRIAAGGPILAE

SEQ ID NO: 1508096 - protein, 26 aa, Mycobacterium tuberculosis
SDELIDYLTMLSWSALCGIVEAGGSL

SEQ ID NO: 1508097 - protein, 27 aa, Mycobacterium tuberculosis
SDILPISFGFPFGFSAAIPPNLPLPAK

SEQ ID NO: 1508098 - protein, 28 aa, Mycobacterium tuberculosis
SDLINPHPLFVPWLVGPLLTGEGIQLVK

SEQ ID NO: 1508099 - protein, 24 aa, Mycobacterium tuberculosis
SDSLAITWAHPELPQRAFDLGAGQ

SEQ ID NO: 1508100 - protein, 18 aa, Mycobacterium tuberculosis
SDSSIFTLSFPYEPWTRE

SEQ ID NO: 1508101 - protein, 18 aa, Mycobacterium tuberculosis
SDTWQPPTPRRLGPFRAS

SEQ ID NO: 1508102 - protein, 19 aa, Mycobacterium tuberculosis
SELRLLYLTVTDPASGNLI

SEQ ID NO: 1508103 - protein, 22 aa, Mycobacterium tuberculosis
SELRRATVIYGSKRQLALLDDT

SEQ ID NO: 1508104 - protein, 20 aa, Mycobacterium tuberculosis
SEVGGPLPGLGADLLAVVAR

SEQ ID NO: 1508105 - protein, 25 aa, Mycobacterium tuberculosis
SFDEDPFAILAWRGREREDLLANLA

SEQ ID NO: 1508106 - protein, 22 aa, Mycobacterium tuberculosis
SGDLLVTVKVAVPPNLAGAAQE

SEQ ID NO: 1508107 - protein, 22 aa, Mycobacterium tuberculosis
SGDLRVDFPWLGTVVQAYLRRT

SEQ ID NO: 1508108 - protein, 34 aa, Mycobacterium tuberculosis; identical to SEQ ID NO: 222898

SEQ ID NO: 1508109 - protein, 26 aa, Mycobacterium tuberculosis
SGFERFPAWMWRNTVVRDFVEWLRTR

SEQ ID NO: 1508110 - protein, 19 aa, Mycobacterium tuberculosis
SGIGFGLHNDIVAPYLLAL

SEQ ID NO: 1508111 - protein, 25 aa, Mycobacterium tuberculosis
SGLDARGYRLPWPADTTVFEVDQPR

SEQ ID NO: 1508112 - protein, 27 aa, Mycobacterium tuberculosis
SGLDSRAYRLPWPTRTVVYEIDQPKVM

SEQ ID NO: 1508113 - protein, 33 aa, Mycobacterium tuberculosis; identical to SEQ ID NO: 222920

SEQ ID NO: 1508114 - protein, 22 aa, Mycobacterium tuberculosis
SGRTYPVLYLFHGGGTDQDFRT

SEQ ID NO: 1508115 - protein, 22 aa, Mycobacterium tuberculosis
SGRYALIRTNGDRWLAHRLKNQ

SEQ ID NO: 1508116 - protein, 31 aa, Mycobacterium tuberculosis; identical to SEQ ID NO: 222950

SEQ ID NO: 1508117 - protein, 23 aa, Mycobacterium tuberculosis
SHDIPRFVSLWQSGRLPVESLVT

SEQ ID NO: 1508118 - protein, 24 aa, Mycobacterium tuberculosis
SHQYPDFRGFLAEVARVLRPGGHF

SEQ ID NO: 1508119 - protein, 17 aa, Mycobacterium tuberculosis
SHRAKVYGFPAPGAPPL

SEQ ID NO: 1508120 - protein, 19 aa, Mycobacterium tuberculosis
SHSHRRTRRRWPPNIQLKA

SEQ ID NO: 1508121 - protein, 29 aa, Mycobacterium tuberculosis
SIARVAATVPLGRLARPADIGWAAAFLAS

SEQ ID NO: 1508122 - protein, 17 aa, Mycobacterium tuberculosis
SIKEKLLELLPNRVITD

SEQ ID NO: 1508123 - protein, 21 aa, Mycobacterium tuberculosis
SINLPYITVDADKNPLFLDEQ

SEQ ID NO: 1508124 - protein, 25 aa, Mycobacterium tuberculosis
SIPNPFAVTYYLIKGSLQAPYGAIV

SEQ ID NO: 1508125 - protein, 26 aa, Mycobacterium tuberculosis
SIQAGIINLLLDLQEQFGLSYLFVSH

SEQ ID NO: 1508126 - protein, 24 aa, Mycobacterium tuberculosis
SKFADPWTFDLARNPNPHLGFGGG

SEQ ID NO: 1508127 - protein, 29 aa, Mycobacterium tuberculosis
SKLRERLGFGELRWALSGAAPIPKETLAF

SEQ ID NO: 1508128 - protein, 33 aa, Mycobacterium tuberculosis; identical to SEQ ID NO: 223001

SEQ ID NO: 1508129 - protein, 28 aa, Mycobacterium tuberculosis
SLGITLPVALVWAYPTISDLATALCERM

SEQ ID NO: 1508130 - protein, 25 aa, Mycobacterium tuberculosis
SLGLVQLTRKRLGTGLIEAFSTSCP

SEQ ID NO: 1508131 - protein, 25 aa, Mycobacterium tuberculosis
SLHCVYKPVSGERPLWDFPDGTLAG

SEQ ID NO: 1508132 - protein, 26 aa, Mycobacterium tuberculosis
SLPLFVSELLALYRAGGHVAALPAAP

SEQ ID NO: 1508133 - protein, 24 aa, Mycobacterium tuberculosis
SLQAPLDVLVVRKLGVPFQPELAF

SEQ ID NO: 1508134 - protein, 24 aa, Mycobacterium tuberculosis
SLTDNYVVIYDLPVTFDPMQVVPA

SEQ ID NO: 1508135 - protein, 17 aa, Mycobacterium tuberculosis
SLVLLAWGAANRDPRQY

SEQ ID NO: 1508136 - protein, 22 aa, Mycobacterium tuberculosis
SLYRFHRRLASFSRVIRLDHRG

SEQ ID NO: 1508137 - protein, 19 aa, Mycobacterium tuberculosis
SMILPPIAHQVKVISIAQF

SEQ ID NO: 1508138 - protein, 22 aa, Mycobacterium tuberculosis
SMTFALGCVLVDADNRPTAFDG

SEQ ID NO: 1508139 - protein, 27 aa, Mycobacterium tuberculosis
SNPLVGKLTTKYFLPLGTRQVGDHVVF

SEQ ID NO: 1508140 - protein, 21 aa, Mycobacterium tuberculosis
SNSPHLYAELAIPATAGGTVG

SEQ ID NO: 1508141 - protein, 21 aa, Mycobacterium tuberculosis
SPETLIIDCGADFRLTDAAVW

SEQ ID NO: 1508142 - protein, 23 aa, Mycobacterium tuberculosis
SPNILYLVWDDVGIATWDCFGGL

SEQ ID NO: 1508143 - protein, 20 aa, Mycobacterium tuberculosis
SPVRSAWLDIPSLVEAAKQT

SEQ ID NO: 1508144 - protein, 29 aa, Mycobacterium tuberculosis
SPWVGNIDLTFPYLDTPATRAIGVPPGSR

SEQ ID NO: 1508145 - protein, 25 aa, Mycobacterium tuberculosis
SQRQALLFLRADRLQYFVSCLVYMP

SEQ ID NO: 1508146 - protein, 23 aa, Mycobacterium tuberculosis
SQTRRRVAVLGGNRIPFARSDGA

SEQ ID NO: 1508147 - protein, 20 aa, Mycobacterium tuberculosis
SRAAVQIAFALRAGANRYAE

SEQ ID NO: 1508148 - protein, 26 aa, Mycobacterium tuberculosis
SRALEDWCHQLAWPIRPAVSADPPST

SEQ ID NO: 1508149 - protein, 31 aa, Mycobacterium tuberculosis; identical to SEQ ID NO: 223109

SEQ ID NO: 1508150 - protein, 18 aa, Mycobacterium tuberculosis
SRGWSNLESFFAGVPGLT

SEQ ID NO: 1508151 - protein, 26 aa, Mycobacterium tuberculosis
SRIGAYQRRGAVSTLLLVVQRVPYFQ

SEQ ID NO: 1508152 - protein, 32 aa, Mycobacterium tuberculosis; identical to SEQ ID NO: 223127

SEQ ID NO: 1508153 - protein, 25 aa, Mycobacterium tuberculosis
SRSLTRLAGRLLGWLLVCDPERQSS

SEQ ID NO: 1508154 - protein, 29 aa, Mycobacterium tuberculosis
SRTPTYDGVLGRLWLARGGTYALANIRGG

SEQ ID NO: 1508155 - protein, 20 aa, Mycobacterium tuberculosis
SSAARHLAARWAAKEAVIKA

SEQ ID NO: 1508156 - protein, 17 aa, Mycobacterium tuberculosis
SSAGTGALLAWLTARPL

SEQ ID NO: 1508157 - protein, 23 aa, Mycobacterium tuberculosis
SSALVVAMLLTTCALIGSSPGPY

SEQ ID NO: 1508158 - protein, 26 aa, Mycobacterium tuberculosis
SSFLLDHALVDIGVGVRWLREVQGVE

SEQ ID NO: 1508159 - protein, 22 aa, Mycobacterium tuberculosis
SSLAFDTIFAEGQRRYVESLSA

SEQ ID NO: 1508160 - protein, 23 aa, Mycobacterium tuberculosis
SSNLARFDAMRYGLRVGDDGTRS

SEQ ID NO: 1508161 - protein, 24 aa, Mycobacterium tuberculosis
SVALGFGFRCGFLGLLHMEITRER

SEQ ID NO: 1508162 - protein, 20 aa, Mycobacterium tuberculosis
SVDRLRWKGYLKPGSRDDAS

SEQ ID NO: 1508163 - protein, 24 aa, Mycobacterium tuberculosis
SVHVLDRYILAKLAVLRDDLSESM

SEQ ID NO: 1508164 - protein, 26 aa, Mycobacterium tuberculosis
SVIFDRRAILKVFRRVSSGINPDIEL

SEQ ID NO: 1508165 - protein, 24 aa, Mycobacterium tuberculosis
SVPSIILGGIDWFRSMGSEKSPGF

SEQ ID NO: 1508166 - protein, 25 aa, Mycobacterium tuberculosis
SVTSGLVVGWWQGSASAAMVDAAAS

SEQ ID NO: 1508167 - protein, 21 aa, Mycobacterium tuberculosis
SVYLTRPSLFHFTRTGEEFSW

SEQ ID NO: 1508168 - protein, 20 aa, Mycobacterium tuberculosis
SWAETLWRMSVSIAGAVCTA

SEQ ID NO: 1508169 - protein, 18 aa, Mycobacterium tuberculosis
SWRAARATLRLPADTAAR

SEQ ID NO: 1508170 - protein, 19 aa, Mycobacterium tuberculosis
SWTTPFTEVLDWSGAPFAK

SEQ ID NO: 1508171 - protein, 21 aa, Mycobacterium tuberculosis
TADDYLRFVRMLLGDGTVDGV

SEQ ID NO: 1508172 - protein, 17 aa, Mycobacterium tuberculosis
TAFRRRITRLSPARLHE

SEQ ID NO: 1508173 - protein, 21 aa, Mycobacterium tuberculosis
TAGDLLKRLAVSGAALLSTTL

SEQ ID NO: 1508174 - protein, 27 aa, Mycobacterium tuberculosis
TAGYLALLEAAFLIHRVPAWSTNLSRK

SEQ ID NO: 1508175 - protein, 25 aa, Mycobacterium tuberculosis
TALGTDPWPWVLSGGEDHALVACFV

SEQ ID NO: 1508176 - protein, 29 aa, Mycobacterium tuberculosis
TANAIAGILFLHSGLIALPPDLASGVVQP

SEQ ID NO: 1508177 - protein, 21 aa, Mycobacterium tuberculosis
TARAAWAWFRHLHRLADRTLA

SEQ ID NO: 1508178 - protein, 25 aa, Mycobacterium tuberculosis
TARATPFTMRTWARLLSEVGAPDQR

SEQ ID NO: 1508179 - protein, 26 aa, Mycobacterium tuberculosis
TATTPDGLLLWTQKRSIYARGEGGFG

SEQ ID NO: 1508180 - protein, 23 aa, Mycobacterium tuberculosis
TAVELMPVHQFLHDSRLLDLGLR

SEQ ID NO: 1508181 - protein, 17 aa, Mycobacterium tuberculosis
TCVRVGTALLGPRRLRS

SEQ ID NO: 1508182 - protein, 19 aa, Mycobacterium tuberculosis
TDAHRAILASLGTGGAYFF

SEQ ID NO: 1508183 - protein, 18 aa, Mycobacterium tuberculosis
TDKTIDLLIACHLAGCGY

SEQ ID NO: 1508184 - protein, 21 aa, Mycobacterium tuberculosis
TDLLRSPRPRWPPNAAGMQVE

SEQ ID NO: 1508185 - protein, 32 aa, Mycobacterium tuberculosis; identical to SEQ ID NO: 223332

SEQ ID NO: 1508186 - protein, 19 aa, Mycobacterium tuberculosis
TDWTATSAEFRKLLADWKA

SEQ ID NO: 1508187 - protein, 34 aa, Mycobacterium tuberculosis; identical to SEQ ID NO: 223352

SEQ ID NO: 1508188 - protein, 33 aa, Mycobacterium tuberculosis; identical to SEQ ID NO: 223353

SEQ ID NO: 1508189 - protein, 24 aa, Mycobacterium tuberculosis
TEIIPLDGFLDGLALYDELDFAEL

SEQ ID NO: 1508190 - protein, 26 aa, Mycobacterium tuberculosis
TELPADSHLLLLWGAANRDPAQFEAP

SEQ ID NO: 1508191 - protein, 25 aa, Mycobacterium tuberculosis
TERTDALIIGPLRVQFWVCGVFEVD

SEQ ID NO: 1508192 - protein, 23 aa, Mycobacterium tuberculosis
TETLRAPMWLEHIRRRGWQAVAA

SEQ ID NO: 1508193 - protein, 17 aa, Mycobacterium tuberculosis
TFTAWRSTPAPVRGALV

SEQ ID NO: 1508194 - protein, 19 aa, Mycobacterium tuberculosis
TGAAYLPIDPANPPPRVAF

SEQ ID NO: 1508195 - protein, 23 aa, Mycobacterium tuberculosis
TGAGVSGLWLLSGMRDDGVLTTI

SEQ ID NO: 1508196 - protein, 26 aa, Mycobacterium tuberculosis
TGFDALYDVAGPQFLLSLIVSSAVCG

SEQ ID NO: 1508197 - protein, 25 aa, Mycobacterium tuberculosis
TGHYLGCVHLQRLLRDPPAELVGGV

SEQ ID NO: 1508198 - protein, 25 aa, Mycobacterium tuberculosis
TGKSVFLKSLIGLLRPERGSIIIDG

SEQ ID NO: 1508199 - protein, 20 aa, Mycobacterium tuberculosis
TGLLGLVLPREIGGMGSGPV

SEQ ID NO: 1508200 - protein, 24 aa, Mycobacterium tuberculosis
TGPTGVLPTLTPTSTRGASALSLS

SEQ ID NO: 1508201 - protein, 44 aa, Mycobacterium tuberculosis; identical to SEQ ID NO: 223431

SEQ ID NO: 1508202 - protein, 19 aa, Mycobacterium tuberculosis
TGSAIAQHWMYEGKHVLII

SEQ ID NO: 1508203 - protein, 24 aa, Mycobacterium tuberculosis
TGSVPQRLWAKPAITVIGIDTTSV

SEQ ID NO: 1508204 - protein, 21 aa, Mycobacterium tuberculosis
TGSWRLHVATAARDVDWWLTF

SEQ ID NO: 1508205 - protein, 23 aa, Mycobacterium tuberculosis
TGVFWIQDRLTIGQLREILSAAT

SEQ ID NO: 1508206 - protein, 21 aa, Mycobacterium tuberculosis
THLDPLRAAVLAHRADLGLAH

SEQ ID NO: 1508207 - protein, 19 aa, Mycobacterium tuberculosis
THWCGLHPGVSVDHSCLSR

SEQ ID NO: 1508208 - protein, 24 aa, Mycobacterium tuberculosis
TIDAARDWLLGTPADDWVSMAVVS

SEQ ID NO: 1508209 - protein, 25 aa, Mycobacterium tuberculosis
TIDEPLVRRLWVLKVWGDVVDDRRG

SEQ ID NO: 1508210 - protein, 19 aa, Mycobacterium tuberculosis
TIVHWPNGIAAKGEMRWQF

SEQ ID NO: 1508211 - protein, 19 aa, Mycobacterium tuberculosis
TIVSFLRYIDANRASWIVM

SEQ ID NO: 1508212 - protein, 22 aa, Mycobacterium tuberculosis
TKAKELGLTPLARIVSTGVSGL

SEQ ID NO: 1508213 - protein, 25 aa, Mycobacterium tuberculosis
TKDIPVYRFVLRAYAAQLVQNHVNL

SEQ ID NO: 1508214 - protein, 20 aa, Mycobacterium tuberculosis
TKILGLLTAAPKSYAATIRL

SEQ ID NO: 1508215 - protein, 18 aa, Mycobacterium tuberculosis
TLARMMSRRQFGQTLFEH

SEQ ID NO: 1508216 - protein, 20 aa, Mycobacterium tuberculosis
TLDALAAELPLPVGLLKIDV

SEQ ID NO: 1508217 - protein, 24 aa, Mycobacterium tuberculosis
TLDRGYVKAVRRRWLREEHYRRMY

SEQ ID NO: 1508218 - protein, 26 aa, Mycobacterium tuberculosis
TLGTALARLGMFAPALSYLEEPDGPV

SEQ ID NO: 1508219 - protein, 19 aa, Mycobacterium tuberculosis
TLLLLDEPSSGLDPLMENV

SEQ ID NO: 1508220 - protein, 20 aa, Mycobacterium tuberculosis
TLLSCLGGILRPKSGSIKFD

SEQ ID NO: 1508221 - protein, 18 aa, Mycobacterium tuberculosis
TLPPGTALTPLGRDQARA

SEQ ID NO: 1508222 - protein, 28 aa, Mycobacterium tuberculosis
TLQVTIQVRIPFIGGKLERLIGTQLSQL

SEQ ID NO: 1508223 - protein, 23 aa, Mycobacterium tuberculosis
TLRELLTIAMRYFALTTMHVDIT

SEQ ID NO: 1508224 - protein, 21 aa, Mycobacterium tuberculosis
TLRFHRAMLVWMLERALTDKE

SEQ ID NO: 1508225 - protein, 20 aa, Mycobacterium tuberculosis
TLTERRLEFTRSLRRVFHDV

SEQ ID NO: 1508226 - protein, 17 aa, Mycobacterium tuberculosis
TLYQHFPSKSALVEEYL

SEQ ID NO: 1508227 - protein, 28 aa, Mycobacterium tuberculosis
TMDGALLRLGRPILPNTVFLAFGEVVIV

SEQ ID NO: 1508228 - protein, 24 aa, Mycobacterium tuberculosis
TNARMLIQFGFIERLAVAGDRRTY

SEQ ID NO: 1508229 - protein, 20 aa, Mycobacterium tuberculosis
TPALFFAVGQGYRNFTQTSD

SEQ ID NO: 1508230 - protein, 26 aa, Mycobacterium tuberculosis
TPAVGALLCLLAKLSGGKAVAEVGTG

SEQ ID NO: 1508231 - protein, 17 aa, Mycobacterium tuberculosis
TPIILADGAHHTNATYY

SEQ ID NO: 1508232 - protein, 35 aa, Mycobacterium tuberculosis; identical to SEQ ID NO: 223601

SEQ ID NO: 1508233 - protein, 29 aa, Mycobacterium tuberculosis
TPTFTGRSWPLADVRLLAPILASKVVCVG

SEQ ID NO: 1508234 - protein, 17 aa, Mycobacterium tuberculosis
TQQLVESGWRPGDSVIL

SEQ ID NO: 1508235 - protein, 26 aa, Mycobacterium tuberculosis
TRALRDWLLMRAWEAGVTPIGAQPVP

SEQ ID NO: 1508236 - protein, 17 aa, Mycobacterium tuberculosis
TREPDVELPFAAQPRVC

SEQ ID NO: 1508237 - protein, 19 aa, Mycobacterium tuberculosis
TRIYLGPGSGPILAAAQGW

SEQ ID NO: 1508238 - protein, 30 aa, Mycobacterium tuberculosis; identical to SEQ ID NO: 223649

SEQ ID NO: 1508239 - protein, 20 aa, Mycobacterium tuberculosis
TRTWVGHGVFAHNLVTISAL

SEQ ID NO: 1508240 - protein, 30 aa, Mycobacterium tuberculosis; identical to SEQ ID NO: 223676

SEQ ID NO: 1508241 - protein, 24 aa, Mycobacterium tuberculosis
TSTTWPKLTGVPMLGISVLGEAHD

SEQ ID NO: 1508242 - protein, 27 aa, Mycobacterium tuberculosis
TTGQDLLLITVLKGAVLFVTDLARAIP

SEQ ID NO: 1508243 - protein, 27 aa, Mycobacterium tuberculosis
TTGRRRRCGWFDAVIARYAARVNGITD

SEQ ID NO: 1508244 - protein, 18 aa, Mycobacterium tuberculosis
TTPLPPIRALVCNAGLQV

SEQ ID NO: 1508245 - protein, 23 aa, Mycobacterium tuberculosis
TTSKLCNVLFTYELDRRLDHGEQ

SEQ ID NO: 1508246 - protein, 22 aa, Mycobacterium tuberculosis
TTWAPKSAGALAYRALARELID

SEQ ID NO: 1508247 - protein, 26 aa, Mycobacterium tuberculosis
TVDYPPVNAIPSKAWFDLADAVTAAG

SEQ ID NO: 1508248 - protein, 26 aa, Mycobacterium tuberculosis
TVHPSGHILVRSCRGGYMHSVSLSEA

SEQ ID NO: 1508249 - protein, 25 aa, Mycobacterium tuberculosis
TVHPTTMRLLDELGLWERFAALPYS

SEQ ID NO: 1508250 - protein, 17 aa, Mycobacterium tuberculosis
TVIIVTHNLAQAARISD

SEQ ID NO: 1508251 - protein, 22 aa, Mycobacterium tuberculosis
TVKRLGTLPNLTWSRLKVNVAV

SEQ ID NO: 1508252 - protein, 21 aa, Mycobacterium tuberculosis
TVLGPLLFQSPEMGALPTLRA

SEQ ID NO: 1508253 - protein, 20 aa, Mycobacterium tuberculosis
TVTYPTDSPFRGVKKVHYWA

SEQ ID NO: 1508254 - protein, 17 aa, Mycobacterium tuberculosis
TVVAKLLTLFGTEEQRR

SEQ ID NO: 1508255 - protein, 18 aa, Mycobacterium tuberculosis
TWMLQRAVGPQVARAALL

SEQ ID NO: 1508256 - protein, 17 aa, Mycobacterium tuberculosis
TYFRLRPNAFAAGERER

SEQ ID NO: 1508257 - protein, 18 aa, Mycobacterium tuberculosis
TYHAFLHVAADEALAAAA

SEQ ID NO: 1508258 - protein, 26 aa, Mycobacterium tuberculosis
VAAAAIGLVDLLLASGGDLVTVLIGA

SEQ ID NO: 1508259 - protein, 17 aa, Mycobacterium tuberculosis
VAALIRSGLLDVGVIQA

SEQ ID NO: 1508260 - protein, 36 aa, Mycobacterium tuberculosis; identical to SEQ ID NO: 223783

SEQ ID NO: 1508261 - protein, 23 aa, Mycobacterium tuberculosis
VAEMNWRILKFKPAGSPSSVPDD

SEQ ID NO: 1508262 - protein, 20 aa, Mycobacterium tuberculosis
VAFGTDLLFAASDLPGFVLH

SEQ ID NO: 1508263 - protein, 19 aa, Mycobacterium tuberculosis
VAGPGFINMRLETAAQAKV

SEQ ID NO: 1508264 - protein, 20 aa, Mycobacterium tuberculosis
VAHLARLARLALTETELDSF

SEQ ID NO: 1508265 - protein, 18 aa, Mycobacterium tuberculosis
VAIMLGLAYVLATESLAD

SEQ ID NO: 1508266 - protein, 26 aa, Mycobacterium tuberculosis
VAPAIISLTLLPKLSPRAAARYYLTG

SEQ ID NO: 1508267 - protein, 27 aa, Mycobacterium tuberculosis
VARAGKLPVTLFTAGGIATPADAAMMM

SEQ ID NO: 1508268 - protein, 21 aa, Mycobacterium tuberculosis
VARGSFFPVIPVCSSTGVGTL

SEQ ID NO: 1508269 - protein, 28 aa, Mycobacterium tuberculosis
VARHVRSTILLAASAFGRLALDAVHLDI

SEQ ID NO: 1508270 - protein, 25 aa, Mycobacterium tuberculosis
VASCQQRCPPRQFERARVVVFAGDH

SEQ ID NO: 1508271 - protein, 42 aa, Mycobacterium tuberculosis; identical to SEQ ID NO: 223850

SEQ ID NO: 1508272 - protein, 29 aa, Mycobacterium tuberculosis
VASQLTPWQQLLSVLPPVVTAAPAGAVGV

SEQ ID NO: 1508273 - protein, 19 aa, Mycobacterium tuberculosis
VATLRRFTERFAPFNLSET

SEQ ID NO: 1508274 - protein, 24 aa, Mycobacterium tuberculosis
VAVARLVLGPGMRIQAPPNLVSGD

SEQ ID NO: 1508275 - protein, 31 aa, Mycobacterium tuberculosis; identical to SEQ ID NO: 223864

SEQ ID NO: 1508276 - protein, 25 aa, Mycobacterium tuberculosis
VDGMEAVLPVLWSDGHALLTDQLPD

SEQ ID NO: 1508277 - protein, 23 aa, Mycobacterium tuberculosis
VDGRFQWIVFTSTNAVRAVWEKF

SEQ ID NO: 1508278 - protein, 21 aa, Mycobacterium tuberculosis
VDLYSCFPSAVQVAAIELGLD

SEQ ID NO: 1508279 - protein, 17 aa, Mycobacterium tuberculosis
VDPHQPGARLFLHYGDL

SEQ ID NO: 1508280 - protein, 26 aa, Mycobacterium tuberculosis
VDQPAFFEKQLALSAPPWLSRATVAH

SEQ ID NO: 1508281 - protein, 27 aa, Mycobacterium tuberculosis
VDTRRWAGVPFYLRTGKRLGRRVTEIA

SEQ ID NO: 1508282 - protein, 28 aa, Mycobacterium tuberculosis
VDVDNLPQLPWWLRPFARFHADDHFADP

SEQ ID NO: 1508283 - protein, 20 aa, Mycobacterium tuberculosis
VDVRCEAEWRFVGVPDLSSL

SEQ ID NO: 1508284 - protein, 35 aa, Mycobacterium tuberculosis; identical to SEQ ID NO: 223917

SEQ ID NO: 1508285 - protein, 26 aa, Mycobacterium tuberculosis
VEEPPEHLIFIFATTEPEKVLPTIRS

SEQ ID NO: 1508286 - protein, 18 aa, Mycobacterium tuberculosis
VEFGIKRGRKTVSIVGST

SEQ ID NO: 1508287 - protein, 22 aa, Mycobacterium tuberculosis
VEGDLWVRGPAIAKGYWNRPDS

SEQ ID NO: 1508288 - protein, 19 aa, Mycobacterium tuberculosis
VEHEGAHVTWLPTAADGSV

SEQ ID NO: 1508289 - protein, 26 aa, Mycobacterium tuberculosis
VEIATPGSWRREPLSGIPAATNTVIV

SEQ ID NO: 1508290 - protein, 24 aa, Mycobacterium tuberculosis
VEICPWALREGLILRKLDSEADGT

SEQ ID NO: 1508291 - protein, 28 aa, Mycobacterium tuberculosis
VERLQRLRLPWWHLWRAAEAAGAATPKR

SEQ ID NO: 1508292 - protein, 23 aa, Mycobacterium tuberculosis
VERRQLLELYGAQIIFSAAEGGS

SEQ ID NO: 1508293 - protein, 17 aa, Mycobacterium tuberculosis
VETGFLEHLWNAPTKDI

SEQ ID NO: 1508294 - protein, 17 aa, Mycobacterium tuberculosis
VFAIEAILRMGDDEQRK

SEQ ID NO: 1508295 - protein, 25 aa, Mycobacterium tuberculosis
VFEAAKAAIVPPAAVAANREAFLAL

SEQ ID NO: 1508296 - protein, 26 aa, Mycobacterium tuberculosis
VFIMGDCDQLMPEYLRFVKGVVDAQD

SEQ ID NO: 1508297 - protein, 18 aa, Mycobacterium tuberculosis
VFVALSWTKHPPPQTYDE

SEQ ID NO: 1508298 - protein, 26 aa, Mycobacterium tuberculosis
VGARQRLMCRLPKRPDPHAWLGDAFH

SEQ ID NO: 1508299 - protein, 26 aa, Mycobacterium tuberculosis
VGCGFITWSLARQPQLLDLALQYEPV

SEQ ID NO: 1508300 - protein, 20 aa, Mycobacterium tuberculosis
VGFVGVPLFHIAGIGNMLTG

SEQ ID NO: 1508301 - protein, 30 aa, Mycobacterium tuberculosis; identical to SEQ ID NO: 223991

SEQ ID NO: 1508302 - protein, 28 aa, Mycobacterium tuberculosis
VGHHCALPLHRRFGLAATARASFAVYNT

SEQ ID NO: 1508303 - protein, 26 aa, Mycobacterium tuberculosis
VGKGTLFRRFGSRAGLMMVLLDEDER

SEQ ID NO: 1508304 - protein, 18 aa, Mycobacterium tuberculosis
VGLGSVRYLLAVGDLLIG

SEQ ID NO: 1508305 - protein, 18 aa, Mycobacterium tuberculosis
VGLGYWRNPQQTEATFRA

SEQ ID NO: 1508306 - protein, 19 aa, Mycobacterium tuberculosis
VGLLNVQYALKDDVLYVLE

SEQ ID NO: 1508307 - protein, 21 aa, Mycobacterium tuberculosis
VGLMGIPPLDWDPDEAFDRLQ

SEQ ID NO: 1508308 - protein, 26 aa, Mycobacterium tuberculosis
VIDQLPANTWLTDVGKYPLRGLHRQE

SEQ ID NO: 1508309 - protein, 19 aa, Mycobacterium tuberculosis
VISARRVLRDLWFDGHRIR

SEQ ID NO: 1508310 - protein, 28 aa, Mycobacterium tuberculosis
VITGAVIIDYWGIIKADIGIRDGRIVGI

SEQ ID NO: 1508311 - protein, 24 aa, Mycobacterium tuberculosis
VIWAFKQLWDKGLAYEGYRVLPYC

SEQ ID NO: 1508312 - protein, 26 aa, Mycobacterium tuberculosis
VKALDDVGFFTLLQPQQWGGLQCDPA

SEQ ID NO: 1508313 - protein, 18 aa, Mycobacterium tuberculosis
VKDCARRLLRHYTMLSLT

SEQ ID NO: 1508314 - protein, 24 aa, Mycobacterium tuberculosis
VKDQRRLRKLAELGWIVIRVIAED

SEQ ID NO: 1508315 - protein, 25 aa, Mycobacterium tuberculosis
VKEVQTYVPGYRLLNEPQFDEPSIN

SEQ ID NO: 1508316 - protein, 30 aa, Mycobacterium tuberculosis; identical to SEQ ID NO: 224079

SEQ ID NO: 1508317 - protein, 18 aa, Mycobacterium tuberculosis
VKHDVTIAAPLNLPATMP

SEQ ID NO: 1508318 - protein, 24 aa, Mycobacterium tuberculosis
VLAGIGNVYCNELCFVSGVLPTAP

SEQ ID NO: 1508319 - protein, 17 aa, Mycobacterium tuberculosis
VLAIYNPASVTRTWQVG

SEQ ID NO: 1508320 - protein, 27 aa, Mycobacterium tuberculosis
VLASAAPPWVGPLDVLIVAGDDPGDPA

SEQ ID NO: 1508321 - protein, 17 aa, Mycobacterium tuberculosis
VLGETWTLLNRRCGHRA

SEQ ID NO: 1508322 - protein, 18 aa, Mycobacterium tuberculosis
VLGLLRDAYCRHIGVEYA

SEQ ID NO: 1508323 - protein, 30 aa, Mycobacterium tuberculosis; identical to SEQ ID NO: 224119

SEQ ID NO: 1508324 - protein, 19 aa, Mycobacterium tuberculosis
VLIPSPDYPLWTASTSLAG

SEQ ID NO: 1508325 - protein, 27 aa, Mycobacterium tuberculosis
VLLSDGPVVLFFYPAAMTPGCTKEACH

SEQ ID NO: 1508326 - protein, 19 aa, Mycobacterium tuberculosis
VLMKPSTLDMICHGTAAKG

SEQ ID NO: 1508327 - protein, 19 aa, Mycobacterium tuberculosis
VLQPLGLHKVANPDLCGFA

SEQ ID NO: 1508328 - protein, 18 aa, Mycobacterium tuberculosis
VLRARFRPSPESGPPVHA

SEQ ID NO: 1508329 - protein, 19 aa, Mycobacterium tuberculosis
VLRSAGVKVLMALPVGMGC

SEQ ID NO: 1508330 - protein, 18 aa, Mycobacterium tuberculosis
VLVAMNSLWELNVPRRDL

SEQ ID NO: 1508331 - protein, 25 aa, Mycobacterium tuberculosis
VMAVWVILRAMEALDLLPLTDRRHL

SEQ ID NO: 1508332 - protein, 25 aa, Mycobacterium tuberculosis
VMTQELLEFPGGILGVALNLDEHSV

SEQ ID NO: 1508333 - protein, 26 aa, Mycobacterium tuberculosis
VNGKSWLVFGPYAGWSPKFLKHGQIS

SEQ ID NO: 1508334 - protein, 24 aa, Mycobacterium tuberculosis
VNQYLAVAALIAGGLYGIERGLQL

SEQ ID NO: 1508335 - protein, 34 aa, Mycobacterium tuberculosis; identical to SEQ ID NO: 224182

SEQ ID NO: 1508336 - protein, 17 aa, Mycobacterium tuberculosis
VNTLVLRVNLAGDPSFA

SEQ ID NO: 1508337 - protein, 24 aa, Mycobacterium tuberculosis
VPESKRFCWNCGRPVGRSDSETKG

SEQ ID NO: 1508338 - protein, 18 aa, Mycobacterium tuberculosis
VPNLLQLASALEVQRNHV

SEQ ID NO: 1508339 - protein, 22 aa, Mycobacterium tuberculosis
VPPGCVGPLQIALTKVAAEEHV

SEQ ID NO: 1508340 - protein, 24 aa, Mycobacterium tuberculosis
VPSSMVLLSPWLDVGTWQISQAWA

SEQ ID NO: 1508341 - protein, 20 aa, Mycobacterium tuberculosis
VQVPIPRAGGLGAPRIRDVE

SEQ ID NO: 1508342 - protein, 21 aa, Mycobacterium tuberculosis
VRAKYGWTDVSRFAALGIPAV

SEQ ID NO: 1508343 - protein, 20 aa, Mycobacterium tuberculosis
VRDWPKPLGFVWGLDDPVAT

SEQ ID NO: 1508344 - protein, 20 aa, Mycobacterium tuberculosis
VRMFDVVPNPAWVARPGKYA

SEQ ID NO: 1508345 - protein, 21 aa, Mycobacterium tuberculosis
VRPIDGLSLDVAPGSLVILLG

SEQ ID NO: 1508346 - protein, 25 aa, Mycobacterium tuberculosis
VRQHGGRLLVRLAGVADRDAADALR

SEQ ID NO: 1508347 - protein, 29 aa, Mycobacterium tuberculosis
VRSGVAFDILRRWLLARGYDVAFIRNVTD

SEQ ID NO: 1508348 - protein, 21 aa, Mycobacterium tuberculosis
VRSMRYTCERLVRGLDTIAAT

SEQ ID NO: 1508349 - protein, 23 aa, Mycobacterium tuberculosis
VRTALFNWAYARHTGGTFVFRIE

SEQ ID NO: 1508350 - protein, 21 aa, Mycobacterium tuberculosis
VRWFDIEPCYVYHPLNAYSEC

SEQ ID NO: 1508351 - protein, 23 aa, Mycobacterium tuberculosis
VSEPFLVAIPILEQKGMQVLTVA

SEQ ID NO: 1508352 - protein, 27 aa, Mycobacterium tuberculosis
VSGRAQILNMTLSQRWGRLFVAVCYAL

SEQ ID NO: 1508353 - protein, 28 aa, Mycobacterium tuberculosis
VSMTMNGAVLPILALYVVAAEEQGVAPE

SEQ ID NO: 1508354 - protein, 26 aa, Mycobacterium tuberculosis
VSRALMYHYFPDKRAFFAAVVKDEAD

SEQ ID NO: 1508355 - protein, 23 aa, Mycobacterium tuberculosis
VSSIFLMCLPDRVLAYGDCAIIP

SEQ ID NO: 1508356 - protein, 31 aa, Mycobacterium tuberculosis; identical to SEQ ID NO: 224322

SEQ ID NO: 1508357 - protein, 24 aa, Mycobacterium tuberculosis
VTASRHAHWLNPEPKHLWGSGDSA

SEQ ID NO: 1508358 - protein, 25 aa, Mycobacterium tuberculosis
VTATNYPLVLGDWKQFIITDRVGST

SEQ ID NO: 1508359 - protein, 17 aa, Mycobacterium tuberculosis
VTGWARLHGYPLGILAN

SEQ ID NO: 1508360 - protein, 26 aa, Mycobacterium tuberculosis
VTQRHLRRLWALPGTQLAVVAWPSTR

SEQ ID NO: 1508361 - protein, 25 aa, Mycobacterium tuberculosis
VTTLPAVISRWLSSVLPGGAAPEVT

SEQ ID NO: 1508362 - protein, 22 aa, Mycobacterium tuberculosis
VTVFFDGATLHALITGTPLSTD

SEQ ID NO: 1508363 - protein, 24 aa, Mycobacterium tuberculosis
VVADLSFISLATVLPALVGCASRD

SEQ ID NO: 1508364 - protein, 27 aa, Mycobacterium tuberculosis
VVAGGHSLLPMMKLRIANPEYLVDIND

SEQ ID NO: 1508365 - protein, 23 aa, Mycobacterium tuberculosis
VVGHPYVDIWQAVKPQRVGLAAW

SEQ ID NO: 1508366 - protein, 18 aa, Mycobacterium tuberculosis
VVIRGQTPHFDYVCDAVT

SEQ ID NO: 1508367 - protein, 17 aa, Mycobacterium tuberculosis
VVLAAGHNFPLACPGLL

SEQ ID NO: 1508368 - protein, 26 aa, Mycobacterium tuberculosis
VVLDNVFATPLLQQGFPLGVDVVVYS

SEQ ID NO: 1508369 - protein, 20 aa, Mycobacterium tuberculosis
VVPDITIPGIPLSLNALGGV

SEQ ID NO: 1508370 - protein, 18 aa, Mycobacterium tuberculosis
VYASLFTCGIAVPHMVAS

SEQ ID NO: 1508371 - protein, 25 aa, Mycobacterium tuberculosis
VYFAGYAMWNYLTTPYLLTREGVAV

SEQ ID NO: 1508372 - protein, 19 aa, Mycobacterium tuberculosis
VYKMPWGTMHPTTISAPIV

SEQ ID NO: 1508373 - protein, 18 aa, Mycobacterium tuberculosis
VYRVGQNVAWQRWTEIAF

SEQ ID NO: 1508374 - protein, 18 aa, Mycobacterium tuberculosis
WAARRSGLYYVPINTHLT

SEQ ID NO: 1508375 - protein, 22 aa, Mycobacterium tuberculosis
WACGVTVVLPPPGTVGAVDCRG

SEQ ID NO: 1508376 - protein, 20 aa, Mycobacterium tuberculosis
WAGPIANWVAACDAMIALDA

SEQ ID NO: 1508377 - protein, 17 aa, Mycobacterium tuberculosis
WCVRLVQGGGFAGPLFD

SEQ ID NO: 1508378 - protein, 31 aa, Mycobacterium tuberculosis; identical to SEQ ID NO: 224465

SEQ ID NO: 1508379 - protein, 17 aa, Mycobacterium tuberculosis
WFMEAWDSTPRIAFLSP

SEQ ID NO: 1508380 - protein, 29 aa, Mycobacterium tuberculosis
WGVGFFDGAIPRRWRSPAPLWGDTSFHSV

SEQ ID NO: 1508381 - protein, 17 aa, Mycobacterium tuberculosis
WHEGWFANTIHAATPAG

SEQ ID NO: 1508382 - protein, 25 aa, Mycobacterium tuberculosis
WKASLQGVLATRPDFVFGAEPYNAD

SEQ ID NO: 1508383 - protein, 17 aa, Mycobacterium tuberculosis
WKGYLKPGSRDDASEIH

SEQ ID NO: 1508384 - protein, 19 aa, Mycobacterium tuberculosis
WLVAADGLHSAVRRAVGIK

SEQ ID NO: 1508385 - protein, 26 aa, Mycobacterium tuberculosis
WMYEGKHVLIIFDDLTKQAEAYRAIS

SEQ ID NO: 1508386 - protein, 20 aa, Mycobacterium tuberculosis
WNEITPCNLSLDRLANAVKE

SEQ ID NO: 1508387 - protein, 25 aa, Mycobacterium tuberculosis
WPGAYGTWWQADPSADLILLYLIQH

SEQ ID NO: 1508388 - protein, 21 aa, Mycobacterium tuberculosis
WPGRRFEGAGPAGWIRRCATS

SEQ ID NO: 1508389 - protein, 19 aa, Mycobacterium tuberculosis
WQRLCTELELPALHVPPEH

SEQ ID NO: 1508390 - protein, 25 aa, Mycobacterium tuberculosis
WRDYFDVYDMFKGLLRGLVALVVPS

SEQ ID NO: 1508391 - protein, 18 aa, Mycobacterium tuberculosis
WTGTVRIAGFYASICNAV

SEQ ID NO: 1508392 - protein, 20 aa, Mycobacterium tuberculosis
WTQRLVSLLVFDGPDLPGPL

SEQ ID NO: 1508393 - protein, 35 aa, Mycobacterium tuberculosis; identical to SEQ ID NO: 224529

SEQ ID NO: 1508394 - protein, 20 aa, Mycobacterium tuberculosis
WVTGLFSRGWSNLESFFAGV

SEQ ID NO: 1508395 - protein, 20 aa, Mycobacterium tuberculosis
YAFSAGGPVLWPDLEAILVV

SEQ ID NO: 1508396 - protein, 17 aa, Mycobacterium tuberculosis
YARGVLVEMYREAKTRL

SEQ ID NO: 1508397 - protein, 23 aa, Mycobacterium tuberculosis
YARVCVDLLKPRKAQPLLPGIGK

SEQ ID NO: 1508398 - protein, 17 aa, Mycobacterium tuberculosis
YCIQALAHWQRHSGTSL

SEQ ID NO: 1508399 - protein, 18 aa, Mycobacterium tuberculosis
YGFVAFDVDPGQPGGTTS

SEQ ID NO: 1508400 - protein, 19 aa, Mycobacterium tuberculosis
YGLTVPPPVIAENRAELMI

SEQ ID NO: 1508401 - protein, 26 aa, Mycobacterium tuberculosis
YGQAKLANLLFTYELQRRLAPGGTTI

SEQ ID NO: 1508402 - protein, 25 aa, Mycobacterium tuberculosis
YGQAKLANLLFTYELQRRLGEAGKS

SEQ ID NO: 1508403 - protein, 21 aa, Mycobacterium tuberculosis
YGQRLAAFVVLKPGVSATPET

SEQ ID NO: 1508404 - protein, 17 aa, Mycobacterium tuberculosis
YGVLYHLSRPAEALAWM

SEQ ID NO: 1508405 - protein, 22 aa, Mycobacterium tuberculosis
YHFLCPNYVFPYEPHFNIPTFF

SEQ ID NO: 1508406 - protein, 18 aa, Mycobacterium tuberculosis
YKLFKRYASHEGGIADPA

SEQ ID NO: 1508407 - protein, 17 aa, Mycobacterium tuberculosis
YLDRRNNVLKLSQGEFI

SEQ ID NO: 1508408 - protein, 18 aa, Mycobacterium tuberculosis
YLRCLRVLTAGRGYPMVA

SEQ ID NO: 1508409 - protein, 17 aa, Mycobacterium tuberculosis
YLVGGSVRDALLGRLSP

SEQ ID NO: 1508410 - protein, 33 aa, Mycobacterium tuberculosis; identical to SEQ ID NO: 224648

SEQ ID NO: 1508411 - protein, 18 aa, Mycobacterium tuberculosis
YPGDAGVLAALLLNRISL

SEQ ID NO: 1508412 - protein, 20 aa, Mycobacterium tuberculosis
YQAVRTNFFDTYFASAVAAG

SEQ ID NO: 1508413 - protein, 18 aa, Mycobacterium tuberculosis
YQRFRGAEIAGLTAGLVG

SEQ ID NO: 1508414 - protein, 22 aa, Mycobacterium tuberculosis
YRKLRDAWLTARRDLVDRRNRA

SEQ ID NO: 1508415 - protein, 24 aa, Mycobacterium tuberculosis
YRLRDPLNRSLRYGVKTMFATAGA

SEQ ID NO: 1508416 - protein, 24 aa, Mycobacterium tuberculosis
YRPALQQVAAWYWTLKHPEQSGSV

SEQ ID NO: 1508417 - protein, 33 aa, Mycobacterium tuberculosis; identical to SEQ ID NO: 224681

SEQ ID NO: 1508418 - protein, 31 aa, Mycobacterium tuberculosis; identical to SEQ ID NO: 224682

SEQ ID NO: 1508419 - protein, 19 aa, Mycobacterium tuberculosis
YTGLIYRALGFPTRMFTVL

SEQ ID NO: 1508420 - protein, 35 aa, Mycobacterium tuberculosis; identical to SEQ ID NO: 224691

SEQ ID NO: 1508421 - protein, 30 aa, Mycobacterium tuberculosis; identical to SEQ ID NO: 224698

SEQ ID NO: 1508422 - protein, 27 aa, Mycobacterium tuberculosis
YVAVFDSFVERIVPGGALVVCTDDPGG

SEQ ID NO: 1508423 - protein, 24 aa, Mycobacterium tuberculosis
YVDWLPAALAMHRRRRRMRFMIKA

SEQ ID NO: 1508424 - protein, 18 aa, Mycobacterium tuberculosis
YVRKPPYFEGMTAKPEPV

SEQ ID NO: 1508425 - protein, 24 aa, Mycobacterium tuberculosis
YVRRAFSAPLRRAGAVLVTPVPHP

SEQ ID NO: 1508426 - protein, 18 aa, Mycobacterium tuberculosis
YVSMPLFHSNAVVAGWAP

SEQ ID NO: 1508427 - protein, 18 aa, Mycobacterium tuberculosis
AAAHWYTYRNRLAEAISV

SEQ ID NO: 1508428 - protein, 25 aa, Mycobacterium tuberculosis
AAALVAERLAPGAHRWWQAGHRSSE

SEQ ID NO: 1508429 - protein, 17 aa, Mycobacterium tuberculosis
AAESLVRQLLTQQYHLL

SEQ ID NO: 1508430 - protein, 31 aa, Mycobacterium tuberculosis
AAEYGRLRHGQILFTFLHLAASRACTDALLD

SEQ ID NO: 1508431 - protein, 25 aa, Mycobacterium tuberculosis
AAFEAFARLYPATMLLVDTYDTLRG

SEQ ID NO: 1508432 - protein, 24 aa, Mycobacterium tuberculosis
AAGKRLPVPLFPGFDTLGTLEYIT

SEQ ID NO: 1508433 - protein, 25 aa, Mycobacterium tuberculosis
AAGRYVLDRAIFDALRRIDRGAGGE

SEQ ID NO: 1508434 - protein, 18 aa, Mycobacterium tuberculosis
AAGYAANLVVLDRDLRVT

SEQ ID NO: 1508435 - protein, 18 aa, Mycobacterium tuberculosis
AALAFEQAYAMTLPPPVV

SEQ ID NO: 1508436 - protein, 34 aa, Mycobacterium tuberculosis; identical to SEQ ID NO: 215518

SEQ ID NO: 1508437 - protein, 22 aa, Mycobacterium tuberculosis
AALRALRYRVAHGPGVALAKLR

SEQ ID NO: 1508438 - protein, 26 aa, Mycobacterium tuberculosis
AALRDLVARRTPLFEFAIRAAIAEMD

SEQ ID NO: 1508439 - protein, 24 aa, Mycobacterium tuberculosis
AANSSPLQIVGQTALDAINSPVQT

SEQ ID NO: 1508440 - protein, 20 aa, Mycobacterium tuberculosis
AAPGWLVSPGVRTALPANGF

SEQ ID NO: 1508441 - protein, 26 aa, Mycobacterium tuberculosis
AAQYRQFVMATLFHKTRSWSNLLKVT

SEQ ID NO: 1508442 - protein, 27 aa, Mycobacterium tuberculosis
AARITTPLLPDDYLHLANPLWSARELR

SEQ ID NO: 1508443 - protein, 17 aa, Mycobacterium tuberculosis
AARQYGIPTFGTMAHSF

SEQ ID NO: 1508444 - protein, 18 aa, Mycobacterium tuberculosis
AASWQRLRTAPATVPLAR

SEQ ID NO: 1508445 - protein, 26 aa, Mycobacterium tuberculosis
AATHRFIAHLPGYQGWQWAVVVASYS

SEQ ID NO: 1508446 - protein, 19 aa, Mycobacterium tuberculosis
AATVLPYRQFHDVAENFRY

SEQ ID NO: 1508447 - protein, 24 aa, Mycobacterium tuberculosis
AAVGSDFIICYRLSMADYVAEGQS

SEQ ID NO: 1508448 - protein, 21 aa, Mycobacterium tuberculosis
ACGLRRLIPLYATVETALAPP

SEQ ID NO: 1508449 - protein, 22 aa, Mycobacterium tuberculosis
ADAHCALWRALIGLDSMERISI

SEQ ID NO: 1508450 - protein, 25 aa, Mycobacterium tuberculosis
ADIADQLARRRLGYGRGARMTFERD

SEQ ID NO: 1508451 - protein, 17 aa, Mycobacterium tuberculosis
ADKYLYFTTESPAVHSV

SEQ ID NO: 1508452 - protein, 25 aa, Mycobacterium tuberculosis
ADRHPGWHALRKIAARITTPLLPDD

SEQ ID NO: 1508453 - protein, 23 aa, Mycobacterium tuberculosis
ADVMARVIGFHLNRGVLAAARRV

SEQ ID NO: 1508454 - protein, 19 aa, Mycobacterium tuberculosis
ADYGFAWRDIARVVGVSVP

SEQ ID NO: 1508455 - protein, 27 aa, Mycobacterium tuberculosis
AEAAAVYDLFVKTLGVSAGTYAATEAA

SEQ ID NO: 1508456 - protein, 26 aa, Mycobacterium tuberculosis
AEAADLGQRRALTGEPLPPLLTATAK

SEQ ID NO: 1508457 - protein, 27 aa, Mycobacterium tuberculosis
AEHDLLPDVLYTSLLRRAITTAHLALD

SEQ ID NO: 1508458 - protein, 20 aa, Mycobacterium tuberculosis
AEHGLWYPPDPSSFEICSIG

SEQ ID NO: 1508459 - protein, 25 aa, Mycobacterium tuberculosis
AEHLVRGRFVLVGVTPAVLASLLGE

SEQ ID NO: 1508460 - protein, 18 aa, Mycobacterium tuberculosis
AEILKIITGGRVIWDPEA

SEQ ID NO: 1508461 - protein, 24 aa, Mycobacterium tuberculosis
AEIRRRLKSFTVFRQRGDAFADRL

SEQ ID NO: 1508462 - protein, 19 aa, Mycobacterium tuberculosis
AELPTIRAQIARMGTTLAA

SEQ ID NO: 1508463 - protein, 24 aa, Mycobacterium tuberculosis
AEMARGQYWIHPALPEVVENALLG

SEQ ID NO: 1508464 - protein, 32 aa, Mycobacterium tuberculosis; identical to SEQ ID NO: 215755

SEQ ID NO: 1508465 - protein, 26 aa, Mycobacterium tuberculosis
AESMDTEWPLPLLDLARIASDRGDAE

SEQ ID NO: 1508466 - protein, 23 aa, Mycobacterium tuberculosis
AESPIDWDIAWPAGDLQVNLTPA

SEQ ID NO: 1508467 - protein, 24 aa, Mycobacterium tuberculosis
AFEIDLRRLLYREAQQRGIYALGA

SEQ ID NO: 1508468 - protein, 25 aa, Mycobacterium tuberculosis
AFGASFLARIFPPGSHIPIPFIEYT

SEQ ID NO: 1508469 - protein, 27 aa, Mycobacterium tuberculosis
AFIGRLLELAPFRKIVYSSDGFGPAEL

SEQ ID NO: 1508470 - protein, 30 aa, Mycobacterium tuberculosis; identical to SEQ ID NO: 215792

SEQ ID NO: 1508471 - protein, 33 aa, Mycobacterium tuberculosis; identical to SEQ ID NO: 215793

SEQ ID NO: 1508472 - protein, 17 aa, Mycobacterium tuberculosis
AFVSERIGLAAQAYSSA

SEQ ID NO: 1508473 - protein, 25 aa, Mycobacterium tuberculosis
AGETGLRPDFPRPALLSGAGDAVEF

SEQ ID NO: 1508474 - protein, 25 aa, Mycobacterium tuberculosis
AGGRPLPLYCASLRTAEPRLLERLG

SEQ ID NO: 1508475 - protein, 21 aa, Mycobacterium tuberculosis
AGHNFPLACPGLLGAMTVGAT

SEQ ID NO: 1508476 - protein, 20 aa, Mycobacterium tuberculosis
AGLDRAALPALRHVVRVPVE

SEQ ID NO: 1508477 - protein, 22 aa, Mycobacterium tuberculosis
AGLTASRFVACPFGGSGARMYR

SEQ ID NO: 1508478 - protein, 24 aa, Mycobacterium tuberculosis
AGVFKRHRQIDRPCLLGYIDKCSA

SEQ ID NO: 1508479 - protein, 19 aa, Mycobacterium tuberculosis
AGVPDLRRLFPTGFDEQRR

SEQ ID NO: 1508480 - protein, 25 aa, Mycobacterium tuberculosis
AGVPKTLIQHLIRWVISAGEFGEKV

SEQ ID NO: 1508481 - protein, 36 aa, Mycobacterium tuberculosis; identical to SEQ ID NO: 215949

SEQ ID NO: 1508482 - protein, 22 aa, Mycobacterium tuberculosis
AHFAAHAAMYQSVSARAAAIHD

SEQ ID NO: 1508483 - protein, 17 aa, Mycobacterium tuberculosis
AHTDQWRYDGYGADKLA

SEQ ID NO: 1508484 - protein, 17 aa, Mycobacterium tuberculosis
AHTLGLHGPAMTFDTAC

SEQ ID NO: 1508485 - protein, 19 aa, Mycobacterium tuberculosis
AHVDLYFEAAVAGAIPVIR

SEQ ID NO: 1508486 - protein, 20 aa, Mycobacterium tuberculosis
AIIANRVSFAFGLRGPSVTI

SEQ ID NO: 1508487 - protein, 28 aa, Mycobacterium tuberculosis
AILNGRRDLFRPAVFRSLWGRVEDAISA

SEQ ID NO: 1508488 - protein, 18 aa, Mycobacterium tuberculosis
AIPVVSFRLAGDRGYTEF

SEQ ID NO: 1508489 - protein, 32 aa, Mycobacterium tuberculosis
AISRANAEALVPITALLPAGADDVSAAIAALF

SEQ ID NO: 1508490 - protein, 17 aa, Mycobacterium tuberculosis
AKGLEWDAVFLVGLADG

SEQ ID NO: 1508491 - protein, 18 aa, Mycobacterium tuberculosis
AKVARGLVMAVRRAVRQQ

SEQ ID NO: 1508492 - protein, 26 aa, Mycobacterium tuberculosis
ALAARAAPLVAILWGRDASTLKPMLA

SEQ ID NO: 1508493 - protein, 31 aa, Mycobacterium tuberculosis; identical to SEQ ID NO: 216046

SEQ ID NO: 1508494 - protein, 24 aa, Mycobacterium tuberculosis
ALAGHLAAILYDIPHVLTAHSLEP

SEQ ID NO: 1508495 - protein, 26 aa, Mycobacterium tuberculosis
ALATPRRHLSYKTGWYGSSLVVADRW

SEQ ID NO: 1508496 - protein, 24 aa, Mycobacterium tuberculosis
ALDMYFNLANYRNNWKRLGFTDDE

SEQ ID NO: 1508497 - protein, 27 aa, Mycobacterium tuberculosis
ALESVLTVLTLRDGVIPPTLNYETPDP

SEQ ID NO: 1508498 - protein, 21 aa, Mycobacterium tuberculosis
ALFSQLVAGPIRRIIDGADEV

SEQ ID NO: 1508499 - protein, 21 aa, Mycobacterium tuberculosis
ALHALGPQWVLVKGGHLRSSD

SEQ ID NO: 1508500 - protein, 23 aa, Mycobacterium tuberculosis
ALMRPRIASRVLGKWARTRLSGQ

SEQ ID NO: 1508501 - protein, 27 aa, Mycobacterium tuberculosis
ALPEPARRLAAVARLRLLCRGSGITDV

SEQ ID NO: 1508502 - protein, 18 aa, Mycobacterium tuberculosis
ALPPYRYSQRELTDSFVS

SEQ ID NO: 1508503 - protein, 30 aa, Mycobacterium tuberculosis; identical to SEQ ID NO: 224794

SEQ ID NO: 1508504 - protein, 27 aa, Mycobacterium tuberculosis
ALRAYWELPAMMLQFLRTGSGATRPAL

SEQ ID NO: 1508505 - protein, 25 aa, Mycobacterium tuberculosis
ALRHPMLRVQFLPDGTQRIPPAAGS

SEQ ID NO: 1508506 - protein, 22 aa, Mycobacterium tuberculosis
ALRVVILHRPGAELRRLTPRNT

SEQ ID NO: 1508507 - protein, 22 aa, Mycobacterium tuberculosis
ALVACFVGPVPAGWRTIGRVLD

SEQ ID NO: 1508508 - protein, 26 aa, Mycobacterium tuberculosis
AMARTCVDAGWLLSLSGTVSFRNARE

SEQ ID NO: 1508509 - protein, 20 aa, Mycobacterium tuberculosis
AMGWSPFYPQFDRSSLDVAD

SEQ ID NO: 1508510 - protein, 22 aa, Mycobacterium tuberculosis
AMVIDLLLKRAASLGIQIRYET

SEQ ID NO: 1508511 - protein, 18 aa, Mycobacterium tuberculosis
ANAATMHALLNPGDTILG

SEQ ID NO: 1508512 - protein, 19 aa, Mycobacterium tuberculosis
ANRELTAELALALGAAAAR

SEQ ID NO: 1508513 - protein, 24 aa, Mycobacterium tuberculosis
ANSWVDVFAHWRRAQGLPVSAIAW

SEQ ID NO: 1508514 - protein, 18 aa, Mycobacterium tuberculosis
APLALAMALGRVPAPLRP

SEQ ID NO: 1508515 - protein, 17 aa, Mycobacterium tuberculosis
APNPLYYWRTQQDAELD

SEQ ID NO: 1508516 - protein, 23 aa, Mycobacterium tuberculosis
APRLLLEVVCARLLLPSASDAES

SEQ ID NO: 1508517 - protein, 24 aa, Mycobacterium tuberculosis
APVAVPWVLAARSPQALTNQAGRL

SEQ ID NO: 1508518 - protein, 25 aa, Mycobacterium tuberculosis
AQCRDLLHWRFCRGVPPRATNDTDI

SEQ ID NO: 1508519 - protein, 19 aa, Mycobacterium tuberculosis
AQHIPLVVFGGKEYGSGSS

SEQ ID NO: 1508520 - protein, 25 aa, Mycobacterium tuberculosis
AQHNWAILHALPELVATGIPVLVGA

SEQ ID NO: 1508521 - protein, 23 aa, Mycobacterium tuberculosis
AQHRYWDRVLFDAGLSVITWPAK

SEQ ID NO: 1508522 - protein, 24 aa, Mycobacterium tuberculosis
AQLPVAPMGFIETRYYVSMNVADK

SEQ ID NO: 1508523 - protein, 26 aa, Mycobacterium tuberculosis
AQQDRLGRLILLAQAGALLDRRIAEL

SEQ ID NO: 1508524 - protein, 25 aa, Mycobacterium tuberculosis
AQVLDPQHRLFLQCAWHALEDAGAD

SEQ ID NO: 1508525 - protein, 17 aa, Mycobacterium tuberculosis
AQVRGWLADNLAGEFAA

SEQ ID NO: 1508526 - protein, 24 aa, Mycobacterium tuberculosis
ARANRLAHWFRQAGLREDDVVAIL

SEQ ID NO: 1508527 - protein, 29 aa, Mycobacterium tuberculosis
ARANVSYPTDLGLLAKAMRRIAATGKRIQ

SEQ ID NO: 1508528 - protein, 22 aa, Mycobacterium tuberculosis
ARFEFRWNDQFALSLDPDTARE

SEQ ID NO: 1508529 - protein, 20 aa, Mycobacterium tuberculosis
ARIAALLHRAAPDTQLVTII

SEQ ID NO: 1508530 - protein, 25 aa, Mycobacterium tuberculosis
ARLVWSGHWTTFSGPDFWVTVVGPA

SEQ ID NO: 1508531 - protein, 29 aa, Mycobacterium tuberculosis
ARMLESLDGWPVNFALLGKGNTVNPDALW

SEQ ID NO: 1508532 - protein, 20 aa, Mycobacterium tuberculosis
ARMYRTGDLVCWRADGQLEF

SEQ ID NO: 1508533 - protein, 26 aa, Mycobacterium tuberculosis
ARRPDGRLLTHKLLSDNPARYRDAAV

SEQ ID NO: 1508534 - protein, 24 aa, Mycobacterium tuberculosis
ASDHVPFYIAARSPMLYVVCKGHS

SEQ ID NO: 1508535 - protein, 26 aa, Mycobacterium tuberculosis
ASGLDSRAWRLPWPDGTVVYELDQPK

SEQ ID NO: 1508536 - protein, 23 aa, Mycobacterium tuberculosis
ASMVAAVTPYVAWLSATAGQAEQ

SEQ ID NO: 1508537 - protein, 25 aa, Mycobacterium tuberculosis
ASPAGAYFKGGIAPVSVWVSTEYVR

SEQ ID NO: 1508538 - protein, 22 aa, Mycobacterium tuberculosis
ASRVELPLLSPARARSYCATVR

SEQ ID NO: 1508539 - protein, 31 aa, Mycobacterium tuberculosis; identical to SEQ ID NO: 216473

SEQ ID NO: 1508540 - protein, 31 aa, Mycobacterium tuberculosis; identical to SEQ ID NO: 216489

SEQ ID NO: 1508541 - protein, 23 aa, Mycobacterium tuberculosis
ATRKSLLEALLNPVPTGDLNLDE

SEQ ID NO: 1508542 - protein, 24 aa, Mycobacterium tuberculosis
AVDANALGAALWRGVELVVASMGG

SEQ ID NO: 1508543 - protein, 26 aa, Mycobacterium tuberculosis
AVLGRLPMRAWLIGLRPMEGSPEGHN

SEQ ID NO: 1508544 - protein, 18 aa, Mycobacterium tuberculosis
AVLTALDRLRFAAGNFYV

SEQ ID NO: 1508545 - protein, 19 aa, Mycobacterium tuberculosis
AVPRRPVIRPIPVDDSGFT

SEQ ID NO: 1508546 - protein, 36 aa, Mycobacterium tuberculosis; identical to SEQ ID NO: 216573

SEQ ID NO: 1508547 - protein, 26 aa, Mycobacterium tuberculosis
AVRRTPLLLDGVAVTAAALVAERLAP

SEQ ID NO: 1508548 - protein, 23 aa, Mycobacterium tuberculosis
AVVPAIVWCSAETQPQGWVRLRG

SEQ ID NO: 1508549 - protein, 17 aa, Mycobacterium tuberculosis
AVYECAVPVIAAVNGFC

SEQ ID NO: 1508550 - protein, 26 aa, Mycobacterium tuberculosis
AYPLGTAFRPKVWPAVRRIDGAYGDR

SEQ ID NO: 1508551 - protein, 25 aa, Mycobacterium tuberculosis
CCQYDPLMSPLVWDLAHIGQQEELW

SEQ ID NO: 1508552 - protein, 17 aa, Mycobacterium tuberculosis
CGLAPSSIYWHFGSKEG

SEQ ID NO: 1508553 - protein, 27 aa, Mycobacterium tuberculosis
CLPSDRLLNLLIYIKGYLDGTLTFRRS

SEQ ID NO: 1508554 - protein, 21 aa, Mycobacterium tuberculosis
CPELGLRPLLPRLDTAERALR

SEQ ID NO: 1508555 - protein, 25 aa, Mycobacterium tuberculosis
CRHNLGYWDGGQWWGAGPGAHGYIG

SEQ ID NO: 1508556 - protein, 22 aa, Mycobacterium tuberculosis
CVRATWLKVVPDQLGRSLEFYR

SEQ ID NO: 1508557 - protein, 20 aa, Mycobacterium tuberculosis
CYGLSVAALMKWHLPRLEVL

SEQ ID NO: 1508558 - protein, 34 aa, Mycobacterium tuberculosis; identical to SEQ ID NO: 216716

SEQ ID NO: 1508559 - protein, 25 aa, Mycobacterium tuberculosis
DAFGIPLVVVVDVPGYLPGVDQEWG

SEQ ID NO: 1508560 - protein, 22 aa, Mycobacterium tuberculosis
DAGRINHAYLFSGPRGCGKTSS

SEQ ID NO: 1508561 - protein, 36 aa, Mycobacterium tuberculosis; identical to SEQ ID NO: 113659

SEQ ID NO: 1508562 - protein, 35 aa, Mycobacterium tuberculosis; identical to SEQ ID NO: 216771

SEQ ID NO: 1508563 - protein, 21 aa, Mycobacterium tuberculosis
DDGVLVCVAQCRPNTGPTVVH

SEQ ID NO: 1508564 - protein, 21 aa, Mycobacterium tuberculosis
DDLQWERRYRRVAAYGQAKLA

SEQ ID NO: 1508565 - protein, 20 aa, Mycobacterium tuberculosis
DDPALLLKTAAEIAARPAGP

SEQ ID NO: 1508566 - protein, 22 aa, Mycobacterium tuberculosis
DDVTVVFERPPSTAIPSSVVEV

SEQ ID NO: 1508567 - protein, 35 aa, Mycobacterium tuberculosis; identical to SEQ ID NO: 216820

SEQ ID NO: 1508568 - protein, 17 aa, Mycobacterium tuberculosis
DDVVRGLRITPQQLRDI

SEQ ID NO: 1508569 - protein, 23 aa, Mycobacterium tuberculosis
DDWPGMFLLAAASFTDFIGPESA

SEQ ID NO: 1508570 - protein, 26 aa, Mycobacterium tuberculosis
DEAAEMMINLFWLGLKGAPVDRLETG

SEQ ID NO: 1508571 - protein, 25 aa, Mycobacterium tuberculosis
DEERLAFYRTLYRDHARYGAALWLV

SEQ ID NO: 1508572 - protein, 20 aa, Mycobacterium tuberculosis
DEFARRLPFMAAKRAFSEPV

SEQ ID NO: 1508573 - protein, 27 aa, Mycobacterium tuberculosis
DEQMSALLMAIVWRGMDRGEIARWTAA

SEQ ID NO: 1508574 - protein, 25 aa, Mycobacterium tuberculosis
DERDPELMWGLRGGGGNFGIVTEFE

SEQ ID NO: 1508575 - protein, 25 aa, Mycobacterium tuberculosis
DETTLGKWWRDMKLARVGGGTDEVL

SEQ ID NO: 1508576 - protein, 22 aa, Mycobacterium tuberculosis
DEVKVPVRWWHGDHDHIVPFSH

SEQ ID NO: 1508577 - protein, 26 aa, Mycobacterium tuberculosis
DEWERRAIAVFGHRPYIGVSANIVAA

SEQ ID NO: 1508578 - protein, 21 aa, Mycobacterium tuberculosis
DFFEGVMMPELFMADAMGATG

SEQ ID NO: 1508579 - protein, 33 aa, Mycobacterium tuberculosis; identical to SEQ ID NO: 216881

SEQ ID NO: 1508580 - protein, 24 aa, Mycobacterium tuberculosis
DGGLSVHYLGARSPAFIGRLLELA

SEQ ID NO: 1508581 - protein, 24 aa, Mycobacterium tuberculosis
DGLVRFIDACHARRLGVLIDAVFN

SEQ ID NO: 1508582 - protein, 27 aa, Mycobacterium tuberculosis
DGPVEPGPALVLPLRAADTVAGVLVAL

SEQ ID NO: 1508583 - protein, 17 aa, Mycobacterium tuberculosis
DGRFIPAGPSGSPLRGL

SEQ ID NO: 1508584 - protein, 26 aa, Mycobacterium tuberculosis
DGRFVGFADFLIRDGHRYRVADTKLA

SEQ ID NO: 1508585 - protein, 18 aa, Mycobacterium tuberculosis
DGSYIITGGLGGLGLFLA

SEQ ID NO: 1508586 - protein, 20 aa, Mycobacterium tuberculosis
DHTIAYYPPAFSTAAQEQLS

SEQ ID NO: 1508587 - protein, 22 aa, Mycobacterium tuberculosis
DHVIQRLFAVGLTLQGAAPRAR

SEQ ID NO: 1508588 - protein, 28 aa, Mycobacterium tuberculosis
DHVVALTREVLGAGIPLFGICFGNQILG

SEQ ID NO: 1508589 - protein, 20 aa, Mycobacterium tuberculosis
DHYRPISWDAAYQLIAEQLN

SEQ ID NO: 1508590 - protein, 29 aa, Mycobacterium tuberculosis
DILDRAGAPVLFAAGLFLGADRAAGLDRA

SEQ ID NO: 1508591 - protein, 25 aa, Mycobacterium tuberculosis
DIPTQWRNQPLGWYTQGLAPYLPGL

SEQ ID NO: 1508592 - protein, 19 aa, Mycobacterium tuberculosis
DITVITPVFNTGGEDVLFF

SEQ ID NO: 1508593 - protein, 18 aa, Mycobacterium tuberculosis
DKVPALNPHQIDDLMMGC

SEQ ID NO: 1508594 - protein, 18 aa, Mycobacterium tuberculosis
DLAEVWFGTGRNAQVDAV

SEQ ID NO: 1508595 - protein, 21 aa, Mycobacterium tuberculosis
DLDVLLLHDGKPADILRPVAD

SEQ ID NO: 1508596 - protein, 23 aa, Mycobacterium tuberculosis
DLPRRYYRAIAKMADTAWFVIRE

SEQ ID NO: 1508597 - protein, 17 aa, Mycobacterium tuberculosis
DLRIALVARRHIDLKRV

SEQ ID NO: 1508598 - protein, 32 aa, Mycobacterium tuberculosis; identical to SEQ ID NO: 217070

SEQ ID NO: 1508599 - protein, 22 aa, Mycobacterium tuberculosis
DNALPPLQETLLRAFDLAASTA

SEQ ID NO: 1508600 - protein, 19 aa, Mycobacterium tuberculosis
DNEPDWVNTIFLSTRFRAW

SEQ ID NO: 1508601 - protein, 23 aa, Mycobacterium tuberculosis
DNPVNWPRVLTVWRANLIGSSGK

SEQ ID NO: 1508602 - protein, 17 aa, Mycobacterium tuberculosis
DNTLVFYIWGDNGASME

SEQ ID NO: 1508603 - protein, 21 aa, Mycobacterium tuberculosis
DPARPLTVTGGLTFAGGPWSN

SEQ ID NO: 1508604 - protein, 24 aa, Mycobacterium tuberculosis
DPDDVTVRFLLTAGAIGSLFKERA

SEQ ID NO: 1508605 - protein, 37 aa, Mycobacterium tuberculosis; identical to SEQ ID NO: 217100

SEQ ID NO: 1508606 - protein, 27 aa, Mycobacterium tuberculosis
DQLTIAARTKGISIRRAPGPSWYHFTL

SEQ ID NO: 1508607 - protein, 22 aa, Mycobacterium tuberculosis
DQPRPLVPAMFSAVLSRLRRTH

SEQ ID NO: 1508608 - protein, 19 aa, Mycobacterium tuberculosis
DRDDPFWDRLRFPAALDRV

SEQ ID NO: 1508609 - protein, 38 aa, Mycobacterium tuberculosis
DRFVSAAPEITPFALTLRLLVIALKHNVILNSTWVDSG

SEQ ID NO: 1508610 - protein, 18 aa, Mycobacterium tuberculosis
DRLRNLAAIKDVAARPTR

SEQ ID NO: 1508611 - protein, 25 aa, Mycobacterium tuberculosis
DRQRHASLLPLLHNYREPAKPICGS

SEQ ID NO: 1508612 - protein, 26 aa, Mycobacterium tuberculosis
DRVYFPDMELLYADIPAHKRKSFEAF

SEQ ID NO: 1508613 - protein, 21 aa, Mycobacterium tuberculosis
DRWATLDPIPRYRTYLQDQGL

SEQ ID NO: 1508614 - protein, 24 aa, Mycobacterium tuberculosis
DSEDETFWRGFLTSLKGRGLGGVR

SEQ ID NO: 1508615 - protein, 25 aa, Mycobacterium tuberculosis
DSEEAVLALYRYLGRTPSRLLAVAL

SEQ ID NO: 1508616 - protein, 24 aa, Mycobacterium tuberculosis
DSMTLYGFPDGETRDLFLTLLSVS

SEQ ID NO: 1508617 - protein, 22 aa, Mycobacterium tuberculosis
DSPLVRQIFIYGNSARAYPLAV

SEQ ID NO: 1508618 - protein, 21 aa, Mycobacterium tuberculosis
DTAILPNGWRDRLVSWTVESS

SEQ ID NO: 1508619 - protein, 25 aa, Mycobacterium tuberculosis
DTDLAWSRITYWRALLTSAVDQPPH

SEQ ID NO: 1508620 - protein, 24 aa, Mycobacterium tuberculosis
DTDQIIPAVFLKRVTRTGFEDGLF

SEQ ID NO: 1508621 - protein, 21 aa, Mycobacterium tuberculosis
DTFCPVGPWIVTDLAPFDPAD

SEQ ID NO: 1508622 - protein, 29 aa, Mycobacterium tuberculosis
DTLVRMAQPWSLRYPLVDGQGNFGSPGND

SEQ ID NO: 1508623 - protein, 25 aa, Mycobacterium tuberculosis
DTPVLPPLDVAASAELLLLAVTDSE

SEQ ID NO: 1508624 - protein, 24 aa, Mycobacterium tuberculosis
DTTNVVTAWRLLRSVDPHLRTRRV

SEQ ID NO: 1508625 - protein, 22 aa, Mycobacterium tuberculosis
DVAAKRIAWIKLLNAGQTCVAP

SEQ ID NO: 1508626 - protein, 22 aa, Mycobacterium tuberculosis
DVAIKRPIFVTGLVRTGTTALH

SEQ ID NO: 1508627 - protein, 26 aa, Mycobacterium tuberculosis
DVARVFLGSWSGKIIRYSPVPVLVLP

SEQ ID NO: 1508628 - protein, 28 aa, Mycobacterium tuberculosis
DVDKKRPFYFGVLTWYMDRVLELVHDDL

SEQ ID NO: 1508629 - protein, 28 aa, Mycobacterium tuberculosis
DVDTEITRLVPFIEWLRGAYPDQLISVD

SEQ ID NO: 1508630 - protein, 24 aa, Mycobacterium tuberculosis
DVELRIPKLRKGSFFPAILEPRRR

SEQ ID NO: 1508631 - protein, 22 aa, Mycobacterium tuberculosis
DVHLPFQLHVLDMAADRVSHVV

SEQ ID NO: 1508632 - protein, 19 aa, Mycobacterium tuberculosis
DVIRFWLGLGIDGFRLDAV

SEQ ID NO: 1508633 - protein, 41 aa, Mycobacterium tuberculosis; identical to SEQ ID NO: 217302

SEQ ID NO: 1508634 - protein, 25 aa, Mycobacterium tuberculosis
DVSDFGHRLLAYLRAADAGAELLIL

SEQ ID NO: 1508635 - protein, 19 aa, Mycobacterium tuberculosis
DVVPPGDLRMALAALASDS

SEQ ID NO: 1508636 - protein, 21 aa, Mycobacterium tuberculosis
DVWELYYLPDDFSQAKNLAAE

SEQ ID NO: 1508637 - protein, 18 aa, Mycobacterium tuberculosis
DWKSRWYADKQYAEYVKE

SEQ ID NO: 1508638 - protein, 26 aa, Mycobacterium tuberculosis
DYNLQFLDHIVAHPTIRWVGSANELN

SEQ ID NO: 1508639 - protein, 25 aa, Mycobacterium tuberculosis
DYTTIDIALIRLGAVSVPLQTSAPV

SEQ ID NO: 1508640 - protein, 23 aa, Mycobacterium tuberculosis
DYVINGRKWWTSGAADPRCKILI

SEQ ID NO: 1508641 - protein, 17 aa, Mycobacterium tuberculosis
DYYLKLAEQIVDAGAHV

SEQ ID NO: 1508642 - protein, 26 aa, Mycobacterium tuberculosis
EAAVAGAIPVIRPLTQSLAGDTVLRV

SEQ ID NO: 1508643 - protein, 21 aa, Mycobacterium tuberculosis
EAHLRRHAPWGAQVTVTRGEV

SEQ ID NO: 1508644 - protein, 20 aa, Mycobacterium tuberculosis
EAILTGWRMLLDEGRLQDGE

SEQ ID NO: 1508645 - protein, 17 aa, Mycobacterium tuberculosis
EARRGMALAAELCLPLV

SEQ ID NO: 1508646 - protein, 30 aa, Mycobacterium tuberculosis; identical to SEQ ID NO: 217402

SEQ ID NO: 1508647 - protein, 26 aa, Mycobacterium tuberculosis
EASAVALSLTPFTPSPSAAATPGGAV

SEQ ID NO: 1508648 - protein, 20 aa, Mycobacterium tuberculosis
EDHWYSTGADFKRPAPHWWF

SEQ ID NO: 1508649 - protein, 25 aa, Mycobacterium tuberculosis
EDLLGGIPLAGFFAAGEIGPVAGHN

SEQ ID NO: 1508650 - protein, 32 aa, Mycobacterium tuberculosis; identical to SEQ ID NO: 217437

SEQ ID NO: 1508651 - protein, 23 aa, Mycobacterium tuberculosis
EDSRLLTRELLYTAVTRAKRKVR

SEQ ID NO: 1508652 - protein, 25 aa, Mycobacterium tuberculosis
EDVFPLPRELVGEGTLFLLKVIGDS

SEQ ID NO: 1508653 - protein, 21 aa, Mycobacterium tuberculosis
EDYRTFWTQFGRVLKEGLLSD

SEQ ID NO: 1508654 - protein, 23 aa, Mycobacterium tuberculosis
EELIGQFGIGFYSSFMVADKVQL

SEQ ID NO: 1508655 - protein, 21 aa, Mycobacterium tuberculosis
EEPPPSTVFLLCAPSVDPEDI

SEQ ID NO: 1508656 - protein, 23 aa, Mycobacterium tuberculosis
EEVEVLRLSALRGLFSAVIEDAV

SEQ ID NO: 1508657 - protein, 40 aa, Mycobacterium tuberculosis; identical to SEQ ID NO: 217489

SEQ ID NO: 1508658 - protein, 35 aa, Mycobacterium tuberculosis; identical to SEQ ID NO: 217499

SEQ ID NO: 1508659 - protein, 20 aa, Mycobacterium tuberculosis
EFSETIRYFSTILAKHGVEV

SEQ ID NO: 1508660 - protein, 22 aa, Mycobacterium tuberculosis
EFTTRFGVARVCEFYAASEGNS

SEQ ID NO: 1508661 - protein, 18 aa, Mycobacterium tuberculosis
EGNAQNFRILTSLEPKVV

SEQ ID NO: 1508662 - protein, 24 aa, Mycobacterium tuberculosis
EGRDIGTVVFPDAPVKIFLTASAE

SEQ ID NO: 1508663 - protein, 26 aa, Mycobacterium tuberculosis
EGRPRLRYWLDRLSTDGILAHAAVVY

SEQ ID NO: 1508664 - protein, 18 aa, Mycobacterium tuberculosis
EHIVIVGSGFIAAEFAHV

SEQ ID NO: 1508665 - protein, 25 aa, Mycobacterium tuberculosis
EKEKWTKYFLDPAQIRLLRGLKQSA

SEQ ID NO: 1508666 - protein, 18 aa, Mycobacterium tuberculosis
ELFTALLLSLPGSPVLYY

SEQ ID NO: 1508667 - protein, 24 aa, Mycobacterium tuberculosis
ELGDTGRILLRPSGTEPMIRVMVE

SEQ ID NO: 1508668 - protein, 32 aa, Mycobacterium tuberculosis; identical to SEQ ID NO: 217625

SEQ ID NO: 1508669 - protein, 27 aa, Mycobacterium tuberculosis
ELGYKLPSLLLPIWDSELGAGLIATLR

SEQ ID NO: 1508670 - protein, 18 aa, Mycobacterium tuberculosis
ELLSYRQTFDLRRATLTR

SEQ ID NO: 1508671 - protein, 17 aa, Mycobacterium tuberculosis
EMWLRADGRQRVRVGAL

SEQ ID NO: 1508672 - protein, 31 aa, Mycobacterium tuberculosis; identical to SEQ ID NO: 217697

SEQ ID NO: 1508673 - protein, 21 aa, Mycobacterium tuberculosis
EPGALIIAWIDDERPAGGHIQ

SEQ ID NO: 1508674 - protein, 25 aa, Mycobacterium tuberculosis
EPRVLQIRALVLGGALDWLKDNKAS

SEQ ID NO: 1508675 - protein, 24 aa, Mycobacterium tuberculosis
EQELDLVLAILRARQLFGGAHAIP

SEQ ID NO: 1508676 - protein, 20 aa, Mycobacterium tuberculosis
EQLEIELNWIDEHIGDHPYG

SEQ ID NO: 1508677 - protein, 17 aa, Mycobacterium tuberculosis
ERATTCAPLTWPEGWRR

SEQ ID NO: 1508678 - protein, 31 aa, Mycobacterium tuberculosis
ERFLAGPGLVYLLWPVALGYLRVVTHPTLLG

SEQ ID NO: 1508679 - protein, 24 aa, Mycobacterium tuberculosis
ERGEVDVLPFQLVTMGQPIADFAN

SEQ ID NO: 1508680 - protein, 19 aa, Mycobacterium tuberculosis
ERMRLGALARHIAEELPLL

SEQ ID NO: 1508681 - protein, 24 aa, Mycobacterium tuberculosis
ERNRVLPLLGGLAVMFGDLPPLPT

SEQ ID NO: 1508682 - protein, 23 aa, Mycobacterium tuberculosis
ESEAFYMRVAAPGDLRCEGAQLG

SEQ ID NO: 1508683 - protein, 24 aa, Mycobacterium tuberculosis
ESPWALMHFMVRLPEVGVAGEGAA

SEQ ID NO: 1508684 - protein, 19 aa, Mycobacterium tuberculosis
ESTLRYWRYWAPVRAAIAL

SEQ ID NO: 1508685 - protein, 17 aa, Mycobacterium tuberculosis
ESVPLTFPSLVESGSRT

SEQ ID NO: 1508686 - protein, 24 aa, Mycobacterium tuberculosis
EVAAMMKATLPRAFIIGPDGSTTV

SEQ ID NO: 1508687 - protein, 19 aa, Mycobacterium tuberculosis
EVPGTIVSVLRAAAGAVDQ

SEQ ID NO: 1508688 - protein, 21 aa, Mycobacterium tuberculosis
EWQRLMVALSAFDLIESTASH

SEQ ID NO: 1508689 - protein, 24 aa, Mycobacterium tuberculosis
FAAACLPYLSWLTQASADCAAAAA

SEQ ID NO: 1508690 - protein, 17 aa, Mycobacterium tuberculosis
FADDPALLLKTAAEIAA

SEQ ID NO: 1508691 - protein, 26 aa, Mycobacterium tuberculosis
FADQRTFGGWLLADLVTVDGSVVPVP

SEQ ID NO: 1508692 - protein, 21 aa, Mycobacterium tuberculosis
FADVLIAFGRFPIIDDREPQL

SEQ ID NO: 1508693 - protein, 21 aa, Mycobacterium tuberculosis
FAEELVRIIGVLRGMQLKKVP

SEQ ID NO: 1508694 - protein, 22 aa, Mycobacterium tuberculosis
FAQALRLALIDAAPDVAQDPVV

SEQ ID NO: 1508695 - protein, 24 aa, Mycobacterium tuberculosis
FATLPSMMHITLNAILRAIFGAGG

SEQ ID NO: 1508696 - protein, 17 aa, Mycobacterium tuberculosis
FDDLRLEHGRLDQPIPV

SEQ ID NO: 1508697 - protein, 26 aa, Mycobacterium tuberculosis
FDPRPPMITSGLRIGTPALAARGFSH

SEQ ID NO: 1508698 - protein, 19 aa, Mycobacterium tuberculosis
FFHQVLPGRVAPLGSPGGA

SEQ ID NO: 1508699 - protein, 18 aa, Mycobacterium tuberculosis
FGAAGEGCLLLVYPNVIA

SEQ ID NO: 1508700 - protein, 17 aa, Mycobacterium tuberculosis
FGAPPPDVVQRLSALGL

SEQ ID NO: 1508701 - protein, 25 aa, Mycobacterium tuberculosis
FGEQKARIFLALLGKQYGVTPKGWQ

SEQ ID NO: 1508702 - protein, 24 aa, Mycobacterium tuberculosis
FGPEVKRRIMIGTYALSAGYYDAY

SEQ ID NO: 1508703 - protein, 25 aa, Mycobacterium tuberculosis
FHMNEGHAGFLGIERIRELVTDAGL

SEQ ID NO: 1508704 - protein, 18 aa, Mycobacterium tuberculosis
FISARWQADFRADVPVLL

SEQ ID NO: 1508705 - protein, 19 aa, Mycobacterium tuberculosis
FITASTFLVDGGISSAYVT

SEQ ID NO: 1508706 - protein, 18 aa, Mycobacterium tuberculosis
FKVDMAAQYRIRLGGTWK

SEQ ID NO: 1508707 - protein, 17 aa, Mycobacterium tuberculosis
FKWIARSADGWITTPRD

SEQ ID NO: 1508708 - protein, 19 aa, Mycobacterium tuberculosis
FLAEPWWCRMVVMSAERIA

SEQ ID NO: 1508709 - protein, 26 aa, Mycobacterium tuberculosis
FLESLRYDLAVQEIFVFTPKGDVITL

SEQ ID NO: 1508710 - protein, 17 aa, Mycobacterium tuberculosis
FLPAILAGEAHFAIGYT

SEQ ID NO: 1508711 - protein, 17 aa, Mycobacterium tuberculosis
FLVAANAWKNLSNELSY

SEQ ID NO: 1508712 - protein, 28 aa, Mycobacterium tuberculosis
FNSAIVRPLLRFFFKSWFRVEVSGVENI

SEQ ID NO: 1508713 - protein, 17 aa, Mycobacterium tuberculosis
FPCYAKCVELGVPVSIH

SEQ ID NO: 1508714 - protein, 19 aa, Mycobacterium tuberculosis
FPVPSFAEFWRTGRLELPT

SEQ ID NO: 1508715 - protein, 22 aa, Mycobacterium tuberculosis
FRTTLYVTCEVVRIAALLIQPV

SEQ ID NO: 1508716 - protein, 20 aa, Mycobacterium tuberculosis
FSLGHFPQSFEFATIGGFAA

SEQ ID NO: 1508717 - protein, 23 aa, Mycobacterium tuberculosis
FSRFNLREFAIRPAYGLAEATVY

SEQ ID NO: 1508718 - protein, 18 aa, Mycobacterium tuberculosis
FTANPWLSGYMSQALNLL

SEQ ID NO: 1508719 - protein, 17 aa, Mycobacterium tuberculosis
FTLSFPYEPWTREEGIA

SEQ ID NO: 1508720 - protein, 27 aa, Mycobacterium tuberculosis
FVGVTAYDYMLTLAGRLRPVDLDAYIP

SEQ ID NO: 1508721 - protein, 18 aa, Mycobacterium tuberculosis
GAAMPHLSGPLAGVGVGG

SEQ ID NO: 1508722 - protein, 30 aa, Mycobacterium tuberculosis; identical to SEQ ID NO: 218178

SEQ ID NO: 1508723 - protein, 19 aa, Mycobacterium tuberculosis
GAEYWLAPSGFTRAPQNSV

SEQ ID NO: 1508724 - protein, 21 aa, Mycobacterium tuberculosis
GAGLNLALAADVRIAGPAALF

SEQ ID NO: 1508725 - protein, 20 aa, Mycobacterium tuberculosis
GAGTALVSYPLPQSPIVRIV

SEQ ID NO: 1508726 - protein, 25 aa, Mycobacterium tuberculosis
GAGTGVRFTPTLTFTLDTISDSVHR

SEQ ID NO: 1508727 - protein, 18 aa, Mycobacterium tuberculosis
GAGWLKVKPVHTLDLVVL

SEQ ID NO: 1508728 - protein, 26 aa, Mycobacterium tuberculosis
GALESRTITFLKIDPAPGIGNSTTNP

SEQ ID NO: 1508729 - protein, 25 aa, Mycobacterium tuberculosis
GAREFQTFLVAKQREIVAVVAAAHE

SEQ ID NO: 1508730 - protein, 23 aa, Mycobacterium tuberculosis
GASRKRFLGALLAGPDGVMRPTD

SEQ ID NO: 1508731 - protein, 27 aa, Mycobacterium tuberculosis
GDECHMAFHFPLMPRIFMAVRRESRFP

SEQ ID NO: 1508732 - protein, 26 aa, Mycobacterium tuberculosis
GDMQTIELAAFHRVPPGPGQIEVAVR

SEQ ID NO: 1508733 - protein, 23 aa, Mycobacterium tuberculosis
GDTPPALRRQLVSQPPDVLITTP

SEQ ID NO: 1508734 - protein, 19 aa, Mycobacterium tuberculosis
GEFVFVLGYLGHVRAIVGN

SEQ ID NO: 1508735 - protein, 18 aa, Mycobacterium tuberculosis
GELLGALPMLHAAFERAG

SEQ ID NO: 1508736 - protein, 23 aa, Mycobacterium tuberculosis
GEPRPRIALAAPTGKAAARLAEA

SEQ ID NO: 1508737 - protein, 25 aa, Mycobacterium tuberculosis
GFDEVFARMWELYLAYSEAGFRSGY

SEQ ID NO: 1508738 - protein, 22 aa, Mycobacterium tuberculosis
GFGAVGHPTPQPAALGAAGVVA

SEQ ID NO: 1508739 - protein, 18 aa, Mycobacterium tuberculosis
GFGEEAFGMAKDSWDLGP

SEQ ID NO: 1508740 - protein, 32 aa, Mycobacterium tuberculosis; identical to SEQ ID NO: 218363

SEQ ID NO: 1508741 - protein, 18 aa, Mycobacterium tuberculosis
GFQLHPAIAALVSGLRLR

SEQ ID NO: 1508742 - protein, 28 aa, Mycobacterium tuberculosis
GFVSEDKFFIIGRIKDLLIVYGRNHSPD

SEQ ID NO: 1508743 - protein, 19 aa, Mycobacterium tuberculosis
GGAYRLIDFVLSNLVNARY

SEQ ID NO: 1508744 - protein, 18 aa, Mycobacterium tuberculosis
GGGPAPRPILDAAAAAGI

SEQ ID NO: 1508745 - protein, 24 aa, Mycobacterium tuberculosis
GGLLRPQVLWDELLAECKAAPGGD

SEQ ID NO: 1508746 - protein, 17 aa, Mycobacterium tuberculosis
GGLPLQRLVNGESMAAV

SEQ ID NO: 1508747 - protein, 21 aa, Mycobacterium tuberculosis
GGSGGLLFGSGGAGGIGGAGG

SEQ ID NO: 1508748 - protein, 26 aa, Mycobacterium tuberculosis
GGYPFEGLRILDLGIIVAGGELSRLF

SEQ ID NO: 1508749 - protein, 24 aa, Mycobacterium tuberculosis
GHEWDLVVIAGLQDGLWPNTVPRG

SEQ ID NO: 1508750 - protein, 23 aa, Mycobacterium tuberculosis
GHFALVTGILDWLARPARIVVVS

SEQ ID NO: 1508751 - protein, 20 aa, Mycobacterium tuberculosis
GHWLLAHNGVVDRAVLPAGP

SEQ ID NO: 1508752 - protein, 24 aa, Mycobacterium tuberculosis
GITIAYFESKLPAGTPVVRAMPNA

SEQ ID NO: 1508753 - protein, 20 aa, Mycobacterium tuberculosis
GKALKFYASVRMDVRRVETL

SEQ ID NO: 1508754 - protein, 39 aa, Mycobacterium tuberculosis; identical to SEQ ID NO: 218532

SEQ ID NO: 1508755 - protein, 27 aa, Mycobacterium tuberculosis
GKPEQNAWWWDVLKFGRSSAYAEFFDI

SEQ ID NO: 1508756 - protein, 19 aa, Mycobacterium tuberculosis
GKTMVVTGLHLLGGARADA

SEQ ID NO: 1508757 - protein, 23 aa, Mycobacterium tuberculosis
GLAVQPMSPIFLYARGRHDLDQA

SEQ ID NO: 1508758 - protein, 19 aa, Mycobacterium tuberculosis
GLLKFRTGVRPPVPLDEVE

SEQ ID NO: 1508759 - protein, 21 aa, Mycobacterium tuberculosis
GLVFQGWFHKAPYYPHDFFVP

SEQ ID NO: 1508760 - protein, 17 aa, Mycobacterium tuberculosis
GLYYVPINTHLTASEAA

SEQ ID NO: 1508761 - protein, 25 aa, Mycobacterium tuberculosis
GNEVTVPKGHRLPPSPKPGQKWVNV

SEQ ID NO: 1508762 - protein, 20 aa, Mycobacterium tuberculosis
GNGMLLSKHIRLIAAFDHRH

SEQ ID NO: 1508763 - protein, 22 aa, Mycobacterium tuberculosis
GPLAHPFQPLLAPRLREFALRE

SEQ ID NO: 1508764 - protein, 22 aa, Mycobacterium tuberculosis
GPLEFPFVYRRHQLSLRISGRS

SEQ ID NO: 1508765 - protein, 18 aa, Mycobacterium tuberculosis
GPSKFRMELLSLPQDEWA

SEQ ID NO: 1508766 - protein, 25 aa, Mycobacterium tuberculosis
GPTEQLYLAGAPLVAFSGLPIVPPG

SEQ ID NO: 1508767 - protein, 29 aa, Mycobacterium tuberculosis
GPTPPKVKSPFGVPGMPGLAGLPGGLPDL

SEQ ID NO: 1508768 - protein, 27 aa, Mycobacterium tuberculosis
GPTVMEDYFYRPFRDLVIRAAERADAP

SEQ ID NO: 1508769 - protein, 23 aa, Mycobacterium tuberculosis
GPVIPASAYLMKSPPEQLPDDIA

SEQ ID NO: 1508770 - protein, 23 aa, Mycobacterium tuberculosis
GQAPVDVLTLFSYPVHPPGKPER

SEQ ID NO: 1508771 - protein, 17 aa, Mycobacterium tuberculosis
GQTLFEHQALRLRMADL

SEQ ID NO: 1508772 - protein, 22 aa, Mycobacterium tuberculosis
GQYEAPLGITLRELLDYAGGVR

SEQ ID NO: 1508773 - protein, 20 aa, Mycobacterium tuberculosis
GREYVAQFLISGAGALHIPS

SEQ ID NO: 1508774 - protein, 18 aa, Mycobacterium tuberculosis
GRIRAGIRQLTAPRRVAR

SEQ ID NO: 1508775 - protein, 27 aa, Mycobacterium tuberculosis
GRSHAWVQAWTGGWWHYDPTNDNEITE

SEQ ID NO: 1508776 - protein, 19 aa, Mycobacterium tuberculosis
GSAAYWRRHIRQAVRFADS

SEQ ID NO: 1508777 - protein, 22 aa, Mycobacterium tuberculosis
GSANTLVRTPHGWRADNTDIDG

SEQ ID NO: 1508778 - protein, 18 aa, Mycobacterium tuberculosis
GSGSSRDWAAKGTLLLGV

SEQ ID NO: 1508779 - protein, 23 aa, Mycobacterium tuberculosis
GSRIDPVLARSWLLVNGAHGDRF

SEQ ID NO: 1508780 - protein, 29 aa, Mycobacterium tuberculosis
GSRTPWRLNQNYLRDIRLIRRGKIDDEGL

SEQ ID NO: 1508781 - protein, 18 aa, Mycobacterium tuberculosis
GTEKNFKWIARSADGWIT

SEQ ID NO: 1508782 - protein, 25 aa, Mycobacterium tuberculosis
GTGAAVALMVLRAAVAALSSMATFT

SEQ ID NO: 1508783 - protein, 17 aa, Mycobacterium tuberculosis
GTGFYRTDSRESGKKSK

SEQ ID NO: 1508784 - protein, 27 aa, Mycobacterium tuberculosis
GTIVLLMAVERIELFVDVLLKGGRTAD

SEQ ID NO: 1508785 - protein, 20 aa, Mycobacterium tuberculosis
GTLVMTHYVPAIGPGQEEQW

SEQ ID NO: 1508786 - protein, 25 aa, Mycobacterium tuberculosis
GTYLNSFYEIRPLPYAEAGYGYPEA

SEQ ID NO: 1508787 - protein, 24 aa, Mycobacterium tuberculosis
GVAGLLSRRLRIPAALAGVGAGLA

SEQ ID NO: 1508788 - protein, 28 aa, Mycobacterium tuberculosis
GVDYMTVHAGVLLRYVPLTAKRVTGIVS

SEQ ID NO: 1508789 - protein, 33 aa, Mycobacterium tuberculosis; identical to SEQ ID NO: 218923

SEQ ID NO: 1508790 - protein, 21 aa, Mycobacterium tuberculosis
GVERTWLDGWLLRAGHGAVLA

SEQ ID NO: 1508791 - protein, 23 aa, Mycobacterium tuberculosis
GVITEQEWLAHWPTAVNDSRGGS

SEQ ID NO: 1508792 - protein, 19 aa, Mycobacterium tuberculosis
GVLVGSWHTIEGLVYSMPD

SEQ ID NO: 1508793 - protein, 22 aa, Mycobacterium tuberculosis
GVPLIAVGLYYRSGYFRQSLTA

SEQ ID NO: 1508794 - protein, 19 aa, Mycobacterium tuberculosis
GWPVPAAAAAVIGPAGVLA

SEQ ID NO: 1508795 - protein, 23 aa, Mycobacterium tuberculosis
GWQSFRVPCLPSDRLLNLLIYIK

SEQ ID NO: 1508796 - protein, 26 aa, Mycobacterium tuberculosis
GWVDANVWRHVVPKGWFYNVMITGVK

SEQ ID NO: 1508797 - protein, 25 aa, Mycobacterium tuberculosis
GYVFDLETDWPIRAALLSTPEQTVL

SEQ ID NO: 1508798 - protein, 28 aa, Mycobacterium tuberculosis
HAFWDTEGFVLPVLTYTAPHAVADALRW

SEQ ID NO: 1508799 - protein, 20 aa, Mycobacterium tuberculosis
HAHLRYLNPFPANLGEVLRR

SEQ ID NO: 1508800 - protein, 22 aa, Mycobacterium tuberculosis
HARLLGYLIGDGRDGWVGGKTP

SEQ ID NO: 1508801 - protein, 23 aa, Mycobacterium tuberculosis
HDDLPWPDPADWLAAVRASPLLA

SEQ ID NO: 1508802 - protein, 24 aa, Mycobacterium tuberculosis
HDPSDTHWLGRDRFVLSAGHSSLT

SEQ ID NO: 1508803 - protein, 35 aa, Mycobacterium tuberculosis; identical to SEQ ID NO: 219069

SEQ ID NO: 1508804 - protein, 20 aa, Mycobacterium tuberculosis
HGNLVRLYPAGTASDEAGAG

SEQ ID NO: 1508805 - protein, 29 aa, Mycobacterium tuberculosis
HHKQPPLQRLVRALLGFDAKLSQYTRGKA

SEQ ID NO: 1508806 - protein, 17 aa, Mycobacterium tuberculosis
HIEAIANWDPKAEPSIE

SEQ ID NO: 1508807 - protein, 20 aa, Mycobacterium tuberculosis
HLARHHLHRFLPGASTRRSP

SEQ ID NO: 1508808 - protein, 33 aa, Mycobacterium tuberculosis; identical to SEQ ID NO: 219136

SEQ ID NO: 1508809 - protein, 33 aa, Mycobacterium tuberculosis; identical to SEQ ID NO: 226373

SEQ ID NO: 1508810 - protein, 17 aa, Mycobacterium tuberculosis
HPRAAFFGRSGLRRNIR

SEQ ID NO: 1508811 - protein, 20 aa, Mycobacterium tuberculosis
HPRSWLLRQASSGVSAATVV

SEQ ID NO: 1508812 - protein, 19 aa, Mycobacterium tuberculosis
HPVLPPFPTVLKQVLRPLD

SEQ ID NO: 1508813 - protein, 17 aa, Mycobacterium tuberculosis
HQGAAEMMRPIARKYDL

SEQ ID NO: 1508814 - protein, 17 aa, Mycobacterium tuberculosis
HQIQLGVRIAPPATDEA

SEQ ID NO: 1508815 - protein, 17 aa, Mycobacterium tuberculosis
HQLQVIEKSFPAGYHVG

SEQ ID NO: 1508816 - protein, 17 aa, Mycobacterium tuberculosis
HQVRMEFAYAGGGLGKG

SEQ ID NO: 1508817 - protein, 20 aa, Mycobacterium tuberculosis
HRDEALHLIRKRAKRLRYTA

SEQ ID NO: 1508818 - protein, 18 aa, Mycobacterium tuberculosis
HRSVKIPDLIIAAVAEHH

SEQ ID NO: 1508819 - protein, 25 aa, Mycobacterium tuberculosis
HRTGKPHGWIHDELRRRCGGPPIAA

SEQ ID NO: 1508820 - protein, 18 aa, Mycobacterium tuberculosis
HSDERFFRRGGSGDWQQF

SEQ ID NO: 1508821 - protein, 18 aa, Mycobacterium tuberculosis
HTDYNLGFALPIALPRRT

SEQ ID NO: 1508822 - protein, 17 aa, Mycobacterium tuberculosis
HTTVRLIDLATRMPRVL

SEQ ID NO: 1508823 - protein, 20 aa, Mycobacterium tuberculosis
HVAYWWSAEPQRLSMAASQA

SEQ ID NO: 1508824 - protein, 18 aa, Mycobacterium tuberculosis
HVCALANNHILDFGYQGL

SEQ ID NO: 1508825 - protein, 19 aa, Mycobacterium tuberculosis
HVFNRLDIPSWMARMGFQM

SEQ ID NO: 1508826 - protein, 25 aa, Mycobacterium tuberculosis
HVRGRGLLLGIALTAPHAKDAEATA

SEQ ID NO: 1508827 - protein, 18 aa, Mycobacterium tuberculosis
HVVPLVRDVRRIGSAALD

SEQ ID NO: 1508828 - protein, 17 aa, Mycobacterium tuberculosis
HYLHVRPADQFDAMIHI

SEQ ID NO: 1508829 - protein, 23 aa, Mycobacterium tuberculosis
IAETIDWGRTVLALGLDTIDDAV

SEQ ID NO: 1508830 - protein, 23 aa, Mycobacterium tuberculosis
IAGFCAQAAVRRTPLLLDGVAVT

SEQ ID NO: 1508831 - protein, 27 aa, Mycobacterium tuberculosis
IAVEARRLAFQALHRPCNSAEWTAAVA

SEQ ID NO: 1508832 - protein, 18 aa, Mycobacterium tuberculosis
IAVPDRQLACVPVHSPDG

SEQ ID NO: 1508833 - protein, 24 aa, Mycobacterium tuberculosis
IAVSDWMRAVPEQIRPWVPGTYLT

SEQ ID NO: 1508834 - protein, 18 aa, Mycobacterium tuberculosis
IDHFLVQADLTVVVPGPL

SEQ ID NO: 1508835 - protein, 21 aa, Mycobacterium tuberculosis
IEALGHPLIDHVRGRGLLLGI

SEQ ID NO: 1508836 - protein, 25 aa, Mycobacterium tuberculosis
IEDQSPIVGIWHSGGARLAEGVRAL

SEQ ID NO: 1508837 - protein, 18 aa, Mycobacterium tuberculosis
IEVYPHPATVALFRLPRA

SEQ ID NO: 1508838 - protein, 20 aa, Mycobacterium tuberculosis
IFAMLRAHIATGGYAALVAP

SEQ ID NO: 1508839 - protein, 18 aa, Mycobacterium tuberculosis
IGRRFSLPTVSLAETAVA

SEQ ID NO: 1508840 - protein, 21 aa, Mycobacterium tuberculosis
IGTHRLLQTGVRWKDLGLVVV

SEQ ID NO: 1508841 - protein, 26 aa, Mycobacterium tuberculosis
IHAPSLRERLRYRRGQWAHGPKLVEH

SEQ ID NO: 1508842 - protein, 26 aa, Mycobacterium tuberculosis
IIGYRSLLRTELPPGGRLGLYGFGGS

SEQ ID NO: 1508843 - protein, 18 aa, Mycobacterium tuberculosis
IKDLLIVYGRNHSPDDIE

SEQ ID NO: 1508844 - protein, 27 aa, Mycobacterium tuberculosis
IKGDPHRYTFQYALDLQLQSLVRVIEA

SEQ ID NO: 1508845 - protein, 17 aa, Mycobacterium tuberculosis
ILDLRAGTLTRRAHWRS

SEQ ID NO: 1508846 - protein, 25 aa, Mycobacterium tuberculosis
ILDVLDNYAFVRTSGYLPGPHDVYV

SEQ ID NO: 1508847 - protein, 18 aa, Mycobacterium tuberculosis
IMTPFRIVRLLEQTVRQQ

SEQ ID NO: 1508848 - protein, 30 aa, Mycobacterium tuberculosis; identical to SEQ ID NO: 219448

SEQ ID NO: 1508849 - protein, 25 aa, Mycobacterium tuberculosis
IPDVCDALGVPWLTLMGYIEAQGWT

SEQ ID NO: 1508850 - protein, 17 aa, Mycobacterium tuberculosis
IQPLIQAMSFGLTAAEM

SEQ ID NO: 1508851 - protein, 20 aa, Mycobacterium tuberculosis
IRETLDLLTRVFPARTCSAG

SEQ ID NO: 1508852 - protein, 31 aa, Mycobacterium tuberculosis; identical to SEQ ID NO: 219495

SEQ ID NO: 1508853 - protein, 19 aa, Mycobacterium tuberculosis
ITAALWGVDEAISRAVPLR

SEQ ID NO: 1508854 - protein, 21 aa, Mycobacterium tuberculosis
ITCLAEPDPSWWDRLAPVSHH

SEQ ID NO: 1508855 - protein, 25 aa, Mycobacterium tuberculosis
ITGGLGGLGLFFASKLAAAGCGRIV

SEQ ID NO: 1508856 - protein, 25 aa, Mycobacterium tuberculosis
ITPEQVLESPFLLLGTHEQMAEALA

SEQ ID NO: 1508857 - protein, 17 aa, Mycobacterium tuberculosis
ITPVNRAIWIPAGCWHQ

SEQ ID NO: 1508858 - protein, 25 aa, Mycobacterium tuberculosis
ITTPALISGFFNTGSNMSGFFGGPP

SEQ ID NO: 1508859 - protein, 23 aa, Mycobacterium tuberculosis
ITVRGQRLLQRCPVCLYAGSIMP

SEQ ID NO: 1508860 - protein, 25 aa, Mycobacterium tuberculosis
IVELCALWAVHLHFDPSPEPWSIVQ

SEQ ID NO: 1508861 - protein, 20 aa, Mycobacterium tuberculosis
IVPHIVWGAQRIWTKDRPKK

SEQ ID NO: 1508862 - protein, 21 aa, Mycobacterium tuberculosis
IVYVHGAVISSRRGELSVLAD

SEQ ID NO: 1508863 - protein, 30 aa, Mycobacterium tuberculosis; identical to SEQ ID NO: 115465

SEQ ID NO: 1508864 - protein, 22 aa, Mycobacterium tuberculosis
KAAGLFNAPASQLARLAAALQE

SEQ ID NO: 1508865 - protein, 19 aa, Mycobacterium tuberculosis
KAILDRTPWRAEEVTVIVA

SEQ ID NO: 1508866 - protein, 18 aa, Mycobacterium tuberculosis
KALDWIGERLGPAEVGPD

SEQ ID NO: 1508867 - protein, 23 aa, Mycobacterium tuberculosis
KAQILASGVAMPAALRAAQMLAA

SEQ ID NO: 1508868 - protein, 22 aa, Mycobacterium tuberculosis
KARPDIGPLFYEPTVLTNVAPE

SEQ ID NO: 1508869 - protein, 18 aa, Mycobacterium tuberculosis
KCFANRYQSWLPTLKEMV

SEQ ID NO: 1508870 - protein, 23 aa, Mycobacterium tuberculosis
KEEAKVWVGDLPGWLALHGYQNS

SEQ ID NO: 1508871 - protein, 20 aa, Mycobacterium tuberculosis
KEPHYGPPPLLLRMVEAGQL

SEQ ID NO: 1508872 - protein, 31 aa, Mycobacterium tuberculosis; identical to SEQ ID NO: 219662

SEQ ID NO: 1508873 - protein, 19 aa, Mycobacterium tuberculosis
KHGPIALIEDGLPVIVVMP

SEQ ID NO: 1508874 - protein, 24 aa, Mycobacterium tuberculosis
KIADYPFTTLVPNLGVVSAGEHAF

SEQ ID NO: 1508875 - protein, 28 aa, Mycobacterium tuberculosis
KIRNLVKKYSDFIAWPIRMDVERRTPAS

SEQ ID NO: 1508876 - protein, 19 aa, Mycobacterium tuberculosis
KLAMPFIVLATDNPIEYEG

SEQ ID NO: 1508877 - protein, 36 aa, Mycobacterium tuberculosis; identical to SEQ ID NO: 219696

SEQ ID NO: 1508878 - protein, 41 aa, Mycobacterium tuberculosis; identical to SEQ ID NO: 219708

SEQ ID NO: 1508879 - protein, 29 aa, Mycobacterium tuberculosis
KPDAPVRYRFHFPRQQRGRFLCIADFIRS

SEQ ID NO: 1508880 - protein, 19 aa, Mycobacterium tuberculosis
KPEEPIQIPPPGTGAPEVH

SEQ ID NO: 1508881 - protein, 21 aa, Mycobacterium tuberculosis
KRLAAALPDYPFAYLITVDDG

SEQ ID NO: 1508882 - protein, 19 aa, Mycobacterium tuberculosis
KTFFQVYWQGGRDALAERV

SEQ ID NO: 1508883 - protein, 21 aa, Mycobacterium tuberculosis
KTMLAQRLPGLLPSLSGSESL

SEQ ID NO: 1508884 - protein, 25 aa, Mycobacterium tuberculosis
KVESFGVRLRKGDIVLPGSCTFAVE

SEQ ID NO: 1508885 - protein, 18 aa, Mycobacterium tuberculosis
LAAGREHPLIARSSLGSA

SEQ ID NO: 1508886 - protein, 28 aa, Mycobacterium tuberculosis
LADVYWGDLDVLLLDLPPGTGDVAISVA

SEQ ID NO: 1508887 - protein, 25 aa, Mycobacterium tuberculosis
LAEVILQSPLDISRPLWTATLVEGM

SEQ ID NO: 1508888 - protein, 33 aa, Mycobacterium tuberculosis; identical to SEQ ID NO: 225254

SEQ ID NO: 1508889 - protein, 17 aa, Mycobacterium tuberculosis
LAHEVLLDCDSPHVGAA

SEQ ID NO: 1508890 - protein, 25 aa, Mycobacterium tuberculosis
LAIDGKLLLIGFAAGAVPTLKVNRL

SEQ ID NO: 1508891 - protein, 24 aa, Mycobacterium tuberculosis
LAKACARIMLGATIAQLRAEGLLA

SEQ ID NO: 1508892 - protein, 23 aa, Mycobacterium tuberculosis
LAPRHPHLVKLVARRANVEGIGE

SEQ ID NO: 1508893 - protein, 18 aa, Mycobacterium tuberculosis
LAQLTIPIPTVTTPQMFT

SEQ ID NO: 1508894 - protein, 17 aa, Mycobacterium tuberculosis
LARLERFDRTIYLFDVE

SEQ ID NO: 1508895 - protein, 18 aa, Mycobacterium tuberculosis
LASFSRVIRLDHRGVGLS

SEQ ID NO: 1508896 - protein, 26 aa, Mycobacterium tuberculosis
LASLPDGALMRRAAFGLATEIGRELT

SEQ ID NO: 1508897 - protein, 25 aa, Mycobacterium tuberculosis
LATEIPLRTWLFRIADDEHVLVAVA

SEQ ID NO: 1508898 - protein, 19 aa, Mycobacterium tuberculosis
LATPGFLSGIGNFGTNLAG

SEQ ID NO: 1508899 - protein, 20 aa, Mycobacterium tuberculosis
LCATVQWSHALLSGPERALL

SEQ ID NO: 1508900 - protein, 26 aa, Mycobacterium tuberculosis
LDAINSPVQTLTGRPLIGNGANGVAG

SEQ ID NO: 1508901 - protein, 24 aa, Mycobacterium tuberculosis
LDARQWFQSFPAVAGSSLFAKLHD

SEQ ID NO: 1508902 - protein, 21 aa, Mycobacterium tuberculosis
LDGAALHQYLVLRGGIRAEES

SEQ ID NO: 1508903 - protein, 22 aa, Mycobacterium tuberculosis
LDGYGLHIIERVPLPVRANAEN

SEQ ID NO: 1508904 - protein, 34 aa, Mycobacterium tuberculosis; identical to SEQ ID NO: 215331

SEQ ID NO: 1508905 - protein, 20 aa, Mycobacterium tuberculosis
LDPVLRVELWDRFTALARRG

SEQ ID NO: 1508906 - protein, 20 aa, Mycobacterium tuberculosis
LDRRLRTGPTPWSGSETLPG

SEQ ID NO: 1508907 - protein, 35 aa, Mycobacterium tuberculosis; identical to SEQ ID NO: 220001

SEQ ID NO: 1508908 - protein, 38 aa, Mycobacterium tuberculosis; identical to SEQ ID NO: 220019

SEQ ID NO: 1508909 - protein, 23 aa, Mycobacterium tuberculosis
LELRPRKLREAGALWERLTRAVG

SEQ ID NO: 1508910 - protein, 27 aa, Mycobacterium tuberculosis
LEQRFDRELWRKLIDAGILSSAAPESL

SEQ ID NO: 1508911 - protein, 19 aa, Mycobacterium tuberculosis
LEVRIRLLRDRIHQGWILT

SEQ ID NO: 1508912 - protein, 18 aa, Mycobacterium tuberculosis
LFCDLLANLHLHLEQEVD

SEQ ID NO: 1508913 - protein, 22 aa, Mycobacterium tuberculosis
LGDVLITSWVTNFAADPAPLPI

SEQ ID NO: 1508914 - protein, 28 aa, Mycobacterium tuberculosis
LGEQPQVTELLPFGRPQLAGGPLGSVAK

SEQ ID NO: 1508915 - protein, 21 aa, Mycobacterium tuberculosis
LGGKLPFALAERLHISRGEAS

SEQ ID NO: 1508916 - protein, 17 aa, Mycobacterium tuberculosis
LGLAHRLADAGVPIVGT

SEQ ID NO: 1508917 - protein, 21 aa, Mycobacterium tuberculosis
LGLLELRGFEMPPHLHMAMVQ

SEQ ID NO: 1508918 - protein, 19 aa, Mycobacterium tuberculosis
LGLTITDALFHRHPDRSEG

SEQ ID NO: 1508919 - protein, 19 aa, Mycobacterium tuberculosis
LGMMMRIAVRLPGEVITFV

SEQ ID NO: 1508920 - protein, 19 aa, Mycobacterium tuberculosis
LGVNWRVRCETGEPAAAAS

SEQ ID NO: 1508921 - protein, 18 aa, Mycobacterium tuberculosis
LHEEMMSELRWPGDPSLD

SEQ ID NO: 1508922 - protein, 26 aa, Mycobacterium tuberculosis
LHLQNGFILPSFPPFSTPDVFQNAFH

SEQ ID NO: 1508923 - protein, 19 aa, Mycobacterium tuberculosis
LIDQHVHGCWLTEGNRRRF

SEQ ID NO: 1508924 - protein, 17 aa, Mycobacterium tuberculosis
LILGPWNHTGGWRVDPL

SEQ ID NO: 1508925 - protein, 18 aa, Mycobacterium tuberculosis
LITTPESLFLMLTSAARQ

SEQ ID NO: 1508926 - protein, 18 aa, Mycobacterium tuberculosis
LIVSLWLDRLRQRGEITR

SEQ ID NO: 1508927 - protein, 20 aa, Mycobacterium tuberculosis
LKAMGVYPGLDGAAPVIGGE

SEQ ID NO: 1508928 - protein, 24 aa, Mycobacterium tuberculosis
LKVNRLLVRNISVVGVGWGEYLNA

SEQ ID NO: 1508929 - protein, 17 aa, Mycobacterium tuberculosis
LLALRQLGQRPRVEPLR

SEQ ID NO: 1508930 - protein, 28 aa, Mycobacterium tuberculosis
LLDDDDFAKHPFLVKGYIGPKALRENNV

SEQ ID NO: 1508931 - protein, 24 aa, Mycobacterium tuberculosis
LLDRAPLAVLALGGEALGAATWRM

SEQ ID NO: 1508932 - protein, 21 aa, Mycobacterium tuberculosis
LLMAPTYAVPRLLARNGLSLQ

SEQ ID NO: 1508933 - protein, 22 aa, Mycobacterium tuberculosis
LLPTYHPLRNYLTKARDLLSDS

SEQ ID NO: 1508934 - protein, 27 aa, Mycobacterium tuberculosis
LLREARLFRAELTIPLILLGGITNRTT

SEQ ID NO: 1508935 - protein, 20 aa, Mycobacterium tuberculosis
LLVDMAHFAGLVAAGLHPSP

SEQ ID NO: 1508936 - protein, 27 aa, Mycobacterium tuberculosis
LMRRSGMIFIRRNIGNDPLYKYVLKEY

SEQ ID NO: 1508937 - protein, 17 aa, Mycobacterium tuberculosis
LPAVLDAGARRIVVVRA

SEQ ID NO: 1508938 - protein, 21 aa, Mycobacterium tuberculosis
LPEIWPEPTEFRPLRWDPNAA

SEQ ID NO: 1508939 - protein, 17 aa, Mycobacterium tuberculosis
LPGIGKTTVCYQPKGVV

SEQ ID NO: 1508940 - protein, 23 aa, Mycobacterium tuberculosis
LPQDEWAGRLRRLLVEQASVILR

SEQ ID NO: 1508941 - protein, 32 aa, Mycobacterium tuberculosis; identical to SEQ ID NO: 220313

SEQ ID NO: 1508942 - protein, 18 aa, Mycobacterium tuberculosis
LQLITTDSAPIITRASAR

SEQ ID NO: 1508943 - protein, 30 aa, Mycobacterium tuberculosis; identical to SEQ ID NO: 220331

SEQ ID NO: 1508944 - protein, 24 aa, Mycobacterium tuberculosis
LQLQRVFVLTFETEFFARHGFTEI

SEQ ID NO: 1508945 - protein, 17 aa, Mycobacterium tuberculosis
LQQLGEFAVIDRLVRGR

SEQ ID NO: 1508946 - protein, 30 aa, Mycobacterium tuberculosis; identical to SEQ ID NO: 220341

SEQ ID NO: 1508947 - protein, 22 aa, Mycobacterium tuberculosis
LQRPARWLQLMAREGQAFSAAP

SEQ ID NO: 1508948 - protein, 18 aa, Mycobacterium tuberculosis
LQRTAPWVESLGLDHVRE

SEQ ID NO: 1508949 - protein, 20 aa, Mycobacterium tuberculosis
LRDRAFYAPVQSRYRVFIVD

SEQ ID NO: 1508950 - protein, 27 aa, Mycobacterium tuberculosis
LRDSVLDAMRDLLLTRDWSAITLSDVA

SEQ ID NO: 1508951 - protein, 18 aa, Mycobacterium tuberculosis
LRGLLRVISSEHPMLRTT

SEQ ID NO: 1508952 - protein, 19 aa, Mycobacterium tuberculosis
LRTRLFAAPGWLVSPGVRT

SEQ ID NO: 1508953 - protein, 19 aa, Mycobacterium tuberculosis
LRVHPTGKAVLRLSVQTQG

SEQ ID NO: 1508954 - protein, 18 aa, Mycobacterium tuberculosis
LSADRAFAAVPAALLRWG

SEQ ID NO: 1508955 - protein, 17 aa, Mycobacterium tuberculosis
LSFQDRTYLVTGGGSGI

SEQ ID NO: 1508956 - protein, 28 aa, Mycobacterium tuberculosis
LSGYVEILPTPFLPAGVFDLWGLEADDS

SEQ ID NO: 1508957 - protein, 21 aa, Mycobacterium tuberculosis
LSLSLDEACLLMFARRDLTAA

SEQ ID NO: 1508958 - protein, 28 aa, Mycobacterium tuberculosis
LSRFSALTRDWFTSTFAAPTAAQASAWA

SEQ ID NO: 1508959 - protein, 18 aa, Mycobacterium tuberculosis
LSTARFEFRWNDQFALSL

SEQ ID NO: 1508960 - protein, 17 aa, Mycobacterium tuberculosis
LSTFIAALMGAEADALC

SEQ ID NO: 1508961 - protein, 19 aa, Mycobacterium tuberculosis
LSVPPAWAAANQAVTPAAR

SEQ ID NO: 1508962 - protein, 21 aa, Mycobacterium tuberculosis
LSVREVTGVPILFASTGEKLE

SEQ ID NO: 1508963 - protein, 21 aa, Mycobacterium tuberculosis
LTALMPMVWRACEREDFVVEV

SEQ ID NO: 1508964 - protein, 19 aa, Mycobacterium tuberculosis
LTGATGFLGRYLVLELLRR

SEQ ID NO: 1508965 - protein, 18 aa, Mycobacterium tuberculosis
LTLMARLAEAVRPGARLI

SEQ ID NO: 1508966 - protein, 28 aa, Mycobacterium tuberculosis
LTPDNRMTIVRLLGISYFDEGLLQFEAS

SEQ ID NO: 1508967 - protein, 23 aa, Mycobacterium tuberculosis
LVAHPQSWKLLRGKVTLPSHDQL

SEQ ID NO: 1508968 - protein, 18 aa, Mycobacterium tuberculosis
LVDGRWRWRSYSLTSSPA

SEQ ID NO: 1508969 - protein, 27 aa, Mycobacterium tuberculosis
LVEHFILEDWWGRWLGRWTAEEHLHAI

SEQ ID NO: 1508970 - protein, 19 aa, Mycobacterium tuberculosis
LVELAFALGQLASAGIGVG

SEQ ID NO: 1508971 - protein, 29 aa, Mycobacterium tuberculosis
LVEPYTEYQPLWEPKIPLGRLGRPEELAG

SEQ ID NO: 1508972 - protein, 26 aa, Mycobacterium tuberculosis
LVHRERAGLLILPGPAPMVARTIVEL

SEQ ID NO: 1508973 - protein, 23 aa, Mycobacterium tuberculosis
LVLDYERAMLRLSDGEDGEPQLF

SEQ ID NO: 1508974 - protein, 25 aa, Mycobacterium tuberculosis
LVNYNTMYFALARRAALRPGDTVLV

SEQ ID NO: 1508975 - protein, 20 aa, Mycobacterium tuberculosis
LVPAIELIDTRIKDWQIKIC

SEQ ID NO: 1508976 - protein, 25 aa, Mycobacterium tuberculosis
LVRAIYFLPYRSPWCRGWLVIAGVL

SEQ ID NO: 1508977 - protein, 40 aa, Mycobacterium tuberculosis; identical to SEQ ID NO: 220567

SEQ ID NO: 1508978 - protein, 31 aa, Mycobacterium tuberculosis; identical to SEQ ID NO: 225339

SEQ ID NO: 1508979 - protein, 18 aa, Mycobacterium tuberculosis
LVTAMGRARRRLLVTAVD

SEQ ID NO: 1508980 - protein, 22 aa, Mycobacterium tuberculosis
LWAPDYPVGAQVRRADPFLTVA

SEQ ID NO: 1508981 - protein, 30 aa, Mycobacterium tuberculosis
LWHAVPCFPTISELWLRLLESYRDSFYLLV

SEQ ID NO: 1508982 - protein, 25 aa, Mycobacterium tuberculosis
LYAGWWQHLSTLGAVPRVLVWDGEG

SEQ ID NO: 1508983 - protein, 18 aa, Mycobacterium tuberculosis
LYGRVALFERMSLEAFQS

SEQ ID NO: 1508984 - protein, 24 aa, Mycobacterium tuberculosis
MAAAAAPYVAWMSATAALAREAAA

SEQ ID NO: 1508985 - protein, 22 aa, Mycobacterium tuberculosis
MAAQYRIRLGGTWKKPGTSDIE

SEQ ID NO: 1508986 - protein, 17 aa, Mycobacterium tuberculosis
MAARLKGYRLICVMPEN

SEQ ID NO: 1508987 - protein, 24 aa, Mycobacterium tuberculosis
MADFHLRVQPGCDAWCLAALAAVL

SEQ ID NO: 1508988 - protein, 22 aa, Mycobacterium tuberculosis
MAGWYFTKWQRVLNDGLDAVMH

SEQ ID NO: 1508989 - protein, 33 aa, Mycobacterium tuberculosis; identical to SEQ ID NO: 220624

SEQ ID NO: 1508990 - protein, 24 aa, Mycobacterium tuberculosis
MEAAKPFVRWLTDLCVQLSEVERQ

SEQ ID NO: 1508991 - protein, 18 aa, Mycobacterium tuberculosis
MEALGALGGLDRAALHSQ

SEQ ID NO: 1508992 - protein, 19 aa, Mycobacterium tuberculosis
MNAMMWVRGFASDYDEWAA

SEQ ID NO: 1508993 - protein, 27 aa, Mycobacterium tuberculosis
MNVDNPHPLLLLTHPVPNTGAVVVQGN

SEQ ID NO: 1508994 - protein, 27 aa, Mycobacterium tuberculosis
MPDPYQAFVLMAAWLAMRYGELTELRR

SEQ ID NO: 1508995 - protein, 20 aa, Mycobacterium tuberculosis
MPQRIWDQKLAEVPMGRAGE

SEQ ID NO: 1508996 - protein, 21 aa, Mycobacterium tuberculosis
MQMRLTFARSLINDPELLFLD

SEQ ID NO: 1508997 - protein, 19 aa, Mycobacterium tuberculosis
MRIADASGIPYVGRILVNV

SEQ ID NO: 1508998 - protein, 24 aa, Mycobacterium tuberculosis
MSQMTWRSMIRDGLTMRHGKELTW

SEQ ID NO: 1508999 - protein, 19 aa, Mycobacterium tuberculosis
MSVIEKYLYGYFGGSVRSE

SEQ ID NO: 1509000 - protein, 22 aa, Mycobacterium tuberculosis
MVAPGLLSWRDIARVMSENPAC

SEQ ID NO: 1509001 - protein, 25 aa, Mycobacterium tuberculosis
MVREWLTVLLRRDLGLLVTIGVPGG

SEQ ID NO: 1509002 - protein, 25 aa, Mycobacterium tuberculosis
NAWDVPSALAYLAEGFTAIGTTSFG

SEQ ID NO: 1509003 - protein, 32 aa, Mycobacterium tuberculosis; identical to SEQ ID NO: 220813

SEQ ID NO: 1509004 - protein, 29 aa, Mycobacterium tuberculosis
NEAADLAAVWQLPVVILVENIRGALSVHL

SEQ ID NO: 1509005 - protein, 18 aa, Mycobacterium tuberculosis
NEPALFDEVWSWSTKALK

SEQ ID NO: 1509006 - protein, 18 aa, Mycobacterium tuberculosis
NFEYGLECILDHAGRLIE

SEQ ID NO: 1509007 - protein, 27 aa, Mycobacterium tuberculosis
NGIDAPALWPGLPIRPVKGEVLRLRWR

SEQ ID NO: 1509008 - protein, 17 aa, Mycobacterium tuberculosis
NGINLWRVDADHVSVAC

SEQ ID NO: 1509009 - protein, 25 aa, Mycobacterium tuberculosis
NLAHRSEVTLLWPPSDPSGYSLIVD

SEQ ID NO: 1509010 - protein, 24 aa, Mycobacterium tuberculosis
NLHGRYLLPHFLIHDIADVAADLR

SEQ ID NO: 1509011 - protein, 19 aa, Mycobacterium tuberculosis
NLQGRIRRHIRRQYVITVV

SEQ ID NO: 1509012 - protein, 23 aa, Mycobacterium tuberculosis
NLVNARYLRICVLTQYKSHSLDR

SEQ ID NO: 1509013 - protein, 23 aa, Mycobacterium tuberculosis
NMVRSLVTAYAPPDVREFVLGKL

SEQ ID NO: 1509014 - protein, 26 aa, Mycobacterium tuberculosis
NRDKRSLVFPVKRLADLGFRVLATEG

SEQ ID NO: 1509015 - protein, 22 aa, Mycobacterium tuberculosis
NRGRLRSLVASNLLGQNAPAIA

SEQ ID NO: 1509016 - protein, 29 aa, Mycobacterium tuberculosis
NRLAVCLDLDWRPQFRVDLIPSYKAHRVA

SEQ ID NO: 1509017 - protein, 19 aa, Mycobacterium tuberculosis
NRSLPFPTLVSILLTDIRV

SEQ ID NO: 1509018 - protein, 22 aa, Mycobacterium tuberculosis
NRYWGTPIPVWKSDDPAYPRID

SEQ ID NO: 1509019 - protein, 26 aa, Mycobacterium tuberculosis
NSENSRFMFDYIPPVFKGQYAETEEE

SEQ ID NO: 1509020 - protein, 21 aa, Mycobacterium tuberculosis
NSWPMARLTLALSPATLPKMG

SEQ ID NO: 1509021 - protein, 25 aa, Mycobacterium tuberculosis
NTAYYRLMDHDLRFYKDFTGTGNSL

SEQ ID NO: 1509022 - protein, 23 aa, Mycobacterium tuberculosis
NVGNFYEAFLQGFRSFFAESAAD

SEQ ID NO: 1509023 - protein, 29 aa, Mycobacterium tuberculosis
NVPGPQGALYWNGARLDALYLLSAPVDGA

SEQ ID NO: 1509024 - protein, 20 aa, Mycobacterium tuberculosis
NVRALLQMAVVLTYGASMPV

SEQ ID NO: 1509025 - protein, 22 aa, Mycobacterium tuberculosis
NVSKLLWANWHRNLGELAMDVI

SEQ ID NO: 1509026 - protein, 27 aa, Mycobacterium tuberculosis
NVVDVFIGYLRRKLEAGGGPRLLHTVR

SEQ ID NO: 1509027 - protein, 19 aa, Mycobacterium tuberculosis
NYLIVRAGEFSRISDVLLP

SEQ ID NO: 1509028 - protein, 17 aa, Mycobacterium tuberculosis
PAAAWQRCRTHYAANHG

SEQ ID NO: 1509029 - protein, 20 aa, Mycobacterium tuberculosis
PADWHMLQPQWLADLSESRR

SEQ ID NO: 1509030 - protein, 26 aa, Mycobacterium tuberculosis
PAELHFLGATLWRSGIQRVLRGFVER

SEQ ID NO: 1509031 - protein, 21 aa, Mycobacterium tuberculosis
PAGLRLPLDSISWRPPRASFD

SEQ ID NO: 1509032 - protein, 33 aa, Mycobacterium tuberculosis; identical to SEQ ID NO: 221053

SEQ ID NO: 1509033 - protein, 20 aa, Mycobacterium tuberculosis
PAMVFRLIAEEALTLMAGAA

SEQ ID NO: 1509034 - protein, 34 aa, Mycobacterium tuberculosis; identical to SEQ ID NO: 221072

SEQ ID NO: 1509035 - protein, 26 aa, Mycobacterium tuberculosis
PASAAMTGVAASYARWLTTAAAQAEQ

SEQ ID NO: 1509036 - protein, 22 aa, Mycobacterium tuberculosis
PAVPHLVSLPGYPFARQRHWVE

SEQ ID NO: 1509037 - protein, 33 aa, Mycobacterium tuberculosis; identical to SEQ ID NO: 221093

SEQ ID NO: 1509038 - protein, 32 aa, Mycobacterium tuberculosis; identical to SEQ ID NO: 221096

SEQ ID NO: 1509039 - protein, 23 aa, Mycobacterium tuberculosis
PDAHYHKIHLYDAFGFTESRTVA

SEQ ID NO: 1509040 - protein, 25 aa, Mycobacterium tuberculosis
PDGEDLSWLWDVRFEHFEKTRVVAA

SEQ ID NO: 1509041 - protein, 33 aa, Mycobacterium tuberculosis; identical to SEQ ID NO: 225395

SEQ ID NO: 1509042 - protein, 24 aa, Mycobacterium tuberculosis
PDSAQVRLKRMYPGAHYRATTATV

SEQ ID NO: 1509043 - protein, 19 aa, Mycobacterium tuberculosis
PDVGKLVELAFALGQLASA

SEQ ID NO: 1509044 - protein, 21 aa, Mycobacterium tuberculosis
PEEIKRAYRKLARDLHPDANP

SEQ ID NO: 1509045 - protein, 35 aa, Mycobacterium tuberculosis; identical to SEQ ID NO: 221160

SEQ ID NO: 1509046 - protein, 24 aa, Mycobacterium tuberculosis
PEPHPTIPTTPWQHTHHWIATTHP

SEQ ID NO: 1509047 - protein, 24 aa, Mycobacterium tuberculosis
PEPHPVLPTTPWQHTQHWITATSA

SEQ ID NO: 1509048 - protein, 17 aa, Mycobacterium tuberculosis
PFDLLARARFRVTVNTD

SEQ ID NO: 1509049 - protein, 18 aa, Mycobacterium tuberculosis
PFGMDEFLARLRAAVRRN

SEQ ID NO: 1509050 - protein, 19 aa, Mycobacterium tuberculosis
PFLEHFVMRSRYVDNPGLF

SEQ ID NO: 1509051 - protein, 23 aa, Mycobacterium tuberculosis
PGGIGAIRKLGMWPVFVQEETVE

SEQ ID NO: 1509052 - protein, 28 aa, Mycobacterium tuberculosis
PGKEGHEVLIFRLFHAPPPSVCSRRRVR

SEQ ID NO: 1509053 - protein, 26 aa, Mycobacterium tuberculosis
PGLPGMGSLLLPPWTVTRYGTDGVEM

SEQ ID NO: 1509054 - protein, 26 aa, Mycobacterium tuberculosis
PGLPRRLRWVSPLVPLVAGPLPVAFF

SEQ ID NO: 1509055 - protein, 22 aa, Mycobacterium tuberculosis
PGQPLWGHGWDESAWPENAAPS

SEQ ID NO: 1509056 - protein, 19 aa, Mycobacterium tuberculosis
PGTIASVAAVALYIGDVLG

SEQ ID NO: 1509057 - protein, 28 aa, Mycobacterium tuberculosis
PGTTFGDYWYANLRHTVRFDRAVESAIR

SEQ ID NO: 1509058 - protein, 21 aa, Mycobacterium tuberculosis
PGVALAKLRLPSPSGRAGIAV

SEQ ID NO: 1509059 - protein, 20 aa, Mycobacterium tuberculosis
PGVGLRYEFTSYRGDRIGIV

SEQ ID NO: 1509060 - protein, 18 aa, Mycobacterium tuberculosis
PHAAITTDLIVGFPGETE

SEQ ID NO: 1509061 - protein, 17 aa, Mycobacterium tuberculosis
PHLTAAIIAKYISNLRL

SEQ ID NO: 1509062 - protein, 19 aa, Mycobacterium tuberculosis
PHVTFDPLHALRAIERHRI

SEQ ID NO: 1509063 - protein, 24 aa, Mycobacterium tuberculosis
PITSPTFVLARMHRPRRPGTPAMV

SEQ ID NO: 1509064 - protein, 28 aa, Mycobacterium tuberculosis
PKDKLDSYVRPLLAISAQRVSKGGNPLF

SEQ ID NO: 1509065 - protein, 26 aa, Mycobacterium tuberculosis
PLFQRRHLLLSGWIKMQEGQLPSASA

SEQ ID NO: 1509066 - protein, 18 aa, Mycobacterium tuberculosis
PLHPGFAASWQRLRTAPA

SEQ ID NO: 1509067 - protein, 21 aa, Mycobacterium tuberculosis
PLLVACDLQRPAAVNQLQVVG

SEQ ID NO: 1509068 - protein, 20 aa, Mycobacterium tuberculosis
PLLVSVFLEKDFAFVVSSEA

SEQ ID NO: 1509069 - protein, 50 aa, Mycobacterium tuberculosis
PLPDVPWTRFFGVRPVSILYRLYRPLIFALYCLPLNWLRRKHGLSSLGWD

SEQ ID NO: 1509070 - protein, 18 aa, Mycobacterium tuberculosis
PMHYFPPRSHRFTRSALD

SEQ ID NO: 1509071 - protein, 42 aa, Mycobacterium tuberculosis; identical to SEQ ID NO: 226685

SEQ ID NO: 1509072 - protein, 20 aa, Mycobacterium tuberculosis
PNGVSVYRHVPWRVHKVYSS

SEQ ID NO: 1509073 - protein, 30 aa, Mycobacterium tuberculosis; identical to SEQ ID NO: 221357

SEQ ID NO: 1509074 - protein, 17 aa, Mycobacterium tuberculosis
PPAEPFLVELRGPSGDT

SEQ ID NO: 1509075 - protein, 20 aa, Mycobacterium tuberculosis
PPTIPIISTTYADLGISLGS

SEQ ID NO: 1509076 - protein, 20 aa, Mycobacterium tuberculosis
PRAVRLPRALAAAGVPVAPP

SEQ ID NO: 1509077 - protein, 22 aa, Mycobacterium tuberculosis
PRDPLLRLSNFFDDGSVELLHE

SEQ ID NO: 1509078 - protein, 25 aa, Mycobacterium tuberculosis
PRELHVVNVLPRRGIGKVDRAALVR

SEQ ID NO: 1509079 - protein, 24 aa, Mycobacterium tuberculosis
PSLAWAETYPGTLSYYLASAFGEV

SEQ ID NO: 1509080 - protein, 18 aa, Mycobacterium tuberculosis
PSRGLIGWRTDFLTETRG

SEQ ID NO: 1509081 - protein, 22 aa, Mycobacterium tuberculosis
PTACILCECNCGIVVQVDDRRL

SEQ ID NO: 1509082 - protein, 21 aa, Mycobacterium tuberculosis
PTLDTAAWLGAAGFIDVGIKR

SEQ ID NO: 1509083 - protein, 26 aa, Mycobacterium tuberculosis
PTLDYVVVKAPRFAFEKFPGADPTLT

SEQ ID NO: 1509084 - protein, 17 aa, Mycobacterium tuberculosis
PTLSIPSVTVPPITIPA

SEQ ID NO: 1509085 - protein, 23 aa, Mycobacterium tuberculosis
PTPLLDFIAPKVAGLSFSGLLGA

SEQ ID NO: 1509086 - protein, 26 aa, Mycobacterium tuberculosis
PTPSANSIAWLLWHSARVQDIQVAHV

SEQ ID NO: 1509087 - protein, 19 aa, Mycobacterium tuberculosis
PTYGFARQRFWLGDNGELS

SEQ ID NO: 1509088 - protein, 18 aa, Mycobacterium tuberculosis
PVAITPRRYRCYTDRLTR

SEQ ID NO: 1509089 - protein, 30 aa, Mycobacterium tuberculosis; identical to SEQ ID NO: 221486

SEQ ID NO: 1509090 - protein, 29 aa, Mycobacterium tuberculosis
PVGEEWLYQSWAAAYLPLLQVLAALADEN

SEQ ID NO: 1509091 - protein, 22 aa, Mycobacterium tuberculosis
PVLLAWVTPIVTALADVVPAEQ

SEQ ID NO: 1509092 - protein, 25 aa, Mycobacterium tuberculosis
PVRRQFYWHRFFSHQPDLNYDNPAV

SEQ ID NO: 1509093 - protein, 23 aa, Mycobacterium tuberculosis
PWMRGDGLGSQRRKFGFYDDDRE

SEQ ID NO: 1509094 - protein, 19 aa, Mycobacterium tuberculosis
QAALGFLLDNGCHHLQLIV

SEQ ID NO: 1509095 - protein, 23 aa, Mycobacterium tuberculosis
QAAVDLSTIRRKAAKRLAKEVSA

SEQ ID NO: 1509096 - protein, 34 aa, Mycobacterium tuberculosis; identical to SEQ ID NO: 221557

SEQ ID NO: 1509097 - protein, 23 aa, Mycobacterium tuberculosis
QAGRLLAHLTADDGLTALDVGWS

SEQ ID NO: 1509098 - protein, 21 aa, Mycobacterium tuberculosis
QAHALARHFGARRKAYNWTVA

SEQ ID NO: 1509099 - protein, 21 aa, Mycobacterium tuberculosis
QALAIITFSTVVHGWDLAVAT

SEQ ID NO: 1509100 - protein, 25 aa, Mycobacterium tuberculosis
QAREELPYLPDRQPRRALATLIDHA

SEQ ID NO: 1509101 - protein, 26 aa, Mycobacterium tuberculosis
QAVHTLPMLYALREQTPDTSRLRELL

SEQ ID NO: 1509102 - protein, 19 aa, Mycobacterium tuberculosis
QAVPVTRLWLSKQQTSDLM

SEQ ID NO: 1509103 - protein, 24 aa, Mycobacterium tuberculosis
QAVTPAARALPLTSLTSAAERGPG

SEQ ID NO: 1509104 - protein, 25 aa, Mycobacterium tuberculosis
QAVTPAARALPLTSLTSAAQTAPGH

SEQ ID NO: 1509105 - protein, 17 aa, Mycobacterium tuberculosis
QAVVELLRRGITARDIL

SEQ ID NO: 1509106 - protein, 22 aa, Mycobacterium tuberculosis
QEPTVLPSRFPNLLANGSGGIA

SEQ ID NO: 1509107 - protein, 18 aa, Mycobacterium tuberculosis
QESLEAILALFRAAPDER

SEQ ID NO: 1509108 - protein, 17 aa, Mycobacterium tuberculosis
QFCYLQLSGKRSRRGQP

SEQ ID NO: 1509109 - protein, 38 aa, Mycobacterium tuberculosis; identical to SEQ ID NO: 221642

SEQ ID NO: 1509110 - protein, 17 aa, Mycobacterium tuberculosis
QGMADGGLLLPLGVRRL

SEQ ID NO: 1509111 - protein, 24 aa, Mycobacterium tuberculosis
QGRNPFWDRLSRAMYRLARPTAAA

SEQ ID NO: 1509112 - protein, 22 aa, Mycobacterium tuberculosis
QGVPFVLPNAWDVPSALAYLAE

SEQ ID NO: 1509113 - protein, 22 aa, Mycobacterium tuberculosis
QGWRHLPDWPPATTERAWYLQP

SEQ ID NO: 1509114 - protein, 25 aa, Mycobacterium tuberculosis
QLAQRLPGYLVPAAVVVIDALPLTV

SEQ ID NO: 1509115 - protein, 20 aa, Mycobacterium tuberculosis
QLGEFAVIDRLVRGRRQPAT

SEQ ID NO: 1509116 - protein, 17 aa, Mycobacterium tuberculosis
QLGFTLSGATPADAYPT

SEQ ID NO: 1509117 - protein, 21 aa, Mycobacterium tuberculosis
QLPSGWMVTAAKFEVEWPADP

SEQ ID NO: 1509118 - protein, 26 aa, Mycobacterium tuberculosis
QLTLSPFTAIALSKWSALSPTGRCNS

SEQ ID NO: 1509119 - protein, 20 aa, Mycobacterium tuberculosis
QLVERFFEARKMMSSMLGGM

SEQ ID NO: 1509120 - protein, 19 aa, Mycobacterium tuberculosis
QPKGVVGVISPWNYPMTLT

SEQ ID NO: 1509121 - protein, 18 aa, Mycobacterium tuberculosis
QPLLPGIGKTTVCYQPKG

SEQ ID NO: 1509122 - protein, 18 aa, Mycobacterium tuberculosis
QPMTPQLGMMEPLTLTVG

SEQ ID NO: 1509123 - protein, 31 aa, Mycobacterium tuberculosis; identical to SEQ ID NO: 163438

SEQ ID NO: 1509124 - protein, 29 aa, Mycobacterium tuberculosis
QPTEPVLKLLKITGDWQKFKGLPGAQGRL

SEQ ID NO: 1509125 - protein, 27 aa, Mycobacterium tuberculosis
QQVAAELVPVLRPRGLFAHDVDLAGEA

SEQ ID NO: 1509126 - protein, 24 aa, Mycobacterium tuberculosis
QQVAPWWRRRPHRSLTSLGQWSWR

SEQ ID NO: 1509127 - protein, 20 aa, Mycobacterium tuberculosis
QRYESGALRQAGFYGLDLYS

SEQ ID NO: 1509128 - protein, 25 aa, Mycobacterium tuberculosis
QRYRDRYIFAGLQPGQRIPSRWLDS

SEQ ID NO: 1509129 - protein, 21 aa, Mycobacterium tuberculosis
QTAPGHMLGGLPLGQLTNSGG

SEQ ID NO: 1509130 - protein, 23 aa, Mycobacterium tuberculosis
QTERPKVLILGSGPNRIGQGIEF

SEQ ID NO: 1509131 - protein, 18 aa, Mycobacterium tuberculosis
QTGRRFPSVAPRLNRLMT

SEQ ID NO: 1509132 - protein, 24 aa, Mycobacterium tuberculosis
QVAKNMMQAFFFDLQAINAGGSRP

SEQ ID NO: 1509133 - protein, 17 aa, Mycobacterium tuberculosis
QVDLWTFGDTGRSIIVL

SEQ ID NO: 1509134 - protein, 21 aa, Mycobacterium tuberculosis
QVLAPVVFTSALGLGDLFCPD

SEQ ID NO: 1509135 - protein, 19 aa, Mycobacterium tuberculosis
QVWQPQPAAELPMTQRYFL

SEQ ID NO: 1509136 - protein, 19 aa, Mycobacterium tuberculosis
QWGCFRFGIVQGCDHFTFF

SEQ ID NO: 1509137 - protein, 17 aa, Mycobacterium tuberculosis
QYVKFDQRYLRPTEVDS

SEQ ID NO: 1509138 - protein, 18 aa, Mycobacterium tuberculosis
QYWSEICQIPISFITETV

SEQ ID NO: 1509139 - protein, 21 aa, Mycobacterium tuberculosis
RAAGIGELTFFSKIHYGGGAA

SEQ ID NO: 1509140 - protein, 18 aa, Mycobacterium tuberculosis
RAALQRWSLMRSDHPVTS

SEQ ID NO: 1509141 - protein, 25 aa, Mycobacterium tuberculosis
RAARVVVPDFQLSLAIGKEGQNARL

SEQ ID NO: 1509142 - protein, 18 aa, Mycobacterium tuberculosis
RADLVIGAVLVPGAKAPK

SEQ ID NO: 1509143 - protein, 28 aa, Mycobacterium tuberculosis
RAEMEMKVLLWAVQRLIGGLSTIGAERD

SEQ ID NO: 1509144 - protein, 23 aa, Mycobacterium tuberculosis
RAGAPEVSGWLDGLRAAKRALVV

SEQ ID NO: 1509145 - protein, 23 aa, Mycobacterium tuberculosis
RAGHRLKFWTPGGSSTPLLTDEH

SEQ ID NO: 1509146 - protein, 19 aa, Mycobacterium tuberculosis
RAGRRLWVYGRAGQGCRRC

SEQ ID NO: 1509147 - protein, 23 aa, Mycobacterium tuberculosis
RAGYRLLYSVRQYALEKLSESGE

SEQ ID NO: 1509148 - protein, 21 aa, Mycobacterium tuberculosis
RAMIVAEELWIYASSGDRVAI

SEQ ID NO: 1509149 - protein, 21 aa, Mycobacterium tuberculosis
RAQARSWWRIGEPYEGVDVAT

SEQ ID NO: 1509150 - protein, 20 aa, Mycobacterium tuberculosis
RAQRRLPDTPVLPPLDVAAS

SEQ ID NO: 1509151 - protein, 22 aa, Mycobacterium tuberculosis
RARYLLDGLDILPLTEPVIGLA

SEQ ID NO: 1509152 - protein, 20 aa, Mycobacterium tuberculosis
RASLDAVTKYPWMRGDGLGS

SEQ ID NO: 1509153 - protein, 22 aa, Mycobacterium tuberculosis
RATAFVYIGEICRYLLNQPAKP

SEQ ID NO: 1509154 - protein, 27 aa, Mycobacterium tuberculosis
RATIPPNLHFSQWNPAIDAASTRFFVP

SEQ ID NO: 1509155 - protein, 17 aa, Mycobacterium tuberculosis
RAVLRAADRLELAEGLR

SEQ ID NO: 1509156 - protein, 20 aa, Mycobacterium tuberculosis
RAYLGLLDVLGRRGDIACDG

SEQ ID NO: 1509157 - protein, 20 aa, Mycobacterium tuberculosis
RAYVHPHRRVTTGPKVVSRI

SEQ ID NO: 1509158 - protein, 32 aa, Mycobacterium tuberculosis; identical to SEQ ID NO: 222004

SEQ ID NO: 1509159 - protein, 27 aa, Mycobacterium tuberculosis
RCSKGSFYLRPIVRPVILVAGGTGLSA

SEQ ID NO: 1509160 - protein, 34 aa, Mycobacterium tuberculosis; identical to SEQ ID NO: 222007

SEQ ID NO: 1509161 - protein, 25 aa, Mycobacterium tuberculosis
RDEATRPLVICDLGMPRDVDPAVAR

SEQ ID NO: 1509162 - protein, 20 aa, Mycobacterium tuberculosis
RDIAMVFQSYALYPHMTVRQ

SEQ ID NO: 1509163 - protein, 26 aa, Mycobacterium tuberculosis
RDPGPLRRLIATLPALEVPRPDWPAE

SEQ ID NO: 1509164 - protein, 31 aa, Mycobacterium tuberculosis; identical to SEQ ID NO: 222046

SEQ ID NO: 1509165 - protein, 18 aa, Mycobacterium tuberculosis
RDWAAKGTLLLGVRAVIA

SEQ ID NO: 1509166 - protein, 23 aa, Mycobacterium tuberculosis
REALLLELAYELEEARPWARIHA

SEQ ID NO: 1509167 - protein, 24 aa, Mycobacterium tuberculosis
RELDVWLPVHPVTRRRWPNGRVTH

SEQ ID NO: 1509168 - protein, 35 aa, Mycobacterium tuberculosis; identical to SEQ ID NO: 226802

SEQ ID NO: 1509169 - protein, 30 aa, Mycobacterium tuberculosis; identical to SEQ ID NO: 222090

SEQ ID NO: 1509170 - protein, 22 aa, Mycobacterium tuberculosis
RFAFFEQTFVRHALTPRCSRTD

SEQ ID NO: 1509171 - protein, 19 aa, Mycobacterium tuberculosis
RFHRPILANDKLYFDTYLD

SEQ ID NO: 1509172 - protein, 18 aa, Mycobacterium tuberculosis
RFRAWRVGGYNEYLYTFF

SEQ ID NO: 1509173 - protein, 19 aa, Mycobacterium tuberculosis
RFRSRALPSTFATWRERRK

SEQ ID NO: 1509174 - protein, 18 aa, Mycobacterium tuberculosis
RGAGWNVIKVVWGREWDA

SEQ ID NO: 1509175 - protein, 18 aa, Mycobacterium tuberculosis
RGCEGDALLMLLDANGIE

SEQ ID NO: 1509176 - protein, 19 aa, Mycobacterium tuberculosis
RGDLAVAIDALRRPERRRG

SEQ ID NO: 1509177 - protein, 18 aa, Mycobacterium tuberculosis
RGFDLDLTELIYFDQRND

SEQ ID NO: 1509178 - protein, 24 aa, Mycobacterium tuberculosis
RGFERFYGFLGGETDQWYPDLVYD

SEQ ID NO: 1509179 - protein, 36 aa, Mycobacterium tuberculosis; identical to SEQ ID NO: 222155

SEQ ID NO: 1509180 - protein, 25 aa, Mycobacterium tuberculosis
RGSSLDALTLSVLRSWLAATAGAGA

SEQ ID NO: 1509181 - protein, 17 aa, Mycobacterium tuberculosis
RHFGARRKAYNWTVAQL

SEQ ID NO: 1509182 - protein, 19 aa, Mycobacterium tuberculosis
RHHDGLLAALRALLCSGEL

SEQ ID NO: 1509183 - protein, 20 aa, Mycobacterium tuberculosis
RHLAPSALYRMFYKARKAAG

SEQ ID NO: 1509184 - protein, 28 aa, Mycobacterium tuberculosis
RHPASVGFPLHHPPMRTFLGVPVRIRDE

SEQ ID NO: 1509185 - protein, 26 aa, Mycobacterium tuberculosis
RHTQTWIQKYIFPGGLLPSTQAIIDI

SEQ ID NO: 1509186 - protein, 31 aa, Mycobacterium tuberculosis; identical to SEQ ID NO: 222223

SEQ ID NO: 1509187 - protein, 26 aa, Mycobacterium tuberculosis
RIDVTVRISGFFRDAFPHVVTMLDDA

SEQ ID NO: 1509188 - protein, 26 aa, Mycobacterium tuberculosis
RIGELPRGLHRLAGAAGLLGAGFPEA

SEQ ID NO: 1509189 - protein, 20 aa, Mycobacterium tuberculosis
RIRAANFAALRPWPGLTVEI

SEQ ID NO: 1509190 - protein, 27 aa, Mycobacterium tuberculosis
RITEAVYFVERLVDCLAFELKMDPAEL

SEQ ID NO: 1509191 - protein, 19 aa, Mycobacterium tuberculosis
RITWSNWIDEQLLGPQRFT

SEQ ID NO: 1509192 - protein, 18 aa, Mycobacterium tuberculosis
RKFDCEAWIPTQGAYREL

SEQ ID NO: 1509193 - protein, 20 aa, Mycobacterium tuberculosis
RKIFDLLEHAPVDVAVLTDA

SEQ ID NO: 1509194 - protein, 17 aa, Mycobacterium tuberculosis
RLAALLRFSADRAADWY

SEQ ID NO: 1509195 - protein, 24 aa, Mycobacterium tuberculosis
RLAELAGLPLFERLAQRIVDGERN

SEQ ID NO: 1509196 - protein, 17 aa, Mycobacterium tuberculosis
RLANWAAAINPLESGWP

SEQ ID NO: 1509197 - protein, 17 aa, Mycobacterium tuberculosis
RLCDAFGIPLVVVVDVP

SEQ ID NO: 1509198 - protein, 20 aa, Mycobacterium tuberculosis
RLDRLAGELSVWSRAAVQIA

SEQ ID NO: 1509199 - protein, 25 aa, Mycobacterium tuberculosis
RLGDLHAVTLHRLLGAKPGARFRQD

SEQ ID NO: 1509200 - protein, 27 aa, Mycobacterium tuberculosis
RLGRPEELAGLYLYLASEASSYMTGSD

SEQ ID NO: 1509201 - protein, 28 aa, Mycobacterium tuberculosis
RLGWGWARFAFTSWKTLGWVDANVWRHV

SEQ ID NO: 1509202 - protein, 17 aa, Mycobacterium tuberculosis
RLIAMKLVASRASDYMR

SEQ ID NO: 1509203 - protein, 17 aa, Mycobacterium tuberculosis
RLIDLATRMPRVLADTP

SEQ ID NO: 1509204 - protein, 19 aa, Mycobacterium tuberculosis
RLLDALPPRRQPPKTVPPL

SEQ ID NO: 1509205 - protein, 17 aa, Mycobacterium tuberculosis
RLLWSELVAQFAPKSAK

SEQ ID NO: 1509206 - protein, 25 aa, Mycobacterium tuberculosis
RLPEIPQLRWRVTGAPLGLDRPWFV

SEQ ID NO: 1509207 - protein, 24 aa, Mycobacterium tuberculosis
RLPEPLAMLSPDEGLLTAGWATLR

SEQ ID NO: 1509208 - protein, 17 aa, Mycobacterium tuberculosis
RLPRLIGHSRAMDMILT

SEQ ID NO: 1509209 - protein, 27 aa, Mycobacterium tuberculosis
RLQDRVLLRFGLHQALRLGKPLQFHVG

SEQ ID NO: 1509210 - protein, 17 aa, Mycobacterium tuberculosis
RLQPGRMFLVDTAQGRI

SEQ ID NO: 1509211 - protein, 19 aa, Mycobacterium tuberculosis
RLRALDYPKVVIGVSGGLD

SEQ ID NO: 1509212 - protein, 18 aa, Mycobacterium tuberculosis
RLRALEHGVEVIGYWGEA

SEQ ID NO: 1509213 - protein, 18 aa, Mycobacterium tuberculosis
RLRLVLEVPTLREVPTWH

SEQ ID NO: 1509214 - protein, 20 aa, Mycobacterium tuberculosis
RLSVPASWSTAAPATAAGAA

SEQ ID NO: 1509215 - protein, 19 aa, Mycobacterium tuberculosis
RLVLDPGLGFAKTAQHNWA

SEQ ID NO: 1509216 - protein, 23 aa, Mycobacterium tuberculosis
RLVPADFIGFAQPLDDLPTAEGT

SEQ ID NO: 1509217 - protein, 20 aa, Mycobacterium tuberculosis
RLYHVLHAIADTIRHNEAAL

SEQ ID NO: 1509218 - protein, 18 aa, Mycobacterium tuberculosis
RMRSLLMPAFTRAALRGY

SEQ ID NO: 1509219 - protein, 22 aa, Mycobacterium tuberculosis
RPARWMQLLAKHRAQISSAPNF

SEQ ID NO: 1509220 - protein, 18 aa, Mycobacterium tuberculosis
RPDQLHKLATKLADCLNP

SEQ ID NO: 1509221 - protein, 18 aa, Mycobacterium tuberculosis
RPEIWDEFTTRFGVARVC

SEQ ID NO: 1509222 - protein, 17 aa, Mycobacterium tuberculosis
RPGEFVFVLGYLGHVRA

SEQ ID NO: 1509223 - protein, 27 aa, Mycobacterium tuberculosis
RPGQKLRIVKYLAYGWSSLRSRPALRD

SEQ ID NO: 1509224 - protein, 27 aa, Mycobacterium tuberculosis
RQPSTHTIFVLGRPITAGAFSAVAREV

SEQ ID NO: 1509225 - protein, 18 aa, Mycobacterium tuberculosis
RQRIVGIAGIDTRAVVRH

SEQ ID NO: 1509226 - protein, 23 aa, Mycobacterium tuberculosis
RQYRDMRILGIGGGTTEILTALA

SEQ ID NO: 1509227 - protein, 25 aa, Mycobacterium tuberculosis
RRAPGPSWYHFTLNGAPGSILADKA

SEQ ID NO: 1509228 - protein, 18 aa, Mycobacterium tuberculosis
RRCRAKRWGGAAPVTRAG

SEQ ID NO: 1509229 - protein, 28 aa, Mycobacterium tuberculosis
RRGRVQSVLLPRLLDWMSYAPDPDGGLL

SEQ ID NO: 1509230 - protein, 20 aa, Mycobacterium tuberculosis
RRMFVPFHDGVISQFEGYSE

SEQ ID NO: 1509231 - protein, 17 aa, Mycobacterium tuberculosis
RRVKAMSYGLAYGLSAY

SEQ ID NO: 1509232 - protein, 22 aa, Mycobacterium tuberculosis
RSGDTLLIVDGLFFQQPSVRHK

SEQ ID NO: 1509233 - protein, 24 aa, Mycobacterium tuberculosis
RSGYPLELLVRAAAAGWRVVELDV

SEQ ID NO: 1509234 - protein, 21 aa, Mycobacterium tuberculosis
RSLVDLFEALFVPVPSGSASN

SEQ ID NO: 1509235 - protein, 17 aa, Mycobacterium tuberculosis
RSTLLVQTPADVAALNL

SEQ ID NO: 1509236 - protein, 19 aa, Mycobacterium tuberculosis
RTDEARQILGHRAMIVAGG

SEQ ID NO: 1509237 - protein, 17 aa, Mycobacterium tuberculosis
RTFLGVPVRIRDEVFGN

SEQ ID NO: 1509238 - protein, 32 aa, Mycobacterium tuberculosis; identical to SEQ ID NO: 222633

SEQ ID NO: 1509239 - protein, 17 aa, Mycobacterium tuberculosis
RTGPTPWSGSETLPGGT

SEQ ID NO: 1509240 - protein, 25 aa, Mycobacterium tuberculosis
RTGRITPFAFMTPVKVAGSTVGQAT

SEQ ID NO: 1509241 - protein, 19 aa, Mycobacterium tuberculosis
RTHLHIEIVPGLAASSAVP

SEQ ID NO: 1509242 - protein, 19 aa, Mycobacterium tuberculosis
RTLIARDLDAAYRSVDVLV

SEQ ID NO: 1509243 - protein, 18 aa, Mycobacterium tuberculosis
RVALPLHPEYRTMPMVWY

SEQ ID NO: 1509244 - protein, 23 aa, Mycobacterium tuberculosis
RVCGYEITPALRGVPTPGLGRIS

SEQ ID NO: 1509245 - protein, 17 aa, Mycobacterium tuberculosis
RVHLFFGARYACELYDL

SEQ ID NO: 1509246 - protein, 18 aa, Mycobacterium tuberculosis
RVLLHEMAHRRRAQGLTV

SEQ ID NO: 1509247 - protein, 24 aa, Mycobacterium tuberculosis
RVVDKLLHAPTVRIKQLASAPGGD

SEQ ID NO: 1509248 - protein, 24 aa, Mycobacterium tuberculosis
RVWSRATIGLAYASALIIADRHDE

SEQ ID NO: 1509249 - protein, 20 aa, Mycobacterium tuberculosis
RVYAAPYFHQFDAYRSIYVR

SEQ ID NO: 1509250 - protein, 18 aa, Mycobacterium tuberculosis
RYEFTSYRGDRIGIVARR

SEQ ID NO: 1509251 - protein, 25 aa, Mycobacterium tuberculosis
RYSGRAYLIQIRRAEAGTVLIDPVS

SEQ ID NO: 1509252 - protein, 31 aa, Mycobacterium tuberculosis; identical to SEQ ID NO: 222752

SEQ ID NO: 1509253 - protein, 29 aa, Mycobacterium tuberculosis
SAAGVLELAWTTGLIRWEDDPQPGWYDTE

SEQ ID NO: 1509254 - protein, 24 aa, Mycobacterium tuberculosis
SADDALALLIYTSGSTGAPKGAMY

SEQ ID NO: 1509255 - protein, 32 aa, Mycobacterium tuberculosis
SAGGGGWVGAVNFGPISVQGFGLFGHGGDGGN

SEQ ID NO: 1509256 - protein, 20 aa, Mycobacterium tuberculosis
SALALRFYGDAELYRLIAAA

SEQ ID NO: 1509257 - protein, 22 aa, Mycobacterium tuberculosis
SALGPKLPELWGGSADLAGSNN

SEQ ID NO: 1509258 - protein, 18 aa, Mycobacterium tuberculosis
SALGVRVTLVIRGSCLLR

SEQ ID NO: 1509259 - protein, 17 aa, Mycobacterium tuberculosis
SALYRMFYKARKAAGRP

SEQ ID NO: 1509260 - protein, 26 aa, Mycobacterium tuberculosis
SANFAAGRLAYILGARGPAVVIDTAC

SEQ ID NO: 1509261 - protein, 24 aa, Mycobacterium tuberculosis
SARPIRVLHLDDLVRFLVLALNTD

SEQ ID NO: 1509262 - protein, 19 aa, Mycobacterium tuberculosis
SAYPRVLDFAAFRSIADEV

SEQ ID NO: 1509263 - protein, 25 aa, Mycobacterium tuberculosis
SDGQARMWFVQMADPSGALLNICVS

SEQ ID NO: 1509264 - protein, 18 aa, Mycobacterium tuberculosis
SDIYLPLHGEHQAHNAVL

SEQ ID NO: 1509265 - protein, 23 aa, Mycobacterium tuberculosis
SDMFGELSIFDPGPRTSSATTIT

SEQ ID NO: 1509266 - protein, 20 aa, Mycobacterium tuberculosis
SDPAYFPCYAKCVELGVPVS

SEQ ID NO: 1509267 - protein, 27 aa, Mycobacterium tuberculosis
SDRAGAITPFALLQLADRGQFFVEPGQ

SEQ ID NO: 1509268 - protein, 17 aa, Mycobacterium tuberculosis
SDYLAGRAFSFISAIDS

SEQ ID NO: 1509269 - protein, 25 aa, Mycobacterium tuberculosis
SELWPDLNLGLPFTYHQGYQSSPVP

SEQ ID NO: 1509270 - protein, 18 aa, Mycobacterium tuberculosis
SFDAAAARKFGCGFAPSG

SEQ ID NO: 1509271 - protein, 22 aa, Mycobacterium tuberculosis
SGALAWAIYALLTVPGTWESAA

SEQ ID NO: 1509272 - protein, 34 aa, Mycobacterium tuberculosis; identical to SEQ ID NO: 222899

SEQ ID NO: 1509273 - protein, 31 aa, Mycobacterium tuberculosis; identical to SEQ ID NO: 222900

SEQ ID NO: 1509274 - protein, 19 aa, Mycobacterium tuberculosis
SGGLMRLGSAVAPLLQVGG

SEQ ID NO: 1509275 - protein, 21 aa, Mycobacterium tuberculosis
SGHALLLGARGRRLDVRQART

SEQ ID NO: 1509276 - protein, 24 aa, Mycobacterium tuberculosis
SGMNRIRLSTTVDAALLTSARDMR

SEQ ID NO: 1509277 - protein, 24 aa, Mycobacterium tuberculosis
SGNPYLAFSAMLMAGLDGIKNKIE

SEQ ID NO: 1509278 - protein, 27 aa, Mycobacterium tuberculosis
SGNYSNGFFWRGDYQGLIGFSGTLTIP

SEQ ID NO: 1509279 - protein, 29 aa, Mycobacterium tuberculosis
SGRTVGVLANNPLRLGGCLNSESAEKAAR

SEQ ID NO: 1509280 - protein, 24 aa, Mycobacterium tuberculosis
SGTDMFWPGWRMAPSPAQLAFLQQ

SEQ ID NO: 1509281 - protein, 17 aa, Mycobacterium tuberculosis
SHALASIDAFAAAVDGA

SEQ ID NO: 1509282 - protein, 28 aa, Mycobacterium tuberculosis
SHQLPVWTLRLYLTGKRLWHDPRRRDCA

SEQ ID NO: 1509283 - protein, 23 aa, Mycobacterium tuberculosis
SIMGIGFPPWTGGSAQFIVGYSG

SEQ ID NO: 1509284 - protein, 19 aa, Mycobacterium tuberculosis
SIRVFPGDHFYLNDNLPEL

SEQ ID NO: 1509285 - protein, 25 aa, Mycobacterium tuberculosis
SIVDRLMYNAFRAAYEPTLAALTTT

SEQ ID NO: 1509286 - protein, 21 aa, Mycobacterium tuberculosis
SIWIGPRVVIPSLALRARVRE

SEQ ID NO: 1509287 - protein, 21 aa, Mycobacterium tuberculosis
SKITAVMAALRRWARDRGLNP

SEQ ID NO: 1509288 - protein, 30 aa, Mycobacterium tuberculosis
SLDKVLGVHNFYFWPDPRASLCDIARALRP

SEQ ID NO: 1509289 - protein, 31 aa, Mycobacterium tuberculosis; identical to SEQ ID NO: 223006

SEQ ID NO: 1509290 - protein, 20 aa, Mycobacterium tuberculosis
SLGLLDDFPPYDSVFDPVNR

SEQ ID NO: 1509291 - protein, 25 aa, Mycobacterium tuberculosis
SLGNPLYLRHLIDGGGLEHVDGRWR

SEQ ID NO: 1509292 - protein, 17 aa, Mycobacterium tuberculosis
SLLMPAFTRAALRGYRD

SEQ ID NO: 1509293 - protein, 25 aa, Mycobacterium tuberculosis
SLLPLPNIPLLEYAARFITPVHPGY

SEQ ID NO: 1509294 - protein, 17 aa, Mycobacterium tuberculosis
SLVIRIAPPVGRQLDWM

SEQ ID NO: 1509295 - protein, 24 aa, Mycobacterium tuberculosis
SLYDSYIRAFRWATDRIGDNGVVG

SEQ ID NO: 1509296 - protein, 17 aa, Mycobacterium tuberculosis
SMVSLTLMARLAEAVRP

SEQ ID NO: 1509297 - protein, 23 aa, Mycobacterium tuberculosis
SNVPGPPFPLYMAGARLDSLVPL

SEQ ID NO: 1509298 - protein, 18 aa, Mycobacterium tuberculosis
SPALDLYGLLSPRADRHL

SEQ ID NO: 1509299 - protein, 43 aa, Mycobacterium tuberculosis; identical to SEQ ID NO: 223062

SEQ ID NO: 1509300 - protein, 19 aa, Mycobacterium tuberculosis
SPLNLLRWTSARSIKETFV

SEQ ID NO: 1509301 - protein, 28 aa, Mycobacterium tuberculosis
SPLQARCGWAVGWRKDAFFGRAALLAEK

SEQ ID NO: 1509302 - protein, 28 aa, Mycobacterium tuberculosis
SRAGGRYSVYLWALLAMAAARCGLGPLR

SEQ ID NO: 1509303 - protein, 23 aa, Mycobacterium tuberculosis
SRALRRVRAVLTAAARCHRSGSL

SEQ ID NO: 1509304 - protein, 24 aa, Mycobacterium tuberculosis
SRARYLMLRLLERAGEQRVAIPAL

SEQ ID NO: 1509305 - protein, 25 aa, Mycobacterium tuberculosis
SRDRFFTALWGVRALLGGLGAASRW

SEQ ID NO: 1509306 - protein, 20 aa, Mycobacterium tuberculosis
SRRWLLNLVITRGTPPRLEG

SEQ ID NO: 1509307 - protein, 21 aa, Mycobacterium tuberculosis
SRVGFLGWSMGGYGALLLGAR

SEQ ID NO: 1509308 - protein, 24 aa, Mycobacterium tuberculosis
SSEPGHGLALAALGLDPIVDLHMR

SEQ ID NO: 1509309 - protein, 27 aa, Mycobacterium tuberculosis
STDPRSRVPALPRLGPTDALPRCRQTV

SEQ ID NO: 1509310 - protein, 34 aa, Mycobacterium tuberculosis; identical to SEQ ID NO: 223192

SEQ ID NO: 1509311 - protein, 31 aa, Mycobacterium tuberculosis; identical to SEQ ID NO: 223194

SEQ ID NO: 1509312 - protein, 20 aa, Mycobacterium tuberculosis
SVATAMIPFLEHDDANRALM

SEQ ID NO: 1509313 - protein, 29 aa, Mycobacterium tuberculosis
SVDELVPRSLHWLRPITPTFRPSWPDHSR

SEQ ID NO: 1509314 - protein, 26 aa, Mycobacterium tuberculosis
SVEHFNWLEGLGFQFERSYFPGKAVI

SEQ ID NO: 1509315 - protein, 23 aa, Mycobacterium tuberculosis
SVFDHRAVVVGADRGRLMAGLAG

SEQ ID NO: 1509316 - protein, 31 aa, Mycobacterium tuberculosis; identical to SEQ ID NO: 223212

SEQ ID NO: 1509317 - protein, 24 aa, Mycobacterium tuberculosis
SVTGFGVHPVLLDAALHAVVLSAE

SEQ ID NO: 1509318 - protein, 24 aa, Mycobacterium tuberculosis
SYGTYFLCADPRPLGYDDSTEFCA

SEQ ID NO: 1509319 - protein, 19 aa, Mycobacterium tuberculosis
TACAYDHLIPGRGVGVLLD

SEQ ID NO: 1509320 - protein, 36 aa, Mycobacterium tuberculosis
TADNLLTMVRRLPPGAIWQVIAIGKANMELTAMGLA

SEQ ID NO: 1509321 - protein, 26 aa, Mycobacterium tuberculosis
TAGLDADYWYRNVRQTVLFDQAVRNA

SEQ ID NO: 1509322 - protein, 17 aa, Mycobacterium tuberculosis
TALLAPDWVPWEQRVRP

SEQ ID NO: 1509323 - protein, 22 aa, Mycobacterium tuberculosis
TANEALYDWNYQRQLLSIRLAE

SEQ ID NO: 1509324 - protein, 20 aa, Mycobacterium tuberculosis
TAPGHMLGGLPLGHSVNAGS

SEQ ID NO: 1509325 - protein, 21 aa, Mycobacterium tuberculosis
TAQIRLMGMLGRPLPAQVAQL

SEQ ID NO: 1509326 - protein, 20 aa, Mycobacterium tuberculosis
TATRAPFVLLTSNATRELSE

SEQ ID NO: 1509327 - protein, 19 aa, Mycobacterium tuberculosis
TAVRFIGRLPRKGPWQQKV

SEQ ID NO: 1509328 - protein, 20 aa, Mycobacterium tuberculosis
TDAYVRLIAMKLVASRASDY

SEQ ID NO: 1509329 - protein, 17 aa, Mycobacterium tuberculosis
TDLRWRIVTALATAGAI

SEQ ID NO: 1509330 - protein, 25 aa, Mycobacterium tuberculosis
TDPGEQLYTLDYYLKLAEQIVDAGA

SEQ ID NO: 1509331 - protein, 21 aa, Mycobacterium tuberculosis
TDPTLAVDWPLVDGAAPSLSD

SEQ ID NO: 1509332 - protein, 31 aa, Mycobacterium tuberculosis; identical to SEQ ID NO: 117795

SEQ ID NO: 1509333 - protein, 19 aa, Mycobacterium tuberculosis
TDYDTADRLYFEPLTFEDV

SEQ ID NO: 1509334 - protein, 19 aa, Mycobacterium tuberculosis
TFGRIGVKVWIYKGDIVGG

SEQ ID NO: 1509335 - protein, 17 aa, Mycobacterium tuberculosis
TFIGVMPAGQALAIITF

SEQ ID NO: 1509336 - protein, 22 aa, Mycobacterium tuberculosis
TFTICSFWLVSALVEIGEVGRA

SEQ ID NO: 1509337 - protein, 25 aa, Mycobacterium tuberculosis
TGFLGRYLVLELLRRLDVDGRLICL

SEQ ID NO: 1509338 - protein, 17 aa, Mycobacterium tuberculosis
TGGNWLDALLRGLDHNR

SEQ ID NO: 1509339 - protein, 24 aa, Mycobacterium tuberculosis
TGKFRQQTLDRWLAGASATRPHHV

SEQ ID NO: 1509340 - protein, 27 aa, Mycobacterium tuberculosis
TGLSLSPTLIFDYPTPNRLASYIRTEL

SEQ ID NO: 1509341 - protein, 26 aa, Mycobacterium tuberculosis
TGLTLPPTLIFDYPTAAELAEHLDIQ

SEQ ID NO: 1509342 - protein, 32 aa, Mycobacterium tuberculosis; identical to SEQ ID NO: 223451

SEQ ID NO: 1509343 - protein, 18 aa, Mycobacterium tuberculosis
THQVIVVTHLPQVAAYAD

SEQ ID NO: 1509344 - protein, 27 aa, Mycobacterium tuberculosis
TITEVYDYLRLLYARAGTPHCPTCGER

SEQ ID NO: 1509345 - protein, 23 aa, Mycobacterium tuberculosis
TKEYTAHWYGRTLHFGVREHAMG

SEQ ID NO: 1509346 - protein, 20 aa, Mycobacterium tuberculosis
TLATTRWLVAILENHQRPDG

SEQ ID NO: 1509347 - protein, 33 aa, Mycobacterium tuberculosis; identical to SEQ ID NO: 117916

SEQ ID NO: 1509348 - protein, 24 aa, Mycobacterium tuberculosis
TLSRTHPNLVRKLFSLEVPEIADG

SEQ ID NO: 1509349 - protein, 25 aa, Mycobacterium tuberculosis
TLTPETPLAAVTRYFAAYNLVCGPV

SEQ ID NO: 1509350 - protein, 24 aa, Mycobacterium tuberculosis
TNNFAILAGDYRFATASQLASRLD

SEQ ID NO: 1509351 - protein, 17 aa, Mycobacterium tuberculosis
TPLGLAHRLADAGVPIV

SEQ ID NO: 1509352 - protein, 20 aa, Mycobacterium tuberculosis
TPRSPWLRTGDLGFIVGDEF

SEQ ID NO: 1509353 - protein, 20 aa, Mycobacterium tuberculosis
TPTLKGPLELLPNAVRPAVS

SEQ ID NO: 1509354 - protein, 30 aa, Mycobacterium tuberculosis; identical to SEQ ID NO: 223610

SEQ ID NO: 1509355 - protein, 19 aa, Mycobacterium tuberculosis
TQPWLADHQIHGAAALPGA

SEQ ID NO: 1509356 - protein, 24 aa, Mycobacterium tuberculosis
TQRPAPQFEVMYLLAVCDAAAADQ

SEQ ID NO: 1509357 - protein, 22 aa, Mycobacterium tuberculosis
TQSATWMALFSGQTTVLAPEFN

SEQ ID NO: 1509358 - protein, 25 aa, Mycobacterium tuberculosis
TRAAICRFATWWVVLERHGNLVRLY

SEQ ID NO: 1509359 - protein, 22 aa, Mycobacterium tuberculosis
TSMLHAMLIAGGRRAVLCGNIG

SEQ ID NO: 1509360 - protein, 20 aa, Mycobacterium tuberculosis
TTLLAIVQKLPTSMVVSRAR

SEQ ID NO: 1509361 - protein, 30 aa, Mycobacterium tuberculosis; identical to SEQ ID NO: 223699

SEQ ID NO: 1509362 - protein, 17 aa, Mycobacterium tuberculosis
TVFLLCAPSVDPEDIAV

SEQ ID NO: 1509363 - protein, 19 aa, Mycobacterium tuberculosis
TVHPALVAANRALVAWLAG

SEQ ID NO: 1509364 - protein, 18 aa, Mycobacterium tuberculosis
TVHSYAYAVLRKAAQRAG

SEQ ID NO: 1509365 - protein, 26 aa, Mycobacterium tuberculosis
TVIVAPMFHAWGFSQLVLASSLACTI

SEQ ID NO: 1509366 - protein, 25 aa, Mycobacterium tuberculosis
TVRRAAPFATLPRSLFEATLDLLSG

SEQ ID NO: 1509367 - protein, 17 aa, Mycobacterium tuberculosis
TVWSRRWRQRWAPPTSV

SEQ ID NO: 1509368 - protein, 20 aa, Mycobacterium tuberculosis
VAALFSRRGFNIESLAVGAT

SEQ ID NO: 1509369 - protein, 36 aa, Mycobacterium tuberculosis; identical to SEQ ID NO: 223784

SEQ ID NO: 1509370 - protein, 24 aa, Mycobacterium tuberculosis
VADMTYLQWLRRYVELAIGEGNST

SEQ ID NO: 1509371 - protein, 18 aa, Mycobacterium tuberculosis
VAENLSIASLRREKDDVT

SEQ ID NO: 1509372 - protein, 25 aa, Mycobacterium tuberculosis
VAGDDVFRAWWDLAGNRAGPPSMAR

SEQ ID NO: 1509373 - protein, 21 aa, Mycobacterium tuberculosis
VAKPDLLQLITTDSAPIITRA

SEQ ID NO: 1509374 - protein, 27 aa, Mycobacterium tuberculosis
VALSRYSYLVSLLPSRIVADLGAPVRL

SEQ ID NO: 1509375 - protein, 24 aa, Mycobacterium tuberculosis
VAMCGLFHGPRLRDMDARHGGSII

SEQ ID NO: 1509376 - protein, 26 aa, Mycobacterium tuberculosis
VAMESRARRFPKGLAAFIGLRDQRCR

SEQ ID NO: 1509377 - protein, 18 aa, Mycobacterium tuberculosis
VAMFNQFCYLQLSGKRSR

SEQ ID NO: 1509378 - protein, 19 aa, Mycobacterium tuberculosis
VAMPLRLTSPAPCTNCHGS

SEQ ID NO: 1509379 - protein, 17 aa, Mycobacterium tuberculosis
VARFDAHGALTNADEAI

SEQ ID NO: 1509380 - protein, 20 aa, Mycobacterium tuberculosis
VASAATRWVWVSDAATLDTD

SEQ ID NO: 1509381 - protein, 26 aa, Mycobacterium tuberculosis
VASDLMLAKLRHGLPGAVFVSARTGD

SEQ ID NO: 1509382 - protein, 25 aa, Mycobacterium tuberculosis
VATETFAPILYVLTYDDLDEAIALN

SEQ ID NO: 1509383 - protein, 24 aa, Mycobacterium tuberculosis
VAVLLRITEVFGVDATFFASQDDT

SEQ ID NO: 1509384 - protein, 23 aa, Mycobacterium tuberculosis
VCTRLIRSALPDATLRLVVDPRK

SEQ ID NO: 1509385 - protein, 17 aa, Mycobacterium tuberculosis
VCVLLDAPQLVDAPLRA

SEQ ID NO: 1509386 - protein, 31 aa, Mycobacterium tuberculosis; identical to SEQ ID NO: 122924

SEQ ID NO: 1509387 - protein, 24 aa, Mycobacterium tuberculosis
VDAQFYWMSAKVPNDQFLLYAFDG

SEQ ID NO: 1509388 - protein, 18 aa, Mycobacterium tuberculosis
VEDLFVWPRFRRRGLARG

SEQ ID NO: 1509389 - protein, 17 aa, Mycobacterium tuberculosis
VEDTEGGIIWRVSAAWQ

SEQ ID NO: 1509390 - protein, 22 aa, Mycobacterium tuberculosis
VEGALVTLDWLGAHGFGRLLQH

SEQ ID NO: 1509391 - protein, 26 aa, Mycobacterium tuberculosis
VELSKELRPWVPVVSLVKGLEQGTNM

SEQ ID NO: 1509392 - protein, 18 aa, Mycobacterium tuberculosis
VERATAERLPLLASPSSG

SEQ ID NO: 1509393 - protein, 24 aa, Mycobacterium tuberculosis
VERRHVPANQWLFHAGEPADSIYI

SEQ ID NO: 1509394 - protein, 25 aa, Mycobacterium tuberculosis
VERRYRAWIRWNAAIMVHRAQRPGV

SEQ ID NO: 1509395 - protein, 36 aa, Mycobacterium tuberculosis; identical to SEQ ID NO: 223957

SEQ ID NO: 1509396 - protein, 17 aa, Mycobacterium tuberculosis
VFDELSIRVTWFDYDGY

SEQ ID NO: 1509397 - protein, 17 aa, Mycobacterium tuberculosis
VGIHSLAWARLAPVVAL

SEQ ID NO: 1509398 - protein, 19 aa, Mycobacterium tuberculosis
VGLGMPGVGLPVSAAKPGG

SEQ ID NO: 1509399 - protein, 20 aa, Mycobacterium tuberculosis
VGLVPLPSKWRIAFGEPICT

SEQ ID NO: 1509400 - protein, 26 aa, Mycobacterium tuberculosis
VGTWHGRSPRLWLVTGGGLSVADDEP

SEQ ID NO: 1509401 - protein, 17 aa, Mycobacterium tuberculosis
VGYPIKWRDYSKLAIDR

SEQ ID NO: 1509402 - protein, 18 aa, Mycobacterium tuberculosis
VHLITCLAEPDPSWWDRL

SEQ ID NO: 1509403 - protein, 23 aa, Mycobacterium tuberculosis
VHVTELVAYLRRLCAVDVHCMGA

SEQ ID NO: 1509404 - protein, 18 aa, Mycobacterium tuberculosis
VICVDLRRTFVPSKGFGL

SEQ ID NO: 1509405 - protein, 17 aa, Mycobacterium tuberculosis
VIDIRDLDFMGSCAYAV

SEQ ID NO: 1509406 - protein, 22 aa, Mycobacterium tuberculosis
VIDRTALILDIFAQHATSREGK

SEQ ID NO: 1509407 - protein, 21 aa, Mycobacterium tuberculosis
VIEPLPNLVFTRDSSIWIGPR

SEQ ID NO: 1509408 - protein, 19 aa, Mycobacterium tuberculosis
VIIDQLRVIRGKRLALQDV

SEQ ID NO: 1509409 - protein, 17 aa, Mycobacterium tuberculosis
VISLVRDPEAAARYAAN

SEQ ID NO: 1509410 - protein, 20 aa, Mycobacterium tuberculosis
VKDIFFLVCDGLKGLPDSVS

SEQ ID NO: 1509411 - protein, 27 aa, Mycobacterium tuberculosis
VLPDPAPPLILFLTAGSGITPVMSMLR

SEQ ID NO: 1509412 - protein, 25 aa, Mycobacterium tuberculosis
VLQSSWVHLLPSRKEGWGLAVIEAA

SEQ ID NO: 1509413 - protein, 21 aa, Mycobacterium tuberculosis
VLVGIAFLRAPCRVVYVIDEP

SEQ ID NO: 1509414 - protein, 28 aa, Mycobacterium tuberculosis
VLVTGYDILFFWVARMMMFGTFVGDDAA

SEQ ID NO: 1509415 - protein, 28 aa, Mycobacterium tuberculosis
VMPETVTWILRDLGVYAIRLSDDVPGFG

SEQ ID NO: 1509416 - protein, 26 aa, Mycobacterium tuberculosis
VNAAAPDVIRLAPPLIIAEAQLDGFV

SEQ ID NO: 1509417 - protein, 19 aa, Mycobacterium tuberculosis
VNGIVFNRAFTGAVQTIYD

SEQ ID NO: 1509418 - protein, 26 aa, Mycobacterium tuberculosis
VNPDAAWYYRRPSPLARRIKNHVAFW

SEQ ID NO: 1509419 - protein, 19 aa, Mycobacterium tuberculosis
VPISGILFGGRRKTTVPLV

SEQ ID NO: 1509420 - protein, 21 aa, Mycobacterium tuberculosis
VPLVAGPLPVAFFIGVLAGEE

SEQ ID NO: 1509421 - protein, 18 aa, Mycobacterium tuberculosis
VPPLTMKPDVCWQLPIRR

SEQ ID NO: 1509422 - protein, 18 aa, Mycobacterium tuberculosis
VQRYPNVRLLPTGANLGY

SEQ ID NO: 1509423 - protein, 29 aa, Mycobacterium tuberculosis
VRAEVAVLKILALQFIMSDPRHLETQARQ

SEQ ID NO: 1509424 - protein, 20 aa, Mycobacterium tuberculosis
VRAYAPVRTARYCYTRVTKV

SEQ ID NO: 1509425 - protein, 19 aa, Mycobacterium tuberculosis
VRGLRITPQQLRDIAEREG

SEQ ID NO: 1509426 - protein, 18 aa, Mycobacterium tuberculosis
VRNNFSWLNSYYDDMAWL

SEQ ID NO: 1509427 - protein, 23 aa, Mycobacterium tuberculosis
VSADELMAAARRLSRLPVVAAVG

SEQ ID NO: 1509428 - protein, 29 aa, Mycobacterium tuberculosis
VSDDGRWRIVGNIPRGMFVGGRRGSSVTV

SEQ ID NO: 1509429 - protein, 25 aa, Mycobacterium tuberculosis
VSENLRYVAAWNAAFLPSKDLTEGI

SEQ ID NO: 1509430 - protein, 23 aa, Mycobacterium tuberculosis
VSLPVVRAFIHRIKERARGAEVS

SEQ ID NO: 1509431 - protein, 27 aa, Mycobacterium tuberculosis
VSMESRARLFPRGLAAFIELRDQRCRT

SEQ ID NO: 1509432 - protein, 25 aa, Mycobacterium tuberculosis
VSRQYHRWLYPHPIADLEAWTTANW

SEQ ID NO: 1509433 - protein, 18 aa, Mycobacterium tuberculosis
VSRRALLALARAEYRILG

SEQ ID NO: 1509434 - protein, 24 aa, Mycobacterium tuberculosis
VSSLYTAIPFAQDASVLVIGERTN

SEQ ID NO: 1509435 - protein, 22 aa, Mycobacterium tuberculosis
VTPVEHGLVLPSGPLIHGGTGG

SEQ ID NO: 1509436 - protein, 32 aa, Mycobacterium tuberculosis; identical to SEQ ID NO: 224350

SEQ ID NO: 1509437 - protein, 23 aa, Mycobacterium tuberculosis
VTTNTHFLQTPPAAPMVAASLGA

SEQ ID NO: 1509438 - protein, 25 aa, Mycobacterium tuberculosis
VTVDDLLDHLLPHDWRVDMPELDPS

SEQ ID NO: 1509439 - protein, 22 aa, Mycobacterium tuberculosis
VTVPVSFTELALGSTLSVPTLD

SEQ ID NO: 1509440 - protein, 27 aa, Mycobacterium tuberculosis
VTWTEEQTYFFRLSAYTDKLLAHYHAN

SEQ ID NO: 1509441 - protein, 20 aa, Mycobacterium tuberculosis
VVARGRLMQALPAGGAMVAV

SEQ ID NO: 1509442 - protein, 17 aa, Mycobacterium tuberculosis
VVELLRRGITARDILTK

SEQ ID NO: 1509443 - protein, 19 aa, Mycobacterium tuberculosis
VVGVISPWNYPMTLTVSDS

SEQ ID NO: 1509444 - protein, 18 aa, Mycobacterium tuberculosis
VVLKGGAIAWAAMGDANA

SEQ ID NO: 1509445 - protein, 19 aa, Mycobacterium tuberculosis
VVNLNGLDFMGCCAVAVLA

SEQ ID NO: 1509446 - protein, 19 aa, Mycobacterium tuberculosis
VVPSMRPAPYSVAPGVDCV

SEQ ID NO: 1509447 - protein, 26 aa, Mycobacterium tuberculosis
VVRRARFAAAFTFQYSKRPGTPAAQL

SEQ ID NO: 1509448 - protein, 19 aa, Mycobacterium tuberculosis
VVVQTMVAPGLLSWRDIAR

SEQ ID NO: 1509449 - protein, 19 aa, Mycobacterium tuberculosis
VVVVEWGEGLAERLSQRHL

SEQ ID NO: 1509450 - protein, 22 aa, Mycobacterium tuberculosis
VYYRAMFSGRVTSWNLRDQHMA

SEQ ID NO: 1509451 - protein, 20 aa, Mycobacterium tuberculosis
WARHIRAVVRFGDSVRSAHC

SEQ ID NO: 1509452 - protein, 24 aa, Mycobacterium tuberculosis
WAVSSPRVLSDLFWMGRYGERAEN

SEQ ID NO: 1509453 - protein, 17 aa, Mycobacterium tuberculosis
WEGRAVGLAQRWGSRNP

SEQ ID NO: 1509454 - protein, 32 aa, Mycobacterium tuberculosis; identical to SEQ ID NO: 224468

SEQ ID NO: 1509455 - protein, 21 aa, Mycobacterium tuberculosis
WGVVTEKGRWYLVGHDRDRDA

SEQ ID NO: 1509456 - protein, 24 aa, Mycobacterium tuberculosis
WPLRTFECTVPPGRLGWGWARFAF

SEQ ID NO: 1509457 - protein, 17 aa, Mycobacterium tuberculosis
WPTALQAAGFDSAAPTA

SEQ ID NO: 1509458 - protein, 24 aa, Mycobacterium tuberculosis
WRDPRVWWQLRNPFTPSWGEPYVD

SEQ ID NO: 1509459 - protein, 27 aa, Mycobacterium tuberculosis
WRDRHRAMVMLVERLEGWAITKARGDD

SEQ ID NO: 1509460 - protein, 17 aa, Mycobacterium tuberculosis
WRERFMQRRDGLAHLGF

SEQ ID NO: 1509461 - protein, 33 aa, Mycobacterium tuberculosis; identical to SEQ ID NO: 224518

SEQ ID NO: 1509462 - protein, 24 aa, Mycobacterium tuberculosis
WTDELAQLPSLLAEKVRAPSVMPG

SEQ ID NO: 1509463 - protein, 24 aa, Mycobacterium tuberculosis
WVNTIFLSTRFRAWRVGGYNEYLY

SEQ ID NO: 1509464 - protein, 25 aa, Mycobacterium tuberculosis
WVSISVGCNNSCTFCIVPSLRGREV

SEQ ID NO: 1509465 - protein, 18 aa, Mycobacterium tuberculosis
WWCRMVVMSAERIARRGG

SEQ ID NO: 1509466 - protein, 17 aa, Mycobacterium tuberculosis
WYGLQDLARIKAGDKVL

SEQ ID NO: 1509467 - protein, 19 aa, Mycobacterium tuberculosis
WYPLTACLPLAPDHTNPDT

SEQ ID NO: 1509468 - protein, 17 aa, Mycobacterium tuberculosis
YAAQHIPLVVFGGKEYG

SEQ ID NO: 1509469 - protein, 24 aa, Mycobacterium tuberculosis
YAAYYEQWAQPWEIQALLRAHAVA

SEQ ID NO: 1509470 - protein, 25 aa, Mycobacterium tuberculosis
YADGKRSGLWPGLRETFKSGSSQPP

SEQ ID NO: 1509471 - protein, 22 aa, Mycobacterium tuberculosis
YADVLGYFRRIENVTAAWHFVS

SEQ ID NO: 1509472 - protein, 19 aa, Mycobacterium tuberculosis
YAPFYAFVSHDGRRVIPAP

SEQ ID NO: 1509473 - protein, 18 aa, Mycobacterium tuberculosis
YAVPRLLARNGLSLQDFD

SEQ ID NO: 1509474 - protein, 18 aa, Mycobacterium tuberculosis
YDVIIRDGLWFDGTGNAP

SEQ ID NO: 1509475 - protein, 27 aa, Mycobacterium tuberculosis
YEGGPTPVLQWLLYPRTDFTAQTRSMG

SEQ ID NO: 1509476 - protein, 29 aa, Mycobacterium tuberculosis
YFSRQRLRDLGLWGLTNFDRVDFVYTDVH

SEQ ID NO: 1509477 - protein, 22 aa, Mycobacterium tuberculosis
YGALLLGARLGPARTAGICAIS

SEQ ID NO: 1509478 - protein, 35 aa, Mycobacterium tuberculosis; identical to SEQ ID NO: 224601

SEQ ID NO: 1509479 - protein, 27 aa, Mycobacterium tuberculosis
YGSASILPITWAYIRMMGAEGLRAASL

SEQ ID NO: 1509480 - protein, 19 aa, Mycobacterium tuberculosis
YIPVVGHALSAAFQAPFCA

SEQ ID NO: 1509481 - protein, 18 aa, Mycobacterium tuberculosis
YKRIRILGGHRLGMMMRI

SEQ ID NO: 1509482 - protein, 19 aa, Mycobacterium tuberculosis
YLAIFDRGKALALYHTKRL

SEQ ID NO: 1509483 - protein, 24 aa, Mycobacterium tuberculosis
YLDGYPRLHLKLSVIGVAAGVAGL

SEQ ID NO: 1509484 - protein, 28 aa, Mycobacterium tuberculosis
YLIGKSYRFRRLELARFLAALHATVLDN

SEQ ID NO: 1509485 - protein, 36 aa, Mycobacterium tuberculosis; identical to SEQ ID NO: 224636

SEQ ID NO: 1509486 - protein, 18 aa, Mycobacterium tuberculosis
YLSPAPMYHTAPSVWTMS

SEQ ID NO: 1509487 - protein, 28 aa, Mycobacterium tuberculosis
YNLGFALPIALPRRTVVTFTPEHTGAIT

SEQ ID NO: 1509488 - protein, 24 aa, Mycobacterium tuberculosis
YRESLGFEVLPLSGGERPPFEVLC

SEQ ID NO: 1509489 - protein, 28 aa, Mycobacterium tuberculosis
YRIWLEQNKQRWLAFFQAEGGAAAARWI

SEQ ID NO: 1509490 - protein, 17 aa, Mycobacterium tuberculosis
YRVAHGPGVALAKLRLP

SEQ ID NO: 1509491 - protein, 37 aa, Mycobacterium tuberculosis; identical to SEQ ID NO: 225827

SEQ ID NO: 1509492 - protein, 17 aa, Mycobacterium tuberculosis
YSQPFFGGDYRVLRGGS

SEQ ID NO: 1509493 - protein, 17 aa, Mycobacterium tuberculosis
YSTRLRIQLEPVRPFVA

SEQ ID NO: 1509494 - protein, 21 aa, Mycobacterium tuberculosis
YVDASYWRDMGTPEDFVRGSA

SEQ ID NO: 1509495 - protein, 20 aa, Mycobacterium tuberculosis
YVFATPYIEAGDWRETLRNH

SEQ ID NO: 1509496 - protein, 29 aa, Mycobacterium tuberculosis
YVHNRLLTLLLFDIGSFAGLAALLNSAVV

SEQ ID NO: 1509497 - protein, 20 aa, Mycobacterium tuberculosis
YVKEDVAIRRLLSSGLERAG

SEQ ID NO: 1509498 - protein, 17 aa, Mycobacterium tuberculosis
YYPKRPAGVKLAPTSKL

SEQ ID NO: 1509499 - protein, 24 aa, Mycobacterium tuberculosis
AAAKAGITALTLSAARALGRYGVC

SEQ ID NO: 1509500 - protein, 19 aa, Mycobacterium tuberculosis
AAALPEYMLPAAYVVLDEI

SEQ ID NO: 1509501 - protein, 39 aa, Mycobacterium tuberculosis; identical to SEQ ID NO: 215442

SEQ ID NO: 1509502 - protein, 19 aa, Mycobacterium tuberculosis
AAAYDAWYDSPTGRPILAT

SEQ ID NO: 1509503 - protein, 28 aa, Mycobacterium tuberculosis
AACLRKTDWLFPQYRELGVYLVRGIPPG

SEQ ID NO: 1509504 - protein, 27 aa, Mycobacterium tuberculosis
AADIEVPAPPFWGSRIVKGLAVADYTG

SEQ ID NO: 1509505 - protein, 19 aa, Mycobacterium tuberculosis
AADLAYFRVLIHSTRNRAL

SEQ ID NO: 1509506 - protein, 24 aa, Mycobacterium tuberculosis
AADSLAEYVLELARKLIKPEERSV

SEQ ID NO: 1509507 - protein, 29 aa, Mycobacterium tuberculosis
AADWSKRPLPSAWLNYAALDVELLIELRA

SEQ ID NO: 1509508 - protein, 28 aa, Mycobacterium tuberculosis
AAFAIMQIKAIFSVLLREYEFEMAQPPE

SEQ ID NO: 1509509 - protein, 21 aa, Mycobacterium tuberculosis
AAFAMTVPPPAIAANRTLLMT

SEQ ID NO: 1509510 - protein, 26 aa, Mycobacterium tuberculosis
AAGLDSRAYRLPWPDGTTVFELDRPQ

SEQ ID NO: 1509511 - protein, 24 aa, Mycobacterium tuberculosis
AAGPHGRVLATETYFSVGGGFIVT

SEQ ID NO: 1509512 - protein, 20 aa, Mycobacterium tuberculosis
AAISAPLRPGSGMPPIGVPV

SEQ ID NO: 1509513 - protein, 20 aa, Mycobacterium tuberculosis
AALDLLVSGRYPFASLPRRC

SEQ ID NO: 1509514 - protein, 20 aa, Mycobacterium tuberculosis
AALVHHYFGTKQQLFAAAIH

SEQ ID NO: 1509515 - protein, 28 aa, Mycobacterium tuberculosis
AANPLDPHWLLDTLGLTEAARTTYRRLS

SEQ ID NO: 1509516 - protein, 19 aa, Mycobacterium tuberculosis
AAPVLNAELLRRAKHSGLS

SEQ ID NO: 1509517 - protein, 20 aa, Mycobacterium tuberculosis
AAQGWGGRWLVVGADVDPGR

SEQ ID NO: 1509518 - protein, 25 aa, Mycobacterium tuberculosis
AAQVRQWLAAHLPAADLRPAYSNAD

SEQ ID NO: 1509519 - protein, 27 aa, Mycobacterium tuberculosis
AASAFQSVVWGLTVGSWIGSSAGLMVA

SEQ ID NO: 1509520 - protein, 17 aa, Mycobacterium tuberculosis
AATHRAMWALGDYALMA

SEQ ID NO: 1509521 - protein, 22 aa, Mycobacterium tuberculosis
AATVPPPVVAANRAELAVLAAT

SEQ ID NO: 1509522 - protein, 34 aa, Mycobacterium tuberculosis; identical to SEQ ID NO: 215616

SEQ ID NO: 1509523 - protein, 24 aa, Mycobacterium tuberculosis
ADARLLAGQRRLASAIAGGAPMYQ

SEQ ID NO: 1509524 - protein, 38 aa, Mycobacterium tuberculosis; identical to SEQ ID NO: 215638

SEQ ID NO: 1509525 - protein, 24 aa, Mycobacterium tuberculosis
ADQMRGVRLMFMQSNGGLAQAGHF

SEQ ID NO: 1509526 - protein, 26 aa, Mycobacterium tuberculosis
ADRDWWAQRIPQLPDPPALPTRAGGE

SEQ ID NO: 1509527 - protein, 23 aa, Mycobacterium tuberculosis
ADRYRRLHVIIGDANLAETSTYL

SEQ ID NO: 1509528 - protein, 17 aa, Mycobacterium tuberculosis
ADYPEVSLGIYASPRQT

SEQ ID NO: 1509529 - protein, 23 aa, Mycobacterium tuberculosis
AEADHIASFALPIDDLDLTVRSY

SEQ ID NO: 1509530 - protein, 30 aa, Mycobacterium tuberculosis; identical to SEQ ID NO: 215705

SEQ ID NO: 1509531 - protein, 30 aa, Mycobacterium tuberculosis; identical to SEQ ID NO: 215712

SEQ ID NO: 1509532 - protein, 26 aa, Mycobacterium tuberculosis
AEHQAIIRDVLTASDFWGGAGSAACQ

SEQ ID NO: 1509533 - protein, 17 aa, Mycobacterium tuberculosis
AEIRNRYDGRSLRFAAA

SEQ ID NO: 1509534 - protein, 27 aa, Mycobacterium tuberculosis
AELHDVDWVPADRGWIADLARTLNGSA

SEQ ID NO: 1509535 - protein, 23 aa, Mycobacterium tuberculosis
AELVAWLEQLLSDSVLRDQLGAK

SEQ ID NO: 1509536 - protein, 28 aa, Mycobacterium tuberculosis
AEPEDFVGALIYLLSDASSFYTGQVMYL

SEQ ID NO: 1509537 - protein, 26 aa, Mycobacterium tuberculosis
AEPPDRPIPGPLKWDLTRGVATDTPE

SEQ ID NO: 1509538 - protein, 24 aa, Mycobacterium tuberculosis
AERGYGYGPAFRGLTAMWRRGDEV

SEQ ID NO: 1509539 - protein, 20 aa, Mycobacterium tuberculosis
AERPALSLSLDEACLLMFAR

SEQ ID NO: 1509540 - protein, 25 aa, Mycobacterium tuberculosis
AEVNGQVFIVYGPQVTLVSPPHMER

SEQ ID NO: 1509541 - protein, 17 aa, Mycobacterium tuberculosis
AFAKTPPTVVMLAGLQG

SEQ ID NO: 1509542 - protein, 19 aa, Mycobacterium tuberculosis
AFDGLRLAGRRVRRPELTL

SEQ ID NO: 1509543 - protein, 24 aa, Mycobacterium tuberculosis
AFDIAQFGWVGDAFPLSSLTQIYA

SEQ ID NO: 1509544 - protein, 25 aa, Mycobacterium tuberculosis
AFHAWVQQFYGAELLFDLGDLPGAA

SEQ ID NO: 1509545 - protein, 27 aa, Mycobacterium tuberculosis
AFSDDLTLLPVASIPVPGPVGVLDALA

SEQ ID NO: 1509546 - protein, 19 aa, Mycobacterium tuberculosis
AGAALAPGLRGPVLVLGGP

SEQ ID NO: 1509547 - protein, 24 aa, Mycobacterium tuberculosis
AGAELMLGMRRFAPSSSTSLYVYA

SEQ ID NO: 1509548 - protein, 29 aa, Mycobacterium tuberculosis
AGDQAGFPLGWVHDVVWAPRPIGGPDAAG

SEQ ID NO: 1509549 - protein, 29 aa, Mycobacterium tuberculosis
AGGDIPFYEPGLRKLLTDNLAAGRLRFTT

SEQ ID NO: 1509550 - protein, 33 aa, Mycobacterium tuberculosis; identical to SEQ ID NO: 215849

SEQ ID NO: 1509551 - protein, 21 aa, Mycobacterium tuberculosis
AGIQVTVRYFAAARAAAGAGS

SEQ ID NO: 1509552 - protein, 20 aa, Mycobacterium tuberculosis
AGNITAYWKGYTEYHQLGLI

SEQ ID NO: 1509553 - protein, 22 aa, Mycobacterium tuberculosis
AGTFPWVLAITMPYSDAAQRGA

SEQ ID NO: 1509554 - protein, 18 aa, Mycobacterium tuberculosis
AGTLTYAALAAAGDMVSL

SEQ ID NO: 1509555 - protein, 25 aa, Mycobacterium tuberculosis
AGTNGFAGFGGSAGGGGWVGAVNFG

SEQ ID NO: 1509556 - protein, 22 aa, Mycobacterium tuberculosis
AGTTANWIFLLARTDPSAAKHR

SEQ ID NO: 1509557 - protein, 18 aa, Mycobacterium tuberculosis
AHGRGVFVLAATSNPEGA

SEQ ID NO: 1509558 - protein, 25 aa, Mycobacterium tuberculosis
AIAIDERALAQRPAWLAAAEALTTE

SEQ ID NO: 1509559 - protein, 41 aa, Mycobacterium tuberculosis; identical to SEQ ID NO: 216037

SEQ ID NO: 1509560 - protein, 24 aa, Mycobacterium tuberculosis
AKYPGTQWRFEYSPESYTGTELEY

SEQ ID NO: 1509561 - protein, 26 aa, Mycobacterium tuberculosis
ALAPDRPFFVYFAPGATHAPHHVPRE

SEQ ID NO: 1509562 - protein, 18 aa, Mycobacterium tuberculosis
ALAQHRANLGLKARIIGI

SEQ ID NO: 1509563 - protein, 25 aa, Mycobacterium tuberculosis
ALDDKFLHDMLAEELRYSVIREVLP

SEQ ID NO: 1509564 - protein, 24 aa, Mycobacterium tuberculosis
ALGVALGVIRLLLGADYAPLAVHL

SEQ ID NO: 1509565 - protein, 23 aa, Mycobacterium tuberculosis
ALHHVLAQYPRVDPALLLNCMLL

SEQ ID NO: 1509566 - protein, 31 aa, Mycobacterium tuberculosis; identical to SEQ ID NO: 216102

SEQ ID NO: 1509567 - protein, 25 aa, Mycobacterium tuberculosis
ALNETRTGDLWLFRGRSRPDRAIQT

SEQ ID NO: 1509568 - protein, 17 aa, Mycobacterium tuberculosis
ALRESMTALLWQAQERY

SEQ ID NO: 1509569 - protein, 18 aa, Mycobacterium tuberculosis
ALRGLRLSYFGDGANNMA

SEQ ID NO: 1509570 - protein, 21 aa, Mycobacterium tuberculosis
ALSLRLIEPPPSLSRPRREPA

SEQ ID NO: 1509571 - protein, 23 aa, Mycobacterium tuberculosis
AMSKFEVLTAMAFAAFADAPVDV

SEQ ID NO: 1509572 - protein, 20 aa, Mycobacterium tuberculosis
AMSLAPLAYTLFQRTMRHDP

SEQ ID NO: 1509573 - protein, 30 aa, Mycobacterium tuberculosis; identical to SEQ ID NO: 216182

SEQ ID NO: 1509574 - protein, 23 aa, Mycobacterium tuberculosis
ANDQFAGELLAWLRDRLSHFKCP

SEQ ID NO: 1509575 - protein, 24 aa, Mycobacterium tuberculosis
ANVRGAWLVCRAAGRVLLEQGQGG

SEQ ID NO: 1509576 - protein, 17 aa, Mycobacterium tuberculosis
APGLRGPVLVLGGPGTG

SEQ ID NO: 1509577 - protein, 18 aa, Mycobacterium tuberculosis
APIQQMIDFMAARTAFFD

SEQ ID NO: 1509578 - protein, 35 aa, Mycobacterium tuberculosis; identical to SEQ ID NO: 216236

SEQ ID NO: 1509579 - protein, 28 aa, Mycobacterium tuberculosis
AQAAAVPVVFLTAWYGLADLAEIKAGES

SEQ ID NO: 1509580 - protein, 20 aa, Mycobacterium tuberculosis
AQPFGDRLAAVPIDILWSPS

SEQ ID NO: 1509581 - protein, 19 aa, Mycobacterium tuberculosis
AQRTVLCKDPFRAVDERVK

SEQ ID NO: 1509582 - protein, 27 aa, Mycobacterium tuberculosis
AQTRISGVLIDLRPYRPPDAARRHNGG

SEQ ID NO: 1509583 - protein, 19 aa, Mycobacterium tuberculosis
AQVRPIHRPPRKPADRHPH

SEQ ID NO: 1509584 - protein, 24 aa, Mycobacterium tuberculosis
ARAEPIFATVAPGVAAAPRTPGRD

SEQ ID NO: 1509585 - protein, 17 aa, Mycobacterium tuberculosis
ARAFVSERIGLAAQAYS

SEQ ID NO: 1509586 - protein, 19 aa, Mycobacterium tuberculosis
ARALDARLRLVLEVPTLRE

SEQ ID NO: 1509587 - protein, 18 aa, Mycobacterium tuberculosis
ARAWQLELVVPILTAALT

SEQ ID NO: 1509588 - protein, 17 aa, Mycobacterium tuberculosis
ARFLLGVQQLLGLGQFA

SEQ ID NO: 1509589 - protein, 25 aa, Mycobacterium tuberculosis
ARLQRLLAFVARQEPRLNWAVGVHA

SEQ ID NO: 1509590 - protein, 26 aa, Mycobacterium tuberculosis
ARVFHRAFPCLGSLAYKAYSLSFETF

SEQ ID NO: 1509591 - protein, 18 aa, Mycobacterium tuberculosis
ASHCYPHFRRFLAEVVRV

SEQ ID NO: 1509592 - protein, 25 aa, Mycobacterium tuberculosis
ASPAYLGFNLFQHAIARAVIFGTYE

SEQ ID NO: 1509593 - protein, 23 aa, Mycobacterium tuberculosis
ASYARQRPGLLAAWLDGDLGELP

SEQ ID NO: 1509594 - protein, 19 aa, Mycobacterium tuberculosis
ATGLVVVPVMFDRIMDLPA

SEQ ID NO: 1509595 - protein, 18 aa, Mycobacterium tuberculosis
ATKRRYLGKLSGPLLDRV

SEQ ID NO: 1509596 - protein, 23 aa, Mycobacterium tuberculosis
ATSIDPQQRLLLETSWEAIEHAG

SEQ ID NO: 1509597 - protein, 17 aa, Mycobacterium tuberculosis
ATVIRLSDYPYVVPLID

SEQ ID NO: 1509598 - protein, 18 aa, Mycobacterium tuberculosis
AVAKVPRGPLAAASAAIA

SEQ ID NO: 1509599 - protein, 24 aa, Mycobacterium tuberculosis
AVDSRWVWVLDPIDGTINYAAGSP

SEQ ID NO: 1509600 - protein, 23 aa, Mycobacterium tuberculosis
AVFTTPCVFYVQNNQWAISMPVS

SEQ ID NO: 1509601 - protein, 17 aa, Mycobacterium tuberculosis
AVFYQVYPRSFADSNGD

SEQ ID NO: 1509602 - protein, 17 aa, Mycobacterium tuberculosis
AVGDAVMGFLGGAGPLA

SEQ ID NO: 1509603 - protein, 22 aa, Mycobacterium tuberculosis
AVGHLLSAFVAITPLDPSQPDD

SEQ ID NO: 1509604 - protein, 29 aa, Mycobacterium tuberculosis
AVIAVHLRGHFLLTRNAAAYWRDKAKDAE

SEQ ID NO: 1509605 - protein, 25 aa, Mycobacterium tuberculosis
AVKRPEDLRFLVRLARQQGERLGRA

SEQ ID NO: 1509606 - protein, 18 aa, Mycobacterium tuberculosis
AVLSAGLMLAWCCDLIVA

SEQ ID NO: 1509607 - protein, 24 aa, Mycobacterium tuberculosis
AWRDNEWYVARLCPTPLRPQERRT

SEQ ID NO: 1509608 - protein, 17 aa, Mycobacterium tuberculosis
AYGPTRNARYCYTRLTK

SEQ ID NO: 1509609 - protein, 24 aa, Mycobacterium tuberculosis
AYLSTSLFAFWAVDAAYSLDGRRN

SEQ ID NO: 1509610 - protein, 25 aa, Mycobacterium tuberculosis
CAPAAFRFMSQARHIGKVVLTMPSA

SEQ ID NO: 1509611 - protein, 18 aa, Mycobacterium tuberculosis
CGRCRAIARCRSCTGPLS

SEQ ID NO: 1509612 - protein, 19 aa, Mycobacterium tuberculosis
CLRPLRIVVPEGSMLAPTH

SEQ ID NO: 1509613 - protein, 22 aa, Mycobacterium tuberculosis
CRFPTVVSPGDLWDLLRDGREA

SEQ ID NO: 1509614 - protein, 18 aa, Mycobacterium tuberculosis
CRRLDGVPLAIELAAART

SEQ ID NO: 1509615 - protein, 23 aa, Mycobacterium tuberculosis
CVHDPLIMRRALEYATGLGVLIA

SEQ ID NO: 1509616 - protein, 21 aa, Mycobacterium tuberculosis
CYPHFRRFLAEVVRVLRPGGY

SEQ ID NO: 1509617 - protein, 17 aa, Mycobacterium tuberculosis
DAALIDVVLPLVDGLPD

SEQ ID NO: 1509618 - protein, 25 aa, Mycobacterium tuberculosis
DAEVLIDLVRRYAPKLALIVTSHQH

SEQ ID NO: 1509619 - protein, 17 aa, Mycobacterium tuberculosis
DAMLPGATGLRAPLACL

SEQ ID NO: 1509620 - protein, 28 aa, Mycobacterium tuberculosis
DAQFVRRQRAWLRTRASRQPRETPATLP

SEQ ID NO: 1509621 - protein, 24 aa, Mycobacterium tuberculosis
DCTGYIVQLPLPKHLDENAALERV

SEQ ID NO: 1509622 - protein, 24 aa, Mycobacterium tuberculosis
DDAAFGRIANALPAAARAAAQERP

SEQ ID NO: 1509623 - protein, 18 aa, Mycobacterium tuberculosis
DDFPPYDSVFDPVNRVLL

SEQ ID NO: 1509624 - protein, 22 aa, Mycobacterium tuberculosis
DDGSWRVFFTDLTQAYSRADLG

SEQ ID NO: 1509625 - protein, 26 aa, Mycobacterium tuberculosis
DDPVPVRVLYLGRGLAKATLFGPAEV

SEQ ID NO: 1509626 - protein, 23 aa, Mycobacterium tuberculosis
DELGTALLLITHDLALAAQRAEA

SEQ ID NO: 1509627 - protein, 25 aa, Mycobacterium tuberculosis
DFMAARTAFFDEYFLATADAGVRQV

SEQ ID NO: 1509628 - protein, 27 aa, Mycobacterium tuberculosis
DFVGSVLAVLRRLEGHFTLVFANADDP

SEQ ID NO: 1509629 - protein, 27 aa, Mycobacterium tuberculosis
DGRPEARLWALVRRQSLSRFERLAGQW

SEQ ID NO: 1509630 - protein, 17 aa, Mycobacterium tuberculosis
DGWNTFNLTLQGDVKRF

SEQ ID NO: 1509631 - protein, 17 aa, Mycobacterium tuberculosis
DHSLALLEVIRAIVDDI

SEQ ID NO: 1509632 - protein, 24 aa, Mycobacterium tuberculosis
DIGAPPQFMDFRFTLHDRWHGEFH

SEQ ID NO: 1509633 - protein, 17 aa, Mycobacterium tuberculosis
DLAAPRKIPPGTGWRKF

SEQ ID NO: 1509634 - protein, 26 aa, Mycobacterium tuberculosis
DLGGLSIALLAYQLSLNGNPAPVIDG

SEQ ID NO: 1509635 - protein, 18 aa, Mycobacterium tuberculosis
DLIVGGSTYDLAAAAALE

SEQ ID NO: 1509636 - protein, 30 aa, Mycobacterium tuberculosis; identical to SEQ ID NO: 217050

SEQ ID NO: 1509637 - protein, 32 aa, Mycobacterium tuberculosis; identical to SEQ ID NO: 217051

SEQ ID NO: 1509638 - protein, 18 aa, Mycobacterium tuberculosis
DLVSLMKVGLRRGKIIVV

SEQ ID NO: 1509639 - protein, 18 aa, Mycobacterium tuberculosis
DLVVVPLDPALPITEQRV

SEQ ID NO: 1509640 - protein, 28 aa, Mycobacterium tuberculosis
DMGPLDFPRLNWAPIEWRNLEDEQEKML

SEQ ID NO: 1509641 - protein, 26 aa, Mycobacterium tuberculosis
DNAWFIAETIGAGTFPWVLAITMPYS

SEQ ID NO: 1509642 - protein, 25 aa, Mycobacterium tuberculosis
DPATNYDVMFVPQGIGADLIATIEG

SEQ ID NO: 1509643 - protein, 25 aa, Mycobacterium tuberculosis
DPDELALPFAWQGVSLHATGASAVR

SEQ ID NO: 1509644 - protein, 17 aa, Mycobacterium tuberculosis
DPPPPPQEQGLIPGFLM

SEQ ID NO: 1509645 - protein, 24 aa, Mycobacterium tuberculosis
DPRQRLALELTWELLEDAFVVPET

SEQ ID NO: 1509646 - protein, 23 aa, Mycobacterium tuberculosis
DPSVDLIIAWNLLSAPARAQFRV

SEQ ID NO: 1509647 - protein, 27 aa, Mycobacterium tuberculosis
DRAIDYRRDGWWQGLGPYDVVLDALGG

SEQ ID NO: 1509648 - protein, 23 aa, Mycobacterium tuberculosis
DRGDRLLVITEKKSWKVKRIRNT

SEQ ID NO: 1509649 - protein, 20 aa, Mycobacterium tuberculosis
DRGTWTPAPVFTMIAQRGRV

SEQ ID NO: 1509650 - protein, 29 aa, Mycobacterium tuberculosis
DRTAHDLHLLLPDPYSFPSNLLIEHLNTD

SEQ ID NO: 1509651 - protein, 24 aa, Mycobacterium tuberculosis
DRVCYDALWTGRRFVVQDTGGWEP

SEQ ID NO: 1509652 - protein, 22 aa, Mycobacterium tuberculosis
DSLVLSDLAYTLARRRTHRSVR

SEQ ID NO: 1509653 - protein, 25 aa, Mycobacterium tuberculosis
DSRIRVLIAGSWFPRYARNLGTPEP

SEQ ID NO: 1509654 - protein, 22 aa, Mycobacterium tuberculosis
DSYGMLKLLVSTEDLKLLGVHI

SEQ ID NO: 1509655 - protein, 25 aa, Mycobacterium tuberculosis
DTSTWPVVFPELPAAPYGGPCRPPQ

SEQ ID NO: 1509656 - protein, 24 aa, Mycobacterium tuberculosis
DVLAFPDHLVPSVSPFAGATAAAM

SEQ ID NO: 1509657 - protein, 20 aa, Mycobacterium tuberculosis
DVLRAWGKLGYPRRAKRLHE

SEQ ID NO: 1509658 - protein, 17 aa, Mycobacterium tuberculosis
DVVGVLRAVLFAPEDLG

SEQ ID NO: 1509659 - protein, 17 aa, Mycobacterium tuberculosis
DWGLWKSLADVQKDATQ

SEQ ID NO: 1509660 - protein, 26 aa, Mycobacterium tuberculosis
DYSEALALARLGWAALAVGTSHAVLD

SEQ ID NO: 1509661 - protein, 22 aa, Mycobacterium tuberculosis
EAAVEHLFAVASGLDSAVIGEQ

SEQ ID NO: 1509662 - protein, 24 aa, Mycobacterium tuberculosis
EADPVLLEIFNNLFMSIAEQMGFR

SEQ ID NO: 1509663 - protein, 24 aa, Mycobacterium tuberculosis
EAERYLLGSRSALGWIIDRYRVTT

SEQ ID NO: 1509664 - protein, 22 aa, Mycobacterium tuberculosis
EAGFPGLAVAAIRVAPFAAWCA

SEQ ID NO: 1509665 - protein, 21 aa, Mycobacterium tuberculosis
ECHHLLATWGALVSALASVLG

SEQ ID NO: 1509666 - protein, 28 aa, Mycobacterium tuberculosis
ECNPAPSTLLLALLGGFERRGRWNVPKK

SEQ ID NO: 1509667 - protein, 23 aa, Mycobacterium tuberculosis
EDKPKPWRVFSAATPAESVSLVI

SEQ ID NO: 1509668 - protein, 17 aa, Mycobacterium tuberculosis
EDLLAEPLQFSIVLGVR

SEQ ID NO: 1509669 - protein, 21 aa, Mycobacterium tuberculosis
EEIFGPVLAIIPYDTEEDAIA

SEQ ID NO: 1509670 - protein, 17 aa, Mycobacterium tuberculosis
EESLPAVLAAIPAGYRA

SEQ ID NO: 1509671 - protein, 23 aa, Mycobacterium tuberculosis
EGAMAEALLFRLTRDDWQRHRTV

SEQ ID NO: 1509672 - protein, 23 aa, Mycobacterium tuberculosis
EGAYEQMWAADVAAMVGYHSGAS

SEQ ID NO: 1509673 - protein, 37 aa, Mycobacterium tuberculosis; identical to SEQ ID NO: 217523

SEQ ID NO: 1509674 - protein, 18 aa, Mycobacterium tuberculosis
EGLRMTWGRAVILEAMRR

SEQ ID NO: 1509675 - protein, 30 aa, Mycobacterium tuberculosis; identical to SEQ ID NO: 217546

SEQ ID NO: 1509676 - protein, 18 aa, Mycobacterium tuberculosis
EHRKSLTFALRFRAPDRT

SEQ ID NO: 1509677 - protein, 22 aa, Mycobacterium tuberculosis
EHVFDFFLRNKRTEWANYRSHV

SEQ ID NO: 1509678 - protein, 18 aa, Mycobacterium tuberculosis
EIEEGILPALYAAATPQA

SEQ ID NO: 1509679 - protein, 22 aa, Mycobacterium tuberculosis
EIGRGRVYRLGRGRYGPGYIPR

SEQ ID NO: 1509680 - protein, 19 aa, Mycobacterium tuberculosis
EILAEKIARWARARSAEIE

SEQ ID NO: 1509681 - protein, 38 aa, Mycobacterium tuberculosis; identical to SEQ ID NO: 224977

SEQ ID NO: 1509682 - protein, 21 aa, Mycobacterium tuberculosis
ELAAELWLAAASFESVCSGLA

SEQ ID NO: 1509683 - protein, 36 aa, Mycobacterium tuberculosis; identical to SEQ ID NO: 217600

SEQ ID NO: 1509684 - protein, 22 aa, Mycobacterium tuberculosis
ELDVFLVRKLGVPQWRELAMGA

SEQ ID NO: 1509685 - protein, 24 aa, Mycobacterium tuberculosis
ELGVLRLMMKYDPHFFTFLEIPEV

SEQ ID NO: 1509686 - protein, 17 aa, Mycobacterium tuberculosis
ELMILIATNLLGQNTPA

SEQ ID NO: 1509687 - protein, 24 aa, Mycobacterium tuberculosis
ELNSLRMFTGAGSAPMLAAAVAWD

SEQ ID NO: 1509688 - protein, 21 aa, Mycobacterium tuberculosis
ELRYSVIREVLPTRRARTFDL

SEQ ID NO: 1509689 - protein, 21 aa, Mycobacterium tuberculosis
ELSVLADCWRIAAKSLRPLPV

SEQ ID NO: 1509690 - protein, 25 aa, Mycobacterium tuberculosis
ELTGHLIFDRPPLGAEALHANSSHL

SEQ ID NO: 1509691 - protein, 18 aa, Mycobacterium tuberculosis
ELTLRCLGPVFIGSGEKR

SEQ ID NO: 1509692 - protein, 25 aa, Mycobacterium tuberculosis
ELVVRTRYFDQFFLDAAAAGVRQAV

SEQ ID NO: 1509693 - protein, 33 aa, Mycobacterium tuberculosis; identical to SEQ ID NO: 114290

SEQ ID NO: 1509694 - protein, 25 aa, Mycobacterium tuberculosis
EQAATMLPFSWQGVSLHAAGASRVR

SEQ ID NO: 1509695 - protein, 23 aa, Mycobacterium tuberculosis
ERAAVFLRAADLLAGPWREKIAA

SEQ ID NO: 1509696 - protein, 28 aa, Mycobacterium tuberculosis
ERAVQAWRGFSRWLMRAYDVLVDEDQIT

SEQ ID NO: 1509697 - protein, 18 aa, Mycobacterium tuberculosis
ERLGFRRDQLSARVDDLS

SEQ ID NO: 1509698 - protein, 30 aa, Mycobacterium tuberculosis; identical to SEQ ID NO: 217769

SEQ ID NO: 1509699 - protein, 22 aa, Mycobacterium tuberculosis
ERTLLVITRGFGDALRIAYQNR

SEQ ID NO: 1509700 - protein, 26 aa, Mycobacterium tuberculosis
ESAARALLLPRRHPGRRSPLWQQRQR

SEQ ID NO: 1509701 - protein, 26 aa, Mycobacterium tuberculosis
ESLADPLAFLLRKEGFEATVVTDGPA

SEQ ID NO: 1509702 - protein, 25 aa, Mycobacterium tuberculosis
ETEQILFRRLAPFVGGFDLAAVRAV

SEQ ID NO: 1509703 - protein, 17 aa, Mycobacterium tuberculosis
ETGCRIVLPEGADPFVL

SEQ ID NO: 1509704 - protein, 18 aa, Mycobacterium tuberculosis
ETIFGAVRFALPDVSRQA

SEQ ID NO: 1509705 - protein, 22 aa, Mycobacterium tuberculosis
ETVRIYSNGLWRDAPLRRREAM

SEQ ID NO: 1509706 - protein, 18 aa, Mycobacterium tuberculosis
EVALPASIRFQQGAYRIH

SEQ ID NO: 1509707 - protein, 25 aa, Mycobacterium tuberculosis
EVCLQMHLLNLSFAIAVRKRAKADA

SEQ ID NO: 1509708 - protein, 17 aa, Mycobacterium tuberculosis
EVIRRRLSGMKPGDVYA

SEQ ID NO: 1509709 - protein, 18 aa, Mycobacterium tuberculosis
EVSITRRMFRDGASEYEI

SEQ ID NO: 1509710 - protein, 17 aa, Mycobacterium tuberculosis
EYYAYSPGFDKKAGEWF

SEQ ID NO: 1509711 - protein, 17 aa, Mycobacterium tuberculosis
FAADYLLNQADIGMACA

SEQ ID NO: 1509712 - protein, 25 aa, Mycobacterium tuberculosis
FALTVPPAEVVANRALLAELTATNI

SEQ ID NO: 1509713 - protein, 19 aa, Mycobacterium tuberculosis
FASVVLSWARVHEPDMDRV

SEQ ID NO: 1509714 - protein, 19 aa, Mycobacterium tuberculosis
FDCSDPAKLAGWWAEQFDG

SEQ ID NO: 1509715 - protein, 17 aa, Mycobacterium tuberculosis
FDEAVGLQWALVARRHG

SEQ ID NO: 1509716 - protein, 18 aa, Mycobacterium tuberculosis
FDGPNAVNNIPFAAALHG

SEQ ID NO: 1509717 - protein, 25 aa, Mycobacterium tuberculosis
FEAGDWHLTAPLTLFGHCMGAIVAF

SEQ ID NO: 1509718 - protein, 18 aa, Mycobacterium tuberculosis
FFVPTQNSPWPTAEGPRR

SEQ ID NO: 1509719 - protein, 25 aa, Mycobacterium tuberculosis
FGAVRMVLALLPHWRERRFGHVVNV

SEQ ID NO: 1509720 - protein, 21 aa, Mycobacterium tuberculosis
FGDLLVEVLGGDAPPSGPGSR

SEQ ID NO: 1509721 - protein, 23 aa, Mycobacterium tuberculosis
FGNGGAINLGFGNSGQLNAGSFN

SEQ ID NO: 1509722 - protein, 24 aa, Mycobacterium tuberculosis
FGPGGLGTFSWPGAYGTWWQADPS

SEQ ID NO: 1509723 - protein, 18 aa, Mycobacterium tuberculosis
FHFPRIYLDYIGHGDSDK

SEQ ID NO: 1509724 - protein, 17 aa, Mycobacterium tuberculosis
FHVLRRAGTERPFTGEY

SEQ ID NO: 1509725 - protein, 21 aa, Mycobacterium tuberculosis
FIEHDSQGYRLIFENDFVTEP

SEQ ID NO: 1509726 - protein, 19 aa, Mycobacterium tuberculosis
FKGLQLDIGAPPQFMDFRF

SEQ ID NO: 1509727 - protein, 18 aa, Mycobacterium tuberculosis
FLASSRIFNRRKGVRMSM

SEQ ID NO: 1509728 - protein, 24 aa, Mycobacterium tuberculosis
FLDSFAGARRTMGLPATVVDWGLW

SEQ ID NO: 1509729 - protein, 25 aa, Mycobacterium tuberculosis
FLLDEAEVIYWGLCPDCSISDTSRS

SEQ ID NO: 1509730 - protein, 21 aa, Mycobacterium tuberculosis
FPPPNTYVAPIAFNVVPLAGS

SEQ ID NO: 1509731 - protein, 18 aa, Mycobacterium tuberculosis
FPTTARLTGRWLRGRLPT

SEQ ID NO: 1509732 - protein, 17 aa, Mycobacterium tuberculosis
FPVERFMRDAKITQIYE

SEQ ID NO: 1509733 - protein, 18 aa, Mycobacterium tuberculosis
FRMWLDAVGISEDLHRYL

SEQ ID NO: 1509734 - protein, 17 aa, Mycobacterium tuberculosis
FTLPTIHTPLISTPQIS

SEQ ID NO: 1509735 - protein, 25 aa, Mycobacterium tuberculosis
FVAAESLIAIDRLPAAIITRLTQTN

SEQ ID NO: 1509736 - protein, 18 aa, Mycobacterium tuberculosis
FVGIYHLIRQAAAQARKR

SEQ ID NO: 1509737 - protein, 23 aa, Mycobacterium tuberculosis
FVRSEGCAMVLLKRLPDALRDGN

SEQ ID NO: 1509738 - protein, 18 aa, Mycobacterium tuberculosis
FVWPRFRRRGLARGLLST

SEQ ID NO: 1509739 - protein, 25 aa, Mycobacterium tuberculosis
GAAGIVPAVLHYAIHYTSAGAGDPD

SEQ ID NO: 1509740 - protein, 45 aa, Mycobacterium tuberculosis; identical to SEQ ID NO: 218175

SEQ ID NO: 1509741 - protein, 23 aa, Mycobacterium tuberculosis
GALRTLLLRYDGKAEPLLASVPV

SEQ ID NO: 1509742 - protein, 18 aa, Mycobacterium tuberculosis
GCLLLVYPNVIAVERQLR

SEQ ID NO: 1509743 - protein, 29 aa, Mycobacterium tuberculosis
GDHDLEPGPWRLDPLPLVISAADWEVLEA

SEQ ID NO: 1509744 - protein, 18 aa, Mycobacterium tuberculosis
GDLLLLRQGQLLAHTTPH

SEQ ID NO: 1509745 - protein, 22 aa, Mycobacterium tuberculosis
GEQFGVASWTPQGEFEFGGQEA

SEQ ID NO: 1509746 - protein, 21 aa, Mycobacterium tuberculosis
GEWTVRHTVAAWPAVCSGLRS

SEQ ID NO: 1509747 - protein, 30 aa, Mycobacterium tuberculosis; identical to SEQ ID NO: 218357

SEQ ID NO: 1509748 - protein, 25 aa, Mycobacterium tuberculosis
GGGNPHYDIPKLLSMYKAGKLNLDD

SEQ ID NO: 1509749 - protein, 17 aa, Mycobacterium tuberculosis
GGNPVCAAAALAVLRVL

SEQ ID NO: 1509750 - protein, 27 aa, Mycobacterium tuberculosis
GGPATIVPMFLLYDYSFLPEGANSKAE

SEQ ID NO: 1509751 - protein, 21 aa, Mycobacterium tuberculosis
GGQVGLAAQVGLGFTAVIEAE

SEQ ID NO: 1509752 - protein, 20 aa, Mycobacterium tuberculosis
GGRPDELTLIAPASARLLVA

SEQ ID NO: 1509753 - protein, 25 aa, Mycobacterium tuberculosis
GGTGLLDLLNRLGITPLPNTAGCRS

SEQ ID NO: 1509754 - protein, 23 aa, Mycobacterium tuberculosis
GGVGWTTRRFGLSCDNLVAVRLV

SEQ ID NO: 1509755 - protein, 21 aa, Mycobacterium tuberculosis
GGVTICQWTRYFPAGDPVAAD

SEQ ID NO: 1509756 - protein, 26 aa, Mycobacterium tuberculosis
GGYCGYLLYNLTTSGFRPATFAAIVD

SEQ ID NO: 1509757 - protein, 26 aa, Mycobacterium tuberculosis
GHEVGWSMLPVARSVLRRIGDGTDVV

SEQ ID NO: 1509758 - protein, 19 aa, Mycobacterium tuberculosis
GIQRPLIVFTPKSMLRHKA

SEQ ID NO: 1509759 - protein, 20 aa, Mycobacterium tuberculosis
GKLAARLRGQGHTPLLVACD

SEQ ID NO: 1509760 - protein, 26 aa, Mycobacterium tuberculosis
GKRIERGLWLTALLQATLSTVRHPAA

SEQ ID NO: 1509761 - protein, 20 aa, Mycobacterium tuberculosis
GKVIYPGRKQVFRKLEHGVF

SEQ ID NO: 1509762 - protein, 25 aa, Mycobacterium tuberculosis
GLLDLSSLWQIYAVDRPTLKDRTFV

SEQ ID NO: 1509763 - protein, 24 aa, Mycobacterium tuberculosis
GLLGSRWLAHYTATSAFLDSFAGA

SEQ ID NO: 1509764 - protein, 36 aa, Mycobacterium tuberculosis; identical to SEQ ID NO: 218583

SEQ ID NO: 1509765 - protein, 24 aa, Mycobacterium tuberculosis
GLPGLSLPRTLIFDYPTASALAEC

SEQ ID NO: 1509766 - protein, 21 aa, Mycobacterium tuberculosis
GLQARLMSQALRKMTGALNNS

SEQ ID NO: 1509767 - protein, 19 aa, Mycobacterium tuberculosis
GLQIMAPALADDRLYRVGA

SEQ ID NO: 1509768 - protein, 25 aa, Mycobacterium tuberculosis
GLRAGMPTLILWDVADQPIWAGAVQ

SEQ ID NO: 1509769 - protein, 20 aa, Mycobacterium tuberculosis
GLRLRLPVIATALGTYDTAS

SEQ ID NO: 1509770 - protein, 19 aa, Mycobacterium tuberculosis
GLRTKLLAASAYIKAADRV

SEQ ID NO: 1509771 - protein, 19 aa, Mycobacterium tuberculosis
GLVELALSAPTFQQLMQRA

SEQ ID NO: 1509772 - protein, 27 aa, Mycobacterium tuberculosis
GMQLTLTELWRSYGVQPDLVIGHSMGE

SEQ ID NO: 1509773 - protein, 32 aa, Mycobacterium tuberculosis
GMRDIRKHIAWYLHGFPAGSALRRALAMVKTF

SEQ ID NO: 1509774 - protein, 19 aa, Mycobacterium tuberculosis
GMYYHCTAPPLPGPLEIDV

SEQ ID NO: 1509775 - protein, 23 aa, Mycobacterium tuberculosis
GNFFRGAQLQQLGMERTRSDYMG

SEQ ID NO: 1509776 - protein, 29 aa, Mycobacterium tuberculosis
GPASLSMAAAVQPYLVWLTCTAESSALAA

SEQ ID NO: 1509777 - protein, 17 aa, Mycobacterium tuberculosis
GPVWVFSGQGSQWAAMG

SEQ ID NO: 1509778 - protein, 19 aa, Mycobacterium tuberculosis
GQFSDEFLRWLAGVRFTGD

SEQ ID NO: 1509779 - protein, 24 aa, Mycobacterium tuberculosis
GQRDVRALLIDVLNVLLAAITAAG

SEQ ID NO: 1509780 - protein, 17 aa, Mycobacterium tuberculosis
GRAFSFISAIDSIGAVP

SEQ ID NO: 1509781 - protein, 21 aa, Mycobacterium tuberculosis
GRARAFALGQLRSLAERNGYP

SEQ ID NO: 1509782 - protein, 23 aa, Mycobacterium tuberculosis
GRAVILEAMRRYLQQRRAMEPWE

SEQ ID NO: 1509783 - protein, 20 aa, Mycobacterium tuberculosis
GRAVPQYGFRPNFVARPPAA

SEQ ID NO: 1509784 - protein, 25 aa, Mycobacterium tuberculosis
GRIYAELTRLCRYPLLVVDEVGYIP

SEQ ID NO: 1509785 - protein, 17 aa, Mycobacterium tuberculosis
GRQLWAQSGLTPADVQT

SEQ ID NO: 1509786 - protein, 28 aa, Mycobacterium tuberculosis
GRSRERGYAYFLYPPQVPLTETAYDRLA

SEQ ID NO: 1509787 - protein, 29 aa, Mycobacterium tuberculosis
GRSVSDALDILRWAPQAASGPVAKVIASA

SEQ ID NO: 1509788 - protein, 25 aa, Mycobacterium tuberculosis
GRWDKPFLAIFGYRDPILGQADGPL

SEQ ID NO: 1509789 - protein, 20 aa, Mycobacterium tuberculosis
GSLRLWSLAGGMPLHRYRKS

SEQ ID NO: 1509790 - protein, 32 aa, Mycobacterium tuberculosis; identical to SEQ ID NO: 218840

SEQ ID NO: 1509791 - protein, 22 aa, Mycobacterium tuberculosis
GSTLFGRWELCALMQTVAELAE

SEQ ID NO: 1509792 - protein, 55 aa, Mycobacterium tuberculosis; identical to SEQ ID NO: 218875

SEQ ID NO: 1509793 - protein, 19 aa, Mycobacterium tuberculosis
GTPIRIGFVARSALEPGPN

SEQ ID NO: 1509794 - protein, 23 aa, Mycobacterium tuberculosis
GVLPPEMLFAHPGYVRAANGIQM

SEQ ID NO: 1509795 - protein, 25 aa, Mycobacterium tuberculosis
GVQTPQPYWYWALDRESIGGSVSAA

SEQ ID NO: 1509796 - protein, 24 aa, Mycobacterium tuberculosis
GVRSLRVRLGIHPVYKTVDTCAAE

SEQ ID NO: 1509797 - protein, 19 aa, Mycobacterium tuberculosis
GVRVGVETALLGRFFERFA

SEQ ID NO: 1509798 - protein, 17 aa, Mycobacterium tuberculosis
GWGLWDQASAMTGGLDA

SEQ ID NO: 1509799 - protein, 22 aa, Mycobacterium tuberculosis
GWPFVARLLYGRRSLVLVHHCH

SEQ ID NO: 1509800 - protein, 21 aa, Mycobacterium tuberculosis
GWTPVPLPEPLGSLRDKRTGL

SEQ ID NO: 1509801 - protein, 21 aa, Mycobacterium tuberculosis
GYAPMIGGLGYVLAPGPAAYT

SEQ ID NO: 1509802 - protein, 23 aa, Mycobacterium tuberculosis
GYFHVELMSIRRSATKLKYLAAA

SEQ ID NO: 1509803 - protein, 25 aa, Mycobacterium tuberculosis
GYIDVKGLRLTLTQAAWRVAEDSLA

SEQ ID NO: 1509804 - protein, 24 aa, Mycobacterium tuberculosis
HADGIRAVAVVCLHSYLYPGHERE

SEQ ID NO: 1509805 - protein, 17 aa, Mycobacterium tuberculosis
HAFMAERVESGFGSLDE

SEQ ID NO: 1509806 - protein, 18 aa, Mycobacterium tuberculosis
HAGHLVPLLTLRRFQRAG

SEQ ID NO: 1509807 - protein, 21 aa, Mycobacterium tuberculosis
HDGRTWYRTGDLARYWHDGTL

SEQ ID NO: 1509808 - protein, 23 aa, Mycobacterium tuberculosis
HEDQAHVDLLWSLSRAPDADAAL

SEQ ID NO: 1509809 - protein, 23 aa, Mycobacterium tuberculosis
HEHERLLGWQRQMLARIEVPYRV

SEQ ID NO: 1509810 - protein, 19 aa, Mycobacterium tuberculosis
HGLADMYGFIPVDREPGLW

SEQ ID NO: 1509811 - protein, 30 aa, Mycobacterium tuberculosis; identical to SEQ ID NO: 219144

SEQ ID NO: 1509812 - protein, 33 aa, Mycobacterium tuberculosis; identical to SEQ ID NO: 219187

SEQ ID NO: 1509813 - protein, 24 aa, Mycobacterium tuberculosis
HRRDALWAAALQTAISRRTGDIGA

SEQ ID NO: 1509814 - protein, 23 aa, Mycobacterium tuberculosis
HSAACTTMRWPLHDDQLAAADQL

SEQ ID NO: 1509815 - protein, 26 aa, Mycobacterium tuberculosis
HSNALDIDLYLRIAPELFLKRCIVGG

SEQ ID NO: 1509816 - protein, 20 aa, Mycobacterium tuberculosis
HTPPAPIELPSYGLFGLPGF

SEQ ID NO: 1509817 - protein, 17 aa, Mycobacterium tuberculosis
HTQVFRMWLDAVGISED

SEQ ID NO: 1509818 - protein, 20 aa, Mycobacterium tuberculosis
HTVPLLGRRIAVIGTGSTGV

SEQ ID NO: 1509819 - protein, 24 aa, Mycobacterium tuberculosis
HVDHPRLGWRQAPVGPVLADALGL

SEQ ID NO: 1509820 - protein, 17 aa, Mycobacterium tuberculosis
HVRRFSLGTNPMVLDLS

SEQ ID NO: 1509821 - protein, 25 aa, Mycobacterium tuberculosis
IAAGTPPIYFGFGSTPVQTPVQTLA

SEQ ID NO: 1509822 - protein, 20 aa, Mycobacterium tuberculosis
IADLAWLRARDLDRALLVHV

SEQ ID NO: 1509823 - protein, 18 aa, Mycobacterium tuberculosis
IAITSALLVAYLPARSRE

SEQ ID NO: 1509824 - protein, 20 aa, Mycobacterium tuberculosis
IALAEELVALLGADQRTRVF

SEQ ID NO: 1509825 - protein, 18 aa, Mycobacterium tuberculosis
IAVNPLPEAGLIRFKDPQ

SEQ ID NO: 1509826 - protein, 18 aa, Mycobacterium tuberculosis
IDDMVAACLKWEGGYVWA

SEQ ID NO: 1509827 - protein, 23 aa, Mycobacterium tuberculosis
IDELIPLVRGVVRGAPHALVVAD

SEQ ID NO: 1509828 - protein, 18 aa, Mycobacterium tuberculosis
IDLIRVIRELNIASVAVP

SEQ ID NO: 1509829 - protein, 25 aa, Mycobacterium tuberculosis
IDSSDEWIYTRTGIKTRRFAADDES

SEQ ID NO: 1509830 - protein, 17 aa, Mycobacterium tuberculosis
IEGVEGLRMTWGRAVIL

SEQ ID NO: 1509831 - protein, 20 aa, Mycobacterium tuberculosis
IFQLAFMRPLRKSRERLMVA

SEQ ID NO: 1509832 - protein, 19 aa, Mycobacterium tuberculosis
IGAILPLLAGVADPSNFGA

SEQ ID NO: 1509833 - protein, 23 aa, Mycobacterium tuberculosis
IGYLTALLRDEGITAMHFVPSLL

SEQ ID NO: 1509834 - protein, 17 aa, Mycobacterium tuberculosis
IIDGIIASAPLFSRVVV

SEQ ID NO: 1509835 - protein, 19 aa, Mycobacterium tuberculosis
IIGCLLHDIGKPVQRAALG

SEQ ID NO: 1509836 - protein, 26 aa, Mycobacterium tuberculosis
IITEAWMRLQHRPRWQVTVSVVFDDW

SEQ ID NO: 1509837 - protein, 22 aa, Mycobacterium tuberculosis
IKRPFAIQELTLPLALDGEDVI

SEQ ID NO: 1509838 - protein, 26 aa, Mycobacterium tuberculosis
ILENPGLLRFLPQLSERLLDESPLLH

SEQ ID NO: 1509839 - protein, 32 aa, Mycobacterium tuberculosis; identical to SEQ ID NO: 219429

SEQ ID NO: 1509840 - protein, 25 aa, Mycobacterium tuberculosis
IPDHFRIYVSQKLARLERFDRTIYL

SEQ ID NO: 1509841 - protein, 24 aa, Mycobacterium tuberculosis
IPEEVAWRMGWIDDEQLVQRARAL

SEQ ID NO: 1509842 - protein, 17 aa, Mycobacterium tuberculosis
IPEIDIHTLVAFACREL

SEQ ID NO: 1509843 - protein, 31 aa, Mycobacterium tuberculosis; identical to SEQ ID NO: 219470

SEQ ID NO: 1509844 - protein, 19 aa, Mycobacterium tuberculosis
IPRLRRALVAPCTTTIRGL

SEQ ID NO: 1509845 - protein, 18 aa, Mycobacterium tuberculosis
IPTNAIPLTIDASGALDP

SEQ ID NO: 1509846 - protein, 28 aa, Mycobacterium tuberculosis
IPWSDIQKYWMMFLGALATAEGFIYDSG

SEQ ID NO: 1509847 - protein, 18 aa, Mycobacterium tuberculosis
IQGVWVHPEWRGIGLGTA

SEQ ID NO: 1509848 - protein, 17 aa, Mycobacterium tuberculosis
IQIDTTNVLFIVAGAFA

SEQ ID NO: 1509849 - protein, 23 aa, Mycobacterium tuberculosis
IRDAKVIAPDKPWFSYVCPGAGH

SEQ ID NO: 1509850 - protein, 26 aa, Mycobacterium tuberculosis
IRSGPPMGFFRIGWVRTLANLNEFFV

SEQ ID NO: 1509851 - protein, 20 aa, Mycobacterium tuberculosis
ISEADLLWDLASRLEGRMAA

SEQ ID NO: 1509852 - protein, 19 aa, Mycobacterium tuberculosis
ISPRDALASAGKTLVELFG

SEQ ID NO: 1509853 - protein, 30 aa, Mycobacterium tuberculosis; identical to SEQ ID NO: 115434

SEQ ID NO: 1509854 - protein, 34 aa, Mycobacterium tuberculosis; identical to SEQ ID NO: 219578

SEQ ID NO: 1509855 - protein, 20 aa, Mycobacterium tuberculosis
IYKIRGVAAVTFYGRGRLVS

SEQ ID NO: 1509856 - protein, 20 aa, Mycobacterium tuberculosis
KALDQLLVLGTLLEGHAEHV

SEQ ID NO: 1509857 - protein, 17 aa, Mycobacterium tuberculosis
KALLFSVFEGGLRHGLF

SEQ ID NO: 1509858 - protein, 22 aa, Mycobacterium tuberculosis
KATLVRAVCDGRRLVTLDGPEI

SEQ ID NO: 1509859 - protein, 24 aa, Mycobacterium tuberculosis
KAVVVLGLPRGGVPVAFEVAKSLQ

SEQ ID NO: 1509860 - protein, 26 aa, Mycobacterium tuberculosis
KDDIFYYVYGLLHDPAYRTKYAADLK

SEQ ID NO: 1509861 - protein, 20 aa, Mycobacterium tuberculosis
KEAVLPFHRFRRADGAAIDS

SEQ ID NO: 1509862 - protein, 20 aa, Mycobacterium tuberculosis
KFPVLLGGAALTRSYVENDL

SEQ ID NO: 1509863 - protein, 17 aa, Mycobacterium tuberculosis
KLFQRYQDRYDMELSHP

SEQ ID NO: 1509864 - protein, 18 aa, Mycobacterium tuberculosis
KPRPGRIVFVGSGPGDPG

SEQ ID NO: 1509865 - protein, 25 aa, Mycobacterium tuberculosis
KTTLIEALLVAAKVLSRPGSVTEGT

SEQ ID NO: 1509866 - protein, 24 aa, Mycobacterium tuberculosis
KVGQYVTWGLNHLVFHAPGHDQRR

SEQ ID NO: 1509867 - protein, 18 aa, Mycobacterium tuberculosis
LAARQRRFGVSYWTVFDE

SEQ ID NO: 1509868 - protein, 27 aa, Mycobacterium tuberculosis
LAELRAARRMGSKSPLLALIADCERGL

SEQ ID NO: 1509869 - protein, 32 aa, Mycobacterium tuberculosis; identical to SEQ ID NO: 219855

SEQ ID NO: 1509870 - protein, 19 aa, Mycobacterium tuberculosis
LAGISLAWGLWEQPGGMTA

SEQ ID NO: 1509871 - protein, 29 aa, Mycobacterium tuberculosis
LAGLCGALRRYHEALGVPISTLPMAVPVN

SEQ ID NO: 1509872 - protein, 23 aa, Mycobacterium tuberculosis
LAPSLTNVPDALVGPCWPAVFAA

SEQ ID NO: 1509873 - protein, 18 aa, Mycobacterium tuberculosis
LAVGFWAAPSDLRANWRE

SEQ ID NO: 1509874 - protein, 30 aa, Mycobacterium tuberculosis; identical to SEQ ID NO: 219939

SEQ ID NO: 1509875 - protein, 21 aa, Mycobacterium tuberculosis
LDCADLGHLVFLPSGDAALTR

SEQ ID NO: 1509876 - protein, 25 aa, Mycobacterium tuberculosis
LDDVNLRRLLSLFEQLREQSQIIII

SEQ ID NO: 1509877 - protein, 47 aa, Mycobacterium tuberculosis; identical to SEQ ID NO: 219960

SEQ ID NO: 1509878 - protein, 18 aa, Mycobacterium tuberculosis
LDKPVKWMEDRSENLTST

SEQ ID NO: 1509879 - protein, 17 aa, Mycobacterium tuberculosis
LDLTYKEFELLKYLAQH

SEQ ID NO: 1509880 - protein, 18 aa, Mycobacterium tuberculosis
LDLWPDFAGSDLVTGPDG

SEQ ID NO: 1509881 - protein, 18 aa, Mycobacterium tuberculosis
LDNFATRWRHGGSPLLRG

SEQ ID NO: 1509882 - protein, 17 aa, Mycobacterium tuberculosis
LDRGLVDELGGLRTAVR

SEQ ID NO: 1509883 - protein, 38 aa, Mycobacterium tuberculosis; identical to SEQ ID NO: 219996

SEQ ID NO: 1509884 - protein, 27 aa, Mycobacterium tuberculosis
LDSPISLAFLTFLPRFDCQDRADWLSV

SEQ ID NO: 1509885 - protein, 17 aa, Mycobacterium tuberculosis
LEEQVVVLRLLAAQQEA

SEQ ID NO: 1509886 - protein, 21 aa, Mycobacterium tuberculosis
LENRIVIAYSPLAQGLLGGKY

SEQ ID NO: 1509887 - protein, 30 aa, Mycobacterium tuberculosis; identical to SEQ ID NO: 220026

SEQ ID NO: 1509888 - protein, 41 aa, Mycobacterium tuberculosis; identical to SEQ ID NO: 220028

SEQ ID NO: 1509889 - protein, 17 aa, Mycobacterium tuberculosis
LERRILLSRVPELPEHF

SEQ ID NO: 1509890 - protein, 20 aa, Mycobacterium tuberculosis
LESLIRPTGFYRNKAASLIG

SEQ ID NO: 1509891 - protein, 20 aa, Mycobacterium tuberculosis
LFAGILAQVPFVDPLTTILD

SEQ ID NO: 1509892 - protein, 22 aa, Mycobacterium tuberculosis
LFDEWFPANKLVKLGLRLTNIS

SEQ ID NO: 1509893 - protein, 25 aa, Mycobacterium tuberculosis
LGDLRSLFAFLADRGSSLDALTLSV

SEQ ID NO: 1509894 - protein, 18 aa, Mycobacterium tuberculosis
LGETAAELSALGLGRVEH

SEQ ID NO: 1509895 - protein, 17 aa, Mycobacterium tuberculosis
LGLRERFIGLTDTVWRV

SEQ ID NO: 1509896 - protein, 34 aa, Mycobacterium tuberculosis; identical to SEQ ID NO: 220118

SEQ ID NO: 1509897 - protein, 23 aa, Mycobacterium tuberculosis
LGRGDEALQWFLRSAAADIDGVT

SEQ ID NO: 1509898 - protein, 19 aa, Mycobacterium tuberculosis
LGRIIFMDEFYSLIERHQD

SEQ ID NO: 1509899 - protein, 35 aa, Mycobacterium tuberculosis; identical to SEQ ID NO: 220130

SEQ ID NO: 1509900 - protein, 18 aa, Mycobacterium tuberculosis
LGVLELHPLLNPAGYVLA

SEQ ID NO: 1509901 - protein, 27 aa, Mycobacterium tuberculosis
LGVLERAATAEALLLAKLAAIPTGRAE

SEQ ID NO: 1509902 - protein, 18 aa, Mycobacterium tuberculosis
LHNDIVAPYLLALATEEQ

SEQ ID NO: 1509903 - protein, 17 aa, Mycobacterium tuberculosis
LHQAPLSPIVLRIGIHT

SEQ ID NO: 1509904 - protein, 18 aa, Mycobacterium tuberculosis
LHTALRRSPHSERLFCIP

SEQ ID NO: 1509905 - protein, 32 aa, Mycobacterium tuberculosis; identical to SEQ ID NO: 226506

SEQ ID NO: 1509906 - protein, 18 aa, Mycobacterium tuberculosis
LIDELGTLTWRQLDERGN

SEQ ID NO: 1509907 - protein, 32 aa, Mycobacterium tuberculosis; identical to SEQ ID NO: 220169

SEQ ID NO: 1509908 - protein, 17 aa, Mycobacterium tuberculosis
LKAVAVKGPYFGDRRKA

SEQ ID NO: 1509909 - protein, 27 aa, Mycobacterium tuberculosis
LLAVNRIGAHILLLNTSFAGPALAEVV

SEQ ID NO: 1509910 - protein, 17 aa, Mycobacterium tuberculosis
LLGILGSGSSWLDKLWA

SEQ ID NO: 1509911 - protein, 17 aa, Mycobacterium tuberculosis
LLMLHPPSETTPSLPEC

SEQ ID NO: 1509912 - protein, 29 aa, Mycobacterium tuberculosis
LLMSTFGPRTALWLLLAKGGGDTEVSAQA

SEQ ID NO: 1509913 - protein, 27 aa, Mycobacterium tuberculosis
LLRRPDLLVSLLTYWQRHPSLSYLFAG

SEQ ID NO: 1509914 - protein, 18 aa, Mycobacterium tuberculosis
LLTDNLAAGRLRFTTDYD

SEQ ID NO: 1509915 - protein, 26 aa, Mycobacterium tuberculosis
LMPRFVREFPFNLMLWDLDRRMRRGR

SEQ ID NO: 1509916 - protein, 28 aa, Mycobacterium tuberculosis
LNINFFVHDPFTLEPYSRDPRNIARKAE

SEQ ID NO: 1509917 - protein, 26 aa, Mycobacterium tuberculosis
LNLKLQPARYRQLLQHILQHVADGKL

SEQ ID NO: 1509918 - protein, 17 aa, Mycobacterium tuberculosis
LNNLQTYDKTFGLETMC

SEQ ID NO: 1509919 - protein, 31 aa, Mycobacterium tuberculosis; identical to SEQ ID NO: 220353

SEQ ID NO: 1509920 - protein, 18 aa, Mycobacterium tuberculosis
LRPIQKVLRSPLGPVAAR

SEQ ID NO: 1509921 - protein, 18 aa, Mycobacterium tuberculosis
LRRQRVWTPVLMLTARGA

SEQ ID NO: 1509922 - protein, 17 aa, Mycobacterium tuberculosis
LSKYVFATPYIEAGDWR

SEQ ID NO: 1509923 - protein, 17 aa, Mycobacterium tuberculosis
LSPIVLRIGIHTGEAQL

SEQ ID NO: 1509924 - protein, 24 aa, Mycobacterium tuberculosis
LSRRYRVPVLSVHAPCLLISQRVW

SEQ ID NO: 1509925 - protein, 20 aa, Mycobacterium tuberculosis
LSTKFTRLTGRSPILLAGMT

SEQ ID NO: 1509926 - protein, 17 aa, Mycobacterium tuberculosis
LSWRGLIAQSTDLDTLA

SEQ ID NO: 1509927 - protein, 28 aa, Mycobacterium tuberculosis
LTDPEVLEWRYPVLLREFAVRQGSGGAG

SEQ ID NO: 1509928 - protein, 20 aa, Mycobacterium tuberculosis
LTEFSVWVVFMMESGSRRAD

SEQ ID NO: 1509929 - protein, 22 aa, Mycobacterium tuberculosis
LTLEDFLEQMLAVRKMGPIGNL

SEQ ID NO: 1509930 - protein, 27 aa, Mycobacterium tuberculosis
LTRAKARLRWREKELVGVGLARLNPAD

SEQ ID NO: 1509931 - protein, 20 aa, Mycobacterium tuberculosis
LTRSGGHCWFLGGVADSVEE

SEQ ID NO: 1509932 - protein, 24 aa, Mycobacterium tuberculosis
LTSTRWRDPYAGTPWHKHVPAAIR

SEQ ID NO: 1509933 - protein, 31 aa, Mycobacterium tuberculosis; identical to SEQ ID NO: 220525

SEQ ID NO: 1509934 - protein, 18 aa, Mycobacterium tuberculosis
LVARRRGISVLGDRPPMV

SEQ ID NO: 1509935 - protein, 20 aa, Mycobacterium tuberculosis
LVASGLRSLPADGLKLAPGE

SEQ ID NO: 1509936 - protein, 18 aa, Mycobacterium tuberculosis
LVEQFLTQFYGDQAALDD

SEQ ID NO: 1509937 - protein, 19 aa, Mycobacterium tuberculosis
LVQDPARLPEALVSARREA

SEQ ID NO: 1509938 - protein, 23 aa, Mycobacterium tuberculosis
LVRGIPPGHVGVAWRGTWHGGLQ

SEQ ID NO: 1509939 - protein, 25 aa, Mycobacterium tuberculosis
MAAAAARLTPFSPPAPIANPGALAR

SEQ ID NO: 1509940 - protein, 22 aa, Mycobacterium tuberculosis
MADGGLLLPLGVRRLRSYGSAR

SEQ ID NO: 1509941 - protein, 18 aa, Mycobacterium tuberculosis
MAKGLRTKLLAASAYIKA

SEQ ID NO: 1509942 - protein, 17 aa, Mycobacterium tuberculosis
MAPALADDRLYRVGAAY

SEQ ID NO: 1509943 - protein, 28 aa, Mycobacterium tuberculosis
MFQRTAQWVLPWPNPRYSKLARVFHRAF

SEQ ID NO: 1509944 - protein, 17 aa, Mycobacterium tuberculosis
MGFLDAALLADRPVVVA

SEQ ID NO: 1509945 - protein, 34 aa, Mycobacterium tuberculosis; identical to SEQ ID NO: 220659

SEQ ID NO: 1509946 - protein, 18 aa, Mycobacterium tuberculosis
MGRHAGWIALNAGLASGA

SEQ ID NO: 1509947 - protein, 23 aa, Mycobacterium tuberculosis
MGSNAEFVVALLAASRADLVVVP

SEQ ID NO: 1509948 - protein, 22 aa, Mycobacterium tuberculosis
MKLFNTIWSGPETLPLPAEIEN

SEQ ID NO: 1509949 - protein, 18 aa, Mycobacterium tuberculosis
MLAKVRRAPALIKVESVV

SEQ ID NO: 1509950 - protein, 17 aa, Mycobacterium tuberculosis
MLFDHVGALAATVMGMP

SEQ ID NO: 1509951 - protein, 17 aa, Mycobacterium tuberculosis
MLPRATFCQPNVASFGL

SEQ ID NO: 1509952 - protein, 23 aa, Mycobacterium tuberculosis
MPCIRGLRIPVATVVAMVADQMT

SEQ ID NO: 1509953 - protein, 36 aa, Mycobacterium tuberculosis; identical to SEQ ID NO: 220705

SEQ ID NO: 1509954 - protein, 26 aa, Mycobacterium tuberculosis
MQLALTELWRSYGVIPDAVIGHSMGE

SEQ ID NO: 1509955 - protein, 17 aa, Mycobacterium tuberculosis
MSQALRKMTGALNNSGT

SEQ ID NO: 1509956 - protein, 20 aa, Mycobacterium tuberculosis
MTEAEVVAHLLELVTRRSEA

SEQ ID NO: 1509957 - protein, 24 aa, Mycobacterium tuberculosis
MTLPLISMRFEGEDWILGSTAAIP

SEQ ID NO: 1509958 - protein, 17 aa, Mycobacterium tuberculosis
MVRYTSGYLCVPLDGAI

SEQ ID NO: 1509959 - protein, 18 aa, Mycobacterium tuberculosis
MVYRHSGYPGGLHKRTIG

SEQ ID NO: 1509960 - protein, 30 aa, Mycobacterium tuberculosis; identical to SEQ ID NO: 220790

SEQ ID NO: 1509961 - protein, 22 aa, Mycobacterium tuberculosis
NDTRVYYVEPAKWVAALRHAKT

SEQ ID NO: 1509962 - protein, 23 aa, Mycobacterium tuberculosis
NDWTYPKWAKQVTRVLIAIENAI

SEQ ID NO: 1509963 - protein, 18 aa, Mycobacterium tuberculosis
NFDAWRFENRCELLAFRH

SEQ ID NO: 1509964 - protein, 19 aa, Mycobacterium tuberculosis
NHLAFHVPAERFDAYRQRL

SEQ ID NO: 1509965 - protein, 27 aa, Mycobacterium tuberculosis
NKVPIYPGYVCAIVASLLLDKPVKWME

SEQ ID NO: 1509966 - protein, 21 aa, Mycobacterium tuberculosis
NKVSRILLTSGKLYYELAARK

SEQ ID NO: 1509967 - protein, 19 aa, Mycobacterium tuberculosis
NLIGMGVIPLQFPEGKSAS

SEQ ID NO: 1509968 - protein, 17 aa, Mycobacterium tuberculosis
NLMLWDLDRRMRRGRPL

SEQ ID NO: 1509969 - protein, 23 aa, Mycobacterium tuberculosis
NLTYPYGAYFCVVDIDPGTAVVK

SEQ ID NO: 1509970 - protein, 21 aa, Mycobacterium tuberculosis
NLVLPALLAQRGIGGRDAAFA

SEQ ID NO: 1509971 - protein, 24 aa, Mycobacterium tuberculosis
NNMVLAVQQIAIAEAFVLAEKLGL

SEQ ID NO: 1509972 - protein, 18 aa, Mycobacterium tuberculosis
NPVRLAEAIRRFGPIFAQ

SEQ ID NO: 1509973 - protein, 33 aa, Mycobacterium tuberculosis; identical to SEQ ID NO: 220960

SEQ ID NO: 1509974 - protein, 24 aa, Mycobacterium tuberculosis
NSGTGNWGLWNPGTGNMGVANVGT

SEQ ID NO: 1509975 - protein, 18 aa, Mycobacterium tuberculosis
NTGGEDVLFFVASRGHHA

SEQ ID NO: 1509976 - protein, 22 aa, Mycobacterium tuberculosis
NTVRYRLKRITDFTGRDPTQPR

SEQ ID NO: 1509977 - protein, 25 aa, Mycobacterium tuberculosis
NVHGKPDGLPLFRECLAPGTSISHR

SEQ ID NO: 1509978 - protein, 18 aa, Mycobacterium tuberculosis
NVILLDCGTPVNGPLFSN

SEQ ID NO: 1509979 - protein, 18 aa, Mycobacterium tuberculosis
NYGSLNWGSGNTGTGNAG

SEQ ID NO: 1509980 - protein, 20 aa, Mycobacterium tuberculosis
NYLRPPATVVFARRGKQIAR

SEQ ID NO: 1509981 - protein, 19 aa, Mycobacterium tuberculosis
PAKYPAGFFGVFTGSYDIE

SEQ ID NO: 1509982 - protein, 17 aa, Mycobacterium tuberculosis
PAPPRRKPIQMPGLQDV

SEQ ID NO: 1509983 - protein, 21 aa, Mycobacterium tuberculosis
PAQAIAQVCELTWQLRGQATG

SEQ ID NO: 1509984 - protein, 18 aa, Mycobacterium tuberculosis
PARWFLDHARVALSSGHV

SEQ ID NO: 1509985 - protein, 21 aa, Mycobacterium tuberculosis
PASTYANYLPRFFRGISDDAD

SEQ ID NO: 1509986 - protein, 20 aa, Mycobacterium tuberculosis
PAVIARYPAPPGAPTVLLYA

SEQ ID NO: 1509987 - protein, 25 aa, Mycobacterium tuberculosis
PDEVARYLFRRVVSWGRSSNVFLRN

SEQ ID NO: 1509988 - protein, 30 aa, Mycobacterium tuberculosis; identical to SEQ ID NO: 221114

SEQ ID NO: 1509989 - protein, 18 aa, Mycobacterium tuberculosis
PDWAARARWANPAAWRLP

SEQ ID NO: 1509990 - protein, 18 aa, Mycobacterium tuberculosis
PDYPASTYANYLPRFFRG

SEQ ID NO: 1509991 - protein, 19 aa, Mycobacterium tuberculosis
PEFAEDWVNLVALAVNEEN

SEQ ID NO: 1509992 - protein, 18 aa, Mycobacterium tuberculosis
PEQFWDLLCAGRSGIVRV

SEQ ID NO: 1509993 - protein, 19 aa, Mycobacterium tuberculosis
PEQIRPWVPGTYLTLGTDG

SEQ ID NO: 1509994 - protein, 25 aa, Mycobacterium tuberculosis
PGDALFAFLRSMVLQWGATDRGLVE

SEQ ID NO: 1509995 - protein, 18 aa, Mycobacterium tuberculosis
PGFGLVMFGAIREASTLA

SEQ ID NO: 1509996 - protein, 17 aa, Mycobacterium tuberculosis
PGKFWSGDSLPLAPGYR

SEQ ID NO: 1509997 - protein, 17 aa, Mycobacterium tuberculosis
PGYIPRSTEYRIHQRVL

SEQ ID NO: 1509998 - protein, 25 aa, Mycobacterium tuberculosis
PIEKKPLNHFLPGSATLSFGTAGCN

SEQ ID NO: 1509999 - protein, 20 aa, Mycobacterium tuberculosis
PIQIPPPGTGAPEVHRWWTS

SEQ ID NO: 1510000 - protein, 23 aa, Mycobacterium tuberculosis
PIRRIDDFAEWLQRFEASLGALP

SEQ ID NO: 1510001 - protein, 18 aa, Mycobacterium tuberculosis
PITAVSLAWLPAGDYERA

SEQ ID NO: 1510002 - protein, 29 aa, Mycobacterium tuberculosis
PKEMWDAFAEEYLAPVRPLERIRQHVDAA

SEQ ID NO: 1510003 - protein, 26 aa, Mycobacterium tuberculosis
PKGVAVPHRPVAEYFVWFKGEYDVDD

SEQ ID NO: 1510004 - protein, 17 aa, Mycobacterium tuberculosis
PLSLGRLDRGWVVASET

SEQ ID NO: 1510005 - protein, 26 aa, Mycobacterium tuberculosis
PLSPQHVVSLVQFLASPAAAEVNGQV

SEQ ID NO: 1510006 - protein, 17 aa, Mycobacterium tuberculosis
PPALFIGGQYDVGTIWG

SEQ ID NO: 1510007 - protein, 27 aa, Mycobacterium tuberculosis
PPPQEQGLIPGFLMPPSDGSGVTPGTG

SEQ ID NO: 1510008 - protein, 29 aa, Mycobacterium tuberculosis
PPPQNELTPFYPRSPYGAAKVYSYWATRN

SEQ ID NO: 1510009 - protein, 24 aa, Mycobacterium tuberculosis
PQAACDGPRFRWVNGMRVSFENGF

SEQ ID NO: 1510010 - protein, 18 aa, Mycobacterium tuberculosis
PRGYRAMAGIPRLQFAHA

SEQ ID NO: 1510011 - protein, 25 aa, Mycobacterium tuberculosis
PRHTLWAAWQRSGLQRRWLAASEHG

SEQ ID NO: 1510012 - protein, 18 aa, Mycobacterium tuberculosis
PRVIFLHGGGQNAHTWDT

SEQ ID NO: 1510013 - protein, 18 aa, Mycobacterium tuberculosis
PRWAKLVEMLGPESDTLR

SEQ ID NO: 1510014 - protein, 26 aa, Mycobacterium tuberculosis
PSKPCAWLAEGLVRYLPARAQDLLFE

SEQ ID NO: 1510015 - protein, 19 aa, Mycobacterium tuberculosis
PTEFRPLRWDPNAADYRKP

SEQ ID NO: 1510016 - protein, 23 aa, Mycobacterium tuberculosis
PTELTATLRDYFAGRDPEQSFSA

SEQ ID NO: 1510017 - protein, 26 aa, Mycobacterium tuberculosis
PTGSGKTLAAFLWALDSLAGSEPMSE

SEQ ID NO: 1510018 - protein, 22 aa, Mycobacterium tuberculosis
PTTFEVFARRLPTGRRYGVVAG

SEQ ID NO: 1510019 - protein, 37 aa, Mycobacterium tuberculosis; identical to SEQ ID NO: 221481

SEQ ID NO: 1510020 - protein, 26 aa, Mycobacterium tuberculosis
PVGILCLEFLVHAWDFAIATGSQVIA

SEQ ID NO: 1510021 - protein, 28 aa, Mycobacterium tuberculosis
PVNFVPVIDQDVRRWWRSDSLWQAHDAR

SEQ ID NO: 1510022 - protein, 18 aa, Mycobacterium tuberculosis
PVPEPMVKMLLNNVLEHL

SEQ ID NO: 1510023 - protein, 20 aa, Mycobacterium tuberculosis
PVRWIETQDLLFIEEAAGGL

SEQ ID NO: 1510024 - protein, 20 aa, Mycobacterium tuberculosis
PWRDIPDIWQWGITDADLES

SEQ ID NO: 1510025 - protein, 28 aa, Mycobacterium tuberculosis
PYRVGYFRFELDAGLWLLATGSESELGL

SEQ ID NO: 1510026 - protein, 18 aa, Mycobacterium tuberculosis
PYSARELIARIRAVLRRG

SEQ ID NO: 1510027 - protein, 23 aa, Mycobacterium tuberculosis
QAGAISALRWGGSAPRVIFLHGG

SEQ ID NO: 1510028 - protein, 17 aa, Mycobacterium tuberculosis
QAMGFLDAALLADRPVV

SEQ ID NO: 1510029 - protein, 17 aa, Mycobacterium tuberculosis
QARAALDALPYLIDNRY

SEQ ID NO: 1510030 - protein, 23 aa, Mycobacterium tuberculosis
QARALARHFGARRKAYNWTVATL

SEQ ID NO: 1510031 - protein, 18 aa, Mycobacterium tuberculosis
QDGLWLRIMNVPAALEAR

SEQ ID NO: 1510032 - protein, 20 aa, Mycobacterium tuberculosis
QDWGVLPDLVMGHSVGEIAA

SEQ ID NO: 1510033 - protein, 18 aa, Mycobacterium tuberculosis
QEGETWRRLIVSFPPDID

SEQ ID NO: 1510034 - protein, 25 aa, Mycobacterium tuberculosis
QFDHRTLSRVYGWMLDGVPVVAMHR

SEQ ID NO: 1510035 - protein, 17 aa, Mycobacterium tuberculosis
QFVAVRDGLLAAARQAG

SEQ ID NO: 1510036 - protein, 19 aa, Mycobacterium tuberculosis
QGLDYVAGFLGALCAGWTP

SEQ ID NO: 1510037 - protein, 23 aa, Mycobacterium tuberculosis
QGRPLQHRWPDRQLPGEGVTRGA

SEQ ID NO: 1510038 - protein, 28 aa, Mycobacterium tuberculosis
QHCEPPYAPLWIAKTLYCSATVVKAAIL

SEQ ID NO: 1510039 - protein, 31 aa, Mycobacterium tuberculosis; identical to SEQ ID NO: 221668

SEQ ID NO: 1510040 - protein, 17 aa, Mycobacterium tuberculosis
QISEHVRRFSLGTNPMV

SEQ ID NO: 1510041 - protein, 25 aa, Mycobacterium tuberculosis
QKMTGAIIILIRLTNTVPSTVRLFP

SEQ ID NO: 1510042 - protein, 17 aa, Mycobacterium tuberculosis
QKVFARTGGLHAAALFG

SEQ ID NO: 1510043 - protein, 18 aa, Mycobacterium tuberculosis
QLAKRGYPEDIGNRVLDR

SEQ ID NO: 1510044 - protein, 18 aa, Mycobacterium tuberculosis
QLEFDAWARREPERKALL

SEQ ID NO: 1510045 - protein, 21 aa, Mycobacterium tuberculosis
QLELVVPILTAALTGAPDAGA

SEQ ID NO: 1510046 - protein, 26 aa, Mycobacterium tuberculosis
QLGRAEIRALFRSSKVGLIAGCLVTS

SEQ ID NO: 1510047 - protein, 17 aa, Mycobacterium tuberculosis
QLLIIISAGRTIANDIS

SEQ ID NO: 1510048 - protein, 21 aa, Mycobacterium tuberculosis
QLNAALHRIALTQIRMTDSRG

SEQ ID NO: 1510049 - protein, 27 aa, Mycobacterium tuberculosis
QLVGPRTLPVMRALIVVAGLRMSRTPP

SEQ ID NO: 1510050 - protein, 17 aa, Mycobacterium tuberculosis
QNWVVRALTPEAPGIAG

SEQ ID NO: 1510051 - protein, 31 aa, Mycobacterium tuberculosis; identical to SEQ ID NO: 221764

SEQ ID NO: 1510052 - protein, 17 aa, Mycobacterium tuberculosis
QQKLVEFAEAGFPGLAV

SEQ ID NO: 1510053 - protein, 20 aa, Mycobacterium tuberculosis
QQYAILDDRLRHLPGGIDEY

SEQ ID NO: 1510054 - protein, 26 aa, Mycobacterium tuberculosis
QRIADLPRLIRLLAARSASELNLSSL

SEQ ID NO: 1510055 - protein, 20 aa, Mycobacterium tuberculosis
QRLRLRPFDLGAPKWVDDPD

SEQ ID NO: 1510056 - protein, 25 aa, Mycobacterium tuberculosis
QRRAFGGALIDKPLMRRKLAEMVVD

SEQ ID NO: 1510057 - protein, 17 aa, Mycobacterium tuberculosis
QRYGWCPRPDWVRVVPD

SEQ ID NO: 1510058 - protein, 24 aa, Mycobacterium tuberculosis
QSAMLRAMARMLRQSRPAKTARRP

SEQ ID NO: 1510059 - protein, 33 aa, Mycobacterium tuberculosis; identical to SEQ ID NO: 221844

SEQ ID NO: 1510060 - protein, 26 aa, Mycobacterium tuberculosis
QTPAARVLAIWPDWVRRWPTPSATAT

SEQ ID NO: 1510061 - protein, 18 aa, Mycobacterium tuberculosis
QVEVFHYTRKWLQKMTVS

SEQ ID NO: 1510062 - protein, 27 aa, Mycobacterium tuberculosis
QVIAELYEKFFRIGFKKQAEALGIVYT

SEQ ID NO: 1510063 - protein, 21 aa, Mycobacterium tuberculosis
QVLRALDGRFIPAGPSGSPLR

SEQ ID NO: 1510064 - protein, 21 aa, Mycobacterium tuberculosis
RAGVLRFVVLDGLAKPGRMVG

SEQ ID NO: 1510065 - protein, 25 aa, Mycobacterium tuberculosis
RAIDDKWTLCQILYWRGVGTCISGD

SEQ ID NO: 1510066 - protein, 28 aa, Mycobacterium tuberculosis
RALELGCGTGFFLLNLIQAGVARRGSVT

SEQ ID NO: 1510067 - protein, 19 aa, Mycobacterium tuberculosis
RALLALARAEYRILGPQYK

SEQ ID NO: 1510068 - protein, 28 aa, Mycobacterium tuberculosis
RALVDLKTWTLLKWLDQPCSFYDWRRSA

SEQ ID NO: 1510069 - protein, 17 aa, Mycobacterium tuberculosis
RAQAPLVPGTPDPVKGA

SEQ ID NO: 1510070 - protein, 26 aa, Mycobacterium tuberculosis
RAREHGLPFLFFTDQATGRGQLLYSR

SEQ ID NO: 1510071 - protein, 24 aa, Mycobacterium tuberculosis
RAVARLRIAVVRAIRTALQRRGFL

SEQ ID NO: 1510072 - protein, 18 aa, Mycobacterium tuberculosis
RCGVARRVPLIRDETGSV

SEQ ID NO: 1510073 - protein, 33 aa, Mycobacterium tuberculosis; identical to SEQ ID NO: 222019

SEQ ID NO: 1510074 - protein, 26 aa, Mycobacterium tuberculosis
RDELGDWRVILHSPYGLRVHGPLALA

SEQ ID NO: 1510075 - protein, 19 aa, Mycobacterium tuberculosis
REEPYCDAYYWVDNLRHTV

SEQ ID NO: 1510076 - protein, 20 aa, Mycobacterium tuberculosis
REFCAPFELSRDAPLRITVV

SEQ ID NO: 1510077 - protein, 27 aa, Mycobacterium tuberculosis
RELKKLVPITTFLRRSPYLAAVRTAIA

SEQ ID NO: 1510078 - protein, 17 aa, Mycobacterium tuberculosis
REQSVEIPLGPAAPQRL

SEQ ID NO: 1510079 - protein, 18 aa, Mycobacterium tuberculosis
REWILRNSPVPVGTVPIY

SEQ ID NO: 1510080 - protein, 26 aa, Mycobacterium tuberculosis
REWVTAQWRWDTLAAKLADFLRGDDA

SEQ ID NO: 1510081 - protein, 19 aa, Mycobacterium tuberculosis
RFALRPVIGIDPAAVSPWW

SEQ ID NO: 1510082 - protein, 17 aa, Mycobacterium tuberculosis
RFIGVPAAFSKLFRSEI

SEQ ID NO: 1510083 - protein, 20 aa, Mycobacterium tuberculosis
RFTERFAPFNLSETAIRPSY

SEQ ID NO: 1510084 - protein, 24 aa, Mycobacterium tuberculosis
RGESFGARRRLALSTVGASGATAG

SEQ ID NO: 1510085 - protein, 24 aa, Mycobacterium tuberculosis
RGPSQWLLRMLATQTQRAELVPLL

SEQ ID NO: 1510086 - protein, 27 aa, Mycobacterium tuberculosis
RGPVLGDLRSFMFVQMFSRALTEDELL

SEQ ID NO: 1510087 - protein, 18 aa, Mycobacterium tuberculosis
RGSRVVLRVPRRGDKRAL

SEQ ID NO: 1510088 - protein, 21 aa, Mycobacterium tuberculosis
RHCVRVIPWEITGRHFRFGPE

SEQ ID NO: 1510089 - protein, 27 aa, Mycobacterium tuberculosis
RHPDSKFDILKLPPRNAPPAALTALVE

SEQ ID NO: 1510090 - protein, 24 aa, Mycobacterium tuberculosis
RHPGYRLHPVVLDAALQSVGAAIP

SEQ ID NO: 1510091 - protein, 22 aa, Mycobacterium tuberculosis
RIAQLCHPNLRNTFPPLRMRIA

SEQ ID NO: 1510092 - protein, 17 aa, Mycobacterium tuberculosis
RKARLLLGSGHSVILDG

SEQ ID NO: 1510093 - protein, 17 aa, Mycobacterium tuberculosis
RKICRVERFTLLEHGFV

SEQ ID NO: 1510094 - protein, 24 aa, Mycobacterium tuberculosis
RKRLRQWMMRITAYADRLLDDLDV

SEQ ID NO: 1510095 - protein, 19 aa, Mycobacterium tuberculosis
RKRRMFDLLVRMGYKEIEV

SEQ ID NO: 1510096 - protein, 18 aa, Mycobacterium tuberculosis
RLADLLAARTRYFDAFFR

SEQ ID NO: 1510097 - protein, 18 aa, Mycobacterium tuberculosis
RLFVVTRQAQIVKPHDSG

SEQ ID NO: 1510098 - protein, 24 aa, Mycobacterium tuberculosis
RLGIPTIATVPWTTDRLLNALMQD

SEQ ID NO: 1510099 - protein, 29 aa, Mycobacterium tuberculosis
RLGLDYVDLYLIHWPAPPVGKYVDAWGGM

SEQ ID NO: 1510100 - protein, 19 aa, Mycobacterium tuberculosis
RLLDAILADLYGPRSMLTE

SEQ ID NO: 1510101 - protein, 27 aa, Mycobacterium tuberculosis
RLLRELEARIIQWRNANPQLAADYRAR

SEQ ID NO: 1510102 - protein, 24 aa, Mycobacterium tuberculosis
RLRRLAGLWLADQEERWAAVRIDV

SEQ ID NO: 1510103 - protein, 21 aa, Mycobacterium tuberculosis
RLTAVWIADWADDTVHLSAHH

SEQ ID NO: 1510104 - protein, 18 aa, Mycobacterium tuberculosis
RLTTVRRKYDPDRIMYSG

SEQ ID NO: 1510105 - protein, 18 aa, Mycobacterium tuberculosis
RLVRIDDPILRVPQLAIH

SEQ ID NO: 1510106 - protein, 19 aa, Mycobacterium tuberculosis
RLYDIELALRLGATVERVA

SEQ ID NO: 1510107 - protein, 19 aa, Mycobacterium tuberculosis
RMELLSLPQDEWAGRLRRL

SEQ ID NO: 1510108 - protein, 22 aa, Mycobacterium tuberculosis
RMNELIPLALRLIEEGFALYGD

SEQ ID NO: 1510109 - protein, 17 aa, Mycobacterium tuberculosis
RNELVAAPVLNAELLRR

SEQ ID NO: 1510110 - protein, 25 aa, Mycobacterium tuberculosis
RNGIDAARWPFAARRPRTGPAELLY

SEQ ID NO: 1510111 - protein, 31 aa, Mycobacterium tuberculosis; identical to SEQ ID NO: 222447

SEQ ID NO: 1510112 - protein, 35 aa, Mycobacterium tuberculosis; identical to SEQ ID NO: 222461

SEQ ID NO: 1510113 - protein, 19 aa, Mycobacterium tuberculosis
RPVVSWFDQGTRDVIGLRI

SEQ ID NO: 1510114 - protein, 22 aa, Mycobacterium tuberculosis
RQRLPRTIQIEAGVFLWCTPGD

SEQ ID NO: 1510115 - protein, 18 aa, Mycobacterium tuberculosis
RQVAMVVLGYRGQGAVAG

SEQ ID NO: 1510116 - protein, 17 aa, Mycobacterium tuberculosis
RRELGLPPAPAPAVRRL

SEQ ID NO: 1510117 - protein, 20 aa, Mycobacterium tuberculosis
RRELLSRRDQLTATLAGLCG

SEQ ID NO: 1510118 - protein, 20 aa, Mycobacterium tuberculosis
RRGTVWHRRVPDRYPEVIVQ

SEQ ID NO: 1510119 - protein, 19 aa, Mycobacterium tuberculosis
RRRSPATRAYRLPAGRRAA

SEQ ID NO: 1510120 - protein, 21 aa, Mycobacterium tuberculosis
RSALDVMLDWDPTTAYSCQQG

SEQ ID NO: 1510121 - protein, 29 aa, Mycobacterium tuberculosis
RSDALAARLPLAYALGWQGRGREADAVLA

SEQ ID NO: 1510122 - protein, 29 aa, Mycobacterium tuberculosis
RSGFVVNALLVPYLLSAIRMVEAGFATVE

SEQ ID NO: 1510123 - protein, 29 aa, Mycobacterium tuberculosis
RSKPIEPSPYLPTSRRFVNPLYLRVEAIP

SEQ ID NO: 1510124 - protein, 24 aa, Mycobacterium tuberculosis
RSPRRQYSWLLEQVSFIAAIEHYT

SEQ ID NO: 1510125 - protein, 23 aa, Mycobacterium tuberculosis
RSSNFMLWQAAYAEYIFQDKLWP

SEQ ID NO: 1510126 - protein, 18 aa, Mycobacterium tuberculosis
RSVLQWDKDDCAAIGLVK

SEQ ID NO: 1510127 - protein, 20 aa, Mycobacterium tuberculosis
RTFYRHFRSKHDLLFADYDA

SEQ ID NO: 1510128 - protein, 19 aa, Mycobacterium tuberculosis
RTGHPWWTLSQLSDESAIE

SEQ ID NO: 1510129 - protein, 27 aa, Mycobacterium tuberculosis
RTRVRTRLIELFELFDPADPEVVAGRR

SEQ ID NO: 1510130 - protein, 23 aa, Mycobacterium tuberculosis
RVAGLIARVQLPPSPAGAVQELR

SEQ ID NO: 1510131 - protein, 21 aa, Mycobacterium tuberculosis
RVGSYLRYGAYPYAIAVREYV

SEQ ID NO: 1510132 - protein, 20 aa, Mycobacterium tuberculosis
RVHGPLALAVGRRLRDRYGI

SEQ ID NO: 1510133 - protein, 23 aa, Mycobacterium tuberculosis
RVLIAIENAIWPDLFIAGGGISR

SEQ ID NO: 1510134 - protein, 27 aa, Mycobacterium tuberculosis
RVPTPQRRRPYRPPPRPNSEALKAVVA

SEQ ID NO: 1510135 - protein, 23 aa, Mycobacterium tuberculosis
RVQLPTYAFQRRRFWETPGADGP

SEQ ID NO: 1510136 - protein, 22 aa, Mycobacterium tuberculosis
RVVATVPQLVQLAPHAVQMSQN

SEQ ID NO: 1510137 - protein, 20 aa, Mycobacterium tuberculosis
RVYAKSTNLPRVLGGLGVAI

SEQ ID NO: 1510138 - protein, 20 aa, Mycobacterium tuberculosis
RWVRPIVDALGFAPMAVCAN

SEQ ID NO: 1510139 - protein, 21 aa, Mycobacterium tuberculosis
RWWERPYIAAGIFLYDRLGGA

SEQ ID NO: 1510140 - protein, 18 aa, Mycobacterium tuberculosis
RYLKKITVSTTTGPGIPV

SEQ ID NO: 1510141 - protein, 19 aa, Mycobacterium tuberculosis
SAFQSVVWGLTTGSWIGSS

SEQ ID NO: 1510142 - protein, 21 aa, Mycobacterium tuberculosis
SALGTTIFGGSGGVGGSGGDG

SEQ ID NO: 1510143 - protein, 18 aa, Mycobacterium tuberculosis
SATLRVAPSASWMLEYYP

SEQ ID NO: 1510144 - protein, 19 aa, Mycobacterium tuberculosis
SATPIPRTLEMSLAGIREM

SEQ ID NO: 1510145 - protein, 20 aa, Mycobacterium tuberculosis
SAYQVFHATRRLAAAMVASS

SEQ ID NO: 1510146 - protein, 24 aa, Mycobacterium tuberculosis
SDTDRQLLAARLLAALAARRDAEL

SEQ ID NO: 1510147 - protein, 22 aa, Mycobacterium tuberculosis
SEDWMTRLLLGFGSDVRVLAPE

SEQ ID NO: 1510148 - protein, 30 aa, Mycobacterium tuberculosis; identical to SEQ ID NO: 222864

SEQ ID NO: 1510149 - protein, 18 aa, Mycobacterium tuberculosis
SELLPQLLAADALAAELK

SEQ ID NO: 1510150 - protein, 23 aa, Mycobacterium tuberculosis
SELSHFSGAGISLLCILDEDCRA

SEQ ID NO: 1510151 - protein, 27 aa, Mycobacterium tuberculosis
SEVEYRQLRLERVVLVGVWTEGSAADN

SEQ ID NO: 1510152 - protein, 22 aa, Mycobacterium tuberculosis
SEVLLIEPFYDSYSPVVAMAGA

SEQ ID NO: 1510153 - protein, 18 aa, Mycobacterium tuberculosis
SFRRIDFALDPPAGDIGL

SEQ ID NO: 1510154 - protein, 21 aa, Mycobacterium tuberculosis
SGFRLLAMTPHGNACKLPEAI

SEQ ID NO: 1510155 - protein, 26 aa, Mycobacterium tuberculosis
SGGQRRRLQLMLTLLSEPNVLLLDEP

SEQ ID NO: 1510156 - protein, 18 aa, Mycobacterium tuberculosis
SGIPYVGRILVNVQVVPH

SEQ ID NO: 1510157 - protein, 29 aa, Mycobacterium tuberculosis
SGNYSNGILWRGDYQGLIGYSYALTIPEI

SEQ ID NO: 1510158 - protein, 33 aa, Mycobacterium tuberculosis; identical to SEQ ID NO: 222931

SEQ ID NO: 1510159 - protein, 26 aa, Mycobacterium tuberculosis
SGTAPILLGALPFDVSRPAALMVPDG

SEQ ID NO: 1510160 - protein, 22 aa, Mycobacterium tuberculosis
SGTRLYPITMGISKQLLPVYDK

SEQ ID NO: 1510161 - protein, 19 aa, Mycobacterium tuberculosis
SGVVLYLRPPGPAQACGLF

SEQ ID NO: 1510162 - protein, 22 aa, Mycobacterium tuberculosis
SGYENIIIRGLFLGQTRKQMQA

SEQ ID NO: 1510163 - protein, 38 aa, Mycobacterium tuberculosis; identical to SEQ ID NO: 222956

SEQ ID NO: 1510164 - protein, 18 aa, Mycobacterium tuberculosis
SHHPIIDPILPELRSALA

SEQ ID NO: 1510165 - protein, 24 aa, Mycobacterium tuberculosis
SKAYAAYSTPFWRASGYSGQALSD

SEQ ID NO: 1510166 - protein, 23 aa, Mycobacterium tuberculosis
SKLHGLHVTDFLLVPPGALPKTT

SEQ ID NO: 1510167 - protein, 18 aa, Mycobacterium tuberculosis
SLIGIFQLGGAAARGGER

SEQ ID NO: 1510168 - protein, 28 aa, Mycobacterium tuberculosis
SLSPTEFTLLRYFVINAGTVLSKPKILD

SEQ ID NO: 1510169 - protein, 29 aa, Mycobacterium tuberculosis
SLVSRISAFLRPDWTRTVRARRFAAAGLV

SEQ ID NO: 1510170 - protein, 18 aa, Mycobacterium tuberculosis
SMPLIRPNGRMLAIKGER

SEQ ID NO: 1510171 - protein, 19 aa, Mycobacterium tuberculosis
SNEFLARLCKTAIWIDHGV

SEQ ID NO: 1510172 - protein, 18 aa, Mycobacterium tuberculosis
SPAWLRLDARFGSVYRHR

SEQ ID NO: 1510173 - protein, 17 aa, Mycobacterium tuberculosis
SPLPVVAASAEGAWIAD

SEQ ID NO: 1510174 - protein, 19 aa, Mycobacterium tuberculosis
SPPAPIANPGALARLYELI

SEQ ID NO: 1510175 - protein, 19 aa, Mycobacterium tuberculosis
SPRQRAVLLLRDVLQWKSA

SEQ ID NO: 1510176 - protein, 32 aa, Mycobacterium tuberculosis; identical to SEQ ID NO: 223081

SEQ ID NO: 1510177 - protein, 18 aa, Mycobacterium tuberculosis
SPYSHWAFQHVEDFMPTT

SEQ ID NO: 1510178 - protein, 17 aa, Mycobacterium tuberculosis
SRKLSLASGFALWRRSL

SEQ ID NO: 1510179 - protein, 25 aa, Mycobacterium tuberculosis
SRLCTACFDGKYPIELPRETALGKN

SEQ ID NO: 1510180 - protein, 35 aa, Mycobacterium tuberculosis; identical to SEQ ID NO: 223142

SEQ ID NO: 1510181 - protein, 40 aa, Mycobacterium tuberculosis; identical to SEQ ID NO: 223143

SEQ ID NO: 1510182 - protein, 18 aa, Mycobacterium tuberculosis
SSGLTAIHLACRSLHDGE

SEQ ID NO: 1510183 - protein, 24 aa, Mycobacterium tuberculosis
STFHSTCVRILRNQAALIEGLNSN

SEQ ID NO: 1510184 - protein, 23 aa, Mycobacterium tuberculosis
STKPAYSIVLPPPNVTGSLHMGH

SEQ ID NO: 1510185 - protein, 25 aa, Mycobacterium tuberculosis
STKTFLAQIAANYLLGLALAQARGT

SEQ ID NO: 1510186 - protein, 24 aa, Mycobacterium tuberculosis
SVFSVEFLVHAWDYAVAVGSELKA

SEQ ID NO: 1510187 - protein, 20 aa, Mycobacterium tuberculosis
SVPVRLAELFIEAGLPAGVF

SEQ ID NO: 1510188 - protein, 19 aa, Mycobacterium tuberculosis
SVSSVLYPGLPSHPGHEIA

SEQ ID NO: 1510189 - protein, 18 aa, Mycobacterium tuberculosis
SWPRYFAALEQLVRPGGP

SEQ ID NO: 1510190 - protein, 20 aa, Mycobacterium tuberculosis
SYSLQMRAVGQPLQDHLAAV

SEQ ID NO: 1510191 - protein, 46 aa, Mycobacterium tuberculosis; identical to SEQ ID NO: 223252

SEQ ID NO: 1510192 - protein, 19 aa, Mycobacterium tuberculosis
TAELLRLALTGKRKPYIYT

SEQ ID NO: 1510193 - protein, 25 aa, Mycobacterium tuberculosis
TAFAESVPMWGPRGAALIQAIPEAT

SEQ ID NO: 1510194 - protein, 32 aa, Mycobacterium tuberculosis; identical to SEQ ID NO: 223262

SEQ ID NO: 1510195 - protein, 22 aa, Mycobacterium tuberculosis
TAGTLSILAFTFTMVTGGNDTV

SEQ ID NO: 1510196 - protein, 27 aa, Mycobacterium tuberculosis
TAMTGAAAPYLGWLSAAAAQAQQAATQ

SEQ ID NO: 1510197 - protein, 19 aa, Mycobacterium tuberculosis
TATIRMLLAAIQTEEVSGK

SEQ ID NO: 1510198 - protein, 32 aa, Mycobacterium tuberculosis; identical to SEQ ID NO: 215390

SEQ ID NO: 1510199 - protein, 28 aa, Mycobacterium tuberculosis
TAVQFHFIARLVLVLLDETFLPGGPRAQ

SEQ ID NO: 1510200 - protein, 25 aa, Mycobacterium tuberculosis
TAWRNGDWYVARLTPSPLGHEERRT

SEQ ID NO: 1510201 - protein, 19 aa, Mycobacterium tuberculosis
TCDPIAGLVQIPCIERNAI

SEQ ID NO: 1510202 - protein, 17 aa, Mycobacterium tuberculosis
TCVPTSWRAARATLRLP

SEQ ID NO: 1510203 - protein, 20 aa, Mycobacterium tuberculosis
TDELLARDWAPKVHGAWELH

SEQ ID NO: 1510204 - protein, 36 aa, Mycobacterium tuberculosis; identical to SEQ ID NO: 223348

SEQ ID NO: 1510205 - protein, 27 aa, Mycobacterium tuberculosis
TEDDPNWFRFHQMFADFLHRRLERGGS

SEQ ID NO: 1510206 - protein, 25 aa, Mycobacterium tuberculosis
TEVKVPGVLTARIVPGATALDFQAK

SEQ ID NO: 1510207 - protein, 17 aa, Mycobacterium tuberculosis
TFAKPYAEWRGMFAGNG

SEQ ID NO: 1510208 - protein, 18 aa, Mycobacterium tuberculosis
TFASYPHFFELKRTRTEP

SEQ ID NO: 1510209 - protein, 23 aa, Mycobacterium tuberculosis
TGLLDERALFLGQWGLRGQRGGE

SEQ ID NO: 1510210 - protein, 18 aa, Mycobacterium tuberculosis
TGLTCPYTTPLDVTADII

SEQ ID NO: 1510211 - protein, 26 aa, Mycobacterium tuberculosis
TGMGKTFAFGVPLLQRITSGDGTRPL

SEQ ID NO: 1510212 - protein, 22 aa, Mycobacterium tuberculosis
TGTNLWGAFGLLAEMVKQGRSG

SEQ ID NO: 1510213 - protein, 23 aa, Mycobacterium tuberculosis
TGVGLALVAQRRGYKCVFVCPDK

SEQ ID NO: 1510214 - protein, 24 aa, Mycobacterium tuberculosis
THNAWVEFPIFDAKSRSLKKAVLG

SEQ ID NO: 1510215 - protein, 31 aa, Mycobacterium tuberculosis
TIFPGGYTIDPLPLHLALNLTVPDSSIPIID

SEQ ID NO: 1510216 - protein, 29 aa, Mycobacterium tuberculosis
TIRPAPDTMTWVTALLPVARGVSVYAALK

SEQ ID NO: 1510217 - protein, 25 aa, Mycobacterium tuberculosis
TIVDLTVIGLGRYIPRIARVAAATE

SEQ ID NO: 1510218 - protein, 18 aa, Mycobacterium tuberculosis
TLACLPGEYGPNLAVMAA

SEQ ID NO: 1510219 - protein, 20 aa, Mycobacterium tuberculosis
TLNALQFVGGMLWSTALAEA

SEQ ID NO: 1510220 - protein, 20 aa, Mycobacterium tuberculosis
TLVFYIWGDNGASMEGTNTG

SEQ ID NO: 1510221 - protein, 23 aa, Mycobacterium tuberculosis
TNATFLRDALHKAGIEAQFVARG

SEQ ID NO: 1510222 - protein, 32 aa, Mycobacterium tuberculosis; identical to SEQ ID NO: 223568

SEQ ID NO: 1510223 - protein, 20 aa, Mycobacterium tuberculosis
TPEHPFPVWTERGGPATIVP

SEQ ID NO: 1510224 - protein, 19 aa, Mycobacterium tuberculosis
TPPTVVMLAGLQGSGKTTL

SEQ ID NO: 1510225 - protein, 31 aa, Mycobacterium tuberculosis
TQAFRSRFGENFFYILYFQEPGIADAELNGD

SEQ ID NO: 1510226 - protein, 22 aa, Mycobacterium tuberculosis
TQIAISAWGLLSPQGRCAAFDA

SEQ ID NO: 1510227 - protein, 20 aa, Mycobacterium tuberculosis
TQLALPGGMQPLWGPDQRRV

SEQ ID NO: 1510228 - protein, 19 aa, Mycobacterium tuberculosis
TQLLERLGFRRDQLSARVD

SEQ ID NO: 1510229 - protein, 18 aa, Mycobacterium tuberculosis
TQLRLQHALVLLAERHDV

SEQ ID NO: 1510230 - protein, 25 aa, Mycobacterium tuberculosis
TQSPYPGGGPIPEKYYRTLDPFVAL

SEQ ID NO: 1510231 - protein, 18 aa, Mycobacterium tuberculosis
TRATIADLAWLRARDLDR

SEQ ID NO: 1510232 - protein, 21 aa, Mycobacterium tuberculosis
TRIKARVPEALAATLREFAPR

SEQ ID NO: 1510233 - protein, 23 aa, Mycobacterium tuberculosis
TRPLDAGPYTFLAADALVLKVRE

SEQ ID NO: 1510234 - protein, 22 aa, Mycobacterium tuberculosis
TRRLFAGGGFGGRRFDSGFGGG

SEQ ID NO: 1510235 - protein, 24 aa, Mycobacterium tuberculosis
TTYPLLLHEAYVRLYPAQVIKQAD

SEQ ID NO: 1510236 - protein, 23 aa, Mycobacterium tuberculosis
TVCKWGGFLDNPADFDCEFFGIG

SEQ ID NO: 1510237 - protein, 24 aa, Mycobacterium tuberculosis
TVGFKFMSRIVPYPGTPLYQAYSD

SEQ ID NO: 1510238 - protein, 18 aa, Mycobacterium tuberculosis
TVMSNLGLHLAMRSAGVT

SEQ ID NO: 1510239 - protein, 26 aa, Mycobacterium tuberculosis
TVSDEAVLAAARRLRIIPGIASRTRT

SEQ ID NO: 1510240 - protein, 24 aa, Mycobacterium tuberculosis
TVSGLFNMSLVAITTPALISGFFN

SEQ ID NO: 1510241 - protein, 24 aa, Mycobacterium tuberculosis
TVVVAADWPLLAAAYRTRGALRIV

SEQ ID NO: 1510242 - protein, 28 aa, Mycobacterium tuberculosis
TYEVTALNFMPGWLDMLLEVGGGRLSSL

SEQ ID NO: 1510243 - protein, 24 aa, Mycobacterium tuberculosis
VADWIKVVCFPDRWLDLRYVGPAS

SEQ ID NO: 1510244 - protein, 26 aa, Mycobacterium tuberculosis
VAEQLAMFSLSQWQEAIYARIVDKVG

SEQ ID NO: 1510245 - protein, 27 aa, Mycobacterium tuberculosis
VAHGWIPPGIALPEGVRLLAPARRAGR

SEQ ID NO: 1510246 - protein, 27 aa, Mycobacterium tuberculosis
VALDRGEFFLVYQPIIRLADNRIIGAE

SEQ ID NO: 1510247 - protein, 25 aa, Mycobacterium tuberculosis
VALGHQLAAVPYLESVVLAAGALAR

SEQ ID NO: 1510248 - protein, 30 aa, Mycobacterium tuberculosis; identical to SEQ ID NO: 223867

SEQ ID NO: 1510249 - protein, 26 aa, Mycobacterium tuberculosis
VDAIRRGAQAILPTPAPLGGALVEEI

SEQ ID NO: 1510250 - protein, 26 aa, Mycobacterium tuberculosis
VDDPDGTWGLQRLADLLAARTRYFDA

SEQ ID NO: 1510251 - protein, 24 aa, Mycobacterium tuberculosis
VDFDPIYCWPKPVTKPYPPLYVGG

SEQ ID NO: 1510252 - protein, 22 aa, Mycobacterium tuberculosis
VDPALLLNCMLLAATERSVTGD

SEQ ID NO: 1510253 - protein, 20 aa, Mycobacterium tuberculosis
VDPDALVHTIWMASNRSDRV

SEQ ID NO: 1510254 - protein, 17 aa, Mycobacterium tuberculosis
VDQGLIRKSGAWFTYEG

SEQ ID NO: 1510255 - protein, 26 aa, Mycobacterium tuberculosis
VDVTLRPAQYLPWHPGRCAQVFVGES

SEQ ID NO: 1510256 - protein, 26 aa, Mycobacterium tuberculosis
VEGAVVWNAPLRFKREGAGHFNRGTQ

SEQ ID NO: 1510257 - protein, 25 aa, Mycobacterium tuberculosis
VEHGFRGLSLRPFMIGRPASDPAYF

SEQ ID NO: 1510258 - protein, 18 aa, Mycobacterium tuberculosis
VERTGATLVPPFDDLRTI

SEQ ID NO: 1510259 - protein, 24 aa, Mycobacterium tuberculosis
VETFIRHFELGAADRWLALATLEC

SEQ ID NO: 1510260 - protein, 19 aa, Mycobacterium tuberculosis
VFNLVQYLGQLGIEAEVWR

SEQ ID NO: 1510261 - protein, 17 aa, Mycobacterium tuberculosis
VFPLSNWTEFDIWSYIG

SEQ ID NO: 1510262 - protein, 21 aa, Mycobacterium tuberculosis
VGIDFFTRWAAGNIKATDVDD

SEQ ID NO: 1510263 - protein, 17 aa, Mycobacterium tuberculosis
VGRLMSYKLDRSRPLWE

SEQ ID NO: 1510264 - protein, 17 aa, Mycobacterium tuberculosis
VHAPGEHPMFKAMAAGL

SEQ ID NO: 1510265 - protein, 18 aa, Mycobacterium tuberculosis
VHEILCQIPTLTAPYRAV

SEQ ID NO: 1510266 - protein, 18 aa, Mycobacterium tuberculosis
VHRCRLPFCDVTVGLVRG

SEQ ID NO: 1510267 - protein, 27 aa, Mycobacterium tuberculosis
VIAPTPERPIIFNLPATVEMTTPNVYA

SEQ ID NO: 1510268 - protein, 22 aa, Mycobacterium tuberculosis
VKQELFERLATLAPDAVLATNT

SEQ ID NO: 1510269 - protein, 19 aa, Mycobacterium tuberculosis
VLAALLLNRISLAPGEAIF

SEQ ID NO: 1510270 - protein, 17 aa, Mycobacterium tuberculosis
VLAQARVGSYLRYGAYP

SEQ ID NO: 1510271 - protein, 23 aa, Mycobacterium tuberculosis
VLAQRCFELLTPALTRYYPDGSQ

SEQ ID NO: 1510272 - protein, 23 aa, Mycobacterium tuberculosis
VLARELLPERALMGDASAIVALH

SEQ ID NO: 1510273 - protein, 23 aa, Mycobacterium tuberculosis
VLRARKLPDWPTGPLPKVRVAAA

SEQ ID NO: 1510274 - protein, 17 aa, Mycobacterium tuberculosis
VLRLPGHDVDWVPVHVT

SEQ ID NO: 1510275 - protein, 27 aa, Mycobacterium tuberculosis
VLVVQRMLASRFTPLALFGTDRRLAEL

SEQ ID NO: 1510276 - protein, 18 aa, Mycobacterium tuberculosis
VLVWQDMAGFSGAKTARF

SEQ ID NO: 1510277 - protein, 20 aa, Mycobacterium tuberculosis
VNRSPGLVSFIHRARRLLPG

SEQ ID NO: 1510278 - protein, 19 aa, Mycobacterium tuberculosis
VNSALMYAGPGSGPMLAAA

SEQ ID NO: 1510279 - protein, 24 aa, Mycobacterium tuberculosis
VPALLRVRFPWPPFEPDVRLSPYL

SEQ ID NO: 1510280 - protein, 18 aa, Mycobacterium tuberculosis
VPGAYVAGWIKRGPTGFI

SEQ ID NO: 1510281 - protein, 25 aa, Mycobacterium tuberculosis
VPPNGLPVILGPDHPITGSYPVVGV

SEQ ID NO: 1510282 - protein, 23 aa, Mycobacterium tuberculosis
VPVAGLTWMPFTDQRYTAVAGGP

SEQ ID NO: 1510283 - protein, 18 aa, Mycobacterium tuberculosis
VPVPKSVWRWIDSAQHRL

SEQ ID NO: 1510284 - protein, 18 aa, Mycobacterium tuberculosis
VPVRAFINPANRLMVYRR

SEQ ID NO: 1510285 - protein, 34 aa, Mycobacterium tuberculosis; identical to SEQ ID NO: 224219

SEQ ID NO: 1510286 - protein, 32 aa, Mycobacterium tuberculosis; identical to SEQ ID NO: 224226

SEQ ID NO: 1510287 - protein, 22 aa, Mycobacterium tuberculosis
VRARLRREVLIDDGTDEARVSR

SEQ ID NO: 1510288 - protein, 21 aa, Mycobacterium tuberculosis
VRDVRLATVLSRCSYLRDGIV

SEQ ID NO: 1510289 - protein, 23 aa, Mycobacterium tuberculosis
VRVLRPGGYFPYADLRPNNEIAA

SEQ ID NO: 1510290 - protein, 35 aa, Mycobacterium tuberculosis; identical to SEQ ID NO: 224292

SEQ ID NO: 1510291 - protein, 26 aa, Mycobacterium tuberculosis
VSGSGPAYFFLLVEALVDAGVGVGLS

SEQ ID NO: 1510292 - protein, 18 aa, Mycobacterium tuberculosis
VSHLYLSPILTAVGGSTH

SEQ ID NO: 1510293 - protein, 21 aa, Mycobacterium tuberculosis
VSMQALLERAYRMGLVSAEAR

SEQ ID NO: 1510294 - protein, 27 aa, Mycobacterium tuberculosis
VSWSNPNDWWLVRLLGSITPTERTTIV

SEQ ID NO: 1510295 - protein, 22 aa, Mycobacterium tuberculosis
VTADVTLTRAWCLRELGDDDAA

SEQ ID NO: 1510296 - protein, 24 aa, Mycobacterium tuberculosis
VTDGKMFIIGRIKDLLIVYGRNHS

SEQ ID NO: 1510297 - protein, 25 aa, Mycobacterium tuberculosis
VTDMPDRVVWLPLNSAGSTVHRQLR

SEQ ID NO: 1510298 - protein, 25 aa, Mycobacterium tuberculosis
VTLADLLDFFKDPVKGFFRALDYTL

SEQ ID NO: 1510299 - protein, 30 aa, Mycobacterium tuberculosis; identical to SEQ ID NO: 224353

SEQ ID NO: 1510300 - protein, 18 aa, Mycobacterium tuberculosis
VVKGGRRFSFTALVIVGD

SEQ ID NO: 1510301 - protein, 18 aa, Mycobacterium tuberculosis
VWCPLCALAALVTGEQHP

SEQ ID NO: 1510302 - protein, 17 aa, Mycobacterium tuberculosis
VYGYFPAVSEGNDIVVL

SEQ ID NO: 1510303 - protein, 18 aa, Mycobacterium tuberculosis
WAAAIPWSDIQKYWMMFL

SEQ ID NO: 1510304 - protein, 17 aa, Mycobacterium tuberculosis
WAKTWEFQALLKARPVV

SEQ ID NO: 1510305 - protein, 24 aa, Mycobacterium tuberculosis
WDAEAFYHPDPLTPGRMTTKWGGF

SEQ ID NO: 1510306 - protein, 18 aa, Mycobacterium tuberculosis
WDLTDWQGTPIRIGFVAR

SEQ ID NO: 1510307 - protein, 19 aa, Mycobacterium tuberculosis
WDVIGDTGIGFCLDTCHTW

SEQ ID NO: 1510308 - protein, 21 aa, Mycobacterium tuberculosis
WFRSFFGVPSSITAPDGRPVN

SEQ ID NO: 1510309 - protein, 19 aa, Mycobacterium tuberculosis
WLDHLMVDYDEQQRWVVMR

SEQ ID NO: 1510310 - protein, 24 aa, Mycobacterium tuberculosis
WLLNGQKIWSSRAPFADMGFGLFR

SEQ ID NO: 1510311 - protein, 25 aa, Mycobacterium tuberculosis
WPVAGRMMGRLGWYVESMLSPRLHR

SEQ ID NO: 1510312 - protein, 20 aa, Mycobacterium tuberculosis
WRAPSKLAYIDAGLIDLIRV

SEQ ID NO: 1510313 - protein, 17 aa, Mycobacterium tuberculosis
WRVLRLLRTVGMHHALG

SEQ ID NO: 1510314 - protein, 24 aa, Mycobacterium tuberculosis
WSNFNADRWELFHIAADRSQCHDL

SEQ ID NO: 1510315 - protein, 25 aa, Mycobacterium tuberculosis
WSPEALAWPLLAVIDASLDEPWCRT

SEQ ID NO: 1510316 - protein, 17 aa, Mycobacterium tuberculosis
WSQLYRRTLNVAQELSR

SEQ ID NO: 1510317 - protein, 18 aa, Mycobacterium tuberculosis
WSRPLEKVYAAVFIDAIM

SEQ ID NO: 1510318 - protein, 18 aa, Mycobacterium tuberculosis
WVAALRNSLRARRDRLAA

SEQ ID NO: 1510319 - protein, 18 aa, Mycobacterium tuberculosis
WVSPVDTIVRVRTGERGH

SEQ ID NO: 1510320 - protein, 31 aa, Mycobacterium tuberculosis; identical to SEQ ID NO: 224561

SEQ ID NO: 1510321 - protein, 27 aa, Mycobacterium tuberculosis
YGPDGLALPMRLALPGSVNRGNAAQAV

SEQ ID NO: 1510322 - protein, 17 aa, Mycobacterium tuberculosis
YHGGEFIDLIVGGSTYD

SEQ ID NO: 1510323 - protein, 18 aa, Mycobacterium tuberculosis
YIDAGLIDLIRVIRELNI

SEQ ID NO: 1510324 - protein, 17 aa, Mycobacterium tuberculosis
YLPMERGRYVITPEQVL

SEQ ID NO: 1510325 - protein, 30 aa, Mycobacterium tuberculosis; identical to SEQ ID NO: 225820

SEQ ID NO: 1510326 - protein, 25 aa, Mycobacterium tuberculosis
YPSAVAKARFVRVSPRKARRVIDLV

SEQ ID NO: 1510327 - protein, 18 aa, Mycobacterium tuberculosis
YQQLVLIRQLVADFNLDV

SEQ ID NO: 1510328 - protein, 28 aa, Mycobacterium tuberculosis
YRDDLRHEKLLFKKGIHLLDCGTSGGVW

SEQ ID NO: 1510329 - protein, 17 aa, Mycobacterium tuberculosis
YSFPMKKKPNRKCLRIT

SEQ ID NO: 1510330 - protein, 29 aa, Mycobacterium tuberculosis
YVDDVALPGMLHLAILRSPYAHARIVRID

SEQ ID NO: 1510331 - protein, 17 aa, Mycobacterium tuberculosis
YVLMLAALDLAATVEDE

SEQ ID NO: 1510332 - protein, 18 aa, Mycobacterium tuberculosis
YVRSFYFQDPDGITLEFA

SEQ ID NO: 1510333 - protein, 28 aa, Mycobacterium tuberculosis
YVTTPGSALLFPALCTPTGDPPAPEPAR

SEQ ID NO: 1510334 - protein, 24 aa, Mycobacterium tuberculosis
AAALADPLVLDAVLFEGGAFAEFL

SEQ ID NO: 1510335 - protein, 23 aa, Mycobacterium tuberculosis
AAALAPRRTTLPGGLRVVTEFLP

SEQ ID NO: 1510336 - protein, 33 aa, Mycobacterium tuberculosis; identical to SEQ ID NO: 215470

SEQ ID NO: 1510337 - protein, 24 aa, Mycobacterium tuberculosis
AAELMGIQIPRFCDHPLLEPVGAC

SEQ ID NO: 1510338 - protein, 21 aa, Mycobacterium tuberculosis
AAGARWILDLGPGDILTRLTA

SEQ ID NO: 1510339 - protein, 30 aa, Mycobacterium tuberculosis; identical to SEQ ID NO: 215487

SEQ ID NO: 1510340 - protein, 18 aa, Mycobacterium tuberculosis
AAHLPRAVRWHRYSLDNG

SEQ ID NO: 1510341 - protein, 23 aa, Mycobacterium tuberculosis
AARAVWQALPGELWADRFAEAAA

SEQ ID NO: 1510342 - protein, 18 aa, Mycobacterium tuberculosis
AARGRLMQALPAGGAMVA

SEQ ID NO: 1510343 - protein, 40 aa, Mycobacterium tuberculosis; identical to SEQ ID NO: 215562

SEQ ID NO: 1510344 - protein, 23 aa, Mycobacterium tuberculosis
AASELLLTVRYQLDTQPRPLVIV

SEQ ID NO: 1510345 - protein, 29 aa, Mycobacterium tuberculosis
AAVLFDIDGVLVLSWRAIPGAAETVRQLT

SEQ ID NO: 1510346 - protein, 23 aa, Mycobacterium tuberculosis
AAYEALRKMVVKAPLRAATVSVA

SEQ ID NO: 1510347 - protein, 29 aa, Mycobacterium tuberculosis
ACGAIELGIKWLSLYAFSTENWKRSPEEV

SEQ ID NO: 1510348 - protein, 26 aa, Mycobacterium tuberculosis
ADALGIRTVLIPPMAGVLSALGIGLA

SEQ ID NO: 1510349 - protein, 32 aa, Mycobacterium tuberculosis; identical to SEQ ID NO: 215646

SEQ ID NO: 1510350 - protein, 27 aa, Mycobacterium tuberculosis
ADIEFPAPALIYGYGAYEICEDPRFSI

SEQ ID NO: 1510351 - protein, 18 aa, Mycobacterium tuberculosis
ADSAACRAAFQALELMVV

SEQ ID NO: 1510352 - protein, 17 aa, Mycobacterium tuberculosis
AEHTQSYVRACHLVGYQ

SEQ ID NO: 1510353 - protein, 26 aa, Mycobacterium tuberculosis
AEISSGPYRFVYRKRFHKRCETELTV

SEQ ID NO: 1510354 - protein, 24 aa, Mycobacterium tuberculosis
AEPTADLAMWPPAGAVPVEVADGY

SEQ ID NO: 1510355 - protein, 19 aa, Mycobacterium tuberculosis
AETLPHRPGVYLFRGPSGE

SEQ ID NO: 1510356 - protein, 22 aa, Mycobacterium tuberculosis
AETPWIHRCATVLAVRSYLLRI

SEQ ID NO: 1510357 - protein, 29 aa, Mycobacterium tuberculosis
AFETSWLDPFTEFRFPRIGTAVFDGIEIE

SEQ ID NO: 1510358 - protein, 21 aa, Mycobacterium tuberculosis
AGAFVNWEGRYRTFEPALRGS

SEQ ID NO: 1510359 - protein, 19 aa, Mycobacterium tuberculosis
AGLPVLGAKGAEYPLLPDE

SEQ ID NO: 1510360 - protein, 19 aa, Mycobacterium tuberculosis
AGPSTLVRAGAQAFLVDCG

SEQ ID NO: 1510361 - protein, 24 aa, Mycobacterium tuberculosis
AGSLVAPPKVRVPLLVGGNGTEVL

SEQ ID NO: 1510362 - protein, 20 aa, Mycobacterium tuberculosis
AGTVYRHFPTKEALFQAVIA

SEQ ID NO: 1510363 - protein, 26 aa, Mycobacterium tuberculosis
AGYEKWRIRFASTAWTSTWRRWCIPA

SEQ ID NO: 1510364 - protein, 19 aa, Mycobacterium tuberculosis
AHAAVVYGYFPAVSEGNDI

SEQ ID NO: 1510365 - protein, 19 aa, Mycobacterium tuberculosis
AHQARILLAKNPAGWQEAL

SEQ ID NO: 1510366 - protein, 22 aa, Mycobacterium tuberculosis
AIAIDPQQRLLLETSWEAMEHA

SEQ ID NO: 1510367 - protein, 17 aa, Mycobacterium tuberculosis
AIEALAPYGLGTAYVNF

SEQ ID NO: 1510368 - protein, 17 aa, Mycobacterium tuberculosis
AIEQLPIPYTAVATDLL

SEQ ID NO: 1510369 - protein, 25 aa, Mycobacterium tuberculosis
AIRESLDSLGPIFSELRDTGRELLE

SEQ ID NO: 1510370 - protein, 25 aa, Mycobacterium tuberculosis
AIVNVSSVLAWLPLGMSYGVSKAAM

SEQ ID NO: 1510371 - protein, 20 aa, Mycobacterium tuberculosis
AKDLTGLRQRWALVGGFAVS

SEQ ID NO: 1510372 - protein, 19 aa, Mycobacterium tuberculosis
ALALYHTKRLASPAQRIML

SEQ ID NO: 1510373 - protein, 17 aa, Mycobacterium tuberculosis
ALFDREFTFGWDELLSK

SEQ ID NO: 1510374 - protein, 24 aa, Mycobacterium tuberculosis
ALFHDRFVQILQEGAAAYAMAEAA

SEQ ID NO: 1510375 - protein, 24 aa, Mycobacterium tuberculosis
ALGDYEWILAFEAPELDRIVDLMR

SEQ ID NO: 1510376 - protein, 17 aa, Mycobacterium tuberculosis
ALKVKFDGGTLPPMFVD

SEQ ID NO: 1510377 - protein, 17 aa, Mycobacterium tuberculosis
ALLEPTWWEGDRPPAAE

SEQ ID NO: 1510378 - protein, 17 aa, Mycobacterium tuberculosis
ALRRKFSASQFLADVRR

SEQ ID NO: 1510379 - protein, 32 aa, Mycobacterium tuberculosis; identical to SEQ ID NO: 216144

SEQ ID NO: 1510380 - protein, 21 aa, Mycobacterium tuberculosis
ALWAATFLRRRGAAADAVLLN

SEQ ID NO: 1510381 - protein, 26 aa, Mycobacterium tuberculosis
ANRRAALAALLSQLPRSDLETLRKAL

SEQ ID NO: 1510382 - protein, 23 aa, Mycobacterium tuberculosis
APADLITEYGPHVALPPTELEMA

SEQ ID NO: 1510383 - protein, 26 aa, Mycobacterium tuberculosis
APEHVHTYRITPLALWNARAAGHDAE

SEQ ID NO: 1510384 - protein, 21 aa, Mycobacterium tuberculosis
APLDRRLLLGMLAELPAGAGV

SEQ ID NO: 1510385 - protein, 17 aa, Mycobacterium tuberculosis
AQAAPAKYPAGFFGVFT

SEQ ID NO: 1510386 - protein, 24 aa, Mycobacterium tuberculosis
AQAGALPALFSGLARRPRRRQIDD

SEQ ID NO: 1510387 - protein, 22 aa, Mycobacterium tuberculosis
AQFSVVLPRRDGVEYSVEHAVI

SEQ ID NO: 1510388 - protein, 18 aa, Mycobacterium tuberculosis
AQGLPVSAIAWGAWGEVG

SEQ ID NO: 1510389 - protein, 25 aa, Mycobacterium tuberculosis
AQLAGLKLLAFRGRFVEIGKRDIYG

SEQ ID NO: 1510390 - protein, 23 aa, Mycobacterium tuberculosis
AQQAFGSPALMRALDRLDAHLQA

SEQ ID NO: 1510391 - protein, 24 aa, Mycobacterium tuberculosis
AQQEPQLVRKIILAGTGPAGGVGI

SEQ ID NO: 1510392 - protein, 24 aa, Mycobacterium tuberculosis
AQRALHRVVTLLAAGRPVLTHCFA

SEQ ID NO: 1510393 - protein, 27 aa, Mycobacterium tuberculosis
AQRPGDPTLRRLLPDFYRPDDLDDDDP

SEQ ID NO: 1510394 - protein, 22 aa, Mycobacterium tuberculosis
AQYDVRLVSRVSDAPPVPARLV

SEQ ID NO: 1510395 - protein, 23 aa, Mycobacterium tuberculosis
ARDRMRERWRIVLVDEFQDTDPM

SEQ ID NO: 1510396 - protein, 21 aa, Mycobacterium tuberculosis
ARFGRLPFETLFEPAISYGRN

SEQ ID NO: 1510397 - protein, 25 aa, Mycobacterium tuberculosis
ARKSFFRVPLIGGTITHPVQGEAAA

SEQ ID NO: 1510398 - protein, 30 aa, Mycobacterium tuberculosis; identical to SEQ ID NO: 216368

SEQ ID NO: 1510399 - protein, 22 aa, Mycobacterium tuberculosis
ARQGPLLVVTATGREADDLAAE

SEQ ID NO: 1510400 - protein, 17 aa, Mycobacterium tuberculosis
ARRLAREEGLLVGISSG

SEQ ID NO: 1510401 - protein, 19 aa, Mycobacterium tuberculosis
ARYPQLFRPILRQTNIGVH

SEQ ID NO: 1510402 - protein, 50 aa, Mycobacterium tuberculosis; identical to SEQ ID NO: 216393

SEQ ID NO: 1510403 - protein, 25 aa, Mycobacterium tuberculosis
ASRPPLMKRIVLQTGARLSRRGRRL

SEQ ID NO: 1510404 - protein, 26 aa, Mycobacterium tuberculosis
ASTETRLPFCWRGVSLHAGGAGRVRA

SEQ ID NO: 1510405 - protein, 20 aa, Mycobacterium tuberculosis
ASTLGLSMPANLSGGGNVGA

SEQ ID NO: 1510406 - protein, 25 aa, Mycobacterium tuberculosis
ASTNHILGFPFTSHGLRLGVEASLR

SEQ ID NO: 1510407 - protein, 17 aa, Mycobacterium tuberculosis
ASYPGFTATAPPGDGQV

SEQ ID NO: 1510408 - protein, 34 aa, Mycobacterium tuberculosis
ATAKEWHQYWIDNRLQWYIDLGIRRENLRLWEHP

SEQ ID NO: 1510409 - protein, 24 aa, Mycobacterium tuberculosis
ATGGLLLPLGVRSLRAYGPTRNAR

SEQ ID NO: 1510410 - protein, 22 aa, Mycobacterium tuberculosis
ATGMSMFNLGLGNIGQFNVGFS

SEQ ID NO: 1510411 - protein, 24 aa, Mycobacterium tuberculosis
ATPDIFVEFSRWRGLSPDGRCKAF

SEQ ID NO: 1510412 - protein, 23 aa, Mycobacterium tuberculosis
ATRGANIALAAALAPLQCYVSVD

SEQ ID NO: 1510413 - protein, 22 aa, Mycobacterium tuberculosis
ATTARAVAVARSGMDCVAGDAS

SEQ ID NO: 1510414 - protein, 17 aa, Mycobacterium tuberculosis
AVDAPRLGLPLAQELSA

SEQ ID NO: 1510415 - protein, 19 aa, Mycobacterium tuberculosis
AVLVFPHAGGAAAAYRWLA

SEQ ID NO: 1510416 - protein, 23 aa, Mycobacterium tuberculosis
AVQNFPALVANLPAAIDAAVQQF

SEQ ID NO: 1510417 - protein, 26 aa, Mycobacterium tuberculosis
AVRIEAMPWQWVGQELPQFSSAPTNH

SEQ ID NO: 1510418 - protein, 23 aa, Mycobacterium tuberculosis
AVRRRPYTVVLFDEIEKAHPDVF

SEQ ID NO: 1510419 - protein, 22 aa, Mycobacterium tuberculosis
AVSAMQERLPFFADLEASQRAS

SEQ ID NO: 1510420 - protein, 26 aa, Mycobacterium tuberculosis
CDVDDMLWQVPYLPIDPRDVGRTYEA

SEQ ID NO: 1510421 - protein, 18 aa, Mycobacterium tuberculosis
CETELTVLAPRREQLTGD

SEQ ID NO: 1510422 - protein, 29 aa, Mycobacterium tuberculosis
CMDYICAEAPLFLDTPAILGVPSSLNCYH

SEQ ID NO: 1510423 - protein, 18 aa, Mycobacterium tuberculosis
DAGPYTFLAADALVLKVR

SEQ ID NO: 1510424 - protein, 31 aa, Mycobacterium tuberculosis; identical to SEQ ID NO: 226020

SEQ ID NO: 1510425 - protein, 29 aa, Mycobacterium tuberculosis
DALAVGLQRKDGAAWLAHNRSGAGLFGSI

SEQ ID NO: 1510426 - protein, 19 aa, Mycobacterium tuberculosis
DALFLWAETPTRPLHVGAL

SEQ ID NO: 1510427 - protein, 17 aa, Mycobacterium tuberculosis
DARLRLVLEVPTLREVP

SEQ ID NO: 1510428 - protein, 18 aa, Mycobacterium tuberculosis
DASALRDWAHAVVSDLIL

SEQ ID NO: 1510429 - protein, 25 aa, Mycobacterium tuberculosis
DASLLLVVLTRFLPPDDPRVRNTVL

SEQ ID NO: 1510430 - protein, 22 aa, Mycobacterium tuberculosis
DDLLRNGVLVDLYPLVRKSIRV

SEQ ID NO: 1510431 - protein, 22 aa, Mycobacterium tuberculosis
DDRGPVWLFSGQGSQWAAMGAD

SEQ ID NO: 1510432 - protein, 22 aa, Mycobacterium tuberculosis
DDVLPYMRYNANKALANLGYQP

SEQ ID NO: 1510433 - protein, 24 aa, Mycobacterium tuberculosis
DERDRLVSERLLTLGWQQRALPEV

SEQ ID NO: 1510434 - protein, 17 aa, Mycobacterium tuberculosis
DGKVWVSPVDTIVRVRT

SEQ ID NO: 1510435 - protein, 25 aa, Mycobacterium tuberculosis
DGNTFQQLPFALAPGPPVPTTALRE

SEQ ID NO: 1510436 - protein, 17 aa, Mycobacterium tuberculosis
DHARYGAALWLVAANMA

SEQ ID NO: 1510437 - protein, 18 aa, Mycobacterium tuberculosis
DHGQPRINRYHHPAKILC

SEQ ID NO: 1510438 - protein, 18 aa, Mycobacterium tuberculosis
DHLIALLEICAVRADPET

SEQ ID NO: 1510439 - protein, 22 aa, Mycobacterium tuberculosis
DHVASVFRHEDLASALAATELT

SEQ ID NO: 1510440 - protein, 23 aa, Mycobacterium tuberculosis
DIGRLRWQFERIARGVPVAAPWD

SEQ ID NO: 1510441 - protein, 17 aa, Mycobacterium tuberculosis
DIIKGILGEVWEFITNA

SEQ ID NO: 1510442 - protein, 28 aa, Mycobacterium tuberculosis
DLAARLKAVWAPQGLIHRGQGRWYPGEP

SEQ ID NO: 1510443 - protein, 23 aa, Mycobacterium tuberculosis
DLASQAWQGPAAAAMAAAAAPYA

SEQ ID NO: 1510444 - protein, 24 aa, Mycobacterium tuberculosis
DLGPGDILTRLTAPVIRGLGIGIV

SEQ ID NO: 1510445 - protein, 34 aa, Mycobacterium tuberculosis; identical to SEQ ID NO: 217036

SEQ ID NO: 1510446 - protein, 23 aa, Mycobacterium tuberculosis
DLSVRDMTVCILDRPRHAQLIHD

SEQ ID NO: 1510447 - protein, 25 aa, Mycobacterium tuberculosis
DLTAWSRAQAAWLWSRRRGVIAGQS

SEQ ID NO: 1510448 - protein, 19 aa, Mycobacterium tuberculosis
DLTVPPWAVAGLGSQAELL

SEQ ID NO: 1510449 - protein, 28 aa, Mycobacterium tuberculosis
DLVVDNFTIPIIGFESFAFSFHIHTEPD

SEQ ID NO: 1510450 - protein, 39 aa, Mycobacterium tuberculosis; identical to SEQ ID NO: 113894

SEQ ID NO: 1510451 - protein, 26 aa, Mycobacterium tuberculosis
DNTVGPPLLPPILGGGMPAAPGPALR

SEQ ID NO: 1510452 - protein, 29 aa, Mycobacterium tuberculosis
DPEHYQRYLDILRPLGFRPALGFSRVDTT

SEQ ID NO: 1510453 - protein, 17 aa, Mycobacterium tuberculosis
DPLTPEAFYLQYFGCRP

SEQ ID NO: 1510454 - protein, 30 aa, Mycobacterium tuberculosis; identical to SEQ ID NO: 217113

SEQ ID NO: 1510455 - protein, 18 aa, Mycobacterium tuberculosis
DPPCDDWSPPPIRMGVDV

SEQ ID NO: 1510456 - protein, 20 aa, Mycobacterium tuberculosis
DPQHRMLLEVAWEALEHAGI

SEQ ID NO: 1510457 - protein, 19 aa, Mycobacterium tuberculosis
DPRPFRAGPHETSALLTSA

SEQ ID NO: 1510458 - protein, 23 aa, Mycobacterium tuberculosis
DPTRRADLIKLLDTFPAGAGARG

SEQ ID NO: 1510459 - protein, 24 aa, Mycobacterium tuberculosis
DQLIGFFINIVVLRNDLRGNPTLR

SEQ ID NO: 1510460 - protein, 25 aa, Mycobacterium tuberculosis
DQQVLPTYAVICCPAFGAAAKVGTF

SEQ ID NO: 1510461 - protein, 21 aa, Mycobacterium tuberculosis
DRIRPLRPDNTAYLIYTSGTT

SEQ ID NO: 1510462 - protein, 26 aa, Mycobacterium tuberculosis
DRKRPHDWIVWHFTHADNLPGIITAG

SEQ ID NO: 1510463 - protein, 24 aa, Mycobacterium tuberculosis
DRMAKMLRLAVDEVFQMQSEARAE

SEQ ID NO: 1510464 - protein, 27 aa, Mycobacterium tuberculosis
DSIVMLHLALKAFRPGRLPFPVMHVDT

SEQ ID NO: 1510465 - protein, 19 aa, Mycobacterium tuberculosis
DTAWFVIREQNLRFDWMKD

SEQ ID NO: 1510466 - protein, 17 aa, Mycobacterium tuberculosis
DTPILVPTGLPSPLPPT

SEQ ID NO: 1510467 - protein, 18 aa, Mycobacterium tuberculosis
DTRLLSETELWQLAFDVV

SEQ ID NO: 1510468 - protein, 30 aa, Mycobacterium tuberculosis; identical to SEQ ID NO: 217267

SEQ ID NO: 1510469 - protein, 18 aa, Mycobacterium tuberculosis
DTTRMRVELGYQPKWTTV

SEQ ID NO: 1510470 - protein, 18 aa, Mycobacterium tuberculosis
DVAARWPVPGPRDDKYTQ

SEQ ID NO: 1510471 - protein, 27 aa, Mycobacterium tuberculosis
DVGGPPLVFQLLWYPTTMADLSLPSFT

SEQ ID NO: 1510472 - protein, 24 aa, Mycobacterium tuberculosis
DVTSLYKVGLGSVRFLMSVGDLII

SEQ ID NO: 1510473 - protein, 18 aa, Mycobacterium tuberculosis
DVVILDLGLPDMSGIDVL

SEQ ID NO: 1510474 - protein, 19 aa, Mycobacterium tuberculosis
DWLSVKRLAGWLAAAGYCG

SEQ ID NO: 1510475 - protein, 22 aa, Mycobacterium tuberculosis
DYDYDTVFARALEGSARPGDTL

SEQ ID NO: 1510476 - protein, 20 aa, Mycobacterium tuberculosis
EADLNYWRAIMADPPEPLEL

SEQ ID NO: 1510477 - protein, 21 aa, Mycobacterium tuberculosis
EAEHQAIISDVLTASDFWGGA

SEQ ID NO: 1510478 - protein, 17 aa, Mycobacterium tuberculosis
EALAPYGLGTAYVNFTA

SEQ ID NO: 1510479 - protein, 23 aa, Mycobacterium tuberculosis
EAVYEQMWAADVAAMLGYHGEAS

SEQ ID NO: 1510480 - protein, 24 aa, Mycobacterium tuberculosis
EEDLRGWLLGLTYTVSGEGMMAAT

SEQ ID NO: 1510481 - protein, 36 aa, Mycobacterium tuberculosis; identical to SEQ ID NO: 217491

SEQ ID NO: 1510482 - protein, 20 aa, Mycobacterium tuberculosis
EGYDMFMAMLDGMKEESVGF

SEQ ID NO: 1510483 - protein, 21 aa, Mycobacterium tuberculosis
EILRLLLGHPAYADGRLRIGA

SEQ ID NO: 1510484 - protein, 19 aa, Mycobacterium tuberculosis
EINSARLYVGAGLAPMLDA

SEQ ID NO: 1510485 - protein, 18 aa, Mycobacterium tuberculosis
EISPLQPEIPYYSATSFD

SEQ ID NO: 1510486 - protein, 20 aa, Mycobacterium tuberculosis
ELAAHWLSHGRWTDGWDPHR

SEQ ID NO: 1510487 - protein, 19 aa, Mycobacterium tuberculosis
ELALASYPGFTATAPPGDG

SEQ ID NO: 1510488 - protein, 19 aa, Mycobacterium tuberculosis
ELHLGFNFRLARTEFDAAE

SEQ ID NO: 1510489 - protein, 18 aa, Mycobacterium tuberculosis
ELIARIRAVLRRGGDDDS

SEQ ID NO: 1510490 - protein, 21 aa, Mycobacterium tuberculosis
ELRPQLLDRFGLTVDVQASRD

SEQ ID NO: 1510491 - protein, 28 aa, Mycobacterium tuberculosis
ELSRAVFSKGIFPAVDPLASSSTILDPS

SEQ ID NO: 1510492 - protein, 18 aa, Mycobacterium tuberculosis
ELTLIAPASARLLVASAL

SEQ ID NO: 1510493 - protein, 17 aa, Mycobacterium tuberculosis
ELVRIVDIQLAQLGKRL

SEQ ID NO: 1510494 - protein, 21 aa, Mycobacterium tuberculosis
EMYKYLVAVSREPDHDKIRAY

SEQ ID NO: 1510495 - protein, 26 aa, Mycobacterium tuberculosis
EPGAYICVYPFVRSYEWYLLPDEERR

SEQ ID NO: 1510496 - protein, 19 aa, Mycobacterium tuberculosis
EPTTRWWPLTVNVGGDSGP

SEQ ID NO: 1510497 - protein, 20 aa, Mycobacterium tuberculosis
EREFPSFQAMLDLTIAAAPH

SEQ ID NO: 1510498 - protein, 17 aa, Mycobacterium tuberculosis
ERLLLSYAAELARRRRA

SEQ ID NO: 1510499 - protein, 24 aa, Mycobacterium tuberculosis
ERVRRIYYYVRDVPYDVLASFRYL

SEQ ID NO: 1510500 - protein, 24 aa, Mycobacterium tuberculosis
ERWKETAFQYGWLLATADSDRYGG

SEQ ID NO: 1510501 - protein, 19 aa, Mycobacterium tuberculosis
ETLVYMAFYERCGAVFCRN

SEQ ID NO: 1510502 - protein, 23 aa, Mycobacterium tuberculosis
EVEALQLEYTWIKEFDPRFNVRY

SEQ ID NO: 1510503 - protein, 26 aa, Mycobacterium tuberculosis
EVIRVRGLTFRYPKAAEPAVRGMEFT

SEQ ID NO: 1510504 - protein, 23 aa, Mycobacterium tuberculosis
EVTTIVVLRHAPPAPWIPVDQRG

SEQ ID NO: 1510505 - protein, 19 aa, Mycobacterium tuberculosis
EVVTDMWGRPRVRLTGAIA

SEQ ID NO: 1510506 - protein, 18 aa, Mycobacterium tuberculosis
EYPLLPDELAEALAGFIA

SEQ ID NO: 1510507 - protein, 18 aa, Mycobacterium tuberculosis
FAAYGEWMATPPPTWEDI

SEQ ID NO: 1510508 - protein, 19 aa, Mycobacterium tuberculosis
FAQKLGWTGVPVSSSYAAC

SEQ ID NO: 1510509 - protein, 24 aa, Mycobacterium tuberculosis
FDYSTPLLKLLLVRAAHATELPYV

SEQ ID NO: 1510510 - protein, 20 aa, Mycobacterium tuberculosis
FEMAATVDYLFGYDATAGVM

SEQ ID NO: 1510511 - protein, 25 aa, Mycobacterium tuberculosis
FGTPDTWVLWNLTGGPRGGVHVTDV

SEQ ID NO: 1510512 - protein, 17 aa, Mycobacterium tuberculosis
FGVPLVLTYATLGAPFA

SEQ ID NO: 1510513 - protein, 18 aa, Mycobacterium tuberculosis
FHLRDLAVTFRFGEEVTA

SEQ ID NO: 1510514 - protein, 17 aa, Mycobacterium tuberculosis
FPDYGEDVYYSVSSVAT

SEQ ID NO: 1510515 - protein, 17 aa, Mycobacterium tuberculosis
FPLALRPNPDAEPDRRG

SEQ ID NO: 1510516 - protein, 22 aa, Mycobacterium tuberculosis
FPQAFTHLALINAVVHVIRAEE

SEQ ID NO: 1510517 - protein, 27 aa, Mycobacterium tuberculosis
FRSADLADLFMLIFTSGTSGDPKAVKC

SEQ ID NO: 1510518 - protein, 17 aa, Mycobacterium tuberculosis
FTLPNVVIQPWSLGGIS

SEQ ID NO: 1510519 - protein, 28 aa, Mycobacterium tuberculosis
FTSDIKNLLPMLAVFKPTVVVSVPRVFE

SEQ ID NO: 1510520 - protein, 31 aa, Mycobacterium tuberculosis; identical to SEQ ID NO: 218151

SEQ ID NO: 1510521 - protein, 25 aa, Mycobacterium tuberculosis
GAKEQLGILARLAGAALVAKEDAVP

SEQ ID NO: 1510522 - protein, 19 aa, Mycobacterium tuberculosis
GAQRFFAAIPTWDEAHGPV

SEQ ID NO: 1510523 - protein, 24 aa, Mycobacterium tuberculosis
GAVSAWVELHARFGRLPFETLFEP

SEQ ID NO: 1510524 - protein, 37 aa, Mycobacterium tuberculosis; identical to SEQ ID NO: 218246

SEQ ID NO: 1510525 - protein, 32 aa, Mycobacterium tuberculosis; identical to SEQ ID NO: 225048

SEQ ID NO: 1510526 - protein, 22 aa, Mycobacterium tuberculosis
GDCALNRGVFADAYGVVGAVGE

SEQ ID NO: 1510527 - protein, 24 aa, Mycobacterium tuberculosis
GDQPGKWSLMAQGVYAPAIPRRKS

SEQ ID NO: 1510528 - protein, 30 aa, Mycobacterium tuberculosis; identical to SEQ ID NO: 114693

SEQ ID NO: 1510529 - protein, 23 aa, Mycobacterium tuberculosis
GFANLGNYNIGFGNAGDFNQGFA

SEQ ID NO: 1510530 - protein, 25 aa, Mycobacterium tuberculosis
GFDIASLWPVKPLLSLSALETHFAI

SEQ ID NO: 1510531 - protein, 26 aa, Mycobacterium tuberculosis
GFPIAKIAAKLAIGYTLDEIVNDITG

SEQ ID NO: 1510532 - protein, 22 aa, Mycobacterium tuberculosis
GFVAHRGMTVLPLAKSASGGEL

SEQ ID NO: 1510533 - protein, 32 aa, Mycobacterium tuberculosis; identical to SEQ ID NO: 218383

SEQ ID NO: 1510534 - protein, 24 aa, Mycobacterium tuberculosis
GGGATPLLVFYHGGGWTLGDLDTH

SEQ ID NO: 1510535 - protein, 24 aa, Mycobacterium tuberculosis
GGNHAFYLAIPPKSFPVVCEQLHK

SEQ ID NO: 1510536 - protein, 21 aa, Mycobacterium tuberculosis
GGVRALNPLFGTENLRRIEPL

SEQ ID NO: 1510537 - protein, 25 aa, Mycobacterium tuberculosis
GHFNAVELILCFNQLAYSAFAPAVL

SEQ ID NO: 1510538 - protein, 18 aa, Mycobacterium tuberculosis
GHLWQWVGTNIGRYHSYP

SEQ ID NO: 1510539 - protein, 17 aa, Mycobacterium tuberculosis
GIAPSATHRRSIDLSYV

SEQ ID NO: 1510540 - protein, 23 aa, Mycobacterium tuberculosis
GIGREMHVIVGQGKLEEILQSRP

SEQ ID NO: 1510541 - protein, 18 aa, Mycobacterium tuberculosis
GLCLDVCTGGELAVALHA

SEQ ID NO: 1510542 - protein, 22 aa, Mycobacterium tuberculosis
GLIAPLRPDRYLRIVAAMRREG

SEQ ID NO: 1510543 - protein, 34 aa, Mycobacterium tuberculosis; identical to SEQ ID NO: 218586

SEQ ID NO: 1510544 - protein, 26 aa, Mycobacterium tuberculosis
GMRREQPLPLGLRRLLTDLHNAGAAV

SEQ ID NO: 1510545 - protein, 25 aa, Mycobacterium tuberculosis
GPGDYFGEIGVLFHLPRSATVRARS

SEQ ID NO: 1510546 - protein, 19 aa, Mycobacterium tuberculosis
GPGVLQHPDLVILRGRTFG

SEQ ID NO: 1510547 - protein, 21 aa, Mycobacterium tuberculosis
GPLAAFVHALADVGFDVAVLD

SEQ ID NO: 1510548 - protein, 30 aa, Mycobacterium tuberculosis; identical to SEQ ID NO: 218703

SEQ ID NO: 1510549 - protein, 20 aa, Mycobacterium tuberculosis
GQAPAALLGGDGLIPAELVA

SEQ ID NO: 1510550 - protein, 26 aa, Mycobacterium tuberculosis
GQEVWTSQMIVAPAFVDAAAKDLATI

SEQ ID NO: 1510551 - protein, 19 aa, Mycobacterium tuberculosis
GQYIGIGLLVDGRWRWRSY

SEQ ID NO: 1510552 - protein, 25 aa, Mycobacterium tuberculosis
GRRRPVAGLHWPWVARVGTVVMSWR

SEQ ID NO: 1510553 - protein, 25 aa, Mycobacterium tuberculosis
GRRVTEIALVFRRAPHLPFDATMTD

SEQ ID NO: 1510554 - protein, 26 aa, Mycobacterium tuberculosis
GSAPMLAAAVAWDGLAAELGSAASSF

SEQ ID NO: 1510555 - protein, 28 aa, Mycobacterium tuberculosis
GTGAPEVHRWWTSLTSEERQRLIAEHPE

SEQ ID NO: 1510556 - protein, 22 aa, Mycobacterium tuberculosis
GVARFMPVYPTEKAASKAIGRL

SEQ ID NO: 1510557 - protein, 18 aa, Mycobacterium tuberculosis
GVEPPVALILQGASLHDL

SEQ ID NO: 1510558 - protein, 20 aa, Mycobacterium tuberculosis
GVLAFRHIFLTLRPGEDTRP

SEQ ID NO: 1510559 - protein, 23 aa, Mycobacterium tuberculosis
GVPSLPFRLIHIADTYTPIAPAD

SEQ ID NO: 1510560 - protein, 20 aa, Mycobacterium tuberculosis
GVTQGVVPDGLAAAALSPAV

SEQ ID NO: 1510561 - protein, 20 aa, Mycobacterium tuberculosis
GVVPDALTVLVRLLASLHDD

SEQ ID NO: 1510562 - protein, 17 aa, Mycobacterium tuberculosis
GWYGSALVVADRWFPSL

SEQ ID NO: 1510563 - protein, 25 aa, Mycobacterium tuberculosis
GYAPNRTGWLLPFASELVTSAQARR

SEQ ID NO: 1510564 - protein, 17 aa, Mycobacterium tuberculosis
GYRLSVDYAVRITSRGL

SEQ ID NO: 1510565 - protein, 17 aa, Mycobacterium tuberculosis
HADALLALRQLGQRPRV

SEQ ID NO: 1510566 - protein, 19 aa, Mycobacterium tuberculosis
HAFEELRMLSLLPSRATTL

SEQ ID NO: 1510567 - protein, 17 aa, Mycobacterium tuberculosis
HATFDALLHNFYGPTET

SEQ ID NO: 1510568 - protein, 17 aa, Mycobacterium tuberculosis
HDPAGLCDVKAVWRSGT

SEQ ID NO: 1510569 - protein, 25 aa, Mycobacterium tuberculosis
HDVGLAILGPLRELDEVAYLRFASV

SEQ ID NO: 1510570 - protein, 25 aa, Mycobacterium tuberculosis
HGSQGIRLHAPLPAAGKLSVVTEVA

SEQ ID NO: 1510571 - protein, 18 aa, Mycobacterium tuberculosis
HKVPRRLLKAARLGLIDF

SEQ ID NO: 1510572 - protein, 19 aa, Mycobacterium tuberculosis
HLITKPVFDALFAGHDFAS

SEQ ID NO: 1510573 - protein, 22 aa, Mycobacterium tuberculosis
HLKGHFATMRHAASHWRGLSKA

SEQ ID NO: 1510574 - protein, 20 aa, Mycobacterium tuberculosis
HPDIVLPTHPNGMTFTAAGP

SEQ ID NO: 1510575 - protein, 25 aa, Mycobacterium tuberculosis
HPGLLRFTVGLAQITSLLLAGDVAP

SEQ ID NO: 1510576 - protein, 20 aa, Mycobacterium tuberculosis
HPPPDLTALGLAAPRVSPPA

SEQ ID NO: 1510577 - protein, 29 aa, Mycobacterium tuberculosis
HSMNHVLAEMKLLRPLLSAGDYLVVEDSN

SEQ ID NO: 1510578 - protein, 24 aa, Mycobacterium tuberculosis
HTRRLRFGLAAPLPRAGTQMRAFA

SEQ ID NO: 1510579 - protein, 18 aa, Mycobacterium tuberculosis
IAARHLLDPMPRGELSYG

SEQ ID NO: 1510580 - protein, 21 aa, Mycobacterium tuberculosis
IALIEDGLPVIVVMPSPKGSA

SEQ ID NO: 1510581 - protein, 22 aa, Mycobacterium tuberculosis
IDHLRHLGRIPATIRYTTQGLG

SEQ ID NO: 1510582 - protein, 18 aa, Mycobacterium tuberculosis
IDSTLFHSLPVDSRDRYL

SEQ ID NO: 1510583 - protein, 27 aa, Mycobacterium tuberculosis
IGLGNLGSYNFGFGNAGDFNLGFANTG

SEQ ID NO: 1510584 - protein, 26 aa, Mycobacterium tuberculosis
IGVNFIDTYFRSGQYPRELPFVIGSE

SEQ ID NO: 1510585 - protein, 20 aa, Mycobacterium tuberculosis
IITGGLGGLGLFLAEKMAAA

SEQ ID NO: 1510586 - protein, 20 aa, Mycobacterium tuberculosis
IKATLTFRDPKELRFFTRTD

SEQ ID NO: 1510587 - protein, 26 aa, Mycobacterium tuberculosis
IKDAQTPTLLFPFAAPRVVGDLSEAG

SEQ ID NO: 1510588 - protein, 22 aa, Mycobacterium tuberculosis
ILTCRLIDRPLRPSFVDGLRNE

SEQ ID NO: 1510589 - protein, 17 aa, Mycobacterium tuberculosis
INGGYFCRGLPSDFDRA

SEQ ID NO: 1510590 - protein, 25 aa, Mycobacterium tuberculosis
IPPVDIPAIVLDRILLDLHADTTIG

SEQ ID NO: 1510591 - protein, 32 aa, Mycobacterium tuberculosis; identical to SEQ ID NO: 215323

SEQ ID NO: 1510592 - protein, 24 aa, Mycobacterium tuberculosis
IQALNRDFTLPGERIHVVFRSDES

SEQ ID NO: 1510593 - protein, 17 aa, Mycobacterium tuberculosis
IREFGLLQPIVVRSLAG

SEQ ID NO: 1510594 - protein, 21 aa, Mycobacterium tuberculosis
IRWSLDLLRRRFAKVIWVPGN

SEQ ID NO: 1510595 - protein, 18 aa, Mycobacterium tuberculosis
ITLYSPLRHWNAGANTRV

SEQ ID NO: 1510596 - protein, 29 aa, Mycobacterium tuberculosis
ITSRGLYVHSAPWALPALGLENVSHGCIS

SEQ ID NO: 1510597 - protein, 20 aa, Mycobacterium tuberculosis
IVMPARLPNRIHPFVQEIVP

SEQ ID NO: 1510598 - protein, 17 aa, Mycobacterium tuberculosis
KAFGHDIGYRIAHHADL

SEQ ID NO: 1510599 - protein, 22 aa, Mycobacterium tuberculosis
KAGRTWWVPNEHKPWPLRAAEI

SEQ ID NO: 1510600 - protein, 23 aa, Mycobacterium tuberculosis
KDGIPEVWPFAPAKHRAMLANLH

SEQ ID NO: 1510601 - protein, 26 aa, Mycobacterium tuberculosis
KEAIAIDPQHRLLLETSWEAMEHGGL

SEQ ID NO: 1510602 - protein, 24 aa, Mycobacterium tuberculosis
KETLAFFAGIGIPIAEIWGMSELS

SEQ ID NO: 1510603 - protein, 26 aa, Mycobacterium tuberculosis
KEWAQLLMVAVRVASLPGLLSTTTVF

SEQ ID NO: 1510604 - protein, 18 aa, Mycobacterium tuberculosis
KGFKSFAAPTTLRFEPGI

SEQ ID NO: 1510605 - protein, 24 aa, Mycobacterium tuberculosis
KHTVARLIGAPPGYVGYEAGGQLT

SEQ ID NO: 1510606 - protein, 18 aa, Mycobacterium tuberculosis
KLEGDAAFFWAPGGNTSV

SEQ ID NO: 1510607 - protein, 20 aa, Mycobacterium tuberculosis
LAAAVEWPMAGTPAWCDLDD

SEQ ID NO: 1510608 - protein, 24 aa, Mycobacterium tuberculosis
LAADIPLAVDHFRYFAAAIRAQEG

SEQ ID NO: 1510609 - protein, 17 aa, Mycobacterium tuberculosis
LAALRRVAAGADVLTFD

SEQ ID NO: 1510610 - protein, 17 aa, Mycobacterium tuberculosis
LAAYQLLRVDGGEPVLL

SEQ ID NO: 1510611 - protein, 17 aa, Mycobacterium tuberculosis
LADRTPASFIAFDLLAL

SEQ ID NO: 1510612 - protein, 27 aa, Mycobacterium tuberculosis
LADYRGRRVIVYFYPAASTPGCTKQAC

SEQ ID NO: 1510613 - protein, 32 aa, Mycobacterium tuberculosis; identical to SEQ ID NO: 219853

SEQ ID NO: 1510614 - protein, 19 aa, Mycobacterium tuberculosis
LANAVRALAARLGIPAQVA

SEQ ID NO: 1510615 - protein, 25 aa, Mycobacterium tuberculosis
LAPGARLVFNAFLANGDYAPDQAAR

SEQ ID NO: 1510616 - protein, 17 aa, Mycobacterium tuberculosis
LARGGVPVGWEVASALG

SEQ ID NO: 1510617 - protein, 24 aa, Mycobacterium tuberculosis
LARLEARIVLRLLLDRTSVIEAAD

SEQ ID NO: 1510618 - protein, 25 aa, Mycobacterium tuberculosis
LASAPRPAPFRLRVVKRHTLGYDGT

SEQ ID NO: 1510619 - protein, 19 aa, Mycobacterium tuberculosis
LCERAELAAHWLSHGRWTD

SEQ ID NO: 1510620 - protein, 17 aa, Mycobacterium tuberculosis
LDCGALSEWRATLIVRE

SEQ ID NO: 1510621 - protein, 29 aa, Mycobacterium tuberculosis
LDDVLRRAVRLLAQLTRQVAVVQYPTLST

SEQ ID NO: 1510622 - protein, 28 aa, Mycobacterium tuberculosis
LDELRRLIPPWVTLGSRLAALPKPKRDY

SEQ ID NO: 1510623 - protein, 21 aa, Mycobacterium tuberculosis
LDNGNWVWRYDAIRTFGDFAG

SEQ ID NO: 1510624 - protein, 25 aa, Mycobacterium tuberculosis
LDRLEDIWSTFTKLAPKQLIVDENL

SEQ ID NO: 1510625 - protein, 25 aa, Mycobacterium tuberculosis
LDWDDELLSLFSIPRAMLPEIASSA

SEQ ID NO: 1510626 - protein, 34 aa, Mycobacterium tuberculosis; identical to SEQ ID NO: 220021

SEQ ID NO: 1510627 - protein, 35 aa, Mycobacterium tuberculosis; identical to SEQ ID NO: 220039

SEQ ID NO: 1510628 - protein, 21 aa, Mycobacterium tuberculosis
LETLLTRLNLPDDVPIEAKMV

SEQ ID NO: 1510629 - protein, 20 aa, Mycobacterium tuberculosis
LGGLALKWRWRQRVGSWKGR

SEQ ID NO: 1510630 - protein, 17 aa, Mycobacterium tuberculosis
LGIGPAAARRLAAELLN

SEQ ID NO: 1510631 - protein, 30 aa, Mycobacterium tuberculosis; identical to SEQ ID NO: 220100

SEQ ID NO: 1510632 - protein, 20 aa, Mycobacterium tuberculosis
LGLLTRLLKGISALGGERTS

SEQ ID NO: 1510633 - protein, 18 aa, Mycobacterium tuberculosis
LGLPLAQELSAYLRSLDP

SEQ ID NO: 1510634 - protein, 31 aa, Mycobacterium tuberculosis; identical to SEQ ID NO: 220126

SEQ ID NO: 1510635 - protein, 22 aa, Mycobacterium tuberculosis
LHAPTRLALLTGLAPHQVTDDD

SEQ ID NO: 1510636 - protein, 27 aa, Mycobacterium tuberculosis
LHEVRIMLDQYWPSVPHVLIEPGVRTG

SEQ ID NO: 1510637 - protein, 36 aa, Mycobacterium tuberculosis
LLDAEWLVHLLECGLLRGWLIPPADIKAARDVIRYR

SEQ ID NO: 1510638 - protein, 28 aa, Mycobacterium tuberculosis
LLSSDELIGLLARLGYRFAPTQIPGTVD

SEQ ID NO: 1510639 - protein, 18 aa, Mycobacterium tuberculosis
LMEALRMERSQVAVLAAA

SEQ ID NO: 1510640 - protein, 19 aa, Mycobacterium tuberculosis
LNRAPTLHRLGIQAFEPML

SEQ ID NO: 1510641 - protein, 21 aa, Mycobacterium tuberculosis
LPGYWQCTIPLGPDPDDEGDI

SEQ ID NO: 1510642 - protein, 18 aa, Mycobacterium tuberculosis
LPLAERVDWLYAKASQHA

SEQ ID NO: 1510643 - protein, 21 aa, Mycobacterium tuberculosis
LPPVAEPPPPAAPPVAEPPPP

SEQ ID NO: 1510644 - protein, 29 aa, Mycobacterium tuberculosis
LPREEWPDRLRRLLSKQVGLILRRTIDTD

SEQ ID NO: 1510645 - protein, 18 aa, Mycobacterium tuberculosis
LQPEIPYYSATSFDPREE

SEQ ID NO: 1510646 - protein, 20 aa, Mycobacterium tuberculosis
LRALFINATLKRSPELSHTD

SEQ ID NO: 1510647 - protein, 35 aa, Mycobacterium tuberculosis; identical to SEQ ID NO: 225317

SEQ ID NO: 1510648 - protein, 18 aa, Mycobacterium tuberculosis
LRLVDLCERLGLAKSTTR

SEQ ID NO: 1510649 - protein, 18 aa, Mycobacterium tuberculosis
LRQKDPAVTARRRLRMIC

SEQ ID NO: 1510650 - protein, 21 aa, Mycobacterium tuberculosis
LSRYVDAIVWRTFGQERLDAM

SEQ ID NO: 1510651 - protein, 20 aa, Mycobacterium tuberculosis
LTIQDLRRIAKRRTPRAAFD

SEQ ID NO: 1510652 - protein, 29 aa, Mycobacterium tuberculosis
LTTRVIDLIMPIGKGQRALIVSPPKAGKT

SEQ ID NO: 1510653 - protein, 25 aa, Mycobacterium tuberculosis
LVAGDVRLLLPMPADWSYAEAAAIS

SEQ ID NO: 1510654 - protein, 25 aa, Mycobacterium tuberculosis
LVARTRSISLPGMPFRMPADYHNAS

SEQ ID NO: 1510655 - protein, 18 aa, Mycobacterium tuberculosis
LVLTAHVLAMDPASWRIV

SEQ ID NO: 1510656 - protein, 18 aa, Mycobacterium tuberculosis
LVLVKEIPMYSTCEHHLV

SEQ ID NO: 1510657 - protein, 17 aa, Mycobacterium tuberculosis
LVMAAAVADFRPAQVAT

SEQ ID NO: 1510658 - protein, 20 aa, Mycobacterium tuberculosis
LVSEFVCRLLNYMDDNGFDT

SEQ ID NO: 1510659 - protein, 20 aa, Mycobacterium tuberculosis
LWEHWGKPEIVWYPGGHTGF

SEQ ID NO: 1510660 - protein, 17 aa, Mycobacterium tuberculosis
MASLRGLLKFRTGVRPP

SEQ ID NO: 1510661 - protein, 19 aa, Mycobacterium tuberculosis
MDQLFRTVAGLGSKSDSAG

SEQ ID NO: 1510662 - protein, 38 aa, Mycobacterium tuberculosis; identical to SEQ ID NO: 220643

SEQ ID NO: 1510663 - protein, 27 aa, Mycobacterium tuberculosis
MHEPSLMQNICFLYHLVGGGTGVWHVP

SEQ ID NO: 1510664 - protein, 20 aa, Mycobacterium tuberculosis
MKLARNMLTFVSYAAAAEAQ

SEQ ID NO: 1510665 - protein, 18 aa, Mycobacterium tuberculosis
MLTLQPVTAHRIMTGAPV

SEQ ID NO: 1510666 - protein, 17 aa, Mycobacterium tuberculosis
MRALTGRSWRAGLRQRA

SEQ ID NO: 1510667 - protein, 26 aa, Mycobacterium tuberculosis
MRPMNPPSGFLRRTPTRRFRDRRDAG

SEQ ID NO: 1510668 - protein, 25 aa, Mycobacterium tuberculosis
MRQAAVQLAVYRLAWAALRGCPTSS

SEQ ID NO: 1510669 - protein, 17 aa, Mycobacterium tuberculosis
MSDVIRLASHANHYLRI

SEQ ID NO: 1510670 - protein, 24 aa, Mycobacterium tuberculosis
MSVGPWQGIAAWDVSTGEPIAPWP

SEQ ID NO: 1510671 - protein, 26 aa, Mycobacterium tuberculosis
MVELLPRFETITYRELWARAGTLATA

SEQ ID NO: 1510672 - protein, 22 aa, Mycobacterium tuberculosis
NATLRYLMFSVFSVSPGALGDQ

SEQ ID NO: 1510673 - protein, 19 aa, Mycobacterium tuberculosis
NDPLRFQPRWKELFPTARQ

SEQ ID NO: 1510674 - protein, 21 aa, Mycobacterium tuberculosis
NDTLFLSTGLRRPGDQPGKWS

SEQ ID NO: 1510675 - protein, 21 aa, Mycobacterium tuberculosis
NFYALDRLWGDCPVVPVDLSA

SEQ ID NO: 1510676 - protein, 23 aa, Mycobacterium tuberculosis
NGGSARILLLVPSISLLSQTLRE

SEQ ID NO: 1510677 - protein, 27 aa, Mycobacterium tuberculosis
NGLAAELLRRLPFELTAGQREVLDVLS

SEQ ID NO: 1510678 - protein, 25 aa, Mycobacterium tuberculosis
NHRKRIGELWARFSAVAADNPHAWI

SEQ ID NO: 1510679 - protein, 28 aa, Mycobacterium tuberculosis
NHYQKLTGYENLRFFASLYAGATADPMQ

SEQ ID NO: 1510680 - protein, 27 aa, Mycobacterium tuberculosis
NLDRPAYVYPIFEQALRIAYGESIENH

SEQ ID NO: 1510681 - protein, 18 aa, Mycobacterium tuberculosis
NMPRPLVAVAAILAPLMQ

SEQ ID NO: 1510682 - protein, 22 aa, Mycobacterium tuberculosis
NNDFKPGFSTALMNKDLGLAMD

SEQ ID NO: 1510683 - protein, 25 aa, Mycobacterium tuberculosis
NPSRLAALYGLQLAHESQCCQMHNL

SEQ ID NO: 1510684 - protein, 21 aa, Mycobacterium tuberculosis
NTGIALAMVCAARGYRCVLTM

SEQ ID NO: 1510685 - protein, 29 aa, Mycobacterium tuberculosis
NVTDMAHFFYIHFGLPTYFKNVFEGHIAS

SEQ ID NO: 1510686 - protein, 25 aa, Mycobacterium tuberculosis
PAELACALGLFPPTAEQAAVIAAPP

SEQ ID NO: 1510687 - protein, 27 aa, Mycobacterium tuberculosis
PAHMIPRHVTLLDRIPFTDSGKIDRAE

SEQ ID NO: 1510688 - protein, 25 aa, Mycobacterium tuberculosis
PAPDTMTYLTALLPVAQGVSVYAAL

SEQ ID NO: 1510689 - protein, 22 aa, Mycobacterium tuberculosis
PARGSRHLGFAKALVYEMPHTL

SEQ ID NO: 1510690 - protein, 18 aa, Mycobacterium tuberculosis
PAVLAAIPAGYRALVVDN

SEQ ID NO: 1510691 - protein, 18 aa, Mycobacterium tuberculosis
PAVTARRRLRMICHGLGH

SEQ ID NO: 1510692 - protein, 26 aa, Mycobacterium tuberculosis
PDGARELIRAFWPGALSLVVVQAPSL

SEQ ID NO: 1510693 - protein, 27 aa, Mycobacterium tuberculosis
PDLIDPALLRPGRLERLVFVEPPDAAA

SEQ ID NO: 1510694 - protein, 22 aa, Mycobacterium tuberculosis
PDVKPPTWWHSLPTDRPIIYAT

SEQ ID NO: 1510695 - protein, 19 aa, Mycobacterium tuberculosis
PECPDWLPPGAKDMWGRVV

SEQ ID NO: 1510696 - protein, 26 aa, Mycobacterium tuberculosis
PECQQAVRFGLFHLLQASARAERRAI

SEQ ID NO: 1510697 - protein, 19 aa, Mycobacterium tuberculosis
PEETLRWLYEMMVVTRELD

SEQ ID NO: 1510698 - protein, 26 aa, Mycobacterium tuberculosis
PELISRWAAYWPPAGAEALFRWLSER

SEQ ID NO: 1510699 - protein, 20 aa, Mycobacterium tuberculosis
PFYIMDEVEAALDDVNLRRL

SEQ ID NO: 1510700 - protein, 24 aa, Mycobacterium tuberculosis
PGGIWRDGVYAHGDYPRSFLDAAG

SEQ ID NO: 1510701 - protein, 22 aa, Mycobacterium tuberculosis
PGKKITRLSLLSGGEKALTAVA

SEQ ID NO: 1510702 - protein, 19 aa, Mycobacterium tuberculosis
PGLLAELRRRAEARHPPVV

SEQ ID NO: 1510703 - protein, 32 aa, Mycobacterium tuberculosis; identical to SEQ ID NO: 221231

SEQ ID NO: 1510704 - protein, 20 aa, Mycobacterium tuberculosis
PGRPPLMFRAVRRTDSTGTR

SEQ ID NO: 1510705 - protein, 17 aa, Mycobacterium tuberculosis
PGTRMRVALSALTMAEW

SEQ ID NO: 1510706 - protein, 25 aa, Mycobacterium tuberculosis
PGTTRLLLRAVGDWLVRPGAQLQAV

SEQ ID NO: 1510707 - protein, 18 aa, Mycobacterium tuberculosis
PHALSMLRGFNLMKQLEE

SEQ ID NO: 1510708 - protein, 19 aa, Mycobacterium tuberculosis
PHHQLATTGGWITRKRKDG

SEQ ID NO: 1510709 - protein, 19 aa, Mycobacterium tuberculosis
PIAVKEAVLPFHRFRRADG

SEQ ID NO: 1510710 - protein, 23 aa, Mycobacterium tuberculosis
PKGLWEWIRLRRLGRREKFGKPG

SEQ ID NO: 1510711 - protein, 23 aa, Mycobacterium tuberculosis
PKPSWPWVRTLLHSIYDQPDAES

SEQ ID NO: 1510712 - protein, 19 aa, Mycobacterium tuberculosis
PLCLGIDPHPELLRGWDLA

SEQ ID NO: 1510713 - protein, 20 aa, Mycobacterium tuberculosis
PLDRLIAFGRERMRFVHAHH

SEQ ID NO: 1510714 - protein, 17 aa, Mycobacterium tuberculosis
PLHASSMYSILGMCQSV

SEQ ID NO: 1510715 - protein, 19 aa, Mycobacterium tuberculosis
PLLADPPVLHLYDDRLLYL

SEQ ID NO: 1510716 - protein, 26 aa, Mycobacterium tuberculosis
PLNRDHPLWEMYFVEGLANHRIAVVA

SEQ ID NO: 1510717 - protein, 17 aa, Mycobacterium tuberculosis
PLRMLRAARFVSQLGFA

SEQ ID NO: 1510718 - protein, 22 aa, Mycobacterium tuberculosis
PLTTILDPSLPLTVTEWDEWGN

SEQ ID NO: 1510719 - protein, 17 aa, Mycobacterium tuberculosis
PLVSYLNNALKAKELFS

SEQ ID NO: 1510720 - protein, 17 aa, Mycobacterium tuberculosis
PLYCCANGKALLAALPP

SEQ ID NO: 1510721 - protein, 18 aa, Mycobacterium tuberculosis
PNVWPRNTTRDEVGVVCI

SEQ ID NO: 1510722 - protein, 25 aa, Mycobacterium tuberculosis
PPAAPPVAEPPPPVAAPAPPGAPEP

SEQ ID NO: 1510723 - protein, 34 aa, Mycobacterium tuberculosis
PPKSPNAEWYLYTKDWLALLRQFAPDRVGALEVL

SEQ ID NO: 1510724 - protein, 25 aa, Mycobacterium tuberculosis
PPTDTRAYFRGECLRRFGADIAAAS

SEQ ID NO: 1510725 - protein, 24 aa, Mycobacterium tuberculosis
PQSTSWAQRWLAATGNRDYLGAFV

SEQ ID NO: 1510726 - protein, 17 aa, Mycobacterium tuberculosis
PQWHLRMQAAVQRHVEA

SEQ ID NO: 1510727 - protein, 19 aa, Mycobacterium tuberculosis
PREWRRRKPYSWLRQVLPD

SEQ ID NO: 1510728 - protein, 22 aa, Mycobacterium tuberculosis
PRKRPYHTIIPGFVTRDGAPVM

SEQ ID NO: 1510729 - protein, 44 aa, Mycobacterium tuberculosis; identical to SEQ ID NO: 163350

SEQ ID NO: 1510730 - protein, 29 aa, Mycobacterium tuberculosis
PSAWIAEGLLIYLPATAQERLFTGIDALA

SEQ ID NO: 1510731 - protein, 21 aa, Mycobacterium tuberculosis
PSEILPFTVLLSSLGVTHLTP

SEQ ID NO: 1510732 - protein, 20 aa, Mycobacterium tuberculosis
PSLHAPPSWRRDIDDYLLNL

SEQ ID NO: 1510733 - protein, 20 aa, Mycobacterium tuberculosis
PTIAVLYYRAQHLAGNTGYV

SEQ ID NO: 1510734 - protein, 19 aa, Mycobacterium tuberculosis
PTNRHPWPAPARCCRHEWR

SEQ ID NO: 1510735 - protein, 17 aa, Mycobacterium tuberculosis
PVILVVNKTDRPDARIA

SEQ ID NO: 1510736 - protein, 20 aa, Mycobacterium tuberculosis
PVLELLTSWRNPPQALRVAN

SEQ ID NO: 1510737 - protein, 19 aa, Mycobacterium tuberculosis
PVNTLPVPGLTIADLGELG

SEQ ID NO: 1510738 - protein, 34 aa, Mycobacterium tuberculosis; identical to SEQ ID NO: 221510

SEQ ID NO: 1510739 - protein, 19 aa, Mycobacterium tuberculosis
PVREPVRSLVWIRGCLHQI

SEQ ID NO: 1510740 - protein, 18 aa, Mycobacterium tuberculosis
PVVVIKNLTFDSSVAQGA

SEQ ID NO: 1510741 - protein, 17 aa, Mycobacterium tuberculosis
PVWASLIALLEDGVPSV

SEQ ID NO: 1510742 - protein, 17 aa, Mycobacterium tuberculosis
PVWTERGGPATIVPMFL

SEQ ID NO: 1510743 - protein, 17 aa, Mycobacterium tuberculosis
PVYSYARPLFLALPESA

SEQ ID NO: 1510744 - protein, 24 aa, Mycobacterium tuberculosis
PYRAAEIGLLVLATSTGFIAPGVD

SEQ ID NO: 1510745 - protein, 25 aa, Mycobacterium tuberculosis
QAAKDWLCLLEAFDAPQRSGLVRAA

SEQ ID NO: 1510746 - protein, 30 aa, Mycobacterium tuberculosis; identical to SEQ ID NO: 225452

SEQ ID NO: 1510747 - protein, 20 aa, Mycobacterium tuberculosis
QCGRRMVVQVRPDGWWARCS

SEQ ID NO: 1510748 - protein, 28 aa, Mycobacterium tuberculosis
QDAFGDKVLPLYLPSGDGLIGLLSQALY

SEQ ID NO: 1510749 - protein, 27 aa, Mycobacterium tuberculosis
QELHANEIMLLAYYIAAVNIESTYHAL

SEQ ID NO: 1510750 - protein, 18 aa, Mycobacterium tuberculosis
QFRYYVRDAPIISDAEFD

SEQ ID NO: 1510751 - protein, 21 aa, Mycobacterium tuberculosis
QIAIDLSVTTPFIPINEQMVI

SEQ ID NO: 1510752 - protein, 25 aa, Mycobacterium tuberculosis
QIDRGQGFLALVDYAHKPEALRSVL

SEQ ID NO: 1510753 - protein, 25 aa, Mycobacterium tuberculosis
QIKEQMIHWWGPIIDEYYASSEASG

SEQ ID NO: 1510754 - protein, 32 aa, Mycobacterium tuberculosis; identical to SEQ ID NO: 116847

SEQ ID NO: 1510755 - protein, 24 aa, Mycobacterium tuberculosis
QLRAHLRVVFPGVVGLFADLDSPI

SEQ ID NO: 1510756 - protein, 25 aa, Mycobacterium tuberculosis
QMEYMLPRLRGWGESMSRQAGGRAG

SEQ ID NO: 1510757 - protein, 28 aa, Mycobacterium tuberculosis
QMIDDISQLVYLHLRFHGYGDGKWTDSA

SEQ ID NO: 1510758 - protein, 25 aa, Mycobacterium tuberculosis
QQHDWSLEVIDLRSLAPLDFDTIAA

SEQ ID NO: 1510759 - protein, 24 aa, Mycobacterium tuberculosis
QQLAMTPGFLRVFGFRTAKARAAL

SEQ ID NO: 1510760 - protein, 19 aa, Mycobacterium tuberculosis
QRAFLRYGKGRHRAALNFG

SEQ ID NO: 1510761 - protein, 19 aa, Mycobacterium tuberculosis
QRAGLELLAFGGRFVEIGK

SEQ ID NO: 1510762 - protein, 19 aa, Mycobacterium tuberculosis
QRCESLRDNLWQLVDSKVA

SEQ ID NO: 1510763 - protein, 28 aa, Mycobacterium tuberculosis
QSPKETWLRLLLINAGFPRPSTQIPLLG

SEQ ID NO: 1510764 - protein, 23 aa, Mycobacterium tuberculosis
QSVPPVTLRQALLGKVMTVGDAV

SEQ ID NO: 1510765 - protein, 29 aa, Mycobacterium tuberculosis
QTVAIPGFPNFFMMLGPHSPVGNFPLTAV

SEQ ID NO: 1510766 - protein, 28 aa, Mycobacterium tuberculosis
QVARYQRLLHPWVNMAMDTVVAIEPEIV

SEQ ID NO: 1510767 - protein, 19 aa, Mycobacterium tuberculosis
QVPFVDPLTTILDPSLPLT

SEQ ID NO: 1510768 - protein, 22 aa, Mycobacterium tuberculosis
QVVAGIRRWLDSPSLMVADMFA

SEQ ID NO: 1510769 - protein, 19 aa, Mycobacterium tuberculosis
QYRDYVLMLAALDLAATVE

SEQ ID NO: 1510770 - protein, 17 aa, Mycobacterium tuberculosis
RADFLVGDRDILLGVLD

SEQ ID NO: 1510771 - protein, 17 aa, Mycobacterium tuberculosis
RAGFPRPQTQIPVYDEY

SEQ ID NO: 1510772 - protein, 22 aa, Mycobacterium tuberculosis
RAGLGWGMFPEKLAASPLADGS

SEQ ID NO: 1510773 - protein, 29 aa, Mycobacterium tuberculosis
RAIAANFRDIMITLGMFTHDALLGGEGAG

SEQ ID NO: 1510774 - protein, 18 aa, Mycobacterium tuberculosis
RAMWADHLNGLDGPTLLS

SEQ ID NO: 1510775 - protein, 21 aa, Mycobacterium tuberculosis
RAQWRMPMGPVVNLTRWMEAA

SEQ ID NO: 1510776 - protein, 26 aa, Mycobacterium tuberculosis
RATQPLSVFFFDILHRDGTDLLEAPT

SEQ ID NO: 1510777 - protein, 23 aa, Mycobacterium tuberculosis
RDETAPLLEYYRDQLKTVDAVGT

SEQ ID NO: 1510778 - protein, 18 aa, Mycobacterium tuberculosis
RDIRFEQMLLLDDETPIG

SEQ ID NO: 1510779 - protein, 22 aa, Mycobacterium tuberculosis
RDRTYFLNFDTIGSPELIMLEG

SEQ ID NO: 1510780 - protein, 29 aa, Mycobacterium tuberculosis
REAAHHRLFSHVPWLASQLLGAVEAYAMG

SEQ ID NO: 1510781 - protein, 19 aa, Mycobacterium tuberculosis
REMGMAHHRKWHKSFPLTC

SEQ ID NO: 1510782 - protein, 17 aa, Mycobacterium tuberculosis
REQPLPHGLRGLLTELH

SEQ ID NO: 1510783 - protein, 26 aa, Mycobacterium tuberculosis
RGAMHRSRLEHLVAPKFFKDTAFTYD

SEQ ID NO: 1510784 - protein, 25 aa, Mycobacterium tuberculosis
RGRDRLLVLGLARGGVPVGWEVASA

SEQ ID NO: 1510785 - protein, 17 aa, Mycobacterium tuberculosis
RGVPVAAPWDARRAREL

SEQ ID NO: 1510786 - protein, 20 aa, Mycobacterium tuberculosis
RHLLDPMPRGELSYGPLHEG

SEQ ID NO: 1510787 - protein, 21 aa, Mycobacterium tuberculosis
RHRVPVYTIAPFATGGLHKMS

SEQ ID NO: 1510788 - protein, 21 aa, Mycobacterium tuberculosis
RIAELPEHIVIVGSGFIAAEF

SEQ ID NO: 1510789 - protein, 27 aa, Mycobacterium tuberculosis
RIDTQLPNWWGPILAPALAGVGALRGS

SEQ ID NO: 1510790 - protein, 26 aa, Mycobacterium tuberculosis
RIVDIQLAQLGKRLAQRRLQLQVSLP

SEQ ID NO: 1510791 - protein, 25 aa, Mycobacterium tuberculosis
RKRRQPVTVLLKALGWTSEQIVERF

SEQ ID NO: 1510792 - protein, 33 aa, Mycobacterium tuberculosis; identical to SEQ ID NO: 222295

SEQ ID NO: 1510793 - protein, 17 aa, Mycobacterium tuberculosis
RLEGYRRLAAASSDREV

SEQ ID NO: 1510794 - protein, 20 aa, Mycobacterium tuberculosis
RLELLRRRLADRGLSSAAQD

SEQ ID NO: 1510795 - protein, 19 aa, Mycobacterium tuberculosis
RLERLVFVEPPDAAARREI

SEQ ID NO: 1510796 - protein, 20 aa, Mycobacterium tuberculosis
RLRVRLADRALTQTNPLLSV

SEQ ID NO: 1510797 - protein, 38 aa, Mycobacterium tuberculosis; identical to SEQ ID NO: 222367

SEQ ID NO: 1510798 - protein, 26 aa, Mycobacterium tuberculosis
RMYTRARFAPYVEKLLLDGARTKLTR

SEQ ID NO: 1510799 - protein, 18 aa, Mycobacterium tuberculosis
RNDWLTTMRSTTAGVAAS

SEQ ID NO: 1510800 - protein, 20 aa, Mycobacterium tuberculosis
RPRAVYRKFGLCRICLREMA

SEQ ID NO: 1510801 - protein, 18 aa, Mycobacterium tuberculosis
RPSWAPLPVQYADYSVWQ

SEQ ID NO: 1510802 - protein, 19 aa, Mycobacterium tuberculosis
RPVGVDALITALWEEWPPS

SEQ ID NO: 1510803 - protein, 25 aa, Mycobacterium tuberculosis
RRDLRCPGLLPPGCHQPVLVVGLVG

SEQ ID NO: 1510804 - protein, 23 aa, Mycobacterium tuberculosis
RRFGVSYWTVFDEWAGRASAMRD

SEQ ID NO: 1510805 - protein, 17 aa, Mycobacterium tuberculosis
RRRGAWVGWPGVNDDGA

SEQ ID NO: 1510806 - protein, 33 aa, Mycobacterium tuberculosis
RRRRKHLTLVHKTNVLTFAGGLWLRTVDEVGEC

SEQ ID NO: 1510807 - protein, 34 aa, Mycobacterium tuberculosis; identical to SEQ ID NO: 222560

SEQ ID NO: 1510808 - protein, 27 aa, Mycobacterium tuberculosis
RRYHATYMNYVGKPLAYILATPERDDD

SEQ ID NO: 1510809 - protein, 18 aa, Mycobacterium tuberculosis
RSDEVPVVVLLWSPRSEV

SEQ ID NO: 1510810 - protein, 20 aa, Mycobacterium tuberculosis
RSEMLSMLRAMLAPESLTAD

SEQ ID NO: 1510811 - protein, 27 aa, Mycobacterium tuberculosis
RSIPGVTEKWDLYLRGIELATGYSELS

SEQ ID NO: 1510812 - protein, 21 aa, Mycobacterium tuberculosis
RSRAAHMGRRYGRRLTVMADR

SEQ ID NO: 1510813 - protein, 20 aa, Mycobacterium tuberculosis
RSVPIVGNPLANLVQPNLKV

SEQ ID NO: 1510814 - protein, 18 aa, Mycobacterium tuberculosis
RTELGTYLFFVDCVGHID

SEQ ID NO: 1510815 - protein, 32 aa, Mycobacterium tuberculosis; identical to SEQ ID NO: 122352

SEQ ID NO: 1510816 - protein, 23 aa, Mycobacterium tuberculosis
RYEAWSFPDFATGVAALRTITQT

SEQ ID NO: 1510817 - protein, 23 aa, Mycobacterium tuberculosis
RYITARFLPDKAIDLVDEAASRL

SEQ ID NO: 1510818 - protein, 29 aa, Mycobacterium tuberculosis
SAAAAALAPWQQAVPGLSGLLGGAANAPA

SEQ ID NO: 1510819 - protein, 17 aa, Mycobacterium tuberculosis
SALLFPALCTPTGDPPR

SEQ ID NO: 1510820 - protein, 17 aa, Mycobacterium tuberculosis
SAQAALFHDRFVQILQE

SEQ ID NO: 1510821 - protein, 26 aa, Mycobacterium tuberculosis
SAQVPDYLMQVLARFARYLRESRSID

SEQ ID NO: 1510822 - protein, 19 aa, Mycobacterium tuberculosis
SARPLWAPDYPVGAQVRRA

SEQ ID NO: 1510823 - protein, 18 aa, Mycobacterium tuberculosis
SDEPTNRHPWPAPARCCR

SEQ ID NO: 1510824 - protein, 24 aa, Mycobacterium tuberculosis
SDGSPPYVVRWLETDHVATVIPGP

SEQ ID NO: 1510825 - protein, 27 aa, Mycobacterium tuberculosis
SDKVVRFILGLVQRYGPGLFGANQLAL

SEQ ID NO: 1510826 - protein, 18 aa, Mycobacterium tuberculosis
SDNPARYRDAAVAGIRAL

SEQ ID NO: 1510827 - protein, 27 aa, Mycobacterium tuberculosis
SDSDMFTFGYKFRPWRDVKVLADGASI

SEQ ID NO: 1510828 - protein, 23 aa, Mycobacterium tuberculosis
SEAQKRHFLPRILSGEHRWCQGF

SEQ ID NO: 1510829 - protein, 20 aa, Mycobacterium tuberculosis
SELRRHGINPHIIGGAAVAA

SEQ ID NO: 1510830 - protein, 18 aa, Mycobacterium tuberculosis
SGKSTFMRLLLAAETPTS

SEQ ID NO: 1510831 - protein, 31 aa, Mycobacterium tuberculosis
SIPMETYLRLMFLKFRYRLGYESLCREVTDS

SEQ ID NO: 1510832 - protein, 30 aa, Mycobacterium tuberculosis; identical to SEQ ID NO: 225614

SEQ ID NO: 1510833 - protein, 25 aa, Mycobacterium tuberculosis
SITVGRISYLLGLRGPAVAVDTACS

SEQ ID NO: 1510834 - protein, 21 aa, Mycobacterium tuberculosis
SLFFRQHINYVLARPKLRPIT

SEQ ID NO: 1510835 - protein, 20 aa, Mycobacterium tuberculosis
SLRRGVFHNSRRLDNGNWVW

SEQ ID NO: 1510836 - protein, 31 aa, Mycobacterium tuberculosis; identical to SEQ ID NO: 223037

SEQ ID NO: 1510837 - protein, 33 aa, Mycobacterium tuberculosis; identical to SEQ ID NO: 223088

SEQ ID NO: 1510838 - protein, 20 aa, Mycobacterium tuberculosis
SRATLRRLYRHPRSGALVAM

SEQ ID NO: 1510839 - protein, 19 aa, Mycobacterium tuberculosis
SRDLGVTEFMLLQAAVAVV

SEQ ID NO: 1510840 - protein, 18 aa, Mycobacterium tuberculosis
SRGVWQFIAPTFAAYHEP

SEQ ID NO: 1510841 - protein, 17 aa, Mycobacterium tuberculosis
SRHGSVRIATQKALTWA

SEQ ID NO: 1510842 - protein, 25 aa, Mycobacterium tuberculosis
SRKRSQSHMPPRTPPRGRCLRAPES

SEQ ID NO: 1510843 - protein, 24 aa, Mycobacterium tuberculosis
SRNTVAIFLGIKDPKHSGPCDVLY

SEQ ID NO: 1510844 - protein, 23 aa, Mycobacterium tuberculosis
SRQRPELAWFPSLAHHLQDASRG

SEQ ID NO: 1510845 - protein, 25 aa, Mycobacterium tuberculosis
SSKEWPGMLAFYRNLAMALVGDHPG

SEQ ID NO: 1510846 - protein, 22 aa, Mycobacterium tuberculosis
SSKLGGLWTAVSPHLSPLSNVS

SEQ ID NO: 1510847 - protein, 22 aa, Mycobacterium tuberculosis
SSLLAGAWSRRDTLRLTDALYV

SEQ ID NO: 1510848 - protein, 17 aa, Mycobacterium tuberculosis
SSPVPVAITPRRYRCYT

SEQ ID NO: 1510849 - protein, 26 aa, Mycobacterium tuberculosis
SSSPFACLLIGQPTLRRRMKLGVLAA

SEQ ID NO: 1510850 - protein, 24 aa, Mycobacterium tuberculosis
SSSQMRSWFNYRFDGPNAVNNIPF

SEQ ID NO: 1510851 - protein, 22 aa, Mycobacterium tuberculosis
SSTVLFLGRHVGYPVALEGALK

SEQ ID NO: 1510852 - protein, 23 aa, Mycobacterium tuberculosis
STEIAYLTRALKAPTLRESVSRL

SEQ ID NO: 1510853 - protein, 29 aa, Mycobacterium tuberculosis
STVRHLEVIALTPARLLMVVITDSGRVDQ

SEQ ID NO: 1510854 - protein, 24 aa, Mycobacterium tuberculosis
SVHRFDLFVPVFRNHLVELSAEFP

SEQ ID NO: 1510855 - protein, 17 aa, Mycobacterium tuberculosis
SVPTRRGNWWYYARTFE

SEQ ID NO: 1510856 - protein, 43 aa, Mycobacterium tuberculosis; identical to SEQ ID NO: 223250

SEQ ID NO: 1510857 - protein, 21 aa, Mycobacterium tuberculosis
TAEVTPHHLLLDDARLASYDG

SEQ ID NO: 1510858 - protein, 22 aa, Mycobacterium tuberculosis
TANTHFGGHRYHWGASAAMIRG

SEQ ID NO: 1510859 - protein, 28 aa, Mycobacterium tuberculosis
TAPGRAIPFGAFRHLISLPASGADIGRP

SEQ ID NO: 1510860 - protein, 29 aa, Mycobacterium tuberculosis
TATMEPITDSWYLTSIRAGLEPWSDGVGL

SEQ ID NO: 1510861 - protein, 25 aa, Mycobacterium tuberculosis
TCAPLTWPEGWRRWPQRVYGDTRLE

SEQ ID NO: 1510862 - protein, 18 aa, Mycobacterium tuberculosis
TGILDPYLLDMIGSPKLW

SEQ ID NO: 1510863 - protein, 23 aa, Mycobacterium tuberculosis
TGNEKVWPFLELAVPAPRGHKVP

SEQ ID NO: 1510864 - protein, 30 aa, Mycobacterium tuberculosis; identical to SEQ ID NO: 223439

SEQ ID NO: 1510865 - protein, 27 aa, Mycobacterium tuberculosis
THGALRSAWIGYWVPSAATGGGVATGA

SEQ ID NO: 1510866 - protein, 18 aa, Mycobacterium tuberculosis
THVLGVKASVNDAALTIT

SEQ ID NO: 1510867 - protein, 20 aa, Mycobacterium tuberculosis
TILPIVHAIVPFAEAPEAHR

SEQ ID NO: 1510868 - protein, 18 aa, Mycobacterium tuberculosis
TIRPAPDTMTYLTALLPV

SEQ ID NO: 1510869 - protein, 29 aa, Mycobacterium tuberculosis
TITIPEIPYRYDLSVPIDIPITGTVVATT

SEQ ID NO: 1510870 - protein, 27 aa, Mycobacterium tuberculosis
TLADGRDLLFFSLPGHVPAPVSDRRPL

SEQ ID NO: 1510871 - protein, 17 aa, Mycobacterium tuberculosis
TLAMGHAMIRAGLRLKK

SEQ ID NO: 1510872 - protein, 20 aa, Mycobacterium tuberculosis
TLLSCLGGILRPKSGAIKFD

SEQ ID NO: 1510873 - protein, 23 aa, Mycobacterium tuberculosis
TLSGFGIHPLVLDAALHAMGMVG

SEQ ID NO: 1510874 - protein, 17 aa, Mycobacterium tuberculosis
TMPPQVLRLQGHEIHLA

SEQ ID NO: 1510875 - protein, 18 aa, Mycobacterium tuberculosis
TNMSLLDRWYAAIGHELH

SEQ ID NO: 1510876 - protein, 18 aa, Mycobacterium tuberculosis
TNVLTHPGTFGLAGAAIS

SEQ ID NO: 1510877 - protein, 25 aa, Mycobacterium tuberculosis
TPATPGIDGALLFALSASSQDALRQ

SEQ ID NO: 1510878 - protein, 26 aa, Mycobacterium tuberculosis
TPGKVPSWISDIANIFNIGAGNWASA

SEQ ID NO: 1510879 - protein, 18 aa, Mycobacterium tuberculosis
TPKVPYYSATLFDPREQP

SEQ ID NO: 1510880 - protein, 17 aa, Mycobacterium tuberculosis
TRQVAVVQYPTLSTSTV

SEQ ID NO: 1510881 - protein, 24 aa, Mycobacterium tuberculosis
TRRVTRLVLVVPFEGHKDIFNLRP

SEQ ID NO: 1510882 - protein, 20 aa, Mycobacterium tuberculosis
TSALLVAYLPARSREEMFGG

SEQ ID NO: 1510883 - protein, 18 aa, Mycobacterium tuberculosis
TSMLIVALQHCGLDPSFA

SEQ ID NO: 1510884 - protein, 17 aa, Mycobacterium tuberculosis
TTGGWITRKRKDGTTEW

SEQ ID NO: 1510885 - protein, 30 aa, Mycobacterium tuberculosis; identical to SEQ ID NO: 223691

SEQ ID NO: 1510886 - protein, 21 aa, Mycobacterium tuberculosis
TTVAHKLIVIIWHVLATGRPH

SEQ ID NO: 1510887 - protein, 26 aa, Mycobacterium tuberculosis
TVDFYSNILGMPLIKALDLPGGQGQH

SEQ ID NO: 1510888 - protein, 20 aa, Mycobacterium tuberculosis
VAAHTPYLAWLVQASANSAA

SEQ ID NO: 1510889 - protein, 27 aa, Mycobacterium tuberculosis
VAAMHYPVWRQSWTGILDPYLLDMIGS

SEQ ID NO: 1510890 - protein, 23 aa, Mycobacterium tuberculosis
VADRAAVAGLFAQLSREYPPVRG

SEQ ID NO: 1510891 - protein, 23 aa, Mycobacterium tuberculosis
VADVSRALRLTGRRVMLVPTMGA

SEQ ID NO: 1510892 - protein, 25 aa, Mycobacterium tuberculosis
VAETLIEVALRFVKIRETAWRVTEL

SEQ ID NO: 1510893 - protein, 24 aa, Mycobacterium tuberculosis
VAGRYRTVRIGAHQARILLAKNPA

SEQ ID NO: 1510894 - protein, 21 aa, Mycobacterium tuberculosis
VAPLIAKYRLAGDHRPAPPET

SEQ ID NO: 1510895 - protein, 21 aa, Mycobacterium tuberculosis
VDALRKTGLLGLVLPREIGGM

SEQ ID NO: 1510896 - protein, 19 aa, Mycobacterium tuberculosis
VDAPLPAWSHRFLFYDREG

SEQ ID NO: 1510897 - protein, 17 aa, Mycobacterium tuberculosis
VDELNVIAVRYLPDERT

SEQ ID NO: 1510898 - protein, 24 aa, Mycobacterium tuberculosis
VDVPALDAVLFLNPRNSIVDVVQS

SEQ ID NO: 1510899 - protein, 23 aa, Mycobacterium tuberculosis
VEGDTVIAAVDPGWRRGATQGHS

SEQ ID NO: 1510900 - protein, 18 aa, Mycobacterium tuberculosis
VEVGWRDPFRLAVGPFPC

SEQ ID NO: 1510901 - protein, 22 aa, Mycobacterium tuberculosis
VEYLVDAVFNYPTFSEAYKNAA

SEQ ID NO: 1510902 - protein, 24 aa, Mycobacterium tuberculosis
VFQDPFTFNILRNPNPHVGFGGTG

SEQ ID NO: 1510903 - protein, 20 aa, Mycobacterium tuberculosis
VGKVVLTMPDAWAAGTVLIT

SEQ ID NO: 1510904 - protein, 25 aa, Mycobacterium tuberculosis
VGLDAFTLLPDGFTLDTVPATFDGT

SEQ ID NO: 1510905 - protein, 33 aa, Mycobacterium tuberculosis; identical to SEQ ID NO: 224022

SEQ ID NO: 1510906 - protein, 27 aa, Mycobacterium tuberculosis
VHIQGISPPLFRRPLEPAVQAAVASCR

SEQ ID NO: 1510907 - protein, 39 aa, Mycobacterium tuberculosis; identical to SEQ ID NO: 164070

SEQ ID NO: 1510908 - protein, 19 aa, Mycobacterium tuberculosis
VIPPELRPMVQLDGGRFAT

SEQ ID NO: 1510909 - protein, 23 aa, Mycobacterium tuberculosis
VKSLARPVADTVWPTPFLAHQAV

SEQ ID NO: 1510910 - protein, 17 aa, Mycobacterium tuberculosis
VLARDRVLSARGLDVLL

SEQ ID NO: 1510911 - protein, 31 aa, Mycobacterium tuberculosis; identical to SEQ ID NO: 224102

SEQ ID NO: 1510912 - protein, 19 aa, Mycobacterium tuberculosis
VLAWHDALNAADIETLVAL

SEQ ID NO: 1510913 - protein, 17 aa, Mycobacterium tuberculosis
VLGGAVALLRDLLNPDE

SEQ ID NO: 1510914 - protein, 17 aa, Mycobacterium tuberculosis
VMRQRLAAAGVAVPRYA

SEQ ID NO: 1510915 - protein, 21 aa, Mycobacterium tuberculosis
VMVPLRSAGMSRRASRRRAEE

SEQ ID NO: 1510916 - protein, 23 aa, Mycobacterium tuberculosis
VNAAVLYVFRTLVADDIPLNDGC

SEQ ID NO: 1510917 - protein, 17 aa, Mycobacterium tuberculosis
VPATVPVGILCLEFLVH

SEQ ID NO: 1510918 - protein, 36 aa, Mycobacterium tuberculosis; identical to SEQ ID NO: 224197

SEQ ID NO: 1510919 - protein, 19 aa, Mycobacterium tuberculosis
VPRTLRLDQLIRYYVDHQL

SEQ ID NO: 1510920 - protein, 26 aa, Mycobacterium tuberculosis
VPSYRGSCWIPFSLEIEGDAAGFVAE

SEQ ID NO: 1510921 - protein, 32 aa, Mycobacterium tuberculosis; identical to SEQ ID NO: 224223

SEQ ID NO: 1510922 - protein, 18 aa, Mycobacterium tuberculosis
VRGAEVVDLLAALNTGHE

SEQ ID NO: 1510923 - protein, 36 aa, Mycobacterium tuberculosis; identical to SEQ ID NO: 224246

SEQ ID NO: 1510924 - protein, 29 aa, Mycobacterium tuberculosis
VRRCGMVSPTVFWPIPRVYSGLVRIDRYE

SEQ ID NO: 1510925 - protein, 27 aa, Mycobacterium tuberculosis
VTDSMPALHMLPLADALGVLPVLATDV

SEQ ID NO: 1510926 - protein, 17 aa, Mycobacterium tuberculosis
VTEFMLLQAAVAVVLHK

SEQ ID NO: 1510927 - protein, 20 aa, Mycobacterium tuberculosis
VTHDRWFLDEVATTTWEVHD

SEQ ID NO: 1510928 - protein, 19 aa, Mycobacterium tuberculosis
VTINYRFAPDRSVAAALQH

SEQ ID NO: 1510929 - protein, 20 aa, Mycobacterium tuberculosis
VVARLRVILRRAGKGNKEPR

SEQ ID NO: 1510930 - protein, 24 aa, Mycobacterium tuberculosis
VVNDARFLVYPAMKALTLDIASMV

SEQ ID NO: 1510931 - protein, 25 aa, Mycobacterium tuberculosis
VVPSTPGDAYWLLRHAIACPDPVMY

SEQ ID NO: 1510932 - protein, 24 aa, Mycobacterium tuberculosis
VWISGPQYQAWKHTQLIIDVVPGR

SEQ ID NO: 1510933 - protein, 24 aa, Mycobacterium tuberculosis
VWLCDHFLTISPGEYAKVAGIAAD

SEQ ID NO: 1510934 - protein, 21 aa, Mycobacterium tuberculosis
WAERRRMFELPRSSWGDYDRS

SEQ ID NO: 1510935 - protein, 25 aa, Mycobacterium tuberculosis
WEDKRLGIIIAGFDRRRIPLVAEIS

SEQ ID NO: 1510936 - protein, 29 aa, Mycobacterium tuberculosis
WEWTTSPLRPWPGFVPMVYERYSQPFFGG

SEQ ID NO: 1510937 - protein, 17 aa, Mycobacterium tuberculosis
WHLRMQAAVQRHVEAAV

SEQ ID NO: 1510938 - protein, 17 aa, Mycobacterium tuberculosis
WLAVLRAQAELGVAVAD

SEQ ID NO: 1510939 - protein, 17 aa, Mycobacterium tuberculosis
WPQPQVLCTMRLARRVL

SEQ ID NO: 1510940 - protein, 18 aa, Mycobacterium tuberculosis
WSFVWRDVLLRLANDFRC

SEQ ID NO: 1510941 - protein, 17 aa, Mycobacterium tuberculosis
WVMLYQYGNPANTDSHY

SEQ ID NO: 1510942 - protein, 19 aa, Mycobacterium tuberculosis
YDPIWPRHGIRIIPGPSSL

SEQ ID NO: 1510943 - protein, 19 aa, Mycobacterium tuberculosis
YGFSRMPFGRDLAPGMLHR

SEQ ID NO: 1510944 - protein, 25 aa, Mycobacterium tuberculosis
YGRRRTFLTLLGDPTVRRIVMKRRD

SEQ ID NO: 1510945 - protein, 17 aa, Mycobacterium tuberculosis
YGWGLDLDLALRARKSG

SEQ ID NO: 1510946 - protein, 20 aa, Mycobacterium tuberculosis
YHRDLPEETLRWLYEMMVVT

SEQ ID NO: 1510947 - protein, 19 aa, Mycobacterium tuberculosis
YHWGASAAMIRGLRRTHGW

SEQ ID NO: 1510948 - protein, 18 aa, Mycobacterium tuberculosis
YIRHCREQWVTGGPLRSF

SEQ ID NO: 1510949 - protein, 29 aa, Mycobacterium tuberculosis
YNNVIQPFINWLTNLPFLQAMFSGFDPWL

SEQ ID NO: 1510950 - protein, 27 aa, Mycobacterium tuberculosis
YPLGEALLALYRWRGPLINAGVGGHGY

SEQ ID NO: 1510951 - protein, 23 aa, Mycobacterium tuberculosis
YVSMPLFHSNAVLVGWAVAAACQ

SEQ ID NO: 1510952 - protein, 21 aa, Mycobacterium tuberculosis
YVSPFHQLAGYYLIRAPRPDR

SEQ ID NO: 1510953 - protein, 17 aa, Mycobacterium tuberculosis
AADAILVPPGDGPWRLG

SEQ ID NO: 1510954 - protein, 29 aa, Mycobacterium tuberculosis
AAEAFVAAYMPFLAWLIQASADCVEMAAQ

SEQ ID NO: 1510955 - protein, 26 aa, Mycobacterium tuberculosis
AAEICDGWLPIFYSPRMAGMYNEWLD

SEQ ID NO: 1510956 - protein, 17 aa, Mycobacterium tuberculosis
AAELTGHLIFDRPPLGA

SEQ ID NO: 1510957 - protein, 25 aa, Mycobacterium tuberculosis
AAGIPMPALLRHQQWMLGPSAGSVD

SEQ ID NO: 1510958 - protein, 28 aa, Mycobacterium tuberculosis
AAIGLVKFDLLGLGMLSALHYAKDLVAE

SEQ ID NO: 1510959 - protein, 20 aa, Mycobacterium tuberculosis
AAKIAEMLRWCHEAGIELAT

SEQ ID NO: 1510960 - protein, 27 aa, Mycobacterium tuberculosis
AAMAAAAAPYAGWLSAAAARAAGAAAQ

SEQ ID NO: 1510961 - protein, 27 aa, Mycobacterium tuberculosis
AANLKCLCRLHHLLATFCGWRAQQLPD

SEQ ID NO: 1510962 - protein, 22 aa, Mycobacterium tuberculosis
AAQGLAELTLNLGVGNIGSLNL

SEQ ID NO: 1510963 - protein, 19 aa, Mycobacterium tuberculosis
AARARWANPAAWRLPGDDV

SEQ ID NO: 1510964 - protein, 17 aa, Mycobacterium tuberculosis
AARLRKLYADDGLFRST

SEQ ID NO: 1510965 - protein, 27 aa, Mycobacterium tuberculosis
AASAFQSVVWGLTVGSWIGSSAGLMAA

SEQ ID NO: 1510966 - protein, 18 aa, Mycobacterium tuberculosis
AASAWTGLAGDLGSAAAS

SEQ ID NO: 1510967 - protein, 19 aa, Mycobacterium tuberculosis
AASHHARVGRRARAARLLR

SEQ ID NO: 1510968 - protein, 28 aa, Mycobacterium tuberculosis
ADELDRHLRLPLRDVIWGADADLLDSTE

SEQ ID NO: 1510969 - protein, 21 aa, Mycobacterium tuberculosis
ADPQMLRYFASIGISLDSRLR

SEQ ID NO: 1510970 - protein, 25 aa, Mycobacterium tuberculosis
ADRRIELMIRLAGEAGLRRAEAAQA

SEQ ID NO: 1510971 - protein, 23 aa, Mycobacterium tuberculosis
AFVRFRIDGKDWPASPLPSLRMR

SEQ ID NO: 1510972 - protein, 40 aa, Mycobacterium tuberculosis; identical to SEQ ID NO: 215804

SEQ ID NO: 1510973 - protein, 19 aa, Mycobacterium tuberculosis
AGALLFTCNGRGRRMFGVA

SEQ ID NO: 1510974 - protein, 26 aa, Mycobacterium tuberculosis
AGFAVGYTLPLFPAVGADVSGGIGPI

SEQ ID NO: 1510975 - protein, 17 aa, Mycobacterium tuberculosis
AGFDPARPTAFSAEGLL

SEQ ID NO: 1510976 - protein, 34 aa, Mycobacterium tuberculosis; identical to SEQ ID NO: 224770

SEQ ID NO: 1510977 - protein, 23 aa, Mycobacterium tuberculosis
AGLDARAYRLNWPAGTVVYEIDQ

SEQ ID NO: 1510978 - protein, 25 aa, Mycobacterium tuberculosis
AGPCGMPILDDAAAWFIGRTASRSD

SEQ ID NO: 1510979 - protein, 24 aa, Mycobacterium tuberculosis
AGSLRLDLSQYRELEAFAAFASDL

SEQ ID NO: 1510980 - protein, 18 aa, Mycobacterium tuberculosis
AGSTAMPQMLRGRTQRTD

SEQ ID NO: 1510981 - protein, 17 aa, Mycobacterium tuberculosis
AGSWPYGLPELPGARDQ

SEQ ID NO: 1510982 - protein, 19 aa, Mycobacterium tuberculosis
AGWLLHAEGILRPGSVEPG

SEQ ID NO: 1510983 - protein, 19 aa, Mycobacterium tuberculosis
AIRIPATASVGPFDVTFVN

SEQ ID NO: 1510984 - protein, 19 aa, Mycobacterium tuberculosis
AIRTPGLLPNAKLVVDHFH

SEQ ID NO: 1510985 - protein, 21 aa, Mycobacterium tuberculosis
AIVDALRILLSNPAVWEKTAL

SEQ ID NO: 1510986 - protein, 21 aa, Mycobacterium tuberculosis
ALAAQLRSYWARPLPATIVMR

SEQ ID NO: 1510987 - protein, 22 aa, Mycobacterium tuberculosis
ALALPYPGVLPQGPPPPKAFGT

SEQ ID NO: 1510988 - protein, 17 aa, Mycobacterium tuberculosis
ALDDCHDGYRWLRLLGY

SEQ ID NO: 1510989 - protein, 24 aa, Mycobacterium tuberculosis
ALFRVRPVLPDPVGLLRCAGGADL

SEQ ID NO: 1510990 - protein, 26 aa, Mycobacterium tuberculosis
ALGLSTYKMVFGHRGINIPVVDHATG

SEQ ID NO: 1510991 - protein, 20 aa, Mycobacterium tuberculosis
ALHERAVLIELLDDEPDPVT

SEQ ID NO: 1510992 - protein, 31 aa, Mycobacterium tuberculosis
ALPPALDPLAPPPPDPLAPPPPDPLAVPVAA

SEQ ID NO: 1510993 - protein, 17 aa, Mycobacterium tuberculosis
ALPPTEPRVLQIRALVL

SEQ ID NO: 1510994 - protein, 18 aa, Mycobacterium tuberculosis
ALRDTHVELERLVHALPA

SEQ ID NO: 1510995 - protein, 36 aa, Mycobacterium tuberculosis; identical to SEQ ID NO: 216131

SEQ ID NO: 1510996 - protein, 18 aa, Mycobacterium tuberculosis
AMPQMLRGRTQRTDPDVA

SEQ ID NO: 1510997 - protein, 21 aa, Mycobacterium tuberculosis
ANFLSILDEGRIAIAALATGA

SEQ ID NO: 1510998 - protein, 21 aa, Mycobacterium tuberculosis
APKYRAYMRRQQGMSWNTIEH

SEQ ID NO: 1510999 - protein, 25 aa, Mycobacterium tuberculosis
AQIATWLGQYPQLLSAALTGVIAHL

SEQ ID NO: 1511000 - protein, 17 aa, Mycobacterium tuberculosis
AQPGSRLYRNGERGVWK

SEQ ID NO: 1511001 - protein, 26 aa, Mycobacterium tuberculosis
AQRRFPLPDVIWTRLFGVRLVKLLYR

SEQ ID NO: 1511002 - protein, 34 aa, Mycobacterium tuberculosis; identical to SEQ ID NO: 1390408

SEQ ID NO: 1511003 - protein, 23 aa, Mycobacterium tuberculosis
ARDSLVKTALFGSDPNWGRVLAA

SEQ ID NO: 1511004 - protein, 21 aa, Mycobacterium tuberculosis
ASPVHAATLLPFIGRLLAARY

SEQ ID NO: 1511005 - protein, 26 aa, Mycobacterium tuberculosis
ASVLAYPRVVWIAGGLLKGASLHAEV

SEQ ID NO: 1511006 - protein, 27 aa, Mycobacterium tuberculosis
ATADCELDWWLGFSSAASLLGSPGQAA

SEQ ID NO: 1511007 - protein, 26 aa, Mycobacterium tuberculosis
ATADQPLDWFCSFSSAAALVGSPGQG

SEQ ID NO: 1511008 - protein, 18 aa, Mycobacterium tuberculosis
ATQIRNLPRHLGIHSGGM

SEQ ID NO: 1511009 - protein, 26 aa, Mycobacterium tuberculosis
ATRGYRYGPAFRGLTAMWARGEEIFA

SEQ ID NO: 1511010 - protein, 17 aa, Mycobacterium tuberculosis
ATRRPVVAVLNKADLAG

SEQ ID NO: 1511011 - protein, 26 aa, Mycobacterium tuberculosis
AVHHDLHLWLPHPSDELWRALAGFQG

SEQ ID NO: 1511012 - protein, 19 aa, Mycobacterium tuberculosis
AVLPSHYEPFGLVALEAAA

SEQ ID NO: 1511013 - protein, 17 aa, Mycobacterium tuberculosis
AVMLSFGDPAVFADAIK

SEQ ID NO: 1511014 - protein, 28 aa, Mycobacterium tuberculosis
AVNVATLPFPGFPTDLQPMAIALASIAD

SEQ ID NO: 1511015 - protein, 18 aa, Mycobacterium tuberculosis
AVPYVAWMRATAASAEQA

SEQ ID NO: 1511016 - protein, 25 aa, Mycobacterium tuberculosis
AVTEWFAVDWHREIVDKWRAAGVRM

SEQ ID NO: 1511017 - protein, 19 aa, Mycobacterium tuberculosis
AYFDAVLQQQLLPTGRVDY

SEQ ID NO: 1511018 - protein, 19 aa, Mycobacterium tuberculosis
CLVALAILDTVGVSPEQAV

SEQ ID NO: 1511019 - protein, 27 aa, Mycobacterium tuberculosis
CMDNGMPILVFNLLTDGNIARAVRGEK

SEQ ID NO: 1511020 - protein, 20 aa, Mycobacterium tuberculosis
CREIRHFYHDGSMRVRTIRH

SEQ ID NO: 1511021 - protein, 19 aa, Mycobacterium tuberculosis
CRPIGYPYIVTGADGILIT

SEQ ID NO: 1511022 - protein, 17 aa, Mycobacterium tuberculosis
CTSGCALTIRLLGRTEI

SEQ ID NO: 1511023 - protein, 24 aa, Mycobacterium tuberculosis
DAGEPWTVSKLYYVHGFLRERMQM

SEQ ID NO: 1511024 - protein, 18 aa, Mycobacterium tuberculosis
DAIELFVDRARRVRSDFA

SEQ ID NO: 1511025 - protein, 29 aa, Mycobacterium tuberculosis
DALGNFLARLVFPNPMRQLRITVGLIADL

SEQ ID NO: 1511026 - protein, 21 aa, Mycobacterium tuberculosis
DAVSFTLLQDQLQSVLDTLSE

SEQ ID NO: 1511027 - protein, 17 aa, Mycobacterium tuberculosis
DEFGFFVVMLAVAGNET

SEQ ID NO: 1511028 - protein, 20 aa, Mycobacterium tuberculosis
DEPAVVVWLASGLAAETFQL

SEQ ID NO: 1511029 - protein, 18 aa, Mycobacterium tuberculosis
DEPFMLPAHIDFAALKVK

SEQ ID NO: 1511030 - protein, 25 aa, Mycobacterium tuberculosis
DETGMVNVLCTPGVWARHRKLAHTA

SEQ ID NO: 1511031 - protein, 22 aa, Mycobacterium tuberculosis
DGSYLAELLLAKGYEVHGLIRR

SEQ ID NO: 1511032 - protein, 32 aa, Mycobacterium tuberculosis; identical to SEQ ID NO: 226045

SEQ ID NO: 1511033 - protein, 17 aa, Mycobacterium tuberculosis
DILARELLGPIRGPQEV

SEQ ID NO: 1511034 - protein, 18 aa, Mycobacterium tuberculosis
DISVPSIHLGLDPAVHVG

SEQ ID NO: 1511035 - protein, 23 aa, Mycobacterium tuberculosis
DKNPLFLDEQLTRAEFQRITQDL

SEQ ID NO: 1511036 - protein, 20 aa, Mycobacterium tuberculosis
DKVNAYVAAFNQGRNTGPTE

SEQ ID NO: 1511037 - protein, 20 aa, Mycobacterium tuberculosis
DLAPEWLVAPTVVLTPEVTP

SEQ ID NO: 1511038 - protein, 28 aa, Mycobacterium tuberculosis
DLGELPGDLAWQPPLWRALVTTVGADPP

SEQ ID NO: 1511039 - protein, 18 aa, Mycobacterium tuberculosis
DPHFFTFLEIPEVLSIVD

SEQ ID NO: 1511040 - protein, 17 aa, Mycobacterium tuberculosis
DPIAANYHFAWFRELDS

SEQ ID NO: 1511041 - protein, 18 aa, Mycobacterium tuberculosis
DPRRRCAPLGAGRCLLGS

SEQ ID NO: 1511042 - protein, 22 aa, Mycobacterium tuberculosis
DPYPYYRRLRDEAPLYRNEERN

SEQ ID NO: 1511043 - protein, 20 aa, Mycobacterium tuberculosis
DRLPEPAGLPAWISQEELDH

SEQ ID NO: 1511044 - protein, 19 aa, Mycobacterium tuberculosis
DRLYIIISGKVKIGRRAPD

SEQ ID NO: 1511045 - protein, 24 aa, Mycobacterium tuberculosis
DRPVYTLSHDILFMGLTGDLFRRT

SEQ ID NO: 1511046 - protein, 33 aa, Mycobacterium tuberculosis
DRRLVFGQRRLEAARLLGWERIPVHVCHTIADV

SEQ ID NO: 1511047 - protein, 27 aa, Mycobacterium tuberculosis
DRWPDKPGRYFTVRAGSLVAWNAEQSG

SEQ ID NO: 1511048 - protein, 21 aa, Mycobacterium tuberculosis
DSRLRVLARREFAGMISVAID

SEQ ID NO: 1511049 - protein, 25 aa, Mycobacterium tuberculosis
DTDAALVGALAWAAFTAARRIGTWI

SEQ ID NO: 1511050 - protein, 33 aa, Mycobacterium tuberculosis; identical to SEQ ID NO: 113990

SEQ ID NO: 1511051 - protein, 18 aa, Mycobacterium tuberculosis
DTPYSGVAAIFRSAVEKG

SEQ ID NO: 1511052 - protein, 23 aa, Mycobacterium tuberculosis
DVLDELCLTIAPYVVGGLARRIV

SEQ ID NO: 1511053 - protein, 18 aa, Mycobacterium tuberculosis
DVMMPGMDGFGVLRRLRA

SEQ ID NO: 1511054 - protein, 19 aa, Mycobacterium tuberculosis
DVRPTVWGAVPRVWEKLKA

SEQ ID NO: 1511055 - protein, 27 aa, Mycobacterium tuberculosis
DVRQYSRWALRLRVPFTVPVEAKSLQL

SEQ ID NO: 1511056 - protein, 19 aa, Mycobacterium tuberculosis
DVSLRPRSLREFIGQPRVR

SEQ ID NO: 1511057 - protein, 18 aa, Mycobacterium tuberculosis
DYGYVILPVAVPEGVEPS

SEQ ID NO: 1511058 - protein, 29 aa, Mycobacterium tuberculosis
DYPAGAAFSWWPTMLLPPGSHQDNMTVGV

SEQ ID NO: 1511059 - protein, 31 aa, Mycobacterium tuberculosis; identical to SEQ ID NO: 217358

SEQ ID NO: 1511060 - protein, 19 aa, Mycobacterium tuberculosis
EALVESALWEASLFEEHGF

SEQ ID NO: 1511061 - protein, 26 aa, Mycobacterium tuberculosis
EANNHFRVLFFRWGQHPVALTAFYKN

SEQ ID NO: 1511062 - protein, 17 aa, Mycobacterium tuberculosis
EASLDQQRQWILHMAKL

SEQ ID NO: 1511063 - protein, 25 aa, Mycobacterium tuberculosis
EDGWVRAQLLHYMRSAPDFYFDEMS

SEQ ID NO: 1511064 - protein, 19 aa, Mycobacterium tuberculosis
EDLGVFGLLKRFAKGRIVR

SEQ ID NO: 1511065 - protein, 18 aa, Mycobacterium tuberculosis
EDSWLRSLVMAGARERYG

SEQ ID NO: 1511066 - protein, 18 aa, Mycobacterium tuberculosis
EEEQVCADLLALLTSRRP

SEQ ID NO: 1511067 - protein, 18 aa, Mycobacterium tuberculosis
EEPILAGLIDRIARDEVR

SEQ ID NO: 1511068 - protein, 17 aa, Mycobacterium tuberculosis
EFAAFDRVPPGPGEIEV

SEQ ID NO: 1511069 - protein, 28 aa, Mycobacterium tuberculosis
EFATYAPGLWRYWAEHLDPDRARRNDPL

SEQ ID NO: 1511070 - protein, 22 aa, Mycobacterium tuberculosis
EFPRLMVYRGPRRKGVRYFGPY

SEQ ID NO: 1511071 - protein, 26 aa, Mycobacterium tuberculosis
EGLPPGSALLVVKRGPNAGSRFLLDQ

SEQ ID NO: 1511072 - protein, 20 aa, Mycobacterium tuberculosis
EGRGIVMRVPLEGGGRLVVE

SEQ ID NO: 1511073 - protein, 22 aa, Mycobacterium tuberculosis
EICRRLDGIPLAIEFAAARVRS

SEQ ID NO: 1511074 - protein, 22 aa, Mycobacterium tuberculosis
EKDRLLAPLLPEMAAPPHPRTP

SEQ ID NO: 1511075 - protein, 26 aa, Mycobacterium tuberculosis
ERCAFGLQLIAPRLPPFDVPDGHTED

SEQ ID NO: 1511076 - protein, 24 aa, Mycobacterium tuberculosis
ERDAIPLLDQLYGGALRMTRNPAD

SEQ ID NO: 1511077 - protein, 18 aa, Mycobacterium tuberculosis
ETATRFVADPFAAQPGSR

SEQ ID NO: 1511078 - protein, 17 aa, Mycobacterium tuberculosis
FAAPTTLRFEPGITAVV

SEQ ID NO: 1511079 - protein, 19 aa, Mycobacterium tuberculosis
FAELSPHPLLTHAVDQIAG

SEQ ID NO: 1511080 - protein, 18 aa, Mycobacterium tuberculosis
FALTERDLLRTDLFRTKA

SEQ ID NO: 1511081 - protein, 21 aa, Mycobacterium tuberculosis
FARLRALSRRGPIPRPPTLEA

SEQ ID NO: 1511082 - protein, 18 aa, Mycobacterium tuberculosis
FASMFPGRRFGGGALAVY

SEQ ID NO: 1511083 - protein, 18 aa, Mycobacterium tuberculosis
FGELLFTNPTGAFQFLLY

SEQ ID NO: 1511084 - protein, 26 aa, Mycobacterium tuberculosis
FGNAGNINTGFWNAGNLNTGFGSAGN

SEQ ID NO: 1511085 - protein, 19 aa, Mycobacterium tuberculosis
FGVIELHDCFSANELLLYE

SEQ ID NO: 1511086 - protein, 17 aa, Mycobacterium tuberculosis
FGYLYGTPGFQAPEIVR

SEQ ID NO: 1511087 - protein, 17 aa, Mycobacterium tuberculosis
FHIDGRTFTWKPLSGVN

SEQ ID NO: 1511088 - protein, 24 aa, Mycobacterium tuberculosis
FHIDRGYPLFVENLVSLGAEIERV

SEQ ID NO: 1511089 - protein, 26 aa, Mycobacterium tuberculosis
FHRIEAAYPGRFLLGIGVGHAEMISE

SEQ ID NO: 1511090 - protein, 22 aa, Mycobacterium tuberculosis
FNKLLGPLPFPHHPIHTVPSEE

SEQ ID NO: 1511091 - protein, 25 aa, Mycobacterium tuberculosis
FTVPNFLELDYWQTWHYGDSTMAGV

SEQ ID NO: 1511092 - protein, 19 aa, Mycobacterium tuberculosis
GAALPALARTPVEAIGVDL

SEQ ID NO: 1511093 - protein, 23 aa, Mycobacterium tuberculosis
GAEVLLLSDLLTEALHHSGAARM

SEQ ID NO: 1511094 - protein, 23 aa, Mycobacterium tuberculosis
GAIAVPLNFRLTPTEIAVLVEDC

SEQ ID NO: 1511095 - protein, 31 aa, Mycobacterium tuberculosis; identical to SEQ ID NO: 218204

SEQ ID NO: 1511096 - protein, 22 aa, Mycobacterium tuberculosis
GALHSWCLAAERPELVSALVVE

SEQ ID NO: 1511097 - protein, 26 aa, Mycobacterium tuberculosis
GARSPVSFFAYPGMPSDLVPAGCEVH

SEQ ID NO: 1511098 - protein, 24 aa, Mycobacterium tuberculosis
GAVAQPLIAAFAAALRQLGAHVEA

SEQ ID NO: 1511099 - protein, 26 aa, Mycobacterium tuberculosis
GAWSDIGQLGWWSASPARASALEESN

SEQ ID NO: 1511100 - protein, 20 aa, Mycobacterium tuberculosis
GCNLACKFCQNWDISKSREI

SEQ ID NO: 1511101 - protein, 18 aa, Mycobacterium tuberculosis
GDGPWRLGLGSAGTFENL

SEQ ID NO: 1511102 - protein, 18 aa, Mycobacterium tuberculosis
GDGSTWILRRILRRLGYA

SEQ ID NO: 1511103 - protein, 23 aa, Mycobacterium tuberculosis
GDVKRFRGFDNWEGDAATACEAS

SEQ ID NO: 1511104 - protein, 25 aa, Mycobacterium tuberculosis
GDVVVLLESMKMEIPVLAEAAGTVS

SEQ ID NO: 1511105 - protein, 20 aa, Mycobacterium tuberculosis
GDYLAELTMLILGRDRMKNP

SEQ ID NO: 1511106 - protein, 26 aa, Mycobacterium tuberculosis
GEAHIKVIRALFRPPARRGGCVHPPG

SEQ ID NO: 1511107 - protein, 23 aa, Mycobacterium tuberculosis
GEFREMFAPGAFRRSIAERGHKV

SEQ ID NO: 1511108 - protein, 24 aa, Mycobacterium tuberculosis
GEKRSWLRARGLKIFPLVGWAERG

SEQ ID NO: 1511109 - protein, 25 aa, Mycobacterium tuberculosis
GFSSLAYLPRLPVDVVKLGGKFIEC

SEQ ID NO: 1511110 - protein, 23 aa, Mycobacterium tuberculosis
GGAKLRALGPQLAQRRLGLENQG

SEQ ID NO: 1511111 - protein, 18 aa, Mycobacterium tuberculosis
GGLVHIFLPPTDALEHFI

SEQ ID NO: 1511112 - protein, 25 aa, Mycobacterium tuberculosis
GGVSFWASLFPAVWSFCLALRSRGL

SEQ ID NO: 1511113 - protein, 23 aa, Mycobacterium tuberculosis
GGVYVMLEPRRFASGSALGMLSA

SEQ ID NO: 1511114 - protein, 17 aa, Mycobacterium tuberculosis
GHPAYADGRLRIGALTA

SEQ ID NO: 1511115 - protein, 26 aa, Mycobacterium tuberculosis
GLDSRAFRLQWPIGTTIFELDRPQVL

SEQ ID NO: 1511116 - protein, 32 aa, Mycobacterium tuberculosis; identical to SEQ ID NO: 218563

SEQ ID NO: 1511117 - protein, 25 aa, Mycobacterium tuberculosis
GMAKGAGMLAPSLATMLCVLTTDAA

SEQ ID NO: 1511118 - protein, 24 aa, Mycobacterium tuberculosis
GMKKLRTWFAADKTGFHLLHTLFQ

SEQ ID NO: 1511119 - protein, 25 aa, Mycobacterium tuberculosis
GNFNNGVLWVGDYQGLFGVSAGSSI

SEQ ID NO: 1511120 - protein, 22 aa, Mycobacterium tuberculosis
GNQILGRALGLSTYKMVFGHRG

SEQ ID NO: 1511121 - protein, 17 aa, Mycobacterium tuberculosis
GNVTHGALRSAWIGYWV

SEQ ID NO: 1511122 - protein, 26 aa, Mycobacterium tuberculosis
GPFTVPDIPIPAINFGLDGNVNVSFN

SEQ ID NO: 1511123 - protein, 29 aa, Mycobacterium tuberculosis
GPMLHIVRHYRPIVVVLFLSAEIAAFENA

SEQ ID NO: 1511124 - protein, 24 aa, Mycobacterium tuberculosis
GPQRDYWIRQLGGLAGETGLRPDF

SEQ ID NO: 1511125 - protein, 17 aa, Mycobacterium tuberculosis
GPVWVFSGQGSQWAGMG

SEQ ID NO: 1511126 - protein, 25 aa, Mycobacterium tuberculosis
GRGDGGLHRFLLSAASAFVAGVAVN

SEQ ID NO: 1511127 - protein, 24 aa, Mycobacterium tuberculosis
GRTRYRLLETVRQYALEKLRESGD

SEQ ID NO: 1511128 - protein, 36 aa, Mycobacterium tuberculosis; identical to SEQ ID NO: 218821

SEQ ID NO: 1511129 - protein, 25 aa, Mycobacterium tuberculosis
GSQGLTPQLYPQLAAIAPTVFTAAP

SEQ ID NO: 1511130 - protein, 26 aa, Mycobacterium tuberculosis
GSTAARLFYAYAEILLALGRGDEALQ

SEQ ID NO: 1511131 - protein, 31 aa, Mycobacterium tuberculosis; identical to SEQ ID NO: 218858

SEQ ID NO: 1511132 - protein, 25 aa, Mycobacterium tuberculosis
GSYSNGILWRGDYQGLIGYSDTLSI

SEQ ID NO: 1511133 - protein, 23 aa, Mycobacterium tuberculosis
GTAWARLADADLAWLDGDQLGRR

SEQ ID NO: 1511134 - protein, 28 aa, Mycobacterium tuberculosis
GTDEAGAAALWFALDTDLPVLVDADGLT

SEQ ID NO: 1511135 - protein, 24 aa, Mycobacterium tuberculosis
GTGMGIDRLLMSLTGLSIRETVLF

SEQ ID NO: 1511136 - protein, 27 aa, Mycobacterium tuberculosis
GTHHYRFTLYHLPVALQLPPGATGVQA

SEQ ID NO: 1511137 - protein, 29 aa, Mycobacterium tuberculosis
GTQPTAWLAEGLLPYLPGDAADRLFDMVT

SEQ ID NO: 1511138 - protein, 22 aa, Mycobacterium tuberculosis
GVEPPRGVLLYGPPGCGKTFVV

SEQ ID NO: 1511139 - protein, 23 aa, Mycobacterium tuberculosis
GVTRELQWPAMRISHCRPPGSDR

SEQ ID NO: 1511140 - protein, 23 aa, Mycobacterium tuberculosis
HAEVLAHWPEVIASPTPAAAGRV

SEQ ID NO: 1511141 - protein, 21 aa, Mycobacterium tuberculosis
HAEVVALRRAGGLAAGAIVVV

SEQ ID NO: 1511142 - protein, 17 aa, Mycobacterium tuberculosis
HAFFQFYVADGRLSCQL

SEQ ID NO: 1511143 - protein, 18 aa, Mycobacterium tuberculosis
HAHAWALRMSPDGNVWGA

SEQ ID NO: 1511144 - protein, 33 aa, Mycobacterium tuberculosis; identical to SEQ ID NO: 219054

SEQ ID NO: 1511145 - protein, 26 aa, Mycobacterium tuberculosis
HGNSVPRFHITWGTGPALVDIFVRQL

SEQ ID NO: 1511146 - protein, 23 aa, Mycobacterium tuberculosis
HGRSYILRAGISSLFRYIEGVHG

SEQ ID NO: 1511147 - protein, 18 aa, Mycobacterium tuberculosis
HHRNEVTEIIPLDGFLDG

SEQ ID NO: 1511148 - protein, 24 aa, Mycobacterium tuberculosis
HIYHYAPYEKTALLRLVGRYGIGE

SEQ ID NO: 1511149 - protein, 26 aa, Mycobacterium tuberculosis
HLAQAWRKHIGPPRQLPADSPQGQAI

SEQ ID NO: 1511150 - protein, 20 aa, Mycobacterium tuberculosis
HPTLRLTTNLRIGLEGREAR

SEQ ID NO: 1511151 - protein, 17 aa, Mycobacterium tuberculosis
HQLNRYPDGLEKCIGCE

SEQ ID NO: 1511152 - protein, 17 aa, Mycobacterium tuberculosis
HRGRRQLRGLLADVARD

SEQ ID NO: 1511153 - protein, 26 aa, Mycobacterium tuberculosis
HRGSYLQMHFALAQPPAFAAPYQALN

SEQ ID NO: 1511154 - protein, 25 aa, Mycobacterium tuberculosis
HRKVVVFRPLYAVGGQELGYLPGSE

SEQ ID NO: 1511155 - protein, 20 aa, Mycobacterium tuberculosis
HRPGVYLFRGPSGEVLYVGT

SEQ ID NO: 1511156 - protein, 19 aa, Mycobacterium tuberculosis
HYLCELKIDGVALSLVYRE

SEQ ID NO: 1511157 - protein, 20 aa, Mycobacterium tuberculosis
IANGSSLAVGGFGLCGIPEA

SEQ ID NO: 1511158 - protein, 18 aa, Mycobacterium tuberculosis
ICDRLGLLPMYAVNQDKH

SEQ ID NO: 1511159 - protein, 18 aa, Mycobacterium tuberculosis
IDAFQVVAGVLFLENIIV

SEQ ID NO: 1511160 - protein, 22 aa, Mycobacterium tuberculosis
IEVVGKKLRDLMSWVDRPITET

SEQ ID NO: 1511161 - protein, 18 aa, Mycobacterium tuberculosis
IFGQFNDPLRFQPRWKEL

SEQ ID NO: 1511162 - protein, 19 aa, Mycobacterium tuberculosis
IGALPLVMNPDAAVATVVV

SEQ ID NO: 1511163 - protein, 21 aa, Mycobacterium tuberculosis
IGLTGRPPRAIPDPAPRSSHG

SEQ ID NO: 1511164 - protein, 25 aa, Mycobacterium tuberculosis
IGQVPYLLTLPGHGFYWFQLTTHEV

SEQ ID NO: 1511165 - protein, 19 aa, Mycobacterium tuberculosis
IIGAEALLRWEHPTLGTLL

SEQ ID NO: 1511166 - protein, 18 aa, Mycobacterium tuberculosis
ILEEVWGFDFPTSGNALE

SEQ ID NO: 1511167 - protein, 18 aa, Mycobacterium tuberculosis
ILPVEDMPFLADGTPVDI

SEQ ID NO: 1511168 - protein, 25 aa, Mycobacterium tuberculosis
INKEINLRFVLGYTPLEFRDTLHML

SEQ ID NO: 1511169 - protein, 24 aa, Mycobacterium tuberculosis
IQGHLPVILPTRRRARDLGHTTAL

SEQ ID NO: 1511170 - protein, 27 aa, Mycobacterium tuberculosis
ISDELWDLLPGYLIFRSIIPNRPPTQD

SEQ ID NO: 1511171 - protein, 27 aa, Mycobacterium tuberculosis
ISGSYSNGFLWSGNYQGLIGLHAALAI

SEQ ID NO: 1511172 - protein, 28 aa, Mycobacterium tuberculosis
IVASIPVKRLRQAGVLDLLLALANETET

SEQ ID NO: 1511173 - protein, 25 aa, Mycobacterium tuberculosis
KAAPVLWTQQVLTTGRLRAVILNSG

SEQ ID NO: 1511174 - protein, 24 aa, Mycobacterium tuberculosis
KAYHAEPFIYLMPEGQLPRTGAVI

SEQ ID NO: 1511175 - protein, 20 aa, Mycobacterium tuberculosis
KDFVAVMRRLAAGHGRVDVV

SEQ ID NO: 1511176 - protein, 18 aa, Mycobacterium tuberculosis
KDTLWKAADKLRGSLSAS

SEQ ID NO: 1511177 - protein, 19 aa, Mycobacterium tuberculosis
KEFTLLEALIRRPGIVHTR

SEQ ID NO: 1511178 - protein, 21 aa, Mycobacterium tuberculosis
KEPLYRLYELRLRQGLAASKS

SEQ ID NO: 1511179 - protein, 24 aa, Mycobacterium tuberculosis
KPSPFAASLLFGYVGAFMYEGDTP

SEQ ID NO: 1511180 - protein, 28 aa, Mycobacterium tuberculosis
KRRATIEQLLTIPLAKELAWAPDEIREE

SEQ ID NO: 1511181 - protein, 25 aa, Mycobacterium tuberculosis
KRSLNHWYRMFGPAFETSLGLEFIG

SEQ ID NO: 1511182 - protein, 23 aa, Mycobacterium tuberculosis
KSRPLWEMYLVEGLEKNRIALYT

SEQ ID NO: 1511183 - protein, 23 aa, Mycobacterium tuberculosis
KTLREAVLYLTGMNQRELYGASY

SEQ ID NO: 1511184 - protein, 20 aa, Mycobacterium tuberculosis
KVARLMEWCAMVGCPIVGIN

SEQ ID NO: 1511185 - protein, 19 aa, Mycobacterium tuberculosis
LAAQLAVYLAPPGYGEMFS

SEQ ID NO: 1511186 - protein, 24 aa, Mycobacterium tuberculosis
LADHKVFGQPIMPAAGFAEIALAA

SEQ ID NO: 1511187 - protein, 21 aa, Mycobacterium tuberculosis
LATAYLFRCLSCGVHLAYADF

SEQ ID NO: 1511188 - protein, 17 aa, Mycobacterium tuberculosis
LCDNAIEAVWPADPLAA

SEQ ID NO: 1511189 - protein, 20 aa, Mycobacterium tuberculosis
LDDLAKRLIVLVEPVEAIVD

SEQ ID NO: 1511190 - protein, 21 aa, Mycobacterium tuberculosis
LDGSPLRYNQLDPYLPDLLMC

SEQ ID NO: 1511191 - protein, 31 aa, Mycobacterium tuberculosis; identical to SEQ ID NO: 219984

SEQ ID NO: 1511192 - protein, 24 aa, Mycobacterium tuberculosis
LDQQRQWILHMAKLSAAMAKQAQY

SEQ ID NO: 1511193 - protein, 18 aa, Mycobacterium tuberculosis
LFETGIPTRYYIDPADIA

SEQ ID NO: 1511194 - protein, 19 aa, Mycobacterium tuberculosis
LFTRTGAGLAFTPGGLRLA

SEQ ID NO: 1511195 - protein, 23 aa, Mycobacterium tuberculosis
LGAQVTIFRLGSDPGLARFIDQV

SEQ ID NO: 1511196 - protein, 28 aa, Mycobacterium tuberculosis
LGHFALTAHLLPLLRAAQRARVVSLSSL

SEQ ID NO: 1511197 - protein, 22 aa, Mycobacterium tuberculosis
LHDHVIQRLFAIGLALQGAVPH

SEQ ID NO: 1511198 - protein, 19 aa, Mycobacterium tuberculosis
LHFTALPDKLAAIETNLFV

SEQ ID NO: 1511199 - protein, 18 aa, Mycobacterium tuberculosis
LHRFLPGASTRRSPNCSP

SEQ ID NO: 1511200 - protein, 17 aa, Mycobacterium tuberculosis
LIGMQLTLTELWRSYGV

SEQ ID NO: 1511201 - protein, 27 aa, Mycobacterium tuberculosis
LIKAILSLRHGVVPPLLHFNRLPDELS

SEQ ID NO: 1511202 - protein, 17 aa, Mycobacterium tuberculosis
LLELARYKRGDLVVIVA

SEQ ID NO: 1511203 - protein, 34 aa, Mycobacterium tuberculosis; identical to SEQ ID NO: 220259

SEQ ID NO: 1511204 - protein, 17 aa, Mycobacterium tuberculosis
LMPAFTRAALRGYRDMI

SEQ ID NO: 1511205 - protein, 22 aa, Mycobacterium tuberculosis
LNKPVISWAGDNGIYFTRFRPY

SEQ ID NO: 1511206 - protein, 17 aa, Mycobacterium tuberculosis
LQNGWLSRDGVWHTDTD

SEQ ID NO: 1511207 - protein, 25 aa, Mycobacterium tuberculosis
LRADMRVAHPLIARAHLLLRFDRGN

SEQ ID NO: 1511208 - protein, 24 aa, Mycobacterium tuberculosis
LRAIAAAHPDLILGSQGLTPQLYP

SEQ ID NO: 1511209 - protein, 21 aa, Mycobacterium tuberculosis
LRPGERHWMAFRQLASDVDAN

SEQ ID NO: 1511210 - protein, 18 aa, Mycobacterium tuberculosis
LRQRFGGARLVWSGHWTT

SEQ ID NO: 1511211 - protein, 22 aa, Mycobacterium tuberculosis
LRRVRSRLARLAGIGLGCGDPA

SEQ ID NO: 1511212 - protein, 22 aa, Mycobacterium tuberculosis
LSPALTMPFTPPPTFMNHRLTP

SEQ ID NO: 1511213 - protein, 20 aa, Mycobacterium tuberculosis
LTGQAWQGPASAAMAAAAAP

SEQ ID NO: 1511214 - protein, 21 aa, Mycobacterium tuberculosis
LTLEALAAQQVSCAGLVIGSW

SEQ ID NO: 1511215 - protein, 20 aa, Mycobacterium tuberculosis
LTPQEFHVLRRAGTERPFTG

SEQ ID NO: 1511216 - protein, 17 aa, Mycobacterium tuberculosis
LVDLPREEWPDRLRRLL

SEQ ID NO: 1511217 - protein, 19 aa, Mycobacterium tuberculosis
LVQGGGFAGPLFDGFDNLY

SEQ ID NO: 1511218 - protein, 21 aa, Mycobacterium tuberculosis
LYPKLLPIARNWWAKLGREAP

SEQ ID NO: 1511219 - protein, 17 aa, Mycobacterium tuberculosis
MAALRRWARDRGLNPSE

SEQ ID NO: 1511220 - protein, 29 aa, Mycobacterium tuberculosis
MAKQAQYVAQLHVWARREHPTYEDIVGLE

SEQ ID NO: 1511221 - protein, 25 aa, Mycobacterium tuberculosis
MMAVATQYLAWLSTAAAQAEQAAAQ

SEQ ID NO: 1511222 - protein, 22 aa, Mycobacterium tuberculosis
MRRLRGRFYDGMRALHGAPDEV

SEQ ID NO: 1511223 - protein, 24 aa, Mycobacterium tuberculosis
MVLRPITGAIPPDGPWGIWASRRI

SEQ ID NO: 1511224 - protein, 20 aa, Mycobacterium tuberculosis
NAMLGLLCDAAFDELTRPDV

SEQ ID NO: 1511225 - protein, 17 aa, Mycobacterium tuberculosis
NATRWLSGQLGRPLSLI

SEQ ID NO: 1511226 - protein, 25 aa, Mycobacterium tuberculosis
NCLGGSLMDYLIPTALEVPHLETGH

SEQ ID NO: 1511227 - protein, 24 aa, Mycobacterium tuberculosis
NCPDILDVPLMAEVLRGLGATVEL

SEQ ID NO: 1511228 - protein, 27 aa, Mycobacterium tuberculosis
NDQVAALFRMWLRDAVRRVATGVLDVV

SEQ ID NO: 1511229 - protein, 21 aa, Mycobacterium tuberculosis
NFPTKKHWRAPSKLAYIDAGL

SEQ ID NO: 1511230 - protein, 18 aa, Mycobacterium tuberculosis
NGALWTGDYHGLVGFSFS

SEQ ID NO: 1511231 - protein, 21 aa, Mycobacterium tuberculosis
NGTPLLNWLRQRGVDEVDVVG

SEQ ID NO: 1511232 - protein, 31 aa, Mycobacterium tuberculosis
NKAALEPVNPPKPPPAIKIDPPPPPQEQGLI

SEQ ID NO: 1511233 - protein, 33 aa, Mycobacterium tuberculosis; identical to SEQ ID NO: 220932

SEQ ID NO: 1511234 - protein, 22 aa, Mycobacterium tuberculosis
NQVQEWLQWLQKIGYTDFYNNV

SEQ ID NO: 1511235 - protein, 22 aa, Mycobacterium tuberculosis
NRAELMILIATNLLGQNTPAIA

SEQ ID NO: 1511236 - protein, 22 aa, Mycobacterium tuberculosis
NRVDLIVGHGRFIDPHTILVED

SEQ ID NO: 1511237 - protein, 29 aa, Mycobacterium tuberculosis
NTFHGLLLLRHVADLVMTGWPVLMALSNK

SEQ ID NO: 1511238 - protein, 19 aa, Mycobacterium tuberculosis
NTGIFDIGLANLGSYNIGL

SEQ ID NO: 1511239 - protein, 18 aa, Mycobacterium tuberculosis
NVFALYEPPAPPGMTDNP

SEQ ID NO: 1511240 - protein, 23 aa, Mycobacterium tuberculosis
NYVAPIVVCHMSFWVDGKQSALA

SEQ ID NO: 1511241 - protein, 21 aa, Mycobacterium tuberculosis
PADFYALLRQTGQHHGPAFAA

SEQ ID NO: 1511242 - protein, 23 aa, Mycobacterium tuberculosis
PAGFTETVTWWQVHRRAMIVAEE

SEQ ID NO: 1511243 - protein, 20 aa, Mycobacterium tuberculosis
PAHLQLVLHKLHDAGATVTQ

SEQ ID NO: 1511244 - protein, 17 aa, Mycobacterium tuberculosis
PAPMYHTAPSVWTMSAL

SEQ ID NO: 1511245 - protein, 22 aa, Mycobacterium tuberculosis
PDFSLVELPAKLPRATLKKLAQ

SEQ ID NO: 1511246 - protein, 18 aa, Mycobacterium tuberculosis
PDLEDRAKMMALLEPERI

SEQ ID NO: 1511247 - protein, 31 aa, Mycobacterium tuberculosis; identical to SEQ ID NO: 221131

SEQ ID NO: 1511248 - protein, 22 aa, Mycobacterium tuberculosis
PGALLGAKPFTFDPAALAAAQA

SEQ ID NO: 1511249 - protein, 24 aa, Mycobacterium tuberculosis
PGARLFLHYGDLIDGTRLVTLLST

SEQ ID NO: 1511250 - protein, 28 aa, Mycobacterium tuberculosis
PGCYPTAALLALFPALAADLIEPAVTVV

SEQ ID NO: 1511251 - protein, 28 aa, Mycobacterium tuberculosis
PGDTYLAGAKILRQYGIGPLPGVAMMVV

SEQ ID NO: 1511252 - protein, 30 aa, Mycobacterium tuberculosis
PGGFGLTSGLFPFHFTLNGGIGPISIPTTT

SEQ ID NO: 1511253 - protein, 23 aa, Mycobacterium tuberculosis
PGLRAEFGDRLPVVLLDGREHSY

SEQ ID NO: 1511254 - protein, 19 aa, Mycobacterium tuberculosis
PGPHLLVLARGPEGYRRLS

SEQ ID NO: 1511255 - protein, 20 aa, Mycobacterium tuberculosis
PGRLTLVEGAGGLLVELAEP

SEQ ID NO: 1511256 - protein, 22 aa, Mycobacterium tuberculosis
PGSFLARQLGVPQPETLRRYRA

SEQ ID NO: 1511257 - protein, 24 aa, Mycobacterium tuberculosis
PHAGGAAAAYRWLAKSLVANDVDT

SEQ ID NO: 1511258 - protein, 25 aa, Mycobacterium tuberculosis
PHHTRLRKIISRGFTPRAVGRLHDE

SEQ ID NO: 1511259 - protein, 27 aa, Mycobacterium tuberculosis
PIVMVDPWGHFDGLRAWLNGLLDTGYV

SEQ ID NO: 1511260 - protein, 27 aa, Mycobacterium tuberculosis
PLALRDRLIVELLYATGIRVSELCGLD

SEQ ID NO: 1511261 - protein, 26 aa, Mycobacterium tuberculosis
PLPPTVGITLHLPFDGILVPPHPVTA

SEQ ID NO: 1511262 - protein, 17 aa, Mycobacterium tuberculosis
PLTVAVLLRITEVFGVD

SEQ ID NO: 1511263 - protein, 26 aa, Mycobacterium tuberculosis
PNDQVALFLRHLWSAGGSVRWDPTNG

SEQ ID NO: 1511264 - protein, 27 aa, Mycobacterium tuberculosis
PPPSEGWRRLLYLLSGRLINAGEGPRA

SEQ ID NO: 1511265 - protein, 25 aa, Mycobacterium tuberculosis
PPQSFAQVLVGWQNWLRTADRGSWA

SEQ ID NO: 1511266 - protein, 32 aa, Mycobacterium tuberculosis; identical to SEQ ID NO: 221398

SEQ ID NO: 1511267 - protein, 29 aa, Mycobacterium tuberculosis
PRLTRMQRFWISLYFPLTMRSLCNAIVVP

SEQ ID NO: 1511268 - protein, 26 aa, Mycobacterium tuberculosis
PSAFNTIIDKWLPLSWSLNMVNRSMG

SEQ ID NO: 1511269 - protein, 20 aa, Mycobacterium tuberculosis
PSSLWLDAAGKRLPVPLFPG

SEQ ID NO: 1511270 - protein, 21 aa, Mycobacterium tuberculosis
PTRRGNWWYYARTFEGKQYGV

SEQ ID NO: 1511271 - protein, 26 aa, Mycobacterium tuberculosis
PTVTTPQMFTYRLLQQARSDLMRIVL

SEQ ID NO: 1511272 - protein, 19 aa, Mycobacterium tuberculosis
PVDPLPRRRADLDNGVFEH

SEQ ID NO: 1511273 - protein, 28 aa, Mycobacterium tuberculosis
PVLAVGSYLPHAPWPWGVIDQAARVLLP

SEQ ID NO: 1511274 - protein, 22 aa, Mycobacterium tuberculosis
PVPVPIHHLLYDGSFAVAVPVD

SEQ ID NO: 1511275 - protein, 28 aa, Mycobacterium tuberculosis
PYPELATTTLLRPVKPPPSEGWRRLLYL

SEQ ID NO: 1511276 - protein, 24 aa, Mycobacterium tuberculosis
PYRANMWALRALGVRRVFGPCAVG

SEQ ID NO: 1511277 - protein, 17 aa, Mycobacterium tuberculosis
QAFFDFIEHDSQGYRLI

SEQ ID NO: 1511278 - protein, 17 aa, Mycobacterium tuberculosis
QAFVQWRAQSRSELTEV

SEQ ID NO: 1511279 - protein, 19 aa, Mycobacterium tuberculosis
QARRRFPLPDVPWTRFFGV

SEQ ID NO: 1511280 - protein, 17 aa, Mycobacterium tuberculosis
QAYPLMSRMVELGWICV

SEQ ID NO: 1511281 - protein, 24 aa, Mycobacterium tuberculosis
QENVMNPATWSGTGVVASHMTATE

SEQ ID NO: 1511282 - protein, 23 aa, Mycobacterium tuberculosis
QGWLADHSVAGVTIFPGAGFVEL

SEQ ID NO: 1511283 - protein, 25 aa, Mycobacterium tuberculosis
QHQMWAAQFIRYEKPRSWLNSGGLG

SEQ ID NO: 1511284 - protein, 22 aa, Mycobacterium tuberculosis
QIKLAVLVATNFFGINTIPIAI

SEQ ID NO: 1511285 - protein, 20 aa, Mycobacterium tuberculosis
QLEHWGCPWSRKPDGRVAVR

SEQ ID NO: 1511286 - protein, 19 aa, Mycobacterium tuberculosis
QLLSLVLSNLFGQNLPAIA

SEQ ID NO: 1511287 - protein, 17 aa, Mycobacterium tuberculosis
QMLAPLAPHIAEELWLR

SEQ ID NO: 1511288 - protein, 32 aa, Mycobacterium tuberculosis; identical to SEQ ID NO: 221755

SEQ ID NO: 1511289 - protein, 19 aa, Mycobacterium tuberculosis
QQIQQLVVARRLLGLSSSE

SEQ ID NO: 1511290 - protein, 23 aa, Mycobacterium tuberculosis
QTFDLRRATLTRSLRFRDAGGRV

SEQ ID NO: 1511291 - protein, 25 aa, Mycobacterium tuberculosis
QTGSPTYVADLAEALLALADAGVRG

SEQ ID NO: 1511292 - protein, 18 aa, Mycobacterium tuberculosis
QVGLILRRTIDTDRLLSE

SEQ ID NO: 1511293 - protein, 17 aa, Mycobacterium tuberculosis
RAQLREWLAEIGADHSD

SEQ ID NO: 1511294 - protein, 23 aa, Mycobacterium tuberculosis
RASGRRKAWLRQAINHLEKLIGR

SEQ ID NO: 1511295 - protein, 29 aa, Mycobacterium tuberculosis
RASQTWRYPAFFHAMLDAGVYPPCSAFEA

SEQ ID NO: 1511296 - protein, 24 aa, Mycobacterium tuberculosis
RAVAPGLFVPTVIASAVVAKEGTD

SEQ ID NO: 1511297 - protein, 24 aa, Mycobacterium tuberculosis
RDCTAGLPFLIHAVSARAQAPAQA

SEQ ID NO: 1511298 - protein, 21 aa, Mycobacterium tuberculosis
RDGRLGTVGKLLPGLQGKIAE

SEQ ID NO: 1511299 - protein, 23 aa, Mycobacterium tuberculosis
RDVIDAFLAWYVPGLDISDHTML

SEQ ID NO: 1511300 - protein, 21 aa, Mycobacterium tuberculosis
REGERLVVWAKRILAEHAAFK

SEQ ID NO: 1511301 - protein, 22 aa, Mycobacterium tuberculosis
RELIQMRRPLRDIPEPTIPDGV

SEQ ID NO: 1511302 - protein, 24 aa, Mycobacterium tuberculosis
RERLGLPGLRDWLRRQAKAGAGPP

SEQ ID NO: 1511303 - protein, 22 aa, Mycobacterium tuberculosis
RFLHGDMFASLRRWTGGSIPET

SEQ ID NO: 1511304 - protein, 21 aa, Mycobacterium tuberculosis
RFRQTIRTLTLTSPPKGPNWA

SEQ ID NO: 1511305 - protein, 19 aa, Mycobacterium tuberculosis
RGECEFIIRLLPDGVMSNY

SEQ ID NO: 1511306 - protein, 17 aa, Mycobacterium tuberculosis
RHELTVLAALLGPADAP

SEQ ID NO: 1511307 - protein, 17 aa, Mycobacterium tuberculosis
RILLSNPAVWEKTALIV

SEQ ID NO: 1511308 - protein, 18 aa, Mycobacterium tuberculosis
RLAALARLFAVASNPTHR

SEQ ID NO: 1511309 - protein, 24 aa, Mycobacterium tuberculosis
RLAELWSIMDFLNPGLLGSSERFR

SEQ ID NO: 1511310 - protein, 24 aa, Mycobacterium tuberculosis
RLKPRVFYDLVVEVALIRPGPIQG

SEQ ID NO: 1511311 - protein, 20 aa, Mycobacterium tuberculosis
RLMVALQRRISEDNPGVGRH

SEQ ID NO: 1511312 - protein, 32 aa, Mycobacterium tuberculosis; identical to SEQ ID NO: 222341

SEQ ID NO: 1511313 - protein, 18 aa, Mycobacterium tuberculosis
RLWEALLRGDDLVTEIPA

SEQ ID NO: 1511314 - protein, 22 aa, Mycobacterium tuberculosis
RLYERLLGWLADIQQPRPADCL

SEQ ID NO: 1511315 - protein, 18 aa, Mycobacterium tuberculosis
RMIDNFFAEILRGVSAGR

SEQ ID NO: 1511316 - protein, 17 aa, Mycobacterium tuberculosis
RNDVMFGPPGRLYTYRS

SEQ ID NO: 1511317 - protein, 18 aa, Mycobacterium tuberculosis
RPINGLNLDVAAGSLVML

SEQ ID NO: 1511318 - protein, 21 aa, Mycobacterium tuberculosis
RPPFARNVRFLPTAAAAQGEG

SEQ ID NO: 1511319 - protein, 17 aa, Mycobacterium tuberculosis
RPRSLYAASKTAQEHYA

SEQ ID NO: 1511320 - protein, 21 aa, Mycobacterium tuberculosis
RQRLHVAVQAFFDFIEHDSQG

SEQ ID NO: 1511321 - protein, 18 aa, Mycobacterium tuberculosis
RRCRAGELRVVPGAPTGG

SEQ ID NO: 1511322 - protein, 17 aa, Mycobacterium tuberculosis
RRLPAAEHPFINKLADQ

SEQ ID NO: 1511323 - protein, 32 aa, Mycobacterium tuberculosis; identical to SEQ ID NO: 226858

SEQ ID NO: 1511324 - protein, 21 aa, Mycobacterium tuberculosis
RSYLLRIELADRPGSLGSLAV

SEQ ID NO: 1511325 - protein, 19 aa, Mycobacterium tuberculosis
RTIRLPVHLVEQVNKLARI

SEQ ID NO: 1511326 - protein, 19 aa, Mycobacterium tuberculosis
RTWLLVATGLSGVAQARGS

SEQ ID NO: 1511327 - protein, 24 aa, Mycobacterium tuberculosis
RVRPVSSAQFPRPAPRSSYSALSS

SEQ ID NO: 1511328 - protein, 20 aa, Mycobacterium tuberculosis
RWRRRRALWVGVTLGGAVDS

SEQ ID NO: 1511329 - protein, 27 aa, Mycobacterium tuberculosis
SADGSPPYVVRWLVNGHETTVYPGSDA

SEQ ID NO: 1511330 - protein, 26 aa, Mycobacterium tuberculosis
SAERDYILELLLAHTSAGLPYERCVG

SEQ ID NO: 1511331 - protein, 29 aa, Mycobacterium tuberculosis
SAHAVAFHEQFVQLMSAGAAQYASAEAAN

SEQ ID NO: 1511332 - protein, 19 aa, Mycobacterium tuberculosis
SAPSLVFLDELDALAPRRG

SEQ ID NO: 1511333 - protein, 23 aa, Mycobacterium tuberculosis
SAVKAFTAWAVRRGLLAGDPAAR

SEQ ID NO: 1511334 - protein, 21 aa, Mycobacterium tuberculosis
SAWLLVSILRQFGLAARFVSG

SEQ ID NO: 1511335 - protein, 23 aa, Mycobacterium tuberculosis
SDGTLRVGYLPVTITRWPPGERV

SEQ ID NO: 1511336 - protein, 21 aa, Mycobacterium tuberculosis
SDKTLIRFGDPPGGKALTFEV

SEQ ID NO: 1511337 - protein, 18 aa, Mycobacterium tuberculosis
SDPFITIDAFQVVAGVLF

SEQ ID NO: 1511338 - protein, 18 aa, Mycobacterium tuberculosis
SEVSFPKPVFHGDTLYAE

SEQ ID NO: 1511339 - protein, 36 aa, Mycobacterium tuberculosis; identical to SEQ ID NO: 225605

SEQ ID NO: 1511340 - protein, 19 aa, Mycobacterium tuberculosis
SGEEMARLFAWCPEAVTAA

SEQ ID NO: 1511341 - protein, 36 aa, Mycobacterium tuberculosis; identical to SEQ ID NO: 222925

SEQ ID NO: 1511342 - protein, 32 aa, Mycobacterium tuberculosis; identical to SEQ ID NO: 222944

SEQ ID NO: 1511343 - protein, 17 aa, Mycobacterium tuberculosis
SIEWMSRNLANRESVIL

SEQ ID NO: 1511344 - protein, 29 aa, Mycobacterium tuberculosis
SKLAPKHVLPAWIGLVTLAAQEPGREWSA

SEQ ID NO: 1511345 - protein, 22 aa, Mycobacterium tuberculosis
SKSALMAAWTSLYDASKGDRGD

SEQ ID NO: 1511346 - protein, 25 aa, Mycobacterium tuberculosis
SLLANAIGYPIAASVALVTPAAGAN

SEQ ID NO: 1511347 - protein, 19 aa, Mycobacterium tuberculosis
SLMMANRIEFYPLDVGAQH

SEQ ID NO: 1511348 - protein, 21 aa, Mycobacterium tuberculosis
SLMTLTTLYPPVAAVVSLWTQ

SEQ ID NO: 1511349 - protein, 22 aa, Mycobacterium tuberculosis
SMDAIMFPYNNARILRQLATPI

SEQ ID NO: 1511350 - protein, 25 aa, Mycobacterium tuberculosis
SNAGPAMLPGFNSGFANIGSFNAGI

SEQ ID NO: 1511351 - protein, 22 aa, Mycobacterium tuberculosis
SNGLLWRGDNQGLIDLAIGVDI

SEQ ID NO: 1511352 - protein, 19 aa, Mycobacterium tuberculosis
SRAIYKDGWWACARLDKAP

SEQ ID NO: 1511353 - protein, 18 aa, Mycobacterium tuberculosis
SRFRELICSRAVDIAIGP

SEQ ID NO: 1511354 - protein, 18 aa, Mycobacterium tuberculosis
SRRAYDVRPIVTAILDAD

SEQ ID NO: 1511355 - protein, 17 aa, Mycobacterium tuberculosis
STGLPVPTLGWQMLKTY

SEQ ID NO: 1511356 - protein, 39 aa, Mycobacterium tuberculosis; identical to SEQ ID NO: 226955

SEQ ID NO: 1511357 - protein, 21 aa, Mycobacterium tuberculosis
SWPYGLPELPGARDQLRGTRR

SEQ ID NO: 1511358 - protein, 25 aa, Mycobacterium tuberculosis
TAETWPNPWPMYRALRDHDPVHHVV

SEQ ID NO: 1511359 - protein, 20 aa, Mycobacterium tuberculosis
TAKILSPHKTVLIPDQRAGC

SEQ ID NO: 1511360 - protein, 26 aa, Mycobacterium tuberculosis
TANGALKFPSLHASPPMLAGKHIWEV

SEQ ID NO: 1511361 - protein, 17 aa, Mycobacterium tuberculosis
TAPGLVVPGRPAVMVLP

SEQ ID NO: 1511362 - protein, 20 aa, Mycobacterium tuberculosis
TAWTSTWRRWCIPANAATSS

SEQ ID NO: 1511363 - protein, 22 aa, Mycobacterium tuberculosis
TDFGAFVSLLPGRDGLVHISKL

SEQ ID NO: 1511364 - protein, 38 aa, Mycobacterium tuberculosis
TEAMLHSDYPLQALLYVVVLHRFLRWRQRDYAPARHLG

SEQ ID NO: 1511365 - protein, 17 aa, Mycobacterium tuberculosis
TEAWLMQAPKQLVQAFL

SEQ ID NO: 1511366 - protein, 24 aa, Mycobacterium tuberculosis
TEKFLKDLLAAFADAPVVIGPTAP

SEQ ID NO: 1511367 - protein, 37 aa, Mycobacterium tuberculosis
TERDRTLFRRDQIGIVFQFFNLIPTLTVLENITLPQE

SEQ ID NO: 1511368 - protein, 25 aa, Mycobacterium tuberculosis
TGCTPYMVLLAAFGALVHRYTHSDD

SEQ ID NO: 1511369 - protein, 22 aa, Mycobacterium tuberculosis
TGDYSNGLLWRGGYEGLVGVRV

SEQ ID NO: 1511370 - protein, 21 aa, Mycobacterium tuberculosis
TGELPTWQWESLISKSTRLVA

SEQ ID NO: 1511371 - protein, 25 aa, Mycobacterium tuberculosis
TGSREFMLHPVMMDIALQTLGATRT

SEQ ID NO: 1511372 - protein, 17 aa, Mycobacterium tuberculosis
TGYLGPPPVPTSSPPTT

SEQ ID NO: 1511373 - protein, 18 aa, Mycobacterium tuberculosis
THEDLLATIRYVRDRTGD

SEQ ID NO: 1511374 - protein, 22 aa, Mycobacterium tuberculosis
THSHRIPDFVKLAEALGCVGLR

SEQ ID NO: 1511375 - protein, 37 aa, Mycobacterium tuberculosis; identical to SEQ ID NO: 223485

SEQ ID NO: 1511376 - protein, 18 aa, Mycobacterium tuberculosis
TIVFCGVHFMAETAKILS

SEQ ID NO: 1511377 - protein, 19 aa, Mycobacterium tuberculosis
TLGRRVVYRRDEVSRWISK

SEQ ID NO: 1511378 - protein, 17 aa, Mycobacterium tuberculosis
TLIGRAYLYGLMAGGEA

SEQ ID NO: 1511379 - protein, 17 aa, Mycobacterium tuberculosis
TNPTGAFQFLLYVVVVD

SEQ ID NO: 1511380 - protein, 19 aa, Mycobacterium tuberculosis
TNYAVLLPTVDIALALVTT

SEQ ID NO: 1511381 - protein, 23 aa, Mycobacterium tuberculosis
TPLHTQVFGPPHGYPIVLTHGFV

SEQ ID NO: 1511382 - protein, 27 aa, Mycobacterium tuberculosis
TQETFLRAIGAIPRFSARSSARTWLLA

SEQ ID NO: 1511383 - protein, 25 aa, Mycobacterium tuberculosis
TRIGLTYPALFGFLRIATSARVLAA

SEQ ID NO: 1511384 - protein, 33 aa, Mycobacterium tuberculosis; identical to SEQ ID NO: 223643

SEQ ID NO: 1511385 - protein, 24 aa, Mycobacterium tuberculosis
TSPPKGPNWAAMPTVRTPAGGGDA

SEQ ID NO: 1511386 - protein, 24 aa, Mycobacterium tuberculosis
TSRAPRWAIAYKYPPEEAQTKLLD

SEQ ID NO: 1511387 - protein, 27 aa, Mycobacterium tuberculosis
TTRLAAPLLPLITEIIWRGLTRERSVH

SEQ ID NO: 1511388 - protein, 24 aa, Mycobacterium tuberculosis
TTVLLAQMFAAGVRRLVLASSMVV

SEQ ID NO: 1511389 - protein, 20 aa, Mycobacterium tuberculosis
TVAQRRLPLLIASGADVHVI

SEQ ID NO: 1511390 - protein, 18 aa, Mycobacterium tuberculosis
TVATIVRRHWPTPSLARV

SEQ ID NO: 1511391 - protein, 21 aa, Mycobacterium tuberculosis
TVFHVHLHVLPPRNGDKLSVA

SEQ ID NO: 1511392 - protein, 18 aa, Mycobacterium tuberculosis
TVLAPRREQLTGDEAHER

SEQ ID NO: 1511393 - protein, 17 aa, Mycobacterium tuberculosis
VADLPFGSYEAGPTAAL

SEQ ID NO: 1511394 - protein, 23 aa, Mycobacterium tuberculosis
VAMTLDRSILRQLGMGRRTVVVT

SEQ ID NO: 1511395 - protein, 20 aa, Mycobacterium tuberculosis
VARFLPYFTDVIVGDLRVGK

SEQ ID NO: 1511396 - protein, 24 aa, Mycobacterium tuberculosis
VARLVSRLPAPLRRGQIRPLGLDR

SEQ ID NO: 1511397 - protein, 18 aa, Mycobacterium tuberculosis
VDGVPRTLRLDQLIRYYV

SEQ ID NO: 1511398 - protein, 33 aa, Mycobacterium tuberculosis
VDLHTTLSIGPFPFRWDYIPPTPANGPIPAVPG

SEQ ID NO: 1511399 - protein, 22 aa, Mycobacterium tuberculosis
VDLNYHIRPWRLRAPGGRRELD

SEQ ID NO: 1511400 - protein, 25 aa, Mycobacterium tuberculosis
VDSYADDWTQLWWVRADGVAAIHRD

SEQ ID NO: 1511401 - protein, 27 aa, Mycobacterium tuberculosis
VDTAGGFLIPAALDPAILLSGDGSTNP

SEQ ID NO: 1511402 - protein, 32 aa, Mycobacterium tuberculosis; identical to SEQ ID NO: 225720

SEQ ID NO: 1511403 - protein, 17 aa, Mycobacterium tuberculosis
VFANYSAGLKTSRDAWC

SEQ ID NO: 1511404 - protein, 17 aa, Mycobacterium tuberculosis
VFEHRAVVVGASREQLI

SEQ ID NO: 1511405 - protein, 25 aa, Mycobacterium tuberculosis
VGCALIEELVLAAPLVMHPGVGVQV

SEQ ID NO: 1511406 - protein, 19 aa, Mycobacterium tuberculosis
VGETAEFLRWTAGQALDAS

SEQ ID NO: 1511407 - protein, 17 aa, Mycobacterium tuberculosis
VGGWAAVQIGRRLARLA

SEQ ID NO: 1511408 - protein, 21 aa, Mycobacterium tuberculosis
VGKALYARRFTLPQALAAVRD

SEQ ID NO: 1511409 - protein, 17 aa, Mycobacterium tuberculosis
VGRLSVPAAWSTAAPAT

SEQ ID NO: 1511410 - protein, 17 aa, Mycobacterium tuberculosis
VGSYQRMATITDSFQQL

SEQ ID NO: 1511411 - protein, 32 aa, Mycobacterium tuberculosis
VGVFTATPLPLALAKLFWTARFNTSQPCEGQT

SEQ ID NO: 1511412 - protein, 17 aa, Mycobacterium tuberculosis
VHLPYDRPPLSKEVLRS

SEQ ID NO: 1511413 - protein, 25 aa, Mycobacterium tuberculosis
VHRVPSRMFPKVTTLPLGVPTFRML

SEQ ID NO: 1511414 - protein, 18 aa, Mycobacterium tuberculosis
VKVPYMPTDLPAWYDVAM

SEQ ID NO: 1511415 - protein, 26 aa, Mycobacterium tuberculosis
VLDELTLAAPLLLPATGSVAVQVVVD

SEQ ID NO: 1511416 - protein, 17 aa, Mycobacterium tuberculosis
VLEEAFRVLRPGGELIF

SEQ ID NO: 1511417 - protein, 26 aa, Mycobacterium tuberculosis
VLLLVAHHIAWDDGSWRVFFTDLTQA

SEQ ID NO: 1511418 - protein, 18 aa, Mycobacterium tuberculosis
VLVCPYHHRAHHRGLITI

SEQ ID NO: 1511419 - protein, 24 aa, Mycobacterium tuberculosis
VMENRWLPMKRTALALHHLVCTRF

SEQ ID NO: 1511420 - protein, 26 aa, Mycobacterium tuberculosis
VNLPNWLSLTFRIDGGAWFNVDTVEL

SEQ ID NO: 1511421 - protein, 40 aa, Mycobacterium tuberculosis; identical to SEQ ID NO: 224191

SEQ ID NO: 1511422 - protein, 21 aa, Mycobacterium tuberculosis
VPPMPVVDAIRRGAQAILPTP

SEQ ID NO: 1511423 - protein, 25 aa, Mycobacterium tuberculosis
VRGLPQLSSAPVWCSDIRAGAGLVL

SEQ ID NO: 1511424 - protein, 25 aa, Mycobacterium tuberculosis
VRGRRRICWQAYLGAETDSHPLGTL

SEQ ID NO: 1511425 - protein, 19 aa, Mycobacterium tuberculosis
VRRHRLLETFLVNELGYRW

SEQ ID NO: 1511426 - protein, 19 aa, Mycobacterium tuberculosis
VSFTPVLIPASRGILATCT

SEQ ID NO: 1511427 - protein, 27 aa, Mycobacterium tuberculosis
VSIERFLDTAWWVSDLPSARAFAAVWT

SEQ ID NO: 1511428 - protein, 34 aa, Mycobacterium tuberculosis; identical to SEQ ID NO: 224302

SEQ ID NO: 1511429 - protein, 17 aa, Mycobacterium tuberculosis
VVAAARWARSELDYIPG

SEQ ID NO: 1511430 - protein, 29 aa, Mycobacterium tuberculosis
VVAANRGLMQLLAATNWFGQNAPALMDVE

SEQ ID NO: 1511431 - protein, 17 aa, Mycobacterium tuberculosis
VVAMLRLVADPTAGAAA

SEQ ID NO: 1511432 - protein, 28 aa, Mycobacterium tuberculosis
VVDPQVHTLLDFHFRPHLTAASGKHGMG

SEQ ID NO: 1511433 - protein, 17 aa, Mycobacterium tuberculosis
VVLPPIPVPAVNAHLTG

SEQ ID NO: 1511434 - protein, 18 aa, Mycobacterium tuberculosis
VVRVLGAIEIPVVAQELA

SEQ ID NO: 1511435 - protein, 17 aa, Mycobacterium tuberculosis
VVWGLTTGSWIGSSAGL

SEQ ID NO: 1511436 - protein, 22 aa, Mycobacterium tuberculosis
VYRGAEYSVDFVPKVRIEVVVD

SEQ ID NO: 1511437 - protein, 20 aa, Mycobacterium tuberculosis
VYRLTVEGVLPMPQSTHYPL

SEQ ID NO: 1511438 - protein, 17 aa, Mycobacterium tuberculosis
WGAVPRVWEKLKAGIEF

SEQ ID NO: 1511439 - protein, 22 aa, Mycobacterium tuberculosis
YDQLRRYPWPQGHTMSVLSNAL

SEQ ID NO: 1511440 - protein, 17 aa, Mycobacterium tuberculosis
YEPFGLVALEAAAAGTP

SEQ ID NO: 1511441 - protein, 24 aa, Mycobacterium tuberculosis
YGKTNLIEALWYSTTLGSHRVSAD

SEQ ID NO: 1511442 - protein, 21 aa, Mycobacterium tuberculosis
YGRYWREVFRLPTMNHRKLAR

SEQ ID NO: 1511443 - protein, 17 aa, Mycobacterium tuberculosis
YLGPPPVPTSSPPTTPA

SEQ ID NO: 1511444 - protein, 34 aa, Mycobacterium tuberculosis; identical to SEQ ID NO: 224665

SEQ ID NO: 1511445 - protein, 18 aa, Mycobacterium tuberculosis
YVAAFNQGRNTGPTEGPA

SEQ ID NO: 1511446 - protein, 17 aa, Mycobacterium tuberculosis
YWRAIMADPPEPLELPG

SEQ ID NO: 1511447 - protein, 24 aa, Mycobacterium tuberculosis
AAAVDVTLLSRFYERFADHAVEVA

SEQ ID NO: 1511448 - protein, 21 aa, Mycobacterium tuberculosis
AADIIARRWGGGGRPLADIAG

SEQ ID NO: 1511449 - protein, 26 aa, Mycobacterium tuberculosis
AAEQLVPFQQALQQLPNLGIGNIGNA

SEQ ID NO: 1511450 - protein, 27 aa, Mycobacterium tuberculosis
AAGGLNWASLPLKLFAGGNAKFWDPAD

SEQ ID NO: 1511451 - protein, 18 aa, Mycobacterium tuberculosis
AAGGLQLLIIISAGRTIA

SEQ ID NO: 1511452 - protein, 18 aa, Mycobacterium tuberculosis
AALRAVPAERLWVNPDCG

SEQ ID NO: 1511453 - protein, 19 aa, Mycobacterium tuberculosis
AALWSDDLLTRVAIEPLDR

SEQ ID NO: 1511454 - protein, 18 aa, Mycobacterium tuberculosis
AAMRLRPGERHWMAFRQL

SEQ ID NO: 1511455 - protein, 19 aa, Mycobacterium tuberculosis
ADPYLWLEDVTGAEALDWV

SEQ ID NO: 1511456 - protein, 23 aa, Mycobacterium tuberculosis
ADTPPIYFGFGSMPIGSLADRVA

SEQ ID NO: 1511457 - protein, 17 aa, Mycobacterium tuberculosis
AEAAFVFAMIAVDLSRL

SEQ ID NO: 1511458 - protein, 25 aa, Mycobacterium tuberculosis
AEELDRHLRLPLRNVLWEGDEALLT

SEQ ID NO: 1511459 - protein, 25 aa, Mycobacterium tuberculosis
AETLLVVLCGVGFYIGFVGSYQRMA

SEQ ID NO: 1511460 - protein, 19 aa, Mycobacterium tuberculosis
AEWLVRQGVPFRSAHEAAG

SEQ ID NO: 1511461 - protein, 17 aa, Mycobacterium tuberculosis
AFGRSIGSFQNSRFLLA

SEQ ID NO: 1511462 - protein, 20 aa, Mycobacterium tuberculosis
AFLTSQKVRWAARASLDAAG

SEQ ID NO: 1511463 - protein, 27 aa, Mycobacterium tuberculosis
AGAGPISIPIIDLRPAPGFFNATTGPS

SEQ ID NO: 1511464 - protein, 18 aa, Mycobacterium tuberculosis
AGGLTIPTNAIPLTIDAS

SEQ ID NO: 1511465 - protein, 25 aa, Mycobacterium tuberculosis
AGLRAGIPTLILWVTSDQPIWAAQI

SEQ ID NO: 1511466 - protein, 26 aa, Mycobacterium tuberculosis
AGSRAAPLLRLPDVRALLDAQLAGRP

SEQ ID NO: 1511467 - protein, 25 aa, Mycobacterium tuberculosis
AGTSISGFFNFGSLMSGFANFDDEV

SEQ ID NO: 1511468 - protein, 23 aa, Mycobacterium tuberculosis
AGVVLLAGAAFVELALRAADQVD

SEQ ID NO: 1511469 - protein, 26 aa, Mycobacterium tuberculosis
AGVVSPGFIGAPLALAALGQMARGGT

SEQ ID NO: 1511470 - protein, 19 aa, Mycobacterium tuberculosis
AHATAWYGLNDLAQIKAGD

SEQ ID NO: 1511471 - protein, 22 aa, Mycobacterium tuberculosis
AHVRAWGPRAPFEVLLGKPRAG

SEQ ID NO: 1511472 - protein, 29 aa, Mycobacterium tuberculosis
AKKPEETRYWYYALLGFGLNRYRAGSGQP

SEQ ID NO: 1511473 - protein, 17 aa, Mycobacterium tuberculosis
AKMDDWLDASRALLTRI

SEQ ID NO: 1511474 - protein, 17 aa, Mycobacterium tuberculosis
AKRIAAIVASAIEYEIK

SEQ ID NO: 1511475 - protein, 17 aa, Mycobacterium tuberculosis
ALEIMLRIWTEDEPWEH

SEQ ID NO: 1511476 - protein, 27 aa, Mycobacterium tuberculosis
ALHSCSPDLPWDLLQRSRISAVSVDAS

SEQ ID NO: 1511477 - protein, 26 aa, Mycobacterium tuberculosis
ALLLASCLQPLWRARGRLQEGLAWFA

SEQ ID NO: 1511478 - protein, 17 aa, Mycobacterium tuberculosis
ALVGPCWPAVFAAIGSA

SEQ ID NO: 1511479 - protein, 19 aa, Mycobacterium tuberculosis
AMRQLLLDLLANNQDLAGK

SEQ ID NO: 1511480 - protein, 23 aa, Mycobacterium tuberculosis
ANHEYLGPVLWSPAGKPPTWWDS

SEQ ID NO: 1511481 - protein, 18 aa, Mycobacterium tuberculosis
ANHRYLGPVLWSPDVKPP

SEQ ID NO: 1511482 - protein, 24 aa, Mycobacterium tuberculosis
APAADLSVWPPLGAAPVDVDGAYQ

SEQ ID NO: 1511483 - protein, 26 aa, Mycobacterium tuberculosis
APARHLGGVLYLFVRGMCGAATPVTA

SEQ ID NO: 1511484 - protein, 24 aa, Mycobacterium tuberculosis
APLAQQGCIPLAIHPAMTFTGSDE

SEQ ID NO: 1511485 - protein, 17 aa, Mycobacterium tuberculosis
ARFGVPVPNLTAWRDAT

SEQ ID NO: 1511486 - protein, 17 aa, Mycobacterium tuberculosis
ARRGIRCHVLPASTTFE

SEQ ID NO: 1511487 - protein, 28 aa, Mycobacterium tuberculosis
ARTDLLAFTAFPKQIWRQIWSNNPQERL

SEQ ID NO: 1511488 - protein, 17 aa, Mycobacterium tuberculosis
ARVGWNRRQLSAVGGRG

SEQ ID NO: 1511489 - protein, 20 aa, Mycobacterium tuberculosis
ASEILVIADLARQKAQSAQY

SEQ ID NO: 1511490 - protein, 24 aa, Mycobacterium tuberculosis
ASGALDLALVFNEGPDYAAAGVFT

SEQ ID NO: 1511491 - protein, 19 aa, Mycobacterium tuberculosis
ASLFDPDSALRARTAVVCI

SEQ ID NO: 1511492 - protein, 25 aa, Mycobacterium tuberculosis
ATGARWLCETFPTCLERGAGIPAVE

SEQ ID NO: 1511493 - protein, 18 aa, Mycobacterium tuberculosis
AVEVARQLRRPRALATLD

SEQ ID NO: 1511494 - protein, 22 aa, Mycobacterium tuberculosis
AVGGLYVHWIVTGIAPGSGSTA

SEQ ID NO: 1511495 - protein, 18 aa, Mycobacterium tuberculosis
AVGYRWDPDTREIGAPLL

SEQ ID NO: 1511496 - protein, 23 aa, Mycobacterium tuberculosis
AVIARPPILPKPRNPRDDRILLE

SEQ ID NO: 1511497 - protein, 19 aa, Mycobacterium tuberculosis
AVLMLRHGLRFLTACQRRY

SEQ ID NO: 1511498 - protein, 30 aa, Mycobacterium tuberculosis; identical to SEQ ID NO: 216575

SEQ ID NO: 1511499 - protein, 20 aa, Mycobacterium tuberculosis
AVTVFLAPPSWQDLQARLIG

SEQ ID NO: 1511500 - protein, 24 aa, Mycobacterium tuberculosis
AYGDLSVLRRLVPAGPLASLAHST

SEQ ID NO: 1511501 - protein, 27 aa, Mycobacterium tuberculosis
AYNAGLPALKSFVLPGGSPLSALLHVA

SEQ ID NO: 1511502 - protein, 22 aa, Mycobacterium tuberculosis
DAILVPPGDGPWRLGLGSAGTF

SEQ ID NO: 1511503 - protein, 24 aa, Mycobacterium tuberculosis
DALKADGIVGVRLNWRHHGEGGEH

SEQ ID NO: 1511504 - protein, 21 aa, Mycobacterium tuberculosis
DCPPSLGVLTLNGLTAADEAI

SEQ ID NO: 1511505 - protein, 24 aa, Mycobacterium tuberculosis
DEMRGMCLYFDELPVIVLNGSDHP

SEQ ID NO: 1511506 - protein, 25 aa, Mycobacterium tuberculosis
DGGYLAILDIRPFTRGHTLVLPKRH

SEQ ID NO: 1511507 - protein, 23 aa, Mycobacterium tuberculosis
DGSPKILERCTLPLTGVGCVDRI

SEQ ID NO: 1511508 - protein, 29 aa, Mycobacterium tuberculosis
DHGRVVFTRAALPAIRPVNHLVVDGRVIG

SEQ ID NO: 1511509 - protein, 22 aa, Mycobacterium tuberculosis
DIRESIHLRALGRQNPLDEFHR

SEQ ID NO: 1511510 - protein, 18 aa, Mycobacterium tuberculosis
DKDDCAAIGLVKFDLLGL

SEQ ID NO: 1511511 - protein, 19 aa, Mycobacterium tuberculosis
DLVDGAPKPLLEKVAKEAA

SEQ ID NO: 1511512 - protein, 21 aa, Mycobacterium tuberculosis
DNRAYLVLPPGAGKTMIGLEA

SEQ ID NO: 1511513 - protein, 22 aa, Mycobacterium tuberculosis
DPARAARVLGFRAAVDPGEGLR

SEQ ID NO: 1511514 - protein, 21 aa, Mycobacterium tuberculosis
DPEAAFAHFGRRFDDLSTEIM

SEQ ID NO: 1511515 - protein, 21 aa, Mycobacterium tuberculosis
DPLCPFAYQTSVWIRDVRAQL

SEQ ID NO: 1511516 - protein, 17 aa, Mycobacterium tuberculosis
DPVMCFSGPMIFGAGVL

SEQ ID NO: 1511517 - protein, 20 aa, Mycobacterium tuberculosis
DQGLSLTLFFKDTATTRDVN

SEQ ID NO: 1511518 - protein, 25 aa, Mycobacterium tuberculosis
DQIAPLEMTKWFDTNYHYLVPEIGP

SEQ ID NO: 1511519 - protein, 30 aa, Mycobacterium tuberculosis; identical to SEQ ID NO: 217146

SEQ ID NO: 1511520 - protein, 18 aa, Mycobacterium tuberculosis
DQLGTGGFTGVFVLTAPQ

SEQ ID NO: 1511521 - protein, 20 aa, Mycobacterium tuberculosis
DRLRRWMAVAARIELRTGGA

SEQ ID NO: 1511522 - protein, 23 aa, Mycobacterium tuberculosis
DRPEDYWPEQWAHAYVDFAAGEK

SEQ ID NO: 1511523 - protein, 19 aa, Mycobacterium tuberculosis
DSMRAGLQALAWIAHQPEA

SEQ ID NO: 1511524 - protein, 27 aa, Mycobacterium tuberculosis
DSPRERPGRLLGFHWTKVHPDHPGLGE

SEQ ID NO: 1511525 - protein, 21 aa, Mycobacterium tuberculosis
DSRFTGVIRAFAGLYPGRKFG

SEQ ID NO: 1511526 - protein, 20 aa, Mycobacterium tuberculosis
DSRLPRWRAMAAHALCKRDD

SEQ ID NO: 1511527 - protein, 17 aa, Mycobacterium tuberculosis
DTELLGYYLPKGTNVIA

SEQ ID NO: 1511528 - protein, 28 aa, Mycobacterium tuberculosis
DTKADLPAFAELLARLPWPLNKTTSVNK

SEQ ID NO: 1511529 - protein, 25 aa, Mycobacterium tuberculosis
DTVARLIGPAALKYLLFSGELIGIE

SEQ ID NO: 1511530 - protein, 18 aa, Mycobacterium tuberculosis
DVLVQWAMFGRDPRHGTV

SEQ ID NO: 1511531 - protein, 27 aa, Mycobacterium tuberculosis
DVNISGGLPAFTLFAGGLTIPTNAIPL

SEQ ID NO: 1511532 - protein, 18 aa, Mycobacterium tuberculosis
DVPVLEVALRLGVGYVGA

SEQ ID NO: 1511533 - protein, 25 aa, Mycobacterium tuberculosis
EAKVVSERRLWLAVLRAQAELGVAV

SEQ ID NO: 1511534 - protein, 32 aa, Mycobacterium tuberculosis; identical to SEQ ID NO: 224955

SEQ ID NO: 1511535 - protein, 23 aa, Mycobacterium tuberculosis
EARYRRWLAALRGSARLVIGTRS

SEQ ID NO: 1511536 - protein, 29 aa, Mycobacterium tuberculosis
ECLAAIEAPLVITPWRSVLICDLDDATAD

SEQ ID NO: 1511537 - protein, 19 aa, Mycobacterium tuberculosis
EEFILTLDRNGLATAYLFR

SEQ ID NO: 1511538 - protein, 22 aa, Mycobacterium tuberculosis
EFLRWLAGVRFTGDVWAAPEGT

SEQ ID NO: 1511539 - protein, 24 aa, Mycobacterium tuberculosis
EHSAHYYFRDFWGADSGMLAALHV

SEQ ID NO: 1511540 - protein, 23 aa, Mycobacterium tuberculosis
EIALFTVTNPPRTVSVSTLMDGR

SEQ ID NO: 1511541 - protein, 23 aa, Mycobacterium tuberculosis
EINSLRMFIGAGTAPMLAAAAAW

SEQ ID NO: 1511542 - protein, 24 aa, Mycobacterium tuberculosis
EINTRGDIILFIDELHTLVGAGAA

SEQ ID NO: 1511543 - protein, 19 aa, Mycobacterium tuberculosis
EIRPAHLLMALLTQNDGIA

SEQ ID NO: 1511544 - protein, 25 aa, Mycobacterium tuberculosis
EITIPQLPLGLALSGATPAFAFPLE

SEQ ID NO: 1511545 - protein, 21 aa, Mycobacterium tuberculosis
EKYYRTLDPFVALAAAAATTQ

SEQ ID NO: 1511546 - protein, 18 aa, Mycobacterium tuberculosis
ELRRIAALCAAFDVDGMR

SEQ ID NO: 1511547 - protein, 19 aa, Mycobacterium tuberculosis
ELRRRRWSLCPAKRDNSVS

SEQ ID NO: 1511548 - protein, 18 aa, Mycobacterium tuberculosis
EMGIRVRYLHSEVDTLRR

SEQ ID NO: 1511549 - protein, 21 aa, Mycobacterium tuberculosis
ENLQPLIFGLSQMISDYNAAR

SEQ ID NO: 1511550 - protein, 21 aa, Mycobacterium tuberculosis
EPLDADAWFDTVRRAAPFATL

SEQ ID NO: 1511551 - protein, 19 aa, Mycobacterium tuberculosis
EPVIWQLVDEDAPLRPRSL

SEQ ID NO: 1511552 - protein, 20 aa, Mycobacterium tuberculosis
EQYWAAAGRPGPVPLALGPV

SEQ ID NO: 1511553 - protein, 29 aa, Mycobacterium tuberculosis
ERLETICRQIMLYHLDRGWADHLAYLADI

SEQ ID NO: 1511554 - protein, 31 aa, Mycobacterium tuberculosis; identical to SEQ ID NO: 217799

SEQ ID NO: 1511555 - protein, 29 aa, Mycobacterium tuberculosis
EVLRLRWRPGCMPLPQRVIRARVRGRQVY

SEQ ID NO: 1511556 - protein, 23 aa, Mycobacterium tuberculosis
EVNSLRMYLGAGSGPMLAAAAAW

SEQ ID NO: 1511557 - protein, 18 aa, Mycobacterium tuberculosis
EYVLPTFRMFGMTKFYKH

SEQ ID NO: 1511558 - protein, 22 aa, Mycobacterium tuberculosis
FAFSHRSYLDGMLLPEAILANR

SEQ ID NO: 1511559 - protein, 17 aa, Mycobacterium tuberculosis
FDHVVPPTPPPGTPGEF

SEQ ID NO: 1511560 - protein, 26 aa, Mycobacterium tuberculosis
FGQSGGFIWVDPKADLALVVLTARDF

SEQ ID NO: 1511561 - protein, 19 aa, Mycobacterium tuberculosis
FGVHPALLDAVLHAVVIAG

SEQ ID NO: 1511562 - protein, 27 aa, Mycobacterium tuberculosis
FMSVGQTLFLFDFRDGIELNPIVIPGS

SEQ ID NO: 1511563 - protein, 17 aa, Mycobacterium tuberculosis
FQLYMWRDRDRSMALVR

SEQ ID NO: 1511564 - protein, 17 aa, Mycobacterium tuberculosis
FSSKLELYLAVLHRHVE

SEQ ID NO: 1511565 - protein, 24 aa, Mycobacterium tuberculosis
GAFQFLLYVVVVDLPTHIAQIATW

SEQ ID NO: 1511566 - protein, 26 aa, Mycobacterium tuberculosis
GARYTWPRFVCALPKEFFAAVRAELA

SEQ ID NO: 1511567 - protein, 23 aa, Mycobacterium tuberculosis
GATVDPVLWRTASLVGARVDVDQ

SEQ ID NO: 1511568 - protein, 20 aa, Mycobacterium tuberculosis
GDIPLLLEMPMVYTGRALTQ

SEQ ID NO: 1511569 - protein, 18 aa, Mycobacterium tuberculosis
GDLQTLEFAAFDRVPPGP

SEQ ID NO: 1511570 - protein, 22 aa, Mycobacterium tuberculosis
GDRLLTELGWALRRAPLPPTGP

SEQ ID NO: 1511571 - protein, 20 aa, Mycobacterium tuberculosis
GEHLAMLRRLMMDDSFFRGE

SEQ ID NO: 1511572 - protein, 22 aa, Mycobacterium tuberculosis
GEQTIIEYPNPAPLKATLVARR

SEQ ID NO: 1511573 - protein, 19 aa, Mycobacterium tuberculosis
GFRVPCLVISPYSRGPLMV

SEQ ID NO: 1511574 - protein, 19 aa, Mycobacterium tuberculosis
GGALLLEPGTLATLGAAAG

SEQ ID NO: 1511575 - protein, 18 aa, Mycobacterium tuberculosis
GGKTPINFINVQRALIDD

SEQ ID NO: 1511576 - protein, 19 aa, Mycobacterium tuberculosis
GIPAVERLAYFAEGAAAQL

SEQ ID NO: 1511577 - protein, 24 aa, Mycobacterium tuberculosis
GITPAFQLLVYPMLDDRPSIAPAN

SEQ ID NO: 1511578 - protein, 22 aa, Mycobacterium tuberculosis
GKLRPPVFGILRYITDAVDEID

SEQ ID NO: 1511579 - protein, 26 aa, Mycobacterium tuberculosis
GLALSPTLIFDYPNSAALAGYMRREL

SEQ ID NO: 1511580 - protein, 18 aa, Mycobacterium tuberculosis
GLFLNWVDRVIGPGDPAL

SEQ ID NO: 1511581 - protein, 25 aa, Mycobacterium tuberculosis
GLGATFRRFCRCSVSIESIANARSK

SEQ ID NO: 1511582 - protein, 26 aa, Mycobacterium tuberculosis
GLSFSGLLGAVYFPGILSLLQDDMPF

SEQ ID NO: 1511583 - protein, 26 aa, Mycobacterium tuberculosis
GMNEIVFPAAILQPPFFDPQADEAAN

SEQ ID NO: 1511584 - protein, 22 aa, Mycobacterium tuberculosis
GNAGLLAVRMLGAANPQLRARI

SEQ ID NO: 1511585 - protein, 19 aa, Mycobacterium tuberculosis
GPHWRLLSAVKELDPSWAR

SEQ ID NO: 1511586 - protein, 22 aa, Mycobacterium tuberculosis
GPLTAQFYNQFDPKTAVLNWKG

SEQ ID NO: 1511587 - protein, 18 aa, Mycobacterium tuberculosis
GPPVGGLLFTCNGRGRRM

SEQ ID NO: 1511588 - protein, 22 aa, Mycobacterium tuberculosis
GQVMMPAFDIGDAGRMSFITDP

SEQ ID NO: 1511589 - protein, 17 aa, Mycobacterium tuberculosis
GRLTGVTALSPVAPLDE

SEQ ID NO: 1511590 - protein, 39 aa, Mycobacterium tuberculosis; identical to SEQ ID NO: 218831

SEQ ID NO: 1511591 - protein, 20 aa, Mycobacterium tuberculosis
GSQWLGMGMGLHAGYPVFAE

SEQ ID NO: 1511592 - protein, 19 aa, Mycobacterium tuberculosis
GTENLRRIEPLLATLRAIA

SEQ ID NO: 1511593 - protein, 21 aa, Mycobacterium tuberculosis
GTNIAGLLRDGAGTAAINLGL

SEQ ID NO: 1511594 - protein, 24 aa, Mycobacterium tuberculosis
GVLRLRALMESFWSDELDRLVADA

SEQ ID NO: 1511595 - protein, 18 aa, Mycobacterium tuberculosis
GVPILDEDGFRRLLADGP

SEQ ID NO: 1511596 - protein, 24 aa, Mycobacterium tuberculosis
GVTHVLLPVSALLRRADTAAVIVS

SEQ ID NO: 1511597 - protein, 24 aa, Mycobacterium tuberculosis
HAGRGSYPWLPTDNANWHMIGVEC

SEQ ID NO: 1511598 - protein, 20 aa, Mycobacterium tuberculosis
HRLAVLVVSAIPLAEPVRLA

SEQ ID NO: 1511599 - protein, 18 aa, Mycobacterium tuberculosis
HVLLQRDVHYIVRDDAVH

SEQ ID NO: 1511600 - protein, 18 aa, Mycobacterium tuberculosis
HYSWRIMPENLEDAGVSW

SEQ ID NO: 1511601 - protein, 18 aa, Mycobacterium tuberculosis
IAQLQRWPDGLQAAVEAK

SEQ ID NO: 1511602 - protein, 22 aa, Mycobacterium tuberculosis
IARAHLLLRFDRGNWIAIDNDS

SEQ ID NO: 1511603 - protein, 28 aa, Mycobacterium tuberculosis
IARVISDVWLSNLLAWLTRRASATDVSK

SEQ ID NO: 1511604 - protein, 19 aa, Mycobacterium tuberculosis
ICDHVRLEILYSANSATDY

SEQ ID NO: 1511605 - protein, 27 aa, Mycobacterium tuberculosis
IDPDAVELPAWYRPNPGLARDLAFIAF

SEQ ID NO: 1511606 - protein, 17 aa, Mycobacterium tuberculosis
IERATKILGLLTAAPKS

SEQ ID NO: 1511607 - protein, 31 aa, Mycobacterium tuberculosis
IERSTALLDLGWTIIRVTSELLWYRRGTFVG

SEQ ID NO: 1511608 - protein, 40 aa, Mycobacterium tuberculosis; identical to SEQ ID NO: 219411

SEQ ID NO: 1511609 - protein, 22 aa, Mycobacterium tuberculosis
IKAHAIALAETLPTACVLGDVD

SEQ ID NO: 1511610 - protein, 17 aa, Mycobacterium tuberculosis
ILVDRAVAELALLAAAE

SEQ ID NO: 1511611 - protein, 17 aa, Mycobacterium tuberculosis
IPDRGLFAVYLATERPS

SEQ ID NO: 1511612 - protein, 23 aa, Mycobacterium tuberculosis
IPPGTGWRKFVYSVSFHKINPGE

SEQ ID NO: 1511613 - protein, 24 aa, Mycobacterium tuberculosis
IQPTQLLRVWVRDVRRLTPGHAAA

SEQ ID NO: 1511614 - protein, 17 aa, Mycobacterium tuberculosis
IRPYERLLYAGLVGDHQ

SEQ ID NO: 1511615 - protein, 18 aa, Mycobacterium tuberculosis
ISPHPSAGIPALAVPHIR

SEQ ID NO: 1511616 - protein, 18 aa, Mycobacterium tuberculosis
ITAIDWLYWRMTKGVEDA

SEQ ID NO: 1511617 - protein, 17 aa, Mycobacterium tuberculosis
ITGYRFDRTAHDLHLLL

SEQ ID NO: 1511618 - protein, 18 aa, Mycobacterium tuberculosis
ITPGYDLCYLIGSRAETF

SEQ ID NO: 1511619 - protein, 25 aa, Mycobacterium tuberculosis
KDIEDLTFALNLGVDMVALSFVRSP

SEQ ID NO: 1511620 - protein, 21 aa, Mycobacterium tuberculosis
KGMLTGPVTILAWSFVRDDQP

SEQ ID NO: 1511621 - protein, 26 aa, Mycobacterium tuberculosis
KIGYPPTRVWGVPAAGLWAHRLGDQR

SEQ ID NO: 1511622 - protein, 17 aa, Mycobacterium tuberculosis
KISPPDLSALTVSVDPI

SEQ ID NO: 1511623 - protein, 21 aa, Mycobacterium tuberculosis
KLAPQRLIVVLGHDHQRIAPL

SEQ ID NO: 1511624 - protein, 37 aa, Mycobacterium tuberculosis; identical to SEQ ID NO: 219702

SEQ ID NO: 1511625 - protein, 21 aa, Mycobacterium tuberculosis
KPVLYQHFSSKLELYLAVLHR

SEQ ID NO: 1511626 - protein, 28 aa, Mycobacterium tuberculosis
KRGAIELAWALLTNSLAAGGYGLDPERI

SEQ ID NO: 1511627 - protein, 20 aa, Mycobacterium tuberculosis
KTLGVPLFQEQLMQLAVDCA

SEQ ID NO: 1511628 - protein, 23 aa, Mycobacterium tuberculosis
KTLTCVLPAYLNALAGNGVHIVT

SEQ ID NO: 1511629 - protein, 18 aa, Mycobacterium tuberculosis
LAAFTAIVPCGISDAAVT

SEQ ID NO: 1511630 - protein, 22 aa, Mycobacterium tuberculosis
LAAMPGNVFLPATTTRLPRDSV

SEQ ID NO: 1511631 - protein, 27 aa, Mycobacterium tuberculosis
LAEIDEFGFPVAPWMFGAAGREHMKKY

SEQ ID NO: 1511632 - protein, 21 aa, Mycobacterium tuberculosis
LAERNGVPVRALWASSGQAPS

SEQ ID NO: 1511633 - protein, 22 aa, Mycobacterium tuberculosis
LAGQAWQGPAALAMAAAAAPYA

SEQ ID NO: 1511634 - protein, 19 aa, Mycobacterium tuberculosis
LAGTPPPPHYPQHHPRQPL

SEQ ID NO: 1511635 - protein, 25 aa, Mycobacterium tuberculosis
LAMAAAAAPYAGWLTAAAAQSAGAA

SEQ ID NO: 1511636 - protein, 26 aa, Mycobacterium tuberculosis
LAPELARALLPMHDTPLGPAAAALTL

SEQ ID NO: 1511637 - protein, 48 aa, Mycobacterium tuberculosis; identical to SEQ ID NO: 219905

SEQ ID NO: 1511638 - protein, 19 aa, Mycobacterium tuberculosis
LARAVRIGDWPAAYAIGEH

SEQ ID NO: 1511639 - protein, 25 aa, Mycobacterium tuberculosis
LARKMTFRALYRLERHQLLDCPILG

SEQ ID NO: 1511640 - protein, 19 aa, Mycobacterium tuberculosis
LASLGTGGAYFFRQLTHDG

SEQ ID NO: 1511641 - protein, 18 aa, Mycobacterium tuberculosis
LAVYAHCARHAPTDPVHW

SEQ ID NO: 1511642 - protein, 28 aa, Mycobacterium tuberculosis
LDALARAGFHTLKLQTFLTAGPKEARAW

SEQ ID NO: 1511643 - protein, 19 aa, Mycobacterium tuberculosis
LDCGTPVNGPLFSNILNDV

SEQ ID NO: 1511644 - protein, 25 aa, Mycobacterium tuberculosis
LDEVDGYVWHAYLPNITPGQRYGFR

SEQ ID NO: 1511645 - protein, 22 aa, Mycobacterium tuberculosis
LDGGFGPVVLPPIPVPAVNAHL

SEQ ID NO: 1511646 - protein, 35 aa, Mycobacterium tuberculosis; identical to SEQ ID NO: 220008

SEQ ID NO: 1511647 - protein, 17 aa, Mycobacterium tuberculosis
LEAQGLFFPGGHCRGVC

SEQ ID NO: 1511648 - protein, 21 aa, Mycobacterium tuberculosis
LELYLAVLHRHVENLVSGVHQ

SEQ ID NO: 1511649 - protein, 17 aa, Mycobacterium tuberculosis
LFAFGKVMSGGMPAAAF

SEQ ID NO: 1511650 - protein, 22 aa, Mycobacterium tuberculosis
LFGSGQMQLPFVLQSAEVMKAA

SEQ ID NO: 1511651 - protein, 18 aa, Mycobacterium tuberculosis
LGGLGLVVARWLVDRGAG

SEQ ID NO: 1511652 - protein, 23 aa, Mycobacterium tuberculosis
LIGDRLPMDKLLAGVAHVVHEMH

SEQ ID NO: 1511653 - protein, 17 aa, Mycobacterium tuberculosis
LIRKSGAWFTYEGEQLG

SEQ ID NO: 1511654 - protein, 20 aa, Mycobacterium tuberculosis
LIVERMFAQLVAIAIKRGSD

SEQ ID NO: 1511655 - protein, 28 aa, Mycobacterium tuberculosis
LLDDSAFFCPFVPFFDPRMGRPSIPMET

SEQ ID NO: 1511656 - protein, 17 aa, Mycobacterium tuberculosis
LLQPATMALIADRLVPS

SEQ ID NO: 1511657 - protein, 17 aa, Mycobacterium tuberculosis
LPRLFVVTRQAQIVKPH

SEQ ID NO: 1511658 - protein, 17 aa, Mycobacterium tuberculosis
LPVHDHMAIADVARVVA

SEQ ID NO: 1511659 - protein, 17 aa, Mycobacterium tuberculosis
LQVIEKSFPAGYHVGRA

SEQ ID NO: 1511660 - protein, 24 aa, Mycobacterium tuberculosis
LRDLLKFEFLFSGRAQFEKDLANE

SEQ ID NO: 1511661 - protein, 24 aa, Mycobacterium tuberculosis
LRDTLAAHPGTSLILLDTASDPRK

SEQ ID NO: 1511662 - protein, 21 aa, Mycobacterium tuberculosis
LRLFKALVDAASGYAGRQSQA

SEQ ID NO: 1511663 - protein, 18 aa, Mycobacterium tuberculosis
LRMGLPVLAVVAFAQSFG

SEQ ID NO: 1511664 - protein, 18 aa, Mycobacterium tuberculosis
LRMTMAPVQRTWPELIPL

SEQ ID NO: 1511665 - protein, 29 aa, Mycobacterium tuberculosis
LRRHGARRMVIAPWLLAPGILSDRVRGYA

SEQ ID NO: 1511666 - protein, 17 aa, Mycobacterium tuberculosis
LSAAGLPAPKYGTATTF

SEQ ID NO: 1511667 - protein, 29 aa, Mycobacterium tuberculosis
LSDGFRVPGLPMPSLPVIGGDAAAACIAA

SEQ ID NO: 1511668 - protein, 26 aa, Mycobacterium tuberculosis
LSDQEIMAFLFLMVIAGNETTTKLLA

SEQ ID NO: 1511669 - protein, 21 aa, Mycobacterium tuberculosis
LSGLRVVELAGIGPGPHAAMI

SEQ ID NO: 1511670 - protein, 19 aa, Mycobacterium tuberculosis
LSGWWNQAASALAGSGSGV

SEQ ID NO: 1511671 - protein, 23 aa, Mycobacterium tuberculosis
LSPIDYRQYVLPHSARVFAALGE

SEQ ID NO: 1511672 - protein, 26 aa, Mycobacterium tuberculosis
LSVPPSWTAAAPLASPLGSALGGTPM

SEQ ID NO: 1511673 - protein, 19 aa, Mycobacterium tuberculosis
LTEALAEYWHRRIREELKF

SEQ ID NO: 1511674 - protein, 17 aa, Mycobacterium tuberculosis
LTKYDDVFYASRHPDIF

SEQ ID NO: 1511675 - protein, 19 aa, Mycobacterium tuberculosis
LTSPDRMYFPKLGSHGTKR

SEQ ID NO: 1511676 - protein, 17 aa, Mycobacterium tuberculosis
LVFTRDSSIWIGPRVVI

SEQ ID NO: 1511677 - protein, 17 aa, Mycobacterium tuberculosis
LVRLRAVLPLIDGGAES

SEQ ID NO: 1511678 - protein, 33 aa, Mycobacterium tuberculosis; identical to SEQ ID NO: 220581

SEQ ID NO: 1511679 - protein, 24 aa, Mycobacterium tuberculosis
LWYCGPWTLWVMAGRGVASGAGVW

SEQ ID NO: 1511680 - protein, 19 aa, Mycobacterium tuberculosis
LYQYAWTRDRLLIVTLADV

SEQ ID NO: 1511681 - protein, 26 aa, Mycobacterium tuberculosis
MDDLHRHLFTVLMDREWKHGVAAAVD

SEQ ID NO: 1511682 - protein, 17 aa, Mycobacterium tuberculosis
MHDTPLGPAAAALTLRQ

SEQ ID NO: 1511683 - protein, 18 aa, Mycobacterium tuberculosis
MIVDPRRRIEVARSLERE

SEQ ID NO: 1511684 - protein, 19 aa, Mycobacterium tuberculosis
MLAAAAAWDGLAEELGTAA

SEQ ID NO: 1511685 - protein, 19 aa, Mycobacterium tuberculosis
MLFRKHLVMFGPREVLLTS

SEQ ID NO: 1511686 - protein, 33 aa, Mycobacterium tuberculosis
MLVAGEDPRFIARRLMILASEDIGMAGPSALQV

SEQ ID NO: 1511687 - protein, 26 aa, Mycobacterium tuberculosis
MPSTPSNYFHLLRRHALDGIQRPLIV

SEQ ID NO: 1511688 - protein, 21 aa, Mycobacterium tuberculosis
MRACRPITVPLTQAQGLVLGG

SEQ ID NO: 1511689 - protein, 17 aa, Mycobacterium tuberculosis
NALIRPLSAYCGHEQRV

SEQ ID NO: 1511690 - protein, 20 aa, Mycobacterium tuberculosis
NDCPVVIDFIVGADAQVWPM

SEQ ID NO: 1511691 - protein, 22 aa, Mycobacterium tuberculosis
NEELISILGGETRELAFAKTPP

SEQ ID NO: 1511692 - protein, 23 aa, Mycobacterium tuberculosis
NGEIAFPARLPAPLVRSTITAID

SEQ ID NO: 1511693 - protein, 29 aa, Mycobacterium tuberculosis
NGFSPAAIKALWDTILPFADYAFNKSHAA

SEQ ID NO: 1511694 - protein, 19 aa, Mycobacterium tuberculosis
NHNYIGTEHILLGLIHEGE

SEQ ID NO: 1511695 - protein, 21 aa, Mycobacterium tuberculosis
NLAIAQELLKAAAAAKIILEI

SEQ ID NO: 1511696 - protein, 26 aa, Mycobacterium tuberculosis
NNRRRARVHGFRLRMRTRAGRSIVSS

SEQ ID NO: 1511697 - protein, 27 aa, Mycobacterium tuberculosis
NSGNYSNGFFWRGDYQGLGGFAYQSAV

SEQ ID NO: 1511698 - protein, 17 aa, Mycobacterium tuberculosis
NSSMVTNWTVAPAGPGS

SEQ ID NO: 1511699 - protein, 25 aa, Mycobacterium tuberculosis
NVADGDAALALLRAELRPGDVVLVK

SEQ ID NO: 1511700 - protein, 28 aa, Mycobacterium tuberculosis
PADFPDDIAHYLWTWTDRSAGSLRARMF

SEQ ID NO: 1511701 - protein, 22 aa, Mycobacterium tuberculosis
PATVLPAIPLNVDVTIPVGPIN

SEQ ID NO: 1511702 - protein, 24 aa, Mycobacterium tuberculosis
PAVTLSWIREFPSLGAAAYPVQRR

SEQ ID NO: 1511703 - protein, 26 aa, Mycobacterium tuberculosis
PCQVRVPVPTLLLADVLAAAPAEFVP

SEQ ID NO: 1511704 - protein, 19 aa, Mycobacterium tuberculosis
PCWLVGLLFPSADGCAGHS

SEQ ID NO: 1511705 - protein, 18 aa, Mycobacterium tuberculosis
PFYTGKQKILDSGGRVAR

SEQ ID NO: 1511706 - protein, 19 aa, Mycobacterium tuberculosis
PGDWSVFDALAKMAGEVMP

SEQ ID NO: 1511707 - protein, 17 aa, Mycobacterium tuberculosis
PGELLLYVFGRRAVARV

SEQ ID NO: 1511708 - protein, 28 aa, Mycobacterium tuberculosis
PGTIEMADWWAYLNGVRKTYPLSYGPQS

SEQ ID NO: 1511709 - protein, 21 aa, Mycobacterium tuberculosis
PKAHWQKIWSTNPLERINKEI

SEQ ID NO: 1511710 - protein, 17 aa, Mycobacterium tuberculosis
PPGVRRPAGIPADAPVI

SEQ ID NO: 1511711 - protein, 17 aa, Mycobacterium tuberculosis
PPVLTYRCPTQDGPLTA

SEQ ID NO: 1511712 - protein, 20 aa, Mycobacterium tuberculosis
PRIAGPCGMVIFGVTGDLAR

SEQ ID NO: 1511713 - protein, 20 aa, Mycobacterium tuberculosis
PRPCPFGRSHSCQIRVAPPP

SEQ ID NO: 1511714 - protein, 23 aa, Mycobacterium tuberculosis
PTEAVFAPISWLGDVLQFGVPEG

SEQ ID NO: 1511715 - protein, 19 aa, Mycobacterium tuberculosis
PYGPVVYLDLRHLGADLID

SEQ ID NO: 1511716 - protein, 20 aa, Mycobacterium tuberculosis
PYGVRPLSLGRLDRGWVVAS

SEQ ID NO: 1511717 - protein, 18 aa, Mycobacterium tuberculosis
QDFGPIQTLFTDAGLLDN

SEQ ID NO: 1511718 - protein, 23 aa, Mycobacterium tuberculosis
QDMVTLLRSGFAPVAFVMGNCVF

SEQ ID NO: 1511719 - protein, 20 aa, Mycobacterium tuberculosis
QDTFYIAPEDSRQLLRTHTS

SEQ ID NO: 1511720 - protein, 20 aa, Mycobacterium tuberculosis
QKLLIGLLRDHGGQATVWDK

SEQ ID NO: 1511721 - protein, 22 aa, Mycobacterium tuberculosis
QLAGLARYPQPMAPAAAAEHAG

SEQ ID NO: 1511722 - protein, 28 aa, Mycobacterium tuberculosis
QLGKGGGRLPITLWIVDTNASTPAPAAN

SEQ ID NO: 1511723 - protein, 17 aa, Mycobacterium tuberculosis
QPARLPFWRGDDAGRPA

SEQ ID NO: 1511724 - protein, 38 aa, Mycobacterium tuberculosis
QPDPDLLEEAKRWAYYPWRRMVVAILGLRGFRAVRLDR

SEQ ID NO: 1511725 - protein, 26 aa, Mycobacterium tuberculosis
QPDVIVLGLARGGLPVAWEVAAALHA

SEQ ID NO: 1511726 - protein, 22 aa, Mycobacterium tuberculosis
QRWLADHVIAGVVLLAGAAFVE

SEQ ID NO: 1511727 - protein, 31 aa, Mycobacterium tuberculosis; identical to SEQ ID NO: 221817

SEQ ID NO: 1511728 - protein, 17 aa, Mycobacterium tuberculosis
QSAQYAFILDRMSQQVD

SEQ ID NO: 1511729 - protein, 27 aa, Mycobacterium tuberculosis
QSGDGPPIFLLSLKAGGTGLNLTAANH

SEQ ID NO: 1511730 - protein, 18 aa, Mycobacterium tuberculosis
QSTFRRIYRSREAEVTLV

SEQ ID NO: 1511731 - protein, 19 aa, Mycobacterium tuberculosis
QTGLLPHLNPGVMSWSEMS

SEQ ID NO: 1511732 - protein, 28 aa, Mycobacterium tuberculosis
QTREHVLLARQVGVPYILVALNKADAVD

SEQ ID NO: 1511733 - protein, 19 aa, Mycobacterium tuberculosis
QYAFILDRMSQQVDADEHR

SEQ ID NO: 1511734 - protein, 20 aa, Mycobacterium tuberculosis
RAEFQRITQDLLDRTRKPFQ

SEQ ID NO: 1511735 - protein, 19 aa, Mycobacterium tuberculosis
RAKALWLRSRRRGVLAGYS

SEQ ID NO: 1511736 - protein, 26 aa, Mycobacterium tuberculosis
RAPADLLSGYYHAVHKLTLEYIAGMT

SEQ ID NO: 1511737 - protein, 19 aa, Mycobacterium tuberculosis
RAWHAYFRDARRAHALYTD

SEQ ID NO: 1511738 - protein, 19 aa, Mycobacterium tuberculosis
RAYLDFGEPLPLRKRLQEM

SEQ ID NO: 1511739 - protein, 25 aa, Mycobacterium tuberculosis
RDGAEWIHLVDLDAAFGRGSNHELL

SEQ ID NO: 1511740 - protein, 19 aa, Mycobacterium tuberculosis
RDIGLGPMPLNGSGRLLVA

SEQ ID NO: 1511741 - protein, 23 aa, Mycobacterium tuberculosis
RDPHRHELRSYRIVDGAVTEEPV

SEQ ID NO: 1511742 - protein, 17 aa, Mycobacterium tuberculosis
RERILVTHPLQPFDRKN

SEQ ID NO: 1511743 - protein, 22 aa, Mycobacterium tuberculosis
RFDAEVYARRLALAAAATADAG

SEQ ID NO: 1511744 - protein, 18 aa, Mycobacterium tuberculosis
RFTASRLFGAPPGYVGYE

SEQ ID NO: 1511745 - protein, 19 aa, Mycobacterium tuberculosis
RFTTDFPLSDGTPAPVLEL

SEQ ID NO: 1511746 - protein, 20 aa, Mycobacterium tuberculosis
RGHVIYRTELYERATAQRFA

SEQ ID NO: 1511747 - protein, 27 aa, Mycobacterium tuberculosis
RGVASVAFLPWPLRAVAGPFNLFATTG

SEQ ID NO: 1511748 - protein, 18 aa, Mycobacterium tuberculosis
RHRGLDVVRLGPALWGDL

SEQ ID NO: 1511749 - protein, 30 aa, Mycobacterium tuberculosis; identical to SEQ ID NO: 222217

SEQ ID NO: 1511750 - protein, 18 aa, Mycobacterium tuberculosis
RIISVVPVVLEVRRAEPA

SEQ ID NO: 1511751 - protein, 23 aa, Mycobacterium tuberculosis
RLAHVHLSRRLAHWTRLYPEVRV

SEQ ID NO: 1511752 - protein, 26 aa, Mycobacterium tuberculosis
RLDGLDSLLSIVQMPAGVPVATVSIG

SEQ ID NO: 1511753 - protein, 18 aa, Mycobacterium tuberculosis
RLIAGLDDAVVGLSADES

SEQ ID NO: 1511754 - protein, 17 aa, Mycobacterium tuberculosis
RLLPALIDGTLTAGVGL

SEQ ID NO: 1511755 - protein, 24 aa, Mycobacterium tuberculosis
RLPKVSWVLPGFLLSEHPAFPVNV

SEQ ID NO: 1511756 - protein, 27 aa, Mycobacterium tuberculosis
RLQADLLGPVDLPPGVRRPAGIPADAP

SEQ ID NO: 1511757 - protein, 19 aa, Mycobacterium tuberculosis
RLRGQGHTPLLVACDLQRP

SEQ ID NO: 1511758 - protein, 30 aa, Mycobacterium tuberculosis; identical to SEQ ID NO: 222369

SEQ ID NO: 1511759 - protein, 18 aa, Mycobacterium tuberculosis
RMLPLADRVLELMPAQVS

SEQ ID NO: 1511760 - protein, 25 aa, Mycobacterium tuberculosis
RNHIARRLFVPPPDPVAVLRELVLL

SEQ ID NO: 1511761 - protein, 19 aa, Mycobacterium tuberculosis
RQFYQLGVSPIPPNKPNIR

SEQ ID NO: 1511762 - protein, 22 aa, Mycobacterium tuberculosis
RQGSFLGYRVTVCDARAVFATP

SEQ ID NO: 1511763 - protein, 20 aa, Mycobacterium tuberculosis
RSRATLRRLYAHPQAGALVS

SEQ ID NO: 1511764 - protein, 23 aa, Mycobacterium tuberculosis
RTHRKALAAFTKSGGRLVESVSA

SEQ ID NO: 1511765 - protein, 20 aa, Mycobacterium tuberculosis
RTRLTDRPVRHLPIVRGATV

SEQ ID NO: 1511766 - protein, 18 aa, Mycobacterium tuberculosis
RVAWWALCTDFDVPRSMG

SEQ ID NO: 1511767 - protein, 17 aa, Mycobacterium tuberculosis
RVLAPLGLVFDENSPWL

SEQ ID NO: 1511768 - protein, 19 aa, Mycobacterium tuberculosis
RVRDPRLRRALTPDYEPMC

SEQ ID NO: 1511769 - protein, 22 aa, Mycobacterium tuberculosis
RVSPYPAVFQDVSLVVAADIPA

SEQ ID NO: 1511770 - protein, 29 aa, Mycobacterium tuberculosis
RVTIDRILGEPITLLGYAPETIIAEKGVT

SEQ ID NO: 1511771 - protein, 18 aa, Mycobacterium tuberculosis
RVWVMNRLREKMPHVYVT

SEQ ID NO: 1511772 - protein, 18 aa, Mycobacterium tuberculosis
RYAQRYRTPRPNPRRVVI

SEQ ID NO: 1511773 - protein, 17 aa, Mycobacterium tuberculosis
RYLVHFTQSGIGLPDES

SEQ ID NO: 1511774 - protein, 25 aa, Mycobacterium tuberculosis
SAAAAALPAFSPPAQALGGGVGAFL

SEQ ID NO: 1511775 - protein, 26 aa, Mycobacterium tuberculosis
SAAKKFYTSLFGWGYDDNPVPGGGGV

SEQ ID NO: 1511776 - protein, 31 aa, Mycobacterium tuberculosis; identical to SEQ ID NO: 222781

SEQ ID NO: 1511777 - protein, 25 aa, Mycobacterium tuberculosis
SDHPRPRLFSLLHEFVHVVLHTEGL

SEQ ID NO: 1511778 - protein, 19 aa, Mycobacterium tuberculosis
SGVLRVPPRPYVMPHSPAA

SEQ ID NO: 1511779 - protein, 29 aa, Mycobacterium tuberculosis
SGVWELFWPDFPCDGLYKFRVHGADGVVT

SEQ ID NO: 1511780 - protein, 18 aa, Mycobacterium tuberculosis
SHPPNPKATIALLRRVED

SEQ ID NO: 1511781 - protein, 33 aa, Mycobacterium tuberculosis; identical to SEQ ID NO: 222973

SEQ ID NO: 1511782 - protein, 21 aa, Mycobacterium tuberculosis
SNYAWGVHTVEFYTAGTAVRR

SEQ ID NO: 1511783 - protein, 25 aa, Mycobacterium tuberculosis
SRLHTSLLDRHRPLWELHVVEGLND

SEQ ID NO: 1511784 - protein, 33 aa, Mycobacterium tuberculosis; identical to SEQ ID NO: 223141

SEQ ID NO: 1511785 - protein, 17 aa, Mycobacterium tuberculosis
SSRDWAAKGTLLLGVRA

SEQ ID NO: 1511786 - protein, 23 aa, Mycobacterium tuberculosis
STVKSMILHEILPIDVSINLEDA

SEQ ID NO: 1511787 - protein, 26 aa, Mycobacterium tuberculosis
SVERATRLRIPAERWVYPQAGTDAHD

SEQ ID NO: 1511788 - protein, 24 aa, Mycobacterium tuberculosis
SVSIHRDWLLIELRTDWTVATTRY

SEQ ID NO: 1511789 - protein, 23 aa, Mycobacterium tuberculosis
SYTFDRLVRVYPHIVRLRPAPHS

SEQ ID NO: 1511790 - protein, 25 aa, Mycobacterium tuberculosis
TAMVAKVGVFRPITRLSAERDYILE

SEQ ID NO: 1511791 - protein, 21 aa, Mycobacterium tuberculosis
TASPYLGFGSLRPLLEVAAAH

SEQ ID NO: 1511792 - protein, 19 aa, Mycobacterium tuberculosis
TEKMYANILLRRVPRMLKQ

SEQ ID NO: 1511793 - protein, 19 aa, Mycobacterium tuberculosis
TFNLTLQGDVKRFRGFDNW

SEQ ID NO: 1511794 - protein, 17 aa, Mycobacterium tuberculosis
TFSWPPRMELPGYKPNT

SEQ ID NO: 1511795 - protein, 17 aa, Mycobacterium tuberculosis
TGQVRIPMLAGRRSLNL

SEQ ID NO: 1511796 - protein, 20 aa, Mycobacterium tuberculosis
TGTMVLNLGLANHGTLNVGI

SEQ ID NO: 1511797 - protein, 18 aa, Mycobacterium tuberculosis
TGYALGAGLTLALAADWR

SEQ ID NO: 1511798 - protein, 25 aa, Mycobacterium tuberculosis
TILLARGDLALRMGLPVLAVVAFAQ

SEQ ID NO: 1511799 - protein, 25 aa, Mycobacterium tuberculosis
TIMQPGMTFTIEPMINLGALDYEIW

SEQ ID NO: 1511800 - protein, 24 aa, Mycobacterium tuberculosis
TKTAIPYRVPFPQSMPTQETAPTR

SEQ ID NO: 1511801 - protein, 17 aa, Mycobacterium tuberculosis
TLAFAFSHRSYLDGMLL

SEQ ID NO: 1511802 - protein, 23 aa, Mycobacterium tuberculosis
TLTYQMMFELRDLGFSTAIGIGG

SEQ ID NO: 1511803 - protein, 19 aa, Mycobacterium tuberculosis
TMTWRDYAAQVRRVAAGLA

SEQ ID NO: 1511804 - protein, 23 aa, Mycobacterium tuberculosis
TPAPGLPADLLIHNRWHRDPHGS

SEQ ID NO: 1511805 - protein, 18 aa, Mycobacterium tuberculosis
TTTYLVEAGLRAAGRVAG

SEQ ID NO: 1511806 - protein, 23 aa, Mycobacterium tuberculosis
TVARAFLRQALGVEVLSHVISIG

SEQ ID NO: 1511807 - protein, 18 aa, Mycobacterium tuberculosis
TVPTITLTIGGPTVTVPI

SEQ ID NO: 1511808 - protein, 23 aa, Mycobacterium tuberculosis
TVVDPQWVWPISPALTELAGRHR

SEQ ID NO: 1511809 - protein, 21 aa, Mycobacterium tuberculosis
TYDFFGIIFDGHPALTRIEMP

SEQ ID NO: 1511810 - protein, 24 aa, Mycobacterium tuberculosis
VAAATPLPVIGVPVPLGRLDGLDS

SEQ ID NO: 1511811 - protein, 26 aa, Mycobacterium tuberculosis
VALATLLQHWGISPDFLIGHSVGEIA

SEQ ID NO: 1511812 - protein, 17 aa, Mycobacterium tuberculosis
VARWPSMTKARLAGQVD

SEQ ID NO: 1511813 - protein, 17 aa, Mycobacterium tuberculosis
VEASLRSLARVAPTQRH

SEQ ID NO: 1511814 - protein, 33 aa, Mycobacterium tuberculosis; identical to SEQ ID NO: 223928

SEQ ID NO: 1511815 - protein, 18 aa, Mycobacterium tuberculosis
VEMFRKLLDQGQAGDNVG

SEQ ID NO: 1511816 - protein, 19 aa, Mycobacterium tuberculosis
VFATAHYALVDLAAARSGQ

SEQ ID NO: 1511817 - protein, 27 aa, Mycobacterium tuberculosis
VGMGAQLYAELPLFALAFDAVAEELDR

SEQ ID NO: 1511818 - protein, 19 aa, Mycobacterium tuberculosis
VGQPVLIPGTMGTASYVLA

SEQ ID NO: 1511819 - protein, 31 aa, Mycobacterium tuberculosis
VGVHDLQPFPLPALTCLLRSITLRMTMAPVQ

SEQ ID NO: 1511820 - protein, 19 aa, Mycobacterium tuberculosis
VIDPIVPQLGKGGGRLPIT

SEQ ID NO: 1511821 - protein, 20 aa, Mycobacterium tuberculosis
VIDRAPLWCAVDLRDGNQAL

SEQ ID NO: 1511822 - protein, 17 aa, Mycobacterium tuberculosis
VIGVNLTGTWRTLRATV

SEQ ID NO: 1511823 - protein, 25 aa, Mycobacterium tuberculosis
VINPFDFFIEDWAEIWPCAGMAYPK

SEQ ID NO: 1511824 - protein, 28 aa, Mycobacterium tuberculosis
VIYEHPSMAPALRKTLGVPLFQEQLMQL

SEQ ID NO: 1511825 - protein, 19 aa, Mycobacterium tuberculosis
VKIPVQGGPIGGIAISRDG

SEQ ID NO: 1511826 - protein, 17 aa, Mycobacterium tuberculosis
VLGICRGTQVLNVALGG

SEQ ID NO: 1511827 - protein, 18 aa, Mycobacterium tuberculosis
VQAGDRVVIFSATRYEWA

SEQ ID NO: 1511828 - protein, 26 aa, Mycobacterium tuberculosis
VRGGKQPRILFATQATARPPTFVLFT

SEQ ID NO: 1511829 - protein, 26 aa, Mycobacterium tuberculosis
VSVDVNIPIHIPITASFTDIVYSGLD

SEQ ID NO: 1511830 - protein, 19 aa, Mycobacterium tuberculosis
VTRMDYLSPFFNETAYCLG

SEQ ID NO: 1511831 - protein, 17 aa, Mycobacterium tuberculosis
VVCDFADACVPVVKVLA

SEQ ID NO: 1511832 - protein, 21 aa, Mycobacterium tuberculosis
VVHPPFRWQRRYAEGFSDQVA

SEQ ID NO: 1511833 - protein, 19 aa, Mycobacterium tuberculosis
VVLVDGELAWFLERGGRSL

SEQ ID NO: 1511834 - protein, 21 aa, Mycobacterium tuberculosis
VVRFIVPRYVQDDPLLAGVLN

SEQ ID NO: 1511835 - protein, 27 aa, Mycobacterium tuberculosis
VVSVDLPLAQLALQRLAAGLGVPHPDT

SEQ ID NO: 1511836 - protein, 19 aa, Mycobacterium tuberculosis
WGLDEILLLSTGPAEIDAR

SEQ ID NO: 1511837 - protein, 20 aa, Mycobacterium tuberculosis
WLEEVLRPALGERLRVLDGW

SEQ ID NO: 1511838 - protein, 22 aa, Mycobacterium tuberculosis
WRARGRLQEGLAWFAAALADHD

SEQ ID NO: 1511839 - protein, 17 aa, Mycobacterium tuberculosis
WRVLERAFSRHSALILI

SEQ ID NO: 1511840 - protein, 25 aa, Mycobacterium tuberculosis
WWDASYLVMWGSNVPITRTPDAHWM

SEQ ID NO: 1511841 - protein, 19 aa, Mycobacterium tuberculosis
YDDFFKRCFNIMPADGRMT

SEQ ID NO: 1511842 - protein, 30 aa, Mycobacterium tuberculosis; identical to SEQ ID NO: 224583

SEQ ID NO: 1511843 - protein, 23 aa, Mycobacterium tuberculosis
YETAYGLTVPPPVIAENRAELMI

SEQ ID NO: 1511844 - protein, 19 aa, Mycobacterium tuberculosis
YLDGMLLPEAILANRLSPA

SEQ ID NO: 1511845 - protein, 19 aa, Mycobacterium tuberculosis
YPEAVLARELELCYAAIAL

SEQ ID NO: 1511846 - protein, 22 aa, Mycobacterium tuberculosis
YSNGVLWRGDYQGLLGFSSGAN

SEQ ID NO: 1511847 - protein, 25 aa, Mycobacterium tuberculosis
YTRRDLPIHYLLADTFTVCDGYFCS

SEQ ID NO: 1511848 - protein, 20 aa, Mycobacterium tuberculosis
YVRVPYRARVPMTRAALMHR

SEQ ID NO: 1511849 - protein, 17 aa, Mycobacterium tuberculosis
YWPSRVLGSADPTTIAH

SEQ ID NO: 1511850 - protein, 22 aa, Mycobacterium tuberculosis
YYADPCALFDLCKRRYSKSVAL

SEQ ID NO: 1511851 - protein, 30 aa, Mycobacterium tuberculosis; identical to SEQ ID NO: 215429

SEQ ID NO: 1511852 - protein, 18 aa, Mycobacterium tuberculosis
AAKIPIVPIVIRNAEIVA

SEQ ID NO: 1511853 - protein, 26 aa, Mycobacterium tuberculosis
AAMAAAVAPYLGWLAAAAAQAQRSAT

SEQ ID NO: 1511854 - protein, 23 aa, Mycobacterium tuberculosis
AANQFVVALRRRGHLDDLEAMRV

SEQ ID NO: 1511855 - protein, 24 aa, Mycobacterium tuberculosis
AAPPARARTPLPVPTPRGERPDDG

SEQ ID NO: 1511856 - protein, 23 aa, Mycobacterium tuberculosis
AASLARHFGARRKAFNWTVTALK

SEQ ID NO: 1511857 - protein, 21 aa, Mycobacterium tuberculosis
AAVQLARLWGLEVFATASRGK

SEQ ID NO: 1511858 - protein, 23 aa, Mycobacterium tuberculosis
AAVSALMPFTQQLKKLAGLSERL

SEQ ID NO: 1511859 - protein, 23 aa, Mycobacterium tuberculosis
ADADELFRRSLGNPLYLRHLIDG

SEQ ID NO: 1511860 - protein, 17 aa, Mycobacterium tuberculosis
ADAVIYAPLLPSVDEVA

SEQ ID NO: 1511861 - protein, 21 aa, Mycobacterium tuberculosis
AEDALWRWMTAAALVRPRGAG

SEQ ID NO: 1511862 - protein, 18 aa, Mycobacterium tuberculosis
AERLFAERGFLAVRLEDI

SEQ ID NO: 1511863 - protein, 19 aa, Mycobacterium tuberculosis
AFGRLLAVDIPALNLRRQL

SEQ ID NO: 1511864 - protein, 17 aa, Mycobacterium tuberculosis
AGGLELALWCDLRVAEE

SEQ ID NO: 1511865 - protein, 21 aa, Mycobacterium tuberculosis
AGLCIVLPGPFQRFAERRRAR

SEQ ID NO: 1511866 - protein, 17 aa, Mycobacterium tuberculosis
AGRLDEFAHWAKSLTQR

SEQ ID NO: 1511867 - protein, 23 aa, Mycobacterium tuberculosis
AGRMLAIMHALDGALATVSPGAT

SEQ ID NO: 1511868 - protein, 18 aa, Mycobacterium tuberculosis
AHLPGMVAAATPLPVIGV

SEQ ID NO: 1511869 - protein, 26 aa, Mycobacterium tuberculosis
AKPAQVALAWLISLPGVVAIPGASSV

SEQ ID NO: 1511870 - protein, 25 aa, Mycobacterium tuberculosis
ALRRFLLEHGVLPEAPLVATVPVSV

SEQ ID NO: 1511871 - protein, 17 aa, Mycobacterium tuberculosis
ALSAMDYLRAHGIYVPG

SEQ ID NO: 1511872 - protein, 27 aa, Mycobacterium tuberculosis
AMARRFDTIARLWDVIGDTGIGFCLDT

SEQ ID NO: 1511873 - protein, 21 aa, Mycobacterium tuberculosis
APAHDWLTLTGGAIGYGIPAA

SEQ ID NO: 1511874 - protein, 17 aa, Mycobacterium tuberculosis
APPAPAPALAHLRGTTQ

SEQ ID NO: 1511875 - protein, 24 aa, Mycobacterium tuberculosis
APSRSAFVAGPWGAVASLSPELFL

SEQ ID NO: 1511876 - protein, 29 aa, Mycobacterium tuberculosis
APTMALVDVLSPLLIMTAVATAPSATTLP

SEQ ID NO: 1511877 - protein, 26 aa, Mycobacterium tuberculosis
AQAPDGLSCFLLPRVLPDGTRNRMFL

SEQ ID NO: 1511878 - protein, 19 aa, Mycobacterium tuberculosis
ARAVPRHPDLRWVDLGRRR

SEQ ID NO: 1511879 - protein, 21 aa, Mycobacterium tuberculosis
ARDVLADRRLFVLTDAAWTEF

SEQ ID NO: 1511880 - protein, 18 aa, Mycobacterium tuberculosis
ARLHRFYRDLIALRHNEA

SEQ ID NO: 1511881 - protein, 19 aa, Mycobacterium tuberculosis
ARLVMIDHGLPLPELQYPI

SEQ ID NO: 1511882 - protein, 19 aa, Mycobacterium tuberculosis
ASEASVTVDWHMPPRARKP

SEQ ID NO: 1511883 - protein, 31 aa, Mycobacterium tuberculosis; identical to SEQ ID NO: 216420

SEQ ID NO: 1511884 - protein, 27 aa, Mycobacterium tuberculosis
ATAGLGPITIPIIDIPAAPGIGNSTTS

SEQ ID NO: 1511885 - protein, 22 aa, Mycobacterium tuberculosis
ATDHPDLFWALRGGGGGNFGVT

SEQ ID NO: 1511886 - protein, 26 aa, Mycobacterium tuberculosis
AVAPVRRLLRRLLGPTDPVLASTVFG

SEQ ID NO: 1511887 - protein, 22 aa, Mycobacterium tuberculosis
AVDAALGWQRDGAEWIHLVDLD

SEQ ID NO: 1511888 - protein, 18 aa, Mycobacterium tuberculosis
CDAYYWVDNLRHTVRFAA

SEQ ID NO: 1511889 - protein, 21 aa, Mycobacterium tuberculosis
CEDPRFSIARLSLLDRGMVFV

SEQ ID NO: 1511890 - protein, 30 aa, Mycobacterium tuberculosis; identical to SEQ ID NO: 216709

SEQ ID NO: 1511891 - protein, 18 aa, Mycobacterium tuberculosis
DAPYLTPHPHRGLANEPY

SEQ ID NO: 1511892 - protein, 22 aa, Mycobacterium tuberculosis
DDPDYVIYQRLIDGVWTDVTCA

SEQ ID NO: 1511893 - protein, 37 aa, Mycobacterium tuberculosis
DDVLKQLFGYLVWRDTKAAILLFIRNKDVTAVIDNAI

SEQ ID NO: 1511894 - protein, 26 aa, Mycobacterium tuberculosis
DELVVVVPPGHKWARRSRVVSARELA

SEQ ID NO: 1511895 - protein, 21 aa, Mycobacterium tuberculosis
DERARLWPRPVDAYADFDSCQ

SEQ ID NO: 1511896 - protein, 26 aa, Mycobacterium tuberculosis
DFVCEQLAAAEPWWQPGAAQGYHMTT

SEQ ID NO: 1511897 - protein, 28 aa, Mycobacterium tuberculosis
DGEFVKFGPSWAWPKPVQPHIPVLVGAA

SEQ ID NO: 1511898 - protein, 29 aa, Mycobacterium tuberculosis
DHIVDYYNFFLSGGFLAPPGRAPVLVYGP

SEQ ID NO: 1511899 - protein, 24 aa, Mycobacterium tuberculosis
DIGVDPVQLRLLAGRGRLERVGRG

SEQ ID NO: 1511900 - protein, 23 aa, Mycobacterium tuberculosis
DIHFQPRYIFAAIDAGCAAVRVN

SEQ ID NO: 1511901 - protein, 17 aa, Mycobacterium tuberculosis
DKGFPNVALLRLRDMAP

SEQ ID NO: 1511902 - protein, 20 aa, Mycobacterium tuberculosis
DLFGARVDQLPLIWQRLVDG

SEQ ID NO: 1511903 - protein, 22 aa, Mycobacterium tuberculosis
DLHLGQVLRTPESWLLIDFEGE

SEQ ID NO: 1511904 - protein, 17 aa, Mycobacterium tuberculosis
DLRAIATLTHRGVEGAI

SEQ ID NO: 1511905 - protein, 23 aa, Mycobacterium tuberculosis
DMGNGAFWRGDQQGLFSAGYRVH

SEQ ID NO: 1511906 - protein, 17 aa, Mycobacterium tuberculosis
DPDLLVAAVKAAGAPVI

SEQ ID NO: 1511907 - protein, 23 aa, Mycobacterium tuberculosis
DPRAWLTTVVSRLGLDKLRSAAH

SEQ ID NO: 1511908 - protein, 23 aa, Mycobacterium tuberculosis
DPRLYRAYLLKESLRHVFSVKGE

SEQ ID NO: 1511909 - protein, 17 aa, Mycobacterium tuberculosis
DRMYSSPLPYMSALHQF

SEQ ID NO: 1511910 - protein, 18 aa, Mycobacterium tuberculosis
DVLQGQCTFSWPPRMELP

SEQ ID NO: 1511911 - protein, 19 aa, Mycobacterium tuberculosis
DVNGFGISLKIGSVDYQMP

SEQ ID NO: 1511912 - protein, 18 aa, Mycobacterium tuberculosis
DVRTVLPPVLSIRNGRRA

SEQ ID NO: 1511913 - protein, 32 aa, Mycobacterium tuberculosis
DVTTMFRPKLDALALLHRRSLKSPVRHFVLFS

SEQ ID NO: 1511914 - protein, 27 aa, Mycobacterium tuberculosis
DYQSTARFILAYLPRWQEPPQIYGGGG

SEQ ID NO: 1511915 - protein, 18 aa, Mycobacterium tuberculosis
EAYLGRRWVKLDATIDAP

SEQ ID NO: 1511916 - protein, 19 aa, Mycobacterium tuberculosis
EDFPLHVAVYRRVIAEFNG

SEQ ID NO: 1511917 - protein, 19 aa, Mycobacterium tuberculosis
EFYAGLLGAYPLVSIEDPL

SEQ ID NO: 1511918 - protein, 23 aa, Mycobacterium tuberculosis
EGPIEALPIAAFSMMRAMSTRND

SEQ ID NO: 1511919 - protein, 17 aa, Mycobacterium tuberculosis
EITSGEMYLGPGAGPML

SEQ ID NO: 1511920 - protein, 24 aa, Mycobacterium tuberculosis
EKVRRKPFSVVLFDEIEKAHQEIY

SEQ ID NO: 1511921 - protein, 19 aa, Mycobacterium tuberculosis
ELFPLLLSVMSTGVTFVRS

SEQ ID NO: 1511922 - protein, 24 aa, Mycobacterium tuberculosis
ELGADPLPFLRRFDIPPGIEHQED

SEQ ID NO: 1511923 - protein, 26 aa, Mycobacterium tuberculosis
ELKAALWELIWAGRVTGDTFAPVRAV

SEQ ID NO: 1511924 - protein, 30 aa, Mycobacterium tuberculosis; identical to SEQ ID NO: 226132

SEQ ID NO: 1511925 - protein, 17 aa, Mycobacterium tuberculosis
ENMSAIHAIYRAAGLPS

SEQ ID NO: 1511926 - protein, 18 aa, Mycobacterium tuberculosis
EQMKHIGIYGLAIDEQYG

SEQ ID NO: 1511927 - protein, 17 aa, Mycobacterium tuberculosis
ERIAPLFNLINGDLCYA

SEQ ID NO: 1511928 - protein, 19 aa, Mycobacterium tuberculosis
ESFKVLLKELQSLCLNVEV

SEQ ID NO: 1511929 - protein, 23 aa, Mycobacterium tuberculosis
ETDKPFLMPVEDVFTITGRGTVV

SEQ ID NO: 1511930 - protein, 30 aa, Mycobacterium tuberculosis; identical to SEQ ID NO: 198850

SEQ ID NO: 1511931 - protein, 24 aa, Mycobacterium tuberculosis
EVDEPYVLILPTYGGGRANPGLDA

SEQ ID NO: 1511932 - protein, 18 aa, Mycobacterium tuberculosis
EVLAFTAFPKAHWQKIWS

SEQ ID NO: 1511933 - protein, 24 aa, Mycobacterium tuberculosis
EVLDFEPRTVWWGSANWTVRAGSH

SEQ ID NO: 1511934 - protein, 22 aa, Mycobacterium tuberculosis
EYLRQRATLIDPKRAMPAATGI

SEQ ID NO: 1511935 - protein, 21 aa, Mycobacterium tuberculosis
FDQVIAVHLKGTWNGTRLAAA

SEQ ID NO: 1511936 - protein, 20 aa, Mycobacterium tuberculosis
FFASIAQQLTFGPGGTTAGS

SEQ ID NO: 1511937 - protein, 17 aa, Mycobacterium tuberculosis
FGRSHSCQIRVAPPPCP

SEQ ID NO: 1511938 - protein, 17 aa, Mycobacterium tuberculosis
FIALRTVIGYPAPNLMD

SEQ ID NO: 1511939 - protein, 20 aa, Mycobacterium tuberculosis
FIEETLRYEPPFRGHYRHVR

SEQ ID NO: 1511940 - protein, 18 aa, Mycobacterium tuberculosis
FVAFIAGIAPSATHRRSI

SEQ ID NO: 1511941 - protein, 22 aa, Mycobacterium tuberculosis
FWHQWMQTWFTGPQFYFDCVSG

SEQ ID NO: 1511942 - protein, 30 aa, Mycobacterium tuberculosis; identical to SEQ ID NO: 218171

SEQ ID NO: 1511943 - protein, 55 aa, Mycobacterium tuberculosis
GAFITGNYSNGLFLSGDYQGLVGLNLVIDMPLPISLGVNIPIDIPITASAGNITL

SEQ ID NO: 1511944 - protein, 23 aa, Mycobacterium tuberculosis
GAPVPIPGFPTTVTVFGTPFMGM

SEQ ID NO: 1511945 - protein, 24 aa, Mycobacterium tuberculosis
GASPRRALSELLRRGTRNLTGADR

SEQ ID NO: 1511946 - protein, 33 aa, Mycobacterium tuberculosis; identical to SEQ ID NO: 226225

SEQ ID NO: 1511947 - protein, 27 aa, Mycobacterium tuberculosis
GCRMDSMFPLGPLLGNAGLNITVMSLN

SEQ ID NO: 1511948 - protein, 32 aa, Mycobacterium tuberculosis
GDIGPITIQPIPILPTIPLSIHQTVNLGPLVV

SEQ ID NO: 1511949 - protein, 23 aa, Mycobacterium tuberculosis
GEGKRLYPLTADRAKPAVPFGGA

SEQ ID NO: 1511950 - protein, 25 aa, Mycobacterium tuberculosis
GERAFGAGPLRPWPDDVRRAIREGR

SEQ ID NO: 1511951 - protein, 17 aa, Mycobacterium tuberculosis
GFCLDTCHTWAAGEALT

SEQ ID NO: 1511952 - protein, 17 aa, Mycobacterium tuberculosis
GGAYFFRQLTHDGLTEA

SEQ ID NO: 1511953 - protein, 24 aa, Mycobacterium tuberculosis
GGCWRTFLTCDANLAVTLPPGLTD

SEQ ID NO: 1511954 - protein, 24 aa, Mycobacterium tuberculosis
GGSPPAALSWVEPILQATTTLCVA

SEQ ID NO: 1511955 - protein, 21 aa, Mycobacterium tuberculosis
GGVLKPILWCPGKATAVQRFA

SEQ ID NO: 1511956 - protein, 29 aa, Mycobacterium tuberculosis
GIPAVTFWAAVPHYVSHPPNPKATIALLR

SEQ ID NO: 1511957 - protein, 26 aa, Mycobacterium tuberculosis
GMVGGVSIPLIKIPAAPGFGNSTTSP

SEQ ID NO: 1511958 - protein, 23 aa, Mycobacterium tuberculosis
GNLGLIRAMEKFDYTKGFKFSTY

SEQ ID NO: 1511959 - protein, 26 aa, Mycobacterium tuberculosis
GNYSNGVLWRGDYQGLIGADIALEIP

SEQ ID NO: 1511960 - protein, 32 aa, Mycobacterium tuberculosis; identical to SEQ ID NO: 218672

SEQ ID NO: 1511961 - protein, 17 aa, Mycobacterium tuberculosis
GPYELARLAWEIERVDL

SEQ ID NO: 1511962 - protein, 29 aa, Mycobacterium tuberculosis
GRNVGEIELLPITKFFPATDVAILFRLGC

SEQ ID NO: 1511963 - protein, 31 aa, Mycobacterium tuberculosis; identical to SEQ ID NO: 218785

SEQ ID NO: 1511964 - protein, 26 aa, Mycobacterium tuberculosis
GVAWVIAYRWFRAGLLPVPAQRVGRL

SEQ ID NO: 1511965 - protein, 22 aa, Mycobacterium tuberculosis
GVEPNMRWRTFCDELLAVIDKL

SEQ ID NO: 1511966 - protein, 23 aa, Mycobacterium tuberculosis
GVGGLMLFGVPRDQDKDGVGSAG

SEQ ID NO: 1511967 - protein, 18 aa, Mycobacterium tuberculosis
GVLGYWVTSQAPPAMQIC

SEQ ID NO: 1511968 - protein, 17 aa, Mycobacterium tuberculosis
GVTLGLLSAWRGPNGQD

SEQ ID NO: 1511969 - protein, 25 aa, Mycobacterium tuberculosis
GWALRRAPLPPTGPHWRLLSAVKEL

SEQ ID NO: 1511970 - protein, 18 aa, Mycobacterium tuberculosis
GWWNQAPSALLGAGSGVG

SEQ ID NO: 1511971 - protein, 34 aa, Mycobacterium tuberculosis
HAPPYNRRSKFPYRWWWVALTDEAFPRLSVIRAP

SEQ ID NO: 1511972 - protein, 19 aa, Mycobacterium tuberculosis
HAVHRKLVLRHLAAKRIRV

SEQ ID NO: 1511973 - protein, 27 aa, Mycobacterium tuberculosis
HDELRPLKALAARMACPYLNPGRYVQG

SEQ ID NO: 1511974 - protein, 33 aa, Mycobacterium tuberculosis; identical to SEQ ID NO: 219115

SEQ ID NO: 1511975 - protein, 27 aa, Mycobacterium tuberculosis
HLGVGVTSIYWYFRKKDDLLNAMTDRA

SEQ ID NO: 1511976 - protein, 18 aa, Mycobacterium tuberculosis
HTRDSLRRAAAAAVAAGV

SEQ ID NO: 1511977 - protein, 20 aa, Mycobacterium tuberculosis
HVVTINDYLARRDAEWMGPL

SEQ ID NO: 1511978 - protein, 18 aa, Mycobacterium tuberculosis
HWVRARVVQLERGWVLRD

SEQ ID NO: 1511979 - protein, 22 aa, Mycobacterium tuberculosis
HYDQHLTLQGLRLVFERNLEVQ

SEQ ID NO: 1511980 - protein, 25 aa, Mycobacterium tuberculosis
IAANFRDVMIALGLYPDPDAVMGVE

SEQ ID NO: 1511981 - protein, 23 aa, Mycobacterium tuberculosis
IAGDQQLSFALIDGVRRQWRNGI

SEQ ID NO: 1511982 - protein, 19 aa, Mycobacterium tuberculosis
IAQLVKWGYAATQLLEGLV

SEQ ID NO: 1511983 - protein, 18 aa, Mycobacterium tuberculosis
IDIPAFDIQITGGFIGIR

SEQ ID NO: 1511984 - protein, 20 aa, Mycobacterium tuberculosis
IDPDGILNVALRDLAKDLGE

SEQ ID NO: 1511985 - protein, 26 aa, Mycobacterium tuberculosis
IELGPIRPPQRLAPYSYALGAEIKHP

SEQ ID NO: 1511986 - protein, 23 aa, Mycobacterium tuberculosis
IGPTLLHDWIQFGGSTMFGAAMR

SEQ ID NO: 1511987 - protein, 17 aa, Mycobacterium tuberculosis
IIGPNCPGIISPGQSLA

SEQ ID NO: 1511988 - protein, 17 aa, Mycobacterium tuberculosis
IIPGPSSLWLDAAGKRL

SEQ ID NO: 1511989 - protein, 23 aa, Mycobacterium tuberculosis
ITALVPGLTWRTDMDTWTGCGGE

SEQ ID NO: 1511990 - protein, 19 aa, Mycobacterium tuberculosis
IVAGWHGRPWAHHVPVMRE

SEQ ID NO: 1511991 - protein, 23 aa, Mycobacterium tuberculosis
IVEGMLALTGYYAWHKICVERAI

SEQ ID NO: 1511992 - protein, 20 aa, Mycobacterium tuberculosis
IVTELFKPLPSMVVAHYLGV

SEQ ID NO: 1511993 - protein, 18 aa, Mycobacterium tuberculosis
IYAPLLPSVDEVAALLRS

SEQ ID NO: 1511994 - protein, 39 aa, Mycobacterium tuberculosis; identical to SEQ ID NO: 219602

SEQ ID NO: 1511995 - protein, 17 aa, Mycobacterium tuberculosis
KRLLVNLDKAKAAPLWR

SEQ ID NO: 1511996 - protein, 26 aa, Mycobacterium tuberculosis
KVTKRGGGAALPFKRRLFGQIVAAAV

SEQ ID NO: 1511997 - protein, 33 aa, Mycobacterium tuberculosis; identical to SEQ ID NO: 219828

SEQ ID NO: 1511998 - protein, 26 aa, Mycobacterium tuberculosis
LAGKSVWFQRGPLDAAIRASIAIPGV

SEQ ID NO: 1511999 - protein, 25 aa, Mycobacterium tuberculosis
LAMDPQQRMLLELSWEALERAGIDP

SEQ ID NO: 1512000 - protein, 25 aa, Mycobacterium tuberculosis
LDPDRPLWECWIIEGLNGNRWAILI

SEQ ID NO: 1512001 - protein, 25 aa, Mycobacterium tuberculosis
LFCPDQFLGAHVRRVTGRKNLHVWA

SEQ ID NO: 1512002 - protein, 20 aa, Mycobacterium tuberculosis
LFQGLAFVVSRRRLLGRFVR

SEQ ID NO: 1512003 - protein, 17 aa, Mycobacterium tuberculosis
LGIGYEIVPGVPAFAAA

SEQ ID NO: 1512004 - protein, 17 aa, Mycobacterium tuberculosis
LGLDRYGVRFRIEARDG

SEQ ID NO: 1512005 - protein, 18 aa, Mycobacterium tuberculosis
LGPLVVPDIVIPAFGGGI

SEQ ID NO: 1512006 - protein, 19 aa, Mycobacterium tuberculosis
LIGLPDPDIAQLVKWGYAA

SEQ ID NO: 1512007 - protein, 25 aa, Mycobacterium tuberculosis
LKAATLPIYVHAPYLINLASANNRV

SEQ ID NO: 1512008 - protein, 28 aa, Mycobacterium tuberculosis
LLDDIRAFLRRFVVYPSDHELIAHTLWI

SEQ ID NO: 1512009 - protein, 19 aa, Mycobacterium tuberculosis
LLMALLTQNDGIAAPLLEA

SEQ ID NO: 1512010 - protein, 17 aa, Mycobacterium tuberculosis
LLRLSFGRFGDEPALTA

SEQ ID NO: 1512011 - protein, 24 aa, Mycobacterium tuberculosis
LLTGRRTWVPWTAVLVNVATRDCW

SEQ ID NO: 1512012 - protein, 34 aa, Mycobacterium tuberculosis; identical to SEQ ID NO: 220279

SEQ ID NO: 1512013 - protein, 19 aa, Mycobacterium tuberculosis
LPASIRFQQGAYRIHPALL

SEQ ID NO: 1512014 - protein, 25 aa, Mycobacterium tuberculosis
LRNRDQWDLLQRDPSLLPGAIEEML

SEQ ID NO: 1512015 - protein, 27 aa, Mycobacterium tuberculosis
LRPYQQRGLAWLAFLSSLGLGSCLADD

SEQ ID NO: 1512016 - protein, 17 aa, Mycobacterium tuberculosis
LTARDFGDWALDLWPAI

SEQ ID NO: 1512017 - protein, 17 aa, Mycobacterium tuberculosis
LTDIPVRVYWPPVVRDN

SEQ ID NO: 1512018 - protein, 31 aa, Mycobacterium tuberculosis
LTLNLDTTPWTLFPNGFTIPAQTPVTVGMEV

SEQ ID NO: 1512019 - protein, 20 aa, Mycobacterium tuberculosis
LTTMPIPVIAAVRGLAVGGG

SEQ ID NO: 1512020 - protein, 31 aa, Mycobacterium tuberculosis; identical to SEQ ID NO: 225334

SEQ ID NO: 1512021 - protein, 19 aa, Mycobacterium tuberculosis
LVKIYNRKALDPAQVVDAL

SEQ ID NO: 1512022 - protein, 38 aa, Mycobacterium tuberculosis; identical to SEQ ID NO: 220549

SEQ ID NO: 1512023 - protein, 23 aa, Mycobacterium tuberculosis
MAAAAAPYAGWLSAAAASAESAA

SEQ ID NO: 1512024 - protein, 21 aa, Mycobacterium tuberculosis
MDPQQRLLLEVSWEALERTGI

SEQ ID NO: 1512025 - protein, 24 aa, Mycobacterium tuberculosis
MSATLGVLLRRLEPNWSITLIERL

SEQ ID NO: 1512026 - protein, 19 aa, Mycobacterium tuberculosis
MTYAAPLFVTAEFINNNTG

SEQ ID NO: 1512027 - protein, 22 aa, Mycobacterium tuberculosis
MWDIRNRGVIPAGALPRVRAFV

SEQ ID NO: 1512028 - protein, 27 aa, Mycobacterium tuberculosis
NETGTLIWNELLTDKPDLALAFYEAVV

SEQ ID NO: 1512029 - protein, 20 aa, Mycobacterium tuberculosis
NFGGGASGFWNLASATSGLS

SEQ ID NO: 1512030 - protein, 25 aa, Mycobacterium tuberculosis
NFSNGILWRGDYQGLAGFAVGYTLP

SEQ ID NO: 1512031 - protein, 20 aa, Mycobacterium tuberculosis
NGGTPFPLQLATQVDAPPGS

SEQ ID NO: 1512032 - protein, 17 aa, Mycobacterium tuberculosis
NLLVQLSDEELAAGVVC

SEQ ID NO: 1512033 - protein, 27 aa, Mycobacterium tuberculosis
NPPLRGWQRRALVQYLGTQPRDFLAVA

SEQ ID NO: 1512034 - protein, 24 aa, Mycobacterium tuberculosis
NQSSGVIPIMKLLEDAFSYANQLG

SEQ ID NO: 1512035 - protein, 19 aa, Mycobacterium tuberculosis
NVVDAYRYWTREAIIADID

SEQ ID NO: 1512036 - protein, 18 aa, Mycobacterium tuberculosis
PAAIVWAAQMGTITLHPW

SEQ ID NO: 1512037 - protein, 19 aa, Mycobacterium tuberculosis
PAGLPAWISQEELDHYIGE

SEQ ID NO: 1512038 - protein, 23 aa, Mycobacterium tuberculosis
PAYTGRMFTAPVPALRMPDESMD

SEQ ID NO: 1512039 - protein, 23 aa, Mycobacterium tuberculosis
PDAHGLHLFATLLAAGERAFGAG

SEQ ID NO: 1512040 - protein, 24 aa, Mycobacterium tuberculosis
PDDLLNALIDFLAAVRNGLVPIIE

SEQ ID NO: 1512041 - protein, 28 aa, Mycobacterium tuberculosis
PDVVHAHDWLVAHPAIALAQFYDVPMVS

SEQ ID NO: 1512042 - protein, 23 aa, Mycobacterium tuberculosis
PELAPADLAYTLARRRGHRPVRT

SEQ ID NO: 1512043 - protein, 34 aa, Mycobacterium tuberculosis
PELSLYALRDSIGTPFLLLAGLEPDLKWERFITA

SEQ ID NO: 1512044 - protein, 19 aa, Mycobacterium tuberculosis
PGALRRFLDDVLGPNDDIT

SEQ ID NO: 1512045 - protein, 28 aa, Mycobacterium tuberculosis
PGETRFALVLSRLFWDAAIFHRACEAVM

SEQ ID NO: 1512046 - protein, 21 aa, Mycobacterium tuberculosis
PGGVLAWESLALSGAEAGTAS

SEQ ID NO: 1512047 - protein, 25 aa, Mycobacterium tuberculosis
PGKFRQLGPVNWLVAKLAARAVGAP

SEQ ID NO: 1512048 - protein, 17 aa, Mycobacterium tuberculosis
PGMLITARALLDRNPDP

SEQ ID NO: 1512049 - protein, 19 aa, Mycobacterium tuberculosis
PGRHQLFMHACDLSRLPDG

SEQ ID NO: 1512050 - protein, 27 aa, Mycobacterium tuberculosis
PGTPPATLLDYFPEDFLLVIDESHVTV

SEQ ID NO: 1512051 - protein, 18 aa, Mycobacterium tuberculosis
PIGTTIFELDRPQVLDFK

SEQ ID NO: 1512052 - protein, 26 aa, Mycobacterium tuberculosis
PINAQLFSMPIHQVMVMPGSVMTIPG

SEQ ID NO: 1512053 - protein, 19 aa, Mycobacterium tuberculosis
PLLIVSSDLRRAYDTAVKL

SEQ ID NO: 1512054 - protein, 23 aa, Mycobacterium tuberculosis
PLVVVAGAATRWVWVKDAPGFDI

SEQ ID NO: 1512055 - protein, 22 aa, Mycobacterium tuberculosis
PSADLILLYLIQHCPDLSVDAA

SEQ ID NO: 1512056 - protein, 20 aa, Mycobacterium tuberculosis
PSFAHVVRAVHRCLLAGRFA

SEQ ID NO: 1512057 - protein, 31 aa, Mycobacterium tuberculosis; identical to SEQ ID NO: 164862

SEQ ID NO: 1512058 - protein, 19 aa, Mycobacterium tuberculosis
PSRIIVTMRGDPYADRPRL

SEQ ID NO: 1512059 - protein, 26 aa, Mycobacterium tuberculosis
PVDVRVRRWIEAMPQYGPGHADVVAE

SEQ ID NO: 1512060 - protein, 21 aa, Mycobacterium tuberculosis
PVLKMLLDTFPVTFTAADGVE

SEQ ID NO: 1512061 - protein, 18 aa, Mycobacterium tuberculosis
PVSYRPGLLCVRQKRFTH

SEQ ID NO: 1512062 - protein, 28 aa, Mycobacterium tuberculosis
PVVLPDPFITIDHYGPPLGPPGAKFPSG

SEQ ID NO: 1512063 - protein, 18 aa, Mycobacterium tuberculosis
PWTMLGNLAFGLPSRLRL

SEQ ID NO: 1512064 - protein, 25 aa, Mycobacterium tuberculosis
QDSRGTFTIIFTGPAFHPHGNSRCR

SEQ ID NO: 1512065 - protein, 27 aa, Mycobacterium tuberculosis
QEIMTELEIAPTRRLRGLGDRQRKALL

SEQ ID NO: 1512066 - protein, 18 aa, Mycobacterium tuberculosis
QFTEFAELLVPHLAARFG

SEQ ID NO: 1512067 - protein, 27 aa, Mycobacterium tuberculosis
QGDPPYVAVPYLDRMELAYAAADLVIC

SEQ ID NO: 1512068 - protein, 18 aa, Mycobacterium tuberculosis
QRDYAPARHLGGVLYLFV

SEQ ID NO: 1512069 - protein, 22 aa, Mycobacterium tuberculosis
QRGIYALGAGPLGFSTAWVVFD

SEQ ID NO: 1512070 - protein, 20 aa, Mycobacterium tuberculosis
QRGLRPIQIWVPDVNAPEFV

SEQ ID NO: 1512071 - protein, 22 aa, Mycobacterium tuberculosis
QSLPLAEMLYARGSGLRASRNQ

SEQ ID NO: 1512072 - protein, 29 aa, Mycobacterium tuberculosis
QTIAEQLMPHWMLSLRAADMRRGGTVPEV

SEQ ID NO: 1512073 - protein, 32 aa, Mycobacterium tuberculosis; identical to SEQ ID NO: 225496

SEQ ID NO: 1512074 - protein, 19 aa, Mycobacterium tuberculosis
QVLTQCRPELIERTFQACS

SEQ ID NO: 1512075 - protein, 18 aa, Mycobacterium tuberculosis
RAALFFDGRLVEEGPTEQ

SEQ ID NO: 1512076 - protein, 19 aa, Mycobacterium tuberculosis
RALGWLREDRKPLLNAKLL

SEQ ID NO: 1512077 - protein, 23 aa, Mycobacterium tuberculosis
RCATYPVLAVQAWAAFHDMTLRA

SEQ ID NO: 1512078 - protein, 28 aa, Mycobacterium tuberculosis
RDGVRIAIDLYLPAGLTSAARLPAILHQ

SEQ ID NO: 1512079 - protein, 17 aa, Mycobacterium tuberculosis
RDGWVDRFGLDLPRHDT

SEQ ID NO: 1512080 - protein, 25 aa, Mycobacterium tuberculosis
RDVRYLGSQQWPFPRSLMVGFHALG

SEQ ID NO: 1512081 - protein, 22 aa, Mycobacterium tuberculosis
REDRKPLLNAKLLVLGHLALNV

SEQ ID NO: 1512082 - protein, 31 aa, Mycobacterium tuberculosis
REQSRPELGYRLLQRLGADVADYGFIETSAK

SEQ ID NO: 1512083 - protein, 19 aa, Mycobacterium tuberculosis
RGWLRRFAERVEAVRSVFT

SEQ ID NO: 1512084 - protein, 17 aa, Mycobacterium tuberculosis
RIRKALIEVSPLPIPVA

SEQ ID NO: 1512085 - protein, 20 aa, Mycobacterium tuberculosis
RLELAALKQSAAAELGLRVC

SEQ ID NO: 1512086 - protein, 19 aa, Mycobacterium tuberculosis
RLFEVIWSPASAATSPGPT

SEQ ID NO: 1512087 - protein, 26 aa, Mycobacterium tuberculosis
RLLADGGILDPLPMAPIAGVNADLTI

SEQ ID NO: 1512088 - protein, 21 aa, Mycobacterium tuberculosis
RLLDVHANTWRYNQLIAQQRA

SEQ ID NO: 1512089 - protein, 21 aa, Mycobacterium tuberculosis
RLMRGLGSSIYPRNVDYRAFD

SEQ ID NO: 1512090 - protein, 22 aa, Mycobacterium tuberculosis
RLRSPLLRLATWNVNSIRTRLD

SEQ ID NO: 1512091 - protein, 20 aa, Mycobacterium tuberculosis
RLSTCAGVTSLPPAHRLTGN

SEQ ID NO: 1512092 - protein, 34 aa, Mycobacterium tuberculosis; identical to SEQ ID NO: 222408

SEQ ID NO: 1512093 - protein, 17 aa, Mycobacterium tuberculosis
RPGGRLGLVWNTRDERL

SEQ ID NO: 1512094 - protein, 18 aa, Mycobacterium tuberculosis
RPLDAGPYTFLAADALVL

SEQ ID NO: 1512095 - protein, 26 aa, Mycobacterium tuberculosis
RPLTDLPVAGYPLVPRVASPRYRCTT

SEQ ID NO: 1512096 - protein, 25 aa, Mycobacterium tuberculosis
RPPVEADWLLLVELAADHDQTDRLA

SEQ ID NO: 1512097 - protein, 25 aa, Mycobacterium tuberculosis
RPQLATTLLPALLEALVRNVSRGLV

SEQ ID NO: 1512098 - protein, 19 aa, Mycobacterium tuberculosis
RPQPILQLPDTNSGWRLVA

SEQ ID NO: 1512099 - protein, 19 aa, Mycobacterium tuberculosis
RQCLNAGLGFGGGCLPKDI

SEQ ID NO: 1512100 - protein, 25 aa, Mycobacterium tuberculosis
RRGRPTVWSVWGVGGAILLGDALHA

SEQ ID NO: 1512101 - protein, 18 aa, Mycobacterium tuberculosis
RRLATLGPLLQDLEARII

SEQ ID NO: 1512102 - protein, 22 aa, Mycobacterium tuberculosis
RSLKSPVRHFVLFSSVSGLLGS

SEQ ID NO: 1512103 - protein, 22 aa, Mycobacterium tuberculosis
RSRDLHDALRRRCLYHWIDYPG

SEQ ID NO: 1512104 - protein, 18 aa, Mycobacterium tuberculosis
RTLPRWQRIVALTMIGIS

SEQ ID NO: 1512105 - protein, 23 aa, Mycobacterium tuberculosis
RTPGFERTLLGRALDFWNEEVYE

SEQ ID NO: 1512106 - protein, 17 aa, Mycobacterium tuberculosis
RTTGWFTGLVPITVPVA

SEQ ID NO: 1512107 - protein, 19 aa, Mycobacterium tuberculosis
RVALLRKTVGETWGLPSPE

SEQ ID NO: 1512108 - protein, 22 aa, Mycobacterium tuberculosis
RVDQLPLIWQRLVDGGMESGHA

SEQ ID NO: 1512109 - protein, 30 aa, Mycobacterium tuberculosis; identical to SEQ ID NO: 222689

SEQ ID NO: 1512110 - protein, 19 aa, Mycobacterium tuberculosis
RVVYRRDEVSRWISKRESA

SEQ ID NO: 1512111 - protein, 17 aa, Mycobacterium tuberculosis
RWARNTGGLLVVTHDRW

SEQ ID NO: 1512112 - protein, 25 aa, Mycobacterium tuberculosis
SADVVVGLPMRCVFALTAMGFLPQS

SEQ ID NO: 1512113 - protein, 26 aa, Mycobacterium tuberculosis
SAQQGKFLCLLAGAIQARRVLEIGTL

SEQ ID NO: 1512114 - protein, 26 aa, Mycobacterium tuberculosis
SEESYLALLDALRWLGLDWDEGPEVG

SEQ ID NO: 1512115 - protein, 21 aa, Mycobacterium tuberculosis
SEHLVAWMKAVVYGAAERWTD

SEQ ID NO: 1512116 - protein, 18 aa, Mycobacterium tuberculosis
SFFPAILEPRRRIDQALY

SEQ ID NO: 1512117 - protein, 21 aa, Mycobacterium tuberculosis
SGLLHHSVGTMTLNFGLANVG

SEQ ID NO: 1512118 - protein, 24 aa, Mycobacterium tuberculosis
SIDGLIAILTFPPAESVFDQIIDA

SEQ ID NO: 1512119 - protein, 19 aa, Mycobacterium tuberculosis
SLYHAGVKLDWMVATTLLT

SEQ ID NO: 1512120 - protein, 31 aa, Mycobacterium tuberculosis; identical to SEQ ID NO: 223052

SEQ ID NO: 1512121 - protein, 21 aa, Mycobacterium tuberculosis
SPLDFFIDGFGRTAPSRSAFV

SEQ ID NO: 1512122 - protein, 23 aa, Mycobacterium tuberculosis
SRLAIADDLAFGRLLAVDIPALN

SEQ ID NO: 1512123 - protein, 24 aa, Mycobacterium tuberculosis
STEQDFRLFSGMSAHYDSLPRLIR

SEQ ID NO: 1512124 - protein, 21 aa, Mycobacterium tuberculosis
SVPLTFLCACGPAYLPERDQR

SEQ ID NO: 1512125 - protein, 17 aa, Mycobacterium tuberculosis
SWALLGRQDLRAAEDAL

SEQ ID NO: 1512126 - protein, 18 aa, Mycobacterium tuberculosis
TATFWLLNASDSLAEQSR

SEQ ID NO: 1512127 - protein, 27 aa, Mycobacterium tuberculosis
TDHPVHRYFLAAKQTEFALGGATGQLR

SEQ ID NO: 1512128 - protein, 17 aa, Mycobacterium tuberculosis
TGMDLDWRAVVGEAQFV

SEQ ID NO: 1512129 - protein, 20 aa, Mycobacterium tuberculosis
TGWFTGLVPITVPVASGLFD

SEQ ID NO: 1512130 - protein, 22 aa, Mycobacterium tuberculosis
TIALGLLHRLTAMVAKVGVFRP

SEQ ID NO: 1512131 - protein, 24 aa, Mycobacterium tuberculosis
TIPGFAINPFGLNVPLSGGTSPVT

SEQ ID NO: 1512132 - protein, 20 aa, Mycobacterium tuberculosis
TIPQFRTLVILSNHGPINLA

SEQ ID NO: 1512133 - protein, 26 aa, Mycobacterium tuberculosis
TLDKSDVLAGLFAVWHSLDALLDGLL

SEQ ID NO: 1512134 - protein, 18 aa, Mycobacterium tuberculosis
TLSFFRLALRLRRERNEF

SEQ ID NO: 1512135 - protein, 24 aa, Mycobacterium tuberculosis
TPSSKLGGLWKTVSPHRSPISNMV

SEQ ID NO: 1512136 - protein, 29 aa, Mycobacterium tuberculosis
TSDLVADLLPKDAWLNDLGTYRLDDLPRP

SEQ ID NO: 1512137 - protein, 27 aa, Mycobacterium tuberculosis
TSPDETWLALQPFLAPAGITGVADVTW

SEQ ID NO: 1512138 - protein, 38 aa, Mycobacterium tuberculosis; identical to SEQ ID NO: 223683

SEQ ID NO: 1512139 - protein, 26 aa, Mycobacterium tuberculosis
TVTVPELLVVRPAPGVWHLVSTVSAR

SEQ ID NO: 1512140 - protein, 33 aa, Mycobacterium tuberculosis; identical to SEQ ID NO: 223779

SEQ ID NO: 1512141 - protein, 17 aa, Mycobacterium tuberculosis
VAELAHRFAQSSTVLFL

SEQ ID NO: 1512142 - protein, 25 aa, Mycobacterium tuberculosis
VAELLLLGMPYRDIGARLFISAKTV

SEQ ID NO: 1512143 - protein, 20 aa, Mycobacterium tuberculosis
VAELTQLWWQEAERNRVLPL

SEQ ID NO: 1512144 - protein, 17 aa, Mycobacterium tuberculosis
VARPLLAALRPELGCVL

SEQ ID NO: 1512145 - protein, 19 aa, Mycobacterium tuberculosis
VDALLPAAHGPNPVLPPGC

SEQ ID NO: 1512146 - protein, 22 aa, Mycobacterium tuberculosis
VDALVHSRLPPTLPARSSMAAA

SEQ ID NO: 1512147 - protein, 22 aa, Mycobacterium tuberculosis
VDDALWRRFKAAQDSFFTARNA

SEQ ID NO: 1512148 - protein, 25 aa, Mycobacterium tuberculosis
VDLDLPRDALIVFTGLSGSGKSSLA

SEQ ID NO: 1512149 - protein, 35 aa, Mycobacterium tuberculosis; identical to SEQ ID NO: 227074

SEQ ID NO: 1512150 - protein, 19 aa, Mycobacterium tuberculosis
VKLPNRWPLTDAAGVPVVF

SEQ ID NO: 1512151 - protein, 18 aa, Mycobacterium tuberculosis
VLESLTGIRRAGADIVLT

SEQ ID NO: 1512152 - protein, 27 aa, Mycobacterium tuberculosis
VLGTLRVTRALLPKLIDSGDGLIVTVT

SEQ ID NO: 1512153 - protein, 19 aa, Mycobacterium tuberculosis
VLREVFVNGIPRRVDRVDL

SEQ ID NO: 1512154 - protein, 28 aa, Mycobacterium tuberculosis
VLRGARPLFASRRLGIAGRRVLLATLTA

SEQ ID NO: 1512155 - protein, 17 aa, Mycobacterium tuberculosis
VMRLSRQLRFRNPSSPV

SEQ ID NO: 1512156 - protein, 17 aa, Mycobacterium tuberculosis
VNGLWVTHLGVGQNVTV

SEQ ID NO: 1512157 - protein, 23 aa, Mycobacterium tuberculosis
VNLLHDHLVDILLDAAAMGRVHV

SEQ ID NO: 1512158 - protein, 17 aa, Mycobacterium tuberculosis
VPNDYGLKIERAIDAYL

SEQ ID NO: 1512159 - protein, 21 aa, Mycobacterium tuberculosis
VPVVFLTAYYALRVLAQVQPG

SEQ ID NO: 1512160 - protein, 19 aa, Mycobacterium tuberculosis
VQARPGCRPSLAELDSFVR

SEQ ID NO: 1512161 - protein, 17 aa, Mycobacterium tuberculosis
VREINIGEIPLGLRLGS

SEQ ID NO: 1512162 - protein, 18 aa, Mycobacterium tuberculosis
VRLGLAAQLARQLGAPVV

SEQ ID NO: 1512163 - protein, 17 aa, Mycobacterium tuberculosis
VTLVAQLSRRFAPPTLV

SEQ ID NO: 1512164 - protein, 18 aa, Mycobacterium tuberculosis
VVADIHFQPRYIFAAIDA

SEQ ID NO: 1512165 - protein, 35 aa, Mycobacterium tuberculosis
VVAVYSTFLHRAFDQLLFDIGLHRLPVTLVLDRAG

SEQ ID NO: 1512166 - protein, 29 aa, Mycobacterium tuberculosis
VVPDITIPGIPLSLNALGGVGPIVVPDIT

SEQ ID NO: 1512167 - protein, 26 aa, Mycobacterium tuberculosis
VYKRSLAVFFLSEPPEGFDTLRDFRR

SEQ ID NO: 1512168 - protein, 48 aa, Mycobacterium tuberculosis
VYSGLDLPPNTAVTVIFFGPVDIDPFTVPVIRITGPTPVVMVGGPTTA

SEQ ID NO: 1512169 - protein, 17 aa, Mycobacterium tuberculosis
WVDIRFTLPANTVDGGT

SEQ ID NO: 1512170 - protein, 18 aa, Mycobacterium tuberculosis
YDAVWRWIDWPERRGRTD

SEQ ID NO: 1512171 - protein, 25 aa, Mycobacterium tuberculosis
YEQIKDLLGRELLDQRFAGMKQALA

SEQ ID NO: 1512172 - protein, 23 aa, Mycobacterium tuberculosis
YFMIVFSGPIPDDKWLQAVQIVK

SEQ ID NO: 1512173 - protein, 17 aa, Mycobacterium tuberculosis
YFNDHGAQIDRFANSLI

SEQ ID NO: 1512174 - protein, 19 aa, Mycobacterium tuberculosis
YRQIFYAELPECLNALSAD

SEQ ID NO: 1512175 - protein, 17 aa, Mycobacterium tuberculosis
YRVGAAYEAARGPLLSA

SEQ ID NO: 1512176 - protein, 19 aa, Mycobacterium tuberculosis
YVSNLRKLLGGAGIDPRVV

SEQ ID NO: 1512177 - protein, 18 aa, Mycobacterium tuberculosis
AALLQDWGVLPDLVMGHS

SEQ ID NO: 1512178 - protein, 27 aa, Mycobacterium tuberculosis
AAQLAGLKLLALGGRFIEIGKRDIYSN

SEQ ID NO: 1512179 - protein, 21 aa, Mycobacterium tuberculosis
AASDLLGLASGGLLPAAEEAA

SEQ ID NO: 1512180 - protein, 20 aa, Mycobacterium tuberculosis
ACEITLQPIRRYDVDAAILF

SEQ ID NO: 1512181 - protein, 28 aa, Mycobacterium tuberculosis
ADNPVLCDLILIRAALSPKTARLGAQEM

SEQ ID NO: 1512182 - protein, 22 aa, Mycobacterium tuberculosis
ADPPMIMRDTIFCAIPTDADRE

SEQ ID NO: 1512183 - protein, 20 aa, Mycobacterium tuberculosis
ADVSIIFVPPTFAKDAIIEA

SEQ ID NO: 1512184 - protein, 20 aa, Mycobacterium tuberculosis
AEAFVLAEKLGLSAQSLFDV

SEQ ID NO: 1512185 - protein, 22 aa, Mycobacterium tuberculosis
AEAFVRTLFDRVTAHGSPTVEF

SEQ ID NO: 1512186 - protein, 22 aa, Mycobacterium tuberculosis
AEFERPVLLFSGGKDSIVMLHL

SEQ ID NO: 1512187 - protein, 29 aa, Mycobacterium tuberculosis
AEIAGRAAVPVLVHPAPRGVLGGLAATVY

SEQ ID NO: 1512188 - protein, 27 aa, Mycobacterium tuberculosis
AGEACARAIAWYLAMARRSQGNESAAV

SEQ ID NO: 1512189 - protein, 31 aa, Mycobacterium tuberculosis; identical to SEQ ID NO: 224771

SEQ ID NO: 1512190 - protein, 24 aa, Mycobacterium tuberculosis
AGLDARAYRLPWPAGTVVYEIDQP

SEQ ID NO: 1512191 - protein, 30 aa, Mycobacterium tuberculosis; identical to SEQ ID NO: 215897

SEQ ID NO: 1512192 - protein, 27 aa, Mycobacterium tuberculosis
AGSLNRPGYLRFDFNWQGPLTDDQRTQ

SEQ ID NO: 1512193 - protein, 18 aa, Mycobacterium tuberculosis
AHLAGVLSLTDAAGLVAA

SEQ ID NO: 1512194 - protein, 17 aa, Mycobacterium tuberculosis
AIGPLVDALAEHAARLR

SEQ ID NO: 1512195 - protein, 20 aa, Mycobacterium tuberculosis
AKHAVFDRLVYRKLRAALGG

SEQ ID NO: 1512196 - protein, 19 aa, Mycobacterium tuberculosis
ALALYRSVGFQRVGLRRRY

SEQ ID NO: 1512197 - protein, 19 aa, Mycobacterium tuberculosis
AMLRRIRLTPAGPDTADTA

SEQ ID NO: 1512198 - protein, 24 aa, Mycobacterium tuberculosis
ANNRAALIGYLPTGYPDVPASVAA

SEQ ID NO: 1512199 - protein, 25 aa, Mycobacterium tuberculosis
ANSDGRLLELTLHPGVMTGYAHGEL

SEQ ID NO: 1512200 - protein, 24 aa, Mycobacterium tuberculosis
ANSWLDAFAHWRQAQGLPATAIAW

SEQ ID NO: 1512201 - protein, 18 aa, Mycobacterium tuberculosis
APSRSLPLLECWTALAAL

SEQ ID NO: 1512202 - protein, 29 aa, Mycobacterium tuberculosis
AQLTVTPVMLLLWIRGVRFMYSVDPYLPP

SEQ ID NO: 1512203 - protein, 24 aa, Mycobacterium tuberculosis
AQRTSAINRLRWLVHELDPERAPA

SEQ ID NO: 1512204 - protein, 27 aa, Mycobacterium tuberculosis
AQVAAYQQRFVLALSQAGSTYAVAEAA

SEQ ID NO: 1512205 - protein, 22 aa, Mycobacterium tuberculosis
ARHTGKVVMLMPGSWAAGTVLI

SEQ ID NO: 1512206 - protein, 27 aa, Mycobacterium tuberculosis
ATSPMDPALYLVWAQANAAAGYRYSVE

SEQ ID NO: 1512207 - protein, 27 aa, Mycobacterium tuberculosis
AVIRTSVPPFTWWRGLRARELLENYFT

SEQ ID NO: 1512208 - protein, 33 aa, Mycobacterium tuberculosis; identical to SEQ ID NO: 225996

SEQ ID NO: 1512209 - protein, 21 aa, Mycobacterium tuberculosis
CHQIVLPQPILRNHELAKLVS

SEQ ID NO: 1512210 - protein, 19 aa, Mycobacterium tuberculosis
CVNIETGVVWWPECSKEAY

SEQ ID NO: 1512211 - protein, 28 aa, Mycobacterium tuberculosis
DAGAHLRNMAFYNFGLRLLKRARDADRA

SEQ ID NO: 1512212 - protein, 21 aa, Mycobacterium tuberculosis
DASLRLLPRGGRFIEMGKTEF

SEQ ID NO: 1512213 - protein, 17 aa, Mycobacterium tuberculosis
DDLCLPDMLLLLATDVA

SEQ ID NO: 1512214 - protein, 21 aa, Mycobacterium tuberculosis
DGGVQALRIWGAGATGSRLVT

SEQ ID NO: 1512215 - protein, 23 aa, Mycobacterium tuberculosis
DGKQWGLEYLFGVLEAGRAGVFR

SEQ ID NO: 1512216 - protein, 22 aa, Mycobacterium tuberculosis
DGRAPVLRRWYPSTGGTWQAEA

SEQ ID NO: 1512217 - protein, 20 aa, Mycobacterium tuberculosis
DHLHAVVGEWQLLADLSFAD

SEQ ID NO: 1512218 - protein, 17 aa, Mycobacterium tuberculosis
DIGLANLGSYNIGFGNF

SEQ ID NO: 1512219 - protein, 17 aa, Mycobacterium tuberculosis
DIRLEPDSILRVLAMHR

SEQ ID NO: 1512220 - protein, 19 aa, Mycobacterium tuberculosis
DLALNWLCERQLPDGSWGA

SEQ ID NO: 1512221 - protein, 17 aa, Mycobacterium tuberculosis
DLNGNVFALYEPPAPPG

SEQ ID NO: 1512222 - protein, 17 aa, Mycobacterium tuberculosis
DLSGPARWFLDHARVAL

SEQ ID NO: 1512223 - protein, 24 aa, Mycobacterium tuberculosis
DSILRVLAMHRFAKAPMLVGGQML

SEQ ID NO: 1512224 - protein, 23 aa, Mycobacterium tuberculosis
DSVAQLELLLPAMAGLVASLTFN

SEQ ID NO: 1512225 - protein, 25 aa, Mycobacterium tuberculosis
DTKLARSPTVTALLQLAAYADALVH

SEQ ID NO: 1512226 - protein, 17 aa, Mycobacterium tuberculosis
DVFYWAHATFFVGTLHV

SEQ ID NO: 1512227 - protein, 25 aa, Mycobacterium tuberculosis
DVGELLRWLGDGNFLLLGYQRCRVA

SEQ ID NO: 1512228 - protein, 20 aa, Mycobacterium tuberculosis
DYLSPFFNETAYCLGVEKLL

SEQ ID NO: 1512229 - protein, 17 aa, Mycobacterium tuberculosis
EAFAAVALASIRELGLN

SEQ ID NO: 1512230 - protein, 17 aa, Mycobacterium tuberculosis
EAMLLAGFVIPVRKKGV

SEQ ID NO: 1512231 - protein, 19 aa, Mycobacterium tuberculosis
EAPEYFRVPKRGQVEILDP

SEQ ID NO: 1512232 - protein, 17 aa, Mycobacterium tuberculosis
EASLTDLIYAHHPRFTG

SEQ ID NO: 1512233 - protein, 19 aa, Mycobacterium tuberculosis
EELFSAVRFDIGWTASSDD

SEQ ID NO: 1512234 - protein, 17 aa, Mycobacterium tuberculosis
EGGGNQDWWPNRLNLKV

SEQ ID NO: 1512235 - protein, 23 aa, Mycobacterium tuberculosis
EGNLGLIRAVEKFDYTKGYKFST

SEQ ID NO: 1512236 - protein, 22 aa, Mycobacterium tuberculosis
EGNLHLNVLRCPPDREPALYAK

SEQ ID NO: 1512237 - protein, 23 aa, Mycobacterium tuberculosis
EGRPKHYWSIYQKMIVKGRDFDD

SEQ ID NO: 1512238 - protein, 36 aa, Mycobacterium tuberculosis; identical to SEQ ID NO: 114216

SEQ ID NO: 1512239 - protein, 25 aa, Mycobacterium tuberculosis
ELGQPLPLFIKWDDADYGLRAAEHG

SEQ ID NO: 1512240 - protein, 18 aa, Mycobacterium tuberculosis
ELSELGEWLVIHEGWRSE

SEQ ID NO: 1512241 - protein, 20 aa, Mycobacterium tuberculosis
ELTLHVRRDLLPRVAQRLRD

SEQ ID NO: 1512242 - protein, 25 aa, Mycobacterium tuberculosis
ELVRRFYAHWFALDASVRDLFPPDM

SEQ ID NO: 1512243 - protein, 22 aa, Mycobacterium tuberculosis
ELYPDPVLPALSLLPHTVRTAP

SEQ ID NO: 1512244 - protein, 27 aa, Mycobacterium tuberculosis
ENLTAAPIERILLRYKAINRVAVYAVP

SEQ ID NO: 1512245 - protein, 19 aa, Mycobacterium tuberculosis
EPDVACEITLQPIRRYDVD

SEQ ID NO: 1512246 - protein, 21 aa, Mycobacterium tuberculosis
ERPFMEFTPGYVLRSLDELPK

SEQ ID NO: 1512247 - protein, 18 aa, Mycobacterium tuberculosis
ESIPIRIPVDIPASVIDG

SEQ ID NO: 1512248 - protein, 23 aa, Mycobacterium tuberculosis
ETAPGLRWPDLALQGGRLNWSAV

SEQ ID NO: 1512249 - protein, 17 aa, Mycobacterium tuberculosis
EVELAKRIEAGLYATQL

SEQ ID NO: 1512250 - protein, 24 aa, Mycobacterium tuberculosis
EVGRLWDRHLLNCAVIGELLERGD

SEQ ID NO: 1512251 - protein, 22 aa, Mycobacterium tuberculosis
FAAVALASIRELGLNPQIVNVN

SEQ ID NO: 1512252 - protein, 23 aa, Mycobacterium tuberculosis
FAKALVYEMPHTLAALDCGALSE

SEQ ID NO: 1512253 - protein, 17 aa, Mycobacterium tuberculosis
FGLLKRFAKGRIVRANE

SEQ ID NO: 1512254 - protein, 17 aa, Mycobacterium tuberculosis
FHATRRLAAAMVASSAT

SEQ ID NO: 1512255 - protein, 17 aa, Mycobacterium tuberculosis
FHHYVGGPVVHVHLGLY

SEQ ID NO: 1512256 - protein, 25 aa, Mycobacterium tuberculosis
FSCIDTFPEVLWLAQRARQAWDGVR

SEQ ID NO: 1512257 - protein, 29 aa, Mycobacterium tuberculosis
FSGFDPWLPSLGNPLTFLSPANIAFALGY

SEQ ID NO: 1512258 - protein, 26 aa, Mycobacterium tuberculosis
FTGEDRLLRLRWPCPVPGAMPISEVG

SEQ ID NO: 1512259 - protein, 25 aa, Mycobacterium tuberculosis
FTNQIRWLFEKLLGESPRRSPRRQY

SEQ ID NO: 1512260 - protein, 25 aa, Mycobacterium tuberculosis
FVEATFPIAAHYFAVFPLAKHMESA

SEQ ID NO: 1512261 - protein, 19 aa, Mycobacterium tuberculosis
GAAIWHMAWSDKDDAIDWQ

SEQ ID NO: 1512262 - protein, 22 aa, Mycobacterium tuberculosis
GAALLLDSWALLGRQDLRAAED

SEQ ID NO: 1512263 - protein, 25 aa, Mycobacterium tuberculosis
GAARLLSIPLRHLYAALWRVGLLEV

SEQ ID NO: 1512264 - protein, 25 aa, Mycobacterium tuberculosis
GATAFPWRRQSALVQWYVETSGSPS

SEQ ID NO: 1512265 - protein, 20 aa, Mycobacterium tuberculosis
GDAMPWLMASAKTLSYAVNM

SEQ ID NO: 1512266 - protein, 26 aa, Mycobacterium tuberculosis
GDIVRLVFALVPFRFRKHPRARAGWD

SEQ ID NO: 1512267 - protein, 22 aa, Mycobacterium tuberculosis
GEFDYNLQWKPVGGFPVTFGWI

SEQ ID NO: 1512268 - protein, 31 aa, Mycobacterium tuberculosis
GERILTWRQLYDLDALPDHLIVVGSGVTGAE

SEQ ID NO: 1512269 - protein, 18 aa, Mycobacterium tuberculosis
GEWLVIHEGWRSELPDQL

SEQ ID NO: 1512270 - protein, 19 aa, Mycobacterium tuberculosis
GGLSRVLPIYPTVDTALGK

SEQ ID NO: 1512271 - protein, 22 aa, Mycobacterium tuberculosis
GGYPPETGGYPPQPGYPRPRHP

SEQ ID NO: 1512272 - protein, 26 aa, Mycobacterium tuberculosis
GIRARQMFDGYRFQRGPVLVVVEDGR

SEQ ID NO: 1512273 - protein, 21 aa, Mycobacterium tuberculosis
GKKLIGIVSIGDVVKSRMGEL

SEQ ID NO: 1512274 - protein, 27 aa, Mycobacterium tuberculosis
GKSTLLLEVAHRWAQSGRRALYVSGEE

SEQ ID NO: 1512275 - protein, 20 aa, Mycobacterium tuberculosis
GLAEYFVHRTGHGIGLCVHE

SEQ ID NO: 1512276 - protein, 17 aa, Mycobacterium tuberculosis
GNYNIGFANLGNYNIGF

SEQ ID NO: 1512277 - protein, 32 aa, Mycobacterium tuberculosis
GPVHPGGPTLIDLLMALFGLSTNADLGGANAD

SEQ ID NO: 1512278 - protein, 17 aa, Mycobacterium tuberculosis
GRLQLVKNPAHGLTLVS

SEQ ID NO: 1512279 - protein, 25 aa, Mycobacterium tuberculosis
GSDTVTLVWLGQRRIPGIDTGRTLR

SEQ ID NO: 1512280 - protein, 27 aa, Mycobacterium tuberculosis
GSEATTVGLFTYPVLQAADVLAYDTEL

SEQ ID NO: 1512281 - protein, 22 aa, Mycobacterium tuberculosis
GSVCWYAPELGPGTGTVFSGDT

SEQ ID NO: 1512282 - protein, 17 aa, Mycobacterium tuberculosis
GTAYRRYAIERPHMYRL

SEQ ID NO: 1512283 - protein, 22 aa, Mycobacterium tuberculosis
GVGGTWHWNTYPGIAVDIPSFS

SEQ ID NO: 1512284 - protein, 18 aa, Mycobacterium tuberculosis
GVPRPYWRSKPISVVELH

SEQ ID NO: 1512285 - protein, 18 aa, Mycobacterium tuberculosis
GWMVQAFRFTLDPTAEQA

SEQ ID NO: 1512286 - protein, 17 aa, Mycobacterium tuberculosis
GYKVPRSLWFVDEVKRS

SEQ ID NO: 1512287 - protein, 21 aa, Mycobacterium tuberculosis
HAPLDAFVVRKLGAPGHDEFA

SEQ ID NO: 1512288 - protein, 19 aa, Mycobacterium tuberculosis
HFGGPSGWGGRYVPEALMA

SEQ ID NO: 1512289 - protein, 27 aa, Mycobacterium tuberculosis
HLHQGIALQVPPYNYAHPDDLLAAALD

SEQ ID NO: 1512290 - protein, 27 aa, Mycobacterium tuberculosis
HSTFFRERWPRLLRSLYPIGGVVFDGD

SEQ ID NO: 1512291 - protein, 25 aa, Mycobacterium tuberculosis
HTLNLTDVHIGWVFTRTVRNNARTH

SEQ ID NO: 1512292 - protein, 23 aa, Mycobacterium tuberculosis
HYDVYPAFGFRFDLKKSGVSVTF

SEQ ID NO: 1512293 - protein, 30 aa, Mycobacterium tuberculosis
IAGAFGYWRESGRFIVFEAPAVVLATGGIG

SEQ ID NO: 1512294 - protein, 22 aa, Mycobacterium tuberculosis
IALEIPAIPINAQLFSMPIHQV

SEQ ID NO: 1512295 - protein, 22 aa, Mycobacterium tuberculosis
IAVAHKLIVIIWHVLATGRPYQ

SEQ ID NO: 1512296 - protein, 20 aa, Mycobacterium tuberculosis
IDHPLAVATLLDRAALDARA

SEQ ID NO: 1512297 - protein, 17 aa, Mycobacterium tuberculosis
IDNAWLGELPPTATVRI

SEQ ID NO: 1512298 - protein, 22 aa, Mycobacterium tuberculosis
IERPHMYRLMFGSTSAHGINVP

SEQ ID NO: 1512299 - protein, 17 aa, Mycobacterium tuberculosis
IGKTPIKRIGVLGAGMM

SEQ ID NO: 1512300 - protein, 19 aa, Mycobacterium tuberculosis
IITGGLGGLGLFLAEKMAN

SEQ ID NO: 1512301 - protein, 19 aa, Mycobacterium tuberculosis
ILETAYVIDFLAYVYEETR

SEQ ID NO: 1512302 - protein, 18 aa, Mycobacterium tuberculosis
IQAAYWPRYGLGMGETYE

SEQ ID NO: 1512303 - protein, 18 aa, Mycobacterium tuberculosis
IQPVLVAASLLVAELGDV

SEQ ID NO: 1512304 - protein, 18 aa, Mycobacterium tuberculosis
IRRYDVDAAILFSDIVVP

SEQ ID NO: 1512305 - protein, 19 aa, Mycobacterium tuberculosis
ISAVVWRNGHDAQIMAACA

SEQ ID NO: 1512306 - protein, 44 aa, Mycobacterium tuberculosis; identical to SEQ ID NO: 164754

SEQ ID NO: 1512307 - protein, 17 aa, Mycobacterium tuberculosis
ITPIMVREINIGEIPLG

SEQ ID NO: 1512308 - protein, 26 aa, Mycobacterium tuberculosis
IVGHDRLRLALLLCAVRPEIGGALIR

SEQ ID NO: 1512309 - protein, 31 aa, Mycobacterium tuberculosis
IVVPDITIPGIPLSLNALGGVGPITVPGVPI

SEQ ID NO: 1512310 - protein, 19 aa, Mycobacterium tuberculosis
IWCTRRFRIPPSCSMTGSS

SEQ ID NO: 1512311 - protein, 20 aa, Mycobacterium tuberculosis
KDAHWFDPGKFWSGDSLPLA

SEQ ID NO: 1512312 - protein, 24 aa, Mycobacterium tuberculosis
KSLLARIGDAFLALPNGFTAHPRV

SEQ ID NO: 1512313 - protein, 17 aa, Mycobacterium tuberculosis
KVVWQVLNALRSHDERF

SEQ ID NO: 1512314 - protein, 22 aa, Mycobacterium tuberculosis
LAARGLRRILTEGGPTLLGTFV

SEQ ID NO: 1512315 - protein, 17 aa, Mycobacterium tuberculosis
LADHPDLVAGRNAPTVL

SEQ ID NO: 1512316 - protein, 21 aa, Mycobacterium tuberculosis
LAEFVGAAAGLLFSSGYTANL

SEQ ID NO: 1512317 - protein, 19 aa, Mycobacterium tuberculosis
LAGELTWRVPPLSLTNDAI

SEQ ID NO: 1512318 - protein, 20 aa, Mycobacterium tuberculosis
LALLIMLERLGPAERVVFVL

SEQ ID NO: 1512319 - protein, 26 aa, Mycobacterium tuberculosis
LAMDPQQRLMLEVSWEALEHAGIDPL

SEQ ID NO: 1512320 - protein, 22 aa, Mycobacterium tuberculosis
LAPGHWPMMVFRIGHARAPSVR

SEQ ID NO: 1512321 - protein, 25 aa, Mycobacterium tuberculosis
LDAIKAVSALDLGLPLAAGNVVSAE

SEQ ID NO: 1512322 - protein, 36 aa, Mycobacterium tuberculosis; identical to SEQ ID NO: 220036

SEQ ID NO: 1512323 - protein, 29 aa, Mycobacterium tuberculosis
LEVEAWMRPMFRGLRHWRVLRLLRTVGMH

SEQ ID NO: 1512324 - protein, 35 aa, Mycobacterium tuberculosis; identical to SEQ ID NO: 225280

SEQ ID NO: 1512325 - protein, 24 aa, Mycobacterium tuberculosis
LGMAAASFSLLISGLTAGPGSAWQ

SEQ ID NO: 1512326 - protein, 19 aa, Mycobacterium tuberculosis
LGVVARRVRKPVFASKPTG

SEQ ID NO: 1512327 - protein, 25 aa, Mycobacterium tuberculosis
LIYSQQRLHPLPPQTVVGIPSSAGS

SEQ ID NO: 1512328 - protein, 17 aa, Mycobacterium tuberculosis
LLFSTQLANAVITRKRA

SEQ ID NO: 1512329 - protein, 20 aa, Mycobacterium tuberculosis
LLIANVVHEALLQRASRKLP

SEQ ID NO: 1512330 - protein, 19 aa, Mycobacterium tuberculosis
LLQKVLDLPAGQLPPEPPI

SEQ ID NO: 1512331 - protein, 18 aa, Mycobacterium tuberculosis
LLRPVIDTVARVAARAYD

SEQ ID NO: 1512332 - protein, 19 aa, Mycobacterium tuberculosis
LLSTFIAALMGAEADALCG

SEQ ID NO: 1512333 - protein, 17 aa, Mycobacterium tuberculosis
LPRIARATKILDLARAY

SEQ ID NO: 1512334 - protein, 39 aa, Mycobacterium tuberculosis; identical to SEQ ID NO: 220319

SEQ ID NO: 1512335 - protein, 21 aa, Mycobacterium tuberculosis
LQANYAGRPSPLYEATRLSQH

SEQ ID NO: 1512336 - protein, 18 aa, Mycobacterium tuberculosis
LSRRRLVRIPWDLDSYGI

SEQ ID NO: 1512337 - protein, 26 aa, Mycobacterium tuberculosis
LTAGAVFERIWLRTTLLGAELQPFAA

SEQ ID NO: 1512338 - protein, 28 aa, Mycobacterium tuberculosis
LVERQTRLIRLLHLPTHDAYCLRIAITE

SEQ ID NO: 1512339 - protein, 18 aa, Mycobacterium tuberculosis
LVGSALLRTFAGAGFTNL

SEQ ID NO: 1512340 - protein, 18 aa, Mycobacterium tuberculosis
LVRRLLRAQFPQWADLPI

SEQ ID NO: 1512341 - protein, 25 aa, Mycobacterium tuberculosis
LVSFIHRARRLLPGDPEFGDPLSTA

SEQ ID NO: 1512342 - protein, 22 aa, Mycobacterium tuberculosis
LYGSLKMWAHLQRQGFRWPSAT

SEQ ID NO: 1512343 - protein, 24 aa, Mycobacterium tuberculosis
MAYEGKIDWAFGELLALGSLVAEG

SEQ ID NO: 1512344 - protein, 17 aa, Mycobacterium tuberculosis
MCELEAPEYFRVPKRGQ

SEQ ID NO: 1512345 - protein, 24 aa, Mycobacterium tuberculosis
MDDLHRHLLSVLIDREWRHGVRVG

SEQ ID NO: 1512346 - protein, 18 aa, Mycobacterium tuberculosis
MDEGLRFAIREGGRTVGA

SEQ ID NO: 1512347 - protein, 23 aa, Mycobacterium tuberculosis
MMPALLDFWMDADSVYLSPAPMY

SEQ ID NO: 1512348 - protein, 18 aa, Mycobacterium tuberculosis
MPGIPWYEYTNQAGSQYF

SEQ ID NO: 1512349 - protein, 17 aa, Mycobacterium tuberculosis
MQWPWSSAYRLEPAVAT

SEQ ID NO: 1512350 - protein, 37 aa, Mycobacterium tuberculosis; identical to SEQ ID NO: 220752

SEQ ID NO: 1512351 - protein, 17 aa, Mycobacterium tuberculosis
MVGRDLGLDIKRYSPRL

SEQ ID NO: 1512352 - protein, 17 aa, Mycobacterium tuberculosis
NAALHRIALTQIRMTDS

SEQ ID NO: 1512353 - protein, 19 aa, Mycobacterium tuberculosis
NIPMVYQYRHTYGRRLWEL

SEQ ID NO: 1512354 - protein, 17 aa, Mycobacterium tuberculosis
NLALFTEAERRLTEAND

SEQ ID NO: 1512355 - protein, 19 aa, Mycobacterium tuberculosis
NLHHALALAGRHLRRHAGA

SEQ ID NO: 1512356 - protein, 17 aa, Mycobacterium tuberculosis
NMTLLADAMGTVGGAAP

SEQ ID NO: 1512357 - protein, 29 aa, Mycobacterium tuberculosis
NNELGHPWTVLRATRRTDYLILEMAARHH

SEQ ID NO: 1512358 - protein, 31 aa, Mycobacterium tuberculosis; identical to SEQ ID NO: 220927

SEQ ID NO: 1512359 - protein, 26 aa, Mycobacterium tuberculosis
NVQEDFAYHQFLIKKSKMPSQTPPEP

SEQ ID NO: 1512360 - protein, 25 aa, Mycobacterium tuberculosis
PADGASNWYTEFARLAPLMEKDVHY

SEQ ID NO: 1512361 - protein, 26 aa, Mycobacterium tuberculosis
PAQQRYPPWPASYDASLRVSWRQLQP

SEQ ID NO: 1512362 - protein, 21 aa, Mycobacterium tuberculosis
PERERTVLVLRFFDSMTQTQI

SEQ ID NO: 1512363 - protein, 39 aa, Mycobacterium tuberculosis; identical to SEQ ID NO: 226653

SEQ ID NO: 1512364 - protein, 29 aa, Mycobacterium tuberculosis
PFSKPLQNLAGLPAWLASGAPAAAMTAAA

SEQ ID NO: 1512365 - protein, 21 aa, Mycobacterium tuberculosis
PFVGPPPFRPPTFNPVDGAMV

SEQ ID NO: 1512366 - protein, 18 aa, Mycobacterium tuberculosis
PGGYGAALLLDSWALLGR

SEQ ID NO: 1512367 - protein, 24 aa, Mycobacterium tuberculosis
PGPPPPGTVSPPLPPSAPAVGVGG

SEQ ID NO: 1512368 - protein, 23 aa, Mycobacterium tuberculosis
PHQPRRTAPAPPWAKMPIGEPPP

SEQ ID NO: 1512369 - protein, 21 aa, Mycobacterium tuberculosis
PIPHGLLFERFLNPERTSMPD

SEQ ID NO: 1512370 - protein, 21 aa, Mycobacterium tuberculosis
PLDPQAIQPVLVAASLLVAEL

SEQ ID NO: 1512371 - protein, 34 aa, Mycobacterium tuberculosis; identical to SEQ ID NO: 221354

SEQ ID NO: 1512372 - protein, 36 aa, Mycobacterium tuberculosis
PPVPGKFYWMSPTQVRWRPFEFWPANTAVNIDAAGT

SEQ ID NO: 1512373 - protein, 26 aa, Mycobacterium tuberculosis
PQAGLLLVHHPLLLRGVDTVAANTPK

SEQ ID NO: 1512374 - protein, 19 aa, Mycobacterium tuberculosis
PQDPEALRRRTLITAAQYL

SEQ ID NO: 1512375 - protein, 21 aa, Mycobacterium tuberculosis
PSSGFLNWGAGSASGLLNFGN

SEQ ID NO: 1512376 - protein, 19 aa, Mycobacterium tuberculosis
PVRVYWPPVVRDNLPVVVY

SEQ ID NO: 1512377 - protein, 26 aa, Mycobacterium tuberculosis
QAYDPVFFPGLAAEWSDRRPFVGPLT

SEQ ID NO: 1512378 - protein, 21 aa, Mycobacterium tuberculosis
QDARWFLLCTVDGATVTTADG

SEQ ID NO: 1512379 - protein, 25 aa, Mycobacterium tuberculosis
QEPPPDPVPFPPYQPKVWAACRARG

SEQ ID NO: 1512380 - protein, 22 aa, Mycobacterium tuberculosis
QGGGPHAWYLSDGILARDDYNG

SEQ ID NO: 1512381 - protein, 20 aa, Mycobacterium tuberculosis
QHGPAFQGIVGLAVTQAGVA

SEQ ID NO: 1512382 - protein, 30 aa, Mycobacterium tuberculosis; identical to SEQ ID NO: 225467

SEQ ID NO: 1512383 - protein, 21 aa, Mycobacterium tuberculosis
QPAVLAFVNRALAGVLALSIE

SEQ ID NO: 1512384 - protein, 25 aa, Mycobacterium tuberculosis
QRDRAKMFALLWQSLRRQRQLLKRF

SEQ ID NO: 1512385 - protein, 23 aa, Mycobacterium tuberculosis
QREAFAWHIDLAKRTGKPLMIHN

SEQ ID NO: 1512386 - protein, 21 aa, Mycobacterium tuberculosis
QVIVLTCSPTRYGGVKGAHRI

SEQ ID NO: 1512387 - protein, 19 aa, Mycobacterium tuberculosis
QVLAVVNGFVKKLRHMRVV

SEQ ID NO: 1512388 - protein, 17 aa, Mycobacterium tuberculosis
QVRIPMLAGRRSLNLSN

SEQ ID NO: 1512389 - protein, 21 aa, Mycobacterium tuberculosis
RAAEILVYGHVPFELVSYVCC

SEQ ID NO: 1512390 - protein, 25 aa, Mycobacterium tuberculosis
RAEESAFVLLALQAPVAGDLRAIVS

SEQ ID NO: 1512391 - protein, 27 aa, Mycobacterium tuberculosis
RAGWPNYDAVASIAWLGYDAPDGLKDV

SEQ ID NO: 1512392 - protein, 26 aa, Mycobacterium tuberculosis
RDIQVRGYTLRLPLDVLVVASANPED

SEQ ID NO: 1512393 - protein, 35 aa, Mycobacterium tuberculosis; identical to SEQ ID NO: 117051

SEQ ID NO: 1512394 - protein, 20 aa, Mycobacterium tuberculosis
RELELCYAAIALVTDVDAGV

SEQ ID NO: 1512395 - protein, 18 aa, Mycobacterium tuberculosis
RGSDGQWRLSPKAMRRLG

SEQ ID NO: 1512396 - protein, 28 aa, Mycobacterium tuberculosis
RHHFSQYFVDYFITPLVAAVWSCGGADA

SEQ ID NO: 1512397 - protein, 20 aa, Mycobacterium tuberculosis
RIARATKILDLARAYGIEVS

SEQ ID NO: 1512398 - protein, 27 aa, Mycobacterium tuberculosis
RIQRRGMADNYWSMGIPGPCGPSSEIY

SEQ ID NO: 1512399 - protein, 24 aa, Mycobacterium tuberculosis
RLDAEILALVKRRAEVSKAIGKAR

SEQ ID NO: 1512400 - protein, 17 aa, Mycobacterium tuberculosis
RLKRLLDDLAGESGLRA

SEQ ID NO: 1512401 - protein, 18 aa, Mycobacterium tuberculosis
RMGALALHVAKIARRRHP

SEQ ID NO: 1512402 - protein, 19 aa, Mycobacterium tuberculosis
RNCFADMAKVAIALGDSAR

SEQ ID NO: 1512403 - protein, 19 aa, Mycobacterium tuberculosis
RNLLVPLNFHLGYHGMPIG

SEQ ID NO: 1512404 - protein, 23 aa, Mycobacterium tuberculosis
RNPRSLRVCTLLRKPDAVHANVE

SEQ ID NO: 1512405 - protein, 25 aa, Mycobacterium tuberculosis
RQKEFADLLTWLQETLSDHVKEVRL

SEQ ID NO: 1512406 - protein, 24 aa, Mycobacterium tuberculosis
RQPDGRIPIWLPPAKRLPDGLASY

SEQ ID NO: 1512407 - protein, 17 aa, Mycobacterium tuberculosis
RQVLGPNAVQAGSLNRP

SEQ ID NO: 1512408 - protein, 25 aa, Mycobacterium tuberculosis
RRAHGLPAISLGWGLWDQASAMTGG

SEQ ID NO: 1512409 - protein, 18 aa, Mycobacterium tuberculosis
RRHSVLPMLLASNSQRLQ

SEQ ID NO: 1512410 - protein, 20 aa, Mycobacterium tuberculosis
RSLPLLECWTALAALSRDTT

SEQ ID NO: 1512411 - protein, 19 aa, Mycobacterium tuberculosis
RSQARILGIFVDGKRVPVV

SEQ ID NO: 1512412 - protein, 24 aa, Mycobacterium tuberculosis
RSVTWLACDVPSLGWRVYRLVPAD

SEQ ID NO: 1512413 - protein, 18 aa, Mycobacterium tuberculosis
RSYFWVAKTTAADGLGYL

SEQ ID NO: 1512414 - protein, 24 aa, Mycobacterium tuberculosis
RTTGPWEPWLRALPVEFDSAEQVF

SEQ ID NO: 1512415 - protein, 18 aa, Mycobacterium tuberculosis
RTWPDRVIDRAPLWCAVD

SEQ ID NO: 1512416 - protein, 19 aa, Mycobacterium tuberculosis
RVVAPHRLTDPKAGPLIAV

SEQ ID NO: 1512417 - protein, 20 aa, Mycobacterium tuberculosis
RWFLPLAVPLGLGPKNSELW

SEQ ID NO: 1512418 - protein, 20 aa, Mycobacterium tuberculosis
RWQRIVALTMIGISTALIGG

SEQ ID NO: 1512419 - protein, 25 aa, Mycobacterium tuberculosis
RWSALLVGAWWPARPDAPMAGVTYW

SEQ ID NO: 1512420 - protein, 27 aa, Mycobacterium tuberculosis
RYPARYLFVFLDHHGMLSVFGSPTWRT

SEQ ID NO: 1512421 - protein, 23 aa, Mycobacterium tuberculosis
SDQVYLDLLTGWRDAWELGRAAR

SEQ ID NO: 1512422 - protein, 19 aa, Mycobacterium tuberculosis
SETAVYNVLPQWAKLAAKP

SEQ ID NO: 1512423 - protein, 25 aa, Mycobacterium tuberculosis
SFATYFNAFPASYWRRWTTCKSVVL

SEQ ID NO: 1512424 - protein, 37 aa, Mycobacterium tuberculosis; identical to SEQ ID NO: 222887

SEQ ID NO: 1512425 - protein, 26 aa, Mycobacterium tuberculosis
SGLDSRAYRLRWPAGTIVFEVDQPQV

SEQ ID NO: 1512426 - protein, 26 aa, Mycobacterium tuberculosis
SHAFHSLLMEPMLAEFTRIAAGISVS

SEQ ID NO: 1512427 - protein, 18 aa, Mycobacterium tuberculosis
SIGSFQNSRFLLAELATE

SEQ ID NO: 1512428 - protein, 22 aa, Mycobacterium tuberculosis
SLARLPLILSDGHLRELALTGK

SEQ ID NO: 1512429 - protein, 24 aa, Mycobacterium tuberculosis
SLGDELMRRFNGAALETLLTRLNL

SEQ ID NO: 1512430 - protein, 17 aa, Mycobacterium tuberculosis
SNVMIGSWFAGTYESPG

SEQ ID NO: 1512431 - protein, 19 aa, Mycobacterium tuberculosis
SQDEIVWAKEFFAEFARDG

SEQ ID NO: 1512432 - protein, 22 aa, Mycobacterium tuberculosis
STANAFVLRGGVPVFVDIRPDT

SEQ ID NO: 1512433 - protein, 23 aa, Mycobacterium tuberculosis
SVLAALGRIDYWFVTDGRRVHKT

SEQ ID NO: 1512434 - protein, 24 aa, Mycobacterium tuberculosis
SVLQAPLFTAYGTLYQQVSAEAAA

SEQ ID NO: 1512435 - protein, 26 aa, Mycobacterium tuberculosis
SVPGYPNFFTVFGPYGYVGSSYFALI

SEQ ID NO: 1512436 - protein, 24 aa, Mycobacterium tuberculosis
TDDALTVLWHSITWQYLPADERAA

SEQ ID NO: 1512437 - protein, 17 aa, Mycobacterium tuberculosis
TDDPARPLTVTGGLTFA

SEQ ID NO: 1512438 - protein, 23 aa, Mycobacterium tuberculosis
TDEALLDIYRKLRPGEPPTKESA

SEQ ID NO: 1512439 - protein, 20 aa, Mycobacterium tuberculosis
TEPMLFEWTDRDTLLYAIGV

SEQ ID NO: 1512440 - protein, 19 aa, Mycobacterium tuberculosis
TGTPALFTLSASSADALRQ

SEQ ID NO: 1512441 - protein, 27 aa, Mycobacterium tuberculosis
TGVSRRHLEIRWDGQVALLADLNSTNG

SEQ ID NO: 1512442 - protein, 24 aa, Mycobacterium tuberculosis
TGYAHGELADRVNLAITALRDEVE

SEQ ID NO: 1512443 - protein, 29 aa, Mycobacterium tuberculosis
THFSVGPIIVPRIAGTLPVIDINIGDPGG

SEQ ID NO: 1512444 - protein, 21 aa, Mycobacterium tuberculosis
THPEAGHYGLATWFTRMDAMT

SEQ ID NO: 1512445 - protein, 23 aa, Mycobacterium tuberculosis
THPMLCALPIERAIDAAETLDAE

SEQ ID NO: 1512446 - protein, 21 aa, Mycobacterium tuberculosis
TIPGFAINPFGLDVPLSGGTN

SEQ ID NO: 1512447 - protein, 19 aa, Mycobacterium tuberculosis
TIRIPVHMVEVINKLGRIQ

SEQ ID NO: 1512448 - protein, 29 aa, Mycobacterium tuberculosis
TITISSAAKMFNCTGWKIGWACGPAELIA

SEQ ID NO: 1512449 - protein, 22 aa, Mycobacterium tuberculosis
TLGVITALDLRLHPTPSHRVTA

SEQ ID NO: 1512450 - protein, 20 aa, Mycobacterium tuberculosis
TMFDPSAVFYMNKIAVGPDA

SEQ ID NO: 1512451 - protein, 26 aa, Mycobacterium tuberculosis
TPAGSLWRLEFLLQSTQDPSLLVPAE

SEQ ID NO: 1512452 - protein, 17 aa, Mycobacterium tuberculosis
TRDRLLIVTLADVASRV

SEQ ID NO: 1512453 - protein, 21 aa, Mycobacterium tuberculosis
TRLADRGMRLTLRVYAYSSCC

SEQ ID NO: 1512454 - protein, 25 aa, Mycobacterium tuberculosis
TSAGPLNIPIIDIPAAPGFGNSTQM

SEQ ID NO: 1512455 - protein, 25 aa, Mycobacterium tuberculosis
TSAPMCDIFLVLAQAPDGLSCFLLP

SEQ ID NO: 1512456 - protein, 29 aa, Mycobacterium tuberculosis
TVARRGGIVILPQDLPIPAVKQTVAFVKS

SEQ ID NO: 1512457 - protein, 28 aa, Mycobacterium tuberculosis
TVGLGPFTVPPISIPSLPIASITGSVDL

SEQ ID NO: 1512458 - protein, 18 aa, Mycobacterium tuberculosis
VAAPWDARRARELDDVSL

SEQ ID NO: 1512459 - protein, 18 aa, Mycobacterium tuberculosis
VAVRRISMSFVNVAPQLV

SEQ ID NO: 1512460 - protein, 27 aa, Mycobacterium tuberculosis
VDIAFTWDHFFPLYGDPDGPHFECWTV

SEQ ID NO: 1512461 - protein, 17 aa, Mycobacterium tuberculosis
VGLLFPSADGCAGHSDG

SEQ ID NO: 1512462 - protein, 18 aa, Mycobacterium tuberculosis
VHAALRQVLGPNAVQAGS

SEQ ID NO: 1512463 - protein, 18 aa, Mycobacterium tuberculosis
VHIAKITRREYPNQVLPE

SEQ ID NO: 1512464 - protein, 17 aa, Mycobacterium tuberculosis
VIVRDWYSIRHYALTED

SEQ ID NO: 1512465 - protein, 24 aa, Mycobacterium tuberculosis
VLAGYPLVNLKVTLLDGAYHEVDS

SEQ ID NO: 1512466 - protein, 22 aa, Mycobacterium tuberculosis
VLASSIPLINIPPTPGIGNSTI

SEQ ID NO: 1512467 - protein, 25 aa, Mycobacterium tuberculosis
VLGVYGPPLKFDVSLPLSAISGFAR

SEQ ID NO: 1512468 - protein, 19 aa, Mycobacterium tuberculosis
VMIGSWFAGTYESPGDLMR

SEQ ID NO: 1512469 - protein, 40 aa, Mycobacterium tuberculosis
VMPGSVMTIPGMRLPFTSIVPFVVYYGPVELPQSTLTLPT

SEQ ID NO: 1512470 - protein, 26 aa, Mycobacterium tuberculosis
VNFRDVLVALGIYPGAAELGAEGAGV

SEQ ID NO: 1512471 - protein, 24 aa, Mycobacterium tuberculosis
VPRQRSALRWLRTVNRSPGLVSFI

SEQ ID NO: 1512472 - protein, 17 aa, Mycobacterium tuberculosis
VPVAAPWDARRARELDD

SEQ ID NO: 1512473 - protein, 28 aa, Mycobacterium tuberculosis
VRAHLIDAARPFIFDTGLAPAAVGAARA

SEQ ID NO: 1512474 - protein, 20 aa, Mycobacterium tuberculosis
VRDWYSIRHYALTEDGRCQA

SEQ ID NO: 1512475 - protein, 24 aa, Mycobacterium tuberculosis
VSDEFFSLFLDPTMAYTCAYFERE

SEQ ID NO: 1512476 - protein, 35 aa, Mycobacterium tuberculosis; identical to SEQ ID NO: 225762

SEQ ID NO: 1512477 - protein, 30 aa, Mycobacterium tuberculosis; identical to SEQ ID NO: 224334

SEQ ID NO: 1512478 - protein, 17 aa, Mycobacterium tuberculosis
VVSLAKRYTGRGMPLLD

SEQ ID NO: 1512479 - protein, 20 aa, Mycobacterium tuberculosis
VYATPVDQRGWSSRAPRIVF

SEQ ID NO: 1512480 - protein, 22 aa, Mycobacterium tuberculosis
WAHLQRQGFRWPSATVKTIMRA

SEQ ID NO: 1512481 - protein, 17 aa, Mycobacterium tuberculosis
WAPFRPPKVLSPLFPRP

SEQ ID NO: 1512482 - protein, 21 aa, Mycobacterium tuberculosis
WVDDYPVMLINANAAPDRKRL

SEQ ID NO: 1512483 - protein, 18 aa, Mycobacterium tuberculosis
WYAELGRRHELLSGLVPQ

SEQ ID NO: 1512484 - protein, 19 aa, Mycobacterium tuberculosis
YATQLMTELSERGEKLPAA

SEQ ID NO: 1512485 - protein, 23 aa, Mycobacterium tuberculosis
YHGWGFHEDGAASGLRAARRLGA

SEQ ID NO: 1512486 - protein, 19 aa, Mycobacterium tuberculosis
YLIDQPLMRNVLADLAVEA

SEQ ID NO: 1512487 - protein, 25 aa, Mycobacterium tuberculosis
YPDDRSMWLCHESIYQAVYQPQSRL

SEQ ID NO: 1512488 - protein, 27 aa, Mycobacterium tuberculosis
YPKFLDRNLIGHVPLIGGGLSLLLSDG

SEQ ID NO: 1512489 - protein, 18 aa, Mycobacterium tuberculosis
YVNQRWLGGMLTNFSTVH

SEQ ID NO: 1512490 - protein, 24 aa, Mycobacterium tuberculosis
AAAAAWDGLADELAVAASWFGSVT

SEQ ID NO: 1512491 - protein, 24 aa, Mycobacterium tuberculosis
AAGSAIPGLPPGLPPGVVANLAAT

SEQ ID NO: 1512492 - protein, 23 aa, Mycobacterium tuberculosis
AAKLIAAARKPVLYVGGGVIRGE

SEQ ID NO: 1512493 - protein, 21 aa, Mycobacterium tuberculosis
AALPSPPRGFTPAPPPQWDDL

SEQ ID NO: 1512494 - protein, 25 aa, Mycobacterium tuberculosis
AARQGFTIALVPPSDDPVPPGMHAL

SEQ ID NO: 1512495 - protein, 34 aa, Mycobacterium tuberculosis; identical to SEQ ID NO: 215576

SEQ ID NO: 1512496 - protein, 20 aa, Mycobacterium tuberculosis
AATVPPPVIAANRAQLMVLI

SEQ ID NO: 1512497 - protein, 17 aa, Mycobacterium tuberculosis
ADATGTPLDLLYDVSHN

SEQ ID NO: 1512498 - protein, 22 aa, Mycobacterium tuberculosis
ADGVYAAWFTVLGHGPVTGTVV

SEQ ID NO: 1512499 - protein, 23 aa, Mycobacterium tuberculosis
ADVYALQSALPPRFQSNSAFAAN

SEQ ID NO: 1512500 - protein, 20 aa, Mycobacterium tuberculosis
AFEGPPPWNIGEPQPELATL

SEQ ID NO: 1512501 - protein, 25 aa, Mycobacterium tuberculosis
AFNTPALNIHQIPLGFQVPGSIDAI

SEQ ID NO: 1512502 - protein, 25 aa, Mycobacterium tuberculosis
AFVNALPVFIASDPVWAKKFTDARV

SEQ ID NO: 1512503 - protein, 22 aa, Mycobacterium tuberculosis
AGGSVQWVLGNLGAIPTVSIDY

SEQ ID NO: 1512504 - protein, 20 aa, Mycobacterium tuberculosis
AGKITYRIKLEVSFKMRPAQ

SEQ ID NO: 1512505 - protein, 27 aa, Mycobacterium tuberculosis
AGSIDVVLRLPGQRYLVVDYKTNHLGD

SEQ ID NO: 1512506 - protein, 25 aa, Mycobacterium tuberculosis
AGTGWLPGWRLTFGGEDIGWEGALA

SEQ ID NO: 1512507 - protein, 31 aa, Mycobacterium tuberculosis; identical to SEQ ID NO: 215967

SEQ ID NO: 1512508 - protein, 18 aa, Mycobacterium tuberculosis
AIVGPIVYLGGGAGYRSK

SEQ ID NO: 1512509 - protein, 34 aa, Mycobacterium tuberculosis; identical to SEQ ID NO: 216027

SEQ ID NO: 1512510 - protein, 17 aa, Mycobacterium tuberculosis
ALIELCGLLGYDARRDT

SEQ ID NO: 1512511 - protein, 19 aa, Mycobacterium tuberculosis
ALLAARWALQTHGAIGFTC

SEQ ID NO: 1512512 - protein, 19 aa, Mycobacterium tuberculosis
ALTLFPVGLSIPTGGPLTL

SEQ ID NO: 1512513 - protein, 24 aa, Mycobacterium tuberculosis
ALTQATCLFLDRQAFERLLATHPA

SEQ ID NO: 1512514 - protein, 17 aa, Mycobacterium tuberculosis
ALVKTYVADALAADLYL

SEQ ID NO: 1512515 - protein, 17 aa, Mycobacterium tuberculosis
APPVGGLHLQFGRNAST

SEQ ID NO: 1512516 - protein, 25 aa, Mycobacterium tuberculosis
APRLSRRILHQLYLGYPDSAAAQGI

SEQ ID NO: 1512517 - protein, 17 aa, Mycobacterium tuberculosis
APSWRKGPRHIAGRGPR

SEQ ID NO: 1512518 - protein, 24 aa, Mycobacterium tuberculosis
AQRRDMMWICRDGDRAKNHLLEAN

SEQ ID NO: 1512519 - protein, 20 aa, Mycobacterium tuberculosis
ARIAGRPAAVLLHLGPGLGN

SEQ ID NO: 1512520 - protein, 22 aa, Mycobacterium tuberculosis
ASAMAAWLFGRPAAVPEIARSR

SEQ ID NO: 1512521 - protein, 23 aa, Mycobacterium tuberculosis
ASARRLQLNRIPLYQIHQPNPVV

SEQ ID NO: 1512522 - protein, 20 aa, Mycobacterium tuberculosis
ASLREHTWKRSSFSGTEIFG

SEQ ID NO: 1512523 - protein, 26 aa, Mycobacterium tuberculosis
ASRFYNLVLADCGAGFFDPLTRGVLS

SEQ ID NO: 1512524 - protein, 20 aa, Mycobacterium tuberculosis
ATRWRHGGSPLLRGLIDAGT

SEQ ID NO: 1512525 - protein, 22 aa, Mycobacterium tuberculosis
ATTTTYFIRTDQLPLVRALVDM

SEQ ID NO: 1512526 - protein, 21 aa, Mycobacterium tuberculosis
AVHFFRRELVARLATGWVLEE

SEQ ID NO: 1512527 - protein, 19 aa, Mycobacterium tuberculosis
AVILDSDPWRKLSANRDNR

SEQ ID NO: 1512528 - protein, 23 aa, Mycobacterium tuberculosis
AWATQLRIMQAQLLAKIAAAVGN

SEQ ID NO: 1512529 - protein, 18 aa, Mycobacterium tuberculosis
AYGLYPSWRGRGLATRAV

SEQ ID NO: 1512530 - protein, 18 aa, Mycobacterium tuberculosis
CDPPPVQRPHPPLWIGGE

SEQ ID NO: 1512531 - protein, 21 aa, Mycobacterium tuberculosis
CERLGLPVFVKPARGGSSIGV

SEQ ID NO: 1512532 - protein, 17 aa, Mycobacterium tuberculosis
CHRAILSQGIYGFENVG

SEQ ID NO: 1512533 - protein, 17 aa, Mycobacterium tuberculosis
CILSPQHRIRIVFRSPM

SEQ ID NO: 1512534 - protein, 24 aa, Mycobacterium tuberculosis
DAFEHFPPPILKPVILAAKSATLF

SEQ ID NO: 1512535 - protein, 23 aa, Mycobacterium tuberculosis
DASLRLLVRGGRFLEMGKTDIRD

SEQ ID NO: 1512536 - protein, 18 aa, Mycobacterium tuberculosis
DAVSLRRILNTPRRGIGD

SEQ ID NO: 1512537 - protein, 23 aa, Mycobacterium tuberculosis
DDLITAHLRGWTLDRLPAVDRAI

SEQ ID NO: 1512538 - protein, 27 aa, Mycobacterium tuberculosis
DEAGFGVLLPSWWDRRRKLGLVLSAYT

SEQ ID NO: 1512539 - protein, 23 aa, Mycobacterium tuberculosis
DELDFLRLAVFDALLVLQADTAP

SEQ ID NO: 1512540 - protein, 18 aa, Mycobacterium tuberculosis
DEVLLRVFGKVVELAFLA

SEQ ID NO: 1512541 - protein, 22 aa, Mycobacterium tuberculosis
DFPASAVRFFASARSQGRKLAF

SEQ ID NO: 1512542 - protein, 23 aa, Mycobacterium tuberculosis
DFSPPPPRYTTGVLSKYVKLVSS

SEQ ID NO: 1512543 - protein, 20 aa, Mycobacterium tuberculosis
DGEHVVPIPRLLNVEDYLDY

SEQ ID NO: 1512544 - protein, 37 aa, Mycobacterium tuberculosis; identical to SEQ ID NO: 224891

SEQ ID NO: 1512545 - protein, 21 aa, Mycobacterium tuberculosis
DIFECAGFAVHFFRRELVARL

SEQ ID NO: 1512546 - protein, 20 aa, Mycobacterium tuberculosis
DLGPRRALTGEPLAPQLTAT

SEQ ID NO: 1512547 - protein, 18 aa, Mycobacterium tuberculosis
DPVLGARPLRRTIQREIE

SEQ ID NO: 1512548 - protein, 25 aa, Mycobacterium tuberculosis
DQLEIKTILHRLLRRYRLELSRPDY

SEQ ID NO: 1512549 - protein, 23 aa, Mycobacterium tuberculosis
DRHLRYPLRDVIWGHDQDLLNTT

SEQ ID NO: 1512550 - protein, 18 aa, Mycobacterium tuberculosis
DVWTPRDRMPVFPVPDGH

SEQ ID NO: 1512551 - protein, 21 aa, Mycobacterium tuberculosis
EAELQRIVASIPVKRLRQAGV

SEQ ID NO: 1512552 - protein, 30 aa, Mycobacterium tuberculosis; identical to SEQ ID NO: 217389

SEQ ID NO: 1512553 - protein, 22 aa, Mycobacterium tuberculosis
EANKIFIEKAVDLGVQALAGAL

SEQ ID NO: 1512554 - protein, 21 aa, Mycobacterium tuberculosis
EASIVVIRILGGYRAWQSGID

SEQ ID NO: 1512555 - protein, 46 aa, Mycobacterium tuberculosis
EATFFNFEFPRNGFQLRRPLFPPLPGTLPEPEIWARLVRALGVVDE

SEQ ID NO: 1512556 - protein, 20 aa, Mycobacterium tuberculosis
EEILAAYHLVARVEGVFVEP

SEQ ID NO: 1512557 - protein, 19 aa, Mycobacterium tuberculosis
EESRFRGMCEARGLPAVRI

SEQ ID NO: 1512558 - protein, 18 aa, Mycobacterium tuberculosis
EGGHRILANWLTCCGWTQ

SEQ ID NO: 1512559 - protein, 21 aa, Mycobacterium tuberculosis
ELDPVGLRQTWLDLHESWLID

SEQ ID NO: 1512560 - protein, 26 aa, Mycobacterium tuberculosis
ELDRRGLLRRIGGAPYLHTLISTVPT

SEQ ID NO: 1512561 - protein, 18 aa, Mycobacterium tuberculosis
ELGFESFVYATPVDQRGW

SEQ ID NO: 1512562 - protein, 26 aa, Mycobacterium tuberculosis
EPGNSLFITVNCWGRLVTGVGAALGK

SEQ ID NO: 1512563 - protein, 18 aa, Mycobacterium tuberculosis
EPIIARMLTAYGAGVDMV

SEQ ID NO: 1512564 - protein, 22 aa, Mycobacterium tuberculosis
ERLNLPAGWSYHTRVLTSELRV

SEQ ID NO: 1512565 - protein, 21 aa, Mycobacterium tuberculosis
ERSSHTWFVLRELLGHQNVKN

SEQ ID NO: 1512566 - protein, 17 aa, Mycobacterium tuberculosis
ESTRFFPMLTTAAGTVK

SEQ ID NO: 1512567 - protein, 18 aa, Mycobacterium tuberculosis
EVARRWLAALSADQIGIC

SEQ ID NO: 1512568 - protein, 23 aa, Mycobacterium tuberculosis
EVRPDRSTTLALRWLVGYSRQRR

SEQ ID NO: 1512569 - protein, 19 aa, Mycobacterium tuberculosis
FERVAPECPDWLPPGAKDM

SEQ ID NO: 1512570 - protein, 36 aa, Mycobacterium tuberculosis; identical to SEQ ID NO: 226191

SEQ ID NO: 1512571 - protein, 18 aa, Mycobacterium tuberculosis
FNWDPLRWFEEDEPIYGH

SEQ ID NO: 1512572 - protein, 35 aa, Mycobacterium tuberculosis
FSVAGETIVRLKARLWFVHRGIEKLFHGRPATAAV

SEQ ID NO: 1512573 - protein, 19 aa, Mycobacterium tuberculosis
FTIPGFSVPAQPLPLSIDI

SEQ ID NO: 1512574 - protein, 25 aa, Mycobacterium tuberculosis
GADPGLYARALADRALIDAVAGITD

SEQ ID NO: 1512575 - protein, 21 aa, Mycobacterium tuberculosis
GAFGDLLSAAGLPAPKYGTAT

SEQ ID NO: 1512576 - protein, 19 aa, Mycobacterium tuberculosis
GATLPAAAWQRCRTHYAAN

SEQ ID NO: 1512577 - protein, 22 aa, Mycobacterium tuberculosis
GDAFARIFGGSIVPQEVEALLR

SEQ ID NO: 1512578 - protein, 18 aa, Mycobacterium tuberculosis
GDCLAPPRPVLRAALSPG

SEQ ID NO: 1512579 - protein, 25 aa, Mycobacterium tuberculosis
GDTNTGFGNAGFFNMGIGNAGNEDM

SEQ ID NO: 1512580 - protein, 20 aa, Mycobacterium tuberculosis
GEDFSWYLEEVPGAMARLGV

SEQ ID NO: 1512581 - protein, 18 aa, Mycobacterium tuberculosis
GEGPARAWERGRFAAPYL

SEQ ID NO: 1512582 - protein, 20 aa, Mycobacterium tuberculosis
GFEMQFGTNHLGHFALTGLL

SEQ ID NO: 1512583 - protein, 31 aa, Mycobacterium tuberculosis; identical to SEQ ID NO: 218374

SEQ ID NO: 1512584 - protein, 25 aa, Mycobacterium tuberculosis
GGGVGAFLTALFASPAKALSLNAGL

SEQ ID NO: 1512585 - protein, 17 aa, Mycobacterium tuberculosis
GGMHSLWTDVLAAQVFA

SEQ ID NO: 1512586 - protein, 18 aa, Mycobacterium tuberculosis
GIDPWEISFGFHGLDSLQ

SEQ ID NO: 1512587 - protein, 30 aa, Mycobacterium tuberculosis; identical to SEQ ID NO: 218513

SEQ ID NO: 1512588 - protein, 17 aa, Mycobacterium tuberculosis
GIPAFYTPAGVGTQVAD

SEQ ID NO: 1512589 - protein, 18 aa, Mycobacterium tuberculosis
GMLAALHVLAALGEQSRP

SEQ ID NO: 1512590 - protein, 18 aa, Mycobacterium tuberculosis
GNKIILFGARTGLDGIGG

SEQ ID NO: 1512591 - protein, 24 aa, Mycobacterium tuberculosis
GPLGRLRNIAYTQLDMRDVKRVKD

SEQ ID NO: 1512592 - protein, 17 aa, Mycobacterium tuberculosis
GPWHLLPTGPVVCSSAC

SEQ ID NO: 1512593 - protein, 17 aa, Mycobacterium tuberculosis
GQLIVIGMQGGVKAELN

SEQ ID NO: 1512594 - protein, 24 aa, Mycobacterium tuberculosis
GQVNKVWLWQSLPGPWIGSARNTV

SEQ ID NO: 1512595 - protein, 31 aa, Mycobacterium tuberculosis
GTIEDYALTEWQRILDVNLTGVFLGIRAVVK

SEQ ID NO: 1512596 - protein, 27 aa, Mycobacterium tuberculosis
GTVDAALRPIIDRAYQPGPAPAVNPRD

SEQ ID NO: 1512597 - protein, 24 aa, Mycobacterium tuberculosis
GVIKMVLAMRHELLPATLHVDVPS

SEQ ID NO: 1512598 - protein, 19 aa, Mycobacterium tuberculosis
GWYGSSLVVADRWFPSSKT

SEQ ID NO: 1512599 - protein, 20 aa, Mycobacterium tuberculosis
GYGMVSYWTAYLKANYPAEY

SEQ ID NO: 1512600 - protein, 19 aa, Mycobacterium tuberculosis
HDAEFFFVANAHLRLHVHL

SEQ ID NO: 1512601 - protein, 22 aa, Mycobacterium tuberculosis
HERANDILIRISGVEPTTGTVL

SEQ ID NO: 1512602 - protein, 21 aa, Mycobacterium tuberculosis
HGHTEWLPPPHLDHGQPRTNT

SEQ ID NO: 1512603 - protein, 38 aa, Mycobacterium tuberculosis
HHKSTYIFLADRHSGWWRAPLRWTLRGSLALRSHLMVR

SEQ ID NO: 1512604 - protein, 20 aa, Mycobacterium tuberculosis
HICPISMTYAVVPALRYNSE

SEQ ID NO: 1512605 - protein, 17 aa, Mycobacterium tuberculosis
HIGIRLPGRYNVANCLV

SEQ ID NO: 1512606 - protein, 25 aa, Mycobacterium tuberculosis
HKVKSRTFHYPGGLVDFVKHINRTK

SEQ ID NO: 1512607 - protein, 17 aa, Mycobacterium tuberculosis
HSVKVIPSRGAWLEFDV

SEQ ID NO: 1512608 - protein, 17 aa, Mycobacterium tuberculosis
HTWKRSSFSGTEIFGKT

SEQ ID NO: 1512609 - protein, 24 aa, Mycobacterium tuberculosis
HYAGAFPAWLAPVQVVGIPVADEH

SEQ ID NO: 1512610 - protein, 23 aa, Mycobacterium tuberculosis
IATTRFLLDVNISGGLPAFTLFA

SEQ ID NO: 1512611 - protein, 17 aa, Mycobacterium tuberculosis
IDDLNSPAPTLMISVDE

SEQ ID NO: 1512612 - protein, 22 aa, Mycobacterium tuberculosis
IDQLPSLPPLPTDLRTRLDAAL

SEQ ID NO: 1512613 - protein, 22 aa, Mycobacterium tuberculosis
IDWVIKRKLFQRYQDRYDMELS

SEQ ID NO: 1512614 - protein, 18 aa, Mycobacterium tuberculosis
IEALGPIALPVKTSADSG

SEQ ID NO: 1512615 - protein, 47 aa, Mycobacterium tuberculosis
IGIPINIGPLTITPITLFAQQTFVNQLPFPTFSLGKITIPQIQTFDS

SEQ ID NO: 1512616 - protein, 26 aa, Mycobacterium tuberculosis
IGLGNLGSYNFGFGNAGDFNLGFANS

SEQ ID NO: 1512617 - protein, 25 aa, Mycobacterium tuberculosis
IGPIVIPDTTILPPLHLQITGDADY

SEQ ID NO: 1512618 - protein, 19 aa, Mycobacterium tuberculosis
IMGEVVDRSIFMWTAAPHA

SEQ ID NO: 1512619 - protein, 17 aa, Mycobacterium tuberculosis
IPVIENISYLVGDSKHR

SEQ ID NO: 1512620 - protein, 22 aa, Mycobacterium tuberculosis
IREVLRVWLGVAGLPAPGCRTI

SEQ ID NO: 1512621 - protein, 27 aa, Mycobacterium tuberculosis
ITAKMTARYSQWVRSRPLLLAGKSVTG

SEQ ID NO: 1512622 - protein, 23 aa, Mycobacterium tuberculosis
ITVDPITLTIPGLSLDAAVSEIR

SEQ ID NO: 1512623 - protein, 24 aa, Mycobacterium tuberculosis
IYGDFFNFYLCDISLKVNGLQPGG

SEQ ID NO: 1512624 - protein, 17 aa, Mycobacterium tuberculosis
KARYMWVSTFHSTCVRI

SEQ ID NO: 1512625 - protein, 19 aa, Mycobacterium tuberculosis
KAVFSARALAEVCRRGWAQ

SEQ ID NO: 1512626 - protein, 20 aa, Mycobacterium tuberculosis
KDKQLYTLDLGSLVAGSRYR

SEQ ID NO: 1512627 - protein, 23 aa, Mycobacterium tuberculosis
KEHFDFFPLTVDVEERMYAAGRI

SEQ ID NO: 1512628 - protein, 23 aa, Mycobacterium tuberculosis
KISELYDRVGFAAAGKFNEFDNL

SEQ ID NO: 1512629 - protein, 18 aa, Mycobacterium tuberculosis
KPVVLRRATPLQAIAAMD

SEQ ID NO: 1512630 - protein, 25 aa, Mycobacterium tuberculosis
KPVVRRRILLPEHKDFGRIAPDEKT

SEQ ID NO: 1512631 - protein, 32 aa, Mycobacterium tuberculosis
KRDLGMLRNMWRFWYQIPMSLPVIGPRVISDP

SEQ ID NO: 1512632 - protein, 20 aa, Mycobacterium tuberculosis
KTAVLTRRIAYLMAARGVGV

SEQ ID NO: 1512633 - protein, 27 aa, Mycobacterium tuberculosis
LAKRDSEWMGRVHRFLGLQVGVILATM

SEQ ID NO: 1512634 - protein, 19 aa, Mycobacterium tuberculosis
LAVDIPALNLRRQLRAIWV

SEQ ID NO: 1512635 - protein, 25 aa, Mycobacterium tuberculosis
LCAGEKMMLLFESANFDEAVFCEPE

SEQ ID NO: 1512636 - protein, 24 aa, Mycobacterium tuberculosis
LDGVRIFEQLAIADPVTAAFLSIH

SEQ ID NO: 1512637 - protein, 17 aa, Mycobacterium tuberculosis
LDLVAWATGLPALGPEA

SEQ ID NO: 1512638 - protein, 28 aa, Mycobacterium tuberculosis
LDRVRGPIPFSLRKFLAGKQVVPHQASF

SEQ ID NO: 1512639 - protein, 18 aa, Mycobacterium tuberculosis
LGPIALPVKTSADSGKLF

SEQ ID NO: 1512640 - protein, 22 aa, Mycobacterium tuberculosis
LGRRELLPYSDLDVLLLHDGKP

SEQ ID NO: 1512641 - protein, 38 aa, Mycobacterium tuberculosis
LIHRGQGRWYPGEPLPRWQIALYWRTDGRPLWTNDALL

SEQ ID NO: 1512642 - protein, 17 aa, Mycobacterium tuberculosis
LLDKIFYRSGQGVTLQA

SEQ ID NO: 1512643 - protein, 18 aa, Mycobacterium tuberculosis
LNIGTIEDYALTEWQRIL

SEQ ID NO: 1512644 - protein, 18 aa, Mycobacterium tuberculosis
LPIEGPAWPLTVQPETGV

SEQ ID NO: 1512645 - protein, 28 aa, Mycobacterium tuberculosis
LPPEINSALMFAGPGSGPLIAAATAWGE

SEQ ID NO: 1512646 - protein, 22 aa, Mycobacterium tuberculosis
LQAAAAWDGLAAELGTAASSFS

SEQ ID NO: 1512647 - protein, 27 aa, Mycobacterium tuberculosis
LREANGDRYLPIWIGQSEAAAIALEQQ

SEQ ID NO: 1512648 - protein, 20 aa, Mycobacterium tuberculosis
LRRILDTVARQEPGLSWAAG

SEQ ID NO: 1512649 - protein, 19 aa, Mycobacterium tuberculosis
LRRWWPRRYRRSSVYWRLM

SEQ ID NO: 1512650 - protein, 17 aa, Mycobacterium tuberculosis
LRSLPADGLKLAPGEPA

SEQ ID NO: 1512651 - protein, 20 aa, Mycobacterium tuberculosis
LSAALSAQLGDALNAYVDAA

SEQ ID NO: 1512652 - protein, 17 aa, Mycobacterium tuberculosis
LTAYRARSTGQRPSWAP

SEQ ID NO: 1512653 - protein, 18 aa, Mycobacterium tuberculosis
LTQETFIRVFRSVQNYQP

SEQ ID NO: 1512654 - protein, 23 aa, Mycobacterium tuberculosis
LTRQDIDDIFWLQATIAQELATS

SEQ ID NO: 1512655 - protein, 18 aa, Mycobacterium tuberculosis
LTTYPNHDIATVVDWMLL

SEQ ID NO: 1512656 - protein, 17 aa, Mycobacterium tuberculosis
LVETTLLRRRAAGKLGE

SEQ ID NO: 1512657 - protein, 17 aa, Mycobacterium tuberculosis
LVKVIRDLFNEDFVGLI

SEQ ID NO: 1512658 - protein, 24 aa, Mycobacterium tuberculosis
LVLEAPRRLVVRQYRLPRIGDDDA

SEQ ID NO: 1512659 - protein, 20 aa, Mycobacterium tuberculosis
LVVALERLGRWCVPGPVTES

SEQ ID NO: 1512660 - protein, 18 aa, Mycobacterium tuberculosis
MAARLGLAGWPRAAEESI

SEQ ID NO: 1512661 - protein, 25 aa, Mycobacterium tuberculosis
MADAAGRYLDWLTKHSRQILETAYV

SEQ ID NO: 1512662 - protein, 17 aa, Mycobacterium tuberculosis
MGMLFRKHLVMFGPREV

SEQ ID NO: 1512663 - protein, 29 aa, Mycobacterium tuberculosis
NGLDGAYLLVWTTTPWTLPSNLAVAVSPD

SEQ ID NO: 1512664 - protein, 20 aa, Mycobacterium tuberculosis
NGRIHRIWETTWPSWRNVAA

SEQ ID NO: 1512665 - protein, 28 aa, Mycobacterium tuberculosis
NKASRRIKLAWFLLNAARYMGAGVRGRP

SEQ ID NO: 1512666 - protein, 18 aa, Mycobacterium tuberculosis
NLAGWLQNGPTETTFSVG

SEQ ID NO: 1512667 - protein, 23 aa, Mycobacterium tuberculosis
NLDKRIVRLPKTHIKAVGTHFVS

SEQ ID NO: 1512668 - protein, 19 aa, Mycobacterium tuberculosis
NLRLVVSLAKRYTGRGMAF

SEQ ID NO: 1512669 - protein, 20 aa, Mycobacterium tuberculosis
NQLAPPDLLAWAHEGRRGYD

SEQ ID NO: 1512670 - protein, 17 aa, Mycobacterium tuberculosis
NRMFLQRLKDKLGNHAN

SEQ ID NO: 1512671 - protein, 29 aa, Mycobacterium tuberculosis
NRRGNYLYNFWRDAANPRGLWRRTTLDSY

SEQ ID NO: 1512672 - protein, 20 aa, Mycobacterium tuberculosis
PEILLQVLTTPPASGPAPFP

SEQ ID NO: 1512673 - protein, 26 aa, Mycobacterium tuberculosis
PERKALLDRLLAQKLPDGWDADLPHW

SEQ ID NO: 1512674 - protein, 20 aa, Mycobacterium tuberculosis
PFGTAPMPPGPPPPGTVSPP

SEQ ID NO: 1512675 - protein, 18 aa, Mycobacterium tuberculosis
PLHLPGFPVQFFVYKQIA

SEQ ID NO: 1512676 - protein, 24 aa, Mycobacterium tuberculosis
PLHSDPWFATQLAGFPKPILHGLC

SEQ ID NO: 1512677 - protein, 25 aa, Mycobacterium tuberculosis
PNDPLALVLIELRHPRTEPPVPSAI

SEQ ID NO: 1512678 - protein, 25 aa, Mycobacterium tuberculosis
PPAAAPAGPLPAYGADLRPPVTTPP

SEQ ID NO: 1512679 - protein, 17 aa, Mycobacterium tuberculosis
PPEINSARIYAGAGSGP

SEQ ID NO: 1512680 - protein, 25 aa, Mycobacterium tuberculosis
PSRVPVWFMRQAGRSLPEYRALRER

SEQ ID NO: 1512681 - protein, 25 aa, Mycobacterium tuberculosis
PSVRELAVFWTARSIGCSWCVDFGA

SEQ ID NO: 1512682 - protein, 17 aa, Mycobacterium tuberculosis
PVGGLHLQFGRNASTEM

SEQ ID NO: 1512683 - protein, 18 aa, Mycobacterium tuberculosis
PVLTVRSLVTRPITAEQL

SEQ ID NO: 1512684 - protein, 25 aa, Mycobacterium tuberculosis
PYEQRPPVSPGPAAGYGAPGYDQGY

SEQ ID NO: 1512685 - protein, 19 aa, Mycobacterium tuberculosis
QEGFLVRPFTQQCQIIHTE

SEQ ID NO: 1512686 - protein, 62 aa, Mycobacterium tuberculosis; identical to SEQ ID NO: 226728

SEQ ID NO: 1512687 - protein, 30 aa, Mycobacterium tuberculosis; identical to SEQ ID NO: 221673

SEQ ID NO: 1512688 - protein, 22 aa, Mycobacterium tuberculosis
QMLDTAVLLGALPPRVSPVSDG

SEQ ID NO: 1512689 - protein, 25 aa, Mycobacterium tuberculosis
QNLTQFYHPLDMFGEWNRAYGPAGF

SEQ ID NO: 1512690 - protein, 22 aa, Mycobacterium tuberculosis
QPPAPTLAPRRATRQLMVGNVG

SEQ ID NO: 1512691 - protein, 33 aa, Mycobacterium tuberculosis; identical to SEQ ID NO: 226761

SEQ ID NO: 1512692 - protein, 19 aa, Mycobacterium tuberculosis
QTIYSFTGASPRFLLDFSR

SEQ ID NO: 1512693 - protein, 23 aa, Mycobacterium tuberculosis
QTVTLTRVATLSTPIPPGEDLAA

SEQ ID NO: 1512694 - protein, 39 aa, Mycobacterium tuberculosis; identical to SEQ ID NO: 226768

SEQ ID NO: 1512695 - protein, 21 aa, Mycobacterium tuberculosis
RADGWLGDLLAGAAAASLQPL

SEQ ID NO: 1512696 - protein, 18 aa, Mycobacterium tuberculosis
RASLAKRGIIVRGTSRRG

SEQ ID NO: 1512697 - protein, 20 aa, Mycobacterium tuberculosis
RAYRRCRRALRQIGVLERPV

SEQ ID NO: 1512698 - protein, 27 aa, Mycobacterium tuberculosis
REARLQRPLYVMPTKGIFTSSFGYRWG

SEQ ID NO: 1512699 - protein, 20 aa, Mycobacterium tuberculosis
REHLGVRPPVEADWLLLVEL

SEQ ID NO: 1512700 - protein, 17 aa, Mycobacterium tuberculosis
RGILLHADPVDSAAATG

SEQ ID NO: 1512701 - protein, 29 aa, Mycobacterium tuberculosis
RGRWNVPKKLTTFTLWGSGVLDLRYADFT

SEQ ID NO: 1512702 - protein, 17 aa, Mycobacterium tuberculosis
RGVRLVTFDAGVFTLAQ

SEQ ID NO: 1512703 - protein, 17 aa, Mycobacterium tuberculosis
RHHGNIAALAEIAPPSI

SEQ ID NO: 1512704 - protein, 23 aa, Mycobacterium tuberculosis
RLAGIPYIAIANAYWSPQARRRF

SEQ ID NO: 1512705 - protein, 18 aa, Mycobacterium tuberculosis
RQECERLGLPVFVKPARG

SEQ ID NO: 1512706 - protein, 22 aa, Mycobacterium tuberculosis
RRTVYIDLRADWPAALQAAGLD

SEQ ID NO: 1512707 - protein, 22 aa, Mycobacterium tuberculosis
RSAAYAMRWVAKNVVAAGLAER

SEQ ID NO: 1512708 - protein, 21 aa, Mycobacterium tuberculosis
RTDQLPLVRALVDMAGLPPQA

SEQ ID NO: 1512709 - protein, 17 aa, Mycobacterium tuberculosis
RVAILAPQGIDYVCGFY

SEQ ID NO: 1512710 - protein, 23 aa, Mycobacterium tuberculosis
RVCRDCGFFLPLAGSLGAMFGVC

SEQ ID NO: 1512711 - protein, 24 aa, Mycobacterium tuberculosis
RVTAPAHWKVISNGAPLAAANGVH

SEQ ID NO: 1512712 - protein, 20 aa, Mycobacterium tuberculosis
SALWEASLFEEHGFGDIKIS

SEQ ID NO: 1512713 - protein, 29 aa, Mycobacterium tuberculosis
SDTTTDPVLAWLYVLDAWEGGLPSARYLG

SEQ ID NO: 1512714 - protein, 17 aa, Mycobacterium tuberculosis
SGKTTTTYLVEAGLRAA

SEQ ID NO: 1512715 - protein, 24 aa, Mycobacterium tuberculosis
SGPAPFPAVPVDLPAPADIANGAL

SEQ ID NO: 1512716 - protein, 29 aa, Mycobacterium tuberculosis
SGRPLAMPRLDMVTGLYYLTTEVPGDTGE

SEQ ID NO: 1512717 - protein, 24 aa, Mycobacterium tuberculosis
SIDPDHLRRILTAVLDNAITHGDG

SEQ ID NO: 1512718 - protein, 18 aa, Mycobacterium tuberculosis
SIEFAFHRVFNKASRRIK

SEQ ID NO: 1512719 - protein, 18 aa, Mycobacterium tuberculosis
SIRHRMASVIFSLEMSKS

SEQ ID NO: 1512720 - protein, 19 aa, Mycobacterium tuberculosis
SNLLDRHRPLWETHVIEGL

SEQ ID NO: 1512721 - protein, 26 aa, Mycobacterium tuberculosis
SSAAGLVGLPWHAAYSASKYGLRGLS

SEQ ID NO: 1512722 - protein, 17 aa, Mycobacterium tuberculosis
SSIPPVPGKFYWMSPTQ

SEQ ID NO: 1512723 - protein, 23 aa, Mycobacterium tuberculosis
SSSLVAIHWAMSSLRSGECDLAL

SEQ ID NO: 1512724 - protein, 25 aa, Mycobacterium tuberculosis
SSYGRGFLTPRNSLRQRCVAHRLTI

SEQ ID NO: 1512725 - protein, 19 aa, Mycobacterium tuberculosis
SWTFRGIPVRRPGRFFATV

SEQ ID NO: 1512726 - protein, 27 aa, Mycobacterium tuberculosis
SYDPSRIDALLKGRRLTKPLIAAVEGP

SEQ ID NO: 1512727 - protein, 19 aa, Mycobacterium tuberculosis
TALYLGAQAIRGGLADCVL

SEQ ID NO: 1512728 - protein, 21 aa, Mycobacterium tuberculosis
TAQCRLPAPQYPVPAQGRHID

SEQ ID NO: 1512729 - protein, 21 aa, Mycobacterium tuberculosis
TFIGAPAMNLIDAAVAHGVVR

SEQ ID NO: 1512730 - protein, 29 aa, Mycobacterium tuberculosis
THGFVCAIRAWAYQIADLAGDYRVIAFDH

SEQ ID NO: 1512731 - protein, 17 aa, Mycobacterium tuberculosis
TIDQALGGVLFIDEAYA

SEQ ID NO: 1512732 - protein, 20 aa, Mycobacterium tuberculosis
TIPAGRRVLLLYGSANRDER

SEQ ID NO: 1512733 - protein, 24 aa, Mycobacterium tuberculosis
TKEDYQILGPLPRKNIDTGMGVER

SEQ ID NO: 1512734 - protein, 23 aa, Mycobacterium tuberculosis
TLAAYLTMQLLEAAGLPPGVINL

SEQ ID NO: 1512735 - protein, 17 aa, Mycobacterium tuberculosis
TLHSVKVIPSRGAWLEF

SEQ ID NO: 1512736 - protein, 19 aa, Mycobacterium tuberculosis
TPPFAIDPIGLSGFTLPQV

SEQ ID NO: 1512737 - protein, 27 aa, Mycobacterium tuberculosis
TQPNGPSIRTILRALAIHRRPSANSKL

SEQ ID NO: 1512738 - protein, 20 aa, Mycobacterium tuberculosis
TRMPSCRAHLLKEGLRHLFS

SEQ ID NO: 1512739 - protein, 19 aa, Mycobacterium tuberculosis
TTELRRQLKPLGRQAEAAQ

SEQ ID NO: 1512740 - protein, 35 aa, Mycobacterium tuberculosis; identical to SEQ ID NO: 223694

SEQ ID NO: 1512741 - protein, 24 aa, Mycobacterium tuberculosis
TVGTRLMALRRLAHPDDAQLGPPL

SEQ ID NO: 1512742 - protein, 28 aa, Mycobacterium tuberculosis
TVVNVGVKVLPWIPTPAKRILSAGRSVI

SEQ ID NO: 1512743 - protein, 17 aa, Mycobacterium tuberculosis
VAANRAVLVSLVSSNLL

SEQ ID NO: 1512744 - protein, 17 aa, Mycobacterium tuberculosis
VADLLRLLGPLTEDEIA

SEQ ID NO: 1512745 - protein, 25 aa, Mycobacterium tuberculosis
VAEFEAVRLAMVQPALVAANRSGLI

SEQ ID NO: 1512746 - protein, 27 aa, Mycobacterium tuberculosis
VEVALPSRPVQVIGFTSVPGAGDNFLV

SEQ ID NO: 1512747 - protein, 29 aa, Mycobacterium tuberculosis
VKDGYGRNFLLPRGLAIVASRGAQKQADE

SEQ ID NO: 1512748 - protein, 21 aa, Mycobacterium tuberculosis
VLHTPPPHWRPDVLLVAVGAM

SEQ ID NO: 1512749 - protein, 17 aa, Mycobacterium tuberculosis
VLPSMEAAFVDIGRGRN

SEQ ID NO: 1512750 - protein, 17 aa, Mycobacterium tuberculosis
VLVSLVSSNLLGFNAPA

SEQ ID NO: 1512751 - protein, 25 aa, Mycobacterium tuberculosis
VMGLPSIFVGFSRQRGLAADGRCKA

SEQ ID NO: 1512752 - protein, 17 aa, Mycobacterium tuberculosis
VRLVTFDAGVFTLAQQR

SEQ ID NO: 1512753 - protein, 18 aa, Mycobacterium tuberculosis
VSHFQRLFRVAQHNPMPV

SEQ ID NO: 1512754 - protein, 19 aa, Mycobacterium tuberculosis
VSKRTLYQHFPSKSALVEE

SEQ ID NO: 1512755 - protein, 23 aa, Mycobacterium tuberculosis
VSWNWTELPSALGVTNHLAFRAQ

SEQ ID NO: 1512756 - protein, 18 aa, Mycobacterium tuberculosis
VVRVSALKALEGDAKWVA

SEQ ID NO: 1512757 - protein, 27 aa, Mycobacterium tuberculosis
WAKSLTQRTILRLLDPSISAAGILRAE

SEQ ID NO: 1512758 - protein, 18 aa, Mycobacterium tuberculosis
WNMVATVDAFLSSGFSPA

SEQ ID NO: 1512759 - protein, 18 aa, Mycobacterium tuberculosis
WTDLGMFPVLGMDWRERE

SEQ ID NO: 1512760 - protein, 19 aa, Mycobacterium tuberculosis
YAEMWAQDALAMYGYAAAS

SEQ ID NO: 1512761 - protein, 18 aa, Mycobacterium tuberculosis
YDVSDDFFALFQDPTRTY

SEQ ID NO: 1512762 - protein, 28 aa, Mycobacterium tuberculosis
YHIGRRQLHSHLRVRSLAIQRLAGRCHH

SEQ ID NO: 1512763 - protein, 26 aa, Mycobacterium tuberculosis
YPNHDIATVVDWMLLAAINALIAGDQ

SEQ ID NO: 1512764 - protein, 20 aa, Mycobacterium tuberculosis
YRTFQTREMLRWLRGEYNDA

SEQ ID NO: 1512765 - protein, 20 aa, Mycobacterium tuberculosis
AAAVAPYVAWISVTAGQAEQ

SEQ ID NO: 1512766 - protein, 18 aa, Mycobacterium tuberculosis
AARDLQFELAARFRDEIA

SEQ ID NO: 1512767 - protein, 19 aa, Mycobacterium tuberculosis
ADATRVQVLWSLADREMSV

SEQ ID NO: 1512768 - protein, 20 aa, Mycobacterium tuberculosis
ADFINLELIDSPTLPTCERI

SEQ ID NO: 1512769 - protein, 21 aa, Mycobacterium tuberculosis
ADRLLAEPTAWLFGPEAHGLS

SEQ ID NO: 1512770 - protein, 24 aa, Mycobacterium tuberculosis
AFGVELQFWVYEETVIRCPVENSL

SEQ ID NO: 1512771 - protein, 20 aa, Mycobacterium tuberculosis
AFIGGNFSNGAFWQSDHQGQ

SEQ ID NO: 1512772 - protein, 17 aa, Mycobacterium tuberculosis
AFKVPHRFAVVDRLPRT

SEQ ID NO: 1512773 - protein, 17 aa, Mycobacterium tuberculosis
AFLPPPHVDSAVLVVRR

SEQ ID NO: 1512774 - protein, 25 aa, Mycobacterium tuberculosis
AGAHADAYLWIKRPGESDGTCGRGE

SEQ ID NO: 1512775 - protein, 24 aa, Mycobacterium tuberculosis
AGDPVALRAFRRGAAALAAMIASV

SEQ ID NO: 1512776 - protein, 24 aa, Mycobacterium tuberculosis
AGGQVWLMPHNPAFDPIPGNDATV

SEQ ID NO: 1512777 - protein, 29 aa, Mycobacterium tuberculosis
AIAAAEAMYEQMWAADVAAMVGYHGGASA

SEQ ID NO: 1512778 - protein, 18 aa, Mycobacterium tuberculosis
AILIRKVDWVDEITRVHA

SEQ ID NO: 1512779 - protein, 19 aa, Mycobacterium tuberculosis
AKRGFDPVLGARPLRRTIQ

SEQ ID NO: 1512780 - protein, 24 aa, Mycobacterium tuberculosis
ALRQDGMLALARLQRKMRLVESPY

SEQ ID NO: 1512781 - protein, 17 aa, Mycobacterium tuberculosis
ALTPFGQALPTVAGGGA

SEQ ID NO: 1512782 - protein, 18 aa, Mycobacterium tuberculosis
AMNLIDAAVAHGVVRAPD

SEQ ID NO: 1512783 - protein, 27 aa, Mycobacterium tuberculosis
ANDWPSPPTHFVITLGVRGARYVGADG

SEQ ID NO: 1512784 - protein, 28 aa, Mycobacterium tuberculosis
ANHTTGWVRMDFVVPSRGLIGWRTDFLT

SEQ ID NO: 1512785 - protein, 19 aa, Mycobacterium tuberculosis
APEFTDTGAFPFLAVEGPG

SEQ ID NO: 1512786 - protein, 19 aa, Mycobacterium tuberculosis
APIVGYSPIIGEKPLRGMA

SEQ ID NO: 1512787 - protein, 17 aa, Mycobacterium tuberculosis
APPPIAHSTVLVAPVSP

SEQ ID NO: 1512788 - protein, 22 aa, Mycobacterium tuberculosis
APRPATLYRLSVVDVLLGSQVV

SEQ ID NO: 1512789 - protein, 24 aa, Mycobacterium tuberculosis
APTALLRVYRDKLPHRYAKALRRY

SEQ ID NO: 1512790 - protein, 23 aa, Mycobacterium tuberculosis
APTGLLDHLAALFGAPKTALLID

SEQ ID NO: 1512791 - protein, 22 aa, Mycobacterium tuberculosis
AQQWSQLERLLRSGKLPPPEPV

SEQ ID NO: 1512792 - protein, 18 aa, Mycobacterium tuberculosis
AREDTVVFPALRDVMSAV

SEQ ID NO: 1512793 - protein, 26 aa, Mycobacterium tuberculosis
ARGKAIIILNPADPPMIMRDTIFCAI

SEQ ID NO: 1512794 - protein, 18 aa, Mycobacterium tuberculosis
ARGRLMQALPAGGAMFAV

SEQ ID NO: 1512795 - protein, 18 aa, Mycobacterium tuberculosis
ARLLLIVAELPLPMQNVN

SEQ ID NO: 1512796 - protein, 22 aa, Mycobacterium tuberculosis
ATATYLVRMLRDIPGLTVTRIA

SEQ ID NO: 1512797 - protein, 31 aa, Mycobacterium tuberculosis; identical to SEQ ID NO: 216457

SEQ ID NO: 1512798 - protein, 18 aa, Mycobacterium tuberculosis
ATGLPSMVVLQPATSAVA

SEQ ID NO: 1512799 - protein, 17 aa, Mycobacterium tuberculosis
ATLILPADVCWSDGAHA

SEQ ID NO: 1512800 - protein, 17 aa, Mycobacterium tuberculosis
AVVNLHRRYRITTAQLA

SEQ ID NO: 1512801 - protein, 23 aa, Mycobacterium tuberculosis
AYPSTLGYKGFPKSCCTSLNEVI

SEQ ID NO: 1512802 - protein, 18 aa, Mycobacterium tuberculosis
CALANRLRITKPDAALRI

SEQ ID NO: 1512803 - protein, 20 aa, Mycobacterium tuberculosis
CGGEYEWTRAKAAYFMIVFS

SEQ ID NO: 1512804 - protein, 21 aa, Mycobacterium tuberculosis
CPLWNVYETFANPGKILVQIA

SEQ ID NO: 1512805 - protein, 24 aa, Mycobacterium tuberculosis
DADWHFIADPASRFYNLVLADCGA

SEQ ID NO: 1512806 - protein, 27 aa, Mycobacterium tuberculosis
DAFLSRSCRWALAAANLWQGNLEAAVG

SEQ ID NO: 1512807 - protein, 29 aa, Mycobacterium tuberculosis
DAMLISDLINVRYLSGFSGSNGALLVFAD

SEQ ID NO: 1512808 - protein, 18 aa, Mycobacterium tuberculosis
DAVAEMTVALLLAVARHL

SEQ ID NO: 1512809 - protein, 17 aa, Mycobacterium tuberculosis
DELDLPVDWEPLGAIAI

SEQ ID NO: 1512810 - protein, 27 aa, Mycobacterium tuberculosis
DELRSLLRFVLDLLADYGLTDFYLELS

SEQ ID NO: 1512811 - protein, 17 aa, Mycobacterium tuberculosis
DFSTAVTGGLFFSPTID

SEQ ID NO: 1512812 - protein, 34 aa, Mycobacterium tuberculosis; identical to SEQ ID NO: 236244

SEQ ID NO: 1512813 - protein, 25 aa, Mycobacterium tuberculosis
DGGRAVLVLSDWPAPQAPQSASGEM

SEQ ID NO: 1512814 - protein, 25 aa, Mycobacterium tuberculosis
DGTGWRWRTWHLYPSASGGTVVHTT

SEQ ID NO: 1512815 - protein, 17 aa, Mycobacterium tuberculosis
DIALRRPSLDHVFLAMT

SEQ ID NO: 1512816 - protein, 17 aa, Mycobacterium tuberculosis
DIRLPFHKPVDDMTGLS

SEQ ID NO: 1512817 - protein, 30 aa, Mycobacterium tuberculosis; identical to SEQ ID NO: 226048

SEQ ID NO: 1512818 - protein, 30 aa, Mycobacterium tuberculosis; identical to SEQ ID NO: 224902

SEQ ID NO: 1512819 - protein, 25 aa, Mycobacterium tuberculosis
DLHPRLLVAPVRPDSLRSNWARAPF

SEQ ID NO: 1512820 - protein, 19 aa, Mycobacterium tuberculosis
DLPTPWPQEALDDLLVVLS

SEQ ID NO: 1512821 - protein, 29 aa, Mycobacterium tuberculosis
DPRRAVLVRPPRGLTATGLAALLRSMRSP

SEQ ID NO: 1512822 - protein, 20 aa, Mycobacterium tuberculosis
DPYHRVYGYPTLYVVDGAAI

SEQ ID NO: 1512823 - protein, 24 aa, Mycobacterium tuberculosis
DQPWLADHVVNGVVLFPGAGFVEL

SEQ ID NO: 1512824 - protein, 19 aa, Mycobacterium tuberculosis
DQWALRRHDFDLRTAAAAL

SEQ ID NO: 1512825 - protein, 25 aa, Mycobacterium tuberculosis
DRDGQWWYESLSGAPIADWLASALA

SEQ ID NO: 1512826 - protein, 25 aa, Mycobacterium tuberculosis
DRQQVLFCGLWYDDDFVRTPDGWRI

SEQ ID NO: 1512827 - protein, 29 aa, Mycobacterium tuberculosis
DTALLAPRPALLVRRRLDLVAWATGLPAL

SEQ ID NO: 1512828 - protein, 17 aa, Mycobacterium tuberculosis
DTQPRPLVIVHGPLFQA

SEQ ID NO: 1512829 - protein, 19 aa, Mycobacterium tuberculosis
DWGVLPDFVMGHSVGELAA

SEQ ID NO: 1512830 - protein, 21 aa, Mycobacterium tuberculosis
DWIDRTAQFASGAIVFSIGVL

SEQ ID NO: 1512831 - protein, 24 aa, Mycobacterium tuberculosis
DWTRLARRMSEISEAPLFIDDSPN

SEQ ID NO: 1512832 - protein, 17 aa, Mycobacterium tuberculosis
EAAFVDIGRGRNGVLYA

SEQ ID NO: 1512833 - protein, 18 aa, Mycobacterium tuberculosis
EERRLAYVGITRARQRLY

SEQ ID NO: 1512834 - protein, 29 aa, Mycobacterium tuberculosis
EETQWPLAGTRWRPMYLAGPGLLATEPPP

SEQ ID NO: 1512835 - protein, 17 aa, Mycobacterium tuberculosis
EGVLFDNWLLAENGRFR

SEQ ID NO: 1512836 - protein, 21 aa, Mycobacterium tuberculosis
EIEALYYLHPLTGEVIRQVDS

SEQ ID NO: 1512837 - protein, 19 aa, Mycobacterium tuberculosis
ELAKLDAELTRIAHRATHL

SEQ ID NO: 1512838 - protein, 21 aa, Mycobacterium tuberculosis
ELKKHFRPEFLNRIDDIIVFH

SEQ ID NO: 1512839 - protein, 17 aa, Mycobacterium tuberculosis
ELLASSGFAARLAGRSA

SEQ ID NO: 1512840 - protein, 30 aa, Mycobacterium tuberculosis; identical to SEQ ID NO: 217634

SEQ ID NO: 1512841 - protein, 21 aa, Mycobacterium tuberculosis
ELPTYAFDKRRFWLSAEGSGA

SEQ ID NO: 1512842 - protein, 24 aa, Mycobacterium tuberculosis
ERGKAARRFLPGATILKASVGPMD

SEQ ID NO: 1512843 - protein, 23 aa, Mycobacterium tuberculosis
ESGMLGGLSVPLSWGVAVPPDDY

SEQ ID NO: 1512844 - protein, 24 aa, Mycobacterium tuberculosis
ESRAQMATLPRLKPRVFYDLVVEV

SEQ ID NO: 1512845 - protein, 21 aa, Mycobacterium tuberculosis
EVHVLFYGDYKKRLPSTAQGA

SEQ ID NO: 1512846 - protein, 35 aa, Mycobacterium tuberculosis
FADAPAAWRRYLEAGILIRDVGIPGYLRATTGLAE

SEQ ID NO: 1512847 - protein, 20 aa, Mycobacterium tuberculosis
FDQIMMDVALHKLPVTMVLD

SEQ ID NO: 1512848 - protein, 22 aa, Mycobacterium tuberculosis
FDSRAIGPGGLFLALPGARADG

SEQ ID NO: 1512849 - protein, 17 aa, Mycobacterium tuberculosis
FFASVEQLTRPTLRGRP

SEQ ID NO: 1512850 - protein, 19 aa, Mycobacterium tuberculosis
FLEKEQRIIAALRAAADSP

SEQ ID NO: 1512851 - protein, 17 aa, Mycobacterium tuberculosis
FNIGTFNTGIANPGHYN

SEQ ID NO: 1512852 - protein, 20 aa, Mycobacterium tuberculosis
FTKKLLAADGLPVGAYAVLR

SEQ ID NO: 1512853 - protein, 25 aa, Mycobacterium tuberculosis
GDERHMLWFELMKPMTSTATGREAA

SEQ ID NO: 1512854 - protein, 42 aa, Mycobacterium tuberculosis
GDFLRTIHELLLSDGFWDEVFRELSIPYLPVRWSTDNPDSIV

SEQ ID NO: 1512855 - protein, 25 aa, Mycobacterium tuberculosis
GDKWRLAEVLAWQAYVGFAGEGDPG

SEQ ID NO: 1512856 - protein, 18 aa, Mycobacterium tuberculosis
GDRDIRLPFHKPVDDMTG

SEQ ID NO: 1512857 - protein, 25 aa, Mycobacterium tuberculosis
GDSLRVVYLFLAGYPDRRVELEYVV

SEQ ID NO: 1512858 - protein, 19 aa, Mycobacterium tuberculosis
GGQGLPFEAGANGGAGGAG

SEQ ID NO: 1512859 - protein, 18 aa, Mycobacterium tuberculosis
GGRRPLITEAIRGEGAIL

SEQ ID NO: 1512860 - protein, 25 aa, Mycobacterium tuberculosis
GHNYIGTEHILLGLIREGEGVAAQV

SEQ ID NO: 1512861 - protein, 20 aa, Mycobacterium tuberculosis
GLCDVKAVWRSGTQVPLQAS

SEQ ID NO: 1512862 - protein, 19 aa, Mycobacterium tuberculosis
GLLRQYFPKGTSLSTYTPD

SEQ ID NO: 1512863 - protein, 20 aa, Mycobacterium tuberculosis
GLLSTFIAALMGAEADALCG

SEQ ID NO: 1512864 - protein, 22 aa, Mycobacterium tuberculosis
GLMLPRRAFLPPPHVDSAVLVV

SEQ ID NO: 1512865 - protein, 22 aa, Mycobacterium tuberculosis
GLMRRHIKPYQKPHPPIGVTGF

SEQ ID NO: 1512866 - protein, 20 aa, Mycobacterium tuberculosis
GNWTGIPVFKLTEAETTRLL

SEQ ID NO: 1512867 - protein, 22 aa, Mycobacterium tuberculosis
GPSHHGLWDLALLACVPGFQIA

SEQ ID NO: 1512868 - protein, 21 aa, Mycobacterium tuberculosis
GRPLGLLLTRRSENATVTLCH

SEQ ID NO: 1512869 - protein, 24 aa, Mycobacterium tuberculosis
GSDAWDRLFAGPRPTELHPFVELT

SEQ ID NO: 1512870 - protein, 20 aa, Mycobacterium tuberculosis
GSVVIAYEPVWAIGTGRVAS

SEQ ID NO: 1512871 - protein, 24 aa, Mycobacterium tuberculosis
GTALNQIPILNIGLADVGNFNVGF

SEQ ID NO: 1512872 - protein, 19 aa, Mycobacterium tuberculosis
GVGPTLLLCPMSLVGNWQQ

SEQ ID NO: 1512873 - protein, 26 aa, Mycobacterium tuberculosis
HAVTLWKQWDRCALHWFPGSHLLHVS

SEQ ID NO: 1512874 - protein, 18 aa, Mycobacterium tuberculosis
HFAGLVAAGLHPSPVPHA

SEQ ID NO: 1512875 - protein, 17 aa, Mycobacterium tuberculosis
HFGSVRALDGLDLTVRE

SEQ ID NO: 1512876 - protein, 18 aa, Mycobacterium tuberculosis
HHTNHKVPFMVLAGDRDV

SEQ ID NO: 1512877 - protein, 20 aa, Mycobacterium tuberculosis
HIEFPYVYLDATYLNVRNGT

SEQ ID NO: 1512878 - protein, 20 aa, Mycobacterium tuberculosis
HVLPNLRALNFVIEAILGQG

SEQ ID NO: 1512879 - protein, 24 aa, Mycobacterium tuberculosis
IDAMAVGLAAWRLGAGRSRPGARV

SEQ ID NO: 1512880 - protein, 20 aa, Mycobacterium tuberculosis
IDSITLLPSYFELDGSFPNH

SEQ ID NO: 1512881 - protein, 25 aa, Mycobacterium tuberculosis
IDSPELLWKALLRGDDLITEVPPDR

SEQ ID NO: 1512882 - protein, 23 aa, Mycobacterium tuberculosis
IEPGIYFPGRWGARIEDIVIVTE

SEQ ID NO: 1512883 - protein, 21 aa, Mycobacterium tuberculosis
IGPPITDGFYYDFDVPEPFTP

SEQ ID NO: 1512884 - protein, 26 aa, Mycobacterium tuberculosis
IHPGKPATAVLLLPSLRSAPLDSPEL

SEQ ID NO: 1512885 - protein, 29 aa, Mycobacterium tuberculosis
IIACITAQLPEWFRPGDFFPVPCCFPSCR

SEQ ID NO: 1512886 - protein, 20 aa, Mycobacterium tuberculosis
ILCQIPTLTAPYRAVLEYRS

SEQ ID NO: 1512887 - protein, 17 aa, Mycobacterium tuberculosis
IPIIDVPAVPGFGNTTT

SEQ ID NO: 1512888 - protein, 23 aa, Mycobacterium tuberculosis
IPTECEFFSLRGLALLTDTVDKV

SEQ ID NO: 1512889 - protein, 17 aa, Mycobacterium tuberculosis
ISLGWGLWDQASAMTGG

SEQ ID NO: 1512890 - protein, 19 aa, Mycobacterium tuberculosis
ITEHLLGAARRRAFRVWLD

SEQ ID NO: 1512891 - protein, 21 aa, Mycobacterium tuberculosis
ITRVRLRVHRIPESTRYEAWS

SEQ ID NO: 1512892 - protein, 25 aa, Mycobacterium tuberculosis
KCCVQQITPDGRLIPFCAYNSVGYR

SEQ ID NO: 1512893 - protein, 23 aa, Mycobacterium tuberculosis
KDVVGAYRFLQRVWRLVVDEHTG

SEQ ID NO: 1512894 - protein, 19 aa, Mycobacterium tuberculosis
KEYRDWFATLPAELTDVVT

SEQ ID NO: 1512895 - protein, 19 aa, Mycobacterium tuberculosis
KLAVLVVSAIPLAEPVRLA

SEQ ID NO: 1512896 - protein, 26 aa, Mycobacterium tuberculosis
KVVDPSWFNWPALPVAMADTIVPDFP

SEQ ID NO: 1512897 - protein, 22 aa, Mycobacterium tuberculosis
KWVVRVVLSLMYWPAENDEAER

SEQ ID NO: 1512898 - protein, 24 aa, Mycobacterium tuberculosis
LAEKRPPPAPRLTFRPADSAADVV

SEQ ID NO: 1512899 - protein, 20 aa, Mycobacterium tuberculosis
LAPLRGGYIGDITPLGGGAT

SEQ ID NO: 1512900 - protein, 21 aa, Mycobacterium tuberculosis
LAQDMAAYIRMFEPHEAREDT

SEQ ID NO: 1512901 - protein, 25 aa, Mycobacterium tuberculosis
LASTVFGVRFPAPLGLAAGFDKDGT

SEQ ID NO: 1512902 - protein, 21 aa, Mycobacterium tuberculosis
LDRPWRRPGALRYALERVRGV

SEQ ID NO: 1512903 - protein, 21 aa, Mycobacterium tuberculosis
LGAAFARLMRTEDARPVVIGH

SEQ ID NO: 1512904 - protein, 27 aa, Mycobacterium tuberculosis
LGAARRRAFRVWLDARRNALVVLAPGY

SEQ ID NO: 1512905 - protein, 17 aa, Mycobacterium tuberculosis
LGYGAKPWLIVSNNARN

SEQ ID NO: 1512906 - protein, 23 aa, Mycobacterium tuberculosis
LKGLVRVLAFEHPDMRTTLVDLD

SEQ ID NO: 1512907 - protein, 23 aa, Mycobacterium tuberculosis
LLAHTFPATRFLGAGAAMSLLPE

SEQ ID NO: 1512908 - protein, 18 aa, Mycobacterium tuberculosis
LLGLIREGEGVAAQVLVK

SEQ ID NO: 1512909 - protein, 26 aa, Mycobacterium tuberculosis
LLRAPHTPPLVIDFGGGVLGALQRHA

SEQ ID NO: 1512910 - protein, 17 aa, Mycobacterium tuberculosis
LLTILHDGGYRDTEIMR

SEQ ID NO: 1512911 - protein, 21 aa, Mycobacterium tuberculosis
LPSMVVLQPATSAVAASRAAI

SEQ ID NO: 1512912 - protein, 30 aa, Mycobacterium tuberculosis
LRQKRLMTLIHLWLVHRFKAQAVHYVTPTD

SEQ ID NO: 1512913 - protein, 20 aa, Mycobacterium tuberculosis
LTALGLAAPRVSPPASLAAL

SEQ ID NO: 1512914 - protein, 24 aa, Mycobacterium tuberculosis
LTLPPLQIPGISVPAFSLPAITLP

SEQ ID NO: 1512915 - protein, 38 aa, Mycobacterium tuberculosis; identical to SEQ ID NO: 220570

SEQ ID NO: 1512916 - protein, 17 aa, Mycobacterium tuberculosis
MATEALYAEMWAQDALA

SEQ ID NO: 1512917 - protein, 18 aa, Mycobacterium tuberculosis
MTMFTSPDPFHANEYAER

SEQ ID NO: 1512918 - protein, 18 aa, Mycobacterium tuberculosis
NAGNVNTGFWNGGSTNTG

SEQ ID NO: 1512919 - protein, 23 aa, Mycobacterium tuberculosis
NAHILPVPMMNILNGGAHADTAV

SEQ ID NO: 1512920 - protein, 23 aa, Mycobacterium tuberculosis
NAQRTAWIAEGLLGYLSAEAQDR

SEQ ID NO: 1512921 - protein, 24 aa, Mycobacterium tuberculosis
NCDVLLTQLEIPVATALAAARAAQ

SEQ ID NO: 1512922 - protein, 25 aa, Mycobacterium tuberculosis
NFSNGILWRGNYEGLFSYSYSLDVP

SEQ ID NO: 1512923 - protein, 18 aa, Mycobacterium tuberculosis
NIFIGECKVWSGPRTMDD

SEQ ID NO: 1512924 - protein, 22 aa, Mycobacterium tuberculosis
NLDHTVLGIFRHISRPTYDDAA

SEQ ID NO: 1512925 - protein, 18 aa, Mycobacterium tuberculosis
NSNGLLRQYFPKGTSLST

SEQ ID NO: 1512926 - protein, 21 aa, Mycobacterium tuberculosis
PAAFLNVDIPVNIPITGDITN

SEQ ID NO: 1512927 - protein, 18 aa, Mycobacterium tuberculosis
PAFKLTRSSAAYWRGDQK

SEQ ID NO: 1512928 - protein, 18 aa, Mycobacterium tuberculosis
PAITFPRIDASGSVDIGI

SEQ ID NO: 1512929 - protein, 17 aa, Mycobacterium tuberculosis
PARYFGPNLSRLSAVRQ

SEQ ID NO: 1512930 - protein, 24 aa, Mycobacterium tuberculosis
PDAANGFILDGYPRSVEQAKALHE

SEQ ID NO: 1512931 - protein, 25 aa, Mycobacterium tuberculosis
PEINSLRMYLGAGSAPMLQAAAAWD

SEQ ID NO: 1512932 - protein, 23 aa, Mycobacterium tuberculosis
PENATAWGLLLTALTGPDVTLLG

SEQ ID NO: 1512933 - protein, 22 aa, Mycobacterium tuberculosis
PGLFTLVLHTHLPWLAHHGRWP

SEQ ID NO: 1512934 - protein, 23 aa, Mycobacterium tuberculosis
PGLPRLLRVVGHYYKPGFHPSQL

SEQ ID NO: 1512935 - protein, 23 aa, Mycobacterium tuberculosis
PGNPAPRLFRLADDRALLNRMGF

SEQ ID NO: 1512936 - protein, 21 aa, Mycobacterium tuberculosis
PLAGKPFYVDPASAAMVAARN

SEQ ID NO: 1512937 - protein, 25 aa, Mycobacterium tuberculosis
PLGALHLDLRFVNGKSWLVFGPYAG

SEQ ID NO: 1512938 - protein, 18 aa, Mycobacterium tuberculosis
PLIAVASAATRWVWVSDA

SEQ ID NO: 1512939 - protein, 17 aa, Mycobacterium tuberculosis
PLNWCNPSGRALGAPPT

SEQ ID NO: 1512940 - protein, 25 aa, Mycobacterium tuberculosis
PPEHAHKLVFAVLRGVAAVAPVRRL

SEQ ID NO: 1512941 - protein, 20 aa, Mycobacterium tuberculosis
PVHIYLQFDGLDEATHRRIR

SEQ ID NO: 1512942 - protein, 25 aa, Mycobacterium tuberculosis
QDWDGVAITLTWSQLYRRTLNVAQE

SEQ ID NO: 1512943 - protein, 19 aa, Mycobacterium tuberculosis
QLEEQYVFPKLEQAGKLTD

SEQ ID NO: 1512944 - protein, 17 aa, Mycobacterium tuberculosis
QLFHTSGHLDWYADGMF

SEQ ID NO: 1512945 - protein, 26 aa, Mycobacterium tuberculosis
QLHNQARLPYLVYLRHPTTGGVFASW

SEQ ID NO: 1512946 - protein, 25 aa, Mycobacterium tuberculosis
QMSTIQLDFNFPERFGLEYTAADGT

SEQ ID NO: 1512947 - protein, 21 aa, Mycobacterium tuberculosis
QPILAPLTPAAIFLVATIGAD

SEQ ID NO: 1512948 - protein, 22 aa, Mycobacterium tuberculosis
QPRPLVIVHGPLFQAVKAARAQ

SEQ ID NO: 1512949 - protein, 19 aa, Mycobacterium tuberculosis
QQRLWRTRESLAEVLGVYG

SEQ ID NO: 1512950 - protein, 17 aa, Mycobacterium tuberculosis
QRIMLYAKDSGCSAPGC

SEQ ID NO: 1512951 - protein, 30 aa, Mycobacterium tuberculosis; identical to SEQ ID NO: 221813

SEQ ID NO: 1512952 - protein, 17 aa, Mycobacterium tuberculosis
QSHWPDDAAAREPVLLW

SEQ ID NO: 1512953 - protein, 20 aa, Mycobacterium tuberculosis
RAGLLALLAGALEGAGAGIV

SEQ ID NO: 1512954 - protein, 21 aa, Mycobacterium tuberculosis
RARMRPPRPAGLLLGNGGARR

SEQ ID NO: 1512955 - protein, 20 aa, Mycobacterium tuberculosis
RDANFDAVLAPAAALPGCQT

SEQ ID NO: 1512956 - protein, 20 aa, Mycobacterium tuberculosis
RDIEWRIGPGERIGIVGANG

SEQ ID NO: 1512957 - protein, 19 aa, Mycobacterium tuberculosis
RGAYLEQLLGGLLADLGVH

SEQ ID NO: 1512958 - protein, 22 aa, Mycobacterium tuberculosis
RKLQLPRDAALVTILRGPRVIV

SEQ ID NO: 1512959 - protein, 24 aa, Mycobacterium tuberculosis
RLRASTRPYILRRLKTDPAIIDDL

SEQ ID NO: 1512960 - protein, 21 aa, Mycobacterium tuberculosis
RMGMHPAVLDAVLHALGLAVE

SEQ ID NO: 1512961 - protein, 18 aa, Mycobacterium tuberculosis
RMLRDIPGLTVTRIASGL

SEQ ID NO: 1512962 - protein, 30 aa, Mycobacterium tuberculosis
RNTHGVSWLPLYHDMGLSMIGFPAVYGGHS

SEQ ID NO: 1512963 - protein, 19 aa, Mycobacterium tuberculosis
RPDIVWFGEPLPEEPWRSA

SEQ ID NO: 1512964 - protein, 22 aa, Mycobacterium tuberculosis
RPEFLNRIDDIIVFHQLTREEI

SEQ ID NO: 1512965 - protein, 21 aa, Mycobacterium tuberculosis
RPPMVTSGLRIGTPALATRGF

SEQ ID NO: 1512966 - protein, 20 aa, Mycobacterium tuberculosis
RPQRFQVTASRFGRSVDVAA

SEQ ID NO: 1512967 - protein, 21 aa, Mycobacterium tuberculosis
RQEIARIYTVLRERELGLATG

SEQ ID NO: 1512968 - protein, 21 aa, Mycobacterium tuberculosis
RQFRASVCVLGPLVGRCKRAR

SEQ ID NO: 1512969 - protein, 20 aa, Mycobacterium tuberculosis
RQRLQDIVKGGYRSANAAIV

SEQ ID NO: 1512970 - protein, 17 aa, Mycobacterium tuberculosis
RREDMLRHPAFLSKQLP

SEQ ID NO: 1512971 - protein, 17 aa, Mycobacterium tuberculosis
RRQLLDHGAAGLSLRAI

SEQ ID NO: 1512972 - protein, 21 aa, Mycobacterium tuberculosis
RTFNDLLATMLWHGTLDSRLR

SEQ ID NO: 1512973 - protein, 18 aa, Mycobacterium tuberculosis
RVEPLRPGPPPTVWSRRW

SEQ ID NO: 1512974 - protein, 29 aa, Mycobacterium tuberculosis
SDMTRTFVLGKAADWQLEIYQLVAEAQQA

SEQ ID NO: 1512975 - protein, 25 aa, Mycobacterium tuberculosis
SDPKGRYFRLLTGWVGGGFRVPDDD

SEQ ID NO: 1512976 - protein, 23 aa, Mycobacterium tuberculosis
SEDLPTLVRTLAATTALMLTGDA

SEQ ID NO: 1512977 - protein, 22 aa, Mycobacterium tuberculosis
SHAPRPRMLVFGAIDFAAALAR

SEQ ID NO: 1512978 - protein, 20 aa, Mycobacterium tuberculosis
SKLTPWKAPPPIAHSTVLVA

SEQ ID NO: 1512979 - protein, 25 aa, Mycobacterium tuberculosis
SKQLDMRRMPWRLHVFTPVHDVPGV

SEQ ID NO: 1512980 - protein, 25 aa, Mycobacterium tuberculosis
SLLQGYTGFIYGGERWAKDIHEGIA

SEQ ID NO: 1512981 - protein, 18 aa, Mycobacterium tuberculosis
SQVHLRLISGDRITTLAL

SEQ ID NO: 1512982 - protein, 18 aa, Mycobacterium tuberculosis
SRVGHSYIKALMAETGAI

SEQ ID NO: 1512983 - protein, 18 aa, Mycobacterium tuberculosis
SRVRKAPGFALLGEKGQS

SEQ ID NO: 1512984 - protein, 20 aa, Mycobacterium tuberculosis
SSYFALIETQAHHIIRCLKR

SEQ ID NO: 1512985 - protein, 26 aa, Mycobacterium tuberculosis
SSYSALSSRQWALAGLTPLRHWRSAL

SEQ ID NO: 1512986 - protein, 20 aa, Mycobacterium tuberculosis
SYAYAVLRKAAQRAGDALPR

SEQ ID NO: 1512987 - protein, 20 aa, Mycobacterium tuberculosis
TAARWNLKTIADLAPHSADV

SEQ ID NO: 1512988 - protein, 18 aa, Mycobacterium tuberculosis
TALDLARRYPVGKAVAAI

SEQ ID NO: 1512989 - protein, 26 aa, Mycobacterium tuberculosis
TAPRRTLKGTYWHQGPTRHPVTSCAD

SEQ ID NO: 1512990 - protein, 19 aa, Mycobacterium tuberculosis
TAPVPIVRLLAVIGDRAAQ

SEQ ID NO: 1512991 - protein, 24 aa, Mycobacterium tuberculosis
TETTLRRILYDHIYLRHFRPKPDY

SEQ ID NO: 1512992 - protein, 23 aa, Mycobacterium tuberculosis
THYFDNFFLDATRAGIRQAVILA

SEQ ID NO: 1512993 - protein, 30 aa, Mycobacterium tuberculosis; identical to SEQ ID NO: 223523

SEQ ID NO: 1512994 - protein, 18 aa, Mycobacterium tuberculosis
TLTVGLMLPRRAFLPPPH

SEQ ID NO: 1512995 - protein, 24 aa, Mycobacterium tuberculosis
TPERLRSLERLECLVRRLPAVGHT

SEQ ID NO: 1512996 - protein, 33 aa, Mycobacterium tuberculosis; identical to SEQ ID NO: 227026

SEQ ID NO: 1512997 - protein, 27 aa, Mycobacterium tuberculosis
TRTAAPPRILWLDTAAPAKLILEVRAM

SEQ ID NO: 1512998 - protein, 18 aa, Mycobacterium tuberculosis
TSLISYMLPRSPIVRIVD

SEQ ID NO: 1512999 - protein, 25 aa, Mycobacterium tuberculosis
TTLPKLLAQMRWVVLVDKRQLAVLL

SEQ ID NO: 1513000 - protein, 17 aa, Mycobacterium tuberculosis
TTRLLDALPPRRQPPKT

SEQ ID NO: 1513001 - protein, 24 aa, Mycobacterium tuberculosis
TVGAFPFGFGWQQSPGFFNSTTTP

SEQ ID NO: 1513002 - protein, 19 aa, Mycobacterium tuberculosis
TVHAALRAALRASAARSLM

SEQ ID NO: 1513003 - protein, 18 aa, Mycobacterium tuberculosis
TVRLFPVDGAVSPTITPA

SEQ ID NO: 1513004 - protein, 17 aa, Mycobacterium tuberculosis
TVYAPGDWSVFDALAKM

SEQ ID NO: 1513005 - protein, 21 aa, Mycobacterium tuberculosis
TYTRWGAFLDDATGFDAGFFG

SEQ ID NO: 1513006 - protein, 24 aa, Mycobacterium tuberculosis
VAAKMALQYWRGRGLPGKRRLMTW

SEQ ID NO: 1513007 - protein, 23 aa, Mycobacterium tuberculosis
VACALGLQRAPLAPIRLRIGMHT

SEQ ID NO: 1513008 - protein, 20 aa, Mycobacterium tuberculosis
VAITEFVVSPLFGSPPAAEL

SEQ ID NO: 1513009 - protein, 20 aa, Mycobacterium tuberculosis
VALMLEPRKAAAGSALGMLS

SEQ ID NO: 1513010 - protein, 26 aa, Mycobacterium tuberculosis
VANTPQSYWLDQAFPPATVGGTVARY

SEQ ID NO: 1513011 - protein, 22 aa, Mycobacterium tuberculosis
VAQPLIVAATLLAHQELARRCV

SEQ ID NO: 1513012 - protein, 25 aa, Mycobacterium tuberculosis
VAVRRISMSFVNVAPQLVSTAAADA

SEQ ID NO: 1513013 - protein, 33 aa, Mycobacterium tuberculosis; identical to SEQ ID NO: 225712

SEQ ID NO: 1513014 - protein, 32 aa, Mycobacterium tuberculosis
VDDALYQMELVGHDFFLFYDKDTERPSVVYRR

SEQ ID NO: 1513015 - protein, 22 aa, Mycobacterium tuberculosis
VDEVHGFRFFDNRDLLGFVDGT

SEQ ID NO: 1513016 - protein, 25 aa, Mycobacterium tuberculosis
VETYSVLTRLPPPHRIAPVAVHAYL

SEQ ID NO: 1513017 - protein, 29 aa, Mycobacterium tuberculosis
VGSGPVFLQYPWQVIPDEIIKPLQDAARA

SEQ ID NO: 1513018 - protein, 30 aa, Mycobacterium tuberculosis
VIFSATRYEWAILDFAILAVGAVTVPTYET

SEQ ID NO: 1513019 - protein, 25 aa, Mycobacterium tuberculosis
VLAARPVGVPAIVVPPVAAPNVLAG

SEQ ID NO: 1513020 - protein, 25 aa, Mycobacterium tuberculosis
VLAQAQRPLLVLSKGAAYAQADNVI

SEQ ID NO: 1513021 - protein, 17 aa, Mycobacterium tuberculosis
VLGVIDSITLLPSYFEL

SEQ ID NO: 1513022 - protein, 17 aa, Mycobacterium tuberculosis
VLSQPGLRKLLAQEWLR

SEQ ID NO: 1513023 - protein, 17 aa, Mycobacterium tuberculosis
VLTLYGIPHRDCGSYAS

SEQ ID NO: 1513024 - protein, 33 aa, Mycobacterium tuberculosis
VNNTGIFVTGVMSSGFFNFGTGNSGLLVSGNGL

SEQ ID NO: 1513025 - protein, 17 aa, Mycobacterium tuberculosis
VPLSWGVAVPPDDYDHW

SEQ ID NO: 1513026 - protein, 19 aa, Mycobacterium tuberculosis
VPNAIPLAGLLADAPHGSK

SEQ ID NO: 1513027 - protein, 22 aa, Mycobacterium tuberculosis
VRDGMATLNPLAAQIIGQLSSL

SEQ ID NO: 1513028 - protein, 25 aa, Mycobacterium tuberculosis
VRQPPPRLANLLPLIRPHEHMPDSV

SEQ ID NO: 1513029 - protein, 19 aa, Mycobacterium tuberculosis
VRQWGFMQGLKQKLGPGVD

SEQ ID NO: 1513030 - protein, 29 aa, Mycobacterium tuberculosis
VRTLSKLVRHHLLLPITATRRDLNDPKTI

SEQ ID NO: 1513031 - protein, 23 aa, Mycobacterium tuberculosis
VSLTQILAWDLPLTKRLTEQVAK

SEQ ID NO: 1513032 - protein, 22 aa, Mycobacterium tuberculosis
VVASPGFSPATPLLAAAAAAGV

SEQ ID NO: 1513033 - protein, 18 aa, Mycobacterium tuberculosis
VVLVATGASPRILPSAQP

SEQ ID NO: 1513034 - protein, 26 aa, Mycobacterium tuberculosis
VVSQRGWRHWVHALTRINLGLSPDEK

SEQ ID NO: 1513035 - protein, 17 aa, Mycobacterium tuberculosis
VVVGENFTFGKKAAGNV

SEQ ID NO: 1513036 - protein, 25 aa, Mycobacterium tuberculosis
VVVIGRGVTVGRPLGLLLTRRSENA

SEQ ID NO: 1513037 - protein, 33 aa, Mycobacterium tuberculosis; identical to SEQ ID NO: 224441

SEQ ID NO: 1513038 - protein, 18 aa, Mycobacterium tuberculosis
WLLAQPDKPDLVFEATSA

SEQ ID NO: 1513039 - protein, 22 aa, Mycobacterium tuberculosis
WLTGLRIEDGLLKKLGAEAVAQ

SEQ ID NO: 1513040 - protein, 20 aa, Mycobacterium tuberculosis
WPEPISYTALDRGDLQRAMS

SEQ ID NO: 1513041 - protein, 17 aa, Mycobacterium tuberculosis
WPKVFRPPVIAATVTTP

SEQ ID NO: 1513042 - protein, 18 aa, Mycobacterium tuberculosis
WTRAKAAYFMIVFSGPIP

SEQ ID NO: 1513043 - protein, 18 aa, Mycobacterium tuberculosis
WVVPHFEKMLYDNALLLR

SEQ ID NO: 1513044 - protein, 17 aa, Mycobacterium tuberculosis
YDVLVGINLLREGLDLP

SEQ ID NO: 1513045 - protein, 19 aa, Mycobacterium tuberculosis
YELEIAFAEILRLSPSSGG

SEQ ID NO: 1513046 - protein, 21 aa, Mycobacterium tuberculosis
YRARSTGQRPSWAPLPVQYAD

SEQ ID NO: 1513047 - protein, 17 aa, Mycobacterium tuberculosis
AALSLEPPLVLFCPTKV

SEQ ID NO: 1513048 - protein, 25 aa, Mycobacterium tuberculosis
AAPGASYYVLVFAKGAFPAELEVKP

SEQ ID NO: 1513049 - protein, 19 aa, Mycobacterium tuberculosis
AAVAPYVAWISVTAGQAEQ

SEQ ID NO: 1513050 - protein, 24 aa, Mycobacterium tuberculosis
AEEVDKMVWATRWGADTIMDLSTG

SEQ ID NO: 1513051 - protein, 25 aa, Mycobacterium tuberculosis
AFGVELQFWVYEETVIRCPVENSLS

SEQ ID NO: 1513052 - protein, 22 aa, Mycobacterium tuberculosis
AFYERLRELFAARKSITTFGPY

SEQ ID NO: 1513053 - protein, 25 aa, Mycobacterium tuberculosis
AGRTERFWVGLSVYRPGGTAEPAPT

SEQ ID NO: 1513054 - protein, 19 aa, Mycobacterium tuberculosis
AIALAQFYDVPMVSTIHAT

SEQ ID NO: 1513055 - protein, 23 aa, Mycobacterium tuberculosis
AIRHAVAWARPGDVVLIAGKGHE

SEQ ID NO: 1513056 - protein, 23 aa, Mycobacterium tuberculosis
AKWVVRVVLSLMYWPAENDEAER

SEQ ID NO: 1513057 - protein, 25 aa, Mycobacterium tuberculosis
ALRQDGMLALARLQRKMRLVESPYR

SEQ ID NO: 1513058 - protein, 17 aa, Mycobacterium tuberculosis
ALRQVLGPNAVQAGSLN

SEQ ID NO: 1513059 - protein, 31 aa, Mycobacterium tuberculosis; identical to SEQ ID NO: 216142

SEQ ID NO: 1513060 - protein, 25 aa, Mycobacterium tuberculosis
AMAAAAAPYAGWLGSVAAAAEAVAG

SEQ ID NO: 1513061 - protein, 18 aa, Mycobacterium tuberculosis
AMVDPVVVAANRSAFVQL

SEQ ID NO: 1513062 - protein, 23 aa, Mycobacterium tuberculosis
ANRANLVYWAAANLRDPGARVPA

SEQ ID NO: 1513063 - protein, 24 aa, Mycobacterium tuberculosis
APGASYYVLVFAKGAFPAELEVKP

SEQ ID NO: 1513064 - protein, 20 aa, Mycobacterium tuberculosis
APLRGGYIADITPLGGGATG

SEQ ID NO: 1513065 - protein, 21 aa, Mycobacterium tuberculosis
AQQWSQLERLLRSGKLPPPEP

SEQ ID NO: 1513066 - protein, 24 aa, Mycobacterium tuberculosis
ARLTSDLYGWLTTVARSGQPVPRL

SEQ ID NO: 1513067 - protein, 22 aa, Mycobacterium tuberculosis
ARTDPMLLAWTVPVVDLDPTAA

SEQ ID NO: 1513068 - protein, 19 aa, Mycobacterium tuberculosis
ASSQFVSGLLLSAASFTDG

SEQ ID NO: 1513069 - protein, 25 aa, Mycobacterium tuberculosis
ATATYLVRMLRDIPGLTVTRIASGL

SEQ ID NO: 1513070 - protein, 21 aa, Mycobacterium tuberculosis
ATTAWLIERLQRPTLVMAPNK

SEQ ID NO: 1513071 - protein, 18 aa, Mycobacterium tuberculosis
AVALLEWLQTTHPEPKVA

SEQ ID NO: 1513072 - protein, 25 aa, Mycobacterium tuberculosis
AVELELYKRLPGDLSILTPSPASDT

SEQ ID NO: 1513073 - protein, 17 aa, Mycobacterium tuberculosis
AVGLSAKAFSAWSPTRS

SEQ ID NO: 1513074 - protein, 23 aa, Mycobacterium tuberculosis
AVPLNSQYRWPAMAGAAVAVTRA

SEQ ID NO: 1513075 - protein, 17 aa, Mycobacterium tuberculosis
CATGVTDGDLLKGVRYY

SEQ ID NO: 1513076 - protein, 17 aa, Mycobacterium tuberculosis
CHGLQCGFCTPGMLITA

SEQ ID NO: 1513077 - protein, 17 aa, Mycobacterium tuberculosis
CRRALRQIGVLERPVGD

SEQ ID NO: 1513078 - protein, 17 aa, Mycobacterium tuberculosis
DALSKLTPWKAPPPIAH

SEQ ID NO: 1513079 - protein, 23 aa, Mycobacterium tuberculosis
DAMAVGLAAWRLGAGRSRPGARV

SEQ ID NO: 1513080 - protein, 25 aa, Mycobacterium tuberculosis
DAVPRMRGMLTLFEGVATGAADGYA

SEQ ID NO: 1513081 - protein, 23 aa, Mycobacterium tuberculosis
DGDLLKGVRYYPGGCTTHSIVMR

SEQ ID NO: 1513082 - protein, 17 aa, Mycobacterium tuberculosis
DGEGWLTELSTRDLREV

SEQ ID NO: 1513083 - protein, 31 aa, Mycobacterium tuberculosis; identical to SEQ ID NO: 216916

SEQ ID NO: 1513084 - protein, 25 aa, Mycobacterium tuberculosis
DGTGPALPTVWPGNAYPLGATYDGA

SEQ ID NO: 1513085 - protein, 25 aa, Mycobacterium tuberculosis
DGTPFPTLYYLTHPVLTAAASRLET

SEQ ID NO: 1513086 - protein, 19 aa, Mycobacterium tuberculosis
DIVALLLGDSFHPGGATLT

SEQ ID NO: 1513087 - protein, 27 aa, Mycobacterium tuberculosis
DLLVARRRPPAGDGWRKAVTKMTFGRV

SEQ ID NO: 1513088 - protein, 30 aa, Mycobacterium tuberculosis; identical to SEQ ID NO: 217090

SEQ ID NO: 1513089 - protein, 19 aa, Mycobacterium tuberculosis
DPYHRVYGYPTLYVVDGAA

SEQ ID NO: 1513090 - protein, 25 aa, Mycobacterium tuberculosis
DQLMKAALPFGLWVPVLPGTRQVTV

SEQ ID NO: 1513091 - protein, 18 aa, Mycobacterium tuberculosis
DWFATLPAELTDVVTAYW

SEQ ID NO: 1513092 - protein, 21 aa, Mycobacterium tuberculosis
DYVMANLPFNIKDWARNEEDP

SEQ ID NO: 1513093 - protein, 18 aa, Mycobacterium tuberculosis
EALVRKLGPDFLVELLEI

SEQ ID NO: 1513094 - protein, 28 aa, Mycobacterium tuberculosis
EANDWPSPPTHFVITLGVRGARYVGADG

SEQ ID NO: 1513095 - protein, 17 aa, Mycobacterium tuberculosis
EEDKAQIWLSKATINGV

SEQ ID NO: 1513096 - protein, 28 aa, Mycobacterium tuberculosis
EGIDFTNIYFYTVLYHALRASNRIAIER

SEQ ID NO: 1513097 - protein, 17 aa, Mycobacterium tuberculosis
EGWLTELSTRDLREVFA

SEQ ID NO: 1513098 - protein, 17 aa, Mycobacterium tuberculosis
EHEVHVLFYGDYKKRLP

SEQ ID NO: 1513099 - protein, 25 aa, Mycobacterium tuberculosis
EIAVRVIRTLRRLGIRSVAVYSDPD

SEQ ID NO: 1513100 - protein, 32 aa, Mycobacterium tuberculosis; identical to SEQ ID NO: 217648

SEQ ID NO: 1513101 - protein, 17 aa, Mycobacterium tuberculosis
ENLLRRNAAVTGHRLLR

SEQ ID NO: 1513102 - protein, 17 aa, Mycobacterium tuberculosis
EQIGYPDQGGYPEQRGY

SEQ ID NO: 1513103 - protein, 18 aa, Mycobacterium tuberculosis
ESFPLYCCANGKALLAAL

SEQ ID NO: 1513104 - protein, 28 aa, Mycobacterium tuberculosis
ETQWPLAGTRWRPMYLAGPGLLATEPPP

SEQ ID NO: 1513105 - protein, 18 aa, Mycobacterium tuberculosis
FCATGVTDGDLLKGVRYY

SEQ ID NO: 1513106 - protein, 30 aa, Mycobacterium tuberculosis
FLDGLAAYRRSRGLAALSVAWGLWEQASAM

SEQ ID NO: 1513107 - protein, 22 aa, Mycobacterium tuberculosis
FMISHFHYDPVWWNTQGAYTSQ

SEQ ID NO: 1513108 - protein, 18 aa, Mycobacterium tuberculosis
FQALDYRILPADADADIV

SEQ ID NO: 1513109 - protein, 20 aa, Mycobacterium tuberculosis
FSLFDVYTDIAFPGGIHAAW

SEQ ID NO: 1513110 - protein, 17 aa, Mycobacterium tuberculosis
FSVGLANLGFWNLGSAN

SEQ ID NO: 1513111 - protein, 25 aa, Mycobacterium tuberculosis
GAAALAFPSLSSSVPILGPYEDLIA

SEQ ID NO: 1513112 - protein, 24 aa, Mycobacterium tuberculosis
GAFYERLRELFAARKSITTFGPYS

SEQ ID NO: 1513113 - protein, 21 aa, Mycobacterium tuberculosis
GDLLKGVRYYPGGCTTHSIVM

SEQ ID NO: 1513114 - protein, 20 aa, Mycobacterium tuberculosis
GFMRNAAGGTLFNFGFANDG

SEQ ID NO: 1513115 - protein, 31 aa, Mycobacterium tuberculosis; identical to SEQ ID NO: 226281

SEQ ID NO: 1513116 - protein, 27 aa, Mycobacterium tuberculosis
GIDFTNIYFYTVLYHALRASNRIAIER

SEQ ID NO: 1513117 - protein, 17 aa, Mycobacterium tuberculosis
GIDPWEISFGFHGLDSL

SEQ ID NO: 1513118 - protein, 20 aa, Mycobacterium tuberculosis
GKMGFVFNFITYGGHQIDGV

SEQ ID NO: 1513119 - protein, 18 aa, Mycobacterium tuberculosis
GLGGFAYQSAVSEIPWSY

SEQ ID NO: 1513120 - protein, 19 aa, Mycobacterium tuberculosis
GNLGFANLGLTAGAAGVGN

SEQ ID NO: 1513121 - protein, 32 aa, Mycobacterium tuberculosis; identical to SEQ ID NO: 218659

SEQ ID NO: 1513122 - protein, 18 aa, Mycobacterium tuberculosis
GQALLARRMGKTRVIAET

SEQ ID NO: 1513123 - protein, 19 aa, Mycobacterium tuberculosis
GRCTPIAAWLAGLGLFTKR

SEQ ID NO: 1513124 - protein, 22 aa, Mycobacterium tuberculosis
GRRSFILVPGIDVPFHSRVLRV

SEQ ID NO: 1513125 - protein, 18 aa, Mycobacterium tuberculosis
GRWQADAVILAVPAPRLA

SEQ ID NO: 1513126 - protein, 23 aa, Mycobacterium tuberculosis
GTITAFLANLPFSTPVVTIDEIP

SEQ ID NO: 1513127 - protein, 24 aa, Mycobacterium tuberculosis
GTLNTGFFSAMTQAGPNSGFFNAG

SEQ ID NO: 1513128 - protein, 25 aa, Mycobacterium tuberculosis
GVEFKDLTPLFADRRGLAAVTEALA

SEQ ID NO: 1513129 - protein, 22 aa, Mycobacterium tuberculosis
HAIQVVRALAARVAITAGSPEK

SEQ ID NO: 1513130 - protein, 30 aa, Mycobacterium tuberculosis; identical to SEQ ID NO: 225158

SEQ ID NO: 1513131 - protein, 20 aa, Mycobacterium tuberculosis
HDFFLFYDKDTERPSVVYRR

SEQ ID NO: 1513132 - protein, 17 aa, Mycobacterium tuberculosis
HGEWGIAGYRHHFIDKP

SEQ ID NO: 1513133 - protein, 22 aa, Mycobacterium tuberculosis
HGRFALGERLLGFGSVTGAHIA

SEQ ID NO: 1513134 - protein, 19 aa, Mycobacterium tuberculosis
HHTNHKVPFMVLAGDRDVA

SEQ ID NO: 1513135 - protein, 19 aa, Mycobacterium tuberculosis
HLHASPYVLVSILITPDLH

SEQ ID NO: 1513136 - protein, 22 aa, Mycobacterium tuberculosis
HPLLAVAPRRPQGELPAVGSLL

SEQ ID NO: 1513137 - protein, 26 aa, Mycobacterium tuberculosis
HSEVDTLRRVELLRQLRLGDYDVLVG

SEQ ID NO: 1513138 - protein, 26 aa, Mycobacterium tuberculosis
HSTLGPVHILIDLPAVPGFGNTTGAP

SEQ ID NO: 1513139 - protein, 20 aa, Mycobacterium tuberculosis
IAFLAWHAWNDAERGNWPPG

SEQ ID NO: 1513140 - protein, 17 aa, Mycobacterium tuberculosis
IAPQWHLRMQAAVQRHV

SEQ ID NO: 1513141 - protein, 18 aa, Mycobacterium tuberculosis
IDHVELSARVAWMSESQL

SEQ ID NO: 1513142 - protein, 30 aa, Mycobacterium tuberculosis; identical to SEQ ID NO: 226398

SEQ ID NO: 1513143 - protein, 23 aa, Mycobacterium tuberculosis
IHIDPIHVHIPPLLDIDQTIDLG

SEQ ID NO: 1513144 - protein, 23 aa, Mycobacterium tuberculosis
IHTAALTCFGTLANTARCWVDSV

SEQ ID NO: 1513145 - protein, 17 aa, Mycobacterium tuberculosis
IPRHLNFHQLTPHASEA

SEQ ID NO: 1513146 - protein, 17 aa, Mycobacterium tuberculosis
IRNLVHGIGFQRDVLGA

SEQ ID NO: 1513147 - protein, 24 aa, Mycobacterium tuberculosis
IRTILQSLWANFYELLADAYGRGI

SEQ ID NO: 1513148 - protein, 18 aa, Mycobacterium tuberculosis
KFEGWTPLAQLKVGDRIA

SEQ ID NO: 1513149 - protein, 21 aa, Mycobacterium tuberculosis
KLQLPRDAALVTILRGPRVIV

SEQ ID NO: 1513150 - protein, 19 aa, Mycobacterium tuberculosis
KPTNALLFPQPRCQVITGV

SEQ ID NO: 1513151 - protein, 20 aa, Mycobacterium tuberculosis
KPTNALLFPQPRCQVITGVG

SEQ ID NO: 1513152 - protein, 23 aa, Mycobacterium tuberculosis
KQRAVLAMLLLSRNQVVAADALV

SEQ ID NO: 1513153 - protein, 21 aa, Mycobacterium tuberculosis
KSCFLAMVRRFYELGVKELNG

SEQ ID NO: 1513154 - protein, 24 aa, Mycobacterium tuberculosis
KSLAAAPFADILWMETKTADLADA

SEQ ID NO: 1513155 - protein, 25 aa, Mycobacterium tuberculosis
KSLAAAPFADILWMETKTADLADAR

SEQ ID NO: 1513156 - protein, 22 aa, Mycobacterium tuberculosis
LAHTFPATRFLGAGAAMSLLPE

SEQ ID NO: 1513157 - protein, 17 aa, Mycobacterium tuberculosis
LAMVRRFTNWASRSSMV

SEQ ID NO: 1513158 - protein, 22 aa, Mycobacterium tuberculosis
LARGSGLLPRMEPFVGELIGRG

SEQ ID NO: 1513159 - protein, 24 aa, Mycobacterium tuberculosis
LDGQRFLLTAGFFETHRPYPHERY

SEQ ID NO: 1513160 - protein, 18 aa, Mycobacterium tuberculosis
LDIRTGHVALRVLHDGTA

SEQ ID NO: 1513161 - protein, 26 aa, Mycobacterium tuberculosis
LDQLMKAALPFGLWVPVLPGTRQVTV

SEQ ID NO: 1513162 - protein, 23 aa, Mycobacterium tuberculosis
LDRDRPLWEMWVIEGGARSDTVA

SEQ ID NO: 1513163 - protein, 18 aa, Mycobacterium tuberculosis
LEEWLAMWSGHYQLKDKL

SEQ ID NO: 1513164 - protein, 19 aa, Mycobacterium tuberculosis
LEEWLAMWSGHYQLKDKLR

SEQ ID NO: 1513165 - protein, 20 aa, Mycobacterium tuberculosis
LETRLVPQRGYHLELITAVP

SEQ ID NO: 1513166 - protein, 22 aa, Mycobacterium tuberculosis
LGAAFARLMRTEDARPVVIGHD

SEQ ID NO: 1513167 - protein, 22 aa, Mycobacterium tuberculosis
LGKMGFVFNFITYGGHQIDGVA

SEQ ID NO: 1513168 - protein, 21 aa, Mycobacterium tuberculosis
LGLPVVVRPSFTMGGLGSGIA

SEQ ID NO: 1513169 - protein, 18 aa, Mycobacterium tuberculosis
LHASPYVLVSILITPDLH

SEQ ID NO: 1513170 - protein, 25 aa, Mycobacterium tuberculosis
LHGLATQLMDWLHPDGNFSDQERAR

SEQ ID NO: 1513171 - protein, 17 aa, Mycobacterium tuberculosis
LIIYDEVHLLPAPVFRM

SEQ ID NO: 1513172 - protein, 23 aa, Mycobacterium tuberculosis
LLARGSGLLPRMEPFVGELIGRG

SEQ ID NO: 1513173 - protein, 17 aa, Mycobacterium tuberculosis
LLDAEGLFDPRLKRPIP

SEQ ID NO: 1513174 - protein, 29 aa, Mycobacterium tuberculosis
LLTDPMLPAELLPADWPGAGLRAAYHDFA

SEQ ID NO: 1513175 - protein, 20 aa, Mycobacterium tuberculosis
LMRSCTGWPSGVWIDQPRRT

SEQ ID NO: 1513176 - protein, 29 aa, Mycobacterium tuberculosis
LPGGIDSPELLWKALLRGDDLITEVPPDR

SEQ ID NO: 1513177 - protein, 20 aa, Mycobacterium tuberculosis
LRMFTGAGSAPMLAASVAWD

SEQ ID NO: 1513178 - protein, 26 aa, Mycobacterium tuberculosis
LRMVARPMINVFPSGRKEVFRLRLAS

SEQ ID NO: 1513179 - protein, 22 aa, Mycobacterium tuberculosis
LTLPDVFPNGLANKYTFGPIGE

SEQ ID NO: 1513180 - protein, 18 aa, Mycobacterium tuberculosis
LVMQRWVYHSTRLAVPTH

SEQ ID NO: 1513181 - protein, 23 aa, Mycobacterium tuberculosis
LVSCMVALPTQLFRSTGIPVCLW

SEQ ID NO: 1513182 - protein, 25 aa, Mycobacterium tuberculosis
LVSLTQILAWDLPLTKRLAEQVAKQ

SEQ ID NO: 1513183 - protein, 26 aa, Mycobacterium tuberculosis
MARAVAPYLGWLISATAQAEQAAAQA

SEQ ID NO: 1513184 - protein, 29 aa, Mycobacterium tuberculosis
MGRGSTWARQLPWLTLLGAVYTYDAPWHR

SEQ ID NO: 1513185 - protein, 25 aa, Mycobacterium tuberculosis
NCDVLLTQLEIPVATALAAARAAQS

SEQ ID NO: 1513186 - protein, 29 aa, Mycobacterium tuberculosis
NGVARVIAYRWLRVGRLPVPARRVGRVIL

SEQ ID NO: 1513187 - protein, 19 aa, Mycobacterium tuberculosis
NGVVLFPGAGFVELVIRAG

SEQ ID NO: 1513188 - protein, 17 aa, Mycobacterium tuberculosis
PAALVQALFNLGEMVTA

SEQ ID NO: 1513189 - protein, 25 aa, Mycobacterium tuberculosis
PAIDPILLKVLDAVPFRLSIDDGIE

SEQ ID NO: 1513190 - protein, 17 aa, Mycobacterium tuberculosis
PAVAPWPGPTGERADWW

SEQ ID NO: 1513191 - protein, 17 aa, Mycobacterium tuberculosis
PDAVVPTVLPLAGTATP

SEQ ID NO: 1513192 - protein, 20 aa, Mycobacterium tuberculosis
PDTQLVTIIVSWLSGELPQR

SEQ ID NO: 1513193 - protein, 20 aa, Mycobacterium tuberculosis
PEYKFVLAEVDYLKPYWDTH

SEQ ID NO: 1513194 - protein, 18 aa, Mycobacterium tuberculosis
PFKRRLFGQIVAAAVRAT

SEQ ID NO: 1513195 - protein, 26 aa, Mycobacterium tuberculosis
PGTFEGWLHRITTNLFLDMVRRRARI

SEQ ID NO: 1513196 - protein, 18 aa, Mycobacterium tuberculosis
PHIAMTAAMLRQAGVDID

SEQ ID NO: 1513197 - protein, 21 aa, Mycobacterium tuberculosis
PKVPRAARVAVRWLRAVALDR

SEQ ID NO: 1513198 - protein, 24 aa, Mycobacterium tuberculosis
PLDKLPPGPIPGTGGQPLQPFKPS

SEQ ID NO: 1513199 - protein, 26 aa, Mycobacterium tuberculosis
PLDSPELIRLAPRPAARTDPMLLAWT

SEQ ID NO: 1513200 - protein, 22 aa, Mycobacterium tuberculosis
PTECEFFSLRGLALLTDTVDKV

SEQ ID NO: 1513201 - protein, 17 aa, Mycobacterium tuberculosis
PTQLFRSTGIPVCLWFF

SEQ ID NO: 1513202 - protein, 24 aa, Mycobacterium tuberculosis
PVCDCGGLIRPDIVWFGEPLPEEP

SEQ ID NO: 1513203 - protein, 20 aa, Mycobacterium tuberculosis
PVLYCHALLMLTRLKPGASC

SEQ ID NO: 1513204 - protein, 22 aa, Mycobacterium tuberculosis
QAVAASVWPMIAANRVRPVIGT

SEQ ID NO: 1513205 - protein, 23 aa, Mycobacterium tuberculosis
QAVAASVWPMIAANRVRPVIGTR

SEQ ID NO: 1513206 - protein, 24 aa, Mycobacterium tuberculosis
QKANLKLIVVDYLQLMTSGKKYES

SEQ ID NO: 1513207 - protein, 28 aa, Mycobacterium tuberculosis
QLFRSTGIPVCLWFFAKDKAAGKQGSID

SEQ ID NO: 1513208 - protein, 17 aa, Mycobacterium tuberculosis
QLHRATADQPLDWFCSF

SEQ ID NO: 1513209 - protein, 24 aa, Mycobacterium tuberculosis
QNLDHTVLGIFRHISRPTYDDAAR

SEQ ID NO: 1513210 - protein, 23 aa, Mycobacterium tuberculosis
QPADHILAILRQLNAVVIHADSS

SEQ ID NO: 1513211 - protein, 21 aa, Mycobacterium tuberculosis
QPFGVYLHVPFCLTRCGYCDF

SEQ ID NO: 1513212 - protein, 24 aa, Mycobacterium tuberculosis
QRRAVRQWLVRWAAHPGRATRGFH

SEQ ID NO: 1513213 - protein, 17 aa, Mycobacterium tuberculosis
QVHLRLISGDRITTLAL

SEQ ID NO: 1513214 - protein, 21 aa, Mycobacterium tuberculosis
RANLVYWAAANLRDPGARVPA

SEQ ID NO: 1513215 - protein, 20 aa, Mycobacterium tuberculosis
RAPFGTMPLPKLIDGQDHSA

SEQ ID NO: 1513216 - protein, 23 aa, Mycobacterium tuberculosis
RAQTLLSQLPRWQEPPQIHQRGR

SEQ ID NO: 1513217 - protein, 30 aa, Mycobacterium tuberculosis; identical to SEQ ID NO: 226785

SEQ ID NO: 1513218 - protein, 26 aa, Mycobacterium tuberculosis
RDSIVAINPLIRVRLHELRLAPSNAV

SEQ ID NO: 1513219 - protein, 25 aa, Mycobacterium tuberculosis
RFEVAAHEFLLFPTVAHSHAERVRP

SEQ ID NO: 1513220 - protein, 26 aa, Mycobacterium tuberculosis
RKALVARLYARRYLADQGPLRGIDAD

SEQ ID NO: 1513221 - protein, 20 aa, Mycobacterium tuberculosis
RMIEAYHRLSKLNEYSAIDF

SEQ ID NO: 1513222 - protein, 25 aa, Mycobacterium tuberculosis
RPDAPMAGVTYWRKAAQLKRNEAND

SEQ ID NO: 1513223 - protein, 20 aa, Mycobacterium tuberculosis
RQEIARIYTVLRERELGLAT

SEQ ID NO: 1513224 - protein, 17 aa, Mycobacterium tuberculosis
RREPLPLPLKTSCAWAQ

SEQ ID NO: 1513225 - protein, 19 aa, Mycobacterium tuberculosis
RRILDINVYGVILGSKLAA

SEQ ID NO: 1513226 - protein, 19 aa, Mycobacterium tuberculosis
RRLEAGMKLGWHPYHFPDE

SEQ ID NO: 1513227 - protein, 19 aa, Mycobacterium tuberculosis
RSSVYWRLMALDQRFGIAD

SEQ ID NO: 1513228 - protein, 22 aa, Mycobacterium tuberculosis
SASRLIPFAAPPKTTNSAGVVA

SEQ ID NO: 1513229 - protein, 18 aa, Mycobacterium tuberculosis
SDFLHGRWLVLRRGKRSI

SEQ ID NO: 1513230 - protein, 28 aa, Mycobacterium tuberculosis
SDMTRTFVLGKAADWQLEIYQLVAEAQQ

SEQ ID NO: 1513231 - protein, 28 aa, Mycobacterium tuberculosis
SGNYSNGFFWRGDYQGLIGLSTTITIPE

SEQ ID NO: 1513232 - protein, 19 aa, Mycobacterium tuberculosis
SLITSWRALGWIGPEAAEA

SEQ ID NO: 1513233 - protein, 25 aa, Mycobacterium tuberculosis
SRSSMVIFSMRLATASTRRPAVGLS

SEQ ID NO: 1513234 - protein, 19 aa, Mycobacterium tuberculosis
SVVIAYEPVWAIGTGRVAS

SEQ ID NO: 1513235 - protein, 21 aa, Mycobacterium tuberculosis
TDQRLLDLLPPAPVDVNPPGD

SEQ ID NO: 1513236 - protein, 17 aa, Mycobacterium tuberculosis
TDRKALVARLYARRYLA

SEQ ID NO: 1513237 - protein, 24 aa, Mycobacterium tuberculosis
TFGPIGELWYRKSGTYRGKVQNLT

SEQ ID NO: 1513238 - protein, 20 aa, Mycobacterium tuberculosis
TFNDLLATMLWHGTLDSRLR

SEQ ID NO: 1513239 - protein, 30 aa, Mycobacterium tuberculosis; identical to SEQ ID NO: 223384

SEQ ID NO: 1513240 - protein, 26 aa, Mycobacterium tuberculosis
TIAHGFMTLALLPRLQHQMYTVKGVK

SEQ ID NO: 1513241 - protein, 27 aa, Mycobacterium tuberculosis
TIAHGFMTLALLPRLQHQMYTVKGVKL

SEQ ID NO: 1513242 - protein, 19 aa, Mycobacterium tuberculosis
TIYDKFPTLTPDQAAGVIT

SEQ ID NO: 1513243 - protein, 23 aa, Mycobacterium tuberculosis
TLLGRLLVYDALEMSYRTITIRK

SEQ ID NO: 1513244 - protein, 21 aa, Mycobacterium tuberculosis
TLPDVFPNGLANKYTFGPIGE

SEQ ID NO: 1513245 - protein, 18 aa, Mycobacterium tuberculosis
TNPPLLLATRHLVGDDGT

SEQ ID NO: 1513246 - protein, 19 aa, Mycobacterium tuberculosis
TRAALRTCMHHKRFGELRE

SEQ ID NO: 1513247 - protein, 25 aa, Mycobacterium tuberculosis
TSDQEVRWCPGCGDYVILNTIRNFL

SEQ ID NO: 1513248 - protein, 23 aa, Mycobacterium tuberculosis
TSEIEPFIVWTSSGAIGPTWYSV

SEQ ID NO: 1513249 - protein, 17 aa, Mycobacterium tuberculosis
TVEILKWAKDQGISITA

SEQ ID NO: 1513250 - protein, 33 aa, Mycobacterium tuberculosis; identical to SEQ ID NO: 223775

SEQ ID NO: 1513251 - protein, 26 aa, Mycobacterium tuberculosis
VAASIGAYLWVPDILECLASVMADAG

SEQ ID NO: 1513252 - protein, 17 aa, Mycobacterium tuberculosis
VADAFGHAGGCPHPLVV

SEQ ID NO: 1513253 - protein, 31 aa, Mycobacterium tuberculosis
VAEVWRRGSVIGSWLLDLTAIALRESPDLAE

SEQ ID NO: 1513254 - protein, 29 aa, Mycobacterium tuberculosis
VAQLLLRVGIFSWITHAPKLGGHDSWRLH

SEQ ID NO: 1513255 - protein, 27 aa, Mycobacterium tuberculosis
VDDALYQMELVGHDFFLFYDKDTERPS

SEQ ID NO: 1513256 - protein, 24 aa, Mycobacterium tuberculosis
VETYSVLTRLPPPHRIAPVAVHAY

SEQ ID NO: 1513257 - protein, 35 aa, Mycobacterium tuberculosis; identical to SEQ ID NO: 225728

SEQ ID NO: 1513258 - protein, 28 aa, Mycobacterium tuberculosis
VGSGPVFLQYPWQVIPDEIIKPLQDAAR

SEQ ID NO: 1513259 - protein, 17 aa, Mycobacterium tuberculosis
VHAALRAALRASAARSL

SEQ ID NO: 1513260 - protein, 20 aa, Mycobacterium tuberculosis
VHGWVQGVGFRWWTRCRALE

SEQ ID NO: 1513261 - protein, 17 aa, Mycobacterium tuberculosis
VLGQALLARRMGKTRVI

SEQ ID NO: 1513262 - protein, 18 aa, Mycobacterium tuberculosis
VMEFPVLPPEINSVLMYS

SEQ ID NO: 1513263 - protein, 18 aa, Mycobacterium tuberculosis
VQFDPLTRLTNSDIIACI

SEQ ID NO: 1513264 - protein, 21 aa, Mycobacterium tuberculosis
VRMIEAYHRLSKLNEYSAIDF

SEQ ID NO: 1513265 - protein, 20 aa, Mycobacterium tuberculosis
VRQMLRRVTIIDSGSTEFLP

SEQ ID NO: 1513266 - protein, 24 aa, Mycobacterium tuberculosis
VRQPPPRLANLLPLIRPHEHMPDS

SEQ ID NO: 1513267 - protein, 29 aa, Mycobacterium tuberculosis
VRTDEQWRWLAHTLTVELLKELLPETAGL

SEQ ID NO: 1513268 - protein, 20 aa, Mycobacterium tuberculosis
VRYLSGFSGSNGALLVFADE

SEQ ID NO: 1513269 - protein, 19 aa, Mycobacterium tuberculosis
VTPILPMIRAAEQRGIDWR

SEQ ID NO: 1513270 - protein, 20 aa, Mycobacterium tuberculosis
VTPTPIPLTLNLDTTPWTLF

SEQ ID NO: 1513271 - protein, 20 aa, Mycobacterium tuberculosis
VTVDWHMPPRARKPQRRVRL

SEQ ID NO: 1513272 - protein, 20 aa, Mycobacterium tuberculosis
VVAGVLFLENIIVPGLTVSG

SEQ ID NO: 1513273 - protein, 20 aa, Mycobacterium tuberculosis
VVGIFPDRASIIRLVGAVLA

SEQ ID NO: 1513274 - protein, 17 aa, Mycobacterium tuberculosis
VVPVMFDRIMDLPAEIR

SEQ ID NO: 1513275 - protein, 17 aa, Mycobacterium tuberculosis
WALYEAYIKLLTGEVDT

SEQ ID NO: 1513276 - protein, 24 aa, Mycobacterium tuberculosis
YGAPPIAIGPLYQPKTLQLCADGD

SEQ ID NO: 1513277 - protein, 29 aa, Mycobacterium tuberculosis
YSYIENYAPRPLLDLPWDIQESPAGMAVA

SEQ ID NO: 1513278 - protein, 27 aa, Mycobacterium tuberculosis
YTLTGPIVIGSFFLPAFNIPGIDVPAI

SEQ ID NO: 1513279 - protein, 20 aa, Mycobacterium tuberculosis
AAAPYAGFLTTASAQAQLAA

SEQ ID NO: 1513280 - protein, 32 aa, Mycobacterium tuberculosis
AADRFATMSPAERWHLLASAWLDLPGRPALIG

SEQ ID NO: 1513281 - protein, 40 aa, Mycobacterium tuberculosis; identical to SEQ ID NO: 215466

SEQ ID NO: 1513282 - protein, 22 aa, Mycobacterium tuberculosis
AAMRWGHLPLAEESGTIAPQLV

SEQ ID NO: 1513283 - protein, 25 aa, Mycobacterium tuberculosis
AAVAQLAPWQQVLRNLGIDIGKNGQ

SEQ ID NO: 1513284 - protein, 17 aa, Mycobacterium tuberculosis
ACVDLELHPGRTVFVGP

SEQ ID NO: 1513285 - protein, 27 aa, Mycobacterium tuberculosis
ADFADLFPVPAKLWTIADLGGWGSVDP

SEQ ID NO: 1513286 - protein, 20 aa, Mycobacterium tuberculosis
ADVFVHYTEIQGTGFRTLEE

SEQ ID NO: 1513287 - protein, 19 aa, Mycobacterium tuberculosis
ADVWTPRDRMPVFPVPDGH

SEQ ID NO: 1513288 - protein, 18 aa, Mycobacterium tuberculosis
AEHQAIISDVLTASDFWG

SEQ ID NO: 1513289 - protein, 17 aa, Mycobacterium tuberculosis
AELSSRLPPRGLTQAAR

SEQ ID NO: 1513290 - protein, 26 aa, Mycobacterium tuberculosis
AELTIDALINRVVPIPGLRSTEAQWA

SEQ ID NO: 1513291 - protein, 30 aa, Mycobacterium tuberculosis; identical to SEQ ID NO: 215768

SEQ ID NO: 1513292 - protein, 21 aa, Mycobacterium tuberculosis
AFDQIMMDVALHKLPVTMVLD

SEQ ID NO: 1513293 - protein, 25 aa, Mycobacterium tuberculosis
AFDRIDERLVVVGLDNTVTYKNGDP

SEQ ID NO: 1513294 - protein, 17 aa, Mycobacterium tuberculosis
AFITGNFNNGFLWRGDH

SEQ ID NO: 1513295 - protein, 18 aa, Mycobacterium tuberculosis
AFVQLVMTNLFGQNAPLI

SEQ ID NO: 1513296 - protein, 23 aa, Mycobacterium tuberculosis
AGELALLRLACEAADAALTDLVA

SEQ ID NO: 1513297 - protein, 25 aa, Mycobacterium tuberculosis
AGGQVWLMPHNPAFDPIPGNDATVL

SEQ ID NO: 1513298 - protein, 20 aa, Mycobacterium tuberculosis
AGHRWPSFATQTLWRFFAAH

SEQ ID NO: 1513299 - protein, 17 aa, Mycobacterium tuberculosis
AGLIGTIGIRVGGADLP

SEQ ID NO: 1513300 - protein, 28 aa, Mycobacterium tuberculosis
AGRSYRLYKPVGLPSSAPLVVMLHGGFG

SEQ ID NO: 1513301 - protein, 24 aa, Mycobacterium tuberculosis
AGTGWLPGWRLTFGGEDIGWEGAL

SEQ ID NO: 1513302 - protein, 20 aa, Mycobacterium tuberculosis
ALGMVFGRKRPGSGPLMIGS

SEQ ID NO: 1513303 - protein, 20 aa, Mycobacterium tuberculosis
ALLAGCTIVLKPAAETPLTA

SEQ ID NO: 1513304 - protein, 18 aa, Mycobacterium tuberculosis
ALVKTYVADALAADLYLE

SEQ ID NO: 1513305 - protein, 17 aa, Mycobacterium tuberculosis
ANRANLVYWAAANLRDP

SEQ ID NO: 1513306 - protein, 25 aa, Mycobacterium tuberculosis
APGVVTTWMKLAIRDRILPDDDIDE

SEQ ID NO: 1513307 - protein, 20 aa, Mycobacterium tuberculosis
APSVDPMFAKSEAALTSVSG

SEQ ID NO: 1513308 - protein, 23 aa, Mycobacterium tuberculosis
APTALLRVYRDKLPHRYAKALRR

SEQ ID NO: 1513309 - protein, 19 aa, Mycobacterium tuberculosis
AQLFHTSGHLDWYADGMFP

SEQ ID NO: 1513310 - protein, 24 aa, Mycobacterium tuberculosis
ARQGFTIALVPPSDDPVPPGMHAL

SEQ ID NO: 1513311 - protein, 25 aa, Mycobacterium tuberculosis
ASTPSLCKPLRQILFRDDYGPIASE

SEQ ID NO: 1513312 - protein, 25 aa, Mycobacterium tuberculosis
ATAFRNFQYTVQAQKLWAQAGFRPV

SEQ ID NO: 1513313 - protein, 20 aa, Mycobacterium tuberculosis
ATSLISYMLPRSPIVRIVDS

SEQ ID NO: 1513314 - protein, 29 aa, Mycobacterium tuberculosis
AVLGVIDSITLLPLYFELDGSFPNHEANP

SEQ ID NO: 1513315 - protein, 24 aa, Mycobacterium tuberculosis
AVRDGMATLNPLAAQIIGQLSSLE

SEQ ID NO: 1513316 - protein, 23 aa, Mycobacterium tuberculosis
AVRQWGFMQGLKQKLGPGVDVRM

SEQ ID NO: 1513317 - protein, 27 aa, Mycobacterium tuberculosis
AVTIPGFAINPFGLNVPLSGGTSPVTI

SEQ ID NO: 1513318 - protein, 27 aa, Mycobacterium tuberculosis
CGLAGTVLRFVPPLAALGSVPVTFDGD

SEQ ID NO: 1513319 - protein, 36 aa, Mycobacterium tuberculosis
CLATITALPRYRDRGRPFLAFLYGIAAHKVADAHRA

SEQ ID NO: 1513320 - protein, 19 aa, Mycobacterium tuberculosis
CPLALGRLLDNPTVTSIAS

SEQ ID NO: 1513321 - protein, 21 aa, Mycobacterium tuberculosis
DEEILAAYHLVARVEGVFVEP

SEQ ID NO: 1513322 - protein, 23 aa, Mycobacterium tuberculosis
DELERRNARRALITLCIGGGMGV

SEQ ID NO: 1513323 - protein, 26 aa, Mycobacterium tuberculosis
DGTGWRWRTWHLYPSASGGTVVHTTS

SEQ ID NO: 1513324 - protein, 27 aa, Mycobacterium tuberculosis
DHAMLATGLLALYQLTSEGAWLTAATG

SEQ ID NO: 1513325 - protein, 17 aa, Mycobacterium tuberculosis
DHVELSARVAWMSESQL

SEQ ID NO: 1513326 - protein, 23 aa, Mycobacterium tuberculosis
DIKAPLLAALGAADLALATVNEL

SEQ ID NO: 1513327 - protein, 29 aa, Mycobacterium tuberculosis
DPAELRLRNLLRPNQFPYQSKTGWVYDSG

SEQ ID NO: 1513328 - protein, 17 aa, Mycobacterium tuberculosis
DPDACDVVLLLMDSRAR

SEQ ID NO: 1513329 - protein, 24 aa, Mycobacterium tuberculosis
DQGQGVFDCAHRGGFEGAESLHES

SEQ ID NO: 1513330 - protein, 43 aa, Mycobacterium tuberculosis; identical to SEQ ID NO: 226065

SEQ ID NO: 1513331 - protein, 22 aa, Mycobacterium tuberculosis
DTYRAHPVLYGTRPSEPGVYAA

SEQ ID NO: 1513332 - protein, 17 aa, Mycobacterium tuberculosis
DVSDDFFALFQDPTRTY

SEQ ID NO: 1513333 - protein, 41 aa, Mycobacterium tuberculosis; identical to SEQ ID NO: 217342

SEQ ID NO: 1513334 - protein, 25 aa, Mycobacterium tuberculosis
EAGKVYRLWVVGRLQLWHGYRLGLI

SEQ ID NO: 1513335 - protein, 19 aa, Mycobacterium tuberculosis
EDFSWYLEEVPGAMARLGV

SEQ ID NO: 1513336 - protein, 23 aa, Mycobacterium tuberculosis
EEVDKMVWATRWGADTIMDLSTG

SEQ ID NO: 1513337 - protein, 22 aa, Mycobacterium tuberculosis
EGISLSSLALNCDILDPTDGDD

SEQ ID NO: 1513338 - protein, 18 aa, Mycobacterium tuberculosis
EIAPQWHLRMQAAVQRHV

SEQ ID NO: 1513339 - protein, 17 aa, Mycobacterium tuberculosis
EIDFGPSPAINLNIGKP

SEQ ID NO: 1513340 - protein, 18 aa, Mycobacterium tuberculosis
EIDIGHRTIPNYGGFDLG

SEQ ID NO: 1513341 - protein, 20 aa, Mycobacterium tuberculosis
EIEALYYLHPLTGEVIRQVD

SEQ ID NO: 1513342 - protein, 24 aa, Mycobacterium tuberculosis
ELRHHIATPQPLQWDCFLFGIIQS

SEQ ID NO: 1513343 - protein, 23 aa, Mycobacterium tuberculosis
ELTLAAPLVLPASGSVAVQVVVN

SEQ ID NO: 1513344 - protein, 23 aa, Mycobacterium tuberculosis
ESQLPELAVQMRRRLIETVTATG

SEQ ID NO: 1513345 - protein, 22 aa, Mycobacterium tuberculosis
EVRPDRSTTLALRWLVGYSRQR

SEQ ID NO: 1513346 - protein, 18 aa, Mycobacterium tuberculosis
FAALSLEPPLVLFCPTKV

SEQ ID NO: 1513347 - protein, 31 aa, Mycobacterium tuberculosis; identical to SEQ ID NO: 217907

SEQ ID NO: 1513348 - protein, 18 aa, Mycobacterium tuberculosis
FGFSIPQLGFTLSGATPA

SEQ ID NO: 1513349 - protein, 23 aa, Mycobacterium tuberculosis
FGPIGELWYRKSGTYRGKVQNLT

SEQ ID NO: 1513350 - protein, 17 aa, Mycobacterium tuberculosis
FIHELLVEHLHVVEVVV

SEQ ID NO: 1513351 - protein, 18 aa, Mycobacterium tuberculosis
FLSGGYSLPAIPLGIDVG

SEQ ID NO: 1513352 - protein, 17 aa, Mycobacterium tuberculosis
FSFGDYFKRGAIELAWA

SEQ ID NO: 1513353 - protein, 24 aa, Mycobacterium tuberculosis
FVELPTYAFQRRRFWLSGDGVAAD

SEQ ID NO: 1513354 - protein, 20 aa, Mycobacterium tuberculosis
GAPGLGGRGGLLLGLPGANG

SEQ ID NO: 1513355 - protein, 22 aa, Mycobacterium tuberculosis
GDEVILPSYTFVSTANAFVLRG

SEQ ID NO: 1513356 - protein, 31 aa, Mycobacterium tuberculosis; identical to SEQ ID NO: 218266

SEQ ID NO: 1513357 - protein, 18 aa, Mycobacterium tuberculosis
GEWFGALAVIAPSVSIQP

SEQ ID NO: 1513358 - protein, 31 aa, Mycobacterium tuberculosis; identical to SEQ ID NO: 114747

SEQ ID NO: 1513359 - protein, 23 aa, Mycobacterium tuberculosis
GHATAIMWAREQFGLELIWGIED

SEQ ID NO: 1513360 - protein, 30 aa, Mycobacterium tuberculosis; identical to SEQ ID NO: 817150

SEQ ID NO: 1513361 - protein, 22 aa, Mycobacterium tuberculosis
GIGPPITDGFYYDFDVPEPFTP

SEQ ID NO: 1513362 - protein, 27 aa, Mycobacterium tuberculosis
GLAGFSFGYPIPLFPAVGADVTGDIGP

SEQ ID NO: 1513363 - protein, 21 aa, Mycobacterium tuberculosis
GLDMSRLMIFTWDLPGRCNIR

SEQ ID NO: 1513364 - protein, 29 aa, Mycobacterium tuberculosis
GLDRVRGPIPFSLRKFLAGKQVVPHQASF

SEQ ID NO: 1513365 - protein, 23 aa, Mycobacterium tuberculosis
GLMRRHIKPYQKPHPPIGVTGFS

SEQ ID NO: 1513366 - protein, 27 aa, Mycobacterium tuberculosis
GNVDALFLFDVLLHQVSPDWDTILDMY

SEQ ID NO: 1513367 - protein, 26 aa, Mycobacterium tuberculosis
GPLTTPPITIPAIPLGIDVSGSLGPI

SEQ ID NO: 1513368 - protein, 27 aa, Mycobacterium tuberculosis
GVAPGTAYRWFRAGLLSVMARRVGRLI

SEQ ID NO: 1513369 - protein, 20 aa, Mycobacterium tuberculosis
GVDLVPTLLDLLRLEVPADV

SEQ ID NO: 1513370 - protein, 23 aa, Mycobacterium tuberculosis
GVKVLPWIPTPAKRILSAGRSVI

SEQ ID NO: 1513371 - protein, 25 aa, Mycobacterium tuberculosis
GVVITPQAELLPTDKHFAPAVLNDV

SEQ ID NO: 1513372 - protein, 18 aa, Mycobacterium tuberculosis
GWGYPQPRSGQRARRATG

SEQ ID NO: 1513373 - protein, 18 aa, Mycobacterium tuberculosis
GWVQGVGFRWWTRCRALE

SEQ ID NO: 1513374 - protein, 21 aa, Mycobacterium tuberculosis
GYGMVSYWTAYLKANYPAEYM

SEQ ID NO: 1513375 - protein, 30 aa, Mycobacterium tuberculosis; identical to SEQ ID NO: 219078

SEQ ID NO: 1513376 - protein, 21 aa, Mycobacterium tuberculosis
HGRFALGERLLGFGSVTGAHI

SEQ ID NO: 1513377 - protein, 27 aa, Mycobacterium tuberculosis
HGVSWLPLYHDMGLSMIGFPAVYGGHS

SEQ ID NO: 1513378 - protein, 20 aa, Mycobacterium tuberculosis
HHIATPQPLQWDCFLFGIIQ

SEQ ID NO: 1513379 - protein, 17 aa, Mycobacterium tuberculosis
HLRGWTLDRLPAVDRAI

SEQ ID NO: 1513380 - protein, 22 aa, Mycobacterium tuberculosis
HVHLGLYGTFTEWARPTDGWLP

SEQ ID NO: 1513381 - protein, 22 aa, Mycobacterium tuberculosis
HVVEVVVGENFTFGKKAAGNVD

SEQ ID NO: 1513382 - protein, 25 aa, Mycobacterium tuberculosis
HYAGAFPAWLAPVQVVGIPVADEHV

SEQ ID NO: 1513383 - protein, 18 aa, Mycobacterium tuberculosis
IAAVFPDGPQRYFDTIYN

SEQ ID NO: 1513384 - protein, 21 aa, Mycobacterium tuberculosis
IAFLAWHAWNDAERGNWPPGF

SEQ ID NO: 1513385 - protein, 21 aa, Mycobacterium tuberculosis
IAHLPNTLLGLTSPLSSALTA

SEQ ID NO: 1513386 - protein, 31 aa, Mycobacterium tuberculosis
IAIGGLYGDITYPVTSPLAITMGFAACEAAQ

SEQ ID NO: 1513387 - protein, 25 aa, Mycobacterium tuberculosis
IDERTVICVLTHDPKFDVPVLEVAL

SEQ ID NO: 1513388 - protein, 21 aa, Mycobacterium tuberculosis
IDQLPSLPPLPTDLRTRLDAA

SEQ ID NO: 1513389 - protein, 18 aa, Mycobacterium tuberculosis
IGDMLTYGSIGTTATLDC

SEQ ID NO: 1513390 - protein, 19 aa, Mycobacterium tuberculosis
IPAFKLTRSSAAYWRGDQK

SEQ ID NO: 1513391 - protein, 27 aa, Mycobacterium tuberculosis
IQLHNQARLPYLVYLRHPTTGGVFASW

SEQ ID NO: 1513392 - protein, 19 aa, Mycobacterium tuberculosis
ISDVLTASDFWGGAGSAAC

SEQ ID NO: 1513393 - protein, 17 aa, Mycobacterium tuberculosis
IVVIKPSTGEILAIAQN

SEQ ID NO: 1513394 - protein, 22 aa, Mycobacterium tuberculosis
KEYRDWFATLPAELTDVVTAYW

SEQ ID NO: 1513395 - protein, 26 aa, Mycobacterium tuberculosis
KPAIDPILLKVLDAVPFRLSIDDGIE

SEQ ID NO: 1513396 - protein, 24 aa, Mycobacterium tuberculosis
KRVCRDCGFFLPLAGSLGAMFGVC

SEQ ID NO: 1513397 - protein, 20 aa, Mycobacterium tuberculosis
LAGQSWQGAAAAAMAAAAAP

SEQ ID NO: 1513398 - protein, 19 aa, Mycobacterium tuberculosis
LCQIPTLTAPYRAVLEYRS

SEQ ID NO: 1513399 - protein, 25 aa, Mycobacterium tuberculosis
LDTDSFYRPKRPGSYPIVLATYEIV

SEQ ID NO: 1513400 - protein, 20 aa, Mycobacterium tuberculosis
LGLPVVVRPSFTMGGLGSGI

SEQ ID NO: 1513401 - protein, 18 aa, Mycobacterium tuberculosis
LHRLGIQAFEPMLVEGKA

SEQ ID NO: 1513402 - protein, 19 aa, Mycobacterium tuberculosis
LIYTGAGPGPLLAAAAAWD

SEQ ID NO: 1513403 - protein, 20 aa, Mycobacterium tuberculosis
LLFEPLRAALADHARLDFLA

SEQ ID NO: 1513404 - protein, 18 aa, Mycobacterium tuberculosis
LLMLTRLKPGASCATSGF

SEQ ID NO: 1513405 - protein, 17 aa, Mycobacterium tuberculosis
LMRIWNQPHWIRVSIDV

SEQ ID NO: 1513406 - protein, 19 aa, Mycobacterium tuberculosis
LPQLSIPAITTPAFTIDPI

SEQ ID NO: 1513407 - protein, 19 aa, Mycobacterium tuberculosis
LPVPARKVGRLILVDELAS

SEQ ID NO: 1513408 - protein, 22 aa, Mycobacterium tuberculosis
LRADACFVIGFGILRHIRCAGI

SEQ ID NO: 1513409 - protein, 19 aa, Mycobacterium tuberculosis
LRGCYRIAVLSLKGGVGKT

SEQ ID NO: 1513410 - protein, 24 aa, Mycobacterium tuberculosis
LRLVNWQRIRHRWNWTDVRRWLTD

SEQ ID NO: 1513411 - protein, 25 aa, Mycobacterium tuberculosis
LSAQAATFHIQFVQALTAGAGSYAA

SEQ ID NO: 1513412 - protein, 21 aa, Mycobacterium tuberculosis
LTGLRIEDGLLKKLGAEAVAQ

SEQ ID NO: 1513413 - protein, 17 aa, Mycobacterium tuberculosis
LTRQDIDDIFWLQATIA

SEQ ID NO: 1513414 - protein, 25 aa, Mycobacterium tuberculosis
MARAVAPYLGWLISATAQAEQAAAQ

SEQ ID NO: 1513415 - protein, 17 aa, Mycobacterium tuberculosis
MLAALHVLAALGEQSRP

SEQ ID NO: 1513416 - protein, 27 aa, Mycobacterium tuberculosis
MRSGERPMVWSLDERLRMVARPMINVF

SEQ ID NO: 1513417 - protein, 41 aa, Mycobacterium tuberculosis
MTIKPLMTVGSYLSPLPLPLGFVDFACRVWRPGQGTVRTTI

SEQ ID NO: 1513418 - protein, 22 aa, Mycobacterium tuberculosis
MTRRTLPVLGLAHELITPTLRQ

SEQ ID NO: 1513419 - protein, 17 aa, Mycobacterium tuberculosis
MVAATMWDRYRQAVAGR

SEQ ID NO: 1513420 - protein, 29 aa, Mycobacterium tuberculosis
MWFTEAHWPAFRHVDFLRALRDYSARHRS

SEQ ID NO: 1513421 - protein, 31 aa, Mycobacterium tuberculosis; identical to SEQ ID NO: 220871

SEQ ID NO: 1513422 - protein, 26 aa, Mycobacterium tuberculosis
NIDDIKAPLLAALGAADLALATVNEL

SEQ ID NO: 1513423 - protein, 30 aa, Mycobacterium tuberculosis; identical to SEQ ID NO: 220885

SEQ ID NO: 1513424 - protein, 18 aa, Mycobacterium tuberculosis
NRYLVYTSADIRALYAFK

SEQ ID NO: 1513425 - protein, 18 aa, Mycobacterium tuberculosis
NWTDVRRWLTDPTGRWHP

SEQ ID NO: 1513426 - protein, 34 aa, Mycobacterium tuberculosis; identical to SEQ ID NO: 226639

SEQ ID NO: 1513427 - protein, 35 aa, Mycobacterium tuberculosis; identical to SEQ ID NO: 226640

SEQ ID NO: 1513428 - protein, 20 aa, Mycobacterium tuberculosis
PAVVKLHRWLTESLDHLHAS

SEQ ID NO: 1513429 - protein, 25 aa, Mycobacterium tuberculosis
PDAANGFILDGYPRSVEQAKALHEM

SEQ ID NO: 1513430 - protein, 20 aa, Mycobacterium tuberculosis
PFTVFPDGYSLPAIPLGIDV

SEQ ID NO: 1513431 - protein, 18 aa, Mycobacterium tuberculosis
PGVRRPRAWCSRIGRWPE

SEQ ID NO: 1513432 - protein, 18 aa, Mycobacterium tuberculosis
PLALGRLLDNPTVTSIAS

SEQ ID NO: 1513433 - protein, 24 aa, Mycobacterium tuberculosis
PNAHILPVPMMNILNGGAHADTAV

SEQ ID NO: 1513434 - protein, 19 aa, Mycobacterium tuberculosis
PPAALTGEWFGALAVIAPS

SEQ ID NO: 1513435 - protein, 28 aa, Mycobacterium tuberculosis
PSHELTAVGDWMLLAAIEALIDEQDYLA

SEQ ID NO: 1513436 - protein, 23 aa, Mycobacterium tuberculosis
PSQWSWRPWSLTVDVEPGPLGIT

SEQ ID NO: 1513437 - protein, 17 aa, Mycobacterium tuberculosis
PSTVRLFPVDGAVSPTI

SEQ ID NO: 1513438 - protein, 17 aa, Mycobacterium tuberculosis
PVATTGLYPPGSTFKMI

SEQ ID NO: 1513439 - protein, 22 aa, Mycobacterium tuberculosis
QGDFLIRGLLGADPTTGAIGIG

SEQ ID NO: 1513440 - protein, 24 aa, Mycobacterium tuberculosis
QKISELYDRVGFAAAGKFNEFDNL

SEQ ID NO: 1513441 - protein, 17 aa, Mycobacterium tuberculosis
QNWRGPVLGDLRSFMFV

SEQ ID NO: 1513442 - protein, 19 aa, Mycobacterium tuberculosis
QPMLSIHQRPFDPADRSEP

SEQ ID NO: 1513443 - protein, 17 aa, Mycobacterium tuberculosis
QPTLRRRMKLGVLAALD

SEQ ID NO: 1513444 - protein, 17 aa, Mycobacterium tuberculosis
QPVLLLREANGDRYLPI

SEQ ID NO: 1513445 - protein, 23 aa, Mycobacterium tuberculosis
QRREDMLRHPAFLSKQLPAEPAD

SEQ ID NO: 1513446 - protein, 21 aa, Mycobacterium tuberculosis
QVKIIDRVLASPLVTEAMVLS

SEQ ID NO: 1513447 - protein, 19 aa, Mycobacterium tuberculosis
RAWHGNWHMLIVTSIGTDA

SEQ ID NO: 1513448 - protein, 17 aa, Mycobacterium tuberculosis
RCRALELGLTGYAANHA

SEQ ID NO: 1513449 - protein, 25 aa, Mycobacterium tuberculosis
RCRGAAVVTPLLLADAYHARVDIPA

SEQ ID NO: 1513450 - protein, 30 aa, Mycobacterium tuberculosis; identical to SEQ ID NO: 222002

SEQ ID NO: 1513451 - protein, 31 aa, Mycobacterium tuberculosis
RCRSRARLLGLRLRRLRYLRTAAARRPQVTT

SEQ ID NO: 1513452 - protein, 26 aa, Mycobacterium tuberculosis
RDEGRWHVRWTTSGLHPKLGEHQTFA

SEQ ID NO: 1513453 - protein, 18 aa, Mycobacterium tuberculosis
RDEMVARFQSGDGPPIFL

SEQ ID NO: 1513454 - protein, 21 aa, Mycobacterium tuberculosis
RDFRSWACVDLELHPGRTVFV

SEQ ID NO: 1513455 - protein, 30 aa, Mycobacterium tuberculosis; identical to SEQ ID NO: 226806

SEQ ID NO: 1513456 - protein, 22 aa, Mycobacterium tuberculosis
RGIQLLPLWRRVHSHILRISLD

SEQ ID NO: 1513457 - protein, 19 aa, Mycobacterium tuberculosis
RGVRLVTFDAGVFTLAQQR

SEQ ID NO: 1513458 - protein, 34 aa, Mycobacterium tuberculosis; identical to SEQ ID NO: 222198

SEQ ID NO: 1513459 - protein, 18 aa, Mycobacterium tuberculosis
RILDINVYGVILGSKLAA

SEQ ID NO: 1513460 - protein, 17 aa, Mycobacterium tuberculosis
RITGWPRVSVQPADHIL

SEQ ID NO: 1513461 - protein, 20 aa, Mycobacterium tuberculosis
RLDFRPKHRLAVLVVSAIPL

SEQ ID NO: 1513462 - protein, 24 aa, Mycobacterium tuberculosis
RLDRFAGQLLPRRAAQKFADFANA

SEQ ID NO: 1513463 - protein, 18 aa, Mycobacterium tuberculosis
RLLDAEGLFDPRLKRPIP

SEQ ID NO: 1513464 - protein, 18 aa, Mycobacterium tuberculosis
RLVRIPWDLDSYGIHPDD

SEQ ID NO: 1513465 - protein, 21 aa, Mycobacterium tuberculosis
RQDIDDIFWLQATIAQELATS

SEQ ID NO: 1513466 - protein, 29 aa, Mycobacterium tuberculosis
RRCGSPAWNLPVVFGPIAVTYNLNSVSSL

SEQ ID NO: 1513467 - protein, 23 aa, Mycobacterium tuberculosis
RSLAWELSWKDTAAPLWTFPRVA

SEQ ID NO: 1513468 - protein, 23 aa, Mycobacterium tuberculosis
RSLLELAKLDAELTRIAHRATHL

SEQ ID NO: 1513469 - protein, 17 aa, Mycobacterium tuberculosis
RVWLGVAGLPAPGCRTI

SEQ ID NO: 1513470 - protein, 31 aa, Mycobacterium tuberculosis
SAAAAALAPWQQAVPGLLGLLDSAQSSAQAV

SEQ ID NO: 1513471 - protein, 24 aa, Mycobacterium tuberculosis
SAAASQLPPFTPPPATTSGAGSLS

SEQ ID NO: 1513472 - protein, 28 aa, Mycobacterium tuberculosis
SDTTTDPVLAWLYVLDAWEGGLPSARYL

SEQ ID NO: 1513473 - protein, 20 aa, Mycobacterium tuberculosis
SGHEVFLIVPGARTERHLLR

SEQ ID NO: 1513474 - protein, 20 aa, Mycobacterium tuberculosis
SIPEQPLPLAINVIGHINAL

SEQ ID NO: 1513475 - protein, 18 aa, Mycobacterium tuberculosis
SKRTLYQHFPSKSALVEE

SEQ ID NO: 1513476 - protein, 19 aa, Mycobacterium tuberculosis
SLPDAMGALLARSIVGIVE

SEQ ID NO: 1513477 - protein, 27 aa, Mycobacterium tuberculosis
SSAAGLVGLPWHAAYSASKYGLRGLSE

SEQ ID NO: 1513478 - protein, 25 aa, Mycobacterium tuberculosis
STGKDVYFNLSLWSAYNVMLMHTVL

SEQ ID NO: 1513479 - protein, 28 aa, Mycobacterium tuberculosis
STPGSALLFPSLCHFSGGIPAPEADPPY

SEQ ID NO: 1513480 - protein, 26 aa, Mycobacterium tuberculosis
STVPGPLQGINFGFGNIGSLNLGSGN

SEQ ID NO: 1513481 - protein, 18 aa, Mycobacterium tuberculosis
SWTFRGIPVRRPGRFFAT

SEQ ID NO: 1513482 - protein, 18 aa, Mycobacterium tuberculosis
TALYLGAQAIRGGLADCV

SEQ ID NO: 1513483 - protein, 18 aa, Mycobacterium tuberculosis
TAPVPIVRLLAVIGDRAA

SEQ ID NO: 1513484 - protein, 25 aa, Mycobacterium tuberculosis
TDAALRYLKWLSKHSKRLWQTANTI

SEQ ID NO: 1513485 - protein, 28 aa, Mycobacterium tuberculosis
TDRKALVARLYARRYLADQGPLRGIDAD

SEQ ID NO: 1513486 - protein, 27 aa, Mycobacterium tuberculosis
TGTVAYRFSWHLPKDRIWTYDGQLKMA

SEQ ID NO: 1513487 - protein, 22 aa, Mycobacterium tuberculosis
TIASGPSLARWARANGWSAPPG

SEQ ID NO: 1513488 - protein, 21 aa, Mycobacterium tuberculosis
TIPAGRRVLLLYGSANRDERQ

SEQ ID NO: 1513489 - protein, 24 aa, Mycobacterium tuberculosis
TKDVVGAYRFLQRVWRLVVDEHTG

SEQ ID NO: 1513490 - protein, 18 aa, Mycobacterium tuberculosis
TLFNPAAVPIRRYRYRGN

SEQ ID NO: 1513491 - protein, 19 aa, Mycobacterium tuberculosis
TLPTMPPWHVQENKWRAAR

SEQ ID NO: 1513492 - protein, 18 aa, Mycobacterium tuberculosis
TNRALVLAALAAAQGRGA

SEQ ID NO: 1513493 - protein, 17 aa, Mycobacterium tuberculosis
TPFNGPLGRLRNIAYTQ

SEQ ID NO: 1513494 - protein, 27 aa, Mycobacterium tuberculosis
TPNGRPFFCGTYYPKAAFLQLLSAISE

SEQ ID NO: 1513495 - protein, 24 aa, Mycobacterium tuberculosis
TSDQEVRWCPGCGDYVILNTIRNF

SEQ ID NO: 1513496 - protein, 27 aa, Mycobacterium tuberculosis
TSGAGPVVIPLLDIPPAPGFGNSTTGP

SEQ ID NO: 1513497 - protein, 20 aa, Mycobacterium tuberculosis
TTIYDKFPTLTPDQAAGVIT

SEQ ID NO: 1513498 - protein, 20 aa, Mycobacterium tuberculosis
TTPPFAIDPIGLSGFTLPQV

SEQ ID NO: 1513499 - protein, 23 aa, Mycobacterium tuberculosis
TVRRRLAIVQRWRGQDEIPTDWG

SEQ ID NO: 1513500 - protein, 17 aa, Mycobacterium tuberculosis
VAALGMYPGQAPPLGAE

SEQ ID NO: 1513501 - protein, 24 aa, Mycobacterium tuberculosis
VAQVRGLLDVKRWVTLTGVGGVGK

SEQ ID NO: 1513502 - protein, 17 aa, Mycobacterium tuberculosis
VAVAVLRRLAPRARITG

SEQ ID NO: 1513503 - protein, 19 aa, Mycobacterium tuberculosis
VAVRRISMSFVNVAPQLVS

SEQ ID NO: 1513504 - protein, 18 aa, Mycobacterium tuberculosis
VFTTAYYAFIHLADVQPG

SEQ ID NO: 1513505 - protein, 22 aa, Mycobacterium tuberculosis
VITRVRLRVHRIPESTRYEAWS

SEQ ID NO: 1513506 - protein, 17 aa, Mycobacterium tuberculosis
VLVCPYHHRAHHRGLIT

SEQ ID NO: 1513507 - protein, 22 aa, Mycobacterium tuberculosis
VLVPGYLYHYSLDAGQAGRELF

SEQ ID NO: 1513508 - protein, 21 aa, Mycobacterium tuberculosis
VPAVVKLHRWLTESLDHLHAS

SEQ ID NO: 1513509 - protein, 20 aa, Mycobacterium tuberculosis
VPHSWNLPPAVRQVAAMFPG

SEQ ID NO: 1513510 - protein, 23 aa, Mycobacterium tuberculosis
VRITLPAKHIPYTGGYRAVMPGA

SEQ ID NO: 1513511 - protein, 20 aa, Mycobacterium tuberculosis
VRSTPGLRYRIYRPAVVVGD

SEQ ID NO: 1513512 - protein, 25 aa, Mycobacterium tuberculosis
VTIPGFAINPFGLNVPLSGGTSPVT

SEQ ID NO: 1513513 - protein, 17 aa, Mycobacterium tuberculosis
VVGLDNTVTYKNGDPTI

SEQ ID NO: 1513514 - protein, 31 aa, Mycobacterium tuberculosis; identical to SEQ ID NO: 227128

SEQ ID NO: 1513515 - protein, 17 aa, Mycobacterium tuberculosis
VWQFIAPTFAAYHEPGT

SEQ ID NO: 1513516 - protein, 17 aa, Mycobacterium tuberculosis
WALVRVGCAGQLVYSPA

SEQ ID NO: 1513517 - protein, 26 aa, Mycobacterium tuberculosis
WDEVFRELSIPYLPVRWSTDNPDSIV

SEQ ID NO: 1513518 - protein, 20 aa, Mycobacterium tuberculosis
WIDRTAQFASGAIVFSIGVL

SEQ ID NO: 1513519 - protein, 19 aa, Mycobacterium tuberculosis
WKDTAAPLWTFPRVAWERE

SEQ ID NO: 1513520 - protein, 18 aa, Mycobacterium tuberculosis
WPKVFRPPVIAATVTTPV

SEQ ID NO: 1513521 - protein, 27 aa, Mycobacterium tuberculosis
WQMSTIQLDFNFPERFGLEYTAADGTR

SEQ ID NO: 1513522 - protein, 19 aa, Mycobacterium tuberculosis
WTGDYHGLVGFSFSIDIAG

SEQ ID NO: 1513523 - protein, 18 aa, Mycobacterium tuberculosis
YIPIPDEFKSRLSTAVNA

SEQ ID NO: 1513524 - protein, 28 aa, Mycobacterium tuberculosis
AAAMAAAAAPYAGWLAAAAARAAGASAQ

SEQ ID NO: 1513525 - protein, 19 aa, Mycobacterium tuberculosis
AAAPYAGFLTTASAQAQLA

SEQ ID NO: 1513526 - protein, 17 aa, Mycobacterium tuberculosis
AAFGALVHRYTHSDDFL

SEQ ID NO: 1513527 - protein, 17 aa, Mycobacterium tuberculosis
AAIPRRRTDRRAYSCWP

SEQ ID NO: 1513528 - protein, 17 aa, Mycobacterium tuberculosis
AALKLVLEPIFETDFEP

SEQ ID NO: 1513529 - protein, 19 aa, Mycobacterium tuberculosis
ACQEFITALGRNFAVIYQQ

SEQ ID NO: 1513530 - protein, 23 aa, Mycobacterium tuberculosis
ADGVYAAWFTVLGHGPVTGTVVP

SEQ ID NO: 1513531 - protein, 27 aa, Mycobacterium tuberculosis
ADRDWLAFHASYPGNDPLRDARPIEQD

SEQ ID NO: 1513532 - protein, 20 aa, Mycobacterium tuberculosis
AEAMLLAGFVIPVRKKGVRA

SEQ ID NO: 1513533 - protein, 24 aa, Mycobacterium tuberculosis
AEPNQALGWLPMQDIDAAAEAAAQ

SEQ ID NO: 1513534 - protein, 24 aa, Mycobacterium tuberculosis
AESPVLIVDYRLIPKHSLGMALDD

SEQ ID NO: 1513535 - protein, 25 aa, Mycobacterium tuberculosis
AGGAGGFGAVLFGNGGAGGSGAPGG

SEQ ID NO: 1513536 - protein, 28 aa, Mycobacterium tuberculosis
AGSLNRPGYLRFDFNWQGPLTDDQRTQV

SEQ ID NO: 1513537 - protein, 17 aa, Mycobacterium tuberculosis
AHVFSALGVRVTLVIRG

SEQ ID NO: 1513538 - protein, 28 aa, Mycobacterium tuberculosis
AKVVDPSWFNWPALPVAMADTIVPDFPL

SEQ ID NO: 1513539 - protein, 20 aa, Mycobacterium tuberculosis
ALALYRSVGFQRVGLRRRYY

SEQ ID NO: 1513540 - protein, 18 aa, Mycobacterium tuberculosis
ALHHPCCGDLVYGADPKL

SEQ ID NO: 1513541 - protein, 21 aa, Mycobacterium tuberculosis
ALLAGCTIVLKPAAETPLTAN

SEQ ID NO: 1513542 - protein, 17 aa, Mycobacterium tuberculosis
ALVRKLGPDFLVELLEI

SEQ ID NO: 1513543 - protein, 26 aa, Mycobacterium tuberculosis
APHDELMHFVQKYGIAKWFNEIRGRT

SEQ ID NO: 1513544 - protein, 20 aa, Mycobacterium tuberculosis
APIVGYSPIIGEKPLRGMAD

SEQ ID NO: 1513545 - protein, 20 aa, Mycobacterium tuberculosis
AQFVAIAARYHIKPLFVLFD

SEQ ID NO: 1513546 - protein, 21 aa, Mycobacterium tuberculosis
AQPLIVAATLLAHQELARRCV

SEQ ID NO: 1513547 - protein, 17 aa, Mycobacterium tuberculosis
AQRIRENLLRRNAAVTG

SEQ ID NO: 1513548 - protein, 22 aa, Mycobacterium tuberculosis
ARGGRRLVIAMMYGLVKEGGPT

SEQ ID NO: 1513549 - protein, 25 aa, Mycobacterium tuberculosis
ARGKAIIILNPADPPMIMRDTIFCA

SEQ ID NO: 1513550 - protein, 24 aa, Mycobacterium tuberculosis
ARLAGIPYIAIANAYWSPYAQRRF

SEQ ID NO: 1513551 - protein, 26 aa, Mycobacterium tuberculosis
ARYHIKPLFVLFDSCWDPLPRPGRQR

SEQ ID NO: 1513552 - protein, 28 aa, Mycobacterium tuberculosis
ASQWDGGYVANYTITQFGRDFDDRLAVA

SEQ ID NO: 1513553 - protein, 31 aa, Mycobacterium tuberculosis
ATLERTGYSWGPLSLMLLATAIAQQGHIAES

SEQ ID NO: 1513554 - protein, 21 aa, Mycobacterium tuberculosis
AVCELMRIAWRTVGAIVARVW

SEQ ID NO: 1513555 - protein, 28 aa, Mycobacterium tuberculosis
AVIRTSVPPFTWWRGLRARELLENYFTA

SEQ ID NO: 1513556 - protein, 25 aa, Mycobacterium tuberculosis
AYAMEANWALLLLDDDGAGERARTA

SEQ ID NO: 1513557 - protein, 23 aa, Mycobacterium tuberculosis
AYEGKIDWAFGELLALGSLVAEG

SEQ ID NO: 1513558 - protein, 18 aa, Mycobacterium tuberculosis
CALANRLRITKPDAARRI

SEQ ID NO: 1513559 - protein, 33 aa, Mycobacterium tuberculosis
DCALMGAFPMRLILATMLVAGRLLATLMAAPSA

SEQ ID NO: 1513560 - protein, 23 aa, Mycobacterium tuberculosis
DDALTVLWHSITWQYLPADERAA

SEQ ID NO: 1513561 - protein, 22 aa, Mycobacterium tuberculosis
DDIFECAGFAVHFFRRELVARL

SEQ ID NO: 1513562 - protein, 18 aa, Mycobacterium tuberculosis
DDLCLPDMLLLLATDVAA

SEQ ID NO: 1513563 - protein, 24 aa, Mycobacterium tuberculosis
DELDFLRLAVFDALLVLQADTAPV

SEQ ID NO: 1513564 - protein, 23 aa, Mycobacterium tuberculosis
DGRAPVLRRWYPSTGGTWQAEAA

SEQ ID NO: 1513565 - protein, 31 aa, Mycobacterium tuberculosis
DIGPATIIPPIHIPSIPLGFAAIGHIGPISI

SEQ ID NO: 1513566 - protein, 19 aa, Mycobacterium tuberculosis
DLLPEAFAVAREAAWRVLD

SEQ ID NO: 1513567 - protein, 20 aa, Mycobacterium tuberculosis
DLLPEAFAVAREAAWRVLDQ

SEQ ID NO: 1513568 - protein, 20 aa, Mycobacterium tuberculosis
DLTQETFIRVFRSVQNYQPG

SEQ ID NO: 1513569 - protein, 30 aa, Mycobacterium tuberculosis; identical to SEQ ID NO: 164669

SEQ ID NO: 1513570 - protein, 20 aa, Mycobacterium tuberculosis
DRLLAEPTAWLFGPEAHGLS

SEQ ID NO: 1513571 - protein, 25 aa, Mycobacterium tuberculosis
DRQPDGRIPIWLPPAKRLPDGLASY

SEQ ID NO: 1513572 - protein, 34 aa, Mycobacterium tuberculosis; identical to SEQ ID NO: 217240

SEQ ID NO: 1513573 - protein, 23 aa, Mycobacterium tuberculosis
DVGDYVAYLLEPVSVWAPECSED

SEQ ID NO: 1513574 - protein, 22 aa, Mycobacterium tuberculosis
DVPLIGFAGAPFTLASYLVEGG

SEQ ID NO: 1513575 - protein, 19 aa, Mycobacterium tuberculosis
DVQRLPLNVTWVNLTTGKS

SEQ ID NO: 1513576 - protein, 19 aa, Mycobacterium tuberculosis
DWMVATTLLTGRRTWVPWT

SEQ ID NO: 1513577 - protein, 18 aa, Mycobacterium tuberculosis
DYLIRTLAAAPPLTDEQR

SEQ ID NO: 1513578 - protein, 28 aa, Mycobacterium tuberculosis
DYPKFLDRNLIGHVPLIGGGLSLLLSDG

SEQ ID NO: 1513579 - protein, 24 aa, Mycobacterium tuberculosis
EAFAAVALASIRELGLNPQIVNVN

SEQ ID NO: 1513580 - protein, 17 aa, Mycobacterium tuberculosis
EAMLLMRAGREYALKRA

SEQ ID NO: 1513581 - protein, 26 aa, Mycobacterium tuberculosis
EARLQRPLYVMPTKGIFTSSFGYRWG

SEQ ID NO: 1513582 - protein, 25 aa, Mycobacterium tuberculosis
EATTVGLFTYPVLQAADVLAYDTEL

SEQ ID NO: 1513583 - protein, 18 aa, Mycobacterium tuberculosis
EFCDIDHSAPWPLGPTHP

SEQ ID NO: 1513584 - protein, 17 aa, Mycobacterium tuberculosis
EFVIERLSLIPESKKAV

SEQ ID NO: 1513585 - protein, 19 aa, Mycobacterium tuberculosis
ELILSCGVALHHCVVALAS

SEQ ID NO: 1513586 - protein, 22 aa, Mycobacterium tuberculosis
ELTLAAPLVLPASGSVAVQVVV

SEQ ID NO: 1513587 - protein, 38 aa, Mycobacterium tuberculosis
EPIHILPDIPININETLYLGPLVVPPINVPAISLGVGI

SEQ ID NO: 1513588 - protein, 19 aa, Mycobacterium tuberculosis
EPIIARMLTAYGAGVDMVT

SEQ ID NO: 1513589 - protein, 22 aa, Mycobacterium tuberculosis
ESPVLIVDYRLIPKHSLGMALD

SEQ ID NO: 1513590 - protein, 18 aa, Mycobacterium tuberculosis
ESRFRGMCEARGLPAVRI

SEQ ID NO: 1513591 - protein, 17 aa, Mycobacterium tuberculosis
ETSWLDQPIPALDGHTP

SEQ ID NO: 1513592 - protein, 21 aa, Mycobacterium tuberculosis
EWVRLYPNRFAGLAAVDLDRP

SEQ ID NO: 1513593 - protein, 17 aa, Mycobacterium tuberculosis
FAAVRQFRASVCVLGPL

SEQ ID NO: 1513594 - protein, 18 aa, Mycobacterium tuberculosis
FARILRPGGLAGITDVTV

SEQ ID NO: 1513595 - protein, 18 aa, Mycobacterium tuberculosis
FDRLVYRKLRAALGGNCR

SEQ ID NO: 1513596 - protein, 19 aa, Mycobacterium tuberculosis
FLASVELLRHPELAGLPVI

SEQ ID NO: 1513597 - protein, 20 aa, Mycobacterium tuberculosis
FNTVRVFLHDLLWAQDAPGF

SEQ ID NO: 1513598 - protein, 21 aa, Mycobacterium tuberculosis
FPQIAQYYRRRFRHVLVDEYQ

SEQ ID NO: 1513599 - protein, 22 aa, Mycobacterium tuberculosis
FSTKMKLFGLPYRITSRVTALK

SEQ ID NO: 1513600 - protein, 36 aa, Mycobacterium tuberculosis; identical to SEQ ID NO: 218117

SEQ ID NO: 1513601 - protein, 17 aa, Mycobacterium tuberculosis
FTKLRIPGARVIPTIYF

SEQ ID NO: 1513602 - protein, 18 aa, Mycobacterium tuberculosis
FWAKLEGFNPGGMKDRPA

SEQ ID NO: 1513603 - protein, 24 aa, Mycobacterium tuberculosis
GAYPSTLGYKGFPKSCCTSLNEVI

SEQ ID NO: 1513604 - protein, 23 aa, Mycobacterium tuberculosis
GCAALIVALLGACPALRVLATSR

SEQ ID NO: 1513605 - protein, 17 aa, Mycobacterium tuberculosis
GCFLLHDNGIDGIVDPS

SEQ ID NO: 1513606 - protein, 18 aa, Mycobacterium tuberculosis
GCFLLHDNGIDGIVDPSN

SEQ ID NO: 1513607 - protein, 19 aa, Mycobacterium tuberculosis
GDNGYIPIPDEFKSRLSTA

SEQ ID NO: 1513608 - protein, 20 aa, Mycobacterium tuberculosis
GDRDIRLPFHKPVDDMTGLS

SEQ ID NO: 1513609 - protein, 21 aa, Mycobacterium tuberculosis
GEFDYNLQWKPVGGFPVTFGW

SEQ ID NO: 1513610 - protein, 32 aa, Mycobacterium tuberculosis
GGAEHAVLHLLYSRFWHKVLYDLGHVSSREPY

SEQ ID NO: 1513611 - protein, 25 aa, Mycobacterium tuberculosis
GGPYAHGWVTWFPPDAPPGTERFGP

SEQ ID NO: 1513612 - protein, 23 aa, Mycobacterium tuberculosis
GGQGAALIGLGAGGAGGAGGATV

SEQ ID NO: 1513613 - protein, 24 aa, Mycobacterium tuberculosis
GGRAVLVLSDWPAPQAPQSASGEM

SEQ ID NO: 1513614 - protein, 17 aa, Mycobacterium tuberculosis
GHDYTWFVLNAKIIEKE

SEQ ID NO: 1513615 - protein, 20 aa, Mycobacterium tuberculosis
GHFGGPSGWGGRYVPEALMA

SEQ ID NO: 1513616 - protein, 19 aa, Mycobacterium tuberculosis
GHTEWLPPPHLDHGQPRTN

SEQ ID NO: 1513617 - protein, 24 aa, Mycobacterium tuberculosis
GKKYGPIAALPKYDSAPANRYRLP

SEQ ID NO: 1513618 - protein, 24 aa, Mycobacterium tuberculosis
GLARARWGLLEPPEPWLPEAALAQ

SEQ ID NO: 1513619 - protein, 18 aa, Mycobacterium tuberculosis
GLMVAAASPYVAWMSVTA

SEQ ID NO: 1513620 - protein, 22 aa, Mycobacterium tuberculosis
GNNINVLAPFTPGTLFTISEIP

SEQ ID NO: 1513621 - protein, 23 aa, Mycobacterium tuberculosis
GPSHHGLWDLALLACVPGFQIAC

SEQ ID NO: 1513622 - protein, 24 aa, Mycobacterium tuberculosis
GQGGWPMTCFLTPNGRPFFCGTYY

SEQ ID NO: 1513623 - protein, 25 aa, Mycobacterium tuberculosis
GQLEIKTILHRLLRRYRLELSRPDY

SEQ ID NO: 1513624 - protein, 18 aa, Mycobacterium tuberculosis
GQLIVIGMQGGVKAELNL

SEQ ID NO: 1513625 - protein, 22 aa, Mycobacterium tuberculosis
GQPFGVYLHVPFCLTRCGYCDF

SEQ ID NO: 1513626 - protein, 22 aa, Mycobacterium tuberculosis
GSAPMLAASVAWDRLAAELAVA

SEQ ID NO: 1513627 - protein, 28 aa, Mycobacterium tuberculosis
GSQTEGMLSPWLQLPGAADQIAAWSKAA

SEQ ID NO: 1513628 - protein, 24 aa, Mycobacterium tuberculosis
GTGPALPTVWPGNAYPLGATYDGA

SEQ ID NO: 1513629 - protein, 26 aa, Mycobacterium tuberculosis
GTVGAFPFGFGWQQSPGFFNSTTTPS

SEQ ID NO: 1513630 - protein, 25 aa, Mycobacterium tuberculosis
GVDAINIPIIHIPATPGFGNSTGGL

SEQ ID NO: 1513631 - protein, 23 aa, Mycobacterium tuberculosis
GVKPGRSYTARQLLDGLLLVSGN

SEQ ID NO: 1513632 - protein, 18 aa, Mycobacterium tuberculosis
GVVARRVRKPVFASKPTG

SEQ ID NO: 1513633 - protein, 18 aa, Mycobacterium tuberculosis
HALGWLPIEEIDAAASDD

SEQ ID NO: 1513634 - protein, 17 aa, Mycobacterium tuberculosis
HFAGLVAAGLHPSPVPH

SEQ ID NO: 1513635 - protein, 17 aa, Mycobacterium tuberculosis
IAAVFPDGPQRYFDTIY

SEQ ID NO: 1513636 - protein, 29 aa, Mycobacterium tuberculosis
IAGAFGYWRESGRFIVFEAPAVVLATGGI

SEQ ID NO: 1513637 - protein, 26 aa, Mycobacterium tuberculosis
IARPDLQVVLLEPLLRRTEFLREMVT

SEQ ID NO: 1513638 - protein, 23 aa, Mycobacterium tuberculosis
IDPDHLRRILTAVLDNAITHGDG

SEQ ID NO: 1513639 - protein, 17 aa, Mycobacterium tuberculosis
IFIGECKVWSGPRTMDD

SEQ ID NO: 1513640 - protein, 22 aa, Mycobacterium tuberculosis
IGPVSLPIFGFGGAPGFGNDTT

SEQ ID NO: 1513641 - protein, 19 aa, Mycobacterium tuberculosis
INVPPITVPAIGLGINSTG

SEQ ID NO: 1513642 - protein, 19 aa, Mycobacterium tuberculosis
IPGFSIPEQPLPLAINVIG

SEQ ID NO: 1513643 - protein, 20 aa, Mycobacterium tuberculosis
IPHGLLFERFLNPERTSMPD

SEQ ID NO: 1513644 - protein, 18 aa, Mycobacterium tuberculosis
IPRHLNFHQLTPHASEAA

SEQ ID NO: 1513645 - protein, 17 aa, Mycobacterium tuberculosis
ISVKLIQPVAMDEGLRF

SEQ ID NO: 1513646 - protein, 18 aa, Mycobacterium tuberculosis
ITLFPGGLTFPATSLLNL

SEQ ID NO: 1513647 - protein, 28 aa, Mycobacterium tuberculosis
ITSGAGPVVIPLLDIPPAPGFGNSTTGP

SEQ ID NO: 1513648 - protein, 23 aa, Mycobacterium tuberculosis
ITSNPQILLANRAHRTLVRSRQT

SEQ ID NO: 1513649 - protein, 24 aa, Mycobacterium tuberculosis
IVSWNWTELPSALGVTNHLAFRAQ

SEQ ID NO: 1513650 - protein, 20 aa, Mycobacterium tuberculosis
KFEWLDNDVVQWVPDRFWPA

SEQ ID NO: 1513651 - protein, 21 aa, Mycobacterium tuberculosis
KFEWLDNDVVQWVPDRFWPAH

SEQ ID NO: 1513652 - protein, 24 aa, Mycobacterium tuberculosis
KQLDMRRMPWRLHVFTPVHDVPGV

SEQ ID NO: 1513653 - protein, 24 aa, Mycobacterium tuberculosis
KRLGLDRQWLHARSLAFAHPADGR

SEQ ID NO: 1513654 - protein, 24 aa, Mycobacterium tuberculosis
KVKSRTFHYPGGLVDFVKHINRTK

SEQ ID NO: 1513655 - protein, 18 aa, Mycobacterium tuberculosis
LAGELTWRVPPLSLTNDA

SEQ ID NO: 1513656 - protein, 22 aa, Mycobacterium tuberculosis
LAKPAGIYQLTDANWMAIMGDR

SEQ ID NO: 1513657 - protein, 24 aa, Mycobacterium tuberculosis
LAPKDLEKIIYFAAYVITSVDEEM

SEQ ID NO: 1513658 - protein, 18 aa, Mycobacterium tuberculosis
LARLLGLSRTAAAALAEE

SEQ ID NO: 1513659 - protein, 20 aa, Mycobacterium tuberculosis
LDACDRWSVGLSGGPDSLAL

SEQ ID NO: 1513660 - protein, 25 aa, Mycobacterium tuberculosis
LDGVRIFEQLAIADPVTAAFLSIHN

SEQ ID NO: 1513661 - protein, 19 aa, Mycobacterium tuberculosis
LEKIIYFAAYVITSVDEEM

SEQ ID NO: 1513662 - protein, 17 aa, Mycobacterium tuberculosis
LEQQLRCGLRRAVELAG

SEQ ID NO: 1513663 - protein, 24 aa, Mycobacterium tuberculosis
LGALHLDLRFVNGKSWLVFGPYAG

SEQ ID NO: 1513664 - protein, 19 aa, Mycobacterium tuberculosis
LGPRRALTGEPLAPQLTAT

SEQ ID NO: 1513665 - protein, 18 aa, Mycobacterium tuberculosis
LIRDVGIPGYLRATTGLA

SEQ ID NO: 1513666 - protein, 21 aa, Mycobacterium tuberculosis
LKLVLEPIFETDFEPVSYGFR

SEQ ID NO: 1513667 - protein, 23 aa, Mycobacterium tuberculosis
LLAPGHWPMMVFRIGHARAPSVR

SEQ ID NO: 1513668 - protein, 17 aa, Mycobacterium tuberculosis
LPELAVQMRRRLIETVT

SEQ ID NO: 1513669 - protein, 28 aa, Mycobacterium tuberculosis
LPPEINSALMFAGAGPGPMLAAASAWTG

SEQ ID NO: 1513670 - protein, 21 aa, Mycobacterium tuberculosis
LPQLVVHPYTLTGPIVIGSFF

SEQ ID NO: 1513671 - protein, 18 aa, Mycobacterium tuberculosis
LQAFPQIAQYYRRRFRHV

SEQ ID NO: 1513672 - protein, 23 aa, Mycobacterium tuberculosis
LSRRRLVRIPWDLDSYGIHPDDF

SEQ ID NO: 1513673 - protein, 23 aa, Mycobacterium tuberculosis
LSSSAWPWQPYLLSHHQGGIAVT

SEQ ID NO: 1513674 - protein, 27 aa, Mycobacterium tuberculosis
LTAGAVFERIWLRTTLLGAELQPFAAS

SEQ ID NO: 1513675 - protein, 21 aa, Mycobacterium tuberculosis
MAAQPFFDPSASFPPAPASAN

SEQ ID NO: 1513676 - protein, 20 aa, Mycobacterium tuberculosis
MDLDWRAVVGEAQFVELPTY

SEQ ID NO: 1513677 - protein, 18 aa, Mycobacterium tuberculosis
MFDPSAVFYMNKIAVGPD

SEQ ID NO: 1513678 - protein, 22 aa, Mycobacterium tuberculosis
MLVSSWQMPGGIYAPMMHPWST

SEQ ID NO: 1513679 - protein, 29 aa, Mycobacterium tuberculosis
MWFTEAHWPAFRHVDFLRALRDYSARHRR

SEQ ID NO: 1513680 - protein, 23 aa, Mycobacterium tuberculosis
NAGDYGFFWITAVTTDGSIVVAN

SEQ ID NO: 1513681 - protein, 22 aa, Mycobacterium tuberculosis
NFQLQHWTHHFDYALVCGGGDW

SEQ ID NO: 1513682 - protein, 21 aa, Mycobacterium tuberculosis
NFSNGILWRGNYEGLAGFSFG

SEQ ID NO: 1513683 - protein, 27 aa, Mycobacterium tuberculosis
NGGAGSLFNGAPGFGGPGGSGGASLLG

SEQ ID NO: 1513684 - protein, 17 aa, Mycobacterium tuberculosis
NLDKRIVRLPKTHIKAV

SEQ ID NO: 1513685 - protein, 18 aa, Mycobacterium tuberculosis
NLLVPLNFHLGYHGMPIG

SEQ ID NO: 1513686 - protein, 24 aa, Mycobacterium tuberculosis
NLTQFYHPLDMFGEWNRAYGPAGF

SEQ ID NO: 1513687 - protein, 24 aa, Mycobacterium tuberculosis
NSDGRLLELTLHPGVMTGYAHGEL

SEQ ID NO: 1513688 - protein, 17 aa, Mycobacterium tuberculosis
PDLLLAQALLRTQQIKL

SEQ ID NO: 1513689 - protein, 22 aa, Mycobacterium tuberculosis
PERERTVLVLRFFDSMTQTQIA

SEQ ID NO: 1513690 - protein, 19 aa, Mycobacterium tuberculosis
PEVAEVVAMLRLVADPTAG

SEQ ID NO: 1513691 - protein, 20 aa, Mycobacterium tuberculosis
PEVAEVVAMLRLVADPTAGA

SEQ ID NO: 1513692 - protein, 27 aa, Mycobacterium tuberculosis
PGAAALAFPSLSSSVPILGPYEDLIAN

SEQ ID NO: 1513693 - protein, 22 aa, Mycobacterium tuberculosis
PINVPPITVPAIGLGVSSSGAL

SEQ ID NO: 1513694 - protein, 19 aa, Mycobacterium tuberculosis
PIPGRLFAGPGLSQPSDVL

SEQ ID NO: 1513695 - protein, 24 aa, Mycobacterium tuberculosis
PKEHFDFFPLTVDVEERMYAAGRI

SEQ ID NO: 1513696 - protein, 19 aa, Mycobacterium tuberculosis
PPSALLEALMRHYERTRSP

SEQ ID NO: 1513697 - protein, 26 aa, Mycobacterium tuberculosis
PQEPPPDPVPFPPYQPKVWAACRARG

SEQ ID NO: 1513698 - protein, 28 aa, Mycobacterium tuberculosis
PRRAVLVRPPRGLTATGLAALLRSMRSP

SEQ ID NO: 1513699 - protein, 17 aa, Mycobacterium tuberculosis
PRRPTLVPVEAIEFLRG

SEQ ID NO: 1513700 - protein, 20 aa, Mycobacterium tuberculosis
PTGLLDHLAALFGAPKTALL

SEQ ID NO: 1513701 - protein, 20 aa, Mycobacterium tuberculosis
QANYAGRPSPLYEATRLSQH

SEQ ID NO: 1513702 - protein, 18 aa, Mycobacterium tuberculosis
QDPEALRRRTLITAAQYL

SEQ ID NO: 1513703 - protein, 17 aa, Mycobacterium tuberculosis
QECERLGLPVFVKPARG

SEQ ID NO: 1513704 - protein, 34 aa, Mycobacterium tuberculosis; identical to SEQ ID NO: 849837

SEQ ID NO: 1513705 - protein, 26 aa, Mycobacterium tuberculosis
QSDAVVVAMWLWRTLCESDTPNKLRA

SEQ ID NO: 1513706 - protein, 21 aa, Mycobacterium tuberculosis
QYNTYLKQYLALYTNGMNDVV

SEQ ID NO: 1513707 - protein, 19 aa, Mycobacterium tuberculosis
RALMHAWVGYLERDVFPGG

SEQ ID NO: 1513708 - protein, 17 aa, Mycobacterium tuberculosis
RAPHLGFHIDFDDAKIS

SEQ ID NO: 1513709 - protein, 24 aa, Mycobacterium tuberculosis
RAPPKVWFHDLLHPNGRPYRDGEV

SEQ ID NO: 1513710 - protein, 25 aa, Mycobacterium tuberculosis
RDGWVRLHWEFACLRYGAAGVRTCE

SEQ ID NO: 1513711 - protein, 27 aa, Mycobacterium tuberculosis
RDIQVRGYTLRLPLDVLVVASANPEDY

SEQ ID NO: 1513712 - protein, 22 aa, Mycobacterium tuberculosis
REAFAWHIDLAKRTGKPLMIHN

SEQ ID NO: 1513713 - protein, 21 aa, Mycobacterium tuberculosis
RENLLIVHWHDLGRYLGVYHH

SEQ ID NO: 1513714 - protein, 17 aa, Mycobacterium tuberculosis
RGFYDRSLRCRDPHARL

SEQ ID NO: 1513715 - protein, 17 aa, Mycobacterium tuberculosis
RGRLMQALPAGGAMFAV

SEQ ID NO: 1513716 - protein, 20 aa, Mycobacterium tuberculosis
RISNFPPKRHKTRVLAAAED

SEQ ID NO: 1513717 - protein, 30 aa, Mycobacterium tuberculosis
RKNERYKLVWKNRLGFARLAIQHGYPIVPF

SEQ ID NO: 1513718 - protein, 21 aa, Mycobacterium tuberculosis
RLASTIRKPPIEHAAGPLGST

SEQ ID NO: 1513719 - protein, 20 aa, Mycobacterium tuberculosis
RLNVYVPDELAERARARGLN

SEQ ID NO: 1513720 - protein, 19 aa, Mycobacterium tuberculosis
RLQVWRTRATTARECSIRV

SEQ ID NO: 1513721 - protein, 22 aa, Mycobacterium tuberculosis
RNPRSLRVCTLLRKPDAVHANV

SEQ ID NO: 1513722 - protein, 18 aa, Mycobacterium tuberculosis
RNTHGVSWLPLYHDMGLS

SEQ ID NO: 1513723 - protein, 19 aa, Mycobacterium tuberculosis
RPIGALLMDQTVIAGVGNV

SEQ ID NO: 1513724 - protein, 27 aa, Mycobacterium tuberculosis
RRAAPLLPTVLLGKTPRYLTSSAATAV

SEQ ID NO: 1513725 - protein, 19 aa, Mycobacterium tuberculosis
RRIGWLVQLPVKGTWAFIP

SEQ ID NO: 1513726 - protein, 23 aa, Mycobacterium tuberculosis
RSAAYAMRWVAKNVVAAGLAERV

SEQ ID NO: 1513727 - protein, 19 aa, Mycobacterium tuberculosis
RSDRALVESLQTVLRDATL

SEQ ID NO: 1513728 - protein, 20 aa, Mycobacterium tuberculosis
RSRHTIIYLPDPTVGVQGIH

SEQ ID NO: 1513729 - protein, 28 aa, Mycobacterium tuberculosis
RSRLTADGIWLHCLYALSGINLRESVRA

SEQ ID NO: 1513730 - protein, 17 aa, Mycobacterium tuberculosis
RSYFWVAKTTAADGLGY

SEQ ID NO: 1513731 - protein, 26 aa, Mycobacterium tuberculosis
RSYPRSALSTYLVFDALIAHGDRHDR

SEQ ID NO: 1513732 - protein, 23 aa, Mycobacterium tuberculosis
RVTAPAHWKVISNGAPLAAANGV

SEQ ID NO: 1513733 - protein, 17 aa, Mycobacterium tuberculosis
RYLVYTSADIRALYAFK

SEQ ID NO: 1513734 - protein, 25 aa, Mycobacterium tuberculosis
SAAAYVAAHAPYLAWLMRASETSAE

SEQ ID NO: 1513735 - protein, 23 aa, Mycobacterium tuberculosis
SADFINLELIDSPTLPTCERIAV

SEQ ID NO: 1513736 - protein, 19 aa, Mycobacterium tuberculosis
SAHTRCWFIDADWTPLLAA

SEQ ID NO: 1513737 - protein, 21 aa, Mycobacterium tuberculosis
SASRLIPFAAPPKTTNSAGVV

SEQ ID NO: 1513738 - protein, 17 aa, Mycobacterium tuberculosis
SDLDLSMFALCSSIAAT

SEQ ID NO: 1513739 - protein, 18 aa, Mycobacterium tuberculosis
SDLDLSMFALCSSIAATV

SEQ ID NO: 1513740 - protein, 25 aa, Mycobacterium tuberculosis
SFSAAAVWRIRRAAPLLPTVLLGKT

SEQ ID NO: 1513741 - protein, 24 aa, Mycobacterium tuberculosis
SGVNLVMQRWVYHSTRLAVPTHTY

SEQ ID NO: 1513742 - protein, 20 aa, Mycobacterium tuberculosis
SIGAPPIVIGPLYAEKTIQL

SEQ ID NO: 1513743 - protein, 25 aa, Mycobacterium tuberculosis
SIGPIKINPITLWPAQNFNQTITLA

SEQ ID NO: 1513744 - protein, 30 aa, Mycobacterium tuberculosis
SLEVEAWMRPMFRGLRHWRVLRLLRTVGMH

SEQ ID NO: 1513745 - protein, 20 aa, Mycobacterium tuberculosis
SQDEIVWAKEFFAEFARDGG

SEQ ID NO: 1513746 - protein, 20 aa, Mycobacterium tuberculosis
SSWPNLDYPGLHALSTVPQC

SEQ ID NO: 1513747 - protein, 17 aa, Mycobacterium tuberculosis
SVDYAVRITSRGLYVHS

SEQ ID NO: 1513748 - protein, 18 aa, Mycobacterium tuberculosis
SVDYAVRITSRGLYVHSA

SEQ ID NO: 1513749 - protein, 17 aa, Mycobacterium tuberculosis
SVFHFRELTIGQVKAAL

SEQ ID NO: 1513750 - protein, 22 aa, Mycobacterium tuberculosis
SVPAFSLPAITLPSLTIPAATT

SEQ ID NO: 1513751 - protein, 24 aa, Mycobacterium tuberculosis
SYGITIPQFPIRITTTGGIGPIVI

SEQ ID NO: 1513752 - protein, 24 aa, Mycobacterium tuberculosis
TAGGDLPLPLRWGEYRAGGLARAR

SEQ ID NO: 1513753 - protein, 20 aa, Mycobacterium tuberculosis
TDQLPLVRALVDMAGLPPQA

SEQ ID NO: 1513754 - protein, 20 aa, Mycobacterium tuberculosis
TFIGAPAMNLIDAAVAHGVV

SEQ ID NO: 1513755 - protein, 30 aa, Mycobacterium tuberculosis
TFIKAGDPNNLLWRAFRPGTHVPIIDYTVP

SEQ ID NO: 1513756 - protein, 29 aa, Mycobacterium tuberculosis
TGPEQVLFRRLAVFPSGFDLDGAQAAAAG

SEQ ID NO: 1513757 - protein, 23 aa, Mycobacterium tuberculosis
TIDAPIGRHRGHEWKFAITKNGR

SEQ ID NO: 1513758 - protein, 21 aa, Mycobacterium tuberculosis
TIGAGLALALVLDGCGKRVEV

SEQ ID NO: 1513759 - protein, 18 aa, Mycobacterium tuberculosis
TITLAWPVSSITIPQIQQ

SEQ ID NO: 1513760 - protein, 23 aa, Mycobacterium tuberculosis
TITRSVLIARLFVGAVPALARDG

SEQ ID NO: 1513761 - protein, 19 aa, Mycobacterium tuberculosis
TKKLLAADGLPVGAYAVLR

SEQ ID NO: 1513762 - protein, 19 aa, Mycobacterium tuberculosis
TLHSVKVIPSRGAWLEFDV

SEQ ID NO: 1513763 - protein, 17 aa, Mycobacterium tuberculosis
TLRERYPQWDRFAAVRD

SEQ ID NO: 1513764 - protein, 28 aa, Mycobacterium tuberculosis
TMAPVQRTWPELIPLLQSGRLDVDGIFT

SEQ ID NO: 1513765 - protein, 31 aa, Mycobacterium tuberculosis
TPERLRSLERLECLARRLPAAQHTLINQLDT

SEQ ID NO: 1513766 - protein, 24 aa, Mycobacterium tuberculosis
TSSPPPGPVLYRTKHTRVEIADEM

SEQ ID NO: 1513767 - protein, 34 aa, Mycobacterium tuberculosis; identical to SEQ ID NO: 223714

SEQ ID NO: 1513768 - protein, 38 aa, Mycobacterium tuberculosis
TVPGVPISRIPLTINIRIPVNITLNELPFNVAGIFTGY

SEQ ID NO: 1513769 - protein, 18 aa, Mycobacterium tuberculosis
VAVAVLRRLAPRARITGG

SEQ ID NO: 1513770 - protein, 23 aa, Mycobacterium tuberculosis
VEDSQLWLLQTRGAERSAQAAVR

SEQ ID NO: 1513771 - protein, 17 aa, Mycobacterium tuberculosis
VHFAALHHPCCGDLVYG

SEQ ID NO: 1513772 - protein, 17 aa, Mycobacterium tuberculosis
VIGPLYAEKTIQLCAPG

SEQ ID NO: 1513773 - protein, 28 aa, Mycobacterium tuberculosis
VKDGYGRNFLLPRGLAIVASRGAQKQAD

SEQ ID NO: 1513774 - protein, 27 aa, Mycobacterium tuberculosis
VPQAGLLLVHHPLLLRGVDTVAANTPK

SEQ ID NO: 1513775 - protein, 21 aa, Mycobacterium tuberculosis
VRSTPGLRYRIYRPAVVVGDS

SEQ ID NO: 1513776 - protein, 22 aa, Mycobacterium tuberculosis
VRVIRTLRRLGIRSVAVYSDPD

SEQ ID NO: 1513777 - protein, 17 aa, Mycobacterium tuberculosis
VSSWLHRIVVNACLDRL

SEQ ID NO: 1513778 - protein, 19 aa, Mycobacterium tuberculosis
VVLVATGASPRILPSAQPD

SEQ ID NO: 1513779 - protein, 17 aa, Mycobacterium tuberculosis
VWGSIYRFEGQASVFWE

SEQ ID NO: 1513780 - protein, 29 aa, Mycobacterium tuberculosis
WADSPRAWPIRAPSRLQVWRTRATTAREC

SEQ ID NO: 1513781 - protein, 17 aa, Mycobacterium tuberculosis
WAPSLRPEAGAVLNIAE

SEQ ID NO: 1513782 - protein, 19 aa, Mycobacterium tuberculosis
WFIDADWTPLLAAELRYHG

SEQ ID NO: 1513783 - protein, 17 aa, Mycobacterium tuberculosis
WLGMGIELLDTAPAFAQ

SEQ ID NO: 1513784 - protein, 17 aa, Mycobacterium tuberculosis
WLLAQPDKPDLVFEATS

SEQ ID NO: 1513785 - protein, 24 aa, Mycobacterium tuberculosis
WSADRAHRWYQAHGWLVGANYITS

SEQ ID NO: 1513786 - protein, 25 aa, Mycobacterium tuberculosis
WVGYLERDVFPGGCFFAAAAADVDS

SEQ ID NO: 1513787 - protein, 17 aa, Mycobacterium tuberculosis
YCVMAPDAVRIARDAGR

SEQ ID NO: 1513788 - protein, 24 aa, Mycobacterium tuberculosis
YDAGTGIALIIRPPTRRAMAPRVY

SEQ ID NO: 1513789 - protein, 24 aa, Mycobacterium tuberculosis
YHERANDILIRISGVEPTTGTVLD

SEQ ID NO: 1513790 - protein, 20 aa, Mycobacterium tuberculosis
YRGAYLEQLLGGLLADLGVH

SEQ ID NO: 1513791 - protein, 17 aa, Mycobacterium tuberculosis
YVNQRWLGGMLTNFSTV

SEQ ID NO: 1513792 - protein, 26 aa, Mycobacterium tuberculosis
YYTRQDIPIHYLLADAFTVCDRYFCS

SEQ ID NO: 1513793 - protein, 30 aa, Mycobacterium tuberculosis; identical to SEQ ID NO: 215432

SEQ ID NO: 1513794 - protein, 27 aa, Mycobacterium tuberculosis
AAELTIDALINRVVPIPGLRSTEAQWA

SEQ ID NO: 1513795 - protein, 17 aa, Mycobacterium tuberculosis
AAKIPIVPIVIRNAEIV

SEQ ID NO: 1513796 - protein, 20 aa, Mycobacterium tuberculosis
AATVDPFVIAANRSRLVSLA

SEQ ID NO: 1513797 - protein, 20 aa, Mycobacterium tuberculosis
AAVILDSDPWRKLSANRDNR

SEQ ID NO: 1513798 - protein, 23 aa, Mycobacterium tuberculosis
AAWRAHRAYLVDLAFRMVGDIGV

SEQ ID NO: 1513799 - protein, 18 aa, Mycobacterium tuberculosis
ADATRVQVLWSLADREMS

SEQ ID NO: 1513800 - protein, 22 aa, Mycobacterium tuberculosis
AFEHFPPPILKPVILAAKSATL

SEQ ID NO: 1513801 - protein, 26 aa, Mycobacterium tuberculosis
AFVNALPVFIASDPVWAKKFTDAGVP

SEQ ID NO: 1513802 - protein, 27 aa, Mycobacterium tuberculosis
AGAHLRNMAFYNFGLRLLKRARDADRA

SEQ ID NO: 1513803 - protein, 26 aa, Mycobacterium tuberculosis
AGGDAPLIGWGGNGGPGGFAAFGNGG

SEQ ID NO: 1513804 - protein, 25 aa, Mycobacterium tuberculosis
AHSISPWGTWEWIGPPALGAVLPAR

SEQ ID NO: 1513805 - protein, 30 aa, Mycobacterium tuberculosis; identical to SEQ ID NO: 124058

SEQ ID NO: 1513806 - protein, 26 aa, Mycobacterium tuberculosis
ALARALPLSMSLLGVQFVMGTAAAHA

SEQ ID NO: 1513807 - protein, 25 aa, Mycobacterium tuberculosis
ALGGKGGSGGLIGRAGSDGGVGAGG

SEQ ID NO: 1513808 - protein, 17 aa, Mycobacterium tuberculosis
AMIAAVLEKHARLAIAV

SEQ ID NO: 1513809 - protein, 38 aa, Mycobacterium tuberculosis
AMLFDGRSGEPFPYPVTVGYMYIMKLHHLVDDKIHARS

SEQ ID NO: 1513810 - protein, 27 aa, Mycobacterium tuberculosis
ANHTTGWVRMDFVVPSRGLIGWRTDFL

SEQ ID NO: 1513811 - protein, 23 aa, Mycobacterium tuberculosis
ANNRAALIGYLPTGYPDVPASVA

SEQ ID NO: 1513812 - protein, 32 aa, Mycobacterium tuberculosis
APRYAELIKRTQWWGRQMLIWGVHVHVGIRSA

SEQ ID NO: 1513813 - protein, 27 aa, Mycobacterium tuberculosis
AQAPDGLSCFLLPRVLPDGTRNRMFLQ

SEQ ID NO: 1513814 - protein, 25 aa, Mycobacterium tuberculosis
AQGIPPQFLVDILTNLRTDRLVRSH

SEQ ID NO: 1513815 - protein, 19 aa, Mycobacterium tuberculosis
AREDTVVFPALRDVMSAVE

SEQ ID NO: 1513816 - protein, 23 aa, Mycobacterium tuberculosis
ASPLAIGLFGVNPTVGSIGPGSI

SEQ ID NO: 1513817 - protein, 25 aa, Mycobacterium tuberculosis
ASRDLQPWLAVPDRLLPLPADLAGE

SEQ ID NO: 1513818 - protein, 19 aa, Mycobacterium tuberculosis
ASRVRKAPGFALLGEKGQS

SEQ ID NO: 1513819 - protein, 17 aa, Mycobacterium tuberculosis
ASWIARLLRAPVRRARR

SEQ ID NO: 1513820 - protein, 27 aa, Mycobacterium tuberculosis
ATDTGSFRWASVRGYRLAARLVEIGVD

SEQ ID NO: 1513821 - protein, 19 aa, Mycobacterium tuberculosis
AVEHRVEYGVWAGIKLPGG

SEQ ID NO: 1513822 - protein, 18 aa, Mycobacterium tuberculosis
AYAVLRKAAQRAGDALPR

SEQ ID NO: 1513823 - protein, 17 aa, Mycobacterium tuberculosis
CALANRLRITKPEAGRR

SEQ ID NO: 1513824 - protein, 23 aa, Mycobacterium tuberculosis
CALDLQRTSLAPIRLRIGLHTGE

SEQ ID NO: 1513825 - protein, 17 aa, Mycobacterium tuberculosis
CALLSDWLPATTGDIIY

SEQ ID NO: 1513826 - protein, 24 aa, Mycobacterium tuberculosis
CCLPPNLRRPLRRTARRGPPTRGL

SEQ ID NO: 1513827 - protein, 24 aa, Mycobacterium tuberculosis
CCRGPYCVYAYDALGLLRPNGFSA

SEQ ID NO: 1513828 - protein, 22 aa, Mycobacterium tuberculosis
CERLGLPVFVKPARGGSSIGVS

SEQ ID NO: 1513829 - protein, 21 aa, Mycobacterium tuberculosis
CFSLFDVYTDIAFPGGIHAAW

SEQ ID NO: 1513830 - protein, 30 aa, Mycobacterium tuberculosis; identical to SEQ ID NO: 226013

SEQ ID NO: 1513831 - protein, 19 aa, Mycobacterium tuberculosis
CHRLDGIPLAIELAASRVR

SEQ ID NO: 1513832 - protein, 22 aa, Mycobacterium tuberculosis
CPLWNVYETFANPGKILVQIAQ

SEQ ID NO: 1513833 - protein, 25 aa, Mycobacterium tuberculosis
CSSSLVAIHWAMSSLRSGECDLALA

SEQ ID NO: 1513834 - protein, 18 aa, Mycobacterium tuberculosis
DALIELCGLLGYDARRDT

SEQ ID NO: 1513835 - protein, 19 aa, Mycobacterium tuberculosis
DAMFPARAFDALAAWVRAA

SEQ ID NO: 1513836 - protein, 18 aa, Mycobacterium tuberculosis
DDGMLEWRLAGLPVDEGA

SEQ ID NO: 1513837 - protein, 21 aa, Mycobacterium tuberculosis
DDLITAHLRGWTLDRLPAVDR

SEQ ID NO: 1513838 - protein, 23 aa, Mycobacterium tuberculosis
DDPYLQVVLQRRLPVVVVDQPKD

SEQ ID NO: 1513839 - protein, 19 aa, Mycobacterium tuberculosis
DEVLLRVFGKVVELAFLAV

SEQ ID NO: 1513840 - protein, 17 aa, Mycobacterium tuberculosis
DGARVVGIAGGPEKCAL

SEQ ID NO: 1513841 - protein, 28 aa, Mycobacterium tuberculosis
DGLDYAVIKFDPAKVTPVAVFNGFAING

SEQ ID NO: 1513842 - protein, 18 aa, Mycobacterium tuberculosis
DGLTFPKIPVHVDAFAGI

SEQ ID NO: 1513843 - protein, 17 aa, Mycobacterium tuberculosis
DGMLEWRLAGLPVDEGA

SEQ ID NO: 1513844 - protein, 26 aa, Mycobacterium tuberculosis
DGSDTVTLVWLGQRRIPGIDTGRTLR

SEQ ID NO: 1513845 - protein, 19 aa, Mycobacterium tuberculosis
DHLHAVVGEWQLLADLSFA

SEQ ID NO: 1513846 - protein, 26 aa, Mycobacterium tuberculosis
DIHETMVIPPIVFLPSMTIGGQTYTI

SEQ ID NO: 1513847 - protein, 19 aa, Mycobacterium tuberculosis
DIPRVPVTLNYLFGSQPGG

SEQ ID NO: 1513848 - protein, 17 aa, Mycobacterium tuberculosis
DLKPGMTLLDIGCGWGT

SEQ ID NO: 1513849 - protein, 17 aa, Mycobacterium tuberculosis
DLPATSIAWGAWGQIGR

SEQ ID NO: 1513850 - protein, 18 aa, Mycobacterium tuberculosis
DLSGPARWFLDHARVALS

SEQ ID NO: 1513851 - protein, 22 aa, Mycobacterium tuberculosis
DLVVALERLGRWCVPGPVTESI

SEQ ID NO: 1513852 - protein, 30 aa, Mycobacterium tuberculosis
DNGLDGAYLLVWTTTPWTLPSNLAVAVSPD

SEQ ID NO: 1513853 - protein, 21 aa, Mycobacterium tuberculosis
DNKAPLTDRLFPIGCQAAPRS

SEQ ID NO: 1513854 - protein, 22 aa, Mycobacterium tuberculosis
DPFSLTLLGFINVNVPAIQTAP

SEQ ID NO: 1513855 - protein, 23 aa, Mycobacterium tuberculosis
DPFSLTLLGFINVNVPAIQTAPS

SEQ ID NO: 1513856 - protein, 18 aa, Mycobacterium tuberculosis
DPIEQWLAAKKAASDAIM

SEQ ID NO: 1513857 - protein, 18 aa, Mycobacterium tuberculosis
DQWALRRHDFDLRTAAAA

SEQ ID NO: 1513858 - protein, 22 aa, Mycobacterium tuberculosis
DRHLRYPLRDVIWGHDQDLLNT

SEQ ID NO: 1513859 - protein, 20 aa, Mycobacterium tuberculosis
DRVVLVLLDRAGSSAVVGAV

SEQ ID NO: 1513860 - protein, 20 aa, Mycobacterium tuberculosis
DTPKYFHYVKKDKIAESAVM

SEQ ID NO: 1513861 - protein, 22 aa, Mycobacterium tuberculosis
DVGDYVAYLLEPVSVWAPECSE

SEQ ID NO: 1513862 - protein, 18 aa, Mycobacterium tuberculosis
DVLASFRYLAQGHHRASD

SEQ ID NO: 1513863 - protein, 19 aa, Mycobacterium tuberculosis
DVLVAAAADLEGIGSALAA

SEQ ID NO: 1513864 - protein, 20 aa, Mycobacterium tuberculosis
DVVYDPWIDQRPLRIYSAEQ

SEQ ID NO: 1513865 - protein, 42 aa, Mycobacterium tuberculosis
DWSPKVFGSWNLHRATLGQPLDWFCLFSSGAALLGSPGQGAY

SEQ ID NO: 1513866 - protein, 17 aa, Mycobacterium tuberculosis
EAATFGVAYLTAWHSLC

SEQ ID NO: 1513867 - protein, 22 aa, Mycobacterium tuberculosis
EDSQLWLLQTRGAERSAQAAVR

SEQ ID NO: 1513868 - protein, 18 aa, Mycobacterium tuberculosis
EFYAGLLGAYPLVSIEDP

SEQ ID NO: 1513869 - protein, 26 aa, Mycobacterium tuberculosis
EIMTELEIAPTRRLRGLGDRQRKALL

SEQ ID NO: 1513870 - protein, 22 aa, Mycobacterium tuberculosis
ELERRNARRALITLCIGGGMGV

SEQ ID NO: 1513871 - protein, 22 aa, Mycobacterium tuberculosis
EPKVPRAARVAVRWLRAVALDR

SEQ ID NO: 1513872 - protein, 23 aa, Mycobacterium tuberculosis
EQALRGLLKPIYEENQLGRAEIR

SEQ ID NO: 1513873 - protein, 21 aa, Mycobacterium tuberculosis
ERPHMYRLMFGSTSAHGINVP

SEQ ID NO: 1513874 - protein, 18 aa, Mycobacterium tuberculosis
ESFKVLLKELQSLCLNVE

SEQ ID NO: 1513875 - protein, 22 aa, Mycobacterium tuberculosis
ETARMHLLRLASEFGLTPAAEQ

SEQ ID NO: 1513876 - protein, 22 aa, Mycobacterium tuberculosis
EWVRLYPNRFAGLAAVDLDRPM

SEQ ID NO: 1513877 - protein, 23 aa, Mycobacterium tuberculosis
EYLRELTIWSGRYGSVAGVPARN

SEQ ID NO: 1513878 - protein, 17 aa, Mycobacterium tuberculosis
FDTAMIVDEPFLAPARI

SEQ ID NO: 1513879 - protein, 19 aa, Mycobacterium tuberculosis
FGFSIPQLGFTLSGATPAD

SEQ ID NO: 1513880 - protein, 35 aa, Mycobacterium tuberculosis; identical to SEQ ID NO: 225023

SEQ ID NO: 1513881 - protein, 19 aa, Mycobacterium tuberculosis
FPNGYTIDPIPLQLNLDLT

SEQ ID NO: 1513882 - protein, 25 aa, Mycobacterium tuberculosis
FSDNLPSCITKYIPLHTPAVVMSIN

SEQ ID NO: 1513883 - protein, 22 aa, Mycobacterium tuberculosis
FSPPPPRYTTGVLSKYVKLVSS

SEQ ID NO: 1513884 - protein, 24 aa, Mycobacterium tuberculosis
FSTKMKLFGLPYRITSRVTALKPN

SEQ ID NO: 1513885 - protein, 29 aa, Mycobacterium tuberculosis
FTLTVGLMLPRRAFLPPPHVDSAVLVVRR

SEQ ID NO: 1513886 - protein, 18 aa, Mycobacterium tuberculosis
FTVPDIPIPAIHIGINGV

SEQ ID NO: 1513887 - protein, 17 aa, Mycobacterium tuberculosis
FVAGLSQGTLVLDREQA

SEQ ID NO: 1513888 - protein, 22 aa, Mycobacterium tuberculosis
GAYLIDQPLMRNVLADLAVEAE

SEQ ID NO: 1513889 - protein, 19 aa, Mycobacterium tuberculosis
GDAVSLRRILNTPRRGIGD

SEQ ID NO: 1513890 - protein, 21 aa, Mycobacterium tuberculosis
GDGIALGLWAGVAVSDLEFIQ

SEQ ID NO: 1513891 - protein, 32 aa, Mycobacterium tuberculosis; identical to SEQ ID NO: 215217

SEQ ID NO: 1513892 - protein, 27 aa, Mycobacterium tuberculosis
GETRFALVLSRLFWDAAIFHRACEAVM

SEQ ID NO: 1513893 - protein, 19 aa, Mycobacterium tuberculosis
GFEMQFGTNHLGHFALTGL

SEQ ID NO: 1513894 - protein, 18 aa, Mycobacterium tuberculosis
GFKDARPDRLPLSASVWD

SEQ ID NO: 1513895 - protein, 32 aa, Mycobacterium tuberculosis
GGGGTATFHEDPVAGVWAVGGVGGDGGSGGSS

SEQ ID NO: 1513896 - protein, 23 aa, Mycobacterium tuberculosis
GGKGGASGMLIGNGGNGGSGGVG

SEQ ID NO: 1513897 - protein, 21 aa, Mycobacterium tuberculosis
GGNAGLWGNGGAGGAGAAGAA

SEQ ID NO: 1513898 - protein, 23 aa, Mycobacterium tuberculosis
GGSAGLIGIGGTGGAGGAGAVGG

SEQ ID NO: 1513899 - protein, 25 aa, Mycobacterium tuberculosis
GGVGGNGGWLYGNGGAGGLGGTGVA

SEQ ID NO: 1513900 - protein, 21 aa, Mycobacterium tuberculosis
GHDYTWFVLNAKIIEKEFALS

SEQ ID NO: 1513901 - protein, 26 aa, Mycobacterium tuberculosis
GHPESRYPSLAPGWHPDPEAAMRIRC

SEQ ID NO: 1513902 - protein, 25 aa, Mycobacterium tuberculosis
GIQCFLRDLPATWPPFIRPGVVTTH

SEQ ID NO: 1513903 - protein, 18 aa, Mycobacterium tuberculosis
GISSRLLRTLLAPNSGLV

SEQ ID NO: 1513904 - protein, 18 aa, Mycobacterium tuberculosis
GKITYRIKLEVSFKMRPA

SEQ ID NO: 1513905 - protein, 24 aa, Mycobacterium tuberculosis
GLDALGFAGTIPKSAPGSATGLTH

SEQ ID NO: 1513906 - protein, 18 aa, Mycobacterium tuberculosis
GNWHMLIVTSIGTDARTR

SEQ ID NO: 1513907 - protein, 18 aa, Mycobacterium tuberculosis
GPESWGFTGWRWFSGTAP

SEQ ID NO: 1513908 - protein, 23 aa, Mycobacterium tuberculosis
GQAGGNGGWLWGNGGNGGSGAPG

SEQ ID NO: 1513909 - protein, 24 aa, Mycobacterium tuberculosis
GQAGGPGGLLYGNGGNGGSGGVGQ

SEQ ID NO: 1513910 - protein, 30 aa, Mycobacterium tuberculosis
GRNVGEIELLPITKFFPATDVAILFRLGCR

SEQ ID NO: 1513911 - protein, 21 aa, Mycobacterium tuberculosis
GSVCWYAPELGPGTGTVFSGD

SEQ ID NO: 1513912 - protein, 25 aa, Mycobacterium tuberculosis
GSVLAALGRIDYWFVTDGRRVHKTV

SEQ ID NO: 1513913 - protein, 23 aa, Mycobacterium tuberculosis
GTDAVTATFWLLNASDSLAEQSR

SEQ ID NO: 1513914 - protein, 28 aa, Mycobacterium tuberculosis
GVARGTAYRWFRAGLLSVMARRVGRLIL

SEQ ID NO: 1513915 - protein, 25 aa, Mycobacterium tuberculosis
GVLAGYPLVNLKVTLLDGAYHEVDS

SEQ ID NO: 1513916 - protein, 18 aa, Mycobacterium tuberculosis
GVLGYWVTSQAPPAMQLC

SEQ ID NO: 1513917 - protein, 19 aa, Mycobacterium tuberculosis
GWFTGLVPITVPVASGLFD

SEQ ID NO: 1513918 - protein, 17 aa, Mycobacterium tuberculosis
HAFSAAPNFAFELAARR

SEQ ID NO: 1513919 - protein, 22 aa, Mycobacterium tuberculosis
HATAIMWAREQFGLELIWGIED

SEQ ID NO: 1513920 - protein, 20 aa, Mycobacterium tuberculosis
HDAEFFFVANAHLRLHVHLE

SEQ ID NO: 1513921 - protein, 17 aa, Mycobacterium tuberculosis
HFPTKEALFQAVIADRM

SEQ ID NO: 1513922 - protein, 17 aa, Mycobacterium tuberculosis
HGELADRVNLAITALRD

SEQ ID NO: 1513923 - protein, 37 aa, Mycobacterium tuberculosis; identical to SEQ ID NO: 219126

SEQ ID NO: 1513924 - protein, 17 aa, Mycobacterium tuberculosis
HMINDLFASDWALQRFA

SEQ ID NO: 1513925 - protein, 17 aa, Mycobacterium tuberculosis
HVVALCGEVFPVTRAPK

SEQ ID NO: 1513926 - protein, 21 aa, Mycobacterium tuberculosis
HVWALMGMPCGKYLVVMHDLW

SEQ ID NO: 1513927 - protein, 17 aa, Mycobacterium tuberculosis
IALADQLIRAREFDVVV

SEQ ID NO: 1513928 - protein, 25 aa, Mycobacterium tuberculosis
IEVDEPYVLILPTYGGGRANPGLDA

SEQ ID NO: 1513929 - protein, 33 aa, Mycobacterium tuberculosis
IGPGDRVGIWAPNRWEWVLVQYATAEIGAILVT

SEQ ID NO: 1513930 - protein, 17 aa, Mycobacterium tuberculosis
IGSFQNSRFLLAELATE

SEQ ID NO: 1513931 - protein, 21 aa, Mycobacterium tuberculosis
IHNTQPWRWRVCPTSLELFSR

SEQ ID NO: 1513932 - protein, 18 aa, Mycobacterium tuberculosis
ILAPLQPFQATAVIPVIG

SEQ ID NO: 1513933 - protein, 20 aa, Mycobacterium tuberculosis
ILETAYVIDFLAYVYEETRH

SEQ ID NO: 1513934 - protein, 30 aa, Mycobacterium tuberculosis
INALYSPQRWKYLTSGLLGLQRGSDAGDLL

SEQ ID NO: 1513935 - protein, 18 aa, Mycobacterium tuberculosis
IRLPMWVGLQEVDQSRVV

SEQ ID NO: 1513936 - protein, 17 aa, Mycobacterium tuberculosis
ITGRPWTTTTLSKFLRK

SEQ ID NO: 1513937 - protein, 21 aa, Mycobacterium tuberculosis
KAVANQLLPWALQHVELGPRT

SEQ ID NO: 1513938 - protein, 18 aa, Mycobacterium tuberculosis
KAVFSARALAEVCRRGWA

SEQ ID NO: 1513939 - protein, 19 aa, Mycobacterium tuberculosis
KDAHWFDPGKFWSGDSLPL

SEQ ID NO: 1513940 - protein, 24 aa, Mycobacterium tuberculosis
KPVVRRRILLPEHKDFGRIAPDEK

SEQ ID NO: 1513941 - protein, 20 aa, Mycobacterium tuberculosis
KRIVRLPKTHIKAVGTHFVS

SEQ ID NO: 1513942 - protein, 21 aa, Mycobacterium tuberculosis
KTAVLTRRIAYLMAARGVGVG

SEQ ID NO: 1513943 - protein, 23 aa, Mycobacterium tuberculosis
KTYTRWGAFLDDATGFDAGFFGI

SEQ ID NO: 1513944 - protein, 19 aa, Mycobacterium tuberculosis
LALLIMLERLGPAERVVFV

SEQ ID NO: 1513945 - protein, 20 aa, Mycobacterium tuberculosis
LAPKDLEKIIYFAAYVITSV

SEQ ID NO: 1513946 - protein, 22 aa, Mycobacterium tuberculosis
LAQDMAAYIRMFEPHEAREDTV

SEQ ID NO: 1513947 - protein, 35 aa, Mycobacterium tuberculosis; identical to SEQ ID NO: 120958

SEQ ID NO: 1513948 - protein, 34 aa, Mycobacterium tuberculosis; identical to SEQ ID NO: 225261

SEQ ID NO: 1513949 - protein, 24 aa, Mycobacterium tuberculosis
LCAGEKMMLLFESANFDEAVFCEP

SEQ ID NO: 1513950 - protein, 29 aa, Mycobacterium tuberculosis
LDGLAAYRRSRGLAALSVAWGLWEQASAM

SEQ ID NO: 1513951 - protein, 20 aa, Mycobacterium tuberculosis
LDWMVATTLLTGRRTWVPWT

SEQ ID NO: 1513952 - protein, 18 aa, Mycobacterium tuberculosis
LEQGLLGAINAPAAALSG

SEQ ID NO: 1513953 - protein, 19 aa, Mycobacterium tuberculosis
LFLENIIVPGLTVSGQILV

SEQ ID NO: 1513954 - protein, 18 aa, Mycobacterium tuberculosis
LFPLLLSVMSTGVTFVRS

SEQ ID NO: 1513955 - protein, 24 aa, Mycobacterium tuberculosis
LGATFRRFCRCSVSIESIANARSK

SEQ ID NO: 1513956 - protein, 23 aa, Mycobacterium tuberculosis
LGDNGYIPIPDEFKSRLSTAVNA

SEQ ID NO: 1513957 - protein, 17 aa, Mycobacterium tuberculosis
LHRLGIQAFEPMLVEGK

SEQ ID NO: 1513958 - protein, 17 aa, Mycobacterium tuberculosis
LLAPGILSDRVRGYARE

SEQ ID NO: 1513959 - protein, 29 aa, Mycobacterium tuberculosis
LLREANGDRYLPIWIGQSEAAAIALEQQG

SEQ ID NO: 1513960 - protein, 26 aa, Mycobacterium tuberculosis
LNAINAPTQTLLGRPLIGNGADGGPG

SEQ ID NO: 1513961 - protein, 25 aa, Mycobacterium tuberculosis
LNAQAAAFHHSFVQTLNAAGGAYSS

SEQ ID NO: 1513962 - protein, 34 aa, Mycobacterium tuberculosis; identical to SEQ ID NO: 220273

SEQ ID NO: 1513963 - protein, 18 aa, Mycobacterium tuberculosis
LPAIPLGIDVGGAIGPLT

SEQ ID NO: 1513964 - protein, 18 aa, Mycobacterium tuberculosis
LPDAMGALLARSIVGIVE

SEQ ID NO: 1513965 - protein, 18 aa, Mycobacterium tuberculosis
LPQLSIPAITTPAFTIDP

SEQ ID NO: 1513966 - protein, 17 aa, Mycobacterium tuberculosis
LPTMPPWHVQENKWRAA

SEQ ID NO: 1513967 - protein, 17 aa, Mycobacterium tuberculosis
LRHHIATPQPLQWDCFL

SEQ ID NO: 1513968 - protein, 18 aa, Mycobacterium tuberculosis
LRRLADVVYDPWIDQRPL

SEQ ID NO: 1513969 - protein, 24 aa, Mycobacterium tuberculosis
LRSQARILGIFVDGKRVPVVAHGV

SEQ ID NO: 1513970 - protein, 20 aa, Mycobacterium tuberculosis
LTDRVFAIVIQDFQDPYTLN

SEQ ID NO: 1513971 - protein, 29 aa, Mycobacterium tuberculosis
LVERQTRLIRLLHLPTHDAYCLRIAITET

SEQ ID NO: 1513972 - protein, 19 aa, Mycobacterium tuberculosis
LVGSALLRTFAGAGFTNLL

SEQ ID NO: 1513973 - protein, 20 aa, Mycobacterium tuberculosis
LYELEIAFAEILRLSPSSGG

SEQ ID NO: 1513974 - protein, 29 aa, Mycobacterium tuberculosis
LYGSLKMWAHLQRQGFRWPSATVKTIMRA

SEQ ID NO: 1513975 - protein, 27 aa, Mycobacterium tuberculosis
MAPVQRTWPELIPLLQSGRLDVDGIFT

SEQ ID NO: 1513976 - protein, 23 aa, Mycobacterium tuberculosis
MDRAGLLALLAGALEGAGAGIVW

SEQ ID NO: 1513977 - protein, 42 aa, Mycobacterium tuberculosis
MPYPTPDAGALFTVARRLLPDPLQIGPIRLLGVGFSGLSDIR

SEQ ID NO: 1513978 - protein, 18 aa, Mycobacterium tuberculosis
NCFADMAKVAIALGDSAR

SEQ ID NO: 1513979 - protein, 24 aa, Mycobacterium tuberculosis
NDPLALVLIELRHPRTEPPVPSAI

SEQ ID NO: 1513980 - protein, 17 aa, Mycobacterium tuberculosis
NGRIHRIWETTWPSWRN

SEQ ID NO: 1513981 - protein, 35 aa, Mycobacterium tuberculosis
NGVARVTAYRWFHAGLLPVPARKVGRLILVDELAS

SEQ ID NO: 1513982 - protein, 17 aa, Mycobacterium tuberculosis
NHPVYSYARPLFLALPE

SEQ ID NO: 1513983 - protein, 18 aa, Mycobacterium tuberculosis
NIPMVYQYRHTYGRRLWE

SEQ ID NO: 1513984 - protein, 26 aa, Mycobacterium tuberculosis
NLTAAPIERILLRYKAINRVAVYAVP

SEQ ID NO: 1513985 - protein, 19 aa, Mycobacterium tuberculosis
NQLAPPDLLAWAHEGRRGY

SEQ ID NO: 1513986 - protein, 20 aa, Mycobacterium tuberculosis
NSLITSWRALGWIGPEAAEA

SEQ ID NO: 1513987 - protein, 23 aa, Mycobacterium tuberculosis
NSNGLLRQYFPKGTSLSTYTPDH

SEQ ID NO: 1513988 - protein, 26 aa, Mycobacterium tuberculosis
NYSNGAFWRGDYQGLLGFSYTSTIIP

SEQ ID NO: 1513989 - protein, 17 aa, Mycobacterium tuberculosis
PAAIVWAAQMGTITLHP

SEQ ID NO: 1513990 - protein, 17 aa, Mycobacterium tuberculosis
PAELTPLAAWVACIADA

SEQ ID NO: 1513991 - protein, 17 aa, Mycobacterium tuberculosis
PAIELAVSRFREITALE

SEQ ID NO: 1513992 - protein, 17 aa, Mycobacterium tuberculosis
PANRRVVAALGPRVLGL

SEQ ID NO: 1513993 - protein, 17 aa, Mycobacterium tuberculosis
PAVLAFVNRALAGVLAL

SEQ ID NO: 1513994 - protein, 23 aa, Mycobacterium tuberculosis
PDSSVPIIIVPPTPGFGNATATP

SEQ ID NO: 1513995 - protein, 17 aa, Mycobacterium tuberculosis
PDWVPWEQRVRPGDLSP

SEQ ID NO: 1513996 - protein, 25 aa, Mycobacterium tuberculosis
PEINSLRMYLGAGSAPMLQAAAWDG

SEQ ID NO: 1513997 - protein, 20 aa, Mycobacterium tuberculosis
PFAVLRRVDRWFWSRRRRPP

SEQ ID NO: 1513998 - protein, 20 aa, Mycobacterium tuberculosis
PGPLCATTRPRPPQGNQPPA

SEQ ID NO: 1513999 - protein, 17 aa, Mycobacterium tuberculosis
PLDTEWIDRPTAFAARR

SEQ ID NO: 1514000 - protein, 23 aa, Mycobacterium tuberculosis
PLGFQVPGSIDAITLFPGGLTFP

SEQ ID NO: 1514001 - protein, 19 aa, Mycobacterium tuberculosis
PLIAVASAATRWVWVSDAA

SEQ ID NO: 1514002 - protein, 22 aa, Mycobacterium tuberculosis
PLVVVAGAATRWVWVKDAPGFD

SEQ ID NO: 1514003 - protein, 23 aa, Mycobacterium tuberculosis
PMLQAAAWDGLAAELGTAASSFS

SEQ ID NO: 1514004 - protein, 17 aa, Mycobacterium tuberculosis
PPASTIKVLLALVALDE

SEQ ID NO: 1514005 - protein, 17 aa, Mycobacterium tuberculosis
PPKVLSPLFPRPDTPAE

SEQ ID NO: 1514006 - protein, 26 aa, Mycobacterium tuberculosis
PRDLCALWPVPATSTPHPAAPAGAGK

SEQ ID NO: 1514007 - protein, 19 aa, Mycobacterium tuberculosis
PRRMGRIPKQLLSGVPAHV

SEQ ID NO: 1514008 - protein, 30 aa, Mycobacterium tuberculosis; identical to SEQ ID NO: 226699

SEQ ID NO: 1514009 - protein, 18 aa, Mycobacterium tuberculosis
PWIDQRPLRIYSAEQLAD

SEQ ID NO: 1514010 - protein, 19 aa, Mycobacterium tuberculosis
PWTMLGNLAFGLPSRLRLG

SEQ ID NO: 1514011 - protein, 20 aa, Mycobacterium tuberculosis
PYLQVVLQRRLPVVVVDQPK

SEQ ID NO: 1514012 - protein, 19 aa, Mycobacterium tuberculosis
QAMRHGVMPATLHVDEPSP

SEQ ID NO: 1514013 - protein, 20 aa, Mycobacterium tuberculosis
QAMRHGVMPATLHVDEPSPR

SEQ ID NO: 1514014 - protein, 18 aa, Mycobacterium tuberculosis
QDLPATSIAWGAWGQIGR

SEQ ID NO: 1514015 - protein, 17 aa, Mycobacterium tuberculosis
QIFNSNYSGLNPAAVVT

SEQ ID NO: 1514016 - protein, 20 aa, Mycobacterium tuberculosis
QLEEQYVFPKLEQAGKLTDI

SEQ ID NO: 1514017 - protein, 18 aa, Mycobacterium tuberculosis
QQQLIQRFARPLRTFFEN

SEQ ID NO: 1514018 - protein, 19 aa, Mycobacterium tuberculosis
QRRHSVLPMLLASNSQRLQ

SEQ ID NO: 1514019 - protein, 27 aa, Mycobacterium tuberculosis
QSDTESPLWQAFLTRVLPDEGVRGFVQ

SEQ ID NO: 1514020 - protein, 24 aa, Mycobacterium tuberculosis
QTLAAYLTMQLLEAAGLPPGVINL

SEQ ID NO: 1514021 - protein, 32 aa, Mycobacterium tuberculosis; identical to SEQ ID NO: 221845

SEQ ID NO: 1514022 - protein, 17 aa, Mycobacterium tuberculosis
RAALFFDGRLVEEGPTE

SEQ ID NO: 1514023 - protein, 19 aa, Mycobacterium tuberculosis
RCRGAAVVTPLLLADAYHA

SEQ ID NO: 1514024 - protein, 20 aa, Mycobacterium tuberculosis
RDWGVLPDFVMGHSVGELAA

SEQ ID NO: 1514025 - protein, 19 aa, Mycobacterium tuberculosis
RFLEKEQRIIAALRAAADS

SEQ ID NO: 1514026 - protein, 18 aa, Mycobacterium tuberculosis
RFLLGLVVSTGVGGGLVL

SEQ ID NO: 1514027 - protein, 24 aa, Mycobacterium tuberculosis
RGATVDPVLWRTASLVGARVDVDQ

SEQ ID NO: 1514028 - protein, 36 aa, Mycobacterium tuberculosis; identical to SEQ ID NO: 222158

SEQ ID NO: 1514029 - protein, 17 aa, Mycobacterium tuberculosis
RGVFTALFPGGEGRLRL

SEQ ID NO: 1514030 - protein, 18 aa, Mycobacterium tuberculosis
RIHRIWETTWPSWRNVAA

SEQ ID NO: 1514031 - protein, 33 aa, Mycobacterium tuberculosis
RKNERYKLVWKNRLGFARLAIQHGYPIVPFASV

SEQ ID NO: 1514032 - protein, 23 aa, Mycobacterium tuberculosis
RLAGIPYIAIANAYWSPYAQRRF

SEQ ID NO: 1514033 - protein, 20 aa, Mycobacterium tuberculosis
RLLDVHANTWRYNQLIAQQR

SEQ ID NO: 1514034 - protein, 21 aa, Mycobacterium tuberculosis
RLSTCAGVTSLPPAHRLTGDN

SEQ ID NO: 1514035 - protein, 18 aa, Mycobacterium tuberculosis
RNPLRFAAPCPGQHGWRA

SEQ ID NO: 1514036 - protein, 20 aa, Mycobacterium tuberculosis
RPPMVTSGLRIGTPALATRG

SEQ ID NO: 1514037 - protein, 17 aa, Mycobacterium tuberculosis
RQDFVEFTPSHTPLLIT

SEQ ID NO: 1514038 - protein, 21 aa, Mycobacterium tuberculosis
RRTVYIDLRADWPAALQAAGL

SEQ ID NO: 1514039 - protein, 24 aa, Mycobacterium tuberculosis
RTHPMLCALPIERAIDAAETLDAE

SEQ ID NO: 1514040 - protein, 21 aa, Mycobacterium tuberculosis
RYGGRLQGHRYLRGSSPFAGK

SEQ ID NO: 1514041 - protein, 21 aa, Mycobacterium tuberculosis
RYINDRFLPDKAIDLIDEAGA

SEQ ID NO: 1514042 - protein, 25 aa, Mycobacterium tuberculosis
SAHSPYYRLVALRETSPRIHELIRE

SEQ ID NO: 1514043 - protein, 25 aa, Mycobacterium tuberculosis
SALTHALAMFPGPLCRCTRRRTTTA

SEQ ID NO: 1514044 - protein, 21 aa, Mycobacterium tuberculosis
SAMAAWLFGRPAAVPEIARSR

SEQ ID NO: 1514045 - protein, 25 aa, Mycobacterium tuberculosis
SAQQGKFLCLLAGAIQARRVLEIGT

SEQ ID NO: 1514046 - protein, 29 aa, Mycobacterium tuberculosis
SDALSKLTPWKAPPPIAHSTVLVAPVSPS

SEQ ID NO: 1514047 - protein, 23 aa, Mycobacterium tuberculosis
SDEFFSLFLDPTMAYTCAYFERE

SEQ ID NO: 1514048 - protein, 19 aa, Mycobacterium tuberculosis
SDFLHGRWLVLRRGKRSIA

SEQ ID NO: 1514049 - protein, 30 aa, Mycobacterium tuberculosis; identical to SEQ ID NO: 236886

SEQ ID NO: 1514050 - protein, 20 aa, Mycobacterium tuberculosis
SDPVWAKKFTDAGVPIVGDD

SEQ ID NO: 1514051 - protein, 18 aa, Mycobacterium tuberculosis
SETAVYNVLPQWAKLAAK

SEQ ID NO: 1514052 - protein, 19 aa, Mycobacterium tuberculosis
SFAHVVRAVHRCLLAGRFA

SEQ ID NO: 1514053 - protein, 19 aa, Mycobacterium tuberculosis
SFFPAILEPRRRIDQALYA

SEQ ID NO: 1514054 - protein, 17 aa, Mycobacterium tuberculosis
SFPLYCCANGKALLAAL

SEQ ID NO: 1514055 - protein, 35 aa, Mycobacterium tuberculosis
SGRYPQAIFDHGTPLALYHTKRLASPAQRIMLFAN

SEQ ID NO: 1514056 - protein, 24 aa, Mycobacterium tuberculosis
SPVTGLVFVTNFDSNTVSVIDPNT

SEQ ID NO: 1514057 - protein, 21 aa, Mycobacterium tuberculosis
SQQQLIQRFARPLRTFFENAC

SEQ ID NO: 1514058 - protein, 31 aa, Mycobacterium tuberculosis; identical to SEQ ID NO: 226941

SEQ ID NO: 1514059 - protein, 18 aa, Mycobacterium tuberculosis
SSATWPEPISYTALDRGD

SEQ ID NO: 1514060 - protein, 17 aa, Mycobacterium tuberculosis
SSDLPWHRVIRASGRPA

SEQ ID NO: 1514061 - protein, 18 aa, Mycobacterium tuberculosis
TAFAAIVPPPLIAANRAR

SEQ ID NO: 1514062 - protein, 26 aa, Mycobacterium tuberculosis
TAGQATAAALWLVAPCTELYHDSRAD

SEQ ID NO: 1514063 - protein, 23 aa, Mycobacterium tuberculosis
TARRGPPTRGLPKAVRAAKMGAR

SEQ ID NO: 1514064 - protein, 30 aa, Mycobacterium tuberculosis
TATRHVVSYPGSFWPVTGLNSPTVGSSVSA

SEQ ID NO: 1514065 - protein, 19 aa, Mycobacterium tuberculosis
TCDPPPVQRPHPPLWIGGE

SEQ ID NO: 1514066 - protein, 20 aa, Mycobacterium tuberculosis
TDGPIFVAGLSQGTLVLDRE

SEQ ID NO: 1514067 - protein, 18 aa, Mycobacterium tuberculosis
TELRRQLKPLGRQAEAAQ

SEQ ID NO: 1514068 - protein, 18 aa, Mycobacterium tuberculosis
TEPLGYDTTYTWSGSAVG

SEQ ID NO: 1514069 - protein, 22 aa, Mycobacterium tuberculosis
TGPEQVLQLNGLLLLSHLEVIN

SEQ ID NO: 1514070 - protein, 19 aa, Mycobacterium tuberculosis
TIKVLLALVALDELDLNST

SEQ ID NO: 1514071 - protein, 18 aa, Mycobacterium tuberculosis
TIYSFTGASPRFLLDFSR

SEQ ID NO: 1514072 - protein, 25 aa, Mycobacterium tuberculosis
TKEDYQILGPLPRKNIDTGMGVERI

SEQ ID NO: 1514073 - protein, 29 aa, Mycobacterium tuberculosis
TLRRAGVRTNTWWLPAMQSLYETDYGPVL

SEQ ID NO: 1514074 - protein, 17 aa, Mycobacterium tuberculosis
TMDSLRRFIGNRRMLMV

SEQ ID NO: 1514075 - protein, 17 aa, Mycobacterium tuberculosis
TNPPLLLATRHLVGDDG

SEQ ID NO: 1514076 - protein, 29 aa, Mycobacterium tuberculosis
TRSLAWELSWKDTAAPLWTFPRVAWEREL

SEQ ID NO: 1514077 - protein, 21 aa, Mycobacterium tuberculosis
TSWVQLPLTPQLAEPVHDEAA

SEQ ID NO: 1514078 - protein, 26 aa, Mycobacterium tuberculosis
TVMGLPSIFVGFSRQRGLAADGRCKA

SEQ ID NO: 1514079 - protein, 17 aa, Mycobacterium tuberculosis
TVRARRFAAAGLVMLAG

SEQ ID NO: 1514080 - protein, 19 aa, Mycobacterium tuberculosis
TVRRDEFSRWLSAKPDYLV

SEQ ID NO: 1514081 - protein, 20 aa, Mycobacterium tuberculosis
TVRRDEFSRWLSAKPDYLVT

SEQ ID NO: 1514082 - protein, 23 aa, Mycobacterium tuberculosis
VAAKMALQYWRGRGLPGKRRLMT

SEQ ID NO: 1514083 - protein, 18 aa, Mycobacterium tuberculosis
VASRLIRLPMWVGLQEVD

SEQ ID NO: 1514084 - protein, 23 aa, Mycobacterium tuberculosis
VASRLIRLPMWVGLQEVDQSRVV

SEQ ID NO: 1514085 - protein, 24 aa, Mycobacterium tuberculosis
VCTLGYVDPALKIAFTAGHCRGGG

SEQ ID NO: 1514086 - protein, 23 aa, Mycobacterium tuberculosis
VDAALRPIIDRAYQPGPAPAVNP

SEQ ID NO: 1514087 - protein, 37 aa, Mycobacterium tuberculosis; identical to SEQ ID NO: 223879

SEQ ID NO: 1514088 - protein, 24 aa, Mycobacterium tuberculosis
VDGGIPGFTLFPDGLTFPKIPVHV

SEQ ID NO: 1514089 - protein, 17 aa, Mycobacterium tuberculosis
VEGGWAWLPDEAQGARV

SEQ ID NO: 1514090 - protein, 24 aa, Mycobacterium tuberculosis
VGGDGVAFLGTAPGGPGGAGGAGG

SEQ ID NO: 1514091 - protein, 28 aa, Mycobacterium tuberculosis
VGKSTLLLEVAHRWAQSGRRALYVSGEE

SEQ ID NO: 1514092 - protein, 17 aa, Mycobacterium tuberculosis
VGTMTLNFGLANVGGNN

SEQ ID NO: 1514093 - protein, 22 aa, Mycobacterium tuberculosis
VHSEAPPFFVLHGEKDPMVPSA

SEQ ID NO: 1514094 - protein, 18 aa, Mycobacterium tuberculosis
VLAFVNRALAGVLALSIE

SEQ ID NO: 1514095 - protein, 26 aa, Mycobacterium tuberculosis
VLDTDSFYRPKRPGSYPIVLATYEIV

SEQ ID NO: 1514096 - protein, 22 aa, Mycobacterium tuberculosis
VLHTPPPHWRPDVLLVAVGAMS

SEQ ID NO: 1514097 - protein, 20 aa, Mycobacterium tuberculosis
VLREVFVNGIPRRVDRVDLE

SEQ ID NO: 1514098 - protein, 20 aa, Mycobacterium tuberculosis
VPLTFLCACGPAYLPERDQR

SEQ ID NO: 1514099 - protein, 17 aa, Mycobacterium tuberculosis
VPPSDRPWRLAMSTAGT

SEQ ID NO: 1514100 - protein, 19 aa, Mycobacterium tuberculosis
VRDWYSIRHYALTEDGRCQ

SEQ ID NO: 1514101 - protein, 22 aa, Mycobacterium tuberculosis
VRLPHGNGETIRLARGASLSDF

SEQ ID NO: 1514102 - protein, 17 aa, Mycobacterium tuberculosis
VSLTLMARLAEAVRPGA

SEQ ID NO: 1514103 - protein, 17 aa, Mycobacterium tuberculosis
VTGLVFVTNFDSNTVSV

SEQ ID NO: 1514104 - protein, 18 aa, Mycobacterium tuberculosis
VTPILPMIRAAEQRGIDW

SEQ ID NO: 1514105 - protein, 29 aa, Mycobacterium tuberculosis
VTRTAAPPRILWLDTAAPAKLILEVRAMD

SEQ ID NO: 1514106 - protein, 21 aa, Mycobacterium tuberculosis
VTVDWHMPPRARKPQRRVRLT

SEQ ID NO: 1514107 - protein, 26 aa, Mycobacterium tuberculosis
VVADIHFQPRYIFAAIDAGCAAVRVN

SEQ ID NO: 1514108 - protein, 28 aa, Mycobacterium tuberculosis
VVCPLGWPATPARLPFTLGAGAHLQADI

SEQ ID NO: 1514109 - protein, 22 aa, Mycobacterium tuberculosis
VVPATVLTLVRTLLRAREGRTM

SEQ ID NO: 1514110 - protein, 18 aa, Mycobacterium tuberculosis
VVVPVMFDRIMDLPAEIR

SEQ ID NO: 1514111 - protein, 19 aa, Mycobacterium tuberculosis
VVYWWRGSGGGPRVGLIIA

SEQ ID NO: 1514112 - protein, 20 aa, Mycobacterium tuberculosis
VWIYRGFLRIAARGYRLCSP

SEQ ID NO: 1514113 - protein, 27 aa, Mycobacterium tuberculosis
WDFVCEQLAAAEPWWQPGAAQGYHMTT

SEQ ID NO: 1514114 - protein, 17 aa, Mycobacterium tuberculosis
WTDLGMFPVLGMDWRER

SEQ ID NO: 1514115 - protein, 20 aa, Mycobacterium tuberculosis
WVDDYPVMLINANAAPDRKR

SEQ ID NO: 1514116 - protein, 18 aa, Mycobacterium tuberculosis
WVMQLCHPDIREKFPPLR

SEQ ID NO: 1514117 - protein, 19 aa, Mycobacterium tuberculosis
WYAELGRRHELLSGLVPQI

SEQ ID NO: 1514118 - protein, 17 aa, Mycobacterium tuberculosis
YAPLLPSVDEVAALLRS

SEQ ID NO: 1514119 - protein, 20 aa, Mycobacterium tuberculosis
YIITGGLGGLGLFLAEKMAN

SEQ ID NO: 1514120 - protein, 27 aa, Mycobacterium tuberculosis
YPDGVWYVNLAPITDPALVPIAAARVL

SEQ ID NO: 1514121 - protein, 17 aa, Mycobacterium tuberculosis
YSVIYQAIDEIEQALRG

SEQ ID NO: 1514122 - protein, 19 aa, Mycobacterium tuberculosis
AAFHDRFAQTLSAAVGSYV

SEQ ID NO: 1514123 - protein, 19 aa, Mycobacterium tuberculosis
AAGGLQLLIIISAGRTIAN

SEQ ID NO: 1514124 - protein, 23 aa, Mycobacterium tuberculosis
AALKLVLEPIFETDFEPVSYGFR

SEQ ID NO: 1514125 - protein, 19 aa, Mycobacterium tuberculosis
AASLARHFGARRKAFNWTV

SEQ ID NO: 1514126 - protein, 21 aa, Mycobacterium tuberculosis
AATVDPFVIAANRSRLVSLAL

SEQ ID NO: 1514127 - protein, 28 aa, Mycobacterium tuberculosis
ADFPDDITHYLWTWTDRSAGSLRARMFA

SEQ ID NO: 1514128 - protein, 23 aa, Mycobacterium tuberculosis
ADPPMIMRDTIFCAIPTDADREA

SEQ ID NO: 1514129 - protein, 20 aa, Mycobacterium tuberculosis
ADQRIRQVAPFLSYGQFTGS

SEQ ID NO: 1514130 - protein, 19 aa, Mycobacterium tuberculosis
AEAMLLMRAGREYALKRAL

SEQ ID NO: 1514131 - protein, 24 aa, Mycobacterium tuberculosis
AEATYEQMWAADVAAMVGYHGGAS

SEQ ID NO: 1514132 - protein, 19 aa, Mycobacterium tuberculosis
AEDALWRWMTAAALVRPRG

SEQ ID NO: 1514133 - protein, 29 aa, Mycobacterium tuberculosis
AESGMLGGLSVPLSWGVAVPPDDYDHWAP

SEQ ID NO: 1514134 - protein, 23 aa, Mycobacterium tuberculosis
AGGLSRVLPIYPTVDTALGKGTA

SEQ ID NO: 1514135 - protein, 28 aa, Mycobacterium tuberculosis
AGGNGGAGGLLFGNGGNGGNAGAGGDGG

SEQ ID NO: 1514136 - protein, 18 aa, Mycobacterium tuberculosis
AGYGAPGYDQGYRQSGGY

SEQ ID NO: 1514137 - protein, 18 aa, Mycobacterium tuberculosis
AHLLLRFDRGNWIAIDND

SEQ ID NO: 1514138 - protein, 23 aa, Mycobacterium tuberculosis
AIKAVSALDLGLPLAAGNVVSAE

SEQ ID NO: 1514139 - protein, 18 aa, Mycobacterium tuberculosis
AKALWLRSRRRGVLAGYS

SEQ ID NO: 1514140 - protein, 30 aa, Mycobacterium tuberculosis
AKKPEETRYWYYALLGFGLNRYRAGSGQPL

SEQ ID NO: 1514141 - protein, 22 aa, Mycobacterium tuberculosis
AKLIAAARKPVLYVGGGVIRGE

SEQ ID NO: 1514142 - protein, 17 aa, Mycobacterium tuberculosis
AKVDVLVSYLPVGSEEA

SEQ ID NO: 1514143 - protein, 28 aa, Mycobacterium tuberculosis
ALAEIDEFGFPVAPWMFGAAGREHMKKY

SEQ ID NO: 1514144 - protein, 18 aa, Mycobacterium tuberculosis
ALATSPYLRQHADNPVHW

SEQ ID NO: 1514145 - protein, 17 aa, Mycobacterium tuberculosis
ALDLARRYPVGKAVAAI

SEQ ID NO: 1514146 - protein, 35 aa, Mycobacterium tuberculosis; identical to SEQ ID NO: 216075

SEQ ID NO: 1514147 - protein, 18 aa, Mycobacterium tuberculosis
ALGIGYEIVPGVPAFAAA

SEQ ID NO: 1514148 - protein, 19 aa, Mycobacterium tuberculosis
APIVLKGLFRLKSNCPSAL

SEQ ID NO: 1514149 - protein, 18 aa, Mycobacterium tuberculosis
APPTPFNGPLGRLRNIAY

SEQ ID NO: 1514150 - protein, 24 aa, Mycobacterium tuberculosis
APSRSLPLLECWTALAALCRDTTK

SEQ ID NO: 1514151 - protein, 18 aa, Mycobacterium tuberculosis
APSWRKGPRHIAGRGPRD

SEQ ID NO: 1514152 - protein, 19 aa, Mycobacterium tuberculosis
ARLLLIVAELPLPMQNVNE

SEQ ID NO: 1514153 - protein, 17 aa, Mycobacterium tuberculosis
ASDFHAFSAAPNFAFEL

SEQ ID NO: 1514154 - protein, 25 aa, Mycobacterium tuberculosis
ATMRAIENALTLILGLPTGPERGEA

SEQ ID NO: 1514155 - protein, 20 aa, Mycobacterium tuberculosis
ATTAWLIERLQRPTLVMAPN

SEQ ID NO: 1514156 - protein, 17 aa, Mycobacterium tuberculosis
AVRAFMQAAIGPGQEGL

SEQ ID NO: 1514157 - protein, 20 aa, Mycobacterium tuberculosis
AVVTPLLLADAYHARVDIPA

SEQ ID NO: 1514158 - protein, 24 aa, Mycobacterium tuberculosis
CGDAVPYIILPNLQTGEPVMGVAD

SEQ ID NO: 1514159 - protein, 26 aa, Mycobacterium tuberculosis
CGSPAWDLPTVFGPIAITYNIKGVST

SEQ ID NO: 1514160 - protein, 19 aa, Mycobacterium tuberculosis
CHPDLHNAFPPLRTRKVVG

SEQ ID NO: 1514161 - protein, 18 aa, Mycobacterium tuberculosis
CPFAYQTSVWIRDVRAQL

SEQ ID NO: 1514162 - protein, 23 aa, Mycobacterium tuberculosis
CVDSAVMHYFLDGTLPPTSLRCA

SEQ ID NO: 1514163 - protein, 18 aa, Mycobacterium tuberculosis
CVGFPKVLAAFRPHAGDL

SEQ ID NO: 1514164 - protein, 18 aa, Mycobacterium tuberculosis
CVNIETGVVWWPECSKEA

SEQ ID NO: 1514165 - protein, 24 aa, Mycobacterium tuberculosis
DAINAPVQSLTGRPLIGDGANGID

SEQ ID NO: 1514166 - protein, 28 aa, Mycobacterium tuberculosis
DELRSLLRFVLDLLADYGLTDFYLELST

SEQ ID NO: 1514167 - protein, 23 aa, Mycobacterium tuberculosis
DGAGWLAFFRDLVARGLSGVALV

SEQ ID NO: 1514168 - protein, 22 aa, Mycobacterium tuberculosis
DGKKLIGIVSIGDVVKSRMGEL

SEQ ID NO: 1514169 - protein, 22 aa, Mycobacterium tuberculosis
DGSPKILERCTLPLTGVGCVDR

SEQ ID NO: 1514170 - protein, 17 aa, Mycobacterium tuberculosis
DIGLANLGSYNIGLANL

SEQ ID NO: 1514171 - protein, 21 aa, Mycobacterium tuberculosis
DIRESIHLRALGRQNPLDEFH

SEQ ID NO: 1514172 - protein, 24 aa, Mycobacterium tuberculosis
DIVRLVFALVPFRFRKHPRARAGW

SEQ ID NO: 1514173 - protein, 22 aa, Mycobacterium tuberculosis
DKGFQRWRKALDRLETEVPVYL

SEQ ID NO: 1514174 - protein, 17 aa, Mycobacterium tuberculosis
DLDASLRLWERGEQLAK

SEQ ID NO: 1514175 - protein, 19 aa, Mycobacterium tuberculosis
DLDWRAVVGEAQFVELPTY

SEQ ID NO: 1514176 - protein, 27 aa, Mycobacterium tuberculosis
DLFGARVDQLPLIWQRLVDGGMESGHA

SEQ ID NO: 1514177 - protein, 22 aa, Mycobacterium tuberculosis
DLRLFKALVDAASGYAGRQSQA

SEQ ID NO: 1514178 - protein, 22 aa, Mycobacterium tuberculosis
DNVGLLFHRLDKGELAPGDVIT

SEQ ID NO: 1514179 - protein, 22 aa, Mycobacterium tuberculosis
DPYLQVVLQRRLPVVVVDQPKD

SEQ ID NO: 1514180 - protein, 22 aa, Mycobacterium tuberculosis
DQVKIIDRVLASPLVTEAMVLS

SEQ ID NO: 1514181 - protein, 22 aa, Mycobacterium tuberculosis
DQYGSIPLPKSFQAKLAAAVNA

SEQ ID NO: 1514182 - protein, 21 aa, Mycobacterium tuberculosis
DRSRHTIIYLPDPTVGVQGIH

SEQ ID NO: 1514183 - protein, 23 aa, Mycobacterium tuberculosis
DSLPRIAQAIALPAVRKTGVLEN

SEQ ID NO: 1514184 - protein, 17 aa, Mycobacterium tuberculosis
DTEWIDRPTAFAARRAE

SEQ ID NO: 1514185 - protein, 26 aa, Mycobacterium tuberculosis
DVGELLRWLGDGNFLLLGYQRCRVAD

SEQ ID NO: 1514186 - protein, 24 aa, Mycobacterium tuberculosis
DVGGATHWAWEKVFTKANMLESLE

SEQ ID NO: 1514187 - protein, 21 aa, Mycobacterium tuberculosis
EDLPTLVRTLAATTALMLTGD

SEQ ID NO: 1514188 - protein, 18 aa, Mycobacterium tuberculosis
EEHYTWLPRQDLLSVKEI

SEQ ID NO: 1514189 - protein, 17 aa, Mycobacterium tuberculosis
EFVVLRPVGVDTSALWA

SEQ ID NO: 1514190 - protein, 24 aa, Mycobacterium tuberculosis
EGDEVILPSYTFVSTANAFVLRGG

SEQ ID NO: 1514191 - protein, 17 aa, Mycobacterium tuberculosis
EGGHRILANWLTCCGWT

SEQ ID NO: 1514192 - protein, 27 aa, Mycobacterium tuberculosis
EHAVTLWKQWDRCALHWFPGSHLLHVS

SEQ ID NO: 1514193 - protein, 24 aa, Mycobacterium tuberculosis
EINSGRMFFGAGSGPMLAAAAAWD

SEQ ID NO: 1514194 - protein, 18 aa, Mycobacterium tuberculosis
EITSGEMYLGPGAGPMLA

SEQ ID NO: 1514195 - protein, 19 aa, Mycobacterium tuberculosis
EKARYMWVSTFHSTCVRIL

SEQ ID NO: 1514196 - protein, 19 aa, Mycobacterium tuberculosis
ELDPVGLRQTWLDLHESWL

SEQ ID NO: 1514197 - protein, 29 aa, Mycobacterium tuberculosis
ELQSPTFQPVRRFGWRIMPQNLSDAGVSW

SEQ ID NO: 1514198 - protein, 17 aa, Mycobacterium tuberculosis
ELTAMITYHRKMAAVAQ

SEQ ID NO: 1514199 - protein, 26 aa, Mycobacterium tuberculosis
ELVRRFYAHWFALDASVRDLFPPDMG

SEQ ID NO: 1514200 - protein, 30 aa, Mycobacterium tuberculosis
ENIQAMDRYLSWTRFALSKLPRWREPPQIH

SEQ ID NO: 1514201 - protein, 25 aa, Mycobacterium tuberculosis
ENQSSGVIPIMKLLEDAFSYANQLG

SEQ ID NO: 1514202 - protein, 21 aa, Mycobacterium tuberculosis
EQTIIEYPNPAPLKATLVARR

SEQ ID NO: 1514203 - protein, 23 aa, Mycobacterium tuberculosis
ERGKAARRFLPGATILKASVGPM

SEQ ID NO: 1514204 - protein, 26 aa, Mycobacterium tuberculosis
ERQKEFADLLTWLQETLSDHVKEVRL

SEQ ID NO: 1514205 - protein, 24 aa, Mycobacterium tuberculosis
ETAPGLRWPDLALQGGRLNWSAVR

SEQ ID NO: 1514206 - protein, 20 aa, Mycobacterium tuberculosis
ETIRAWFPDAPLEVREALVR

SEQ ID NO: 1514207 - protein, 26 aa, Mycobacterium tuberculosis
EVAELLLLGMPYRDIGARLFISAKTV

SEQ ID NO: 1514208 - protein, 37 aa, Mycobacterium tuberculosis; identical to SEQ ID NO: 226170

SEQ ID NO: 1514209 - protein, 21 aa, Mycobacterium tuberculosis
FATRWRHGGSPLLRGLIDAGT

SEQ ID NO: 1514210 - protein, 17 aa, Mycobacterium tuberculosis
FGNGFLLTKRDIDWFHT

SEQ ID NO: 1514211 - protein, 17 aa, Mycobacterium tuberculosis
FLPAFNIPGIDVPAINV

SEQ ID NO: 1514212 - protein, 19 aa, Mycobacterium tuberculosis
FLTPRNSLRQRCVAHRLTI

SEQ ID NO: 1514213 - protein, 23 aa, Mycobacterium tuberculosis
GAGGAGGWLLGNGGAGGPGGPTD

SEQ ID NO: 1514214 - protein, 18 aa, Mycobacterium tuberculosis
GAGGLLYGNGGAGGNGGA

SEQ ID NO: 1514215 - protein, 28 aa, Mycobacterium tuberculosis
GAQGFFDAQAQMLSGLQGLIETVGQHGT

SEQ ID NO: 1514216 - protein, 18 aa, Mycobacterium tuberculosis
GATLPAAAWQRCRTHYAA

SEQ ID NO: 1514217 - protein, 24 aa, Mycobacterium tuberculosis
GCAALIVALLGACPALRVLATSRE

SEQ ID NO: 1514218 - protein, 25 aa, Mycobacterium tuberculosis
GGAGGNGGWLYGNGGLGGNGGAATQ

SEQ ID NO: 1514219 - protein, 23 aa, Mycobacterium tuberculosis
GGDGGWGRPGGQGGFGSTSGAHG

SEQ ID NO: 1514220 - protein, 21 aa, Mycobacterium tuberculosis
GGEHLAMLRRLMMDDSFFRGE

SEQ ID NO: 1514221 - protein, 23 aa, Mycobacterium tuberculosis
GGNAGVIANGSFAPSFVGFGGNG

SEQ ID NO: 1514222 - protein, 24 aa, Mycobacterium tuberculosis
GGNGGLGGLLLGNGGAGGVGGTGD

SEQ ID NO: 1514223 - protein, 21 aa, Mycobacterium tuberculosis
GGRGGLLIGDGGAGGAGGVGG

SEQ ID NO: 1514224 - protein, 18 aa, Mycobacterium tuberculosis
GGTLCCALANRLRITKPE

SEQ ID NO: 1514225 - protein, 26 aa, Mycobacterium tuberculosis
GHFVPNLTIGLPVVESLLAVTDIPMD

SEQ ID NO: 1514226 - protein, 20 aa, Mycobacterium tuberculosis
GKLRPPVFGILRYITDAVDE

SEQ ID NO: 1514227 - protein, 25 aa, Mycobacterium tuberculosis
GLAKPAGIYQLTDANWMAIMGDRTV

SEQ ID NO: 1514228 - protein, 19 aa, Mycobacterium tuberculosis
GLMVAAASPYVAWMSVTAG

SEQ ID NO: 1514229 - protein, 17 aa, Mycobacterium tuberculosis
GLPYRAAEIGLLVLATS

SEQ ID NO: 1514230 - protein, 25 aa, Mycobacterium tuberculosis
GMNEIVFPAAILQPPFFDPQADEAA

SEQ ID NO: 1514231 - protein, 24 aa, Mycobacterium tuberculosis
GNGGAAGSLIGLGGGGGAGGVGGT

SEQ ID NO: 1514232 - protein, 28 aa, Mycobacterium tuberculosis
GPEQVLFRRLAVFPSGFDLDGAQAAAAG

SEQ ID NO: 1514233 - protein, 29 aa, Mycobacterium tuberculosis
GRGLRCIAPTWPLGAHPKPLRPGADQTIG

SEQ ID NO: 1514234 - protein, 20 aa, Mycobacterium tuberculosis
GRQCLNAGLGFGGGCLPKDI

SEQ ID NO: 1514235 - protein, 18 aa, Mycobacterium tuberculosis
GRREPLPLPLKTSCAWAQ

SEQ ID NO: 1514236 - protein, 18 aa, Mycobacterium tuberculosis
GRYPQAIFDHGTPLALYH

SEQ ID NO: 1514237 - protein, 24 aa, Mycobacterium tuberculosis
GSGGFGQFGGAGGLLYGNGGAAGS

SEQ ID NO: 1514238 - protein, 18 aa, Mycobacterium tuberculosis
GSIAQLVKVLSGYEAALA

SEQ ID NO: 1514239 - protein, 25 aa, Mycobacterium tuberculosis
GTALNQIPILNIGLADVGNFNVGFG

SEQ ID NO: 1514240 - protein, 25 aa, Mycobacterium tuberculosis
GTGGAGQITGLRSGFGGAGGAGGAS

SEQ ID NO: 1514241 - protein, 35 aa, Mycobacterium tuberculosis
GTTTLLVTDLAGGWIPPHVRLPANVTLLEPTARRR

SEQ ID NO: 1514242 - protein, 22 aa, Mycobacterium tuberculosis
GVAITLTWSQLYRRTLNVAQEL

SEQ ID NO: 1514243 - protein, 17 aa, Mycobacterium tuberculosis
GVRRVILIHWDDFFRPL

SEQ ID NO: 1514244 - protein, 18 aa, Mycobacterium tuberculosis
GWLRRFAERVEAVRSVFT

SEQ ID NO: 1514245 - protein, 19 aa, Mycobacterium tuberculosis
GWMVQAFRFTLDPTAEQAR

SEQ ID NO: 1514246 - protein, 19 aa, Mycobacterium tuberculosis
HAQAYQTLGTQAAAFHERF

SEQ ID NO: 1514247 - protein, 20 aa, Mycobacterium tuberculosis
HAVHRKLVLRHLAAKRIRVM

SEQ ID NO: 1514248 - protein, 28 aa, Mycobacterium tuberculosis
HETFDLGPLVIFPPMNIPATVIESFSTA

SEQ ID NO: 1514249 - protein, 19 aa, Mycobacterium tuberculosis
HFFPLYGDPDGPHFECWTV

SEQ ID NO: 1514250 - protein, 23 aa, Mycobacterium tuberculosis
HSAHYYFRDFWGADSGMLAALHV

SEQ ID NO: 1514251 - protein, 26 aa, Mycobacterium tuberculosis
HSTFFRERWPRLLRSLYPIGGVVFDG

SEQ ID NO: 1514252 - protein, 19 aa, Mycobacterium tuberculosis
HVVTINDYLARRDAEWMGP

SEQ ID NO: 1514253 - protein, 18 aa, Mycobacterium tuberculosis
IAGDQQLSFALIDGVRRQ

SEQ ID NO: 1514254 - protein, 22 aa, Mycobacterium tuberculosis
IAHLPNTLLGLTSPLSSALTAA

SEQ ID NO: 1514255 - protein, 24 aa, Mycobacterium tuberculosis
IDERTVICVLTHDPKFDVPVLEVA

SEQ ID NO: 1514256 - protein, 20 aa, Mycobacterium tuberculosis
IDFRDPAPFAVLRRVDRWFW

SEQ ID NO: 1514257 - protein, 26 aa, Mycobacterium tuberculosis
IDPDAVELPAWYRPNPGLARDLAFIA

SEQ ID NO: 1514258 - protein, 21 aa, Mycobacterium tuberculosis
IDPDLLVAAVKAAGAPVICET

SEQ ID NO: 1514259 - protein, 36 aa, Mycobacterium tuberculosis
IDPIPLQLNLDLTLGPVHILIDLPAVPGFGNTTGAP

SEQ ID NO: 1514260 - protein, 18 aa, Mycobacterium tuberculosis
IEFVIERLSLIPESKKAV

SEQ ID NO: 1514261 - protein, 19 aa, Mycobacterium tuberculosis
IGDIPIPIIDVPAVPGFGN

SEQ ID NO: 1514262 - protein, 19 aa, Mycobacterium tuberculosis
IGFCLDTCHTWAAGEALTD

SEQ ID NO: 1514263 - protein, 18 aa, Mycobacterium tuberculosis
IGKTPIKRIGVLGAGMMG

SEQ ID NO: 1514264 - protein, 17 aa, Mycobacterium tuberculosis
ILFGARTGLDGIGGVSV

SEQ ID NO: 1514265 - protein, 18 aa, Mycobacterium tuberculosis
IRIPSTLLGLLSEIPRCP

SEQ ID NO: 1514266 - protein, 35 aa, Mycobacterium tuberculosis; identical to SEQ ID NO: 219528

SEQ ID NO: 1514267 - protein, 36 aa, Mycobacterium tuberculosis
ITGNFNNGFLWRGDHQGLIFGSPGFFNSTSAPSSGF

SEQ ID NO: 1514268 - protein, 23 aa, Mycobacterium tuberculosis
KGGTGLMPGINGTGGAGGSRGQI

SEQ ID NO: 1514269 - protein, 20 aa, Mycobacterium tuberculosis
KGGVGAAGGLAGQIGNGGSG

SEQ ID NO: 1514270 - protein, 22 aa, Mycobacterium tuberculosis
KIEEFILTLDRNGLATAYLFRC

SEQ ID NO: 1514271 - protein, 17 aa, Mycobacterium tuberculosis
KILSPHYSEYQVLEGGK

SEQ ID NO: 1514272 - protein, 22 aa, Mycobacterium tuberculosis
KLAPQRLIVVLGHDHQRIAPLV

SEQ ID NO: 1514273 - protein, 19 aa, Mycobacterium tuberculosis
KLLIGLLRDHGGQATVWDK

SEQ ID NO: 1514274 - protein, 18 aa, Mycobacterium tuberculosis
LALNWLCERQLPDGSWGA

SEQ ID NO: 1514275 - protein, 25 aa, Mycobacterium tuberculosis
LALSPTLIFDYPNSAALAGYMRREL

SEQ ID NO: 1514276 - protein, 24 aa, Mycobacterium tuberculosis
LAQRTRQVFLPVSRLKRDPHLEMH

SEQ ID NO: 1514277 - protein, 23 aa, Mycobacterium tuberculosis
LATVGSPLLMTYLLVDVSGARLT

SEQ ID NO: 1514278 - protein, 18 aa, Mycobacterium tuberculosis
LAVLLLENEGPVASATDT

SEQ ID NO: 1514279 - protein, 21 aa, Mycobacterium tuberculosis
LDACDRWSVGLSGGPDSLALT

SEQ ID NO: 1514280 - protein, 17 aa, Mycobacterium tuberculosis
LDAIKAVSALDLGLPLA

SEQ ID NO: 1514281 - protein, 29 aa, Mycobacterium tuberculosis
LDALARAGFHTLKLQTFLTAGPKEARAWT

SEQ ID NO: 1514282 - protein, 25 aa, Mycobacterium tuberculosis
LDTSSFYRPTQPGSYPIVLATYEIV

SEQ ID NO: 1514283 - protein, 17 aa, Mycobacterium tuberculosis
LEAFLRISVEHADAAGG

SEQ ID NO: 1514284 - protein, 40 aa, Mycobacterium tuberculosis
LERSLVHLGLKHYFLVDFPQEPGALRRFLDDVLGPNDDIT

SEQ ID NO: 1514285 - protein, 18 aa, Mycobacterium tuberculosis
LFEAWQRWRVQEGVPEIS

SEQ ID NO: 1514286 - protein, 25 aa, Mycobacterium tuberculosis
LGMAAASFSLLISGLTAGPGSAWQG

SEQ ID NO: 1514287 - protein, 26 aa, Mycobacterium tuberculosis
LGTLRVTRALLPKLIDSGDGLIVTVT

SEQ ID NO: 1514288 - protein, 29 aa, Mycobacterium tuberculosis
LGTPEIPAIPPFFPGFPPDYVTVSGQIGP

SEQ ID NO: 1514289 - protein, 17 aa, Mycobacterium tuberculosis
LLLLSHLEVINALGALE

SEQ ID NO: 1514290 - protein, 33 aa, Mycobacterium tuberculosis
LLVTDLASGWIPPHIRLPAHITLLEPAPRRRHA

SEQ ID NO: 1514291 - protein, 22 aa, Mycobacterium tuberculosis
LPRIARATKILDLARAYGIEVS

SEQ ID NO: 1514292 - protein, 23 aa, Mycobacterium tuberculosis
LRLVNWQRIRHRWNWTDVRRWLT

SEQ ID NO: 1514293 - protein, 22 aa, Mycobacterium tuberculosis
LRPAPGFFNATTGPSSGFLNWG

SEQ ID NO: 1514294 - protein, 31 aa, Mycobacterium tuberculosis; identical to SEQ ID NO: 225321

SEQ ID NO: 1514295 - protein, 19 aa, Mycobacterium tuberculosis
LRRILDTVARQEPGLSWAA

SEQ ID NO: 1514296 - protein, 17 aa, Mycobacterium tuberculosis
LRRRSLLAEVYSGRTGV

SEQ ID NO: 1514297 - protein, 20 aa, Mycobacterium tuberculosis
LSSSAWPWQPYLLSHHQGGI

SEQ ID NO: 1514298 - protein, 19 aa, Mycobacterium tuberculosis
LTLHVRRDLLPRVAQRLRD

SEQ ID NO: 1514299 - protein, 23 aa, Mycobacterium tuberculosis
LTQATCLFLDRQAFERLLATHPA

SEQ ID NO: 1514300 - protein, 17 aa, Mycobacterium tuberculosis
LTTDERLARAWPSAHAI

SEQ ID NO: 1514301 - protein, 32 aa, Mycobacterium tuberculosis; identical to SEQ ID NO: 226552

SEQ ID NO: 1514302 - protein, 18 aa, Mycobacterium tuberculosis
LVRHAHWPDWHPMRTDAG

SEQ ID NO: 1514303 - protein, 34 aa, Mycobacterium tuberculosis
LVVSQPCVLFPKLNPRIPRIWNITSLPSEMALAS

SEQ ID NO: 1514304 - protein, 20 aa, Mycobacterium tuberculosis
LWTGDYHGLVGFSFSIDIAG

SEQ ID NO: 1514305 - protein, 24 aa, Mycobacterium tuberculosis
MAKRLLDWPGGLTVFDVRVEAMAP

SEQ ID NO: 1514306 - protein, 17 aa, Mycobacterium tuberculosis
MFHRGTFVGTATPRAYP

SEQ ID NO: 1514307 - protein, 17 aa, Mycobacterium tuberculosis
MIGSWFAGTYESPGDLM

SEQ ID NO: 1514308 - protein, 21 aa, Mycobacterium tuberculosis
MLAMSAPYVEWLERTAAQTKQ

SEQ ID NO: 1514309 - protein, 17 aa, Mycobacterium tuberculosis
MPAGALLLSAVIAIQLD

SEQ ID NO: 1514310 - protein, 39 aa, Mycobacterium tuberculosis; identical to SEQ ID NO: 220796

SEQ ID NO: 1514311 - protein, 19 aa, Mycobacterium tuberculosis
NDCPVVIDFIVGADAQVWP

SEQ ID NO: 1514312 - protein, 30 aa, Mycobacterium tuberculosis
NGFSPAAIKALWDTILPFADYAFNKSHAAG

SEQ ID NO: 1514313 - protein, 28 aa, Mycobacterium tuberculosis
NGGDPGLGARLFQVGSRGGDGGVGGWLY

SEQ ID NO: 1514314 - protein, 20 aa, Mycobacterium tuberculosis
NLHHALALAGRHLRRHAGAQ

SEQ ID NO: 1514315 - protein, 18 aa, Mycobacterium tuberculosis
NSSMVTNWTVAPAGPGSS

SEQ ID NO: 1514316 - protein, 25 aa, Mycobacterium tuberculosis
NVDALFLFDVLLHQVSPDWDTILDM

SEQ ID NO: 1514317 - protein, 29 aa, Mycobacterium tuberculosis
PAANPLARAWLPGADLRAPCALPVLVIDG

SEQ ID NO: 1514318 - protein, 32 aa, Mycobacterium tuberculosis
PAHVIAAFDTELFGHWWYEGPTWLQRVLRALP

SEQ ID NO: 1514319 - protein, 33 aa, Mycobacterium tuberculosis; identical to SEQ ID NO: 221162

SEQ ID NO: 1514320 - protein, 18 aa, Mycobacterium tuberculosis
PEQIGYPDQGGYPEQRGY

SEQ ID NO: 1514321 - protein, 17 aa, Mycobacterium tuberculosis
PGGLNIPQNAIPLTIDA

SEQ ID NO: 1514322 - protein, 18 aa, Mycobacterium tuberculosis
PGMLITARALLDRNPDPD

SEQ ID NO: 1514323 - protein, 26 aa, Mycobacterium tuberculosis
PGVEFKDLTPLFADRRGLAAVTEALA

SEQ ID NO: 1514324 - protein, 23 aa, Mycobacterium tuberculosis
PLEPYLDILPHFDTLLVMSVEPG

SEQ ID NO: 1514325 - protein, 18 aa, Mycobacterium tuberculosis
PLGLDRYGVRFRIEARDG

SEQ ID NO: 1514326 - protein, 26 aa, Mycobacterium tuberculosis
PPYEQRPPVSPGPAAGYGAPGYDQGY

SEQ ID NO: 1514327 - protein, 22 aa, Mycobacterium tuberculosis
QAGGNGGWLWGNGGNGGSGAPG

SEQ ID NO: 1514328 - protein, 19 aa, Mycobacterium tuberculosis
QDTFYIAPEDSRQLLRTHT

SEQ ID NO: 1514329 - protein, 25 aa, Mycobacterium tuberculosis
QDYLANYHLAWYAVTTRRGGSRGFA

SEQ ID NO: 1514330 - protein, 19 aa, Mycobacterium tuberculosis
QHGPAFQGIVGLAVTQAGV

SEQ ID NO: 1514331 - protein, 31 aa, Mycobacterium tuberculosis; identical to SEQ ID NO: 221803

SEQ ID NO: 1514332 - protein, 17 aa, Mycobacterium tuberculosis
RACRAPSSLPAPLMARP

SEQ ID NO: 1514333 - protein, 17 aa, Mycobacterium tuberculosis
RDGMAGWYFTKWQRVLN

SEQ ID NO: 1514334 - protein, 17 aa, Mycobacterium tuberculosis
RDSHPIRIPSTLLGLLS

SEQ ID NO: 1514335 - protein, 19 aa, Mycobacterium tuberculosis
REQSRPELGYRLLQRLGAD

SEQ ID NO: 1514336 - protein, 17 aa, Mycobacterium tuberculosis
RERGVFLPLSTLKADPH

SEQ ID NO: 1514337 - protein, 24 aa, Mycobacterium tuberculosis
RETDKPFLMPVEDVFTITGRGTVV

SEQ ID NO: 1514338 - protein, 18 aa, Mycobacterium tuberculosis
RGLNVSALTQAAISAELE

SEQ ID NO: 1514339 - protein, 26 aa, Mycobacterium tuberculosis
RGVASVAFLPWPLRAVAGPFNLFATT

SEQ ID NO: 1514340 - protein, 19 aa, Mycobacterium tuberculosis
RILEEVWGFDFPTSGNALE

SEQ ID NO: 1514341 - protein, 25 aa, Mycobacterium tuberculosis
RIQPTQLLRVWVRDVRRLTPGHAAA

SEQ ID NO: 1514342 - protein, 23 aa, Mycobacterium tuberculosis
RLDAEILALVKRRAEVSKAIGTA

SEQ ID NO: 1514343 - protein, 27 aa, Mycobacterium tuberculosis
RLETICRQIMLYHLDRGWADHLAYLAD

SEQ ID NO: 1514344 - protein, 20 aa, Mycobacterium tuberculosis
RLGYIGLGNQGAPMAKRLLD

SEQ ID NO: 1514345 - protein, 22 aa, Mycobacterium tuberculosis
RLMRGLGSSIYPRNVDYRAFDE

SEQ ID NO: 1514346 - protein, 28 aa, Mycobacterium tuberculosis
RNGVAWVIAYRWFRAGLLPVPAQRVGRL

SEQ ID NO: 1514347 - protein, 27 aa, Mycobacterium tuberculosis
RPELGYRLLQRLGADVADYGFIETSAK

SEQ ID NO: 1514348 - protein, 18 aa, Mycobacterium tuberculosis
RPLDTEWIDRPTAFAARR

SEQ ID NO: 1514349 - protein, 20 aa, Mycobacterium tuberculosis
RPLDTEWIDRPTAFAARRAE

SEQ ID NO: 1514350 - protein, 17 aa, Mycobacterium tuberculosis
RPQRFQVTASRFGRSVD

SEQ ID NO: 1514351 - protein, 19 aa, Mycobacterium tuberculosis
RQMLRRVTIIDSGSTEFLP

SEQ ID NO: 1514352 - protein, 24 aa, Mycobacterium tuberculosis
RQQVLFCGLWYDDDFVRTPDGWRI

SEQ ID NO: 1514353 - protein, 24 aa, Mycobacterium tuberculosis
RRAAEILVYGHVLFELVSYVCCYN

SEQ ID NO: 1514354 - protein, 23 aa, Mycobacterium tuberculosis
RRAHGLPAISLGWGLWDQASAMT

SEQ ID NO: 1514355 - protein, 19 aa, Mycobacterium tuberculosis
RRASMPAGALLLSAVIAIQ

SEQ ID NO: 1514356 - protein, 18 aa, Mycobacterium tuberculosis
RSDRALVESLQTVLRDAT

SEQ ID NO: 1514357 - protein, 18 aa, Mycobacterium tuberculosis
RTDFHTEILRMQKAINAV

SEQ ID NO: 1514358 - protein, 19 aa, Mycobacterium tuberculosis
RTVVGQRIVFAPGAAHMSP

SEQ ID NO: 1514359 - protein, 20 aa, Mycobacterium tuberculosis
RYLDWLSKHSRQILRTARVI

SEQ ID NO: 1514360 - protein, 22 aa, Mycobacterium tuberculosis
SDERARLWPRPVDAYADFDSCQ

SEQ ID NO: 1514361 - protein, 18 aa, Mycobacterium tuberculosis
SFLDALAAHRRAHGLPAI

SEQ ID NO: 1514362 - protein, 27 aa, Mycobacterium tuberculosis
SGNYSNGFFWRGDYQGLIGLSTTITIP

SEQ ID NO: 1514363 - protein, 23 aa, Mycobacterium tuberculosis
SLARLPLILSDGHLRELALTGKN

SEQ ID NO: 1514364 - protein, 26 aa, Mycobacterium tuberculosis
SPGKFRQLGPVNWLVAKLAARAVGAP

SEQ ID NO: 1514365 - protein, 26 aa, Mycobacterium tuberculosis
SPRERPGRLLGFHWTKVHPDHPGLGE

SEQ ID NO: 1514366 - protein, 24 aa, Mycobacterium tuberculosis
SRLHTSLLDRHRPLWELHVVEGLN

SEQ ID NO: 1514367 - protein, 25 aa, Mycobacterium tuberculosis
SVIARLTGMHWWGPASTSMLAMSAP

SEQ ID NO: 1514368 - protein, 29 aa, Mycobacterium tuberculosis
SVLRGARPLFASRRLGIAGRRVLLATLTA

SEQ ID NO: 1514369 - protein, 19 aa, Mycobacterium tuberculosis
SVRAYLKQIGKVALLNAEE

SEQ ID NO: 1514370 - protein, 20 aa, Mycobacterium tuberculosis
SVRAYLKQIGKVALLNAEEE

SEQ ID NO: 1514371 - protein, 25 aa, Mycobacterium tuberculosis
SYPRSALSTYLAFDALIAHGDRHDR

SEQ ID NO: 1514372 - protein, 25 aa, Mycobacterium tuberculosis
TAWATQLRIMQAQLLAKIAAAVGND

SEQ ID NO: 1514373 - protein, 36 aa, Mycobacterium tuberculosis
TCDRSRLTADGLWLHCLYAISGINLREPLRAGATHD

SEQ ID NO: 1514374 - protein, 18 aa, Mycobacterium tuberculosis
TDRQALLLVTVAHPVAEV

SEQ ID NO: 1514375 - protein, 19 aa, Mycobacterium tuberculosis
TFHAEFVSLLNGGAAAYTG

SEQ ID NO: 1514376 - protein, 31 aa, Mycobacterium tuberculosis
TGAPQFEIVDPRPLTLLPEPNPGDLFFDFEG

SEQ ID NO: 1514377 - protein, 27 aa, Mycobacterium tuberculosis
TGDYQGLLDFSFPVGPLIPQTHLVHLR

SEQ ID NO: 1514378 - protein, 26 aa, Mycobacterium tuberculosis
TGGPYAHGWVTWFPPDAPPGTERFGS

SEQ ID NO: 1514379 - protein, 32 aa, Mycobacterium tuberculosis
TGHKWFTSAPMCDIFLVLAQAPDGLSCFLLPR

SEQ ID NO: 1514380 - protein, 18 aa, Mycobacterium tuberculosis
TGLLPHLNPGVMSWSEMS

SEQ ID NO: 1514381 - protein, 23 aa, Mycobacterium tuberculosis
TGNNINVLAPFTPGTLFTISEIP

SEQ ID NO: 1514382 - protein, 17 aa, Mycobacterium tuberculosis
TICVTIAIDRWRRTRSP

SEQ ID NO: 1514383 - protein, 24 aa, Mycobacterium tuberculosis
TIPGIPLSLNALGGVGPIVVPDIT

SEQ ID NO: 1514384 - protein, 17 aa, Mycobacterium tuberculosis
TLILGLPTGPERGEAAT

SEQ ID NO: 1514385 - protein, 18 aa, Mycobacterium tuberculosis
TPPLTVPGIHLPSTTIGA

SEQ ID NO: 1514386 - protein, 25 aa, Mycobacterium tuberculosis
TPTGYLGPPPVPTSSPPTTPAGAPA

SEQ ID NO: 1514387 - protein, 30 aa, Mycobacterium tuberculosis
TRVTIDRILGEPITLLGYAPETIIAEKGVT

SEQ ID NO: 1514388 - protein, 27 aa, Mycobacterium tuberculosis
TVARRGGIVILPQDLPIPAVKQTVAFV

SEQ ID NO: 1514389 - protein, 23 aa, Mycobacterium tuberculosis
TVGTRLMALRRLAHPDDAQLGPP

SEQ ID NO: 1514390 - protein, 18 aa, Mycobacterium tuberculosis
TVIGVNLTGTWRTLRATV

SEQ ID NO: 1514391 - protein, 23 aa, Mycobacterium tuberculosis
TVVPATVLTLVRTLLRAREGRTM

SEQ ID NO: 1514392 - protein, 18 aa, Mycobacterium tuberculosis
TYAAPLFVTAEFINNNTG

SEQ ID NO: 1514393 - protein, 21 aa, Mycobacterium tuberculosis
VAITEFVVSPLFGSPPAAELV

SEQ ID NO: 1514394 - protein, 17 aa, Mycobacterium tuberculosis
VALFGCLRRVHISRLVM

SEQ ID NO: 1514395 - protein, 26 aa, Mycobacterium tuberculosis
VAVRRISMSFVNVAPQLVSTAAADAA

SEQ ID NO: 1514396 - protein, 24 aa, Mycobacterium tuberculosis
VDLDLPRDALIVFTGLSGSGKSSL

SEQ ID NO: 1514397 - protein, 24 aa, Mycobacterium tuberculosis
VEGPIEALPIAAFSMMRAMSTRND

SEQ ID NO: 1514398 - protein, 23 aa, Mycobacterium tuberculosis
VELPTYAFQRRRFWLSGDGVAAD

SEQ ID NO: 1514399 - protein, 26 aa, Mycobacterium tuberculosis
VEVALPSRPVQVIGFTSVPGAGDNFL

SEQ ID NO: 1514400 - protein, 17 aa, Mycobacterium tuberculosis
VFTTAYYAFIHLADVQP

SEQ ID NO: 1514401 - protein, 26 aa, Mycobacterium tuberculosis
VGHVFRRAFSWLPAQFASQSDAPVGA

SEQ ID NO: 1514402 - protein, 18 aa, Mycobacterium tuberculosis
VIPGQTGMRELPFGVHVT

SEQ ID NO: 1514403 - protein, 18 aa, Mycobacterium tuberculosis
VLGICRGTQVLNVALGGT

SEQ ID NO: 1514404 - protein, 34 aa, Mycobacterium tuberculosis; identical to SEQ ID NO: 227090

SEQ ID NO: 1514405 - protein, 27 aa, Mycobacterium tuberculosis
VNPASWYRAVVISMRLPQRRHAVNRWS

SEQ ID NO: 1514406 - protein, 30 aa, Mycobacterium tuberculosis
VPAANPLARAWLPGADLRAPCALPVLVIDG

SEQ ID NO: 1514407 - protein, 28 aa, Mycobacterium tuberculosis
VRTDEQWRWLAHTLTVELLKELLPETAG

SEQ ID NO: 1514408 - protein, 26 aa, Mycobacterium tuberculosis
VSVDLPLAQLALQRLAAGLGVPHPDT

SEQ ID NO: 1514409 - protein, 24 aa, Mycobacterium tuberculosis
VTRMDYLSPFFNETAYCLGVEKLL

SEQ ID NO: 1514410 - protein, 36 aa, Mycobacterium tuberculosis; identical to SEQ ID NO: 224373

SEQ ID NO: 1514411 - protein, 30 aa, Mycobacterium tuberculosis; identical to SEQ ID NO: 224393

SEQ ID NO: 1514412 - protein, 26 aa, Mycobacterium tuberculosis
VVVDAINIPIIHIPATPGFGNSTGGL

SEQ ID NO: 1514413 - protein, 19 aa, Mycobacterium tuberculosis
VWGGFPAAVSWRSTSEQVH

SEQ ID NO: 1514414 - protein, 27 aa, Mycobacterium tuberculosis
WEPGNSLFITVNCWGRLVTGVGAALGK

SEQ ID NO: 1514415 - protein, 18 aa, Mycobacterium tuberculosis
WLHHCGDAAAFLGPVGAS

SEQ ID NO: 1514416 - protein, 23 aa, Mycobacterium tuberculosis
WVPNDYGLKIERAIDAYLETWPI

SEQ ID NO: 1514417 - protein, 18 aa, Mycobacterium tuberculosis
YAEMWAQDALAMYGYAAA

SEQ ID NO: 1514418 - protein, 17 aa, Mycobacterium tuberculosis
YAEPAGRDYDYGQSGAP

SEQ ID NO: 1514419 - protein, 19 aa, Mycobacterium tuberculosis
YATPVDQRGWSSRAPRIVF

SEQ ID NO: 1514420 - protein, 19 aa, Mycobacterium tuberculosis
YDDFFKRCFSIMPADGRMT

SEQ ID NO: 1514421 - protein, 17 aa, Mycobacterium tuberculosis
YNLILSNVPGPQAQLYF

SEQ ID NO: 1514422 - protein, 25 aa, Mycobacterium tuberculosis
YPNHDIATVVDWMLLAAINALIAGD

SEQ ID NO: 1514423 - protein, 23 aa, Mycobacterium tuberculosis
YQDKLLHVAGIGWHSWDGRRWAA

SEQ ID NO: 1514424 - protein, 25 aa, Mycobacterium tuberculosis
YTDAAQPIWWVVRAIEFSKDFETFV

SEQ ID NO: 1514425 - protein, 17 aa, Mycobacterium tuberculosis
YTTVMTVLQRLAKKNLV

SEQ ID NO: 1514426 - protein, 23 aa, Mycobacterium tuberculosis
AAATPLPVIGVPVPLGRLDGLDS

SEQ ID NO: 1514427 - protein, 25 aa, Mycobacterium tuberculosis
AAFHDQFVHTLTAAARWYTATEIAN

SEQ ID NO: 1514428 - protein, 35 aa, Mycobacterium tuberculosis; identical to SEQ ID NO: 225844

SEQ ID NO: 1514429 - protein, 40 aa, Mycobacterium tuberculosis; identical to SEQ ID NO: 215520

SEQ ID NO: 1514430 - protein, 17 aa, Mycobacterium tuberculosis
AALLQDWGVLPDLVMGH

SEQ ID NO: 1514431 - protein, 23 aa, Mycobacterium tuberculosis
AAPADQALLPTFRAFDLPRVRRI

SEQ ID NO: 1514432 - protein, 26 aa, Mycobacterium tuberculosis
AAVAQLAPWQQVLRNLGIDIGKNGQI

SEQ ID NO: 1514433 - protein, 22 aa, Mycobacterium tuberculosis
AAVSALMPFTQQLKKLAGLSER

SEQ ID NO: 1514434 - protein, 24 aa, Mycobacterium tuberculosis
ADAAGRYLDWLTKHSRQILETAYV

SEQ ID NO: 1514435 - protein, 17 aa, Mycobacterium tuberculosis
ADNPVLCDLILIRAALS

SEQ ID NO: 1514436 - protein, 18 aa, Mycobacterium tuberculosis
ADQYAQLSGLRLGKVISI

SEQ ID NO: 1514437 - protein, 23 aa, Mycobacterium tuberculosis
ADVYALQSALPPRFQASAAFAAN

SEQ ID NO: 1514438 - protein, 24 aa, Mycobacterium tuberculosis
AEICDGWLPIFYSPRMAGMYNEWL

SEQ ID NO: 1514439 - protein, 27 aa, Mycobacterium tuberculosis
AFDRIDERLVVVGLDNTVTYKNGDPTI

SEQ ID NO: 1514440 - protein, 21 aa, Mycobacterium tuberculosis
AFRAFYALPAENFKTRGGLTT

SEQ ID NO: 1514441 - protein, 19 aa, Mycobacterium tuberculosis
AFVQLVMTNLFGQNAPLIA

SEQ ID NO: 1514442 - protein, 22 aa, Mycobacterium tuberculosis
AGELALLRLACEAADAALTDLV

SEQ ID NO: 1514443 - protein, 26 aa, Mycobacterium tuberculosis
AGGAGRGLFLGLGGDGGAGGTSNNNG

SEQ ID NO: 1514444 - protein, 23 aa, Mycobacterium tuberculosis
AGGDAGLLFGSGGAGGAGGSGRT

SEQ ID NO: 1514445 - protein, 23 aa, Mycobacterium tuberculosis
AGGDGGLFFGVGGAGGAGGTGTN

SEQ ID NO: 1514446 - protein, 27 aa, Mycobacterium tuberculosis
AGGVGGRGGWLLGNGGTGGAGGAAGAT

SEQ ID NO: 1514447 - protein, 25 aa, Mycobacterium tuberculosis
AGLDARAYRLPWPAGTVVYEIDQPQ

SEQ ID NO: 1514448 - protein, 17 aa, Mycobacterium tuberculosis
AGSSRKAFGGDGGVGGD

SEQ ID NO: 1514449 - protein, 22 aa, Mycobacterium tuberculosis
AGSWPMAGTPAWRQLDDADPRK

SEQ ID NO: 1514450 - protein, 18 aa, Mycobacterium tuberculosis
AHATAWYGLNDLAQIKAG

SEQ ID NO: 1514451 - protein, 17 aa, Mycobacterium tuberculosis
AHEYLVDNGAYPSTLGY

SEQ ID NO: 1514452 - protein, 18 aa, Mycobacterium tuberculosis
AIGPLVDALAEHAARLRA

SEQ ID NO: 1514453 - protein, 19 aa, Mycobacterium tuberculosis
AKILSPHKTVLIPDQRAGC

SEQ ID NO: 1514454 - protein, 29 aa, Mycobacterium tuberculosis
AKRYTGRGMAFLDLIQEGNLGLIRAVEKF

SEQ ID NO: 1514455 - protein, 20 aa, Mycobacterium tuberculosis
AMLRRIRLTPAGPDTADTAA

SEQ ID NO: 1514456 - protein, 37 aa, Mycobacterium tuberculosis; identical to SEQ ID NO: 216181

SEQ ID NO: 1514457 - protein, 21 aa, Mycobacterium tuberculosis
ANKIFIEKAVDLGVQALAGAL

SEQ ID NO: 1514458 - protein, 18 aa, Mycobacterium tuberculosis
APGGVLYGNGGAGGQGSS

SEQ ID NO: 1514459 - protein, 20 aa, Mycobacterium tuberculosis
APLDAFVVRKLGAPGHDEFA

SEQ ID NO: 1514460 - protein, 17 aa, Mycobacterium tuberculosis
AQQRVIQAALANAGLSA

SEQ ID NO: 1514461 - protein, 20 aa, Mycobacterium tuberculosis
ARAVPRHPDLRWVDLGRRRS

SEQ ID NO: 1514462 - protein, 22 aa, Mycobacterium tuberculosis
ARVRVCTPTGRNSWTTVHVHGP

SEQ ID NO: 1514463 - protein, 23 aa, Mycobacterium tuberculosis
ARYAQRVMDWLHPDGDLTDTERA

SEQ ID NO: 1514464 - protein, 31 aa, Mycobacterium tuberculosis
ASDLSNILLLGPVGDLFPILSIPGAMSQNFT

SEQ ID NO: 1514465 - protein, 17 aa, Mycobacterium tuberculosis
ASFALAPKQQLIARLKE

SEQ ID NO: 1514466 - protein, 19 aa, Mycobacterium tuberculosis
ASIVVIRILGGYRAWQSGI

SEQ ID NO: 1514467 - protein, 23 aa, Mycobacterium tuberculosis
ASKSALMAAWTSLYDASKGDRGD

SEQ ID NO: 1514468 - protein, 22 aa, Mycobacterium tuberculosis
ASLREHTWKRSSFSGTEIFGKT

SEQ ID NO: 1514469 - protein, 17 aa, Mycobacterium tuberculosis
ASPFGMALVAATVAAGK

SEQ ID NO: 1514470 - protein, 23 aa, Mycobacterium tuberculosis
ATSFSARLFNLLITNAPGTQSQM

SEQ ID NO: 1514471 - protein, 27 aa, Mycobacterium tuberculosis
AVCLRALTTMPIPVIAAVRGLAVGGGC

SEQ ID NO: 1514472 - protein, 20 aa, Mycobacterium tuberculosis
AVLMLRHGLRFLTACQRRYG

SEQ ID NO: 1514473 - protein, 26 aa, Mycobacterium tuberculosis
AVPNYRGSCWIPFSIELEGDAASFVG

SEQ ID NO: 1514474 - protein, 20 aa, Mycobacterium tuberculosis
AVPPNSSWPNLDYPGLHALS

SEQ ID NO: 1514475 - protein, 18 aa, Mycobacterium tuberculosis
CHAFFQFYVADGRLSCQL

SEQ ID NO: 1514476 - protein, 19 aa, Mycobacterium tuberculosis
CNLACKFCQNWDISKSREI

SEQ ID NO: 1514477 - protein, 17 aa, Mycobacterium tuberculosis
CQQVWCPLCALAALVTG

SEQ ID NO: 1514478 - protein, 23 aa, Mycobacterium tuberculosis
DAGEPWTVSKLYYVHGFLRERMQ

SEQ ID NO: 1514479 - protein, 19 aa, Mycobacterium tuberculosis
DAILIRKVDWVDEITRVHA

SEQ ID NO: 1514480 - protein, 23 aa, Mycobacterium tuberculosis
DALALPYPGVLPQGPPPPKAFGT

SEQ ID NO: 1514481 - protein, 28 aa, Mycobacterium tuberculosis
DATRDFAIGLAGIPPSLQSALQALAAGD

SEQ ID NO: 1514482 - protein, 25 aa, Mycobacterium tuberculosis
DAVNAPTQTLLGRPLIGNGADGVAG

SEQ ID NO: 1514483 - protein, 26 aa, Mycobacterium tuberculosis
DEALRMDPQQRLLLEVSWEALEHAGI

SEQ ID NO: 1514484 - protein, 25 aa, Mycobacterium tuberculosis
DERDFPASAVRFFASARSQGRKLAF

SEQ ID NO: 1514485 - protein, 19 aa, Mycobacterium tuberculosis
DFRPKHKLAVLVVCAIPLA

SEQ ID NO: 1514486 - protein, 18 aa, Mycobacterium tuberculosis
DFVAVMRRLAAGHGRVDV

SEQ ID NO: 1514487 - protein, 27 aa, Mycobacterium tuberculosis
DFVEFTPSHTPLLITNHLPRVPGDDTA

SEQ ID NO: 1514488 - protein, 24 aa, Mycobacterium tuberculosis
DGGGRGIFGQFGAGGAGGAGGVGG

SEQ ID NO: 1514489 - protein, 21 aa, Mycobacterium tuberculosis
DGLMAFPEYSPAASAATFADL

SEQ ID NO: 1514490 - protein, 17 aa, Mycobacterium tuberculosis
DHLALRQRFGGARLVWS

SEQ ID NO: 1514491 - protein, 24 aa, Mycobacterium tuberculosis
DKSRPLWEMYLVEGLEKNRIALYT

SEQ ID NO: 1514492 - protein, 18 aa, Mycobacterium tuberculosis
DLGVFGLLKRFAKGRIVR

SEQ ID NO: 1514493 - protein, 28 aa, Mycobacterium tuberculosis
DLLVARRRPPAGDGWRKAVTKMTFGRVN

SEQ ID NO: 1514494 - protein, 17 aa, Mycobacterium tuberculosis
DLQTLEFAAFDRVPPGP

SEQ ID NO: 1514495 - protein, 20 aa, Mycobacterium tuberculosis
DLVDGAPKPLLEKVAKEAAD

SEQ ID NO: 1514496 - protein, 17 aa, Mycobacterium tuberculosis
DNAAFFHQVLPGRVAPL

SEQ ID NO: 1514497 - protein, 18 aa, Mycobacterium tuberculosis
DNVPMRTIMDRYGAVWQR

SEQ ID NO: 1514498 - protein, 24 aa, Mycobacterium tuberculosis
DPDRPLWECWIIEGLNGNRWAILI

SEQ ID NO: 1514499 - protein, 20 aa, Mycobacterium tuberculosis
DPYPYYRRLRDEAPLYRNEE

SEQ ID NO: 1514500 - protein, 25 aa, Mycobacterium tuberculosis
DQLKTDAKLLSSILTYHVIAGQASP

SEQ ID NO: 1514501 - protein, 21 aa, Mycobacterium tuberculosis
DSQLWLLQTRGAERSAQAAVR

SEQ ID NO: 1514502 - protein, 26 aa, Mycobacterium tuberculosis
DTVARLIGPAALKYLLFSGELIGIEE

SEQ ID NO: 1514503 - protein, 25 aa, Mycobacterium tuberculosis
DVASRLIRLPMWVGLQEVDQSRVVE

SEQ ID NO: 1514504 - protein, 22 aa, Mycobacterium tuberculosis
DVDAKLYGLPFGDGAYGAQDMS

SEQ ID NO: 1514505 - protein, 23 aa, Mycobacterium tuberculosis
DVDDALWRRFKAAQDSFFTARNA

SEQ ID NO: 1514506 - protein, 24 aa, Mycobacterium tuberculosis
DVLDELCLTIAPYVVGGLARRIVT

SEQ ID NO: 1514507 - protein, 20 aa, Mycobacterium tuberculosis
DVRPTVWGAVPRVWEKLKAG

SEQ ID NO: 1514508 - protein, 25 aa, Mycobacterium tuberculosis
DVSGGLPAFTLFPGGLNIPQNAIPL

SEQ ID NO: 1514509 - protein, 18 aa, Mycobacterium tuberculosis
DVSLRPRSLREFIGQPRV

SEQ ID NO: 1514510 - protein, 26 aa, Mycobacterium tuberculosis
DWWDASYLVMWGSNVPITRTPDAHWM

SEQ ID NO: 1514511 - protein, 18 aa, Mycobacterium tuberculosis
EALEIMLRIWTEDEPWEH

SEQ ID NO: 1514512 - protein, 19 aa, Mycobacterium tuberculosis
EALLAAATDLAAIRSTIRA

SEQ ID NO: 1514513 - protein, 31 aa, Mycobacterium tuberculosis; identical to SEQ ID NO: 226097

SEQ ID NO: 1514514 - protein, 19 aa, Mycobacterium tuberculosis
EALTMAASDLANIGSTINA

SEQ ID NO: 1514515 - protein, 25 aa, Mycobacterium tuberculosis
EALVESALWEASLFEEHGFGDIKIS

SEQ ID NO: 1514516 - protein, 18 aa, Mycobacterium tuberculosis
EAMLLMRAGREYALKRAL

SEQ ID NO: 1514517 - protein, 17 aa, Mycobacterium tuberculosis
EARVALGALLRRIRNYE

SEQ ID NO: 1514518 - protein, 18 aa, Mycobacterium tuberculosis
EDFPLHVAVYRRVIAEFN

SEQ ID NO: 1514519 - protein, 26 aa, Mycobacterium tuberculosis
EDGGYLAILDIRPFTRGHTLVLPKRH

SEQ ID NO: 1514520 - protein, 25 aa, Mycobacterium tuberculosis
EDRKPLLNAKLLVLGHLALNVYDPD

SEQ ID NO: 1514521 - protein, 20 aa, Mycobacterium tuberculosis
EFERPVLLFSGGKDSIVMLH

SEQ ID NO: 1514522 - protein, 22 aa, Mycobacterium tuberculosis
EGRPKHYWSIYQKMIVKGRDFD

SEQ ID NO: 1514523 - protein, 18 aa, Mycobacterium tuberculosis
EGVLFDNWLLAENGRFRE

SEQ ID NO: 1514524 - protein, 17 aa, Mycobacterium tuberculosis
EILILRVVVGLSAEETA

SEQ ID NO: 1514525 - protein, 22 aa, Mycobacterium tuberculosis
EKDRLLAPLLPEMAAPPHPRAP

SEQ ID NO: 1514526 - protein, 28 aa, Mycobacterium tuberculosis
ELLAVELSSFQLHWAPSLRPEAGAVLNI

SEQ ID NO: 1514527 - protein, 22 aa, Mycobacterium tuberculosis
ESLEQRGLLRRPIIPQGCSHNA

SEQ ID NO: 1514528 - protein, 26 aa, Mycobacterium tuberculosis
ETIMQPGMTFTIEPMINLGALDYEIW

SEQ ID NO: 1514529 - protein, 19 aa, Mycobacterium tuberculosis
EVARRWLAALSADQIGICD

SEQ ID NO: 1514530 - protein, 25 aa, Mycobacterium tuberculosis
EVDIRPKISLPDLSALTVSVDPIEI

SEQ ID NO: 1514531 - protein, 25 aa, Mycobacterium tuberculosis
EVLDFEPRTVWWGSANWTVRAGSHL

SEQ ID NO: 1514532 - protein, 27 aa, Mycobacterium tuberculosis
EVLRLRWRPGCMPLPQRVIRARVRGRQ

SEQ ID NO: 1514533 - protein, 17 aa, Mycobacterium tuberculosis
EVSLTGVPAYLGAQIAG

SEQ ID NO: 1514534 - protein, 19 aa, Mycobacterium tuberculosis
FAIGLAGIPPSLQSALQAL

SEQ ID NO: 1514535 - protein, 25 aa, Mycobacterium tuberculosis
FAVHFFRRELVARLATGWVLEEVHD

SEQ ID NO: 1514536 - protein, 25 aa, Mycobacterium tuberculosis
FERDAIPLLDQLYGGALRMTRNPAD

SEQ ID NO: 1514537 - protein, 32 aa, Mycobacterium tuberculosis; identical to SEQ ID NO: 226180

SEQ ID NO: 1514538 - protein, 18 aa, Mycobacterium tuberculosis
FHVHLHVLPRRNGDKLSV

SEQ ID NO: 1514539 - protein, 21 aa, Mycobacterium tuberculosis
FIEETLRYEPPFRGHYRHVRN

SEQ ID NO: 1514540 - protein, 19 aa, Mycobacterium tuberculosis
FIGGNFSNGAFWQSDHQGQ

SEQ ID NO: 1514541 - protein, 24 aa, Mycobacterium tuberculosis
FLNGEARLPLALPTSATGGIPVTV

SEQ ID NO: 1514542 - protein, 22 aa, Mycobacterium tuberculosis
FPANSLLNLDVFVGTPGATIPA

SEQ ID NO: 1514543 - protein, 19 aa, Mycobacterium tuberculosis
FPVVFVTGWEDGMFPHMRA

SEQ ID NO: 1514544 - protein, 18 aa, Mycobacterium tuberculosis
FQLLVYPMLDDRTSIAPA

SEQ ID NO: 1514545 - protein, 17 aa, Mycobacterium tuberculosis
FSMVMENRWLPMKRTAL

SEQ ID NO: 1514546 - protein, 17 aa, Mycobacterium tuberculosis
FVAFIAGIAPSATHRRS

SEQ ID NO: 1514547 - protein, 28 aa, Mycobacterium tuberculosis
GAAQLAGLKLLALGGRFIEIGKRDIYSN

SEQ ID NO: 1514548 - protein, 20 aa, Mycobacterium tuberculosis
GAHGKAGFGAPGGDGGDGGN

SEQ ID NO: 1514549 - protein, 24 aa, Mycobacterium tuberculosis
GAPGGPGGLLLGNGGNGGSGAPGQ

SEQ ID NO: 1514550 - protein, 23 aa, Mycobacterium tuberculosis
GARLFLHYGDLIDGTRLVTLLST

SEQ ID NO: 1514551 - protein, 21 aa, Mycobacterium tuberculosis
GAVFHYVPLHDSPAGRRYGRT

SEQ ID NO: 1514552 - protein, 25 aa, Mycobacterium tuberculosis
GDGGAGPLLIGNGGVGGLGGAGAAG

SEQ ID NO: 1514553 - protein, 22 aa, Mycobacterium tuberculosis
GDPEAAFAHFGRRFDDLSTEIM

SEQ ID NO: 1514554 - protein, 22 aa, Mycobacterium tuberculosis
GDTTIVVNGMLAPSTLGYGGNG

SEQ ID NO: 1514555 - protein, 24 aa, Mycobacterium tuberculosis
GDVPLIGFAGAPFTLASYLVEGGP

SEQ ID NO: 1514556 - protein, 21 aa, Mycobacterium tuberculosis
GELALLRLACEAADAALTDLV

SEQ ID NO: 1514557 - protein, 32 aa, Mycobacterium tuberculosis; identical to SEQ ID NO: 225059

SEQ ID NO: 1514558 - protein, 17 aa, Mycobacterium tuberculosis
GESRLFVPVLRSAINSH

SEQ ID NO: 1514559 - protein, 20 aa, Mycobacterium tuberculosis
GFRVPCIVISPYSRGPLMVS

SEQ ID NO: 1514560 - protein, 29 aa, Mycobacterium tuberculosis
GGAGAGIANFLGFSVLHGGAGGAGGTATG

SEQ ID NO: 1514561 - protein, 24 aa, Mycobacterium tuberculosis
GGAGGAGGWLWGNGGAGGNGGVGV

SEQ ID NO: 1514562 - protein, 26 aa, Mycobacterium tuberculosis
GGAGGNGAWLFGNGGAGGGGGKGGNG

SEQ ID NO: 1514563 - protein, 25 aa, Mycobacterium tuberculosis
GGAGGSAGLFYGSGGAGGNGGYSLN

SEQ ID NO: 1514564 - protein, 25 aa, Mycobacterium tuberculosis
GGDPGLGARLFQVGSRGGDGGVGGW

SEQ ID NO: 1514565 - protein, 24 aa, Mycobacterium tuberculosis
GGEGKRLYPLTADRAKPAVPFGGA

SEQ ID NO: 1514566 - protein, 20 aa, Mycobacterium tuberculosis
GGFGGSGGRGGLLLGTGGAG

SEQ ID NO: 1514567 - protein, 27 aa, Mycobacterium tuberculosis
GGNATSTSSIPFDAHGGNGGAGGDAGH

SEQ ID NO: 1514568 - protein, 24 aa, Mycobacterium tuberculosis
GGPAVAGVLGGMPGAGGNGGNANW

SEQ ID NO: 1514569 - protein, 21 aa, Mycobacterium tuberculosis
GGPLWWPKCPKVIRCRSPAST

SEQ ID NO: 1514570 - protein, 17 aa, Mycobacterium tuberculosis
GICFGNQILGRALGLST

SEQ ID NO: 1514571 - protein, 29 aa, Mycobacterium tuberculosis
GKRRATIEQLLTIPLAKELAWAPDEIREE

SEQ ID NO: 1514572 - protein, 22 aa, Mycobacterium tuberculosis
GLATAYLFRCLSCGVHLAYADF

SEQ ID NO: 1514573 - protein, 19 aa, Mycobacterium tuberculosis
GLDLDASLRLWERGEQLAK

SEQ ID NO: 1514574 - protein, 21 aa, Mycobacterium tuberculosis
GLDLDASLRLWERGEQLAKRC

SEQ ID NO: 1514575 - protein, 17 aa, Mycobacterium tuberculosis
GLFLNWVDRVIGPGDPA

SEQ ID NO: 1514576 - protein, 27 aa, Mycobacterium tuberculosis
GLGGDGFTYLADFDGEPGGDGGDGGDG

SEQ ID NO: 1514577 - protein, 18 aa, Mycobacterium tuberculosis
GLTGRPPRAIPDPTPRSS

SEQ ID NO: 1514578 - protein, 27 aa, Mycobacterium tuberculosis
GLVAYRRSRGLAGLSVAWGLWEQASAM

SEQ ID NO: 1514579 - protein, 19 aa, Mycobacterium tuberculosis
GNGGLPFIGSTNAGNGGSA

SEQ ID NO: 1514580 - protein, 17 aa, Mycobacterium tuberculosis
GNYEGLAGFSFGYPIPL

SEQ ID NO: 1514581 - protein, 17 aa, Mycobacterium tuberculosis
GPINIPPITLNSIGLEL

SEQ ID NO: 1514582 - protein, 28 aa, Mycobacterium tuberculosis
GPMLAAAAAWDGLAAELGLAAESFGLVT

SEQ ID NO: 1514583 - protein, 27 aa, Mycobacterium tuberculosis
GQYGAPPIAIGPLYQPKTLQLCADGDS

SEQ ID NO: 1514584 - protein, 19 aa, Mycobacterium tuberculosis
GSMVELVPHLFGPNRRPTG

SEQ ID NO: 1514585 - protein, 31 aa, Mycobacterium tuberculosis
GTTGGSGGAGGLIGWAGAAGGTGAGGTGGQG

SEQ ID NO: 1514586 - protein, 26 aa, Mycobacterium tuberculosis
GVGGATGLIGSGGFGGAGGAAAGVGT

SEQ ID NO: 1514587 - protein, 20 aa, Mycobacterium tuberculosis
GVGGVFGNGGFGGAGGLGAA

SEQ ID NO: 1514588 - protein, 17 aa, Mycobacterium tuberculosis
GVPRPYWRSKPISVVEL

SEQ ID NO: 1514589 - protein, 28 aa, Mycobacterium tuberculosis
HAGTGGRGGLLAGQHANSGNGGGGGTGG

SEQ ID NO: 1514590 - protein, 20 aa, Mycobacterium tuberculosis
HAKCMSMRLAHRLQILLDDE

SEQ ID NO: 1514591 - protein, 24 aa, Mycobacterium tuberculosis
HDPLVQGLRALGHRVNLAEQSSGL

SEQ ID NO: 1514592 - protein, 23 aa, Mycobacterium tuberculosis
HGGNAILFGQGGAGGPGGTGAMG

SEQ ID NO: 1514593 - protein, 17 aa, Mycobacterium tuberculosis
HLRLISGDRITTLALDQ

SEQ ID NO: 1514594 - protein, 19 aa, Mycobacterium tuberculosis
HLVARMRAAGISVVCGLPT

SEQ ID NO: 1514595 - protein, 21 aa, Mycobacterium tuberculosis
HSEAPPFFVLHGEKDPMVPSA

SEQ ID NO: 1514596 - protein, 23 aa, Mycobacterium tuberculosis
IAVAHKLIVIIWHVLATGRPYQD

SEQ ID NO: 1514597 - protein, 20 aa, Mycobacterium tuberculosis
ICHRLDGIPLAIELAASRVR

SEQ ID NO: 1514598 - protein, 37 aa, Mycobacterium tuberculosis; identical to SEQ ID NO: 219401

SEQ ID NO: 1514599 - protein, 25 aa, Mycobacterium tuberculosis
IIANRISYFLDIQGPSIVIDTACSS

SEQ ID NO: 1514600 - protein, 18 aa, Mycobacterium tuberculosis
IIGAEALLRWEHPTLGTL

SEQ ID NO: 1514601 - protein, 18 aa, Mycobacterium tuberculosis
ILEHFPMSDYAPSKVDLN

SEQ ID NO: 1514602 - protein, 17 aa, Mycobacterium tuberculosis
ILPSYTFVSTANAFVLR

SEQ ID NO: 1514603 - protein, 17 aa, Mycobacterium tuberculosis
IPDFVKLAEALGCVGLR

SEQ ID NO: 1514604 - protein, 17 aa, Mycobacterium tuberculosis
IRIPSTLLGLLSEIPRC

SEQ ID NO: 1514605 - protein, 25 aa, Mycobacterium tuberculosis
IRTILQSLWANFYELLADAYGRGIR

SEQ ID NO: 1514606 - protein, 28 aa, Mycobacterium tuberculosis
ITAKMTARYSQWVRSRPLLLAGKSVTGA

SEQ ID NO: 1514607 - protein, 23 aa, Mycobacterium tuberculosis
KIKAHAIALAETLPTACVLGDVD

SEQ ID NO: 1514608 - protein, 18 aa, Mycobacterium tuberculosis
KLGPVRPYGFLLICPVRS

SEQ ID NO: 1514609 - protein, 22 aa, Mycobacterium tuberculosis
KSHGWGVPGLSWLPGEDPDPFG

SEQ ID NO: 1514610 - protein, 23 aa, Mycobacterium tuberculosis
KTRQVVLALADWLRDETLPAPDT

SEQ ID NO: 1514611 - protein, 26 aa, Mycobacterium tuberculosis
KVINPFDFFIEDWAEIWPCAGMAYPK

SEQ ID NO: 1514612 - protein, 30 aa, Mycobacterium tuberculosis
KVTKRGGGAALPFKRRLFGQIVAAAVRATE

SEQ ID NO: 1514613 - protein, 17 aa, Mycobacterium tuberculosis
LAAFTAIVPCGISDAAV

SEQ ID NO: 1514614 - protein, 18 aa, Mycobacterium tuberculosis
LAALIDEPRFVRSPAAAV

SEQ ID NO: 1514615 - protein, 23 aa, Mycobacterium tuberculosis
LAARGLRRILTEGGPTLLGTFVE

SEQ ID NO: 1514616 - protein, 21 aa, Mycobacterium tuberculosis
LADIALRRPSLDDVFLAMTTD

SEQ ID NO: 1514617 - protein, 23 aa, Mycobacterium tuberculosis
LAKPAGIYQLTDANWMAIMGDRT

SEQ ID NO: 1514618 - protein, 20 aa, Mycobacterium tuberculosis
LALRQRFGGARLVWSGHWTT

SEQ ID NO: 1514619 - protein, 18 aa, Mycobacterium tuberculosis
LARAVASVYDEYQRRLRA

SEQ ID NO: 1514620 - protein, 37 aa, Mycobacterium tuberculosis; identical to SEQ ID NO: 219918

SEQ ID NO: 1514621 - protein, 23 aa, Mycobacterium tuberculosis
LATARWVDWFNHRRLYQYCGDVP

SEQ ID NO: 1514622 - protein, 25 aa, Mycobacterium tuberculosis
LDGLDSLLSIVQMPAGVPVATVSIG

SEQ ID NO: 1514623 - protein, 25 aa, Mycobacterium tuberculosis
LDVLAQAQRPLLVLGKGAAYAQADN

SEQ ID NO: 1514624 - protein, 19 aa, Mycobacterium tuberculosis
LEIPAIPINAQLFSMPIHQ

SEQ ID NO: 1514625 - protein, 22 aa, Mycobacterium tuberculosis
LFCPDQFLGAHVRRVTGRKNLH

SEQ ID NO: 1514626 - protein, 17 aa, Mycobacterium tuberculosis
LFNPAAVPIRRYRYRGN

SEQ ID NO: 1514627 - protein, 23 aa, Mycobacterium tuberculosis
LGADPLPFLRRFDIPPGIEHQED

SEQ ID NO: 1514628 - protein, 17 aa, Mycobacterium tuberculosis
LGAHVRRVTGRKNLHVW

SEQ ID NO: 1514629 - protein, 26 aa, Mycobacterium tuberculosis
LGAINAPTMALLGRPLIGHGADGAPG

SEQ ID NO: 1514630 - protein, 33 aa, Mycobacterium tuberculosis; identical to SEQ ID NO: 220116

SEQ ID NO: 1514631 - protein, 18 aa, Mycobacterium tuberculosis
LGRRVVYRRDEVSRWISK

SEQ ID NO: 1514632 - protein, 23 aa, Mycobacterium tuberculosis
LHDHVIQRLFAIGLALQGAVPHE

SEQ ID NO: 1514633 - protein, 19 aa, Mycobacterium tuberculosis
LIDEPRFVRSPAAAVTNSG

SEQ ID NO: 1514634 - protein, 17 aa, Mycobacterium tuberculosis
LKGLFRLKSNCPSALND

SEQ ID NO: 1514635 - protein, 27 aa, Mycobacterium tuberculosis
LKIGPITGLFNTPIGLTPLALSQIVIG

SEQ ID NO: 1514636 - protein, 18 aa, Mycobacterium tuberculosis
LLATIRYVRDRTGDPNAW

SEQ ID NO: 1514637 - protein, 27 aa, Mycobacterium tuberculosis
LLDDIRAFLRRFVVYPSDHELIAHTLW

SEQ ID NO: 1514638 - protein, 19 aa, Mycobacterium tuberculosis
LLFETGIPTRYYIDPADIA

SEQ ID NO: 1514639 - protein, 18 aa, Mycobacterium tuberculosis
LLHHSVGTMTLNFGLANV

SEQ ID NO: 1514640 - protein, 29 aa, Mycobacterium tuberculosis
LNALNAPTQALLGRPLIGDGAAGAPGTGQ

SEQ ID NO: 1514641 - protein, 17 aa, Mycobacterium tuberculosis
LPAVAHLHPRRVRGQPG

SEQ ID NO: 1514642 - protein, 26 aa, Mycobacterium tuberculosis
LPHLRAWDGAPWIWNLATAILPEATP

SEQ ID NO: 1514643 - protein, 35 aa, Mycobacterium tuberculosis; identical to SEQ ID NO: 225311

SEQ ID NO: 1514644 - protein, 20 aa, Mycobacterium tuberculosis
LRGCYRIAVLSLKGGVGKTT

SEQ ID NO: 1514645 - protein, 24 aa, Mycobacterium tuberculosis
LRNRDQWDLLQRDPSLLPGAIEEM

SEQ ID NO: 1514646 - protein, 25 aa, Mycobacterium tuberculosis
LRSSRRHSLRYSAYTGGPDPLAPPV

SEQ ID NO: 1514647 - protein, 19 aa, Mycobacterium tuberculosis
LTALGLAAPRVSPPASLAA

SEQ ID NO: 1514648 - protein, 23 aa, Mycobacterium tuberculosis
LTGGVLKPILWGPGKATAVQRFA

SEQ ID NO: 1514649 - protein, 17 aa, Mycobacterium tuberculosis
MAARLGLAGWPRAAEES

SEQ ID NO: 1514650 - protein, 17 aa, Mycobacterium tuberculosis
MARQGIVLLQNRGLLPL

SEQ ID NO: 1514651 - protein, 20 aa, Mycobacterium tuberculosis
MGMHPAVLDAVLHALGLAVE

SEQ ID NO: 1514652 - protein, 26 aa, Mycobacterium tuberculosis
MLVAGEDPRFIARRLMILASEDIGMA

SEQ ID NO: 1514653 - protein, 22 aa, Mycobacterium tuberculosis
MMPALLDFWMDADSVYLSPAPM

SEQ ID NO: 1514654 - protein, 25 aa, Mycobacterium tuberculosis
MVGGVSIPLIKIPAAPGFGNSTTSP

SEQ ID NO: 1514655 - protein, 23 aa, Mycobacterium tuberculosis
MWDIRNRGVIPAGALPRVRAFVD

SEQ ID NO: 1514656 - protein, 20 aa, Mycobacterium tuberculosis
NAHMYYVLLAPSADREEVLA

SEQ ID NO: 1514657 - protein, 24 aa, Mycobacterium tuberculosis
NAYVSWTRSALSDLPRWREPPQIY

SEQ ID NO: 1514658 - protein, 29 aa, Mycobacterium tuberculosis
NGGAGGTAGWFFGFGGNGGAGGIGVAGIN

SEQ ID NO: 1514659 - protein, 17 aa, Mycobacterium tuberculosis
NKIILFGARTGLDGIGG

SEQ ID NO: 1514660 - protein, 20 aa, Mycobacterium tuberculosis
NKRHAYFRSISKTPHIRARG

SEQ ID NO: 1514661 - protein, 22 aa, Mycobacterium tuberculosis
NLGLIRAMEKFDYTKGFKFSTY

SEQ ID NO: 1514662 - protein, 27 aa, Mycobacterium tuberculosis
NLTGVMTFGLPLAMTLNAVGSPITTAI

SEQ ID NO: 1514663 - protein, 26 aa, Mycobacterium tuberculosis
NPVLCDLILIRAALSPKTARLGAQEM

SEQ ID NO: 1514664 - protein, 20 aa, Mycobacterium tuberculosis
NQTITLAWPVSSITIPQIQQ

SEQ ID NO: 1514665 - protein, 23 aa, Mycobacterium tuberculosis
PAGMTGMPMVPPGALGAGAEGAN

SEQ ID NO: 1514666 - protein, 20 aa, Mycobacterium tuberculosis
PAIALAQFYDVPMVSTIHAT

SEQ ID NO: 1514667 - protein, 17 aa, Mycobacterium tuberculosis
PAKQREILILRVVVGLS

SEQ ID NO: 1514668 - protein, 25 aa, Mycobacterium tuberculosis
PAVTLSWIREFPSLGAAAYPVQRRG

SEQ ID NO: 1514669 - protein, 39 aa, Mycobacterium tuberculosis
PDHSFFGLLWADVKFEWHALPYLLGFKKACAGFRSLGRG

SEQ ID NO: 1514670 - protein, 27 aa, Mycobacterium tuberculosis
PDRANFTQLLSRGSWWRIHSPPVVAEP

SEQ ID NO: 1514671 - protein, 27 aa, Mycobacterium tuberculosis
PDVVHAHDWLVAHPAIALAQFYDVPMV

SEQ ID NO: 1514672 - protein, 47 aa, Mycobacterium tuberculosis; identical to SEQ ID NO: 221142

SEQ ID NO: 1514673 - protein, 18 aa, Mycobacterium tuberculosis
PEVLWLAQRARQAWDGVR

SEQ ID NO: 1514674 - protein, 19 aa, Mycobacterium tuberculosis
PFKRRLFGQIVAAAVRATE

SEQ ID NO: 1514675 - protein, 17 aa, Mycobacterium tuberculosis
PGAGGTSGLLIGENGLN

SEQ ID NO: 1514676 - protein, 24 aa, Mycobacterium tuberculosis
PGPVAPRLLPLPHLRAWDGAPWIW

SEQ ID NO: 1514677 - protein, 20 aa, Mycobacterium tuberculosis
PGRHQLFMHACDLSRLPDGT

SEQ ID NO: 1514678 - protein, 23 aa, Mycobacterium tuberculosis
PGRLSSRFWRLLGASTEKNRSRS

SEQ ID NO: 1514679 - protein, 37 aa, Mycobacterium tuberculosis
PGSVMTIPGMRLPFTSIVPFVVYYGPVELPQSTLTLP

SEQ ID NO: 1514680 - protein, 26 aa, Mycobacterium tuberculosis
PGTPPATLLDYFPEDFLLVIDESHVT

SEQ ID NO: 1514681 - protein, 17 aa, Mycobacterium tuberculosis
PHAWYLSDGILARDDYN

SEQ ID NO: 1514682 - protein, 17 aa, Mycobacterium tuberculosis
PIGTTIFELDRPQVLDF

SEQ ID NO: 1514683 - protein, 22 aa, Mycobacterium tuberculosis
PLRPASPRLRSSRRHSLRYSAY

SEQ ID NO: 1514684 - protein, 23 aa, Mycobacterium tuberculosis
PLTDLPVAGYPLVPRVAKPRYRC

SEQ ID NO: 1514685 - protein, 28 aa, Mycobacterium tuberculosis
PMMPVIADQPIITAIKPAARPAPHFCDV

SEQ ID NO: 1514686 - protein, 18 aa, Mycobacterium tuberculosis
PPGPIPGTGGQPLQPFKP

SEQ ID NO: 1514687 - protein, 24 aa, Mycobacterium tuberculosis
PQSTSWAQRWLAATGSRDYLGAFV

SEQ ID NO: 1514688 - protein, 17 aa, Mycobacterium tuberculosis
PRVIKRWRRGKPLADAE

SEQ ID NO: 1514689 - protein, 27 aa, Mycobacterium tuberculosis
PSAFNTIIDKWLPLSWSLNMVNRSMGH

SEQ ID NO: 1514690 - protein, 20 aa, Mycobacterium tuberculosis
PSTVRLFPVDGAVSPTITPA

SEQ ID NO: 1514691 - protein, 25 aa, Mycobacterium tuberculosis
PSYSALSSRQWALAGLTPLRHWRSA

SEQ ID NO: 1514692 - protein, 23 aa, Mycobacterium tuberculosis
PTASRAVSWWSVHEHVAPVLDAA

SEQ ID NO: 1514693 - protein, 22 aa, Mycobacterium tuberculosis
PTHIETLLRPSLQPETRLAAPL

SEQ ID NO: 1514694 - protein, 55 aa, Mycobacterium tuberculosis; identical to SEQ ID NO: 221475

SEQ ID NO: 1514695 - protein, 19 aa, Mycobacterium tuberculosis
PVEGGGNQDWWPNRLNLKV

SEQ ID NO: 1514696 - protein, 23 aa, Mycobacterium tuberculosis
PVTIPGFAINPFGLDVPLSGGTN

SEQ ID NO: 1514697 - protein, 26 aa, Mycobacterium tuberculosis
PVTIPGFAINPFGLNVPLSGGTSPVT

SEQ ID NO: 1514698 - protein, 17 aa, Mycobacterium tuberculosis
QCRLPAPQYPVPAQGRH

SEQ ID NO: 1514699 - protein, 26 aa, Mycobacterium tuberculosis
QETFLRAIGAIPRFSARSSARTWLLA

SEQ ID NO: 1514700 - protein, 22 aa, Mycobacterium tuberculosis
QFDQVIAVHLKGTWNGTRLAAA

SEQ ID NO: 1514701 - protein, 24 aa, Mycobacterium tuberculosis
QHQMWAAQFIRYEKPRSWLNSGGL

SEQ ID NO: 1514702 - protein, 29 aa, Mycobacterium tuberculosis
QIARTGHMPVRRLDLIWISARNAARRELD

SEQ ID NO: 1514703 - protein, 18 aa, Mycobacterium tuberculosis
QLHRATADQPLDWFCSFS

SEQ ID NO: 1514704 - protein, 17 aa, Mycobacterium tuberculosis
QLRRRLRIGVQLGSRVV

SEQ ID NO: 1514705 - protein, 17 aa, Mycobacterium tuberculosis
QMKHIGIYGLAIDEQYG

SEQ ID NO: 1514706 - protein, 20 aa, Mycobacterium tuberculosis
QPLLIVSSDLRRAYDTAVKL

SEQ ID NO: 1514707 - protein, 24 aa, Mycobacterium tuberculosis
QRALRLPFSRLLATLPISATPDGV

SEQ ID NO: 1514708 - protein, 17 aa, Mycobacterium tuberculosis
QRFQVTASRFGRSVDVA

SEQ ID NO: 1514709 - protein, 18 aa, Mycobacterium tuberculosis
QRIMLYAKDSGCSAPGCD

SEQ ID NO: 1514710 - protein, 33 aa, Mycobacterium tuberculosis
QSQGPISRRLALTALGFGVLAPNVLVACAGKVT

SEQ ID NO: 1514711 - protein, 32 aa, Mycobacterium tuberculosis; identical to SEQ ID NO: 221846

SEQ ID NO: 1514712 - protein, 26 aa, Mycobacterium tuberculosis
QVAPFLSYGQFTGSAPRDLCALWPVP

SEQ ID NO: 1514713 - protein, 19 aa, Mycobacterium tuberculosis
QYRYFHAPYPEPIERLKQA

SEQ ID NO: 1514714 - protein, 17 aa, Mycobacterium tuberculosis
RCRRTLRAIIAAARLNP

SEQ ID NO: 1514715 - protein, 19 aa, Mycobacterium tuberculosis
RDEMVARFQSGDGPPIFLL

SEQ ID NO: 1514716 - protein, 23 aa, Mycobacterium tuberculosis
RDFRSWACVDLELHPGRTVFVGP

SEQ ID NO: 1514717 - protein, 22 aa, Mycobacterium tuberculosis
RDGRLGTVGKLLPGLQGKIAED

SEQ ID NO: 1514718 - protein, 27 aa, Mycobacterium tuberculosis
RDGVRIAIDLYLPAGLTSAARLPAILH

SEQ ID NO: 1514719 - protein, 21 aa, Mycobacterium tuberculosis
RDIEWRIGPGERIGIVGANGA

SEQ ID NO: 1514720 - protein, 29 aa, Mycobacterium tuberculosis
RDRQWGFVNAWVSFYAAGLFAMNNGVPWS

SEQ ID NO: 1514721 - protein, 23 aa, Mycobacterium tuberculosis
RDSLLTTHPLPNIGRVVITGNPV

SEQ ID NO: 1514722 - protein, 19 aa, Mycobacterium tuberculosis
REILILRVVVGLSAEETAA

SEQ ID NO: 1514723 - protein, 19 aa, Mycobacterium tuberculosis
REYVLPTFRMFGMTKFYKH

SEQ ID NO: 1514724 - protein, 18 aa, Mycobacterium tuberculosis
RGKTFAQSVIRRAALART

SEQ ID NO: 1514725 - protein, 17 aa, Mycobacterium tuberculosis
RGLVRLRAVLPLIDGGA

SEQ ID NO: 1514726 - protein, 30 aa, Mycobacterium tuberculosis; identical to SEQ ID NO: 222173

SEQ ID NO: 1514727 - protein, 18 aa, Mycobacterium tuberculosis
RHQLNRYPDGLEKCIGCE

SEQ ID NO: 1514728 - protein, 21 aa, Mycobacterium tuberculosis
RKVARLMEWCAMVGCPIVGIN

SEQ ID NO: 1514729 - protein, 17 aa, Mycobacterium tuberculosis
RLATLGPLLQDLEARII

SEQ ID NO: 1514730 - protein, 17 aa, Mycobacterium tuberculosis
RLIAGLDDAVVGLSADE

SEQ ID NO: 1514731 - protein, 26 aa, Mycobacterium tuberculosis
RLKQALYPKLLPIARNWWAKLGREAP

SEQ ID NO: 1514732 - protein, 20 aa, Mycobacterium tuberculosis
RLLSIPLRHLYAALWRVGLL

SEQ ID NO: 1514733 - protein, 18 aa, Mycobacterium tuberculosis
RLMILASEDIGMADPSAL

SEQ ID NO: 1514734 - protein, 23 aa, Mycobacterium tuberculosis
RLTSDLYGWLTTVARSGQPVPRL

SEQ ID NO: 1514735 - protein, 17 aa, Mycobacterium tuberculosis
RNPLRFAAPCPGQHGWR

SEQ ID NO: 1514736 - protein, 20 aa, Mycobacterium tuberculosis
RPGERHWMAFRQLASDVDAN

SEQ ID NO: 1514737 - protein, 21 aa, Mycobacterium tuberculosis
RRASMPAGALLLSAVIAIQLD

SEQ ID NO: 1514738 - protein, 23 aa, Mycobacterium tuberculosis
RRAVRQWLVRWAAHPGRATRGFH

SEQ ID NO: 1514739 - protein, 19 aa, Mycobacterium tuberculosis
RRLKRLLDDLAGESGLRAV

SEQ ID NO: 1514740 - protein, 20 aa, Mycobacterium tuberculosis
RRTLRAIIAAARLNPTQLDP

SEQ ID NO: 1514741 - protein, 23 aa, Mycobacterium tuberculosis
RSDMVVYWWRGSGGGPRVGLIIA

SEQ ID NO: 1514742 - protein, 20 aa, Mycobacterium tuberculosis
RSSVYWRLMALDQRFGIADR

SEQ ID NO: 1514743 - protein, 23 aa, Mycobacterium tuberculosis
RTILQSLWANFYELLADAYGRGI

SEQ ID NO: 1514744 - protein, 22 aa, Mycobacterium tuberculosis
RTPGFERTLLGRALDFWNEEVY

SEQ ID NO: 1514745 - protein, 25 aa, Mycobacterium tuberculosis
RVRPVSSAQFPRPAPRPSYSALSSR

SEQ ID NO: 1514746 - protein, 18 aa, Mycobacterium tuberculosis
RVVAPHRLTDPKAGPLIA

SEQ ID NO: 1514747 - protein, 18 aa, Mycobacterium tuberculosis
RVVVMPWDRHIAAGTEIS

SEQ ID NO: 1514748 - protein, 27 aa, Mycobacterium tuberculosis
RWSAVLVGPWWPAPSAALRAAAQHWAT

SEQ ID NO: 1514749 - protein, 22 aa, Mycobacterium tuberculosis
SAASDLLGLASGGLLPAAEEAA

SEQ ID NO: 1514750 - protein, 22 aa, Mycobacterium tuberculosis
SAVPAGPLPAYGSDLRPPVVAA

SEQ ID NO: 1514751 - protein, 18 aa, Mycobacterium tuberculosis
SCCFAGAALSLVAGQFGG

SEQ ID NO: 1514752 - protein, 21 aa, Mycobacterium tuberculosis
SCIDTFPEVLWLAQRARQAWD

SEQ ID NO: 1514753 - protein, 22 aa, Mycobacterium tuberculosis
SDGVPVLYRPSDLATLTDGAGP

SEQ ID NO: 1514754 - protein, 25 aa, Mycobacterium tuberculosis
SDQEIMAFLFLMVIAGNETTTKLLA

SEQ ID NO: 1514755 - protein, 17 aa, Mycobacterium tuberculosis
SFYHYYALMTGRAVPQE

SEQ ID NO: 1514756 - protein, 24 aa, Mycobacterium tuberculosis
SGGNAGLLALGASGGAGGSGGSAL

SEQ ID NO: 1514757 - protein, 19 aa, Mycobacterium tuberculosis
SGRYPQAIFDHGTPLALYH

SEQ ID NO: 1514758 - protein, 21 aa, Mycobacterium tuberculosis
SLDDLAKRLIVLVEPVEAIVD

SEQ ID NO: 1514759 - protein, 21 aa, Mycobacterium tuberculosis
SLQPETRLAAPLLAKGLPACP

SEQ ID NO: 1514760 - protein, 18 aa, Mycobacterium tuberculosis
SNGMLWRGDHEGLFGLSY

SEQ ID NO: 1514761 - protein, 24 aa, Mycobacterium tuberculosis
SPVTGLVFVTNFDSNTVSVIDPTT

SEQ ID NO: 1514762 - protein, 26 aa, Mycobacterium tuberculosis
SPVTIPGFAINPFGLDVPLSGGTNAV

SEQ ID NO: 1514763 - protein, 34 aa, Mycobacterium tuberculosis
SSSARARRLYASRGWLPWHGPTSVLAPTGPVRTP

SEQ ID NO: 1514764 - protein, 24 aa, Mycobacterium tuberculosis
STEYDVERYFRDAPLMILGEGTNE

SEQ ID NO: 1514765 - protein, 18 aa, Mycobacterium tuberculosis
STWDCDIALVGGTNVLIS

SEQ ID NO: 1514766 - protein, 20 aa, Mycobacterium tuberculosis
SVPILGPYEDLIANTVANLA

SEQ ID NO: 1514767 - protein, 17 aa, Mycobacterium tuberculosis
SYAYAVLRKAAQRAGDA

SEQ ID NO: 1514768 - protein, 23 aa, Mycobacterium tuberculosis
SYSLDVPRITILDAHFTGAFGPV

SEQ ID NO: 1514769 - protein, 17 aa, Mycobacterium tuberculosis
TAAPLDRRLLLGMLAEL

SEQ ID NO: 1514770 - protein, 31 aa, Mycobacterium tuberculosis
TAPRLPDGTPFPTLYYLTHPVLTAAASRLET

SEQ ID NO: 1514771 - protein, 22 aa, Mycobacterium tuberculosis
TEAVFAPISWLGDVLQFGVPEG

SEQ ID NO: 1514772 - protein, 24 aa, Mycobacterium tuberculosis
TGGRRSFILVPGIDVPFHSRVLRV

SEQ ID NO: 1514773 - protein, 24 aa, Mycobacterium tuberculosis
TGSPTYVADLAEALLALADAGVRG

SEQ ID NO: 1514774 - protein, 28 aa, Mycobacterium tuberculosis
TGVSRRHLEIRWDGQVALLADLNSTNGT

SEQ ID NO: 1514775 - protein, 35 aa, Mycobacterium tuberculosis; identical to SEQ ID NO: 223449

SEQ ID NO: 1514776 - protein, 19 aa, Mycobacterium tuberculosis
THEDLLATIRYVRDRTGDP

SEQ ID NO: 1514777 - protein, 20 aa, Mycobacterium tuberculosis
THSHRIPDFVKLAEALGCVG

SEQ ID NO: 1514778 - protein, 23 aa, Mycobacterium tuberculosis
TIPGFAINPFGLDVPLSGGTSPV

SEQ ID NO: 1514779 - protein, 21 aa, Mycobacterium tuberculosis
TIPGFAINPFGLNVPLSGGTN

SEQ ID NO: 1514780 - protein, 17 aa, Mycobacterium tuberculosis
TIVFCGVHFMAETAKIL

SEQ ID NO: 1514781 - protein, 19 aa, Mycobacterium tuberculosis
TLFDLDDTWIGGSSAFMTD

SEQ ID NO: 1514782 - protein, 18 aa, Mycobacterium tuberculosis
TLIGRAYLYGLMAGGEAG

SEQ ID NO: 1514783 - protein, 32 aa, Mycobacterium tuberculosis
TPGPQRSLAYDRAWWFARFVAAAYGTAKLREL

SEQ ID NO: 1514784 - protein, 20 aa, Mycobacterium tuberculosis
TPPFDLPTVVIDRIPVELHA

SEQ ID NO: 1514785 - protein, 39 aa, Mycobacterium tuberculosis; identical to SEQ ID NO: 223657

SEQ ID NO: 1514786 - protein, 23 aa, Mycobacterium tuberculosis
TTGPWEPWLRALPVEFDSAEQVF

SEQ ID NO: 1514787 - protein, 27 aa, Mycobacterium tuberculosis
TTLDKSDVLAGLFAVWHSLDALLDGLL

SEQ ID NO: 1514788 - protein, 19 aa, Mycobacterium tuberculosis
TTPPLTVPGIHLPSTTIGA

SEQ ID NO: 1514789 - protein, 33 aa, Mycobacterium tuberculosis; identical to SEQ ID NO: 223720

SEQ ID NO: 1514790 - protein, 25 aa, Mycobacterium tuberculosis
TVPGVPISRIPLTINIRIPVNITLN

SEQ ID NO: 1514791 - protein, 17 aa, Mycobacterium tuberculosis
TWLLVATGLSGVAQARG

SEQ ID NO: 1514792 - protein, 22 aa, Mycobacterium tuberculosis
VACALGLQRAPLAPIRLRIGMH

SEQ ID NO: 1514793 - protein, 24 aa, Mycobacterium tuberculosis
VAVRRISMSFVNVAPQLVSTAAAD

SEQ ID NO: 1514794 - protein, 24 aa, Mycobacterium tuberculosis
VDASLRLLVRGGRFLEMGKTDIRD

SEQ ID NO: 1514795 - protein, 27 aa, Mycobacterium tuberculosis
VDTQGGFLIPAALDPAILLSGDGSTNP

SEQ ID NO: 1514796 - protein, 19 aa, Mycobacterium tuberculosis
VEMFRKLLDQGQAGDNVGL

SEQ ID NO: 1514797 - protein, 17 aa, Mycobacterium tuberculosis
VEPLRPGPPPTVWSRRW

SEQ ID NO: 1514798 - protein, 34 aa, Mycobacterium tuberculosis; identical to SEQ ID NO: 227068

SEQ ID NO: 1514799 - protein, 23 aa, Mycobacterium tuberculosis
VHGFPQNWWEWRDLIGPLAADGN

SEQ ID NO: 1514800 - protein, 18 aa, Mycobacterium tuberculosis
VKIYNRKALDPAQVVDAL

SEQ ID NO: 1514801 - protein, 24 aa, Mycobacterium tuberculosis
VLNLSIPPIHIPGLTIPSVPLRID

SEQ ID NO: 1514802 - protein, 17 aa, Mycobacterium tuberculosis
VLPRDQANVWMFSPNRL

SEQ ID NO: 1514803 - protein, 20 aa, Mycobacterium tuberculosis
VLQASLFTAYGTLYQQVSAE

SEQ ID NO: 1514804 - protein, 18 aa, Mycobacterium tuberculosis
VLSQPGLRKLLAQEWLRF

SEQ ID NO: 1514805 - protein, 32 aa, Mycobacterium tuberculosis; identical to SEQ ID NO: 225744

SEQ ID NO: 1514806 - protein, 18 aa, Mycobacterium tuberculosis
VQTLPAGPAGRWPAYDMR

SEQ ID NO: 1514807 - protein, 17 aa, Mycobacterium tuberculosis
VRHAHWPDWHPMRTDAG

SEQ ID NO: 1514808 - protein, 18 aa, Mycobacterium tuberculosis
VRPEIELGPIRPPQRLAP

SEQ ID NO: 1514809 - protein, 18 aa, Mycobacterium tuberculosis
VSNLRKLLGGAGIDPRVV

SEQ ID NO: 1514810 - protein, 17 aa, Mycobacterium tuberculosis
VSRLLVAGGVLMVYVAT

SEQ ID NO: 1514811 - protein, 29 aa, Mycobacterium tuberculosis
VSTPGSALLFPSLCHFSGGIPAPEADPPY

SEQ ID NO: 1514812 - protein, 22 aa, Mycobacterium tuberculosis
VTIPGFTIPGSPLNLTANGGLG

SEQ ID NO: 1514813 - protein, 24 aa, Mycobacterium tuberculosis
VVAGVLFLENIIVPGLTVSGQILV

SEQ ID NO: 1514814 - protein, 26 aa, Mycobacterium tuberculosis
VVGGVRLPHGNGETIRLARGASLSDF

SEQ ID NO: 1514815 - protein, 20 aa, Mycobacterium tuberculosis
VVRFIVPRYVQDDPSLAGVL

SEQ ID NO: 1514816 - protein, 18 aa, Mycobacterium tuberculosis
VWGAVPRVWEKLKAGIEF

SEQ ID NO: 1514817 - protein, 18 aa, Mycobacterium tuberculosis
WAPFRPPKVLSPLFPRPD

SEQ ID NO: 1514818 - protein, 18 aa, Mycobacterium tuberculosis
WLQEEWLHHCGDAAAFLG

SEQ ID NO: 1514819 - protein, 18 aa, Mycobacterium tuberculosis
WLVETTLLRRRAAGKLGE

SEQ ID NO: 1514820 - protein, 21 aa, Mycobacterium tuberculosis
WPRRMGRIPKQLLSGVPAHVD

SEQ ID NO: 1514821 - protein, 18 aa, Mycobacterium tuberculosis
WPWQPYLLSHHQGGIAVT

SEQ ID NO: 1514822 - protein, 20 aa, Mycobacterium tuberculosis
WRSDRALVESLQTVLRDATL

SEQ ID NO: 1514823 - protein, 25 aa, Mycobacterium tuberculosis
WSPDSDLKGFDGFDGGSGGAGGDGG

SEQ ID NO: 1514824 - protein, 17 aa, Mycobacterium tuberculosis
WTDVRRWLTDPTGRWHP

SEQ ID NO: 1514825 - protein, 17 aa, Mycobacterium tuberculosis
WYGSSLVVADRWFPSSK

SEQ ID NO: 1514826 - protein, 22 aa, Mycobacterium tuberculosis
YANFLSILDEGRIAIAALATGA

SEQ ID NO: 1514827 - protein, 26 aa, Mycobacterium tuberculosis
YARPDIPIHYLLADTFTICDQYFSSL

SEQ ID NO: 1514828 - protein, 26 aa, Mycobacterium tuberculosis
YDPSRIDALLKGRRLTKPLIAAVEGP

SEQ ID NO: 1514829 - protein, 23 aa, Mycobacterium tuberculosis
YGDLSVLRRLVPAGPLASLAHST

SEQ ID NO: 1514830 - protein, 17 aa, Mycobacterium tuberculosis
YGYKWPTLDGMFAPHAS

SEQ ID NO: 1514831 - protein, 19 aa, Mycobacterium tuberculosis
YLPSELVAAFLWAQFEEAE

SEQ ID NO: 1514832 - protein, 19 aa, Mycobacterium tuberculosis
YQGLLGFSYTSTIIPEFTV

SEQ ID NO: 1514833 - protein, 19 aa, Mycobacterium tuberculosis
YQQRFVLALSQAGSTYAVA

SEQ ID NO: 1514834 - protein, 18 aa, Mycobacterium tuberculosis
YRLVALRETSPRIHELIR

SEQ ID NO: 1514835 - protein, 24 aa, Mycobacterium tuberculosis
YRRMWVLRLLDMALEQLRIEGLIN

SEQ ID NO: 1514836 - protein, 25 aa, Mycobacterium tuberculosis
YTRQDIPIHYLLADTFTICDGYHCS

SEQ ID NO: 1514837 - protein, 23 aa, Mycobacterium tuberculosis
AAAAGPTMGILAAGADEVSVAIS

SEQ ID NO: 1514838 - protein, 17 aa, Mycobacterium tuberculosis
AAARWYTATEIANAAAM

SEQ ID NO: 1514839 - protein, 24 aa, Mycobacterium tuberculosis
AAFHAQVVRTLTVDAGAYASAEAA

SEQ ID NO: 1514840 - protein, 24 aa, Mycobacterium tuberculosis
AAFHARFVQALAGAMGAYAAAEAA

SEQ ID NO: 1514841 - protein, 28 aa, Mycobacterium tuberculosis
AAHCPAYFQLLVKALVLPGLQELEHTAV

SEQ ID NO: 1514842 - protein, 32 aa, Mycobacterium tuberculosis
AALAAHAPPERLLRCIEAVLACREALAVNVKP

SEQ ID NO: 1514843 - protein, 25 aa, Mycobacterium tuberculosis
AALADTAWQGPAATAMAAAAAPYAS

SEQ ID NO: 1514844 - protein, 22 aa, Mycobacterium tuberculosis
AALESLYEWMWAQDAAAMAGYY

SEQ ID NO: 1514845 - protein, 26 aa, Mycobacterium tuberculosis
AANSWLDAFAHWRQAQGLPATAIAWG

SEQ ID NO: 1514846 - protein, 36 aa, Mycobacterium tuberculosis; identical to SEQ ID NO: 215546

SEQ ID NO: 1514847 - protein, 25 aa, Mycobacterium tuberculosis
AAPPARARTPLPVPTPRGERPDDGG

SEQ ID NO: 1514848 - protein, 20 aa, Mycobacterium tuberculosis
AASPFGIDIGIGGAGGHGGA

SEQ ID NO: 1514849 - protein, 41 aa, Mycobacterium tuberculosis; identical to SEQ ID NO: 236077

SEQ ID NO: 1514850 - protein, 29 aa, Mycobacterium tuberculosis
ACRKHHLLKTFWTGWRDVQLPDGTVIWTA

SEQ ID NO: 1514851 - protein, 23 aa, Mycobacterium tuberculosis
ACTVLAVLAATLLLGACGGPTQP

SEQ ID NO: 1514852 - protein, 19 aa, Mycobacterium tuberculosis
ADAAGRYLDWLTKHSRQIL

SEQ ID NO: 1514853 - protein, 24 aa, Mycobacterium tuberculosis
ADGASNWYTEFARLAPLMEKDVHY

SEQ ID NO: 1514854 - protein, 22 aa, Mycobacterium tuberculosis
ADLRHWLIDYLVTNIGCTPDEV

SEQ ID NO: 1514855 - protein, 23 aa, Mycobacterium tuberculosis
ADNPGKTLVGLLAAAERAKHQTD

SEQ ID NO: 1514856 - protein, 19 aa, Mycobacterium tuberculosis
AEHQAIISDVLTASDFWGG

SEQ ID NO: 1514857 - protein, 20 aa, Mycobacterium tuberculosis
AELQRIVASIPVKRLRQAGV

SEQ ID NO: 1514858 - protein, 19 aa, Mycobacterium tuberculosis
AEVLAFTAFPKAHWQKIWS

SEQ ID NO: 1514859 - protein, 20 aa, Mycobacterium tuberculosis
AEVVALRRAGGLATGAIVVV

SEQ ID NO: 1514860 - protein, 19 aa, Mycobacterium tuberculosis
AFFLYMETPSQPLNVCCVL

SEQ ID NO: 1514861 - protein, 17 aa, Mycobacterium tuberculosis
AFGYLPGPNGPEPDPRT

SEQ ID NO: 1514862 - protein, 19 aa, Mycobacterium tuberculosis
AFHQQFVRALSSAAGSYAA

SEQ ID NO: 1514863 - protein, 32 aa, Mycobacterium tuberculosis
AFWAQAMRLRDLLKFDFYFADSTAFRANIAQE

SEQ ID NO: 1514864 - protein, 31 aa, Mycobacterium tuberculosis
AGAPTMALVDVLSPLLIMTAVATAPSATTLP

SEQ ID NO: 1514865 - protein, 25 aa, Mycobacterium tuberculosis
AGFDNRFFDIPPDEALRMDPQQRLL

SEQ ID NO: 1514866 - protein, 17 aa, Mycobacterium tuberculosis
AGFFDPLTRGVLSTVSG

SEQ ID NO: 1514867 - protein, 22 aa, Mycobacterium tuberculosis
AGGAGGWLFGNGGAGGVGGAGG

SEQ ID NO: 1514868 - protein, 21 aa, Mycobacterium tuberculosis
AGGGALLFGAGGAGGAGGSSG

SEQ ID NO: 1514869 - protein, 23 aa, Mycobacterium tuberculosis
AGGKAGLLFGSGGAGGSGGAAGT

SEQ ID NO: 1514870 - protein, 23 aa, Mycobacterium tuberculosis
AGGKAGLLFGSGGAGGSGGAGGF

SEQ ID NO: 1514871 - protein, 23 aa, Mycobacterium tuberculosis
AGGNAALLFGNGGAGGAGGAGGI

SEQ ID NO: 1514872 - protein, 22 aa, Mycobacterium tuberculosis
AGGNAGTFYGSGGAGGAGGESD

SEQ ID NO: 1514873 - protein, 24 aa, Mycobacterium tuberculosis
AGGNALMFGIGGNGGAGGAASGVG

SEQ ID NO: 1514874 - protein, 23 aa, Mycobacterium tuberculosis
AGGNGGWLYGNGGPGGAAGLGTA

SEQ ID NO: 1514875 - protein, 25 aa, Mycobacterium tuberculosis
AGGSARGLIFALGGAGAAGGDASTG

SEQ ID NO: 1514876 - protein, 30 aa, Mycobacterium tuberculosis; identical to SEQ ID NO: 225909

SEQ ID NO: 1514877 - protein, 24 aa, Mycobacterium tuberculosis
AGPCGMPILDDAAAWFIGRTASRS

SEQ ID NO: 1514878 - protein, 26 aa, Mycobacterium tuberculosis
AGRLGLRPDVRRMPLFGLGCVAGAAG

SEQ ID NO: 1514879 - protein, 23 aa, Mycobacterium tuberculosis
AGSLRLDLSQYRELEAFAAFASD

SEQ ID NO: 1514880 - protein, 18 aa, Mycobacterium tuberculosis
AGTPPPPHYPQHHPRQPL

SEQ ID NO: 1514881 - protein, 28 aa, Mycobacterium tuberculosis
AHPPAALLRLVNPILRSLLHTPLAGPLR

SEQ ID NO: 1514882 - protein, 41 aa, Mycobacterium tuberculosis
AIISFPPTQWTRWRQPVIGMPSTPRFLGHGRLLVSTHLGQL

SEQ ID NO: 1514883 - protein, 17 aa, Mycobacterium tuberculosis
AILIRKVDWVDEITRVH

SEQ ID NO: 1514884 - protein, 25 aa, Mycobacterium tuberculosis
AIQPKLTFTWRIMPQNLSDAGISWK

SEQ ID NO: 1514885 - protein, 26 aa, Mycobacterium tuberculosis
AIVNVSSVLAWLPLGMSYGVSKAAMW

SEQ ID NO: 1514886 - protein, 34 aa, Mycobacterium tuberculosis; identical to SEQ ID NO: 216020

SEQ ID NO: 1514887 - protein, 18 aa, Mycobacterium tuberculosis
AKRGFDPVLGARPLRRTI

SEQ ID NO: 1514888 - protein, 28 aa, Mycobacterium tuberculosis
ALAAHRRAHGLPAISLGWGLWDQASAMT

SEQ ID NO: 1514889 - protein, 28 aa, Mycobacterium tuberculosis
ALAAVNAPIQAVTGRPLIGNGANGAPGS

SEQ ID NO: 1514890 - protein, 18 aa, Mycobacterium tuberculosis
ALALYHTKRLASPAQRIM

SEQ ID NO: 1514891 - protein, 27 aa, Mycobacterium tuberculosis
ALASGPAALAIPALGIGNTGIGNIFSI

SEQ ID NO: 1514892 - protein, 18 aa, Mycobacterium tuberculosis
ALDTRPLFEPVLAGLGEG

SEQ ID NO: 1514893 - protein, 22 aa, Mycobacterium tuberculosis
ALETLLTRLNLPDDVPIEAKMV

SEQ ID NO: 1514894 - protein, 19 aa, Mycobacterium tuberculosis
ALMLEPRKAAAGSALGMLS

SEQ ID NO: 1514895 - protein, 17 aa, Mycobacterium tuberculosis
ALNLASWRRLKRLLDDL

SEQ ID NO: 1514896 - protein, 25 aa, Mycobacterium tuberculosis
AMAAAVAPYLGWLAAAAAQAQRSAT

SEQ ID NO: 1514897 - protein, 19 aa, Mycobacterium tuberculosis
AMGAIALFGESYPDEVRVV

SEQ ID NO: 1514898 - protein, 18 aa, Mycobacterium tuberculosis
AMRQLLLDLLANNQDLAG

SEQ ID NO: 1514899 - protein, 25 aa, Mycobacterium tuberculosis
AMRVPGIVFASRSLLPRDEGDMALM

SEQ ID NO: 1514900 - protein, 17 aa, Mycobacterium tuberculosis
AMTASAEYLRLLRRHNV

SEQ ID NO: 1514901 - protein, 26 aa, Mycobacterium tuberculosis
APHHTRLRKIISRGFTPRAVGRLHDE

SEQ ID NO: 1514902 - protein, 34 aa, Mycobacterium tuberculosis
APLEGLLNIVNTPTQLLLGRPLIGNGANGAPGTG

SEQ ID NO: 1514903 - protein, 22 aa, Mycobacterium tuberculosis
APMFSIIIPTLNVAAVLPACLD

SEQ ID NO: 1514904 - protein, 18 aa, Mycobacterium tuberculosis
APPAPAPALAHLRGTTQK

SEQ ID NO: 1514905 - protein, 18 aa, Mycobacterium tuberculosis
APPFFVLHGEKDPMVPSA

SEQ ID NO: 1514906 - protein, 28 aa, Mycobacterium tuberculosis
AQLTVTPVMLLLWIRGVRFMYSVDPYLP

SEQ ID NO: 1514907 - protein, 25 aa, Mycobacterium tuberculosis
AQQEPQLVRKIILAGTGPAGGVGIG

SEQ ID NO: 1514908 - protein, 23 aa, Mycobacterium tuberculosis
AQSAQYAFILDRMSQQVDADEHR

SEQ ID NO: 1514909 - protein, 19 aa, Mycobacterium tuberculosis
ARFLPYFTDVIVGDLRVGK

SEQ ID NO: 1514910 - protein, 21 aa, Mycobacterium tuberculosis
ARGLVRLRAVLPLIDGGAESP

SEQ ID NO: 1514911 - protein, 18 aa, Mycobacterium tuberculosis
ARHFGARRKAFNWTVTAL

SEQ ID NO: 1514912 - protein, 24 aa, Mycobacterium tuberculosis
ARKMTFRALYRLERHQLLDCPILG

SEQ ID NO: 1514913 - protein, 17 aa, Mycobacterium tuberculosis
ARLHRFYRDLIALRHNE

SEQ ID NO: 1514914 - protein, 23 aa, Mycobacterium tuberculosis
ARLVSRLPAPLRRGQIRPLGLDR

SEQ ID NO: 1514915 - protein, 26 aa, Mycobacterium tuberculosis
ARVISDVWLSNLLAWLTRRASATDVS

SEQ ID NO: 1514916 - protein, 22 aa, Mycobacterium tuberculosis
ASARRLQMNRIPLYQIHQPNPV

SEQ ID NO: 1514917 - protein, 26 aa, Mycobacterium tuberculosis
ASLFSGNAQAYQALSAQAAAFHQQFV

SEQ ID NO: 1514918 - protein, 17 aa, Mycobacterium tuberculosis
ASPLQTLEQGLLGAINA

SEQ ID NO: 1514919 - protein, 23 aa, Mycobacterium tuberculosis
ASPRRALSELLRRGTRNLTGADR

SEQ ID NO: 1514920 - protein, 26 aa, Mycobacterium tuberculosis
ASRDLQPWLAVPDRLLPLPADLAGER

SEQ ID NO: 1514921 - protein, 27 aa, Mycobacterium tuberculosis
ASRDLQPWLAVPDRLLPLPAGLAGERR

SEQ ID NO: 1514922 - protein, 19 aa, Mycobacterium tuberculosis
ATLGILEHFPMSDYAPSKV

SEQ ID NO: 1514923 - protein, 18 aa, Mycobacterium tuberculosis
ATRGANIALAAALAPLQC

SEQ ID NO: 1514924 - protein, 17 aa, Mycobacterium tuberculosis
ATTGLYPPGSTFKMITA

SEQ ID NO: 1514925 - protein, 23 aa, Mycobacterium tuberculosis
AVAQPLIAAFAAALRQLGAHVEA

SEQ ID NO: 1514926 - protein, 17 aa, Mycobacterium tuberculosis
AVGGNAQLIGNGGNGGG

SEQ ID NO: 1514927 - protein, 20 aa, Mycobacterium tuberculosis
AYQQRFVLALSQAGSTYAVA

SEQ ID NO: 1514928 - protein, 17 aa, Mycobacterium tuberculosis
AYQRLPFGQGPDVWLAA

SEQ ID NO: 1514929 - protein, 22 aa, Mycobacterium tuberculosis
AYVSWTRSALSDLPRWREPPQI

SEQ ID NO: 1514930 - protein, 24 aa, Mycobacterium tuberculosis
CAPLTWPEGWRRWPQRVYGDTRLE

SEQ ID NO: 1514931 - protein, 29 aa, Mycobacterium tuberculosis
CGKYLVVMHDLWLPLLTAAGDLDKPLVTE

SEQ ID NO: 1514932 - protein, 25 aa, Mycobacterium tuberculosis
CGVTHVLLPVSALLRRADTAAVIVS

SEQ ID NO: 1514933 - protein, 17 aa, Mycobacterium tuberculosis
CGYAELSLALAADGYTV

SEQ ID NO: 1514934 - protein, 18 aa, Mycobacterium tuberculosis
CHRLDGIPLAIELAASRV

SEQ ID NO: 1514935 - protein, 18 aa, Mycobacterium tuberculosis
CRAPSSLPAPLMARPGRS

SEQ ID NO: 1514936 - protein, 26 aa, Mycobacterium tuberculosis
DAIRESLDSLGPIFSELRDTGRELLE

SEQ ID NO: 1514937 - protein, 24 aa, Mycobacterium tuberculosis
DAIRHAVAWARPGDVVLIAGKGHE

SEQ ID NO: 1514938 - protein, 27 aa, Mycobacterium tuberculosis
DAKPAQVALAWLISLPGVVAIPGASSV

SEQ ID NO: 1514939 - protein, 23 aa, Mycobacterium tuberculosis
DAVGGLYVHWIVTGIAPGSGSTA

SEQ ID NO: 1514940 - protein, 18 aa, Mycobacterium tuberculosis
DDEFGFFVVMLAVAGNET

SEQ ID NO: 1514941 - protein, 21 aa, Mycobacterium tuberculosis
DEALLDIYRKLRPGEPPTKES

SEQ ID NO: 1514942 - protein, 19 aa, Mycobacterium tuberculosis
DFHIDGRTFTWKPLSGVNV

SEQ ID NO: 1514943 - protein, 22 aa, Mycobacterium tuberculosis
DGTLRVGYLPVTITRWPPGERV

SEQ ID NO: 1514944 - protein, 26 aa, Mycobacterium tuberculosis
DGVFEGIAVLGLGFGGAAGAGGAATG

SEQ ID NO: 1514945 - protein, 24 aa, Mycobacterium tuberculosis
DHGQPWTCEIHYTCACCCLPPNLR

SEQ ID NO: 1514946 - protein, 29 aa, Mycobacterium tuberculosis
DHGRVVFTRAALPAIRPVNHLVVDGRVIV

SEQ ID NO: 1514947 - protein, 19 aa, Mycobacterium tuberculosis
DHLIALLEICAVRADPETP

SEQ ID NO: 1514948 - protein, 26 aa, Mycobacterium tuberculosis
DHPVHRYFLAAKQTEFALGGATGQLR

SEQ ID NO: 1514949 - protein, 18 aa, Mycobacterium tuberculosis
DLGDRFGFCIPDLAVWDN

SEQ ID NO: 1514950 - protein, 18 aa, Mycobacterium tuberculosis
DLNWRPRFDLNAVAARLA

SEQ ID NO: 1514951 - protein, 25 aa, Mycobacterium tuberculosis
DNGGSARILLLVPSISLLSQTLREW

SEQ ID NO: 1514952 - protein, 18 aa, Mycobacterium tuberculosis
DPAAWFPSAEHLASWVRL

SEQ ID NO: 1514953 - protein, 22 aa, Mycobacterium tuberculosis
DPHRHELRSYRIVDGAVTEEPV

SEQ ID NO: 1514954 - protein, 18 aa, Mycobacterium tuberculosis
DPIYKRKVLELAAALSDD

SEQ ID NO: 1514955 - protein, 17 aa, Mycobacterium tuberculosis
DPYLWLEDVTGAEALDW

SEQ ID NO: 1514956 - protein, 29 aa, Mycobacterium tuberculosis
DQPWLADHVVNGVVLFPGAGFVELVIRAG

SEQ ID NO: 1514957 - protein, 23 aa, Mycobacterium tuberculosis
DRPVYTLSHDILFMGLTGDLFRR

SEQ ID NO: 1514958 - protein, 28 aa, Mycobacterium tuberculosis
DTKADLPAFAELLARLPWPLNKTTSVSK

SEQ ID NO: 1514959 - protein, 25 aa, Mycobacterium tuberculosis
DTTDQRLLDLLPPAPVDVNPPGDER

SEQ ID NO: 1514960 - protein, 41 aa, Mycobacterium tuberculosis
DVTSLYKVGLGSVRFLMSVGALIIGWLLQRQAAVAVAALDA

SEQ ID NO: 1514961 - protein, 26 aa, Mycobacterium tuberculosis
DYQSTARFILAYLPRWQEPPQIYRGG

SEQ ID NO: 1514962 - protein, 17 aa, Mycobacterium tuberculosis
DYTWFVLNAKIIEKEFA

SEQ ID NO: 1514963 - protein, 27 aa, Mycobacterium tuberculosis
EAGRTERFWVGLSVYRPGGTAEPAPTR

SEQ ID NO: 1514964 - protein, 20 aa, Mycobacterium tuberculosis
EALLAAATDLAAIRSTIRAA

SEQ ID NO: 1514965 - protein, 27 aa, Mycobacterium tuberculosis
EANNHFRVLFFRWGQHPVALTAFYKNQ

SEQ ID NO: 1514966 - protein, 19 aa, Mycobacterium tuberculosis
EAPVARRLRESFGGSKPAP

SEQ ID NO: 1514967 - protein, 18 aa, Mycobacterium tuberculosis
EAVRRRDSLPRIAQAIAL

SEQ ID NO: 1514968 - protein, 27 aa, Mycobacterium tuberculosis
EDAGFDPNLPPPLAPDFLSPPAEEAPP

SEQ ID NO: 1514969 - protein, 17 aa, Mycobacterium tuberculosis
EDRGAFGDLLSAAGLPA

SEQ ID NO: 1514970 - protein, 20 aa, Mycobacterium tuberculosis
EELFSAVRFDIGWTASSDDG

SEQ ID NO: 1514971 - protein, 25 aa, Mycobacterium tuberculosis
EESYLALLDALRWLGLDWDEGPEVG

SEQ ID NO: 1514972 - protein, 17 aa, Mycobacterium tuberculosis
EEWLHHCGDAAAFLGPV

SEQ ID NO: 1514973 - protein, 19 aa, Mycobacterium tuberculosis
EGLCLDVCTGGELAVALHA

SEQ ID NO: 1514974 - protein, 17 aa, Mycobacterium tuberculosis
EGPARAWERGRFAAPYL

SEQ ID NO: 1514975 - protein, 19 aa, Mycobacterium tuberculosis
EGRGIVMRVPLEGGGRLVV

SEQ ID NO: 1514976 - protein, 17 aa, Mycobacterium tuberculosis
EGRMIEFVIERLSLIPE

SEQ ID NO: 1514977 - protein, 24 aa, Mycobacterium tuberculosis
EHGRTPWRDLFGPAVTLADGGFDI

SEQ ID NO: 1514978 - protein, 28 aa, Mycobacterium tuberculosis
EIQAYDPVFFPGLAAEWSDRRPFVGPLT

SEQ ID NO: 1514979 - protein, 17 aa, Mycobacterium tuberculosis
ELFKTEALHRLPVKSWD

SEQ ID NO: 1514980 - protein, 25 aa, Mycobacterium tuberculosis
ELGPIRPPQRLAPYSYALGAEIKHP

SEQ ID NO: 1514981 - protein, 20 aa, Mycobacterium tuberculosis
ELIQMRRPLRDIPEPTIPDG

SEQ ID NO: 1514982 - protein, 20 aa, Mycobacterium tuberculosis
ELMRRFNGAALETLLTRLNL

SEQ ID NO: 1514983 - protein, 20 aa, Mycobacterium tuberculosis
ENLQPLIFGLSQMISDYNAA

SEQ ID NO: 1514984 - protein, 18 aa, Mycobacterium tuberculosis
ENMSAIHAIYRAAGLPSR

SEQ ID NO: 1514985 - protein, 25 aa, Mycobacterium tuberculosis
EPDVACEITLQPIRRYDVDAAILFS

SEQ ID NO: 1514986 - protein, 19 aa, Mycobacterium tuberculosis
EQLMVRYFELDPTMAQQYD

SEQ ID NO: 1514987 - protein, 20 aa, Mycobacterium tuberculosis
ERHRGLDVVRLGPALWGDLA

SEQ ID NO: 1514988 - protein, 25 aa, Mycobacterium tuberculosis
ERKALLDRLLAQKLPDGWDADLPHW

SEQ ID NO: 1514989 - protein, 21 aa, Mycobacterium tuberculosis
ERLNLPAGWSYHTRVLTSELR

SEQ ID NO: 1514990 - protein, 18 aa, Mycobacterium tuberculosis
ERVAPECPDWLPPGAKDM

SEQ ID NO: 1514991 - protein, 22 aa, Mycobacterium tuberculosis
EVNSLRMYLGAGSGPMLAAAAA

SEQ ID NO: 1514992 - protein, 18 aa, Mycobacterium tuberculosis
FDPSLTFDDLAWIKSQWP

SEQ ID NO: 1514993 - protein, 26 aa, Mycobacterium tuberculosis
FGATSGPASIGVTGAPGGNGGKGGAG

SEQ ID NO: 1514994 - protein, 25 aa, Mycobacterium tuberculosis
FGNAGNVNTGFWNGGSTNTGLANAG

SEQ ID NO: 1514995 - protein, 18 aa, Mycobacterium tuberculosis
FHARFVQALAGAMGAYAA

SEQ ID NO: 1514996 - protein, 19 aa, Mycobacterium tuberculosis
FLIRGLLGADPTTGAIGIG

SEQ ID NO: 1514997 - protein, 19 aa, Mycobacterium tuberculosis
FMRNAAGGTLFNFGFANDG

SEQ ID NO: 1514998 - protein, 23 aa, Mycobacterium tuberculosis
FPKAHWQKIWSTNPLERINKEIK

SEQ ID NO: 1514999 - protein, 18 aa, Mycobacterium tuberculosis
FQDPFTFNTLRNPNPHVG

SEQ ID NO: 1515000 - protein, 17 aa, Mycobacterium tuberculosis
FQVGSRGGDGGVGGWLY

SEQ ID NO: 1515001 - protein, 18 aa, Mycobacterium tuberculosis
FTLPNVVIQPWSLGGISV

SEQ ID NO: 1515002 - protein, 24 aa, Mycobacterium tuberculosis
FVEGDTVIAAVDPGWRRGATQGHS

SEQ ID NO: 1515003 - protein, 20 aa, Mycobacterium tuberculosis
FYRRGLFGTIGPYNLRYRVL

SEQ ID NO: 1515004 - protein, 29 aa, Mycobacterium tuberculosis
GADFKRPAPHWWFDDATLYGPDGLALPMR

SEQ ID NO: 1515005 - protein, 18 aa, Mycobacterium tuberculosis
GAFFIGHSGLLNSGGGQH

SEQ ID NO: 1515006 - protein, 23 aa, Mycobacterium tuberculosis
GAFGDLLSAAGLPAPKYGTATTF

SEQ ID NO: 1515007 - protein, 22 aa, Mycobacterium tuberculosis
GAGGAALLFGAGGAGGAGGSGG

SEQ ID NO: 1515008 - protein, 26 aa, Mycobacterium tuberculosis
GAGGNAGLLAPGLAGGAGGGGGQGFD

SEQ ID NO: 1515009 - protein, 25 aa, Mycobacterium tuberculosis
GAGGNAGWLGFGGAGGIGGIGGNAN

SEQ ID NO: 1515010 - protein, 25 aa, Mycobacterium tuberculosis
GAGGQGGLLFGDGGNGGAGGAGGIG

SEQ ID NO: 1515011 - protein, 18 aa, Mycobacterium tuberculosis
GAGGTAGLFGVGGAGGAG

SEQ ID NO: 1515012 - protein, 23 aa, Mycobacterium tuberculosis
GAGSLFNGAPGFGGPGGSGGASL

SEQ ID NO: 1515013 - protein, 26 aa, Mycobacterium tuberculosis
GAGSNALGLFLGLGGSGGQGGDSAMG

SEQ ID NO: 1515014 - protein, 22 aa, Mycobacterium tuberculosis
GAIAVPLNFRLTPTEIAVLVED

SEQ ID NO: 1515015 - protein, 27 aa, Mycobacterium tuberculosis
GAKPSLRLYERLWRPASFHLASRITTR

SEQ ID NO: 1515016 - protein, 32 aa, Mycobacterium tuberculosis
GALAGIHPVDLGALAWRGLLDRTDIDPAAVDD

SEQ ID NO: 1515017 - protein, 20 aa, Mycobacterium tuberculosis
GANIALAAALAPLQCYVSVD

SEQ ID NO: 1515018 - protein, 23 aa, Mycobacterium tuberculosis
GAQYDVRLVSRVSDAPPVPARLV

SEQ ID NO: 1515019 - protein, 33 aa, Mycobacterium tuberculosis
GATTTTYLVPVNHLPLTLPLRYLGISDAEVDQI

SEQ ID NO: 1515020 - protein, 21 aa, Mycobacterium tuberculosis
GDAMPWLMASAKTLSYAVNMA

SEQ ID NO: 1515021 - protein, 26 aa, Mycobacterium tuberculosis
GEAHVKVIRALFRPPARRGGCVHPPG

SEQ ID NO: 1515022 - protein, 20 aa, Mycobacterium tuberculosis
GEAYLGRRWVKLDATIDAPT

SEQ ID NO: 1515023 - protein, 27 aa, Mycobacterium tuberculosis
GEFVKFGPSWAWPKPVQPHIPVLVGAA

SEQ ID NO: 1515024 - protein, 29 aa, Mycobacterium tuberculosis
GERRRVALCKLLLSKPDLLLLDEPTNHLD

SEQ ID NO: 1515025 - protein, 24 aa, Mycobacterium tuberculosis
GFLNEGLPYRVPYPQTTPVQESGP

SEQ ID NO: 1515026 - protein, 23 aa, Mycobacterium tuberculosis
GGAAVIGGLPGNGGAGGNAGLIG

SEQ ID NO: 1515027 - protein, 22 aa, Mycobacterium tuberculosis
GGAGGKAGLYGNGGDGGAGGDG

SEQ ID NO: 1515028 - protein, 23 aa, Mycobacterium tuberculosis
GGAGGLGVGLLGGAGGAGGPGGA

SEQ ID NO: 1515029 - protein, 24 aa, Mycobacterium tuberculosis
GGAGGNAWLFGNGGAGGLGAAGAA

SEQ ID NO: 1515030 - protein, 20 aa, Mycobacterium tuberculosis
GGAKLRALGPQLAQRRLGLE

SEQ ID NO: 1515031 - protein, 25 aa, Mycobacterium tuberculosis
GGARNAGLLAVRMLGAANPQLRARI

SEQ ID NO: 1515032 - protein, 23 aa, Mycobacterium tuberculosis
GGCWRTFLTCDANLAVTLPPGLT

SEQ ID NO: 1515033 - protein, 17 aa, Mycobacterium tuberculosis
GGDGGHAGTGGRGGLLA

SEQ ID NO: 1515034 - protein, 25 aa, Mycobacterium tuberculosis
GGGATGTLTFFGSGGDGGPGGAGAN

SEQ ID NO: 1515035 - protein, 26 aa, Mycobacterium tuberculosis
GGHGGAGGWLYGNGGAGGFGGAGAVG

SEQ ID NO: 1515036 - protein, 31 aa, Mycobacterium tuberculosis
GGKGGAGTLLGLTVFGDNGGAGVLGDSTDPD

SEQ ID NO: 1515037 - protein, 25 aa, Mycobacterium tuberculosis
GGKGGTGGWLWGSGGAGGAGGSGGG

SEQ ID NO: 1515038 - protein, 17 aa, Mycobacterium tuberculosis
GGKTPINFINVQRALID

SEQ ID NO: 1515039 - protein, 17 aa, Mycobacterium tuberculosis
GGLGLVVARWLVDRGAG

SEQ ID NO: 1515040 - protein, 18 aa, Mycobacterium tuberculosis
GGLQFTAGTWRANGGSGS

SEQ ID NO: 1515041 - protein, 25 aa, Mycobacterium tuberculosis
GGNGATGPWLFGDGGAGGGGGAGGI

SEQ ID NO: 1515042 - protein, 23 aa, Mycobacterium tuberculosis
GGNGGVWYGNGGAGGAAGQGGPG

SEQ ID NO: 1515043 - protein, 20 aa, Mycobacterium tuberculosis
GGPGGLLYGNGGNGGAGDTA

SEQ ID NO: 1515044 - protein, 29 aa, Mycobacterium tuberculosis
GGTGGFAVAPDFIGFGAAYGGAGGLGGAA

SEQ ID NO: 1515045 - protein, 19 aa, Mycobacterium tuberculosis
GGVLAWESLALSGAEAGTA

SEQ ID NO: 1515046 - protein, 29 aa, Mycobacterium tuberculosis
GKHLRVGVTSIYWYFRKKDDLLNAMTDRA

SEQ ID NO: 1515047 - protein, 25 aa, Mycobacterium tuberculosis
GLDSRAFRLQWPIGTTIFELDRPQV

SEQ ID NO: 1515048 - protein, 25 aa, Mycobacterium tuberculosis
GLPPGSALLVVKRGPNAGSRFLLDQ

SEQ ID NO: 1515049 - protein, 17 aa, Mycobacterium tuberculosis
GLRAEFGDRLPVVLLDG

SEQ ID NO: 1515050 - protein, 22 aa, Mycobacterium tuberculosis
GLSSPVILGIGIGGAGGDGGGA

SEQ ID NO: 1515051 - protein, 21 aa, Mycobacterium tuberculosis
GMTGMPMVPPGALGAGAEGAN

SEQ ID NO: 1515052 - protein, 17 aa, Mycobacterium tuberculosis
GNANWFGSGGAGGQGGT

SEQ ID NO: 1515053 - protein, 23 aa, Mycobacterium tuberculosis
GNGATGTWGHNLGAGGTGGNGGN

SEQ ID NO: 1515054 - protein, 48 aa, Mycobacterium tuberculosis
GNYSNGAFWRGDYQGLLGFSYRPAVLPQTPFLDLTLTGGLGSVVIPAI

SEQ ID NO: 1515055 - protein, 19 aa, Mycobacterium tuberculosis
GPGALQHPDLVILRGRTFG

SEQ ID NO: 1515056 - protein, 18 aa, Mycobacterium tuberculosis
GPVLALLCDPRVTVEIIA

SEQ ID NO: 1515057 - protein, 25 aa, Mycobacterium tuberculosis
GQAGGPGGLLYGNGGNGAAGGPNQA

SEQ ID NO: 1515058 - protein, 18 aa, Mycobacterium tuberculosis
GRCTPIAAWLAGLGLFTK

SEQ ID NO: 1515059 - protein, 25 aa, Mycobacterium tuberculosis
GRGGAGGLGFGSEAPGRPGGAGGTG

SEQ ID NO: 1515060 - protein, 19 aa, Mycobacterium tuberculosis
GRGGLLLGTGGAGGDGGVG

SEQ ID NO: 1515061 - protein, 27 aa, Mycobacterium tuberculosis
GSGAPGGHGGWLFGGGGTGGSGVSGGA

SEQ ID NO: 1515062 - protein, 25 aa, Mycobacterium tuberculosis
GSSGTVFALDLSWGGAGGNGGAATT

SEQ ID NO: 1515063 - protein, 27 aa, Mycobacterium tuberculosis
GTGQPGGPGGLLWGNGGNGGSGVAGVG

SEQ ID NO: 1515064 - protein, 28 aa, Mycobacterium tuberculosis
GTHHYRFTLYHLPVALQLPPGATGVQAA

SEQ ID NO: 1515065 - protein, 22 aa, Mycobacterium tuberculosis
GTNIAGLLRDGAGTAAINLGLA

SEQ ID NO: 1515066 - protein, 33 aa, Mycobacterium tuberculosis
GVAPVYLYRFDYSTPLLKLLLVRAAHATELPYV

SEQ ID NO: 1515067 - protein, 18 aa, Mycobacterium tuberculosis
GVGRIGWALKGRRADKTV

SEQ ID NO: 1515068 - protein, 26 aa, Mycobacterium tuberculosis
GVNAVNPGLATPVTPAANGGNGLNLV

SEQ ID NO: 1515069 - protein, 18 aa, Mycobacterium tuberculosis
GWYGSALVVADRWFPSLS

SEQ ID NO: 1515070 - protein, 19 aa, Mycobacterium tuberculosis
HAQAYQALSAQAALFHEQF

SEQ ID NO: 1515071 - protein, 26 aa, Mycobacterium tuberculosis
HDELRPLKALAARMACPYLNPGRYVQ

SEQ ID NO: 1515072 - protein, 24 aa, Mycobacterium tuberculosis
HDVGLAILGPLRELDEVAYLRFAS

SEQ ID NO: 1515073 - protein, 35 aa, Mycobacterium tuberculosis; identical to SEQ ID NO: 226364

SEQ ID NO: 1515074 - protein, 36 aa, Mycobacterium tuberculosis
HFTFYASIAHLCVDPMIVGVLFIEIHMMYSALVGGD

SEQ ID NO: 1515075 - protein, 22 aa, Mycobacterium tuberculosis
HGRSYILRAGISSLFRYIEGVH

SEQ ID NO: 1515076 - protein, 18 aa, Mycobacterium tuberculosis
HIGIRLPGRYNVANCLVA

SEQ ID NO: 1515077 - protein, 23 aa, Mycobacterium tuberculosis
HLKGHFATMRHAASHWRGLSKAG

SEQ ID NO: 1515078 - protein, 25 aa, Mycobacterium tuberculosis
HPPPDLTALGLAAPRVSPPASLAAL

SEQ ID NO: 1515079 - protein, 18 aa, Mycobacterium tuberculosis
HQWIAAHLSWNGGANDGW

SEQ ID NO: 1515080 - protein, 18 aa, Mycobacterium tuberculosis
HRGRRQLRGLLADVARDR

SEQ ID NO: 1515081 - protein, 27 aa, Mycobacterium tuberculosis
HRGSYLQMHFALAQPPAFAAPYQALND

SEQ ID NO: 1515082 - protein, 18 aa, Mycobacterium tuberculosis
HRKPFPRTVSTGQAIAMA

SEQ ID NO: 1515083 - protein, 20 aa, Mycobacterium tuberculosis
HRVALLRKTVGETWGLPSPE

SEQ ID NO: 1515084 - protein, 18 aa, Mycobacterium tuberculosis
HSSPVPVAITPRRYRCYT

SEQ ID NO: 1515085 - protein, 25 aa, Mycobacterium tuberculosis
HSWFAGYRGDLAFASLIVGGGSSEY

SEQ ID NO: 1515086 - protein, 28 aa, Mycobacterium tuberculosis
HWAKSLTQRTILRLLDPSISAAGILRAE

SEQ ID NO: 1515087 - protein, 17 aa, Mycobacterium tuberculosis
IADVDFVRLPGGSLTTL

SEQ ID NO: 1515088 - protein, 19 aa, Mycobacterium tuberculosis
IAMAKRTPVRKACTVLAVL

SEQ ID NO: 1515089 - protein, 17 aa, Mycobacterium tuberculosis
IANGSSLAVGGFGLCGI

SEQ ID NO: 1515090 - protein, 28 aa, Mycobacterium tuberculosis
IARPDLQVVLLEPLLRRTEFLREMVTDL

SEQ ID NO: 1515091 - protein, 21 aa, Mycobacterium tuberculosis
IDWVIKRKLFQRYQDRYDMEL

SEQ ID NO: 1515092 - protein, 27 aa, Mycobacterium tuberculosis
IFPGGFTIDPLPLSLALNISVPDSSVP

SEQ ID NO: 1515093 - protein, 29 aa, Mycobacterium tuberculosis
IGATPPDMTLFLDLKQTPPQPLVSAVAQV

SEQ ID NO: 1515094 - protein, 20 aa, Mycobacterium tuberculosis
IGDIPIPIIDVPAVPGFGNT

SEQ ID NO: 1515095 - protein, 27 aa, Mycobacterium tuberculosis
IGLGNLGSYNFGFGNAGDFNLGFANSG

SEQ ID NO: 1515096 - protein, 24 aa, Mycobacterium tuberculosis
IGNTWLADPAPFLQQYLANQFGYG

SEQ ID NO: 1515097 - protein, 17 aa, Mycobacterium tuberculosis
IGQQPFEIGGHRSLQHP

SEQ ID NO: 1515098 - protein, 20 aa, Mycobacterium tuberculosis
IGVNTGTGWAYGGNGGNGGD

SEQ ID NO: 1515099 - protein, 18 aa, Mycobacterium tuberculosis
IPGFTIPGSPLNLTANGG

SEQ ID NO: 1515100 - protein, 17 aa, Mycobacterium tuberculosis
IPQNAIPLTIDASGVLD

SEQ ID NO: 1515101 - protein, 20 aa, Mycobacterium tuberculosis
IQVLTQCRPELIERTFQACS

SEQ ID NO: 1515102 - protein, 25 aa, Mycobacterium tuberculosis
IRLLTRIAFGFRSPQALIALAMLTL

SEQ ID NO: 1515103 - protein, 26 aa, Mycobacterium tuberculosis
ISDELWDLLPGYLIFRSIIPNRPPTQ

SEQ ID NO: 1515104 - protein, 25 aa, Mycobacterium tuberculosis
ISDGELFIMGRIKDLLIVDGRNHYP

SEQ ID NO: 1515105 - protein, 26 aa, Mycobacterium tuberculosis
ISIGPIKINPITLWPAQNFNQTITLA

SEQ ID NO: 1515106 - protein, 24 aa, Mycobacterium tuberculosis
ISIPNIAIPSIHLGIDPTFDVGPI

SEQ ID NO: 1515107 - protein, 26 aa, Mycobacterium tuberculosis
ISSAAKMFNCTGWKIGWACGPAELIA

SEQ ID NO: 1515108 - protein, 26 aa, Mycobacterium tuberculosis
ITELAQQILLPRLPPKGLSQEELRAL

SEQ ID NO: 1515109 - protein, 19 aa, Mycobacterium tuberculosis
ITTSPIPLKIDVSGGLPAF

SEQ ID NO: 1515110 - protein, 17 aa, Mycobacterium tuberculosis
IVGPIVYLGGGAGYRSK

SEQ ID NO: 1515111 - protein, 24 aa, Mycobacterium tuberculosis
KDIEDLTFALNLGVDMVALSFVRS

SEQ ID NO: 1515112 - protein, 17 aa, Mycobacterium tuberculosis
KDREMPQGTVKWFNAEK

SEQ ID NO: 1515113 - protein, 25 aa, Mycobacterium tuberculosis
KETLAFFAGIGIPIAEIWGMSELSC

SEQ ID NO: 1515114 - protein, 25 aa, Mycobacterium tuberculosis
KEWAQLLMVAVRVASLPGLLSTTTV

SEQ ID NO: 1515115 - protein, 21 aa, Mycobacterium tuberculosis
KGRYFRLLTGWVGGGFRVPDD

SEQ ID NO: 1515116 - protein, 27 aa, Mycobacterium tuberculosis
KIRLLTRIAFGFRSPQALIALAMLTLA

SEQ ID NO: 1515117 - protein, 41 aa, Mycobacterium tuberculosis; identical to SEQ ID NO: 236557

SEQ ID NO: 1515118 - protein, 28 aa, Mycobacterium tuberculosis
KLAPKHVLPAWIGLVTLAAQEPGREWSA

SEQ ID NO: 1515119 - protein, 21 aa, Mycobacterium tuberculosis
KLLETYSVPPLLHNQALAISV

SEQ ID NO: 1515120 - protein, 23 aa, Mycobacterium tuberculosis
KLPRRFDYLAYDPREGWPPALQG

SEQ ID NO: 1515121 - protein, 17 aa, Mycobacterium tuberculosis
KPVISWAGDNGIYFTRF

SEQ ID NO: 1515122 - protein, 28 aa, Mycobacterium tuberculosis
KPVKGMLTGPVTILAWSFVRDDQPLADT

SEQ ID NO: 1515123 - protein, 26 aa, Mycobacterium tuberculosis
KRSLNHWYRMFGPAFETSLGLEFIGF

SEQ ID NO: 1515124 - protein, 24 aa, Mycobacterium tuberculosis
KRVRRIYYYVRDVPYDVLASFRYL

SEQ ID NO: 1515125 - protein, 28 aa, Mycobacterium tuberculosis
KVVSQRGWRHWVHALTRINLGLSPDEKY

SEQ ID NO: 1515126 - protein, 26 aa, Mycobacterium tuberculosis
LAAVNAPTQALFGRPLIGNGADGSPG

SEQ ID NO: 1515127 - protein, 25 aa, Mycobacterium tuberculosis
LADGRDLLFFSLPGHVPAPVSDRRP

SEQ ID NO: 1515128 - protein, 18 aa, Mycobacterium tuberculosis
LARAVRIGDWPAAYAIGE

SEQ ID NO: 1515129 - protein, 24 aa, Mycobacterium tuberculosis
LARYGIAPAYPWDFIRDVINNTLP

SEQ ID NO: 1515130 - protein, 21 aa, Mycobacterium tuberculosis
LASEILVIADLARQKAQSAQY

SEQ ID NO: 1515131 - protein, 18 aa, Mycobacterium tuberculosis
LASLGTGGAYFFRQLTHD

SEQ ID NO: 1515132 - protein, 20 aa, Mycobacterium tuberculosis
LDGSPLRYNQLDPYLPDLLM

SEQ ID NO: 1515133 - protein, 31 aa, Mycobacterium tuberculosis
LDTGSSSLVIPFWKIGWQNLGLPTGFDVVHY

SEQ ID NO: 1515134 - protein, 18 aa, Mycobacterium tuberculosis
LETAYVIDFLAYVYEETR

SEQ ID NO: 1515135 - protein, 18 aa, Mycobacterium tuberculosis
LFEPLRAALADHARLDFL

SEQ ID NO: 1515136 - protein, 17 aa, Mycobacterium tuberculosis
LFEPVLAGLGEGPHVQL

SEQ ID NO: 1515137 - protein, 26 aa, Mycobacterium tuberculosis
LFKRNICHQAIFYRRGLFGTIGPYNL

SEQ ID NO: 1515138 - protein, 17 aa, Mycobacterium tuberculosis
LGMVFGRKRPGSGPLMI

SEQ ID NO: 1515139 - protein, 23 aa, Mycobacterium tuberculosis
LGQPRSYLAPPTRPAPTEPPPSP

SEQ ID NO: 1515140 - protein, 26 aa, Mycobacterium tuberculosis
LGRRVTEIALVFRRAPHLPFDATMTD

SEQ ID NO: 1515141 - protein, 21 aa, Mycobacterium tuberculosis
LGWPATPARLPFTLGAGAHLQ

SEQ ID NO: 1515142 - protein, 18 aa, Mycobacterium tuberculosis
LGYGAKPWLIVSNNARNR

SEQ ID NO: 1515143 - protein, 18 aa, Mycobacterium tuberculosis
LIGKRFGVPVPNLTPWRA

SEQ ID NO: 1515144 - protein, 21 aa, Mycobacterium tuberculosis
LKDKQLYTLDLGSLVAGSRYR

SEQ ID NO: 1515145 - protein, 20 aa, Mycobacterium tuberculosis
LLDCGTPVNGPLFSNILNDV

SEQ ID NO: 1515146 - protein, 28 aa, Mycobacterium tuberculosis
LLDVQTDSFEWLIGSPRWRESAAERGDV

SEQ ID NO: 1515147 - protein, 27 aa, Mycobacterium tuberculosis
LLECGLLRGWLIPPADIKAARDVIRYR

SEQ ID NO: 1515148 - protein, 19 aa, Mycobacterium tuberculosis
LLETYSVPPLLHNQALAIS

SEQ ID NO: 1515149 - protein, 18 aa, Mycobacterium tuberculosis
LLQPATMALIADRLVPSG

SEQ ID NO: 1515150 - protein, 17 aa, Mycobacterium tuberculosis
LNKPVISWAGDNGIYFT

SEQ ID NO: 1515151 - protein, 19 aa, Mycobacterium tuberculosis
LPAIPLGIDVGGAIGPLTT

SEQ ID NO: 1515152 - protein, 27 aa, Mycobacterium tuberculosis
LPPEINSALMFAGPGSGPLIAAATAWG

SEQ ID NO: 1515153 - protein, 21 aa, Mycobacterium tuberculosis
LPRLLRVVGHYYKPGFHPSQL

SEQ ID NO: 1515154 - protein, 17 aa, Mycobacterium tuberculosis
LPVEDMPFLADGTPVDI

SEQ ID NO: 1515155 - protein, 20 aa, Mycobacterium tuberculosis
LPVLTVRSLVTRPITAEQLR

SEQ ID NO: 1515156 - protein, 25 aa, Mycobacterium tuberculosis
LQAFPQIAQYYRRRFRHVLVDEYQD

SEQ ID NO: 1515157 - protein, 21 aa, Mycobacterium tuberculosis
LQQIEQALLGVINTPTEALVG

SEQ ID NO: 1515158 - protein, 18 aa, Mycobacterium tuberculosis
LQRGLWFEEFQIGTTYLH

SEQ ID NO: 1515159 - protein, 21 aa, Mycobacterium tuberculosis
LRAIAAAHPDLILGSQGLTPQ

SEQ ID NO: 1515160 - protein, 21 aa, Mycobacterium tuberculosis
LRPAPGFFNATTGPSSGFLNW

SEQ ID NO: 1515161 - protein, 29 aa, Mycobacterium tuberculosis
LSAQLAAYHNQFVRALNAGAGSYASAEAA

SEQ ID NO: 1515162 - protein, 28 aa, Mycobacterium tuberculosis
LSDGFRVPGLPMPSLPVIGGDAAAACIA

SEQ ID NO: 1515163 - protein, 25 aa, Mycobacterium tuberculosis
LSFSGLLGAVYFPGILSLLQDDMPF

SEQ ID NO: 1515164 - protein, 18 aa, Mycobacterium tuberculosis
LSGRPFIGNGTNGAPGTG

SEQ ID NO: 1515165 - protein, 27 aa, Mycobacterium tuberculosis
LSRAVFSKGIFPAVDPLASSSTILDPS

SEQ ID NO: 1515166 - protein, 18 aa, Mycobacterium tuberculosis
LSWRRVRTGDLGLAVWGG

SEQ ID NO: 1515167 - protein, 24 aa, Mycobacterium tuberculosis
LTAYRARSTGQRPSWAPLPVQYAD

SEQ ID NO: 1515168 - protein, 29 aa, Mycobacterium tuberculosis
LTHPHGQIYAYPYLTPRTAAMLRQARRHR

SEQ ID NO: 1515169 - protein, 19 aa, Mycobacterium tuberculosis
LVKVPYMPTDLPAWYDVAM

SEQ ID NO: 1515170 - protein, 23 aa, Mycobacterium tuberculosis
LVLEAPRRLVVRQYRLPRIGDDD

SEQ ID NO: 1515171 - protein, 27 aa, Mycobacterium tuberculosis
LVNLPNWLSLTFRINGGAWFNVDTVEL

SEQ ID NO: 1515172 - protein, 26 aa, Mycobacterium tuberculosis
LVSFIHRARRLLPGDPEFGDPLSTAG

SEQ ID NO: 1515173 - protein, 25 aa, Mycobacterium tuberculosis
LVTGRLPADAWLVDLGRHPLRGLPR

SEQ ID NO: 1515174 - protein, 25 aa, Mycobacterium tuberculosis
MAAAAAPYASWLSTAATRALSAAAQ

SEQ ID NO: 1515175 - protein, 29 aa, Mycobacterium tuberculosis
MAMVTAAQPYLAWLTYTAEAAAHAGSQAM

SEQ ID NO: 1515176 - protein, 23 aa, Mycobacterium tuberculosis
MDDLHRHLLSVLIDREWRHGVRV

SEQ ID NO: 1515177 - protein, 19 aa, Mycobacterium tuberculosis
MIVDPRRRIEVARSLEREC

SEQ ID NO: 1515178 - protein, 17 aa, Mycobacterium tuberculosis
MLCYVTPKEHLGLPDRK

SEQ ID NO: 1515179 - protein, 18 aa, Mycobacterium tuberculosis
MLDAVELELYKRLPGDLS

SEQ ID NO: 1515180 - protein, 18 aa, Mycobacterium tuberculosis
MLTLMGPSDLWTVERAAR

SEQ ID NO: 1515181 - protein, 20 aa, Mycobacterium tuberculosis
MLVLQRLSDARRLGHPVLAV

SEQ ID NO: 1515182 - protein, 35 aa, Mycobacterium tuberculosis
MPGVTPAMWAWWFGWHGSDTRRYKLWHPRAHLSAR

SEQ ID NO: 1515183 - protein, 19 aa, Mycobacterium tuberculosis
MSVGPWQGIAAWDVSTGEP

SEQ ID NO: 1515184 - protein, 18 aa, Mycobacterium tuberculosis
MVAATMWDRYRQAVAGRI

SEQ ID NO: 1515185 - protein, 20 aa, Mycobacterium tuberculosis
MVVSFTGRKTGRHFSIPLSA

SEQ ID NO: 1515186 - protein, 20 aa, Mycobacterium tuberculosis
NAPVQSLTGRPLIGDGANGI

SEQ ID NO: 1515187 - protein, 18 aa, Mycobacterium tuberculosis
NAQAAAFHHSFVQTLNAA

SEQ ID NO: 1515188 - protein, 38 aa, Mycobacterium tuberculosis; identical to SEQ ID NO: 220797

SEQ ID NO: 1515189 - protein, 25 aa, Mycobacterium tuberculosis
NAVNAPTQTLLGRPLVGDGADGASG

SEQ ID NO: 1515190 - protein, 24 aa, Mycobacterium tuberculosis
NCLGGSLMDYLIPTALEVPHLETG

SEQ ID NO: 1515191 - protein, 17 aa, Mycobacterium tuberculosis
NFGGANSGFWNLASATS

SEQ ID NO: 1515192 - protein, 17 aa, Mycobacterium tuberculosis
NFNQTITLAWPVSSITI

SEQ ID NO: 1515193 - protein, 21 aa, Mycobacterium tuberculosis
NGGAGGLLYGNGGNGAAGVNA

SEQ ID NO: 1515194 - protein, 20 aa, Mycobacterium tuberculosis
NGGDGSFGATSGPASIGVTG

SEQ ID NO: 1515195 - protein, 17 aa, Mycobacterium tuberculosis
NGMLWRGDHEGLFGLSY

SEQ ID NO: 1515196 - protein, 18 aa, Mycobacterium tuberculosis
NGSSLAVGGFGLCGIPEA

SEQ ID NO: 1515197 - protein, 28 aa, Mycobacterium tuberculosis
NGVARVIAYRWLRVGRLPVPARRVGRVI

SEQ ID NO: 1515198 - protein, 30 aa, Mycobacterium tuberculosis; identical to SEQ ID NO: 226595

SEQ ID NO: 1515199 - protein, 17 aa, Mycobacterium tuberculosis
NGWVQSYGSRCVRPPIL

SEQ ID NO: 1515200 - protein, 22 aa, Mycobacterium tuberculosis
NMGMLFRKHLVMFGPREVLLTS

SEQ ID NO: 1515201 - protein, 17 aa, Mycobacterium tuberculosis
NMSLLDRWYAAIGHELH

SEQ ID NO: 1515202 - protein, 56 aa, Mycobacterium tuberculosis
NPTTLHFPGFTIPTGPIHIGLPLSLTIPGFTIPGGTLIPQLPLGLGLSGGTPPFDL

SEQ ID NO: 1515203 - protein, 19 aa, Mycobacterium tuberculosis
NRTWPDRVIDRAPLWCAVD

SEQ ID NO: 1515204 - protein, 20 aa, Mycobacterium tuberculosis
NTGIALAMVCAARGYRCVLT

SEQ ID NO: 1515205 - protein, 25 aa, Mycobacterium tuberculosis
NTGLTPFLLGPVYISNNPSGVGTVV

SEQ ID NO: 1515206 - protein, 24 aa, Mycobacterium tuberculosis
NVADGDAALALLRAELRPGDVVLV

SEQ ID NO: 1515207 - protein, 26 aa, Mycobacterium tuberculosis
NVINAPTQTLLGRPLIGNGTNGAPGT

SEQ ID NO: 1515208 - protein, 18 aa, Mycobacterium tuberculosis
NVPPITVPAIGLGVSSSG

SEQ ID NO: 1515209 - protein, 35 aa, Mycobacterium tuberculosis
NVQQSLLNAINAPTQALLGRPLIGDGADGTAPGQN

SEQ ID NO: 1515210 - protein, 35 aa, Mycobacterium tuberculosis; identical to SEQ ID NO: 221000

SEQ ID NO: 1515211 - protein, 37 aa, Mycobacterium tuberculosis
PALRELLPLRRADQAEYLRWAVGAFRLATSGVSDATQ

SEQ ID NO: 1515212 - protein, 22 aa, Mycobacterium tuberculosis
PAPGLPADLLIHNRWHRDPHGS

SEQ ID NO: 1515213 - protein, 17 aa, Mycobacterium tuberculosis
PAPPPFVIPATSNVFIS

SEQ ID NO: 1515214 - protein, 25 aa, Mycobacterium tuberculosis
PASPLAIGLFGVNPTVGSIGPGSIS

SEQ ID NO: 1515215 - protein, 25 aa, Mycobacterium tuberculosis
PDGVWYVNLAPITDPALVPIAAARV

SEQ ID NO: 1515216 - protein, 26 aa, Mycobacterium tuberculosis
PDGVWYVNLAPITDPALVPIAAARVL

SEQ ID NO: 1515217 - protein, 19 aa, Mycobacterium tuberculosis
PFGAALLDVTTLRAFSGGN

SEQ ID NO: 1515218 - protein, 19 aa, Mycobacterium tuberculosis
PFLQQYLANQFGYGQLTLT

SEQ ID NO: 1515219 - protein, 28 aa, Mycobacterium tuberculosis
PGAEASWVVGITWWSAVVGGFQMSFVIA

SEQ ID NO: 1515220 - protein, 19 aa, Mycobacterium tuberculosis
PGFAINPFGLDVPLSGGTS

SEQ ID NO: 1515221 - protein, 20 aa, Mycobacterium tuberculosis
PGFLPLQQFSWRIMPENLED

SEQ ID NO: 1515222 - protein, 21 aa, Mycobacterium tuberculosis
PGIPLSLNALGGVGPIVVPDI

SEQ ID NO: 1515223 - protein, 20 aa, Mycobacterium tuberculosis
PGLLTIEDLAGYLAKRRQPL

SEQ ID NO: 1515224 - protein, 33 aa, Mycobacterium tuberculosis
PGNDGRGYVLRRLLRRVIRSAKLLGIDAAIVGD

SEQ ID NO: 1515225 - protein, 22 aa, Mycobacterium tuberculosis
PGRPCWLVGLLFPSADGCAGHS

SEQ ID NO: 1515226 - protein, 17 aa, Mycobacterium tuberculosis
PIEQWLAAKKAASDAIM

SEQ ID NO: 1515227 - protein, 21 aa, Mycobacterium tuberculosis
PINVPPITVPAIGLGINSTGA

SEQ ID NO: 1515228 - protein, 24 aa, Mycobacterium tuberculosis
PLDPQAIQPVLVAASLLVAELGDV

SEQ ID NO: 1515229 - protein, 23 aa, Mycobacterium tuberculosis
PLHSDPWFATQLAGFPKPILHGL

SEQ ID NO: 1515230 - protein, 17 aa, Mycobacterium tuberculosis
PLMLCAKMIHALARLPQ

SEQ ID NO: 1515231 - protein, 17 aa, Mycobacterium tuberculosis
PLPQRVIRARVRGRQVY

SEQ ID NO: 1515232 - protein, 18 aa, Mycobacterium tuberculosis
PMSDVIRLASHANHYLRI

SEQ ID NO: 1515233 - protein, 21 aa, Mycobacterium tuberculosis
PPAPRKPIPLLMWPDRIKGRI

SEQ ID NO: 1515234 - protein, 21 aa, Mycobacterium tuberculosis
PQAPHPGMAPGARPGPVPKPG

SEQ ID NO: 1515235 - protein, 23 aa, Mycobacterium tuberculosis
PQGTVKWFNAEKGFGFIAPEDGS

SEQ ID NO: 1515236 - protein, 17 aa, Mycobacterium tuberculosis
PQLSIPAITTPAFTIDP

SEQ ID NO: 1515237 - protein, 19 aa, Mycobacterium tuberculosis
PRAVYRKFGLCRICLREMA

SEQ ID NO: 1515238 - protein, 31 aa, Mycobacterium tuberculosis; identical to SEQ ID NO: 225432

SEQ ID NO: 1515239 - protein, 23 aa, Mycobacterium tuberculosis
PSADLILLYLIQHCPDLSVDAAA

SEQ ID NO: 1515240 - protein, 20 aa, Mycobacterium tuberculosis
PSRIIVTMRGDPYADRPRLD

SEQ ID NO: 1515241 - protein, 17 aa, Mycobacterium tuberculosis
PTYRAYMRRQQGMSWNT

SEQ ID NO: 1515242 - protein, 18 aa, Mycobacterium tuberculosis
PVREPVRSLVWIRGCLHQ

SEQ ID NO: 1515243 - protein, 19 aa, Mycobacterium tuberculosis
PVTGLVFVTNFDSNTVSVI

SEQ ID NO: 1515244 - protein, 19 aa, Mycobacterium tuberculosis
PVVRVSALKALEGDAKWVA

SEQ ID NO: 1515245 - protein, 20 aa, Mycobacterium tuberculosis
PWQGIAAWDVSTGEPIAPWP

SEQ ID NO: 1515246 - protein, 24 aa, Mycobacterium tuberculosis
QAATFHAQFVQTLSAGAGAYANAE

SEQ ID NO: 1515247 - protein, 21 aa, Mycobacterium tuberculosis
QAIFDHGTPLALYHTKRLASP

SEQ ID NO: 1515248 - protein, 28 aa, Mycobacterium tuberculosis
QALSAQAALFHEQFVRALTAGAGSYAAA

SEQ ID NO: 1515249 - protein, 37 aa, Mycobacterium tuberculosis; identical to SEQ ID NO: 221588

SEQ ID NO: 1515250 - protein, 18 aa, Mycobacterium tuberculosis
QEGFLVRPFTQQCQIIHT

SEQ ID NO: 1515251 - protein, 24 aa, Mycobacterium tuberculosis
QEIALFTVTNPPRTVSVSTLMDGR

SEQ ID NO: 1515252 - protein, 24 aa, Mycobacterium tuberculosis
QENVMNPATWSGAGVVASHMTATE

SEQ ID NO: 1515253 - protein, 18 aa, Mycobacterium tuberculosis
QGDFLIRGLLGADPTTGA

SEQ ID NO: 1515254 - protein, 19 aa, Mycobacterium tuberculosis
QGGLLFGDGGNGGAGGAGG

SEQ ID NO: 1515255 - protein, 18 aa, Mycobacterium tuberculosis
QGPGPAAEKFFAALAIGD

SEQ ID NO: 1515256 - protein, 19 aa, Mycobacterium tuberculosis
QGPGPAAEKFFAALAIGDT

SEQ ID NO: 1515257 - protein, 24 aa, Mycobacterium tuberculosis
QHDWSLEVIDLRSLAPLDFDTIAA

SEQ ID NO: 1515258 - protein, 18 aa, Mycobacterium tuberculosis
QIQQLVVARRLLGLSSSE

SEQ ID NO: 1515259 - protein, 17 aa, Mycobacterium tuberculosis
QLGVRNVAIPRKSKPSA

SEQ ID NO: 1515260 - protein, 25 aa, Mycobacterium tuberculosis
QNATRPPRPGRRLPVYPAAADVDPP

SEQ ID NO: 1515261 - protein, 18 aa, Mycobacterium tuberculosis
QNTNTGAFFIGHSGLLNS

SEQ ID NO: 1515262 - protein, 37 aa, Mycobacterium tuberculosis; identical to SEQ ID NO: 221756

SEQ ID NO: 1515263 - protein, 25 aa, Mycobacterium tuberculosis
QPFEIGGHRSLQHPIQRGRAAHGQQ

SEQ ID NO: 1515264 - protein, 21 aa, Mycobacterium tuberculosis
QPIRRYDVDAAILFSDIVVPL

SEQ ID NO: 1515265 - protein, 20 aa, Mycobacterium tuberculosis
QPLRVRAAMKPISTVPRALA

SEQ ID NO: 1515266 - protein, 25 aa, Mycobacterium tuberculosis
QPNGPSIRTILRALAIHRRPSANSK

SEQ ID NO: 1515267 - protein, 17 aa, Mycobacterium tuberculosis
QVPVSWRRRLRTDRNST

SEQ ID NO: 1515268 - protein, 26 aa, Mycobacterium tuberculosis
RAAEAPTTGLLAAGADEVSAAIASLF

SEQ ID NO: 1515269 - protein, 19 aa, Mycobacterium tuberculosis
RAEFGDRLPVVLLDGREHS

SEQ ID NO: 1515270 - protein, 19 aa, Mycobacterium tuberculosis
RAEFQRITQDLLDRTRKPF

SEQ ID NO: 1515271 - protein, 21 aa, Mycobacterium tuberculosis
RAGLGWGMFPEKLAASPLADG

SEQ ID NO: 1515272 - protein, 18 aa, Mycobacterium tuberculosis
RALGPQLAQRRLGLENQG

SEQ ID NO: 1515273 - protein, 18 aa, Mycobacterium tuberculosis
RAQLREWLAEIGADHSDI

SEQ ID NO: 1515274 - protein, 21 aa, Mycobacterium tuberculosis
RAQMATLPRLKPRVFYDLVVE

SEQ ID NO: 1515275 - protein, 34 aa, Mycobacterium tuberculosis; identical to SEQ ID NO: 221989

SEQ ID NO: 1515276 - protein, 17 aa, Mycobacterium tuberculosis
RCQMSFVVTIPEALAAV

SEQ ID NO: 1515277 - protein, 26 aa, Mycobacterium tuberculosis
RCRGAAVVTPLLLADAYHARVDIPAQ

SEQ ID NO: 1515278 - protein, 18 aa, Mycobacterium tuberculosis
RDIGLGPMPLNGSGRLLV

SEQ ID NO: 1515279 - protein, 31 aa, Mycobacterium tuberculosis
RDLGMLRNMWRFWYQIPMSLPVIGPRVISDP

SEQ ID NO: 1515280 - protein, 18 aa, Mycobacterium tuberculosis
RDSHPIRIPSTLLGLLSE

SEQ ID NO: 1515281 - protein, 17 aa, Mycobacterium tuberculosis
RFYAMRTLRKYVEADLR

SEQ ID NO: 1515282 - protein, 19 aa, Mycobacterium tuberculosis
RGHRVLTRCQMSFVVTIPE

SEQ ID NO: 1515283 - protein, 18 aa, Mycobacterium tuberculosis
RGRYRQSGIRVDHDRHGL

SEQ ID NO: 1515284 - protein, 31 aa, Mycobacterium tuberculosis
RHLHGRSRLWLFRYQGTPIAFFLNVWGADEN

SEQ ID NO: 1515285 - protein, 31 aa, Mycobacterium tuberculosis
RIAEEIGYPVLVRPSYVLGGRGMEIVYDEET

SEQ ID NO: 1515286 - protein, 17 aa, Mycobacterium tuberculosis
RIAGRLGLRPDVRRMPL

SEQ ID NO: 1515287 - protein, 31 aa, Mycobacterium tuberculosis; identical to SEQ ID NO: 225539

SEQ ID NO: 1515288 - protein, 25 aa, Mycobacterium tuberculosis
RLGIRLVIVLVRRWPKVISRAMVMR

SEQ ID NO: 1515289 - protein, 17 aa, Mycobacterium tuberculosis
RLQVLVNEAPRVLRVSW

SEQ ID NO: 1515290 - protein, 25 aa, Mycobacterium tuberculosis
RLRASTRPYILRRLKTDPAIIDDLP

SEQ ID NO: 1515291 - protein, 20 aa, Mycobacterium tuberculosis
RLRRWWPRRYRRSSVYWRLM

SEQ ID NO: 1515292 - protein, 20 aa, Mycobacterium tuberculosis
RLRRWWPRRYRRSSVYWTLM

SEQ ID NO: 1515293 - protein, 27 aa, Mycobacterium tuberculosis
RLSAQAAGFHAQFVQALNAGVNSYASA

SEQ ID NO: 1515294 - protein, 21 aa, Mycobacterium tuberculosis
RLWEHWGKPEIVWYPGGHTGF

SEQ ID NO: 1515295 - protein, 21 aa, Mycobacterium tuberculosis
RLYERLLGWLADIQQPRPADC

SEQ ID NO: 1515296 - protein, 21 aa, Mycobacterium tuberculosis
RPLDAGPYTFLAADALVLKVR

SEQ ID NO: 1515297 - protein, 18 aa, Mycobacterium tuberculosis
RRCEALPVLDTRAADTIL

SEQ ID NO: 1515298 - protein, 25 aa, Mycobacterium tuberculosis
RRGNYLYNFWRDAANPRGLWRRTTL

SEQ ID NO: 1515299 - protein, 20 aa, Mycobacterium tuberculosis
RSALRWLRTVNRSPGLVSFI

SEQ ID NO: 1515300 - protein, 22 aa, Mycobacterium tuberculosis
RSRDLHDALRRRCLYHWIDYPE

SEQ ID NO: 1515301 - protein, 25 aa, Mycobacterium tuberculosis
RTADPWLAPIFARSTLRHSHHLGGI

SEQ ID NO: 1515302 - protein, 19 aa, Mycobacterium tuberculosis
RVELVLDRTPLYAESGGQI

SEQ ID NO: 1515303 - protein, 18 aa, Mycobacterium tuberculosis
RVLADWDFNIRCFSNPAL

SEQ ID NO: 1515304 - protein, 31 aa, Mycobacterium tuberculosis; identical to SEQ ID NO: 226874

SEQ ID NO: 1515305 - protein, 17 aa, Mycobacterium tuberculosis
RVWVMNRLREKMPHVYV

SEQ ID NO: 1515306 - protein, 18 aa, Mycobacterium tuberculosis
RWARNTGGLLVVTHDRWF

SEQ ID NO: 1515307 - protein, 22 aa, Mycobacterium tuberculosis
RYINDRFLPDKAIDLIDEAGAR

SEQ ID NO: 1515308 - protein, 23 aa, Mycobacterium tuberculosis
SAAMRWGHLPLAEESGTIAPQLV

SEQ ID NO: 1515309 - protein, 24 aa, Mycobacterium tuberculosis
SAGPLNIPIIDIPAAPGFGNSTQM

SEQ ID NO: 1515310 - protein, 17 aa, Mycobacterium tuberculosis
SAHAVHTRLRRLTADRD

SEQ ID NO: 1515311 - protein, 19 aa, Mycobacterium tuberculosis
SAPPTPFNGPLGRLRNIAY

SEQ ID NO: 1515312 - protein, 23 aa, Mycobacterium tuberculosis
SATLGVLLRRLEPNWSITLIERL

SEQ ID NO: 1515313 - protein, 26 aa, Mycobacterium tuberculosis
SAVAAQLAPWAQAVRALPNPTAPALA

SEQ ID NO: 1515314 - protein, 22 aa, Mycobacterium tuberculosis
SCHQIVLPQPILRNHELAKLVS

SEQ ID NO: 1515315 - protein, 25 aa, Mycobacterium tuberculosis
SDADWHFIADPASRFYNLVLADCGA

SEQ ID NO: 1515316 - protein, 39 aa, Mycobacterium tuberculosis
SDADWHFIADPASRFYNLVLADCGAGFFDPLTRGVLSTV

SEQ ID NO: 1515317 - protein, 22 aa, Mycobacterium tuberculosis
SDKTLIRFGDPPGGKALTFEVV

SEQ ID NO: 1515318 - protein, 27 aa, Mycobacterium tuberculosis
SEAVDPLLPEVAWSWLVDALTARTDQV

SEQ ID NO: 1515319 - protein, 29 aa, Mycobacterium tuberculosis
SEAVDPLLPEVAWSWLVDALTARTDQVRA

SEQ ID NO: 1515320 - protein, 17 aa, Mycobacterium tuberculosis
SEVSFPKPVFHGDTLYA

SEQ ID NO: 1515321 - protein, 18 aa, Mycobacterium tuberculosis
SFRRTLPATLRAPSAGEP

SEQ ID NO: 1515322 - protein, 43 aa, Mycobacterium tuberculosis
SGDFSMLTYNIAGLPFPLSSAILPRFFYTKEIGKRLNAYYVAN

SEQ ID NO: 1515323 - protein, 22 aa, Mycobacterium tuberculosis
SGGFGQFGGAGGLLYGNGGAAG

SEQ ID NO: 1515324 - protein, 20 aa, Mycobacterium tuberculosis
SGGSALLWGDGGAGGAGGVG

SEQ ID NO: 1515325 - protein, 26 aa, Mycobacterium tuberculosis
SIERFLDTAWWVSDLPSARAFAAVWT

SEQ ID NO: 1515326 - protein, 25 aa, Mycobacterium tuberculosis
SIIANRLSYFLDLRGPSVAVDTACS

SEQ ID NO: 1515327 - protein, 18 aa, Mycobacterium tuberculosis
SIIDAAIAELRHLNPLNI

SEQ ID NO: 1515328 - protein, 21 aa, Mycobacterium tuberculosis
SIKATLTFRDPKELRFFTRTD

SEQ ID NO: 1515329 - protein, 19 aa, Mycobacterium tuberculosis
SIPYRVPYPQVMPTQETTP

SEQ ID NO: 1515330 - protein, 26 aa, Mycobacterium tuberculosis
SIVMLHLALKAFRPGRLPFPVMHVDT

SEQ ID NO: 1515331 - protein, 22 aa, Mycobacterium tuberculosis
SLAYLPRLPVDVVKLGGKFIEC

SEQ ID NO: 1515332 - protein, 19 aa, Mycobacterium tuberculosis
SLGDELMRRFNGAALETLL

SEQ ID NO: 1515333 - protein, 21 aa, Mycobacterium tuberculosis
SLSAALSAQLGDALNAYVDAA

SEQ ID NO: 1515334 - protein, 17 aa, Mycobacterium tuberculosis
SPLLRNSITIHTCSDEA

SEQ ID NO: 1515335 - protein, 36 aa, Mycobacterium tuberculosis; identical to SEQ ID NO: 223074

SEQ ID NO: 1515336 - protein, 26 aa, Mycobacterium tuberculosis
SQAAKDWLCLLEAFDAPQRSGLVRAA

SEQ ID NO: 1515337 - protein, 23 aa, Mycobacterium tuberculosis
SQGLTPQLYPQLAAIAPTVFTAA

SEQ ID NO: 1515338 - protein, 18 aa, Mycobacterium tuberculosis
SRAIYKDGWWACARLDKA

SEQ ID NO: 1515339 - protein, 24 aa, Mycobacterium tuberculosis
SRLAHVHLSRRLAHWTRLYPEVRV

SEQ ID NO: 1515340 - protein, 25 aa, Mycobacterium tuberculosis
SSDGSPPYVVRWLETDHVATVIPGP

SEQ ID NO: 1515341 - protein, 31 aa, Mycobacterium tuberculosis
SSEAVDPLLPEVAWSWLVDALTARTDQVRAL

SEQ ID NO: 1515342 - protein, 25 aa, Mycobacterium tuberculosis
SSYSALSSRQWALAGLTPLRHWRSA

SEQ ID NO: 1515343 - protein, 25 aa, Mycobacterium tuberculosis
STQIAALFGAHARSYQTLSTQAAAF

SEQ ID NO: 1515344 - protein, 27 aa, Mycobacterium tuberculosis
SVERATRLRIPAERWVYPQAGTDAHDT

SEQ ID NO: 1515345 - protein, 19 aa, Mycobacterium tuberculosis
SVPIVGNPLANLVQPNLKV

SEQ ID NO: 1515346 - protein, 25 aa, Mycobacterium tuberculosis
SVSIHRDWLLIELRTDWTVATTRYT

SEQ ID NO: 1515347 - protein, 24 aa, Mycobacterium tuberculosis
SWFAGYRGDLAFASLIVGGGSSEY

SEQ ID NO: 1515348 - protein, 23 aa, Mycobacterium tuberculosis
TAGQLPLEAGKLVRTGKLGADVN

SEQ ID NO: 1515349 - protein, 32 aa, Mycobacterium tuberculosis
TAPRLPDGTPFPTLYYLTHPVLTAAASRLETT

SEQ ID NO: 1515350 - protein, 27 aa, Mycobacterium tuberculosis
TASAEYLRLLRRHNVAAALSGAGPSLI

SEQ ID NO: 1515351 - protein, 17 aa, Mycobacterium tuberculosis
TELGTYLFFVDCVGHID

SEQ ID NO: 1515352 - protein, 56 aa, Mycobacterium tuberculosis
TGAFITGNYSNGLFLSGDYQGLVGLNLVIDMPLPISLGVNIPIDIPITASAGNITL

SEQ ID NO: 1515353 - protein, 25 aa, Mycobacterium tuberculosis
TGAFQFLLYVVVVDLPTHIAQIATW

SEQ ID NO: 1515354 - protein, 24 aa, Mycobacterium tuberculosis
TGEAGGPGGWLLGNGGNGGSGAPG

SEQ ID NO: 1515355 - protein, 20 aa, Mycobacterium tuberculosis
TGELPTWQWESLISKSTRLV

SEQ ID NO: 1515356 - protein, 20 aa, Mycobacterium tuberculosis
TGGNGGYAQLIGDGGDGGPG

SEQ ID NO: 1515357 - protein, 21 aa, Mycobacterium tuberculosis
TGGQGGDFALGGNGGAGGAGG

SEQ ID NO: 1515358 - protein, 27 aa, Mycobacterium tuberculosis
TGGSGGAGGLIGWAGAAGGTGAGGTGG

SEQ ID NO: 1515359 - protein, 26 aa, Mycobacterium tuberculosis
TGGSGGFGAPPPRSIGGGDGGDGGRG

SEQ ID NO: 1515360 - protein, 49 aa, Mycobacterium tuberculosis
TGIIGWPALVMLFAGPRVGEPGKPVRLPIPWRDVGGYRPTGRSIAACRR

SEQ ID NO: 1515361 - protein, 17 aa, Mycobacterium tuberculosis
TGLYPPGSTFKMITAGA

SEQ ID NO: 1515362 - protein, 19 aa, Mycobacterium tuberculosis
TGQVRIPMLAGRRSLNLSN

SEQ ID NO: 1515363 - protein, 21 aa, Mycobacterium tuberculosis
TGTMVLNLGLANHGTLNVGIA

SEQ ID NO: 1515364 - protein, 27 aa, Mycobacterium tuberculosis
TGVGGIGGLLLGLDGANAPASTNPLHT

SEQ ID NO: 1515365 - protein, 26 aa, Mycobacterium tuberculosis
THEAPAPPRGLSAVPLEPGQQTVGFS

SEQ ID NO: 1515366 - protein, 28 aa, Mycobacterium tuberculosis
THFSVGPIIVPRIAGTLPVIDINIGDPG

SEQ ID NO: 1515367 - protein, 19 aa, Mycobacterium tuberculosis
TICVTIAIDRWRRTRPPVY

SEQ ID NO: 1515368 - protein, 19 aa, Mycobacterium tuberculosis
TIQDLRRIAKRRTPRAAFD

SEQ ID NO: 1515369 - protein, 18 aa, Mycobacterium tuberculosis
TITISSAAKMFNCTGWKI

SEQ ID NO: 1515370 - protein, 22 aa, Mycobacterium tuberculosis
TLAAAAAWDGLAAELGQAANSF

SEQ ID NO: 1515371 - protein, 24 aa, Mycobacterium tuberculosis
TLNLTDVHIGWVFTRTVRNNARTH

SEQ ID NO: 1515372 - protein, 35 aa, Mycobacterium tuberculosis
TNFGPLQPLFDVINAPTLALLNRPLIGNGADGTAA

SEQ ID NO: 1515373 - protein, 24 aa, Mycobacterium tuberculosis
TNQIRWLFEKLLGESPRRSPRRQY

SEQ ID NO: 1515374 - protein, 17 aa, Mycobacterium tuberculosis
TNTLALATSPYLRQHAD

SEQ ID NO: 1515375 - protein, 25 aa, Mycobacterium tuberculosis
TPERLRSLERLECLVRRLPAVGHAL

SEQ ID NO: 1515376 - protein, 28 aa, Mycobacterium tuberculosis
TPERLRSLERLECLVRRLPAVGHTLINQ

SEQ ID NO: 1515377 - protein, 18 aa, Mycobacterium tuberculosis
TPIAFFLNVWGADENYIL

SEQ ID NO: 1515378 - protein, 25 aa, Mycobacterium tuberculosis
TPISQKMIDALRPMMRLVVTNGTAK

SEQ ID NO: 1515379 - protein, 24 aa, Mycobacterium tuberculosis
TPTGYLGPPPVPTSSPPTTPAGAP

SEQ ID NO: 1515380 - protein, 19 aa, Mycobacterium tuberculosis
TRLTDRPVRHLPIVRGATV

SEQ ID NO: 1515381 - protein, 23 aa, Mycobacterium tuberculosis
TRVVKVVGFVASAPGFHGQPSVI

SEQ ID NO: 1515382 - protein, 21 aa, Mycobacterium tuberculosis
TSFSARLFNLLITNAPGTQSQ

SEQ ID NO: 1515383 - protein, 19 aa, Mycobacterium tuberculosis
TSVGGTLYAAGGNGGDGGL

SEQ ID NO: 1515384 - protein, 18 aa, Mycobacterium tuberculosis
TTTLSKFLRKPRNAGLRA

SEQ ID NO: 1515385 - protein, 18 aa, Mycobacterium tuberculosis
TVTPLTPGSHAAGAAVGL

SEQ ID NO: 1515386 - protein, 17 aa, Mycobacterium tuberculosis
TWFVLNAKIIEKEFALS

SEQ ID NO: 1515387 - protein, 18 aa, Mycobacterium tuberculosis
TWWVPNEHKPWPLRAAEI

SEQ ID NO: 1515388 - protein, 40 aa, Mycobacterium tuberculosis; identical to SEQ ID NO: 237006

SEQ ID NO: 1515389 - protein, 24 aa, Mycobacterium tuberculosis
VAEFEAVRLAMVQPALVAANRSGL

SEQ ID NO: 1515390 - protein, 28 aa, Mycobacterium tuberculosis
VAQLLLRVGIFSWITHAPKLGGHDSWRL

SEQ ID NO: 1515391 - protein, 17 aa, Mycobacterium tuberculosis
VARRLLCDVGVNAAILD

SEQ ID NO: 1515392 - protein, 26 aa, Mycobacterium tuberculosis
VATVRRFIERFAPYNLSPTAIRPSYG

SEQ ID NO: 1515393 - protein, 17 aa, Mycobacterium tuberculosis
VAYLLEPVSVWAPECSE

SEQ ID NO: 1515394 - protein, 17 aa, Mycobacterium tuberculosis
VCKACHGVAILADNIEP

SEQ ID NO: 1515395 - protein, 22 aa, Mycobacterium tuberculosis
VDGVPRTLRLDQLIRYYVDHQL

SEQ ID NO: 1515396 - protein, 26 aa, Mycobacterium tuberculosis
VDKYLLARIGDAFLALPNGFTAHPRV

SEQ ID NO: 1515397 - protein, 27 aa, Mycobacterium tuberculosis
VDPQVHTLLDFHFRPHLTAASGKHGMG

SEQ ID NO: 1515398 - protein, 31 aa, Mycobacterium tuberculosis; identical to SEQ ID NO: 227062

SEQ ID NO: 1515399 - protein, 38 aa, Mycobacterium tuberculosis; identical to SEQ ID NO: 225724

SEQ ID NO: 1515400 - protein, 19 aa, Mycobacterium tuberculosis
VGCFLLHDNGIDGIVDPSN

SEQ ID NO: 1515401 - protein, 17 aa, Mycobacterium tuberculosis
VGDYVAYLLEPVSVWAP

SEQ ID NO: 1515402 - protein, 19 aa, Mycobacterium tuberculosis
VGETAEFLRWTAGQAPDAS

SEQ ID NO: 1515403 - protein, 17 aa, Mycobacterium tuberculosis
VGFASLGGFNFGGATIG

SEQ ID NO: 1515404 - protein, 25 aa, Mycobacterium tuberculosis
VGGAGGAGWLVGNGGAGGFGGVGTT

SEQ ID NO: 1515405 - protein, 27 aa, Mycobacterium tuberculosis
VGGPGGGHGLLGLGGSHGAGGAGGSGG

SEQ ID NO: 1515406 - protein, 26 aa, Mycobacterium tuberculosis
VGGVSFWASLFPAVWSFCLALRSRGL

SEQ ID NO: 1515407 - protein, 17 aa, Mycobacterium tuberculosis
VGLILRRTIDTDRLLSE

SEQ ID NO: 1515408 - protein, 20 aa, Mycobacterium tuberculosis
VGPINIPPITLNSIGLELSA

SEQ ID NO: 1515409 - protein, 18 aa, Mycobacterium tuberculosis
VGQPVLIPGTMGTASYVL

SEQ ID NO: 1515410 - protein, 32 aa, Mycobacterium tuberculosis; identical to SEQ ID NO: 225731

SEQ ID NO: 1515411 - protein, 23 aa, Mycobacterium tuberculosis
VHAALRQVLGPNAVQAGSLNRPG

SEQ ID NO: 1515412 - protein, 17 aa, Mycobacterium tuberculosis
VHIAKITRREYPNQVLP

SEQ ID NO: 1515413 - protein, 24 aa, Mycobacterium tuberculosis
VHRVPSRMFPKVTTLPLGVPTFRM

SEQ ID NO: 1515414 - protein, 17 aa, Mycobacterium tuberculosis
VLASFRYLAQGHHRASD

SEQ ID NO: 1515415 - protein, 23 aa, Mycobacterium tuberculosis
VLASSIPLINIPPTPGIGNSTIT

SEQ ID NO: 1515416 - protein, 19 aa, Mycobacterium tuberculosis
VLPNLRALNFVIEAILGQG

SEQ ID NO: 1515417 - protein, 17 aa, Mycobacterium tuberculosis
VLVKEIPMYSTCEHHLV

SEQ ID NO: 1515418 - protein, 24 aa, Mycobacterium tuberculosis
VNGRHLVLPLQQYPSLTDFGDANE

SEQ ID NO: 1515419 - protein, 17 aa, Mycobacterium tuberculosis
VNIGPFRIEPIDVPAVV

SEQ ID NO: 1515420 - protein, 20 aa, Mycobacterium tuberculosis
VPPMPVVDAIRRGAQAILPT

SEQ ID NO: 1515421 - protein, 25 aa, Mycobacterium tuberculosis
VRGGKQPRILFATQATARPPTFVLF

SEQ ID NO: 1515422 - protein, 22 aa, Mycobacterium tuberculosis
VRQFRASVCVLGPLVGRCKRAR

SEQ ID NO: 1515423 - protein, 17 aa, Mycobacterium tuberculosis
VRRLLRAQFPQWADLPI

SEQ ID NO: 1515424 - protein, 30 aa, Mycobacterium tuberculosis; identical to SEQ ID NO: 224283

SEQ ID NO: 1515425 - protein, 29 aa, Mycobacterium tuberculosis
VSAQMSAFHAQFVQTFTAGAGAYASAEAA

SEQ ID NO: 1515426 - protein, 33 aa, Mycobacterium tuberculosis
VSHDDARFNVSRAALLVVALTERPDLLMAATED

SEQ ID NO: 1515427 - protein, 17 aa, Mycobacterium tuberculosis
VSSDGVPVLYRPSDLAT

SEQ ID NO: 1515428 - protein, 22 aa, Mycobacterium tuberculosis
VTAITAPDWQQGLSASVRAGLA

SEQ ID NO: 1515429 - protein, 28 aa, Mycobacterium tuberculosis
VTDMAHFFYIHFGLPTYFKNVFEGHIAS

SEQ ID NO: 1515430 - protein, 26 aa, Mycobacterium tuberculosis
VTIVNLIRVLLRNPAVWEKTALIIAY

SEQ ID NO: 1515431 - protein, 18 aa, Mycobacterium tuberculosis
VTVFLAPPSWQDLQARLI

SEQ ID NO: 1515432 - protein, 26 aa, Mycobacterium tuberculosis
VVAVERLPQPALPADAASLADATGGA

SEQ ID NO: 1515433 - protein, 27 aa, Mycobacterium tuberculosis
VVFSQGVAIMIWTLMNARNSRDSLLTT

SEQ ID NO: 1515434 - protein, 20 aa, Mycobacterium tuberculosis
VVKIPVQGGPIGGIAISRDG

SEQ ID NO: 1515435 - protein, 19 aa, Mycobacterium tuberculosis
VVPSTPGDAYWLLRHAIAC

SEQ ID NO: 1515436 - protein, 18 aa, Mycobacterium tuberculosis
VVVLKRLPDALADGDRIL

SEQ ID NO: 1515437 - protein, 18 aa, Mycobacterium tuberculosis
VVYRRDEVSRWISKRESA

SEQ ID NO: 1515438 - protein, 24 aa, Mycobacterium tuberculosis
VYETDLLRPVIDTVARVAARAYDV

SEQ ID NO: 1515439 - protein, 18 aa, Mycobacterium tuberculosis
WLAVLRAQAELGVAVADS

SEQ ID NO: 1515440 - protein, 24 aa, Mycobacterium tuberculosis
WVVNDARFLIYPAMKALTLDIASM

SEQ ID NO: 1515441 - protein, 19 aa, Mycobacterium tuberculosis
WYGKPKVLVDGWLDTAVGA

SEQ ID NO: 1515442 - protein, 17 aa, Mycobacterium tuberculosis
YAQRYRTPRPNPRRVVI

SEQ ID NO: 1515443 - protein, 21 aa, Mycobacterium tuberculosis
YASVEAANASPLQVALDVINA

SEQ ID NO: 1515444 - protein, 19 aa, Mycobacterium tuberculosis
YCRTHHLVKTFWGWRDQQL

SEQ ID NO: 1515445 - protein, 20 aa, Mycobacterium tuberculosis
YDFFGIIFDGHPALTRIEMP

SEQ ID NO: 1515446 - protein, 21 aa, Mycobacterium tuberculosis
YDQLRRYPWPQGHTMSVLSNA

SEQ ID NO: 1515447 - protein, 31 aa, Mycobacterium tuberculosis
YEKTHLPPGAWPPTSWYADWIRGLDVFTTNV

SEQ ID NO: 1515448 - protein, 24 aa, Mycobacterium tuberculosis
YETAYGLTVPPPVIAENRAELMIL

SEQ ID NO: 1515449 - protein, 23 aa, Mycobacterium tuberculosis
YGITIPQFPIRITTTGGIGPIVI

SEQ ID NO: 1515450 - protein, 24 aa, Mycobacterium tuberculosis
YGPLRSLYHFNPAMQPQIGANYYN

SEQ ID NO: 1515451 - protein, 24 aa, Mycobacterium tuberculosis
YGRRRTFLTLLGDPTVRRIVMKRR

SEQ ID NO: 1515452 - protein, 29 aa, Mycobacterium tuberculosis
YHIGRRQLHSHLRVRSLAIQRLAGRCHHR

SEQ ID NO: 1515453 - protein, 17 aa, Mycobacterium tuberculosis
YRRLRDEAPLYRNEERN

SEQ ID NO: 1515454 - protein, 19 aa, Mycobacterium tuberculosis
YRTFQTREMLRWLRGEYND

SEQ ID NO: 1515455 - protein, 20 aa, Mycobacterium tuberculosis
YYGNLVWTKTTYMGINCWKS

SEQ ID NO: 1515456 - protein, 36 aa, Mycobacterium tuberculosis
AAAEAAATSPLLAPINEFFLANTGRPLIGNGTNGAP

SEQ ID NO: 1515457 - protein, 38 aa, Mycobacterium tuberculosis; identical to SEQ ID NO: 215444

SEQ ID NO: 1515458 - protein, 21 aa, Mycobacterium tuberculosis
AAARDLQFELAARFRDEIADL

SEQ ID NO: 1515459 - protein, 18 aa, Mycobacterium tuberculosis
AAAYDAWYDSPTGRPILA

SEQ ID NO: 1515460 - protein, 18 aa, Mycobacterium tuberculosis
AAEAPTTGLLAAGADEVS

SEQ ID NO: 1515461 - protein, 19 aa, Mycobacterium tuberculosis
AAFHHSFVQTLNAAGGAYS

SEQ ID NO: 1515462 - protein, 28 aa, Mycobacterium tuberculosis
AAGAGYADMTAIFLGSSGTPGEDGGNGG

SEQ ID NO: 1515463 - protein, 18 aa, Mycobacterium tuberculosis
AAGGTLFNFGFANDGTLN

SEQ ID NO: 1515464 - protein, 25 aa, Mycobacterium tuberculosis
AAGHRSPLGRLPLRIGRSKSNDMVL

SEQ ID NO: 1515465 - protein, 18 aa, Mycobacterium tuberculosis
AAHPGTSLILLDTASDPR

SEQ ID NO: 1515466 - protein, 18 aa, Mycobacterium tuberculosis
AAIASLFAAHGQAYQAVS

SEQ ID NO: 1515467 - protein, 20 aa, Mycobacterium tuberculosis
AALLLDSWALLGRQDLRAAE

SEQ ID NO: 1515468 - protein, 22 aa, Mycobacterium tuberculosis
AALPSPPRGFTPAPPPQWDDLD

SEQ ID NO: 1515469 - protein, 20 aa, Mycobacterium tuberculosis
AALWSDDLLTRVAIEPLDRA

SEQ ID NO: 1515470 - protein, 27 aa, Mycobacterium tuberculosis
AAMAAAAAPYAGWLAAAAARAAGASAQ

SEQ ID NO: 1515471 - protein, 35 aa, Mycobacterium tuberculosis; identical to SEQ ID NO: 224739

SEQ ID NO: 1515472 - protein, 28 aa, Mycobacterium tuberculosis
AANPLDPHWLLDTLGLTEAARATYRRLS

SEQ ID NO: 1515473 - protein, 20 aa, Mycobacterium tuberculosis
AARYPQLFRPILRQTNIGVH

SEQ ID NO: 1515474 - protein, 18 aa, Mycobacterium tuberculosis
AATHRAMWALGDYALMAE

SEQ ID NO: 1515475 - protein, 17 aa, Mycobacterium tuberculosis
AAYGEWMATPPPTWEDI

SEQ ID NO: 1515476 - protein, 18 aa, Mycobacterium tuberculosis
ADAALRYLDWLSKHSRQI

SEQ ID NO: 1515477 - protein, 24 aa, Mycobacterium tuberculosis
ADDLAPEWLVAPTVVLTPGVTPVS

SEQ ID NO: 1515478 - protein, 23 aa, Mycobacterium tuberculosis
ADGIRAVAVVCLHSYLYPGHERE

SEQ ID NO: 1515479 - protein, 19 aa, Mycobacterium tuberculosis
ADIALRRPSLDHVFLAMTT

SEQ ID NO: 1515480 - protein, 27 aa, Mycobacterium tuberculosis
ADLVYHLTTLFPPVRPRQWLEIRYLDS

SEQ ID NO: 1515481 - protein, 24 aa, Mycobacterium tuberculosis
ADSLVLSDLAYTLARRRTHRSVRT

SEQ ID NO: 1515482 - protein, 27 aa, Mycobacterium tuberculosis
AEAFVAAYMPFLAWLIQASADCVEMAA

SEQ ID NO: 1515483 - protein, 28 aa, Mycobacterium tuberculosis
AELHDVDWVPADRGWIADLARTLNGSAA

SEQ ID NO: 1515484 - protein, 21 aa, Mycobacterium tuberculosis
AELRRRRWSLCPAKRDNSVSA

SEQ ID NO: 1515485 - protein, 25 aa, Mycobacterium tuberculosis
AERDYILELLLAHTSAGLPYERCVG

SEQ ID NO: 1515486 - protein, 20 aa, Mycobacterium tuberculosis
AERNGVPVRALWASSGQAPS

SEQ ID NO: 1515487 - protein, 30 aa, Mycobacterium tuberculosis
AETPQVSNIAYTKKLWQAIRAQDVCGNDAL

SEQ ID NO: 1515488 - protein, 24 aa, Mycobacterium tuberculosis
AFDVTPPAWLEPGQWWALVRVGCA

SEQ ID NO: 1515489 - protein, 20 aa, Mycobacterium tuberculosis
AFHERFIQALSTAAGAYGSA

SEQ ID NO: 1515490 - protein, 19 aa, Mycobacterium tuberculosis
AFHSRFVQALTTAAASYAS

SEQ ID NO: 1515491 - protein, 38 aa, Mycobacterium tuberculosis
AFITGNFNNGFLWRGDHQGLIFGSPGFFNSTSAPSSGF

SEQ ID NO: 1515492 - protein, 19 aa, Mycobacterium tuberculosis
AGAGLMRAGSLPGEAGSAA

SEQ ID NO: 1515493 - protein, 18 aa, Mycobacterium tuberculosis
AGALLFTCNGRGRRMFGV

SEQ ID NO: 1515494 - protein, 22 aa, Mycobacterium tuberculosis
AGGAGGLLFGSGGAGGPGGVGN

SEQ ID NO: 1515495 - protein, 22 aa, Mycobacterium tuberculosis
AGGLGGTLYGAGGHGGAGGPGP

SEQ ID NO: 1515496 - protein, 28 aa, Mycobacterium tuberculosis
AGGNGGNGGWLFGAGGTGGIGGTGAPGA

SEQ ID NO: 1515497 - protein, 25 aa, Mycobacterium tuberculosis
AGGRSGLFEVLAAGGAGGTGGLSVN

SEQ ID NO: 1515498 - protein, 29 aa, Mycobacterium tuberculosis
AGQGSARWRRWLLLLALVGAGDQRRPAGC

SEQ ID NO: 1515499 - protein, 17 aa, Mycobacterium tuberculosis
AGSTAMPQMLRGRTQRT

SEQ ID NO: 1515500 - protein, 24 aa, Mycobacterium tuberculosis
AGWPNYDAVASIAWLGYDAPDGLK

SEQ ID NO: 1515501 - protein, 35 aa, Mycobacterium tuberculosis
AHQRRHRARRLRVGPRQPGVQWHQARLRTKPDQRE

SEQ ID NO: 1515502 - protein, 18 aa, Mycobacterium tuberculosis
AIALAQFYDVPMVSTIHA

SEQ ID NO: 1515503 - protein, 17 aa, Mycobacterium tuberculosis
AIRHAVAWARPGDVVLI

SEQ ID NO: 1515504 - protein, 29 aa, Mycobacterium tuberculosis
AISTQVAAFHDRFAQTLSAAVGSYVSAEA

SEQ ID NO: 1515505 - protein, 36 aa, Mycobacterium tuberculosis; identical to SEQ ID NO: 216036

SEQ ID NO: 1515506 - protein, 26 aa, Mycobacterium tuberculosis
ALAMDPQHRMLLELSWEALERAGIDP

SEQ ID NO: 1515507 - protein, 18 aa, Mycobacterium tuberculosis
ALDAYRRLKTSLAEDLGV

SEQ ID NO: 1515508 - protein, 19 aa, Mycobacterium tuberculosis
ALDLLVSGRYPFASLPRRC

SEQ ID NO: 1515509 - protein, 33 aa, Mycobacterium tuberculosis
ALEQNLLAVINAPAQALFGRPLIGNGANGTAAS

SEQ ID NO: 1515510 - protein, 20 aa, Mycobacterium tuberculosis
ALQEWAYGRRFRYSETMSLG

SEQ ID NO: 1515511 - protein, 21 aa, Mycobacterium tuberculosis
ALRTLLLRYDGKAEPLLASVP

SEQ ID NO: 1515512 - protein, 25 aa, Mycobacterium tuberculosis
ALRVNRSLVLPDPPRHPILREDLSE

SEQ ID NO: 1515513 - protein, 24 aa, Mycobacterium tuberculosis
ALTVPPAEVVANRALLAELTATNI

SEQ ID NO: 1515514 - protein, 19 aa, Mycobacterium tuberculosis
ALVGPCWPAVFAAIGSAVT

SEQ ID NO: 1515515 - protein, 25 aa, Mycobacterium tuberculosis
AMDPQQRLMLEVSWEALEHAGIDPL

SEQ ID NO: 1515516 - protein, 17 aa, Mycobacterium tuberculosis
AMLDLTIAAAPHRDIKS

SEQ ID NO: 1515517 - protein, 17 aa, Mycobacterium tuberculosis
ANISRQVAMVVLGYRGQ

SEQ ID NO: 1515518 - protein, 25 aa, Mycobacterium tuberculosis
ANSWLDAFAHWRQAQGLPATAIAWG

SEQ ID NO: 1515519 - protein, 21 aa, Mycobacterium tuberculosis
ANTGIFDIGLANLGSYNIGLA

SEQ ID NO: 1515520 - protein, 23 aa, Mycobacterium tuberculosis
APLAQQGCIPLAIHPAMTFTGSD

SEQ ID NO: 1515521 - protein, 20 aa, Mycobacterium tuberculosis
APLIAKYRLAGDHRPAPPET

SEQ ID NO: 1515522 - protein, 17 aa, Mycobacterium tuberculosis
APPPRLIRENDLAALTG

SEQ ID NO: 1515523 - protein, 19 aa, Mycobacterium tuberculosis
APRRLVVRQYRLPRIGDDD

SEQ ID NO: 1515524 - protein, 26 aa, Mycobacterium tuberculosis
AQFVRRQRAWLRTRASRQPRETPATL

SEQ ID NO: 1515525 - protein, 17 aa, Mycobacterium tuberculosis
AQPDFLRRPGRDLAPEL

SEQ ID NO: 1515526 - protein, 20 aa, Mycobacterium tuberculosis
AQPMLSIHQRPFDPADRSEP

SEQ ID NO: 1515527 - protein, 24 aa, Mycobacterium tuberculosis
AQVRQWLAAHLPAADLRPAYSNAD

SEQ ID NO: 1515528 - protein, 20 aa, Mycobacterium tuberculosis
AQWRMPMGPVVNLTRWMEAA

SEQ ID NO: 1515529 - protein, 18 aa, Mycobacterium tuberculosis
ARAQAPLVPGTPDPVKGA

SEQ ID NO: 1515530 - protein, 30 aa, Mycobacterium tuberculosis
ARASQTWRYPAFFHAMLDAGVYPPCSAFEA

SEQ ID NO: 1515531 - protein, 24 aa, Mycobacterium tuberculosis
ARDRMRERWRIVLVDEFQDTDPMQ

SEQ ID NO: 1515532 - protein, 25 aa, Mycobacterium tuberculosis
ARGAGGAGGAGGWLSGHSGAHGAMG

SEQ ID NO: 1515533 - protein, 23 aa, Mycobacterium tuberculosis
ARGVPVAAPWDARRARELDDVSL

SEQ ID NO: 1515534 - protein, 23 aa, Mycobacterium tuberculosis
ARHTGKVVMLMPGSWAAGTVLIT

SEQ ID NO: 1515535 - protein, 31 aa, Mycobacterium tuberculosis
ARPPARLVGWTARFLGMVRPGDEVDFRVERV

SEQ ID NO: 1515536 - protein, 18 aa, Mycobacterium tuberculosis
ARRAWLAELAEERRTCVF

SEQ ID NO: 1515537 - protein, 26 aa, Mycobacterium tuberculosis
ARYQRLLHPWVNMAMDTVVAIEPEIV

SEQ ID NO: 1515538 - protein, 18 aa, Mycobacterium tuberculosis
ASEASVTVDWHMPPRARK

SEQ ID NO: 1515539 - protein, 28 aa, Mycobacterium tuberculosis
ASFDMYTGRLFAVSLLPGSPDRLVLTAS

SEQ ID NO: 1515540 - protein, 17 aa, Mycobacterium tuberculosis
ASIRFQQGAYRIHPALL

SEQ ID NO: 1515541 - protein, 19 aa, Mycobacterium tuberculosis
ASLFAAHGQAYQAVSAQMS

SEQ ID NO: 1515542 - protein, 25 aa, Mycobacterium tuberculosis
ASRFYNLVLADCGAGFFDPLTRGVL

SEQ ID NO: 1515543 - protein, 27 aa, Mycobacterium tuberculosis
ASRGAEVLLLSDLLIEALHHSGAARMQ

SEQ ID NO: 1515544 - protein, 26 aa, Mycobacterium tuberculosis
ASRRLRVGQPIQPSPAPLARGSVDSI

SEQ ID NO: 1515545 - protein, 24 aa, Mycobacterium tuberculosis
ASTVFGVRFPAPLGLAAGFDKDGT

SEQ ID NO: 1515546 - protein, 27 aa, Mycobacterium tuberculosis
ATAETWPNPWPMYRALRDHDPVHHVVP

SEQ ID NO: 1515547 - protein, 23 aa, Mycobacterium tuberculosis
ATDLAKIGSTITAANTAAAAVAK

SEQ ID NO: 1515548 - protein, 27 aa, Mycobacterium tuberculosis
ATGLTLSPTLIFDYPTPATLAEHLDSR

SEQ ID NO: 1515549 - protein, 17 aa, Mycobacterium tuberculosis
ATKYTVCFKFMSRIVPY

SEQ ID NO: 1515550 - protein, 24 aa, Mycobacterium tuberculosis
ATSIDPQQRLLLETSWEAIEHAGL

SEQ ID NO: 1515551 - protein, 27 aa, Mycobacterium tuberculosis
AVHSAHSPYYRLVALRLATVGLRAQSL

SEQ ID NO: 1515552 - protein, 24 aa, Mycobacterium tuberculosis
AVKRPEDLRFLVRLARQQGERLGR

SEQ ID NO: 1515553 - protein, 18 aa, Mycobacterium tuberculosis
AVLPSHYEPFGLVALEAA

SEQ ID NO: 1515554 - protein, 24 aa, Mycobacterium tuberculosis
AVNAPTQTLLGRPLIGDGAHGTAP

SEQ ID NO: 1515555 - protein, 19 aa, Mycobacterium tuberculosis
AVQLARLWGLEVFATASRG

SEQ ID NO: 1515556 - protein, 22 aa, Mycobacterium tuberculosis
AVSAWVELHARFGRLPFETLFE

SEQ ID NO: 1515557 - protein, 18 aa, Mycobacterium tuberculosis
AYHNQFVRALNAGAGSYA

SEQ ID NO: 1515558 - protein, 19 aa, Mycobacterium tuberculosis
AYHNQFVRALNAGAGSYAS

SEQ ID NO: 1515559 - protein, 20 aa, Mycobacterium tuberculosis
AYTTVMTVLQRLAKKNRVLQ

SEQ ID NO: 1515560 - protein, 18 aa, Mycobacterium tuberculosis
CDHVRLEILYSANSATDY

SEQ ID NO: 1515561 - protein, 25 aa, Mycobacterium tuberculosis
CGANYLRPPATVVFARRGKQIARGS

SEQ ID NO: 1515562 - protein, 29 aa, Mycobacterium tuberculosis
CGDTDRVTLFRAWYSRRNFGQLSGSVQIS

SEQ ID NO: 1515563 - protein, 17 aa, Mycobacterium tuberculosis
CGRRMVVQVRPDGWWAR

SEQ ID NO: 1515564 - protein, 18 aa, Mycobacterium tuberculosis
CRPIGYPYIVTGADGILI

SEQ ID NO: 1515565 - protein, 23 aa, Mycobacterium tuberculosis
DDVLPYMRYNANKALANLGYQPA

SEQ ID NO: 1515566 - protein, 22 aa, Mycobacterium tuberculosis
DELAAELWLAAASFESVCSGLA

SEQ ID NO: 1515567 - protein, 19 aa, Mycobacterium tuberculosis
DEPAVVVWLASGLAAETFQ

SEQ ID NO: 1515568 - protein, 25 aa, Mycobacterium tuberculosis
DESAFTAGHPLVQPPATCGMKATSS

SEQ ID NO: 1515569 - protein, 23 aa, Mycobacterium tuberculosis
DEVWPAVVFTLVTLLDDPVAADL

SEQ ID NO: 1515570 - protein, 20 aa, Mycobacterium tuberculosis
DFGAFVSLLPGRDGLVHISK

SEQ ID NO: 1515571 - protein, 21 aa, Mycobacterium tuberculosis
DFSLVELPAKLPRATLKKLAQ

SEQ ID NO: 1515572 - protein, 21 aa, Mycobacterium tuberculosis
DGDIPLLLEMPMVYTGRALTQ

SEQ ID NO: 1515573 - protein, 30 aa, Mycobacterium tuberculosis; identical to SEQ ID NO: 216901

SEQ ID NO: 1515574 - protein, 34 aa, Mycobacterium tuberculosis; identical to SEQ ID NO: 236245

SEQ ID NO: 1515575 - protein, 29 aa, Mycobacterium tuberculosis
DHAMARRFDTIARLWDVIGDTGIGFCLDT

SEQ ID NO: 1515576 - protein, 24 aa, Mycobacterium tuberculosis
DHCSHNVLLVRLDGSHPRTPLCDS

SEQ ID NO: 1515577 - protein, 18 aa, Mycobacterium tuberculosis
DHGPFDLTLLPIGAYNTA

SEQ ID NO: 1515578 - protein, 21 aa, Mycobacterium tuberculosis
DHLRHLGRIPATIRYTTQGLG

SEQ ID NO: 1515579 - protein, 18 aa, Mycobacterium tuberculosis
DHSLALLEVIRAIVDDID

SEQ ID NO: 1515580 - protein, 21 aa, Mycobacterium tuberculosis
DIAQLVKWGYAATQLLEGLVE

SEQ ID NO: 1515581 - protein, 20 aa, Mycobacterium tuberculosis
DLFAFGKVMSGGMPAAAFGG

SEQ ID NO: 1515582 - protein, 17 aa, Mycobacterium tuberculosis
DLTLLPIGAYNTAWPDI

SEQ ID NO: 1515583 - protein, 26 aa, Mycobacterium tuberculosis
DLTLPPLQIPGISVPAFSLPAITLPS

SEQ ID NO: 1515584 - protein, 19 aa, Mycobacterium tuberculosis
DLVSLMKVGLRRGKIIVVR

SEQ ID NO: 1515585 - protein, 19 aa, Mycobacterium tuberculosis
DNGNWVWRYDAIRTFGDFA

SEQ ID NO: 1515586 - protein, 21 aa, Mycobacterium tuberculosis
DNPGKTLVGLLAAAERAKHQT

SEQ ID NO: 1515587 - protein, 22 aa, Mycobacterium tuberculosis
DPQQRMALELTWEALEHARIPA

SEQ ID NO: 1515588 - protein, 29 aa, Mycobacterium tuberculosis
DPRLNTGLTPFLLGPVYISNNPSGVGTVV

SEQ ID NO: 1515589 - protein, 20 aa, Mycobacterium tuberculosis
DPTCWWMHHFQMPSRVETWV

SEQ ID NO: 1515590 - protein, 24 aa, Mycobacterium tuberculosis
DPTRRADLIKLLDTFPAGAGARGG

SEQ ID NO: 1515591 - protein, 24 aa, Mycobacterium tuberculosis
DQMLDTAVLLGALPPRVSPVSDGL

SEQ ID NO: 1515592 - protein, 23 aa, Mycobacterium tuberculosis
DQQRQWILHMAKLSAAMAKQAQY

SEQ ID NO: 1515593 - protein, 19 aa, Mycobacterium tuberculosis
DRGTWTPAPVFTMIAQRGR

SEQ ID NO: 1515594 - protein, 26 aa, Mycobacterium tuberculosis
DRKRRQPVTVLLKALGWTSEQIVERF

SEQ ID NO: 1515595 - protein, 20 aa, Mycobacterium tuberculosis
DRMTGLYLQAMFGTQVTAVA

SEQ ID NO: 1515596 - protein, 21 aa, Mycobacterium tuberculosis
DRWFLPLAVPLGLGPKNSELW

SEQ ID NO: 1515597 - protein, 23 aa, Mycobacterium tuberculosis
DRYINDRFLPDKAIDLIDEAGAR

SEQ ID NO: 1515598 - protein, 26 aa, Mycobacterium tuberculosis
DSDMFTFGYKFRPWRHVKVLADGASI

SEQ ID NO: 1515599 - protein, 20 aa, Mycobacterium tuberculosis
DSIQRPLIVFTPKSMLRHKA

SEQ ID NO: 1515600 - protein, 21 aa, Mycobacterium tuberculosis
DTAFTQTLDFAGSGTVGAFPF

SEQ ID NO: 1515601 - protein, 23 aa, Mycobacterium tuberculosis
DTAGTLSILAFTFTMVTGGNDTV

SEQ ID NO: 1515602 - protein, 18 aa, Mycobacterium tuberculosis
DTQLVTIIVSWLSGELPQ

SEQ ID NO: 1515603 - protein, 19 aa, Mycobacterium tuberculosis
DTQLVTIIVSWLSGELPQR

SEQ ID NO: 1515604 - protein, 24 aa, Mycobacterium tuberculosis
DVLAQAQRPLLVLGKGAAYAQADN

SEQ ID NO: 1515605 - protein, 19 aa, Mycobacterium tuberculosis
DVMMPGMDGFGVLRRLRAD

SEQ ID NO: 1515606 - protein, 17 aa, Mycobacterium tuberculosis
DVRLLFSLGLRAMERTA

SEQ ID NO: 1515607 - protein, 19 aa, Mycobacterium tuberculosis
DVRTVLPPVLSIRNGRRAV

SEQ ID NO: 1515608 - protein, 22 aa, Mycobacterium tuberculosis
DVVGLPMRCVFALTAMGFLPQS

SEQ ID NO: 1515609 - protein, 22 aa, Mycobacterium tuberculosis
DVYALQSALPPRFQSNSAFAAN

SEQ ID NO: 1515610 - protein, 25 aa, Mycobacterium tuberculosis
DYSEALALARLGWAALAVGTSHAVL

SEQ ID NO: 1515611 - protein, 19 aa, Mycobacterium tuberculosis
DYTWFVLNAKIIEKEFALS

SEQ ID NO: 1515612 - protein, 38 aa, Mycobacterium tuberculosis
EAANVEQQLLGAINAPTMALLGRPLIGHGADGAPGTGQ

SEQ ID NO: 1515613 - protein, 19 aa, Mycobacterium tuberculosis
EAFVLAEKLGLSAQSLFDV

SEQ ID NO: 1515614 - protein, 24 aa, Mycobacterium tuberculosis
EAIAIDPQQRLLLETSWEAMEHAG

SEQ ID NO: 1515615 - protein, 23 aa, Mycobacterium tuberculosis
EAKVVSERRLWLAVLRAQAELGV

SEQ ID NO: 1515616 - protein, 20 aa, Mycobacterium tuberculosis
EAPVARRLRESFGGSKPAPA

SEQ ID NO: 1515617 - protein, 22 aa, Mycobacterium tuberculosis
EERPFMEFTPGYVLRSLDELPK

SEQ ID NO: 1515618 - protein, 23 aa, Mycobacterium tuberculosis
EERRTCVFFESPRRLAACLNDAV

SEQ ID NO: 1515619 - protein, 20 aa, Mycobacterium tuberculosis
EEVKRWWHSLTPGQQDRVKQ

SEQ ID NO: 1515620 - protein, 32 aa, Mycobacterium tuberculosis
EGFRPATLHQAYLALRAWGLPVSEHTTLATDL

SEQ ID NO: 1515621 - protein, 18 aa, Mycobacterium tuberculosis
EHAHKLVFAVLRGVAAVA

SEQ ID NO: 1515622 - protein, 24 aa, Mycobacterium tuberculosis
EHGFRGLNLRPFMIGRPASDPAYF

SEQ ID NO: 1515623 - protein, 21 aa, Mycobacterium tuberculosis
EICRRLDGIPLAIEFAAARVR

SEQ ID NO: 1515624 - protein, 18 aa, Mycobacterium tuberculosis
EIGVRLFISPRTVHSHLT

SEQ ID NO: 1515625 - protein, 23 aa, Mycobacterium tuberculosis
EIRRSLFGRRIAKYGWPNLSDIL

SEQ ID NO: 1515626 - protein, 21 aa, Mycobacterium tuberculosis
ELIGLPDPDIAQLVKWGYAAT

SEQ ID NO: 1515627 - protein, 24 aa, Mycobacterium tuberculosis
ELISRWAAYWPPAGAEALFRWLSE

SEQ ID NO: 1515628 - protein, 22 aa, Mycobacterium tuberculosis
ELPTYAFDKRRFWLSAEGSGAD

SEQ ID NO: 1515629 - protein, 23 aa, Mycobacterium tuberculosis
ELYPDPVLPALSLLPHTVRTAPA

SEQ ID NO: 1515630 - protein, 19 aa, Mycobacterium tuberculosis
EMLTTAATDLAKIGSTITA

SEQ ID NO: 1515631 - protein, 25 aa, Mycobacterium tuberculosis
EPGAYICVYPFVRSYEWYLLPDEER

SEQ ID NO: 1515632 - protein, 22 aa, Mycobacterium tuberculosis
EPLDADAWFDTVRRAAPFATLP

SEQ ID NO: 1515633 - protein, 19 aa, Mycobacterium tuberculosis
EQERLLLSYAAELARRRRA

SEQ ID NO: 1515634 - protein, 24 aa, Mycobacterium tuberculosis
EQIKDLLGRELLDQRFAGMKQALA

SEQ ID NO: 1515635 - protein, 25 aa, Mycobacterium tuberculosis
ERCAFGLQLIAPRLPPFDVPDGHTE

SEQ ID NO: 1515636 - protein, 24 aa, Mycobacterium tuberculosis
ERDFPASAVRFFASARSQGRKLAF

SEQ ID NO: 1515637 - protein, 19 aa, Mycobacterium tuberculosis
EREFPSFQAMLDLTIAAAP

SEQ ID NO: 1515638 - protein, 19 aa, Mycobacterium tuberculosis
ERRVRAVGLTALAGDEFGN

SEQ ID NO: 1515639 - protein, 21 aa, Mycobacterium tuberculosis
ESALWEASLFEEHGFGDIKIS

SEQ ID NO: 1515640 - protein, 18 aa, Mycobacterium tuberculosis
ETRLVPQRGYHLELITAV

SEQ ID NO: 1515641 - protein, 32 aa, Mycobacterium tuberculosis; identical to SEQ ID NO: 198861

SEQ ID NO: 1515642 - protein, 24 aa, Mycobacterium tuberculosis
EVNSALMFAGAGSGPTLAAAAAWD

SEQ ID NO: 1515643 - protein, 24 aa, Mycobacterium tuberculosis
EVVRVLRPGRYFPYADLRPNNEIA

SEQ ID NO: 1515644 - protein, 17 aa, Mycobacterium tuberculosis
EYAARYPQLFRPILRQT

SEQ ID NO: 1515645 - protein, 17 aa, Mycobacterium tuberculosis
FAIAIRTALMRNGTAYV

SEQ ID NO: 1515646 - protein, 32 aa, Mycobacterium tuberculosis; identical to SEQ ID NO: 236320

SEQ ID NO: 1515647 - protein, 17 aa, Mycobacterium tuberculosis
FFDPLTRGVLSTVSGVV

SEQ ID NO: 1515648 - protein, 18 aa, Mycobacterium tuberculosis
FFDQFFLDATHSGIGQFV

SEQ ID NO: 1515649 - protein, 17 aa, Mycobacterium tuberculosis
FFLVHQRDFQSNRGSHN

SEQ ID NO: 1515650 - protein, 19 aa, Mycobacterium tuberculosis
FGVEPPVALILQGASLHDL

SEQ ID NO: 1515651 - protein, 17 aa, Mycobacterium tuberculosis
FIRDYETSWLDQPIPAL

SEQ ID NO: 1515652 - protein, 28 aa, Mycobacterium tuberculosis
FISGSYSNGFLWSGNYQGLIGLHAALAI

SEQ ID NO: 1515653 - protein, 18 aa, Mycobacterium tuberculosis
FKVRPSFSFFAVGPDGMP

SEQ ID NO: 1515654 - protein, 20 aa, Mycobacterium tuberculosis
FLELDYWQTWHYGDSTMAGV

SEQ ID NO: 1515655 - protein, 21 aa, Mycobacterium tuberculosis
FLRWLAGVRFTGDVWAAPEGT

SEQ ID NO: 1515656 - protein, 18 aa, Mycobacterium tuberculosis
FNLTLQGDVKRFRGFDNW

SEQ ID NO: 1515657 - protein, 27 aa, Mycobacterium tuberculosis
FNVNLKLQFLHDAFPNEFPDPTISVQI

SEQ ID NO: 1515658 - protein, 23 aa, Mycobacterium tuberculosis
FPYAWPRMPILATNVVCTSQPLA

SEQ ID NO: 1515659 - protein, 28 aa, Mycobacterium tuberculosis
FSGFDPWLPSLGNPLTFLSPANIAFALG

SEQ ID NO: 1515660 - protein, 23 aa, Mycobacterium tuberculosis
FSTKMKLFGLPYRITSRVTALKP

SEQ ID NO: 1515661 - protein, 18 aa, Mycobacterium tuberculosis
FTGVIRAFAGLYPGRKFG

SEQ ID NO: 1515662 - protein, 20 aa, Mycobacterium tuberculosis
FTVPNFLELDYWQTWHYGDS

SEQ ID NO: 1515663 - protein, 31 aa, Mycobacterium tuberculosis; identical to SEQ ID NO: 225031

SEQ ID NO: 1515664 - protein, 18 aa, Mycobacterium tuberculosis
FVPYQNFDALRTLALPFG

SEQ ID NO: 1515665 - protein, 17 aa, Mycobacterium tuberculosis
FWRGDQQGLFSAGYRVH

SEQ ID NO: 1515666 - protein, 24 aa, Mycobacterium tuberculosis
GAAGFGYPYAIAPPGIGFGSGMSA

SEQ ID NO: 1515667 - protein, 21 aa, Mycobacterium tuberculosis
GAALLLDSWALLGRQDLRAAE

SEQ ID NO: 1515668 - protein, 23 aa, Mycobacterium tuberculosis
GADGGAGGWLFGNGGNGGHGATG

SEQ ID NO: 1515669 - protein, 30 aa, Mycobacterium tuberculosis
GAELDVFLVRKLGVPQWRELAMGALASGGG

SEQ ID NO: 1515670 - protein, 25 aa, Mycobacterium tuberculosis
GAGGAGPVLFGHGGAGGMGGQGGTG

SEQ ID NO: 1515671 - protein, 18 aa, Mycobacterium tuberculosis
GAGGILYGNGGNGGSGAT

SEQ ID NO: 1515672 - protein, 18 aa, Mycobacterium tuberculosis
GAGGLLYGNGGAGGSGAP

SEQ ID NO: 1515673 - protein, 25 aa, Mycobacterium tuberculosis
GAGGNAGILFGAGGIGGTGGTGLGA

SEQ ID NO: 1515674 - protein, 24 aa, Mycobacterium tuberculosis
GAGGNGGWLYGNGGLGGNGGAATQ

SEQ ID NO: 1515675 - protein, 23 aa, Mycobacterium tuberculosis
GAGGRAFLFGDGGAGGAALSAGS

SEQ ID NO: 1515676 - protein, 24 aa, Mycobacterium tuberculosis
GAGGSAGLLALGDGGAGGAGGAAT

SEQ ID NO: 1515677 - protein, 23 aa, Mycobacterium tuberculosis
GAGGTAGFTGSGGIGGNGGAGGT

SEQ ID NO: 1515678 - protein, 25 aa, Mycobacterium tuberculosis
GAGTPVPASLIPVAAVVGTVRTGVG

SEQ ID NO: 1515679 - protein, 22 aa, Mycobacterium tuberculosis
GALFAPIPVLLVDLGGWQHESV

SEQ ID NO: 1515680 - protein, 22 aa, Mycobacterium tuberculosis
GAQVTIFRLGSDPGLARFIDQV

SEQ ID NO: 1515681 - protein, 23 aa, Mycobacterium tuberculosis
GATLPAAAWQRCRTHYAANLMAA

SEQ ID NO: 1515682 - protein, 25 aa, Mycobacterium tuberculosis
GAWSDIGQLGWWSASPARASALEES

SEQ ID NO: 1515683 - protein, 17 aa, Mycobacterium tuberculosis
GDCLAPPRPVLRAALSP

SEQ ID NO: 1515684 - protein, 27 aa, Mycobacterium tuberculosis
GDGADAVNVVFMPTEPQAATGTAGSAG

SEQ ID NO: 1515685 - protein, 31 aa, Mycobacterium tuberculosis
GDIGPITIQPIPILPTIPLSIHQTVNLGPLV

SEQ ID NO: 1515686 - protein, 23 aa, Mycobacterium tuberculosis
GDNRAYLVLPPGAGKTMIGLEAA

SEQ ID NO: 1515687 - protein, 24 aa, Mycobacterium tuberculosis
GDVNGGLAGIGGNAGFVGNGGAGG

SEQ ID NO: 1515688 - protein, 23 aa, Mycobacterium tuberculosis
GDVPLIGFAGAPFTLASYLVEGG

SEQ ID NO: 1515689 - protein, 20 aa, Mycobacterium tuberculosis
GEWTVRHTVAAWPAVCSGLR

SEQ ID NO: 1515690 - protein, 24 aa, Mycobacterium tuberculosis
GFDIASLWPVKPLLSLSALETHFA

SEQ ID NO: 1515691 - protein, 18 aa, Mycobacterium tuberculosis
GFSRMPFGRDLAPGMLHR

SEQ ID NO: 1515692 - protein, 27 aa, Mycobacterium tuberculosis
GGAAGARGALTSGGLAGGVGAGGTGGT

SEQ ID NO: 1515693 - protein, 21 aa, Mycobacterium tuberculosis
GGAGGILFGAGGAGGAGGAVT

SEQ ID NO: 1515694 - protein, 27 aa, Mycobacterium tuberculosis
GGAGGNAGILFGAGGIGGTGGTGLGAP

SEQ ID NO: 1515695 - protein, 24 aa, Mycobacterium tuberculosis
GGAGGSGGFLSGAAGVSGADGIGG

SEQ ID NO: 1515696 - protein, 24 aa, Mycobacterium tuberculosis
GGAGGSGGWLLGNGGVGGAGGQSL

SEQ ID NO: 1515697 - protein, 25 aa, Mycobacterium tuberculosis
GGAGRGLFLGLGGDGGAGGTSNNNG

SEQ ID NO: 1515698 - protein, 24 aa, Mycobacterium tuberculosis
GGAGSPGGLLYGTGGAGGNGGPGG

SEQ ID NO: 1515699 - protein, 18 aa, Mycobacterium tuberculosis
GGALLLEPGTLATLGAAA

SEQ ID NO: 1515700 - protein, 33 aa, Mycobacterium tuberculosis
GGAPGALGGKGGSGGLIGRAGSDGGVGAGGAGG

SEQ ID NO: 1515701 - protein, 25 aa, Mycobacterium tuberculosis
GGASGAGGWLLGTGGAGGAGGNGGN

SEQ ID NO: 1515702 - protein, 20 aa, Mycobacterium tuberculosis
GGDAGFFYGNGGAGGSGAGG

SEQ ID NO: 1515703 - protein, 21 aa, Mycobacterium tuberculosis
GGDAGLFLGAAGTGGQAALSQ

SEQ ID NO: 1515704 - protein, 25 aa, Mycobacterium tuberculosis
GGDARFLSLLSIRQLATEPSLSGPG

SEQ ID NO: 1515705 - protein, 26 aa, Mycobacterium tuberculosis
GGDGGAAGLFGAGGIGGAGGPGFNGG

SEQ ID NO: 1515706 - protein, 18 aa, Mycobacterium tuberculosis
GGDQLRQLGCAGAACLGE

SEQ ID NO: 1515707 - protein, 29 aa, Mycobacterium tuberculosis
GGGAGGAGGSGFFGGKGGFGGDGGQGGPN

SEQ ID NO: 1515708 - protein, 29 aa, Mycobacterium tuberculosis
GGGLGGGSFGLPGLNGSCGDGGDGGNGAP

SEQ ID NO: 1515709 - protein, 24 aa, Mycobacterium tuberculosis
GGGNPHYDIPKLLSMYKAGKLNLD

SEQ ID NO: 1515710 - protein, 22 aa, Mycobacterium tuberculosis
GGNAGLLSLGASGGAGGSGGAS

SEQ ID NO: 1515711 - protein, 24 aa, Mycobacterium tuberculosis
GGNAVIPGDGVGKAPHGDAGGSGG

SEQ ID NO: 1515712 - protein, 27 aa, Mycobacterium tuberculosis
GGNGGDGGWLFGSGGNGAPGAAGQSGG

SEQ ID NO: 1515713 - protein, 25 aa, Mycobacterium tuberculosis
GGNGGHGGLWIGNGGDGGAGGVGGV

SEQ ID NO: 1515714 - protein, 22 aa, Mycobacterium tuberculosis
GGNGGLLFGSAGAGGAGGSGAN

SEQ ID NO: 1515715 - protein, 27 aa, Mycobacterium tuberculosis
GGNGGNGALLIGAGGVGGAGGIGGQGT

SEQ ID NO: 1515716 - protein, 25 aa, Mycobacterium tuberculosis
GGNGGSAGLWGNGGAGGAGGSGGAA

SEQ ID NO: 1515717 - protein, 25 aa, Mycobacterium tuberculosis
GGNHAFYLAIPPKSFPVVCEQLHKS

SEQ ID NO: 1515718 - protein, 27 aa, Mycobacterium tuberculosis
GGRGAHGTLFSSLAGTGGTGGNGGTGG

SEQ ID NO: 1515719 - protein, 23 aa, Mycobacterium tuberculosis
GGRRSFILVPGIDVPFHSRVLRV

SEQ ID NO: 1515720 - protein, 30 aa, Mycobacterium tuberculosis; identical to SEQ ID NO: 215219

SEQ ID NO: 1515721 - protein, 22 aa, Mycobacterium tuberculosis
GGTLCCALANRLRITKPEAGRR

SEQ ID NO: 1515722 - protein, 23 aa, Mycobacterium tuberculosis
GGTLCCALANRLRITKPEAGRRI

SEQ ID NO: 1515723 - protein, 19 aa, Mycobacterium tuberculosis
GGTRFVYRRLGADAGVPVI

SEQ ID NO: 1515724 - protein, 26 aa, Mycobacterium tuberculosis
GGYAPNRTGWLLPFASELVTSAQARR

SEQ ID NO: 1515725 - protein, 19 aa, Mycobacterium tuberculosis
GHFNAVELILCFNQLAYSA

SEQ ID NO: 1515726 - protein, 23 aa, Mycobacterium tuberculosis
GHICPISMTYAVVPALRYNSELA

SEQ ID NO: 1515727 - protein, 29 aa, Mycobacterium tuberculosis
GIGPITVLPPIHIPPIPVGFAAVGGIGPI

SEQ ID NO: 1515728 - protein, 24 aa, Mycobacterium tuberculosis
GIGREMHVIVGQGKLEEILQSRPE

SEQ ID NO: 1515729 - protein, 29 aa, Mycobacterium tuberculosis
GKGGAGTLLGLTVFGDNGGAGVLGDSTDP

SEQ ID NO: 1515730 - protein, 24 aa, Mycobacterium tuberculosis
GKPPTWWDSLPTDRPIVYATLGTS

SEQ ID NO: 1515731 - protein, 22 aa, Mycobacterium tuberculosis
GKQWGLEYLFGVLEAGRAGVFR

SEQ ID NO: 1515732 - protein, 23 aa, Mycobacterium tuberculosis
GLGGFAYQSAVSEIPWSYDIGSN

SEQ ID NO: 1515733 - protein, 17 aa, Mycobacterium tuberculosis
GLGGLLLGNGGAGGVGG

SEQ ID NO: 1515734 - protein, 29 aa, Mycobacterium tuberculosis
GLIDPDAWAFVWVVDPPLFEPADEATAAG

SEQ ID NO: 1515735 - protein, 33 aa, Mycobacterium tuberculosis
GLLGSAGVQLFRPAFLLAVPTALGGVGSLAIAV

SEQ ID NO: 1515736 - protein, 17 aa, Mycobacterium tuberculosis
GMGMGLHAGYPVFAEAF

SEQ ID NO: 1515737 - protein, 26 aa, Mycobacterium tuberculosis
GNFSNGILWRGNFEGLFGLNVGITIP

SEQ ID NO: 1515738 - protein, 24 aa, Mycobacterium tuberculosis
GNGGAGGLLIGNGGAGGVGGTAGA

SEQ ID NO: 1515739 - protein, 25 aa, Mycobacterium tuberculosis
GNGGKAGFSPGPTNFGLNGAGGGGG

SEQ ID NO: 1515740 - protein, 25 aa, Mycobacterium tuberculosis
GNGGRAGLLLGVGGMGGNGGATSVG

SEQ ID NO: 1515741 - protein, 24 aa, Mycobacterium tuberculosis
GNGGRGGMLIGNGGAGGAGGTGGT

SEQ ID NO: 1515742 - protein, 25 aa, Mycobacterium tuberculosis
GNGGTGGFAGFGGTAGNGGSGGTGG

SEQ ID NO: 1515743 - protein, 21 aa, Mycobacterium tuberculosis
GNGGVWYGNGGAGGAAGQGGP

SEQ ID NO: 1515744 - protein, 27 aa, Mycobacterium tuberculosis
GNGSKGLPGLGRLGNPGLDGGTGGNGG

SEQ ID NO: 1515745 - protein, 21 aa, Mycobacterium tuberculosis
GNPAPRLFRLADDRALLNRMG

SEQ ID NO: 1515746 - protein, 17 aa, Mycobacterium tuberculosis
GNPGFSGAGGLGGLSGD

SEQ ID NO: 1515747 - protein, 18 aa, Mycobacterium tuberculosis
GNYNIGFANLGNYNIGFG

SEQ ID NO: 1515748 - protein, 24 aa, Mycobacterium tuberculosis
GPEGLPSVFVYDGYPGGAGFAERG

SEQ ID NO: 1515749 - protein, 27 aa, Mycobacterium tuberculosis
GPGQPGGPGGLLYGNGGHGGAGAAGQD

SEQ ID NO: 1515750 - protein, 18 aa, Mycobacterium tuberculosis
GPINIPPITLNSIGLELS

SEQ ID NO: 1515751 - protein, 17 aa, Mycobacterium tuberculosis
GPPPVPTSSPPTTPAGA

SEQ ID NO: 1515752 - protein, 20 aa, Mycobacterium tuberculosis
GPRMPMVPGTWEQGSNEPEA

SEQ ID NO: 1515753 - protein, 25 aa, Mycobacterium tuberculosis
GQAGGAGGILWGNGGAGGSGAPGQV

SEQ ID NO: 1515754 - protein, 19 aa, Mycobacterium tuberculosis
GQPGGDGGILWGNGGNGGD

SEQ ID NO: 1515755 - protein, 22 aa, Mycobacterium tuberculosis
GQRKRLRTVVDVSALSWDRVLR

SEQ ID NO: 1515756 - protein, 22 aa, Mycobacterium tuberculosis
GQVIVLTCSPTRYGGVKGAHRI

SEQ ID NO: 1515757 - protein, 17 aa, Mycobacterium tuberculosis
GQVVYVCKACHGVAILA

SEQ ID NO: 1515758 - protein, 18 aa, Mycobacterium tuberculosis
GRKTGRHFSIPLSAHVID

SEQ ID NO: 1515759 - protein, 20 aa, Mycobacterium tuberculosis
GRRELLPYSDLDVLLLHDGK

SEQ ID NO: 1515760 - protein, 22 aa, Mycobacterium tuberculosis
GSAACQGFITQLGRNFQVIYEQ

SEQ ID NO: 1515761 - protein, 24 aa, Mycobacterium tuberculosis
GSRWYRTFQTREMLRWLRGEYNDA

SEQ ID NO: 1515762 - protein, 27 aa, Mycobacterium tuberculosis
GSVIARLTGMHWWGPASTSMLAMSAPY

SEQ ID NO: 1515763 - protein, 23 aa, Mycobacterium tuberculosis
GTASSPFGIAIAIGGAGAQGGAG

SEQ ID NO: 1515764 - protein, 20 aa, Mycobacterium tuberculosis
GTENLRRIEPLLATLRAIAV

SEQ ID NO: 1515765 - protein, 22 aa, Mycobacterium tuberculosis
GTGGAGGLFASGGVGGTGGGAG

SEQ ID NO: 1515766 - protein, 18 aa, Mycobacterium tuberculosis
GTPALFTLSASSADALRQ

SEQ ID NO: 1515767 - protein, 24 aa, Mycobacterium tuberculosis
GTRMKLARNMLTLVSYAAAAEAQR

SEQ ID NO: 1515768 - protein, 18 aa, Mycobacterium tuberculosis
GVGGPGGFAAAFGATGGA

SEQ ID NO: 1515769 - protein, 18 aa, Mycobacterium tuberculosis
GVIELHDCFSANELLLYE

SEQ ID NO: 1515770 - protein, 25 aa, Mycobacterium tuberculosis
GVLRLRALMESFWSDELDRLVADAA

SEQ ID NO: 1515771 - protein, 23 aa, Mycobacterium tuberculosis
GVPSLPFRLIHIADTYTPIAPED

SEQ ID NO: 1515772 - protein, 28 aa, Mycobacterium tuberculosis
GVWELFWPDFPCDGLYKFRVHGADGVVT

SEQ ID NO: 1515773 - protein, 20 aa, Mycobacterium tuberculosis
GWVRAQLLHYMRSAPRRNVA

SEQ ID NO: 1515774 - protein, 20 aa, Mycobacterium tuberculosis
GYSLPAIPLGIDVGGGLGPF

SEQ ID NO: 1515775 - protein, 17 aa, Mycobacterium tuberculosis
HAIPVDEIARCATYPVL

SEQ ID NO: 1515776 - protein, 19 aa, Mycobacterium tuberculosis
HDPVMCFSGPMIFGAGVLG

SEQ ID NO: 1515777 - protein, 21 aa, Mycobacterium tuberculosis
HEELFSAVRFDIGWTASSDDG

SEQ ID NO: 1515778 - protein, 25 aa, Mycobacterium tuberculosis
HEVGWSMLPVARSVLRRIGDGTDVV

SEQ ID NO: 1515779 - protein, 18 aa, Mycobacterium tuberculosis
HFGPITIPNITVVGPTTT

SEQ ID NO: 1515780 - protein, 25 aa, Mycobacterium tuberculosis
HGALRSAWIGYWVPSAATGGGVATG

SEQ ID NO: 1515781 - protein, 18 aa, Mycobacterium tuberculosis
HGLADMYGFIPVDREPGL

SEQ ID NO: 1515782 - protein, 17 aa, Mycobacterium tuberculosis
HHRNEVTEIIPLDGFLD

SEQ ID NO: 1515783 - protein, 19 aa, Mycobacterium tuberculosis
HIEFPYVYLDATYLNVRNG

SEQ ID NO: 1515784 - protein, 25 aa, Mycobacterium tuberculosis
HLHQGIALQVPPYNYAHPDDLLAAA

SEQ ID NO: 1515785 - protein, 20 aa, Mycobacterium tuberculosis
HLLMALLTQNDGIAAPLLEA

SEQ ID NO: 1515786 - protein, 17 aa, Mycobacterium tuberculosis
HLTVPRNNHPRAAGGEL

SEQ ID NO: 1515787 - protein, 17 aa, Mycobacterium tuberculosis
HPDLHNAFPPLRTRKVV

SEQ ID NO: 1515788 - protein, 22 aa, Mycobacterium tuberculosis
HPGIDWAKYALKAPVMMVRSPD

SEQ ID NO: 1515789 - protein, 26 aa, Mycobacterium tuberculosis
HPGLLRFTVGLAQITSLLLAGDVAPA

SEQ ID NO: 1515790 - protein, 21 aa, Mycobacterium tuberculosis
HPTLRLTTNLRIGLEGREARA

SEQ ID NO: 1515791 - protein, 21 aa, Mycobacterium tuberculosis
HRPGVYLFRGPSGEVLYVGTA

SEQ ID NO: 1515792 - protein, 18 aa, Mycobacterium tuberculosis
HSEAPPFFVLHGEKDPMV

SEQ ID NO: 1515793 - protein, 18 aa, Mycobacterium tuberculosis
HWVHALTRINLGLSPDEK

SEQ ID NO: 1515794 - protein, 26 aa, Mycobacterium tuberculosis
HYQKLTGYENLRFFASLYAGATADPM

SEQ ID NO: 1515795 - protein, 17 aa, Mycobacterium tuberculosis
IALGHPLGATGAKLFTT

SEQ ID NO: 1515796 - protein, 20 aa, Mycobacterium tuberculosis
IASGPSLARWARANGWSAPP

SEQ ID NO: 1515797 - protein, 24 aa, Mycobacterium tuberculosis
IATGVSPYTLAFSAALRPKTQRRL

SEQ ID NO: 1515798 - protein, 18 aa, Mycobacterium tuberculosis
IATLILPADVCWSDGAHA

SEQ ID NO: 1515799 - protein, 17 aa, Mycobacterium tuberculosis
IAVNPLPEAGLIRFKDP

SEQ ID NO: 1515800 - protein, 31 aa, Mycobacterium tuberculosis
IDALAVGLQRKDGAAWLAHNRSGAGLFGSIA

SEQ ID NO: 1515801 - protein, 21 aa, Mycobacterium tuberculosis
IDHPLAVATLLDRAALDARAQ

SEQ ID NO: 1515802 - protein, 25 aa, Mycobacterium tuberculosis
IDKGDIVVLLESMKMEIPVLAEAAG

SEQ ID NO: 1515803 - protein, 17 aa, Mycobacterium tuberculosis
IDSTLFHSLPVDSRDRY

SEQ ID NO: 1515804 - protein, 18 aa, Mycobacterium tuberculosis
IDTPVLVAFCARSPHGVS

SEQ ID NO: 1515805 - protein, 22 aa, Mycobacterium tuberculosis
IEAIIGCLLHDIGKPVQRAALG

SEQ ID NO: 1515806 - protein, 20 aa, Mycobacterium tuberculosis
IEGHRKPPRYGWAGSTPSSI

SEQ ID NO: 1515807 - protein, 39 aa, Mycobacterium tuberculosis
IEPIHILPDIPININETLYLGPLVVPPINVPAISLGVGI

SEQ ID NO: 1515808 - protein, 27 aa, Mycobacterium tuberculosis
IERSTALLDLGWTIIRVTSELLRYRRG

SEQ ID NO: 1515809 - protein, 18 aa, Mycobacterium tuberculosis
IFSVLLREYEFEMAQPPE

SEQ ID NO: 1515810 - protein, 19 aa, Mycobacterium tuberculosis
IGAILPLLASVADPSNFGA

SEQ ID NO: 1515811 - protein, 17 aa, Mycobacterium tuberculosis
IGALLMDQTVIAGVGNV

SEQ ID NO: 1515812 - protein, 28 aa, Mycobacterium tuberculosis
IGGGATGTLTFFGSGGDGGPGGAGANTA

SEQ ID NO: 1515813 - protein, 30 aa, Mycobacterium tuberculosis; identical to SEQ ID NO: 219376

SEQ ID NO: 1515814 - protein, 28 aa, Mycobacterium tuberculosis
IGPIIIPDTTILPPIHLGLTGQANYGFA

SEQ ID NO: 1515815 - protein, 28 aa, Mycobacterium tuberculosis
IGTLGFTIPGFTIPAAPLPLTIDIDGQI

SEQ ID NO: 1515816 - protein, 25 aa, Mycobacterium tuberculosis
IGVNFIDTYFRSGQYPRELPFVIGS

SEQ ID NO: 1515817 - protein, 25 aa, Mycobacterium tuberculosis
IGYPPTRVWGVPAAGLWAHRLGDQR

SEQ ID NO: 1515818 - protein, 17 aa, Mycobacterium tuberculosis
ILDVMMPGMDGFGVLRR

SEQ ID NO: 1515819 - protein, 25 aa, Mycobacterium tuberculosis
INAQLFSMPIHQVMVMPGSVMTIPG

SEQ ID NO: 1515820 - protein, 18 aa, Mycobacterium tuberculosis
INGLYKTELIKPGKPWRS

SEQ ID NO: 1515821 - protein, 19 aa, Mycobacterium tuberculosis
IPAITFPRIDASGSVDIGI

SEQ ID NO: 1515822 - protein, 20 aa, Mycobacterium tuberculosis
IPGFAINPFGLDVPLSGGTN

SEQ ID NO: 1515823 - protein, 24 aa, Mycobacterium tuberculosis
IPGFSIPEQPLPLAINVIGHINAL

SEQ ID NO: 1515824 - protein, 22 aa, Mycobacterium tuberculosis
IPGIPLSLNALGGVGPIVVPDI

SEQ ID NO: 1515825 - protein, 17 aa, Mycobacterium tuberculosis
IPIPAIHIDFDGAADAG

SEQ ID NO: 1515826 - protein, 19 aa, Mycobacterium tuberculosis
IQGVWVHPEWRGIGLGTAG

SEQ ID NO: 1515827 - protein, 18 aa, Mycobacterium tuberculosis
IQIDTTNVLFIVAGAFAG

SEQ ID NO: 1515828 - protein, 21 aa, Mycobacterium tuberculosis
IRACRPITVPLTQAQGLVLGG

SEQ ID NO: 1515829 - protein, 17 aa, Mycobacterium tuberculosis
IRGLLGADPTTGAIGIG

SEQ ID NO: 1515830 - protein, 28 aa, Mycobacterium tuberculosis
ISAVRGPNFLGWIHPAATATAPARTEAP

SEQ ID NO: 1515831 - protein, 29 aa, Mycobacterium tuberculosis
ISDPKGRYFRLLTGWVGGGFRVPDDDVRL

SEQ ID NO: 1515832 - protein, 29 aa, Mycobacterium tuberculosis
ISGNYSNGFFWRGDYQGLIGLSTTITIPE

SEQ ID NO: 1515833 - protein, 25 aa, Mycobacterium tuberculosis
ISHGPAVLGAPAWKPPHPLSDSITA

SEQ ID NO: 1515834 - protein, 23 aa, Mycobacterium tuberculosis
ISIPNIAIPSIHLGIDPTFDVGP

SEQ ID NO: 1515835 - protein, 19 aa, Mycobacterium tuberculosis
ISPAWLRLDARFGSVYRHR

SEQ ID NO: 1515836 - protein, 25 aa, Mycobacterium tuberculosis
ISTQVAAFHDRFAQTLSAAVGSYVS

SEQ ID NO: 1515837 - protein, 25 aa, Mycobacterium tuberculosis
ITEAWMRLQHRPRWQVTVSVVFDDW

SEQ ID NO: 1515838 - protein, 20 aa, Mycobacterium tuberculosis
ITEPLGYDTTYTWSGSAVGH

SEQ ID NO: 1515839 - protein, 25 aa, Mycobacterium tuberculosis
ITIPEFPIHWTSTGGIGPIIIPDTT

SEQ ID NO: 1515840 - protein, 22 aa, Mycobacterium tuberculosis
IVEGMLALTGYYAWHKICVERA

SEQ ID NO: 1515841 - protein, 17 aa, Mycobacterium tuberculosis
IVVPKPLREALGLQPGS

SEQ ID NO: 1515842 - protein, 19 aa, Mycobacterium tuberculosis
IYDPGIILDKDRGLGAVVG

SEQ ID NO: 1515843 - protein, 19 aa, Mycobacterium tuberculosis
KAFGYLPGPNGPEPDPRTA

SEQ ID NO: 1515844 - protein, 17 aa, Mycobacterium tuberculosis
KAMMLAEPASWHALMAK

SEQ ID NO: 1515845 - protein, 23 aa, Mycobacterium tuberculosis
KARLVGAMSVPPTWEGSVPARMA

SEQ ID NO: 1515846 - protein, 17 aa, Mycobacterium tuberculosis
KAWLRQAINHLEKLIGR

SEQ ID NO: 1515847 - protein, 17 aa, Mycobacterium tuberculosis
KAYAAYSTPFWRASGYS

SEQ ID NO: 1515848 - protein, 18 aa, Mycobacterium tuberculosis
KCQQVWCPLCALAALVTG

SEQ ID NO: 1515849 - protein, 22 aa, Mycobacterium tuberculosis
KGGTGGWLWGSGGAGGAGGSGG

SEQ ID NO: 1515850 - protein, 22 aa, Mycobacterium tuberculosis
KGLVRVLAFEHPDMRTTLVDLD

SEQ ID NO: 1515851 - protein, 22 aa, Mycobacterium tuberculosis
KGLWEWIRLRRLGRREKFGKPG

SEQ ID NO: 1515852 - protein, 21 aa, Mycobacterium tuberculosis
KIAMLAKVRRAPALIKVESVV

SEQ ID NO: 1515853 - protein, 27 aa, Mycobacterium tuberculosis
KIRLLTRIAFGFRSPQALIALAMLALA

SEQ ID NO: 1515854 - protein, 20 aa, Mycobacterium tuberculosis
KKLVPITTFLRRSPYLAAVR

SEQ ID NO: 1515855 - protein, 22 aa, Mycobacterium tuberculosis
KLARSPTVTALLQLAAYADALV

SEQ ID NO: 1515856 - protein, 19 aa, Mycobacterium tuberculosis
KLAVLVATNFFGINTIPIA

SEQ ID NO: 1515857 - protein, 20 aa, Mycobacterium tuberculosis
KMLRLAVDEVFQMQSEARAE

SEQ ID NO: 1515858 - protein, 19 aa, Mycobacterium tuberculosis
KMVYRHSGYPGGLHKRTIG

SEQ ID NO: 1515859 - protein, 22 aa, Mycobacterium tuberculosis
KNPLFLDEQLTRAEFQRITQDL

SEQ ID NO: 1515860 - protein, 28 aa, Mycobacterium tuberculosis
KPIVMVDPWGHFDGLRAWLNGLLDTGYV

SEQ ID NO: 1515861 - protein, 22 aa, Mycobacterium tuberculosis
KQRAVLAMLLLSRNQVVAADAL

SEQ ID NO: 1515862 - protein, 26 aa, Mycobacterium tuberculosis
KYTVCFKFMSRIVPYPGTPLYQAYSD

SEQ ID NO: 1515863 - protein, 32 aa, Mycobacterium tuberculosis
LADVVGCSMRLPFLYAPLPYGGTLHVDGGVLD

SEQ ID NO: 1515864 - protein, 26 aa, Mycobacterium tuberculosis
LAETLLVVLCGVGFYIGFVGSYQRMA

SEQ ID NO: 1515865 - protein, 29 aa, Mycobacterium tuberculosis
LAFDVTPPAWLEPGQWWALVRVGCAGQLV

SEQ ID NO: 1515866 - protein, 20 aa, Mycobacterium tuberculosis
LAIAQELLKAAAAAKIILEI

SEQ ID NO: 1515867 - protein, 22 aa, Mycobacterium tuberculosis
LAPELAGFWTGGFVQAPFNTRI

SEQ ID NO: 1515868 - protein, 26 aa, Mycobacterium tuberculosis
LASAPRPAPFRLRVVKRHTLGYDGTA

SEQ ID NO: 1515869 - protein, 17 aa, Mycobacterium tuberculosis
LASSRIFNRRKGVRMSM

SEQ ID NO: 1515870 - protein, 19 aa, Mycobacterium tuberculosis
LAVGFWAAPSDLRANWRED

SEQ ID NO: 1515871 - protein, 17 aa, Mycobacterium tuberculosis
LAVRLDVSRLVVVGTGR

SEQ ID NO: 1515872 - protein, 25 aa, Mycobacterium tuberculosis
LDAINAPVQSLTGRPLIGDGANGID

SEQ ID NO: 1515873 - protein, 26 aa, Mycobacterium tuberculosis
LDASLLLVVLTRFLPPDDPRVRNTVL

SEQ ID NO: 1515874 - protein, 26 aa, Mycobacterium tuberculosis
LDAVPRMRGMLTLFEGVATGAADGYA

SEQ ID NO: 1515875 - protein, 28 aa, Mycobacterium tuberculosis
LDDVLRRAVRLLAQLTRQVAVVQYPTLS

SEQ ID NO: 1515876 - protein, 25 aa, Mycobacterium tuberculosis
LDEVDGYVWHAYLPNITPSQRYGFR

SEQ ID NO: 1515877 - protein, 18 aa, Mycobacterium tuberculosis
LDFRPKHRLAVLVVSAIP

SEQ ID NO: 1515878 - protein, 27 aa, Mycobacterium tuberculosis
LDHHINLRPARLYPGVASPLSGNPGID

SEQ ID NO: 1515879 - protein, 18 aa, Mycobacterium tuberculosis
LDLTYKEFELLKYLAQHA

SEQ ID NO: 1515880 - protein, 31 aa, Mycobacterium tuberculosis; identical to SEQ ID NO: 220013

SEQ ID NO: 1515881 - protein, 17 aa, Mycobacterium tuberculosis
LEEVLIRAGIPYKVVGG

SEQ ID NO: 1515882 - protein, 34 aa, Mycobacterium tuberculosis
LETEWPARQLVDDRWVWLPTLLAGRVFTHRLGAD

SEQ ID NO: 1515883 - protein, 17 aa, Mycobacterium tuberculosis
LFEKLLGESPRRSPRRQ

SEQ ID NO: 1515884 - protein, 20 aa, Mycobacterium tuberculosis
LFFRQHINYVLARPKLRPIT

SEQ ID NO: 1515885 - protein, 18 aa, Mycobacterium tuberculosis
LFGSHAREYQAISTQVAA

SEQ ID NO: 1515886 - protein, 23 aa, Mycobacterium tuberculosis
LFRVRPVLPDPVGLLRCAGGADL

SEQ ID NO: 1515887 - protein, 23 aa, Mycobacterium tuberculosis
LGDYEWILAFEAPELDRIVDLMR

SEQ ID NO: 1515888 - protein, 22 aa, Mycobacterium tuberculosis
LGNWTGIPVFKLTEAETTRLLR

SEQ ID NO: 1515889 - protein, 17 aa, Mycobacterium tuberculosis
LGVINTPTEALVGRKLI

SEQ ID NO: 1515890 - protein, 26 aa, Mycobacterium tuberculosis
LGVVNAPAQALLGRPLIGNGANGADG

SEQ ID NO: 1515891 - protein, 30 aa, Mycobacterium tuberculosis
LIELDIHFRIEDDLYYPALSAAGKPITGTH

SEQ ID NO: 1515892 - protein, 18 aa, Mycobacterium tuberculosis
LIYTGAGPGPLLAAAAAW

SEQ ID NO: 1515893 - protein, 18 aa, Mycobacterium tuberculosis
LKKHFRPEFLNRIDDIIV

SEQ ID NO: 1515894 - protein, 24 aa, Mycobacterium tuberculosis
LLDEAEVIYWGLCPDCSISDTSRS

SEQ ID NO: 1515895 - protein, 18 aa, Mycobacterium tuberculosis
LLELARYKRGDLVVIVAG

SEQ ID NO: 1515896 - protein, 19 aa, Mycobacterium tuberculosis
LLGAINAPAAALSGRPFIG

SEQ ID NO: 1515897 - protein, 24 aa, Mycobacterium tuberculosis
LLQGYTGFIYGGERWAKDIHEGIA

SEQ ID NO: 1515898 - protein, 18 aa, Mycobacterium tuberculosis
LMAQLLEGHPRRWHRPPL

SEQ ID NO: 1515899 - protein, 33 aa, Mycobacterium tuberculosis
LNMVLIAAWGHPLPNQLYVRWAGQDEWAAVPLH

SEQ ID NO: 1515900 - protein, 24 aa, Mycobacterium tuberculosis
LNRDHPLWEMYFVEGLANHRIAVV

SEQ ID NO: 1515901 - protein, 17 aa, Mycobacterium tuberculosis
LPASIRFQQGAYRIHPA

SEQ ID NO: 1515902 - protein, 22 aa, Mycobacterium tuberculosis
LPQLVVHPYTLTGPIVIGSFFL

SEQ ID NO: 1515903 - protein, 24 aa, Mycobacterium tuberculosis
LQAFPQIAQYYRRRFRHVLVDEYQ

SEQ ID NO: 1515904 - protein, 20 aa, Mycobacterium tuberculosis
LRALFINATLKRSPELSHTG

SEQ ID NO: 1515905 - protein, 18 aa, Mycobacterium tuberculosis
LRGQGHTPLLVACDLQRP

SEQ ID NO: 1515906 - protein, 17 aa, Mycobacterium tuberculosis
LRIELADRPGSLGSLAV

SEQ ID NO: 1515907 - protein, 28 aa, Mycobacterium tuberculosis
LRQGSYFPDWLLQRRKRAERALTSVVAT

SEQ ID NO: 1515908 - protein, 19 aa, Mycobacterium tuberculosis
LSALGITGQFRFGPITVSN

SEQ ID NO: 1515909 - protein, 23 aa, Mycobacterium tuberculosis
LSSLLAGAWSRRDTLRLTDALYV

SEQ ID NO: 1515910 - protein, 25 aa, Mycobacterium tuberculosis
LSVPPSWTAAAPLASPLGSALGGTP

SEQ ID NO: 1515911 - protein, 21 aa, Mycobacterium tuberculosis
LSVVAPSQFTFSSRSPDFVDE

SEQ ID NO: 1515912 - protein, 21 aa, Mycobacterium tuberculosis
LTDRVFAIVIQDFQDPYTLNV

SEQ ID NO: 1515913 - protein, 19 aa, Mycobacterium tuberculosis
LTHVLGVKASVNDAALTIT

SEQ ID NO: 1515914 - protein, 23 aa, Mycobacterium tuberculosis
LTKWSMPLIRPNGRMLAIKGERA

SEQ ID NO: 1515915 - protein, 20 aa, Mycobacterium tuberculosis
LTLEALAAQQVSCAGLVIGS

SEQ ID NO: 1515916 - protein, 19 aa, Mycobacterium tuberculosis
LTRLQNGWLSRDGVWHTDT

SEQ ID NO: 1515917 - protein, 19 aa, Mycobacterium tuberculosis
LTVATIVRRHWPTPSLARV

SEQ ID NO: 1515918 - protein, 37 aa, Mycobacterium tuberculosis
LVAGWHVVALQPYGGVWLHSWLDRDLGISGRLSVRDG

SEQ ID NO: 1515919 - protein, 17 aa, Mycobacterium tuberculosis
LVATNFFGINTIPIALN

SEQ ID NO: 1515920 - protein, 18 aa, Mycobacterium tuberculosis
LVFPGRKGGFLPLGEYRW

SEQ ID NO: 1515921 - protein, 17 aa, Mycobacterium tuberculosis
LVLTAHVLAMDPASWRI

SEQ ID NO: 1515922 - protein, 20 aa, Mycobacterium tuberculosis
LYQYAWTRDRLLIVTLADVA

SEQ ID NO: 1515923 - protein, 24 aa, Mycobacterium tuberculosis
LYYADPCALFDLCKRRYSKSVALL

SEQ ID NO: 1515924 - protein, 25 aa, Mycobacterium tuberculosis
MAAARDLQFELAARFRDEIADLKRE

SEQ ID NO: 1515925 - protein, 27 aa, Mycobacterium tuberculosis
MASHAHHYLALFDGAKPLALYHTKRLA

SEQ ID NO: 1515926 - protein, 17 aa, Mycobacterium tuberculosis
MAVVMLALPGVVFLYNG

SEQ ID NO: 1515927 - protein, 23 aa, Mycobacterium tuberculosis
MENRWLPMKRTALALHHLVCTRF

SEQ ID NO: 1515928 - protein, 17 aa, Mycobacterium tuberculosis
MGAIALFGESYPDEVRV

SEQ ID NO: 1515929 - protein, 30 aa, Mycobacterium tuberculosis
MGRGSTWARQLPWLTLLGAVYTYDAPWHRG

SEQ ID NO: 1515930 - protein, 18 aa, Mycobacterium tuberculosis
MGTMTLNLGLANLGSNNA

SEQ ID NO: 1515931 - protein, 17 aa, Mycobacterium tuberculosis
MHKTSLTVATIVRRHWP

SEQ ID NO: 1515932 - protein, 27 aa, Mycobacterium tuberculosis
MIIQFVVKTLVAMLDWGLNPQQAVSLV

SEQ ID NO: 1515933 - protein, 18 aa, Mycobacterium tuberculosis
MLADRTPASFIAFDLLAL

SEQ ID NO: 1515934 - protein, 18 aa, Mycobacterium tuberculosis
MLALKRLPDALADGDRIL

SEQ ID NO: 1515935 - protein, 26 aa, Mycobacterium tuberculosis
MPSTPSNYFHLLRRHALDSIQRPLIV

SEQ ID NO: 1515936 - protein, 30 aa, Mycobacterium tuberculosis
MVPASLSMAAAVQPYLVWLTCTAESSALAA

SEQ ID NO: 1515937 - protein, 26 aa, Mycobacterium tuberculosis
NAGTSISGFFNFGSLMSGFANFDDEV

SEQ ID NO: 1515938 - protein, 19 aa, Mycobacterium tuberculosis
NAMLGLLCDAAFDELTRPD

SEQ ID NO: 1515939 - protein, 23 aa, Mycobacterium tuberculosis
NFPQAFTHLALINAVVHVIRAEE

SEQ ID NO: 1515940 - protein, 31 aa, Mycobacterium tuberculosis; identical to SEQ ID NO: 220845

SEQ ID NO: 1515941 - protein, 26 aa, Mycobacterium tuberculosis
NGGDTTIVVNGMLAPSTLGYGGNGGN

SEQ ID NO: 1515942 - protein, 20 aa, Mycobacterium tuberculosis
NGGLFFGNGGAGASSFLGGG

SEQ ID NO: 1515943 - protein, 24 aa, Mycobacterium tuberculosis
NGGNGLNLVGVPGTAGGGADGANG

SEQ ID NO: 1515944 - protein, 23 aa, Mycobacterium tuberculosis
NGGTAGLLFGAGGAGGFGFGGAG

SEQ ID NO: 1515945 - protein, 17 aa, Mycobacterium tuberculosis
NISIIDIPALPGFGNST

SEQ ID NO: 1515946 - protein, 24 aa, Mycobacterium tuberculosis
NKEINLRFVLGYTPLEFRDTLHML

SEQ ID NO: 1515947 - protein, 19 aa, Mycobacterium tuberculosis
NLDLDIADGEFLVLVGPSG

SEQ ID NO: 1515948 - protein, 24 aa, Mycobacterium tuberculosis
NNAGDYGFFWITAVTTDGSIVVAN

SEQ ID NO: 1515949 - protein, 19 aa, Mycobacterium tuberculosis
NRMFLQRLKDKLGNHANAS

SEQ ID NO: 1515950 - protein, 19 aa, Mycobacterium tuberculosis
NRYLVYTSADIRALYAFKR

SEQ ID NO: 1515951 - protein, 18 aa, Mycobacterium tuberculosis
NSGSFNNGALWTGDHHGL

SEQ ID NO: 1515952 - protein, 19 aa, Mycobacterium tuberculosis
NSGSFNNGALWTGDHHGLV

SEQ ID NO: 1515953 - protein, 23 aa, Mycobacterium tuberculosis
NSGYPEHTFTWETGLRLRAALNA

SEQ ID NO: 1515954 - protein, 22 aa, Mycobacterium tuberculosis
NWPRRMGRIPKQLLSGVPAHVD

SEQ ID NO: 1515955 - protein, 18 aa, Mycobacterium tuberculosis
NYAVLLPTVDIALALVTT

SEQ ID NO: 1515956 - protein, 17 aa, Mycobacterium tuberculosis
NYHIRPWRLRAPGGRRE

SEQ ID NO: 1515957 - protein, 22 aa, Mycobacterium tuberculosis
PAGLCDVKAVWRSGTQVPLQAS

SEQ ID NO: 1515958 - protein, 18 aa, Mycobacterium tuberculosis
PAGLPAWISQEELDHYIG

SEQ ID NO: 1515959 - protein, 17 aa, Mycobacterium tuberculosis
PAMRFERPVLAIAATVA

SEQ ID NO: 1515960 - protein, 24 aa, Mycobacterium tuberculosis
PAMSKFEVLTAMAFAAFADAPVDV

SEQ ID NO: 1515961 - protein, 25 aa, Mycobacterium tuberculosis
PANHEYLGPVLWSPAGKPPTWWDSL

SEQ ID NO: 1515962 - protein, 24 aa, Mycobacterium tuberculosis
PARHFSGRFLSRNTTLWASWAFVG

SEQ ID NO: 1515963 - protein, 27 aa, Mycobacterium tuberculosis
PDGARELIRAFWPGALSLVVVQAPSLQ

SEQ ID NO: 1515964 - protein, 26 aa, Mycobacterium tuberculosis
PEINSALMFAGAGPGPMLAAASAWTG

SEQ ID NO: 1515965 - protein, 25 aa, Mycobacterium tuberculosis
PERVVQLCHPGLHNAFPPLRTRKVV

SEQ ID NO: 1515966 - protein, 24 aa, Mycobacterium tuberculosis
PESLRSLPGCHLLVRPEVMRRDVD

SEQ ID NO: 1515967 - protein, 25 aa, Mycobacterium tuberculosis
PESLRSLPGCHLLVRPEVMRRDVDL

SEQ ID NO: 1515968 - protein, 20 aa, Mycobacterium tuberculosis
PGDAYWLLRHAIACPDPVMY

SEQ ID NO: 1515969 - protein, 27 aa, Mycobacterium tuberculosis
PGDERHMLWFELMKPMTSTATGREAAH

SEQ ID NO: 1515970 - protein, 19 aa, Mycobacterium tuberculosis
PGDTYLAGAKILRQYGNGP

SEQ ID NO: 1515971 - protein, 24 aa, Mycobacterium tuberculosis
PGHICPISMTYAVVPALRYNSELA

SEQ ID NO: 1515972 - protein, 18 aa, Mycobacterium tuberculosis
PGSRLAFEFVPDTAIFAD

SEQ ID NO: 1515973 - protein, 17 aa, Mycobacterium tuberculosis
PGTYGAGLLQLIDSRSW

SEQ ID NO: 1515974 - protein, 22 aa, Mycobacterium tuberculosis
PKPSWPWVRTLLHSIYDQPDAE

SEQ ID NO: 1515975 - protein, 28 aa, Mycobacterium tuberculosis
PLQTPGRINALWSLRPVLPMPGRGCQLL

SEQ ID NO: 1515976 - protein, 19 aa, Mycobacterium tuberculosis
PLRPMLPLWPPSRVPSPPV

SEQ ID NO: 1515977 - protein, 34 aa, Mycobacterium tuberculosis
PMQAVLDVVNGPTQLLLGRPLIGDGANGGPGQNG

SEQ ID NO: 1515978 - protein, 23 aa, Mycobacterium tuberculosis
PMTARFLSVVLRRIRGMRSDTRE

SEQ ID NO: 1515979 - protein, 17 aa, Mycobacterium tuberculosis
PPCAPFARRASSSGYAR

SEQ ID NO: 1515980 - protein, 29 aa, Mycobacterium tuberculosis
PPCQVRVPVPTLLLADLLAAAPAEFVPGP

SEQ ID NO: 1515981 - protein, 25 aa, Mycobacterium tuberculosis
PPGAPAPPMPPLPPAPPAPPLPINP

SEQ ID NO: 1515982 - protein, 26 aa, Mycobacterium tuberculosis
PPNAYDEYPVLPPIGLQAPQVPIPPP

SEQ ID NO: 1515983 - protein, 26 aa, Mycobacterium tuberculosis
PPQEQGLIPGFLMPPSDGSGVTPGTG

SEQ ID NO: 1515984 - protein, 35 aa, Mycobacterium tuberculosis; identical to SEQ ID NO: 221403

SEQ ID NO: 1515985 - protein, 19 aa, Mycobacterium tuberculosis
PRLLRVVGHYYKPGFHPSQ

SEQ ID NO: 1515986 - protein, 18 aa, Mycobacterium tuberculosis
PRVIKRWRRGKPLADAET

SEQ ID NO: 1515987 - protein, 23 aa, Mycobacterium tuberculosis
PRVSPYPAVFQDVSLVVAADIPA

SEQ ID NO: 1515988 - protein, 23 aa, Mycobacterium tuberculosis
PSPFAASLLFGYVGAFMYEGDTP

SEQ ID NO: 1515989 - protein, 25 aa, Mycobacterium tuberculosis
PSWEEITEVLEWLSPLPGGSVVSVE

SEQ ID NO: 1515990 - protein, 18 aa, Mycobacterium tuberculosis
PTLAPRRATRQLMVGNVG

SEQ ID NO: 1515991 - protein, 21 aa, Mycobacterium tuberculosis
PTQIPSVAVPVTGAGGTGGNG

SEQ ID NO: 1515992 - protein, 27 aa, Mycobacterium tuberculosis
PTQLRFDRWFLPLAVPLGLGPKNSELW

SEQ ID NO: 1515993 - protein, 26 aa, Mycobacterium tuberculosis
PTSVHVGILPYPRNLDSLVLIASGGA

SEQ ID NO: 1515994 - protein, 27 aa, Mycobacterium tuberculosis
PTVTTPQMFTYRLLQQARSDLMRIVLP

SEQ ID NO: 1515995 - protein, 18 aa, Mycobacterium tuberculosis
PVEGGWAWLPDEAQGARV

SEQ ID NO: 1515996 - protein, 17 aa, Mycobacterium tuberculosis
PVLGARPLRRTIQREIE

SEQ ID NO: 1515997 - protein, 18 aa, Mycobacterium tuberculosis
PVLYQHFSSKLELYLAVL

SEQ ID NO: 1515998 - protein, 17 aa, Mycobacterium tuberculosis
PVRAMVLAMRKAGVPAD

SEQ ID NO: 1515999 - protein, 17 aa, Mycobacterium tuberculosis
PVRVNPGARYRAMEQFF

SEQ ID NO: 1516000 - protein, 34 aa, Mycobacterium tuberculosis; identical to SEQ ID NO: 163380

SEQ ID NO: 1516001 - protein, 25 aa, Mycobacterium tuberculosis
PVTIPGFAINPFGLDVPLSGGTSPV

SEQ ID NO: 1516002 - protein, 17 aa, Mycobacterium tuberculosis
PVVLRRATPLQAIAAMD

SEQ ID NO: 1516003 - protein, 18 aa, Mycobacterium tuberculosis
PVWASLIALLEDGVPSVG

SEQ ID NO: 1516004 - protein, 22 aa, Mycobacterium tuberculosis
QALRGLLKPIYEENQLGRAEIR

SEQ ID NO: 1516005 - protein, 20 aa, Mycobacterium tuberculosis
QAPHPGMAPGARPGPVPKPG

SEQ ID NO: 1516006 - protein, 28 aa, Mycobacterium tuberculosis
QDAFGEKVLPLYLPSGDGLIGLLSQALY

SEQ ID NO: 1516007 - protein, 23 aa, Mycobacterium tuberculosis
QDGSYLAELLLAKGYEVHGLIRR

SEQ ID NO: 1516008 - protein, 24 aa, Mycobacterium tuberculosis
QDKLRTATIRMLLAAIQTEEVSGK

SEQ ID NO: 1516009 - protein, 19 aa, Mycobacterium tuberculosis
QFARILRPGGLAGITDVTV

SEQ ID NO: 1516010 - protein, 17 aa, Mycobacterium tuberculosis
QGDFLIRGLLGADPTTG

SEQ ID NO: 1516011 - protein, 61 aa, Mycobacterium tuberculosis; identical to SEQ ID NO: 225464

SEQ ID NO: 1516012 - protein, 17 aa, Mycobacterium tuberculosis
QGRLMRDNATPQSPRHC

SEQ ID NO: 1516013 - protein, 20 aa, Mycobacterium tuberculosis
QGRTGAMAVPVGWAATVVGE

SEQ ID NO: 1516014 - protein, 37 aa, Mycobacterium tuberculosis; identical to SEQ ID NO: 221665

SEQ ID NO: 1516015 - protein, 24 aa, Mycobacterium tuberculosis
QIATTRFLLDVNISGGLPAFTLFA

SEQ ID NO: 1516016 - protein, 17 aa, Mycobacterium tuberculosis
QLGTGGFTGVFVLTAPQ

SEQ ID NO: 1516017 - protein, 20 aa, Mycobacterium tuberculosis
QLLSLVLSNLFGQNLPAIAA

SEQ ID NO: 1516018 - protein, 27 aa, Mycobacterium tuberculosis
QLTVTPVMLLLWIRGVRFMYSVDPYLP

SEQ ID NO: 1516019 - protein, 28 aa, Mycobacterium tuberculosis
QLVGPRTLPVMRALIVVAGLRMSRTPPD

SEQ ID NO: 1516020 - protein, 23 aa, Mycobacterium tuberculosis
QPDVIVLGLARGGLPVAWEVAAA

SEQ ID NO: 1516021 - protein, 23 aa, Mycobacterium tuberculosis
QQLAMTPGFLRVFGFRTAKARAA

SEQ ID NO: 1516022 - protein, 22 aa, Mycobacterium tuberculosis
QQRKPPPAWARPQQLQIETDDA

SEQ ID NO: 1516023 - protein, 23 aa, Mycobacterium tuberculosis
QRALHRVVTLLAAGRPVLTHCFA

SEQ ID NO: 1516024 - protein, 21 aa, Mycobacterium tuberculosis
QRAVLAMLLLSRNQVVAADAL

SEQ ID NO: 1516025 - protein, 17 aa, Mycobacterium tuberculosis
QRDQAHVLGRRIGQQPF

SEQ ID NO: 1516026 - protein, 27 aa, Mycobacterium tuberculosis
QRETWERLWPELGLLALPQSPRGTPVD

SEQ ID NO: 1516027 - protein, 19 aa, Mycobacterium tuberculosis
QRGGAGGAAGLIGNGGNGG

SEQ ID NO: 1516028 - protein, 21 aa, Mycobacterium tuberculosis
QRGIYALGAGPLGFSTAWVVF

SEQ ID NO: 1516029 - protein, 19 aa, Mycobacterium tuberculosis
QRLHVAVQAFFDFIEHDSQ

SEQ ID NO: 1516030 - protein, 19 aa, Mycobacterium tuberculosis
QRLRLRPFDLGAPKWVDDP

SEQ ID NO: 1516031 - protein, 36 aa, Mycobacterium tuberculosis; identical to SEQ ID NO: 221814

SEQ ID NO: 1516032 - protein, 17 aa, Mycobacterium tuberculosis
QSTFRRIYRSREAEVTL

SEQ ID NO: 1516033 - protein, 31 aa, Mycobacterium tuberculosis
QTAVLYDHFTPFTLIQLEELGFCGKGEAKDF

SEQ ID NO: 1516034 - protein, 21 aa, Mycobacterium tuberculosis
QTFDLRRATLTRSLRFRDAGG

SEQ ID NO: 1516035 - protein, 20 aa, Mycobacterium tuberculosis
QVKIIDRVLASPLVTEAMVL

SEQ ID NO: 1516036 - protein, 19 aa, Mycobacterium tuberculosis
QYWAAAGRPGPVPLALGPV

SEQ ID NO: 1516037 - protein, 19 aa, Mycobacterium tuberculosis
RAALRAVPAERLWVNPDCG

SEQ ID NO: 1516038 - protein, 27 aa, Mycobacterium tuberculosis
RAGSRAAPLLRLPDVRALLDAQLAGRP

SEQ ID NO: 1516039 - protein, 27 aa, Mycobacterium tuberculosis
RAHLIDAARPFIFDTGLAPAAVGAARA

SEQ ID NO: 1516040 - protein, 19 aa, Mycobacterium tuberculosis
RAMWADHLNGLDGPTLLSP

SEQ ID NO: 1516041 - protein, 23 aa, Mycobacterium tuberculosis
RANRVFDERLLTIEWERGELPEV

SEQ ID NO: 1516042 - protein, 17 aa, Mycobacterium tuberculosis
RAQTLPPGRGLLVGADG

SEQ ID NO: 1516043 - protein, 17 aa, Mycobacterium tuberculosis
RATLTRSLRFRDAGGRV

SEQ ID NO: 1516044 - protein, 25 aa, Mycobacterium tuberculosis
RATQPLSVFFFDILHRDGTDLLEAP

SEQ ID NO: 1516045 - protein, 27 aa, Mycobacterium tuberculosis
RAVQAWRGFSRWLMRAYDVLVDEDQIT

SEQ ID NO: 1516046 - protein, 19 aa, Mycobacterium tuberculosis
RCILSPQHRIRIVFRSPMV

SEQ ID NO: 1516047 - protein, 17 aa, Mycobacterium tuberculosis
RCMRRHWPPGWHVPTCL

SEQ ID NO: 1516048 - protein, 18 aa, Mycobacterium tuberculosis
RDGWVDRFGLDLPRHDTG

SEQ ID NO: 1516049 - protein, 18 aa, Mycobacterium tuberculosis
RDGWWQGLGPYDVVLDAL

SEQ ID NO: 1516050 - protein, 28 aa, Mycobacterium tuberculosis
REAAHHRLFSHVPWLASQLLGAVEAYAM

SEQ ID NO: 1516051 - protein, 20 aa, Mycobacterium tuberculosis
REGERLVVWAKRILAEHAAF

SEQ ID NO: 1516052 - protein, 23 aa, Mycobacterium tuberculosis
REGYDMFMAMLDGMKEESVGFLF

SEQ ID NO: 1516053 - protein, 18 aa, Mycobacterium tuberculosis
REHLYEMDYLKEGIGLRA

SEQ ID NO: 1516054 - protein, 17 aa, Mycobacterium tuberculosis
REKELVGVGLARLNPAD

SEQ ID NO: 1516055 - protein, 34 aa, Mycobacterium tuberculosis; identical to SEQ ID NO: 226801

SEQ ID NO: 1516056 - protein, 17 aa, Mycobacterium tuberculosis
RGAEVVDLLAALNTGHE

SEQ ID NO: 1516057 - protein, 19 aa, Mycobacterium tuberculosis
RGGKGIDGGFGGDGGNGGS

SEQ ID NO: 1516058 - protein, 24 aa, Mycobacterium tuberculosis
RGGYPPETGGYPPQPGYPRPRHPD

SEQ ID NO: 1516059 - protein, 17 aa, Mycobacterium tuberculosis
RGKPRVPGLTDTLLRTM

SEQ ID NO: 1516060 - protein, 21 aa, Mycobacterium tuberculosis
RGLTFRYPKAAEPAVRGMEFT

SEQ ID NO: 1516061 - protein, 28 aa, Mycobacterium tuberculosis
RGRDRLLVLGLARGGVPVGWEVASALGA

SEQ ID NO: 1516062 - protein, 21 aa, Mycobacterium tuberculosis
RHAVAWARPGDVVLIAGKGHE

SEQ ID NO: 1516063 - protein, 28 aa, Mycobacterium tuberculosis
RHPDSKFDILKLPPRNAPPAALTALVEQ

SEQ ID NO: 1516064 - protein, 18 aa, Mycobacterium tuberculosis
RHPGWPMAVGPLRVSAGV

SEQ ID NO: 1516065 - protein, 24 aa, Mycobacterium tuberculosis
RIDPIPLNFDVLSSAGPINISIID

SEQ ID NO: 1516066 - protein, 19 aa, Mycobacterium tuberculosis
RIQITQLLAYAAEQGRLQL

SEQ ID NO: 1516067 - protein, 20 aa, Mycobacterium tuberculosis
RKGGFLPLGEYRWAFDNAGD

SEQ ID NO: 1516068 - protein, 20 aa, Mycobacterium tuberculosis
RKRPYHTIIPGFVTRDGAPV

SEQ ID NO: 1516069 - protein, 23 aa, Mycobacterium tuberculosis
RKVVVFRPLYAVGGQELGYLPGS

SEQ ID NO: 1516070 - protein, 22 aa, Mycobacterium tuberculosis
RLAALYGLQLAHESQCCQMHNL

SEQ ID NO: 1516071 - protein, 19 aa, Mycobacterium tuberculosis
RLAFEFVPDTAIFADERWR

SEQ ID NO: 1516072 - protein, 22 aa, Mycobacterium tuberculosis
RLAGIPYIAIANAYWSPQARRR

SEQ ID NO: 1516073 - protein, 33 aa, Mycobacterium tuberculosis
RLPRYLQSVLYLRFREWFLPAIHRKYGDVFSLR

SEQ ID NO: 1516074 - protein, 26 aa, Mycobacterium tuberculosis
RLQADLLGPVDLPPGVRRPAGIPADA

SEQ ID NO: 1516075 - protein, 22 aa, Mycobacterium tuberculosis
RLTSDLYGWLTTVARSGQPVPR

SEQ ID NO: 1516076 - protein, 18 aa, Mycobacterium tuberculosis
RLYIIISGKVKIGRRAPD

SEQ ID NO: 1516077 - protein, 17 aa, Mycobacterium tuberculosis
RLYWLSANIDPAGTDGG

SEQ ID NO: 1516078 - protein, 28 aa, Mycobacterium tuberculosis
RMMLGPNAADWPLILADASQPLTLEAMA

SEQ ID NO: 1516079 - protein, 25 aa, Mycobacterium tuberculosis
RMYTRARFAPYVEKLLLDGARTKLT

SEQ ID NO: 1516080 - protein, 18 aa, Mycobacterium tuberculosis
RNPIQAGDLVHLFLVQPN

SEQ ID NO: 1516081 - protein, 20 aa, Mycobacterium tuberculosis
RNRMFLQRLKDKLGNHANAS

SEQ ID NO: 1516082 - protein, 20 aa, Mycobacterium tuberculosis
RPAPGFFNATTGPSSGFLNW

SEQ ID NO: 1516083 - protein, 20 aa, Mycobacterium tuberculosis
RPPFARNVRFLPTAAAAQGE

SEQ ID NO: 1516084 - protein, 24 aa, Mycobacterium tuberculosis
RPQLATTLLPALLEALVRNVSRGL

SEQ ID NO: 1516085 - protein, 17 aa, Mycobacterium tuberculosis
RPSMKQMGLVMKAATVI

SEQ ID NO: 1516086 - protein, 22 aa, Mycobacterium tuberculosis
RQRPELAWFPSLAHHLQDASRG

SEQ ID NO: 1516087 - protein, 26 aa, Mycobacterium tuberculosis
RRAHGLPAISLGWGLWDQASAMTGGL

SEQ ID NO: 1516088 - protein, 19 aa, Mycobacterium tuberculosis
RRLVRIPWDLDSYGIHPDD

SEQ ID NO: 1516089 - protein, 21 aa, Mycobacterium tuberculosis
RRVIVYFYPAASTPGCTKQAC

SEQ ID NO: 1516090 - protein, 18 aa, Mycobacterium tuberculosis
RSNALQEWAYGRRFRYSE

SEQ ID NO: 1516091 - protein, 24 aa, Mycobacterium tuberculosis
RSSNFMLWQAAYAEYIFQDKLWPD

SEQ ID NO: 1516092 - protein, 28 aa, Mycobacterium tuberculosis
RSVIASLTGWQWLGPSSVRMGAAVTPYV

SEQ ID NO: 1516093 - protein, 25 aa, Mycobacterium tuberculosis
RSVRSPVYLVLAARRRCVSGCARRR

SEQ ID NO: 1516094 - protein, 21 aa, Mycobacterium tuberculosis
RTFYRHFRSKHDLLFADYDAG

SEQ ID NO: 1516095 - protein, 20 aa, Mycobacterium tuberculosis
RTLEPWIAPLTKALNDGTIL

SEQ ID NO: 1516096 - protein, 17 aa, Mycobacterium tuberculosis
RTPTRRFRDRRDAGRVL

SEQ ID NO: 1516097 - protein, 19 aa, Mycobacterium tuberculosis
RTQLRLQHALVLLAERHDV

SEQ ID NO: 1516098 - protein, 31 aa, Mycobacterium tuberculosis; identical to SEQ ID NO: 225578

SEQ ID NO: 1516099 - protein, 17 aa, Mycobacterium tuberculosis
RVHWRPREYYPAGTTVD

SEQ ID NO: 1516100 - protein, 29 aa, Mycobacterium tuberculosis
RVRGRDDRLRWWAGPWPDDERWWDPDRAS

SEQ ID NO: 1516101 - protein, 17 aa, Mycobacterium tuberculosis
RVRQQVIQLLSGYQGKE

SEQ ID NO: 1516102 - protein, 26 aa, Mycobacterium tuberculosis
RWPDKPGRYFTVRAGSLVAWNAEQSG

SEQ ID NO: 1516103 - protein, 19 aa, Mycobacterium tuberculosis
RWVRPIVDALGFAPMAVCA

SEQ ID NO: 1516104 - protein, 22 aa, Mycobacterium tuberculosis
RWWERPYIAAGIFLYDRLGGAK

SEQ ID NO: 1516105 - protein, 27 aa, Mycobacterium tuberculosis
RYRDRGRPFLAFLYGIAAHKVADAHRA

SEQ ID NO: 1516106 - protein, 32 aa, Mycobacterium tuberculosis; identical to SEQ ID NO: 222753

SEQ ID NO: 1516107 - protein, 23 aa, Mycobacterium tuberculosis
SAAASQLPPFTPPPATTSGAGSL

SEQ ID NO: 1516108 - protein, 26 aa, Mycobacterium tuberculosis
SADGSPPYVVRWLVNGHETTVYPGSD

SEQ ID NO: 1516109 - protein, 19 aa, Mycobacterium tuberculosis
SAGLLFGSGGAGGAGGFGF

SEQ ID NO: 1516110 - protein, 19 aa, Mycobacterium tuberculosis
SALAAANRAAEAPTTGLLA

SEQ ID NO: 1516111 - protein, 28 aa, Mycobacterium tuberculosis
SAQPADRPIPRPPAPRPGTARPGVPRPG

SEQ ID NO: 1516112 - protein, 23 aa, Mycobacterium tuberculosis
SAQVAAFQTLFVRTLTGGCGVFR

SEQ ID NO: 1516113 - protein, 26 aa, Mycobacterium tuberculosis
SARMVTQALLPSGLVASAVVAASSAN

SEQ ID NO: 1516114 - protein, 24 aa, Mycobacterium tuberculosis
SDQVYLDLLTGWRDAWELGRAARD

SEQ ID NO: 1516115 - protein, 28 aa, Mycobacterium tuberculosis
SEAVDPLLPEVAWSWLVDALTARTDQVR

SEQ ID NO: 1516116 - protein, 19 aa, Mycobacterium tuberculosis
SEERRLAYVGITRARQRLY

SEQ ID NO: 1516117 - protein, 23 aa, Mycobacterium tuberculosis
SELYPDPVLPALSLLPHTVRTAP

SEQ ID NO: 1516118 - protein, 24 aa, Mycobacterium tuberculosis
SEVDTLRRVELLRQLRLGDYDVLV

SEQ ID NO: 1516119 - protein, 19 aa, Mycobacterium tuberculosis
SFAAPTTLRFEPGITAVVG

SEQ ID NO: 1516120 - protein, 23 aa, Mycobacterium tuberculosis
SFIHRARRLLPGDPEFGDPLSTA

SEQ ID NO: 1516121 - protein, 19 aa, Mycobacterium tuberculosis
SGAPGQRGGAGGAAGLIGN

SEQ ID NO: 1516122 - protein, 24 aa, Mycobacterium tuberculosis
SGDGQWRLRQQRHFGCGGQPEFRQ

SEQ ID NO: 1516123 - protein, 37 aa, Mycobacterium tuberculosis; identical to SEQ ID NO: 226905

SEQ ID NO: 1516124 - protein, 25 aa, Mycobacterium tuberculosis
SGGAGSIGFNASAPGAAGSPGGNGG

SEQ ID NO: 1516125 - protein, 19 aa, Mycobacterium tuberculosis
SGGASLLGPPGLAGTNGAD

SEQ ID NO: 1516126 - protein, 20 aa, Mycobacterium tuberculosis
SGIGQFVILASGLDARAYRL

SEQ ID NO: 1516127 - protein, 19 aa, Mycobacterium tuberculosis
SGKSTFMRLLLAAETPTSG

SEQ ID NO: 1516128 - protein, 26 aa, Mycobacterium tuberculosis
SGMLVPVHWGTFRLAPHPWGEPVERL

SEQ ID NO: 1516129 - protein, 21 aa, Mycobacterium tuberculosis
SGNFGVDGEAGFSGGAGGNGG

SEQ ID NO: 1516130 - protein, 19 aa, Mycobacterium tuberculosis
SGPTTALTDVWRALRASMR

SEQ ID NO: 1516131 - protein, 23 aa, Mycobacterium tuberculosis
SGYENIIIRGLFLGQTRKQMQAK

SEQ ID NO: 1516132 - protein, 17 aa, Mycobacterium tuberculosis
SHCYPHFRRFLAEVVRV

SEQ ID NO: 1516133 - protein, 17 aa, Mycobacterium tuberculosis
SIASLRREKDDVTEVRD

SEQ ID NO: 1516134 - protein, 20 aa, Mycobacterium tuberculosis
SIREFGLLQPIVVRSLAGSQ

SEQ ID NO: 1516135 - protein, 25 aa, Mycobacterium tuberculosis
SLGDELMRRFNGAALETLLTRLNLP

SEQ ID NO: 1516136 - protein, 33 aa, Mycobacterium tuberculosis
SLGIYASPRQTVISGPPLLIDELIDKVRQQNGF

SEQ ID NO: 1516137 - protein, 20 aa, Mycobacterium tuberculosis
SLPDAMGALLARSIVGIVEQ

SEQ ID NO: 1516138 - protein, 30 aa, Mycobacterium tuberculosis
SMCGRAYSPRFLWMWPNARISVIGGEQAAS

SEQ ID NO: 1516139 - protein, 18 aa, Mycobacterium tuberculosis
SMSFVNVAPQLVSTAAAD

SEQ ID NO: 1516140 - protein, 20 aa, Mycobacterium tuberculosis
SNEFLARLCKTAIWIDHGVI

SEQ ID NO: 1516141 - protein, 24 aa, Mycobacterium tuberculosis
SPAYLGFNLFQHAIARAVIFGTYE

SEQ ID NO: 1516142 - protein, 22 aa, Mycobacterium tuberculosis
SPRRQYSWLLEQVSFIAAIEHY

SEQ ID NO: 1516143 - protein, 29 aa, Mycobacterium tuberculosis
SQTPPEPPTLLWPIGVPFSDGLNTLSEFK

SEQ ID NO: 1516144 - protein, 19 aa, Mycobacterium tuberculosis
SRAPRWAIAYKYPPEEAQT

SEQ ID NO: 1516145 - protein, 19 aa, Mycobacterium tuberculosis
SRATLRRLYAHPQAGALVS

SEQ ID NO: 1516146 - protein, 28 aa, Mycobacterium tuberculosis
SRNTTLWASWAFVGPNHRAYFGGDTGYT

SEQ ID NO: 1516147 - protein, 29 aa, Mycobacterium tuberculosis
SSAQPADRPIPRPPAPRPGTARPGVPRPG

SEQ ID NO: 1516148 - protein, 26 aa, Mycobacterium tuberculosis
SSASEFCGIFAAPGLMRNCHHGGSAP

SEQ ID NO: 1516149 - protein, 26 aa, Mycobacterium tuberculosis
SSSLVAVHLACRSLSTWDCDIALVGG

SEQ ID NO: 1516150 - protein, 25 aa, Mycobacterium tuberculosis
STWARQLPWLTLLGAVYTYDAPWHR

SEQ ID NO: 1516151 - protein, 19 aa, Mycobacterium tuberculosis
SVALDWLRNNGYQDLASRA

SEQ ID NO: 1516152 - protein, 27 aa, Mycobacterium tuberculosis
SVSDALDILRWAPQAASGPVAKVIASA

SEQ ID NO: 1516153 - protein, 20 aa, Mycobacterium tuberculosis
SVTINYRFAPDRSVAAALQH

SEQ ID NO: 1516154 - protein, 25 aa, Mycobacterium tuberculosis
SVWLCDHFLKISPGEYAKVAGIAAD

SEQ ID NO: 1516155 - protein, 26 aa, Mycobacterium tuberculosis
TADCELDWWLGFSSAASLLGSPGQAA

SEQ ID NO: 1516156 - protein, 27 aa, Mycobacterium tuberculosis
TAGAHADAYLWIKRPGESDGTCGRGEP

SEQ ID NO: 1516157 - protein, 26 aa, Mycobacterium tuberculosis
TAGLGPITIPVIDIPAAPGIGNSTTS

SEQ ID NO: 1516158 - protein, 31 aa, Mycobacterium tuberculosis
TATRYHSLTILPKSLPAVLRVTARTSSGVIM

SEQ ID NO: 1516159 - protein, 21 aa, Mycobacterium tuberculosis
TDGEGWLTELSTRDLREVFAL

SEQ ID NO: 1516160 - protein, 21 aa, Mycobacterium tuberculosis
TFAVVHFDWERLTDSVHRCRL

SEQ ID NO: 1516161 - protein, 18 aa, Mycobacterium tuberculosis
TFDTACSSGLMAVHLACR

SEQ ID NO: 1516162 - protein, 19 aa, Mycobacterium tuberculosis
TFHDRFVQTLSAAASSYVA

SEQ ID NO: 1516163 - protein, 20 aa, Mycobacterium tuberculosis
TGELMFCRNSIDLYHKQAAD

SEQ ID NO: 1516164 - protein, 26 aa, Mycobacterium tuberculosis
TGGNGGAGGLFMNGGDGGAGGQGGDG

SEQ ID NO: 1516165 - protein, 33 aa, Mycobacterium tuberculosis; identical to SEQ ID NO: 223400

SEQ ID NO: 1516166 - protein, 24 aa, Mycobacterium tuberculosis
TGGTGGYIESLDGKGQAGNGGNGG

SEQ ID NO: 1516167 - protein, 17 aa, Mycobacterium tuberculosis
TGPTQKFMAIWRASKPV

SEQ ID NO: 1516168 - protein, 26 aa, Mycobacterium tuberculosis
TGQAGGPGGILYGNGGNGGSGAPGQR

SEQ ID NO: 1516169 - protein, 21 aa, Mycobacterium tuberculosis
TGTNLWGAFGLLAEMVKQGRS

SEQ ID NO: 1516170 - protein, 30 aa, Mycobacterium tuberculosis
THGFVCAIRAWAYQIADLAGDYRVIAFDHR

SEQ ID NO: 1516171 - protein, 26 aa, Mycobacterium tuberculosis
TIEMADWWAYLNGVRKTYPLSYGPQS

SEQ ID NO: 1516172 - protein, 17 aa, Mycobacterium tuberculosis
TLAAHPGTSLILLDTAS

SEQ ID NO: 1516173 - protein, 20 aa, Mycobacterium tuberculosis
TLFDLDDTWIGGSSAFMTDA

SEQ ID NO: 1516174 - protein, 18 aa, Mycobacterium tuberculosis
TLFNFGFANDGTLNLGNA

SEQ ID NO: 1516175 - protein, 21 aa, Mycobacterium tuberculosis
TMEIGIFLMPAHPPERTLYDA

SEQ ID NO: 1516176 - protein, 21 aa, Mycobacterium tuberculosis
TNQIRWLFEKLLGESPRRSPR

SEQ ID NO: 1516177 - protein, 18 aa, Mycobacterium tuberculosis
TPAPPRRKPIQMPGLQDV

SEQ ID NO: 1516178 - protein, 25 aa, Mycobacterium tuberculosis
TPERLRSLERLECLVRRLPAVGHTL

SEQ ID NO: 1516179 - protein, 19 aa, Mycobacterium tuberculosis
TPVRKACTVLAVLAATLLL

SEQ ID NO: 1516180 - protein, 19 aa, Mycobacterium tuberculosis
TQALISGFGNHGARLSGIL

SEQ ID NO: 1516181 - protein, 21 aa, Mycobacterium tuberculosis
TRGGYLKDIKGFDSEFFAVAK

SEQ ID NO: 1516182 - protein, 21 aa, Mycobacterium tuberculosis
TRGITVVVLIDVPSTVAGAAA

SEQ ID NO: 1516183 - protein, 24 aa, Mycobacterium tuberculosis
TSYTFDRLVRVYPHIVRLRPAPHS

SEQ ID NO: 1516184 - protein, 19 aa, Mycobacterium tuberculosis
TTGLLAAGADEVSAAIASL

SEQ ID NO: 1516185 - protein, 30 aa, Mycobacterium tuberculosis
TTITIPEIPYRYDLSVPIDIPITGTVVATT

SEQ ID NO: 1516186 - protein, 17 aa, Mycobacterium tuberculosis
TTPPITTPPLTIDPINL

SEQ ID NO: 1516187 - protein, 25 aa, Mycobacterium tuberculosis
TTPSSKLGGLWKTVSPHLSPISNMV

SEQ ID NO: 1516188 - protein, 20 aa, Mycobacterium tuberculosis
TTSMLIVALQHCGLDPSFAV

SEQ ID NO: 1516189 - protein, 19 aa, Mycobacterium tuberculosis
TTTLSKFLRKPRNAGLRAY

SEQ ID NO: 1516190 - protein, 22 aa, Mycobacterium tuberculosis
TTVAHKLIVIIWHVLATGRPHQ

SEQ ID NO: 1516191 - protein, 24 aa, Mycobacterium tuberculosis
TVCKWGGFLDNPADFDCEFFGIGE

SEQ ID NO: 1516192 - protein, 37 aa, Mycobacterium tuberculosis; identical to SEQ ID NO: 227045

SEQ ID NO: 1516193 - protein, 18 aa, Mycobacterium tuberculosis
TVYAPGDWSVFDALAKMA

SEQ ID NO: 1516194 - protein, 20 aa, Mycobacterium tuberculosis
VAFIMMLRHPEKVTGFFGVN

SEQ ID NO: 1516195 - protein, 26 aa, Mycobacterium tuberculosis
VAHGWIPPGIALPEGVRLLAPARRAG

SEQ ID NO: 1516196 - protein, 26 aa, Mycobacterium tuberculosis
VALDRGEFFLVYQPIIRLADNRIIGA

SEQ ID NO: 1516197 - protein, 24 aa, Mycobacterium tuberculosis
VARVFLGSWSGKIIRYSPVPVLVL

SEQ ID NO: 1516198 - protein, 19 aa, Mycobacterium tuberculosis
VASAFGGGNAFGGRGGDGG

SEQ ID NO: 1516199 - protein, 20 aa, Mycobacterium tuberculosis
VASPGFSPATPLLAAAAAAG

SEQ ID NO: 1516200 - protein, 26 aa, Mycobacterium tuberculosis
VDDPDGTWGLQRLADLLGARTRYFDA

SEQ ID NO: 1516201 - protein, 24 aa, Mycobacterium tuberculosis
VDELERRNARRALITLCIGGGMGV

SEQ ID NO: 1516202 - protein, 23 aa, Mycobacterium tuberculosis
VDFDPIYCWPKPVTKPYPPLYVG

SEQ ID NO: 1516203 - protein, 18 aa, Mycobacterium tuberculosis
VDIPIHIPINIDAGVVTL

SEQ ID NO: 1516204 - protein, 23 aa, Mycobacterium tuberculosis
VDVRVRRWIEAMPQYGPGHADVV

SEQ ID NO: 1516205 - protein, 24 aa, Mycobacterium tuberculosis
VGGRGGDGVFAGAGGQGGLGGQGG

SEQ ID NO: 1516206 - protein, 22 aa, Mycobacterium tuberculosis
VGIDFFTRWAAGNIKATDVDDP

SEQ ID NO: 1516207 - protein, 17 aa, Mycobacterium tuberculosis
VGIYHLIRQAAAQARKR

SEQ ID NO: 1516208 - protein, 24 aa, Mycobacterium tuberculosis
VGSYLPHAPWPWGVIDQAARVLLP

SEQ ID NO: 1516209 - protein, 22 aa, Mycobacterium tuberculosis
VHAALRQVLGPNAVQAGSLNRP

SEQ ID NO: 1516210 - protein, 23 aa, Mycobacterium tuberculosis
VHVHLGLYGTFTEWARPTDGWLP

SEQ ID NO: 1516211 - protein, 25 aa, Mycobacterium tuberculosis
VIAARHLLDPMPRGELSYGPLHEGG

SEQ ID NO: 1516212 - protein, 17 aa, Mycobacterium tuberculosis
VIDFKTTTLAGLGAAPT

SEQ ID NO: 1516213 - protein, 36 aa, Mycobacterium tuberculosis
VIDPIVPQLGKGGGRLPITLWIVDTNASTPAPAANL

SEQ ID NO: 1516214 - protein, 31 aa, Mycobacterium tuberculosis
VIFSATRYEWAILDFAILAVGAVTVPIYETS

SEQ ID NO: 1516215 - protein, 27 aa, Mycobacterium tuberculosis
VIYEHPSMAPALRKTLGVPLFQEQLMQ

SEQ ID NO: 1516216 - protein, 18 aa, Mycobacterium tuberculosis
VLAALLLNRISLAPGEAI

SEQ ID NO: 1516217 - protein, 25 aa, Mycobacterium tuberculosis
VLLLVAHHIAWDDGSWRVFFTDLTQ

SEQ ID NO: 1516218 - protein, 17 aa, Mycobacterium tuberculosis
VLTIPDGPGGQSGLAGG

SEQ ID NO: 1516219 - protein, 18 aa, Mycobacterium tuberculosis
VLVDGELAWFLERGGRSL

SEQ ID NO: 1516220 - protein, 20 aa, Mycobacterium tuberculosis
VLVGIAFLRAPCRVVYVIDE

SEQ ID NO: 1516221 - protein, 17 aa, Mycobacterium tuberculosis
VNTLPVPGLTIADLGEL

SEQ ID NO: 1516222 - protein, 24 aa, Mycobacterium tuberculosis
VPGMIRLVRHSIALVAAGLAAALS

SEQ ID NO: 1516223 - protein, 20 aa, Mycobacterium tuberculosis
VPVAAPWDARRARELDDVSL

SEQ ID NO: 1516224 - protein, 19 aa, Mycobacterium tuberculosis
VPVAITPRRYRCYTDRLTR

SEQ ID NO: 1516225 - protein, 19 aa, Mycobacterium tuberculosis
VPVRLAELFIEAGLPAGVF

SEQ ID NO: 1516226 - protein, 25 aa, Mycobacterium tuberculosis
VQEDFAYHQFLIKKSKMPSQTPPEP

SEQ ID NO: 1516227 - protein, 18 aa, Mycobacterium tuberculosis
VQGGGFAGPLFDGFDNLY

SEQ ID NO: 1516228 - protein, 22 aa, Mycobacterium tuberculosis
VRADGWLGDLLAGAAAASLQPL

SEQ ID NO: 1516229 - protein, 27 aa, Mycobacterium tuberculosis
VRDVRYLGSQPWPFPRSLMVGFHALGD

SEQ ID NO: 1516230 - protein, 26 aa, Mycobacterium tuberculosis
VRQYSRWALRLRVPFTVPVEAKSLQL

SEQ ID NO: 1516231 - protein, 24 aa, Mycobacterium tuberculosis
VRRHRLLETFLVNELGYRWDEVHD

SEQ ID NO: 1516232 - protein, 17 aa, Mycobacterium tuberculosis
VRVFKKTLPLIKDDQLR

SEQ ID NO: 1516233 - protein, 24 aa, Mycobacterium tuberculosis
VSEKLGALPGWQLLDMRLSRAFQC

SEQ ID NO: 1516234 - protein, 29 aa, Mycobacterium tuberculosis
VSLSPTEFTLLRYFVINAGTVLSKPKILD

SEQ ID NO: 1516235 - protein, 17 aa, Mycobacterium tuberculosis
VTCGANYLRPPATVVFA

SEQ ID NO: 1516236 - protein, 19 aa, Mycobacterium tuberculosis
VTHDRWFLDEVATTTWEVH

SEQ ID NO: 1516237 - protein, 25 aa, Mycobacterium tuberculosis
VTIFPNGISIPNNPLALLASASIGT

SEQ ID NO: 1516238 - protein, 17 aa, Mycobacterium tuberculosis
VTSELLWYRRGTFVGRV

SEQ ID NO: 1516239 - protein, 28 aa, Mycobacterium tuberculosis
VTTRLAAPLLPLITEIIWRGLTRERSVH

SEQ ID NO: 1516240 - protein, 24 aa, Mycobacterium tuberculosis
VTVVDPQWVWPISPALTELAGRHR

SEQ ID NO: 1516241 - protein, 18 aa, Mycobacterium tuberculosis
VVAAARWARSELDYIPGT

SEQ ID NO: 1516242 - protein, 18 aa, Mycobacterium tuberculosis
VVAALGMYPGQAPPLGAE

SEQ ID NO: 1516243 - protein, 20 aa, Mycobacterium tuberculosis
VVAALGMYPGQAPPLGAEGA

SEQ ID NO: 1516244 - protein, 17 aa, Mycobacterium tuberculosis
VVADRWFPSLSVEPTVR

SEQ ID NO: 1516245 - protein, 25 aa, Mycobacterium tuberculosis
VVAWDLDRLHRRPIELEAFMSLADE

SEQ ID NO: 1516246 - protein, 17 aa, Mycobacterium tuberculosis
VVRVLGAIEIPVVAQEL

SEQ ID NO: 1516247 - protein, 17 aa, Mycobacterium tuberculosis
VVVIKNLTFDSSVAQGA

SEQ ID NO: 1516248 - protein, 17 aa, Mycobacterium tuberculosis
VYGFPAPGAPPLGALHL

SEQ ID NO: 1516249 - protein, 18 aa, Mycobacterium tuberculosis
WAIAYKYPPEEAQTKLLD

SEQ ID NO: 1516250 - protein, 17 aa, Mycobacterium tuberculosis
WNVGKDLSFVPLRPERV

SEQ ID NO: 1516251 - protein, 18 aa, Mycobacterium tuberculosis
WRVLRLLRTVGMHHALGL

SEQ ID NO: 1516252 - protein, 18 aa, Mycobacterium tuberculosis
WTRDRLLIVTLADVASRV

SEQ ID NO: 1516253 - protein, 17 aa, Mycobacterium tuberculosis
WWHSLTPGQQDRVKQWF

SEQ ID NO: 1516254 - protein, 24 aa, Mycobacterium tuberculosis
YCMPEAEYAWLPRADLLSVDEISL

SEQ ID NO: 1516255 - protein, 21 aa, Mycobacterium tuberculosis
YELISDRAITGKPLILTSNRA

SEQ ID NO: 1516256 - protein, 18 aa, Mycobacterium tuberculosis
YFDAVLQQQLLPTGRVDY

SEQ ID NO: 1516257 - protein, 18 aa, Mycobacterium tuberculosis
YGPVVYLDLRHLGADLID

SEQ ID NO: 1516258 - protein, 17 aa, Mycobacterium tuberculosis
YIIDLQQTLTFIDKAYE

SEQ ID NO: 1516259 - protein, 30 aa, Mycobacterium tuberculosis
YLAGLCGALRRYHEALGVPISTLPMAVPVN

SEQ ID NO: 1516260 - protein, 25 aa, Mycobacterium tuberculosis
YNAGLPALKSFVLPGGSPLSALLHV

SEQ ID NO: 1516261 - protein, 19 aa, Mycobacterium tuberculosis
YPALFGFLRIATSARVLAA

SEQ ID NO: 1516262 - protein, 18 aa, Mycobacterium tuberculosis
YQIVMGERRWRAAQEAGL

SEQ ID NO: 1516263 - protein, 24 aa, Mycobacterium tuberculosis
YRDETAPLLEYYRDQLKTVDAVGT

SEQ ID NO: 1516264 - protein, 18 aa, Mycobacterium tuberculosis
YRQIFYAELPECLNALSA

SEQ ID NO: 1516265 - protein, 23 aa, Mycobacterium tuberculosis
YSAVSLRLHPDIRLFTAIPEQRS

SEQ ID NO: 1516266 - protein, 20 aa, Mycobacterium tuberculosis
YSGPTTALTDVWRALRASMR

SEQ ID NO: 1516267 - protein, 22 aa, Mycobacterium tuberculosis
YSLDVPRITILDAHFTGAFGPV

SEQ ID NO: 1516268 - protein, 17 aa, Mycobacterium tuberculosis
YSLPAIPLGIDVGGGLG

SEQ ID NO: 1516269 - protein, 19 aa, Mycobacterium tuberculosis
YSLPAIPLGIDVGGGLGPF

SEQ ID NO: 1516270 - protein, 29 aa, Mycobacterium tuberculosis
YTLTGPIVIGSFFLPAFNIPGIDVPAINV

SEQ ID NO: 1516271 - protein, 43 aa, Mycobacterium tuberculosis; identical to SEQ ID NO: 224697

SEQ ID NO: 1516272 - protein, 18 aa, Mycobacterium tuberculosis
YVCKACHGVAILADNIEP

SEQ ID NO: 1516273 - protein, 23 aa, Mycobacterium tuberculosis
AAAAALPAFSPPAQALGGGVGAF

SEQ ID NO: 1516274 - protein, 36 aa, Mycobacterium tuberculosis
AAAEAAAVTPLLNSINAPVLAATGRPLIGNGANGAP

SEQ ID NO: 1516275 - protein, 29 aa, Mycobacterium tuberculosis
AAAHHKPQLAFLPRQAFLDTNIIGTQTVL

SEQ ID NO: 1516276 - protein, 25 aa, Mycobacterium tuberculosis
AAEAMYEQMWAADVAAMVGYHGGAS

SEQ ID NO: 1516277 - protein, 32 aa, Mycobacterium tuberculosis
AAELLGIPWVELNPHPLYLPSKGLPPIGSGLA

SEQ ID NO: 1516278 - protein, 27 aa, Mycobacterium tuberculosis
AAEQLVPFQQALQQLPNLGIGNIGNAN

SEQ ID NO: 1516279 - protein, 25 aa, Mycobacterium tuberculosis
AAFAIMQIKAIFSVLLREYEFEMAQ

SEQ ID NO: 1516280 - protein, 20 aa, Mycobacterium tuberculosis
AAFAMTVPPPAIAANRTLLM

SEQ ID NO: 1516281 - protein, 20 aa, Mycobacterium tuberculosis
AAFHDQFTLALTSSAGAYAS

SEQ ID NO: 1516282 - protein, 29 aa, Mycobacterium tuberculosis
AAGAFAIVNILRILLANPAVWEKTALIVS

SEQ ID NO: 1516283 - protein, 27 aa, Mycobacterium tuberculosis
AAGGLNWASLPLKLFAGGNAKFWHPAD

SEQ ID NO: 1516284 - protein, 25 aa, Mycobacterium tuberculosis
AAGRYVLDRAIFDALRRIDQGAGGE

SEQ ID NO: 1516285 - protein, 19 aa, Mycobacterium tuberculosis
AAHTPYLAWLVQASANSAA

SEQ ID NO: 1516286 - protein, 22 aa, Mycobacterium tuberculosis
AAIEAPLVITPWRSVLICDLDD

SEQ ID NO: 1516287 - protein, 17 aa, Mycobacterium tuberculosis
AAKFAAIASGAYCPEHL

SEQ ID NO: 1516288 - protein, 24 aa, Mycobacterium tuberculosis
AAKLIAAARKPVLYVGGGVIRGEA

SEQ ID NO: 1516289 - protein, 26 aa, Mycobacterium tuberculosis
AAMAAAAAPYAGWLAAAAARAAGASA

SEQ ID NO: 1516290 - protein, 17 aa, Mycobacterium tuberculosis
AANQFVVALRRRGHLDD

SEQ ID NO: 1516291 - protein, 26 aa, Mycobacterium tuberculosis
AANSWLDAFAHWRRAQGLPATSIAWG

SEQ ID NO: 1516292 - protein, 19 aa, Mycobacterium tuberculosis
AAQGWGGRWLVVGADVDPG

SEQ ID NO: 1516293 - protein, 24 aa, Mycobacterium tuberculosis
AAVNAPTQALFGRPLIGNGADGSP

SEQ ID NO: 1516294 - protein, 36 aa, Mycobacterium tuberculosis
AAVNNTGIFVTGVMSSGFFNFGTGNSGLLVSGNGLS

SEQ ID NO: 1516295 - protein, 19 aa, Mycobacterium tuberculosis
ADAALRYLDWLSKHSRQIL

SEQ ID NO: 1516296 - protein, 24 aa, Mycobacterium tuberculosis
ADADELFRRSLGNPLYLRHLIDGG

SEQ ID NO: 1516297 - protein, 33 aa, Mycobacterium tuberculosis; identical to SEQ ID NO: 1068838

SEQ ID NO: 1516298 - protein, 26 aa, Mycobacterium tuberculosis
ADLVYHLTTLFPPVRPRQWLEIRYLD

SEQ ID NO: 1516299 - protein, 23 aa, Mycobacterium tuberculosis
ADMTYLQWLRRYVELAIGEGNST

SEQ ID NO: 1516300 - protein, 24 aa, Mycobacterium tuberculosis
ADPGLYARALADRALIDAVAGITD

SEQ ID NO: 1516301 - protein, 23 aa, Mycobacterium tuberculosis
ADVMARVIGFHLNRGVLAAAGRV

SEQ ID NO: 1516302 - protein, 24 aa, Mycobacterium tuberculosis
ADVVVGLPMRCVFALTAMGFLPQS

SEQ ID NO: 1516303 - protein, 18 aa, Mycobacterium tuberculosis
ADWPEGLAAVLRGAADQA

SEQ ID NO: 1516304 - protein, 32 aa, Mycobacterium tuberculosis
AEAAATSPLLAPINEFFLANTGRPLIGNGTNG

SEQ ID NO: 1516305 - protein, 27 aa, Mycobacterium tuberculosis
AEAADLGQRRALTGEPLPPLLTATAKA

SEQ ID NO: 1516306 - protein, 26 aa, Mycobacterium tuberculosis
AEDGAGWLAFFRDLVARGLSGVALVT

SEQ ID NO: 1516307 - protein, 19 aa, Mycobacterium tuberculosis
AEELVRIIGVLRGMQLKKV

SEQ ID NO: 1516308 - protein, 21 aa, Mycobacterium tuberculosis
AEFERPVLLFSGGKDSIVMLH

SEQ ID NO: 1516309 - protein, 19 aa, Mycobacterium tuberculosis
AEFVGAAAGLLFSSGYTAN

SEQ ID NO: 1516310 - protein, 19 aa, Mycobacterium tuberculosis
AEIIRLGTALGANGATLAG

SEQ ID NO: 1516311 - protein, 19 aa, Mycobacterium tuberculosis
AERGPGQMLGGLPVGQMGA

SEQ ID NO: 1516312 - protein, 19 aa, Mycobacterium tuberculosis
AERRRMFELPRSSWSDYDR

SEQ ID NO: 1516313 - protein, 31 aa, Mycobacterium tuberculosis
AERVNGRIPLPVDWRWPWGEALAVLENTATD

SEQ ID NO: 1516314 - protein, 24 aa, Mycobacterium tuberculosis
AESIRKFRILPVDFTEDTGELTPT

SEQ ID NO: 1516315 - protein, 19 aa, Mycobacterium tuberculosis
AESIRPLVAPPPAPAPAPA

SEQ ID NO: 1516316 - protein, 22 aa, Mycobacterium tuberculosis
AESPIDWDIAWPADDLQVNLTP

SEQ ID NO: 1516317 - protein, 20 aa, Mycobacterium tuberculosis
AETIDWGRTVLALGLDTIDD

SEQ ID NO: 1516318 - protein, 18 aa, Mycobacterium tuberculosis
AFEELRMLSLLPSRATTL

SEQ ID NO: 1516319 - protein, 31 aa, Mycobacterium tuberculosis
AFESSHRALYTFLLDRPLIAEAISVEATGLT

SEQ ID NO: 1516320 - protein, 26 aa, Mycobacterium tuberculosis
AFETSWLDPFTEFRFPRIGTAVFDGI

SEQ ID NO: 1516321 - protein, 20 aa, Mycobacterium tuberculosis
AFFHQVLPGRVAPLGSPGGA

SEQ ID NO: 1516322 - protein, 19 aa, Mycobacterium tuberculosis
AFFLYMETPSQPLNVCCVS

SEQ ID NO: 1516323 - protein, 20 aa, Mycobacterium tuberculosis
AFHQQIVQTLTSTAGAYASA

SEQ ID NO: 1516324 - protein, 29 aa, Mycobacterium tuberculosis
AGAPGGTGGTGGWLAGGGGVGGMGGAGGG

SEQ ID NO: 1516325 - protein, 19 aa, Mycobacterium tuberculosis
AGATGINGPAGISAAGGDG

SEQ ID NO: 1516326 - protein, 38 aa, Mycobacterium tuberculosis
AGCDKSLPGMLMAAARLDLAAVFLYAGSILPGRAKLSD

SEQ ID NO: 1516327 - protein, 28 aa, Mycobacterium tuberculosis
AGDGGTGGRGGWLAGAGGAGGAGGVGGT

SEQ ID NO: 1516328 - protein, 27 aa, Mycobacterium tuberculosis
AGDTNTGFGNAGFFNMGIGNAGNEDMG

SEQ ID NO: 1516329 - protein, 32 aa, Mycobacterium tuberculosis
AGGDIPFYEPGLRKLLTDNLAAGRLRFTTDYD

SEQ ID NO: 1516330 - protein, 24 aa, Mycobacterium tuberculosis
AGGGAGMFSQPGVHGAGGTGGQGG

SEQ ID NO: 1516331 - protein, 17 aa, Mycobacterium tuberculosis
AGGLTIPTNAIPLTIDA

SEQ ID NO: 1516332 - protein, 24 aa, Mycobacterium tuberculosis
AGGNAGLFGVGGTGGPGGPGGPGG

SEQ ID NO: 1516333 - protein, 24 aa, Mycobacterium tuberculosis
AGGVYVMLEPRRFASGSALGMLSA

SEQ ID NO: 1516334 - protein, 18 aa, Mycobacterium tuberculosis
AGLGLVFLGADPLRSPVR

SEQ ID NO: 1516335 - protein, 17 aa, Mycobacterium tuberculosis
AGMLRQKGLLGARARRR

SEQ ID NO: 1516336 - protein, 21 aa, Mycobacterium tuberculosis
AGNITAYWKGYTEYHQLGLID

SEQ ID NO: 1516337 - protein, 19 aa, Mycobacterium tuberculosis
AGQITGLRSGFGGAGGAGG

SEQ ID NO: 1516338 - protein, 22 aa, Mycobacterium tuberculosis
AGRMLAIMHALDGALATVSPGA

SEQ ID NO: 1516339 - protein, 17 aa, Mycobacterium tuberculosis
AGRYLLKMNLAPWEQCR

SEQ ID NO: 1516340 - protein, 17 aa, Mycobacterium tuberculosis
AGRYRTVRIGAHQARIL

SEQ ID NO: 1516341 - protein, 26 aa, Mycobacterium tuberculosis
AGSIDVVLRLPGQRYLVVDYKTNHLG

SEQ ID NO: 1516342 - protein, 26 aa, Mycobacterium tuberculosis
AGWPNYDAVASIAWLGYDAPDGLKDV

SEQ ID NO: 1516343 - protein, 26 aa, Mycobacterium tuberculosis
AGYEKWRIRFASTAWTSTWRRWCILA

SEQ ID NO: 1516344 - protein, 22 aa, Mycobacterium tuberculosis
AHGALGGLTVAGGNGGAGGAGG

SEQ ID NO: 1516345 - protein, 27 aa, Mycobacterium tuberculosis
AIAAGVNLLLSPAVFRGFDQVGALSPT

SEQ ID NO: 1516346 - protein, 23 aa, Mycobacterium tuberculosis
AIRRGAQAILPTPAPLGGALVEE

SEQ ID NO: 1516347 - protein, 18 aa, Mycobacterium tuberculosis
AIRTPGLLPNAKLVVDHF

SEQ ID NO: 1516348 - protein, 21 aa, Mycobacterium tuberculosis
AKALVYEMPHTLAALDCGALS

SEQ ID NO: 1516349 - protein, 23 aa, Mycobacterium tuberculosis
AKHAVFDRLVYRKLRAALGGNCR

SEQ ID NO: 1516350 - protein, 33 aa, Mycobacterium tuberculosis; identical to SEQ ID NO: 792210

SEQ ID NO: 1516351 - protein, 28 aa, Mycobacterium tuberculosis
AKQAQYVAQLHVWARREHPTYEDIVGLE

SEQ ID NO: 1516352 - protein, 21 aa, Mycobacterium tuberculosis
AKVGVFRPITRLSAERDYILE

SEQ ID NO: 1516353 - protein, 18 aa, Mycobacterium tuberculosis
ALAAANRAAEAPTTGLLA

SEQ ID NO: 1516354 - protein, 25 aa, Mycobacterium tuberculosis
ALAADIPLAVDHFRYFAAAIRAQEG

SEQ ID NO: 1516355 - protein, 30 aa, Mycobacterium tuberculosis
ALAAHRRAHGLPAISLGWGLWDQASAMTGG

SEQ ID NO: 1516356 - protein, 25 aa, Mycobacterium tuberculosis
ALAARAAPLVAILWGRDASTLKPML

SEQ ID NO: 1516357 - protein, 19 aa, Mycobacterium tuberculosis
ALDLWPDFAGSDLVTGPDG

SEQ ID NO: 1516358 - protein, 19 aa, Mycobacterium tuberculosis
ALDRGLVDELGGLRTAVRR

SEQ ID NO: 1516359 - protein, 36 aa, Mycobacterium tuberculosis
ALDYSALYPAGWLVDAPLPAWTHARLFIDDDGQEQR

SEQ ID NO: 1516360 - protein, 18 aa, Mycobacterium tuberculosis
ALGELFAYRWSRCGGREE

SEQ ID NO: 1516361 - protein, 28 aa, Mycobacterium tuberculosis
ALGNFLARLVFPNPMRQLRITVGLIADL

SEQ ID NO: 1516362 - protein, 22 aa, Mycobacterium tuberculosis
ALHHVLAQYPRVDPALLLNCML

SEQ ID NO: 1516363 - protein, 28 aa, Mycobacterium tuberculosis
ALHSCSPDLPWDLLQRSRISAVSVDAST

SEQ ID NO: 1516364 - protein, 19 aa, Mycobacterium tuberculosis
ALIEDGLPVIVVMPSPKGS

SEQ ID NO: 1516365 - protein, 23 aa, Mycobacterium tuberculosis
ALKHAFDVCYYLCLDTTRGRSFG

SEQ ID NO: 1516366 - protein, 17 aa, Mycobacterium tuberculosis
ALLLNCMLLAATERSVT

SEQ ID NO: 1516367 - protein, 69 aa, Mycobacterium tuberculosis
ALSAQAAAFHDQFVHTLTAAARWYTATEIANAAAMRVVLGAVNAPTQTLLGRPLIGDGAHGTAPGQPGG

SEQ ID NO: 1516368 - protein, 26 aa, Mycobacterium tuberculosis
ALSAQAALFHEQFVRALTAGAGSYAA

SEQ ID NO: 1516369 - protein, 23 aa, Mycobacterium tuberculosis
AMAAAAAPYAGWLGSVAAQAVAV

SEQ ID NO: 1516370 - protein, 28 aa, Mycobacterium tuberculosis
AMARTCVDAGWLLSLSGTVSFRTARELR

SEQ ID NO: 1516371 - protein, 25 aa, Mycobacterium tuberculosis
AMDDLHRHLLSVLIDREWRHGVRVG

SEQ ID NO: 1516372 - protein, 24 aa, Mycobacterium tuberculosis
AMDPQQRLMLEVSWEALEHAGIDP

SEQ ID NO: 1516373 - protein, 19 aa, Mycobacterium tuberculosis
AMLSHGWIDGPPPGQYFHG

SEQ ID NO: 1516374 - protein, 27 aa, Mycobacterium tuberculosis
AMRQAAVQLAVYRLAWAALRGCPTSSV

SEQ ID NO: 1516375 - protein, 24 aa, Mycobacterium tuberculosis
ANDQFAGELLAWLRDRLSHFKCPR

SEQ ID NO: 1516376 - protein, 25 aa, Mycobacterium tuberculosis
ANGSRIYVLLPQTTTGRAVTSWVRG

SEQ ID NO: 1516377 - protein, 25 aa, Mycobacterium tuberculosis
ANSWLDAFAHWRRAQGLPATSIAWG

SEQ ID NO: 1516378 - protein, 20 aa, Mycobacterium tuberculosis
APAHDWLTLTGGAIGYGIPA

SEQ ID NO: 1516379 - protein, 28 aa, Mycobacterium tuberculosis
APDAGPPQRWFVVWLGTANNPVDKGAAK

SEQ ID NO: 1516380 - protein, 18 aa, Mycobacterium tuberculosis
APDWVPWEQRVRPGDLSP

SEQ ID NO: 1516381 - protein, 24 aa, Mycobacterium tuberculosis
APGARLVFNAFLANGDYAPDQAAR

SEQ ID NO: 1516382 - protein, 28 aa, Mycobacterium tuberculosis
APHDELMHFVQKYGIAKWFNGIRGRTRP

SEQ ID NO: 1516383 - protein, 25 aa, Mycobacterium tuberculosis
APIVKNRQYNYPPLGANLFVGAQAR

SEQ ID NO: 1516384 - protein, 35 aa, Mycobacterium tuberculosis
APKRLGSFMDSRLWRLLLAPGRGIGRLITGVMALA

SEQ ID NO: 1516385 - protein, 17 aa, Mycobacterium tuberculosis
APLGPILVSTSGTRRGD

SEQ ID NO: 1516386 - protein, 19 aa, Mycobacterium tuberculosis
APNRLWVADLTYVSTWAGF

SEQ ID NO: 1516387 - protein, 22 aa, Mycobacterium tuberculosis
APRHPHLVKLVARRANVEGIGE

SEQ ID NO: 1516388 - protein, 28 aa, Mycobacterium tuberculosis
APTMALVDVLSPLLIMTAVATAPSATTL

SEQ ID NO: 1516389 - protein, 27 aa, Mycobacterium tuberculosis
AQGFFDAQAQMLSGLQGLIETVGQHGT

SEQ ID NO: 1516390 - protein, 24 aa, Mycobacterium tuberculosis
AQHRYWDRVLFDAGLSVITWPAKY

SEQ ID NO: 1516391 - protein, 26 aa, Mycobacterium tuberculosis
AQNFNTTFPVGPFFGLGVVNISGIEI

SEQ ID NO: 1516392 - protein, 26 aa, Mycobacterium tuberculosis
AQQYRLGRLILLAQAGALLDRRIAEL

SEQ ID NO: 1516393 - protein, 25 aa, Mycobacterium tuberculosis
AQVSDYLMQVLARFARYLRESRSID

SEQ ID NO: 1516394 - protein, 28 aa, Mycobacterium tuberculosis
ARANVSYPTDLGLLAKAMRRIAAIGKRI

SEQ ID NO: 1516395 - protein, 25 aa, Mycobacterium tuberculosis
ARCATYPVLAVQAWAAFHDMTLRAV

SEQ ID NO: 1516396 - protein, 18 aa, Mycobacterium tuberculosis
ARHFGARRKAYNWTVATL

SEQ ID NO: 1516397 - protein, 20 aa, Mycobacterium tuberculosis
ARLRALSRRGPIPRPPTLEA

SEQ ID NO: 1516398 - protein, 26 aa, Mycobacterium tuberculosis
ARLVWSGHWTTFSGPDFWVTVVGPAQ

SEQ ID NO: 1516399 - protein, 31 aa, Mycobacterium tuberculosis
ARRCRWIPRVRRRWWHCIWRCSHCASANATW

SEQ ID NO: 1516400 - protein, 24 aa, Mycobacterium tuberculosis
ARTDLLAFTAFPKQIWRQIGSNNP

SEQ ID NO: 1516401 - protein, 21 aa, Mycobacterium tuberculosis
ARVRVCTPTGRNSWTAVHVHG

SEQ ID NO: 1516402 - protein, 29 aa, Mycobacterium tuberculosis
ARWSASSRFLLNLPLFSRQALHPDVDLLV

SEQ ID NO: 1516403 - protein, 22 aa, Mycobacterium tuberculosis
ASDFHAFSAAPNFAFELAARRT

SEQ ID NO: 1516404 - protein, 25 aa, Mycobacterium tuberculosis
ASGLDARAYRLAWPVGSIVYEVDMP

SEQ ID NO: 1516405 - protein, 33 aa, Mycobacterium tuberculosis
ASIGNTWLADPAPFLQQYLANQFGYGQLTLTAL

SEQ ID NO: 1516406 - protein, 18 aa, Mycobacterium tuberculosis
ASLFDPDSALRARTAVVC

SEQ ID NO: 1516407 - protein, 25 aa, Mycobacterium tuberculosis
ASLFSGNAQAYQALSAQAAAFHQQF

SEQ ID NO: 1516408 - protein, 18 aa, Mycobacterium tuberculosis
ASLRLLPRGGRFIEMGKT

SEQ ID NO: 1516409 - protein, 18 aa, Mycobacterium tuberculosis
ASPLQTLEQGLLGAINAP

SEQ ID NO: 1516410 - protein, 26 aa, Mycobacterium tuberculosis
ASRPPLMKRIVLQTGARLSRRGRRLG

SEQ ID NO: 1516411 - protein, 22 aa, Mycobacterium tuberculosis
ASVHRSPMPALVPWNQSRLSAT

SEQ ID NO: 1516412 - protein, 28 aa, Mycobacterium tuberculosis
ATAGLGPITIPIIDIPAAPGIGNSTTSP

SEQ ID NO: 1516413 - protein, 33 aa, Mycobacterium tuberculosis; identical to SEQ ID NO: 216451

SEQ ID NO: 1516414 - protein, 30 aa, Mycobacterium tuberculosis; identical to SEQ ID NO: 1391568

SEQ ID NO: 1516415 - protein, 21 aa, Mycobacterium tuberculosis
ATFHDRFVQTLSAAASSYVAA

SEQ ID NO: 1516416 - protein, 17 aa, Mycobacterium tuberculosis
ATPLQQIEQALLGVINT

SEQ ID NO: 1516417 - protein, 18 aa, Mycobacterium tuberculosis
ATVIRLSDYPYVVPLIDL

SEQ ID NO: 1516418 - protein, 18 aa, Mycobacterium tuberculosis
AVAAMPTTEVVAAGADEV

SEQ ID NO: 1516419 - protein, 24 aa, Mycobacterium tuberculosis
AVASFLLAEGLFQERLRASGADVV

SEQ ID NO: 1516420 - protein, 18 aa, Mycobacterium tuberculosis
AVASVYDEYQRRLRAANA

SEQ ID NO: 1516421 - protein, 29 aa, Mycobacterium tuberculosis
AVDGPVEPGPALVLPLRAADTVAGVLVAL

SEQ ID NO: 1516422 - protein, 20 aa, Mycobacterium tuberculosis
AVDSRWVWVLDPIDGTINYA

SEQ ID NO: 1516423 - protein, 19 aa, Mycobacterium tuberculosis
AVHIAKITRREYPNQVLPE

SEQ ID NO: 1516424 - protein, 17 aa, Mycobacterium tuberculosis
AVLLLENEGPVASATDT

SEQ ID NO: 1516425 - protein, 23 aa, Mycobacterium tuberculosis
AVNAPTQTLLGRPLVGDGADGAS

SEQ ID NO: 1516426 - protein, 35 aa, Mycobacterium tuberculosis
AVNNTGIFVTGVMSSGFFNFGTGNSGLLVSGNGLS

SEQ ID NO: 1516427 - protein, 17 aa, Mycobacterium tuberculosis
AVTDALRRFTPPSYVVP

SEQ ID NO: 1516428 - protein, 24 aa, Mycobacterium tuberculosis
AVTEWFAVDWHREIVDKWRAAGVR

SEQ ID NO: 1516429 - protein, 26 aa, Mycobacterium tuberculosis
AVTIPGFAINPFGLNVPLSGGTSPVT

SEQ ID NO: 1516430 - protein, 20 aa, Mycobacterium tuberculosis
AWLLVSILRQFGLAARFVSG

SEQ ID NO: 1516431 - protein, 18 aa, Mycobacterium tuberculosis
AYLVTESVPLTFPSLVKS

SEQ ID NO: 1516432 - protein, 21 aa, Mycobacterium tuberculosis
AYPASMLIGPMMQLAQMGTTA

SEQ ID NO: 1516433 - protein, 21 aa, Mycobacterium tuberculosis
AYQQRFVLALSQAGSTYAVAE

SEQ ID NO: 1516434 - protein, 22 aa, Mycobacterium tuberculosis
AYTGRMFTAPVPALRMPDESMD

SEQ ID NO: 1516435 - protein, 23 aa, Mycobacterium tuberculosis
AYVSWTRSALSDLPRWREPPQIY

SEQ ID NO: 1516436 - protein, 31 aa, Mycobacterium tuberculosis
CACRKHHLLKTFWTGWRDVQLPDGTVIWTAP

SEQ ID NO: 1516437 - protein, 32 aa, Mycobacterium tuberculosis; identical to SEQ ID NO: 162063

SEQ ID NO: 1516438 - protein, 20 aa, Mycobacterium tuberculosis
CDDVLVQWAMFGRDPRHGTV

SEQ ID NO: 1516439 - protein, 27 aa, Mycobacterium tuberculosis
CDVDDMLWQVPYLPIDPRDVGRTYEAV

SEQ ID NO: 1516440 - protein, 24 aa, Mycobacterium tuberculosis
CGGEYEWTRAKAAYFMIVFSGPIP

SEQ ID NO: 1516441 - protein, 17 aa, Mycobacterium tuberculosis
CGGGAFTAGVTTGGAGG

SEQ ID NO: 1516442 - protein, 17 aa, Mycobacterium tuberculosis
CPTLRAAVTGLPGVVDG

SEQ ID NO: 1516443 - protein, 17 aa, Mycobacterium tuberculosis
CTTLHLRINHESAPRLA

SEQ ID NO: 1516444 - protein, 20 aa, Mycobacterium tuberculosis
CVRATWLKVVPDQLGRSLEF

SEQ ID NO: 1516445 - protein, 22 aa, Mycobacterium tuberculosis
CYPHFRRFLAEVVRVLRPGRYF

SEQ ID NO: 1516446 - protein, 22 aa, Mycobacterium tuberculosis
DADELFRRSLGNPLYLRHLIDG

SEQ ID NO: 1516447 - protein, 31 aa, Mycobacterium tuberculosis
DAGLLVGSGGVGGAGGFGLTTGGPGAAGGDA

SEQ ID NO: 1516448 - protein, 18 aa, Mycobacterium tuberculosis
DAINAPVQSLTGRPLIGD

SEQ ID NO: 1516449 - protein, 24 aa, Mycobacterium tuberculosis
DALGIRTVLIPPMAGVLSALGIGL

SEQ ID NO: 1516450 - protein, 22 aa, Mycobacterium tuberculosis
DARWREFCLRVADRVVLVASNP

SEQ ID NO: 1516451 - protein, 20 aa, Mycobacterium tuberculosis
DASLRLLPRGGRFIEMGKTE

SEQ ID NO: 1516452 - protein, 26 aa, Mycobacterium tuberculosis
DAVNAPTQTLLGRPLIGNGADGVAGT

SEQ ID NO: 1516453 - protein, 17 aa, Mycobacterium tuberculosis
DAYYWVDNLRHTVRFAA

SEQ ID NO: 1516454 - protein, 22 aa, Mycobacterium tuberculosis
DCPPSLGVLTLNGLTAADEAIV

SEQ ID NO: 1516455 - protein, 21 aa, Mycobacterium tuberculosis
DCPPSLGVLTLNGLTAADKAI

SEQ ID NO: 1516456 - protein, 24 aa, Mycobacterium tuberculosis
DCTGYIVQLPLPKHLDENATLERV

SEQ ID NO: 1516457 - protein, 37 aa, Mycobacterium tuberculosis
DDALKQLFGYLVWRDTKAAILLFIRNKDVTAVIDNAI

SEQ ID NO: 1516458 - protein, 22 aa, Mycobacterium tuberculosis
DEALLDIYRKLRPGEPPTKESA

SEQ ID NO: 1516459 - protein, 32 aa, Mycobacterium tuberculosis
DEGITAMHFVPSLLGLFLSLPGVSQWRTLQRV

SEQ ID NO: 1516460 - protein, 23 aa, Mycobacterium tuberculosis
DEPDPVTLVAQLSRRFAPPTLVN

SEQ ID NO: 1516461 - protein, 17 aa, Mycobacterium tuberculosis
DERLRMVARPMINVFPS

SEQ ID NO: 1516462 - protein, 17 aa, Mycobacterium tuberculosis
DEVSAAVAALFGSYAQS

SEQ ID NO: 1516463 - protein, 25 aa, Mycobacterium tuberculosis
DEVSQAIARLFSDYATHYQSLNAQA

SEQ ID NO: 1516464 - protein, 25 aa, Mycobacterium tuberculosis
DFADLFPVPAKLWTIADLGGWGSVD

SEQ ID NO: 1516465 - protein, 18 aa, Mycobacterium tuberculosis
DFRPKHKLAVLVVCAIPL

SEQ ID NO: 1516466 - protein, 34 aa, Mycobacterium tuberculosis
DFVSKFIGLGRGYRWLQLFDAAGLPVRDIEQVSV

SEQ ID NO: 1516467 - protein, 24 aa, Mycobacterium tuberculosis
DGGAGGNGGSWLAAGDGGAGGHGG

SEQ ID NO: 1516468 - protein, 23 aa, Mycobacterium tuberculosis
DGGDGGYGGWGGAGGNGGAGGSA

SEQ ID NO: 1516469 - protein, 20 aa, Mycobacterium tuberculosis
DGIALGLWAGVAVSDLEFIQ

SEQ ID NO: 1516470 - protein, 22 aa, Mycobacterium tuberculosis
DGRIMWSNWIDEQLLGPQRFTP

SEQ ID NO: 1516471 - protein, 25 aa, Mycobacterium tuberculosis
DGRTRYRLLETVRQYALEKLRESGD

SEQ ID NO: 1516472 - protein, 26 aa, Mycobacterium tuberculosis
DGVPVAGLTWMPFTDPRYTAVAGGPL

SEQ ID NO: 1516473 - protein, 19 aa, Mycobacterium tuberculosis
DGVVWWQVVLQLPLLPGWP

SEQ ID NO: 1516474 - protein, 33 aa, Mycobacterium tuberculosis
DHAMARRFDTIARLWDVIGDTGIGFCLDTCHTW

SEQ ID NO: 1516475 - protein, 19 aa, Mycobacterium tuberculosis
DHGQPRINRYHHPAKILCE

SEQ ID NO: 1516476 - protein, 18 aa, Mycobacterium tuberculosis
DIDRLVELFTAEAIWEMP

SEQ ID NO: 1516477 - protein, 28 aa, Mycobacterium tuberculosis
DIGPIEVLVSTMFSLLTSGALCVDHEQV

SEQ ID NO: 1516478 - protein, 23 aa, Mycobacterium tuberculosis
DISLRNWIATLTLELEPTVRLPA

SEQ ID NO: 1516479 - protein, 17 aa, Mycobacterium tuberculosis
DIYLPLHGEHQAHNAVL

SEQ ID NO: 1516480 - protein, 28 aa, Mycobacterium tuberculosis
DKAKAAPLWRVLVALSIRHVGPTAARAL

SEQ ID NO: 1516481 - protein, 25 aa, Mycobacterium tuberculosis
DKVAELTQLWWPEAERNRVLPLLGG

SEQ ID NO: 1516482 - protein, 23 aa, Mycobacterium tuberculosis
DLHLGQVLRTPESWLLIDFEGEP

SEQ ID NO: 1516483 - protein, 25 aa, Mycobacterium tuberculosis
DLIDPALLRPGRLERLVFVEPPDAA

SEQ ID NO: 1516484 - protein, 20 aa, Mycobacterium tuberculosis
DLLRNGVLVDLYPLVRKSIR

SEQ ID NO: 1516485 - protein, 19 aa, Mycobacterium tuberculosis
DLLRPVIDTVARVAARAYD

SEQ ID NO: 1516486 - protein, 21 aa, Mycobacterium tuberculosis
DLVSEFVCRLLNYMDDNGFDT

SEQ ID NO: 1516487 - protein, 33 aa, Mycobacterium tuberculosis
DNFDFDYVFVDCPPSLGLLTINALVAAPEVMIP

SEQ ID NO: 1516488 - protein, 28 aa, Mycobacterium tuberculosis
DNNAGDYGFFWITAVTTDGSIVVANSYG

SEQ ID NO: 1516489 - protein, 29 aa, Mycobacterium tuberculosis
DNQPAAHVVKLLNRFFAIVVNEVDRHHGL

SEQ ID NO: 1516490 - protein, 19 aa, Mycobacterium tuberculosis
DPDALVHTIWMASNRSDRV

SEQ ID NO: 1516491 - protein, 28 aa, Mycobacterium tuberculosis
DPLALRDRLIVELLYATGIRVSELCGLD

SEQ ID NO: 1516492 - protein, 19 aa, Mycobacterium tuberculosis
DPPCDDWSPPPIRMGVDVP

SEQ ID NO: 1516493 - protein, 27 aa, Mycobacterium tuberculosis
DPQLARARWRRVRSLPHLQDRWVAMFG

SEQ ID NO: 1516494 - protein, 22 aa, Mycobacterium tuberculosis
DPSVDLIIAWNLLSAPARAQFR

SEQ ID NO: 1516495 - protein, 20 aa, Mycobacterium tuberculosis
DQAHVLGRRIGQQPFEIGGH

SEQ ID NO: 1516496 - protein, 24 aa, Mycobacterium tuberculosis
DQIAPLEMTKWFDTNYHYLVPEIG

SEQ ID NO: 1516497 - protein, 22 aa, Mycobacterium tuberculosis
DQIIPAVFLKRVTRTGFEDGLF

SEQ ID NO: 1516498 - protein, 20 aa, Mycobacterium tuberculosis
DQRLLDLLPPAPVDVNPPGD

SEQ ID NO: 1516499 - protein, 19 aa, Mycobacterium tuberculosis
DRLWEALLRGDDLVTEIPA

SEQ ID NO: 1516500 - protein, 18 aa, Mycobacterium tuberculosis
DRMAKMLRLAVDEVFQMQ

SEQ ID NO: 1516501 - protein, 24 aa, Mycobacterium tuberculosis
DRRTELMIRLAGEAGLRRAEAAQA

SEQ ID NO: 1516502 - protein, 28 aa, Mycobacterium tuberculosis
DRWAGFFNEFDVLLLPVTPTPAPLHHNK

SEQ ID NO: 1516503 - protein, 21 aa, Mycobacterium tuberculosis
DSAGSSRKAFGGDGGVGGDGA

SEQ ID NO: 1516504 - protein, 25 aa, Mycobacterium tuberculosis
DSEDETFWRGFLTSLKGRGLGGVRL

SEQ ID NO: 1516505 - protein, 17 aa, Mycobacterium tuberculosis
DSLPRIAQAIALPAVRK

SEQ ID NO: 1516506 - protein, 18 aa, Mycobacterium tuberculosis
DSRLPRWRAMAAHALCKR

SEQ ID NO: 1516507 - protein, 32 aa, Mycobacterium tuberculosis
DSSEAVDPLLPEVAWSWLVDALTARTDQVRAL

SEQ ID NO: 1516508 - protein, 24 aa, Mycobacterium tuberculosis
DSVAQLELLLPAMAGLVASLTFNV

SEQ ID NO: 1516509 - protein, 33 aa, Mycobacterium tuberculosis
DSWRNYQWHQLARAFLMYVTQRWPDVLSTAAED

SEQ ID NO: 1516510 - protein, 25 aa, Mycobacterium tuberculosis
DTDLAWSRITYWRALLTSAVDQPRH

SEQ ID NO: 1516511 - protein, 24 aa, Mycobacterium tuberculosis
DTKLARSPTVTALLQLAAYADALV

SEQ ID NO: 1516512 - protein, 34 aa, Mycobacterium tuberculosis; identical to SEQ ID NO: 226075

SEQ ID NO: 1516513 - protein, 24 aa, Mycobacterium tuberculosis
DTQPRPLVIVHGPLFQAVKAARAQ

SEQ ID NO: 1516514 - protein, 20 aa, Mycobacterium tuberculosis
DTTVPLFDSGVGGAGGAGGN

SEQ ID NO: 1516515 - protein, 26 aa, Mycobacterium tuberculosis
DVGAGYQFPAWRLVGGHQPVNPPAQR

SEQ ID NO: 1516516 - protein, 20 aa, Mycobacterium tuberculosis
DVKRFRGFDNWEGDAATACE

SEQ ID NO: 1516517 - protein, 17 aa, Mycobacterium tuberculosis
DVLECLAGLASDAGTHH

SEQ ID NO: 1516518 - protein, 18 aa, Mycobacterium tuberculosis
DVNGLWVTHLGVGQNVTV

SEQ ID NO: 1516519 - protein, 17 aa, Mycobacterium tuberculosis
DVQLPDGTVIWTAPNGH

SEQ ID NO: 1516520 - protein, 40 aa, Mycobacterium tuberculosis; identical to SEQ ID NO: 217332

SEQ ID NO: 1516521 - protein, 18 aa, Mycobacterium tuberculosis
DWGVLPDLVMGHSVGEIA

SEQ ID NO: 1516522 - protein, 28 aa, Mycobacterium tuberculosis
DYPAGAAFSWWPTMLLPPGSHQDNMTVG

SEQ ID NO: 1516523 - protein, 26 aa, Mycobacterium tuberculosis
DYQSTARFILAYLPRWQEPPQIYGGG

SEQ ID NO: 1516524 - protein, 17 aa, Mycobacterium tuberculosis
DYTLPWDVDTVEDSIPV

SEQ ID NO: 1516525 - protein, 18 aa, Mycobacterium tuberculosis
DYVPFTDWVDGRVLLDGR

SEQ ID NO: 1516526 - protein, 28 aa, Mycobacterium tuberculosis
EAAGWFGVAMILDFSWLPPEINSARIYA

SEQ ID NO: 1516527 - protein, 34 aa, Mycobacterium tuberculosis
EAELQRIVASIPVKRLRQAGVLDLLLALANETET

SEQ ID NO: 1516528 - protein, 17 aa, Mycobacterium tuberculosis
EAFGRYGAYLSQLNVLP

SEQ ID NO: 1516529 - protein, 18 aa, Mycobacterium tuberculosis
EAFVLAEKLGLSAQSLFD

SEQ ID NO: 1516530 - protein, 24 aa, Mycobacterium tuberculosis
EAKVVSERRLWLAVLRAQAELGVA

SEQ ID NO: 1516531 - protein, 18 aa, Mycobacterium tuberculosis
EALPPTEPRVLQIRALVL

SEQ ID NO: 1516532 - protein, 28 aa, Mycobacterium tuberculosis
EAPTGWPNILPDDFTILDGIFAAYATVG

SEQ ID NO: 1516533 - protein, 26 aa, Mycobacterium tuberculosis
EARKSFFRVPLIGGTITHPVQGEAAA

SEQ ID NO: 1516534 - protein, 20 aa, Mycobacterium tuberculosis
EASIVVIRILGGYRAWQSGI

SEQ ID NO: 1516535 - protein, 19 aa, Mycobacterium tuberculosis
EAYLGRRWVKLDATIDAPT

SEQ ID NO: 1516536 - protein, 26 aa, Mycobacterium tuberculosis
ECRHNLGYWDGGQWWGAGPGAHGYIG

SEQ ID NO: 1516537 - protein, 26 aa, Mycobacterium tuberculosis
EDDPNWFRFHQMFADFLHRRLERGGS

SEQ ID NO: 1516538 - protein, 18 aa, Mycobacterium tuberculosis
EDEQVCADLLALLTSRRP

SEQ ID NO: 1516539 - protein, 30 aa, Mycobacterium tuberculosis; identical to SEQ ID NO: 237569

SEQ ID NO: 1516540 - protein, 18 aa, Mycobacterium tuberculosis
EDLLAEPLQFSIVLGVRG

SEQ ID NO: 1516541 - protein, 23 aa, Mycobacterium tuberculosis
EEDLRGWLLGLTYTVSGEGMMAA

SEQ ID NO: 1516542 - protein, 21 aa, Mycobacterium tuberculosis
EEFSETIRYFSTILAKHGVEV

SEQ ID NO: 1516543 - protein, 36 aa, Mycobacterium tuberculosis
EEISQWRVGILEQLARIHAQLENIPALLESARHSET

SEQ ID NO: 1516544 - protein, 21 aa, Mycobacterium tuberculosis
EELISILGGETRELAFAKTPP

SEQ ID NO: 1516545 - protein, 17 aa, Mycobacterium tuberculosis
EEPILAGLIDRIARDEV

SEQ ID NO: 1516546 - protein, 18 aa, Mycobacterium tuberculosis
EEVRNCFADMAKVAIALG

SEQ ID NO: 1516547 - protein, 23 aa, Mycobacterium tuberculosis
EFKDLTPLFADRRGLAAVTEALA

SEQ ID NO: 1516548 - protein, 17 aa, Mycobacterium tuberculosis
EFLFLCSGYYNYDEGYS

SEQ ID NO: 1516549 - protein, 22 aa, Mycobacterium tuberculosis
EFREMFAPGAFRRSIAERGHKV

SEQ ID NO: 1516550 - protein, 23 aa, Mycobacterium tuberculosis
EGAMAEALLLRLTRDDWQRHRTV

SEQ ID NO: 1516551 - protein, 24 aa, Mycobacterium tuberculosis
EGARAFQTLLRYGRAYSGYAPIMG

SEQ ID NO: 1516552 - protein, 28 aa, Mycobacterium tuberculosis
EGLAGFSFGYPIPLFPAVGADVTGDIGP

SEQ ID NO: 1516553 - protein, 25 aa, Mycobacterium tuberculosis
EGRPRLRYWLDRLSTDGILAHAAVV

SEQ ID NO: 1516554 - protein, 25 aa, Mycobacterium tuberculosis
EHQAIVRDVLAAGDFWGGAGSVACQ

SEQ ID NO: 1516555 - protein, 21 aa, Mycobacterium tuberculosis
EHVFDFFLRNKRTEWANYRSH

SEQ ID NO: 1516556 - protein, 18 aa, Mycobacterium tuberculosis
EICAYFDAVLQQQLLPTG

SEQ ID NO: 1516557 - protein, 25 aa, Mycobacterium tuberculosis
EIDWVIKRKLFQRYQDRYDMELSHP

SEQ ID NO: 1516558 - protein, 24 aa, Mycobacterium tuberculosis
EINSLRMFTGAGSAPMLAASVAWD

SEQ ID NO: 1516559 - protein, 31 aa, Mycobacterium tuberculosis
EIPDHFRIYVSQKLARLERFDRTIYLFDVEL

SEQ ID NO: 1516560 - protein, 17 aa, Mycobacterium tuberculosis
EIQAYDPVFFPGLAAEW

SEQ ID NO: 1516561 - protein, 37 aa, Mycobacterium tuberculosis; identical to SEQ ID NO: 125850

SEQ ID NO: 1516562 - protein, 22 aa, Mycobacterium tuberculosis
EKAVANQLLPWALQHVELGPRT

SEQ ID NO: 1516563 - protein, 26 aa, Mycobacterium tuberculosis
EKHTVARLIGAPPGYVGYEAGGQLTE

SEQ ID NO: 1516564 - protein, 23 aa, Mycobacterium tuberculosis
EKVRRKPFSVVLFDEIEKAHQEI

SEQ ID NO: 1516565 - protein, 20 aa, Mycobacterium tuberculosis
EKYYRTLDPFVALAAAAATT

SEQ ID NO: 1516566 - protein, 26 aa, Mycobacterium tuberculosis
ELAAKLHAVYPALGRTPLVVWPAGPG

SEQ ID NO: 1516567 - protein, 17 aa, Mycobacterium tuberculosis
ELGLPPAPAPPVRRLAE

SEQ ID NO: 1516568 - protein, 20 aa, Mycobacterium tuberculosis
ELHLGFNFRLARTEFDAAEI

SEQ ID NO: 1516569 - protein, 25 aa, Mycobacterium tuberculosis
ELKTNSSLLTSILTYHVVAGQTSPA

SEQ ID NO: 1516570 - protein, 20 aa, Mycobacterium tuberculosis
ELLARMRALLRRTKPEDAAE

SEQ ID NO: 1516571 - protein, 27 aa, Mycobacterium tuberculosis
ELLAVELSSFQLHWAPSLRPEAGAVLN

SEQ ID NO: 1516572 - protein, 18 aa, Mycobacterium tuberculosis
ELRASWTATTPDLGAHVQ

SEQ ID NO: 1516573 - protein, 23 aa, Mycobacterium tuberculosis
ELRHHIATPQPLQWDCFLFGIIQ

SEQ ID NO: 1516574 - protein, 17 aa, Mycobacterium tuberculosis
ELRPLKAVAARMACPYL

SEQ ID NO: 1516575 - protein, 17 aa, Mycobacterium tuberculosis
ELSHFSGAGISLLCILD

SEQ ID NO: 1516576 - protein, 17 aa, Mycobacterium tuberculosis
ELVARLATGWVLEEVHD

SEQ ID NO: 1516577 - protein, 17 aa, Mycobacterium tuberculosis
ELVLDRTPLYAESGGQI

SEQ ID NO: 1516578 - protein, 26 aa, Mycobacterium tuberculosis
ELVVAWGKLYPQFGAVAALNLVKCVH

SEQ ID NO: 1516579 - protein, 26 aa, Mycobacterium tuberculosis
ELVVRTRYFDQFFLDAAAAGVRQAVI

SEQ ID NO: 1516580 - protein, 19 aa, Mycobacterium tuberculosis
ELYLAVLHRHVENLVSGVH

SEQ ID NO: 1516581 - protein, 18 aa, Mycobacterium tuberculosis
ENIPALLESARHSETEPL

SEQ ID NO: 1516582 - protein, 24 aa, Mycobacterium tuberculosis
ENRAELMILIATNLLGQNTPAIAV

SEQ ID NO: 1516583 - protein, 19 aa, Mycobacterium tuberculosis
ENYDRVAAITGQPTEWIVP

SEQ ID NO: 1516584 - protein, 21 aa, Mycobacterium tuberculosis
EPAESLPPPYDNRLAQPYGGY

SEQ ID NO: 1516585 - protein, 22 aa, Mycobacterium tuberculosis
EPGIYFPGRWGARIEDIVIVTE

SEQ ID NO: 1516586 - protein, 21 aa, Mycobacterium tuberculosis
EPTEALTGRPLIGNGDSGTPG

SEQ ID NO: 1516587 - protein, 21 aa, Mycobacterium tuberculosis
EQLEIELNWIDEHIGDHPYGV

SEQ ID NO: 1516588 - protein, 33 aa, Mycobacterium tuberculosis; identical to SEQ ID NO: 226142

SEQ ID NO: 1516589 - protein, 24 aa, Mycobacterium tuberculosis
ERASPYVVGALKLGLTAPFNIDEV

SEQ ID NO: 1516590 - protein, 28 aa, Mycobacterium tuberculosis
ERIQRRGMADNYWSMGIPGPCGPSSEIY

SEQ ID NO: 1516591 - protein, 17 aa, Mycobacterium tuberculosis
ERKGALRGLRLSYFGDG

SEQ ID NO: 1516592 - protein, 31 aa, Mycobacterium tuberculosis
ERMSGTAVFEIFFRKLPPGRSYIMAAGLADV

SEQ ID NO: 1516593 - protein, 22 aa, Mycobacterium tuberculosis
ESGFRLLAMTPHGNACKLPEAI

SEQ ID NO: 1516594 - protein, 17 aa, Mycobacterium tuberculosis
ESIPIRIPVDIPASVID

SEQ ID NO: 1516595 - protein, 23 aa, Mycobacterium tuberculosis
ESPVLIVDYRLIPKHSLGMALDD

SEQ ID NO: 1516596 - protein, 17 aa, Mycobacterium tuberculosis
ESRAQMATLPRLKPRVF

SEQ ID NO: 1516597 - protein, 17 aa, Mycobacterium tuberculosis
ETLPHRPGVYLFRGPSG

SEQ ID NO: 1516598 - protein, 27 aa, Mycobacterium tuberculosis
ETPQVSNIAYTKKLWQAIRAQDVCGND

SEQ ID NO: 1516599 - protein, 24 aa, Mycobacterium tuberculosis
EVCTRLIRSALPDATLRLVVDPRK

SEQ ID NO: 1516600 - protein, 23 aa, Mycobacterium tuberculosis
EVSQAIARLFSDYATHYQSLNAQ

SEQ ID NO: 1516601 - protein, 23 aa, Mycobacterium tuberculosis
EVVARLRVILRRAGKGNKEPRNV

SEQ ID NO: 1516602 - protein, 18 aa, Mycobacterium tuberculosis
EVVTDMWGRPRVRLTGAI

SEQ ID NO: 1516603 - protein, 24 aa, Mycobacterium tuberculosis
EWERRAIAVFGHRPYIGVSANIVA

SEQ ID NO: 1516604 - protein, 21 aa, Mycobacterium tuberculosis
EYLRQRATLIDPKRAMPAATG

SEQ ID NO: 1516605 - protein, 22 aa, Mycobacterium tuberculosis
EYRGHVIYRTELYERATAQRFA

SEQ ID NO: 1516606 - protein, 17 aa, Mycobacterium tuberculosis
FATAHYALVDLAAARSG

SEQ ID NO: 1516607 - protein, 23 aa, Mycobacterium tuberculosis
FAVHFFRRELVARLATGWVLEEV

SEQ ID NO: 1516608 - protein, 18 aa, Mycobacterium tuberculosis
FDAALIDVVLPLVDGLPD

SEQ ID NO: 1516609 - protein, 18 aa, Mycobacterium tuberculosis
FDGLRLAGRRVRRPELTL

SEQ ID NO: 1516610 - protein, 21 aa, Mycobacterium tuberculosis
FEAVRLAMVQPALVAANRSGL

SEQ ID NO: 1516611 - protein, 19 aa, Mycobacterium tuberculosis
FEGPPPWNIGEPQPELATL

SEQ ID NO: 1516612 - protein, 19 aa, Mycobacterium tuberculosis
FEHLPRGSFGRILSVLNAA

SEQ ID NO: 1516613 - protein, 29 aa, Mycobacterium tuberculosis
FEKMLYDNALLLRAYAHWARRTGDPLARR

SEQ ID NO: 1516614 - protein, 17 aa, Mycobacterium tuberculosis
FGGFGTAGGVGGAGGNA

SEQ ID NO: 1516615 - protein, 17 aa, Mycobacterium tuberculosis
FGLGNSGLTPGLMGLGN

SEQ ID NO: 1516616 - protein, 34 aa, Mycobacterium tuberculosis
FGNQILGRALGLPTYKMVFGHRGINIPVVDHATG

SEQ ID NO: 1516617 - protein, 17 aa, Mycobacterium tuberculosis
FGPVPYSHQPNRGFLRC

SEQ ID NO: 1516618 - protein, 25 aa, Mycobacterium tuberculosis
FGQSGGFIWVDPKADLALVVLTARD

SEQ ID NO: 1516619 - protein, 20 aa, Mycobacterium tuberculosis
FIEHDSQGYRLIFENDFVTE

SEQ ID NO: 1516620 - protein, 18 aa, Mycobacterium tuberculosis
FLENIIVPGLTVSGQILV

SEQ ID NO: 1516621 - protein, 17 aa, Mycobacterium tuberculosis
FLQSHPAWIAAQQRDHQ

SEQ ID NO: 1516622 - protein, 18 aa, Mycobacterium tuberculosis
FMRNAAGGTLFNFGFAND

SEQ ID NO: 1516623 - protein, 17 aa, Mycobacterium tuberculosis
FNLVQYLGQLGIEAEVW

SEQ ID NO: 1516624 - protein, 19 aa, Mycobacterium tuberculosis
FNTGWANSGDINTGGFHSG

SEQ ID NO: 1516625 - protein, 17 aa, Mycobacterium tuberculosis
FPHLAETLRRAGVRTNT

SEQ ID NO: 1516626 - protein, 25 aa, Mycobacterium tuberculosis
FPIAKIAAKLAIGYTLDEIVNDITG

SEQ ID NO: 1516627 - protein, 20 aa, Mycobacterium tuberculosis
FPPPNTYVAPIAFNVVPLAG

SEQ ID NO: 1516628 - protein, 18 aa, Mycobacterium tuberculosis
FPSLVKSGSRTPGLANIA

SEQ ID NO: 1516629 - protein, 17 aa, Mycobacterium tuberculosis
FPTKADCRRIRGVPVFD

SEQ ID NO: 1516630 - protein, 22 aa, Mycobacterium tuberculosis
FPVPALTCLLRSITLRMTMAPV

SEQ ID NO: 1516631 - protein, 18 aa, Mycobacterium tuberculosis
FQGLAFVVSRRRLLGRFV

SEQ ID NO: 1516632 - protein, 20 aa, Mycobacterium tuberculosis
FQLQHWTHHFDYALVCGGGD

SEQ ID NO: 1516633 - protein, 25 aa, Mycobacterium tuberculosis
FQNTNTGAFFIGHSGLLNSGGGQHV

SEQ ID NO: 1516634 - protein, 23 aa, Mycobacterium tuberculosis
FRTTLYVTCEVVRIAALLIQPVM

SEQ ID NO: 1516635 - protein, 25 aa, Mycobacterium tuberculosis
FSDSYPFCHNGFRPIMMPKIVSVQH

SEQ ID NO: 1516636 - protein, 18 aa, Mycobacterium tuberculosis
FSFGDYFKRGAIELAWAL

SEQ ID NO: 1516637 - protein, 30 aa, Mycobacterium tuberculosis
FSGFDPWLPSLGNPLTFLSPANIAFALGYP

SEQ ID NO: 1516638 - protein, 17 aa, Mycobacterium tuberculosis
FSHRSYLDGMLLPEAIL

SEQ ID NO: 1516639 - protein, 27 aa, Mycobacterium tuberculosis
FSNAGPAMLPGFNSGFANIGSFNAGIA

SEQ ID NO: 1516640 - protein, 18 aa, Mycobacterium tuberculosis
FSWLPAQFASQSDAPVGA

SEQ ID NO: 1516641 - protein, 20 aa, Mycobacterium tuberculosis
FTLTVGLMLPRRAFLPPPHV

SEQ ID NO: 1516642 - protein, 19 aa, Mycobacterium tuberculosis
FTVPDIPIPAIHIGINGVV

SEQ ID NO: 1516643 - protein, 26 aa, Mycobacterium tuberculosis
FVRSEGCAMVLLKRLPDALRDGNRIF

SEQ ID NO: 1516644 - protein, 26 aa, Mycobacterium tuberculosis
FVTDGKMFIIGRIKDLLIVYGRNHSP

SEQ ID NO: 1516645 - protein, 19 aa, Mycobacterium tuberculosis
GAAGGAGWSPDSDLKGFDG

SEQ ID NO: 1516646 - protein, 26 aa, Mycobacterium tuberculosis
GAARRRAFRVWLDARRNALVVLAPGY

SEQ ID NO: 1516647 - protein, 52 aa, Mycobacterium tuberculosis; identical to SEQ ID NO: 236349

SEQ ID NO: 1516648 - protein, 29 aa, Mycobacterium tuberculosis
GADEVSAGIAALFSAHAQEYQALSAQAAA

SEQ ID NO: 1516649 - protein, 24 aa, Mycobacterium tuberculosis
GAGGAAGMLFGAAGVGGPGGFAAA

SEQ ID NO: 1516650 - protein, 25 aa, Mycobacterium tuberculosis
GAGGAGGFGFLGGDGGAGGNAGLLL

SEQ ID NO: 1516651 - protein, 24 aa, Mycobacterium tuberculosis
GAGGGAFVHIATATSTGGSGGFGG

SEQ ID NO: 1516652 - protein, 20 aa, Mycobacterium tuberculosis
GAGGLFGAGGAGGLGGQGNH

SEQ ID NO: 1516653 - protein, 23 aa, Mycobacterium tuberculosis
GAGGNAGWFGHGGAGGVGGVGAA

SEQ ID NO: 1516654 - protein, 27 aa, Mycobacterium tuberculosis
GAGGSAGLLGYVGRAGDGGAGGGGGLG

SEQ ID NO: 1516655 - protein, 19 aa, Mycobacterium tuberculosis
GAGGWLFGNGGAGGVGGAG

SEQ ID NO: 1516656 - protein, 20 aa, Mycobacterium tuberculosis
GALTVAMKHIKEPPPPLPPD

SEQ ID NO: 1516657 - protein, 19 aa, Mycobacterium tuberculosis
GAPVPIPGFPTTVTVFGTP

SEQ ID NO: 1516658 - protein, 18 aa, Mycobacterium tuberculosis
GAQLRRRLRGHPAHRADA

SEQ ID NO: 1516659 - protein, 26 aa, Mycobacterium tuberculosis
GATAFPWRRQSALVQWYVETSGSPPE

SEQ ID NO: 1516660 - protein, 21 aa, Mycobacterium tuberculosis
GCAALIVALLGACPALRVLAT

SEQ ID NO: 1516661 - protein, 22 aa, Mycobacterium tuberculosis
GCWRTFLTCDANLAVTLPPGLT

SEQ ID NO: 1516662 - protein, 24 aa, Mycobacterium tuberculosis
GDALFVQLHAPLRGVARGQTLVLY

SEQ ID NO: 1516663 - protein, 24 aa, Mycobacterium tuberculosis
GDEFCLLDGLLAWYATIGSINNIN

SEQ ID NO: 1516664 - protein, 25 aa, Mycobacterium tuberculosis
GDERHMLWFALMKPMTSTATGREAA

SEQ ID NO: 1516665 - protein, 23 aa, Mycobacterium tuberculosis
GDGKVWVSPVDTIVRVRTGERGH

SEQ ID NO: 1516666 - protein, 23 aa, Mycobacterium tuberculosis
GDPGAALPALARTPVEAIGVDLV

SEQ ID NO: 1516667 - protein, 25 aa, Mycobacterium tuberculosis
GDVELRIPKLRKGSFFPAILEPRRR

SEQ ID NO: 1516668 - protein, 18 aa, Mycobacterium tuberculosis
GECEFIIRLLPDGVMSNY

SEQ ID NO: 1516669 - protein, 24 aa, Mycobacterium tuberculosis
GEQKARIFLALLGKQYGVTPKGWQ

SEQ ID NO: 1516670 - protein, 19 aa, Mycobacterium tuberculosis
GEQPQVTELLPFGRPQLAG

SEQ ID NO: 1516671 - protein, 23 aa, Mycobacterium tuberculosis
GERLNLPAGWSYHTRVLTSELRV

SEQ ID NO: 1516672 - protein, 19 aa, Mycobacterium tuberculosis
GFNVGFYNSGAGTVGIANS

SEQ ID NO: 1516673 - protein, 17 aa, Mycobacterium tuberculosis
GFSIPQLGFTLSGATPA

SEQ ID NO: 1516674 - protein, 18 aa, Mycobacterium tuberculosis
GFSSLAYLPRLPVDVVKL

SEQ ID NO: 1516675 - protein, 18 aa, Mycobacterium tuberculosis
GFTIGQRRGLGIAGPGPN

SEQ ID NO: 1516676 - protein, 26 aa, Mycobacterium tuberculosis
GGAGGAAGLFGIGGAGGAGGAGAPGG

SEQ ID NO: 1516677 - protein, 24 aa, Mycobacterium tuberculosis
GGAGGAAGLFGTGGAGGAGGAGAA

SEQ ID NO: 1516678 - protein, 20 aa, Mycobacterium tuberculosis
GGAGGAFLGDGGNGGAGGQG

SEQ ID NO: 1516679 - protein, 18 aa, Mycobacterium tuberculosis
GGAGGFGGFGTAGGVGGA

SEQ ID NO: 1516680 - protein, 25 aa, Mycobacterium tuberculosis
GGAGGHGGWLWGNGGVGGSGGAGVG

SEQ ID NO: 1516681 - protein, 26 aa, Mycobacterium tuberculosis
GGAGGHGGWLWGNGGVGGSGGAGVGA

SEQ ID NO: 1516682 - protein, 22 aa, Mycobacterium tuberculosis
GGAGGLFGAGGMGGAGGFGDHG

SEQ ID NO: 1516683 - protein, 25 aa, Mycobacterium tuberculosis
GGAGGNGAWLFGNGGAGGGGGKGGN

SEQ ID NO: 1516684 - protein, 27 aa, Mycobacterium tuberculosis
GGAGGTGGLLFGAGGNGGPGGSGGAAD

SEQ ID NO: 1516685 - protein, 19 aa, Mycobacterium tuberculosis
GGALIDKPLMRRKLAEMVV

SEQ ID NO: 1516686 - protein, 23 aa, Mycobacterium tuberculosis
GGATPLLVFYHGGGWTLGDLDTH

SEQ ID NO: 1516687 - protein, 22 aa, Mycobacterium tuberculosis
GGDAGMLSLGAAGGAGGSGGSS

SEQ ID NO: 1516688 - protein, 22 aa, Mycobacterium tuberculosis
GGDAMPWLIASAKTLSYAVNMA

SEQ ID NO: 1516689 - protein, 30 aa, Mycobacterium tuberculosis
GGDGGCRRVWRRYRRQRWCRRQRRADRQRR

SEQ ID NO: 1516690 - protein, 23 aa, Mycobacterium tuberculosis
GGDGGYGGWGGAGGNGGAGGSAP

SEQ ID NO: 1516691 - protein, 25 aa, Mycobacterium tuberculosis
GGFGGAGGIAQLFGTGGMGGSGGGI

SEQ ID NO: 1516692 - protein, 25 aa, Mycobacterium tuberculosis
GGGLSSPVILGIGIGGAGGDGGGAL

SEQ ID NO: 1516693 - protein, 22 aa, Mycobacterium tuberculosis
GGNAALLFGNGGAGGAGGAGGI

SEQ ID NO: 1516694 - protein, 25 aa, Mycobacterium tuberculosis
GGNGGAGGLLFGDGGNGGAGGAGGI

SEQ ID NO: 1516695 - protein, 25 aa, Mycobacterium tuberculosis
GGQRRRLQLMLTLLSEPNVLLLDEP

SEQ ID NO: 1516696 - protein, 18 aa, Mycobacterium tuberculosis
GGRLTGVTALSPVAPLDE

SEQ ID NO: 1516697 - protein, 22 aa, Mycobacterium tuberculosis
GGSGGSLFGFGGAGGTGGSSGI

SEQ ID NO: 1516698 - protein, 23 aa, Mycobacterium tuberculosis
GGSPPAALSWVEPILQATTTLCV

SEQ ID NO: 1516699 - protein, 27 aa, Mycobacterium tuberculosis
GGTAHLGPLAIIGQSGQPGQFGSPGAD

SEQ ID NO: 1516700 - protein, 27 aa, Mycobacterium tuberculosis
GGTGLLDLLNRLGITPLPNTAGSRSAA

SEQ ID NO: 1516701 - protein, 18 aa, Mycobacterium tuberculosis
GGTPFPLQLATQVDAPPG

SEQ ID NO: 1516702 - protein, 19 aa, Mycobacterium tuberculosis
GGTPFPLQLATQVDAPPGS

SEQ ID NO: 1516703 - protein, 26 aa, Mycobacterium tuberculosis
GGVGAFLNALFAGPAKMLRLNAGLGN

SEQ ID NO: 1516704 - protein, 20 aa, Mycobacterium tuberculosis
GGVLAWESLALSGAEAGTAS

SEQ ID NO: 1516705 - protein, 17 aa, Mycobacterium tuberculosis
GGYGAALLLDSWALLGR

SEQ ID NO: 1516706 - protein, 26 aa, Mycobacterium tuberculosis
GHGGTGGAGGLLFGAGEDGTTPGGNG

SEQ ID NO: 1516707 - protein, 21 aa, Mycobacterium tuberculosis
GHIEFPYVYLDATYLNVRNGT

SEQ ID NO: 1516708 - protein, 29 aa, Mycobacterium tuberculosis
GHLGARLFSIIAWRTYLVRDPHALSLLDA

SEQ ID NO: 1516709 - protein, 28 aa, Mycobacterium tuberculosis
GHNYIGTEHILLGLIREGEGVAAQVLVK

SEQ ID NO: 1516710 - protein, 24 aa, Mycobacterium tuberculosis
GHRRKFPAVLRDLSVTRIVVEHRD

SEQ ID NO: 1516711 - protein, 19 aa, Mycobacterium tuberculosis
GIARFDSPDPEAEPDVVGG

SEQ ID NO: 1516712 - protein, 24 aa, Mycobacterium tuberculosis
GIGGAAINILANAGAGGAGGAAGS

SEQ ID NO: 1516713 - protein, 18 aa, Mycobacterium tuberculosis
GIHALLPESSRRAYDVRP

SEQ ID NO: 1516714 - protein, 33 aa, Mycobacterium tuberculosis
GIPPPNSALVSWLPFYHDMGLVIGICAPILGGY

SEQ ID NO: 1516715 - protein, 19 aa, Mycobacterium tuberculosis
GISHPASIAALRRGRGALV

SEQ ID NO: 1516716 - protein, 26 aa, Mycobacterium tuberculosis
GKGADPGGLFPIPGAGGKGGTGGTGG

SEQ ID NO: 1516717 - protein, 21 aa, Mycobacterium tuberculosis
GLAEYFVHRTGHGIGLCVHEE

SEQ ID NO: 1516718 - protein, 19 aa, Mycobacterium tuberculosis
GLCIVLPGPFQRFAERRRA

SEQ ID NO: 1516719 - protein, 24 aa, Mycobacterium tuberculosis
GLERIGLRFVLEIRVPAGVDGRIM

SEQ ID NO: 1516720 - protein, 28 aa, Mycobacterium tuberculosis
GLIKAILSLRHGVVPPLLHFNRLPDELS

SEQ ID NO: 1516721 - protein, 24 aa, Mycobacterium tuberculosis
GLLDLSSLWQIYAVDRPTLKDRTF

SEQ ID NO: 1516722 - protein, 23 aa, Mycobacterium tuberculosis
GLLSTFIAALMGAEADALCGAGY

SEQ ID NO: 1516723 - protein, 24 aa, Mycobacterium tuberculosis
GLMLPRRAFLPPPHVDSAVLVVRR

SEQ ID NO: 1516724 - protein, 17 aa, Mycobacterium tuberculosis
GLPLAQELSAYLRSLDP

SEQ ID NO: 1516725 - protein, 23 aa, Mycobacterium tuberculosis
GMNRIRLSTTVDAALLTSARDMR

SEQ ID NO: 1516726 - protein, 22 aa, Mycobacterium tuberculosis
GNAGVIANGSFAPSFVGFGGNG

SEQ ID NO: 1516727 - protein, 20 aa, Mycobacterium tuberculosis
GNAQAYQALSAQAAAFHQQF

SEQ ID NO: 1516728 - protein, 22 aa, Mycobacterium tuberculosis
GNEKVWPFLELAVPAPRGHKVP

SEQ ID NO: 1516729 - protein, 19 aa, Mycobacterium tuberculosis
GNGLLFGAGGTGGAGTLGA

SEQ ID NO: 1516730 - protein, 23 aa, Mycobacterium tuberculosis
GPADLLQHFASVRSNPPIGPACG

SEQ ID NO: 1516731 - protein, 24 aa, Mycobacterium tuberculosis
GPELAPADLAYTLARRRGHRPVRT

SEQ ID NO: 1516732 - protein, 26 aa, Mycobacterium tuberculosis
GPGGLAGNLFGQNGIQGVGGSGGKGG

SEQ ID NO: 1516733 - protein, 24 aa, Mycobacterium tuberculosis
GPIVIPDTTILPPLHLQITGDADY

SEQ ID NO: 1516734 - protein, 28 aa, Mycobacterium tuberculosis
GPLTTPPITIPAIPLGIDVSGRLGPINI

SEQ ID NO: 1516735 - protein, 25 aa, Mycobacterium tuberculosis
GPLTTPPITIPSIPLGIDVSGSLGP

SEQ ID NO: 1516736 - protein, 17 aa, Mycobacterium tuberculosis
GPSTLVRAGAQAFLVDC

SEQ ID NO: 1516737 - protein, 24 aa, Mycobacterium tuberculosis
GQAGGNGGWLWGNGGNGGSGAPGQ

SEQ ID NO: 1516738 - protein, 21 aa, Mycobacterium tuberculosis
GQGALVVLIARDDPLDTYLVH

SEQ ID NO: 1516739 - protein, 32 aa, Mycobacterium tuberculosis
GQGIPARPVIIGPITFLLLSKAVDGAGAPIER

SEQ ID NO: 1516740 - protein, 21 aa, Mycobacterium tuberculosis
GQGVFDCGHRGGFEGAESLHE

SEQ ID NO: 1516741 - protein, 19 aa, Mycobacterium tuberculosis
GQMGAANLGILNLGSLNPG

SEQ ID NO: 1516742 - protein, 24 aa, Mycobacterium tuberculosis
GQVPYLLTLPGHGFYWFQLTTHEV

SEQ ID NO: 1516743 - protein, 18 aa, Mycobacterium tuberculosis
GRAFSFISAIDSIGAVPP

SEQ ID NO: 1516744 - protein, 24 aa, Mycobacterium tuberculosis
GRAGYRLLYSVRQYALEKLSESGE

SEQ ID NO: 1516745 - protein, 24 aa, Mycobacterium tuberculosis
GRGANVFFMLGGQRLDLSSLQKVK

SEQ ID NO: 1516746 - protein, 18 aa, Mycobacterium tuberculosis
GRKICRVERFTLLEHGFV

SEQ ID NO: 1516747 - protein, 18 aa, Mycobacterium tuberculosis
GRLTLVEGAGGLLVELAE

SEQ ID NO: 1516748 - protein, 19 aa, Mycobacterium tuberculosis
GRPPLMFRAVRRTDSTGTR

SEQ ID NO: 1516749 - protein, 25 aa, Mycobacterium tuberculosis
GRSVTWLACDVPSLGWRVYRLVPAD

SEQ ID NO: 1516750 - protein, 24 aa, Mycobacterium tuberculosis
GRTERFWVGLSVYRPGGTAEPAPT

SEQ ID NO: 1516751 - protein, 17 aa, Mycobacterium tuberculosis
GRWQADAVILAVPAPRL

SEQ ID NO: 1516752 - protein, 26 aa, Mycobacterium tuberculosis
GSASILPITWAYIRMMGAEGLRAASL

SEQ ID NO: 1516753 - protein, 23 aa, Mycobacterium tuberculosis
GSDMGEFYMPYPGTRINQETVSL

SEQ ID NO: 1516754 - protein, 20 aa, Mycobacterium tuberculosis
GSGQRRWRRSPPTGRYRSNS

SEQ ID NO: 1516755 - protein, 18 aa, Mycobacterium tuberculosis
GSPYSFLPQLNPGDIVAG

SEQ ID NO: 1516756 - protein, 24 aa, Mycobacterium tuberculosis
GSQGIRLHAPLPAAGKLSVVTEVA

SEQ ID NO: 1516757 - protein, 22 aa, Mycobacterium tuberculosis
GSQWLGMGMGLHAGYPVFAEAF

SEQ ID NO: 1516758 - protein, 25 aa, Mycobacterium tuberculosis
GSTAARLFYAYAEILLALGRGDEAL

SEQ ID NO: 1516759 - protein, 44 aa, Mycobacterium tuberculosis
GSYSNGFLVSGDYQGLIGLPLLGIPVTPGYFNLTGGPSSGFFNS

SEQ ID NO: 1516760 - protein, 24 aa, Mycobacterium tuberculosis
GSYSNGILWRGDYQGLIGYSDTLS

SEQ ID NO: 1516761 - protein, 29 aa, Mycobacterium tuberculosis
GTAPGQPGGAGGLLFGNGGNGAAGAVGQV

SEQ ID NO: 1516762 - protein, 27 aa, Mycobacterium tuberculosis
GTGGSGGFGAPPPRSIGGGDGGDGGRG

SEQ ID NO: 1516763 - protein, 25 aa, Mycobacterium tuberculosis
GTGVSHRLVLIDDPILRVPQLAIHL

SEQ ID NO: 1516764 - protein, 27 aa, Mycobacterium tuberculosis
GTIEMADWWAYLNGVRKTYPLSYGPQS

SEQ ID NO: 1516765 - protein, 17 aa, Mycobacterium tuberculosis
GTLLPMSDVIRLASHAN

SEQ ID NO: 1516766 - protein, 23 aa, Mycobacterium tuberculosis
GTPLALYHTKRLASPAQRIMLFA

SEQ ID NO: 1516767 - protein, 21 aa, Mycobacterium tuberculosis
GTRLYPITMGISKQLLPVYDK

SEQ ID NO: 1516768 - protein, 17 aa, Mycobacterium tuberculosis
GTSIETLIQCGWFQIRI

SEQ ID NO: 1516769 - protein, 17 aa, Mycobacterium tuberculosis
GTVYRHFPTKEALFQAV

SEQ ID NO: 1516770 - protein, 22 aa, Mycobacterium tuberculosis
GTWITLVNRAIWIPAGCWHQHK

SEQ ID NO: 1516771 - protein, 28 aa, Mycobacterium tuberculosis
GVAASIGAYLWVPDILECLASVMADAGS

SEQ ID NO: 1516772 - protein, 28 aa, Mycobacterium tuberculosis
GVAPGTAYRWFRAGLLSVMARRVGRLIL

SEQ ID NO: 1516773 - protein, 17 aa, Mycobacterium tuberculosis
GVEEARRRQLGRVAKAR

SEQ ID NO: 1516774 - protein, 28 aa, Mycobacterium tuberculosis
GVLVVQRMLASRFTPLALFGTDRRLAEL

SEQ ID NO: 1516775 - protein, 20 aa, Mycobacterium tuberculosis
GVRVGVETALLGRFFERFAD

SEQ ID NO: 1516776 - protein, 20 aa, Mycobacterium tuberculosis
GVSMQALLARAYRMGLVSAE

SEQ ID NO: 1516777 - protein, 19 aa, Mycobacterium tuberculosis
GVTLMEFHLMYAAVVGGHA

SEQ ID NO: 1516778 - protein, 18 aa, Mycobacterium tuberculosis
GVVLFPGAGFVELVIRAG

SEQ ID NO: 1516779 - protein, 27 aa, Mycobacterium tuberculosis
GVWELFWPDFPCDGLYKFRVHGADGVV

SEQ ID NO: 1516780 - protein, 18 aa, Mycobacterium tuberculosis
GWCVQAFRFTLNPTQTQA

SEQ ID NO: 1516781 - protein, 24 aa, Mycobacterium tuberculosis
GYFHVELMSIRRSATKLKYLAAAE

SEQ ID NO: 1516782 - protein, 36 aa, Mycobacterium tuberculosis
GYGDLYLNRDCGIGKFIWERVVEELKLEVNVERIEL

SEQ ID NO: 1516783 - protein, 17 aa, Mycobacterium tuberculosis
GYPPPYEQRPPVSPGPA

SEQ ID NO: 1516784 - protein, 17 aa, Mycobacterium tuberculosis
HAATLLPFIGRLLAARY

SEQ ID NO: 1516785 - protein, 19 aa, Mycobacterium tuberculosis
HAHLRYLNPFPANLGEVLR

SEQ ID NO: 1516786 - protein, 18 aa, Mycobacterium tuberculosis
HAQAYQALSAQAAAFHQQ

SEQ ID NO: 1516787 - protein, 28 aa, Mycobacterium tuberculosis
HAQRPGDPTLRRLLPDFYRPDDLDDDDP

SEQ ID NO: 1516788 - protein, 27 aa, Mycobacterium tuberculosis
HCEPPYAPLWIAKTLYCSATVVKAAIL

SEQ ID NO: 1516789 - protein, 23 aa, Mycobacterium tuberculosis
HDHVIQRLFAVGLTLQGAAPRAR

SEQ ID NO: 1516790 - protein, 24 aa, Mycobacterium tuberculosis
HDPAGLCDVKAVWRSGTQVPLQAS

SEQ ID NO: 1516791 - protein, 33 aa, Mycobacterium tuberculosis
HDRAYSGYIPILGAPWLADLVRRSPWGEMFASP

SEQ ID NO: 1516792 - protein, 37 aa, Mycobacterium tuberculosis; identical to SEQ ID NO: 236492

SEQ ID NO: 1516793 - protein, 20 aa, Mycobacterium tuberculosis
HGNLGFANLGLTAGAAGVGN

SEQ ID NO: 1516794 - protein, 17 aa, Mycobacterium tuberculosis
HGPRLRDMDARHGGSII

SEQ ID NO: 1516795 - protein, 34 aa, Mycobacterium tuberculosis; identical to SEQ ID NO: 115115

SEQ ID NO: 1516796 - protein, 27 aa, Mycobacterium tuberculosis
HIKDAQTPTLLFPFAAPRVVGDLSEAG

SEQ ID NO: 1516797 - protein, 22 aa, Mycobacterium tuberculosis
HKRTKRQPAIAAGLNAPRRNRV

SEQ ID NO: 1516798 - protein, 18 aa, Mycobacterium tuberculosis
HLDLPDVLECLAGLASDA

SEQ ID NO: 1516799 - protein, 17 aa, Mycobacterium tuberculosis
HLFGPNRRPTGQRGFFA

SEQ ID NO: 1516800 - protein, 26 aa, Mycobacterium tuberculosis
HLHQGIALQVPPYNYAHPDDLLAAAL

SEQ ID NO: 1516801 - protein, 26 aa, Mycobacterium tuberculosis
HPASVGFPLHHPPMRTFLGVPVRIRD

SEQ ID NO: 1516802 - protein, 18 aa, Mycobacterium tuberculosis
HRGAVPLGSGGDAAGKVE

SEQ ID NO: 1516803 - protein, 24 aa, Mycobacterium tuberculosis
HRKRIGELWARFSAVAADNPHAWI

SEQ ID NO: 1516804 - protein, 24 aa, Mycobacterium tuberculosis
HRTGKPHGWIHDERRRRCGGPPIA

SEQ ID NO: 1516805 - protein, 26 aa, Mycobacterium tuberculosis
HSAHLPYYRLVALRETSPRIHELIRE

SEQ ID NO: 1516806 - protein, 17 aa, Mycobacterium tuberculosis
HTALRRSPHSERLFCIP

SEQ ID NO: 1516807 - protein, 33 aa, Mycobacterium tuberculosis
HTLDQALTLLDLLGNPALWSNSLHWAGVHAGIL

SEQ ID NO: 1516808 - protein, 24 aa, Mycobacterium tuberculosis
HVFRRAFSWLPAQFASQSDAPVGA

SEQ ID NO: 1516809 - protein, 23 aa, Mycobacterium tuberculosis
HYDQHLTLQGLRLVFERNLEVQR

SEQ ID NO: 1516810 - protein, 30 aa, Mycobacterium tuberculosis
IACGAIELGIKWLSLYAFSTENWKRSPEEV

SEQ ID NO: 1516811 - protein, 28 aa, Mycobacterium tuberculosis
IAIGGLYGDITYPVTSPLAITMGFAACE

SEQ ID NO: 1516812 - protein, 28 aa, Mycobacterium tuberculosis
IANGGITMRPYLVGSLKGPDLANISTTV

SEQ ID NO: 1516813 - protein, 18 aa, Mycobacterium tuberculosis
IARFRDAFASDLAAHHRL

SEQ ID NO: 1516814 - protein, 26 aa, Mycobacterium tuberculosis
IARPDLQVVLLDPLLRRTEFLREMVT

SEQ ID NO: 1516815 - protein, 18 aa, Mycobacterium tuberculosis
ICDHVRLEILYSANSATD

SEQ ID NO: 1516816 - protein, 22 aa, Mycobacterium tuberculosis
ICEDPRFSIARLSLLDRGMVFV

SEQ ID NO: 1516817 - protein, 18 aa, Mycobacterium tuberculosis
IDAITLFPGGLTFPANSL

SEQ ID NO: 1516818 - protein, 24 aa, Mycobacterium tuberculosis
IDIGRLRWQFERIARGVPVAAPWD

SEQ ID NO: 1516819 - protein, 24 aa, Mycobacterium tuberculosis
IDPFSLTLLGFINVNVPAIQTAPS

SEQ ID NO: 1516820 - protein, 24 aa, Mycobacterium tuberculosis
IDSSDEWIYTRTGIKTRRFAADDE

SEQ ID NO: 1516821 - protein, 26 aa, Mycobacterium tuberculosis
IFPGGFTIDPLPLSLALNISVPDSSV

SEQ ID NO: 1516822 - protein, 18 aa, Mycobacterium tuberculosis
IGDIPIPIIDVPAVPGFG

SEQ ID NO: 1516823 - protein, 27 aa, Mycobacterium tuberculosis
IGPLTTPPITIPAIPLGIDVSGSLGPI

SEQ ID NO: 1516824 - protein, 48 aa, Mycobacterium tuberculosis
IGTDSPGAEASWVVGITWWSAVVGGFQMSFVIAVPETIAAAATDLADL

SEQ ID NO: 1516825 - protein, 25 aa, Mycobacterium tuberculosis
IGYRSLLRTELPPGGRLGLYGFGGS

SEQ ID NO: 1516826 - protein, 27 aa, Mycobacterium tuberculosis
IHAPSLRERLRYRRGQWAHGPKLVEHG

SEQ ID NO: 1516827 - protein, 19 aa, Mycobacterium tuberculosis
IHQTFSLGPLVVPDIVIPA

SEQ ID NO: 1516828 - protein, 19 aa, Mycobacterium tuberculosis
IITGGLGGLGLFLAEKMAA

SEQ ID NO: 1516829 - protein, 22 aa, Mycobacterium tuberculosis
IKSLRRGVFHNSRRLDNGNWVW

SEQ ID NO: 1516830 - protein, 20 aa, Mycobacterium tuberculosis
ILSSILFRTAELRPGEGRTV

SEQ ID NO: 1516831 - protein, 18 aa, Mycobacterium tuberculosis
INVPPITVPAIGLGINST

SEQ ID NO: 1516832 - protein, 26 aa, Mycobacterium tuberculosis
IPDDLLNALIDFLAAVRNGLVPIIEN

SEQ ID NO: 1516833 - protein, 18 aa, Mycobacterium tuberculosis
IPGFPTTVTVFGTPFMGM

SEQ ID NO: 1516834 - protein, 18 aa, Mycobacterium tuberculosis
IPGFSIPEQPLPLAINVI

SEQ ID NO: 1516835 - protein, 23 aa, Mycobacterium tuberculosis
IPGIPLSLNALGGVGPITVPGVP

SEQ ID NO: 1516836 - protein, 17 aa, Mycobacterium tuberculosis
IPLAGLLADAPHGSKQA

SEQ ID NO: 1516837 - protein, 22 aa, Mycobacterium tuberculosis
IPPGTGWRKFVYSVSFHKINPG

SEQ ID NO: 1516838 - protein, 37 aa, Mycobacterium tuberculosis
IPPVPGKFYWMSPTQVRWRPFEFWPANTAVNIDAAGT

SEQ ID NO: 1516839 - protein, 21 aa, Mycobacterium tuberculosis
IPTITTVPWTTDRLLNALMQD

SEQ ID NO: 1516840 - protein, 21 aa, Mycobacterium tuberculosis
IQAYDPVFSPDWRPNGATAAR

SEQ ID NO: 1516841 - protein, 18 aa, Mycobacterium tuberculosis
IRNLVHGIGFQRDVLGAE

SEQ ID NO: 1516842 - protein, 26 aa, Mycobacterium tuberculosis
ISAAIAALFGAHGRAYQAASAEAAAF

SEQ ID NO: 1516843 - protein, 28 aa, Mycobacterium tuberculosis
ISARVITRTLFVVRLLPAIDHFLDLLRK

SEQ ID NO: 1516844 - protein, 17 aa, Mycobacterium tuberculosis
ISMLRRGDPNGAAAGDL

SEQ ID NO: 1516845 - protein, 23 aa, Mycobacterium tuberculosis
ISNIIYEGPGADSLFFAAEQLRL

SEQ ID NO: 1516846 - protein, 17 aa, Mycobacterium tuberculosis
ISPWGTWEWIGPPALGA

SEQ ID NO: 1516847 - protein, 20 aa, Mycobacterium tuberculosis
ISSATWPEPISYTALDRGDL

SEQ ID NO: 1516848 - protein, 21 aa, Mycobacterium tuberculosis
ITIPQLPLGLALSGATPAFAF

SEQ ID NO: 1516849 - protein, 19 aa, Mycobacterium tuberculosis
ITLFPGGLTFPATSLLNLD

SEQ ID NO: 1516850 - protein, 23 aa, Mycobacterium tuberculosis
ITSPTFVLARMHRPRRPGTPAMV

SEQ ID NO: 1516851 - protein, 21 aa, Mycobacterium tuberculosis
ITVPDIGIARFRDAFASDLAA

SEQ ID NO: 1516852 - protein, 24 aa, Mycobacterium tuberculosis
IVDLTVIGLGRYIPRIARVAAATE

SEQ ID NO: 1516853 - protein, 17 aa, Mycobacterium tuberculosis
IVISLILERYALGENMA

SEQ ID NO: 1516854 - protein, 19 aa, Mycobacterium tuberculosis
IVMPARLPNRIHPFVQEIV

SEQ ID NO: 1516855 - protein, 21 aa, Mycobacterium tuberculosis
IVQEAWLRWDSPDTVIADPRA

SEQ ID NO: 1516856 - protein, 23 aa, Mycobacterium tuberculosis
IYAELTRLCRYPLLVVDEVGYIP

SEQ ID NO: 1516857 - protein, 29 aa, Mycobacterium tuberculosis
KAALEPVNPPKPPPAIKIDPPPPPQEQGL

SEQ ID NO: 1516858 - protein, 23 aa, Mycobacterium tuberculosis
KAALWELIWAGRVTGDTFAPVRA

SEQ ID NO: 1516859 - protein, 19 aa, Mycobacterium tuberculosis
KAGRTWWVPNEHKPWPLRA

SEQ ID NO: 1516860 - protein, 20 aa, Mycobacterium tuberculosis
KALAATHQDGSMGAGGAGGN

SEQ ID NO: 1516861 - protein, 17 aa, Mycobacterium tuberculosis
KALASRLATSSTLPIML

SEQ ID NO: 1516862 - protein, 17 aa, Mycobacterium tuberculosis
KATLVRAVCDGRRLVTL

SEQ ID NO: 1516863 - protein, 19 aa, Mycobacterium tuberculosis
KAVAARMACPYLNPGRYVQ

SEQ ID NO: 1516864 - protein, 17 aa, Mycobacterium tuberculosis
KDLLIVYGRNHSPDDIE

SEQ ID NO: 1516865 - protein, 25 aa, Mycobacterium tuberculosis
KEAIAIDPQHRLLLETSWEAMEHGG

SEQ ID NO: 1516866 - protein, 18 aa, Mycobacterium tuberculosis
KEFTLLEALIRRPGIVHT

SEQ ID NO: 1516867 - protein, 21 aa, Mycobacterium tuberculosis
KEPPPPLPPDLPPNVRELIEI

SEQ ID NO: 1516868 - protein, 23 aa, Mycobacterium tuberculosis
KEYLRQRATLIDPKRAMPAATGI

SEQ ID NO: 1516869 - protein, 17 aa, Mycobacterium tuberculosis
KFEGWTPLAQLKVGDRI

SEQ ID NO: 1516870 - protein, 19 aa, Mycobacterium tuberculosis
KGFKSFAAPTTLRFEPGIT

SEQ ID NO: 1516871 - protein, 21 aa, Mycobacterium tuberculosis
KGVLANLSLGLANSGFGQMGA

SEQ ID NO: 1516872 - protein, 26 aa, Mycobacterium tuberculosis
KIGPITGLFNTPIGLTPLALSQIVIG

SEQ ID NO: 1516873 - protein, 17 aa, Mycobacterium tuberculosis
KLPNRWPLTDAAGVPVV

SEQ ID NO: 1516874 - protein, 18 aa, Mycobacterium tuberculosis
KLWESLLRGDDLVTEIPP

SEQ ID NO: 1516875 - protein, 27 aa, Mycobacterium tuberculosis
KNDWTYPKWAKQVIRVLIAIENAIWPD

SEQ ID NO: 1516876 - protein, 26 aa, Mycobacterium tuberculosis
KPLQNLAGLPAWLASGAPAAAMTAAA

SEQ ID NO: 1516877 - protein, 21 aa, Mycobacterium tuberculosis
KQWGLEYLFGVLEAGRAGVFR

SEQ ID NO: 1516878 - protein, 17 aa, Mycobacterium tuberculosis
KRQFRRAILDHQAGTVI

SEQ ID NO: 1516879 - protein, 25 aa, Mycobacterium tuberculosis
KSARPATVWIAQDGSHHLVRASIDL

SEQ ID NO: 1516880 - protein, 25 aa, Mycobacterium tuberculosis
KSGFGGFGGLLLGADGYNAPESTSP

SEQ ID NO: 1516881 - protein, 24 aa, Mycobacterium tuberculosis
KTLTCVLPAYLNALAGNGVHIVTV

SEQ ID NO: 1516882 - protein, 17 aa, Mycobacterium tuberculosis
KTVFVFPGQGSQWLGMG

SEQ ID NO: 1516883 - protein, 19 aa, Mycobacterium tuberculosis
KYFLDMGWEDIMLAVEYDG

SEQ ID NO: 1516884 - protein, 25 aa, Mycobacterium tuberculosis
LAAALADPLVLDAVLFEGGAFAEFL

SEQ ID NO: 1516885 - protein, 17 aa, Mycobacterium tuberculosis
LAAFTKSGGRLVESVSA

SEQ ID NO: 1516886 - protein, 20 aa, Mycobacterium tuberculosis
LAAQLAVYLAPPGYGEMFSA

SEQ ID NO: 1516887 - protein, 20 aa, Mycobacterium tuberculosis
LAAQLRSYWARPLPATIVMR

SEQ ID NO: 1516888 - protein, 20 aa, Mycobacterium tuberculosis
LAARGLRRILTEGGPTLLGT

SEQ ID NO: 1516889 - protein, 27 aa, Mycobacterium tuberculosis
LAAVNAPTQALFGRPLIGNGADGSPGT

SEQ ID NO: 1516890 - protein, 19 aa, Mycobacterium tuberculosis
LAGAKILRQYGNGPLPGVA

SEQ ID NO: 1516891 - protein, 25 aa, Mycobacterium tuberculosis
LAGKSVWFQRGPLDAAIRASIAIPG

SEQ ID NO: 1516892 - protein, 17 aa, Mycobacterium tuberculosis
LAGLLADAPHGSKQANT

SEQ ID NO: 1516893 - protein, 17 aa, Mycobacterium tuberculosis
LAGWLQNGPTETTFSVG

SEQ ID NO: 1516894 - protein, 17 aa, Mycobacterium tuberculosis
LAIFDRGKALALYHTKR

SEQ ID NO: 1516895 - protein, 17 aa, Mycobacterium tuberculosis
LALIALSAKMRIDQIEE

SEQ ID NO: 1516896 - protein, 18 aa, Mycobacterium tuberculosis
LARGGLPVAWEVAAALHA

SEQ ID NO: 1516897 - protein, 17 aa, Mycobacterium tuberculosis
LARIAMVRAALPAGAAS

SEQ ID NO: 1516898 - protein, 17 aa, Mycobacterium tuberculosis
LARLEARIVLRLLLDRT

SEQ ID NO: 1516899 - protein, 19 aa, Mycobacterium tuberculosis
LCATVQWSHALLSGPERAL

SEQ ID NO: 1516900 - protein, 20 aa, Mycobacterium tuberculosis
LDCADLGHLVFLPSGDAALT

SEQ ID NO: 1516901 - protein, 24 aa, Mycobacterium tuberculosis
LDELTLAAPLLLPATGSVAVQVVV

SEQ ID NO: 1516902 - protein, 22 aa, Mycobacterium tuberculosis
LDGAALHQYLVLRGGIRAEESA

SEQ ID NO: 1516903 - protein, 26 aa, Mycobacterium tuberculosis
LDLLNAPTQALLGRPLVGNGANGAPG

SEQ ID NO: 1516904 - protein, 21 aa, Mycobacterium tuberculosis
LDRVRVVVIDGAALRGDNRAV

SEQ ID NO: 1516905 - protein, 25 aa, Mycobacterium tuberculosis
LDTQPRPLVIVHGPLFQAVKAARAQ

SEQ ID NO: 1516906 - protein, 27 aa, Mycobacterium tuberculosis
LDVVNGPTQLLLGRPLIGDGANGGPGQ

SEQ ID NO: 1516907 - protein, 30 aa, Mycobacterium tuberculosis
LDYDDYVYPGHAIWWLARGLEFFQDGEQFG

SEQ ID NO: 1516908 - protein, 40 aa, Mycobacterium tuberculosis
LEHVWALMGMPCGKYLVVMLELWLPLEAAAGDLDKPFATE

SEQ ID NO: 1516909 - protein, 17 aa, Mycobacterium tuberculosis
LERLVFVEPPDAAARRE

SEQ ID NO: 1516910 - protein, 25 aa, Mycobacterium tuberculosis
LESLRYDLAVQEIFVFTPKGDVITL

SEQ ID NO: 1516911 - protein, 30 aa, Mycobacterium tuberculosis; identical to SEQ ID NO: 220047

SEQ ID NO: 1516912 - protein, 17 aa, Mycobacterium tuberculosis
LFGAHGRAYQAASAEAA

SEQ ID NO: 1516913 - protein, 17 aa, Mycobacterium tuberculosis
LGAINAPAAALSGRPFI

SEQ ID NO: 1516914 - protein, 24 aa, Mycobacterium tuberculosis
LGAVQVPQLLRDAGFRLTTMREHY

SEQ ID NO: 1516915 - protein, 20 aa, Mycobacterium tuberculosis
LGFGRYLVSATTPFTRDDLT

SEQ ID NO: 1516916 - protein, 24 aa, Mycobacterium tuberculosis
LGGGSFGLPGLNGSGGDGGDGGNG

SEQ ID NO: 1516917 - protein, 22 aa, Mycobacterium tuberculosis
LGGIRDLWLDLGALTELLRDPR

SEQ ID NO: 1516918 - protein, 21 aa, Mycobacterium tuberculosis
LGGLALKWRWRQRVGSWKGRM

SEQ ID NO: 1516919 - protein, 20 aa, Mycobacterium tuberculosis
LGGVLYLFVRGMCGAATPVT

SEQ ID NO: 1516920 - protein, 17 aa, Mycobacterium tuberculosis
LGHRKGRIAPGYDADLL

SEQ ID NO: 1516921 - protein, 17 aa, Mycobacterium tuberculosis
LGIPTITTVPWTTDRLL

SEQ ID NO: 1516922 - protein, 27 aa, Mycobacterium tuberculosis
LGLINGPAQTLLGRPLIGNGADGAPGT

SEQ ID NO: 1516923 - protein, 17 aa, Mycobacterium tuberculosis
LGPILVSTSGTRRGDRV

SEQ ID NO: 1516924 - protein, 17 aa, Mycobacterium tuberculosis
LGPINAGLVIPPVPGFG

SEQ ID NO: 1516925 - protein, 19 aa, Mycobacterium tuberculosis
LGPLVVPDIVIPAFGGGTA

SEQ ID NO: 1516926 - protein, 19 aa, Mycobacterium tuberculosis
LGRTPLVVWPAGPGTRRQP

SEQ ID NO: 1516927 - protein, 18 aa, Mycobacterium tuberculosis
LGVPLFQEQLMQLAVDCA

SEQ ID NO: 1516928 - protein, 20 aa, Mycobacterium tuberculosis
LHALGPQWVLVKGGHLRSSD

SEQ ID NO: 1516929 - protein, 21 aa, Mycobacterium tuberculosis
LHLGQVLRTPESWLLIDFEGE

SEQ ID NO: 1516930 - protein, 31 aa, Mycobacterium tuberculosis; identical to SEQ ID NO: 225292

SEQ ID NO: 1516931 - protein, 25 aa, Mycobacterium tuberculosis
LKAALWELIWAGRVTGDTFAPVRAV

SEQ ID NO: 1516932 - protein, 24 aa, Mycobacterium tuberculosis
LKGLVRVLAFEHPDMRTTLVDLDI

SEQ ID NO: 1516933 - protein, 23 aa, Mycobacterium tuberculosis
LKPRVFYDLVVEVALIRPGPIQG

SEQ ID NO: 1516934 - protein, 34 aa, Mycobacterium tuberculosis
LLAGERPYREFPLDWMLGRLGLAGFRILEARRFP

SEQ ID NO: 1516935 - protein, 24 aa, Mycobacterium tuberculosis
LLCTACFDGKYPIELPRETALGKN

SEQ ID NO: 1516936 - protein, 20 aa, Mycobacterium tuberculosis
LLGRDGFNAPASTPLHTLQQ

SEQ ID NO: 1516937 - protein, 18 aa, Mycobacterium tuberculosis
LLLRLRFELDHHINLRPA

SEQ ID NO: 1516938 - protein, 29 aa, Mycobacterium tuberculosis
LLSSDELIGLLARLGYRFAPTQIPGTVDY

SEQ ID NO: 1516939 - protein, 27 aa, Mycobacterium tuberculosis
LLTHLHGDVLITSWVTNFAADPAPLPI

SEQ ID NO: 1516940 - protein, 20 aa, Mycobacterium tuberculosis
LLVNLDKAKAAPLWRVLVAL

SEQ ID NO: 1516941 - protein, 26 aa, Mycobacterium tuberculosis
LMCSAATMYTPERVTFFCIGGATMAQ

SEQ ID NO: 1516942 - protein, 20 aa, Mycobacterium tuberculosis
LMTLTTLYPPVAAVVSLWTQ

SEQ ID NO: 1516943 - protein, 20 aa, Mycobacterium tuberculosis
LNAALHRIALTQIRMTDSRG

SEQ ID NO: 1516944 - protein, 19 aa, Mycobacterium tuberculosis
LNALQFVGGMLWSTALAEA

SEQ ID NO: 1516945 - protein, 26 aa, Mycobacterium tuberculosis
LNATLRYLMFSVFLVSPGALGDQRDA

SEQ ID NO: 1516946 - protein, 24 aa, Mycobacterium tuberculosis
LNETRTGDLWLFRGRSRPDRAIQT

SEQ ID NO: 1516947 - protein, 19 aa, Mycobacterium tuberculosis
LPAIYVPLPIGNGEQRLNA

SEQ ID NO: 1516948 - protein, 20 aa, Mycobacterium tuberculosis
LPAVLAAIPAGYRALVVDNN

SEQ ID NO: 1516949 - protein, 19 aa, Mycobacterium tuberculosis
LPELAVQMRRRLIETVTAT

SEQ ID NO: 1516950 - protein, 20 aa, Mycobacterium tuberculosis
LPSGWMVTAAKFEVEWPADP

SEQ ID NO: 1516951 - protein, 18 aa, Mycobacterium tuberculosis
LPTLSIPSVTVPPITIPA

SEQ ID NO: 1516952 - protein, 18 aa, Mycobacterium tuberculosis
LPTMPPWHVQENKWRAAR

SEQ ID NO: 1516953 - protein, 38 aa, Mycobacterium tuberculosis; identical to SEQ ID NO: 835539

SEQ ID NO: 1516954 - protein, 17 aa, Mycobacterium tuberculosis
LPVIPLSLDINGGVGAI

SEQ ID NO: 1516955 - protein, 38 aa, Mycobacterium tuberculosis
LPVSLTIPGFTIPGGTLIPTLPLGLALSNGIPPVDIPA

SEQ ID NO: 1516956 - protein, 20 aa, Mycobacterium tuberculosis
LQWGCFRFGIVQGCDHFTFF

SEQ ID NO: 1516957 - protein, 27 aa, Mycobacterium tuberculosis
LRASIDPFGWYRSWEEMLTGMAPLAGL

SEQ ID NO: 1516958 - protein, 31 aa, Mycobacterium tuberculosis
LRMTMAPVQRTWPELIPLLQSGRLDVDGIFT

SEQ ID NO: 1516959 - protein, 17 aa, Mycobacterium tuberculosis
LRRILTEGGPTLLGTFV

SEQ ID NO: 1516960 - protein, 20 aa, Mycobacterium tuberculosis
LRRRCPVHVVDWHNVAGLTP

SEQ ID NO: 1516961 - protein, 29 aa, Mycobacterium tuberculosis
LRVLNPVVPQLFHRLPPLACVSARRFRCR

SEQ ID NO: 1516962 - protein, 17 aa, Mycobacterium tuberculosis
LRYSAYTGGPDPLAPPV

SEQ ID NO: 1516963 - protein, 25 aa, Mycobacterium tuberculosis
LSAQAALFHEQFVRALTAGAGSYAA

SEQ ID NO: 1516964 - protein, 17 aa, Mycobacterium tuberculosis
LSGGYSLPAIPLGIDVG

SEQ ID NO: 1516965 - protein, 27 aa, Mycobacterium tuberculosis
LSKLVRHHLLLPITATRRDLNDPKTIE

SEQ ID NO: 1516966 - protein, 22 aa, Mycobacterium tuberculosis
LSPIDYRQYVLPHSARVFAALG

SEQ ID NO: 1516967 - protein, 21 aa, Mycobacterium tuberculosis
LSTRKGFWPSVYRSASSGSCS

SEQ ID NO: 1516968 - protein, 19 aa, Mycobacterium tuberculosis
LSVPASWSTAAPATAAGAA

SEQ ID NO: 1516969 - protein, 26 aa, Mycobacterium tuberculosis
LSVPTRRGNWWYYARTFEGKQYGVHC

SEQ ID NO: 1516970 - protein, 22 aa, Mycobacterium tuberculosis
LSVRDMTVCTLDRPRHAQLIHD

SEQ ID NO: 1516971 - protein, 20 aa, Mycobacterium tuberculosis
LTCRLIDRPLRPSFVDGLRN

SEQ ID NO: 1516972 - protein, 21 aa, Mycobacterium tuberculosis
LTGQAWQGPASAAMAAAAAPY

SEQ ID NO: 1516973 - protein, 19 aa, Mycobacterium tuberculosis
LTSATLGGLALPLQQTIDA

SEQ ID NO: 1516974 - protein, 28 aa, Mycobacterium tuberculosis
LTVRHLEVIALTPARLLMVVITDSGRVD

SEQ ID NO: 1516975 - protein, 22 aa, Mycobacterium tuberculosis
LTYQMMFELRDLGFSTAIGIGG

SEQ ID NO: 1516976 - protein, 25 aa, Mycobacterium tuberculosis
LVELFTAEAIWEMPPYTDWYQGAQA

SEQ ID NO: 1516977 - protein, 20 aa, Mycobacterium tuberculosis
LVLPALLAQRGIGGRDAAFA

SEQ ID NO: 1516978 - protein, 17 aa, Mycobacterium tuberculosis
LVMAYEETLLRVVPPAT

SEQ ID NO: 1516979 - protein, 22 aa, Mycobacterium tuberculosis
LVPADFIGFAQPLDDLPTAEGT

SEQ ID NO: 1516980 - protein, 23 aa, Mycobacterium tuberculosis
LVSKEIIYFLAQLDVKEIHGYNP

SEQ ID NO: 1516981 - protein, 19 aa, Mycobacterium tuberculosis
LVSLVFSNFFGQNAPAIAA

SEQ ID NO: 1516982 - protein, 22 aa, Mycobacterium tuberculosis
LVTPTPIPLTLNLDTTPWTLFP

SEQ ID NO: 1516983 - protein, 19 aa, Mycobacterium tuberculosis
LVVWPAGPGTRRQPGIGGQ

SEQ ID NO: 1516984 - protein, 18 aa, Mycobacterium tuberculosis
LYETFTFNGGQYAFPEQW

SEQ ID NO: 1516985 - protein, 18 aa, Mycobacterium tuberculosis
MAALRRWARDRGLNPSET

SEQ ID NO: 1516986 - protein, 21 aa, Mycobacterium tuberculosis
MAGWYFTKWQRVLNDGLDAVM

SEQ ID NO: 1516987 - protein, 17 aa, Mycobacterium tuberculosis
MDAAWALYEAYIKLLTG

SEQ ID NO: 1516988 - protein, 38 aa, Mycobacterium tuberculosis; identical to SEQ ID NO: 220635

SEQ ID NO: 1516989 - protein, 18 aa, Mycobacterium tuberculosis
MDPQQRLLLEVSWEALER

SEQ ID NO: 1516990 - protein, 27 aa, Mycobacterium tuberculosis
MELALRVALGVIRLLLGADYAPLAVHL

SEQ ID NO: 1516991 - protein, 21 aa, Mycobacterium tuberculosis
MFAPGAFRRSIAERGHKLKLL

SEQ ID NO: 1516992 - protein, 18 aa, Mycobacterium tuberculosis
MFAQIYDLERDPPPRSTP

SEQ ID NO: 1516993 - protein, 24 aa, Mycobacterium tuberculosis
MFMISHFHYDPVWWNTQGAYTSQW

SEQ ID NO: 1516994 - protein, 17 aa, Mycobacterium tuberculosis
MGIRVRYLHSEVDTLRR

SEQ ID NO: 1516995 - protein, 24 aa, Mycobacterium tuberculosis
MIAAAAGELASIRSAINAANAAAA

SEQ ID NO: 1516996 - protein, 27 aa, Mycobacterium tuberculosis
MIDDISQLVYLHLRFHGYGDGKWTDSA

SEQ ID NO: 1516997 - protein, 18 aa, Mycobacterium tuberculosis
MPALVPWNQSRLSATLTR

SEQ ID NO: 1516998 - protein, 19 aa, Mycobacterium tuberculosis
MQQKLVEFAEAGFPGLAVA

SEQ ID NO: 1516999 - protein, 17 aa, Mycobacterium tuberculosis
MQVLSRRTKNNPVLIGE

SEQ ID NO: 1517000 - protein, 26 aa, Mycobacterium tuberculosis
MRSGERPMVWSLDERLRMVARPMINV

SEQ ID NO: 1517001 - protein, 23 aa, Mycobacterium tuberculosis
MVLRPITGAIPPDGPWGIWASRR

SEQ ID NO: 1517002 - protein, 17 aa, Mycobacterium tuberculosis
MVSLGYSLLYKNIIGAI

SEQ ID NO: 1517003 - protein, 27 aa, Mycobacterium tuberculosis
NAATHRFIAHLPGYQGWQWAVVVASYS

SEQ ID NO: 1517004 - protein, 17 aa, Mycobacterium tuberculosis
NAGLFGNGGAGGAGGAG

SEQ ID NO: 1517005 - protein, 17 aa, Mycobacterium tuberculosis
NAGLWGNGGAGGAGAAG

SEQ ID NO: 1517006 - protein, 23 aa, Mycobacterium tuberculosis
NAGTLNVGFANAGSINTGFANSG

SEQ ID NO: 1517007 - protein, 17 aa, Mycobacterium tuberculosis
NAITETLDLSPQALELT

SEQ ID NO: 1517008 - protein, 29 aa, Mycobacterium tuberculosis
NASIPTPQPVLPRPMFGAAAATAAATSVH

SEQ ID NO: 1517009 - protein, 19 aa, Mycobacterium tuberculosis
NFGGGASGFWNLASATSGL

SEQ ID NO: 1517010 - protein, 24 aa, Mycobacterium tuberculosis
NFSNGVLWRGDYEGLWGLSGGSTI

SEQ ID NO: 1517011 - protein, 20 aa, Mycobacterium tuberculosis
NFYALDRLWGDCPVVPVDLS

SEQ ID NO: 1517012 - protein, 21 aa, Mycobacterium tuberculosis
NGAAGGAGWSPDSDLKGFDGF

SEQ ID NO: 1517013 - protein, 22 aa, Mycobacterium tuberculosis
NGGAIFNAGTPGAAGTGGDGGV

SEQ ID NO: 1517014 - protein, 23 aa, Mycobacterium tuberculosis
NGGRAGLLLGVGGMGGNGGATSV

SEQ ID NO: 1517015 - protein, 24 aa, Mycobacterium tuberculosis
NGIDAARWPFAARRPRTGPAELLY

SEQ ID NO: 1517016 - protein, 21 aa, Mycobacterium tuberculosis
NGVAFFGPVLSKIPRGEEAGK

SEQ ID NO: 1517017 - protein, 44 aa, Mycobacterium tuberculosis
NGVLWRGDYQGLLGFSYRPAVLPQTPFLDLTLTGGLGSVVIPAI

SEQ ID NO: 1517018 - protein, 23 aa, Mycobacterium tuberculosis
NHIARRLFVPPPDPVAVLRELVL

SEQ ID NO: 1517019 - protein, 29 aa, Mycobacterium tuberculosis
NHTFNYLDLVRYLAVGNLNPSPLGYVGGS

SEQ ID NO: 1517020 - protein, 34 aa, Mycobacterium tuberculosis
NINTGGFNPGTLNTGFFSAMTQAGPNSGFFNAGT

SEQ ID NO: 1517021 - protein, 28 aa, Mycobacterium tuberculosis
NIQAMDRYLSWTRFALSKLPRWREPPQI

SEQ ID NO: 1517022 - protein, 24 aa, Mycobacterium tuberculosis
NISVKLFDDWSNLGSISELSTSRV

SEQ ID NO: 1517023 - protein, 17 aa, Mycobacterium tuberculosis
NIVNMLHGVRDGLVRDA

SEQ ID NO: 1517024 - protein, 19 aa, Mycobacterium tuberculosis
NLAGLFLDNTGNLTLNFGV

SEQ ID NO: 1517025 - protein, 23 aa, Mycobacterium tuberculosis
NLAQYPSILVELGNMKNPADSAL

SEQ ID NO: 1517026 - protein, 26 aa, Mycobacterium tuberculosis
NLDRPAYVYPIFEQALRIAYGESIEN

SEQ ID NO: 1517027 - protein, 18 aa, Mycobacterium tuberculosis
NLFVPEVTTPWPTNGRQV

SEQ ID NO: 1517028 - protein, 31 aa, Mycobacterium tuberculosis
NLHRATLGQPLDWFCLFSSGAALLGSPGQGA

SEQ ID NO: 1517029 - protein, 18 aa, Mycobacterium tuberculosis
NLSLYAVDLALLTHSHPH

SEQ ID NO: 1517030 - protein, 18 aa, Mycobacterium tuberculosis
NMGMLFRKHLVMFGPREV

SEQ ID NO: 1517031 - protein, 25 aa, Mycobacterium tuberculosis
NNAGDYGFFWITAVTTDGSIVVANS

SEQ ID NO: 1517032 - protein, 28 aa, Mycobacterium tuberculosis
NNELGHPWTVLRATRRTDYLILEMAARH

SEQ ID NO: 1517033 - protein, 20 aa, Mycobacterium tuberculosis
NNMVLAVQQIAIAEAFVLAE

SEQ ID NO: 1517034 - protein, 25 aa, Mycobacterium tuberculosis
NPLHSDPWFATQLAGFPKPILHGLC

SEQ ID NO: 1517035 - protein, 21 aa, Mycobacterium tuberculosis
NQFVVALRRRGHLDDLEAMRV

SEQ ID NO: 1517036 - protein, 25 aa, Mycobacterium tuberculosis
NRRAALAALLSQLPRSDLETLRKAL

SEQ ID NO: 1517037 - protein, 17 aa, Mycobacterium tuberculosis
NRRISLSSLWVALSIRL

SEQ ID NO: 1517038 - protein, 29 aa, Mycobacterium tuberculosis
NSGNYSNGFFWRGDYQGLIGFSGTLTIPA

SEQ ID NO: 1517039 - protein, 19 aa, Mycobacterium tuberculosis
NVDGYGLAERDCRQFDGVD

SEQ ID NO: 1517040 - protein, 27 aa, Mycobacterium tuberculosis
NVIQPFINWLTNLPFLQAMFSGFDPWL

SEQ ID NO: 1517041 - protein, 18 aa, Mycobacterium tuberculosis
NVVDAYRYWTREAIIADI

SEQ ID NO: 1517042 - protein, 17 aa, Mycobacterium tuberculosis
NWHMLIVTSIGTDARTR

SEQ ID NO: 1517043 - protein, 23 aa, Mycobacterium tuberculosis
NYSNGVLWRGDYQGLIGADIALE

SEQ ID NO: 1517044 - protein, 24 aa, Mycobacterium tuberculosis
NYSNGVLWRGDYQGLIGADIALEI

SEQ ID NO: 1517045 - protein, 22 aa, Mycobacterium tuberculosis
PAAFLNVDIPVNIPITGDITNV

SEQ ID NO: 1517046 - protein, 26 aa, Mycobacterium tuberculosis
PADLVQRRFGPPAPNRLWVADLTYVS

SEQ ID NO: 1517047 - protein, 24 aa, Mycobacterium tuberculosis
PAELACALGLFPPTAEQAAVIAAP

SEQ ID NO: 1517048 - protein, 22 aa, Mycobacterium tuberculosis
PAGFTETVTWWQVHRRAMIVAE

SEQ ID NO: 1517049 - protein, 19 aa, Mycobacterium tuberculosis
PAGPLPAYGSDLRPPVVAA

SEQ ID NO: 1517050 - protein, 23 aa, Mycobacterium tuberculosis
PALLRVRFPWPPFEPDVRLSPYL

SEQ ID NO: 1517051 - protein, 20 aa, Mycobacterium tuberculosis
PALTLFPVGLSIPTGGPLTL

SEQ ID NO: 1517052 - protein, 33 aa, Mycobacterium tuberculosis
PARRVGRPRIRLAYRLTPRRVLGQRRAGGVQFS

SEQ ID NO: 1517053 - protein, 20 aa, Mycobacterium tuberculosis
PASIAALRRGRGALVTQQRG

SEQ ID NO: 1517054 - protein, 24 aa, Mycobacterium tuberculosis
PATNYDVMFVPQSIGADLIATIEG

SEQ ID NO: 1517055 - protein, 36 aa, Mycobacterium tuberculosis
PDGLVANLRRRGDRWYWHWDPQFIGGIAAFPPVEVT

SEQ ID NO: 1517056 - protein, 31 aa, Mycobacterium tuberculosis
PDIGPIIVPSFVLSVPTFAIAVGGPTTAINI

SEQ ID NO: 1517057 - protein, 18 aa, Mycobacterium tuberculosis
PDLLLAQALLRTQHIKLA

SEQ ID NO: 1517058 - protein, 34 aa, Mycobacterium tuberculosis; identical to SEQ ID NO: 226644

SEQ ID NO: 1517059 - protein, 22 aa, Mycobacterium tuberculosis
PDSHDICFIPSGNTKAFLGERI

SEQ ID NO: 1517060 - protein, 21 aa, Mycobacterium tuberculosis
PDSMRAGLQALAWIAHQPEAT

SEQ ID NO: 1517061 - protein, 25 aa, Mycobacterium tuberculosis
PDTTNVVTAWRLLRSVDPHLRTRRV

SEQ ID NO: 1517062 - protein, 25 aa, Mycobacterium tuberculosis
PEHVHTYRITPLALWNARAAGHDAE

SEQ ID NO: 1517063 - protein, 26 aa, Mycobacterium tuberculosis
PEHYQRYLDILRPLGFRPALGFSRVD

SEQ ID NO: 1517064 - protein, 20 aa, Mycobacterium tuberculosis
PEIRPAHLLMALLTQNDGIA

SEQ ID NO: 1517065 - protein, 26 aa, Mycobacterium tuberculosis
PEITIPQLPLGLALSGATPAFAFPLE

SEQ ID NO: 1517066 - protein, 30 aa, Mycobacterium tuberculosis
PESTSPWHNLQQDILSFINEPTEALTGRPL

SEQ ID NO: 1517067 - protein, 19 aa, Mycobacterium tuberculosis
PEYKFVLAEVDYLKPYWDT

SEQ ID NO: 1517068 - protein, 19 aa, Mycobacterium tuberculosis
PFLFTQALLRTSTIATYLR

SEQ ID NO: 1517069 - protein, 17 aa, Mycobacterium tuberculosis
PFVIPATSNVFISTVDF

SEQ ID NO: 1517070 - protein, 17 aa, Mycobacterium tuberculosis
PGAYVAGWIKRGPTGFI

SEQ ID NO: 1517071 - protein, 24 aa, Mycobacterium tuberculosis
PGDALFAFLRSMVLQWGATDRGLV

SEQ ID NO: 1517072 - protein, 17 aa, Mycobacterium tuberculosis
PGFAINPFGLDVPLSGG

SEQ ID NO: 1517073 - protein, 17 aa, Mycobacterium tuberculosis
PGGLTVFDVRVEAMAPF

SEQ ID NO: 1517074 - protein, 20 aa, Mycobacterium tuberculosis
PGGTPGDWGTGGTGGTGGTG

SEQ ID NO: 1517075 - protein, 17 aa, Mycobacterium tuberculosis
PGQMLGGLPVGQMGARA

SEQ ID NO: 1517076 - protein, 26 aa, Mycobacterium tuberculosis
PGRQKIFLYSAIARPGNSGGPIVAQD

SEQ ID NO: 1517077 - protein, 22 aa, Mycobacterium tuberculosis
PGSRIFFPTWHTTTAELPQTST

SEQ ID NO: 1517078 - protein, 27 aa, Mycobacterium tuberculosis
PGTFEGWLHRITTNLFLDMVRRRARIR

SEQ ID NO: 1517079 - protein, 28 aa, Mycobacterium tuberculosis
PGTSIYVLLPGRRMPIPQLPGATAGARS

SEQ ID NO: 1517080 - protein, 17 aa, Mycobacterium tuberculosis
PIADLFQPQLRVLVDLG

SEQ ID NO: 1517081 - protein, 28 aa, Mycobacterium tuberculosis
PIAVEARRLAFQALHRPCNSAEWTAAVA

SEQ ID NO: 1517082 - protein, 20 aa, Mycobacterium tuberculosis
PIRGFGIHPAVLDAALHAWG

SEQ ID NO: 1517083 - protein, 19 aa, Mycobacterium tuberculosis
PKPFALEELLARMRALLRR

SEQ ID NO: 1517084 - protein, 18 aa, Mycobacterium tuberculosis
PLCDNAIEAVWPADPLAA

SEQ ID NO: 1517085 - protein, 17 aa, Mycobacterium tuberculosis
PLDAGPYTFLAADALVL

SEQ ID NO: 1517086 - protein, 19 aa, Mycobacterium tuberculosis
PLPIEGPAWPLTVQPETGV

SEQ ID NO: 1517087 - protein, 20 aa, Mycobacterium tuberculosis
PLTYPEVGATATGRLPAGYN

SEQ ID NO: 1517088 - protein, 21 aa, Mycobacterium tuberculosis
PNSMLVAAASWDALAAELASA

SEQ ID NO: 1517089 - protein, 18 aa, Mycobacterium tuberculosis
PPFDLPTVVIDRIPVELH

SEQ ID NO: 1517090 - protein, 17 aa, Mycobacterium tuberculosis
PPFFVLHGEKDPMVPSA

SEQ ID NO: 1517091 - protein, 23 aa, Mycobacterium tuberculosis
PPGQYFHGITLHKNGVTANMSLA

SEQ ID NO: 1517092 - protein, 24 aa, Mycobacterium tuberculosis
PPNGLPVILGPDHPITGSYPVVGV

SEQ ID NO: 1517093 - protein, 28 aa, Mycobacterium tuberculosis
PPQNELTPFYPRSPYGAAKVYSYWATRN

SEQ ID NO: 1517094 - protein, 17 aa, Mycobacterium tuberculosis
PPVGGLLFTCNGRGRRM

SEQ ID NO: 1517095 - protein, 26 aa, Mycobacterium tuberculosis
PPYQGTVRMAFLLQGDHDAYFQHVRA

SEQ ID NO: 1517096 - protein, 20 aa, Mycobacterium tuberculosis
PQAVPVTRLWLSKQQTSDLM

SEQ ID NO: 1517097 - protein, 19 aa, Mycobacterium tuberculosis
PQDFGPIQTLFTDAGLLDN

SEQ ID NO: 1517098 - protein, 17 aa, Mycobacterium tuberculosis
PQLIASHTAFAAKAGLM

SEQ ID NO: 1517099 - protein, 22 aa, Mycobacterium tuberculosis
PRAWLTTVVSRLGLDKLRSAAH

SEQ ID NO: 1517100 - protein, 28 aa, Mycobacterium tuberculosis
PREEWPDRLRRLLSKQVGLILRRTIDTD

SEQ ID NO: 1517101 - protein, 26 aa, Mycobacterium tuberculosis
PRELHVVNVLPRRGIGKVDRAALVRR

SEQ ID NO: 1517102 - protein, 22 aa, Mycobacterium tuberculosis
PRQWLEIRYLDSVPDEVWPAVV

SEQ ID NO: 1517103 - protein, 19 aa, Mycobacterium tuberculosis
PRVAWWALCTDFDVPRSMG

SEQ ID NO: 1517104 - protein, 19 aa, Mycobacterium tuberculosis
PSGAGGAGGLLLGENGLNG

SEQ ID NO: 1517105 - protein, 18 aa, Mycobacterium tuberculosis
PSIQFPAIPLDLSATGHI

SEQ ID NO: 1517106 - protein, 25 aa, Mycobacterium tuberculosis
PSQGGGNPGFGGDGGTGGPGGVGVP

SEQ ID NO: 1517107 - protein, 19 aa, Mycobacterium tuberculosis
PTALLAPDWVPWEQRVRPG

SEQ ID NO: 1517108 - protein, 19 aa, Mycobacterium tuberculosis
PTGLTCPYTTPLDVTADII

SEQ ID NO: 1517109 - protein, 29 aa, Mycobacterium tuberculosis
PTMAQQYDAVWWWIDWPERRGRTDTGIDL

SEQ ID NO: 1517110 - protein, 17 aa, Mycobacterium tuberculosis
PTPWPQEALDDLLVVLS

SEQ ID NO: 1517111 - protein, 17 aa, Mycobacterium tuberculosis
PTTARLTGRWLRGRLPT

SEQ ID NO: 1517112 - protein, 21 aa, Mycobacterium tuberculosis
PTTFEVFARRLPTGRRYGVVA

SEQ ID NO: 1517113 - protein, 19 aa, Mycobacterium tuberculosis
PTTRWWVLTVNVGGDSGPS

SEQ ID NO: 1517114 - protein, 29 aa, Mycobacterium tuberculosis
PVAVRAHLAPFLPGHPFAPELPKGYPVSS

SEQ ID NO: 1517115 - protein, 18 aa, Mycobacterium tuberculosis
PVEIIRRSRAAVGCDFII

SEQ ID NO: 1517116 - protein, 24 aa, Mycobacterium tuberculosis
PVPEPMVKMMLNNVLEHLAENLKQ

SEQ ID NO: 1517117 - protein, 18 aa, Mycobacterium tuberculosis
PVQSLTGRPLIGDGANGI

SEQ ID NO: 1517118 - protein, 22 aa, Mycobacterium tuberculosis
PVRRALGNLIRIGEWDPTDHAR

SEQ ID NO: 1517119 - protein, 25 aa, Mycobacterium tuberculosis
PVTIPGFAINPFGLNVPLSGGTNAV

SEQ ID NO: 1517120 - protein, 18 aa, Mycobacterium tuberculosis
PWGTWEWIGPPALGAVLP

SEQ ID NO: 1517121 - protein, 19 aa, Mycobacterium tuberculosis
PWRDIPDIWQWGITDADLE

SEQ ID NO: 1517122 - protein, 26 aa, Mycobacterium tuberculosis
PWSDIQKYWMMFLGALATAEGFIYDS

SEQ ID NO: 1517123 - protein, 19 aa, Mycobacterium tuberculosis
PYGVRPLSLGRLDRGWVVA

SEQ ID NO: 1517124 - protein, 18 aa, Mycobacterium tuberculosis
PYVGPDYLVPKPLHSVRS

SEQ ID NO: 1517125 - protein, 18 aa, Mycobacterium tuberculosis
QAALGFLLDNGCHHLQLI

SEQ ID NO: 1517126 - protein, 17 aa, Mycobacterium tuberculosis
QAFHTMVNMLLTCFACQ

SEQ ID NO: 1517127 - protein, 22 aa, Mycobacterium tuberculosis
QAGRLLAHLTADDGLTALDVGW

SEQ ID NO: 1517128 - protein, 21 aa, Mycobacterium tuberculosis
QAQRTVLCKDPFRAVDERVKR

SEQ ID NO: 1517129 - protein, 32 aa, Mycobacterium tuberculosis
QAVLDVVNGPTQLLLGRPLIGDGANGGPGQNG

SEQ ID NO: 1517130 - protein, 28 aa, Mycobacterium tuberculosis
QDWDGVAITLTWSQLYRRTLNVAQELSR

SEQ ID NO: 1517131 - protein, 24 aa, Mycobacterium tuberculosis
QDYLANYHLAWYAVTTRRGGSRGF

SEQ ID NO: 1517132 - protein, 19 aa, Mycobacterium tuberculosis
QEIEEGILPALYAAATPQA

SEQ ID NO: 1517133 - protein, 24 aa, Mycobacterium tuberculosis
QFDSLLAVARPFFAKNREVLTHDV

SEQ ID NO: 1517134 - protein, 25 aa, Mycobacterium tuberculosis
QFVELPTYAFQRRRFWLSGDGVAAD

SEQ ID NO: 1517135 - protein, 23 aa, Mycobacterium tuberculosis
QGGWPMTCFLTPNGRPFFCGTYY

SEQ ID NO: 1517136 - protein, 17 aa, Mycobacterium tuberculosis
QGPLRDGVIIPGANLVV

SEQ ID NO: 1517137 - protein, 17 aa, Mycobacterium tuberculosis
QGQIAIDLSVTTPFIPI

SEQ ID NO: 1517138 - protein, 24 aa, Mycobacterium tuberculosis
QLAGLKLLAFRGRFVEIGKRDIYG

SEQ ID NO: 1517139 - protein, 17 aa, Mycobacterium tuberculosis
QLLGEGYTLVRREYMTA

SEQ ID NO: 1517140 - protein, 18 aa, Mycobacterium tuberculosis
QLLIIISAGRTIANDISA

SEQ ID NO: 1517141 - protein, 19 aa, Mycobacterium tuberculosis
QLTDRLLRRPAPVKFMLSA

SEQ ID NO: 1517142 - protein, 17 aa, Mycobacterium tuberculosis
QMAVIVRSVPRAVRLPR

SEQ ID NO: 1517143 - protein, 28 aa, Mycobacterium tuberculosis
QMHLSLALNRLPQVAALFLAGHLGARLF

SEQ ID NO: 1517144 - protein, 22 aa, Mycobacterium tuberculosis
QPGGPGGLLWGNGGNGGSGVAG

SEQ ID NO: 1517145 - protein, 21 aa, Mycobacterium tuberculosis
QQAFGSPALMRALDRLDAHLQ

SEQ ID NO: 1517146 - protein, 18 aa, Mycobacterium tuberculosis
QQLSFALIDGVRRQWRNG

SEQ ID NO: 1517147 - protein, 26 aa, Mycobacterium tuberculosis
QQNPALHQVVIGNELPLPPVRSAVAD

SEQ ID NO: 1517148 - protein, 17 aa, Mycobacterium tuberculosis
QQRLLLEVSWEALERAG

SEQ ID NO: 1517149 - protein, 17 aa, Mycobacterium tuberculosis
QRDYAPARHLGGVLYLF

SEQ ID NO: 1517150 - protein, 19 aa, Mycobacterium tuberculosis
QRPLLTAIRRTEPTVLLID

SEQ ID NO: 1517151 - protein, 21 aa, Mycobacterium tuberculosis
QRRLEAGMKLGWHPYHFPDEP

SEQ ID NO: 1517152 - protein, 21 aa, Mycobacterium tuberculosis
QRWLADHVIAGVVLLAGAAFV

SEQ ID NO: 1517153 - protein, 21 aa, Mycobacterium tuberculosis
QSLPLAEMLYARGSGLRASRN

SEQ ID NO: 1517154 - protein, 20 aa, Mycobacterium tuberculosis
QTMRANLERWAPLLPEGATL

SEQ ID NO: 1517155 - protein, 27 aa, Mycobacterium tuberculosis
QTREHVLLARQVGVPYILVALNKADAV

SEQ ID NO: 1517156 - protein, 17 aa, Mycobacterium tuberculosis
QVEVFHYTRKWLQKMTV

SEQ ID NO: 1517157 - protein, 20 aa, Mycobacterium tuberculosis
QVLRALDGRFIPAGPSGSPL

SEQ ID NO: 1517158 - protein, 21 aa, Mycobacterium tuberculosis
QVQEWLQWLQKIGYTDFYNNV

SEQ ID NO: 1517159 - protein, 18 aa, Mycobacterium tuberculosis
QWRVLERAFSRHSALILI

SEQ ID NO: 1517160 - protein, 19 aa, Mycobacterium tuberculosis
QWRVLERAFSRHSALILIG

SEQ ID NO: 1517161 - protein, 18 aa, Mycobacterium tuberculosis
QYAILDDRLRHLPGGIDE

SEQ ID NO: 1517162 - protein, 17 aa, Mycobacterium tuberculosis
QYALKDDVLYVLEANPR

SEQ ID NO: 1517163 - protein, 25 aa, Mycobacterium tuberculosis
RAAEAPTTGLLAAGADEVSAAIASL

SEQ ID NO: 1517164 - protein, 18 aa, Mycobacterium tuberculosis
RAAHMGRRYGRRLTVMAD

SEQ ID NO: 1517165 - protein, 25 aa, Mycobacterium tuberculosis
RAARAVWQALPGELWADRFAEAAAQ

SEQ ID NO: 1517166 - protein, 17 aa, Mycobacterium tuberculosis
RADGIDAPALFLTARDS

SEQ ID NO: 1517167 - protein, 17 aa, Mycobacterium tuberculosis
RADLVIGAVLVPGAKAP

SEQ ID NO: 1517168 - protein, 21 aa, Mycobacterium tuberculosis
RAHGLPAISLGWGLWDQASAM

SEQ ID NO: 1517169 - protein, 17 aa, Mycobacterium tuberculosis
RAHLRVVFPGVVGLFAD

SEQ ID NO: 1517170 - protein, 26 aa, Mycobacterium tuberculosis
RAIDDKWTLCQILYWRGVGTCISGDP

SEQ ID NO: 1517171 - protein, 17 aa, Mycobacterium tuberculosis
RAPSSLPAPLMARPGRS

SEQ ID NO: 1517172 - protein, 17 aa, Mycobacterium tuberculosis
RAQGFNDLLIRLATALE

SEQ ID NO: 1517173 - protein, 22 aa, Mycobacterium tuberculosis
RAQMATLPRLKPRVFYDLVVEV

SEQ ID NO: 1517174 - protein, 25 aa, Mycobacterium tuberculosis
RARYLLDGLDILPLTEPVIGLAETI

SEQ ID NO: 1517175 - protein, 19 aa, Mycobacterium tuberculosis
RAVPQYGFRPNFVARPPAA

SEQ ID NO: 1517176 - protein, 23 aa, Mycobacterium tuberculosis
RDCTAGLPFLIHAVSARAQAPAQ

SEQ ID NO: 1517177 - protein, 22 aa, Mycobacterium tuberculosis
RDIEWRIGPGERIGIVGANGAG

SEQ ID NO: 1517178 - protein, 21 aa, Mycobacterium tuberculosis
RDLLKFEFLFSGRAQFEKDLA

SEQ ID NO: 1517179 - protein, 19 aa, Mycobacterium tuberculosis
RDTIAKPPPSGSPGLMIAM

SEQ ID NO: 1517180 - protein, 25 aa, Mycobacterium tuberculosis
RELDVWLPVHPVTRRRWPNGRVTHD

SEQ ID NO: 1517181 - protein, 19 aa, Mycobacterium tuberculosis
RFLLGLVVSTGVGGGLVLD

SEQ ID NO: 1517182 - protein, 17 aa, Mycobacterium tuberculosis
RFNWDPLRWFEEDEPIH

SEQ ID NO: 1517183 - protein, 19 aa, Mycobacterium tuberculosis
RFNWDPLRWFEEDEPIYGH

SEQ ID NO: 1517184 - protein, 19 aa, Mycobacterium tuberculosis
RFVRKPPEPPALPAFSAIN

SEQ ID NO: 1517185 - protein, 17 aa, Mycobacterium tuberculosis
RGIEGFASRFPTVTASC

SEQ ID NO: 1517186 - protein, 21 aa, Mycobacterium tuberculosis
RGIQLLPLWRRVHSHILRISL

SEQ ID NO: 1517187 - protein, 22 aa, Mycobacterium tuberculosis
RGRKLRRPSLPFPLPTCRQTQN

SEQ ID NO: 1517188 - protein, 20 aa, Mycobacterium tuberculosis
RGSRVVLRVPRRGDKRALAE

SEQ ID NO: 1517189 - protein, 20 aa, Mycobacterium tuberculosis
RHRVPVYTIAPFATGGLHKM

SEQ ID NO: 1517190 - protein, 19 aa, Mycobacterium tuberculosis
RIAGAMFPNLLTASADITC

SEQ ID NO: 1517191 - protein, 18 aa, Mycobacterium tuberculosis
RIAQAIALPAVRKTGVLE

SEQ ID NO: 1517192 - protein, 21 aa, Mycobacterium tuberculosis
RIAQLCHPNLRNTFPPLRMRI

SEQ ID NO: 1517193 - protein, 26 aa, Mycobacterium tuberculosis
RIDTQLPNWWGPILAPALAGVGALRG

SEQ ID NO: 1517194 - protein, 17 aa, Mycobacterium tuberculosis
RIISLAVLGLDAAGRLE

SEQ ID NO: 1517195 - protein, 17 aa, Mycobacterium tuberculosis
RIPVHMVEVINKLGRIQ

SEQ ID NO: 1517196 - protein, 21 aa, Mycobacterium tuberculosis
RIPVNITLNELPFNVAGIFTG

SEQ ID NO: 1517197 - protein, 22 aa, Mycobacterium tuberculosis
RIQVPQLGDRRVDDARLPGAAR

SEQ ID NO: 1517198 - protein, 20 aa, Mycobacterium tuberculosis
RIRPLRPDNTAYLIYTSGTT

SEQ ID NO: 1517199 - protein, 18 aa, Mycobacterium tuberculosis
RIVRRSIMLVPRRGTRVR

SEQ ID NO: 1517200 - protein, 24 aa, Mycobacterium tuberculosis
RKGGKLPRPVLSEEYYRAYGAATL

SEQ ID NO: 1517201 - protein, 25 aa, Mycobacterium tuberculosis
RKRLRQWMMRITAYADRLLDDLDVL

SEQ ID NO: 1517202 - protein, 25 aa, Mycobacterium tuberculosis
RKSSQSHMPPRTPPRGRCLRAPESA

SEQ ID NO: 1517203 - protein, 18 aa, Mycobacterium tuberculosis
RLAALLRFSADRAADWYS

SEQ ID NO: 1517204 - protein, 25 aa, Mycobacterium tuberculosis
RLAGRDLPPVPVLLVIVDEYLELFA

SEQ ID NO: 1517205 - protein, 22 aa, Mycobacterium tuberculosis
RLEARIVLRLLLDRTSVIEAAD

SEQ ID NO: 1517206 - protein, 19 aa, Mycobacterium tuberculosis
RLELLRRRLADRGLSSAAQ

SEQ ID NO: 1517207 - protein, 19 aa, Mycobacterium tuberculosis
RLGALAARLWLPLLAAEGS

SEQ ID NO: 1517208 - protein, 25 aa, Mycobacterium tuberculosis
RLLADGGILDPLPMAPIAGVNADLT

SEQ ID NO: 1517209 - protein, 30 aa, Mycobacterium tuberculosis
RLLRDRIHQGWILTVLWVIDTGVTAATLEH

SEQ ID NO: 1517210 - protein, 29 aa, Mycobacterium tuberculosis
RLLRLGLQSLRLWREGSFLDGLGPQLVTA

SEQ ID NO: 1517211 - protein, 23 aa, Mycobacterium tuberculosis
RLQRLLAFVARQEPRLNWAVGVH

SEQ ID NO: 1517212 - protein, 19 aa, Mycobacterium tuberculosis
RLRFELDHHINLRPARLYP

SEQ ID NO: 1517213 - protein, 20 aa, Mycobacterium tuberculosis
RLRGRFYDGMRALHGAPDEV

SEQ ID NO: 1517214 - protein, 21 aa, Mycobacterium tuberculosis
RLRVRLADRALTQTNPLLSVA

SEQ ID NO: 1517215 - protein, 21 aa, Mycobacterium tuberculosis
RLTAVWIADWADNTVHLSAHH

SEQ ID NO: 1517216 - protein, 30 aa, Mycobacterium tuberculosis; identical to SEQ ID NO: 131395

SEQ ID NO: 1517217 - protein, 29 aa, Mycobacterium tuberculosis
RLVDLPPTPWHHQRFWVTDRSAMSELAAT

SEQ ID NO: 1517218 - protein, 29 aa, Mycobacterium tuberculosis
RLVELFTAEAIWEMPPYTGWYQGAQAIVT

SEQ ID NO: 1517219 - protein, 18 aa, Mycobacterium tuberculosis
RMMELTNRLRLGTAPFAL

SEQ ID NO: 1517220 - protein, 25 aa, Mycobacterium tuberculosis
RMVARPMINVFPSGRKEVFRLRLAS

SEQ ID NO: 1517221 - protein, 19 aa, Mycobacterium tuberculosis
RNMPRPLVAVAAILAPLMQ

SEQ ID NO: 1517222 - protein, 17 aa, Mycobacterium tuberculosis
RPAGREHRRAWEQLITP

SEQ ID NO: 1517223 - protein, 33 aa, Mycobacterium tuberculosis
RPQPSSTPPPPPPLPPVPFPKECPAPGVMQGCL

SEQ ID NO: 1517224 - protein, 18 aa, Mycobacterium tuberculosis
RPRLTPPVPSIPGRRSKP

SEQ ID NO: 1517225 - protein, 18 aa, Mycobacterium tuberculosis
RPVGVDALITALWEEWPP

SEQ ID NO: 1517226 - protein, 27 aa, Mycobacterium tuberculosis
RQGSYFPDWLLQRRKRAERALTSVVAT

SEQ ID NO: 1517227 - protein, 23 aa, Mycobacterium tuberculosis
RRDALWAAALQTAISRRTGDIGA

SEQ ID NO: 1517228 - protein, 28 aa, Mycobacterium tuberculosis
RRDRMVRAIWVLRALLREYGRRLTEAGV

SEQ ID NO: 1517229 - protein, 17 aa, Mycobacterium tuberculosis
RRELGLPPAPAPPVRRL

SEQ ID NO: 1517230 - protein, 26 aa, Mycobacterium tuberculosis
RRGRPTVWSVWGVGVAILLGDALHAT

SEQ ID NO: 1517231 - protein, 29 aa, Mycobacterium tuberculosis
RRIELPTYAFQRQRYWLPPTSAGSADISG

SEQ ID NO: 1517232 - protein, 18 aa, Mycobacterium tuberculosis
RRLPAAEHPFINKLADQT

SEQ ID NO: 1517233 - protein, 19 aa, Mycobacterium tuberculosis
RRMWASAQNISGAGWSGQA

SEQ ID NO: 1517234 - protein, 27 aa, Mycobacterium tuberculosis
RRPSDYHLELAWPGRVWYQDYFAVQDG

SEQ ID NO: 1517235 - protein, 21 aa, Mycobacterium tuberculosis
RRPVAGLHWPWVARVGTVVMS

SEQ ID NO: 1517236 - protein, 32 aa, Mycobacterium tuberculosis
RRRRKHLTLVHKINVLTFAGGLWLRTVDEVGE

SEQ ID NO: 1517237 - protein, 20 aa, Mycobacterium tuberculosis
RRRYEAWRRQAEQARKAADE

SEQ ID NO: 1517238 - protein, 31 aa, Mycobacterium tuberculosis
RRVGEGFVGLRVVPWLWGAPPTDRRYYPLFA

SEQ ID NO: 1517239 - protein, 17 aa, Mycobacterium tuberculosis
RSLPFPTLVSILLTDIR

SEQ ID NO: 1517240 - protein, 17 aa, Mycobacterium tuberculosis
RSWAVLGEMAELGEDAI

SEQ ID NO: 1517241 - protein, 18 aa, Mycobacterium tuberculosis
RTVRIGAHQARILLAKNP

SEQ ID NO: 1517242 - protein, 17 aa, Mycobacterium tuberculosis
RVAAITGQPTEWIVPRG

SEQ ID NO: 1517243 - protein, 17 aa, Mycobacterium tuberculosis
RVAISRALAHNPMLVLA

SEQ ID NO: 1517244 - protein, 25 aa, Mycobacterium tuberculosis
RVALQAIGRLLFAAGAVEVLTGIPG

SEQ ID NO: 1517245 - protein, 17 aa, Mycobacterium tuberculosis
RVHRFLGLQVGVILATM

SEQ ID NO: 1517246 - protein, 18 aa, Mycobacterium tuberculosis
RVLAAVGMAPITLDPDRI

SEQ ID NO: 1517247 - protein, 20 aa, Mycobacterium tuberculosis
RVPVRAFINPANRLMVYRRP

SEQ ID NO: 1517248 - protein, 19 aa, Mycobacterium tuberculosis
RVRRVFLVEGQLVGYPAGG

SEQ ID NO: 1517249 - protein, 19 aa, Mycobacterium tuberculosis
RVYAKSTNLPRVLGGLGVA

SEQ ID NO: 1517250 - protein, 20 aa, Mycobacterium tuberculosis
RWRRSPPTGRYRSNSQIQVW

SEQ ID NO: 1517251 - protein, 19 aa, Mycobacterium tuberculosis
RYLDWLTKHSRQILETAYV

SEQ ID NO: 1517252 - protein, 17 aa, Mycobacterium tuberculosis
RYLKKITVSTTTGPGIP

SEQ ID NO: 1517253 - protein, 24 aa, Mycobacterium tuberculosis
SAAAAALPAFSPPAQALGGGVGAF

SEQ ID NO: 1517254 - protein, 28 aa, Mycobacterium tuberculosis
SAAMAAAVAPYLGWLAAAAAQAQRSATQ

SEQ ID NO: 1517255 - protein, 21 aa, Mycobacterium tuberculosis
SAPMLAASVAWDRLAAELAVA

SEQ ID NO: 1517256 - protein, 21 aa, Mycobacterium tuberculosis
SAPPTPFNGPLGRLRNIAYTQ

SEQ ID NO: 1517257 - protein, 18 aa, Mycobacterium tuberculosis
SAPSLVFLDELDALAPRR

SEQ ID NO: 1517258 - protein, 24 aa, Mycobacterium tuberculosis
SAQAATFHIQFVQALTAGAGSYAA

SEQ ID NO: 1517259 - protein, 24 aa, Mycobacterium tuberculosis
SAQAQAFHAQFVQALTSGGGAYAA

SEQ ID NO: 1517260 - protein, 24 aa, Mycobacterium tuberculosis
SCIDTFPEVLWLAQRARQAWDGVR

SEQ ID NO: 1517261 - protein, 27 aa, Mycobacterium tuberculosis
SCLLAEFGQTRLLFDPGTFSHGFEGIT

SEQ ID NO: 1517262 - protein, 23 aa, Mycobacterium tuberculosis
SDMFGELSIFDPGPRTSSAITIT

SEQ ID NO: 1517263 - protein, 22 aa, Mycobacterium tuberculosis
SDPAYFPCYAKCVELGVPVSIH

SEQ ID NO: 1517264 - protein, 24 aa, Mycobacterium tuberculosis
SDSEPINCDVTCGGLFYATDEVQQ

SEQ ID NO: 1517265 - protein, 25 aa, Mycobacterium tuberculosis
SDYDGFTLAGIPSGGLFSGAEVKKS

SEQ ID NO: 1517266 - protein, 18 aa, Mycobacterium tuberculosis
SDYLAGRAFSFISAIDSI

SEQ ID NO: 1517267 - protein, 24 aa, Mycobacterium tuberculosis
SEAQKRHFLPRILSGEHRWCQGFS

SEQ ID NO: 1517268 - protein, 25 aa, Mycobacterium tuberculosis
SENSRFMFDYIPPVFKGQYAETEEE

SEQ ID NO: 1517269 - protein, 21 aa, Mycobacterium tuberculosis
SFVGPPPFRPPTFNPVDGAMV

SEQ ID NO: 1517270 - protein, 18 aa, Mycobacterium tuberculosis
SGGAGGLSGLLFGEPGAN

SEQ ID NO: 1517271 - protein, 19 aa, Mycobacterium tuberculosis
SGGLGSAFGPGGTGGMGGA

SEQ ID NO: 1517272 - protein, 17 aa, Mycobacterium tuberculosis
SGIPYVGRILVNVQVVP

SEQ ID NO: 1517273 - protein, 30 aa, Mycobacterium tuberculosis
SGNYSNGILWRGDYQGLIGYSYALTIPEIP

SEQ ID NO: 1517274 - protein, 21 aa, Mycobacterium tuberculosis
SGSHLYWLETCRVAALACVER

SEQ ID NO: 1517275 - protein, 29 aa, Mycobacterium tuberculosis
SGSSWLDKLWALLDPNSNFWNTIASSGLF

SEQ ID NO: 1517276 - protein, 29 aa, Mycobacterium tuberculosis
SGYAPIMGTPWLTAFAQRSRFAEAFHATG

SEQ ID NO: 1517277 - protein, 23 aa, Mycobacterium tuberculosis
SGYPLELLVRAAAAGWRVVELDV

SEQ ID NO: 1517278 - protein, 19 aa, Mycobacterium tuberculosis
SHAPRPRMLVFGAIDFAAA

SEQ ID NO: 1517279 - protein, 20 aa, Mycobacterium tuberculosis
SHFSGAGISLLCILDEDCRA

SEQ ID NO: 1517280 - protein, 24 aa, Mycobacterium tuberculosis
SIAITSALLVAYLPARSREEMFGG

SEQ ID NO: 1517281 - protein, 21 aa, Mycobacterium tuberculosis
SIDVVLRLPGQRYLVVDYKTN

SEQ ID NO: 1517282 - protein, 24 aa, Mycobacterium tuberculosis
SIGPIKINPITLWPAQNFNQTITL

SEQ ID NO: 1517283 - protein, 22 aa, Mycobacterium tuberculosis
SISPWGTWEWIGPPALGAVLPA

SEQ ID NO: 1517284 - protein, 24 aa, Mycobacterium tuberculosis
SIVDRLMYNAFRAAYEPTLAALTT

SEQ ID NO: 1517285 - protein, 22 aa, Mycobacterium tuberculosis
SLLARIGDAFLALPNGFTAHPR

SEQ ID NO: 1517286 - protein, 18 aa, Mycobacterium tuberculosis
SLPVHDHMAIADVARVVA

SEQ ID NO: 1517287 - protein, 27 aa, Mycobacterium tuberculosis
SMNHVLAEMKLLRPLLSAGDYLVVEDS

SEQ ID NO: 1517288 - protein, 19 aa, Mycobacterium tuberculosis
SNGMLWRGDHEGLFGLSYG

SEQ ID NO: 1517289 - protein, 24 aa, Mycobacterium tuberculosis
SPAGAYFKGGIAPVSVWVSTEYVR

SEQ ID NO: 1517290 - protein, 20 aa, Mycobacterium tuberculosis
SPEQWFAFTPPRVPVLESLQ

SEQ ID NO: 1517291 - protein, 37 aa, Mycobacterium tuberculosis
SPGAEASWVVGITWWSAVVGGFQMSFVIAVPETIAAA

SEQ ID NO: 1517292 - protein, 17 aa, Mycobacterium tuberculosis
SPGPYELARLAWEIERV

SEQ ID NO: 1517293 - protein, 24 aa, Mycobacterium tuberculosis
SPISLAFLTFLPRFDCQDRADWLS

SEQ ID NO: 1517294 - protein, 21 aa, Mycobacterium tuberculosis
SPLAIGLFGVNPTVGSIGPGS

SEQ ID NO: 1517295 - protein, 35 aa, Mycobacterium tuberculosis
SPMQAVLDVVNGPTQLLLGRPLIGDGANGGPGQNG

SEQ ID NO: 1517296 - protein, 18 aa, Mycobacterium tuberculosis
SPQALIALAMLTLAGHRP

SEQ ID NO: 1517297 - protein, 19 aa, Mycobacterium tuberculosis
SPRGYRAMAGIPRLQFAHA

SEQ ID NO: 1517298 - protein, 18 aa, Mycobacterium tuberculosis
SPRQRAVLLLRDVLQWKS

SEQ ID NO: 1517299 - protein, 21 aa, Mycobacterium tuberculosis
SPRRPWLAPLEDPEPVDRLVA

SEQ ID NO: 1517300 - protein, 27 aa, Mycobacterium tuberculosis
SPVTIPGFAINPFGLNVPLSGGTSPVT

SEQ ID NO: 1517301 - protein, 19 aa, Mycobacterium tuberculosis
SRALAHNPMLVLADEPTGN

SEQ ID NO: 1517302 - protein, 26 aa, Mycobacterium tuberculosis
SRDLQPWLAVPDRLLPLPAGLAGERR

SEQ ID NO: 1517303 - protein, 21 aa, Mycobacterium tuberculosis
SRIEELLARSGRFFIPGEISA

SEQ ID NO: 1517304 - protein, 18 aa, Mycobacterium tuberculosis
SRIIVTMRGDPYADRPRL

SEQ ID NO: 1517305 - protein, 19 aa, Mycobacterium tuberculosis
SRLRVLARREFAGMISVAI

SEQ ID NO: 1517306 - protein, 17 aa, Mycobacterium tuberculosis
SRRAYDVRPIVTAILDA

SEQ ID NO: 1517307 - protein, 36 aa, Mycobacterium tuberculosis
SSAVGYLMPALGRPNLTLLARMRAVRLRFSATTAVG

SEQ ID NO: 1517308 - protein, 25 aa, Mycobacterium tuberculosis
SSKEWPGMLAFYRNLAIALVGDHPG

SEQ ID NO: 1517309 - protein, 25 aa, Mycobacterium tuberculosis
SSLVAVHLACRSLSTWDCDIALVGG

SEQ ID NO: 1517310 - protein, 32 aa, Mycobacterium tuberculosis
SSSEWMADAALRYLDWLSKHSRQILRTARVIE

SEQ ID NO: 1517311 - protein, 28 aa, Mycobacterium tuberculosis
SSSPFACLLIGQPTLRRRMKLGVLAALD

SEQ ID NO: 1517312 - protein, 25 aa, Mycobacterium tuberculosis
STAWTSTWRRWCILANAATSSTTCA

SEQ ID NO: 1517313 - protein, 18 aa, Mycobacterium tuberculosis
STKFTRLTGRSPILLAGM

SEQ ID NO: 1517314 - protein, 18 aa, Mycobacterium tuberculosis
STLRYWRYWAPVRAAIAL

SEQ ID NO: 1517315 - protein, 20 aa, Mycobacterium tuberculosis
STLSFFRLALRLRRERNEFD

SEQ ID NO: 1517316 - protein, 17 aa, Mycobacterium tuberculosis
STPLHTLQQQILNAINE

SEQ ID NO: 1517317 - protein, 24 aa, Mycobacterium tuberculosis
STPSNYFHLLRRHALDGIQRPLIV

SEQ ID NO: 1517318 - protein, 23 aa, Mycobacterium tuberculosis
STQVAAFHDRFAQTLSAAVGSYV

SEQ ID NO: 1517319 - protein, 25 aa, Mycobacterium tuberculosis
STSMLAMSAPYVEWLERTAAQTKQT

SEQ ID NO: 1517320 - protein, 22 aa, Mycobacterium tuberculosis
SVFDHRAVVVGADRGRLMAGLA

SEQ ID NO: 1517321 - protein, 25 aa, Mycobacterium tuberculosis
SVGPITISPITLFPAQNFNTTFPVG

SEQ ID NO: 1517322 - protein, 25 aa, Mycobacterium tuberculosis
SVSSLYTAIPFAQDASVLVIGERTN

SEQ ID NO: 1517323 - protein, 25 aa, Mycobacterium tuberculosis
SYGITIPQFPIRITTTGGIGPIVIP

SEQ ID NO: 1517324 - protein, 22 aa, Mycobacterium tuberculosis
SYGRYWREVFRLPTINHRKLAR

SEQ ID NO: 1517325 - protein, 17 aa, Mycobacterium tuberculosis
SYMLPRSPIVRIVDSDT

SEQ ID NO: 1517326 - protein, 25 aa, Mycobacterium tuberculosis
SYPQKPPVGAALWKLMERARQVGLH

SEQ ID NO: 1517327 - protein, 18 aa, Mycobacterium tuberculosis
SYSGVFVHSAPWSVGAQG

SEQ ID NO: 1517328 - protein, 23 aa, Mycobacterium tuberculosis
SYSNGILWRGDYQGLIGYSDTLS

SEQ ID NO: 1517329 - protein, 22 aa, Mycobacterium tuberculosis
TAAAANLAGIRSALSEAAAAAS

SEQ ID NO: 1517330 - protein, 23 aa, Mycobacterium tuberculosis
TAAPLDRRLLLGMLAELPAGAGV

SEQ ID NO: 1517331 - protein, 18 aa, Mycobacterium tuberculosis
TACAYDHLIPGRGVGVLL

SEQ ID NO: 1517332 - protein, 37 aa, Mycobacterium tuberculosis
TADNLLTMVRRLPPGAIWQVIAIGKANMELTAMGLAL

SEQ ID NO: 1517333 - protein, 25 aa, Mycobacterium tuberculosis
TADQPLDWFCSFSSAAALVGSPGQG

SEQ ID NO: 1517334 - protein, 20 aa, Mycobacterium tuberculosis
TAELLRLALTGKRKPYIYTS

SEQ ID NO: 1517335 - protein, 20 aa, Mycobacterium tuberculosis
TAIRIPATASVGPFDVTFVN

SEQ ID NO: 1517336 - protein, 18 aa, Mycobacterium tuberculosis
TALLLITHDLALAAQRAE

SEQ ID NO: 1517337 - protein, 24 aa, Mycobacterium tuberculosis
TATTARAVAVARSGMDCVAGDASG

SEQ ID NO: 1517338 - protein, 30 aa, Mycobacterium tuberculosis
TCARASWRRAIWRWYRARYVSPKPWTCRSP

SEQ ID NO: 1517339 - protein, 29 aa, Mycobacterium tuberculosis
TDLVVDNFTIPIIGFESFAFSFHIHTEPD

SEQ ID NO: 1517340 - protein, 24 aa, Mycobacterium tuberculosis
TDMPDRVVWLPLNSAGSTVHRQLR

SEQ ID NO: 1517341 - protein, 17 aa, Mycobacterium tuberculosis
TDPDCIAVIAPSDSECA

SEQ ID NO: 1517342 - protein, 29 aa, Mycobacterium tuberculosis
TDPRHTPPHAWYIAFAPAQAPKVAVAVLV

SEQ ID NO: 1517343 - protein, 18 aa, Mycobacterium tuberculosis
TEAWLMQAPKQLVQAFLA

SEQ ID NO: 1517344 - protein, 25 aa, Mycobacterium tuberculosis
TEHSRHCYFFRTRRYRPLHRPSDTD

SEQ ID NO: 1517345 - protein, 27 aa, Mycobacterium tuberculosis
TGAPEVHRWWTSLTSEERQRLIAEHPE

SEQ ID NO: 1517346 - protein, 25 aa, Mycobacterium tuberculosis
TGAPQFEIVDPRPLTLLPEPNPGDL

SEQ ID NO: 1517347 - protein, 24 aa, Mycobacterium tuberculosis
TGCTPYMVLLAAFGALVHRYTHSD

SEQ ID NO: 1517348 - protein, 19 aa, Mycobacterium tuberculosis
TGGLLFGNGGAGGQGGLGL

SEQ ID NO: 1517349 - protein, 17 aa, Mycobacterium tuberculosis
TGHPFLQHLLAHRDVTR

SEQ ID NO: 1517350 - protein, 26 aa, Mycobacterium tuberculosis
TGQAGGAGGILWGNGGAGGSGAPGQV

SEQ ID NO: 1517351 - protein, 27 aa, Mycobacterium tuberculosis
TGRRRPVAGLHWPWVARVGTVVMSWRL

SEQ ID NO: 1517352 - protein, 24 aa, Mycobacterium tuberculosis
TGSREFMLHPVMMDIALQTLGATR

SEQ ID NO: 1517353 - protein, 26 aa, Mycobacterium tuberculosis
TGTGERLVFGPVALGLVPVTVTNHVV

SEQ ID NO: 1517354 - protein, 23 aa, Mycobacterium tuberculosis
TGVARFMPVYPTEKAASKAIGRL

SEQ ID NO: 1517355 - protein, 18 aa, Mycobacterium tuberculosis
THAGTWITLVNRAIWIPA

SEQ ID NO: 1517356 - protein, 20 aa, Mycobacterium tuberculosis
THAHAWALRMSPDGNVWGAT

SEQ ID NO: 1517357 - protein, 33 aa, Mycobacterium tuberculosis
THARVGLLPTWGLSVRLPQKVGIGLARRMSLTG

SEQ ID NO: 1517358 - protein, 19 aa, Mycobacterium tuberculosis
THRKALAAFTKSGGRLVES

SEQ ID NO: 1517359 - protein, 19 aa, Mycobacterium tuberculosis
TIAAVFPDGPQRYFDTIYN

SEQ ID NO: 1517360 - protein, 19 aa, Mycobacterium tuberculosis
TICVTIAIDRWRRTRSPVY

SEQ ID NO: 1517361 - protein, 34 aa, Mycobacterium tuberculosis; identical to SEQ ID NO: 223469

SEQ ID NO: 1517362 - protein, 19 aa, Mycobacterium tuberculosis
TINIRIPVNITLNELPFNV

SEQ ID NO: 1517363 - protein, 20 aa, Mycobacterium tuberculosis
TIPGFTIPGSPLNLTANGGL

SEQ ID NO: 1517364 - protein, 17 aa, Mycobacterium tuberculosis
TIRLPVHLVEQVNKLAR

SEQ ID NO: 1517365 - protein, 18 aa, Mycobacterium tuberculosis
TLAAMRRGEQLPFGLRGF

SEQ ID NO: 1517366 - protein, 29 aa, Mycobacterium tuberculosis
TLALLPAALPLLAAPLAPLTLAPASAAGG

SEQ ID NO: 1517367 - protein, 31 aa, Mycobacterium tuberculosis
TLGTQAAAFHERFIQALSTAAGAYGSAEAAN

SEQ ID NO: 1517368 - protein, 29 aa, Mycobacterium tuberculosis
TLNINFFVHDPFTLEPYSRDPRNIARKAE

SEQ ID NO: 1517369 - protein, 27 aa, Mycobacterium tuberculosis
TLSVPPSWTAAAPLASPLGSALGGTPM

SEQ ID NO: 1517370 - protein, 19 aa, Mycobacterium tuberculosis
TLVMTHYVPAIGPGQEEQW

SEQ ID NO: 1517371 - protein, 25 aa, Mycobacterium tuberculosis
TLVSTTFVVPYPPGFPVLVPGQLVS

SEQ ID NO: 1517372 - protein, 21 aa, Mycobacterium tuberculosis
TNFEYGLECILDHAGRLIEQS

SEQ ID NO: 1517373 - protein, 18 aa, Mycobacterium tuberculosis
TNLFLDMVRRRARIRMEA

SEQ ID NO: 1517374 - protein, 34 aa, Mycobacterium tuberculosis
TPAWRTTIKRWFPGFMTFRFLECGLLTMVSNPLA

SEQ ID NO: 1517375 - protein, 17 aa, Mycobacterium tuberculosis
TPCTCARASWRRAIWRW

SEQ ID NO: 1517376 - protein, 28 aa, Mycobacterium tuberculosis
TPERLRSLERLECLVRRLPAVGHALINQ

SEQ ID NO: 1517377 - protein, 26 aa, Mycobacterium tuberculosis
TPNGRPFFCGTYYPKAAFLQLLSAIS

SEQ ID NO: 1517378 - protein, 19 aa, Mycobacterium tuberculosis
TPPFDLPTVVIDRIPVELH

SEQ ID NO: 1517379 - protein, 28 aa, Mycobacterium tuberculosis
TQPNGPSIRTILRALAIHRRPSANSKLG

SEQ ID NO: 1517380 - protein, 18 aa, Mycobacterium tuberculosis
TQQLVESGWRPGDSVILA

SEQ ID NO: 1517381 - protein, 23 aa, Mycobacterium tuberculosis
TRAKARLRWREKELVGVGLARLN

SEQ ID NO: 1517382 - protein, 24 aa, Mycobacterium tuberculosis
TRGYRYGPAFRGLTAMWARGEEIF

SEQ ID NO: 1517383 - protein, 20 aa, Mycobacterium tuberculosis
TRIGLTYPALFGFLRIATSA

SEQ ID NO: 1517384 - protein, 21 aa, Mycobacterium tuberculosis
TRIGLTYPALFGFLRIATSAR

SEQ ID NO: 1517385 - protein, 22 aa, Mycobacterium tuberculosis
TSEALMRIWNQPHWIRVSIDVP

SEQ ID NO: 1517386 - protein, 26 aa, Mycobacterium tuberculosis
TSPDETWLALQPFLAPAGITRVADVT

SEQ ID NO: 1517387 - protein, 17 aa, Mycobacterium tuberculosis
TSPLAITMGFAACEAAQ

SEQ ID NO: 1517388 - protein, 22 aa, Mycobacterium tuberculosis
TTASDLWQPQYGSGQLAAVVAA

SEQ ID NO: 1517389 - protein, 17 aa, Mycobacterium tuberculosis
TTSPIPLKIDVSGGLPA

SEQ ID NO: 1517390 - protein, 33 aa, Mycobacterium tuberculosis
TTTLLVTDLAGGWIPPHVRLPANVTLLEPTARR

SEQ ID NO: 1517391 - protein, 21 aa, Mycobacterium tuberculosis
TVAQRRLPLLIASGADVHVIA

SEQ ID NO: 1517392 - protein, 25 aa, Mycobacterium tuberculosis
TVDFYSNILGMPLIKALDLPGGQGQ

SEQ ID NO: 1517393 - protein, 18 aa, Mycobacterium tuberculosis
TVEVPVGGILAPLQPFQA

SEQ ID NO: 1517394 - protein, 17 aa, Mycobacterium tuberculosis
TVFPDGYSLPAIPLGID

SEQ ID NO: 1517395 - protein, 25 aa, Mycobacterium tuberculosis
TVGAFSLPGLTLPSLNIPAATTPAN

SEQ ID NO: 1517396 - protein, 32 aa, Mycobacterium tuberculosis
TVRPEIELGPIRPPQRLAPYSYALGAEIKHPE

SEQ ID NO: 1517397 - protein, 32 aa, Mycobacterium tuberculosis; identical to SEQ ID NO: 227046

SEQ ID NO: 1517398 - protein, 20 aa, Mycobacterium tuberculosis
TVSPIDFWEHPTINALAAYL

SEQ ID NO: 1517399 - protein, 18 aa, Mycobacterium tuberculosis
TYGFARQRFWLGDNGELS

SEQ ID NO: 1517400 - protein, 19 aa, Mycobacterium tuberculosis
TYRAHPVLYGTRPSEPGVY

SEQ ID NO: 1517401 - protein, 19 aa, Mycobacterium tuberculosis
VAALFSRRGFNIESLAVGA

SEQ ID NO: 1517402 - protein, 18 aa, Mycobacterium tuberculosis
VAEFEAVRLAMVQPALVA

SEQ ID NO: 1517403 - protein, 29 aa, Mycobacterium tuberculosis
VAEFPGFAFFEIQLRLPVNGRWVLVVTGG

SEQ ID NO: 1517404 - protein, 19 aa, Mycobacterium tuberculosis
VAELTQLWWQEAERNRVLP

SEQ ID NO: 1517405 - protein, 23 aa, Mycobacterium tuberculosis
VAERHRGVRYRAFDLVEAGPDRI

SEQ ID NO: 1517406 - protein, 25 aa, Mycobacterium tuberculosis
VAGDDVFRAWWDLAGNRAGPPSIAR

SEQ ID NO: 1517407 - protein, 21 aa, Mycobacterium tuberculosis
VAHQPFRYWLTHAATVATAAA

SEQ ID NO: 1517408 - protein, 21 aa, Mycobacterium tuberculosis
VAKDLTGLRQRWALVGGFAVS

SEQ ID NO: 1517409 - protein, 21 aa, Mycobacterium tuberculosis
VALHERAVLIELLDDEPDPVT

SEQ ID NO: 1517410 - protein, 17 aa, Mycobacterium tuberculosis
VALLEWLQTTHPEPKVA

SEQ ID NO: 1517411 - protein, 32 aa, Mycobacterium tuberculosis
VARRLLPRVPRCIPLAARLAPGTIGCPSFWNP

SEQ ID NO: 1517412 - protein, 27 aa, Mycobacterium tuberculosis
VASIPVKRLRQAGVLDLLLALANETET

SEQ ID NO: 1517413 - protein, 17 aa, Mycobacterium tuberculosis
VASVYDEYQRRLRAANA

SEQ ID NO: 1517414 - protein, 17 aa, Mycobacterium tuberculosis
VDAIRRGAQAILPTPAP

SEQ ID NO: 1517415 - protein, 20 aa, Mycobacterium tuberculosis
VDALRKTGLLGLVLPREIGG

SEQ ID NO: 1517416 - protein, 18 aa, Mycobacterium tuberculosis
VDAPLPSWTHRTLMLSRE

SEQ ID NO: 1517417 - protein, 30 aa, Mycobacterium tuberculosis
VDEIARCATYPVLAVQAWAAFHDMTLRAVI

SEQ ID NO: 1517418 - protein, 18 aa, Mycobacterium tuberculosis
VDELNVIAVRYLLDERTS

SEQ ID NO: 1517419 - protein, 31 aa, Mycobacterium tuberculosis
VDLRRTVGWFTTYYPVPLACATGLGALAQLD

SEQ ID NO: 1517420 - protein, 22 aa, Mycobacterium tuberculosis
VDQGLSLTLFFKDTATTRDVNK

SEQ ID NO: 1517421 - protein, 24 aa, Mycobacterium tuberculosis
VDVDAKLYGLPFGDGAYGAQDMSL

SEQ ID NO: 1517422 - protein, 23 aa, Mycobacterium tuberculosis
VEERPFMEFTPGYVLRSLDELPK

SEQ ID NO: 1517423 - protein, 20 aa, Mycobacterium tuberculosis
VELILCFNQLAYSAFAPAVL

SEQ ID NO: 1517424 - protein, 25 aa, Mycobacterium tuberculosis
VELSKELRPWVPVVSLVKGLEQGTN

SEQ ID NO: 1517425 - protein, 25 aa, Mycobacterium tuberculosis
VERTLASVALILTGGGIVNLDVIQT

SEQ ID NO: 1517426 - protein, 23 aa, Mycobacterium tuberculosis
VESDVRYLARLLCSTTPTGKHKT

SEQ ID NO: 1517427 - protein, 17 aa, Mycobacterium tuberculosis
VEVIDYYPDGRPHHVRA

SEQ ID NO: 1517428 - protein, 18 aa, Mycobacterium tuberculosis
VFFIRNRGLVATGRVEHG

SEQ ID NO: 1517429 - protein, 19 aa, Mycobacterium tuberculosis
VFISARWQADFRADVPVLL

SEQ ID NO: 1517430 - protein, 27 aa, Mycobacterium tuberculosis
VGGILAPLQPFQATAVIPVIGPVTVTL

SEQ ID NO: 1517431 - protein, 26 aa, Mycobacterium tuberculosis
VGLGPFTVPPISIPSLPIASITGSVD

SEQ ID NO: 1517432 - protein, 38 aa, Mycobacterium tuberculosis
VGQSRRERGPAMEYLIAAQDVLVAAAADLEGIGSALAA

SEQ ID NO: 1517433 - protein, 34 aa, Mycobacterium tuberculosis
VGTLLVRGPYGRRFPFSLVFARIYAARGYHVVLQ

SEQ ID NO: 1517434 - protein, 19 aa, Mycobacterium tuberculosis
VGVAILLGDALHATAVRIL

SEQ ID NO: 1517435 - protein, 18 aa, Mycobacterium tuberculosis
VGVRRLRNYHSTRSAHYC

SEQ ID NO: 1517436 - protein, 17 aa, Mycobacterium tuberculosis
VHEILCQIPTLTAPYRA

SEQ ID NO: 1517437 - protein, 19 aa, Mycobacterium tuberculosis
VHPPFRWQRRYAEGFSDQV

SEQ ID NO: 1517438 - protein, 17 aa, Mycobacterium tuberculosis
VIAVRYLLDERTSWAPD

SEQ ID NO: 1517439 - protein, 24 aa, Mycobacterium tuberculosis
VIRVLIAIENAIWPDLFIAGGGIS

SEQ ID NO: 1517440 - protein, 22 aa, Mycobacterium tuberculosis
VITEQEWLAHWPTAVNDSRGGS

SEQ ID NO: 1517441 - protein, 24 aa, Mycobacterium tuberculosis
VLAQRCFELLTPALTRYYPDGSQA

SEQ ID NO: 1517442 - protein, 27 aa, Mycobacterium tuberculosis
VLDVINAPALALLGRPLIGNGANGAPG

SEQ ID NO: 1517443 - protein, 17 aa, Mycobacterium tuberculosis
VLDVLLDLTRQAGKTLI

SEQ ID NO: 1517444 - protein, 30 aa, Mycobacterium tuberculosis
VLNALNAPTQALLGRPLIGDGAAGAPGTGQ

SEQ ID NO: 1517445 - protein, 22 aa, Mycobacterium tuberculosis
VLPTYAVICCPAFGAAAKVGTF

SEQ ID NO: 1517446 - protein, 26 aa, Mycobacterium tuberculosis
VLQAFPQIAQYYRRRFRHVLVDEYQD

SEQ ID NO: 1517447 - protein, 24 aa, Mycobacterium tuberculosis
VLRESLYNVPHRSPRRPWLAPLED

SEQ ID NO: 1517448 - protein, 26 aa, Mycobacterium tuberculosis
VNISGGLPAFTLFAGGLTIPTNAIPL

SEQ ID NO: 1517449 - protein, 19 aa, Mycobacterium tuberculosis
VPPNSSWPNLDYPGLHALS

SEQ ID NO: 1517450 - protein, 18 aa, Mycobacterium tuberculosis
VQDPARLPEALVSARREA

SEQ ID NO: 1517451 - protein, 23 aa, Mycobacterium tuberculosis
VQEPTVLPSRFPNLLANGSGGIA

SEQ ID NO: 1517452 - protein, 18 aa, Mycobacterium tuberculosis
VQQIAIAEAFVLAEKLGL

SEQ ID NO: 1517453 - protein, 19 aa, Mycobacterium tuberculosis
VRALLQMAVVLTYGASMPV

SEQ ID NO: 1517454 - protein, 18 aa, Mycobacterium tuberculosis
VRERILVTHPLQPFDRKN

SEQ ID NO: 1517455 - protein, 20 aa, Mycobacterium tuberculosis
VRGLLDVKRWVTLTGVGGVG

SEQ ID NO: 1517456 - protein, 25 aa, Mycobacterium tuberculosis
VSARPIRVLHLDDLVRFLVLALNTD

SEQ ID NO: 1517457 - protein, 27 aa, Mycobacterium tuberculosis
VSGSGPAYFFLLVEALVDAGVGVGLSR

SEQ ID NO: 1517458 - protein, 17 aa, Mycobacterium tuberculosis
VSHLYLSPILTAVGGST

SEQ ID NO: 1517459 - protein, 25 aa, Mycobacterium tuberculosis
VSIDGLIAILTFPPAESVFDQIIDA

SEQ ID NO: 1517460 - protein, 27 aa, Mycobacterium tuberculosis
VSLDGAEFLVRWLTTGWPRQVAEALHA

SEQ ID NO: 1517461 - protein, 24 aa, Mycobacterium tuberculosis
VSMVTALRILLSNPAVWEKTALIV

SEQ ID NO: 1517462 - protein, 25 aa, Mycobacterium tuberculosis
VSMVTALRILLSNPAVWEKTALIVS

SEQ ID NO: 1517463 - protein, 20 aa, Mycobacterium tuberculosis
VSPFHQLAGYYLIRAPRPDR

SEQ ID NO: 1517464 - protein, 26 aa, Mycobacterium tuberculosis
VSPVTGLVFVTNFDSNTVSVIDPTTN

SEQ ID NO: 1517465 - protein, 24 aa, Mycobacterium tuberculosis
VSRSYWDQLKWNALANIAGTPATT

SEQ ID NO: 1517466 - protein, 24 aa, Mycobacterium tuberculosis
VSTANAFVLRGGVPVFVDIRPDTL

SEQ ID NO: 1517467 - protein, 19 aa, Mycobacterium tuberculosis
VSTAVAALFSSHAQAYQAA

SEQ ID NO: 1517468 - protein, 25 aa, Mycobacterium tuberculosis
VTATNHPLVLGDWKQFLIGDRVGSM

SEQ ID NO: 1517469 - protein, 32 aa, Mycobacterium tuberculosis; identical to SEQ ID NO: 227115

SEQ ID NO: 1517470 - protein, 24 aa, Mycobacterium tuberculosis
VTGRLPADAWLVDLGRHPLRGLPR

SEQ ID NO: 1517471 - protein, 24 aa, Mycobacterium tuberculosis
VTIPGFAINPFGLNVPLSGGTNAV

SEQ ID NO: 1517472 - protein, 19 aa, Mycobacterium tuberculosis
VTPTPIPLTLNLDTTPWTL

SEQ ID NO: 1517473 - protein, 26 aa, Mycobacterium tuberculosis
VTWTEEQTYFFRLSAYTDKLLAHYHA

SEQ ID NO: 1517474 - protein, 26 aa, Mycobacterium tuberculosis
VVDVFIGYLRRKLEAGGGPRLLHTVR

SEQ ID NO: 1517475 - protein, 18 aa, Mycobacterium tuberculosis
VVPPGDLRMALAALASDS

SEQ ID NO: 1517476 - protein, 25 aa, Mycobacterium tuberculosis
VVRTVGQLHPRLGQRRLRILGAGQQ

SEQ ID NO: 1517477 - protein, 20 aa, Mycobacterium tuberculosis
VWALMGMPCGKYLVVMHDLW

SEQ ID NO: 1517478 - protein, 19 aa, Mycobacterium tuberculosis
VWSVWGVGGAILLGDALHA

SEQ ID NO: 1517479 - protein, 21 aa, Mycobacterium tuberculosis
VYAPFYAFVSHDGRRVIPAPL

SEQ ID NO: 1517480 - protein, 18 aa, Mycobacterium tuberculosis
VYETDLLRPVIDTVARVA

SEQ ID NO: 1517481 - protein, 18 aa, Mycobacterium tuberculosis
VYFTTPHFDGYPAVLVRL

SEQ ID NO: 1517482 - protein, 17 aa, Mycobacterium tuberculosis
VYRRDEVSRWISKRESA

SEQ ID NO: 1517483 - protein, 18 aa, Mycobacterium tuberculosis
VYTKLGFTSRLQLAQAAA

SEQ ID NO: 1517484 - protein, 18 aa, Mycobacterium tuberculosis
WACVDLELHPGRTVFVGP

SEQ ID NO: 1517485 - protein, 22 aa, Mycobacterium tuberculosis
WATQLRIMQAQLLAKIAAAVGN

SEQ ID NO: 1517486 - protein, 17 aa, Mycobacterium tuberculosis
WEMPPYTDWYQGAQAIV

SEQ ID NO: 1517487 - protein, 27 aa, Mycobacterium tuberculosis
WGARYTWPRFVCALPKEFFAAVRAELA

SEQ ID NO: 1517488 - protein, 17 aa, Mycobacterium tuberculosis
WGRTVLALGLDTIDDAV

SEQ ID NO: 1517489 - protein, 17 aa, Mycobacterium tuberculosis
WIPAGVPQKIRALGSVP

SEQ ID NO: 1517490 - protein, 17 aa, Mycobacterium tuberculosis
WLDHLMVDYDEQQRWVV

SEQ ID NO: 1517491 - protein, 18 aa, Mycobacterium tuberculosis
WLSVKRLAGWLAAAGYCG

SEQ ID NO: 1517492 - protein, 23 aa, Mycobacterium tuberculosis
WNLTTLAGIRRPARGAAGRLMVT

SEQ ID NO: 1517493 - protein, 17 aa, Mycobacterium tuberculosis
WNMVATVDAFLSSGFSP

SEQ ID NO: 1517494 - protein, 17 aa, Mycobacterium tuberculosis
WQCTIPLGPDPDDEGDI

SEQ ID NO: 1517495 - protein, 17 aa, Mycobacterium tuberculosis
WSRPLEKVYAAVFIDAI

SEQ ID NO: 1517496 - protein, 23 aa, Mycobacterium tuberculosis
WTDELAQLPSLLAEKVRAPSVMP

SEQ ID NO: 1517497 - protein, 17 aa, Mycobacterium tuberculosis
WVPSINPGLNFYFGQPQ

SEQ ID NO: 1517498 - protein, 19 aa, Mycobacterium tuberculosis
WVWVLDPIDGTINYAAGSP

SEQ ID NO: 1517499 - protein, 23 aa, Mycobacterium tuberculosis
YCMPEAEYAWLPRADLLSVDEIS

SEQ ID NO: 1517500 - protein, 30 aa, Mycobacterium tuberculosis
YDSLVRMAQPWSLRYPLVDGQGNFGSPGND

SEQ ID NO: 1517501 - protein, 21 aa, Mycobacterium tuberculosis
YEAWSFPDFATGVAALRTITQ

SEQ ID NO: 1517502 - protein, 18 aa, Mycobacterium tuberculosis
YERAMLRLSDGDDGEPQL

SEQ ID NO: 1517503 - protein, 17 aa, Mycobacterium tuberculosis
YETFTFNGGQYAFPEQW

SEQ ID NO: 1517504 - protein, 19 aa, Mycobacterium tuberculosis
YETSWLDQPIPALDGHTPR

SEQ ID NO: 1517505 - protein, 26 aa, Mycobacterium tuberculosis
YGDTRLGLFPFRRNLSLYAVDLALLT

SEQ ID NO: 1517506 - protein, 23 aa, Mycobacterium tuberculosis
YGKTNLIEALWYSTTLGSHRVSA

SEQ ID NO: 1517507 - protein, 17 aa, Mycobacterium tuberculosis
YGLADLAEIKAGESVLI

SEQ ID NO: 1517508 - protein, 19 aa, Mycobacterium tuberculosis
YGLAYIPDGMELPNKVYLA

SEQ ID NO: 1517509 - protein, 22 aa, Mycobacterium tuberculosis
YGNSGFYNAAVNNTGIFVTGVM

SEQ ID NO: 1517510 - protein, 26 aa, Mycobacterium tuberculosis
YGPSRIDALLKGRRLTKPLIAAVEGP

SEQ ID NO: 1517511 - protein, 30 aa, Mycobacterium tuberculosis
YHETFDLGPLVIFPPMNIPATVIESFSTAP

SEQ ID NO: 1517512 - protein, 37 aa, Mycobacterium tuberculosis
YLNRVFDYLMVSLRSLPLVMLIGRPEAQIPVVSFAVH

SEQ ID NO: 1517513 - protein, 23 aa, Mycobacterium tuberculosis
YLSTSLFAFWAVDAAYSLDGRRN

SEQ ID NO: 1517514 - protein, 21 aa, Mycobacterium tuberculosis
YPDVPVPKSVWRWIDSAQHRL

SEQ ID NO: 1517515 - protein, 26 aa, Mycobacterium tuberculosis
YPLGEALLALYRWRGPLINAGVGGHG

SEQ ID NO: 1517516 - protein, 25 aa, Mycobacterium tuberculosis
YPLGTAFRPKVWPAVRRIDGAYGDR

SEQ ID NO: 1517517 - protein, 21 aa, Mycobacterium tuberculosis
YREGMARAWGPVRVAIAAEQA

SEQ ID NO: 1517518 - protein, 24 aa, Mycobacterium tuberculosis
YRESLGFEVLPLSGGERPPFEVLS

SEQ ID NO: 1517519 - protein, 18 aa, Mycobacterium tuberculosis
YRLTVEGVLPMPQSTHYP

SEQ ID NO: 1517520 - protein, 30 aa, Mycobacterium tuberculosis; identical to SEQ ID NO: 237115

SEQ ID NO: 1517521 - protein, 23 aa, Mycobacterium tuberculosis
YVEDLFVWPRFRRRGLARGLLST

SEQ ID NO: 1517522 - protein, 22 aa, Mycobacterium tuberculosis
YVINGRKWWTSGAADPRCKILI

SEQ ID NO: 1517523 - protein, 34 aa, Mycobacterium tuberculosis
YWRYDTGEELELLNRLWPLVSLRCNFFTPTKKPV

SEQ ID NO: 1517524 - protein, 21 aa, Mycobacterium tuberculosis
YYGLSVAALMKWHLPRLEVLV

SEQ ID NO: 1517525 - protein, 33 aa, Mycobacterium tuberculosis; identical to SEQ ID NO: 225833

SEQ ID NO: 1517526 - protein, 29 aa, Mycobacterium tuberculosis
AAAAARLTPFSPLAPIANPGALARLYELI

SEQ ID NO: 1517527 - protein, 19 aa, Mycobacterium tuberculosis
AAAAHWYTYRNRLAEAISV

SEQ ID NO: 1517528 - protein, 19 aa, Mycobacterium tuberculosis
AAAAPYAGWLAAAAARAAG

SEQ ID NO: 1517529 - protein, 30 aa, Mycobacterium tuberculosis
AAAAQLASWQPALPNINLGVGNIGNLNVGN

SEQ ID NO: 1517530 - protein, 26 aa, Mycobacterium tuberculosis
AAAFHDRFVQLLNAGGGSYASAEIAN

SEQ ID NO: 1517531 - protein, 20 aa, Mycobacterium tuberculosis
AAALDVARIGSSIGAANAAA

SEQ ID NO: 1517532 - protein, 17 aa, Mycobacterium tuberculosis
AAALGDDRWRDLLDNHD

SEQ ID NO: 1517533 - protein, 25 aa, Mycobacterium tuberculosis
AAAMVVAAAPYAGWLAAAAARAGGA

SEQ ID NO: 1517534 - protein, 28 aa, Mycobacterium tuberculosis
AAAQLSSWSIGLQQALPAAPSALAAAIG

SEQ ID NO: 1517535 - protein, 18 aa, Mycobacterium tuberculosis
AAARYLLTDVQLADARAV

SEQ ID NO: 1517536 - protein, 19 aa, Mycobacterium tuberculosis
AAAVEWPMAGTPAWCDLDD

SEQ ID NO: 1517537 - protein, 25 aa, Mycobacterium tuberculosis
AADRLCYSYFRSYGLDVTIVRPFNI

SEQ ID NO: 1517538 - protein, 17 aa, Mycobacterium tuberculosis
AAEAPTTGLLAAGADEV

SEQ ID NO: 1517539 - protein, 23 aa, Mycobacterium tuberculosis
AAELMGIQIPRFCDHPLLEPVGA

SEQ ID NO: 1517540 - protein, 28 aa, Mycobacterium tuberculosis
AAELTIDALINRVVPIPGLRSTEAQWAR

SEQ ID NO: 1517541 - protein, 26 aa, Mycobacterium tuberculosis
AAFHDQFVHTLTAAARWYTATEIANA

SEQ ID NO: 1517542 - protein, 23 aa, Mycobacterium tuberculosis
AAFHGRFVQALTTGGGAYAAAEA

SEQ ID NO: 1517543 - protein, 19 aa, Mycobacterium tuberculosis
AAFLNVDIPVNIPITGDIT

SEQ ID NO: 1517544 - protein, 24 aa, Mycobacterium tuberculosis
AAGAALATLSAVAGRPAGAAGASG

SEQ ID NO: 1517545 - protein, 26 aa, Mycobacterium tuberculosis
AAGGAGGNAYLFGSGGAGGQGGMGAA

SEQ ID NO: 1517546 - protein, 19 aa, Mycobacterium tuberculosis
AAGGTLFNFGFANDGTLNL

SEQ ID NO: 1517547 - protein, 26 aa, Mycobacterium tuberculosis
AAGNGWRVSGLLRIDEVASATGYRAP

SEQ ID NO: 1517548 - protein, 19 aa, Mycobacterium tuberculosis
AAHLAGVLSLTDAAGLVAA

SEQ ID NO: 1517549 - protein, 23 aa, Mycobacterium tuberculosis
AAIAALFGAHGRAYQAASAEAAA

SEQ ID NO: 1517550 - protein, 20 aa, Mycobacterium tuberculosis
AAIPMMVFSGVMNAGQGCVN

SEQ ID NO: 1517551 - protein, 18 aa, Mycobacterium tuberculosis
AALPALARTPVEAIGVDL

SEQ ID NO: 1517552 - protein, 21 aa, Mycobacterium tuberculosis
AALRALRYRVAHGPGVALAKL

SEQ ID NO: 1517553 - protein, 27 aa, Mycobacterium tuberculosis
AALRDLVARRTPLFEFAIRAAIAEMDL

SEQ ID NO: 1517554 - protein, 17 aa, Mycobacterium tuberculosis
AAMPGNVFLPATTTRLP

SEQ ID NO: 1517555 - protein, 37 aa, Mycobacterium tuberculosis
AAMRVLTGPRWRLGARDLAALWRRALTLSGESPSTAS

SEQ ID NO: 1517556 - protein, 24 aa, Mycobacterium tuberculosis
AANFRDVMIALGLYPDPDAVMGVE

SEQ ID NO: 1517557 - protein, 26 aa, Mycobacterium tuberculosis
AANLKCLCRLHHLLATFCGWRAQQLP

SEQ ID NO: 1517558 - protein, 24 aa, Mycobacterium tuberculosis
AANLKTFFQVYWQGGRDALAERVE

SEQ ID NO: 1517559 - protein, 18 aa, Mycobacterium tuberculosis
AANTPMLLKAGLVDGNTE

SEQ ID NO: 1517560 - protein, 36 aa, Mycobacterium tuberculosis; identical to SEQ ID NO: 215544

SEQ ID NO: 1517561 - protein, 41 aa, Mycobacterium tuberculosis; identical to SEQ ID NO: 237490

SEQ ID NO: 1517562 - protein, 36 aa, Mycobacterium tuberculosis
AAPLEGLLNIVNTPTQLLLGRPLIGNGANGAPGTGQ

SEQ ID NO: 1517563 - protein, 21 aa, Mycobacterium tuberculosis
AAQPGSRLYRNGERGVWKADG

SEQ ID NO: 1517564 - protein, 17 aa, Mycobacterium tuberculosis
AARARWANPAAWRLPGD

SEQ ID NO: 1517565 - protein, 19 aa, Mycobacterium tuberculosis
AARFIRFSDAFDIPLVFVV

SEQ ID NO: 1517566 - protein, 20 aa, Mycobacterium tuberculosis
AARHGCLARRAPLVRTKQGS

SEQ ID NO: 1517567 - protein, 41 aa, Mycobacterium tuberculosis
AARLPAILHQTRYYRSLQLRWPLRMLLGGKPLQHIAADKRR

SEQ ID NO: 1517568 - protein, 24 aa, Mycobacterium tuberculosis
AARVVVPDFQLSLAIGKEGQNARL

SEQ ID NO: 1517569 - protein, 22 aa, Mycobacterium tuberculosis
AATFHAQFVQTLSAGAGAYANA

SEQ ID NO: 1517570 - protein, 25 aa, Mycobacterium tuberculosis
AATVHPAIISANRALFASLVVSNLL

SEQ ID NO: 1517571 - protein, 26 aa, Mycobacterium tuberculosis
AATVHPMLVAANRNAFVQLVLSNLFG

SEQ ID NO: 1517572 - protein, 19 aa, Mycobacterium tuberculosis
AATVPPPVIAANRAQLMVL

SEQ ID NO: 1517573 - protein, 25 aa, Mycobacterium tuberculosis
AAVFTTPCVFYVQNNQWAISMPVSR

SEQ ID NO: 1517574 - protein, 38 aa, Mycobacterium tuberculosis
AAVIDPIVPQLGKGGGRLPITLWIVDTNASTPAPAANL

SEQ ID NO: 1517575 - protein, 21 aa, Mycobacterium tuberculosis
AAVILDSDPWRKLSANRDNRV

SEQ ID NO: 1517576 - protein, 25 aa, Mycobacterium tuberculosis
AAVSRLFGAYGQQFQALNARAATFH

SEQ ID NO: 1517577 - protein, 20 aa, Mycobacterium tuberculosis
ACGLRRLIPLYATVETALAP

SEQ ID NO: 1517578 - protein, 27 aa, Mycobacterium tuberculosis
ADDPVPVRVLYLGRGLAKATLFGPAEV

SEQ ID NO: 1517579 - protein, 20 aa, Mycobacterium tuberculosis
ADDRWRALAVSKAGARAESR

SEQ ID NO: 1517580 - protein, 29 aa, Mycobacterium tuberculosis
ADELDRHLRLPLRDVIWGADADLLDSTEF

SEQ ID NO: 1517581 - protein, 20 aa, Mycobacterium tuberculosis
ADFYALLRQTGQHHGPAFAA

SEQ ID NO: 1517582 - protein, 21 aa, Mycobacterium tuberculosis
ADGGLLLPLGVRRLRSYGSAR

SEQ ID NO: 1517583 - protein, 24 aa, Mycobacterium tuberculosis
ADLQARVDLLRYALHGIAEQGRLE

SEQ ID NO: 1517584 - protein, 27 aa, Mycobacterium tuberculosis
ADPAGWPRLDWSMDAALLLAALASRAG

SEQ ID NO: 1517585 - protein, 24 aa, Mycobacterium tuberculosis
ADPARAARVLGFRAAVDPGEGLRE

SEQ ID NO: 1517586 - protein, 26 aa, Mycobacterium tuberculosis
ADPGNPLAILVPLTAAAMDLVAMGAT

SEQ ID NO: 1517587 - protein, 20 aa, Mycobacterium tuberculosis
ADPQMLRYFASIGISLDSRL

SEQ ID NO: 1517588 - protein, 23 aa, Mycobacterium tuberculosis
ADPVLLEIFNNLFMSIAEQMGFR

SEQ ID NO: 1517589 - protein, 24 aa, Mycobacterium tuberculosis
ADRRWHPRGAGDRAERWGGRNLVG

SEQ ID NO: 1517590 - protein, 17 aa, Mycobacterium tuberculosis
ADSAACRAAFQALELMV

SEQ ID NO: 1517591 - protein, 26 aa, Mycobacterium tuberculosis
ADSAHAAILPLYYLRRAGIAESDLQV

SEQ ID NO: 1517592 - protein, 21 aa, Mycobacterium tuberculosis
ADVLGYFRRIENVTAAWHFVS

SEQ ID NO: 1517593 - protein, 22 aa, Mycobacterium tuberculosis
ADVSRALRLTGRRVMLVPTMGA

SEQ ID NO: 1517594 - protein, 17 aa, Mycobacterium tuberculosis
ADWPRLVAPVFDPKKAV

SEQ ID NO: 1517595 - protein, 23 aa, Mycobacterium tuberculosis
AEAGFPGLAVAAIRVAPFAAWCA

SEQ ID NO: 1517596 - protein, 23 aa, Mycobacterium tuberculosis
AEDVNGLWVTHLGVGQNVTVLGH

SEQ ID NO: 1517597 - protein, 22 aa, Mycobacterium tuberculosis
AEGHYVVYVNDHLLVYGDEWSG

SEQ ID NO: 1517598 - protein, 20 aa, Mycobacterium tuberculosis
AEIGRFLGCQGHRGGAAHAV

SEQ ID NO: 1517599 - protein, 23 aa, Mycobacterium tuberculosis
AELAYLTRALKAPTLRGAIEQLA

SEQ ID NO: 1517600 - protein, 18 aa, Mycobacterium tuberculosis
AELPGEPPRLFVVTRSAA

SEQ ID NO: 1517601 - protein, 25 aa, Mycobacterium tuberculosis
AELPGEPPRLFVVTRSAASVLPSDL

SEQ ID NO: 1517602 - protein, 18 aa, Mycobacterium tuberculosis
AELQLAFQQLLVGDYNAA

SEQ ID NO: 1517603 - protein, 19 aa, Mycobacterium tuberculosis
AELQRIVASIPVKRLRQAG

SEQ ID NO: 1517604 - protein, 25 aa, Mycobacterium tuberculosis
AELRAARRMGSKSPLLALIADCERG

SEQ ID NO: 1517605 - protein, 23 aa, Mycobacterium tuberculosis
AERAQARSWWRIGEPYEGVDVAT

SEQ ID NO: 1517606 - protein, 19 aa, Mycobacterium tuberculosis
AESTPWPTYPLMYRVSAAH

SEQ ID NO: 1517607 - protein, 23 aa, Mycobacterium tuberculosis
AETLIEVALRFVKIRETAWRVTE

SEQ ID NO: 1517608 - protein, 24 aa, Mycobacterium tuberculosis
AEVALPASIRFQQGAYRIHPALLD

SEQ ID NO: 1517609 - protein, 19 aa, Mycobacterium tuberculosis
AEYYAFSPGFDKKAGEWFA

SEQ ID NO: 1517610 - protein, 26 aa, Mycobacterium tuberculosis
AFGASFLARIFPPGSHIPIPFIEYTM

SEQ ID NO: 1517611 - protein, 20 aa, Mycobacterium tuberculosis
AFGDLLSAAGLPAPKYGTAT

SEQ ID NO: 1517612 - protein, 19 aa, Mycobacterium tuberculosis
AFHDQFTLALTSSAGAYAS

SEQ ID NO: 1517613 - protein, 21 aa, Mycobacterium tuberculosis
AFHERFIQALSTAAGAYGSAE

SEQ ID NO: 1517614 - protein, 19 aa, Mycobacterium tuberculosis
AFHQQIVQTLTSTAGAYAS

SEQ ID NO: 1517615 - protein, 26 aa, Mycobacterium tuberculosis
AFIGRLLELAPFRKIVYSSDGFGPAE

SEQ ID NO: 1517616 - protein, 17 aa, Mycobacterium tuberculosis
AFILDRMSQQVDADEHR

SEQ ID NO: 1517617 - protein, 17 aa, Mycobacterium tuberculosis
AFSWLPAQFASQSDAPV

SEQ ID NO: 1517618 - protein, 18 aa, Mycobacterium tuberculosis
AFVQLVLSNLFGQNAPAI

SEQ ID NO: 1517619 - protein, 24 aa, Mycobacterium tuberculosis
AFVQLVLSNLFGQNAPAIAAAEAM

SEQ ID NO: 1517620 - protein, 20 aa, Mycobacterium tuberculosis
AFVRFRIDGKDWPASPLPSL

SEQ ID NO: 1517621 - protein, 37 aa, Mycobacterium tuberculosis
AGAAVDFAVLYPTGRLINAPLPTWNHRRLLLDDTTRR

SEQ ID NO: 1517622 - protein, 25 aa, Mycobacterium tuberculosis
AGAGAYAFAEAANASPLQSAMGAVS

SEQ ID NO: 1517623 - protein, 19 aa, Mycobacterium tuberculosis
AGARWILDLGPGDILTRLT

SEQ ID NO: 1517624 - protein, 18 aa, Mycobacterium tuberculosis
AGFDPARPTAFSAEGLLS

SEQ ID NO: 1517625 - protein, 20 aa, Mycobacterium tuberculosis
AGGAGGILWGNGGAGGSGAP

SEQ ID NO: 1517626 - protein, 20 aa, Mycobacterium tuberculosis
AGGAGGILWGNGGNGGSGAP

SEQ ID NO: 1517627 - protein, 17 aa, Mycobacterium tuberculosis
AGGAGGWLLGNGGAGGP

SEQ ID NO: 1517628 - protein, 33 aa, Mycobacterium tuberculosis
AGGAPGLGGAGGAGGWLIGQSGSTGGGGAGGAG

SEQ ID NO: 1517629 - protein, 25 aa, Mycobacterium tuberculosis
AGGATGLSGAFHIGGKGGVGGSAVL

SEQ ID NO: 1517630 - protein, 23 aa, Mycobacterium tuberculosis
AGGGAGMFSQPGVHGAGGTGGQG

SEQ ID NO: 1517631 - protein, 32 aa, Mycobacterium tuberculosis
AGGKGGAGTLLGLTVFGDNGGAGVLGDSTDPD

SEQ ID NO: 1517632 - protein, 23 aa, Mycobacterium tuberculosis
AGGNAGILFGAGGIGGTGGTGLG

SEQ ID NO: 1517633 - protein, 23 aa, Mycobacterium tuberculosis
AGGNAGWLGFGGAGGIGGIGGNA

SEQ ID NO: 1517634 - protein, 27 aa, Mycobacterium tuberculosis
AGGNGGAGGLLFGNGGNGGNAGAGGDG

SEQ ID NO: 1517635 - protein, 21 aa, Mycobacterium tuberculosis
AGGNGGLFYGNGGVGGRGGNG

SEQ ID NO: 1517636 - protein, 22 aa, Mycobacterium tuberculosis
AGGNGGWLYGNGGLGGNGGAAT

SEQ ID NO: 1517637 - protein, 23 aa, Mycobacterium tuberculosis
AGGNGGWLYGNGGLGGNGGAATQ

SEQ ID NO: 1517638 - protein, 28 aa, Mycobacterium tuberculosis
AGGPGGAGGLISLLGGQGAGGAGGTGGA

SEQ ID NO: 1517639 - protein, 21 aa, Mycobacterium tuberculosis
AGGPGGLLYGNGGNGGSGGVG

SEQ ID NO: 1517640 - protein, 21 aa, Mycobacterium tuberculosis
AGGQGLPFEAGANGGAGGAGG

SEQ ID NO: 1517641 - protein, 24 aa, Mycobacterium tuberculosis
AGGRSGLFEVLAAGGAGGTGGLSV

SEQ ID NO: 1517642 - protein, 17 aa, Mycobacterium tuberculosis
AGGWLFGNGGNGGHGAT

SEQ ID NO: 1517643 - protein, 20 aa, Mycobacterium tuberculosis
AGHKFGGPPGVGALLLRRDV

SEQ ID NO: 1517644 - protein, 18 aa, Mycobacterium tuberculosis
AGIAPSATHRRSIDLSYV

SEQ ID NO: 1517645 - protein, 19 aa, Mycobacterium tuberculosis
AGIPYIAIANAYWSPQARR

SEQ ID NO: 1517646 - protein, 29 aa, Mycobacterium tuberculosis
AGITLSARSAGFAGIRACRRTTAGTSLAA

SEQ ID NO: 1517647 - protein, 33 aa, Mycobacterium tuberculosis
AGKTGMDVCLWLLRNDVCPDKPTWIMPRDSWLI

SEQ ID NO: 1517648 - protein, 17 aa, Mycobacterium tuberculosis
AGKTVFVFPGQGSQWLG

SEQ ID NO: 1517649 - protein, 21 aa, Mycobacterium tuberculosis
AGLCDVKAVWRSGTQVPLQAS

SEQ ID NO: 1517650 - protein, 22 aa, Mycobacterium tuberculosis
AGLLPVPARKVGRLILVDELAS

SEQ ID NO: 1517651 - protein, 18 aa, Mycobacterium tuberculosis
AGLRQWRSLDWGTVEVFL

SEQ ID NO: 1517652 - protein, 29 aa, Mycobacterium tuberculosis
AGLVRSHFGARRKAFNWGLAQVKADLDAK

SEQ ID NO: 1517653 - protein, 19 aa, Mycobacterium tuberculosis
AGPIANWVAACDAMIALDA

SEQ ID NO: 1517654 - protein, 18 aa, Mycobacterium tuberculosis
AGPSTLVRAGAQAFLVDC

SEQ ID NO: 1517655 - protein, 17 aa, Mycobacterium tuberculosis
AGQSWQGAAAAAMAAAA

SEQ ID NO: 1517656 - protein, 25 aa, Mycobacterium tuberculosis
AGSRAAPLLRLPDVRALLDAQLAGR

SEQ ID NO: 1517657 - protein, 23 aa, Mycobacterium tuberculosis
AGSWPYGLPELPGARDQLRGTRR

SEQ ID NO: 1517658 - protein, 20 aa, Mycobacterium tuberculosis
AGTGGNGGLLLGFNGTNGLP

SEQ ID NO: 1517659 - protein, 19 aa, Mycobacterium tuberculosis
AGTLTYAALAAAGDMVSLT

SEQ ID NO: 1517660 - protein, 19 aa, Mycobacterium tuberculosis
AGYLRLMRSGVYVNPVAPP

SEQ ID NO: 1517661 - protein, 24 aa, Mycobacterium tuberculosis
AGYVHLPFQLHVLDMAADRVSHVV

SEQ ID NO: 1517662 - protein, 18 aa, Mycobacterium tuberculosis
AHAAVVYGYFPAVSEGND

SEQ ID NO: 1517663 - protein, 24 aa, Mycobacterium tuberculosis
AHALTAIKRVLPGLGYRLTSRGVR

SEQ ID NO: 1517664 - protein, 17 aa, Mycobacterium tuberculosis
AHDLVDLQLLEGLLLDA

SEQ ID NO: 1517665 - protein, 18 aa, Mycobacterium tuberculosis
AHLRRHAPWGAQVTVTRG

SEQ ID NO: 1517666 - protein, 23 aa, Mycobacterium tuberculosis
AHSPDLDWKSVWDHGWSAAAEAA

SEQ ID NO: 1517667 - protein, 18 aa, Mycobacterium tuberculosis
AHVFSALGVRVTLVIRGS

SEQ ID NO: 1517668 - protein, 23 aa, Mycobacterium tuberculosis
AHVRAWGPRAPFEVLLGKPRAGE

SEQ ID NO: 1517669 - protein, 32 aa, Mycobacterium tuberculosis
AIAAGHSFVIFLREGFPINILNPVQAVPEVCT

SEQ ID NO: 1517670 - protein, 17 aa, Mycobacterium tuberculosis
AIAALFGAHGRAYQAAS

SEQ ID NO: 1517671 - protein, 24 aa, Mycobacterium tuberculosis
AIAGILFLHSGLIALPPDLASGVV

SEQ ID NO: 1517672 - protein, 26 aa, Mycobacterium tuberculosis
AIAIDERALAQRPAWLAAAEALTTEG

SEQ ID NO: 1517673 - protein, 17 aa, Mycobacterium tuberculosis
AIAVQWCRSWPGCTAVA

SEQ ID NO: 1517674 - protein, 26 aa, Mycobacterium tuberculosis
AIGLVKFDLLGLGMLSALHYAKDLVA

SEQ ID NO: 1517675 - protein, 18 aa, Mycobacterium tuberculosis
AILDRTPWRAEEVTVIVA

SEQ ID NO: 1517676 - protein, 17 aa, Mycobacterium tuberculosis
AINAPVQSLTGRPLIGD

SEQ ID NO: 1517677 - protein, 18 aa, Mycobacterium tuberculosis
AIPDRGLFAVYLATERPS

SEQ ID NO: 1517678 - protein, 19 aa, Mycobacterium tuberculosis
AIPDRGLFAVYLATERPSR

SEQ ID NO: 1517679 - protein, 24 aa, Mycobacterium tuberculosis
AIRAWAYQIADLAGDYRVIAFDHR

SEQ ID NO: 1517680 - protein, 19 aa, Mycobacterium tuberculosis
AISAPLRPGSGMPPIGVPV

SEQ ID NO: 1517681 - protein, 17 aa, Mycobacterium tuberculosis
AIVLDRILLDLHADTTI

SEQ ID NO: 1517682 - protein, 23 aa, Mycobacterium tuberculosis
AKEQLGILARLAGAALVAKEDAV

SEQ ID NO: 1517683 - protein, 23 aa, Mycobacterium tuberculosis
AKGAEYPLLPDELAEALAGFIAE

SEQ ID NO: 1517684 - protein, 24 aa, Mycobacterium tuberculosis
AKNDFGLVAIDTLLARMENDRDRL

SEQ ID NO: 1517685 - protein, 24 aa, Mycobacterium tuberculosis
AKRDSEWMGRVHRFLGLQVGVILA

SEQ ID NO: 1517686 - protein, 18 aa, Mycobacterium tuberculosis
AKVAAIPALAATAAPADL

SEQ ID NO: 1517687 - protein, 40 aa, Mycobacterium tuberculosis
AKVSGSRFYFLTGRGALLQLGLLQLALKLAVDNGFVPTIP

SEQ ID NO: 1517688 - protein, 18 aa, Mycobacterium tuberculosis
ALAAFTKSGGRLVESVSA

SEQ ID NO: 1517689 - protein, 31 aa, Mycobacterium tuberculosis
ALAAHRRAHGLPAISLGWGLWDQASAMTGGL

SEQ ID NO: 1517690 - protein, 18 aa, Mycobacterium tuberculosis
ALAEELVALLGADQRTRV

SEQ ID NO: 1517691 - protein, 22 aa, Mycobacterium tuberculosis
ALAGFIAEFGLSLVGGCCGTTP

SEQ ID NO: 1517692 - protein, 19 aa, Mycobacterium tuberculosis
ALALELFEAGDWHLTAPLT

SEQ ID NO: 1517693 - protein, 26 aa, Mycobacterium tuberculosis
ALAMDPQQRLLLEVSWEALERTGIDP

SEQ ID NO: 1517694 - protein, 17 aa, Mycobacterium tuberculosis
ALAPRPGQRLWDVGAGS

SEQ ID NO: 1517695 - protein, 24 aa, Mycobacterium tuberculosis
ALASSLLRVWMTRGRIQEGRAWFD

SEQ ID NO: 1517696 - protein, 25 aa, Mycobacterium tuberculosis
ALATPRRHLSYKTGWYGSSLVVADR

SEQ ID NO: 1517697 - protein, 20 aa, Mycobacterium tuberculosis
ALDAVVRPKTPRGDGNLCEV

SEQ ID NO: 1517698 - protein, 19 aa, Mycobacterium tuberculosis
ALDEGLLPVLPQLSARHHV

SEQ ID NO: 1517699 - protein, 26 aa, Mycobacterium tuberculosis
ALDRGALTAFLSWLESRPSPRARRRS

SEQ ID NO: 1517700 - protein, 27 aa, Mycobacterium tuberculosis
ALDVLNGPFQALFGRPLIGDGANGAPG

SEQ ID NO: 1517701 - protein, 36 aa, Mycobacterium tuberculosis
ALDYSALYPAGRLVDAPLPAWTHARLFIDDDGQEQR

SEQ ID NO: 1517702 - protein, 27 aa, Mycobacterium tuberculosis
ALELGCGTGFFLLNLIQAGVARRGSVT

SEQ ID NO: 1517703 - protein, 27 aa, Mycobacterium tuberculosis
ALEPVNPPKPPPAIKIDPPPPPQEQGL

SEQ ID NO: 1517704 - protein, 25 aa, Mycobacterium tuberculosis
ALFHDRFVQILQEGAAAYAMAEAAN

SEQ ID NO: 1517705 - protein, 19 aa, Mycobacterium tuberculosis
ALFHEQFVRALTAGAGSYA

SEQ ID NO: 1517706 - protein, 17 aa, Mycobacterium tuberculosis
ALGIYPGAAELGAEGAG

SEQ ID NO: 1517707 - protein, 19 aa, Mycobacterium tuberculosis
ALGMVFGRKRPGSGPLMIG

SEQ ID NO: 1517708 - protein, 23 aa, Mycobacterium tuberculosis
ALGVNWRVRCETGEPAAAASPVG

SEQ ID NO: 1517709 - protein, 28 aa, Mycobacterium tuberculosis
ALKGIALYLNFDMLASPNPGYFTYDGDQ

SEQ ID NO: 1517710 - protein, 19 aa, Mycobacterium tuberculosis
ALLAGCTIVLKPAAETPLT

SEQ ID NO: 1517711 - protein, 17 aa, Mycobacterium tuberculosis
ALLDLLHPNGRAVIERA

SEQ ID NO: 1517712 - protein, 19 aa, Mycobacterium tuberculosis
ALLGPINAGLVIPPVPGFG

SEQ ID NO: 1517713 - protein, 21 aa, Mycobacterium tuberculosis
ALMFHRGTFVGTATPRAYPFT

SEQ ID NO: 1517714 - protein, 17 aa, Mycobacterium tuberculosis
ALNFAAVFTTPCVFYVQ

SEQ ID NO: 1517715 - protein, 20 aa, Mycobacterium tuberculosis
ALPAGLALAASFNPVLARSS

SEQ ID NO: 1517716 - protein, 17 aa, Mycobacterium tuberculosis
ALPPYRYSQRELTDSFV

SEQ ID NO: 1517717 - protein, 26 aa, Mycobacterium tuberculosis
ALRGDRTMFLFVFRAEHDNPGVAPKD

SEQ ID NO: 1517718 - protein, 17 aa, Mycobacterium tuberculosis
ALRGLLKPIYEENQLGR

SEQ ID NO: 1517719 - protein, 23 aa, Mycobacterium tuberculosis
ALRYYLIERNALPDRPLIAMVPV

SEQ ID NO: 1517720 - protein, 28 aa, Mycobacterium tuberculosis
ALSAQAAAFHQQFVQTLAGGAGAYAAAE

SEQ ID NO: 1517721 - protein, 19 aa, Mycobacterium tuberculosis
ALTQRRLYIGNPSEITDTR

SEQ ID NO: 1517722 - protein, 18 aa, Mycobacterium tuberculosis
ALVAQRRGYKCVFVCPDK

SEQ ID NO: 1517723 - protein, 24 aa, Mycobacterium tuberculosis
AMAAAAAPYAGWLGSVAAAAEAVA

SEQ ID NO: 1517724 - protein, 18 aa, Mycobacterium tuberculosis
AMTIWRVPSKVTSGPVSA

SEQ ID NO: 1517725 - protein, 17 aa, Mycobacterium tuberculosis
AMTLDRSILRQLGMGRR

SEQ ID NO: 1517726 - protein, 24 aa, Mycobacterium tuberculosis
ANGALKFPSLHASPPMLAGKHIWE

SEQ ID NO: 1517727 - protein, 17 aa, Mycobacterium tuberculosis
ANHRYLGPVLWSPDVKP

SEQ ID NO: 1517728 - protein, 17 aa, Mycobacterium tuberculosis
ANKIFIEKAVDLGVQAL

SEQ ID NO: 1517729 - protein, 23 aa, Mycobacterium tuberculosis
ANRSRILGFYRLAMVFRHRAALH

SEQ ID NO: 1517730 - protein, 26 aa, Mycobacterium tuberculosis
APAGSGAMGSTGFAGGAGGDGGNGGG

SEQ ID NO: 1517731 - protein, 20 aa, Mycobacterium tuberculosis
APDKLQFTTFGDPTGRHAFG

SEQ ID NO: 1517732 - protein, 17 aa, Mycobacterium tuberculosis
APELRATQMDHVRFTEG

SEQ ID NO: 1517733 - protein, 19 aa, Mycobacterium tuberculosis
APFAFEGVFGHLAATAVPG

SEQ ID NO: 1517734 - protein, 19 aa, Mycobacterium tuberculosis
APGAFARLNRRLCGGWYGG

SEQ ID NO: 1517735 - protein, 25 aa, Mycobacterium tuberculosis
APGGLPLSGLLRGVGDEPELTDFDE

SEQ ID NO: 1517736 - protein, 19 aa, Mycobacterium tuberculosis
APLALAMALGRVPAPLRPP

SEQ ID NO: 1517737 - protein, 20 aa, Mycobacterium tuberculosis
APLDRRLLLGMLAELPAGAG

SEQ ID NO: 1517738 - protein, 20 aa, Mycobacterium tuberculosis
APMEPADPLRPLLEHTRGLG

SEQ ID NO: 1517739 - protein, 19 aa, Mycobacterium tuberculosis
APPVGGLHLQFGRNASTEM

SEQ ID NO: 1517740 - protein, 19 aa, Mycobacterium tuberculosis
APQPIPESALLTGPLEPTN

SEQ ID NO: 1517741 - protein, 19 aa, Mycobacterium tuberculosis
APRLSRRILHQLYLGYPDS

SEQ ID NO: 1517742 - protein, 26 aa, Mycobacterium tuberculosis
APRLSRRILHQLYLGYPDSAAAQGIS

SEQ ID NO: 1517743 - protein, 23 aa, Mycobacterium tuberculosis
APRQWRGLRRWLGEPEDFQDPKY

SEQ ID NO: 1517744 - protein, 22 aa, Mycobacterium tuberculosis
APSEILPFTVLLSSLGVTHLTP

SEQ ID NO: 1517745 - protein, 23 aa, Mycobacterium tuberculosis
APSEILPFTVLLSSLGVTHLTPE

SEQ ID NO: 1517746 - protein, 21 aa, Mycobacterium tuberculosis
APSLVIRIAPPVGRQLDWMVC

SEQ ID NO: 1517747 - protein, 20 aa, Mycobacterium tuberculosis
APTQTLLGRPLIGNGADGVA

SEQ ID NO: 1517748 - protein, 19 aa, Mycobacterium tuberculosis
APVQSLTGRPLIGDGANGI

SEQ ID NO: 1517749 - protein, 18 aa, Mycobacterium tuberculosis
APVVEPPTPPTPASAAEP

SEQ ID NO: 1517750 - protein, 28 aa, Mycobacterium tuberculosis
AQAAAFHDRFVQLLNAGGGSYASAEIAN

SEQ ID NO: 1517751 - protein, 20 aa, Mycobacterium tuberculosis
AQEGFLVRPFTQQCQIIHTE

SEQ ID NO: 1517752 - protein, 17 aa, Mycobacterium tuberculosis
AQKLGWTGVPVSSSYAA

SEQ ID NO: 1517753 - protein, 18 aa, Mycobacterium tuberculosis
AQLLAALGRRYDGDERLS

SEQ ID NO: 1517754 - protein, 24 aa, Mycobacterium tuberculosis
AQLLDILRTEIWPLLADRSPITKL

SEQ ID NO: 1517755 - protein, 34 aa, Mycobacterium tuberculosis
AQPALFAVEVALFRLLGSWGVRPDFVMGHSIGEL

SEQ ID NO: 1517756 - protein, 19 aa, Mycobacterium tuberculosis
AQPFFDPSASFPPAPASAN

SEQ ID NO: 1517757 - protein, 18 aa, Mycobacterium tuberculosis
AQPGSRLYRNGERGVWKA

SEQ ID NO: 1517758 - protein, 24 aa, Mycobacterium tuberculosis
AQPPKPRVFAIKPPCPEPAAADPT

SEQ ID NO: 1517759 - protein, 23 aa, Mycobacterium tuberculosis
AQRRDMMWICRDGDRAKNHLLEA

SEQ ID NO: 1517760 - protein, 28 aa, Mycobacterium tuberculosis
AQTRISGVLIDLRPYRPPDAARRHNGGK

SEQ ID NO: 1517761 - protein, 20 aa, Mycobacterium tuberculosis
AQYWSEICQIPISFITETVK

SEQ ID NO: 1517762 - protein, 25 aa, Mycobacterium tuberculosis
ARALDARLRLVLEVPTLREVPTWHR

SEQ ID NO: 1517763 - protein, 25 aa, Mycobacterium tuberculosis
ARAWQLELVVPILTAALTGAPDAGA

SEQ ID NO: 1517764 - protein, 26 aa, Mycobacterium tuberculosis
ARDLTAPPVWFIKTIGDAVMLVCPDP

SEQ ID NO: 1517765 - protein, 25 aa, Mycobacterium tuberculosis
AREHGLPFLFFTDQATGRGQLLYSR

SEQ ID NO: 1517766 - protein, 33 aa, Mycobacterium tuberculosis
ARFAKIFDVNLWAPLMWTSLVVTAWMGEHGGAV

SEQ ID NO: 1517767 - protein, 22 aa, Mycobacterium tuberculosis
ARGIEIGHIFQLGSKYTDAFTA

SEQ ID NO: 1517768 - protein, 19 aa, Mycobacterium tuberculosis
ARHFGARRKAFNWTVTALK

SEQ ID NO: 1517769 - protein, 18 aa, Mycobacterium tuberculosis
ARHRVVRHPVVGVPGVAG

SEQ ID NO: 1517770 - protein, 21 aa, Mycobacterium tuberculosis
ARKLPDWPTGPLPKVRVAAAL

SEQ ID NO: 1517771 - protein, 17 aa, Mycobacterium tuberculosis
ARLAIQHGYPIVPFASV

SEQ ID NO: 1517772 - protein, 20 aa, Mycobacterium tuberculosis
ARLDSLFRLDHLAARLRRNS

SEQ ID NO: 1517773 - protein, 20 aa, Mycobacterium tuberculosis
ARLLGYLIGDGRDGWVGGKT

SEQ ID NO: 1517774 - protein, 21 aa, Mycobacterium tuberculosis
ARLLSIPLRHLYAALWRVGLL

SEQ ID NO: 1517775 - protein, 18 aa, Mycobacterium tuberculosis
ARLNRRLCGGWYGGLFQD

SEQ ID NO: 1517776 - protein, 39 aa, Mycobacterium tuberculosis
ARLPAILHQTRYYRSLQLRWPLRMLLGGKPLQHIAADKR

SEQ ID NO: 1517777 - protein, 18 aa, Mycobacterium tuberculosis
ARPLWAPDYPVGAQVRRA

SEQ ID NO: 1517778 - protein, 21 aa, Mycobacterium tuberculosis
ARRILGWRVASTMATSMVLDA

SEQ ID NO: 1517779 - protein, 23 aa, Mycobacterium tuberculosis
ARRRRRVTRRGYGDEFMDMNIDV

SEQ ID NO: 1517780 - protein, 24 aa, Mycobacterium tuberculosis
ARSRRPCRMPVAPGCGSWPKTSTP

SEQ ID NO: 1517781 - protein, 23 aa, Mycobacterium tuberculosis
ARTDPMLLAWTVPVVDLDPTAAL

SEQ ID NO: 1517782 - protein, 18 aa, Mycobacterium tuberculosis
ARVGWNRRQLSAVGGRGQ

SEQ ID NO: 1517783 - protein, 28 aa, Mycobacterium tuberculosis
ARVPTPQRRRPYRPPPRPNSEALKAVVA

SEQ ID NO: 1517784 - protein, 17 aa, Mycobacterium tuberculosis
ARVVTLRSKLLAGLAGP

SEQ ID NO: 1517785 - protein, 25 aa, Mycobacterium tuberculosis
ASAFQSVVWGLTVGSWIGSSAGLMV

SEQ ID NO: 1517786 - protein, 17 aa, Mycobacterium tuberculosis
ASAWTGLAGDLGSAAAS

SEQ ID NO: 1517787 - protein, 27 aa, Mycobacterium tuberculosis
ASCATIEVTGPWYGGWAARGPADGVAS

SEQ ID NO: 1517788 - protein, 17 aa, Mycobacterium tuberculosis
ASDRLRLEGYRRLAAAS

SEQ ID NO: 1517789 - protein, 26 aa, Mycobacterium tuberculosis
ASGLDARAYRLAWPVGSIVYEVDMPE

SEQ ID NO: 1517790 - protein, 27 aa, Mycobacterium tuberculosis
ASGPAPFPAVPVDLPAPADIANGALFA

SEQ ID NO: 1517791 - protein, 23 aa, Mycobacterium tuberculosis
ASGRIAHTLGLHGPAMTFDTACS

SEQ ID NO: 1517792 - protein, 25 aa, Mycobacterium tuberculosis
ASLPDGALMRRAAFGLATEIGRELT

SEQ ID NO: 1517793 - protein, 37 aa, Mycobacterium tuberculosis
ASPLQQALNVINAPTQTLLGRPLIGNGTNGAPGTGQA

SEQ ID NO: 1517794 - protein, 22 aa, Mycobacterium tuberculosis
ASPRRALSELLRRGTRNLTGAD

SEQ ID NO: 1517795 - protein, 17 aa, Mycobacterium tuberculosis
ASPVHAATLLPFIGRLL

SEQ ID NO: 1517796 - protein, 22 aa, Mycobacterium tuberculosis
ASPVHAATLLPFIGRLLAARYA

SEQ ID NO: 1517797 - protein, 34 aa, Mycobacterium tuberculosis
ASRASATLIWRRPRWARRLQPAPIADLLTEGHAL

SEQ ID NO: 1517798 - protein, 21 aa, Mycobacterium tuberculosis
ASTLGLSMPANLSGGGNVGAT

SEQ ID NO: 1517799 - protein, 18 aa, Mycobacterium tuberculosis
ASVVLSWARVHEPDMDRV

SEQ ID NO: 1517800 - protein, 27 aa, Mycobacterium tuberculosis
ATAAQPLEWFCLFSSAAALVGSPGQGA

SEQ ID NO: 1517801 - protein, 26 aa, Mycobacterium tuberculosis
ATAETWPNPWPMYRALRDHDPVHHVV

SEQ ID NO: 1517802 - protein, 23 aa, Mycobacterium tuberculosis
ATAFRNFQYTVQAQKLWAQAGFR

SEQ ID NO: 1517803 - protein, 21 aa, Mycobacterium tuberculosis
ATFAKGAMYWSPVTDAQPITG

SEQ ID NO: 1517804 - protein, 21 aa, Mycobacterium tuberculosis
ATFHAQFVQTLSAGAGAYANA

SEQ ID NO: 1517805 - protein, 20 aa, Mycobacterium tuberculosis
ATFHDRFVQTLSATASSYVA

SEQ ID NO: 1517806 - protein, 23 aa, Mycobacterium tuberculosis
ATGGQGGDFALGGNGGAGGAGGS

SEQ ID NO: 1517807 - protein, 35 aa, Mycobacterium tuberculosis
ATGRIRAMRLALLAEQLPAREALAWGLISAVYPDS

SEQ ID NO: 1517808 - protein, 30 aa, Mycobacterium tuberculosis
ATHNEPMIPIYIFYSMFGFQRTGDSFWAAA

SEQ ID NO: 1517809 - protein, 17 aa, Mycobacterium tuberculosis
ATILLRLDQDVPDDVRT

SEQ ID NO: 1517810 - protein, 20 aa, Mycobacterium tuberculosis
ATLKKGTFLGLTALTRQPDP

SEQ ID NO: 1517811 - protein, 17 aa, Mycobacterium tuberculosis
ATMLFNHPTVKSLASYL

SEQ ID NO: 1517812 - protein, 28 aa, Mycobacterium tuberculosis
ATMRAIENALTLILGLPTGPERGEAATH

SEQ ID NO: 1517813 - protein, 23 aa, Mycobacterium tuberculosis
ATNPSWVMLYQYGNPANTDSHYC

SEQ ID NO: 1517814 - protein, 17 aa, Mycobacterium tuberculosis
ATPALVPGVSAPGGLPL

SEQ ID NO: 1517815 - protein, 21 aa, Mycobacterium tuberculosis
ATQRAFLRYGKGRHRAALNFG

SEQ ID NO: 1517816 - protein, 27 aa, Mycobacterium tuberculosis
ATQSVPPVTLRQALLGKVMTVGDAVSL

SEQ ID NO: 1517817 - protein, 25 aa, Mycobacterium tuberculosis
ATRDFAIGLAGIPPSLQSALQALAA

SEQ ID NO: 1517818 - protein, 24 aa, Mycobacterium tuberculosis
ATRKSLLEALLNPVPTGDLNLDEI

SEQ ID NO: 1517819 - protein, 17 aa, Mycobacterium tuberculosis
ATRPHHVIDSVAGLPPL

SEQ ID NO: 1517820 - protein, 18 aa, Mycobacterium tuberculosis
ATRRPVVAVLNKADLAGP

SEQ ID NO: 1517821 - protein, 20 aa, Mycobacterium tuberculosis
ATVHPALVAANRALVAWLAG

SEQ ID NO: 1517822 - protein, 18 aa, Mycobacterium tuberculosis
AVDIPALNLRRQLRAIWV

SEQ ID NO: 1517823 - protein, 19 aa, Mycobacterium tuberculosis
AVDRAILRVSVWELLHAAD

SEQ ID NO: 1517824 - protein, 20 aa, Mycobacterium tuberculosis
AVEHLFAVASGLDSAVIGEQ

SEQ ID NO: 1517825 - protein, 20 aa, Mycobacterium tuberculosis
AVFPTILARATPGDGWASLA

SEQ ID NO: 1517826 - protein, 23 aa, Mycobacterium tuberculosis
AVIIDQLRVIRGKRLALQDVSVR

SEQ ID NO: 1517827 - protein, 17 aa, Mycobacterium tuberculosis
AVLLGALPPRVSPVSDG

SEQ ID NO: 1517828 - protein, 33 aa, Mycobacterium tuberculosis; identical to SEQ ID NO: 225994

SEQ ID NO: 1517829 - protein, 17 aa, Mycobacterium tuberculosis
AVNAPTQTLLGRPLVGD

SEQ ID NO: 1517830 - protein, 21 aa, Mycobacterium tuberculosis
AVPAGPLPAYGSDLRPPVVAA

SEQ ID NO: 1517831 - protein, 21 aa, Mycobacterium tuberculosis
AVPHLVSLPGYPFARQRHWVE

SEQ ID NO: 1517832 - protein, 17 aa, Mycobacterium tuberculosis
AVPRLLARNGLSLQDFD

SEQ ID NO: 1517833 - protein, 17 aa, Mycobacterium tuberculosis
AVRRRDSLPRIAQAIAL

SEQ ID NO: 1517834 - protein, 24 aa, Mycobacterium tuberculosis
AVSRLFGAYGQQFQALNARAATFH

SEQ ID NO: 1517835 - protein, 21 aa, Mycobacterium tuberculosis
AVTVFLAPPSWQDLQARLIGR

SEQ ID NO: 1517836 - protein, 19 aa, Mycobacterium tuberculosis
AVTWLDTPKRFLSTQTASR

SEQ ID NO: 1517837 - protein, 27 aa, Mycobacterium tuberculosis
AWIAEGLLIYLPATAQERLFTGIDALA

SEQ ID NO: 1517838 - protein, 25 aa, Mycobacterium tuberculosis
AWRDNEWYVARLCPTPLRPQERRTI

SEQ ID NO: 1517839 - protein, 23 aa, Mycobacterium tuberculosis
AWRNGDWYVARLTPSPLGHEERR

SEQ ID NO: 1517840 - protein, 24 aa, Mycobacterium tuberculosis
AWSDIGQLGWWSASPARASALEES

SEQ ID NO: 1517841 - protein, 17 aa, Mycobacterium tuberculosis
AWSDMGPLDFPRLNWAP

SEQ ID NO: 1517842 - protein, 25 aa, Mycobacterium tuberculosis
AYAEGLRALYLYTATFQDAAVAEVV

SEQ ID NO: 1517843 - protein, 18 aa, Mycobacterium tuberculosis
AYEQLWAADVAAMVSYHS

SEQ ID NO: 1517844 - protein, 20 aa, Mycobacterium tuberculosis
AYGLTVPPPVIAENRAELMI

SEQ ID NO: 1517845 - protein, 22 aa, Mycobacterium tuberculosis
AYHAEPFIYLMPEGQLPRTGAV

SEQ ID NO: 1517846 - protein, 33 aa, Mycobacterium tuberculosis
AYNGALDIDLVFSPFFNALPIRRLGLHERAESI

SEQ ID NO: 1517847 - protein, 21 aa, Mycobacterium tuberculosis
AYQERFVLALSQASSTYAVAE

SEQ ID NO: 1517848 - protein, 23 aa, Mycobacterium tuberculosis
AYQERFVLALSQASSTYAVAEAA

SEQ ID NO: 1517849 - protein, 22 aa, Mycobacterium tuberculosis
CAELSMLLLDTAAMADLHMRWM

SEQ ID NO: 1517850 - protein, 23 aa, Mycobacterium tuberculosis
CAGEKMMLLFESANFDEAVFCEP

SEQ ID NO: 1517851 - protein, 26 aa, Mycobacterium tuberculosis
CCQYDPLMSPLVWDLAHIGQQEELWL

SEQ ID NO: 1517852 - protein, 17 aa, Mycobacterium tuberculosis
CDRLGLLPMYAVNQDKH

SEQ ID NO: 1517853 - protein, 24 aa, Mycobacterium tuberculosis
CETSYVRLGLAAQLARQLGAPVVR

SEQ ID NO: 1517854 - protein, 22 aa, Mycobacterium tuberculosis
CFLLQKVLDLPAGQLPPEPPIW

SEQ ID NO: 1517855 - protein, 23 aa, Mycobacterium tuberculosis
CGDCALNRGVFADAYGVVGAVGE

SEQ ID NO: 1517856 - protein, 26 aa, Mycobacterium tuberculosis
CGELGLPYLVLARPPWDPGTAIIAVS

SEQ ID NO: 1517857 - protein, 20 aa, Mycobacterium tuberculosis
CGRDYRVLSAALLEVTFCGF

SEQ ID NO: 1517858 - protein, 26 aa, Mycobacterium tuberculosis
CIASASRWRHIIPAGVVCALIAGIGV

SEQ ID NO: 1517859 - protein, 18 aa, Mycobacterium tuberculosis
CIGVSLLVDRQSGRCIAT

SEQ ID NO: 1517860 - protein, 22 aa, Mycobacterium tuberculosis
CPDRRRVVVHPAVIGLAGHRGV

SEQ ID NO: 1517861 - protein, 18 aa, Mycobacterium tuberculosis
CPPPTLEALRAHVARTLD

SEQ ID NO: 1517862 - protein, 22 aa, Mycobacterium tuberculosis
CQTGRRFPRVAPRLNRLMTNMM

SEQ ID NO: 1517863 - protein, 18 aa, Mycobacterium tuberculosis
CRRALRQIGVLERPVGDS

SEQ ID NO: 1517864 - protein, 19 aa, Mycobacterium tuberculosis
CRRLDGIPLAIEFAAARVR

SEQ ID NO: 1517865 - protein, 30 aa, Mycobacterium tuberculosis
CSARMYFAYGLGNSVWFPLATGGSAVINSA

SEQ ID NO: 1517866 - protein, 26 aa, Mycobacterium tuberculosis
CSVVAAATAILAVVLAIGGCSTEGDA

SEQ ID NO: 1517867 - protein, 18 aa, Mycobacterium tuberculosis
CVAILAPQGIDYVCGFYA

SEQ ID NO: 1517868 - protein, 23 aa, Mycobacterium tuberculosis
DAAFGRIANALPAAARAAAQERP

SEQ ID NO: 1517869 - protein, 22 aa, Mycobacterium tuberculosis
DAALVHHYFGTKQQLFAAAIHI

SEQ ID NO: 1517870 - protein, 18 aa, Mycobacterium tuberculosis
DAAWRPDTVWRYRLGSGE

SEQ ID NO: 1517871 - protein, 26 aa, Mycobacterium tuberculosis
DAEPGRITVILALHDLINGGHVGHYG

SEQ ID NO: 1517872 - protein, 24 aa, Mycobacterium tuberculosis
DAERDWEDFWAATRPVELTATVEQ

SEQ ID NO: 1517873 - protein, 26 aa, Mycobacterium tuberculosis
DAEVLIDLVRRYAPKLALIVTSHQHF

SEQ ID NO: 1517874 - protein, 19 aa, Mycobacterium tuberculosis
DAFARIFGGSIVPQEVEAL

SEQ ID NO: 1517875 - protein, 28 aa, Mycobacterium tuberculosis
DAFHAWVQQFYGAELLFDLGDLPGAADR

SEQ ID NO: 1517876 - protein, 21 aa, Mycobacterium tuberculosis
DAGLLVGSGGVGGAGGFGLTT

SEQ ID NO: 1517877 - protein, 31 aa, Mycobacterium tuberculosis
DALAAHRRAHGLPAISLGWGLWDQASAMTGG

SEQ ID NO: 1517878 - protein, 20 aa, Mycobacterium tuberculosis
DALFLWAETPTRPLHVGALA

SEQ ID NO: 1517879 - protein, 25 aa, Mycobacterium tuberculosis
DALGIRTVLIPPMAGVLSALGIGLA

SEQ ID NO: 1517880 - protein, 22 aa, Mycobacterium tuberculosis
DALWAATFLRRRGAAADAVLLN

SEQ ID NO: 1517881 - protein, 20 aa, Mycobacterium tuberculosis
DAMFPARAFDALAAWVRAAA

SEQ ID NO: 1517882 - protein, 20 aa, Mycobacterium tuberculosis
DAMLYAKRPLMSDAMLRVFF

SEQ ID NO: 1517883 - protein, 20 aa, Mycobacterium tuberculosis
DAPLNWCNPSGRALGAPPTT

SEQ ID NO: 1517884 - protein, 23 aa, Mycobacterium tuberculosis
DAPMAGVTYWREAAQLKRNEAND

SEQ ID NO: 1517885 - protein, 19 aa, Mycobacterium tuberculosis
DARRLGHPVLALVRGSAVN

SEQ ID NO: 1517886 - protein, 32 aa, Mycobacterium tuberculosis
DASDLSNILLLGPVGDLFPILSIPGAMSQNFT

SEQ ID NO: 1517887 - protein, 35 aa, Mycobacterium tuberculosis
DASDLSNILLLGPVGDLFPILSIPGAMSQNFTNVV

SEQ ID NO: 1517888 - protein, 17 aa, Mycobacterium tuberculosis
DCFARIAPGLPSSVIRI

SEQ ID NO: 1517889 - protein, 24 aa, Mycobacterium tuberculosis
DCFLLQKVLDLPAGQLPPEPPIWP

SEQ ID NO: 1517890 - protein, 20 aa, Mycobacterium tuberculosis
DCIAVIAPSDSECAPAAAGC

SEQ ID NO: 1517891 - protein, 17 aa, Mycobacterium tuberculosis
DDGVFPRLSHPDGDDVL

SEQ ID NO: 1517892 - protein, 20 aa, Mycobacterium tuberculosis
DDLITAHLRGWTLDRLPAVD

SEQ ID NO: 1517893 - protein, 21 aa, Mycobacterium tuberculosis
DDLLVAVLEEVIYLLDTVGET

SEQ ID NO: 1517894 - protein, 17 aa, Mycobacterium tuberculosis
DDMVAACLKWEGGYVWA

SEQ ID NO: 1517895 - protein, 21 aa, Mycobacterium tuberculosis
DDPDYVIYQRLIDGVWTDVTC

SEQ ID NO: 1517896 - protein, 17 aa, Mycobacterium tuberculosis
DDPVMSWLLSKDNARTA

SEQ ID NO: 1517897 - protein, 18 aa, Mycobacterium tuberculosis
DDPVMSWLLSKDNARTAR

SEQ ID NO: 1517898 - protein, 25 aa, Mycobacterium tuberculosis
DDPVPVRVLYLGRGLAKATLFGPAE

SEQ ID NO: 1517899 - protein, 23 aa, Mycobacterium tuberculosis
DDRGPVWLFSGQGSQWAAMGADL

SEQ ID NO: 1517900 - protein, 26 aa, Mycobacterium tuberculosis
DDTLFLERFVLRPRHIEVQVLADAHG

SEQ ID NO: 1517901 - protein, 23 aa, Mycobacterium tuberculosis
DDVNLRRLLSLFEQLREQSQIII

SEQ ID NO: 1517902 - protein, 22 aa, Mycobacterium tuberculosis
DEFMDMNIDVDPDWGPPPGEDP

SEQ ID NO: 1517903 - protein, 20 aa, Mycobacterium tuberculosis
DELGLRWPSTVAPFDVHLVI

SEQ ID NO: 1517904 - protein, 19 aa, Mycobacterium tuberculosis
DELGTALLLITHDLALAAQ

SEQ ID NO: 1517905 - protein, 19 aa, Mycobacterium tuberculosis
DELIDRCWAPKVHGAWNIH

SEQ ID NO: 1517906 - protein, 20 aa, Mycobacterium tuberculosis
DELIDRCWAPKVHGAWNIHR

SEQ ID NO: 1517907 - protein, 19 aa, Mycobacterium tuberculosis
DELLARDWAPKVHGAWELH

SEQ ID NO: 1517908 - protein, 29 aa, Mycobacterium tuberculosis
DELRSLLRFVLDLLADYGLTDFYLELSTK

SEQ ID NO: 1517909 - protein, 17 aa, Mycobacterium tuberculosis
DEPFMLPAHIDFAALKV

SEQ ID NO: 1517910 - protein, 26 aa, Mycobacterium tuberculosis
DEQMSALLMAIVWRGMDRGEIARWTA

SEQ ID NO: 1517911 - protein, 17 aa, Mycobacterium tuberculosis
DERRRLQGQPPLGPVLM

SEQ ID NO: 1517912 - protein, 24 aa, Mycobacterium tuberculosis
DESAFTAGHPLVQPPATCGMKATS

SEQ ID NO: 1517913 - protein, 26 aa, Mycobacterium tuberculosis
DESNPLPPPWYPQPASLPAAGATGQP

SEQ ID NO: 1517914 - protein, 26 aa, Mycobacterium tuberculosis
DETGMVNVLCTPGVWARHRKLAHTAP

SEQ ID NO: 1517915 - protein, 23 aa, Mycobacterium tuberculosis
DEVARYLFRRVVSWGRSSNVFLR

SEQ ID NO: 1517916 - protein, 22 aa, Mycobacterium tuberculosis
DEVSAAIATLFGSHAREYQAIS

SEQ ID NO: 1517917 - protein, 30 aa, Mycobacterium tuberculosis; identical to SEQ ID NO: 228301

SEQ ID NO: 1517918 - protein, 19 aa, Mycobacterium tuberculosis
DFFEGVMMPELLMADAMGA

SEQ ID NO: 1517919 - protein, 21 aa, Mycobacterium tuberculosis
DFGAFVSLLPGRDGLVHISKL

SEQ ID NO: 1517920 - protein, 18 aa, Mycobacterium tuberculosis
DFTDPRIATPMLARIGGA

SEQ ID NO: 1517921 - protein, 28 aa, Mycobacterium tuberculosis
DFVEFTPSHTPLLITNHLPRVPGDDTAI

SEQ ID NO: 1517922 - protein, 21 aa, Mycobacterium tuberculosis
DFVRDLAAPLPMAVIGDMLGV

SEQ ID NO: 1517923 - protein, 25 aa, Mycobacterium tuberculosis
DGAHGALGGLTVAGGNGGAGGAGGA

SEQ ID NO: 1517924 - protein, 25 aa, Mycobacterium tuberculosis
DGASMWFRSFFGVPSSITAPDGRPV

SEQ ID NO: 1517925 - protein, 26 aa, Mycobacterium tuberculosis
DGGDGGWGRPGGQGGFGSTSGAHGKA

SEQ ID NO: 1517926 - protein, 22 aa, Mycobacterium tuberculosis
DGGLHLLVHLLVDERITQRQQL

SEQ ID NO: 1517927 - protein, 27 aa, Mycobacterium tuberculosis
DGGNGAPGGFGGGAGAGGLGGSGAGGG

SEQ ID NO: 1517928 - protein, 36 aa, Mycobacterium tuberculosis
DGGRDEQLLLLPLTSLRGLRHTLKKLSGLRARNGLL

SEQ ID NO: 1517929 - protein, 27 aa, Mycobacterium tuberculosis
DGGTGGRGGLLMGAGAGGHGGTGGAGG

SEQ ID NO: 1517930 - protein, 20 aa, Mycobacterium tuberculosis
DGGVQALRIWGAGATGSRLV

SEQ ID NO: 1517931 - protein, 18 aa, Mycobacterium tuberculosis
DGGWLIGNGGAGGSGAAG

SEQ ID NO: 1517932 - protein, 19 aa, Mycobacterium tuberculosis
DGGWLIGNGGAGGSGAAGV

SEQ ID NO: 1517933 - protein, 23 aa, Mycobacterium tuberculosis
DGHKWAMLTAYDYSTARIFDEAG

SEQ ID NO: 1517934 - protein, 23 aa, Mycobacterium tuberculosis
DGLETVLHIFPTLAANINQLYHP

SEQ ID NO: 1517935 - protein, 20 aa, Mycobacterium tuberculosis
DGLVRFIDACHARRLGVLID

SEQ ID NO: 1517936 - protein, 26 aa, Mycobacterium tuberculosis
DGNTFQQLPFALAPGPPVPTTALRES

SEQ ID NO: 1517937 - protein, 18 aa, Mycobacterium tuberculosis
DGSYLAELLLAKGYEVHG

SEQ ID NO: 1517938 - protein, 17 aa, Mycobacterium tuberculosis
DGTSVFFDYPPHPRTIA

SEQ ID NO: 1517939 - protein, 20 aa, Mycobacterium tuberculosis
DGVLVCVAQCRPNTGPTVVH

SEQ ID NO: 1517940 - protein, 21 aa, Mycobacterium tuberculosis
DGYGLHIIERVPLPVRANAEN

SEQ ID NO: 1517941 - protein, 21 aa, Mycobacterium tuberculosis
DGYVWHAYLPNITPGQRYGFR

SEQ ID NO: 1517942 - protein, 18 aa, Mycobacterium tuberculosis
DHIEAIANWDPKAEPSIE

SEQ ID NO: 1517943 - protein, 31 aa, Mycobacterium tuberculosis
DHLIEIPAVSTLLQPLLSTIPLQVFAASVAR

SEQ ID NO: 1517944 - protein, 23 aa, Mycobacterium tuberculosis
DHVASVFRHEDLASALAATELTE

SEQ ID NO: 1517945 - protein, 27 aa, Mycobacterium tuberculosis
DIADMRNWRPGWFPTMHSRCLSNLIHD

SEQ ID NO: 1517946 - protein, 17 aa, Mycobacterium tuberculosis
DIDRLVELFTAEAIWEM

SEQ ID NO: 1517947 - protein, 17 aa, Mycobacterium tuberculosis
DIGLGPMPLNGSGRLLV

SEQ ID NO: 1517948 - protein, 17 aa, Mycobacterium tuberculosis
DIKRAYRKLARELHPDV

SEQ ID NO: 1517949 - protein, 17 aa, Mycobacterium tuberculosis
DIRFEQMLLLDDETPIG

SEQ ID NO: 1517950 - protein, 19 aa, Mycobacterium tuberculosis
DKDDCAAIGLVKFDLLGLG

SEQ ID NO: 1517951 - protein, 24 aa, Mycobacterium tuberculosis
DKMDPQQRLLLEVAWEALEHAGIP

SEQ ID NO: 1517952 - protein, 25 aa, Mycobacterium tuberculosis
DKMDPQQRLLLEVAWEALEHAGIPP

SEQ ID NO: 1517953 - protein, 33 aa, Mycobacterium tuberculosis
DKPFSCLMLNAIPDLAFWGSSNGQFFPRWTYEK

SEQ ID NO: 1517954 - protein, 30 aa, Mycobacterium tuberculosis
DKPTWIMPRDSWLIDRATLQPGPTFVRQFR

SEQ ID NO: 1517955 - protein, 19 aa, Mycobacterium tuberculosis
DKVPALNPHQIDDLMMGCG

SEQ ID NO: 1517956 - protein, 27 aa, Mycobacterium tuberculosis
DLAARLKAVWAPQGLIHRGQGRWYPGE

SEQ ID NO: 1517957 - protein, 35 aa, Mycobacterium tuberculosis
DLDTEVRLRLLDTLDLFGIALGMAAFRPGRPSRTP

SEQ ID NO: 1517958 - protein, 20 aa, Mycobacterium tuberculosis
DLDVLLLHDGKPADILRPVA

SEQ ID NO: 1517959 - protein, 17 aa, Mycobacterium tuberculosis
DLEDRAKMMALLEPERI

SEQ ID NO: 1517960 - protein, 21 aa, Mycobacterium tuberculosis
DLESREVLLAKLAGAMKGNLA

SEQ ID NO: 1517961 - protein, 29 aa, Mycobacterium tuberculosis
DLGELPGDLAWQPPLWRALVTTVGADPPH

SEQ ID NO: 1517962 - protein, 19 aa, Mycobacterium tuberculosis
DLGPGDILTRLTAPVIRGL

SEQ ID NO: 1517963 - protein, 28 aa, Mycobacterium tuberculosis
DLHDPPPCMTGFLPPPLVRSPADESVRE

SEQ ID NO: 1517964 - protein, 24 aa, Mycobacterium tuberculosis
DLLNAPTQALLGRPLVGNGANGAP

SEQ ID NO: 1517965 - protein, 26 aa, Mycobacterium tuberculosis
DLLVARRRPPAGDGWRKAVTKMTFGR

SEQ ID NO: 1517966 - protein, 39 aa, Mycobacterium tuberculosis
DLPQLVVHPYTLTGPIVIGSFFLPAFNIPGIDVPAINVD

SEQ ID NO: 1517967 - protein, 19 aa, Mycobacterium tuberculosis
DLVVVPLDPALPITEQRVR

SEQ ID NO: 1517968 - protein, 19 aa, Mycobacterium tuberculosis
DLWVRGPAIAKGYWNRPDS

SEQ ID NO: 1517969 - protein, 31 aa, Mycobacterium tuberculosis
DMGGPPIVFQLLWYPSTLWDQSLPSLAENAD

SEQ ID NO: 1517970 - protein, 21 aa, Mycobacterium tuberculosis
DMGNGAFWRGDQQGLFSAGYR

SEQ ID NO: 1517971 - protein, 27 aa, Mycobacterium tuberculosis
DMGPLDFPRLNWAPIEWRNLEDEQEKM

SEQ ID NO: 1517972 - protein, 20 aa, Mycobacterium tuberculosis
DMPIATLAAMRRGEQLPFGL

SEQ ID NO: 1517973 - protein, 24 aa, Mycobacterium tuberculosis
DMQTIELAAFHRVPPGPGQIEVAV

SEQ ID NO: 1517974 - protein, 26 aa, Mycobacterium tuberculosis
DNNAGDYGFFWITAVTTDGSIVVANS

SEQ ID NO: 1517975 - protein, 26 aa, Mycobacterium tuberculosis
DNTAYYRLMDHDLRFYKDFTGTGNSL

SEQ ID NO: 1517976 - protein, 22 aa, Mycobacterium tuberculosis
DNTLVFYIWGDNGASMEGTNTG

SEQ ID NO: 1517977 - protein, 25 aa, Mycobacterium tuberculosis
DNTVGPPLLPPILGGGMPAAPGPAL

SEQ ID NO: 1517978 - protein, 18 aa, Mycobacterium tuberculosis
DPAHLLRRKLVNAGFTRK

SEQ ID NO: 1517979 - protein, 34 aa, Mycobacterium tuberculosis
DPIPLQLNLDLTLGPVHILIDLPAVPGFGNTTGA

SEQ ID NO: 1517980 - protein, 31 aa, Mycobacterium tuberculosis
DPRLLELQLVDPSLGWQWLDPDIRNLAQRDF

SEQ ID NO: 1517981 - protein, 22 aa, Mycobacterium tuberculosis
DPRLYRAYLLKESLRHVFSVKG

SEQ ID NO: 1517982 - protein, 21 aa, Mycobacterium tuberculosis
DPVALRAFRRGAAALAAMIAS

SEQ ID NO: 1517983 - protein, 17 aa, Mycobacterium tuberculosis
DPWQPQYGSGQLAAVVA

SEQ ID NO: 1517984 - protein, 22 aa, Mycobacterium tuberculosis
DQMRGVRLMFMQSNGGLAQAGH

SEQ ID NO: 1517985 - protein, 21 aa, Mycobacterium tuberculosis
DQPRPLVPAMFSAVLSRLRRT

SEQ ID NO: 1517986 - protein, 25 aa, Mycobacterium tuberculosis
DQPWLADHVVNGVVLFPGAGFVELV

SEQ ID NO: 1517987 - protein, 18 aa, Mycobacterium tuberculosis
DQQALLDLLHPNGRAVIE

SEQ ID NO: 1517988 - protein, 25 aa, Mycobacterium tuberculosis
DRDWWAQRIPQLPDPPALPTRAGGE

SEQ ID NO: 1517989 - protein, 18 aa, Mycobacterium tuberculosis
DREAQLLDILRTEIWPLL

SEQ ID NO: 1517990 - protein, 22 aa, Mycobacterium tuberculosis
DRGAWTLAEPRVTPVAVIGMAC

SEQ ID NO: 1517991 - protein, 19 aa, Mycobacterium tuberculosis
DRLPEPAGLPAWISQEELD

SEQ ID NO: 1517992 - protein, 18 aa, Mycobacterium tuberculosis
DRMYSSPLPYMSALHQFS

SEQ ID NO: 1517993 - protein, 22 aa, Mycobacterium tuberculosis
DRRLLSLILLARDHVVHGWVLA

SEQ ID NO: 1517994 - protein, 25 aa, Mycobacterium tuberculosis
DRRMYRRRQGCLEGGRRQPGLGGRL

SEQ ID NO: 1517995 - protein, 18 aa, Mycobacterium tuberculosis
DRSILRQLGMGRRTVVVT

SEQ ID NO: 1517996 - protein, 22 aa, Mycobacterium tuberculosis
DRTLRRPIVAIKERLRPSSGPT

SEQ ID NO: 1517997 - protein, 25 aa, Mycobacterium tuberculosis
DRVCYDALWTGRRFVVQDTGGWEPN

SEQ ID NO: 1517998 - protein, 18 aa, Mycobacterium tuberculosis
DRVDVVQPVLFAVMVSLA

SEQ ID NO: 1517999 - protein, 31 aa, Mycobacterium tuberculosis
DRYFCSVLGPTLPNRLYWLSATIDPDGQNGG

SEQ ID NO: 1518000 - protein, 24 aa, Mycobacterium tuberculosis
DRYITARFLPDKAIDLVDEAASRL

SEQ ID NO: 1518001 - protein, 20 aa, Mycobacterium tuberculosis
DSAPSLVFLDELDALAPRRG

SEQ ID NO: 1518002 - protein, 22 aa, Mycobacterium tuberculosis
DSAWLLVSILRQFGLAARFVSG

SEQ ID NO: 1518003 - protein, 26 aa, Mycobacterium tuberculosis
DSEEAVLALYRYLGRTPSRLLAVALT

SEQ ID NO: 1518004 - protein, 19 aa, Mycobacterium tuberculosis
DSEWMGRVHRFLGLQVGVI

SEQ ID NO: 1518005 - protein, 26 aa, Mycobacterium tuberculosis
DSLAEYVLELARKLIRPEERSVAGFN

SEQ ID NO: 1518006 - protein, 20 aa, Mycobacterium tuberculosis
DSMTLYGFPDGETRDLFLTL

SEQ ID NO: 1518007 - protein, 19 aa, Mycobacterium tuberculosis
DSRLPRWRAMAAHALCKRD

SEQ ID NO: 1518008 - protein, 25 aa, Mycobacterium tuberculosis
DTAGGFLIPAALDPAILLSGDGSTN

SEQ ID NO: 1518009 - protein, 27 aa, Mycobacterium tuberculosis
DTGNLDPIIAFYPKHVLYEVFGPPGTV

SEQ ID NO: 1518010 - protein, 22 aa, Mycobacterium tuberculosis
DTHAHAWALRMSPDGNVWGATV

SEQ ID NO: 1518011 - protein, 17 aa, Mycobacterium tuberculosis
DTLWKAADKLRGSLSAS

SEQ ID NO: 1518012 - protein, 23 aa, Mycobacterium tuberculosis
DVAFGTDLLFAASDLPGFVLHVE

SEQ ID NO: 1518013 - protein, 22 aa, Mycobacterium tuberculosis
DVALRSWRPRVAVWGIHLLRRG

SEQ ID NO: 1518014 - protein, 27 aa, Mycobacterium tuberculosis
DVASDLMLAKLRHGLPGAVFVSARTGD

SEQ ID NO: 1518015 - protein, 26 aa, Mycobacterium tuberculosis
DVAVGTLYRYFPSKVHLLVSALGREF

SEQ ID NO: 1518016 - protein, 22 aa, Mycobacterium tuberculosis
DVDGFVFPTCRWVHPIGPGNRS

SEQ ID NO: 1518017 - protein, 17 aa, Mycobacterium tuberculosis
DVELFALAQLIGAAGTL

SEQ ID NO: 1518018 - protein, 33 aa, Mycobacterium tuberculosis; identical to SEQ ID NO: 1481606

SEQ ID NO: 1518019 - protein, 20 aa, Mycobacterium tuberculosis
DVKPPTWWHSLPTDRPIIYA

SEQ ID NO: 1518020 - protein, 20 aa, Mycobacterium tuberculosis
DVLEPLPVLAALDGVEIGAD

SEQ ID NO: 1518021 - protein, 33 aa, Mycobacterium tuberculosis
DVLTTYILLPSQDLPLLVPLRAIPLLGNPLADL

SEQ ID NO: 1518022 - protein, 17 aa, Mycobacterium tuberculosis
DVMPYTFGDNWFADAPA

SEQ ID NO: 1518023 - protein, 24 aa, Mycobacterium tuberculosis
DVSGGLPAFTLFPGGLNIPQNAIP

SEQ ID NO: 1518024 - protein, 24 aa, Mycobacterium tuberculosis
DVVVHPRSWLLRQASSGVSAATVV

SEQ ID NO: 1518025 - protein, 21 aa, Mycobacterium tuberculosis
DWADEVYVFGYPRVPMTAEMA

SEQ ID NO: 1518026 - protein, 18 aa, Mycobacterium tuberculosis
DWSPKVFGSWNLHRATLG

SEQ ID NO: 1518027 - protein, 18 aa, Mycobacterium tuberculosis
DYGFAWRDIARVVGVSVP

SEQ ID NO: 1518028 - protein, 25 aa, Mycobacterium tuberculosis
DYNLQFLDHIVAHPTIRWVGSANEL

SEQ ID NO: 1518029 - protein, 26 aa, Mycobacterium tuberculosis
DYTDAAQPIWWVVRAIEFSKDFETFV

SEQ ID NO: 1518030 - protein, 19 aa, Mycobacterium tuberculosis
DYYRNGGILQYVLRNILKS

SEQ ID NO: 1518031 - protein, 28 aa, Mycobacterium tuberculosis
EAADLAAVWQLPVVILVENIRGALSVHL

SEQ ID NO: 1518032 - protein, 24 aa, Mycobacterium tuberculosis
EAARRGTVWHRRVPDRYPEVIVQA

SEQ ID NO: 1518033 - protein, 21 aa, Mycobacterium tuberculosis
EADFILAKHRNGPTKTVTVAH

SEQ ID NO: 1518034 - protein, 22 aa, Mycobacterium tuberculosis
EADHIASFALPIDDLDLTVRSY

SEQ ID NO: 1518035 - protein, 18 aa, Mycobacterium tuberculosis
EADLNYWRAIMADPPEPL

SEQ ID NO: 1518036 - protein, 19 aa, Mycobacterium tuberculosis
EARLPLALPTSATGGIPVT

SEQ ID NO: 1518037 - protein, 21 aa, Mycobacterium tuberculosis
EARYRRWLAALRGSARLVIGT

SEQ ID NO: 1518038 - protein, 17 aa, Mycobacterium tuberculosis
EATLDLLSGKYPSTEFA

SEQ ID NO: 1518039 - protein, 37 aa, Mycobacterium tuberculosis
EATLPPVAEPPPPAAPPVAEPPPPVAAPAPPGAPEPA

SEQ ID NO: 1518040 - protein, 23 aa, Mycobacterium tuberculosis
EAVSAMQERLPFFADLEASQRAS

SEQ ID NO: 1518041 - protein, 20 aa, Mycobacterium tuberculosis
EAVVAAARWARSELDYIPGT

SEQ ID NO: 1518042 - protein, 22 aa, Mycobacterium tuberculosis
EAVYEQMWAADVAAMLGYHGEA

SEQ ID NO: 1518043 - protein, 23 aa, Mycobacterium tuberculosis
EAYQLMRDGLGLTAPAIADVFTE

SEQ ID NO: 1518044 - protein, 22 aa, Mycobacterium tuberculosis
ECHHLLATWGALVSALASVLGA

SEQ ID NO: 1518045 - protein, 24 aa, Mycobacterium tuberculosis
EDIEQWYVSRFLAMRTTAFADPES

SEQ ID NO: 1518046 - protein, 17 aa, Mycobacterium tuberculosis
EEEMRLHPAFLGRQRAA

SEQ ID NO: 1518047 - protein, 18 aa, Mycobacterium tuberculosis
EEGRDKAPELRATQMDHV

SEQ ID NO: 1518048 - protein, 28 aa, Mycobacterium tuberculosis
EELGYKLPSLLLPIWDSELGAGLIATLR

SEQ ID NO: 1518049 - protein, 22 aa, Mycobacterium tuberculosis
EELRKMFNSLGIQYGPAFSGLV

SEQ ID NO: 1518050 - protein, 18 aa, Mycobacterium tuberculosis
EESLPAVLAAIPAGYRAL

SEQ ID NO: 1518051 - protein, 35 aa, Mycobacterium tuberculosis
EFAQPALFAVEVALYRLLMSWGVRPGLVLGHSVGE

SEQ ID NO: 1518052 - protein, 17 aa, Mycobacterium tuberculosis
EFCAPFELSRDAPLRIT

SEQ ID NO: 1518053 - protein, 36 aa, Mycobacterium tuberculosis
EFGSQALRPAMFSTFLMWVLADLFTFLPEVGDLDKP

SEQ ID NO: 1518054 - protein, 17 aa, Mycobacterium tuberculosis
EFLDTWCDAGSPVAGRH

SEQ ID NO: 1518055 - protein, 25 aa, Mycobacterium tuberculosis
EFMVRNTYIYPPKPSMRIISDIFAY

SEQ ID NO: 1518056 - protein, 41 aa, Mycobacterium tuberculosis
EFPRLMVYRGPRRKGVRYFGPYSHAWAIRETLDLLTRVFPA

SEQ ID NO: 1518057 - protein, 17 aa, Mycobacterium tuberculosis
EFRFPRIGTAVFDGIEI

SEQ ID NO: 1518058 - protein, 18 aa, Mycobacterium tuberculosis
EFRFPRIGTAVFDGIEIE

SEQ ID NO: 1518059 - protein, 25 aa, Mycobacterium tuberculosis
EGARAFQTLLRYGRAYSGYAPIMGT

SEQ ID NO: 1518060 - protein, 26 aa, Mycobacterium tuberculosis
EGGPTPVLQWLLYPRTDFTAQTRSMG

SEQ ID NO: 1518061 - protein, 30 aa, Mycobacterium tuberculosis
EGGRHTPFFNNYRPQFYFPHHRRDRCGDTA

SEQ ID NO: 1518062 - protein, 26 aa, Mycobacterium tuberculosis
EGHRLRADAILLRRTDRLPFAEPPDW

SEQ ID NO: 1518063 - protein, 36 aa, Mycobacterium tuberculosis
EGIGSLDLIRILPETRRYLGWRLSLLDLIGADTAAN

SEQ ID NO: 1518064 - protein, 24 aa, Mycobacterium tuberculosis
EGVLPPEMLFAHPGYVRAANGIQM

SEQ ID NO: 1518065 - protein, 21 aa, Mycobacterium tuberculosis
EHERLLGWQRQMLARIEVPYR

SEQ ID NO: 1518066 - protein, 17 aa, Mycobacterium tuberculosis
EHLGLRTRLFAAPGWLV

SEQ ID NO: 1518067 - protein, 23 aa, Mycobacterium tuberculosis
EHPFGTVFVLEHPQPLPLGDLVV

SEQ ID NO: 1518068 - protein, 22 aa, Mycobacterium tuberculosis
EHRKAFRRTIKWRTGCEGRISH

SEQ ID NO: 1518069 - protein, 22 aa, Mycobacterium tuberculosis
EHVWALMGMPCGKYLVVMHDLW

SEQ ID NO: 1518070 - protein, 19 aa, Mycobacterium tuberculosis
EHWSIHRKPPAFEELEPRT

SEQ ID NO: 1518071 - protein, 22 aa, Mycobacterium tuberculosis
EICAYFDAVLQQQLLPTGRVDY

SEQ ID NO: 1518072 - protein, 18 aa, Mycobacterium tuberculosis
EIGRDRVYRLGRGRYGPG

SEQ ID NO: 1518073 - protein, 18 aa, Mycobacterium tuberculosis
EIMASVWTGVWTGVLPKP

SEQ ID NO: 1518074 - protein, 24 aa, Mycobacterium tuberculosis
EINSLLIYTGAGPGPLLAAAAAWD

SEQ ID NO: 1518075 - protein, 19 aa, Mycobacterium tuberculosis
EINSLRMFIGAGTAPMLAA

SEQ ID NO: 1518076 - protein, 33 aa, Mycobacterium tuberculosis
EIPVRTLPPYLDLLETLYLIDRIPAWSTNLSKR

SEQ ID NO: 1518077 - protein, 17 aa, Mycobacterium tuberculosis
EISPLQPEIPYYSATSF

SEQ ID NO: 1518078 - protein, 24 aa, Mycobacterium tuberculosis
EITIPQLPLGLALSGATPAFAFPL

SEQ ID NO: 1518079 - protein, 22 aa, Mycobacterium tuberculosis
ELALYHTKRLASPGQRIVLYAK

SEQ ID NO: 1518080 - protein, 29 aa, Mycobacterium tuberculosis
ELDRRGLLRRIGGAPYLHTLISTVPTAAN

SEQ ID NO: 1518081 - protein, 17 aa, Mycobacterium tuberculosis
ELGFESFVYATPVDQRG

SEQ ID NO: 1518082 - protein, 24 aa, Mycobacterium tuberculosis
ELGPVPIKLRESPGLMILGRQGCG

SEQ ID NO: 1518083 - protein, 23 aa, Mycobacterium tuberculosis
ELGVLRLMMKYDPHFFTFLEIPE

SEQ ID NO: 1518084 - protein, 17 aa, Mycobacterium tuberculosis
ELLARDWAPKVHGAWEL

SEQ ID NO: 1518085 - protein, 26 aa, Mycobacterium tuberculosis
ELLRPGLLVLPVRGPARFFGSEQMAA

SEQ ID NO: 1518086 - protein, 18 aa, Mycobacterium tuberculosis
ELMILIATNLLGQNTPAI

SEQ ID NO: 1518087 - protein, 22 aa, Mycobacterium tuberculosis
ELRAPMEQATPLRRLGDPVDIA

SEQ ID NO: 1518088 - protein, 17 aa, Mycobacterium tuberculosis
ELRGIAISPVEAHLTEN

SEQ ID NO: 1518089 - protein, 18 aa, Mycobacterium tuberculosis
ELRHHIATPQPLQWDCFL

SEQ ID NO: 1518090 - protein, 21 aa, Mycobacterium tuberculosis
ELRKMFNSLGIQYGPAFSGLV

SEQ ID NO: 1518091 - protein, 19 aa, Mycobacterium tuberculosis
ELRRHGINPHIIGGAAVAA

SEQ ID NO: 1518092 - protein, 26 aa, Mycobacterium tuberculosis
EMMATAAFDLARIGSQVSAASAVAAM

SEQ ID NO: 1518093 - protein, 20 aa, Mycobacterium tuberculosis
EMYKYLVAVSREPDHDKIRA

SEQ ID NO: 1518094 - protein, 34 aa, Mycobacterium tuberculosis; identical to SEQ ID NO: 224990

SEQ ID NO: 1518095 - protein, 19 aa, Mycobacterium tuberculosis
ENRWLPMKRTALALHHLVC

SEQ ID NO: 1518096 - protein, 25 aa, Mycobacterium tuberculosis
EPALLSRALTACGLIAVAVARADAA

SEQ ID NO: 1518097 - protein, 31 aa, Mycobacterium tuberculosis; identical to SEQ ID NO: 226134

SEQ ID NO: 1518098 - protein, 27 aa, Mycobacterium tuberculosis
EPEDFVGALIYLLSDASSFYTGQVMYL

SEQ ID NO: 1518099 - protein, 24 aa, Mycobacterium tuberculosis
EPEHLRRRKLLTPPLHGAALDRYV

SEQ ID NO: 1518100 - protein, 17 aa, Mycobacterium tuberculosis
EPPGTRMRVALSALTMA

SEQ ID NO: 1518101 - protein, 19 aa, Mycobacterium tuberculosis
EPPRGVLLYGPPGCGKTFV

SEQ ID NO: 1518102 - protein, 20 aa, Mycobacterium tuberculosis
EPPRLFVVTRSAASVLPSDL

SEQ ID NO: 1518103 - protein, 17 aa, Mycobacterium tuberculosis
EPTPITPVTPPVAPATP

SEQ ID NO: 1518104 - protein, 25 aa, Mycobacterium tuberculosis
EQAAKLCVQYLAPIVKNRQYNYPPL

SEQ ID NO: 1518105 - protein, 24 aa, Mycobacterium tuberculosis
EQLTVRYALRRLGALRVWPARARA

SEQ ID NO: 1518106 - protein, 17 aa, Mycobacterium tuberculosis
EQRDMFLRWSDDLVTFL

SEQ ID NO: 1518107 - protein, 18 aa, Mycobacterium tuberculosis
EQVLPEPALLALEQIGKR

SEQ ID NO: 1518108 - protein, 24 aa, Mycobacterium tuberculosis
ERAFGAGPLRPWPDDVRRAIREGR

SEQ ID NO: 1518109 - protein, 30 aa, Mycobacterium tuberculosis
ERAGWPNYDAVASIAWLGYDAPDGLKDVMH

SEQ ID NO: 1518110 - protein, 26 aa, Mycobacterium tuberculosis
EREDKAITLTLLDWAYAVMGGNHTRH

SEQ ID NO: 1518111 - protein, 24 aa, Mycobacterium tuberculosis
ERKALLDRLLAQKLPDGWDADLPH

SEQ ID NO: 1518112 - protein, 18 aa, Mycobacterium tuberculosis
ERMRLGALARHIAEELPL

SEQ ID NO: 1518113 - protein, 19 aa, Mycobacterium tuberculosis
ESAWSVFISARWQADFRAD

SEQ ID NO: 1518114 - protein, 26 aa, Mycobacterium tuberculosis
ESCDTLIVIPNDRLLQMGDAAVSLMD

SEQ ID NO: 1518115 - protein, 24 aa, Mycobacterium tuberculosis
ESDNLAVKGIYWARRDAEPHRRRI

SEQ ID NO: 1518116 - protein, 22 aa, Mycobacterium tuberculosis
ESEAFYMRVAAPGDLRCEGAQL

SEQ ID NO: 1518117 - protein, 20 aa, Mycobacterium tuberculosis
ESELLPQLLAADALAAELKA

SEQ ID NO: 1518118 - protein, 31 aa, Mycobacterium tuberculosis
ESLYGAWSANPFPFLRQIIANHQVYWQQIAA

SEQ ID NO: 1518119 - protein, 17 aa, Mycobacterium tuberculosis
ETATRFVADPFAAQPGS

SEQ ID NO: 1518120 - protein, 23 aa, Mycobacterium tuberculosis
ETEIEILAEKIARWARARSAEIE

SEQ ID NO: 1518121 - protein, 23 aa, Mycobacterium tuberculosis
ETGMVNVLCTPGVWARHRKLAHT

SEQ ID NO: 1518122 - protein, 19 aa, Mycobacterium tuberculosis
ETRLVPQRGYHLELITAVP

SEQ ID NO: 1518123 - protein, 23 aa, Mycobacterium tuberculosis
ETRRLFAGGGFGGRRFDSGFGGG

SEQ ID NO: 1518124 - protein, 31 aa, Mycobacterium tuberculosis
ETTLGRVMFNELLPLGYPFVNKQMHKKVQAA

SEQ ID NO: 1518125 - protein, 21 aa, Mycobacterium tuberculosis
ETVRIYSNGLWRDAPLRRREA

SEQ ID NO: 1518126 - protein, 22 aa, Mycobacterium tuberculosis
EVEALQLEYTWIKEFDPRFNVR

SEQ ID NO: 1518127 - protein, 25 aa, Mycobacterium tuberculosis
EVENPKCHLAWTTLAGIGRVESHHG

SEQ ID NO: 1518128 - protein, 28 aa, Mycobacterium tuberculosis
EVERDLRVIIHGWLAFTFELCRQRIMDP

SEQ ID NO: 1518129 - protein, 29 aa, Mycobacterium tuberculosis
EVFGDEKAIWWQRAVAVWPDYASYQTKTD

SEQ ID NO: 1518130 - protein, 18 aa, Mycobacterium tuberculosis
EVIRRRLSGMKPGDVYAV

SEQ ID NO: 1518131 - protein, 20 aa, Mycobacterium tuberculosis
EVKRRIMIGTYALSAGYYDA

SEQ ID NO: 1518132 - protein, 21 aa, Mycobacterium tuberculosis
EVSAAIATLFGSHAREYQAIS

SEQ ID NO: 1518133 - protein, 19 aa, Mycobacterium tuberculosis
EVVGLLAAGVLARLPVKTF

SEQ ID NO: 1518134 - protein, 24 aa, Mycobacterium tuberculosis
EVYRGAEYSVDFVPKVRIEVVVDD

SEQ ID NO: 1518135 - protein, 23 aa, Mycobacterium tuberculosis
EVYYRAMFSGRVTSWNLRDQHMA

SEQ ID NO: 1518136 - protein, 18 aa, Mycobacterium tuberculosis
EYKFVLAEVDYLKPYWDT

SEQ ID NO: 1518137 - protein, 19 aa, Mycobacterium tuberculosis
FAALSLEPPLVLFCPTKVS

SEQ ID NO: 1518138 - protein, 23 aa, Mycobacterium tuberculosis
FAAPVWMPRAKRTSIRRVQEAIE

SEQ ID NO: 1518139 - protein, 30 aa, Mycobacterium tuberculosis
FADNPVLCDLILIRAALSPKTARLGAQEME

SEQ ID NO: 1518140 - protein, 20 aa, Mycobacterium tuberculosis
FADVLIAFGRFPIIDDREPQ

SEQ ID NO: 1518141 - protein, 17 aa, Mycobacterium tuberculosis
FAELSPHPLLTHAVDQI

SEQ ID NO: 1518142 - protein, 21 aa, Mycobacterium tuberculosis
FAENLVFTEAPKLVRHLQNTQ

SEQ ID NO: 1518143 - protein, 29 aa, Mycobacterium tuberculosis
FAEREGVNLTFLPFFAKAVIDALKIHPNI

SEQ ID NO: 1518144 - protein, 17 aa, Mycobacterium tuberculosis
FALRPVIGIDPAAVSPW

SEQ ID NO: 1518145 - protein, 26 aa, Mycobacterium tuberculosis
FARRVPLAAAVWTQRGWRFPDRLDRV

SEQ ID NO: 1518146 - protein, 17 aa, Mycobacterium tuberculosis
FDAAAARKFGCGFAPSG

SEQ ID NO: 1518147 - protein, 19 aa, Mycobacterium tuberculosis
FDCSGLVQWAYAQAGVHLD

SEQ ID NO: 1518148 - protein, 17 aa, Mycobacterium tuberculosis
FDGLPATEPLRVPAVPE

SEQ ID NO: 1518149 - protein, 23 aa, Mycobacterium tuberculosis
FDMYTGRLFAVSLLPGSPDRLVL

SEQ ID NO: 1518150 - protein, 20 aa, Mycobacterium tuberculosis
FDQVIAVHLKGTWNGTRLAA

SEQ ID NO: 1518151 - protein, 27 aa, Mycobacterium tuberculosis
FDRIDERLVVVGLDKTVTYKNGDPTID

SEQ ID NO: 1518152 - protein, 26 aa, Mycobacterium tuberculosis
FDVLAFPDHLVPSVSPFAGATAAAMA

SEQ ID NO: 1518153 - protein, 28 aa, Mycobacterium tuberculosis
FEAAVAGAIPVIRPLTQSLAGDTVLRVA

SEQ ID NO: 1518154 - protein, 18 aa, Mycobacterium tuberculosis
FEGGLWSGGAANAANGAL

SEQ ID NO: 1518155 - protein, 24 aa, Mycobacterium tuberculosis
FEIADYGVVGDLFKVAPQLTEAIK

SEQ ID NO: 1518156 - protein, 19 aa, Mycobacterium tuberculosis
FEMAATVDYLFGYDATAGV

SEQ ID NO: 1518157 - protein, 17 aa, Mycobacterium tuberculosis
FEMFGNRGIYHKGWTAV

SEQ ID NO: 1518158 - protein, 26 aa, Mycobacterium tuberculosis
FEPWSVADFSRYLSTLGLPAAGDAVT

SEQ ID NO: 1518159 - protein, 20 aa, Mycobacterium tuberculosis
FGDLLVEVLGGDAPPSGPGS

SEQ ID NO: 1518160 - protein, 22 aa, Mycobacterium tuberculosis
FGDLVAMEAYRRSLLEQASGDD

SEQ ID NO: 1518161 - protein, 18 aa, Mycobacterium tuberculosis
FGGGASGFWNLASATSGL

SEQ ID NO: 1518162 - protein, 29 aa, Mycobacterium tuberculosis
FGNAGNINTGFWNAGNLNTGFGSAGNGNV

SEQ ID NO: 1518163 - protein, 18 aa, Mycobacterium tuberculosis
FGPGGLGTFSWPGAYGTW

SEQ ID NO: 1518164 - protein, 20 aa, Mycobacterium tuberculosis
FGSAAYWRRHIRQAVRFADS

SEQ ID NO: 1518165 - protein, 20 aa, Mycobacterium tuberculosis
FGSGQMQLPFVLQSAEVMKA

SEQ ID NO: 1518166 - protein, 24 aa, Mycobacterium tuberculosis
FGTPDTWVLWNLTGGPRGGCACHR

SEQ ID NO: 1518167 - protein, 24 aa, Mycobacterium tuberculosis
FGTPDTWVLWNLTGGPRGGVHVTD

SEQ ID NO: 1518168 - protein, 18 aa, Mycobacterium tuberculosis
FHERFVQALATGGGAYAA

SEQ ID NO: 1518169 - protein, 19 aa, Mycobacterium tuberculosis
FHERFVQALATGGGAYAAA

SEQ ID NO: 1518170 - protein, 18 aa, Mycobacterium tuberculosis
FHRPILANDKLYFDTYLD

SEQ ID NO: 1518171 - protein, 19 aa, Mycobacterium tuberculosis
FHRSVKIPDLIIAAVAEHH

SEQ ID NO: 1518172 - protein, 18 aa, Mycobacterium tuberculosis
FHTLTGRMHFYLAHDWVE

SEQ ID NO: 1518173 - protein, 26 aa, Mycobacterium tuberculosis
FKCPAAPFEAAFLIAAQLGDRYATGT

SEQ ID NO: 1518174 - protein, 17 aa, Mycobacterium tuberculosis
FKEMTLLELSDFVKKFE

SEQ ID NO: 1518175 - protein, 17 aa, Mycobacterium tuberculosis
FKVRPSFSFFAVGPDGM

SEQ ID NO: 1518176 - protein, 18 aa, Mycobacterium tuberculosis
FLATHLSALASLFWCIVG

SEQ ID NO: 1518177 - protein, 18 aa, Mycobacterium tuberculosis
FLEKEQRIIAALRAAADS

SEQ ID NO: 1518178 - protein, 21 aa, Mycobacterium tuberculosis
FLHGDMFASLRRWTGGSIPET

SEQ ID NO: 1518179 - protein, 19 aa, Mycobacterium tuberculosis
FLSSRFHFPRIYLDYIGHG

SEQ ID NO: 1518180 - protein, 17 aa, Mycobacterium tuberculosis
FNAPASQLARLAAALQE

SEQ ID NO: 1518181 - protein, 32 aa, Mycobacterium tuberculosis
FNIYRTGEHIGWRFWMGIAFELTSDPQELREL

SEQ ID NO: 1518182 - protein, 19 aa, Mycobacterium tuberculosis
FNKLLGPLPFPHHPIHTVP

SEQ ID NO: 1518183 - protein, 28 aa, Mycobacterium tuberculosis
FNPGTLNTGFFSAMTQAGPNSGFFNAGT

SEQ ID NO: 1518184 - protein, 18 aa, Mycobacterium tuberculosis
FNRKLRFESYSPVEIVEI

SEQ ID NO: 1518185 - protein, 18 aa, Mycobacterium tuberculosis
FPVERFMRDAKITQIYEG

SEQ ID NO: 1518186 - protein, 20 aa, Mycobacterium tuberculosis
FPVPSFAEFWRTGRLELPTR

SEQ ID NO: 1518187 - protein, 18 aa, Mycobacterium tuberculosis
FPVVFVTGWEDGMFPHMR

SEQ ID NO: 1518188 - protein, 18 aa, Mycobacterium tuberculosis
FQHLPVPFELYSDGIDLP

SEQ ID NO: 1518189 - protein, 25 aa, Mycobacterium tuberculosis
FRSDALQIIAFGRYARTVTAAELTG

SEQ ID NO: 1518190 - protein, 28 aa, Mycobacterium tuberculosis
FSGHAQTYQALRTQAAAFHQQIVQTLTS

SEQ ID NO: 1518191 - protein, 17 aa, Mycobacterium tuberculosis
FSKPLQNLAGLPAWLAS

SEQ ID NO: 1518192 - protein, 17 aa, Mycobacterium tuberculosis
FSLPAITLPSLNIPAAT

SEQ ID NO: 1518193 - protein, 17 aa, Mycobacterium tuberculosis
FSLPAITLPSLTIPAAT

SEQ ID NO: 1518194 - protein, 20 aa, Mycobacterium tuberculosis
FSNGILWRGNYEGLAGFSFG

SEQ ID NO: 1518195 - protein, 17 aa, Mycobacterium tuberculosis
FSSLAYLPRLPVDVVKL

SEQ ID NO: 1518196 - protein, 17 aa, Mycobacterium tuberculosis
FTRPVSVDPVRGLDPLT

SEQ ID NO: 1518197 - protein, 18 aa, Mycobacterium tuberculosis
FVAHRGMTVLPLAKSASG

SEQ ID NO: 1518198 - protein, 18 aa, Mycobacterium tuberculosis
FVELPRLEDIEPGAHTDV

SEQ ID NO: 1518199 - protein, 20 aa, Mycobacterium tuberculosis
FVQLNRGPLYGHMYILVSDM

SEQ ID NO: 1518200 - protein, 24 aa, Mycobacterium tuberculosis
FVVNALLVPYLLSAIRMVEAGFAT

SEQ ID NO: 1518201 - protein, 26 aa, Mycobacterium tuberculosis
FWDTEGFVLPVLTYTAPHAVADALRW

SEQ ID NO: 1518202 - protein, 24 aa, Mycobacterium tuberculosis
GAAARVRAKLPSGAELLFCQHHAN

SEQ ID NO: 1518203 - protein, 22 aa, Mycobacterium tuberculosis
GAAGFGYPYAIAPPGIGFGSGM

SEQ ID NO: 1518204 - protein, 27 aa, Mycobacterium tuberculosis
GAALGSPGWAFGVLAAAGGGGATGVAG

SEQ ID NO: 1518205 - protein, 20 aa, Mycobacterium tuberculosis
GAFVNWEGRYRTFEPALRGS

SEQ ID NO: 1518206 - protein, 23 aa, Mycobacterium tuberculosis
GAGAYAFAEAANASPLQSAMGAV

SEQ ID NO: 1518207 - protein, 24 aa, Mycobacterium tuberculosis
GAGGAGGLFGVSGSSGLGGAAGSG

SEQ ID NO: 1518208 - protein, 22 aa, Mycobacterium tuberculosis
GAGGAGGWLFGNGGAGGNGGIG

SEQ ID NO: 1518209 - protein, 21 aa, Mycobacterium tuberculosis
GAGGKAGLYGNGGDGGAGGDG

SEQ ID NO: 1518210 - protein, 24 aa, Mycobacterium tuberculosis
GAGGLGGTLYGAGGHGGAGGPGPI

SEQ ID NO: 1518211 - protein, 18 aa, Mycobacterium tuberculosis
GAGGLLFGAGEDGTTPGG

SEQ ID NO: 1518212 - protein, 18 aa, Mycobacterium tuberculosis
GAGGLLYGNGGNGAAGVN

SEQ ID NO: 1518213 - protein, 23 aa, Mycobacterium tuberculosis
GAGGNAWLFGNGGAGGLGAAGAA

SEQ ID NO: 1518214 - protein, 24 aa, Mycobacterium tuberculosis
GAGGNGGWLLGNGGIGGAGGTGGG

SEQ ID NO: 1518215 - protein, 22 aa, Mycobacterium tuberculosis
GAGGSGGFLSGAAGVSGADGIG

SEQ ID NO: 1518216 - protein, 20 aa, Mycobacterium tuberculosis
GAGGWLLGNGGNGGAGAAGT

SEQ ID NO: 1518217 - protein, 18 aa, Mycobacterium tuberculosis
GAGIPVGRGGDGGSGGLI

SEQ ID NO: 1518218 - protein, 23 aa, Mycobacterium tuberculosis
GAGSIFKIFTTAAALDMGMGINA

SEQ ID NO: 1518219 - protein, 24 aa, Mycobacterium tuberculosis
GAGSLFNGAPGFGGPGGSGGASLL

SEQ ID NO: 1518220 - protein, 21 aa, Mycobacterium tuberculosis
GAHQVRMEFAYAGGGLGKGGE

SEQ ID NO: 1518221 - protein, 23 aa, Mycobacterium tuberculosis
GAIYQRWQALGGMNSALGAPTSP

SEQ ID NO: 1518222 - protein, 42 aa, Mycobacterium tuberculosis
GAKVSGSRFYFLTGRGALLQLGLLQLALKLAVDNGFVPTIPP

SEQ ID NO: 1518223 - protein, 25 aa, Mycobacterium tuberculosis
GALFDTPILVPPQAAMLGTGAIVKR

SEQ ID NO: 1518224 - protein, 18 aa, Mycobacterium tuberculosis
GALHPQHLMRVGRAFHQL

SEQ ID NO: 1518225 - protein, 17 aa, Mycobacterium tuberculosis
GALLLEPGTLATLGAAA

SEQ ID NO: 1518226 - protein, 19 aa, Mycobacterium tuberculosis
GALLLGSRLGPARTAAICA

SEQ ID NO: 1518227 - protein, 17 aa, Mycobacterium tuberculosis
GALPLVMNPDAAVATVV

SEQ ID NO: 1518228 - protein, 24 aa, Mycobacterium tuberculosis
GANSTWRAIAGPTPRLNPWRTPIP

SEQ ID NO: 1518229 - protein, 18 aa, Mycobacterium tuberculosis
GAPAPPMPPLPPAPPAPP

SEQ ID NO: 1518230 - protein, 19 aa, Mycobacterium tuberculosis
GAPAPPMPPLPPAPPAPPL

SEQ ID NO: 1518231 - protein, 17 aa, Mycobacterium tuberculosis
GAPGGFGGGAGAGGLGG

SEQ ID NO: 1518232 - protein, 21 aa, Mycobacterium tuberculosis
GAQVTIFRLGSDPGLARFIDQ

SEQ ID NO: 1518233 - protein, 18 aa, Mycobacterium tuberculosis
GARWILDLGPGDILTRLT

SEQ ID NO: 1518234 - protein, 23 aa, Mycobacterium tuberculosis
GASIYNVSVLLDPNKGLANLLAN

SEQ ID NO: 1518235 - protein, 18 aa, Mycobacterium tuberculosis
GATGADGAKGLDGATGGK

SEQ ID NO: 1518236 - protein, 34 aa, Mycobacterium tuberculosis; identical to SEQ ID NO: 225044

SEQ ID NO: 1518237 - protein, 18 aa, Mycobacterium tuberculosis
GAVRFGIYQAGCNSSLAT

SEQ ID NO: 1518238 - protein, 21 aa, Mycobacterium tuberculosis
GCLRPLRIVVPEGSMLAPTHP

SEQ ID NO: 1518239 - protein, 18 aa, Mycobacterium tuberculosis
GDAGFFYGNGGAGGSGAG

SEQ ID NO: 1518240 - protein, 18 aa, Mycobacterium tuberculosis
GDAGLLFGAAGTGGHGAA

SEQ ID NO: 1518241 - protein, 19 aa, Mycobacterium tuberculosis
GDAGLLFGAAGTGGHGAAG

SEQ ID NO: 1518242 - protein, 22 aa, Mycobacterium tuberculosis
GDARLLLIVAELPLPMQNVNEE

SEQ ID NO: 1518243 - protein, 23 aa, Mycobacterium tuberculosis
GDGAPVPMLPGSWGPDLVGVAGD

SEQ ID NO: 1518244 - protein, 22 aa, Mycobacterium tuberculosis
GDGFDGTMAGLGGTGGSGGTGG

SEQ ID NO: 1518245 - protein, 26 aa, Mycobacterium tuberculosis
GDGGDGGYGGWGGAGGNGGAGGSAPA

SEQ ID NO: 1518246 - protein, 26 aa, Mycobacterium tuberculosis
GDGGGRGIFGQFGAGGAGGAGGVGGA

SEQ ID NO: 1518247 - protein, 29 aa, Mycobacterium tuberculosis
GDGGNGAIGGHGPLTDDPGGNGGTGGNGG

SEQ ID NO: 1518248 - protein, 23 aa, Mycobacterium tuberculosis
GDGGPGMFGGPGGAGGSGGTIFG

SEQ ID NO: 1518249 - protein, 25 aa, Mycobacterium tuberculosis
GDGGTGGRGGWLAGAGGAGGAGGVG

SEQ ID NO: 1518250 - protein, 30 aa, Mycobacterium tuberculosis
GDHDLEPGPWRLDPLPLVISAADWEVLEAG

SEQ ID NO: 1518251 - protein, 20 aa, Mycobacterium tuberculosis
GDILTRLTAPVIRGLGIGIV

SEQ ID NO: 1518252 - protein, 18 aa, Mycobacterium tuberculosis
GDLAVAIDALRRPERRRG

SEQ ID NO: 1518253 - protein, 22 aa, Mycobacterium tuberculosis
GDNRAYLVLPPGAGKTMIGLEA

SEQ ID NO: 1518254 - protein, 23 aa, Mycobacterium tuberculosis
GDRDIRLPFHKPVDDMTGLSQAI

SEQ ID NO: 1518255 - protein, 23 aa, Mycobacterium tuberculosis
GDRGPVWVFSGQGSQWAAMGTQL

SEQ ID NO: 1518256 - protein, 23 aa, Mycobacterium tuberculosis
GDRRLATRYPGLEQLLHPGQTTG

SEQ ID NO: 1518257 - protein, 35 aa, Mycobacterium tuberculosis; identical to SEQ ID NO: 1065343

SEQ ID NO: 1518258 - protein, 26 aa, Mycobacterium tuberculosis
GDVNTGFWNGGPFNTGFGNGGNTNFG

SEQ ID NO: 1518259 - protein, 17 aa, Mycobacterium tuberculosis
GEFWVPHRLGGGAPSLA

SEQ ID NO: 1518260 - protein, 18 aa, Mycobacterium tuberculosis
GEGCVMLALKRLPDALAD

SEQ ID NO: 1518261 - protein, 20 aa, Mycobacterium tuberculosis
GEPTPITPVTPPVAPATPAT

SEQ ID NO: 1518262 - protein, 31 aa, Mycobacterium tuberculosis
GEPTPLDYLVAEILRIISGGRLIWDPAEGTM

SEQ ID NO: 1518263 - protein, 25 aa, Mycobacterium tuberculosis
GEQKLDLVLAILRARQLFGGAHAIP

SEQ ID NO: 1518264 - protein, 25 aa, Mycobacterium tuberculosis
GEQQTMLPFSWQGVCLHASGAARVR

SEQ ID NO: 1518265 - protein, 21 aa, Mycobacterium tuberculosis
GERADWWWYEPFQPQPPPISN

SEQ ID NO: 1518266 - protein, 17 aa, Mycobacterium tuberculosis
GETAAELSALGLGRVEH

SEQ ID NO: 1518267 - protein, 19 aa, Mycobacterium tuberculosis
GETWPLQDTVRPWDSLSDE

SEQ ID NO: 1518268 - protein, 24 aa, Mycobacterium tuberculosis
GEVRWVSARDLRFGYRTSVLKHAD

SEQ ID NO: 1518269 - protein, 26 aa, Mycobacterium tuberculosis
GFAAFYRRCRLVTARLWPTLIEPLRT

SEQ ID NO: 1518270 - protein, 24 aa, Mycobacterium tuberculosis
GFDNRFFDIPPDEALRMDPQQRLL

SEQ ID NO: 1518271 - protein, 23 aa, Mycobacterium tuberculosis
GFERFYGFLGGETDQWYPDLVYD

SEQ ID NO: 1518272 - protein, 19 aa, Mycobacterium tuberculosis
GFGRYLVSATTPFTRDDLT

SEQ ID NO: 1518273 - protein, 17 aa, Mycobacterium tuberculosis
GFIAEFGLSLVGGCCGT

SEQ ID NO: 1518274 - protein, 20 aa, Mycobacterium tuberculosis
GFLTPRNSLRQRCVAHRLTI

SEQ ID NO: 1518275 - protein, 19 aa, Mycobacterium tuberculosis
GFSFFDGNGGDGGTGGTLI

SEQ ID NO: 1518276 - protein, 25 aa, Mycobacterium tuberculosis
GFSYDVLHAFNPRIVLAGSSAFGNR

SEQ ID NO: 1518277 - protein, 21 aa, Mycobacterium tuberculosis
GFVAHRGMTVLPLAKSASGGE

SEQ ID NO: 1518278 - protein, 20 aa, Mycobacterium tuberculosis
GGAAGLFGIGGAGGAGGAGA

SEQ ID NO: 1518279 - protein, 21 aa, Mycobacterium tuberculosis
GGAAVTGGPRGARGAAGDIAA

SEQ ID NO: 1518280 - protein, 17 aa, Mycobacterium tuberculosis
GGAGGAGGWLIGQSGST

SEQ ID NO: 1518281 - protein, 23 aa, Mycobacterium tuberculosis
GGAGGLISLLGGQGAGGAGGTGG

SEQ ID NO: 1518282 - protein, 20 aa, Mycobacterium tuberculosis
GGAGGLLFGSGGAGGPGGVG

SEQ ID NO: 1518283 - protein, 20 aa, Mycobacterium tuberculosis
GGAGGLLYGNGGNGAAGVNA

SEQ ID NO: 1518284 - protein, 25 aa, Mycobacterium tuberculosis
GGAGGSGGWLLGNGGVGGAGGQSLL

SEQ ID NO: 1518285 - protein, 23 aa, Mycobacterium tuberculosis
GGAGGVGGLLYGNGGNGGAGGIG

SEQ ID NO: 1518286 - protein, 25 aa, Mycobacterium tuberculosis
GGAGSLFNGAPGFGGPGGSGGASLL

SEQ ID NO: 1518287 - protein, 21 aa, Mycobacterium tuberculosis
GGDGGLLFGSGGNGAPGAPGQ

SEQ ID NO: 1518288 - protein, 25 aa, Mycobacterium tuberculosis
GGDTTIVVNGMLAPSTLGYGGNGGN

SEQ ID NO: 1518289 - protein, 23 aa, Mycobacterium tuberculosis
GGDTTVPLFDSGVGGAGGAGGNA

SEQ ID NO: 1518290 - protein, 33 aa, Mycobacterium tuberculosis
GGEPTPLDYLVAEILRIISGGRLIWDPAEGTMN

SEQ ID NO: 1518291 - protein, 27 aa, Mycobacterium tuberculosis
GGGGGNGGTGWNGGKGDTGSGGGAGDG

SEQ ID NO: 1518292 - protein, 28 aa, Mycobacterium tuberculosis
GGGGGNGGTGWNGGKGDTGSGGGAGDGG

SEQ ID NO: 1518293 - protein, 31 aa, Mycobacterium tuberculosis; identical to SEQ ID NO: 218404

SEQ ID NO: 1518294 - protein, 23 aa, Mycobacterium tuberculosis
GGGHSLVIATGQAGGAGGSGGAG

SEQ ID NO: 1518295 - protein, 24 aa, Mycobacterium tuberculosis
GGGSQFYVLLPDGVQKISSFVADL

SEQ ID NO: 1518296 - protein, 19 aa, Mycobacterium tuberculosis
GGGTGFNPGAPGDPGTQGA

SEQ ID NO: 1518297 - protein, 17 aa, Mycobacterium tuberculosis
GGHGGTAILFGDGGAGG

SEQ ID NO: 1518298 - protein, 19 aa, Mycobacterium tuberculosis
GGIAQLFGTGGMGGSGGGI

SEQ ID NO: 1518299 - protein, 25 aa, Mycobacterium tuberculosis
GGIIGRACWPSWTPPPLMSRWSNRP

SEQ ID NO: 1518300 - protein, 21 aa, Mycobacterium tuberculosis
GGILAPLQPFQATAVIPVIGP

SEQ ID NO: 1518301 - protein, 23 aa, Mycobacterium tuberculosis
GGKALKFYASVRMDVRRVETLKD

SEQ ID NO: 1518302 - protein, 30 aa, Mycobacterium tuberculosis
GGKGGAGTLLGLTVFGDNGGAGVLGDSTDP

SEQ ID NO: 1518303 - protein, 22 aa, Mycobacterium tuberculosis
GGLGGLGGVGGTGGMGGSGGVG

SEQ ID NO: 1518304 - protein, 21 aa, Mycobacterium tuberculosis
GGLGTFSWPGAYGTWWQADPS

SEQ ID NO: 1518305 - protein, 19 aa, Mycobacterium tuberculosis
GGLSVHYLGARSPAFIGRL

SEQ ID NO: 1518306 - protein, 17 aa, Mycobacterium tuberculosis
GGLVHIFLPPTDALEHF

SEQ ID NO: 1518307 - protein, 21 aa, Mycobacterium tuberculosis
GGNAGWLYGRGGVGGAGGIGG

SEQ ID NO: 1518308 - protein, 19 aa, Mycobacterium tuberculosis
GGNALLFGNGGNGGSGASG

SEQ ID NO: 1518309 - protein, 25 aa, Mycobacterium tuberculosis
GGNGATGTWGHNLGAGGTGGNGGNP

SEQ ID NO: 1518310 - protein, 26 aa, Mycobacterium tuberculosis
GGNGGAGGLLIGNGGAGGVGGTAGAG

SEQ ID NO: 1518311 - protein, 25 aa, Mycobacterium tuberculosis
GGNGGGAGLFYGFGGAGGNGGMGGV

SEQ ID NO: 1518312 - protein, 18 aa, Mycobacterium tuberculosis
GGNGGHGGLWIGNGGDGG

SEQ ID NO: 1518313 - protein, 22 aa, Mycobacterium tuberculosis
GGNGGLGGFGGNGAAGANGVAV

SEQ ID NO: 1518314 - protein, 20 aa, Mycobacterium tuberculosis
GGNGGLPFIGSTNAGNGGSA

SEQ ID NO: 1518315 - protein, 28 aa, Mycobacterium tuberculosis
GGNGGNGALLIGGGGLGGAGGMGGTGGG

SEQ ID NO: 1518316 - protein, 27 aa, Mycobacterium tuberculosis
GGNGGNPGFSGAGGLGGLSGDGVTRAA

SEQ ID NO: 1518317 - protein, 23 aa, Mycobacterium tuberculosis
GGNIFHGALSWPFADNDDPLDTP

SEQ ID NO: 1518318 - protein, 26 aa, Mycobacterium tuberculosis
GGPGGAGGLISLLGGQGAGGAGGTGG

SEQ ID NO: 1518319 - protein, 26 aa, Mycobacterium tuberculosis
GGPGGNGGWLLGNGGHGGAGGIGGGS

SEQ ID NO: 1518320 - protein, 18 aa, Mycobacterium tuberculosis
GGPGPIGGVGGHGGVGGA

SEQ ID NO: 1518321 - protein, 21 aa, Mycobacterium tuberculosis
GGPHAVYLLDAFNAGPDVSNW

SEQ ID NO: 1518322 - protein, 19 aa, Mycobacterium tuberculosis
GGPPLPGQAGMGAAGGAGG

SEQ ID NO: 1518323 - protein, 19 aa, Mycobacterium tuberculosis
GGQGGDFALGGNGGAGGAG

SEQ ID NO: 1518324 - protein, 20 aa, Mycobacterium tuberculosis
GGQGLPFEAGANGGAGGAGG

SEQ ID NO: 1518325 - protein, 22 aa, Mycobacterium tuberculosis
GGQSGLLFGNAGAGGAGAAGGA

SEQ ID NO: 1518326 - protein, 27 aa, Mycobacterium tuberculosis
GGRGGAGGLGFGSEAPGRPGGAGGTGG

SEQ ID NO: 1518327 - protein, 20 aa, Mycobacterium tuberculosis
GGRGGLLMGAGAGGHGGTGG

SEQ ID NO: 1518328 - protein, 20 aa, Mycobacterium tuberculosis
GGRHTPFFNNYRPQSTSAPP

SEQ ID NO: 1518329 - protein, 24 aa, Mycobacterium tuberculosis
GGRPLPLYCASLRTAEPRLLERLG

SEQ ID NO: 1518330 - protein, 21 aa, Mycobacterium tuberculosis
GGSAGLLGNGGSGGAGGTGAP

SEQ ID NO: 1518331 - protein, 25 aa, Mycobacterium tuberculosis
GGSGGAGGMLYGAGGVGGNGGAAVA

SEQ ID NO: 1518332 - protein, 19 aa, Mycobacterium tuberculosis
GGTALGAGGIGGDGGTGGA

SEQ ID NO: 1518333 - protein, 28 aa, Mycobacterium tuberculosis
GGTGGAGGHAWLFGHGGTGGIGGGPGGN

SEQ ID NO: 1518334 - protein, 22 aa, Mycobacterium tuberculosis
GGTGGIGGTGAPGAMGGTGGNG

SEQ ID NO: 1518335 - protein, 26 aa, Mycobacterium tuberculosis
GGTRNGTIVHWPNGIAAKGEMRWQFH

SEQ ID NO: 1518336 - protein, 23 aa, Mycobacterium tuberculosis
GGVALMLEPRKAAAGSALGMLSP

SEQ ID NO: 1518337 - protein, 23 aa, Mycobacterium tuberculosis
GGVGAFLTALFASPAKALSLNAG

SEQ ID NO: 1518338 - protein, 21 aa, Mycobacterium tuberculosis
GGVGGNARLLGTGGAGGVGGG

SEQ ID NO: 1518339 - protein, 32 aa, Mycobacterium tuberculosis
GGVGPITVLPIQILPTIPLNIHQTFSLGPLVV

SEQ ID NO: 1518340 - protein, 33 aa, Mycobacterium tuberculosis; identical to SEQ ID NO: 236414

SEQ ID NO: 1518341 - protein, 26 aa, Mycobacterium tuberculosis
GGVVLLMWAGILAYLDRYGYDYVTGC

SEQ ID NO: 1518342 - protein, 25 aa, Mycobacterium tuberculosis
GGYPFEGLRILDLGIIVAGGELSRL

SEQ ID NO: 1518343 - protein, 27 aa, Mycobacterium tuberculosis
GHFALTAHLLPLLRAAQRARVVSLSSL

SEQ ID NO: 1518344 - protein, 21 aa, Mycobacterium tuberculosis
GHGGLWIGNGGDGGAGGVGGV

SEQ ID NO: 1518345 - protein, 21 aa, Mycobacterium tuberculosis
GHLAAILYDIPHVLTAHSLEP

SEQ ID NO: 1518346 - protein, 21 aa, Mycobacterium tuberculosis
GHVFRRAFSWLPAQFASQSDA

SEQ ID NO: 1518347 - protein, 21 aa, Mycobacterium tuberculosis
GHVLLPGFVDLHTHLREPGRE

SEQ ID NO: 1518348 - protein, 19 aa, Mycobacterium tuberculosis
GHWLLAHNGVVDRAVLPAG

SEQ ID NO: 1518349 - protein, 17 aa, Mycobacterium tuberculosis
GIELSATMLFNHPTVKS

SEQ ID NO: 1518350 - protein, 23 aa, Mycobacterium tuberculosis
GIERTFVAYLKMAGKTAQDTSFD

SEQ ID NO: 1518351 - protein, 29 aa, Mycobacterium tuberculosis
GIFTGYIGPIPLSTFVLGVTLAGGTLESG

SEQ ID NO: 1518352 - protein, 26 aa, Mycobacterium tuberculosis
GIGCSSRFPYYLETYGFHSIHGRAPA

SEQ ID NO: 1518353 - protein, 33 aa, Mycobacterium tuberculosis; identical to SEQ ID NO: 218512

SEQ ID NO: 1518354 - protein, 27 aa, Mycobacterium tuberculosis
GILENPGLLRFLPQLSERLLDESPLLH

SEQ ID NO: 1518355 - protein, 19 aa, Mycobacterium tuberculosis
GINASDLNWQQAALLAGMV

SEQ ID NO: 1518356 - protein, 22 aa, Mycobacterium tuberculosis
GITIPQFPIRITTTGGIGPIVI

SEQ ID NO: 1518357 - protein, 17 aa, Mycobacterium tuberculosis
GIYGKLAWEKTIPNWFF

SEQ ID NO: 1518358 - protein, 23 aa, Mycobacterium tuberculosis
GKARPDIGPLFYEPTVLTNVAPE

SEQ ID NO: 1518359 - protein, 25 aa, Mycobacterium tuberculosis
GKGGTGLMPGINGTGGAGGSRGQIS

SEQ ID NO: 1518360 - protein, 21 aa, Mycobacterium tuberculosis
GKPGIDMYWADQGCGNGGRAE

SEQ ID NO: 1518361 - protein, 26 aa, Mycobacterium tuberculosis
GLAAELLRRLPFELTAGQREVLDVLS

SEQ ID NO: 1518362 - protein, 17 aa, Mycobacterium tuberculosis
GLAYIPDGMELPNKVYL

SEQ ID NO: 1518363 - protein, 22 aa, Mycobacterium tuberculosis
GLGGFAYQSAVSEIPWSYDRFQ

SEQ ID NO: 1518364 - protein, 18 aa, Mycobacterium tuberculosis
GLGNIGSWNLGGGNVGLL

SEQ ID NO: 1518365 - protein, 23 aa, Mycobacterium tuberculosis
GLGSFLARQLGVPQPETLRRYRA

SEQ ID NO: 1518366 - protein, 18 aa, Mycobacterium tuberculosis
GLINAPTQALLGRPLIGN

SEQ ID NO: 1518367 - protein, 18 aa, Mycobacterium tuberculosis
GLLAELRRRAEARHPPVV

SEQ ID NO: 1518368 - protein, 20 aa, Mycobacterium tuberculosis
GLLAGHYRADRFWSQQVLDE

SEQ ID NO: 1518369 - protein, 20 aa, Mycobacterium tuberculosis
GLLDERALFLGQWGLRGQRG

SEQ ID NO: 1518370 - protein, 29 aa, Mycobacterium tuberculosis
GLLDNRPIGVLFKRIFDRPARRPVRRVLL

SEQ ID NO: 1518371 - protein, 22 aa, Mycobacterium tuberculosis
GLLSTFIAALMGAEADALCGAG

SEQ ID NO: 1518372 - protein, 20 aa, Mycobacterium tuberculosis
GLMVAAASPYVAWMSVTAGQ

SEQ ID NO: 1518373 - protein, 18 aa, Mycobacterium tuberculosis
GLPLAMTLNAVGSPITTA

SEQ ID NO: 1518374 - protein, 27 aa, Mycobacterium tuberculosis
GLPYRAAEIGLLVLATSTGFIAPGVDV

SEQ ID NO: 1518375 - protein, 24 aa, Mycobacterium tuberculosis
GLQARLMSQALRKMTGALNNSGTT

SEQ ID NO: 1518376 - protein, 19 aa, Mycobacterium tuberculosis
GLRLRLPVIATALGTYDTA

SEQ ID NO: 1518377 - protein, 20 aa, Mycobacterium tuberculosis
GLSESGWIPVDPRTLSTSAD

SEQ ID NO: 1518378 - protein, 18 aa, Mycobacterium tuberculosis
GLSLICQTGRRFPRVAPR

SEQ ID NO: 1518379 - protein, 19 aa, Mycobacterium tuberculosis
GLVPLPSKWRIAFGEPICT

SEQ ID NO: 1518380 - protein, 18 aa, Mycobacterium tuberculosis
GMLLSKHIRLIAAFDHRH

SEQ ID NO: 1518381 - protein, 29 aa, Mycobacterium tuberculosis
GMRDIRKHIAWYLHGFPAGSARRALAMVK

SEQ ID NO: 1518382 - protein, 21 aa, Mycobacterium tuberculosis
GMRREQPLPHGLRGLLTELHR

SEQ ID NO: 1518383 - protein, 17 aa, Mycobacterium tuberculosis
GMSRLSGYLTPQARATF

SEQ ID NO: 1518384 - protein, 24 aa, Mycobacterium tuberculosis
GMVQFVPFFLGQRTPPYPTATSIQ

SEQ ID NO: 1518385 - protein, 21 aa, Mycobacterium tuberculosis
GNAGLFGVGGTGGPGGPGGPG

SEQ ID NO: 1518386 - protein, 26 aa, Mycobacterium tuberculosis
GNFSNGILWRGDYQGLAGFAVGYTLP

SEQ ID NO: 1518387 - protein, 27 aa, Mycobacterium tuberculosis
GNGGNGALLIGGGGLGGAGGMGGTGGG

SEQ ID NO: 1518388 - protein, 33 aa, Mycobacterium tuberculosis; identical to SEQ ID NO: 226317

SEQ ID NO: 1518389 - protein, 34 aa, Mycobacterium tuberculosis; identical to SEQ ID NO: 225121

SEQ ID NO: 1518390 - protein, 24 aa, Mycobacterium tuberculosis
GNGGRGGWLLGNGGAGGVGGVGGA

SEQ ID NO: 1518391 - protein, 21 aa, Mycobacterium tuberculosis
GNGGTGWNGGKGDTGSGGGAG

SEQ ID NO: 1518392 - protein, 17 aa, Mycobacterium tuberculosis
GNGMLLSKHIRLIAAFD

SEQ ID NO: 1518393 - protein, 17 aa, Mycobacterium tuberculosis
GNGWLLESVPPTAPAEP

SEQ ID NO: 1518394 - protein, 19 aa, Mycobacterium tuberculosis
GNLWLSEVFGAELIIPSYN

SEQ ID NO: 1518395 - protein, 18 aa, Mycobacterium tuberculosis
GPAGRGGDGNLGQFGPEG

SEQ ID NO: 1518396 - protein, 18 aa, Mycobacterium tuberculosis
GPAPPPFVIPATSNVFIS

SEQ ID NO: 1518397 - protein, 20 aa, Mycobacterium tuberculosis
GPAPPPFVIPATSNVFISTV

SEQ ID NO: 1518398 - protein, 19 aa, Mycobacterium tuberculosis
GPARWFLDHARVALSSGHV

SEQ ID NO: 1518399 - protein, 18 aa, Mycobacterium tuberculosis
GPGGILYGNGGNGGSGAP

SEQ ID NO: 1518400 - protein, 19 aa, Mycobacterium tuberculosis
GPGYIPRSTEYRIHQRVLA

SEQ ID NO: 1518401 - protein, 24 aa, Mycobacterium tuberculosis
GPLRSLYHFNPAMQPQIGANYYTP

SEQ ID NO: 1518402 - protein, 18 aa, Mycobacterium tuberculosis
GPPPPPVTAPPPVTGAGI

SEQ ID NO: 1518403 - protein, 26 aa, Mycobacterium tuberculosis
GPRDLEPFRCFYLSAPFVVPKKKEVA

SEQ ID NO: 1518404 - protein, 21 aa, Mycobacterium tuberculosis
GPSSLWLDAAGKRLPVPLFPG

SEQ ID NO: 1518405 - protein, 20 aa, Mycobacterium tuberculosis
GPVSLPIFGFGGAPGFGNDT

SEQ ID NO: 1518406 - protein, 17 aa, Mycobacterium tuberculosis
GQAHLFQLATPLVPEAT

SEQ ID NO: 1518407 - protein, 23 aa, Mycobacterium tuberculosis
GQANSWQSLAGIGPKTAKVIAQA

SEQ ID NO: 1518408 - protein, 24 aa, Mycobacterium tuberculosis
GQGDFLIRGLLGADPTTGAIGIGE

SEQ ID NO: 1518409 - protein, 30 aa, Mycobacterium tuberculosis; identical to SEQ ID NO: 237891

SEQ ID NO: 1518410 - protein, 24 aa, Mycobacterium tuberculosis
GQNDPKLYASFYSALFGSDFQPQE

SEQ ID NO: 1518411 - protein, 18 aa, Mycobacterium tuberculosis
GQPGGDGGILWGNGGNGG

SEQ ID NO: 1518412 - protein, 20 aa, Mycobacterium tuberculosis
GQVGLAAQVGLGFTAVIEAE

SEQ ID NO: 1518413 - protein, 18 aa, Mycobacterium tuberculosis
GQYIGIGLLVDGRWRWRS

SEQ ID NO: 1518414 - protein, 30 aa, Mycobacterium tuberculosis
GRATREAMLARIPLRRFAEPEDFVGALIYL

SEQ ID NO: 1518415 - protein, 34 aa, Mycobacterium tuberculosis
GRDTRVEFWAFDLLYLDGRALLGTRYQDRRKLLE

SEQ ID NO: 1518416 - protein, 23 aa, Mycobacterium tuberculosis
GRFAFFEQTFVRHALTPRCSRTD

SEQ ID NO: 1518417 - protein, 21 aa, Mycobacterium tuberculosis
GRGDEALQWFLRSAAADIDGV

SEQ ID NO: 1518418 - protein, 28 aa, Mycobacterium tuberculosis
GRGGNGGHGGLWIGNGGDGGAGGVGGVG

SEQ ID NO: 1518419 - protein, 27 aa, Mycobacterium tuberculosis
GRGQRTAWHPGAIGRRGAGRQGGRRSG

SEQ ID NO: 1518420 - protein, 17 aa, Mycobacterium tuberculosis
GRHAGWIALNAGLASGA

SEQ ID NO: 1518421 - protein, 27 aa, Mycobacterium tuberculosis
GRPLAMPRLDMVTGLYYLTTEVPGDTG

SEQ ID NO: 1518422 - protein, 26 aa, Mycobacterium tuberculosis
GRPRRGRHLLPARRRPITSTNPIAAS

SEQ ID NO: 1518423 - protein, 19 aa, Mycobacterium tuberculosis
GRRELLPYSDLDVLLLHDG

SEQ ID NO: 1518424 - protein, 22 aa, Mycobacterium tuberculosis
GRRIDLLELIKMGGHADPGSGR

SEQ ID NO: 1518425 - protein, 25 aa, Mycobacterium tuberculosis
GRSHAWVQAWNGGWWHYDPTNDNEI

SEQ ID NO: 1518426 - protein, 17 aa, Mycobacterium tuberculosis
GRSIGSFQNSRFLLAEL

SEQ ID NO: 1518427 - protein, 29 aa, Mycobacterium tuberculosis
GRSRERGYAYFLYPPQVPLTETAYDRLAT

SEQ ID NO: 1518428 - protein, 23 aa, Mycobacterium tuberculosis
GRTERFWVGLSVYRPGGTAEPAP

SEQ ID NO: 1518429 - protein, 17 aa, Mycobacterium tuberculosis
GRTWWVPNEHKPWPLRA

SEQ ID NO: 1518430 - protein, 31 aa, Mycobacterium tuberculosis
GRVLMDTWYRIPAFYFACPSTVLGPYDDAPT

SEQ ID NO: 1518431 - protein, 26 aa, Mycobacterium tuberculosis
GRWAQAYGFPLMPIDGILVGTAAMAT

SEQ ID NO: 1518432 - protein, 24 aa, Mycobacterium tuberculosis
GRWDKPFLAIFGYRDPILGQADGP

SEQ ID NO: 1518433 - protein, 20 aa, Mycobacterium tuberculosis
GRYLDWLTKHSRQILETAYV

SEQ ID NO: 1518434 - protein, 26 aa, Mycobacterium tuberculosis
GSAARTPLMAQLLEGASAPMASTAAN

SEQ ID NO: 1518435 - protein, 26 aa, Mycobacterium tuberculosis
GSAARTPLMAQLLEGASSPMASTAAN

SEQ ID NO: 1518436 - protein, 22 aa, Mycobacterium tuberculosis
GSAGLIGIGGTGGAGGAGAVGG

SEQ ID NO: 1518437 - protein, 24 aa, Mycobacterium tuberculosis
GSDFELVQGFLLAEGVVAHREDVL

SEQ ID NO: 1518438 - protein, 20 aa, Mycobacterium tuberculosis
GSDQHQFLRERVGLGIGQQR

SEQ ID NO: 1518439 - protein, 23 aa, Mycobacterium tuberculosis
GSFGDDPLRMLRAARFVSQLGFA

SEQ ID NO: 1518440 - protein, 26 aa, Mycobacterium tuberculosis
GSFWHQWMQTWFTGPQFYFDCVSGGE

SEQ ID NO: 1518441 - protein, 17 aa, Mycobacterium tuberculosis
GSGGAGGAGGFGFLGGD

SEQ ID NO: 1518442 - protein, 18 aa, Mycobacterium tuberculosis
GSGGAGGAGGFGFLGGDG

SEQ ID NO: 1518443 - protein, 29 aa, Mycobacterium tuberculosis
GSGGAGGNGGWLLGNGGIGGAGGTGGGAG

SEQ ID NO: 1518444 - protein, 19 aa, Mycobacterium tuberculosis
GSGGFLSGAAGVSGADGIG

SEQ ID NO: 1518445 - protein, 23 aa, Mycobacterium tuberculosis
GSGGNGFDSFASGGTGGAGGTGG

SEQ ID NO: 1518446 - protein, 33 aa, Mycobacterium tuberculosis
GSGLARDYPPILRLAYRLLSPMLRVLPFVHSTR

SEQ ID NO: 1518447 - protein, 17 aa, Mycobacterium tuberculosis
GSGLSGWFNTNPAGLLG

SEQ ID NO: 1518448 - protein, 19 aa, Mycobacterium tuberculosis
GSGQMQLPFVLQSAEVMKA

SEQ ID NO: 1518449 - protein, 21 aa, Mycobacterium tuberculosis
GSHPQHAFGVQQPTLGLITAG

SEQ ID NO: 1518450 - protein, 17 aa, Mycobacterium tuberculosis
GSIAQLVKVRSGYEAAL

SEQ ID NO: 1518451 - protein, 32 aa, Mycobacterium tuberculosis; identical to SEQ ID NO: 236469

SEQ ID NO: 1518452 - protein, 17 aa, Mycobacterium tuberculosis
GSKYRGEFEERLKAVLD

SEQ ID NO: 1518453 - protein, 18 aa, Mycobacterium tuberculosis
GSLTHGFLNLFQLGGGSA

SEQ ID NO: 1518454 - protein, 21 aa, Mycobacterium tuberculosis
GSPLNLLRWTSARSIKETFVA

SEQ ID NO: 1518455 - protein, 33 aa, Mycobacterium tuberculosis
GSQHGGILLITHYTRILRYIHPEYVHVFVGGRI

SEQ ID NO: 1518456 - protein, 34 aa, Mycobacterium tuberculosis
GSQHGGILLITHYTRILRYIHPEYVHVFVGGRIV

SEQ ID NO: 1518457 - protein, 24 aa, Mycobacterium tuberculosis
GSRIDPVLARSWLLVNGAHGDRFE

SEQ ID NO: 1518458 - protein, 31 aa, Mycobacterium tuberculosis
GSVDELVPRSLHWLRPITPTFRPSWPDHSRD

SEQ ID NO: 1518459 - protein, 28 aa, Mycobacterium tuberculosis
GSVGNSWTPLAPVVEPPTPPTPASAAEP

SEQ ID NO: 1518460 - protein, 22 aa, Mycobacterium tuberculosis
GTAGLLFGAGGAGGFGFGGAGG

SEQ ID NO: 1518461 - protein, 30 aa, Mycobacterium tuberculosis
GTDRKALVARLYARRYLADQGPLRGIDADC

SEQ ID NO: 1518462 - protein, 27 aa, Mycobacterium tuberculosis
GTGGAGGAGFSRALIVAGDNGGDGGNG

SEQ ID NO: 1518463 - protein, 23 aa, Mycobacterium tuberculosis
GTGGNAAWLLGGGGTGGAGGIGG

SEQ ID NO: 1518464 - protein, 19 aa, Mycobacterium tuberculosis
GTGGNGGLLLGFNGTNGLP

SEQ ID NO: 1518465 - protein, 25 aa, Mycobacterium tuberculosis
GTGMGIDRLLMSLTGLSIRETVLFP

SEQ ID NO: 1518466 - protein, 17 aa, Mycobacterium tuberculosis
GTIVLLMAVERIELFVD

SEQ ID NO: 1518467 - protein, 24 aa, Mycobacterium tuberculosis
GTVARAFLRQALGVEVLSHVISIG

SEQ ID NO: 1518468 - protein, 27 aa, Mycobacterium tuberculosis
GVAASIGAYLWVPDILECLASVMADAG

SEQ ID NO: 1518469 - protein, 22 aa, Mycobacterium tuberculosis
GVALMLEPRKAAAGSALGMLSP

SEQ ID NO: 1518470 - protein, 18 aa, Mycobacterium tuberculosis
GVDAIWINPVTVSPMADH

SEQ ID NO: 1518471 - protein, 25 aa, Mycobacterium tuberculosis
GVDVPALDAVLFLNPRNSIVDVVQS

SEQ ID NO: 1518472 - protein, 19 aa, Mycobacterium tuberculosis
GVDWKGTLTGLAGYASGDL

SEQ ID NO: 1518473 - protein, 28 aa, Mycobacterium tuberculosis
GVGGNGGRGGWLLGNGGAGGVGGVGGAG

SEQ ID NO: 1518474 - protein, 24 aa, Mycobacterium tuberculosis
GVGGNGGWLYGNGGAGGLGGTGVA

SEQ ID NO: 1518475 - protein, 19 aa, Mycobacterium tuberculosis
GVGLALVAQRRGYKCVFVC

SEQ ID NO: 1518476 - protein, 22 aa, Mycobacterium tuberculosis
GVGLALVAQRRGYKCVFVCPDK

SEQ ID NO: 1518477 - protein, 19 aa, Mycobacterium tuberculosis
GVGPTLLLCPMSLVGNWPQ

SEQ ID NO: 1518478 - protein, 20 aa, Mycobacterium tuberculosis
GVGPTLLLCPMSLVGNWQQE

SEQ ID NO: 1518479 - protein, 24 aa, Mycobacterium tuberculosis
GVLERAATAEALLLAKLAAIPTGR

SEQ ID NO: 1518480 - protein, 29 aa, Mycobacterium tuberculosis
GVLFAGDLLFIGCTPIVWAGPIANWVAAC

SEQ ID NO: 1518481 - protein, 19 aa, Mycobacterium tuberculosis
GVPEVIWMRQPAEYHDAAR

SEQ ID NO: 1518482 - protein, 26 aa, Mycobacterium tuberculosis
GVSRRHLEIRWDGQVALLADLNSTNG

SEQ ID NO: 1518483 - protein, 18 aa, Mycobacterium tuberculosis
GVTLGLLSAWRGPNGQDL

SEQ ID NO: 1518484 - protein, 19 aa, Mycobacterium tuberculosis
GVVGSRWIERRSWGRGGAG

SEQ ID NO: 1518485 - protein, 20 aa, Mycobacterium tuberculosis
GVVTEKGRWYLVGHDRDRDA

SEQ ID NO: 1518486 - protein, 24 aa, Mycobacterium tuberculosis
GWALRRAPLPPTGPHWRLLSAVKE

SEQ ID NO: 1518487 - protein, 23 aa, Mycobacterium tuberculosis
GYGYGPAFRGLQALWRRGAEVFA

SEQ ID NO: 1518488 - protein, 28 aa, Mycobacterium tuberculosis
GYKFSTYATWWIRQAITRAMADQARTIR

SEQ ID NO: 1518489 - protein, 18 aa, Mycobacterium tuberculosis
GYSTRLRIQLEPVRPFVA

SEQ ID NO: 1518490 - protein, 23 aa, Mycobacterium tuberculosis
HAGGAAAAYRWLAKSLVANDVDT

SEQ ID NO: 1518491 - protein, 27 aa, Mycobacterium tuberculosis
HAGVVSPGFIGAPLALAALGQMARGGT

SEQ ID NO: 1518492 - protein, 37 aa, Mycobacterium tuberculosis
HALSFASLVFYSAWFKLHHPAAFCAALLRAQPMGFYS

SEQ ID NO: 1518493 - protein, 22 aa, Mycobacterium tuberculosis
HARAARPAGAPKSAGATLAAGT

SEQ ID NO: 1518494 - protein, 20 aa, Mycobacterium tuberculosis
HARLHRFYRDLIALRHNEAD

SEQ ID NO: 1518495 - protein, 17 aa, Mycobacterium tuberculosis
HATAWYGLHELARIRAG

SEQ ID NO: 1518496 - protein, 19 aa, Mycobacterium tuberculosis
HAVAWARPGDVVLIAGKGH

SEQ ID NO: 1518497 - protein, 25 aa, Mycobacterium tuberculosis
HAVTLWKQWDRCALHWFPGSHLLHV

SEQ ID NO: 1518498 - protein, 29 aa, Mycobacterium tuberculosis
HDCAASPAGWLFVSRWTAGGNSLHIRAGD

SEQ ID NO: 1518499 - protein, 30 aa, Mycobacterium tuberculosis
HDCVSANELLLYEALGLCGPGEAPELIDDN

SEQ ID NO: 1518500 - protein, 17 aa, Mycobacterium tuberculosis
HDDRRLLSLILLARDHV

SEQ ID NO: 1518501 - protein, 19 aa, Mycobacterium tuberculosis
HDLVAQACAFINYARGHYG

SEQ ID NO: 1518502 - protein, 19 aa, Mycobacterium tuberculosis
HDPARYDQIWKDHVLALNG

SEQ ID NO: 1518503 - protein, 17 aa, Mycobacterium tuberculosis
HDRAEPTTRWWPLTVNV

SEQ ID NO: 1518504 - protein, 20 aa, Mycobacterium tuberculosis
HEALNFAAVFTTPCVFYVQN

SEQ ID NO: 1518505 - protein, 25 aa, Mycobacterium tuberculosis
HEAPAPPRGLSAVPLEPGQQTVGFS

SEQ ID NO: 1518506 - protein, 19 aa, Mycobacterium tuberculosis
HEDQAHVDLLWSLSRAPDA

SEQ ID NO: 1518507 - protein, 26 aa, Mycobacterium tuberculosis
HEKAKWTKYFLDPAQIRLLRGLKQSA

SEQ ID NO: 1518508 - protein, 28 aa, Mycobacterium tuberculosis
HELKVIAQLRFPGYFLVVHDITRFCRDN

SEQ ID NO: 1518509 - protein, 26 aa, Mycobacterium tuberculosis
HERGLPMSFTFARFLKFIVTEIFPGG

SEQ ID NO: 1518510 - protein, 17 aa, Mycobacterium tuberculosis
HERLWEVLGAHPRSFTT

SEQ ID NO: 1518511 - protein, 18 aa, Mycobacterium tuberculosis
HFAAHAAMYQSVSARAAA

SEQ ID NO: 1518512 - protein, 18 aa, Mycobacterium tuberculosis
HFDVRLADQALALGGGGG

SEQ ID NO: 1518513 - protein, 20 aa, Mycobacterium tuberculosis
HGELLTLRPFGCADGVVARA

SEQ ID NO: 1518514 - protein, 22 aa, Mycobacterium tuberculosis
HGGAGGWLYGNGGAGGFGGAGA

SEQ ID NO: 1518515 - protein, 22 aa, Mycobacterium tuberculosis
HGGNAGLLYGTGGAGGAGGFGG

SEQ ID NO: 1518516 - protein, 26 aa, Mycobacterium tuberculosis
HGGNGGNPGWLLGTAGGGGNGGAGST

SEQ ID NO: 1518517 - protein, 22 aa, Mycobacterium tuberculosis
HGGNGGWLLGNGGNGGLGGDGD

SEQ ID NO: 1518518 - protein, 24 aa, Mycobacterium tuberculosis
HGGTGGAGGLLFGAGEDGTTPGGN

SEQ ID NO: 1518519 - protein, 18 aa, Mycobacterium tuberculosis
HGGVGGAAGLLGVGGHGG

SEQ ID NO: 1518520 - protein, 17 aa, Mycobacterium tuberculosis
HGQPRINRYHHPAKILC

SEQ ID NO: 1518521 - protein, 17 aa, Mycobacterium tuberculosis
HGWVLASGSFMLCAAFN

SEQ ID NO: 1518522 - protein, 17 aa, Mycobacterium tuberculosis
HHGLINKFAGDAALAIF

SEQ ID NO: 1518523 - protein, 19 aa, Mycobacterium tuberculosis
HHKQPPLQRLVRALLGFDA

SEQ ID NO: 1518524 - protein, 17 aa, Mycobacterium tuberculosis
HHLARAAARYLLTDVQL

SEQ ID NO: 1518525 - protein, 19 aa, Mycobacterium tuberculosis
HIHLTATGLMLSGLDLRPA

SEQ ID NO: 1518526 - protein, 20 aa, Mycobacterium tuberculosis
HKLAMPFIVLATDNPIEYEG

SEQ ID NO: 1518527 - protein, 27 aa, Mycobacterium tuberculosis
HKSIEQLLVVFPALFAAIITSAGGVPQ

SEQ ID NO: 1518528 - protein, 17 aa, Mycobacterium tuberculosis
HLAFHVPAERFDAYRQR

SEQ ID NO: 1518529 - protein, 28 aa, Mycobacterium tuberculosis
HLGARLFSIIAWRTYLVRDPHALSLLDA

SEQ ID NO: 1518530 - protein, 24 aa, Mycobacterium tuberculosis
HLIHALRRNINVTILLFNNRIYGL

SEQ ID NO: 1518531 - protein, 17 aa, Mycobacterium tuberculosis
HLKPFHTLTGRMHFYLA

SEQ ID NO: 1518532 - protein, 20 aa, Mycobacterium tuberculosis
HLRRWFDDKVLRIFVFARRG

SEQ ID NO: 1518533 - protein, 20 aa, Mycobacterium tuberculosis
HLSFARDRLGDEFITGVLFY

SEQ ID NO: 1518534 - protein, 17 aa, Mycobacterium tuberculosis
HLWQWVGTNIGRYHSYP

SEQ ID NO: 1518535 - protein, 18 aa, Mycobacterium tuberculosis
HNTGLFNIGTFNTGIANP

SEQ ID NO: 1518536 - protein, 17 aa, Mycobacterium tuberculosis
HNVAFSKPPIGKRGYNE

SEQ ID NO: 1518537 - protein, 21 aa, Mycobacterium tuberculosis
HPADWHMLQPQWLADLSESRR

SEQ ID NO: 1518538 - protein, 17 aa, Mycobacterium tuberculosis
HPAVAGAWSPGVGVRGH

SEQ ID NO: 1518539 - protein, 24 aa, Mycobacterium tuberculosis
HPGQPLWGHGWDESAWPENAAPST

SEQ ID NO: 1518540 - protein, 25 aa, Mycobacterium tuberculosis
HRAALHSRYRWLARWRKEVVMADPG

SEQ ID NO: 1518541 - protein, 23 aa, Mycobacterium tuberculosis
HRADAVVHRLALRGLDRPAATHR

SEQ ID NO: 1518542 - protein, 19 aa, Mycobacterium tuberculosis
HRDEALHLIRKRAKRLRYT

SEQ ID NO: 1518543 - protein, 29 aa, Mycobacterium tuberculosis
HRPVPLWQHVLVGKRMFDLFDYRIGEAEG

SEQ ID NO: 1518544 - protein, 28 aa, Mycobacterium tuberculosis
HRSIPGVTEKWDLYLRGIELATGYSELS

SEQ ID NO: 1518545 - protein, 26 aa, Mycobacterium tuberculosis
HRTVEIHLQPLPNGGLQRVGHPSGRR

SEQ ID NO: 1518546 - protein, 36 aa, Mycobacterium tuberculosis
HRVVGGAKRPVPRLGVLTVTIIQQTPDAGLALECRD

SEQ ID NO: 1518547 - protein, 24 aa, Mycobacterium tuberculosis
HSISPWGTWEWIGPPALGAVLPAR

SEQ ID NO: 1518548 - protein, 20 aa, Mycobacterium tuberculosis
HSNLLDRHRPLWETHVIEGL

SEQ ID NO: 1518549 - protein, 26 aa, Mycobacterium tuberculosis
HSSLTLYIQLYLGGFGLELSDIESLR

SEQ ID NO: 1518550 - protein, 18 aa, Mycobacterium tuberculosis
HTLPRTAFRRRITRLSPA

SEQ ID NO: 1518551 - protein, 24 aa, Mycobacterium tuberculosis
HVRGRGLLLGIALTAPHAKDAEAT

SEQ ID NO: 1518552 - protein, 24 aa, Mycobacterium tuberculosis
HYDQHLTLQGLRLVFERNLEVQRG

SEQ ID NO: 1518553 - protein, 17 aa, Mycobacterium tuberculosis
HYLGARSPAFIGRLLEL

SEQ ID NO: 1518554 - protein, 19 aa, Mycobacterium tuberculosis
HYRPISWDAAYQLIAEQLN

SEQ ID NO: 1518555 - protein, 28 aa, Mycobacterium tuberculosis
IAAAEAMYEQMWAADVAAMVGYHGGASA

SEQ ID NO: 1518556 - protein, 23 aa, Mycobacterium tuberculosis
IAAAPLGILPMPRAMPATAAFPP

SEQ ID NO: 1518557 - protein, 18 aa, Mycobacterium tuberculosis
IAALPRLRRTHPGTTLTI

SEQ ID NO: 1518558 - protein, 30 aa, Mycobacterium tuberculosis
IAALRAYWELPAMMLQFLRTGSGATRPALQ

SEQ ID NO: 1518559 - protein, 26 aa, Mycobacterium tuberculosis
IAANFRDVMIALGLYPDPDAVMGVEA

SEQ ID NO: 1518560 - protein, 18 aa, Mycobacterium tuberculosis
IADFPQVTLGIYNSPRQT

SEQ ID NO: 1518561 - protein, 20 aa, Mycobacterium tuberculosis
IAELPEHIVIVGSGFIAAEF

SEQ ID NO: 1518562 - protein, 18 aa, Mycobacterium tuberculosis
IAHLPNTLLGLTSPLSSA

SEQ ID NO: 1518563 - protein, 20 aa, Mycobacterium tuberculosis
IAPLVGELADTLGRTIDVAL

SEQ ID NO: 1518564 - protein, 26 aa, Mycobacterium tuberculosis
IARDSLVKTALFGSDPNWGRVLAAVG

SEQ ID NO: 1518565 - protein, 27 aa, Mycobacterium tuberculosis
IARVISDVWLSNLLAWLTRRASATDVS

SEQ ID NO: 1518566 - protein, 21 aa, Mycobacterium tuberculosis
IAVAHKLIVIIWHVLATGRPH

SEQ ID NO: 1518567 - protein, 19 aa, Mycobacterium tuberculosis
IAVGYRWDPDTREIGAPLL

SEQ ID NO: 1518568 - protein, 22 aa, Mycobacterium tuberculosis
IDELIPLVRGVVRGAPHALVVA

SEQ ID NO: 1518569 - protein, 26 aa, Mycobacterium tuberculosis
IEDLLGGIPLAGFFAAGEIGPVAGHN

SEQ ID NO: 1518570 - protein, 17 aa, Mycobacterium tuberculosis
IEGKQASAAKFIWFFRH

SEQ ID NO: 1518571 - protein, 18 aa, Mycobacterium tuberculosis
IEIDFGPSPAINLNIGKP

SEQ ID NO: 1518572 - protein, 37 aa, Mycobacterium tuberculosis
IEQIQLGLIGMQLALTELWCSYGVRPDLVIGHSMGEV

SEQ ID NO: 1518573 - protein, 17 aa, Mycobacterium tuberculosis
IEVYPHPATVALFRLPR

SEQ ID NO: 1518574 - protein, 25 aa, Mycobacterium tuberculosis
IEYYKSSVLPQIEGLDGFCSASLLV

SEQ ID NO: 1518575 - protein, 21 aa, Mycobacterium tuberculosis
IFAMLRAHIATGGYAALVAPG

SEQ ID NO: 1518576 - protein, 17 aa, Mycobacterium tuberculosis
IFPELVPALRTACPSGL

SEQ ID NO: 1518577 - protein, 29 aa, Mycobacterium tuberculosis
IFSATRYEWAILDFAILAVGAVTVPIYET

SEQ ID NO: 1518578 - protein, 19 aa, Mycobacterium tuberculosis
IGAAGLGGCGGGAFTAGVT

SEQ ID NO: 1518579 - protein, 22 aa, Mycobacterium tuberculosis
IGDIPIPIIDVPAVPGFGNTTT

SEQ ID NO: 1518580 - protein, 25 aa, Mycobacterium tuberculosis
IGELPRGLHRLAGAAGLLGAGFPEA

SEQ ID NO: 1518581 - protein, 23 aa, Mycobacterium tuberculosis
IGGAGGIGGLIGSGGGGGDGGNG

SEQ ID NO: 1518582 - protein, 18 aa, Mycobacterium tuberculosis
IGGNFSNGAFWQSDHQGQ

SEQ ID NO: 1518583 - protein, 18 aa, Mycobacterium tuberculosis
IGGVGGHGGVGGAAGLLG

SEQ ID NO: 1518584 - protein, 20 aa, Mycobacterium tuberculosis
IGIPINIGPLTITPITLFAQ

SEQ ID NO: 1518585 - protein, 17 aa, Mycobacterium tuberculosis
IGLFGVNPTVGSIGPGS

SEQ ID NO: 1518586 - protein, 17 aa, Mycobacterium tuberculosis
IGLLVLATSTGFIAPGV

SEQ ID NO: 1518587 - protein, 20 aa, Mycobacterium tuberculosis
IGPLTITPITLFAQQTFVNQ

SEQ ID NO: 1518588 - protein, 17 aa, Mycobacterium tuberculosis
IGRRFSLPTVSLAETAV

SEQ ID NO: 1518589 - protein, 22 aa, Mycobacterium tuberculosis
IGYLTALLRDEGITAMHFVPSL

SEQ ID NO: 1518590 - protein, 25 aa, Mycobacterium tuberculosis
IHPGKPATAVLLLPSLRSAPLDSPE

SEQ ID NO: 1518591 - protein, 17 aa, Mycobacterium tuberculosis
IHRATAAQPLEWFCLFS

SEQ ID NO: 1518592 - protein, 18 aa, Mycobacterium tuberculosis
IIPGPSSLWLDAAGKRLP

SEQ ID NO: 1518593 - protein, 24 aa, Mycobacterium tuberculosis
IKEQMIHWWGPIIDEYYASSEASG

SEQ ID NO: 1518594 - protein, 17 aa, Mycobacterium tuberculosis
ILALFRAAPDARIDRHS

SEQ ID NO: 1518595 - protein, 19 aa, Mycobacterium tuberculosis
ILASLGTGGAYFFRQLTHD

SEQ ID NO: 1518596 - protein, 26 aa, Mycobacterium tuberculosis
ILDVLDNYAFVRTSGYLPGPHDVYVS

SEQ ID NO: 1518597 - protein, 17 aa, Mycobacterium tuberculosis
ILEPRRRIDQALYAVVM

SEQ ID NO: 1518598 - protein, 24 aa, Mycobacterium tuberculosis
ILLARGDLALRMGLPVLAVVAFAQ

SEQ ID NO: 1518599 - protein, 29 aa, Mycobacterium tuberculosis
ILSSMERAGLLLPLGWDPRLPVMGQKYIS

SEQ ID NO: 1518600 - protein, 24 aa, Mycobacterium tuberculosis
INAQLFSMPIHQVMVMPGSVMTIP

SEQ ID NO: 1518601 - protein, 22 aa, Mycobacterium tuberculosis
INFPTKKHWRAPSKLAYIDAGL

SEQ ID NO: 1518602 - protein, 27 aa, Mycobacterium tuberculosis
ININETLYLGPLVVPPINVPAISLGVG

SEQ ID NO: 1518603 - protein, 26 aa, Mycobacterium tuberculosis
INKEINLRFVLGYTPLEFRDTLHMLA

SEQ ID NO: 1518604 - protein, 19 aa, Mycobacterium tuberculosis
INNALRVPARAYAILRTPA

SEQ ID NO: 1518605 - protein, 17 aa, Mycobacterium tuberculosis
INPFGLDVPLSGGTSPV

SEQ ID NO: 1518606 - protein, 20 aa, Mycobacterium tuberculosis
INTGGFNPGTLNTGFFSAMT

SEQ ID NO: 1518607 - protein, 17 aa, Mycobacterium tuberculosis
IPAMSSPAWRNGWCRAK

SEQ ID NO: 1518608 - protein, 42 aa, Mycobacterium tuberculosis
IPCRTFAAFLDLRYWIKTFTRAAKPGAYLRVIAPGTVRAGDT

SEQ ID NO: 1518609 - protein, 22 aa, Mycobacterium tuberculosis
IPGFAINPFGLDVPLSGGTSPV

SEQ ID NO: 1518610 - protein, 20 aa, Mycobacterium tuberculosis
IPGFAINPFGLNVPLSGGTN

SEQ ID NO: 1518611 - protein, 22 aa, Mycobacterium tuberculosis
IPGFAINPFGLNVPLSGGTSPV

SEQ ID NO: 1518612 - protein, 19 aa, Mycobacterium tuberculosis
IPLAGLLADAPHGSKQANT

SEQ ID NO: 1518613 - protein, 17 aa, Mycobacterium tuberculosis
IPLGFDIRTSAGPLNIP

SEQ ID NO: 1518614 - protein, 17 aa, Mycobacterium tuberculosis
IPLLLEMPMVYTGRALT

SEQ ID NO: 1518615 - protein, 17 aa, Mycobacterium tuberculosis
IPPAPRGIPQIEVTFDI

SEQ ID NO: 1518616 - protein, 22 aa, Mycobacterium tuberculosis
IPTQWRNQPLGWYTQGLAPYLP

SEQ ID NO: 1518617 - protein, 18 aa, Mycobacterium tuberculosis
IPVDPRTLSTSADNVWAI

SEQ ID NO: 1518618 - protein, 20 aa, Mycobacterium tuberculosis
IPVNITLNELPFNVAGIFTG

SEQ ID NO: 1518619 - protein, 24 aa, Mycobacterium tuberculosis
IQGHLPVILLTRRRARDLGHTTAL

SEQ ID NO: 1518620 - protein, 17 aa, Mycobacterium tuberculosis
IQPWVGLHVGHKSTRLR

SEQ ID NO: 1518621 - protein, 20 aa, Mycobacterium tuberculosis
IQVYRHMLSPLRPASCRFVP

SEQ ID NO: 1518622 - protein, 17 aa, Mycobacterium tuberculosis
IRAAEQRGIDWRAIYAG

SEQ ID NO: 1518623 - protein, 25 aa, Mycobacterium tuberculosis
IRLLTRIAFGFRSPQALIALAMLAL

SEQ ID NO: 1518624 - protein, 21 aa, Mycobacterium tuberculosis
ISEADLLWDLASRLEGRMAAI

SEQ ID NO: 1518625 - protein, 23 aa, Mycobacterium tuberculosis
ISGRYALIRTNGDRWLAHRLKNQ

SEQ ID NO: 1518626 - protein, 17 aa, Mycobacterium tuberculosis
ISLLLRRTIDPDRPLSD

SEQ ID NO: 1518627 - protein, 23 aa, Mycobacterium tuberculosis
ISPTTIYDKFPTLTPDQAAGVIT

SEQ ID NO: 1518628 - protein, 18 aa, Mycobacterium tuberculosis
ISRALFDGLPATEPLRVP

SEQ ID NO: 1518629 - protein, 20 aa, Mycobacterium tuberculosis
ISRQVAMVVLGYRGQGAVAG

SEQ ID NO: 1518630 - protein, 23 aa, Mycobacterium tuberculosis
ISVGYLRWDFFPKPGSAPDFLTV

SEQ ID NO: 1518631 - protein, 21 aa, Mycobacterium tuberculosis
ITALGQLRIAVRDIHTLRALG

SEQ ID NO: 1518632 - protein, 19 aa, Mycobacterium tuberculosis
ITDITPYWRPASWAAGVAV

SEQ ID NO: 1518633 - protein, 23 aa, Mycobacterium tuberculosis
ITIAIERIAPLFNLINGDLCYAN

SEQ ID NO: 1518634 - protein, 18 aa, Mycobacterium tuberculosis
ITIERPAAFLNVDIPVNI

SEQ ID NO: 1518635 - protein, 19 aa, Mycobacterium tuberculosis
ITPITLFAQQTFVNQLPFP

SEQ ID NO: 1518636 - protein, 23 aa, Mycobacterium tuberculosis
ITQAPLNALWQLTKAVRAELSDP

SEQ ID NO: 1518637 - protein, 17 aa, Mycobacterium tuberculosis
ITVITPVFNTGGEDVLF

SEQ ID NO: 1518638 - protein, 20 aa, Mycobacterium tuberculosis
ITVRGQRLLQRCPVCLYAGS

SEQ ID NO: 1518639 - protein, 17 aa, Mycobacterium tuberculosis
ITVWSYVDQLNISVLTD

SEQ ID NO: 1518640 - protein, 20 aa, Mycobacterium tuberculosis
IVAGWHGRPWAHHVPVMRET

SEQ ID NO: 1518641 - protein, 23 aa, Mycobacterium tuberculosis
IVALRIRGIALPGPLRRLSEGIA

SEQ ID NO: 1518642 - protein, 25 aa, Mycobacterium tuberculosis
IVANCGWPWPWLILRLVMSMCSRTG

SEQ ID NO: 1518643 - protein, 32 aa, Mycobacterium tuberculosis
IVDEYLELFANHKKWIGLIIHIGQEGRGANVF

SEQ ID NO: 1518644 - protein, 27 aa, Mycobacterium tuberculosis
IVGHDRLRLALLLCAVRPEIGGALIRG

SEQ ID NO: 1518645 - protein, 17 aa, Mycobacterium tuberculosis
IVSLWLDRLRQRGEITR

SEQ ID NO: 1518646 - protein, 25 aa, Mycobacterium tuberculosis
IVTTNTHFLQTPPAAPMVAASLGAK

SEQ ID NO: 1518647 - protein, 17 aa, Mycobacterium tuberculosis
IVWQRHTLDFWDHVVDS

SEQ ID NO: 1518648 - protein, 18 aa, Mycobacterium tuberculosis
KAAGLFNAPASQLARLAA

SEQ ID NO: 1518649 - protein, 20 aa, Mycobacterium tuberculosis
KAAGLFNAPASQLARLAAAL

SEQ ID NO: 1518650 - protein, 18 aa, Mycobacterium tuberculosis
KAFGRSIGSFQNSRFLLA

SEQ ID NO: 1518651 - protein, 17 aa, Mycobacterium tuberculosis
KAGRTWWVPNEHKPWPL

SEQ ID NO: 1518652 - protein, 17 aa, Mycobacterium tuberculosis
KAGSPLNLLRWTSARSI

SEQ ID NO: 1518653 - protein, 19 aa, Mycobacterium tuberculosis
KAMGVYPGLDGAAPVIGGE

SEQ ID NO: 1518654 - protein, 22 aa, Mycobacterium tuberculosis
KARLVGAMSVPPTWEGSVPARM

SEQ ID NO: 1518655 - protein, 17 aa, Mycobacterium tuberculosis
KAVFSARALAEVCRRGW

SEQ ID NO: 1518656 - protein, 23 aa, Mycobacterium tuberculosis
KAVVVLGLPRGGVPVAFEVAKSL

SEQ ID NO: 1518657 - protein, 17 aa, Mycobacterium tuberculosis
KDDCAAIGLVKFDLLGL

SEQ ID NO: 1518658 - protein, 20 aa, Mycobacterium tuberculosis
KDIEDLTFALNLGVDMVALS

SEQ ID NO: 1518659 - protein, 18 aa, Mycobacterium tuberculosis
KDIFFLVCDGLKGLPDSV

SEQ ID NO: 1518660 - protein, 19 aa, Mycobacterium tuberculosis
KDPVFRERMKREARIAGRL

SEQ ID NO: 1518661 - protein, 18 aa, Mycobacterium tuberculosis
KDTAAPLWTFPRVAWERE

SEQ ID NO: 1518662 - protein, 23 aa, Mycobacterium tuberculosis
KEFADLLTWLQETLSDHVKEVRL

SEQ ID NO: 1518663 - protein, 27 aa, Mycobacterium tuberculosis
KFKDAELLGMPWIVVVGRGWADGVVEL

SEQ ID NO: 1518664 - protein, 22 aa, Mycobacterium tuberculosis
KFRQQTLDRWLAGASATRPHHV

SEQ ID NO: 1518665 - protein, 24 aa, Mycobacterium tuberculosis
KFRTGGYMIDFWGVGYQVAKRMGI

SEQ ID NO: 1518666 - protein, 23 aa, Mycobacterium tuberculosis
KGAFEMAATVDYLFGYDATAGVM

SEQ ID NO: 1518667 - protein, 31 aa, Mycobacterium tuberculosis; identical to SEQ ID NO: 219655

SEQ ID NO: 1518668 - protein, 19 aa, Mycobacterium tuberculosis
KGMWTVPVFGNPSGVTYSW

SEQ ID NO: 1518669 - protein, 29 aa, Mycobacterium tuberculosis
KGNPDYGLRLSWNFLARSTAGLWEWAERL

SEQ ID NO: 1518670 - protein, 18 aa, Mycobacterium tuberculosis
KGTTTKKYSEGAAAGTED

SEQ ID NO: 1518671 - protein, 25 aa, Mycobacterium tuberculosis
KGVAVPHRPVAEYFVWFKGEYDVDD

SEQ ID NO: 1518672 - protein, 17 aa, Mycobacterium tuberculosis
KHDVTIAAPLNLPATMP

SEQ ID NO: 1518673 - protein, 17 aa, Mycobacterium tuberculosis
KIFIEKAVDLGVQALAG

SEQ ID NO: 1518674 - protein, 22 aa, Mycobacterium tuberculosis
KILCRSVMGERPRMATGGRSAS

SEQ ID NO: 1518675 - protein, 24 aa, Mycobacterium tuberculosis
KIPPGTGWRKFVYSVSFHKINPGE

SEQ ID NO: 1518676 - protein, 31 aa, Mycobacterium tuberculosis
KIRLLTRIAFGFRSPQALIALAMLTLAGHRP

SEQ ID NO: 1518677 - protein, 21 aa, Mycobacterium tuberculosis
KIYDPGIILDKDRGLGAVVGQ

SEQ ID NO: 1518678 - protein, 29 aa, Mycobacterium tuberculosis
KLEQRFDRELWRKLIDAGILSSAAPESLG

SEQ ID NO: 1518679 - protein, 33 aa, Mycobacterium tuberculosis
KLFVNPVEAFQFYFELLLFDYPTHIVQIVEALS

SEQ ID NO: 1518680 - protein, 17 aa, Mycobacterium tuberculosis
KLGYLTDIDFDLAASVE

SEQ ID NO: 1518681 - protein, 19 aa, Mycobacterium tuberculosis
KLTPDRFIHELLVEHLHVV

SEQ ID NO: 1518682 - protein, 20 aa, Mycobacterium tuberculosis
KPLALYHTKRLASPAQRIML

SEQ ID NO: 1518683 - protein, 28 aa, Mycobacterium tuberculosis
KQASAAKFIWFFRHPNPIRPVVSQRCDA

SEQ ID NO: 1518684 - protein, 17 aa, Mycobacterium tuberculosis
KRDIYGDTRLGLFPFRR

SEQ ID NO: 1518685 - protein, 22 aa, Mycobacterium tuberculosis
KRLDFGLLGPLQMTIDGTPVPS

SEQ ID NO: 1518686 - protein, 32 aa, Mycobacterium tuberculosis
KRLPRLTRMQRFWIALYFPLTMRSLCNAIVVP

SEQ ID NO: 1518687 - protein, 24 aa, Mycobacterium tuberculosis
KRSVRVTAWTRKLGYLTDIDFDLA

SEQ ID NO: 1518688 - protein, 23 aa, Mycobacterium tuberculosis
KRTFSLPWRLANIQDLPAVDSPA

SEQ ID NO: 1518689 - protein, 21 aa, Mycobacterium tuberculosis
KSLARPVADTVWPTPFLAHQA

SEQ ID NO: 1518690 - protein, 23 aa, Mycobacterium tuberculosis
KTPRGFARLFGGQRPALQGQHLV

SEQ ID NO: 1518691 - protein, 17 aa, Mycobacterium tuberculosis
KVALTRNVLLPVGTDYT

SEQ ID NO: 1518692 - protein, 20 aa, Mycobacterium tuberculosis
KVFGQPIMPAAGFAEIALAA

SEQ ID NO: 1518693 - protein, 23 aa, Mycobacterium tuberculosis
KVGQYVTWGLNHLVFHAPGHDQR

SEQ ID NO: 1518694 - protein, 19 aa, Mycobacterium tuberculosis
KVIYPGRKQVFRKLEHGVF

SEQ ID NO: 1518695 - protein, 18 aa, Mycobacterium tuberculosis
KVSRILLTSGKLYYELAA

SEQ ID NO: 1518696 - protein, 26 aa, Mycobacterium tuberculosis
KVTPEILLQVLTTPPASGPAPFPAVP

SEQ ID NO: 1518697 - protein, 18 aa, Mycobacterium tuberculosis
KWRAHPADVLPLWVAEMD

SEQ ID NO: 1518698 - protein, 25 aa, Mycobacterium tuberculosis
KYRLRDPLNRSLRYGVKTMFATAGA

SEQ ID NO: 1518699 - protein, 18 aa, Mycobacterium tuberculosis
LAAHRRAHGLPAISLGWG

SEQ ID NO: 1518700 - protein, 17 aa, Mycobacterium tuberculosis
LAALKQSAAAELGLRVC

SEQ ID NO: 1518701 - protein, 19 aa, Mycobacterium tuberculosis
LADHKVFGQPIMPAAGFAE

SEQ ID NO: 1518702 - protein, 22 aa, Mycobacterium tuberculosis
LAEIIRLGTALGANGATLAGLA

SEQ ID NO: 1518703 - protein, 20 aa, Mycobacterium tuberculosis
LAHLGIRVNAIAPGLIRSAM

SEQ ID NO: 1518704 - protein, 17 aa, Mycobacterium tuberculosis
LAKRGYPEDIGNRVLDR

SEQ ID NO: 1518705 - protein, 20 aa, Mycobacterium tuberculosis
LALCQATRQVIANGLAIIGV

SEQ ID NO: 1518706 - protein, 24 aa, Mycobacterium tuberculosis
LANVGSTISAANKAAAAATTQVLA

SEQ ID NO: 1518707 - protein, 20 aa, Mycobacterium tuberculosis
LARALLPMHDTPLGPAAAAL

SEQ ID NO: 1518708 - protein, 25 aa, Mycobacterium tuberculosis
LARNTFYGMARWQASLEKKQGFLGR

SEQ ID NO: 1518709 - protein, 23 aa, Mycobacterium tuberculosis
LARQGPLLVVTATGREADDLAAE

SEQ ID NO: 1518710 - protein, 26 aa, Mycobacterium tuberculosis
LARSRRRWYPLTACLPLAPDHTNPDT

SEQ ID NO: 1518711 - protein, 20 aa, Mycobacterium tuberculosis
LARVVSMPCLEWFEAQPYEY

SEQ ID NO: 1518712 - protein, 23 aa, Mycobacterium tuberculosis
LARYAQRVMDWLHPDGDLTDTER

SEQ ID NO: 1518713 - protein, 25 aa, Mycobacterium tuberculosis
LARYAQRVMDWLHPDGDLTDTERAR

SEQ ID NO: 1518714 - protein, 20 aa, Mycobacterium tuberculosis
LATQLMDWLHPDGNFSDQER

SEQ ID NO: 1518715 - protein, 27 aa, Mycobacterium tuberculosis
LAVHHDLHLWLPHPSDELWRALAGFQG

SEQ ID NO: 1518716 - protein, 25 aa, Mycobacterium tuberculosis
LAVLTRLPAQVLGRVAFQVLAGLAE

SEQ ID NO: 1518717 - protein, 26 aa, Mycobacterium tuberculosis
LAVNRIGAHILLLNTSFAGPALAEVV

SEQ ID NO: 1518718 - protein, 17 aa, Mycobacterium tuberculosis
LAVTLPPELPVAAAAAV

SEQ ID NO: 1518719 - protein, 17 aa, Mycobacterium tuberculosis
LAVWNMVATVDAFLSSG

SEQ ID NO: 1518720 - protein, 17 aa, Mycobacterium tuberculosis
LCEDLTIPAQPQLNRTA

SEQ ID NO: 1518721 - protein, 17 aa, Mycobacterium tuberculosis
LDAVELELYKRLPGDLS

SEQ ID NO: 1518722 - protein, 29 aa, Mycobacterium tuberculosis
LDAVNAPTQTLLGRPLIGNGADGVAGTGS

SEQ ID NO: 1518723 - protein, 19 aa, Mycobacterium tuberculosis
LDEVDGYVWHAYLPNITPG

SEQ ID NO: 1518724 - protein, 18 aa, Mycobacterium tuberculosis
LDGVVRAIELSRQTLRTI

SEQ ID NO: 1518725 - protein, 20 aa, Mycobacterium tuberculosis
LDHCRGVAGALQPVGERRSC

SEQ ID NO: 1518726 - protein, 30 aa, Mycobacterium tuberculosis
LDPGAAVQAPWPLLRTFAAGPALSRDAALL

SEQ ID NO: 1518727 - protein, 25 aa, Mycobacterium tuberculosis
LDQLIGFFINIVVLRNDLRGNPTLR

SEQ ID NO: 1518728 - protein, 23 aa, Mycobacterium tuberculosis
LDRAPLAVLALGGEALGAATWRM

SEQ ID NO: 1518729 - protein, 23 aa, Mycobacterium tuberculosis
LDRDRPLWEMWVIEGGARSDTVV

SEQ ID NO: 1518730 - protein, 18 aa, Mycobacterium tuberculosis
LDVALGIGGLPRGRVIEI

SEQ ID NO: 1518731 - protein, 25 aa, Mycobacterium tuberculosis
LDVINAPALALLGRPLIGNGANGAP

SEQ ID NO: 1518732 - protein, 17 aa, Mycobacterium tuberculosis
LEAAGLPEPLFVNGVQQ

SEQ ID NO: 1518733 - protein, 17 aa, Mycobacterium tuberculosis
LELIWGIEDCRNMSARL

SEQ ID NO: 1518734 - protein, 20 aa, Mycobacterium tuberculosis
LENLALLRTLVGAIGTFEDL

SEQ ID NO: 1518735 - protein, 29 aa, Mycobacterium tuberculosis
LEPGFGYTLGNSLRRTLLSSIPGAAVTSI

SEQ ID NO: 1518736 - protein, 18 aa, Mycobacterium tuberculosis
LEPGQWWALVRVGCAGQL

SEQ ID NO: 1518737 - protein, 17 aa, Mycobacterium tuberculosis
LEQGLLGAINAPAAALS

SEQ ID NO: 1518738 - protein, 19 aa, Mycobacterium tuberculosis
LESLIRPTGFYRNKAASLI

SEQ ID NO: 1518739 - protein, 17 aa, Mycobacterium tuberculosis
LESVVLAAGALARFGSP

SEQ ID NO: 1518740 - protein, 24 aa, Mycobacterium tuberculosis
LFCPDQFLGAHVRRVTGRKNLHVW

SEQ ID NO: 1518741 - protein, 21 aa, Mycobacterium tuberculosis
LFDEWFPANKLVKLGLRLTNI

SEQ ID NO: 1518742 - protein, 27 aa, Mycobacterium tuberculosis
LFEAGDWHLTAPLTLFGHCMGAIVAFE

SEQ ID NO: 1518743 - protein, 21 aa, Mycobacterium tuberculosis
LFGSGQMQLPFVLQSAEVMKA

SEQ ID NO: 1518744 - protein, 25 aa, Mycobacterium tuberculosis
LFQRRHLLLSGWIKMQEGQLPSASA

SEQ ID NO: 1518745 - protein, 18 aa, Mycobacterium tuberculosis
LGAINAPAAALSGRPFIG

SEQ ID NO: 1518746 - protein, 23 aa, Mycobacterium tuberculosis
LGALHLDLRFVNGKSWLVFGPYA

SEQ ID NO: 1518747 - protein, 29 aa, Mycobacterium tuberculosis
LGAVNAPTQTLLGRPLIGDGAHGTAPGQP

SEQ ID NO: 1518748 - protein, 18 aa, Mycobacterium tuberculosis
LGGLQFTQSTWAAHGGGE

SEQ ID NO: 1518749 - protein, 24 aa, Mycobacterium tuberculosis
LGGLSIALLAYQLSLNGNPAPVID

SEQ ID NO: 1518750 - protein, 18 aa, Mycobacterium tuberculosis
LGGMALSGLAGRAAAGST

SEQ ID NO: 1518751 - protein, 23 aa, Mycobacterium tuberculosis
LGGRFRPDQLHKLATKLADCLNP

SEQ ID NO: 1518752 - protein, 22 aa, Mycobacterium tuberculosis
LGHIEFPYVYLDATYLNVRNGT

SEQ ID NO: 1518753 - protein, 20 aa, Mycobacterium tuberculosis
LGLAFYRPDYGLDLGPDNKP

SEQ ID NO: 1518754 - protein, 25 aa, Mycobacterium tuberculosis
LGLINAPTQALLGRPLIGNGADGTA

SEQ ID NO: 1518755 - protein, 30 aa, Mycobacterium tuberculosis
LGLPEEIVARQPFPGPGLGIRIVGEVTAKR

SEQ ID NO: 1518756 - protein, 20 aa, Mycobacterium tuberculosis
LGLTITDALFHRHPDRSEGD

SEQ ID NO: 1518757 - protein, 18 aa, Mycobacterium tuberculosis
LGMVFGRKRPGSGPLMIG

SEQ ID NO: 1518758 - protein, 23 aa, Mycobacterium tuberculosis
LGNPLYLRHLIDGGGLEHVDGRW

SEQ ID NO: 1518759 - protein, 17 aa, Mycobacterium tuberculosis
LGPGDILTRLTAPVIRG

SEQ ID NO: 1518760 - protein, 17 aa, Mycobacterium tuberculosis
LGPTHPSNLKCACRKHH

SEQ ID NO: 1518761 - protein, 19 aa, Mycobacterium tuberculosis
LGQFGPEGAPGQPGQPGQP

SEQ ID NO: 1518762 - protein, 22 aa, Mycobacterium tuberculosis
LGRGDEALQWFLRSAAADIDGV

SEQ ID NO: 1518763 - protein, 21 aa, Mycobacterium tuberculosis
LGRRELLPYSDLDVLLLHDGK

SEQ ID NO: 1518764 - protein, 19 aa, Mycobacterium tuberculosis
LGTRGIWHEGWFANTIHAA

SEQ ID NO: 1518765 - protein, 36 aa, Mycobacterium tuberculosis
LGTVEPWVRDYLLLRGLLGTSILWFEQDRDCGPAGT

SEQ ID NO: 1518766 - protein, 17 aa, Mycobacterium tuberculosis
LGWSQQAPRLFHYRDRD

SEQ ID NO: 1518767 - protein, 19 aa, Mycobacterium tuberculosis
LHAGHLVPLLTLRRFQRAG

SEQ ID NO: 1518768 - protein, 17 aa, Mycobacterium tuberculosis
LHNDIVAPYLLALATEE

SEQ ID NO: 1518769 - protein, 17 aa, Mycobacterium tuberculosis
LHQLGLSLKDSPPSFDP

SEQ ID NO: 1518770 - protein, 29 aa, Mycobacterium tuberculosis
LIATMRRAGLIAPLRPDRYLRIVAAMRRE

SEQ ID NO: 1518771 - protein, 17 aa, Mycobacterium tuberculosis
LIDELGTLTWRQLDERG

SEQ ID NO: 1518772 - protein, 18 aa, Mycobacterium tuberculosis
LILGPWNHTGGWRVDPLR

SEQ ID NO: 1518773 - protein, 19 aa, Mycobacterium tuberculosis
LILVIAPDFEHTDAVRAAG

SEQ ID NO: 1518774 - protein, 18 aa, Mycobacterium tuberculosis
LKAVAVKGPYFGDRRKAF

SEQ ID NO: 1518775 - protein, 18 aa, Mycobacterium tuberculosis
LKIALSTHFPYTGFRAKL

SEQ ID NO: 1518776 - protein, 18 aa, Mycobacterium tuberculosis
LLADPPVLHLYDDRLLYL

SEQ ID NO: 1518777 - protein, 17 aa, Mycobacterium tuberculosis
LLAGLDPRYPLKGVFHA

SEQ ID NO: 1518778 - protein, 17 aa, Mycobacterium tuberculosis
LLALLHRADAAVLPSHY

SEQ ID NO: 1518779 - protein, 24 aa, Mycobacterium tuberculosis
LLANAIGYPIAASVALVTPAAGAN

SEQ ID NO: 1518780 - protein, 34 aa, Mycobacterium tuberculosis
LLAVPPHGWVNLHFSLLPAWRGAAPVQAAIAAGD

SEQ ID NO: 1518781 - protein, 24 aa, Mycobacterium tuberculosis
LLDSHVAYWWSAEPQRLSMAASQA

SEQ ID NO: 1518782 - protein, 17 aa, Mycobacterium tuberculosis
LLDVKRWVTLTGVGGVG

SEQ ID NO: 1518783 - protein, 17 aa, Mycobacterium tuberculosis
LLFSVFEGGLRHGLFHG

SEQ ID NO: 1518784 - protein, 28 aa, Mycobacterium tuberculosis
LLGAINAPTMALLGRPLIGHGADGAPGT

SEQ ID NO: 1518785 - protein, 17 aa, Mycobacterium tuberculosis
LLGRPLVGNGANGAPGT

SEQ ID NO: 1518786 - protein, 22 aa, Mycobacterium tuberculosis
LLGSRWLAHYTATSAFLDSFAG

SEQ ID NO: 1518787 - protein, 17 aa, Mycobacterium tuberculosis
LLLQVLFHARIAEDASQ

SEQ ID NO: 1518788 - protein, 20 aa, Mycobacterium tuberculosis
LLMAPTYAVPRLLARNGLSL

SEQ ID NO: 1518789 - protein, 23 aa, Mycobacterium tuberculosis
LLMAVERIELFVDVLLKGGRTAD

SEQ ID NO: 1518790 - protein, 17 aa, Mycobacterium tuberculosis
LLPAFPKPKLPLPAFPK

SEQ ID NO: 1518791 - protein, 18 aa, Mycobacterium tuberculosis
LLPEAFAVAREAAWRVLD

SEQ ID NO: 1518792 - protein, 27 aa, Mycobacterium tuberculosis
LLQSAMLRAMARMLRQSRPAKTARRPR

SEQ ID NO: 1518793 - protein, 25 aa, Mycobacterium tuberculosis
LLRELEARIIQWRNANPQLAADYRA

SEQ ID NO: 1518794 - protein, 18 aa, Mycobacterium tuberculosis
LLSGLPVRRLWGIGPVAE

SEQ ID NO: 1518795 - protein, 28 aa, Mycobacterium tuberculosis
LLTETGQILFRRLAPFVGGFDLAAVRAV

SEQ ID NO: 1518796 - protein, 22 aa, Mycobacterium tuberculosis
LLTGTLPNRLYWLSANIDPAGT

SEQ ID NO: 1518797 - protein, 23 aa, Mycobacterium tuberculosis
LLTGTLPNRLYWLSANIDPAGTD

SEQ ID NO: 1518798 - protein, 18 aa, Mycobacterium tuberculosis
LLVITEKKSWKVKRIRNT

SEQ ID NO: 1518799 - protein, 19 aa, Mycobacterium tuberculosis
LLVSGHHWGPTGTKPRGPS

SEQ ID NO: 1518800 - protein, 29 aa, Mycobacterium tuberculosis
LMSTFGPRTALWLLLAKCGGDTEVSAQAW

SEQ ID NO: 1518801 - protein, 26 aa, Mycobacterium tuberculosis
LNAINAPTQALLGRPLIGDGADGTAP

SEQ ID NO: 1518802 - protein, 26 aa, Mycobacterium tuberculosis
LNAINAPTQTLFGRPLIGDGANGTAE

SEQ ID NO: 1518803 - protein, 23 aa, Mycobacterium tuberculosis
LNDMTHWLAMVLADGVYNGRRIT

SEQ ID NO: 1518804 - protein, 35 aa, Mycobacterium tuberculosis
LNIGTIEDYALTEWQRILDVNLTGVFLGIRAVVKP

SEQ ID NO: 1518805 - protein, 24 aa, Mycobacterium tuberculosis
LNLKLQPARYRQLLQHILQHVADG

SEQ ID NO: 1518806 - protein, 18 aa, Mycobacterium tuberculosis
LNNLQTYDKTFGLETMCV

SEQ ID NO: 1518807 - protein, 35 aa, Mycobacterium tuberculosis
LPGIRSILDTLPPHPAHFLWLNWGPCPPRQDMAYS

SEQ ID NO: 1518808 - protein, 19 aa, Mycobacterium tuberculosis
LPNIPLLEYAARFITPVHP

SEQ ID NO: 1518809 - protein, 18 aa, Mycobacterium tuberculosis
LPSKENGFALLKVGPRDL

SEQ ID NO: 1518810 - protein, 18 aa, Mycobacterium tuberculosis
LPVILVVNKTDRPDARIA

SEQ ID NO: 1518811 - protein, 25 aa, Mycobacterium tuberculosis
LQADLLGPVDLPPGVRRPAGIPADA

SEQ ID NO: 1518812 - protein, 20 aa, Mycobacterium tuberculosis
LQAPQVPIPPPPPGPDVIPG

SEQ ID NO: 1518813 - protein, 25 aa, Mycobacterium tuberculosis
LQDRVLLRFGLHQALRLGKPLQFHV

SEQ ID NO: 1518814 - protein, 25 aa, Mycobacterium tuberculosis
LQHISSGVFLLKASVRELRECVGSE

SEQ ID NO: 1518815 - protein, 23 aa, Mycobacterium tuberculosis
LQLQRVFVLTFETEFFARHGFTE

SEQ ID NO: 1518816 - protein, 19 aa, Mycobacterium tuberculosis
LQNLAIFLGPVIESVFIGF

SEQ ID NO: 1518817 - protein, 18 aa, Mycobacterium tuberculosis
LQRTAPWVESLGLDHLRE

SEQ ID NO: 1518818 - protein, 31 aa, Mycobacterium tuberculosis
LQSAFPQLLSAVPRALQGLALPTASQSASAT

SEQ ID NO: 1518819 - protein, 25 aa, Mycobacterium tuberculosis
LQSPTFQPVRRFGWRIMPQNLSDAG

SEQ ID NO: 1518820 - protein, 28 aa, Mycobacterium tuberculosis
LQSPTFQPVRRFGWRIMPQNLSDAGVSW

SEQ ID NO: 1518821 - protein, 17 aa, Mycobacterium tuberculosis
LQTGVRWKDLGLVVVDE

SEQ ID NO: 1518822 - protein, 19 aa, Mycobacterium tuberculosis
LRALPRKHDHRLAHRPWLT

SEQ ID NO: 1518823 - protein, 26 aa, Mycobacterium tuberculosis
LRAQGRHCVAVKWGLWQAPKAGEPAR

SEQ ID NO: 1518824 - protein, 28 aa, Mycobacterium tuberculosis
LREANGDRYLPIWIGQSEAAAIALEQQG

SEQ ID NO: 1518825 - protein, 17 aa, Mycobacterium tuberculosis
LRESFGGSKPAPAKGTA

SEQ ID NO: 1518826 - protein, 18 aa, Mycobacterium tuberculosis
LRLEGYRRLAAASSDREV

SEQ ID NO: 1518827 - protein, 44 aa, Mycobacterium tuberculosis; identical to SEQ ID NO: 1392754

SEQ ID NO: 1518828 - protein, 17 aa, Mycobacterium tuberculosis
LRLVDLCERLGLAKSTT

SEQ ID NO: 1518829 - protein, 18 aa, Mycobacterium tuberculosis
LRNRDQWDLLQRDPSLLP

SEQ ID NO: 1518830 - protein, 28 aa, Mycobacterium tuberculosis
LRPYQQRGLAWLAFLSSLGLGSCLADDM

SEQ ID NO: 1518831 - protein, 17 aa, Mycobacterium tuberculosis
LRRQRVWTPVLMLTARG

SEQ ID NO: 1518832 - protein, 28 aa, Mycobacterium tuberculosis
LRVVAPDAFFQFPTSKYGLALDNWSIRR

SEQ ID NO: 1518833 - protein, 19 aa, Mycobacterium tuberculosis
LRYSVIREVLPTRRARTFD

SEQ ID NO: 1518834 - protein, 23 aa, Mycobacterium tuberculosis
LSAGYTFMGFAEDLPAVGSTVCS

SEQ ID NO: 1518835 - protein, 26 aa, Mycobacterium tuberculosis
LSAQAAAFHQQFVQTLAGGAGAYAAA

SEQ ID NO: 1518836 - protein, 30 aa, Mycobacterium tuberculosis
LSAQAAAFHQQFVRALSSAAGSYAAAEAAN

SEQ ID NO: 1518837 - protein, 26 aa, Mycobacterium tuberculosis
LSAQAALFHEQFVHAMTAGAGAYAGA

SEQ ID NO: 1518838 - protein, 20 aa, Mycobacterium tuberculosis
LSAQAALFHEQFVRALTAGA

SEQ ID NO: 1518839 - protein, 24 aa, Mycobacterium tuberculosis
LSAQAALFHEQFVRALTAGAGSYA

SEQ ID NO: 1518840 - protein, 17 aa, Mycobacterium tuberculosis
LSFFRLALRLRRERNEF

SEQ ID NO: 1518841 - protein, 18 aa, Mycobacterium tuberculosis
LSGWWNQAASALAGSGSG

SEQ ID NO: 1518842 - protein, 23 aa, Mycobacterium tuberculosis
LSLTLNRLPQVAALFLAGQLSAR

SEQ ID NO: 1518843 - protein, 26 aa, Mycobacterium tuberculosis
LSLVKFACAWTYIALDPAVVQSVPVF

SEQ ID NO: 1518844 - protein, 21 aa, Mycobacterium tuberculosis
LSPALTMPFTPPPTFMNHRLT

SEQ ID NO: 1518845 - protein, 18 aa, Mycobacterium tuberculosis
LSPFFNETAYCLGVEKLL

SEQ ID NO: 1518846 - protein, 23 aa, Mycobacterium tuberculosis
LSRYSYLVSLLPSRIVADLGAPV

SEQ ID NO: 1518847 - protein, 24 aa, Mycobacterium tuberculosis
LSSSAWPWQPYLLSHHQGGIAVTD

SEQ ID NO: 1518848 - protein, 17 aa, Mycobacterium tuberculosis
LSTARFEFRWNDQFALS

SEQ ID NO: 1518849 - protein, 25 aa, Mycobacterium tuberculosis
LSVPTRRGNWWYYARTFEGKQYGVH

SEQ ID NO: 1518850 - protein, 17 aa, Mycobacterium tuberculosis
LTAALQGLRGKGRLTDA

SEQ ID NO: 1518851 - protein, 17 aa, Mycobacterium tuberculosis
LTALLAAGFVRTPRGLR

SEQ ID NO: 1518852 - protein, 23 aa, Mycobacterium tuberculosis
LTATQLALPGGMQPLWGPDQRRV

SEQ ID NO: 1518853 - protein, 28 aa, Mycobacterium tuberculosis
LTAVAMLVAIFRARPSPFYIMDEVEAAL

SEQ ID NO: 1518854 - protein, 25 aa, Mycobacterium tuberculosis
LTAYRARSTGQRPSWAPLPVQYADY

SEQ ID NO: 1518855 - protein, 34 aa, Mycobacterium tuberculosis
LTDPAVNGALVHPLMIALISYAVGGPIRMIDARG

SEQ ID NO: 1518856 - protein, 19 aa, Mycobacterium tuberculosis
LTFALNLGVDMVALSFVRS

SEQ ID NO: 1518857 - protein, 26 aa, Mycobacterium tuberculosis
LTINIRIPVNITLNELPFNVAGIFTG

SEQ ID NO: 1518858 - protein, 20 aa, Mycobacterium tuberculosis
LTLEDFLEQMLAVRKMGPIG

SEQ ID NO: 1518859 - protein, 30 aa, Mycobacterium tuberculosis; identical to SEQ ID NO: 220488

SEQ ID NO: 1518860 - protein, 19 aa, Mycobacterium tuberculosis
LTNVLTHPGTFGLAGAAIS

SEQ ID NO: 1518861 - protein, 21 aa, Mycobacterium tuberculosis
LTRSGGHCWFLGGVADSVEEL

SEQ ID NO: 1518862 - protein, 17 aa, Mycobacterium tuberculosis
LTTVRRKYDPDRIMYSG

SEQ ID NO: 1518863 - protein, 18 aa, Mycobacterium tuberculosis
LTVPPWAVAGLGSQAELL

SEQ ID NO: 1518864 - protein, 21 aa, Mycobacterium tuberculosis
LTVVNPLVDATWRFMTLDTDG

SEQ ID NO: 1518865 - protein, 25 aa, Mycobacterium tuberculosis
LVAPLAPLHGWGLDPYLTPGFTELS

SEQ ID NO: 1518866 - protein, 21 aa, Mycobacterium tuberculosis
LVARVKALLRRRGSTATSSSE

SEQ ID NO: 1518867 - protein, 19 aa, Mycobacterium tuberculosis
LVDATWRFMTLDTDGKIRM

SEQ ID NO: 1518868 - protein, 17 aa, Mycobacterium tuberculosis
LVDRWRAVDGCQGDPSA

SEQ ID NO: 1518869 - protein, 20 aa, Mycobacterium tuberculosis
LVELAFALGQLASAGIGVGV

SEQ ID NO: 1518870 - protein, 19 aa, Mycobacterium tuberculosis
LVERFFEARKMMSSMLGGM

SEQ ID NO: 1518871 - protein, 18 aa, Mycobacterium tuberculosis
LVGRLMSYKLDRSRPLWE

SEQ ID NO: 1518872 - protein, 17 aa, Mycobacterium tuberculosis
LVHGIGFQRDVLGAEPA

SEQ ID NO: 1518873 - protein, 20 aa, Mycobacterium tuberculosis
LVISGRRFGSTGALRRNTRR

SEQ ID NO: 1518874 - protein, 19 aa, Mycobacterium tuberculosis
LVMDSQFLTQNFGPVIGTG

SEQ ID NO: 1518875 - protein, 18 aa, Mycobacterium tuberculosis
LVPPSDRPWRLAMSTAGT

SEQ ID NO: 1518876 - protein, 19 aa, Mycobacterium tuberculosis
LVPPSDRPWRLAMSTAGTF

SEQ ID NO: 1518877 - protein, 18 aa, Mycobacterium tuberculosis
LWAADVAAMVSYHSGASA

SEQ ID NO: 1518878 - protein, 26 aa, Mycobacterium tuberculosis
LWGDRYGVVADPFGHHWSLGQPVREV

SEQ ID NO: 1518879 - protein, 18 aa, Mycobacterium tuberculosis
LWVPDILECLASVMADAG

SEQ ID NO: 1518880 - protein, 24 aa, Mycobacterium tuberculosis
LYATQLMTELSERGEKLPAAQRRD

SEQ ID NO: 1518881 - protein, 22 aa, Mycobacterium tuberculosis
LYELISDRAITGKPLILTSNRA

SEQ ID NO: 1518882 - protein, 23 aa, Mycobacterium tuberculosis
MAAAAAPYAAWLAAAAVQAEQTA

SEQ ID NO: 1518883 - protein, 22 aa, Mycobacterium tuberculosis
MAAAAAPYAGWLSAAAASAESA

SEQ ID NO: 1518884 - protein, 17 aa, Mycobacterium tuberculosis
MAELIREAALQGVRDEL

SEQ ID NO: 1518885 - protein, 20 aa, Mycobacterium tuberculosis
MANPIAFLCGAIQAASRLGG

SEQ ID NO: 1518886 - protein, 23 aa, Mycobacterium tuberculosis
MASTFTIVAIGTYCPAVIAPLMP

SEQ ID NO: 1518887 - protein, 25 aa, Mycobacterium tuberculosis
MAVSLRLWRCGRVGPMRVAVVAGPD

SEQ ID NO: 1518888 - protein, 25 aa, Mycobacterium tuberculosis
MDNGMPILVFNLLTDGNIARAVRGE

SEQ ID NO: 1518889 - protein, 18 aa, Mycobacterium tuberculosis
MDQLFRTVAGLGSKSDSA

SEQ ID NO: 1518890 - protein, 18 aa, Mycobacterium tuberculosis
MDYLKEGIGLRAMAQRDP

SEQ ID NO: 1518891 - protein, 30 aa, Mycobacterium tuberculosis
MERLRARLPAPDWMPPLTVAQQLGFGEANV

SEQ ID NO: 1518892 - protein, 24 aa, Mycobacterium tuberculosis
MGALHSWCLAAERPELVSALVVED

SEQ ID NO: 1518893 - protein, 34 aa, Mycobacterium tuberculosis
MGCGDACPYFPGVSYRNWKLPDPAGQPLDVVRMI

SEQ ID NO: 1518894 - protein, 25 aa, Mycobacterium tuberculosis
MGEGEAMLFGEYIRLMALVEYSADE

SEQ ID NO: 1518895 - protein, 22 aa, Mycobacterium tuberculosis
MGGSIPFIAEFAAAFPQATILV

SEQ ID NO: 1518896 - protein, 30 aa, Mycobacterium tuberculosis; identical to SEQ ID NO: 236652

SEQ ID NO: 1518897 - protein, 18 aa, Mycobacterium tuberculosis
MGSNAEFVVALLAASRAD

SEQ ID NO: 1518898 - protein, 28 aa, Mycobacterium tuberculosis
MHEPSLMQNICFLYHLVGGGTGVWHVPI

SEQ ID NO: 1518899 - protein, 26 aa, Mycobacterium tuberculosis
MIDDISQLVYLHLRFHGYGDGKWTDS

SEQ ID NO: 1518900 - protein, 22 aa, Mycobacterium tuberculosis
MLQAFIGRMSGVSPSVWGGLAA

SEQ ID NO: 1518901 - protein, 39 aa, Mycobacterium tuberculosis; identical to SEQ ID NO: 225348

SEQ ID NO: 1518902 - protein, 23 aa, Mycobacterium tuberculosis
MLTLQPVTAHRIMTGAPVPIGAT

SEQ ID NO: 1518903 - protein, 29 aa, Mycobacterium tuberculosis
MLVGAQCRDLLHWRFCRGVPPRATNDTDI

SEQ ID NO: 1518904 - protein, 24 aa, Mycobacterium tuberculosis
MMAVATQYLAWLSTAAAQAEQAAA

SEQ ID NO: 1518905 - protein, 35 aa, Mycobacterium tuberculosis
MNDHNFFVMTTPDDPIRYPARLAPLHGWGSDGADT

SEQ ID NO: 1518906 - protein, 17 aa, Mycobacterium tuberculosis
MNLIDAAVAHGVVRAPD

SEQ ID NO: 1518907 - protein, 20 aa, Mycobacterium tuberculosis
MPFLEHFVMRSRYVDNPGLF

SEQ ID NO: 1518908 - protein, 24 aa, Mycobacterium tuberculosis
MPNAGLPVLGAKGAEYPLLPDELA

SEQ ID NO: 1518909 - protein, 18 aa, Mycobacterium tuberculosis
MRIADASGIPYVGRILVN

SEQ ID NO: 1518910 - protein, 23 aa, Mycobacterium tuberculosis
MRLKMITTPTDWPRYGGYALAGV

SEQ ID NO: 1518911 - protein, 17 aa, Mycobacterium tuberculosis
MRQLLLDLLANNQDLAG

SEQ ID NO: 1518912 - protein, 20 aa, Mycobacterium tuberculosis
MSATPIPRTLEMSLAGIREM

SEQ ID NO: 1518913 - protein, 19 aa, Mycobacterium tuberculosis
MSFVVTIPEALAAVATDLA

SEQ ID NO: 1518914 - protein, 18 aa, Mycobacterium tuberculosis
MSLAPLAYTLFQRTMRHD

SEQ ID NO: 1518915 - protein, 22 aa, Mycobacterium tuberculosis
MTDFTFYIPLAKAAEAAGYSSM

SEQ ID NO: 1518916 - protein, 25 aa, Mycobacterium tuberculosis
MTQLHYPLRTRQIPQRVRPQVNQPC

SEQ ID NO: 1518917 - protein, 28 aa, Mycobacterium tuberculosis
MTTSEIATVLAWHDALNAADIETLVALS

SEQ ID NO: 1518918 - protein, 22 aa, Mycobacterium tuberculosis
MVAAITVGLSRGWSLIKSVRLG

SEQ ID NO: 1518919 - protein, 20 aa, Mycobacterium tuberculosis
MVAPGLLSWRDIARVMSENP

SEQ ID NO: 1518920 - protein, 27 aa, Mycobacterium tuberculosis
MVELLPRFETITYRELWARAGTLATAL

SEQ ID NO: 1518921 - protein, 30 aa, Mycobacterium tuberculosis
MVLIAAWGHPLPNQLYVRWAGQDEWAAVPL

SEQ ID NO: 1518922 - protein, 22 aa, Mycobacterium tuberculosis
MVRSLVTAYAPPDVREFVLGKL

SEQ ID NO: 1518923 - protein, 17 aa, Mycobacterium tuberculosis
NAAVLVAARGRLMQALP

SEQ ID NO: 1518924 - protein, 20 aa, Mycobacterium tuberculosis
NAEFVVALLAASRADLVVVP

SEQ ID NO: 1518925 - protein, 20 aa, Mycobacterium tuberculosis
NAGLFGVGGTGGPGGPGGPG

SEQ ID NO: 1518926 - protein, 25 aa, Mycobacterium tuberculosis
NAINAPTQTLLGRPLIGNGADGGPG

SEQ ID NO: 1518927 - protein, 19 aa, Mycobacterium tuberculosis
NAIVGPIVYLGGGAGYRSK

SEQ ID NO: 1518928 - protein, 26 aa, Mycobacterium tuberculosis
NALNAPTQALLGRPLIGDGAAGAPGT

SEQ ID NO: 1518929 - protein, 21 aa, Mycobacterium tuberculosis
NAPTQALLGRPLIGNGADGTA

SEQ ID NO: 1518930 - protein, 21 aa, Mycobacterium tuberculosis
NAPTQTLLGRPLVGDGADGAS

SEQ ID NO: 1518931 - protein, 21 aa, Mycobacterium tuberculosis
NAPVLAATGRPLIGNGANGAP

SEQ ID NO: 1518932 - protein, 18 aa, Mycobacterium tuberculosis
NAQAYQALSAQAAAFHQQ

SEQ ID NO: 1518933 - protein, 23 aa, Mycobacterium tuberculosis
NATFLRDALHKAGIEAQFVARGE

SEQ ID NO: 1518934 - protein, 26 aa, Mycobacterium tuberculosis
NAVQNFPALVANLPAAIDAAVQQFLA

SEQ ID NO: 1518935 - protein, 24 aa, Mycobacterium tuberculosis
NAWFIAETIGAGTFPWVLAITMPY

SEQ ID NO: 1518936 - protein, 17 aa, Mycobacterium tuberculosis
NCTGWKIGWACGPAELI

SEQ ID NO: 1518937 - protein, 22 aa, Mycobacterium tuberculosis
NDAVLLGCPGTDLAHSAASFHL

SEQ ID NO: 1518938 - protein, 27 aa, Mycobacterium tuberculosis
NDNGPPPPFTSWMPPGYPPEPPQVPYP

SEQ ID NO: 1518939 - protein, 20 aa, Mycobacterium tuberculosis
NDPDRLILRKYDPILRLHVD

SEQ ID NO: 1518940 - protein, 23 aa, Mycobacterium tuberculosis
NEGRGDFFAVVRSLALFVNALHQ

SEQ ID NO: 1518941 - protein, 18 aa, Mycobacterium tuberculosis
NEPDWVNTIFLSTRFRAW

SEQ ID NO: 1518942 - protein, 24 aa, Mycobacterium tuberculosis
NEPSRTWFAAMKPIANNFGEVQLP

SEQ ID NO: 1518943 - protein, 18 aa, Mycobacterium tuberculosis
NFDALRTLALPFGIQVET

SEQ ID NO: 1518944 - protein, 34 aa, Mycobacterium tuberculosis
NFGPLQPLFDVINAPTLALLNRPLIGNGADGTAA

SEQ ID NO: 1518945 - protein, 21 aa, Mycobacterium tuberculosis
NFRDVLVALGIYPGAAELGAE

SEQ ID NO: 1518946 - protein, 22 aa, Mycobacterium tuberculosis
NFSNGILWRGNYEGLAGFSFGY

SEQ ID NO: 1518947 - protein, 26 aa, Mycobacterium tuberculosis
NGAAGGAGGRLFGNGGAGGNGGTAGQ

SEQ ID NO: 1518948 - protein, 27 aa, Mycobacterium tuberculosis
NGAAGIVPAVLHYAIHYTSAGAGDPDD

SEQ ID NO: 1518949 - protein, 30 aa, Mycobacterium tuberculosis; identical to SEQ ID NO: 220852

SEQ ID NO: 1518950 - protein, 21 aa, Mycobacterium tuberculosis
NGGAIFNAGTPGAAGTGGDGG

SEQ ID NO: 1518951 - protein, 27 aa, Mycobacterium tuberculosis
NGGDAEPGVPPGAGGAGGAGTTGGKGG

SEQ ID NO: 1518952 - protein, 28 aa, Mycobacterium tuberculosis
NGGDGGFGGGAGAGGGGLTAGANGTGGQ

SEQ ID NO: 1518953 - protein, 29 aa, Mycobacterium tuberculosis
NGGDPGLGARLFQVGSRGGDGGVGGWLYG

SEQ ID NO: 1518954 - protein, 27 aa, Mycobacterium tuberculosis
NGGHGGNGGWLLGNGGNGGLGGDGDGG

SEQ ID NO: 1518955 - protein, 25 aa, Mycobacterium tuberculosis
NGGNAGVIANGSFAPSFVGFGGNGG

SEQ ID NO: 1518956 - protein, 26 aa, Mycobacterium tuberculosis
NGGNAGVIANGSFAPSFVGFGGNGGN

SEQ ID NO: 1518957 - protein, 23 aa, Mycobacterium tuberculosis
NGGNGLNLVGVPGTAGGGADGAN

SEQ ID NO: 1518958 - protein, 23 aa, Mycobacterium tuberculosis
NGGQSGLLFGNAGAGGAGAAGGA

SEQ ID NO: 1518959 - protein, 19 aa, Mycobacterium tuberculosis
NGGTGWNGGKGDTGSGGGA

SEQ ID NO: 1518960 - protein, 18 aa, Mycobacterium tuberculosis
NGGWLLGNGGHGGAGGIG

SEQ ID NO: 1518961 - protein, 26 aa, Mycobacterium tuberculosis
NGIDAPALWPGLPIRPVKGEVLRLRW

SEQ ID NO: 1518962 - protein, 24 aa, Mycobacterium tuberculosis
NGKSWLVFGPYAGWSPKFLKHGQI

SEQ ID NO: 1518963 - protein, 17 aa, Mycobacterium tuberculosis
NGLAFHQHWLEGLDTQP

SEQ ID NO: 1518964 - protein, 23 aa, Mycobacterium tuberculosis
NGSRIYVLLPQTTTGRAVTSWVR

SEQ ID NO: 1518965 - protein, 21 aa, Mycobacterium tuberculosis
NGTPLLNWLRQRGVDEVDVVA

SEQ ID NO: 1518966 - protein, 23 aa, Mycobacterium tuberculosis
NGYIETWPVARLLRDAQVNTIWE

SEQ ID NO: 1518967 - protein, 29 aa, Mycobacterium tuberculosis
NIGLLGKFMPNYLFAPDSTLPVIPRRDDA

SEQ ID NO: 1518968 - protein, 17 aa, Mycobacterium tuberculosis
NIGSWNLGGGNVGLLNL

SEQ ID NO: 1518969 - protein, 28 aa, Mycobacterium tuberculosis
NIPIHQLRRTGLLDKLLLLAGQPEESLA

SEQ ID NO: 1518970 - protein, 20 aa, Mycobacterium tuberculosis
NISAILISPPQAPPGTQWTP

SEQ ID NO: 1518971 - protein, 21 aa, Mycobacterium tuberculosis
NLHFTALPDKLAAIETNLFVP

SEQ ID NO: 1518972 - protein, 20 aa, Mycobacterium tuberculosis
NLIGMGVIPLQFPEGKSASS

SEQ ID NO: 1518973 - protein, 22 aa, Mycobacterium tuberculosis
NNTRVWVWSPTNPGASDPAAMI

SEQ ID NO: 1518974 - protein, 24 aa, Mycobacterium tuberculosis
NPDAAWYYRRPSPLARRIKNHVAF

SEQ ID NO: 1518975 - protein, 19 aa, Mycobacterium tuberculosis
NPDLYRPQTSLPQPLPISS

SEQ ID NO: 1518976 - protein, 21 aa, Mycobacterium tuberculosis
NPFWDRLSRAMYRLARPTAAA

SEQ ID NO: 1518977 - protein, 19 aa, Mycobacterium tuberculosis
NPHFYQNFIHEFGMSRSRR

SEQ ID NO: 1518978 - protein, 22 aa, Mycobacterium tuberculosis
NQRYESGALRQAGFYGLDLYSL

SEQ ID NO: 1518979 - protein, 17 aa, Mycobacterium tuberculosis
NQTITLAWPVSSITIPQ

SEQ ID NO: 1518980 - protein, 23 aa, Mycobacterium tuberculosis
NQVQEWLQWLQKIGYTDFYNNVI

SEQ ID NO: 1518981 - protein, 25 aa, Mycobacterium tuberculosis
NRDKRSLVFPVKRLADLGFRVLATE

SEQ ID NO: 1518982 - protein, 23 aa, Mycobacterium tuberculosis
NRHLRRIGHLPILHRYATVCKLI

SEQ ID NO: 1518983 - protein, 19 aa, Mycobacterium tuberculosis
NRLYIIISGKVKIGRRAPD

SEQ ID NO: 1518984 - protein, 26 aa, Mycobacterium tuberculosis
NRNAFVQLVLSNLFGQNAPAIAAAEA

SEQ ID NO: 1518985 - protein, 36 aa, Mycobacterium tuberculosis
NRRGNYLYNFWRDAANPPGLWRRTTLDSYRTDSPGW

SEQ ID NO: 1518986 - protein, 26 aa, Mycobacterium tuberculosis
NSAIVRPLLRFFFKSWFRVEVSGVEN

SEQ ID NO: 1518987 - protein, 28 aa, Mycobacterium tuberculosis
NSGNYSNGFFWRGDYQGLGGFAYQSAVS

SEQ ID NO: 1518988 - protein, 22 aa, Mycobacterium tuberculosis
NSGSYNFGFGNSGSYNFGFGNT

SEQ ID NO: 1518989 - protein, 26 aa, Mycobacterium tuberculosis
NSNEGFFNTGMFNNGIYNSGVASTGI

SEQ ID NO: 1518990 - protein, 22 aa, Mycobacterium tuberculosis
NSNGLLRQYFPKGTSLSTYTPD

SEQ ID NO: 1518991 - protein, 24 aa, Mycobacterium tuberculosis
NTPAIAATEFDYVEMWAQDVGAMV

SEQ ID NO: 1518992 - protein, 24 aa, Mycobacterium tuberculosis
NTVGPPLLPPILGGGMPAAPGPAL

SEQ ID NO: 1518993 - protein, 26 aa, Mycobacterium tuberculosis
NTVSGLFNMSLVAITTPALISGFFNT

SEQ ID NO: 1518994 - protein, 19 aa, Mycobacterium tuberculosis
NVARWPSMTKARLAGQVDK

SEQ ID NO: 1518995 - protein, 26 aa, Mycobacterium tuberculosis
NVDNPHPLLLLTHPVPNTGAVVVQGN

SEQ ID NO: 1518996 - protein, 24 aa, Mycobacterium tuberculosis
NVGIHSLAWARLAPVVALEPAPGT

SEQ ID NO: 1518997 - protein, 33 aa, Mycobacterium tuberculosis
NVPGPQGALYWNGARLDALYLLSAPVDGAALNI

SEQ ID NO: 1518998 - protein, 20 aa, Mycobacterium tuberculosis
NVRELIEITLVKNPAMRYRS

SEQ ID NO: 1518999 - protein, 23 aa, Mycobacterium tuberculosis
NVRGAWLVCRAAGRVLLEQGQGG

SEQ ID NO: 1519000 - protein, 20 aa, Mycobacterium tuberculosis
NVVDAYRYWTREAIIADIDT

SEQ ID NO: 1519001 - protein, 19 aa, Mycobacterium tuberculosis
NWTGIPVFKLTEAETTRLL

SEQ ID NO: 1519002 - protein, 31 aa, Mycobacterium tuberculosis
NYSNGAFWRGDYQGLLGFSYTSTIIPEFTVA

SEQ ID NO: 1519003 - protein, 22 aa, Mycobacterium tuberculosis
PAAALQATRLAAAPIAATDGAG

SEQ ID NO: 1519004 - protein, 23 aa, Mycobacterium tuberculosis
PAADLSVWPPLGAAPVDVDGAYQ

SEQ ID NO: 1519005 - protein, 17 aa, Mycobacterium tuberculosis
PAAQHERKPLAQPAFHA

SEQ ID NO: 1519006 - protein, 17 aa, Mycobacterium tuberculosis
PADLITEYGPHVALPPT

SEQ ID NO: 1519007 - protein, 25 aa, Mycobacterium tuberculosis
PAELHFLGATLWRSGIQRVLRGFVE

SEQ ID NO: 1519008 - protein, 23 aa, Mycobacterium tuberculosis
PAEPTAALPIIRSDGDDSEAATE

SEQ ID NO: 1519009 - protein, 17 aa, Mycobacterium tuberculosis
PAFSLPAITLPSLTIPA

SEQ ID NO: 1519010 - protein, 21 aa, Mycobacterium tuberculosis
PAIVLGLPRLAAGPPTFSITI

SEQ ID NO: 1519011 - protein, 28 aa, Mycobacterium tuberculosis
PALASGPAALAIPALGIGNTGIGNIFSI

SEQ ID NO: 1519012 - protein, 24 aa, Mycobacterium tuberculosis
PALASLRRLIESPSHDVIAVLTRP

SEQ ID NO: 1519013 - protein, 18 aa, Mycobacterium tuberculosis
PANSLLNLDVFVGTPGAT

SEQ ID NO: 1519014 - protein, 20 aa, Mycobacterium tuberculosis
PANSLLNLDVFVGTPGATIP

SEQ ID NO: 1519015 - protein, 21 aa, Mycobacterium tuberculosis
PANSLLNLDVFVGTPGATIPA

SEQ ID NO: 1519016 - protein, 22 aa, Mycobacterium tuberculosis
PAPPPPPLPEDGGPPPPVGSQV

SEQ ID NO: 1519017 - protein, 19 aa, Mycobacterium tuberculosis
PAPRKPIPLLMWPDRIKGR

SEQ ID NO: 1519018 - protein, 19 aa, Mycobacterium tuberculosis
PAQRRALTVHSARWRPWRS

SEQ ID NO: 1519019 - protein, 25 aa, Mycobacterium tuberculosis
PARHLGGVLYLFVRGMCGAATPVTA

SEQ ID NO: 1519020 - protein, 20 aa, Mycobacterium tuberculosis
PARPLTVTGGLTFAGGPWSN

SEQ ID NO: 1519021 - protein, 29 aa, Mycobacterium tuberculosis
PASGPAPFPAVPVDLPAPADIANGALFAA

SEQ ID NO: 1519022 - protein, 23 aa, Mycobacterium tuberculosis
PASRISNFPPKRHKTRVLAAAED

SEQ ID NO: 1519023 - protein, 25 aa, Mycobacterium tuberculosis
PATLSVPFSAFPKPQNYPGLPTVSF

SEQ ID NO: 1519024 - protein, 17 aa, Mycobacterium tuberculosis
PAVERLAYFAEGAAAQL

SEQ ID NO: 1519025 - protein, 27 aa, Mycobacterium tuberculosis
PDAPQLAPAVAWVKKRAGRTPRTVTAD

SEQ ID NO: 1519026 - protein, 27 aa, Mycobacterium tuberculosis
PDAPVRYRFHFPRQQRGRFLCIADFIR

SEQ ID NO: 1519027 - protein, 25 aa, Mycobacterium tuberculosis
PDDGDIGLIIAVKRLAAAKTRLAPV

SEQ ID NO: 1519028 - protein, 25 aa, Mycobacterium tuberculosis
PDDSMRWLATVIQMDGRRIDLLELI

SEQ ID NO: 1519029 - protein, 25 aa, Mycobacterium tuberculosis
PDELPATGARLRWAPAQGPSATPAQ

SEQ ID NO: 1519030 - protein, 23 aa, Mycobacterium tuberculosis
PDIDPEILPHLFDRFVRASKSRS

SEQ ID NO: 1519031 - protein, 31 aa, Mycobacterium tuberculosis
PDLACSGLRFAYDGLIPLPDGVRLREQHRIA

SEQ ID NO: 1519032 - protein, 17 aa, Mycobacterium tuberculosis
PDLVLRWAALLHDIGKP

SEQ ID NO: 1519033 - protein, 20 aa, Mycobacterium tuberculosis
PDQWALRRHDFDLRTAAAAL

SEQ ID NO: 1519034 - protein, 21 aa, Mycobacterium tuberculosis
PDRLRRWMAVAARIELRTGGA

SEQ ID NO: 1519035 - protein, 21 aa, Mycobacterium tuberculosis
PDSAQVRLKRMYPGAHYRATT

SEQ ID NO: 1519036 - protein, 20 aa, Mycobacterium tuberculosis
PDVGKLVELAFALGQLASAG

SEQ ID NO: 1519037 - protein, 33 aa, Mycobacterium tuberculosis; identical to SEQ ID NO: 785408

SEQ ID NO: 1519038 - protein, 17 aa, Mycobacterium tuberculosis
PDWLGLPDKLAGRRAWG

SEQ ID NO: 1519039 - protein, 24 aa, Mycobacterium tuberculosis
PDYPASTYANYLPRFFRGISDDAD

SEQ ID NO: 1519040 - protein, 27 aa, Mycobacterium tuberculosis
PECQQAVRFGLFHLLQASARAERRAIP

SEQ ID NO: 1519041 - protein, 19 aa, Mycobacterium tuberculosis
PEEVALELLQNELGARRID

SEQ ID NO: 1519042 - protein, 18 aa, Mycobacterium tuberculosis
PEFTDTGAFPFLAVEGPG

SEQ ID NO: 1519043 - protein, 24 aa, Mycobacterium tuberculosis
PEINSLRMYLGAGSAPMLQAAAAW

SEQ ID NO: 1519044 - protein, 20 aa, Mycobacterium tuberculosis
PETYQQAFYARDLAGTVVLV

SEQ ID NO: 1519045 - protein, 23 aa, Mycobacterium tuberculosis
PEVAEVVAMLRLVADPTAGAAAM

SEQ ID NO: 1519046 - protein, 17 aa, Mycobacterium tuberculosis
PFADFELRIADDGEVLL

SEQ ID NO: 1519047 - protein, 19 aa, Mycobacterium tuberculosis
PFAELGLNSLMAMAIRREA

SEQ ID NO: 1519048 - protein, 18 aa, Mycobacterium tuberculosis
PGAGGTSGLLIGENGLNG

SEQ ID NO: 1519049 - protein, 19 aa, Mycobacterium tuberculosis
PGAKGAHGFTPTSGGDGGD

SEQ ID NO: 1519050 - protein, 23 aa, Mycobacterium tuberculosis
PGALLGAKPFTFDPAALAAAQAA

SEQ ID NO: 1519051 - protein, 18 aa, Mycobacterium tuberculosis
PGARVIPTIYFLRHSTDP

SEQ ID NO: 1519052 - protein, 31 aa, Mycobacterium tuberculosis
PGAVLVFPHAGGAAAAYRWLAKSLVANDVDT

SEQ ID NO: 1519053 - protein, 27 aa, Mycobacterium tuberculosis
PGCYPTAALLALFPALAADLIEPAVTV

SEQ ID NO: 1519054 - protein, 28 aa, Mycobacterium tuberculosis
PGGNGGNAGWLYGRGGVGGAGGIGGGTG

SEQ ID NO: 1519055 - protein, 20 aa, Mycobacterium tuberculosis
PGGSSGIQGNMGPPGTQGAD

SEQ ID NO: 1519056 - protein, 21 aa, Mycobacterium tuberculosis
PGIPLSLNALGGVGPITVPGV

SEQ ID NO: 1519057 - protein, 22 aa, Mycobacterium tuberculosis
PGLGARLFQVGSRGGDGGVGGW

SEQ ID NO: 1519058 - protein, 17 aa, Mycobacterium tuberculosis
PGPNGETWPLQDTVRPW

SEQ ID NO: 1519059 - protein, 17 aa, Mycobacterium tuberculosis
PGPPSPPRGASAPGSAP

SEQ ID NO: 1519060 - protein, 21 aa, Mycobacterium tuberculosis
PGPPVGGLLFTCNGRGRRMFG

SEQ ID NO: 1519061 - protein, 20 aa, Mycobacterium tuberculosis
PGQPWPGRLPDPSPAVLFDD

SEQ ID NO: 1519062 - protein, 27 aa, Mycobacterium tuberculosis
PGRDDLTDLLWRMGIRTIGQFAALSRT

SEQ ID NO: 1519063 - protein, 28 aa, Mycobacterium tuberculosis
PGRDDLTDLLWRMGIRTIGQFAALSRTD

SEQ ID NO: 1519064 - protein, 35 aa, Mycobacterium tuberculosis
PGSAALFAWGLNQLVFLGLRPPPPQRYPLSEAQAA

SEQ ID NO: 1519065 - protein, 42 aa, Mycobacterium tuberculosis
PGSVPELGWPACPLPPAPPALAPLLPPLPPSPPSPPSPPRPV

SEQ ID NO: 1519066 - protein, 21 aa, Mycobacterium tuberculosis
PGSYATGIAFLPQSSKDAAAA

SEQ ID NO: 1519067 - protein, 25 aa, Mycobacterium tuberculosis
PGTLNTGFFSAMTQAGPNSGFFNAG

SEQ ID NO: 1519068 - protein, 27 aa, Mycobacterium tuberculosis
PGTTFGDYWYANLRHTVRFDRAVESAI

SEQ ID NO: 1519069 - protein, 23 aa, Mycobacterium tuberculosis
PGVGLRYEFTSYRGDRIGIVARR

SEQ ID NO: 1519070 - protein, 25 aa, Mycobacterium tuberculosis
PGVTPTDPRPFRAGPHETSALLTSA

SEQ ID NO: 1519071 - protein, 19 aa, Mycobacterium tuberculosis
PHGQIHRRLSGSHPQHAFG

SEQ ID NO: 1519072 - protein, 20 aa, Mycobacterium tuberculosis
PHHQLATTGGWITRKRKDGT

SEQ ID NO: 1519073 - protein, 24 aa, Mycobacterium tuberculosis
PHHQLATTGGWITRKRKDGTTEWL

SEQ ID NO: 1519074 - protein, 27 aa, Mycobacterium tuberculosis
PHLVHAMPQLVPLLPSMGHTKRALVRA

SEQ ID NO: 1519075 - protein, 20 aa, Mycobacterium tuberculosis
PHVTFDPLHALRAIERHRIT

SEQ ID NO: 1519076 - protein, 26 aa, Mycobacterium tuberculosis
PIEKKPLNHFLLGSATLSFGTAGCNL

SEQ ID NO: 1519077 - protein, 24 aa, Mycobacterium tuberculosis
PIHILPDIPININETLYLGPLVVP

SEQ ID NO: 1519078 - protein, 20 aa, Mycobacterium tuberculosis
PINVPPITVPAIGLGINSTG

SEQ ID NO: 1519079 - protein, 25 aa, Mycobacterium tuberculosis
PIQIRTVGRLLGWRLGMDDVDPRSM

SEQ ID NO: 1519080 - protein, 22 aa, Mycobacterium tuberculosis
PIRARRLPKPPSLKRIRGQLHP

SEQ ID NO: 1519081 - protein, 25 aa, Mycobacterium tuberculosis
PISIPNIAIPSIHLGIDPTFDVGPI

SEQ ID NO: 1519082 - protein, 19 aa, Mycobacterium tuberculosis
PITAVSLAWLPAGDYERAL

SEQ ID NO: 1519083 - protein, 18 aa, Mycobacterium tuberculosis
PITIDRIPLNLGASVTVG

SEQ ID NO: 1519084 - protein, 27 aa, Mycobacterium tuberculosis
PIVELLRSRVFFDWFDAMGVDDIPAVF

SEQ ID NO: 1519085 - protein, 21 aa, Mycobacterium tuberculosis
PIVPHIVWGAQRIWTKDRPKK

SEQ ID NO: 1519086 - protein, 17 aa, Mycobacterium tuberculosis
PIVWAGPIANWVAACDA

SEQ ID NO: 1519087 - protein, 19 aa, Mycobacterium tuberculosis
PKAPLGYRPARSTAVMSTM

SEQ ID NO: 1519088 - protein, 23 aa, Mycobacterium tuberculosis
PKIGWRRLEAQAVLSRLLNAPVS

SEQ ID NO: 1519089 - protein, 22 aa, Mycobacterium tuberculosis
PKVFGSWNLHRATLGQPLDWFC

SEQ ID NO: 1519090 - protein, 18 aa, Mycobacterium tuberculosis
PLAIGLFGVNPTVGSIGP

SEQ ID NO: 1519091 - protein, 17 aa, Mycobacterium tuberculosis
PLALGRLLDNPTVTSIA

SEQ ID NO: 1519092 - protein, 24 aa, Mycobacterium tuberculosis
PLATMAGYHLGWWNADRSTAAGSS

SEQ ID NO: 1519093 - protein, 19 aa, Mycobacterium tuberculosis
PLDRLIAFGRERMRFVHAH

SEQ ID NO: 1519094 - protein, 18 aa, Mycobacterium tuberculosis
PLDTPIEIDFGPSPAINL

SEQ ID NO: 1519095 - protein, 32 aa, Mycobacterium tuberculosis
PLEGLLNIVNTPTQLLLGRPLIGNGANGAPGT

SEQ ID NO: 1519096 - protein, 26 aa, Mycobacterium tuberculosis
PLFEPRHRPPPLPPQQERPVWQPVTS

SEQ ID NO: 1519097 - protein, 21 aa, Mycobacterium tuberculosis
PLGFQVPGSIDAITLFPGGLT

SEQ ID NO: 1519098 - protein, 22 aa, Mycobacterium tuberculosis
PLGFQVPGSIDAITLFPGGLTF

SEQ ID NO: 1519099 - protein, 17 aa, Mycobacterium tuberculosis
PLGLALSGATPAFAFPL

SEQ ID NO: 1519100 - protein, 26 aa, Mycobacterium tuberculosis
PLMDVTLLRDRWGFQPAWNAEECLED

SEQ ID NO: 1519101 - protein, 20 aa, Mycobacterium tuberculosis
PLQRLVRALLGFDAKLSQYT

SEQ ID NO: 1519102 - protein, 19 aa, Mycobacterium tuberculosis
PLQWDCFLFGIIQSDDHFT

SEQ ID NO: 1519103 - protein, 21 aa, Mycobacterium tuberculosis
PLRGCYRIAVLSLKGGIGKTT

SEQ ID NO: 1519104 - protein, 17 aa, Mycobacterium tuberculosis
PLRYDLDSAMRPLVRGG

SEQ ID NO: 1519105 - protein, 22 aa, Mycobacterium tuberculosis
PLTDLPVAGYPLVPRVAKPRYR

SEQ ID NO: 1519106 - protein, 35 aa, Mycobacterium tuberculosis
PLTLSAPKPMLPTAGLPFLTHLLSRIAAAGIEHVI

SEQ ID NO: 1519107 - protein, 24 aa, Mycobacterium tuberculosis
PLTTPPITIPAIPLGIDVSGSLGP

SEQ ID NO: 1519108 - protein, 24 aa, Mycobacterium tuberculosis
PLVGRLLMYEALDATYHQIRIAKN

SEQ ID NO: 1519109 - protein, 17 aa, Mycobacterium tuberculosis
PMHYFPPRSHRFTRSAL

SEQ ID NO: 1519110 - protein, 25 aa, Mycobacterium tuberculosis
PMLAASVAWDGLAAELAVAASSFGS

SEQ ID NO: 1519111 - protein, 18 aa, Mycobacterium tuberculosis
PMLFEWTDRDTLLYAIGV

SEQ ID NO: 1519112 - protein, 17 aa, Mycobacterium tuberculosis
PNGYTIDPIPLQLNLDL

SEQ ID NO: 1519113 - protein, 24 aa, Mycobacterium tuberculosis
PNHDIATVVDWMLLAAINALIAGD

SEQ ID NO: 1519114 - protein, 31 aa, Mycobacterium tuberculosis
PPAPGAAGFGYPYAIAPPGIGFGSGMSASAS

SEQ ID NO: 1519115 - protein, 28 aa, Mycobacterium tuberculosis
PPAPPNWPKPPLPPLPPALPLPPCPPSP

SEQ ID NO: 1519116 - protein, 25 aa, Mycobacterium tuberculosis
PPEHLQWIGQWGIFDALRAGREVVR

SEQ ID NO: 1519117 - protein, 17 aa, Mycobacterium tuberculosis
PPFLVIHGSRDCVIPVE

SEQ ID NO: 1519118 - protein, 20 aa, Mycobacterium tuberculosis
PPLPPLPPLPISPARRRTRR

SEQ ID NO: 1519119 - protein, 21 aa, Mycobacterium tuberculosis
PPMKWDAWGDPAAAKPLSDGV

SEQ ID NO: 1519120 - protein, 18 aa, Mycobacterium tuberculosis
PPSALLEALMRHYERTRS

SEQ ID NO: 1519121 - protein, 23 aa, Mycobacterium tuberculosis
PPTPVIPLRAKPVALLAARQLRD

SEQ ID NO: 1519122 - protein, 21 aa, Mycobacterium tuberculosis
PPTVGITLHLPFDGILVPPHP

SEQ ID NO: 1519123 - protein, 20 aa, Mycobacterium tuberculosis
PPVDIPAIVLDRILLDLHAD

SEQ ID NO: 1519124 - protein, 24 aa, Mycobacterium tuberculosis
PQAACDGPRFCWVNGMRVSFENGF

SEQ ID NO: 1519125 - protein, 31 aa, Mycobacterium tuberculosis
PQIDLTIRWDTPPITLFPNGISAPDNPLGLL

SEQ ID NO: 1519126 - protein, 36 aa, Mycobacterium tuberculosis
PQISPAGLLYLVGPIAWTLGFPIVPMLAPGSTDVNG

SEQ ID NO: 1519127 - protein, 26 aa, Mycobacterium tuberculosis
PQRVLGLHFFNPVPVLPLVELVRTLV

SEQ ID NO: 1519128 - protein, 19 aa, Mycobacterium tuberculosis
PQVDLWTFGDTGRSIIVLS

SEQ ID NO: 1519129 - protein, 19 aa, Mycobacterium tuberculosis
PQWHLRMQAAVQRHVEAAV

SEQ ID NO: 1519130 - protein, 17 aa, Mycobacterium tuberculosis
PRDALASAGKTLVELFG

SEQ ID NO: 1519131 - protein, 19 aa, Mycobacterium tuberculosis
PRMTFTTVVLNPPLATLEV

SEQ ID NO: 1519132 - protein, 23 aa, Mycobacterium tuberculosis
PRVAQGILILFFATGFPAQRIHQ

SEQ ID NO: 1519133 - protein, 19 aa, Mycobacterium tuberculosis
PSATLRVAPSASWMLEYYP

SEQ ID NO: 1519134 - protein, 20 aa, Mycobacterium tuberculosis
PSATLRVAPSASWMLEYYPI

SEQ ID NO: 1519135 - protein, 29 aa, Mycobacterium tuberculosis
PSFSVLNLSIPPIHIPGLTIPSVPLRIDV

SEQ ID NO: 1519136 - protein, 28 aa, Mycobacterium tuberculosis
PSHIWAPWISSPPAITSCFWAPPGTGKT

SEQ ID NO: 1519137 - protein, 19 aa, Mycobacterium tuberculosis
PSIQFPAIPLDLSATGHIG

SEQ ID NO: 1519138 - protein, 23 aa, Mycobacterium tuberculosis
PSLSMRSLRYRALDFGLDVGRAQ

SEQ ID NO: 1519139 - protein, 26 aa, Mycobacterium tuberculosis
PSQGGGNPGFGGDGGTGGPGGVGVPD

SEQ ID NO: 1519140 - protein, 23 aa, Mycobacterium tuberculosis
PSRGVWQFIAPTFAAITSRARRP

SEQ ID NO: 1519141 - protein, 22 aa, Mycobacterium tuberculosis
PSSGFLNWGAGSASGLLNFGNN

SEQ ID NO: 1519142 - protein, 19 aa, Mycobacterium tuberculosis
PTAASLVRITFEEPPPDQE

SEQ ID NO: 1519143 - protein, 18 aa, Mycobacterium tuberculosis
PTEFRPLRWDPNAADYRK

SEQ ID NO: 1519144 - protein, 25 aa, Mycobacterium tuberculosis
PTEKFLKDLLAAFADAPVVIGPTAP

SEQ ID NO: 1519145 - protein, 27 aa, Mycobacterium tuberculosis
PTGSGKTLAAFLWALDSLAGSEPMSER

SEQ ID NO: 1519146 - protein, 20 aa, Mycobacterium tuberculosis
PTGTPALFTLSASSADALRQ

SEQ ID NO: 1519147 - protein, 23 aa, Mycobacterium tuberculosis
PTGYLGPPPVPTSSPPTTPAGAP

SEQ ID NO: 1519148 - protein, 28 aa, Mycobacterium tuberculosis
PTPPKVKSPFGVPGMPGLAGLPGGLPDL

SEQ ID NO: 1519149 - protein, 22 aa, Mycobacterium tuberculosis
PVAVPWVLAARSPQALTNQAGR

SEQ ID NO: 1519150 - protein, 17 aa, Mycobacterium tuberculosis
PVHAATLLPFIGRLLAA

SEQ ID NO: 1519151 - protein, 18 aa, Mycobacterium tuberculosis
PVHAPGEHPMFKAMAAGL

SEQ ID NO: 1519152 - protein, 19 aa, Mycobacterium tuberculosis
PVITAPERWAFEYSRFQEA

SEQ ID NO: 1519153 - protein, 20 aa, Mycobacterium tuberculosis
PVLLEIFNNLFMSIAEQMGF

SEQ ID NO: 1519154 - protein, 17 aa, Mycobacterium tuberculosis
PVLLGGAALTRSYVEND

SEQ ID NO: 1519155 - protein, 18 aa, Mycobacterium tuberculosis
PVLPPFPTVLKQVLRPLD

SEQ ID NO: 1519156 - protein, 17 aa, Mycobacterium tuberculosis
PVLTRIDLRGAELTAAE

SEQ ID NO: 1519157 - protein, 27 aa, Mycobacterium tuberculosis
PVNFVPVIDQDVRRWWRSDSLWQAHDA

SEQ ID NO: 1519158 - protein, 17 aa, Mycobacterium tuberculosis
PVQSLTGRPLIGDGANG

SEQ ID NO: 1519159 - protein, 31 aa, Mycobacterium tuberculosis
PVRIIGYANAYDFFNMWRVRPAGLRVIGAGY

SEQ ID NO: 1519160 - protein, 17 aa, Mycobacterium tuberculosis
PVSLDELARPRFTLHAH

SEQ ID NO: 1519161 - protein, 23 aa, Mycobacterium tuberculosis
PVTIPGFAINPFGLNVPLSGGTN

SEQ ID NO: 1519162 - protein, 25 aa, Mycobacterium tuberculosis
PVTTGPVWVLAGFGAQHRKMGKSLY

SEQ ID NO: 1519163 - protein, 19 aa, Mycobacterium tuberculosis
PVVVGRRKLVDEQHLVLPD

SEQ ID NO: 1519164 - protein, 24 aa, Mycobacterium tuberculosis
PWGVRDSIPLTPPQTIRALDSVQR

SEQ ID NO: 1519165 - protein, 18 aa, Mycobacterium tuberculosis
PYEYRDAVLPPTVSARVA

SEQ ID NO: 1519166 - protein, 23 aa, Mycobacterium tuberculosis
PYGVRPLSLGRLDRGWVVASETA

SEQ ID NO: 1519167 - protein, 21 aa, Mycobacterium tuberculosis
PYRAAEIGLLVLATSTGFIAP

SEQ ID NO: 1519168 - protein, 24 aa, Mycobacterium tuberculosis
PYSARELIARIRAVLRRGGDDDSE

SEQ ID NO: 1519169 - protein, 27 aa, Mycobacterium tuberculosis
QAAAFHDRFVQLLNAGGGSYASAEIAN

SEQ ID NO: 1519170 - protein, 20 aa, Mycobacterium tuberculosis
QAALLFGRGGTGGAGGYGGD

SEQ ID NO: 1519171 - protein, 17 aa, Mycobacterium tuberculosis
QALAWIAHQPEATRRSW

SEQ ID NO: 1519172 - protein, 18 aa, Mycobacterium tuberculosis
QALRGLLKPIYEENQLGR

SEQ ID NO: 1519173 - protein, 19 aa, Mycobacterium tuberculosis
QAPAALLGGDGLIPAELVA

SEQ ID NO: 1519174 - protein, 20 aa, Mycobacterium tuberculosis
QARALARHFGARRKAYNWTV

SEQ ID NO: 1519175 - protein, 26 aa, Mycobacterium tuberculosis
QATGARWLCETFPTCLERGAGIPAVE

SEQ ID NO: 1519176 - protein, 23 aa, Mycobacterium tuberculosis
QATQAIPAYEPEPGKPAPAAVSA

SEQ ID NO: 1519177 - protein, 23 aa, Mycobacterium tuberculosis
QAVTPAARALPLTSLTSAAERGP

SEQ ID NO: 1519178 - protein, 19 aa, Mycobacterium tuberculosis
QAVVELLRRGITARDILTK

SEQ ID NO: 1519179 - protein, 24 aa, Mycobacterium tuberculosis
QDDRGPVWLFSGQGSQWAAMGADL

SEQ ID NO: 1519180 - protein, 20 aa, Mycobacterium tuberculosis
QDEWAGRLRRLLVEQASVIL

SEQ ID NO: 1519181 - protein, 17 aa, Mycobacterium tuberculosis
QDGLPDDSMRWLATVIQ

SEQ ID NO: 1519182 - protein, 17 aa, Mycobacterium tuberculosis
QDGLWLRIMNVPAALEA

SEQ ID NO: 1519183 - protein, 21 aa, Mycobacterium tuberculosis
QEAVLTFDYLPQNAPEADAIL

SEQ ID NO: 1519184 - protein, 21 aa, Mycobacterium tuberculosis
QEELRALKPWEGPRHFVLIDD

SEQ ID NO: 1519185 - protein, 26 aa, Mycobacterium tuberculosis
QEEVDRWATLDPIPRYRTYLQDQGLW

SEQ ID NO: 1519186 - protein, 23 aa, Mycobacterium tuberculosis
QEMFAPGAFRRSIAERGHKLKLL

SEQ ID NO: 1519187 - protein, 20 aa, Mycobacterium tuberculosis
QESLEAILALFRAAPDARID

SEQ ID NO: 1519188 - protein, 17 aa, Mycobacterium tuberculosis
QEYRPFRALIQAALRHA

SEQ ID NO: 1519189 - protein, 19 aa, Mycobacterium tuberculosis
QFTEFAELLVPHLAARFGR

SEQ ID NO: 1519190 - protein, 17 aa, Mycobacterium tuberculosis
QFTTFGDPTGRHAFGAS

SEQ ID NO: 1519191 - protein, 20 aa, Mycobacterium tuberculosis
QFVVALRRRGHLDDLEAMRV

SEQ ID NO: 1519192 - protein, 21 aa, Mycobacterium tuberculosis
QGEGPWHLLPTGPVVCSSACP

SEQ ID NO: 1519193 - protein, 20 aa, Mycobacterium tuberculosis
QGGIGTGELLEREPRRLDHH

SEQ ID NO: 1519194 - protein, 37 aa, Mycobacterium tuberculosis; identical to SEQ ID NO: 225463

SEQ ID NO: 1519195 - protein, 22 aa, Mycobacterium tuberculosis
QGGWPMTCFLTPNGRPFFCGTY

SEQ ID NO: 1519196 - protein, 18 aa, Mycobacterium tuberculosis
QGRNPFWDRLSRAMYRLA

SEQ ID NO: 1519197 - protein, 24 aa, Mycobacterium tuberculosis
QGWLADHSVAGVTIFPGAGFVELA

SEQ ID NO: 1519198 - protein, 30 aa, Mycobacterium tuberculosis
QHMDQMFITAPPYPPSILLTGIIVNKLGQR

SEQ ID NO: 1519199 - protein, 24 aa, Mycobacterium tuberculosis
QIATWLGQYPQLLSAALTGVIAHL

SEQ ID NO: 1519200 - protein, 28 aa, Mycobacterium tuberculosis
QITKHPIRVLTLAALAPRPGQRLWDVGA

SEQ ID NO: 1519201 - protein, 34 aa, Mycobacterium tuberculosis
QKLFVNPVEAFQFYFELLLFDYPTHIVQIVEALS

SEQ ID NO: 1519202 - protein, 24 aa, Mycobacterium tuberculosis
QKLPHPRVHRATLRWARGYSCCRP

SEQ ID NO: 1519203 - protein, 18 aa, Mycobacterium tuberculosis
QKVFARTGGLHAAALFGV

SEQ ID NO: 1519204 - protein, 24 aa, Mycobacterium tuberculosis
QLAEARLFPLAQFMGDVYAGALLT

SEQ ID NO: 1519205 - protein, 18 aa, Mycobacterium tuberculosis
QLAPPDLLAWAHEGRRGY

SEQ ID NO: 1519206 - protein, 24 aa, Mycobacterium tuberculosis
QLAQRLPGYLVPAAVVVIDALPLT

SEQ ID NO: 1519207 - protein, 17 aa, Mycobacterium tuberculosis
QLNGLAFHQHWLEGLDT

SEQ ID NO: 1519208 - protein, 20 aa, Mycobacterium tuberculosis
QLPAAWAYKRFRDLDDKESY

SEQ ID NO: 1519209 - protein, 28 aa, Mycobacterium tuberculosis
QLQNKTRALQVLAARLQAMAEEQALADA

SEQ ID NO: 1519210 - protein, 24 aa, Mycobacterium tuberculosis
QMEYMLPRLRGWGESMSRQAGGRA

SEQ ID NO: 1519211 - protein, 21 aa, Mycobacterium tuberculosis
QMSFVVTIPEALAAVATDLAG

SEQ ID NO: 1519212 - protein, 25 aa, Mycobacterium tuberculosis
QNARLAARLTGWRIDIRGDAPPPPP

SEQ ID NO: 1519213 - protein, 19 aa, Mycobacterium tuberculosis
QNFDALRTLALPFGIQVET

SEQ ID NO: 1519214 - protein, 23 aa, Mycobacterium tuberculosis
QNTNTGAFFIGHSGLLNSGGGQH

SEQ ID NO: 1519215 - protein, 21 aa, Mycobacterium tuberculosis
QPDTPPWPGRPGGHSVGYDSQ

SEQ ID NO: 1519216 - protein, 17 aa, Mycobacterium tuberculosis
QPEIPYYSATSFDPREE

SEQ ID NO: 1519217 - protein, 22 aa, Mycobacterium tuberculosis
QPSTRPAGTSGCARPARATGAA

SEQ ID NO: 1519218 - protein, 30 aa, Mycobacterium tuberculosis
QPTEPVLKLLKITGDWQKFKGLPGAQGRLK

SEQ ID NO: 1519219 - protein, 20 aa, Mycobacterium tuberculosis
QQGVDLVAPLGLLGDNPLHE

SEQ ID NO: 1519220 - protein, 32 aa, Mycobacterium tuberculosis
QQLLAAINAPTQALLGRPLIGNGADGAPGTGQ

SEQ ID NO: 1519221 - protein, 18 aa, Mycobacterium tuberculosis
QQRLWRTRESLAEVLGVY

SEQ ID NO: 1519222 - protein, 17 aa, Mycobacterium tuberculosis
QQRVPLGVVGMIYEGRP

SEQ ID NO: 1519223 - protein, 18 aa, Mycobacterium tuberculosis
QRAFLRYGKGRHRAALNF

SEQ ID NO: 1519224 - protein, 21 aa, Mycobacterium tuberculosis
QRHHDGLLAALRALLCSGELG

SEQ ID NO: 1519225 - protein, 24 aa, Mycobacterium tuberculosis
QRIADLPRLIRLLATRSASELNLS

SEQ ID NO: 1519226 - protein, 18 aa, Mycobacterium tuberculosis
QRLLQRCPVCLYAGSIMP

SEQ ID NO: 1519227 - protein, 19 aa, Mycobacterium tuberculosis
QRLQDIVKGGYRSANAAIV

SEQ ID NO: 1519228 - protein, 26 aa, Mycobacterium tuberculosis
QRPGDPTLRRLLPDFYRPDDLDDDDP

SEQ ID NO: 1519229 - protein, 20 aa, Mycobacterium tuberculosis
QRRAFGGALIDKPLMRRKLA

SEQ ID NO: 1519230 - protein, 25 aa, Mycobacterium tuberculosis
QRRAVRQWLVRWAAHPGRATRGFHN

SEQ ID NO: 1519231 - protein, 24 aa, Mycobacterium tuberculosis
QRRLEAGMMLGWHPYQFPDEPDSK

SEQ ID NO: 1519232 - protein, 17 aa, Mycobacterium tuberculosis
QRYPNVRLLPTGANLGY

SEQ ID NO: 1519233 - protein, 25 aa, Mycobacterium tuberculosis
QRYRDRYIFAGLQPGQRIPSSWLDS

SEQ ID NO: 1519234 - protein, 29 aa, Mycobacterium tuberculosis
QSAFPQLLSAVPRALQGLALPTASQSASA

SEQ ID NO: 1519235 - protein, 30 aa, Mycobacterium tuberculosis
QSAQPILLAHHLLAHAHPLLRDLDRIVDFD

SEQ ID NO: 1519236 - protein, 27 aa, Mycobacterium tuberculosis
QSEAVDKPLWRWIKMGQTAPTSPNNQH

SEQ ID NO: 1519237 - protein, 19 aa, Mycobacterium tuberculosis
QSHYLHVRPADQFDAMIHI

SEQ ID NO: 1519238 - protein, 34 aa, Mycobacterium tuberculosis
QSQGPISRRLALTALGFGVLAPNVLVACAGKVTK

SEQ ID NO: 1519239 - protein, 37 aa, Mycobacterium tuberculosis; identical to SEQ ID NO: 237376

SEQ ID NO: 1519240 - protein, 26 aa, Mycobacterium tuberculosis
QTKDIPVYRFVLRAYAAQLVQNHVNL

SEQ ID NO: 1519241 - protein, 38 aa, Mycobacterium tuberculosis; identical to SEQ ID NO: 1393218

SEQ ID NO: 1519242 - protein, 31 aa, Mycobacterium tuberculosis
QTREHVLLARQVGVPYILVALNKADAVDDEE

SEQ ID NO: 1519243 - protein, 24 aa, Mycobacterium tuberculosis
QTRISGVLIDLRPYRPPDAARRHN

SEQ ID NO: 1519244 - protein, 19 aa, Mycobacterium tuberculosis
QVAHPLVFPVGQRHRRRDG

SEQ ID NO: 1519245 - protein, 26 aa, Mycobacterium tuberculosis
QVAKNMMQAFFFDLQAINAGGSRPEG

SEQ ID NO: 1519246 - protein, 19 aa, Mycobacterium tuberculosis
QVCADLLALLTSRRPAGVP

SEQ ID NO: 1519247 - protein, 18 aa, Mycobacterium tuberculosis
QVPPQRWQPFEGGPPEVA

SEQ ID NO: 1519248 - protein, 22 aa, Mycobacterium tuberculosis
QVTELLPFGRPQLAGGPLGSVA

SEQ ID NO: 1519249 - protein, 20 aa, Mycobacterium tuberculosis
QVTIFAIQIALGELLRHHGA

SEQ ID NO: 1519250 - protein, 17 aa, Mycobacterium tuberculosis
QVTLGIYNSPRQTVIAG

SEQ ID NO: 1519251 - protein, 18 aa, Mycobacterium tuberculosis
QVTVRYFAAARAAAGAGS

SEQ ID NO: 1519252 - protein, 19 aa, Mycobacterium tuberculosis
QVWCPLCALAALVTGEQHP

SEQ ID NO: 1519253 - protein, 20 aa, Mycobacterium tuberculosis
QVWCPLCALAALVTGEQHPL

SEQ ID NO: 1519254 - protein, 17 aa, Mycobacterium tuberculosis
QYFEMFGNRGIYHKGWT

SEQ ID NO: 1519255 - protein, 17 aa, Mycobacterium tuberculosis
RAAEMLKPCTLELGGKS

SEQ ID NO: 1519256 - protein, 20 aa, Mycobacterium tuberculosis
RAAGIGELTFFSKIHYGGGA

SEQ ID NO: 1519257 - protein, 20 aa, Mycobacterium tuberculosis
RAAMALPARRPVAPAATVPP

SEQ ID NO: 1519258 - protein, 21 aa, Mycobacterium tuberculosis
RAAVFLRAADLLAGPWREKIA

SEQ ID NO: 1519259 - protein, 26 aa, Mycobacterium tuberculosis
RAEESAFVLLALQAPVAGDLRAIVSA

SEQ ID NO: 1519260 - protein, 18 aa, Mycobacterium tuberculosis
RAGIELLAFGGRFVEIGK

SEQ ID NO: 1519261 - protein, 18 aa, Mycobacterium tuberculosis
RAIGPGGLFLALPGARAD

SEQ ID NO: 1519262 - protein, 31 aa, Mycobacterium tuberculosis
RALELGCGTGFFLLNLIQAGVARRGSVTDLS

SEQ ID NO: 1519263 - protein, 25 aa, Mycobacterium tuberculosis
RALRDWLLMRAWEAGVTPIGAQPVP

SEQ ID NO: 1519264 - protein, 22 aa, Mycobacterium tuberculosis
RARASFYGYGFNVGVTSSGRTE

SEQ ID NO: 1519265 - protein, 17 aa, Mycobacterium tuberculosis
RARWANPAAWRLPGDDV

SEQ ID NO: 1519266 - protein, 24 aa, Mycobacterium tuberculosis
RASRVELPLLSPARARSYCATVRS

SEQ ID NO: 1519267 - protein, 27 aa, Mycobacterium tuberculosis
RASVLAYPRVVWIAGGLLKGASLHAEV

SEQ ID NO: 1519268 - protein, 17 aa, Mycobacterium tuberculosis
RATIADLAWLRARDLDR

SEQ ID NO: 1519269 - protein, 20 aa, Mycobacterium tuberculosis
RAVDMAIKLGLRSYANPGTA

SEQ ID NO: 1519270 - protein, 18 aa, Mycobacterium tuberculosis
RAWGPRAPFEVLLGKPRA

SEQ ID NO: 1519271 - protein, 18 aa, Mycobacterium tuberculosis
RAWHAYFRDARRAHALYT

SEQ ID NO: 1519272 - protein, 19 aa, Mycobacterium tuberculosis
RAYAPVRTARYCYTRVTKV

SEQ ID NO: 1519273 - protein, 18 aa, Mycobacterium tuberculosis
RAYARLLTTMTAEEPTVV

SEQ ID NO: 1519274 - protein, 18 aa, Mycobacterium tuberculosis
RCESLRDNLWQLVDSKVA

SEQ ID NO: 1519275 - protein, 35 aa, Mycobacterium tuberculosis
RDADPDLIIVRYIPNLVPRLFTLDRDFIQEIRDLV

SEQ ID NO: 1519276 - protein, 19 aa, Mycobacterium tuberculosis
RDASPIQRVTRNAPPFLVI

SEQ ID NO: 1519277 - protein, 25 aa, Mycobacterium tuberculosis
RDLHRGLLNRLSAFKVPHRFAVVDR

SEQ ID NO: 1519278 - protein, 25 aa, Mycobacterium tuberculosis
RDPGPLRRLIATLPALEVPRPDWPA

SEQ ID NO: 1519279 - protein, 21 aa, Mycobacterium tuberculosis
RDQQALLDLLHPNGRAVIERA

SEQ ID NO: 1519280 - protein, 21 aa, Mycobacterium tuberculosis
RDQWDLLQRDPSLLPGAIEEM

SEQ ID NO: 1519281 - protein, 40 aa, Mycobacterium tuberculosis
RDRFVSAAPEITPFALTLRLLVIALKHNVILNSTWVDSGE

SEQ ID NO: 1519282 - protein, 28 aa, Mycobacterium tuberculosis
RDRLGDEFITGVLFYTGARALPFGDRLM

SEQ ID NO: 1519283 - protein, 21 aa, Mycobacterium tuberculosis
RDSEWMGRVHRFLGLQVGVIL

SEQ ID NO: 1519284 - protein, 20 aa, Mycobacterium tuberculosis
RDVRLATVLSRCSYLRDGIV

SEQ ID NO: 1519285 - protein, 18 aa, Mycobacterium tuberculosis
REASLTDLIYAHHPRFTG

SEQ ID NO: 1519286 - protein, 20 aa, Mycobacterium tuberculosis
REAVWIDLIGKLVPATSVAQ

SEQ ID NO: 1519287 - protein, 20 aa, Mycobacterium tuberculosis
REDWAALYKKAFAPLNELAG

SEQ ID NO: 1519288 - protein, 18 aa, Mycobacterium tuberculosis
REFPFNLMLWDLDRRMRR

SEQ ID NO: 1519289 - protein, 24 aa, Mycobacterium tuberculosis
REFTFPMEFVSFKGGWQLSRQTAE

SEQ ID NO: 1519290 - protein, 19 aa, Mycobacterium tuberculosis
RELELCYAAIALVTDVDAG

SEQ ID NO: 1519291 - protein, 18 aa, Mycobacterium tuberculosis
REPALASPRRPQAPVVPI

SEQ ID NO: 1519292 - protein, 25 aa, Mycobacterium tuberculosis
RERLGLPGLRDWLRRQAKAGAGPPE

SEQ ID NO: 1519293 - protein, 17 aa, Mycobacterium tuberculosis
REWILRNSPVPVGTVPI

SEQ ID NO: 1519294 - protein, 18 aa, Mycobacterium tuberculosis
RFGWRIMPQNLSDAGVSW

SEQ ID NO: 1519295 - protein, 19 aa, Mycobacterium tuberculosis
RFHFPRIYLDYIGHGDSDK

SEQ ID NO: 1519296 - protein, 17 aa, Mycobacterium tuberculosis
RFRAWRVGGYNEYLYTF

SEQ ID NO: 1519297 - protein, 19 aa, Mycobacterium tuberculosis
RFTERFAPFNLSETAIRPS

SEQ ID NO: 1519298 - protein, 18 aa, Mycobacterium tuberculosis
RFTTDFPLSDGTPAPVLE

SEQ ID NO: 1519299 - protein, 17 aa, Mycobacterium tuberculosis
RFVANALSPAKVVSVSV

SEQ ID NO: 1519300 - protein, 20 aa, Mycobacterium tuberculosis
RGAGWLKVKPVHTLDLVVLA

SEQ ID NO: 1519301 - protein, 21 aa, Mycobacterium tuberculosis
RGAVFQLRAGLSNAERPGDGL

SEQ ID NO: 1519302 - protein, 17 aa, Mycobacterium tuberculosis
RGAVPLGSGGDAAGKVE

SEQ ID NO: 1519303 - protein, 17 aa, Mycobacterium tuberculosis
RGDHEGLFGLSYGITIP

SEQ ID NO: 1519304 - protein, 17 aa, Mycobacterium tuberculosis
RGFDLDLTELIYFDQRN

SEQ ID NO: 1519305 - protein, 17 aa, Mycobacterium tuberculosis
RGFDNWEGDAATACEAS

SEQ ID NO: 1519306 - protein, 22 aa, Mycobacterium tuberculosis
RGGDAGLFLGAAGTGGQAALSQ

SEQ ID NO: 1519307 - protein, 20 aa, Mycobacterium tuberculosis
RGGDGNLGQFGPEGAPGQPG

SEQ ID NO: 1519308 - protein, 35 aa, Mycobacterium tuberculosis
RGGTVHAPRLSPAPALLALPAAESAWRLAAGGGGT

SEQ ID NO: 1519309 - protein, 23 aa, Mycobacterium tuberculosis
RGGYPPETGGYPPQPGYPRPRHP

SEQ ID NO: 1519310 - protein, 20 aa, Mycobacterium tuberculosis
RGIYALGAGPLGFSTAWVVF

SEQ ID NO: 1519311 - protein, 21 aa, Mycobacterium tuberculosis
RGLIFVIQVYRHMLSPLRPAS

SEQ ID NO: 1519312 - protein, 17 aa, Mycobacterium tuberculosis
RGLMRVIDSEHPHLGAT

SEQ ID NO: 1519313 - protein, 18 aa, Mycobacterium tuberculosis
RGLMRVIDSEHPHLGATA

SEQ ID NO: 1519314 - protein, 35 aa, Mycobacterium tuberculosis
RGMAKLAFDVTPPAWLEPGQWWALVRVGCAGQLVY

SEQ ID NO: 1519315 - protein, 23 aa, Mycobacterium tuberculosis
RGPSQWLLRMLATQTQRAELVPL

SEQ ID NO: 1519316 - protein, 19 aa, Mycobacterium tuberculosis
RGRPTVWSVWGVGGAILLG

SEQ ID NO: 1519317 - protein, 26 aa, Mycobacterium tuberculosis
RGRVQSVLLPRLLDWMSYAPDPDGGL

SEQ ID NO: 1519318 - protein, 21 aa, Mycobacterium tuberculosis
RGRVYAARLAPVAAGLTLPSA

SEQ ID NO: 1519319 - protein, 21 aa, Mycobacterium tuberculosis
RGTGGLLFGNGGAGGQGGLGL

SEQ ID NO: 1519320 - protein, 19 aa, Mycobacterium tuberculosis
RHHGLINKFAGDAALAIFG

SEQ ID NO: 1519321 - protein, 37 aa, Mycobacterium tuberculosis
RHLHGRSRLWLFRYQGTPIAFFLNVWGADENYILLEW

SEQ ID NO: 1519322 - protein, 17 aa, Mycobacterium tuberculosis
RIAALLHRAAPDTQLVT

SEQ ID NO: 1519323 - protein, 24 aa, Mycobacterium tuberculosis
RIAELPEHIVIVGSGFIAAEFAHV

SEQ ID NO: 1519324 - protein, 23 aa, Mycobacterium tuberculosis
RIGAYQRRGAVSTLLLVVQRVPY

SEQ ID NO: 1519325 - protein, 18 aa, Mycobacterium tuberculosis
RIGLGKRTFSLPWRLANI

SEQ ID NO: 1519326 - protein, 23 aa, Mycobacterium tuberculosis
RIGRLAVRLDVSRLVVVGTGRSI

SEQ ID NO: 1519327 - protein, 17 aa, Mycobacterium tuberculosis
RIISVVPVVLEVRRAEP

SEQ ID NO: 1519328 - protein, 17 aa, Mycobacterium tuberculosis
RILLTSGKLYYELAARK

SEQ ID NO: 1519329 - protein, 23 aa, Mycobacterium tuberculosis
RIQEEMFYQLEAPVLRACGFDTP

SEQ ID NO: 1519330 - protein, 22 aa, Mycobacterium tuberculosis
RIRAANFAALRPWPGLTVEIRK

SEQ ID NO: 1519331 - protein, 27 aa, Mycobacterium tuberculosis
RIWLEQNKQRWLAFFQAEGGAAAARWI

SEQ ID NO: 1519332 - protein, 18 aa, Mycobacterium tuberculosis
RKHDHRLAHRPWLTDRHA

SEQ ID NO: 1519333 - protein, 25 aa, Mycobacterium tuberculosis
RKLNNTFFERGAVESVVRPKTPRGD

SEQ ID NO: 1519334 - protein, 24 aa, Mycobacterium tuberculosis
RKPAPHEFIPFSGGLHRCIGAVMA

SEQ ID NO: 1519335 - protein, 24 aa, Mycobacterium tuberculosis
RLAARRHPGAQRAVLPPAACGGAA

SEQ ID NO: 1519336 - protein, 22 aa, Mycobacterium tuberculosis
RLAHVHLSRRLAHWTRLYPEVR

SEQ ID NO: 1519337 - protein, 27 aa, Mycobacterium tuberculosis
RLAVCLDLDWRPQFRVDLIPSYKAHRV

SEQ ID NO: 1519338 - protein, 23 aa, Mycobacterium tuberculosis
RLDAEILALVKRRAEVSKAIGKA

SEQ ID NO: 1519339 - protein, 19 aa, Mycobacterium tuberculosis
RLDFRPKHRLAVLVVSAIP

SEQ ID NO: 1519340 - protein, 18 aa, Mycobacterium tuberculosis
RLELAALKQSAAAELGLR

SEQ ID NO: 1519341 - protein, 19 aa, Mycobacterium tuberculosis
RLGAERLIGLSVAGKQRRD

SEQ ID NO: 1519342 - protein, 28 aa, Mycobacterium tuberculosis
RLGLDYVDLYLIHWPAPPVGKYVDAWGG

SEQ ID NO: 1519343 - protein, 18 aa, Mycobacterium tuberculosis
RLHLPPLPTTTIGSYPQT

SEQ ID NO: 1519344 - protein, 21 aa, Mycobacterium tuberculosis
RLKAPTVMLAGVVAAGMVSDG

SEQ ID NO: 1519345 - protein, 18 aa, Mycobacterium tuberculosis
RLKRMYPGAHYRATTATV

SEQ ID NO: 1519346 - protein, 19 aa, Mycobacterium tuberculosis
RLLTELGWALRRAPLPPTG

SEQ ID NO: 1519347 - protein, 28 aa, Mycobacterium tuberculosis
RLQDAMHPMMLPLLERMVVKQPRTANMQ

SEQ ID NO: 1519348 - protein, 18 aa, Mycobacterium tuberculosis
RLRRALEHRDRTCVVPGC

SEQ ID NO: 1519349 - protein, 30 aa, Mycobacterium tuberculosis
RLTDPEVLEWRYPVLLREFAVRQGSGGAGR

SEQ ID NO: 1519350 - protein, 18 aa, Mycobacterium tuberculosis
RLVKLIVDPLQLTFERRN

SEQ ID NO: 1519351 - protein, 19 aa, Mycobacterium tuberculosis
RMFDLFDYRIGEAEGQPQV

SEQ ID NO: 1519352 - protein, 19 aa, Mycobacterium tuberculosis
RMGALALHVAKIARRRHPQ

SEQ ID NO: 1519353 - protein, 17 aa, Mycobacterium tuberculosis
RMLRAARFVSQLGFAVA

SEQ ID NO: 1519354 - protein, 18 aa, Mycobacterium tuberculosis
RMPQLSIVGTPRPAPRTT

SEQ ID NO: 1519355 - protein, 24 aa, Mycobacterium tuberculosis
RMPQLSIVGTPRPAPRTTVGVVEY

SEQ ID NO: 1519356 - protein, 17 aa, Mycobacterium tuberculosis
RMVARLMGSLAVLRSVS

SEQ ID NO: 1519357 - protein, 31 aa, Mycobacterium tuberculosis
RNAPHLVHAMPQLVPLLPSMGHTKRALVRAG

SEQ ID NO: 1519358 - protein, 19 aa, Mycobacterium tuberculosis
RNDWLTTMRSTTAGVAASY

SEQ ID NO: 1519359 - protein, 20 aa, Mycobacterium tuberculosis
RNHLQPLEGAKLLLPLAVSD

SEQ ID NO: 1519360 - protein, 27 aa, Mycobacterium tuberculosis
RPADLVQRRFGPPAPNRLWVADLTYVS

SEQ ID NO: 1519361 - protein, 18 aa, Mycobacterium tuberculosis
RPGAPRPGGRPGAPGAGR

SEQ ID NO: 1519362 - protein, 25 aa, Mycobacterium tuberculosis
RPGPKGFIGQPIPIAGLYLGSAGCP

SEQ ID NO: 1519363 - protein, 20 aa, Mycobacterium tuberculosis
RPKHYWSIYQKMIVKGRDFD

SEQ ID NO: 1519364 - protein, 32 aa, Mycobacterium tuberculosis
RPKRVELPTYAFQHQKFWLAPAPSVSDPTAAG

SEQ ID NO: 1519365 - protein, 19 aa, Mycobacterium tuberculosis
RPLTLLPEPNPGDLFFDFE

SEQ ID NO: 1519366 - protein, 18 aa, Mycobacterium tuberculosis
RPLTVAVLLRITEVFGVD

SEQ ID NO: 1519367 - protein, 19 aa, Mycobacterium tuberculosis
RPQRFQVTASRFGRSVDVA

SEQ ID NO: 1519368 - protein, 40 aa, Mycobacterium tuberculosis
RPREMARTVFIELLAWQFASPVRWIETQDLLFIEEAAGGL

SEQ ID NO: 1519369 - protein, 24 aa, Mycobacterium tuberculosis
RPRSDILAFALPGFATGEHTKNNA

SEQ ID NO: 1519370 - protein, 23 aa, Mycobacterium tuberculosis
RPRVAVWGIHLLRRGGLTGDGIP

SEQ ID NO: 1519371 - protein, 19 aa, Mycobacterium tuberculosis
RPSWAPLPVQYADYSVWQS

SEQ ID NO: 1519372 - protein, 17 aa, Mycobacterium tuberculosis
RPVRMGRLVLPGRTTVP

SEQ ID NO: 1519373 - protein, 20 aa, Mycobacterium tuberculosis
RPVTGEWQIAALRAYWELPA

SEQ ID NO: 1519374 - protein, 17 aa, Mycobacterium tuberculosis
RQHYIRILPEDRVVVEL

SEQ ID NO: 1519375 - protein, 27 aa, Mycobacterium tuberculosis
RQPSTHTIFVLGRPITAGAFSAVARGV

SEQ ID NO: 1519376 - protein, 25 aa, Mycobacterium tuberculosis
RQQVAPWWRRRPHRSLTSLGQWSWR

SEQ ID NO: 1519377 - protein, 24 aa, Mycobacterium tuberculosis
RQQVLFCGLWYDDDFVRTPNGWRI

SEQ ID NO: 1519378 - protein, 17 aa, Mycobacterium tuberculosis
RQRIVGIAGIDTRAVVR

SEQ ID NO: 1519379 - protein, 21 aa, Mycobacterium tuberculosis
RQRLPRTIQIEAGVFLWCTPG

SEQ ID NO: 1519380 - protein, 19 aa, Mycobacterium tuberculosis
RQWLEIRYLDSVPDEVWPA

SEQ ID NO: 1519381 - protein, 28 aa, Mycobacterium tuberculosis
RRDRRRHLIGTRGQHGGGRRSRGGIGRA

SEQ ID NO: 1519382 - protein, 18 aa, Mycobacterium tuberculosis
RREDMLRHPAFLSKQLPA

SEQ ID NO: 1519383 - protein, 22 aa, Mycobacterium tuberculosis
RRGRVYAARLAPVAAGLTLPSA

SEQ ID NO: 1519384 - protein, 25 aa, Mycobacterium tuberculosis
RRLAARRHPGAQRAVLPPAACGGAA

SEQ ID NO: 1519385 - protein, 24 aa, Mycobacterium tuberculosis
RRLCGGWYGGLFQDQMRVGAADPK

SEQ ID NO: 1519386 - protein, 17 aa, Mycobacterium tuberculosis
RRLDSSLLVPWPRRHRD

SEQ ID NO: 1519387 - protein, 25 aa, Mycobacterium tuberculosis
RRLRRLAGLWLADQEERWAAVRIDV

SEQ ID NO: 1519388 - protein, 25 aa, Mycobacterium tuberculosis
RRPDGRLLTHKLLSDNPARYRDAAV

SEQ ID NO: 1519389 - protein, 29 aa, Mycobacterium tuberculosis
RRQPGLGGRLLGLRRRRAQPAQIGGGRSR

SEQ ID NO: 1519390 - protein, 18 aa, Mycobacterium tuberculosis
RRRNGRYFPAPGVKPHAA

SEQ ID NO: 1519391 - protein, 32 aa, Mycobacterium tuberculosis; identical to SEQ ID NO: 226857

SEQ ID NO: 1519392 - protein, 18 aa, Mycobacterium tuberculosis
RRRRRVTRRGYGDEFMDM

SEQ ID NO: 1519393 - protein, 29 aa, Mycobacterium tuberculosis
RRRVIEPIDMDAYRQFLTEIGYLLPEPDD

SEQ ID NO: 1519394 - protein, 21 aa, Mycobacterium tuberculosis
RRTQPQRQLDVVEPAFGRGPQ

SEQ ID NO: 1519395 - protein, 20 aa, Mycobacterium tuberculosis
RRYHATYMNYVGKPLAYILD

SEQ ID NO: 1519396 - protein, 21 aa, Mycobacterium tuberculosis
RRYHATYMNYVGKPLAYILDT

SEQ ID NO: 1519397 - protein, 24 aa, Mycobacterium tuberculosis
RSAACWARRLVFVNGHGGNVGALT

SEQ ID NO: 1519398 - protein, 28 aa, Mycobacterium tuberculosis
RSADGSPPYVVRWLVNGHETTVYPGSDA

SEQ ID NO: 1519399 - protein, 22 aa, Mycobacterium tuberculosis
RSALDVMLDWDPTTAYSCQQGF

SEQ ID NO: 1519400 - protein, 25 aa, Mycobacterium tuberculosis
RSDSSIFTLPFPYEPWTREEGIADG

SEQ ID NO: 1519401 - protein, 19 aa, Mycobacterium tuberculosis
RSEMLSMLRAMLAPESLTA

SEQ ID NO: 1519402 - protein, 32 aa, Mycobacterium tuberculosis
RSNIDIPPMDFTLGLPVLGPITGQLGPIHLEP

SEQ ID NO: 1519403 - protein, 27 aa, Mycobacterium tuberculosis
RSRERGYAYFLYPPQVPLTETAYDRLA

SEQ ID NO: 1519404 - protein, 18 aa, Mycobacterium tuberculosis
RSRLARLAGIGLGCGDPA

SEQ ID NO: 1519405 - protein, 19 aa, Mycobacterium tuberculosis
RTAFRRRITRLSPARLHEA

SEQ ID NO: 1519406 - protein, 21 aa, Mycobacterium tuberculosis
RTARQRLAAFVSPIPVRLADG

SEQ ID NO: 1519407 - protein, 18 aa, Mycobacterium tuberculosis
RTDEARQILGHRAMIVAG

SEQ ID NO: 1519408 - protein, 24 aa, Mycobacterium tuberculosis
RTDLLAFTAFPKQIWRQIWSNNPQ

SEQ ID NO: 1519409 - protein, 22 aa, Mycobacterium tuberculosis
RTDYGLPVREPGARLVPGAAVP

SEQ ID NO: 1519410 - protein, 22 aa, Mycobacterium tuberculosis
RTHARSWHRYLEPSPGAIAMVV

SEQ ID NO: 1519411 - protein, 17 aa, Mycobacterium tuberculosis
RTLLVITRGFGDALRIA

SEQ ID NO: 1519412 - protein, 20 aa, Mycobacterium tuberculosis
RTLSRVYGWMLDGVPVVAMH

SEQ ID NO: 1519413 - protein, 25 aa, Mycobacterium tuberculosis
RTTGPWEPWLRALPVEFDSAEQVFA

SEQ ID NO: 1519414 - protein, 26 aa, Mycobacterium tuberculosis
RTVRQFNDLLRVLPPLPQEMPQQTGV

SEQ ID NO: 1519415 - protein, 17 aa, Mycobacterium tuberculosis
RTYLPYLDHVEQHWVRG

SEQ ID NO: 1519416 - protein, 20 aa, Mycobacterium tuberculosis
RVAFLGWSMGGYGALLLGSR

SEQ ID NO: 1519417 - protein, 17 aa, Mycobacterium tuberculosis
RVAMFPAVEPDDVSALT

SEQ ID NO: 1519418 - protein, 17 aa, Mycobacterium tuberculosis
RVAWWALCTDFDVPRSM

SEQ ID NO: 1519419 - protein, 17 aa, Mycobacterium tuberculosis
RVGHSYIKALMAETGAI

SEQ ID NO: 1519420 - protein, 22 aa, Mycobacterium tuberculosis
RVHGFLQHPLLVVDDDFRRTQI

SEQ ID NO: 1519421 - protein, 22 aa, Mycobacterium tuberculosis
RVIDRAPLWCAVDLRDGNQALI

SEQ ID NO: 1519422 - protein, 18 aa, Mycobacterium tuberculosis
RVLDRLAALGLVDDTDFA

SEQ ID NO: 1519423 - protein, 19 aa, Mycobacterium tuberculosis
RVPDPGRVWPLLQRNKSAL

SEQ ID NO: 1519424 - protein, 27 aa, Mycobacterium tuberculosis
RVQTTVLKAINWFGQFSTRIADKEADY

SEQ ID NO: 1519425 - protein, 17 aa, Mycobacterium tuberculosis
RVRLLERLAQTGGAAVS

SEQ ID NO: 1519426 - protein, 17 aa, Mycobacterium tuberculosis
RVRSRLARLAGIGLGCG

SEQ ID NO: 1519427 - protein, 24 aa, Mycobacterium tuberculosis
RVRTRLIELFELFDPADPEVVAGR

SEQ ID NO: 1519428 - protein, 23 aa, Mycobacterium tuberculosis
RVVAKVPQLVQLAPHAVQMSQNA

SEQ ID NO: 1519429 - protein, 32 aa, Mycobacterium tuberculosis
RVYTGYAPVIGAPWLVAFAERSRFFEVFSSSN

SEQ ID NO: 1519430 - protein, 21 aa, Mycobacterium tuberculosis
RWGSFLPDIDAFDAEFFEISP

SEQ ID NO: 1519431 - protein, 34 aa, Mycobacterium tuberculosis; identical to SEQ ID NO: 858929

SEQ ID NO: 1519432 - protein, 17 aa, Mycobacterium tuberculosis
RWQPFEGGPPEVAAALA

SEQ ID NO: 1519433 - protein, 18 aa, Mycobacterium tuberculosis
RYDLRPVTGEWQIAALRA

SEQ ID NO: 1519434 - protein, 19 aa, Mycobacterium tuberculosis
RYDQIWKDHVLALNGAYQM

SEQ ID NO: 1519435 - protein, 18 aa, Mycobacterium tuberculosis
RYGALPEPARRLAAVARL

SEQ ID NO: 1519436 - protein, 19 aa, Mycobacterium tuberculosis
RYLQWLTKHSRQILETAYV

SEQ ID NO: 1519437 - protein, 24 aa, Mycobacterium tuberculosis
RYNPDYLPGALLPPSIHATADAEE

SEQ ID NO: 1519438 - protein, 36 aa, Mycobacterium tuberculosis
RYQTGLRRSLIALRSQRYFRLLDALDALVSERAHAT

SEQ ID NO: 1519439 - protein, 25 aa, Mycobacterium tuberculosis
RYRSLKVDGARVQRPLWASTGVKNP

SEQ ID NO: 1519440 - protein, 35 aa, Mycobacterium tuberculosis
SAAAAALPSWQQALRGLPGLGQVASAISGGAASMF

SEQ ID NO: 1519441 - protein, 21 aa, Mycobacterium tuberculosis
SAACTTMRWPLHDDQLAAADQ

SEQ ID NO: 1519442 - protein, 27 aa, Mycobacterium tuberculosis
SAAVAQLAPWQQVLRNLGIDIGKNGQI

SEQ ID NO: 1519443 - protein, 25 aa, Mycobacterium tuberculosis
SADSVRAYLKQIGKVALLNAEEEVE

SEQ ID NO: 1519444 - protein, 20 aa, Mycobacterium tuberculosis
SAFQSVVWGLTTGSWIGSSA

SEQ ID NO: 1519445 - protein, 32 aa, Mycobacterium tuberculosis
SAIAAQVVPWASLLQRFPGLGAGATGATGGES

SEQ ID NO: 1519446 - protein, 19 aa, Mycobacterium tuberculosis
SALGVRVTLVIRGSCLLRH

SEQ ID NO: 1519447 - protein, 22 aa, Mycobacterium tuberculosis
SAPVYKMPWGTMHPTTISAPIV

SEQ ID NO: 1519448 - protein, 36 aa, Mycobacterium tuberculosis
SAQAAAFHDQFVHTLTAAARWYTATEIANAAAMRVV

SEQ ID NO: 1519449 - protein, 24 aa, Mycobacterium tuberculosis
SAQAALFHEQFVHAMTAGAGAYAG

SEQ ID NO: 1519450 - protein, 29 aa, Mycobacterium tuberculosis
SAQVAAYQQRFVLALSQAGSTYAVAEAAS

SEQ ID NO: 1519451 - protein, 29 aa, Mycobacterium tuberculosis
SAQVATFHDRFVQTLSATASSYVAAEAVN

SEQ ID NO: 1519452 - protein, 26 aa, Mycobacterium tuberculosis
SARPLWAPDYPVGAQVRRADPFLTVA

SEQ ID NO: 1519453 - protein, 28 aa, Mycobacterium tuberculosis
SAVAAQLAPWAQAVRALPNPTAPALASG

SEQ ID NO: 1519454 - protein, 22 aa, Mycobacterium tuberculosis
SAVFPTILARATPGDGWASLAS

SEQ ID NO: 1519455 - protein, 27 aa, Mycobacterium tuberculosis
SAVRGRNFLGWIHPAATATAPARTEAP

SEQ ID NO: 1519456 - protein, 28 aa, Mycobacterium tuberculosis
SAWIAEGLLIYLPATAQERLFTGIDALA

SEQ ID NO: 1519457 - protein, 21 aa, Mycobacterium tuberculosis
SCHQIVLPQPILRNHELAKLV

SEQ ID NO: 1519458 - protein, 22 aa, Mycobacterium tuberculosis
SCIYPKLAPQPIPESALLTGPL

SEQ ID NO: 1519459 - protein, 17 aa, Mycobacterium tuberculosis
SDARRRIDLEEGNRAAL

SEQ ID NO: 1519460 - protein, 26 aa, Mycobacterium tuberculosis
SDDESIWQLLKNIPIHQLRRTGLLDK

SEQ ID NO: 1519461 - protein, 17 aa, Mycobacterium tuberculosis
SDERFFRRGGSGDWQQF

SEQ ID NO: 1519462 - protein, 20 aa, Mycobacterium tuberculosis
SDFLHGRWLVLRRGKRSIAG

SEQ ID NO: 1519463 - protein, 24 aa, Mycobacterium tuberculosis
SDIDRQLLAARLLAALAARRDAEL

SEQ ID NO: 1519464 - protein, 23 aa, Mycobacterium tuberculosis
SDRWPAVAKVPRGPLAAASAAIA

SEQ ID NO: 1519465 - protein, 18 aa, Mycobacterium tuberculosis
SDYAFPVRGLVRGRRTLT

SEQ ID NO: 1519466 - protein, 22 aa, Mycobacterium tuberculosis
SEDLPTLVRTLAATTALMLTGD

SEQ ID NO: 1519467 - protein, 18 aa, Mycobacterium tuberculosis
SEDWLRPDYVAPVADTPP

SEQ ID NO: 1519468 - protein, 21 aa, Mycobacterium tuberculosis
SEDWMTRLLLGFGSDVRVLAP

SEQ ID NO: 1519469 - protein, 24 aa, Mycobacterium tuberculosis
SEELIGQFGIGFYSSFMVADKVQL

SEQ ID NO: 1519470 - protein, 24 aa, Mycobacterium tuberculosis
SELHDAIHRFLLICLPRCDGVRLR

SEQ ID NO: 1519471 - protein, 21 aa, Mycobacterium tuberculosis
SELRRHGINPHIIGGAAVAAE

SEQ ID NO: 1519472 - protein, 18 aa, Mycobacterium tuberculosis
SEMLSMLRAMLAPESLTA

SEQ ID NO: 1519473 - protein, 28 aa, Mycobacterium tuberculosis
SFADQRTFGGWLLADLVTVDGSVVPVPV

SEQ ID NO: 1519474 - protein, 17 aa, Mycobacterium tuberculosis
SFAPSFVGFGGNGGNGV

SEQ ID NO: 1519475 - protein, 19 aa, Mycobacterium tuberculosis
SFGYLYGTPGFQAPEIVRT

SEQ ID NO: 1519476 - protein, 25 aa, Mycobacterium tuberculosis
SFLLDHALVDIGVGVRWLREVQGVE

SEQ ID NO: 1519477 - protein, 17 aa, Mycobacterium tuberculosis
SFRRIDFALDPPAGDIG

SEQ ID NO: 1519478 - protein, 18 aa, Mycobacterium tuberculosis
SFSVLNLSIPPIHIPGLT

SEQ ID NO: 1519479 - protein, 18 aa, Mycobacterium tuberculosis
SFTPVLIPASRGILATCT

SEQ ID NO: 1519480 - protein, 20 aa, Mycobacterium tuberculosis
SFTVPDIPIPAIHIGINGVV

SEQ ID NO: 1519481 - protein, 23 aa, Mycobacterium tuberculosis
SGALAWAIYALLTVPGTWESAAS

SEQ ID NO: 1519482 - protein, 17 aa, Mycobacterium tuberculosis
SGDPLDEVSVPPRPGHQ

SEQ ID NO: 1519483 - protein, 24 aa, Mycobacterium tuberculosis
SGDPLLHGIGSTLIRLFGHDNVTV

SEQ ID NO: 1519484 - protein, 19 aa, Mycobacterium tuberculosis
SGEGCVMLALKRLPDALAD

SEQ ID NO: 1519485 - protein, 33 aa, Mycobacterium tuberculosis
SGELPQRHIGVGWAALRSLPPPAPQPALTVTGV

SEQ ID NO: 1519486 - protein, 17 aa, Mycobacterium tuberculosis
SGFQLPPLSIPSVAIPP

SEQ ID NO: 1519487 - protein, 23 aa, Mycobacterium tuberculosis
SGGRGGLLVGDGGAGGIGGTGGE

SEQ ID NO: 1519488 - protein, 24 aa, Mycobacterium tuberculosis
SGGVGGAGGFGLTTGGPGAAGGDA

SEQ ID NO: 1519489 - protein, 38 aa, Mycobacterium tuberculosis
SGPDPLIDIAGTGGLLPIKIPLIDIPAAPGFGNSTTTP

SEQ ID NO: 1519490 - protein, 18 aa, Mycobacterium tuberculosis
SGPGAAFGGNGNTGGNGG

SEQ ID NO: 1519491 - protein, 28 aa, Mycobacterium tuberculosis
SGRPLAMPRLDMVTGLYYLTTEVPGDTG

SEQ ID NO: 1519492 - protein, 29 aa, Mycobacterium tuberculosis
SGRYAARIVTGLRLDCPAPPRAATRPASS

SEQ ID NO: 1519493 - protein, 17 aa, Mycobacterium tuberculosis
SGTWVDIRFTLPANTVD

SEQ ID NO: 1519494 - protein, 25 aa, Mycobacterium tuberculosis
SHAFHSLLMEPMLAEFTRIAAGISV

SEQ ID NO: 1519495 - protein, 25 aa, Mycobacterium tuberculosis
SHYDVYPAFGFRFDLKKSGVSVTFS

SEQ ID NO: 1519496 - protein, 18 aa, Mycobacterium tuberculosis
SIEWMSRNLANRESVILS

SEQ ID NO: 1519497 - protein, 24 aa, Mycobacterium tuberculosis
SIFVPSVPNLLQLASALEVQRNHV

SEQ ID NO: 1519498 - protein, 31 aa, Mycobacterium tuberculosis
SIGNTWLADPAPFLQQYLANQFGYGQLTLTA

SEQ ID NO: 1519499 - protein, 17 aa, Mycobacterium tuberculosis
SINAPVLAATGRPLIGN

SEQ ID NO: 1519500 - protein, 21 aa, Mycobacterium tuberculosis
SIPAITFPRIDASGSVDIGIL

SEQ ID NO: 1519501 - protein, 19 aa, Mycobacterium tuberculosis
SIPEIDIHTLVAFACRELL

SEQ ID NO: 1519502 - protein, 22 aa, Mycobacterium tuberculosis
SIPNIAIPSIHLGIDPTFDVGP

SEQ ID NO: 1519503 - protein, 17 aa, Mycobacterium tuberculosis
SIQFPAIPLDLSATGHI

SEQ ID NO: 1519504 - protein, 20 aa, Mycobacterium tuberculosis
SISPRDALASAGKTLVELFG

SEQ ID NO: 1519505 - protein, 24 aa, Mycobacterium tuberculosis
SITVGRISYLLGLRGPAVAVDTAC

SEQ ID NO: 1519506 - protein, 18 aa, Mycobacterium tuberculosis
SIVGTPRPAPRTTVGVVE

SEQ ID NO: 1519507 - protein, 25 aa, Mycobacterium tuberculosis
SIYSSCAVPPLVAYLDTGKLPDTDT

SEQ ID NO: 1519508 - protein, 24 aa, Mycobacterium tuberculosis
SKGMQMRLPFARSLINDPELLFLD

SEQ ID NO: 1519509 - protein, 24 aa, Mycobacterium tuberculosis
SKITAVMAALRRWARDRGLNPSET

SEQ ID NO: 1519510 - protein, 30 aa, Mycobacterium tuberculosis; identical to SEQ ID NO: 222995

SEQ ID NO: 1519511 - protein, 20 aa, Mycobacterium tuberculosis
SLDELARPRFTLHAHDAQAE

SEQ ID NO: 1519512 - protein, 18 aa, Mycobacterium tuberculosis
SLGTPLLDLVQRSLQISE

SEQ ID NO: 1519513 - protein, 25 aa, Mycobacterium tuberculosis
SLHNSQPWRWIAEDHTVALFLDKDR

SEQ ID NO: 1519514 - protein, 20 aa, Mycobacterium tuberculosis
SLKSPVRHFVLFSSVSGLLG

SEQ ID NO: 1519515 - protein, 22 aa, Mycobacterium tuberculosis
SLMTLTTLYPPVAAVVSLWTQQ

SEQ ID NO: 1519516 - protein, 17 aa, Mycobacterium tuberculosis
SLREHTWKRSSFSGTEI

SEQ ID NO: 1519517 - protein, 26 aa, Mycobacterium tuberculosis
SLVPSPTCIIVGLPAGLRLAVDNAIA

SEQ ID NO: 1519518 - protein, 20 aa, Mycobacterium tuberculosis
SLYHAGVKLDWMVATTLLTG

SEQ ID NO: 1519519 - protein, 28 aa, Mycobacterium tuberculosis
SMIIQFVVKTLVAMLDWGLNPQQAVSLV

SEQ ID NO: 1519520 - protein, 26 aa, Mycobacterium tuberculosis
SMNHVLAEMKLLRPLLSAGDYLVVED

SEQ ID NO: 1519521 - protein, 23 aa, Mycobacterium tuberculosis
SNALWCRWCLGYAQLMRGELAAA

SEQ ID NO: 1519522 - protein, 24 aa, Mycobacterium tuberculosis
SNEGFFNTGMFNNGIYNSGVASTG

SEQ ID NO: 1519523 - protein, 23 aa, Mycobacterium tuberculosis
SNFNADRWELFHIAADRSQCHDL

SEQ ID NO: 1519524 - protein, 25 aa, Mycobacterium tuberculosis
SNIDIPPMDFTLGLPVLGPITGQLG

SEQ ID NO: 1519525 - protein, 22 aa, Mycobacterium tuberculosis
SNVLRAFTFPFDNVRVLIVGQD

SEQ ID NO: 1519526 - protein, 20 aa, Mycobacterium tuberculosis
SPAGLPSPRRPIGTVADQGA

SEQ ID NO: 1519527 - protein, 33 aa, Mycobacterium tuberculosis
SPGMVAKHRRHVLGPHLLVGGLGGRDRRGVLAQ

SEQ ID NO: 1519528 - protein, 22 aa, Mycobacterium tuberculosis
SPLAIGLFGVNPTVGSIGPGSI

SEQ ID NO: 1519529 - protein, 25 aa, Mycobacterium tuberculosis
SPPSHLWQARLAPDAKPYQGGHRFH

SEQ ID NO: 1519530 - protein, 17 aa, Mycobacterium tuberculosis
SPQALIALAMLTLAGHR

SEQ ID NO: 1519531 - protein, 33 aa, Mycobacterium tuberculosis
SPVRIIGYANAYDFFNMWRVRPAGLRVIGAGYG

SEQ ID NO: 1519532 - protein, 19 aa, Mycobacterium tuberculosis
SPVRSAWLDIPSLVEAAKQ

SEQ ID NO: 1519533 - protein, 17 aa, Mycobacterium tuberculosis
SPYSHWAFQHVEDFMPT

SEQ ID NO: 1519534 - protein, 21 aa, Mycobacterium tuberculosis
SQVPPQRWQPFEGGPPEVAAA

SEQ ID NO: 1519535 - protein, 29 aa, Mycobacterium tuberculosis
SRAEMEMKVLLWAVQRLIGGLSTIGAERD

SEQ ID NO: 1519536 - protein, 25 aa, Mycobacterium tuberculosis
SRARRPTSTIWSPRRARSSTTREAT

SEQ ID NO: 1519537 - protein, 20 aa, Mycobacterium tuberculosis
SRARRWLRTLRNIGVFGVNL

SEQ ID NO: 1519538 - protein, 18 aa, Mycobacterium tuberculosis
SRESLFWVSGNGVRFGIA

SEQ ID NO: 1519539 - protein, 20 aa, Mycobacterium tuberculosis
SRLLDAILADLYGPRSMLTE

SEQ ID NO: 1519540 - protein, 18 aa, Mycobacterium tuberculosis
SRNLKPLTKLRFTGGGYA

SEQ ID NO: 1519541 - protein, 19 aa, Mycobacterium tuberculosis
SRNLKPLTKLRFTGGGYAR

SEQ ID NO: 1519542 - protein, 21 aa, Mycobacterium tuberculosis
SRPASRWYSLPPTATAEFTGS

SEQ ID NO: 1519543 - protein, 23 aa, Mycobacterium tuberculosis
SRQHLHGLGGLVKPARGVRADVP

SEQ ID NO: 1519544 - protein, 23 aa, Mycobacterium tuberculosis
SRQLAALSIFANSGGKTAEAAAH

SEQ ID NO: 1519545 - protein, 31 aa, Mycobacterium tuberculosis
SRQLVREWLTQWSRPGLIPVALVVVNVFVEN

SEQ ID NO: 1519546 - protein, 21 aa, Mycobacterium tuberculosis
SRRILHQLYLGYPDSAAAQGI

SEQ ID NO: 1519547 - protein, 31 aa, Mycobacterium tuberculosis
SRSAVVVELLPPITAPRRNALRPRIGTTGIA

SEQ ID NO: 1519548 - protein, 21 aa, Mycobacterium tuberculosis
SSAAKMFNCTGWKIGWACGPA

SEQ ID NO: 1519549 - protein, 18 aa, Mycobacterium tuberculosis
SSGFFNFGTGNSGLLVSG

SEQ ID NO: 1519550 - protein, 20 aa, Mycobacterium tuberculosis
SSGFLNWGAGSASGLLNFGN

SEQ ID NO: 1519551 - protein, 17 aa, Mycobacterium tuberculosis
SSGLMAVHLACRSLHDG

SEQ ID NO: 1519552 - protein, 25 aa, Mycobacterium tuberculosis
SSGNPYLAFSAMLMAGLDGIKNKIE

SEQ ID NO: 1519553 - protein, 25 aa, Mycobacterium tuberculosis
SSIIANRVSYFYDFHGPSVTIDTAC

SEQ ID NO: 1519554 - protein, 23 aa, Mycobacterium tuberculosis
SSKLGGLWTAVSPHLSPLSNVSS

SEQ ID NO: 1519555 - protein, 24 aa, Mycobacterium tuberculosis
SSSLWRSSFSWWWKVLVRGWPWTA

SEQ ID NO: 1519556 - protein, 19 aa, Mycobacterium tuberculosis
SSYFALIETQAHHIIRCLK

SEQ ID NO: 1519557 - protein, 18 aa, Mycobacterium tuberculosis
STAVAALFSSHAQAYQAA

SEQ ID NO: 1519558 - protein, 25 aa, Mycobacterium tuberculosis
STEQDFRLFSGMSAHYDSLPRLIRK

SEQ ID NO: 1519559 - protein, 21 aa, Mycobacterium tuberculosis
STHVVWMGLPQPGGSLDVGQQ

SEQ ID NO: 1519560 - protein, 22 aa, Mycobacterium tuberculosis
SVACQGFITQLGRNFQVIYEQA

SEQ ID NO: 1519561 - protein, 20 aa, Mycobacterium tuberculosis
SVAQLELLLPAMAGLVASLT

SEQ ID NO: 1519562 - protein, 25 aa, Mycobacterium tuberculosis
SVDVNIPIHIPITASFTDIVYSGLD

SEQ ID NO: 1519563 - protein, 19 aa, Mycobacterium tuberculosis
SVFFDYPPHPRTIAHTVRG

SEQ ID NO: 1519564 - protein, 24 aa, Mycobacterium tuberculosis
SVHWSRIRLADRAHLEPWEPSADG

SEQ ID NO: 1519565 - protein, 19 aa, Mycobacterium tuberculosis
SVPILGPYEDLIANTVANL

SEQ ID NO: 1519566 - protein, 20 aa, Mycobacterium tuberculosis
SVREVTGVPILFASTGEKLE

SEQ ID NO: 1519567 - protein, 18 aa, Mycobacterium tuberculosis
SVSSVLYPGLPSHPGHEI

SEQ ID NO: 1519568 - protein, 20 aa, Mycobacterium tuberculosis
SVWGGFPAAVSWRSTSEQVH

SEQ ID NO: 1519569 - protein, 19 aa, Mycobacterium tuberculosis
SWPNLDYPGLHALSTVPQC

SEQ ID NO: 1519570 - protein, 21 aa, Mycobacterium tuberculosis
SWVDVFAHWRRAQGLPVSAIA

SEQ ID NO: 1519571 - protein, 18 aa, Mycobacterium tuberculosis
TAALWGVDEAISRAVPLR

SEQ ID NO: 1519572 - protein, 26 aa, Mycobacterium tuberculosis
TAAQPLEWFCLFSSAAALVGSPGQGA

SEQ ID NO: 1519573 - protein, 18 aa, Mycobacterium tuberculosis
TADTLRQLLPPEDRIILV

SEQ ID NO: 1519574 - protein, 26 aa, Mycobacterium tuberculosis
TAGDRGLLEMIWTPVPLEGGDIGDDA

SEQ ID NO: 1519575 - protein, 19 aa, Mycobacterium tuberculosis
TAGLLFGAGGAGGAGGFGF

SEQ ID NO: 1519576 - protein, 32 aa, Mycobacterium tuberculosis
TAKEWHQYWIDNRLQWYIDLGIRRENLRLWEH

SEQ ID NO: 1519577 - protein, 26 aa, Mycobacterium tuberculosis
TALRDGSYLPMTFAANDIAWSDNKPS

SEQ ID NO: 1519578 - protein, 25 aa, Mycobacterium tuberculosis
TANGALKFPSLHASPPMLAGKHIWE

SEQ ID NO: 1519579 - protein, 22 aa, Mycobacterium tuberculosis
TAPGLRWPDLALQGGRLNWSAV

SEQ ID NO: 1519580 - protein, 20 aa, Mycobacterium tuberculosis
TASPYLGFGSLRPLLEVAAA

SEQ ID NO: 1519581 - protein, 23 aa, Mycobacterium tuberculosis
TASRHAHWLNPEPKHLWGSGDSA

SEQ ID NO: 1519582 - protein, 20 aa, Mycobacterium tuberculosis
TASVYPLRAEAAFEYADRLG

SEQ ID NO: 1519583 - protein, 28 aa, Mycobacterium tuberculosis
TATSPMDPALYLVWAQANAAAGYRYSVE

SEQ ID NO: 1519584 - protein, 17 aa, Mycobacterium tuberculosis
TATVTRLALAIAAIASA

SEQ ID NO: 1519585 - protein, 25 aa, Mycobacterium tuberculosis
TAVDFAVPFSPRMSAPPISGRTAHN

SEQ ID NO: 1519586 - protein, 19 aa, Mycobacterium tuberculosis
TAVTKHKTPWILVGEQTVA

SEQ ID NO: 1519587 - protein, 17 aa, Mycobacterium tuberculosis
TAWLIERLQRPTLVMAP

SEQ ID NO: 1519588 - protein, 24 aa, Mycobacterium tuberculosis
TAWRNGDWYVARLTPSPLGHEERR

SEQ ID NO: 1519589 - protein, 26 aa, Mycobacterium tuberculosis
TCATTWRTHWMIWCSAGTITPLSTRS

SEQ ID NO: 1519590 - protein, 18 aa, Mycobacterium tuberculosis
TCLFLDRQAFERLLATHP

SEQ ID NO: 1519591 - protein, 20 aa, Mycobacterium tuberculosis
TCVLPAYLNALAGNGVHIVT

SEQ ID NO: 1519592 - protein, 20 aa, Mycobacterium tuberculosis
TDAHRAILASLGTGGAYFFR

SEQ ID NO: 1519593 - protein, 25 aa, Mycobacterium tuberculosis
TDEAGAAALWFALDTDLPVLVDADG

SEQ ID NO: 1519594 - protein, 19 aa, Mycobacterium tuberculosis
TDLAAPRKIPPGTGWRKFV

SEQ ID NO: 1519595 - protein, 25 aa, Mycobacterium tuberculosis
TDPRSRVPALPRLGPTDALPRCRQT

SEQ ID NO: 1519596 - protein, 23 aa, Mycobacterium tuberculosis
TDSAGSSRKAFGGDGGVGGDGAS

SEQ ID NO: 1519597 - protein, 34 aa, Mycobacterium tuberculosis
TEAMLHSDYPLQALLYVVVLHRFLRWRQRDYAPA

SEQ ID NO: 1519598 - protein, 35 aa, Mycobacterium tuberculosis; identical to SEQ ID NO: 223347

SEQ ID NO: 1519599 - protein, 18 aa, Mycobacterium tuberculosis
TEHLLGAARRRAFRVWLD

SEQ ID NO: 1519600 - protein, 19 aa, Mycobacterium tuberculosis
TELSGFYQVVVRPKTPRGD

SEQ ID NO: 1519601 - protein, 17 aa, Mycobacterium tuberculosis
TEPMLFEWTDRDTLLYA

SEQ ID NO: 1519602 - protein, 21 aa, Mycobacterium tuberculosis
TESVPLTFPSLVKSGSRTPGL

SEQ ID NO: 1519603 - protein, 27 aa, Mycobacterium tuberculosis
TFHGLLLLRHVADLVMTGWPVLMALSN

SEQ ID NO: 1519604 - protein, 23 aa, Mycobacterium tuberculosis
TFHSTCVRILRNQAALIEGLNSN

SEQ ID NO: 1519605 - protein, 17 aa, Mycobacterium tuberculosis
TFIHWPVLPDSVAGSYP

SEQ ID NO: 1519606 - protein, 22 aa, Mycobacterium tuberculosis
TFTICSFWLVSALVEIGEMGRA

SEQ ID NO: 1519607 - protein, 17 aa, Mycobacterium tuberculosis
TGATGFLGRYLVLELLR

SEQ ID NO: 1519608 - protein, 25 aa, Mycobacterium tuberculosis
TGEDRLLRLRWPCPVPGAMPISEVG

SEQ ID NO: 1519609 - protein, 25 aa, Mycobacterium tuberculosis
TGGAGGAGFSRALIVAGDNGGDGGN

SEQ ID NO: 1519610 - protein, 18 aa, Mycobacterium tuberculosis
TGGAGIGSLGGGTGGDGG

SEQ ID NO: 1519611 - protein, 17 aa, Mycobacterium tuberculosis
TGGEDVLFFVASRGHHA

SEQ ID NO: 1519612 - protein, 26 aa, Mycobacterium tuberculosis
TGGFTPRTWVALATEYFLAGRARVLV

SEQ ID NO: 1519613 - protein, 21 aa, Mycobacterium tuberculosis
TGGLGDPRVGGSGGDGGTGGS

SEQ ID NO: 1519614 - protein, 24 aa, Mycobacterium tuberculosis
TGGLGGLGGVGGTGGMGGSGGVGG

SEQ ID NO: 1519615 - protein, 24 aa, Mycobacterium tuberculosis
TGGLGGLGLFFASKLAAAGCGRIV

SEQ ID NO: 1519616 - protein, 23 aa, Mycobacterium tuberculosis
TGGLLLPLGVRSLRAYGPTRNAR

SEQ ID NO: 1519617 - protein, 18 aa, Mycobacterium tuberculosis
TGGNWLDALLRGLDHNRT

SEQ ID NO: 1519618 - protein, 22 aa, Mycobacterium tuberculosis
TGGPPLPGQAGMGAAGGAGGLI

SEQ ID NO: 1519619 - protein, 17 aa, Mycobacterium tuberculosis
TGKRLHELLMKRRRLGA

SEQ ID NO: 1519620 - protein, 18 aa, Mycobacterium tuberculosis
TGLLAAGADEVSAAIASL

SEQ ID NO: 1519621 - protein, 22 aa, Mycobacterium tuberculosis
TGMDLDWRAVVGEAQFVELPTY

SEQ ID NO: 1519622 - protein, 23 aa, Mycobacterium tuberculosis
TGMDLDWRAVVGEAQFVELPTYA

SEQ ID NO: 1519623 - protein, 28 aa, Mycobacterium tuberculosis
TGPYTFPGVLPPSGVPYLLGIQSVLVTQ

SEQ ID NO: 1519624 - protein, 19 aa, Mycobacterium tuberculosis
TGQAWQGPASAAMAAAAAP

SEQ ID NO: 1519625 - protein, 27 aa, Mycobacterium tuberculosis
TGSTAARLFYAYAEILLALGRGDEALQ

SEQ ID NO: 1519626 - protein, 17 aa, Mycobacterium tuberculosis
TGYALGAGLTLALAADW

SEQ ID NO: 1519627 - protein, 32 aa, Mycobacterium tuberculosis
THARVGLLPTWGLSVRLPQKVGIGLARRMSLT

SEQ ID NO: 1519628 - protein, 28 aa, Mycobacterium tuberculosis
THQQVVVPPAGAEATHPGPFADASSPRY

SEQ ID NO: 1519629 - protein, 17 aa, Mycobacterium tuberculosis
THRKALAAFTKSGGRLV

SEQ ID NO: 1519630 - protein, 21 aa, Mycobacterium tuberculosis
THYFDNFFLDATRAGIRQAVI

SEQ ID NO: 1519631 - protein, 18 aa, Mycobacterium tuberculosis
TIATVARRLPEFPRCARG

SEQ ID NO: 1519632 - protein, 19 aa, Mycobacterium tuberculosis
TIAVLYYRAQHLAGNTGYV

SEQ ID NO: 1519633 - protein, 24 aa, Mycobacterium tuberculosis
TICRRAGLSVRYFYESFTDKDEFV

SEQ ID NO: 1519634 - protein, 20 aa, Mycobacterium tuberculosis
TIFHDQFVQALTSGGNLYAA

SEQ ID NO: 1519635 - protein, 17 aa, Mycobacterium tuberculosis
TIKWRTGCEGRISHLKR

SEQ ID NO: 1519636 - protein, 28 aa, Mycobacterium tuberculosis
TILLARGDLALRMGLPVLAVVAFAQSFG

SEQ ID NO: 1519637 - protein, 23 aa, Mycobacterium tuberculosis
TIPGFAINPFGLNVPLSGGTNAV

SEQ ID NO: 1519638 - protein, 18 aa, Mycobacterium tuberculosis
TIPGFSVPAQPLPLSIDI

SEQ ID NO: 1519639 - protein, 19 aa, Mycobacterium tuberculosis
TIPGFTIPGSPLNLTANGG

SEQ ID NO: 1519640 - protein, 37 aa, Mycobacterium tuberculosis
TIPLDTPPAPAPPPFRLPLLFVNALGDNWIVGASNST

SEQ ID NO: 1519641 - protein, 21 aa, Mycobacterium tuberculosis
TIPPVLVRPEVMVGTGFLGAH

SEQ ID NO: 1519642 - protein, 19 aa, Mycobacterium tuberculosis
TIPQFRTLVILSNHGPINL

SEQ ID NO: 1519643 - protein, 26 aa, Mycobacterium tuberculosis
TITEVYDYLRLLYARAGTPHCPTCGE

SEQ ID NO: 1519644 - protein, 25 aa, Mycobacterium tuberculosis
TKAITKRITVWPQGADIQDRVNNRS

SEQ ID NO: 1519645 - protein, 25 aa, Mycobacterium tuberculosis
TKIRTHHLQRWKADGHKWAMLTAYD

SEQ ID NO: 1519646 - protein, 23 aa, Mycobacterium tuberculosis
TKRNIARALGRIAPLRVGRAAVN

SEQ ID NO: 1519647 - protein, 17 aa, Mycobacterium tuberculosis
TLDRSILRQLGMGRRTV

SEQ ID NO: 1519648 - protein, 20 aa, Mycobacterium tuberculosis
TLDRSILRQLGMGRRTVVVT

SEQ ID NO: 1519649 - protein, 32 aa, Mycobacterium tuberculosis
TLFDRFGTELPPLEGIYLAAFAGRPALLSEMT

SEQ ID NO: 1519650 - protein, 17 aa, Mycobacterium tuberculosis
TLHLPFDGILVPPHPVT

SEQ ID NO: 1519651 - protein, 18 aa, Mycobacterium tuberculosis
TLLDFDDLLLHTAAAIEN

SEQ ID NO: 1519652 - protein, 18 aa, Mycobacterium tuberculosis
TLLRYTQTLTLWDGVDRV

SEQ ID NO: 1519653 - protein, 25 aa, Mycobacterium tuberculosis
TLLTGRRTWVPWTAVLVNVATRDCW

SEQ ID NO: 1519654 - protein, 23 aa, Mycobacterium tuberculosis
TLNTGFFSAMTQAGPNSGFFNAG

SEQ ID NO: 1519655 - protein, 17 aa, Mycobacterium tuberculosis
TLPPGTALTPLGRDQAR

SEQ ID NO: 1519656 - protein, 23 aa, Mycobacterium tuberculosis
TLQQLGEFAVIDRLVRGRRQPAT

SEQ ID NO: 1519657 - protein, 25 aa, Mycobacterium tuberculosis
TLTGPIVIGSFFLPAFNIPGIDVPA

SEQ ID NO: 1519658 - protein, 33 aa, Mycobacterium tuberculosis; identical to SEQ ID NO: 223553

SEQ ID NO: 1519659 - protein, 17 aa, Mycobacterium tuberculosis
TLVRAVCDGRRLVTLDG

SEQ ID NO: 1519660 - protein, 18 aa, Mycobacterium tuberculosis
TLVYMAFYERCGAVFCRN

SEQ ID NO: 1519661 - protein, 24 aa, Mycobacterium tuberculosis
TMAKGLRTKLLAASAYIKAADRVV

SEQ ID NO: 1519662 - protein, 17 aa, Mycobacterium tuberculosis
TMNAFGIALLCHVLLVE

SEQ ID NO: 1519663 - protein, 44 aa, Mycobacterium tuberculosis; identical to SEQ ID NO: 236979

SEQ ID NO: 1519664 - protein, 35 aa, Mycobacterium tuberculosis
TNLESLYGAWSANPFPFLRQIIANQQVYWQQIAAA

SEQ ID NO: 1519665 - protein, 24 aa, Mycobacterium tuberculosis
TNSGGFNVGFYNSGAGTVGIANSG

SEQ ID NO: 1519666 - protein, 21 aa, Mycobacterium tuberculosis
TNTICLDIDWVIGGCMSVDPT

SEQ ID NO: 1519667 - protein, 18 aa, Mycobacterium tuberculosis
TNTLALATSPYLRQHADN

SEQ ID NO: 1519668 - protein, 36 aa, Mycobacterium tuberculosis
TNVEQNLLNLINAPTQTLLGRPLIGDGANATTPGGA

SEQ ID NO: 1519669 - protein, 21 aa, Mycobacterium tuberculosis
TPGAKGAHGFTPTSGGDGGDG

SEQ ID NO: 1519670 - protein, 30 aa, Mycobacterium tuberculosis; identical to SEQ ID NO: 227018

SEQ ID NO: 1519671 - protein, 25 aa, Mycobacterium tuberculosis
TPGKVPSWISDIANIFNIGAGNWVS

SEQ ID NO: 1519672 - protein, 17 aa, Mycobacterium tuberculosis
TPHHLLLDDARLASYDG

SEQ ID NO: 1519673 - protein, 22 aa, Mycobacterium tuberculosis
TPLALYHTKRLASPAQRIMLFA

SEQ ID NO: 1519674 - protein, 17 aa, Mycobacterium tuberculosis
TPPLTVPGIHLPSTTIG

SEQ ID NO: 1519675 - protein, 17 aa, Mycobacterium tuberculosis
TPPMPIAGPEPAPPKPP

SEQ ID NO: 1519676 - protein, 23 aa, Mycobacterium tuberculosis
TPPTGTPALFTLSASSADALRQT

SEQ ID NO: 1519677 - protein, 17 aa, Mycobacterium tuberculosis
TQFGMTQLHYPLRTRQI

SEQ ID NO: 1519678 - protein, 18 aa, Mycobacterium tuberculosis
TQGVVPDGLAAAALSPAV

SEQ ID NO: 1519679 - protein, 23 aa, Mycobacterium tuberculosis
TQIARAFVSERIGLAAQAYSSAQ

SEQ ID NO: 1519680 - protein, 19 aa, Mycobacterium tuberculosis
TQIPSVAVPVTGAGGTGGN

SEQ ID NO: 1519681 - protein, 20 aa, Mycobacterium tuberculosis
TRAGRRLWVYGRAGQGCRRC

SEQ ID NO: 1519682 - protein, 22 aa, Mycobacterium tuberculosis
TRARVHLALSWALSRSPGGRQS

SEQ ID NO: 1519683 - protein, 22 aa, Mycobacterium tuberculosis
TRLYHVLHAIADTIRHNEAALR

SEQ ID NO: 1519684 - protein, 26 aa, Mycobacterium tuberculosis
TRNHIARRLFVPPPDPVAVLRELVLL

SEQ ID NO: 1519685 - protein, 25 aa, Mycobacterium tuberculosis
TSAVKAFTAWAVRRGLLAGDPAARL

SEQ ID NO: 1519686 - protein, 29 aa, Mycobacterium tuberculosis
TSEQLAHQIHWLLLRFGVGSTVRDYDPTQ

SEQ ID NO: 1519687 - protein, 26 aa, Mycobacterium tuberculosis
TSGQPLDWFCLFSSAAALTGSPGQSA

SEQ ID NO: 1519688 - protein, 25 aa, Mycobacterium tuberculosis
TSRSARPILLHRSIAGSPGLAKLAE

SEQ ID NO: 1519689 - protein, 30 aa, Mycobacterium tuberculosis
TSTAPPTMRSCRFLRAMLPALGDSQLPADS

SEQ ID NO: 1519690 - protein, 25 aa, Mycobacterium tuberculosis
TSTKPAYSIVLPPPNVTGSLHMGHA

SEQ ID NO: 1519691 - protein, 22 aa, Mycobacterium tuberculosis
TTAIDLALALHPTPAVGGVPTK

SEQ ID NO: 1519692 - protein, 20 aa, Mycobacterium tuberculosis
TTFSVGLANLGFWNLGSANI

SEQ ID NO: 1519693 - protein, 29 aa, Mycobacterium tuberculosis
TTGGSGGAGGLIGWAGAAGGTGAGGTGGQ

SEQ ID NO: 1519694 - protein, 30 aa, Mycobacterium tuberculosis
TTGGSGGAGGLIGWAGAAGGTGAGGTGGQG

SEQ ID NO: 1519695 - protein, 21 aa, Mycobacterium tuberculosis
TTKLMPPALSRAFPTSLSTGD

SEQ ID NO: 1519696 - protein, 25 aa, Mycobacterium tuberculosis
TTLDALAAELPLPVGLLKIDVEGLE

SEQ ID NO: 1519697 - protein, 21 aa, Mycobacterium tuberculosis
TTLIEALLVAAKVLSRPGSVT

SEQ ID NO: 1519698 - protein, 19 aa, Mycobacterium tuberculosis
TTLLAIVQKLPTSMVVSRA

SEQ ID NO: 1519699 - protein, 26 aa, Mycobacterium tuberculosis
TVERRHVPANQWLFHAGEPADSIYIV

SEQ ID NO: 1519700 - protein, 25 aa, Mycobacterium tuberculosis
TVETFIRHFELGAADRWLALATLEC

SEQ ID NO: 1519701 - protein, 17 aa, Mycobacterium tuberculosis
TVFAPTNAAFSKLPAST

SEQ ID NO: 1519702 - protein, 17 aa, Mycobacterium tuberculosis
TVGFAGSGGFGGAGGIA

SEQ ID NO: 1519703 - protein, 23 aa, Mycobacterium tuberculosis
TVHSYAYAVLRKAAQRAGDALPR

SEQ ID NO: 1519704 - protein, 26 aa, Mycobacterium tuberculosis
TVPEMRQWLRNWVGKAVGKAPDSIDE

SEQ ID NO: 1519705 - protein, 26 aa, Mycobacterium tuberculosis
TVPGVPISRIPLTINIRIPVNITLNE

SEQ ID NO: 1519706 - protein, 18 aa, Mycobacterium tuberculosis
TVTPMLDMPLEEFQRLQN

SEQ ID NO: 1519707 - protein, 17 aa, Mycobacterium tuberculosis
TVVGQRIVFAPGAAHMS

SEQ ID NO: 1519708 - protein, 21 aa, Mycobacterium tuberculosis
TWAPKSAGALAYRALARELID

SEQ ID NO: 1519709 - protein, 18 aa, Mycobacterium tuberculosis
TWNHRRLLLDDTTRRIAH

SEQ ID NO: 1519710 - protein, 23 aa, Mycobacterium tuberculosis
TWPGGRQYLPKAVIGATTRAFDG

SEQ ID NO: 1519711 - protein, 24 aa, Mycobacterium tuberculosis
TWPVDRPFAMLTVARSLMLDVIVK

SEQ ID NO: 1519712 - protein, 24 aa, Mycobacterium tuberculosis
TYGSSVLILPDALLDAVHISASLC

SEQ ID NO: 1519713 - protein, 17 aa, Mycobacterium tuberculosis
TYLNDFAQLLAALGRRY

SEQ ID NO: 1519714 - protein, 22 aa, Mycobacterium tuberculosis
TYPLLLHEAYVRLYPAQVIKQA

SEQ ID NO: 1519715 - protein, 21 aa, Mycobacterium tuberculosis
VAAKRIAWIKLLNAGQTCVAP

SEQ ID NO: 1519716 - protein, 17 aa, Mycobacterium tuberculosis
VAALLGCAVLTGGGAVL

SEQ ID NO: 1519717 - protein, 19 aa, Mycobacterium tuberculosis
VAARGRLMQALPAGGAMVA

SEQ ID NO: 1519718 - protein, 27 aa, Mycobacterium tuberculosis
VAAYHQQFVQTLRTGAASYMLAEATNV

SEQ ID NO: 1519719 - protein, 17 aa, Mycobacterium tuberculosis
VAELFVCRPTEPDVGDF

SEQ ID NO: 1519720 - protein, 25 aa, Mycobacterium tuberculosis
VAEYADIWHSFTAGDSYLAKSAVLS

SEQ ID NO: 1519721 - protein, 18 aa, Mycobacterium tuberculosis
VAGLFGDGGNGGNAGVGT

SEQ ID NO: 1519722 - protein, 18 aa, Mycobacterium tuberculosis
VALAKLRLPSPSGRAGIA

SEQ ID NO: 1519723 - protein, 19 aa, Mycobacterium tuberculosis
VALFLDKDRVLYATDHSGR

SEQ ID NO: 1519724 - protein, 22 aa, Mycobacterium tuberculosis
VALHERAVLIELLDDEPDPVTL

SEQ ID NO: 1519725 - protein, 17 aa, Mycobacterium tuberculosis
VALPLHPEYRTMPMVWY

SEQ ID NO: 1519726 - protein, 20 aa, Mycobacterium tuberculosis
VALQRALNSGYFRPYTNADV

SEQ ID NO: 1519727 - protein, 22 aa, Mycobacterium tuberculosis
VAMCGLFHGPRLRDMDARHGGS

SEQ ID NO: 1519728 - protein, 25 aa, Mycobacterium tuberculosis
VANLAPRIGLGALGLQLGQVGLQLL

SEQ ID NO: 1519729 - protein, 21 aa, Mycobacterium tuberculosis
VARFMPVYPTEKAASKAIGRL

SEQ ID NO: 1519730 - protein, 29 aa, Mycobacterium tuberculosis
VARHVRSTILLAASAFGRLALDAVHLDIL

SEQ ID NO: 1519731 - protein, 19 aa, Mycobacterium tuberculosis
VARLRVILRRAGKGNKEPR

SEQ ID NO: 1519732 - protein, 17 aa, Mycobacterium tuberculosis
VARRRGISVLGDRPPMV

SEQ ID NO: 1519733 - protein, 18 aa, Mycobacterium tuberculosis
VARWPSMTKARLAGQVDK

SEQ ID NO: 1519734 - protein, 21 aa, Mycobacterium tuberculosis
VASPGFSPATPLLAAAAAAGV

SEQ ID NO: 1519735 - protein, 19 aa, Mycobacterium tuberculosis
VATAMIPFLEHDDANRALM

SEQ ID NO: 1519736 - protein, 24 aa, Mycobacterium tuberculosis
VATETFAPILYVLTYDDLDEAIAL

SEQ ID NO: 1519737 - protein, 27 aa, Mycobacterium tuberculosis
VAVAHQLEFEFLPAVNRFLDEHVGAGR

SEQ ID NO: 1519738 - protein, 21 aa, Mycobacterium tuberculosis
VAVARLVLGPGMRIQAPPNLV

SEQ ID NO: 1519739 - protein, 17 aa, Mycobacterium tuberculosis
VAVSPVTGLVFVTNFDS

SEQ ID NO: 1519740 - protein, 24 aa, Mycobacterium tuberculosis
VCPLGWPATPARLPFTLGAGAHLQ

SEQ ID NO: 1519741 - protein, 36 aa, Mycobacterium tuberculosis
VDASDLSNILLLGPVGDLFPILSIPGAMSQNFTNVV

SEQ ID NO: 1519742 - protein, 18 aa, Mycobacterium tuberculosis
VDELNVIAVRYLPDERTS

SEQ ID NO: 1519743 - protein, 18 aa, Mycobacterium tuberculosis
VDGAGKWRRWIGGRAAQL

SEQ ID NO: 1519744 - protein, 18 aa, Mycobacterium tuberculosis
VDIQLAQLGKRLAQRRLQ

SEQ ID NO: 1519745 - protein, 21 aa, Mycobacterium tuberculosis
VDLILPGFRYRAAMADGTVEN

SEQ ID NO: 1519746 - protein, 24 aa, Mycobacterium tuberculosis
VDNPHPLLLLTHPVPNTGAVVVQG

SEQ ID NO: 1519747 - protein, 25 aa, Mycobacterium tuberculosis
VDRGQQLLLDLGLGGRICSSATGKR

SEQ ID NO: 1519748 - protein, 26 aa, Mycobacterium tuberculosis
VDSYADDWTQLWWVRADGVAAIHRDG

SEQ ID NO: 1519749 - protein, 25 aa, Mycobacterium tuberculosis
VDVVYQFIPVLKANGYRLVTVSELL

SEQ ID NO: 1519750 - protein, 26 aa, Mycobacterium tuberculosis
VEDVFPLPRELVGEGTLFLLKVIGDS

SEQ ID NO: 1519751 - protein, 25 aa, Mycobacterium tuberculosis
VEFDRRQWRALRMSTPLALTEEELV

SEQ ID NO: 1519752 - protein, 18 aa, Mycobacterium tuberculosis
VEHEGAHVTWLPTAADGS

SEQ ID NO: 1519753 - protein, 26 aa, Mycobacterium tuberculosis
VEHFILEDWWGRWLGRWTAEEHLHAI

SEQ ID NO: 1519754 - protein, 25 aa, Mycobacterium tuberculosis
VEHRDRFCRLGSKYVQAAFAAQGRE

SEQ ID NO: 1519755 - protein, 23 aa, Mycobacterium tuberculosis
VEIPGLPPITIPLLAPPPPAPPP

SEQ ID NO: 1519756 - protein, 34 aa, Mycobacterium tuberculosis
VEQQLLAAINAPTQALLGRPLIGNGADGAPGTGQ

SEQ ID NO: 1519757 - protein, 34 aa, Mycobacterium tuberculosis
VEVGKLADLVLWEPAFFGVRPHVVLKGGAIAWAA

SEQ ID NO: 1519758 - protein, 18 aa, Mycobacterium tuberculosis
VFEHRAVVVGASREQLIA

SEQ ID NO: 1519759 - protein, 18 aa, Mycobacterium tuberculosis
VFNRLDIPSWMARMGFQM

SEQ ID NO: 1519760 - protein, 17 aa, Mycobacterium tuberculosis
VFVFPGQGSQWLGMGIE

SEQ ID NO: 1519761 - protein, 24 aa, Mycobacterium tuberculosis
VGCALIEELVLAAPLVMHPGVGVQ

SEQ ID NO: 1519762 - protein, 23 aa, Mycobacterium tuberculosis
VGDDLVPYRTLVTQAPVGVMVGH

SEQ ID NO: 1519763 - protein, 17 aa, Mycobacterium tuberculosis
VGDGYARTLSTLTWRVV

SEQ ID NO: 1519764 - protein, 30 aa, Mycobacterium tuberculosis
VGEALAPIVNAPTNVLLGRDLIGNGVTGTA

SEQ ID NO: 1519765 - protein, 17 aa, Mycobacterium tuberculosis
VGFGANGDPGFAGGKGG

SEQ ID NO: 1519766 - protein, 24 aa, Mycobacterium tuberculosis
VGFGWAMRRLLGLVDHVVAVDLAE

SEQ ID NO: 1519767 - protein, 21 aa, Mycobacterium tuberculosis
VGGHGGTAILFGDGGAGGAGA

SEQ ID NO: 1519768 - protein, 19 aa, Mycobacterium tuberculosis
VGGLMLPVGVRRLRNYHST

SEQ ID NO: 1519769 - protein, 22 aa, Mycobacterium tuberculosis
VGGRGGWLLGNGGTGGAGGAAG

SEQ ID NO: 1519770 - protein, 28 aa, Mycobacterium tuberculosis
VGGVGGNGGWLYGNGGAGGLGGTGVAGV

SEQ ID NO: 1519771 - protein, 18 aa, Mycobacterium tuberculosis
VGGWAAVQIGRRLARLAR

SEQ ID NO: 1519772 - protein, 29 aa, Mycobacterium tuberculosis
VGKPEQNAWWWYVLKFGRSSAYAEFFDID

SEQ ID NO: 1519773 - protein, 17 aa, Mycobacterium tuberculosis
VGLFGQGGAGGAGGSGF

SEQ ID NO: 1519774 - protein, 25 aa, Mycobacterium tuberculosis
VGPQRDYWIRQLGGLAGETGLRPDF

SEQ ID NO: 1519775 - protein, 18 aa, Mycobacterium tuberculosis
VGQAEILWDVIPFDWIND

SEQ ID NO: 1519776 - protein, 20 aa, Mycobacterium tuberculosis
VGRRRGFAMPWVSTARSGAV

SEQ ID NO: 1519777 - protein, 23 aa, Mycobacterium tuberculosis
VHVSFVMAYPEMLAAAADTLQSI

SEQ ID NO: 1519778 - protein, 18 aa, Mycobacterium tuberculosis
VIATPEMMATAAFDLARI

SEQ ID NO: 1519779 - protein, 27 aa, Mycobacterium tuberculosis
VIDQLPANTWLTDVGKYPLRGLHRQER

SEQ ID NO: 1519780 - protein, 24 aa, Mycobacterium tuberculosis
VIGVPGVIGVPGVIGVPGVPGVPG

SEQ ID NO: 1519781 - protein, 17 aa, Mycobacterium tuberculosis
VILLDCGTPVNGPLFSN

SEQ ID NO: 1519782 - protein, 22 aa, Mycobacterium tuberculosis
VIRKLFWRNLPDEQPGLAPTAL

SEQ ID NO: 1519783 - protein, 18 aa, Mycobacterium tuberculosis
VISARRVLRDLWFDGHRI

SEQ ID NO: 1519784 - protein, 19 aa, Mycobacterium tuberculosis
VITPWRSVLICDLDDATAD

SEQ ID NO: 1519785 - protein, 20 aa, Mycobacterium tuberculosis
VKLRLGIGYVIQDAGLMPHQ

SEQ ID NO: 1519786 - protein, 18 aa, Mycobacterium tuberculosis
VKLWLTDEGDIDADWPRL

SEQ ID NO: 1519787 - protein, 37 aa, Mycobacterium tuberculosis
VKTLLEQTLALLPAALPLLAAPLAPLTLAPASAAGGF

SEQ ID NO: 1519788 - protein, 20 aa, Mycobacterium tuberculosis
VLAHWPEVIASPTPAAAGRV

SEQ ID NO: 1519789 - protein, 20 aa, Mycobacterium tuberculosis
VLAPVVFTSALGLGDLFCPD

SEQ ID NO: 1519790 - protein, 23 aa, Mycobacterium tuberculosis
VLDLLARICDPLTGIKEVWEFLT

SEQ ID NO: 1519791 - protein, 18 aa, Mycobacterium tuberculosis
VLGPGMRIQAPPNLVSGD

SEQ ID NO: 1519792 - protein, 24 aa, Mycobacterium tuberculosis
VLGRLPMRAWLIGLRPMEGSPEGH

SEQ ID NO: 1519793 - protein, 17 aa, Mycobacterium tuberculosis
VLLLREANGDRYLPIWI

SEQ ID NO: 1519794 - protein, 31 aa, Mycobacterium tuberculosis; identical to SEQ ID NO: 237966

SEQ ID NO: 1519795 - protein, 25 aa, Mycobacterium tuberculosis
VLNLSIPPIHIPGLTIPSVPLRIDV

SEQ ID NO: 1519796 - protein, 18 aa, Mycobacterium tuberculosis
VLNRLRRAQGQLAGVISM

SEQ ID NO: 1519797 - protein, 18 aa, Mycobacterium tuberculosis
VLPVIPLSLDINGGVGAI

SEQ ID NO: 1519798 - protein, 17 aa, Mycobacterium tuberculosis
VLQGQCTFSWPPRMELP

SEQ ID NO: 1519799 - protein, 18 aa, Mycobacterium tuberculosis
VLRRLPDLRLVADDSVLP

SEQ ID NO: 1519800 - protein, 17 aa, Mycobacterium tuberculosis
VLRVPRRGDKRALAETV

SEQ ID NO: 1519801 - protein, 17 aa, Mycobacterium tuberculosis
VLSAGLMLAWCCDLIVA

SEQ ID NO: 1519802 - protein, 25 aa, Mycobacterium tuberculosis
VLSGPNWSYWPSRVLGSADPTTIAH

SEQ ID NO: 1519803 - protein, 22 aa, Mycobacterium tuberculosis
VLSRYVDAIVWRTFGQERLDAM

SEQ ID NO: 1519804 - protein, 17 aa, Mycobacterium tuberculosis
VLTCSPTRYGGVKGAHR

SEQ ID NO: 1519805 - protein, 18 aa, Mycobacterium tuberculosis
VLVATNFFGINTIPIALN

SEQ ID NO: 1519806 - protein, 27 aa, Mycobacterium tuberculosis
VLVTGYDILFFWVARMMMFGTFVGDDA

SEQ ID NO: 1519807 - protein, 17 aa, Mycobacterium tuberculosis
VLVWQDMAGFSGAKTAR

SEQ ID NO: 1519808 - protein, 17 aa, Mycobacterium tuberculosis
VMEFPVLPPEINSVLMY

SEQ ID NO: 1519809 - protein, 17 aa, Mycobacterium tuberculosis
VMMPGMDGFGVLRRLRA

SEQ ID NO: 1519810 - protein, 17 aa, Mycobacterium tuberculosis
VMSNLGLHLAMRSAGVT

SEQ ID NO: 1519811 - protein, 26 aa, Mycobacterium tuberculosis
VNFVPVIDQDVRRWWRSDSLWQAHDA

SEQ ID NO: 1519812 - protein, 32 aa, Mycobacterium tuberculosis
VNNTGIFVTGVMSSGFFNFGTGNSGLLVSGNG

SEQ ID NO: 1519813 - protein, 20 aa, Mycobacterium tuberculosis
VNSALMYAGPGSGPMLAAAA

SEQ ID NO: 1519814 - protein, 23 aa, Mycobacterium tuberculosis
VNTIFLSTRFRAWRVGGYNEYLY

SEQ ID NO: 1519815 - protein, 17 aa, Mycobacterium tuberculosis
VPAFGIPFTLQFQTNVP

SEQ ID NO: 1519816 - protein, 17 aa, Mycobacterium tuberculosis
VPAIVVPPVAAPNVLAG

SEQ ID NO: 1519817 - protein, 24 aa, Mycobacterium tuberculosis
VPGLPRLLRVVGHYYKPGFHPSQL

SEQ ID NO: 1519818 - protein, 21 aa, Mycobacterium tuberculosis
VPHSWNLPPAVRQVAAMFPGA

SEQ ID NO: 1519819 - protein, 29 aa, Mycobacterium tuberculosis
VPIKVTPEILLQVLTTPPASGPAPFPAVP

SEQ ID NO: 1519820 - protein, 18 aa, Mycobacterium tuberculosis
VPISGILFGGRRKTTVPL

SEQ ID NO: 1519821 - protein, 17 aa, Mycobacterium tuberculosis
VPRGYRIAARPGAVTRR

SEQ ID NO: 1519822 - protein, 28 aa, Mycobacterium tuberculosis
VPTEVRLRLLDTLDLFGIALGMAAFRPG

SEQ ID NO: 1519823 - protein, 17 aa, Mycobacterium tuberculosis
VPTITLTIGGPTVTVPI

SEQ ID NO: 1519824 - protein, 19 aa, Mycobacterium tuberculosis
VPVVFLTAYYALRVLAQVQ

SEQ ID NO: 1519825 - protein, 35 aa, Mycobacterium tuberculosis
VQEIVPVQLVRIGRLYLIGIPGEPTIVAGLRLRRM

SEQ ID NO: 1519826 - protein, 17 aa, Mycobacterium tuberculosis
VQLARLWGLEVFATASR

SEQ ID NO: 1519827 - protein, 20 aa, Mycobacterium tuberculosis
VQQFLAFNAAYYIQQIISSQ

SEQ ID NO: 1519828 - protein, 31 aa, Mycobacterium tuberculosis
VQRCGPLDWRWRRRGFFGDHGGRWCRHRSLQ

SEQ ID NO: 1519829 - protein, 29 aa, Mycobacterium tuberculosis
VQRGHIPRNLHFTRWNPAIDASATRLFVP

SEQ ID NO: 1519830 - protein, 20 aa, Mycobacterium tuberculosis
VQTDGFLRGHGGDGGNAVGL

SEQ ID NO: 1519831 - protein, 27 aa, Mycobacterium tuberculosis
VRAPADLLSGYYHAVHKLTLEYIAGMT

SEQ ID NO: 1519832 - protein, 28 aa, Mycobacterium tuberculosis
VRAPADLLSGYYHAVHKLTLEYIAGMTA

SEQ ID NO: 1519833 - protein, 17 aa, Mycobacterium tuberculosis
VRARDRFASRVNIEVAP

SEQ ID NO: 1519834 - protein, 17 aa, Mycobacterium tuberculosis
VRASAQWCPRPWPDRPR

SEQ ID NO: 1519835 - protein, 18 aa, Mycobacterium tuberculosis
VRASAQWCPRPWPDRPRR

SEQ ID NO: 1519836 - protein, 17 aa, Mycobacterium tuberculosis
VRAVCDGRRLVTLDGPE

SEQ ID NO: 1519837 - protein, 25 aa, Mycobacterium tuberculosis
VRDVRYLGSQQWRFPRSLMVGFHAL

SEQ ID NO: 1519838 - protein, 28 aa, Mycobacterium tuberculosis
VRGRDDRLRWWAGPWPDDERWWDPDRAS

SEQ ID NO: 1519839 - protein, 19 aa, Mycobacterium tuberculosis
VRLAMVQPALVAANRSGLI

SEQ ID NO: 1519840 - protein, 17 aa, Mycobacterium tuberculosis
VRLGLLAGHYRADRFWS

SEQ ID NO: 1519841 - protein, 25 aa, Mycobacterium tuberculosis
VRRARFAAAFTFQYSKRPGTPAAQL

SEQ ID NO: 1519842 - protein, 25 aa, Mycobacterium tuberculosis
VRTRWSRCWVRVWGSLRSTRPESVV

SEQ ID NO: 1519843 - protein, 18 aa, Mycobacterium tuberculosis
VSGFQLPPLSIPSVAIPP

SEQ ID NO: 1519844 - protein, 34 aa, Mycobacterium tuberculosis
VSGPLLRRKFRPSSAAMLPLRTALDRGLLSIRGV

SEQ ID NO: 1519845 - protein, 27 aa, Mycobacterium tuberculosis
VSHAFHSLLMEPMLAEFTRIAAGISVS

SEQ ID NO: 1519846 - protein, 24 aa, Mycobacterium tuberculosis
VSISVGCNNSCTFCIVPSLRGREV

SEQ ID NO: 1519847 - protein, 25 aa, Mycobacterium tuberculosis
VSNVPGPPFPLYMAGARLDSLVPLG

SEQ ID NO: 1519848 - protein, 20 aa, Mycobacterium tuberculosis
VSRDLGVTEFMLLQAAVAVV

SEQ ID NO: 1519849 - protein, 24 aa, Mycobacterium tuberculosis
VSSKYALVIYAAKRARQINDYYNQ

SEQ ID NO: 1519850 - protein, 26 aa, Mycobacterium tuberculosis
VTAESGHALLLGARGRRLDVRQARTA

SEQ ID NO: 1519851 - protein, 21 aa, Mycobacterium tuberculosis
VTAPLVPLAVSAFLTSRKKAA

SEQ ID NO: 1519852 - protein, 18 aa, Mycobacterium tuberculosis
VTAVGWTSLMRSTVCCWL

SEQ ID NO: 1519853 - protein, 18 aa, Mycobacterium tuberculosis
VTDHRYVPAAVFTDPQIA

SEQ ID NO: 1519854 - protein, 18 aa, Mycobacterium tuberculosis
VTEFMLLQAAVAVVLHKA

SEQ ID NO: 1519855 - protein, 21 aa, Mycobacterium tuberculosis
VTEPMLFEWTDRDTLLYAIGV

SEQ ID NO: 1519856 - protein, 21 aa, Mycobacterium tuberculosis
VTIPGFTIPGSPLNLTANGGL

SEQ ID NO: 1519857 - protein, 17 aa, Mycobacterium tuberculosis
VTKLARTYKPYGPVLSD

SEQ ID NO: 1519858 - protein, 25 aa, Mycobacterium tuberculosis
VTKTAIPYRVPFPQSMPTQETAPTR

SEQ ID NO: 1519859 - protein, 22 aa, Mycobacterium tuberculosis
VTPDWLGLPDKLAGRRAWGLAV

SEQ ID NO: 1519860 - protein, 20 aa, Mycobacterium tuberculosis
VTPILPMIRAAEQRGIDWRA

SEQ ID NO: 1519861 - protein, 17 aa, Mycobacterium tuberculosis
VTRLHVTWTGEGAAAHA

SEQ ID NO: 1519862 - protein, 22 aa, Mycobacterium tuberculosis
VTRTFLPGWPDGSYGWAKVEAF

SEQ ID NO: 1519863 - protein, 31 aa, Mycobacterium tuberculosis
VTTMFRPKLDALALLHRRSLKSPVRHFVLFS

SEQ ID NO: 1519864 - protein, 21 aa, Mycobacterium tuberculosis
VTVPVSFTELALGSTLSVPTL

SEQ ID NO: 1519865 - protein, 30 aa, Mycobacterium tuberculosis
VTWDTPVVSKLPWFALRDPYVTGQVTIADL

SEQ ID NO: 1519866 - protein, 27 aa, Mycobacterium tuberculosis
VVASPGFSPAIPLLAAAAAAGVPIWGD

SEQ ID NO: 1519867 - protein, 18 aa, Mycobacterium tuberculosis
VVCDFADACVPVVKVLAP

SEQ ID NO: 1519868 - protein, 27 aa, Mycobacterium tuberculosis
VVCPLGWPATPARLPFTLGAGAHLQAD

SEQ ID NO: 1519869 - protein, 18 aa, Mycobacterium tuberculosis
VVEQALVKVPYMPTDLPA

SEQ ID NO: 1519870 - protein, 26 aa, Mycobacterium tuberculosis
VVKEVQTYVPGYRLLNEPQFDEPSIN

SEQ ID NO: 1519871 - protein, 19 aa, Mycobacterium tuberculosis
VVKGGRRFSFTALVIVGDG

SEQ ID NO: 1519872 - protein, 27 aa, Mycobacterium tuberculosis
VVLPDPFITIDHYGPPLGPPGAKFPSG

SEQ ID NO: 1519873 - protein, 24 aa, Mycobacterium tuberculosis
VVNAAVLYVFRTLVADDIPLNDGC

SEQ ID NO: 1519874 - protein, 21 aa, Mycobacterium tuberculosis
VVNEPFQTLTGRPLIGNGANG

SEQ ID NO: 1519875 - protein, 19 aa, Mycobacterium tuberculosis
VVPDALTVLVRLLASLHDD

SEQ ID NO: 1519876 - protein, 27 aa, Mycobacterium tuberculosis
VVQSATLELLFDLVRALLVVVEDLLLA

SEQ ID NO: 1519877 - protein, 17 aa, Mycobacterium tuberculosis
VVRVSALKALEGDAKWV

SEQ ID NO: 1519878 - protein, 18 aa, Mycobacterium tuberculosis
VVVEWGEGLAERLSQRHL

SEQ ID NO: 1519879 - protein, 18 aa, Mycobacterium tuberculosis
VVVIYLAAANRDPAVFPD

SEQ ID NO: 1519880 - protein, 17 aa, Mycobacterium tuberculosis
VVVLKRLPDALADGDRI

SEQ ID NO: 1519881 - protein, 17 aa, Mycobacterium tuberculosis
VVWKPSELTPLTALASQ

SEQ ID NO: 1519882 - protein, 17 aa, Mycobacterium tuberculosis
VWQPQPAAELPMTQRYF

SEQ ID NO: 1519883 - protein, 19 aa, Mycobacterium tuberculosis
VYFTTPHFDGYPAVLVRLA

SEQ ID NO: 1519884 - protein, 19 aa, Mycobacterium tuberculosis
VYRLTVEGVLPMPQSTHYP

SEQ ID NO: 1519885 - protein, 19 aa, Mycobacterium tuberculosis
WAILHALPELVATGIPVLV

SEQ ID NO: 1519886 - protein, 17 aa, Mycobacterium tuberculosis
WAYWVAESLLGPGTQLA

SEQ ID NO: 1519887 - protein, 18 aa, Mycobacterium tuberculosis
WDDVVSRVFGRIDPIALS

SEQ ID NO: 1519888 - protein, 17 aa, Mycobacterium tuberculosis
WEEMLTGMAPLAGLGGE

SEQ ID NO: 1519889 - protein, 20 aa, Mycobacterium tuberculosis
WEGFTAIFTAPKKSMFLVCR

SEQ ID NO: 1519890 - protein, 30 aa, Mycobacterium tuberculosis
WEQDPDVLDTWFSSALWPFSTLGWPDKTAE

SEQ ID NO: 1519891 - protein, 28 aa, Mycobacterium tuberculosis
WEWTTSPLRPWPGFVPMVYERYSQPFFG

SEQ ID NO: 1519892 - protein, 19 aa, Mycobacterium tuberculosis
WGDCLAPPRPVLRAALSPG

SEQ ID NO: 1519893 - protein, 17 aa, Mycobacterium tuberculosis
WGGFPLRDRVAAAVPGV

SEQ ID NO: 1519894 - protein, 29 aa, Mycobacterium tuberculosis
WKIRNLVKKYSDFIAWPIRMDVERRTPAS

SEQ ID NO: 1519895 - protein, 17 aa, Mycobacterium tuberculosis
WKSRWYADKQYAEYVKE

SEQ ID NO: 1519896 - protein, 21 aa, Mycobacterium tuberculosis
WLADHAVGPVVLFPGTGFVEL

SEQ ID NO: 1519897 - protein, 17 aa, Mycobacterium tuberculosis
WLKVVPDQLGRSLEFYR

SEQ ID NO: 1519898 - protein, 18 aa, Mycobacterium tuberculosis
WMPAVITAADRRLRQLRA

SEQ ID NO: 1519899 - protein, 17 aa, Mycobacterium tuberculosis
WMRDFHADGLRLDAVHA

SEQ ID NO: 1519900 - protein, 19 aa, Mycobacterium tuberculosis
WPYGLPELPGARDQLRGTR

SEQ ID NO: 1519901 - protein, 23 aa, Mycobacterium tuberculosis
WRDNEWYVARLCPTPLRPQERRT

SEQ ID NO: 1519902 - protein, 25 aa, Mycobacterium tuberculosis
WSNFNADRWELFHIAADRSQCHDLA

SEQ ID NO: 1519903 - protein, 23 aa, Mycobacterium tuberculosis
WTTSPLRPWPGFVPMVYERYSQP

SEQ ID NO: 1519904 - protein, 17 aa, Mycobacterium tuberculosis
WWNQAPSALLGAGSGVG

SEQ ID NO: 1519905 - protein, 26 aa, Mycobacterium tuberculosis
YAINRSLLLDGLRRIGIDRLAPTDGA

SEQ ID NO: 1519906 - protein, 26 aa, Mycobacterium tuberculosis
YAYEYFIRHNPLSDYAFPVRGLVRGR

SEQ ID NO: 1519907 - protein, 23 aa, Mycobacterium tuberculosis
YDAGTGIALIIRPPTRRAMAPRV

SEQ ID NO: 1519908 - protein, 20 aa, Mycobacterium tuberculosis
YDAVWRWIDWPERRGRTGTG

SEQ ID NO: 1519909 - protein, 18 aa, Mycobacterium tuberculosis
YDFFGIIFDGHPALTRIE

SEQ ID NO: 1519910 - protein, 22 aa, Mycobacterium tuberculosis
YEAWSFPDFATGVAALRTITQT

SEQ ID NO: 1519911 - protein, 22 aa, Mycobacterium tuberculosis
YETAYGLTVPPPVIAENRTELM

SEQ ID NO: 1519912 - protein, 24 aa, Mycobacterium tuberculosis
YFAGYAMWNYLTTPYLLTREGVAV

SEQ ID NO: 1519913 - protein, 17 aa, Mycobacterium tuberculosis
YGDERIFAALAKRLPKL

SEQ ID NO: 1519914 - protein, 19 aa, Mycobacterium tuberculosis
YGFPDGETRDLFLTLLSVS

SEQ ID NO: 1519915 - protein, 29 aa, Mycobacterium tuberculosis
YGKLAWEKTIPNWFFEPDIAADIVGNLLF

SEQ ID NO: 1519916 - protein, 21 aa, Mycobacterium tuberculosis
YGNSGFYNAAVNNTGIFVTGV

SEQ ID NO: 1519917 - protein, 34 aa, Mycobacterium tuberculosis; identical to SEQ ID NO: 1068482

SEQ ID NO: 1519918 - protein, 22 aa, Mycobacterium tuberculosis
YHGWGFHEDGAASGLRAARRLG

SEQ ID NO: 1519919 - protein, 19 aa, Mycobacterium tuberculosis
YHYAPYEKTALLRLVGRYG

SEQ ID NO: 1519920 - protein, 24 aa, Mycobacterium tuberculosis
YIDVKGLRLTLTQAAWRVAEDSLA

SEQ ID NO: 1519921 - protein, 19 aa, Mycobacterium tuberculosis
YLAELLLAKGYEVHGLIRR

SEQ ID NO: 1519922 - protein, 24 aa, Mycobacterium tuberculosis
YLAGAKILRQYGIGPLPGVAMMVV

SEQ ID NO: 1519923 - protein, 24 aa, Mycobacterium tuberculosis
YLDDDGYLFLTGRRHHMIISGGVN

SEQ ID NO: 1519924 - protein, 18 aa, Mycobacterium tuberculosis
YLHLAGALHPQHLMRVGR

SEQ ID NO: 1519925 - protein, 18 aa, Mycobacterium tuberculosis
YLRKRLPRLTRMQRFWIA

SEQ ID NO: 1519926 - protein, 29 aa, Mycobacterium tuberculosis
YNHYPIGWAMAFNTPYKLFKRYASHEGGI

SEQ ID NO: 1519927 - protein, 18 aa, Mycobacterium tuberculosis
YNLILSNVPGPQAQLYFL

SEQ ID NO: 1519928 - protein, 18 aa, Mycobacterium tuberculosis
YPALFGFLRIATSARVLA

SEQ ID NO: 1519929 - protein, 20 aa, Mycobacterium tuberculosis
YPEAVLARELELCYAAIALV

SEQ ID NO: 1519930 - protein, 24 aa, Mycobacterium tuberculosis
YPQKPPVGAALWKLMERARQVGLH

SEQ ID NO: 1519931 - protein, 18 aa, Mycobacterium tuberculosis
YQALQKYSTDLTARAREG

SEQ ID NO: 1519932 - protein, 21 aa, Mycobacterium tuberculosis
YQDKLLHVAGIGWHSWDGRRW

SEQ ID NO: 1519933 - protein, 17 aa, Mycobacterium tuberculosis
YQQRFVLALSQAGSTYA

SEQ ID NO: 1519934 - protein, 18 aa, Mycobacterium tuberculosis
YQQRFVLALSQAGSTYAV

SEQ ID NO: 1519935 - protein, 21 aa, Mycobacterium tuberculosis
YRGAEYSVDFVPKVRIEVVVD

SEQ ID NO: 1519936 - protein, 21 aa, Mycobacterium tuberculosis
YRGAYLEQLLGGLLADLGVHT

SEQ ID NO: 1519937 - protein, 19 aa, Mycobacterium tuberculosis
YRPQTSLPQPLPISSHAIS

SEQ ID NO: 1519938 - protein, 20 aa, Mycobacterium tuberculosis
YSLDVPRITILDAHFTGAFG

SEQ ID NO: 1519939 - protein, 18 aa, Mycobacterium tuberculosis
YSPIIGEKPLRGMADTCL

SEQ ID NO: 1519940 - protein, 21 aa, Mycobacterium tuberculosis
YTEYQPLWEPKIPLGRLGRPE

SEQ ID NO: 1519941 - protein, 23 aa, Mycobacterium tuberculosis
YTYHSKTLGWCDIAYNALVDKYG

SEQ ID NO: 1519942 - protein, 20 aa, Mycobacterium tuberculosis
YVDASYWRDMGTPEDFVRGS

SEQ ID NO: 1519943 - protein, 21 aa, Mycobacterium tuberculosis
YVFATPYIEAGDWRETLRNHA

SEQ ID NO: 1519944 - protein, 18 aa, Mycobacterium tuberculosis
YVLYLRRKIDTGEKRLLH

SEQ ID NO: 1519945 - protein, 17 aa, Mycobacterium tuberculosis
YVRSFYFQDPDGITLEF

SEQ ID NO: 1519946 - protein, 29 aa, Mycobacterium tuberculosis
YVSTPGRALLFPSLCHFSGGIPAPAADPP

SEQ ID NO: 1519947 - protein, 17 aa, Mycobacterium tuberculosis
YWLLCDPRHTYKTGWQP

SEQ ID NO: 1519948 - protein, 18 aa, Mycobacterium tuberculosis
YYSVIYQAIDEIEQALRG

SEQ ID NO: 1519949 - protein, 25 aa, Mycobacterium tuberculosis
AAAAALAPWQQAVPGLSGLLDSAQS

SEQ ID NO: 1519950 - protein, 27 aa, Mycobacterium tuberculosis
AAAAALAPWQQAVPGLSGLLGGAANAP

SEQ ID NO: 1519951 - protein, 23 aa, Mycobacterium tuberculosis
AAAAALPAFSPPAQALGVVSRVP

SEQ ID NO: 1519952 - protein, 21 aa, Mycobacterium tuberculosis
AAAAAPYAAWLAAAAVQAEQT

SEQ ID NO: 1519953 - protein, 21 aa, Mycobacterium tuberculosis
AAAAAPYAGWLGSVAAAAEAV

SEQ ID NO: 1519954 - protein, 21 aa, Mycobacterium tuberculosis
AAAAAPYAGWLSAAAARAAGA

SEQ ID NO: 1519955 - protein, 19 aa, Mycobacterium tuberculosis
AAAAAWDGLAAELGLAAES

SEQ ID NO: 1519956 - protein, 19 aa, Mycobacterium tuberculosis
AAAAAWDGLADELAVAASW

SEQ ID NO: 1519957 - protein, 23 aa, Mycobacterium tuberculosis
AAAAAWDGLADELAVAASWFGSV

SEQ ID NO: 1519958 - protein, 21 aa, Mycobacterium tuberculosis
AAAAGELASIRSAINAANAAA

SEQ ID NO: 1519959 - protein, 22 aa, Mycobacterium tuberculosis
AAAAGELASIRSAINAANAAAA

SEQ ID NO: 1519960 - protein, 19 aa, Mycobacterium tuberculosis
AAAAGRPWWEWAATHERAF

SEQ ID NO: 1519961 - protein, 22 aa, Mycobacterium tuberculosis
AAAAKEYVGVARALALTKSDAM

SEQ ID NO: 1519962 - protein, 22 aa, Mycobacterium tuberculosis
AAAAKEYVGVARALGLTKSDAM

SEQ ID NO: 1519963 - protein, 24 aa, Mycobacterium tuberculosis
AAAALARAPVRPRRQRLQRRRAGP

SEQ ID NO: 1519964 - protein, 27 aa, Mycobacterium tuberculosis
AAAALPSWQQALRGLPGLGQVASAISG

SEQ ID NO: 1519965 - protein, 27 aa, Mycobacterium tuberculosis
AAAAMVVAAAPYAGWLAAAAARAGGAA

SEQ ID NO: 1519966 - protein, 20 aa, Mycobacterium tuberculosis
AAAANLAGIRSALSEAAAAA

SEQ ID NO: 1519967 - protein, 28 aa, Mycobacterium tuberculosis
AAAANPPMIRYPIPPMIHGATQSATWMA

SEQ ID NO: 1519968 - protein, 19 aa, Mycobacterium tuberculosis
AAAAPYAGWLGSVAAQAVA

SEQ ID NO: 1519969 - protein, 25 aa, Mycobacterium tuberculosis
AAAASLAAIAIAFLAGCSSTKPVSQ

SEQ ID NO: 1519970 - protein, 17 aa, Mycobacterium tuberculosis
AAAAWDGLAAELGTAAS

SEQ ID NO: 1519971 - protein, 34 aa, Mycobacterium tuberculosis
AAAEAAAVSPLLDPINEFFLANTGRPLIGNGANG

SEQ ID NO: 1519972 - protein, 36 aa, Mycobacterium tuberculosis
AAAEAAAVSPLLDPINEFFLANTGRPLIGNGTNGAP

SEQ ID NO: 1519973 - protein, 29 aa, Mycobacterium tuberculosis
AAAEAMYEQMWPADVAAMVGYHGGASAAA

SEQ ID NO: 1519974 - protein, 30 aa, Mycobacterium tuberculosis
AAAELTIDALINRVVPIPGLRSTEAQWART

SEQ ID NO: 1519975 - protein, 27 aa, Mycobacterium tuberculosis
AAAFHDQFVHTLTAAARWYTATEIANA

SEQ ID NO: 1519976 - protein, 26 aa, Mycobacterium tuberculosis
AAAGFSVLLLPDPAPTPVVAFAVRHT

SEQ ID NO: 1519977 - protein, 28 aa, Mycobacterium tuberculosis
AAAGGAGGNALLFGNGGNGGSGASGGAA

SEQ ID NO: 1519978 - protein, 20 aa, Mycobacterium tuberculosis
AAAGPTMGILAAGADEVSVA

SEQ ID NO: 1519979 - protein, 28 aa, Mycobacterium tuberculosis
AAAHHKPQLAFLPRQAFLDTNIIGTQTV

SEQ ID NO: 1519980 - protein, 23 aa, Mycobacterium tuberculosis
AAAIGLVDLLLASGGDLVTVLIG

SEQ ID NO: 1519981 - protein, 18 aa, Mycobacterium tuberculosis
AAAILLTEWQLRNTPHVP

SEQ ID NO: 1519982 - protein, 23 aa, Mycobacterium tuberculosis
AAALADPLVLDAVLFEGGAFAEF

SEQ ID NO: 1519983 - protein, 25 aa, Mycobacterium tuberculosis
AAALPSWQQALRGLPGLGQVASAIS

SEQ ID NO: 1519984 - protein, 18 aa, Mycobacterium tuberculosis
AAALRDREMPAVRAALEA

SEQ ID NO: 1519985 - protein, 17 aa, Mycobacterium tuberculosis
AAALRRELLRDGQAFYV

SEQ ID NO: 1519986 - protein, 26 aa, Mycobacterium tuberculosis
AAAMVVAAAPYAGWLAAAAARAGGAA

SEQ ID NO: 1519987 - protein, 19 aa, Mycobacterium tuberculosis
AAANLAGIRSALSEAAAAA

SEQ ID NO: 1519988 - protein, 19 aa, Mycobacterium tuberculosis
AAAPYAAWLAAAAVQAEQT

SEQ ID NO: 1519989 - protein, 17 aa, Mycobacterium tuberculosis
AAAPYAGFLTTASAQAQ

SEQ ID NO: 1519990 - protein, 18 aa, Mycobacterium tuberculosis
AAAPYVGWLSAAAGQAEL

SEQ ID NO: 1519991 - protein, 26 aa, Mycobacterium tuberculosis
AAAQIRDMLPDWPALAHGPLTLKGFD

SEQ ID NO: 1519992 - protein, 26 aa, Mycobacterium tuberculosis
AAAQLASWQPALPNINLGVGNIGNLN

SEQ ID NO: 1519993 - protein, 28 aa, Mycobacterium tuberculosis
AAAQLRDILPDWPALAHGPLTLKGFDAP

SEQ ID NO: 1519994 - protein, 19 aa, Mycobacterium tuberculosis
AAARKFGCGFAPSGWDSLT

SEQ ID NO: 1519995 - protein, 27 aa, Mycobacterium tuberculosis
AAARLTPFSPLAPIANPGALARLYELI

SEQ ID NO: 1519996 - protein, 18 aa, Mycobacterium tuberculosis
AAARWYTATEIANAAAMR

SEQ ID NO: 1519997 - protein, 18 aa, Mycobacterium tuberculosis
AAARWYTGTRDRQTPRRC

SEQ ID NO: 1519998 - protein, 21 aa, Mycobacterium tuberculosis
AAASQLPPFTPPPATTSGAGS

SEQ ID NO: 1519999 - protein, 22 aa, Mycobacterium tuberculosis
AAASQLPPFTPPPATTSGAGSL

SEQ ID NO: 1520000 - protein, 20 aa, Mycobacterium tuberculosis
AAATVLPYRQFHDVAENFRY

SEQ ID NO: 1520001 - protein, 25 aa, Mycobacterium tuberculosis
AAATWLRGVSIVHLPTTLLGMVDAA

SEQ ID NO: 1520002 - protein, 26 aa, Mycobacterium tuberculosis
AAAVRAYLGLLDVLGRRGDIACDGVR

SEQ ID NO: 1520003 - protein, 27 aa, Mycobacterium tuberculosis
AAAVRREIGVPTVFNLLGPLTNPARPR

SEQ ID NO: 1520004 - protein, 23 aa, Mycobacterium tuberculosis
AAAVYDLFVKTLGVSAGTYAATE

SEQ ID NO: 1520005 - protein, 24 aa, Mycobacterium tuberculosis
AACAWFHQPELPAPKLPKPDTPPA

SEQ ID NO: 1520006 - protein, 21 aa, Mycobacterium tuberculosis
AADALFLWAETPTRPLHVGAL

SEQ ID NO: 1520007 - protein, 18 aa, Mycobacterium tuberculosis
AADARLAHAVRHRPDPTP

SEQ ID NO: 1520008 - protein, 29 aa, Mycobacterium tuberculosis
AADEVSTAVAALFSQHAQGYQAAAAQVAA

SEQ ID NO: 1520009 - protein, 23 aa, Mycobacterium tuberculosis
AADIPLAVDHFRYFAAAIRAQEG

SEQ ID NO: 1520010 - protein, 17 aa, Mycobacterium tuberculosis
AADLGPRRALTGEPLAP

SEQ ID NO: 1520011 - protein, 26 aa, Mycobacterium tuberculosis
AADPVFLDWLVGLAFPCQRPFGHQYG

SEQ ID NO: 1520012 - protein, 27 aa, Mycobacterium tuberculosis
AADPVFLDWLVGLAFPCQRPFGHQYGV

SEQ ID NO: 1520013 - protein, 29 aa, Mycobacterium tuberculosis
AADPVFMLTGPIPATRYALDKTGLAIDDI

SEQ ID NO: 1520014 - protein, 27 aa, Mycobacterium tuberculosis
AADSAELPLFRYVGGPNAHILPVPMMN

SEQ ID NO: 1520015 - protein, 25 aa, Mycobacterium tuberculosis
AADTPPIYFGFGSMPIGSLADRVAM

SEQ ID NO: 1520016 - protein, 19 aa, Mycobacterium tuberculosis
AADVELLRQAWLTATRARN

SEQ ID NO: 1520017 - protein, 33 aa, Mycobacterium tuberculosis
AAEAAATSPLLAPINEFFLANTGRPLIGNGTNG

SEQ ID NO: 1520018 - protein, 23 aa, Mycobacterium tuberculosis
AAEAGFAVHPKVAAVAGASLAAA

SEQ ID NO: 1520019 - protein, 40 aa, Mycobacterium tuberculosis
AAEAVNVEQSLLAAVNAPTQALFGRPLIGNGADGSPGTGQ

SEQ ID NO: 1520020 - protein, 19 aa, Mycobacterium tuberculosis
AAEFDYELMWAQDVAAMLG

SEQ ID NO: 1520021 - protein, 18 aa, Mycobacterium tuberculosis
AAEIAINSPLLEASMEGA

SEQ ID NO: 1520022 - protein, 25 aa, Mycobacterium tuberculosis
AAEIARLAPLAILARQAVLTTTRYR

SEQ ID NO: 1520023 - protein, 21 aa, Mycobacterium tuberculosis
AAELLRRLPFELTAGQREVLD

SEQ ID NO: 1520024 - protein, 20 aa, Mycobacterium tuberculosis
AAELQLAFQQLLVGDYNAAV

SEQ ID NO: 1520025 - protein, 29 aa, Mycobacterium tuberculosis
AAELTIDALINRVVPIPGLRSTEAQWART

SEQ ID NO: 1520026 - protein, 26 aa, Mycobacterium tuberculosis
AAEMARGQYWIHPALPEVVENALLGL

SEQ ID NO: 1520027 - protein, 18 aa, Mycobacterium tuberculosis
AAEPFHRSPLLIGRPYNW

SEQ ID NO: 1520028 - protein, 27 aa, Mycobacterium tuberculosis
AAESLWALLARVLPEPWRVEALVLLAF

SEQ ID NO: 1520029 - protein, 30 aa, Mycobacterium tuberculosis
AAEYGRLRHGQILFTFLHLAASRACTDALL

SEQ ID NO: 1520030 - protein, 19 aa, Mycobacterium tuberculosis
AAFAIMQIKAIFSVLLREY

SEQ ID NO: 1520031 - protein, 24 aa, Mycobacterium tuberculosis
AAFEAFARLYPATMLLVDTYDTLR

SEQ ID NO: 1520032 - protein, 17 aa, Mycobacterium tuberculosis
AAFGPNPLDPLCRVNSA

SEQ ID NO: 1520033 - protein, 24 aa, Mycobacterium tuberculosis
AAFHAQVVRTLTVDAGAYVSAEAA

SEQ ID NO: 1520034 - protein, 26 aa, Mycobacterium tuberculosis
AAFHDQFVHTLTAAARWYTGTRDRQT

SEQ ID NO: 1520035 - protein, 19 aa, Mycobacterium tuberculosis
AAFHDQFVRALAAGAGAYA

SEQ ID NO: 1520036 - protein, 24 aa, Mycobacterium tuberculosis
AAFHERFIQALSTAAGAYGSAEAA

SEQ ID NO: 1520037 - protein, 22 aa, Mycobacterium tuberculosis
AAFHGRFVQALTTGGGAYAAAE

SEQ ID NO: 1520038 - protein, 20 aa, Mycobacterium tuberculosis
AAFHQQFVQTLAGGAGAYAA

SEQ ID NO: 1520039 - protein, 24 aa, Mycobacterium tuberculosis
AAFHQQFVRALSSAAGSYAAAEAA

SEQ ID NO: 1520040 - protein, 22 aa, Mycobacterium tuberculosis
AAFHSRFVQALTTAAASYASVE

SEQ ID NO: 1520041 - protein, 29 aa, Mycobacterium tuberculosis
AAGAGYADMTAIFLGSSGTPGEDGGNGGA

SEQ ID NO: 1520042 - protein, 20 aa, Mycobacterium tuberculosis
AAGCAAWSLLSRRRSHHLRG

SEQ ID NO: 1520043 - protein, 20 aa, Mycobacterium tuberculosis
AAGDLRRSLVRPDRVRLGAH

SEQ ID NO: 1520044 - protein, 25 aa, Mycobacterium tuberculosis
AAGDWFRRLPALPGRRWRPRNRVRL

SEQ ID NO: 1520045 - protein, 19 aa, Mycobacterium tuberculosis
AAGEPLLQPLRTLFEPIML

SEQ ID NO: 1520046 - protein, 21 aa, Mycobacterium tuberculosis
AAGFGYPYAIAPPGIGFGSGM

SEQ ID NO: 1520047 - protein, 21 aa, Mycobacterium tuberculosis
AAGFHAQFVQALNAGVNSYAS

SEQ ID NO: 1520048 - protein, 23 aa, Mycobacterium tuberculosis
AAGGAGGWLFGNGGNGGHGATNT

SEQ ID NO: 1520049 - protein, 23 aa, Mycobacterium tuberculosis
AAGHAGTIFGNGGNAGAGSGLAG

SEQ ID NO: 1520050 - protein, 18 aa, Mycobacterium tuberculosis
AAGKTVFVFPGQGSQWLG

SEQ ID NO: 1520051 - protein, 22 aa, Mycobacterium tuberculosis
AAGKTVFVFPGQGSQWLGMGIE

SEQ ID NO: 1520052 - protein, 26 aa, Mycobacterium tuberculosis
AAGLDARAYRLPWPAGTVVYEIDQPQ

SEQ ID NO: 1520053 - protein, 26 aa, Mycobacterium tuberculosis
AAGLDCRAYRLGWQPGTTVFEIDVPK

SEQ ID NO: 1520054 - protein, 18 aa, Mycobacterium tuberculosis
AAGLFANGGAGGAGGTGS

SEQ ID NO: 1520055 - protein, 17 aa, Mycobacterium tuberculosis
AAGLFGTGGAGGAGGAG

SEQ ID NO: 1520056 - protein, 30 aa, Mycobacterium tuberculosis
AAGLGLALGGRALRWPRFPLVIEAAVAAVD

SEQ ID NO: 1520057 - protein, 18 aa, Mycobacterium tuberculosis
AAGLIGNGGAGGAGGPGA

SEQ ID NO: 1520058 - protein, 25 aa, Mycobacterium tuberculosis
AAGLLARWQRWLMGLASAASRRKIT

SEQ ID NO: 1520059 - protein, 18 aa, Mycobacterium tuberculosis
AAGLLGVGGHGGAGGHGA

SEQ ID NO: 1520060 - protein, 19 aa, Mycobacterium tuberculosis
AAGLLGVGGHGGAGGHGAE

SEQ ID NO: 1520061 - protein, 17 aa, Mycobacterium tuberculosis
AAGLLTALSARLRAVDP

SEQ ID NO: 1520062 - protein, 19 aa, Mycobacterium tuberculosis
AAGLLTALSARLRAVDPGR

SEQ ID NO: 1520063 - protein, 27 aa, Mycobacterium tuberculosis
AAGLRAGIPTLILWVTSDQPIWAAQIK

SEQ ID NO: 1520064 - protein, 19 aa, Mycobacterium tuberculosis
AAGMLFGAAGIGGLGGFVV

SEQ ID NO: 1520065 - protein, 19 aa, Mycobacterium tuberculosis
AAGQLRPRVRQDPKIQMRG

SEQ ID NO: 1520066 - protein, 17 aa, Mycobacterium tuberculosis
AAGREHPLIARSSLGSA

SEQ ID NO: 1520067 - protein, 24 aa, Mycobacterium tuberculosis
AAGRPVLMASRRRRWPPTRGCRRR

SEQ ID NO: 1520068 - protein, 18 aa, Mycobacterium tuberculosis
AAGSLIGLGGGALGGNGG

SEQ ID NO: 1520069 - protein, 23 aa, Mycobacterium tuberculosis
AAGTPPIYFGFGSTPVQTPVQTL

SEQ ID NO: 1520070 - protein, 23 aa, Mycobacterium tuberculosis
AAGVHFGFGRWLVNGSRKGLVAL

SEQ ID NO: 1520071 - protein, 35 aa, Mycobacterium tuberculosis
AAGVIILTCGMFGNIIRLLPPLTIGDELLSEGLDI

SEQ ID NO: 1520072 - protein, 24 aa, Mycobacterium tuberculosis
AAGVTVWPVFTRVGGVGTHATKRA

SEQ ID NO: 1520073 - protein, 19 aa, Mycobacterium tuberculosis
AAGWLVERAGFGKGYPDAG

SEQ ID NO: 1520074 - protein, 28 aa, Mycobacterium tuberculosis
AAGYIDVVILAYAAKFASAFYGPFREAV

SEQ ID NO: 1520075 - protein, 27 aa, Mycobacterium tuberculosis
AAHAAIGLLRWWPAATADIGGLSAVLG

SEQ ID NO: 1520076 - protein, 27 aa, Mycobacterium tuberculosis
AAHCPAYFQLLVKALVLPGLQELEHTA

SEQ ID NO: 1520077 - protein, 24 aa, Mycobacterium tuberculosis
AAHFAAHAAMYQSVSARAAAIHDQ

SEQ ID NO: 1520078 - protein, 19 aa, Mycobacterium tuberculosis
AAHLPRAVRWHHYSLDNGD

SEQ ID NO: 1520079 - protein, 17 aa, Mycobacterium tuberculosis
AAHLPRAVRWHRYSLDN

SEQ ID NO: 1520080 - protein, 27 aa, Mycobacterium tuberculosis
AAIARQRRRLLAPLRLDPQNLGAGPQR

SEQ ID NO: 1520081 - protein, 26 aa, Mycobacterium tuberculosis
AAIEAPLVITPWRSVLICDLDDATAD

SEQ ID NO: 1520082 - protein, 26 aa, Mycobacterium tuberculosis
AAIGPLPPVTLLPRRTPGSRGIADVP

SEQ ID NO: 1520083 - protein, 27 aa, Mycobacterium tuberculosis
AAIGPLPPVTLLPRRTPGSSGIADVPA

SEQ ID NO: 1520084 - protein, 19 aa, Mycobacterium tuberculosis
AAIHLSRVPGADLLEVCQR

SEQ ID NO: 1520085 - protein, 21 aa, Mycobacterium tuberculosis
AAILRRIRLTPAGPDTADTAA

SEQ ID NO: 1520086 - protein, 17 aa, Mycobacterium tuberculosis
AAIMSVALLLSHLGEHD

SEQ ID NO: 1520087 - protein, 18 aa, Mycobacterium tuberculosis
AAISWFELAWLAEQERIQ

SEQ ID NO: 1520088 - protein, 19 aa, Mycobacterium tuberculosis
AAKAAILASIAFHTRVTAD

SEQ ID NO: 1520089 - protein, 21 aa, Mycobacterium tuberculosis
AAKAAIVPPAAVAANREAFLA

SEQ ID NO: 1520090 - protein, 23 aa, Mycobacterium tuberculosis
AAKAGITALTLSAARALGRYGVC

SEQ ID NO: 1520091 - protein, 30 aa, Mycobacterium tuberculosis
AAKFGVEWLPAKGFITDRLPRLCRKYLLTP

SEQ ID NO: 1520092 - protein, 20 aa, Mycobacterium tuberculosis
AAKIAEMLRWCHEAGIDLAT

SEQ ID NO: 1520093 - protein, 21 aa, Mycobacterium tuberculosis
AAKLAGLVFPQPPAPIAVSGT

SEQ ID NO: 1520094 - protein, 23 aa, Mycobacterium tuberculosis
AAKLATALQSAAPWLAKSGGEFI

SEQ ID NO: 1520095 - protein, 21 aa, Mycobacterium tuberculosis
AAKLVGIELPKKAAPAKKAAP

SEQ ID NO: 1520096 - protein, 24 aa, Mycobacterium tuberculosis
AAKSLGWRAAPIPRNAPGCRGCCQ

SEQ ID NO: 1520097 - protein, 25 aa, Mycobacterium tuberculosis
AAKYPGTQWRFEYSPESYTGTELEY

SEQ ID NO: 1520098 - protein, 18 aa, Mycobacterium tuberculosis
AALAALFGAHAREYQAAA

SEQ ID NO: 1520099 - protein, 19 aa, Mycobacterium tuberculosis
AALAALFGAHAREYQAAAA

SEQ ID NO: 1520100 - protein, 19 aa, Mycobacterium tuberculosis
AALAFEQAYAMTLPPPVVA

SEQ ID NO: 1520101 - protein, 18 aa, Mycobacterium tuberculosis
AALAIDHPLAVATLLGPG

SEQ ID NO: 1520102 - protein, 34 aa, Mycobacterium tuberculosis
AALDRGVWLRPFRNLVYVMPPYICTPAEITQITS

SEQ ID NO: 1520103 - protein, 21 aa, Mycobacterium tuberculosis
AALDRVQVPVLLVGGWQDIFL

SEQ ID NO: 1520104 - protein, 17 aa, Mycobacterium tuberculosis
AALFGAHGRAYQAASAE

SEQ ID NO: 1520105 - protein, 18 aa, Mycobacterium tuberculosis
AALFSSGVGGAGCSGGTA

SEQ ID NO: 1520106 - protein, 17 aa, Mycobacterium tuberculosis
AALGAAIRYAAVDKDAV

SEQ ID NO: 1520107 - protein, 26 aa, Mycobacterium tuberculosis
AALGTPRRHLSYKTGWYGSQLVVADR

SEQ ID NO: 1520108 - protein, 18 aa, Mycobacterium tuberculosis
AALKVKFDGGTLPPMFVD

SEQ ID NO: 1520109 - protein, 25 aa, Mycobacterium tuberculosis
AALLTGLDPRYPLKGCFMPLSVDDA

SEQ ID NO: 1520110 - protein, 17 aa, Mycobacterium tuberculosis
AALRAAAQHWATWAMQK

SEQ ID NO: 1520111 - protein, 17 aa, Mycobacterium tuberculosis
AALRAVPAERLWVNPDC

SEQ ID NO: 1520112 - protein, 30 aa, Mycobacterium tuberculosis
AALRDLVARRTPLFEFAIRAAIAEMDLDSA

SEQ ID NO: 1520113 - protein, 18 aa, Mycobacterium tuberculosis
AALRPYVVGDCLVAFDAP

SEQ ID NO: 1520114 - protein, 35 aa, Mycobacterium tuberculosis; identical to SEQ ID NO: 161739

SEQ ID NO: 1520115 - protein, 17 aa, Mycobacterium tuberculosis
AALVAERLAPGAHRWWQ

SEQ ID NO: 1520116 - protein, 28 aa, Mycobacterium tuberculosis
AALVAISPLRHRLPRSPLGAALARTSPR

SEQ ID NO: 1520117 - protein, 21 aa, Mycobacterium tuberculosis
AALVHHYFGTKQQLFAAAIHI

SEQ ID NO: 1520118 - protein, 25 aa, Mycobacterium tuberculosis
AAMAAAAAPYAGWLAAAAARAAGAS

SEQ ID NO: 1520119 - protein, 26 aa, Mycobacterium tuberculosis
AAMAAAAAPYAGWLGSVAAAAEAVAG

SEQ ID NO: 1520120 - protein, 28 aa, Mycobacterium tuberculosis
AAMAAAAAPYAGWLSAAAARAAGAAAQA

SEQ ID NO: 1520121 - protein, 22 aa, Mycobacterium tuberculosis
AAMADLRSGAHRVALVVGLELE

SEQ ID NO: 1520122 - protein, 26 aa, Mycobacterium tuberculosis
AAMGLTIPVLLIRGKLSDVVSSDGAR

SEQ ID NO: 1520123 - protein, 24 aa, Mycobacterium tuberculosis
AAMLTLPPVGPSIGWRTSTRLPRD

SEQ ID NO: 1520124 - protein, 23 aa, Mycobacterium tuberculosis
AAMVVAAAPYAGWLAAAAARAGG

SEQ ID NO: 1520125 - protein, 27 aa, Mycobacterium tuberculosis
AANGGNGLNLVGVPGTAGGGADGANGS

SEQ ID NO: 1520126 - protein, 37 aa, Mycobacterium tuberculosis
AANVQQSLLNAINAPTQALLGRPLIGDGADGTAPGQN

SEQ ID NO: 1520127 - protein, 32 aa, Mycobacterium tuberculosis
AAPAAVVGAALPPAGKALPAPAGTAGPAGTAA

SEQ ID NO: 1520128 - protein, 20 aa, Mycobacterium tuberculosis
AAPALNAELLRRAKHSGLSD

SEQ ID NO: 1520129 - protein, 17 aa, Mycobacterium tuberculosis
AAPEVLAGPAAMADPEV

SEQ ID NO: 1520130 - protein, 26 aa, Mycobacterium tuberculosis
AAPGGHRACWLFGNELGFLLQKKKAA

SEQ ID NO: 1520131 - protein, 21 aa, Mycobacterium tuberculosis
AAPLFHNIAGWLMQRENGPLS

SEQ ID NO: 1520132 - protein, 20 aa, Mycobacterium tuberculosis
AAPLGILPMPRAMPATAAFP

SEQ ID NO: 1520133 - protein, 17 aa, Mycobacterium tuberculosis
AAPLLEAVGVEPATVRA

SEQ ID NO: 1520134 - protein, 17 aa, Mycobacterium tuberculosis
AAPLLLPATGSVAVQVV

SEQ ID NO: 1520135 - protein, 23 aa, Mycobacterium tuberculosis
AAPLVTLYKQYVVRFGLGYREEV

SEQ ID NO: 1520136 - protein, 19 aa, Mycobacterium tuberculosis
AAPPLPPDPPMPPAIWSAL

SEQ ID NO: 1520137 - protein, 18 aa, Mycobacterium tuberculosis
AAPPPLPLVSRDGGYLIV

SEQ ID NO: 1520138 - protein, 24 aa, Mycobacterium tuberculosis
AAPRLRLPMLPRPTLPLPTLANPM

SEQ ID NO: 1520139 - protein, 25 aa, Mycobacterium tuberculosis
AAPTSNLLVWISTLGTTDGKSQADI

SEQ ID NO: 1520140 - protein, 21 aa, Mycobacterium tuberculosis
AAPVVRAAPVAAVATAGRPAG

SEQ ID NO: 1520141 - protein, 17 aa, Mycobacterium tuberculosis
AAPYLSWLNAATARAEG

SEQ ID NO: 1520142 - protein, 26 aa, Mycobacterium tuberculosis
AAQGLAELGINFGFGNIGSLNLGSGN

SEQ ID NO: 1520143 - protein, 17 aa, Mycobacterium tuberculosis
AAQGWHFAKALPVDFFR

SEQ ID NO: 1520144 - protein, 26 aa, Mycobacterium tuberculosis
AAQLAGLKLLAFRGRFVEIGKRDIYG

SEQ ID NO: 1520145 - protein, 27 aa, Mycobacterium tuberculosis
AAQLAGLKLLAFRGRFVEIGKRDIYGD

SEQ ID NO: 1520146 - protein, 25 aa, Mycobacterium tuberculosis
AAQLAGLKLLALGGRFIEIGKRDIY

SEQ ID NO: 1520147 - protein, 23 aa, Mycobacterium tuberculosis
AAQLAGLKLLALGGRFIENRQTR

SEQ ID NO: 1520148 - protein, 17 aa, Mycobacterium tuberculosis
AAQLAVYLAPPGYGEMF

SEQ ID NO: 1520149 - protein, 25 aa, Mycobacterium tuberculosis
AAQLSSWSIGLQQALPAAPSALAAA

SEQ ID NO: 1520150 - protein, 35 aa, Mycobacterium tuberculosis
AAQRHAAIPLSFAQRRLWFLDQLQRPAPVYNMAVA

SEQ ID NO: 1520151 - protein, 24 aa, Mycobacterium tuberculosis
AAQRLPFLPIRAGLGSSVPQFWAG

SEQ ID NO: 1520152 - protein, 26 aa, Mycobacterium tuberculosis
AAQRRDMMWICRDGDRAKNHLLEANL

SEQ ID NO: 1520153 - protein, 27 aa, Mycobacterium tuberculosis
AAQRRDMMWICRDGDRAKNHLLEANLR

SEQ ID NO: 1520154 - protein, 21 aa, Mycobacterium tuberculosis
AAQYRIRLGGTWKKPGTSDIE

SEQ ID NO: 1520155 - protein, 27 aa, Mycobacterium tuberculosis
AAQYRQFVMATLFHKTRSWSNLLKVTE

SEQ ID NO: 1520156 - protein, 27 aa, Mycobacterium tuberculosis
AARAGVGGPVVSVPPGGGGGAGGDGGA

SEQ ID NO: 1520157 - protein, 22 aa, Mycobacterium tuberculosis
AARALIAVRGLHRFAAAEGLVE

SEQ ID NO: 1520158 - protein, 20 aa, Mycobacterium tuberculosis
AARARWANPAAWRLPGDDVF

SEQ ID NO: 1520159 - protein, 25 aa, Mycobacterium tuberculosis
AARHQLRKHLLSRQFHRCHGAGAGD

SEQ ID NO: 1520160 - protein, 18 aa, Mycobacterium tuberculosis
AARLIGHGGAGGLGGTGA

SEQ ID NO: 1520161 - protein, 17 aa, Mycobacterium tuberculosis
AARLQVPKARRTLPAVL

SEQ ID NO: 1520162 - protein, 17 aa, Mycobacterium tuberculosis
AARPAVAAVAAVTAAGG

SEQ ID NO: 1520163 - protein, 18 aa, Mycobacterium tuberculosis
AARPFTWQVGSDPAVADL

SEQ ID NO: 1520164 - protein, 27 aa, Mycobacterium tuberculosis
AARRNAIMMRFWPRCGACWPPVSWANT

SEQ ID NO: 1520165 - protein, 22 aa, Mycobacterium tuberculosis
AARRPAWTPGSRWAASGRRRCP

SEQ ID NO: 1520166 - protein, 23 aa, Mycobacterium tuberculosis
AARRRAFRVWLDARRNALVVLAP

SEQ ID NO: 1520167 - protein, 18 aa, Mycobacterium tuberculosis
AARRRYRRLAADQVLEAA

SEQ ID NO: 1520168 - protein, 20 aa, Mycobacterium tuberculosis
AARRTRRARRWYRGGHPLPG

SEQ ID NO: 1520169 - protein, 18 aa, Mycobacterium tuberculosis
AARSADLCRRELLSRRDQ

SEQ ID NO: 1520170 - protein, 19 aa, Mycobacterium tuberculosis
AARSADLCRRELLSRRDQL

SEQ ID NO: 1520171 - protein, 21 aa, Mycobacterium tuberculosis
AARSLLDRPTARAVLSRFGAA

SEQ ID NO: 1520172 - protein, 17 aa, Mycobacterium tuberculosis
AARSPGAAPAPGATVAA

SEQ ID NO: 1520173 - protein, 24 aa, Mycobacterium tuberculosis
AARTPPVCELPPLPAGDAARDEAD

SEQ ID NO: 1520174 - protein, 30 aa, Mycobacterium tuberculosis
AASAARVVTPSPRSLRPATAVPAATAANVG

SEQ ID NO: 1520175 - protein, 26 aa, Mycobacterium tuberculosis
AASAFQSVVWGLTVGSWIGSSAGLMA

SEQ ID NO: 1520176 - protein, 28 aa, Mycobacterium tuberculosis
AASALLKGLTAHYLLKSVYPVKRGDTVL

SEQ ID NO: 1520177 - protein, 24 aa, Mycobacterium tuberculosis
AASDAFFPFPDGLETLAAAGVTAV

SEQ ID NO: 1520178 - protein, 17 aa, Mycobacterium tuberculosis
AASDLLGLASGGLLPAA

SEQ ID NO: 1520179 - protein, 20 aa, Mycobacterium tuberculosis
AASDLLGLASGGLLPAAEEA

SEQ ID NO: 1520180 - protein, 22 aa, Mycobacterium tuberculosis
AASGAPPPRSIGRRVTAGDGRA

SEQ ID NO: 1520181 - protein, 20 aa, Mycobacterium tuberculosis
AASHHARVGRRARAARLLRF

SEQ ID NO: 1520182 - protein, 23 aa, Mycobacterium tuberculosis
AASIGAYLWVRRHSRVPRLGDGG

SEQ ID NO: 1520183 - protein, 18 aa, Mycobacterium tuberculosis
AASQLPPFTPPPATTSGA

SEQ ID NO: 1520184 - protein, 24 aa, Mycobacterium tuberculosis
AASQRGLLRLLEDLRRARGLTVVV

SEQ ID NO: 1520185 - protein, 18 aa, Mycobacterium tuberculosis
AASSSPRYIHCWTGPRPT

SEQ ID NO: 1520186 - protein, 27 aa, Mycobacterium tuberculosis
AASTPSIPVLAWALPQPIADRLNAEFS

SEQ ID NO: 1520187 - protein, 19 aa, Mycobacterium tuberculosis
AASTRFFVPTQNSPWPTAE

SEQ ID NO: 1520188 - protein, 23 aa, Mycobacterium tuberculosis
AATAGGGISFRRARAANGGLRGR

SEQ ID NO: 1520189 - protein, 18 aa, Mycobacterium tuberculosis
AATAVAPGSGGTGGDGGT

SEQ ID NO: 1520190 - protein, 23 aa, Mycobacterium tuberculosis
AATFHAEFVSLLNGGAAAYTGAE

SEQ ID NO: 1520191 - protein, 22 aa, Mycobacterium tuberculosis
AATGRWVPDFLSLPITVENSLK

SEQ ID NO: 1520192 - protein, 28 aa, Mycobacterium tuberculosis
AATPEALLGPWVRTLLHSIYDQPDAESV

SEQ ID NO: 1520193 - protein, 33 aa, Mycobacterium tuberculosis
AATPGGAVIIAGFPFLDLGNVTIGGFNLASGNL

SEQ ID NO: 1520194 - protein, 23 aa, Mycobacterium tuberculosis
AATPLLGCELHDGARPHHLGPVE

SEQ ID NO: 1520195 - protein, 20 aa, Mycobacterium tuberculosis
AATPSWSVTAATAATAARVA

SEQ ID NO: 1520196 - protein, 24 aa, Mycobacterium tuberculosis
AATRRPVVAVLNKADLAGPLSGAG

SEQ ID NO: 1520197 - protein, 25 aa, Mycobacterium tuberculosis
AATTGVAAWVPLPETGFRGRPGGGG

SEQ ID NO: 1520198 - protein, 24 aa, Mycobacterium tuberculosis
AATTRAWPASPWATPSRCSPRWAP

SEQ ID NO: 1520199 - protein, 18 aa, Mycobacterium tuberculosis
AATTTWPAHLRPALTTAG

SEQ ID NO: 1520200 - protein, 29 aa, Mycobacterium tuberculosis
AATVASAGLGAPAAPAPRASSAPTRAMAV

SEQ ID NO: 1520201 - protein, 26 aa, Mycobacterium tuberculosis
AATVHPAIISANRALFVSLVVSNLLG

SEQ ID NO: 1520202 - protein, 32 aa, Mycobacterium tuberculosis
AATVHPAIISANRALFVSLVVSNLLGQNAPAI

SEQ ID NO: 1520203 - protein, 22 aa, Mycobacterium tuberculosis
AATVHPMLVAANRNAFVQLVLS

SEQ ID NO: 1520204 - protein, 23 aa, Mycobacterium tuberculosis
AATVHPMLVAANRNAFVQLVLSN

SEQ ID NO: 1520205 - protein, 37 aa, Mycobacterium tuberculosis; identical to SEQ ID NO: 237492

SEQ ID NO: 1520206 - protein, 23 aa, Mycobacterium tuberculosis
AATVPLGRLARPADIGWAAAFLA

SEQ ID NO: 1520207 - protein, 20 aa, Mycobacterium tuberculosis
AATVPPPVVAANRAELAVLA

SEQ ID NO: 1520208 - protein, 21 aa, Mycobacterium tuberculosis
AATVPPPVVAANRAELAVLAA

SEQ ID NO: 1520209 - protein, 27 aa, Mycobacterium tuberculosis
AAVAALAPPLAPAAPGAWAAPAAPAPS

SEQ ID NO: 1520210 - protein, 21 aa, Mycobacterium tuberculosis
AAVALMVLRAAVAALSSMATF

SEQ ID NO: 1520211 - protein, 24 aa, Mycobacterium tuberculosis
AAVAQLAPWQQVLRNLGIDIGKNG

SEQ ID NO: 1520212 - protein, 17 aa, Mycobacterium tuberculosis
AAVFLRELLAADLQPVV

SEQ ID NO: 1520213 - protein, 24 aa, Mycobacterium tuberculosis
AAVFTTPCVFYVQNNQWAISMPVS

SEQ ID NO: 1520214 - protein, 25 aa, Mycobacterium tuberculosis
AAVNAPAQALLGRPLIGNGANGAPG

SEQ ID NO: 1520215 - protein, 25 aa, Mycobacterium tuberculosis
AAVNAPTQALFGRPLIGNGADGSPG

SEQ ID NO: 1520216 - protein, 23 aa, Mycobacterium tuberculosis
AAVRAYLGLLDVLGRRGDIACDG

SEQ ID NO: 1520217 - protein, 18 aa, Mycobacterium tuberculosis
AAVRRWVPAAVLRLRAAP

SEQ ID NO: 1520218 - protein, 18 aa, Mycobacterium tuberculosis
AAVRRYRWWPVTRRIERR

SEQ ID NO: 1520219 - protein, 23 aa, Mycobacterium tuberculosis
AAVSFGFGPLLLAGSDPLLAVPF

SEQ ID NO: 1520220 - protein, 26 aa, Mycobacterium tuberculosis
AAVSRLFGAYGQQFQALNARAATFHA

SEQ ID NO: 1520221 - protein, 26 aa, Mycobacterium tuberculosis
AAVTEWFAVDWHREIVDKWRAAGVRM

SEQ ID NO: 1520222 - protein, 17 aa, Mycobacterium tuberculosis
AAVTPLLNSINAPVLAA

SEQ ID NO: 1520223 - protein, 21 aa, Mycobacterium tuberculosis
AAVVTPLLLADAYHARVDIPA

SEQ ID NO: 1520224 - protein, 17 aa, Mycobacterium tuberculosis
AAVWGLVRSAQAEHPGR

SEQ ID NO: 1520225 - protein, 21 aa, Mycobacterium tuberculosis
AAWVILAVIRYRGATTPGPVL

SEQ ID NO: 1520226 - protein, 24 aa, Mycobacterium tuberculosis
AAYEALRKMVVKAPLRAATVSVDR

SEQ ID NO: 1520227 - protein, 27 aa, Mycobacterium tuberculosis
AAYETAFAAIVPPPLIAANRARLTSLV

SEQ ID NO: 1520228 - protein, 23 aa, Mycobacterium tuberculosis
AAYLQPFLLDLSKLASPTPSSMR

SEQ ID NO: 1520229 - protein, 24 aa, Mycobacterium tuberculosis
AAYQERFVLALSQAGSTYAVAEAA

SEQ ID NO: 1520230 - protein, 22 aa, Mycobacterium tuberculosis
AAYQQRFVLALSQAGSTYAVAE

SEQ ID NO: 1520231 - protein, 22 aa, Mycobacterium tuberculosis
AAYQQRFVLALSQASSTYAVAE

SEQ ID NO: 1520232 - protein, 17 aa, Mycobacterium tuberculosis
ACAAAHTPLLGVCLGHQ

SEQ ID NO: 1520233 - protein, 29 aa, Mycobacterium tuberculosis
ACAVGRTWCVPWWWGPGALPKSSAGHSRV

SEQ ID NO: 1520234 - protein, 31 aa, Mycobacterium tuberculosis
ACEASARSTTAWILHMAKLSAAMAKQLHMSR

SEQ ID NO: 1520235 - protein, 17 aa, Mycobacterium tuberculosis
ACGAIELGIKWLSLYAF

SEQ ID NO: 1520236 - protein, 30 aa, Mycobacterium tuberculosis
ACGFDTPYPPARLEKLWLPGPDRLLDCVER

SEQ ID NO: 1520237 - protein, 23 aa, Mycobacterium tuberculosis
ACKRGWPGSPPPWPTTPNINGSS

SEQ ID NO: 1520238 - protein, 19 aa, Mycobacterium tuberculosis
ACQGFITQLGRNFQVIYEQ

SEQ ID NO: 1520239 - protein, 23 aa, Mycobacterium tuberculosis
ACRFPTVVSPGDLWDLLRDGREA

SEQ ID NO: 1520240 - protein, 19 aa, Mycobacterium tuberculosis
ACSRWGMLSPEGRCKTFDA

SEQ ID NO: 1520241 - protein, 26 aa, Mycobacterium tuberculosis
ACTLRGWLGMWSLRVAQTRAAPHLAQ

SEQ ID NO: 1520242 - protein, 22 aa, Mycobacterium tuberculosis
ACTRREPALTLQLPNRDPITGV

SEQ ID NO: 1520243 - protein, 30 aa, Mycobacterium tuberculosis
ADAALTPIAAGPRRALIISVNVHAGLSQLP

SEQ ID NO: 1520244 - protein, 25 aa, Mycobacterium tuberculosis
ADAIRQDIDWITSPRIPAAHARLCG

SEQ ID NO: 1520245 - protein, 22 aa, Mycobacterium tuberculosis
ADAKLIIASAYLPQHEDARAAD

SEQ ID NO: 1520246 - protein, 23 aa, Mycobacterium tuberculosis
ADDALALLIYTSGSTGAPKGAMY

SEQ ID NO: 1520247 - protein, 19 aa, Mycobacterium tuberculosis
ADDILPLEYAPPIGPELVS

SEQ ID NO: 1520248 - protein, 22 aa, Mycobacterium tuberculosis
ADDLAPEWLVAPTVVLTPEVTP

SEQ ID NO: 1520249 - protein, 23 aa, Mycobacterium tuberculosis
ADDLAPEWLVAPTVVLTPEVTPV

SEQ ID NO: 1520250 - protein, 19 aa, Mycobacterium tuberculosis
ADDYLRFVRMLLGDGTVDG

SEQ ID NO: 1520251 - protein, 17 aa, Mycobacterium tuberculosis
ADEFTGGFAQRLPRWLR

SEQ ID NO: 1520252 - protein, 21 aa, Mycobacterium tuberculosis
ADELFRRSLGNPLYLRHLIDG

SEQ ID NO: 1520253 - protein, 23 aa, Mycobacterium tuberculosis
ADEVRQYFGSKVLRTVIPRSVKV

SEQ ID NO: 1520254 - protein, 23 aa, Mycobacterium tuberculosis
ADEVSLAISALFGQHAQAYQALS

SEQ ID NO: 1520255 - protein, 19 aa, Mycobacterium tuberculosis
ADFSRYLSTLGLPAAGDAV

SEQ ID NO: 1520256 - protein, 30 aa, Mycobacterium tuberculosis
ADGELYVIAGNIPLINIPPTPGIGNTTTVP

SEQ ID NO: 1520257 - protein, 17 aa, Mycobacterium tuberculosis
ADGFYGHRVDEFATVAV

SEQ ID NO: 1520258 - protein, 33 aa, Mycobacterium tuberculosis
ADGKAKWSAPLGFLAQTPPALTPHGLIVSGGGP

SEQ ID NO: 1520259 - protein, 23 aa, Mycobacterium tuberculosis
ADGLPVGAYAVLRPPRSTLHRQE

SEQ ID NO: 1520260 - protein, 24 aa, Mycobacterium tuberculosis
ADGPWVKWYPGIPGYIDQQWVTQA

SEQ ID NO: 1520261 - protein, 24 aa, Mycobacterium tuberculosis
ADGRTLLLGSPSLLRAEKVRVSKK

SEQ ID NO: 1520262 - protein, 18 aa, Mycobacterium tuberculosis
ADGWLGDLLAGAAAASLQ

SEQ ID NO: 1520263 - protein, 20 aa, Mycobacterium tuberculosis
ADGWNTFNLTLQGDVKRFRG

SEQ ID NO: 1520264 - protein, 25 aa, Mycobacterium tuberculosis
ADGWNTFNLTLQGDVKRFRGFDNWE

SEQ ID NO: 1520265 - protein, 24 aa, Mycobacterium tuberculosis
ADIADQLARRRLGYGRGARMTFER

SEQ ID NO: 1520266 - protein, 20 aa, Mycobacterium tuberculosis
ADIALRRPSLDHVFLAMTTD

SEQ ID NO: 1520267 - protein, 25 aa, Mycobacterium tuberculosis
ADIEDPLYVLAGPDEGYVPYYAEYP

SEQ ID NO: 1520268 - protein, 26 aa, Mycobacterium tuberculosis
ADIEFPAPALIYGYGAYEICEDPRFS

SEQ ID NO: 1520269 - protein, 24 aa, Mycobacterium tuberculosis
ADIEVPAPPFWGSRIVKGLAVADY

SEQ ID NO: 1520270 - protein, 25 aa, Mycobacterium tuberculosis
ADIEVPAPPFWGSRIVKGLAVADYT

SEQ ID NO: 1520271 - protein, 19 aa, Mycobacterium tuberculosis
ADILVPTAFIRDLGVPSRR

SEQ ID NO: 1520272 - protein, 18 aa, Mycobacterium tuberculosis
ADIWRRRDLPRDAKAPVL

SEQ ID NO: 1520273 - protein, 22 aa, Mycobacterium tuberculosis
ADKCIREGRRPAWAGHLGGLSG

SEQ ID NO: 1520274 - protein, 18 aa, Mycobacterium tuberculosis
ADKGGAGGAGISFSNGSN

SEQ ID NO: 1520275 - protein, 26 aa, Mycobacterium tuberculosis
ADKLTEVIKNFKKGFAATGGGSVVPD

SEQ ID NO: 1520276 - protein, 18 aa, Mycobacterium tuberculosis
ADLALRPLISYYTDLRRD

SEQ ID NO: 1520277 - protein, 28 aa, Mycobacterium tuberculosis
ADLANLFPFQLFLVLYGLPLEDRDRLIG

SEQ ID NO: 1520278 - protein, 18 aa, Mycobacterium tuberculosis
ADLAWLRARDLDRALLLH

SEQ ID NO: 1520279 - protein, 19 aa, Mycobacterium tuberculosis
ADLAWLRARDLDRALLVHV

SEQ ID NO: 1520280 - protein, 18 aa, Mycobacterium tuberculosis
ADLAYFRVLIHSTRNRAL

SEQ ID NO: 1520281 - protein, 20 aa, Mycobacterium tuberculosis
ADLGLTYLFISHDLAVIRQI

SEQ ID NO: 1520282 - protein, 19 aa, Mycobacterium tuberculosis
ADLLGLPGFALLDQDLHPG

SEQ ID NO: 1520283 - protein, 21 aa, Mycobacterium tuberculosis
ADLLSGYYHAVHKLTLEYIAG

SEQ ID NO: 1520284 - protein, 22 aa, Mycobacterium tuberculosis
ADLLTRLHWPTPTAGAHRAPLT

SEQ ID NO: 1520285 - protein, 26 aa, Mycobacterium tuberculosis
ADLNRLRWCCWWDSSPKTSRRSCFCG

SEQ ID NO: 1520286 - protein, 17 aa, Mycobacterium tuberculosis
ADLPQRILAGAGVTEAD

SEQ ID NO: 1520287 - protein, 22 aa, Mycobacterium tuberculosis
ADLRTILAPDYVTRAREIASRM

SEQ ID NO: 1520288 - protein, 21 aa, Mycobacterium tuberculosis
ADNVMTFRYVIKEVALEEGAR

SEQ ID NO: 1520289 - protein, 21 aa, Mycobacterium tuberculosis
ADPRFTVAAIPPRNDPRDAVV

SEQ ID NO: 1520290 - protein, 27 aa, Mycobacterium tuberculosis
ADPTASRAVSWWSVHEHVAPVLDACRV

SEQ ID NO: 1520291 - protein, 21 aa, Mycobacterium tuberculosis
ADPTLAVDWPLVDGAAPSLSD

SEQ ID NO: 1520292 - protein, 23 aa, Mycobacterium tuberculosis
ADQHAVLPLRPESLRRLDRVDAI

SEQ ID NO: 1520293 - protein, 19 aa, Mycobacterium tuberculosis
ADQHWRPGVYRHGLNLARR

SEQ ID NO: 1520294 - protein, 22 aa, Mycobacterium tuberculosis
ADQPLDWFCSFSSAAARVGSPG

SEQ ID NO: 1520295 - protein, 48 aa, Mycobacterium tuberculosis
ADQPPAGPPGAPVPGWPLAPLPISGRPVAAWMGALNTSIRLCNGDAAA

SEQ ID NO: 1520296 - protein, 33 aa, Mycobacterium tuberculosis
ADQRIRQVAPFLSYGQFTGSAPRDLCALWPVPA

SEQ ID NO: 1520297 - protein, 24 aa, Mycobacterium tuberculosis
ADRCGWLALPRRTHVSVLTGTEAA

SEQ ID NO: 1520298 - protein, 27 aa, Mycobacterium tuberculosis
ADRPQLATTLLPALLEALVRNVSRGLV

SEQ ID NO: 1520299 - protein, 17 aa, Mycobacterium tuberculosis
ADRQTVGPWIPVRGAGS

SEQ ID NO: 1520300 - protein, 25 aa, Mycobacterium tuberculosis
ADRSLAGPALRCRHPRRPDGRTPAR

SEQ ID NO: 1520301 - protein, 18 aa, Mycobacterium tuberculosis
ADRSYRRSFRREFDRIKL

SEQ ID NO: 1520302 - protein, 18 aa, Mycobacterium tuberculosis
ADRTDVLALMLRSTYDDG

SEQ ID NO: 1520303 - protein, 25 aa, Mycobacterium tuberculosis
ADRTPWQEFTLQDGCHLRTFWEGGA

SEQ ID NO: 1520304 - protein, 21 aa, Mycobacterium tuberculosis
ADRVVLVLLDRAGSSAVVGAV

SEQ ID NO: 1520305 - protein, 24 aa, Mycobacterium tuberculosis
ADRYINDRFLPDKAIDLIDEAGAR

SEQ ID NO: 1520306 - protein, 27 aa, Mycobacterium tuberculosis
ADSGGRWHMSFVLAMPEVLGSAATDLA

SEQ ID NO: 1520307 - protein, 22 aa, Mycobacterium tuberculosis
ADSLAEYVLELARKLIKPEERS

SEQ ID NO: 1520308 - protein, 23 aa, Mycobacterium tuberculosis
ADSVRAYLKQIGKVALLNAEEEV

SEQ ID NO: 1520309 - protein, 18 aa, Mycobacterium tuberculosis
ADTLMRKLGNRAPGVLAG

SEQ ID NO: 1520310 - protein, 25 aa, Mycobacterium tuberculosis
ADVEQARDICRCSQAGVVDARDAVA

SEQ ID NO: 1520311 - protein, 22 aa, Mycobacterium tuberculosis
ADVFVHYTEIQGTGFRTLEENQ

SEQ ID NO: 1520312 - protein, 19 aa, Mycobacterium tuberculosis
ADVLIAFGRYPSFEGHLPQ

SEQ ID NO: 1520313 - protein, 21 aa, Mycobacterium tuberculosis
ADVPLRVPSCWRPTPCRRYCT

SEQ ID NO: 1520314 - protein, 21 aa, Mycobacterium tuberculosis
ADVSIIFVPPTFAKDAIIEAI

SEQ ID NO: 1520315 - protein, 21 aa, Mycobacterium tuberculosis
ADVSIIFVPPTFAKDAIIEAV

SEQ ID NO: 1520316 - protein, 24 aa, Mycobacterium tuberculosis
ADVSIRWQLKQAAAPELFQQYKTF

SEQ ID NO: 1520317 - protein, 31 aa, Mycobacterium tuberculosis; identical to SEQ ID NO: 1391366

SEQ ID NO: 1520318 - protein, 21 aa, Mycobacterium tuberculosis
ADVVGFLQYDEVHSLLLQCDG

SEQ ID NO: 1520319 - protein, 26 aa, Mycobacterium tuberculosis
ADVYWGDLDVLLLDLPPGTGDVAISV

SEQ ID NO: 1520320 - protein, 17 aa, Mycobacterium tuberculosis
ADWIKVVCFPDRWLDLR

SEQ ID NO: 1520321 - protein, 23 aa, Mycobacterium tuberculosis
ADWIKVVCFPDRWLDLRYVGPAS

SEQ ID NO: 1520322 - protein, 19 aa, Mycobacterium tuberculosis
ADYPTVLLSGAWLSQEQTS

SEQ ID NO: 1520323 - protein, 32 aa, Mycobacterium tuberculosis
AEAAATSPLLDPINEFFLANTGRPLIGNGANG

SEQ ID NO: 1520324 - protein, 30 aa, Mycobacterium tuberculosis
AEAAAVSPLLDPINEFFLANRRPAEPKRGP

SEQ ID NO: 1520325 - protein, 32 aa, Mycobacterium tuberculosis
AEAAAVTPLLNSINAPVLAATGRPLIGNGANG

SEQ ID NO: 1520326 - protein, 33 aa, Mycobacterium tuberculosis
AEAAAVTPLLNSINAPVLAATGRPLIGNGANGA

SEQ ID NO: 1520327 - protein, 25 aa, Mycobacterium tuberculosis
AEAAAVYDLFVKTLGVSAGTYAATE

SEQ ID NO: 1520328 - protein, 26 aa, Mycobacterium tuberculosis
AEAAAVYDLFVKTLGVSAGTYAATEA

SEQ ID NO: 1520329 - protein, 24 aa, Mycobacterium tuberculosis
AEADHIASFALPIDDLDLTVRSYN

SEQ ID NO: 1520330 - protein, 23 aa, Mycobacterium tuberculosis
AEAFGRYGAYLSQLNVLPIYGGS

SEQ ID NO: 1520331 - protein, 24 aa, Mycobacterium tuberculosis
AEAGFPGLAVAAIRVAPFAAWCAE

SEQ ID NO: 1520332 - protein, 17 aa, Mycobacterium tuberculosis
AEAIRQLAIRAFAAIDC

SEQ ID NO: 1520333 - protein, 20 aa, Mycobacterium tuberculosis
AEAMLLMRAGREYALKRALA

SEQ ID NO: 1520334 - protein, 23 aa, Mycobacterium tuberculosis
AEAMYEQMWAADVAAMVGYHGGA

SEQ ID NO: 1520335 - protein, 25 aa, Mycobacterium tuberculosis
AEATYEQMWAADVAAMVGYHGGASA

SEQ ID NO: 1520336 - protein, 27 aa, Mycobacterium tuberculosis
AEAYRAISLLLRRPPGREAYPGDVFYL

SEQ ID NO: 1520337 - protein, 20 aa, Mycobacterium tuberculosis
AECWPAVGGGVPSAYDLGTV

SEQ ID NO: 1520338 - protein, 24 aa, Mycobacterium tuberculosis
AEDHALRLLNLRRAARSVEGAGPG

SEQ ID NO: 1520339 - protein, 24 aa, Mycobacterium tuberculosis
AEDVLVHGLPLYHVHGLVLGLCSG

SEQ ID NO: 1520340 - protein, 25 aa, Mycobacterium tuberculosis
AEEFFDLIWRLMRFDKHGPLDLILY

SEQ ID NO: 1520341 - protein, 26 aa, Mycobacterium tuberculosis
AEELLSRSWWSGPEIFLIVDDIQQLP

SEQ ID NO: 1520342 - protein, 23 aa, Mycobacterium tuberculosis
AEETLNGLIQFDAAIQPGDSGGP

SEQ ID NO: 1520343 - protein, 19 aa, Mycobacterium tuberculosis
AEFVGAAAGLLLSSGYTAT

SEQ ID NO: 1520344 - protein, 26 aa, Mycobacterium tuberculosis
AEGARAFQTLLRYGRAYSGYAPIMGT

SEQ ID NO: 1520345 - protein, 20 aa, Mycobacterium tuberculosis
AEGFDFVAMARALLAEPDLV

SEQ ID NO: 1520346 - protein, 19 aa, Mycobacterium tuberculosis
AEGLHRALSKLISMLRCGD

SEQ ID NO: 1520347 - protein, 23 aa, Mycobacterium tuberculosis
AEGRLKGILKYYDAPIVSSDIVT

SEQ ID NO: 1520348 - protein, 27 aa, Mycobacterium tuberculosis
AEGRTRRRFRRVVGTSICWVTSTRVRG

SEQ ID NO: 1520349 - protein, 26 aa, Mycobacterium tuberculosis
AEGSALLREFVGMTLNLPTPEEAAAA

SEQ ID NO: 1520350 - protein, 28 aa, Mycobacterium tuberculosis
AEHDLLPDVLYTSLLRRAITTAHLALDS

SEQ ID NO: 1520351 - protein, 19 aa, Mycobacterium tuberculosis
AEHGLWYPPDPSSFEICSI

SEQ ID NO: 1520352 - protein, 23 aa, Mycobacterium tuberculosis
AEHPPDLVILDLGLPDMSGIDVL

SEQ ID NO: 1520353 - protein, 28 aa, Mycobacterium tuberculosis
AEIAGRAAVPVLVHPAPRGVLGGLAATV

SEQ ID NO: 1520354 - protein, 20 aa, Mycobacterium tuberculosis
AEIIRLGTALGANGATLAGL

SEQ ID NO: 1520355 - protein, 18 aa, Mycobacterium tuberculosis
AEILRIISGGRLIWDPAE

SEQ ID NO: 1520356 - protein, 23 aa, Mycobacterium tuberculosis
AEIRRRLKSFTVFRQRGDAFADR

SEQ ID NO: 1520357 - protein, 24 aa, Mycobacterium tuberculosis
AEISPLQPEIPYYSATSFDPREEP

SEQ ID NO: 1520358 - protein, 24 aa, Mycobacterium tuberculosis
AEKSTFIEVCYLLIYGELPDTDQL

SEQ ID NO: 1520359 - protein, 17 aa, Mycobacterium tuberculosis
AEKVTGIFLVPAQWQAV

SEQ ID NO: 1520360 - protein, 22 aa, Mycobacterium tuberculosis
AELACALGLFPPTAEQAAVIAA

SEQ ID NO: 1520361 - protein, 27 aa, Mycobacterium tuberculosis
AELFRAIALALERPLDPDRPLWECWII

SEQ ID NO: 1520362 - protein, 22 aa, Mycobacterium tuberculosis
AELIGLPDPDIAQLVKWGYAAT

SEQ ID NO: 1520363 - protein, 21 aa, Mycobacterium tuberculosis
AELLLLGMPYRDIGARLFIST

SEQ ID NO: 1520364 - protein, 17 aa, Mycobacterium tuberculosis
AELLRCGQPLLPSTCRR

SEQ ID NO: 1520365 - protein, 27 aa, Mycobacterium tuberculosis
AELLRPGLLVLPVRGPARFFGSEQMAA

SEQ ID NO: 1520366 - protein, 18 aa, Mycobacterium tuberculosis
AELPTIRAQIARMGTTLA

SEQ ID NO: 1520367 - protein, 22 aa, Mycobacterium tuberculosis
AELRRRRWSLCPAKRDNSGFCR

SEQ ID NO: 1520368 - protein, 20 aa, Mycobacterium tuberculosis
AELTRLCRYPLWWLTKSATF

SEQ ID NO: 1520369 - protein, 25 aa, Mycobacterium tuberculosis
AEMARGQYWIHPALPEVVENALLGL

SEQ ID NO: 1520370 - protein, 17 aa, Mycobacterium tuberculosis
AEMLKPCTLELGGKSAA

SEQ ID NO: 1520371 - protein, 22 aa, Mycobacterium tuberculosis
AEMMINLFWLGLKGAPVDRLET

SEQ ID NO: 1520372 - protein, 22 aa, Mycobacterium tuberculosis
AEMNWRILKFKPAGSPSSVPDD

SEQ ID NO: 1520373 - protein, 18 aa, Mycobacterium tuberculosis
AENMARLLIVTRERYHVF

SEQ ID NO: 1520374 - protein, 27 aa, Mycobacterium tuberculosis
AEPEDFVGALIYLLSDALELLHRAGDV

SEQ ID NO: 1520375 - protein, 23 aa, Mycobacterium tuberculosis
AEPLPRWWRPAGSLFDQFLGAAE

SEQ ID NO: 1520376 - protein, 25 aa, Mycobacterium tuberculosis
AEPNQALGWLPMQDIDAAAEAAAQP

SEQ ID NO: 1520377 - protein, 25 aa, Mycobacterium tuberculosis
AEPTADLAMWPPAGVVPVEVADGYQ

SEQ ID NO: 1520378 - protein, 17 aa, Mycobacterium tuberculosis
AEQLSNRVAFRRAMRKA

SEQ ID NO: 1520379 - protein, 25 aa, Mycobacterium tuberculosis
AEQRDWFEVSLIPTTRELTTLGSAA

SEQ ID NO: 1520380 - protein, 17 aa, Mycobacterium tuberculosis
AEQRQLQLLSGNVDLVV

SEQ ID NO: 1520381 - protein, 18 aa, Mycobacterium tuberculosis
AEQVFRMIKLGLTGLLYR

SEQ ID NO: 1520382 - protein, 17 aa, Mycobacterium tuberculosis
AERAQARSWWRIGEPYE

SEQ ID NO: 1520383 - protein, 26 aa, Mycobacterium tuberculosis
AERARAIGLFRYQLIWEAADAAHSTK

SEQ ID NO: 1520384 - protein, 18 aa, Mycobacterium tuberculosis
AERFAVFAALLTGAEYPQ

SEQ ID NO: 1520385 - protein, 19 aa, Mycobacterium tuberculosis
AERFAVFAALLTGAEYPQA

SEQ ID NO: 1520386 - protein, 25 aa, Mycobacterium tuberculosis
AERGEVHVLPFQLVTMGQPIADFAN

SEQ ID NO: 1520387 - protein, 17 aa, Mycobacterium tuberculosis
AERHRGVRYRAFDLVEA

SEQ ID NO: 1520388 - protein, 17 aa, Mycobacterium tuberculosis
AERIHRAMALPGGIEGA

SEQ ID NO: 1520389 - protein, 23 aa, Mycobacterium tuberculosis
AERLRARLIERINNLRVGHSLDP

SEQ ID NO: 1520390 - protein, 25 aa, Mycobacterium tuberculosis
AERNRVLPLLGGLAVMFGDLPPLPT

SEQ ID NO: 1520391 - protein, 20 aa, Mycobacterium tuberculosis
AERRRMFELPRSSWGDYDRS

SEQ ID NO: 1520392 - protein, 28 aa, Mycobacterium tuberculosis
AESFAAACLPYLSWLTQASADCAAAAAR

SEQ ID NO: 1520393 - protein, 25 aa, Mycobacterium tuberculosis
AETAQPQYARYWLHNTRPGAAGRAA

SEQ ID NO: 1520394 - protein, 24 aa, Mycobacterium tuberculosis
AETLIEVALRFVNIRETAWRVTEL

SEQ ID NO: 1520395 - protein, 24 aa, Mycobacterium tuberculosis
AETLLVVLCGVGFYIGFVGSYQRM

SEQ ID NO: 1520396 - protein, 24 aa, Mycobacterium tuberculosis
AETLTPFSVPPLDLAGLASQAGAQ

SEQ ID NO: 1520397 - protein, 22 aa, Mycobacterium tuberculosis
AETQQTLLLNGLRDRIVVQVDG

SEQ ID NO: 1520398 - protein, 17 aa, Mycobacterium tuberculosis
AETSPSCRLPPRRESRG

SEQ ID NO: 1520399 - protein, 18 aa, Mycobacterium tuberculosis
AEVAANRALLAALVATNV

SEQ ID NO: 1520400 - protein, 24 aa, Mycobacterium tuberculosis
AEVILQSPLDISRPLWTATLVEGM

SEQ ID NO: 1520401 - protein, 22 aa, Mycobacterium tuberculosis
AEVLAHWPEVIASPTPAAAGRV

SEQ ID NO: 1520402 - protein, 23 aa, Mycobacterium tuberculosis
AEVNGQVFIVYGPQVTLVSPPHM

SEQ ID NO: 1520403 - protein, 24 aa, Mycobacterium tuberculosis
AEVNGQVFIVYGPQVTLVSPPHME

SEQ ID NO: 1520404 - protein, 24 aa, Mycobacterium tuberculosis
AEYSPPILFRPAALVNCGSRPPEC

SEQ ID NO: 1520405 - protein, 24 aa, Mycobacterium tuberculosis
AFAESVPMWGPRGAALIQAIPEAT

SEQ ID NO: 1520406 - protein, 18 aa, Mycobacterium tuberculosis
AFAQHSPFAEKFQSLGQN

SEQ ID NO: 1520407 - protein, 21 aa, Mycobacterium tuberculosis
AFATPYIEAGDWRETLRNHAR

SEQ ID NO: 1520408 - protein, 20 aa, Mycobacterium tuberculosis
AFDGLRLAGRRVRRPELTLA

SEQ ID NO: 1520409 - protein, 23 aa, Mycobacterium tuberculosis
AFDIAQFGWVGDAFPLSSLTQIY

SEQ ID NO: 1520410 - protein, 28 aa, Mycobacterium tuberculosis
AFDRIDERLVVVGLDKTVTYKNGDPTID

SEQ ID NO: 1520411 - protein, 17 aa, Mycobacterium tuberculosis
AFELVVVNLYPFSQTVE

SEQ ID NO: 1520412 - protein, 20 aa, Mycobacterium tuberculosis
AFFLYMETPSQPLNVCCVLE

SEQ ID NO: 1520413 - protein, 18 aa, Mycobacterium tuberculosis
AFGALGGKGGSGGLIARG

SEQ ID NO: 1520414 - protein, 19 aa, Mycobacterium tuberculosis
AFGDLLSAAGLPAPKYGTA

SEQ ID NO: 1520415 - protein, 21 aa, Mycobacterium tuberculosis
AFGRLLGRIWRAETADVNRIA

SEQ ID NO: 1520416 - protein, 17 aa, Mycobacterium tuberculosis
AFHAFPASRWRRYDKLE

SEQ ID NO: 1520417 - protein, 17 aa, Mycobacterium tuberculosis
AFHDRFAQTLSAAVGSY

SEQ ID NO: 1520418 - protein, 18 aa, Mycobacterium tuberculosis
AFHEQFVQALTAAAGRYA

SEQ ID NO: 1520419 - protein, 20 aa, Mycobacterium tuberculosis
AFHERFVQALATGGGAYAAA

SEQ ID NO: 1520420 - protein, 21 aa, Mycobacterium tuberculosis
AFHGRFVQALTPGGGGLSGRR

SEQ ID NO: 1520421 - protein, 18 aa, Mycobacterium tuberculosis
AFHHSFVQTLNAAGGAYS

SEQ ID NO: 1520422 - protein, 19 aa, Mycobacterium tuberculosis
AFHQQFVQTLAGGAGAYAA

SEQ ID NO: 1520423 - protein, 19 aa, Mycobacterium tuberculosis
AFHQQFVQTLAVALEHMRP

SEQ ID NO: 1520424 - protein, 21 aa, Mycobacterium tuberculosis
AFHQQIVQTLTSTAGAYASAE

SEQ ID NO: 1520425 - protein, 18 aa, Mycobacterium tuberculosis
AFHSPLMEPMLEEFARVA

SEQ ID NO: 1520426 - protein, 54 aa, Mycobacterium tuberculosis; identical to SEQ ID NO: 215791

SEQ ID NO: 1520427 - protein, 18 aa, Mycobacterium tuberculosis
AFKLSRLTGRTKLVAAHD

SEQ ID NO: 1520428 - protein, 30 aa, Mycobacterium tuberculosis
AFKVDMAAQYRIRLGGTWKKPGTSDIEIVC

SEQ ID NO: 1520429 - protein, 20 aa, Mycobacterium tuberculosis
AFLSRSCRWALAAANLWQGN

SEQ ID NO: 1520430 - protein, 19 aa, Mycobacterium tuberculosis
AFLTSQKVRWAARASLDAA

SEQ ID NO: 1520431 - protein, 19 aa, Mycobacterium tuberculosis
AFMGLIPQPVTATQLLYRT

SEQ ID NO: 1520432 - protein, 21 aa, Mycobacterium tuberculosis
AFMVRYTSGYLCVPLDGAICD

SEQ ID NO: 1520433 - protein, 30 aa, Mycobacterium tuberculosis
AFNSGNYSNGFFWRGDYQGLGGFAYQSAVS

SEQ ID NO: 1520434 - protein, 42 aa, Mycobacterium tuberculosis
AFNTPALNIHQIPLGFQVPGSIDAITLFPGGLTFPANSLLNL

SEQ ID NO: 1520435 - protein, 23 aa, Mycobacterium tuberculosis
AFPPAKVRVTRLGGRRVNTMRTS

SEQ ID NO: 1520436 - protein, 19 aa, Mycobacterium tuberculosis
AFQAWANGPAIAAHAGHRA

SEQ ID NO: 1520437 - protein, 18 aa, Mycobacterium tuberculosis
AFQQLLVGDYNAAVANLG

SEQ ID NO: 1520438 - protein, 20 aa, Mycobacterium tuberculosis
AFRAFYALPAENFKTRGGLT

SEQ ID NO: 1520439 - protein, 29 aa, Mycobacterium tuberculosis
AFRSRFGENFFYILYFQEPGIADAELNGD

SEQ ID NO: 1520440 - protein, 25 aa, Mycobacterium tuberculosis
AFSGPRWLALLLQPLSGPPSTSAKH

SEQ ID NO: 1520441 - protein, 27 aa, Mycobacterium tuberculosis
AFTWEHDLHLYYAGPRPPRRFREQRSK

SEQ ID NO: 1520442 - protein, 17 aa, Mycobacterium tuberculosis
AFVLRRPEMPALLAELG

SEQ ID NO: 1520443 - protein, 19 aa, Mycobacterium tuberculosis
AFYFACPSTVLGPYDDAPT

SEQ ID NO: 1520444 - protein, 19 aa, Mycobacterium tuberculosis
AFYLQYFGCRPYFAERVGG

SEQ ID NO: 1520445 - protein, 17 aa, Mycobacterium tuberculosis
AGAALAPGLRGPVLVLG

SEQ ID NO: 1520446 - protein, 23 aa, Mycobacterium tuberculosis
AGAALAPGLRGPVLVLGGPGTGK

SEQ ID NO: 1520447 - protein, 23 aa, Mycobacterium tuberculosis
AGAALVPGLRGPVLVLGGPGTGK

SEQ ID NO: 1520448 - protein, 40 aa, Mycobacterium tuberculosis
AGAAVDFAVLYPTGRLINAPLPIWNHRRLLLDDTTRRIAH

SEQ ID NO: 1520449 - protein, 36 aa, Mycobacterium tuberculosis
AGAAVDFAVLYPTGRLINAPLPTWNHRRLLLDDTTR

SEQ ID NO: 1520450 - protein, 22 aa, Mycobacterium tuberculosis
AGAFVNWEGRYRTFEPALRGST

SEQ ID NO: 1520451 - protein, 25 aa, Mycobacterium tuberculosis
AGAGENLLLLPPGSAVRFCTGGTVA

SEQ ID NO: 1520452 - protein, 34 aa, Mycobacterium tuberculosis
AGAGPISIPIIDLRPAPGFFNATTGPSSGFLNWG

SEQ ID NO: 1520453 - protein, 36 aa, Mycobacterium tuberculosis
AGAGPISIPIIDLRPAPGFFNATTGPSSGFLNWGAR

SEQ ID NO: 1520454 - protein, 24 aa, Mycobacterium tuberculosis
AGAGTARVYLLDDALKPVPVGVVG

SEQ ID NO: 1520455 - protein, 26 aa, Mycobacterium tuberculosis
AGAHLRNMAFYNFGLRLLKRARDADR

SEQ ID NO: 1520456 - protein, 24 aa, Mycobacterium tuberculosis
AGALKPARLLVSGSAALPVPVFDK

SEQ ID NO: 1520457 - protein, 27 aa, Mycobacterium tuberculosis
AGALRRFLLEHGVLPEAPLVATVPVSV

SEQ ID NO: 1520458 - protein, 23 aa, Mycobacterium tuberculosis
AGALWAHHFKPAGVDHGFGWTVE

SEQ ID NO: 1520459 - protein, 21 aa, Mycobacterium tuberculosis
AGAPGLGGRGGLLLGLPGANG

SEQ ID NO: 1520460 - protein, 33 aa, Mycobacterium tuberculosis
AGAPPWYADVLLPDLGAAWRVLHAIPAARAARQ

SEQ ID NO: 1520461 - protein, 28 aa, Mycobacterium tuberculosis
AGAPSPVGWYRWQQCPHRHSLAGGDERA

SEQ ID NO: 1520462 - protein, 24 aa, Mycobacterium tuberculosis
AGARLDSLVPLGPPVMDVALNITC

SEQ ID NO: 1520463 - protein, 17 aa, Mycobacterium tuberculosis
AGARRTMGLPATVVDWG

SEQ ID NO: 1520464 - protein, 29 aa, Mycobacterium tuberculosis
AGAYLVGWDPLLQSGLGEPTLTWLDSLAP

SEQ ID NO: 1520465 - protein, 25 aa, Mycobacterium tuberculosis
AGCKTIVMRLYRDRAVVLRQHKLGE

SEQ ID NO: 1520466 - protein, 25 aa, Mycobacterium tuberculosis
AGDGGAGGRGGWLAGAGGAGGDGGI

SEQ ID NO: 1520467 - protein, 28 aa, Mycobacterium tuberculosis
AGDGSTWILRRILRRLGYAAYGWGLGRN

SEQ ID NO: 1520468 - protein, 29 aa, Mycobacterium tuberculosis
AGDHAAICWPLLVGMAKAKYYLLTCEPLS

SEQ ID NO: 1520469 - protein, 19 aa, Mycobacterium tuberculosis
AGDIGLLREVERFPFVPAD

SEQ ID NO: 1520470 - protein, 25 aa, Mycobacterium tuberculosis
AGDRGLLEMIWTPVPLEGGDIGDDA

SEQ ID NO: 1520471 - protein, 25 aa, Mycobacterium tuberculosis
AGDRYAFDQLFRRHHRQLHRLARLT

SEQ ID NO: 1520472 - protein, 27 aa, Mycobacterium tuberculosis
AGDVNTGFWNGGPFNTGFGNGGNTNFG

SEQ ID NO: 1520473 - protein, 22 aa, Mycobacterium tuberculosis
AGELALLRLACEAADAALTDLW

SEQ ID NO: 1520474 - protein, 24 aa, Mycobacterium tuberculosis
AGEPPLPLVVPPTPVGGNALGGCG

SEQ ID NO: 1520475 - protein, 25 aa, Mycobacterium tuberculosis
AGEPPLTGSLLIGGAGRVVEPLRAA

SEQ ID NO: 1520476 - protein, 34 aa, Mycobacterium tuberculosis
AGETGCRILLPEGADPFVLLFSESAGRVLVAVPR

SEQ ID NO: 1520477 - protein, 18 aa, Mycobacterium tuberculosis
AGEVGNRGVGGDGGDGGS

SEQ ID NO: 1520478 - protein, 22 aa, Mycobacterium tuberculosis
AGFCAQAAVRRTPLLLDGVAVT

SEQ ID NO: 1520479 - protein, 28 aa, Mycobacterium tuberculosis
AGFMRNAAGGTLFNFGFANDGTLNLGNA

SEQ ID NO: 1520480 - protein, 21 aa, Mycobacterium tuberculosis
AGFNPLDPRNLDVSPLPSLAK

SEQ ID NO: 1520481 - protein, 19 aa, Mycobacterium tuberculosis
AGFREGLDLPEVSLVPILD

SEQ ID NO: 1520482 - protein, 17 aa, Mycobacterium tuberculosis
AGFVYIGGMQRLLAAGQ

SEQ ID NO: 1520483 - protein, 23 aa, Mycobacterium tuberculosis
AGGAAGMLFGAAGVGGPGGFAAA

SEQ ID NO: 1520484 - protein, 25 aa, Mycobacterium tuberculosis
AGGAGATGINGPAGISAAGGDGGAG

SEQ ID NO: 1520485 - protein, 21 aa, Mycobacterium tuberculosis
AGGAGGFGFLGGDGGAGGNAG

SEQ ID NO: 1520486 - protein, 24 aa, Mycobacterium tuberculosis
AGGAGGFGFLGGDGGAGGNAGLLL

SEQ ID NO: 1520487 - protein, 22 aa, Mycobacterium tuberculosis
AGGAGGILFGTGGAGGAGGVGT

SEQ ID NO: 1520488 - protein, 25 aa, Mycobacterium tuberculosis
AGGAGGILWGGRRLGRARPSRRGRR

SEQ ID NO: 1520489 - protein, 21 aa, Mycobacterium tuberculosis
AGGAGGILWGNGGNGGSGAPG

SEQ ID NO: 1520490 - protein, 26 aa, Mycobacterium tuberculosis
AGGAGGNAWLFGNGGAGGLGAAGAAG

SEQ ID NO: 1520491 - protein, 20 aa, Mycobacterium tuberculosis
AGGAGGNAWLIGDGGAGGNG

SEQ ID NO: 1520492 - protein, 24 aa, Mycobacterium tuberculosis
AGGAGGNAYLFGSGGAGGQGGMGA

SEQ ID NO: 1520493 - protein, 26 aa, Mycobacterium tuberculosis
AGGAGGSGGWLLGNGGVGGAGGQSLL

SEQ ID NO: 1520494 - protein, 17 aa, Mycobacterium tuberculosis
AGGAGGWLFGNGGNGGH

SEQ ID NO: 1520495 - protein, 21 aa, Mycobacterium tuberculosis
AGGAGGWLFGNGGNGGHGATN

SEQ ID NO: 1520496 - protein, 22 aa, Mycobacterium tuberculosis
AGGAGGWLLGNGGGRRGRRGRL

SEQ ID NO: 1520497 - protein, 22 aa, Mycobacterium tuberculosis
AGGASGWLMGNGGNGGNGGTGG

SEQ ID NO: 1520498 - protein, 25 aa, Mycobacterium tuberculosis
AGGDAPLIGWGGNGGPGGFAAFGNG

SEQ ID NO: 1520499 - protein, 29 aa, Mycobacterium tuberculosis
AGGEGGAGGLALAASGQNGSQGAGGDGGA

SEQ ID NO: 1520500 - protein, 21 aa, Mycobacterium tuberculosis
AGGFGGSGGRGGLLLGTGGAG

SEQ ID NO: 1520501 - protein, 23 aa, Mycobacterium tuberculosis
AGGGGGTGFNPGAPGDPGTQGAT

SEQ ID NO: 1520502 - protein, 29 aa, Mycobacterium tuberculosis
AGGGGWVGAVNFGPISVQGFGLFGHGGDG

SEQ ID NO: 1520503 - protein, 20 aa, Mycobacterium tuberculosis
AGGHAWLFGHGGTGGIGGGP

SEQ ID NO: 1520504 - protein, 20 aa, Mycobacterium tuberculosis
AGGHGGLFGAGGTGGAGGSS

SEQ ID NO: 1520505 - protein, 23 aa, Mycobacterium tuberculosis
AGGHGGWLWGNGGVGGSGGAGVG

SEQ ID NO: 1520506 - protein, 26 aa, Mycobacterium tuberculosis
AGGIGWAAINILANAGAGGAGGAAGS

SEQ ID NO: 1520507 - protein, 29 aa, Mycobacterium tuberculosis
AGGIYGDFFNFYLCDISLKVNGLQPGGPV

SEQ ID NO: 1520508 - protein, 19 aa, Mycobacterium tuberculosis
AGGKAGLYGNGGDGGAGGD

SEQ ID NO: 1520509 - protein, 30 aa, Mycobacterium tuberculosis
AGGKGRRQPPTVWPSIPVFGCNGGDTGNAG

SEQ ID NO: 1520510 - protein, 24 aa, Mycobacterium tuberculosis
AGGKSGAFGLGGDGGAGGATGLSG

SEQ ID NO: 1520511 - protein, 19 aa, Mycobacterium tuberculosis
AGGLFGAGGAGGLGGQGNH

SEQ ID NO: 1520512 - protein, 17 aa, Mycobacterium tuberculosis
AGGLGAPRIRDVELVEM

SEQ ID NO: 1520513 - protein, 18 aa, Mycobacterium tuberculosis
AGGLLFGSGGAGGSGGFS

SEQ ID NO: 1520514 - protein, 24 aa, Mycobacterium tuberculosis
AGGNAGLFSLGASGGAGGSGGSSL

SEQ ID NO: 1520515 - protein, 24 aa, Mycobacterium tuberculosis
AGGNAGLLGVGGAGGHGASGGAGD

SEQ ID NO: 1520516 - protein, 21 aa, Mycobacterium tuberculosis
AGGNALLFGNGGNGGSGASGG

SEQ ID NO: 1520517 - protein, 27 aa, Mycobacterium tuberculosis
AGGNAVIPGDGVGKAPHGDAGGSGGDG

SEQ ID NO: 1520518 - protein, 21 aa, Mycobacterium tuberculosis
AGGNAWLFGNGGAGGLGAAGA

SEQ ID NO: 1520519 - protein, 27 aa, Mycobacterium tuberculosis
AGGNGGAGGLLFGDGGNGGAGGAGGIG

SEQ ID NO: 1520520 - protein, 28 aa, Mycobacterium tuberculosis
AGGNGGAGGLLFGDGGNGGAGGAGGIGG

SEQ ID NO: 1520521 - protein, 22 aa, Mycobacterium tuberculosis
AGGNGGLLFGAGGVGGVGGDGV

SEQ ID NO: 1520522 - protein, 20 aa, Mycobacterium tuberculosis
AGGNGGLSLGLGVAGGAGGA

SEQ ID NO: 1520523 - protein, 17 aa, Mycobacterium tuberculosis
AGGNGGWLWGNGGNGGS

SEQ ID NO: 1520524 - protein, 25 aa, Mycobacterium tuberculosis
AGGPGGAAGLFGNGGAGGAGGTATA

SEQ ID NO: 1520525 - protein, 20 aa, Mycobacterium tuberculosis
AGGRAWLWGTGGAGGAGGDG

SEQ ID NO: 1520526 - protein, 23 aa, Mycobacterium tuberculosis
AGGRGATAPRPADAASPSCGSSP

SEQ ID NO: 1520527 - protein, 29 aa, Mycobacterium tuberculosis
AGGRGGAGGLGFGSEAPGRPGGAGGTGGA

SEQ ID NO: 1520528 - protein, 24 aa, Mycobacterium tuberculosis
AGGRGLLVLLDALRSTICGQAPAP

SEQ ID NO: 1520529 - protein, 24 aa, Mycobacterium tuberculosis
AGGRGLLVLLDALRSTICGQAPAR

SEQ ID NO: 1520530 - protein, 21 aa, Mycobacterium tuberculosis
AGGSAFLIGSGGTGGVGGAAT

SEQ ID NO: 1520531 - protein, 21 aa, Mycobacterium tuberculosis
AGGSAGLFYGSGGAGGNGGYS

SEQ ID NO: 1520532 - protein, 25 aa, Mycobacterium tuberculosis
AGGSAGLIGIGGTGGAGGAGAVGGV

SEQ ID NO: 1520533 - protein, 25 aa, Mycobacterium tuberculosis
AGGSARLIGAGGHGGDGGAGGNTAG

SEQ ID NO: 1520534 - protein, 21 aa, Mycobacterium tuberculosis
AGGSELGFRLAFAEGYSHAMT

SEQ ID NO: 1520535 - protein, 23 aa, Mycobacterium tuberculosis
AGGSVQWVLGNLGAIPTVSIDYR

SEQ ID NO: 1520536 - protein, 54 aa, Mycobacterium tuberculosis
AGGTGGFPWGPADPAGPAGLGGFGGAWRLLFRPNRPGWRVAVAGRLAASAALAS

SEQ ID NO: 1520537 - protein, 24 aa, Mycobacterium tuberculosis
AGGTGGFPWVPEVSGGAGGGGSTV

SEQ ID NO: 1520538 - protein, 22 aa, Mycobacterium tuberculosis
AGGTGGLLFGAGGNGGPGGSGG

SEQ ID NO: 1520539 - protein, 24 aa, Mycobacterium tuberculosis
AGGTGGLLFGAGGNGGPGGSGGAA

SEQ ID NO: 1520540 - protein, 25 aa, Mycobacterium tuberculosis
AGGTRRRRRRRRSGRQGRQRRRLVA

SEQ ID NO: 1520541 - protein, 22 aa, Mycobacterium tuberculosis
AGGTTPFFKQIPFAVLLSPPPT

SEQ ID NO: 1520542 - protein, 21 aa, Mycobacterium tuberculosis
AGGVGGDARLIGHGGAGGAGG

SEQ ID NO: 1520543 - protein, 31 aa, Mycobacterium tuberculosis
AGGVGGNGGRGGWLLGNGGAGGVGGVGGAGG

SEQ ID NO: 1520544 - protein, 23 aa, Mycobacterium tuberculosis
AGGVYKFFIARRDPVTMSGMLIP

SEQ ID NO: 1520545 - protein, 17 aa, Mycobacterium tuberculosis
AGGWLFGNGGAGGNGGI

SEQ ID NO: 1520546 - protein, 17 aa, Mycobacterium tuberculosis
AGGWLFGNGGNGGAGAA

SEQ ID NO: 1520547 - protein, 17 aa, Mycobacterium tuberculosis
AGGWLFGNGGNGGSGAT

SEQ ID NO: 1520548 - protein, 20 aa, Mycobacterium tuberculosis
AGGWLFGNGGQRRGPGGAGT

SEQ ID NO: 1520549 - protein, 19 aa, Mycobacterium tuberculosis
AGGWLIGQSGSTGGGGAGG

SEQ ID NO: 1520550 - protein, 24 aa, Mycobacterium tuberculosis
AGHALGVFVVAGTGHRPARGHVGS

SEQ ID NO: 1520551 - protein, 26 aa, Mycobacterium tuberculosis
AGHATAIMWAREQFGLELIWGIEDCR

SEQ ID NO: 1520552 - protein, 20 aa, Mycobacterium tuberculosis
AGHNFPLACPGLLGAMTVGA

SEQ ID NO: 1520553 - protein, 20 aa, Mycobacterium tuberculosis
AGHRLKFWTPGGSSTPLLTD

SEQ ID NO: 1520554 - protein, 20 aa, Mycobacterium tuberculosis
AGIAVTAGLLGSGGSGGTGG

SEQ ID NO: 1520555 - protein, 17 aa, Mycobacterium tuberculosis
AGIELLAFGGRFVEIGK

SEQ ID NO: 1520556 - protein, 29 aa, Mycobacterium tuberculosis
AGIRWRAWRFATIFTVRYGRCVSTCWPWG

SEQ ID NO: 1520557 - protein, 25 aa, Mycobacterium tuberculosis
AGISYCDPPPSVGVFARFVAAQRCA

SEQ ID NO: 1520558 - protein, 17 aa, Mycobacterium tuberculosis
AGITLSARSAGFAGIRA

SEQ ID NO: 1520559 - protein, 33 aa, Mycobacterium tuberculosis
AGIYGKLAWEKTIPNWFFEPDIAADIVGNLLFG

SEQ ID NO: 1520560 - protein, 25 aa, Mycobacterium tuberculosis
AGKPASVATIAWMGYHPPPNPLDTG

SEQ ID NO: 1520561 - protein, 24 aa, Mycobacterium tuberculosis
AGKSVWFQRGPLDAAIRASIAIPG

SEQ ID NO: 1520562 - protein, 27 aa, Mycobacterium tuberculosis
AGLAECRDGRWRILRAGAGQAAAKGAA

SEQ ID NO: 1520563 - protein, 22 aa, Mycobacterium tuberculosis
AGLAEYFVHRTGHGIGLCVHEE

SEQ ID NO: 1520564 - protein, 25 aa, Mycobacterium tuberculosis
AGLAFHGTVGYRRVRWRRTQLPVGT

SEQ ID NO: 1520565 - protein, 17 aa, Mycobacterium tuberculosis
AGLAVSARLAERAGTAD

SEQ ID NO: 1520566 - protein, 22 aa, Mycobacterium tuberculosis
AGLCIVLPGPFQRFAERRRARL

SEQ ID NO: 1520567 - protein, 24 aa, Mycobacterium tuberculosis
AGLDSRAYRLPWPDGTTVFELDRP

SEQ ID NO: 1520568 - protein, 25 aa, Mycobacterium tuberculosis
AGLDSRAYRLPWPDGTTVFELDRPQ

SEQ ID NO: 1520569 - protein, 19 aa, Mycobacterium tuberculosis
AGLGRAEALGWPGGRHRRR

SEQ ID NO: 1520570 - protein, 17 aa, Mycobacterium tuberculosis
AGLIDRIARDEVRHEEF

SEQ ID NO: 1520571 - protein, 17 aa, Mycobacterium tuberculosis
AGLIGIGGTGGAGGAGA

SEQ ID NO: 1520572 - protein, 25 aa, Mycobacterium tuberculosis
AGLIKTILCLKNKALPATLHYTQPE

SEQ ID NO: 1520573 - protein, 22 aa, Mycobacterium tuberculosis
AGLLEAAGYRRATDGSEADVVV

SEQ ID NO: 1520574 - protein, 18 aa, Mycobacterium tuberculosis
AGLLFGSGGAGGAGGFGF

SEQ ID NO: 1520575 - protein, 17 aa, Mycobacterium tuberculosis
AGLLPCPRFFAKASIAS

SEQ ID NO: 1520576 - protein, 21 aa, Mycobacterium tuberculosis
AGLLSTYSPTPVPAAPVVPRA

SEQ ID NO: 1520577 - protein, 20 aa, Mycobacterium tuberculosis
AGLLVGSGGVGGAGGFGLTT

SEQ ID NO: 1520578 - protein, 19 aa, Mycobacterium tuberculosis
AGLPFLIHAVSARAQAPAQ

SEQ ID NO: 1520579 - protein, 20 aa, Mycobacterium tuberculosis
AGLPRPFDAFSERVAPALPV

SEQ ID NO: 1520580 - protein, 21 aa, Mycobacterium tuberculosis
AGLPSLMVLTGVNSAWDAVYA

SEQ ID NO: 1520581 - protein, 17 aa, Mycobacterium tuberculosis
AGLVQIPCIERNAISAG

SEQ ID NO: 1520582 - protein, 28 aa, Mycobacterium tuberculosis
AGLVRSRWHRRCRRARFSTVAPAGPEFA

SEQ ID NO: 1520583 - protein, 17 aa, Mycobacterium tuberculosis
AGMHPWGKWGNDFTEYG

SEQ ID NO: 1520584 - protein, 17 aa, Mycobacterium tuberculosis
AGMPRQAGRWSPTALRI

SEQ ID NO: 1520585 - protein, 32 aa, Mycobacterium tuberculosis
AGNGGLGGDGFTYLADFDGEPGGDGGDGGDGG

SEQ ID NO: 1520586 - protein, 21 aa, Mycobacterium tuberculosis
AGNIARLSWLAAGYPEEVPGV

SEQ ID NO: 1520587 - protein, 22 aa, Mycobacterium tuberculosis
AGNITAYWKGYTEYHQLGLIDK

SEQ ID NO: 1520588 - protein, 20 aa, Mycobacterium tuberculosis
AGPADKPVPAPPAHPANRAA

SEQ ID NO: 1520589 - protein, 20 aa, Mycobacterium tuberculosis
AGPDRSLIRAQSWDIDLPNQ

SEQ ID NO: 1520590 - protein, 17 aa, Mycobacterium tuberculosis
AGPHGRVLATETYFSVG

SEQ ID NO: 1520591 - protein, 20 aa, Mycobacterium tuberculosis
AGPLPLQIICDMMGIPKADH

SEQ ID NO: 1520592 - protein, 22 aa, Mycobacterium tuberculosis
AGPLPYIVMEYVDGVTLRDIVH

SEQ ID NO: 1520593 - protein, 28 aa, Mycobacterium tuberculosis
AGPQLHRDRTLLLALLELEDGDGPLHRS

SEQ ID NO: 1520594 - protein, 22 aa, Mycobacterium tuberculosis
AGPRHLDIALGLLDKLGTASHL

SEQ ID NO: 1520595 - protein, 18 aa, Mycobacterium tuberculosis
AGPRYGFRVTVMSRPPFA

SEQ ID NO: 1520596 - protein, 18 aa, Mycobacterium tuberculosis
AGPSPYIDFDAMRLKMIT

SEQ ID NO: 1520597 - protein, 22 aa, Mycobacterium tuberculosis
AGPTVPADVDYARPATTAGAAG

SEQ ID NO: 1520598 - protein, 30 aa, Mycobacterium tuberculosis
AGPVSLERIGQAALYAACPRCPSRGPDSGS

SEQ ID NO: 1520599 - protein, 19 aa, Mycobacterium tuberculosis
AGQASTVAPAGPAVAACCS

SEQ ID NO: 1520600 - protein, 18 aa, Mycobacterium tuberculosis
AGQASTVAPAGPAVAAGC

SEQ ID NO: 1520601 - protein, 23 aa, Mycobacterium tuberculosis
AGQCPPMRYAPNAAAGNIGLTMF

SEQ ID NO: 1520602 - protein, 28 aa, Mycobacterium tuberculosis
AGQGGRFLCTFPFSFEITEGEDRYVVSV

SEQ ID NO: 1520603 - protein, 22 aa, Mycobacterium tuberculosis
AGQLPLEAGKLVRTGKLGADVN

SEQ ID NO: 1520604 - protein, 17 aa, Mycobacterium tuberculosis
AGQLRPRVRQDPKIQMR

SEQ ID NO: 1520605 - protein, 29 aa, Mycobacterium tuberculosis
AGQQFGDVFLGWLVRGVVGFPDNVQNRGE

SEQ ID NO: 1520606 - protein, 23 aa, Mycobacterium tuberculosis
AGQRRRLLLARAVLSPARIVLLD

SEQ ID NO: 1520607 - protein, 25 aa, Mycobacterium tuberculosis
AGQRSFIALEFLLDEPASYPQTMEL

SEQ ID NO: 1520608 - protein, 30 aa, Mycobacterium tuberculosis
AGRCPAGKRLPCFGFWAGAGPGRAGIGGSR

SEQ ID NO: 1520609 - protein, 23 aa, Mycobacterium tuberculosis
AGRICASLGLPRAGADPSGCVPF

SEQ ID NO: 1520610 - protein, 22 aa, Mycobacterium tuberculosis
AGRLLIFSAYVTHRLPEIWPEP

SEQ ID NO: 1520611 - protein, 19 aa, Mycobacterium tuberculosis
AGRRRDRVPLRWRRWSTSS

SEQ ID NO: 1520612 - protein, 24 aa, Mycobacterium tuberculosis
AGRRSWWRIAPARRRKSGALVRAS

SEQ ID NO: 1520613 - protein, 27 aa, Mycobacterium tuberculosis
AGRSGAALIFVSPRELHLLKAIEKATR

SEQ ID NO: 1520614 - protein, 24 aa, Mycobacterium tuberculosis
AGRTERFWVGLSVYRPGGTAEPAP

SEQ ID NO: 1520615 - protein, 19 aa, Mycobacterium tuberculosis
AGRVAILDLWPLSVAERSG

SEQ ID NO: 1520616 - protein, 23 aa, Mycobacterium tuberculosis
AGRWGCARCRWPRWCRPTEDGVR

SEQ ID NO: 1520617 - protein, 18 aa, Mycobacterium tuberculosis
AGRYRQRCWLRQLTPHAN

SEQ ID NO: 1520618 - protein, 22 aa, Mycobacterium tuberculosis
AGSAIPGLPRGLPPGVVANLAA

SEQ ID NO: 1520619 - protein, 26 aa, Mycobacterium tuberculosis
AGSDPLLAVPFSYPASLPTPFGPVTM

SEQ ID NO: 1520620 - protein, 29 aa, Mycobacterium tuberculosis
AGSEQFLDPLIFARRRLIAAGTTRGRLDE

SEQ ID NO: 1520621 - protein, 17 aa, Mycobacterium tuberculosis
AGSLFNGAPGFGGPGGS

SEQ ID NO: 1520622 - protein, 27 aa, Mycobacterium tuberculosis
AGSLLRDYGLLLPLEPDTRLLSETELW

SEQ ID NO: 1520623 - protein, 23 aa, Mycobacterium tuberculosis
AGSLVAPPKVRVPLLVGGNGTEV

SEQ ID NO: 1520624 - protein, 24 aa, Mycobacterium tuberculosis
AGSNALGLFLGLGGSGGQGGDSAM

SEQ ID NO: 1520625 - protein, 21 aa, Mycobacterium tuberculosis
AGSPGGLLYGTGGAGGNGGPG

SEQ ID NO: 1520626 - protein, 20 aa, Mycobacterium tuberculosis
AGTAAPAGPVVSCYGNGGAG

SEQ ID NO: 1520627 - protein, 25 aa, Mycobacterium tuberculosis
AGTERAPALLAGPAVTAGKAGTAAA

SEQ ID NO: 1520628 - protein, 26 aa, Mycobacterium tuberculosis
AGTGGRGGLLAGQHANSGNGGGGGTG

SEQ ID NO: 1520629 - protein, 30 aa, Mycobacterium tuberculosis; identical to SEQ ID NO: 196404

SEQ ID NO: 1520630 - protein, 19 aa, Mycobacterium tuberculosis
AGTLTRRAHWRSPAGKQVK

SEQ ID NO: 1520631 - protein, 28 aa, Mycobacterium tuberculosis
AGTNVWWGHAEAALLRLVEERHIPVLMN

SEQ ID NO: 1520632 - protein, 18 aa, Mycobacterium tuberculosis
AGTPISPRRRLSGPTAPA

SEQ ID NO: 1520633 - protein, 29 aa, Mycobacterium tuberculosis
AGTRNAAGFGWLSTRRFKPPKAALSSSEL

SEQ ID NO: 1520634 - protein, 26 aa, Mycobacterium tuberculosis
AGTSRAIIANRVSFAFGLRGPSVTID

SEQ ID NO: 1520635 - protein, 20 aa, Mycobacterium tuberculosis
AGVAKYPARVKCALLGWMAF

SEQ ID NO: 1520636 - protein, 24 aa, Mycobacterium tuberculosis
AGVARLHDYLRGGPGRRCRVGLGR

SEQ ID NO: 1520637 - protein, 28 aa, Mycobacterium tuberculosis
AGVATAVRWVMAVPVGPVAAAGPAVSDL

SEQ ID NO: 1520638 - protein, 25 aa, Mycobacterium tuberculosis
AGVDPGRIPGPWSGAGLSAAHRALR

SEQ ID NO: 1520639 - protein, 33 aa, Mycobacterium tuberculosis
AGVLRQRWQRRGRWCPERTPPPAAPPAGSSASA

SEQ ID NO: 1520640 - protein, 34 aa, Mycobacterium tuberculosis
AGVMAGAVVSPVWPAPRALGLRAVAATATSASSA

SEQ ID NO: 1520641 - protein, 27 aa, Mycobacterium tuberculosis
AGVNAEYWYRSIRQPVQFERAVRNAFD

SEQ ID NO: 1520642 - protein, 27 aa, Mycobacterium tuberculosis
AGVNAVNPGLATPVTPAANGGNGLNLV

SEQ ID NO: 1520643 - protein, 39 aa, Mycobacterium tuberculosis
AGVNPASWYRAVVISMRLPQRRHAVNRWSSPDFGADQGR

SEQ ID NO: 1520644 - protein, 19 aa, Mycobacterium tuberculosis
AGVNRQRERFSRRQPAAEV

SEQ ID NO: 1520645 - protein, 32 aa, Mycobacterium tuberculosis
AGVPKTLIQHLIRWVISAGEFGEKWVRYCSRC

SEQ ID NO: 1520646 - protein, 24 aa, Mycobacterium tuberculosis
AGVPKTLIQHMIRWVISAGEFGEK

SEQ ID NO: 1520647 - protein, 19 aa, Mycobacterium tuberculosis
AGVRIDADLLLGEQTRLAR

SEQ ID NO: 1520648 - protein, 20 aa, Mycobacterium tuberculosis
AGVRPAIHLPLEDPYQMPNG

SEQ ID NO: 1520649 - protein, 18 aa, Mycobacterium tuberculosis
AGVRVPSTSPPRWGGKGF

SEQ ID NO: 1520650 - protein, 20 aa, Mycobacterium tuberculosis
AGVSGLWLLSGMRDDGVLTT

SEQ ID NO: 1520651 - protein, 25 aa, Mycobacterium tuberculosis
AGVSRPTVYRRWPDTRSIMASMLTS

SEQ ID NO: 1520652 - protein, 18 aa, Mycobacterium tuberculosis
AGWLSGNGGAGGSGGSAG

SEQ ID NO: 1520653 - protein, 25 aa, Mycobacterium tuberculosis
AGWLVHVLLDPRRVRWIVGERADTN

SEQ ID NO: 1520654 - protein, 18 aa, Mycobacterium tuberculosis
AGWPLSCSTPPTPSTTAA

SEQ ID NO: 1520655 - protein, 19 aa, Mycobacterium tuberculosis
AGYKVPRSLWFVDEVKRSP

SEQ ID NO: 1520656 - protein, 22 aa, Mycobacterium tuberculosis
AHAGYLRLMRSGVYVNPVAPPA

SEQ ID NO: 1520657 - protein, 19 aa, Mycobacterium tuberculosis
AHALARHFGARRKAYNWTV

SEQ ID NO: 1520658 - protein, 21 aa, Mycobacterium tuberculosis
AHCGSILRPRLSWNAQVIRRR

SEQ ID NO: 1520659 - protein, 24 aa, Mycobacterium tuberculosis
AHDEGWLAEHMLILKLISPENKAY

SEQ ID NO: 1520660 - protein, 26 aa, Mycobacterium tuberculosis
AHDEGWLAEHMLILKLISPENKAYYF

SEQ ID NO: 1520661 - protein, 25 aa, Mycobacterium tuberculosis
AHGGRLMAGWFAHTLRPAMLAAGRS

SEQ ID NO: 1520662 - protein, 17 aa, Mycobacterium tuberculosis
AHLGPLAIIGQSGQPGQ

SEQ ID NO: 1520663 - protein, 17 aa, Mycobacterium tuberculosis
AHLLAGQLAPGARVLIV

SEQ ID NO: 1520664 - protein, 17 aa, Mycobacterium tuberculosis
AHLLPYHHPVELAHRVA

SEQ ID NO: 1520665 - protein, 17 aa, Mycobacterium tuberculosis
AHLPGMVAAATPLPVIG

SEQ ID NO: 1520666 - protein, 26 aa, Mycobacterium tuberculosis
AHLRHPLFLDIMRPSAPAARSASPTP

SEQ ID NO: 1520667 - protein, 17 aa, Mycobacterium tuberculosis
AHLRSLLHEALIASGSA

SEQ ID NO: 1520668 - protein, 19 aa, Mycobacterium tuberculosis
AHPAALHLRPARRRISCCP

SEQ ID NO: 1520669 - protein, 25 aa, Mycobacterium tuberculosis
AHPLTITALYLPHLSATAALQAWDT

SEQ ID NO: 1520670 - protein, 18 aa, Mycobacterium tuberculosis
AHPPALPDPLPAGPTRRV

SEQ ID NO: 1520671 - protein, 22 aa, Mycobacterium tuberculosis
AHPTLRLTTNLRIGLEGREARA

SEQ ID NO: 1520672 - protein, 26 aa, Mycobacterium tuberculosis
AHPVQLRHTVLVPGPPPGSAIAGWDL

SEQ ID NO: 1520673 - protein, 17 aa, Mycobacterium tuberculosis
AHPWFQAALADLPGSPA

SEQ ID NO: 1520674 - protein, 20 aa, Mycobacterium tuberculosis
AHQALQPDVPRRRARRHRPR

SEQ ID NO: 1520675 - protein, 21 aa, Mycobacterium tuberculosis
AHQALQPDVPRRRARRHRPRR

SEQ ID NO: 1520676 - protein, 36 aa, Mycobacterium tuberculosis
AHQRRHRARRLRVGPRQPGVQWHQARLRTKPDQREH

SEQ ID NO: 1520677 - protein, 24 aa, Mycobacterium tuberculosis
AHRADAVVHRLALRGLDRPAATHR

SEQ ID NO: 1520678 - protein, 17 aa, Mycobacterium tuberculosis
AHRCVQPRRAAVVPIVP

SEQ ID NO: 1520679 - protein, 20 aa, Mycobacterium tuberculosis
AHRPRPGYLPVLRAYDYAGD

SEQ ID NO: 1520680 - protein, 27 aa, Mycobacterium tuberculosis
AHRRFADYRQTSFAQRARWANATADLL

SEQ ID NO: 1520681 - protein, 24 aa, Mycobacterium tuberculosis
AHRRVGRWFFRWERQTRRCMAAPG

SEQ ID NO: 1520682 - protein, 17 aa, Mycobacterium tuberculosis
AHRVVVDYLSSITPLGE

SEQ ID NO: 1520683 - protein, 18 aa, Mycobacterium tuberculosis
AHTKHYRVVSKPAALVHG

SEQ ID NO: 1520684 - protein, 19 aa, Mycobacterium tuberculosis
AHVAAQRFQQRVLGGPPAG

SEQ ID NO: 1520685 - protein, 18 aa, Mycobacterium tuberculosis
AHVDLLWSLSRAPDADAA

SEQ ID NO: 1520686 - protein, 18 aa, Mycobacterium tuberculosis
AHWFRQAGLREDDVVAIL

SEQ ID NO: 1520687 - protein, 21 aa, Mycobacterium tuberculosis
AHWRYRLLCERRQWCHRRERR

SEQ ID NO: 1520688 - protein, 20 aa, Mycobacterium tuberculosis
AHYHKIHLYDAFGFTESRTV

SEQ ID NO: 1520689 - protein, 19 aa, Mycobacterium tuberculosis
AIAALFGAHGRAYQAASAE

SEQ ID NO: 1520690 - protein, 18 aa, Mycobacterium tuberculosis
AIAANFRDIMITLGMFTH

SEQ ID NO: 1520691 - protein, 30 aa, Mycobacterium tuberculosis
AIAAQVVPWASLLQRFPGLGAGATGATGGE

SEQ ID NO: 1520692 - protein, 19 aa, Mycobacterium tuberculosis
AIAATEFDYVEMWAQDVGA

SEQ ID NO: 1520693 - protein, 26 aa, Mycobacterium tuberculosis
AIASSARPRRHWAAQAATGGTGGYIE

SEQ ID NO: 1520694 - protein, 20 aa, Mycobacterium tuberculosis
AICDRLGLLPMYAVNQDKHG

SEQ ID NO: 1520695 - protein, 21 aa, Mycobacterium tuberculosis
AICRFATWWVVLERHGNLVRL

SEQ ID NO: 1520696 - protein, 20 aa, Mycobacterium tuberculosis
AIDHLLRLCAGPRGRVMSRA

SEQ ID NO: 1520697 - protein, 19 aa, Mycobacterium tuberculosis
AIDLQRYGLTWKWPDVDCA

SEQ ID NO: 1520698 - protein, 25 aa, Mycobacterium tuberculosis
AIDMRRRRGLPPIAPHSGLGYAQNF

SEQ ID NO: 1520699 - protein, 23 aa, Mycobacterium tuberculosis
AIEALGPIALPVKTSADSGKLFG

SEQ ID NO: 1520700 - protein, 18 aa, Mycobacterium tuberculosis
AIFVYRQAIGLGARERQC

SEQ ID NO: 1520701 - protein, 26 aa, Mycobacterium tuberculosis
AIGGLYGDITYPVTSPLAITMGFAAC

SEQ ID NO: 1520702 - protein, 19 aa, Mycobacterium tuberculosis
AIGLGCDLDLVELAGLAHD

SEQ ID NO: 1520703 - protein, 19 aa, Mycobacterium tuberculosis
AIGMLSVPPAWAGQATLVS

SEQ ID NO: 1520704 - protein, 19 aa, Mycobacterium tuberculosis
AIHMVTLLEALPVQETLEA

SEQ ID NO: 1520705 - protein, 20 aa, Mycobacterium tuberculosis
AIHPLLMLNTLVGGMMAAAG

SEQ ID NO: 1520706 - protein, 27 aa, Mycobacterium tuberculosis
AIIDSALDGVLFLDEAYALVATGAKND

SEQ ID NO: 1520707 - protein, 19 aa, Mycobacterium tuberculosis
AILIDRVGFLRGRARPAST

SEQ ID NO: 1520708 - protein, 18 aa, Mycobacterium tuberculosis
AILPNGWRDRLVSWTVES

SEQ ID NO: 1520709 - protein, 19 aa, Mycobacterium tuberculosis
AILVPPGDGPWRLGLGSAG

SEQ ID NO: 1520710 - protein, 17 aa, Mycobacterium tuberculosis
AINAPTQALLGRPLIGN

SEQ ID NO: 1520711 - protein, 19 aa, Mycobacterium tuberculosis
AIPLGFDIRTSAGPLNIPI

SEQ ID NO: 1520712 - protein, 19 aa, Mycobacterium tuberculosis
AIPVVSFRLAGDRGYTEFD

SEQ ID NO: 1520713 - protein, 18 aa, Mycobacterium tuberculosis
AIRARLLDRMKDKWRSDL

SEQ ID NO: 1520714 - protein, 18 aa, Mycobacterium tuberculosis
AIRRGAQAILPTPAPLGG

SEQ ID NO: 1520715 - protein, 19 aa, Mycobacterium tuberculosis
AITKAWRGSAKRSPCPTPP

SEQ ID NO: 1520716 - protein, 26 aa, Mycobacterium tuberculosis
AITNTARPWHIGLYGNAGGLGPMQGH

SEQ ID NO: 1520717 - protein, 27 aa, Mycobacterium tuberculosis
AITTPALISGFFNTGSNMSGFFGGPPV

SEQ ID NO: 1520718 - protein, 24 aa, Mycobacterium tuberculosis
AITVARSVPSGYYPIYVTTSAGDS

SEQ ID NO: 1520719 - protein, 28 aa, Mycobacterium tuberculosis
AIVAWNVPLFLAVNKIAPALLAGCTIVL

SEQ ID NO: 1520720 - protein, 21 aa, Mycobacterium tuberculosis
AIVEFPPAGTLNGIAKRELRG

SEQ ID NO: 1520721 - protein, 21 aa, Mycobacterium tuberculosis
AIVEFPPAGTLSGIAKRELRG

SEQ ID NO: 1520722 - protein, 20 aa, Mycobacterium tuberculosis
AIVQIAARRPTTGHWQIVVI

SEQ ID NO: 1520723 - protein, 22 aa, Mycobacterium tuberculosis
AIVRDVLAAGDFWGGAGLGGLP

SEQ ID NO: 1520724 - protein, 22 aa, Mycobacterium tuberculosis
AIVRDVLAAGDFWGGAGSVACQ

SEQ ID NO: 1520725 - protein, 18 aa, Mycobacterium tuberculosis
AIWPPARTLRYDRQSPWL

SEQ ID NO: 1520726 - protein, 17 aa, Mycobacterium tuberculosis
AIYLLYTGGTTGFPKGV

SEQ ID NO: 1520727 - protein, 22 aa, Mycobacterium tuberculosis
AIYQRWQALGGMNSALGAPTSP

SEQ ID NO: 1520728 - protein, 20 aa, Mycobacterium tuberculosis
AIYVAAWKAKVKGITVYRYG

SEQ ID NO: 1520729 - protein, 25 aa, Mycobacterium tuberculosis
AKALAESIPAFGRPAAGAGTGSCRA

SEQ ID NO: 1520730 - protein, 19 aa, Mycobacterium tuberculosis
AKALARHFGARRKAYNWTV

SEQ ID NO: 1520731 - protein, 23 aa, Mycobacterium tuberculosis
AKALVYEMPHTLAALEVGRLSEW

SEQ ID NO: 1520732 - protein, 22 aa, Mycobacterium tuberculosis
AKAMGAIALFGESYPDEVRVVE

SEQ ID NO: 1520733 - protein, 18 aa, Mycobacterium tuberculosis
AKAPPSPYPARALAGGLH

SEQ ID NO: 1520734 - protein, 18 aa, Mycobacterium tuberculosis
AKDTLLGDRIISLSSRGP

SEQ ID NO: 1520735 - protein, 19 aa, Mycobacterium tuberculosis
AKELGLTPLARIVSTGVSG

SEQ ID NO: 1520736 - protein, 22 aa, Mycobacterium tuberculosis
AKGAEYPLLPDELAEALAGFIA

SEQ ID NO: 1520737 - protein, 26 aa, Mycobacterium tuberculosis
AKGLQFPIVYLPFAFNRNVRSDDILL

SEQ ID NO: 1520738 - protein, 27 aa, Mycobacterium tuberculosis
AKGLQFPIVYLPFAFNRNVRSDDILLY

SEQ ID NO: 1520739 - protein, 18 aa, Mycobacterium tuberculosis
AKGRIPCYVPVPTTIRGP

SEQ ID NO: 1520740 - protein, 20 aa, Mycobacterium tuberculosis
AKGSLFQYFADKRDLYAFIA

SEQ ID NO: 1520741 - protein, 17 aa, Mycobacterium tuberculosis
AKGWRPSARDAHPNLMI

SEQ ID NO: 1520742 - protein, 19 aa, Mycobacterium tuberculosis
AKIDLALGKLGLQPGMTLL

SEQ ID NO: 1520743 - protein, 26 aa, Mycobacterium tuberculosis
AKKRPEFGKLTPLYPNQRLRLETSTE

SEQ ID NO: 1520744 - protein, 20 aa, Mycobacterium tuberculosis
AKLANADFLAKAPDAVIAKI

SEQ ID NO: 1520745 - protein, 18 aa, Mycobacterium tuberculosis
AKLEGDAAFFWAPGGQHQ

SEQ ID NO: 1520746 - protein, 19 aa, Mycobacterium tuberculosis
AKLEGDAAFFWAPGGQHQC

SEQ ID NO: 1520747 - protein, 21 aa, Mycobacterium tuberculosis
AKLKPAFEGLAALGGFDDVAL

SEQ ID NO: 1520748 - protein, 20 aa, Mycobacterium tuberculosis
AKLRQAPILALGGRPEELRE

SEQ ID NO: 1520749 - protein, 20 aa, Mycobacterium tuberculosis
AKPDLLQLITTDSAPIITRA

SEQ ID NO: 1520750 - protein, 17 aa, Mycobacterium tuberculosis
AKPINISAQVLLDRERC

SEQ ID NO: 1520751 - protein, 23 aa, Mycobacterium tuberculosis
AKPQRRNASTSPRVGQRRRHRRR

SEQ ID NO: 1520752 - protein, 26 aa, Mycobacterium tuberculosis
AKQAQYVAQLHVWARREHPTHEDIVG

SEQ ID NO: 1520753 - protein, 26 aa, Mycobacterium tuberculosis
AKRDSEWMGRVHRFLGLQVGVILATM

SEQ ID NO: 1520754 - protein, 21 aa, Mycobacterium tuberculosis
AKRITAVMPFYPYARQDKKHR

SEQ ID NO: 1520755 - protein, 24 aa, Mycobacterium tuberculosis
AKRITAVMPFYPYARQDKKHRGRE

SEQ ID NO: 1520756 - protein, 26 aa, Mycobacterium tuberculosis
AKRLCERLLSFASPLLLYAEEIEPRS

SEQ ID NO: 1520757 - protein, 25 aa, Mycobacterium tuberculosis
AKRQATLNRLLFPSPTKEFNEHREA

SEQ ID NO: 1520758 - protein, 27 aa, Mycobacterium tuberculosis
AKRQNLLRKELAWLRAAHRRGPASPSS

SEQ ID NO: 1520759 - protein, 26 aa, Mycobacterium tuberculosis
AKRSPNWQRWWPLDSRRPAALQTELH

SEQ ID NO: 1520760 - protein, 39 aa, Mycobacterium tuberculosis
AKRYTGRGMAFLDLIQEGNLRLIRAVEKFDYTKGYKFST

SEQ ID NO: 1520761 - protein, 22 aa, Mycobacterium tuberculosis
AKSLGWRAAPIPRNAPGCRGCC

SEQ ID NO: 1520762 - protein, 29 aa, Mycobacterium tuberculosis
AKVERPDLVIGWWAAPTILEHGTPEQIER

SEQ ID NO: 1520763 - protein, 21 aa, Mycobacterium tuberculosis
AKVVLALQHDKLPPSINFAGP

SEQ ID NO: 1520764 - protein, 18 aa, Mycobacterium tuberculosis
ALAACDAAALFWSFELLI

SEQ ID NO: 1520765 - protein, 22 aa, Mycobacterium tuberculosis
ALAAQLRSYWARPLPATIVMRA

SEQ ID NO: 1520766 - protein, 29 aa, Mycobacterium tuberculosis
ALAARQRRFGVSYWTVFDEWAGRASAMRD

SEQ ID NO: 1520767 - protein, 25 aa, Mycobacterium tuberculosis
ALADKAMLSTWLATSPVGATVLAAL

SEQ ID NO: 1520768 - protein, 18 aa, Mycobacterium tuberculosis
ALADKLLPARFTAALAQA

SEQ ID NO: 1520769 - protein, 30 aa, Mycobacterium tuberculosis
ALAEYSLDLFALLPLGELWVAAARMRQVDQ

SEQ ID NO: 1520770 - protein, 28 aa, Mycobacterium tuberculosis
ALAFKIATHPFFGKLTYIRVYSGTVESG

SEQ ID NO: 1520771 - protein, 20 aa, Mycobacterium tuberculosis
ALAGFIAEFGLSLVGGCCGT

SEQ ID NO: 1520772 - protein, 18 aa, Mycobacterium tuberculosis
ALAGHLAAILYDIPHVLT

SEQ ID NO: 1520773 - protein, 19 aa, Mycobacterium tuberculosis
ALAHLDLLRVDKRVLDLAG

SEQ ID NO: 1520774 - protein, 18 aa, Mycobacterium tuberculosis
ALAIYPDGPTIAGDCGHS

SEQ ID NO: 1520775 - protein, 26 aa, Mycobacterium tuberculosis
ALAPDRPFFAYFAPGATHAPHHVPRE

SEQ ID NO: 1520776 - protein, 26 aa, Mycobacterium tuberculosis
ALAPDRPFFVHFAPGATHAPHHVPRE

SEQ ID NO: 1520777 - protein, 26 aa, Mycobacterium tuberculosis
ALAPDRPFFVYFAPGVTHAPHHVPRE

SEQ ID NO: 1520778 - protein, 25 aa, Mycobacterium tuberculosis
ALAPVRFFNPIAMRFAQKATREDID

SEQ ID NO: 1520779 - protein, 17 aa, Mycobacterium tuberculosis
ALAQHRANLGLKARIIG

SEQ ID NO: 1520780 - protein, 25 aa, Mycobacterium tuberculosis
ALARALPLSMSLLGVQFVMGTAAAH

SEQ ID NO: 1520781 - protein, 17 aa, Mycobacterium tuberculosis
ALARHFGARRKAYNLDR

SEQ ID NO: 1520782 - protein, 19 aa, Mycobacterium tuberculosis
ALARIRLPGGMITAAQLAT

SEQ ID NO: 1520783 - protein, 22 aa, Mycobacterium tuberculosis
ALAVHIAKITRREYPNQVLPEE

SEQ ID NO: 1520784 - protein, 17 aa, Mycobacterium tuberculosis
ALAVRGLGSCWIGSTIF

SEQ ID NO: 1520785 - protein, 27 aa, Mycobacterium tuberculosis
ALDASLLLVVLTRFLPPDDPRVRNTVL

SEQ ID NO: 1520786 - protein, 33 aa, Mycobacterium tuberculosis
ALDATARFGLLPLRWALACLLIDIGTVTFSAQQ

SEQ ID NO: 1520787 - protein, 24 aa, Mycobacterium tuberculosis
ALDDKFLHDMLAEELRYSVIREVL

SEQ ID NO: 1520788 - protein, 19 aa, Mycobacterium tuberculosis
ALDDVGFFTLLQPQQWGGL

SEQ ID NO: 1520789 - protein, 17 aa, Mycobacterium tuberculosis
ALDFAAVFTTPCVFYVQ

SEQ ID NO: 1520790 - protein, 18 aa, Mycobacterium tuberculosis
ALDFHQGVHRALVWSHLA

SEQ ID NO: 1520791 - protein, 17 aa, Mycobacterium tuberculosis
ALDLLLGSWPGENRTLA

SEQ ID NO: 1520792 - protein, 18 aa, Mycobacterium tuberculosis
ALDPTLWNTYLQGALRAY

SEQ ID NO: 1520793 - protein, 20 aa, Mycobacterium tuberculosis
ALDRGLVDELGGLRTAVRRA

SEQ ID NO: 1520794 - protein, 27 aa, Mycobacterium tuberculosis
ALDTINAPIRTLLGRAPLSPTDPAGPA

SEQ ID NO: 1520795 - protein, 30 aa, Mycobacterium tuberculosis
ALDVINAPAQTLLGRPLIGNGADGSTPGQA

SEQ ID NO: 1520796 - protein, 34 aa, Mycobacterium tuberculosis
ALDYSALYPAGWLVDAPLPAWTHARLFIDDDGQE

SEQ ID NO: 1520797 - protein, 17 aa, Mycobacterium tuberculosis
ALDYTLPWDVDTVEDSI

SEQ ID NO: 1520798 - protein, 22 aa, Mycobacterium tuberculosis
ALENRIKAMPPSSVVGLWTFDG

SEQ ID NO: 1520799 - protein, 17 aa, Mycobacterium tuberculosis
ALEPLCEDLTIPAQPQL

SEQ ID NO: 1520800 - protein, 34 aa, Mycobacterium tuberculosis
ALEQNLLAVINAPAQALFGRPLIGNGANGTAASP

SEQ ID NO: 1520801 - protein, 21 aa, Mycobacterium tuberculosis
ALESLYEWMWAQDAAAMAGYY

SEQ ID NO: 1520802 - protein, 28 aa, Mycobacterium tuberculosis
ALESVLTVLTLRDGVIPPTLNYETPDPE

SEQ ID NO: 1520803 - protein, 25 aa, Mycobacterium tuberculosis
ALFAADLARMYIRYAERHGWAVTVL

SEQ ID NO: 1520804 - protein, 19 aa, Mycobacterium tuberculosis
ALFAPFVPFFDPRRGRPST

SEQ ID NO: 1520805 - protein, 30 aa, Mycobacterium tuberculosis
ALFAWGLNQLVFLGLRPPPPQRYPLSEAQA

SEQ ID NO: 1520806 - protein, 25 aa, Mycobacterium tuberculosis
ALGDYEWILAFEAPELDRIVDLMRE

SEQ ID NO: 1520807 - protein, 26 aa, Mycobacterium tuberculosis
ALGEIRAIWRINELLNWQVASAGEDI

SEQ ID NO: 1520808 - protein, 17 aa, Mycobacterium tuberculosis
ALGHPLIDHVRGRGLLL

SEQ ID NO: 1520809 - protein, 21 aa, Mycobacterium tuberculosis
ALGIPIMGDPLYPNVISVAAH

SEQ ID NO: 1520810 - protein, 17 aa, Mycobacterium tuberculosis
ALGMYPGQAPPLGAEGA

SEQ ID NO: 1520811 - protein, 18 aa, Mycobacterium tuberculosis
ALGPKLPELWGGSADLAG

SEQ ID NO: 1520812 - protein, 28 aa, Mycobacterium tuberculosis
ALGSYGAFFNIYFCSVTIKINGPAGSDI

SEQ ID NO: 1520813 - protein, 28 aa, Mycobacterium tuberculosis
ALGTPRRHLSYKTGWYGSALVVADRWFP

SEQ ID NO: 1520814 - protein, 37 aa, Mycobacterium tuberculosis
ALGTPRRHLSYKTVWYGSALVVADRWFPSSKTCHACR

SEQ ID NO: 1520815 - protein, 20 aa, Mycobacterium tuberculosis
ALGVLELHPLLNPAGYVLAE

SEQ ID NO: 1520816 - protein, 17 aa, Mycobacterium tuberculosis
ALGWLPIEEIDAAASDD

SEQ ID NO: 1520817 - protein, 17 aa, Mycobacterium tuberculosis
ALHSWCLAAERPELVSA

SEQ ID NO: 1520818 - protein, 21 aa, Mycobacterium tuberculosis
ALHSWCLAAERPELVSALVVE

SEQ ID NO: 1520819 - protein, 38 aa, Mycobacterium tuberculosis; identical to SEQ ID NO: 236139

SEQ ID NO: 1520820 - protein, 20 aa, Mycobacterium tuberculosis
ALHYLARILVAGEDPRFIAP

SEQ ID NO: 1520821 - protein, 29 aa, Mycobacterium tuberculosis
ALIASDIPPLSWFLGNSPPPLLNSLLGQT

SEQ ID NO: 1520822 - protein, 18 aa, Mycobacterium tuberculosis
ALIIGPLRVQFWVCGVFE

SEQ ID NO: 1520823 - protein, 22 aa, Mycobacterium tuberculosis
ALIQQTLPYVQWLTTTAEHAHK

SEQ ID NO: 1520824 - protein, 18 aa, Mycobacterium tuberculosis
ALKFYASVRMGRAASRDA

SEQ ID NO: 1520825 - protein, 21 aa, Mycobacterium tuberculosis
ALKGAHFIELCDKRKIPLLFL

SEQ ID NO: 1520826 - protein, 26 aa, Mycobacterium tuberculosis
ALKSPVLPVPLLPMPVLKLPELNNPQ

SEQ ID NO: 1520827 - protein, 26 aa, Mycobacterium tuberculosis
ALLAADAGVPVLLAPAADAATAASAD

SEQ ID NO: 1520828 - protein, 19 aa, Mycobacterium tuberculosis
ALLAEIRQSLDATKGLTSV

SEQ ID NO: 1520829 - protein, 17 aa, Mycobacterium tuberculosis
ALLAGLQDRHGPVMFHQ

SEQ ID NO: 1520830 - protein, 18 aa, Mycobacterium tuberculosis
ALLALARAEYRILGPQYK

SEQ ID NO: 1520831 - protein, 29 aa, Mycobacterium tuberculosis
ALLDDDDFAKHPFLVKGYIGPKALRENNV

SEQ ID NO: 1520832 - protein, 19 aa, Mycobacterium tuberculosis
ALLDIYRKLRPGEPPTKES

SEQ ID NO: 1520833 - protein, 19 aa, Mycobacterium tuberculosis
ALLGAKPFTFDPAALAAAQ

SEQ ID NO: 1520834 - protein, 19 aa, Mycobacterium tuberculosis
ALLGDARWLASIATPGRDE

SEQ ID NO: 1520835 - protein, 19 aa, Mycobacterium tuberculosis
ALLKLPVANWPALGGMGNA

SEQ ID NO: 1520836 - protein, 18 aa, Mycobacterium tuberculosis
ALLKVVEEPPPSTVFLLC

SEQ ID NO: 1520837 - protein, 26 aa, Mycobacterium tuberculosis
ALLLASCLQPLWRARGRLQDGLAWFA

SEQ ID NO: 1520838 - protein, 25 aa, Mycobacterium tuberculosis
ALLLASCLQPLWRARGRLQEGLAWF

SEQ ID NO: 1520839 - protein, 26 aa, Mycobacterium tuberculosis
ALLRARVERMHRACLILTFGGGTNEV

SEQ ID NO: 1520840 - protein, 17 aa, Mycobacterium tuberculosis
ALLRVYRDKLPHRYAKA

SEQ ID NO: 1520841 - protein, 18 aa, Mycobacterium tuberculosis
ALLVVKRGPNAGSRFLLD

SEQ ID NO: 1520842 - protein, 28 aa, Mycobacterium tuberculosis
ALMCSAATMYTPERVTFFCIGGATMAQI

SEQ ID NO: 1520843 - protein, 20 aa, Mycobacterium tuberculosis
ALMMRRVMPLLTIGDQFPAY

SEQ ID NO: 1520844 - protein, 26 aa, Mycobacterium tuberculosis
ALNETRTGDLWLFRGRSRPDRAIQTL

SEQ ID NO: 1520845 - protein, 19 aa, Mycobacterium tuberculosis
ALNEVSLEKGPRLGVLGVV

SEQ ID NO: 1520846 - protein, 17 aa, Mycobacterium tuberculosis
ALNLVKCVHWPSSSPPQ

SEQ ID NO: 1520847 - protein, 26 aa, Mycobacterium tuberculosis
ALNPDTFYWAHATFFMLVIKVAEYFC

SEQ ID NO: 1520848 - protein, 28 aa, Mycobacterium tuberculosis
ALNVINAPTQTLLGRPLIGNGTNGAPGD

SEQ ID NO: 1520849 - protein, 30 aa, Mycobacterium tuberculosis
ALNVINAPTQTLLGRPLIGNGTNGAPGTGQ

SEQ ID NO: 1520850 - protein, 19 aa, Mycobacterium tuberculosis
ALPAPLQSGGNGATGGNGG

SEQ ID NO: 1520851 - protein, 20 aa, Mycobacterium tuberculosis
ALPAWVYIDHRVMPGRPRPG

SEQ ID NO: 1520852 - protein, 17 aa, Mycobacterium tuberculosis
ALPDMRVNIDIKAASAI

SEQ ID NO: 1520853 - protein, 26 aa, Mycobacterium tuberculosis
ALPEPARRLAAVARLRLLCRGSGITD

SEQ ID NO: 1520854 - protein, 24 aa, Mycobacterium tuberculosis
ALPGADLRRTARRQADRRGAAPGA

SEQ ID NO: 1520855 - protein, 25 aa, Mycobacterium tuberculosis
ALPGVGACPPLPPSPAAAAAADQPA

SEQ ID NO: 1520856 - protein, 17 aa, Mycobacterium tuberculosis
ALPHPRTRRRRVHTATG

SEQ ID NO: 1520857 - protein, 19 aa, Mycobacterium tuberculosis
ALPSPPRGFTPAPPPQWDD

SEQ ID NO: 1520858 - protein, 17 aa, Mycobacterium tuberculosis
ALPSRLAPLTANTITDR

SEQ ID NO: 1520859 - protein, 18 aa, Mycobacterium tuberculosis
ALPVGMQASVFPLVVTPK

SEQ ID NO: 1520860 - protein, 20 aa, Mycobacterium tuberculosis
ALPVLTMVCGYSRWASALLI

SEQ ID NO: 1520861 - protein, 21 aa, Mycobacterium tuberculosis
ALQIHGAIAFTWEHDLHLYYA

SEQ ID NO: 1520862 - protein, 17 aa, Mycobacterium tuberculosis
ALQLELLNAINAPTLAL

SEQ ID NO: 1520863 - protein, 32 aa, Mycobacterium tuberculosis
ALQRRLGFTSRAPRWAIAYKYPPEEAQTKLLD

SEQ ID NO: 1520864 - protein, 18 aa, Mycobacterium tuberculosis
ALQSALPPRFQSNSAFAA

SEQ ID NO: 1520865 - protein, 26 aa, Mycobacterium tuberculosis
ALRAYWELPAMMLQFLRTGSGATRPA

SEQ ID NO: 1520866 - protein, 27 aa, Mycobacterium tuberculosis
ALRDSHPIRIPSTLLGLLSEIPRCPPE

SEQ ID NO: 1520867 - protein, 17 aa, Mycobacterium tuberculosis
ALRDTHVELERLVHALP

SEQ ID NO: 1520868 - protein, 25 aa, Mycobacterium tuberculosis
ALRDTLAAHPGTSLILLDTASDPRK

SEQ ID NO: 1520869 - protein, 17 aa, Mycobacterium tuberculosis
ALRPLISYYTDLRRDEW

SEQ ID NO: 1520870 - protein, 18 aa, Mycobacterium tuberculosis
ALRRKFSASQFLADVRRY

SEQ ID NO: 1520871 - protein, 19 aa, Mycobacterium tuberculosis
ALRSRLLVRLGGAGGMVSL

SEQ ID NO: 1520872 - protein, 18 aa, Mycobacterium tuberculosis
ALRVLVGRGQRTAWHPGA

SEQ ID NO: 1520873 - protein, 19 aa, Mycobacterium tuberculosis
ALRVLVGRGQRTAWHPGAI

SEQ ID NO: 1520874 - protein, 26 aa, Mycobacterium tuberculosis
ALSAQAALFHEQFVRALTAGAGSYAD

SEQ ID NO: 1520875 - protein, 29 aa, Mycobacterium tuberculosis
ALSAQLAVFHERFVQALTGAAKGYAAAEL

SEQ ID NO: 1520876 - protein, 29 aa, Mycobacterium tuberculosis
ALSGYVEILPTPFLPAGVFDLWGLEADDS

SEQ ID NO: 1520877 - protein, 18 aa, Mycobacterium tuberculosis
ALSLGFRVRVAATVASPA

SEQ ID NO: 1520878 - protein, 20 aa, Mycobacterium tuberculosis
ALSLRLIEPPPSLSRPRREP

SEQ ID NO: 1520879 - protein, 24 aa, Mycobacterium tuberculosis
ALSPVLAAILHNASSVAVVANSSR

SEQ ID NO: 1520880 - protein, 24 aa, Mycobacterium tuberculosis
ALSRYSYLVSLLPSRIVADLGAPV

SEQ ID NO: 1520881 - protein, 43 aa, Mycobacterium tuberculosis; identical to SEQ ID NO: 1479864

SEQ ID NO: 1520882 - protein, 19 aa, Mycobacterium tuberculosis
ALTALLAAGFVRTPRGLRR

SEQ ID NO: 1520883 - protein, 31 aa, Mycobacterium tuberculosis
ALTAVAMLVAIFRARPSPFYIMDEVEAALDD

SEQ ID NO: 1520884 - protein, 32 aa, Mycobacterium tuberculosis
ALTFEHPYREPLWTQLITAYYLSDRQSDALGA

SEQ ID NO: 1520885 - protein, 18 aa, Mycobacterium tuberculosis
ALTIPADWSTQPVVSGPG

SEQ ID NO: 1520886 - protein, 26 aa, Mycobacterium tuberculosis
ALTIVPSYNIHLFLEGIQQALKGDPM

SEQ ID NO: 1520887 - protein, 18 aa, Mycobacterium tuberculosis
ALTKPRVIELLLVTAIPA

SEQ ID NO: 1520888 - protein, 20 aa, Mycobacterium tuberculosis
ALTRDWFTSTFAAPTAAQAS

SEQ ID NO: 1520889 - protein, 18 aa, Mycobacterium tuberculosis
ALTRVLRANIGPASDSGP

SEQ ID NO: 1520890 - protein, 22 aa, Mycobacterium tuberculosis
ALTTMPIPVIAAVRGLAVGGGC

SEQ ID NO: 1520891 - protein, 23 aa, Mycobacterium tuberculosis
ALVTGLGLLRRRGLRQAVASGIA

SEQ ID NO: 1520892 - protein, 20 aa, Mycobacterium tuberculosis
ALWAATFLRRRGAAADAVLL

SEQ ID NO: 1520893 - protein, 19 aa, Mycobacterium tuberculosis
ALWAVHLHFDPSPEPWSIV

SEQ ID NO: 1520894 - protein, 18 aa, Mycobacterium tuberculosis
ALWRRFKAAQDSFFTARN

SEQ ID NO: 1520895 - protein, 17 aa, Mycobacterium tuberculosis
ALWSDDLLTRVAIEPLD

SEQ ID NO: 1520896 - protein, 19 aa, Mycobacterium tuberculosis
ALWSLRPVLPMPGRGCQLL

SEQ ID NO: 1520897 - protein, 24 aa, Mycobacterium tuberculosis
ALYQYAWTRDRLLIVTLADVASRV

SEQ ID NO: 1520898 - protein, 24 aa, Mycobacterium tuberculosis
AMAAAAAPYAGWLAAAAARAAGAS

SEQ ID NO: 1520899 - protein, 24 aa, Mycobacterium tuberculosis
AMAAAAAPYAGWLGSVAAAAEAVV

SEQ ID NO: 1520900 - protein, 24 aa, Mycobacterium tuberculosis
AMAAAAAPYAGWLSAAAASAESAA

SEQ ID NO: 1520901 - protein, 20 aa, Mycobacterium tuberculosis
AMAQQLAGTPGATVAGGAAV

SEQ ID NO: 1520902 - protein, 18 aa, Mycobacterium tuberculosis
AMAVPLGWAATVVGEGGF

SEQ ID NO: 1520903 - protein, 33 aa, Mycobacterium tuberculosis
AMAWRARPSWVWRPPTRGWTGCWRSPINPTWCS

SEQ ID NO: 1520904 - protein, 21 aa, Mycobacterium tuberculosis
AMCGLFHGPRLRDMDARHGGS

SEQ ID NO: 1520905 - protein, 23 aa, Mycobacterium tuberculosis
AMDPQQRLLLEVSWEALERTGID

SEQ ID NO: 1520906 - protein, 25 aa, Mycobacterium tuberculosis
AMEARPHLPMTPVAGYWVTGRASAR

SEQ ID NO: 1520907 - protein, 33 aa, Mycobacterium tuberculosis
AMGAVSASAQTLLSRPLIGNGANATTPGGNGGD

SEQ ID NO: 1520908 - protein, 20 aa, Mycobacterium tuberculosis
AMGPMQFISETWRLYGVAAR

SEQ ID NO: 1520909 - protein, 29 aa, Mycobacterium tuberculosis
AMGYEPEDLPWEVPLIELGLDSLMAVRIK

SEQ ID NO: 1520910 - protein, 17 aa, Mycobacterium tuberculosis
AMLPGHAVVLHPGPMVR

SEQ ID NO: 1520911 - protein, 18 aa, Mycobacterium tuberculosis
AMLRDLAALRWLDAGESV

SEQ ID NO: 1520912 - protein, 23 aa, Mycobacterium tuberculosis
AMLTLPPVGPSIGWRTSTRLPRD

SEQ ID NO: 1520913 - protein, 26 aa, Mycobacterium tuberculosis
AMMAVATQYLAWLSTAAAQAEQAAAQ

SEQ ID NO: 1520914 - protein, 18 aa, Mycobacterium tuberculosis
AMPTAPFNVSGNPAICLP

SEQ ID NO: 1520915 - protein, 31 aa, Mycobacterium tuberculosis
AMQAGGLTVYSGEWWHFDGPGAGVDRPILEV

SEQ ID NO: 1520916 - protein, 18 aa, Mycobacterium tuberculosis
AMRDYVERFRRIEALARS

SEQ ID NO: 1520917 - protein, 17 aa, Mycobacterium tuberculosis
AMRLRPGERHWMAFRQL

SEQ ID NO: 1520918 - protein, 23 aa, Mycobacterium tuberculosis
AMSAFNAWVLLKGLETLAIRVQH

SEQ ID NO: 1520919 - protein, 23 aa, Mycobacterium tuberculosis
AMSALPPAPPAPPGAPGATGTAV

SEQ ID NO: 1520920 - protein, 29 aa, Mycobacterium tuberculosis
AMSPNALQHYSVFGLLPIAVGQKTGALGV

SEQ ID NO: 1520921 - protein, 19 aa, Mycobacterium tuberculosis
AMTGAAAPYLGWLSAAAAQ

SEQ ID NO: 1520922 - protein, 24 aa, Mycobacterium tuberculosis
AMTVPPAEVAANRALLAALVATNV

SEQ ID NO: 1520923 - protein, 25 aa, Mycobacterium tuberculosis
AMVDPVVVAANRSAFVQLVLSNVFG

SEQ ID NO: 1520924 - protein, 21 aa, Mycobacterium tuberculosis
AMVIDLLLKRAASLGIQIRYE

SEQ ID NO: 1520925 - protein, 31 aa, Mycobacterium tuberculosis
AMVQSLLVRSLVAWFWDQPLRAPLIRHGANL

SEQ ID NO: 1520926 - protein, 25 aa, Mycobacterium tuberculosis
ANDQFAGELLVWLRDRLSHFKCPRS

SEQ ID NO: 1520927 - protein, 20 aa, Mycobacterium tuberculosis
ANEALYDWNYQRQLLSIRLA

SEQ ID NO: 1520928 - protein, 18 aa, Mycobacterium tuberculosis
ANELLFERFLSPARDGPP

SEQ ID NO: 1520929 - protein, 19 aa, Mycobacterium tuberculosis
ANFEAANVQQSLLNAINAP

SEQ ID NO: 1520930 - protein, 24 aa, Mycobacterium tuberculosis
ANFRDIMITLGMFTHDALLGGEGA

SEQ ID NO: 1520931 - protein, 19 aa, Mycobacterium tuberculosis
ANGPAIAAHAGHRANPVAT

SEQ ID NO: 1520932 - protein, 19 aa, Mycobacterium tuberculosis
ANHEYLGPVLWSPAGKPPT

SEQ ID NO: 1520933 - protein, 22 aa, Mycobacterium tuberculosis
ANHLIAGLIAAGAIDVGIACGI

SEQ ID NO: 1520934 - protein, 22 aa, Mycobacterium tuberculosis
ANHRQPRCLPQRIAVPVTKLKT

SEQ ID NO: 1520935 - protein, 21 aa, Mycobacterium tuberculosis
ANIPLVTQRLSFHTRRPVLTA

SEQ ID NO: 1520936 - protein, 24 aa, Mycobacterium tuberculosis
ANKDAWMVGYTPSLSTAVWVGTVK

SEQ ID NO: 1520937 - protein, 17 aa, Mycobacterium tuberculosis
ANLALWSASAHGAGYVL

SEQ ID NO: 1520938 - protein, 23 aa, Mycobacterium tuberculosis
ANLKCLCRLHHLLATFCGWRAQQ

SEQ ID NO: 1520939 - protein, 25 aa, Mycobacterium tuberculosis
ANNHFRVLFFRWGQHPVALTAFYKN

SEQ ID NO: 1520940 - protein, 19 aa, Mycobacterium tuberculosis
ANPAGLIDITRFWFEQGSL

SEQ ID NO: 1520941 - protein, 20 aa, Mycobacterium tuberculosis
ANPTYIVDLIKKVTTVSVET

SEQ ID NO: 1520942 - protein, 24 aa, Mycobacterium tuberculosis
ANRANLVYWAAANLRDPGARVPAN

SEQ ID NO: 1520943 - protein, 31 aa, Mycobacterium tuberculosis
ANREAFLALIRSNWLGLNAPWIAAVESLYEE

SEQ ID NO: 1520944 - protein, 23 aa, Mycobacterium tuberculosis
ANRGLMQLLAATNWFGQNAPALM

SEQ ID NO: 1520945 - protein, 25 aa, Mycobacterium tuberculosis
ANRGLMQLLAATNWFGQNAPALMDV

SEQ ID NO: 1520946 - protein, 27 aa, Mycobacterium tuberculosis
ANRRAALAALLSQLPRSDLETLRKALA

SEQ ID NO: 1520947 - protein, 26 aa, Mycobacterium tuberculosis
ANSGVLNSGFFNSGVHNSGGFNSENQ

SEQ ID NO: 1520948 - protein, 23 aa, Mycobacterium tuberculosis
ANTPQSYWLDQAFPPATVGGTVA

SEQ ID NO: 1520949 - protein, 20 aa, Mycobacterium tuberculosis
ANVARWPSMTKARLAGQVDK

SEQ ID NO: 1520950 - protein, 34 aa, Mycobacterium tuberculosis
ANVEQQLLGAINAPTMALLGRPLIGHGADGAPGT

SEQ ID NO: 1520951 - protein, 18 aa, Mycobacterium tuberculosis
ANVFFMLGGQRLDLSSLQ

SEQ ID NO: 1520952 - protein, 24 aa, Mycobacterium tuberculosis
ANVRGAWLVCWAAGRVLLEQGQGG

SEQ ID NO: 1520953 - protein, 20 aa, Mycobacterium tuberculosis
APAASAPLRLAASAAVTAGT

SEQ ID NO: 1520954 - protein, 19 aa, Mycobacterium tuberculosis
APADLITEYGPHVALPPTE

SEQ ID NO: 1520955 - protein, 29 aa, Mycobacterium tuberculosis
APAHPPALPDPLPAGPTRRVPLGLIAGAR

SEQ ID NO: 1520956 - protein, 19 aa, Mycobacterium tuberculosis
APALRLGPRMGPLVHRPQP

SEQ ID NO: 1520957 - protein, 17 aa, Mycobacterium tuberculosis
APAMHTEMWLHPATVDN

SEQ ID NO: 1520958 - protein, 24 aa, Mycobacterium tuberculosis
APAMHTEMWLHPATVDNVDTLRRR

SEQ ID NO: 1520959 - protein, 30 aa, Mycobacterium tuberculosis
APAPHHTRPTRFVWLQTPAIRARLLDRMKD

SEQ ID NO: 1520960 - protein, 20 aa, Mycobacterium tuberculosis
APAQALLGRPLIGNGANGAD

SEQ ID NO: 1520961 - protein, 21 aa, Mycobacterium tuberculosis
APAQTLLGRPLIGNGADGSTP

SEQ ID NO: 1520962 - protein, 26 aa, Mycobacterium tuberculosis
APASASPLHTLKQQALAAINAPTQTL

SEQ ID NO: 1520963 - protein, 20 aa, Mycobacterium tuberculosis
APASTPLHTLQQQILNAINE

SEQ ID NO: 1520964 - protein, 22 aa, Mycobacterium tuberculosis
APATRPPPITSSRLPARCWAPE

SEQ ID NO: 1520965 - protein, 23 aa, Mycobacterium tuberculosis
APAVIARYPAPPGAPTVLLYAHH

SEQ ID NO: 1520966 - protein, 18 aa, Mycobacterium tuberculosis
APCRGTPTSGWTPKMPST

SEQ ID NO: 1520967 - protein, 29 aa, Mycobacterium tuberculosis
APDAGPPQRWFVVWLGTANNPVDKGAAKA

SEQ ID NO: 1520968 - protein, 21 aa, Mycobacterium tuberculosis
APDFRLFWDNAYAVHTLTLDF

SEQ ID NO: 1520969 - protein, 23 aa, Mycobacterium tuberculosis
APDHLRLVTLPWSRDLAAAIERL

SEQ ID NO: 1520970 - protein, 19 aa, Mycobacterium tuberculosis
APDLLLAQALLRTQHIKLA

SEQ ID NO: 1520971 - protein, 22 aa, Mycobacterium tuberculosis
APDRYVLVFNGEIYNYLELRDE

SEQ ID NO: 1520972 - protein, 21 aa, Mycobacterium tuberculosis
APDTMTWVTALLPVARGVSVY

SEQ ID NO: 1520973 - protein, 24 aa, Mycobacterium tuberculosis
APDTMTYLTALLPVAQGVSVYAAL

SEQ ID NO: 1520974 - protein, 18 aa, Mycobacterium tuberculosis
APECAGSVEIDATGALSC

SEQ ID NO: 1520975 - protein, 17 aa, Mycobacterium tuberculosis
APELARALLPMHDTPLG

SEQ ID NO: 1520976 - protein, 24 aa, Mycobacterium tuberculosis
APELARALLPMHDTPLGPAAAALT

SEQ ID NO: 1520977 - protein, 24 aa, Mycobacterium tuberculosis
APENATAWGLLLTALTGPDVTLLG

SEQ ID NO: 1520978 - protein, 24 aa, Mycobacterium tuberculosis
APERLRSGWLNGIKHWQVDYTGRC

SEQ ID NO: 1520979 - protein, 42 aa, Mycobacterium tuberculosis; identical to SEQ ID NO: 216225

SEQ ID NO: 1520980 - protein, 18 aa, Mycobacterium tuberculosis
APEVMIPDPMRVLRVGGC

SEQ ID NO: 1520981 - protein, 17 aa, Mycobacterium tuberculosis
APFGSPLASLAAAAEPA

SEQ ID NO: 1520982 - protein, 20 aa, Mycobacterium tuberculosis
APFLQQYLANQFGYGQLTLT

SEQ ID NO: 1520983 - protein, 24 aa, Mycobacterium tuberculosis
APFRHIPQAPQRPAPLPGQDSVQI

SEQ ID NO: 1520984 - protein, 35 aa, Mycobacterium tuberculosis
APFSFVLAPWQIHDWILLTPWGLLSWPQINQQLGI

SEQ ID NO: 1520985 - protein, 17 aa, Mycobacterium tuberculosis
APFTSLTRPHWVSDGGL

SEQ ID NO: 1520986 - protein, 23 aa, Mycobacterium tuberculosis
APGARLVFNAFLANGDYAPDQAA

SEQ ID NO: 1520987 - protein, 20 aa, Mycobacterium tuberculosis
APGGWLIGNGGAGGSGAANN

SEQ ID NO: 1520988 - protein, 33 aa, Mycobacterium tuberculosis
APGLGRTALAARLPLAYALGWQSRGREADAVLA

SEQ ID NO: 1520989 - protein, 18 aa, Mycobacterium tuberculosis
APGLIRELRPLPTALPHP

SEQ ID NO: 1520990 - protein, 18 aa, Mycobacterium tuberculosis
APGLRGPVLVLGGPGTGK

SEQ ID NO: 1520991 - protein, 27 aa, Mycobacterium tuberculosis
APGRAIPFGAFRHLISLPASGADIGRP

SEQ ID NO: 1520992 - protein, 20 aa, Mycobacterium tuberculosis
APGWRPVRRVLRSPAGPRRR

SEQ ID NO: 1520993 - protein, 17 aa, Mycobacterium tuberculosis
APGWVWSPDLNQCVFWL

SEQ ID NO: 1520994 - protein, 19 aa, Mycobacterium tuberculosis
APHALSMLRGFNLMKQLEE

SEQ ID NO: 1520995 - protein, 23 aa, Mycobacterium tuberculosis
APHSPAVRLAPGPARCCVVLKRC

SEQ ID NO: 1520996 - protein, 17 aa, Mycobacterium tuberculosis
APIQQMIDFMAARTAFF

SEQ ID NO: 1520997 - protein, 26 aa, Mycobacterium tuberculosis
APITVLPPIHIPPIPVGFAAVGGIGP

SEQ ID NO: 1520998 - protein, 18 aa, Mycobacterium tuberculosis
APIWTGSRCVDTAGRRPP

SEQ ID NO: 1520999 - protein, 19 aa, Mycobacterium tuberculosis
APKDLEKIIYFAAYVITSV

SEQ ID NO: 1521000 - protein, 25 aa, Mycobacterium tuberculosis
APKLDPALLDLGVPVLGICYGFQAM

SEQ ID NO: 1521001 - protein, 34 aa, Mycobacterium tuberculosis
APKRLGSFMDSRLWRLLLAPGRGIGRLITGVMGL

SEQ ID NO: 1521002 - protein, 19 aa, Mycobacterium tuberculosis
APLDAFVVRKLGAPGHDEF

SEQ ID NO: 1521003 - protein, 33 aa, Mycobacterium tuberculosis; identical to SEQ ID NO: 227267

SEQ ID NO: 1521004 - protein, 31 aa, Mycobacterium tuberculosis
APLEGVLDVINAPALALMGRPLIGNEANGAP

SEQ ID NO: 1521005 - protein, 18 aa, Mycobacterium tuberculosis
APLLGIPIAVKGRRRRCW

SEQ ID NO: 1521006 - protein, 19 aa, Mycobacterium tuberculosis
APLNWCNPSGRALGAPPTT

SEQ ID NO: 1521007 - protein, 20 aa, Mycobacterium tuberculosis
APLRPMLPLWPPSRVPSPPV

SEQ ID NO: 1521008 - protein, 26 aa, Mycobacterium tuberculosis
APLSTVISALHRSPWEICWSCRVRSA

SEQ ID NO: 1521009 - protein, 20 aa, Mycobacterium tuberculosis
APMLLEVYLQRIERLDSHLR

SEQ ID NO: 1521010 - protein, 23 aa, Mycobacterium tuberculosis
APNNWYGLFPNPVVAESLLDRLI

SEQ ID NO: 1521011 - protein, 18 aa, Mycobacterium tuberculosis
APNRLWVADLTYVSTWQG

SEQ ID NO: 1521012 - protein, 20 aa, Mycobacterium tuberculosis
APNTWLPFGGGVRRCLGFGF

SEQ ID NO: 1521013 - protein, 24 aa, Mycobacterium tuberculosis
APPAPPIPLLAVAVPPAPPAPPLP

SEQ ID NO: 1521014 - protein, 25 aa, Mycobacterium tuberculosis
APPAPPIPLLAVAVPPAPPAPPLPN

SEQ ID NO: 1521015 - protein, 24 aa, Mycobacterium tuberculosis
APPPPPPPPPPPPTPMPIAAGEPP

SEQ ID NO: 1521016 - protein, 23 aa, Mycobacterium tuberculosis
APPRRATLVVPFLGAHRASRSPR

SEQ ID NO: 1521017 - protein, 25 aa, Mycobacterium tuberculosis
APPSPPLLAWALKVPLPSPPAPPPP

SEQ ID NO: 1521018 - protein, 18 aa, Mycobacterium tuberculosis
APPTPATAAARGSSARWC

SEQ ID NO: 1521019 - protein, 21 aa, Mycobacterium tuberculosis
APRATISELRYPATAFTDAID

SEQ ID NO: 1521020 - protein, 21 aa, Mycobacterium tuberculosis
APRFHPSYRHAAAVRREIGVP

SEQ ID NO: 1521021 - protein, 22 aa, Mycobacterium tuberculosis
APRLLLEVVCARLLLPSASDAE

SEQ ID NO: 1521022 - protein, 19 aa, Mycobacterium tuberculosis
APRPRTLVFGAIDFAAALA

SEQ ID NO: 1521023 - protein, 20 aa, Mycobacterium tuberculosis
APRQAFVFPGQGGHWPGMGA

SEQ ID NO: 1521024 - protein, 20 aa, Mycobacterium tuberculosis
APRRLVVRQYRLPRIGDDDA

SEQ ID NO: 1521025 - protein, 22 aa, Mycobacterium tuberculosis
APRRQNLPPAPRRSATPVGVPS

SEQ ID NO: 1521026 - protein, 19 aa, Mycobacterium tuberculosis
APRSPLPPAVGPAGHRRGG

SEQ ID NO: 1521027 - protein, 25 aa, Mycobacterium tuberculosis
APSASWMLEYYPIRELRQLPDGSCE

SEQ ID NO: 1521028 - protein, 17 aa, Mycobacterium tuberculosis
APSCIIIAASRRGDTPA

SEQ ID NO: 1521029 - protein, 25 aa, Mycobacterium tuberculosis
APSTGPSMGILPAGGVGGPGGSGGA

SEQ ID NO: 1521030 - protein, 26 aa, Mycobacterium tuberculosis
APSTGPSMGILPAGGVGGPGGSGGAS

SEQ ID NO: 1521031 - protein, 25 aa, Mycobacterium tuberculosis
APSTSTGIWLPPKRAATSTSCSRRS

SEQ ID NO: 1521032 - protein, 21 aa, Mycobacterium tuberculosis
APTEALLGRPLIGNGADGTAP

SEQ ID NO: 1521033 - protein, 19 aa, Mycobacterium tuberculosis
APTLALLGRPLIGDGTDAA

SEQ ID NO: 1521034 - protein, 18 aa, Mycobacterium tuberculosis
APTLLYLAAAGVGTIGIV

SEQ ID NO: 1521035 - protein, 21 aa, Mycobacterium tuberculosis
APTLYIFPHAGGTAKDYVAFS

SEQ ID NO: 1521036 - protein, 19 aa, Mycobacterium tuberculosis
APTMALLGRPLIGHGADGA

SEQ ID NO: 1521037 - protein, 17 aa, Mycobacterium tuberculosis
APTPIQIRTVGRLLGWR

SEQ ID NO: 1521038 - protein, 18 aa, Mycobacterium tuberculosis
APTPIQIRTVGRLLGWRL

SEQ ID NO: 1521039 - protein, 19 aa, Mycobacterium tuberculosis
APTPKAEPAPSPPAAQPAG

SEQ ID NO: 1521040 - protein, 21 aa, Mycobacterium tuberculosis
APTRGAPLCGFRQTSRILAGL

SEQ ID NO: 1521041 - protein, 24 aa, Mycobacterium tuberculosis
APTWLKTVPKRLSALLNTSGLPAV

SEQ ID NO: 1521042 - protein, 19 aa, Mycobacterium tuberculosis
APVGPVAPVAPASAAARMA

SEQ ID NO: 1521043 - protein, 28 aa, Mycobacterium tuberculosis
APVGTRQLLLVNLLTDMFPALAVAVTSQ

SEQ ID NO: 1521044 - protein, 22 aa, Mycobacterium tuberculosis
APVLELLTSWRNPPQALRVANG

SEQ ID NO: 1521045 - protein, 26 aa, Mycobacterium tuberculosis
APVLWDEMPTLPLYRQQRTLLMSTKM

SEQ ID NO: 1521046 - protein, 27 aa, Mycobacterium tuberculosis
APVLWDEMPTLPLYRQQRTLLMSTKMY

SEQ ID NO: 1521047 - protein, 25 aa, Mycobacterium tuberculosis
APVQRTWPELIPLLQSGRLDVDGIF

SEQ ID NO: 1521048 - protein, 26 aa, Mycobacterium tuberculosis
APVRPWPPLPPLPPLPPLPPSPPSPS

SEQ ID NO: 1521049 - protein, 18 aa, Mycobacterium tuberculosis
APVVMAWLKEIKADPAKV

SEQ ID NO: 1521050 - protein, 20 aa, Mycobacterium tuberculosis
APVVRVSALKALEGDAKWVA

SEQ ID NO: 1521051 - protein, 17 aa, Mycobacterium tuberculosis
APYAGFLTTASAQAQLA

SEQ ID NO: 1521052 - protein, 24 aa, Mycobacterium tuberculosis
APYLARTMPQLLSVEWLRGRCDPY

SEQ ID NO: 1521053 - protein, 23 aa, Mycobacterium tuberculosis
APYLGFQLGSMWYISLDYINHQT

SEQ ID NO: 1521054 - protein, 17 aa, Mycobacterium tuberculosis
AQAAAFHQQFVQTLAGG

SEQ ID NO: 1521055 - protein, 23 aa, Mycobacterium tuberculosis
AQAAAYHEQFVHRLSAAATSYAV

SEQ ID NO: 1521056 - protein, 24 aa, Mycobacterium tuberculosis
AQAAIASCTAGRTVAAPAAVADQP

SEQ ID NO: 1521057 - protein, 18 aa, Mycobacterium tuberculosis
AQAAWLWSRRRGVIAGQS

SEQ ID NO: 1521058 - protein, 20 aa, Mycobacterium tuberculosis
AQACAWLASAIETAYCAPPP

SEQ ID NO: 1521059 - protein, 19 aa, Mycobacterium tuberculosis
AQAIAQVCELTWQLRGQAT

SEQ ID NO: 1521060 - protein, 17 aa, Mycobacterium tuberculosis
AQALLGRPLTGNGANGA

SEQ ID NO: 1521061 - protein, 18 aa, Mycobacterium tuberculosis
AQAQAFHAQFVQALTSGG

SEQ ID NO: 1521062 - protein, 22 aa, Mycobacterium tuberculosis
AQATFPVDRMLARLSSTVAVVP

SEQ ID NO: 1521063 - protein, 19 aa, Mycobacterium tuberculosis
AQAWAAEIARLAPLAILAR

SEQ ID NO: 1521064 - protein, 18 aa, Mycobacterium tuberculosis
AQDVAAMFGYHSAASAVA

SEQ ID NO: 1521065 - protein, 28 aa, Mycobacterium tuberculosis
AQGDPPYVAVPYLDRMELAYAAADLVIC

SEQ ID NO: 1521066 - protein, 17 aa, Mycobacterium tuberculosis
AQGWHLHHLLTAGQIEL

SEQ ID NO: 1521067 - protein, 21 aa, Mycobacterium tuberculosis
AQHIDLPRRAVTGMDLHRSVG

SEQ ID NO: 1521068 - protein, 18 aa, Mycobacterium tuberculosis
AQIATWLGPVPAVAVGCP

SEQ ID NO: 1521069 - protein, 18 aa, Mycobacterium tuberculosis
AQLALRRSVIRRAGAVID

SEQ ID NO: 1521070 - protein, 23 aa, Mycobacterium tuberculosis
AQLASRMLLQVHDELLFEIAPGE

SEQ ID NO: 1521071 - protein, 18 aa, Mycobacterium tuberculosis
AQLDVPPRFQAKGLGSGG

SEQ ID NO: 1521072 - protein, 17 aa, Mycobacterium tuberculosis
AQLLAAHDLPAAPALPA

SEQ ID NO: 1521073 - protein, 26 aa, Mycobacterium tuberculosis
AQLLLRVGIFSWITHAPKLGGHDSWR

SEQ ID NO: 1521074 - protein, 24 aa, Mycobacterium tuberculosis
AQLSSWSIGLQQALPAAPSALAAA

SEQ ID NO: 1521075 - protein, 17 aa, Mycobacterium tuberculosis
AQMMAAARDLQFELAAR

SEQ ID NO: 1521076 - protein, 18 aa, Mycobacterium tuberculosis
AQPFFDPSASFPPAPASA

SEQ ID NO: 1521077 - protein, 20 aa, Mycobacterium tuberculosis
AQPLIVAATLLAHQELARRC

SEQ ID NO: 1521078 - protein, 17 aa, Mycobacterium tuberculosis
AQPRRFDGFGYSAPIPA

SEQ ID NO: 1521079 - protein, 20 aa, Mycobacterium tuberculosis
AQQPAAATPGPTGGAGPTGP

SEQ ID NO: 1521080 - protein, 17 aa, Mycobacterium tuberculosis
AQRAKIVADYLVARGVA

SEQ ID NO: 1521081 - protein, 17 aa, Mycobacterium tuberculosis
AQRLLVRALLDTVIDSG

SEQ ID NO: 1521082 - protein, 23 aa, Mycobacterium tuberculosis
AQRRAWCVRARWPPSSRHALPNL

SEQ ID NO: 1521083 - protein, 18 aa, Mycobacterium tuberculosis
AQRRLPDTPVLPPLDVAA

SEQ ID NO: 1521084 - protein, 21 aa, Mycobacterium tuberculosis
AQRTAWIAEGLLGYLSAEAQD

SEQ ID NO: 1521085 - protein, 23 aa, Mycobacterium tuberculosis
AQRTRQVFLPVSRLKRDPHLEMH

SEQ ID NO: 1521086 - protein, 26 aa, Mycobacterium tuberculosis
AQRTSPTRWPLPCTARFWASRKKTAR

SEQ ID NO: 1521087 - protein, 29 aa, Mycobacterium tuberculosis
AQRWCGSGLLGALSPRPLGRCSAAGVVAP

SEQ ID NO: 1521088 - protein, 26 aa, Mycobacterium tuberculosis
AQSGSIGLGFAIPVDQAKRIADELIS

SEQ ID NO: 1521089 - protein, 29 aa, Mycobacterium tuberculosis
AQSPKETWLRLLLIRAGFPRPQMQIAVRN

SEQ ID NO: 1521090 - protein, 23 aa, Mycobacterium tuberculosis
AQTAPGHMLGGLPLGQLTNSGGG

SEQ ID NO: 1521091 - protein, 24 aa, Mycobacterium tuberculosis
AQTLIPPPPIVAPPPPRPAPPQQP

SEQ ID NO: 1521092 - protein, 27 aa, Mycobacterium tuberculosis
AQTRAVPGCRWWWLSETTRLTHKKYDA

SEQ ID NO: 1521093 - protein, 18 aa, Mycobacterium tuberculosis
AQVATFHDRFVQTLSAAA

SEQ ID NO: 1521094 - protein, 22 aa, Mycobacterium tuberculosis
AQVLDWFISFVSGPVFTFSPTW

SEQ ID NO: 1521095 - protein, 24 aa, Mycobacterium tuberculosis
AQVPDYLMQVLARFARYLRESRSI

SEQ ID NO: 1521096 - protein, 25 aa, Mycobacterium tuberculosis
AQVPDYLMQVLARFARYLRESRSID

SEQ ID NO: 1521097 - protein, 18 aa, Mycobacterium tuberculosis
AQVRGWLADNLAGEFAAL

SEQ ID NO: 1521098 - protein, 18 aa, Mycobacterium tuberculosis
AQVVRAHLTYRDVSAGRG

SEQ ID NO: 1521099 - protein, 30 aa, Mycobacterium tuberculosis
AQYLAPVLDALKFNYLPFGSNPFSSAATLP

SEQ ID NO: 1521100 - protein, 23 aa, Mycobacterium tuberculosis
AQYRQFVMATLFHKTRSWSNLFE

SEQ ID NO: 1521101 - protein, 17 aa, Mycobacterium tuberculosis
ARAALRVLQAEPWRPQA

SEQ ID NO: 1521102 - protein, 23 aa, Mycobacterium tuberculosis
ARAAMALPARPTGGTGGDGATAT

SEQ ID NO: 1521103 - protein, 26 aa, Mycobacterium tuberculosis
ARAATFHAEFVSLLNGGAAAYTGAEA

SEQ ID NO: 1521104 - protein, 27 aa, Mycobacterium tuberculosis
ARAATFHAEFVSLLNGGAAAYTGAEAA

SEQ ID NO: 1521105 - protein, 23 aa, Mycobacterium tuberculosis
ARAEPIFATVAPGVAAAPRTPGR

SEQ ID NO: 1521106 - protein, 17 aa, Mycobacterium tuberculosis
ARAFSRWSTTRTNRKRC

SEQ ID NO: 1521107 - protein, 18 aa, Mycobacterium tuberculosis
ARAFSRWSTTRTNRKRCG

SEQ ID NO: 1521108 - protein, 28 aa, Mycobacterium tuberculosis
ARAHGADMLLLIVAALEQSVLVSMLDRT

SEQ ID NO: 1521109 - protein, 18 aa, Mycobacterium tuberculosis
ARAHWKAHKLDLAPVLHE

SEQ ID NO: 1521110 - protein, 25 aa, Mycobacterium tuberculosis
ARAIGLFRYHMIWEAADAVHSTMHR

SEQ ID NO: 1521111 - protein, 25 aa, Mycobacterium tuberculosis
ARAKVLAFTAFPKAHWQKIWSTNPL

SEQ ID NO: 1521112 - protein, 23 aa, Mycobacterium tuberculosis
ARALEWVVGYPDRVRAGLLLAVG

SEQ ID NO: 1521113 - protein, 26 aa, Mycobacterium tuberculosis
ARALPFGDRLMALPINLLWNGQSVSS

SEQ ID NO: 1521114 - protein, 20 aa, Mycobacterium tuberculosis
ARALPLPRRHPGRRSPLWQQ

SEQ ID NO: 1521115 - protein, 20 aa, Mycobacterium tuberculosis
ARALRPYAEKLITHAKKRRV

SEQ ID NO: 1521116 - protein, 21 aa, Mycobacterium tuberculosis
ARAPFGTMPLPKLIDGQDHSA

SEQ ID NO: 1521117 - protein, 34 aa, Mycobacterium tuberculosis
ARAQHPWPPRVATLPHWPLICAGALEGLDHLELA

SEQ ID NO: 1521118 - protein, 24 aa, Mycobacterium tuberculosis
ARAYRRCRRALRQIGVLERPVGDS

SEQ ID NO: 1521119 - protein, 22 aa, Mycobacterium tuberculosis
ARCRARCPPHRPTTTSSPGFDR

SEQ ID NO: 1521120 - protein, 27 aa, Mycobacterium tuberculosis
ARCRGSLSPVWRKVSAHRWIRECTPAT

SEQ ID NO: 1521121 - protein, 32 aa, Mycobacterium tuberculosis
ARCRSRARLLGLRLRRLRYLRTAAARRPQVTT

SEQ ID NO: 1521122 - protein, 28 aa, Mycobacterium tuberculosis
ARCSFEQVAFLLWRGELPTDAELALFSQ

SEQ ID NO: 1521123 - protein, 33 aa, Mycobacterium tuberculosis
ARDAVAQIRPARLQRPIVLEARISHAASGEVVE

SEQ ID NO: 1521124 - protein, 23 aa, Mycobacterium tuberculosis
ARDGKPWGSRFPLISIRDQVQAD

SEQ ID NO: 1521125 - protein, 19 aa, Mycobacterium tuberculosis
ARDLMVALVPRGASPRPAA

SEQ ID NO: 1521126 - protein, 18 aa, Mycobacterium tuberculosis
ARDMLWVNRFRWNRCTTG

SEQ ID NO: 1521127 - protein, 24 aa, Mycobacterium tuberculosis
AREFQTFLVAKQREIVAVVAAAHE

SEQ ID NO: 1521128 - protein, 25 aa, Mycobacterium tuberculosis
AREGMLAFLQKRPPRWVQPATMRAA

SEQ ID NO: 1521129 - protein, 24 aa, Mycobacterium tuberculosis
AREHGLPFLFFTDQATGRGQLLYS

SEQ ID NO: 1521130 - protein, 26 aa, Mycobacterium tuberculosis
AREKLFSLICRYAVAYHVVFIPSAEV

SEQ ID NO: 1521131 - protein, 21 aa, Mycobacterium tuberculosis
ARELIARIRAVLRRGGDDDSE

SEQ ID NO: 1521132 - protein, 19 aa, Mycobacterium tuberculosis
ARESATRFFGASAAAIIND

SEQ ID NO: 1521133 - protein, 20 aa, Mycobacterium tuberculosis
AREVMVPRTEMIWIESDKTA

SEQ ID NO: 1521134 - protein, 22 aa, Mycobacterium tuberculosis
ARFDGWFVVAVLTTGVYCRPSC

SEQ ID NO: 1521135 - protein, 20 aa, Mycobacterium tuberculosis
ARFLLGLVVSTGVGGGLVLD

SEQ ID NO: 1521136 - protein, 19 aa, Mycobacterium tuberculosis
ARFVETFARVLGDPALPHL

SEQ ID NO: 1521137 - protein, 23 aa, Mycobacterium tuberculosis
ARGALTTPLPAPPAREVYLLQRT

SEQ ID NO: 1521138 - protein, 23 aa, Mycobacterium tuberculosis
ARGANGIDSIGGTGGAGGGGGDG

SEQ ID NO: 1521139 - protein, 18 aa, Mycobacterium tuberculosis
ARGGRHLGFAKALVYEMP

SEQ ID NO: 1521140 - protein, 21 aa, Mycobacterium tuberculosis
ARGIWWRQSRWCGLIAMSEIF

SEQ ID NO: 1521141 - protein, 34 aa, Mycobacterium tuberculosis
ARGKAIIILNPADPPMIMRDTIFCAIPTDADREA

SEQ ID NO: 1521142 - protein, 20 aa, Mycobacterium tuberculosis
ARGLVRLRAVLPLIDGGAES

SEQ ID NO: 1521143 - protein, 23 aa, Mycobacterium tuberculosis
ARGPGRYHRTGEPEVWYASNKEQ

SEQ ID NO: 1521144 - protein, 20 aa, Mycobacterium tuberculosis
ARGQYWIHPALPEVVENALL

SEQ ID NO: 1521145 - protein, 21 aa, Mycobacterium tuberculosis
ARGRLLISAMAAGAAAAAAHT

SEQ ID NO: 1521146 - protein, 20 aa, Mycobacterium tuberculosis
ARGSFFPVIPVCSSTGVGTL

SEQ ID NO: 1521147 - protein, 21 aa, Mycobacterium tuberculosis
ARGSGLLPRMEPFVGELIGRG

SEQ ID NO: 1521148 - protein, 21 aa, Mycobacterium tuberculosis
ARGSRRWRRWPACSRWSRAAG

SEQ ID NO: 1521149 - protein, 26 aa, Mycobacterium tuberculosis
ARGVTFSRGWLPFLPTSDPPAHTRMR

SEQ ID NO: 1521150 - protein, 20 aa, Mycobacterium tuberculosis
ARGYRLPWPADTTVFEVDQP

SEQ ID NO: 1521151 - protein, 18 aa, Mycobacterium tuberculosis
ARHHAGHTYAFDDTVALA

SEQ ID NO: 1521152 - protein, 18 aa, Mycobacterium tuberculosis
ARHHVLVAAVADPRVDQL

SEQ ID NO: 1521153 - protein, 19 aa, Mycobacterium tuberculosis
ARHREHGFMLALVTAATCC

SEQ ID NO: 1521154 - protein, 17 aa, Mycobacterium tuberculosis
ARILYHAALAHASNHIV

SEQ ID NO: 1521155 - protein, 22 aa, Mycobacterium tuberculosis
ARIRKALIEVSPLPIPVASVDP

SEQ ID NO: 1521156 - protein, 26 aa, Mycobacterium tuberculosis
ARITTPLLPDDYLHLANPLWSARELR

SEQ ID NO: 1521157 - protein, 21 aa, Mycobacterium tuberculosis
ARKRRMFDLLVRMGYKEIEVG

SEQ ID NO: 1521158 - protein, 25 aa, Mycobacterium tuberculosis
ARKSFFRAPLIGGTITHPVQGEAAA

SEQ ID NO: 1521159 - protein, 18 aa, Mycobacterium tuberculosis
ARLAVLSRSSVIPDQPRT

SEQ ID NO: 1521160 - protein, 19 aa, Mycobacterium tuberculosis
ARLHLPPLPTTTIGSYPQT

SEQ ID NO: 1521161 - protein, 19 aa, Mycobacterium tuberculosis
ARLLDRMKDKWRSDLTSDG

SEQ ID NO: 1521162 - protein, 17 aa, Mycobacterium tuberculosis
ARLLGWERIPVHVCHTI

SEQ ID NO: 1521163 - protein, 17 aa, Mycobacterium tuberculosis
ARLLLDSDVLVGTSAGA

SEQ ID NO: 1521164 - protein, 20 aa, Mycobacterium tuberculosis
ARLPDGVANWTYAAGMDGTP

SEQ ID NO: 1521165 - protein, 17 aa, Mycobacterium tuberculosis
ARLPLALPTSATGGIPV

SEQ ID NO: 1521166 - protein, 24 aa, Mycobacterium tuberculosis
ARLQRLLAFVARQEPRLNWAVGVH

SEQ ID NO: 1521167 - protein, 17 aa, Mycobacterium tuberculosis
ARLSVVVAESWRASALA

SEQ ID NO: 1521168 - protein, 19 aa, Mycobacterium tuberculosis
ARLYLLADQLPPLSHKPRV

SEQ ID NO: 1521169 - protein, 28 aa, Mycobacterium tuberculosis
ARMLESLDGWPVNFALLGKGNTVNPDAL

SEQ ID NO: 1521170 - protein, 23 aa, Mycobacterium tuberculosis
ARMRSLLMPAFTRAALRGYRDMI

SEQ ID NO: 1521171 - protein, 19 aa, Mycobacterium tuberculosis
ARNPLRFAAPCPGQHGWRA

SEQ ID NO: 1521172 - protein, 18 aa, Mycobacterium tuberculosis
ARPAASDGLAADAGDGGA

SEQ ID NO: 1521173 - protein, 26 aa, Mycobacterium tuberculosis
ARPDAPMAGVTYWRKAAQLKRNEAND

SEQ ID NO: 1521174 - protein, 17 aa, Mycobacterium tuberculosis
ARPFTWQVGSDPAVADL

SEQ ID NO: 1521175 - protein, 18 aa, Mycobacterium tuberculosis
ARPGRRAVRLVPPTRHRR

SEQ ID NO: 1521176 - protein, 19 aa, Mycobacterium tuberculosis
ARPGSARILSAQPCPREVS

SEQ ID NO: 1521177 - protein, 17 aa, Mycobacterium tuberculosis
ARPLWAPDYPVGAQVRR

SEQ ID NO: 1521178 - protein, 23 aa, Mycobacterium tuberculosis
ARPRLTPPVPSIPGRRSKPTIAV

SEQ ID NO: 1521179 - protein, 26 aa, Mycobacterium tuberculosis
ARPTIEMRGLLRWSPPNQDAQEGRPD

SEQ ID NO: 1521180 - protein, 20 aa, Mycobacterium tuberculosis
ARPVVSWFDQGTRDVIGLRI

SEQ ID NO: 1521181 - protein, 21 aa, Mycobacterium tuberculosis
ARPVVSWFDQGTRDVIGLRIA

SEQ ID NO: 1521182 - protein, 19 aa, Mycobacterium tuberculosis
ARQGPLLVVTATGREADDL

SEQ ID NO: 1521183 - protein, 24 aa, Mycobacterium tuberculosis
ARQVPGLWTIPHTAPGKSQIGGAS

SEQ ID NO: 1521184 - protein, 25 aa, Mycobacterium tuberculosis
ARRCGWSLGISAETLRRWAGQAEVD

SEQ ID NO: 1521185 - protein, 18 aa, Mycobacterium tuberculosis
ARRLATMVLLIAQSTIQS

SEQ ID NO: 1521186 - protein, 21 aa, Mycobacterium tuberculosis
ARRLATMVLLIAQSTIQSADI

SEQ ID NO: 1521187 - protein, 17 aa, Mycobacterium tuberculosis
ARRLPRCIPMVAGARIP

SEQ ID NO: 1521188 - protein, 34 aa, Mycobacterium tuberculosis
ARRRARRHLAALRALWYRVAHGPGVALAKLRLPS

SEQ ID NO: 1521189 - protein, 17 aa, Mycobacterium tuberculosis
ARRRFPLPDVPWTRFFG

SEQ ID NO: 1521190 - protein, 27 aa, Mycobacterium tuberculosis
ARRRLDSSLLVPWPRRHRDLVEWVAAA

SEQ ID NO: 1521191 - protein, 17 aa, Mycobacterium tuberculosis
ARRRRIVDHLAHAGTHV

SEQ ID NO: 1521192 - protein, 18 aa, Mycobacterium tuberculosis
ARRRRRSELRDYGDEFLD

SEQ ID NO: 1521193 - protein, 19 aa, Mycobacterium tuberculosis
ARRRRRVTRRGYGDEFTDM

SEQ ID NO: 1521194 - protein, 19 aa, Mycobacterium tuberculosis
ARRTRIAIRAVSWGERGAL

SEQ ID NO: 1521195 - protein, 24 aa, Mycobacterium tuberculosis
ARRTVGHLAGVRRALAGLAGLPVG

SEQ ID NO: 1521196 - protein, 29 aa, Mycobacterium tuberculosis
ARRVADVLGIPFYVWDFAEKFKEDVINDF

SEQ ID NO: 1521197 - protein, 29 aa, Mycobacterium tuberculosis
ARSDQFCHALLAVAPRRPQVELPAVGSLL

SEQ ID NO: 1521198 - protein, 27 aa, Mycobacterium tuberculosis
ARSRHRRYWSRRWLGPRIRPYARRGGR

SEQ ID NO: 1521199 - protein, 23 aa, Mycobacterium tuberculosis
ARSSASFPLAFEPSFLPFTKGTA

SEQ ID NO: 1521200 - protein, 25 aa, Mycobacterium tuberculosis
ARTDLLAFTAFPKQIWRQIGSNNPQ

SEQ ID NO: 1521201 - protein, 21 aa, Mycobacterium tuberculosis
ARTGHPWWTLSQLSDESAIEL

SEQ ID NO: 1521202 - protein, 26 aa, Mycobacterium tuberculosis
ARTHPGLRRHLPAVLRLHAPGGAAGG

SEQ ID NO: 1521203 - protein, 21 aa, Mycobacterium tuberculosis
ARTTDGPAPSHNAMASNTAAA

SEQ ID NO: 1521204 - protein, 24 aa, Mycobacterium tuberculosis
ARTYEKMSLFIVPADTPGIEIVRN

SEQ ID NO: 1521205 - protein, 19 aa, Mycobacterium tuberculosis
ARVGWNRRQLSAVGGRGQQ

SEQ ID NO: 1521206 - protein, 19 aa, Mycobacterium tuberculosis
ARVLLHEMAHRRRAQGLTV

SEQ ID NO: 1521207 - protein, 20 aa, Mycobacterium tuberculosis
ARVLLHEMAHRRRAQGLTVV

SEQ ID NO: 1521208 - protein, 26 aa, Mycobacterium tuberculosis
ARVLQNIYRALRPGGVLLLVDIKASS

SEQ ID NO: 1521209 - protein, 17 aa, Mycobacterium tuberculosis
ARWFLLCTVDGATVTTA

SEQ ID NO: 1521210 - protein, 25 aa, Mycobacterium tuberculosis
ARWHRYGLASMRSQWGYSARTARRG

SEQ ID NO: 1521211 - protein, 21 aa, Mycobacterium tuberculosis
ARWREFCLRVADRVVLVASNP

SEQ ID NO: 1521212 - protein, 28 aa, Mycobacterium tuberculosis
ARWSASSRFLLNLPLFSRQALHPDVDLL

SEQ ID NO: 1521213 - protein, 21 aa, Mycobacterium tuberculosis
ARYGIAPAYPWDFIRDVINNT

SEQ ID NO: 1521214 - protein, 21 aa, Mycobacterium tuberculosis
ARYGIVWGAMGAARSAWPCAL

SEQ ID NO: 1521215 - protein, 20 aa, Mycobacterium tuberculosis
ARYRRWLAALRGSARLVIGT

SEQ ID NO: 1521216 - protein, 25 aa, Mycobacterium tuberculosis
ARYVWEVPYYPQYYIPLADVRMEFL

SEQ ID NO: 1521217 - protein, 19 aa, Mycobacterium tuberculosis
ASAATRWVWVSDAATLDTD

SEQ ID NO: 1521218 - protein, 18 aa, Mycobacterium tuberculosis
ASAFEAARAATVHPLLVA

SEQ ID NO: 1521219 - protein, 26 aa, Mycobacterium tuberculosis
ASAFQSVVWGLTTGSWIGSSAGLMAA

SEQ ID NO: 1521220 - protein, 25 aa, Mycobacterium tuberculosis
ASAGLLSTYSPTPVPAAPVVPRAVA

SEQ ID NO: 1521221 - protein, 22 aa, Mycobacterium tuberculosis
ASAMASVFHRDDPEWRSTVDDV

SEQ ID NO: 1521222 - protein, 21 aa, Mycobacterium tuberculosis
ASARFDFGAAPLPTGPDAAPA

SEQ ID NO: 1521223 - protein, 22 aa, Mycobacterium tuberculosis
ASARFRVRVRLTGHLDPIDGNY

SEQ ID NO: 1521224 - protein, 21 aa, Mycobacterium tuberculosis
ASARRLQLNRIPLYQIHQPNP

SEQ ID NO: 1521225 - protein, 23 aa, Mycobacterium tuberculosis
ASARRLRLRSRRAGDIGLCHLTP

SEQ ID NO: 1521226 - protein, 20 aa, Mycobacterium tuberculosis
ASATAWYGLQDLARIKAGDK

SEQ ID NO: 1521227 - protein, 25 aa, Mycobacterium tuberculosis
ASCKHPMIFPLSNPTSRMEAIPADV

SEQ ID NO: 1521228 - protein, 30 aa, Mycobacterium tuberculosis
ASDLSNILLLGPVGDLFPILSIPGAMSQNF

SEQ ID NO: 1521229 - protein, 20 aa, Mycobacterium tuberculosis
ASELFFGRPAPTPQQWLQIV

SEQ ID NO: 1521230 - protein, 30 aa, Mycobacterium tuberculosis
ASERFDGLLTFTLTETLWLAGQGFSNLLLA

SEQ ID NO: 1521231 - protein, 25 aa, Mycobacterium tuberculosis
ASEWVDKLRRQAETPLLLAVDGTLV

SEQ ID NO: 1521232 - protein, 33 aa, Mycobacterium tuberculosis
ASGGFVVPFLHPDLVWDFRLPRVVSINVSGHKY

SEQ ID NO: 1521233 - protein, 26 aa, Mycobacterium tuberculosis
ASGLDARGYRLPWPADTTVFEVDQPR

SEQ ID NO: 1521234 - protein, 27 aa, Mycobacterium tuberculosis
ASGLDSRAYRLPWPTMTVVYEIDQPKV

SEQ ID NO: 1521235 - protein, 19 aa, Mycobacterium tuberculosis
ASGRVAYTLGLHGPAVTVD

SEQ ID NO: 1521236 - protein, 19 aa, Mycobacterium tuberculosis
ASGYWAAPAVANYVLSVES

SEQ ID NO: 1521237 - protein, 18 aa, Mycobacterium tuberculosis
ASHHARVGRRARAARLLR

SEQ ID NO: 1521238 - protein, 25 aa, Mycobacterium tuberculosis
ASHKLLIRAGYIRPVAPGLYSWLPL

SEQ ID NO: 1521239 - protein, 37 aa, Mycobacterium tuberculosis
ASHKLLIRAGYIRPVAPGLYSWLPLGLRVLRNIERVI

SEQ ID NO: 1521240 - protein, 27 aa, Mycobacterium tuberculosis
ASHLGGTRYPLVVAWPARIRPDGRVRS

SEQ ID NO: 1521241 - protein, 23 aa, Mycobacterium tuberculosis
ASIAGFQPIPYMAVYSATKAFVL

SEQ ID NO: 1521242 - protein, 35 aa, Mycobacterium tuberculosis
ASIGNTWLADPAPFLQQYLANQFGYGQLTLTALTD

SEQ ID NO: 1521243 - protein, 33 aa, Mycobacterium tuberculosis
ASITSPLLDAINAPFLAALGRPLIGNGADGAPG

SEQ ID NO: 1521244 - protein, 27 aa, Mycobacterium tuberculosis
ASLDHAMWFMRPFRADEWLLYDQSSPS

SEQ ID NO: 1521245 - protein, 27 aa, Mycobacterium tuberculosis
ASLLQGYTGFIYGGERWAKDIHEGIAR

SEQ ID NO: 1521246 - protein, 22 aa, Mycobacterium tuberculosis
ASLPDAMGALLARSIVGIVEQV

SEQ ID NO: 1521247 - protein, 21 aa, Mycobacterium tuberculosis
ASMMSRWLTSPRHWPCSAAAV

SEQ ID NO: 1521248 - protein, 31 aa, Mycobacterium tuberculosis
ASMSMVVAAQPYLAWLTYTAESAAHAAAQAM

SEQ ID NO: 1521249 - protein, 24 aa, Mycobacterium tuberculosis
ASMVAAVTPYVAWLSATAGQAEQA

SEQ ID NO: 1521250 - protein, 23 aa, Mycobacterium tuberculosis
ASPIYNFRYPNMLRLRYEKKRNL

SEQ ID NO: 1521251 - protein, 24 aa, Mycobacterium tuberculosis
ASPLAIGLFGVNPTVGSIGPGSIS

SEQ ID NO: 1521252 - protein, 37 aa, Mycobacterium tuberculosis
ASPLQVALDVINAPAQTLLGRPLIGNGADGSTPGQAG

SEQ ID NO: 1521253 - protein, 19 aa, Mycobacterium tuberculosis
ASPVHAATLLPFIGRLLAA

SEQ ID NO: 1521254 - protein, 30 aa, Mycobacterium tuberculosis
ASPVHAATLLPFIGRLLAALAAPAPRSART

SEQ ID NO: 1521255 - protein, 18 aa, Mycobacterium tuberculosis
ASPYLGFGSLRPLLEVAA

SEQ ID NO: 1521256 - protein, 17 aa, Mycobacterium tuberculosis
ASRLIRLPMWVGLQEVD

SEQ ID NO: 1521257 - protein, 23 aa, Mycobacterium tuberculosis
ASRPPCTRSWSWLRRNRDRSKSS

SEQ ID NO: 1521258 - protein, 18 aa, Mycobacterium tuberculosis
ASRQAFGRPSGVQGSFVA

SEQ ID NO: 1521259 - protein, 20 aa, Mycobacterium tuberculosis
ASRQAFGRPSGVQGSFVAER

SEQ ID NO: 1521260 - protein, 27 aa, Mycobacterium tuberculosis
ASRTGNLVTWWTGDALLVFDAGNLTQR

SEQ ID NO: 1521261 - protein, 19 aa, Mycobacterium tuberculosis
ASRVRKAPGFALLGEKGQP

SEQ ID NO: 1521262 - protein, 18 aa, Mycobacterium tuberculosis
ASRWRPSVRVAVISGRDP

SEQ ID NO: 1521263 - protein, 30 aa, Mycobacterium tuberculosis
ASSAGTGALLAWLTARPLGSRAYAWRMMRD

SEQ ID NO: 1521264 - protein, 21 aa, Mycobacterium tuberculosis
ASSAPSRWVNTRPASSVGSHT

SEQ ID NO: 1521265 - protein, 25 aa, Mycobacterium tuberculosis
ASSTVEAPVARRLRESFGGSKPAPA

SEQ ID NO: 1521266 - protein, 25 aa, Mycobacterium tuberculosis
ASSVRAIVTGYRLSPRDATVAVMPL

SEQ ID NO: 1521267 - protein, 25 aa, Mycobacterium tuberculosis
ASSWNEITPCNLSLDRLANAVKEGG

SEQ ID NO: 1521268 - protein, 18 aa, Mycobacterium tuberculosis
ASTGLFNVGGFNTGVANV

SEQ ID NO: 1521269 - protein, 23 aa, Mycobacterium tuberculosis
ASTTAFLVLSAFCSAHPLAKVQV

SEQ ID NO: 1521270 - protein, 18 aa, Mycobacterium tuberculosis
ASTTYYFSSLEDLIARAV

SEQ ID NO: 1521271 - protein, 19 aa, Mycobacterium tuberculosis
ASVATIAWMGYHPPPNPLD

SEQ ID NO: 1521272 - protein, 20 aa, Mycobacterium tuberculosis
ASVATIAWMGYHPPPNPLDT

SEQ ID NO: 1521273 - protein, 31 aa, Mycobacterium tuberculosis
ASVLGHSFTFMTPAAFVRRPGRWVRELARKP

SEQ ID NO: 1521274 - protein, 21 aa, Mycobacterium tuberculosis
ASVSLAWVDGIAKALACRGNA

SEQ ID NO: 1521275 - protein, 25 aa, Mycobacterium tuberculosis
ASWPDTHAIAVWRGVFRRLKLAGMG

SEQ ID NO: 1521276 - protein, 17 aa, Mycobacterium tuberculosis
ASYWYAHTDQWRYDGYG

SEQ ID NO: 1521277 - protein, 23 aa, Mycobacterium tuberculosis
ATAAFDLARIGSQVSAASAVAAM

SEQ ID NO: 1521278 - protein, 43 aa, Mycobacterium tuberculosis
ATAATPATPVPAAPAAPAPPQARRGRPAASCTTGGKGRSRAAT

SEQ ID NO: 1521279 - protein, 21 aa, Mycobacterium tuberculosis
ATAAWAIGRWTPGTERRTATM

SEQ ID NO: 1521280 - protein, 24 aa, Mycobacterium tuberculosis
ATAFPWRRQSALVQWYVETSGSPS

SEQ ID NO: 1521281 - protein, 24 aa, Mycobacterium tuberculosis
ATAFRNFQYTVQAQKLWAQAGFRP

SEQ ID NO: 1521282 - protein, 24 aa, Mycobacterium tuberculosis
ATAIDPQHRLLLEVSWEAIEHAGV

SEQ ID NO: 1521283 - protein, 25 aa, Mycobacterium tuberculosis
ATAKEARIAFLMLPGVGTKDDIKEA

SEQ ID NO: 1521284 - protein, 18 aa, Mycobacterium tuberculosis
ATAPPGAPPSGGDPNGGG

SEQ ID NO: 1521285 - protein, 26 aa, Mycobacterium tuberculosis
ATAPRLLLEVVCARLLLPSASDAESA

SEQ ID NO: 1521286 - protein, 20 aa, Mycobacterium tuberculosis
ATAPSPKAAAAFSAARAASA

SEQ ID NO: 1521287 - protein, 23 aa, Mycobacterium tuberculosis
ATATAVFLADRLGKPLLVEGPAG

SEQ ID NO: 1521288 - protein, 24 aa, Mycobacterium tuberculosis
ATAVLGRWPDIRLLAGAPTRHVDR

SEQ ID NO: 1521289 - protein, 30 aa, Mycobacterium tuberculosis
ATDAIFGVGHIWRRIRAANLPIALSDRLTL

SEQ ID NO: 1521290 - protein, 22 aa, Mycobacterium tuberculosis
ATDEIYFVLSGRGLVSVGDESG

SEQ ID NO: 1521291 - protein, 18 aa, Mycobacterium tuberculosis
ATDIRHAVASLPAVVADI

SEQ ID NO: 1521292 - protein, 24 aa, Mycobacterium tuberculosis
ATDLCEFVEFPSQLLQVCGDSFAG

SEQ ID NO: 1521293 - protein, 20 aa, Mycobacterium tuberculosis
ATDPRLWRHRSLAGETPVTT

SEQ ID NO: 1521294 - protein, 24 aa, Mycobacterium tuberculosis
ATEALLPFEDAPLITNPGGSLSRP

SEQ ID NO: 1521295 - protein, 17 aa, Mycobacterium tuberculosis
ATEGIWVGPPEPPAPPF

SEQ ID NO: 1521296 - protein, 24 aa, Mycobacterium tuberculosis
ATEIPLRTWLFRIADDEHVLVAVA

SEQ ID NO: 1521297 - protein, 19 aa, Mycobacterium tuberculosis
ATELGRNLLLEQLHYRHEV

SEQ ID NO: 1521298 - protein, 23 aa, Mycobacterium tuberculosis
ATELPMLLYDIPGRSAVPIEPDT

SEQ ID NO: 1521299 - protein, 24 aa, Mycobacterium tuberculosis
ATETRIVVTGNYRAWRSSSQCGPA

SEQ ID NO: 1521300 - protein, 24 aa, Mycobacterium tuberculosis
ATFAKGAMYWSPVTDAQPITGAIY

SEQ ID NO: 1521301 - protein, 22 aa, Mycobacterium tuberculosis
ATFGVAYLTAWHPAVRGRAPIP

SEQ ID NO: 1521302 - protein, 21 aa, Mycobacterium tuberculosis
ATFHAEFVSLLNGGAAAYTGA

SEQ ID NO: 1521303 - protein, 22 aa, Mycobacterium tuberculosis
ATFHDRFVQTLSAAASSYVAAE

SEQ ID NO: 1521304 - protein, 22 aa, Mycobacterium tuberculosis
ATGGQGGDFALGGNGGAGGAGG

SEQ ID NO: 1521305 - protein, 18 aa, Mycobacterium tuberculosis
ATGHPYLSGLPIGLPSLI

SEQ ID NO: 1521306 - protein, 24 aa, Mycobacterium tuberculosis
ATGLESTMRFLLSAKSAYVDGQVF

SEQ ID NO: 1521307 - protein, 22 aa, Mycobacterium tuberculosis
ATGLNLLAFGGINLSVDGVAVD

SEQ ID NO: 1521308 - protein, 19 aa, Mycobacterium tuberculosis
ATGLPLSLTMVTAASTPSA

SEQ ID NO: 1521309 - protein, 27 aa, Mycobacterium tuberculosis
ATGLTLPPTLIFDYPTAAELAEHLDIQ

SEQ ID NO: 1521310 - protein, 21 aa, Mycobacterium tuberculosis
ATGMSMFNLGLGNIGQFNVGF

SEQ ID NO: 1521311 - protein, 24 aa, Mycobacterium tuberculosis
ATGRQLLPVIAAVFRKAIGGTVHE

SEQ ID NO: 1521312 - protein, 17 aa, Mycobacterium tuberculosis
ATGRYADAWIPIVVVRP

SEQ ID NO: 1521313 - protein, 17 aa, Mycobacterium tuberculosis
ATGTKWSFIPQGDTGAA

SEQ ID NO: 1521314 - protein, 37 aa, Mycobacterium tuberculosis
ATGTLTFFGSGGRRRPRRGWRQHRRHPGVSALFGGAR

SEQ ID NO: 1521315 - protein, 25 aa, Mycobacterium tuberculosis
ATGVFPVDLPPITGPPPPLGDAHLE

SEQ ID NO: 1521316 - protein, 31 aa, Mycobacterium tuberculosis
ATHFSRLVPQHLMRRLFFTAATVDAVTLQHF

SEQ ID NO: 1521317 - protein, 18 aa, Mycobacterium tuberculosis
ATIGVVRPKTPRGDGNWT

SEQ ID NO: 1521318 - protein, 18 aa, Mycobacterium tuberculosis
ATIHRHRPRRRRASHRNP

SEQ ID NO: 1521319 - protein, 18 aa, Mycobacterium tuberculosis
ATLAYTLRNGYFPRRHVF

SEQ ID NO: 1521320 - protein, 17 aa, Mycobacterium tuberculosis
ATLFGSYALGYQAISTQ

SEQ ID NO: 1521321 - protein, 25 aa, Mycobacterium tuberculosis
ATLPELLARVWPQHPSQWRRLNPAK

SEQ ID NO: 1521322 - protein, 17 aa, Mycobacterium tuberculosis
ATLPYCDLFLPAHSLAG

SEQ ID NO: 1521323 - protein, 20 aa, Mycobacterium tuberculosis
ATLSLSLKLISPAKGRIPCY

SEQ ID NO: 1521324 - protein, 27 aa, Mycobacterium tuberculosis
ATMAHPAWSRMRPLRSPGPRRGNRVLK

SEQ ID NO: 1521325 - protein, 27 aa, Mycobacterium tuberculosis
ATMEPITDSWYLTSIRAGLEPWSDGVG

SEQ ID NO: 1521326 - protein, 45 aa, Mycobacterium tuberculosis
ATNAAPLATLEHNVLNALNAPTQALLGRPLIGDGAAGAPGTGQAG

SEQ ID NO: 1521327 - protein, 18 aa, Mycobacterium tuberculosis
ATNMPWTQRGRLTHHSVV

SEQ ID NO: 1521328 - protein, 18 aa, Mycobacterium tuberculosis
ATNRRLASTIRKTPIEHA

SEQ ID NO: 1521329 - protein, 27 aa, Mycobacterium tuberculosis
ATPAVIDAMLLVRLPYHLSSVTQAAAR

SEQ ID NO: 1521330 - protein, 26 aa, Mycobacterium tuberculosis
ATPAVIDAMLLVRLPYHLSSVTQAAS

SEQ ID NO: 1521331 - protein, 22 aa, Mycobacterium tuberculosis
ATPDIQVLSIDYPVGSRASGAG

SEQ ID NO: 1521332 - protein, 17 aa, Mycobacterium tuberculosis
ATPIPRTLEMSLAGIRE

SEQ ID NO: 1521333 - protein, 25 aa, Mycobacterium tuberculosis
ATPKPSWPWVRTLLHSIYDQPDAES

SEQ ID NO: 1521334 - protein, 18 aa, Mycobacterium tuberculosis
ATPLQQIEQALLGVINTP

SEQ ID NO: 1521335 - protein, 19 aa, Mycobacterium tuberculosis
ATPLRPGIWRAYADHRMAM

SEQ ID NO: 1521336 - protein, 23 aa, Mycobacterium tuberculosis
ATPPGPLCATTRPRPPQGNQPPA

SEQ ID NO: 1521337 - protein, 21 aa, Mycobacterium tuberculosis
ATPQPRYCSMSSDPKPREGTE

SEQ ID NO: 1521338 - protein, 30 aa, Mycobacterium tuberculosis
ATPSHIWAPWISSPPAITSCFWAPPGTGKT

SEQ ID NO: 1521339 - protein, 24 aa, Mycobacterium tuberculosis
ATQFNFHAAMYQAVGAQAIAMNEA

SEQ ID NO: 1521340 - protein, 17 aa, Mycobacterium tuberculosis
ATQLMTELSERGEKLPA

SEQ ID NO: 1521341 - protein, 29 aa, Mycobacterium tuberculosis
ATQPNGPSIRTILRALAIHRRPSANSKLG

SEQ ID NO: 1521342 - protein, 22 aa, Mycobacterium tuberculosis
ATQRIQMPLPAAQARLLATIEA

SEQ ID NO: 1521343 - protein, 25 aa, Mycobacterium tuberculosis
ATQRPAPQFEVMYLLAVCDAAAADQ

SEQ ID NO: 1521344 - protein, 26 aa, Mycobacterium tuberculosis
ATRCRDPRIVWLPRRRIGAEVAAQAT

SEQ ID NO: 1521345 - protein, 24 aa, Mycobacterium tuberculosis
ATRDFAIGLAGIPPSLQSALQALA

SEQ ID NO: 1521346 - protein, 22 aa, Mycobacterium tuberculosis
ATREQRWQSFVPVAHVGRLGSA

SEQ ID NO: 1521347 - protein, 25 aa, Mycobacterium tuberculosis
ATREYPGCKRIVLGTAWAAALCSLT

SEQ ID NO: 1521348 - protein, 19 aa, Mycobacterium tuberculosis
ATRPHHVIDSVAGLPPLLG

SEQ ID NO: 1521349 - protein, 17 aa, Mycobacterium tuberculosis
ATRPWQFGDTEPWHVAR

SEQ ID NO: 1521350 - protein, 17 aa, Mycobacterium tuberculosis
ATRQVIANGLAIIGVTA

SEQ ID NO: 1521351 - protein, 28 aa, Mycobacterium tuberculosis
ATRSVRSPAYCFTLPFAHQALMPINVVA

SEQ ID NO: 1521352 - protein, 26 aa, Mycobacterium tuberculosis
ATRSVRSPVYCFTLPFAHQALMPINV

SEQ ID NO: 1521353 - protein, 19 aa, Mycobacterium tuberculosis
ATRVARPDLLALGALLHDI

SEQ ID NO: 1521354 - protein, 20 aa, Mycobacterium tuberculosis
ATRVARPDLLALGALLHDIG

SEQ ID NO: 1521355 - protein, 22 aa, Mycobacterium tuberculosis
ATRVFRLSRIGAQVTPIGPAGA

SEQ ID NO: 1521356 - protein, 17 aa, Mycobacterium tuberculosis
ATSDFWCDAEWAGLRGP

SEQ ID NO: 1521357 - protein, 17 aa, Mycobacterium tuberculosis
ATTAWLIERLQRPTLVM

SEQ ID NO: 1521358 - protein, 18 aa, Mycobacterium tuberculosis
ATTGGWITRKRKDGTTEW

SEQ ID NO: 1521359 - protein, 19 aa, Mycobacterium tuberculosis
ATTGGWITRKRKDGTTEWL

SEQ ID NO: 1521360 - protein, 17 aa, Mycobacterium tuberculosis
ATTGRFALYPYIREYVY

SEQ ID NO: 1521361 - protein, 23 aa, Mycobacterium tuberculosis
ATTKAGMIGITQALAPGLAAKGI

SEQ ID NO: 1521362 - protein, 19 aa, Mycobacterium tuberculosis
ATVGFAGSGGFGGAGGIAQ

SEQ ID NO: 1521363 - protein, 22 aa, Mycobacterium tuberculosis
ATVGPFVAGHNTGFGNSGSLNT

SEQ ID NO: 1521364 - protein, 23 aa, Mycobacterium tuberculosis
ATVGPFVAGHNTGFGNSGSLNTG

SEQ ID NO: 1521365 - protein, 20 aa, Mycobacterium tuberculosis
ATVHPMLVAANRNAFVQLVL

SEQ ID NO: 1521366 - protein, 31 aa, Mycobacterium tuberculosis
ATVIRLSDYPYVVPLIDLEMRRPTYVFAAVD

SEQ ID NO: 1521367 - protein, 21 aa, Mycobacterium tuberculosis
ATVLPAIPLNVDVTIPVGPIN

SEQ ID NO: 1521368 - protein, 17 aa, Mycobacterium tuberculosis
ATVPPPVIAANRAQLMG

SEQ ID NO: 1521369 - protein, 17 aa, Mycobacterium tuberculosis
ATVPPPVIAANRAQLMV

SEQ ID NO: 1521370 - protein, 20 aa, Mycobacterium tuberculosis
ATVPSLRLVGYGGSRAIAAD

SEQ ID NO: 1521371 - protein, 19 aa, Mycobacterium tuberculosis
ATVQPAVVAANRGLMQLLA

SEQ ID NO: 1521372 - protein, 20 aa, Mycobacterium tuberculosis
ATVYRWQCLFHDKDSERYAV

SEQ ID NO: 1521373 - protein, 19 aa, Mycobacterium tuberculosis
ATYEQMWAADVAAMVGYHG

SEQ ID NO: 1521374 - protein, 31 aa, Mycobacterium tuberculosis
AVAAAIAFATDCARIARVRPCGAVGAVAAGP

SEQ ID NO: 1521375 - protein, 22 aa, Mycobacterium tuberculosis
AVAALFSQTRPGLPSGGRSGSS

SEQ ID NO: 1521376 - protein, 20 aa, Mycobacterium tuberculosis
AVAAPYRTLFTTLQQLLIGK

SEQ ID NO: 1521377 - protein, 21 aa, Mycobacterium tuberculosis
AVAASVWPMIAANRVRPVIGT

SEQ ID NO: 1521378 - protein, 20 aa, Mycobacterium tuberculosis
AVAELLAVAGVKYLVLGAGE

SEQ ID NO: 1521379 - protein, 17 aa, Mycobacterium tuberculosis
AVAEMTVALLLAVARHL

SEQ ID NO: 1521380 - protein, 23 aa, Mycobacterium tuberculosis
AVAEVTRLRQGWGAWPVCAARAG

SEQ ID NO: 1521381 - protein, 26 aa, Mycobacterium tuberculosis
AVAGIRLALSLGFRVRVAATVASPAP

SEQ ID NO: 1521382 - protein, 25 aa, Mycobacterium tuberculosis
AVAGIWSHIGGQVSGSAWALGAAMS

SEQ ID NO: 1521383 - protein, 20 aa, Mycobacterium tuberculosis
AVALSLTPFTPSPSAAATPG

SEQ ID NO: 1521384 - protein, 23 aa, Mycobacterium tuberculosis
AVAPGLFVPTVIASAVVAKEGTD

SEQ ID NO: 1521385 - protein, 27 aa, Mycobacterium tuberculosis
AVAPVRRLLRRLLGPTDPVLASTVFGV

SEQ ID NO: 1521386 - protein, 21 aa, Mycobacterium tuberculosis
AVAPYLGWLISATAQLSRPPL

SEQ ID NO: 1521387 - protein, 17 aa, Mycobacterium tuberculosis
AVAQPLIAAFAAALRQL

SEQ ID NO: 1521388 - protein, 18 aa, Mycobacterium tuberculosis
AVARFDAHGALTNADEAI

SEQ ID NO: 1521389 - protein, 18 aa, Mycobacterium tuberculosis
AVARLAPGTGLRDGLERI

SEQ ID NO: 1521390 - protein, 24 aa, Mycobacterium tuberculosis
AVARQRCDGPRWAATPPTSTANSP

SEQ ID NO: 1521391 - protein, 22 aa, Mycobacterium tuberculosis
AVASFFAKNFLPLLTSTREVIE

SEQ ID NO: 1521392 - protein, 29 aa, Mycobacterium tuberculosis
AVASQWDDGYVANYTITQFGRDFDDRLAV

SEQ ID NO: 1521393 - protein, 30 aa, Mycobacterium tuberculosis
AVASQWDDGYVANYTITQFGRDFDDRLAVA

SEQ ID NO: 1521394 - protein, 27 aa, Mycobacterium tuberculosis
AVDAATHFILATGRPPRWVRPIVDALG

SEQ ID NO: 1521395 - protein, 22 aa, Mycobacterium tuberculosis
AVDANALGAALWRGVELVVASM

SEQ ID NO: 1521396 - protein, 21 aa, Mycobacterium tuberculosis
AVDANALGAAWWRGVELVVAS

SEQ ID NO: 1521397 - protein, 20 aa, Mycobacterium tuberculosis
AVDTDLRWRIVTALATAGAI

SEQ ID NO: 1521398 - protein, 20 aa, Mycobacterium tuberculosis
AVDYLTSMGLRILNRNWRCR

SEQ ID NO: 1521399 - protein, 25 aa, Mycobacterium tuberculosis
AVEDSVIMLTVLKSCPMLTRGREPN

SEQ ID NO: 1521400 - protein, 20 aa, Mycobacterium tuberculosis
AVELGKQVEILPGLQAINAG

SEQ ID NO: 1521401 - protein, 21 aa, Mycobacterium tuberculosis
AVELILCFNQLAYSAFAPAVL

SEQ ID NO: 1521402 - protein, 31 aa, Mycobacterium tuberculosis
AVEPEAMASTMLLFFCQFSDGYGTAGRDYEI

SEQ ID NO: 1521403 - protein, 24 aa, Mycobacterium tuberculosis
AVEPRARWERLYHLVNHVLEHHGD

SEQ ID NO: 1521404 - protein, 27 aa, Mycobacterium tuberculosis
AVEQQALIALPPRAFELTSWSIGTVGV

SEQ ID NO: 1521405 - protein, 35 aa, Mycobacterium tuberculosis
AVEQQVLGLINGPAQTLLGRPLIGNGADGAPGTGQ

SEQ ID NO: 1521406 - protein, 23 aa, Mycobacterium tuberculosis
AVFANFKPGTLTSLGFSYDVLHA

SEQ ID NO: 1521407 - protein, 19 aa, Mycobacterium tuberculosis
AVFTTAYYAFIHLADVQPG

SEQ ID NO: 1521408 - protein, 21 aa, Mycobacterium tuberculosis
AVGALGAWGRAGATATALPAG

SEQ ID NO: 1521409 - protein, 28 aa, Mycobacterium tuberculosis
AVGDKWRLAEVLAWQAYVGFAGEGDPGA

SEQ ID NO: 1521410 - protein, 19 aa, Mycobacterium tuberculosis
AVGDNFVWAYQRSEALADD

SEQ ID NO: 1521411 - protein, 21 aa, Mycobacterium tuberculosis
AVGGLYVHWIVTGIAPGSGST

SEQ ID NO: 1521412 - protein, 18 aa, Mycobacterium tuberculosis
AVGGNAQLIGNGGNGGGG

SEQ ID NO: 1521413 - protein, 26 aa, Mycobacterium tuberculosis
AVGIAAYRCAIGRRRWPNCGQPEEWG

SEQ ID NO: 1521414 - protein, 19 aa, Mycobacterium tuberculosis
AVGLAQRWGSRNPIPWSGL

SEQ ID NO: 1521415 - protein, 21 aa, Mycobacterium tuberculosis
AVGLGMPGVGLPVSAAKPGGC

SEQ ID NO: 1521416 - protein, 17 aa, Mycobacterium tuberculosis
AVGLWQANRHIGATLVN

SEQ ID NO: 1521417 - protein, 23 aa, Mycobacterium tuberculosis
AVGTGLRVLGPIHTVGAGIQANT

SEQ ID NO: 1521418 - protein, 26 aa, Mycobacterium tuberculosis
AVHLRGHFLLTRNAAAYWRDKAKDAE

SEQ ID NO: 1521419 - protein, 28 aa, Mycobacterium tuberculosis
AVHSAHSPYYRLVALRLATVGLRAQSLG

SEQ ID NO: 1521420 - protein, 20 aa, Mycobacterium tuberculosis
AVHSARYWRLSWRTRFANSS

SEQ ID NO: 1521421 - protein, 19 aa, Mycobacterium tuberculosis
AVIGGLPGNGGAGGNAGLI

SEQ ID NO: 1521422 - protein, 23 aa, Mycobacterium tuberculosis
AVIIAGFPFLDLGNVTIGGFNLA

SEQ ID NO: 1521423 - protein, 20 aa, Mycobacterium tuberculosis
AVIPGDGVGKAPHGDAGGSG

SEQ ID NO: 1521424 - protein, 28 aa, Mycobacterium tuberculosis
AVKRRYLQGRAWTAPWSPPASTGCRTGC

SEQ ID NO: 1521425 - protein, 19 aa, Mycobacterium tuberculosis
AVLAALLHRERNGVADVVQ

SEQ ID NO: 1521426 - protein, 19 aa, Mycobacterium tuberculosis
AVLAIENAVIPPSLNYVGA

SEQ ID NO: 1521427 - protein, 30 aa, Mycobacterium tuberculosis
AVLDVVNGPTQLLLGRPLIGDGANGGPGQN

SEQ ID NO: 1521428 - protein, 18 aa, Mycobacterium tuberculosis
AVLERTIAELRAADVLVL

SEQ ID NO: 1521429 - protein, 17 aa, Mycobacterium tuberculosis
AVLGVILGRDRPLRRRT

SEQ ID NO: 1521430 - protein, 25 aa, Mycobacterium tuberculosis
AVLMSPMAFLQRPARWMQLLAKHRA

SEQ ID NO: 1521431 - protein, 17 aa, Mycobacterium tuberculosis
AVLPFDRFRRADGAAID

SEQ ID NO: 1521432 - protein, 20 aa, Mycobacterium tuberculosis
AVLPSHYEPFGLVALEAAAA

SEQ ID NO: 1521433 - protein, 17 aa, Mycobacterium tuberculosis
AVLPTYFEIVERPHALV

SEQ ID NO: 1521434 - protein, 18 aa, Mycobacterium tuberculosis
AVLPVTGPTAATAREQGP

SEQ ID NO: 1521435 - protein, 17 aa, Mycobacterium tuberculosis
AVLRRCGRCGRKASWYD

SEQ ID NO: 1521436 - protein, 18 aa, Mycobacterium tuberculosis
AVLVFPHAGGAAAAYRWL

SEQ ID NO: 1521437 - protein, 18 aa, Mycobacterium tuberculosis
AVLYCKTGVRSAEALAAV

SEQ ID NO: 1521438 - protein, 18 aa, Mycobacterium tuberculosis
AVMFGDLPPLPTTARFSF

SEQ ID NO: 1521439 - protein, 18 aa, Mycobacterium tuberculosis
AVMLSFGDPAVFADAIKS

SEQ ID NO: 1521440 - protein, 17 aa, Mycobacterium tuberculosis
AVNAPAQALLGRPLIGS

SEQ ID NO: 1521441 - protein, 17 aa, Mycobacterium tuberculosis
AVNAPTQTLLGRPLIGD

SEQ ID NO: 1521442 - protein, 24 aa, Mycobacterium tuberculosis
AVNAPTQTLLGRPLIGNGADGVAG

SEQ ID NO: 1521443 - protein, 23 aa, Mycobacterium tuberculosis
AVNASAQTLLSRPLIGNGANATT

SEQ ID NO: 1521444 - protein, 17 aa, Mycobacterium tuberculosis
AVNRIGAHILLLNTSFA

SEQ ID NO: 1521445 - protein, 24 aa, Mycobacterium tuberculosis
AVNRPTPLMLPSVAVRAAFGEFAD

SEQ ID NO: 1521446 - protein, 35 aa, Mycobacterium tuberculosis
AVNTTAWFVMATIPNAVFLGHAFAALNPATVTAAA

SEQ ID NO: 1521447 - protein, 31 aa, Mycobacterium tuberculosis
AVPGCYPTAALLALFPALAADLIEPAVTVVA

SEQ ID NO: 1521448 - protein, 20 aa, Mycobacterium tuberculosis
AVPLDKPLTELGLDSLMAVR

SEQ ID NO: 1521449 - protein, 18 aa, Mycobacterium tuberculosis
AVPPWARPVRQGRPAAPE

SEQ ID NO: 1521450 - protein, 19 aa, Mycobacterium tuberculosis
AVPRMRGMLTLFEGVATGA

SEQ ID NO: 1521451 - protein, 18 aa, Mycobacterium tuberculosis
AVPRRPVIRPIPVDDSGF

SEQ ID NO: 1521452 - protein, 20 aa, Mycobacterium tuberculosis
AVPRRPVIRPIPVDDSGFTV

SEQ ID NO: 1521453 - protein, 27 aa, Mycobacterium tuberculosis
AVPVELPLCALLTAWVRGQARPEARAQ

SEQ ID NO: 1521454 - protein, 24 aa, Mycobacterium tuberculosis
AVQNFPALVANLPAAIDAAVQQFL

SEQ ID NO: 1521455 - protein, 23 aa, Mycobacterium tuberculosis
AVQRHLVGRRRRFADHAANAHSI

SEQ ID NO: 1521456 - protein, 17 aa, Mycobacterium tuberculosis
AVQRYRKLRDAWLTARR

SEQ ID NO: 1521457 - protein, 20 aa, Mycobacterium tuberculosis
AVRAGFVRAAPPFGRCRADR

SEQ ID NO: 1521458 - protein, 23 aa, Mycobacterium tuberculosis
AVRDGMATLNPLAAQIIGQLSSL

SEQ ID NO: 1521459 - protein, 26 aa, Mycobacterium tuberculosis
AVREFACQRWQWHDLEVSRTAIVPDV

SEQ ID NO: 1521460 - protein, 31 aa, Mycobacterium tuberculosis
  misc_feature (23)..(23): Xaa can be any naturally occurring amino acid
AVRIDHIIGLFRLWWIPDGAPPXQGTYVRYD

SEQ ID NO: 1521461 - protein, 27 aa, Mycobacterium tuberculosis
AVRIEAMPWQWVGQELPQFSSAPINHA

SEQ ID NO: 1521462 - protein, 24 aa, Mycobacterium tuberculosis
AVRLGLLAGHYRADRFWSQQVLDE

SEQ ID NO: 1521463 - protein, 22 aa, Mycobacterium tuberculosis
AVRPEWPVLVAAIAEWAKRGGR

SEQ ID NO: 1521464 - protein, 21 aa, Mycobacterium tuberculosis
AVRQWGFMQGLKQKLGPGVDV

SEQ ID NO: 1521465 - protein, 21 aa, Mycobacterium tuberculosis
AVRRRPYTVVLFDEIEKAHPD

SEQ ID NO: 1521466 - protein, 24 aa, Mycobacterium tuberculosis
AVRRRPYTVVLFDEIEKAHPDVFD

SEQ ID NO: 1521467 - protein, 17 aa, Mycobacterium tuberculosis
AVRVARMHKTSLTVATI

SEQ ID NO: 1521468 - protein, 23 aa, Mycobacterium tuberculosis
AVSFTTLRLIYQEMLANYRVGQA

SEQ ID NO: 1521469 - protein, 17 aa, Mycobacterium tuberculosis
AVSLLTQPRAWSVHGRP

SEQ ID NO: 1521470 - protein, 19 aa, Mycobacterium tuberculosis
AVSRLLVAGGVLMVYVATV

SEQ ID NO: 1521471 - protein, 18 aa, Mycobacterium tuberculosis
AVSSWLHRIVVNACLDRL

SEQ ID NO: 1521472 - protein, 26 aa, Mycobacterium tuberculosis
AVSVFSVEFLVHAWDYAVAVVSELKA

SEQ ID NO: 1521473 - protein, 20 aa, Mycobacterium tuberculosis
AVTELMLFDAQNPRSLVYQL

SEQ ID NO: 1521474 - protein, 23 aa, Mycobacterium tuberculosis
AVTEPMLFEWTDRNTLLYAIGVG

SEQ ID NO: 1521475 - protein, 25 aa, Mycobacterium tuberculosis
AVTIPGFAINPFGLDVPLSGGTNAV

SEQ ID NO: 1521476 - protein, 22 aa, Mycobacterium tuberculosis
AVTIPVMAKVRIGHFVEAQILQ

SEQ ID NO: 1521477 - protein, 19 aa, Mycobacterium tuberculosis
AVTVAPLKAALVTLSAAMA

SEQ ID NO: 1521478 - protein, 31 aa, Mycobacterium tuberculosis; identical to SEQ ID NO: 216597

SEQ ID NO: 1521479 - protein, 19 aa, Mycobacterium tuberculosis
AVVGLLPEYAQVRGSVRLQ

SEQ ID NO: 1521480 - protein, 22 aa, Mycobacterium tuberculosis
AVVKIPVQGGPIGGIAISRDGS

SEQ ID NO: 1521481 - protein, 22 aa, Mycobacterium tuberculosis
AVVPTIVWCSAETQPQGWVRLR

SEQ ID NO: 1521482 - protein, 20 aa, Mycobacterium tuberculosis
AVVQANRVRTWLLAVSNVFG

SEQ ID NO: 1521483 - protein, 25 aa, Mycobacterium tuberculosis
AVVQLRVPRRRACAAPRLQGMGGQI

SEQ ID NO: 1521484 - protein, 20 aa, Mycobacterium tuberculosis
AVVVLGLPRGGVPVAFEVAK

SEQ ID NO: 1521485 - protein, 20 aa, Mycobacterium tuberculosis
AWAPFRPPKVLSPLFPRPDT

SEQ ID NO: 1521486 - protein, 17 aa, Mycobacterium tuberculosis
AWFVIREQNLRFDWMKD

SEQ ID NO: 1521487 - protein, 17 aa, Mycobacterium tuberculosis
AWGLWEQPGGMTAHLSS

SEQ ID NO: 1521488 - protein, 18 aa, Mycobacterium tuberculosis
AWHGNWHMLIVTSIGTDA

SEQ ID NO: 1521489 - protein, 19 aa, Mycobacterium tuberculosis
AWITGQIERGWASCAITQN

SEQ ID NO: 1521490 - protein, 29 aa, Mycobacterium tuberculosis
AWKGETLEEYWWAAEQMLTWPDPDKPANM

SEQ ID NO: 1521491 - protein, 18 aa, Mycobacterium tuberculosis
AWLRSRLPTLWTNSYFVA

SEQ ID NO: 1521492 - protein, 17 aa, Mycobacterium tuberculosis
AWMGYHPPPNPLDTGSA

SEQ ID NO: 1521493 - protein, 18 aa, Mycobacterium tuberculosis
AWNAAPPRVLLVWSPTGV

SEQ ID NO: 1521494 - protein, 17 aa, Mycobacterium tuberculosis
AWNVGKLGLFGVGRIRA

SEQ ID NO: 1521495 - protein, 17 aa, Mycobacterium tuberculosis
AWPTPKSAAALAAAARN

SEQ ID NO: 1521496 - protein, 25 aa, Mycobacterium tuberculosis
AWRNDQWYTARLCPAPLRPEERQTT

SEQ ID NO: 1521497 - protein, 18 aa, Mycobacterium tuberculosis
AWRRGPLAALDRLVGPDT

SEQ ID NO: 1521498 - protein, 18 aa, Mycobacterium tuberculosis
AWRWYRDVIGGGRTPLVD

SEQ ID NO: 1521499 - protein, 19 aa, Mycobacterium tuberculosis
AWVAPGTSLNIVLIDTLRP

SEQ ID NO: 1521500 - protein, 24 aa, Mycobacterium tuberculosis
AWVLGWRRPQAYPLMSHLAARGWV

SEQ ID NO: 1521501 - protein, 20 aa, Mycobacterium tuberculosis
AWVLIHAVAGIWSHIGGQVS

SEQ ID NO: 1521502 - protein, 28 aa, Mycobacterium tuberculosis
AYASARPIRNRPTWRPAAPRTRLRRLQT

SEQ ID NO: 1521503 - protein, 25 aa, Mycobacterium tuberculosis
AYDPVFFPGLAAEWSDRRPFVGPLT

SEQ ID NO: 1521504 - protein, 21 aa, Mycobacterium tuberculosis
AYGHALGIPVYGVCSLDAIGG

SEQ ID NO: 1521505 - protein, 17 aa, Mycobacterium tuberculosis
AYGLYPSWRGRGLATRA

SEQ ID NO: 1521506 - protein, 17 aa, Mycobacterium tuberculosis
AYHPTLLRKGERLLVFL

SEQ ID NO: 1521507 - protein, 19 aa, Mycobacterium tuberculosis
AYIRHCREQWVTGGPLRSF

SEQ ID NO: 1521508 - protein, 19 aa, Mycobacterium tuberculosis
AYISPRLPVREPGLTDPRH

SEQ ID NO: 1521509 - protein, 17 aa, Mycobacterium tuberculosis
AYLERFGTHVRAMVLDG

SEQ ID NO: 1521510 - protein, 27 aa, Mycobacterium tuberculosis
AYLFTNDYEWDLLLSKTGWSEADVMAQ

SEQ ID NO: 1521511 - protein, 18 aa, Mycobacterium tuberculosis
AYLGLLDVLGRRGDIACD

SEQ ID NO: 1521512 - protein, 22 aa, Mycobacterium tuberculosis
AYLVTGGLGGLGLFLAGELAAA

SEQ ID NO: 1521513 - protein, 20 aa, Mycobacterium tuberculosis
AYPASMLIGPMMQLAQMGTT

SEQ ID NO: 1521514 - protein, 24 aa, Mycobacterium tuberculosis
AYPRTASIVIWYSRAICDTAAILS

SEQ ID NO: 1521515 - protein, 20 aa, Mycobacterium tuberculosis
AYPRTASVVIWYSPELGDTA

SEQ ID NO: 1521516 - protein, 22 aa, Mycobacterium tuberculosis
AYPSTLGYKGFPKSCCTSLNEV

SEQ ID NO: 1521517 - protein, 23 aa, Mycobacterium tuberculosis
AYQERFVLALSQAGSTYAVAEAA

SEQ ID NO: 1521518 - protein, 17 aa, Mycobacterium tuberculosis
AYQVFHATRRLAAAMVA

SEQ ID NO: 1521519 - protein, 17 aa, Mycobacterium tuberculosis
AYQWLRARGYRPEQIVL

SEQ ID NO: 1521520 - protein, 22 aa, Mycobacterium tuberculosis
AYRARSTGQRPSWAPLPVQYAD

SEQ ID NO: 1521521 - protein, 25 aa, Mycobacterium tuberculosis
AYRSWRRHWPTTGSTGWGRLMRRPR

SEQ ID NO: 1521522 - protein, 19 aa, Mycobacterium tuberculosis
AYRYARAMARWSPTSRSEV

SEQ ID NO: 1521523 - protein, 29 aa, Mycobacterium tuberculosis
AYSGYIPILGAPWLADLVRRSPWGEMFAS

SEQ ID NO: 1521524 - protein, 17 aa, Mycobacterium tuberculosis
AYSRDIVALLLGDSFHP

SEQ ID NO: 1521525 - protein, 20 aa, Mycobacterium tuberculosis
AYTLRNGYFPRRHVFVVPAS

SEQ ID NO: 1521526 - protein, 29 aa, Mycobacterium tuberculosis
CAAIGLVKFDLLGLGMLSALHYAKDLVAE

SEQ ID NO: 1521527 - protein, 24 aa, Mycobacterium tuberculosis
CAAVGGRWRRWRPEGLGVGGPVYR

SEQ ID NO: 1521528 - protein, 18 aa, Mycobacterium tuberculosis
CAAWPSGLLAVRGRPRLL

SEQ ID NO: 1521529 - protein, 30 aa, Mycobacterium tuberculosis
CACRKHHLLKTFWTGWRDVQLPDGTVIWTA

SEQ ID NO: 1521530 - protein, 33 aa, Mycobacterium tuberculosis
CADGHLPRLKPRVFYDLVVEVALIRPPGPSRAD

SEQ ID NO: 1521531 - protein, 20 aa, Mycobacterium tuberculosis
CADPAIAIPAGLPVAQRDSV

SEQ ID NO: 1521532 - protein, 18 aa, Mycobacterium tuberculosis
CAECHLDAPMVNRALAGA

SEQ ID NO: 1521533 - protein, 17 aa, Mycobacterium tuberculosis
CAFGRIGSMFACEDLGY

SEQ ID NO: 1521534 - protein, 22 aa, Mycobacterium tuberculosis
CAIFTPYRWMIEHVTTKRGQLR

SEQ ID NO: 1521535 - protein, 24 aa, Mycobacterium tuberculosis
CAKYTPGLFSTLLAAAVPAADKHL

SEQ ID NO: 1521536 - protein, 18 aa, Mycobacterium tuberculosis
CALANRLRITKPEAALRI

SEQ ID NO: 1521537 - protein, 17 aa, Mycobacterium tuberculosis
CALDYARQRTQFGRPIA

SEQ ID NO: 1521538 - protein, 17 aa, Mycobacterium tuberculosis
CAPFELSRDAPLRITVV

SEQ ID NO: 1521539 - protein, 24 aa, Mycobacterium tuberculosis
CAPSRSLPLLECWTALAALSRDTT

SEQ ID NO: 1521540 - protein, 17 aa, Mycobacterium tuberculosis
CAQPVGQWLFAAHAGQR

SEQ ID NO: 1521541 - protein, 22 aa, Mycobacterium tuberculosis
CARRRAEIFTWQRAAASMLATL

SEQ ID NO: 1521542 - protein, 19 aa, Mycobacterium tuberculosis
CATCDGFFFRDQDIAVIGG

SEQ ID NO: 1521543 - protein, 21 aa, Mycobacterium tuberculosis
CATFLADYLPGPVRVEPMRNF

SEQ ID NO: 1521544 - protein, 17 aa, Mycobacterium tuberculosis
CAVAVGPAATSPTVVLC

SEQ ID NO: 1521545 - protein, 20 aa, Mycobacterium tuberculosis
CAVPPLVAYLDTGKLPDTDT

SEQ ID NO: 1521546 - protein, 19 aa, Mycobacterium tuberculosis
CCAVVAYGALLGGPLLAVP

SEQ ID NO: 1521547 - protein, 20 aa, Mycobacterium tuberculosis
CCAVVAYGALLGGPLLAVPP

SEQ ID NO: 1521548 - protein, 17 aa, Mycobacterium tuberculosis
CCFRVSLPRVSDVDQLS

SEQ ID NO: 1521549 - protein, 30 aa, Mycobacterium tuberculosis
CCRTHHLVKTFWGWRDQQLPDGTLILTSPS

SEQ ID NO: 1521550 - protein, 22 aa, Mycobacterium tuberculosis
CCRWWPGCDRRHRRPVRGARAG

SEQ ID NO: 1521551 - protein, 33 aa, Mycobacterium tuberculosis
CCSGESKKKNLYSLKYWGVRGVWGGGGGGGGGG

SEQ ID NO: 1521552 - protein, 18 aa, Mycobacterium tuberculosis
CDAALSSRLAYPEVRAAL

SEQ ID NO: 1521553 - protein, 17 aa, Mycobacterium tuberculosis
CDKFANNGLGSHAGTWR

SEQ ID NO: 1521554 - protein, 18 aa, Mycobacterium tuberculosis
CDLGRQIGYLLASQEPAL

SEQ ID NO: 1521555 - protein, 24 aa, Mycobacterium tuberculosis
CDQPVKPGLVIPAPSINTGLNPAP

SEQ ID NO: 1521556 - protein, 17 aa, Mycobacterium tuberculosis
CDSMLYIEGRLLGKPAS

SEQ ID NO: 1521557 - protein, 20 aa, Mycobacterium tuberculosis
CDYLISCTGYYNYDAGYLPD

SEQ ID NO: 1521558 - protein, 22 aa, Mycobacterium tuberculosis
CEAGLLPGALTRNVGLHFICRD

SEQ ID NO: 1521559 - protein, 18 aa, Mycobacterium tuberculosis
CEAGSLADWPPPGGSGSG

SEQ ID NO: 1521560 - protein, 19 aa, Mycobacterium tuberculosis
CELMRIAWRTVGAIVARVW

SEQ ID NO: 1521561 - protein, 26 aa, Mycobacterium tuberculosis
CEVLVGLGMRTWADGRTLLLGSPSLL

SEQ ID NO: 1521562 - protein, 17 aa, Mycobacterium tuberculosis
CFANRYQSWLPTLKEMV

SEQ ID NO: 1521563 - protein, 19 aa, Mycobacterium tuberculosis
CFDGKYPIELPRETALGKN

SEQ ID NO: 1521564 - protein, 17 aa, Mycobacterium tuberculosis
CFLLQKVLDLPAGQLPP

SEQ ID NO: 1521565 - protein, 22 aa, Mycobacterium tuberculosis
CFVQTRLRENVLLQAKVCQSGN

SEQ ID NO: 1521566 - protein, 25 aa, Mycobacterium tuberculosis
CGAIGAGRTLHGWNGALAAGPTLAG

SEQ ID NO: 1521567 - protein, 20 aa, Mycobacterium tuberculosis
CGATLIVWTTISAARQVPGL

SEQ ID NO: 1521568 - protein, 24 aa, Mycobacterium tuberculosis
CGDCALNRGVFADAYGVVGAVGEV

SEQ ID NO: 1521569 - protein, 25 aa, Mycobacterium tuberculosis
CGDIAVLSKLLRLGEGRMVKRLKKV

SEQ ID NO: 1521570 - protein, 26 aa, Mycobacterium tuberculosis
CGGKRLDRPGWFYPPTVITDISKDMA

SEQ ID NO: 1521571 - protein, 17 aa, Mycobacterium tuberculosis
CGLGWRGTRFTVRRRCR

SEQ ID NO: 1521572 - protein, 25 aa, Mycobacterium tuberculosis
CGPPLVFQLLWYPTTMADLSLPSFT

SEQ ID NO: 1521573 - protein, 21 aa, Mycobacterium tuberculosis
CGRAVGWRKDAFFGRAALLAE

SEQ ID NO: 1521574 - protein, 18 aa, Mycobacterium tuberculosis
CGRCWAIARCRSCTGPLS

SEQ ID NO: 1521575 - protein, 18 aa, Mycobacterium tuberculosis
CGRRVRRTRRAAVRQRRR

SEQ ID NO: 1521576 - protein, 17 aa, Mycobacterium tuberculosis
CGSGATITAPPLPMRGP

SEQ ID NO: 1521577 - protein, 29 aa, Mycobacterium tuberculosis
CGSGGAGGVAWLLYGNGGNGGAGGIGGAA

SEQ ID NO: 1521578 - protein, 27 aa, Mycobacterium tuberculosis
CGSPARRWIPRASPWPYWPADLTSRIR

SEQ ID NO: 1521579 - protein, 18 aa, Mycobacterium tuberculosis
CHGNPTWSFLYRDIIVAL

SEQ ID NO: 1521580 - protein, 20 aa, Mycobacterium tuberculosis
CHHRVLAMTYPDPPQTGLSD

SEQ ID NO: 1521581 - protein, 18 aa, Mycobacterium tuberculosis
CHLLAPPTPATAAARGSS

SEQ ID NO: 1521582 - protein, 25 aa, Mycobacterium tuberculosis
CHPEVSWAAMFLRLAEPRAPQKPSR

SEQ ID NO: 1521583 - protein, 20 aa, Mycobacterium tuberculosis
CHQIVLPQPILRNHELAKLV

SEQ ID NO: 1521584 - protein, 22 aa, Mycobacterium tuberculosis
CIAFVLIFACRCALRWAMRAAA

SEQ ID NO: 1521585 - protein, 17 aa, Mycobacterium tuberculosis
CIFFSAGPVKSSRALLG

SEQ ID NO: 1521586 - protein, 29 aa, Mycobacterium tuberculosis
CIRSGDIFQLAFMRPLRKSRERLMVAPGY

SEQ ID NO: 1521587 - protein, 33 aa, Mycobacterium tuberculosis
CISWTFRGIPVRRPGRFFATVDFSPMGCGIAGA

SEQ ID NO: 1521588 - protein, 23 aa, Mycobacterium tuberculosis
CKRGWPGSPPPWPTTMHIRRGPT

SEQ ID NO: 1521589 - protein, 21 aa, Mycobacterium tuberculosis
CLCRKHHLLKTFWTGWRDVQL

SEQ ID NO: 1521590 - protein, 18 aa, Mycobacterium tuberculosis
CLFFDDIADWVECARCAG

SEQ ID NO: 1521591 - protein, 29 aa, Mycobacterium tuberculosis
CLIRGDEFSAWHRLLFQRPGCAESVLACR

SEQ ID NO: 1521592 - protein, 17 aa, Mycobacterium tuberculosis
CLLASWVPPDTPAGQRL

SEQ ID NO: 1521593 - protein, 17 aa, Mycobacterium tuberculosis
CLLLVYPNVIAVERQLR

SEQ ID NO: 1521594 - protein, 17 aa, Mycobacterium tuberculosis
CLLMFARRDLTAAEASA

SEQ ID NO: 1521595 - protein, 19 aa, Mycobacterium tuberculosis
CLPLNWLRRKHGLSSLGWD

SEQ ID NO: 1521596 - protein, 18 aa, Mycobacterium tuberculosis
CLTFMDENTLYACRDPYG

SEQ ID NO: 1521597 - protein, 23 aa, Mycobacterium tuberculosis
CLWWRPALRVRGSPISTACATWT

SEQ ID NO: 1521598 - protein, 19 aa, Mycobacterium tuberculosis
CMRGRTMYVVPFCMGPLGA

SEQ ID NO: 1521599 - protein, 19 aa, Mycobacterium tuberculosis
CNPRHHSLAFLPMPTSSGI

SEQ ID NO: 1521600 - protein, 24 aa, Mycobacterium tuberculosis
CNPRHHSLAFLPMPTSSGIVHLMV

SEQ ID NO: 1521601 - protein, 18 aa, Mycobacterium tuberculosis
CPAAWPTPKSAAALAAAA

SEQ ID NO: 1521602 - protein, 17 aa, Mycobacterium tuberculosis
CPCLTVCANWRCQHKLL

SEQ ID NO: 1521603 - protein, 21 aa, Mycobacterium tuberculosis
CPGMKLARPDVFHPRVVLAGW

SEQ ID NO: 1521604 - protein, 23 aa, Mycobacterium tuberculosis
CPGPTCMPSWKRPQQKLPHPRVH

SEQ ID NO: 1521605 - protein, 23 aa, Mycobacterium tuberculosis
CPHFDHALAAYYLILPSEVSSNL

SEQ ID NO: 1521606 - protein, 24 aa, Mycobacterium tuberculosis
CPHFDHALAAYYLILPSEVSSNLA

SEQ ID NO: 1521607 - protein, 23 aa, Mycobacterium tuberculosis
CPLWNVYETFANPGKILVQIAQM

SEQ ID NO: 1521608 - protein, 19 aa, Mycobacterium tuberculosis
CPMSFPTSRPGSLCRKRLR

SEQ ID NO: 1521609 - protein, 18 aa, Mycobacterium tuberculosis
CPPTLWELESGLSMLRPS

SEQ ID NO: 1521610 - protein, 17 aa, Mycobacterium tuberculosis
CPWMPSGEENSGAQQYQ

SEQ ID NO: 1521611 - protein, 18 aa, Mycobacterium tuberculosis
CQDRADWLSVKRLAGWLA

SEQ ID NO: 1521612 - protein, 21 aa, Mycobacterium tuberculosis
CQLLDGVRRVGWPRVGNARHR

SEQ ID NO: 1521613 - protein, 23 aa, Mycobacterium tuberculosis
CQQAVRFGLFHLLQASARAERRA

SEQ ID NO: 1521614 - protein, 40 aa, Mycobacterium tuberculosis
CQQILFMDDDIRLEPDSILRVLAMHRFAKAPMLVGGQMLN

SEQ ID NO: 1521615 - protein, 25 aa, Mycobacterium tuberculosis
CRCTAGSVWPPPRGRRSRCTTPQTR

SEQ ID NO: 1521616 - protein, 20 aa, Mycobacterium tuberculosis
CRELITQRLYLLPTFRWRLA

SEQ ID NO: 1521617 - protein, 33 aa, Mycobacterium tuberculosis
CRGAGCAPWNVGWPVRLPWLRRDSPARGQPASG

SEQ ID NO: 1521618 - protein, 18 aa, Mycobacterium tuberculosis
CRGVCLGGYLLQGGYGWT

SEQ ID NO: 1521619 - protein, 21 aa, Mycobacterium tuberculosis
CRLDRLAGELSVWSRAAVQIA

SEQ ID NO: 1521620 - protein, 18 aa, Mycobacterium tuberculosis
CRLRWPTPRCCSRILRWC

SEQ ID NO: 1521621 - protein, 25 aa, Mycobacterium tuberculosis
CRMDSMFPLGPLLGNAGLNITVMSL

SEQ ID NO: 1521622 - protein, 30 aa, Mycobacterium tuberculosis
CRPATDIRYWCYLACWPATVSTWILRRILR

SEQ ID NO: 1521623 - protein, 17 aa, Mycobacterium tuberculosis
CRPLLGVRRSVTHAACR

SEQ ID NO: 1521624 - protein, 29 aa, Mycobacterium tuberculosis
CRPRIPLARAWLPGADLRAPCALPVLVID

SEQ ID NO: 1521625 - protein, 17 aa, Mycobacterium tuberculosis
CRSTRWWRRSPPAVAVP

SEQ ID NO: 1521626 - protein, 25 aa, Mycobacterium tuberculosis
CRTDTCQHMWLSPLAPPAKQSGTTS

SEQ ID NO: 1521627 - protein, 29 aa, Mycobacterium tuberculosis
CRTHHLVKTFWGWRDQQLPDGTLILTSPS

SEQ ID NO: 1521628 - protein, 22 aa, Mycobacterium tuberculosis
CRVHGRTWDLLRLTRMPTVQVD

SEQ ID NO: 1521629 - protein, 29 aa, Mycobacterium tuberculosis
CRVILLDAAPAVLPPMGPKLGLKAQRRLE

SEQ ID NO: 1521630 - protein, 19 aa, Mycobacterium tuberculosis
CRWALAAANLWQGNLEAAV

SEQ ID NO: 1521631 - protein, 25 aa, Mycobacterium tuberculosis
CSASPVAPGWAVPPVAGVMAGAVVS

SEQ ID NO: 1521632 - protein, 17 aa, Mycobacterium tuberculosis
CSCRMTRTFWQPGFRTR

SEQ ID NO: 1521633 - protein, 18 aa, Mycobacterium tuberculosis
CSGLVLYSFAGVGIKLPH

SEQ ID NO: 1521634 - protein, 25 aa, Mycobacterium tuberculosis
CSGSPPSAPWRSQTPRLATMRARKT

SEQ ID NO: 1521635 - protein, 26 aa, Mycobacterium tuberculosis
CSKGSFYLRPIVRPVILVAGGTGLSA

SEQ ID NO: 1521636 - protein, 17 aa, Mycobacterium tuberculosis
CSRWGMLSPEGRCKTFD

SEQ ID NO: 1521637 - protein, 20 aa, Mycobacterium tuberculosis
CSSGLTAIHLACRSLHDGES

SEQ ID NO: 1521638 - protein, 17 aa, Mycobacterium tuberculosis
CTLLVTDGDWQGVSTRL

SEQ ID NO: 1521639 - protein, 26 aa, Mycobacterium tuberculosis
CTPQEYVLFLRQTPIFEQMLIDDGIL

SEQ ID NO: 1521640 - protein, 24 aa, Mycobacterium tuberculosis
CTPRGIVHLLRRYDISIAGAHVVV

SEQ ID NO: 1521641 - protein, 23 aa, Mycobacterium tuberculosis
CTRLRGDCLAPPRPALRAALSPG

SEQ ID NO: 1521642 - protein, 18 aa, Mycobacterium tuberculosis
CTRTALRRWPKCSTMSSA

SEQ ID NO: 1521643 - protein, 23 aa, Mycobacterium tuberculosis
CTSWVQLPLTPQLAEPVHDEAAL

SEQ ID NO: 1521644 - protein, 27 aa, Mycobacterium tuberculosis
CTTPQTRWTAWWPACGDPGISLEERDV

SEQ ID NO: 1521645 - protein, 17 aa, Mycobacterium tuberculosis
CVAGIRAIPGLSDRAAQ

SEQ ID NO: 1521646 - protein, 19 aa, Mycobacterium tuberculosis
CVAILAPQGIDYVCGFYAA

SEQ ID NO: 1521647 - protein, 18 aa, Mycobacterium tuberculosis
CVAYVIWPSGSMIDFSSA

SEQ ID NO: 1521648 - protein, 17 aa, Mycobacterium tuberculosis
CVDLLKPRKAQPLLPGI

SEQ ID NO: 1521649 - protein, 17 aa, Mycobacterium tuberculosis
CVELYALRQRRLGAGLR

SEQ ID NO: 1521650 - protein, 17 aa, Mycobacterium tuberculosis
CVESVTSGQRRYQVLSP

SEQ ID NO: 1521651 - protein, 26 aa, Mycobacterium tuberculosis
CVLERFRAIKPWLVGGRVHAPFWEVH

SEQ ID NO: 1521652 - protein, 19 aa, Mycobacterium tuberculosis
CVLPAYLNALAGNGVHIVT

SEQ ID NO: 1521653 - protein, 18 aa, Mycobacterium tuberculosis
CVPERFRAMDLPMAAADA

SEQ ID NO: 1521654 - protein, 35 aa, Mycobacterium tuberculosis
CVTTLSRRFGPLIRWPHVAAMWSGARRWWRRPCRP

SEQ ID NO: 1521655 - protein, 17 aa, Mycobacterium tuberculosis
CWGPRRWRSSTRPPAWC

SEQ ID NO: 1521656 - protein, 27 aa, Mycobacterium tuberculosis
CWHAGRGSYPWLPTDNANWHMIGVECA

SEQ ID NO: 1521657 - protein, 17 aa, Mycobacterium tuberculosis
CWLVKKNSSVGGDGGNG

SEQ ID NO: 1521658 - protein, 27 aa, Mycobacterium tuberculosis
CWMHIGIDLFWFALPPEQLDLARVRPE

SEQ ID NO: 1521659 - protein, 18 aa, Mycobacterium tuberculosis
CYGVLYHLSRPAEALAWM

SEQ ID NO: 1521660 - protein, 19 aa, Mycobacterium tuberculosis
CYSAWTWLASLPAVDPARV

SEQ ID NO: 1521661 - protein, 26 aa, Mycobacterium tuberculosis
CYVHPEIEFFLLKPGPEDGSVPVPVD

SEQ ID NO: 1521662 - protein, 19 aa, Mycobacterium tuberculosis
DAAGAWRTAAVELARALVR

SEQ ID NO: 1521663 - protein, 27 aa, Mycobacterium tuberculosis
DAAGHRSPLGRLPLRIGRSKSNDMVLP

SEQ ID NO: 1521664 - protein, 17 aa, Mycobacterium tuberculosis
DAAGVVGWWVNPQAPGI

SEQ ID NO: 1521665 - protein, 19 aa, Mycobacterium tuberculosis
DAALALLRAELRPGDVVLV

SEQ ID NO: 1521666 - protein, 22 aa, Mycobacterium tuberculosis
DAAQPIWWVVRAIEFSKDFETF

SEQ ID NO: 1521667 - protein, 25 aa, Mycobacterium tuberculosis
DAARFLLEGMPVQVAFHNGVPLYIE

SEQ ID NO: 1521668 - protein, 23 aa, Mycobacterium tuberculosis
DAARLMVGAVRRHRPGSLQRVVL

SEQ ID NO: 1521669 - protein, 19 aa, Mycobacterium tuberculosis
DACDVVLLLMDSRARHCHA

SEQ ID NO: 1521670 - protein, 17 aa, Mycobacterium tuberculosis
DACHARRLGVLIDAVFN

SEQ ID NO: 1521671 - protein, 32 aa, Mycobacterium tuberculosis
DADPDLIIVRYIPNLVPRLFTLDRDFIQEIRD

SEQ ID NO: 1521672 - protein, 22 aa, Mycobacterium tuberculosis
DADRLLAEPTAWLFGPEAHGLS

SEQ ID NO: 1521673 - protein, 22 aa, Mycobacterium tuberculosis
DAEFSFLPRFSPGKGLGVIPRE

SEQ ID NO: 1521674 - protein, 42 aa, Mycobacterium tuberculosis
DAELRPRHRDGHRRLRRRADLQLQHLLNDGGFRQWPSHPADQ

SEQ ID NO: 1521675 - protein, 26 aa, Mycobacterium tuberculosis
DAENTLGSWLPPGPAAVADYPTVLLS

SEQ ID NO: 1521676 - protein, 24 aa, Mycobacterium tuberculosis
DAFDIPLVFVVDTPGFLPGVEQEK

SEQ ID NO: 1521677 - protein, 25 aa, Mycobacterium tuberculosis
DAFDYVRELLSYLPPNNSTDAPRYQ

SEQ ID NO: 1521678 - protein, 23 aa, Mycobacterium tuberculosis
DAFEHFPPPILKPVILAAKSATL

SEQ ID NO: 1521679 - protein, 18 aa, Mycobacterium tuberculosis
DAFFASVEQLTRPTLRGR

SEQ ID NO: 1521680 - protein, 24 aa, Mycobacterium tuberculosis
DAFFSLAHRLLPADGVMLLHTITG

SEQ ID NO: 1521681 - protein, 27 aa, Mycobacterium tuberculosis
DAFHAWVQQFYGAELLFDLGDLPGAAD

SEQ ID NO: 1521682 - protein, 22 aa, Mycobacterium tuberculosis
DAFLSRSCRWALAAANLWQGNL

SEQ ID NO: 1521683 - protein, 23 aa, Mycobacterium tuberculosis
DAFVQLVMTNLFGQNAPLIAAAE

SEQ ID NO: 1521684 - protein, 34 aa, Mycobacterium tuberculosis
DAGDQAGFPLGWVHDVVWAPRPIGGPDAAGMAVA

SEQ ID NO: 1521685 - protein, 27 aa, Mycobacterium tuberculosis
DAGGTPFRPLFTVLAAQLGSDPDGWEV

SEQ ID NO: 1521686 - protein, 22 aa, Mycobacterium tuberculosis
DAGHRWPSFATQTLWRFFAAHF

SEQ ID NO: 1521687 - protein, 19 aa, Mycobacterium tuberculosis
DAGLPARRRGRGVASEVAL

SEQ ID NO: 1521688 - protein, 17 aa, Mycobacterium tuberculosis
DAGRIHKNLVPGTRQRK

SEQ ID NO: 1521689 - protein, 23 aa, Mycobacterium tuberculosis
DAGVPVIFLHHLGAVLDNWDPRV

SEQ ID NO: 1521690 - protein, 21 aa, Mycobacterium tuberculosis
DAILVPPGDGPWRLGLGSAGT

SEQ ID NO: 1521691 - protein, 18 aa, Mycobacterium tuberculosis
DAINSPVQTLTGRPLIGN

SEQ ID NO: 1521692 - protein, 32 aa, Mycobacterium tuberculosis; identical to SEQ ID NO: 226021

SEQ ID NO: 1521693 - protein, 25 aa, Mycobacterium tuberculosis
DAKITLDCFFDFRQPGHAEFEDRAA

SEQ ID NO: 1521694 - protein, 17 aa, Mycobacterium tuberculosis
DAKPFIGALITIDPEAF

SEQ ID NO: 1521695 - protein, 19 aa, Mycobacterium tuberculosis
DAKPFIGALITIDPEAFEG

SEQ ID NO: 1521696 - protein, 20 aa, Mycobacterium tuberculosis
DAKPFIGALITIDPEAFEGW

SEQ ID NO: 1521697 - protein, 28 aa, Mycobacterium tuberculosis
DAKTLGFPIRLPQLPGGWTPNSGGRGGI

SEQ ID NO: 1521698 - protein, 32 aa, Mycobacterium tuberculosis
DALAAHRRAHGLPAISLGWGLWDQASAMTGGL

SEQ ID NO: 1521699 - protein, 24 aa, Mycobacterium tuberculosis
DALAAQLRSYWARPLPATIVMRAG

SEQ ID NO: 1521700 - protein, 25 aa, Mycobacterium tuberculosis
DALAAQLRSYWARPLPATIVMRAGE

SEQ ID NO: 1521701 - protein, 20 aa, Mycobacterium tuberculosis
DALALLTYTSGSTGAPKGAM

SEQ ID NO: 1521702 - protein, 18 aa, Mycobacterium tuberculosis
DALCFPGLAAEWGGRRPF

SEQ ID NO: 1521703 - protein, 26 aa, Mycobacterium tuberculosis
DALDDKFLHDMLAEELRYSVIREVLP

SEQ ID NO: 1521704 - protein, 24 aa, Mycobacterium tuberculosis
DALFRVRPVLPDPVGLLRCAGGAE

SEQ ID NO: 1521705 - protein, 30 aa, Mycobacterium tuberculosis
DALGNFLARLVFPNPMRQLRITVGLIADLK

SEQ ID NO: 1521706 - protein, 18 aa, Mycobacterium tuberculosis
DALHAWLVDGRRALVTAE

SEQ ID NO: 1521707 - protein, 23 aa, Mycobacterium tuberculosis
DALIEGLALKPRKAFSPIRVAAT

SEQ ID NO: 1521708 - protein, 32 aa, Mycobacterium tuberculosis
DALKAVAAFRLALPRTMLRFAGGREITLGDLG

SEQ ID NO: 1521709 - protein, 21 aa, Mycobacterium tuberculosis
DALRGYQSLLPFAVIADPDRV

SEQ ID NO: 1521710 - protein, 17 aa, Mycobacterium tuberculosis
DALYLLSAPVDGAALNI

SEQ ID NO: 1521711 - protein, 20 aa, Mycobacterium tuberculosis
DAMALIHKRAHGVAVVILES

SEQ ID NO: 1521712 - protein, 26 aa, Mycobacterium tuberculosis
DAPANAFVMSFLGAVSTLNGSLVRPH

SEQ ID NO: 1521713 - protein, 19 aa, Mycobacterium tuberculosis
DAPARYAQRLYGAAPGTVI

SEQ ID NO: 1521714 - protein, 47 aa, Mycobacterium tuberculosis
DAPIDRLGAATAGPAFSLLLGTWGPRKRRAKRFAFEFGGAGGVGGSS

SEQ ID NO: 1521715 - protein, 26 aa, Mycobacterium tuberculosis
DAPVRYRFHFPRQQRGRFLCIADFIR

SEQ ID NO: 1521716 - protein, 23 aa, Mycobacterium tuberculosis
DARAVLRDVLINELQPGMDRSIR

SEQ ID NO: 1521717 - protein, 17 aa, Mycobacterium tuberculosis
DARLLAGQRRLASAIAG

SEQ ID NO: 1521718 - protein, 23 aa, Mycobacterium tuberculosis
DARLLAGQRRLASAIAGGAPMYQ

SEQ ID NO: 1521719 - protein, 25 aa, Mycobacterium tuberculosis
DARLVTMVPAGWSLVEAAAVPVAFL

SEQ ID NO: 1521720 - protein, 23 aa, Mycobacterium tuberculosis
DARQWFQSFPAVAGSSLFAKLHD

SEQ ID NO: 1521721 - protein, 17 aa, Mycobacterium tuberculosis
DARRLGHPVLALVRGSA

SEQ ID NO: 1521722 - protein, 35 aa, Mycobacterium tuberculosis
DASEGPLPQTRFVLRKALAAHLPVILVVSKTDPPD

SEQ ID NO: 1521723 - protein, 25 aa, Mycobacterium tuberculosis
DASVTFASYPPFLEHKRTRTEPLQF

SEQ ID NO: 1521724 - protein, 26 aa, Mycobacterium tuberculosis
DATRDFAIGLAGIPPSLQSALQALAA

SEQ ID NO: 1521725 - protein, 27 aa, Mycobacterium tuberculosis
DATRDFAIGLAGIPPSLQSALQALAAG

SEQ ID NO: 1521726 - protein, 17 aa, Mycobacterium tuberculosis
DATYGRGVYAWRLVRYY

SEQ ID NO: 1521727 - protein, 28 aa, Mycobacterium tuberculosis
DAVAEMTVALLLAVARHLIPADADVRSG

SEQ ID NO: 1521728 - protein, 21 aa, Mycobacterium tuberculosis
DAVHAAVLDLLARICDPLTGI

SEQ ID NO: 1521729 - protein, 28 aa, Mycobacterium tuberculosis
DAVIAVHLRGHFLLTRNAAAYCGTKPRM

SEQ ID NO: 1521730 - protein, 27 aa, Mycobacterium tuberculosis
DAVLGRLPMRVWLFGLRPMEGSPEGHN

SEQ ID NO: 1521731 - protein, 28 aa, Mycobacterium tuberculosis
DAVNAPTQTLLGLPLIGNGADGVAGTGS

SEQ ID NO: 1521732 - protein, 28 aa, Mycobacterium tuberculosis
DAVNAPTQTLLGRPLIGNGADGVAGTGS

SEQ ID NO: 1521733 - protein, 21 aa, Mycobacterium tuberculosis
DAVPYIILPNLQTGEPVMGVA

SEQ ID NO: 1521734 - protein, 23 aa, Mycobacterium tuberculosis
DAVTGMAGLLAWSQAPTRALGRF

SEQ ID NO: 1521735 - protein, 21 aa, Mycobacterium tuberculosis
DAWRRVFEFFGQHLRTGSPGE

SEQ ID NO: 1521736 - protein, 17 aa, Mycobacterium tuberculosis
DAYLLALAVAHDGRFVT

SEQ ID NO: 1521737 - protein, 17 aa, Mycobacterium tuberculosis
DAYLSPVLRRYINQVAD

SEQ ID NO: 1521738 - protein, 28 aa, Mycobacterium tuberculosis
DCAASPAGWLFVSRWTAGGNSLHIRAGD

SEQ ID NO: 1521739 - protein, 31 aa, Mycobacterium tuberculosis
DCALMGAFPMRLILATMLVAGRLLATLMAAP

SEQ ID NO: 1521740 - protein, 32 aa, Mycobacterium tuberculosis
DCALMGAFPMRLILATMLVAGRLLATLMAAPS

SEQ ID NO: 1521741 - protein, 23 aa, Mycobacterium tuberculosis
DCFLLQKVLDLPAGQLPPEPPIW

SEQ ID NO: 1521742 - protein, 23 aa, Mycobacterium tuberculosis
DCFLLQKVLELPAGQLPPEPPIW

SEQ ID NO: 1521743 - protein, 17 aa, Mycobacterium tuberculosis
DCGFATLWVGEHVRDDD

SEQ ID NO: 1521744 - protein, 19 aa, Mycobacterium tuberculosis
DCPSYAEVMLWHADLAAEV

SEQ ID NO: 1521745 - protein, 28 aa, Mycobacterium tuberculosis
DCRVHGRTWDLLRLTRMPTVQVDIGYIT

SEQ ID NO: 1521746 - protein, 18 aa, Mycobacterium tuberculosis
DCTAGLPFLIHAVSARAQ

SEQ ID NO: 1521747 - protein, 17 aa, Mycobacterium tuberculosis
DCTTRVIGGLWPAELSS

SEQ ID NO: 1521748 - protein, 29 aa, Mycobacterium tuberculosis
DDATAHAWIRASNPIMVGWPSDWGLKPHD

SEQ ID NO: 1521749 - protein, 27 aa, Mycobacterium tuberculosis
DDDSRWRCGWPRFALAPKQQLIARLIE

SEQ ID NO: 1521750 - protein, 30 aa, Mycobacterium tuberculosis
DDFVGSVLAVLRRLEGHFTLVFANADDPGT

SEQ ID NO: 1521751 - protein, 23 aa, Mycobacterium tuberculosis
DDGGAGGWLFGNGGNGGAGAAGT

SEQ ID NO: 1521752 - protein, 26 aa, Mycobacterium tuberculosis
DDGRMLLHSLFTYDRRWLHEQGIALT

SEQ ID NO: 1521753 - protein, 18 aa, Mycobacterium tuberculosis
DDGSIIDGLYAAGNVSAP

SEQ ID NO: 1521754 - protein, 20 aa, Mycobacterium tuberculosis
DDGSWRVFFTDLTQAYSRAD

SEQ ID NO: 1521755 - protein, 21 aa, Mycobacterium tuberculosis
DDGSWRVFFTDLTQAYSRADL

SEQ ID NO: 1521756 - protein, 21 aa, Mycobacterium tuberculosis
DDHTIAYYPPAFSTAAQEQLS

SEQ ID NO: 1521757 - protein, 28 aa, Mycobacterium tuberculosis
DDIVAHFFVCSTHDLILFFTTQGRVYRA

SEQ ID NO: 1521758 - protein, 22 aa, Mycobacterium tuberculosis
DDLFEHIPHLGALALHHALGAL

SEQ ID NO: 1521759 - protein, 21 aa, Mycobacterium tuberculosis
DDLLDHLLPHDWRVDMPELDP

SEQ ID NO: 1521760 - protein, 29 aa, Mycobacterium tuberculosis
DDLLRNGVLVDLYPLVRKIIRVGTDSFSL

SEQ ID NO: 1521761 - protein, 21 aa, Mycobacterium tuberculosis
DDLLRNGVLVDLYPLVRKSIR

SEQ ID NO: 1521762 - protein, 22 aa, Mycobacterium tuberculosis
DDLPWPDPADWLAAVRASPLLA

SEQ ID NO: 1521763 - protein, 20 aa, Mycobacterium tuberculosis
DDLQWERRYRRVAAYGQAKL

SEQ ID NO: 1521764 - protein, 20 aa, Mycobacterium tuberculosis
DDLQWERRYRRVAAYGQIGE

SEQ ID NO: 1521765 - protein, 29 aa, Mycobacterium tuberculosis
DDLRAQLQRLTALLQPTRPGGVSTLGALI

SEQ ID NO: 1521766 - protein, 23 aa, Mycobacterium tuberculosis
DDMAAQPFFDPSASFPPAPASAN

SEQ ID NO: 1521767 - protein, 18 aa, Mycobacterium tuberculosis
DDMAWMRQLLDWQREAAD

SEQ ID NO: 1521768 - protein, 33 aa, Mycobacterium tuberculosis
DDMHDWCISRQLWWGHRIPIWYGPDGEQVCVGP

SEQ ID NO: 1521769 - protein, 26 aa, Mycobacterium tuberculosis
DDMRHEKLLFKKGIHLLDCGTSGGVW

SEQ ID NO: 1521770 - protein, 31 aa, Mycobacterium tuberculosis; identical to SEQ ID NO: 1391694

SEQ ID NO: 1521771 - protein, 23 aa, Mycobacterium tuberculosis
DDPTRLAFPLRRGLVWRRRASEL

SEQ ID NO: 1521772 - protein, 24 aa, Mycobacterium tuberculosis
DDQAQWLDFVQRSVLLFAARGADG

SEQ ID NO: 1521773 - protein, 27 aa, Mycobacterium tuberculosis
DDQIRLPAGELAQPGLFAVLVGQHMQI

SEQ ID NO: 1521774 - protein, 23 aa, Mycobacterium tuberculosis
DDRITKARWVYFLTRMRNPTGDT

SEQ ID NO: 1521775 - protein, 25 aa, Mycobacterium tuberculosis
DDTPLARLYGWHRAMRIFDGPDEVH

SEQ ID NO: 1521776 - protein, 22 aa, Mycobacterium tuberculosis
DDVIWTREWLVDALRVFEGCRV

SEQ ID NO: 1521777 - protein, 18 aa, Mycobacterium tuberculosis
DDVLPYMRYNANKALANL

SEQ ID NO: 1521778 - protein, 27 aa, Mycobacterium tuberculosis
DDVLRRAVRLLAQLTRQVAVVQYPTLS

SEQ ID NO: 1521779 - protein, 30 aa, Mycobacterium tuberculosis
DDVQIRLQHIVFRPLPRHLRRDDQFFRLAH

SEQ ID NO: 1521780 - protein, 18 aa, Mycobacterium tuberculosis
DDVRAIYVAAWKAKVKGI

SEQ ID NO: 1521781 - protein, 21 aa, Mycobacterium tuberculosis
DDVSARFRGALGLGGQGGNGG

SEQ ID NO: 1521782 - protein, 23 aa, Mycobacterium tuberculosis
DDVVRDYLYPIVALRIRGIALPG

SEQ ID NO: 1521783 - protein, 20 aa, Mycobacterium tuberculosis
DDWLDASRALLTRIGDHAFG

SEQ ID NO: 1521784 - protein, 18 aa, Mycobacterium tuberculosis
DDYFMPLTRQVLSEGIQD

SEQ ID NO: 1521785 - protein, 19 aa, Mycobacterium tuberculosis
DDYLVKPFVLAELVARVKA

SEQ ID NO: 1521786 - protein, 27 aa, Mycobacterium tuberculosis
DDYLVKPFVLAELVARVKALLRRRGST

SEQ ID NO: 1521787 - protein, 25 aa, Mycobacterium tuberculosis
DDYNELVISVPLQLTLPAIETSPAE

SEQ ID NO: 1521788 - protein, 18 aa, Mycobacterium tuberculosis
DEAAEMMINLFWLGLKGA

SEQ ID NO: 1521789 - protein, 25 aa, Mycobacterium tuberculosis
DEAERYLLGSRSALGWIIDRYRVTT

SEQ ID NO: 1521790 - protein, 24 aa, Mycobacterium tuberculosis
DEAGAAALWFALDTDLPVLVDADG

SEQ ID NO: 1521791 - protein, 26 aa, Mycobacterium tuberculosis
DEAGFGVLLPSWWDRRRKLGLVLSAY

SEQ ID NO: 1521792 - protein, 17 aa, Mycobacterium tuberculosis
DEAILFGPGIRGEPTAQ

SEQ ID NO: 1521793 - protein, 23 aa, Mycobacterium tuberculosis
DEATRPLVICDLGMPHDVDPAVA

SEQ ID NO: 1521794 - protein, 24 aa, Mycobacterium tuberculosis
DECHHLLATWGALVSALASVLGAQ

SEQ ID NO: 1521795 - protein, 25 aa, Mycobacterium tuberculosis
DECHHLLATWGALVSALASVLGAQT

SEQ ID NO: 1521796 - protein, 17 aa, Mycobacterium tuberculosis
DEELDIWLISWVPGQPT

SEQ ID NO: 1521797 - protein, 32 aa, Mycobacterium tuberculosis
DEERLAFYRTLYRDLARYGAALWLVAANMASY

SEQ ID NO: 1521798 - protein, 24 aa, Mycobacterium tuberculosis
DEETIKYLRFTGRTPEQVALVEAY

SEQ ID NO: 1521799 - protein, 24 aa, Mycobacterium tuberculosis
DEFARRLPFMAAKRAFSEPVALNW

SEQ ID NO: 1521800 - protein, 18 aa, Mycobacterium tuberculosis
DEFLYYDDGFRERSSTCR

SEQ ID NO: 1521801 - protein, 28 aa, Mycobacterium tuberculosis
DEGHQRACIRGRWFIVAARPGVGKSTLG

SEQ ID NO: 1521802 - protein, 21 aa, Mycobacterium tuberculosis
DEHFLAHTLVHRESDGTLRVG

SEQ ID NO: 1521803 - protein, 19 aa, Mycobacterium tuberculosis
DEHGWYDTGDLGYLTEEGH

SEQ ID NO: 1521804 - protein, 24 aa, Mycobacterium tuberculosis
DEHNSFFLPRIAAGDLHFSIGYSE

SEQ ID NO: 1521805 - protein, 19 aa, Mycobacterium tuberculosis
DEIAELLLKWKKTPQRPVS

SEQ ID NO: 1521806 - protein, 24 aa, Mycobacterium tuberculosis
DELAGQLAGFFGSGRWGGRQLGSG

SEQ ID NO: 1521807 - protein, 20 aa, Mycobacterium tuberculosis
DELASCPPILVLTGRPDDTW

SEQ ID NO: 1521808 - protein, 25 aa, Mycobacterium tuberculosis
DELDALLWRAARPGEPSWPSPFGPG

SEQ ID NO: 1521809 - protein, 18 aa, Mycobacterium tuberculosis
DELDLPVDWEPLGAIAIG

SEQ ID NO: 1521810 - protein, 26 aa, Mycobacterium tuberculosis
DELDRHLRLPLRDVIWGADADLLDST

SEQ ID NO: 1521811 - protein, 20 aa, Mycobacterium tuberculosis
DELFRRSLGNPLYLRHLIDG

SEQ ID NO: 1521812 - protein, 18 aa, Mycobacterium tuberculosis
DELGTALLLITHDLALAA

SEQ ID NO: 1521813 - protein, 21 aa, Mycobacterium tuberculosis
DELHLGFNFRLARTEFDAAEI

SEQ ID NO: 1521814 - protein, 20 aa, Mycobacterium tuberculosis
DELIPLVRGVVRGAPHALVV

SEQ ID NO: 1521815 - protein, 22 aa, Mycobacterium tuberculosis
DELIRQLWQRAVIVLPAGADTV

SEQ ID NO: 1521816 - protein, 24 aa, Mycobacterium tuberculosis
DELKLYDTPAMPPPIFVAASGPQS

SEQ ID NO: 1521817 - protein, 20 aa, Mycobacterium tuberculosis
DELPATGARLRWAPAQGPSA

SEQ ID NO: 1521818 - protein, 24 aa, Mycobacterium tuberculosis
DELTLAAPLVLPASGSVAVQVVVN

SEQ ID NO: 1521819 - protein, 24 aa, Mycobacterium tuberculosis
DELVDGLLAILAAGASLVQVANPD

SEQ ID NO: 1521820 - protein, 32 aa, Mycobacterium tuberculosis
DEMTRVIWKLIKDMLILPYLDIRLDYYDLGIE

SEQ ID NO: 1521821 - protein, 22 aa, Mycobacterium tuberculosis
DENLHMIFYRDVSEAAFDLVPN

SEQ ID NO: 1521822 - protein, 24 aa, Mycobacterium tuberculosis
DEPDPVTLVAQLSRRFAPPTLVNT

SEQ ID NO: 1521823 - protein, 23 aa, Mycobacterium tuberculosis
DEPGALIIAWIDDERPAGGHIQM

SEQ ID NO: 1521824 - protein, 22 aa, Mycobacterium tuberculosis
DEQFLHNAWKLQNPIKLLREAM

SEQ ID NO: 1521825 - protein, 22 aa, Mycobacterium tuberculosis
DESMLLSFERWAPDMGWEIATG

SEQ ID NO: 1521826 - protein, 29 aa, Mycobacterium tuberculosis
DETAWRNGIWYTARLRPGPLRPAERRTAV

SEQ ID NO: 1521827 - protein, 24 aa, Mycobacterium tuberculosis
DETTLGKWWRDMKLARVGGGTDEV

SEQ ID NO: 1521828 - protein, 25 aa, Mycobacterium tuberculosis
DETTLGKWWRDMKLARVGGGTRRGA

SEQ ID NO: 1521829 - protein, 18 aa, Mycobacterium tuberculosis
DEVGLRRVFGCFPCGVIA

SEQ ID NO: 1521830 - protein, 23 aa, Mycobacterium tuberculosis
DEVHLPRVWRGRGVCAVVSHPSL

SEQ ID NO: 1521831 - protein, 21 aa, Mycobacterium tuberculosis
DEVKVPVRWWHGDHDHIVPFS

SEQ ID NO: 1521832 - protein, 17 aa, Mycobacterium tuberculosis
DEVLLRVFGKVVELAFL

SEQ ID NO: 1521833 - protein, 18 aa, Mycobacterium tuberculosis
DEVSAAIASLFGAHGWRI

SEQ ID NO: 1521834 - protein, 18 aa, Mycobacterium tuberculosis
DEVSAAIASLFSGNAQAY

SEQ ID NO: 1521835 - protein, 21 aa, Mycobacterium tuberculosis
DEVSLAISALFGQHAQAYQAL

SEQ ID NO: 1521836 - protein, 19 aa, Mycobacterium tuberculosis
DEVWRTIHKHKVNLLFFTG

SEQ ID NO: 1521837 - protein, 26 aa, Mycobacterium tuberculosis
DFAELRRRHLVPQPPYGHGAAAAAVG

SEQ ID NO: 1521838 - protein, 17 aa, Mycobacterium tuberculosis
DFALCVQSALERLGLGP

SEQ ID NO: 1521839 - protein, 22 aa, Mycobacterium tuberculosis
DFEKTLRFWLDRGVDGFRIDVA

SEQ ID NO: 1521840 - protein, 18 aa, Mycobacterium tuberculosis
DFFRPLSKPLRALPYAAD

SEQ ID NO: 1521841 - protein, 24 aa, Mycobacterium tuberculosis
DFGRLKRWAGWNRNRCAGAINDIG

SEQ ID NO: 1521842 - protein, 19 aa, Mycobacterium tuberculosis
DFHIRRIGVPAPGGRRELE

SEQ ID NO: 1521843 - protein, 26 aa, Mycobacterium tuberculosis
DFKQCPLLYRFRAIDRLPEATSAAQL

SEQ ID NO: 1521844 - protein, 17 aa, Mycobacterium tuberculosis
DFLDLPRQQLADAALSA

SEQ ID NO: 1521845 - protein, 24 aa, Mycobacterium tuberculosis
DFMAARTAFFDEYFLATADAGVRQ

SEQ ID NO: 1521846 - protein, 17 aa, Mycobacterium tuberculosis
DFNAGVRNTGWSNSGLT

SEQ ID NO: 1521847 - protein, 17 aa, Mycobacterium tuberculosis
DFPPYDSVFDPVNRVLL

SEQ ID NO: 1521848 - protein, 20 aa, Mycobacterium tuberculosis
DFPVERFMRDAKITQIYEGT

SEQ ID NO: 1521849 - protein, 19 aa, Mycobacterium tuberculosis
DFRDPAPFAVLRRVDRWFW

SEQ ID NO: 1521850 - protein, 21 aa, Mycobacterium tuberculosis
DFRLWVCLHEVTHRVQFTANS

SEQ ID NO: 1521851 - protein, 21 aa, Mycobacterium tuberculosis
DFRNAWFVDASGRKVFVRVVL

SEQ ID NO: 1521852 - protein, 21 aa, Mycobacterium tuberculosis
DFSRFDAVVLALDPPFGAHGQ

SEQ ID NO: 1521853 - protein, 19 aa, Mycobacterium tuberculosis
DFTGRLCPAPCEPACVLGI

SEQ ID NO: 1521854 - protein, 19 aa, Mycobacterium tuberculosis
DFVGSVLAVLRRLEWHFTL

SEQ ID NO: 1521855 - protein, 31 aa, Mycobacterium tuberculosis; identical to SEQ ID NO: 236241

SEQ ID NO: 1521856 - protein, 26 aa, Mycobacterium tuberculosis
DGAAMRPLRHTLSQLRLHELLVEVQD

SEQ ID NO: 1521857 - protein, 32 aa, Mycobacterium tuberculosis
DGAFATLRREAPISFWPTIELPGFVAGNGHWA

SEQ ID NO: 1521858 - protein, 21 aa, Mycobacterium tuberculosis
DGAGTYRRLVGRAWRGRLGSR

SEQ ID NO: 1521859 - protein, 17 aa, Mycobacterium tuberculosis
DGALARIRLPGGMITAA

SEQ ID NO: 1521860 - protein, 20 aa, Mycobacterium tuberculosis
DGALPLLAPMSEVAGRLAAQ

SEQ ID NO: 1521861 - protein, 19 aa, Mycobacterium tuberculosis
DGARFYLRAQPRRSRRRAP

SEQ ID NO: 1521862 - protein, 26 aa, Mycobacterium tuberculosis
DGAYLVTGGLGGLGLFLAGELAAAGC

SEQ ID NO: 1521863 - protein, 23 aa, Mycobacterium tuberculosis
DGAYRRTLRFPWGNGIVSLTPAP

SEQ ID NO: 1521864 - protein, 25 aa, Mycobacterium tuberculosis
DGAYRRTLRLPWGNGIVSLTPAPDH

SEQ ID NO: 1521865 - protein, 24 aa, Mycobacterium tuberculosis
DGCLRPLRIVVPEGSMLAPTHPAA

SEQ ID NO: 1521866 - protein, 21 aa, Mycobacterium tuberculosis
DGDHLRLSGAMALVLAAAGGV

SEQ ID NO: 1521867 - protein, 30 aa, Mycobacterium tuberculosis
DGDLHIAGQYLPAPITKRWLRVTLDTPGPN

SEQ ID NO: 1521868 - protein, 24 aa, Mycobacterium tuberculosis
DGEDLSWLWDVRFEHFEKTRVVAA

SEQ ID NO: 1521869 - protein, 19 aa, Mycobacterium tuberculosis
DGEFFGVIAQLPGASGRIT

SEQ ID NO: 1521870 - protein, 17 aa, Mycobacterium tuberculosis
DGELRMNAHLRAAHHLS

SEQ ID NO: 1521871 - protein, 26 aa, Mycobacterium tuberculosis
DGELYVIAGNIPLINIPPTPGIGNTT

SEQ ID NO: 1521872 - protein, 20 aa, Mycobacterium tuberculosis
DGFHILETITVTGSFTLKDE

SEQ ID NO: 1521873 - protein, 21 aa, Mycobacterium tuberculosis
DGFQAFVYGPIHATGQQWINS

SEQ ID NO: 1521874 - protein, 21 aa, Mycobacterium tuberculosis
DGFYRGQRLFRAPHLDPSGGN

SEQ ID NO: 1521875 - protein, 19 aa, Mycobacterium tuberculosis
DGGAAARAGVGGPVVSVPP

SEQ ID NO: 1521876 - protein, 21 aa, Mycobacterium tuberculosis
DGGAGGWLFGNGGNGGHGATG

SEQ ID NO: 1521877 - protein, 24 aa, Mycobacterium tuberculosis
DGGAGPLLIGNGGVGGLGGAGAAG

SEQ ID NO: 1521878 - protein, 17 aa, Mycobacterium tuberculosis
DGGHGGNATLIGNGGDG

SEQ ID NO: 1521879 - protein, 17 aa, Mycobacterium tuberculosis
DGGIPGFTLFPDGLTFP

SEQ ID NO: 1521880 - protein, 23 aa, Mycobacterium tuberculosis
DGGIPGFTLFPDGLTFPKIPVHV

SEQ ID NO: 1521881 - protein, 24 aa, Mycobacterium tuberculosis
DGGNGRLFGVDGAGGHGGFGSAAG

SEQ ID NO: 1521882 - protein, 23 aa, Mycobacterium tuberculosis
DGGNLRLSLTDFPPNFNILHIDG

SEQ ID NO: 1521883 - protein, 26 aa, Mycobacterium tuberculosis
DGGRAVLVLSDWPAPQAPQSASGEML

SEQ ID NO: 1521884 - protein, 28 aa, Mycobacterium tuberculosis
DGGRGAHGTLFSSLAGTGGTGGNGGTGG

SEQ ID NO: 1521885 - protein, 20 aa, Mycobacterium tuberculosis
DGGRGGLLAGNGGTGGAGGN

SEQ ID NO: 1521886 - protein, 22 aa, Mycobacterium tuberculosis
DGGRGGLLAGNGGTGGAGGNGG

SEQ ID NO: 1521887 - protein, 30 aa, Mycobacterium tuberculosis; identical to SEQ ID NO: 224882

SEQ ID NO: 1521888 - protein, 18 aa, Mycobacterium tuberculosis
DGHQWRYNTLFRSQDRDL

SEQ ID NO: 1521889 - protein, 22 aa, Mycobacterium tuberculosis
DGHWLLAHNGVVDRAVLPAGPA

SEQ ID NO: 1521890 - protein, 21 aa, Mycobacterium tuberculosis
DGIAHAPQFPLRILSDINAFM

SEQ ID NO: 1521891 - protein, 19 aa, Mycobacterium tuberculosis
DGIALGLWAGVAVSDLEFI

SEQ ID NO: 1521892 - protein, 18 aa, Mycobacterium tuberculosis
DGIDVHLLPFPDLADDDA

SEQ ID NO: 1521893 - protein, 21 aa, Mycobacterium tuberculosis
DGIGIVFRKGLPLEDMEFHQF

SEQ ID NO: 1521894 - protein, 17 aa, Mycobacterium tuberculosis
DGISAAVLVCDLVAALK

SEQ ID NO: 1521895 - protein, 23 aa, Mycobacterium tuberculosis
DGISAAVLVCDLVAALKGQGRSV

SEQ ID NO: 1521896 - protein, 26 aa, Mycobacterium tuberculosis
DGISRLRFRLRWRGFRLIVDANHTDV

SEQ ID NO: 1521897 - protein, 27 aa, Mycobacterium tuberculosis
DGISRLRFRLRWRGFRLIVDANHTDVT

SEQ ID NO: 1521898 - protein, 17 aa, Mycobacterium tuberculosis
DGKLLLIGFAAGAVPTL

SEQ ID NO: 1521899 - protein, 17 aa, Mycobacterium tuberculosis
DGKPFIETFVLTAALGA

SEQ ID NO: 1521900 - protein, 20 aa, Mycobacterium tuberculosis
DGLETVLHIFPTLAANINQL

SEQ ID NO: 1521901 - protein, 24 aa, Mycobacterium tuberculosis
DGLLAVTFCSRAAWRFVASRGAQK

SEQ ID NO: 1521902 - protein, 24 aa, Mycobacterium tuberculosis
DGMEAVLPVLWSDGHALLTDQLPD

SEQ ID NO: 1521903 - protein, 24 aa, Mycobacterium tuberculosis
DGMESLLGAIYLQHGMEKAREVIL

SEQ ID NO: 1521904 - protein, 25 aa, Mycobacterium tuberculosis
DGMPQPLLPVFDVVDGFAAGFDVAA

SEQ ID NO: 1521905 - protein, 22 aa, Mycobacterium tuberculosis
DGMSRLSGYLTPQARATFEAVL

SEQ ID NO: 1521906 - protein, 22 aa, Mycobacterium tuberculosis
DGPMAGLLARAIVVIGADGNVA

SEQ ID NO: 1521907 - protein, 25 aa, Mycobacterium tuberculosis
DGPSHHGLWDLALLACVPGFQIACP

SEQ ID NO: 1521908 - protein, 17 aa, Mycobacterium tuberculosis
DGPVLVQLAFQKPGTPD

SEQ ID NO: 1521909 - protein, 18 aa, Mycobacterium tuberculosis
DGQMFLEMRLVEGTDLDS

SEQ ID NO: 1521910 - protein, 21 aa, Mycobacterium tuberculosis
DGREYVAQFLISGAGALHIPS

SEQ ID NO: 1521911 - protein, 22 aa, Mycobacterium tuberculosis
DGRFQWIVFTSTNAVRAVWEKF

SEQ ID NO: 1521912 - protein, 21 aa, Mycobacterium tuberculosis
DGRGLSGSVFPVGASANLVFY

SEQ ID NO: 1521913 - protein, 23 aa, Mycobacterium tuberculosis
DGRKFLAYYERDGVLVGVVGGGM

SEQ ID NO: 1521914 - protein, 22 aa, Mycobacterium tuberculosis
DGRLPFDLRLAVLSNGSVILER

SEQ ID NO: 1521915 - protein, 28 aa, Mycobacterium tuberculosis
DGRPEARLWALVRRQSLSRFERLAGQWG

SEQ ID NO: 1521916 - protein, 21 aa, Mycobacterium tuberculosis
DGRSRLLPGLPADRIVALGAE

SEQ ID NO: 1521917 - protein, 19 aa, Mycobacterium tuberculosis
DGRTWYRTGDLARYWHDGT

SEQ ID NO: 1521918 - protein, 17 aa, Mycobacterium tuberculosis
DGRTYIDLLGGIAVNVL

SEQ ID NO: 1521919 - protein, 17 aa, Mycobacterium tuberculosis
DGSTWILRRILRRLGYA

SEQ ID NO: 1521920 - protein, 17 aa, Mycobacterium tuberculosis
DGSYIITGGLGGLGLFL

SEQ ID NO: 1521921 - protein, 26 aa, Mycobacterium tuberculosis
DGTIKIEMNFLPDVYMPCEVCQGARY

SEQ ID NO: 1521922 - protein, 17 aa, Mycobacterium tuberculosis
DGTILIGDIPIPIIDVP

SEQ ID NO: 1521923 - protein, 26 aa, Mycobacterium tuberculosis
DGTRRPLAALQAQILHIETLAATGRE

SEQ ID NO: 1521924 - protein, 30 aa, Mycobacterium tuberculosis
DGVAILARNHRWFVIANYGAARVGARIILL

SEQ ID NO: 1521925 - protein, 20 aa, Mycobacterium tuberculosis
DGVYAAWFTVLGHGPVTGTV

SEQ ID NO: 1521926 - protein, 21 aa, Mycobacterium tuberculosis
DGYARTLSTLTWRVVTQRYQA

SEQ ID NO: 1521927 - protein, 27 aa, Mycobacterium tuberculosis
DHAMLATGLLALYQLTSEGAWLTAAVD

SEQ ID NO: 1521928 - protein, 18 aa, Mycobacterium tuberculosis
DHCHTRILTPGPGNDATG

SEQ ID NO: 1521929 - protein, 26 aa, Mycobacterium tuberculosis
DHCLDLPGLFVWRRYHPSRPSGKALL

SEQ ID NO: 1521930 - protein, 36 aa, Mycobacterium tuberculosis
DHERIWYSDFLDFVGRERIFASLLTPASYGADDCRW

SEQ ID NO: 1521931 - protein, 23 aa, Mycobacterium tuberculosis
DHFRIYVSQKLARLERFDRTIYL

SEQ ID NO: 1521932 - protein, 24 aa, Mycobacterium tuberculosis
DHGPGFADHFLPVAFDRFTRADTA

SEQ ID NO: 1521933 - protein, 22 aa, Mycobacterium tuberculosis
DHIAAIALFGNPSGRAGGLMSA

SEQ ID NO: 1521934 - protein, 18 aa, Mycobacterium tuberculosis
DHLRLVTLPWSRDLAAAI

SEQ ID NO: 1521935 - protein, 17 aa, Mycobacterium tuberculosis
DHPFNPVSLALGAEATF

SEQ ID NO: 1521936 - protein, 23 aa, Mycobacterium tuberculosis
DHPRPRLFSLLHEFVHVVLHTEG

SEQ ID NO: 1521937 - protein, 27 aa, Mycobacterium tuberculosis
DHRRRGRQPAWRFHRRQRGGGGRRRGV

SEQ ID NO: 1521938 - protein, 29 aa, Mycobacterium tuberculosis
DHRVQRAVIWPLVYLKSLTLKGFKSFAAP

SEQ ID NO: 1521939 - protein, 27 aa, Mycobacterium tuberculosis
DHTARAFGRALGCPQPLIAVASAATRW

SEQ ID NO: 1521940 - protein, 18 aa, Mycobacterium tuberculosis
DHTIAYYPPAFSTAAQEQ

SEQ ID NO: 1521941 - protein, 19 aa, Mycobacterium tuberculosis
DHTIAYYPPAFSTAAQEQL

SEQ ID NO: 1521942 - protein, 26 aa, Mycobacterium tuberculosis
DIAEEYYLSFLLDRANRTYLAMCSVE

SEQ ID NO: 1521943 - protein, 20 aa, Mycobacterium tuberculosis
DIAEPLPRTLVWSAAWEMTR

SEQ ID NO: 1521944 - protein, 40 aa, Mycobacterium tuberculosis
DIAKQRLVWRLCQRYPRAARRLIRHLNAKQLAAGYPADEH

SEQ ID NO: 1521945 - protein, 19 aa, Mycobacterium tuberculosis
DIAMVFQSYALYPHMTVRQ

SEQ ID NO: 1521946 - protein, 18 aa, Mycobacterium tuberculosis
DICFIPSGNTRAFLGERI

SEQ ID NO: 1521947 - protein, 18 aa, Mycobacterium tuberculosis
DIDPLFGGMPAFERLVAA

SEQ ID NO: 1521948 - protein, 20 aa, Mycobacterium tuberculosis
DIDYPIRSGIDPIVFGVVRE

SEQ ID NO: 1521949 - protein, 18 aa, Mycobacterium tuberculosis
DIEAVLAAGMAEKSREFA

SEQ ID NO: 1521950 - protein, 23 aa, Mycobacterium tuberculosis
DIEVPAPPFWGSRIVKGLAVADY

SEQ ID NO: 1521951 - protein, 33 aa, Mycobacterium tuberculosis
DIGAGAVTPAVGALLCLLAKLSGGKAVAEVGTG

SEQ ID NO: 1521952 - protein, 23 aa, Mycobacterium tuberculosis
DIGSRFDSQVQPRQYERGADQDK

SEQ ID NO: 1521953 - protein, 22 aa, Mycobacterium tuberculosis
DIKAPLLAALGAADLALATVNE

SEQ ID NO: 1521954 - protein, 31 aa, Mycobacterium tuberculosis
DIKAPLLPRLERPTWPWATVNELITNLRERA

SEQ ID NO: 1521955 - protein, 24 aa, Mycobacterium tuberculosis
DIKPEHLILIGQIAQDFGLYTKIT

SEQ ID NO: 1521956 - protein, 23 aa, Mycobacterium tuberculosis
DILAPTTSLLFKYNPEYTCFLQG

SEQ ID NO: 1521957 - protein, 19 aa, Mycobacterium tuberculosis
DILATAFLQAGQGGRFLCT

SEQ ID NO: 1521958 - protein, 29 aa, Mycobacterium tuberculosis
DILHREEAMARYWRAVPARDYSIANVTAG

SEQ ID NO: 1521959 - protein, 24 aa, Mycobacterium tuberculosis
DILPISFGFPFGFSAAIPPNLPLP

SEQ ID NO: 1521960 - protein, 25 aa, Mycobacterium tuberculosis
DILPISFGFPFGFSAAIPPNLPLPA

SEQ ID NO: 1521961 - protein, 18 aa, Mycobacterium tuberculosis
DILTRLTAPVIRGLGIGI

SEQ ID NO: 1521962 - protein, 24 aa, Mycobacterium tuberculosis
DINKYGAFCWSRCPSWPTRWTRNH

SEQ ID NO: 1521963 - protein, 17 aa, Mycobacterium tuberculosis
DIPIHIPINIDAGVVTL

SEQ ID NO: 1521964 - protein, 25 aa, Mycobacterium tuberculosis
DIRDACGLAPSSIYWHFGSKEGVLA

SEQ ID NO: 1521965 - protein, 18 aa, Mycobacterium tuberculosis
DIRFGLYGALAHPMESAA

SEQ ID NO: 1521966 - protein, 17 aa, Mycobacterium tuberculosis
DIVLLDLMLPGMSGTDV

SEQ ID NO: 1521967 - protein, 23 aa, Mycobacterium tuberculosis
DIVYVHGAVISSRRGELSVLADC

SEQ ID NO: 1521968 - protein, 17 aa, Mycobacterium tuberculosis
DIWLISWVPGQPTELHD

SEQ ID NO: 1521969 - protein, 23 aa, Mycobacterium tuberculosis
DIYNPLRFLRAAMKWCRKAQELG

SEQ ID NO: 1521970 - protein, 29 aa, Mycobacterium tuberculosis
DIYTDPVPFPSFKNGVGLMLQLPQATVVG

SEQ ID NO: 1521971 - protein, 20 aa, Mycobacterium tuberculosis
DKALRLAIAKGIDRYTIARV

SEQ ID NO: 1521972 - protein, 29 aa, Mycobacterium tuberculosis
DKAQHGVMELLLINHPLDCPMCDKGGECP

SEQ ID NO: 1521973 - protein, 21 aa, Mycobacterium tuberculosis
DKEILMQTNWARYISVRQVEV

SEQ ID NO: 1521974 - protein, 23 aa, Mycobacterium tuberculosis
DKLQKWFREVLVHAYRVSSNEVS

SEQ ID NO: 1521975 - protein, 17 aa, Mycobacterium tuberculosis
DKLRRQAETPLLLAVDG

SEQ ID NO: 1521976 - protein, 22 aa, Mycobacterium tuberculosis
DKLVHELVRRWSGHMVTSQGDG

SEQ ID NO: 1521977 - protein, 19 aa, Mycobacterium tuberculosis
DKMVWATRWGADTIMDLST

SEQ ID NO: 1521978 - protein, 34 aa, Mycobacterium tuberculosis
DKPFSCLMLNAIPDLAFWGSSNGQFFPRWTYEKT

SEQ ID NO: 1521979 - protein, 17 aa, Mycobacterium tuberculosis
DKPVKWMEDRSENLTST

SEQ ID NO: 1521980 - protein, 24 aa, Mycobacterium tuberculosis
DKRFPQLTVLSIAPLLASTIRAVF

SEQ ID NO: 1521981 - protein, 26 aa, Mycobacterium tuberculosis
DKRHRAHQVAARLQRLLVGRLQPQRG

SEQ ID NO: 1521982 - protein, 17 aa, Mycobacterium tuberculosis
DKTFRLFSTLHDALTGV

SEQ ID NO: 1521983 - protein, 23 aa, Mycobacterium tuberculosis
DKVAELTQLWWPEAERNRVLPLL

SEQ ID NO: 1521984 - protein, 21 aa, Mycobacterium tuberculosis
DKVILDDVTLSFYPGAKIGVV

SEQ ID NO: 1521985 - protein, 18 aa, Mycobacterium tuberculosis
DKVNAYVAAFNQGRNTGP

SEQ ID NO: 1521986 - protein, 20 aa, Mycobacterium tuberculosis
DKWRLAEVLAWQAYVGFAGE

SEQ ID NO: 1521987 - protein, 23 aa, Mycobacterium tuberculosis
DKWRLAEVLAWQAYVGFAGEGDP

SEQ ID NO: 1521988 - protein, 21 aa, Mycobacterium tuberculosis
DLAAFTAIVPCGISDAAVTSL

SEQ ID NO: 1521989 - protein, 27 aa, Mycobacterium tuberculosis
DLAELLAMRGIDGLPFSWTVASWTQHS

SEQ ID NO: 1521990 - protein, 28 aa, Mycobacterium tuberculosis
DLAELLAMRGIDGLPFSWTVASWTQHSS

SEQ ID NO: 1521991 - protein, 17 aa, Mycobacterium tuberculosis
DLAEVWFGTGRNAQVDA

SEQ ID NO: 1521992 - protein, 21 aa, Mycobacterium tuberculosis
DLAGCLIFRIGPFFLRDNKVT

SEQ ID NO: 1521993 - protein, 20 aa, Mycobacterium tuberculosis
DLALNWLCERQLPDGSWGAE

SEQ ID NO: 1521994 - protein, 24 aa, Mycobacterium tuberculosis
DLAPQHWIALTPPRIPRVRTLQNV

SEQ ID NO: 1521995 - protein, 17 aa, Mycobacterium tuberculosis
DLARRYPVGKAVAAIDA

SEQ ID NO: 1521996 - protein, 21 aa, Mycobacterium tuberculosis
DLASQAWQGPAAAAMAAAAPY

SEQ ID NO: 1521997 - protein, 20 aa, Mycobacterium tuberculosis
DLATPGFLSGIGNFGTNLAG

SEQ ID NO: 1521998 - protein, 17 aa, Mycobacterium tuberculosis
DLAYFRVLIHSTRNRAL

SEQ ID NO: 1521999 - protein, 19 aa, Mycobacterium tuberculosis
DLCAKTRVFILAESLGGVE

SEQ ID NO: 1522000 - protein, 24 aa, Mycobacterium tuberculosis
DLDAALTTIFRTPVRLRAAGRTDA

SEQ ID NO: 1522001 - protein, 23 aa, Mycobacterium tuberculosis
DLDALIGGFKPVFRALDPAKVNN

SEQ ID NO: 1522002 - protein, 24 aa, Mycobacterium tuberculosis
DLDIENYWFRRHQVVYQRLAPRCT

SEQ ID NO: 1522003 - protein, 17 aa, Mycobacterium tuberculosis
DLEDAVVVVEWARAWPS

SEQ ID NO: 1522004 - protein, 25 aa, Mycobacterium tuberculosis
DLEEQLLSHPAIFSAAAVGLPDQYL

SEQ ID NO: 1522005 - protein, 26 aa, Mycobacterium tuberculosis
DLELIGRIGWTCRDVWWAATQDPRAW

SEQ ID NO: 1522006 - protein, 19 aa, Mycobacterium tuberculosis
DLFAAIVVLMQWGDEYLPR

SEQ ID NO: 1522007 - protein, 17 aa, Mycobacterium tuberculosis
DLFEALFVPVPSGSASN

SEQ ID NO: 1522008 - protein, 18 aa, Mycobacterium tuberculosis
DLFPVLRVLVDRPVMPAR

SEQ ID NO: 1522009 - protein, 28 aa, Mycobacterium tuberculosis
DLGALSSWYVWAALGLYPSTPGTTILTV

SEQ ID NO: 1522010 - protein, 29 aa, Mycobacterium tuberculosis
DLGELPGDLAWQPPLWRALVTTVGADPAH

SEQ ID NO: 1522011 - protein, 24 aa, Mycobacterium tuberculosis
DLGIEVFLVMPFTTDFMKLTPDRF

SEQ ID NO: 1522012 - protein, 26 aa, Mycobacterium tuberculosis
DLGIRQEWLPLFDQYQVDLVVCGHEH

SEQ ID NO: 1522013 - protein, 19 aa, Mycobacterium tuberculosis
DLGSIPRRLRKEIFELYGY

SEQ ID NO: 1522014 - protein, 17 aa, Mycobacterium tuberculosis
DLGVAIDALRRPERRRG

SEQ ID NO: 1522015 - protein, 28 aa, Mycobacterium tuberculosis
DLGVIFEGELFITGRIKELLVVDGANHY

SEQ ID NO: 1522016 - protein, 36 aa, Mycobacterium tuberculosis
DLGYDRRQVLQRLKYLPLAPFRISYAYTNFGVTAAA

SEQ ID NO: 1522017 - protein, 37 aa, Mycobacterium tuberculosis; identical to SEQ ID NO: 236254

SEQ ID NO: 1522018 - protein, 24 aa, Mycobacterium tuberculosis
DLHLGQVLRTPESWLLIDFEGEPG

SEQ ID NO: 1522019 - protein, 19 aa, Mycobacterium tuberculosis
DLHRPLVMAVDRADVLQPE

SEQ ID NO: 1522020 - protein, 26 aa, Mycobacterium tuberculosis
DLHTRKVLDLTIRLAEVMLSSGSGTA

SEQ ID NO: 1522021 - protein, 20 aa, Mycobacterium tuberculosis
DLILFFTTQGRVYRAKAYDL

SEQ ID NO: 1522022 - protein, 27 aa, Mycobacterium tuberculosis
DLINPHPLFVPWLVGPLLTGEGIQLVK

SEQ ID NO: 1522023 - protein, 28 aa, Mycobacterium tuberculosis
DLIQDPLTGFIYAFDDMLARHNASWADL

SEQ ID NO: 1522024 - protein, 17 aa, Mycobacterium tuberculosis
DLKTLHDQALSAAAQAK

SEQ ID NO: 1522025 - protein, 20 aa, Mycobacterium tuberculosis
DLLCVIQSSLASRHPLTPGS

SEQ ID NO: 1522026 - protein, 20 aa, Mycobacterium tuberculosis
DLLLTKGEYQLKLTPPFVPG

SEQ ID NO: 1522027 - protein, 28 aa, Mycobacterium tuberculosis
DLNLKLQPARYRQLLQHILQHVADGKLE

SEQ ID NO: 1522028 - protein, 17 aa, Mycobacterium tuberculosis
DLPEVSLVPILDATKKD

SEQ ID NO: 1522029 - protein, 24 aa, Mycobacterium tuberculosis
DLPRIARATKILDLARAYGIEVSD

SEQ ID NO: 1522030 - protein, 20 aa, Mycobacterium tuberculosis
DLQRTLRCGGIRRKVRQPHA

SEQ ID NO: 1522031 - protein, 19 aa, Mycobacterium tuberculosis
DLQSILDRGWLHPGSIVVA

SEQ ID NO: 1522032 - protein, 18 aa, Mycobacterium tuberculosis
DLRAIATLTHRGVEGAIV

SEQ ID NO: 1522033 - protein, 28 aa, Mycobacterium tuberculosis
DLRAQGINLIIHYVDRPGALGKIGTLLG

SEQ ID NO: 1522034 - protein, 26 aa, Mycobacterium tuberculosis
DLRGRATLYLTYWTAGDTRNRGREML

SEQ ID NO: 1522035 - protein, 17 aa, Mycobacterium tuberculosis
DLRLVADDSVLPLRPAN

SEQ ID NO: 1522036 - protein, 31 aa, Mycobacterium tuberculosis
DLRPGAIIRDLNLLRPIYAPTAAYGHFGRTD

SEQ ID NO: 1522037 - protein, 17 aa, Mycobacterium tuberculosis
DLRPRRHRSPASVPAHP

SEQ ID NO: 1522038 - protein, 17 aa, Mycobacterium tuberculosis
DLRPVREDFRMGGPGVA

SEQ ID NO: 1522039 - protein, 17 aa, Mycobacterium tuberculosis
DLRRRQCSVAGLRAGRQ

SEQ ID NO: 1522040 - protein, 18 aa, Mycobacterium tuberculosis
DLRVIDNIRYFAELCGVD

SEQ ID NO: 1522041 - protein, 31 aa, Mycobacterium tuberculosis
DLRVVAPDAFFQFPTSKYGLALDNWSIRRLS

SEQ ID NO: 1522042 - protein, 24 aa, Mycobacterium tuberculosis
DLSVRDMTVCILDRPRHAQLIHDV

SEQ ID NO: 1522043 - protein, 23 aa, Mycobacterium tuberculosis
DLSVRDMTVCTLDRPRHAQLIHD

SEQ ID NO: 1522044 - protein, 26 aa, Mycobacterium tuberculosis
DLTAWSRAQAAWLWSRRRGVIAGQSA

SEQ ID NO: 1522045 - protein, 25 aa, Mycobacterium tuberculosis
DLTLPPLQIPGISVPAFSLPAITLP

SEQ ID NO: 1522046 - protein, 18 aa, Mycobacterium tuberculosis
DLTPLTLPTPAQLALRRS

SEQ ID NO: 1522047 - protein, 22 aa, Mycobacterium tuberculosis
DLTTELRRQLKPLGRQAEAAQR

SEQ ID NO: 1522048 - protein, 27 aa, Mycobacterium tuberculosis
DLVADLLPKDAWLNDLGTYRLDDLPRP

SEQ ID NO: 1522049 - protein, 17 aa, Mycobacterium tuberculosis
DLVAQACAFINYARGHY

SEQ ID NO: 1522050 - protein, 20 aa, Mycobacterium tuberculosis
DLVDGAPKPLLEKVAEEAAD

SEQ ID NO: 1522051 - protein, 17 aa, Mycobacterium tuberculosis
DLVLLDPDGERLVFGMR

SEQ ID NO: 1522052 - protein, 20 aa, Mycobacterium tuberculosis
DLVSCLPVSVLVVAKAPEPG

SEQ ID NO: 1522053 - protein, 19 aa, Mycobacterium tuberculosis
DLVSIVTSMLFSMHGELYK

SEQ ID NO: 1522054 - protein, 27 aa, Mycobacterium tuberculosis
DLVVDNFTIPIIGFESFAFSFHIHTEP

SEQ ID NO: 1522055 - protein, 19 aa, Mycobacterium tuberculosis
DLYSCFPSAVQVAAIELGL

SEQ ID NO: 1522056 - protein, 24 aa, Mycobacterium tuberculosis
DLYYADPCALFDLCKRRSSKSVAL

SEQ ID NO: 1522057 - protein, 22 aa, Mycobacterium tuberculosis
DMAAQPFFDPSASFPPAPASAN

SEQ ID NO: 1522058 - protein, 17 aa, Mycobacterium tuberculosis
DMFVPMPPSAEAALAGA

SEQ ID NO: 1522059 - protein, 24 aa, Mycobacterium tuberculosis
DMGNGAFWRGDQQGLFSAGYRVHV

SEQ ID NO: 1522060 - protein, 24 aa, Mycobacterium tuberculosis
DMLELTDLLDRKAPPSSPAGSGSG

SEQ ID NO: 1522061 - protein, 19 aa, Mycobacterium tuberculosis
DMLRVYPSLDPNLVHVIRN

SEQ ID NO: 1522062 - protein, 19 aa, Mycobacterium tuberculosis
DMPIATLAAMRRGEQLPFG

SEQ ID NO: 1522063 - protein, 23 aa, Mycobacterium tuberculosis
DMPIATLAAMRRGEQLPFGLRGF

SEQ ID NO: 1522064 - protein, 22 aa, Mycobacterium tuberculosis
DMTEAEVVAHLLELVTRRSEAV

SEQ ID NO: 1522065 - protein, 21 aa, Mycobacterium tuberculosis
DNALPPLQETLLRAFDLAAST

SEQ ID NO: 1522066 - protein, 33 aa, Mycobacterium tuberculosis
DNAWFIAETIGAGTFPWVLAITMPYSDAAQRGA

SEQ ID NO: 1522067 - protein, 32 aa, Mycobacterium tuberculosis
DNEPDWVNTIFLSTRFRAWRVGGYNEYLYTFF

SEQ ID NO: 1522068 - protein, 17 aa, Mycobacterium tuberculosis
DNFATRWRHGGSPLLRG

SEQ ID NO: 1522069 - protein, 23 aa, Mycobacterium tuberculosis
DNGGGIFELLEQGDPRFSDVSSR

SEQ ID NO: 1522070 - protein, 24 aa, Mycobacterium tuberculosis
DNKDFQFFHPPPLHYCAYYSKYVK

SEQ ID NO: 1522071 - protein, 27 aa, Mycobacterium tuberculosis
DNNAGDYGFFWITAVTTDGSIVVANSY

SEQ ID NO: 1522072 - protein, 38 aa, Mycobacterium tuberculosis
DNNPALYLIGKSYRFRRLELARFLAALHATVLDNPVQL

SEQ ID NO: 1522073 - protein, 27 aa, Mycobacterium tuberculosis
DNPRAERVRARAIAWLDTSRSTRRGSK

SEQ ID NO: 1522074 - protein, 31 aa, Mycobacterium tuberculosis
DNPRPHTGQAPRPWVASTRSPTAICCSRLAS

SEQ ID NO: 1522075 - protein, 22 aa, Mycobacterium tuberculosis
DNPRYVIGIMLDNPARNSDGAP

SEQ ID NO: 1522076 - protein, 26 aa, Mycobacterium tuberculosis
DNQGILTYMRAIWTGSIAFGLVNVPV

SEQ ID NO: 1522077 - protein, 27 aa, Mycobacterium tuberculosis
DNRAWRLYRRLGFTDIIRGYHFAGDPR

SEQ ID NO: 1522078 - protein, 23 aa, Mycobacterium tuberculosis
DNRSQFVIEPLEPGFGYTLGNSL

SEQ ID NO: 1522079 - protein, 24 aa, Mycobacterium tuberculosis
DNRSQFVIEPLEPGFGYTLGNSLR

SEQ ID NO: 1522080 - protein, 17 aa, Mycobacterium tuberculosis
DPAAHLPRAVRWHHYSL

SEQ ID NO: 1522081 - protein, 27 aa, Mycobacterium tuberculosis
DPAELRLRNLLRPNQFPYQSKTGWVYD

SEQ ID NO: 1522082 - protein, 26 aa, Mycobacterium tuberculosis
DPAGWPRLDWSMDAALLLAALASRAG

SEQ ID NO: 1522083 - protein, 22 aa, Mycobacterium tuberculosis
DPAKSFRRRRSCPRSLAAVQPA

SEQ ID NO: 1522084 - protein, 35 aa, Mycobacterium tuberculosis
DPAMGPLLAEADVPWVLMHWRAVSADTPHVPVRYG

SEQ ID NO: 1522085 - protein, 29 aa, Mycobacterium tuberculosis
DPANPAFRDGAAPKWWFTVGGQVRPGERL

SEQ ID NO: 1522086 - protein, 24 aa, Mycobacterium tuberculosis
DPAPGVLVLWHPTPASCAKALAAP

SEQ ID NO: 1522087 - protein, 23 aa, Mycobacterium tuberculosis
DPARAWVGLAEPGGRRAAPVLAR

SEQ ID NO: 1522088 - protein, 20 aa, Mycobacterium tuberculosis
DPAVTARRRLRMICHGLGHV

SEQ ID NO: 1522089 - protein, 20 aa, Mycobacterium tuberculosis
DPCFPGIRHGSTLGGPHRHR

SEQ ID NO: 1522090 - protein, 19 aa, Mycobacterium tuberculosis
DPDACDVVLLLMDSRARHC

SEQ ID NO: 1522091 - protein, 24 aa, Mycobacterium tuberculosis
DPDAHGLHLFATLLAAGERAFGAG

SEQ ID NO: 1522092 - protein, 25 aa, Mycobacterium tuberculosis
DPDDVTVRFLLTAGAIGSLFKERAS

SEQ ID NO: 1522093 - protein, 24 aa, Mycobacterium tuberculosis
DPDGGLLAYRRLSEALATESWYLA

SEQ ID NO: 1522094 - protein, 20 aa, Mycobacterium tuberculosis
DPDYVIYQRLIDGVWTDVTC

SEQ ID NO: 1522095 - protein, 19 aa, Mycobacterium tuberculosis
DPFGRPATGLPVGVTDYAT

SEQ ID NO: 1522096 - protein, 30 aa, Mycobacterium tuberculosis
DPGATPGHRRRRGPPGAPGGHRCSGPPRNH

SEQ ID NO: 1522097 - protein, 23 aa, Mycobacterium tuberculosis
DPGEQLYTLDYYLKLAEQIVDAG

SEQ ID NO: 1522098 - protein, 26 aa, Mycobacterium tuberculosis
DPGGASRRWRPIWRVSGRRSAPAKRG

SEQ ID NO: 1522099 - protein, 17 aa, Mycobacterium tuberculosis
DPGNLSMDWFRAEVAKD

SEQ ID NO: 1522100 - protein, 24 aa, Mycobacterium tuberculosis
DPGNPLAILVPLTAAAMDLVAMGA

SEQ ID NO: 1522101 - protein, 25 aa, Mycobacterium tuberculosis
DPGNPLAILVPLTAAAMDLVAMGAT

SEQ ID NO: 1522102 - protein, 24 aa, Mycobacterium tuberculosis
DPGPTLRALNERILRQQPLDAKKS

SEQ ID NO: 1522103 - protein, 18 aa, Mycobacterium tuberculosis
DPGVGKSTLLLEVAHRWA

SEQ ID NO: 1522104 - protein, 25 aa, Mycobacterium tuberculosis
DPHKVAMLGLTFDDVLLLPAASAVV

SEQ ID NO: 1522105 - protein, 18 aa, Mycobacterium tuberculosis
DPIAANYHFAWFRELDSR

SEQ ID NO: 1522106 - protein, 24 aa, Mycobacterium tuberculosis
DPIDIAYPVLWRHLTAIVASVLDA

SEQ ID NO: 1522107 - protein, 18 aa, Mycobacterium tuberculosis
DPIDIGLPVSLTIPGFTI

SEQ ID NO: 1522108 - protein, 21 aa, Mycobacterium tuberculosis
DPILNGSDRRLFGRRLADFFT

SEQ ID NO: 1522109 - protein, 23 aa, Mycobacterium tuberculosis
DPITVLRPIHIPPIPVGFAAVGG

SEQ ID NO: 1522110 - protein, 17 aa, Mycobacterium tuberculosis
DPIYKRKVLELAAALSD

SEQ ID NO: 1522111 - protein, 21 aa, Mycobacterium tuberculosis
DPLHLPGFPVQFFVYKQIAAN

SEQ ID NO: 1522112 - protein, 19 aa, Mycobacterium tuberculosis
DPLIMRRALEYATGLGVLI

SEQ ID NO: 1522113 - protein, 17 aa, Mycobacterium tuberculosis
DPLLNVGKLIANNTRVW

SEQ ID NO: 1522114 - protein, 18 aa, Mycobacterium tuberculosis
DPLMSPLVWDLAHIGQQE

SEQ ID NO: 1522115 - protein, 31 aa, Mycobacterium tuberculosis
DPMDCAELLDWPAKLRLLDGFPAAGEPELVG

SEQ ID NO: 1522116 - protein, 18 aa, Mycobacterium tuberculosis
DPMLLAWTVPVVDLDPTA

SEQ ID NO: 1522117 - protein, 19 aa, Mycobacterium tuberculosis
DPMMFDRSYFLEPDSKSSK

SEQ ID NO: 1522118 - protein, 22 aa, Mycobacterium tuberculosis
DPPGPHLLVLARGPEGYRRLSR

SEQ ID NO: 1522119 - protein, 24 aa, Mycobacterium tuberculosis
DPPLPPMPPLPPLPPLRARPVPAT

SEQ ID NO: 1522120 - protein, 24 aa, Mycobacterium tuberculosis
DPPYVAVPYLDRMELAYAARRSGD

SEQ ID NO: 1522121 - protein, 17 aa, Mycobacterium tuberculosis
DPQHRMLLEVAWEALEH

SEQ ID NO: 1522122 - protein, 28 aa, Mycobacterium tuberculosis
DPQLARARWRRVRSLPHLQDRWVAMFGD

SEQ ID NO: 1522123 - protein, 19 aa, Mycobacterium tuberculosis
DPQMLRYFASIGISLDSRL

SEQ ID NO: 1522124 - protein, 20 aa, Mycobacterium tuberculosis
DPQQRLLLEVAWEALEHAGI

SEQ ID NO: 1522125 - protein, 20 aa, Mycobacterium tuberculosis
DPQQRMLLEVAWEALEHAGI

SEQ ID NO: 1522126 - protein, 26 aa, Mycobacterium tuberculosis
DPQVHTLLDFHFRPHLTAASGKHGMG

SEQ ID NO: 1522127 - protein, 17 aa, Mycobacterium tuberculosis
DPQWVWPISPALTELAG

SEQ ID NO: 1522128 - protein, 19 aa, Mycobacterium tuberculosis
DPRLPVFDLIAEPLQANGF

SEQ ID NO: 1522129 - protein, 18 aa, Mycobacterium tuberculosis
DPRPFRAGPHETSALLTS

SEQ ID NO: 1522130 - protein, 18 aa, Mycobacterium tuberculosis
DPRRTQGLATPPRAGCGG

SEQ ID NO: 1522131 - protein, 19 aa, Mycobacterium tuberculosis
DPRVWWQLRNPFTPSWGEP

SEQ ID NO: 1522132 - protein, 19 aa, Mycobacterium tuberculosis
DPRWAKLVEMLGPESDTLR

SEQ ID NO: 1522133 - protein, 25 aa, Mycobacterium tuberculosis
DPTRRADLIKLLDTFPAGAGARGGM

SEQ ID NO: 1522134 - protein, 19 aa, Mycobacterium tuberculosis
DPVIFLKPNTAIIGPNTPI

SEQ ID NO: 1522135 - protein, 29 aa, Mycobacterium tuberculosis
DPVLAEWFLRRFSLLDSLYMVPSVPIIGR

SEQ ID NO: 1522136 - protein, 23 aa, Mycobacterium tuberculosis
DPVPVPIHHLLYDGSFAVAVPVD

SEQ ID NO: 1522137 - protein, 19 aa, Mycobacterium tuberculosis
DPVTLVAQLSRRFAPPTLV

SEQ ID NO: 1522138 - protein, 20 aa, Mycobacterium tuberculosis
DPVTLVAQLSRRFAPPTLVN

SEQ ID NO: 1522139 - protein, 17 aa, Mycobacterium tuberculosis
DPWPNFRDICPPQHPWS

SEQ ID NO: 1522140 - protein, 28 aa, Mycobacterium tuberculosis
DPWSPEALAWPLLAVIDASLDEPWCRTL

SEQ ID NO: 1522141 - protein, 19 aa, Mycobacterium tuberculosis
DQAHVLGRRIGQQPFEIGG

SEQ ID NO: 1522142 - protein, 24 aa, Mycobacterium tuberculosis
DQANVWMFSPNRLLEHRKPADLVR

SEQ ID NO: 1522143 - protein, 21 aa, Mycobacterium tuberculosis
DQEQLWGTLLASAAATRNPQV

SEQ ID NO: 1522144 - protein, 20 aa, Mycobacterium tuberculosis
DQGLSLTLFFKDTAPTRDVN

SEQ ID NO: 1522145 - protein, 24 aa, Mycobacterium tuberculosis
DQHERPVIFLCRSGNRSNRRGRGR

SEQ ID NO: 1522146 - protein, 28 aa, Mycobacterium tuberculosis
DQIAPLEMTKWFDTQLPLPGTRDRAVDH

SEQ ID NO: 1522147 - protein, 22 aa, Mycobacterium tuberculosis
DQIRLRRAMNLLPASHATESSG

SEQ ID NO: 1522148 - protein, 20 aa, Mycobacterium tuberculosis
DQISLLLRRTIDPDRPLSDY

SEQ ID NO: 1522149 - protein, 19 aa, Mycobacterium tuberculosis
DQLGTGGFTGVFVLTAPQT

SEQ ID NO: 1522150 - protein, 22 aa, Mycobacterium tuberculosis
DQLIGFFINIVVLRNDLRGNPT

SEQ ID NO: 1522151 - protein, 17 aa, Mycobacterium tuberculosis
DQLIRYYVDHQLDVIVR

SEQ ID NO: 1522152 - protein, 25 aa, Mycobacterium tuberculosis
DQLRLSGFRLVGIADVYPGHDAIFD

SEQ ID NO: 1522153 - protein, 25 aa, Mycobacterium tuberculosis
DQLRTELLRRGIVFAMARVKQDLRE

SEQ ID NO: 1522154 - protein, 18 aa, Mycobacterium tuberculosis
DQLSRWVDSLLSATAGKL

SEQ ID NO: 1522155 - protein, 18 aa, Mycobacterium tuberculosis
DQMRGVRLMFMQSNGGLA

SEQ ID NO: 1522156 - protein, 27 aa, Mycobacterium tuberculosis
DQPDVIVLGLARGGLPVAWEVAAALHA

SEQ ID NO: 1522157 - protein, 18 aa, Mycobacterium tuberculosis
DQRPGCLCGAAAYHSFQF

SEQ ID NO: 1522158 - protein, 24 aa, Mycobacterium tuberculosis
DQRVLGAALWYAATVKDAVIVAAA

SEQ ID NO: 1522159 - protein, 21 aa, Mycobacterium tuberculosis
DQRVRLLLYTRVTQIDRATKS

SEQ ID NO: 1522160 - protein, 29 aa, Mycobacterium tuberculosis
DQTAITAPAAGRAGLAKAGGIGASAAVAA

SEQ ID NO: 1522161 - protein, 20 aa, Mycobacterium tuberculosis
DQTSWIPWSPTRVPAATMVA

SEQ ID NO: 1522162 - protein, 20 aa, Mycobacterium tuberculosis
DQVLDGDLDALFDALSAADK

SEQ ID NO: 1522163 - protein, 20 aa, Mycobacterium tuberculosis
DQVYLDLLTGWRDAWELGRA

SEQ ID NO: 1522164 - protein, 26 aa, Mycobacterium tuberculosis
DRAALGRRWCCATGIIQPVGCRSDPA

SEQ ID NO: 1522165 - protein, 18 aa, Mycobacterium tuberculosis
DRAGLLPGAVYDQRQPGV

SEQ ID NO: 1522166 - protein, 22 aa, Mycobacterium tuberculosis
DRAIPRGVGTAGVWRLPDRNTL

SEQ ID NO: 1522167 - protein, 30 aa, Mycobacterium tuberculosis
DRAKSYPLASFGAALLPPELGGPLPAQFVQ

SEQ ID NO: 1522168 - protein, 17 aa, Mycobacterium tuberculosis
DRALVAFPEIRSISYFT

SEQ ID NO: 1522169 - protein, 25 aa, Mycobacterium tuberculosis
DRARVLHSAALRRLADKTQVVGPRE

SEQ ID NO: 1522170 - protein, 26 aa, Mycobacterium tuberculosis
DRAVILAPQGLAYIAAFLGSMQAGAI

SEQ ID NO: 1522171 - protein, 20 aa, Mycobacterium tuberculosis
DRAWPANGPGWWPGEFRGAG

SEQ ID NO: 1522172 - protein, 31 aa, Mycobacterium tuberculosis
DRAYSGYIPILGAPWLADLVRRSPWGEMFAS

SEQ ID NO: 1522173 - protein, 18 aa, Mycobacterium tuberculosis
DRDATRVFRLSRIGAQVT

SEQ ID NO: 1522174 - protein, 31 aa, Mycobacterium tuberculosis
DRDFWLQVGIDPIQIRAPPPSTRFAVTWMID

SEQ ID NO: 1522175 - protein, 24 aa, Mycobacterium tuberculosis
DRDGQWWYESLSGAPIADWLASAL

SEQ ID NO: 1522176 - protein, 21 aa, Mycobacterium tuberculosis
DRDIAMVFQSYALYPHMTVRQ

SEQ ID NO: 1522177 - protein, 25 aa, Mycobacterium tuberculosis
DRDRGMHLLGLVGLGRRVAHALAGD

SEQ ID NO: 1522178 - protein, 21 aa, Mycobacterium tuberculosis
DRDRLVVIIAGYRADLDKFLD

SEQ ID NO: 1522179 - protein, 22 aa, Mycobacterium tuberculosis
DRDRLVVIIAGYRADLDKFLDT

SEQ ID NO: 1522180 - protein, 18 aa, Mycobacterium tuberculosis
DRDRPLWEMWVIEGGARS

SEQ ID NO: 1522181 - protein, 29 aa, Mycobacterium tuberculosis
DRDRRATRLVAEWPPRLNIPDPDPLRLIY

SEQ ID NO: 1522182 - protein, 19 aa, Mycobacterium tuberculosis
DRDRRPGRFLLTGSARLLS

SEQ ID NO: 1522183 - protein, 24 aa, Mycobacterium tuberculosis
DRDWWAQRIPQLPDPPALPTRAGG

SEQ ID NO: 1522184 - protein, 20 aa, Mycobacterium tuberculosis
DREELVPMTPFERKIVHDAV

SEQ ID NO: 1522185 - protein, 34 aa, Mycobacterium tuberculosis
DREGEAIAWHLLETLKPRIPVKRMVFPEITEPAI

SEQ ID NO: 1522186 - protein, 23 aa, Mycobacterium tuberculosis
DRFAGQLLPRRAAQKFADFANAR

SEQ ID NO: 1522187 - protein, 20 aa, Mycobacterium tuberculosis
DRFRGLLRLLTASSGTPTSA

SEQ ID NO: 1522188 - protein, 20 aa, Mycobacterium tuberculosis
DRFTASRLFGAPPGYVGYEE

SEQ ID NO: 1522189 - protein, 21 aa, Mycobacterium tuberculosis
DRGAWTLAEPRVTPVAVIGMA

SEQ ID NO: 1522190 - protein, 28 aa, Mycobacterium tuberculosis
DRGDGAVLRGYPPLRAVVGPRSSPTRRG

SEQ ID NO: 1522191 - protein, 22 aa, Mycobacterium tuberculosis
DRGDRLLVITEKKSWKVKRIRN

SEQ ID NO: 1522192 - protein, 30 aa, Mycobacterium tuberculosis
DRGFIPEGLLNYLALLGWSIADDHDLFGLD

SEQ ID NO: 1522193 - protein, 21 aa, Mycobacterium tuberculosis
DRGPVWLFSGQGSQWAAMGAD

SEQ ID NO: 1522194 - protein, 21 aa, Mycobacterium tuberculosis
DRGPVWVFSGQGSQWAGMGAD

SEQ ID NO: 1522195 - protein, 22 aa, Mycobacterium tuberculosis
DRGPVWVFSGQGSQWAGMGADL

SEQ ID NO: 1522196 - protein, 29 aa, Mycobacterium tuberculosis
DRGSSLDALTLSVLRSWLAATAGAGAART

SEQ ID NO: 1522197 - protein, 18 aa, Mycobacterium tuberculosis
DRHAGAHAGRRLTRRFGL

SEQ ID NO: 1522198 - protein, 23 aa, Mycobacterium tuberculosis
DRHPGWHALRKIAARITTPLLPD

SEQ ID NO: 1522199 - protein, 24 aa, Mycobacterium tuberculosis
DRIGRLAVRLDVSRLVVVGTGRSI

SEQ ID NO: 1522200 - protein, 18 aa, Mycobacterium tuberculosis
DRITKARWVYFLTRMRNP

SEQ ID NO: 1522201 - protein, 21 aa, Mycobacterium tuberculosis
DRKRLPITAPLVGAITSLALG

SEQ ID NO: 1522202 - protein, 25 aa, Mycobacterium tuberculosis
DRLAELAGLPLFERLAQRIVDGERN

SEQ ID NO: 1522203 - protein, 26 aa, Mycobacterium tuberculosis
DRLAELAGLPLFERLAQRIVDGERNG

SEQ ID NO: 1522204 - protein, 23 aa, Mycobacterium tuberculosis
DRLEDIWSTFTKLAPKQLIVDEN

SEQ ID NO: 1522205 - protein, 31 aa, Mycobacterium tuberculosis
DRLGGPGSWLLAVPPYHIAGLAVLVRSVIAG

SEQ ID NO: 1522206 - protein, 21 aa, Mycobacterium tuberculosis
DRLRFPAALDRVQVPVLLVGG

SEQ ID NO: 1522207 - protein, 23 aa, Mycobacterium tuberculosis
DRLTALLSGVYLNLAPVILDAGA

SEQ ID NO: 1522208 - protein, 20 aa, Mycobacterium tuberculosis
DRLWEALLRGDDLVTEIPAD

SEQ ID NO: 1522209 - protein, 19 aa, Mycobacterium tuberculosis
DRMAKMLRLAVDEVFQMQS

SEQ ID NO: 1522210 - protein, 21 aa, Mycobacterium tuberculosis
DRMPTPYLPVGLKLNALEGTG

SEQ ID NO: 1522211 - protein, 21 aa, Mycobacterium tuberculosis
DRNIFIGECKVWSGPRTMDDV

SEQ ID NO: 1522212 - protein, 23 aa, Mycobacterium tuberculosis
DRNLIQHNIGRGQHIFRQCRGHP

SEQ ID NO: 1522213 - protein, 42 aa, Mycobacterium tuberculosis
DRPAATHRPGWLEFPTPALDPPLRLRACLRRRRLAARRHPGA

SEQ ID NO: 1522214 - protein, 22 aa, Mycobacterium tuberculosis
DRPLRGMGGPWALIPRARAECR

SEQ ID NO: 1522215 - protein, 25 aa, Mycobacterium tuberculosis
DRPPRLRIDRLVACRVRGAARDGAL

SEQ ID NO: 1522216 - protein, 25 aa, Mycobacterium tuberculosis
DRPVYTLSHDILFMGLTGDLFRRTG

SEQ ID NO: 1522217 - protein, 19 aa, Mycobacterium tuberculosis
DRQHYRLVGWRHGLCGYRR

SEQ ID NO: 1522218 - protein, 22 aa, Mycobacterium tuberculosis
DRQHYRLVGWRHGLCGYRRFFS

SEQ ID NO: 1522219 - protein, 17 aa, Mycobacterium tuberculosis
DRQLPGEGVTLGAIQVP

SEQ ID NO: 1522220 - protein, 25 aa, Mycobacterium tuberculosis
DRQQVLFCGLWYDDDFVRTPNGWRI

SEQ ID NO: 1522221 - protein, 25 aa, Mycobacterium tuberculosis
DRQQVLFCGLWYDDDFVRTPRWLAD

SEQ ID NO: 1522222 - protein, 18 aa, Mycobacterium tuberculosis
DRRAHRCVQPRRAAVVPI

SEQ ID NO: 1522223 - protein, 17 aa, Mycobacterium tuberculosis
DRRAVLRPGRARIHQRR

SEQ ID NO: 1522224 - protein, 20 aa, Mycobacterium tuberculosis
DRRMPYTVGLLGSVPRLDAA

SEQ ID NO: 1522225 - protein, 17 aa, Mycobacterium tuberculosis
DRRRQATHPAAVKPELV

SEQ ID NO: 1522226 - protein, 21 aa, Mycobacterium tuberculosis
DRRRQRLGLVRDQRGGLVGTR

SEQ ID NO: 1522227 - protein, 22 aa, Mycobacterium tuberculosis
DRSARVRNIFDGGALGRGDDRK

SEQ ID NO: 1522228 - protein, 22 aa, Mycobacterium tuberculosis
DRSDFLAFSREFADLILGERGA

SEQ ID NO: 1522229 - protein, 24 aa, Mycobacterium tuberculosis
DRSIVPVRVIWLPPADRSRAGKVA

SEQ ID NO: 1522230 - protein, 29 aa, Mycobacterium tuberculosis
DRSSDVGGGVWPLGFGRFADAGAGGNEAL

SEQ ID NO: 1522231 - protein, 17 aa, Mycobacterium tuberculosis
DRSYRRSFRREFDRIKL

SEQ ID NO: 1522232 - protein, 18 aa, Mycobacterium tuberculosis
DRTAGRRTLIPLAGDPVS

SEQ ID NO: 1522233 - protein, 28 aa, Mycobacterium tuberculosis
DRTAHDLHLLLPDPYSFPSNLLIEHLNT

SEQ ID NO: 1522234 - protein, 29 aa, Mycobacterium tuberculosis
DRTAHDLHLLLPDPYSFPSNLLIERLNTD

SEQ ID NO: 1522235 - protein, 25 aa, Mycobacterium tuberculosis
DRTAPGVFPALFAAIITSAGGAPQD

SEQ ID NO: 1522236 - protein, 18 aa, Mycobacterium tuberculosis
DRTAVLYCKTGVRSAEAL

SEQ ID NO: 1522237 - protein, 17 aa, Mycobacterium tuberculosis
DRTDVLALMLRSTYDDG

SEQ ID NO: 1522238 - protein, 20 aa, Mycobacterium tuberculosis
DRTYFLNFDTIGSPELIMLE

SEQ ID NO: 1522239 - protein, 21 aa, Mycobacterium tuberculosis
DRTYFLNFDTIGSPELIMLEG

SEQ ID NO: 1522240 - protein, 26 aa, Mycobacterium tuberculosis
DRVAIYLPLIPEAVIAMLACARLGIM

SEQ ID NO: 1522241 - protein, 21 aa, Mycobacterium tuberculosis
DRVCASARYAVAAGPANASRT

SEQ ID NO: 1522242 - protein, 17 aa, Mycobacterium tuberculosis
DRVFRYQLIWEAADAAH

SEQ ID NO: 1522243 - protein, 25 aa, Mycobacterium tuberculosis
DRVIDRAPLWCAVDLRDGNQALIDP

SEQ ID NO: 1522244 - protein, 19 aa, Mycobacterium tuberculosis
DRVRVVVIDGAALRGDNRA

SEQ ID NO: 1522245 - protein, 28 aa, Mycobacterium tuberculosis
DRVYCPGWVALFRWLKPLLSTRVGQRPI

SEQ ID NO: 1522246 - protein, 25 aa, Mycobacterium tuberculosis
DRWAGFFNEFDVLLLPVTPTPAPLH

SEQ ID NO: 1522247 - protein, 25 aa, Mycobacterium tuberculosis
DRYITARFLPDKAIDLVDEAASRLR

SEQ ID NO: 1522248 - protein, 20 aa, Mycobacterium tuberculosis
DSEHPLFLLYTSGTTGKPKG

SEQ ID NO: 1522249 - protein, 27 aa, Mycobacterium tuberculosis
DSESYEFWREFLASLKARGLTGVHLVI

SEQ ID NO: 1522250 - protein, 31 aa, Mycobacterium tuberculosis
DSFAPRLSFFWGIGMNFFMEVAKLRAGRLLW

SEQ ID NO: 1522251 - protein, 30 aa, Mycobacterium tuberculosis
DSGEGGFGGPGLAGGLFGNPGNGGVGGIGG

SEQ ID NO: 1522252 - protein, 19 aa, Mycobacterium tuberculosis
DSIEWMSRNLANRESVILS

SEQ ID NO: 1522253 - protein, 22 aa, Mycobacterium tuberculosis
DSLAITWAHPELPQRAFDLGAG

SEQ ID NO: 1522254 - protein, 27 aa, Mycobacterium tuberculosis
DSLNNRMLSQIWSHWSLLSAPSCAAQL

SEQ ID NO: 1522255 - protein, 23 aa, Mycobacterium tuberculosis
DSLRAALRAVPAERLWVNPDCGL

SEQ ID NO: 1522256 - protein, 23 aa, Mycobacterium tuberculosis
DSMDAIMFPYNNARILRQLATPI

SEQ ID NO: 1522257 - protein, 25 aa, Mycobacterium tuberculosis
DSMDAMMFPYNNARILRQLATPISV

SEQ ID NO: 1522258 - protein, 17 aa, Mycobacterium tuberculosis
DSMIGYRSPRYLRFGWA

SEQ ID NO: 1522259 - protein, 29 aa, Mycobacterium tuberculosis
DSMRAGLQALAWIALQPEATRRSWAVLGE

SEQ ID NO: 1522260 - protein, 17 aa, Mycobacterium tuberculosis
DSNRPYHRTFQAVKHHC

SEQ ID NO: 1522261 - protein, 23 aa, Mycobacterium tuberculosis
DSPAGLRLPLDSISWRPPRASFD

SEQ ID NO: 1522262 - protein, 44 aa, Mycobacterium tuberculosis
DSPGAEASWVVGITWWSAVVGGFQMSFVIAVPETIAAAATDLAD

SEQ ID NO: 1522263 - protein, 17 aa, Mycobacterium tuberculosis
DSPLVRQIFIYGNSARA

SEQ ID NO: 1522264 - protein, 21 aa, Mycobacterium tuberculosis
DSPTYVQLINPLVDAAAVSGE

SEQ ID NO: 1522265 - protein, 18 aa, Mycobacterium tuberculosis
DSQKGIVIGKGGARLREV

SEQ ID NO: 1522266 - protein, 22 aa, Mycobacterium tuberculosis
DSRAYRLPWPDGTTVFELDRPQ

SEQ ID NO: 1522267 - protein, 26 aa, Mycobacterium tuberculosis
DSRIRVLIAGSWFPRYARNLGTPEPI

SEQ ID NO: 1522268 - protein, 21 aa, Mycobacterium tuberculosis
DSSLLVPWPRRHRDLVEWVAA

SEQ ID NO: 1522269 - protein, 22 aa, Mycobacterium tuberculosis
DSSLLVPWPRRHRDLVEWVAAA

SEQ ID NO: 1522270 - protein, 21 aa, Mycobacterium tuberculosis
DSTRYLVHFTQSGIGLPDESY

SEQ ID NO: 1522271 - protein, 25 aa, Mycobacterium tuberculosis
DSVVPLIVNLYAFGARDFDLKSALH

SEQ ID NO: 1522272 - protein, 18 aa, Mycobacterium tuberculosis
DTALLAPRPALLVRRRLD

SEQ ID NO: 1522273 - protein, 30 aa, Mycobacterium tuberculosis
DTALLAPRPALLVRRRLDLVAWATGLPALG

SEQ ID NO: 1522274 - protein, 17 aa, Mycobacterium tuberculosis
DTAWFVIREQNLRFDWM

SEQ ID NO: 1522275 - protein, 20 aa, Mycobacterium tuberculosis
DTAWFVIREQNLRFDWMKDV

SEQ ID NO: 1522276 - protein, 24 aa, Mycobacterium tuberculosis
DTDTQYAFTRPIAGHMFTNYDGVL

SEQ ID NO: 1522277 - protein, 18 aa, Mycobacterium tuberculosis
DTEWLPPPHLDHGQPRIN

SEQ ID NO: 1522278 - protein, 20 aa, Mycobacterium tuberculosis
DTHRTIVRRCCWLRRPVAEV

SEQ ID NO: 1522279 - protein, 21 aa, Mycobacterium tuberculosis
DTHVTYTRALGLLGVTDVALI

SEQ ID NO: 1522280 - protein, 27 aa, Mycobacterium tuberculosis
DTKADLPAFAELLARLPWPLNKTTSVN

SEQ ID NO: 1522281 - protein, 27 aa, Mycobacterium tuberculosis
DTKLARSPTVTALLQLAAYADALVHSG

SEQ ID NO: 1522282 - protein, 19 aa, Mycobacterium tuberculosis
DTNTGFGNAGFFNMGIGNA

SEQ ID NO: 1522283 - protein, 24 aa, Mycobacterium tuberculosis
DTNTGFGNAGFFNMGIGNAGNEDM

SEQ ID NO: 1522284 - protein, 17 aa, Mycobacterium tuberculosis
DTPATPALPPAPPAPKR

SEQ ID NO: 1522285 - protein, 26 aa, Mycobacterium tuberculosis
DTPATPGIDGALLFALSASSQDALRQ

SEQ ID NO: 1522286 - protein, 18 aa, Mycobacterium tuberculosis
DTPKYFHYVKKDKIAESA

SEQ ID NO: 1522287 - protein, 22 aa, Mycobacterium tuberculosis
DTPPALRRQLVSQPPDVLITTP

SEQ ID NO: 1522288 - protein, 25 aa, Mycobacterium tuberculosis
DTQGGFLIPAALDPAILLSGDGSTN

SEQ ID NO: 1522289 - protein, 20 aa, Mycobacterium tuberculosis
DTQRQCIELAYYGGLTYVEV

SEQ ID NO: 1522290 - protein, 23 aa, Mycobacterium tuberculosis
DTQVRQLLQRLLKGHQLLGRRRG

SEQ ID NO: 1522291 - protein, 21 aa, Mycobacterium tuberculosis
DTREPVIPFAQPDSLTRVYAV

SEQ ID NO: 1522292 - protein, 26 aa, Mycobacterium tuberculosis
DTRRWASVPFYLRTGKRLGRRVTEIA

SEQ ID NO: 1522293 - protein, 23 aa, Mycobacterium tuberculosis
DTSCGGCRWGLVSGWEGEWVMEF

SEQ ID NO: 1522294 - protein, 30 aa, Mycobacterium tuberculosis; identical to SEQ ID NO: 226076

SEQ ID NO: 1522295 - protein, 26 aa, Mycobacterium tuberculosis
DTTDQRLLDLLPPAPVDVNPPGDERH

SEQ ID NO: 1522296 - protein, 19 aa, Mycobacterium tuberculosis
DTTILPPIHLGLTGQANYG

SEQ ID NO: 1522297 - protein, 17 aa, Mycobacterium tuberculosis
DTTILPPLHLQITGDAD

SEQ ID NO: 1522298 - protein, 21 aa, Mycobacterium tuberculosis
DTTIVVNGMLAPSTLGYGGNG

SEQ ID NO: 1522299 - protein, 31 aa, Mycobacterium tuberculosis
DTTRLRYVEPYRAELHRLGRPVFGPSFEVEV

SEQ ID NO: 1522300 - protein, 30 aa, Mycobacterium tuberculosis; identical to SEQ ID NO: 236279

SEQ ID NO: 1522301 - protein, 17 aa, Mycobacterium tuberculosis
DTVPRGYGIAARPGRGD

SEQ ID NO: 1522302 - protein, 26 aa, Mycobacterium tuberculosis
DTVRRAAPFATLPRSLFEATLDLLSG

SEQ ID NO: 1522303 - protein, 17 aa, Mycobacterium tuberculosis
DTWVSMSALPPPGGQTG

SEQ ID NO: 1522304 - protein, 22 aa, Mycobacterium tuberculosis
DTYDLVGWLADQSWRDGRVVML

SEQ ID NO: 1522305 - protein, 29 aa, Mycobacterium tuberculosis
DTYEVTALNFMPGWLDMLLEVGGGRLSSL

SEQ ID NO: 1522306 - protein, 18 aa, Mycobacterium tuberculosis
DTYGLIRFGSRLDTYLPA

SEQ ID NO: 1522307 - protein, 22 aa, Mycobacterium tuberculosis
DVAHPVYLLYGVERTEDLCKLD

SEQ ID NO: 1522308 - protein, 26 aa, Mycobacterium tuberculosis
DVAHRSGLVHVWARAPQKAQQNLLNL

SEQ ID NO: 1522309 - protein, 23 aa, Mycobacterium tuberculosis
DVAIKRPIFVTGLVRTGTTALHR

SEQ ID NO: 1522310 - protein, 20 aa, Mycobacterium tuberculosis
DVAIPARWTLDNGATFRGVD

SEQ ID NO: 1522311 - protein, 31 aa, Mycobacterium tuberculosis
DVANELEFIVFDQPYRQAWASGYRGLTPASD

SEQ ID NO: 1522312 - protein, 18 aa, Mycobacterium tuberculosis
DVATELEFIVFDQPYRQA

SEQ ID NO: 1522313 - protein, 24 aa, Mycobacterium tuberculosis
DVAVLQLRGAGGLPSAAIGGGVAV

SEQ ID NO: 1522314 - protein, 23 aa, Mycobacterium tuberculosis
DVCDALGVPWLTLMGYIEAQGWT

SEQ ID NO: 1522315 - protein, 22 aa, Mycobacterium tuberculosis
DVDAKLYGLPFGDGAYGAQDIS

SEQ ID NO: 1522316 - protein, 29 aa, Mycobacterium tuberculosis
DVDTEITRLVPFIEWLRGAYPDQLISVDT

SEQ ID NO: 1522317 - protein, 22 aa, Mycobacterium tuberculosis
DVDTFYTCLYRSLLHPNTFNDV

SEQ ID NO: 1522318 - protein, 19 aa, Mycobacterium tuberculosis
DVDTVGGLLALELGRVPLP

SEQ ID NO: 1522319 - protein, 25 aa, Mycobacterium tuberculosis
DVDVTHLPPRAPGRGRMVFKKLRAE

SEQ ID NO: 1522320 - protein, 27 aa, Mycobacterium tuberculosis
DVELSKLYLLPGYHGTGAAAALMHKVL

SEQ ID NO: 1522321 - protein, 21 aa, Mycobacterium tuberculosis
DVGFVGVPLFHIAGIGNMLTG

SEQ ID NO: 1522322 - protein, 23 aa, Mycobacterium tuberculosis
DVGGATHWAWEKVFTKANMLESL

SEQ ID NO: 1522323 - protein, 17 aa, Mycobacterium tuberculosis
DVHAALYVERDSQKGIV

SEQ ID NO: 1522324 - protein, 20 aa, Mycobacterium tuberculosis
DVHIGWVFTRTVRNNARTHI

SEQ ID NO: 1522325 - protein, 27 aa, Mycobacterium tuberculosis
DVINAPAQTLLGRPLIGNGTDGSTPGQ

SEQ ID NO: 1522326 - protein, 18 aa, Mycobacterium tuberculosis
DVIVLGLARGGLPVAWEV

SEQ ID NO: 1522327 - protein, 20 aa, Mycobacterium tuberculosis
DVIVLGLARGGLPVAWEVAA

SEQ ID NO: 1522328 - protein, 22 aa, Mycobacterium tuberculosis
DVKLPRELVLIGKQFLYVERYM

SEQ ID NO: 1522329 - protein, 23 aa, Mycobacterium tuberculosis
DVKLPRELVLIGKQFLYVERYMK

SEQ ID NO: 1522330 - protein, 41 aa, Mycobacterium tuberculosis
DVKLPRELVLIGKQFLYVERYMKLLAPRWQMMSDPHLTGYF

SEQ ID NO: 1522331 - protein, 18 aa, Mycobacterium tuberculosis
DVKPPTWWHSLPTDRPII

SEQ ID NO: 1522332 - protein, 18 aa, Mycobacterium tuberculosis
DVLALLPHRATAPEFSVA

SEQ ID NO: 1522333 - protein, 20 aa, Mycobacterium tuberculosis
DVLDALSLWAPTQSVAAYDA

SEQ ID NO: 1522334 - protein, 36 aa, Mycobacterium tuberculosis
DVLKQLFGYLVWRDTKAAILLFIRNKDVTAVIDNAI

SEQ ID NO: 1522335 - protein, 26 aa, Mycobacterium tuberculosis
DVLLKVRLRQGLPFARLGAAERERAE

SEQ ID NO: 1522336 - protein, 18 aa, Mycobacterium tuberculosis
DVLLLPVTPTPAPLHHNK

SEQ ID NO: 1522337 - protein, 17 aa, Mycobacterium tuberculosis
DVLPFQLVTMGQPIADF

SEQ ID NO: 1522338 - protein, 18 aa, Mycobacterium tuberculosis
DVLVAAAADLEGIGSALA

SEQ ID NO: 1522339 - protein, 18 aa, Mycobacterium tuberculosis
DVLVLRSLTKTWSLAGLR

SEQ ID NO: 1522340 - protein, 17 aa, Mycobacterium tuberculosis
DVLVQWAMFGRDPRHGT

SEQ ID NO: 1522341 - protein, 20 aa, Mycobacterium tuberculosis
DVMLGIVEVLRLITDRGDPV

SEQ ID NO: 1522342 - protein, 25 aa, Mycobacterium tuberculosis
DVMRYDEWFATTLLVDDGRVCGLVA

SEQ ID NO: 1522343 - protein, 23 aa, Mycobacterium tuberculosis
DVNGGLAGIGGNAGFVGNGGAGG

SEQ ID NO: 1522344 - protein, 23 aa, Mycobacterium tuberculosis
DVNSAIIKIAKWAQSQQWTVEDD

SEQ ID NO: 1522345 - protein, 38 aa, Mycobacterium tuberculosis
DVPGLPRRLRWVSPLVPLVAGPLPVAFFIGVLAGEEPI

SEQ ID NO: 1522346 - protein, 19 aa, Mycobacterium tuberculosis
DVPTGPRGTAIFTCAPGPT

SEQ ID NO: 1522347 - protein, 19 aa, Mycobacterium tuberculosis
DVPVLEVALRLGVGYVGAM

SEQ ID NO: 1522348 - protein, 29 aa, Mycobacterium tuberculosis
DVQAGLAMLAPIWGYAPLLDIDDATARQQ

SEQ ID NO: 1522349 - protein, 18 aa, Mycobacterium tuberculosis
DVQLPDGTVIWTAPNGHT

SEQ ID NO: 1522350 - protein, 18 aa, Mycobacterium tuberculosis
DVRCEAEWRFVGVPDLSS

SEQ ID NO: 1522351 - protein, 17 aa, Mycobacterium tuberculosis
DVRIAGPAALFDARFQK

SEQ ID NO: 1522352 - protein, 30 aa, Mycobacterium tuberculosis
DVRPLTVAVLLRITEVFGVDATFFASQDDT

SEQ ID NO: 1522353 - protein, 28 aa, Mycobacterium tuberculosis
DVRQYSRWALRLRVPFTVPVEAKSLQLN

SEQ ID NO: 1522354 - protein, 24 aa, Mycobacterium tuberculosis
DVSDFGHRLLAYLRAADAGAELLI

SEQ ID NO: 1522355 - protein, 17 aa, Mycobacterium tuberculosis
DVSIIFVPPTFAKDAII

SEQ ID NO: 1522356 - protein, 18 aa, Mycobacterium tuberculosis
DVSIIFVPPTFAKDAIIE

SEQ ID NO: 1522357 - protein, 20 aa, Mycobacterium tuberculosis
DVSQLADHLLRSLAIIGAAA

SEQ ID NO: 1522358 - protein, 24 aa, Mycobacterium tuberculosis
DVSYPVCAGLDRGPGLHAAPRRPP

SEQ ID NO: 1522359 - protein, 17 aa, Mycobacterium tuberculosis
DVTAEHLLDWLGKQQHL

SEQ ID NO: 1522360 - protein, 21 aa, Mycobacterium tuberculosis
DVTFDAKQPLWRSGSTVGDGH

SEQ ID NO: 1522361 - protein, 24 aa, Mycobacterium tuberculosis
DVTQRVGLPGIWYAGSHGFELTAP

SEQ ID NO: 1522362 - protein, 17 aa, Mycobacterium tuberculosis
DVTRYALTTFGGAGGQH

SEQ ID NO: 1522363 - protein, 41 aa, Mycobacterium tuberculosis
DVTTMFRPKLDALALLHRLSLKSPVRHFVLFSSVSGLLGSR

SEQ ID NO: 1522364 - protein, 18 aa, Mycobacterium tuberculosis
DVVGVLRAVLFAPEDLGL

SEQ ID NO: 1522365 - protein, 18 aa, Mycobacterium tuberculosis
DVVLFPGTGFVDLAIRAG

SEQ ID NO: 1522366 - protein, 19 aa, Mycobacterium tuberculosis
DVVLHFEGDRNGALRMVRG

SEQ ID NO: 1522367 - protein, 20 aa, Mycobacterium tuberculosis
DVVLVATGASPRILPSAQPD

SEQ ID NO: 1522368 - protein, 25 aa, Mycobacterium tuberculosis
DVVNGPTQLLLGRPLIGDGANGGPG

SEQ ID NO: 1522369 - protein, 20 aa, Mycobacterium tuberculosis
DVVVGVALTVGGCTLVRGTQ

SEQ ID NO: 1522370 - protein, 17 aa, Mycobacterium tuberculosis
DVWRGALPPAQTRAARE

SEQ ID NO: 1522371 - protein, 23 aa, Mycobacterium tuberculosis
DWDDELLSLFSIPRAMLPEIASS

SEQ ID NO: 1522372 - protein, 24 aa, Mycobacterium tuberculosis
DWDDELLSLFSIPRAMLPEIASSA

SEQ ID NO: 1522373 - protein, 19 aa, Mycobacterium tuberculosis
DWDREKLGERLAKLAGGVA

SEQ ID NO: 1522374 - protein, 25 aa, Mycobacterium tuberculosis
DWGAPVAWTFAWLHPDRCAGVVGIS

SEQ ID NO: 1522375 - protein, 19 aa, Mycobacterium tuberculosis
DWGVLPDLVMGHSVGEIAA

SEQ ID NO: 1522376 - protein, 25 aa, Mycobacterium tuberculosis
DWHQVTVVSSPSWFSDYVLSVGAVD

SEQ ID NO: 1522377 - protein, 20 aa, Mycobacterium tuberculosis
DWLSVKRLAGWLAAAGYCGR

SEQ ID NO: 1522378 - protein, 18 aa, Mycobacterium tuberculosis
DWMVATTLLTGRRTWVPW

SEQ ID NO: 1522379 - protein, 19 aa, Mycobacterium tuberculosis
DWQRFHLIGATNTVYFALL

SEQ ID NO: 1522380 - protein, 18 aa, Mycobacterium tuberculosis
DWRIMTTAQLRPIAPQKL

SEQ ID NO: 1522381 - protein, 18 aa, Mycobacterium tuberculosis
DWTQLWWVRADGVAAIHR

SEQ ID NO: 1522382 - protein, 20 aa, Mycobacterium tuberculosis
DWVIKRKLFQRYQDRYDMEL

SEQ ID NO: 1522383 - protein, 20 aa, Mycobacterium tuberculosis
DWYRRCYDPVVPLDAAAAVT

SEQ ID NO: 1522384 - protein, 19 aa, Mycobacterium tuberculosis
DYAGMLKYGLRTTRGRLLE

SEQ ID NO: 1522385 - protein, 26 aa, Mycobacterium tuberculosis
DYDAWQETVYLLRSPENARRLMEAVA

SEQ ID NO: 1522386 - protein, 18 aa, Mycobacterium tuberculosis
DYDTADRLYFEPLTFEDV

SEQ ID NO: 1522387 - protein, 18 aa, Mycobacterium tuberculosis
DYDTWLRERPREMARTVF

SEQ ID NO: 1522388 - protein, 24 aa, Mycobacterium tuberculosis
DYDVLIGINLLREGLDLPEVSLGG

SEQ ID NO: 1522389 - protein, 21 aa, Mycobacterium tuberculosis
DYDYDTVFARALEGSARPGDT

SEQ ID NO: 1522390 - protein, 23 aa, Mycobacterium tuberculosis
DYFGEFGVLFHLATLRQTVQGLQ

SEQ ID NO: 1522391 - protein, 21 aa, Mycobacterium tuberculosis
DYFGEIGVLFHLPRSATVRAR

SEQ ID NO: 1522392 - protein, 27 aa, Mycobacterium tuberculosis
DYGTYFKDHLYIAGRIKDLVIIDGRNH

SEQ ID NO: 1522393 - protein, 18 aa, Mycobacterium tuberculosis
DYMILEMSARHHDNIAAL

SEQ ID NO: 1522394 - protein, 18 aa, Mycobacterium tuberculosis
DYMRPAVRLAALMDIDTI

SEQ ID NO: 1522395 - protein, 27 aa, Mycobacterium tuberculosis
DYPDIPPRPDWKPTGAEPIAAAPAAAV

SEQ ID NO: 1522396 - protein, 25 aa, Mycobacterium tuberculosis
DYPTLLATMIETALAAAWACTSPMV

SEQ ID NO: 1522397 - protein, 20 aa, Mycobacterium tuberculosis
DYQILGPLPRKNIDTGMGVE

SEQ ID NO: 1522398 - protein, 19 aa, Mycobacterium tuberculosis
DYQQLVLIRQLVADFNLDV

SEQ ID NO: 1522399 - protein, 18 aa, Mycobacterium tuberculosis
DYRPACDVMLALVAQLDP

SEQ ID NO: 1522400 - protein, 17 aa, Mycobacterium tuberculosis
DYRRFLAGKPDGVADFL

SEQ ID NO: 1522401 - protein, 18 aa, Mycobacterium tuberculosis
DYRTFWTQFGRVLKEGLL

SEQ ID NO: 1522402 - protein, 24 aa, Mycobacterium tuberculosis
DYSGPLVTELLTEAGFVVDGVVAV

SEQ ID NO: 1522403 - protein, 18 aa, Mycobacterium tuberculosis
DYSIGSGRDPYLAVLGRL

SEQ ID NO: 1522404 - protein, 17 aa, Mycobacterium tuberculosis
DYTIPISALTRGGRVDR

SEQ ID NO: 1522405 - protein, 22 aa, Mycobacterium tuberculosis
DYTNRGRIITPIKDRFGAEIRT

SEQ ID NO: 1522406 - protein, 30 aa, Mycobacterium tuberculosis
DYTRTLDILERFYGLVLTDCGTGLLHSAMS

SEQ ID NO: 1522407 - protein, 17 aa, Mycobacterium tuberculosis
DYVAYLLEPVSVWAPEC

SEQ ID NO: 1522408 - protein, 27 aa, Mycobacterium tuberculosis
EAAAPTSNLLVWISTLGTTDGKSQADI

SEQ ID NO: 1522409 - protein, 24 aa, Mycobacterium tuberculosis
EAAATPANLPLGASGGAGGTGGSA

SEQ ID NO: 1522410 - protein, 24 aa, Mycobacterium tuberculosis
EAACRAFDALAARYDVVVAEAPAA

SEQ ID NO: 1522411 - protein, 25 aa, Mycobacterium tuberculosis
EAADLGPRRTLTGQPLPPLLTATAA

SEQ ID NO: 1522412 - protein, 36 aa, Mycobacterium tuberculosis; identical to SEQ ID NO: 226091

SEQ ID NO: 1522413 - protein, 40 aa, Mycobacterium tuberculosis
EAANVQQNLLNAINAPTQALLGRPLIGDGAVGTASSPDGQ

SEQ ID NO: 1522414 - protein, 22 aa, Mycobacterium tuberculosis
EAAWRNLSLALPLSAAVQRAFN

SEQ ID NO: 1522415 - protein, 17 aa, Mycobacterium tuberculosis
EAAYPGRFLLGIGVGHA

SEQ ID NO: 1522416 - protein, 17 aa, Mycobacterium tuberculosis
EADLAIEYDVLNRLKPG

SEQ ID NO: 1522417 - protein, 19 aa, Mycobacterium tuberculosis
EADLNYWRAIMADPPEPLE

SEQ ID NO: 1522418 - protein, 17 aa, Mycobacterium tuberculosis
EADLRVLQTAEQRVIDL

SEQ ID NO: 1522419 - protein, 28 aa, Mycobacterium tuberculosis
EADPVPRAWRMRITVQRVGDRVKVSDVG

SEQ ID NO: 1522420 - protein, 22 aa, Mycobacterium tuberculosis
EAEAILAELRQLLGSPWTDEHG

SEQ ID NO: 1522421 - protein, 20 aa, Mycobacterium tuberculosis
EAERFAVFAALLTGAEYPQA

SEQ ID NO: 1522422 - protein, 18 aa, Mycobacterium tuberculosis
EAETRRLLTEAPFGSRNP

SEQ ID NO: 1522423 - protein, 17 aa, Mycobacterium tuberculosis
EAGALPTLLPGGRPLAD

SEQ ID NO: 1522424 - protein, 17 aa, Mycobacterium tuberculosis
EAGFRGDQWFDRGDGGG

SEQ ID NO: 1522425 - protein, 25 aa, Mycobacterium tuberculosis
EAGSLVAPPKVRVPLLVGGNGTEVL

SEQ ID NO: 1522426 - protein, 26 aa, Mycobacterium tuberculosis
EAGSLVAPPKVRVPLLVGGNGTEVLR

SEQ ID NO: 1522427 - protein, 23 aa, Mycobacterium tuberculosis
EAIAIDPQQRLLLETSWEAMEHA

SEQ ID NO: 1522428 - protein, 17 aa, Mycobacterium tuberculosis
EAILAELRQLLGSPWTD

SEQ ID NO: 1522429 - protein, 19 aa, Mycobacterium tuberculosis
EAILTGWRMLLDEGRLQDG

SEQ ID NO: 1522430 - protein, 22 aa, Mycobacterium tuberculosis
EAIPVPHVPPHGRRARCAGTSS

SEQ ID NO: 1522431 - protein, 20 aa, Mycobacterium tuberculosis
EAIPVQIIWGTKDVVLPVRH

SEQ ID NO: 1522432 - protein, 23 aa, Mycobacterium tuberculosis
EAIRRRVARLRAQRAHVLTARRR

SEQ ID NO: 1522433 - protein, 22 aa, Mycobacterium tuberculosis
EAKLRQAPILALGGRPEELREI

SEQ ID NO: 1522434 - protein, 23 aa, Mycobacterium tuberculosis
EALAGFIAEFGLSLVGGCCGTTP

SEQ ID NO: 1522435 - protein, 17 aa, Mycobacterium tuberculosis
EALALTRFHIFSHSWGG

SEQ ID NO: 1522436 - protein, 29 aa, Mycobacterium tuberculosis
EALDRTGLWGRLLPEWEPIRDLPPRDVAH

SEQ ID NO: 1522437 - protein, 17 aa, Mycobacterium tuberculosis
EALGALGGLDRAALHSQ

SEQ ID NO: 1522438 - protein, 26 aa, Mycobacterium tuberculosis
EALGGMPMPKAVVWALHEHILGRQSG

SEQ ID NO: 1522439 - protein, 19 aa, Mycobacterium tuberculosis
EALGHPLIDHVRGRGLLLG

SEQ ID NO: 1522440 - protein, 22 aa, Mycobacterium tuberculosis
EALLLELAYELEEARPWARIHA

SEQ ID NO: 1522441 - protein, 17 aa, Mycobacterium tuberculosis
EALRELFELDQTAVDAV

SEQ ID NO: 1522442 - protein, 25 aa, Mycobacterium tuberculosis
EALRMDPQQRLLLEVSWEALEHAGI

SEQ ID NO: 1522443 - protein, 22 aa, Mycobacterium tuberculosis
EALRRCRAGELRVVPGAPTGGD

SEQ ID NO: 1522444 - protein, 17 aa, Mycobacterium tuberculosis
EALTMAASDLANIGSTI

SEQ ID NO: 1522445 - protein, 26 aa, Mycobacterium tuberculosis
EAMLHSDYPLQALLYVVVLHRFLRWR

SEQ ID NO: 1522446 - protein, 20 aa, Mycobacterium tuberculosis
EAMYEQMWAADVAAMVGYHG

SEQ ID NO: 1522447 - protein, 21 aa, Mycobacterium tuberculosis
EANLRLVVSLAKRYTGRGMAF

SEQ ID NO: 1522448 - protein, 17 aa, Mycobacterium tuberculosis
EAPLFLDTPAILGVPSS

SEQ ID NO: 1522449 - protein, 25 aa, Mycobacterium tuberculosis
EAQARRLVVRGFFGEIIAKIAVPEV

SEQ ID NO: 1522450 - protein, 25 aa, Mycobacterium tuberculosis
EAQGTWRLWLPGCSWPPNVPQRRGQ

SEQ ID NO: 1522451 - protein, 25 aa, Mycobacterium tuberculosis
EARALLSGTTLSRSCVSRPAREIGR

SEQ ID NO: 1522452 - protein, 32 aa, Mycobacterium tuberculosis; identical to SEQ ID NO: 237566

SEQ ID NO: 1522453 - protein, 22 aa, Mycobacterium tuberculosis
EARLFRAELTIPLILLGGITNR

SEQ ID NO: 1522454 - protein, 17 aa, Mycobacterium tuberculosis
EARLLSGRLRLHHLHRQ

SEQ ID NO: 1522455 - protein, 17 aa, Mycobacterium tuberculosis
EARRLVDALIALRKHCQ

SEQ ID NO: 1522456 - protein, 29 aa, Mycobacterium tuberculosis
EARRRGIPVVLRPAVLAKLMAGRTTLMVT

SEQ ID NO: 1522457 - protein, 24 aa, Mycobacterium tuberculosis
EARRVGRRFARLAPIVATHRKLTS

SEQ ID NO: 1522458 - protein, 20 aa, Mycobacterium tuberculosis
EARYRRWLAALRGSARLSDW

SEQ ID NO: 1522459 - protein, 28 aa, Mycobacterium tuberculosis
EASAVALSLTPFTPSPSAAATPGGAVII

SEQ ID NO: 1522460 - protein, 18 aa, Mycobacterium tuberculosis
EASLDQQRQWILHMAKLS

SEQ ID NO: 1522461 - protein, 20 aa, Mycobacterium tuberculosis
EASMSICDPALRNALRTLKL

SEQ ID NO: 1522462 - protein, 45 aa, Mycobacterium tuberculosis
EATFFNFEFPRNGFQLRRPLFPPLPGTLPEPEIWARLVRALGVVD

SEQ ID NO: 1522463 - protein, 26 aa, Mycobacterium tuberculosis
EAVLASTGWHLMMALIARAQVAIAQD

SEQ ID NO: 1522464 - protein, 25 aa, Mycobacterium tuberculosis
EAVRRRPYTVVLFDEIEKAHPDVFD

SEQ ID NO: 1522465 - protein, 24 aa, Mycobacterium tuberculosis
EAVYEQMWAADVAAMLGYHGEASA

SEQ ID NO: 1522466 - protein, 23 aa, Mycobacterium tuberculosis
EAWRERGFDLDLTELIYFDQRND

SEQ ID NO: 1522467 - protein, 20 aa, Mycobacterium tuberculosis
EAWRWYRDVIGGGRTPLVDT

SEQ ID NO: 1522468 - protein, 25 aa, Mycobacterium tuberculosis
EAYERLILDVLLGEPSLFPVNAEVE

SEQ ID NO: 1522469 - protein, 18 aa, Mycobacterium tuberculosis
ECCRLRKVVPLGKTLRGY

SEQ ID NO: 1522470 - protein, 29 aa, Mycobacterium tuberculosis
ECTGASGCVLLPGLPYLGLEHRAAWVEAE

SEQ ID NO: 1522471 - protein, 18 aa, Mycobacterium tuberculosis
EDAFVVPETLRGQPIAVY

SEQ ID NO: 1522472 - protein, 29 aa, Mycobacterium tuberculosis
EDAKKRPEFGKLTPLYPNSGLRLETSTER

SEQ ID NO: 1522473 - protein, 20 aa, Mycobacterium tuberculosis
EDAVVVVEWARAWPSGSRSA

SEQ ID NO: 1522474 - protein, 26 aa, Mycobacterium tuberculosis
EDDPNWFRLHQMFADFLHRRLERGGS

SEQ ID NO: 1522475 - protein, 17 aa, Mycobacterium tuberculosis
EDEANGLRRFADAMAIR

SEQ ID NO: 1522476 - protein, 31 aa, Mycobacterium tuberculosis; identical to SEQ ID NO: 237199

SEQ ID NO: 1522477 - protein, 18 aa, Mycobacterium tuberculosis
EDFIGIHFFSPVDKMPLV

SEQ ID NO: 1522478 - protein, 19 aa, Mycobacterium tuberculosis
EDFLDLPRQQLADAALSAA

SEQ ID NO: 1522479 - protein, 33 aa, Mycobacterium tuberculosis
EDFVLGGGKRLRPLFAYWGWHTVASREPDPDVL

SEQ ID NO: 1522480 - protein, 21 aa, Mycobacterium tuberculosis
EDGAFGLLRVLGTAMARLAEA

SEQ ID NO: 1522481 - protein, 18 aa, Mycobacterium tuberculosis
EDGGWVWFDITTDTAVTL

SEQ ID NO: 1522482 - protein, 26 aa, Mycobacterium tuberculosis
EDKRFPQLTVLSIAPLLASTIRAVFE

SEQ ID NO: 1522483 - protein, 31 aa, Mycobacterium tuberculosis
EDLLHRSGGFGTLLLLGHDWAPPPATFHSYE

SEQ ID NO: 1522484 - protein, 20 aa, Mycobacterium tuberculosis
EDLPTLVRTLAATTALMLTG

SEQ ID NO: 1522485 - protein, 22 aa, Mycobacterium tuberculosis
EDLRGWLLGLTYTVSGEGMMAA

SEQ ID NO: 1522486 - protein, 20 aa, Mycobacterium tuberculosis
EDMFVPMPPSAEAALAGATV

SEQ ID NO: 1522487 - protein, 24 aa, Mycobacterium tuberculosis
EDNSALMFAGAGSGPTLAAAAAWD

SEQ ID NO: 1522488 - protein, 19 aa, Mycobacterium tuberculosis
EDPQLIERNLFRDMVHPLI

SEQ ID NO: 1522489 - protein, 21 aa, Mycobacterium tuberculosis
EDPRFIAPPLMILASEDIGMA

SEQ ID NO: 1522490 - protein, 20 aa, Mycobacterium tuberculosis
EDPRFSIARLSLLDRGMVFV

SEQ ID NO: 1522491 - protein, 26 aa, Mycobacterium tuberculosis
EDRLRTRFEWGLITDVQPPELETRIA

SEQ ID NO: 1522492 - protein, 22 aa, Mycobacterium tuberculosis
EDSRLLTRELLYTAVTRAKRKV

SEQ ID NO: 1522493 - protein, 17 aa, Mycobacterium tuberculosis
EDWLRPDYVAPVADTPP

SEQ ID NO: 1522494 - protein, 23 aa, Mycobacterium tuberculosis
EDYRTFWTQFGRVLKEGLLSDID

SEQ ID NO: 1522495 - protein, 25 aa, Mycobacterium tuberculosis
EEAKRWAYYPWAAHDVAILGSRGVP

SEQ ID NO: 1522496 - protein, 24 aa, Mycobacterium tuberculosis
EEALRRCRAGELRVVPGAPTGGDD

SEQ ID NO: 1522497 - protein, 39 aa, Mycobacterium tuberculosis
EEATLPPVAEPPPPAAPPVAEPPPPVAAPAPPGAPEPAN

SEQ ID NO: 1522498 - protein, 20 aa, Mycobacterium tuberculosis
EEAVPYYGGLRRMVNRNDAT

SEQ ID NO: 1522499 - protein, 24 aa, Mycobacterium tuberculosis
EEDGAVYQLRRWYEQFYVDVADIK

SEQ ID NO: 1522500 - protein, 22 aa, Mycobacterium tuberculosis
EEEVELAKRIEAGLYATQLMTE

SEQ ID NO: 1522501 - protein, 20 aa, Mycobacterium tuberculosis
EEFGFATAPLVVAGCIMMRV

SEQ ID NO: 1522502 - protein, 20 aa, Mycobacterium tuberculosis
EEFYLVHRTRRFEPAVQGRT

SEQ ID NO: 1522503 - protein, 23 aa, Mycobacterium tuberculosis
EEGRLFTRFLGMLPTNEPMVEEL

SEQ ID NO: 1522504 - protein, 21 aa, Mycobacterium tuberculosis
EEGVLFDNWLLAENGRFREAE

SEQ ID NO: 1522505 - protein, 19 aa, Mycobacterium tuberculosis
EEIFGPVLAIIPYDTEEDA

SEQ ID NO: 1522506 - protein, 20 aa, Mycobacterium tuberculosis
EEIFGPVLAIIPYDTEEDAI

SEQ ID NO: 1522507 - protein, 24 aa, Mycobacterium tuberculosis
EEIFGPVLAIIPYDTEEDAIAIAN

SEQ ID NO: 1522508 - protein, 39 aa, Mycobacterium tuberculosis
EEISQWRVGILEQLARIHAQLENIPALLESARHSETEPL

SEQ ID NO: 1522509 - protein, 40 aa, Mycobacterium tuberculosis
EEIVRQLRLRDIGGIVVIDFIDMVLESNRDLVLRRLTESL

SEQ ID NO: 1522510 - protein, 18 aa, Mycobacterium tuberculosis
EELAALGIWDGKHAAGPH

SEQ ID NO: 1522511 - protein, 29 aa, Mycobacterium tuberculosis
EELGYKLPSLLLPIWDSELGAGLIATLRS

SEQ ID NO: 1522512 - protein, 23 aa, Mycobacterium tuberculosis
EELRYSVIREVLPTRRARTFDLE

SEQ ID NO: 1522513 - protein, 28 aa, Mycobacterium tuberculosis
EELVRQAISALLLPLAIEHTLQYRRGGA

SEQ ID NO: 1522514 - protein, 19 aa, Mycobacterium tuberculosis
EEMAPIPSLLAVAGVHHHL

SEQ ID NO: 1522515 - protein, 30 aa, Mycobacterium tuberculosis
EEPGAYICVYPFVRSYEWYLLPDEERRRML

SEQ ID NO: 1522516 - protein, 21 aa, Mycobacterium tuberculosis
EEPGNQTRVGWWPAPTTTTGI

SEQ ID NO: 1522517 - protein, 26 aa, Mycobacterium tuberculosis
EEPPEHLIFIFATPNRRRYCRRFGRA

SEQ ID NO: 1522518 - protein, 24 aa, Mycobacterium tuberculosis
EEPPPSTVFLLCAPSVDPEDIAVT

SEQ ID NO: 1522519 - protein, 17 aa, Mycobacterium tuberculosis
EEPSHLGLPPAGRQTQN

SEQ ID NO: 1522520 - protein, 17 aa, Mycobacterium tuberculosis
EEQVCADLLALLTSRRP

SEQ ID NO: 1522521 - protein, 23 aa, Mycobacterium tuberculosis
EERLGVGPYRRLPGVQIVRIVDE

SEQ ID NO: 1522522 - protein, 24 aa, Mycobacterium tuberculosis
EESYLALLDALRWLGLDWDEGPEV

SEQ ID NO: 1522523 - protein, 18 aa, Mycobacterium tuberculosis
EETLRWLYEMMVVTRELD

SEQ ID NO: 1522524 - protein, 29 aa, Mycobacterium tuberculosis
EETRIAFGFRSPQALIALAMLTLAGHRPT

SEQ ID NO: 1522525 - protein, 17 aa, Mycobacterium tuberculosis
EEVALELLQNELGARRI

SEQ ID NO: 1522526 - protein, 18 aa, Mycobacterium tuberculosis
EEVDKMVWATRWGADTIM

SEQ ID NO: 1522527 - protein, 17 aa, Mycobacterium tuberculosis
EEWLAMWSGHYQLKDKL

SEQ ID NO: 1522528 - protein, 18 aa, Mycobacterium tuberculosis
EFAAFDRVPPGPGEIEVA

SEQ ID NO: 1522529 - protein, 36 aa, Mycobacterium tuberculosis
EFADAPAAWRRYLEAGILIRDVGIPGYLRATTGLAE

SEQ ID NO: 1522530 - protein, 18 aa, Mycobacterium tuberculosis
EFARRLPFMAAKRAFSEP

SEQ ID NO: 1522531 - protein, 18 aa, Mycobacterium tuberculosis
EFARRPLALPSELLAFIQ

SEQ ID NO: 1522532 - protein, 23 aa, Mycobacterium tuberculosis
EFDGQLWIAMDYVDGIDATQHMA

SEQ ID NO: 1522533 - protein, 19 aa, Mycobacterium tuberculosis
EFFVKIRTCWQKELEVPVV

SEQ ID NO: 1522534 - protein, 18 aa, Mycobacterium tuberculosis
EFGFATAPLVVAGCIMMR

SEQ ID NO: 1522535 - protein, 25 aa, Mycobacterium tuberculosis
EFGHIDVHMLQYSGAIWYPMVYDMP

SEQ ID NO: 1522536 - protein, 26 aa, Mycobacterium tuberculosis
EFGHIDVHMLQYSGAIWYPMVYDMPP

SEQ ID NO: 1522537 - protein, 20 aa, Mycobacterium tuberculosis
EFHSPLMEPMLEEFARVAAR

SEQ ID NO: 1522538 - protein, 18 aa, Mycobacterium tuberculosis
EFHVRVVPVAWSATPSWV

SEQ ID NO: 1522539 - protein, 19 aa, Mycobacterium tuberculosis
EFKCYRIRRAAGALGELPY

SEQ ID NO: 1522540 - protein, 18 aa, Mycobacterium tuberculosis
EFLNRIDDIIVFHQLTRE

SEQ ID NO: 1522541 - protein, 19 aa, Mycobacterium tuberculosis
EFLNRIDDIIVFHQLTREE

SEQ ID NO: 1522542 - protein, 18 aa, Mycobacterium tuberculosis
EFNLKKMWLSPNGTIRNI

SEQ ID NO: 1522543 - protein, 42 aa, Mycobacterium tuberculosis; identical to SEQ ID NO: 119775

SEQ ID NO: 1522544 - protein, 24 aa, Mycobacterium tuberculosis
EFPVNFDVWWFKLPREGDAEFSFL

SEQ ID NO: 1522545 - protein, 21 aa, Mycobacterium tuberculosis
EFREMFAPGAFRRSIAERGHK

SEQ ID NO: 1522546 - protein, 22 aa, Mycobacterium tuberculosis
EFRPERFLGTRPQTYAWVPFGG

SEQ ID NO: 1522547 - protein, 18 aa, Mycobacterium tuberculosis
EFSWQNATRPPRPGRRLP

SEQ ID NO: 1522548 - protein, 25 aa, Mycobacterium tuberculosis
EFTEPEMWFVRQAHQICPVGAVVAT

SEQ ID NO: 1522549 - protein, 23 aa, Mycobacterium tuberculosis
EFTEPEMWFVRQAHTDLSGRGGR

SEQ ID NO: 1522550 - protein, 21 aa, Mycobacterium tuberculosis
EFTKKLLAADGLPVGAYAVLR

SEQ ID NO: 1522551 - protein, 20 aa, Mycobacterium tuberculosis
EFTTRFGVARVCEFYAASEG

SEQ ID NO: 1522552 - protein, 18 aa, Mycobacterium tuberculosis
EFVAEHLPPGWPGPGALP

SEQ ID NO: 1522553 - protein, 18 aa, Mycobacterium tuberculosis
EFVPVHHGELTLPQIREI

SEQ ID NO: 1522554 - protein, 26 aa, Mycobacterium tuberculosis
EGAHGLLVVTPYYSKPPQRGLQAHFT

SEQ ID NO: 1522555 - protein, 21 aa, Mycobacterium tuberculosis
EGALVTLDWLGAHGFGQLLQH

SEQ ID NO: 1522556 - protein, 33 aa, Mycobacterium tuberculosis
EGAYLGYHPSLPTPVNPWDPTAWAGVSSSGCGV

SEQ ID NO: 1522557 - protein, 33 aa, Mycobacterium tuberculosis
EGAYLGYHPSLPTSVNPWDPTAWAGVSSSGCGV

SEQ ID NO: 1522558 - protein, 25 aa, Mycobacterium tuberculosis
EGGAGGLALAPRARTAARALAVTAE

SEQ ID NO: 1522559 - protein, 23 aa, Mycobacterium tuberculosis
EGGGAGFGSGVAGAAGAGGNGGK

SEQ ID NO: 1522560 - protein, 17 aa, Mycobacterium tuberculosis
EGGGMLVLQRLSDARRL

SEQ ID NO: 1522561 - protein, 25 aa, Mycobacterium tuberculosis
EGGPTPVLQWLLYPRTDFTAQTRSM

SEQ ID NO: 1522562 - protein, 30 aa, Mycobacterium tuberculosis
EGGRHTPFFNNYRPQFYFPHHRRVRCGDTC

SEQ ID NO: 1522563 - protein, 23 aa, Mycobacterium tuberculosis
EGIRQLFVKLLDDIPNALWDLKT

SEQ ID NO: 1522564 - protein, 21 aa, Mycobacterium tuberculosis
EGISLSSLALNCDILDPTDGD

SEQ ID NO: 1522565 - protein, 17 aa, Mycobacterium tuberculosis
EGKMAAVAKRRGWPILK

SEQ ID NO: 1522566 - protein, 17 aa, Mycobacterium tuberculosis
EGKRGAGGAGGAGGTCG

SEQ ID NO: 1522567 - protein, 18 aa, Mycobacterium tuberculosis
EGLLLTMDQPYPVAMAKL

SEQ ID NO: 1522568 - protein, 30 aa, Mycobacterium tuberculosis
EGLLNIVNTPTQLLLGRPLIGNGANGAPGT

SEQ ID NO: 1522569 - protein, 17 aa, Mycobacterium tuberculosis
EGLLRRYLEVDRAWRDH

SEQ ID NO: 1522570 - protein, 28 aa, Mycobacterium tuberculosis
EGNADAWRPVFAGLAGLGLFGVAVPEDC

SEQ ID NO: 1522571 - protein, 19 aa, Mycobacterium tuberculosis
EGNAQNFRILTSLEPKVVD

SEQ ID NO: 1522572 - protein, 23 aa, Mycobacterium tuberculosis
EGNAQNFRILTSLEPKVVDAQGL

SEQ ID NO: 1522573 - protein, 18 aa, Mycobacterium tuberculosis
EGPDAPSAAAWLGAAARR

SEQ ID NO: 1522574 - protein, 21 aa, Mycobacterium tuberculosis
EGPHVQLWPHRHGTDAMFAAA

SEQ ID NO: 1522575 - protein, 24 aa, Mycobacterium tuberculosis
EGPHVQLWPHRHGTDAMFAAALRR

SEQ ID NO: 1522576 - protein, 17 aa, Mycobacterium tuberculosis
EGQRVELVLDRTPLYAE

SEQ ID NO: 1522577 - protein, 23 aa, Mycobacterium tuberculosis
EGQRVELVLDRTPLYAESGGQIA

SEQ ID NO: 1522578 - protein, 40 aa, Mycobacterium tuberculosis
EGRGVFDNLTKFITWTLPTNLGEGLVILAAIAVGVALPIL

SEQ ID NO: 1522579 - protein, 32 aa, Mycobacterium tuberculosis
EGRINPDVKMNYLASPPLVIAYALAGTMDFDF

SEQ ID NO: 1522580 - protein, 26 aa, Mycobacterium tuberculosis
EGRTAMSFVIANPEMLAAAATDLAGI

SEQ ID NO: 1522581 - protein, 17 aa, Mycobacterium tuberculosis
EGRYRTFEPALRGSTLQ

SEQ ID NO: 1522582 - protein, 36 aa, Mycobacterium tuberculosis
EGTVRTDLFRRNGLPVPAPHDDDPLGEIIFISGRLN

SEQ ID NO: 1522583 - protein, 33 aa, Mycobacterium tuberculosis
EGVDPLRVGVLPTPAVAYLTGAYDADFGVMISA

SEQ ID NO: 1522584 - protein, 18 aa, Mycobacterium tuberculosis
EGVIPPPEPVPGRAMNMA

SEQ ID NO: 1522585 - protein, 32 aa, Mycobacterium tuberculosis
EGVLDVINAPALALLGRLLIGNGANGAPGTGA

SEQ ID NO: 1522586 - protein, 30 aa, Mycobacterium tuberculosis
EGVLDVINAPALALLGRPLIGNGANGAPGT

SEQ ID NO: 1522587 - protein, 20 aa, Mycobacterium tuberculosis
EGVLFDNWLLAENGRFREAE

SEQ ID NO: 1522588 - protein, 17 aa, Mycobacterium tuberculosis
EGVPIRGFGIHPAVLDA

SEQ ID NO: 1522589 - protein, 17 aa, Mycobacterium tuberculosis
EGVRPPWSIGEPQPELA

SEQ ID NO: 1522590 - protein, 21 aa, Mycobacterium tuberculosis
EGYDMFMAMLDGMKEESVGFL

SEQ ID NO: 1522591 - protein, 17 aa, Mycobacterium tuberculosis
EGYPLHSFPGEPPFVRG

SEQ ID NO: 1522592 - protein, 20 aa, Mycobacterium tuberculosis
EHACSLGLLARAHCGVLYVD

SEQ ID NO: 1522593 - protein, 31 aa, Mycobacterium tuberculosis
EHAVTLWKQWDRCALHWFPGSHLLACEPVGL

SEQ ID NO: 1522594 - protein, 17 aa, Mycobacterium tuberculosis
EHGLWYPPDPSSFEICS

SEQ ID NO: 1522595 - protein, 27 aa, Mycobacterium tuberculosis
EHGRIWHRLAHYLPEIPIAAPDLLGHG

SEQ ID NO: 1522596 - protein, 23 aa, Mycobacterium tuberculosis
EHGRTPWRDLFGPAVTLADGGFD

SEQ ID NO: 1522597 - protein, 24 aa, Mycobacterium tuberculosis
EHGYELLPPWESAGVVFDALLAAV

SEQ ID NO: 1522598 - protein, 17 aa, Mycobacterium tuberculosis
EHKIRVISPYIGGGFGN

SEQ ID NO: 1522599 - protein, 21 aa, Mycobacterium tuberculosis
EHLGQLHRRPNVGRTLAAVGV

SEQ ID NO: 1522600 - protein, 17 aa, Mycobacterium tuberculosis
EHLLDWLGKQQHLSPEG

SEQ ID NO: 1522601 - protein, 19 aa, Mycobacterium tuberculosis
EHLVRGRFVLVGVTPAVLA

SEQ ID NO: 1522602 - protein, 20 aa, Mycobacterium tuberculosis
EHNALHLVYITMTGSAIAAQ

SEQ ID NO: 1522603 - protein, 24 aa, Mycobacterium tuberculosis
EHPQYPKVVLVTGACRFLGGYLTA

SEQ ID NO: 1522604 - protein, 19 aa, Mycobacterium tuberculosis
EHPSVCLLASWVPPDTPAG

SEQ ID NO: 1522605 - protein, 22 aa, Mycobacterium tuberculosis
EHPSVCLLASWVPPDTPAGQRL

SEQ ID NO: 1522606 - protein, 25 aa, Mycobacterium tuberculosis
EHQAIVRDVLAASDFWGGAGSAACQ

SEQ ID NO: 1522607 - protein, 29 aa, Mycobacterium tuberculosis
EHQRLHRQPRLRALGRRRTGRRRAVTERG

SEQ ID NO: 1522608 - protein, 18 aa, Mycobacterium tuberculosis
EHRDRFCRFGSEYVHAAL

SEQ ID NO: 1522609 - protein, 19 aa, Mycobacterium tuberculosis
EHRKSLTFALRFSCAGSHL

SEQ ID NO: 1522610 - protein, 17 aa, Mycobacterium tuberculosis
EHRRIVELILDGAPISR

SEQ ID NO: 1522611 - protein, 17 aa, Mycobacterium tuberculosis
EHRYLMTVIATASNPRF

SEQ ID NO: 1522612 - protein, 25 aa, Mycobacterium tuberculosis
EHSPNILYLVWDDVGIATWDCFGGL

SEQ ID NO: 1522613 - protein, 27 aa, Mycobacterium tuberculosis
EIAGRAAVPVLVHPAPRGVLGGLAATV

SEQ ID NO: 1522614 - protein, 28 aa, Mycobacterium tuberculosis
EIAGRAAVPVLVHPAPRGVLGGLAATVY

SEQ ID NO: 1522615 - protein, 29 aa, Mycobacterium tuberculosis
EIARLTFDLLPTSYLFQPGHRIRIAIAGA

SEQ ID NO: 1522616 - protein, 24 aa, Mycobacterium tuberculosis
EIAVRVIRTLRRLGIRSVAVYSDP

SEQ ID NO: 1522617 - protein, 17 aa, Mycobacterium tuberculosis
EICAYFDAVLQQQLLPT

SEQ ID NO: 1522618 - protein, 24 aa, Mycobacterium tuberculosis
EIDGQLYVDMRLINGVDLAAMLRR

SEQ ID NO: 1522619 - protein, 18 aa, Mycobacterium tuberculosis
EIDKRLDRIGSRQALELR

SEQ ID NO: 1522620 - protein, 19 aa, Mycobacterium tuberculosis
EIDKRLDRIGSRQALELRG

SEQ ID NO: 1522621 - protein, 17 aa, Mycobacterium tuberculosis
EIGDAFLSRSCRWALAA

SEQ ID NO: 1522622 - protein, 17 aa, Mycobacterium tuberculosis
EIGDAFLSRSCRWTLAA

SEQ ID NO: 1522623 - protein, 17 aa, Mycobacterium tuberculosis
EIGPGYGATLQALLGLT

SEQ ID NO: 1522624 - protein, 25 aa, Mycobacterium tuberculosis
EINEAFASVVLSWARVHEPDMDRVN

SEQ ID NO: 1522625 - protein, 23 aa, Mycobacterium tuberculosis
EINSALMFAGAGPGPMLAAASAW

SEQ ID NO: 1522626 - protein, 20 aa, Mycobacterium tuberculosis
EINSGRMFFGAGSGPMLAAA

SEQ ID NO: 1522627 - protein, 23 aa, Mycobacterium tuberculosis
EINSGRMFFGAGSGPMLAAAAAW

SEQ ID NO: 1522628 - protein, 18 aa, Mycobacterium tuberculosis
EINSGRMYAGPGSGPMLA

SEQ ID NO: 1522629 - protein, 23 aa, Mycobacterium tuberculosis
EINSLLIYTGAGPGPLLAAAAAW

SEQ ID NO: 1522630 - protein, 22 aa, Mycobacterium tuberculosis
EINSLRMFIGAGTAPMLAAAAA

SEQ ID NO: 1522631 - protein, 25 aa, Mycobacterium tuberculosis
EINTRGDIILFIDELHTLVGAGAAE

SEQ ID NO: 1522632 - protein, 25 aa, Mycobacterium tuberculosis
EIPAVSTLLQPLLSTIPLQVFAASV

SEQ ID NO: 1522633 - protein, 37 aa, Mycobacterium tuberculosis
EIPDHFRIYVSQKLARLERFDRTIYLFDVELDHERNR

SEQ ID NO: 1522634 - protein, 17 aa, Mycobacterium tuberculosis
EIPLGPAAPQRLASVAE

SEQ ID NO: 1522635 - protein, 18 aa, Mycobacterium tuberculosis
EIQAYDALCFPGLAAEWG

SEQ ID NO: 1522636 - protein, 19 aa, Mycobacterium tuberculosis
EIRLLSRFTGANPTVPVVG

SEQ ID NO: 1522637 - protein, 23 aa, Mycobacterium tuberculosis
EIRWSLDLLRRRFAKVIWVPGNH

SEQ ID NO: 1522638 - protein, 27 aa, Mycobacterium tuberculosis
EIRYGSFRRSFWLPAHVTSEAIAASYD

SEQ ID NO: 1522639 - protein, 26 aa, Mycobacterium tuberculosis
EISAGFRSLPLGTPKQRAVLATLIIH

SEQ ID NO: 1522640 - protein, 20 aa, Mycobacterium tuberculosis
EISSGPYRFVYRKRFHKRCE

SEQ ID NO: 1522641 - protein, 21 aa, Mycobacterium tuberculosis
EISSGPYRFVYRKRFHKRCET

SEQ ID NO: 1522642 - protein, 25 aa, Mycobacterium tuberculosis
EIWVKPSFFPGIRIAPSSGGGATST

SEQ ID NO: 1522643 - protein, 25 aa, Mycobacterium tuberculosis
EKAKWTKYFLDPAQIRLLRGLKQSA

SEQ ID NO: 1522644 - protein, 20 aa, Mycobacterium tuberculosis
EKARYMWVSTFHSTCVRILR

SEQ ID NO: 1522645 - protein, 27 aa, Mycobacterium tuberculosis
EKAYHAEPFIYLMPEGQLPRTGAVIGS

SEQ ID NO: 1522646 - protein, 27 aa, Mycobacterium tuberculosis
EKLCDIFARYDVTFSLGDGLRPGSIAD

SEQ ID NO: 1522647 - protein, 18 aa, Mycobacterium tuberculosis
EKMYANILLRRVPRMLKQ

SEQ ID NO: 1522648 - protein, 20 aa, Mycobacterium tuberculosis
EKQKLELLRSLLTYFHYASK

SEQ ID NO: 1522649 - protein, 22 aa, Mycobacterium tuberculosis
EKRSWLRARGLKIFPLVGWAER

SEQ ID NO: 1522650 - protein, 22 aa, Mycobacterium tuberculosis
EKVARIHVEALGGHLTKLTKEQ

SEQ ID NO: 1522651 - protein, 32 aa, Mycobacterium tuberculosis
EKVPSTPVSWLPFYHDMGLMLGIILPMINQDT

SEQ ID NO: 1522652 - protein, 27 aa, Mycobacterium tuberculosis
ELAAMGFKFQFITLAGFHALNYSMFDL

SEQ ID NO: 1522653 - protein, 24 aa, Mycobacterium tuberculosis
ELAATIARRLGLTGALGTVAESVD

SEQ ID NO: 1522654 - protein, 26 aa, Mycobacterium tuberculosis
ELADNALGFLYDTGLYLRFRATGPDD

SEQ ID NO: 1522655 - protein, 28 aa, Mycobacterium tuberculosis
ELAELLSPSLFAEERIVVLGAAAEAGKD

SEQ ID NO: 1522656 - protein, 35 aa, Mycobacterium tuberculosis
ELAGSAHFVWVRDTLRLGGKFPLKAGMLTSLGFGH

SEQ ID NO: 1522657 - protein, 20 aa, Mycobacterium tuberculosis
ELAKLDAELTRIAHRATHLP

SEQ ID NO: 1522658 - protein, 17 aa, Mycobacterium tuberculosis
ELAKRLELGPQAKSVQS

SEQ ID NO: 1522659 - protein, 23 aa, Mycobacterium tuberculosis
ELALASYPGFTATAPPGDGQVYG

SEQ ID NO: 1522660 - protein, 25 aa, Mycobacterium tuberculosis
ELALRVALGVIRLLLGADYAPLAVH

SEQ ID NO: 1522661 - protein, 17 aa, Mycobacterium tuberculosis
ELAPKLALAATAELAGN

SEQ ID NO: 1522662 - protein, 22 aa, Mycobacterium tuberculosis
ELARALLPMHDTPLGPAAAALT

SEQ ID NO: 1522663 - protein, 17 aa, Mycobacterium tuberculosis
ELARWTPILEQEEVRQV

SEQ ID NO: 1522664 - protein, 26 aa, Mycobacterium tuberculosis
ELARYAQRVMDWLHPDGDLTDTERAR

SEQ ID NO: 1522665 - protein, 19 aa, Mycobacterium tuberculosis
ELCAIMQRRDRPEISRLVD

SEQ ID NO: 1522666 - protein, 32 aa, Mycobacterium tuberculosis
ELCDIFARYDVTFSLGDWLRPGSIADANDAAQ

SEQ ID NO: 1522667 - protein, 27 aa, Mycobacterium tuberculosis
ELCDKRKIPLLFLQNIAGFMVGRDYEA

SEQ ID NO: 1522668 - protein, 30 aa, Mycobacterium tuberculosis
ELDELRRLIPPWVTLGSRLAALPKPKRDYG

SEQ ID NO: 1522669 - protein, 17 aa, Mycobacterium tuberculosis
ELDFLRLAVFDALLVLQ

SEQ ID NO: 1522670 - protein, 20 aa, Mycobacterium tuberculosis
ELDPVGLRQTWLDLHESWLI

SEQ ID NO: 1522671 - protein, 17 aa, Mycobacterium tuberculosis
ELELCYAAIALVTDVDA

SEQ ID NO: 1522672 - protein, 21 aa, Mycobacterium tuberculosis
ELESLIRPTGFYRNKAASLIG

SEQ ID NO: 1522673 - protein, 20 aa, Mycobacterium tuberculosis
ELFAELAGCSSSIEMTREQL

SEQ ID NO: 1522674 - protein, 18 aa, Mycobacterium tuberculosis
ELFKTEALHRLPVKSWDV

SEQ ID NO: 1522675 - protein, 18 aa, Mycobacterium tuberculosis
ELFVCRPTEPDVGDFVGL

SEQ ID NO: 1522676 - protein, 20 aa, Mycobacterium tuberculosis
ELGDTGRILLRPSGTEPMIR

SEQ ID NO: 1522677 - protein, 22 aa, Mycobacterium tuberculosis
ELGGKLPFALAERLHISRGEAS

SEQ ID NO: 1522678 - protein, 19 aa, Mycobacterium tuberculosis
ELGIPDQIRDSCEAYLLVA

SEQ ID NO: 1522679 - protein, 21 aa, Mycobacterium tuberculosis
ELGKHRFQLLEVLHALSEADS

SEQ ID NO: 1522680 - protein, 21 aa, Mycobacterium tuberculosis
ELGLLTRLLKGISALGGERTS

SEQ ID NO: 1522681 - protein, 21 aa, Mycobacterium tuberculosis
ELGLLTRLLRGISALGGERTS

SEQ ID NO: 1522682 - protein, 18 aa, Mycobacterium tuberculosis
ELGPVPIKLRESPGLMIL

SEQ ID NO: 1522683 - protein, 19 aa, Mycobacterium tuberculosis
ELGPVPIKLRESPGLMILG

SEQ ID NO: 1522684 - protein, 25 aa, Mycobacterium tuberculosis
ELGPVPIKLRESPVLMILGRQGCGK

SEQ ID NO: 1522685 - protein, 33 aa, Mycobacterium tuberculosis
ELGRALVPSPLLGTTLAELALLAAAKPDAQALT

SEQ ID NO: 1522686 - protein, 25 aa, Mycobacterium tuberculosis
ELHANEIMLLAYYIAAVNIESTYHA

SEQ ID NO: 1522687 - protein, 26 aa, Mycobacterium tuberculosis
ELHANEIMLLAYYIAAVNIESTYHAL

SEQ ID NO: 1522688 - protein, 21 aa, Mycobacterium tuberculosis
ELHFLGATLWRSGIQRVLRGF

SEQ ID NO: 1522689 - protein, 21 aa, Mycobacterium tuberculosis
ELIAAFLPVLFAGMGNRRAPR

SEQ ID NO: 1522690 - protein, 18 aa, Mycobacterium tuberculosis
ELIDRCWAPKVHGAWNIH

SEQ ID NO: 1522691 - protein, 19 aa, Mycobacterium tuberculosis
ELIEANVVLLHHNHIERNL

SEQ ID NO: 1522692 - protein, 24 aa, Mycobacterium tuberculosis
ELIKAHLPDVALLDYRMPGMDGAQ

SEQ ID NO: 1522693 - protein, 18 aa, Mycobacterium tuberculosis
ELIPVYRSQRALLQRLLD

SEQ ID NO: 1522694 - protein, 20 aa, Mycobacterium tuberculosis
ELISDRAITGKPLILTSNRA

SEQ ID NO: 1522695 - protein, 17 aa, Mycobacterium tuberculosis
ELITVRGRRLLAQADVV

SEQ ID NO: 1522696 - protein, 26 aa, Mycobacterium tuberculosis
ELKARFSRPLAFGTAGLRGHLRGGPD

SEQ ID NO: 1522697 - protein, 22 aa, Mycobacterium tuberculosis
ELLAHVVPLVRDVRRIGFCGAG

SEQ ID NO: 1522698 - protein, 27 aa, Mycobacterium tuberculosis
ELLARQGVTGAPARRRRRRRGDSDAIT

SEQ ID NO: 1522699 - protein, 18 aa, Mycobacterium tuberculosis
ELLDKIFYRSGQGVTLQA

SEQ ID NO: 1522700 - protein, 20 aa, Mycobacterium tuberculosis
ELLGGIPLAGFFAAGEIGPI

SEQ ID NO: 1522701 - protein, 18 aa, Mycobacterium tuberculosis
ELLLQLKSWRLSTAKEQN

SEQ ID NO: 1522702 - protein, 17 aa, Mycobacterium tuberculosis
ELLPQLLAADALAAELK

SEQ ID NO: 1522703 - protein, 19 aa, Mycobacterium tuberculosis
ELLRSLLTYFHYASKETRP

SEQ ID NO: 1522704 - protein, 17 aa, Mycobacterium tuberculosis
ELLTLLLVDAYSDLADT

SEQ ID NO: 1522705 - protein, 17 aa, Mycobacterium tuberculosis
ELMAILESLPLAGWMTI

SEQ ID NO: 1522706 - protein, 24 aa, Mycobacterium tuberculosis
ELNRFVFAMPEQLGRIYLGLTDED

SEQ ID NO: 1522707 - protein, 22 aa, Mycobacterium tuberculosis
ELNSLRMFTGAGSAPMLAAAVA

SEQ ID NO: 1522708 - protein, 18 aa, Mycobacterium tuberculosis
ELPADASALDAKLARQAQ

SEQ ID NO: 1522709 - protein, 17 aa, Mycobacterium tuberculosis
ELPTIRAQIARMGTTLA

SEQ ID NO: 1522710 - protein, 28 aa, Mycobacterium tuberculosis
ELPTPTLPWPILPNPRLPAPIFPKPRLC

SEQ ID NO: 1522711 - protein, 26 aa, Mycobacterium tuberculosis
ELPTYAFARQRFWLDGLGAVGGDLGG

SEQ ID NO: 1522712 - protein, 22 aa, Mycobacterium tuberculosis
ELPTYAFQRRRFWLSGDGVAAD

SEQ ID NO: 1522713 - protein, 21 aa, Mycobacterium tuberculosis
ELQQLGRCRGRPEWIAAGQFA

SEQ ID NO: 1522714 - protein, 19 aa, Mycobacterium tuberculosis
ELRDLCDELIRAARAADGW

SEQ ID NO: 1522715 - protein, 23 aa, Mycobacterium tuberculosis
ELRDRAFYAPVQSRYRVFIVDEA

SEQ ID NO: 1522716 - protein, 17 aa, Mycobacterium tuberculosis
ELREKRFMKIISLAPEV

SEQ ID NO: 1522717 - protein, 29 aa, Mycobacterium tuberculosis
ELRELAVFITHYVGFPLGSRLNSAIERVA

SEQ ID NO: 1522718 - protein, 17 aa, Mycobacterium tuberculosis
ELRKRRYPDRKTARRVA

SEQ ID NO: 1522719 - protein, 17 aa, Mycobacterium tuberculosis
ELRLLYLTVTDPASGNL

SEQ ID NO: 1522720 - protein, 21 aa, Mycobacterium tuberculosis
ELRPRKLREAGALWERLTRAV

SEQ ID NO: 1522721 - protein, 22 aa, Mycobacterium tuberculosis
ELRPRKLREAGALWERLTRAVG

SEQ ID NO: 1522722 - protein, 19 aa, Mycobacterium tuberculosis
ELRRIAALCAAFDVDGMRA

SEQ ID NO: 1522723 - protein, 20 aa, Mycobacterium tuberculosis
ELRSDVRLDFKPVVQTRYEP

SEQ ID NO: 1522724 - protein, 20 aa, Mycobacterium tuberculosis
ELRVHPTGKAVLRLSVQTQG

SEQ ID NO: 1522725 - protein, 17 aa, Mycobacterium tuberculosis
ELSPHPLLTHAVDQIAG

SEQ ID NO: 1522726 - protein, 17 aa, Mycobacterium tuberculosis
ELTGMGVTWMLRPSAEN

SEQ ID NO: 1522727 - protein, 24 aa, Mycobacterium tuberculosis
ELTLEDFLEQMLAVRKMGPIGNLL

SEQ ID NO: 1522728 - protein, 18 aa, Mycobacterium tuberculosis
ELTMLAAALRDGSANRPT

SEQ ID NO: 1522729 - protein, 21 aa, Mycobacterium tuberculosis
ELTNRLFMLEWEPAPLEKTAE

SEQ ID NO: 1522730 - protein, 21 aa, Mycobacterium tuberculosis
ELTPEERLLRAIFGEKAREVR

SEQ ID NO: 1522731 - protein, 17 aa, Mycobacterium tuberculosis
ELTPLAAWVACIADART

SEQ ID NO: 1522732 - protein, 28 aa, Mycobacterium tuberculosis
ELTVPEMRQWLRNWVGKAVGKAPDSIDE

SEQ ID NO: 1522733 - protein, 19 aa, Mycobacterium tuberculosis
ELVAWLEQLLSDSVLRDQL

SEQ ID NO: 1522734 - protein, 20 aa, Mycobacterium tuberculosis
ELVDGLLAILAAGASLVQVA

SEQ ID NO: 1522735 - protein, 17 aa, Mycobacterium tuberculosis
ELVPHLFGPNRRPTGQR

SEQ ID NO: 1522736 - protein, 26 aa, Mycobacterium tuberculosis
ELVPVAMPNWHYLHIHNDVIPALKQH

SEQ ID NO: 1522737 - protein, 17 aa, Mycobacterium tuberculosis
ELVQWLHVAALGAPLGN

SEQ ID NO: 1522738 - protein, 17 aa, Mycobacterium tuberculosis
ELVVPILTAALTGAPDA

SEQ ID NO: 1522739 - protein, 18 aa, Mycobacterium tuberculosis
ELYLAVLHRHVENLVSGV

SEQ ID NO: 1522740 - protein, 40 aa, Mycobacterium tuberculosis; identical to SEQ ID NO: 1391825

SEQ ID NO: 1522741 - protein, 22 aa, Mycobacterium tuberculosis
EMFAPGAFRRSIAERGHKLKLL

SEQ ID NO: 1522742 - protein, 17 aa, Mycobacterium tuberculosis
EMIPPRYVEYRGARFPE

SEQ ID NO: 1522743 - protein, 18 aa, Mycobacterium tuberculosis
EMLTTAATDLAKIGSTIT

SEQ ID NO: 1522744 - protein, 17 aa, Mycobacterium tuberculosis
EMMATAAFDLARIGSQV

SEQ ID NO: 1522745 - protein, 21 aa, Mycobacterium tuberculosis
EMMINLFWLGLKGAPVDRLET

SEQ ID NO: 1522746 - protein, 20 aa, Mycobacterium tuberculosis
EMRLNRQLADIEKLQVNVRQ

SEQ ID NO: 1522747 - protein, 31 aa, Mycobacterium tuberculosis
EMWFTEAHWPAFRHVDFLRALRDYSARHRSY

SEQ ID NO: 1522748 - protein, 19 aa, Mycobacterium tuberculosis
EMYKYLVAVSREPDHDKIR

SEQ ID NO: 1522749 - protein, 21 aa, Mycobacterium tuberculosis
ENDLLGIDLLGSTLIALGSEA

SEQ ID NO: 1522750 - protein, 23 aa, Mycobacterium tuberculosis
ENFSRRFVPTSFIVSAIALLITG

SEQ ID NO: 1522751 - protein, 21 aa, Mycobacterium tuberculosis
ENKAYYFAAAFPSACGKTNLA

SEQ ID NO: 1522752 - protein, 19 aa, Mycobacterium tuberculosis
ENLALLRTLVGAIGTFEDL

SEQ ID NO: 1522753 - protein, 23 aa, Mycobacterium tuberculosis
ENLLDIWRRPDLAPGPPGSGSSS

SEQ ID NO: 1522754 - protein, 22 aa, Mycobacterium tuberculosis
ENLQPLIFGLSQMISDYNAARP

SEQ ID NO: 1522755 - protein, 23 aa, Mycobacterium tuberculosis
ENRAELMILIATNLLGQNTPAIA

SEQ ID NO: 1522756 - protein, 17 aa, Mycobacterium tuberculosis
ENRTLACLPGEYGPNLA

SEQ ID NO: 1522757 - protein, 22 aa, Mycobacterium tuberculosis
ENTPNLAWIIGYTNASWTLKSD

SEQ ID NO: 1522758 - protein, 19 aa, Mycobacterium tuberculosis
ENWIATREPPLFGTEPDAR

SEQ ID NO: 1522759 - protein, 25 aa, Mycobacterium tuberculosis
ENYRGAMGLNWYLTDPTLQFIMAYY

SEQ ID NO: 1522760 - protein, 27 aa, Mycobacterium tuberculosis
EPAARAAPVPVPRPAAPVATAVTAATP

SEQ ID NO: 1522761 - protein, 17 aa, Mycobacterium tuberculosis
EPAAWIAEGLFGYLPPD

SEQ ID NO: 1522762 - protein, 25 aa, Mycobacterium tuberculosis
EPALPRLLRRLVIMGGMFDGQPITE

SEQ ID NO: 1522763 - protein, 17 aa, Mycobacterium tuberculosis
EPAPATPAGPAGAGVAA

SEQ ID NO: 1522764 - protein, 17 aa, Mycobacterium tuberculosis
EPAPSPPAAQPAGCGRG

SEQ ID NO: 1522765 - protein, 20 aa, Mycobacterium tuberculosis
EPAVATGPRGAPDQPTGAAV

SEQ ID NO: 1522766 - protein, 17 aa, Mycobacterium tuberculosis
EPAVVVWLASGLAAETF

SEQ ID NO: 1522767 - protein, 24 aa, Mycobacterium tuberculosis
EPCCSAWTGWTWTGSRTSTITPPH

SEQ ID NO: 1522768 - protein, 32 aa, Mycobacterium tuberculosis; identical to SEQ ID NO: 226135

SEQ ID NO: 1522769 - protein, 23 aa, Mycobacterium tuberculosis
EPDPVTLVAQLSRRFAPPTLVNT

SEQ ID NO: 1522770 - protein, 21 aa, Mycobacterium tuberculosis
EPGIYFPGRWGARIEDIVIVT

SEQ ID NO: 1522771 - protein, 17 aa, Mycobacterium tuberculosis
EPGQWWALVRVGCAGQL

SEQ ID NO: 1522772 - protein, 22 aa, Mycobacterium tuberculosis
EPIFHSAPPWRSSAWEPSASAR

SEQ ID NO: 1522773 - protein, 20 aa, Mycobacterium tuberculosis
EPITAVSLAWLPAGDYERAL

SEQ ID NO: 1522774 - protein, 25 aa, Mycobacterium tuberculosis
EPKATTWPPPSRLWTRHLPKSTKPG

SEQ ID NO: 1522775 - protein, 21 aa, Mycobacterium tuberculosis
EPKVPRAARVAVRWLRVGRAG

SEQ ID NO: 1522776 - protein, 23 aa, Mycobacterium tuberculosis
EPLGIQRLLAARSQRGRKIPDLL

SEQ ID NO: 1522777 - protein, 19 aa, Mycobacterium tuberculosis
EPNMRWRTFCDELLAVIDK

SEQ ID NO: 1522778 - protein, 21 aa, Mycobacterium tuberculosis
EPNMRWRTFCDEVLAVIDKLN

SEQ ID NO: 1522779 - protein, 25 aa, Mycobacterium tuberculosis
EPNQALGWLPMQDIGAAAAAAAQPS

SEQ ID NO: 1522780 - protein, 20 aa, Mycobacterium tuberculosis
EPPRGVLLYGPPGCGKTFVV

SEQ ID NO: 1522781 - protein, 18 aa, Mycobacterium tuberculosis
EPPRLFVVTRSAASVLPS

SEQ ID NO: 1522782 - protein, 20 aa, Mycobacterium tuberculosis
EPRLAELGGRFWFGLDDGRA

SEQ ID NO: 1522783 - protein, 21 aa, Mycobacterium tuberculosis
EPRLSLQWWVRVESLAKAAGD

SEQ ID NO: 1522784 - protein, 22 aa, Mycobacterium tuberculosis
EPRPRIALAAPTGKAAARLAEA

SEQ ID NO: 1522785 - protein, 17 aa, Mycobacterium tuberculosis
EPSEWLGGPRAARYPLH

SEQ ID NO: 1522786 - protein, 20 aa, Mycobacterium tuberculosis
EPTEFRPLRWDPNAADYRKP

SEQ ID NO: 1522787 - protein, 19 aa, Mycobacterium tuberculosis
EPVFTASVPIPDFGLKVER

SEQ ID NO: 1522788 - protein, 17 aa, Mycobacterium tuberculosis
EPVIPFAQPDSLTRVYA

SEQ ID NO: 1522789 - protein, 19 aa, Mycobacterium tuberculosis
EPVWTTRLTGPGGATQLAI

SEQ ID NO: 1522790 - protein, 18 aa, Mycobacterium tuberculosis
EPWSVADFSRYLSTLGLP

SEQ ID NO: 1522791 - protein, 19 aa, Mycobacterium tuberculosis
EQAAKLCVQYLAPIVKNRQ

SEQ ID NO: 1522792 - protein, 25 aa, Mycobacterium tuberculosis
EQAVSQIWPIDRPGLLFDDMDDLRD

SEQ ID NO: 1522793 - protein, 19 aa, Mycobacterium tuberculosis
EQDFRLFSGMSAHYDSLPR

SEQ ID NO: 1522794 - protein, 21 aa, Mycobacterium tuberculosis
EQDFRLFSGMSAHYDSLPRLI

SEQ ID NO: 1522795 - protein, 24 aa, Mycobacterium tuberculosis
EQHPLLTVIADHSLALLEVIRAIV

SEQ ID NO: 1522796 - protein, 32 aa, Mycobacterium tuberculosis
EQIQLGLIGMQLALTALWRSYGVTPDAVIGHS

SEQ ID NO: 1522797 - protein, 35 aa, Mycobacterium tuberculosis
EQIQLGLIGMQLTLTELWRSYGVQPDLVIGHSMGE

SEQ ID NO: 1522798 - protein, 17 aa, Mycobacterium tuberculosis
EQKLRLVQALQARGHVV

SEQ ID NO: 1522799 - protein, 24 aa, Mycobacterium tuberculosis
EQPALAVRRLVAVLAAAFDAQHPA

SEQ ID NO: 1522800 - protein, 21 aa, Mycobacterium tuberculosis
EQPARAAIPAGAAAKDAESAG

SEQ ID NO: 1522801 - protein, 33 aa, Mycobacterium tuberculosis; identical to SEQ ID NO: 217738

SEQ ID NO: 1522802 - protein, 24 aa, Mycobacterium tuberculosis
EQQTMLPFSWQGVCLHASGAARVR

SEQ ID NO: 1522803 - protein, 21 aa, Mycobacterium tuberculosis
EQRARLRFRPGNRLADPGGAA

SEQ ID NO: 1522804 - protein, 25 aa, Mycobacterium tuberculosis
EQRFDRELWRKLIDAGILSSAAPES

SEQ ID NO: 1522805 - protein, 17 aa, Mycobacterium tuberculosis
EQRLRALDYPKVVIGVS

SEQ ID NO: 1522806 - protein, 29 aa, Mycobacterium tuberculosis
EQSKNPVLQLFIDILMRLTKRYVQKSGTQ

SEQ ID NO: 1522807 - protein, 17 aa, Mycobacterium tuberculosis
EQVAKLACDWFIDHLCG

SEQ ID NO: 1522808 - protein, 17 aa, Mycobacterium tuberculosis
EQVFPVLTPLAVDPAHP

SEQ ID NO: 1522809 - protein, 20 aa, Mycobacterium tuberculosis
EQWRWLAHTLTVELLKELLP

SEQ ID NO: 1522810 - protein, 21 aa, Mycobacterium tuberculosis
EQYWAAAGRPGPVPLALGPVH

SEQ ID NO: 1522811 - protein, 23 aa, Mycobacterium tuberculosis
ERARLRIFFEFLRGADETGTSAL

SEQ ID NO: 1522812 - protein, 29 aa, Mycobacterium tuberculosis
ERARLWPRPVDAYRLRFLPKLDRAWDSGD

SEQ ID NO: 1522813 - protein, 28 aa, Mycobacterium tuberculosis
ERATPMPIPIGLWMFQTKLHVNAGGADV

SEQ ID NO: 1522814 - protein, 18 aa, Mycobacterium tuberculosis
ERAYVIFGNHEFGLPPGD

SEQ ID NO: 1522815 - protein, 20 aa, Mycobacterium tuberculosis
ERCGRFLKVLSQVGYQQADH

SEQ ID NO: 1522816 - protein, 37 aa, Mycobacterium tuberculosis
ERCSGRLRKLFNAVGVVFKGTGFYRTDSRESGKKSKS

SEQ ID NO: 1522817 - protein, 23 aa, Mycobacterium tuberculosis
ERDRALGLLTFTTDLNDLSDRQL

SEQ ID NO: 1522818 - protein, 22 aa, Mycobacterium tuberculosis
ERDRLVSERLLTLGWQQRALPE

SEQ ID NO: 1522819 - protein, 23 aa, Mycobacterium tuberculosis
ERDRLVSERLLTLGWQQRALPEV

SEQ ID NO: 1522820 - protein, 28 aa, Mycobacterium tuberculosis
ERELRARFRPIFRPQFTLDGGVGARRHT

SEQ ID NO: 1522821 - protein, 30 aa, Mycobacterium tuberculosis
ERFLAGPGLVYLLWPVALGYLRVVTHPTLL

SEQ ID NO: 1522822 - protein, 21 aa, Mycobacterium tuberculosis
ERGKAARRFLPGATILKASVG

SEQ ID NO: 1522823 - protein, 17 aa, Mycobacterium tuberculosis
ERGPAMEYLIAAQDVLV

SEQ ID NO: 1522824 - protein, 18 aa, Mycobacterium tuberculosis
ERGPGQMLGGLPVGQMGA

SEQ ID NO: 1522825 - protein, 23 aa, Mycobacterium tuberculosis
ERGYAYDPAFHGLVSIWRRRSEL

SEQ ID NO: 1522826 - protein, 24 aa, Mycobacterium tuberculosis
ERHDALPYDLAGRKLLVTAGGTRE

SEQ ID NO: 1522827 - protein, 25 aa, Mycobacterium tuberculosis
ERHDRLIEAIVLIRQLWSGERISFT

SEQ ID NO: 1522828 - protein, 19 aa, Mycobacterium tuberculosis
ERHRGLDVVRLGPALWGDL

SEQ ID NO: 1522829 - protein, 27 aa, Mycobacterium tuberculosis
ERIGHLAARLATLGPAATLARGYAIVQ

SEQ ID NO: 1522830 - protein, 23 aa, Mycobacterium tuberculosis
ERIRLTLYIRIYGWIFSIAGSTG

SEQ ID NO: 1522831 - protein, 17 aa, Mycobacterium tuberculosis
ERIVAVGVFHPGFEPRR

SEQ ID NO: 1522832 - protein, 25 aa, Mycobacterium tuberculosis
ERIWYSDFLDFVGRERIFASLLTPA

SEQ ID NO: 1522833 - protein, 18 aa, Mycobacterium tuberculosis
ERKVPVHPGLNRVYARLP

SEQ ID NO: 1522834 - protein, 20 aa, Mycobacterium tuberculosis
ERLGLPVFVKPARGGSSIGV

SEQ ID NO: 1522835 - protein, 22 aa, Mycobacterium tuberculosis
ERLLPALGFRVRFGVLVIRCAL

SEQ ID NO: 1522836 - protein, 17 aa, Mycobacterium tuberculosis
ERLTALPGWELVDGKLR

SEQ ID NO: 1522837 - protein, 29 aa, Mycobacterium tuberculosis
ERLTTRVIDLILPIGKVNAAFIVSAVQRV

SEQ ID NO: 1522838 - protein, 25 aa, Mycobacterium tuberculosis
ERMRHGMYWSGDLAYRDSEGWIYLA

SEQ ID NO: 1522839 - protein, 29 aa, Mycobacterium tuberculosis
ERNLFRDMVHPLIARPLPAETGPAPFRHI

SEQ ID NO: 1522840 - protein, 23 aa, Mycobacterium tuberculosis
ERNRVLPLLGGLAVMFGDLPPLP

SEQ ID NO: 1522841 - protein, 26 aa, Mycobacterium tuberculosis
ERPRFDALGRWLLARTAEIVAGRPGI

SEQ ID NO: 1522842 - protein, 20 aa, Mycobacterium tuberculosis
ERQRLATSLRNAAKAYGEVD

SEQ ID NO: 1522843 - protein, 24 aa, Mycobacterium tuberculosis
ERQYRDMRILGIGGGTTEILTALA

SEQ ID NO: 1522844 - protein, 18 aa, Mycobacterium tuberculosis
ERSGLRQMAPSRRSRRAC

SEQ ID NO: 1522845 - protein, 28 aa, Mycobacterium tuberculosis
ERSRNPALTARPRRTIVKHERSCLMKAA

SEQ ID NO: 1522846 - protein, 28 aa, Mycobacterium tuberculosis
ERSTALLDLGWTIIRFVGRVDAAMRAAG

SEQ ID NO: 1522847 - protein, 28 aa, Mycobacterium tuberculosis
ERTRVRTPLIELFELFDPADPEVVARRR

SEQ ID NO: 1522848 - protein, 19 aa, Mycobacterium tuberculosis
ERTWLDGWLLRAGHGAVLA

SEQ ID NO: 1522849 - protein, 19 aa, Mycobacterium tuberculosis
ERVEILGRYWWRIRRRATE

SEQ ID NO: 1522850 - protein, 23 aa, Mycobacterium tuberculosis
ERWKETAFQYGWLLATADSDRYG

SEQ ID NO: 1522851 - protein, 24 aa, Mycobacterium tuberculosis
ERYGVPASALLHRAGQRKLIGGQE

SEQ ID NO: 1522852 - protein, 19 aa, Mycobacterium tuberculosis
ESAHRAPCGPVFLLGLIAT

SEQ ID NO: 1522853 - protein, 25 aa, Mycobacterium tuberculosis
ESAQTLLENLFFKEKRYDLARVGRY

SEQ ID NO: 1522854 - protein, 23 aa, Mycobacterium tuberculosis
ESAYQVFHATRRLAAAMVASSAT

SEQ ID NO: 1522855 - protein, 23 aa, Mycobacterium tuberculosis
ESDALRRYLRTRHPRVSSALARA

SEQ ID NO: 1522856 - protein, 26 aa, Mycobacterium tuberculosis
ESDGTLRVGYLPVTITRWPPGERVYG

SEQ ID NO: 1522857 - protein, 33 aa, Mycobacterium tuberculosis; identical to SEQ ID NO: 164365

SEQ ID NO: 1522858 - protein, 22 aa, Mycobacterium tuberculosis
ESFRNGPWPGRAFPSDAGGFCG

SEQ ID NO: 1522859 - protein, 21 aa, Mycobacterium tuberculosis
ESFRRIDFALDPPAGDIGLLR

SEQ ID NO: 1522860 - protein, 22 aa, Mycobacterium tuberculosis
ESFRRIDFALDPPAGDIGLLRE

SEQ ID NO: 1522861 - protein, 23 aa, Mycobacterium tuberculosis
ESGDWWDVVWQCASVLLTYPNSR

SEQ ID NO: 1522862 - protein, 19 aa, Mycobacterium tuberculosis
ESGRLDRHPIKRARTTFTY

SEQ ID NO: 1522863 - protein, 21 aa, Mycobacterium tuberculosis
ESGVRRVYPGAATAGCFFYSK

SEQ ID NO: 1522864 - protein, 22 aa, Mycobacterium tuberculosis
ESGWHVVAPFMRGYAPSSIPAD

SEQ ID NO: 1522865 - protein, 19 aa, Mycobacterium tuberculosis
ESIEIPAIRRSVDPRRQLT

SEQ ID NO: 1522866 - protein, 27 aa, Mycobacterium tuberculosis
ESKLPKVFFVNWFRRGDDGRFLWPGFG

SEQ ID NO: 1522867 - protein, 25 aa, Mycobacterium tuberculosis
ESLADPLAFLLRKEGFEATVVTDGP

SEQ ID NO: 1522868 - protein, 21 aa, Mycobacterium tuberculosis
ESLCFAGANLIPLRGGPIDLN

SEQ ID NO: 1522869 - protein, 28 aa, Mycobacterium tuberculosis
ESLPLASIFKLYVLHALAGAVQHNTVSW

SEQ ID NO: 1522870 - protein, 29 aa, Mycobacterium tuberculosis
ESLYGAWSANPFPFLRQIIANHQVYWQQI

SEQ ID NO: 1522871 - protein, 17 aa, Mycobacterium tuberculosis
ESPIVHGMWLSAAAQHA

SEQ ID NO: 1522872 - protein, 25 aa, Mycobacterium tuberculosis
ESPQAHPLLPKRRPSTCCSWPTAAS

SEQ ID NO: 1522873 - protein, 21 aa, Mycobacterium tuberculosis
ESPTWKFTDTPALRALSRARS

SEQ ID NO: 1522874 - protein, 34 aa, Mycobacterium tuberculosis
ESPYFPLHNALFDLPPYRGKWPEIWVAAHGPRML

SEQ ID NO: 1522875 - protein, 23 aa, Mycobacterium tuberculosis
ESQPRRRGRRGRRAVGPCGSGGP

SEQ ID NO: 1522876 - protein, 21 aa, Mycobacterium tuberculosis
ESRPIGLVRESSCLGRRSLHP

SEQ ID NO: 1522877 - protein, 26 aa, Mycobacterium tuberculosis
ESYGRYWREVFRLPTMNHRKLARQLD

SEQ ID NO: 1522878 - protein, 23 aa, Mycobacterium tuberculosis
ESYKVTGTAPIYEILHDARNERT

SEQ ID NO: 1522879 - protein, 24 aa, Mycobacterium tuberculosis
ETAQPQYARYWLHNPRPGAAGRAA

SEQ ID NO: 1522880 - protein, 32 aa, Mycobacterium tuberculosis
ETARNFQVVSIPTLILFKDGQPVKRIVGAKGK

SEQ ID NO: 1522881 - protein, 21 aa, Mycobacterium tuberculosis
ETAYCAPPPVRRDRVPINATV

SEQ ID NO: 1522882 - protein, 17 aa, Mycobacterium tuberculosis
ETDKATVKLLFRDAYAL

SEQ ID NO: 1522883 - protein, 24 aa, Mycobacterium tuberculosis
ETEIEILAEKIARWARARSAEIER

SEQ ID NO: 1522884 - protein, 20 aa, Mycobacterium tuberculosis
ETELMAWAIPRAANRFWMLN

SEQ ID NO: 1522885 - protein, 22 aa, Mycobacterium tuberculosis
ETEQILFRRLAPFVGGFDLAAV

SEQ ID NO: 1522886 - protein, 24 aa, Mycobacterium tuberculosis
ETGMVNVLCTPGVWARHRKLAHTA

SEQ ID NO: 1522887 - protein, 29 aa, Mycobacterium tuberculosis
ETGQTPLARWSAGGPIPLPAPETLTEAFL

SEQ ID NO: 1522888 - protein, 17 aa, Mycobacterium tuberculosis
ETGRPRWMAVSANGGAG

SEQ ID NO: 1522889 - protein, 24 aa, Mycobacterium tuberculosis
ETGYAMPHWPRPWGRAAGAVEQLV

SEQ ID NO: 1522890 - protein, 18 aa, Mycobacterium tuberculosis
ETHLLFGIPYDRIDVVVH

SEQ ID NO: 1522891 - protein, 19 aa, Mycobacterium tuberculosis
ETIRAWFPDAPLEVREALV

SEQ ID NO: 1522892 - protein, 18 aa, Mycobacterium tuberculosis
ETITYRELWARAGTLATA

SEQ ID NO: 1522893 - protein, 20 aa, Mycobacterium tuberculosis
ETLTPFSVPPLDLAGLASQA

SEQ ID NO: 1522894 - protein, 22 aa, Mycobacterium tuberculosis
ETLTWSQLYRRTLNLAAQLREH

SEQ ID NO: 1522895 - protein, 18 aa, Mycobacterium tuberculosis
ETPLAAVTRYFAAYNLVC

SEQ ID NO: 1522896 - protein, 23 aa, Mycobacterium tuberculosis
ETQIAISAWGLLSPQGRCAAFDA

SEQ ID NO: 1522897 - protein, 20 aa, Mycobacterium tuberculosis
ETQMTAAIPLATREVGRRLN

SEQ ID NO: 1522898 - protein, 21 aa, Mycobacterium tuberculosis
ETRERLRRHLEACPGCLRHYG

SEQ ID NO: 1522899 - protein, 21 aa, Mycobacterium tuberculosis
ETRKFRVEFLTPTAFKQSGEY

SEQ ID NO: 1522900 - protein, 24 aa, Mycobacterium tuberculosis
ETRRLFAGGGFGGRRFDSGFGGGF

SEQ ID NO: 1522901 - protein, 35 aa, Mycobacterium tuberculosis
ETRTRPSHLGLRLVPPTRAARTEIPEARHPTVAGV

SEQ ID NO: 1522902 - protein, 21 aa, Mycobacterium tuberculosis
ETSLWCRHPWPEVHGAGRERS

SEQ ID NO: 1522903 - protein, 26 aa, Mycobacterium tuberculosis
ETSVPYFSLAMLPGGRRRALLTGTVA

SEQ ID NO: 1522904 - protein, 23 aa, Mycobacterium tuberculosis
ETTLGKWWRDMKLARVGGGTDEV

SEQ ID NO: 1522905 - protein, 21 aa, Mycobacterium tuberculosis
ETVLGWLDSVHLARRTAIDTH

SEQ ID NO: 1522906 - protein, 23 aa, Mycobacterium tuberculosis
ETVRIYSNGLWRDAPLRRREAMR

SEQ ID NO: 1522907 - protein, 17 aa, Mycobacterium tuberculosis
ETVTWILRDLGVYAIRL

SEQ ID NO: 1522908 - protein, 19 aa, Mycobacterium tuberculosis
ETYHAFLHVAADEALAAAA

SEQ ID NO: 1522909 - protein, 20 aa, Mycobacterium tuberculosis
ETYHAFLHVAADEALAAAAA

SEQ ID NO: 1522910 - protein, 25 aa, Mycobacterium tuberculosis
EVAGKMALLYWRGRGLPGKRRLMTW

SEQ ID NO: 1522911 - protein, 17 aa, Mycobacterium tuberculosis
EVALPASIRFQQGAYRI

SEQ ID NO: 1522912 - protein, 23 aa, Mycobacterium tuberculosis
EVALPASIRFQQGAYRIHPALLD

SEQ ID NO: 1522913 - protein, 24 aa, Mycobacterium tuberculosis
EVASVAVFLASDLSLYMTGTVLDV

SEQ ID NO: 1522914 - protein, 18 aa, Mycobacterium tuberculosis
EVAVAFAGVATATARAGP

SEQ ID NO: 1522915 - protein, 22 aa, Mycobacterium tuberculosis
EVAYLRFASVYRSFSSADDFAR

SEQ ID NO: 1522916 - protein, 27 aa, Mycobacterium tuberculosis
EVCGYHCWVEFFVAGLGWLPADASCAT

SEQ ID NO: 1522917 - protein, 26 aa, Mycobacterium tuberculosis
EVCLQMHLLNLSFAIAVRKRAKADAQ

SEQ ID NO: 1522918 - protein, 29 aa, Mycobacterium tuberculosis
EVDTLRRVELLRQLRLVVYDLLVVSIDPE

SEQ ID NO: 1522919 - protein, 29 aa, Mycobacterium tuberculosis
EVDTRRWAGVPFYLRTGKRLGRRVTEIAL

SEQ ID NO: 1522920 - protein, 18 aa, Mycobacterium tuberculosis
EVELAKRIEAGLYATQLM

SEQ ID NO: 1522921 - protein, 19 aa, Mycobacterium tuberculosis
EVELAKRIEAGLYATQLMT

SEQ ID NO: 1522922 - protein, 17 aa, Mycobacterium tuberculosis
EVEPIARVLPMLSVPHL

SEQ ID NO: 1522923 - protein, 22 aa, Mycobacterium tuberculosis
EVEVLRLSALRGLFSAVIEDAV

SEQ ID NO: 1522924 - protein, 25 aa, Mycobacterium tuberculosis
EVEYRQLRLEQVVLVGVWTEGSAAD

SEQ ID NO: 1522925 - protein, 26 aa, Mycobacterium tuberculosis
EVEYRQLRLERVVLVGVWTEGSAADN

SEQ ID NO: 1522926 - protein, 18 aa, Mycobacterium tuberculosis
EVFFRLDDFQALNASLVE

SEQ ID NO: 1522927 - protein, 24 aa, Mycobacterium tuberculosis
EVGQYVTWGLNHLVFHAPGHDQRR

SEQ ID NO: 1522928 - protein, 18 aa, Mycobacterium tuberculosis
EVGYGQRPQQLGGASRLP

SEQ ID NO: 1522929 - protein, 17 aa, Mycobacterium tuberculosis
EVHFACDPRFNKLLGPL

SEQ ID NO: 1522930 - protein, 21 aa, Mycobacterium tuberculosis
EVHLGSWRPGLSYRQLARELT

SEQ ID NO: 1522931 - protein, 24 aa, Mycobacterium tuberculosis
EVHRARSTLRRNLTLMVAAETERI

SEQ ID NO: 1522932 - protein, 18 aa, Mycobacterium tuberculosis
EVIAEHPVLLNRAPTLHR

SEQ ID NO: 1522933 - protein, 17 aa, Mycobacterium tuberculosis
EVIAGRLHKLEPLGYQL

SEQ ID NO: 1522934 - protein, 28 aa, Mycobacterium tuberculosis
EVIAPTPERPIIFNLPATVEMTTPNVYA

SEQ ID NO: 1522935 - protein, 18 aa, Mycobacterium tuberculosis
EVIETHLLFGIPYDRIDV

SEQ ID NO: 1522936 - protein, 24 aa, Mycobacterium tuberculosis
EVKPLSLVVGLIDELRKRHPDLDE

SEQ ID NO: 1522937 - protein, 17 aa, Mycobacterium tuberculosis
EVLAELMAIWAAGDTAG

SEQ ID NO: 1522938 - protein, 18 aa, Mycobacterium tuberculosis
EVLAWRQRSLTGRRWFDE

SEQ ID NO: 1522939 - protein, 24 aa, Mycobacterium tuberculosis
EVLGNWTGIPVFKLTEAETTRLLR

SEQ ID NO: 1522940 - protein, 21 aa, Mycobacterium tuberculosis
EVLLIEPFYDSYSPVVAMAGA

SEQ ID NO: 1522941 - protein, 17 aa, Mycobacterium tuberculosis
EVLPLAAGQIERLDQRH

SEQ ID NO: 1522942 - protein, 18 aa, Mycobacterium tuberculosis
EVLQWPAGTIARIRRGEP

SEQ ID NO: 1522943 - protein, 18 aa, Mycobacterium tuberculosis
EVLRACLRVRPAVRHHDL

SEQ ID NO: 1522944 - protein, 17 aa, Mycobacterium tuberculosis
EVLRNMLYADSPALQGA

SEQ ID NO: 1522945 - protein, 18 aa, Mycobacterium tuberculosis
EVLRRLDLNGRLAPLSWC

SEQ ID NO: 1522946 - protein, 24 aa, Mycobacterium tuberculosis
EVLVGLGMRTWADGRTLLLGSPSL

SEQ ID NO: 1522947 - protein, 24 aa, Mycobacterium tuberculosis
EVNLLHDHLVDILLDAAAMGRVHV

SEQ ID NO: 1522948 - protein, 17 aa, Mycobacterium tuberculosis
EVNSARIFAGAGLGPML

SEQ ID NO: 1522949 - protein, 22 aa, Mycobacterium tuberculosis
EVNSARIFAGAGLGPMLAAASA

SEQ ID NO: 1522950 - protein, 17 aa, Mycobacterium tuberculosis
EVPAQALLGLQVTVGPI

SEQ ID NO: 1522951 - protein, 20 aa, Mycobacterium tuberculosis
EVPPALRRLVLEGQAAVQRS

SEQ ID NO: 1522952 - protein, 24 aa, Mycobacterium tuberculosis
EVQIGKFRLVFLTGPKQGEDDGST

SEQ ID NO: 1522953 - protein, 18 aa, Mycobacterium tuberculosis
EVQTVQRSLLGQMLTSRP

SEQ ID NO: 1522954 - protein, 18 aa, Mycobacterium tuberculosis
EVRGPWIAGSYYGGRDES

SEQ ID NO: 1522955 - protein, 26 aa, Mycobacterium tuberculosis
EVRHYIIDCALRWMRDFHADGLRLDA

SEQ ID NO: 1522956 - protein, 25 aa, Mycobacterium tuberculosis
EVRKNGVLPYLRPDGKTQVTIAYED

SEQ ID NO: 1522957 - protein, 18 aa, Mycobacterium tuberculosis
EVSAAIAGAVWRARAGVS

SEQ ID NO: 1522958 - protein, 36 aa, Mycobacterium tuberculosis
EVSGPLLRRKFRPSSAAMLPLRTALDRGLLSIRGVD

SEQ ID NO: 1522959 - protein, 31 aa, Mycobacterium tuberculosis
EVSVAGAVPCFFGHAQAYQTLGTQAAAFHER

SEQ ID NO: 1522960 - protein, 22 aa, Mycobacterium tuberculosis
EVTAPLVPLAVSAFLTSRKKAA

SEQ ID NO: 1522961 - protein, 17 aa, Mycobacterium tuberculosis
EVTPHHLLLDDARLASY

SEQ ID NO: 1522962 - protein, 24 aa, Mycobacterium tuberculosis
EVTSLGLVQLTRKRLRTGLIEAFS

SEQ ID NO: 1522963 - protein, 20 aa, Mycobacterium tuberculosis
EVTSLLRFAGGLHIVGGRVV

SEQ ID NO: 1522964 - protein, 22 aa, Mycobacterium tuberculosis
EVTTIVVLRHAPPAPWIPVDQR

SEQ ID NO: 1522965 - protein, 19 aa, Mycobacterium tuberculosis
EVVANYTAFLQLQRALARR

SEQ ID NO: 1522966 - protein, 25 aa, Mycobacterium tuberculosis
EVVGQDHLLAPGSPLRRLVEGSGVA

SEQ ID NO: 1522967 - protein, 19 aa, Mycobacterium tuberculosis
EVVSLWHADADLKGVDAVV

SEQ ID NO: 1522968 - protein, 21 aa, Mycobacterium tuberculosis
EVWPAVVFTLVTLLDDPVAAD

SEQ ID NO: 1522969 - protein, 18 aa, Mycobacterium tuberculosis
EVWYATLSDPLTRTGPMG

SEQ ID NO: 1522970 - protein, 19 aa, Mycobacterium tuberculosis
EVYKRSRPLPAAGSDRRRV

SEQ ID NO: 1522971 - protein, 18 aa, Mycobacterium tuberculosis
EWATIQMYPSLSVALGEE

SEQ ID NO: 1522972 - protein, 17 aa, Mycobacterium tuberculosis
EWLVRQGVPFRSAHEAA

SEQ ID NO: 1522973 - protein, 18 aa, Mycobacterium tuberculosis
EWLVRQGVPFRSAHEAAG

SEQ ID NO: 1522974 - protein, 22 aa, Mycobacterium tuberculosis
EWQRLMVALSAFDLIESTASHH

SEQ ID NO: 1522975 - protein, 17 aa, Mycobacterium tuberculosis
EWRIGPGERIGIVGANG

SEQ ID NO: 1522976 - protein, 26 aa, Mycobacterium tuberculosis
EYADGKRSGLWPGLRETFKSGSSQPP

SEQ ID NO: 1522977 - protein, 32 aa, Mycobacterium tuberculosis
EYGYELVLSATRLAELLAPLEPVTVTFTPTFG

SEQ ID NO: 1522978 - protein, 17 aa, Mycobacterium tuberculosis
EYLIAAQDVLVAAAADL

SEQ ID NO: 1522979 - protein, 21 aa, Mycobacterium tuberculosis
EYPLHQLPQPIAWPGSSDRNF

SEQ ID NO: 1522980 - protein, 21 aa, Mycobacterium tuberculosis
EYRQLRLERVVLVGVWTEGSA

SEQ ID NO: 1522981 - protein, 24 aa, Mycobacterium tuberculosis
EYRRIRQILGRRPTDTELAMYSVM

SEQ ID NO: 1522982 - protein, 22 aa, Mycobacterium tuberculosis
EYVKEDVAIRRLLSSGLERAGI

SEQ ID NO: 1522983 - protein, 24 aa, Mycobacterium tuberculosis
EYWKKGLRHSVYFTHGIRNAVDSG

SEQ ID NO: 1522984 - protein, 17 aa, Mycobacterium tuberculosis
EYYAFSPGFDKKAGEWF

SEQ ID NO: 1522985 - protein, 18 aa, Mycobacterium tuberculosis
EYYAYSPGFDKKAGEWFA

SEQ ID NO: 1522986 - protein, 25 aa, Mycobacterium tuberculosis
FAAPADQALLPMFRAFDLPRVRRID

SEQ ID NO: 1522987 - protein, 23 aa, Mycobacterium tuberculosis
FAAVGARQRREARWVWPADGMVV

SEQ ID NO: 1522988 - protein, 29 aa, Mycobacterium tuberculosis
FACRQSLRPRYLCMLAEILRFHRAAARLL

SEQ ID NO: 1522989 - protein, 20 aa, Mycobacterium tuberculosis
FADFLIRDGHRYRVADTKLA

SEQ ID NO: 1522990 - protein, 31 aa, Mycobacterium tuberculosis
FADNPVLCDLILIRAALSPKTARLGAQEMEK

SEQ ID NO: 1522991 - protein, 21 aa, Mycobacterium tuberculosis
FADVLIAFGRYPSFEGHLPQL

SEQ ID NO: 1522992 - protein, 24 aa, Mycobacterium tuberculosis
FAEFGGWLMPVSYAGTVSEHNATR

SEQ ID NO: 1522993 - protein, 39 aa, Mycobacterium tuberculosis
FAEIMGFYGLSYWYPFQVTALGLGPIWMSANEDAKRKAA

SEQ ID NO: 1522994 - protein, 23 aa, Mycobacterium tuberculosis
FAELRSAAPIWWNGQDPGKGGGF

SEQ ID NO: 1522995 - protein, 20 aa, Mycobacterium tuberculosis
FAELSPHPLLTHAVDQIAGS

SEQ ID NO: 1522996 - protein, 19 aa, Mycobacterium tuberculosis
FAGARRTMGLPATVVDWGL

SEQ ID NO: 1522997 - protein, 20 aa, Mycobacterium tuberculosis
FAGQRLSVGLPDTLGSPGDD

SEQ ID NO: 1522998 - protein, 17 aa, Mycobacterium tuberculosis
FAGVATATARAGPAKVP

SEQ ID NO: 1522999 - protein, 22 aa, Mycobacterium tuberculosis
FAKALVYEMPHTLAALDCGALS

SEQ ID NO: 1523000 - protein, 17 aa, Mycobacterium tuberculosis
FALGDVSSPYLLKHVAN

SEQ ID NO: 1523001 - protein, 26 aa, Mycobacterium tuberculosis
FALQDFSLFQVLRYGFRPSKIAFLAW

SEQ ID NO: 1523002 - protein, 17 aa, Mycobacterium tuberculosis
FANSDAWFLIRVVTAPD

SEQ ID NO: 1523003 - protein, 20 aa, Mycobacterium tuberculosis
FAPGAFRRSIAERGHKLKLL

SEQ ID NO: 1523004 - protein, 24 aa, Mycobacterium tuberculosis
FAPGVIDAMFHPPGRRIAPVGPPG

SEQ ID NO: 1523005 - protein, 17 aa, Mycobacterium tuberculosis
FAQIYDLERDPPPRSTP

SEQ ID NO: 1523006 - protein, 18 aa, Mycobacterium tuberculosis
FAQKLGWTGVPVSSSYAA

SEQ ID NO: 1523007 - protein, 34 aa, Mycobacterium tuberculosis
FAQPALFAVEVALYRLVMSWGVRPGLVLGHSVGE

SEQ ID NO: 1523008 - protein, 29 aa, Mycobacterium tuberculosis
FAQQTFVNQLPFPTFSLGKITIPQIQTFD

SEQ ID NO: 1523009 - protein, 25 aa, Mycobacterium tuberculosis
FARAEPIFATVAPGVAAAPRTPGRD

SEQ ID NO: 1523010 - protein, 20 aa, Mycobacterium tuberculosis
FARDWLSEDLARLPVGAALL

SEQ ID NO: 1523011 - protein, 25 aa, Mycobacterium tuberculosis
FARLAERNGVPVRALWASSGQAPST

SEQ ID NO: 1523012 - protein, 27 aa, Mycobacterium tuberculosis
FARRVPLAAAVWTQRGWRFPDRLDRVY

SEQ ID NO: 1523013 - protein, 25 aa, Mycobacterium tuberculosis
FASGPYFKVLLANLVPGQILQPFVD

SEQ ID NO: 1523014 - protein, 25 aa, Mycobacterium tuberculosis
FASYARQRPGLLAAWLDGDLGELPG

SEQ ID NO: 1523015 - protein, 25 aa, Mycobacterium tuberculosis
FATLPSMMHITLNAILRAIFGAGGS

SEQ ID NO: 1523016 - protein, 28 aa, Mycobacterium tuberculosis
FATMSPAERWHLLASAWLDLPGRPALIG

SEQ ID NO: 1523017 - protein, 19 aa, Mycobacterium tuberculosis
FATVPPPEIAANRALLMAL

SEQ ID NO: 1523018 - protein, 18 aa, Mycobacterium tuberculosis
FAVALPFVDLIDYRLQVT

SEQ ID NO: 1523019 - protein, 17 aa, Mycobacterium tuberculosis
FAVMVSLAELWKSVAVH

SEQ ID NO: 1523020 - protein, 17 aa, Mycobacterium tuberculosis
FCITTEVGVRYLAAPES

SEQ ID NO: 1523021 - protein, 18 aa, Mycobacterium tuberculosis
FCLGTCVAGIRAIPGLSD

SEQ ID NO: 1523022 - protein, 21 aa, Mycobacterium tuberculosis
FCPDQFLGAHVRRVTGRKNLH

SEQ ID NO: 1523023 - protein, 18 aa, Mycobacterium tuberculosis
FCRDTWPSAAAPIQVPMR

SEQ ID NO: 1523024 - protein, 17 aa, Mycobacterium tuberculosis
FCSPRIPPVPDAVKRRY

SEQ ID NO: 1523025 - protein, 18 aa, Mycobacterium tuberculosis
FDAFSERVAPALPVDLEE

SEQ ID NO: 1523026 - protein, 17 aa, Mycobacterium tuberculosis
FDAWRFENRCELLAFRH

SEQ ID NO: 1523027 - protein, 21 aa, Mycobacterium tuberculosis
FDDDVFAWRGVLQSAAVHEFH

SEQ ID NO: 1523028 - protein, 26 aa, Mycobacterium tuberculosis
FDDVHVAPRVIFLPGPAAALTSDDHG

SEQ ID NO: 1523029 - protein, 25 aa, Mycobacterium tuberculosis
FDEQPRLFYMHFWAENDAVALARTL

SEQ ID NO: 1523030 - protein, 26 aa, Mycobacterium tuberculosis
FDEQPRLFYMHFWAENDAVALARTLR

SEQ ID NO: 1523031 - protein, 19 aa, Mycobacterium tuberculosis
FDGFGYSAPIPADHARLLG

SEQ ID NO: 1523032 - protein, 27 aa, Mycobacterium tuberculosis
FDGRFVGFADFLIRDGHRYRVADTKLA

SEQ ID NO: 1523033 - protein, 27 aa, Mycobacterium tuberculosis
FDGVTYVLERGIRTDFALVHAWQGDRH

SEQ ID NO: 1523034 - protein, 21 aa, Mycobacterium tuberculosis
FDGYEYLFWVGCAGAYDDKAK

SEQ ID NO: 1523035 - protein, 22 aa, Mycobacterium tuberculosis
FDIASLWPVKPLLSLSALETHF

SEQ ID NO: 1523036 - protein, 18 aa, Mycobacterium tuberculosis
FDIGLANLGSYNIGFGNF

SEQ ID NO: 1523037 - protein, 30 aa, Mycobacterium tuberculosis
FDIRTSAGPLNIPIIDIPAAPGFGNSTQMP

SEQ ID NO: 1523038 - protein, 28 aa, Mycobacterium tuberculosis
FDLRAQGINLIIHYVHRAGALGKIGTLL

SEQ ID NO: 1523039 - protein, 27 aa, Mycobacterium tuberculosis
FDPRPPMITSGLRIGTPALAARGFSHN

SEQ ID NO: 1523040 - protein, 29 aa, Mycobacterium tuberculosis
FDPTARTAWLAEGLLMYLPAEAQDRLFTQ

SEQ ID NO: 1523041 - protein, 20 aa, Mycobacterium tuberculosis
FDRLRNLAAIKDVAARPTRT

SEQ ID NO: 1523042 - protein, 18 aa, Mycobacterium tuberculosis
FDRNAFVNLSRSAGLVDV

SEQ ID NO: 1523043 - protein, 17 aa, Mycobacterium tuberculosis
FDRNWVAGLVGLMVHSI

SEQ ID NO: 1523044 - protein, 21 aa, Mycobacterium tuberculosis
FDVDTPWRKLPAKAPQGDSGR

SEQ ID NO: 1523045 - protein, 30 aa, Mycobacterium tuberculosis
FDVGAVIYFLRKVIWFLPDFTVEGYHDRLR

SEQ ID NO: 1523046 - protein, 21 aa, Mycobacterium tuberculosis
FDVPGRRWDQLGLCHSAVIAP

SEQ ID NO: 1523047 - protein, 17 aa, Mycobacterium tuberculosis
FDVYTDIAFPGGIHAAW

SEQ ID NO: 1523048 - protein, 24 aa, Mycobacterium tuberculosis
FEAAKAAIVPPAAVAANREAFLAL

SEQ ID NO: 1523049 - protein, 47 aa, Mycobacterium tuberculosis
FEAARAATVHPLLVAANRNAFAQLVMSNWFGLNAPLIAAVEGAYEQM

SEQ ID NO: 1523050 - protein, 27 aa, Mycobacterium tuberculosis
FEAVRARLRRRGPVTVYGVDKFPRMVD

SEQ ID NO: 1523051 - protein, 19 aa, Mycobacterium tuberculosis
FEDADWFRTYFHEVGPSIS

SEQ ID NO: 1523052 - protein, 19 aa, Mycobacterium tuberculosis
FEFRWNDQFALSLDPDTAR

SEQ ID NO: 1523053 - protein, 20 aa, Mycobacterium tuberculosis
FEFRWNDQFALSLDPDTARE

SEQ ID NO: 1523054 - protein, 22 aa, Mycobacterium tuberculosis
FEGASPTCSTLWWSGCPIRVTA

SEQ ID NO: 1523055 - protein, 17 aa, Mycobacterium tuberculosis
FEGGLWSGGAANAAKRR

SEQ ID NO: 1523056 - protein, 18 aa, Mycobacterium tuberculosis
FEGGYPFEYLNDPAKTAA

SEQ ID NO: 1523057 - protein, 25 aa, Mycobacterium tuberculosis
FEGNAQNFRILTSLEPKVVDAQGLS

SEQ ID NO: 1523058 - protein, 19 aa, Mycobacterium tuberculosis
FEHLLIPFLVALAQLRWHR

SEQ ID NO: 1523059 - protein, 23 aa, Mycobacterium tuberculosis
FEIDLRRLLYREAQQRGIYALGA

SEQ ID NO: 1523060 - protein, 21 aa, Mycobacterium tuberculosis
FEKTLRFWLDRGVEGFRIDMS

SEQ ID NO: 1523061 - protein, 22 aa, Mycobacterium tuberculosis
FENNGIRALELMSSPGSGKTTV

SEQ ID NO: 1523062 - protein, 17 aa, Mycobacterium tuberculosis
FERGLRWSPPPAGIPAT

SEQ ID NO: 1523063 - protein, 17 aa, Mycobacterium tuberculosis
FERSGFGGPLSFYHNID

SEQ ID NO: 1523064 - protein, 18 aa, Mycobacterium tuberculosis
FESVREKIETRYGTALGA

SEQ ID NO: 1523065 - protein, 17 aa, Mycobacterium tuberculosis
FETSWLDPFTEFRFPRI

SEQ ID NO: 1523066 - protein, 17 aa, Mycobacterium tuberculosis
FFAAIDIGGDVVGGARV

SEQ ID NO: 1523067 - protein, 19 aa, Mycobacterium tuberculosis
FFDAYRAIKPYLITSGNPP

SEQ ID NO: 1523068 - protein, 18 aa, Mycobacterium tuberculosis
FFGSGRWGGRQLGSGGLG

SEQ ID NO: 1523069 - protein, 17 aa, Mycobacterium tuberculosis
FFPTWHTTTAELPQTST

SEQ ID NO: 1523070 - protein, 19 aa, Mycobacterium tuberculosis
FGAAGEGCLLLVYPNVIAV

SEQ ID NO: 1523071 - protein, 17 aa, Mycobacterium tuberculosis
FGALVHRYTHSDDFLVA

SEQ ID NO: 1523072 - protein, 26 aa, Mycobacterium tuberculosis
FGAQPGPFRGFRRIVVHRLVGRNRHL

SEQ ID NO: 1523073 - protein, 26 aa, Mycobacterium tuberculosis
FGDGGNGGFSFFDGNGGDGGTGGTLI

SEQ ID NO: 1523074 - protein, 17 aa, Mycobacterium tuberculosis
FGEEAFGMAKDSWDLGP

SEQ ID NO: 1523075 - protein, 17 aa, Mycobacterium tuberculosis
FGFDYLRDTWRTHLDDL

SEQ ID NO: 1523076 - protein, 17 aa, Mycobacterium tuberculosis
FGGAGGIAQLFGTGGMG

SEQ ID NO: 1523077 - protein, 18 aa, Mycobacterium tuberculosis
FGGAGGIAQLFGTGGMGG

SEQ ID NO: 1523078 - protein, 19 aa, Mycobacterium tuberculosis
FGGFGGLLLGADGYNAPES

SEQ ID NO: 1523079 - protein, 20 aa, Mycobacterium tuberculosis
FGGFGGLLLGADGYNAPEST

SEQ ID NO: 1523080 - protein, 18 aa, Mycobacterium tuberculosis
FGGFGTAGGVGGAGGNAG

SEQ ID NO: 1523081 - protein, 17 aa, Mycobacterium tuberculosis
FGGGASGFWNLASATSG

SEQ ID NO: 1523082 - protein, 25 aa, Mycobacterium tuberculosis
FGGNPVCAAAALAVLRVLASDGLVR

SEQ ID NO: 1523083 - protein, 26 aa, Mycobacterium tuberculosis
FGGYVALPAYLAARGLPLPPRRRRRI

SEQ ID NO: 1523084 - protein, 23 aa, Mycobacterium tuberculosis
FGIIKHVMGFRQFSLRGLDKVSG

SEQ ID NO: 1523085 - protein, 21 aa, Mycobacterium tuberculosis
FGILGPLEISAGFRSLPLGTP

SEQ ID NO: 1523086 - protein, 17 aa, Mycobacterium tuberculosis
FGLILRPGQIGRHCLGK

SEQ ID NO: 1523087 - protein, 17 aa, Mycobacterium tuberculosis
FGLLCRMEGIIPAIESA

SEQ ID NO: 1523088 - protein, 19 aa, Mycobacterium tuberculosis
FGLPLAMTLNAVGSPITTA

SEQ ID NO: 1523089 - protein, 29 aa, Mycobacterium tuberculosis
FGLSYGITIPQFPIRITTTGGIGPIVIPD

SEQ ID NO: 1523090 - protein, 17 aa, Mycobacterium tuberculosis
FGMDEFLARLRAAVRRN

SEQ ID NO: 1523091 - protein, 30 aa, Mycobacterium tuberculosis
FGNAGDVNTGFWNGGPFNTGFGNGGNTNFG

SEQ ID NO: 1523092 - protein, 31 aa, Mycobacterium tuberculosis
FGNAGDVNTGFWNGGPFNTGFGNGGNTNFGF

SEQ ID NO: 1523093 - protein, 28 aa, Mycobacterium tuberculosis
FGNAGNINTGFWNAGNLNTGFGSAGNGN

SEQ ID NO: 1523094 - protein, 26 aa, Mycobacterium tuberculosis
FGNAGTLNVGFANAGSINTGFANSGS

SEQ ID NO: 1523095 - protein, 28 aa, Mycobacterium tuberculosis
FGNIGNANFGFGNSGLGLPPGMGNIGLG

SEQ ID NO: 1523096 - protein, 24 aa, Mycobacterium tuberculosis
FGNSGFINTGFGNALSVNTGFGNS

SEQ ID NO: 1523097 - protein, 22 aa, Mycobacterium tuberculosis
FGPIGELWYRKSGTYRGKVQNL

SEQ ID NO: 1523098 - protein, 17 aa, Mycobacterium tuberculosis
FGPITIPNITVVGPTTT

SEQ ID NO: 1523099 - protein, 19 aa, Mycobacterium tuberculosis
FGPYRLRRLVGRGGMGDVY

SEQ ID NO: 1523100 - protein, 24 aa, Mycobacterium tuberculosis
FGRAWFVDLAPITDPDLVPVTVAG

SEQ ID NO: 1523101 - protein, 20 aa, Mycobacterium tuberculosis
FGRWGEVFGGDDVVAAAMID

SEQ ID NO: 1523102 - protein, 19 aa, Mycobacterium tuberculosis
FGRYGAYLSQLNVLPIYGG

SEQ ID NO: 1523103 - protein, 20 aa, Mycobacterium tuberculosis
FGSIAQLVKVLSGYEAALAA

SEQ ID NO: 1523104 - protein, 27 aa, Mycobacterium tuberculosis
FGSIERFFGILTEHYAGAFPAWLAPVQ

SEQ ID NO: 1523105 - protein, 34 aa, Mycobacterium tuberculosis
FGSQALRPAMFSTFLMWVLADLFTFLPEVGDLDK

SEQ ID NO: 1523106 - protein, 30 aa, Mycobacterium tuberculosis
FGSRVSTLVFSRFTSLIRSAGGYRQSRPAR

SEQ ID NO: 1523107 - protein, 21 aa, Mycobacterium tuberculosis
FGSSRPMPLPPGRGILVTGAG

SEQ ID NO: 1523108 - protein, 18 aa, Mycobacterium tuberculosis
FGTAPMPPGPPPPGTVSP

SEQ ID NO: 1523109 - protein, 17 aa, Mycobacterium tuberculosis
FGVARVCEFYAASEGNS

SEQ ID NO: 1523110 - protein, 19 aa, Mycobacterium tuberculosis
FGWVGDAFPLSSLTQIYAS

SEQ ID NO: 1523111 - protein, 18 aa, Mycobacterium tuberculosis
FGYLYGTPGFQAPEIVRT

SEQ ID NO: 1523112 - protein, 22 aa, Mycobacterium tuberculosis
FGYTLGNSLRRTLLSSIPGAAS

SEQ ID NO: 1523113 - protein, 25 aa, Mycobacterium tuberculosis
FGYTLGNSLRRTLLSSIPGAAVTSI

SEQ ID NO: 1523114 - protein, 17 aa, Mycobacterium tuberculosis
FHAQFVQTLSAGAGAYA

SEQ ID NO: 1523115 - protein, 18 aa, Mycobacterium tuberculosis
FHAQFVQTLSAGAGAYAN

SEQ ID NO: 1523116 - protein, 17 aa, Mycobacterium tuberculosis
FHARFVQALAGAMGAYA

SEQ ID NO: 1523117 - protein, 17 aa, Mycobacterium tuberculosis
FHDRFVRALSAAAGWYV

SEQ ID NO: 1523118 - protein, 18 aa, Mycobacterium tuberculosis
FHEQFVQLMSAGAAQYAS

SEQ ID NO: 1523119 - protein, 18 aa, Mycobacterium tuberculosis
FHERFIQALSTAAGAYGS

SEQ ID NO: 1523120 - protein, 23 aa, Mycobacterium tuberculosis
FHIDRGYPLFVENLVSLGAEIER

SEQ ID NO: 1523121 - protein, 20 aa, Mycobacterium tuberculosis
FHLDRLTAEDLLDTEYARLT

SEQ ID NO: 1523122 - protein, 26 aa, Mycobacterium tuberculosis
FHMNEGHAGFLGIERIRELVTDAGLD

SEQ ID NO: 1523123 - protein, 25 aa, Mycobacterium tuberculosis
FHNGVPLYIELPVTVELEVTHTEPG

SEQ ID NO: 1523124 - protein, 27 aa, Mycobacterium tuberculosis
FHRIEAAYPGRFLLGIGVGHAKMISEY

SEQ ID NO: 1523125 - protein, 17 aa, Mycobacterium tuberculosis
FHSRFVQALTTAAASYA

SEQ ID NO: 1523126 - protein, 23 aa, Mycobacterium tuberculosis
FHTEFMAPALDGFAAAAANIATA

SEQ ID NO: 1523127 - protein, 24 aa, Mycobacterium tuberculosis
FHTEFMAPALDGFAAAAANIATRG

SEQ ID NO: 1523128 - protein, 19 aa, Mycobacterium tuberculosis
FIAARRFAIPAVESKGALL

SEQ ID NO: 1523129 - protein, 19 aa, Mycobacterium tuberculosis
FIDACHARRLGVLIDAVFN

SEQ ID NO: 1523130 - protein, 17 aa, Mycobacterium tuberculosis
FIDHRPCRPGPSRYTQL

SEQ ID NO: 1523131 - protein, 19 aa, Mycobacterium tuberculosis
FIGQPLWGSIGYTLPAAVG

SEQ ID NO: 1523132 - protein, 24 aa, Mycobacterium tuberculosis
FIGRLLELAPFRKIVYSSDGFGPA

SEQ ID NO: 1523133 - protein, 24 aa, Mycobacterium tuberculosis
FIMGDCDQLMPEYLRFVKGVVDAQ

SEQ ID NO: 1523134 - protein, 18 aa, Mycobacterium tuberculosis
FINTGFGNALSVNTGFGN

SEQ ID NO: 1523135 - protein, 25 aa, Mycobacterium tuberculosis
FIRDAKVIAPDKPWFSYVCPGAGHA

SEQ ID NO: 1523136 - protein, 23 aa, Mycobacterium tuberculosis
FIRDYETSWLDQPIPALDGHTPR

SEQ ID NO: 1523137 - protein, 18 aa, Mycobacterium tuberculosis
FKDYVAFPALTSLSPGAT

SEQ ID NO: 1523138 - protein, 25 aa, Mycobacterium tuberculosis
FKRNICHQAIFYRRGLFGTIGPYNL

SEQ ID NO: 1523139 - protein, 19 aa, Mycobacterium tuberculosis
FLAQPPLYKLKWQRSDPEF

SEQ ID NO: 1523140 - protein, 20 aa, Mycobacterium tuberculosis
FLDGLAAYRRSRGLAALSVA

SEQ ID NO: 1523141 - protein, 17 aa, Mycobacterium tuberculosis
FLDQVHFQPLPPAVVKL

SEQ ID NO: 1523142 - protein, 19 aa, Mycobacterium tuberculosis
FLETDLFNQGVRPAINVGV

SEQ ID NO: 1523143 - protein, 17 aa, Mycobacterium tuberculosis
FLFVFRAEHDNPGVAPK

SEQ ID NO: 1523144 - protein, 18 aa, Mycobacterium tuberculosis
FLGVIYGRRMGARKGSLA

SEQ ID NO: 1523145 - protein, 18 aa, Mycobacterium tuberculosis
FLHVDYRRITPIDVPLIV

SEQ ID NO: 1523146 - protein, 23 aa, Mycobacterium tuberculosis
FLNEGLPYRVPYPQTTPVQESGP

SEQ ID NO: 1523147 - protein, 30 aa, Mycobacterium tuberculosis
FLNGHPSVRWVRYPYLPSHPQYDLAKRQMS

SEQ ID NO: 1523148 - protein, 23 aa, Mycobacterium tuberculosis
FLNKPVISWAGDNGIYFTRFRPY

SEQ ID NO: 1523149 - protein, 19 aa, Mycobacterium tuberculosis
FLNNVPRLRKPTVLVIDQI

SEQ ID NO: 1523150 - protein, 20 aa, Mycobacterium tuberculosis
FLPKRPLVEVLRDLASRIYT

SEQ ID NO: 1523151 - protein, 18 aa, Mycobacterium tuberculosis
FLQAAKQLEQRMLRGRRA

SEQ ID NO: 1523152 - protein, 19 aa, Mycobacterium tuberculosis
FLRLAVFDALLVLQADTAP

SEQ ID NO: 1523153 - protein, 26 aa, Mycobacterium tuberculosis
FLRMEADWEASYLLSLRAAWQADNNI

SEQ ID NO: 1523154 - protein, 20 aa, Mycobacterium tuberculosis
FLRWLAGVRFTGDVWAAPEG

SEQ ID NO: 1523155 - protein, 18 aa, Mycobacterium tuberculosis
FLSIERAVYRLTGELAEW

SEQ ID NO: 1523156 - protein, 26 aa, Mycobacterium tuberculosis
FLSLPQPRQMAYRRLDLWLDDYLGTH

SEQ ID NO: 1523157 - protein, 18 aa, Mycobacterium tuberculosis
FLTSQKVRWAARVSLDAA

SEQ ID NO: 1523158 - protein, 18 aa, Mycobacterium tuberculosis
FLVHAWDYAVAVGSELKA

SEQ ID NO: 1523159 - protein, 23 aa, Mycobacterium tuberculosis
FMISHFHYDPVWWNTQGAYTSQW

SEQ ID NO: 1523160 - protein, 17 aa, Mycobacterium tuberculosis
FMRNAAGGTLFNFGFAN

SEQ ID NO: 1523161 - protein, 19 aa, Mycobacterium tuberculosis
FMTMFTSPDPFHANEYAER

SEQ ID NO: 1523162 - protein, 20 aa, Mycobacterium tuberculosis
FMVDFQQHRLIGLHYQWSVS

SEQ ID NO: 1523163 - protein, 17 aa, Mycobacterium tuberculosis
FNARLHWLVVTLAQRVV

SEQ ID NO: 1523164 - protein, 18 aa, Mycobacterium tuberculosis
FNEGTRLRRRRGCSPATR

SEQ ID NO: 1523165 - protein, 18 aa, Mycobacterium tuberculosis
FNIGTFNTGIANPGHYNT

SEQ ID NO: 1523166 - protein, 20 aa, Mycobacterium tuberculosis
FNLVPRWARSPFWPDQSVHR

SEQ ID NO: 1523167 - protein, 18 aa, Mycobacterium tuberculosis
FNNGVLWVGDYQGLFGVS

SEQ ID NO: 1523168 - protein, 21 aa, Mycobacterium tuberculosis
FNRTLLSLMDAWAGPVVMQLM

SEQ ID NO: 1523169 - protein, 29 aa, Mycobacterium tuberculosis
FNSGNYSNGFFWRGDYQGLGGFAYQSAVS

SEQ ID NO: 1523170 - protein, 18 aa, Mycobacterium tuberculosis
FNSGTANFGLFNSGSYNT

SEQ ID NO: 1523171 - protein, 17 aa, Mycobacterium tuberculosis
FNSGTTNTGWFNSGTTN

SEQ ID NO: 1523172 - protein, 19 aa, Mycobacterium tuberculosis
FNTGFYNTGSYNTGGFNVG

SEQ ID NO: 1523173 - protein, 23 aa, Mycobacterium tuberculosis
FPANSLLNLDVFVGTPGATIPAI

SEQ ID NO: 1523174 - protein, 17 aa, Mycobacterium tuberculosis
FPASRWRRYDKLERFPR

SEQ ID NO: 1523175 - protein, 21 aa, Mycobacterium tuberculosis
FPATDVAILFRLGCRSVGESR

SEQ ID NO: 1523176 - protein, 19 aa, Mycobacterium tuberculosis
FPAVLPVGEVLAIVTAVAG

SEQ ID NO: 1523177 - protein, 19 aa, Mycobacterium tuberculosis
FPEIVINPSRYSGQPTFVG

SEQ ID NO: 1523178 - protein, 31 aa, Mycobacterium tuberculosis
FPKASVMTHHRWLRALAVFGGMGLRLKGSDT

SEQ ID NO: 1523179 - protein, 17 aa, Mycobacterium tuberculosis
FPLACPGLLGAMTVGAT

SEQ ID NO: 1523180 - protein, 20 aa, Mycobacterium tuberculosis
FPPPPPLPPLPMSWALPPTA

SEQ ID NO: 1523181 - protein, 26 aa, Mycobacterium tuberculosis
FPQLLSAVPRALQGLALPTASQSASA

SEQ ID NO: 1523182 - protein, 17 aa, Mycobacterium tuberculosis
FPQVTLGIYNSPRQTVI

SEQ ID NO: 1523183 - protein, 17 aa, Mycobacterium tuberculosis
FPTPAACGRTPLVANGL

SEQ ID NO: 1523184 - protein, 19 aa, Mycobacterium tuberculosis
FPVLLGGAALTRSYVENDL

SEQ ID NO: 1523185 - protein, 18 aa, Mycobacterium tuberculosis
FPVWTERGGPATIVPMFL

SEQ ID NO: 1523186 - protein, 17 aa, Mycobacterium tuberculosis
FQAWANGPAIAAHAGHR

SEQ ID NO: 1523187 - protein, 17 aa, Mycobacterium tuberculosis
FQDALVMENYWEAVQEA

SEQ ID NO: 1523188 - protein, 21 aa, Mycobacterium tuberculosis
FQDFRLLQQKTVYDNVAFALE

SEQ ID NO: 1523189 - protein, 19 aa, Mycobacterium tuberculosis
FQGLAFVVSRRRLLGRFVR

SEQ ID NO: 1523190 - protein, 21 aa, Mycobacterium tuberculosis
FQGLQPADQLSRWVDSLLSAT

SEQ ID NO: 1523191 - protein, 27 aa, Mycobacterium tuberculosis
FQHTAAVLFGVWWIGAQAILDDSPADV

SEQ ID NO: 1523192 - protein, 18 aa, Mycobacterium tuberculosis
FQKLFGYSEPHATKLMLQ

SEQ ID NO: 1523193 - protein, 19 aa, Mycobacterium tuberculosis
FQLQHWTHHFDYALVCGGG

SEQ ID NO: 1523194 - protein, 19 aa, Mycobacterium tuberculosis
FQPVPPFPPPPPVPPSPPV

SEQ ID NO: 1523195 - protein, 17 aa, Mycobacterium tuberculosis
FQQLLVGDYNAAVANLG

SEQ ID NO: 1523196 - protein, 20 aa, Mycobacterium tuberculosis
FRACDPGRRRYPAVAGFAEP

SEQ ID NO: 1523197 - protein, 21 aa, Mycobacterium tuberculosis
FRDRVAAISQRWARTAGRCAA

SEQ ID NO: 1523198 - protein, 19 aa, Mycobacterium tuberculosis
FREGLTVLEYFINTHGARK

SEQ ID NO: 1523199 - protein, 28 aa, Mycobacterium tuberculosis
FRESAARALLLPRRHPGRRSPLWQQRQR

SEQ ID NO: 1523200 - protein, 18 aa, Mycobacterium tuberculosis
FREYPYRDAYLLREARLF

SEQ ID NO: 1523201 - protein, 24 aa, Mycobacterium tuberculosis
FRPGLLDLPAPAPVDLRRLLPSGQ

SEQ ID NO: 1523202 - protein, 17 aa, Mycobacterium tuberculosis
FRPKHKLAVLVVCAIPL

SEQ ID NO: 1523203 - protein, 18 aa, Mycobacterium tuberculosis
FRSRALPSTFATWRERRK

SEQ ID NO: 1523204 - protein, 18 aa, Mycobacterium tuberculosis
FRVPCLVISPYSRGPLMV

SEQ ID NO: 1523205 - protein, 26 aa, Mycobacterium tuberculosis
FRWQHRKLHHPFPFPARHQSPPTPPT

SEQ ID NO: 1523206 - protein, 17 aa, Mycobacterium tuberculosis
FSAFRGWVTTQSTSWGA

SEQ ID NO: 1523207 - protein, 17 aa, Mycobacterium tuberculosis
FSAHGRPIRRSAQAAAF

SEQ ID NO: 1523208 - protein, 26 aa, Mycobacterium tuberculosis
FSATRYEWAILDFAILAVGAVTVPTY

SEQ ID NO: 1523209 - protein, 32 aa, Mycobacterium tuberculosis
FSAVTALRAGPAVAAVAALGARRGGVGAVGAV

SEQ ID NO: 1523210 - protein, 26 aa, Mycobacterium tuberculosis
FSDDLTLLPVASIPVPGPVGVLDALA

SEQ ID NO: 1523211 - protein, 27 aa, Mycobacterium tuberculosis
FSGFDPWLPSLGNPLTFLSPANIAFAL

SEQ ID NO: 1523212 - protein, 25 aa, Mycobacterium tuberculosis
FSGLYTPAQFQPWTGIPSLTYDQSV

SEQ ID NO: 1523213 - protein, 22 aa, Mycobacterium tuberculosis
FSIRVFPGDHFYLNDNLPQLVS

SEQ ID NO: 1523214 - protein, 17 aa, Mycobacterium tuberculosis
FSKDPVFRERMKREARI

SEQ ID NO: 1523215 - protein, 25 aa, Mycobacterium tuberculosis
FSLDRAALPLRRGPTSWPACRVRHD

SEQ ID NO: 1523216 - protein, 19 aa, Mycobacterium tuberculosis
FSLFDVYTDIAFPGGIHAA

SEQ ID NO: 1523217 - protein, 18 aa, Mycobacterium tuberculosis
FSLTLLGFINVNVPAIQT

SEQ ID NO: 1523218 - protein, 18 aa, Mycobacterium tuberculosis
FSLTVPRHDGGERRLYLI

SEQ ID NO: 1523219 - protein, 20 aa, Mycobacterium tuberculosis
FSMCINCMLCYLACPVYALD

SEQ ID NO: 1523220 - protein, 21 aa, Mycobacterium tuberculosis
FSPPPPRYTTGVLSKYVKLVS

SEQ ID NO: 1523221 - protein, 23 aa, Mycobacterium tuberculosis
FSRAPLMAMAPSSLALKSFREPI

SEQ ID NO: 1523222 - protein, 19 aa, Mycobacterium tuberculosis
FSRCFGCGRIYWPGSHHAR

SEQ ID NO: 1523223 - protein, 23 aa, Mycobacterium tuberculosis
FSRFTSLIRSCRRYRQSRPARCC

SEQ ID NO: 1523224 - protein, 31 aa, Mycobacterium tuberculosis
FSRISDVLLPFLVTRQLICGAGKVLQTPKGR

SEQ ID NO: 1523225 - protein, 21 aa, Mycobacterium tuberculosis
FSRYVDAIVWRTFGQERLDAM

SEQ ID NO: 1523226 - protein, 17 aa, Mycobacterium tuberculosis
FTFGGIMEEAPVLRRAE

SEQ ID NO: 1523227 - protein, 27 aa, Mycobacterium tuberculosis
FTGEDRLLRLRWPCPVPGAMPISEVGD

SEQ ID NO: 1523228 - protein, 17 aa, Mycobacterium tuberculosis
FTGYADRGEAFATAVRA

SEQ ID NO: 1523229 - protein, 35 aa, Mycobacterium tuberculosis
FTIDEFEIPIKLRVSVCVIYIPFKGCVKHVSVTIP

SEQ ID NO: 1523230 - protein, 19 aa, Mycobacterium tuberculosis
FTIPLDPIDIGLPVSLTIP

SEQ ID NO: 1523231 - protein, 18 aa, Mycobacterium tuberculosis
FTKLRIPGARVIPTIYFL

SEQ ID NO: 1523232 - protein, 30 aa, Mycobacterium tuberculosis
FTKLRIPGARVIPTIYFLRHSTDPVHTATL

SEQ ID NO: 1523233 - protein, 18 aa, Mycobacterium tuberculosis
FTLSFPYEPWTREEGIAD

SEQ ID NO: 1523234 - protein, 26 aa, Mycobacterium tuberculosis
FTSAPMCDIFLVLAQAPDGLSCFLLP

SEQ ID NO: 1523235 - protein, 21 aa, Mycobacterium tuberculosis
FTTMPPQVLRLQGHEIHLAID

SEQ ID NO: 1523236 - protein, 17 aa, Mycobacterium tuberculosis
FVALLAKYYGGGEDRRT

SEQ ID NO: 1523237 - protein, 17 aa, Mycobacterium tuberculosis
FVALSWTKHPPPQTYDE

SEQ ID NO: 1523238 - protein, 17 aa, Mycobacterium tuberculosis
FVDVAMCGLFHGPRLRD

SEQ ID NO: 1523239 - protein, 25 aa, Mycobacterium tuberculosis
FVEGDTVIAAVDPGWRRGATQGHSG

SEQ ID NO: 1523240 - protein, 17 aa, Mycobacterium tuberculosis
FVFLDHDKKAYLPDLQS

SEQ ID NO: 1523241 - protein, 17 aa, Mycobacterium tuberculosis
FVFPNFANPIQLICSAI

SEQ ID NO: 1523242 - protein, 25 aa, Mycobacterium tuberculosis
FVGEFRDFRRATIGSFNALREDFTA

SEQ ID NO: 1523243 - protein, 26 aa, Mycobacterium tuberculosis
FVGEFRDFRRATIGSFNALREDFTAL

SEQ ID NO: 1523244 - protein, 17 aa, Mycobacterium tuberculosis
FVGQRRPTADRGAPGAR

SEQ ID NO: 1523245 - protein, 22 aa, Mycobacterium tuberculosis
FVGRERIFASLLTPASYGADDC

SEQ ID NO: 1523246 - protein, 28 aa, Mycobacterium tuberculosis
FVGVTAYDYMLTLAGRLRPVDLDAYIPT

SEQ ID NO: 1523247 - protein, 30 aa, Mycobacterium tuberculosis
FVGVTAYDYMLTLAGRLRPVDLDAYIPTGN

SEQ ID NO: 1523248 - protein, 23 aa, Mycobacterium tuberculosis
FVHAHPRWIAQAFADALGAAVGE

SEQ ID NO: 1523249 - protein, 17 aa, Mycobacterium tuberculosis
FVHIATATSTGGSGDFG

SEQ ID NO: 1523250 - protein, 18 aa, Mycobacterium tuberculosis
FVHIATATSTGGSGGFGG

SEQ ID NO: 1523251 - protein, 19 aa, Mycobacterium tuberculosis
FVHVGSWSFVWRDVLLRLA

SEQ ID NO: 1523252 - protein, 22 aa, Mycobacterium tuberculosis
FVIEPLPNLVFTRDSSIWIGPR

SEQ ID NO: 1523253 - protein, 19 aa, Mycobacterium tuberculosis
FVLAEKLGLSAQSLFDVHH

SEQ ID NO: 1523254 - protein, 29 aa, Mycobacterium tuberculosis
FVNAGMVQFVPFFLGQRTPPYPTATSIQK

SEQ ID NO: 1523255 - protein, 30 aa, Mycobacterium tuberculosis
FVNAGMVQFVPFFLGQRTPPYPTATSIQKC

SEQ ID NO: 1523256 - protein, 19 aa, Mycobacterium tuberculosis
FVNQGGWMLSRASAMELLQ

SEQ ID NO: 1523257 - protein, 17 aa, Mycobacterium tuberculosis
FVPMPPSAEAALAGATV

SEQ ID NO: 1523258 - protein, 17 aa, Mycobacterium tuberculosis
FVPSKGFGLLPPIVTPP

SEQ ID NO: 1523259 - protein, 18 aa, Mycobacterium tuberculosis
FVQALTTGGAPMRPPRPP

SEQ ID NO: 1523260 - protein, 17 aa, Mycobacterium tuberculosis
FVQLVLSNLFGQNAPAI

SEQ ID NO: 1523261 - protein, 25 aa, Mycobacterium tuberculosis
FVRSEGCAMVLLKRLPDALRDGNRI

SEQ ID NO: 1523262 - protein, 25 aa, Mycobacterium tuberculosis
FVSAIDVLLGLGWLAPSHVDQWRQG

SEQ ID NO: 1523263 - protein, 29 aa, Mycobacterium tuberculosis
FVSAPPPPPPPPPPPPPTPMPIAAGEPPS

SEQ ID NO: 1523264 - protein, 18 aa, Mycobacterium tuberculosis
FVTDLARAIPVPTQFEFM

SEQ ID NO: 1523265 - protein, 17 aa, Mycobacterium tuberculosis
FVYIGGMQRLLAAGQVP

SEQ ID NO: 1523266 - protein, 25 aa, Mycobacterium tuberculosis
FWRTGRLELPTRTGLTWLADFRADP

SEQ ID NO: 1523267 - protein, 18 aa, Mycobacterium tuberculosis
FWTGWRDVQLPDGTIIWT

SEQ ID NO: 1523268 - protein, 18 aa, Mycobacterium tuberculosis
FWVAVIELIPRPFTRTVI

SEQ ID NO: 1523269 - protein, 20 aa, Mycobacterium tuberculosis
FYLHAKSREQVPENLWPVLK

SEQ ID NO: 1523270 - protein, 30 aa, Mycobacterium tuberculosis
FYNNVIQPFINWLTNLPFLQAMFSGFDPWL

SEQ ID NO: 1523271 - protein, 26 aa, Mycobacterium tuberculosis
FYREGRVPLHSLAGRYRLRPIRGQDH

SEQ ID NO: 1523272 - protein, 19 aa, Mycobacterium tuberculosis
FYRRGLFGTIGPYNLRYRV

SEQ ID NO: 1523273 - protein, 27 aa, Mycobacterium tuberculosis
FYSSYMHLHTRLTRRFNAVIVPGVTSV

SEQ ID NO: 1523274 - protein, 19 aa, Mycobacterium tuberculosis
GAAAGLLLSSGYTATWAPW

SEQ ID NO: 1523275 - protein, 41 aa, Mycobacterium tuberculosis
GAAAMRVLTGPRWRLGARDLAALWRRALTLSGESPSTASPE

SEQ ID NO: 1523276 - protein, 20 aa, Mycobacterium tuberculosis
GAAAPYVGWLSAAAGQAELS

SEQ ID NO: 1523277 - protein, 19 aa, Mycobacterium tuberculosis
GAADSWDPFPEFLGGLRFA

SEQ ID NO: 1523278 - protein, 34 aa, Mycobacterium tuberculosis
GAADWSKRPLPSAWLNYAALDVELLIELRAAISR

SEQ ID NO: 1523279 - protein, 26 aa, Mycobacterium tuberculosis
GAAGARGALTSGGLAGGVGAGGTGGT

SEQ ID NO: 1523280 - protein, 20 aa, Mycobacterium tuberculosis
GAAGLLGVGGHGGAGGHGAE

SEQ ID NO: 1523281 - protein, 22 aa, Mycobacterium tuberculosis
GAAGRHWLDQRPVVPDGVGKSD

SEQ ID NO: 1523282 - protein, 18 aa, Mycobacterium tuberculosis
GAAIPAVLSAQPVYFDYW

SEQ ID NO: 1523283 - protein, 22 aa, Mycobacterium tuberculosis
GAAKIAEMLRWCHEAGIELATV

SEQ ID NO: 1523284 - protein, 17 aa, Mycobacterium tuberculosis
GAAMPHLSGPLAGVGVG

SEQ ID NO: 1523285 - protein, 24 aa, Mycobacterium tuberculosis
GAAQGLAELTLNLGVGNIGSLNLG

SEQ ID NO: 1523286 - protein, 26 aa, Mycobacterium tuberculosis
GAAVGLFGPWRGRRGRRARQGRLRGR

SEQ ID NO: 1523287 - protein, 19 aa, Mycobacterium tuberculosis
GAAVWGLVRSAQAEHPGRV

SEQ ID NO: 1523288 - protein, 24 aa, Mycobacterium tuberculosis
GADAKLIIASAYLPQHEDARAADI

SEQ ID NO: 1523289 - protein, 24 aa, Mycobacterium tuberculosis
GADGGAGGWLFGNGGNGGHGATGA

SEQ ID NO: 1523290 - protein, 22 aa, Mycobacterium tuberculosis
GADPLPFLRRFDIPPGIEHQED

SEQ ID NO: 1523291 - protein, 24 aa, Mycobacterium tuberculosis
GADPLWFTSLFSQHTLDLLELGLG

SEQ ID NO: 1523292 - protein, 22 aa, Mycobacterium tuberculosis
GADRLTCGFGGPLAASAAPSIP

SEQ ID NO: 1523293 - protein, 44 aa, Mycobacterium tuberculosis
GADTVAWLREQPWFTGRFGTIGLPYLGFTQWALLHDPPPELAAA

SEQ ID NO: 1523294 - protein, 47 aa, Mycobacterium tuberculosis
GADTVAWLREQPWFTGRFGTIGLPYLGFTQWALLHDPPPELAAAVIT

SEQ ID NO: 1523295 - protein, 24 aa, Mycobacterium tuberculosis
GADVPLLGQIPLDPALVAAGDSGV

SEQ ID NO: 1523296 - protein, 18 aa, Mycobacterium tuberculosis
GADWPRLVAPVFDPKKAV

SEQ ID NO: 1523297 - protein, 27 aa, Mycobacterium tuberculosis
GAEHLVRGRFVLVGVTPAVLASLLGEP

SEQ ID NO: 1523298 - protein, 31 aa, Mycobacterium tuberculosis
GAEPAGEPGLFTQPRHRIGAVGGLVDHGLEH

SEQ ID NO: 1523299 - protein, 32 aa, Mycobacterium tuberculosis
GAESPRETWLRLLLIRAGFPRPQTQIPVYDEY

SEQ ID NO: 1523300 - protein, 25 aa, Mycobacterium tuberculosis
GAFDIAQFGWVGDAFPLSSLTQIYA

SEQ ID NO: 1523301 - protein, 35 aa, Mycobacterium tuberculosis
GAGAGPISIPIIDLRPAPGFFNATTGPSSGFLNWG

SEQ ID NO: 1523302 - protein, 20 aa, Mycobacterium tuberculosis
GAGAYAFAEAANASPLQSAM

SEQ ID NO: 1523303 - protein, 17 aa, Mycobacterium tuberculosis
GAGDWAAAGPGGSCTQW

SEQ ID NO: 1523304 - protein, 28 aa, Mycobacterium tuberculosis
GAGENGLNSGAMLPGGGTVGNPGTGGNG

SEQ ID NO: 1523305 - protein, 20 aa, Mycobacterium tuberculosis
GAGFLGQGGLALAASSGGFG

SEQ ID NO: 1523306 - protein, 21 aa, Mycobacterium tuberculosis
GAGGAAGLWGSGGSGGTGGQG

SEQ ID NO: 1523307 - protein, 24 aa, Mycobacterium tuberculosis
GAGGAGGAFLGDGGNGGAGGQGGA

SEQ ID NO: 1523308 - protein, 23 aa, Mycobacterium tuberculosis
GAGGAGGAGGRGGWLVGNGGNGG

SEQ ID NO: 1523309 - protein, 25 aa, Mycobacterium tuberculosis
GAGGAGGLFGIGGAGGGCGSAVAIG

SEQ ID NO: 1523310 - protein, 23 aa, Mycobacterium tuberculosis
GAGGAGGLFTTGGVGGAGGAGGD

SEQ ID NO: 1523311 - protein, 18 aa, Mycobacterium tuberculosis
GAGGAGGLVLGRDGQHGL

SEQ ID NO: 1523312 - protein, 27 aa, Mycobacterium tuberculosis
GAGGAGGSGFFGGKGGFGGDGGQGGPN

SEQ ID NO: 1523313 - protein, 24 aa, Mycobacterium tuberculosis
GAGGAGGWLFGNGGAGGVGGAGGA

SEQ ID NO: 1523314 - protein, 22 aa, Mycobacterium tuberculosis
GAGGAGGWLWGNGGAGGNGGVG

SEQ ID NO: 1523315 - protein, 23 aa, Mycobacterium tuberculosis
GAGGAGGWLYGDGGAGGAGGGGG

SEQ ID NO: 1523316 - protein, 18 aa, Mycobacterium tuberculosis
GAGGAGPPEPSSRQASWI

SEQ ID NO: 1523317 - protein, 27 aa, Mycobacterium tuberculosis
GAGGAGVAGGWLYGDGGAGGAGGGGGR

SEQ ID NO: 1523318 - protein, 34 aa, Mycobacterium tuberculosis
GAGGAPGLGGAGGAGGWLIGQSGSTGGGGAGGAG

SEQ ID NO: 1523319 - protein, 52 aa, Mycobacterium tuberculosis
GAGGDAPLIGWAATAGPAVSLLLKTVAGGGQLVLVYAFDAHLLGGAGGVGGS

SEQ ID NO: 1523320 - protein, 25 aa, Mycobacterium tuberculosis
GAGGDGGLFFGVGGAGGAGGTGTNV

SEQ ID NO: 1523321 - protein, 25 aa, Mycobacterium tuberculosis
GAGGGAGMFSQPGVHGAGGTGGQGG

SEQ ID NO: 1523322 - protein, 23 aa, Mycobacterium tuberculosis
GAGGGGGLLYGNGGAGGAGNSGG

SEQ ID NO: 1523323 - protein, 17 aa, Mycobacterium tuberculosis
GAGGIFFGTGGTGGAGG

SEQ ID NO: 1523324 - protein, 20 aa, Mycobacterium tuberculosis
GAGGILFGAGGAGGAGGAVT

SEQ ID NO: 1523325 - protein, 17 aa, Mycobacterium tuberculosis
GAGGILYGNGGNGGSGA

SEQ ID NO: 1523326 - protein, 17 aa, Mycobacterium tuberculosis
GAGGIPGLIGNGGNGGD

SEQ ID NO: 1523327 - protein, 26 aa, Mycobacterium tuberculosis
GAGGISGLLLGADGFNAPASASPLHT

SEQ ID NO: 1523328 - protein, 19 aa, Mycobacterium tuberculosis
GAGGLFASGGVGGTGGGAG

SEQ ID NO: 1523329 - protein, 20 aa, Mycobacterium tuberculosis
GAGGLFGQSGSPGSGAAGGL

SEQ ID NO: 1523330 - protein, 18 aa, Mycobacterium tuberculosis
GAGGLFNGGGAGGAGGAG

SEQ ID NO: 1523331 - protein, 25 aa, Mycobacterium tuberculosis
GAGGLGGTLYGAGGHGGAGGPGPIG

SEQ ID NO: 1523332 - protein, 19 aa, Mycobacterium tuberculosis
GAGGLLFGTAGAGGNGGLS

SEQ ID NO: 1523333 - protein, 26 aa, Mycobacterium tuberculosis
GAGGNAGILFGAGGIGGTGGTGLGAP

SEQ ID NO: 1523334 - protein, 26 aa, Mycobacterium tuberculosis
GAGGNAGLLGVGGAGGHGASGGAGDR

SEQ ID NO: 1523335 - protein, 24 aa, Mycobacterium tuberculosis
GAGGNAGLLIGAAGLGGCGGGAFT

SEQ ID NO: 1523336 - protein, 25 aa, Mycobacterium tuberculosis
GAGGNAGTFYGFGGAGGAGGESDNG

SEQ ID NO: 1523337 - protein, 22 aa, Mycobacterium tuberculosis
GAGGNAWLFGNGGAGGLGAAGA

SEQ ID NO: 1523338 - protein, 23 aa, Mycobacterium tuberculosis
GAGGNGAWLFGNGGAGGGGGKGG

SEQ ID NO: 1523339 - protein, 24 aa, Mycobacterium tuberculosis
GAGGNGAWLFGNGGAGGGGGKGGN

SEQ ID NO: 1523340 - protein, 23 aa, Mycobacterium tuberculosis
GAGGNGGLLFGAGGVGGVGGDGV

SEQ ID NO: 1523341 - protein, 23 aa, Mycobacterium tuberculosis
GAGGNGGWLFGNGGAGGSGGDGG

SEQ ID NO: 1523342 - protein, 22 aa, Mycobacterium tuberculosis
GAGGRAFLFGDGGAGGAALSAG

SEQ ID NO: 1523343 - protein, 24 aa, Mycobacterium tuberculosis
GAGGRGGKGIDGGFGGDGGNGGSN

SEQ ID NO: 1523344 - protein, 26 aa, Mycobacterium tuberculosis
GAGGSAGLIGIGGTGGAGGAGAVGGV

SEQ ID NO: 1523345 - protein, 27 aa, Mycobacterium tuberculosis
GAGGSARGLIFALGGAGAAGGDASTGV

SEQ ID NO: 1523346 - protein, 26 aa, Mycobacterium tuberculosis
GAGGSARLIGAGGHGGDGGAGGNTAG

SEQ ID NO: 1523347 - protein, 23 aa, Mycobacterium tuberculosis
GAGGSGGFLSGAAGVSGADGIGG

SEQ ID NO: 1523348 - protein, 25 aa, Mycobacterium tuberculosis
GAGGSGGLLFGSGGAGGIGGAGGVG

SEQ ID NO: 1523349 - protein, 22 aa, Mycobacterium tuberculosis
GAGGSGGLLWGNGGAGGAGGNG

SEQ ID NO: 1523350 - protein, 24 aa, Mycobacterium tuberculosis
GAGGSGGWLYGNGGNGGIGGNAIV

SEQ ID NO: 1523351 - protein, 26 aa, Mycobacterium tuberculosis
GAGGTGGLLFGAGGNGGPGGSGGAAD

SEQ ID NO: 1523352 - protein, 28 aa, Mycobacterium tuberculosis
GAGGTGGNAAWLLGGGGTGGAGGIGGGN

SEQ ID NO: 1523353 - protein, 29 aa, Mycobacterium tuberculosis
GAGGTGGNAAWLLGGGGTGGAGGIGGGNG

SEQ ID NO: 1523354 - protein, 19 aa, Mycobacterium tuberculosis
GAGGWLFGNGGNGGHGATN

SEQ ID NO: 1523355 - protein, 19 aa, Mycobacterium tuberculosis
GAGGWLWGNGGAGGNGGVG

SEQ ID NO: 1523356 - protein, 24 aa, Mycobacterium tuberculosis
GAGLAPWPGPSFTAARASPPGSAP

SEQ ID NO: 1523357 - protein, 19 aa, Mycobacterium tuberculosis
GAGLGPMLAAASAWDGLAE

SEQ ID NO: 1523358 - protein, 21 aa, Mycobacterium tuberculosis
GAGLMGRRIAGVLASAGLDVA

SEQ ID NO: 1523359 - protein, 20 aa, Mycobacterium tuberculosis
GAGLNLALAADVRIAGPAAL

SEQ ID NO: 1523360 - protein, 21 aa, Mycobacterium tuberculosis
GAGMINGGLGGFGGAGGGGAV

SEQ ID NO: 1523361 - protein, 21 aa, Mycobacterium tuberculosis
GAGPPRPALAAALAGSCSANP

SEQ ID NO: 1523362 - protein, 22 aa, Mycobacterium tuberculosis
GAGQLLSHSGVAGASGKGGAGG

SEQ ID NO: 1523363 - protein, 23 aa, Mycobacterium tuberculosis
GAGQLLSHSGVAGASGKGGAGGT

SEQ ID NO: 1523364 - protein, 29 aa, Mycobacterium tuberculosis
GAGRSYRLYKPVGLPSSAPLVVMLHGGFG

SEQ ID NO: 1523365 - protein, 24 aa, Mycobacterium tuberculosis
GAGSMLPLGGRRWLPRTRRRHRAR

SEQ ID NO: 1523366 - protein, 22 aa, Mycobacterium tuberculosis
GAGSNALGLFLGLGGSGGQGGV

SEQ ID NO: 1523367 - protein, 22 aa, Mycobacterium tuberculosis
GAGSPGGLLYGTGGAGGNGGPG

SEQ ID NO: 1523368 - protein, 24 aa, Mycobacterium tuberculosis
GAGTGVRFTPTLTFTLDTISDSVH

SEQ ID NO: 1523369 - protein, 24 aa, Mycobacterium tuberculosis
GAGTPVPASLIPVAAVVGTVRTGV

SEQ ID NO: 1523370 - protein, 24 aa, Mycobacterium tuberculosis
GAHAGRRLTRRFGLGGAGTGEKPD

SEQ ID NO: 1523371 - protein, 17 aa, Mycobacterium tuberculosis
GAIATFAAVAAADRPVV

SEQ ID NO: 1523372 - protein, 25 aa, Mycobacterium tuberculosis
GAIELAWALLTNSLAAGGYGLDPER

SEQ ID NO: 1523373 - protein, 27 aa, Mycobacterium tuberculosis
GAIELGIKWLSLYAFSTENWKRSPEEV

SEQ ID NO: 1523374 - protein, 25 aa, Mycobacterium tuberculosis
GAINAPTMALLGRPLIGHGADGAPG

SEQ ID NO: 1523375 - protein, 30 aa, Mycobacterium tuberculosis
GAINAPTMALLGRPLIGHGALRGVGDRAGR

SEQ ID NO: 1523376 - protein, 21 aa, Mycobacterium tuberculosis
GAIPDRGLFAVYLATERPSRV

SEQ ID NO: 1523377 - protein, 33 aa, Mycobacterium tuberculosis
GAITRAWPASPSGTPFRCSPRWAPTSPATSAPP

SEQ ID NO: 1523378 - protein, 20 aa, Mycobacterium tuberculosis
GAKEILCIRVLGGSSRRYAG

SEQ ID NO: 1523379 - protein, 17 aa, Mycobacterium tuberculosis
GAKGLDGATGGKGNNGN

SEQ ID NO: 1523380 - protein, 26 aa, Mycobacterium tuberculosis
GALAERALVPVLPSVEEFPYAIRQVS

SEQ ID NO: 1523381 - protein, 30 aa, Mycobacterium tuberculosis
GALAGIHPVDLGALAWRGLLDRTDIDPAAV

SEQ ID NO: 1523382 - protein, 31 aa, Mycobacterium tuberculosis
GALAGKSGFGGFGGLLLGADGYNAPESTSPW

SEQ ID NO: 1523383 - protein, 20 aa, Mycobacterium tuberculosis
GALAWAIYALLTVPGTWESA

SEQ ID NO: 1523384 - protein, 27 aa, Mycobacterium tuberculosis
GALGARRRVPSLRRAFAAPAADPRGRS

SEQ ID NO: 1523385 - protein, 23 aa, Mycobacterium tuberculosis
GALHSWCLAAERPELVSALVVED

SEQ ID NO: 1523386 - protein, 19 aa, Mycobacterium tuberculosis
GALIRIGHDASPLDLLPGG

SEQ ID NO: 1523387 - protein, 18 aa, Mycobacterium tuberculosis
GALMSGFVERIGDAVALV

SEQ ID NO: 1523388 - protein, 19 aa, Mycobacterium tuberculosis
GALRGLRLSYFGDGANNMA

SEQ ID NO: 1523389 - protein, 23 aa, Mycobacterium tuberculosis
GALRVVILHRPGAELRRLTPRNT

SEQ ID NO: 1523390 - protein, 17 aa, Mycobacterium tuberculosis
GALTTPLPAPPAREVYL

SEQ ID NO: 1523391 - protein, 25 aa, Mycobacterium tuberculosis
GAMHRSRLEHLVAPKFFKDTAFTYD

SEQ ID NO: 1523392 - protein, 20 aa, Mycobacterium tuberculosis
GAMRELLLAHRDPGIPVVIG

SEQ ID NO: 1523393 - protein, 17 aa, Mycobacterium tuberculosis
GANGIDSIGGTGGAGGG

SEQ ID NO: 1523394 - protein, 17 aa, Mycobacterium tuberculosis
GANRWTRCRRGFAAGGG

SEQ ID NO: 1523395 - protein, 22 aa, Mycobacterium tuberculosis
GANSGSLFASPGGTGGAGGHGG

SEQ ID NO: 1523396 - protein, 31 aa, Mycobacterium tuberculosis
GAPAFYQAEIFEIVWSLWNLSRTDIDLSDPE

SEQ ID NO: 1523397 - protein, 37 aa, Mycobacterium tuberculosis
GAPFSFVLAPWQIHDWILLTPWGLLSWLQINQQLGIA

SEQ ID NO: 1523398 - protein, 30 aa, Mycobacterium tuberculosis
GAPGALGGKGGSGGLIGRAGSDGGVGAGGA

SEQ ID NO: 1523399 - protein, 31 aa, Mycobacterium tuberculosis
GAPGALGGKGGSGGLIGRAGSDGGVGAGGAG

SEQ ID NO: 1523400 - protein, 30 aa, Mycobacterium tuberculosis
GAPGLGGAGGAGGWLIGQSGSTGGGGAGGA

SEQ ID NO: 1523401 - protein, 24 aa, Mycobacterium tuberculosis
GAPHALVVADLPFGQLRGGAHRRV

SEQ ID NO: 1523402 - protein, 21 aa, Mycobacterium tuberculosis
GAPSPLLRGGLAFIDTPGVGG

SEQ ID NO: 1523403 - protein, 17 aa, Mycobacterium tuberculosis
GAPVLVQVPRRGYIPSL

SEQ ID NO: 1523404 - protein, 18 aa, Mycobacterium tuberculosis
GAPVPIPGFPTTVTVFGT

SEQ ID NO: 1523405 - protein, 20 aa, Mycobacterium tuberculosis
GAQAGMGFGGGVGLGLGGQA

SEQ ID NO: 1523406 - protein, 33 aa, Mycobacterium tuberculosis
GAQDAMQYGVLAGYPLVNLKVTLLDGAYHEVDS

SEQ ID NO: 1523407 - protein, 23 aa, Mycobacterium tuberculosis
GAQINVPLFINTGDKLKVDSRDG

SEQ ID NO: 1523408 - protein, 17 aa, Mycobacterium tuberculosis
GAQLQQLGMERTRSDYM

SEQ ID NO: 1523409 - protein, 20 aa, Mycobacterium tuberculosis
GAQRARRVGASPGAGAAGGG

SEQ ID NO: 1523410 - protein, 26 aa, Mycobacterium tuberculosis
GAQVVPIRVYRWKPAPLGGVFDHLVT

SEQ ID NO: 1523411 - protein, 27 aa, Mycobacterium tuberculosis
GAQVVPIRVYRWKPAPLGGVFDHLVTA

SEQ ID NO: 1523412 - protein, 18 aa, Mycobacterium tuberculosis
GAQWLGMGAQLCATAPVF

SEQ ID NO: 1523413 - protein, 47 aa, Mycobacterium tuberculosis
GARDFLVPARLHPGSFYALPQSPQLFKQLLMVAGMERYYQIARCYRD

SEQ ID NO: 1523414 - protein, 24 aa, Mycobacterium tuberculosis
GAREHALLLALGKDLQVSGLIVAP

SEQ ID NO: 1523415 - protein, 21 aa, Mycobacterium tuberculosis
GARFLLGLVVSTGVGGGLVLD

SEQ ID NO: 1523416 - protein, 30 aa, Mycobacterium tuberculosis
GARGAGGAGGAGGWLSGHSGAHGAMGSGGE

SEQ ID NO: 1523417 - protein, 18 aa, Mycobacterium tuberculosis
GARIVVVTHLATDAALSE

SEQ ID NO: 1523418 - protein, 24 aa, Mycobacterium tuberculosis
GARKDTVIVLPKQKMRAVLVADNP

SEQ ID NO: 1523419 - protein, 26 aa, Mycobacterium tuberculosis
GARKSPRLWIVTRGAAQFDAGESVTL

SEQ ID NO: 1523420 - protein, 17 aa, Mycobacterium tuberculosis
GARLRWAPAQGPSATPA

SEQ ID NO: 1523421 - protein, 23 aa, Mycobacterium tuberculosis
GARNAGLLAVRMLGAVNPQLRAR

SEQ ID NO: 1523422 - protein, 23 aa, Mycobacterium tuberculosis
GARPAASPLAAPVDPSTPAPSTT

SEQ ID NO: 1523423 - protein, 30 aa, Mycobacterium tuberculosis
GARPLIYSQQRLHPLPPQTVVGIPSSAGSM

SEQ ID NO: 1523424 - protein, 19 aa, Mycobacterium tuberculosis
GARPLVAWLDALATGIDLL

SEQ ID NO: 1523425 - protein, 20 aa, Mycobacterium tuberculosis
GARPLVAWLDALATGIDLLT

SEQ ID NO: 1523426 - protein, 17 aa, Mycobacterium tuberculosis
GARPPRPGAPRPGGRPG

SEQ ID NO: 1523427 - protein, 25 aa, Mycobacterium tuberculosis
GARQRLMCRLPKRPDPHAWLGDAFH

SEQ ID NO: 1523428 - protein, 20 aa, Mycobacterium tuberculosis
GARSLLLSMVASVTAAGGNA

SEQ ID NO: 1523429 - protein, 26 aa, Mycobacterium tuberculosis
GARVKEPHITGPRIKQPHIPATGIET

SEQ ID NO: 1523430 - protein, 27 aa, Mycobacterium tuberculosis
GARVKEPHITGPRIKQPHIPATGIETT

SEQ ID NO: 1523431 - protein, 33 aa, Mycobacterium tuberculosis
GASALTIGNWQQPPGPGRRWAAQAAPGGTGGYI

SEQ ID NO: 1523432 - protein, 24 aa, Mycobacterium tuberculosis
GASIYNVSVLLDPNKGLANLLANL

SEQ ID NO: 1523433 - protein, 24 aa, Mycobacterium tuberculosis
GASNVMIGSWFAGTYESPGDLMRD

SEQ ID NO: 1523434 - protein, 32 aa, Mycobacterium tuberculosis
GASQAAAQLPLPAGLQQFLNTLPNLGIGNQGN

SEQ ID NO: 1523435 - protein, 23 aa, Mycobacterium tuberculosis
GASWPPRLIFGGRRVHRHGTDQR

SEQ ID NO: 1523436 - protein, 19 aa, Mycobacterium tuberculosis
GASYAARDALAAASYLSGG

SEQ ID NO: 1523437 - protein, 23 aa, Mycobacterium tuberculosis
GATVACCTATAATAARVAPQASP

SEQ ID NO: 1523438 - protein, 18 aa, Mycobacterium tuberculosis
GATYRLVKRSGFVASSTY

SEQ ID NO: 1523439 - protein, 19 aa, Mycobacterium tuberculosis
GAVDAYWNWQQRRAGKRDG

SEQ ID NO: 1523440 - protein, 30 aa, Mycobacterium tuberculosis
GAVESILTVLALRDQVIPPTLNLVNLDPEI

SEQ ID NO: 1523441 - protein, 30 aa, Mycobacterium tuberculosis
GAVLVFPHAGGAAAAYRWLAKSLVANDVDT

SEQ ID NO: 1523442 - protein, 27 aa, Mycobacterium tuberculosis
GAVNAPTQTLLGRPLIGDGAHGTAPGQ

SEQ ID NO: 1523443 - protein, 28 aa, Mycobacterium tuberculosis
GAVPKVRVFMVRLPDATSRQARAHSWGA

SEQ ID NO: 1523444 - protein, 18 aa, Mycobacterium tuberculosis
GAVPLRPVGPAATPCCSA

SEQ ID NO: 1523445 - protein, 23 aa, Mycobacterium tuberculosis
GAVVSGVCHAGVVATGVVGAGVV

SEQ ID NO: 1523446 - protein, 20 aa, Mycobacterium tuberculosis
GAWDGLAEELHAAASSFGSV

SEQ ID NO: 1523447 - protein, 28 aa, Mycobacterium tuberculosis
GAYLVTGGLGGFGLFLAGELAAAGCGRI

SEQ ID NO: 1523448 - protein, 23 aa, Mycobacterium tuberculosis
GAYLVTGGLGGLGLFLAGELAAA

SEQ ID NO: 1523449 - protein, 24 aa, Mycobacterium tuberculosis
GAYLVTGGLGGLGLFLAGELAAAG

SEQ ID NO: 1523450 - protein, 25 aa, Mycobacterium tuberculosis
GAYLVTGGLGGLGLFLAGELAAAGC

SEQ ID NO: 1523451 - protein, 18 aa, Mycobacterium tuberculosis
GAYRLIDFVLSNLVNARY

SEQ ID NO: 1523452 - protein, 18 aa, Mycobacterium tuberculosis
GCAESVPMLRCVPLAIAT

SEQ ID NO: 1523453 - protein, 17 aa, Mycobacterium tuberculosis
GCEGDALLMLLDANGIE

SEQ ID NO: 1523454 - protein, 17 aa, Mycobacterium tuberculosis
GCFLATAVLAPAASSAG

SEQ ID NO: 1523455 - protein, 25 aa, Mycobacterium tuberculosis
GCGFITWSLARQPQLLDLALQYEPV

SEQ ID NO: 1523456 - protein, 19 aa, Mycobacterium tuberculosis
GCGGGAFTAGVTTGGAGGT

SEQ ID NO: 1523457 - protein, 24 aa, Mycobacterium tuberculosis
GCGYEFRLETSCYNPSFGGMDRQS

SEQ ID NO: 1523458 - protein, 21 aa, Mycobacterium tuberculosis
GCHLPAAWRTAPPPLNMRPAN

SEQ ID NO: 1523459 - protein, 22 aa, Mycobacterium tuberculosis
GCHLRTFWEGGASAPALFIPDS

SEQ ID NO: 1523460 - protein, 21 aa, Mycobacterium tuberculosis
GCMRGRTMYVVPFCMGPLGAE

SEQ ID NO: 1523461 - protein, 26 aa, Mycobacterium tuberculosis
GCNRPLVFRLPHDPAVDIRTARRITG

SEQ ID NO: 1523462 - protein, 17 aa, Mycobacterium tuberculosis
GCPARVTTYILARRARF

SEQ ID NO: 1523463 - protein, 40 aa, Mycobacterium tuberculosis
GCQPTHSTFWPSTRWRRLRWNRWMPTRGSTPCGGPPRSRP

SEQ ID NO: 1523464 - protein, 26 aa, Mycobacterium tuberculosis
GCQTYKWETFLTSELPGWLQANRHVK

SEQ ID NO: 1523465 - protein, 22 aa, Mycobacterium tuberculosis
GCRPIGYPYIVTGADGILITEL

SEQ ID NO: 1523466 - protein, 29 aa, Mycobacterium tuberculosis
GCRPRRATQATWWQGSRWPRPADPCIAVR

SEQ ID NO: 1523467 - protein, 30 aa, Mycobacterium tuberculosis
GCWQPITRDLWPAPYLVMDTGASLAPYNHM

SEQ ID NO: 1523468 - protein, 26 aa, Mycobacterium tuberculosis
GDACVWWGLWLITINDWAPLATVGSP

SEQ ID NO: 1523469 - protein, 29 aa, Mycobacterium tuberculosis
GDAFLSRSCRWALAAANLWQGNLEAAVGL

SEQ ID NO: 1523470 - protein, 27 aa, Mycobacterium tuberculosis
GDAFLSRSCRWTLAAANLWQGNLEAAV

SEQ ID NO: 1523471 - protein, 25 aa, Mycobacterium tuberculosis
GDANQTIYSFTGASPRFLLDFSRRF

SEQ ID NO: 1523472 - protein, 23 aa, Mycobacterium tuberculosis
GDAPHPRPIPGPPVGPEGLTPTQ

SEQ ID NO: 1523473 - protein, 17 aa, Mycobacterium tuberculosis
GDAVSYALALQTSLHIC

SEQ ID NO: 1523474 - protein, 24 aa, Mycobacterium tuberculosis
GDDGRFLWPGFGENSRVLKWIVDR

SEQ ID NO: 1523475 - protein, 23 aa, Mycobacterium tuberculosis
GDDLFEHIPHLGALALHHALGAL

SEQ ID NO: 1523476 - protein, 18 aa, Mycobacterium tuberculosis
GDDWTPVTLLEGGTPLIA

SEQ ID NO: 1523477 - protein, 23 aa, Mycobacterium tuberculosis
GDEFCLLDGLLAWYAMIGSINNI

SEQ ID NO: 1523478 - protein, 26 aa, Mycobacterium tuberculosis
GDERHMLWFELMKPMTSTATGREAAH

SEQ ID NO: 1523479 - protein, 26 aa, Mycobacterium tuberculosis
GDERHMLWFELMKPMTSTATGREAGS

SEQ ID NO: 1523480 - protein, 20 aa, Mycobacterium tuberculosis
GDFAGLWDDVDALSAPITLV

SEQ ID NO: 1523481 - protein, 19 aa, Mycobacterium tuberculosis
GDFYRPAHQNVYDAILDLY

SEQ ID NO: 1523482 - protein, 28 aa, Mycobacterium tuberculosis
GDGADAVNVVFMPTEPQAATGTAGSAGD

SEQ ID NO: 1523483 - protein, 18 aa, Mycobacterium tuberculosis
GDGELFFGVSGAGGADGT

SEQ ID NO: 1523484 - protein, 27 aa, Mycobacterium tuberculosis
GDGFVGLRVVPWLWGAPPTDRRYYPLF

SEQ ID NO: 1523485 - protein, 24 aa, Mycobacterium tuberculosis
GDGGAAGLFGAGGIGGAGGPGFNG

SEQ ID NO: 1523486 - protein, 23 aa, Mycobacterium tuberculosis
GDGGAAGLFGAGGIGGAGGRSGL

SEQ ID NO: 1523487 - protein, 26 aa, Mycobacterium tuberculosis
GDGGAGGNGGSWLAAGDGGAGGHGGD

SEQ ID NO: 1523488 - protein, 26 aa, Mycobacterium tuberculosis
GDGGDIAYPYYLINGRIPVAATSFKA

SEQ ID NO: 1523489 - protein, 31 aa, Mycobacterium tuberculosis
GDGGKGADPGGLFPIPGAGGKGGTGGTGGTA

SEQ ID NO: 1523490 - protein, 22 aa, Mycobacterium tuberculosis
GDGGNAGLFGDGGAGGDGADGT

SEQ ID NO: 1523491 - protein, 25 aa, Mycobacterium tuberculosis
GDGGNAGLLFGAAGVGGAGGFALAT

SEQ ID NO: 1523492 - protein, 17 aa, Mycobacterium tuberculosis
GDGGPGGAAFGLGNGGN

SEQ ID NO: 1523493 - protein, 21 aa, Mycobacterium tuberculosis
GDGGPGMFGGPGGAGGSGGTI

SEQ ID NO: 1523494 - protein, 22 aa, Mycobacterium tuberculosis
GDGGPGMFGGPGGAGGSGGTIF

SEQ ID NO: 1523495 - protein, 17 aa, Mycobacterium tuberculosis
GDGGRGAGGLTSGGVGS

SEQ ID NO: 1523496 - protein, 29 aa, Mycobacterium tuberculosis
GDGGRGAHGTLFSSLAGTGGTGGNGGTGG

SEQ ID NO: 1523497 - protein, 24 aa, Mycobacterium tuberculosis
GDGGTGGRGGWLAGAGGAGGDGGI

SEQ ID NO: 1523498 - protein, 24 aa, Mycobacterium tuberculosis
GDGRIRARREISVKIPAGVGDGDA

SEQ ID NO: 1523499 - protein, 28 aa, Mycobacterium tuberculosis
GDGVFEGIAVLGLGFGGAAGAGGAATGD

SEQ ID NO: 1523500 - protein, 17 aa, Mycobacterium tuberculosis
GDGVLRPLPVTTFDVRC

SEQ ID NO: 1523501 - protein, 18 aa, Mycobacterium tuberculosis
GDGWWLTRVVEGDGRGTV

SEQ ID NO: 1523502 - protein, 28 aa, Mycobacterium tuberculosis
GDHHRDEALYLIHKRAKRLRYTVAATGA

SEQ ID NO: 1523503 - protein, 21 aa, Mycobacterium tuberculosis
GDHIRICDHEFTFQISAGTHG

SEQ ID NO: 1523504 - protein, 18 aa, Mycobacterium tuberculosis
GDIGLLREVERFPFVPAD

SEQ ID NO: 1523505 - protein, 31 aa, Mycobacterium tuberculosis
GDIKSLADGLARFTWQLRAAAPAAARHVGRR

SEQ ID NO: 1523506 - protein, 23 aa, Mycobacterium tuberculosis
GDIKSLADGLARFTWQLRAADPR

SEQ ID NO: 1523507 - protein, 24 aa, Mycobacterium tuberculosis
GDIKSLADGLARFTWQLRAADPRL

SEQ ID NO: 1523508 - protein, 24 aa, Mycobacterium tuberculosis
GDKWRLAEVLAWQAYVGFAGEGDP

SEQ ID NO: 1523509 - protein, 17 aa, Mycobacterium tuberculosis
GDLVSCRQWVVSVTAIG

SEQ ID NO: 1523510 - protein, 25 aa, Mycobacterium tuberculosis
GDMQTIELAAFHRVPPGPGQIEVAV

SEQ ID NO: 1523511 - protein, 17 aa, Mycobacterium tuberculosis
GDNGYIPIPDEFKSRLS

SEQ ID NO: 1523512 - protein, 26 aa, Mycobacterium tuberculosis
GDNHATGGWLYRNGGAGDQGAIAGAG

SEQ ID NO: 1523513 - protein, 29 aa, Mycobacterium tuberculosis
GDPLALRDRLIVELLYATGIRVSELCGLD

SEQ ID NO: 1523514 - protein, 26 aa, Mycobacterium tuberculosis
GDPPYVAVPYLDRMELAYAAADLVIC

SEQ ID NO: 1523515 - protein, 18 aa, Mycobacterium tuberculosis
GDPRGYPAPPGAPTVLLY

SEQ ID NO: 1523516 - protein, 20 aa, Mycobacterium tuberculosis
GDPRRFFQMVYNERWARATE

SEQ ID NO: 1523517 - protein, 22 aa, Mycobacterium tuberculosis
GDPVALRAFRRGAAALAAMIAS

SEQ ID NO: 1523518 - protein, 23 aa, Mycobacterium tuberculosis
GDPVALRAFRRGAAALAAMIASV

SEQ ID NO: 1523519 - protein, 22 aa, Mycobacterium tuberculosis
GDRAGALVGRDGGPGGNGGAGG

SEQ ID NO: 1523520 - protein, 25 aa, Mycobacterium tuberculosis
GDRDILLGVLERRGRRRAGVDFGPA

SEQ ID NO: 1523521 - protein, 17 aa, Mycobacterium tuberculosis
GDRFGRVVAPHRLTDPK

SEQ ID NO: 1523522 - protein, 18 aa, Mycobacterium tuberculosis
GDRFGRVVAPHRLTDPKA

SEQ ID NO: 1523523 - protein, 17 aa, Mycobacterium tuberculosis
GDRGWAGRQWPVMGAAG

SEQ ID NO: 1523524 - protein, 27 aa, Mycobacterium tuberculosis
GDRVAIYLPLIPEAVIAMLACARLGIM

SEQ ID NO: 1523525 - protein, 20 aa, Mycobacterium tuberculosis
GDRVLLCLPDSPDLVQLLLA

SEQ ID NO: 1523526 - protein, 31 aa, Mycobacterium tuberculosis
GDSAPIPADHARLLCYLIGDGRDGWVGGKTP

SEQ ID NO: 1523527 - protein, 17 aa, Mycobacterium tuberculosis
GDTAVQLGLPRLAARIN

SEQ ID NO: 1523528 - protein, 19 aa, Mycobacterium tuberculosis
GDTEWLPPPHLDHGQPRTN

SEQ ID NO: 1523529 - protein, 24 aa, Mycobacterium tuberculosis
GDTPPALRRQLVSQPPDVLITTPE

SEQ ID NO: 1523530 - protein, 22 aa, Mycobacterium tuberculosis
GDTTVPLFDSGVGGAGGAGGNA

SEQ ID NO: 1523531 - protein, 17 aa, Mycobacterium tuberculosis
GDTYLAGAKILRQYGIG

SEQ ID NO: 1523532 - protein, 24 aa, Mycobacterium tuberculosis
GDVKRFRGFDNWEGDAATACEASA

SEQ ID NO: 1523533 - protein, 24 aa, Mycobacterium tuberculosis
GDVKRFRGFDNWEGDAATACEASL

SEQ ID NO: 1523534 - protein, 30 aa, Mycobacterium tuberculosis
GDVLPARVRVPFLLDLLRALRGADDRHRQL

SEQ ID NO: 1523535 - protein, 24 aa, Mycobacterium tuberculosis
GDVVVLLESMKMEIPVLAEAAGTV

SEQ ID NO: 1523536 - protein, 19 aa, Mycobacterium tuberculosis
GDVYLVIDNYRALAEENEV

SEQ ID NO: 1523537 - protein, 22 aa, Mycobacterium tuberculosis
GDYLEELLDVLDFDGDIDLDVE

SEQ ID NO: 1523538 - protein, 26 aa, Mycobacterium tuberculosis
GEACARAIAWYLAMARRSQGNESAAV

SEQ ID NO: 1523539 - protein, 22 aa, Mycobacterium tuberculosis
GEADFILAKHRNGPTKTVTVAH

SEQ ID NO: 1523540 - protein, 22 aa, Mycobacterium tuberculosis
GEAILTGWRMLLDEGRLQDGEP

SEQ ID NO: 1523541 - protein, 21 aa, Mycobacterium tuberculosis
GEARLPLALPTSATGGIPVTV

SEQ ID NO: 1523542 - protein, 26 aa, Mycobacterium tuberculosis
GEATGLPSMVVLHPATSAVAASRAAI

SEQ ID NO: 1523543 - protein, 19 aa, Mycobacterium tuberculosis
GEDVLSRLPRRSLAFDVPA

SEQ ID NO: 1523544 - protein, 18 aa, Mycobacterium tuberculosis
GEEMARLFAWCPEAVTAA

SEQ ID NO: 1523545 - protein, 23 aa, Mycobacterium tuberculosis
GEEQFMAWRRSYDTPPPPIERGS

SEQ ID NO: 1523546 - protein, 18 aa, Mycobacterium tuberculosis
GEFAVIDRLVRGRRQPAT

SEQ ID NO: 1523547 - protein, 17 aa, Mycobacterium tuberculosis
GEFLALGAGFEDIGIKT

SEQ ID NO: 1523548 - protein, 20 aa, Mycobacterium tuberculosis
GEFLDPLGGLAALRAKVLDT

SEQ ID NO: 1523549 - protein, 23 aa, Mycobacterium tuberculosis
GEFRKLWIARINAAARLNDITYN

SEQ ID NO: 1523550 - protein, 26 aa, Mycobacterium tuberculosis
GEFVKFGPSWAWPKPVQPHIPVLVGA

SEQ ID NO: 1523551 - protein, 21 aa, Mycobacterium tuberculosis
GEGCLLLVYPNVIAVERQLRV

SEQ ID NO: 1523552 - protein, 19 aa, Mycobacterium tuberculosis
GEHRKSLTFALRFRAPDRT

SEQ ID NO: 1523553 - protein, 26 aa, Mycobacterium tuberculosis
GEIAVRVIRTLRRLGIRSVAVYSDPD

SEQ ID NO: 1523554 - protein, 25 aa, Mycobacterium tuberculosis
GEILRLLLGHPAYADGRLRIGALTA

SEQ ID NO: 1523555 - protein, 19 aa, Mycobacterium tuberculosis
GEIPLGIYCRASLAEYMDA

SEQ ID NO: 1523556 - protein, 19 aa, Mycobacterium tuberculosis
GEIPLGLRLGSDTTLLDAA

SEQ ID NO: 1523557 - protein, 27 aa, Mycobacterium tuberculosis
GEKKRHEILQLELLKPKIAILDETDSG

SEQ ID NO: 1523558 - protein, 25 aa, Mycobacterium tuberculosis
GEKNMPFWGTSFSAAYVSGVAALVR

SEQ ID NO: 1523559 - protein, 17 aa, Mycobacterium tuberculosis
GELLFTNPTGAFQFLLY

SEQ ID NO: 1523560 - protein, 17 aa, Mycobacterium tuberculosis
GELLGALPMLHAAFERA

SEQ ID NO: 1523561 - protein, 28 aa, Mycobacterium tuberculosis
GELLKPFARRYFQAIPGVWARRSSEVAQ

SEQ ID NO: 1523562 - protein, 26 aa, Mycobacterium tuberculosis
GELNRFVFAMPEQLGRIYLGLTDEDA

SEQ ID NO: 1523563 - protein, 33 aa, Mycobacterium tuberculosis
GELPEHLADRFNWLLMTIRLSISSLAGTARTLV

SEQ ID NO: 1523564 - protein, 19 aa, Mycobacterium tuberculosis
GELPTWQWESLISKSTRLV

SEQ ID NO: 1523565 - protein, 27 aa, Mycobacterium tuberculosis
GELSAVVMAPMYLGLRVWSRATIGLAY

SEQ ID NO: 1523566 - protein, 23 aa, Mycobacterium tuberculosis
GELSVLADCWRIAAKSLRPLPVA

SEQ ID NO: 1523567 - protein, 24 aa, Mycobacterium tuberculosis
GELSVLADCWRIAAKSLRPLPVAH

SEQ ID NO: 1523568 - protein, 21 aa, Mycobacterium tuberculosis
GELTHLRGVVGSGVAGGAGGR

SEQ ID NO: 1523569 - protein, 25 aa, Mycobacterium tuberculosis
GENFSRRFVPTSFIVSAIALLITGD

SEQ ID NO: 1523570 - protein, 26 aa, Mycobacterium tuberculosis
GEPAPAVPGIPMPLPPNAPPGARTQP

SEQ ID NO: 1523571 - protein, 18 aa, Mycobacterium tuberculosis
GEPASWLEMPIQAGVGIT

SEQ ID NO: 1523572 - protein, 23 aa, Mycobacterium tuberculosis
GEPSWPTPWGRGRPGWHLECSAM

SEQ ID NO: 1523573 - protein, 18 aa, Mycobacterium tuberculosis
GEPTPITPVTPPVAPATP

SEQ ID NO: 1523574 - protein, 19 aa, Mycobacterium tuberculosis
GEPTPITPVTPPVAPATPA

SEQ ID NO: 1523575 - protein, 25 aa, Mycobacterium tuberculosis
GEPTPLDYLVAEILRIISGGRLIWD

SEQ ID NO: 1523576 - protein, 20 aa, Mycobacterium tuberculosis
GEPVIWQLVDEDAPLRPRSL

SEQ ID NO: 1523577 - protein, 30 aa, Mycobacterium tuberculosis
GEQRLSGFLLWQSAYSEMWFTEAHWPAFRH

SEQ ID NO: 1523578 - protein, 39 aa, Mycobacterium tuberculosis
GERGRRHWNWGWRRYTWPSAFDKVWRGGARPVFWLSLDG

SEQ ID NO: 1523579 - protein, 35 aa, Mycobacterium tuberculosis
GERIRVCDWLPDDPYPRAKVRFWPDQPGHPVTAAQ

SEQ ID NO: 1523580 - protein, 22 aa, Mycobacterium tuberculosis
GERLNLPAGWSYHTRVLTSELR

SEQ ID NO: 1523581 - protein, 19 aa, Mycobacterium tuberculosis
GERRIECACKVWAAGVAAS

SEQ ID NO: 1523582 - protein, 20 aa, Mycobacterium tuberculosis
GERRPGWVGLPLAGVQTRLV

SEQ ID NO: 1523583 - protein, 24 aa, Mycobacterium tuberculosis
GERSADAIYLLYTGGTTGFPKGVM

SEQ ID NO: 1523584 - protein, 23 aa, Mycobacterium tuberculosis
GERVVWFGFIPQSIDRVQVLGGV

SEQ ID NO: 1523585 - protein, 24 aa, Mycobacterium tuberculosis
GETGLRPDFPRPALLSGAGDAVEF

SEQ ID NO: 1523586 - protein, 26 aa, Mycobacterium tuberculosis
GETRQLLERLQPTVPILLANLVSVGQ

SEQ ID NO: 1523587 - protein, 18 aa, Mycobacterium tuberculosis
GEVIVRKGPLSGRPLVLH

SEQ ID NO: 1523588 - protein, 17 aa, Mycobacterium tuberculosis
GEVPLLPYESCNLGSIN

SEQ ID NO: 1523589 - protein, 21 aa, Mycobacterium tuberculosis
GEVRVPAKALWRAQTQRAVQN

SEQ ID NO: 1523590 - protein, 27 aa, Mycobacterium tuberculosis
GEYAARYPQLFRPILRQINIGVHANFK

SEQ ID NO: 1523591 - protein, 23 aa, Mycobacterium tuberculosis
GEYQLKLTPPFVPGMETAGVVRS

SEQ ID NO: 1523592 - protein, 24 aa, Mycobacterium tuberculosis
GFAIFRIEVNLPVDGRWVLVVTGD

SEQ ID NO: 1523593 - protein, 25 aa, Mycobacterium tuberculosis
GFAIFRIEVNLPVDGRWVLVVTGDA

SEQ ID NO: 1523594 - protein, 18 aa, Mycobacterium tuberculosis
GFAINPFGLDVPLSGGTS

SEQ ID NO: 1523595 - protein, 22 aa, Mycobacterium tuberculosis
GFANRGILPFSVASVVSGFANI

SEQ ID NO: 1523596 - protein, 29 aa, Mycobacterium tuberculosis
GFATAAMLVAYWPTNLRPIAAGTGLLVLG

SEQ ID NO: 1523597 - protein, 24 aa, Mycobacterium tuberculosis
GFAVGYTLPLFPAVGADVSGGIGP

SEQ ID NO: 1523598 - protein, 17 aa, Mycobacterium tuberculosis
GFDELRSQARILGIFVD

SEQ ID NO: 1523599 - protein, 27 aa, Mycobacterium tuberculosis
GFDGYVALPAYLAARGLTLPPRRRRRI

SEQ ID NO: 1523600 - protein, 17 aa, Mycobacterium tuberculosis
GFDTESIDLAPTSSRIA

SEQ ID NO: 1523601 - protein, 18 aa, Mycobacterium tuberculosis
GFEMQFGTNHLGHFALTG

SEQ ID NO: 1523602 - protein, 22 aa, Mycobacterium tuberculosis
GFERFYGFLGGETDQWYPDLVY

SEQ ID NO: 1523603 - protein, 20 aa, Mycobacterium tuberculosis
GFEYFYGFIGGEANQWYPSL

SEQ ID NO: 1523604 - protein, 19 aa, Mycobacterium tuberculosis
GFGALARRIAGRSLGLVMA

SEQ ID NO: 1523605 - protein, 21 aa, Mycobacterium tuberculosis
GFGAVGHPTPQPAALGAAGVV

SEQ ID NO: 1523606 - protein, 24 aa, Mycobacterium tuberculosis
GFGGAGGIAQLFGTGGMGGSGGGI

SEQ ID NO: 1523607 - protein, 19 aa, Mycobacterium tuberculosis
GFGGSGGRGGLLLGTGGAG

SEQ ID NO: 1523608 - protein, 31 aa, Mycobacterium tuberculosis
GFGGYVALPAYLAARGLPLPPRRRRRIPVVI

SEQ ID NO: 1523609 - protein, 32 aa, Mycobacterium tuberculosis
GFGGYVALPAYLAARGLPLPPRRRRRIPVVIH

SEQ ID NO: 1523610 - protein, 17 aa, Mycobacterium tuberculosis
GFGHMVYLSDPAAIKTV

SEQ ID NO: 1523611 - protein, 17 aa, Mycobacterium tuberculosis
GFGLVMFGAIREASTLA

SEQ ID NO: 1523612 - protein, 20 aa, Mycobacterium tuberculosis
GFGNAGFFNMGIGNAGNEDM

SEQ ID NO: 1523613 - protein, 23 aa, Mycobacterium tuberculosis
GFGNAGNVNTGFWNGGSTNTVSK

SEQ ID NO: 1523614 - protein, 20 aa, Mycobacterium tuberculosis
GFGNASILNTGLGNAGELNT

SEQ ID NO: 1523615 - protein, 18 aa, Mycobacterium tuberculosis
GFGRYLVSATTPFTRDDL

SEQ ID NO: 1523616 - protein, 28 aa, Mycobacterium tuberculosis
GFGSTSGAHGKAGFGAPGGDGGDGGNGG

SEQ ID NO: 1523617 - protein, 19 aa, Mycobacterium tuberculosis
GFHAQLVQAIDALVDSYAS

SEQ ID NO: 1523618 - protein, 24 aa, Mycobacterium tuberculosis
GFLGRYLVLELLRRLDVDGRLICL

SEQ ID NO: 1523619 - protein, 19 aa, Mycobacterium tuberculosis
GFLPLQQFSWRIMPENLED

SEQ ID NO: 1523620 - protein, 27 aa, Mycobacterium tuberculosis
GFNIARVVAVALGYDFLPGTTVNRYCS

SEQ ID NO: 1523621 - protein, 17 aa, Mycobacterium tuberculosis
GFPAPLADLRGGAVWDA

SEQ ID NO: 1523622 - protein, 19 aa, Mycobacterium tuberculosis
GFRAAFAAAYAVAVPGGWR

SEQ ID NO: 1523623 - protein, 20 aa, Mycobacterium tuberculosis
GFRLLAMTPHGNACKLPEAI

SEQ ID NO: 1523624 - protein, 17 aa, Mycobacterium tuberculosis
GFSFFDGNDGDGSTVGT

SEQ ID NO: 1523625 - protein, 19 aa, Mycobacterium tuberculosis
GFSPLLDTVGQPAREVYPE

SEQ ID NO: 1523626 - protein, 19 aa, Mycobacterium tuberculosis
GFTALIDAYRGCFAAFCAV

SEQ ID NO: 1523627 - protein, 23 aa, Mycobacterium tuberculosis
GFTFFPGGLTFPRASAGVTGLSV

SEQ ID NO: 1523628 - protein, 20 aa, Mycobacterium tuberculosis
GFTIPGFSVPAQPLPLSIDI

SEQ ID NO: 1523629 - protein, 21 aa, Mycobacterium tuberculosis
GFTIPGFSVPAQPLPLSIDIE

SEQ ID NO: 1523630 - protein, 17 aa, Mycobacterium tuberculosis
GFTPAPPPQWDDLDVDP

SEQ ID NO: 1523631 - protein, 18 aa, Mycobacterium tuberculosis
GFVAGGYLSADRLADDIA

SEQ ID NO: 1523632 - protein, 19 aa, Mycobacterium tuberculosis
GFVAHRGMTVLPLAKSASG

SEQ ID NO: 1523633 - protein, 28 aa, Mycobacterium tuberculosis
GFYHKHFGLPYAFGKYDQLFVPEFNAGA

SEQ ID NO: 1523634 - protein, 22 aa, Mycobacterium tuberculosis
GGAAGLLVGTGGHGGDGGAGGQ

SEQ ID NO: 1523635 - protein, 17 aa, Mycobacterium tuberculosis
GGAAGSLIGLGGGALGG

SEQ ID NO: 1523636 - protein, 20 aa, Mycobacterium tuberculosis
GGAALPTTPARRFGPTRLAQ

SEQ ID NO: 1523637 - protein, 23 aa, Mycobacterium tuberculosis
GGAGGAAGLWGSGGSGGQGGNGL

SEQ ID NO: 1523638 - protein, 27 aa, Mycobacterium tuberculosis
GGAGGAGAWFGNVAPAASAGGGGRGTT

SEQ ID NO: 1523639 - protein, 25 aa, Mycobacterium tuberculosis
GGAGGAGGAFLGDGGNGGAGGQGGA

SEQ ID NO: 1523640 - protein, 28 aa, Mycobacterium tuberculosis
GGAGGAGGLFGAGGMGGAGGFGDHGTLG

SEQ ID NO: 1523641 - protein, 26 aa, Mycobacterium tuberculosis
GGAGGAGGWLFGVGGAGGVGGAGGGT

SEQ ID NO: 1523642 - protein, 18 aa, Mycobacterium tuberculosis
GGAGGAGGWLIGQSGSTG

SEQ ID NO: 1523643 - protein, 23 aa, Mycobacterium tuberculosis
GGAGGAGWLVGNGGAGGFGGVGT

SEQ ID NO: 1523644 - protein, 26 aa, Mycobacterium tuberculosis
GGAGGGAFVHIATATSTGGSGGFGGN

SEQ ID NO: 1523645 - protein, 26 aa, Mycobacterium tuberculosis
GGAGGGAGMFSQPGVHGAGGTGGQGG

SEQ ID NO: 1523646 - protein, 23 aa, Mycobacterium tuberculosis
GGAGGGGGWLHGDGGAGGHGGQG

SEQ ID NO: 1523647 - protein, 23 aa, Mycobacterium tuberculosis
GGAGGGGGWLYGDGGAGGHGGQG

SEQ ID NO: 1523648 - protein, 24 aa, Mycobacterium tuberculosis
GGAGGHVGLISNGGNGGAGGNGGN

SEQ ID NO: 1523649 - protein, 20 aa, Mycobacterium tuberculosis
GGAGGIFFGTGGTGGAGGVG

SEQ ID NO: 1523650 - protein, 24 aa, Mycobacterium tuberculosis
GGAGGILVGQRRQWRVGGTRTGRR

SEQ ID NO: 1523651 - protein, 23 aa, Mycobacterium tuberculosis
GGAGGKAGLYGNGGDGGAGGDGA

SEQ ID NO: 1523652 - protein, 26 aa, Mycobacterium tuberculosis
GGAGGKGAIPAMKGATGADGTAPTSG

SEQ ID NO: 1523653 - protein, 18 aa, Mycobacterium tuberculosis
GGAGGLFGAGGEGGSGGS

SEQ ID NO: 1523654 - protein, 20 aa, Mycobacterium tuberculosis
GGAGGLFGPGGGSGGVGGFG

SEQ ID NO: 1523655 - protein, 21 aa, Mycobacterium tuberculosis
GGAGGLLFGNGGNGGNAGAGG

SEQ ID NO: 1523656 - protein, 20 aa, Mycobacterium tuberculosis
GGAGGLLYGARRGPEAPADA

SEQ ID NO: 1523657 - protein, 19 aa, Mycobacterium tuberculosis
GGAGGLLYGNGGAGGNGGA

SEQ ID NO: 1523658 - protein, 20 aa, Mycobacterium tuberculosis
GGAGGLLYGNGGAGGNGGAA

SEQ ID NO: 1523659 - protein, 25 aa, Mycobacterium tuberculosis
GGAGGNAGLLIGAAGLGGCGGGAFT

SEQ ID NO: 1523660 - protein, 29 aa, Mycobacterium tuberculosis
GGAGGNAGLLIGAAGLGGCGGGAFTAGVT

SEQ ID NO: 1523661 - protein, 31 aa, Mycobacterium tuberculosis
GGAGGNAGLLIGAAGLGGCGGGAFTAGVTTG

SEQ ID NO: 1523662 - protein, 25 aa, Mycobacterium tuberculosis
GGAGGNAGMLFGAAGVGGVGGFSNG

SEQ ID NO: 1523663 - protein, 18 aa, Mycobacterium tuberculosis
GGAGGNAMLIGHGGAGGA

SEQ ID NO: 1523664 - protein, 25 aa, Mycobacterium tuberculosis
GGAGGNARLWGVGGAGGAGGKGGSG

SEQ ID NO: 1523665 - protein, 25 aa, Mycobacterium tuberculosis
GGAGGNGALLFGFGGAGGAGGHGGA

SEQ ID NO: 1523666 - protein, 26 aa, Mycobacterium tuberculosis
GGAGGNGALLFGFGGAGGAGGHGGAA

SEQ ID NO: 1523667 - protein, 26 aa, Mycobacterium tuberculosis
GGAGGNGGWLYGNGGLGGNGGAATQI

SEQ ID NO: 1523668 - protein, 26 aa, Mycobacterium tuberculosis
GGAGGQGGLLFGDGGNGGAGGAGGIG

SEQ ID NO: 1523669 - protein, 25 aa, Mycobacterium tuberculosis
GGAGGRGGLLIGDGGAGGAGGVGGT

SEQ ID NO: 1523670 - protein, 24 aa, Mycobacterium tuberculosis
GGAGGSAGLFYGSGGAGGNGGYSL

SEQ ID NO: 1523671 - protein, 28 aa, Mycobacterium tuberculosis
GGAGGSAGLLGYVGRAGDGGAGGGGGLG

SEQ ID NO: 1523672 - protein, 22 aa, Mycobacterium tuberculosis
GGAGGTAWLFGVGGAVEPEAMA

SEQ ID NO: 1523673 - protein, 24 aa, Mycobacterium tuberculosis
GGAGGTGGLLYGSGGAGGNGGSAA

SEQ ID NO: 1523674 - protein, 21 aa, Mycobacterium tuberculosis
GGAGGWLYGNGGAGGFGGAGA

SEQ ID NO: 1523675 - protein, 21 aa, Mycobacterium tuberculosis
GGAGLIAGLDGAGGAGGTRGL

SEQ ID NO: 1523676 - protein, 23 aa, Mycobacterium tuberculosis
GGAGPPRPALAAALAGSCSANPG

SEQ ID NO: 1523677 - protein, 20 aa, Mycobacterium tuberculosis
GGAGSIGFNASAPGAAGSPG

SEQ ID NO: 1523678 - protein, 26 aa, Mycobacterium tuberculosis
GGAGTLLGLTVFGDNGGAGVLGDSTD

SEQ ID NO: 1523679 - protein, 27 aa, Mycobacterium tuberculosis
GGAGTLLGLTVFGDNGGAGVLGDSTDP

SEQ ID NO: 1523680 - protein, 20 aa, Mycobacterium tuberculosis
GGAILLRDALHATAVRILTG

SEQ ID NO: 1523681 - protein, 25 aa, Mycobacterium tuberculosis
GGAIYQRWQALGGMNSALGAPTSPE

SEQ ID NO: 1523682 - protein, 24 aa, Mycobacterium tuberculosis
GGANSGSLFASPGGTGGAGGHGGA

SEQ ID NO: 1523683 - protein, 24 aa, Mycobacterium tuberculosis
GGANSGSLFASPGGTGGAGGPGGA

SEQ ID NO: 1523684 - protein, 34 aa, Mycobacterium tuberculosis
GGAPGALGGKGGSGGLIGRAGSDGGVGAGGAGGA

SEQ ID NO: 1523685 - protein, 31 aa, Mycobacterium tuberculosis
GGAPGLGGAGGAGGWLIGQSGSTGGGGAGGA

SEQ ID NO: 1523686 - protein, 26 aa, Mycobacterium tuberculosis
GGASALGALLMLPGVRGLGPGPVTTG

SEQ ID NO: 1523687 - protein, 21 aa, Mycobacterium tuberculosis
GGASALLTGNGSSAGAGGAGG

SEQ ID NO: 1523688 - protein, 36 aa, Mycobacterium tuberculosis
GGAWGDGGFRRRGSARAVWLMGNGGQRGATAAPAAQ

SEQ ID NO: 1523689 - protein, 17 aa, Mycobacterium tuberculosis
GGAYRWTVTPGHSAAGT

SEQ ID NO: 1523690 - protein, 20 aa, Mycobacterium tuberculosis
GGDAGLFLGAAGTGGQAALS

SEQ ID NO: 1523691 - protein, 20 aa, Mycobacterium tuberculosis
GGDAGLLFGAAGTGGHGAAG

SEQ ID NO: 1523692 - protein, 22 aa, Mycobacterium tuberculosis
GGDAGMLSLGAAGGAGGSGGSN

SEQ ID NO: 1523693 - protein, 23 aa, Mycobacterium tuberculosis
GGDALLEQPLDKLRTLGARGTAQ

SEQ ID NO: 1523694 - protein, 22 aa, Mycobacterium tuberculosis
GGDAQLIGQRRPRAGPAAPGCR

SEQ ID NO: 1523695 - protein, 31 aa, Mycobacterium tuberculosis
GGDGGCRRVWRRYRRQRWCRRQRRADRQRRQ

SEQ ID NO: 1523696 - protein, 18 aa, Mycobacterium tuberculosis
GGDGGLFRQRRQRRVPAQ

SEQ ID NO: 1523697 - protein, 24 aa, Mycobacterium tuberculosis
GGDGGPGMFGGPGGAGGSGGTIFG

SEQ ID NO: 1523698 - protein, 19 aa, Mycobacterium tuberculosis
GGDGGQFGAGGNGGAGGSV

SEQ ID NO: 1523699 - protein, 22 aa, Mycobacterium tuberculosis
GGDGGWLWGNGVVGGYGGVGVP

SEQ ID NO: 1523700 - protein, 18 aa, Mycobacterium tuberculosis
GGDGVFAGAGGQGGLGGQ

SEQ ID NO: 1523701 - protein, 18 aa, Mycobacterium tuberculosis
GGDLVSCRQWVVSVTAIG

SEQ ID NO: 1523702 - protein, 18 aa, Mycobacterium tuberculosis
GGDPGLGARLFQVGSRGG

SEQ ID NO: 1523703 - protein, 20 aa, Mycobacterium tuberculosis
GGDTAVQLGLPRLAARINNE

SEQ ID NO: 1523704 - protein, 24 aa, Mycobacterium tuberculosis
GGDTTIVVNGMLAPSTLGYGGNGG

SEQ ID NO: 1523705 - protein, 24 aa, Mycobacterium tuberculosis
GGEADFILAKHRNGPTKTVTVAHQ

SEQ ID NO: 1523706 - protein, 23 aa, Mycobacterium tuberculosis
GGEGGAGGLALAASGQNGSQGAG

SEQ ID NO: 1523707 - protein, 34 aa, Mycobacterium tuberculosis
GGFAALGVGVGGPRRGWRGPPPKTGGIGGAGGLG

SEQ ID NO: 1523708 - protein, 26 aa, Mycobacterium tuberculosis
GGFDCSGLVMWAFQQAGIALPHSSQA

SEQ ID NO: 1523709 - protein, 31 aa, Mycobacterium tuberculosis; identical to SEQ ID NO: 226257

SEQ ID NO: 1523710 - protein, 19 aa, Mycobacterium tuberculosis
GGFRNAMTFVLTGLDIDAK

SEQ ID NO: 1523711 - protein, 25 aa, Mycobacterium tuberculosis
GGGAGGRAFLFGDGGDGGAALSAGS

SEQ ID NO: 1523712 - protein, 31 aa, Mycobacterium tuberculosis
GGGDGGNGGLPIYWLHQRRQRRQRAAHRQRW

SEQ ID NO: 1523713 - protein, 17 aa, Mycobacterium tuberculosis
GGGGAWDGLAEELHAAA

SEQ ID NO: 1523714 - protein, 33 aa, Mycobacterium tuberculosis
GGGGGTATFHEDPVAGVWAVGGVGGDGGSGGSS

SEQ ID NO: 1523715 - protein, 22 aa, Mycobacterium tuberculosis
GGGGGTGGFGFAAGGQGGVGGS

SEQ ID NO: 1523716 - protein, 31 aa, Mycobacterium tuberculosis
GGGGTATFHEDPVAGVWAVGGVGGDGGSGGS

SEQ ID NO: 1523717 - protein, 28 aa, Mycobacterium tuberculosis
GGGGTMTHAWLLTGPPGSGRSVAALCFA

SEQ ID NO: 1523718 - protein, 20 aa, Mycobacterium tuberculosis
GGGHGLLGLGGSHGAGGAGG

SEQ ID NO: 1523719 - protein, 26 aa, Mycobacterium tuberculosis
GGGKGGAIFNAGTHGAAGTGGDGGVG

SEQ ID NO: 1523720 - protein, 25 aa, Mycobacterium tuberculosis
GGGLLRLPERIPYAIAMELALTGDN

SEQ ID NO: 1523721 - protein, 24 aa, Mycobacterium tuberculosis
GGGLNRGEHLRGRRSQRPRAGDAD

SEQ ID NO: 1523722 - protein, 25 aa, Mycobacterium tuberculosis
GGGNGGTGWNGGKGDTGSGGGAGDG

SEQ ID NO: 1523723 - protein, 19 aa, Mycobacterium tuberculosis
GGGPAPRPILDAAAAAGIT

SEQ ID NO: 1523724 - protein, 24 aa, Mycobacterium tuberculosis
GGGPGGLATALHARARGLSVIVAE

SEQ ID NO: 1523725 - protein, 32 aa, Mycobacterium tuberculosis
GGGPPQPPTGFFEIPCPKFRKAAVSKGNGLRG

SEQ ID NO: 1523726 - protein, 31 aa, Mycobacterium tuberculosis
GGGRGGDGVFFSLFLGTFSGNSLSGRGGAVG

SEQ ID NO: 1523727 - protein, 24 aa, Mycobacterium tuberculosis
GGGSFGLPGLNGSCGDGGDGGNGA

SEQ ID NO: 1523728 - protein, 19 aa, Mycobacterium tuberculosis
GGGSFGLPGLNGSGGDGGD

SEQ ID NO: 1523729 - protein, 22 aa, Mycobacterium tuberculosis
GGGSFGLPGLNGSGGDGGDGGN

SEQ ID NO: 1523730 - protein, 24 aa, Mycobacterium tuberculosis
GGGSTVVRAQRLAVTATLGGNGGN

SEQ ID NO: 1523731 - protein, 25 aa, Mycobacterium tuberculosis
GGGTATFHEDPVAGVWAVGGVGGDG

SEQ ID NO: 1523732 - protein, 26 aa, Mycobacterium tuberculosis
GGGVGAFLTALFASPAKALSLNAGLG

SEQ ID NO: 1523733 - protein, 25 aa, Mycobacterium tuberculosis
GGHGGAGGLLIGNGGAGGAGGLGGA

SEQ ID NO: 1523734 - protein, 19 aa, Mycobacterium tuberculosis
GGHGGLFGAGGTGGAGGSS

SEQ ID NO: 1523735 - protein, 26 aa, Mycobacterium tuberculosis
GGHGGNAGLWGNGGAGGAGAAGAAGA

SEQ ID NO: 1523736 - protein, 19 aa, Mycobacterium tuberculosis
GGHGGSVLSGPVGDSGNGG

SEQ ID NO: 1523737 - protein, 19 aa, Mycobacterium tuberculosis
GGHIWADGGIRHPRDVALA

SEQ ID NO: 1523738 - protein, 25 aa, Mycobacterium tuberculosis
GGHPRLGHNLALHPATMLAGLFDDD

SEQ ID NO: 1523739 - protein, 21 aa, Mycobacterium tuberculosis
GGHVGLIGNGGNGGAGGNGGN

SEQ ID NO: 1523740 - protein, 20 aa, Mycobacterium tuberculosis
GGIGGAGERGADGAGPNANG

SEQ ID NO: 1523741 - protein, 25 aa, Mycobacterium tuberculosis
GGIGGSAARLFGGGGAGGAGGTGST

SEQ ID NO: 1523742 - protein, 20 aa, Mycobacterium tuberculosis
GGIHLLKRRPNGARAARHRI

SEQ ID NO: 1523743 - protein, 24 aa, Mycobacterium tuberculosis
GGIVFRVQQELGVPVKLVGLGEGP

SEQ ID NO: 1523744 - protein, 25 aa, Mycobacterium tuberculosis
GGIVFRVQQELGVPVKLVGLGEGPD

SEQ ID NO: 1523745 - protein, 40 aa, Mycobacterium tuberculosis
GGIVGSGSTFRCDRLRQQLFTFICGNAGYGRQRRPCPQRQ

SEQ ID NO: 1523746 - protein, 23 aa, Mycobacterium tuberculosis
GGKADIANSLGDNATVTGGNGGT

SEQ ID NO: 1523747 - protein, 17 aa, Mycobacterium tuberculosis
GGKALAATHQDGSMGAG

SEQ ID NO: 1523748 - protein, 22 aa, Mycobacterium tuberculosis
GGKGGASGMLIGNGGNGGSGGV

SEQ ID NO: 1523749 - protein, 26 aa, Mycobacterium tuberculosis
GGKGGTGGLLFGNGGAGGQGGLGLAG

SEQ ID NO: 1523750 - protein, 26 aa, Mycobacterium tuberculosis
GGKGGTGLMPGINGTGGAGGSRGQIS

SEQ ID NO: 1523751 - protein, 23 aa, Mycobacterium tuberculosis
GGKVTAWRYIRAAVRAVLACTRR

SEQ ID NO: 1523752 - protein, 24 aa, Mycobacterium tuberculosis
GGLADCVLALGFEKMQPGALGGGA

SEQ ID NO: 1523753 - protein, 25 aa, Mycobacterium tuberculosis
GGLDVAPLFKVAWPGALAGGHGTVR

SEQ ID NO: 1523754 - protein, 18 aa, Mycobacterium tuberculosis
GGLFFGNGGAGASSFLGG

SEQ ID NO: 1523755 - protein, 17 aa, Mycobacterium tuberculosis
GGLGGGSFGLPGLNGSC

SEQ ID NO: 1523756 - protein, 23 aa, Mycobacterium tuberculosis
GGLGGLGGVGGTGGMGGSGGVGG

SEQ ID NO: 1523757 - protein, 18 aa, Mycobacterium tuberculosis
GGLGSAFGPGGTGGMGGA

SEQ ID NO: 1523758 - protein, 29 aa, Mycobacterium tuberculosis
GGLLARFPGFYIPFLDVPFNGATPANSPY

SEQ ID NO: 1523759 - protein, 18 aa, Mycobacterium tuberculosis
GGLLFGSGGAGGSGGFSN

SEQ ID NO: 1523760 - protein, 21 aa, Mycobacterium tuberculosis
GGLLLPLGVRSLRAYGPTRNA

SEQ ID NO: 1523761 - protein, 19 aa, Mycobacterium tuberculosis
GGLLPIAYTQGIDFRPAKR

SEQ ID NO: 1523762 - protein, 17 aa, Mycobacterium tuberculosis
GGLLVGDGGAAWHRGHR

SEQ ID NO: 1523763 - protein, 27 aa, Mycobacterium tuberculosis
GGLLYGNGGKWRRRWAQPGRRRGRQRR

SEQ ID NO: 1523764 - protein, 24 aa, Mycobacterium tuberculosis
GGLMPGFGGAPWVGGHWGLGGEGH

SEQ ID NO: 1523765 - protein, 25 aa, Mycobacterium tuberculosis
GGLRARVLRRWSVPPVRPPVTVVQA

SEQ ID NO: 1523766 - protein, 19 aa, Mycobacterium tuberculosis
GGLVHIFLPPTDALEHFID

SEQ ID NO: 1523767 - protein, 28 aa, Mycobacterium tuberculosis
GGLYRQWALARRAQGDLWAAPSGWRGGG

SEQ ID NO: 1523768 - protein, 25 aa, Mycobacterium tuberculosis
GGMGGLGFVVARWLAEQGAGLIVLN

SEQ ID NO: 1523769 - protein, 17 aa, Mycobacterium tuberculosis
GGMGIPGIGRKSATRKS

SEQ ID NO: 1523770 - protein, 22 aa, Mycobacterium tuberculosis
GGMLRRMRPLFSVGLGARLGSG

SEQ ID NO: 1523771 - protein, 22 aa, Mycobacterium tuberculosis
GGMLVLQRLSDARRLGHPVLAV

SEQ ID NO: 1523772 - protein, 21 aa, Mycobacterium tuberculosis
GGNAALLIGTGGDGGDGVPPA

SEQ ID NO: 1523773 - protein, 25 aa, Mycobacterium tuberculosis
GGNAFTPLQLFKRYASHEGGIADPA

SEQ ID NO: 1523774 - protein, 22 aa, Mycobacterium tuberculosis
GGNAGLLFGAAGVGGAGGFALA

SEQ ID NO: 1523775 - protein, 22 aa, Mycobacterium tuberculosis
GGNAGLLFGAGGTGGSGGAGLG

SEQ ID NO: 1523776 - protein, 17 aa, Mycobacterium tuberculosis
GGNAGLLGVGGAGGHGA

SEQ ID NO: 1523777 - protein, 23 aa, Mycobacterium tuberculosis
GGNAGSFTLKASGGAGGSGGSSL

SEQ ID NO: 1523778 - protein, 17 aa, Mycobacterium tuberculosis
GGNAGTFYGSGGAGGAG

SEQ ID NO: 1523779 - protein, 25 aa, Mycobacterium tuberculosis
GGNAGVIANGSFAPSFVGFGGNGVN

SEQ ID NO: 1523780 - protein, 23 aa, Mycobacterium tuberculosis
GGNAGWLGFGGAGGVGGSAGLIG

SEQ ID NO: 1523781 - protein, 18 aa, Mycobacterium tuberculosis
GGNALLFGNGGNGGSGAS

SEQ ID NO: 1523782 - protein, 20 aa, Mycobacterium tuberculosis
GGNALMFGIGGNGGAGGAAS

SEQ ID NO: 1523783 - protein, 21 aa, Mycobacterium tuberculosis
GGNFDWTQGRFPGFTTPDPSY

SEQ ID NO: 1523784 - protein, 25 aa, Mycobacterium tuberculosis
GGNGAPGGFGGGAGAGGLGGSGAGG

SEQ ID NO: 1523785 - protein, 25 aa, Mycobacterium tuberculosis
GGNGGAGGLLFGNGGNGGNAGAGGD

SEQ ID NO: 1523786 - protein, 25 aa, Mycobacterium tuberculosis
GGNGGAIFNAGTPGAAGTGGDGGVG

SEQ ID NO: 1523787 - protein, 19 aa, Mycobacterium tuberculosis
GGNGGIGITVGGAGGAGGN

SEQ ID NO: 1523788 - protein, 20 aa, Mycobacterium tuberculosis
GGNGGLGGFGGNGAAGANGV

SEQ ID NO: 1523789 - protein, 23 aa, Mycobacterium tuberculosis
GGNGGLGGFGGNGAAGANGVAVG

SEQ ID NO: 1523790 - protein, 26 aa, Mycobacterium tuberculosis
GGNGGNGGWLFGAGGTGGIGGTGAPG

SEQ ID NO: 1523791 - protein, 37 aa, Mycobacterium tuberculosis
GGNGGPGTPGSPMVAPPPPTPITQVQQGGDGGAGGTG

SEQ ID NO: 1523792 - protein, 27 aa, Mycobacterium tuberculosis
GGNGGTGGFAGFGGTAGNGGSGGTGGA

SEQ ID NO: 1523793 - protein, 22 aa, Mycobacterium tuberculosis
GGNGGVWYGNGGAGGAAGQGGP

SEQ ID NO: 1523794 - protein, 19 aa, Mycobacterium tuberculosis
GGNGGWLYGNGGAGGLGGT

SEQ ID NO: 1523795 - protein, 21 aa, Mycobacterium tuberculosis
GGNGGWLYGNGGPGGAAGLGT

SEQ ID NO: 1523796 - protein, 21 aa, Mycobacterium tuberculosis
GGNGGWLYGSGGNGGAGGAGP

SEQ ID NO: 1523797 - protein, 17 aa, Mycobacterium tuberculosis
GGNGIPGTGTEPAGGTG

SEQ ID NO: 1523798 - protein, 20 aa, Mycobacterium tuberculosis
GGNGLLFGAGGTGGAGTLGA

SEQ ID NO: 1523799 - protein, 21 aa, Mycobacterium tuberculosis
GGNGLLFGAGGTGGAGTLGAD

SEQ ID NO: 1523800 - protein, 22 aa, Mycobacterium tuberculosis
GGNGVAGTGLALNGGNGGNGGI

SEQ ID NO: 1523801 - protein, 23 aa, Mycobacterium tuberculosis
GGNHAFYLAIPPKSFPVVCEQLH

SEQ ID NO: 1523802 - protein, 17 aa, Mycobacterium tuberculosis
GGNPLFQSHMWDGSAVP

SEQ ID NO: 1523803 - protein, 23 aa, Mycobacterium tuberculosis
GGPAVAGVLGGMPGAGGNGGNAN

SEQ ID NO: 1523804 - protein, 17 aa, Mycobacterium tuberculosis
GGPGGAAFGLGNGGNGG

SEQ ID NO: 1523805 - protein, 20 aa, Mycobacterium tuberculosis
GGPGGLLYGNGGNGAAGGPN

SEQ ID NO: 1523806 - protein, 17 aa, Mycobacterium tuberculosis
GGPGNQAFNAGAGGAGG

SEQ ID NO: 1523807 - protein, 23 aa, Mycobacterium tuberculosis
GGPGPIGGVGGHGGVGGAAGLLG

SEQ ID NO: 1523808 - protein, 25 aa, Mycobacterium tuberculosis
GGPKCLVKVIQKLSGLSINRFIAID

SEQ ID NO: 1523809 - protein, 17 aa, Mycobacterium tuberculosis
GGPLIDLNGQVLGVVFG

SEQ ID NO: 1523810 - protein, 17 aa, Mycobacterium tuberculosis
GGPPLPAVRCLDWVAHE

SEQ ID NO: 1523811 - protein, 19 aa, Mycobacterium tuberculosis
GGPRPPIPAPAMRPRRRRA

SEQ ID NO: 1523812 - protein, 22 aa, Mycobacterium tuberculosis
GGPYAHGWVTWFPPDAPPGTER

SEQ ID NO: 1523813 - protein, 25 aa, Mycobacterium tuberculosis
GGQALLFGNAAWAEPAGLAGSMGLS

SEQ ID NO: 1523814 - protein, 21 aa, Mycobacterium tuberculosis
GGQALLFGNGGLGGAGGAGGV

SEQ ID NO: 1523815 - protein, 24 aa, Mycobacterium tuberculosis
GGQEILFPALLPRAPYETTNRVDP

SEQ ID NO: 1523816 - protein, 24 aa, Mycobacterium tuberculosis
GGQEILFPALLPRAPYETTNRWTQ

SEQ ID NO: 1523817 - protein, 35 aa, Mycobacterium tuberculosis
GGQGGGGGFSILLGLGGLGGLGSPGSIATGTAGGA

SEQ ID NO: 1523818 - protein, 24 aa, Mycobacterium tuberculosis
GGQGGIGGAGERGADGAGPNANGA

SEQ ID NO: 1523819 - protein, 21 aa, Mycobacterium tuberculosis
GGQGGLGLAGINGGSGGQGGH

SEQ ID NO: 1523820 - protein, 28 aa, Mycobacterium tuberculosis
GGQGGPAVAGVLGGMPGAGGNGGNANWF

SEQ ID NO: 1523821 - protein, 32 aa, Mycobacterium tuberculosis
GGQLLVYGVDPLILRQAYPVRQAPYGLAGSRE

SEQ ID NO: 1523822 - protein, 23 aa, Mycobacterium tuberculosis
GGQMLFDLPPRWFAGWSRLGLRT

SEQ ID NO: 1523823 - protein, 19 aa, Mycobacterium tuberculosis
GGQVPRLDQRHLEPTGGSI

SEQ ID NO: 1523824 - protein, 21 aa, Mycobacterium tuberculosis
GGRAVPRRPGTPDPPPAVLGE

SEQ ID NO: 1523825 - protein, 17 aa, Mycobacterium tuberculosis
GGRFRPDQLHKLATKLA

SEQ ID NO: 1523826 - protein, 18 aa, Mycobacterium tuberculosis
GGRGGAAGLIGNGGAGGA

SEQ ID NO: 1523827 - protein, 22 aa, Mycobacterium tuberculosis
GGRGGDGVFAGAGGQGGLGGQG

SEQ ID NO: 1523828 - protein, 22 aa, Mycobacterium tuberculosis
GGRGGLLAGQHANSGNGGGGGT

SEQ ID NO: 1523829 - protein, 27 aa, Mycobacterium tuberculosis
GGRLAPRPVFRPPVDPASRQAFGRPSG

SEQ ID NO: 1523830 - protein, 21 aa, Mycobacterium tuberculosis
GGRLRRPLPAAGVAAKLSASR

SEQ ID NO: 1523831 - protein, 18 aa, Mycobacterium tuberculosis
GGRPDELTLIAPASARLL

SEQ ID NO: 1523832 - protein, 23 aa, Mycobacterium tuberculosis
GGRPDELTLIAPASARLLVASAL

SEQ ID NO: 1523833 - protein, 24 aa, Mycobacterium tuberculosis
GGRPDELTLIAPASARLLVASALA

SEQ ID NO: 1523834 - protein, 19 aa, Mycobacterium tuberculosis
GGRPWVPARVPVPFPPRHA

SEQ ID NO: 1523835 - protein, 24 aa, Mycobacterium tuberculosis
GGRRRRHLALLLRPRHCRGPVWWR

SEQ ID NO: 1523836 - protein, 19 aa, Mycobacterium tuberculosis
GGRSKLLRCQAPAVPAAPA

SEQ ID NO: 1523837 - protein, 32 aa, Mycobacterium tuberculosis
GGRVLMDTWYRIPAFYFACPSTVLGPYDDAPT

SEQ ID NO: 1523838 - protein, 17 aa, Mycobacterium tuberculosis
GGRWPDHPKFHGPKGIG

SEQ ID NO: 1523839 - protein, 21 aa, Mycobacterium tuberculosis
GGSAMLFGAGGAGGAGGAATS

SEQ ID NO: 1523840 - protein, 28 aa, Mycobacterium tuberculosis
GGSAVRLVRQIPYTLACDLLLTGRHITA

SEQ ID NO: 1523841 - protein, 25 aa, Mycobacterium tuberculosis
GGSELDELRCRRARWVRARKEPIRT

SEQ ID NO: 1523842 - protein, 26 aa, Mycobacterium tuberculosis
GGSGGAGGMLYGAGGVGGNGGAAVAI

SEQ ID NO: 1523843 - protein, 18 aa, Mycobacterium tuberculosis
GGSGGLGGLLFGQTGTAG

SEQ ID NO: 1523844 - protein, 23 aa, Mycobacterium tuberculosis
GGSGGSALLWGDGGAGGAGGVGS

SEQ ID NO: 1523845 - protein, 24 aa, Mycobacterium tuberculosis
GGSGGSALLWGDGGAGGAGGVGST

SEQ ID NO: 1523846 - protein, 21 aa, Mycobacterium tuberculosis
GGSGGSLFGFGGAGGTGGSSG

SEQ ID NO: 1523847 - protein, 23 aa, Mycobacterium tuberculosis
GGSGGSLFGFGGAGGTGGSSGIG

SEQ ID NO: 1523848 - protein, 23 aa, Mycobacterium tuberculosis
GGSGRAVLCFFFCDLRAPTARLW

SEQ ID NO: 1523849 - protein, 25 aa, Mycobacterium tuberculosis
GGSLTRTPLMSQLIEKPVAPSVMPA

SEQ ID NO: 1523850 - protein, 32 aa, Mycobacterium tuberculosis
GGSLWLDPQMTSPYAWYQYFVNTADADVIRYL

SEQ ID NO: 1523851 - protein, 26 aa, Mycobacterium tuberculosis
GGSNRRRRRRCGRSRWGGLAGRQRRC

SEQ ID NO: 1523852 - protein, 23 aa, Mycobacterium tuberculosis
GGSPTVHIGPTAFLGLGVVDNNG

SEQ ID NO: 1523853 - protein, 24 aa, Mycobacterium tuberculosis
GGSTLFGRWELCALMQTVAELAEA

SEQ ID NO: 1523854 - protein, 19 aa, Mycobacterium tuberculosis
GGTAGLLGSGGSGGTGGDG

SEQ ID NO: 1523855 - protein, 21 aa, Mycobacterium tuberculosis
GGTEVTLRFPDGEVVTMHVIS

SEQ ID NO: 1523856 - protein, 24 aa, Mycobacterium tuberculosis
GGTFLQRAIFHLPGLTAAVDELQR

SEQ ID NO: 1523857 - protein, 17 aa, Mycobacterium tuberculosis
GGTGFNPGAPGDPGTQG

SEQ ID NO: 1523858 - protein, 20 aa, Mycobacterium tuberculosis
GGTGGIGGTGAPGAMGGTGG

SEQ ID NO: 1523859 - protein, 21 aa, Mycobacterium tuberculosis
GGTGGIGGTGAPGAMGGTGGN

SEQ ID NO: 1523860 - protein, 23 aa, Mycobacterium tuberculosis
GGTGGLLAGLIGAGGGHGGTGGL

SEQ ID NO: 1523861 - protein, 21 aa, Mycobacterium tuberculosis
GGTGGLLFGAGGNGGPGGSGG

SEQ ID NO: 1523862 - protein, 23 aa, Mycobacterium tuberculosis
GGTGGLRRQKAALGGLRWRRRGP

SEQ ID NO: 1523863 - protein, 25 aa, Mycobacterium tuberculosis
GGTGGNGALLFGFGGAGGAGGHGGA

SEQ ID NO: 1523864 - protein, 26 aa, Mycobacterium tuberculosis
GGTGGNGALLFGFGGAGGAGGHGGAA

SEQ ID NO: 1523865 - protein, 21 aa, Mycobacterium tuberculosis
GGTGGSAGWLSGNGGAGGSGG

SEQ ID NO: 1523866 - protein, 28 aa, Mycobacterium tuberculosis
GGTGGSGGFGAPPPRSIGGGDGGDGGRG

SEQ ID NO: 1523867 - protein, 24 aa, Mycobacterium tuberculosis
GGTGGTNFAGGQGGAGGRGGAGGN

SEQ ID NO: 1523868 - protein, 24 aa, Mycobacterium tuberculosis
GGTGGVLLGLDGFTAPASTSLRDA

SEQ ID NO: 1523869 - protein, 26 aa, Mycobacterium tuberculosis
GGTGGVLLGLDGFTAPASTSPLHTLQ

SEQ ID NO: 1523870 - protein, 21 aa, Mycobacterium tuberculosis
GGTGGWLFGNGGAGGTGGAVT

SEQ ID NO: 1523871 - protein, 19 aa, Mycobacterium tuberculosis
GGTGGYIESLDGKGQAGNG

SEQ ID NO: 1523872 - protein, 18 aa, Mycobacterium tuberculosis
GGTGLMPGINGTGGAGGS

SEQ ID NO: 1523873 - protein, 18 aa, Mycobacterium tuberculosis
GGTLCCALANRLRITKPD

SEQ ID NO: 1523874 - protein, 20 aa, Mycobacterium tuberculosis
GGTLCCALANRLRITKPEAG

SEQ ID NO: 1523875 - protein, 20 aa, Mycobacterium tuberculosis
GGTLTVRRRAGRLANLEEAV

SEQ ID NO: 1523876 - protein, 21 aa, Mycobacterium tuberculosis
GGTNFAGGQGGAGGRGGAGGN

SEQ ID NO: 1523877 - protein, 18 aa, Mycobacterium tuberculosis
GGTNPPTGLQAAGGNGGS

SEQ ID NO: 1523878 - protein, 19 aa, Mycobacterium tuberculosis
GGTWDLFRYPGIRSDSDMY

SEQ ID NO: 1523879 - protein, 23 aa, Mycobacterium tuberculosis
GGTWTPPRRWAPSTSPPPDVRYG

SEQ ID NO: 1523880 - protein, 20 aa, Mycobacterium tuberculosis
GGVCGLGFDAGGAGGAGGKA

SEQ ID NO: 1523881 - protein, 27 aa, Mycobacterium tuberculosis
GGVDSTALYPPKRFLGAARNIEEGGSL

SEQ ID NO: 1523882 - protein, 27 aa, Mycobacterium tuberculosis
GGVGAFLNALFAGPAKMLRLNAGLGNV

SEQ ID NO: 1523883 - protein, 26 aa, Mycobacterium tuberculosis
GGVGGAGGLLFGYGGAGGAGGYSNIG

SEQ ID NO: 1523884 - protein, 18 aa, Mycobacterium tuberculosis
GGVGGLGFDAGGAGGAGG

SEQ ID NO: 1523885 - protein, 25 aa, Mycobacterium tuberculosis
GGVGGRGGWLLGNGGTGGAGGAAGA

SEQ ID NO: 1523886 - protein, 34 aa, Mycobacterium tuberculosis
GGVGPITVLPIQILPTIPLNIHQTFSLGPLVVPD

SEQ ID NO: 1523887 - protein, 20 aa, Mycobacterium tuberculosis
GGVGSILGGPGGNGGTGGNA

SEQ ID NO: 1523888 - protein, 24 aa, Mycobacterium tuberculosis
GGVGWTTRRFGLSCDNLVAVRLVT

SEQ ID NO: 1523889 - protein, 25 aa, Mycobacterium tuberculosis
GGVPVVMKALLDAGLLHGDCLTVTG

SEQ ID NO: 1523890 - protein, 19 aa, Mycobacterium tuberculosis
GGVQALRIWGAGATGSRLV

SEQ ID NO: 1523891 - protein, 20 aa, Mycobacterium tuberculosis
GGVRALNPLFGTENLRRIEP

SEQ ID NO: 1523892 - protein, 22 aa, Mycobacterium tuberculosis
GGVRALNPLFGTENLRRIEPLL

SEQ ID NO: 1523893 - protein, 18 aa, Mycobacterium tuberculosis
GGVSLLIGSGGTGGNGGN

SEQ ID NO: 1523894 - protein, 25 aa, Mycobacterium tuberculosis
GGYCGYLLNNLTTSGFRPATFAAIV

SEQ ID NO: 1523895 - protein, 26 aa, Mycobacterium tuberculosis
GGYCGYLLYNLTTSGFRPATFAAIFD

SEQ ID NO: 1523896 - protein, 26 aa, Mycobacterium tuberculosis
GGYCGYLPYNLTTSGFRPATFAAIVD

SEQ ID NO: 1523897 - protein, 17 aa, Mycobacterium tuberculosis
GGYFESRSLTRLAGRLL

SEQ ID NO: 1523898 - protein, 27 aa, Mycobacterium tuberculosis
GGYGGSGGRGGLLLGTGGAGGDGGVGG

SEQ ID NO: 1523899 - protein, 20 aa, Mycobacterium tuberculosis
GGYGYMREYPVARAYLDSRV

SEQ ID NO: 1523900 - protein, 21 aa, Mycobacterium tuberculosis
GGYSLPAIPLGIDVGGGLGPF

SEQ ID NO: 1523901 - protein, 24 aa, Mycobacterium tuberculosis
GGYVALPAYLAARGLPLPPRRRRR

SEQ ID NO: 1523902 - protein, 33 aa, Mycobacterium tuberculosis
GHADSVVIPFLLLDIPVVAWWPDIAPAVPAQDA

SEQ ID NO: 1523903 - protein, 34 aa, Mycobacterium tuberculosis
GHADSVVIPFLLPDIPVVAWWPDIAPAVPAQDAL

SEQ ID NO: 1523904 - protein, 22 aa, Mycobacterium tuberculosis
GHDYTWFVLNAKIIEKEFALSG

SEQ ID NO: 1523905 - protein, 23 aa, Mycobacterium tuberculosis
GHEWDLVVIAGLQDGLWPNTVPR

SEQ ID NO: 1523906 - protein, 22 aa, Mycobacterium tuberculosis
GHFALVTGILDWLARPARIVVV

SEQ ID NO: 1523907 - protein, 17 aa, Mycobacterium tuberculosis
GHFTLVFANADDPGTLV

SEQ ID NO: 1523908 - protein, 22 aa, Mycobacterium tuberculosis
GHGGAGGLIWGNGGAGGNGGNG

SEQ ID NO: 1523909 - protein, 26 aa, Mycobacterium tuberculosis
GHGGAGGWLYGNGGAGGFGGAGAVGG

SEQ ID NO: 1523910 - protein, 20 aa, Mycobacterium tuberculosis
GHGGLWIGNGGDGGAGVSAV

SEQ ID NO: 1523911 - protein, 19 aa, Mycobacterium tuberculosis
GHGGSAAKLFGDGGAGGAG

SEQ ID NO: 1523912 - protein, 18 aa, Mycobacterium tuberculosis
GHGGSVLSGPVGDSGNGG

SEQ ID NO: 1523913 - protein, 25 aa, Mycobacterium tuberculosis
GHGHAWTSITYLVLDDAARLPALQN

SEQ ID NO: 1523914 - protein, 23 aa, Mycobacterium tuberculosis
GHGQAPAALLGGDGLIPAELVAE

SEQ ID NO: 1523915 - protein, 21 aa, Mycobacterium tuberculosis
GHICPISMTYAVVPALRYNSE

SEQ ID NO: 1523916 - protein, 21 aa, Mycobacterium tuberculosis
GHLAGRLAGLARDLTAPPVWF

SEQ ID NO: 1523917 - protein, 17 aa, Mycobacterium tuberculosis
GHLPLAEESGTIAPQLV

SEQ ID NO: 1523918 - protein, 20 aa, Mycobacterium tuberculosis
GHLRLVDLCERLGLAKSTTR

SEQ ID NO: 1523919 - protein, 18 aa, Mycobacterium tuberculosis
GHLTRYLARRWPGAVIEA

SEQ ID NO: 1523920 - protein, 25 aa, Mycobacterium tuberculosis
GHNGLTAAVLLQRAGLRTACLDAKR

SEQ ID NO: 1523921 - protein, 47 aa, Mycobacterium tuberculosis
GHPGARRTRRVRRAWRPAVRPNRHGWRVAVAGRLAASAALASSQTSR

SEQ ID NO: 1523922 - protein, 20 aa, Mycobacterium tuberculosis
GHPLGYIATDVYARYFRMWA

SEQ ID NO: 1523923 - protein, 23 aa, Mycobacterium tuberculosis
GHPRLGHNLALHPATMLAGLFDD

SEQ ID NO: 1523924 - protein, 26 aa, Mycobacterium tuberculosis
GHQGGQGAALIGLGTGGAGGAGGATV

SEQ ID NO: 1523925 - protein, 17 aa, Mycobacterium tuberculosis
GHRVLTRCQMSFVVTIP

SEQ ID NO: 1523926 - protein, 23 aa, Mycobacterium tuberculosis
GHRYRWLRGTGLLAAAACAGFFR

SEQ ID NO: 1523927 - protein, 21 aa, Mycobacterium tuberculosis
GHSPLVLWALGPARLDEVAPR

SEQ ID NO: 1523928 - protein, 19 aa, Mycobacterium tuberculosis
GHTEWLPPPHLDHGQPWTN

SEQ ID NO: 1523929 - protein, 19 aa, Mycobacterium tuberculosis
GHVIYRTELYERATAQRFA

SEQ ID NO: 1523930 - protein, 20 aa, Mycobacterium tuberculosis
GHVLLPGFVDLHTHLREPGR

SEQ ID NO: 1523931 - protein, 24 aa, Mycobacterium tuberculosis
GHYDAEWIIILDDWTDGIGKSPQQ

SEQ ID NO: 1523932 - protein, 28 aa, Mycobacterium tuberculosis
GIAAVHRLVTRLGLVTRLGLVERVDAHS

SEQ ID NO: 1523933 - protein, 17 aa, Mycobacterium tuberculosis
GIAQLFGTGGMGGSGGG

SEQ ID NO: 1523934 - protein, 17 aa, Mycobacterium tuberculosis
GIAQRKAVRPALHGSVE

SEQ ID NO: 1523935 - protein, 20 aa, Mycobacterium tuberculosis
GIARFDSPDPEAEPDVVGGK

SEQ ID NO: 1523936 - protein, 18 aa, Mycobacterium tuberculosis
GIARRTLFRYYASKNAIS

SEQ ID NO: 1523937 - protein, 18 aa, Mycobacterium tuberculosis
GIATHVAAFWAHGGRPPV

SEQ ID NO: 1523938 - protein, 26 aa, Mycobacterium tuberculosis
GIDFTNIYFYTVLYHALRASNRIAIE

SEQ ID NO: 1523939 - protein, 17 aa, Mycobacterium tuberculosis
GIELTKRTLWSGLDAAS

SEQ ID NO: 1523940 - protein, 38 aa, Mycobacterium tuberculosis
GIEQIQLGLIGMQLALTELWCSYGVRPDLVIGHSMGEV

SEQ ID NO: 1523941 - protein, 26 aa, Mycobacterium tuberculosis
GIEVVDAPWAPFAVDFHLANVGGPSA

SEQ ID NO: 1523942 - protein, 17 aa, Mycobacterium tuberculosis
GIGGAGGLLFGSGGAGG

SEQ ID NO: 1523943 - protein, 48 aa, Mycobacterium tuberculosis
GIGIPINIGPLTIIPITLFAQQTFVNQLPFPTFSLGKITIPQIQTFDS

SEQ ID NO: 1523944 - protein, 19 aa, Mycobacterium tuberculosis
GIGNIGVPGTLFGSVRSGL

SEQ ID NO: 1523945 - protein, 33 aa, Mycobacterium tuberculosis
GIGNMLTGLLLGLPTVIYPLGAFDPGQLLDVLE

SEQ ID NO: 1523946 - protein, 30 aa, Mycobacterium tuberculosis
GIGPIVIPDTTILPPLHLQITGDADYSFTV

SEQ ID NO: 1523947 - protein, 33 aa, Mycobacterium tuberculosis
GIGVELARGLAGRGFPLMLVARRRERLDELADQ

SEQ ID NO: 1523948 - protein, 18 aa, Mycobacterium tuberculosis
GIIIAGFDRRRIPLVAEI

SEQ ID NO: 1523949 - protein, 24 aa, Mycobacterium tuberculosis
GIISRRRYHTLRGARPTRPPPPML

SEQ ID NO: 1523950 - protein, 21 aa, Mycobacterium tuberculosis
GILAAVKRLYLLGKNDRPTGT

SEQ ID NO: 1523951 - protein, 19 aa, Mycobacterium tuberculosis
GILAPLQPFQATAVIPVIG

SEQ ID NO: 1523952 - protein, 20 aa, Mycobacterium tuberculosis
GILAPLQPFQATAVIPVIGP

SEQ ID NO: 1523953 - protein, 21 aa, Mycobacterium tuberculosis
GILSGTVLAPVGPITLHGGDA

SEQ ID NO: 1523954 - protein, 22 aa, Mycobacterium tuberculosis
GILSGTVLAPVGPITLHGGDAS

SEQ ID NO: 1523955 - protein, 30 aa, Mycobacterium tuberculosis
GIPAVTFWAAVPHYVSHPPNPKATIALLRR

SEQ ID NO: 1523956 - protein, 21 aa, Mycobacterium tuberculosis
GIPGFTLFPDGLTFPKIPVHV

SEQ ID NO: 1523957 - protein, 20 aa, Mycobacterium tuberculosis
GIPLRYDLDSAMRPLVRGGT

SEQ ID NO: 1523958 - protein, 24 aa, Mycobacterium tuberculosis
GIPTHVAAFWANGGRPPVGVTVFV

SEQ ID NO: 1523959 - protein, 19 aa, Mycobacterium tuberculosis
GIQIPRFCDHPLLEPVGAC

SEQ ID NO: 1523960 - protein, 18 aa, Mycobacterium tuberculosis
GIRAARRCRWCQRGGKQP

SEQ ID NO: 1523961 - protein, 17 aa, Mycobacterium tuberculosis
GIRAQLLERFGMFGIRM

SEQ ID NO: 1523962 - protein, 18 aa, Mycobacterium tuberculosis
GISFLLNRNRLNVAVSRA

SEQ ID NO: 1523963 - protein, 24 aa, Mycobacterium tuberculosis
GISHPASIAALRRGRGALVTQQRG

SEQ ID NO: 1523964 - protein, 18 aa, Mycobacterium tuberculosis
GISIPNNPLALLASASIG

SEQ ID NO: 1523965 - protein, 19 aa, Mycobacterium tuberculosis
GISVVMIARPLLPAGVAAV

SEQ ID NO: 1523966 - protein, 19 aa, Mycobacterium tuberculosis
GITDLITTPGLINVDFADV

SEQ ID NO: 1523967 - protein, 23 aa, Mycobacterium tuberculosis
GITIAYFESKLPAGTPVVRAMPN

SEQ ID NO: 1523968 - protein, 17 aa, Mycobacterium tuberculosis
GITKASLATDSWLSAAS

SEQ ID NO: 1523969 - protein, 17 aa, Mycobacterium tuberculosis
GITLFGRPTMTTPFIVE

SEQ ID NO: 1523970 - protein, 20 aa, Mycobacterium tuberculosis
GITVANMPNLFFLLGPNTGL

SEQ ID NO: 1523971 - protein, 27 aa, Mycobacterium tuberculosis
GIVGPQRDYWILQLGGLAGETGLRPDF

SEQ ID NO: 1523972 - protein, 31 aa, Mycobacterium tuberculosis
GIYSETAFDQAYLATLLGFPLVESADLVVRD

SEQ ID NO: 1523973 - protein, 20 aa, Mycobacterium tuberculosis
GKADIANSLGDNATVTGGNG

SEQ ID NO: 1523974 - protein, 20 aa, Mycobacterium tuberculosis
GKAGLLIGAGGAGGAGGGSF

SEQ ID NO: 1523975 - protein, 25 aa, Mycobacterium tuberculosis
GKARLVGAMSVPPTWEGSVPARMAS

SEQ ID NO: 1523976 - protein, 27 aa, Mycobacterium tuberculosis
GKEGHEVLIFRLFHAPPPSVCSRRRVR

SEQ ID NO: 1523977 - protein, 22 aa, Mycobacterium tuberculosis
GKGGASGMLIGNGGNGGSGGVG

SEQ ID NO: 1523978 - protein, 25 aa, Mycobacterium tuberculosis
GKGGDGFGVFGKGGAGGTGGRGGAA

SEQ ID NO: 1523979 - protein, 25 aa, Mycobacterium tuberculosis
GKGTLFRRFGSRAGLMMVLLDEDER

SEQ ID NO: 1523980 - protein, 21 aa, Mycobacterium tuberculosis
GKHVLIIFDDLTKQAEAYRAI

SEQ ID NO: 1523981 - protein, 24 aa, Mycobacterium tuberculosis
GKIYVRFPEAVSMRQYLGAPHGEL

SEQ ID NO: 1523982 - protein, 20 aa, Mycobacterium tuberculosis
GKLARVLVADGRRVVLGAAD

SEQ ID NO: 1523983 - protein, 32 aa, Mycobacterium tuberculosis
GKPADILRPVADRLWYPLWDANIRLDHSVRTV

SEQ ID NO: 1523984 - protein, 17 aa, Mycobacterium tuberculosis
GKPELWVEFPHGASLCS

SEQ ID NO: 1523985 - protein, 28 aa, Mycobacterium tuberculosis
GKPEQNAWWWDVLKFGRSSAYAEFFDID

SEQ ID NO: 1523986 - protein, 23 aa, Mycobacterium tuberculosis
GKPLEVVVFHHRPERYQFSVTLP

SEQ ID NO: 1523987 - protein, 26 aa, Mycobacterium tuberculosis
GKPVVRRRILLPEHKDFGRIAPDEKT

SEQ ID NO: 1523988 - protein, 26 aa, Mycobacterium tuberculosis
GKREVMMVHTLLWPDEIRDPDFPVLD

SEQ ID NO: 1523989 - protein, 17 aa, Mycobacterium tuberculosis
GKRLHRVLGPLAHVNLI

SEQ ID NO: 1523990 - protein, 24 aa, Mycobacterium tuberculosis
GKSQLLNSLLNLPAARVGDDEATV

SEQ ID NO: 1523991 - protein, 26 aa, Mycobacterium tuberculosis
GKSTLLLEVAHRWAQSGRRALYVSGE

SEQ ID NO: 1523992 - protein, 24 aa, Mycobacterium tuberculosis
GKSVFLKSLIGLLRPERGSIIIDG

SEQ ID NO: 1523993 - protein, 21 aa, Mycobacterium tuberculosis
GKSVLLNIFPSVDTPVCATSV

SEQ ID NO: 1523994 - protein, 22 aa, Mycobacterium tuberculosis
GKTAAFAIPMLSKIDITSKVPQ

SEQ ID NO: 1523995 - protein, 23 aa, Mycobacterium tuberculosis
GKTAAFAIPMLSKIDITSKVPQA

SEQ ID NO: 1523996 - protein, 23 aa, Mycobacterium tuberculosis
GKTMLAQRLPGLLPSLSGSESLE

SEQ ID NO: 1523997 - protein, 20 aa, Mycobacterium tuberculosis
GKTMVVTGLHLLGGARADAT

SEQ ID NO: 1523998 - protein, 30 aa, Mycobacterium tuberculosis
GKTRGFPLGPGYLLDGLPVILTAPRCAAAA

SEQ ID NO: 1523999 - protein, 27 aa, Mycobacterium tuberculosis
GKTTLIEALLVAAKVLSRPGSVTEGTT

SEQ ID NO: 1524000 - protein, 18 aa, Mycobacterium tuberculosis
GKVGRPRGYAVDEIQGLE

SEQ ID NO: 1524001 - protein, 31 aa, Mycobacterium tuberculosis
GKVLPAMLKRQLQLLLPLVEDRFVESVCLSN

SEQ ID NO: 1524002 - protein, 30 aa, Mycobacterium tuberculosis
GKVLPAMLKRQLQLLLPLVEDRFVETVCLS

SEQ ID NO: 1524003 - protein, 24 aa, Mycobacterium tuberculosis
GLAAELLRRLPFELTAGQREVLDV

SEQ ID NO: 1524004 - protein, 20 aa, Mycobacterium tuberculosis
GLADIEWTVQLLQLQHAHQV

SEQ ID NO: 1524005 - protein, 24 aa, Mycobacterium tuberculosis
GLAERLMEFFGGIPILDGIGSTEV

SEQ ID NO: 1524006 - protein, 18 aa, Mycobacterium tuberculosis
GLAGGRRFPGKPGVPPAS

SEQ ID NO: 1524007 - protein, 18 aa, Mycobacterium tuberculosis
GLAGLVITPGYDLCYLIG

SEQ ID NO: 1524008 - protein, 24 aa, Mycobacterium tuberculosis
GLAKPAGIYQLTDANWMAIMGDRT

SEQ ID NO: 1524009 - protein, 17 aa, Mycobacterium tuberculosis
GLALKWRWRQRVGSWKG

SEQ ID NO: 1524010 - protein, 21 aa, Mycobacterium tuberculosis
GLANAVRALAARLGIPAQVAH

SEQ ID NO: 1524011 - protein, 18 aa, Mycobacterium tuberculosis
GLARGGVPVGWEVASALG

SEQ ID NO: 1524012 - protein, 24 aa, Mycobacterium tuberculosis
GLASTDQLYFASGLLDCPGAMFTA

SEQ ID NO: 1524013 - protein, 24 aa, Mycobacterium tuberculosis
GLAVQPMSPIFLYARGRHDLDQAS

SEQ ID NO: 1524014 - protein, 20 aa, Mycobacterium tuberculosis
GLCIVLPGPFQRFAERRRAR

SEQ ID NO: 1524015 - protein, 21 aa, Mycobacterium tuberculosis
GLCPLDWCAWRHAGYPPSDGP

SEQ ID NO: 1524016 - protein, 25 aa, Mycobacterium tuberculosis
GLDGFLERPGIAAYLRLGYGPQTAE

SEQ ID NO: 1524017 - protein, 23 aa, Mycobacterium tuberculosis
GLDPVLRVELWDRFTALARRGTT

SEQ ID NO: 1524018 - protein, 24 aa, Mycobacterium tuberculosis
GLDPVLRVELWDRFTALARRGTTL

SEQ ID NO: 1524019 - protein, 44 aa, Mycobacterium tuberculosis
GLDRPAATHRPGWLEFPTPALDPPLRLRACLRRRRLAARRHPGA

SEQ ID NO: 1524020 - protein, 45 aa, Mycobacterium tuberculosis
GLDRPAATHRPGWLEFPTPALDPPLRLRACLRRRRLAARRHPGAQ

SEQ ID NO: 1524021 - protein, 29 aa, Mycobacterium tuberculosis
GLDSRAFRLQWPIGTTIFELDRPQVLDFK

SEQ ID NO: 1524022 - protein, 26 aa, Mycobacterium tuberculosis
GLDVTIVRPFNIFGVRQKAGRFGALI

SEQ ID NO: 1524023 - protein, 31 aa, Mycobacterium tuberculosis
GLDYDDYVYPGHAIWWLARGLEFFQDGEQFG

SEQ ID NO: 1524024 - protein, 17 aa, Mycobacterium tuberculosis
GLDYVAGFLGALCAGWT

SEQ ID NO: 1524025 - protein, 23 aa, Mycobacterium tuberculosis
GLEDKTWLTVPTIIIVMTDEETC

SEQ ID NO: 1524026 - protein, 17 aa, Mycobacterium tuberculosis
GLEPPLNYAALAADIRK

SEQ ID NO: 1524027 - protein, 24 aa, Mycobacterium tuberculosis
GLEQRLRALDYPKVVIGVSGGLDS

SEQ ID NO: 1524028 - protein, 26 aa, Mycobacterium tuberculosis
GLEYIIAFMGVLQAGLIAVPLPVPQF

SEQ ID NO: 1524029 - protein, 17 aa, Mycobacterium tuberculosis
GLFAVLVGQHMQIADVQ

SEQ ID NO: 1524030 - protein, 17 aa, Mycobacterium tuberculosis
GLFAVNGILFNHESPRR

SEQ ID NO: 1524031 - protein, 31 aa, Mycobacterium tuberculosis
GLFDPRLKRPIPYLPNMIGLITGRASAAERD

SEQ ID NO: 1524032 - protein, 26 aa, Mycobacterium tuberculosis
GLFGSWHYWWQAHLLDCLVDAQLRDP

SEQ ID NO: 1524033 - protein, 18 aa, Mycobacterium tuberculosis
GLFNTPIGLTPLALSQIV

SEQ ID NO: 1524034 - protein, 19 aa, Mycobacterium tuberculosis
GLFQLGQLQHRHRQWRNGQ

SEQ ID NO: 1524035 - protein, 25 aa, Mycobacterium tuberculosis
GLFRQRRQRRVPAQPGQAVGAGGAA

SEQ ID NO: 1524036 - protein, 20 aa, Mycobacterium tuberculosis
GLGCDLAHAHKLVYSTGVVL

SEQ ID NO: 1524037 - protein, 26 aa, Mycobacterium tuberculosis
GLGDPTPFRPVISACGWPPKSWACLH

SEQ ID NO: 1524038 - protein, 21 aa, Mycobacterium tuberculosis
GLGFLGERAVNVLRLNLALDR

SEQ ID NO: 1524039 - protein, 17 aa, Mycobacterium tuberculosis
GLGGFAGLAGLANRIVD

SEQ ID NO: 1524040 - protein, 25 aa, Mycobacterium tuberculosis
GLGGGSFGLPGLNGSGIHGGDGGNG

SEQ ID NO: 1524041 - protein, 27 aa, Mycobacterium tuberculosis
GLGGHGGAGGLLIGNGGAGGAGGLGGA

SEQ ID NO: 1524042 - protein, 28 aa, Mycobacterium tuberculosis
GLGGHGGAGGLLIGNGGAGGAGGLGGAG

SEQ ID NO: 1524043 - protein, 18 aa, Mycobacterium tuberculosis
GLGGLLLGNGGAGGVGGT

SEQ ID NO: 1524044 - protein, 25 aa, Mycobacterium tuberculosis
GLGNLGSYNFGFGNAGDFNLGFANS

SEQ ID NO: 1524045 - protein, 26 aa, Mycobacterium tuberculosis
GLGNLGSYNFGFGNAGDFNLGFANTG

SEQ ID NO: 1524046 - protein, 24 aa, Mycobacterium tuberculosis
GLGRSLFGARRRSVLSTVGASGAT

SEQ ID NO: 1524047 - protein, 19 aa, Mycobacterium tuberculosis
GLGTFSWPGAYGTWWQADP

SEQ ID NO: 1524048 - protein, 17 aa, Mycobacterium tuberculosis
GLGYFRKSLEDIIRFQA

SEQ ID NO: 1524049 - protein, 19 aa, Mycobacterium tuberculosis
GLHMWLAEYPQPRPPRETW

SEQ ID NO: 1524050 - protein, 19 aa, Mycobacterium tuberculosis
GLIAPLRPDRYLRIVAAMR

SEQ ID NO: 1524051 - protein, 27 aa, Mycobacterium tuberculosis
GLIARGQRRWRWCRRSGRRGWRRRHRR

SEQ ID NO: 1524052 - protein, 17 aa, Mycobacterium tuberculosis
GLIAVPLPVPQFGIHDE

SEQ ID NO: 1524053 - protein, 19 aa, Mycobacterium tuberculosis
GLIDITRFWFEQGSLSNER

SEQ ID NO: 1524054 - protein, 28 aa, Mycobacterium tuberculosis
GLIDPDAWAFVWVVDPPLFEPADEATAA

SEQ ID NO: 1524055 - protein, 34 aa, Mycobacterium tuberculosis
GLIGNERQRWSRRRGYHRRGRWSRRRGRVAVWQR

SEQ ID NO: 1524056 - protein, 35 aa, Mycobacterium tuberculosis
GLIKAILSLRHGVVPPLLHFNRLPDELPTSRPGSL

SEQ ID NO: 1524057 - protein, 28 aa, Mycobacterium tuberculosis
GLIKVILSLRHGVVPPLLHFNRLPDELS

SEQ ID NO: 1524058 - protein, 17 aa, Mycobacterium tuberculosis
GLITNMRGYWNLDMMTF

SEQ ID NO: 1524059 - protein, 19 aa, Mycobacterium tuberculosis
GLIYPRHRALKAASGQSRP

SEQ ID NO: 1524060 - protein, 26 aa, Mycobacterium tuberculosis
GLKGLHEFFTPVLRNLGRCGRVVVVG

SEQ ID NO: 1524061 - protein, 26 aa, Mycobacterium tuberculosis
GLKPVHRRVLYAMFDSGFRPDRSHAK

SEQ ID NO: 1524062 - protein, 17 aa, Mycobacterium tuberculosis
GLLAWYAMIGSINNINS

SEQ ID NO: 1524063 - protein, 27 aa, Mycobacterium tuberculosis
GLLDNRPIGVLFKRIFDRPARRPVRRV

SEQ ID NO: 1524064 - protein, 21 aa, Mycobacterium tuberculosis
GLLEAAGYRRATDGSEADVVV

SEQ ID NO: 1524065 - protein, 18 aa, Mycobacterium tuberculosis
GLLIGPTEPIPRSLTIVV

SEQ ID NO: 1524066 - protein, 18 aa, Mycobacterium tuberculosis
GLLLLSHLEVINALGALE

SEQ ID NO: 1524067 - protein, 23 aa, Mycobacterium tuberculosis
GLLLRLRFELDHHINLRPARLYP

SEQ ID NO: 1524068 - protein, 21 aa, Mycobacterium tuberculosis
GLLMAPTYAVPRLLARNGLSL

SEQ ID NO: 1524069 - protein, 23 aa, Mycobacterium tuberculosis
GLLRPQVLWDELLAECKAAPGGD

SEQ ID NO: 1524070 - protein, 24 aa, Mycobacterium tuberculosis
GLLSTFIAALMGAEADALCGAGYR

SEQ ID NO: 1524071 - protein, 17 aa, Mycobacterium tuberculosis
GLLTALSARLRAVDPGR

SEQ ID NO: 1524072 - protein, 19 aa, Mycobacterium tuberculosis
GLLTIEDLAGYLAKRRQPL

SEQ ID NO: 1524073 - protein, 17 aa, Mycobacterium tuberculosis
GLLVPPSDRPWRLAMST

SEQ ID NO: 1524074 - protein, 17 aa, Mycobacterium tuberculosis
GLMRLGSAVAPLLQVGG

SEQ ID NO: 1524075 - protein, 18 aa, Mycobacterium tuberculosis
GLNLSIRDGWWDEWYDGE

SEQ ID NO: 1524076 - protein, 34 aa, Mycobacterium tuberculosis
GLNMLRLWDDRRTLEPWIAPLTKALNDGTSLPIV

SEQ ID NO: 1524077 - protein, 17 aa, Mycobacterium tuberculosis
GLPFGAGGAGGAGGFGF

SEQ ID NO: 1524078 - protein, 17 aa, Mycobacterium tuberculosis
GLPGDLTFSWYAVDKTG

SEQ ID NO: 1524079 - protein, 17 aa, Mycobacterium tuberculosis
GLPQLSSAPVWCSDIRA

SEQ ID NO: 1524080 - protein, 19 aa, Mycobacterium tuberculosis
GLPSLMVLTGVNSAWDAVY

SEQ ID NO: 1524081 - protein, 24 aa, Mycobacterium tuberculosis
GLPTAAIPAPWPVLATLPSGPELS

SEQ ID NO: 1524082 - protein, 18 aa, Mycobacterium tuberculosis
GLPVLGAKGAEYPLLPDE

SEQ ID NO: 1524083 - protein, 24 aa, Mycobacterium tuberculosis
GLPVPVTSRHTLLLGPPGTGKTSV

SEQ ID NO: 1524084 - protein, 21 aa, Mycobacterium tuberculosis
GLQAPQVPIPPPPPGPDVIPG

SEQ ID NO: 1524085 - protein, 24 aa, Mycobacterium tuberculosis
GLQAPQVPIPPPPPGPDVIPGPVP

SEQ ID NO: 1524086 - protein, 23 aa, Mycobacterium tuberculosis
GLQARLMSQALRKMTGALNNSGT

SEQ ID NO: 1524087 - protein, 20 aa, Mycobacterium tuberculosis
GLQHQLSRLTNQAWPVSMTG

SEQ ID NO: 1524088 - protein, 22 aa, Mycobacterium tuberculosis
GLQIMAPALADDRLYRVGAAYE

SEQ ID NO: 1524089 - protein, 20 aa, Mycobacterium tuberculosis
GLQLPLWGGLGEQDRLRARR

SEQ ID NO: 1524090 - protein, 17 aa, Mycobacterium tuberculosis
GLRAIFAELLGIAVPNL

SEQ ID NO: 1524091 - protein, 20 aa, Mycobacterium tuberculosis
GLRGLLRVISSEHPMLRTTL

SEQ ID NO: 1524092 - protein, 18 aa, Mycobacterium tuberculosis
GLRLARWQGLGILGPVAV

SEQ ID NO: 1524093 - protein, 20 aa, Mycobacterium tuberculosis
GLRPGALAIYPDGPTIAGDC

SEQ ID NO: 1524094 - protein, 26 aa, Mycobacterium tuberculosis
GLRPTPLTWPVVIAGDFLGVWDPPPS

SEQ ID NO: 1524095 - protein, 17 aa, Mycobacterium tuberculosis
GLRRIIAAELRVPEKEL

SEQ ID NO: 1524096 - protein, 26 aa, Mycobacterium tuberculosis
GLRRLRRCWRLWGAARAPPQVGRVGR

SEQ ID NO: 1524097 - protein, 22 aa, Mycobacterium tuberculosis
GLRTAANALPRRASRPWCGGQS

SEQ ID NO: 1524098 - protein, 25 aa, Mycobacterium tuberculosis
GLSESGWIPVDPRTLSTSADNVWAI

SEQ ID NO: 1524099 - protein, 25 aa, Mycobacterium tuberculosis
GLSINRFIAIDFVGFARMVEALGGV

SEQ ID NO: 1524100 - protein, 18 aa, Mycobacterium tuberculosis
GLSLPRTLIFDYPTASAL

SEQ ID NO: 1524101 - protein, 20 aa, Mycobacterium tuberculosis
GLSLPRTLIFDYPTASALAE

SEQ ID NO: 1524102 - protein, 20 aa, Mycobacterium tuberculosis
GLSRPATGLPLSLTMVTAAS

SEQ ID NO: 1524103 - protein, 18 aa, Mycobacterium tuberculosis
GLSRVLPIYPTVDTALGK

SEQ ID NO: 1524104 - protein, 23 aa, Mycobacterium tuberculosis
GLSRWTWPARWRCPSSTAASSRF

SEQ ID NO: 1524105 - protein, 21 aa, Mycobacterium tuberculosis
GLTASRFVACPFGGSGARMYR

SEQ ID NO: 1524106 - protein, 22 aa, Mycobacterium tuberculosis
GLTERRLLNYLISQLRLSEPER

SEQ ID NO: 1524107 - protein, 23 aa, Mycobacterium tuberculosis
GLTHKRRLLALGPGGLSRERAGL

SEQ ID NO: 1524108 - protein, 20 aa, Mycobacterium tuberculosis
GLTNTGAFNAGSLNTGFGAV

SEQ ID NO: 1524109 - protein, 20 aa, Mycobacterium tuberculosis
GLVAALRHRGLHAGWLSWDD

SEQ ID NO: 1524110 - protein, 24 aa, Mycobacterium tuberculosis
GLVDAPLLAAELWERGRIVQSLGD

SEQ ID NO: 1524111 - protein, 20 aa, Mycobacterium tuberculosis
GLVELALSAPTFQQLMQRAG

SEQ ID NO: 1524112 - protein, 24 aa, Mycobacterium tuberculosis
GLVITATPLRPGIWRAYADHRTAM

SEQ ID NO: 1524113 - protein, 17 aa, Mycobacterium tuberculosis
GLVLNAPAPRPLATHRL

SEQ ID NO: 1524114 - protein, 23 aa, Mycobacterium tuberculosis
GLVPRRIPSLPDLDGIRVLRSFD

SEQ ID NO: 1524115 - protein, 20 aa, Mycobacterium tuberculosis
GLVRVWYGVYAAQEPDLLGR

SEQ ID NO: 1524116 - protein, 25 aa, Mycobacterium tuberculosis
GLVTRSFSPRWRGLKADVVHVDPDP

SEQ ID NO: 1524117 - protein, 17 aa, Mycobacterium tuberculosis
GLVVVPVMFDRIMDLPA

SEQ ID NO: 1524118 - protein, 17 aa, Mycobacterium tuberculosis
GLWGYSGGGLASAWAAE

SEQ ID NO: 1524119 - protein, 22 aa, Mycobacterium tuberculosis
GLYGHKSTWRSVPLVGHIPSAP

SEQ ID NO: 1524120 - protein, 20 aa, Mycobacterium tuberculosis
GMAGALRYRAGQFAQLQVPG

SEQ ID NO: 1524121 - protein, 18 aa, Mycobacterium tuberculosis
GMAKLAFDVTPPAWLEPG

SEQ ID NO: 1524122 - protein, 17 aa, Mycobacterium tuberculosis
GMFFGSGGAGGAGGFGR

SEQ ID NO: 1524123 - protein, 21 aa, Mycobacterium tuberculosis
GMKKLRTWFAADKTGFHLLHT

SEQ ID NO: 1524124 - protein, 24 aa, Mycobacterium tuberculosis
GMKLFNTIWSDPETLPLPAEIENP

SEQ ID NO: 1524125 - protein, 20 aa, Mycobacterium tuberculosis
GMLAFRHIFLTLRPGEDTRP

SEQ ID NO: 1524126 - protein, 19 aa, Mycobacterium tuberculosis
GMMLSGIPNMAYTVGYTNA

SEQ ID NO: 1524127 - protein, 24 aa, Mycobacterium tuberculosis
GMMPALLDFWMDADSVYLSPAPMY

SEQ ID NO: 1524128 - protein, 17 aa, Mycobacterium tuberculosis
GMMSSPTGELFFDNVRL

SEQ ID NO: 1524129 - protein, 18 aa, Mycobacterium tuberculosis
GMPGLASATRSSAGFGAP

SEQ ID NO: 1524130 - protein, 18 aa, Mycobacterium tuberculosis
GMPMVPPGALGAGAEGAN

SEQ ID NO: 1524131 - protein, 28 aa, Mycobacterium tuberculosis
GMRDIRKHIAWYLHGFPAGSARRALAMV

SEQ ID NO: 1524132 - protein, 19 aa, Mycobacterium tuberculosis
GMRKPRMHGMPPITSGSMV

SEQ ID NO: 1524133 - protein, 28 aa, Mycobacterium tuberculosis
GMRREQPLPLGLRRLLTDLHIAGAAVDF

SEQ ID NO: 1524134 - protein, 27 aa, Mycobacterium tuberculosis
GMRREQPLPLGLRRLLTDLHNAGAAVD

SEQ ID NO: 1524135 - protein, 19 aa, Mycobacterium tuberculosis
GMSGIARILLDAAGWSPGQ

SEQ ID NO: 1524136 - protein, 22 aa, Mycobacterium tuberculosis
GMTADILGVPRTPGLPPMWRAV

SEQ ID NO: 1524137 - protein, 21 aa, Mycobacterium tuberculosis
GMVQFVPFFLGQEHAAVPDGH

SEQ ID NO: 1524138 - protein, 25 aa, Mycobacterium tuberculosis
GMVQFVPFFLGQRTPPYPTATSIQK

SEQ ID NO: 1524139 - protein, 32 aa, Mycobacterium tuberculosis
GNADWVRINGFGTPWWADDLAMLADSAVGGVM

SEQ ID NO: 1524140 - protein, 29 aa, Mycobacterium tuberculosis
GNAGDVNTGFWNGGPFNTGFGNGGNTNFG

SEQ ID NO: 1524141 - protein, 21 aa, Mycobacterium tuberculosis
GNAGIIANGSFAPSFVGFGGN

SEQ ID NO: 1524142 - protein, 24 aa, Mycobacterium tuberculosis
GNAGNINTGFWNAGNLNTGFGSAG

SEQ ID NO: 1524143 - protein, 20 aa, Mycobacterium tuberculosis
GNAGNVNTGFWNGGSTNTGL

SEQ ID NO: 1524144 - protein, 23 aa, Mycobacterium tuberculosis
GNAGVIANGSFAPSFVGFGGNGV

SEQ ID NO: 1524145 - protein, 20 aa, Mycobacterium tuberculosis
GNALWARLQPCVNWISQHWT

SEQ ID NO: 1524146 - protein, 19 aa, Mycobacterium tuberculosis
GNAQAYQALSAQAAAFHQQ

SEQ ID NO: 1524147 - protein, 26 aa, Mycobacterium tuberculosis
GNATSTSSIPFDAHGGNGGAGGDAGH

SEQ ID NO: 1524148 - protein, 17 aa, Mycobacterium tuberculosis
GNAVIPGDGVGKAPHGD

SEQ ID NO: 1524149 - protein, 21 aa, Mycobacterium tuberculosis
GNCENWLTQLKRRLSRSRTSS

SEQ ID NO: 1524150 - protein, 30 aa, Mycobacterium tuberculosis
GNDGRGYVLRRLLRRVIRSAKLLGIDAAIV

SEQ ID NO: 1524151 - protein, 18 aa, Mycobacterium tuberculosis
GNDGVNPAPVTNPALNGA

SEQ ID NO: 1524152 - protein, 26 aa, Mycobacterium tuberculosis
GNDYDLSSLFLLASTAALFSPSIKEK

SEQ ID NO: 1524153 - protein, 23 aa, Mycobacterium tuberculosis
GNEAIGPGGWLDGAGRPSPDLLG

SEQ ID NO: 1524154 - protein, 24 aa, Mycobacterium tuberculosis
GNERYQYLRNCRIGLRVPVTGTTG

SEQ ID NO: 1524155 - protein, 19 aa, Mycobacterium tuberculosis
GNFGVDGEAGFSGGAGGNG

SEQ ID NO: 1524156 - protein, 25 aa, Mycobacterium tuberculosis
GNFSNGVLWRGDYEGLWGLSGGSTI

SEQ ID NO: 1524157 - protein, 22 aa, Mycobacterium tuberculosis
GNGANGNFAFGDGNGGHGGNGG

SEQ ID NO: 1524158 - protein, 22 aa, Mycobacterium tuberculosis
GNGAPGGFGGGAGAGGLGGSGA

SEQ ID NO: 1524159 - protein, 25 aa, Mycobacterium tuberculosis
GNGATGPWLFGDGGPTPGSTGAGAA

SEQ ID NO: 1524160 - protein, 25 aa, Mycobacterium tuberculosis
GNGGAAGSLIGLGGGGGAGGVGGTG

SEQ ID NO: 1524161 - protein, 32 aa, Mycobacterium tuberculosis
GNGGAGGFGIPVGSGGAGGSRGVLFGTPGANG

SEQ ID NO: 1524162 - protein, 23 aa, Mycobacterium tuberculosis
GNGGAIFNAGTPGAAGTGGDGGV

SEQ ID NO: 1524163 - protein, 26 aa, Mycobacterium tuberculosis
GNGGDGGWLFGSGGNGAPGAAGQSGG

SEQ ID NO: 1524164 - protein, 24 aa, Mycobacterium tuberculosis
GNGGGAGLFYGFGGAGGNGGMGGV

SEQ ID NO: 1524165 - protein, 29 aa, Mycobacterium tuberculosis
GNGGGALNQAGFFGTGGKGGNGGNGGAGM

SEQ ID NO: 1524166 - protein, 18 aa, Mycobacterium tuberculosis
GNGGGRRGRRGRLNQGCH

SEQ ID NO: 1524167 - protein, 28 aa, Mycobacterium tuberculosis
GNGGHGGNAGLWGNGGAGGAGAAGAAGA

SEQ ID NO: 1524168 - protein, 19 aa, Mycobacterium tuberculosis
GNGGHSVLIGNGGNGGAGG

SEQ ID NO: 1524169 - protein, 17 aa, Mycobacterium tuberculosis
GNGGIGITVGGAGGAGG

SEQ ID NO: 1524170 - protein, 31 aa, Mycobacterium tuberculosis; identical to SEQ ID NO: 225120

SEQ ID NO: 1524171 - protein, 22 aa, Mycobacterium tuberculosis
GNGGLGGLLLGNGGAGGVGGTG

SEQ ID NO: 1524172 - protein, 25 aa, Mycobacterium tuberculosis
GNGGNANWFGSGGAGGQGGTGLAGT

SEQ ID NO: 1524173 - protein, 25 aa, Mycobacterium tuberculosis
GNGGNGALLIGAGGVGGAGGIGGQG

SEQ ID NO: 1524174 - protein, 24 aa, Mycobacterium tuberculosis
GNGGRAGLLLGVGGMGGNGGATSV

SEQ ID NO: 1524175 - protein, 23 aa, Mycobacterium tuberculosis
GNGGSAGLWGNGGAGGAGGSGGA

SEQ ID NO: 1524176 - protein, 24 aa, Mycobacterium tuberculosis
GNGGTAGLLFGAGGAGGAGGFGFG

SEQ ID NO: 1524177 - protein, 22 aa, Mycobacterium tuberculosis
GNGGVWYGNGGAGGAAGQGGPG

SEQ ID NO: 1524178 - protein, 20 aa, Mycobacterium tuberculosis
GNGGWLYGNGGLGGAAGLGN

SEQ ID NO: 1524179 - protein, 20 aa, Mycobacterium tuberculosis
GNGGWLYGNGGLGGNGGAAT

SEQ ID NO: 1524180 - protein, 19 aa, Mycobacterium tuberculosis
GNGGWLYGPGGLGGNGGAA

SEQ ID NO: 1524181 - protein, 18 aa, Mycobacterium tuberculosis
GNGLLFGAGGTGGAGTLG

SEQ ID NO: 1524182 - protein, 28 aa, Mycobacterium tuberculosis
GNGPLAAFVHALADVGFDVAVLDYYEHA

SEQ ID NO: 1524183 - protein, 28 aa, Mycobacterium tuberculosis
GNGRLPVATPVLLAMKNSIGGAGGTGGK

SEQ ID NO: 1524184 - protein, 28 aa, Mycobacterium tuberculosis
GNGSKGLPGLGRLGNPGLDGGTGGNGGA

SEQ ID NO: 1524185 - protein, 29 aa, Mycobacterium tuberculosis
GNGSKGLPGLGRLGNPGLDGGTGGNGGAG

SEQ ID NO: 1524186 - protein, 26 aa, Mycobacterium tuberculosis
GNGYEFRLLQIKFATLNITGDCFLLQ

SEQ ID NO: 1524187 - protein, 25 aa, Mycobacterium tuberculosis
GNGYYGGLQFTAGTWRANGGSGSAA

SEQ ID NO: 1524188 - protein, 18 aa, Mycobacterium tuberculosis
GNHRPLRREAEKLAALLT

SEQ ID NO: 1524189 - protein, 20 aa, Mycobacterium tuberculosis
GNIGLFNSGTNNVGFFNSGN

SEQ ID NO: 1524190 - protein, 19 aa, Mycobacterium tuberculosis
GNINTGFGNSGFINTGFGN

SEQ ID NO: 1524191 - protein, 17 aa, Mycobacterium tuberculosis
GNLGFANLGLTAGAAGV

SEQ ID NO: 1524192 - protein, 18 aa, Mycobacterium tuberculosis
GNLGFANLGLTAGAAGVG

SEQ ID NO: 1524193 - protein, 27 aa, Mycobacterium tuberculosis
GNLRSLPVPFILNQPPPPPGPVPAPGP

SEQ ID NO: 1524194 - protein, 17 aa, Mycobacterium tuberculosis
GNPGAITGSGGRGGDGG

SEQ ID NO: 1524195 - protein, 24 aa, Mycobacterium tuberculosis
GNPGQWYLHLFDTEQPDLNWDNPE

SEQ ID NO: 1524196 - protein, 25 aa, Mycobacterium tuberculosis
GNPGTITLTFAPNSLYRASLAIGAG

SEQ ID NO: 1524197 - protein, 33 aa, Mycobacterium tuberculosis
GNPSNVIGLSLPLLRSLVQRCGLSVAALWAGNA

SEQ ID NO: 1524198 - protein, 24 aa, Mycobacterium tuberculosis
GNQDWWPNRLNLKVLHQNPAVADP

SEQ ID NO: 1524199 - protein, 32 aa, Mycobacterium tuberculosis
GNQILGRALGLPTYKMVFGHRGINIPVVDHAT

SEQ ID NO: 1524200 - protein, 23 aa, Mycobacterium tuberculosis
GNQIWMRPHAVPGLRRLTEAIHA

SEQ ID NO: 1524201 - protein, 25 aa, Mycobacterium tuberculosis
GNQRLPTLTDLLYQLATRAVTSEEL

SEQ ID NO: 1524202 - protein, 25 aa, Mycobacterium tuberculosis
GNRHLRRIGHLPILHRYATVCKLIP

SEQ ID NO: 1524203 - protein, 20 aa, Mycobacterium tuberculosis
GNRLPWRTPLSLERHGRCGS

SEQ ID NO: 1524204 - protein, 22 aa, Mycobacterium tuberculosis
GNSLITSWRALGWIGSRGRRSC

SEQ ID NO: 1524205 - protein, 17 aa, Mycobacterium tuberculosis
GNSLRDTAFRTLDVCVR

SEQ ID NO: 1524206 - protein, 28 aa, Mycobacterium tuberculosis
GNSNEGFFNTGMFNNGIYNSGVASTGIA

SEQ ID NO: 1524207 - protein, 29 aa, Mycobacterium tuberculosis
GNSSVTQGGSGFFGGKGGFGGDGGQGGPN

SEQ ID NO: 1524208 - protein, 22 aa, Mycobacterium tuberculosis
GNSWPMARLTLALSPATLPKMG

SEQ ID NO: 1524209 - protein, 23 aa, Mycobacterium tuberculosis
GNSWPMARLTLALSPATLPKMGS

SEQ ID NO: 1524210 - protein, 18 aa, Mycobacterium tuberculosis
GNTGFFNAGSFNTGMLDV

SEQ ID NO: 1524211 - protein, 21 aa, Mycobacterium tuberculosis
GNTKAFLGERIGVRRGVVVDA

SEQ ID NO: 1524212 - protein, 28 aa, Mycobacterium tuberculosis
GNVADLLTPPLRVECWLCHGNWACNSLG

SEQ ID NO: 1524213 - protein, 19 aa, Mycobacterium tuberculosis
GNVFALYEPPAPPGMTDNP

SEQ ID NO: 1524214 - protein, 18 aa, Mycobacterium tuberculosis
GNYEGLAGFSFGYPIPLF

SEQ ID NO: 1524215 - protein, 30 aa, Mycobacterium tuberculosis
GPAAAAMAAAAPYAGWLSAAAARAAGAAAQ

SEQ ID NO: 1524216 - protein, 24 aa, Mycobacterium tuberculosis
GPAGMTGMPMVPPGALGAGAEGAN

SEQ ID NO: 1524217 - protein, 21 aa, Mycobacterium tuberculosis
GPAQTLLGRPLIGNGADGAPG

SEQ ID NO: 1524218 - protein, 26 aa, Mycobacterium tuberculosis
GPATIVPMFLLYDYSFLPEGANSKAE

SEQ ID NO: 1524219 - protein, 22 aa, Mycobacterium tuberculosis
GPAVATVWEDTALTGGAGDTRS

SEQ ID NO: 1524220 - protein, 22 aa, Mycobacterium tuberculosis
GPAYSIYDQLSGAFADPAGGTG

SEQ ID NO: 1524221 - protein, 26 aa, Mycobacterium tuberculosis
GPDGLALPMRLALPGSVNRGNAAQAV

SEQ ID NO: 1524222 - protein, 21 aa, Mycobacterium tuberculosis
GPDVWLAALATLPLVHQPGDR

SEQ ID NO: 1524223 - protein, 22 aa, Mycobacterium tuberculosis
GPDVWLAALATLPLVHQPGDRV

SEQ ID NO: 1524224 - protein, 19 aa, Mycobacterium tuberculosis
GPEARYSALGWPRLRAARG

SEQ ID NO: 1524225 - protein, 25 aa, Mycobacterium tuberculosis
GPELAPADLAYTLARRRGHRPVRTA

SEQ ID NO: 1524226 - protein, 17 aa, Mycobacterium tuberculosis
GPEPNLVQVEFDDAAMA

SEQ ID NO: 1524227 - protein, 17 aa, Mycobacterium tuberculosis
GPERDFEHYLGCKVAAC

SEQ ID NO: 1524228 - protein, 20 aa, Mycobacterium tuberculosis
GPERRYIMVIESLQPADDAT

SEQ ID NO: 1524229 - protein, 23 aa, Mycobacterium tuberculosis
GPEVKRRIMIGTYALSAGYYDAY

SEQ ID NO: 1524230 - protein, 25 aa, Mycobacterium tuberculosis
GPFDAYLTMRGLKTLVLRMQRHSEN

SEQ ID NO: 1524231 - protein, 17 aa, Mycobacterium tuberculosis
GPFPMETVYPVGGRPRT

SEQ ID NO: 1524232 - protein, 17 aa, Mycobacterium tuberculosis
GPGAAFGGNGNTGGNGG

SEQ ID NO: 1524233 - protein, 30 aa, Mycobacterium tuberculosis
GPGCTPTVLPVWRRSPWIAPMAAVRELRRR

SEQ ID NO: 1524234 - protein, 24 aa, Mycobacterium tuberculosis
GPGGAAVGLFGHGGAGGAGGLGKA

SEQ ID NO: 1524235 - protein, 19 aa, Mycobacterium tuberculosis
GPGGILYGNGGNGGAGGPD

SEQ ID NO: 1524236 - protein, 19 aa, Mycobacterium tuberculosis
GPGGLLLGNGGNGGSGAPG

SEQ ID NO: 1524237 - protein, 18 aa, Mycobacterium tuberculosis
GPGGLLYGNGGNGAAGGP

SEQ ID NO: 1524238 - protein, 18 aa, Mycobacterium tuberculosis
GPGGLLYGNGGNGGSGGV

SEQ ID NO: 1524239 - protein, 17 aa, Mycobacterium tuberculosis
GPGMGWVFGFPGGPPPP

SEQ ID NO: 1524240 - protein, 39 aa, Mycobacterium tuberculosis
GPGPVAPRLLPLPHLRAWDGAPWIWNLATAILPEATPIV

SEQ ID NO: 1524241 - protein, 20 aa, Mycobacterium tuberculosis
GPGRWRVFLGPGIPGGGAGN

SEQ ID NO: 1524242 - protein, 20 aa, Mycobacterium tuberculosis
GPGYIPRSTEYRIHQRVLAL

SEQ ID NO: 1524243 - protein, 18 aa, Mycobacterium tuberculosis
GPHGLRHSAATHLLEGGA

SEQ ID NO: 1524244 - protein, 18 aa, Mycobacterium tuberculosis
GPHLLVLARGPEGYRRLS

SEQ ID NO: 1524245 - protein, 27 aa, Mycobacterium tuberculosis
GPHQPRRTAPAPPWAKMPIGEPPPAPS

SEQ ID NO: 1524246 - protein, 17 aa, Mycobacterium tuberculosis
GPIGGVGGHGGVGGAAG

SEQ ID NO: 1524247 - protein, 18 aa, Mycobacterium tuberculosis
GPIPQPSAIRPGIPKAFD

SEQ ID NO: 1524248 - protein, 23 aa, Mycobacterium tuberculosis
GPISEADLLWDLASRLEGRMAAI

SEQ ID NO: 1524249 - protein, 22 aa, Mycobacterium tuberculosis
GPIVIGSFFLPAFNIPGIDVPA

SEQ ID NO: 1524250 - protein, 19 aa, Mycobacterium tuberculosis
GPIVMAQARVRAIFYTPRG

SEQ ID NO: 1524251 - protein, 21 aa, Mycobacterium tuberculosis
GPLAAFVHALADVGFDVAVLN

SEQ ID NO: 1524252 - protein, 17 aa, Mycobacterium tuberculosis
GPLGITELLMRATTVAS

SEQ ID NO: 1524253 - protein, 19 aa, Mycobacterium tuberculosis
GPLGLGFRVPCIVISPYSR

SEQ ID NO: 1524254 - protein, 23 aa, Mycobacterium tuberculosis
GPLGRLRNIAYTQLDMRDVKRVK

SEQ ID NO: 1524255 - protein, 20 aa, Mycobacterium tuberculosis
GPLQGINFGFGNIGSLNLGS

SEQ ID NO: 1524256 - protein, 30 aa, Mycobacterium tuberculosis; identical to SEQ ID NO: 218688

SEQ ID NO: 1524257 - protein, 20 aa, Mycobacterium tuberculosis
GPNAAPFYRGIPSSEVIRAL

SEQ ID NO: 1524258 - protein, 27 aa, Mycobacterium tuberculosis
GPNGQDFSAFRQLARMADRAATAATAA

SEQ ID NO: 1524259 - protein, 26 aa, Mycobacterium tuberculosis
GPPGVGALLLRRDVTCVPLMHGGGQE

SEQ ID NO: 1524260 - protein, 27 aa, Mycobacterium tuberculosis
GPPGVGALLLRRDVTCVPLMHGGGQER

SEQ ID NO: 1524261 - protein, 17 aa, Mycobacterium tuberculosis
GPQLPAPFINPGGTGGS

SEQ ID NO: 1524262 - protein, 19 aa, Mycobacterium tuberculosis
GPQRPKVFPAGTGGAGGPR

SEQ ID NO: 1524263 - protein, 19 aa, Mycobacterium tuberculosis
GPQTVAPAPQPPSGGRNGS

SEQ ID NO: 1524264 - protein, 19 aa, Mycobacterium tuberculosis
GPRPHCGDAFRGSGVASGR

SEQ ID NO: 1524265 - protein, 17 aa, Mycobacterium tuberculosis
GPRRCHRLPARLGTAAG

SEQ ID NO: 1524266 - protein, 24 aa, Mycobacterium tuberculosis
GPRSPLRWPWGACPAPLRPPNVTI

SEQ ID NO: 1524267 - protein, 25 aa, Mycobacterium tuberculosis
GPSGGLLVVITTRAQSDGGRIGSRS

SEQ ID NO: 1524268 - protein, 22 aa, Mycobacterium tuberculosis
GPSMGILPAGGVGGPGGSGGAS

SEQ ID NO: 1524269 - protein, 22 aa, Mycobacterium tuberculosis
GPSQWLLRMLATQTQRAELVPL

SEQ ID NO: 1524270 - protein, 24 aa, Mycobacterium tuberculosis
GPSRRRTGFVLFSAGCRSTGERSP

SEQ ID NO: 1524271 - protein, 24 aa, Mycobacterium tuberculosis
GPSSGFLNWGARSASGLLNFGNNS

SEQ ID NO: 1524272 - protein, 23 aa, Mycobacterium tuberculosis
GPTGFPPGLWARQTTEIRSTNRL

SEQ ID NO: 1524273 - protein, 18 aa, Mycobacterium tuberculosis
GPTTPMVPGSWDPDRDAP

SEQ ID NO: 1524274 - protein, 22 aa, Mycobacterium tuberculosis
GPTTPMVPGSWDPDRDAPGSAE

SEQ ID NO: 1524275 - protein, 24 aa, Mycobacterium tuberculosis
GPTVAPQDPAGPAGLPGAGCSSRP

SEQ ID NO: 1524276 - protein, 17 aa, Mycobacterium tuberculosis
GPVAPVGLQRYLAPVSA

SEQ ID NO: 1524277 - protein, 27 aa, Mycobacterium tuberculosis
GPVAPVGLQRYLAPVSAVPAAAAAPRC

SEQ ID NO: 1524278 - protein, 17 aa, Mycobacterium tuberculosis
GPVDPGGAWAGNGGTGG

SEQ ID NO: 1524279 - protein, 26 aa, Mycobacterium tuberculosis
GPVGTAALVGLTLAPSSQVPAVPAVP

SEQ ID NO: 1524280 - protein, 25 aa, Mycobacterium tuberculosis
GPVGTAALVGLTLAPSSQVSAVPAV

SEQ ID NO: 1524281 - protein, 23 aa, Mycobacterium tuberculosis
GPVIPASAYLMKSPPEQLPDDFA

SEQ ID NO: 1524282 - protein, 17 aa, Mycobacterium tuberculosis
GPVLALLCDPRVTVEII

SEQ ID NO: 1524283 - protein, 23 aa, Mycobacterium tuberculosis
GPVRPALAVPTRAAATTGVAAWV

SEQ ID NO: 1524284 - protein, 17 aa, Mycobacterium tuberculosis
GPVRPPPAAATPIDEIN

SEQ ID NO: 1524285 - protein, 23 aa, Mycobacterium tuberculosis
GPVSLDELARPRFTLHAHDAQAE

SEQ ID NO: 1524286 - protein, 21 aa, Mycobacterium tuberculosis
GPVSLPIFGFGGAPGFGNDTT

SEQ ID NO: 1524287 - protein, 20 aa, Mycobacterium tuberculosis
GPVVMQLMEAAKPFVRWLTD

SEQ ID NO: 1524288 - protein, 24 aa, Mycobacterium tuberculosis
GQAGGAGGILWGNGGNGGSGAPGQ

SEQ ID NO: 1524289 - protein, 24 aa, Mycobacterium tuberculosis
GQAGGPGGILYGNGGNGGSGAPGQ

SEQ ID NO: 1524290 - protein, 24 aa, Mycobacterium tuberculosis
GQAKLANLLFTYELQRRLGEAGKS

SEQ ID NO: 1524291 - protein, 24 aa, Mycobacterium tuberculosis
GQAPVDVLTLFSYPVHPPGKPERV

SEQ ID NO: 1524292 - protein, 27 aa, Mycobacterium tuberculosis
GQATIPIVYAVSRIVEVPYAEIVASVA

SEQ ID NO: 1524293 - protein, 18 aa, Mycobacterium tuberculosis
GQCELPDGARFYFELNLA

SEQ ID NO: 1524294 - protein, 17 aa, Mycobacterium tuberculosis
GQDLLFDAMFLVATVEA

SEQ ID NO: 1524295 - protein, 25 aa, Mycobacterium tuberculosis
GQEVWTSQMIVAPAFVDAAAKDLAT

SEQ ID NO: 1524296 - protein, 25 aa, Mycobacterium tuberculosis
GQFSDEFLRWLARSAFHRRCLGRAG

SEQ ID NO: 1524297 - protein, 21 aa, Mycobacterium tuberculosis
GQGAALIGLGAGGAGGAGGAT

SEQ ID NO: 1524298 - protein, 17 aa, Mycobacterium tuberculosis
GQGGAGRGLWGTGGAGG

SEQ ID NO: 1524299 - protein, 25 aa, Mycobacterium tuberculosis
GQGGKALAATHQDGSMGAGGAGGNG

SEQ ID NO: 1524300 - protein, 17 aa, Mycobacterium tuberculosis
GQGLPFEAGANGGAGGA

SEQ ID NO: 1524301 - protein, 22 aa, Mycobacterium tuberculosis
GQGVGFGGWYAPVALHVDTESI

SEQ ID NO: 1524302 - protein, 24 aa, Mycobacterium tuberculosis
GQGWRHLPDWPPATTERAWYLQPG

SEQ ID NO: 1524303 - protein, 32 aa, Mycobacterium tuberculosis
GQHISTLLLTLLFRFMRPLIENGHVFLAQPPL

SEQ ID NO: 1524304 - protein, 26 aa, Mycobacterium tuberculosis
GQIGELNLLFTYELQRRLAPGGTTIA

SEQ ID NO: 1524305 - protein, 20 aa, Mycobacterium tuberculosis
GQLAKRGYPEDIGNRVLDRL

SEQ ID NO: 1524306 - protein, 28 aa, Mycobacterium tuberculosis
GQLGWGWARFAFTSWKTLGWVDANVWRH

SEQ ID NO: 1524307 - protein, 18 aa, Mycobacterium tuberculosis
GQLIVAFRDAATAQRHLA

SEQ ID NO: 1524308 - protein, 22 aa, Mycobacterium tuberculosis
GQLLGRDGFNAPASTPLHTLQQ

SEQ ID NO: 1524309 - protein, 17 aa, Mycobacterium tuberculosis
GQLLQHTVVVLNAIQKT

SEQ ID NO: 1524310 - protein, 31 aa, Mycobacterium tuberculosis; identical to SEQ ID NO: 237631

SEQ ID NO: 1524311 - protein, 24 aa, Mycobacterium tuberculosis
GQNGGAGGLLYGNGGNGAAGVNAG

SEQ ID NO: 1524312 - protein, 18 aa, Mycobacterium tuberculosis
GQPARLPFWRGDDAGRPA

SEQ ID NO: 1524313 - protein, 19 aa, Mycobacterium tuberculosis
GQPARLPFWRGDDAGRPAE

SEQ ID NO: 1524314 - protein, 22 aa, Mycobacterium tuberculosis
GQPFEVYLFGTHGFEDRRPMCY

SEQ ID NO: 1524315 - protein, 24 aa, Mycobacterium tuberculosis
GQPGGPGGLLYGNGGHGGAGAAGQ

SEQ ID NO: 1524316 - protein, 17 aa, Mycobacterium tuberculosis
GQPVLIPGTMGTASYVL

SEQ ID NO: 1524317 - protein, 23 aa, Mycobacterium tuberculosis
GQPWVVSFQLNWPRDHGPTVTGW

SEQ ID NO: 1524318 - protein, 24 aa, Mycobacterium tuberculosis
GQQRKPPPAWARPQQLQIETDDAV

SEQ ID NO: 1524319 - protein, 20 aa, Mycobacterium tuberculosis
GQQVWLITATPYELAATIAR

SEQ ID NO: 1524320 - protein, 25 aa, Mycobacterium tuberculosis
GQRGPAVAQGCCLAAAARRAPADLV

SEQ ID NO: 1524321 - protein, 26 aa, Mycobacterium tuberculosis
GQRKPRLWKPRQRKLWQWEPGQWKHR

SEQ ID NO: 1524322 - protein, 26 aa, Mycobacterium tuberculosis
GQTHLRHGVALWAGGLRVLAGSGRPV

SEQ ID NO: 1524323 - protein, 18 aa, Mycobacterium tuberculosis
GQTLFEHQALRLRMADLQ

SEQ ID NO: 1524324 - protein, 21 aa, Mycobacterium tuberculosis
GQTLLYSYTTTATNTPFVTSG

SEQ ID NO: 1524325 - protein, 20 aa, Mycobacterium tuberculosis
GQWAGPAGVGQAGGAGGSAG

SEQ ID NO: 1524326 - protein, 22 aa, Mycobacterium tuberculosis
GQWWQQQVVLGLQRSGFPRLAI

SEQ ID NO: 1524327 - protein, 23 aa, Mycobacterium tuberculosis
GQWWQQQVVLGLQRSGFPRLAIA

SEQ ID NO: 1524328 - protein, 19 aa, Mycobacterium tuberculosis
GRAAHLTRIIGGVAGGRRI

SEQ ID NO: 1524329 - protein, 29 aa, Mycobacterium tuberculosis
GRAGPPEHLQWIGQWGIFDALRAGREVVR

SEQ ID NO: 1524330 - protein, 30 aa, Mycobacterium tuberculosis
GRASFELTQKALMAGIPVLAAVSAPSSLAG

SEQ ID NO: 1524331 - protein, 18 aa, Mycobacterium tuberculosis
GRAVILEAMRRYLQQRRA

SEQ ID NO: 1524332 - protein, 28 aa, Mycobacterium tuberculosis
GRCDRHETFLLTTPIHPVSQHRNRACRP

SEQ ID NO: 1524333 - protein, 17 aa, Mycobacterium tuberculosis
GRCYVTEFDSESANLDL

SEQ ID NO: 1524334 - protein, 26 aa, Mycobacterium tuberculosis
GRDGVPTFLLPANPVSALVVFEVMVR

SEQ ID NO: 1524335 - protein, 37 aa, Mycobacterium tuberculosis
GRERWRRRRVRQWWIRRGRWPWRRRRRRRGGQLLRDR

SEQ ID NO: 1524336 - protein, 19 aa, Mycobacterium tuberculosis
GREYVAQFLISGAGALHIP

SEQ ID NO: 1524337 - protein, 22 aa, Mycobacterium tuberculosis
GRFALGERLLGFGSVTGAYIAA

SEQ ID NO: 1524338 - protein, 22 aa, Mycobacterium tuberculosis
GRFGPETIWTFCAYVSSPPNLS

SEQ ID NO: 1524339 - protein, 25 aa, Mycobacterium tuberculosis
GRFVGFADFLIRDGHRYRVADTKLA

SEQ ID NO: 1524340 - protein, 19 aa, Mycobacterium tuberculosis
GRFVLVGVTPAVLASLLGE

SEQ ID NO: 1524341 - protein, 25 aa, Mycobacterium tuberculosis
GRGCLGRPWLFAELSAAFTGSPAPT

SEQ ID NO: 1524342 - protein, 20 aa, Mycobacterium tuberculosis
GRGGLLIGDGGAGGAGGVGG

SEQ ID NO: 1524343 - protein, 18 aa, Mycobacterium tuberculosis
GRGGLLLGTGGAGGDGGV

SEQ ID NO: 1524344 - protein, 21 aa, Mycobacterium tuberculosis
GRGGRRRALPRRRSARHLPAV

SEQ ID NO: 1524345 - protein, 18 aa, Mycobacterium tuberculosis
GRGILLHADPVDSAAATG

SEQ ID NO: 1524346 - protein, 28 aa, Mycobacterium tuberculosis
GRGLRCIAPTWPLGAHPKPLRPGADQTI

SEQ ID NO: 1524347 - protein, 28 aa, Mycobacterium tuberculosis
GRGSTWARQLPWLTLLGAVYTYDAPWHR

SEQ ID NO: 1524348 - protein, 24 aa, Mycobacterium tuberculosis
GRGTRLPVWLTQWGYRRPAEDTVD

SEQ ID NO: 1524349 - protein, 24 aa, Mycobacterium tuberculosis
GRHEGRYFVAGQPTDLVREGDAEA

SEQ ID NO: 1524350 - protein, 18 aa, Mycobacterium tuberculosis
GRHLVSRKTWSAAAAVVL

SEQ ID NO: 1524351 - protein, 25 aa, Mycobacterium tuberculosis
GRHPGIRLLGRGALADRLPPVRVAA

SEQ ID NO: 1524352 - protein, 18 aa, Mycobacterium tuberculosis
GRHVIITWCVQRHREGIG

SEQ ID NO: 1524353 - protein, 19 aa, Mycobacterium tuberculosis
GRIEGIEHVVLQRRQRCGV

SEQ ID NO: 1524354 - protein, 28 aa, Mycobacterium tuberculosis
GRIKRQQLFLSSLLRSMISTDTLFNLSR

SEQ ID NO: 1524355 - protein, 19 aa, Mycobacterium tuberculosis
GRILLRPSGTEPMIRVMVE

SEQ ID NO: 1524356 - protein, 20 aa, Mycobacterium tuberculosis
GRINHAYLFSGPRGCGKTSS

SEQ ID NO: 1524357 - protein, 31 aa, Mycobacterium tuberculosis
GRINPDVKMNYLASPPLVIAYALAGTMDFDF

SEQ ID NO: 1524358 - protein, 21 aa, Mycobacterium tuberculosis
GRIQRELPDWLSADVAILGEP

SEQ ID NO: 1524359 - protein, 22 aa, Mycobacterium tuberculosis
GRIQRELPDWLSADVAILGEPT

SEQ ID NO: 1524360 - protein, 20 aa, Mycobacterium tuberculosis
GRIRAGIRQLTAPRRVARTA

SEQ ID NO: 1524361 - protein, 24 aa, Mycobacterium tuberculosis
GRKRPRGWRIALCAQRVVRPKNPE

SEQ ID NO: 1524362 - protein, 25 aa, Mycobacterium tuberculosis
GRLAPRPVFRPPVDPASRQAFGRPS

SEQ ID NO: 1524363 - protein, 26 aa, Mycobacterium tuberculosis
GRLAPRPVFRPPVDPASRQAFGRPSG

SEQ ID NO: 1524364 - protein, 17 aa, Mycobacterium tuberculosis
GRLLWSELVAQFAPRAP

SEQ ID NO: 1524365 - protein, 17 aa, Mycobacterium tuberculosis
GRLSPWGRLAEWRRQYD

SEQ ID NO: 1524366 - protein, 20 aa, Mycobacterium tuberculosis
GRLVSLPRRVGGDLYGSFLP

SEQ ID NO: 1524367 - protein, 24 aa, Mycobacterium tuberculosis
GRLWATILQHRFGGSGALAGHPIG

SEQ ID NO: 1524368 - protein, 23 aa, Mycobacterium tuberculosis
GRMKFYVFGYPRVPMTAEMAITV

SEQ ID NO: 1524369 - protein, 18 aa, Mycobacterium tuberculosis
GRNRIVRRLLAAAGFPVE

SEQ ID NO: 1524370 - protein, 20 aa, Mycobacterium tuberculosis
GRNRIVRRLLAAAGFPVEAL

SEQ ID NO: 1524371 - protein, 26 aa, Mycobacterium tuberculosis
GRPEARLWALVRRQSLSRFERLAGQW

SEQ ID NO: 1524372 - protein, 18 aa, Mycobacterium tuberculosis
GRPFPWHSLGEAYLGRRW

SEQ ID NO: 1524373 - protein, 19 aa, Mycobacterium tuberculosis
GRPGLLRPSEGMAVAAAAV

SEQ ID NO: 1524374 - protein, 25 aa, Mycobacterium tuberculosis
GRPLAMPRLDMVTGLYYLTTEVPED

SEQ ID NO: 1524375 - protein, 28 aa, Mycobacterium tuberculosis
GRPLAMPRLDMVTGLYYLTTEVPGDTGE

SEQ ID NO: 1524376 - protein, 17 aa, Mycobacterium tuberculosis
GRPLIGNGADGAAGTGQ

SEQ ID NO: 1524377 - protein, 21 aa, Mycobacterium tuberculosis
GRPLQHRWPDRQLPGEGVTRG

SEQ ID NO: 1524378 - protein, 22 aa, Mycobacterium tuberculosis
GRPLQHRWPDRQLPGEGVTRGA

SEQ ID NO: 1524379 - protein, 21 aa, Mycobacterium tuberculosis
GRPVTCDDLVLAWAAQSGRFP

SEQ ID NO: 1524380 - protein, 28 aa, Mycobacterium tuberculosis
GRQGLCGYPGVLLLLIPQRTAQVVVQVG

SEQ ID NO: 1524381 - protein, 25 aa, Mycobacterium tuberculosis
GRQIGPLAKFYSVAPANIIVIHDDL

SEQ ID NO: 1524382 - protein, 20 aa, Mycobacterium tuberculosis
GRQPLGPLMPGRGGQPRIVD

SEQ ID NO: 1524383 - protein, 23 aa, Mycobacterium tuberculosis
GRQVFKDYVAFPALTSLSPGRRI

SEQ ID NO: 1524384 - protein, 20 aa, Mycobacterium tuberculosis
GRQVQRFSAGRRGALHRGSG

SEQ ID NO: 1524385 - protein, 27 aa, Mycobacterium tuberculosis
GRRAAAPRLGWITRAWTLPRCAAAAAA

SEQ ID NO: 1524386 - protein, 24 aa, Mycobacterium tuberculosis
GRRARAARLLRFGDGTPPRHHPAA

SEQ ID NO: 1524387 - protein, 26 aa, Mycobacterium tuberculosis
GRRARVALLYWQPAAMGGVPAGFGPS

SEQ ID NO: 1524388 - protein, 17 aa, Mycobacterium tuberculosis
GRRATSHWLTLPALKAF

SEQ ID NO: 1524389 - protein, 17 aa, Mycobacterium tuberculosis
GRRFSFTALVIVGDGNG

SEQ ID NO: 1524390 - protein, 18 aa, Mycobacterium tuberculosis
GRRFSFTALVIVGDGNGM

SEQ ID NO: 1524391 - protein, 26 aa, Mycobacterium tuberculosis
GRRGQPRLRPPFPAVAGLYGCPTVIN

SEQ ID NO: 1524392 - protein, 32 aa, Mycobacterium tuberculosis
GRRIELPTYAFQRQRYWLPPTSAGSADISGVG

SEQ ID NO: 1524393 - protein, 18 aa, Mycobacterium tuberculosis
GRRIFIIDVARFPASVPP

SEQ ID NO: 1524394 - protein, 22 aa, Mycobacterium tuberculosis
GRRIVARLNWIKQGPAPAPVTE

SEQ ID NO: 1524395 - protein, 25 aa, Mycobacterium tuberculosis
GRRLRRCGVLVIRISVYGHRGCRGR

SEQ ID NO: 1524396 - protein, 24 aa, Mycobacterium tuberculosis
GRRLSWSMPAPRTPCWWRRVPMHI

SEQ ID NO: 1524397 - protein, 24 aa, Mycobacterium tuberculosis
GRRRPTPRWGPGPPPVPSTPTASD

SEQ ID NO: 1524398 - protein, 23 aa, Mycobacterium tuberculosis
GRRRRLMAVFRRMVDEHGEDVEV

SEQ ID NO: 1524399 - protein, 24 aa, Mycobacterium tuberculosis
GRRRRRRCFWWQSRSRHSTGTGCC

SEQ ID NO: 1524400 - protein, 19 aa, Mycobacterium tuberculosis
GRRVRINDLWIAAVAASRA

SEQ ID NO: 1524401 - protein, 20 aa, Mycobacterium tuberculosis
GRRWAAAGGVGGDGGRGGLL

SEQ ID NO: 1524402 - protein, 18 aa, Mycobacterium tuberculosis
GRSDPGRRWRCRTGPAAL

SEQ ID NO: 1524403 - protein, 29 aa, Mycobacterium tuberculosis
GRSEAGLPAPFWPVMPSAVAPRRPRLQPP

SEQ ID NO: 1524404 - protein, 18 aa, Mycobacterium tuberculosis
GRSHAWVQAWNGGWWHYD

SEQ ID NO: 1524405 - protein, 19 aa, Mycobacterium tuberculosis
GRSLSGFSASRPIGPRTLG

SEQ ID NO: 1524406 - protein, 25 aa, Mycobacterium tuberculosis
GRSVTWLACDVPSLGWRVYRLVPRR

SEQ ID NO: 1524407 - protein, 22 aa, Mycobacterium tuberculosis
GRTGDLIAARDAAARALDRARG

SEQ ID NO: 1524408 - protein, 23 aa, Mycobacterium tuberculosis
GRTLTRCDIRVPRFAAVDLTGEV

SEQ ID NO: 1524409 - protein, 23 aa, Mycobacterium tuberculosis
GRTQRFWVGLSVYRPGGTAEPAP

SEQ ID NO: 1524410 - protein, 17 aa, Mycobacterium tuberculosis
GRTVRGQVLTGCAGHTL

SEQ ID NO: 1524411 - protein, 28 aa, Mycobacterium tuberculosis
GRVDCGQRLLLRGVQRVGAGRGVGAVQT

SEQ ID NO: 1524412 - protein, 23 aa, Mycobacterium tuberculosis
GRVGLVRALRDRGLQSAAQSVVC

SEQ ID NO: 1524413 - protein, 22 aa, Mycobacterium tuberculosis
GRVVLYLHGGAFVMCRPNSHSR

SEQ ID NO: 1524414 - protein, 21 aa, Mycobacterium tuberculosis
GRVYAAPYFHQFDAYRSIYVR

SEQ ID NO: 1524415 - protein, 20 aa, Mycobacterium tuberculosis
GRWAAQPRPMLGSGAVRYEV

SEQ ID NO: 1524416 - protein, 24 aa, Mycobacterium tuberculosis
GRWDKPFLAIFGYRDPILGQAGGP

SEQ ID NO: 1524417 - protein, 28 aa, Mycobacterium tuberculosis
GRWSAVLVGPWWPAPSAALRAAAQHWAT

SEQ ID NO: 1524418 - protein, 17 aa, Mycobacterium tuberculosis
GRYIGFDGVIHSVASGH

SEQ ID NO: 1524419 - protein, 25 aa, Mycobacterium tuberculosis
GRYPQAIFDHGKPLALYHTKRLASP

SEQ ID NO: 1524420 - protein, 23 aa, Mycobacterium tuberculosis
GRYSPFAVYLPRGDPGRLAPVRD

SEQ ID NO: 1524421 - protein, 33 aa, Mycobacterium tuberculosis
GSAALFAWGLNQLVFLGLRPPPPQRYPLSEAQA

SEQ ID NO: 1524422 - protein, 25 aa, Mycobacterium tuberculosis
GSACNLVFPIGIIDRPYKHDQPPWT

SEQ ID NO: 1524423 - protein, 21 aa, Mycobacterium tuberculosis
GSAELIRPLTADALVAAVNEV

SEQ ID NO: 1524424 - protein, 22 aa, Mycobacterium tuberculosis
GSALGTTIFGGSGGVGGSGGDG

SEQ ID NO: 1524425 - protein, 17 aa, Mycobacterium tuberculosis
GSAPARNRCGWARFSRP

SEQ ID NO: 1524426 - protein, 27 aa, Mycobacterium tuberculosis
GSAPMLAAAVAWDGLAAELGSAASSFG

SEQ ID NO: 1524427 - protein, 17 aa, Mycobacterium tuberculosis
GSAPRDLCALWPVPATS

SEQ ID NO: 1524428 - protein, 22 aa, Mycobacterium tuberculosis
GSAQRWKAIRGEAGWMTTYAYP

SEQ ID NO: 1524429 - protein, 23 aa, Mycobacterium tuberculosis
GSAQRWKAIRGEAGWMTTYAYPA

SEQ ID NO: 1524430 - protein, 34 aa, Mycobacterium tuberculosis
GSARLPCCRPSTSRPFRVGFAAVGWHRADRHPGH

SEQ ID NO: 1524431 - protein, 22 aa, Mycobacterium tuberculosis
GSATFFVRGLRDWDQCAGGIVG

SEQ ID NO: 1524432 - protein, 24 aa, Mycobacterium tuberculosis
GSCSTKDIVLLLSSGASEIPPAQA

SEQ ID NO: 1524433 - protein, 20 aa, Mycobacterium tuberculosis
GSCWIPFSLEIEGDAAGFVA

SEQ ID NO: 1524434 - protein, 17 aa, Mycobacterium tuberculosis
GSDLRPPSWQPPACLRF

SEQ ID NO: 1524435 - protein, 18 aa, Mycobacterium tuberculosis
GSDSAVEALFRPMHDRLA

SEQ ID NO: 1524436 - protein, 25 aa, Mycobacterium tuberculosis
GSDTVTLVWLGQRRVPGIDTGRTLR

SEQ ID NO: 1524437 - protein, 17 aa, Mycobacterium tuberculosis
GSFGLILRPGQIGRHCL

SEQ ID NO: 1524438 - protein, 21 aa, Mycobacterium tuberculosis
GSFLARQLGVPQPETLRRYRA

SEQ ID NO: 1524439 - protein, 17 aa, Mycobacterium tuberculosis
GSFLPACGEHHMGAGSC

SEQ ID NO: 1524440 - protein, 17 aa, Mycobacterium tuberculosis
GSFLPDIDAFDAEFFEI

SEQ ID NO: 1524441 - protein, 18 aa, Mycobacterium tuberculosis
GSFNVGFQNTGFGNSGAG

SEQ ID NO: 1524442 - protein, 24 aa, Mycobacterium tuberculosis
GSGANAYLLPARNWSVMAATEVRS

SEQ ID NO: 1524443 - protein, 19 aa, Mycobacterium tuberculosis
GSGFLVDYPLEQYIRDAKI

SEQ ID NO: 1524444 - protein, 26 aa, Mycobacterium tuberculosis
GSGGAGSIGFNASAPGAAGSPGGNGG

SEQ ID NO: 1524445 - protein, 27 aa, Mycobacterium tuberculosis
GSGGAGSIGFNASAPGAAGSPGGNGGN

SEQ ID NO: 1524446 - protein, 23 aa, Mycobacterium tuberculosis
GSGGFGQFGGAGGLLYGNGGAAG

SEQ ID NO: 1524447 - protein, 18 aa, Mycobacterium tuberculosis
GSGGFLSGAAGVSGADGI

SEQ ID NO: 1524448 - protein, 18 aa, Mycobacterium tuberculosis
GSGGFLSGAQESAALTVF

SEQ ID NO: 1524449 - protein, 23 aa, Mycobacterium tuberculosis
GSGGNGFDSFASGGTGGAAEPGG

SEQ ID NO: 1524450 - protein, 19 aa, Mycobacterium tuberculosis
GSGGNRRAAVRSPRPVRPG

SEQ ID NO: 1524451 - protein, 21 aa, Mycobacterium tuberculosis
GSGGSALLWGDGGAGGAGGVG

SEQ ID NO: 1524452 - protein, 17 aa, Mycobacterium tuberculosis
GSGGTAGLLGSGGSGGT

SEQ ID NO: 1524453 - protein, 21 aa, Mycobacterium tuberculosis
GSGGTAGLLGSGGSGGTGGDG

SEQ ID NO: 1524454 - protein, 17 aa, Mycobacterium tuberculosis
GSGIPKSNFYPSPDRES

SEQ ID NO: 1524455 - protein, 21 aa, Mycobacterium tuberculosis
GSGLAGADGGLFGNGGDGGSS

SEQ ID NO: 1524456 - protein, 19 aa, Mycobacterium tuberculosis
GSGLLVPLGVRRVRAYAPV

SEQ ID NO: 1524457 - protein, 19 aa, Mycobacterium tuberculosis
GSHLYWLETCRVAALACVE

SEQ ID NO: 1524458 - protein, 20 aa, Mycobacterium tuberculosis
GSHRRRIRRNIKNRKSVNLD

SEQ ID NO: 1524459 - protein, 23 aa, Mycobacterium tuberculosis
GSIDVVLRLPGQRYLVVDYKTNH

SEQ ID NO: 1524460 - protein, 24 aa, Mycobacterium tuberculosis
GSIDVVLRLPGQRYLVVDYKTNHL

SEQ ID NO: 1524461 - protein, 25 aa, Mycobacterium tuberculosis
GSIDVVLRLPGQRYLVVDYKTNHLG

SEQ ID NO: 1524462 - protein, 34 aa, Mycobacterium tuberculosis
GSILCDPWVNPAYFASWFPFPDNSGLDWGALGEC

SEQ ID NO: 1524463 - protein, 18 aa, Mycobacterium tuberculosis
GSILIPKGEIGSAAGLAQ

SEQ ID NO: 1524464 - protein, 28 aa, Mycobacterium tuberculosis
GSKFSTKMKLFGLPYRIASRVTALKPNE

SEQ ID NO: 1524465 - protein, 18 aa, Mycobacterium tuberculosis
GSLPVLNRAAVESAIRIG

SEQ ID NO: 1524466 - protein, 21 aa, Mycobacterium tuberculosis
GSLRLDLSQYRELEAFAAFAS

SEQ ID NO: 1524467 - protein, 19 aa, Mycobacterium tuberculosis
GSLRLWSLAGGMPLHRYRK

SEQ ID NO: 1524468 - protein, 24 aa, Mycobacterium tuberculosis
GSLTAPAPFVYGLGAVGPALTTMT

SEQ ID NO: 1524469 - protein, 18 aa, Mycobacterium tuberculosis
GSLVLLAWGAANRDPRQY

SEQ ID NO: 1524470 - protein, 25 aa, Mycobacterium tuberculosis
GSMVFPGYGAELLRWLDRAPQIATF

SEQ ID NO: 1524471 - protein, 31 aa, Mycobacterium tuberculosis
GSNMSGFFGGPPVFNLGLANRGVVNILGNAN

SEQ ID NO: 1524472 - protein, 49 aa, Mycobacterium tuberculosis
GSNNTTIIWRRLLWPALYFYLCVHRSLYWSLHVLLCIASTRWVPSCPAS

SEQ ID NO: 1524473 - protein, 18 aa, Mycobacterium tuberculosis
GSNQRRLRRRQGHHVRCR

SEQ ID NO: 1524474 - protein, 23 aa, Mycobacterium tuberculosis
GSPPRRVLPLRPDVVIAFMDQFG

SEQ ID NO: 1524475 - protein, 19 aa, Mycobacterium tuberculosis
GSPVIVGRDARHGSPAFAA

SEQ ID NO: 1524476 - protein, 22 aa, Mycobacterium tuberculosis
GSQWLGMGIELLDTAPAFAQQI

SEQ ID NO: 1524477 - protein, 23 aa, Mycobacterium tuberculosis
GSQWLGMGMGLHAGYPVFAEAFN

SEQ ID NO: 1524478 - protein, 23 aa, Mycobacterium tuberculosis
GSREFMLHPVMMDIALQTLGATR

SEQ ID NO: 1524479 - protein, 17 aa, Mycobacterium tuberculosis
GSRFLLDQAITSAGRHP

SEQ ID NO: 1524480 - protein, 17 aa, Mycobacterium tuberculosis
GSRLVELPGTDTLYWVG

SEQ ID NO: 1524481 - protein, 18 aa, Mycobacterium tuberculosis
GSRRRRRSRRARPGRRLL

SEQ ID NO: 1524482 - protein, 18 aa, Mycobacterium tuberculosis
GSRSPPMRSSPPNPAFQS

SEQ ID NO: 1524483 - protein, 21 aa, Mycobacterium tuberculosis
GSSNLLFRRNSVSGAVEVLAR

SEQ ID NO: 1524484 - protein, 24 aa, Mycobacterium tuberculosis
GSSPQLRGLWYSFTAGSVRVISLH

SEQ ID NO: 1524485 - protein, 17 aa, Mycobacterium tuberculosis
GSSRPMPLPPGRGILVT

SEQ ID NO: 1524486 - protein, 24 aa, Mycobacterium tuberculosis
GSTAARLFYAYAEILLALGRGDEA

SEQ ID NO: 1524487 - protein, 23 aa, Mycobacterium tuberculosis
GSTAMIYLMHMAGRSKAAAPGYR

SEQ ID NO: 1524488 - protein, 18 aa, Mycobacterium tuberculosis
GSTFANLPIGQGLSMTLL

SEQ ID NO: 1524489 - protein, 23 aa, Mycobacterium tuberculosis
GSTGPAVPAAVPAGPAGPAVTAV

SEQ ID NO: 1524490 - protein, 17 aa, Mycobacterium tuberculosis
GSTLFGRWELCALMQTV

SEQ ID NO: 1524491 - protein, 23 aa, Mycobacterium tuberculosis
GSTLFGRWELCALMQTVAELAEA

SEQ ID NO: 1524492 - protein, 17 aa, Mycobacterium tuberculosis
GSVGLWGSGGAGGDGGA

SEQ ID NO: 1524493 - protein, 30 aa, Mycobacterium tuberculosis
GSVRFLMSVGDLIIGWLLQRQAAVAVAALD

SEQ ID NO: 1524494 - protein, 19 aa, Mycobacterium tuberculosis
GSVYLTRPLAVPLHPHRRG

SEQ ID NO: 1524495 - protein, 19 aa, Mycobacterium tuberculosis
GSWPMAGTPAWRQLDDADP

SEQ ID NO: 1524496 - protein, 21 aa, Mycobacterium tuberculosis
GSWSFVWRDVLLRLANDFRCV

SEQ ID NO: 1524497 - protein, 26 aa, Mycobacterium tuberculosis
GSYAAYYEQWAQPWEIQALLRAHAVA

SEQ ID NO: 1524498 - protein, 25 aa, Mycobacterium tuberculosis
GSYFGQRRLEAARLLGWERIPVHVC

SEQ ID NO: 1524499 - protein, 22 aa, Mycobacterium tuberculosis
GTAELIRIALTTKLKPFTYVST

SEQ ID NO: 1524500 - protein, 20 aa, Mycobacterium tuberculosis
GTAGLFGHGGAGGAGGIGSA

SEQ ID NO: 1524501 - protein, 21 aa, Mycobacterium tuberculosis
GTAGLLFGAGGAGGAGGFGFG

SEQ ID NO: 1524502 - protein, 24 aa, Mycobacterium tuberculosis
GTAHLGPLAIIGQSGQPGQFGSPG

SEQ ID NO: 1524503 - protein, 21 aa, Mycobacterium tuberculosis
GTAIQPIYGPTLDGTLPGNEI

SEQ ID NO: 1524504 - protein, 17 aa, Mycobacterium tuberculosis
GTALGAGGIGGDGGTGG

SEQ ID NO: 1524505 - protein, 23 aa, Mycobacterium tuberculosis
GTANRYFHTAIVLFGNSLEQDRS

SEQ ID NO: 1524506 - protein, 29 aa, Mycobacterium tuberculosis
GTAPGRAIPFGAFRHLISLPASGADIGRP

SEQ ID NO: 1524507 - protein, 26 aa, Mycobacterium tuberculosis
GTARRLHAVTLHRLLGAKPGARFRQD

SEQ ID NO: 1524508 - protein, 22 aa, Mycobacterium tuberculosis
GTASSPFGIAIAIGGAGAQGGA

SEQ ID NO: 1524509 - protein, 22 aa, Mycobacterium tuberculosis
GTCRNRPSPAPTFIATRHADGD

SEQ ID NO: 1524510 - protein, 18 aa, Mycobacterium tuberculosis
GTDGNGGKWRVRRRRRQR

SEQ ID NO: 1524511 - protein, 24 aa, Mycobacterium tuberculosis
GTDLDSVLKRFGPLTPPRAVAIIT

SEQ ID NO: 1524512 - protein, 20 aa, Mycobacterium tuberculosis
GTDPLAYVDPYLPIESFRRR

SEQ ID NO: 1524513 - protein, 17 aa, Mycobacterium tuberculosis
GTEKNFKWIARSADGWI

SEQ ID NO: 1524514 - protein, 18 aa, Mycobacterium tuberculosis
GTENLRRIEPLLATLRAI

SEQ ID NO: 1524515 - protein, 25 aa, Mycobacterium tuberculosis
GTETLRAPMWLEHIRRRGWQAVAAV

SEQ ID NO: 1524516 - protein, 26 aa, Mycobacterium tuberculosis
GTETLRRRIRDLFPRIGRQTQNPERG

SEQ ID NO: 1524517 - protein, 20 aa, Mycobacterium tuberculosis
GTFNELHILAITQAIVEYRA

SEQ ID NO: 1524518 - protein, 24 aa, Mycobacterium tuberculosis
GTFTICSFWLVSALVEIGEVGRAK

SEQ ID NO: 1524519 - protein, 20 aa, Mycobacterium tuberculosis
GTGATLIGLGAGGGGGIGGF

SEQ ID NO: 1524520 - protein, 29 aa, Mycobacterium tuberculosis
GTGGAGGAGFSRALIVAGDNGGDPGAGGA

SEQ ID NO: 1524521 - protein, 18 aa, Mycobacterium tuberculosis
GTGGAGGLFASGGVGGTG

SEQ ID NO: 1524522 - protein, 26 aa, Mycobacterium tuberculosis
GTGGFAVAPDFIGFGAAYGGAGGLGG

SEQ ID NO: 1524523 - protein, 21 aa, Mycobacterium tuberculosis
GTGGLLFGNGGAGGQGGLGLA

SEQ ID NO: 1524524 - protein, 25 aa, Mycobacterium tuberculosis
GTGGPPLPGQAGMGAAGGAGGLIGN

SEQ ID NO: 1524525 - protein, 25 aa, Mycobacterium tuberculosis
GTGGRGGLLAGQHANSGNGGGGGTG

SEQ ID NO: 1524526 - protein, 17 aa, Mycobacterium tuberculosis
GTGGRGGNGGHGGLWIG

SEQ ID NO: 1524527 - protein, 35 aa, Mycobacterium tuberculosis
GTGGTGGTAHLGPLAIIGQSGQPGQFGSPGADGRG

SEQ ID NO: 1524528 - protein, 17 aa, Mycobacterium tuberculosis
GTGGTGGWLAGGGGVGG

SEQ ID NO: 1524529 - protein, 18 aa, Mycobacterium tuberculosis
GTGGWLFGNGGAGGNSGG

SEQ ID NO: 1524530 - protein, 21 aa, Mycobacterium tuberculosis
GTGLRRQRRPGWRRHSDRQRR

SEQ ID NO: 1524531 - protein, 26 aa, Mycobacterium tuberculosis
GTGQPGGAGGLLWGNGGNGGSGAAGQ

SEQ ID NO: 1524532 - protein, 24 aa, Mycobacterium tuberculosis
GTGQPGGPGALWGNGGNGGSGVAG

SEQ ID NO: 1524533 - protein, 26 aa, Mycobacterium tuberculosis
GTGSTFTLALPALIEAYHDDERPEQA

SEQ ID NO: 1524534 - protein, 18 aa, Mycobacterium tuberculosis
GTGVAGVNGGMGAAGGAG

SEQ ID NO: 1524535 - protein, 26 aa, Mycobacterium tuberculosis
GTGVGSPGGLGGAGGTGGLGGAGAGG

SEQ ID NO: 1524536 - protein, 23 aa, Mycobacterium tuberculosis
GTGWRWRTWHLYPSASGGTVVHT

SEQ ID NO: 1524537 - protein, 17 aa, Mycobacterium tuberculosis
GTIASVAAVALYIGDVL

SEQ ID NO: 1524538 - protein, 18 aa, Mycobacterium tuberculosis
GTIASVAAVALYIGDVLG

SEQ ID NO: 1524539 - protein, 21 aa, Mycobacterium tuberculosis
GTIGPAMTFGYLAALHIADQA

SEQ ID NO: 1524540 - protein, 25 aa, Mycobacterium tuberculosis
GTKGLSLFYVPNYLFDPDTFELGAR

SEQ ID NO: 1524541 - protein, 24 aa, Mycobacterium tuberculosis
GTLIPTLPLGLALSNGIPPVDIPA

SEQ ID NO: 1524542 - protein, 24 aa, Mycobacterium tuberculosis
GTLIWNELLTDKPDLALAFYEAVV

SEQ ID NO: 1524543 - protein, 20 aa, Mycobacterium tuberculosis
GTLNVGFANAGSINTGFANS

SEQ ID NO: 1524544 - protein, 17 aa, Mycobacterium tuberculosis
GTMTLNLGLANLGSNNA

SEQ ID NO: 1524545 - protein, 23 aa, Mycobacterium tuberculosis
GTNGFAGFGGSAGGGGWVGAVNF

SEQ ID NO: 1524546 - protein, 24 aa, Mycobacterium tuberculosis
GTNGFAGFGGSAGGGGWVGAVNFG

SEQ ID NO: 1524547 - protein, 29 aa, Mycobacterium tuberculosis
GTNGLGGFGGFRRCFGQLGPWLSAYGCGA

SEQ ID NO: 1524548 - protein, 17 aa, Mycobacterium tuberculosis
GTNPWRGPPIPYGTEVT

SEQ ID NO: 1524549 - protein, 29 aa, Mycobacterium tuberculosis
GTPHCAAVGRIAYLLGLRGPAVAVDTACS

SEQ ID NO: 1524550 - protein, 21 aa, Mycobacterium tuberculosis
GTPLRVQRAAMAATAGPAARP

SEQ ID NO: 1524551 - protein, 25 aa, Mycobacterium tuberculosis
GTPPMAPLRVAPAVSAAPEAAPSRS

SEQ ID NO: 1524552 - protein, 25 aa, Mycobacterium tuberculosis
GTPPRHHPAALRRAIPGGATSARPP

SEQ ID NO: 1524553 - protein, 24 aa, Mycobacterium tuberculosis
GTPRAGLRTYLAVRGGVCVEPVLG

SEQ ID NO: 1524554 - protein, 36 aa, Mycobacterium tuberculosis
GTPRRYGVRWHYRLPVWSDFVEVHWSRWGEAYVTPV

SEQ ID NO: 1524555 - protein, 27 aa, Mycobacterium tuberculosis
GTPSWLSICLPRCGSPRVWWATAASER

SEQ ID NO: 1524556 - protein, 28 aa, Mycobacterium tuberculosis
GTRGLRTYVQLFVLIAAANDVRCDVASN

SEQ ID NO: 1524557 - protein, 21 aa, Mycobacterium tuberculosis
GTRLMALRRLAHPDDAQLGPP

SEQ ID NO: 1524558 - protein, 23 aa, Mycobacterium tuberculosis
GTRQYWALQCRQFQHRHRQPRVV

SEQ ID NO: 1524559 - protein, 22 aa, Mycobacterium tuberculosis
GTSLRALLKQYGPLTPARAVAI

SEQ ID NO: 1524560 - protein, 25 aa, Mycobacterium tuberculosis
GTSPPPPFAPWDTPDGTPPPGTGLS

SEQ ID NO: 1524561 - protein, 25 aa, Mycobacterium tuberculosis
GTTEQLYLAGAPLVAFSGLPIVPPG

SEQ ID NO: 1524562 - protein, 26 aa, Mycobacterium tuberculosis
GTTFGDYWYANLRHTVRFDRAVESAI

SEQ ID NO: 1524563 - protein, 23 aa, Mycobacterium tuberculosis
GTTKVMIIVVMFFSCRKPDQRAS

SEQ ID NO: 1524564 - protein, 20 aa, Mycobacterium tuberculosis
GTTRFFRWPAISASATIQTR

SEQ ID NO: 1524565 - protein, 34 aa, Mycobacterium tuberculosis
GTTTLLVTDLAGGWIPPHVRLPANVTLLEPTARR

SEQ ID NO: 1524566 - protein, 31 aa, Mycobacterium tuberculosis
GTVEPWVRDYLLLRGLLGTSILWFEQDRDCG

SEQ ID NO: 1524567 - protein, 24 aa, Mycobacterium tuberculosis
GTVGKPPVPGGKRRQTAATPGVGR

SEQ ID NO: 1524568 - protein, 22 aa, Mycobacterium tuberculosis
GTVGLCCLVLSYPGWVSWPLCS

SEQ ID NO: 1524569 - protein, 31 aa, Mycobacterium tuberculosis
GTVTFPGFTIPLDPIDIGLPVSLTIPGFTIP

SEQ ID NO: 1524570 - protein, 19 aa, Mycobacterium tuberculosis
GTVYRHFPTKEALFQAVIA

SEQ ID NO: 1524571 - protein, 27 aa, Mycobacterium tuberculosis
GTYGDFQNFYLCDLQIKWNGFQAGGPV

SEQ ID NO: 1524572 - protein, 27 aa, Mycobacterium tuberculosis
GVAASGRICWPTWPLPAPTERHRPPTT

SEQ ID NO: 1524573 - protein, 17 aa, Mycobacterium tuberculosis
GVAEFRRSLDRVMPRDA

SEQ ID NO: 1524574 - protein, 17 aa, Mycobacterium tuberculosis
GVAETIDWVAALVALGV

SEQ ID NO: 1524575 - protein, 17 aa, Mycobacterium tuberculosis
GVAFPDALLTRGRYQYR

SEQ ID NO: 1524576 - protein, 18 aa, Mycobacterium tuberculosis
GVAGPRPSPRRARADPRD

SEQ ID NO: 1524577 - protein, 24 aa, Mycobacterium tuberculosis
GVAGRPMILKRFVKGIFAEAVFQK

SEQ ID NO: 1524578 - protein, 23 aa, Mycobacterium tuberculosis
GVAITEFVVSPLFGSPPAAELVR

SEQ ID NO: 1524579 - protein, 19 aa, Mycobacterium tuberculosis
GVALAKLRLPSPSGRAGIA

SEQ ID NO: 1524580 - protein, 21 aa, Mycobacterium tuberculosis
GVALMLEPRKAAAGSALGMLS

SEQ ID NO: 1524581 - protein, 20 aa, Mycobacterium tuberculosis
GVAMPLRLTSPAPCTNCHGS

SEQ ID NO: 1524582 - protein, 21 aa, Mycobacterium tuberculosis
GVAMPLRLTSPAPCTNCHGSG

SEQ ID NO: 1524583 - protein, 27 aa, Mycobacterium tuberculosis
GVARGTAYRWFRAGLLSVMARRVGRLI

SEQ ID NO: 1524584 - protein, 26 aa, Mycobacterium tuberculosis
GVARVIAYRWLRVGRLPVPARRVGRV

SEQ ID NO: 1524585 - protein, 24 aa, Mycobacterium tuberculosis
GVASAFGGGNAFGGRGGDGGDGGD

SEQ ID NO: 1524586 - protein, 18 aa, Mycobacterium tuberculosis
GVAVSPVTGLVFVTNFDS

SEQ ID NO: 1524587 - protein, 24 aa, Mycobacterium tuberculosis
GVAWVIAYRWFRAGLLPVPAQRVG

SEQ ID NO: 1524588 - protein, 33 aa, Mycobacterium tuberculosis
GVCAQLHVCPQLRLWDWCPTPWTPHGGWVTVFS

SEQ ID NO: 1524589 - protein, 24 aa, Mycobacterium tuberculosis
GVDAINIPIIHIPATPGFGNSTGG

SEQ ID NO: 1524590 - protein, 18 aa, Mycobacterium tuberculosis
GVDAIWINPVTISPMADH

SEQ ID NO: 1524591 - protein, 18 aa, Mycobacterium tuberculosis
GVDASKHGPLTGGDGGVG

SEQ ID NO: 1524592 - protein, 28 aa, Mycobacterium tuberculosis
GVDPDLSEMPFYGLPGPPGGDAHGLVVV

SEQ ID NO: 1524593 - protein, 23 aa, Mycobacterium tuberculosis
GVDPWISLYRNAFHGRRVGGLQP

SEQ ID NO: 1524594 - protein, 23 aa, Mycobacterium tuberculosis
GVDQGLIRKSGAWFTYEGEQLGQ

SEQ ID NO: 1524595 - protein, 27 aa, Mycobacterium tuberculosis
GVDYMTVHAGVLLRYVPLTAKRVTGIV

SEQ ID NO: 1524596 - protein, 24 aa, Mycobacterium tuberculosis
GVEGALVTLDWLGAHGFGRLLQHT

SEQ ID NO: 1524597 - protein, 17 aa, Mycobacterium tuberculosis
GVERTWLDGWLLRAGHG

SEQ ID NO: 1524598 - protein, 23 aa, Mycobacterium tuberculosis
GVFQENRFWPPPCNIRIVGRSAA

SEQ ID NO: 1524599 - protein, 18 aa, Mycobacterium tuberculosis
GVGAAGGLAGQIGNGGSG

SEQ ID NO: 1524600 - protein, 31 aa, Mycobacterium tuberculosis
GVGFFDGAIPRRWRNPAPLWGDTSFHSVAPA

SEQ ID NO: 1524601 - protein, 25 aa, Mycobacterium tuberculosis
GVGGAGGLLFGYGGAGGAGGYSNIG

SEQ ID NO: 1524602 - protein, 30 aa, Mycobacterium tuberculosis
GVGGAGNPWRQRWPTAACGTATVAPAGPPA

SEQ ID NO: 1524603 - protein, 27 aa, Mycobacterium tuberculosis
GVGGIGGAGALFGPGGAGGTGGFGASS

SEQ ID NO: 1524604 - protein, 19 aa, Mycobacterium tuberculosis
GVGGLWGAGGAGGAGGTGL

SEQ ID NO: 1524605 - protein, 23 aa, Mycobacterium tuberculosis
GVGGNGGWLYGNGGAGGLGGTGV

SEQ ID NO: 1524606 - protein, 29 aa, Mycobacterium tuberculosis
GVGGPGGGHGLLGLGGSHGAGGAGGSGGD

SEQ ID NO: 1524607 - protein, 26 aa, Mycobacterium tuberculosis
GVGGSGGLGSAFGPGGTGGMGGAGGT

SEQ ID NO: 1524608 - protein, 24 aa, Mycobacterium tuberculosis
GVGKRRYAGNGRTAGLFGHGGAGG

SEQ ID NO: 1524609 - protein, 35 aa, Mycobacterium tuberculosis; identical to SEQ ID NO: 162569

SEQ ID NO: 1524610 - protein, 20 aa, Mycobacterium tuberculosis
GVGPTLLLCPMSLVGNWPQE

SEQ ID NO: 1524611 - protein, 17 aa, Mycobacterium tuberculosis
GVGVPDGIGGANGAQGK

SEQ ID NO: 1524612 - protein, 23 aa, Mycobacterium tuberculosis
GVHALRARGALIRIGHDASSLDL

SEQ ID NO: 1524613 - protein, 18 aa, Mycobacterium tuberculosis
GVHPALLDAVLHAVVIAG

SEQ ID NO: 1524614 - protein, 23 aa, Mycobacterium tuberculosis
GVIGQFHLPLQHTSRGRRARGGF

SEQ ID NO: 1524615 - protein, 25 aa, Mycobacterium tuberculosis
GVIKMVLAMRHELLPATLHVDVPSP

SEQ ID NO: 1524616 - protein, 20 aa, Mycobacterium tuberculosis
GVIKVVREIVSGLGLKEAKD

SEQ ID NO: 1524617 - protein, 22 aa, Mycobacterium tuberculosis
GVITPRIEHPPVPGARVKEPHI

SEQ ID NO: 1524618 - protein, 17 aa, Mycobacterium tuberculosis
GVLPRYGVRLTVMAHPP

SEQ ID NO: 1524619 - protein, 18 aa, Mycobacterium tuberculosis
GVLRVPPRPYVMPHSPAA

SEQ ID NO: 1524620 - protein, 18 aa, Mycobacterium tuberculosis
GVLVGSWHTIEGLVYSMP

SEQ ID NO: 1524621 - protein, 20 aa, Mycobacterium tuberculosis
GVLWVGDYQGLFGVSAGSSI

SEQ ID NO: 1524622 - protein, 17 aa, Mycobacterium tuberculosis
GVLYLFVRGMCGAATPV

SEQ ID NO: 1524623 - protein, 22 aa, Mycobacterium tuberculosis
GVMRTWYLIGRKVAADPGEVRG

SEQ ID NO: 1524624 - protein, 24 aa, Mycobacterium tuberculosis
GVNFIDTYFRSGQYPRELPFVIGS

SEQ ID NO: 1524625 - protein, 21 aa, Mycobacterium tuberculosis
GVNPAPVTNPALNGAAGDSNI

SEQ ID NO: 1524626 - protein, 24 aa, Mycobacterium tuberculosis
GVNQQEIMIWFTTRAPFSRSAPRW

SEQ ID NO: 1524627 - protein, 19 aa, Mycobacterium tuberculosis
GVPFYDHMLTALGSHASFD

SEQ ID NO: 1524628 - protein, 17 aa, Mycobacterium tuberculosis
GVPGMPGLAGLPGGLPD

SEQ ID NO: 1524629 - protein, 19 aa, Mycobacterium tuberculosis
GVPPLTMKPDVCWQLPIRR

SEQ ID NO: 1524630 - protein, 34 aa, Mycobacterium tuberculosis
GVPVFAWKGETLEEYWWAAEQMLTWPDPDKSANM

SEQ ID NO: 1524631 - protein, 17 aa, Mycobacterium tuberculosis
GVQLLVDLVRHAVLFAA

SEQ ID NO: 1524632 - protein, 19 aa, Mycobacterium tuberculosis
GVRALNPLFGTENLRRIEP

SEQ ID NO: 1524633 - protein, 20 aa, Mycobacterium tuberculosis
GVRCPGRTGGGRRAERYRRG

SEQ ID NO: 1524634 - protein, 18 aa, Mycobacterium tuberculosis
GVRDGRSTFRYPGGPIVH

SEQ ID NO: 1524635 - protein, 27 aa, Mycobacterium tuberculosis
GVRLNPLRPLAQLWPPHVPAMLVAGCD

SEQ ID NO: 1524636 - protein, 27 aa, Mycobacterium tuberculosis
GVRPATQYRYLLIASPAGAYFKGGIAP

SEQ ID NO: 1524637 - protein, 22 aa, Mycobacterium tuberculosis
GVRPHAIRVPDAALDAVLAGLD

SEQ ID NO: 1524638 - protein, 33 aa, Mycobacterium tuberculosis
GVRRVILIHWDDFFRPLSKPLRALPYAADDLDL

SEQ ID NO: 1524639 - protein, 23 aa, Mycobacterium tuberculosis
GVRSLRVRLGIHPVYKTVDTCAA

SEQ ID NO: 1524640 - protein, 18 aa, Mycobacterium tuberculosis
GVRVFFPDPWPKARHHKR

SEQ ID NO: 1524641 - protein, 18 aa, Mycobacterium tuberculosis
GVSAGLDLALWLAGQLGG

SEQ ID NO: 1524642 - protein, 19 aa, Mycobacterium tuberculosis
GVSHLYLSPILTAVGGSTH

SEQ ID NO: 1524643 - protein, 22 aa, Mycobacterium tuberculosis
GVSMQALLERAYRMGLVSAEAR

SEQ ID NO: 1524644 - protein, 25 aa, Mycobacterium tuberculosis
GVSRQTLHTWLARYEAEGLDGLRIG

SEQ ID NO: 1524645 - protein, 25 aa, Mycobacterium tuberculosis
GVSRSYWDQLKWNALANIAGTPATT

SEQ ID NO: 1524646 - protein, 19 aa, Mycobacterium tuberculosis
GVTGAPARRRRRRRGDSDA

SEQ ID NO: 1524647 - protein, 19 aa, Mycobacterium tuberculosis
GVTICQWTRYFPAGDPVAA

SEQ ID NO: 1524648 - protein, 19 aa, Mycobacterium tuberculosis
GVTPSMSWTASSAPSRWVN

SEQ ID NO: 1524649 - protein, 25 aa, Mycobacterium tuberculosis
GVTPVEHGLVLPSGPLIHGGTGGYG

SEQ ID NO: 1524650 - protein, 25 aa, Mycobacterium tuberculosis
GVVGSRRFFYDVWGDAVNVASRMES

SEQ ID NO: 1524651 - protein, 33 aa, Mycobacterium tuberculosis
GVVHPAVVQANRVRTWLLAVSNVFGQNAPAIAA

SEQ ID NO: 1524652 - protein, 21 aa, Mycobacterium tuberculosis
GVVIEEQIFIGVNATLRDHIT

SEQ ID NO: 1524653 - protein, 19 aa, Mycobacterium tuberculosis
GVVLLAGAAFVELALRAAD

SEQ ID NO: 1524654 - protein, 20 aa, Mycobacterium tuberculosis
GVVLLAGAAFVELALRAADQ

SEQ ID NO: 1524655 - protein, 21 aa, Mycobacterium tuberculosis
GVVLLAGAAFVELALRAADQV

SEQ ID NO: 1524656 - protein, 17 aa, Mycobacterium tuberculosis
GVVNAPAQALLGRPLIG

SEQ ID NO: 1524657 - protein, 24 aa, Mycobacterium tuberculosis
GVVPDALTVLVRLLASLHDDDGNV

SEQ ID NO: 1524658 - protein, 25 aa, Mycobacterium tuberculosis
GVVRFIGVDGYRWMIRCVVNGPQET

SEQ ID NO: 1524659 - protein, 23 aa, Mycobacterium tuberculosis
GWANADLISWTFQGPNWAFGGAY

SEQ ID NO: 1524660 - protein, 20 aa, Mycobacterium tuberculosis
GWEVDPYAIPLLQTAHRTGA

SEQ ID NO: 1524661 - protein, 25 aa, Mycobacterium tuberculosis
GWEVDPYAIPLLQTAHRTGARVVLR

SEQ ID NO: 1524662 - protein, 29 aa, Mycobacterium tuberculosis
GWGRRRRYGWGWWWRRRGGWQRGPVRQRR

SEQ ID NO: 1524663 - protein, 19 aa, Mycobacterium tuberculosis
GWGYPQPRSGQRARRATGQ

SEQ ID NO: 1524664 - protein, 22 aa, Mycobacterium tuberculosis
GWLADHSVAGVTIFPGAGFVEL

SEQ ID NO: 1524665 - protein, 37 aa, Mycobacterium tuberculosis
GWLFHAHWRYSLRQQRWWCLQPWRHTHRIVDGLRRVA

SEQ ID NO: 1524666 - protein, 17 aa, Mycobacterium tuberculosis
GWMTTYAYPAEAISSRV

SEQ ID NO: 1524667 - protein, 18 aa, Mycobacterium tuberculosis
GWPNLAAELQLAFQQLLV

SEQ ID NO: 1524668 - protein, 21 aa, Mycobacterium tuberculosis
GWRHLPDWPPATTERAWYLQP

SEQ ID NO: 1524669 - protein, 20 aa, Mycobacterium tuberculosis
GWRRPQAYPLMSHLAARGWV

SEQ ID NO: 1524670 - protein, 26 aa, Mycobacterium tuberculosis
GWRRRGWIVAIDRHFQRRRHPRHVGF

SEQ ID NO: 1524671 - protein, 28 aa, Mycobacterium tuberculosis
GWSLPLFVSELLALYRAGGHVAALPAAP

SEQ ID NO: 1524672 - protein, 17 aa, Mycobacterium tuberculosis
GWTGRFVSRILIDGSTL

SEQ ID NO: 1524673 - protein, 25 aa, Mycobacterium tuberculosis
GWVDANVWRHVVPKGWFYNVMITGV

SEQ ID NO: 1524674 - protein, 26 aa, Mycobacterium tuberculosis
GWVDAYARRILGWRVASTMATSMVLD

SEQ ID NO: 1524675 - protein, 22 aa, Mycobacterium tuberculosis
GWVQGVGFRWWTRCRALELGLT

SEQ ID NO: 1524676 - protein, 20 aa, Mycobacterium tuberculosis
GWWVLGIRTPTAAECLRAVP

SEQ ID NO: 1524677 - protein, 32 aa, Mycobacterium tuberculosis; identical to SEQ ID NO: 226353

SEQ ID NO: 1524678 - protein, 27 aa, Mycobacterium tuberculosis
GYANFAIADPPLKLVLLENPGTGGTLN

SEQ ID NO: 1524679 - protein, 21 aa, Mycobacterium tuberculosis
GYCHCMFTALDTLPAERYQPW

SEQ ID NO: 1524680 - protein, 31 aa, Mycobacterium tuberculosis
GYDEGNAEQYLWWVPHNVAGLVTALGGRTAV

SEQ ID NO: 1524681 - protein, 23 aa, Mycobacterium tuberculosis
GYEFRLLQIKFATLNITGDCFLL

SEQ ID NO: 1524682 - protein, 19 aa, Mycobacterium tuberculosis
GYIESLDGKGQAGNGGNGG

SEQ ID NO: 1524683 - protein, 24 aa, Mycobacterium tuberculosis
GYLALLEAAFLIHRVPAWSTNLSR

SEQ ID NO: 1524684 - protein, 17 aa, Mycobacterium tuberculosis
GYLAQLRELLGPNAWIV

SEQ ID NO: 1524685 - protein, 17 aa, Mycobacterium tuberculosis
GYLLRAPHTPPLVIDFA

SEQ ID NO: 1524686 - protein, 18 aa, Mycobacterium tuberculosis
GYPALVAPLTFLAIAGRR

SEQ ID NO: 1524687 - protein, 30 aa, Mycobacterium tuberculosis
GYPVKASVSFGLYYPPGSALYHDTLAELWF

SEQ ID NO: 1524688 - protein, 19 aa, Mycobacterium tuberculosis
GYRSPRYLRFGWAAARLDD

SEQ ID NO: 1524689 - protein, 20 aa, Mycobacterium tuberculosis
GYRVIPIRYGCANFPSQGVR

SEQ ID NO: 1524690 - protein, 32 aa, Mycobacterium tuberculosis
GYTEYHQLGLIDKLPRMLGTQAAGAAPLVLSE

SEQ ID NO: 1524691 - protein, 24 aa, Mycobacterium tuberculosis
GYVFDLETDWPIRAALLSTPEQTV

SEQ ID NO: 1524692 - protein, 23 aa, Mycobacterium tuberculosis
GYVHLPFQLHVLDMAADRVSHVV

SEQ ID NO: 1524693 - protein, 25 aa, Mycobacterium tuberculosis
HAAAAPFIAAVIPPGSDSVSVCNTV

SEQ ID NO: 1524694 - protein, 36 aa, Mycobacterium tuberculosis
HAAAYRQLRYFWSRVIADTGWQLLDSKFAVVARAAS

SEQ ID NO: 1524695 - protein, 28 aa, Mycobacterium tuberculosis
HAANLKCLCRLHHLLATFCGWRAQQLPD

SEQ ID NO: 1524696 - protein, 17 aa, Mycobacterium tuberculosis
HAANYGVYGARKVWLTL

SEQ ID NO: 1524697 - protein, 25 aa, Mycobacterium tuberculosis
HAARRTRLLLRPLVPDAPGGVRGRV

SEQ ID NO: 1524698 - protein, 20 aa, Mycobacterium tuberculosis
HAASHHARVGRRARAARLLR

SEQ ID NO: 1524699 - protein, 24 aa, Mycobacterium tuberculosis
HADAVDFHRWLQWQLDEQLASAQS

SEQ ID NO: 1524700 - protein, 25 aa, Mycobacterium tuberculosis
HADDIRLRRWRWFDVLINTPTARAV

SEQ ID NO: 1524701 - protein, 27 aa, Mycobacterium tuberculosis
HAEEITDRILLLDGLPNYQRIGSLRIG

SEQ ID NO: 1524702 - protein, 25 aa, Mycobacterium tuberculosis
HAEGRLGRAVLQPPSQVGADVEQAR

SEQ ID NO: 1524703 - protein, 20 aa, Mycobacterium tuberculosis
HAEQLKWHQAASALNEILID

SEQ ID NO: 1524704 - protein, 24 aa, Mycobacterium tuberculosis
HAEVLAHWPEVIASPTPAAAAAAD

SEQ ID NO: 1524705 - protein, 18 aa, Mycobacterium tuberculosis
HAFAGSLLRDYGLLLPLE

SEQ ID NO: 1524706 - protein, 18 aa, Mycobacterium tuberculosis
HAFMAERVESGFGSLDEV

SEQ ID NO: 1524707 - protein, 20 aa, Mycobacterium tuberculosis
HAFPASRWRRYDKLERFPRG

SEQ ID NO: 1524708 - protein, 19 aa, Mycobacterium tuberculosis
HAGFPLAEIAADGSSVITK

SEQ ID NO: 1524709 - protein, 17 aa, Mycobacterium tuberculosis
HAGLSYLLVPLDQPGVQ

SEQ ID NO: 1524710 - protein, 24 aa, Mycobacterium tuberculosis
HAGSWLYGLPELPGARDQLRGTRR

SEQ ID NO: 1524711 - protein, 21 aa, Mycobacterium tuberculosis
HAGYLRLMRSGVYVNPVAPPA

SEQ ID NO: 1524712 - protein, 19 aa, Mycobacterium tuberculosis
HAHAWALRMSPDGNVWGAT

SEQ ID NO: 1524713 - protein, 20 aa, Mycobacterium tuberculosis
HAHKVPRRLLKAARLGLIDF

SEQ ID NO: 1524714 - protein, 22 aa, Mycobacterium tuberculosis
HAHVKAMMLAEPASWHALMAKL

SEQ ID NO: 1524715 - protein, 34 aa, Mycobacterium tuberculosis
HAIRRHRRAPGRFLIGAGPRRNLLRHKQVGFDCG

SEQ ID NO: 1524716 - protein, 22 aa, Mycobacterium tuberculosis
HAKALLQSAFRTQGCSDRPAAA

SEQ ID NO: 1524717 - protein, 35 aa, Mycobacterium tuberculosis
HALLLASCLQPLWRARGRLQEGLAWFAAALADHDA

SEQ ID NO: 1524718 - protein, 17 aa, Mycobacterium tuberculosis
HAPGQLDFLGYGAQRAL

SEQ ID NO: 1524719 - protein, 23 aa, Mycobacterium tuberculosis
HARGLRSLAPGGLPARRGAGAFG

SEQ ID NO: 1524720 - protein, 23 aa, Mycobacterium tuberculosis
HASPLLVSVFLEKDFAFVVSSEA

SEQ ID NO: 1524721 - protein, 18 aa, Mycobacterium tuberculosis
HASRLDGSPLRYNQLDPY

SEQ ID NO: 1524722 - protein, 17 aa, Mycobacterium tuberculosis
HATAWYGLNDLAQIKAG

SEQ ID NO: 1524723 - protein, 24 aa, Mycobacterium tuberculosis
HATGLVVVPVMFDRIMDLPAEIRN

SEQ ID NO: 1524724 - protein, 25 aa, Mycobacterium tuberculosis
HAVAFHEQFVQLMSAGAAQYASAEA

SEQ ID NO: 1524725 - protein, 24 aa, Mycobacterium tuberculosis
HAVEVGRRVIFMVTGVLPTEDEIS

SEQ ID NO: 1524726 - protein, 18 aa, Mycobacterium tuberculosis
HAVHAYPRTASVVIWYSP

SEQ ID NO: 1524727 - protein, 27 aa, Mycobacterium tuberculosis
HAVWGHRLAHWLWQRGARLLARAAAEF

SEQ ID NO: 1524728 - protein, 17 aa, Mycobacterium tuberculosis
HAWLGDAFHAWVQQFYG

SEQ ID NO: 1524729 - protein, 22 aa, Mycobacterium tuberculosis
HAWVQAWNGGWWHYDPTNDNEI

SEQ ID NO: 1524730 - protein, 29 aa, Mycobacterium tuberculosis
HAYAGELLFLYNGVRPRNVMPVHGTWRML

SEQ ID NO: 1524731 - protein, 19 aa, Mycobacterium tuberculosis
HAYPLSTTLLTNVMARNAT

SEQ ID NO: 1524732 - protein, 18 aa, Mycobacterium tuberculosis
HCCWPTKPVPIAAHRAAL

SEQ ID NO: 1524733 - protein, 19 aa, Mycobacterium tuberculosis
HCDPSLSPYGPPGHRYPRH

SEQ ID NO: 1524734 - protein, 17 aa, Mycobacterium tuberculosis
HCRFYQRPRRRCSAPRR

SEQ ID NO: 1524735 - protein, 18 aa, Mycobacterium tuberculosis
HDAEFFFVANAHLRLHVH

SEQ ID NO: 1524736 - protein, 17 aa, Mycobacterium tuberculosis
HDAPKGEFLLFDGRVHT

SEQ ID NO: 1524737 - protein, 17 aa, Mycobacterium tuberculosis
HDDFRNAWFVDASGRKV

SEQ ID NO: 1524738 - protein, 25 aa, Mycobacterium tuberculosis
HDDRGPVWVFSRQGSQWPGMGTELL

SEQ ID NO: 1524739 - protein, 22 aa, Mycobacterium tuberculosis
HDGRTWYRTGDLARYWHDGTLE

SEQ ID NO: 1524740 - protein, 19 aa, Mycobacterium tuberculosis
HDGTPGLSLLVFDPANGHT

SEQ ID NO: 1524741 - protein, 18 aa, Mycobacterium tuberculosis
HDLAPRQIARTAPTTARS

SEQ ID NO: 1524742 - protein, 26 aa, Mycobacterium tuberculosis
HDLQPFPLPALTCLLRSITLRMTMAP

SEQ ID NO: 1524743 - protein, 20 aa, Mycobacterium tuberculosis
HDPDLLLVEALDAMVLTAGA

SEQ ID NO: 1524744 - protein, 17 aa, Mycobacterium tuberculosis
HDPRRFATDLLERFRDL

SEQ ID NO: 1524745 - protein, 17 aa, Mycobacterium tuberculosis
HDPSDTHWLGRDRFVLS

SEQ ID NO: 1524746 - protein, 23 aa, Mycobacterium tuberculosis
HDPSDTHWLGRDRFVLSAGHSSL

SEQ ID NO: 1524747 - protein, 20 aa, Mycobacterium tuberculosis
HDPVMCFSGPMIFGAGVLGG

SEQ ID NO: 1524748 - protein, 33 aa, Mycobacterium tuberculosis
HDRAYSGYIPILGAPWLADLVRRSPWGGMFASP

SEQ ID NO: 1524749 - protein, 19 aa, Mycobacterium tuberculosis
HDVDRLSAFFDLVQQDPVV

SEQ ID NO: 1524750 - protein, 25 aa, Mycobacterium tuberculosis
HDVEFFNEFYALDLALTQTPSGPVA

SEQ ID NO: 1524751 - protein, 17 aa, Mycobacterium tuberculosis
HEDQAHVDLLWSLSRAP

SEQ ID NO: 1524752 - protein, 18 aa, Mycobacterium tuberculosis
HEDQAHVDLLWSLSRAPD

SEQ ID NO: 1524753 - protein, 17 aa, Mycobacterium tuberculosis
HEFPTEPGAAGLDGEPG

SEQ ID NO: 1524754 - protein, 22 aa, Mycobacterium tuberculosis
HEFRPERFLGTRPQTYAWVPFG

SEQ ID NO: 1524755 - protein, 23 aa, Mycobacterium tuberculosis
HEFRPERFLGTRPQTYAWVPFGG

SEQ ID NO: 1524756 - protein, 22 aa, Mycobacterium tuberculosis
HEHERLLGWQRQMLARIEVPYR

SEQ ID NO: 1524757 - protein, 37 aa, Mycobacterium tuberculosis
HELALQDWLGTAAFYRPEDYWPEQWAHAYVDFAAGEK

SEQ ID NO: 1524758 - protein, 17 aa, Mycobacterium tuberculosis
HEMTFSMLYAFSENYVL

SEQ ID NO: 1524759 - protein, 25 aa, Mycobacterium tuberculosis
HERGLPMSFTFARFLKFIVTEIFPG

SEQ ID NO: 1524760 - protein, 19 aa, Mycobacterium tuberculosis
HERHPYGGDLVYTAFSGSH

SEQ ID NO: 1524761 - protein, 29 aa, Mycobacterium tuberculosis
HETFDLGPLVIFPPMNIPATVIESFSTAP

SEQ ID NO: 1524762 - protein, 26 aa, Mycobacterium tuberculosis
HFADGWNTFNLTLQGDVKRVPGGLTT

SEQ ID NO: 1524763 - protein, 18 aa, Mycobacterium tuberculosis
HFALSGVLTALDDLFGQV

SEQ ID NO: 1524764 - protein, 20 aa, Mycobacterium tuberculosis
HFERELVHSPPFRSSDPKPR

SEQ ID NO: 1524765 - protein, 29 aa, Mycobacterium tuberculosis
HFGQSGGFIWVDPKAVLALVVLTARDFGD

SEQ ID NO: 1524766 - protein, 20 aa, Mycobacterium tuberculosis
HFHSIFYLRHNARRQEHLAT

SEQ ID NO: 1524767 - protein, 19 aa, Mycobacterium tuberculosis
HFVQKYRIAKWFNEIRGRT

SEQ ID NO: 1524768 - protein, 21 aa, Mycobacterium tuberculosis
HFYRDVLGFRLRDSMRLPPQM

SEQ ID NO: 1524769 - protein, 18 aa, Mycobacterium tuberculosis
HGAHLRLIPQRRLGGLGD

SEQ ID NO: 1524770 - protein, 23 aa, Mycobacterium tuberculosis
HGDKLFQLVRRVPVTTIIVDTPQ

SEQ ID NO: 1524771 - protein, 19 aa, Mycobacterium tuberculosis
HGFTIGQRRGLGIAGPGPN

SEQ ID NO: 1524772 - protein, 20 aa, Mycobacterium tuberculosis
HGFTIGQRRGLGIAGPGPNG

SEQ ID NO: 1524773 - protein, 26 aa, Mycobacterium tuberculosis
HGFVCAIRAWAYQIADLAGDYRVIAF

SEQ ID NO: 1524774 - protein, 27 aa, Mycobacterium tuberculosis
HGGCGGFHRWFRWWPDHCRWPSSSACS

SEQ ID NO: 1524775 - protein, 18 aa, Mycobacterium tuberculosis
HGGEMWRGDFAWPDMRLA

SEQ ID NO: 1524776 - protein, 23 aa, Mycobacterium tuberculosis
HGGNATLIGNGGDGGAGGAGGAG

SEQ ID NO: 1524777 - protein, 18 aa, Mycobacterium tuberculosis
HGGPVRMVVPGFIGARSV

SEQ ID NO: 1524778 - protein, 17 aa, Mycobacterium tuberculosis
HGGVGGAAGLLGVGGHG

SEQ ID NO: 1524779 - protein, 22 aa, Mycobacterium tuberculosis
HGGYGYMREYPVARAYLDSRVQ

SEQ ID NO: 1524780 - protein, 25 aa, Mycobacterium tuberculosis
HGHTEWLPPPHLDHGQPRTNTFHHP

SEQ ID NO: 1524781 - protein, 17 aa, Mycobacterium tuberculosis
HGIGGFPRWDPGRWAAS

SEQ ID NO: 1524782 - protein, 17 aa, Mycobacterium tuberculosis
HGLALAALGLDPIVDLH

SEQ ID NO: 1524783 - protein, 17 aa, Mycobacterium tuberculosis
HGLTPRARIVAQALVGA

SEQ ID NO: 1524784 - protein, 18 aa, Mycobacterium tuberculosis
HGMTTRYLLDKSAAYRAH

SEQ ID NO: 1524785 - protein, 23 aa, Mycobacterium tuberculosis
HGNLGFANLGLTAGAVGLANVGF

SEQ ID NO: 1524786 - protein, 26 aa, Mycobacterium tuberculosis
HGNSVPRFHITWGTGPALVDKFVRQL

SEQ ID NO: 1524787 - protein, 22 aa, Mycobacterium tuberculosis
HGPLRAAVRRPLRHSPLPAGRR

SEQ ID NO: 1524788 - protein, 27 aa, Mycobacterium tuberculosis
HGPMDRFHRRLLWPIRTSAGEVVGFGA

SEQ ID NO: 1524789 - protein, 17 aa, Mycobacterium tuberculosis
HGQAYQELSAHAVAFHE

SEQ ID NO: 1524790 - protein, 23 aa, Mycobacterium tuberculosis
HGRFALGERLLGFGSVTGAHIAA

SEQ ID NO: 1524791 - protein, 23 aa, Mycobacterium tuberculosis
HGRFALGERLLGFGSVTGAYIAA

SEQ ID NO: 1524792 - protein, 17 aa, Mycobacterium tuberculosis
HGRPIRRSAQAAAFHTR

SEQ ID NO: 1524793 - protein, 20 aa, Mycobacterium tuberculosis
HGRVYAVSWCWPGSRRLSAI

SEQ ID NO: 1524794 - protein, 23 aa, Mycobacterium tuberculosis
HGSTPRWFAIPRPTCLRSPNCWR

SEQ ID NO: 1524795 - protein, 17 aa, Mycobacterium tuberculosis
HGTAIVPVILGNPTVAH

SEQ ID NO: 1524796 - protein, 34 aa, Mycobacterium tuberculosis
HGTTVRAMRFLPWDRRRYQPTGRLALPCFATEIA

SEQ ID NO: 1524797 - protein, 24 aa, Mycobacterium tuberculosis
HGTVMLRMPLHPVAIELLREVGPM

SEQ ID NO: 1524798 - protein, 28 aa, Mycobacterium tuberculosis
HGVGRLKRPWLAGYLGPDVLALNQRIKQ

SEQ ID NO: 1524799 - protein, 22 aa, Mycobacterium tuberculosis
HGYELLPPWESAGVVFDALLAA

SEQ ID NO: 1524800 - protein, 24 aa, Mycobacterium tuberculosis
HHAGTAWPRRRARRRFGCAWSNGT

SEQ ID NO: 1524801 - protein, 19 aa, Mycobacterium tuberculosis
HHEGRVVFVRYACPVNECG

SEQ ID NO: 1524802 - protein, 22 aa, Mycobacterium tuberculosis
HHHGGFPEYGPASPGAGFGQFV

SEQ ID NO: 1524803 - protein, 19 aa, Mycobacterium tuberculosis
HHHRNEVTEIIPLDGFLDG

SEQ ID NO: 1524804 - protein, 20 aa, Mycobacterium tuberculosis
HHHRNEVTEIIPLDGFLDGL

SEQ ID NO: 1524805 - protein, 38 aa, Mycobacterium tuberculosis
HHKSIYIFLADRHSGWWRAPLRWTLRGSLALRSHLMVR

SEQ ID NO: 1524806 - protein, 27 aa, Mycobacterium tuberculosis
HHQKLTGYENLRFFASLYAGATADPMQ

SEQ ID NO: 1524807 - protein, 18 aa, Mycobacterium tuberculosis
HHRALPGALGIDVAVGAA

SEQ ID NO: 1524808 - protein, 17 aa, Mycobacterium tuberculosis
HHRFDVPGRRWDQLGLC

SEQ ID NO: 1524809 - protein, 19 aa, Mycobacterium tuberculosis
HHRTRTMLALPPLPPAPGI

SEQ ID NO: 1524810 - protein, 17 aa, Mycobacterium tuberculosis
HHTARGVAGPRPSPRRA

SEQ ID NO: 1524811 - protein, 23 aa, Mycobacterium tuberculosis
HHTRLRKIISRGFTPRAVGRLHD

SEQ ID NO: 1524812 - protein, 17 aa, Mycobacterium tuberculosis
HHVRADAPPFFVLHGRH

SEQ ID NO: 1524813 - protein, 17 aa, Mycobacterium tuberculosis
HIAQLLHEAAHRERLGL

SEQ ID NO: 1524814 - protein, 17 aa, Mycobacterium tuberculosis
HIDQTRALEPLEVTSRW

SEQ ID NO: 1524815 - protein, 24 aa, Mycobacterium tuberculosis
HIEAPTLILHRVGSTYIPVGHGRY

SEQ ID NO: 1524816 - protein, 19 aa, Mycobacterium tuberculosis
HIERVLRPAAQRLGRPLRI

SEQ ID NO: 1524817 - protein, 17 aa, Mycobacterium tuberculosis
HIGIRLPGRYNVANCLG

SEQ ID NO: 1524818 - protein, 20 aa, Mycobacterium tuberculosis
HIPAFKLTRSSAAYWRGDQK

SEQ ID NO: 1524819 - protein, 18 aa, Mycobacterium tuberculosis
HIRICDHEFTFQISAGTH

SEQ ID NO: 1524820 - protein, 26 aa, Mycobacterium tuberculosis
HIRRWRHRRWWWERRHRLNGGKGDTG

SEQ ID NO: 1524821 - protein, 17 aa, Mycobacterium tuberculosis
HIVAVRQGAVLATAFHP

SEQ ID NO: 1524822 - protein, 25 aa, Mycobacterium tuberculosis
HIYHYAPYEKTALLRLVGRYGIGED

SEQ ID NO: 1524823 - protein, 20 aa, Mycobacterium tuberculosis
HKLAVLVVSAIPLAEPVRLA

SEQ ID NO: 1524824 - protein, 18 aa, Mycobacterium tuberculosis
HKQPPLQRLVRALLGFDA

SEQ ID NO: 1524825 - protein, 23 aa, Mycobacterium tuberculosis
HKRRLRHMLIADARPSGVLRPGT

SEQ ID NO: 1524826 - protein, 36 aa, Mycobacterium tuberculosis
HKSTYIFLADRHSGWWRAPLRWTLRDHWRCVPTSWV

SEQ ID NO: 1524827 - protein, 31 aa, Mycobacterium tuberculosis
HKVMPIMTSLLNYYPHLWRSRPRHPGGVAER

SEQ ID NO: 1524828 - protein, 19 aa, Mycobacterium tuberculosis
HLAAILYDIPHVLTAHSLE

SEQ ID NO: 1524829 - protein, 25 aa, Mycobacterium tuberculosis
HLAQAWRKHIGPPRQLPADSPQGQA

SEQ ID NO: 1524830 - protein, 25 aa, Mycobacterium tuberculosis
HLAQAWRKHIGPPRQLPADSPTRAS

SEQ ID NO: 1524831 - protein, 22 aa, Mycobacterium tuberculosis
HLAVQSLRLGECDLALVGGVTV

SEQ ID NO: 1524832 - protein, 17 aa, Mycobacterium tuberculosis
HLAVRVARMHKTSLTVA

SEQ ID NO: 1524833 - protein, 26 aa, Mycobacterium tuberculosis
HLDGGFGPVVLPPIPVPAVNAHLTGN

SEQ ID NO: 1524834 - protein, 20 aa, Mycobacterium tuberculosis
HLDPLRAAVLAHRADLGLAH

SEQ ID NO: 1524835 - protein, 19 aa, Mycobacterium tuberculosis
HLFEAWQRWRVQEGVPEIS

SEQ ID NO: 1524836 - protein, 20 aa, Mycobacterium tuberculosis
HLFEAWQRWRVQEGVPEISR

SEQ ID NO: 1524837 - protein, 17 aa, Mycobacterium tuberculosis
HLFVRPVIRMDQTAWCA

SEQ ID NO: 1524838 - protein, 28 aa, Mycobacterium tuberculosis
HLHGRSRLWLFRYQGTPIAFFLNVWGAD

SEQ ID NO: 1524839 - protein, 30 aa, Mycobacterium tuberculosis
HLHGRSRLWLFRYQGTPIAFFLNVWGADEN

SEQ ID NO: 1524840 - protein, 24 aa, Mycobacterium tuberculosis
HLHQGIALQVPPYNYAHPDDLLAA

SEQ ID NO: 1524841 - protein, 27 aa, Mycobacterium tuberculosis
HLHQRGPLRGQCALLWRGSRSVQGRSR

SEQ ID NO: 1524842 - protein, 17 aa, Mycobacterium tuberculosis
HLIADAGVLTHRRTRAG

SEQ ID NO: 1524843 - protein, 17 aa, Mycobacterium tuberculosis
HLIAGLIAAGAIDVGIA

SEQ ID NO: 1524844 - protein, 24 aa, Mycobacterium tuberculosis
HLIDAARPFIFDTGLAPAAVGAAR

SEQ ID NO: 1524845 - protein, 29 aa, Mycobacterium tuberculosis
HLIEIPAVSTLLQPLLSTIPLQVFAASVA

SEQ ID NO: 1524846 - protein, 20 aa, Mycobacterium tuberculosis
HLITKPVFDALFAGHDFASH

SEQ ID NO: 1524847 - protein, 27 aa, Mycobacterium tuberculosis
HLKVGKALYSVPWRLIGQRLHARTAGD

SEQ ID NO: 1524848 - protein, 25 aa, Mycobacterium tuberculosis
HLLEANLRLVVSLAKRYTGRGMAFL

SEQ ID NO: 1524849 - protein, 17 aa, Mycobacterium tuberculosis
HLLTLARRRGVRLVTFD

SEQ ID NO: 1524850 - protein, 19 aa, Mycobacterium tuberculosis
HLPSKENGFALLKVGPRDL

SEQ ID NO: 1524851 - protein, 26 aa, Mycobacterium tuberculosis
HLPVVCRTICRSAVWWSWSATRSVRG

SEQ ID NO: 1524852 - protein, 18 aa, Mycobacterium tuberculosis
HLQITCDADYSFTVPDIP

SEQ ID NO: 1524853 - protein, 27 aa, Mycobacterium tuberculosis
HLQRARVPMPIIAVSSLLRSHAVTLND

SEQ ID NO: 1524854 - protein, 25 aa, Mycobacterium tuberculosis
HLSLTLNRLPQVAALFLAGQLSARL

SEQ ID NO: 1524855 - protein, 29 aa, Mycobacterium tuberculosis
HLSRLVPQHLMRRLFFTAATVDAATLQHF

SEQ ID NO: 1524856 - protein, 17 aa, Mycobacterium tuberculosis
HLTHVYAKLGLASRVQL

SEQ ID NO: 1524857 - protein, 33 aa, Mycobacterium tuberculosis
HLTVFQRTPIWCFPKFDVPLPTAVRWAMRIPGG

SEQ ID NO: 1524858 - protein, 25 aa, Mycobacterium tuberculosis
HLVAHPQSWKLLRGKVTLPSHDQLQ

SEQ ID NO: 1524859 - protein, 29 aa, Mycobacterium tuberculosis
HLVALPNGRYGWRISLPAMGVLLERTGPR

SEQ ID NO: 1524860 - protein, 25 aa, Mycobacterium tuberculosis
HLVKTFWGWRDQQLPDGTLILTSRP

SEQ ID NO: 1524861 - protein, 25 aa, Mycobacterium tuberculosis
HLVKTFWGWRDQQLPDGTLILTSTS

SEQ ID NO: 1524862 - protein, 17 aa, Mycobacterium tuberculosis
HMALLVDEYGAIAGLVS

SEQ ID NO: 1524863 - protein, 24 aa, Mycobacterium tuberculosis
HMISTLFLTLADYPDQLTLLAQQP

SEQ ID NO: 1524864 - protein, 17 aa, Mycobacterium tuberculosis
HNGLMGYVLAELGYRVR

SEQ ID NO: 1524865 - protein, 20 aa, Mycobacterium tuberculosis
HNLPGLVTQLHRGRSFGTAR

SEQ ID NO: 1524866 - protein, 17 aa, Mycobacterium tuberculosis
HNRVLNERLLTIEWHQR

SEQ ID NO: 1524867 - protein, 18 aa, Mycobacterium tuberculosis
HNRVRAMFPHAIGLSAGM

SEQ ID NO: 1524868 - protein, 18 aa, Mycobacterium tuberculosis
HPAALHLRPARRRISCCP

SEQ ID NO: 1524869 - protein, 25 aa, Mycobacterium tuberculosis
HPATPGIDGALLFALSASSQDALRQ

SEQ ID NO: 1524870 - protein, 26 aa, Mycobacterium tuberculosis
HPAVRGRAPIPRRTRAHPFPPPGGVG

SEQ ID NO: 1524871 - protein, 19 aa, Mycobacterium tuberculosis
HPDIVLPTHPNGMTFTAAG

SEQ ID NO: 1524872 - protein, 29 aa, Mycobacterium tuberculosis
HPEAAILGLGAIWWRSSRARWSSAARLFR

SEQ ID NO: 1524873 - protein, 43 aa, Mycobacterium tuberculosis
HPGARRTRRVRRAWRPAVRPNRHGWRVAVAGRLAASAALASSQ

SEQ ID NO: 1524874 - protein, 24 aa, Mycobacterium tuberculosis
HPLGATGLAQCELTWQLRGTAEAR

SEQ ID NO: 1524875 - protein, 17 aa, Mycobacterium tuberculosis
HPLPPQTVVGIPSSEGS

SEQ ID NO: 1524876 - protein, 22 aa, Mycobacterium tuberculosis
HPLPVRIRSFRRPAAGRRDRAA

SEQ ID NO: 1524877 - protein, 25 aa, Mycobacterium tuberculosis
HPNVFVVGDLMFVPGVPGVAQGAIQ

SEQ ID NO: 1524878 - protein, 17 aa, Mycobacterium tuberculosis
HPRSWLLRQASSGVSAA

SEQ ID NO: 1524879 - protein, 23 aa, Mycobacterium tuberculosis
HPTNLGRLVLGTPAPLPCTPRGI

SEQ ID NO: 1524880 - protein, 24 aa, Mycobacterium tuberculosis
HPVHRYFLAAKQTEFALGGATGQL

SEQ ID NO: 1524881 - protein, 17 aa, Mycobacterium tuberculosis
HPVLVLPGLLAGDGSTW

SEQ ID NO: 1524882 - protein, 20 aa, Mycobacterium tuberculosis
HPVVGVAVGLLARVERGRRV

SEQ ID NO: 1524883 - protein, 17 aa, Mycobacterium tuberculosis
HPVYLLYGVERTEDLCK

SEQ ID NO: 1524884 - protein, 17 aa, Mycobacterium tuberculosis
HQAIVRDVLAAGDFWGG

SEQ ID NO: 1524885 - protein, 23 aa, Mycobacterium tuberculosis
HQAIVRDVLAAGDFWGGAGSVAC

SEQ ID NO: 1524886 - protein, 22 aa, Mycobacterium tuberculosis
HQAKFHLDRLTAEGLLDTEYAR

SEQ ID NO: 1524887 - protein, 17 aa, Mycobacterium tuberculosis
HQALQPDVPRRRARRHR

SEQ ID NO: 1524888 - protein, 19 aa, Mycobacterium tuberculosis
HQALQPDVPRRRARRHRPR

SEQ ID NO: 1524889 - protein, 17 aa, Mycobacterium tuberculosis
HQARILLAKNPAGWQEA

SEQ ID NO: 1524890 - protein, 18 aa, Mycobacterium tuberculosis
HQARILLAKNPAGWQEAL

SEQ ID NO: 1524891 - protein, 64 aa, Mycobacterium tuberculosis
HQGQWGAHYAITVPQIPLLNFSLNIPVNIPIHLDFGTLAVNGFQIPAITLRALGVTHFSVGPII

SEQ ID NO: 1524892 - protein, 23 aa, Mycobacterium tuberculosis
HQGVHRALVWSHLALRCSRARDG

SEQ ID NO: 1524893 - protein, 31 aa, Mycobacterium tuberculosis; identical to SEQ ID NO: 215317

SEQ ID NO: 1524894 - protein, 21 aa, Mycobacterium tuberculosis
HQKWFNLYDEATRVPFVIARI

SEQ ID NO: 1524895 - protein, 29 aa, Mycobacterium tuberculosis
HQLLRSWYILYFQLPWLPERSASWVVPLL

SEQ ID NO: 1524896 - protein, 21 aa, Mycobacterium tuberculosis
HQLVSLVLSNLFGQNAPAIAA

SEQ ID NO: 1524897 - protein, 23 aa, Mycobacterium tuberculosis
HQSRRRLPAPPAVRGGAGLRGAG

SEQ ID NO: 1524898 - protein, 18 aa, Mycobacterium tuberculosis
HQVRMEFAYAGGGLGKGG

SEQ ID NO: 1524899 - protein, 17 aa, Mycobacterium tuberculosis
HRAAPDTQLVTIIVSWL

SEQ ID NO: 1524900 - protein, 17 aa, Mycobacterium tuberculosis
HRAFYEADYWKARLAET

SEQ ID NO: 1524901 - protein, 23 aa, Mycobacterium tuberculosis
HRDEALHLIRKRAKRLRYTAAAT

SEQ ID NO: 1524902 - protein, 25 aa, Mycobacterium tuberculosis
HRDMEIVTWVLRGALRHQDSAGNSG

SEQ ID NO: 1524903 - protein, 20 aa, Mycobacterium tuberculosis
HRDYRLGLPRAGRWREVLNT

SEQ ID NO: 1524904 - protein, 26 aa, Mycobacterium tuberculosis
HRERLVLPGLRDWLRRQAKAGAGPPE

SEQ ID NO: 1524905 - protein, 22 aa, Mycobacterium tuberculosis
HRFHRRFQWYRGESRPSQAVNS

SEQ ID NO: 1524906 - protein, 17 aa, Mycobacterium tuberculosis
HRFLPGASTRRSPNCSP

SEQ ID NO: 1524907 - protein, 18 aa, Mycobacterium tuberculosis
HRGPPGWLNISGTLRRAP

SEQ ID NO: 1524908 - protein, 25 aa, Mycobacterium tuberculosis
HRHIARCRSRARYWGCGCAGCATCA

SEQ ID NO: 1524909 - protein, 19 aa, Mycobacterium tuberculosis
HRKLGVELDLFSFPDEIGS

SEQ ID NO: 1524910 - protein, 23 aa, Mycobacterium tuberculosis
HRLGMASVKWELEDLSFAILHPK

SEQ ID NO: 1524911 - protein, 18 aa, Mycobacterium tuberculosis
HRLLETWHPLGVVGVITA

SEQ ID NO: 1524912 - protein, 18 aa, Mycobacterium tuberculosis
HRLPLAIMRLRMLRRRSV

SEQ ID NO: 1524913 - protein, 17 aa, Mycobacterium tuberculosis
HRMVALTIRARVATARG

SEQ ID NO: 1524914 - protein, 18 aa, Mycobacterium tuberculosis
HRPLPQGQVGQLCPALAG

SEQ ID NO: 1524915 - protein, 17 aa, Mycobacterium tuberculosis
HRPQRPAAASWPTGARP

SEQ ID NO: 1524916 - protein, 32 aa, Mycobacterium tuberculosis
HRQGAHLLLRPRARQRLCRWPSNLVADVVLNG

SEQ ID NO: 1524917 - protein, 24 aa, Mycobacterium tuberculosis
HRQYNPGWNLSIDLRNMLLVSECV

SEQ ID NO: 1524918 - protein, 17 aa, Mycobacterium tuberculosis
HRRGHRAPALRLGPRMG

SEQ ID NO: 1524919 - protein, 32 aa, Mycobacterium tuberculosis
HRRGRLVDVIGCSLRLPGIYPPQVYNGRLHVD

SEQ ID NO: 1524920 - protein, 19 aa, Mycobacterium tuberculosis
HRRLHLSGGPLGGARSRRR

SEQ ID NO: 1524921 - protein, 23 aa, Mycobacterium tuberculosis
HRRQRFLRALICRRWAGIAATAV

SEQ ID NO: 1524922 - protein, 17 aa, Mycobacterium tuberculosis
HRRRRAGVDPGRIPGPW

SEQ ID NO: 1524923 - protein, 17 aa, Mycobacterium tuberculosis
HRSVKIPDLIIAAVAEH

SEQ ID NO: 1524924 - protein, 26 aa, Mycobacterium tuberculosis
HRTGEKLIITFAMPAYAKMVMNFGRF

SEQ ID NO: 1524925 - protein, 18 aa, Mycobacterium tuberculosis
HRVLGPLAHVNLIPLNPT

SEQ ID NO: 1524926 - protein, 25 aa, Mycobacterium tuberculosis
HRYHRGDHCGLPPLAGRHADRDRTQ

SEQ ID NO: 1524927 - protein, 17 aa, Mycobacterium tuberculosis
HSAPWPLGPTHPSNLKC

SEQ ID NO: 1524928 - protein, 23 aa, Mycobacterium tuberculosis
HSAVTAPVWGMRHGQHRVVQRDS

SEQ ID NO: 1524929 - protein, 24 aa, Mycobacterium tuberculosis
HSCISWCGYPKWVWQEKGRPPRRW

SEQ ID NO: 1524930 - protein, 17 aa, Mycobacterium tuberculosis
HSEAPPFFVLHGEKDPM

SEQ ID NO: 1524931 - protein, 25 aa, Mycobacterium tuberculosis
HSEVDTLRRVELLRQLRLGDYDVLV

SEQ ID NO: 1524932 - protein, 21 aa, Mycobacterium tuberculosis
HSFLGAPFWVGRGFGLNLSVV

SEQ ID NO: 1524933 - protein, 17 aa, Mycobacterium tuberculosis
HSHRRTRRRWPPNIQLK

SEQ ID NO: 1524934 - protein, 31 aa, Mycobacterium tuberculosis
HSLDKVLGVHNFYFWPDPRASLCDIARALRP

SEQ ID NO: 1524935 - protein, 21 aa, Mycobacterium tuberculosis
HSSEAVWWRVAANYAAQGSIT

SEQ ID NO: 1524936 - protein, 25 aa, Mycobacterium tuberculosis
HSSLTLYIQLYLGGFGLELSDIESL

SEQ ID NO: 1524937 - protein, 25 aa, Mycobacterium tuberculosis
HSTLGPVHILIDLPAVPGFGNTTGA

SEQ ID NO: 1524938 - protein, 18 aa, Mycobacterium tuberculosis
HSVLIGNGGNGGAGGFRI

SEQ ID NO: 1524939 - protein, 19 aa, Mycobacterium tuberculosis
HSWCLAAERPELVSALVVE

SEQ ID NO: 1524940 - protein, 17 aa, Mycobacterium tuberculosis
HTAILLGAALALASVPE

SEQ ID NO: 1524941 - protein, 24 aa, Mycobacterium tuberculosis
HTALMRSCTGWPSGVWIDQPRRTA

SEQ ID NO: 1524942 - protein, 17 aa, Mycobacterium tuberculosis
HTAQNLYRGIGIAIGKL

SEQ ID NO: 1524943 - protein, 26 aa, Mycobacterium tuberculosis
HTGQAPRPWVASTRSPTAICCSRLAS

SEQ ID NO: 1524944 - protein, 24 aa, Mycobacterium tuberculosis
HTGRGSYPWLPTDNANWHMIGVEC

SEQ ID NO: 1524945 - protein, 18 aa, Mycobacterium tuberculosis
HTLFAEIGPFFADRDGGY

SEQ ID NO: 1524946 - protein, 19 aa, Mycobacterium tuberculosis
HTLTQQRLHLVLTGSHRHH

SEQ ID NO: 1524947 - protein, 17 aa, Mycobacterium tuberculosis
HTPPPHWRPDVLLVAVG

SEQ ID NO: 1524948 - protein, 19 aa, Mycobacterium tuberculosis
HTQVFGPPHGYPIVLTHGF

SEQ ID NO: 1524949 - protein, 20 aa, Mycobacterium tuberculosis
HTSIPAPGLGALGAGRGGKD

SEQ ID NO: 1524950 - protein, 17 aa, Mycobacterium tuberculosis
HTTLVRIDRGEATVGVI

SEQ ID NO: 1524951 - protein, 19 aa, Mycobacterium tuberculosis
HTTSAHPWFQAALADLPGS

SEQ ID NO: 1524952 - protein, 18 aa, Mycobacterium tuberculosis
HVAGLRRRHPTTLGQFGA

SEQ ID NO: 1524953 - protein, 25 aa, Mycobacterium tuberculosis
HVDQGLSLTLFFKDTATHPRREQGA

SEQ ID NO: 1524954 - protein, 26 aa, Mycobacterium tuberculosis
HVDQGLSLTLFFKDTGHHPRREQGAD

SEQ ID NO: 1524955 - protein, 34 aa, Mycobacterium tuberculosis
HVEGFRPATLHQAYLALRAWGLPVSEHTTLATDL

SEQ ID NO: 1524956 - protein, 29 aa, Mycobacterium tuberculosis
HVERGKAARRFLPGATILKASVGPMNNNA

SEQ ID NO: 1524957 - protein, 25 aa, Mycobacterium tuberculosis
HVETLTGFKWLARADANLPGTLVYA

SEQ ID NO: 1524958 - protein, 30 aa, Mycobacterium tuberculosis
HVGDPEFLPLLRRLGRFLPADVRILDITRA

SEQ ID NO: 1524959 - protein, 18 aa, Mycobacterium tuberculosis
HVLAMDPASWRIVLGELD

SEQ ID NO: 1524960 - protein, 17 aa, Mycobacterium tuberculosis
HVLRRQLTKAGELGFSC

SEQ ID NO: 1524961 - protein, 19 aa, Mycobacterium tuberculosis
HVMYVWVDALTNYLTGAGF

SEQ ID NO: 1524962 - protein, 19 aa, Mycobacterium tuberculosis
HVQFDPLTRLTNSDIIACI

SEQ ID NO: 1524963 - protein, 20 aa, Mycobacterium tuberculosis
HVTELVAYLRRLCAVDVHCM

SEQ ID NO: 1524964 - protein, 25 aa, Mycobacterium tuberculosis
HWEVVRIEMPGFGGSLCRRKGLDHR

SEQ ID NO: 1524965 - protein, 17 aa, Mycobacterium tuberculosis
HWVRARVVQLERGWVLR

SEQ ID NO: 1524966 - protein, 25 aa, Mycobacterium tuberculosis
HYAGAGSGPLFMAAAAWEGLAADLR

SEQ ID NO: 1524967 - protein, 17 aa, Mycobacterium tuberculosis
HYAVPYARSTPLFYYNK

SEQ ID NO: 1524968 - protein, 18 aa, Mycobacterium tuberculosis
HYEPFGLVALEAAAAGTP

SEQ ID NO: 1524969 - protein, 24 aa, Mycobacterium tuberculosis
HYGEMWAHDILAMDGYAGASGAAS

SEQ ID NO: 1524970 - protein, 20 aa, Mycobacterium tuberculosis
HYLCELKIDGVALSLVYREG

SEQ ID NO: 1524971 - protein, 22 aa, Mycobacterium tuberculosis
HYVSHPPNPKATIALLRRVEDV

SEQ ID NO: 1524972 - protein, 26 aa, Mycobacterium tuberculosis
IAACGLRRLIPLYATVETALAPPPSA

SEQ ID NO: 1524973 - protein, 19 aa, Mycobacterium tuberculosis
IAAFVDGELRMNAHLRAAH

SEQ ID NO: 1524974 - protein, 26 aa, Mycobacterium tuberculosis
IAAGVNLLLSPAVFRGFDQVGALSPT

SEQ ID NO: 1524975 - protein, 26 aa, Mycobacterium tuberculosis
IAAGVNLLLSPAVFRGFDQVGALSST

SEQ ID NO: 1524976 - protein, 17 aa, Mycobacterium tuberculosis
IAALFGMYGLEYQAISA

SEQ ID NO: 1524977 - protein, 20 aa, Mycobacterium tuberculosis
IAALPSPPRGFTPAPPPQCD

SEQ ID NO: 1524978 - protein, 24 aa, Mycobacterium tuberculosis
IAALPSPPRGFTPAPPPQWDDLDV

SEQ ID NO: 1524979 - protein, 22 aa, Mycobacterium tuberculosis
IAALWSDDLLTRVAIEPLDRAQ

SEQ ID NO: 1524980 - protein, 26 aa, Mycobacterium tuberculosis
IAANFRDVMIALGLYPDPDAVVVVEV

SEQ ID NO: 1524981 - protein, 23 aa, Mycobacterium tuberculosis
IAARHLLDPMPRGELSYGPLHEG

SEQ ID NO: 1524982 - protein, 17 aa, Mycobacterium tuberculosis
IAARRFAIPAVESKGAL

SEQ ID NO: 1524983 - protein, 18 aa, Mycobacterium tuberculosis
IAARSPGAAPAPGATVAA

SEQ ID NO: 1524984 - protein, 18 aa, Mycobacterium tuberculosis
IAAYLRLGYGPQTAEFRA

SEQ ID NO: 1524985 - protein, 28 aa, Mycobacterium tuberculosis
IACITAQLPEWFRPGDFFPVPCCFPSCR

SEQ ID NO: 1524986 - protein, 17 aa, Mycobacterium tuberculosis
IADFANSLGENATVTGG

SEQ ID NO: 1524987 - protein, 20 aa, Mycobacterium tuberculosis
IADFPQVTLGIYNSPRQTVI

SEQ ID NO: 1524988 - protein, 23 aa, Mycobacterium tuberculosis
IADLRTILAPDYVTRAREIASRM

SEQ ID NO: 1524989 - protein, 18 aa, Mycobacterium tuberculosis
IADYPEVSLGIYASPRQT

SEQ ID NO: 1524990 - protein, 26 aa, Mycobacterium tuberculosis
IAEDERLTPALVPLGDGVLAAVRDYS

SEQ ID NO: 1524991 - protein, 17 aa, Mycobacterium tuberculosis
IAEGDPLTYQVFDVDAT

SEQ ID NO: 1524992 - protein, 18 aa, Mycobacterium tuberculosis
IAEGLFGYLPPDAQNRLL

SEQ ID NO: 1524993 - protein, 18 aa, Mycobacterium tuberculosis
IAELPEHIVIVGSGFIAA

SEQ ID NO: 1524994 - protein, 26 aa, Mycobacterium tuberculosis
IAFSGPRWLALLLQPLSGPPSTSAKH

SEQ ID NO: 1524995 - protein, 22 aa, Mycobacterium tuberculosis
IAGDFLGVWDPPPSLPGAANHE

SEQ ID NO: 1524996 - protein, 17 aa, Mycobacterium tuberculosis
IAGDIPLINIPPTPGIG

SEQ ID NO: 1524997 - protein, 25 aa, Mycobacterium tuberculosis
IAGGRLILRFFPTPACARLTEQNLQ

SEQ ID NO: 1524998 - protein, 17 aa, Mycobacterium tuberculosis
IAGLIAAGAIDVGIACG

SEQ ID NO: 1524999 - protein, 26 aa, Mycobacterium tuberculosis
IAGPAALFDARFQKLGLHPGGGATWM

SEQ ID NO: 1525000 - protein, 18 aa, Mycobacterium tuberculosis
IAGRWPGRSGTRPRAEAA

SEQ ID NO: 1525001 - protein, 23 aa, Mycobacterium tuberculosis
IAHGGLGWIYLALDRNVNGRPVV

SEQ ID NO: 1525002 - protein, 22 aa, Mycobacterium tuberculosis
IAHSHQPLRWGPPEAPDRYVLV

SEQ ID NO: 1525003 - protein, 30 aa, Mycobacterium tuberculosis
IAIGGLYGDITYPVTSPLAITMGFAACEAA

SEQ ID NO: 1525004 - protein, 17 aa, Mycobacterium tuberculosis
IAILRRFGKSDYLRDIC

SEQ ID NO: 1525005 - protein, 19 aa, Mycobacterium tuberculosis
IAIRAVSWGERGALPARDG

SEQ ID NO: 1525006 - protein, 17 aa, Mycobacterium tuberculosis
IAIVGLSTRFPGEMNTP

SEQ ID NO: 1525007 - protein, 38 aa, Mycobacterium tuberculosis
IAKQRLVWRLCQRYPRAARRLIRHLNAKQLAAGYPADE

SEQ ID NO: 1525008 - protein, 21 aa, Mycobacterium tuberculosis
IALAEELVALLGADQRTRVFF

SEQ ID NO: 1525009 - protein, 20 aa, Mycobacterium tuberculosis
IALIEDGLPVIVVMPSPKGS

SEQ ID NO: 1525010 - protein, 18 aa, Mycobacterium tuberculosis
IAMPALRLDAAFAHLNLG

SEQ ID NO: 1525011 - protein, 18 aa, Mycobacterium tuberculosis
IAMVFQSYALYPHMTVRQ

SEQ ID NO: 1525012 - protein, 23 aa, Mycobacterium tuberculosis
IANRISYFLDIQGPSIVIDTACS

SEQ ID NO: 1525013 - protein, 27 aa, Mycobacterium tuberculosis
IANSGVLNSGFFNSGVHNSGGFNSENQ

SEQ ID NO: 1525014 - protein, 26 aa, Mycobacterium tuberculosis
IAPANPHYRLWNGRANRFGWRAYLGD

SEQ ID NO: 1525015 - protein, 24 aa, Mycobacterium tuberculosis
IAPGPFVIDIRDLDFMGSCAYAVL

SEQ ID NO: 1525016 - protein, 17 aa, Mycobacterium tuberculosis
IAPQKLHFSENLSVWVS

SEQ ID NO: 1525017 - protein, 24 aa, Mycobacterium tuberculosis
IAPTPERPIIFNLPATVEMTTPNV

SEQ ID NO: 1525018 - protein, 17 aa, Mycobacterium tuberculosis
IAQELLKAAAAAKIILE

SEQ ID NO: 1525019 - protein, 18 aa, Mycobacterium tuberculosis
IAQLVKWGYAATQLLEGL

SEQ ID NO: 1525020 - protein, 20 aa, Mycobacterium tuberculosis
IAQLVKWGYAATQLLEGLVE

SEQ ID NO: 1525021 - protein, 21 aa, Mycobacterium tuberculosis
IARAHLLLRFDRGNWIAIDND

SEQ ID NO: 1525022 - protein, 24 aa, Mycobacterium tuberculosis
IARALPGMIVGEIALLRDSPRSAT

SEQ ID NO: 1525023 - protein, 27 aa, Mycobacterium tuberculosis
IARCATYPVLAVQAWAAFHDMTLRAVI

SEQ ID NO: 1525024 - protein, 25 aa, Mycobacterium tuberculosis
IARDSLVKTALFGSDPNWGRVLAAV

SEQ ID NO: 1525025 - protein, 18 aa, Mycobacterium tuberculosis
IARFDSPDPEAEPDVVGG

SEQ ID NO: 1525026 - protein, 28 aa, Mycobacterium tuberculosis
IARPDLQVVLLEPLLHRTEFLREMVTDL

SEQ ID NO: 1525027 - protein, 25 aa, Mycobacterium tuberculosis
IARPDLQVVLLEPLLRRTESLREMV

SEQ ID NO: 1525028 - protein, 28 aa, Mycobacterium tuberculosis
IARVAATVPLGRLARPADIGWAAAFLAS

SEQ ID NO: 1525029 - protein, 18 aa, Mycobacterium tuberculosis
IARVLPMLSVPHLDRDFD

SEQ ID NO: 1525030 - protein, 21 aa, Mycobacterium tuberculosis
IASGPSLARWARANGWSAPPG

SEQ ID NO: 1525031 - protein, 24 aa, Mycobacterium tuberculosis
IATDHLMRFPGRFSEQLLPEHLHK

SEQ ID NO: 1525032 - protein, 21 aa, Mycobacterium tuberculosis
IATTRFLLDVNISGGLPAFTL

SEQ ID NO: 1525033 - protein, 22 aa, Mycobacterium tuberculosis
IATTRFLLDVNISGGLPAFTLF

SEQ ID NO: 1525034 - protein, 25 aa, Mycobacterium tuberculosis
IAVAADHVWLMSTASYPEMATVIET

SEQ ID NO: 1525035 - protein, 17 aa, Mycobacterium tuberculosis
IAVLYYRAQHLAGNTGY

SEQ ID NO: 1525036 - protein, 18 aa, Mycobacterium tuberculosis
IAVLYYRAQHLAGNTGYV

SEQ ID NO: 1525037 - protein, 17 aa, Mycobacterium tuberculosis
IAWSWFRHPVKSHEFPA

SEQ ID NO: 1525038 - protein, 25 aa, Mycobacterium tuberculosis
ICGPETLRSLYFLSSRVSGGSPHAI

SEQ ID NO: 1525039 - protein, 18 aa, Mycobacterium tuberculosis
ICHVIPGLLCWVGEYAGQ

SEQ ID NO: 1525040 - protein, 17 aa, Mycobacterium tuberculosis
ICMDQFMVDLGPGPLDV

SEQ ID NO: 1525041 - protein, 25 aa, Mycobacterium tuberculosis
ICSSETLLIVPTPAGVLFTQATAAA

SEQ ID NO: 1525042 - protein, 19 aa, Mycobacterium tuberculosis
IDAARAWLLGTPADDWVSM

SEQ ID NO: 1525043 - protein, 36 aa, Mycobacterium tuberculosis
IDAITLFPGGLTFPANSLLNLDVFVGTPGATIPAIT

SEQ ID NO: 1525044 - protein, 23 aa, Mycobacterium tuberculosis
IDCPPSLGVLTLNGLTAADEAIV

SEQ ID NO: 1525045 - protein, 25 aa, Mycobacterium tuberculosis
IDDEALVECRPRRGQPRQLLTNIAD

SEQ ID NO: 1525046 - protein, 26 aa, Mycobacterium tuberculosis
IDDEALVECRPRRGQPRQLLTNIADA

SEQ ID NO: 1525047 - protein, 19 aa, Mycobacterium tuberculosis
IDDMAWMRQLLDWQREAAD

SEQ ID NO: 1525048 - protein, 23 aa, Mycobacterium tuberculosis
IDDRHRVIISRPIDSTRDAVPRL

SEQ ID NO: 1525049 - protein, 28 aa, Mycobacterium tuberculosis
IDEDLVRRLLRAQFPQWADLPIAPVRSA

SEQ ID NO: 1525050 - protein, 25 aa, Mycobacterium tuberculosis
IDEMRGMCLYFDELPVIVLNGSDHP

SEQ ID NO: 1525051 - protein, 26 aa, Mycobacterium tuberculosis
IDEMRGMCLYFDELPVIVLNGSDHPR

SEQ ID NO: 1525052 - protein, 24 aa, Mycobacterium tuberculosis
IDEPLVRRLWVLKVWGDVVDDRRG

SEQ ID NO: 1525053 - protein, 17 aa, Mycobacterium tuberculosis
IDFTGFISDRHAVAGLL

SEQ ID NO: 1525054 - protein, 25 aa, Mycobacterium tuberculosis
IDGAALPWSLTLKTTAPSAAPNILA

SEQ ID NO: 1525055 - protein, 22 aa, Mycobacterium tuberculosis
IDGLIAILTFPPAESVFDQIID

SEQ ID NO: 1525056 - protein, 17 aa, Mycobacterium tuberculosis
IDHFLVQADLTVVVPGP

SEQ ID NO: 1525057 - protein, 28 aa, Mycobacterium tuberculosis
IDHIIGLFRLWWIPDGAPPTQGTYVRYD

SEQ ID NO: 1525058 - protein, 23 aa, Mycobacterium tuberculosis
IDHLRHLGRIPATIRYTTQGLGR

SEQ ID NO: 1525059 - protein, 22 aa, Mycobacterium tuberculosis
IDHLRRHSLPLFGYAAMPAYDV

SEQ ID NO: 1525060 - protein, 18 aa, Mycobacterium tuberculosis
IDIALIRLRAVSVPLQTS

SEQ ID NO: 1525061 - protein, 25 aa, Mycobacterium tuberculosis
IDIGRLRWQFERIARGVPVAAPWDA

SEQ ID NO: 1525062 - protein, 30 aa, Mycobacterium tuberculosis; identical to SEQ ID NO: 201055

SEQ ID NO: 1525063 - protein, 17 aa, Mycobacterium tuberculosis
IDSPDRLWEALLRGDDL

SEQ ID NO: 1525064 - protein, 18 aa, Mycobacterium tuberculosis
IDSPQRLWEALLRGDDLV

SEQ ID NO: 1525065 - protein, 20 aa, Mycobacterium tuberculosis
IDVLGGLRGWLTAPVIVLSA

SEQ ID NO: 1525066 - protein, 25 aa, Mycobacterium tuberculosis
IDVTVRISGFFRDAFPHVVTMLDDA

SEQ ID NO: 1525067 - protein, 17 aa, Mycobacterium tuberculosis
IDVVHPGVIWTCSARVI

SEQ ID NO: 1525068 - protein, 19 aa, Mycobacterium tuberculosis
IDVVLRLPGQRYLVVDYKT

SEQ ID NO: 1525069 - protein, 20 aa, Mycobacterium tuberculosis
IEAALKDALIEGLALKPRKA

SEQ ID NO: 1525070 - protein, 17 aa, Mycobacterium tuberculosis
IEAGDWRETLRNHARSM

SEQ ID NO: 1525071 - protein, 17 aa, Mycobacterium tuberculosis
IEALGPIALPVKTSADS

SEQ ID NO: 1525072 - protein, 17 aa, Mycobacterium tuberculosis
IEAMPQYGPGHADVVAE

SEQ ID NO: 1525073 - protein, 18 aa, Mycobacterium tuberculosis
IEAPLVITPWRSVLICDL

SEQ ID NO: 1525074 - protein, 19 aa, Mycobacterium tuberculosis
IEAPLVITPWRSVLICDLD

SEQ ID NO: 1525075 - protein, 27 aa, Mycobacterium tuberculosis
IEDLLGGIPLAGFFAAGEIGPVAGHNA

SEQ ID NO: 1525076 - protein, 19 aa, Mycobacterium tuberculosis
IEEPILAGLIDRIARDEVR

SEQ ID NO: 1525077 - protein, 18 aa, Mycobacterium tuberculosis
IEFDPPTTLAYRIEGLPA

SEQ ID NO: 1525078 - protein, 20 aa, Mycobacterium tuberculosis
IEHVVLQRRQRCGVGRLRAD

SEQ ID NO: 1525079 - protein, 17 aa, Mycobacterium tuberculosis
IEISPHPVLTHALTDTL

SEQ ID NO: 1525080 - protein, 17 aa, Mycobacterium tuberculosis
IEITLVKNPAMRYRSGG

SEQ ID NO: 1525081 - protein, 18 aa, Mycobacterium tuberculosis
IEITLVKNPAMRYRSGGT

SEQ ID NO: 1525082 - protein, 24 aa, Mycobacterium tuberculosis
IEKKPLNQFLPGSATLSFGTAGCN

SEQ ID NO: 1525083 - protein, 31 aa, Mycobacterium tuberculosis
IELAAPVTHIWYFKGVPSRLGYLLDLAPKDL

SEQ ID NO: 1525084 - protein, 24 aa, Mycobacterium tuberculosis
IELGIKWLSLYAFSTENWKRSPEE

SEQ ID NO: 1525085 - protein, 25 aa, Mycobacterium tuberculosis
IELMRYYADLIAEFRRRPANNLTSA

SEQ ID NO: 1525086 - protein, 23 aa, Mycobacterium tuberculosis
IELTGPMPPACGFNWMAATTRTC

SEQ ID NO: 1525087 - protein, 36 aa, Mycobacterium tuberculosis
IEQIQLGLIGMQLALTELWCSYGVRPDLVIGHSMGE

SEQ ID NO: 1525088 - protein, 19 aa, Mycobacterium tuberculosis
IERIEAEYARYFTPTGRPT

SEQ ID NO: 1525089 - protein, 26 aa, Mycobacterium tuberculosis
IERSTALLDLGWTIIRVTSELLRYRR

SEQ ID NO: 1525090 - protein, 28 aa, Mycobacterium tuberculosis
IERSTALLDLGWTIIRVTSELLRYRRGT

SEQ ID NO: 1525091 - protein, 22 aa, Mycobacterium tuberculosis
IERTFVAYLKMAGKTAQDTSFD

SEQ ID NO: 1525092 - protein, 26 aa, Mycobacterium tuberculosis
IESEARRMTLLVDELLLLSRLSEGED

SEQ ID NO: 1525093 - protein, 34 aa, Mycobacterium tuberculosis
IESEASRMGLLVDDLLLLARLDAHRPLELCRVDL

SEQ ID NO: 1525094 - protein, 25 aa, Mycobacterium tuberculosis
IETAQRLFPRAILHFEDFGPANARK

SEQ ID NO: 1525095 - protein, 24 aa, Mycobacterium tuberculosis
IEVIPDVLRHRLVLTYDALADEIS

SEQ ID NO: 1525096 - protein, 25 aa, Mycobacterium tuberculosis
IEVIVRQMLRRVTIIDSGSTEFLPG

SEQ ID NO: 1525097 - protein, 17 aa, Mycobacterium tuberculosis
IEVLGYEAGVALLQAKV

SEQ ID NO: 1525098 - protein, 21 aa, Mycobacterium tuberculosis
IEVPAPPFWGSRIVKGLAVAD

SEQ ID NO: 1525099 - protein, 20 aa, Mycobacterium tuberculosis
IEVVTDMWGRPRIRLTGAIA

SEQ ID NO: 1525100 - protein, 21 aa, Mycobacterium tuberculosis
IEWSKVHLFWGDERYVPEDDD

SEQ ID NO: 1525101 - protein, 18 aa, Mycobacterium tuberculosis
IFAALAKRLPKLATGPFP

SEQ ID NO: 1525102 - protein, 17 aa, Mycobacterium tuberculosis
IFGIPGQGSYAAANSYL

SEQ ID NO: 1525103 - protein, 18 aa, Mycobacterium tuberculosis
IFGKPQLRQLISDRITAW

SEQ ID NO: 1525104 - protein, 23 aa, Mycobacterium tuberculosis
IFGKPQLRQLISDRITAWGLAGE

SEQ ID NO: 1525105 - protein, 19 aa, Mycobacterium tuberculosis
IFGQFNDPLRFQPRWKELF

SEQ ID NO: 1525106 - protein, 21 aa, Mycobacterium tuberculosis
IFNLRPDQFTTMPPQVLRLQG

SEQ ID NO: 1525107 - protein, 43 aa, Mycobacterium tuberculosis
IFPNGYTIDPIPLQLNLDLTLGPVHILIDLPAVPGFGNTTGAP

SEQ ID NO: 1525108 - protein, 20 aa, Mycobacterium tuberculosis
IGAHILLLNTSFAGPALAEV

SEQ ID NO: 1525109 - protein, 28 aa, Mycobacterium tuberculosis
IGATPPDMTLFLDLKQTPPQPLVSAVAQ

SEQ ID NO: 1525110 - protein, 17 aa, Mycobacterium tuberculosis
IGAVLSMHFAKQAARFF

SEQ ID NO: 1525111 - protein, 17 aa, Mycobacterium tuberculosis
IGAVLVPGAKAPKLVSN

SEQ ID NO: 1525112 - protein, 22 aa, Mycobacterium tuberculosis
IGDAFPFTFMSLGAGRGESLAG

SEQ ID NO: 1525113 - protein, 26 aa, Mycobacterium tuberculosis
IGDALFVQLHAPLRGVARGQTLVLYR

SEQ ID NO: 1525114 - protein, 20 aa, Mycobacterium tuberculosis
IGDGWWLTRVVEGDGRGTVR

SEQ ID NO: 1525115 - protein, 17 aa, Mycobacterium tuberculosis
IGDTLRPIEGRTAMSFV

SEQ ID NO: 1525116 - protein, 24 aa, Mycobacterium tuberculosis
IGFANLGNYNIGFGNAGDFNQGFA

SEQ ID NO: 1525117 - protein, 17 aa, Mycobacterium tuberculosis
IGFGNVGPGLTAALNNI

SEQ ID NO: 1525118 - protein, 19 aa, Mycobacterium tuberculosis
IGFNASAPGAAGSPGGNGG

SEQ ID NO: 1525119 - protein, 26 aa, Mycobacterium tuberculosis
IGGKGGDAFATFAKAGNGGAGGNGGN

SEQ ID NO: 1525120 - protein, 27 aa, Mycobacterium tuberculosis
IGGVGGAGGLLFGYGGAGGAGGYSNIG

SEQ ID NO: 1525121 - protein, 47 aa, Mycobacterium tuberculosis
IGIPINIGPLTITPITLFAQQTFVNQLPFPAFSLGKITIPQIQTFDS

SEQ ID NO: 1525122 - protein, 32 aa, Mycobacterium tuberculosis; identical to SEQ ID NO: 236518

SEQ ID NO: 1525123 - protein, 17 aa, Mycobacterium tuberculosis
IGKRFGVPVPNLTPWRA

SEQ ID NO: 1525124 - protein, 27 aa, Mycobacterium tuberculosis
IGKRIERGLWLTALLQATLSTVRHPAA

SEQ ID NO: 1525125 - protein, 18 aa, Mycobacterium tuberculosis
IGKRNGWLSGLHATELLG

SEQ ID NO: 1525126 - protein, 19 aa, Mycobacterium tuberculosis
IGKTPIKRIGVLGAGMMGA

SEQ ID NO: 1525127 - protein, 19 aa, Mycobacterium tuberculosis
IGLGNLGSYNFGFGNSGDF

SEQ ID NO: 1525128 - protein, 17 aa, Mycobacterium tuberculosis
IGLPDPDIAQLVKWGYA

SEQ ID NO: 1525129 - protein, 24 aa, Mycobacterium tuberculosis
IGNTQALRWRTSVGAAAISVAQRV

SEQ ID NO: 1525130 - protein, 23 aa, Mycobacterium tuberculosis
IGNTWLADPAPFLQQYLANQFGY

SEQ ID NO: 1525131 - protein, 29 aa, Mycobacterium tuberculosis
IGNTWLADPAPFLQQYLANQFGYGQLTLT

SEQ ID NO: 1525132 - protein, 27 aa, Mycobacterium tuberculosis
IGPADIPLLVADLAYVRGMVYRQLHEE

SEQ ID NO: 1525133 - protein, 18 aa, Mycobacterium tuberculosis
IGPFFADRDGGYTRIIKI

SEQ ID NO: 1525134 - protein, 28 aa, Mycobacterium tuberculosis
IGPITVLPPIHIPPIPVGFAAVGGIGPI

SEQ ID NO: 1525135 - protein, 23 aa, Mycobacterium tuberculosis
IGPIVIPDTTILPPLHLQITCDA

SEQ ID NO: 1525136 - protein, 17 aa, Mycobacterium tuberculosis
IGQNPRPYRCRRSGCGG

SEQ ID NO: 1525137 - protein, 26 aa, Mycobacterium tuberculosis
IGQRRPHHPLLRRTIRRGQPIRRPIL

SEQ ID NO: 1525138 - protein, 24 aa, Mycobacterium tuberculosis
IGRPAYTPPGWRQPPTRRDVHRTR

SEQ ID NO: 1525139 - protein, 17 aa, Mycobacterium tuberculosis
IGRVRPGSDSLLRMRLD

SEQ ID NO: 1525140 - protein, 32 aa, Mycobacterium tuberculosis
IGSDGSIFLRPFLKYQIITVVAPNSPLAAGIP

SEQ ID NO: 1525141 - protein, 18 aa, Mycobacterium tuberculosis
IGSFNALREDFTALREEM

SEQ ID NO: 1525142 - protein, 19 aa, Mycobacterium tuberculosis
IGSFNALREDFTALRGRDD

SEQ ID NO: 1525143 - protein, 17 aa, Mycobacterium tuberculosis
IGTGRHSNLIRARWARE

SEQ ID NO: 1525144 - protein, 20 aa, Mycobacterium tuberculosis
IGTHRLLQTGVRWKDLGLVV

SEQ ID NO: 1525145 - protein, 27 aa, Mycobacterium tuberculosis
IGTLGFTIPGFTIPAAPLPLTIDIDGQ

SEQ ID NO: 1525146 - protein, 18 aa, Mycobacterium tuberculosis
IGTLLAELTFDAPRRLGL

SEQ ID NO: 1525147 - protein, 17 aa, Mycobacterium tuberculosis
IGVPGVIGVPGVIGVPG

SEQ ID NO: 1525148 - protein, 17 aa, Mycobacterium tuberculosis
IGVPHPSLAVPLHPHRR

SEQ ID NO: 1525149 - protein, 17 aa, Mycobacterium tuberculosis
IGVVYLPATERQSHYLH

SEQ ID NO: 1525150 - protein, 21 aa, Mycobacterium tuberculosis
IGYLTALLRDEGITAMHFVPS

SEQ ID NO: 1525151 - protein, 17 aa, Mycobacterium tuberculosis
IHFFSPVDKMPLVEIIK

SEQ ID NO: 1525152 - protein, 23 aa, Mycobacterium tuberculosis
IHHRDMMWICRDGDRAKNHLLEA

SEQ ID NO: 1525153 - protein, 29 aa, Mycobacterium tuberculosis
IHPGKPATAVLLLPSLRSAPRDSPELIRL

SEQ ID NO: 1525154 - protein, 19 aa, Mycobacterium tuberculosis
IHPVYRRAAHLGRCWSRRG

SEQ ID NO: 1525155 - protein, 25 aa, Mycobacterium tuberculosis
IHQPGAARHLGFAKALVYEMPHTLA

SEQ ID NO: 1525156 - protein, 20 aa, Mycobacterium tuberculosis
IHQTFSLGPLVVPDIVIPAF

SEQ ID NO: 1525157 - protein, 18 aa, Mycobacterium tuberculosis
IHRDIEVVTDMWGRPRIR

SEQ ID NO: 1525158 - protein, 36 aa, Mycobacterium tuberculosis
IHRGQGRWYPGEPLPRWQIALYWRTDGRPLWTNDAL

SEQ ID NO: 1525159 - protein, 23 aa, Mycobacterium tuberculosis
IHRQAQVLVHQRGRKPGLEVVVG

SEQ ID NO: 1525160 - protein, 17 aa, Mycobacterium tuberculosis
IHSHPVWATMFAVAHEP

SEQ ID NO: 1525161 - protein, 25 aa, Mycobacterium tuberculosis
IHVERTSVWIVTSRPAMEIGSPSTR

SEQ ID NO: 1525162 - protein, 26 aa, Mycobacterium tuberculosis
IIAAAPLGILPMPRAMPATAAFPPPA

SEQ ID NO: 1525163 - protein, 24 aa, Mycobacterium tuberculosis
IIAHAAVIQRRLIYRGNALRCGYV

SEQ ID NO: 1525164 - protein, 24 aa, Mycobacterium tuberculosis
IIANRLSYFLDLRGPSVAVDTACS

SEQ ID NO: 1525165 - protein, 20 aa, Mycobacterium tuberculosis
IIANRVSYFYDFHGPSVTID

SEQ ID NO: 1525166 - protein, 27 aa, Mycobacterium tuberculosis
IIAVAHKLIVIIWARAGHRPASPGSRR

SEQ ID NO: 1525167 - protein, 26 aa, Mycobacterium tuberculosis
IIDSMHLGRYLGISDLMVAAPRQESN

SEQ ID NO: 1525168 - protein, 37 aa, Mycobacterium tuberculosis
IIETEHLPLLAPLRAIPVIGPWGLGFVAVAVAAATLG

SEQ ID NO: 1525169 - protein, 17 aa, Mycobacterium tuberculosis
IIFDDLTKQAEAYRAIS

SEQ ID NO: 1525170 - protein, 18 aa, Mycobacterium tuberculosis
IIGPNCPGIISPGQSLAG

SEQ ID NO: 1525171 - protein, 36 aa, Mycobacterium tuberculosis
IILVDRSFDGTLGLSLLWVLRGWRRPDDVRVRPTAA

SEQ ID NO: 1525172 - protein, 21 aa, Mycobacterium tuberculosis
IKAVSALDLGLPLAAGNVVSA

SEQ ID NO: 1525173 - protein, 23 aa, Mycobacterium tuberculosis
IKDSLSPQLLFTDLGLKYVGPVD

SEQ ID NO: 1525174 - protein, 20 aa, Mycobacterium tuberculosis
IKPVRLAEAIRRFGPIFAQY

SEQ ID NO: 1525175 - protein, 19 aa, Mycobacterium tuberculosis
IKSLRRGVFHNSRRLDNGN

SEQ ID NO: 1525176 - protein, 18 aa, Mycobacterium tuberculosis
IKVVCFPDRWLDLRYVGP

SEQ ID NO: 1525177 - protein, 26 aa, Mycobacterium tuberculosis
ILAAPQQAMHLQRGPQPVCGGPGQVG

SEQ ID NO: 1525178 - protein, 25 aa, Mycobacterium tuberculosis
ILAPQILDYVVSFIASLQAGIVAVP

SEQ ID NO: 1525179 - protein, 21 aa, Mycobacterium tuberculosis
ILARFPGLYLQSLGLTFNGAT

SEQ ID NO: 1525180 - protein, 17 aa, Mycobacterium tuberculosis
ILDPSLPLTVTEWDEWG

SEQ ID NO: 1525181 - protein, 18 aa, Mycobacterium tuberculosis
ILDRRTRIGLVPRDRERV

SEQ ID NO: 1525182 - protein, 25 aa, Mycobacterium tuberculosis
ILDVLDNYAFVRTSSYLPGPHDVYV

SEQ ID NO: 1525183 - protein, 17 aa, Mycobacterium tuberculosis
ILGLLDVDLLAAVGAGT

SEQ ID NO: 1525184 - protein, 26 aa, Mycobacterium tuberculosis
ILHAGRYAYHPLAVSASPIKAPITPF

SEQ ID NO: 1525185 - protein, 27 aa, Mycobacterium tuberculosis
ILHLQNSFILPSFPPFSTPDVFQNAFH

SEQ ID NO: 1525186 - protein, 35 aa, Mycobacterium tuberculosis; identical to SEQ ID NO: 236527

SEQ ID NO: 1525187 - protein, 25 aa, Mycobacterium tuberculosis
ILIGDIPIPIIDVPAVPGFGNTTTA

SEQ ID NO: 1525188 - protein, 17 aa, Mycobacterium tuberculosis
ILITWRRGTAQGPAGQN

SEQ ID NO: 1525189 - protein, 20 aa, Mycobacterium tuberculosis
ILLARGDLALRMGLPVLAVV

SEQ ID NO: 1525190 - protein, 22 aa, Mycobacterium tuberculosis
ILLARGDLALRMGLPVLAVVAF

SEQ ID NO: 1525191 - protein, 20 aa, Mycobacterium tuberculosis
ILLTEWQLRNTPHVPIPYVY

SEQ ID NO: 1525192 - protein, 17 aa, Mycobacterium tuberculosis
ILMGYGWHRGRDEGQLL

SEQ ID NO: 1525193 - protein, 26 aa, Mycobacterium tuberculosis
ILNGRRDLFRPAVFRSLWGRVEDAIS

SEQ ID NO: 1525194 - protein, 17 aa, Mycobacterium tuberculosis
ILPVYAEYQQRSEKVLI

SEQ ID NO: 1525195 - protein, 18 aa, Mycobacterium tuberculosis
ILRALRINLTVRGYQVIT

SEQ ID NO: 1525196 - protein, 21 aa, Mycobacterium tuberculosis
ILSSILFRMAELRSGEGRTVY

SEQ ID NO: 1525197 - protein, 18 aa, Mycobacterium tuberculosis
ILTARYSVGAVDAVRRTR

SEQ ID NO: 1525198 - protein, 22 aa, Mycobacterium tuberculosis
ILTCRLIDRPLRPSFVDGLRDE

SEQ ID NO: 1525199 - protein, 17 aa, Mycobacterium tuberculosis
ILTPGPGNDATGWCQSR

SEQ ID NO: 1525200 - protein, 17 aa, Mycobacterium tuberculosis
ILTRLTAPVIRGLGIGI

SEQ ID NO: 1525201 - protein, 37 aa, Mycobacterium tuberculosis; identical to SEQ ID NO: 1392382

SEQ ID NO: 1525202 - protein, 35 aa, Mycobacterium tuberculosis; identical to SEQ ID NO: 236529

SEQ ID NO: 1525203 - protein, 22 aa, Mycobacterium tuberculosis
ILVSADDFAYLVDFGIASATTD

SEQ ID NO: 1525204 - protein, 18 aa, Mycobacterium tuberculosis
IMGLGPIEASKKALERAG

SEQ ID NO: 1525205 - protein, 25 aa, Mycobacterium tuberculosis
IMGSEGYLLNQFLAPRTNKRTDSWG

SEQ ID NO: 1525206 - protein, 26 aa, Mycobacterium tuberculosis
IMGSEGYLLNQFLAPRTNKRTDSWGG

SEQ ID NO: 1525207 - protein, 21 aa, Mycobacterium tuberculosis
IMPIGKGQRALIVSPPKAGKT

SEQ ID NO: 1525208 - protein, 19 aa, Mycobacterium tuberculosis
IMRAMIDAGHRLAAVEYQT

SEQ ID NO: 1525209 - protein, 18 aa, Mycobacterium tuberculosis
IMRDTIFCAIPTDADREA

SEQ ID NO: 1525210 - protein, 25 aa, Mycobacterium tuberculosis
IMSATLGVLLRRLEPNWSITLIERL

SEQ ID NO: 1525211 - protein, 23 aa, Mycobacterium tuberculosis
INAPTQTLLGRPLIGNGTNGAPG

SEQ ID NO: 1525212 - protein, 17 aa, Mycobacterium tuberculosis
INILANAGAGGAGGAAG

SEQ ID NO: 1525213 - protein, 18 aa, Mycobacterium tuberculosis
INISIIDIPALPGFGNST

SEQ ID NO: 1525214 - protein, 19 aa, Mycobacterium tuberculosis
INMEFVQFHPTGMVWPPSV

SEQ ID NO: 1525215 - protein, 25 aa, Mycobacterium tuberculosis
INQLIAQWLKLMQPASDHLAKRVDT

SEQ ID NO: 1525216 - protein, 27 aa, Mycobacterium tuberculosis
INQLMTLQDYLATVITWHRHIAGLIEQ

SEQ ID NO: 1525217 - protein, 18 aa, Mycobacterium tuberculosis
INSGFGWHEARVPTIVTS

SEQ ID NO: 1525218 - protein, 17 aa, Mycobacterium tuberculosis
INTGSWNAGNVNTGFGI

SEQ ID NO: 1525219 - protein, 17 aa, Mycobacterium tuberculosis
IPAIRRSVDPRRQLTVV

SEQ ID NO: 1525220 - protein, 23 aa, Mycobacterium tuberculosis
IPAVTFWAAVPHYVSHPPNPKAT

SEQ ID NO: 1525221 - protein, 18 aa, Mycobacterium tuberculosis
IPAWFRYYQNCKAGRGGG

SEQ ID NO: 1525222 - protein, 35 aa, Mycobacterium tuberculosis
IPCRTFAAFLDLRYWIKTFTRAAKPGAYLRVIAPG

SEQ ID NO: 1525223 - protein, 19 aa, Mycobacterium tuberculosis
IPDFVSSQWQWQTGMWVGG

SEQ ID NO: 1525224 - protein, 25 aa, Mycobacterium tuberculosis
IPEEVAWRMGWIDDEQLVQRARALV

SEQ ID NO: 1525225 - protein, 19 aa, Mycobacterium tuberculosis
IPEQPLPLAINVIGHINAL

SEQ ID NO: 1525226 - protein, 18 aa, Mycobacterium tuberculosis
IPEQPLPLAINVIRHINA

SEQ ID NO: 1525227 - protein, 21 aa, Mycobacterium tuberculosis
IPFGAFRHLISLPASGADIGR

SEQ ID NO: 1525228 - protein, 17 aa, Mycobacterium tuberculosis
IPFLDYDVEIRRVPCST

SEQ ID NO: 1525229 - protein, 17 aa, Mycobacterium tuberculosis
IPGAFLGGGRGGDGVFF

SEQ ID NO: 1525230 - protein, 17 aa, Mycobacterium tuberculosis
IPGFPTTVTVFGTPFMG

SEQ ID NO: 1525231 - protein, 19 aa, Mycobacterium tuberculosis
IPGFTIPGSPLNLTANGGL

SEQ ID NO: 1525232 - protein, 24 aa, Mycobacterium tuberculosis
IPGIPLSLNALGGVGPITVPGVPI

SEQ ID NO: 1525233 - protein, 18 aa, Mycobacterium tuberculosis
IPIMLGAEGPKNVALAAE

SEQ ID NO: 1525234 - protein, 17 aa, Mycobacterium tuberculosis
IPKMLVYRELADHDADE

SEQ ID NO: 1525235 - protein, 19 aa, Mycobacterium tuberculosis
IPLAGFFAAGEIGPIAGRN

SEQ ID NO: 1525236 - protein, 17 aa, Mycobacterium tuberculosis
IPLGASVLLVSGRASFE

SEQ ID NO: 1525237 - protein, 25 aa, Mycobacterium tuberculosis
IPPAPPMPRLPPLPPLPPTPSPPLS

SEQ ID NO: 1525238 - protein, 19 aa, Mycobacterium tuberculosis
IPPGHVGVAWRGTWHGGLQ

SEQ ID NO: 1525239 - protein, 29 aa, Mycobacterium tuberculosis
IPRLQFAHADLLVRAFGTLQGLLAASAGD

SEQ ID NO: 1525240 - protein, 17 aa, Mycobacterium tuberculosis
IPRVPVTLNYLFGSQPG

SEQ ID NO: 1525241 - protein, 18 aa, Mycobacterium tuberculosis
IPRVPVTLNYLFGSQPGG

SEQ ID NO: 1525242 - protein, 25 aa, Mycobacterium tuberculosis
IPSGNTRAFLGERIGVRRGVVVDAD

SEQ ID NO: 1525243 - protein, 17 aa, Mycobacterium tuberculosis
IPSLACGRCRAIARCRS

SEQ ID NO: 1525244 - protein, 17 aa, Mycobacterium tuberculosis
IPSVLPPAPAGRGLTAG

SEQ ID NO: 1525245 - protein, 17 aa, Mycobacterium tuberculosis
IPTLPLGLALSNGIPPV

SEQ ID NO: 1525246 - protein, 26 aa, Mycobacterium tuberculosis
IPTTKHIPAFKLTRSSAAYWRGDQKN

SEQ ID NO: 1525247 - protein, 29 aa, Mycobacterium tuberculosis
IPTVTTPQMFTYRLLQQARSDLMRIVLPE

SEQ ID NO: 1525248 - protein, 25 aa, Mycobacterium tuberculosis
IPVLLDAIYDPWPTPLAAAVGSAGG

SEQ ID NO: 1525249 - protein, 33 aa, Mycobacterium tuberculosis
IPVRTLPPYLDLLETLYLIDRIPAWSTNLSERV

SEQ ID NO: 1525250 - protein, 20 aa, Mycobacterium tuberculosis
IPVRVYWPPVVRDNLPVVVY

SEQ ID NO: 1525251 - protein, 17 aa, Mycobacterium tuberculosis
IPYRVPYPQVMPTQETT

SEQ ID NO: 1525252 - protein, 17 aa, Mycobacterium tuberculosis
IQDRLTIGQLREILSAA

SEQ ID NO: 1525253 - protein, 19 aa, Mycobacterium tuberculosis
IQIPPPGTGAPEVHRWWTS

SEQ ID NO: 1525254 - protein, 24 aa, Mycobacterium tuberculosis
IQPKLTFTWRIMPQNLSDAGISWK

SEQ ID NO: 1525255 - protein, 27 aa, Mycobacterium tuberculosis
IRAAELMGIQIPRFCDHPLLEPVGACR

SEQ ID NO: 1525256 - protein, 22 aa, Mycobacterium tuberculosis
IRACRPITVPLTQAQGLVLGGD

SEQ ID NO: 1525257 - protein, 26 aa, Mycobacterium tuberculosis
IRADFPILKRIMRGGNPLAYLDSGAT

SEQ ID NO: 1525258 - protein, 19 aa, Mycobacterium tuberculosis
IRARGRLIVGLDIGSNLFS

SEQ ID NO: 1525259 - protein, 19 aa, Mycobacterium tuberculosis
IRASLAKRGIIVRGRIVGV

SEQ ID NO: 1525260 - protein, 18 aa, Mycobacterium tuberculosis
IREFGLLQPIVVRSLAGS

SEQ ID NO: 1525261 - protein, 25 aa, Mycobacterium tuberculosis
IRGGCGPWPRRRCWGLKVRCTSAQA

SEQ ID NO: 1525262 - protein, 27 aa, Mycobacterium tuberculosis
IRIDLRKTYLFAFLDDHSRLVPGYRWG

SEQ ID NO: 1525263 - protein, 18 aa, Mycobacterium tuberculosis
IRLLLDRLRITSAAGVWE

SEQ ID NO: 1525264 - protein, 19 aa, Mycobacterium tuberculosis
IRLMSTASYLETALVIEAR

SEQ ID NO: 1525265 - protein, 17 aa, Mycobacterium tuberculosis
IRLPMWVGLQEVDQSRV

SEQ ID NO: 1525266 - protein, 22 aa, Mycobacterium tuberculosis
IRNLVHGIGFQRDVLGAEPATA

SEQ ID NO: 1525267 - protein, 26 aa, Mycobacterium tuberculosis
IRNLVKKYSDFIAWPIRMDVERRTPA

SEQ ID NO: 1525268 - protein, 25 aa, Mycobacterium tuberculosis
IRPVAPGLYSWLPLGLRVLRNIERV

SEQ ID NO: 1525269 - protein, 18 aa, Mycobacterium tuberculosis
IRQTVIDRGLIGDRLSIE

SEQ ID NO: 1525270 - protein, 19 aa, Mycobacterium tuberculosis
IRRYGQLEERFVALGGYGA

SEQ ID NO: 1525271 - protein, 21 aa, Mycobacterium tuberculosis
IRVALRLAVVLRPEKLRCGDP

SEQ ID NO: 1525272 - protein, 17 aa, Mycobacterium tuberculosis
IRVFPGDHFYLNDNLPE

SEQ ID NO: 1525273 - protein, 24 aa, Mycobacterium tuberculosis
ISAGFRSLPLGTPKQRAVLATLII

SEQ ID NO: 1525274 - protein, 18 aa, Mycobacterium tuberculosis
ISAPLRPGSGMPPIGVPV

SEQ ID NO: 1525275 - protein, 17 aa, Mycobacterium tuberculosis
ISARLTSWIALVTSMPR

SEQ ID NO: 1525276 - protein, 27 aa, Mycobacterium tuberculosis
ISDELWDLLPGYLIFRSIIPNRRSTPD

SEQ ID NO: 1525277 - protein, 27 aa, Mycobacterium tuberculosis
ISDPKGRYFRLLTGWVGGGFRVPDDDV

SEQ ID NO: 1525278 - protein, 23 aa, Mycobacterium tuberculosis
ISGDLRVDFPWLGTVVQAYLRRT

SEQ ID NO: 1525279 - protein, 35 aa, Mycobacterium tuberculosis
ISGLRRDYRWAEADRHLWIADERGTWHLREAEEHK

SEQ ID NO: 1525280 - protein, 17 aa, Mycobacterium tuberculosis
ISGPQYQAWKHTQLIID

SEQ ID NO: 1525281 - protein, 27 aa, Mycobacterium tuberculosis
ISMVHSRRLWSLLPHRCSSSMRYTAAM

SEQ ID NO: 1525282 - protein, 19 aa, Mycobacterium tuberculosis
ISNFPPKRHKTRVLAAAED

SEQ ID NO: 1525283 - protein, 18 aa, Mycobacterium tuberculosis
ISPENKAYYFAAAFPSAC

SEQ ID NO: 1525284 - protein, 36 aa, Mycobacterium tuberculosis
ISPIRALDPLAGSIGLFLEPFRLSDPFITIDAFQVV

SEQ ID NO: 1525285 - protein, 20 aa, Mycobacterium tuberculosis
ISPWGTWEWIGPPALGAVLP

SEQ ID NO: 1525286 - protein, 21 aa, Mycobacterium tuberculosis
ISPWGTWEWIGPPALGAVLPA

SEQ ID NO: 1525287 - protein, 24 aa, Mycobacterium tuberculosis
ISPYFDSMLVKLTCRGRDLPTAVS

SEQ ID NO: 1525288 - protein, 31 aa, Mycobacterium tuberculosis
ISRANAEALVPITALLPAGADDVSAAIAALF

SEQ ID NO: 1525289 - protein, 17 aa, Mycobacterium tuberculosis
ISRLPDTCFGIIAADDV

SEQ ID NO: 1525290 - protein, 17 aa, Mycobacterium tuberculosis
ISVASLVDRWRAVDGCQ

SEQ ID NO: 1525291 - protein, 21 aa, Mycobacterium tuberculosis
ISVGCNNSCTFCIVPSLRGRE

SEQ ID NO: 1525292 - protein, 20 aa, Mycobacterium tuberculosis
ISVKLIQPVAMDEGLRFAIR

SEQ ID NO: 1525293 - protein, 21 aa, Mycobacterium tuberculosis
ISVVAAPWLADHAVGPVVLFP

SEQ ID NO: 1525294 - protein, 19 aa, Mycobacterium tuberculosis
ISYSGVFVHSAPWSVGAQG

SEQ ID NO: 1525295 - protein, 19 aa, Mycobacterium tuberculosis
ITAHLLGAARRRAFRVWLD

SEQ ID NO: 1525296 - protein, 17 aa, Mycobacterium tuberculosis
ITASTFLVDGGISSAYA

SEQ ID NO: 1525297 - protein, 18 aa, Mycobacterium tuberculosis
ITATILLSWSQPTAQPLP

SEQ ID NO: 1525298 - protein, 25 aa, Mycobacterium tuberculosis
ITEAVYFVERLVDCLAFELKMDPAE

SEQ ID NO: 1525299 - protein, 20 aa, Mycobacterium tuberculosis
ITEHLLGAARRRAFRVWLDA

SEQ ID NO: 1525300 - protein, 18 aa, Mycobacterium tuberculosis
ITERCVCSQCGTVSGHAA

SEQ ID NO: 1525301 - protein, 18 aa, Mycobacterium tuberculosis
ITEYGPHVALPPTELEMA

SEQ ID NO: 1525302 - protein, 26 aa, Mycobacterium tuberculosis
ITGAVIIDYWGIIKADIGIRDGRIVG

SEQ ID NO: 1525303 - protein, 27 aa, Mycobacterium tuberculosis
ITGDVRRAMTMLLIACPCAVGLSTPTA

SEQ ID NO: 1525304 - protein, 28 aa, Mycobacterium tuberculosis
ITGDVRRAMTMLLIACPCAVGLSTPTAI

SEQ ID NO: 1525305 - protein, 18 aa, Mycobacterium tuberculosis
ITGGLGGLGLFLAEKMAA

SEQ ID NO: 1525306 - protein, 18 aa, Mycobacterium tuberculosis
ITGRPWTTTTLSKFLRKP

SEQ ID NO: 1525307 - protein, 18 aa, Mycobacterium tuberculosis
ITGYRFDRTANDLHLLVP

SEQ ID NO: 1525308 - protein, 23 aa, Mycobacterium tuberculosis
ITIAYFESKLPAGTPVVRAMPNA

SEQ ID NO: 1525309 - protein, 31 aa, Mycobacterium tuberculosis
ITITSGAGPVVIPLLDIPPAPGFGNSTTGPS

SEQ ID NO: 1525310 - protein, 22 aa, Mycobacterium tuberculosis
ITKAQLFHTSGHLDWYADGMFP

SEQ ID NO: 1525311 - protein, 17 aa, Mycobacterium tuberculosis
ITLLEPAPRRRHATVTD

SEQ ID NO: 1525312 - protein, 24 aa, Mycobacterium tuberculosis
ITLVTFERLVFDGILQEVVLFCGV

SEQ ID NO: 1525313 - protein, 17 aa, Mycobacterium tuberculosis
ITLYSPLRHWNAGANTR

SEQ ID NO: 1525314 - protein, 18 aa, Mycobacterium tuberculosis
ITNDAVITPFNVSPAFVA

SEQ ID NO: 1525315 - protein, 17 aa, Mycobacterium tuberculosis
ITPAAAFPPPDPVPAVT

SEQ ID NO: 1525316 - protein, 23 aa, Mycobacterium tuberculosis
ITPAFQLLVYPMLDDRPSIAPAN

SEQ ID NO: 1525317 - protein, 18 aa, Mycobacterium tuberculosis
ITPIMVREINIGEIPLGL

SEQ ID NO: 1525318 - protein, 25 aa, Mycobacterium tuberculosis
ITPRTRLIWVETPTNPLLSIADITA

SEQ ID NO: 1525319 - protein, 17 aa, Mycobacterium tuberculosis
ITQRRLGCIGNPSKVTD

SEQ ID NO: 1525320 - protein, 24 aa, Mycobacterium tuberculosis
ITRARQRLYVSRRSCVRLGASRCS

SEQ ID NO: 1525321 - protein, 19 aa, Mycobacterium tuberculosis
ITSDRLYPAAPAAGAGRPA

SEQ ID NO: 1525322 - protein, 18 aa, Mycobacterium tuberculosis
ITVITPVFNTGGEDVLFF

SEQ ID NO: 1525323 - protein, 39 aa, Mycobacterium tuberculosis
ITVPGVPISRIPLTINIRIPVNITLNELPFNVAGIFTGY

SEQ ID NO: 1525324 - protein, 18 aa, Mycobacterium tuberculosis
ITVRGQRLLQRCPVCLYA

SEQ ID NO: 1525325 - protein, 17 aa, Mycobacterium tuberculosis
ITWRRFCRIPLEGSVPH

SEQ ID NO: 1525326 - protein, 18 aa, Mycobacterium tuberculosis
IVALLLGDSFHPGGATLT

SEQ ID NO: 1525327 - protein, 20 aa, Mycobacterium tuberculosis
IVAMFNQFCYLQLSGKRSRR

SEQ ID NO: 1525328 - protein, 27 aa, Mycobacterium tuberculosis
IVATETFAPILYVLTYDDLDEAIALNN

SEQ ID NO: 1525329 - protein, 26 aa, Mycobacterium tuberculosis
IVATVAATWRRLELSVPLVVDPVCAS

SEQ ID NO: 1525330 - protein, 22 aa, Mycobacterium tuberculosis
IVDEPFMLPAHIDFTALRAHAV

SEQ ID NO: 1525331 - protein, 28 aa, Mycobacterium tuberculosis
IVDSMRQRWLSCPWAGWYATNSVASTGW

SEQ ID NO: 1525332 - protein, 28 aa, Mycobacterium tuberculosis
IVEWISAIMTLLPGDLILTGTPAGVGPI

SEQ ID NO: 1525333 - protein, 18 aa, Mycobacterium tuberculosis
IVFASRSLLPRDEGDMAL

SEQ ID NO: 1525334 - protein, 19 aa, Mycobacterium tuberculosis
IVGPLARAALENTLQRGQA

SEQ ID NO: 1525335 - protein, 18 aa, Mycobacterium tuberculosis
IVISAYVPKHWQKLCYLI

SEQ ID NO: 1525336 - protein, 19 aa, Mycobacterium tuberculosis
IVISLPLRSKHVLNVNCIF

SEQ ID NO: 1525337 - protein, 17 aa, Mycobacterium tuberculosis
IVISLVLERYALGENMA

SEQ ID NO: 1525338 - protein, 20 aa, Mycobacterium tuberculosis
IVISNMPRLVPGWTKPIVIG

SEQ ID NO: 1525339 - protein, 18 aa, Mycobacterium tuberculosis
IVLANLPCGYVGAVVADE

SEQ ID NO: 1525340 - protein, 18 aa, Mycobacterium tuberculosis
IVLLMQETSFDHYFGTLS

SEQ ID NO: 1525341 - protein, 19 aa, Mycobacterium tuberculosis
IVLTCSPTRYGGVKGAHRI

SEQ ID NO: 1525342 - protein, 18 aa, Mycobacterium tuberculosis
IVMPARLPNRIHPFVQEN

SEQ ID NO: 1525343 - protein, 22 aa, Mycobacterium tuberculosis
IVRQMLRRVTIIDSGSTEFLPG

SEQ ID NO: 1525344 - protein, 18 aa, Mycobacterium tuberculosis
IVSFLRYIDANRASWIVM

SEQ ID NO: 1525345 - protein, 23 aa, Mycobacterium tuberculosis
IVVPDITIPGIPLSLNALGGNFR

SEQ ID NO: 1525346 - protein, 30 aa, Mycobacterium tuberculosis; identical to SEQ ID NO: 225232

SEQ ID NO: 1525347 - protein, 25 aa, Mycobacterium tuberculosis
IWATQSGFTFPLLSDFWPHGAVSQA

SEQ ID NO: 1525348 - protein, 18 aa, Mycobacterium tuberculosis
IWHEGWFANTIHAATPAG

SEQ ID NO: 1525349 - protein, 20 aa, Mycobacterium tuberculosis
IWIGPRVVIPSLALRARVRE

SEQ ID NO: 1525350 - protein, 17 aa, Mycobacterium tuberculosis
IWISRRLCMAVVAPSQF

SEQ ID NO: 1525351 - protein, 18 aa, Mycobacterium tuberculosis
IWLEQNKQRWLAFFQAEG

SEQ ID NO: 1525352 - protein, 19 aa, Mycobacterium tuberculosis
IWMRPHAVPGLRRLTEAIH

SEQ ID NO: 1525353 - protein, 23 aa, Mycobacterium tuberculosis
IYDQLRRYPWPQGHTMSVLSNAL

SEQ ID NO: 1525354 - protein, 21 aa, Mycobacterium tuberculosis
IYHYAPYEKTALLRLVGRYGI

SEQ ID NO: 1525355 - protein, 23 aa, Mycobacterium tuberculosis
IYHYAPYEKTALLRLVGRYGIGE

SEQ ID NO: 1525356 - protein, 19 aa, Mycobacterium tuberculosis
IYNFRYPNMLRLRYEKKRN

SEQ ID NO: 1525357 - protein, 29 aa, Mycobacterium tuberculosis
IYRTGEHIGWRLWMGIAFELTSDPQELRE

SEQ ID NO: 1525358 - protein, 24 aa, Mycobacterium tuberculosis
IYSQQRLHPLPPQTVVGIPSSAGS

SEQ ID NO: 1525359 - protein, 21 aa, Mycobacterium tuberculosis
KAAAAGRPWWEWAATHERAFT

SEQ ID NO: 1525360 - protein, 17 aa, Mycobacterium tuberculosis
KAALEPVNPPKPPPAIK

SEQ ID NO: 1525361 - protein, 24 aa, Mycobacterium tuberculosis
KAALWELIWAGRVTGDTFAPVRAV

SEQ ID NO: 1525362 - protein, 17 aa, Mycobacterium tuberculosis
KAARFVRTCDCFNIPIV

SEQ ID NO: 1525363 - protein, 17 aa, Mycobacterium tuberculosis
KADIANSLGDNATVTGG

SEQ ID NO: 1525364 - protein, 24 aa, Mycobacterium tuberculosis
KADLPAFAELLARLPWPLNKTTSV

SEQ ID NO: 1525365 - protein, 25 aa, Mycobacterium tuberculosis
KADSIVIGGGMCFTFLAAQGFSVGT

SEQ ID NO: 1525366 - protein, 24 aa, Mycobacterium tuberculosis
KAEALKCAKGFRYYAENAEALLAD

SEQ ID NO: 1525367 - protein, 29 aa, Mycobacterium tuberculosis
KAEGTFEYQALLFIPSHAPFDLFDRDAHV

SEQ ID NO: 1525368 - protein, 20 aa, Mycobacterium tuberculosis
KAFIQTLFPGAVSQGLFTPE

SEQ ID NO: 1525369 - protein, 18 aa, Mycobacterium tuberculosis
KAFLGERIGVRRGVVVDA

SEQ ID NO: 1525370 - protein, 27 aa, Mycobacterium tuberculosis
KAFRTRPLDAGPYTFLAADALVLKVRE

SEQ ID NO: 1525371 - protein, 25 aa, Mycobacterium tuberculosis
KAGAFVNWEGRYRTFEPALRGSTLQ

SEQ ID NO: 1525372 - protein, 33 aa, Mycobacterium tuberculosis
KAGVGGVSGLLLGLDGFKLPRAPRHCTPCSKMC

SEQ ID NO: 1525373 - protein, 29 aa, Mycobacterium tuberculosis
KAGVGGVSGLLLGLDGFNAPASTSPLHTL

SEQ ID NO: 1525374 - protein, 20 aa, Mycobacterium tuberculosis
KAHAIALAETLPTACVLGDV

SEQ ID NO: 1525375 - protein, 24 aa, Mycobacterium tuberculosis
KAHELGLTWLAEIGAHGVVAGPDS

SEQ ID NO: 1525376 - protein, 23 aa, Mycobacterium tuberculosis
KAHELRIQRLADGSLRYPPVPAV

SEQ ID NO: 1525377 - protein, 26 aa, Mycobacterium tuberculosis
KAKAAPLWRVLVALSIRHVGPTAARA

SEQ ID NO: 1525378 - protein, 17 aa, Mycobacterium tuberculosis
KALDWIGERLGPAEVGP

SEQ ID NO: 1525379 - protein, 20 aa, Mycobacterium tuberculosis
KALLRRLVEAGTRVVQYGYA

SEQ ID NO: 1525380 - protein, 26 aa, Mycobacterium tuberculosis
KAMPEGFLIFNVVWNTILAIGFEWGV

SEQ ID NO: 1525381 - protein, 24 aa, Mycobacterium tuberculosis
KANPLYLLDFLRQSGNTPIVLLHC

SEQ ID NO: 1525382 - protein, 17 aa, Mycobacterium tuberculosis
KAPPSPYPARALAGGLH

SEQ ID NO: 1525383 - protein, 32 aa, Mycobacterium tuberculosis
KAQQNLLNLINAPTQTLLGRPLIGDGANATTP

SEQ ID NO: 1525384 - protein, 17 aa, Mycobacterium tuberculosis
KARAYERLATQARIQCL

SEQ ID NO: 1525385 - protein, 17 aa, Mycobacterium tuberculosis
KARPRYIRIAADLPSTA

SEQ ID NO: 1525386 - protein, 23 aa, Mycobacterium tuberculosis
KASLQGVLATRPDFVFGAEPYNA

SEQ ID NO: 1525387 - protein, 28 aa, Mycobacterium tuberculosis
KATRVHAAAWTKFLDDYLTRRPQRTGED

SEQ ID NO: 1525388 - protein, 20 aa, Mycobacterium tuberculosis
KAVSLAQPPLGKLRALGVNP

SEQ ID NO: 1525389 - protein, 18 aa, Mycobacterium tuberculosis
KCAKGFRYYAENAEALLA

SEQ ID NO: 1525390 - protein, 24 aa, Mycobacterium tuberculosis
KCCVQQITPDGRLIPFCAYNSVGY

SEQ ID NO: 1525391 - protein, 24 aa, Mycobacterium tuberculosis
KCRTRNLPLIGAPANPGPAPGSGA

SEQ ID NO: 1525392 - protein, 22 aa, Mycobacterium tuberculosis
KDDPLGPIIKLFDDAGYIGVVA

SEQ ID NO: 1525393 - protein, 21 aa, Mycobacterium tuberculosis
KDHIEAIANWDPKAEPSIEIQ

SEQ ID NO: 1525394 - protein, 21 aa, Mycobacterium tuberculosis
KDLVDGAPKPLLEKVAKEAAD

SEQ ID NO: 1525395 - protein, 25 aa, Mycobacterium tuberculosis
KDPYVPLGTNPWFGDPNQILTCPAP

SEQ ID NO: 1525396 - protein, 19 aa, Mycobacterium tuberculosis
KDYGYVILPVAVPEGVEPS

SEQ ID NO: 1525397 - protein, 20 aa, Mycobacterium tuberculosis
KDYGYVILPVAVPEGVEPSA

SEQ ID NO: 1525398 - protein, 21 aa, Mycobacterium tuberculosis
KEAGWWRLGLAEEIGGMPAPP

SEQ ID NO: 1525399 - protein, 17 aa, Mycobacterium tuberculosis
KEDYQILGPLPRKNIDT

SEQ ID NO: 1525400 - protein, 23 aa, Mycobacterium tuberculosis
KEDYQILGPLPRNNIDTGMGVER

SEQ ID NO: 1525401 - protein, 18 aa, Mycobacterium tuberculosis
KEEDINMWESLTHESALT

SEQ ID NO: 1525402 - protein, 20 aa, Mycobacterium tuberculosis
KEFTLLEALIRRPGIVHTRA

SEQ ID NO: 1525403 - protein, 18 aa, Mycobacterium tuberculosis
KEHWLPAHFSGDGSTYMP

SEQ ID NO: 1525404 - protein, 20 aa, Mycobacterium tuberculosis
KEIGVRLFISPRTVHSHLTH

SEQ ID NO: 1525405 - protein, 24 aa, Mycobacterium tuberculosis
KENNVAYIQWAIRWTRRGAVIVVD

SEQ ID NO: 1525406 - protein, 23 aa, Mycobacterium tuberculosis
KEPLYRLYELRLRQGLAASKSDL

SEQ ID NO: 1525407 - protein, 18 aa, Mycobacterium tuberculosis
KEPLYRLYELRLRQGLPA

SEQ ID NO: 1525408 - protein, 21 aa, Mycobacterium tuberculosis
KESLVAGGSLVLRAARPGQIV

SEQ ID NO: 1525409 - protein, 17 aa, Mycobacterium tuberculosis
KEVIRGKRLIVVDDSIV

SEQ ID NO: 1525410 - protein, 22 aa, Mycobacterium tuberculosis
KEYTAHWYGRTLHFGVREHAMG

SEQ ID NO: 1525411 - protein, 20 aa, Mycobacterium tuberculosis
KFADPWTFDLARNPNPHLGF

SEQ ID NO: 1525412 - protein, 23 aa, Mycobacterium tuberculosis
KFADPWTFDLARNPNPHLGFGGG

SEQ ID NO: 1525413 - protein, 35 aa, Mycobacterium tuberculosis
KFDYTKGYKFSTYATWWIRQAITPRHGRPGPHHPH

SEQ ID NO: 1525414 - protein, 34 aa, Mycobacterium tuberculosis; identical to SEQ ID NO: 782833

SEQ ID NO: 1525415 - protein, 41 aa, Mycobacterium tuberculosis
KFNTISRTAAFSRMLSLFFRQHINYVLARPKLRPITGDDPA

SEQ ID NO: 1525416 - protein, 24 aa, Mycobacterium tuberculosis
KFRTGGYMIDFWGVGYHVAKRMGI

SEQ ID NO: 1525417 - protein, 22 aa, Mycobacterium tuberculosis
KFSMPGPWVGIAAPGENIASVS

SEQ ID NO: 1525418 - protein, 20 aa, Mycobacterium tuberculosis
KFYTSLFGWGYDDNPVPGGG

SEQ ID NO: 1525419 - protein, 24 aa, Mycobacterium tuberculosis
KGAANGFRRFSGKGGPGGTGGRGG

SEQ ID NO: 1525420 - protein, 24 aa, Mycobacterium tuberculosis
KGADPGGLFPIPGAGGKGGTGGTG

SEQ ID NO: 1525421 - protein, 21 aa, Mycobacterium tuberculosis
KGAEYPLLPDELAEALAGFIA

SEQ ID NO: 1525422 - protein, 21 aa, Mycobacterium tuberculosis
KGAGMLAPSLATMLCVLTTDA

SEQ ID NO: 1525423 - protein, 22 aa, Mycobacterium tuberculosis
KGALRGLRLSYFGDGAQQHGPL

SEQ ID NO: 1525424 - protein, 17 aa, Mycobacterium tuberculosis
KGAVLFVTDLARAIPVP

SEQ ID NO: 1525425 - protein, 26 aa, Mycobacterium tuberculosis
KGDVVVLLESMKMEIPVLAEAAGTVS

SEQ ID NO: 1525426 - protein, 22 aa, Mycobacterium tuberculosis
KGFHWEPTAAYRRASVTSASSS

SEQ ID NO: 1525427 - protein, 18 aa, Mycobacterium tuberculosis
KGGAGGTAGLLGLNGSPG

SEQ ID NO: 1525428 - protein, 19 aa, Mycobacterium tuberculosis
KGGAGGTAGLLGLNGSPGL

SEQ ID NO: 1525429 - protein, 23 aa, Mycobacterium tuberculosis
KGGAGLIAGLDGAGGAGGTRGLI

SEQ ID NO: 1525430 - protein, 25 aa, Mycobacterium tuberculosis
KGGDTPNGLAINPGIGGNGGDTGNA

SEQ ID NO: 1525431 - protein, 18 aa, Mycobacterium tuberculosis
KGGEPAVATGPRGAPDQP

SEQ ID NO: 1525432 - protein, 25 aa, Mycobacterium tuberculosis
KGGEVRYFIDRLAGWYVITSSDRMS

SEQ ID NO: 1525433 - protein, 17 aa, Mycobacterium tuberculosis
KGGFLPLGEYRWAFDNA

SEQ ID NO: 1525434 - protein, 20 aa, Mycobacterium tuberculosis
KGHPLFAHITLLRSERSPIA

SEQ ID NO: 1525435 - protein, 17 aa, Mycobacterium tuberculosis
KGIVIGKGGARLREVGT

SEQ ID NO: 1525436 - protein, 19 aa, Mycobacterium tuberculosis
KGIVIGKGGARLREVGTAA

SEQ ID NO: 1525437 - protein, 26 aa, Mycobacterium tuberculosis
KGKTLLWVLDHLPHSGSAPLVPIYLG

SEQ ID NO: 1525438 - protein, 20 aa, Mycobacterium tuberculosis
KGMLTGPVTILAWSFVRDDQ

SEQ ID NO: 1525439 - protein, 23 aa, Mycobacterium tuberculosis
KGMQMRLPFARSLINDPELLFLD

SEQ ID NO: 1525440 - protein, 25 aa, Mycobacterium tuberculosis
KGNTRRLATLGPLLQDLEARIIDEQ

SEQ ID NO: 1525441 - protein, 24 aa, Mycobacterium tuberculosis
KGPKIRIHKFKNKTGYHKRQGHRQ

SEQ ID NO: 1525442 - protein, 17 aa, Mycobacterium tuberculosis
KGQLLLDVLRCGICGSD

SEQ ID NO: 1525443 - protein, 17 aa, Mycobacterium tuberculosis
KGRRRRRAGRRWHGNAD

SEQ ID NO: 1525444 - protein, 20 aa, Mycobacterium tuberculosis
KGTADGRILRVRGRGVPKRS

SEQ ID NO: 1525445 - protein, 17 aa, Mycobacterium tuberculosis
KGTWNGTRLAAAIMRER

SEQ ID NO: 1525446 - protein, 24 aa, Mycobacterium tuberculosis
KGVAVPHRPVAEYFVWFKGEYDVD

SEQ ID NO: 1525447 - protein, 24 aa, Mycobacterium tuberculosis
KGVMRTWYLIGRKVAADPGEVRGA

SEQ ID NO: 1525448 - protein, 20 aa, Mycobacterium tuberculosis
KGVPGRWRLCVLMRDDATRT

SEQ ID NO: 1525449 - protein, 33 aa, Mycobacterium tuberculosis
KGYTEYHQLGLIDKLPRMLGTQAAGAAPLVLGE

SEQ ID NO: 1525450 - protein, 17 aa, Mycobacterium tuberculosis
KHGIVFAGGGRGIGDDR

SEQ ID NO: 1525451 - protein, 26 aa, Mycobacterium tuberculosis
KHHRGLMNMIFITTIPHHGAPQCKSQ

SEQ ID NO: 1525452 - protein, 25 aa, Mycobacterium tuberculosis
KHQRNPLRVALIDTYLPSQIANPSM

SEQ ID NO: 1525453 - protein, 18 aa, Mycobacterium tuberculosis
KHRGLSFLLVPMDQPGVV

SEQ ID NO: 1525454 - protein, 22 aa, Mycobacterium tuberculosis
KHSFGVLRHRAAVGIPLGGHAT

SEQ ID NO: 1525455 - protein, 20 aa, Mycobacterium tuberculosis
KHTTTPSVLFLLLKTIATSR

SEQ ID NO: 1525456 - protein, 26 aa, Mycobacterium tuberculosis
KHTTTPSVLFLLLKTIATSRSHRAST

SEQ ID NO: 1525457 - protein, 23 aa, Mycobacterium tuberculosis
KHTVARLIGAPPGYVGYEAGGQL

SEQ ID NO: 1525458 - protein, 18 aa, Mycobacterium tuberculosis
KHYWSIYQKMIVKGRDFD

SEQ ID NO: 1525459 - protein, 19 aa, Mycobacterium tuberculosis
KIFDLLEHAPVDVAVLTDA

SEQ ID NO: 1525460 - protein, 18 aa, Mycobacterium tuberculosis
KIFIEKAVDLGVQALAGA

SEQ ID NO: 1525461 - protein, 20 aa, Mycobacterium tuberculosis
KIGPITGLFNTPIGLTPLAL

SEQ ID NO: 1525462 - protein, 25 aa, Mycobacterium tuberculosis
KIGPITGLFNTPIGLTPLALSQIVI

SEQ ID NO: 1525463 - protein, 24 aa, Mycobacterium tuberculosis
KIGYPPTRVWGGAGGGPVGAPARR

SEQ ID NO: 1525464 - protein, 27 aa, Mycobacterium tuberculosis
KIGYPPTRVWGVPAAGLWAHRLGDQRA

SEQ ID NO: 1525465 - protein, 26 aa, Mycobacterium tuberculosis
KIRLLTRIAFGFRSPQALIALAMLAL

SEQ ID NO: 1525466 - protein, 18 aa, Mycobacterium tuberculosis
KITAVMAALRRWARDRGL

SEQ ID NO: 1525467 - protein, 17 aa, Mycobacterium tuberculosis
KKLLAADGLPVGAYAVL

SEQ ID NO: 1525468 - protein, 24 aa, Mycobacterium tuberculosis
KKRRRRCRRRAWPPRRLRPPTARV

SEQ ID NO: 1525469 - protein, 18 aa, Mycobacterium tuberculosis
KLAAMRALWAAEPVHYEG

SEQ ID NO: 1525470 - protein, 30 aa, Mycobacterium tuberculosis
KLAFDVTPPAWLEPGQWWALVRVGCAGQLV

SEQ ID NO: 1525471 - protein, 19 aa, Mycobacterium tuberculosis
KLALRDPITRWAPELCKVA

SEQ ID NO: 1525472 - protein, 24 aa, Mycobacterium tuberculosis
KLAPKHVLPAWIGLVTLAAQENWP

SEQ ID NO: 1525473 - protein, 18 aa, Mycobacterium tuberculosis
KLAVLPSFTPMLLPDIGR

SEQ ID NO: 1525474 - protein, 21 aa, Mycobacterium tuberculosis
KLCVQYLAPIVKNRQYNYPPL

SEQ ID NO: 1525475 - protein, 26 aa, Mycobacterium tuberculosis
KLDALALLHRLSLKSPVRHFVLFSSV

SEQ ID NO: 1525476 - protein, 20 aa, Mycobacterium tuberculosis
KLEVLPVTAFSLHDAADAFR

SEQ ID NO: 1525477 - protein, 23 aa, Mycobacterium tuberculosis
KLFDEWFPANKLVKLGLRLTNIS

SEQ ID NO: 1525478 - protein, 24 aa, Mycobacterium tuberculosis
KLFDEWFPANKLVKLGLRLTNISR

SEQ ID NO: 1525479 - protein, 17 aa, Mycobacterium tuberculosis
KLFRPKVPVTIVVGERI

SEQ ID NO: 1525480 - protein, 37 aa, Mycobacterium tuberculosis
KLGDLITFVIHIPLSIDLLLDLRLDKQQFMVAGDIAL

SEQ ID NO: 1525481 - protein, 29 aa, Mycobacterium tuberculosis
KLGIGPPITDGFYYDFDVPEPFTPEDLAA

SEQ ID NO: 1525482 - protein, 20 aa, Mycobacterium tuberculosis
KLGLFGVGRIRAGLELSEVS

SEQ ID NO: 1525483 - protein, 18 aa, Mycobacterium tuberculosis
KLGLPAQRRALTVHSARW

SEQ ID NO: 1525484 - protein, 19 aa, Mycobacterium tuberculosis
KLGPEGFARWLRESAAVGV

SEQ ID NO: 1525485 - protein, 27 aa, Mycobacterium tuberculosis
KLGVGPADHPVLWAGLPDLVSRNRVAD

SEQ ID NO: 1525486 - protein, 38 aa, Mycobacterium tuberculosis
KLLSPTRIRQLLTVSRLLAPILTPVIYRAAMAARGLID

SEQ ID NO: 1525487 - protein, 38 aa, Mycobacterium tuberculosis
KLLSPTRIRRLLTVSRLLAPILTPVIYRAAMAARGLID

SEQ ID NO: 1525488 - protein, 17 aa, Mycobacterium tuberculosis
KLLWANWHRNLGELAMD

SEQ ID NO: 1525489 - protein, 23 aa, Mycobacterium tuberculosis
KLMTDIFALAMELGGAISGEHGV

SEQ ID NO: 1525490 - protein, 23 aa, Mycobacterium tuberculosis
KLPKRRPVPLRLRDWREVYEEFD

SEQ ID NO: 1525491 - protein, 17 aa, Mycobacterium tuberculosis
KLREIDGLLPTLIRGQG

SEQ ID NO: 1525492 - protein, 18 aa, Mycobacterium tuberculosis
KLREIDGLLPTLIRGQGT

SEQ ID NO: 1525493 - protein, 28 aa, Mycobacterium tuberculosis
KLRELYLGHLWCRTLRPGLPPPTTSSGI

SEQ ID NO: 1525494 - protein, 28 aa, Mycobacterium tuberculosis
KLRIPGARVIPTIYFLRHSTDPVHTATL

SEQ ID NO: 1525495 - protein, 20 aa, Mycobacterium tuberculosis
KLSLTICAPLLHLGSYLSAP

SEQ ID NO: 1525496 - protein, 19 aa, Mycobacterium tuberculosis
KLVLEPIFETDFEPVSYGF

SEQ ID NO: 1525497 - protein, 20 aa, Mycobacterium tuberculosis
KLVLEPIFETDFEPVSYGFR

SEQ ID NO: 1525498 - protein, 17 aa, Mycobacterium tuberculosis
KLWLTDEGDIDADWPRL

SEQ ID NO: 1525499 - protein, 18 aa, Mycobacterium tuberculosis
KLWQWEPGQWKHRKYQLR

SEQ ID NO: 1525500 - protein, 19 aa, Mycobacterium tuberculosis
KLYYEAYPAMVHRTLMDII

SEQ ID NO: 1525501 - protein, 26 aa, Mycobacterium tuberculosis
KMAAVAKRRGWPILKFNSRGGVGIRR

SEQ ID NO: 1525502 - protein, 17 aa, Mycobacterium tuberculosis
KMADTAWFVIREQNLRF

SEQ ID NO: 1525503 - protein, 23 aa, Mycobacterium tuberculosis
KMDPQQRLLLEVAWEALEHAGIP

SEQ ID NO: 1525504 - protein, 17 aa, Mycobacterium tuberculosis
KMLPPKLGLMSYVADAY

SEQ ID NO: 1525505 - protein, 19 aa, Mycobacterium tuberculosis
KMRARWRTPMNCGCSPMST

SEQ ID NO: 1525506 - protein, 25 aa, Mycobacterium tuberculosis
KMTKDLAILIGPEQDWLNSEEFLDA

SEQ ID NO: 1525507 - protein, 18 aa, Mycobacterium tuberculosis
KMTPAPTQPIPILVGGHA

SEQ ID NO: 1525508 - protein, 20 aa, Mycobacterium tuberculosis
KMVRKRMRALKYSKQMIDDI

SEQ ID NO: 1525509 - protein, 21 aa, Mycobacterium tuberculosis
KMVRKRMRALKYSKQMIDDIS

SEQ ID NO: 1525510 - protein, 20 aa, Mycobacterium tuberculosis
KNFVAPLLYITDRNNVIVVA

SEQ ID NO: 1525511 - protein, 18 aa, Mycobacterium tuberculosis
KNIRDWDDLLLPGIEVIT

SEQ ID NO: 1525512 - protein, 23 aa, Mycobacterium tuberculosis
KNLFPDWVIADGPWVKWYPGIPG

SEQ ID NO: 1525513 - protein, 24 aa, Mycobacterium tuberculosis
KNSPGLVVLLTFGTGIGSAVIHNG

SEQ ID NO: 1525514 - protein, 24 aa, Mycobacterium tuberculosis
KNTVLWCGYTWQYWLTTRSVNPAE

SEQ ID NO: 1525515 - protein, 25 aa, Mycobacterium tuberculosis
KPAQVALAWLISLPGVVAIPAVSDA

SEQ ID NO: 1525516 - protein, 20 aa, Mycobacterium tuberculosis
KPAVILYPSGTVISFDELEA

SEQ ID NO: 1525517 - protein, 22 aa, Mycobacterium tuberculosis
KPDQWALRRHDFDLRTAAAALL

SEQ ID NO: 1525518 - protein, 21 aa, Mycobacterium tuberculosis
KPEFAEDWVNLVALAVNEENA

SEQ ID NO: 1525519 - protein, 22 aa, Mycobacterium tuberculosis
KPEFAEDWVNLVALAVNEENAS

SEQ ID NO: 1525520 - protein, 22 aa, Mycobacterium tuberculosis
KPEFINRLDDVLIFEGLNPEEL

SEQ ID NO: 1525521 - protein, 27 aa, Mycobacterium tuberculosis
KPEFVENFFMFIAEEVREYLAQLGFRT

SEQ ID NO: 1525522 - protein, 26 aa, Mycobacterium tuberculosis
KPGQLISYLLRRRGMLTSNVGEAYGF

SEQ ID NO: 1525523 - protein, 25 aa, Mycobacterium tuberculosis
KPITHPLRADIPIMLGAEGPKNVAL

SEQ ID NO: 1525524 - protein, 23 aa, Mycobacterium tuberculosis
KPLALYHTKRLASPAQRIMLFAN

SEQ ID NO: 1525525 - protein, 20 aa, Mycobacterium tuberculosis
KPLWRWIKMGQTAPTSPNNQ

SEQ ID NO: 1525526 - protein, 17 aa, Mycobacterium tuberculosis
KPPAVATRLCWPDQAKA

SEQ ID NO: 1525527 - protein, 22 aa, Mycobacterium tuberculosis
KPPTWWDSLPTDRPIVYATLGT

SEQ ID NO: 1525528 - protein, 17 aa, Mycobacterium tuberculosis
KPRVIELLLVTAIPAML

SEQ ID NO: 1525529 - protein, 26 aa, Mycobacterium tuberculosis
KPSRVPVWFMRQAGRSLPEYRALRER

SEQ ID NO: 1525530 - protein, 22 aa, Mycobacterium tuberculosis
KPTNALLFPQPRCQVITGVGAT

SEQ ID NO: 1525531 - protein, 32 aa, Mycobacterium tuberculosis
KPVLYQHFSSKLELYLAVLHRHVENLVSGVHQ

SEQ ID NO: 1525532 - protein, 19 aa, Mycobacterium tuberculosis
KPVPAPPAHPANRAAPVVR

SEQ ID NO: 1525533 - protein, 19 aa, Mycobacterium tuberculosis
KPVVLRRATPLQAIAAMDA

SEQ ID NO: 1525534 - protein, 19 aa, Mycobacterium tuberculosis
KPWTPRRWSTRCWSRPRVS

SEQ ID NO: 1525535 - protein, 24 aa, Mycobacterium tuberculosis
KQERLAALDHSRDSWRGRDFTGTE

SEQ ID NO: 1525536 - protein, 23 aa, Mycobacterium tuberculosis
KQERVAALDHSRGSWRGRDFTGT

SEQ ID NO: 1525537 - protein, 24 aa, Mycobacterium tuberculosis
KQLVAYVGLERFLAGLRDYFRTHA

SEQ ID NO: 1525538 - protein, 17 aa, Mycobacterium tuberculosis
KQLYTLDLGSLVAGSRY

SEQ ID NO: 1525539 - protein, 32 aa, Mycobacterium tuberculosis
KQPQRVLGLHFFNPVPVLPLVELVRTLVTDEA

SEQ ID NO: 1525540 - protein, 25 aa, Mycobacterium tuberculosis
KQRTGLPYVTWKYATSIDGRSAAAD

SEQ ID NO: 1525541 - protein, 17 aa, Mycobacterium tuberculosis
KRAGKRVGFPRFKRKGR

SEQ ID NO: 1525542 - protein, 34 aa, Mycobacterium tuberculosis
KRCAACWRQCRPAVLSAAWFEPASTDLILGAARR

SEQ ID NO: 1525543 - protein, 18 aa, Mycobacterium tuberculosis
KRDDWSLPLAVLVDGRAV

SEQ ID NO: 1525544 - protein, 17 aa, Mycobacterium tuberculosis
KRDIYGDTKLGLFPFRR

SEQ ID NO: 1525545 - protein, 20 aa, Mycobacterium tuberculosis
KRDIYGDTRLGLFPFGRQPV

SEQ ID NO: 1525546 - protein, 18 aa, Mycobacterium tuberculosis
KRDIYGDTRLGLFPFRRN

SEQ ID NO: 1525547 - protein, 30 aa, Mycobacterium tuberculosis
KRDIYGDTRLGLFPFRRNLSLYAVDLALLT

SEQ ID NO: 1525548 - protein, 29 aa, Mycobacterium tuberculosis
KRDQIGIVFQFFNLIPTLTVLENITLPQE

SEQ ID NO: 1525549 - protein, 23 aa, Mycobacterium tuberculosis
KRDSEWMGRVHRFLGLQVGVILA

SEQ ID NO: 1525550 - protein, 21 aa, Mycobacterium tuberculosis
KRIGELWARFSAVAADNPHAW

SEQ ID NO: 1525551 - protein, 19 aa, Mycobacterium tuberculosis
KRIVRLPKTHIKAVGTHFV

SEQ ID NO: 1525552 - protein, 18 aa, Mycobacterium tuberculosis
KRLDGLPLAIELAAARLR

SEQ ID NO: 1525553 - protein, 21 aa, Mycobacterium tuberculosis
KRLHELLMKRRRLGAERLIGL

SEQ ID NO: 1525554 - protein, 36 aa, Mycobacterium tuberculosis
KRLLVNLDKAKAAPLWRVLVALSIRHVGPTAARALA

SEQ ID NO: 1525555 - protein, 21 aa, Mycobacterium tuberculosis
KRLVDFAAGLAFALRGSFDKV

SEQ ID NO: 1525556 - protein, 20 aa, Mycobacterium tuberculosis
KRMEVALTYIFGIGRTRSNE

SEQ ID NO: 1525557 - protein, 24 aa, Mycobacterium tuberculosis
KRPTKKRCLVANRGGAGPNSPRKN

SEQ ID NO: 1525558 - protein, 20 aa, Mycobacterium tuberculosis
KRQLAVLLLENEGPVASATD

SEQ ID NO: 1525559 - protein, 17 aa, Mycobacterium tuberculosis
KRRMFDLLVRMGYKEIE

SEQ ID NO: 1525560 - protein, 25 aa, Mycobacterium tuberculosis
KRSGLRVYARTGLPCPVCGDTVREV

SEQ ID NO: 1525561 - protein, 20 aa, Mycobacterium tuberculosis
KRSLLRPMQIAHACLNIGWS

SEQ ID NO: 1525562 - protein, 29 aa, Mycobacterium tuberculosis
KRSWLRARGLKIFRWWAGPSVVVTTRRGT

SEQ ID NO: 1525563 - protein, 24 aa, Mycobacterium tuberculosis
KRVLEALLLVIDTPVTADALAAAT

SEQ ID NO: 1525564 - protein, 27 aa, Mycobacterium tuberculosis
KRYTGRGMPLLDLIQEGNLGLIRAREK

SEQ ID NO: 1525565 - protein, 23 aa, Mycobacterium tuberculosis
KSAPQPAWLWSRGGGVIAGKSAA

SEQ ID NO: 1525566 - protein, 17 aa, Mycobacterium tuberculosis
KSCLRNVDRFRPGLLDL

SEQ ID NO: 1525567 - protein, 21 aa, Mycobacterium tuberculosis
KSELFLSLVYGIALTHSPETF

SEQ ID NO: 1525568 - protein, 34 aa, Mycobacterium tuberculosis
KSGDCGTGGYRRRLWRWWLAARATASPADTGGRS

SEQ ID NO: 1525569 - protein, 24 aa, Mycobacterium tuberculosis
KSGGAPGHRGAGGAGGLLLGENGL

SEQ ID NO: 1525570 - protein, 19 aa, Mycobacterium tuberculosis
KSHNLDQVLDGDLDALFDA

SEQ ID NO: 1525571 - protein, 19 aa, Mycobacterium tuberculosis
KSLAYQLLVLNALATDSRA

SEQ ID NO: 1525572 - protein, 20 aa, Mycobacterium tuberculosis
KSLPPKWFYDTVGSELLDQI

SEQ ID NO: 1525573 - protein, 26 aa, Mycobacterium tuberculosis
KSPFSRTCKSLLRLLGIGSPTWGRWR

SEQ ID NO: 1525574 - protein, 28 aa, Mycobacterium tuberculosis
KSPPPPDVPTLVVPFPGTPGTPGTPGTP

SEQ ID NO: 1525575 - protein, 17 aa, Mycobacterium tuberculosis
KSPPPPDVPTLVVPSPG

SEQ ID NO: 1525576 - protein, 26 aa, Mycobacterium tuberculosis
KSQDTLLAKLRRRPYLQLNTIQDIAG

SEQ ID NO: 1525577 - protein, 23 aa, Mycobacterium tuberculosis
KSSLAFDTIFAEGQRRYVESLSA

SEQ ID NO: 1525578 - protein, 22 aa, Mycobacterium tuberculosis
KSSYAQFIFLLSGADHDQMDRM

SEQ ID NO: 1525579 - protein, 24 aa, Mycobacterium tuberculosis
KSTRALRPSLLRRQKRGRPQTSRR

SEQ ID NO: 1525580 - protein, 26 aa, Mycobacterium tuberculosis
KSTTAAAILGLLPAGGRITAGRVVFD

SEQ ID NO: 1525581 - protein, 20 aa, Mycobacterium tuberculosis
KSVYLCCRAALRHMVLAGKR

SEQ ID NO: 1525582 - protein, 22 aa, Mycobacterium tuberculosis
KTDWLFPQYRELGVYLVRGIPP

SEQ ID NO: 1525583 - protein, 18 aa, Mycobacterium tuberculosis
KTFLAQIAANYLLGLALA

SEQ ID NO: 1525584 - protein, 20 aa, Mycobacterium tuberculosis
KTFLAQIAANYLLGLALAQA

SEQ ID NO: 1525585 - protein, 32 aa, Mycobacterium tuberculosis
KTGFHLLHTLFQRLLTYSDVMRYDEWFATTLL

SEQ ID NO: 1525586 - protein, 17 aa, Mycobacterium tuberculosis
KTGRHFSIPLSAHVIDN

SEQ ID NO: 1525587 - protein, 37 aa, Mycobacterium tuberculosis
KTIQQAIELWKIVDRPNLFIKIPATKAGLPAISAVLA

SEQ ID NO: 1525588 - protein, 20 aa, Mycobacterium tuberculosis
KTLLEQTLALLPAALPLLAA

SEQ ID NO: 1525589 - protein, 21 aa, Mycobacterium tuberculosis
KTLLEQTLALLPAALPLLAAP

SEQ ID NO: 1525590 - protein, 17 aa, Mycobacterium tuberculosis
KTLPVTWTVAHGGLAGR

SEQ ID NO: 1525591 - protein, 19 aa, Mycobacterium tuberculosis
KTLQPWRPGKPNYNALWRP

SEQ ID NO: 1525592 - protein, 26 aa, Mycobacterium tuberculosis
KTPSRSIGWWLRIVANPGMSTTVKTR

SEQ ID NO: 1525593 - protein, 23 aa, Mycobacterium tuberculosis
KTPVGAMALLAEALLASADDSET

SEQ ID NO: 1525594 - protein, 21 aa, Mycobacterium tuberculosis
KTQTVLPFTGLNDPDGVAVDN

SEQ ID NO: 1525595 - protein, 26 aa, Mycobacterium tuberculosis
KTTFGRIGVKVWIYKGDIVGGKRELA

SEQ ID NO: 1525596 - protein, 23 aa, Mycobacterium tuberculosis
KTTTHLFQPLLYQVATGILSEGD

SEQ ID NO: 1525597 - protein, 23 aa, Mycobacterium tuberculosis
KTVHHYLMRFLGGELSDEDLEVA

SEQ ID NO: 1525598 - protein, 17 aa, Mycobacterium tuberculosis
KTWSAWVAPGTSLNIVL

SEQ ID NO: 1525599 - protein, 17 aa, Mycobacterium tuberculosis
KVARGLVMAVRRAVRQQ

SEQ ID NO: 1525600 - protein, 29 aa, Mycobacterium tuberculosis
KVDDPLAMYLFDLCTLPLNLAGHCGMSVP

SEQ ID NO: 1525601 - protein, 30 aa, Mycobacterium tuberculosis
KVDDPLAMYLFDLCTLPLNLAGHCGMSVPS

SEQ ID NO: 1525602 - protein, 24 aa, Mycobacterium tuberculosis
KVESFGVRLRKGDIVLPGSCTFAV

SEQ ID NO: 1525603 - protein, 29 aa, Mycobacterium tuberculosis
KVFGPVRRVLCRLRLLLGPPRGPPRHRTT

SEQ ID NO: 1525604 - protein, 20 aa, Mycobacterium tuberculosis
KVFGSWNLHRATLGQPLDWF

SEQ ID NO: 1525605 - protein, 29 aa, Mycobacterium tuberculosis
KVGNVDALFLFDVLLHQVSPDWDTILDMY

SEQ ID NO: 1525606 - protein, 21 aa, Mycobacterium tuberculosis
KVHLYGGYHVLRAAWPHFREQ

SEQ ID NO: 1525607 - protein, 20 aa, Mycobacterium tuberculosis
KVIPDLITWWCERDGVHPDK

SEQ ID NO: 1525608 - protein, 19 aa, Mycobacterium tuberculosis
KVLDVLLDLTRQAGKTLIM

SEQ ID NO: 1525609 - protein, 19 aa, Mycobacterium tuberculosis
KVLNRADIPYLLIRNHKNR

SEQ ID NO: 1525610 - protein, 17 aa, Mycobacterium tuberculosis
KVLPASADEVSVAVAAL

SEQ ID NO: 1525611 - protein, 21 aa, Mycobacterium tuberculosis
KVNRLLVRNISVVGVGWGEYL

SEQ ID NO: 1525612 - protein, 26 aa, Mycobacterium tuberculosis
KVPIYPGYVCAIVASLLLDKPVKWME

SEQ ID NO: 1525613 - protein, 23 aa, Mycobacterium tuberculosis
KVPSWISDIANIFNIGAGNWASA

SEQ ID NO: 1525614 - protein, 24 aa, Mycobacterium tuberculosis
KVPSYWPLGFRRLRWTMRAGRGER

SEQ ID NO: 1525615 - protein, 23 aa, Mycobacterium tuberculosis
KVPVHAPGEHPMFKAMAAGLSSL

SEQ ID NO: 1525616 - protein, 30 aa, Mycobacterium tuberculosis
KVRAPADLLSGYYHAVHKLTLEYIAGMTAD

SEQ ID NO: 1525617 - protein, 17 aa, Mycobacterium tuberculosis
KVRGDKLAYRFLDFSTE

SEQ ID NO: 1525618 - protein, 20 aa, Mycobacterium tuberculosis
KVSRILLTSGKLYYELAARK

SEQ ID NO: 1525619 - protein, 21 aa, Mycobacterium tuberculosis
KVTGIFLVPAQWQAVCTEQQA

SEQ ID NO: 1525620 - protein, 25 aa, Mycobacterium tuberculosis
KVTKRGCGAALPFKRRLFGQIVAAA

SEQ ID NO: 1525621 - protein, 25 aa, Mycobacterium tuberculosis
KVTKRGGGAALPFKRRLFGQIVAAA

SEQ ID NO: 1525622 - protein, 26 aa, Mycobacterium tuberculosis
KVTTLPLGVPTFRMLRALRGFDPDVV

SEQ ID NO: 1525623 - protein, 27 aa, Mycobacterium tuberculosis
KVVSQRGWRHWVHALTRINLGLSPDEK

SEQ ID NO: 1525624 - protein, 18 aa, Mycobacterium tuberculosis
KWELEDLSFAILHPKKYE

SEQ ID NO: 1525625 - protein, 21 aa, Mycobacterium tuberculosis
KWPCFYGIDFPSPAELIANAV

SEQ ID NO: 1525626 - protein, 20 aa, Mycobacterium tuberculosis
KWRLAEVLAWQAYVGFAGEG

SEQ ID NO: 1525627 - protein, 22 aa, Mycobacterium tuberculosis
KYPGTQWRFEYSPESYTGTELE

SEQ ID NO: 1525628 - protein, 27 aa, Mycobacterium tuberculosis
KYPWMRGDGLGSQRRKFGFYDDDRESA

SEQ ID NO: 1525629 - protein, 17 aa, Mycobacterium tuberculosis
KYQALVRQGMYGDFFAF

SEQ ID NO: 1525630 - protein, 17 aa, Mycobacterium tuberculosis
KYRDTVRDYWRGEPATL

SEQ ID NO: 1525631 - protein, 17 aa, Mycobacterium tuberculosis
KYRGEFEERLKAVLDDI

SEQ ID NO: 1525632 - protein, 20 aa, Mycobacterium tuberculosis
LAAAALARSVGVPAGAIADA

SEQ ID NO: 1525633 - protein, 19 aa, Mycobacterium tuberculosis
LAAAVRILSALPVARAASE

SEQ ID NO: 1525634 - protein, 18 aa, Mycobacterium tuberculosis
LAADLLFLALRDALTEKL

SEQ ID NO: 1525635 - protein, 18 aa, Mycobacterium tuberculosis
LAAFVSPIPVRLADGTQL

SEQ ID NO: 1525636 - protein, 27 aa, Mycobacterium tuberculosis
LAAGLDARAYRLPWPAGTVVYEIDQPQ

SEQ ID NO: 1525637 - protein, 38 aa, Mycobacterium tuberculosis
LAAGLDTLLRLLHPVIPFLTEALWLALTGRESLVSANW

SEQ ID NO: 1525638 - protein, 20 aa, Mycobacterium tuberculosis
LAAGYAANLVVLDRDLRVTA

SEQ ID NO: 1525639 - protein, 17 aa, Mycobacterium tuberculosis
LAALARLFAVASNPTHR

SEQ ID NO: 1525640 - protein, 17 aa, Mycobacterium tuberculosis
LAALLPELARYPSTDDV

SEQ ID NO: 1525641 - protein, 18 aa, Mycobacterium tuberculosis
LAALRISISRWQLDLSAL

SEQ ID NO: 1525642 - protein, 20 aa, Mycobacterium tuberculosis
LAAQGWGGRWLVVGSDVDPG

SEQ ID NO: 1525643 - protein, 31 aa, Mycobacterium tuberculosis; identical to SEQ ID NO: 1392504

SEQ ID NO: 1525644 - protein, 20 aa, Mycobacterium tuberculosis
LAARPVGVPAIVVPPVAAPN

SEQ ID NO: 1525645 - protein, 21 aa, Mycobacterium tuberculosis
LAARPVGVPAIVVPPVAAPNV

SEQ ID NO: 1525646 - protein, 20 aa, Mycobacterium tuberculosis
LAASVAWDGLAAELAVAASS

SEQ ID NO: 1525647 - protein, 24 aa, Mycobacterium tuberculosis
LAATVDPFVIAANRSRLVSLALSN

SEQ ID NO: 1525648 - protein, 17 aa, Mycobacterium tuberculosis
LAAVPLNPQPLGGGSRP

SEQ ID NO: 1525649 - protein, 17 aa, Mycobacterium tuberculosis
LAAVPYLESVVLAAGAL

SEQ ID NO: 1525650 - protein, 18 aa, Mycobacterium tuberculosis
LAAVWEEADRREGLARWL

SEQ ID NO: 1525651 - protein, 18 aa, Mycobacterium tuberculosis
LAAYQLLRVDGGEPVLLL

SEQ ID NO: 1525652 - protein, 18 aa, Mycobacterium tuberculosis
LAAYRALGLHDWTYERIE

SEQ ID NO: 1525653 - protein, 27 aa, Mycobacterium tuberculosis
LACAELLYRAGLPRALYAIVPGPGSVV

SEQ ID NO: 1525654 - protein, 18 aa, Mycobacterium tuberculosis
LACHKVIGAQRGLNQRRE

SEQ ID NO: 1525655 - protein, 17 aa, Mycobacterium tuberculosis
LACLPGEYGPNLAVMAA

SEQ ID NO: 1525656 - protein, 17 aa, Mycobacterium tuberculosis
LADADNPWRLSGRLRPV

SEQ ID NO: 1525657 - protein, 29 aa, Mycobacterium tuberculosis
LADCARLLLQIPAVLGLAFDGGWWVLGIR

SEQ ID NO: 1525658 - protein, 25 aa, Mycobacterium tuberculosis
LADFAHRGWIRLAGKSVLISDSERL

SEQ ID NO: 1525659 - protein, 18 aa, Mycobacterium tuberculosis
LADFDGEPGGDGGDGGDG

SEQ ID NO: 1525660 - protein, 20 aa, Mycobacterium tuberculosis
LADGGILDPLPMAPIAGVNA

SEQ ID NO: 1525661 - protein, 20 aa, Mycobacterium tuberculosis
LADHLRRRWARNTGGLLVVT

SEQ ID NO: 1525662 - protein, 20 aa, Mycobacterium tuberculosis
LADLELGFAAARRFSSDPQS

SEQ ID NO: 1525663 - protein, 24 aa, Mycobacterium tuberculosis
LADPAVVWALRLQGRVPHVVAQSL

SEQ ID NO: 1525664 - protein, 27 aa, Mycobacterium tuberculosis
LADPRRVPVWLPYIRGERTPFHEPDRR

SEQ ID NO: 1525665 - protein, 19 aa, Mycobacterium tuberculosis
LADRGMRLTLRVYAYSSCC

SEQ ID NO: 1525666 - protein, 23 aa, Mycobacterium tuberculosis
LADTGLLAPHWPAPYGRGASPAE

SEQ ID NO: 1525667 - protein, 25 aa, Mycobacterium tuberculosis
LAEAGWPVRVWAAALPQQTTSAVAG

SEQ ID NO: 1525668 - protein, 28 aa, Mycobacterium tuberculosis
LAECAGLHDPYFDFILDRPDASTVRIGA

SEQ ID NO: 1525669 - protein, 20 aa, Mycobacterium tuberculosis
LAEFVGAAAGLLFSSGYTAN

SEQ ID NO: 1525670 - protein, 17 aa, Mycobacterium tuberculosis
LAEGFTAIGTPSFGVSS

SEQ ID NO: 1525671 - protein, 27 aa, Mycobacterium tuberculosis
LAEIRHWLQIFVQRFYSFSQFKRSALP

SEQ ID NO: 1525672 - protein, 21 aa, Mycobacterium tuberculosis
LAELAGLPLFERLAQRIVDGE

SEQ ID NO: 1525673 - protein, 18 aa, Mycobacterium tuberculosis
LAELWRSVGVVPDAVIGH

SEQ ID NO: 1525674 - protein, 25 aa, Mycobacterium tuberculosis
LAEPSGWAYWVAESLLGPGHSLPIS

SEQ ID NO: 1525675 - protein, 26 aa, Mycobacterium tuberculosis
LAERGYGYGPAFRGLTAMWRRGDEVF

SEQ ID NO: 1525676 - protein, 22 aa, Mycobacterium tuberculosis
LAERNGVPVRALWASSGQAPST

SEQ ID NO: 1525677 - protein, 21 aa, Mycobacterium tuberculosis
LAERPALSLSLDEACLLMFAR

SEQ ID NO: 1525678 - protein, 17 aa, Mycobacterium tuberculosis
LAESGWHVVAPFMRGYA

SEQ ID NO: 1525679 - protein, 21 aa, Mycobacterium tuberculosis
LAESIRPLVAPPPAPAPAPAE

SEQ ID NO: 1525680 - protein, 32 aa, Mycobacterium tuberculosis; identical to SEQ ID NO: 237314

SEQ ID NO: 1525681 - protein, 33 aa, Mycobacterium tuberculosis
LAEVGAVHYPWLPLRRLLLDHYPSIERIASVHA

SEQ ID NO: 1525682 - protein, 21 aa, Mycobacterium tuberculosis
LAEWLVRQGVPFRSAHEAAGA

SEQ ID NO: 1525683 - protein, 28 aa, Mycobacterium tuberculosis
LAEYSLDLFALLPLGELWVAAARMRQVD

SEQ ID NO: 1525684 - protein, 17 aa, Mycobacterium tuberculosis
LAFLPMPTSSGIVHLMV

SEQ ID NO: 1525685 - protein, 25 aa, Mycobacterium tuberculosis
LAFVRFRIDGKDWPASPLPSLRMRT

SEQ ID NO: 1525686 - protein, 20 aa, Mycobacterium tuberculosis
LAGGAWQGPASAAMANAAGP

SEQ ID NO: 1525687 - protein, 34 aa, Mycobacterium tuberculosis
LAGGSLEIFLTPQLPAPLIQIYGETPIADALIEL

SEQ ID NO: 1525688 - protein, 25 aa, Mycobacterium tuberculosis
LAGGVYVMLEPRRFASGSALGMLSA

SEQ ID NO: 1525689 - protein, 17 aa, Mycobacterium tuberculosis
LAGGWVDAYARRILGWR

SEQ ID NO: 1525690 - protein, 23 aa, Mycobacterium tuberculosis
LAGIGNVYCNELCFVSGVLPTAP

SEQ ID NO: 1525691 - protein, 18 aa, Mycobacterium tuberculosis
LAGKPFYVDPASAAMVAA

SEQ ID NO: 1525692 - protein, 21 aa, Mycobacterium tuberculosis
LAGLARYPQPMAPAAAAEHAG

SEQ ID NO: 1525693 - protein, 17 aa, Mycobacterium tuberculosis
LAGLVITPGYDLCYLIG

SEQ ID NO: 1525694 - protein, 20 aa, Mycobacterium tuberculosis
LAGPVIRSARFRGGCCFPSI

SEQ ID NO: 1525695 - protein, 21 aa, Mycobacterium tuberculosis
LAGQAWQGPAALAMAAAAAPY

SEQ ID NO: 1525696 - protein, 24 aa, Mycobacterium tuberculosis
LAGSAHFVWVRDTLRLGGKFPLKA

SEQ ID NO: 1525697 - protein, 34 aa, Mycobacterium tuberculosis
LAGSAHFVWVRDTLRLGGKFPLKAGMLTSLGFGH

SEQ ID NO: 1525698 - protein, 27 aa, Mycobacterium tuberculosis
LAGSDPLLAVPFSYPASLPPFGPVTMT

SEQ ID NO: 1525699 - protein, 18 aa, Mycobacterium tuberculosis
LAGWVARRRDHGGVIFID

SEQ ID NO: 1525700 - protein, 24 aa, Mycobacterium tuberculosis
LAHLRSLLRRGGELRYLERVASAG

SEQ ID NO: 1525701 - protein, 17 aa, Mycobacterium tuberculosis
LAHNEVLIEVRIPLRHN

SEQ ID NO: 1525702 - protein, 24 aa, Mycobacterium tuberculosis
LAIVASRWHGKICDALLDGARKVA

SEQ ID NO: 1525703 - protein, 24 aa, Mycobacterium tuberculosis
LAIVDAFVTTPWSKAQRHQRRIDI

SEQ ID NO: 1525704 - protein, 17 aa, Mycobacterium tuberculosis
LAKLREIDGLLPTLIRG

SEQ ID NO: 1525705 - protein, 28 aa, Mycobacterium tuberculosis
LAKRDSEWMGFVHRFLGLQVGVILATMT

SEQ ID NO: 1525706 - protein, 20 aa, Mycobacterium tuberculosis
LALDNWLSSPYSHWAFQHVE

SEQ ID NO: 1525707 - protein, 17 aa, Mycobacterium tuberculosis
LALELFEAGDWHLTAPL

SEQ ID NO: 1525708 - protein, 26 aa, Mycobacterium tuberculosis
LALFETVYLVHRLPAWSRNLTAKIKK

SEQ ID NO: 1525709 - protein, 18 aa, Mycobacterium tuberculosis
LALGTQGAWTGSQWLMVE

SEQ ID NO: 1525710 - protein, 19 aa, Mycobacterium tuberculosis
LALITIADLIEWRRKHEKH

SEQ ID NO: 1525711 - protein, 34 aa, Mycobacterium tuberculosis
LALRADGITAPVLAWLHPPGIDFGPALLADVQVA

SEQ ID NO: 1525712 - protein, 17 aa, Mycobacterium tuberculosis
LALRDPITRWAPELCKV

SEQ ID NO: 1525713 - protein, 26 aa, Mycobacterium tuberculosis
LALRHPMLRVQFLPDGTQRIPPAAGS

SEQ ID NO: 1525714 - protein, 23 aa, Mycobacterium tuberculosis
LAMDPQQRLLLEVSWEALERAGI

SEQ ID NO: 1525715 - protein, 24 aa, Mycobacterium tuberculosis
LANPRLPWPMLPNPRLPSPTLPRP

SEQ ID NO: 1525716 - protein, 19 aa, Mycobacterium tuberculosis
LANPSLLNNRLWSRLRRRI

SEQ ID NO: 1525717 - protein, 24 aa, Mycobacterium tuberculosis
LANVLNSGLTNTPVAAPASAPVGG

SEQ ID NO: 1525718 - protein, 19 aa, Mycobacterium tuberculosis
LANYFAAATVLPYRQFHDV

SEQ ID NO: 1525719 - protein, 27 aa, Mycobacterium tuberculosis
LAPGGHFPGWIPILASKVVFVGKHPAD

SEQ ID NO: 1525720 - protein, 19 aa, Mycobacterium tuberculosis
LAPGLRGPVLVLGGPGTGK

SEQ ID NO: 1525721 - protein, 17 aa, Mycobacterium tuberculosis
LAPPSPRYAPASWAAPL

SEQ ID NO: 1525722 - protein, 22 aa, Mycobacterium tuberculosis
LAPQHWIALTPPRIPRVRTLQN

SEQ ID NO: 1525723 - protein, 24 aa, Mycobacterium tuberculosis
LAPRHAHLRRSRRGAPALHRPRRA

SEQ ID NO: 1525724 - protein, 27 aa, Mycobacterium tuberculosis
LAPRVVATVPQLVQLAPHAVQMSQNAS

SEQ ID NO: 1525725 - protein, 23 aa, Mycobacterium tuberculosis
LAPVRFFNPIAMRFAQKATREDI

SEQ ID NO: 1525726 - protein, 18 aa, Mycobacterium tuberculosis
LAQAYRINALRTAQRAHA

SEQ ID NO: 1525727 - protein, 18 aa, Mycobacterium tuberculosis
LAQHRHQPGWGGCRTARP

SEQ ID NO: 1525728 - protein, 47 aa, Mycobacterium tuberculosis
LAQRRLQLQVSLPAKRWLAQRGFDPVYGARPLRRLVQQAIGDQLAKM

SEQ ID NO: 1525729 - protein, 17 aa, Mycobacterium tuberculosis
LAQYPSILVELGNMKNP

SEQ ID NO: 1525730 - protein, 17 aa, Mycobacterium tuberculosis
LARGGLPVAWEVAAALH

SEQ ID NO: 1525731 - protein, 31 aa, Mycobacterium tuberculosis
LARHRAPSASLLVIAPPWPTADVPGPMLRIR

SEQ ID NO: 1525732 - protein, 17 aa, Mycobacterium tuberculosis
LARICDPLTGIKEVWEF

SEQ ID NO: 1525733 - protein, 32 aa, Mycobacterium tuberculosis
LARPLVILLHGFGSFWWSWRHQLCGLTGARVV

SEQ ID NO: 1525734 - protein, 19 aa, Mycobacterium tuberculosis
LARPVADTVWPTPFLAHQA

SEQ ID NO: 1525735 - protein, 20 aa, Mycobacterium tuberculosis
LARRMSEISEAPLFIDDSPN

SEQ ID NO: 1525736 - protein, 25 aa, Mycobacterium tuberculosis
LARRRRARGLRLNHPEAIAVIADHI

SEQ ID NO: 1525737 - protein, 19 aa, Mycobacterium tuberculosis
LARVVSMPCLEWFEAQPYE

SEQ ID NO: 1525738 - protein, 22 aa, Mycobacterium tuberculosis
LARYAQRVMDWLHPDGDLTDTE

SEQ ID NO: 1525739 - protein, 17 aa, Mycobacterium tuberculosis
LARYPQPMAPAAAAEHA

SEQ ID NO: 1525740 - protein, 26 aa, Mycobacterium tuberculosis
LASAAPPWVGPLDVLIVAGDDPGDPA

SEQ ID NO: 1525741 - protein, 24 aa, Mycobacterium tuberculosis
LASAMRTLRRLLIKRRGCRQGHRR

SEQ ID NO: 1525742 - protein, 17 aa, Mycobacterium tuberculosis
LASFSRVIRLDHRGVGL

SEQ ID NO: 1525743 - protein, 31 aa, Mycobacterium tuberculosis
LASQGVPLDAWLRRARSRALIPWASVRAAVN

SEQ ID NO: 1525744 - protein, 18 aa, Mycobacterium tuberculosis
LASSQTSRTPWCRSLPLN

SEQ ID NO: 1525745 - protein, 19 aa, Mycobacterium tuberculosis
LASTIRKTPIEHAAGPLGS

SEQ ID NO: 1525746 - protein, 19 aa, Mycobacterium tuberculosis
LASTTYYFSSLDDLIARAV

SEQ ID NO: 1525747 - protein, 24 aa, Mycobacterium tuberculosis
LATDSWLFGGVVPGDTRVLTDAAI

SEQ ID NO: 1525748 - protein, 25 aa, Mycobacterium tuberculosis
LATLVVNAIRKTLKAVAVKGPYFGD

SEQ ID NO: 1525749 - protein, 26 aa, Mycobacterium tuberculosis
LATPSRLMILTQLRNGPLPVTDLAEA

SEQ ID NO: 1525750 - protein, 19 aa, Mycobacterium tuberculosis
LATQIRNLPRHLGIHSGGM

SEQ ID NO: 1525751 - protein, 17 aa, Mycobacterium tuberculosis
LATTRWLVAILENHQRP

SEQ ID NO: 1525752 - protein, 18 aa, Mycobacterium tuberculosis
LATTRWLVAILENHQRPD

SEQ ID NO: 1525753 - protein, 24 aa, Mycobacterium tuberculosis
LATVGSPLLMTYLLVDVSGARLTE

SEQ ID NO: 1525754 - protein, 17 aa, Mycobacterium tuberculosis
LATVITWHRHIAGLIEQ

SEQ ID NO: 1525755 - protein, 27 aa, Mycobacterium tuberculosis
LAVDLAVPMIGMLKRKAERRLIDGALK

SEQ ID NO: 1525756 - protein, 25 aa, Mycobacterium tuberculosis
LAVDPAHPFPFVSGLSLNLAVTVRQ

SEQ ID NO: 1525757 - protein, 27 aa, Mycobacterium tuberculosis
LAVDYLTSMGLRILNRNWRCRYGELDV

SEQ ID NO: 1525758 - protein, 20 aa, Mycobacterium tuberculosis
LAVFITHYVGFPLGSRLNSA

SEQ ID NO: 1525759 - protein, 26 aa, Mycobacterium tuberculosis
LAVHNGYIPRHLNFHQLTPHASEAAS

SEQ ID NO: 1525760 - protein, 20 aa, Mycobacterium tuberculosis
LAVLPLQRMLPAGDGHPVLV

SEQ ID NO: 1525761 - protein, 26 aa, Mycobacterium tuberculosis
LAVLRRLEWHFTLVFANADDPGTLVA

SEQ ID NO: 1525762 - protein, 17 aa, Mycobacterium tuberculosis
LAVLVVCASRWPSRSGW

SEQ ID NO: 1525763 - protein, 18 aa, Mycobacterium tuberculosis
LAVPGIRAALREATAPIV

SEQ ID NO: 1525764 - protein, 20 aa, Mycobacterium tuberculosis
LAVQPMSPIFLYARGRHDLD

SEQ ID NO: 1525765 - protein, 28 aa, Mycobacterium tuberculosis
LAVRIEAMPWQWVGQELPQFSSAPTNHA

SEQ ID NO: 1525766 - protein, 18 aa, Mycobacterium tuberculosis
LAVRLDVSRLVVVGTGRS

SEQ ID NO: 1525767 - protein, 17 aa, Mycobacterium tuberculosis
LAVYAHCARHAPTDPVH

SEQ ID NO: 1525768 - protein, 17 aa, Mycobacterium tuberculosis
LAWAFDLLLHHPDALRR

SEQ ID NO: 1525769 - protein, 20 aa, Mycobacterium tuberculosis
LAWELSWKDTAAPLWTFPRV

SEQ ID NO: 1525770 - protein, 24 aa, Mycobacterium tuberculosis
LAWTRTAFALLVNGVLLTLKDTQG

SEQ ID NO: 1525771 - protein, 17 aa, Mycobacterium tuberculosis
LAWYAMIGSINNINSMG

SEQ ID NO: 1525772 - protein, 21 aa, Mycobacterium tuberculosis
LAYLPRLPVDVVKLGGKFIEC

SEQ ID NO: 1525773 - protein, 17 aa, Mycobacterium tuberculosis
LCADPRPLGYDDSTEFC

SEQ ID NO: 1525774 - protein, 17 aa, Mycobacterium tuberculosis
LCAFGTALHPRFGPDSS

SEQ ID NO: 1525775 - protein, 34 aa, Mycobacterium tuberculosis; identical to SEQ ID NO: 236586

SEQ ID NO: 1525776 - protein, 21 aa, Mycobacterium tuberculosis
LCCALANRLRITKPDAARRIA

SEQ ID NO: 1525777 - protein, 19 aa, Mycobacterium tuberculosis
LCDTVLMTGFGFTPPVATP

SEQ ID NO: 1525778 - protein, 25 aa, Mycobacterium tuberculosis
LCDTVLMTGFGFTPPVATPTWGVLE

SEQ ID NO: 1525779 - protein, 19 aa, Mycobacterium tuberculosis
LCEAGLLPGALTCNVGLHF

SEQ ID NO: 1525780 - protein, 26 aa, Mycobacterium tuberculosis
LCHDRRMFRLLFVSPRIAPNTGNAIR

SEQ ID NO: 1525781 - protein, 24 aa, Mycobacterium tuberculosis
LCHGNPTWSFLYRDIIVALRDRFR

SEQ ID NO: 1525782 - protein, 17 aa, Mycobacterium tuberculosis
LCLDFDAGYWRAGGRIK

SEQ ID NO: 1525783 - protein, 18 aa, Mycobacterium tuberculosis
LCLESDGSAMYTISGLWS

SEQ ID NO: 1525784 - protein, 20 aa, Mycobacterium tuberculosis
LCLTFNGLSKAYRVAGYRAG

SEQ ID NO: 1525785 - protein, 20 aa, Mycobacterium tuberculosis
LCNSAGFGTSGRFWSCRSHA

SEQ ID NO: 1525786 - protein, 19 aa, Mycobacterium tuberculosis
LCPAPCEPACVLGINQDPV

SEQ ID NO: 1525787 - protein, 18 aa, Mycobacterium tuberculosis
LCPNYVFPYEPHFNIPTF

SEQ ID NO: 1525788 - protein, 26 aa, Mycobacterium tuberculosis
LCPQNLDYLISFFGALYSGRIAVPLF

SEQ ID NO: 1525789 - protein, 19 aa, Mycobacterium tuberculosis
LCRTGPPQSTSWAQRWLAG

SEQ ID NO: 1525790 - protein, 24 aa, Mycobacterium tuberculosis
LCSTKRWWSKPTNSSLWPASNGHA

SEQ ID NO: 1525791 - protein, 24 aa, Mycobacterium tuberculosis
LDAGRINHAYLFSGPRGCGKTSSA

SEQ ID NO: 1525792 - protein, 24 aa, Mycobacterium tuberculosis
LDALSGRYRWPGGLVLEPVSTVSG

SEQ ID NO: 1525793 - protein, 28 aa, Mycobacterium tuberculosis
LDAMGHPRWWFDLLTTEPLAFSSLDRWP

SEQ ID NO: 1525794 - protein, 23 aa, Mycobacterium tuberculosis
LDARVLLRRLVVADPTAYGYLVD

SEQ ID NO: 1525795 - protein, 30 aa, Mycobacterium tuberculosis
LDAVNAPTQTLLGRPLIGNGADGVAGTGSN

SEQ ID NO: 1525796 - protein, 26 aa, Mycobacterium tuberculosis
LDDDDFAKHPFLVKGYIGPKALRENN

SEQ ID NO: 1525797 - protein, 27 aa, Mycobacterium tuberculosis
LDDDDFAKHPFLVKGYIGPKALRENNV

SEQ ID NO: 1525798 - protein, 19 aa, Mycobacterium tuberculosis
LDDGVFPRLSHPDGDDVLA

SEQ ID NO: 1525799 - protein, 19 aa, Mycobacterium tuberculosis
LDDIPNALWDLKTQIFEGD

SEQ ID NO: 1525800 - protein, 23 aa, Mycobacterium tuberculosis
LDDKFLHDMLAEELRYSVIREVL

SEQ ID NO: 1525801 - protein, 24 aa, Mycobacterium tuberculosis
LDDLAERPALSLSLDEACLLMFAR

SEQ ID NO: 1525802 - protein, 26 aa, Mycobacterium tuberculosis
LDDVARVYIIYRQRRAELRTAKALLG

SEQ ID NO: 1525803 - protein, 26 aa, Mycobacterium tuberculosis
LDEDTEVRIVSYPGSSLWDMVRPRPS

SEQ ID NO: 1525804 - protein, 22 aa, Mycobacterium tuberculosis
LDELLAPLAEPRYLIGRKMLTP

SEQ ID NO: 1525805 - protein, 29 aa, Mycobacterium tuberculosis
LDELRRLIPPWVTLGSRLAALPKPKRDYG

SEQ ID NO: 1525806 - protein, 28 aa, Mycobacterium tuberculosis
LDELRRLIPPWVTLGSRLAALPRPKRDY

SEQ ID NO: 1525807 - protein, 23 aa, Mycobacterium tuberculosis
LDEQGHSRWRRSTCGRTARTVRR

SEQ ID NO: 1525808 - protein, 17 aa, Mycobacterium tuberculosis
LDFPVMTDMRDPLTTAF

SEQ ID NO: 1525809 - protein, 20 aa, Mycobacterium tuberculosis
LDFRPKHKLAVLVVCAIPLA

SEQ ID NO: 1525810 - protein, 18 aa, Mycobacterium tuberculosis
LDFRPKHRLAVLVVCAIP

SEQ ID NO: 1525811 - protein, 21 aa, Mycobacterium tuberculosis
LDGGFGPVVLPPIPVPAVNAH

SEQ ID NO: 1525812 - protein, 24 aa, Mycobacterium tuberculosis
LDGGFGPVVLPPIPVPAVNAHLTG

SEQ ID NO: 1525813 - protein, 23 aa, Mycobacterium tuberculosis
LDGRFRVPFVMRAEEKLLSYNRN

SEQ ID NO: 1525814 - protein, 20 aa, Mycobacterium tuberculosis
LDHGQPRINRYHHPEKILCE

SEQ ID NO: 1525815 - protein, 18 aa, Mycobacterium tuberculosis
LDHLAARLRRNSANLLVL

SEQ ID NO: 1525816 - protein, 22 aa, Mycobacterium tuberculosis
LDHLHASPYVLVSILITPDLHQ

SEQ ID NO: 1525817 - protein, 25 aa, Mycobacterium tuberculosis
LDHVLGKLPDAYRIIGRAGGIYGDF

SEQ ID NO: 1525818 - protein, 27 aa, Mycobacterium tuberculosis
LDILHREEAMARYWRAVAARDYSIANV

SEQ ID NO: 1525819 - protein, 20 aa, Mycobacterium tuberculosis
LDILVDRMRREFKVEANVGK

SEQ ID NO: 1525820 - protein, 21 aa, Mycobacterium tuberculosis
LDIPRVPVTLNYLFGSQPGGP

SEQ ID NO: 1525821 - protein, 25 aa, Mycobacterium tuberculosis
LDKVPALNPHQIDDLMMGCGLPGGE

SEQ ID NO: 1525822 - protein, 26 aa, Mycobacterium tuberculosis
LDLGLRNYWGYNTFGFFAPHHQYAST

SEQ ID NO: 1525823 - protein, 17 aa, Mycobacterium tuberculosis
LDLLLSEKILVTQGTGF

SEQ ID NO: 1525824 - protein, 22 aa, Mycobacterium tuberculosis
LDLRNRLKRSIGATVSLATLMG

SEQ ID NO: 1525825 - protein, 23 aa, Mycobacterium tuberculosis
LDNVFATPLLQQGFPLGVDVVVY

SEQ ID NO: 1525826 - protein, 31 aa, Mycobacterium tuberculosis
LDPARPPHVGVLLQNTPFFSATLVAGALSGI

SEQ ID NO: 1525827 - protein, 21 aa, Mycobacterium tuberculosis
LDPGALRRLDRVRVVVIDGAA

SEQ ID NO: 1525828 - protein, 18 aa, Mycobacterium tuberculosis
LDPIYKRKVLELAAALSD

SEQ ID NO: 1525829 - protein, 22 aa, Mycobacterium tuberculosis
LDPNRPFFEFLTDLLDGWVAYF

SEQ ID NO: 1525830 - protein, 24 aa, Mycobacterium tuberculosis
LDPRLLIEFCLLATQYDAIAATIT

SEQ ID NO: 1525831 - protein, 18 aa, Mycobacterium tuberculosis
LDPVGLRQTWLDLHESWL

SEQ ID NO: 1525832 - protein, 23 aa, Mycobacterium tuberculosis
LDQIGVPRPYWRSKPISVVELHL

SEQ ID NO: 1525833 - protein, 41 aa, Mycobacterium tuberculosis
LDQLTIAARTKGISIRRAPGPSWYHFTLNGAPGSILADKAL

SEQ ID NO: 1525834 - protein, 24 aa, Mycobacterium tuberculosis
LDRDRPLWEMWVIEGGARSDTVAV

SEQ ID NO: 1525835 - protein, 29 aa, Mycobacterium tuberculosis
LDRGVWLRPFRNLVYAMPPYICTPAEITQ

SEQ ID NO: 1525836 - protein, 18 aa, Mycobacterium tuberculosis
LDRLAGELSVWSRAAVQI

SEQ ID NO: 1525837 - protein, 24 aa, Mycobacterium tuberculosis
LDRLYVVALPMRVRFRGITTREVA

SEQ ID NO: 1525838 - protein, 43 aa, Mycobacterium tuberculosis
LDRPAATHRPGWLEFPTPALDPPLRLRACLRRRRLAARRHPGA

SEQ ID NO: 1525839 - protein, 25 aa, Mycobacterium tuberculosis
LDRPAYVYPIFEQALRIAYGESIEN

SEQ ID NO: 1525840 - protein, 18 aa, Mycobacterium tuberculosis
LDRRLRTGPTPWSGSETL

SEQ ID NO: 1525841 - protein, 22 aa, Mycobacterium tuberculosis
LDRRLRTGPTPWSGSETLPGGT

SEQ ID NO: 1525842 - protein, 27 aa, Mycobacterium tuberculosis
LDRRPRANWGRRPFSCGPLSGTSRVGL

SEQ ID NO: 1525843 - protein, 22 aa, Mycobacterium tuberculosis
LDRSRHTIIYLPDPTVGVQGIH

SEQ ID NO: 1525844 - protein, 37 aa, Mycobacterium tuberculosis
LDRTAQRIVLTRNPRWWGARPRLDSITYLVLDDAARL

SEQ ID NO: 1525845 - protein, 24 aa, Mycobacterium tuberculosis
LDRYEMRVWGWGPGEESWLIDRQI

SEQ ID NO: 1525846 - protein, 21 aa, Mycobacterium tuberculosis
LDSFLHYRMIDVSSIKELCRR

SEQ ID NO: 1525847 - protein, 19 aa, Mycobacterium tuberculosis
LDSFRHLAKERALMAGLAS

SEQ ID NO: 1525848 - protein, 18 aa, Mycobacterium tuberculosis
LDSGLFAVALPFVDLIDY

SEQ ID NO: 1525849 - protein, 26 aa, Mycobacterium tuberculosis
LDSNVYLRDLVLALRWVHDNIAEFGG

SEQ ID NO: 1525850 - protein, 24 aa, Mycobacterium tuberculosis
LDSPELIRLAPRPAARTDPMLLAW

SEQ ID NO: 1525851 - protein, 25 aa, Mycobacterium tuberculosis
LDSVITTHGLSWGFDRIFAASANHS

SEQ ID NO: 1525852 - protein, 18 aa, Mycobacterium tuberculosis
LDSVLAKEVPRQTAGPAF

SEQ ID NO: 1525853 - protein, 18 aa, Mycobacterium tuberculosis
LDVAASAELLLLAVTDSE

SEQ ID NO: 1525854 - protein, 29 aa, Mycobacterium tuberculosis
LDVINAPAQTLLGRPLIGNGADGSTPGQA

SEQ ID NO: 1525855 - protein, 19 aa, Mycobacterium tuberculosis
LDVLARDRVLSARGLDVLL

SEQ ID NO: 1525856 - protein, 25 aa, Mycobacterium tuberculosis
LDVLNGPFQALFGRPLIGDGANGAP

SEQ ID NO: 1525857 - protein, 26 aa, Mycobacterium tuberculosis
LDVLNGPFQALFGRPLIGDGANGAPG

SEQ ID NO: 1525858 - protein, 25 aa, Mycobacterium tuberculosis
LDVTIVRPFNIFGVRQKAGRFGALI

SEQ ID NO: 1525859 - protein, 17 aa, Mycobacterium tuberculosis
LDVVRLGPALWGDLAKR

SEQ ID NO: 1525860 - protein, 18 aa, Mycobacterium tuberculosis
LDVVRLGPALWGDLAKRS

SEQ ID NO: 1525861 - protein, 24 aa, Mycobacterium tuberculosis
LDWDDELLSLFSIPRAMLPEIASS

SEQ ID NO: 1525862 - protein, 17 aa, Mycobacterium tuberculosis
LDWKSVCGHGWSAAAEA

SEQ ID NO: 1525863 - protein, 17 aa, Mycobacterium tuberculosis
LDWLSKHSRQILRTARV

SEQ ID NO: 1525864 - protein, 18 aa, Mycobacterium tuberculosis
LDWRAVVGEAQFVELPTY

SEQ ID NO: 1525865 - protein, 33 aa, Mycobacterium tuberculosis
LDYSALYPAGRLVDAPLPAWTHARLFIDDDGQE

SEQ ID NO: 1525866 - protein, 18 aa, Mycobacterium tuberculosis
LEAMRRYLQQRRAMEPWE

SEQ ID NO: 1525867 - protein, 28 aa, Mycobacterium tuberculosis
LEAQVPIIPMIVWGAHRIWPKDHPKNLF

SEQ ID NO: 1525868 - protein, 27 aa, Mycobacterium tuberculosis
LEDIIRFQAEFLWRDYFQPGVSIDGEE

SEQ ID NO: 1525869 - protein, 21 aa, Mycobacterium tuberculosis
LEDLLQQKSPPPPDVPTLVVP

SEQ ID NO: 1525870 - protein, 19 aa, Mycobacterium tuberculosis
LEEEMRLHPAFLGRQRAAE

SEQ ID NO: 1525871 - protein, 20 aa, Mycobacterium tuberculosis
LEEEMRLHPAFLGRQRAAER

SEQ ID NO: 1525872 - protein, 31 aa, Mycobacterium tuberculosis
LEERDIRFVRLWFTDVLGFLKSVAIAPAELE

SEQ ID NO: 1525873 - protein, 32 aa, Mycobacterium tuberculosis
LEERDIRFVRLWFTDVLGFLKSVAIAPAELEG

SEQ ID NO: 1525874 - protein, 19 aa, Mycobacterium tuberculosis
LEFDAWARREPELKALLDR

SEQ ID NO: 1525875 - protein, 17 aa, Mycobacterium tuberculosis
LEFDAWARREPERKALL

SEQ ID NO: 1525876 - protein, 17 aa, Mycobacterium tuberculosis
LEGFYESVRRRAGEVTS

SEQ ID NO: 1525877 - protein, 31 aa, Mycobacterium tuberculosis
LEGVLDVINAPALALLGRPLIGNGANGAPGT

SEQ ID NO: 1525878 - protein, 17 aa, Mycobacterium tuberculosis
LEHNVLNVLNAPTQALL

SEQ ID NO: 1525879 - protein, 25 aa, Mycobacterium tuberculosis
LEHRAFVGLLQFRCGRQLGLRQQRL

SEQ ID NO: 1525880 - protein, 17 aa, Mycobacterium tuberculosis
LEHVGAIRPDQLRRAAE

SEQ ID NO: 1525881 - protein, 17 aa, Mycobacterium tuberculosis
LEILAQLLVLATGTRIT

SEQ ID NO: 1525882 - protein, 19 aa, Mycobacterium tuberculosis
LEILRSGPLALVEDLGRAG

SEQ ID NO: 1525883 - protein, 20 aa, Mycobacterium tuberculosis
LEIPAIPINAQLFSMPIHQV

SEQ ID NO: 1525884 - protein, 37 aa, Mycobacterium tuberculosis
LELAAKLHAVYPALGRTPLVVWPAGPGTRRQPGIGGQ

SEQ ID NO: 1525885 - protein, 18 aa, Mycobacterium tuberculosis
LELALYCDILIASEHARF

SEQ ID NO: 1525886 - protein, 17 aa, Mycobacterium tuberculosis
LELCRVDLLALASDAAH

SEQ ID NO: 1525887 - protein, 31 aa, Mycobacterium tuberculosis
LENTATPMYVGLLLILRRPRAGLSYEALLET

SEQ ID NO: 1525888 - protein, 19 aa, Mycobacterium tuberculosis
LEPGQWWALVRVGCAGQLV

SEQ ID NO: 1525889 - protein, 18 aa, Mycobacterium tuberculosis
LEPIPGQAGIIVPADDYL

SEQ ID NO: 1525890 - protein, 18 aa, Mycobacterium tuberculosis
LEPRPEPEPDFRPDPRPS

SEQ ID NO: 1525891 - protein, 18 aa, Mycobacterium tuberculosis
LEPRPEPEPDFRPEPRPS

SEQ ID NO: 1525892 - protein, 37 aa, Mycobacterium tuberculosis
LEQINFGFTIDIAGIPLLAGAISKAVLPPITGTGPAI

SEQ ID NO: 1525893 - protein, 17 aa, Mycobacterium tuberculosis
LEQLEFGLVREALYERE

SEQ ID NO: 1525894 - protein, 32 aa, Mycobacterium tuberculosis
LEQNLLAVINAPAQALFGRPLIGNGANGTAAS

SEQ ID NO: 1525895 - protein, 18 aa, Mycobacterium tuberculosis
LERLVFVEPPDAAARREI

SEQ ID NO: 1525896 - protein, 35 aa, Mycobacterium tuberculosis
LERSLVHLGLKHYFLVDFPQEPGALRRFLDDVLGP

SEQ ID NO: 1525897 - protein, 17 aa, Mycobacterium tuberculosis
LERTFPLALSALIQEAI

SEQ ID NO: 1525898 - protein, 19 aa, Mycobacterium tuberculosis
LESMTFPDPVIEVAIEPKT

SEQ ID NO: 1525899 - protein, 17 aa, Mycobacterium tuberculosis
LETIKSALLTAYRHTQG

SEQ ID NO: 1525900 - protein, 23 aa, Mycobacterium tuberculosis
LETPEVLVYAVVARSDRATTSPA

SEQ ID NO: 1525901 - protein, 37 aa, Mycobacterium tuberculosis; identical to SEQ ID NO: 215333

SEQ ID NO: 1525902 - protein, 18 aa, Mycobacterium tuberculosis
LEWAEIHGGLHRSGTLAQ

SEQ ID NO: 1525903 - protein, 19 aa, Mycobacterium tuberculosis
LFALTERDLLRTDLFRTKA

SEQ ID NO: 1525904 - protein, 25 aa, Mycobacterium tuberculosis
LFANHKKWIDLIIHIGQEGRGANVF

SEQ ID NO: 1525905 - protein, 21 aa, Mycobacterium tuberculosis
LFANHKKWIGLIIHIGQEGRG

SEQ ID NO: 1525906 - protein, 22 aa, Mycobacterium tuberculosis
LFARLRALSRRGPIPRPPTLEA

SEQ ID NO: 1525907 - protein, 25 aa, Mycobacterium tuberculosis
LFASDWALQRFAGLSNLPATPQRLG

SEQ ID NO: 1525908 - protein, 28 aa, Mycobacterium tuberculosis
LFCARDPFGIKPLFIATGAGGTAVASEK

SEQ ID NO: 1525909 - protein, 17 aa, Mycobacterium tuberculosis
LFDAMFLVATVEAVGDV

SEQ ID NO: 1525910 - protein, 20 aa, Mycobacterium tuberculosis
LFDARFQKLGLHPGGGATWM

SEQ ID NO: 1525911 - protein, 26 aa, Mycobacterium tuberculosis
LFEAGDWHLTAPLTLFGHCMGAIVAF

SEQ ID NO: 1525912 - protein, 17 aa, Mycobacterium tuberculosis
LFEEGISTSRMGLDPDR

SEQ ID NO: 1525913 - protein, 20 aa, Mycobacterium tuberculosis
LFFGARYACELYDLPTLWQI

SEQ ID NO: 1525914 - protein, 32 aa, Mycobacterium tuberculosis
LFFGARYACELYDLPTLWQIAAHNPWLSVSPV

SEQ ID NO: 1525915 - protein, 18 aa, Mycobacterium tuberculosis
LFGARVDQLPLIWQRLVD

SEQ ID NO: 1525916 - protein, 21 aa, Mycobacterium tuberculosis
LFGHWWYEGPTWLQRVLRALP

SEQ ID NO: 1525917 - protein, 21 aa, Mycobacterium tuberculosis
LFGRANVVFTLLVVPTSELLA

SEQ ID NO: 1525918 - protein, 25 aa, Mycobacterium tuberculosis
LFKYNPEYTCFLQGAKWYLDNGGYA

SEQ ID NO: 1525919 - protein, 19 aa, Mycobacterium tuberculosis
LFLGSSCIYPKLAPQPIPE

SEQ ID NO: 1525920 - protein, 26 aa, Mycobacterium tuberculosis
LFLPSNTIAPFLGLLGGVAAADAAGD

SEQ ID NO: 1525921 - protein, 19 aa, Mycobacterium tuberculosis
LFNIGTFNTGIANPGHYNT

SEQ ID NO: 1525922 - protein, 30 aa, Mycobacterium tuberculosis
LFQDAEAEPAAWLRFWFPDPNGSNTEFQRA

SEQ ID NO: 1525923 - protein, 24 aa, Mycobacterium tuberculosis
LFQRRHLLLSGWIKMQEGQLPSAS

SEQ ID NO: 1525924 - protein, 18 aa, Mycobacterium tuberculosis
LFQSHMWDGSAVPVDENL

SEQ ID NO: 1525925 - protein, 19 aa, Mycobacterium tuberculosis
LFSQHAQGCSLAWDDYSIG

SEQ ID NO: 1525926 - protein, 22 aa, Mycobacterium tuberculosis
LFTTPWVCHISPLVLATALLHR

SEQ ID NO: 1525927 - protein, 20 aa, Mycobacterium tuberculosis
LFVMDHFYQLPMLGTPDQPM

SEQ ID NO: 1525928 - protein, 31 aa, Mycobacterium tuberculosis
LFVNPVEAFQFYFELLLFDYPTHIVQIVEAL

SEQ ID NO: 1525929 - protein, 17 aa, Mycobacterium tuberculosis
LFVPEVTTPWPTNGRQV

SEQ ID NO: 1525930 - protein, 17 aa, Mycobacterium tuberculosis
LFVPQAVTPWPNGNDHT

SEQ ID NO: 1525931 - protein, 18 aa, Mycobacterium tuberculosis
LFVSLVVSNLLGQNAPAI

SEQ ID NO: 1525932 - protein, 19 aa, Mycobacterium tuberculosis
LFVWPRFRRRGLARGLLST

SEQ ID NO: 1525933 - protein, 18 aa, Mycobacterium tuberculosis
LGAAIRYAAVDKDAVIVA

SEQ ID NO: 1525934 - protein, 28 aa, Mycobacterium tuberculosis
LGAARRRAFRVWLDARRNALVVLAPGYE

SEQ ID NO: 1525935 - protein, 20 aa, Mycobacterium tuberculosis
LGAAVELRLPRAVRPAARGH

SEQ ID NO: 1525936 - protein, 28 aa, Mycobacterium tuberculosis
LGAINAPTMALLRRPQIGHGADEAPGTG

SEQ ID NO: 1525937 - protein, 19 aa, Mycobacterium tuberculosis
LGALPMLHAAFERAGRDPA

SEQ ID NO: 1525938 - protein, 23 aa, Mycobacterium tuberculosis
LGAPLIAVGLYYRSGYFRQSLTA

SEQ ID NO: 1525939 - protein, 21 aa, Mycobacterium tuberculosis
LGARGLFACRQSLRPRYLCML

SEQ ID NO: 1525940 - protein, 38 aa, Mycobacterium tuberculosis
LGARGLFACRQSLRPRYLCMLAEILRFHRAALACCVRR

SEQ ID NO: 1525941 - protein, 17 aa, Mycobacterium tuberculosis
LGAVRGSCRRRAIAARH

SEQ ID NO: 1525942 - protein, 17 aa, Mycobacterium tuberculosis
LGAYLDELPADASALDA

SEQ ID NO: 1525943 - protein, 24 aa, Mycobacterium tuberculosis
LGCPGRRRRFPAARATLPSGVGGV

SEQ ID NO: 1525944 - protein, 19 aa, Mycobacterium tuberculosis
LGDPALPHLFFVEGGALAV

SEQ ID NO: 1525945 - protein, 22 aa, Mycobacterium tuberculosis
LGDRRVILHSPYGLRVHGPLAL

SEQ ID NO: 1525946 - protein, 20 aa, Mycobacterium tuberculosis
LGEDYLRLSALGSYGAFFNI

SEQ ID NO: 1525947 - protein, 25 aa, Mycobacterium tuberculosis
LGELPGDLAWQPPLWRALVTTVGAD

SEQ ID NO: 1525948 - protein, 25 aa, Mycobacterium tuberculosis
LGERLNLPAGWSYHTRVLTSELRVD

SEQ ID NO: 1525949 - protein, 19 aa, Mycobacterium tuberculosis
LGETAAELSALGLGRVEHV

SEQ ID NO: 1525950 - protein, 17 aa, Mycobacterium tuberculosis
LGEVPGQVFIGLRTTDV

SEQ ID NO: 1525951 - protein, 24 aa, Mycobacterium tuberculosis
LGFGAVGHPTPQPAALGAAGVVAK

SEQ ID NO: 1525952 - protein, 19 aa, Mycobacterium tuberculosis
LGFGGMSEVHLARDLRLHR

SEQ ID NO: 1525953 - protein, 21 aa, Mycobacterium tuberculosis
LGFRVPCIVISPYSRGPLMVS

SEQ ID NO: 1525954 - protein, 24 aa, Mycobacterium tuberculosis
LGFTQSYSYFTWRTTKWELTEFGN

SEQ ID NO: 1525955 - protein, 22 aa, Mycobacterium tuberculosis
LGFVVADLLAARLGAKFKAHKR

SEQ ID NO: 1525956 - protein, 17 aa, Mycobacterium tuberculosis
LGGFGGNGAAGANGVAV

SEQ ID NO: 1525957 - protein, 32 aa, Mycobacterium tuberculosis
LGGFGGRLGFRLGFRFLFHHVTRQDLAHHHVR

SEQ ID NO: 1525958 - protein, 17 aa, Mycobacterium tuberculosis
LGGGIRLSRGGRPVYHH

SEQ ID NO: 1525959 - protein, 18 aa, Mycobacterium tuberculosis
LGGGIRLSRGGRPVYHHL

SEQ ID NO: 1525960 - protein, 17 aa, Mycobacterium tuberculosis
LGGITPEQVLESPFLLL

SEQ ID NO: 1525961 - protein, 17 aa, Mycobacterium tuberculosis
LGGKFPLKAGMLTSLGF

SEQ ID NO: 1525962 - protein, 20 aa, Mycobacterium tuberculosis
LGGKGGSGGLIGRAGSDGGV

SEQ ID NO: 1525963 - protein, 27 aa, Mycobacterium tuberculosis
LGGKRRRLRDWVWAAPAATAATAGPGR

SEQ ID NO: 1525964 - protein, 19 aa, Mycobacterium tuberculosis
LGGLGGQLIGLDGSNAPVS

SEQ ID NO: 1525965 - protein, 19 aa, Mycobacterium tuberculosis
LGGLGLVVARWLVDRGAGR

SEQ ID NO: 1525966 - protein, 25 aa, Mycobacterium tuberculosis
LGGLSIALLAYQLSLNGNPAPVIDG

SEQ ID NO: 1525967 - protein, 23 aa, Mycobacterium tuberculosis
LGGMHALIWHHGAIIAHAAVIQR

SEQ ID NO: 1525968 - protein, 21 aa, Mycobacterium tuberculosis
LGGNGGWLYGNGGAGGIGGAG

SEQ ID NO: 1525969 - protein, 25 aa, Mycobacterium tuberculosis
LGGQGAALIGLGAGGAGGAGGATVV

SEQ ID NO: 1525970 - protein, 17 aa, Mycobacterium tuberculosis
LGGVNLIKSWLTTDPEA

SEQ ID NO: 1525971 - protein, 17 aa, Mycobacterium tuberculosis
LGGWYFPHTSGGSGPAV

SEQ ID NO: 1525972 - protein, 29 aa, Mycobacterium tuberculosis
LGHNYIGTEHILLGLIREGEGVAAQVLVK

SEQ ID NO: 1525973 - protein, 18 aa, Mycobacterium tuberculosis
LGHPAYADGRLRIGALTA

SEQ ID NO: 1525974 - protein, 18 aa, Mycobacterium tuberculosis
LGIEFPIFAVTHCRDVVV

SEQ ID NO: 1525975 - protein, 24 aa, Mycobacterium tuberculosis
LGIGPPITDGFYYDFDVPEPFTPE

SEQ ID NO: 1525976 - protein, 18 aa, Mycobacterium tuberculosis
LGIRLVIVLVRRWPKVIS

SEQ ID NO: 1525977 - protein, 26 aa, Mycobacterium tuberculosis
LGITLPVALVWAYPTISDLATALCER

SEQ ID NO: 1525978 - protein, 17 aa, Mycobacterium tuberculosis
LGIYASPRQTVISGPPL

SEQ ID NO: 1525979 - protein, 17 aa, Mycobacterium tuberculosis
LGKRVSRRKPTSTTPEE

SEQ ID NO: 1525980 - protein, 25 aa, Mycobacterium tuberculosis
LGLAFDGGWWVLGIRTPTAAECLRA

SEQ ID NO: 1525981 - protein, 18 aa, Mycobacterium tuberculosis
LGLINAPTPTWWSSADGE

SEQ ID NO: 1525982 - protein, 26 aa, Mycobacterium tuberculosis
LGLINAPTQALWGRPLIGNGADGTAA

SEQ ID NO: 1525983 - protein, 20 aa, Mycobacterium tuberculosis
LGLIRAMEKFDYTKGFKFST

SEQ ID NO: 1525984 - protein, 19 aa, Mycobacterium tuberculosis
LGLLARAHCGVLYVDEVNL

SEQ ID NO: 1525985 - protein, 20 aa, Mycobacterium tuberculosis
LGLLELRGFEMPPHLHMAMV

SEQ ID NO: 1525986 - protein, 17 aa, Mycobacterium tuberculosis
LGLLGVTDVALIDDAVD

SEQ ID NO: 1525987 - protein, 32 aa, Mycobacterium tuberculosis
LGLNPPPVPIPWSVLSLFVPGPTLSRADALLA

SEQ ID NO: 1525988 - protein, 18 aa, Mycobacterium tuberculosis
LGLRLGSDTTLLDAALAG

SEQ ID NO: 1525989 - protein, 17 aa, Mycobacterium tuberculosis
LGMPGVGLPVSAAKPGG

SEQ ID NO: 1525990 - protein, 29 aa, Mycobacterium tuberculosis
LGNLRSLPVPFILNQPPPPPGPVPAPGPA

SEQ ID NO: 1525991 - protein, 24 aa, Mycobacterium tuberculosis
LGNPLYLRHLIDGGGLEHVDGRWR

SEQ ID NO: 1525992 - protein, 27 aa, Mycobacterium tuberculosis
LGPATPRAVWWRPPRSATPTHMDCTCS

SEQ ID NO: 1525993 - protein, 17 aa, Mycobacterium tuberculosis
LGPLVPKQTLLWQDPVP

SEQ ID NO: 1525994 - protein, 33 aa, Mycobacterium tuberculosis
LGPVHPGGPTLIDLLMALFGLSTNADLGGANAD

SEQ ID NO: 1525995 - protein, 28 aa, Mycobacterium tuberculosis
LGQEGMGFIYLMQNLPQERIAIAIMAAA

SEQ ID NO: 1525996 - protein, 24 aa, Mycobacterium tuberculosis
LGQPLPLFIKWDDADYGLRAAEHG

SEQ ID NO: 1525997 - protein, 28 aa, Mycobacterium tuberculosis
LGQYGAPPIAIGPLYQPKTLQLCADGDS

SEQ ID NO: 1525998 - protein, 30 aa, Mycobacterium tuberculosis
LGRALVPSPLLGTTLAELALLAAAKPDAQA

SEQ ID NO: 1525999 - protein, 31 aa, Mycobacterium tuberculosis
LGRALVPSPLLGTTLAELALLAAAKPDAQAL

SEQ ID NO: 1526000 - protein, 18 aa, Mycobacterium tuberculosis
LGRDGFNAPASTPLHTLQ

SEQ ID NO: 1526001 - protein, 18 aa, Mycobacterium tuberculosis
LGRIIFMDEFYSLIERHQ

SEQ ID NO: 1526002 - protein, 29 aa, Mycobacterium tuberculosis
LGSAGSLNTSFWNAGMQNAALGSAAGSEA

SEQ ID NO: 1526003 - protein, 24 aa, Mycobacterium tuberculosis
LGSDMGEFYMPYPGTRINQETVSL

SEQ ID NO: 1526004 - protein, 28 aa, Mycobacterium tuberculosis
LGSGKPRLWKPRQRKLWQWEPGQWKHRK

SEQ ID NO: 1526005 - protein, 30 aa, Mycobacterium tuberculosis
LGSGSSWLDKLWALLDPNSNFWNTIASSGL

SEQ ID NO: 1526006 - protein, 17 aa, Mycobacterium tuberculosis
LGSLLTHLDRHLDAPPA

SEQ ID NO: 1526007 - protein, 23 aa, Mycobacterium tuberculosis
LGSSSRLTLRRAPPRLGPAAIGR

SEQ ID NO: 1526008 - protein, 29 aa, Mycobacterium tuberculosis
LGSYAAYYEQWAQPWEIQALLRAHAVAGD

SEQ ID NO: 1526009 - protein, 18 aa, Mycobacterium tuberculosis
LGTLRGLETRLVPQRGYH

SEQ ID NO: 1526010 - protein, 25 aa, Mycobacterium tuberculosis
LGTLRVTRALLPKLIDSGDGLIVTV

SEQ ID NO: 1526011 - protein, 32 aa, Mycobacterium tuberculosis
LGTPRRHLSYKTVWYGSALVVADRWFPSSKTC

SEQ ID NO: 1526012 - protein, 30 aa, Mycobacterium tuberculosis
LGTQAAAFHERFIQALSTAAGAYGSAEAAN

SEQ ID NO: 1526013 - protein, 24 aa, Mycobacterium tuberculosis
LGTSLSQYAFGSSGEGLAGVASVG

SEQ ID NO: 1526014 - protein, 22 aa, Mycobacterium tuberculosis
LGTTTTEPAVCAAAASPTGPAI

SEQ ID NO: 1526015 - protein, 33 aa, Mycobacterium tuberculosis
LGTVEPWVRDYLLLRGLLGTSILWFEQDRDCGP

SEQ ID NO: 1526016 - protein, 32 aa, Mycobacterium tuberculosis
LGVDVFSEALAAPLFWIAANAGLDGSVVVNKV

SEQ ID NO: 1526017 - protein, 23 aa, Mycobacterium tuberculosis
LGVEPPRGVLLYGPPGCGKTFVV

SEQ ID NO: 1526018 - protein, 26 aa, Mycobacterium tuberculosis
LGVLERAATAEALLLAKLAAIPTGRA

SEQ ID NO: 1526019 - protein, 19 aa, Mycobacterium tuberculosis
LGVPILDEDGFRRLLADGP

SEQ ID NO: 1526020 - protein, 18 aa, Mycobacterium tuberculosis
LGVRLHVVQQRLALLLRD

SEQ ID NO: 1526021 - protein, 20 aa, Mycobacterium tuberculosis
LGVVIRGQTPHFDYVCDAVT

SEQ ID NO: 1526022 - protein, 23 aa, Mycobacterium tuberculosis
LGVYGPPLKFDVSLPLSAISGFA

SEQ ID NO: 1526023 - protein, 26 aa, Mycobacterium tuberculosis
LGWALRRAPLPPTGPHWRLLSAVKEL

SEQ ID NO: 1526024 - protein, 30 aa, Mycobacterium tuberculosis
LGYDALVAPLTFVTILAKYVQLDFFRHVDV

SEQ ID NO: 1526025 - protein, 19 aa, Mycobacterium tuberculosis
LGYDTPTGLTCPYTTPLDV

SEQ ID NO: 1526026 - protein, 19 aa, Mycobacterium tuberculosis
LGYGAKPWLIVSNNARNRH

SEQ ID NO: 1526027 - protein, 19 aa, Mycobacterium tuberculosis
LGYGAVWVGGSPPAALSCV

SEQ ID NO: 1526028 - protein, 17 aa, Mycobacterium tuberculosis
LHAFAGQGPTIGSLLAQ

SEQ ID NO: 1526029 - protein, 21 aa, Mycobacterium tuberculosis
LHAGHLVPLLTLRRFQRAGHR

SEQ ID NO: 1526030 - protein, 23 aa, Mycobacterium tuberculosis
LHAPTRLALLTGLAPHQVTDDDV

SEQ ID NO: 1526031 - protein, 20 aa, Mycobacterium tuberculosis
LHARVRRIPRGSYQIAVVGL

SEQ ID NO: 1526032 - protein, 17 aa, Mycobacterium tuberculosis
LHDLEALFAKLAAESTP

SEQ ID NO: 1526033 - protein, 19 aa, Mycobacterium tuberculosis
LHDQALSAAAQAKKAVERN

SEQ ID NO: 1526034 - protein, 38 aa, Mycobacterium tuberculosis; identical to SEQ ID NO: 833599

SEQ ID NO: 1526035 - protein, 29 aa, Mycobacterium tuberculosis
LHFESILIRGLMNYTFWMPNGSPEYRYCL

SEQ ID NO: 1526036 - protein, 18 aa, Mycobacterium tuberculosis
LHFTAATSRFRLGRERAN

SEQ ID NO: 1526037 - protein, 20 aa, Mycobacterium tuberculosis
LHFTALPDKLAAIETNLFVP

SEQ ID NO: 1526038 - protein, 18 aa, Mycobacterium tuberculosis
LHGRWLVLRRGSGVSPGW

SEQ ID NO: 1526039 - protein, 22 aa, Mycobacterium tuberculosis
LHGRYLLPHFLIHDIADVAADL

SEQ ID NO: 1526040 - protein, 23 aa, Mycobacterium tuberculosis
LHGVLMATNFFGINTIPIALNES

SEQ ID NO: 1526041 - protein, 21 aa, Mycobacterium tuberculosis
LHHVLAQYPRVDPALLLNCML

SEQ ID NO: 1526042 - protein, 26 aa, Mycobacterium tuberculosis
LHLAVQSLRLGECDLALVGGVTVMAT

SEQ ID NO: 1526043 - protein, 17 aa, Mycobacterium tuberculosis
LHLDILVDRMRREFKVE

SEQ ID NO: 1526044 - protein, 18 aa, Mycobacterium tuberculosis
LHLFWTDRVTLYERRAGR

SEQ ID NO: 1526045 - protein, 19 aa, Mycobacterium tuberculosis
LHLNVLRCPPDREPALYAK

SEQ ID NO: 1526046 - protein, 20 aa, Mycobacterium tuberculosis
LHLVDFPVTLGIRPNIPQED

SEQ ID NO: 1526047 - protein, 21 aa, Mycobacterium tuberculosis
LHLWLPHPSDELWRALAGFQG

SEQ ID NO: 1526048 - protein, 17 aa, Mycobacterium tuberculosis
LHPGFAASWQRLRTAPA

SEQ ID NO: 1526049 - protein, 22 aa, Mycobacterium tuberculosis
LHPYRVRHLLDRYGSLISDVLA

SEQ ID NO: 1526050 - protein, 20 aa, Mycobacterium tuberculosis
LHQRQVVLADLDGADRIRRQ

SEQ ID NO: 1526051 - protein, 17 aa, Mycobacterium tuberculosis
LHRAGACVRRGGAGRAP

SEQ ID NO: 1526052 - protein, 30 aa, Mycobacterium tuberculosis
LHRATLGQPLDWFCLFSSGAALLGSPGQGA

SEQ ID NO: 1526053 - protein, 18 aa, Mycobacterium tuberculosis
LHRRLLGPLLQGRDPHAA

SEQ ID NO: 1526054 - protein, 23 aa, Mycobacterium tuberculosis
LHRRRHGVRLLGTRIAVGRNGAP

SEQ ID NO: 1526055 - protein, 20 aa, Mycobacterium tuberculosis
LHVDDLASACLYLLEHFDGP

SEQ ID NO: 1526056 - protein, 17 aa, Mycobacterium tuberculosis
LHVTSLRDPYHAYTIDW

SEQ ID NO: 1526057 - protein, 28 aa, Mycobacterium tuberculosis
LHVVQQRLALLLRDDAATPLLGCELHDG

SEQ ID NO: 1526058 - protein, 24 aa, Mycobacterium tuberculosis
LIADFPQVTLGIYNSPRQTVIAGP

SEQ ID NO: 1526059 - protein, 32 aa, Mycobacterium tuberculosis
LIADLMARRLDRGRPLWEVWVIAGLADSKWAI

SEQ ID NO: 1526060 - protein, 23 aa, Mycobacterium tuberculosis
LIAHLPNTLLGLTSPLSSALTAA

SEQ ID NO: 1526061 - protein, 18 aa, Mycobacterium tuberculosis
LIANVVHEALLQRASRKL

SEQ ID NO: 1526062 - protein, 17 aa, Mycobacterium tuberculosis
LIAVASAATRWVWVSDA

SEQ ID NO: 1526063 - protein, 29 aa, Mycobacterium tuberculosis
LIDDMVAACLKWEGGYVWACKNYDGDVQS

SEQ ID NO: 1526064 - protein, 17 aa, Mycobacterium tuberculosis
LIDFRDITVRPVAFDPD

SEQ ID NO: 1526065 - protein, 17 aa, Mycobacterium tuberculosis
LIDQPLMRNVLADLAVE

SEQ ID NO: 1526066 - protein, 25 aa, Mycobacterium tuberculosis
LIDRRGYVLIVRPTTCRRRVTSTSP

SEQ ID NO: 1526067 - protein, 28 aa, Mycobacterium tuberculosis
LIEIPAVSTLLQPLLSTIPLQVFAASVA

SEQ ID NO: 1526068 - protein, 18 aa, Mycobacterium tuberculosis
LIELLASELRRTVDRYGN

SEQ ID NO: 1526069 - protein, 17 aa, Mycobacterium tuberculosis
LIETARLWLSLGHHDRH

SEQ ID NO: 1526070 - protein, 18 aa, Mycobacterium tuberculosis
LIFVPGGAWVHGSRAIQG

SEQ ID NO: 1526071 - protein, 18 aa, Mycobacterium tuberculosis
LIFYFAQGELLPSFVGAC

SEQ ID NO: 1526072 - protein, 19 aa, Mycobacterium tuberculosis
LIGATNTVYFALLARRRMD

SEQ ID NO: 1526073 - protein, 17 aa, Mycobacterium tuberculosis
LIGDGGNGGAGGDSGIG

SEQ ID NO: 1526074 - protein, 24 aa, Mycobacterium tuberculosis
LIGDIPIPIIDVPAVPGFGNTTTA

SEQ ID NO: 1526075 - protein, 21 aa, Mycobacterium tuberculosis
LIGDRIKLLTPQPATPLAVAK

SEQ ID NO: 1526076 - protein, 24 aa, Mycobacterium tuberculosis
LIGDRLPMDKLLAGVAHVVHEMHG

SEQ ID NO: 1526077 - protein, 19 aa, Mycobacterium tuberculosis
LIGEHRFDALLAAAAEYIS

SEQ ID NO: 1526078 - protein, 20 aa, Mycobacterium tuberculosis
LIGLPDPDIAQLVKWGYAAT

SEQ ID NO: 1526079 - protein, 18 aa, Mycobacterium tuberculosis
LIGMGVIPLQFPEGKSAS

SEQ ID NO: 1526080 - protein, 20 aa, Mycobacterium tuberculosis
LIHWDDFFRPLSKPLRALPY

SEQ ID NO: 1526081 - protein, 17 aa, Mycobacterium tuberculosis
LIKAEAIGVNFIDTYFR

SEQ ID NO: 1526082 - protein, 21 aa, Mycobacterium tuberculosis
LIKAILSLRHGVCRRCCISIG

SEQ ID NO: 1526083 - protein, 17 aa, Mycobacterium tuberculosis
LILDHDEHMRPDTTKEG

SEQ ID NO: 1526084 - protein, 20 aa, Mycobacterium tuberculosis
LILFDIYRQAAEGTLAAVHD

SEQ ID NO: 1526085 - protein, 18 aa, Mycobacterium tuberculosis
LINDPFAEPLVRAVGIDL

SEQ ID NO: 1526086 - protein, 20 aa, Mycobacterium tuberculosis
LINMEFVQFHPTGMVWPPSV

SEQ ID NO: 1526087 - protein, 17 aa, Mycobacterium tuberculosis
LINVGIMTLFRIVRLLE

SEQ ID NO: 1526088 - protein, 21 aa, Mycobacterium tuberculosis
LIPNPPPIPVPPPAAQTLIPP

SEQ ID NO: 1526089 - protein, 19 aa, Mycobacterium tuberculosis
LIPTLPLGLALSNGIPPVD

SEQ ID NO: 1526090 - protein, 18 aa, Mycobacterium tuberculosis
LIQPLIQAMSFGLTAAEM

SEQ ID NO: 1526091 - protein, 18 aa, Mycobacterium tuberculosis
LIQRITDRLPAKAPLLEL

SEQ ID NO: 1526092 - protein, 19 aa, Mycobacterium tuberculosis
LIRDPYIETSAYARTLGTD

SEQ ID NO: 1526093 - protein, 19 aa, Mycobacterium tuberculosis
LIRDVGIPGYLRATTGLAE

SEQ ID NO: 1526094 - protein, 24 aa, Mycobacterium tuberculosis
LIRERLTRAWTGLRAMRSYALATM

SEQ ID NO: 1526095 - protein, 23 aa, Mycobacterium tuberculosis
LIREVLRLYHRTGEKLIITFAMP

SEQ ID NO: 1526096 - protein, 17 aa, Mycobacterium tuberculosis
LIRPDLPEIVRTLSAKV

SEQ ID NO: 1526097 - protein, 18 aa, Mycobacterium tuberculosis
LIVDYRLIPKHSLGDGAR

SEQ ID NO: 1526098 - protein, 24 aa, Mycobacterium tuberculosis
LIVSGWRLIGKCLRPLPNKWKGLL

SEQ ID NO: 1526099 - protein, 17 aa, Mycobacterium tuberculosis
LIVSSDLRRAYDTAVKL

SEQ ID NO: 1526100 - protein, 20 aa, Mycobacterium tuberculosis
LIYQEMLANYRVGQANSVLV

SEQ ID NO: 1526101 - protein, 18 aa, Mycobacterium tuberculosis
LKAALVTLSAAMAAPAET

SEQ ID NO: 1526102 - protein, 24 aa, Mycobacterium tuberculosis
LKAALWELIWAGRVTGDTFAPVRA

SEQ ID NO: 1526103 - protein, 18 aa, Mycobacterium tuberculosis
LKAPTVMLAGVVAAGMST

SEQ ID NO: 1526104 - protein, 20 aa, Mycobacterium tuberculosis
LKEPLYRLYELHLRQMLGPP

SEQ ID NO: 1526105 - protein, 30 aa, Mycobacterium tuberculosis; identical to SEQ ID NO: 220198

SEQ ID NO: 1526106 - protein, 21 aa, Mycobacterium tuberculosis
LKLGGVYGFYPRFTGPQRSTV

SEQ ID NO: 1526107 - protein, 17 aa, Mycobacterium tuberculosis
LKLWYAAAPHKHPGADR

SEQ ID NO: 1526108 - protein, 19 aa, Mycobacterium tuberculosis
LKMLLDTFPVTFTAADGVE

SEQ ID NO: 1526109 - protein, 23 aa, Mycobacterium tuberculosis
LKQFRGNIRDQVPPRRVRINVGH

SEQ ID NO: 1526110 - protein, 21 aa, Mycobacterium tuberculosis
LKRRGFRFVGPTTAYALMQAT

SEQ ID NO: 1526111 - protein, 19 aa, Mycobacterium tuberculosis
LKSYAFVMPETALAAARAA

SEQ ID NO: 1526112 - protein, 20 aa, Mycobacterium tuberculosis
LKVLSQVGYQQADHGESLLT

SEQ ID NO: 1526113 - protein, 18 aa, Mycobacterium tuberculosis
LKWLSKHSKRLWQTANTI

SEQ ID NO: 1526114 - protein, 29 aa, Mycobacterium tuberculosis
LLAAINAPTQALLGRPLIGNGADGAPGTG

SEQ ID NO: 1526115 - protein, 20 aa, Mycobacterium tuberculosis
LLAALRRAVPATKGNTRRLA

SEQ ID NO: 1526116 - protein, 20 aa, Mycobacterium tuberculosis
LLAFTAFPKQIWRQIGSNNP

SEQ ID NO: 1526117 - protein, 17 aa, Mycobacterium tuberculosis
LLANGHWVTVLDKSSRN

SEQ ID NO: 1526118 - protein, 18 aa, Mycobacterium tuberculosis
LLAPDWQTAQQKLTGMLA

SEQ ID NO: 1526119 - protein, 26 aa, Mycobacterium tuberculosis
LLAPRPALLVRRRLDLVAWATGLPAL

SEQ ID NO: 1526120 - protein, 20 aa, Mycobacterium tuberculosis
LLAQLTIPIPTVTTPQMFTY

SEQ ID NO: 1526121 - protein, 19 aa, Mycobacterium tuberculosis
LLARGDLALRMGLPVLAVV

SEQ ID NO: 1526122 - protein, 18 aa, Mycobacterium tuberculosis
LLASRLIDVTGWLATQPD

SEQ ID NO: 1526123 - protein, 19 aa, Mycobacterium tuberculosis
LLAVAPRRPQGELPAVGSL

SEQ ID NO: 1526124 - protein, 19 aa, Mycobacterium tuberculosis
LLCTACFDGKYPIELPRET

SEQ ID NO: 1526125 - protein, 18 aa, Mycobacterium tuberculosis
LLDALPPRRQPPKTVPPL

SEQ ID NO: 1526126 - protein, 23 aa, Mycobacterium tuberculosis
LLDATAALVLALVKACRGVRLLA

SEQ ID NO: 1526127 - protein, 17 aa, Mycobacterium tuberculosis
LLDERALFLGQWGLRGQ

SEQ ID NO: 1526128 - protein, 18 aa, Mycobacterium tuberculosis
LLDFFAELTIYTSSACLI

SEQ ID NO: 1526129 - protein, 20 aa, Mycobacterium tuberculosis
LLDIPGERRPHRADHAVCVH

SEQ ID NO: 1526130 - protein, 28 aa, Mycobacterium tuberculosis
LLDLGLRNYWGYNTFGFFAPHHQYASTR

SEQ ID NO: 1526131 - protein, 19 aa, Mycobacterium tuberculosis
LLDLWAAAYPGVWAGPTNS

SEQ ID NO: 1526132 - protein, 25 aa, Mycobacterium tuberculosis
LLDRAPLAVLALGGEALGAATWRMI

SEQ ID NO: 1526133 - protein, 24 aa, Mycobacterium tuberculosis
LLDSHVAYWWSAEPQRLSMAASQG

SEQ ID NO: 1526134 - protein, 30 aa, Mycobacterium tuberculosis
LLDSRDLARLWPSLLARPLRSRLLGCAPAS

SEQ ID NO: 1526135 - protein, 18 aa, Mycobacterium tuberculosis
LLERLNHNLAAVTSLLAD

SEQ ID NO: 1526136 - protein, 17 aa, Mycobacterium tuberculosis
LLEVYLQRIERLDSHLR

SEQ ID NO: 1526137 - protein, 17 aa, Mycobacterium tuberculosis
LLFGDGGNGGAGGAGGI

SEQ ID NO: 1526138 - protein, 17 aa, Mycobacterium tuberculosis
LLFPQPRCQVITGVGDF

SEQ ID NO: 1526139 - protein, 27 aa, Mycobacterium tuberculosis
LLFTAGLWSVWKSYRSAPPLLSCTVIT

SEQ ID NO: 1526140 - protein, 34 aa, Mycobacterium tuberculosis
LLFTNPVKAFQFLVDLILFDWPTHMLQLATWLAE

SEQ ID NO: 1526141 - protein, 17 aa, Mycobacterium tuberculosis
LLGLRQPKPGRYKRGLR

SEQ ID NO: 1526142 - protein, 18 aa, Mycobacterium tuberculosis
LLGPINAGLVIPPVPGFG

SEQ ID NO: 1526143 - protein, 19 aa, Mycobacterium tuberculosis
LLGPLGDLFTIMTIPAQEA

SEQ ID NO: 1526144 - protein, 29 aa, Mycobacterium tuberculosis
LLGQEGMGFIYLMQNLPQERISIAIMAAA

SEQ ID NO: 1526145 - protein, 18 aa, Mycobacterium tuberculosis
LLGVINTPTEALVGRKLI

SEQ ID NO: 1526146 - protein, 21 aa, Mycobacterium tuberculosis
LLHDHLVDILLDAAAMGRVHV

SEQ ID NO: 1526147 - protein, 18 aa, Mycobacterium tuberculosis
LLHPFLMSQTVWEKVAQQ

SEQ ID NO: 1526148 - protein, 19 aa, Mycobacterium tuberculosis
LLLELAYELEEARPWARIH

SEQ ID NO: 1526149 - protein, 17 aa, Mycobacterium tuberculosis
LLLLEHPAVYTAGRRTE

SEQ ID NO: 1526150 - protein, 18 aa, Mycobacterium tuberculosis
LLLQVLFHARIAEDASQS

SEQ ID NO: 1526151 - protein, 17 aa, Mycobacterium tuberculosis
LLMLTRLKPGASCATSG

SEQ ID NO: 1526152 - protein, 30 aa, Mycobacterium tuberculosis
LLMSTFGPRTALWLLLAKCGGDTEVSAQAW

SEQ ID NO: 1526153 - protein, 27 aa, Mycobacterium tuberculosis
LLNAINAPTQALLGRPLIGDGADGTAP

SEQ ID NO: 1526154 - protein, 29 aa, Mycobacterium tuberculosis
LLNIVNTPTQLLLGRPLIGKNPRAPWERA

SEQ ID NO: 1526155 - protein, 27 aa, Mycobacterium tuberculosis
LLNIVNTPTQLLLGRPLIGNGANGAPG

SEQ ID NO: 1526156 - protein, 25 aa, Mycobacterium tuberculosis
LLNRAPTLHRLGIQAFEPMLVEGKA

SEQ ID NO: 1526157 - protein, 17 aa, Mycobacterium tuberculosis
LLPALLEALVRNVSRGL

SEQ ID NO: 1526158 - protein, 17 aa, Mycobacterium tuberculosis
LLPEAFAVAREAAWRVL

SEQ ID NO: 1526159 - protein, 21 aa, Mycobacterium tuberculosis
LLPFELRTLDAIHLATAQRLG

SEQ ID NO: 1526160 - protein, 26 aa, Mycobacterium tuberculosis
LLPRASHIRRFWMPTRSVEPAASARS

SEQ ID NO: 1526161 - protein, 17 aa, Mycobacterium tuberculosis
LLQGGYGWTAGSTARRA

SEQ ID NO: 1526162 - protein, 17 aa, Mycobacterium tuberculosis
LLQKVLDLPAGQLPPEP

SEQ ID NO: 1526163 - protein, 19 aa, Mycobacterium tuberculosis
LLQMTGMYQAIANDGVRVP

SEQ ID NO: 1526164 - protein, 33 aa, Mycobacterium tuberculosis
LLQVGETMPRRAPALTAPLLVLHGTDDRLIPIE

SEQ ID NO: 1526165 - protein, 33 aa, Mycobacterium tuberculosis
LLRAHVMATYLSRDWARDWGSLRKFDTLVDAPP

SEQ ID NO: 1526166 - protein, 17 aa, Mycobacterium tuberculosis
LLRAPHTPPLVIDFAGC

SEQ ID NO: 1526167 - protein, 17 aa, Mycobacterium tuberculosis
LLRCIEAVLACREALAV

SEQ ID NO: 1526168 - protein, 25 aa, Mycobacterium tuberculosis
LLRELEARIIQWRNANPQLAANYRA

SEQ ID NO: 1526169 - protein, 18 aa, Mycobacterium tuberculosis
LLRFGLHQALRLGKPLQF

SEQ ID NO: 1526170 - protein, 20 aa, Mycobacterium tuberculosis
LLRHGRVYAAPYFHQFDAYR

SEQ ID NO: 1526171 - protein, 19 aa, Mycobacterium tuberculosis
LLRLLGFDTRWSSAADDPT

SEQ ID NO: 1526172 - protein, 21 aa, Mycobacterium tuberculosis
LLRRAHTGSVQPLPWPTARWA

SEQ ID NO: 1526173 - protein, 17 aa, Mycobacterium tuberculosis
LLRRLVVADPTAYGYLV

SEQ ID NO: 1526174 - protein, 26 aa, Mycobacterium tuberculosis
LLRRPDLLVSLLTYWQRHPSLSYLFA

SEQ ID NO: 1526175 - protein, 17 aa, Mycobacterium tuberculosis
LLRRYLEVDRAWRDHLL

SEQ ID NO: 1526176 - protein, 17 aa, Mycobacterium tuberculosis
LLSAVWLREPDGPGVLV

SEQ ID NO: 1526177 - protein, 18 aa, Mycobacterium tuberculosis
LLSCLGGILRPKSGSIKF

SEQ ID NO: 1526178 - protein, 24 aa, Mycobacterium tuberculosis
LLSLPNIPLLEYAARFITPVHPGY

SEQ ID NO: 1526179 - protein, 24 aa, Mycobacterium tuberculosis
LLSQRHFLHLLPQYGTYHPLYEKA

SEQ ID NO: 1526180 - protein, 17 aa, Mycobacterium tuberculosis
LLSYRQTFDLRRATLTR

SEQ ID NO: 1526181 - protein, 23 aa, Mycobacterium tuberculosis
LLTEPRPWHVPGRPRRAGRCVVV

SEQ ID NO: 1526182 - protein, 24 aa, Mycobacterium tuberculosis
LLTEPRPWHVPGRPRRAGVSSFGI

SEQ ID NO: 1526183 - protein, 19 aa, Mycobacterium tuberculosis
LLTGRRTWVPWTAVLVNVA

SEQ ID NO: 1526184 - protein, 25 aa, Mycobacterium tuberculosis
LLTGTLPNRLYWLSANIDPAGTDGG

SEQ ID NO: 1526185 - protein, 17 aa, Mycobacterium tuberculosis
LLVAAKVLSRPGSVTEG

SEQ ID NO: 1526186 - protein, 19 aa, Mycobacterium tuberculosis
LLVDMAHFAGLVAAGLHPS

SEQ ID NO: 1526187 - protein, 17 aa, Mycobacterium tuberculosis
LLVDTLFDLALTREMLA

SEQ ID NO: 1526188 - protein, 17 aa, Mycobacterium tuberculosis
LLVGLVCLQAAAVLGRP

SEQ ID NO: 1526189 - protein, 18 aa, Mycobacterium tuberculosis
LLVPLDQPGVQIRPIVQI

SEQ ID NO: 1526190 - protein, 18 aa, Mycobacterium tuberculosis
LLVSGHHWGPTGTKPRGP

SEQ ID NO: 1526191 - protein, 19 aa, Mycobacterium tuberculosis
LLVSVFLEKDFAFVVSSEA

SEQ ID NO: 1526192 - protein, 27 aa, Mycobacterium tuberculosis
LLVVQRVPYFQVWNLTGQPAAVVPWDF

SEQ ID NO: 1526193 - protein, 29 aa, Mycobacterium tuberculosis
LLWRGDHEGLFSLFYSLDVPRITIVDAHL

SEQ ID NO: 1526194 - protein, 17 aa, Mycobacterium tuberculosis
LLWSELVAQFAPRAPNP

SEQ ID NO: 1526195 - protein, 27 aa, Mycobacterium tuberculosis
LLYRLERPLLFALQCMPLNWVRRRHGL

SEQ ID NO: 1526196 - protein, 18 aa, Mycobacterium tuberculosis
LLYVVVLHRFLRWRQRDY

SEQ ID NO: 1526197 - protein, 19 aa, Mycobacterium tuberculosis
LMCASLESYGRYWREVFRL

SEQ ID NO: 1526198 - protein, 17 aa, Mycobacterium tuberculosis
LMHRTRASALMMAAGWN

SEQ ID NO: 1526199 - protein, 17 aa, Mycobacterium tuberculosis
LMHWRAVSADTPHVPVR

SEQ ID NO: 1526200 - protein, 17 aa, Mycobacterium tuberculosis
LMKPSTLDMICHGTAAK

SEQ ID NO: 1526201 - protein, 26 aa, Mycobacterium tuberculosis
LMLARNAEALYWNRSLRRARRRHRAH

SEQ ID NO: 1526202 - protein, 17 aa, Mycobacterium tuberculosis
LMLTRLKPGASCATSGF

SEQ ID NO: 1526203 - protein, 19 aa, Mycobacterium tuberculosis
LMMGLWVNAVPAANTPDSC

SEQ ID NO: 1526204 - protein, 18 aa, Mycobacterium tuberculosis
LMPRFVREFPFNLMLWDL

SEQ ID NO: 1526205 - protein, 28 aa, Mycobacterium tuberculosis
LMPRFVREFPFNLMLWDLDRRMRRGRPL

SEQ ID NO: 1526206 - protein, 25 aa, Mycobacterium tuberculosis
LMRCARGFRRWANPPLKTSAMPPRT

SEQ ID NO: 1526207 - protein, 21 aa, Mycobacterium tuberculosis
LMRPILAYLADGQAKSGKDVI

SEQ ID NO: 1526208 - protein, 21 aa, Mycobacterium tuberculosis
LMRPRIASRVLGKWARTRLSG

SEQ ID NO: 1526209 - protein, 26 aa, Mycobacterium tuberculosis
LMRRSGMIFIRRNIGNDPLYKYVLKE

SEQ ID NO: 1526210 - protein, 28 aa, Mycobacterium tuberculosis
LMSTFGPRTALWLLLAKGGGDTEVSAQA

SEQ ID NO: 1526211 - protein, 17 aa, Mycobacterium tuberculosis
LMTIPWAVISGFLFNVL

SEQ ID NO: 1526212 - protein, 19 aa, Mycobacterium tuberculosis
LMTLQDYLATVITWHRHIA

SEQ ID NO: 1526213 - protein, 35 aa, Mycobacterium tuberculosis
LMTVGSYLSPLPLPLGFVDFACRVWRPGQGTVRTT

SEQ ID NO: 1526214 - protein, 17 aa, Mycobacterium tuberculosis
LNAFWREVNRCGALDTT

SEQ ID NO: 1526215 - protein, 25 aa, Mycobacterium tuberculosis
LNAINAPTLALLGRPLIGNGADGAA

SEQ ID NO: 1526216 - protein, 27 aa, Mycobacterium tuberculosis
LNAINAPTQTLFGRPLIGDGANGTAEN

SEQ ID NO: 1526217 - protein, 29 aa, Mycobacterium tuberculosis
LNALNAPTQALLGRPLIGDGAAGAPGTGH

SEQ ID NO: 1526218 - protein, 25 aa, Mycobacterium tuberculosis
LNAQLIDELPLPRPRYEIFVYSPRV

SEQ ID NO: 1526219 - protein, 18 aa, Mycobacterium tuberculosis
LNASPPRPSLPGPPFVLT

SEQ ID NO: 1526220 - protein, 26 aa, Mycobacterium tuberculosis
LNATLLTARCPVLFAPAMHTEMWLHP

SEQ ID NO: 1526221 - protein, 25 aa, Mycobacterium tuberculosis
LNATLRYLMFSVFSVSPGALGDQRD

SEQ ID NO: 1526222 - protein, 25 aa, Mycobacterium tuberculosis
LNDAEKRWVLKNPSHLFALDALMAT

SEQ ID NO: 1526223 - protein, 23 aa, Mycobacterium tuberculosis
LNGEARLPLALPTSATGGIPVTV

SEQ ID NO: 1526224 - protein, 26 aa, Mycobacterium tuberculosis
LNGITILNLVVFIPTNITACQTNMPG

SEQ ID NO: 1526225 - protein, 18 aa, Mycobacterium tuberculosis
LNHIITNLKYACLSIYTF

SEQ ID NO: 1526226 - protein, 27 aa, Mycobacterium tuberculosis
LNIPDPDPLRLIYFADADPVFALCEHA

SEQ ID NO: 1526227 - protein, 27 aa, Mycobacterium tuberculosis
LNLKLQPARYRQLLQHILQHVADGKLE

SEQ ID NO: 1526228 - protein, 20 aa, Mycobacterium tuberculosis
LNLPPRCTTGFLPAQQRRIP

SEQ ID NO: 1526229 - protein, 23 aa, Mycobacterium tuberculosis
LNLSIPPIHIPGLTIPSVPLRID

SEQ ID NO: 1526230 - protein, 21 aa, Mycobacterium tuberculosis
LNNRLWSRLRRRIEEADALLY

SEQ ID NO: 1526231 - protein, 19 aa, Mycobacterium tuberculosis
LNRELSWLDFNARVLALAA

SEQ ID NO: 1526232 - protein, 26 aa, Mycobacterium tuberculosis
LNRFGAAVGVLAAGALVLSACGNDDN

SEQ ID NO: 1526233 - protein, 17 aa, Mycobacterium tuberculosis
LNRVVVPGAAVGPKDPR

SEQ ID NO: 1526234 - protein, 17 aa, Mycobacterium tuberculosis
LNVAIEKLLAHQLRRRN

SEQ ID NO: 1526235 - protein, 19 aa, Mycobacterium tuberculosis
LPAATPWDIGGPQPVVQQL

SEQ ID NO: 1526236 - protein, 17 aa, Mycobacterium tuberculosis
LPADLPLGYHRVNLRSG

SEQ ID NO: 1526237 - protein, 28 aa, Mycobacterium tuberculosis
LPADRVLAALHGWLAPLPPEGASAIVFR

SEQ ID NO: 1526238 - protein, 18 aa, Mycobacterium tuberculosis
LPAIYVPLPIGNGEQRLN

SEQ ID NO: 1526239 - protein, 18 aa, Mycobacterium tuberculosis
LPAKRWLAQRGFDPVYGA

SEQ ID NO: 1526240 - protein, 17 aa, Mycobacterium tuberculosis
LPAMGVLLERTGPRHRA

SEQ ID NO: 1526241 - protein, 40 aa, Mycobacterium tuberculosis
LPANHRYLGPVLWSPDVKPPTWWHSLPTDRPIIYATLGSS

SEQ ID NO: 1526242 - protein, 17 aa, Mycobacterium tuberculosis
LPDIYLLGKTLGGGAVP

SEQ ID NO: 1526243 - protein, 20 aa, Mycobacterium tuberculosis
LPDPLPAGPTRRVPLGLIAG

SEQ ID NO: 1526244 - protein, 26 aa, Mycobacterium tuberculosis
LPDVPWTRFFGVRPVSILYRLYRPLI

SEQ ID NO: 1526245 - protein, 19 aa, Mycobacterium tuberculosis
LPEIPQLRWRVTGAPLGLD

SEQ ID NO: 1526246 - protein, 22 aa, Mycobacterium tuberculosis
LPEIVWYLDEPVADPALVPLFF

SEQ ID NO: 1526247 - protein, 18 aa, Mycobacterium tuberculosis
LPELAVQMRRRLIETVTA

SEQ ID NO: 1526248 - protein, 25 aa, Mycobacterium tuberculosis
LPEPARRLAAVARLRLLCRGSGITD

SEQ ID NO: 1526249 - protein, 17 aa, Mycobacterium tuberculosis
LPFELTAGQREVLDVLS

SEQ ID NO: 1526250 - protein, 17 aa, Mycobacterium tuberculosis
LPFVLQSAEVMKAAVAY

SEQ ID NO: 1526251 - protein, 17 aa, Mycobacterium tuberculosis
LPGAGWTAAAPQAAAGT

SEQ ID NO: 1526252 - protein, 21 aa, Mycobacterium tuberculosis
LPGDPLALIAPAGSGAGAGAL

SEQ ID NO: 1526253 - protein, 20 aa, Mycobacterium tuberculosis
LPGGLPDLLMLAGGGLVGWM

SEQ ID NO: 1526254 - protein, 21 aa, Mycobacterium tuberculosis
LPGGLPDLLMLAGGGLVGWMT

SEQ ID NO: 1526255 - protein, 30 aa, Mycobacterium tuberculosis
LPGHARHWRRGWRRWADWPTRGRRRPRCRR

SEQ ID NO: 1526256 - protein, 17 aa, Mycobacterium tuberculosis
LPGLGQVASAISGGAAS

SEQ ID NO: 1526257 - protein, 23 aa, Mycobacterium tuberculosis
LPGLSLPRTLIFDYPTASALAEC

SEQ ID NO: 1526258 - protein, 18 aa, Mycobacterium tuberculosis
LPGNPRVLSIAQFWDRAA

SEQ ID NO: 1526259 - protein, 28 aa, Mycobacterium tuberculosis
LPGTYLNSFYEIRPLPYAEAGYGYPEAG

SEQ ID NO: 1526260 - protein, 17 aa, Mycobacterium tuberculosis
LPIEGPAWPLTVQPETG

SEQ ID NO: 1526261 - protein, 26 aa, Mycobacterium tuberculosis
LPPAPPLAPVPPAPPAPPLPFNHPPD

SEQ ID NO: 1526262 - protein, 27 aa, Mycobacterium tuberculosis
LPPDINSALMFAGPGSGPLIAAATAWG

SEQ ID NO: 1526263 - protein, 26 aa, Mycobacterium tuberculosis
LPPEINSARMFAGPGSGPLIAAATAW

SEQ ID NO: 1526264 - protein, 26 aa, Mycobacterium tuberculosis
LPPEINSLRMFTGAGSAPMLAASVAW

SEQ ID NO: 1526265 - protein, 19 aa, Mycobacterium tuberculosis
LPPLPLSPPTALPKDTPAT

SEQ ID NO: 1526266 - protein, 17 aa, Mycobacterium tuberculosis
LPPMLTPPKLRSPRLPM

SEQ ID NO: 1526267 - protein, 19 aa, Mycobacterium tuberculosis
LPPPHLDHGQPRINRYHHP

SEQ ID NO: 1526268 - protein, 17 aa, Mycobacterium tuberculosis
LPPSIFHWLNYSVTAYQ

SEQ ID NO: 1526269 - protein, 25 aa, Mycobacterium tuberculosis
LPPTVGITLHLPFDGILVPPHPVTA

SEQ ID NO: 1526270 - protein, 19 aa, Mycobacterium tuberculosis
LPQSALPNTYPYLPSANPG

SEQ ID NO: 1526271 - protein, 17 aa, Mycobacterium tuberculosis
LPRFFRGISDDADAQAH

SEQ ID NO: 1526272 - protein, 21 aa, Mycobacterium tuberculosis
LPRFTTDFPLSDGTPAPVLEL

SEQ ID NO: 1526273 - protein, 21 aa, Mycobacterium tuberculosis
LPRIAGPCGMVIFGVTGDLAR

SEQ ID NO: 1526274 - protein, 23 aa, Mycobacterium tuberculosis
LPRIARATKILDLARAYGIEVSD

SEQ ID NO: 1526275 - protein, 23 aa, Mycobacterium tuberculosis
LPRPWDPLPCANLTQGPFGGPDF

SEQ ID NO: 1526276 - protein, 22 aa, Mycobacterium tuberculosis
LPRRYYRAIAKMADTAWFVIRE

SEQ ID NO: 1526277 - protein, 19 aa, Mycobacterium tuberculosis
LPRTLVWSAAWEMTREAEL

SEQ ID NO: 1526278 - protein, 20 aa, Mycobacterium tuberculosis
LPSCITKYIPLHTPAVVMSI

SEQ ID NO: 1526279 - protein, 26 aa, Mycobacterium tuberculosis
LPSDRLLNLLIYIKGYLDGTLTFRRS

SEQ ID NO: 1526280 - protein, 24 aa, Mycobacterium tuberculosis
LPSTALMDVLLRRPPRTAQRRRIA

SEQ ID NO: 1526281 - protein, 31 aa, Mycobacterium tuberculosis
LPTIRSRTHHYPFRLLPPRTMRALLARICEQ

SEQ ID NO: 1526282 - protein, 18 aa, Mycobacterium tuberculosis
LPTPWPQEALDDLLVVLS

SEQ ID NO: 1526283 - protein, 20 aa, Mycobacterium tuberculosis
LPTYAFDKRRFWLSAEGSGA

SEQ ID NO: 1526284 - protein, 20 aa, Mycobacterium tuberculosis
LPTYAVICCPAFGAAAKVGT

SEQ ID NO: 1526285 - protein, 17 aa, Mycobacterium tuberculosis
LPVLGPITGQLGPIHLE

SEQ ID NO: 1526286 - protein, 18 aa, Mycobacterium tuberculosis
LPVLPQLSARHHVLVAAV

SEQ ID NO: 1526287 - protein, 27 aa, Mycobacterium tuberculosis
LPVYDKPMIYYPLTTLMMAGIRDIQLI

SEQ ID NO: 1526288 - protein, 19 aa, Mycobacterium tuberculosis
LPYMRYNANKALANLGYQP

SEQ ID NO: 1526289 - protein, 21 aa, Mycobacterium tuberculosis
LQAAAAWDGLAAELGTAASSF

SEQ ID NO: 1526290 - protein, 25 aa, Mycobacterium tuberculosis
LQAAVSGLVTALFGAPGQPGDTGQP

SEQ ID NO: 1526291 - protein, 20 aa, Mycobacterium tuberculosis
LQARLMSQALRKMTGALNNS

SEQ ID NO: 1526292 - protein, 17 aa, Mycobacterium tuberculosis
LQEIAGGRLILRFFPTP

SEQ ID NO: 1526293 - protein, 18 aa, Mycobacterium tuberculosis
LQEVSTARRLVRERLEPA

SEQ ID NO: 1526294 - protein, 23 aa, Mycobacterium tuberculosis
LQGFRSMLWPRVYADLRTAGVRG

SEQ ID NO: 1526295 - protein, 25 aa, Mycobacterium tuberculosis
LQHTWIRRSRCWIRWATPPCGRTHC

SEQ ID NO: 1526296 - protein, 19 aa, Mycobacterium tuberculosis
LQIHPRVLRAIGDVGYESP

SEQ ID NO: 1526297 - protein, 17 aa, Mycobacterium tuberculosis
LQIVTELAPVFKAAGFR

SEQ ID NO: 1526298 - protein, 17 aa, Mycobacterium tuberculosis
LQLITTDSAPIITRASA

SEQ ID NO: 1526299 - protein, 26 aa, Mycobacterium tuberculosis
LQLSALLPEWRTELPLRYLESVITQL

SEQ ID NO: 1526300 - protein, 49 aa, Mycobacterium tuberculosis
LQLVPKMLRMLRPDLTIGFFLHIPFPPVELFMQMPWRTEIIQGLLGADL

SEQ ID NO: 1526301 - protein, 23 aa, Mycobacterium tuberculosis
LQNMLPCIYLVDSGGAFLPRQDE

SEQ ID NO: 1526302 - protein, 29 aa, Mycobacterium tuberculosis
LQQLSSTSLIPWYSALQQWLAENLLGLTP

SEQ ID NO: 1526303 - protein, 26 aa, Mycobacterium tuberculosis
LQRLRGMFAFALWDTVTRELFCARDP

SEQ ID NO: 1526304 - protein, 20 aa, Mycobacterium tuberculosis
LQRLSPRWDDGRDGPHVRLW

SEQ ID NO: 1526305 - protein, 18 aa, Mycobacterium tuberculosis
LQRLVRALLGFDAKLSQY

SEQ ID NO: 1526306 - protein, 20 aa, Mycobacterium tuberculosis
LQRQGWLVRRQGLGTFVADP

SEQ ID NO: 1526307 - protein, 32 aa, Mycobacterium tuberculosis
LQRVIDLVRRRSLPIMFPIEVRFSAPDDSFLS

SEQ ID NO: 1526308 - protein, 24 aa, Mycobacterium tuberculosis
LQRVKRRLLAPLHKSTIGGGNTGT

SEQ ID NO: 1526309 - protein, 18 aa, Mycobacterium tuberculosis
LQRVLAVLRVPAGGGLVI

SEQ ID NO: 1526310 - protein, 36 aa, Mycobacterium tuberculosis
LQRWRPFGLPPHRWRLAPWYWRGLQVTLEPGSAIAW

SEQ ID NO: 1526311 - protein, 25 aa, Mycobacterium tuberculosis
LQSAMLRAMARMLRQSRPAKTARRP

SEQ ID NO: 1526312 - protein, 32 aa, Mycobacterium tuberculosis
LQSAQPILLAHHLLAHAHPLLRDLDRIVDFDK

SEQ ID NO: 1526313 - protein, 21 aa, Mycobacterium tuberculosis
LQSLRTRFGTLTAVDRPVAVG

SEQ ID NO: 1526314 - protein, 31 aa, Mycobacterium tuberculosis; identical to SEQ ID NO: 163024

SEQ ID NO: 1526315 - protein, 20 aa, Mycobacterium tuberculosis
LRAAFAVQPREWRYRPRVAV

SEQ ID NO: 1526316 - protein, 20 aa, Mycobacterium tuberculosis
LRAALRAVPAERLWVNPDCG

SEQ ID NO: 1526317 - protein, 19 aa, Mycobacterium tuberculosis
LRAAYPRDAERVKRAMFIV

SEQ ID NO: 1526318 - protein, 24 aa, Mycobacterium tuberculosis
LRADLARDPSFYLRFRREAQNAAA

SEQ ID NO: 1526319 - protein, 35 aa, Mycobacterium tuberculosis
LRADVRVAHPLISRAHLLLRFDQGRWVAIDNGSLN

SEQ ID NO: 1526320 - protein, 25 aa, Mycobacterium tuberculosis
LRAHVMATYLSRDWARDWGSLRKFD

SEQ ID NO: 1526321 - protein, 18 aa, Mycobacterium tuberculosis
LRAILVHALHDEARAFYV

SEQ ID NO: 1526322 - protein, 19 aa, Mycobacterium tuberculosis
LRALFINATLKRSPELSHT

SEQ ID NO: 1526323 - protein, 26 aa, Mycobacterium tuberculosis
LRANGIRRIVMLTGDHPEIAQVVADE

SEQ ID NO: 1526324 - protein, 22 aa, Mycobacterium tuberculosis
LRAPHTPPLVIDFGGGVLGALQ

SEQ ID NO: 1526325 - protein, 17 aa, Mycobacterium tuberculosis
LRAQPRRSRRRAPRRLC

SEQ ID NO: 1526326 - protein, 17 aa, Mycobacterium tuberculosis
LRAVGMDDEDFAKPQIG

SEQ ID NO: 1526327 - protein, 31 aa, Mycobacterium tuberculosis
LRCARMRFCGKAARWSYLGRRRDPASTRRGS

SEQ ID NO: 1526328 - protein, 29 aa, Mycobacterium tuberculosis
LRCSKGSFYLRPIVRPVILVAGGTGLSAI

SEQ ID NO: 1526329 - protein, 38 aa, Mycobacterium tuberculosis
LRDDRLVLSPQWPEALGPLEFPFVYRRHQLSLRISGRS

SEQ ID NO: 1526330 - protein, 28 aa, Mycobacterium tuberculosis
LRDGKARWYRNRWVRTPAVCAALGEPIS

SEQ ID NO: 1526331 - protein, 20 aa, Mycobacterium tuberculosis
LRDIGLGPMPLNGSGRLLVA

SEQ ID NO: 1526332 - protein, 26 aa, Mycobacterium tuberculosis
LRDSVLDAMRDLLLTRDWSAITLSDV

SEQ ID NO: 1526333 - protein, 29 aa, Mycobacterium tuberculosis
LRDTGRCRVPLILRLDPKIGLPDIRAVLT

SEQ ID NO: 1526334 - protein, 17 aa, Mycobacterium tuberculosis
LRDYGSAASPFNAFLVA

SEQ ID NO: 1526335 - protein, 21 aa, Mycobacterium tuberculosis
LRDYLLTLRRKSAHGGPFEYR

SEQ ID NO: 1526336 - protein, 26 aa, Mycobacterium tuberculosis
LREARLFRAELTIPLILLGGITNRTT

SEQ ID NO: 1526337 - protein, 22 aa, Mycobacterium tuberculosis
LRELLTIAMRYFALTTMHVDIT

SEQ ID NO: 1526338 - protein, 23 aa, Mycobacterium tuberculosis
LRELQTRMFACFAAGALAAGCEY

SEQ ID NO: 1526339 - protein, 17 aa, Mycobacterium tuberculosis
LRENLQWLGTHNSFNSL

SEQ ID NO: 1526340 - protein, 26 aa, Mycobacterium tuberculosis
LRETLLTVSSDWPFMVSKDSAADYAR

SEQ ID NO: 1526341 - protein, 17 aa, Mycobacterium tuberculosis
LREVERFPFVPADPQRL

SEQ ID NO: 1526342 - protein, 17 aa, Mycobacterium tuberculosis
LRFDVPLYTLAEASRYL

SEQ ID NO: 1526343 - protein, 19 aa, Mycobacterium tuberculosis
LRGCYRIAVLSLKGGIGKT

SEQ ID NO: 1526344 - protein, 24 aa, Mycobacterium tuberculosis
LRGDRTMFLFVFRAEHDNPGVAPK

SEQ ID NO: 1526345 - protein, 25 aa, Mycobacterium tuberculosis
LRGDRTMFLFVFRAEHDNPGVAPKD

SEQ ID NO: 1526346 - protein, 18 aa, Mycobacterium tuberculosis
LRGFDPDVVHLASPALLG

SEQ ID NO: 1526347 - protein, 27 aa, Mycobacterium tuberculosis
LRGGPDYLMFLYKTKGPVVFGDSAVLP

SEQ ID NO: 1526348 - protein, 19 aa, Mycobacterium tuberculosis
LRGGVRSPNPLPLQQLRAR

SEQ ID NO: 1526349 - protein, 20 aa, Mycobacterium tuberculosis
LRGLGPRHVPIWPPPRLRSG

SEQ ID NO: 1526350 - protein, 19 aa, Mycobacterium tuberculosis
LRGLLRTIGAEHPHLRATQ

SEQ ID NO: 1526351 - protein, 20 aa, Mycobacterium tuberculosis
LRGQRPLTVSAPSCTALAAC

SEQ ID NO: 1526352 - protein, 19 aa, Mycobacterium tuberculosis
LRGSPCAIGWVAGWLSAEF

SEQ ID NO: 1526353 - protein, 21 aa, Mycobacterium tuberculosis
LRGSRVVLRVPRRGDKRALAE

SEQ ID NO: 1526354 - protein, 20 aa, Mycobacterium tuberculosis
LRGYTLPNGLQLRQQRVPLG

SEQ ID NO: 1526355 - protein, 21 aa, Mycobacterium tuberculosis
LRHRGNPRPGRRLPGPLRPAG

SEQ ID NO: 1526356 - protein, 17 aa, Mycobacterium tuberculosis
LRIISGGRLIWDPAEGT

SEQ ID NO: 1526357 - protein, 17 aa, Mycobacterium tuberculosis
LRIQLEPVRPFVALRHI

SEQ ID NO: 1526358 - protein, 20 aa, Mycobacterium tuberculosis
LRKLFNAVGVVFKGTGFYRT

SEQ ID NO: 1526359 - protein, 27 aa, Mycobacterium tuberculosis
LRKSRSEMAWAFPAVPMVARAPAAQPA

SEQ ID NO: 1526360 - protein, 21 aa, Mycobacterium tuberculosis
LRKVVPLGKTLRGYSAWVTGL

SEQ ID NO: 1526361 - protein, 25 aa, Mycobacterium tuberculosis
LRLDKARFRSHPDLEVLTHGLTLWD

SEQ ID NO: 1526362 - protein, 17 aa, Mycobacterium tuberculosis
LRLIEPPPSLYRPHREP

SEQ ID NO: 1526363 - protein, 19 aa, Mycobacterium tuberculosis
LRLKYRYLDLRRDDPAAAI

SEQ ID NO: 1526364 - protein, 18 aa, Mycobacterium tuberculosis
LRLPLRNVLWEGDEALLT

SEQ ID NO: 1526365 - protein, 27 aa, Mycobacterium tuberculosis
LRLRQKVVVPTLPTAAPRWVVDPDFNL

SEQ ID NO: 1526366 - protein, 17 aa, Mycobacterium tuberculosis
LRLVVSLAKRYTGRGMA

SEQ ID NO: 1526367 - protein, 25 aa, Mycobacterium tuberculosis
LRMPKVARSLLDYRYRRLPAARRAA

SEQ ID NO: 1526368 - protein, 26 aa, Mycobacterium tuberculosis
LRMRHAPFRISLIERDAWLRCMHTAV

SEQ ID NO: 1526369 - protein, 25 aa, Mycobacterium tuberculosis
LRNHARWAVLLRNLRFVIVDECHYY

SEQ ID NO: 1526370 - protein, 30 aa, Mycobacterium tuberculosis
LRNLPHAQVRFVWLRGRRATSHWLTLPALK

SEQ ID NO: 1526371 - protein, 40 aa, Mycobacterium tuberculosis
LRNLPHAQVRFVWLRGRRATSHWLTLPALKAFGAIPVADE

SEQ ID NO: 1526372 - protein, 22 aa, Mycobacterium tuberculosis
LRNRTWPDRVIDRAPLWCAVDL

SEQ ID NO: 1526373 - protein, 18 aa, Mycobacterium tuberculosis
LRPASCTTALRRPTAVAT

SEQ ID NO: 1526374 - protein, 17 aa, Mycobacterium tuberculosis
LRPGDFYRPAHQNVYDA

SEQ ID NO: 1526375 - protein, 22 aa, Mycobacterium tuberculosis
LRPGDFYRPAHQNVYDAILDLY

SEQ ID NO: 1526376 - protein, 26 aa, Mycobacterium tuberculosis
LRPHGQVLVFWDCYRPHDVQVRMFDV

SEQ ID NO: 1526377 - protein, 26 aa, Mycobacterium tuberculosis
LRPIAAGTGLLVLGLARGGVPVGWEV

SEQ ID NO: 1526378 - protein, 19 aa, Mycobacterium tuberculosis
LRPPRTPLLSNLTGSWMSD

SEQ ID NO: 1526379 - protein, 20 aa, Mycobacterium tuberculosis
LRPQPILQLPDTNSGWRLVA

SEQ ID NO: 1526380 - protein, 19 aa, Mycobacterium tuberculosis
LRPRHCRGPVWWRHQRRWW

SEQ ID NO: 1526381 - protein, 26 aa, Mycobacterium tuberculosis
LRPVADRLWYPLWDANIRLDHNPRTL

SEQ ID NO: 1526382 - protein, 17 aa, Mycobacterium tuberculosis
LRPVKPPPSEGWRRLLY

SEQ ID NO: 1526383 - protein, 19 aa, Mycobacterium tuberculosis
LRPVLFDPTQRAGSSPINI

SEQ ID NO: 1526384 - protein, 18 aa, Mycobacterium tuberculosis
LRQHRFEFLADDGRLTMP

SEQ ID NO: 1526385 - protein, 17 aa, Mycobacterium tuberculosis
LRQIIANHQVYWQQIAA

SEQ ID NO: 1526386 - protein, 18 aa, Mycobacterium tuberculosis
LRRALAPPVKRQEQYRLE

SEQ ID NO: 1526387 - protein, 17 aa, Mycobacterium tuberculosis
LRRANAILKTASAFFAA

SEQ ID NO: 1526388 - protein, 19 aa, Mycobacterium tuberculosis
LRRCGRCGRKASWYDRGAG

SEQ ID NO: 1526389 - protein, 20 aa, Mycobacterium tuberculosis
LRRHSLPLFGYAAMPAYDVA

SEQ ID NO: 1526390 - protein, 26 aa, Mycobacterium tuberculosis
LRRMGYLQRMSTVLSRRLWENAGSPE

SEQ ID NO: 1526391 - protein, 17 aa, Mycobacterium tuberculosis
LRRRFPIQNPNCPTRRW

SEQ ID NO: 1526392 - protein, 17 aa, Mycobacterium tuberculosis
LRRSGLGGHPRLGHNLA

SEQ ID NO: 1526393 - protein, 26 aa, Mycobacterium tuberculosis
LRRSRGPRPNCCMARWARPSRSTRKP

SEQ ID NO: 1526394 - protein, 18 aa, Mycobacterium tuberculosis
LRRYGEERFARRIAAGIV

SEQ ID NO: 1526395 - protein, 17 aa, Mycobacterium tuberculosis
LRSKLLAGLAGPGGMVS

SEQ ID NO: 1526396 - protein, 19 aa, Mycobacterium tuberculosis
LRSLERLECLVRRLPAVGH

SEQ ID NO: 1526397 - protein, 25 aa, Mycobacterium tuberculosis
LRSQARILGIFVDGKRVPVVAHGVA

SEQ ID NO: 1526398 - protein, 18 aa, Mycobacterium tuberculosis
LRSRTTEVMLAGATVRAL

SEQ ID NO: 1526399 - protein, 20 aa, Mycobacterium tuberculosis
LRTFQEVANIRRRPRRRAED

SEQ ID NO: 1526400 - protein, 17 aa, Mycobacterium tuberculosis
LRTRGLSRCILGAGTIL

SEQ ID NO: 1526401 - protein, 25 aa, Mycobacterium tuberculosis
LRVDTALTPWPVADEPRRAGVSSFG

SEQ ID NO: 1526402 - protein, 18 aa, Mycobacterium tuberculosis
LRVEAIPELVDLPKRGRV

SEQ ID NO: 1526403 - protein, 28 aa, Mycobacterium tuberculosis
LRVGVLPTPAVAYLTGAYDADFGVMISA

SEQ ID NO: 1526404 - protein, 18 aa, Mycobacterium tuberculosis
LRVKDFGKREVMMVHTLL

SEQ ID NO: 1526405 - protein, 27 aa, Mycobacterium tuberculosis
LRVPDEFGLSRYLAAGLAALQTVDPKL

SEQ ID NO: 1526406 - protein, 25 aa, Mycobacterium tuberculosis
LRVWSRATIGLAYASALIIADRHDE

SEQ ID NO: 1526407 - protein, 18 aa, Mycobacterium tuberculosis
LRVYRDKLPHRYAKALRR

SEQ ID NO: 1526408 - protein, 17 aa, Mycobacterium tuberculosis
LRWRVTGAPLGLDRPWF

SEQ ID NO: 1526409 - protein, 28 aa, Mycobacterium tuberculosis
LRYPARYLFVFLDHHGMLSVFGSPTWRT

SEQ ID NO: 1526410 - protein, 23 aa, Mycobacterium tuberculosis
LRYRGLRAPHKIKLGVSGCAREC

SEQ ID NO: 1526411 - protein, 20 aa, Mycobacterium tuberculosis
LRYVAAWNAAFLPSKDLTEG

SEQ ID NO: 1526412 - protein, 17 aa, Mycobacterium tuberculosis
LSADRAFAAVPAALLRW

SEQ ID NO: 1526413 - protein, 17 aa, Mycobacterium tuberculosis
LSAFFDLVQQDPVVSQV

SEQ ID NO: 1526414 - protein, 30 aa, Mycobacterium tuberculosis
LSAHAVAFHEQFVQLMSAGAAQYASAEAAN

SEQ ID NO: 1526415 - protein, 23 aa, Mycobacterium tuberculosis
LSALALRFYGDAELYRLIAAASG

SEQ ID NO: 1526416 - protein, 27 aa, Mycobacterium tuberculosis
LSAQAAAFHQQFVQTLAGGAGAYAAAE

SEQ ID NO: 1526417 - protein, 29 aa, Mycobacterium tuberculosis
LSAQAAAFHQQFVRALSSAAGSYAAAEAA

SEQ ID NO: 1526418 - protein, 27 aa, Mycobacterium tuberculosis
LSAQAATFHIQFVRALTAGAGSYATAE

SEQ ID NO: 1526419 - protein, 28 aa, Mycobacterium tuberculosis
LSAQAATFISIFVQPLTAGAGSYAAAEA

SEQ ID NO: 1526420 - protein, 19 aa, Mycobacterium tuberculosis
LSAQATIFHDQFVQALTSG

SEQ ID NO: 1526421 - protein, 24 aa, Mycobacterium tuberculosis
LSARSAGFAGIRACRRTTAGTSLA

SEQ ID NO: 1526422 - protein, 29 aa, Mycobacterium tuberculosis
LSAVCALEPYWEALRKVYAPFESGLPGPT

SEQ ID NO: 1526423 - protein, 25 aa, Mycobacterium tuberculosis
LSAVLKLMQIVRPDRVFFGEKDYQQ

SEQ ID NO: 1526424 - protein, 19 aa, Mycobacterium tuberculosis
LSDPVFAGALRVGAGAGRR

SEQ ID NO: 1526425 - protein, 25 aa, Mycobacterium tuberculosis
LSDQEIIAFLFLMVIAGNETTTKLL

SEQ ID NO: 1526426 - protein, 27 aa, Mycobacterium tuberculosis
LSEKIDPYLRPLHDALYDMMDPELIPK

SEQ ID NO: 1526427 - protein, 21 aa, Mycobacterium tuberculosis
LSGLGLTMTGPRPGGFGALDG

SEQ ID NO: 1526428 - protein, 18 aa, Mycobacterium tuberculosis
LSHFGALVRIPRSWRRSA

SEQ ID NO: 1526429 - protein, 24 aa, Mycobacterium tuberculosis
LSKLHGLHVTDFLLVPPGALPKTT

SEQ ID NO: 1526430 - protein, 24 aa, Mycobacterium tuberculosis
LSKQPFSLQLIGPPPSPVQRYPLY

SEQ ID NO: 1526431 - protein, 19 aa, Mycobacterium tuberculosis
LSLPQPRQMAYRRLDLWLD

SEQ ID NO: 1526432 - protein, 24 aa, Mycobacterium tuberculosis
LSLTLNRLPQVAALFLAGQLSARL

SEQ ID NO: 1526433 - protein, 32 aa, Mycobacterium tuberculosis
LSNIDIPPMDFTLGLPVLGPITGQLGPIHLEP

SEQ ID NO: 1526434 - protein, 28 aa, Mycobacterium tuberculosis
LSPEAITRPRWLWKFAKTLRPPDLRVPN

SEQ ID NO: 1526435 - protein, 23 aa, Mycobacterium tuberculosis
LSPETLIIDCGADFRLTDAAVWE

SEQ ID NO: 1526436 - protein, 32 aa, Mycobacterium tuberculosis
LSPFSKPLQNLAGLPAWLASGAPAAAMTAAAG

SEQ ID NO: 1526437 - protein, 33 aa, Mycobacterium tuberculosis
LSPFSKPLQNLAGLPAWLASGAPAAAMTAAAGI

SEQ ID NO: 1526438 - protein, 18 aa, Mycobacterium tuberculosis
LSPFVTWGTNPGQGVPLA

SEQ ID NO: 1526439 - protein, 24 aa, Mycobacterium tuberculosis
LSPIDYRQYVLPHSARVFAALGEH

SEQ ID NO: 1526440 - protein, 23 aa, Mycobacterium tuberculosis
LSPLAPLRGGYIGDITPLGGGAT

SEQ ID NO: 1526441 - protein, 23 aa, Mycobacterium tuberculosis
LSPQHVVSLVQFLASPAAAEVNG

SEQ ID NO: 1526442 - protein, 24 aa, Mycobacterium tuberculosis
LSPQHVVSLVQFLASPAAAEVNGQ

SEQ ID NO: 1526443 - protein, 17 aa, Mycobacterium tuberculosis
LSQFARIFYARPETRKF

SEQ ID NO: 1526444 - protein, 28 aa, Mycobacterium tuberculosis
LSQYVEPVRPWPGSAAGLIVRLGTDPAG

SEQ ID NO: 1526445 - protein, 27 aa, Mycobacterium tuberculosis
LSRFSALTRDWFTSTFAAPTAAQASAW

SEQ ID NO: 1526446 - protein, 23 aa, Mycobacterium tuberculosis
LSRRRRLHPLRRRRHAGAQAGRR

SEQ ID NO: 1526447 - protein, 23 aa, Mycobacterium tuberculosis
LSRRYRVPVLSVHAPCLLISQRV

SEQ ID NO: 1526448 - protein, 26 aa, Mycobacterium tuberculosis
LSSDELIGLLARLGYRFAPTQIPGTV

SEQ ID NO: 1526449 - protein, 20 aa, Mycobacterium tuberculosis
LSSLSPLFGSKAIDLCNPTD

SEQ ID NO: 1526450 - protein, 27 aa, Mycobacterium tuberculosis
LSSMERAGLLLPLGWDPRLPVMGQKYI

SEQ ID NO: 1526451 - protein, 18 aa, Mycobacterium tuberculosis
LSSRRRAMSSSLNGPCSA

SEQ ID NO: 1526452 - protein, 25 aa, Mycobacterium tuberculosis
LSSSQMRSWFNYRFDGPNAVNNIPF

SEQ ID NO: 1526453 - protein, 25 aa, Mycobacterium tuberculosis
LSTARFEFRWNDQFALSLDPDTARE

SEQ ID NO: 1526454 - protein, 19 aa, Mycobacterium tuberculosis
LSTKFTRLTGRSPILLAGM

SEQ ID NO: 1526455 - protein, 30 aa, Mycobacterium tuberculosis
LSTQAAAFHSRFVQALTTAAASYASVEAAN

SEQ ID NO: 1526456 - protein, 17 aa, Mycobacterium tuberculosis
LSTSLFAFWAVDAAYSL

SEQ ID NO: 1526457 - protein, 20 aa, Mycobacterium tuberculosis
LSVRAKIKVRLTQLRPPVEI

SEQ ID NO: 1526458 - protein, 18 aa, Mycobacterium tuberculosis
LSVRQLMVRPVSAAALSR

SEQ ID NO: 1526459 - protein, 17 aa, Mycobacterium tuberculosis
LSVVVAESWRASALAEM

SEQ ID NO: 1526460 - protein, 17 aa, Mycobacterium tuberculosis
LSWGVAVPPDDYDHWAP

SEQ ID NO: 1526461 - protein, 20 aa, Mycobacterium tuberculosis
LSWRGLIAQSTDLDTLAAEA

SEQ ID NO: 1526462 - protein, 19 aa, Mycobacterium tuberculosis
LTAAMRLPTGLGALSRRYP

SEQ ID NO: 1526463 - protein, 18 aa, Mycobacterium tuberculosis
LTALLAAGFVRTPRGLRR

SEQ ID NO: 1526464 - protein, 27 aa, Mycobacterium tuberculosis
LTALPDAVRRRVIRGWLLAGGATGLTD

SEQ ID NO: 1526465 - protein, 17 aa, Mycobacterium tuberculosis
LTAQLRAKALWLRSRRR

SEQ ID NO: 1526466 - protein, 17 aa, Mycobacterium tuberculosis
LTAQMMAAARDLQFELA

SEQ ID NO: 1526467 - protein, 30 aa, Mycobacterium tuberculosis
LTAQMMAAARDLQFELAARFRDEIADLKRE

SEQ ID NO: 1526468 - protein, 24 aa, Mycobacterium tuberculosis
LTATQLALPGGMQPLWGPDQRRVM

SEQ ID NO: 1526469 - protein, 21 aa, Mycobacterium tuberculosis
LTAWSRAQAAWLWSRRRGVIA

SEQ ID NO: 1526470 - protein, 20 aa, Mycobacterium tuberculosis
LTCDPIAGLVQIPCIERNAI

SEQ ID NO: 1526471 - protein, 24 aa, Mycobacterium tuberculosis
LTCDPIAGLVQIPCIERNAISAGK

SEQ ID NO: 1526472 - protein, 21 aa, Mycobacterium tuberculosis
LTCRLIDRPLRPSFVDGLRNE

SEQ ID NO: 1526473 - protein, 17 aa, Mycobacterium tuberculosis
LTDLIYAHHPRFTGVRR

SEQ ID NO: 1526474 - protein, 29 aa, Mycobacterium tuberculosis
LTDPEVLEWRYPVLLREFAVRQGSGGAGR

SEQ ID NO: 1526475 - protein, 26 aa, Mycobacterium tuberculosis
LTEFKAMFQMKFYAVALFRSRGVPPT

SEQ ID NO: 1526476 - protein, 17 aa, Mycobacterium tuberculosis
LTERPDLLMAATEDLLH

SEQ ID NO: 1526477 - protein, 18 aa, Mycobacterium tuberculosis
LTERRLEFTRSLRRVFHD

SEQ ID NO: 1526478 - protein, 19 aa, Mycobacterium tuberculosis
LTFDVIHLRGHTPGSIALA

SEQ ID NO: 1526479 - protein, 25 aa, Mycobacterium tuberculosis
LTGDYLAELTMLILGRDRMKNPDRG

SEQ ID NO: 1526480 - protein, 19 aa, Mycobacterium tuberculosis
LTGLDGTDGITPNGGNGGN

SEQ ID NO: 1526481 - protein, 17 aa, Mycobacterium tuberculosis
LTGRSPILLAGMTPTTV

SEQ ID NO: 1526482 - protein, 20 aa, Mycobacterium tuberculosis
LTGTLPNRLYWLSANIDPAG

SEQ ID NO: 1526483 - protein, 26 aa, Mycobacterium tuberculosis
LTGVMTFGLPLAMTLNAVGSPITTAI

SEQ ID NO: 1526484 - protein, 17 aa, Mycobacterium tuberculosis
LTHPRPAKTTAGPVWVF

SEQ ID NO: 1526485 - protein, 18 aa, Mycobacterium tuberculosis
LTINIRIPVNITLNELPE

SEQ ID NO: 1526486 - protein, 18 aa, Mycobacterium tuberculosis
LTINNVLLRDIRIQAVQT

SEQ ID NO: 1526487 - protein, 21 aa, Mycobacterium tuberculosis
LTIPGFTIPGGTLIPTLPLGL

SEQ ID NO: 1526488 - protein, 17 aa, Mycobacterium tuberculosis
LTKLRANGIRRIVMLTG

SEQ ID NO: 1526489 - protein, 19 aa, Mycobacterium tuberculosis
LTLASLKWVLANRATLRGT

SEQ ID NO: 1526490 - protein, 22 aa, Mycobacterium tuberculosis
LTLIARYLDRYGIRADTIRITS

SEQ ID NO: 1526491 - protein, 26 aa, Mycobacterium tuberculosis
LTLLDSLGNPALWSNSLHWAGVHAGI

SEQ ID NO: 1526492 - protein, 20 aa, Mycobacterium tuberculosis
LTLPPVGPSIGWRTSTRLPR

SEQ ID NO: 1526493 - protein, 17 aa, Mycobacterium tuberculosis
LTLQPVTAHRIMTGAPV

SEQ ID NO: 1526494 - protein, 17 aa, Mycobacterium tuberculosis
LTLRRFQRAGHRPIVLA

SEQ ID NO: 1526495 - protein, 26 aa, Mycobacterium tuberculosis
LTLTPETPLAAVTRYFAAYNLVCGPV

SEQ ID NO: 1526496 - protein, 23 aa, Mycobacterium tuberculosis
LTNDFFVNLLDMGITWEPSPADD

SEQ ID NO: 1526497 - protein, 18 aa, Mycobacterium tuberculosis
LTNVPDALVGPCWPAVFR

SEQ ID NO: 1526498 - protein, 18 aa, Mycobacterium tuberculosis
LTPADRIAALTLAHAYSR

SEQ ID NO: 1526499 - protein, 22 aa, Mycobacterium tuberculosis
LTPETPLAAVTRYFAAYNLVCG

SEQ ID NO: 1526500 - protein, 20 aa, Mycobacterium tuberculosis
LTPPALFIGGQYDVGTIWGA

SEQ ID NO: 1526501 - protein, 25 aa, Mycobacterium tuberculosis
LTPQALIDLVASRSYCITSPAQVRT

SEQ ID NO: 1526502 - protein, 17 aa, Mycobacterium tuberculosis
LTQLLELRPDLAQPPPG

SEQ ID NO: 1526503 - protein, 20 aa, Mycobacterium tuberculosis
LTQRTILRLLDPSISAAGIL

SEQ ID NO: 1526504 - protein, 25 aa, Mycobacterium tuberculosis
LTRAKARLRWREKELVGVGLARLNP

SEQ ID NO: 1526505 - protein, 19 aa, Mycobacterium tuberculosis
LTRLAVHQKTGVWSRLMLD

SEQ ID NO: 1526506 - protein, 17 aa, Mycobacterium tuberculosis
LTRRALLRWGAGAGAGA

SEQ ID NO: 1526507 - protein, 20 aa, Mycobacterium tuberculosis
LTSATLGGLALPLQQTIDAI

SEQ ID NO: 1526508 - protein, 24 aa, Mycobacterium tuberculosis
LTSTRWRDPYAGTPWHKHVPAAIG

SEQ ID NO: 1526509 - protein, 19 aa, Mycobacterium tuberculosis
LTSWIALVTSMPRGQDSVQ

SEQ ID NO: 1526510 - protein, 18 aa, Mycobacterium tuberculosis
LTTILDPSLPLTVTEWDE

SEQ ID NO: 1526511 - protein, 23 aa, Mycobacterium tuberculosis
LTTRVIDLIMPIGKGQRALIVSP

SEQ ID NO: 1526512 - protein, 20 aa, Mycobacterium tuberculosis
LTVATIVRRHWPTPSLARVD

SEQ ID NO: 1526513 - protein, 27 aa, Mycobacterium tuberculosis
LTVHSARWRPWRSYATQHLWTTLEHPG

SEQ ID NO: 1526514 - protein, 21 aa, Mycobacterium tuberculosis
LTVPEKPRELWFSHMAVAAAG

SEQ ID NO: 1526515 - protein, 19 aa, Mycobacterium tuberculosis
LTVPGIHLPSTTIGAFAIP

SEQ ID NO: 1526516 - protein, 20 aa, Mycobacterium tuberculosis
LTVPGIHLPSTTIGAFAIPG

SEQ ID NO: 1526517 - protein, 17 aa, Mycobacterium tuberculosis
LTVPPWAVAGLGSQAEL

SEQ ID NO: 1526518 - protein, 20 aa, Mycobacterium tuberculosis
LTVPTITLTIGGPTVTVPIS

SEQ ID NO: 1526519 - protein, 17 aa, Mycobacterium tuberculosis
LTYIFGIGRTRSNEILA

SEQ ID NO: 1526520 - protein, 22 aa, Mycobacterium tuberculosis
LVAERLAPGAHRWWQAGHRSSE

SEQ ID NO: 1526521 - protein, 26 aa, Mycobacterium tuberculosis
LVAGDVRLLLPMPADWSYAEAAAISA

SEQ ID NO: 1526522 - protein, 20 aa, Mycobacterium tuberculosis
LVAHPQSWKLLRGKVTLPSH

SEQ ID NO: 1526523 - protein, 21 aa, Mycobacterium tuberculosis
LVAHPQSWKLLRGKVTLPSHD

SEQ ID NO: 1526524 - protein, 19 aa, Mycobacterium tuberculosis
LVAIHQWGAGAAPRRGRRS

SEQ ID NO: 1526525 - protein, 18 aa, Mycobacterium tuberculosis
LVALAILDTVGVSPEQAG

SEQ ID NO: 1526526 - protein, 20 aa, Mycobacterium tuberculosis
LVALGELFAYRWSRCGAARS

SEQ ID NO: 1526527 - protein, 26 aa, Mycobacterium tuberculosis
LVALGHQLAAVPYLESVVLAAGALAR

SEQ ID NO: 1526528 - protein, 17 aa, Mycobacterium tuberculosis
LVAMNSLWELNVPRRDL

SEQ ID NO: 1526529 - protein, 23 aa, Mycobacterium tuberculosis
LVANDRWWGTKAITKRITVWPQG

SEQ ID NO: 1526530 - protein, 20 aa, Mycobacterium tuberculosis
LVAQRIAAFGAYVVAYDPYV

SEQ ID NO: 1526531 - protein, 18 aa, Mycobacterium tuberculosis
LVARIAALPVNQLIMVKL

SEQ ID NO: 1526532 - protein, 22 aa, Mycobacterium tuberculosis
LVARLYARRYLADQGPLRGIDA

SEQ ID NO: 1526533 - protein, 17 aa, Mycobacterium tuberculosis
LVAYRRRIEPQGGPVYG

SEQ ID NO: 1526534 - protein, 18 aa, Mycobacterium tuberculosis
LVCTLICAGRRIGGLGAG

SEQ ID NO: 1526535 - protein, 20 aa, Mycobacterium tuberculosis
LVDAPLPAWSHRVLFYDREG

SEQ ID NO: 1526536 - protein, 19 aa, Mycobacterium tuberculosis
LVDAPLPSWTHRTLMLSRE

SEQ ID NO: 1526537 - protein, 29 aa, Mycobacterium tuberculosis
LVDDDLADLFLPRPLRWLAGATRSAVLRR

SEQ ID NO: 1526538 - protein, 17 aa, Mycobacterium tuberculosis
LVDLFEALFVPVPSGSA

SEQ ID NO: 1526539 - protein, 29 aa, Mycobacterium tuberculosis
LVDLPPTTWHHQRFWVTDRSAMSELAATH

SEQ ID NO: 1526540 - protein, 17 aa, Mycobacterium tuberculosis
LVDLVRHAVLFAADDAD

SEQ ID NO: 1526541 - protein, 17 aa, Mycobacterium tuberculosis
LVDLYPLVRKSIRVGTD

SEQ ID NO: 1526542 - protein, 25 aa, Mycobacterium tuberculosis
LVDSGAGTWLLWDGKRSPIDLADHA

SEQ ID NO: 1526543 - protein, 18 aa, Mycobacterium tuberculosis
LVDYPLEQYIRDAKIDSL

SEQ ID NO: 1526544 - protein, 28 aa, Mycobacterium tuberculosis
LVEAAAVPVAFLTAFYGLSVLAEVAAGQ

SEQ ID NO: 1526545 - protein, 17 aa, Mycobacterium tuberculosis
LVELALSAPTFQQLMQR

SEQ ID NO: 1526546 - protein, 19 aa, Mycobacterium tuberculosis
LVEQFLTQFYGDQAALDDA

SEQ ID NO: 1526547 - protein, 17 aa, Mycobacterium tuberculosis
LVFNRTHPMLSALPIER

SEQ ID NO: 1526548 - protein, 17 aa, Mycobacterium tuberculosis
LVFSGRFFDAEEALALG

SEQ ID NO: 1526549 - protein, 22 aa, Mycobacterium tuberculosis
LVFVADGIIGGAISFGGHVWDH

SEQ ID NO: 1526550 - protein, 19 aa, Mycobacterium tuberculosis
LVFVTNFDSNTVSVIDPNT

SEQ ID NO: 1526551 - protein, 19 aa, Mycobacterium tuberculosis
LVFVTNFDSNTVSVIDPTT

SEQ ID NO: 1526552 - protein, 19 aa, Mycobacterium tuberculosis
LVGGIWQGPSSVAMAAAAA

SEQ ID NO: 1526553 - protein, 28 aa, Mycobacterium tuberculosis
LVGGVGPGPPGLWGHWGGRAGRAAAPSG

SEQ ID NO: 1526554 - protein, 22 aa, Mycobacterium tuberculosis
LVGLMGIPPLDWDPDEAFDRLQ

SEQ ID NO: 1526555 - protein, 20 aa, Mycobacterium tuberculosis
LVGRLSVPAAWSTAAPATTA

SEQ ID NO: 1526556 - protein, 18 aa, Mycobacterium tuberculosis
LVHGIGFQRDVLGAEPAT

SEQ ID NO: 1526557 - protein, 19 aa, Mycobacterium tuberculosis
LVHGLSWSSWSRSRRSTRP

SEQ ID NO: 1526558 - protein, 17 aa, Mycobacterium tuberculosis
LVHLTVVASHRGVAQPL

SEQ ID NO: 1526559 - protein, 24 aa, Mycobacterium tuberculosis
LVHPGDLVILIAYATMDDARATHI

SEQ ID NO: 1526560 - protein, 25 aa, Mycobacterium tuberculosis
LVHRERAGLLILPGPAPMVARTIVE

SEQ ID NO: 1526561 - protein, 23 aa, Mycobacterium tuberculosis
LVHSIDYIRPQLFTNSFTPLEVS

SEQ ID NO: 1526562 - protein, 27 aa, Mycobacterium tuberculosis
LVHVHRSWLQIPGDHRRYLLDRHTVQC

SEQ ID NO: 1526563 - protein, 18 aa, Mycobacterium tuberculosis
LVIGSWPDPPGLVAASNR

SEQ ID NO: 1526564 - protein, 18 aa, Mycobacterium tuberculosis
LVKVIRDLFNEDFVGLIV

SEQ ID NO: 1526565 - protein, 18 aa, Mycobacterium tuberculosis
LVLAIYNPASVTRTWQVG

SEQ ID NO: 1526566 - protein, 18 aa, Mycobacterium tuberculosis
LVLLDGASMWFRSFFGVP

SEQ ID NO: 1526567 - protein, 18 aa, Mycobacterium tuberculosis
LVLQRLSDARRLGHPVLA

SEQ ID NO: 1526568 - protein, 19 aa, Mycobacterium tuberculosis
LVLSPQWPEALGPLEFPFV

SEQ ID NO: 1526569 - protein, 35 aa, Mycobacterium tuberculosis
LVLVPGMAFSIEPGIYFPGRWGARIEDIVIVTEDG

SEQ ID NO: 1526570 - protein, 19 aa, Mycobacterium tuberculosis
LVMQRWVYHSTRLAVPTHT

SEQ ID NO: 1526571 - protein, 19 aa, Mycobacterium tuberculosis
LVMTATPIPRTVALTVYGD

SEQ ID NO: 1526572 - protein, 24 aa, Mycobacterium tuberculosis
LVNARYLRICVLTQYKSHSLDRHI

SEQ ID NO: 1526573 - protein, 21 aa, Mycobacterium tuberculosis
LVNLVIALLSTRGYITAEKIR

SEQ ID NO: 1526574 - protein, 26 aa, Mycobacterium tuberculosis
LVNYNTMYFALARRAALRRHLAGARR

SEQ ID NO: 1526575 - protein, 20 aa, Mycobacterium tuberculosis
LVPNLGCGLGWRGTRFTVRR

SEQ ID NO: 1526576 - protein, 30 aa, Mycobacterium tuberculosis
LVRAEVAVLKILALQFIMSDPRHLETQARQ

SEQ ID NO: 1526577 - protein, 26 aa, Mycobacterium tuberculosis
LVRAIYFFPYRSPWCRGWLVIAGVLA

SEQ ID NO: 1526578 - protein, 21 aa, Mycobacterium tuberculosis
LVRGGVVFSGYWRNEQATTEA

SEQ ID NO: 1526579 - protein, 19 aa, Mycobacterium tuberculosis
LVRGIPPGHVGVAWRGTWH

SEQ ID NO: 1526580 - protein, 17 aa, Mycobacterium tuberculosis
LVRLFVCQRQRRVGLLR

SEQ ID NO: 1526581 - protein, 17 aa, Mycobacterium tuberculosis
LVRRTFAAFARGDLAEL

SEQ ID NO: 1526582 - protein, 22 aa, Mycobacterium tuberculosis
LVRSTPGLRYRIYRPAVVVGDS

SEQ ID NO: 1526583 - protein, 19 aa, Mycobacterium tuberculosis
LVRWLSGMPSTRASVEAYI

SEQ ID NO: 1526584 - protein, 30 aa, Mycobacterium tuberculosis
LVSLQSQHPDFLRLFYLLSMERSQDPAVAA

SEQ ID NO: 1526585 - protein, 24 aa, Mycobacterium tuberculosis
LVTAAAANLAGIRSALSEAAAAAS

SEQ ID NO: 1526586 - protein, 26 aa, Mycobacterium tuberculosis
LVTGYDILFFWVARMMMFGTFVGDDA

SEQ ID NO: 1526587 - protein, 17 aa, Mycobacterium tuberculosis
LVTLGLNLFSRGVDPQI

SEQ ID NO: 1526588 - protein, 24 aa, Mycobacterium tuberculosis
LVTLTVVPRCCAPGRRPARCWPSS

SEQ ID NO: 1526589 - protein, 21 aa, Mycobacterium tuberculosis
LVVALERLGRWCVPGPVTESI

SEQ ID NO: 1526590 - protein, 23 aa, Mycobacterium tuberculosis
LVVASPGFSPATPLLAAAAAAGV

SEQ ID NO: 1526591 - protein, 29 aa, Mycobacterium tuberculosis
LVVDLATRRKIFIPILRVAAIEPHAVTLS

SEQ ID NO: 1526592 - protein, 17 aa, Mycobacterium tuberculosis
LVVFEDGLPRKSDYRHF

SEQ ID NO: 1526593 - protein, 25 aa, Mycobacterium tuberculosis
LVVGHPYVDIWQAVKPQRVGLAAWP

SEQ ID NO: 1526594 - protein, 19 aa, Mycobacterium tuberculosis
LVVGLIDELRKRHPDLDEN

SEQ ID NO: 1526595 - protein, 17 aa, Mycobacterium tuberculosis
LVVHPYTLTGPIVIGSF

SEQ ID NO: 1526596 - protein, 17 aa, Mycobacterium tuberculosis
LVVLDNCEHLLDATAAL

SEQ ID NO: 1526597 - protein, 31 aa, Mycobacterium tuberculosis
LVVLLHGFPESWYSWRHQIPALAGAGYRVVA

SEQ ID NO: 1526598 - protein, 20 aa, Mycobacterium tuberculosis
LVVMHDLWLPLLTAAGDLDK

SEQ ID NO: 1526599 - protein, 26 aa, Mycobacterium tuberculosis
LVVQRVPYFQVWNLTGQPAAVVPWDF

SEQ ID NO: 1526600 - protein, 17 aa, Mycobacterium tuberculosis
LVVSDECYLGLGWDAEP

SEQ ID NO: 1526601 - protein, 18 aa, Mycobacterium tuberculosis
LVVSLAKRYTGRGMPLLD

SEQ ID NO: 1526602 - protein, 19 aa, Mycobacterium tuberculosis
LWAATFLRRRGAAADAVLL

SEQ ID NO: 1526603 - protein, 17 aa, Mycobacterium tuberculosis
LWDLASRLEGRMAAIGM

SEQ ID NO: 1526604 - protein, 17 aa, Mycobacterium tuberculosis
LWEALLRGDDLVGEIPA

SEQ ID NO: 1526605 - protein, 17 aa, Mycobacterium tuberculosis
LWPHRHGTDAMFAAALR

SEQ ID NO: 1526606 - protein, 17 aa, Mycobacterium tuberculosis
LWPRRRKLSALRRGDTP

SEQ ID NO: 1526607 - protein, 41 aa, Mycobacterium tuberculosis
LWRGDYQGLLGFSYRPAVLPQTPFLDLTLTGGLGSVVIPAI

SEQ ID NO: 1526608 - protein, 18 aa, Mycobacterium tuberculosis
LWVGDYQGLFGVSAGSSI

SEQ ID NO: 1526609 - protein, 26 aa, Mycobacterium tuberculosis
LYAGWWQHLSTLGAVPRVLVWDGEGA

SEQ ID NO: 1526610 - protein, 21 aa, Mycobacterium tuberculosis
LYATQLMTELSERGEKLPAAQ

SEQ ID NO: 1526611 - protein, 19 aa, Mycobacterium tuberculosis
LYGDERIFAALAKRLPKLA

SEQ ID NO: 1526612 - protein, 31 aa, Mycobacterium tuberculosis
LYGSLKMWAHLQRQGFRWPSATVKTIMRANG

SEQ ID NO: 1526613 - protein, 18 aa, Mycobacterium tuberculosis
LYHAGVKLDWMVATTLLT

SEQ ID NO: 1526614 - protein, 29 aa, Mycobacterium tuberculosis
LYHLSRPAEALAWMCDRAVDLLLLETCVS

SEQ ID NO: 1526615 - protein, 20 aa, Mycobacterium tuberculosis
LYRYHKAGASTWTPWRHHRI

SEQ ID NO: 1526616 - protein, 19 aa, Mycobacterium tuberculosis
LYVEAMALSYIGDSAARTI

SEQ ID NO: 1526617 - protein, 23 aa, Mycobacterium tuberculosis
LYYADPCALFDLCKRRYSRSVAL

SEQ ID NO: 1526618 - protein, 23 aa, Mycobacterium tuberculosis
MAAAAAPYAGWLGSVAAAAEAVA

SEQ ID NO: 1526619 - protein, 23 aa, Mycobacterium tuberculosis
MAAAAAPYAGWLTAAAAQSAGAA

SEQ ID NO: 1526620 - protein, 34 aa, Mycobacterium tuberculosis
MAAELLGIPWVELNPHPLYLPSKGLPPIGSGLAA

SEQ ID NO: 1526621 - protein, 25 aa, Mycobacterium tuberculosis
MADLFHARVALWFIREVFEVMRATP

SEQ ID NO: 1526622 - protein, 23 aa, Mycobacterium tuberculosis
MADPGSVSYLFSRKGVVTLEKNG

SEQ ID NO: 1526623 - protein, 19 aa, Mycobacterium tuberculosis
MADRFPAVLPVGEVLAIVT

SEQ ID NO: 1526624 - protein, 25 aa, Mycobacterium tuberculosis
MAELEAQGLFFPGGHCRGVCLGGYL

SEQ ID NO: 1526625 - protein, 26 aa, Mycobacterium tuberculosis
MAELEAQGLFFPGGHCRGVCLGGYLL

SEQ ID NO: 1526626 - protein, 23 aa, Mycobacterium tuberculosis
MAGAAAPYVGWLSAAAGQAELSA

SEQ ID NO: 1526627 - protein, 39 aa, Mycobacterium tuberculosis
MAGNFSFGGLFQTRVIELAWALLTNSLAAGGYGLDPERI

SEQ ID NO: 1526628 - protein, 29 aa, Mycobacterium tuberculosis
MAGTNVWWGHAEAALLRLVEERHIPVLMN

SEQ ID NO: 1526629 - protein, 34 aa, Mycobacterium tuberculosis
MAHMWFGDLVTMTWWDDLWLNESFATFASVLCQS

SEQ ID NO: 1526630 - protein, 17 aa, Mycobacterium tuberculosis
MAKGAGMLAPSLATMLC

SEQ ID NO: 1526631 - protein, 27 aa, Mycobacterium tuberculosis
MAMVAAAQPYLAWLTYTAEAAAHAGSQ

SEQ ID NO: 1526632 - protein, 27 aa, Mycobacterium tuberculosis
MANAAGPYASWLTAAGAQAELAARQAR

SEQ ID NO: 1526633 - protein, 29 aa, Mycobacterium tuberculosis
MANHTTGWVRMDFVVPSRGLIGWRTDFLT

SEQ ID NO: 1526634 - protein, 19 aa, Mycobacterium tuberculosis
MANPIAFLCGAIQAASRLG

SEQ ID NO: 1526635 - protein, 18 aa, Mycobacterium tuberculosis
MAPFTSLTRPHWVSDGGL

SEQ ID NO: 1526636 - protein, 26 aa, Mycobacterium tuberculosis
MAQARVRAIFYTPRGPHGVHDRVARR

SEQ ID NO: 1526637 - protein, 17 aa, Mycobacterium tuberculosis
MARSYLGPEFDIHCGGM

SEQ ID NO: 1526638 - protein, 17 aa, Mycobacterium tuberculosis
MARYIVRIEPVCFVAGR

SEQ ID NO: 1526639 - protein, 25 aa, Mycobacterium tuberculosis
MASLRGLLKFRTGVRPPVPLDEVEP

SEQ ID NO: 1526640 - protein, 30 aa, Mycobacterium tuberculosis
MATARYGEFLRASLPPFWQTTNATQVRAAL

SEQ ID NO: 1526641 - protein, 17 aa, Mycobacterium tuberculosis
MATLPPARTVRLAPRAS

SEQ ID NO: 1526642 - protein, 20 aa, Mycobacterium tuberculosis
MATPAMFIEFSRQRALSADG

SEQ ID NO: 1526643 - protein, 22 aa, Mycobacterium tuberculosis
MATVAVLEGRLAAWAIELDAAA

SEQ ID NO: 1526644 - protein, 23 aa, Mycobacterium tuberculosis
MAVATQYLAWLSTAAAQAEQAAA

SEQ ID NO: 1526645 - protein, 32 aa, Mycobacterium tuberculosis
MCGCIAGWPLDRDRPLWEMWVIEGGARSDTVA

SEQ ID NO: 1526646 - protein, 30 aa, Mycobacterium tuberculosis
MCGRAYSPRFLWMWPNARISVMGGEQAASV

SEQ ID NO: 1526647 - protein, 18 aa, Mycobacterium tuberculosis
MCRMWRGWCRPVRIARRR

SEQ ID NO: 1526648 - protein, 19 aa, Mycobacterium tuberculosis
MDCTCSLPCWPPASVRSEP

SEQ ID NO: 1526649 - protein, 18 aa, Mycobacterium tuberculosis
MDEWDEWQAWNEWVAENA

SEQ ID NO: 1526650 - protein, 18 aa, Mycobacterium tuberculosis
MDMNIDVDPDWGPPPGED

SEQ ID NO: 1526651 - protein, 25 aa, Mycobacterium tuberculosis
MDPRQRLALELTWELLEDAFVVPET

SEQ ID NO: 1526652 - protein, 26 aa, Mycobacterium tuberculosis
MDPRQRLALELTWELLEDAFVVPETL

SEQ ID NO: 1526653 - protein, 30 aa, Mycobacterium tuberculosis
MDTIDGPYYLFGVLAKLAVLPSFTPMLLPD

SEQ ID NO: 1526654 - protein, 39 aa, Mycobacterium tuberculosis
MDTIDGPYYLFGVLAKLAVLPSFTPMLLPDIGRTNIVPV

SEQ ID NO: 1526655 - protein, 25 aa, Mycobacterium tuberculosis
MEAAKPFVRWLTDLCVQLSEVERQI

SEQ ID NO: 1526656 - protein, 17 aa, Mycobacterium tuberculosis
MELLSLPQDEWAGRLRR

SEQ ID NO: 1526657 - protein, 17 aa, Mycobacterium tuberculosis
MELVGHDFFLFYDKDTE

SEQ ID NO: 1526658 - protein, 25 aa, Mycobacterium tuberculosis
MEPITDSWYLTSIRAGLEPWSDGVG

SEQ ID NO: 1526659 - protein, 23 aa, Mycobacterium tuberculosis
MEYMLPRLRGWGESMSRQAGGRA

SEQ ID NO: 1526660 - protein, 18 aa, Mycobacterium tuberculosis
MFARGLVRKTYLARAPVA

SEQ ID NO: 1526661 - protein, 17 aa, Mycobacterium tuberculosis
MFGIDYPIVSAPMDLIA

SEQ ID NO: 1526662 - protein, 19 aa, Mycobacterium tuberculosis
MFGIGRQRRSWRGRQRSRD

SEQ ID NO: 1526663 - protein, 35 aa, Mycobacterium tuberculosis
MFGYAINATPELMPLPIALAHRLSRRLTEVRKNGV

SEQ ID NO: 1526664 - protein, 18 aa, Mycobacterium tuberculosis
MFVPFHDGVISQFEGYSE

SEQ ID NO: 1526665 - protein, 18 aa, Mycobacterium tuberculosis
MGAVRFGIYQAGCNSSLA

SEQ ID NO: 1526666 - protein, 35 aa, Mycobacterium tuberculosis
MGCGDACPYFPGVSYRNWKLPDPAGQPLDVVRMIR

SEQ ID NO: 1526667 - protein, 25 aa, Mycobacterium tuberculosis
MGEVVDRSIFMWTVAPHAEYDHDFA

SEQ ID NO: 1526668 - protein, 17 aa, Mycobacterium tuberculosis
MGFGGGVGLGLGGQAGG

SEQ ID NO: 1526669 - protein, 17 aa, Mycobacterium tuberculosis
MGGGRVLMDTWYRIPAF

SEQ ID NO: 1526670 - protein, 25 aa, Mycobacterium tuberculosis
MGIGFPPWDRWQCPVHRRLLRPGRY

SEQ ID NO: 1526671 - protein, 24 aa, Mycobacterium tuberculosis
MGKTFAFGVPLLQRITSGDGTRPL

SEQ ID NO: 1526672 - protein, 17 aa, Mycobacterium tuberculosis
MGLDIGPGSIKRFSTLL

SEQ ID NO: 1526673 - protein, 19 aa, Mycobacterium tuberculosis
MGNGAFWRGDQQGLFSAGY

SEQ ID NO: 1526674 - protein, 20 aa, Mycobacterium tuberculosis
MGNGAFWRGDQQGLFSAGYR

SEQ ID NO: 1526675 - protein, 17 aa, Mycobacterium tuberculosis
MGQRRQVRMVFAERAAG

SEQ ID NO: 1526676 - protein, 29 aa, Mycobacterium tuberculosis
MGRGFTWARQLPWLTLLGAVYTYDAPWHR

SEQ ID NO: 1526677 - protein, 19 aa, Mycobacterium tuberculosis
MGRHAGWIALNAGLASGAH

SEQ ID NO: 1526678 - protein, 31 aa, Mycobacterium tuberculosis
MGSSYLLNGLFFSLPWYYRSGYDVLLYTLPF

SEQ ID NO: 1526679 - protein, 28 aa, Mycobacterium tuberculosis
MGTPEDLVGMCLFLLSDSASWITGQIFN

SEQ ID NO: 1526680 - protein, 19 aa, Mycobacterium tuberculosis
MGWSPFYPQFDRSSLDVAD

SEQ ID NO: 1526681 - protein, 17 aa, Mycobacterium tuberculosis
MHHGAVLEGAWGSGEAT

SEQ ID NO: 1526682 - protein, 17 aa, Mycobacterium tuberculosis
MHQVLMAQLALAGGDAI

SEQ ID NO: 1526683 - protein, 18 aa, Mycobacterium tuberculosis
MIHALARLPQQGIVTLAT

SEQ ID NO: 1526684 - protein, 19 aa, Mycobacterium tuberculosis
MIRAAEQRGIDWRAIYAGR

SEQ ID NO: 1526685 - protein, 24 aa, Mycobacterium tuberculosis
MISELDLRQMLHVTPRHRCLGHHA

SEQ ID NO: 1526686 - protein, 21 aa, Mycobacterium tuberculosis
MISHFHYDPVWWNTQGAYTSQ

SEQ ID NO: 1526687 - protein, 18 aa, Mycobacterium tuberculosis
MIVAEELWIYASSGDRVA

SEQ ID NO: 1526688 - protein, 18 aa, Mycobacterium tuberculosis
MKALASRLATSSTLPIML

SEQ ID NO: 1526689 - protein, 17 aa, Mycobacterium tuberculosis
MKKLRTWFAADKTGFHL

SEQ ID NO: 1526690 - protein, 18 aa, Mycobacterium tuberculosis
MKTILALRHGVVPQNLHF

SEQ ID NO: 1526691 - protein, 26 aa, Mycobacterium tuberculosis
MKTLTNCWTFPIPSWESRSARWATVP

SEQ ID NO: 1526692 - protein, 22 aa, Mycobacterium tuberculosis
MLAAAAAWDGLAAELGLAAESF

SEQ ID NO: 1526693 - protein, 43 aa, Mycobacterium tuberculosis
MLAEATNVEQNLLNLINAPTQTLLGRPLIGDGANATTPGGAGG

SEQ ID NO: 1526694 - protein, 27 aa, Mycobacterium tuberculosis
MLAGLFDDDVFAWRGVLQSAAVHEFHE

SEQ ID NO: 1526695 - protein, 22 aa, Mycobacterium tuberculosis
MLARFPDLTLPTLDLTFYGATP

SEQ ID NO: 1526696 - protein, 18 aa, Mycobacterium tuberculosis
MLCGCLRAYSFTALGARR

SEQ ID NO: 1526697 - protein, 18 aa, Mycobacterium tuberculosis
MLCYVTPKEHLGLPDRKD

SEQ ID NO: 1526698 - protein, 28 aa, Mycobacterium tuberculosis
MLDAVELELYKRLPGDLSILTPSPASDT

SEQ ID NO: 1526699 - protein, 19 aa, Mycobacterium tuberculosis
MLDTAVLLGALPPRVSPVS

SEQ ID NO: 1526700 - protein, 22 aa, Mycobacterium tuberculosis
MLGGLALKWRWRQRVGSWKGRM

SEQ ID NO: 1526701 - protein, 17 aa, Mycobacterium tuberculosis
MLKSKIHRATVTCADLH

SEQ ID NO: 1526702 - protein, 18 aa, Mycobacterium tuberculosis
MLMDLKTLDWDDELLSLF

SEQ ID NO: 1526703 - protein, 17 aa, Mycobacterium tuberculosis
MLRIWTEDEPWEHRGKY

SEQ ID NO: 1526704 - protein, 18 aa, Mycobacterium tuberculosis
MLRYNFPGTGLTDDALRT

SEQ ID NO: 1526705 - protein, 25 aa, Mycobacterium tuberculosis
MLSGPQGLMRLWGQPWDTTRPRAGQ

SEQ ID NO: 1526706 - protein, 17 aa, Mycobacterium tuberculosis
MLTIVLRGEGFDTAVIG

SEQ ID NO: 1526707 - protein, 20 aa, Mycobacterium tuberculosis
MLTLQPVTAHRIMTGAPVPI

SEQ ID NO: 1526708 - protein, 18 aa, Mycobacterium tuberculosis
MLVLELSAGRWLSSNDWA

SEQ ID NO: 1526709 - protein, 21 aa, Mycobacterium tuberculosis
MLVSSWQMPGGIYAPMMHPWS

SEQ ID NO: 1526710 - protein, 26 aa, Mycobacterium tuberculosis
MMAAARDLQFELAARFRDEIADLKRE

SEQ ID NO: 1526711 - protein, 22 aa, Mycobacterium tuberculosis
MMMPFLEHFVMRSRYVDNPGLF

SEQ ID NO: 1526712 - protein, 20 aa, Mycobacterium tuberculosis
MMPALLDFWMDADSVYLSPA

SEQ ID NO: 1526713 - protein, 21 aa, Mycobacterium tuberculosis
MMPALLDFWMDADSVYLSPAP

SEQ ID NO: 1526714 - protein, 21 aa, Mycobacterium tuberculosis
MNGGFFPSVREYSVRYGLTER

SEQ ID NO: 1526715 - protein, 19 aa, Mycobacterium tuberculosis
MNGWYYLTRREDVLAALRN

SEQ ID NO: 1526716 - protein, 32 aa, Mycobacterium tuberculosis
MNYSVLPPEINSLRMFTGAGSAPMLAASVAWD

SEQ ID NO: 1526717 - protein, 17 aa, Mycobacterium tuberculosis
MPAFDIGDAGRMSFITD

SEQ ID NO: 1526718 - protein, 17 aa, Mycobacterium tuberculosis
MPAKLFDEWFPANKLVK

SEQ ID NO: 1526719 - protein, 17 aa, Mycobacterium tuberculosis
MPAMIPTGSPLSVTAVG

SEQ ID NO: 1526720 - protein, 26 aa, Mycobacterium tuberculosis
MPAPGLIRELRPLPTALPHPRTRRRR

SEQ ID NO: 1526721 - protein, 18 aa, Mycobacterium tuberculosis
MPATAAFPPPAGPPPVTA

SEQ ID NO: 1526722 - protein, 18 aa, Mycobacterium tuberculosis
MPATPMEFPPLPPVPPEP

SEQ ID NO: 1526723 - protein, 21 aa, Mycobacterium tuberculosis
MPEEHYTWLPRQDLLSVKEIS

SEQ ID NO: 1526724 - protein, 27 aa, Mycobacterium tuberculosis
MPETVTWILRDLGVYAIRLSDDVPGFG

SEQ ID NO: 1526725 - protein, 17 aa, Mycobacterium tuberculosis
MPGFQVPEFRRKAVVIA

SEQ ID NO: 1526726 - protein, 27 aa, Mycobacterium tuberculosis
MPGGMYRNQVWFPYPGSNVALCVGMCG

SEQ ID NO: 1526727 - protein, 39 aa, Mycobacterium tuberculosis; identical to SEQ ID NO: 220704

SEQ ID NO: 1526728 - protein, 26 aa, Mycobacterium tuberculosis
MPGVPNHWHLPLRWMTPTPRRQRRRS

SEQ ID NO: 1526729 - protein, 17 aa, Mycobacterium tuberculosis
MPMMLMPMSISGAGAGM

SEQ ID NO: 1526730 - protein, 23 aa, Mycobacterium tuberculosis
MPNAGLPVLGAKGAEYPLLPDEL

SEQ ID NO: 1526731 - protein, 18 aa, Mycobacterium tuberculosis
MPNLFFLLGPNTGLGHNS

SEQ ID NO: 1526732 - protein, 25 aa, Mycobacterium tuberculosis
MPNRIKWTIVRYKPPEGMTLNGDGV

SEQ ID NO: 1526733 - protein, 17 aa, Mycobacterium tuberculosis
MPRLMAQQIDEAGGALL

SEQ ID NO: 1526734 - protein, 26 aa, Mycobacterium tuberculosis
MQAGGLTVYSGEWWHFDGPGPGPGAG

SEQ ID NO: 1526735 - protein, 25 aa, Mycobacterium tuberculosis
MQFAYQFPQLVDRLILVSAGGVTKD

SEQ ID NO: 1526736 - protein, 20 aa, Mycobacterium tuberculosis
MQIKAIFSVLLREYEFEMAQ

SEQ ID NO: 1526737 - protein, 24 aa, Mycobacterium tuberculosis
MQNGYLLLMQVGDGSALAALAATG

SEQ ID NO: 1526738 - protein, 27 aa, Mycobacterium tuberculosis
MQQVYDRYIAPHYLGYAFSGLYTPAQF

SEQ ID NO: 1526739 - protein, 29 aa, Mycobacterium tuberculosis
MRDGVRIAIDLYLPAGLTSAARLPAILHQ

SEQ ID NO: 1526740 - protein, 31 aa, Mycobacterium tuberculosis
MRDIRKHIAWYLHGFPAGSALRRALAMVKTF

SEQ ID NO: 1526741 - protein, 31 aa, Mycobacterium tuberculosis; identical to SEQ ID NO: 236661

SEQ ID NO: 1526742 - protein, 17 aa, Mycobacterium tuberculosis
MREFVAALRAIWLAWQD

SEQ ID NO: 1526743 - protein, 21 aa, Mycobacterium tuberculosis
MREQTQKRHFCAAKGCFCVCS

SEQ ID NO: 1526744 - protein, 25 aa, Mycobacterium tuberculosis
MRIAGVGLGQLLLALDATVVSLVDA

SEQ ID NO: 1526745 - protein, 18 aa, Mycobacterium tuberculosis
MRRALEICHRFGRADRPA

SEQ ID NO: 1526746 - protein, 20 aa, Mycobacterium tuberculosis
MRREQPLPHGLRGLLTELHR

SEQ ID NO: 1526747 - protein, 25 aa, Mycobacterium tuberculosis
MRREQPLPLGLRRLLTDLHNAGAAV

SEQ ID NO: 1526748 - protein, 17 aa, Mycobacterium tuberculosis
MRRLRGRFYDGMRALHG

SEQ ID NO: 1526749 - protein, 17 aa, Mycobacterium tuberculosis
MRTAAPDFRLFWDNAYA

SEQ ID NO: 1526750 - protein, 26 aa, Mycobacterium tuberculosis
MSAMQPLQSMVGMFANPGALGMGGAA

SEQ ID NO: 1526751 - protein, 17 aa, Mycobacterium tuberculosis
MSEVHLARDLRLHRDVA

SEQ ID NO: 1526752 - protein, 19 aa, Mycobacterium tuberculosis
MSFVIANPEMLAAAATDLA

SEQ ID NO: 1526753 - protein, 37 aa, Mycobacterium tuberculosis
MSGNFSNGLLWRGDHEGLFSLFYSLDVPRITIVDAHL

SEQ ID NO: 1526754 - protein, 19 aa, Mycobacterium tuberculosis
MSLAPLAYTLFQRTMRHDP

SEQ ID NO: 1526755 - protein, 22 aa, Mycobacterium tuberculosis
MSLVGRWRRKGIAVDFATLAAT

SEQ ID NO: 1526756 - protein, 19 aa, Mycobacterium tuberculosis
MSQMTWRSMIRDGLTMRHG

SEQ ID NO: 1526757 - protein, 26 aa, Mycobacterium tuberculosis
MSRPSMPFRLHWAAIRASRTWCCPAA

SEQ ID NO: 1526758 - protein, 19 aa, Mycobacterium tuberculosis
MSRRQFGQTLFEHQALRLR

SEQ ID NO: 1526759 - protein, 19 aa, Mycobacterium tuberculosis
MSTSTWRWRLSLLEGCTVS

SEQ ID NO: 1526760 - protein, 26 aa, Mycobacterium tuberculosis
MSVGQTLFLFDFRDGIELNPIVIPGS

SEQ ID NO: 1526761 - protein, 18 aa, Mycobacterium tuberculosis
MSVIEKYLYGYFGGSVRS

SEQ ID NO: 1526762 - protein, 20 aa, Mycobacterium tuberculosis
MSVIEKYLYGYFGGSVRSER

SEQ ID NO: 1526763 - protein, 17 aa, Mycobacterium tuberculosis
MTELSERGEKLPAAQRR

SEQ ID NO: 1526764 - protein, 23 aa, Mycobacterium tuberculosis
MTESMLELLLRELDVHPGDVIEV

SEQ ID NO: 1526765 - protein, 22 aa, Mycobacterium tuberculosis
MTGAIIILIRLTNTVPSTVRLF

SEQ ID NO: 1526766 - protein, 17 aa, Mycobacterium tuberculosis
MTGMPMVPPGALGAGAE

SEQ ID NO: 1526767 - protein, 17 aa, Mycobacterium tuberculosis
MTLRWLTDRFAGKPLTD

SEQ ID NO: 1526768 - protein, 24 aa, Mycobacterium tuberculosis
MTMNGAVLPILALYVVAAEEQGVA

SEQ ID NO: 1526769 - protein, 29 aa, Mycobacterium tuberculosis
MTPDLSTLRLIPWLPGTALVIADLVWADG

SEQ ID NO: 1526770 - protein, 19 aa, Mycobacterium tuberculosis
MTPKVPYYSATLFDPREQP

SEQ ID NO: 1526771 - protein, 20 aa, Mycobacterium tuberculosis
MTPKVPYYSATLFDPREQPV

SEQ ID NO: 1526772 - protein, 19 aa, Mycobacterium tuberculosis
MTRYSWQSYLIATASFAEW

SEQ ID NO: 1526773 - protein, 22 aa, Mycobacterium tuberculosis
MTSGRRWRVWRERRLNRQRRRR

SEQ ID NO: 1526774 - protein, 22 aa, Mycobacterium tuberculosis
MTTAQLRPIAPQKLHFSENLSV

SEQ ID NO: 1526775 - protein, 18 aa, Mycobacterium tuberculosis
MTVPPAEVAANRALLAAL

SEQ ID NO: 1526776 - protein, 18 aa, Mycobacterium tuberculosis
MTWRDYAAQVRRVAAGLA

SEQ ID NO: 1526777 - protein, 21 aa, Mycobacterium tuberculosis
MVAAATPYVAWLSQAAARAEQ

SEQ ID NO: 1526778 - protein, 27 aa, Mycobacterium tuberculosis
MVAGHRRHIGGPHQLVLGLGGRDRRRV

SEQ ID NO: 1526779 - protein, 23 aa, Mycobacterium tuberculosis
MVARPMINVFPSGRKEVFRLRLA

SEQ ID NO: 1526780 - protein, 18 aa, Mycobacterium tuberculosis
MVDAGYQCALLAPTEVLA

SEQ ID NO: 1526781 - protein, 24 aa, Mycobacterium tuberculosis
MVHAALRQVLGPNAVQAGSLNRPG

SEQ ID NO: 1526782 - protein, 24 aa, Mycobacterium tuberculosis
MVHGYVNFALVVPAAAEATGRGLA

SEQ ID NO: 1526783 - protein, 17 aa, Mycobacterium tuberculosis
MVLLIAQSTIQSADIVD

SEQ ID NO: 1526784 - protein, 17 aa, Mycobacterium tuberculosis
MVPGSWDPDRDAPGSAE

SEQ ID NO: 1526785 - protein, 20 aa, Mycobacterium tuberculosis
MVQFVPFFLGQRTPPYPTAT

SEQ ID NO: 1526786 - protein, 21 aa, Mycobacterium tuberculosis
MVQFVPFFLGQRTPPYPTATS

SEQ ID NO: 1526787 - protein, 26 aa, Mycobacterium tuberculosis
MVREWLTVLLRRDLGLLVTIGVPGGE

SEQ ID NO: 1526788 - protein, 23 aa, Mycobacterium tuberculosis
MVSLTLMARLAEAVRPGARLILV

SEQ ID NO: 1526789 - protein, 20 aa, Mycobacterium tuberculosis
MWFQDALVMENYWEAVQEAI

SEQ ID NO: 1526790 - protein, 30 aa, Mycobacterium tuberculosis
MWFTEAHWPAFRHVDFLRALRDYSARHRRY

SEQ ID NO: 1526791 - protein, 30 aa, Mycobacterium tuberculosis
MWFTEAHWPAFRHVDFLRALRDYSARHRSY

SEQ ID NO: 1526792 - protein, 18 aa, Mycobacterium tuberculosis
MYEGKHVLIIFDDLTKQA

SEQ ID NO: 1526793 - protein, 19 aa, Mycobacterium tuberculosis
MYRRLRQALEALIPVLLEE

SEQ ID NO: 1526794 - protein, 18 aa, Mycobacterium tuberculosis
MYSVMWSEHWSYKSSKVH

SEQ ID NO: 1526795 - protein, 23 aa, Mycobacterium tuberculosis
MYVNQPWTIRQYAGFSTAADSNA

SEQ ID NO: 1526796 - protein, 18 aa, Mycobacterium tuberculosis
MYYHCTAPPLPGPLEIDV

SEQ ID NO: 1526797 - protein, 27 aa, Mycobacterium tuberculosis
NAAAGRAPRWGCWPRAPDEVSAAVADL

SEQ ID NO: 1526798 - protein, 23 aa, Mycobacterium tuberculosis
NAAAPDVIRLAPPLIIAEAQLDG

SEQ ID NO: 1526799 - protein, 25 aa, Mycobacterium tuberculosis
NAACAWFHQPELPAPKLPKPDTPPA

SEQ ID NO: 1526800 - protein, 33 aa, Mycobacterium tuberculosis
NAAGKPASVATIAWMGYHPPPNPLDTGSAGDLW

SEQ ID NO: 1526801 - protein, 25 aa, Mycobacterium tuberculosis
NAAMLIDTPCRIHSPRWASNRRRPS

SEQ ID NO: 1526802 - protein, 42 aa, Mycobacterium tuberculosis
NAAPLATLEHNVLNALNAPTQALLGRPLIGDGAAGAPGTGQA

SEQ ID NO: 1526803 - protein, 43 aa, Mycobacterium tuberculosis; identical to SEQ ID NO: 237342

SEQ ID NO: 1526804 - protein, 30 aa, Mycobacterium tuberculosis
NAAYTGIDPYFDDLFLMAAERRFLSVERIV

SEQ ID NO: 1526805 - protein, 26 aa, Mycobacterium tuberculosis
NAEALVPITALLPAGADDVSAAIAAL

SEQ ID NO: 1526806 - protein, 24 aa, Mycobacterium tuberculosis
NAEEEVELAKRIEAGLYATQLMTE

SEQ ID NO: 1526807 - protein, 17 aa, Mycobacterium tuberculosis
NAELLRRAKHSGLSDHQ

SEQ ID NO: 1526808 - protein, 24 aa, Mycobacterium tuberculosis
NAEQILNDQLAQASPDKLRGSLSD

SEQ ID NO: 1526809 - protein, 21 aa, Mycobacterium tuberculosis
NAFVQLVLSNLFGQNAPAIAA

SEQ ID NO: 1526810 - protein, 22 aa, Mycobacterium tuberculosis
NAFVQLVLSNLFGQNAPAIAAA

SEQ ID NO: 1526811 - protein, 36 aa, Mycobacterium tuberculosis
NAGFAHRRGWARRVWRRRFSPQALTTGGRPAGLGGA

SEQ ID NO: 1526812 - protein, 18 aa, Mycobacterium tuberculosis
NAGGPRKVSPLAVQMIMP

SEQ ID NO: 1526813 - protein, 22 aa, Mycobacterium tuberculosis
NAGIARFDSPDPEAEPDVVGGK

SEQ ID NO: 1526814 - protein, 23 aa, Mycobacterium tuberculosis
NAGIARFDSPDPEAEPDVVGGKA

SEQ ID NO: 1526815 - protein, 17 aa, Mycobacterium tuberculosis
NAGLFGDGGAGGDGADG

SEQ ID NO: 1526816 - protein, 19 aa, Mycobacterium tuberculosis
NAGLGLVFLGADPLRSPVR

SEQ ID NO: 1526817 - protein, 20 aa, Mycobacterium tuberculosis
NAGLGLVSWVQTAAVAGAGQ

SEQ ID NO: 1526818 - protein, 17 aa, Mycobacterium tuberculosis
NAGLIGNGGNGGNAEIV

SEQ ID NO: 1526819 - protein, 19 aa, Mycobacterium tuberculosis
NAGLLFGAAGVGGAGGFAL

SEQ ID NO: 1526820 - protein, 23 aa, Mycobacterium tuberculosis
NAGLPALKSFVLPGGSPLSALLH

SEQ ID NO: 1526821 - protein, 21 aa, Mycobacterium tuberculosis
NAGLPVLGAKGAEYPLLPDEL

SEQ ID NO: 1526822 - protein, 18 aa, Mycobacterium tuberculosis
NAGMLFGSGGGGGTGGFG

SEQ ID NO: 1526823 - protein, 17 aa, Mycobacterium tuberculosis
NAGTFYGSGGAGGAGGE

SEQ ID NO: 1526824 - protein, 28 aa, Mycobacterium tuberculosis
NAGTSISGFFNFGSLMSGFANFDDEVSG

SEQ ID NO: 1526825 - protein, 29 aa, Mycobacterium tuberculosis
NAGTSISGFFNFGSLMSGFANFDDEVSGY

SEQ ID NO: 1526826 - protein, 22 aa, Mycobacterium tuberculosis
NAHILPVPMMNILNGGAHADTA

SEQ ID NO: 1526827 - protein, 21 aa, Mycobacterium tuberculosis
NAIGIFHAFLDDPGVRLVGFE

SEQ ID NO: 1526828 - protein, 24 aa, Mycobacterium tuberculosis
NAINAPTQALLGRPLIGDGADGTA

SEQ ID NO: 1526829 - protein, 24 aa, Mycobacterium tuberculosis
NAINAPTQTLFGRPLIGDGANGTA

SEQ ID NO: 1526830 - protein, 21 aa, Mycobacterium tuberculosis
NAITLFPGGLTFPATSLLNLD

SEQ ID NO: 1526831 - protein, 24 aa, Mycobacterium tuberculosis
NAITLFPGGLTFPATSLLNLDVTA

SEQ ID NO: 1526832 - protein, 25 aa, Mycobacterium tuberculosis
NAKGIAWRLLLLELSGPSRLLRKAN

SEQ ID NO: 1526833 - protein, 26 aa, Mycobacterium tuberculosis
NAKRWGVLHVIWRQGYYPGIGAPSWT

SEQ ID NO: 1526834 - protein, 20 aa, Mycobacterium tuberculosis
NALLGPINAGLVIPPVPGFG

SEQ ID NO: 1526835 - protein, 17 aa, Mycobacterium tuberculosis
NALMFGIGRQRRSWRGR

SEQ ID NO: 1526836 - protein, 18 aa, Mycobacterium tuberculosis
NAMMWVRGFASDYDEWAA

SEQ ID NO: 1526837 - protein, 21 aa, Mycobacterium tuberculosis
NAPAQALLGRPLIGNGANGAD

SEQ ID NO: 1526838 - protein, 23 aa, Mycobacterium tuberculosis
NAPAQALLGRPLIGSGANGAPGT

SEQ ID NO: 1526839 - protein, 24 aa, Mycobacterium tuberculosis
NAPASTPLHTLQQQILNAINEPTQ

SEQ ID NO: 1526840 - protein, 29 aa, Mycobacterium tuberculosis
NAPHLVHAMPQLVPLLPSMGHTKRALVRA

SEQ ID NO: 1526841 - protein, 23 aa, Mycobacterium tuberculosis
NAPTLALLNRPLIGNGADGTAAN

SEQ ID NO: 1526842 - protein, 21 aa, Mycobacterium tuberculosis
NAPTQALLGRPLIGNGADGGA

SEQ ID NO: 1526843 - protein, 22 aa, Mycobacterium tuberculosis
NAPTQTLLGRPLIGDGAHGTAP

SEQ ID NO: 1526844 - protein, 25 aa, Mycobacterium tuberculosis
NAPVAVPWVLAARSPQALTNQAGRL

SEQ ID NO: 1526845 - protein, 22 aa, Mycobacterium tuberculosis
NAPVAVPWVWAARSPQALTNQA

SEQ ID NO: 1526846 - protein, 23 aa, Mycobacterium tuberculosis
NAPVFLISLKPAASGWTSNLFAS

SEQ ID NO: 1526847 - protein, 22 aa, Mycobacterium tuberculosis
NAPVLAATGRPLIGNGANGAPG

SEQ ID NO: 1526848 - protein, 22 aa, Mycobacterium tuberculosis
NAQMLQHRRALSARSARHGPLT

SEQ ID NO: 1526849 - protein, 19 aa, Mycobacterium tuberculosis
NAQVALVRRRLASAGLGGA

SEQ ID NO: 1526850 - protein, 29 aa, Mycobacterium tuberculosis
NARAATFHAEFVSLLNGGAAAYTGAEAAS

SEQ ID NO: 1526851 - protein, 17 aa, Mycobacterium tuberculosis
NARTRFVLVGRPGPPPA

SEQ ID NO: 1526852 - protein, 24 aa, Mycobacterium tuberculosis
NASATVATLCRGQPRLDVGHQPMG

SEQ ID NO: 1526853 - protein, 29 aa, Mycobacterium tuberculosis
NASIPTPQPGLPRPMFGAAAATAAATSVH

SEQ ID NO: 1526854 - protein, 38 aa, Mycobacterium tuberculosis
NASPLQQALNVINAPTQTLLGRPLIGNGTNGAPGTGQA

SEQ ID NO: 1526855 - protein, 22 aa, Mycobacterium tuberculosis
NATFLRDALHKAGIEAQFVARG

SEQ ID NO: 1526856 - protein, 25 aa, Mycobacterium tuberculosis
NATPDIFVEFSRWRGLSPDGRCKAF

SEQ ID NO: 1526857 - protein, 25 aa, Mycobacterium tuberculosis
NATRAITSDHDIPGKSMPGACASSY

SEQ ID NO: 1526858 - protein, 23 aa, Mycobacterium tuberculosis
NAVDKVIGWAFERDRIPLAPRCC

SEQ ID NO: 1526859 - protein, 23 aa, Mycobacterium tuberculosis
NAVEYFVSYYDYYQPEAYIAQTD

SEQ ID NO: 1526860 - protein, 17 aa, Mycobacterium tuberculosis
NAVMGFASPLTSAADAA

SEQ ID NO: 1526861 - protein, 24 aa, Mycobacterium tuberculosis
NAVNAPTQTLLGRPLVGDGADGAS

SEQ ID NO: 1526862 - protein, 21 aa, Mycobacterium tuberculosis
NCFAWRPTGPLFRGMLAAMGS

SEQ ID NO: 1526863 - protein, 23 aa, Mycobacterium tuberculosis
NDAEKRWVLKNPSHLFALDALMA

SEQ ID NO: 1526864 - protein, 27 aa, Mycobacterium tuberculosis
NDAEVLIDLVRRYAPKLALIVTSHQHF

SEQ ID NO: 1526865 - protein, 24 aa, Mycobacterium tuberculosis
NDDVTLLAMQRRAPTPPLHITLDA

SEQ ID NO: 1526866 - protein, 17 aa, Mycobacterium tuberculosis
NDEYKILITWRRGTAQG

SEQ ID NO: 1526867 - protein, 25 aa, Mycobacterium tuberculosis
NDGCLRPLRIVVPEGSMLAPTHPAA

SEQ ID NO: 1526868 - protein, 29 aa, Mycobacterium tuberculosis
NDNGPPPPFTSWMPPGYPPEPPQVPYPAT

SEQ ID NO: 1526869 - protein, 27 aa, Mycobacterium tuberculosis
NDQVAALFRMWLPDPVRRVATGVLDVV

SEQ ID NO: 1526870 - protein, 27 aa, Mycobacterium tuberculosis
NDQVAALFRMWLRDAVGRVATGVLDVV

SEQ ID NO: 1526871 - protein, 25 aa, Mycobacterium tuberculosis
NDQVALFLRHLWSAGGSVRWDPTNG

SEQ ID NO: 1526872 - protein, 24 aa, Mycobacterium tuberculosis
NDSGLRPRYPAIEIYRVSAPANPG

SEQ ID NO: 1526873 - protein, 25 aa, Mycobacterium tuberculosis
NDSGLRPRYPAIEIYRVSAPANPGA

SEQ ID NO: 1526874 - protein, 18 aa, Mycobacterium tuberculosis
NDSRGFFTSRVIGTFVNE

SEQ ID NO: 1526875 - protein, 23 aa, Mycobacterium tuberculosis
NDYDLSSLFLLASTAALFSPSIK

SEQ ID NO: 1526876 - protein, 32 aa, Mycobacterium tuberculosis
NDYYDRSGLWPYLEKLGFYLVGYGCTTCIGNS

SEQ ID NO: 1526877 - protein, 30 aa, Mycobacterium tuberculosis
NEAADLAAVWQLPVVILVENIRGALSVHLD

SEQ ID NO: 1526878 - protein, 25 aa, Mycobacterium tuberculosis
NEARRLRWAAPYLAVPRVLGVGVDG

SEQ ID NO: 1526879 - protein, 20 aa, Mycobacterium tuberculosis
NEEDPRWRFGVPPANNANYA

SEQ ID NO: 1526880 - protein, 25 aa, Mycobacterium tuberculosis
NEGVKGAWVLARYDDGRPSQVRLDT

SEQ ID NO: 1526881 - protein, 24 aa, Mycobacterium tuberculosis
NEHRRKFLSLLRDPSVHRIVVEHR

SEQ ID NO: 1526882 - protein, 26 aa, Mycobacterium tuberculosis
NELGHPWTVLRATRRTDYLILEMAAR

SEQ ID NO: 1526883 - protein, 26 aa, Mycobacterium tuberculosis
NELGHPWTVLRATRRTDYLILEMGGT

SEQ ID NO: 1526884 - protein, 17 aa, Mycobacterium tuberculosis
NEPALFDEVWSWSTKAL

SEQ ID NO: 1526885 - protein, 24 aa, Mycobacterium tuberculosis
NEPIFHSAPPWRSSAWEPSASARC

SEQ ID NO: 1526886 - protein, 22 aa, Mycobacterium tuberculosis
NFADVLIAFGRFPIIDDREPQL

SEQ ID NO: 1526887 - protein, 22 aa, Mycobacterium tuberculosis
NFFRGAQLQQLGMERTRSDYMG

SEQ ID NO: 1526888 - protein, 18 aa, Mycobacterium tuberculosis
NFGLGNSGLTPGLMGLGN

SEQ ID NO: 1526889 - protein, 18 aa, Mycobacterium tuberculosis
NFLKDLLAAFADATVVIG

SEQ ID NO: 1526890 - protein, 21 aa, Mycobacterium tuberculosis
NFNGGIINTGSFNSGAFNSGS

SEQ ID NO: 1526891 - protein, 22 aa, Mycobacterium tuberculosis
NFNGGIINTGSFNSGAFNSGSF

SEQ ID NO: 1526892 - protein, 24 aa, Mycobacterium tuberculosis
NFPQAFTHLALINAVVHVIRAEEE

SEQ ID NO: 1526893 - protein, 18 aa, Mycobacterium tuberculosis
NFRDICPPQHPWSGSLSK

SEQ ID NO: 1526894 - protein, 20 aa, Mycobacterium tuberculosis
NFRDVLVALGIYPGAAELGA

SEQ ID NO: 1526895 - protein, 24 aa, Mycobacterium tuberculosis
NFRDVLVALGIYPGAAELGAEGAG

SEQ ID NO: 1526896 - protein, 24 aa, Mycobacterium tuberculosis
NFSNGILWRGDYQGLAGFAVGYTL

SEQ ID NO: 1526897 - protein, 24 aa, Mycobacterium tuberculosis
NFSNGILWRGNFEGLFGLNVGITI

SEQ ID NO: 1526898 - protein, 25 aa, Mycobacterium tuberculosis
NFTDFAICNIGKLEWLYSARSATDY

SEQ ID NO: 1526899 - protein, 23 aa, Mycobacterium tuberculosis
NFTPKIRFWHVESAPRVRSLAKS

SEQ ID NO: 1526900 - protein, 25 aa, Mycobacterium tuberculosis
NFVARLVFPNPMRQLRITVGLIADL

SEQ ID NO: 1526901 - protein, 38 aa, Mycobacterium tuberculosis
NFVKTLLDRAYAKKFRFPTFLGAFKYYTSYTLKTFDGK

SEQ ID NO: 1526902 - protein, 20 aa, Mycobacterium tuberculosis
NFVLFGEFADAPAAWRRYLE

SEQ ID NO: 1526903 - protein, 25 aa, Mycobacterium tuberculosis
NFWRSAGLPEFRWPDPNGTRFPNGA

SEQ ID NO: 1526904 - protein, 27 aa, Mycobacterium tuberculosis
NGAAGGAGGRLFGNGGAGGNGGTAGQG

SEQ ID NO: 1526905 - protein, 21 aa, Mycobacterium tuberculosis
NGAAMPHLSGPLAGVGVGGQA

SEQ ID NO: 1526906 - protein, 45 aa, Mycobacterium tuberculosis
NGAFWTGDYQGLLGFSYRPAVLPQTPFLDLTLTGGLGSVVIPAID

SEQ ID NO: 1526907 - protein, 23 aa, Mycobacterium tuberculosis
NGAHGFNAVLVSDGGNGGDGGAG

SEQ ID NO: 1526908 - protein, 32 aa, Mycobacterium tuberculosis
NGAHGTVGAQFVPATSLPTPNGGAGGNGGTGS

SEQ ID NO: 1526909 - protein, 20 aa, Mycobacterium tuberculosis
NGAIGGHGPLTDDPGGNGGT

SEQ ID NO: 1526910 - protein, 21 aa, Mycobacterium tuberculosis
NGAIGGHGPLTDDPGGNGGTG

SEQ ID NO: 1526911 - protein, 23 aa, Mycobacterium tuberculosis
NGALWTGDYHGLVGFSFSIDIAG

SEQ ID NO: 1526912 - protein, 24 aa, Mycobacterium tuberculosis
NGAPGTRPGPAGPGGFVVLATGGN

SEQ ID NO: 1526913 - protein, 19 aa, Mycobacterium tuberculosis
NGATGADGAKGLDGATGGK

SEQ ID NO: 1526914 - protein, 23 aa, Mycobacterium tuberculosis
NGDGYLVFAAQAATPRLVAFAVR

SEQ ID NO: 1526915 - protein, 22 aa, Mycobacterium tuberculosis
NGGAGGLFMNGGDGGAGGQGGD

SEQ ID NO: 1526916 - protein, 23 aa, Mycobacterium tuberculosis
NGGAGGLLIGNGGAGGVGGTAGA

SEQ ID NO: 1526917 - protein, 23 aa, Mycobacterium tuberculosis
NGGAGGNAWLFGAGGSGGAGTNG

SEQ ID NO: 1526918 - protein, 28 aa, Mycobacterium tuberculosis
NGGAGGNGGWLYGNGGLGGNGGAATQIG

SEQ ID NO: 1526919 - protein, 19 aa, Mycobacterium tuberculosis
NGGAGGQGGLGLAGINGGS

SEQ ID NO: 1526920 - protein, 35 aa, Mycobacterium tuberculosis
NGGAPGALGGKGGSGGLIGRAGSDGGVGAGGAGGA

SEQ ID NO: 1526921 - protein, 21 aa, Mycobacterium tuberculosis
NGGFSFFDGNGGDGGTGGTLI

SEQ ID NO: 1526922 - protein, 21 aa, Mycobacterium tuberculosis
NGGKAGFSPGPTNFGLNGAGG

SEQ ID NO: 1526923 - protein, 23 aa, Mycobacterium tuberculosis
NGGNAGLFGHGGAGGTGGAGLAG

SEQ ID NO: 1526924 - protein, 28 aa, Mycobacterium tuberculosis
NGGNAGVIANGSFAPSFVGFGGNGGNGV

SEQ ID NO: 1526925 - protein, 29 aa, Mycobacterium tuberculosis
NGGNAGVIANGSFAPSFVGFGGNGGNGVN

SEQ ID NO: 1526926 - protein, 26 aa, Mycobacterium tuberculosis
NGGNGALLIGGGGLGGAGGMGGTGGG

SEQ ID NO: 1526927 - protein, 34 aa, Mycobacterium tuberculosis
NGGNGGGALNQAGFFGTGGKRRVTAGNGGARHDQ

SEQ ID NO: 1526928 - protein, 24 aa, Mycobacterium tuberculosis
NGGNGGIRGIGGAGGIGGAGSTAG

SEQ ID NO: 1526929 - protein, 24 aa, Mycobacterium tuberculosis
NGGNPGFSGAGGLGGLSGDGVTRA

SEQ ID NO: 1526930 - protein, 24 aa, Mycobacterium tuberculosis
NGGPGSDGLGGDAFNGSRGTDGNP

SEQ ID NO: 1526931 - protein, 33 aa, Mycobacterium tuberculosis
NGGQGGPGGLAGNLFGQNGIQGVGGSGGKGGAG

SEQ ID NO: 1526932 - protein, 19 aa, Mycobacterium tuberculosis
NGGSGGRGDMAFKDGDGGA

SEQ ID NO: 1526933 - protein, 24 aa, Mycobacterium tuberculosis
NGGSGGSLFGFGGAGGTGGSSGIG

SEQ ID NO: 1526934 - protein, 25 aa, Mycobacterium tuberculosis
NGGSGGSLFGFGGAGGTGGSSGIGS

SEQ ID NO: 1526935 - protein, 23 aa, Mycobacterium tuberculosis
NGGTAGLLFGAGGAGGAGGFGFG

SEQ ID NO: 1526936 - protein, 21 aa, Mycobacterium tuberculosis
NGGVGASGGAGARGANGIDSI

SEQ ID NO: 1526937 - protein, 24 aa, Mycobacterium tuberculosis
NGHNPIAIIVPCHRVIGASGKLTG

SEQ ID NO: 1526938 - protein, 18 aa, Mycobacterium tuberculosis
NGHQWLTGLRIEDGLLKK

SEQ ID NO: 1526939 - protein, 20 aa, Mycobacterium tuberculosis
NGIALLRYLSAQAQQIEWSK

SEQ ID NO: 1526940 - protein, 30 aa, Mycobacterium tuberculosis
NGIARVTAYRWFHAGLLPVPARKAGRLILV

SEQ ID NO: 1526941 - protein, 23 aa, Mycobacterium tuberculosis
NGIDAARWPFAARRPRTGPAELL

SEQ ID NO: 1526942 - protein, 17 aa, Mycobacterium tuberculosis
NGLDIEVLGYEAGVALL

SEQ ID NO: 1526943 - protein, 17 aa, Mycobacterium tuberculosis
NGLLFGAGGTGGAGTLG

SEQ ID NO: 1526944 - protein, 18 aa, Mycobacterium tuberculosis
NGLLWRGDNQGLIDLAIG

SEQ ID NO: 1526945 - protein, 18 aa, Mycobacterium tuberculosis
NGLRQLIAFLSRMTAVDP

SEQ ID NO: 1526946 - protein, 27 aa, Mycobacterium tuberculosis
NGMWGAPQLGRWKWHDPWVHASLLAQN

SEQ ID NO: 1526947 - protein, 28 aa, Mycobacterium tuberculosis
NGMWGAPQLGRWKWHDPWVHASLLAQNN

SEQ ID NO: 1526948 - protein, 17 aa, Mycobacterium tuberculosis
NGPGWWPGEFRGAGQRI

SEQ ID NO: 1526949 - protein, 25 aa, Mycobacterium tuberculosis
NGPLAAFVHALADVGFDVAVLDYYE

SEQ ID NO: 1526950 - protein, 26 aa, Mycobacterium tuberculosis
NGSKGLPGLGRLGNPGLDGGTGGNGG

SEQ ID NO: 1526951 - protein, 17 aa, Mycobacterium tuberculosis
NGSSLAVGGFGLCGIPE

SEQ ID NO: 1526952 - protein, 25 aa, Mycobacterium tuberculosis
NGTLLPELVQWLHVAALGAPLGNAG

SEQ ID NO: 1526953 - protein, 22 aa, Mycobacterium tuberculosis
NGTPLLNWLRQRGVDEVDMVGI

SEQ ID NO: 1526954 - protein, 25 aa, Mycobacterium tuberculosis
NGVDLAAMLRRQGPLAPPRAVAIVR

SEQ ID NO: 1526955 - protein, 25 aa, Mycobacterium tuberculosis
NGVGPAQFPAMLTALRQAMAEDAVR

SEQ ID NO: 1526956 - protein, 17 aa, Mycobacterium tuberculosis
NGYIPIPDEFKSRLSTA

SEQ ID NO: 1526957 - protein, 38 aa, Mycobacterium tuberculosis
NGYPVKASVSFGLYYPPGSALYHDTLAELWFASEEVAQ

SEQ ID NO: 1526958 - protein, 26 aa, Mycobacterium tuberculosis
NHERVALVSPAPIFGCLREVRAWAQN

SEQ ID NO: 1526959 - protein, 17 aa, Mycobacterium tuberculosis
NHEYLGPVLWSPAGKPP

SEQ ID NO: 1526960 - protein, 17 aa, Mycobacterium tuberculosis
NHIVTVLADALEALRAA

SEQ ID NO: 1526961 - protein, 18 aa, Mycobacterium tuberculosis
NHLAFHVPAERFDAYRQR

SEQ ID NO: 1526962 - protein, 18 aa, Mycobacterium tuberculosis
NHNYIGTEHILLGLIHEG

SEQ ID NO: 1526963 - protein, 19 aa, Mycobacterium tuberculosis
NHPVYSYARPLFLALPESA

SEQ ID NO: 1526964 - protein, 17 aa, Mycobacterium tuberculosis
NHQLPPVGDVTSPVKQR

SEQ ID NO: 1526965 - protein, 26 aa, Mycobacterium tuberculosis
NHRDDYLPCLVSIQFRLCQTAKITSS

SEQ ID NO: 1526966 - protein, 32 aa, Mycobacterium tuberculosis
NHRDDYLPCLVSIQFRLLPDGKDYVFHTTFYS

SEQ ID NO: 1526967 - protein, 32 aa, Mycobacterium tuberculosis
NHRPSGAPMRWARWPPALIGLPAAAVIPTAHP

SEQ ID NO: 1526968 - protein, 17 aa, Mycobacterium tuberculosis
NHVDRQRKWLLGNRESR

SEQ ID NO: 1526969 - protein, 18 aa, Mycobacterium tuberculosis
NIARPIIGIVPGATGTVT

SEQ ID NO: 1526970 - protein, 18 aa, Mycobacterium tuberculosis
NIAYTKKLWQAIRAQDVC

SEQ ID NO: 1526971 - protein, 25 aa, Mycobacterium tuberculosis
NIDHIEVVTPWRCSPRQAVLPARTA

SEQ ID NO: 1526972 - protein, 24 aa, Mycobacterium tuberculosis
NIEPQTSVLIGTQGGDGTPGGAGV

SEQ ID NO: 1526973 - protein, 17 aa, Mycobacterium tuberculosis
NIGFGNLGNNNLGFGNN

SEQ ID NO: 1526974 - protein, 18 aa, Mycobacterium tuberculosis
NIGLFNSGTNNVGFFNSG

SEQ ID NO: 1526975 - protein, 28 aa, Mycobacterium tuberculosis
NIGLGNLGSYNFGFGNAGDFNLGFANSG

SEQ ID NO: 1526976 - protein, 31 aa, Mycobacterium tuberculosis; identical to SEQ ID NO: 236681

SEQ ID NO: 1526977 - protein, 22 aa, Mycobacterium tuberculosis
NIIYEGPGADSLFFASGQLREL

SEQ ID NO: 1526978 - protein, 22 aa, Mycobacterium tuberculosis
NILGLDIKGHIVKKLLVAEASD

SEQ ID NO: 1526979 - protein, 23 aa, Mycobacterium tuberculosis
NILVTASDFAYLVDFGIARAASD

SEQ ID NO: 1526980 - protein, 26 aa, Mycobacterium tuberculosis
NINFFVHDPFTLEPYSRDPRNIARKA

SEQ ID NO: 1526981 - protein, 24 aa, Mycobacterium tuberculosis
NIPPHNLRELADAVFWALENHDAD

SEQ ID NO: 1526982 - protein, 30 aa, Mycobacterium tuberculosis
NKAALEPVNPPKPPPAIKIDPPPPPQEQGL

SEQ ID NO: 1526983 - protein, 23 aa, Mycobacterium tuberculosis
NKDAWMVGYTPSLSTAVWVGTVK

SEQ ID NO: 1526984 - protein, 19 aa, Mycobacterium tuberculosis
NKFGRMIFIGSVSGSWGIG

SEQ ID NO: 1526985 - protein, 19 aa, Mycobacterium tuberculosis
NKLFEERIIFLGVQVDDAS

SEQ ID NO: 1526986 - protein, 18 aa, Mycobacterium tuberculosis
NKPSMPYRLRVIVHEDEN

SEQ ID NO: 1526987 - protein, 20 aa, Mycobacterium tuberculosis
NKQRWLAFFQAEGGAAAARW

SEQ ID NO: 1526988 - protein, 18 aa, Mycobacterium tuberculosis
NKVLLKGKKSLAERIVYG

SEQ ID NO: 1526989 - protein, 22 aa, Mycobacterium tuberculosis
NKVSRILLTSGKLYYELAARKA

SEQ ID NO: 1526990 - protein, 19 aa, Mycobacterium tuberculosis
NLAELRRSLTGSATYAVAK

SEQ ID NO: 1526991 - protein, 19 aa, Mycobacterium tuberculosis
NLAGWLQNGPTETTFSVGL

SEQ ID NO: 1526992 - protein, 22 aa, Mycobacterium tuberculosis
NLAQYPSILVELGNMKNPADSA

SEQ ID NO: 1526993 - protein, 18 aa, Mycobacterium tuberculosis
NLAVIAQFVSLLGEVEQK

SEQ ID NO: 1526994 - protein, 18 aa, Mycobacterium tuberculosis
NLDLDIADGEFLVLVGPS

SEQ ID NO: 1526995 - protein, 17 aa, Mycobacterium tuberculosis
NLDPAPTRWRPRGTRRR

SEQ ID NO: 1526996 - protein, 17 aa, Mycobacterium tuberculosis
NLDTVIGRYSRLIVVGA

SEQ ID NO: 1526997 - protein, 19 aa, Mycobacterium tuberculosis
NLDTVIGRYSRLIVVGADA

SEQ ID NO: 1526998 - protein, 34 aa, Mycobacterium tuberculosis
NLESLYGAWSANPFPFLRQIIANQQVYWQQIAAA

SEQ ID NO: 1526999 - protein, 26 aa, Mycobacterium tuberculosis
NLGFALPIALPRRTVVTFTPEHTGAI

SEQ ID NO: 1527000 - protein, 27 aa, Mycobacterium tuberculosis
NLGFALPIALPRRTVVTFTPEHTGAIT

SEQ ID NO: 1527001 - protein, 18 aa, Mycobacterium tuberculosis
NLGFWNLGSANIGNYNLG

SEQ ID NO: 1527002 - protein, 17 aa, Mycobacterium tuberculosis
NLGNYNIGFANLGNYNI

SEQ ID NO: 1527003 - protein, 31 aa, Mycobacterium tuberculosis
NLGNYNIGFANLGNYNIGFGNAGDFNQGFAN

SEQ ID NO: 1527004 - protein, 18 aa, Mycobacterium tuberculosis
NLGSGNYGSLNWGSGNTG

SEQ ID NO: 1527005 - protein, 19 aa, Mycobacterium tuberculosis
NLGSYNFGFGNSGDFNLGF

SEQ ID NO: 1527006 - protein, 25 aa, Mycobacterium tuberculosis
NLHGRYLLPHFLIHDIADVAADLRA

SEQ ID NO: 1527007 - protein, 20 aa, Mycobacterium tuberculosis
NLISLQMLPLRVSRMRLQRA

SEQ ID NO: 1527008 - protein, 30 aa, Mycobacterium tuberculosis
NLKSVYLCCRAALRHMVLAGKGSIVNTASF

SEQ ID NO: 1527009 - protein, 18 aa, Mycobacterium tuberculosis
NLLAQASQWRRLGGTFPT

SEQ ID NO: 1527010 - protein, 32 aa, Mycobacterium tuberculosis
NLLLEQLHYRHEVLYFKVLADHLPELMPVVYT

SEQ ID NO: 1527011 - protein, 20 aa, Mycobacterium tuberculosis
NLQGRIRRHIRRQYVITVVS

SEQ ID NO: 1527012 - protein, 17 aa, Mycobacterium tuberculosis
NLRLYGRLLRRAIDPDP

SEQ ID NO: 1527013 - protein, 17 aa, Mycobacterium tuberculosis
NLRVIDNIRYFAELCGV

SEQ ID NO: 1527014 - protein, 17 aa, Mycobacterium tuberculosis
NLSIASLRREKDDVTEV

SEQ ID NO: 1527015 - protein, 26 aa, Mycobacterium tuberculosis
NLTAAPIERILLRYKAINRVAVYASR

SEQ ID NO: 1527016 - protein, 25 aa, Mycobacterium tuberculosis
NLTKPIANGLTYNFTFKFEKAGQGS

SEQ ID NO: 1527017 - protein, 23 aa, Mycobacterium tuberculosis
NLTVLRTLLRLMDRDPDDFDHVT

SEQ ID NO: 1527018 - protein, 22 aa, Mycobacterium tuberculosis
NLTYPYGAYFCVVDIDPGTAVV

SEQ ID NO: 1527019 - protein, 26 aa, Mycobacterium tuberculosis
NLVAPLAPLHGWGLDPYLTPGFTELS

SEQ ID NO: 1527020 - protein, 27 aa, Mycobacterium tuberculosis
NLVAPLAPLHGWGLDPYLTPGFTELSS

SEQ ID NO: 1527021 - protein, 17 aa, Mycobacterium tuberculosis
NLVEITLPDNTPWGGKP

SEQ ID NO: 1527022 - protein, 19 aa, Mycobacterium tuberculosis
NLVFTRDSSIWIGPRVVIP

SEQ ID NO: 1527023 - protein, 18 aa, Mycobacterium tuberculosis
NLVNARYLRICVLTQYKS

SEQ ID NO: 1527024 - protein, 19 aa, Mycobacterium tuberculosis
NLYRGIGIAIGKLVARQDA

SEQ ID NO: 1527025 - protein, 23 aa, Mycobacterium tuberculosis
NMANPLWIDRAEIWTRFASGDNP

SEQ ID NO: 1527026 - protein, 24 aa, Mycobacterium tuberculosis
NMGRKFLEQLGILQPTDTGITNAP

SEQ ID NO: 1527027 - protein, 18 aa, Mycobacterium tuberculosis
NMLRLRYEKKRNLPRALL

SEQ ID NO: 1527028 - protein, 17 aa, Mycobacterium tuberculosis
NMPRPLVAVAAILAPLM

SEQ ID NO: 1527029 - protein, 18 aa, Mycobacterium tuberculosis
NMTGYPEAVLARELELCY

SEQ ID NO: 1527030 - protein, 18 aa, Mycobacterium tuberculosis
NMVGTAIVFEALRRVRPH

SEQ ID NO: 1527031 - protein, 24 aa, Mycobacterium tuberculosis
NMVNDPFQTLTGRPLIGNGANGTP

SEQ ID NO: 1527032 - protein, 17 aa, Mycobacterium tuberculosis
NMWESLTHESALTSNGG

SEQ ID NO: 1527033 - protein, 21 aa, Mycobacterium tuberculosis
NNDFKPGFSTALMNKDLGLAM

SEQ ID NO: 1527034 - protein, 20 aa, Mycobacterium tuberculosis
NNFGFGNFGNANIGIGNAGP

SEQ ID NO: 1527035 - protein, 22 aa, Mycobacterium tuberculosis
NNFPLVNLLVNRGPTVPILLDT

SEQ ID NO: 1527036 - protein, 24 aa, Mycobacterium tuberculosis
NNGFHGKWPWQMTHPMDGAVQIDK

SEQ ID NO: 1527037 - protein, 34 aa, Mycobacterium tuberculosis
NNPALYLIGKSYRFRRLELARFLAALHATVLDNP

SEQ ID NO: 1527038 - protein, 22 aa, Mycobacterium tuberculosis
NNQVVLPFTDITAPWGIAVDEA

SEQ ID NO: 1527039 - protein, 20 aa, Mycobacterium tuberculosis
NNRYIPVTRPPSTSAVIPAV

SEQ ID NO: 1527040 - protein, 20 aa, Mycobacterium tuberculosis
NPAALVQALFNLGEMVTATQ

SEQ ID NO: 1527041 - protein, 31 aa, Mycobacterium tuberculosis
NPAGPRLRPPRPLKGWVFAAGAKRPGAKKTP

SEQ ID NO: 1527042 - protein, 17 aa, Mycobacterium tuberculosis
NPAIDAASTRFFVPTQN

SEQ ID NO: 1527043 - protein, 28 aa, Mycobacterium tuberculosis
NPEIRPAHLLMALLTQNDGIAAPLLEAV

SEQ ID NO: 1527044 - protein, 19 aa, Mycobacterium tuberculosis
NPEQFWDLLCAGRSGIVRV

SEQ ID NO: 1527045 - protein, 23 aa, Mycobacterium tuberculosis
NPEVMLGAALLAPQRRRKGTDLE

SEQ ID NO: 1527046 - protein, 22 aa, Mycobacterium tuberculosis
NPGDSLLPDVQNLRAISTTVAE

SEQ ID NO: 1527047 - protein, 19 aa, Mycobacterium tuberculosis
NPGVCRGICGDGGAGGASD

SEQ ID NO: 1527048 - protein, 24 aa, Mycobacterium tuberculosis
NPIASIFAWTRGLQHRGKLDGTPE

SEQ ID NO: 1527049 - protein, 20 aa, Mycobacterium tuberculosis
NPNLRLLGALPTLYDSRTTH

SEQ ID NO: 1527050 - protein, 28 aa, Mycobacterium tuberculosis
NPQRPWEHPDFWDIWKASLQGVLATRPD

SEQ ID NO: 1527051 - protein, 20 aa, Mycobacterium tuberculosis
NPRVLSIAQFWDRAAGHDRI

SEQ ID NO: 1527052 - protein, 24 aa, Mycobacterium tuberculosis
NPSGAAIPAFKPLGGRELGAGMSA

SEQ ID NO: 1527053 - protein, 56 aa, Mycobacterium tuberculosis
NPTTLHFPGFTIPTVPIHIGLPLSLTIPGFTIPGGTLIPQLPLGLGLSGGTPPFDL

SEQ ID NO: 1527054 - protein, 17 aa, Mycobacterium tuberculosis
NPTWSFLYRDIIVALRD

SEQ ID NO: 1527055 - protein, 20 aa, Mycobacterium tuberculosis
NPVCAAAALAVLRVLASDGL

SEQ ID NO: 1527056 - protein, 29 aa, Mycobacterium tuberculosis
NPVEAFQFYFELLLFDYPTHIVQIVEALS

SEQ ID NO: 1527057 - protein, 22 aa, Mycobacterium tuberculosis
NPVNWPRVLTVWRANLIGSSGK

SEQ ID NO: 1527058 - protein, 18 aa, Mycobacterium tuberculosis
NPVPIIEQVRAREILDSR

SEQ ID NO: 1527059 - protein, 25 aa, Mycobacterium tuberculosis
NQAPLSFPIPGWNICVDFPIKDGLG

SEQ ID NO: 1527060 - protein, 24 aa, Mycobacterium tuberculosis
NQGQIAIDLSVTTPFIPINEQMVI

SEQ ID NO: 1527061 - protein, 25 aa, Mycobacterium tuberculosis
NQGQIAIDLSVTTPFIPINEQMVID

SEQ ID NO: 1527062 - protein, 20 aa, Mycobacterium tuberculosis
NQTVLPFDGLNYPEGLAVDT

SEQ ID NO: 1527063 - protein, 25 aa, Mycobacterium tuberculosis
NQVDQWLRFLTSWRKDRIATVENLR

SEQ ID NO: 1527064 - protein, 20 aa, Mycobacterium tuberculosis
NQVPLTYPFALTFPSVMSLV

SEQ ID NO: 1527065 - protein, 25 aa, Mycobacterium tuberculosis
NRAKAMRMMAVLPTIVAIDMRRRRG

SEQ ID NO: 1527066 - protein, 21 aa, Mycobacterium tuberculosis
NRASDLIDRYIQRAAGVRRCA

SEQ ID NO: 1527067 - protein, 17 aa, Mycobacterium tuberculosis
NRELTAELALALGAAAA

SEQ ID NO: 1527068 - protein, 18 aa, Mycobacterium tuberculosis
NRELTAELALALGAAAAR

SEQ ID NO: 1527069 - protein, 22 aa, Mycobacterium tuberculosis
NRGELPCVPTIMAGLYCEWDNA

SEQ ID NO: 1527070 - protein, 17 aa, Mycobacterium tuberculosis
NRGWALNEVSLEKGPRL

SEQ ID NO: 1527071 - protein, 24 aa, Mycobacterium tuberculosis
NRIEGWMPFGRVFETLAWGRRHVV

SEQ ID NO: 1527072 - protein, 21 aa, Mycobacterium tuberculosis
NRIEIVIAMLGIVKAGAILVN

SEQ ID NO: 1527073 - protein, 17 aa, Mycobacterium tuberculosis
NRIVIAYSPLAQGLLGG

SEQ ID NO: 1527074 - protein, 18 aa, Mycobacterium tuberculosis
NRIVIAYSPLAQGLLGGK

SEQ ID NO: 1527075 - protein, 20 aa, Mycobacterium tuberculosis
NRLAHWFRQAGLREDDVVAI

SEQ ID NO: 1527076 - protein, 21 aa, Mycobacterium tuberculosis
NRLAHWFRQAGLREDDVVAIL

SEQ ID NO: 1527077 - protein, 17 aa, Mycobacterium tuberculosis
NRLPMMVVAELIGLPDP

SEQ ID NO: 1527078 - protein, 18 aa, Mycobacterium tuberculosis
NRMFLQRLKDKLGNHANA

SEQ ID NO: 1527079 - protein, 44 aa, Mycobacterium tuberculosis
NRMRWPHGRMRYYIAMLAELSRLRPLPFRLVLDGTEEIVADLTL

SEQ ID NO: 1527080 - protein, 21 aa, Mycobacterium tuberculosis
NRPQRFQVTASRFGRSVDVAA

SEQ ID NO: 1527081 - protein, 21 aa, Mycobacterium tuberculosis
NRPTGAFMFLGPTGVGKTELA

SEQ ID NO: 1527082 - protein, 19 aa, Mycobacterium tuberculosis
NRQPLGRMPVHGGGQAAEH

SEQ ID NO: 1527083 - protein, 27 aa, Mycobacterium tuberculosis
NRRGNYLYNFWRDAANPRGLWRRTTLD

SEQ ID NO: 1527084 - protein, 17 aa, Mycobacterium tuberculosis
NRRYTFDTFVIGASNRF

SEQ ID NO: 1527085 - protein, 23 aa, Mycobacterium tuberculosis
NRSALDVMLDWDPTTAYSCQQGF

SEQ ID NO: 1527086 - protein, 23 aa, Mycobacterium tuberculosis
NRSVRAQTLPPGRGLLVGADGDV

SEQ ID NO: 1527087 - protein, 19 aa, Mycobacterium tuberculosis
NRTHPMLSALPIERAIAAT

SEQ ID NO: 1527088 - protein, 27 aa, Mycobacterium tuberculosis
NRWPDKPGRYFTVRAGSLVAWNAEQSG

SEQ ID NO: 1527089 - protein, 28 aa, Mycobacterium tuberculosis
NSANFAAGRLAYILGARGPAVVIDTACS

SEQ ID NO: 1527090 - protein, 21 aa, Mycobacterium tuberculosis
NSARLRLLRDRLVEGVLAEID

SEQ ID NO: 1527091 - protein, 19 aa, Mycobacterium tuberculosis
NSDAWFLIRVVTAPDGTAL

SEQ ID NO: 1527092 - protein, 33 aa, Mycobacterium tuberculosis
NSFSKYYAMTGWRLGWLLVPTVLRRAVDCLTGN

SEQ ID NO: 1527093 - protein, 28 aa, Mycobacterium tuberculosis
NSGAPGSDALALGQPGGNGGQGDAGQAG

SEQ ID NO: 1527094 - protein, 17 aa, Mycobacterium tuberculosis
NSGFINTGFGNALSVNT

SEQ ID NO: 1527095 - protein, 23 aa, Mycobacterium tuberculosis
NSGLTNTGAFNAGSLNTGFGAVG

SEQ ID NO: 1527096 - protein, 22 aa, Mycobacterium tuberculosis
NSGNINTGFGNSGFINTGFGNA

SEQ ID NO: 1527097 - protein, 20 aa, Mycobacterium tuberculosis
NSGPGAAFGGNGNTGGNGGN

SEQ ID NO: 1527098 - protein, 20 aa, Mycobacterium tuberculosis
NSGSFNVGFQNTGFGNSGAG

SEQ ID NO: 1527099 - protein, 23 aa, Mycobacterium tuberculosis
NSGVLNSGFFNSGVHNSGGFNSE

SEQ ID NO: 1527100 - protein, 18 aa, Mycobacterium tuberculosis
NSINAPVLAATGRPLIGN

SEQ ID NO: 1527101 - protein, 32 aa, Mycobacterium tuberculosis
NSLETLIRRHGPLDWRETLSIGVKLAGALEAA

SEQ ID NO: 1527102 - protein, 21 aa, Mycobacterium tuberculosis
NSLTYRGYPVQDLAARCSFEQ

SEQ ID NO: 1527103 - protein, 18 aa, Mycobacterium tuberculosis
NSLVTWGAGVPAAMGTST

SEQ ID NO: 1527104 - protein, 27 aa, Mycobacterium tuberculosis
NSNEGFFNTGMFNNGIYNSGVASTGIA

SEQ ID NO: 1527105 - protein, 31 aa, Mycobacterium tuberculosis
NTAAWYVNAAIPTAIFLANALNSGAPVAIAE

SEQ ID NO: 1527106 - protein, 28 aa, Mycobacterium tuberculosis
NTADADVIRYLRWFTFLSADELAELEQA

SEQ ID NO: 1527107 - protein, 30 aa, Mycobacterium tuberculosis
NTFHGLLLLRHVADLVMTGWPVLMALSNKD

SEQ ID NO: 1527108 - protein, 42 aa, Mycobacterium tuberculosis
NTGAFITGNFNNGFLWRGDHQGLIFGSPGFFNSTSAPSSGFF

SEQ ID NO: 1527109 - protein, 26 aa, Mycobacterium tuberculosis
NTGCTPYMVLLAAFGALVHRYTHSDD

SEQ ID NO: 1527110 - protein, 17 aa, Mycobacterium tuberculosis
NTGFFNAGSFNTGMLDV

SEQ ID NO: 1527111 - protein, 23 aa, Mycobacterium tuberculosis
NTGLGNIGSWNLGGGNVGLLNLG

SEQ ID NO: 1527112 - protein, 18 aa, Mycobacterium tuberculosis
NTGTLNWGSGNIGSYNLG

SEQ ID NO: 1527113 - protein, 18 aa, Mycobacterium tuberculosis
NTHFGGHRYHWGASAAMI

SEQ ID NO: 1527114 - protein, 25 aa, Mycobacterium tuberculosis
NTLDPTLQLMLLTSRIFGVDGLAVD

SEQ ID NO: 1527115 - protein, 37 aa, Mycobacterium tuberculosis
NTLMAIANRLPFPMTAWAVGLLMRLPQRGVVTVATNV

SEQ ID NO: 1527116 - protein, 25 aa, Mycobacterium tuberculosis
NTNSSQFFMVYRDSKLPPQYTVFGT

SEQ ID NO: 1527117 - protein, 20 aa, Mycobacterium tuberculosis
NTPQSYWLDQAFPPATVGGT

SEQ ID NO: 1527118 - protein, 18 aa, Mycobacterium tuberculosis
NTPSCWTWCARTSPPCWV

SEQ ID NO: 1527119 - protein, 21 aa, Mycobacterium tuberculosis
NTRRDAVIGDTLRPIEGRTAM

SEQ ID NO: 1527120 - protein, 25 aa, Mycobacterium tuberculosis
NTSTTWPKLTGVPMLGISVLGEAHD

SEQ ID NO: 1527121 - protein, 23 aa, Mycobacterium tuberculosis
NTVGPPLLPPILGGGMPAAPGPA

SEQ ID NO: 1527122 - protein, 22 aa, Mycobacterium tuberculosis
NTVLWCGYTWQYWLTTRSVNPA

SEQ ID NO: 1527123 - protein, 20 aa, Mycobacterium tuberculosis
NTVRYRLKRITDFTGRDPTQ

SEQ ID NO: 1527124 - protein, 17 aa, Mycobacterium tuberculosis
NVAMRTMNFGPLATLFA

SEQ ID NO: 1527125 - protein, 22 aa, Mycobacterium tuberculosis
NVAYGLYPSWRGRGLATRAVDL

SEQ ID NO: 1527126 - protein, 26 aa, Mycobacterium tuberculosis
NVDALFLFDVLLHQVSPDWDTILDMY

SEQ ID NO: 1527127 - protein, 18 aa, Mycobacterium tuberculosis
NVDEGYAFAWGSLSAPMG

SEQ ID NO: 1527128 - protein, 25 aa, Mycobacterium tuberculosis
NVDNWVQRLFALPVLPAGYADRVVQ

SEQ ID NO: 1527129 - protein, 39 aa, Mycobacterium tuberculosis
NVEDWKCWARWRLIRARAPWLTRALVAEDFEFYGRTLTG

SEQ ID NO: 1527130 - protein, 17 aa, Mycobacterium tuberculosis
NVFGRRAGIAAASYAQG

SEQ ID NO: 1527131 - protein, 20 aa, Mycobacterium tuberculosis
NVGDYNVGFGNAGDFNQGFA

SEQ ID NO: 1527132 - protein, 19 aa, Mycobacterium tuberculosis
NVGLLNLGSGNFGSLNLGG

SEQ ID NO: 1527133 - protein, 21 aa, Mycobacterium tuberculosis
NVGNFYEAFLQGFRSFFAESA

SEQ ID NO: 1527134 - protein, 24 aa, Mycobacterium tuberculosis
NVGNFYEAFLQGFRSFFAESAADP

SEQ ID NO: 1527135 - protein, 26 aa, Mycobacterium tuberculosis
NVGWGNFGLGNSGLTPGLMGLGNIGF

SEQ ID NO: 1527136 - protein, 18 aa, Mycobacterium tuberculosis
NVIAWASSGHVGFKGSRK

SEQ ID NO: 1527137 - protein, 23 aa, Mycobacterium tuberculosis
NVILLDCGTPVNGPLFSNILNDV

SEQ ID NO: 1527138 - protein, 32 aa, Mycobacterium tuberculosis
NVLSQLPRAQALAVSLLLLSPAALNTLPGLAK

SEQ ID NO: 1527139 - protein, 26 aa, Mycobacterium tuberculosis
NVMPVHGTWRMLRANAKLAASTGVPQ

SEQ ID NO: 1527140 - protein, 22 aa, Mycobacterium tuberculosis
NVNVPLMIIAVGTPAQVAVAAM

SEQ ID NO: 1527141 - protein, 23 aa, Mycobacterium tuberculosis
NVQLDRRLVGQLAQRPPRMTRSG

SEQ ID NO: 1527142 - protein, 25 aa, Mycobacterium tuberculosis
NVRRDPMAMLPFLGYNVGDYFQHWI

SEQ ID NO: 1527143 - protein, 19 aa, Mycobacterium tuberculosis
NVVLLHHNHIERNLAIRGL

SEQ ID NO: 1527144 - protein, 24 aa, Mycobacterium tuberculosis
NVVNEPFQTLTGRPLIGNGANGTP

SEQ ID NO: 1527145 - protein, 24 aa, Mycobacterium tuberculosis
NVVNPGIFALISRATCVDLDGTQR

SEQ ID NO: 1527146 - protein, 18 aa, Mycobacterium tuberculosis
NVYGVILGSTLAAQRMVP

SEQ ID NO: 1527147 - protein, 19 aa, Mycobacterium tuberculosis
NWDAVLKVHLYGGYHVLRA

SEQ ID NO: 1527148 - protein, 17 aa, Mycobacterium tuberculosis
NWRVTWNPSGMYFWLDY

SEQ ID NO: 1527149 - protein, 23 aa, Mycobacterium tuberculosis
NWTEPFPGLAWTLLSRNGFTICV

SEQ ID NO: 1527150 - protein, 21 aa, Mycobacterium tuberculosis
NYDPIWPRHGIRIIPGPSSLW

SEQ ID NO: 1527151 - protein, 17 aa, Mycobacterium tuberculosis
NYFYPDMPKNYQISQYD

SEQ ID NO: 1527152 - protein, 18 aa, Mycobacterium tuberculosis
NYLIVRAGEFSRISDVLL

SEQ ID NO: 1527153 - protein, 27 aa, Mycobacterium tuberculosis
NYLTPQALIDLVASRSYCITSPAQVRT

SEQ ID NO: 1527154 - protein, 35 aa, Mycobacterium tuberculosis
NYSNGAFWRGDYQGLLDFSFPVGPLIPQTHLVHLR

SEQ ID NO: 1527155 - protein, 47 aa, Mycobacterium tuberculosis
NYSNGAFWRGDYQGLLGFSYRPAVLPQTPFLDLTLTGGLGSVVIPAI

SEQ ID NO: 1527156 - protein, 17 aa, Mycobacterium tuberculosis
NYSNGAFWTGDYQGLLG

SEQ ID NO: 1527157 - protein, 22 aa, Mycobacterium tuberculosis
NYVAPIVVCHMSFWVDGKQSAL

SEQ ID NO: 1527158 - protein, 18 aa, Mycobacterium tuberculosis
NYVELCAIMQRRDRPEIS

SEQ ID NO: 1527159 - protein, 18 aa, Mycobacterium tuberculosis
PAAAFPPPDPVPAVTSRP

SEQ ID NO: 1527160 - protein, 18 aa, Mycobacterium tuberculosis
PAAAWQRCRTHYAANLMA

SEQ ID NO: 1527161 - protein, 22 aa, Mycobacterium tuberculosis
PAADLSVWPPLGAAPVDVDGAY

SEQ ID NO: 1527162 - protein, 23 aa, Mycobacterium tuberculosis
PAAFLNVDIPVNIPITGDITNVS

SEQ ID NO: 1527163 - protein, 24 aa, Mycobacterium tuberculosis
PAAFLNVDIPVNIPITGDITNVSI

SEQ ID NO: 1527164 - protein, 17 aa, Mycobacterium tuberculosis
PAAGPARPASPAVLAAR

SEQ ID NO: 1527165 - protein, 20 aa, Mycobacterium tuberculosis
PAALAASLLPPTSSGFARPT

SEQ ID NO: 1527166 - protein, 20 aa, Mycobacterium tuberculosis
PAALGDCYSAWTWLASLPAV

SEQ ID NO: 1527167 - protein, 18 aa, Mycobacterium tuberculosis
PAALSWVEPILQATTTLC

SEQ ID NO: 1527168 - protein, 22 aa, Mycobacterium tuberculosis
PAAPAGLRRLLSVASAVPAEPA

SEQ ID NO: 1527169 - protein, 25 aa, Mycobacterium tuberculosis
PAAPFPPLPPAPPLPTRPASPPLPA

SEQ ID NO: 1527170 - protein, 22 aa, Mycobacterium tuberculosis
PAARLQVPKARRTLPAVLRQDQ

SEQ ID NO: 1527171 - protein, 17 aa, Mycobacterium tuberculosis
PAAVLLASGPRTGQRPG

SEQ ID NO: 1527172 - protein, 19 aa, Mycobacterium tuberculosis
PACTRHRLGRKMPCDGCSI

SEQ ID NO: 1527173 - protein, 34 aa, Mycobacterium tuberculosis
PADLVQRRFGPPAPNRLWVADLTYVSTSPRLLAG

SEQ ID NO: 1527174 - protein, 26 aa, Mycobacterium tuberculosis
PADPATLTDLVFAWRACRAVKSNAIV

SEQ ID NO: 1527175 - protein, 29 aa, Mycobacterium tuberculosis
PADPTVAAFTTVLATLARGGGIGTLGTTT

SEQ ID NO: 1527176 - protein, 36 aa, Mycobacterium tuberculosis
PAEAATPPAPAAKAATATAVLIPVNGGQGADTGNAG

SEQ ID NO: 1527177 - protein, 20 aa, Mycobacterium tuberculosis
PAEFGPWQTVWKRHHRWSLD

SEQ ID NO: 1527178 - protein, 25 aa, Mycobacterium tuberculosis
PAEGFLPALLDWCRKNHVVFIADEV

SEQ ID NO: 1527179 - protein, 18 aa, Mycobacterium tuberculosis
PAEIRNRYDGRSLRFAAA

SEQ ID NO: 1527180 - protein, 32 aa, Mycobacterium tuberculosis
PAELAYFEVLHELKLIVDLMYEGGLARMYYSV

SEQ ID NO: 1527181 - protein, 19 aa, Mycobacterium tuberculosis
PAERVDIAIVGLSTRFPGE

SEQ ID NO: 1527182 - protein, 23 aa, Mycobacterium tuberculosis
PAETAVSLMARPAARAVPEGTSS

SEQ ID NO: 1527183 - protein, 17 aa, Mycobacterium tuberculosis
PAGAYWVPRRLGGGAPT

SEQ ID NO: 1527184 - protein, 21 aa, Mycobacterium tuberculosis
PAGEFWVPHRLGGGAPSLAEA

SEQ ID NO: 1527185 - protein, 17 aa, Mycobacterium tuberculosis
PAGGIVPALVNYAPTQL

SEQ ID NO: 1527186 - protein, 22 aa, Mycobacterium tuberculosis
PAGLFLARYPDQYGKRLKRAEQ

SEQ ID NO: 1527187 - protein, 30 aa, Mycobacterium tuberculosis
PAGLVGLRPVPAAPAGPVALVPAASRLWAR

SEQ ID NO: 1527188 - protein, 20 aa, Mycobacterium tuberculosis
PAGMPGMLAGPGGAGGAGGD

SEQ ID NO: 1527189 - protein, 24 aa, Mycobacterium tuberculosis
PAGPEFAAGCSTCWPPSGAGGPRP

SEQ ID NO: 1527190 - protein, 20 aa, Mycobacterium tuberculosis
PAGPLPAYGSDLRPPSWQPP

SEQ ID NO: 1527191 - protein, 24 aa, Mycobacterium tuberculosis
PAGRPITPGLLYGDARGRVPNASV

SEQ ID NO: 1527192 - protein, 18 aa, Mycobacterium tuberculosis
PAGTLNGIAKRELRGVPA

SEQ ID NO: 1527193 - protein, 23 aa, Mycobacterium tuberculosis
PAGWHAPGWPPRSSHRPSYSGEP

SEQ ID NO: 1527194 - protein, 26 aa, Mycobacterium tuberculosis
PAHMIPRHVTLLDRIPFTDSGKIDRA

SEQ ID NO: 1527195 - protein, 24 aa, Mycobacterium tuberculosis
PAHPQWPLCGWATRRRPGAENLRL

SEQ ID NO: 1527196 - protein, 18 aa, Mycobacterium tuberculosis
PAHRLRVRLADRALTQTN

SEQ ID NO: 1527197 - protein, 24 aa, Mycobacterium tuberculosis
PAHRLRVRLADRALTQTNPLLSVA

SEQ ID NO: 1527198 - protein, 25 aa, Mycobacterium tuberculosis
PAHSAVALPGWAAPAETAARQGRCW

SEQ ID NO: 1527199 - protein, 30 aa, Mycobacterium tuberculosis
PAIAAAEAMYEQMWAADVAAMVGYHGGASA

SEQ ID NO: 1527200 - protein, 24 aa, Mycobacterium tuberculosis
PAIDPILLKVLDAVPFRLSIDDGI

SEQ ID NO: 1527201 - protein, 17 aa, Mycobacterium tuberculosis
PAIRPVNHLVVDGRVIV

SEQ ID NO: 1527202 - protein, 17 aa, Mycobacterium tuberculosis
PAISAFAPSYDPLDGNH

SEQ ID NO: 1527203 - protein, 28 aa, Mycobacterium tuberculosis
PAISVRALPTRVISPPGLSSPATWATAP

SEQ ID NO: 1527204 - protein, 17 aa, Mycobacterium tuberculosis
PAKRYRADRGRPGQARP

SEQ ID NO: 1527205 - protein, 27 aa, Mycobacterium tuberculosis
PALANARLTWLTWVLADSTPRFMHGGW

SEQ ID NO: 1527206 - protein, 21 aa, Mycobacterium tuberculosis
PALDAVYLPPGRSAYVAARSL

SEQ ID NO: 1527207 - protein, 21 aa, Mycobacterium tuberculosis
PALDPTLWNTYLQGALRAYSK

SEQ ID NO: 1527208 - protein, 18 aa, Mycobacterium tuberculosis
PALFFAVGQGYRNFTQTS

SEQ ID NO: 1527209 - protein, 25 aa, Mycobacterium tuberculosis
PALKSPVLPVPLLPTPVLKLPELNN

SEQ ID NO: 1527210 - protein, 19 aa, Mycobacterium tuberculosis
PALLSPRDKLAQLLVVGVR

SEQ ID NO: 1527211 - protein, 23 aa, Mycobacterium tuberculosis
PALWAVMVSLAELWRSVGCGSRR

SEQ ID NO: 1527212 - protein, 24 aa, Mycobacterium tuberculosis
PAMPAECLLDRNALIMGYSGVYSS

SEQ ID NO: 1527213 - protein, 21 aa, Mycobacterium tuberculosis
PAMVHVDVYRLLDHNSADLLS

SEQ ID NO: 1527214 - protein, 24 aa, Mycobacterium tuberculosis
PANHEYLGPVLWSPAGKPPTWWDS

SEQ ID NO: 1527215 - protein, 26 aa, Mycobacterium tuberculosis
PAPAGDRRRWRRRRGSHRRSATAATV

SEQ ID NO: 1527216 - protein, 17 aa, Mycobacterium tuberculosis
PAPAMRPRRRRASAATF

SEQ ID NO: 1527217 - protein, 20 aa, Mycobacterium tuberculosis
PAPEFTDTGAFPFLAVEGPG

SEQ ID NO: 1527218 - protein, 27 aa, Mycobacterium tuberculosis
PAPERGTFLQRAIFHLAGLTAAVQQMQ

SEQ ID NO: 1527219 - protein, 17 aa, Mycobacterium tuberculosis
PAPIELPSYGLFGLPGF

SEQ ID NO: 1527220 - protein, 20 aa, Mycobacterium tuberculosis
PAPLDARIGWRRATLAVCEA

SEQ ID NO: 1527221 - protein, 26 aa, Mycobacterium tuberculosis
PAPPAPMLPSWWVAASALPPCPPAPP

SEQ ID NO: 1527222 - protein, 19 aa, Mycobacterium tuberculosis
PAPPAPPLKPGPPAPPMPP

SEQ ID NO: 1527223 - protein, 23 aa, Mycobacterium tuberculosis
PAPPAPPWPPVPPIPALPAAPTT

SEQ ID NO: 1527224 - protein, 21 aa, Mycobacterium tuberculosis
PAPPLPPAPPRPPAAPEPGGC

SEQ ID NO: 1527225 - protein, 27 aa, Mycobacterium tuberculosis
PAPPNWPKPPLPPLPPALPLPPCPPSP

SEQ ID NO: 1527226 - protein, 24 aa, Mycobacterium tuberculosis
PAPPVEVPPPMPPPPPVTITQTVA

SEQ ID NO: 1527227 - protein, 20 aa, Mycobacterium tuberculosis
PAPPVPPTPGGTPSPPLPPL

SEQ ID NO: 1527228 - protein, 25 aa, Mycobacterium tuberculosis
PAPSCPPHWWPTTAIRRRVPPENSA

SEQ ID NO: 1527229 - protein, 21 aa, Mycobacterium tuberculosis
PAPVTFVDIAGLIKGASEGAG

SEQ ID NO: 1527230 - protein, 27 aa, Mycobacterium tuberculosis
PAQNFNTTFPVGPFFGLGVVNISGIEI

SEQ ID NO: 1527231 - protein, 17 aa, Mycobacterium tuberculosis
PAREVYLLQRTKGPQGK

SEQ ID NO: 1527232 - protein, 22 aa, Mycobacterium tuberculosis
PARGGRHLGFAKALVYEMPHTL

SEQ ID NO: 1527233 - protein, 24 aa, Mycobacterium tuberculosis
PARHLGGVLYLFVRGMCGAATPVT

SEQ ID NO: 1527234 - protein, 25 aa, Mycobacterium tuberculosis
PARPASPAVLAARAGFARGGGRGTG

SEQ ID NO: 1527235 - protein, 28 aa, Mycobacterium tuberculosis
PARPPHVGVLLQNTPFFSATLVAGALSG

SEQ ID NO: 1527236 - protein, 21 aa, Mycobacterium tuberculosis
PARRGAPADGRRRRARGTHGG

SEQ ID NO: 1527237 - protein, 17 aa, Mycobacterium tuberculosis
PARWFLDHARVALSSGH

SEQ ID NO: 1527238 - protein, 21 aa, Mycobacterium tuberculosis
PARWMQLLAKHRAQISSAPNF

SEQ ID NO: 1527239 - protein, 31 aa, Mycobacterium tuberculosis
PASADEVSVAVAALFGTHAQEYQTVSAQVAT

SEQ ID NO: 1527240 - protein, 19 aa, Mycobacterium tuberculosis
PASFRRWLNPVNAAAATAL

SEQ ID NO: 1527241 - protein, 20 aa, Mycobacterium tuberculosis
PASGMLFVGTPDGQIVAPGP

SEQ ID NO: 1527242 - protein, 32 aa, Mycobacterium tuberculosis; identical to SEQ ID NO: 236711

SEQ ID NO: 1527243 - protein, 24 aa, Mycobacterium tuberculosis
PASMTPFPTMYELFSVGWGKPDLR

SEQ ID NO: 1527244 - protein, 24 aa, Mycobacterium tuberculosis
PASPLAIGLFGVNPTVGSIGPGSI

SEQ ID NO: 1527245 - protein, 27 aa, Mycobacterium tuberculosis
PASPPTPWPVTSSPTMAALPPPPPQPG

SEQ ID NO: 1527246 - protein, 26 aa, Mycobacterium tuberculosis
PATLIAALPAILGFVPEKSLVLVSLA

SEQ ID NO: 1527247 - protein, 24 aa, Mycobacterium tuberculosis
PATNYDVMFVPQGIGADLIATIEG

SEQ ID NO: 1527248 - protein, 24 aa, Mycobacterium tuberculosis
PATPAPGPAIAGVAADPTGRTVRG

SEQ ID NO: 1527249 - protein, 17 aa, Mycobacterium tuberculosis
PATPIGLWGYSGGGLAS

SEQ ID NO: 1527250 - protein, 25 aa, Mycobacterium tuberculosis
PATQPLPVMVFIHGGGYILGSSATP

SEQ ID NO: 1527251 - protein, 17 aa, Mycobacterium tuberculosis
PATSAPPPSFRPSTSRP

SEQ ID NO: 1527252 - protein, 21 aa, Mycobacterium tuberculosis
PATYHWFTGDAMVHGVALRDG

SEQ ID NO: 1527253 - protein, 21 aa, Mycobacterium tuberculosis
PAVATRLCWPDQAKADELQHA

SEQ ID NO: 1527254 - protein, 20 aa, Mycobacterium tuberculosis
PAVFVPDSKPLDALLREMQR

SEQ ID NO: 1527255 - protein, 24 aa, Mycobacterium tuberculosis
PAVGALLCLLAKLSGGKAVAEVGT

SEQ ID NO: 1527256 - protein, 24 aa, Mycobacterium tuberculosis
PAVIARPPILPKPRNPRDDRILLE

SEQ ID NO: 1527257 - protein, 24 aa, Mycobacterium tuberculosis
PAVIARYPAPLGAPTVLLYAHHDV

SEQ ID NO: 1527258 - protein, 17 aa, Mycobacterium tuberculosis
PAVISVNEKINEPRFPS

SEQ ID NO: 1527259 - protein, 20 aa, Mycobacterium tuberculosis
PAVLSAQPVYFDYWSARGVD

SEQ ID NO: 1527260 - protein, 18 aa, Mycobacterium tuberculosis
PAVMAVTAVPVATAGWSV

SEQ ID NO: 1527261 - protein, 23 aa, Mycobacterium tuberculosis
PAVRAMLMLCVTIRMVASIGGPR

SEQ ID NO: 1527262 - protein, 17 aa, Mycobacterium tuberculosis
PAVRWVMTGWQRLHFRF

SEQ ID NO: 1527263 - protein, 19 aa, Mycobacterium tuberculosis
PAVSTPVWPTPAATTRAAS

SEQ ID NO: 1527264 - protein, 17 aa, Mycobacterium tuberculosis
PAWGTRAPATGACGTQA

SEQ ID NO: 1527265 - protein, 20 aa, Mycobacterium tuberculosis
PAWKWRARETPAAAVAPETV

SEQ ID NO: 1527266 - protein, 22 aa, Mycobacterium tuberculosis
PAWLPNPLLANLSQTGGSSMLT

SEQ ID NO: 1527267 - protein, 21 aa, Mycobacterium tuberculosis
PAYGWFGVVLGGAGTRRRWGA

SEQ ID NO: 1527268 - protein, 24 aa, Mycobacterium tuberculosis
PAYTGRMFTAPVPALRMPDESMDP

SEQ ID NO: 1527269 - protein, 23 aa, Mycobacterium tuberculosis
PCDAPGWFLYLTDIPRAGVEYGQ

SEQ ID NO: 1527270 - protein, 18 aa, Mycobacterium tuberculosis
PCHRAILSQGIYGFENVG

SEQ ID NO: 1527271 - protein, 19 aa, Mycobacterium tuberculosis
PCHRAILSQGIYGFENVGG

SEQ ID NO: 1527272 - protein, 17 aa, Mycobacterium tuberculosis
PCRLERAGHRLGLGRRP

SEQ ID NO: 1527273 - protein, 17 aa, Mycobacterium tuberculosis
PCRPECAPGLPGTRCAA

SEQ ID NO: 1527274 - protein, 32 aa, Mycobacterium tuberculosis
PCRTFAAFLDLRYWIKTFTRAAKPGAYLRVIA

SEQ ID NO: 1527275 - protein, 19 aa, Mycobacterium tuberculosis
PCRVACSRPPWTCCPASTH

SEQ ID NO: 1527276 - protein, 27 aa, Mycobacterium tuberculosis
PCTCRAERSWLPSPMPPASCVGRQCWW

SEQ ID NO: 1527277 - protein, 17 aa, Mycobacterium tuberculosis
PCWPAVFAAIGSAVTDT

SEQ ID NO: 1527278 - protein, 24 aa, Mycobacterium tuberculosis
PDAELTERPDLFPAWDSMSEAQKR

SEQ ID NO: 1527279 - protein, 22 aa, Mycobacterium tuberculosis
PDAHGLHLFATLLAAGERAFGA

SEQ ID NO: 1527280 - protein, 24 aa, Mycobacterium tuberculosis
PDAHGLHLFATLLAAGERAFGAGP

SEQ ID NO: 1527281 - protein, 17 aa, Mycobacterium tuberculosis
PDAHYHKIHLYDAFGFT

SEQ ID NO: 1527282 - protein, 22 aa, Mycobacterium tuberculosis
PDAHYHKIHLYDAFGFTESRTV

SEQ ID NO: 1527283 - protein, 19 aa, Mycobacterium tuberculosis
PDAIQCADPFHVVAWATEA

SEQ ID NO: 1527284 - protein, 24 aa, Mycobacterium tuberculosis
PDAPMAGVTYWREAAQLKRNEAND

SEQ ID NO: 1527285 - protein, 29 aa, Mycobacterium tuberculosis
PDATMLFESLLPRYLTTRVYAALLESAAS

SEQ ID NO: 1527286 - protein, 19 aa, Mycobacterium tuberculosis
PDAVLLPGGPNGGGRRRRH

SEQ ID NO: 1527287 - protein, 21 aa, Mycobacterium tuberculosis
PDCIAVIAPSDSECAPAAAGC

SEQ ID NO: 1527288 - protein, 24 aa, Mycobacterium tuberculosis
PDEVPLNFLNPRPGTPFADLEVMP

SEQ ID NO: 1527289 - protein, 23 aa, Mycobacterium tuberculosis
PDFFEGVMMPELFMADAMGATGK

SEQ ID NO: 1527290 - protein, 20 aa, Mycobacterium tuberculosis
PDFRLFWDNAYAVHTLTLDF

SEQ ID NO: 1527291 - protein, 17 aa, Mycobacterium tuberculosis
  misc_feature (7)..(7): Xaa can be any naturally occurring amino acid
PDGAPPXQGTYVRYDHD

SEQ ID NO: 1527292 - protein, 25 aa, Mycobacterium tuberculosis
PDGEDLSWLWDVRFEHFETTRVVAA

SEQ ID NO: 1527293 - protein, 29 aa, Mycobacterium tuberculosis
PDGISRLRFRLRWRGFRLIVDANHTDVTF

SEQ ID NO: 1527294 - protein, 23 aa, Mycobacterium tuberculosis
PDIAQLVKWGYAATQLLEGLVEN

SEQ ID NO: 1527295 - protein, 19 aa, Mycobacterium tuberculosis
PDIPGLPDFKWPPTPGSPL

SEQ ID NO: 1527296 - protein, 24 aa, Mycobacterium tuberculosis
PDKPGRYFTVRAGSLVAWNAEQSG

SEQ ID NO: 1527297 - protein, 20 aa, Mycobacterium tuberculosis
PDLALDFTPGRYGPYSERVR

SEQ ID NO: 1527298 - protein, 26 aa, Mycobacterium tuberculosis
PDLIDPALLRPGRLERLVFVEPPDAA

SEQ ID NO: 1527299 - protein, 20 aa, Mycobacterium tuberculosis
PDLIYIDLHLVHEVTSPQAF

SEQ ID NO: 1527300 - protein, 38 aa, Mycobacterium tuberculosis
PDLTLPPLQIPGISVPAFSLPAITLPSLTIPAATTPAN

SEQ ID NO: 1527301 - protein, 23 aa, Mycobacterium tuberculosis
PDNEFRVVLARRGQHWVSAVRVG

SEQ ID NO: 1527302 - protein, 25 aa, Mycobacterium tuberculosis
PDNPVNWPRVLTVWRANLIGSSGKG

SEQ ID NO: 1527303 - protein, 38 aa, Mycobacterium tuberculosis
PDPTKLILQLLKDFLELLRYLAVELLPGPLGDLIAQVL

SEQ ID NO: 1527304 - protein, 17 aa, Mycobacterium tuberculosis
PDPVPVILLSRLAVDRK

SEQ ID NO: 1527305 - protein, 25 aa, Mycobacterium tuberculosis
PDQDVFASRLPRYFPTALRERFTPE

SEQ ID NO: 1527306 - protein, 28 aa, Mycobacterium tuberculosis
PDQDVFASRLPRYFPTALRERFTPEIRS

SEQ ID NO: 1527307 - protein, 22 aa, Mycobacterium tuberculosis
PDQIRDSCEAYLLVALENRIAD

SEQ ID NO: 1527308 - protein, 28 aa, Mycobacterium tuberculosis
PDRANFTQLLSRGSWWRIHSPPVVAEPP

SEQ ID NO: 1527309 - protein, 19 aa, Mycobacterium tuberculosis
PDRFLPFAGRTRGCLLRST

SEQ ID NO: 1527310 - protein, 23 aa, Mycobacterium tuberculosis
PDRLRRLLSKQVGLILRRTIDTD

SEQ ID NO: 1527311 - protein, 22 aa, Mycobacterium tuberculosis
PDRLRRWMAVAARIELRTGGAY

SEQ ID NO: 1527312 - protein, 28 aa, Mycobacterium tuberculosis
PDRMSAFAGMFPAIPRPGNTASSTTAPH

SEQ ID NO: 1527313 - protein, 19 aa, Mycobacterium tuberculosis
PDRRHLTLPVIGCVRTHEN

SEQ ID NO: 1527314 - protein, 35 aa, Mycobacterium tuberculosis
PDRRLVFGQRRLEAARLLGWERIPVHVCHTIADVV

SEQ ID NO: 1527315 - protein, 23 aa, Mycobacterium tuberculosis
PDRSAVVLADRGWVGGFAGGDFP

SEQ ID NO: 1527316 - protein, 17 aa, Mycobacterium tuberculosis
PDRVHPPRRRLRSRYSW

SEQ ID NO: 1527317 - protein, 17 aa, Mycobacterium tuberculosis
PDSHDICFIPSGNTRAF

SEQ ID NO: 1527318 - protein, 20 aa, Mycobacterium tuberculosis
PDSMRAGLQALAWIAHQPEA

SEQ ID NO: 1527319 - protein, 19 aa, Mycobacterium tuberculosis
PDSPPRTIALIGDLTFVHD

SEQ ID NO: 1527320 - protein, 30 aa, Mycobacterium tuberculosis
PDTAVPVKLHVPIFLDIPVTGTLGTFTVHG

SEQ ID NO: 1527321 - protein, 33 aa, Mycobacterium tuberculosis
PDTAVPVKLHVPIFLDIPVTGTLVHVHRSWLQI

SEQ ID NO: 1527322 - protein, 19 aa, Mycobacterium tuberculosis
PDTLRLSVTLLLVPTQSGE

SEQ ID NO: 1527323 - protein, 18 aa, Mycobacterium tuberculosis
PDTMTYLTALLPVAQGVS

SEQ ID NO: 1527324 - protein, 18 aa, Mycobacterium tuberculosis
PDTPLPCAGATVGPFGGP

SEQ ID NO: 1527325 - protein, 21 aa, Mycobacterium tuberculosis
PDTQLVTIIVSWLSGELPQRH

SEQ ID NO: 1527326 - protein, 19 aa, Mycobacterium tuberculosis
PDVPWTRFFGVRPVSILYR

SEQ ID NO: 1527327 - protein, 20 aa, Mycobacterium tuberculosis
PDYLQTCRVTFPSGRIADAL

SEQ ID NO: 1527328 - protein, 25 aa, Mycobacterium tuberculosis
PDYPASTYANYLPRFFRGISDDADA

SEQ ID NO: 1527329 - protein, 18 aa, Mycobacterium tuberculosis
PEAAFAHFGRRFDDLSTE

SEQ ID NO: 1527330 - protein, 19 aa, Mycobacterium tuberculosis
PEAKLFRRGVTNSPAVTEG

SEQ ID NO: 1527331 - protein, 23 aa, Mycobacterium tuberculosis
PEAPPLTAPIIPDAGNPASFGVP

SEQ ID NO: 1527332 - protein, 18 aa, Mycobacterium tuberculosis
PEAVVIRRLPHPVLRGAV

SEQ ID NO: 1527333 - protein, 25 aa, Mycobacterium tuberculosis
PECQQAVRFGLFHLLQASARAERRA

SEQ ID NO: 1527334 - protein, 27 aa, Mycobacterium tuberculosis
PEDFWRSAGLPAYRWPDPNGTRFPNGA

SEQ ID NO: 1527335 - protein, 20 aa, Mycobacterium tuberculosis
PEEIKRAYRKLARDLHPDAN

SEQ ID NO: 1527336 - protein, 17 aa, Mycobacterium tuberculosis
PEELVPVAMPNWHYLHI

SEQ ID NO: 1527337 - protein, 24 aa, Mycobacterium tuberculosis
PEEVRNCFADMAKVAIALGDSARQ

SEQ ID NO: 1527338 - protein, 29 aa, Mycobacterium tuberculosis
PEFATYAPGLWRYWAEHLDPDRARRNDPL

SEQ ID NO: 1527339 - protein, 20 aa, Mycobacterium tuberculosis
PEFLNRIDDIIVFHQLTREE

SEQ ID NO: 1527340 - protein, 21 aa, Mycobacterium tuberculosis
PEFLNRIDDIIVFHQLTREEI

SEQ ID NO: 1527341 - protein, 26 aa, Mycobacterium tuberculosis
PEFVENFFMFIAEEVREYLAQLGFRT

SEQ ID NO: 1527342 - protein, 21 aa, Mycobacterium tuberculosis
PEHKIRVISPYIGGGFGNKVP

SEQ ID NO: 1527343 - protein, 22 aa, Mycobacterium tuberculosis
PEHKIRVISPYIGGGFGNKVPI

SEQ ID NO: 1527344 - protein, 25 aa, Mycobacterium tuberculosis
PEIDSLRMYLGAGSAPMLQAAAAWD

SEQ ID NO: 1527345 - protein, 18 aa, Mycobacterium tuberculosis
PEINSGRMFFGAGSGPML

SEQ ID NO: 1527346 - protein, 23 aa, Mycobacterium tuberculosis
PEINSGRMFFGAGSGPMLAAAAA

SEQ ID NO: 1527347 - protein, 24 aa, Mycobacterium tuberculosis
PEINSGRMFFGAGSGPMLAAAAAW

SEQ ID NO: 1527348 - protein, 26 aa, Mycobacterium tuberculosis
PEINSGRMFFGAGSGPMLAAAAWDGL

SEQ ID NO: 1527349 - protein, 19 aa, Mycobacterium tuberculosis
PEINSLRMFTGAGSAPMLA

SEQ ID NO: 1527350 - protein, 26 aa, Mycobacterium tuberculosis
PEIRPAHLLMALLTQNDGIAAPLLEA

SEQ ID NO: 1527351 - protein, 19 aa, Mycobacterium tuberculosis
PEIWPEPTEFRPLRWDPNA

SEQ ID NO: 1527352 - protein, 26 aa, Mycobacterium tuberculosis
PELGYRLLQRLGADVADYGFIETSAK

SEQ ID NO: 1527353 - protein, 17 aa, Mycobacterium tuberculosis
PELIGLTAGADVVLDPG

SEQ ID NO: 1527354 - protein, 26 aa, Mycobacterium tuberculosis
PELISRWAAYWPPAGAEALFRSLSER

SEQ ID NO: 1527355 - protein, 17 aa, Mycobacterium tuberculosis
PELITVRGRRLLAQADV

SEQ ID NO: 1527356 - protein, 31 aa, Mycobacterium tuberculosis
PELKLPDLELIFAPAPFYDEALVPPAGHGVV

SEQ ID NO: 1527357 - protein, 25 aa, Mycobacterium tuberculosis
PELLRVLDFAPTPKARLRPPIRREG

SEQ ID NO: 1527358 - protein, 36 aa, Mycobacterium tuberculosis
PELLRVLDFAPTPKARLRPPIRREGLGLVFETPTDE

SEQ ID NO: 1527359 - protein, 19 aa, Mycobacterium tuberculosis
PELSQPWEPVPACARPRPV

SEQ ID NO: 1527360 - protein, 19 aa, Mycobacterium tuberculosis
PEMMATAAFDLARIGSQVS

SEQ ID NO: 1527361 - protein, 17 aa, Mycobacterium tuberculosis
PEPLVPPTPLLPPAPPS

SEQ ID NO: 1527362 - protein, 26 aa, Mycobacterium tuberculosis
PEPWRVEALVLLAFSAYARGDGPLAG

SEQ ID NO: 1527363 - protein, 17 aa, Mycobacterium tuberculosis
PEQIRPWVPGTYLTLGT

SEQ ID NO: 1527364 - protein, 20 aa, Mycobacterium tuberculosis
PERAYVIFGNHEFGLPPGDT

SEQ ID NO: 1527365 - protein, 31 aa, Mycobacterium tuberculosis
PERGRKRGWWASWRWGLSQVVRPKTPRGDGN

SEQ ID NO: 1527366 - protein, 20 aa, Mycobacterium tuberculosis
PERIDTDVLAALRSAERTPA

SEQ ID NO: 1527367 - protein, 27 aa, Mycobacterium tuberculosis
PERLRSLERLECLARRLPAAQHTLINQ

SEQ ID NO: 1527368 - protein, 24 aa, Mycobacterium tuberculosis
PERSASWVVPLLWRRWSPGYHAEE

SEQ ID NO: 1527369 - protein, 18 aa, Mycobacterium tuberculosis
PERTAAPAAPPAGSSASA

SEQ ID NO: 1527370 - protein, 24 aa, Mycobacterium tuberculosis
PERVVQLCHPGLHNAFPPLRTRKV

SEQ ID NO: 1527371 - protein, 33 aa, Mycobacterium tuberculosis
PESDFPTLIDLYLQGRLPLQRFVSERIGLEDVE

SEQ ID NO: 1527372 - protein, 23 aa, Mycobacterium tuberculosis
PESKRFCWNCGRPVGRSDSETKG

SEQ ID NO: 1527373 - protein, 23 aa, Mycobacterium tuberculosis
PESLLLARPRTPPPPPPPPPPPP

SEQ ID NO: 1527374 - protein, 20 aa, Mycobacterium tuberculosis
PESLRSLPGCHLLVRPEVMR

SEQ ID NO: 1527375 - protein, 26 aa, Mycobacterium tuberculosis
PESRFLREIPQELIDWRRTAPKPSFS

SEQ ID NO: 1527376 - protein, 25 aa, Mycobacterium tuberculosis
PESWPRPWHPPGSLAGITASARFDF

SEQ ID NO: 1527377 - protein, 19 aa, Mycobacterium tuberculosis
PETMRRFRAGDLRPGPGRL

SEQ ID NO: 1527378 - protein, 18 aa, Mycobacterium tuberculosis
PETVTWILRDLGVYAIRL

SEQ ID NO: 1527379 - protein, 29 aa, Mycobacterium tuberculosis
PETWTHGSAAQRQKWFTVGYQTGDPNICD

SEQ ID NO: 1527380 - protein, 33 aa, Mycobacterium tuberculosis
PEVAEVWRRGSVIGSWLLDLTAIALRESPDLAE

SEQ ID NO: 1527381 - protein, 30 aa, Mycobacterium tuberculosis
PEVLAASASMRPLPGPQAHPAGMAVTVGLA

SEQ ID NO: 1527382 - protein, 25 aa, Mycobacterium tuberculosis
PEVLEWRYPVLLREFAVRQGSGGAG

SEQ ID NO: 1527383 - protein, 20 aa, Mycobacterium tuberculosis
PEYGRLRWPAYPAGTNNDRL

SEQ ID NO: 1527384 - protein, 27 aa, Mycobacterium tuberculosis
PEYKQVALFSATMPPAIRKLSAKYLHD

SEQ ID NO: 1527385 - protein, 17 aa, Mycobacterium tuberculosis
PFAALAFKIATHPFFGK

SEQ ID NO: 1527386 - protein, 20 aa, Mycobacterium tuberculosis
PFADLLVPKLTASVTDGAVG

SEQ ID NO: 1527387 - protein, 18 aa, Mycobacterium tuberculosis
PFAELGLNSLMAMAIRRE

SEQ ID NO: 1527388 - protein, 23 aa, Mycobacterium tuberculosis
PFAQALRLALIDAAPDVAQDPVV

SEQ ID NO: 1527389 - protein, 22 aa, Mycobacterium tuberculosis
PFAWREYLLQCWFVARVSTLPG

SEQ ID NO: 1527390 - protein, 20 aa, Mycobacterium tuberculosis
PFDLLAVVPPHVPSAAARSA

SEQ ID NO: 1527391 - protein, 19 aa, Mycobacterium tuberculosis
PFDWRLPDLVGAQPSIRCS

SEQ ID NO: 1527392 - protein, 22 aa, Mycobacterium tuberculosis
PFGADVPTPWLRQALTQTSRLS

SEQ ID NO: 1527393 - protein, 19 aa, Mycobacterium tuberculosis
PFGMDEFLARLRAAVRRNT

SEQ ID NO: 1527394 - protein, 18 aa, Mycobacterium tuberculosis
PFGQALPTVAGGGALVSA

SEQ ID NO: 1527395 - protein, 29 aa, Mycobacterium tuberculosis
PFKCPAAPFEAAFLIAAQLGDRYATGTVQ

SEQ ID NO: 1527396 - protein, 18 aa, Mycobacterium tuberculosis
PFPPAPPVPPLPPAAPSA

SEQ ID NO: 1527397 - protein, 22 aa, Mycobacterium tuberculosis
PFPPRVYLRLTLESRCESCQRR

SEQ ID NO: 1527398 - protein, 18 aa, Mycobacterium tuberculosis
PFPTDSPITTGTAAAAEA

SEQ ID NO: 1527399 - protein, 20 aa, Mycobacterium tuberculosis
PFPTTARLTGRWLRGRLPTL

SEQ ID NO: 1527400 - protein, 22 aa, Mycobacterium tuberculosis
PFPVRAVAIRVAGWIDKLGAVW

SEQ ID NO: 1527401 - protein, 19 aa, Mycobacterium tuberculosis
PFQTLTGRPLITTAPTAFR

SEQ ID NO: 1527402 - protein, 25 aa, Mycobacterium tuberculosis
PFSGPARKVLELTFREALRAGPQLH

SEQ ID NO: 1527403 - protein, 18 aa, Mycobacterium tuberculosis
PFSKPLQNLAGLPAWLAS

SEQ ID NO: 1527404 - protein, 21 aa, Mycobacterium tuberculosis
PFSLTLLGFINVNVPAIQTAP

SEQ ID NO: 1527405 - protein, 26 aa, Mycobacterium tuberculosis
PFTNPGAQPRCGLGWRARVHRRRRAG

SEQ ID NO: 1527406 - protein, 18 aa, Mycobacterium tuberculosis
PFVIPATSNVFISTVDFA

SEQ ID NO: 1527407 - protein, 21 aa, Mycobacterium tuberculosis
PGAALPALARTPVEAIGVDLV

SEQ ID NO: 1527408 - protein, 32 aa, Mycobacterium tuberculosis
PGAAQLPLAPAINYPPPCLTGFLPASEWRSPA

SEQ ID NO: 1527409 - protein, 22 aa, Mycobacterium tuberculosis
PGAGWPPSPPRSARLPPPLPST

SEQ ID NO: 1527410 - protein, 17 aa, Mycobacterium tuberculosis
PGALRRLDRVRVVVIDG

SEQ ID NO: 1527411 - protein, 23 aa, Mycobacterium tuberculosis
PGAPAPPMPPLPPAPPAPPLPIN

SEQ ID NO: 1527412 - protein, 28 aa, Mycobacterium tuberculosis
PGARVKEPHITGPRIKQPHIPATGIETT

SEQ ID NO: 1527413 - protein, 17 aa, Mycobacterium tuberculosis
PGAWLLISTCDAADLVA

SEQ ID NO: 1527414 - protein, 21 aa, Mycobacterium tuberculosis
PGCGRWRWRAPRSRVACPACC

SEQ ID NO: 1527415 - protein, 22 aa, Mycobacterium tuberculosis
PGCRGWPRRRAAARASVRHATA

SEQ ID NO: 1527416 - protein, 17 aa, Mycobacterium tuberculosis
PGDAGVLAALLLNRISL

SEQ ID NO: 1527417 - protein, 27 aa, Mycobacterium tuberculosis
PGDERHMLWFALMKPMTSTATGREAAH

SEQ ID NO: 1527418 - protein, 18 aa, Mycobacterium tuberculosis
PGDLALLIGYGAGLSYAA

SEQ ID NO: 1527419 - protein, 22 aa, Mycobacterium tuberculosis
PGDLALLIGYGAGLSYAAPGGA

SEQ ID NO: 1527420 - protein, 19 aa, Mycobacterium tuberculosis
PGDLTFSWYAVDKTGQPWV

SEQ ID NO: 1527421 - protein, 27 aa, Mycobacterium tuberculosis
PGDQRVLGAALWYAATVKDAVIVAAAG

SEQ ID NO: 1527422 - protein, 23 aa, Mycobacterium tuberculosis
PGDSWQVRRLLTHSPDTAGGLMT

SEQ ID NO: 1527423 - protein, 19 aa, Mycobacterium tuberculosis
PGDTYLAGAKILRQYGIGP

SEQ ID NO: 1527424 - protein, 21 aa, Mycobacterium tuberculosis
PGEFLDPLGGLAALRAKVLDT

SEQ ID NO: 1527425 - protein, 24 aa, Mycobacterium tuberculosis
PGEPSWPTPWGRGRPGWHLECSAM

SEQ ID NO: 1527426 - protein, 27 aa, Mycobacterium tuberculosis
PGEQLYTLDYYLKLAERIVDAGAHVLA

SEQ ID NO: 1527427 - protein, 17 aa, Mycobacterium tuberculosis
PGFADSLLRVWQAKKRT

SEQ ID NO: 1527428 - protein, 17 aa, Mycobacterium tuberculosis
PGFTIPGSPLNLTANGG

SEQ ID NO: 1527429 - protein, 23 aa, Mycobacterium tuberculosis
PGFTTISMYPRMWAASGVDYPTL

SEQ ID NO: 1527430 - protein, 18 aa, Mycobacterium tuberculosis
PGGAAFGLGNGGNGGNGG

SEQ ID NO: 1527431 - protein, 22 aa, Mycobacterium tuberculosis
PGGAGGLLFGNGGAGGPGASGG

SEQ ID NO: 1527432 - protein, 27 aa, Mycobacterium tuberculosis
PGGAGGRGGLLIGDGGAGGAGGVGGTG

SEQ ID NO: 1527433 - protein, 18 aa, Mycobacterium tuberculosis
PGGLNIPQNAIPLTIDAS

SEQ ID NO: 1527434 - protein, 17 aa, Mycobacterium tuberculosis
PGGPGGLLLGNGGNGGS

SEQ ID NO: 1527435 - protein, 21 aa, Mycobacterium tuberculosis
PGGPGGLLYGNGGHGGAGAAG

SEQ ID NO: 1527436 - protein, 29 aa, Mycobacterium tuberculosis
PGGPGGNPFWHPLAPGGPGGVRNSFFLCG

SEQ ID NO: 1527437 - protein, 18 aa, Mycobacterium tuberculosis
PGGQGGKGGLIGLPGQNG

SEQ ID NO: 1527438 - protein, 18 aa, Mycobacterium tuberculosis
PGGRQYLPKAVIGATTRA

SEQ ID NO: 1527439 - protein, 18 aa, Mycobacterium tuberculosis
PGGRRRALLTGTVAVVGL

SEQ ID NO: 1527440 - protein, 23 aa, Mycobacterium tuberculosis
PGGTLIPQLPLGLGLSGGTPPFD

SEQ ID NO: 1527441 - protein, 20 aa, Mycobacterium tuberculosis
PGHGLALAALGLDPIVDLHM

SEQ ID NO: 1527442 - protein, 17 aa, Mycobacterium tuberculosis
PGHGLDGRVDCGQRLLL

SEQ ID NO: 1527443 - protein, 21 aa, Mycobacterium tuberculosis
PGHPGSILLPLPEVSLRGRRP

SEQ ID NO: 1527444 - protein, 19 aa, Mycobacterium tuberculosis
PGIDMYWADQGCGNGGRAE

SEQ ID NO: 1527445 - protein, 20 aa, Mycobacterium tuberculosis
PGIDWAKYALKAPVMMVRSP

SEQ ID NO: 1527446 - protein, 21 aa, Mycobacterium tuberculosis
PGIDWAKYALKAPVMMVRSPD

SEQ ID NO: 1527447 - protein, 28 aa, Mycobacterium tuberculosis
PGIGHPCWANYFPVTRAVPEPPSIRQCI

SEQ ID NO: 1527448 - protein, 23 aa, Mycobacterium tuberculosis
PGIITPRIEHPPVPGARVKEPHI

SEQ ID NO: 1527449 - protein, 19 aa, Mycobacterium tuberculosis
PGIWRAYADHRMAMAGAII

SEQ ID NO: 1527450 - protein, 19 aa, Mycobacterium tuberculosis
PGIWRAYADHRTAMAGAII

SEQ ID NO: 1527451 - protein, 29 aa, Mycobacterium tuberculosis
PGKEGHEVLIFRLFHAPPPSVCSRRRVRH

SEQ ID NO: 1527452 - protein, 20 aa, Mycobacterium tuberculosis
PGKKITRLSLLSGGEKALTA

SEQ ID NO: 1527453 - protein, 27 aa, Mycobacterium tuberculosis
PGKPVRLPIPWRDVGGYRPTGRSIAAC

SEQ ID NO: 1527454 - protein, 25 aa, Mycobacterium tuberculosis
PGKVPSWISDIANIFNIGAGNWASA

SEQ ID NO: 1527455 - protein, 20 aa, Mycobacterium tuberculosis
PGLKLVKVETLSQAVDALHA

SEQ ID NO: 1527456 - protein, 26 aa, Mycobacterium tuberculosis
PGLLDLSSLWQIYAVDRPTLKDRTFV

SEQ ID NO: 1527457 - protein, 20 aa, Mycobacterium tuberculosis
PGLLTILHDGGYRDTEIMRW

SEQ ID NO: 1527458 - protein, 24 aa, Mycobacterium tuberculosis
PGLNVTTLGLPFYGATPDNPYPTT

SEQ ID NO: 1527459 - protein, 20 aa, Mycobacterium tuberculosis
PGLQDFIRKSADPAKPIAVN

SEQ ID NO: 1527460 - protein, 21 aa, Mycobacterium tuberculosis
PGLSLPRTLIFDYPTASALAE

SEQ ID NO: 1527461 - protein, 19 aa, Mycobacterium tuberculosis
PGLVRSLPGWSAAVASHEG

SEQ ID NO: 1527462 - protein, 26 aa, Mycobacterium tuberculosis
PGMPPATLLDYFPEDFLLVIDESHVT

SEQ ID NO: 1527463 - protein, 30 aa, Mycobacterium tuberculosis
PGNNGQLKHHLPPDNAVDVALRPCARANRC

SEQ ID NO: 1527464 - protein, 24 aa, Mycobacterium tuberculosis
PGNSLFITVNCWGRLVTGVGAALG

SEQ ID NO: 1527465 - protein, 25 aa, Mycobacterium tuberculosis
PGPDLVDLFPAHRPRPGYLPVLRAY

SEQ ID NO: 1527466 - protein, 18 aa, Mycobacterium tuberculosis
PGPKPSASIGQWPRHQPQ

SEQ ID NO: 1527467 - protein, 18 aa, Mycobacterium tuberculosis
PGPLWSVSIERFLDTAWW

SEQ ID NO: 1527468 - protein, 17 aa, Mycobacterium tuberculosis
PGPMPLHHIHLGRAQPG

SEQ ID NO: 1527469 - protein, 22 aa, Mycobacterium tuberculosis
PGPPPTVWSRRWRQPWAPPTSV

SEQ ID NO: 1527470 - protein, 23 aa, Mycobacterium tuberculosis
PGPPVGGLLFTCNGRGRRMFGVT

SEQ ID NO: 1527471 - protein, 27 aa, Mycobacterium tuberculosis
PGPQGALYWNGARLDALYLLSAPVDGA

SEQ ID NO: 1527472 - protein, 18 aa, Mycobacterium tuberculosis
PGPRRCGGLRRRRRGCPG

SEQ ID NO: 1527473 - protein, 17 aa, Mycobacterium tuberculosis
PGPTGERADWWWYEPFQ

SEQ ID NO: 1527474 - protein, 26 aa, Mycobacterium tuberculosis
PGQAGGPGGLLYGNGGNGAAGGPNQA

SEQ ID NO: 1527475 - protein, 19 aa, Mycobacterium tuberculosis
PGQDALWLRLFGCLPRVPI

SEQ ID NO: 1527476 - protein, 22 aa, Mycobacterium tuberculosis
PGQLSRRRGASARRLRLRSRRA

SEQ ID NO: 1527477 - protein, 18 aa, Mycobacterium tuberculosis
PGQMLGGLPVGQMGARAG

SEQ ID NO: 1527478 - protein, 24 aa, Mycobacterium tuberculosis
PGQPARLPFWRGDDAGRPAELGAA

SEQ ID NO: 1527479 - protein, 18 aa, Mycobacterium tuberculosis
PGQPLWGHGWDESAWPEN

SEQ ID NO: 1527480 - protein, 20 aa, Mycobacterium tuberculosis
PGQRSGLPPAPRPNSQSDLI

SEQ ID NO: 1527481 - protein, 25 aa, Mycobacterium tuberculosis
PGRAIPFGAFRHLISLPASGADIGR

SEQ ID NO: 1527482 - protein, 19 aa, Mycobacterium tuberculosis
PGRGAWLHPLRQCAQQAIR

SEQ ID NO: 1527483 - protein, 21 aa, Mycobacterium tuberculosis
PGRIRAGIRQLTAPRRVARTA

SEQ ID NO: 1527484 - protein, 17 aa, Mycobacterium tuberculosis
PGRLERMRSAPTGFIDA

SEQ ID NO: 1527485 - protein, 19 aa, Mycobacterium tuberculosis
PGRLGQQPGQPLRADQRTT

SEQ ID NO: 1527486 - protein, 24 aa, Mycobacterium tuberculosis
PGRLSSRFWRLLGASTEKNRRRSL

SEQ ID NO: 1527487 - protein, 17 aa, Mycobacterium tuberculosis
PGRMAPTPGRRTRNGSV

SEQ ID NO: 1527488 - protein, 19 aa, Mycobacterium tuberculosis
PGRRCRYRRRPMAATPRPA

SEQ ID NO: 1527489 - protein, 21 aa, Mycobacterium tuberculosis
PGSALLFPALCTPTGDPPAPE

SEQ ID NO: 1527490 - protein, 21 aa, Mycobacterium tuberculosis
PGSALYHDTLAELWFASEEVA

SEQ ID NO: 1527491 - protein, 17 aa, Mycobacterium tuberculosis
PGSFYALPQSPQLFKQL

SEQ ID NO: 1527492 - protein, 23 aa, Mycobacterium tuberculosis
PGSGIDYGLLRYLRADTAERLRA

SEQ ID NO: 1527493 - protein, 20 aa, Mycobacterium tuberculosis
PGSGIPKSNFYPSPDRESAY

SEQ ID NO: 1527494 - protein, 18 aa, Mycobacterium tuberculosis
PGSLGRQPLGPLMPGRGG

SEQ ID NO: 1527495 - protein, 17 aa, Mycobacterium tuberculosis
PGSPVGPGGWFVGQRRP

SEQ ID NO: 1527496 - protein, 18 aa, Mycobacterium tuberculosis
PGSRIFFPTWHTTTAELP

SEQ ID NO: 1527497 - protein, 23 aa, Mycobacterium tuberculosis
PGSRIFFPTWHTTTAELPQTSTA

SEQ ID NO: 1527498 - protein, 22 aa, Mycobacterium tuberculosis
PGSRLAFEFVPDTAIFADERWR

SEQ ID NO: 1527499 - protein, 22 aa, Mycobacterium tuberculosis
PGSVDFFYLTASAAGIFGIPGQ

SEQ ID NO: 1527500 - protein, 22 aa, Mycobacterium tuberculosis
PGTARPGVLRPGASPGSMPPRP

SEQ ID NO: 1527501 - protein, 17 aa, Mycobacterium tuberculosis
PGTPITPIPGAPVTPIT

SEQ ID NO: 1527502 - protein, 24 aa, Mycobacterium tuberculosis
PGTRRRRALLPPGRPGAVHREGAG

SEQ ID NO: 1527503 - protein, 26 aa, Mycobacterium tuberculosis
PGTSIYVLLPGRRMPIPQLPGATAGA

SEQ ID NO: 1527504 - protein, 26 aa, Mycobacterium tuberculosis
PGTTRLLLRAVGDWLVRPGAQLQAVG

SEQ ID NO: 1527505 - protein, 23 aa, Mycobacterium tuberculosis
PGTVFALEMAFFGALVQAGSGHL

SEQ ID NO: 1527506 - protein, 19 aa, Mycobacterium tuberculosis
PGVGLRYEFTSYRGDRIGI

SEQ ID NO: 1527507 - protein, 17 aa, Mycobacterium tuberculosis
PGVGRAWAAGPGCAGRR

SEQ ID NO: 1527508 - protein, 20 aa, Mycobacterium tuberculosis
PGVWARHRKLAHTAPALLIR

SEQ ID NO: 1527509 - protein, 20 aa, Mycobacterium tuberculosis
PGWLNISGTLRRAPPGTALC

SEQ ID NO: 1527510 - protein, 18 aa, Mycobacterium tuberculosis
PGYSWTPIILADGAHHTN

SEQ ID NO: 1527511 - protein, 17 aa, Mycobacterium tuberculosis
PHDPDYARLWQIVNENN

SEQ ID NO: 1527512 - protein, 24 aa, Mycobacterium tuberculosis
PHGGIAFGWDRTTALLAGMDSIRE

SEQ ID NO: 1527513 - protein, 20 aa, Mycobacterium tuberculosis
PHGRVLATETYFSVGGGFIV

SEQ ID NO: 1527514 - protein, 24 aa, Mycobacterium tuberculosis
PHHRWPRHILDVKSAIAWARANVD

SEQ ID NO: 1527515 - protein, 18 aa, Mycobacterium tuberculosis
PHLTAAIIAKYISNLRLL

SEQ ID NO: 1527516 - protein, 24 aa, Mycobacterium tuberculosis
PHPRRPPRRRLPTAPAGGVDGNGG

SEQ ID NO: 1527517 - protein, 26 aa, Mycobacterium tuberculosis
PHQPRRTAPAPPWAKMPIGEPPPAPS

SEQ ID NO: 1527518 - protein, 19 aa, Mycobacterium tuberculosis
PHRFAVVDRLPRTPNGKLV

SEQ ID NO: 1527519 - protein, 18 aa, Mycobacterium tuberculosis
PHSGSAPLVPIYLGDDIT

SEQ ID NO: 1527520 - protein, 26 aa, Mycobacterium tuberculosis
PHWDPRHLWLVPITQAVQLQMVRNLP

SEQ ID NO: 1527521 - protein, 25 aa, Mycobacterium tuberculosis
PIAADDFWYLWQQMVTQPGVVDPAG

SEQ ID NO: 1527522 - protein, 17 aa, Mycobacterium tuberculosis
PIAFFLNVWGADENYIL

SEQ ID NO: 1527523 - protein, 21 aa, Mycobacterium tuberculosis
PIAGCRYHLGRLSYGGARGRW

SEQ ID NO: 1527524 - protein, 18 aa, Mycobacterium tuberculosis
PIAPQKLHFSENLSVWVS

SEQ ID NO: 1527525 - protein, 21 aa, Mycobacterium tuberculosis
PIARHPPFVPQPSVADWAQLE

SEQ ID NO: 1527526 - protein, 21 aa, Mycobacterium tuberculosis
PIASELILPIAVAVQNRITVN

SEQ ID NO: 1527527 - protein, 18 aa, Mycobacterium tuberculosis
PIAVKEAVLPFHRFRRAD

SEQ ID NO: 1527528 - protein, 25 aa, Mycobacterium tuberculosis
PIAVKEAVLPFHRFRRADGAAIDSL

SEQ ID NO: 1527529 - protein, 21 aa, Mycobacterium tuberculosis
PIAVTDFWTFPRSCNPTGGLM

SEQ ID NO: 1527530 - protein, 20 aa, Mycobacterium tuberculosis
PICPAPTTPTRWIASLTVPP

SEQ ID NO: 1527531 - protein, 19 aa, Mycobacterium tuberculosis
PIDHFLVQADLTVVVPGPL

SEQ ID NO: 1527532 - protein, 23 aa, Mycobacterium tuberculosis
PIDVTVRISGFFRDAFPACGDHA

SEQ ID NO: 1527533 - protein, 25 aa, Mycobacterium tuberculosis
PIEKKPLNHFLLGSATLSFGTAGCN

SEQ ID NO: 1527534 - protein, 23 aa, Mycobacterium tuberculosis
PIERTCEFLEWFGENVPISPIWL

SEQ ID NO: 1527535 - protein, 19 aa, Mycobacterium tuberculosis
PIGKRNGWLSGLHATELLG

SEQ ID NO: 1527536 - protein, 19 aa, Mycobacterium tuberculosis
PIGLWGYSGGGLASAWAAE

SEQ ID NO: 1527537 - protein, 37 aa, Mycobacterium tuberculosis
PIHILPDIPININETLYLGPLVVPPINVPAISLGVGI

SEQ ID NO: 1527538 - protein, 19 aa, Mycobacterium tuberculosis
PIIDAVGLELPFSPVCRSD

SEQ ID NO: 1527539 - protein, 18 aa, Mycobacterium tuberculosis
PIIIPDTTILPPIHLGLT

SEQ ID NO: 1527540 - protein, 17 aa, Mycobacterium tuberculosis
PIKVTPEILLQVLTTPP

SEQ ID NO: 1527541 - protein, 25 aa, Mycobacterium tuberculosis
PILHAQHSLPPWPIAKALQEAGQFS

SEQ ID NO: 1527542 - protein, 18 aa, Mycobacterium tuberculosis
PILPMIRAAEQRGIDWRA

SEQ ID NO: 1527543 - protein, 19 aa, Mycobacterium tuberculosis
PINEFFLANTGRPLIGNGA

SEQ ID NO: 1527544 - protein, 19 aa, Mycobacterium tuberculosis
PINEFFLANTGRPLIGTAR

SEQ ID NO: 1527545 - protein, 17 aa, Mycobacterium tuberculosis
PINGLNLDVAAGSLVML

SEQ ID NO: 1527546 - protein, 18 aa, Mycobacterium tuberculosis
PIPLASPNIYRGDASRLA

SEQ ID NO: 1527547 - protein, 26 aa, Mycobacterium tuberculosis
PIQIRTVGRLLGWRLGMDDVDPRSMV

SEQ ID NO: 1527548 - protein, 25 aa, Mycobacterium tuberculosis
PIQTVTLLRAIRENPIRRGIRGSPA

SEQ ID NO: 1527549 - protein, 21 aa, Mycobacterium tuberculosis
PIRATHFRRPATSNPGRRRQP

SEQ ID NO: 1527550 - protein, 18 aa, Mycobacterium tuberculosis
PIRPYERLLYAGLVGDHQ

SEQ ID NO: 1527551 - protein, 23 aa, Mycobacterium tuberculosis
PIRRASVTVMEWGLRGTRRAEAA

SEQ ID NO: 1527552 - protein, 22 aa, Mycobacterium tuberculosis
PIRRIDDFAEWLQRFEANLGAL

SEQ ID NO: 1527553 - protein, 22 aa, Mycobacterium tuberculosis
PIRRIDDFAEWLQRFEASLGAL

SEQ ID NO: 1527554 - protein, 24 aa, Mycobacterium tuberculosis
PIRRIDDFAEWLQRFEASLGALPD

SEQ ID NO: 1527555 - protein, 38 aa, Mycobacterium tuberculosis
PISGTKWAILRLLALRCLWVFRGFPARLRPPASWWCAD

SEQ ID NO: 1527556 - protein, 20 aa, Mycobacterium tuberculosis
PITISPITLFPAQNFNTTFP

SEQ ID NO: 1527557 - protein, 21 aa, Mycobacterium tuberculosis
PITPFRPRALSARGVEATIAD

SEQ ID NO: 1527558 - protein, 26 aa, Mycobacterium tuberculosis
PIVALRIRGIALPGPLRRLSEGIALL

SEQ ID NO: 1527559 - protein, 17 aa, Mycobacterium tuberculosis
PIVGYSPIIGEKPLRGM

SEQ ID NO: 1527560 - protein, 18 aa, Mycobacterium tuberculosis
PIVIPDTTILPPLHLQIT

SEQ ID NO: 1527561 - protein, 19 aa, Mycobacterium tuberculosis
PIVIPDTTILPPLHLQITG

SEQ ID NO: 1527562 - protein, 21 aa, Mycobacterium tuberculosis
PIVMVDPWGHFDGLRAWLNGL

SEQ ID NO: 1527563 - protein, 18 aa, Mycobacterium tuberculosis
PIWRGSGWAPNRRGRPTR

SEQ ID NO: 1527564 - protein, 17 aa, Mycobacterium tuberculosis
PKACVWVARLAVDFRQR

SEQ ID NO: 1527565 - protein, 20 aa, Mycobacterium tuberculosis
PKAPLGYRPARSTAVMSTMS

SEQ ID NO: 1527566 - protein, 25 aa, Mycobacterium tuberculosis
PKDDPLGPIIKLFDDAGYIGVVATN

SEQ ID NO: 1527567 - protein, 30 aa, Mycobacterium tuberculosis; identical to SEQ ID NO: 225416

SEQ ID NO: 1527568 - protein, 18 aa, Mycobacterium tuberculosis
PKGQWYLRQMLGSANFNA

SEQ ID NO: 1527569 - protein, 17 aa, Mycobacterium tuberculosis
PKHGAHLRLIPQRRLGG

SEQ ID NO: 1527570 - protein, 18 aa, Mycobacterium tuberculosis
PKISPPDLSALTVSVDPI

SEQ ID NO: 1527571 - protein, 20 aa, Mycobacterium tuberculosis
PKKQVRCVYVAIGQKGTTIA

SEQ ID NO: 1527572 - protein, 23 aa, Mycobacterium tuberculosis
PKLALPILPKPKFPLPALAAPKF

SEQ ID NO: 1527573 - protein, 19 aa, Mycobacterium tuberculosis
PKLDISGILITRYDPRTVN

SEQ ID NO: 1527574 - protein, 19 aa, Mycobacterium tuberculosis
PKLRHWVKEVKAAMAALDI

SEQ ID NO: 1527575 - protein, 18 aa, Mycobacterium tuberculosis
PKPALWLPTLANPIFRTV

SEQ ID NO: 1527576 - protein, 19 aa, Mycobacterium tuberculosis
PKRRRPQLLAVDNVVVCAG

SEQ ID NO: 1527577 - protein, 18 aa, Mycobacterium tuberculosis
PKSNFYPSPDRESAYASP

SEQ ID NO: 1527578 - protein, 20 aa, Mycobacterium tuberculosis
PKTLTPYRRPGGVNGAASLV

SEQ ID NO: 1527579 - protein, 21 aa, Mycobacterium tuberculosis
PKVFGSWNLHRATLGQPLDWF

SEQ ID NO: 1527580 - protein, 22 aa, Mycobacterium tuberculosis
PKVKSPFGVPGMPGLAGLPGGL

SEQ ID NO: 1527581 - protein, 20 aa, Mycobacterium tuberculosis
PKYRAYMRRQQGMSWNTIEH

SEQ ID NO: 1527582 - protein, 27 aa, Mycobacterium tuberculosis
PLAFVRFRIDGKDWPASPLPSLRMRTT

SEQ ID NO: 1527583 - protein, 17 aa, Mycobacterium tuberculosis
PLAIEHTLQYRRGGAAG

SEQ ID NO: 1527584 - protein, 25 aa, Mycobacterium tuberculosis
PLAKACARIMLGATIAQLRAEGLLA

SEQ ID NO: 1527585 - protein, 22 aa, Mycobacterium tuberculosis
PLALVTAYIPPGVGPAVEPLLS

SEQ ID NO: 1527586 - protein, 24 aa, Mycobacterium tuberculosis
PLAPSLTNVPDALVGPCWPAVFAA

SEQ ID NO: 1527587 - protein, 20 aa, Mycobacterium tuberculosis
PLAQQGCIPLAIHPAMTFTG

SEQ ID NO: 1527588 - protein, 18 aa, Mycobacterium tuberculosis
PLCGFRQTSRILAGLPDQ

SEQ ID NO: 1527589 - protein, 20 aa, Mycobacterium tuberculosis
PLDADAWFDTVRRAAPFATL

SEQ ID NO: 1527590 - protein, 18 aa, Mycobacterium tuberculosis
PLDAFVVRKLGAPGHDEF

SEQ ID NO: 1527591 - protein, 26 aa, Mycobacterium tuberculosis
PLDEVDGYVWHAYLPNITPSQRYGFR

SEQ ID NO: 1527592 - protein, 17 aa, Mycobacterium tuberculosis
PLDPIDIGLPVSLTIPG

SEQ ID NO: 1527593 - protein, 20 aa, Mycobacterium tuberculosis
PLDRLIAFGRERMRFIHAHH

SEQ ID NO: 1527594 - protein, 18 aa, Mycobacterium tuberculosis
PLDRLIAFGRERMRFVHA

SEQ ID NO: 1527595 - protein, 25 aa, Mycobacterium tuberculosis
PLDSPELIRLAPRPAARTDPMLLAW

SEQ ID NO: 1527596 - protein, 20 aa, Mycobacterium tuberculosis
PLDWLVSKFAREVPGVAHAL

SEQ ID NO: 1527597 - protein, 21 aa, Mycobacterium tuberculosis
PLEFPFVYRRHQLSLRISGRS

SEQ ID NO: 1527598 - protein, 17 aa, Mycobacterium tuberculosis
PLEGLLNIVNTPTQLLL

SEQ ID NO: 1527599 - protein, 17 aa, Mycobacterium tuberculosis
PLEMTKWFDTNYHYLVP

SEQ ID NO: 1527600 - protein, 20 aa, Mycobacterium tuberculosis
PLFGQTWALLRLLGELGLPP

SEQ ID NO: 1527601 - protein, 19 aa, Mycobacterium tuberculosis
PLGEPLPAAPAELAPPADL

SEQ ID NO: 1527602 - protein, 20 aa, Mycobacterium tuberculosis
PLGEPLPAAPAELAPPADLA

SEQ ID NO: 1527603 - protein, 28 aa, Mycobacterium tuberculosis
PLGFQVPGSIDAITLFPGGLTFPANSLL

SEQ ID NO: 1527604 - protein, 19 aa, Mycobacterium tuberculosis
PLGHWQHIPRCVRAGLRQT

SEQ ID NO: 1527605 - protein, 22 aa, Mycobacterium tuberculosis
PLGRLRNIAYTQLDMRDVKRVK

SEQ ID NO: 1527606 - protein, 17 aa, Mycobacterium tuberculosis
PLGSWLAALPDERLTQL

SEQ ID NO: 1527607 - protein, 22 aa, Mycobacterium tuberculosis
PLGWPATPARLPFTLGAGAHLQ

SEQ ID NO: 1527608 - protein, 18 aa, Mycobacterium tuberculosis
PLHHIHLGRAQPGIGQRR

SEQ ID NO: 1527609 - protein, 26 aa, Mycobacterium tuberculosis
PLHPAPPRLRSPLVLLDGASMWFRSF

SEQ ID NO: 1527610 - protein, 27 aa, Mycobacterium tuberculosis
PLHPAPPRLRSPLVLLDGASMWFRSFF

SEQ ID NO: 1527611 - protein, 17 aa, Mycobacterium tuberculosis
PLHTQVFGPPHGYPIVL

SEQ ID NO: 1527612 - protein, 24 aa, Mycobacterium tuberculosis
PLIAVASAATRWVWVSDAATLDTD

SEQ ID NO: 1527613 - protein, 25 aa, Mycobacterium tuberculosis
PLIDQHVHGCWLTEGNRRRFENALN

SEQ ID NO: 1527614 - protein, 18 aa, Mycobacterium tuberculosis
PLIMRRALEYATGLGVLI

SEQ ID NO: 1527615 - protein, 22 aa, Mycobacterium tuberculosis
PLIPNPPPIPVPPPAAQTLIPP

SEQ ID NO: 1527616 - protein, 18 aa, Mycobacterium tuberculosis
PLIRPDLPEIVRTLSAKV

SEQ ID NO: 1527617 - protein, 21 aa, Mycobacterium tuberculosis
PLLDFIAPKVAGLSFSGLLGA

SEQ ID NO: 1527618 - protein, 19 aa, Mycobacterium tuberculosis
PLLDPINEFFLANTGRPLI

SEQ ID NO: 1527619 - protein, 17 aa, Mycobacterium tuberculosis
PLLEPLAVERLYLDNYF

SEQ ID NO: 1527620 - protein, 19 aa, Mycobacterium tuberculosis
PLLERAKFLAIFASNLDEF

SEQ ID NO: 1527621 - protein, 17 aa, Mycobacterium tuberculosis
PLLLDRALVCVGSDGSI

SEQ ID NO: 1527622 - protein, 19 aa, Mycobacterium tuberculosis
PLLQPLRTLFEPIMLQSNE

SEQ ID NO: 1527623 - protein, 19 aa, Mycobacterium tuberculosis
PLLRHPLDLELDSISVVTF

SEQ ID NO: 1527624 - protein, 25 aa, Mycobacterium tuberculosis
PLLSGMFGTFPVAQTFHDAVGAAHA

SEQ ID NO: 1527625 - protein, 17 aa, Mycobacterium tuberculosis
PLLTATAAAQRAGHLGP

SEQ ID NO: 1527626 - protein, 25 aa, Mycobacterium tuberculosis
PLMPPAMALPPWPPTPPAPPANPVP

SEQ ID NO: 1527627 - protein, 26 aa, Mycobacterium tuberculosis
PLMRRSGMIFIRRNIGNGPLYKYVLK

SEQ ID NO: 1527628 - protein, 20 aa, Mycobacterium tuberculosis
PLNRRCGPPLPTRRRRSARR

SEQ ID NO: 1527629 - protein, 18 aa, Mycobacterium tuberculosis
PLNWCNPSGRALGAPPTT

SEQ ID NO: 1527630 - protein, 17 aa, Mycobacterium tuberculosis
PLNWVRRRHGLSSLGWN

SEQ ID NO: 1527631 - protein, 18 aa, Mycobacterium tuberculosis
PLPALTCLLRSITLRMTM

SEQ ID NO: 1527632 - protein, 17 aa, Mycobacterium tuberculosis
PLPMLVVVIDEFYEWFR

SEQ ID NO: 1527633 - protein, 19 aa, Mycobacterium tuberculosis
PLPNKLALPPAPPAPPTPE

SEQ ID NO: 1527634 - protein, 20 aa, Mycobacterium tuberculosis
PLPPLPPLPPLVGVLPGAPL

SEQ ID NO: 1527635 - protein, 21 aa, Mycobacterium tuberculosis
PLPPLPPLPPLVGVLPGAPLA

SEQ ID NO: 1527636 - protein, 19 aa, Mycobacterium tuberculosis
PLPPLPVPLPLPASPASPP

SEQ ID NO: 1527637 - protein, 26 aa, Mycobacterium tuberculosis
PLPPTVGITLHLPFDGILVPPHPVNA

SEQ ID NO: 1527638 - protein, 22 aa, Mycobacterium tuberculosis
PLPVLYCHALLMLTRLKPGASC

SEQ ID NO: 1527639 - protein, 26 aa, Mycobacterium tuberculosis
PLQARCGWAVGWRKDAFFGRAALLAE

SEQ ID NO: 1527640 - protein, 24 aa, Mycobacterium tuberculosis
PLQQLRARPRRRNRGGPADRKAQG

SEQ ID NO: 1527641 - protein, 30 aa, Mycobacterium tuberculosis
PLRATDFSLPLARMVLTSAPVTVLEVSGER

SEQ ID NO: 1527642 - protein, 18 aa, Mycobacterium tuberculosis
PLRAVRHLEKGRVVIFGA

SEQ ID NO: 1527643 - protein, 18 aa, Mycobacterium tuberculosis
PLRHLLLAELSIRPLYWL

SEQ ID NO: 1527644 - protein, 17 aa, Mycobacterium tuberculosis
PLRKKIADILDQVYREA

SEQ ID NO: 1527645 - protein, 18 aa, Mycobacterium tuberculosis
PLRPDRYLRIVAAMRREG

SEQ ID NO: 1527646 - protein, 18 aa, Mycobacterium tuberculosis
PLRPMLPLWPPSRVPSPP

SEQ ID NO: 1527647 - protein, 21 aa, Mycobacterium tuberculosis
PLRREAEKLAALLTQPGRTYD

SEQ ID NO: 1527648 - protein, 17 aa, Mycobacterium tuberculosis
PLRRISIPSCRPGWCGP

SEQ ID NO: 1527649 - protein, 24 aa, Mycobacterium tuberculosis
PLRTFECTVPPGQLGWGWARFAFT

SEQ ID NO: 1527650 - protein, 21 aa, Mycobacterium tuberculosis
PLSVTWMGVATLLVDDGSSAL

SEQ ID NO: 1527651 - protein, 25 aa, Mycobacterium tuberculosis
PLTASLGLMILASGHRHGWPVARGG

SEQ ID NO: 1527652 - protein, 34 aa, Mycobacterium tuberculosis
PLTDIAGTGGLLPIKIPLIDIPAAPGFGNSTTTP

SEQ ID NO: 1527653 - protein, 19 aa, Mycobacterium tuberculosis
PLTFVTILAKYVQLDFFRH

SEQ ID NO: 1527654 - protein, 18 aa, Mycobacterium tuberculosis
PLTLLPEPNPGDLFFDFE

SEQ ID NO: 1527655 - protein, 27 aa, Mycobacterium tuberculosis
PLTTPPITIPAIPLGIDVSGRLGPINI

SEQ ID NO: 1527656 - protein, 25 aa, Mycobacterium tuberculosis
PLTTPPITIPAIPLGIDVSGSLGPI

SEQ ID NO: 1527657 - protein, 22 aa, Mycobacterium tuberculosis
PLVHHGRVPGRDWPRAAAGGRD

SEQ ID NO: 1527658 - protein, 17 aa, Mycobacterium tuberculosis
PLVIDFGGGVLGALQRH

SEQ ID NO: 1527659 - protein, 20 aa, Mycobacterium tuberculosis
PLVRQIFIYGNSARAYPLAV

SEQ ID NO: 1527660 - protein, 18 aa, Mycobacterium tuberculosis
PLVVPQLRTITLGGAVTG

SEQ ID NO: 1527661 - protein, 19 aa, Mycobacterium tuberculosis
PLWGHGWDESAWPENAAPS

SEQ ID NO: 1527662 - protein, 17 aa, Mycobacterium tuberculosis
PLYCASAAHRPSRACVR

SEQ ID NO: 1527663 - protein, 22 aa, Mycobacterium tuberculosis
PLYRQRQDRPRGGWRPACRRGR

SEQ ID NO: 1527664 - protein, 18 aa, Mycobacterium tuberculosis
PMAPTALPDPMATGPTPA

SEQ ID NO: 1527665 - protein, 19 aa, Mycobacterium tuberculosis
PMGMMPMPMGMPAGMMGRG

SEQ ID NO: 1527666 - protein, 20 aa, Mycobacterium tuberculosis
PMGNLDLLLRLSGRIVKGCR

SEQ ID NO: 1527667 - protein, 24 aa, Mycobacterium tuberculosis
PMLAAAAAWDGLAAELGLAAESFG

SEQ ID NO: 1527668 - protein, 25 aa, Mycobacterium tuberculosis
PMLAAAAWDGLAAELGLAAESFGLV

SEQ ID NO: 1527669 - protein, 19 aa, Mycobacterium tuberculosis
PMLAAASAWDGLAEELHAA

SEQ ID NO: 1527670 - protein, 28 aa, Mycobacterium tuberculosis
PMLHIVRHYRPIVVVLFLSAEIAAFENA

SEQ ID NO: 1527671 - protein, 17 aa, Mycobacterium tuberculosis
PMLLSRDGRDDSGFYPV

SEQ ID NO: 1527672 - protein, 17 aa, Mycobacterium tuberculosis
PMLRIRDVLGAQARAAG

SEQ ID NO: 1527673 - protein, 28 aa, Mycobacterium tuberculosis
PMPGGMYRNQVWFPYPGSNVALCVGMCG

SEQ ID NO: 1527674 - protein, 23 aa, Mycobacterium tuberculosis
PMPPAPPWPPVPPAPPEPLMPPA

SEQ ID NO: 1527675 - protein, 21 aa, Mycobacterium tuberculosis
PMTPKVPYYSATLFDPREQPV

SEQ ID NO: 1527676 - protein, 20 aa, Mycobacterium tuberculosis
PNALWDLKTQIFEGDILFLE

SEQ ID NO: 1527677 - protein, 24 aa, Mycobacterium tuberculosis
PNGGLLVTPLDFRFGRQPRNASGG

SEQ ID NO: 1527678 - protein, 29 aa, Mycobacterium tuberculosis
PNGGVLERYVGLYLPFLDMSFNGATPPDS

SEQ ID NO: 1527679 - protein, 18 aa, Mycobacterium tuberculosis
PNKPATPSPPRKAPTPSR

SEQ ID NO: 1527680 - protein, 24 aa, Mycobacterium tuberculosis
PNLDKRIVRLPKTHIKAVGTHFVS

SEQ ID NO: 1527681 - protein, 36 aa, Mycobacterium tuberculosis
PNNPLLALIASDIPPLSWFLGNSPPPLLNSLLGQTV

SEQ ID NO: 1527682 - protein, 18 aa, Mycobacterium tuberculosis
PNPFAVTYYLIKGSLQAP

SEQ ID NO: 1527683 - protein, 30 aa, Mycobacterium tuberculosis
PNRRPTGQRGFFAWFRVGSDVLVRNAFRVL

SEQ ID NO: 1527684 - protein, 20 aa, Mycobacterium tuberculosis
PNSMLVAAASWDALAAELAS

SEQ ID NO: 1527685 - protein, 19 aa, Mycobacterium tuberculosis
PPAAPLPRYPGGTSPRALS

SEQ ID NO: 1527686 - protein, 18 aa, Mycobacterium tuberculosis
PPADPVIFLKPNTAIIGP

SEQ ID NO: 1527687 - protein, 23 aa, Mycobacterium tuberculosis
PPADPVIFLKPNTAIIGPNTPIR

SEQ ID NO: 1527688 - protein, 25 aa, Mycobacterium tuberculosis
PPADVVKLLNKFFAIVVDEVDRHHG

SEQ ID NO: 1527689 - protein, 18 aa, Mycobacterium tuberculosis
PPAIAIPGAGPTSAAPDV

SEQ ID NO: 1527690 - protein, 17 aa, Mycobacterium tuberculosis
PPALFAPIVENLANVRL

SEQ ID NO: 1527691 - protein, 20 aa, Mycobacterium tuberculosis
PPAPAAQPDTPPWPGRPGGH

SEQ ID NO: 1527692 - protein, 18 aa, Mycobacterium tuberculosis
PPAPIELPSYGLFGLPGF

SEQ ID NO: 1527693 - protein, 18 aa, Mycobacterium tuberculosis
PPAPPAPLGPWCTPGFPG

SEQ ID NO: 1527694 - protein, 26 aa, Mycobacterium tuberculosis
PPAPPLPINIPPRPPFPPAPPVPPLP

SEQ ID NO: 1527695 - protein, 20 aa, Mycobacterium tuberculosis
PPAPPLPRSHPPRPPLPPTP

SEQ ID NO: 1527696 - protein, 29 aa, Mycobacterium tuberculosis
PPAPPNWPKPPLPPLPPALPLPPCPPSPP

SEQ ID NO: 1527697 - protein, 20 aa, Mycobacterium tuberculosis
PPAPPVPPLPPAPPAPPEPL

SEQ ID NO: 1527698 - protein, 17 aa, Mycobacterium tuberculosis
PPAPPVPPPLPPAPPGP

SEQ ID NO: 1527699 - protein, 21 aa, Mycobacterium tuberculosis
PPAWPLGFAAVPSAPLPISGR

SEQ ID NO: 1527700 - protein, 24 aa, Mycobacterium tuberculosis
PPDELVDVDYYRPTGRGGEREIAG

SEQ ID NO: 1527701 - protein, 19 aa, Mycobacterium tuberculosis
PPEAPLPPFPPLPNSRALP

SEQ ID NO: 1527702 - protein, 25 aa, Mycobacterium tuberculosis
PPEHLQWIGQWGIFDALRPGREVVR

SEQ ID NO: 1527703 - protein, 18 aa, Mycobacterium tuberculosis
PPEINSVLMYSGAGSSPL

SEQ ID NO: 1527704 - protein, 28 aa, Mycobacterium tuberculosis
PPEPHPPIPTTPWQHTRHWITTKYPAGS

SEQ ID NO: 1527705 - protein, 31 aa, Mycobacterium tuberculosis
PPEPHPPIPTTPWQHTRHWITTKYPAGSVGS

SEQ ID NO: 1527706 - protein, 25 aa, Mycobacterium tuberculosis
PPEPHPTIPTTPWQHTHHWIATTHP

SEQ ID NO: 1527707 - protein, 37 aa, Mycobacterium tuberculosis
PPETNSLRMYLGAGSRPLLAAAGAWDGLAEELHAAAS

SEQ ID NO: 1527708 - protein, 18 aa, Mycobacterium tuberculosis
PPFARNVRFLPTAAAAQG

SEQ ID NO: 1527709 - protein, 24 aa, Mycobacterium tuberculosis
PPFAWREYLLQCWFVARVSTLPGV

SEQ ID NO: 1527710 - protein, 17 aa, Mycobacterium tuberculosis
PPFLSRKHLPSRLAKLR

SEQ ID NO: 1527711 - protein, 18 aa, Mycobacterium tuberculosis
PPFLSRKHLPSRLAKLRE

SEQ ID NO: 1527712 - protein, 21 aa, Mycobacterium tuberculosis
PPFPANLTTLFFGPTGIPLPP

SEQ ID NO: 1527713 - protein, 26 aa, Mycobacterium tuberculosis
PPGAPAPPMPPLPPAPPAPPLPINPA

SEQ ID NO: 1527714 - protein, 17 aa, Mycobacterium tuberculosis
PPGAPPSGGDPNGGGGG

SEQ ID NO: 1527715 - protein, 23 aa, Mycobacterium tuberculosis
PPGELLLYVFGRRVNRPGMSGDS

SEQ ID NO: 1527716 - protein, 18 aa, Mycobacterium tuberculosis
PPGFDFTDPAIYAERLPV

SEQ ID NO: 1527717 - protein, 19 aa, Mycobacterium tuberculosis
PPGGARRGPGGPGGAFTPH

SEQ ID NO: 1527718 - protein, 18 aa, Mycobacterium tuberculosis
PPGGWPEPLRTAALAGRG

SEQ ID NO: 1527719 - protein, 23 aa, Mycobacterium tuberculosis
PPGIGWRKFVYSVSFHKINPGES

SEQ ID NO: 1527720 - protein, 18 aa, Mycobacterium tuberculosis
PPGLSSPATWATAPSGAA

SEQ ID NO: 1527721 - protein, 29 aa, Mycobacterium tuberculosis
PPGSAILTAIVPPGIGFGSGMSASASAQR

SEQ ID NO: 1527722 - protein, 21 aa, Mycobacterium tuberculosis
PPGTRRFSPPGGGSGGNGGNG

SEQ ID NO: 1527723 - protein, 18 aa, Mycobacterium tuberculosis
PPGVHVDIPLQAYFRINT

SEQ ID NO: 1527724 - protein, 23 aa, Mycobacterium tuberculosis
PPIAPHSGLGYAQNFLHMCFGEV

SEQ ID NO: 1527725 - protein, 19 aa, Mycobacterium tuberculosis
PPITIDRIPLNLGASVTVG

SEQ ID NO: 1527726 - protein, 29 aa, Mycobacterium tuberculosis
PPKSPNAEWYLYTKDWLALLRQFAPDRVG

SEQ ID NO: 1527727 - protein, 20 aa, Mycobacterium tuberculosis
PPLAPVWRPSAGSSRKLLPP

SEQ ID NO: 1527728 - protein, 22 aa, Mycobacterium tuberculosis
PPLDRLIAFGRERMRFVHAHHQ

SEQ ID NO: 1527729 - protein, 19 aa, Mycobacterium tuberculosis
PPLPPLPPKPPSGALPPPP

SEQ ID NO: 1527730 - protein, 20 aa, Mycobacterium tuberculosis
PPLQIPGISVPAFSLPAITL

SEQ ID NO: 1527731 - protein, 18 aa, Mycobacterium tuberculosis
PPMLLPAFATLALPPAPP

SEQ ID NO: 1527732 - protein, 17 aa, Mycobacterium tuberculosis
PPMQAVLDVSWAHPAVA

SEQ ID NO: 1527733 - protein, 18 aa, Mycobacterium tuberculosis
PPMVTSGLRIGTPALATR

SEQ ID NO: 1527734 - protein, 19 aa, Mycobacterium tuberculosis
PPMVTSGLRIGTPALATRG

SEQ ID NO: 1527735 - protein, 20 aa, Mycobacterium tuberculosis
PPPAALTGEWFGALAVIAPS

SEQ ID NO: 1527736 - protein, 17 aa, Mycobacterium tuberculosis
PPPFLPAAPPPPDPLAG

SEQ ID NO: 1527737 - protein, 19 aa, Mycobacterium tuberculosis
PPPHFFHPVNKKKKKKKKI

SEQ ID NO: 1527738 - protein, 17 aa, Mycobacterium tuberculosis
PPPHLDHGQPRINRYHH

SEQ ID NO: 1527739 - protein, 17 aa, Mycobacterium tuberculosis
PPPLLNSLLGQTVQYTT

SEQ ID NO: 1527740 - protein, 19 aa, Mycobacterium tuberculosis
PPPNTYVAPIAFNVVPLAG

SEQ ID NO: 1527741 - protein, 21 aa, Mycobacterium tuberculosis
PPPPPLPPLPAAPPSPELPET

SEQ ID NO: 1527742 - protein, 29 aa, Mycobacterium tuberculosis
PPPPPPPPPPPFFFFPARSACRGLLRLLA

SEQ ID NO: 1527743 - protein, 23 aa, Mycobacterium tuberculosis
PPPPPPPPPPPPPTPMPIAAGEP

SEQ ID NO: 1527744 - protein, 28 aa, Mycobacterium tuberculosis
PPPSEGWRRLLYLLSGRLINAGEGPQAE

SEQ ID NO: 1527745 - protein, 28 aa, Mycobacterium tuberculosis
PPPSEGWRRLLYLLSGRLINAGEGPRAA

SEQ ID NO: 1527746 - protein, 27 aa, Mycobacterium tuberculosis
PPQAATAPPLPPFKPSANLGANCQYPP

SEQ ID NO: 1527747 - protein, 24 aa, Mycobacterium tuberculosis
PPQSFAQVLVGWQNWLRTADRGSW

SEQ ID NO: 1527748 - protein, 17 aa, Mycobacterium tuberculosis
PPRARKPQRRVRLTGEL

SEQ ID NO: 1527749 - protein, 20 aa, Mycobacterium tuberculosis
PPRPGAPRPGGRPGAPGAGR

SEQ ID NO: 1527750 - protein, 21 aa, Mycobacterium tuberculosis
PPRRFREQRSKSCAARRTRGA

SEQ ID NO: 1527751 - protein, 23 aa, Mycobacterium tuberculosis
PPRRITLTLPAIQRSREVWLLVS

SEQ ID NO: 1527752 - protein, 31 aa, Mycobacterium tuberculosis
PPRRPKLARALRHLLLLWGALPESQPPPTAE

SEQ ID NO: 1527753 - protein, 19 aa, Mycobacterium tuberculosis
PPSALTWPMRSAHTGANSD

SEQ ID NO: 1527754 - protein, 26 aa, Mycobacterium tuberculosis
PPSEGWRRLLYLLSGRLINAGEGPRA

SEQ ID NO: 1527755 - protein, 22 aa, Mycobacterium tuberculosis
PPSPPVPVFPTPPGPPAPPEPN

SEQ ID NO: 1527756 - protein, 23 aa, Mycobacterium tuberculosis
PPSPPVPVFPTPPGPPAPPEPNS

SEQ ID NO: 1527757 - protein, 17 aa, Mycobacterium tuberculosis
PPSPQAPHPGMAPGARP

SEQ ID NO: 1527758 - protein, 19 aa, Mycobacterium tuberculosis
PPTIPIISTTYADLGISLG

SEQ ID NO: 1527759 - protein, 28 aa, Mycobacterium tuberculosis
PPTSSGFARPTAGPAGLVGLRPVPAAPA

SEQ ID NO: 1527760 - protein, 34 aa, Mycobacterium tuberculosis
PPVAELRAMLLERLPRYLVPHHIVVLDELPLTPH

SEQ ID NO: 1527761 - protein, 25 aa, Mycobacterium tuberculosis
PPVCDCGGLIRPDIVWFGEPLPEEP

SEQ ID NO: 1527762 - protein, 19 aa, Mycobacterium tuberculosis
PPVDIPAIVLDRILLDLHA

SEQ ID NO: 1527763 - protein, 17 aa, Mycobacterium tuberculosis
PPVNAIPSKAWFDLADA

SEQ ID NO: 1527764 - protein, 25 aa, Mycobacterium tuberculosis
PPVPPILSIPLAPLAPAPPLAPTPP

SEQ ID NO: 1527765 - protein, 26 aa, Mycobacterium tuberculosis
PPVTRRAVLTLYPHCAPKIGVPSQNP

SEQ ID NO: 1527766 - protein, 18 aa, Mycobacterium tuberculosis
PPWLTRLCDERTVVAVLQ

SEQ ID NO: 1527767 - protein, 21 aa, Mycobacterium tuberculosis
PPWPNRMALPPWPPCPPLPPL

SEQ ID NO: 1527768 - protein, 20 aa, Mycobacterium tuberculosis
PPYSQWAFQHVEDFMPTTVI

SEQ ID NO: 1527769 - protein, 30 aa, Mycobacterium tuberculosis
PQAIFDHGTPLALYHTKRLASPAQRIMLFA

SEQ ID NO: 1527770 - protein, 31 aa, Mycobacterium tuberculosis
PQAIFDHGTPLALYHTKRLASPAQRIMLFAK

SEQ ID NO: 1527771 - protein, 22 aa, Mycobacterium tuberculosis
PQALIDLVASRSYCITSPAQVR

SEQ ID NO: 1527772 - protein, 19 aa, Mycobacterium tuberculosis
PQALSLRLIEPPPSLYRPH

SEQ ID NO: 1527773 - protein, 25 aa, Mycobacterium tuberculosis
PQAPHPGMAPGARPGPVPKPGIRTP

SEQ ID NO: 1527774 - protein, 26 aa, Mycobacterium tuberculosis
PQAPHPGMAPGARPGPVPKPGIRTPR

SEQ ID NO: 1527775 - protein, 21 aa, Mycobacterium tuberculosis
PQDFGPIQTLFTDAGLLDNPQ

SEQ ID NO: 1527776 - protein, 27 aa, Mycobacterium tuberculosis
PQEDSRLLTRELLYTAVTRAKRKVRVV

SEQ ID NO: 1527777 - protein, 18 aa, Mycobacterium tuberculosis
PQEFHVLRRAGTERPFTG

SEQ ID NO: 1527778 - protein, 20 aa, Mycobacterium tuberculosis
PQELHELLTLPFRSASEFID

SEQ ID NO: 1527779 - protein, 19 aa, Mycobacterium tuberculosis
PQFPLRILSDINAFMGYFY

SEQ ID NO: 1527780 - protein, 17 aa, Mycobacterium tuberculosis
PQGIDYVCGFYAAIKAG

SEQ ID NO: 1527781 - protein, 33 aa, Mycobacterium tuberculosis
PQLKLHQCGLPKLMALELFKPFVMKRLVDLNHA

SEQ ID NO: 1527782 - protein, 24 aa, Mycobacterium tuberculosis
PQLLSAVPRALQGLALPTASQSAS

SEQ ID NO: 1527783 - protein, 21 aa, Mycobacterium tuberculosis
PQLPYLPLQVPQQLSLPADLP

SEQ ID NO: 1527784 - protein, 17 aa, Mycobacterium tuberculosis
PQLTMVSGLRRLSERCH

SEQ ID NO: 1527785 - protein, 17 aa, Mycobacterium tuberculosis
PQLVVHPYTLTGPIVIG

SEQ ID NO: 1527786 - protein, 20 aa, Mycobacterium tuberculosis
PQLVVHPYTLTGPIVIGSFF

SEQ ID NO: 1527787 - protein, 23 aa, Mycobacterium tuberculosis
PQNPPPTCHFAPVGRFPPRCPAP

SEQ ID NO: 1527788 - protein, 19 aa, Mycobacterium tuberculosis
PQPIPFSGPARKVLELTFR

SEQ ID NO: 1527789 - protein, 22 aa, Mycobacterium tuberculosis
PQPPTIPIISTTYADLGISLGS

SEQ ID NO: 1527790 - protein, 20 aa, Mycobacterium tuberculosis
PQQRMALELTWEALEHARIP

SEQ ID NO: 1527791 - protein, 23 aa, Mycobacterium tuberculosis
PQQWGGLQCDPALFFEATRRLAS

SEQ ID NO: 1527792 - protein, 24 aa, Mycobacterium tuberculosis
PQRAPQIYRPPTAAPPPAGARGGT

SEQ ID NO: 1527793 - protein, 29 aa, Mycobacterium tuberculosis
PQRDPRIWARWAAAWRGHGGLRVQPRAAP

SEQ ID NO: 1527794 - protein, 31 aa, Mycobacterium tuberculosis
PQRHIGVGWAALRSLPPPAPQPALVAGDEPT

SEQ ID NO: 1527795 - protein, 17 aa, Mycobacterium tuberculosis
PQRIWDQKLAEVPMGRA

SEQ ID NO: 1527796 - protein, 25 aa, Mycobacterium tuberculosis
PQRPAVLLRHLLPESGFPATSFGHI

SEQ ID NO: 1527797 - protein, 22 aa, Mycobacterium tuberculosis
PQSTSWAQRWLAGTGSRDYMDP

SEQ ID NO: 1527798 - protein, 31 aa, Mycobacterium tuberculosis
PQTREHVLLARQVGVPYILVALNKADAVDDE

SEQ ID NO: 1527799 - protein, 21 aa, Mycobacterium tuberculosis
PQTYAWVPFGGGVKRCLGANF

SEQ ID NO: 1527800 - protein, 18 aa, Mycobacterium tuberculosis
PRATISELRYPATAFTDA

SEQ ID NO: 1527801 - protein, 21 aa, Mycobacterium tuberculosis
PRAVRLPRALAAAGVPVAPPA

SEQ ID NO: 1527802 - protein, 18 aa, Mycobacterium tuberculosis
PRCCSRILRWCARRSARM

SEQ ID NO: 1527803 - protein, 19 aa, Mycobacterium tuberculosis
PRCLLQRPAFLSNSSPTTR

SEQ ID NO: 1527804 - protein, 19 aa, Mycobacterium tuberculosis
PRCRRHYRNQRQPGVGFRC

SEQ ID NO: 1527805 - protein, 32 aa, Mycobacterium tuberculosis
PRCSPTSIWMCRWTTRVWVRPARCWGPRRWRS

SEQ ID NO: 1527806 - protein, 23 aa, Mycobacterium tuberculosis
PRDLEPFRCFYLSAPFVVPKKKE

SEQ ID NO: 1527807 - protein, 23 aa, Mycobacterium tuberculosis
PREGYFQIAYLGPKGTDAQLRER

SEQ ID NO: 1527808 - protein, 34 aa, Mycobacterium tuberculosis
PREMARTVFIELLAWQFASPVRWIETQDLLFIEE

SEQ ID NO: 1527809 - protein, 18 aa, Mycobacterium tuberculosis
PREWRRRKPYSWLRQVLP

SEQ ID NO: 1527810 - protein, 24 aa, Mycobacterium tuberculosis
PRGFARLFCGQRPALQGQHLVANR

SEQ ID NO: 1527811 - protein, 21 aa, Mycobacterium tuberculosis
PRGNPVPLRVGLATGPVVAGV

SEQ ID NO: 1527812 - protein, 27 aa, Mycobacterium tuberculosis
PRGTRRRREFLRPQQLRWPLAGDQETA

SEQ ID NO: 1527813 - protein, 19 aa, Mycobacterium tuberculosis
PRGYPRPSAPTRSLPAPHF

SEQ ID NO: 1527814 - protein, 19 aa, Mycobacterium tuberculosis
PRIAGPCGMVIFGVTGDLA

SEQ ID NO: 1527815 - protein, 21 aa, Mycobacterium tuberculosis
PRKIFDLLEHAPVDVAVLTDA

SEQ ID NO: 1527816 - protein, 17 aa, Mycobacterium tuberculosis
PRKSCLRNVDRFRPGLL

SEQ ID NO: 1527817 - protein, 21 aa, Mycobacterium tuberculosis
PRLELAALKQSAAAELGLRVC

SEQ ID NO: 1527818 - protein, 21 aa, Mycobacterium tuberculosis
PRLGMQRLPVSYRPGLLCVRQ

SEQ ID NO: 1527819 - protein, 18 aa, Mycobacterium tuberculosis
PRLQLARRRRSAAGPGGN

SEQ ID NO: 1527820 - protein, 29 aa, Mycobacterium tuberculosis
PRLTRMHRFWISLYFPLTMRSLCNAIVVP

SEQ ID NO: 1527821 - protein, 18 aa, Mycobacterium tuberculosis
PRLVPGWTKPIVIGRHAF

SEQ ID NO: 1527822 - protein, 18 aa, Mycobacterium tuberculosis
PRMPMVPGTWEQGSNEPE

SEQ ID NO: 1527823 - protein, 17 aa, Mycobacterium tuberculosis
PRNAPPAALTALVEQLE

SEQ ID NO: 1527824 - protein, 35 aa, Mycobacterium tuberculosis
PRNVSFSQSWRSAPPPLWCGPYNSINASLHAPALG

SEQ ID NO: 1527825 - protein, 29 aa, Mycobacterium tuberculosis
PRNWETFHIAQLLPWIEANFRTYAEYDGR

SEQ ID NO: 1527826 - protein, 25 aa, Mycobacterium tuberculosis
PRPAVPPLMRGYLRLGARACGEPAH

SEQ ID NO: 1527827 - protein, 26 aa, Mycobacterium tuberculosis
PRPEMLLHAILKLHEKIQQMPLGINR

SEQ ID NO: 1527828 - protein, 22 aa, Mycobacterium tuberculosis
PRPLVIVHGPLFQAVKAARAQV

SEQ ID NO: 1527829 - protein, 21 aa, Mycobacterium tuberculosis
PRPRQVILRLAARFFEPGIER

SEQ ID NO: 1527830 - protein, 17 aa, Mycobacterium tuberculosis
PRQRAVLLLRDALQWKS

SEQ ID NO: 1527831 - protein, 18 aa, Mycobacterium tuberculosis
PRRAVTGMDLHRSVGIRQ

SEQ ID NO: 1527832 - protein, 32 aa, Mycobacterium tuberculosis
PRRGHRVLTRCQMSFVVTIPEALAAVATDLAG

SEQ ID NO: 1527833 - protein, 17 aa, Mycobacterium tuberculosis
PRRTRRIGIPAAAPRRS

SEQ ID NO: 1527834 - protein, 21 aa, Mycobacterium tuberculosis
PRRWRFWRRGRRPLETKVVLD

SEQ ID NO: 1527835 - protein, 29 aa, Mycobacterium tuberculosis
PRRYGVRWHYRLPVWSDFVEVHWSRWGEA

SEQ ID NO: 1527836 - protein, 18 aa, Mycobacterium tuberculosis
PRRYYRAIAKMADTAWFV

SEQ ID NO: 1527837 - protein, 18 aa, Mycobacterium tuberculosis
PRTRPFRVSYGTTTRGVV

SEQ ID NO: 1527838 - protein, 18 aa, Mycobacterium tuberculosis
PRVHLFFGARYACELYDL

SEQ ID NO: 1527839 - protein, 19 aa, Mycobacterium tuberculosis
PRVYELLYGDPFPSGVQTA

SEQ ID NO: 1527840 - protein, 19 aa, Mycobacterium tuberculosis
PRWAKLVEMLGPESDILRG

SEQ ID NO: 1527841 - protein, 18 aa, Mycobacterium tuberculosis
PRYALIDDPYAAPLVRAV

SEQ ID NO: 1527842 - protein, 21 aa, Mycobacterium tuberculosis
PSADLILLYLIQHCPDLSVDV

SEQ ID NO: 1527843 - protein, 29 aa, Mycobacterium tuberculosis
PSAELFVAAYVPYVAWLVQASADSAAAAG

SEQ ID NO: 1527844 - protein, 27 aa, Mycobacterium tuberculosis
PSAELFVAAYVPYVAWLVQASSDSAAA

SEQ ID NO: 1527845 - protein, 20 aa, Mycobacterium tuberculosis
PSAGLMFSLAVVDKLTSGHL

SEQ ID NO: 1527846 - protein, 20 aa, Mycobacterium tuberculosis
PSALAYLAEGFTAIGTTSFG

SEQ ID NO: 1527847 - protein, 17 aa, Mycobacterium tuberculosis
PSALKNAGFDPARPTAF

SEQ ID NO: 1527848 - protein, 19 aa, Mycobacterium tuberculosis
PSAPAYALAADLLFLALRD

SEQ ID NO: 1527849 - protein, 24 aa, Mycobacterium tuberculosis
PSAPRRLLEQLPSVTGPVEALARV

SEQ ID NO: 1527850 - protein, 26 aa, Mycobacterium tuberculosis
PSASFGTLWIKSPANMLGYWNNPERT

SEQ ID NO: 1527851 - protein, 22 aa, Mycobacterium tuberculosis
PSASIGQWPRHQPQAQGGGLTD

SEQ ID NO: 1527852 - protein, 17 aa, Mycobacterium tuberculosis
PSDFRLWVCLHEVTHRV

SEQ ID NO: 1527853 - protein, 22 aa, Mycobacterium tuberculosis
PSDTHWLGRDRFVLSAGHSSLT

SEQ ID NO: 1527854 - protein, 20 aa, Mycobacterium tuberculosis
PSEILPFTVLLSSLGVTHLT

SEQ ID NO: 1527855 - protein, 26 aa, Mycobacterium tuberculosis
PSERRGPAAVRPFGQAGGGRANSGNS

SEQ ID NO: 1527856 - protein, 18 aa, Mycobacterium tuberculosis
PSFLKVLAGMHNEIVDDI

SEQ ID NO: 1527857 - protein, 29 aa, Mycobacterium tuberculosis
PSFSVVAPLLSRSLILQLRPLTAEDTRAV

SEQ ID NO: 1527858 - protein, 21 aa, Mycobacterium tuberculosis
PSGVQGSFCGRACAPAEVPGP

SEQ ID NO: 1527859 - protein, 19 aa, Mycobacterium tuberculosis
PSHHGLWDLALLACVPGFQ

SEQ ID NO: 1527860 - protein, 18 aa, Mycobacterium tuberculosis
PSHLFPAELAKRAKTLSE

SEQ ID NO: 1527861 - protein, 21 aa, Mycobacterium tuberculosis
PSHTRGYIGTALRLLERKIAQ

SEQ ID NO: 1527862 - protein, 20 aa, Mycobacterium tuberculosis
PSIKEKLLELLPNRVITDSI

SEQ ID NO: 1527863 - protein, 21 aa, Mycobacterium tuberculosis
PSIPYRVPYPQVMPTQETTPV

SEQ ID NO: 1527864 - protein, 28 aa, Mycobacterium tuberculosis
PSKGFGLLPPIVTPPGLLRRLLTGTDNA

SEQ ID NO: 1527865 - protein, 25 aa, Mycobacterium tuberculosis
PSLAALYRPMLLRTTNRHHGMPGHV

SEQ ID NO: 1527866 - protein, 26 aa, Mycobacterium tuberculosis
PSLSLVLIDRIPFPRPDDPLLSARQR

SEQ ID NO: 1527867 - protein, 17 aa, Mycobacterium tuberculosis
PSLTNVPDALVGPCWPA

SEQ ID NO: 1527868 - protein, 20 aa, Mycobacterium tuberculosis
PSLTNVPDALVGPCWPAVFA

SEQ ID NO: 1527869 - protein, 20 aa, Mycobacterium tuberculosis
PSLVIRIAPPVGRQLDWMVC

SEQ ID NO: 1527870 - protein, 25 aa, Mycobacterium tuberculosis
PSMFAQLHNAGLLDRAPLAVLALGG

SEQ ID NO: 1527871 - protein, 29 aa, Mycobacterium tuberculosis
PSPCPLRSKWFRSSWAPAVTWTRCPSRTS

SEQ ID NO: 1527872 - protein, 23 aa, Mycobacterium tuberculosis
PSPDLPTSRRFVNPLYLRVEAIP

SEQ ID NO: 1527873 - protein, 25 aa, Mycobacterium tuberculosis
PSQTPPAWAGPPRAAIPSGTTGQGR

SEQ ID NO: 1527874 - protein, 24 aa, Mycobacterium tuberculosis
PSQWSWRPWSLTVDVEPGPLGITA

SEQ ID NO: 1527875 - protein, 41 aa, Mycobacterium tuberculosis
PSRDRHHRPFRSPVRPSPSKPPLPRLQRRRVRHSDAAVSTK

SEQ ID NO: 1527876 - protein, 20 aa, Mycobacterium tuberculosis
PSRHRAGLLPHRTPRRRAAD

SEQ ID NO: 1527877 - protein, 32 aa, Mycobacterium tuberculosis
PSRSLPLLECWTALAALCRDTMKLRLGTSVLC

SEQ ID NO: 1527878 - protein, 24 aa, Mycobacterium tuberculosis
PSTGPSMGILPAGGVGGPGGSGGA

SEQ ID NO: 1527879 - protein, 18 aa, Mycobacterium tuberculosis
PSTSPPRWGGKGFVSSAT

SEQ ID NO: 1527880 - protein, 20 aa, Mycobacterium tuberculosis
PSVGLMQPWRFIRITDETLK

SEQ ID NO: 1527881 - protein, 19 aa, Mycobacterium tuberculosis
PSYRGSCWIPFSLEIEGDA

SEQ ID NO: 1527882 - protein, 22 aa, Mycobacterium tuberculosis
PTAAVVAIGALCFPLGSTGTTK

SEQ ID NO: 1527883 - protein, 21 aa, Mycobacterium tuberculosis
PTAFHRPLRHLLLAELSIRPL

SEQ ID NO: 1527884 - protein, 17 aa, Mycobacterium tuberculosis
PTALLRVYRDKLPHRYA

SEQ ID NO: 1527885 - protein, 17 aa, Mycobacterium tuberculosis
PTAPALASGPAALAIPA

SEQ ID NO: 1527886 - protein, 18 aa, Mycobacterium tuberculosis
PTAPALASGPAALAIPAL

SEQ ID NO: 1527887 - protein, 26 aa, Mycobacterium tuberculosis
PTAPNALVFPSYRGGHLPIEEYRRAF

SEQ ID NO: 1527888 - protein, 22 aa, Mycobacterium tuberculosis
PTAPPWPRCQRWPSWAPTTPST

SEQ ID NO: 1527889 - protein, 24 aa, Mycobacterium tuberculosis
PTASHRWHCGMLAPPAMMPSKSST

SEQ ID NO: 1527890 - protein, 25 aa, Mycobacterium tuberculosis
PTAVIARPPILPKPRNPRDDRILLE

SEQ ID NO: 1527891 - protein, 17 aa, Mycobacterium tuberculosis
PTAWLFGPEAHGLSAEI

SEQ ID NO: 1527892 - protein, 22 aa, Mycobacterium tuberculosis
PTDPARTAVATGGLGAAAEGGA

SEQ ID NO: 1527893 - protein, 19 aa, Mycobacterium tuberculosis
PTDWPRYGGYALAGVSSFG

SEQ ID NO: 1527894 - protein, 23 aa, Mycobacterium tuberculosis
PTEGRGFGGLGGAGGAGGKGGAG

SEQ ID NO: 1527895 - protein, 26 aa, Mycobacterium tuberculosis
PTEVKVPGVLTARIVPGATALDFQAK

SEQ ID NO: 1527896 - protein, 18 aa, Mycobacterium tuberculosis
PTEWGMLEMLARNRGKLV

SEQ ID NO: 1527897 - protein, 28 aa, Mycobacterium tuberculosis
PTFTGRSWPLADVRLLAPILASKVVCVG

SEQ ID NO: 1527898 - protein, 19 aa, Mycobacterium tuberculosis
PTGLLDHLAALFGAPKTAL

SEQ ID NO: 1527899 - protein, 18 aa, Mycobacterium tuberculosis
PTGLQAAGGNGGSGHAGG

SEQ ID NO: 1527900 - protein, 20 aa, Mycobacterium tuberculosis
PTICATPCGSPLRCARRSTT

SEQ ID NO: 1527901 - protein, 22 aa, Mycobacterium tuberculosis
PTIDLPVPDDWRLLPESSRAPY

SEQ ID NO: 1527902 - protein, 17 aa, Mycobacterium tuberculosis
PTLADAVLPLPNAVPGL

SEQ ID NO: 1527903 - protein, 20 aa, Mycobacterium tuberculosis
PTLCPGPTWSTCFPPTGRGR

SEQ ID NO: 1527904 - protein, 25 aa, Mycobacterium tuberculosis
PTLDYVVVKAPRFAFEKFPGADPTL

SEQ ID NO: 1527905 - protein, 18 aa, Mycobacterium tuberculosis
PTLKGPLELLPNAVRPAV

SEQ ID NO: 1527906 - protein, 19 aa, Mycobacterium tuberculosis
PTLKGPLELLPNAVRPAVS

SEQ ID NO: 1527907 - protein, 28 aa, Mycobacterium tuberculosis
PTLLRKGERLLVFLPLAHVLARAISMAA

SEQ ID NO: 1527908 - protein, 21 aa, Mycobacterium tuberculosis
PTLPLPTPVGMEIMPPQPPLP

SEQ ID NO: 1527909 - protein, 19 aa, Mycobacterium tuberculosis
PTLQQMILGGDPANLTGQG

SEQ ID NO: 1527910 - protein, 19 aa, Mycobacterium tuberculosis
PTLRLTTNLRIGLEGREAR

SEQ ID NO: 1527911 - protein, 18 aa, Mycobacterium tuberculosis
PTLYIFPHAGGTAKDYVA

SEQ ID NO: 1527912 - protein, 23 aa, Mycobacterium tuberculosis
PTMLSVPRWAVGPVMELGTDHRR

SEQ ID NO: 1527913 - protein, 34 aa, Mycobacterium tuberculosis
PTNRPRTWTFIPGGRRCWRLIPLASAGRPCGGGR

SEQ ID NO: 1527914 - protein, 29 aa, Mycobacterium tuberculosis
PTPDMRLDMPLVDFFSHGGALKSSWYGDC

SEQ ID NO: 1527915 - protein, 25 aa, Mycobacterium tuberculosis
PTPQRRRPYQPPPRPNSEALKAVVA

SEQ ID NO: 1527916 - protein, 21 aa, Mycobacterium tuberculosis
PTPRLNPWRTPIPKVYLCSAA

SEQ ID NO: 1527917 - protein, 24 aa, Mycobacterium tuberculosis
PTPSSWRFRRRGWRASSMASRRAH

SEQ ID NO: 1527918 - protein, 28 aa, Mycobacterium tuberculosis
PTPTITARLNFQLAFGARVGQRLADARE

SEQ ID NO: 1527919 - protein, 22 aa, Mycobacterium tuberculosis
PTPVAWTRMRAPRSLMAAIGAE

SEQ ID NO: 1527920 - protein, 22 aa, Mycobacterium tuberculosis
PTQPQPRLRRRRAGRLRAFRVG

SEQ ID NO: 1527921 - protein, 19 aa, Mycobacterium tuberculosis
PTQTLLGRPLIGNGADGVA

SEQ ID NO: 1527922 - protein, 18 aa, Mycobacterium tuberculosis
PTQYDTLRRALYTTLRDY

SEQ ID NO: 1527923 - protein, 28 aa, Mycobacterium tuberculosis
PTRRLNLLVAPMARLRWPKPIGSMGTDT

SEQ ID NO: 1527924 - protein, 28 aa, Mycobacterium tuberculosis
PTSEIWVKPSFFPGIRIAPSSGGGATST

SEQ ID NO: 1527925 - protein, 25 aa, Mycobacterium tuberculosis
PTSVHVGILPYPRNLDSLVLIASGG

SEQ ID NO: 1527926 - protein, 18 aa, Mycobacterium tuberculosis
PTSWLPVPVPPVPPVPPL

SEQ ID NO: 1527927 - protein, 34 aa, Mycobacterium tuberculosis
PTTICSPSPSCRAMFSPTVSAPSTAPPAACSASA

SEQ ID NO: 1527928 - protein, 28 aa, Mycobacterium tuberculosis
PTVAPTTLAILMLLPLSAFEATVALPAA

SEQ ID NO: 1527929 - protein, 27 aa, Mycobacterium tuberculosis
PTVAQGELAAMVAPAGCYSGDGGNGGA

SEQ ID NO: 1527930 - protein, 24 aa, Mycobacterium tuberculosis
PTVDFLVFPDYGEDVYYSVSSVAT

SEQ ID NO: 1527931 - protein, 26 aa, Mycobacterium tuberculosis
PTVMEDYFYRPFRDLVIRAAERADAP

SEQ ID NO: 1527932 - protein, 26 aa, Mycobacterium tuberculosis
PTVRTTVSWAWRRAGLDGIAELTGAR

SEQ ID NO: 1527933 - protein, 18 aa, Mycobacterium tuberculosis
PVAAFKWRAQLPIEDSGR

SEQ ID NO: 1527934 - protein, 24 aa, Mycobacterium tuberculosis
PVAGRMMGRLGWYVESMLSPRLHR

SEQ ID NO: 1527935 - protein, 20 aa, Mycobacterium tuberculosis
PVALALLKQGLPGDTALVTC

SEQ ID NO: 1527936 - protein, 17 aa, Mycobacterium tuberculosis
PVARYLGPLVPKQTLLW

SEQ ID NO: 1527937 - protein, 17 aa, Mycobacterium tuberculosis
PVAVEWGCGCGVAGSAA

SEQ ID NO: 1527938 - protein, 25 aa, Mycobacterium tuberculosis
PVAVLRELVLLYDAGRREPLPLPLK

SEQ ID NO: 1527939 - protein, 32 aa, Mycobacterium tuberculosis
PVAVLSQRPRMLYDYFHQLFAQVTNPPLDAIR

SEQ ID NO: 1527940 - protein, 18 aa, Mycobacterium tuberculosis
PVAYHTFGGWKRSGFGDL

SEQ ID NO: 1527941 - protein, 17 aa, Mycobacterium tuberculosis
PVDCPSYAEVMLWHADL

SEQ ID NO: 1527942 - protein, 17 aa, Mycobacterium tuberculosis
PVDSIYSPVLKVTYKVD

SEQ ID NO: 1527943 - protein, 21 aa, Mycobacterium tuberculosis
PVDVLTLFSYPVHPPGKPERV

SEQ ID NO: 1527944 - protein, 24 aa, Mycobacterium tuberculosis
PVDVRVRRWIEAMPQYGPGHADVV

SEQ ID NO: 1527945 - protein, 27 aa, Mycobacterium tuberculosis
PVEAFQFYFELLLFDYPTHIVQIVEAL

SEQ ID NO: 1527946 - protein, 20 aa, Mycobacterium tuberculosis
PVEIAVIHRPRYDDWSLPKG

SEQ ID NO: 1527947 - protein, 20 aa, Mycobacterium tuberculosis
PVEPPVHDKPPSHSVFDVGH

SEQ ID NO: 1527948 - protein, 19 aa, Mycobacterium tuberculosis
PVFDHPFLHVVATPAQHLL

SEQ ID NO: 1527949 - protein, 28 aa, Mycobacterium tuberculosis
PVGGILAPLQPFQATAVIPVIGPVTVTL

SEQ ID NO: 1527950 - protein, 33 aa, Mycobacterium tuberculosis
PVGGLLARFPGFYIPFLDVPFNGATPANSPYPT

SEQ ID NO: 1527951 - protein, 18 aa, Mycobacterium tuberculosis
PVGNGRTNFNGHRREPGG

SEQ ID NO: 1527952 - protein, 24 aa, Mycobacterium tuberculosis
PVGTAALVGLTLAPSSQVPAGTGR

SEQ ID NO: 1527953 - protein, 17 aa, Mycobacterium tuberculosis
PVGVDALITALWEEWPP

SEQ ID NO: 1527954 - protein, 19 aa, Mycobacterium tuberculosis
PVGVRRLRNYHSTRSAHYC

SEQ ID NO: 1527955 - protein, 18 aa, Mycobacterium tuberculosis
PVGVVGDVYYGGGPAVGA

SEQ ID NO: 1527956 - protein, 26 aa, Mycobacterium tuberculosis
PVHLITCLAEPDPSWWDRLAPVSHHP

SEQ ID NO: 1527957 - protein, 26 aa, Mycobacterium tuberculosis
PVHPARLAVPVGLPGYWATAGAAEPA

SEQ ID NO: 1527958 - protein, 17 aa, Mycobacterium tuberculosis
PVILGPDHPITGSYPVV

SEQ ID NO: 1527959 - protein, 20 aa, Mycobacterium tuberculosis
PVITAPERWAFEYSRFQEAQ

SEQ ID NO: 1527960 - protein, 27 aa, Mycobacterium tuberculosis
PVIVEPHRVLTLPLVRARQPVADTSLA

SEQ ID NO: 1527961 - protein, 20 aa, Mycobacterium tuberculosis
PVKSVGTWRLQPVLAGGGLS

SEQ ID NO: 1527962 - protein, 27 aa, Mycobacterium tuberculosis
PVLAEWFLRRFSLLDSLYMVPSVPIIG

SEQ ID NO: 1527963 - protein, 18 aa, Mycobacterium tuberculosis
PVLEPLVAVHREIYPKAD

SEQ ID NO: 1527964 - protein, 22 aa, Mycobacterium tuberculosis
PVLFAVMVSLAELWKSVAVHPD

SEQ ID NO: 1527965 - protein, 21 aa, Mycobacterium tuberculosis
PVLGRLYSTEFYALAARALAP

SEQ ID NO: 1527966 - protein, 20 aa, Mycobacterium tuberculosis
PVLIVDYRLIPKHSLGMALD

SEQ ID NO: 1527967 - protein, 17 aa, Mycobacterium tuberculosis
PVLKMLLDTFPVTFTAA

SEQ ID NO: 1527968 - protein, 17 aa, Mycobacterium tuberculosis
PVLPQLSARHHVLVAAV

SEQ ID NO: 1527969 - protein, 22 aa, Mycobacterium tuberculosis
PVLWDEMPTLPLYRQQRTLLMS

SEQ ID NO: 1527970 - protein, 23 aa, Mycobacterium tuberculosis
PVMATCCWGWRSTPSRIGIGTTP

SEQ ID NO: 1527971 - protein, 18 aa, Mycobacterium tuberculosis
PVNFALLGKGNTVNPDAL

SEQ ID NO: 1527972 - protein, 27 aa, Mycobacterium tuberculosis
PVNPDAAWYYRRPSPLARRIKNHVAFR

SEQ ID NO: 1527973 - protein, 18 aa, Mycobacterium tuberculosis
PVNTLPVPGLTIADLGEL

SEQ ID NO: 1527974 - protein, 18 aa, Mycobacterium tuberculosis
PVPAPHDDDPLGEIIFIS

SEQ ID NO: 1527975 - protein, 18 aa, Mycobacterium tuberculosis
PVPGFEVRALFTAGIDTP

SEQ ID NO: 1527976 - protein, 25 aa, Mycobacterium tuberculosis
PVPHWPKYWIQALAKHFQRQLKPSP

SEQ ID NO: 1527977 - protein, 24 aa, Mycobacterium tuberculosis
PVPISPRRRWTWTRHTWRCTALRG

SEQ ID NO: 1527978 - protein, 17 aa, Mycobacterium tuberculosis
PVPPTFKALPLAPESPA

SEQ ID NO: 1527979 - protein, 18 aa, Mycobacterium tuberculosis
PVPSLFHFTRTGEEFSWR

SEQ ID NO: 1527980 - protein, 20 aa, Mycobacterium tuberculosis
PVPVPPVPPVPPLPVKMPPS

SEQ ID NO: 1527981 - protein, 24 aa, Mycobacterium tuberculosis
PVPVPPVPPVPPLPVKMPPSPPVP

SEQ ID NO: 1527982 - protein, 27 aa, Mycobacterium tuberculosis
PVQERRLVFERFYRSASARALPGSGLG

SEQ ID NO: 1527983 - protein, 19 aa, Mycobacterium tuberculosis
PVQTLTGRPLIGNGANGVA

SEQ ID NO: 1527984 - protein, 29 aa, Mycobacterium tuberculosis
PVRAHLIDAARPFIFDTGLAPAAVGAARA

SEQ ID NO: 1527985 - protein, 19 aa, Mycobacterium tuberculosis
PVRERILVTHPLQPFDRKN

SEQ ID NO: 1527986 - protein, 20 aa, Mycobacterium tuberculosis
PVRERILVTHPLQPFDRKNV

SEQ ID NO: 1527987 - protein, 30 aa, Mycobacterium tuberculosis
PVRGMLRRQRSMVAPLLYIGMHTEISGFAG

SEQ ID NO: 1527988 - protein, 17 aa, Mycobacterium tuberculosis
PVRQAPYGLAGSRELAW

SEQ ID NO: 1527989 - protein, 34 aa, Mycobacterium tuberculosis
PVSALVVFEVMVRPLIRLSLGKRHPMRRIVSART

SEQ ID NO: 1527990 - protein, 27 aa, Mycobacterium tuberculosis
PVSLTIPGFTIPGGTLIPTLPLGLALS

SEQ ID NO: 1527991 - protein, 20 aa, Mycobacterium tuberculosis
PVSPGWAGPAGPAGPADCSA

SEQ ID NO: 1527992 - protein, 19 aa, Mycobacterium tuberculosis
PVSRMRAGDVGAYELAELL

SEQ ID NO: 1527993 - protein, 17 aa, Mycobacterium tuberculosis
PVSRVAVVVAPTLNIVK

SEQ ID NO: 1527994 - protein, 25 aa, Mycobacterium tuberculosis
PVSVTPMVWVRPRQGPKLADLIAAP

SEQ ID NO: 1527995 - protein, 18 aa, Mycobacterium tuberculosis
PVTAHRIMTGAPVPIGAT

SEQ ID NO: 1527996 - protein, 23 aa, Mycobacterium tuberculosis
PVTGLVFVTNFDSNTVSVIDPNT

SEQ ID NO: 1527997 - protein, 25 aa, Mycobacterium tuberculosis
PVTIPGFAINPFGLDVPLSGGTNAV

SEQ ID NO: 1527998 - protein, 26 aa, Mycobacterium tuberculosis
PVTIPGFAINPFGLDVPLSGGTSPVT

SEQ ID NO: 1527999 - protein, 18 aa, Mycobacterium tuberculosis
PVTLVAQLSRRFAPPTLV

SEQ ID NO: 1528000 - protein, 17 aa, Mycobacterium tuberculosis
PVVFLTAYYALRVLAQV

SEQ ID NO: 1528001 - protein, 25 aa, Mycobacterium tuberculosis
PVVGWAVLVGPAGPAAMAGCCSAPA

SEQ ID NO: 1528002 - protein, 20 aa, Mycobacterium tuberculosis
PVVRVSALKALEGDAKWVAS

SEQ ID NO: 1528003 - protein, 20 aa, Mycobacterium tuberculosis
PVVWRGPMLHRTLQQFLADV

SEQ ID NO: 1528004 - protein, 19 aa, Mycobacterium tuberculosis
PVYFDYWSARGVDVTPFFA

SEQ ID NO: 1528005 - protein, 27 aa, Mycobacterium tuberculosis
PWANRDRIWLRPPAPRRQNLPPAPRRS

SEQ ID NO: 1528006 - protein, 18 aa, Mycobacterium tuberculosis
PWDTLADAKALAGAHPDG

SEQ ID NO: 1528007 - protein, 17 aa, Mycobacterium tuberculosis
PWGAQLRRRLRGHPAHR

SEQ ID NO: 1528008 - protein, 21 aa, Mycobacterium tuberculosis
PWGHFDGLRAWLNGLLDTGYV

SEQ ID NO: 1528009 - protein, 23 aa, Mycobacterium tuberculosis
PWGVVTEKGRWYLVGHDRDRDAT

SEQ ID NO: 1528010 - protein, 20 aa, Mycobacterium tuberculosis
PWIHCWSRNRHQLVSLVLSN

SEQ ID NO: 1528011 - protein, 24 aa, Mycobacterium tuberculosis
PWMRGDGLGSQRRKFGFYDDDRES

SEQ ID NO: 1528012 - protein, 19 aa, Mycobacterium tuberculosis
PWPQPVPEPAFKAAIAQAT

SEQ ID NO: 1528013 - protein, 22 aa, Mycobacterium tuberculosis
PWRLNQNYLRDIRLIRRGKIDD

SEQ ID NO: 1528014 - protein, 19 aa, Mycobacterium tuberculosis
PWRPGKPNYNALWRPFRSS

SEQ ID NO: 1528015 - protein, 28 aa, Mycobacterium tuberculosis
PYAGRRETWLIMRLPVIGNTQALRWRTS

SEQ ID NO: 1528016 - protein, 19 aa, Mycobacterium tuberculosis
PYASWLTAAGAQAELAARQ

SEQ ID NO: 1528017 - protein, 19 aa, Mycobacterium tuberculosis
PYAWYQYFVNTADADVIRY

SEQ ID NO: 1528018 - protein, 23 aa, Mycobacterium tuberculosis
PYFGDRRKAFLEGLAVVTGGQVV

SEQ ID NO: 1528019 - protein, 21 aa, Mycobacterium tuberculosis
PYGAGWLLDIQVDSSDVAALE

SEQ ID NO: 1528020 - protein, 19 aa, Mycobacterium tuberculosis
PYGFVAFDVDPGQPGGTTS

SEQ ID NO: 1528021 - protein, 18 aa, Mycobacterium tuberculosis
PYGVRPLSLGRLDRGWVV

SEQ ID NO: 1528022 - protein, 23 aa, Mycobacterium tuberculosis
PYNRGWFPQVFSIIDGQKVGVTI

SEQ ID NO: 1528023 - protein, 18 aa, Mycobacterium tuberculosis
PYPAVFQDVSLVVAADIP

SEQ ID NO: 1528024 - protein, 29 aa, Mycobacterium tuberculosis
PYPELATTTLLRPVKPPPSEGWRRLLYLL

SEQ ID NO: 1528025 - protein, 23 aa, Mycobacterium tuberculosis
PYQGTVRMAFLLQGDHDAYFQHV

SEQ ID NO: 1528026 - protein, 19 aa, Mycobacterium tuberculosis
PYRLRVIVHEDENGRMTGY

SEQ ID NO: 1528027 - protein, 29 aa, Mycobacterium tuberculosis
PYRVGYFRFELDAGLWLLATGSESELGLL

SEQ ID NO: 1528028 - protein, 26 aa, Mycobacterium tuberculosis
PYVWGSIYRFNGQTSVFWPGRGPCYR

SEQ ID NO: 1528029 - protein, 28 aa, Mycobacterium tuberculosis
QAAAQLPLPAGLQQFLNTLPNLGIGNQG

SEQ ID NO: 1528030 - protein, 22 aa, Mycobacterium tuberculosis
QAAAYHEQFVHRLSAAATSYAV

SEQ ID NO: 1528031 - protein, 23 aa, Mycobacterium tuberculosis
QAACDGPRFCWVNGMRVSFENGF

SEQ ID NO: 1528032 - protein, 20 aa, Mycobacterium tuberculosis
QAADLAYFRVLIHSTRNRAL

SEQ ID NO: 1528033 - protein, 24 aa, Mycobacterium tuberculosis
QAAGPWLKNALISNLNIVSTVNPG

SEQ ID NO: 1528034 - protein, 21 aa, Mycobacterium tuberculosis
QAAIVPPRDLVFAFVADEERG

SEQ ID NO: 1528035 - protein, 19 aa, Mycobacterium tuberculosis
QAALSQNFIGAGGTAGAGG

SEQ ID NO: 1528036 - protein, 24 aa, Mycobacterium tuberculosis
QAASLARHFGARRKAFNWTVTALK

SEQ ID NO: 1528037 - protein, 24 aa, Mycobacterium tuberculosis
QAAVDLSMIRRKAAKRLAKEVSAE

SEQ ID NO: 1528038 - protein, 24 aa, Mycobacterium tuberculosis
QAAWPERMFSLLAGFVEAGESFEV

SEQ ID NO: 1528039 - protein, 26 aa, Mycobacterium tuberculosis
QACYEAHGTLFFGVPTVWSRVAADQA

SEQ ID NO: 1528040 - protein, 22 aa, Mycobacterium tuberculosis
QADALMLLYLLSSDELIGLLAR

SEQ ID NO: 1528041 - protein, 20 aa, Mycobacterium tuberculosis
QADIRRKIEIGCYQGLRHRR

SEQ ID NO: 1528042 - protein, 22 aa, Mycobacterium tuberculosis
QAEARQLLDLMVHSVYSNKDAF

SEQ ID NO: 1528043 - protein, 33 aa, Mycobacterium tuberculosis; identical to SEQ ID NO: 848042

SEQ ID NO: 1528044 - protein, 24 aa, Mycobacterium tuberculosis
QAEQALVITPPQQAVAEVARHERA

SEQ ID NO: 1528045 - protein, 20 aa, Mycobacterium tuberculosis
QAFHAQFVQALTSGGGAYAA

SEQ ID NO: 1528046 - protein, 25 aa, Mycobacterium tuberculosis
QAGDNPQLLPLLDDYRHASTEYALG

SEQ ID NO: 1528047 - protein, 17 aa, Mycobacterium tuberculosis
QAGDRVVIFSATRYEWA

SEQ ID NO: 1528048 - protein, 21 aa, Mycobacterium tuberculosis
QAGGIGGWLWCNGGNGGSGAS

SEQ ID NO: 1528049 - protein, 22 aa, Mycobacterium tuberculosis
QAGGNGGWLWGKRRQRRVGGTR

SEQ ID NO: 1528050 - protein, 23 aa, Mycobacterium tuberculosis
QAGGPGGLLYGNGGNGAAGGPNQ

SEQ ID NO: 1528051 - protein, 24 aa, Mycobacterium tuberculosis
QAGLRTDYLLRIPNQRGGIVLGTG

SEQ ID NO: 1528052 - protein, 23 aa, Mycobacterium tuberculosis
QAGNIARLSWLAAGYPEEVPGVT

SEQ ID NO: 1528053 - protein, 23 aa, Mycobacterium tuberculosis
QAGRLLAHLTADDGLTALDVGWR

SEQ ID NO: 1528054 - protein, 29 aa, Mycobacterium tuberculosis
QAGSLNRPGYLRFDFNWQGPLTDDQRTQV

SEQ ID NO: 1528055 - protein, 20 aa, Mycobacterium tuberculosis
QAHALARHFGARRKAYNWTV

SEQ ID NO: 1528056 - protein, 19 aa, Mycobacterium tuberculosis
QAIARLFSDYATHYQSLNA

SEQ ID NO: 1528057 - protein, 29 aa, Mycobacterium tuberculosis
QAILATYGQRPADRPLWLGSIKSNIGHTS

SEQ ID NO: 1528058 - protein, 30 aa, Mycobacterium tuberculosis; identical to SEQ ID NO: 163392

SEQ ID NO: 1528059 - protein, 40 aa, Mycobacterium tuberculosis; identical to SEQ ID NO: 226721

SEQ ID NO: 1528060 - protein, 33 aa, Mycobacterium tuberculosis
QALARTVYGHLPGYALPLFVRVVGSLAHTTTFK

SEQ ID NO: 1528061 - protein, 18 aa, Mycobacterium tuberculosis
QALAWIAHQPEATRRSWA

SEQ ID NO: 1528062 - protein, 19 aa, Mycobacterium tuberculosis
QALGAPPQRRQWWIDRVKA

SEQ ID NO: 1528063 - protein, 31 aa, Mycobacterium tuberculosis
QALQALTIPSFIPEDFTFLDAIFAGYATVGV

SEQ ID NO: 1528064 - protein, 32 aa, Mycobacterium tuberculosis
QALQALTIPSFIPEDFTFLDAIFAGYATVGVT

SEQ ID NO: 1528065 - protein, 19 aa, Mycobacterium tuberculosis
QALRGLLKPIYEENQLGRA

SEQ ID NO: 1528066 - protein, 32 aa, Mycobacterium tuberculosis
QALSAQAAAFHQQFVRALSSAAGSYAAAEAAN

SEQ ID NO: 1528067 - protein, 27 aa, Mycobacterium tuberculosis
QALSAQAAMFHEQFVRALAAGGNSYAV

SEQ ID NO: 1528068 - protein, 19 aa, Mycobacterium tuberculosis
QALTPGGGGLSGRRGRRRD

SEQ ID NO: 1528069 - protein, 31 aa, Mycobacterium tuberculosis; identical to SEQ ID NO: 1389503

SEQ ID NO: 1528070 - protein, 26 aa, Mycobacterium tuberculosis
QAMKSLHLILSHFQMPGFQVPEFRRK

SEQ ID NO: 1528071 - protein, 19 aa, Mycobacterium tuberculosis
QAMTLAVRSGHSRIPVIGE

SEQ ID NO: 1528072 - protein, 21 aa, Mycobacterium tuberculosis
QANSLLLRRLQAERPGDAVLS

SEQ ID NO: 1528073 - protein, 31 aa, Mycobacterium tuberculosis
QAPNAFAPLFKHYRHIYLRPFRYYVAYRTTD

SEQ ID NO: 1528074 - protein, 31 aa, Mycobacterium tuberculosis
QAQDYAWRKGIKTLYYIRLRQMALEGTEVEG

SEQ ID NO: 1528075 - protein, 21 aa, Mycobacterium tuberculosis
QARAALASGAARGTRAADAAG

SEQ ID NO: 1528076 - protein, 24 aa, Mycobacterium tuberculosis
QAREELPYLPDCQPRRALATLIDH

SEQ ID NO: 1528077 - protein, 18 aa, Mycobacterium tuberculosis
QARPGCRPSLAELDSFVR

SEQ ID NO: 1528078 - protein, 17 aa, Mycobacterium tuberculosis
QARTIGGVYPRGPPLTD

SEQ ID NO: 1528079 - protein, 23 aa, Mycobacterium tuberculosis
QARVGSYLRYGAYPYAIVVREYV

SEQ ID NO: 1528080 - protein, 18 aa, Mycobacterium tuberculosis
QARYILPSFIEHSSFGVK

SEQ ID NO: 1528081 - protein, 36 aa, Mycobacterium tuberculosis
QASAAKFIWFFATRTRFGLWFRNVAMRTMNFGPLAT

SEQ ID NO: 1528082 - protein, 37 aa, Mycobacterium tuberculosis
QASAAKFIWFFATRTRFGLWFRNVAMRTMNFGPLATL

SEQ ID NO: 1528083 - protein, 41 aa, Mycobacterium tuberculosis
QASAAKFIWFFATRTRFGLWFRNVAMRTMNFGPLATLFAGS

SEQ ID NO: 1528084 - protein, 23 aa, Mycobacterium tuberculosis
QATGMSMFNLGLGNIGQFNVGFS

SEQ ID NO: 1528085 - protein, 18 aa, Mycobacterium tuberculosis
QATHPAAVKPELVAHQPN

SEQ ID NO: 1528086 - protein, 18 aa, Mycobacterium tuberculosis
QAVFPHRAHRRAPPRRVS

SEQ ID NO: 1528087 - protein, 25 aa, Mycobacterium tuberculosis
QAVHTLPMLYALREQTPDTSRMREL

SEQ ID NO: 1528088 - protein, 21 aa, Mycobacterium tuberculosis
QAVLMLRHGLRFLTACQRRYG

SEQ ID NO: 1528089 - protein, 23 aa, Mycobacterium tuberculosis
QAVRPARTLAKKGNIPVGYYKDE

SEQ ID NO: 1528090 - protein, 35 aa, Mycobacterium tuberculosis
QAWLAEETGQPPWTPWYAGRPLLVTANDYGLRVYN

SEQ ID NO: 1528091 - protein, 30 aa, Mycobacterium tuberculosis
QCCGPLDWRWRRRGFFGDHGGRWCRHRSLQ

SEQ ID NO: 1528092 - protein, 19 aa, Mycobacterium tuberculosis
QCGRRMVVQVRPDGWWARC

SEQ ID NO: 1528093 - protein, 20 aa, Mycobacterium tuberculosis
QCLNVRWWSPQQVTQRRGFL

SEQ ID NO: 1528094 - protein, 23 aa, Mycobacterium tuberculosis
QCRLDHLLGIGQAVRPAGHDGGV

SEQ ID NO: 1528095 - protein, 17 aa, Mycobacterium tuberculosis
QCRWPGCHPKDPTIYRR

SEQ ID NO: 1528096 - protein, 20 aa, Mycobacterium tuberculosis
QCWWPAEISLTIGGTRWGDP

SEQ ID NO: 1528097 - protein, 26 aa, Mycobacterium tuberculosis
QDCMRPRWPQRSPTADGCWPGGCTGR

SEQ ID NO: 1528098 - protein, 17 aa, Mycobacterium tuberculosis
QDFGPIQTLFTDAGLLD

SEQ ID NO: 1528099 - protein, 23 aa, Mycobacterium tuberculosis
QDLRGLLGAFMFTGPQLEQPAGT

SEQ ID NO: 1528100 - protein, 29 aa, Mycobacterium tuberculosis
QDNEGHSMFPWLTLALVGNSTSSILFGTG

SEQ ID NO: 1528101 - protein, 22 aa, Mycobacterium tuberculosis
QDPMTNLNPVWKVGFQVTEALR

SEQ ID NO: 1528102 - protein, 19 aa, Mycobacterium tuberculosis
QDRRRGVPWWSKTTSHRFS

SEQ ID NO: 1528103 - protein, 25 aa, Mycobacterium tuberculosis
QDSCRLAPQLLLRQNGDVPLRPTTT

SEQ ID NO: 1528104 - protein, 22 aa, Mycobacterium tuberculosis
QDYANIPPTRFKRKEHWLPAHF

SEQ ID NO: 1528105 - protein, 17 aa, Mycobacterium tuberculosis
QDYQLQLVPKMLRMLRP

SEQ ID NO: 1528106 - protein, 17 aa, Mycobacterium tuberculosis
QEALLADDRIHHLRGRV

SEQ ID NO: 1528107 - protein, 25 aa, Mycobacterium tuberculosis
QEDSRLLTRELLYTAVTRAKRKVRV

SEQ ID NO: 1528108 - protein, 31 aa, Mycobacterium tuberculosis; identical to SEQ ID NO: 163405

SEQ ID NO: 1528109 - protein, 19 aa, Mycobacterium tuberculosis
QELPLIEEWLQFVGEKLPT

SEQ ID NO: 1528110 - protein, 32 aa, Mycobacterium tuberculosis
QELSAHAVAFHDQFVQLMSAGAAQYASAEAAN

SEQ ID NO: 1528111 - protein, 32 aa, Mycobacterium tuberculosis
QELSAHAVAFHEQFVQLMSAGAAQYASAEAAN

SEQ ID NO: 1528112 - protein, 17 aa, Mycobacterium tuberculosis
QEMFAPGAFRRSIAERG

SEQ ID NO: 1528113 - protein, 25 aa, Mycobacterium tuberculosis
QERARIMFMIGTLTPDRVTRDADAL

SEQ ID NO: 1528114 - protein, 17 aa, Mycobacterium tuberculosis
QERQRLVVMPYAPSRED

SEQ ID NO: 1528115 - protein, 22 aa, Mycobacterium tuberculosis
QETWTRLVLIDAGLPKPQTQIR

SEQ ID NO: 1528116 - protein, 25 aa, Mycobacterium tuberculosis
QEWHYYFENTKRWRNLRKITIAQVH

SEQ ID NO: 1528117 - protein, 18 aa, Mycobacterium tuberculosis
QFCYLQLSGKRSRRGQPD

SEQ ID NO: 1528118 - protein, 26 aa, Mycobacterium tuberculosis
QFDHRTLSRVYGWMLDGVPVVAMHRN

SEQ ID NO: 1528119 - protein, 22 aa, Mycobacterium tuberculosis
QFFASIAQQLTFGPGGTTAGSG

SEQ ID NO: 1528120 - protein, 22 aa, Mycobacterium tuberculosis
QFGPYQLLRLLGRGGMGEVYEA

SEQ ID NO: 1528121 - protein, 20 aa, Mycobacterium tuberculosis
QFGVASWTPQGEFEFGGQEA

SEQ ID NO: 1528122 - protein, 25 aa, Mycobacterium tuberculosis
QFKTLKYRPDFPKRFESIEAARVHC

SEQ ID NO: 1528123 - protein, 17 aa, Mycobacterium tuberculosis
QFLAALDREFGITSPRA

SEQ ID NO: 1528124 - protein, 18 aa, Mycobacterium tuberculosis
QFSDEFLRWLAGVRFTGD

SEQ ID NO: 1528125 - protein, 18 aa, Mycobacterium tuberculosis
QFVQPFISAAFSDLGLDP

SEQ ID NO: 1528126 - protein, 38 aa, Mycobacterium tuberculosis
QGAPFSFVLAPWQIHDWILLTPWGLLSWLQINQQLGIA

SEQ ID NO: 1528127 - protein, 23 aa, Mycobacterium tuberculosis
QGDFLIRGLLGADPTKGAIGIGE

SEQ ID NO: 1528128 - protein, 23 aa, Mycobacterium tuberculosis
QGDFLIRGLLGADPTTGAIGIGE

SEQ ID NO: 1528129 - protein, 26 aa, Mycobacterium tuberculosis
QGDGGRCMVVFQPHLYSRTKAFAAEF

SEQ ID NO: 1528130 - protein, 26 aa, Mycobacterium tuberculosis
QGGHGGNAILFGQGGAGGPGGTGAMG

SEQ ID NO: 1528131 - protein, 22 aa, Mycobacterium tuberculosis
QGGIGGAGERGADGAGPNANGA

SEQ ID NO: 1528132 - protein, 32 aa, Mycobacterium tuberculosis
QGGIGGAGGNAGFGAGVPGDGGIGGTGGAGGA

SEQ ID NO: 1528133 - protein, 26 aa, Mycobacterium tuberculosis
QGGKGGLNSTGLASAASGDGGNGGAG

SEQ ID NO: 1528134 - protein, 17 aa, Mycobacterium tuberculosis
QGGWLEFDAAIATPDQM

SEQ ID NO: 1528135 - protein, 21 aa, Mycobacterium tuberculosis
QGKTRLLRALAGLLDEWTPVI

SEQ ID NO: 1528136 - protein, 17 aa, Mycobacterium tuberculosis
QGLPATSIAWGAWAEIG

SEQ ID NO: 1528137 - protein, 17 aa, Mycobacterium tuberculosis
QGLPVSAIAWGAWGEVG

SEQ ID NO: 1528138 - protein, 18 aa, Mycobacterium tuberculosis
QGLRRIIAAELRVPEKEL

SEQ ID NO: 1528139 - protein, 20 aa, Mycobacterium tuberculosis
QGLVLNFGLADVGLGNVGLG

SEQ ID NO: 1528140 - protein, 24 aa, Mycobacterium tuberculosis
QGMADGGLLLPLGVRRLRSYGSAR

SEQ ID NO: 1528141 - protein, 18 aa, Mycobacterium tuberculosis
QGMPDAMELLAGLAGEVG

SEQ ID NO: 1528142 - protein, 21 aa, Mycobacterium tuberculosis
QGMRKRLGAFPIGPVFGDDYL

SEQ ID NO: 1528143 - protein, 37 aa, Mycobacterium tuberculosis
QGPVMADPRLPRSRRWLLNLVITRGTPPRLEGCRPAS

SEQ ID NO: 1528144 - protein, 36 aa, Mycobacterium tuberculosis
QGQGGYPPPTSNALLFLPARLPATALPATTRAIAKA

SEQ ID NO: 1528145 - protein, 23 aa, Mycobacterium tuberculosis
QGQIAIDLSVTTPFIPINEQMVI

SEQ ID NO: 1528146 - protein, 59 aa, Mycobacterium tuberculosis
QGQWGAHYAITVPQIPLLNFSLNIPVNIPIHLDFGTLAVNGFQIPAITLRALGVTHFSV

SEQ ID NO: 1528147 - protein, 60 aa, Mycobacterium tuberculosis
QGQWGAHYAITVPQIPLLNFSLNIPVNIPIHLDFGTLAVNGFQIPAITLRALGVTHFSVG

SEQ ID NO: 1528148 - protein, 18 aa, Mycobacterium tuberculosis
QGRAYWIHLMMASQTIES

SEQ ID NO: 1528149 - protein, 22 aa, Mycobacterium tuberculosis
QGRGQLCWPDCGIPSIPPGHGW

SEQ ID NO: 1528150 - protein, 24 aa, Mycobacterium tuberculosis
QGRNPFWHRLSRAMYRLARPTAAA

SEQ ID NO: 1528151 - protein, 23 aa, Mycobacterium tuberculosis
QGRPLQHRWPDRQLPGEGVTLGA

SEQ ID NO: 1528152 - protein, 19 aa, Mycobacterium tuberculosis
QGRTGAMAVPVGWAATVVG

SEQ ID NO: 1528153 - protein, 29 aa, Mycobacterium tuberculosis
QGSQTEGMLSPWLQLPGAADQIAAWSKAA

SEQ ID NO: 1528154 - protein, 23 aa, Mycobacterium tuberculosis
QGTWRLWLPGCSWPPNVPQRRGQ

SEQ ID NO: 1528155 - protein, 22 aa, Mycobacterium tuberculosis
QGVPFVLPNAWDVPSDLAYLAE

SEQ ID NO: 1528156 - protein, 18 aa, Mycobacterium tuberculosis
QGYRLIFENDFVTEPEVA

SEQ ID NO: 1528157 - protein, 24 aa, Mycobacterium tuberculosis
QHGRTRIRRRPGQHAGHALGVFVV

SEQ ID NO: 1528158 - protein, 28 aa, Mycobacterium tuberculosis
QHHHPRQLQRSAPGWRSTRGGNVYVTNF

SEQ ID NO: 1528159 - protein, 21 aa, Mycobacterium tuberculosis
QHLITKPVFDALFAGHDFASH

SEQ ID NO: 1528160 - protein, 26 aa, Mycobacterium tuberculosis
QHNDKGRRLLWPALDFHQGVHRALVW

SEQ ID NO: 1528161 - protein, 26 aa, Mycobacterium tuberculosis
QHNGRLGLIGTRWRPIDPGPDRPRRS

SEQ ID NO: 1528162 - protein, 22 aa, Mycobacterium tuberculosis
QHPLPEALVGDAARFLLEGMPV

SEQ ID NO: 1528163 - protein, 25 aa, Mycobacterium tuberculosis
QHPRSRPRQRARRLVPPARQVRPDV

SEQ ID NO: 1528164 - protein, 22 aa, Mycobacterium tuberculosis
QHRDMRILGIGGGTTEILTALA

SEQ ID NO: 1528165 - protein, 18 aa, Mycobacterium tuberculosis
QHRLFLQCAWHALEDAGA

SEQ ID NO: 1528166 - protein, 18 aa, Mycobacterium tuberculosis
QHRMLLEVAWEALEHAGI

SEQ ID NO: 1528167 - protein, 25 aa, Mycobacterium tuberculosis
QHSLWPVFADIPAGWRVVHGEASRA

SEQ ID NO: 1528168 - protein, 17 aa, Mycobacterium tuberculosis
QIAALFGAHARSYQTLS

SEQ ID NO: 1528169 - protein, 21 aa, Mycobacterium tuberculosis
QIAMYLCRELTDLSLPKIGQA

SEQ ID NO: 1528170 - protein, 20 aa, Mycobacterium tuberculosis
QIAPLEMTKWFDTNYHYLVP

SEQ ID NO: 1528171 - protein, 22 aa, Mycobacterium tuberculosis
QIAPLEMTKWFDTNYHYLVPEI

SEQ ID NO: 1528172 - protein, 30 aa, Mycobacterium tuberculosis
QIAPTGHMPVRRLDLIWISARNAARRELDL

SEQ ID NO: 1528173 - protein, 23 aa, Mycobacterium tuberculosis
QIATWLGQYPQLLSAALTGVIAH

SEQ ID NO: 1528174 - protein, 25 aa, Mycobacterium tuberculosis
QIDPDLLVAAVKAAGAPVICETADQ

SEQ ID NO: 1528175 - protein, 25 aa, Mycobacterium tuberculosis
QIDRGQGFLALVDYAHKPESAAVGA

SEQ ID NO: 1528176 - protein, 25 aa, Mycobacterium tuberculosis
QIDRSRIKVIMDKVNGRWLASKVEL

SEQ ID NO: 1528177 - protein, 22 aa, Mycobacterium tuberculosis
QIEEPILAGLIDRIARDEVRHE

SEQ ID NO: 1528178 - protein, 19 aa, Mycobacterium tuberculosis
QIFVQRFYSFSQFKRSALP

SEQ ID NO: 1528179 - protein, 18 aa, Mycobacterium tuberculosis
QILPVYAEYQQRSEKVLI

SEQ ID NO: 1528180 - protein, 18 aa, Mycobacterium tuberculosis
QIPPPGTGAPEVHRWWTS

SEQ ID NO: 1528181 - protein, 34 aa, Mycobacterium tuberculosis
QIQLGLIGMQLTLTELWRSYGVQPDLVIGHSMGE

SEQ ID NO: 1528182 - protein, 18 aa, Mycobacterium tuberculosis
QIRLMGMLGRPLPAQVAQ

SEQ ID NO: 1528183 - protein, 19 aa, Mycobacterium tuberculosis
QIRLMGMLGRPLPAQVAQL

SEQ ID NO: 1528184 - protein, 17 aa, Mycobacterium tuberculosis
QIRPWVPGTYLTLGTDG

SEQ ID NO: 1528185 - protein, 25 aa, Mycobacterium tuberculosis
QISGRLCWIGPPSGHTARPTHHRRH

SEQ ID NO: 1528186 - protein, 19 aa, Mycobacterium tuberculosis
QISLLLRRTIDPDRPLSDY

SEQ ID NO: 1528187 - protein, 20 aa, Mycobacterium tuberculosis
QITGLRSGFGGAGGAGGASD

SEQ ID NO: 1528188 - protein, 17 aa, Mycobacterium tuberculosis
QITRLPEYYPTRAEAEI

SEQ ID NO: 1528189 - protein, 21 aa, Mycobacterium tuberculosis
QIVPGKVTKLVPFGAFVRVEE

SEQ ID NO: 1528190 - protein, 23 aa, Mycobacterium tuberculosis
QKANLKLIVVDYLQLMTSGKKYE

SEQ ID NO: 1528191 - protein, 24 aa, Mycobacterium tuberculosis
QKLRIVKYLAYGWSSLRSRPALRD

SEQ ID NO: 1528192 - protein, 25 aa, Mycobacterium tuberculosis
QKQRLAVMVGLPDRVHPPRRRLRSR

SEQ ID NO: 1528193 - protein, 18 aa, Mycobacterium tuberculosis
QKRLQVILDRQIMRKLAG

SEQ ID NO: 1528194 - protein, 25 aa, Mycobacterium tuberculosis
QLAKAMDRKVWLPSGGTLVIDRTEA

SEQ ID NO: 1528195 - protein, 25 aa, Mycobacterium tuberculosis
QLALTELWRSYGVIPDAVIGHSMGE

SEQ ID NO: 1528196 - protein, 18 aa, Mycobacterium tuberculosis
QLAPLVFEGTSFGGALMT

SEQ ID NO: 1528197 - protein, 17 aa, Mycobacterium tuberculosis
QLARLAAALQEKKACPG

SEQ ID NO: 1528198 - protein, 18 aa, Mycobacterium tuberculosis
QLARLAAALQEKKACPGP

SEQ ID NO: 1528199 - protein, 23 aa, Mycobacterium tuberculosis
QLASWLQRLQSIPGAASLDARLP

SEQ ID NO: 1528200 - protein, 20 aa, Mycobacterium tuberculosis
QLDALQVPRLELPTVSDGVD

SEQ ID NO: 1528201 - protein, 28 aa, Mycobacterium tuberculosis
QLDKGGGRLPITLWIVDTNASTPAPAAN

SEQ ID NO: 1528202 - protein, 18 aa, Mycobacterium tuberculosis
QLDRPLHYLPWTNTSTCM

SEQ ID NO: 1528203 - protein, 21 aa, Mycobacterium tuberculosis
QLDRSVWPYIGAKAGGLPGDL

SEQ ID NO: 1528204 - protein, 17 aa, Mycobacterium tuberculosis
QLDVPPRFQAKGLGSGG

SEQ ID NO: 1528205 - protein, 19 aa, Mycobacterium tuberculosis
QLEHWGCPWSRKPDGRVAV

SEQ ID NO: 1528206 - protein, 24 aa, Mycobacterium tuberculosis
QLEQLPCHLPLDQPVGSFGLILRP

SEQ ID NO: 1528207 - protein, 18 aa, Mycobacterium tuberculosis
QLFKPLIAGQRWIAAGLF

SEQ ID NO: 1528208 - protein, 19 aa, Mycobacterium tuberculosis
QLGGLPFSGPIGGVRVALI

SEQ ID NO: 1528209 - protein, 17 aa, Mycobacterium tuberculosis
QLGRRPGRPEWIAAGQF

SEQ ID NO: 1528210 - protein, 30 aa, Mycobacterium tuberculosis
QLGTPAIPAIPPFFPGFPPDYVTVSGQIGP

SEQ ID NO: 1528211 - protein, 24 aa, Mycobacterium tuberculosis
QLHTYGASVLSRPVAKIMSTTVAT

SEQ ID NO: 1528212 - protein, 31 aa, Mycobacterium tuberculosis
QLKLHQCGLPKLMALELFKPFVMKRLVDLNH

SEQ ID NO: 1528213 - protein, 17 aa, Mycobacterium tuberculosis
QLLDSKFAVVARAASRT

SEQ ID NO: 1528214 - protein, 17 aa, Mycobacterium tuberculosis
QLLFSSGEFEFLAERQQ

SEQ ID NO: 1528215 - protein, 21 aa, Mycobacterium tuberculosis
QLLGRDGFNAPASTPLHTLQQ

SEQ ID NO: 1528216 - protein, 17 aa, Mycobacterium tuberculosis
QLLLLADEIYDKILYDD

SEQ ID NO: 1528217 - protein, 18 aa, Mycobacterium tuberculosis
QLLPLLDDYRHASTEYAL

SEQ ID NO: 1528218 - protein, 17 aa, Mycobacterium tuberculosis
QLMVRYFELDPTMAQQY

SEQ ID NO: 1528219 - protein, 17 aa, Mycobacterium tuberculosis
QLPAPFINPGGTGGSGV

SEQ ID NO: 1528220 - protein, 30 aa, Mycobacterium tuberculosis
QLPLQHASMLFLPVRILTSPITTLASMARE

SEQ ID NO: 1528221 - protein, 28 aa, Mycobacterium tuberculosis
QLPNGCQFAVALFALLRAGAIPVMCLPG

SEQ ID NO: 1528222 - protein, 26 aa, Mycobacterium tuberculosis
QLPSTALMDVLLRRPPRTRSGAALPR

SEQ ID NO: 1528223 - protein, 19 aa, Mycobacterium tuberculosis
QLPTYAFQRRRFWETPGAD

SEQ ID NO: 1528224 - protein, 25 aa, Mycobacterium tuberculosis
QLPVWTLRLYLTGKRLWHDPRRRDC

SEQ ID NO: 1528225 - protein, 18 aa, Mycobacterium tuberculosis
QLQDQLFAEAYRVLQPGG

SEQ ID NO: 1528226 - protein, 24 aa, Mycobacterium tuberculosis
QLQRLTALLQPTRPGGVSTLGALI

SEQ ID NO: 1528227 - protein, 23 aa, Mycobacterium tuberculosis
QLQSFHLRRYTPEWMVVAAAGNV

SEQ ID NO: 1528228 - protein, 22 aa, Mycobacterium tuberculosis
QLREELGDLLLQVLFHARIAED

SEQ ID NO: 1528229 - protein, 30 aa, Mycobacterium tuberculosis; identical to SEQ ID NO: 163427

SEQ ID NO: 1528230 - protein, 17 aa, Mycobacterium tuberculosis
QLRQLISDRITAWGLAG

SEQ ID NO: 1528231 - protein, 26 aa, Mycobacterium tuberculosis
QLSARLVLIIAWRTYLVRDPEALSLL

SEQ ID NO: 1528232 - protein, 18 aa, Mycobacterium tuberculosis
QLSFQDRTYLVTGGGSGI

SEQ ID NO: 1528233 - protein, 19 aa, Mycobacterium tuberculosis
QLSVLAPGGGHHPADERVE

SEQ ID NO: 1528234 - protein, 25 aa, Mycobacterium tuberculosis
QLTADAILANRLYVLPHAASRASIR

SEQ ID NO: 1528235 - protein, 21 aa, Mycobacterium tuberculosis
QLVALGELFAYRWSRCGGREE

SEQ ID NO: 1528236 - protein, 27 aa, Mycobacterium tuberculosis
QLVDVINAPFRSALGRPLIGNGANGKP

SEQ ID NO: 1528237 - protein, 20 aa, Mycobacterium tuberculosis
QLVEQFLTQFYGDQAALDDA

SEQ ID NO: 1528238 - protein, 24 aa, Mycobacterium tuberculosis
QLVLDPGALRRLDRVRVVVIDGAA

SEQ ID NO: 1528239 - protein, 48 aa, Mycobacterium tuberculosis
QLVPKMLRMLRPDLTIGFFLHIPFPPVELFMQMPWRTEIIQGLLGADL

SEQ ID NO: 1528240 - protein, 17 aa, Mycobacterium tuberculosis
QLVTRLHRDEGVDVRTG

SEQ ID NO: 1528241 - protein, 20 aa, Mycobacterium tuberculosis
QLVVPVLNARFALNAANARW

SEQ ID NO: 1528242 - protein, 31 aa, Mycobacterium tuberculosis
QMASADVIHAFWVPEFLFKRDVMPNPVANNS

SEQ ID NO: 1528243 - protein, 18 aa, Mycobacterium tuberculosis
QMGINLAGLLNSGSGNIG

SEQ ID NO: 1528244 - protein, 21 aa, Mycobacterium tuberculosis
QMHLDAGQQVWLITATPYELA

SEQ ID NO: 1528245 - protein, 29 aa, Mycobacterium tuberculosis
QMHLSLALNRLPQVAALFLAGHLGARLFS

SEQ ID NO: 1528246 - protein, 33 aa, Mycobacterium tuberculosis
QMHLSLALNRLPRWRRCFWPSILVRGFSRSSPG

SEQ ID NO: 1528247 - protein, 17 aa, Mycobacterium tuberculosis
QMLAVRKMGPIGNLLGM

SEQ ID NO: 1528248 - protein, 19 aa, Mycobacterium tuberculosis
QMLAYNCSPSFNWKKHLDD

SEQ ID NO: 1528249 - protein, 20 aa, Mycobacterium tuberculosis
QMLDTAVLLGALPPRVSPVS

SEQ ID NO: 1528250 - protein, 23 aa, Mycobacterium tuberculosis
QMLDTAVLLGALPPRVSPVSDGL

SEQ ID NO: 1528251 - protein, 19 aa, Mycobacterium tuberculosis
QMPKVSTSCRPAWPTSTCP

SEQ ID NO: 1528252 - protein, 18 aa, Mycobacterium tuberculosis
QMQIAVRNEWGWAEAHLD

SEQ ID NO: 1528253 - protein, 30 aa, Mycobacterium tuberculosis
QMRIPKPRFVLMPTPIWDQLFKPLIAGQRW

SEQ ID NO: 1528254 - protein, 18 aa, Mycobacterium tuberculosis
QMRTAAPDFRLFWDNAYA

SEQ ID NO: 1528255 - protein, 28 aa, Mycobacterium tuberculosis
QNATRPPRPGRRLPVYPAAADVDPPGPA

SEQ ID NO: 1528256 - protein, 17 aa, Mycobacterium tuberculosis
QNDGIAAPLLEAVGVEP

SEQ ID NO: 1528257 - protein, 22 aa, Mycobacterium tuberculosis
QNELTPFYPRSPYGAAKVYSYW

SEQ ID NO: 1528258 - protein, 20 aa, Mycobacterium tuberculosis
QNFDALRTLALPFGIQVETV

SEQ ID NO: 1528259 - protein, 24 aa, Mycobacterium tuberculosis
QNFNTTFPVGPFFGLGVVNISGIE

SEQ ID NO: 1528260 - protein, 18 aa, Mycobacterium tuberculosis
QNFTFLPGTHKLARTCFV

SEQ ID NO: 1528261 - protein, 24 aa, Mycobacterium tuberculosis
QNKIAAMRVLQAKLLERKRLEERA

SEQ ID NO: 1528262 - protein, 27 aa, Mycobacterium tuberculosis
QNLAHRSEVTLLWPPSDPSGYSLIVDG

SEQ ID NO: 1528263 - protein, 24 aa, Mycobacterium tuberculosis
QNLVLFGRLWGLSKSAARKRAAEL

SEQ ID NO: 1528264 - protein, 17 aa, Mycobacterium tuberculosis
QNMLPCIYLVDSGGAFL

SEQ ID NO: 1528265 - protein, 33 aa, Mycobacterium tuberculosis
QNPERGRKLLTMRLPRALFQPSSDPKPREGTET

SEQ ID NO: 1528266 - protein, 27 aa, Mycobacterium tuberculosis
QNPERGRKLPRRLAITTPTNGRQTHGR

SEQ ID NO: 1528267 - protein, 20 aa, Mycobacterium tuberculosis
QNQCRFSSRSARPHFAEVSP

SEQ ID NO: 1528268 - protein, 18 aa, Mycobacterium tuberculosis
QNSGWLHTGTNNSGYANA

SEQ ID NO: 1528269 - protein, 22 aa, Mycobacterium tuberculosis
QPAADALHAWLVDGRRALVTAE

SEQ ID NO: 1528270 - protein, 22 aa, Mycobacterium tuberculosis
QPALDPTLWNTYLQGALRAYSK

SEQ ID NO: 1528271 - protein, 33 aa, Mycobacterium tuberculosis
QPALFAVEVALFRLLGSWGVRPDFVMGHSIGEL

SEQ ID NO: 1528272 - protein, 20 aa, Mycobacterium tuberculosis
QPDYVAEGVRLLRSGGVIVV

SEQ ID NO: 1528273 - protein, 33 aa, Mycobacterium tuberculosis
QPGLRKLLAQEWLRFGWFFLATRRDPKGLWEWI

SEQ ID NO: 1528274 - protein, 25 aa, Mycobacterium tuberculosis
QPGNPAPRLFRLADDRALLNRMGFN

SEQ ID NO: 1528275 - protein, 18 aa, Mycobacterium tuberculosis
QPIAVYLGAMNDDYAVLT

SEQ ID NO: 1528276 - protein, 18 aa, Mycobacterium tuberculosis
QPIWFGRAHLREGLSWFN

SEQ ID NO: 1528277 - protein, 19 aa, Mycobacterium tuberculosis
QPIWFGRAHLREGLSWFNS

SEQ ID NO: 1528278 - protein, 20 aa, Mycobacterium tuberculosis
QPKRRPPGPPAPPAPPSSPT

SEQ ID NO: 1528279 - protein, 21 aa, Mycobacterium tuberculosis
QPLFSLVNFFDAQVGPLSAVT

SEQ ID NO: 1528280 - protein, 19 aa, Mycobacterium tuberculosis
QPLIAAFAAALRQLGAHVE

SEQ ID NO: 1528281 - protein, 21 aa, Mycobacterium tuberculosis
QPLLPGIGKTTVCYQPKGVVG

SEQ ID NO: 1528282 - protein, 18 aa, Mycobacterium tuberculosis
QPNRTLPCRPECAPGLPG

SEQ ID NO: 1528283 - protein, 18 aa, Mycobacterium tuberculosis
QPNWNPDDKTRLIKRLQA

SEQ ID NO: 1528284 - protein, 24 aa, Mycobacterium tuberculosis
QPPTPVIPLRAKPVALLAARQLRD

SEQ ID NO: 1528285 - protein, 21 aa, Mycobacterium tuberculosis
QPRQMAYRRLDLWLDDYLGTH

SEQ ID NO: 1528286 - protein, 22 aa, Mycobacterium tuberculosis
QPSARNFRPRRVMPRAGVDAEH

SEQ ID NO: 1528287 - protein, 31 aa, Mycobacterium tuberculosis
QPSSTPPPPPPLPPVPFPKECPAPGVMQGCL

SEQ ID NO: 1528288 - protein, 25 aa, Mycobacterium tuberculosis
QPVNYVAPIVVCHMSFWVDGKQSAL

SEQ ID NO: 1528289 - protein, 24 aa, Mycobacterium tuberculosis
QPVQRSVARFALIQALSAVLVGAG

SEQ ID NO: 1528290 - protein, 23 aa, Mycobacterium tuberculosis
QPWLADHVVNGVVLFPGAGFVEL

SEQ ID NO: 1528291 - protein, 22 aa, Mycobacterium tuberculosis
QQAFGSPALMRALDRLDAHLQA

SEQ ID NO: 1528292 - protein, 33 aa, Mycobacterium tuberculosis
QQALNVINAPTQTLLGRPLIGNGTNGAPGTGQA

SEQ ID NO: 1528293 - protein, 20 aa, Mycobacterium tuberculosis
QQCVAAGPTGTSRTAIACGE

SEQ ID NO: 1528294 - protein, 32 aa, Mycobacterium tuberculosis; identical to SEQ ID NO: 236787

SEQ ID NO: 1528295 - protein, 20 aa, Mycobacterium tuberculosis
QQIQQLVVARRLLGLSSSEL

SEQ ID NO: 1528296 - protein, 20 aa, Mycobacterium tuberculosis
QQLAGFKRDDWSLPLAVLVD

SEQ ID NO: 1528297 - protein, 37 aa, Mycobacterium tuberculosis
QQLAQPTKSIWPFDQLSELWKAISPHLSPLSNIVSML

SEQ ID NO: 1528298 - protein, 17 aa, Mycobacterium tuberculosis
QQLIQRFARPLRTFFEN

SEQ ID NO: 1528299 - protein, 17 aa, Mycobacterium tuberculosis
QQLSFALIDGVRRQWRN

SEQ ID NO: 1528300 - protein, 25 aa, Mycobacterium tuberculosis
QQNPALHQVVIGNELPLPPVRSAVA

SEQ ID NO: 1528301 - protein, 18 aa, Mycobacterium tuberculosis
QQRLAFFADIHMIAVLTE

SEQ ID NO: 1528302 - protein, 18 aa, Mycobacterium tuberculosis
QQRTLLMSTKMYAVSRNP

SEQ ID NO: 1528303 - protein, 32 aa, Mycobacterium tuberculosis
QQSLLNAINAPTQALLGRPLIGDGADGTAPGQ

SEQ ID NO: 1528304 - protein, 20 aa, Mycobacterium tuberculosis
QQSPRWPVPAGSKRTSLGRF

SEQ ID NO: 1528305 - protein, 17 aa, Mycobacterium tuberculosis
QQVLPTYAVICCPAFGA

SEQ ID NO: 1528306 - protein, 25 aa, Mycobacterium tuberculosis
QQVLSRFLHDFAGLGAQWTPANIAN

SEQ ID NO: 1528307 - protein, 19 aa, Mycobacterium tuberculosis
QQYAILDDRLRHLPGGIDE

SEQ ID NO: 1528308 - protein, 20 aa, Mycobacterium tuberculosis
QQYLMLDYDCPRPALKKATA

SEQ ID NO: 1528309 - protein, 17 aa, Mycobacterium tuberculosis
QRAGLELLAFGGRFVEI

SEQ ID NO: 1528310 - protein, 17 aa, Mycobacterium tuberculosis
QRALIAIGLAGRPRLLI

SEQ ID NO: 1528311 - protein, 22 aa, Mycobacterium tuberculosis
QRAMLTRVRWRALPRRCVRVVR

SEQ ID NO: 1528312 - protein, 18 aa, Mycobacterium tuberculosis
QRCGLSVAALWAGNAGGP

SEQ ID NO: 1528313 - protein, 21 aa, Mycobacterium tuberculosis
QRDFALCVQSALERLGLGPFS

SEQ ID NO: 1528314 - protein, 22 aa, Mycobacterium tuberculosis
QRDFALCVQSALERLGLGPFSH

SEQ ID NO: 1528315 - protein, 28 aa, Mycobacterium tuberculosis
QRDLLYEGPWWVAVSRAPAGPPFTAPTG

SEQ ID NO: 1528316 - protein, 20 aa, Mycobacterium tuberculosis
QRDRAVAAGCWPPTRPRQRS

SEQ ID NO: 1528317 - protein, 21 aa, Mycobacterium tuberculosis
QRDRFLFKINVGYPSPEEERE

SEQ ID NO: 1528318 - protein, 20 aa, Mycobacterium tuberculosis
QRGLTVAQRTHHLVFAGPPG

SEQ ID NO: 1528319 - protein, 24 aa, Mycobacterium tuberculosis
QRGWRVRQRPRPPVDCRALVMERR

SEQ ID NO: 1528320 - protein, 25 aa, Mycobacterium tuberculosis
QRHRLPVFEIAWALVHLAVEGSTPC

SEQ ID NO: 1528321 - protein, 18 aa, Mycobacterium tuberculosis
QRIGIARALALQPKILAL

SEQ ID NO: 1528322 - protein, 17 aa, Mycobacterium tuberculosis
QRILSDWSGQQRHFVKV

SEQ ID NO: 1528323 - protein, 23 aa, Mycobacterium tuberculosis
QRKHRQYPAHRKPAPSWRHTACP

SEQ ID NO: 1528324 - protein, 17 aa, Mycobacterium tuberculosis
QRLATAPVITEWCELPT

SEQ ID NO: 1528325 - protein, 18 aa, Mycobacterium tuberculosis
QRLCTELELPALHVPPEH

SEQ ID NO: 1528326 - protein, 19 aa, Mycobacterium tuberculosis
QRLDGFLEVLRAGVQLLVD

SEQ ID NO: 1528327 - protein, 18 aa, Mycobacterium tuberculosis
QRPKPWPPTPAPPPPMPA

SEQ ID NO: 1528328 - protein, 18 aa, Mycobacterium tuberculosis
QRPPVRLDLALVFNEGTR

SEQ ID NO: 1528329 - protein, 24 aa, Mycobacterium tuberculosis
QRPRRFDPPGRRRPRPPIPAPAMR

SEQ ID NO: 1528330 - protein, 23 aa, Mycobacterium tuberculosis
QRQERFDLVRYAVDTLTRDPAAA

SEQ ID NO: 1528331 - protein, 21 aa, Mycobacterium tuberculosis
QRQKFNPLVRLDSINGGSVED

SEQ ID NO: 1528332 - protein, 27 aa, Mycobacterium tuberculosis
QRQRRRGFVLHHPLRRGPGGGRIAVGG

SEQ ID NO: 1528333 - protein, 19 aa, Mycobacterium tuberculosis
QRRAFGGALIDKPLMRRKL

SEQ ID NO: 1528334 - protein, 24 aa, Mycobacterium tuberculosis
QRRAVRQWLVRWAVHPGRATRGFH

SEQ ID NO: 1528335 - protein, 30 aa, Mycobacterium tuberculosis
QRRCGSPAWNLPVVFGPIAVTYNLNSVSSL

SEQ ID NO: 1528336 - protein, 22 aa, Mycobacterium tuberculosis
QRRDMMWICRDGDRAKNHLLEA

SEQ ID NO: 1528337 - protein, 23 aa, Mycobacterium tuberculosis
QRRHRRAAVRSPRPVRPGRVTGV

SEQ ID NO: 1528338 - protein, 21 aa, Mycobacterium tuberculosis
QRRLEAGMKLGWHPYQFPDEP

SEQ ID NO: 1528339 - protein, 17 aa, Mycobacterium tuberculosis
QRRPRRPSLFFLSFHFA

SEQ ID NO: 1528340 - protein, 26 aa, Mycobacterium tuberculosis
QRRRLQYRLLQHRRLQHRLLQHRRRE

SEQ ID NO: 1528341 - protein, 18 aa, Mycobacterium tuberculosis
QRSLAADGIINAGALIAF

SEQ ID NO: 1528342 - protein, 23 aa, Mycobacterium tuberculosis
QRSQPFVEVLRHAKASTVGTITE

SEQ ID NO: 1528343 - protein, 26 aa, Mycobacterium tuberculosis
QRSVRSPVYLVLAARRRCVSGCARRR

SEQ ID NO: 1528344 - protein, 17 aa, Mycobacterium tuberculosis
QRTLLMSTKMYAVSRNP

SEQ ID NO: 1528345 - protein, 20 aa, Mycobacterium tuberculosis
QRTSAINRLRWLVHELDPER

SEQ ID NO: 1528346 - protein, 19 aa, Mycobacterium tuberculosis
QRVTRNAPPFLVIHGSRDC

SEQ ID NO: 1528347 - protein, 20 aa, Mycobacterium tuberculosis
QRVTRNAPPFLVIHGSRDCV

SEQ ID NO: 1528348 - protein, 17 aa, Mycobacterium tuberculosis
QRVVLRSMGMRPSGAFS

SEQ ID NO: 1528349 - protein, 17 aa, Mycobacterium tuberculosis
QRVWGANPILKLDRSVR

SEQ ID NO: 1528350 - protein, 18 aa, Mycobacterium tuberculosis
QRWQAVMMNNYGTPPIAL

SEQ ID NO: 1528351 - protein, 19 aa, Mycobacterium tuberculosis
QRYESGALRQAGFYGLDLY

SEQ ID NO: 1528352 - protein, 27 aa, Mycobacterium tuberculosis
QSASRAKWLALFPWAVSKDESTANIPA

SEQ ID NO: 1528353 - protein, 20 aa, Mycobacterium tuberculosis
QSATWMALFSGQTTVLAPEF

SEQ ID NO: 1528354 - protein, 25 aa, Mycobacterium tuberculosis
QSDIDRQLLAARLLAALAARRDAEL

SEQ ID NO: 1528355 - protein, 25 aa, Mycobacterium tuberculosis
QSDTDRQLLAARLLAALAARRDAEL

SEQ ID NO: 1528356 - protein, 18 aa, Mycobacterium tuberculosis
QSFPVTVNWSTPAVTIFP

SEQ ID NO: 1528357 - protein, 17 aa, Mycobacterium tuberculosis
QSGLACTGYPFACDHGG

SEQ ID NO: 1528358 - protein, 25 aa, Mycobacterium tuberculosis
QSGLSWLIILRKRENFRRAFSGIHP

SEQ ID NO: 1528359 - protein, 24 aa, Mycobacterium tuberculosis
QSGTGRSRRWAWTTPTPSTSAPGC

SEQ ID NO: 1528360 - protein, 17 aa, Mycobacterium tuberculosis
QSHYLHVRPADQFDAMI

SEQ ID NO: 1528361 - protein, 21 aa, Mycobacterium tuberculosis
QSLLDDWSFPATDPSVRARWE

SEQ ID NO: 1528362 - protein, 31 aa, Mycobacterium tuberculosis
QSLLNAINAPTQALLGRPLIGDGADGTAPGQ

SEQ ID NO: 1528363 - protein, 30 aa, Mycobacterium tuberculosis
QSLQGNRLLAPNEYIITLGVHDFEKLGADP

SEQ ID NO: 1528364 - protein, 22 aa, Mycobacterium tuberculosis
QSMTGHHLAMALATRARIAVAE

SEQ ID NO: 1528365 - protein, 18 aa, Mycobacterium tuberculosis
QSQLPFTGLFSPTDVAVD

SEQ ID NO: 1528366 - protein, 17 aa, Mycobacterium tuberculosis
QSRPELGYRLLQRLGAD

SEQ ID NO: 1528367 - protein, 23 aa, Mycobacterium tuberculosis
QSRPRPVRLPRPPQQRAKALPGR

SEQ ID NO: 1528368 - protein, 24 aa, Mycobacterium tuberculosis
QSVPPVTLRQALLGKVMTVGDAVS

SEQ ID NO: 1528369 - protein, 19 aa, Mycobacterium tuberculosis
QSYLIATASFAEWIDRGRP

SEQ ID NO: 1528370 - protein, 23 aa, Mycobacterium tuberculosis
QTCPELGLRPLLPRLDTAERALR

SEQ ID NO: 1528371 - protein, 23 aa, Mycobacterium tuberculosis
QTDRLPRFMRYLAAITAQELNVA

SEQ ID NO: 1528372 - protein, 25 aa, Mycobacterium tuberculosis
QTDSERVFALITASIRARDGNESAG

SEQ ID NO: 1528373 - protein, 23 aa, Mycobacterium tuberculosis
QTELLRVVRRWRGGPAPGCTAPN

SEQ ID NO: 1528374 - protein, 18 aa, Mycobacterium tuberculosis
QTFDLRRATLTRSLRFRD

SEQ ID NO: 1528375 - protein, 23 aa, Mycobacterium tuberculosis
QTLIPPPPIVAPPPPRPAPPQQP

SEQ ID NO: 1528376 - protein, 17 aa, Mycobacterium tuberculosis
QTLLYSYTTTATNTPFV

SEQ ID NO: 1528377 - protein, 17 aa, Mycobacterium tuberculosis
QTPFAPLPGDVTHVGYG

SEQ ID NO: 1528378 - protein, 19 aa, Mycobacterium tuberculosis
QTPYRKVGAGPLDTPRSAS

SEQ ID NO: 1528379 - protein, 29 aa, Mycobacterium tuberculosis
QTQAGQFALTYPRRLGFGLGSSVVSLSWR

SEQ ID NO: 1528380 - protein, 20 aa, Mycobacterium tuberculosis
QTRSRISVRLSARRGLRIRN

SEQ ID NO: 1528381 - protein, 22 aa, Mycobacterium tuberculosis
QTSVFWPGRGPCYRCLHPAPPP

SEQ ID NO: 1528382 - protein, 36 aa, Mycobacterium tuberculosis
QTTLLVTDLASGWIPPHIRLPAHITLLEPAPRRRHA

SEQ ID NO: 1528383 - protein, 29 aa, Mycobacterium tuberculosis
QTVAIPGFPNFFMMLGPHSPVGNFPADSG

SEQ ID NO: 1528384 - protein, 17 aa, Mycobacterium tuberculosis
QTVNLGPLVVPDIVIPA

SEQ ID NO: 1528385 - protein, 33 aa, Mycobacterium tuberculosis; identical to SEQ ID NO: 225494

SEQ ID NO: 1528386 - protein, 33 aa, Mycobacterium tuberculosis
QTVSAQVATFHDRFVQTLSATASSYVAAEAVNV

SEQ ID NO: 1528387 - protein, 18 aa, Mycobacterium tuberculosis
QTVVLEYAMPGPGALVPA

SEQ ID NO: 1528388 - protein, 17 aa, Mycobacterium tuberculosis
QTYAWVPFGGGVKRCLG

SEQ ID NO: 1528389 - protein, 21 aa, Mycobacterium tuberculosis
QTYLGTRRYVRRQRSWFRRDH

SEQ ID NO: 1528390 - protein, 22 aa, Mycobacterium tuberculosis
QVAAFHDRFAQTLSAASARMST

SEQ ID NO: 1528391 - protein, 18 aa, Mycobacterium tuberculosis
QVADGPQRQVRFGHLAHG

SEQ ID NO: 1528392 - protein, 26 aa, Mycobacterium tuberculosis
QVAEPYLPLRAVRHLEKGRVVIFGAG

SEQ ID NO: 1528393 - protein, 19 aa, Mycobacterium tuberculosis
QVAPMTTAVRPPAADLVSE

SEQ ID NO: 1528394 - protein, 19 aa, Mycobacterium tuberculosis
QVAPPSDWGTGGTGGTGGT

SEQ ID NO: 1528395 - protein, 17 aa, Mycobacterium tuberculosis
QVASLDHAMWFMRPFRA

SEQ ID NO: 1528396 - protein, 18 aa, Mycobacterium tuberculosis
QVAVLVALGHQLAAVPYL

SEQ ID NO: 1528397 - protein, 30 aa, Mycobacterium tuberculosis
QVAVLVALGHQLAAVPYLESVVLAAGALAR

SEQ ID NO: 1528398 - protein, 31 aa, Mycobacterium tuberculosis
QVAVLVALGHQLAAVPYLESVVLAAGALARF

SEQ ID NO: 1528399 - protein, 18 aa, Mycobacterium tuberculosis
QVCADLLALLTSRRPAGV

SEQ ID NO: 1528400 - protein, 19 aa, Mycobacterium tuberculosis
QVDERVEVGYGQRPQQLGG

SEQ ID NO: 1528401 - protein, 35 aa, Mycobacterium tuberculosis
QVEQQLLAAINAPTQALLGRPLIGNGADGAPGTGQ

SEQ ID NO: 1528402 - protein, 17 aa, Mycobacterium tuberculosis
QVFPDGPRLLLTGRDTG

SEQ ID NO: 1528403 - protein, 18 aa, Mycobacterium tuberculosis
QVIAVYRLRASRGREGPR

SEQ ID NO: 1528404 - protein, 22 aa, Mycobacterium tuberculosis
QVIEKSFPAGLPRRQGPPPHFV

SEQ ID NO: 1528405 - protein, 17 aa, Mycobacterium tuberculosis
QVIGNDAAIAWGGANGA

SEQ ID NO: 1528406 - protein, 19 aa, Mycobacterium tuberculosis
QVKIIDRVLASPLVTEAMV

SEQ ID NO: 1528407 - protein, 24 aa, Mycobacterium tuberculosis
QVLAAVRATFKPEFINRLDDVLIF

SEQ ID NO: 1528408 - protein, 19 aa, Mycobacterium tuberculosis
QVLDGDLDALFDALSAADK

SEQ ID NO: 1528409 - protein, 17 aa, Mycobacterium tuberculosis
QVLDHITFDFEPGEFVA

SEQ ID NO: 1528410 - protein, 23 aa, Mycobacterium tuberculosis
QVLDPQHRLFLQCAWHALEDAGA

SEQ ID NO: 1528411 - protein, 20 aa, Mycobacterium tuberculosis
QVLIPSPDYPLWTASTSLAG

SEQ ID NO: 1528412 - protein, 22 aa, Mycobacterium tuberculosis
QVLIPSPDYPLWTASTSLAGGT

SEQ ID NO: 1528413 - protein, 18 aa, Mycobacterium tuberculosis
QVLPIPPTALQLSTGIAV

SEQ ID NO: 1528414 - protein, 32 aa, Mycobacterium tuberculosis
QVPATVPVGILCLEFLVHAWDFAIATGSQVIA

SEQ ID NO: 1528415 - protein, 18 aa, Mycobacterium tuberculosis
QVPRRGYIPSLACGRCRA

SEQ ID NO: 1528416 - protein, 18 aa, Mycobacterium tuberculosis
QVPVSWRRRLRTDRNSTV

SEQ ID NO: 1528417 - protein, 21 aa, Mycobacterium tuberculosis
QVRIPFIGGKLERLIGTQLSQ

SEQ ID NO: 1528418 - protein, 22 aa, Mycobacterium tuberculosis
QVRSMRYTCERLVRGLDTIAAT

SEQ ID NO: 1528419 - protein, 33 aa, Mycobacterium tuberculosis
QVSKPVIGTVMRQGYQLGEQVLRHALVGVVDTV

SEQ ID NO: 1528420 - protein, 19 aa, Mycobacterium tuberculosis
QVTIQVRIPFIGGKLERLI

SEQ ID NO: 1528421 - protein, 18 aa, Mycobacterium tuberculosis
QVTLGIYNSPRQTVIAGP

SEQ ID NO: 1528422 - protein, 21 aa, Mycobacterium tuberculosis
QVTRIILTRPAVEAGERLGFL

SEQ ID NO: 1528423 - protein, 21 aa, Mycobacterium tuberculosis
QVVAPRRVPQLPPAGQRQLGV

SEQ ID NO: 1528424 - protein, 17 aa, Mycobacterium tuberculosis
QVWLVDPRRQLLTALGS

SEQ ID NO: 1528425 - protein, 31 aa, Mycobacterium tuberculosis
QWGELYLPRFLFGVFLSEQMIAAIAALGERD

SEQ ID NO: 1528426 - protein, 19 aa, Mycobacterium tuberculosis
QWLGMGIELLDTAPAFAQQ

SEQ ID NO: 1528427 - protein, 18 aa, Mycobacterium tuberculosis
QWRAVRSPALLIEAGDGV

SEQ ID NO: 1528428 - protein, 21 aa, Mycobacterium tuberculosis
QWWYESLSGAPIADWLASALA

SEQ ID NO: 1528429 - protein, 20 aa, Mycobacterium tuberculosis
QYDAVWRWIDWPERRGRTDT

SEQ ID NO: 1528430 - protein, 20 aa, Mycobacterium tuberculosis
QYEAPLGITLRELLDYAGGV

SEQ ID NO: 1528431 - protein, 17 aa, Mycobacterium tuberculosis
QYEPVAVMLSFGDPAVF

SEQ ID NO: 1528432 - protein, 37 aa, Mycobacterium tuberculosis
QYFAEQLAGFLRYPERLGAILRQPLCASAESLYGRRV

SEQ ID NO: 1528433 - protein, 19 aa, Mycobacterium tuberculosis
QYFHGITLHKNGVTANMSL

SEQ ID NO: 1528434 - protein, 24 aa, Mycobacterium tuberculosis
QYFTNLMPPSILRDMSQNFTNCAH

SEQ ID NO: 1528435 - protein, 17 aa, Mycobacterium tuberculosis
QYGIEPQQLFGYLQERN

SEQ ID NO: 1528436 - protein, 23 aa, Mycobacterium tuberculosis
QYGQRLAAFVVLKPGVSATPETL

SEQ ID NO: 1528437 - protein, 24 aa, Mycobacterium tuberculosis
QYGSTQPDYGAPAGWHAPGWPPRS

SEQ ID NO: 1528438 - protein, 18 aa, Mycobacterium tuberculosis
QYHASLMEPWDGPASMTF

SEQ ID NO: 1528439 - protein, 19 aa, Mycobacterium tuberculosis
QYPSILVELGNMKNPADSA

SEQ ID NO: 1528440 - protein, 17 aa, Mycobacterium tuberculosis
QYRDYVLMLAALDLAAT

SEQ ID NO: 1528441 - protein, 23 aa, Mycobacterium tuberculosis
QYVNLGIGMPTLIPNHILDGVHV

SEQ ID NO: 1528442 - protein, 30 aa, Mycobacterium tuberculosis
RAADAILVPPGDGPWRLGLGSAGTFENLRL

SEQ ID NO: 1528443 - protein, 21 aa, Mycobacterium tuberculosis
RAAEPSPLLRRRSLTTRTEAI

SEQ ID NO: 1528444 - protein, 21 aa, Mycobacterium tuberculosis
RAAGIGELTFFAKIHYGGGAA

SEQ ID NO: 1528445 - protein, 19 aa, Mycobacterium tuberculosis
RAAGSAVTPGSAGAPQQCV

SEQ ID NO: 1528446 - protein, 17 aa, Mycobacterium tuberculosis
RAAICRFATWWVVLERH

SEQ ID NO: 1528447 - protein, 21 aa, Mycobacterium tuberculosis
RAAKPGAYLRVIAPGTVRAAT

SEQ ID NO: 1528448 - protein, 40 aa, Mycobacterium tuberculosis
RAARRQKAGPAAAPAPAAPNGFGGRPAGPADKGGAGGAGI

SEQ ID NO: 1528449 - protein, 26 aa, Mycobacterium tuberculosis
RAARVVVPDFQLSLAIGKDGQNARLA

SEQ ID NO: 1528450 - protein, 25 aa, Mycobacterium tuberculosis
RAATFHAEFVSLLNGGAAAYTGAEA

SEQ ID NO: 1528451 - protein, 31 aa, Mycobacterium tuberculosis
RACESLYHFAWDEFCDWYLELAKTQLAQGLT

SEQ ID NO: 1528452 - protein, 19 aa, Mycobacterium tuberculosis
RACGGWTVGVIPKMLVYRE

SEQ ID NO: 1528453 - protein, 18 aa, Mycobacterium tuberculosis
RACGLFLPALANARLTWL

SEQ ID NO: 1528454 - protein, 33 aa, Mycobacterium tuberculosis
RADVRVAHPLISRAHLLLRFDQGRWVAIDNGSL

SEQ ID NO: 1528455 - protein, 20 aa, Mycobacterium tuberculosis
RAEALGWPGGRHRRRQRCCF

SEQ ID NO: 1528456 - protein, 24 aa, Mycobacterium tuberculosis
RAEKYRALMAKRAPLYRRVATMRV

SEQ ID NO: 1528457 - protein, 24 aa, Mycobacterium tuberculosis
RAELIRLLLNRALTTAGDDLASDL

SEQ ID NO: 1528458 - protein, 20 aa, Mycobacterium tuberculosis
RAELMILIATNLLGQNTPAI

SEQ ID NO: 1528459 - protein, 22 aa, Mycobacterium tuberculosis
RAFGAGPLRPWPDDVRRAIREG

SEQ ID NO: 1528460 - protein, 17 aa, Mycobacterium tuberculosis
RAFLRQALGVEVLSHVI

SEQ ID NO: 1528461 - protein, 17 aa, Mycobacterium tuberculosis
RAFLRYGKGRHRAALNF

SEQ ID NO: 1528462 - protein, 17 aa, Mycobacterium tuberculosis
RAFRVWLDARRNALVVL

SEQ ID NO: 1528463 - protein, 28 aa, Mycobacterium tuberculosis
RAFSDDLTLLPVASIPVPGPVGVLDALA

SEQ ID NO: 1528464 - protein, 17 aa, Mycobacterium tuberculosis
RAFSIVAALICARKLIP

SEQ ID NO: 1528465 - protein, 27 aa, Mycobacterium tuberculosis
RAFTVRRRWCRRGSPYPRVALGRGGDA

SEQ ID NO: 1528466 - protein, 19 aa, Mycobacterium tuberculosis
RAFVAQPVNYVAPIVVCHM

SEQ ID NO: 1528467 - protein, 19 aa, Mycobacterium tuberculosis
RAFVNRPLVLLADEPTGNL

SEQ ID NO: 1528468 - protein, 29 aa, Mycobacterium tuberculosis
RAGAINRILAYVAPILLGGPVTAVDDVGV

SEQ ID NO: 1528469 - protein, 20 aa, Mycobacterium tuberculosis
RAGDYVAIPPTRHALHAVED

SEQ ID NO: 1528470 - protein, 26 aa, Mycobacterium tuberculosis
RAGITCAVLIPQGKIAMGKLAQAVMH

SEQ ID NO: 1528471 - protein, 21 aa, Mycobacterium tuberculosis
RAGLLALLAGALEGAGAGIVW

SEQ ID NO: 1528472 - protein, 23 aa, Mycobacterium tuberculosis
RAGPAVFALAASGPETAAQGRLA

SEQ ID NO: 1528473 - protein, 17 aa, Mycobacterium tuberculosis
RAGPPEHLQWIGQWGIF

SEQ ID NO: 1528474 - protein, 19 aa, Mycobacterium tuberculosis
RAGRRRLWSRARPGGGWRG

SEQ ID NO: 1528475 - protein, 30 aa, Mycobacterium tuberculosis
RAGVARLHPVVLALGTRRIPRQPALLTQGC

SEQ ID NO: 1528476 - protein, 20 aa, Mycobacterium tuberculosis
RAGVLRFVVLDGLAKPGRMV

SEQ ID NO: 1528477 - protein, 21 aa, Mycobacterium tuberculosis
RAHGQLPNMRAIVGFAAETGD

SEQ ID NO: 1528478 - protein, 21 aa, Mycobacterium tuberculosis
RAHKILPPDGVLLLHTITGLT

SEQ ID NO: 1528479 - protein, 17 aa, Mycobacterium tuberculosis
RAHVEIPDDLRPRRHRS

SEQ ID NO: 1528480 - protein, 34 aa, Mycobacterium tuberculosis
RAIAANFRDIMITLGMFIRTRSWALRPAASLSKP

SEQ ID NO: 1528481 - protein, 17 aa, Mycobacterium tuberculosis
RAIGPGGLFLALPGARA

SEQ ID NO: 1528482 - protein, 32 aa, Mycobacterium tuberculosis
RAIGSMFPKYPHTSPWKFPSTSPSPPASPTPS

SEQ ID NO: 1528483 - protein, 23 aa, Mycobacterium tuberculosis
RAIVQIAARRPTTGHWQIVVIED

SEQ ID NO: 1528484 - protein, 20 aa, Mycobacterium tuberculosis
RAKIVADYLVARGVAGDHIA

SEQ ID NO: 1528485 - protein, 17 aa, Mycobacterium tuberculosis
RAKKVLELSLREALQLG

SEQ ID NO: 1528486 - protein, 18 aa, Mycobacterium tuberculosis
RAKWLVAADGLHSAVRRA

SEQ ID NO: 1528487 - protein, 19 aa, Mycobacterium tuberculosis
RAKYGWTDVSRFAALGIPA

SEQ ID NO: 1528488 - protein, 25 aa, Mycobacterium tuberculosis
RALAVDPEVLLLDEPFGALDAKVRE

SEQ ID NO: 1528489 - protein, 18 aa, Mycobacterium tuberculosis
RALDARLRLVLEVPTLRE

SEQ ID NO: 1528490 - protein, 25 aa, Mycobacterium tuberculosis
RALEDWCHQLAWPIRPAVSADPPST

SEQ ID NO: 1528491 - protein, 26 aa, Mycobacterium tuberculosis
RALELDLHYLPCLEGHGAPGVTVCHG

SEQ ID NO: 1528492 - protein, 30 aa, Mycobacterium tuberculosis; identical to SEQ ID NO: 121985

SEQ ID NO: 1528493 - protein, 28 aa, Mycobacterium tuberculosis
RALPQPLRTHPVVLRRFRGCAGVPATQD

SEQ ID NO: 1528494 - protein, 20 aa, Mycobacterium tuberculosis
RALQFAHVAAQRFQQRVLGG

SEQ ID NO: 1528495 - protein, 18 aa, Mycobacterium tuberculosis
RALRDGVVWRIAAETFTD

SEQ ID NO: 1528496 - protein, 31 aa, Mycobacterium tuberculosis
RALRTVPGLRALLRLGIYWAQEALAYGMTKR

SEQ ID NO: 1528497 - protein, 18 aa, Mycobacterium tuberculosis
RAMDLPMAAADALFLWAE

SEQ ID NO: 1528498 - protein, 17 aa, Mycobacterium tuberculosis
RAMFSGRVTSWNLDEAV

SEQ ID NO: 1528499 - protein, 22 aa, Mycobacterium tuberculosis
RAMGPMQFISETWRLYGVAARN

SEQ ID NO: 1528500 - protein, 20 aa, Mycobacterium tuberculosis
RAMGPMQFLPGTWARYATDG

SEQ ID NO: 1528501 - protein, 21 aa, Mycobacterium tuberculosis
RAMHMALLPDRVPAAEALSWG

SEQ ID NO: 1528502 - protein, 24 aa, Mycobacterium tuberculosis
RAMREYVLPTFRMFGMTKFYKHNP

SEQ ID NO: 1528503 - protein, 17 aa, Mycobacterium tuberculosis
RAMWCPCRRKPTVCWVG

SEQ ID NO: 1528504 - protein, 24 aa, Mycobacterium tuberculosis
RANGIRRIVMLTGDHPEIAQVVAD

SEQ ID NO: 1528505 - protein, 17 aa, Mycobacterium tuberculosis
RANRLAHWFRQAGLRED

SEQ ID NO: 1528506 - protein, 21 aa, Mycobacterium tuberculosis
RAPFAFEGVFGHLAATAVPGC

SEQ ID NO: 1528507 - protein, 20 aa, Mycobacterium tuberculosis
RAPVAPGLALPRLVRSRIVK

SEQ ID NO: 1528508 - protein, 18 aa, Mycobacterium tuberculosis
RAQHLVPELERRLEDINS

SEQ ID NO: 1528509 - protein, 27 aa, Mycobacterium tuberculosis
RARCTRWICCWAAGLGRTGRWLACPAN

SEQ ID NO: 1528510 - protein, 36 aa, Mycobacterium tuberculosis
RARDAGAIAYLVKPFSISDLIPAIELAVSRFREITA

SEQ ID NO: 1528511 - protein, 22 aa, Mycobacterium tuberculosis
RARFGDVLPFLVKVLAADEPLS

SEQ ID NO: 1528512 - protein, 20 aa, Mycobacterium tuberculosis
RARGRLQDGLAWFAAALANH

SEQ ID NO: 1528513 - protein, 21 aa, Mycobacterium tuberculosis
RARGRLQEGLAWFAAALADHD

SEQ ID NO: 1528514 - protein, 23 aa, Mycobacterium tuberculosis
RARKALFEEGISTSRMGLDPDRG

SEQ ID NO: 1528515 - protein, 25 aa, Mycobacterium tuberculosis
RARQKGCTLLVTDGDWQGVSTRLAA

SEQ ID NO: 1528516 - protein, 20 aa, Mycobacterium tuberculosis
RARRFGYRMVANRSRILGFY

SEQ ID NO: 1528517 - protein, 21 aa, Mycobacterium tuberculosis
RARRFGYRMVANRSRILGFYR

SEQ ID NO: 1528518 - protein, 17 aa, Mycobacterium tuberculosis
RARRPLVVVLTDGRATA

SEQ ID NO: 1528519 - protein, 24 aa, Mycobacterium tuberculosis
RARRSPICWCPKLTASVTDGAVGV

SEQ ID NO: 1528520 - protein, 20 aa, Mycobacterium tuberculosis
RARSTGQRPSWAPLPVQYAD

SEQ ID NO: 1528521 - protein, 26 aa, Mycobacterium tuberculosis
RASCKYMKMITPAALLRCLVEGADEV

SEQ ID NO: 1528522 - protein, 26 aa, Mycobacterium tuberculosis
RASIDPFGWYRSWEEMLTGMAPLAGL

SEQ ID NO: 1528523 - protein, 21 aa, Mycobacterium tuberculosis
RASLDAVTKYPWMRGDGLGSQ

SEQ ID NO: 1528524 - protein, 22 aa, Mycobacterium tuberculosis
RASLDAVTKYPWMRGDGLGSQR

SEQ ID NO: 1528525 - protein, 25 aa, Mycobacterium tuberculosis
RASQQAFLFGPPPLGPDAPPLDRLI

SEQ ID NO: 1528526 - protein, 23 aa, Mycobacterium tuberculosis
RASSTWRLAVLRHHRFPGHDAVH

SEQ ID NO: 1528527 - protein, 19 aa, Mycobacterium tuberculosis
RASTGSIFAIPVVVAPDVG

SEQ ID NO: 1528528 - protein, 28 aa, Mycobacterium tuberculosis
RASVLAYPRVVWIAGGLLKGASLHAEVA

SEQ ID NO: 1528529 - protein, 18 aa, Mycobacterium tuberculosis
RATALRRAGRSAGPRQLG

SEQ ID NO: 1528530 - protein, 22 aa, Mycobacterium tuberculosis
RATGWLGGVFPGDDAALTALAA

SEQ ID NO: 1528531 - protein, 17 aa, Mycobacterium tuberculosis
RATLRRLYAHPQAGALV

SEQ ID NO: 1528532 - protein, 19 aa, Mycobacterium tuberculosis
RATLRRLYRHPRSGALVAM

SEQ ID NO: 1528533 - protein, 21 aa, Mycobacterium tuberculosis
RAVAGRLWPRRRKLSALRRGD

SEQ ID NO: 1528534 - protein, 18 aa, Mycobacterium tuberculosis
RAVAIVRQIAAALDAAHA

SEQ ID NO: 1528535 - protein, 28 aa, Mycobacterium tuberculosis
RAVGADVPLLGQIPLDPALVAAGDSGVP

SEQ ID NO: 1528536 - protein, 29 aa, Mycobacterium tuberculosis
RAVGDKWRLAEVLAWQAYVGFAGEGDPGA

SEQ ID NO: 1528537 - protein, 27 aa, Mycobacterium tuberculosis
RAVLGFSMPVISIPVWPTLGRTTRAAS

SEQ ID NO: 1528538 - protein, 20 aa, Mycobacterium tuberculosis
RAVMSIPGRPISPAHRSLAL

SEQ ID NO: 1528539 - protein, 18 aa, Mycobacterium tuberculosis
RAVPQYGFRPNFVARPPA

SEQ ID NO: 1528540 - protein, 19 aa, Mycobacterium tuberculosis
RAVRLPRALAAAGVPVAPP

SEQ ID NO: 1528541 - protein, 21 aa, Mycobacterium tuberculosis
RAVRLVPPTRHRRTEVVETRS

SEQ ID NO: 1528542 - protein, 23 aa, Mycobacterium tuberculosis
RAVVDPVPFPRATDRLLLQNLSG

SEQ ID NO: 1528543 - protein, 17 aa, Mycobacterium tuberculosis
RAYEAAAAHWYTYRNRL

SEQ ID NO: 1528544 - protein, 17 aa, Mycobacterium tuberculosis
RAYERLATQARIQCLRR

SEQ ID NO: 1528545 - protein, 33 aa, Mycobacterium tuberculosis
RAYHPTLLRKGERLLVFLPLAHVLARAISMAAF

SEQ ID NO: 1528546 - protein, 17 aa, Mycobacterium tuberculosis
RAYLGDLRSLFAFLADR

SEQ ID NO: 1528547 - protein, 17 aa, Mycobacterium tuberculosis
RCDHAHRWSATTCPPRC

SEQ ID NO: 1528548 - protein, 17 aa, Mycobacterium tuberculosis
RCESLRDNLWQLVDSKV

SEQ ID NO: 1528549 - protein, 19 aa, Mycobacterium tuberculosis
RCGRQLGLRQQRLGPLGLV

SEQ ID NO: 1528550 - protein, 26 aa, Mycobacterium tuberculosis
RCGTTVQWGVVAALPGAFHAKPVHRG

SEQ ID NO: 1528551 - protein, 26 aa, Mycobacterium tuberculosis
RCIVPKHIPVTWWPKTDSVSPQLGWL

SEQ ID NO: 1528552 - protein, 17 aa, Mycobacterium tuberculosis
RCNRIGLLRVVRGPIRA

SEQ ID NO: 1528553 - protein, 17 aa, Mycobacterium tuberculosis
RCPLTSYVLIGFSQGAV

SEQ ID NO: 1528554 - protein, 23 aa, Mycobacterium tuberculosis
RCQMSFVVTIPEALAAVATDLAG

SEQ ID NO: 1528555 - protein, 22 aa, Mycobacterium tuberculosis
RCRGFRIAQLPSTALMDVLLRR

SEQ ID NO: 1528556 - protein, 18 aa, Mycobacterium tuberculosis
RCRRQRRVAIRQRWARRQ

SEQ ID NO: 1528557 - protein, 29 aa, Mycobacterium tuberculosis
RCRSRARLLGLRLRRLRYLRTAAARRPQV

SEQ ID NO: 1528558 - protein, 21 aa, Mycobacterium tuberculosis
RCSYCMPERGLRWLPGEQLLR

SEQ ID NO: 1528559 - protein, 28 aa, Mycobacterium tuberculosis
RCVLERFRAIKPWLVGGRVRAPFWEVHA

SEQ ID NO: 1528560 - protein, 21 aa, Mycobacterium tuberculosis
RCWPRQRPGTGWPPNYSPTAA

SEQ ID NO: 1528561 - protein, 21 aa, Mycobacterium tuberculosis
RDAGVLPVLKHFPGHGRGSGD

SEQ ID NO: 1528562 - protein, 22 aa, Mycobacterium tuberculosis
RDAKVIAPDKPWFSYVCPGAGH

SEQ ID NO: 1528563 - protein, 26 aa, Mycobacterium tuberculosis
RDALDRALIDLATYFRDALLVAAHAG

SEQ ID NO: 1528564 - protein, 27 aa, Mycobacterium tuberculosis
RDALDRALIDLATYFRDALLVAAHAGG

SEQ ID NO: 1528565 - protein, 18 aa, Mycobacterium tuberculosis
RDASPIQRVTRNAPPFLV

SEQ ID NO: 1528566 - protein, 27 aa, Mycobacterium tuberculosis
RDDLRHEKLLFKKGIHLLDCGTSGGVW

SEQ ID NO: 1528567 - protein, 18 aa, Mycobacterium tuberculosis
RDELGDWRVILHSPYGAA

SEQ ID NO: 1528568 - protein, 17 aa, Mycobacterium tuberculosis
RDELLTLLLVDAYSDLA

SEQ ID NO: 1528569 - protein, 31 aa, Mycobacterium tuberculosis
RDELRSLLRFVLDLLADYGLTDFYLELSTKD

SEQ ID NO: 1528570 - protein, 22 aa, Mycobacterium tuberculosis
RDFAIGLAGIPPSLQSALQALA

SEQ ID NO: 1528571 - protein, 24 aa, Mycobacterium tuberculosis
RDFRSWACVDLELHPGRTVFVGPN

SEQ ID NO: 1528572 - protein, 21 aa, Mycobacterium tuberculosis
RDGCRVPIPWSGNIPPFGFST

SEQ ID NO: 1528573 - protein, 18 aa, Mycobacterium tuberculosis
RDGQPEKAFLAVRTPDGS

SEQ ID NO: 1528574 - protein, 19 aa, Mycobacterium tuberculosis
RDGQWWYESLSGVPIADWL

SEQ ID NO: 1528575 - protein, 34 aa, Mycobacterium tuberculosis
RDGRGNLIRRKAGLPPATYFSGGKLQWILENVDG

SEQ ID NO: 1528576 - protein, 22 aa, Mycobacterium tuberculosis
RDGTCKRLVVSSMRSDTTFCSA

SEQ ID NO: 1528577 - protein, 18 aa, Mycobacterium tuberculosis
RDGVYAHGDYPRSFLDAA

SEQ ID NO: 1528578 - protein, 18 aa, Mycobacterium tuberculosis
RDGWPAVVVPADNLPEAS

SEQ ID NO: 1528579 - protein, 18 aa, Mycobacterium tuberculosis
RDHARYGAALWLVAANMA

SEQ ID NO: 1528580 - protein, 21 aa, Mycobacterium tuberculosis
RDHRSFRLDDEDLDAVLASDL

SEQ ID NO: 1528581 - protein, 18 aa, Mycobacterium tuberculosis
RDIEWRIGPGERIGIVGA

SEQ ID NO: 1528582 - protein, 20 aa, Mycobacterium tuberculosis
RDIEWRIGPGERIGIVGANR

SEQ ID NO: 1528583 - protein, 20 aa, Mycobacterium tuberculosis
RDIVALLLGDSFHPGGATLT

SEQ ID NO: 1528584 - protein, 24 aa, Mycobacterium tuberculosis
RDLFAAIVVLMQWGDEYLPRPEGP

SEQ ID NO: 1528585 - protein, 30 aa, Mycobacterium tuberculosis
RDLLVARRRPPAGDGWRKAVTKMTFGRVNP

SEQ ID NO: 1528586 - protein, 19 aa, Mycobacterium tuberculosis
RDLNLTIADGEFLILVGPS

SEQ ID NO: 1528587 - protein, 19 aa, Mycobacterium tuberculosis
RDLWWHHVVGAASPAHTPE

SEQ ID NO: 1528588 - protein, 20 aa, Mycobacterium tuberculosis
RDNLERVWAHPRPPVRCACT

SEQ ID NO: 1528589 - protein, 36 aa, Mycobacterium tuberculosis
RDPDFHALSWRDPALRLNVLPRRVIALWSDKGKHVA

SEQ ID NO: 1528590 - protein, 24 aa, Mycobacterium tuberculosis
RDPPAWVQVLSRRTKNNPVLIGEP

SEQ ID NO: 1528591 - protein, 23 aa, Mycobacterium tuberculosis
RDPRVWWQLRNPFTPSWGEPYVD

SEQ ID NO: 1528592 - protein, 17 aa, Mycobacterium tuberculosis
RDQARARRRRRVTRRGY

SEQ ID NO: 1528593 - protein, 18 aa, Mycobacterium tuberculosis
RDQARARRRRRVTRRGYG

SEQ ID NO: 1528594 - protein, 26 aa, Mycobacterium tuberculosis
RDQLQRLWTPYRMNYLAEAPVKRDPN

SEQ ID NO: 1528595 - protein, 22 aa, Mycobacterium tuberculosis
RDRAKMFALLWQSLRRQRQLLK

SEQ ID NO: 1528596 - protein, 20 aa, Mycobacterium tuberculosis
RDRASELRSRRVRELGAEVL

SEQ ID NO: 1528597 - protein, 39 aa, Mycobacterium tuberculosis
RDRFVSAAPEITPFALTLRLLVIALKHNVILNSTWVDSG

SEQ ID NO: 1528598 - protein, 24 aa, Mycobacterium tuberculosis
RDRGAHRRGRWPERRWRHAAAGTG

SEQ ID NO: 1528599 - protein, 20 aa, Mycobacterium tuberculosis
RDRLVSERLLTLGWQQRALP

SEQ ID NO: 1528600 - protein, 21 aa, Mycobacterium tuberculosis
RDRLVSERLLTLGWQQRALPE

SEQ ID NO: 1528601 - protein, 21 aa, Mycobacterium tuberculosis
RDRMRERWRIVLVDEFQDTDP

SEQ ID NO: 1528602 - protein, 20 aa, Mycobacterium tuberculosis
RDRVPLRWRRWSTSSTCSRP

SEQ ID NO: 1528603 - protein, 20 aa, Mycobacterium tuberculosis
RDSEWMGRVHRFLGLQVGVI

SEQ ID NO: 1528604 - protein, 25 aa, Mycobacterium tuberculosis
RDSPELIRLAPRPAARTDPMLLAWT

SEQ ID NO: 1528605 - protein, 20 aa, Mycobacterium tuberculosis
RDSPHLLADRISATVYIGGA

SEQ ID NO: 1528606 - protein, 25 aa, Mycobacterium tuberculosis
RDSVLDAMRDLLLTRDWSAITLSDV

SEQ ID NO: 1528607 - protein, 17 aa, Mycobacterium tuberculosis
RDTAFFWDGVKAHELRI

SEQ ID NO: 1528608 - protein, 18 aa, Mycobacterium tuberculosis
RDTELLGYYLPKGTNVIA

SEQ ID NO: 1528609 - protein, 31 aa, Mycobacterium tuberculosis
RDTTRLRYVEPYRAELHRLGRPVFGPSFEVE

SEQ ID NO: 1528610 - protein, 17 aa, Mycobacterium tuberculosis
RDTVRDYWRGEPATLGE

SEQ ID NO: 1528611 - protein, 21 aa, Mycobacterium tuberculosis
RDVLGLLHDAYCRHIGVEYAH

SEQ ID NO: 1528612 - protein, 18 aa, Mycobacterium tuberculosis
RDVLVALGIYPGAAELGA

SEQ ID NO: 1528613 - protein, 20 aa, Mycobacterium tuberculosis
RDVLVLARELGCTPSAEANL

SEQ ID NO: 1528614 - protein, 25 aa, Mycobacterium tuberculosis
RDVRYLGSQPWPFPRSLMVGFHALG

SEQ ID NO: 1528615 - protein, 31 aa, Mycobacterium tuberculosis
RDVTTLPAVISRWLSSVLPGGAAPEVTVESG

SEQ ID NO: 1528616 - protein, 19 aa, Mycobacterium tuberculosis
RDVVGVLRAVLFAPEDLGL

SEQ ID NO: 1528617 - protein, 17 aa, Mycobacterium tuberculosis
RDWAAKGTLLLGVRAVI

SEQ ID NO: 1528618 - protein, 18 aa, Mycobacterium tuberculosis
RDWARDWGSLRKFDTLVD

SEQ ID NO: 1528619 - protein, 21 aa, Mycobacterium tuberculosis
RDYETSWLDQPIPALDGHTPR

SEQ ID NO: 1528620 - protein, 18 aa, Mycobacterium tuberculosis
RDYRVLSAALLEVTFCGF

SEQ ID NO: 1528621 - protein, 17 aa, Mycobacterium tuberculosis
RDYVLMLAALDLAATVE

SEQ ID NO: 1528622 - protein, 19 aa, Mycobacterium tuberculosis
RDYWAQWRAVRSPALLIEA

SEQ ID NO: 1528623 - protein, 23 aa, Mycobacterium tuberculosis
RDYWAQWRAVRSPALLIEAGDGV

SEQ ID NO: 1528624 - protein, 22 aa, Mycobacterium tuberculosis
REAFLPHQRSALRTALIPAIDS

SEQ ID NO: 1528625 - protein, 22 aa, Mycobacterium tuberculosis
REAGLAGGWLRANLPAVDAVLC

SEQ ID NO: 1528626 - protein, 26 aa, Mycobacterium tuberculosis
REAIAIDPQHRLLLETSWEAMEHGGL

SEQ ID NO: 1528627 - protein, 25 aa, Mycobacterium tuberculosis
REARLFRAELTIPLILLGGITNRTT

SEQ ID NO: 1528628 - protein, 23 aa, Mycobacterium tuberculosis
REAYQRIFDRLQVRYVIVSAVSG

SEQ ID NO: 1528629 - protein, 17 aa, Mycobacterium tuberculosis
REDFRMGGPGVADHAGG

SEQ ID NO: 1528630 - protein, 19 aa, Mycobacterium tuberculosis
REEPSHLGLPPAGRQTQNP

SEQ ID NO: 1528631 - protein, 18 aa, Mycobacterium tuberculosis
REEPYCDAYYWVDNLRHT

SEQ ID NO: 1528632 - protein, 27 aa, Mycobacterium tuberculosis
REEWPDRLRRLLSKQVGLILRRTIDTD

SEQ ID NO: 1528633 - protein, 26 aa, Mycobacterium tuberculosis
REFPVNFDVWWFKLPREGDAEFSFLP

SEQ ID NO: 1528634 - protein, 25 aa, Mycobacterium tuberculosis
REGAMAEALLLRLTRDDWQRHRTVE

SEQ ID NO: 1528635 - protein, 17 aa, Mycobacterium tuberculosis
REGLTVLEYFINTHGAR

SEQ ID NO: 1528636 - protein, 20 aa, Mycobacterium tuberculosis
REGYFQIAYLGPKGTDAQLR

SEQ ID NO: 1528637 - protein, 19 aa, Mycobacterium tuberculosis
REHLGVRPPVEADWLLLVE

SEQ ID NO: 1528638 - protein, 20 aa, Mycobacterium tuberculosis
REIRLALLEADVSLPVVRAF

SEQ ID NO: 1528639 - protein, 26 aa, Mycobacterium tuberculosis
REKQKLELLRSLLTYFHYASKETRPD

SEQ ID NO: 1528640 - protein, 21 aa, Mycobacterium tuberculosis
RELAVFWDRPAASAARGAWTS

SEQ ID NO: 1528641 - protein, 17 aa, Mycobacterium tuberculosis
RELDPELSQPWEPVPAC

SEQ ID NO: 1528642 - protein, 21 aa, Mycobacterium tuberculosis
RELELCYAAIALVTDVDAGVA

SEQ ID NO: 1528643 - protein, 25 aa, Mycobacterium tuberculosis
RELGADPLPFLRRFDIPPGIEHQED

SEQ ID NO: 1528644 - protein, 18 aa, Mycobacterium tuberculosis
RELRPLPTALPHPRTRRR

SEQ ID NO: 1528645 - protein, 28 aa, Mycobacterium tuberculosis
RELVVAWGKLYPQFGAVAALNLVKCVHW

SEQ ID NO: 1528646 - protein, 17 aa, Mycobacterium tuberculosis
RELWFSHMAVAAAGTVS

SEQ ID NO: 1528647 - protein, 30 aa, Mycobacterium tuberculosis
REMARTVFIELLAWQFASPVRWIETQDLLF

SEQ ID NO: 1528648 - protein, 35 aa, Mycobacterium tuberculosis
RENHLTLPHPLAHLRAFVLIPWIAVDPTAQLTGLP

SEQ ID NO: 1528649 - protein, 24 aa, Mycobacterium tuberculosis
RENLQPLIFGLSQMISDYNAARPV

SEQ ID NO: 1528650 - protein, 19 aa, Mycobacterium tuberculosis
REQMSVTISGLRRDYRWAE

SEQ ID NO: 1528651 - protein, 17 aa, Mycobacterium tuberculosis
REQSRPELGYRLLQRLG

SEQ ID NO: 1528652 - protein, 18 aa, Mycobacterium tuberculosis
REQSVEIPLGPAAPQRLA

SEQ ID NO: 1528653 - protein, 20 aa, Mycobacterium tuberculosis
RERGWPQFADRLLELAREAE

SEQ ID NO: 1528654 - protein, 17 aa, Mycobacterium tuberculosis
RERIPNLHFSVSATTRA

SEQ ID NO: 1528655 - protein, 17 aa, Mycobacterium tuberculosis
RETELLAVTLRLLQEHG

SEQ ID NO: 1528656 - protein, 18 aa, Mycobacterium tuberculosis
REVFSDFPDLEVCVYAAP

SEQ ID NO: 1528657 - protein, 17 aa, Mycobacterium tuberculosis
REVYLLQRTKGPQGKRL

SEQ ID NO: 1528658 - protein, 23 aa, Mycobacterium tuberculosis
REWLTVLLRRDLGLLVTIGVPGG

SEQ ID NO: 1528659 - protein, 18 aa, Mycobacterium tuberculosis
REWRYRPRVAVGIMSAAV

SEQ ID NO: 1528660 - protein, 22 aa, Mycobacterium tuberculosis
REYGVRVLVIPAPARCVPRMSA

SEQ ID NO: 1528661 - protein, 19 aa, Mycobacterium tuberculosis
REYPVARAYLDSRVQTIYG

SEQ ID NO: 1528662 - protein, 17 aa, Mycobacterium tuberculosis
RFAAAGLVILAGVAALR

SEQ ID NO: 1528663 - protein, 23 aa, Mycobacterium tuberculosis
RFAPRSLLLPAIRIGNRLRGGPS

SEQ ID NO: 1528664 - protein, 21 aa, Mycobacterium tuberculosis
RFATDLLERFRDLIVLQSVPD

SEQ ID NO: 1528665 - protein, 29 aa, Mycobacterium tuberculosis
RFATMSPAERWHLLASAWLDLPGRPALIG

SEQ ID NO: 1528666 - protein, 18 aa, Mycobacterium tuberculosis
RFCRFGSEYVHAALAAQG

SEQ ID NO: 1528667 - protein, 17 aa, Mycobacterium tuberculosis
RFDAMRYGLRVGDDGTR

SEQ ID NO: 1528668 - protein, 17 aa, Mycobacterium tuberculosis
RFDLMRYAVDTLTRDPA

SEQ ID NO: 1528669 - protein, 17 aa, Mycobacterium tuberculosis
RFDPQRYIGSKPSPFAW

SEQ ID NO: 1528670 - protein, 19 aa, Mycobacterium tuberculosis
RFEKTLMAIWRAIQSAGET

SEQ ID NO: 1528671 - protein, 19 aa, Mycobacterium tuberculosis
RFEQPIFADRPRLIQVVAD

SEQ ID NO: 1528672 - protein, 24 aa, Mycobacterium tuberculosis
RFEVAAHEFLLFPTVAHSHAERVR

SEQ ID NO: 1528673 - protein, 19 aa, Mycobacterium tuberculosis
RFFVPTQNSPWPTAEGPRR

SEQ ID NO: 1528674 - protein, 17 aa, Mycobacterium tuberculosis
RFGIPESVLGFLRGELG

SEQ ID NO: 1528675 - protein, 18 aa, Mycobacterium tuberculosis
RFHIFSHSWGGMLAQQYV

SEQ ID NO: 1528676 - protein, 27 aa, Mycobacterium tuberculosis
RFITAVRLLAERLGVRQTIGLGTVPMA

SEQ ID NO: 1528677 - protein, 20 aa, Mycobacterium tuberculosis
RFKVVWQVLNALRSHDERFD

SEQ ID NO: 1528678 - protein, 26 aa, Mycobacterium tuberculosis
RFLEHSRILHFRAIDEFWIGSADMMH

SEQ ID NO: 1528679 - protein, 17 aa, Mycobacterium tuberculosis
RFLGALLAGPDGVMRPT

SEQ ID NO: 1528680 - protein, 18 aa, Mycobacterium tuberculosis
RFLGHGRLLVSTHLGQLL

SEQ ID NO: 1528681 - protein, 17 aa, Mycobacterium tuberculosis
RFMTRWQGEPDPRHIEA

SEQ ID NO: 1528682 - protein, 20 aa, Mycobacterium tuberculosis
RFNWDPLRWFEEDEPIYGHP

SEQ ID NO: 1528683 - protein, 38 aa, Mycobacterium tuberculosis
RFPIQNPNCPTRRWICSPIWLTPASWKLRREASHDKSG

SEQ ID NO: 1528684 - protein, 27 aa, Mycobacterium tuberculosis
RFPTPTLLLPRFPKPMLLLPRLAEPIL

SEQ ID NO: 1528685 - protein, 22 aa, Mycobacterium tuberculosis
RFQQRVLGGPPAGVLPPRQQAI

SEQ ID NO: 1528686 - protein, 17 aa, Mycobacterium tuberculosis
RFSAGRRGALHRGSGMD

SEQ ID NO: 1528687 - protein, 24 aa, Mycobacterium tuberculosis
RFSEQLLPEHLHKVSLSFLVDDLV

SEQ ID NO: 1528688 - protein, 19 aa, Mycobacterium tuberculosis
RFTASRLFGAPPGYVGYEE

SEQ ID NO: 1528689 - protein, 20 aa, Mycobacterium tuberculosis
RFTSPHPAGIHRRRHRGDGA

SEQ ID NO: 1528690 - protein, 17 aa, Mycobacterium tuberculosis
RFVREFPFNLMLWDLDR

SEQ ID NO: 1528691 - protein, 26 aa, Mycobacterium tuberculosis
RFVSAPPPPPPPPPPPPQLRCRSPQG

SEQ ID NO: 1528692 - protein, 29 aa, Mycobacterium tuberculosis
RFVSAPPPPPPPSPPPPPTPMPIAAGEPP

SEQ ID NO: 1528693 - protein, 25 aa, Mycobacterium tuberculosis
RFVSRHCSLWLSLAQMWAGNLTEAL

SEQ ID NO: 1528694 - protein, 20 aa, Mycobacterium tuberculosis
RGAEYSVDFVPKVRIEVVVD

SEQ ID NO: 1528695 - protein, 22 aa, Mycobacterium tuberculosis
RGAGAHLFRVAHQHRRAVGQLI

SEQ ID NO: 1528696 - protein, 18 aa, Mycobacterium tuberculosis
RGAGGAGGFGGFGGDGGD

SEQ ID NO: 1528697 - protein, 19 aa, Mycobacterium tuberculosis
RGAGGLTSGGVGSSGESGG

SEQ ID NO: 1528698 - protein, 17 aa, Mycobacterium tuberculosis
RGALGSLEDLSVWVASC

SEQ ID NO: 1528699 - protein, 17 aa, Mycobacterium tuberculosis
RGALTQRRLYIGNPSEI

SEQ ID NO: 1528700 - protein, 20 aa, Mycobacterium tuberculosis
RGAQAILPTPAPLGGALVEE

SEQ ID NO: 1528701 - protein, 23 aa, Mycobacterium tuberculosis
RGAQRFFAAIPTWDEAHGPVEQR

SEQ ID NO: 1528702 - protein, 19 aa, Mycobacterium tuberculosis
RGCEGDALLMLLDANGIEC

SEQ ID NO: 1528703 - protein, 24 aa, Mycobacterium tuberculosis
RGDGGLHRFLLSAASAVCGGGGCE

SEQ ID NO: 1528704 - protein, 27 aa, Mycobacterium tuberculosis
RGDGNSITLFLSVARLRVSSDPKPREG

SEQ ID NO: 1528705 - protein, 17 aa, Mycobacterium tuberculosis
RGDLLRVLPGDGSDTHA

SEQ ID NO: 1528706 - protein, 18 aa, Mycobacterium tuberculosis
RGDMAFKDGDGGAGGDGG

SEQ ID NO: 1528707 - protein, 17 aa, Mycobacterium tuberculosis
RGDMAFKDGDGGDRRRW

SEQ ID NO: 1528708 - protein, 24 aa, Mycobacterium tuberculosis
RGDPLLLGHLPGDRRDRAGAAWPA

SEQ ID NO: 1528709 - protein, 26 aa, Mycobacterium tuberculosis
RGDQVGQLRALPWSHPHHRGHRHRAG

SEQ ID NO: 1528710 - protein, 21 aa, Mycobacterium tuberculosis
RGDRTMFLFVFRAEHDNPGVA

SEQ ID NO: 1528711 - protein, 28 aa, Mycobacterium tuberculosis
RGDYLNVFTTFDLTLRRIGETFFTTAYF

SEQ ID NO: 1528712 - protein, 20 aa, Mycobacterium tuberculosis
RGECEFIIRLLPDGVMSNYL

SEQ ID NO: 1528713 - protein, 23 aa, Mycobacterium tuberculosis
RGESFGAHRRLALSTVGASGATA

SEQ ID NO: 1528714 - protein, 25 aa, Mycobacterium tuberculosis
RGESFGARRRLALSTVGASGATAGL

SEQ ID NO: 1528715 - protein, 23 aa, Mycobacterium tuberculosis
RGEVDVLPFQLVTMGQPIADFAN

SEQ ID NO: 1528716 - protein, 24 aa, Mycobacterium tuberculosis
RGEVLGELGLLIDAPRSATVRALR

SEQ ID NO: 1528717 - protein, 20 aa, Mycobacterium tuberculosis
RGFFTSRVIGTFVNEALAML

SEQ ID NO: 1528718 - protein, 23 aa, Mycobacterium tuberculosis
RGFHRLKQWRGIATRYDKYALTY

SEQ ID NO: 1528719 - protein, 17 aa, Mycobacterium tuberculosis
RGGAGGAAGLIGNGGNG

SEQ ID NO: 1528720 - protein, 23 aa, Mycobacterium tuberculosis
RGGAGGLGFGSEAPGRPGGAGGT

SEQ ID NO: 1528721 - protein, 22 aa, Mycobacterium tuberculosis
RGGDAGLLFGAAGTGGHGAAGG

SEQ ID NO: 1528722 - protein, 22 aa, Mycobacterium tuberculosis
RGGKYGSHWLVDNRPDLFDGIT

SEQ ID NO: 1528723 - protein, 21 aa, Mycobacterium tuberculosis
RGGLLAGQHANSGNGGGGGTG

SEQ ID NO: 1528724 - protein, 25 aa, Mycobacterium tuberculosis
RGGRWAPPAAWAGAVALAACSAMVD

SEQ ID NO: 1528725 - protein, 18 aa, Mycobacterium tuberculosis
RGHFRFRCVDRLLDSSSD

SEQ ID NO: 1528726 - protein, 24 aa, Mycobacterium tuberculosis
RGHPPSPVHRQPLAVRLHVAGAKP

SEQ ID NO: 1528727 - protein, 19 aa, Mycobacterium tuberculosis
RGHTLIVTMNRPAARNALS

SEQ ID NO: 1528728 - protein, 17 aa, Mycobacterium tuberculosis
RGIAAPASDPANRAIVV

SEQ ID NO: 1528729 - protein, 18 aa, Mycobacterium tuberculosis
RGIDWRAIYAGRGREYMP

SEQ ID NO: 1528730 - protein, 20 aa, Mycobacterium tuberculosis
RGIDWRAIYAGRGREYMPFL

SEQ ID NO: 1528731 - protein, 17 aa, Mycobacterium tuberculosis
RGITINIAHVEYQTDKR

SEQ ID NO: 1528732 - protein, 17 aa, Mycobacterium tuberculosis
RGKHLFIRTGTASIHSH

SEQ ID NO: 1528733 - protein, 17 aa, Mycobacterium tuberculosis
RGKPIPDLPFDEQAALV

SEQ ID NO: 1528734 - protein, 18 aa, Mycobacterium tuberculosis
RGLAALSVALGIVGAGFG

SEQ ID NO: 1528735 - protein, 30 aa, Mycobacterium tuberculosis
RGLATRQLVLDPGALRRLDRVRVVVIDGAA

SEQ ID NO: 1528736 - protein, 25 aa, Mycobacterium tuberculosis
RGLDALGFAGTIPKSAPGSATGLTH

SEQ ID NO: 1528737 - protein, 23 aa, Mycobacterium tuberculosis
RGLETRLVPQRGYHLELITAVPM

SEQ ID NO: 1528738 - protein, 21 aa, Mycobacterium tuberculosis
RGLINDPFAEPLVRAVGLISS

SEQ ID NO: 1528739 - protein, 19 aa, Mycobacterium tuberculosis
RGLLDVKRWVTLTGVGGVG

SEQ ID NO: 1528740 - protein, 20 aa, Mycobacterium tuberculosis
RGLLKFRTGVRPPVPLDEVE

SEQ ID NO: 1528741 - protein, 19 aa, Mycobacterium tuberculosis
RGLPLLDLKDLRAVITHLT

SEQ ID NO: 1528742 - protein, 23 aa, Mycobacterium tuberculosis
RGLPQLSSAPVWCSDIRAGAGLV

SEQ ID NO: 1528743 - protein, 18 aa, Mycobacterium tuberculosis
RGLRITPQQLRDIAEREG

SEQ ID NO: 1528744 - protein, 39 aa, Mycobacterium tuberculosis
RGLRMTHIRLHRPQPQRFSRLPPILPISGQQRLSLNRIP

SEQ ID NO: 1528745 - protein, 20 aa, Mycobacterium tuberculosis
RGLTLALMTDSKPSAWQLLS

SEQ ID NO: 1528746 - protein, 20 aa, Mycobacterium tuberculosis
RGLYFTTIARRGLAILRRRR

SEQ ID NO: 1528747 - protein, 20 aa, Mycobacterium tuberculosis
RGMAFIYKLLELLAERDDRI

SEQ ID NO: 1528748 - protein, 29 aa, Mycobacterium tuberculosis
RGMALAAELCLPLVLVIDAAGPALSAAAE

SEQ ID NO: 1528749 - protein, 22 aa, Mycobacterium tuberculosis
RGNFPVFRKRLRQWMMRITAYA

SEQ ID NO: 1528750 - protein, 20 aa, Mycobacterium tuberculosis
RGPDLPATLRDYLLTLRRKS

SEQ ID NO: 1528751 - protein, 18 aa, Mycobacterium tuberculosis
RGPGRRCRVGLGRAVFTH

SEQ ID NO: 1528752 - protein, 19 aa, Mycobacterium tuberculosis
RGPHLFVGALNGRNQRRVQ

SEQ ID NO: 1528753 - protein, 21 aa, Mycobacterium tuberculosis
RGPPPYVGGLRRGPCSTPAVH

SEQ ID NO: 1528754 - protein, 21 aa, Mycobacterium tuberculosis
RGQFELNRPATLIAALPAILG

SEQ ID NO: 1528755 - protein, 17 aa, Mycobacterium tuberculosis
RGQLQQRRLLAERSPRP

SEQ ID NO: 1528756 - protein, 23 aa, Mycobacterium tuberculosis
RGQPLVIAQLPALLVQADRVRFT

SEQ ID NO: 1528757 - protein, 19 aa, Mycobacterium tuberculosis
RGQPRLDVGHQPMGLASPR

SEQ ID NO: 1528758 - protein, 35 aa, Mycobacterium tuberculosis
RGQRTAMMPHKIILQYLRPLHRRRTPPQPPSPPDC

SEQ ID NO: 1528759 - protein, 19 aa, Mycobacterium tuberculosis
RGQVLTGCAGHTLRAVSSG

SEQ ID NO: 1528760 - protein, 19 aa, Mycobacterium tuberculosis
RGQYLSFNLNLNLPPRCTT

SEQ ID NO: 1528761 - protein, 25 aa, Mycobacterium tuberculosis
RGRARPASTLIYPVHRRSSGHREGP

SEQ ID NO: 1528762 - protein, 29 aa, Mycobacterium tuberculosis
RGRCRRAPLRQWRVRRPRRSRHGRQHRYR

SEQ ID NO: 1528763 - protein, 27 aa, Mycobacterium tuberculosis
RGRDDRLRWWAGPWPDDERWWDPDRAS

SEQ ID NO: 1528764 - protein, 17 aa, Mycobacterium tuberculosis
RGRFDAIVPDEVIAQLP

SEQ ID NO: 1528765 - protein, 18 aa, Mycobacterium tuberculosis
RGRFYDGMRALHGAPDEV

SEQ ID NO: 1528766 - protein, 20 aa, Mycobacterium tuberculosis
RGRRARRVGASPEAGAAGGG

SEQ ID NO: 1528767 - protein, 17 aa, Mycobacterium tuberculosis
RGRRPRAAGSRTGPSVA

SEQ ID NO: 1528768 - protein, 25 aa, Mycobacterium tuberculosis
RGRRRRWRCPAATGAPGGNGGNGGS

SEQ ID NO: 1528769 - protein, 20 aa, Mycobacterium tuberculosis
RGRTAPPAPPLPISSPPAPP

SEQ ID NO: 1528770 - protein, 26 aa, Mycobacterium tuberculosis
RGSSTSYWRRLPNRATHRTQDLTSLA

SEQ ID NO: 1528771 - protein, 25 aa, Mycobacterium tuberculosis
RGSYLQMHFALAQPPAFAAPYQALN

SEQ ID NO: 1528772 - protein, 17 aa, Mycobacterium tuberculosis
RGVAAVAPVRRLLRRLL

SEQ ID NO: 1528773 - protein, 25 aa, Mycobacterium tuberculosis
RGVDYLLHNDTHRRNAHGPHNDAEG

SEQ ID NO: 1528774 - protein, 17 aa, Mycobacterium tuberculosis
RGVKKVHYWAARSTGGE

SEQ ID NO: 1528775 - protein, 17 aa, Mycobacterium tuberculosis
RGVRLMFMQSNGGLAQA

SEQ ID NO: 1528776 - protein, 21 aa, Mycobacterium tuberculosis
RGWREHGFHLDIWALNYAGRR

SEQ ID NO: 1528777 - protein, 17 aa, Mycobacterium tuberculosis
RGWTLDRLPAVDRAILR

SEQ ID NO: 1528778 - protein, 25 aa, Mycobacterium tuberculosis
RGYGYGPAFRGLQALWRRGAEVFAD

SEQ ID NO: 1528779 - protein, 19 aa, Mycobacterium tuberculosis
RGYHRLSKLNEYSAIDFTG

SEQ ID NO: 1528780 - protein, 28 aa, Mycobacterium tuberculosis
RGYMSKIFNDAWMSSYGFLRSRLDGSTE

SEQ ID NO: 1528781 - protein, 18 aa, Mycobacterium tuberculosis
RHAARPHPLYRQRQDRPR

SEQ ID NO: 1528782 - protein, 23 aa, Mycobacterium tuberculosis
RHASHGYIRYHDVRVPADHVLGG

SEQ ID NO: 1528783 - protein, 19 aa, Mycobacterium tuberculosis
RHCAHRHGFGGFGGLGGGS

SEQ ID NO: 1528784 - protein, 24 aa, Mycobacterium tuberculosis
RHDRLIEAIVLIRQLWSGERISFT

SEQ ID NO: 1528785 - protein, 17 aa, Mycobacterium tuberculosis
RHFNWVRSWYDFAVEGI

SEQ ID NO: 1528786 - protein, 27 aa, Mycobacterium tuberculosis
RHGLAILTFWRCRMSFLIASPEALAAT

SEQ ID NO: 1528787 - protein, 17 aa, Mycobacterium tuberculosis
RHGLSESALPPLASKAG

SEQ ID NO: 1528788 - protein, 24 aa, Mycobacterium tuberculosis
RHGQIRPLGLDRYGVRFRIEARDG

SEQ ID NO: 1528789 - protein, 27 aa, Mycobacterium tuberculosis
RHHFSQYFVDYFITPLVAAVWSCGGAD

SEQ ID NO: 1528790 - protein, 22 aa, Mycobacterium tuberculosis
RHHLLLPITATRRDLNDPKTIE

SEQ ID NO: 1528791 - protein, 25 aa, Mycobacterium tuberculosis
RHIAYVPGDVTLWPSLTGGETIDLL

SEQ ID NO: 1528792 - protein, 26 aa, Mycobacterium tuberculosis
RHLRRDDQFFRLAHQTAPPVLCGTDQ

SEQ ID NO: 1528793 - protein, 34 aa, Mycobacterium tuberculosis
RHLSFARDRLGDEFITGVLFYTGARALPFGDRLM

SEQ ID NO: 1528794 - protein, 17 aa, Mycobacterium tuberculosis
RHLSMHKPWNPHDYIPW

SEQ ID NO: 1528795 - protein, 22 aa, Mycobacterium tuberculosis
RHMGLFVVGRLAGRHGIRVGLR

SEQ ID NO: 1528796 - protein, 20 aa, Mycobacterium tuberculosis
RHNTFFRWPAISASATISNA

SEQ ID NO: 1528797 - protein, 22 aa, Mycobacterium tuberculosis
RHPGWHALRKIAARITTPLLPD

SEQ ID NO: 1528798 - protein, 25 aa, Mycobacterium tuberculosis
RHPHTLQLIMDSLRYWVIEMHVDGF

SEQ ID NO: 1528799 - protein, 29 aa, Mycobacterium tuberculosis
RHPWSKRRRRLTRAPSERSRNPALTARPR

SEQ ID NO: 1528800 - protein, 23 aa, Mycobacterium tuberculosis
RHQAKFHLDRLTAEGLLDTEYAR

SEQ ID NO: 1528801 - protein, 17 aa, Mycobacterium tuberculosis
RHRGLDVVRLGPALWGD

SEQ ID NO: 1528802 - protein, 20 aa, Mycobacterium tuberculosis
RHRGVRYRAFDLVEAGPDRI

SEQ ID NO: 1528803 - protein, 20 aa, Mycobacterium tuberculosis
RHRNHQARRIAQAAVIATET

SEQ ID NO: 1528804 - protein, 23 aa, Mycobacterium tuberculosis
RHRPGRLSGRRRRRRDQRPPVRL

SEQ ID NO: 1528805 - protein, 17 aa, Mycobacterium tuberculosis
RHRPVMIHRALFGSIER

SEQ ID NO: 1528806 - protein, 18 aa, Mycobacterium tuberculosis
RHRRRLAAPGGALRGCRP

SEQ ID NO: 1528807 - protein, 27 aa, Mycobacterium tuberculosis
RHRRRPQLLSQPIPRRGRRQQRARPRT

SEQ ID NO: 1528808 - protein, 19 aa, Mycobacterium tuberculosis
RHRRVAVRQRRGPAAIAAV

SEQ ID NO: 1528809 - protein, 17 aa, Mycobacterium tuberculosis
RHRWLGMVWPRSWRWRR

SEQ ID NO: 1528810 - protein, 22 aa, Mycobacterium tuberculosis
RHRWPAFLMDRRVVDTALEQPH

SEQ ID NO: 1528811 - protein, 17 aa, Mycobacterium tuberculosis
RHTRIRRLVSSGLTPRM

SEQ ID NO: 1528812 - protein, 26 aa, Mycobacterium tuberculosis
RHTTATLLLHVLRPKTPRGDGNTPPM

SEQ ID NO: 1528813 - protein, 17 aa, Mycobacterium tuberculosis
RHTVIYLPDPTVGVQGI

SEQ ID NO: 1528814 - protein, 28 aa, Mycobacterium tuberculosis
RIAALPVNQLIMVKLALNSALLQQGVAT

SEQ ID NO: 1528815 - protein, 17 aa, Mycobacterium tuberculosis
RIADASGIPYVGRILVN

SEQ ID NO: 1528816 - protein, 23 aa, Mycobacterium tuberculosis
RIDAVHAAVLDLLARICDPLTGI

SEQ ID NO: 1528817 - protein, 22 aa, Mycobacterium tuberculosis
RIDDAFLDPLQFRADSVLGVAG

SEQ ID NO: 1528818 - protein, 21 aa, Mycobacterium tuberculosis
RIDDPVAFFGHSMGGMLAFEV

SEQ ID NO: 1528819 - protein, 18 aa, Mycobacterium tuberculosis
RIDGKDWPASPLPSLRMR

SEQ ID NO: 1528820 - protein, 24 aa, Mycobacterium tuberculosis
RIEAAYPDRFLLGIGVGHAEMISE

SEQ ID NO: 1528821 - protein, 18 aa, Mycobacterium tuberculosis
RIEAGLYATQLMTELSER

SEQ ID NO: 1528822 - protein, 21 aa, Mycobacterium tuberculosis
RIEGTLAPRYVDLRPFAVNDG

SEQ ID NO: 1528823 - protein, 17 aa, Mycobacterium tuberculosis
RIEIVIAMLGIVKAGAI

SEQ ID NO: 1528824 - protein, 19 aa, Mycobacterium tuberculosis
RIFAALAKRLPKLATGPFP

SEQ ID NO: 1528825 - protein, 20 aa, Mycobacterium tuberculosis
RIFAALAKRLPKLATGPFPP

SEQ ID NO: 1528826 - protein, 17 aa, Mycobacterium tuberculosis
RIFFPTWHTTTAELPQT

SEQ ID NO: 1528827 - protein, 17 aa, Mycobacterium tuberculosis
RIFHWTNVILGFGDPDL

SEQ ID NO: 1528828 - protein, 22 aa, Mycobacterium tuberculosis
RIGQQVPDWRERQTWACGPEGV

SEQ ID NO: 1528829 - protein, 17 aa, Mycobacterium tuberculosis
RIGWLVQLPVKGTWAFI

SEQ ID NO: 1528830 - protein, 25 aa, Mycobacterium tuberculosis
RIHKNLVPGTRQRKFVDQLGIEFQR

SEQ ID NO: 1528831 - protein, 25 aa, Mycobacterium tuberculosis
RIIPGPSSLWLDAAGKRLPVPLFPG

SEQ ID NO: 1528832 - protein, 17 aa, Mycobacterium tuberculosis
RILDINVYGVILGSKLA

SEQ ID NO: 1528833 - protein, 20 aa, Mycobacterium tuberculosis
RILDLRAGTLTRRAHWRSPA

SEQ ID NO: 1528834 - protein, 18 aa, Mycobacterium tuberculosis
RILLTRERGLLKRRAITH

SEQ ID NO: 1528835 - protein, 21 aa, Mycobacterium tuberculosis
RIPACFAGHHRRRTVPGAGPG

SEQ ID NO: 1528836 - protein, 17 aa, Mycobacterium tuberculosis
RIPCYVPVPTTIRGPVT

SEQ ID NO: 1528837 - protein, 17 aa, Mycobacterium tuberculosis
RIPNLHFSVSATTRAPR

SEQ ID NO: 1528838 - protein, 19 aa, Mycobacterium tuberculosis
RIPVDSIYSPVLKVTYKVD

SEQ ID NO: 1528839 - protein, 17 aa, Mycobacterium tuberculosis
RIPVSVMPNAGLPVLGA

SEQ ID NO: 1528840 - protein, 20 aa, Mycobacterium tuberculosis
RIQASLWSWAPDEPRAGAGA

SEQ ID NO: 1528841 - protein, 17 aa, Mycobacterium tuberculosis
RIRLATAVALPVEHYPI

SEQ ID NO: 1528842 - protein, 20 aa, Mycobacterium tuberculosis
RIRLGIALPAAVAADLLAPR

SEQ ID NO: 1528843 - protein, 17 aa, Mycobacterium tuberculosis
RIRNYGGVLFAQLRDWS

SEQ ID NO: 1528844 - protein, 19 aa, Mycobacterium tuberculosis
RIRPLRPDNTAYLIYTSGT

SEQ ID NO: 1528845 - protein, 18 aa, Mycobacterium tuberculosis
RIRRLPRWCAGSATPRSP

SEQ ID NO: 1528846 - protein, 22 aa, Mycobacterium tuberculosis
RISISRWQLDLSALLDSRGSLP

SEQ ID NO: 1528847 - protein, 22 aa, Mycobacterium tuberculosis
RISVVAAPWLADHAVGPVVLFP

SEQ ID NO: 1528848 - protein, 21 aa, Mycobacterium tuberculosis
RITDRLKDMYICGGFNVYPAE

SEQ ID NO: 1528849 - protein, 19 aa, Mycobacterium tuberculosis
RITLPTPRPPFHEELPRIT

SEQ ID NO: 1528850 - protein, 23 aa, Mycobacterium tuberculosis
RITTPLLPDDYLHLANPLWSARE

SEQ ID NO: 1528851 - protein, 18 aa, Mycobacterium tuberculosis
RITWSNWIDEQLLGPQRF

SEQ ID NO: 1528852 - protein, 17 aa, Mycobacterium tuberculosis
RIVAAMRREGMGFTAGF

SEQ ID NO: 1528853 - protein, 19 aa, Mycobacterium tuberculosis
RIVQPRRWGAHERAQLLVG

SEQ ID NO: 1528854 - protein, 27 aa, Mycobacterium tuberculosis
RIVRRSNALLDWAYGRRFRYSETMSVG

SEQ ID NO: 1528855 - protein, 23 aa, Mycobacterium tuberculosis
RIVTPRVMQFTLRANVPKLADTQ

SEQ ID NO: 1528856 - protein, 25 aa, Mycobacterium tuberculosis
RKAFGRSIGSFQNSRFLLAELATEA

SEQ ID NO: 1528857 - protein, 21 aa, Mycobacterium tuberculosis
RKALDQLLVLGTLLEGHAEHV

SEQ ID NO: 1528858 - protein, 19 aa, Mycobacterium tuberculosis
RKFDCEAWIPTQGAYRELT

SEQ ID NO: 1528859 - protein, 18 aa, Mycobacterium tuberculosis
RKGYLRRDPNRPRAVNVR

SEQ ID NO: 1528860 - protein, 20 aa, Mycobacterium tuberculosis
RKLRDAWLTARRDLVDRRNR

SEQ ID NO: 1528861 - protein, 19 aa, Mycobacterium tuberculosis
RKLREAGALWERLTRAVGM

SEQ ID NO: 1528862 - protein, 20 aa, Mycobacterium tuberculosis
RKLWQWEPGQWKHRKYQLRR

SEQ ID NO: 1528863 - protein, 29 aa, Mycobacterium tuberculosis
RKNERYKLVWKNRLGFARLAIQHGYPIVP

SEQ ID NO: 1528864 - protein, 24 aa, Mycobacterium tuberculosis
RKNWPRRMGRIPKQLLSGVPAHVD

SEQ ID NO: 1528865 - protein, 25 aa, Mycobacterium tuberculosis
RKPDGTELSGFYQVVVRPKTPRGDG

SEQ ID NO: 1528866 - protein, 23 aa, Mycobacterium tuberculosis
RKPTVCWVGGDPPRRPSTWPRLA

SEQ ID NO: 1528867 - protein, 20 aa, Mycobacterium tuberculosis
RKPVVLRRATPLQAIAAMDA

SEQ ID NO: 1528868 - protein, 22 aa, Mycobacterium tuberculosis
RKQRGLTVAQRTHHLVFAGPPG

SEQ ID NO: 1528869 - protein, 30 aa, Mycobacterium tuberculosis
RKRGAAAFPWCCGRPVLAKLMAGRTTLMVT

SEQ ID NO: 1528870 - protein, 24 aa, Mycobacterium tuberculosis
RKRRQPVTVLLKALGWTSEQIVER

SEQ ID NO: 1528871 - protein, 17 aa, Mycobacterium tuberculosis
RKSGAWFTYEGEQLGQG

SEQ ID NO: 1528872 - protein, 24 aa, Mycobacterium tuberculosis
RKSRFLQLGQWKHRLLQHRFRKQR

SEQ ID NO: 1528873 - protein, 24 aa, Mycobacterium tuberculosis
RKSSQSHMPPRTPPRGRCLRAPES

SEQ ID NO: 1528874 - protein, 17 aa, Mycobacterium tuberculosis
RKTGRHFSIPLSAHVID

SEQ ID NO: 1528875 - protein, 21 aa, Mycobacterium tuberculosis
RKVDDALWKRYSTARDTFNRR

SEQ ID NO: 1528876 - protein, 18 aa, Mycobacterium tuberculosis
RKVFSAAVARQPFIALQP

SEQ ID NO: 1528877 - protein, 23 aa, Mycobacterium tuberculosis
RKVVPLGKDAAWLLRVGDRATAG

SEQ ID NO: 1528878 - protein, 18 aa, Mycobacterium tuberculosis
RLAALSILVGAVGATGPG

SEQ ID NO: 1528879 - protein, 27 aa, Mycobacterium tuberculosis
RLAERPANLAFFLRALTDRRRARGCAE

SEQ ID NO: 1528880 - protein, 23 aa, Mycobacterium tuberculosis
RLAHPMVLRPVMTTTGLISWDAA

SEQ ID NO: 1528881 - protein, 20 aa, Mycobacterium tuberculosis
RLCPAPCEPACVLGINQDPV

SEQ ID NO: 1528882 - protein, 18 aa, Mycobacterium tuberculosis
RLCPTPGHLHFFAVDGRR

SEQ ID NO: 1528883 - protein, 23 aa, Mycobacterium tuberculosis
RLDFRPKHKLAVLVVCAIPLAEP

SEQ ID NO: 1528884 - protein, 22 aa, Mycobacterium tuberculosis
RLDGSPLRYNQLDPYLPDLLMC

SEQ ID NO: 1528885 - protein, 23 aa, Mycobacterium tuberculosis
RLDGSVLLARMRQIAARNADGRR

SEQ ID NO: 1528886 - protein, 19 aa, Mycobacterium tuberculosis
RLDHLAARLRRNSANLLVL

SEQ ID NO: 1528887 - protein, 19 aa, Mycobacterium tuberculosis
RLDLVAWATGLPALGPEAL

SEQ ID NO: 1528888 - protein, 22 aa, Mycobacterium tuberculosis
RLDPLLPTRSGLLLNRFYGRGE

SEQ ID NO: 1528889 - protein, 25 aa, Mycobacterium tuberculosis
RLDPQLKSYAFVMPETALAAARAAD

SEQ ID NO: 1528890 - protein, 21 aa, Mycobacterium tuberculosis
RLERMRSAPTGFIDAAHNPAG

SEQ ID NO: 1528891 - protein, 18 aa, Mycobacterium tuberculosis
RLFGRRLADFFTGRDPRG

SEQ ID NO: 1528892 - protein, 27 aa, Mycobacterium tuberculosis
RLFGVRLVKLLYRLERPLLFALQCMPL

SEQ ID NO: 1528893 - protein, 21 aa, Mycobacterium tuberculosis
RLFPTLNYAVSVAEACERADA

SEQ ID NO: 1528894 - protein, 17 aa, Mycobacterium tuberculosis
RLFSGMSAHYDSLPRLI

SEQ ID NO: 1528895 - protein, 17 aa, Mycobacterium tuberculosis
RLFVVTRQAQIVKPHDS

SEQ ID NO: 1528896 - protein, 18 aa, Mycobacterium tuberculosis
RLGALAARLWLPLLAAEG

SEQ ID NO: 1528897 - protein, 24 aa, Mycobacterium tuberculosis
RLGAWAGPPPQWWAQRFGIEPELA

SEQ ID NO: 1528898 - protein, 29 aa, Mycobacterium tuberculosis
RLGGPGSWLLAVPPYHIAGLAVLVRSVIA

SEQ ID NO: 1528899 - protein, 25 aa, Mycobacterium tuberculosis
RLGIPTIATVPWTTDRLLNALMPDT

SEQ ID NO: 1528900 - protein, 17 aa, Mycobacterium tuberculosis
RLGLARALGSPAAVLLL

SEQ ID NO: 1528901 - protein, 19 aa, Mycobacterium tuberculosis
RLGLFPFGRQPVAVCRRLG

SEQ ID NO: 1528902 - protein, 31 aa, Mycobacterium tuberculosis
RLGLSELRRAILGLFQPWQRRLRLRQQGHPA

SEQ ID NO: 1528903 - protein, 20 aa, Mycobacterium tuberculosis
RLGPVLRRLTVNYPPIMFHP

SEQ ID NO: 1528904 - protein, 18 aa, Mycobacterium tuberculosis
RLGTLPNLTWSRLKVNVA

SEQ ID NO: 1528905 - protein, 19 aa, Mycobacterium tuberculosis
RLHEEMMSELRWPGDPSLD

SEQ ID NO: 1528906 - protein, 20 aa, Mycobacterium tuberculosis
RLHELLMKRRRLGAERLIGL

SEQ ID NO: 1528907 - protein, 17 aa, Mycobacterium tuberculosis
RLHPLPPQTVVGIPSSE

SEQ ID NO: 1528908 - protein, 28 aa, Mycobacterium tuberculosis
RLHPVVLDAAFKAWVPRYPTARSRGRRK

SEQ ID NO: 1528909 - protein, 18 aa, Mycobacterium tuberculosis
RLHRWRTATALPAGPAAV

SEQ ID NO: 1528910 - protein, 18 aa, Mycobacterium tuberculosis
RLIGAFGHGDVCGTAQFE

SEQ ID NO: 1528911 - protein, 24 aa, Mycobacterium tuberculosis
RLILDGPLLPGDWTVELNYLANSD

SEQ ID NO: 1528912 - protein, 17 aa, Mycobacterium tuberculosis
RLIVWELVARHSASRPA

SEQ ID NO: 1528913 - protein, 24 aa, Mycobacterium tuberculosis
RLKDPHHHPRLPGHRLGRGRHRTQ

SEQ ID NO: 1528914 - protein, 21 aa, Mycobacterium tuberculosis
RLLAGQRRLASAIAGGAPMYQ

SEQ ID NO: 1528915 - protein, 28 aa, Mycobacterium tuberculosis
RLLELQLVDPSLGWQWLDPDIRNLAQRD

SEQ ID NO: 1528916 - protein, 26 aa, Mycobacterium tuberculosis
RLLRELEARIIQWRNANPQLAANYRA

SEQ ID NO: 1528917 - protein, 18 aa, Mycobacterium tuberculosis
RLLSAVWLREPDGPGVLV

SEQ ID NO: 1528918 - protein, 20 aa, Mycobacterium tuberculosis
RLLSGRLRLHHLHRQLRAAA

SEQ ID NO: 1528919 - protein, 18 aa, Mycobacterium tuberculosis
RLLVRALLDTVIDSGPVN

SEQ ID NO: 1528920 - protein, 17 aa, Mycobacterium tuberculosis
RLLWSLPKGHIELGETA

SEQ ID NO: 1528921 - protein, 18 aa, Mycobacterium tuberculosis
RLMLKLNGGPQAVADAAH

SEQ ID NO: 1528922 - protein, 22 aa, Mycobacterium tuberculosis
RLNRLLAQQIPPARKVLAGADD

SEQ ID NO: 1528923 - protein, 22 aa, Mycobacterium tuberculosis
RLPEIWPEPTEFRPLRWDPNAA

SEQ ID NO: 1528924 - protein, 27 aa, Mycobacterium tuberculosis
RLPEIWPEPTEFRPLRWDPNAADYRKP

SEQ ID NO: 1528925 - protein, 23 aa, Mycobacterium tuberculosis
RLPKVSWVLPGFLLSEHPAFPVN

SEQ ID NO: 1528926 - protein, 25 aa, Mycobacterium tuberculosis
RLPQELPMLAPGQEWRMVWDSALDR

SEQ ID NO: 1528927 - protein, 17 aa, Mycobacterium tuberculosis
RLPRRQSRRQQRTDHPG

SEQ ID NO: 1528928 - protein, 18 aa, Mycobacterium tuberculosis
RLPRRSLAFDVPAEYVNL

SEQ ID NO: 1528929 - protein, 22 aa, Mycobacterium tuberculosis
RLPSIYFAHRRKVFQRDGMLLA

SEQ ID NO: 1528930 - protein, 17 aa, Mycobacterium tuberculosis
RLPTAPSYRTALSMVRQ

SEQ ID NO: 1528931 - protein, 22 aa, Mycobacterium tuberculosis
RLPTGSMPRRWWSGPPGPRPNA

SEQ ID NO: 1528932 - protein, 19 aa, Mycobacterium tuberculosis
RLQGQPPLGPVLMTADARA

SEQ ID NO: 1528933 - protein, 20 aa, Mycobacterium tuberculosis
RLQGQPPLGPVLMTADARAA

SEQ ID NO: 1528934 - protein, 18 aa, Mycobacterium tuberculosis
RLQPGRMFLVDTAQGRIV

SEQ ID NO: 1528935 - protein, 25 aa, Mycobacterium tuberculosis
RLQVKYINRALKPIARYLPGTATIE

SEQ ID NO: 1528936 - protein, 23 aa, Mycobacterium tuberculosis
RLQYFVSCLVYMPEIATPPPCAC

SEQ ID NO: 1528937 - protein, 20 aa, Mycobacterium tuberculosis
RLRALDYPKVVIGVSGGLDS

SEQ ID NO: 1528938 - protein, 17 aa, Mycobacterium tuberculosis
RLRALEHGVEVIGYWGE

SEQ ID NO: 1528939 - protein, 23 aa, Mycobacterium tuberculosis
RLRKEIFELYGYTAVVHVLSASG

SEQ ID NO: 1528940 - protein, 17 aa, Mycobacterium tuberculosis
RLRKVVPLGKDAAWLLR

SEQ ID NO: 1528941 - protein, 18 aa, Mycobacterium tuberculosis
RLRLEHVGAIRPDQLRRA

SEQ ID NO: 1528942 - protein, 20 aa, Mycobacterium tuberculosis
RLRPYQPGHIPFIEPTERLG

SEQ ID NO: 1528943 - protein, 19 aa, Mycobacterium tuberculosis
RLRQEHLPWAAAIATRGRS

SEQ ID NO: 1528944 - protein, 21 aa, Mycobacterium tuberculosis
RLRRGRRQRRQTGDAGTNASD

SEQ ID NO: 1528945 - protein, 21 aa, Mycobacterium tuberculosis
RLRRILDTVARQEPGLSWAAG

SEQ ID NO: 1528946 - protein, 23 aa, Mycobacterium tuberculosis
RLRRLAGLWLADQEERWAAVRID

SEQ ID NO: 1528947 - protein, 19 aa, Mycobacterium tuberculosis
RLRRQRVWTPVLMLTARGA

SEQ ID NO: 1528948 - protein, 19 aa, Mycobacterium tuberculosis
RLRRWMAVAARIELRTGGA

SEQ ID NO: 1528949 - protein, 17 aa, Mycobacterium tuberculosis
RLRWARRPDWGGLEVDV

SEQ ID NO: 1528950 - protein, 18 aa, Mycobacterium tuberculosis
RLSALLNTSGLPAVWEPF

SEQ ID NO: 1528951 - protein, 22 aa, Mycobacterium tuberculosis
RLSSWAHPFRPVTKTPVGWIPQ

SEQ ID NO: 1528952 - protein, 19 aa, Mycobacterium tuberculosis
RLTDLVGGFLPNLHQRLVA

SEQ ID NO: 1528953 - protein, 24 aa, Mycobacterium tuberculosis
RLTELPLTLFTDPAAPGLTCTPFV

SEQ ID NO: 1528954 - protein, 18 aa, Mycobacterium tuberculosis
RLTGRSPILLAGMTPTTV

SEQ ID NO: 1528955 - protein, 18 aa, Mycobacterium tuberculosis
RLTIANGLSPDRLRKQLD

SEQ ID NO: 1528956 - protein, 17 aa, Mycobacterium tuberculosis
RLTLVEGAGGLLVELAE

SEQ ID NO: 1528957 - protein, 27 aa, Mycobacterium tuberculosis
RLTRMQRFWISLYFPLTMRSLCNAIVV

SEQ ID NO: 1528958 - protein, 17 aa, Mycobacterium tuberculosis
RLTSDFDWQTVATRPRR

SEQ ID NO: 1528959 - protein, 24 aa, Mycobacterium tuberculosis
RLTVNYPPIMFHPLNTITAYKGQI

SEQ ID NO: 1528960 - protein, 36 aa, Mycobacterium tuberculosis
RLVAGWHVVALQPYGGVWLHSWLDRDRGISGRLSVR

SEQ ID NO: 1528961 - protein, 33 aa, Mycobacterium tuberculosis
RLVARIAALPVNQLIMVKLALNSALLQQGVATS

SEQ ID NO: 1528962 - protein, 21 aa, Mycobacterium tuberculosis
RLVAWLPVRDVVDAALHGGAG

SEQ ID NO: 1528963 - protein, 22 aa, Mycobacterium tuberculosis
RLVDAPLPAWSHRFLFYDREGV

SEQ ID NO: 1528964 - protein, 32 aa, Mycobacterium tuberculosis
RLVDDDLADLFLPRPLRWLAGATRSGVLRRLL

SEQ ID NO: 1528965 - protein, 18 aa, Mycobacterium tuberculosis
RLVFRRRAPVDPKRRPLI

SEQ ID NO: 1528966 - protein, 18 aa, Mycobacterium tuberculosis
RLVMIDHGLPLPELQYPI

SEQ ID NO: 1528967 - protein, 21 aa, Mycobacterium tuberculosis
RLVNWQRIRHRWNWTDVRRWL

SEQ ID NO: 1528968 - protein, 20 aa, Mycobacterium tuberculosis
RLVQALFDALALPEFAVSPD

SEQ ID NO: 1528969 - protein, 18 aa, Mycobacterium tuberculosis
RLVSDQISLLLRRTIDPD

SEQ ID NO: 1528970 - protein, 17 aa, Mycobacterium tuberculosis
RLVSIIAWRTYLVRDPE

SEQ ID NO: 1528971 - protein, 18 aa, Mycobacterium tuberculosis
RLVSIIAWRTYLVRDPEA

SEQ ID NO: 1528972 - protein, 20 aa, Mycobacterium tuberculosis
RLVSIIAWRTYLVRDPEALS

SEQ ID NO: 1528973 - protein, 17 aa, Mycobacterium tuberculosis
RLVTLPWSRDLAAAIER

SEQ ID NO: 1528974 - protein, 19 aa, Mycobacterium tuberculosis
RLVTRARDMLWVNRFRCNR

SEQ ID NO: 1528975 - protein, 19 aa, Mycobacterium tuberculosis
RLVTRARDMLWVNRFRWNR

SEQ ID NO: 1528976 - protein, 21 aa, Mycobacterium tuberculosis
RLVTTSRQYGIEPQQLFGYLQ

SEQ ID NO: 1528977 - protein, 17 aa, Mycobacterium tuberculosis
RLWRRSRISSRSPAGPP

SEQ ID NO: 1528978 - protein, 18 aa, Mycobacterium tuberculosis
RLYDIELALRLGATVERV

SEQ ID NO: 1528979 - protein, 17 aa, Mycobacterium tuberculosis
RLYLYAEAFQTSTLHAT

SEQ ID NO: 1528980 - protein, 17 aa, Mycobacterium tuberculosis
RLYPAGTASDEAGAGEL

SEQ ID NO: 1528981 - protein, 20 aa, Mycobacterium tuberculosis
RLYPATMLLVDTYDTLRGVD

SEQ ID NO: 1528982 - protein, 18 aa, Mycobacterium tuberculosis
RMAAPAGPTGPAHTAVPA

SEQ ID NO: 1528983 - protein, 28 aa, Mycobacterium tuberculosis
RMAAVDAQFYWMSAKVPNDQFLLYAFDG

SEQ ID NO: 1528984 - protein, 21 aa, Mycobacterium tuberculosis
RMAHQWAFPPRKNSSRGRGHE

SEQ ID NO: 1528985 - protein, 27 aa, Mycobacterium tuberculosis
RMASLRGLLKFRTGVRPPVPLDEVEPA

SEQ ID NO: 1528986 - protein, 19 aa, Mycobacterium tuberculosis
RMFDVVPNPAWVARPGKYA

SEQ ID NO: 1528987 - protein, 17 aa, Mycobacterium tuberculosis
RMFFGAGSGPMLAAAAA

SEQ ID NO: 1528988 - protein, 17 aa, Mycobacterium tuberculosis
RMFLVDTAQGRIVSDEE

SEQ ID NO: 1528989 - protein, 17 aa, Mycobacterium tuberculosis
RMGLPVLAVVAFAQSFG

SEQ ID NO: 1528990 - protein, 24 aa, Mycobacterium tuberculosis
RMGSNAEFVVALLAGVACGSRRRA

SEQ ID NO: 1528991 - protein, 30 aa, Mycobacterium tuberculosis
RMHEPSLMQNICFLYHLVGGGTGVWHVPIG

SEQ ID NO: 1528992 - protein, 18 aa, Mycobacterium tuberculosis
RMHKTSLTVATIVRRHWP

SEQ ID NO: 1528993 - protein, 25 aa, Mycobacterium tuberculosis
RMLLDALRHRGSLRRFVPFDVDASV

SEQ ID NO: 1528994 - protein, 19 aa, Mycobacterium tuberculosis
RMLPRATFCQPNVASFGLI

SEQ ID NO: 1528995 - protein, 19 aa, Mycobacterium tuberculosis
RMLRALRGFDPDVVHLASP

SEQ ID NO: 1528996 - protein, 19 aa, Mycobacterium tuberculosis
RMRHPLYGKIIRTTKKVKA

SEQ ID NO: 1528997 - protein, 20 aa, Mycobacterium tuberculosis
RMRSLLMPAFTRAALRGYRD

SEQ ID NO: 1528998 - protein, 17 aa, Mycobacterium tuberculosis
RMSATPAWGTRAPATGA

SEQ ID NO: 1528999 - protein, 17 aa, Mycobacterium tuberculosis
RMSVSIAGAVCTAAARA

SEQ ID NO: 1529000 - protein, 42 aa, Mycobacterium tuberculosis
RMTIKPLMTVGSYLSPLPLPLGFVDFACRVWRPGQGTVRTTI

SEQ ID NO: 1529001 - protein, 18 aa, Mycobacterium tuberculosis
RMVARLMGSLAVLRSVSI

SEQ ID NO: 1529002 - protein, 18 aa, Mycobacterium tuberculosis
RMVSWPYTKLMNSNNMVD

SEQ ID NO: 1529003 - protein, 19 aa, Mycobacterium tuberculosis
RMYLLVHRAATADGADKSG

SEQ ID NO: 1529004 - protein, 19 aa, Mycobacterium tuberculosis
RMYRTGDLVCWRADGQLEF

SEQ ID NO: 1529005 - protein, 25 aa, Mycobacterium tuberculosis
RNAATSIVGFISPTGRYLSLTQSNA

SEQ ID NO: 1529006 - protein, 24 aa, Mycobacterium tuberculosis
RNAFVQLVLSNLFGQNAPAIAAAE

SEQ ID NO: 1529007 - protein, 21 aa, Mycobacterium tuberculosis
RNAMVLQQKIAERTKLLSQLE

SEQ ID NO: 1529008 - protein, 21 aa, Mycobacterium tuberculosis
RNDMLRVYPSLDPNLVHVIRN

SEQ ID NO: 1529009 - protein, 25 aa, Mycobacterium tuberculosis
RNEALDCFVYALAALRISISRWQLD

SEQ ID NO: 1529010 - protein, 18 aa, Mycobacterium tuberculosis
RNFARRGIRWPCAAGIDQ

SEQ ID NO: 1529011 - protein, 24 aa, Mycobacterium tuberculosis
RNFYALDRLWGDCPVVLVDLSANS

SEQ ID NO: 1529012 - protein, 23 aa, Mycobacterium tuberculosis
RNHARWAVLLRNLRFVIVDECHY

SEQ ID NO: 1529013 - protein, 17 aa, Mycobacterium tuberculosis
RNHGGYHFGRLVRRWRW

SEQ ID NO: 1529014 - protein, 18 aa, Mycobacterium tuberculosis
RNIVNMLHGVRDGLVRDA

SEQ ID NO: 1529015 - protein, 20 aa, Mycobacterium tuberculosis
RNIVNMLHGVRDGRSTFRYP

SEQ ID NO: 1529016 - protein, 21 aa, Mycobacterium tuberculosis
RNKFGRMIFIGSVSGSWGIGN

SEQ ID NO: 1529017 - protein, 22 aa, Mycobacterium tuberculosis
RNMTMVLAPHRGAKTRARARHP

SEQ ID NO: 1529018 - protein, 26 aa, Mycobacterium tuberculosis
RNPLHSDPWFATQLAGFPKPILHGLC

SEQ ID NO: 1529019 - protein, 17 aa, Mycobacterium tuberculosis
RNPTRWGAGWNMDRWAL

SEQ ID NO: 1529020 - protein, 19 aa, Mycobacterium tuberculosis
RNQGIRVRIGTTWGARCGT

SEQ ID NO: 1529021 - protein, 26 aa, Mycobacterium tuberculosis
RNQNWRAMMLMLRWRAAPSCTSTRAC

SEQ ID NO: 1529022 - protein, 17 aa, Mycobacterium tuberculosis
RNRHQLVSLVLSNLFGQ

SEQ ID NO: 1529023 - protein, 25 aa, Mycobacterium tuberculosis
RNRTVWAPPMRFRVCSRRGGYNWTG

SEQ ID NO: 1529024 - protein, 17 aa, Mycobacterium tuberculosis
RNTHGVSWLPLYHDMGL

SEQ ID NO: 1529025 - protein, 17 aa, Mycobacterium tuberculosis
RNVALRDSAVAAVAAAA

SEQ ID NO: 1529026 - protein, 18 aa, Mycobacterium tuberculosis
RNVDRFRPGLLDLPAPAP

SEQ ID NO: 1529027 - protein, 21 aa, Mycobacterium tuberculosis
RPAAGLRRAASRRVGLRTRRL

SEQ ID NO: 1529028 - protein, 19 aa, Mycobacterium tuberculosis
RPAAPRTRLRRLQTCPAYR

SEQ ID NO: 1529029 - protein, 17 aa, Mycobacterium tuberculosis
RPAARGHRRGDRLTLIR

SEQ ID NO: 1529030 - protein, 18 aa, Mycobacterium tuberculosis
RPADRFQRGGLAFRALHP

SEQ ID NO: 1529031 - protein, 21 aa, Mycobacterium tuberculosis
RPAPQFEVMYLLAVCDAAAAD

SEQ ID NO: 1529032 - protein, 21 aa, Mycobacterium tuberculosis
RPASAAFGGAAGGDAFDVAAT

SEQ ID NO: 1529033 - protein, 24 aa, Mycobacterium tuberculosis
RPAVPPLMRGYLRLGARACGEPAH

SEQ ID NO: 1529034 - protein, 18 aa, Mycobacterium tuberculosis
RPCAHLRSLLHEALIASG

SEQ ID NO: 1529035 - protein, 18 aa, Mycobacterium tuberculosis
RPCGHSPLVLWALGPARL

SEQ ID NO: 1529036 - protein, 31 aa, Mycobacterium tuberculosis
RPCPQRQRRRPCGNGRQRSVSAACAVAVGPA

SEQ ID NO: 1529037 - protein, 28 aa, Mycobacterium tuberculosis
RPDAEWMGPLLDAMGLTVGWITADSTPD

SEQ ID NO: 1529038 - protein, 23 aa, Mycobacterium tuberculosis
RPDGRLLTHKLLSDNPARYRDAA

SEQ ID NO: 1529039 - protein, 17 aa, Mycobacterium tuberculosis
RPDPHAWLGDAFHAWVQ

SEQ ID NO: 1529040 - protein, 18 aa, Mycobacterium tuberculosis
RPDPHAWLGDAFHAWVQQ

SEQ ID NO: 1529041 - protein, 17 aa, Mycobacterium tuberculosis
RPDQLHKLATKLADCLN

SEQ ID NO: 1529042 - protein, 31 aa, Mycobacterium tuberculosis
RPDQSVHVISWRWVKFVYIGDSAHPLQQARQ

SEQ ID NO: 1529043 - protein, 22 aa, Mycobacterium tuberculosis
RPEDYWPEQWAHAYVDFAAGEK

SEQ ID NO: 1529044 - protein, 18 aa, Mycobacterium tuberculosis
RPGALHTELLQLCAPEKV

SEQ ID NO: 1529045 - protein, 17 aa, Mycobacterium tuberculosis
RPGAPRPGGRPGAPGAG

SEQ ID NO: 1529046 - protein, 21 aa, Mycobacterium tuberculosis
RPGFHPFQKHVEPVWTLGSTT

SEQ ID NO: 1529047 - protein, 27 aa, Mycobacterium tuberculosis
RPGRCPPGFQILPISSTLGLGTGPPPR

SEQ ID NO: 1529048 - protein, 19 aa, Mycobacterium tuberculosis
RPGRFLLTGSARLLSAPDM

SEQ ID NO: 1529049 - protein, 21 aa, Mycobacterium tuberculosis
RPGRPLLPLPPAPPAPPLPTK

SEQ ID NO: 1529050 - protein, 18 aa, Mycobacterium tuberculosis
RPIDGLSLDVAPGSLVIL

SEQ ID NO: 1529051 - protein, 19 aa, Mycobacterium tuberculosis
RPIEIYRGKPILYGCGDVV

SEQ ID NO: 1529052 - protein, 20 aa, Mycobacterium tuberculosis
RPIGLRRRTARWWSSIICRC

SEQ ID NO: 1529053 - protein, 17 aa, Mycobacterium tuberculosis
RPIQKVLRSPLGPVAAR

SEQ ID NO: 1529054 - protein, 17 aa, Mycobacterium tuberculosis
RPLDGLNQIVLHLGNGA

SEQ ID NO: 1529055 - protein, 27 aa, Mycobacterium tuberculosis
RPLDPDRPLWECWIIEGLNGNRWAILI

SEQ ID NO: 1529056 - protein, 19 aa, Mycobacterium tuberculosis
RPLFGGAPLIRKTGAERDG

SEQ ID NO: 1529057 - protein, 28 aa, Mycobacterium tuberculosis
RPLIYSQQRLHPLPPQTVVGIPSSAGSM

SEQ ID NO: 1529058 - protein, 20 aa, Mycobacterium tuberculosis
RPLKLTSPEATGLLVALRAL

SEQ ID NO: 1529059 - protein, 24 aa, Mycobacterium tuberculosis
RPLPPGLTPPRWPAMNAGSTRPSS

SEQ ID NO: 1529060 - protein, 24 aa, Mycobacterium tuberculosis
RPLRGCYRIAVLSLKGGIGKTTIT

SEQ ID NO: 1529061 - protein, 25 aa, Mycobacterium tuberculosis
RPLRGCYRIAVLSLKGGVGKTTITA

SEQ ID NO: 1529062 - protein, 19 aa, Mycobacterium tuberculosis
RPLRPSFVDGLRDEIQIVV

SEQ ID NO: 1529063 - protein, 19 aa, Mycobacterium tuberculosis
RPLTVAVLLRITEVFGVDA

SEQ ID NO: 1529064 - protein, 17 aa, Mycobacterium tuberculosis
RPLVAWLDALATGIDLL

SEQ ID NO: 1529065 - protein, 19 aa, Mycobacterium tuberculosis
RPLWEMWVIEGGARSDTVV

SEQ ID NO: 1529066 - protein, 17 aa, Mycobacterium tuberculosis
RPMPLPPGRGILVTGAG

SEQ ID NO: 1529067 - protein, 18 aa, Mycobacterium tuberculosis
RPPKVLSPLFPRPDTPAE

SEQ ID NO: 1529068 - protein, 20 aa, Mycobacterium tuberculosis
RPPRFCRRVGVRPPAPAALP

SEQ ID NO: 1529069 - protein, 30 aa, Mycobacterium tuberculosis
RPPSWQPPACLRFLQRPVIRAPVAASASSA

SEQ ID NO: 1529070 - protein, 19 aa, Mycobacterium tuberculosis
RPPVVASRVDWWRGRPPAA

SEQ ID NO: 1529071 - protein, 17 aa, Mycobacterium tuberculosis
RPPWTCCPASTHPPSSL

SEQ ID NO: 1529072 - protein, 22 aa, Mycobacterium tuberculosis
RPQLATTLLPALLEALVRNVSR

SEQ ID NO: 1529073 - protein, 18 aa, Mycobacterium tuberculosis
RPQPILQLPDTNSGWRLV

SEQ ID NO: 1529074 - protein, 24 aa, Mycobacterium tuberculosis
RPQRVGRQLPIPLGASTVDHMARR

SEQ ID NO: 1529075 - protein, 21 aa, Mycobacterium tuberculosis
RPQVLDLLHHTPDYGPPGGPL

SEQ ID NO: 1529076 - protein, 19 aa, Mycobacterium tuberculosis
RPRAERLISRPWGGKQRSD

SEQ ID NO: 1529077 - protein, 17 aa, Mycobacterium tuberculosis
RPRAGIAGLLVPDSPPA

SEQ ID NO: 1529078 - protein, 20 aa, Mycobacterium tuberculosis
RPRIFDRRIVLPEMLYERVV

SEQ ID NO: 1529079 - protein, 21 aa, Mycobacterium tuberculosis
RPRIFDRRIVLPEMLYERVVE

SEQ ID NO: 1529080 - protein, 22 aa, Mycobacterium tuberculosis
RPRLRLRARAVLQARRPPGSAV

SEQ ID NO: 1529081 - protein, 18 aa, Mycobacterium tuberculosis
RPRMLVFGAIDFAAALAR

SEQ ID NO: 1529082 - protein, 22 aa, Mycobacterium tuberculosis
RPRPTRELSWVRGAPADAGSFG

SEQ ID NO: 1529083 - protein, 23 aa, Mycobacterium tuberculosis
RPRQWLEIRYLDSVPDEVWPAVV

SEQ ID NO: 1529084 - protein, 17 aa, Mycobacterium tuberculosis
RPRRCTWRRSAVNGSRS

SEQ ID NO: 1529085 - protein, 25 aa, Mycobacterium tuberculosis
RPRRLPPLPPQPPRRYPPACPVPSI

SEQ ID NO: 1529086 - protein, 19 aa, Mycobacterium tuberculosis
RPRRRVRPGCRRRRAGVPR

SEQ ID NO: 1529087 - protein, 33 aa, Mycobacterium tuberculosis
RPRRSGPACWAPWWPGSAWPPTVAPTTLAILML

SEQ ID NO: 1529088 - protein, 21 aa, Mycobacterium tuberculosis
RPRSLVTAQDRPPRGKTVWFT

SEQ ID NO: 1529089 - protein, 21 aa, Mycobacterium tuberculosis
RPRSPRWRRWARRPERSPCTC

SEQ ID NO: 1529090 - protein, 21 aa, Mycobacterium tuberculosis
RPRWLGWPARSRVSACGCAKA

SEQ ID NO: 1529091 - protein, 17 aa, Mycobacterium tuberculosis
RPRYIRIAADLPSTATH

SEQ ID NO: 1529092 - protein, 24 aa, Mycobacterium tuberculosis
RPSEAPGFFVGFAAVGARQRREAR

SEQ ID NO: 1529093 - protein, 17 aa, Mycobacterium tuberculosis
RPSRIWPRLERTARAGP

SEQ ID NO: 1529094 - protein, 18 aa, Mycobacterium tuberculosis
RPTGAFMFLGPTGVGKTE

SEQ ID NO: 1529095 - protein, 19 aa, Mycobacterium tuberculosis
RPTGAFMFLGPTGVGKTEL

SEQ ID NO: 1529096 - protein, 17 aa, Mycobacterium tuberculosis
RPTGWFGVVLGGGGYGA

SEQ ID NO: 1529097 - protein, 23 aa, Mycobacterium tuberculosis
RPTPPNCSGSWRRPARPGCGCRP

SEQ ID NO: 1529098 - protein, 18 aa, Mycobacterium tuberculosis
RPVFGVGRTAPPPRTGRF

SEQ ID NO: 1529099 - protein, 25 aa, Mycobacterium tuberculosis
RPVGQLRPLLAPGLVDSVLAVSRTA

SEQ ID NO: 1529100 - protein, 17 aa, Mycobacterium tuberculosis
RPVKWPISACCLGVVWG

SEQ ID NO: 1529101 - protein, 29 aa, Mycobacterium tuberculosis
RPVSILYRLYRPLIFALYCLPLNWLRRKH

SEQ ID NO: 1529102 - protein, 24 aa, Mycobacterium tuberculosis
RPVVAGRQTIGPRASTGAARRPPG

SEQ ID NO: 1529103 - protein, 18 aa, Mycobacterium tuberculosis
RPVVLVAHGGLIAALSAA

SEQ ID NO: 1529104 - protein, 28 aa, Mycobacterium tuberculosis
RPVWDVEPWDRWLRDFFGPAATTDWYRP

SEQ ID NO: 1529105 - protein, 24 aa, Mycobacterium tuberculosis
RPWPVAVPGCPWACRVRGVSVVNV

SEQ ID NO: 1529106 - protein, 22 aa, Mycobacterium tuberculosis
RPWRRSPERPSSWYRRPRTPIN

SEQ ID NO: 1529107 - protein, 19 aa, Mycobacterium tuberculosis
RPWWEWAATHERAFTAAYD

SEQ ID NO: 1529108 - protein, 20 aa, Mycobacterium tuberculosis
RPYHRTFQAVKHHCANMLVA

SEQ ID NO: 1529109 - protein, 26 aa, Mycobacterium tuberculosis
RPYQQRGLAWLAFLSSLGLGSCLAPA

SEQ ID NO: 1529110 - protein, 23 aa, Mycobacterium tuberculosis
RQAAVQLAVYRLAWAALRGCPTS

SEQ ID NO: 1529111 - protein, 18 aa, Mycobacterium tuberculosis
RQAIMLAPVTRPGGGPSG

SEQ ID NO: 1529112 - protein, 22 aa, Mycobacterium tuberculosis
RQALLFLRADRLQYFVSCLVYM

SEQ ID NO: 1529113 - protein, 22 aa, Mycobacterium tuberculosis
RQARTIGGVYPRGPPLTDDRGL

SEQ ID NO: 1529114 - protein, 25 aa, Mycobacterium tuberculosis
RQAVRPARTLAKKGNIPVGYYKDEK

SEQ ID NO: 1529115 - protein, 24 aa, Mycobacterium tuberculosis
RQCERPWPPHQTVRWSRSVRGVRH

SEQ ID NO: 1529116 - protein, 29 aa, Mycobacterium tuberculosis
RQDFVEFTPSHTPLLITNHLPRVPGDDTA

SEQ ID NO: 1529117 - protein, 25 aa, Mycobacterium tuberculosis
RQECERLGLPVFVKPARGGSSIGVS

SEQ ID NO: 1529118 - protein, 26 aa, Mycobacterium tuberculosis
RQEHRPDIRLARWMSTGFRQEPNGGE

SEQ ID NO: 1529119 - protein, 26 aa, Mycobacterium tuberculosis
RQFTRPQRPAPMLRGARAERGHFTDS

SEQ ID NO: 1529120 - protein, 19 aa, Mycobacterium tuberculosis
RQGRHFPDGIRQRRKRADR

SEQ ID NO: 1529121 - protein, 28 aa, Mycobacterium tuberculosis
RQGRQRRRLVAMGPAAAMVRRASAGEWS

SEQ ID NO: 1529122 - protein, 24 aa, Mycobacterium tuberculosis
RQGSYFPDWLLQRRKRAERALTSV

SEQ ID NO: 1529123 - protein, 17 aa, Mycobacterium tuberculosis
RQHEATLLLSPTSSAHI

SEQ ID NO: 1529124 - protein, 22 aa, Mycobacterium tuberculosis
RQHGGRLLVRLAGVADRDAADA

SEQ ID NO: 1529125 - protein, 24 aa, Mycobacterium tuberculosis
RQHGGRLLVRLAGVADRDAADALR

SEQ ID NO: 1529126 - protein, 17 aa, Mycobacterium tuberculosis
RQHPEFWVMSRIVDHPN

SEQ ID NO: 1529127 - protein, 17 aa, Mycobacterium tuberculosis
RQKEFADLLTWLQETLS

SEQ ID NO: 1529128 - protein, 20 aa, Mycobacterium tuberculosis
RQLIAFLSRMTAVDPCRTGR

SEQ ID NO: 1529129 - protein, 26 aa, Mycobacterium tuberculosis
RQLVASGLRSLPADGLKLAPGEPAIP

SEQ ID NO: 1529130 - protein, 17 aa, Mycobacterium tuberculosis
RQMAPSRRSRRACTNSL

SEQ ID NO: 1529131 - protein, 25 aa, Mycobacterium tuberculosis
RQPGRLRIALSTRVPTPLPVRCGKQ

SEQ ID NO: 1529132 - protein, 25 aa, Mycobacterium tuberculosis
RQPHTHPAPLMPAVPAPTRRWGGKR

SEQ ID NO: 1529133 - protein, 23 aa, Mycobacterium tuberculosis
RQPQAHVCHVEFGRIVLGAQRDD

SEQ ID NO: 1529134 - protein, 23 aa, Mycobacterium tuberculosis
RQQALPVGAPEQAVVHAAGDERA

SEQ ID NO: 1529135 - protein, 25 aa, Mycobacterium tuberculosis
RQQTRQVRFKIWDAGYQASVTALRE

SEQ ID NO: 1529136 - protein, 18 aa, Mycobacterium tuberculosis
RQRCCFRPGCFRRRRRDR

SEQ ID NO: 1529137 - protein, 23 aa, Mycobacterium tuberculosis
RQRDQAHVLGRRIGQQPFEIGGH

SEQ ID NO: 1529138 - protein, 30 aa, Mycobacterium tuberculosis
RQRDQWCRNLLGRKLFQRGFLEPQRLLGDS

SEQ ID NO: 1529139 - protein, 24 aa, Mycobacterium tuberculosis
RQRHASLLPLLHNYREPAKPICGS

SEQ ID NO: 1529140 - protein, 22 aa, Mycobacterium tuberculosis
RQRLHVAVQAFFDFIEHDSQGY

SEQ ID NO: 1529141 - protein, 26 aa, Mycobacterium tuberculosis
RQRNGFVLHSPLQFAALGAQARSGAP

SEQ ID NO: 1529142 - protein, 19 aa, Mycobacterium tuberculosis
RQRRIPAVKPQPDPDHRTR

SEQ ID NO: 1529143 - protein, 17 aa, Mycobacterium tuberculosis
RQTPRRCESGFGALKCA

SEQ ID NO: 1529144 - protein, 20 aa, Mycobacterium tuberculosis
RQTRAALTRVLRANIGPASD

SEQ ID NO: 1529145 - protein, 18 aa, Mycobacterium tuberculosis
RQVAERLLPALGFRVRFG

SEQ ID NO: 1529146 - protein, 27 aa, Mycobacterium tuberculosis
RQVAPFLSYGQFTGSAPRDLCALWPVP

SEQ ID NO: 1529147 - protein, 18 aa, Mycobacterium tuberculosis
RQVLDHITFDFEPGEFVA

SEQ ID NO: 1529148 - protein, 18 aa, Mycobacterium tuberculosis
RQVVPYRTFASGDAWPLV

SEQ ID NO: 1529149 - protein, 35 aa, Mycobacterium tuberculosis
RRAELGVRRDLRFRQRGAVDFAMRGDRNLIQHNIG

SEQ ID NO: 1529150 - protein, 23 aa, Mycobacterium tuberculosis
RRAELLVWLNPRAAHPEFQPRAG

SEQ ID NO: 1529151 - protein, 18 aa, Mycobacterium tuberculosis
RRAEVTSLLRFAGGLHIV

SEQ ID NO: 1529152 - protein, 19 aa, Mycobacterium tuberculosis
RRAFRDKIKWRTGSEGRIN

SEQ ID NO: 1529153 - protein, 19 aa, Mycobacterium tuberculosis
RRAFRRIAGAALGKRLREL

SEQ ID NO: 1529154 - protein, 18 aa, Mycobacterium tuberculosis
RRAFSAPLRRAGAVLVTP

SEQ ID NO: 1529155 - protein, 22 aa, Mycobacterium tuberculosis
RRAHGLPAISLGWGLWDQASAM

SEQ ID NO: 1529156 - protein, 23 aa, Mycobacterium tuberculosis
RRAIVPLCALLPTAFRYGVNILA

SEQ ID NO: 1529157 - protein, 30 aa, Mycobacterium tuberculosis
RRASAATFGPLWLPCSPASPQQARKGSAVS

SEQ ID NO: 1529158 - protein, 21 aa, Mycobacterium tuberculosis
RRAWHAYFRDARRAHALYTDV

SEQ ID NO: 1529159 - protein, 20 aa, Mycobacterium tuberculosis
RRAWHAYFRDARRAHAPLYR

SEQ ID NO: 1529160 - protein, 29 aa, Mycobacterium tuberculosis
RRAYLGDLRSLFAFLADRGSSLDALTLSV

SEQ ID NO: 1529161 - protein, 23 aa, Mycobacterium tuberculosis
RRCADVRYLGSWPTGPAAGVQPP

SEQ ID NO: 1529162 - protein, 21 aa, Mycobacterium tuberculosis
RRCGGLRRRRRGCPGGHQFSQ

SEQ ID NO: 1529163 - protein, 25 aa, Mycobacterium tuberculosis
RRCGGRTVTLFRSEWRRPVELSTSV

SEQ ID NO: 1529164 - protein, 17 aa, Mycobacterium tuberculosis
RRCGRCGRKASWYDRGA

SEQ ID NO: 1529165 - protein, 20 aa, Mycobacterium tuberculosis
RRCLLAPPRGGGGHGCHHRG

SEQ ID NO: 1529166 - protein, 20 aa, Mycobacterium tuberculosis
RRDALWAAALQTAISRRTGD

SEQ ID NO: 1529167 - protein, 19 aa, Mycobacterium tuberculosis
RRELGLPPAPAPPVRRLAE

SEQ ID NO: 1529168 - protein, 18 aa, Mycobacterium tuberculosis
RRELLPYSDLDVLLLHDG

SEQ ID NO: 1529169 - protein, 23 aa, Mycobacterium tuberculosis
RRELLSRRDQLTATLAGLCGDEQ

SEQ ID NO: 1529170 - protein, 18 aa, Mycobacterium tuberculosis
RREPARSSPIAGRWPGRS

SEQ ID NO: 1529171 - protein, 29 aa, Mycobacterium tuberculosis
RREPELKALLDRLLAQKLPDGWDADLPHW

SEQ ID NO: 1529172 - protein, 18 aa, Mycobacterium tuberculosis
RRERPSGTRPRRSGASGT

SEQ ID NO: 1529173 - protein, 19 aa, Mycobacterium tuberculosis
RRERPSGTRPRRSGASGTT

SEQ ID NO: 1529174 - protein, 18 aa, Mycobacterium tuberculosis
RRFARERSRWLFSNPEMT

SEQ ID NO: 1529175 - protein, 23 aa, Mycobacterium tuberculosis
RRFDAEVYARRLALAAAATADAG

SEQ ID NO: 1529176 - protein, 18 aa, Mycobacterium tuberculosis
RRFGVSYWTVFDEWAGRA

SEQ ID NO: 1529177 - protein, 17 aa, Mycobacterium tuberculosis
RRFLPGATILKASVGPM

SEQ ID NO: 1529178 - protein, 22 aa, Mycobacterium tuberculosis
RRFPLPDVIWTRLFGVRLVKLL

SEQ ID NO: 1529179 - protein, 26 aa, Mycobacterium tuberculosis
RRFSDHRLILEGIAWRFRTGSPWRDL

SEQ ID NO: 1529180 - protein, 19 aa, Mycobacterium tuberculosis
RRFTSMYRRIVGSAGPITD

SEQ ID NO: 1529181 - protein, 20 aa, Mycobacterium tuberculosis
RRFTSMYRRIVGSAGPITDD

SEQ ID NO: 1529182 - protein, 17 aa, Mycobacterium tuberculosis
RRGAAWGAGVGLAIGLF

SEQ ID NO: 1529183 - protein, 28 aa, Mycobacterium tuberculosis
RRGDQVGQLRALPWSQPHHRGHRHRAGY

SEQ ID NO: 1529184 - protein, 32 aa, Mycobacterium tuberculosis
RRGDTPLPVRTPLPVHLPEPMAAQLRRLRRHR

SEQ ID NO: 1529185 - protein, 24 aa, Mycobacterium tuberculosis
RRGGYNWTGYCGSLIWGTTLCSTK

SEQ ID NO: 1529186 - protein, 21 aa, Mycobacterium tuberculosis
RRGHRVLTRCQMSFVVTIPEA

SEQ ID NO: 1529187 - protein, 31 aa, Mycobacterium tuberculosis
RRGHRVLTRCQMSFVVTIPEALAAVATDLAG

SEQ ID NO: 1529188 - protein, 27 aa, Mycobacterium tuberculosis
RRGIPVVLRSAVLAKLMAGRTTLMVTG

SEQ ID NO: 1529189 - protein, 18 aa, Mycobacterium tuberculosis
RRGQPRQLLTNIADARDH

SEQ ID NO: 1529190 - protein, 31 aa, Mycobacterium tuberculosis
RRGRLVDVIGCSLRLPGIYPPQVYNGRLHVD

SEQ ID NO: 1529191 - protein, 20 aa, Mycobacterium tuberculosis
RRGRPTVWSVWGVGGAILLG

SEQ ID NO: 1529192 - protein, 21 aa, Mycobacterium tuberculosis
RRGRPTVWSVWGVGGAILLRD

SEQ ID NO: 1529193 - protein, 27 aa, Mycobacterium tuberculosis
RRGRVQSVLLPRLLDWMSYAPDPDGGL

SEQ ID NO: 1529194 - protein, 22 aa, Mycobacterium tuberculosis
RRGTPVVAMPLLRGGNKEVHGI

SEQ ID NO: 1529195 - protein, 18 aa, Mycobacterium tuberculosis
RRGVFHNSRRLDNGNWVW

SEQ ID NO: 1529196 - protein, 19 aa, Mycobacterium tuberculosis
RRGVSWRAAELFDAIGSEA

SEQ ID NO: 1529197 - protein, 19 aa, Mycobacterium tuberculosis
RRGWRTIAVAQGFSVRSPN

SEQ ID NO: 1529198 - protein, 19 aa, Mycobacterium tuberculosis
RRHHDELMRLGATAPGATL

SEQ ID NO: 1529199 - protein, 18 aa, Mycobacterium tuberculosis
RRHRSPASVPAHPSATAA

SEQ ID NO: 1529200 - protein, 19 aa, Mycobacterium tuberculosis
RRIHLPGHNLRNGLATRLA

SEQ ID NO: 1529201 - protein, 18 aa, Mycobacterium tuberculosis
RRIHRYRPFPGQRGITRT

SEQ ID NO: 1529202 - protein, 19 aa, Mycobacterium tuberculosis
RRILDINVYGVILGSTLAA

SEQ ID NO: 1529203 - protein, 26 aa, Mycobacterium tuberculosis
RRILEEGAAAFRLLHPRHPQRRRQRA

SEQ ID NO: 1529204 - protein, 17 aa, Mycobacterium tuberculosis
RRLAAPGGALRGCRPRR

SEQ ID NO: 1529205 - protein, 19 aa, Mycobacterium tuberculosis
RRLEADGLVRRVPHPTDGR

SEQ ID NO: 1529206 - protein, 20 aa, Mycobacterium tuberculosis
RRLEAGMMLGWHPYQFPDEP

SEQ ID NO: 1529207 - protein, 34 aa, Mycobacterium tuberculosis
RRLIDDVAQLLLRIGIFSWITHAPKLGGHDSWRL

SEQ ID NO: 1529208 - protein, 23 aa, Mycobacterium tuberculosis
RRLREDPPRRLAGFPATVTDIGD

SEQ ID NO: 1529209 - protein, 20 aa, Mycobacterium tuberculosis
RRLVDALIALRKHCQLSQVE

SEQ ID NO: 1529210 - protein, 17 aa, Mycobacterium tuberculosis
RRMFVPFHDGVISQFEG

SEQ ID NO: 1529211 - protein, 17 aa, Mycobacterium tuberculosis
RRNGRYFPAPGVKPHAA

SEQ ID NO: 1529212 - protein, 20 aa, Mycobacterium tuberculosis
RRPRWLDVPGHHRALPQRRR

SEQ ID NO: 1529213 - protein, 17 aa, Mycobacterium tuberculosis
RRPSLDHVFLAMTTDPT

SEQ ID NO: 1529214 - protein, 19 aa, Mycobacterium tuberculosis
RRPVLEGAGLGHPENLCRP

SEQ ID NO: 1529215 - protein, 18 aa, Mycobacterium tuberculosis
RRPVRRVLLFVVPSSGPA

SEQ ID NO: 1529216 - protein, 25 aa, Mycobacterium tuberculosis
RRPWRRSPERPSSWYRRPRTPINST

SEQ ID NO: 1529217 - protein, 21 aa, Mycobacterium tuberculosis
RRPWYLAAQAGTGGGQLNDSA

SEQ ID NO: 1529218 - protein, 18 aa, Mycobacterium tuberculosis
RRPYDLTLLTTPDVPWDA

SEQ ID NO: 1529219 - protein, 20 aa, Mycobacterium tuberculosis
RRPYRPPPRPNSEALKAVVA

SEQ ID NO: 1529220 - protein, 21 aa, Mycobacterium tuberculosis
RRQLLELYGAQIIFSAAEGGS

SEQ ID NO: 1529221 - protein, 19 aa, Mycobacterium tuberculosis
RRQLWHFGLDPEEVAGFLA

SEQ ID NO: 1529222 - protein, 25 aa, Mycobacterium tuberculosis
RRQPTRFPMSWSTTPSLATTPCPYR

SEQ ID NO: 1529223 - protein, 30 aa, Mycobacterium tuberculosis
RRQQGCHTMSLDWVAWRGLGLAADAQLVSE

SEQ ID NO: 1529224 - protein, 22 aa, Mycobacterium tuberculosis
RRQRSWFRRDHRVHWLDAGVAS

SEQ ID NO: 1529225 - protein, 36 aa, Mycobacterium tuberculosis
RRRAGSHRWRRWRRRGRYHWNPAVPAPPAATHWGCS

SEQ ID NO: 1529226 - protein, 21 aa, Mycobacterium tuberculosis
RRRARFRRRSDITAGRAAVGG

SEQ ID NO: 1529227 - protein, 17 aa, Mycobacterium tuberculosis
RRRCLADLLSSQRPLPR

SEQ ID NO: 1529228 - protein, 33 aa, Mycobacterium tuberculosis
RRRCRGLIPGRIPGPVVWGWTFCRTSSACAELV

SEQ ID NO: 1529229 - protein, 26 aa, Mycobacterium tuberculosis
RRRCRRVWRRYRRQWRCRRQRRADRQ

SEQ ID NO: 1529230 - protein, 23 aa, Mycobacterium tuberculosis
RRRGENIGLTTVYRTLQSMVSSG

SEQ ID NO: 1529231 - protein, 29 aa, Mycobacterium tuberculosis
RRRGGGGQCWFWQCRHQQLWLGEHGCGQY

SEQ ID NO: 1529232 - protein, 18 aa, Mycobacterium tuberculosis
RRRIRTGDQPLALVTAYI

SEQ ID NO: 1529233 - protein, 20 aa, Mycobacterium tuberculosis
RRRLPLQPPAPHRPFAAGRA

SEQ ID NO: 1529234 - protein, 24 aa, Mycobacterium tuberculosis
RRRPRLRGGLADRPLLTIFGQFND

SEQ ID NO: 1529235 - protein, 21 aa, Mycobacterium tuberculosis
RRRPSWLSSRWSPLVNDPSPT

SEQ ID NO: 1529236 - protein, 23 aa, Mycobacterium tuberculosis
RRRQRRCPADSGTRTRRALPVGS

SEQ ID NO: 1529237 - protein, 20 aa, Mycobacterium tuberculosis
RRRRALWVGVTLDGAVDRAT

SEQ ID NO: 1529238 - protein, 32 aa, Mycobacterium tuberculosis
RRRRASAATFGPLWLPCSPASPQQARKGSAVS

SEQ ID NO: 1529239 - protein, 18 aa, Mycobacterium tuberculosis
RRRRHGIGGTACSTSAFG

SEQ ID NO: 1529240 - protein, 24 aa, Mycobacterium tuberculosis
RRRRLQDLRLCRCQLLAGHGHTGR

SEQ ID NO: 1529241 - protein, 17 aa, Mycobacterium tuberculosis
RRRRRNSAFADGGQGGP

SEQ ID NO: 1529242 - protein, 20 aa, Mycobacterium tuberculosis
RRRRRRRRRPTHAQDGFAAR

SEQ ID NO: 1529243 - protein, 19 aa, Mycobacterium tuberculosis
RRRRRVTRRGYGDEFMDMN

SEQ ID NO: 1529244 - protein, 21 aa, Mycobacterium tuberculosis
RRRRRVTRRGYGDEFMDMNID

SEQ ID NO: 1529245 - protein, 26 aa, Mycobacterium tuberculosis
RRRRRWPGWVRWHRGQRQRHWRRAPA

SEQ ID NO: 1529246 - protein, 26 aa, Mycobacterium tuberculosis
RRRRWCRRQRVAIRQRWGRGARRGRR

SEQ ID NO: 1529247 - protein, 25 aa, Mycobacterium tuberculosis
RRRWCRRQRVAIRQRWGRGARRGRR

SEQ ID NO: 1529248 - protein, 21 aa, Mycobacterium tuberculosis
RRSFILVPGIDVPFHSRVLRV

SEQ ID NO: 1529249 - protein, 18 aa, Mycobacterium tuberculosis
RRSPATRAYRLPAGRRAA

SEQ ID NO: 1529250 - protein, 21 aa, Mycobacterium tuberculosis
RRSPLLQHRRRIPGGRGFGGV

SEQ ID NO: 1529251 - protein, 26 aa, Mycobacterium tuberculosis
RRSTVLAMPMLLPPMLTPPKLRSPRL

SEQ ID NO: 1529252 - protein, 26 aa, Mycobacterium tuberculosis
RRTGIEMAWSEGRDLWWHHVVGAASP

SEQ ID NO: 1529253 - protein, 19 aa, Mycobacterium tuberculosis
RRTITYPDQLPHWYLHCYL

SEQ ID NO: 1529254 - protein, 24 aa, Mycobacterium tuberculosis
RRTPPRLPPGFRRIAVRPEAALPP

SEQ ID NO: 1529255 - protein, 27 aa, Mycobacterium tuberculosis
RRTRSLCRIIWPSLWIRDQADVYTVDF

SEQ ID NO: 1529256 - protein, 28 aa, Mycobacterium tuberculosis
RRVADVLGIPFYVWDFAEKFKEDVINDF

SEQ ID NO: 1529257 - protein, 21 aa, Mycobacterium tuberculosis
RRVAVVACEFDFLGGSIGVAA

SEQ ID NO: 1529258 - protein, 20 aa, Mycobacterium tuberculosis
RRVFAPKVTGSWRLHVATPA

SEQ ID NO: 1529259 - protein, 18 aa, Mycobacterium tuberculosis
RRVFHDVDILLMPSAGIA

SEQ ID NO: 1529260 - protein, 18 aa, Mycobacterium tuberculosis
RRVRAVGLTALAGDEFGN

SEQ ID NO: 1529261 - protein, 21 aa, Mycobacterium tuberculosis
RRVRSRLARLAGIGLGCGDPA

SEQ ID NO: 1529262 - protein, 26 aa, Mycobacterium tuberculosis
RRVVDKLLHAPTVRIKQLASAPGGDS

SEQ ID NO: 1529263 - protein, 17 aa, Mycobacterium tuberculosis
RRWGAHERAQLLVGPKA

SEQ ID NO: 1529264 - protein, 22 aa, Mycobacterium tuberculosis
RRWRAVVRSAARQSRRARIPPV

SEQ ID NO: 1529265 - protein, 23 aa, Mycobacterium tuberculosis
RRWRGGRAFLFGDGGAGGAALSA

SEQ ID NO: 1529266 - protein, 21 aa, Mycobacterium tuberculosis
RRWSQYLAWVADHIGLKVIHG

SEQ ID NO: 1529267 - protein, 17 aa, Mycobacterium tuberculosis
RRYRRLAADQVLEAARR

SEQ ID NO: 1529268 - protein, 23 aa, Mycobacterium tuberculosis
RSAALPRWRGAAGRLEVWYATLS

SEQ ID NO: 1529269 - protein, 18 aa, Mycobacterium tuberculosis
RSADAIYLLYTGGTTGFP

SEQ ID NO: 1529270 - protein, 25 aa, Mycobacterium tuberculosis
RSADLADLFMLIFTSGTSGDPKAVK

SEQ ID NO: 1529271 - protein, 22 aa, Mycobacterium tuberculosis
RSAFVQLVLSNVFGQNAPAIAA

SEQ ID NO: 1529272 - protein, 17 aa, Mycobacterium tuberculosis
RSAGLSESGWIPVDPRT

SEQ ID NO: 1529273 - protein, 18 aa, Mycobacterium tuberculosis
RSAGWRPPAAATTWGRSS

SEQ ID NO: 1529274 - protein, 17 aa, Mycobacterium tuberculosis
RSASARALPGSGLGLAI

SEQ ID NO: 1529275 - protein, 25 aa, Mycobacterium tuberculosis
RSCRNRRLPLRRLGAGVGRIAGSPK

SEQ ID NO: 1529276 - protein, 17 aa, Mycobacterium tuberculosis
RSCTGWPSGVWIDQPRR

SEQ ID NO: 1529277 - protein, 28 aa, Mycobacterium tuberculosis
RSDALAARLPLAYALGWQGRGREADAVL

SEQ ID NO: 1529278 - protein, 27 aa, Mycobacterium tuberculosis
RSDGNIFQQLPFALAPGPPVPTTALRE

SEQ ID NO: 1529279 - protein, 24 aa, Mycobacterium tuberculosis
RSEGGGMLVLKRSTTPAATATRSW

SEQ ID NO: 1529280 - protein, 18 aa, Mycobacterium tuberculosis
RSELLTQYLPATPDGLVD

SEQ ID NO: 1529281 - protein, 36 aa, Mycobacterium tuberculosis
RSEVGPGLLLPIYIGVRLRRRCLDAVAFTGVGIVVR

SEQ ID NO: 1529282 - protein, 17 aa, Mycobacterium tuberculosis
RSFIHRFLDLRRSPGML

SEQ ID NO: 1529283 - protein, 18 aa, Mycobacterium tuberculosis
RSFIHRFLDLRRSPGMLT

SEQ ID NO: 1529284 - protein, 24 aa, Mycobacterium tuberculosis
RSGERPMVWSLDERLRMVARPMIN

SEQ ID NO: 1529285 - protein, 30 aa, Mycobacterium tuberculosis
RSGFVVNALLVPYLLSAIRMVEAGFATVED

SEQ ID NO: 1529286 - protein, 31 aa, Mycobacterium tuberculosis
RSGRNRGRRWPRRAADRRRRRRRRGRSRWYR

SEQ ID NO: 1529287 - protein, 27 aa, Mycobacterium tuberculosis
RSGVAFDILRRWLLARGYDVAFIRNVT

SEQ ID NO: 1529288 - protein, 27 aa, Mycobacterium tuberculosis
RSIPGVTEKWDLYLRGIELAAGYSELS

SEQ ID NO: 1529289 - protein, 22 aa, Mycobacterium tuberculosis
RSIRRSWSTPRPAARLRAGDGG

SEQ ID NO: 1529290 - protein, 29 aa, Mycobacterium tuberculosis
RSKNRALPASPPLPPFTAGTTRCCLRVHR

SEQ ID NO: 1529291 - protein, 30 aa, Mycobacterium tuberculosis
RSKPIEPSPYLPTSRRFVNPLYLRVEAIPE

SEQ ID NO: 1529292 - protein, 31 aa, Mycobacterium tuberculosis
RSKPIEPSPYLPTSRRFVNPLYLRVEAIPEL

SEQ ID NO: 1529293 - protein, 22 aa, Mycobacterium tuberculosis
RSLGYTGNFFQAAGPWLKNALI

SEQ ID NO: 1529294 - protein, 19 aa, Mycobacterium tuberculosis
RSLRQIGQFIRDATADSSL

SEQ ID NO: 1529295 - protein, 22 aa, Mycobacterium tuberculosis
RSLVDLFEALFVPVPSGSASNR

SEQ ID NO: 1529296 - protein, 22 aa, Mycobacterium tuberculosis
RSLVRPDRVRLGAHLIECTVCR

SEQ ID NO: 1529297 - protein, 18 aa, Mycobacterium tuberculosis
RSMIRDGLTMRHGKELTW

SEQ ID NO: 1529298 - protein, 24 aa, Mycobacterium tuberculosis
RSNSRLPTTLNARDQPPAEVSDQR

SEQ ID NO: 1529299 - protein, 26 aa, Mycobacterium tuberculosis
RSPAGPPVRTWPRWPRFRRMIRRCSR

SEQ ID NO: 1529300 - protein, 34 aa, Mycobacterium tuberculosis
RSPEGLKRNLRLRDGRWHWHWDPAMMTAPGHDPQ

SEQ ID NO: 1529301 - protein, 21 aa, Mycobacterium tuberculosis
RSPGGSPDRRLGRRRSLLATN

SEQ ID NO: 1529302 - protein, 18 aa, Mycobacterium tuberculosis
RSPIPITELQRQAAERGL

SEQ ID NO: 1529303 - protein, 17 aa, Mycobacterium tuberculosis
RSPTWPGCRLRCTPTLS

SEQ ID NO: 1529304 - protein, 27 aa, Mycobacterium tuberculosis
RSPVWTGHMCILLRRLCKVHPVPAIIG

SEQ ID NO: 1529305 - protein, 29 aa, Mycobacterium tuberculosis
RSPVWTGHMCILLRRLCKVHPVPAIIGES

SEQ ID NO: 1529306 - protein, 22 aa, Mycobacterium tuberculosis
RSPWAAPWTIDANVSALAALLD

SEQ ID NO: 1529307 - protein, 23 aa, Mycobacterium tuberculosis
RSQARILGIFVDGKRVPVVAHGV

SEQ ID NO: 1529308 - protein, 22 aa, Mycobacterium tuberculosis
RSQRLSVFELQARAILGLAVDT

SEQ ID NO: 1529309 - protein, 19 aa, Mycobacterium tuberculosis
RSRATLRRLYRHPRSGALG

SEQ ID NO: 1529310 - protein, 18 aa, Mycobacterium tuberculosis
RSRAVTPSMCQWVHIVGG

SEQ ID NO: 1529311 - protein, 21 aa, Mycobacterium tuberculosis
RSRTRLPGWSPRARPAVVVDC

SEQ ID NO: 1529312 - protein, 17 aa, Mycobacterium tuberculosis
RSRTRPMAPTALPDPMA

SEQ ID NO: 1529313 - protein, 29 aa, Mycobacterium tuberculosis
RSRVVAIIAVNCSWLLGSFGLGAGDVGHE

SEQ ID NO: 1529314 - protein, 19 aa, Mycobacterium tuberculosis
RSRWLFSNPEMTHLSVLRN

SEQ ID NO: 1529315 - protein, 18 aa, Mycobacterium tuberculosis
RSSAKKMRARWRTPMNCG

SEQ ID NO: 1529316 - protein, 22 aa, Mycobacterium tuberculosis
RSSASFPLAFEPSFLPFTKGTA

SEQ ID NO: 1529317 - protein, 18 aa, Mycobacterium tuberculosis
RSSHTWFVLRELLGHQNV

SEQ ID NO: 1529318 - protein, 17 aa, Mycobacterium tuberculosis
RSSLIGGIRYYDTVVDD

SEQ ID NO: 1529319 - protein, 17 aa, Mycobacterium tuberculosis
RSSRTPVFPGRQADRVR

SEQ ID NO: 1529320 - protein, 26 aa, Mycobacterium tuberculosis
RSSSEGFLIFKQPLLRSLVVVCNVEN

SEQ ID NO: 1529321 - protein, 19 aa, Mycobacterium tuberculosis
RSTPGLRYRIYRPAVVVGD

SEQ ID NO: 1529322 - protein, 29 aa, Mycobacterium tuberculosis
RSTTDTVLRFLGGRPALVVLDNCEHLLDA

SEQ ID NO: 1529323 - protein, 20 aa, Mycobacterium tuberculosis
RSTTVAMHLLRRTLSGIPGS

SEQ ID NO: 1529324 - protein, 24 aa, Mycobacterium tuberculosis
RSVCRLLTVRRTLAWVRVESLQLP

SEQ ID NO: 1529325 - protein, 17 aa, Mycobacterium tuberculosis
RSVLQWDKDDCAAIGLV

SEQ ID NO: 1529326 - protein, 22 aa, Mycobacterium tuberculosis
RSVRAQTLPPGRGLLVGADGDV

SEQ ID NO: 1529327 - protein, 22 aa, Mycobacterium tuberculosis
RSWAETLWRMSVSIAGAVCTAA

SEQ ID NO: 1529328 - protein, 18 aa, Mycobacterium tuberculosis
RSWLLRQASSGVSAATVV

SEQ ID NO: 1529329 - protein, 17 aa, Mycobacterium tuberculosis
RSYLAPPTRPAPTEPPP

SEQ ID NO: 1529330 - protein, 17 aa, Mycobacterium tuberculosis
RSYLGPEFDIHCGGMDL

SEQ ID NO: 1529331 - protein, 21 aa, Mycobacterium tuberculosis
RSYVNIGFWSSVPVGATEGAT

SEQ ID NO: 1529332 - protein, 27 aa, Mycobacterium tuberculosis
RTAAQFGIEPWVAMLSYSTGDSGKGAD

SEQ ID NO: 1529333 - protein, 23 aa, Mycobacterium tuberculosis
RTAMSFVIANPEMLAAAATDLAG

SEQ ID NO: 1529334 - protein, 26 aa, Mycobacterium tuberculosis
RTANDLHLLVPNPYSFPSKSAHRAPS

SEQ ID NO: 1529335 - protein, 18 aa, Mycobacterium tuberculosis
RTARRGWRTIAVAQGFSV

SEQ ID NO: 1529336 - protein, 25 aa, Mycobacterium tuberculosis
RTDEQWRWLAHTLTVELLKELLPET

SEQ ID NO: 1529337 - protein, 19 aa, Mycobacterium tuberculosis
RTDFALVHAWQGDRHGNLM

SEQ ID NO: 1529338 - protein, 25 aa, Mycobacterium tuberculosis
RTDLLAFTAFPKKIWRQIWSNNPQE

SEQ ID NO: 1529339 - protein, 18 aa, Mycobacterium tuberculosis
RTDLLAFTAFPKQIWRQI

SEQ ID NO: 1529340 - protein, 17 aa, Mycobacterium tuberculosis
RTDRVRRWKPFSSARCP

SEQ ID NO: 1529341 - protein, 17 aa, Mycobacterium tuberculosis
RTDVVGIFPDRASIIRL

SEQ ID NO: 1529342 - protein, 18 aa, Mycobacterium tuberculosis
RTDVVGIFPDRASIIRLV

SEQ ID NO: 1529343 - protein, 20 aa, Mycobacterium tuberculosis
RTEPPVAILAAPQQAMHLQR

SEQ ID NO: 1529344 - protein, 18 aa, Mycobacterium tuberculosis
RTFQACSGAPRAIVHFYN

SEQ ID NO: 1529345 - protein, 23 aa, Mycobacterium tuberculosis
RTGELIPLCHRWGSRRSPSRSSR

SEQ ID NO: 1529346 - protein, 25 aa, Mycobacterium tuberculosis
RTGIEMAWSEGRDLWWHHVVGSASP

SEQ ID NO: 1529347 - protein, 26 aa, Mycobacterium tuberculosis
RTGKFRQQTLDRWLAGASATRPHHVI

SEQ ID NO: 1529348 - protein, 24 aa, Mycobacterium tuberculosis
RTGQALLGDARWLASIATPGRDEV

SEQ ID NO: 1529349 - protein, 24 aa, Mycobacterium tuberculosis
RTGRITPFAFMTPVKVAGSTVGQA

SEQ ID NO: 1529350 - protein, 24 aa, Mycobacterium tuberculosis
RTHYFDNFFLDATRAGIRQAVILA

SEQ ID NO: 1529351 - protein, 19 aa, Mycobacterium tuberculosis
RTIGGVYPRGPPLTDDRGL

SEQ ID NO: 1529352 - protein, 18 aa, Mycobacterium tuberculosis
RTIRLPVHLVEQVNKLAR

SEQ ID NO: 1529353 - protein, 24 aa, Mycobacterium tuberculosis
RTITDACQILLILKDNLAGHHREL

SEQ ID NO: 1529354 - protein, 30 aa, Mycobacterium tuberculosis
RTIYQNLGWAFGYNTAAIPLAALGALNPVV

SEQ ID NO: 1529355 - protein, 19 aa, Mycobacterium tuberculosis
RTLACLPGEYGPNLAVMAA

SEQ ID NO: 1529356 - protein, 24 aa, Mycobacterium tuberculosis
RTLGHIEFPYVYLDATYLNVRNGT

SEQ ID NO: 1529357 - protein, 18 aa, Mycobacterium tuberculosis
RTLIARDLDAAYRSVDVL

SEQ ID NO: 1529358 - protein, 17 aa, Mycobacterium tuberculosis
RTLLDPVGGVRKYVIKP

SEQ ID NO: 1529359 - protein, 28 aa, Mycobacterium tuberculosis
RTLSKLVRHHLLLPITATRRDLNDPKTI

SEQ ID NO: 1529360 - protein, 21 aa, Mycobacterium tuberculosis
RTNLYTPLQAAKLAKETSSNK

SEQ ID NO: 1529361 - protein, 26 aa, Mycobacterium tuberculosis
RTPATPPPRGSFSSSWRPGDDAFGPR

SEQ ID NO: 1529362 - protein, 18 aa, Mycobacterium tuberculosis
RTPGVPRPGLSPIFIPAL

SEQ ID NO: 1529363 - protein, 23 aa, Mycobacterium tuberculosis
RTPSITWVLSWSNNGFPAFTSTR

SEQ ID NO: 1529364 - protein, 18 aa, Mycobacterium tuberculosis
RTPTIGIISTTYADLHTQ

SEQ ID NO: 1529365 - protein, 19 aa, Mycobacterium tuberculosis
RTPWNTYMAQGLPATAICS

SEQ ID NO: 1529366 - protein, 30 aa, Mycobacterium tuberculosis; identical to SEQ ID NO: 1389247

SEQ ID NO: 1529367 - protein, 27 aa, Mycobacterium tuberculosis
RTRACQSGVRLVPPPRHVRAEVAETRA

SEQ ID NO: 1529368 - protein, 20 aa, Mycobacterium tuberculosis
RTRFVLVGRPGPPPARTGAD

SEQ ID NO: 1529369 - protein, 17 aa, Mycobacterium tuberculosis
RTRLWRPQRFRHHGAAG

SEQ ID NO: 1529370 - protein, 20 aa, Mycobacterium tuberculosis
RTRNLPLIGAPANPGAGPRI

SEQ ID NO: 1529371 - protein, 24 aa, Mycobacterium tuberculosis
RTRPLDAGPYTFLAADALVLKVRE

SEQ ID NO: 1529372 - protein, 19 aa, Mycobacterium tuberculosis
RTRRPAITSCFRSTNMRNT

SEQ ID NO: 1529373 - protein, 19 aa, Mycobacterium tuberculosis
RTRRRWPPNIQLKAYYLPS

SEQ ID NO: 1529374 - protein, 26 aa, Mycobacterium tuberculosis
RTRRVTRLVLVVPFEGHKDIFNLRPD

SEQ ID NO: 1529375 - protein, 21 aa, Mycobacterium tuberculosis
RTRTILTLDRRHFSALRPIGG

SEQ ID NO: 1529376 - protein, 21 aa, Mycobacterium tuberculosis
RTRYRLLETVRRYALEKLGDS

SEQ ID NO: 1529377 - protein, 22 aa, Mycobacterium tuberculosis
RTRYRLLETVRRYALEKLGDSG

SEQ ID NO: 1529378 - protein, 22 aa, Mycobacterium tuberculosis
RTSAPNVWALGDVASWRDPMGH

SEQ ID NO: 1529379 - protein, 26 aa, Mycobacterium tuberculosis
RTSYTFDRLVRVYPHIVRLRPAPHSR

SEQ ID NO: 1529380 - protein, 17 aa, Mycobacterium tuberculosis
RTVAIPRKGRPSQARRA

SEQ ID NO: 1529381 - protein, 20 aa, Mycobacterium tuberculosis
RTVRARRFAAAGLVILAGVA

SEQ ID NO: 1529382 - protein, 17 aa, Mycobacterium tuberculosis
RTVRIGDWPAAYAIGEH

SEQ ID NO: 1529383 - protein, 17 aa, Mycobacterium tuberculosis
RTWCGHGVFAHNLVKIS

SEQ ID NO: 1529384 - protein, 17 aa, Mycobacterium tuberculosis
RTWPDRVIDRAPLWCAV

SEQ ID NO: 1529385 - protein, 19 aa, Mycobacterium tuberculosis
RTWVPWTAVLVNVATRDCW

SEQ ID NO: 1529386 - protein, 17 aa, Mycobacterium tuberculosis
RTYFLNFDTIGSPELIM

SEQ ID NO: 1529387 - protein, 17 aa, Mycobacterium tuberculosis
RVAARRRGTGGAVAAGT

SEQ ID NO: 1529388 - protein, 23 aa, Mycobacterium tuberculosis
RVAAVFLRELLAADLQPVVERVA

SEQ ID NO: 1529389 - protein, 18 aa, Mycobacterium tuberculosis
RVACLLDERPPRPVLVEL

SEQ ID NO: 1529390 - protein, 22 aa, Mycobacterium tuberculosis
RVAGLIARVQLPPSPAGAVQEL

SEQ ID NO: 1529391 - protein, 21 aa, Mycobacterium tuberculosis
RVAGVHFLMKKNKITEIHGYG

SEQ ID NO: 1529392 - protein, 18 aa, Mycobacterium tuberculosis
RVALLRKTVGETWGLPSP

SEQ ID NO: 1529393 - protein, 19 aa, Mycobacterium tuberculosis
RVARQLGFLRVADSDLIDI

SEQ ID NO: 1529394 - protein, 17 aa, Mycobacterium tuberculosis
RVARRFGRVLLKLGGNN

SEQ ID NO: 1529395 - protein, 30 aa, Mycobacterium tuberculosis
RVCDIHLDVPLYWQCWKLDSPIIARITDTV

SEQ ID NO: 1529396 - protein, 19 aa, Mycobacterium tuberculosis
RVCGYEITPALRGVPPRGV

SEQ ID NO: 1529397 - protein, 22 aa, Mycobacterium tuberculosis
RVCGYEITPALRGVPTPGLGRI

SEQ ID NO: 1529398 - protein, 17 aa, Mycobacterium tuberculosis
RVCVDLLKPRKAQPLLP

SEQ ID NO: 1529399 - protein, 26 aa, Mycobacterium tuberculosis
RVDAAGGVLVFLATPRGTHVCVELPL

SEQ ID NO: 1529400 - protein, 22 aa, Mycobacterium tuberculosis
RVDGAVLPWSLHITTNDAAVMG

SEQ ID NO: 1529401 - protein, 24 aa, Mycobacterium tuberculosis
RVDHPLFARIWPVVAAHEAEAIRA

SEQ ID NO: 1529402 - protein, 17 aa, Mycobacterium tuberculosis
RVDIAIVGLSTRFPGEM

SEQ ID NO: 1529403 - protein, 24 aa, Mycobacterium tuberculosis
RVDPAFRREPLPSRPGLGRSRPRP

SEQ ID NO: 1529404 - protein, 18 aa, Mycobacterium tuberculosis
RVDPTRAADPGLAYSAWV

SEQ ID NO: 1529405 - protein, 31 aa, Mycobacterium tuberculosis
RVDRLLDPGSPFLELAPLAAGGMYGDESPGA

SEQ ID NO: 1529406 - protein, 18 aa, Mycobacterium tuberculosis
RVDRQRWRRGSRRARRER

SEQ ID NO: 1529407 - protein, 27 aa, Mycobacterium tuberculosis
RVDRREQILCRFVPGPPQIGRQLVQGG

SEQ ID NO: 1529408 - protein, 17 aa, Mycobacterium tuberculosis
RVDVVQPVLFAVMVSLA

SEQ ID NO: 1529409 - protein, 26 aa, Mycobacterium tuberculosis
RVECEYFVRQPFPLRTRGLSRCILGA

SEQ ID NO: 1529410 - protein, 18 aa, Mycobacterium tuberculosis
RVELLPQLRLGSTTCWSS

SEQ ID NO: 1529411 - protein, 17 aa, Mycobacterium tuberculosis
RVEVEVGFILAADLPGA

SEQ ID NO: 1529412 - protein, 17 aa, Mycobacterium tuberculosis
RVFLPGGDRIISAGLES

SEQ ID NO: 1529413 - protein, 18 aa, Mycobacterium tuberculosis
RVGALLALAALIHRDRTG

SEQ ID NO: 1529414 - protein, 21 aa, Mycobacterium tuberculosis
RVGARIVVVTHLATDAALSET

SEQ ID NO: 1529415 - protein, 29 aa, Mycobacterium tuberculosis
RVGEGFVGLRVVPWLWGAPPTDRRYYPLF

SEQ ID NO: 1529416 - protein, 24 aa, Mycobacterium tuberculosis
RVGFAWVPLLAFVRLATKVGLFPR

SEQ ID NO: 1529417 - protein, 20 aa, Mycobacterium tuberculosis
RVGSYLRYGAYPYAIAVREY

SEQ ID NO: 1529418 - protein, 25 aa, Mycobacterium tuberculosis
RVGVTWWKEHRFLDEIPLSAFFGTG

SEQ ID NO: 1529419 - protein, 18 aa, Mycobacterium tuberculosis
RVHAVLLARAPRSAGHWL

SEQ ID NO: 1529420 - protein, 19 aa, Mycobacterium tuberculosis
RVHGPLALAVGRRLRDRYG

SEQ ID NO: 1529421 - protein, 17 aa, Mycobacterium tuberculosis
RVHPTGKAVLRLSVQTQ

SEQ ID NO: 1529422 - protein, 17 aa, Mycobacterium tuberculosis
RVHRAPGAPAAFAGQGF

SEQ ID NO: 1529423 - protein, 20 aa, Mycobacterium tuberculosis
RVHRRRPCRLERAGHRLGLG

SEQ ID NO: 1529424 - protein, 18 aa, Mycobacterium tuberculosis
RVIALWSDKGKHVALASV

SEQ ID NO: 1529425 - protein, 19 aa, Mycobacterium tuberculosis
RVIAPCFSLFDVYTDIAFP

SEQ ID NO: 1529426 - protein, 21 aa, Mycobacterium tuberculosis
RVIDRAPLWCAVDLRDGNQAL

SEQ ID NO: 1529427 - protein, 19 aa, Mycobacterium tuberculosis
RVIELLLVTAIPAMLLADR

SEQ ID NO: 1529428 - protein, 17 aa, Mycobacterium tuberculosis
RVILRRAGKGNKEPRNV

SEQ ID NO: 1529429 - protein, 17 aa, Mycobacterium tuberculosis
RVIPDLAIREALENLWS

SEQ ID NO: 1529430 - protein, 20 aa, Mycobacterium tuberculosis
RVLAIWPDWVRRWPTPSATA

SEQ ID NO: 1529431 - protein, 18 aa, Mycobacterium tuberculosis
RVLARWHSVNRVLVRTSG

SEQ ID NO: 1529432 - protein, 18 aa, Mycobacterium tuberculosis
RVLDVLLGNRRSALQIAA

SEQ ID NO: 1529433 - protein, 19 aa, Mycobacterium tuberculosis
RVLGGAVALLRDLLNPDEV

SEQ ID NO: 1529434 - protein, 27 aa, Mycobacterium tuberculosis
RVLHNYRPQFYFRPTDVTGVVTLPEGT

SEQ ID NO: 1529435 - protein, 18 aa, Mycobacterium tuberculosis
RVLLCLPDSPDLVQLLLA

SEQ ID NO: 1529436 - protein, 17 aa, Mycobacterium tuberculosis
RVLPWATSSGHHHSARM

SEQ ID NO: 1529437 - protein, 20 aa, Mycobacterium tuberculosis
RVLQPLGLHKVANPDLCGFA

SEQ ID NO: 1529438 - protein, 18 aa, Mycobacterium tuberculosis
RVLVLPEKHQLGLGDPHE

SEQ ID NO: 1529439 - protein, 17 aa, Mycobacterium tuberculosis
RVMAEHVELPRGGRLGA

SEQ ID NO: 1529440 - protein, 25 aa, Mycobacterium tuberculosis
RVNSTLRLPLGLVGKGGDGGKRGHR

SEQ ID NO: 1529441 - protein, 17 aa, Mycobacterium tuberculosis
RVPMPPPRASVARTVVK

SEQ ID NO: 1529442 - protein, 23 aa, Mycobacterium tuberculosis
RVPRRLLFRGRGRRRGLTAWPGA

SEQ ID NO: 1529443 - protein, 18 aa, Mycobacterium tuberculosis
RVPTSSAAEWRWSAAVPA

SEQ ID NO: 1529444 - protein, 17 aa, Mycobacterium tuberculosis
RVQKAQKQARRWSRDTV

SEQ ID NO: 1529445 - protein, 19 aa, Mycobacterium tuberculosis
RVQLLRDYGSAASPFNAFL

SEQ ID NO: 1529446 - protein, 32 aa, Mycobacterium tuberculosis
RVQTGAPLPTLADAVLPLRWTDGGMSRVRVLR

SEQ ID NO: 1529447 - protein, 19 aa, Mycobacterium tuberculosis
RVRARDRFASRVNIEVAPH

SEQ ID NO: 1529448 - protein, 20 aa, Mycobacterium tuberculosis
RVRDPRLRRALTPDYEPMCK

SEQ ID NO: 1529449 - protein, 18 aa, Mycobacterium tuberculosis
RVREGFVMRLAIVGTALL

SEQ ID NO: 1529450 - protein, 18 aa, Mycobacterium tuberculosis
RVRLGAHLIECTVCRGGG

SEQ ID NO: 1529451 - protein, 19 aa, Mycobacterium tuberculosis
RVRNNFSWLNSYYDDMAWL

SEQ ID NO: 1529452 - protein, 20 aa, Mycobacterium tuberculosis
RVRNNFSWLNSYYDDMAWLA

SEQ ID NO: 1529453 - protein, 18 aa, Mycobacterium tuberculosis
RVRPVLPDPVGLLRCAGG

SEQ ID NO: 1529454 - protein, 18 aa, Mycobacterium tuberculosis
RVRRGRRGRRAALRRRRG

SEQ ID NO: 1529455 - protein, 25 aa, Mycobacterium tuberculosis
RVRRWMRRRYLLLEVPQLPGRGWVE

SEQ ID NO: 1529456 - protein, 20 aa, Mycobacterium tuberculosis
RVRSRLARLAGIGLGCGDPA

SEQ ID NO: 1529457 - protein, 17 aa, Mycobacterium tuberculosis
RVRTWLLAVSNVFGQNA

SEQ ID NO: 1529458 - protein, 18 aa, Mycobacterium tuberculosis
RVRWCRRPQRAAVRRAGG

SEQ ID NO: 1529459 - protein, 20 aa, Mycobacterium tuberculosis
RVRWRRTQLPVGTSQRRRQS

SEQ ID NO: 1529460 - protein, 25 aa, Mycobacterium tuberculosis
RVSADELMAAARRLSRLPVVAAVGK

SEQ ID NO: 1529461 - protein, 25 aa, Mycobacterium tuberculosis
RVSADELMAAPRRLSRLPVVAAVGK

SEQ ID NO: 1529462 - protein, 21 aa, Mycobacterium tuberculosis
RVSKMTVYRLVHNGELPAVRV

SEQ ID NO: 1529463 - protein, 17 aa, Mycobacterium tuberculosis
RVSLACALVGRPDLLVL

SEQ ID NO: 1529464 - protein, 18 aa, Mycobacterium tuberculosis
RVSPYPAVFQDVSLVVAA

SEQ ID NO: 1529465 - protein, 17 aa, Mycobacterium tuberculosis
RVSRSGWYGIDPVPADL

SEQ ID NO: 1529466 - protein, 24 aa, Mycobacterium tuberculosis
RVSVPPGCVCPLQIALTKVAAEEH

SEQ ID NO: 1529467 - protein, 24 aa, Mycobacterium tuberculosis
RVTADVTLTRAWCLRELGDDDAAR

SEQ ID NO: 1529468 - protein, 21 aa, Mycobacterium tuberculosis
RVTFAAFPWRWVGGDGCIVRL

SEQ ID NO: 1529469 - protein, 18 aa, Mycobacterium tuberculosis
RVTRNAPPFLVIHGSRDC

SEQ ID NO: 1529470 - protein, 19 aa, Mycobacterium tuberculosis
RVTWNPSGMYFWLDYADGI

SEQ ID NO: 1529471 - protein, 21 aa, Mycobacterium tuberculosis
RVVAVSFPRDLAITPIQCEAW

SEQ ID NO: 1529472 - protein, 17 aa, Mycobacterium tuberculosis
RVVELAGIGPGPHAAMI

SEQ ID NO: 1529473 - protein, 20 aa, Mycobacterium tuberculosis
RVVEPLPNAMFRIELENGHK

SEQ ID NO: 1529474 - protein, 26 aa, Mycobacterium tuberculosis
RVVLDDSLVYLALNKPRGMHSTMSDD

SEQ ID NO: 1529475 - protein, 20 aa, Mycobacterium tuberculosis
RVVLLDAQPIHRQTQEYRLV

SEQ ID NO: 1529476 - protein, 17 aa, Mycobacterium tuberculosis
RVVRAHVPLSEMFGYVG

SEQ ID NO: 1529477 - protein, 17 aa, Mycobacterium tuberculosis
RVVVAHLRPAVLGCRAC

SEQ ID NO: 1529478 - protein, 17 aa, Mycobacterium tuberculosis
RVVVMPWDRHIAAGTEI

SEQ ID NO: 1529479 - protein, 19 aa, Mycobacterium tuberculosis
RVWAHPRPPVRCACTKPPL

SEQ ID NO: 1529480 - protein, 23 aa, Mycobacterium tuberculosis
RVWPGQAHLFQLATPLVPEATRS

SEQ ID NO: 1529481 - protein, 20 aa, Mycobacterium tuberculosis
RVWSKPGTGSTFTLALPALI

SEQ ID NO: 1529482 - protein, 19 aa, Mycobacterium tuberculosis
RVWSRATIGLAYASALIIA

SEQ ID NO: 1529483 - protein, 19 aa, Mycobacterium tuberculosis
RVWVMNRLREKMPHVYVTA

SEQ ID NO: 1529484 - protein, 27 aa, Mycobacterium tuberculosis
RVYCPGWVALFRWLKPLLSTRVGQRPI

SEQ ID NO: 1529485 - protein, 18 aa, Mycobacterium tuberculosis
RWALAAANLWQGNLEAAV

SEQ ID NO: 1529486 - protein, 26 aa, Mycobacterium tuberculosis
RWDAEAFYHPDPLTPGRMTTKWGGFV

SEQ ID NO: 1529487 - protein, 18 aa, Mycobacterium tuberculosis
RWIETQDLLFIEEAAGGL

SEQ ID NO: 1529488 - protein, 22 aa, Mycobacterium tuberculosis
RWKETAFQYGWLLATADSDRYG

SEQ ID NO: 1529489 - protein, 34 aa, Mycobacterium tuberculosis
RWLDPRHVDQARLSWACGLPYYSNLYTPNCTSDA

SEQ ID NO: 1529490 - protein, 19 aa, Mycobacterium tuberculosis
RWLGDGNFLLLGYQRCRVA

SEQ ID NO: 1529491 - protein, 18 aa, Mycobacterium tuberculosis
RWMQLLAKHRAQISSAPN

SEQ ID NO: 1529492 - protein, 17 aa, Mycobacterium tuberculosis
RWPDKPGRYFTVRAGSL

SEQ ID NO: 1529493 - protein, 19 aa, Mycobacterium tuberculosis
RWPTGSPVMWLPASLRRRH

SEQ ID NO: 1529494 - protein, 21 aa, Mycobacterium tuberculosis
RWQRIVALTMIGISTALIGGC

SEQ ID NO: 1529495 - protein, 26 aa, Mycobacterium tuberculosis
RWQRRRHRPRRPLPPPPTTHCADKVA

SEQ ID NO: 1529496 - protein, 17 aa, Mycobacterium tuberculosis
RWRLAQILTFQAVDAVV

SEQ ID NO: 1529497 - protein, 21 aa, Mycobacterium tuberculosis
RWRRRRALWVGVTLGGAVDSA

SEQ ID NO: 1529498 - protein, 26 aa, Mycobacterium tuberculosis
RWSALLVGAWWPARPDAPMAGVTYWR

SEQ ID NO: 1529499 - protein, 27 aa, Mycobacterium tuberculosis
RWSAVLVGAWWPAPSAALRAAAQHWAT

SEQ ID NO: 1529500 - protein, 19 aa, Mycobacterium tuberculosis
RWSISRERGPAMEYLIAAQ

SEQ ID NO: 1529501 - protein, 23 aa, Mycobacterium tuberculosis
RWSSAARLFRPTMTLTCVFDHRV

SEQ ID NO: 1529502 - protein, 19 aa, Mycobacterium tuberculosis
RWVLVLVTAVNRCGWTRRG

SEQ ID NO: 1529503 - protein, 26 aa, Mycobacterium tuberculosis
RYACELYDLPTLWQIAAHNPWLSVSP

SEQ ID NO: 1529504 - protein, 25 aa, Mycobacterium tuberculosis
RYADGVGHPFWFSRTVFGELARLHG

SEQ ID NO: 1529505 - protein, 20 aa, Mycobacterium tuberculosis
RYAQRVMDWLHPDGDLTDTE

SEQ ID NO: 1529506 - protein, 22 aa, Mycobacterium tuberculosis
RYDTFFKKFYNLTPDDGRMLLH

SEQ ID NO: 1529507 - protein, 18 aa, Mycobacterium tuberculosis
RYGFRPSKIAFLAWHAWN

SEQ ID NO: 1529508 - protein, 25 aa, Mycobacterium tuberculosis
RYGRCVSTCWPWGNPARVASKRSPS

SEQ ID NO: 1529509 - protein, 26 aa, Mycobacterium tuberculosis
RYHATYMNYVGKPLAYILATPERDDD

SEQ ID NO: 1529510 - protein, 19 aa, Mycobacterium tuberculosis
RYHSLRCYAAPPDVGRCEF

SEQ ID NO: 1529511 - protein, 20 aa, Mycobacterium tuberculosis
RYINDRFLPDKAIDLIDEAG

SEQ ID NO: 1529512 - protein, 22 aa, Mycobacterium tuberculosis
RYITARFLPDKAIDLVDEAASR

SEQ ID NO: 1529513 - protein, 23 aa, Mycobacterium tuberculosis
RYLHKPEQLAKLARAGFRVSDVK

SEQ ID NO: 1529514 - protein, 18 aa, Mycobacterium tuberculosis
RYLPMERGRYVITPEQVL

SEQ ID NO: 1529515 - protein, 18 aa, Mycobacterium tuberculosis
RYLRICVLTQYKSHSLDR

SEQ ID NO: 1529516 - protein, 17 aa, Mycobacterium tuberculosis
RYNLPYRRRRPTGPPSG

SEQ ID NO: 1529517 - protein, 18 aa, Mycobacterium tuberculosis
RYRLRPEPAFCRRPRRPP

SEQ ID NO: 1529518 - protein, 20 aa, Mycobacterium tuberculosis
RYRRAWWERRQRRADRRRRD

SEQ ID NO: 1529519 - protein, 18 aa, Mycobacterium tuberculosis
RYRSLNTVSFRPPSRRRM

SEQ ID NO: 1529520 - protein, 18 aa, Mycobacterium tuberculosis
RYRVGELIPVYRSQRALL

SEQ ID NO: 1529521 - protein, 26 aa, Mycobacterium tuberculosis
RYTGRGMAFLDLIQEGNLGLIRAVEK

SEQ ID NO: 1529522 - protein, 26 aa, Mycobacterium tuberculosis
RYTGRGMPLLDLIQEGNLGLIRAMEK

SEQ ID NO: 1529523 - protein, 18 aa, Mycobacterium tuberculosis
RYTLWAPRWRDAGDEWEA

SEQ ID NO: 1529524 - protein, 20 aa, Mycobacterium tuberculosis
RYVAAMLAVLKAGGMIVPLD

SEQ ID NO: 1529525 - protein, 20 aa, Mycobacterium tuberculosis
RYVEPYRAELHRLGRPVFGP

SEQ ID NO: 1529526 - protein, 20 aa, Mycobacterium tuberculosis
RYVMMVLRHIPRSIFRKLPI

SEQ ID NO: 1529527 - protein, 20 aa, Mycobacterium tuberculosis
RYVPAGGRRGAGPAGLSAVV

SEQ ID NO: 1529528 - protein, 21 aa, Mycobacterium tuberculosis
RYWGTPIPVWKSDDPAYPRID

SEQ ID NO: 1529529 - protein, 25 aa, Mycobacterium tuberculosis
RYYDMLRKFGLGQRTGVGLPGESAG

SEQ ID NO: 1529530 - protein, 30 aa, Mycobacterium tuberculosis
SAAAAALAPWQQAVPGLLGLLDSAQSSAQA

SEQ ID NO: 1529531 - protein, 28 aa, Mycobacterium tuberculosis
SAAAAALAPWQQAVPGLSGLLDSAQSSA

SEQ ID NO: 1529532 - protein, 33 aa, Mycobacterium tuberculosis
SAAAAALAPWQQAVPGLSGLLGGAANAPAAAAQ

SEQ ID NO: 1529533 - protein, 30 aa, Mycobacterium tuberculosis
SAAAEQLVPFQQALQQLPNLGIGNIGNANL

SEQ ID NO: 1529534 - protein, 32 aa, Mycobacterium tuberculosis
SAAAEQLVPFQQALQQLPNLGIGNIGNANLGG

SEQ ID NO: 1529535 - protein, 24 aa, Mycobacterium tuberculosis
SAAARMARTARPAPPPPAVVTAAT

SEQ ID NO: 1529536 - protein, 22 aa, Mycobacterium tuberculosis
SAACTTMRWPLHDDQLAAADQL

SEQ ID NO: 1529537 - protein, 19 aa, Mycobacterium tuberculosis
SAAKLFGDGGAGGAGGMGS

SEQ ID NO: 1529538 - protein, 18 aa, Mycobacterium tuberculosis
SAAPIRNYGWPRDLPRAV

SEQ ID NO: 1529539 - protein, 37 aa, Mycobacterium tuberculosis
SAAPLQDLLGVVNAPAQALLGRPLIGNGANGADGTGA

SEQ ID NO: 1529540 - protein, 18 aa, Mycobacterium tuberculosis
SAARLFGGGGAGGAGGTG

SEQ ID NO: 1529541 - protein, 21 aa, Mycobacterium tuberculosis
SAASIGNAAIGGNGGAGGNAQ

SEQ ID NO: 1529542 - protein, 24 aa, Mycobacterium tuberculosis
SAAVVLFSPLIDLTFRLGASRELQ

SEQ ID NO: 1529543 - protein, 23 aa, Mycobacterium tuberculosis
SAEGLLSYLPPTGAGPPARCDYR

SEQ ID NO: 1529544 - protein, 25 aa, Mycobacterium tuberculosis
SAEKRRWRQASTDVDGAGGYGGSGG

SEQ ID NO: 1529545 - protein, 17 aa, Mycobacterium tuberculosis
SAEVLAWRQRSLTGRRW

SEQ ID NO: 1529546 - protein, 20 aa, Mycobacterium tuberculosis
SAFHAQFVQTFTAGCWRVRE

SEQ ID NO: 1529547 - protein, 23 aa, Mycobacterium tuberculosis
SAFQSVVWGLTTGSWIGSSAGLM

SEQ ID NO: 1529548 - protein, 24 aa, Mycobacterium tuberculosis
SAFQSVVWGLTTGSWIGSSAGLMA

SEQ ID NO: 1529549 - protein, 19 aa, Mycobacterium tuberculosis
SAFQSVVWGLTVGSWIGSS

SEQ ID NO: 1529550 - protein, 20 aa, Mycobacterium tuberculosis
SAFTLPELIGLTAGADVVLD

SEQ ID NO: 1529551 - protein, 21 aa, Mycobacterium tuberculosis
SAFVQLVLSNVFGQNAPAIAA

SEQ ID NO: 1529552 - protein, 37 aa, Mycobacterium tuberculosis
SAGKPLAIIRPRRTEEVQTVLRWASANQVPVVTRGAG

SEQ ID NO: 1529553 - protein, 17 aa, Mycobacterium tuberculosis
SAGLIGHGGTGGAGGHS

SEQ ID NO: 1529554 - protein, 21 aa, Mycobacterium tuberculosis
SAGLIGIGGTGGAGGAGAVGG

SEQ ID NO: 1529555 - protein, 19 aa, Mycobacterium tuberculosis
SAGLVPPIDQWSGSTFANL

SEQ ID NO: 1529556 - protein, 19 aa, Mycobacterium tuberculosis
SAGTGGAGGLLGKNGMNGL

SEQ ID NO: 1529557 - protein, 21 aa, Mycobacterium tuberculosis
SAGVRPAIHLPLEDPYQMPNG

SEQ ID NO: 1529558 - protein, 20 aa, Mycobacterium tuberculosis
SAHVDLYFEAAVAGAIPVIR

SEQ ID NO: 1529559 - protein, 21 aa, Mycobacterium tuberculosis
SAHVDLYFEAAVAGAIPVIRP

SEQ ID NO: 1529560 - protein, 23 aa, Mycobacterium tuberculosis
SAILQINRTFFTLKRTVSRGVIM

SEQ ID NO: 1529561 - protein, 21 aa, Mycobacterium tuberculosis
SAIPVVSFRLAGDRGYTEFDV

SEQ ID NO: 1529562 - protein, 18 aa, Mycobacterium tuberculosis
SAIRAPGARVTSPGVCTR

SEQ ID NO: 1529563 - protein, 23 aa, Mycobacterium tuberculosis
SAISLLQTLPIDTLKIDKTFVRQ

SEQ ID NO: 1529564 - protein, 17 aa, Mycobacterium tuberculosis
SAIYQKWLDAGYFTADP

SEQ ID NO: 1529565 - protein, 18 aa, Mycobacterium tuberculosis
SAIYQKWLDAGYFTADPT

SEQ ID NO: 1529566 - protein, 19 aa, Mycobacterium tuberculosis
SAKCRQLRSFADCGTGGAG

SEQ ID NO: 1529567 - protein, 20 aa, Mycobacterium tuberculosis
SALAAANRAAEAPTTGLLAA

SEQ ID NO: 1529568 - protein, 19 aa, Mycobacterium tuberculosis
SALALRFYGDAELYRLIAA

SEQ ID NO: 1529569 - protein, 19 aa, Mycobacterium tuberculosis
SALGAGPRSPLRWPWGACP

SEQ ID NO: 1529570 - protein, 23 aa, Mycobacterium tuberculosis
SALGPKLPELWGGSADLAGSNNT

SEQ ID NO: 1529571 - protein, 19 aa, Mycobacterium tuberculosis
SALLVAYLPARSREEMFGG

SEQ ID NO: 1529572 - protein, 22 aa, Mycobacterium tuberculosis
SALTCEFLFLCSGYYNYDEGYS

SEQ ID NO: 1529573 - protein, 19 aa, Mycobacterium tuberculosis
SALTPFGQALPTVAGGGAL

SEQ ID NO: 1529574 - protein, 18 aa, Mycobacterium tuberculosis
SALTPVRGWVVRKLGPVT

SEQ ID NO: 1529575 - protein, 36 aa, Mycobacterium tuberculosis
SALVSFEVFIRPSLRMAMGLPDPYRPHRSAVLTASL

SEQ ID NO: 1529576 - protein, 23 aa, Mycobacterium tuberculosis
SALWGQLQSWLRGVSPGLPSEIT

SEQ ID NO: 1529577 - protein, 17 aa, Mycobacterium tuberculosis
SAMARSYLGPEFDIHCG

SEQ ID NO: 1529578 - protein, 23 aa, Mycobacterium tuberculosis
SAMLPYLPVEYDDPVRRLRTVHN

SEQ ID NO: 1529579 - protein, 27 aa, Mycobacterium tuberculosis
SANFAAGRLAYILGARGPAVVIDTACS

SEQ ID NO: 1529580 - protein, 21 aa, Mycobacterium tuberculosis
SAPIWRENHFFRLGDRRRGGE

SEQ ID NO: 1529581 - protein, 20 aa, Mycobacterium tuberculosis
SAPLPAFWVNIARKKILHAA

SEQ ID NO: 1529582 - protein, 28 aa, Mycobacterium tuberculosis
SAPMLAASVAWDGLAAELAVAASSFGSV

SEQ ID NO: 1529583 - protein, 32 aa, Mycobacterium tuberculosis
SAPPTPFNGPLGRLRNIAYTQLDMRDVKRVKD

SEQ ID NO: 1529584 - protein, 22 aa, Mycobacterium tuberculosis
SAPRQAFVFPGQGGHWPGMGAV

SEQ ID NO: 1529585 - protein, 35 aa, Mycobacterium tuberculosis; identical to SEQ ID NO: 222807

SEQ ID NO: 1529586 - protein, 18 aa, Mycobacterium tuberculosis
SAQAAAFHQQFVRALSSA

SEQ ID NO: 1529587 - protein, 18 aa, Mycobacterium tuberculosis
SAQAALFHDRFVQILQEG

SEQ ID NO: 1529588 - protein, 20 aa, Mycobacterium tuberculosis
SAQHVVRPKTPRGDGNPSTP

SEQ ID NO: 1529589 - protein, 25 aa, Mycobacterium tuberculosis
SAQLAAYHNQFVRALNAGAGSYASA

SEQ ID NO: 1529590 - protein, 21 aa, Mycobacterium tuberculosis
SAQLRRRPAWDRHRGTVCVRH

SEQ ID NO: 1529591 - protein, 29 aa, Mycobacterium tuberculosis
SAQPADRPIPRPPAPRPGTARPGVLRPGA

SEQ ID NO: 1529592 - protein, 29 aa, Mycobacterium tuberculosis
SAQVATFHDRFVQTLSAAASSYVAAEAVN

SEQ ID NO: 1529593 - protein, 22 aa, Mycobacterium tuberculosis
SARDQILPVYAEYQPRSEKVLT

SEQ ID NO: 1529594 - protein, 19 aa, Mycobacterium tuberculosis
SARFDFGAAPLPTGPDAAP

SEQ ID NO: 1529595 - protein, 25 aa, Mycobacterium tuberculosis
SARMVTQALLPSGLVASAVVAASSA

SEQ ID NO: 1529596 - protein, 35 aa, Mycobacterium tuberculosis
SARPPSVRALFRGRGRYRFAHPQPHPGRQNRALRV

SEQ ID NO: 1529597 - protein, 20 aa, Mycobacterium tuberculosis
SARRLQLNRIPLYQIHQPNP

SEQ ID NO: 1529598 - protein, 19 aa, Mycobacterium tuberculosis
SARRRPAGWPLSCSTPPTP

SEQ ID NO: 1529599 - protein, 25 aa, Mycobacterium tuberculosis
SARTVCGWRRFARWRGTRARKCCAA

SEQ ID NO: 1529600 - protein, 23 aa, Mycobacterium tuberculosis
SASALPVGLAAPAGPVGCSPPAV

SEQ ID NO: 1529601 - protein, 20 aa, Mycobacterium tuberculosis
SASFPLAFEPSFLPFTKGTA

SEQ ID NO: 1529602 - protein, 21 aa, Mycobacterium tuberculosis
SASKATRLRRRLRQHRFEFLA

SEQ ID NO: 1529603 - protein, 17 aa, Mycobacterium tuberculosis
SASSAHRRVGRWFFRWE

SEQ ID NO: 1529604 - protein, 28 aa, Mycobacterium tuberculosis
SASSTVEAPVARRLRESFGGSKPAPAKG

SEQ ID NO: 1529605 - protein, 26 aa, Mycobacterium tuberculosis
SATAALPAPWLLNNTSQPRTLPVCGR

SEQ ID NO: 1529606 - protein, 18 aa, Mycobacterium tuberculosis
SATAWYGLQDLARIKAGD

SEQ ID NO: 1529607 - protein, 17 aa, Mycobacterium tuberculosis
SATLFIKPGWGFSFDYQ

SEQ ID NO: 1529608 - protein, 26 aa, Mycobacterium tuberculosis
SATRSWAARWACRPTRWCLGTAASTS

SEQ ID NO: 1529609 - protein, 27 aa, Mycobacterium tuberculosis
SAVCALEPYWEALRKVYAPFESGLPGP

SEQ ID NO: 1529610 - protein, 24 aa, Mycobacterium tuberculosis
SAVKAFTAWAVRRVLLAGDPAARL

SEQ ID NO: 1529611 - protein, 23 aa, Mycobacterium tuberculosis
SAVLRRCGRCGRKASWYDRGAGL

SEQ ID NO: 1529612 - protein, 17 aa, Mycobacterium tuberculosis
SAVLSRLRRTHTVIVID

SEQ ID NO: 1529613 - protein, 35 aa, Mycobacterium tuberculosis
SAVNTAAWYVNAAIPTAIFLANALNSGAPVAIAEG

SEQ ID NO: 1529614 - protein, 34 aa, Mycobacterium tuberculosis
SAVSGWVRSGATVDWWWGAWGAWVGVSRAGGSRC

SEQ ID NO: 1529615 - protein, 29 aa, Mycobacterium tuberculosis
SAWIAEGLLIYLPATAQERLFTGIDALAG

SEQ ID NO: 1529616 - protein, 17 aa, Mycobacterium tuberculosis
SAWTPRRSCSSTSAWTP

SEQ ID NO: 1529617 - protein, 21 aa, Mycobacterium tuberculosis
SAYFAGGLSLRDATRAICSRS

SEQ ID NO: 1529618 - protein, 22 aa, Mycobacterium tuberculosis
SAYFAGGLSLRDATRAICSRSH

SEQ ID NO: 1529619 - protein, 18 aa, Mycobacterium tuberculosis
SAYPRVLDFAAFRSIADE

SEQ ID NO: 1529620 - protein, 18 aa, Mycobacterium tuberculosis
SCCPSRFLRNHELAKLVS

SEQ ID NO: 1529621 - protein, 24 aa, Mycobacterium tuberculosis
SCCTSRMRWVRWSARRWPARPERS

SEQ ID NO: 1529622 - protein, 21 aa, Mycobacterium tuberculosis
SCGGCRWGLVSGWEGEWVMEF

SEQ ID NO: 1529623 - protein, 18 aa, Mycobacterium tuberculosis
SCPGPEAALALVGAARRI

SEQ ID NO: 1529624 - protein, 19 aa, Mycobacterium tuberculosis
SCQAGWRCLCRRCRRGTAA

SEQ ID NO: 1529625 - protein, 19 aa, Mycobacterium tuberculosis
SCWIPFSIELEGDAASFVG

SEQ ID NO: 1529626 - protein, 18 aa, Mycobacterium tuberculosis
SDALALGQPGGNGGQGDA

SEQ ID NO: 1529627 - protein, 24 aa, Mycobacterium tuberculosis
SDALPEPTFVPVLGRIAAGGPILA

SEQ ID NO: 1529628 - protein, 39 aa, Mycobacterium tuberculosis
SDDESIWQLLKNIPIHQLRRTGLLDKLLLLAGQPEESLA

SEQ ID NO: 1529629 - protein, 28 aa, Mycobacterium tuberculosis
SDDGRWRIVGNIPRGMFVGGRRGSSVTV

SEQ ID NO: 1529630 - protein, 25 aa, Mycobacterium tuberculosis
SDDQWAPVAHRPAHRRWFAEEAGCR

SEQ ID NO: 1529631 - protein, 30 aa, Mycobacterium tuberculosis
SDELRSLLRFVLDLLADYGLTDFYLELSTK

SEQ ID NO: 1529632 - protein, 21 aa, Mycobacterium tuberculosis
SDEVLVPFVRAIVTSVSLDDG

SEQ ID NO: 1529633 - protein, 17 aa, Mycobacterium tuberculosis
SDEVPVVVLLWSPRSEV

SEQ ID NO: 1529634 - protein, 17 aa, Mycobacterium tuberculosis
SDGGRIGSRSRSRQKSS

SEQ ID NO: 1529635 - protein, 23 aa, Mycobacterium tuberculosis
SDGNPGAITGSGGRGGDGGVGGQ

SEQ ID NO: 1529636 - protein, 26 aa, Mycobacterium tuberculosis
SDGNTFQQLPFALAPGPPVPTTALRE

SEQ ID NO: 1529637 - protein, 24 aa, Mycobacterium tuberculosis
SDGQARMWFVQMADPSGALLNICV

SEQ ID NO: 1529638 - protein, 24 aa, Mycobacterium tuberculosis
SDHPRPRLFSLLHEFVHVVLHTEG

SEQ ID NO: 1529639 - protein, 28 aa, Mycobacterium tuberculosis
SDIERLRKLWDVPALAFVGIGNGTQVAL

SEQ ID NO: 1529640 - protein, 30 aa, Mycobacterium tuberculosis
SDIERLRKLWDVPALAFVGIGNGTQVALAY

SEQ ID NO: 1529641 - protein, 20 aa, Mycobacterium tuberculosis
SDLDALLRRVAGHDQAAFAE

SEQ ID NO: 1529642 - protein, 28 aa, Mycobacterium tuberculosis
SDLVADLLPKDAWLNDLGTYRLDDLPRP

SEQ ID NO: 1529643 - protein, 17 aa, Mycobacterium tuberculosis
SDLYGWLTTVARSGQPV

SEQ ID NO: 1529644 - protein, 24 aa, Mycobacterium tuberculosis
SDQPRPLVPAMFSAVLSRLRRTHT

SEQ ID NO: 1529645 - protein, 17 aa, Mycobacterium tuberculosis
SDRALVESLQTVLRDAT

SEQ ID NO: 1529646 - protein, 27 aa, Mycobacterium tuberculosis
SDRPVPRLLAMGLLRRIDAETVILPRH

SEQ ID NO: 1529647 - protein, 22 aa, Mycobacterium tuberculosis
SDRQRRGRREWGDRWDRSRQHH

SEQ ID NO: 1529648 - protein, 17 aa, Mycobacterium tuberculosis
SDRRLWQRLCTELELPA

SEQ ID NO: 1529649 - protein, 28 aa, Mycobacterium tuberculosis
SDSDMFTFGYKFRPWRDVKVLADGASIR

SEQ ID NO: 1529650 - protein, 25 aa, Mycobacterium tuberculosis
SDSLTTRYMPSGMTRWSPDSGETIA

SEQ ID NO: 1529651 - protein, 26 aa, Mycobacterium tuberculosis
SDSRTKLLRLFPTIFKGAHVELDEVS

SEQ ID NO: 1529652 - protein, 26 aa, Mycobacterium tuberculosis
SDTESPLWQAFLTRVLPDEGVRGFLQ

SEQ ID NO: 1529653 - protein, 20 aa, Mycobacterium tuberculosis
SDTHWLGRDRFVLSAGHSSL

SEQ ID NO: 1529654 - protein, 17 aa, Mycobacterium tuberculosis
SDTWQPPTPRRLGPFRA

SEQ ID NO: 1529655 - protein, 26 aa, Mycobacterium tuberculosis
SDVEYPLLGPWGTARVFAPQKGADMA

SEQ ID NO: 1529656 - protein, 53 aa, Mycobacterium tuberculosis
SDVRAFFHNNTVPLYFISPTPFNLLGIYRWIRNFFYLTYYDSFEGEHSRVFVP

SEQ ID NO: 1529657 - protein, 18 aa, Mycobacterium tuberculosis
SDWDTYRSLAPLQGLLFP

SEQ ID NO: 1529658 - protein, 19 aa, Mycobacterium tuberculosis
SEADLLWDLASRLEGRMAA

SEQ ID NO: 1529659 - protein, 24 aa, Mycobacterium tuberculosis
SEAQKRHFLPRILSGEHRWCQASP

SEQ ID NO: 1529660 - protein, 26 aa, Mycobacterium tuberculosis
SEAVDKPLWRWIKMGQTAPTSPNNQH

SEQ ID NO: 1529661 - protein, 23 aa, Mycobacterium tuberculosis
SEDWMTRLLLGFGSDVRVLAPES

SEQ ID NO: 1529662 - protein, 23 aa, Mycobacterium tuberculosis
SEERRLAYVGITRAPAAVVREPG

SEQ ID NO: 1529663 - protein, 42 aa, Mycobacterium tuberculosis
SEFAEIMGFYGLSYWYPFQVTALGLGPIWMSANEDAKRKAAA

SEQ ID NO: 1529664 - protein, 18 aa, Mycobacterium tuberculosis
SEHFGFGDQFPPEPVAPD

SEQ ID NO: 1529665 - protein, 18 aa, Mycobacterium tuberculosis
SELDTLREAATTARATLC

SEQ ID NO: 1529666 - protein, 17 aa, Mycobacterium tuberculosis
SELVGRFASAAIATTRA

SEQ ID NO: 1529667 - protein, 24 aa, Mycobacterium tuberculosis
SELWPDLNLGLPFTYHQGYQSSPV

SEQ ID NO: 1529668 - protein, 22 aa, Mycobacterium tuberculosis
SELYPDPVLPALSLLPHTVRTA

SEQ ID NO: 1529669 - protein, 23 aa, Mycobacterium tuberculosis
SEPGHGLALAALGLDPIVDLHMR

SEQ ID NO: 1529670 - protein, 17 aa, Mycobacterium tuberculosis
SEQLLHAFAGQGPTIGS

SEQ ID NO: 1529671 - protein, 25 aa, Mycobacterium tuberculosis
SEQLTVRYALRRLGALRVWPARARA

SEQ ID NO: 1529672 - protein, 20 aa, Mycobacterium tuberculosis
SESIPIRIPVDIPASVIDGI

SEQ ID NO: 1529673 - protein, 25 aa, Mycobacterium tuberculosis
SESPWALMHFMVRLPEVGVAGEGAA

SEQ ID NO: 1529674 - protein, 25 aa, Mycobacterium tuberculosis
SETATRFVADPFAAQPGSRLYRNGE

SEQ ID NO: 1529675 - protein, 26 aa, Mycobacterium tuberculosis
SETATRFVADPFAAQPGSRLYRNGER

SEQ ID NO: 1529676 - protein, 24 aa, Mycobacterium tuberculosis
SETAVYNVLPQWAKLAAKPKTMFI

SEQ ID NO: 1529677 - protein, 24 aa, Mycobacterium tuberculosis
SEVDGLVHLPPMKSLSYSVATVRH

SEQ ID NO: 1529678 - protein, 24 aa, Mycobacterium tuberculosis
SEVSIQCGLRRPLAGAVGHHQRRV

SEQ ID NO: 1529679 - protein, 19 aa, Mycobacterium tuberculosis
SEWVDKLRRQAETPLLLAV

SEQ ID NO: 1529680 - protein, 17 aa, Mycobacterium tuberculosis
SFAPSFVGFGGNGVNGG

SEQ ID NO: 1529681 - protein, 26 aa, Mycobacterium tuberculosis
SFDEDPFAILAWRGREREDLLANLAA

SEQ ID NO: 1529682 - protein, 17 aa, Mycobacterium tuberculosis
SFDFRAVIPHLTGQAWV

SEQ ID NO: 1529683 - protein, 27 aa, Mycobacterium tuberculosis
SFHRIEAAYPGRFLLGIGVGHAEMISE

SEQ ID NO: 1529684 - protein, 25 aa, Mycobacterium tuberculosis
SFKKGPFRIAMAAKIPIVPIVIRNA

SEQ ID NO: 1529685 - protein, 17 aa, Mycobacterium tuberculosis
SFLARQLGVPQPETLRR

SEQ ID NO: 1529686 - protein, 19 aa, Mycobacterium tuberculosis
SFMITDLRSVNGVYVRGRR

SEQ ID NO: 1529687 - protein, 20 aa, Mycobacterium tuberculosis
SFNLNLNLPPRCTTGFLPAQ

SEQ ID NO: 1529688 - protein, 17 aa, Mycobacterium tuberculosis
SFRRTLPATLRAPSAGE

SEQ ID NO: 1529689 - protein, 20 aa, Mycobacterium tuberculosis
SFTLVYDALVSRAGSESVLP

SEQ ID NO: 1529690 - protein, 22 aa, Mycobacterium tuberculosis
SFTVPDIPIPAIHIGINGVVTV

SEQ ID NO: 1529691 - protein, 30 aa, Mycobacterium tuberculosis
SFTYARHRPIRLNFAPKLALHKLTVEATAT

SEQ ID NO: 1529692 - protein, 22 aa, Mycobacterium tuberculosis
SFVLAFVVGAVRLSPPRWTCSE

SEQ ID NO: 1529693 - protein, 24 aa, Mycobacterium tuberculosis
SFVPGVLLAVRRIAERPGLTVGLE

SEQ ID NO: 1529694 - protein, 18 aa, Mycobacterium tuberculosis
SFVVTIPEALAAVATDLA

SEQ ID NO: 1529695 - protein, 20 aa, Mycobacterium tuberculosis
SGAAHHRATRPKPGRGSPGG

SEQ ID NO: 1529696 - protein, 25 aa, Mycobacterium tuberculosis
SGADGIGGARRTGGAGGAGGSGGEA

SEQ ID NO: 1529697 - protein, 22 aa, Mycobacterium tuberculosis
SGANAYLLPARNWSVMAATEVR

SEQ ID NO: 1529698 - protein, 20 aa, Mycobacterium tuberculosis
SGAPRAIVHFYNSTSILQRR

SEQ ID NO: 1529699 - protein, 26 aa, Mycobacterium tuberculosis
SGAQESAALTVFGGAGGAGGAGGAGG

SEQ ID NO: 1529700 - protein, 26 aa, Mycobacterium tuberculosis
SGAQQYQPGGWSAGSRGAHPPGKGEK

SEQ ID NO: 1529701 - protein, 22 aa, Mycobacterium tuberculosis
SGARPLVAWLDALATGIDLLTA

SEQ ID NO: 1529702 - protein, 17 aa, Mycobacterium tuberculosis
SGCGADAGCWRCRGGPG

SEQ ID NO: 1529703 - protein, 21 aa, Mycobacterium tuberculosis
SGCGRWRWRAPRSRVACPACC

SEQ ID NO: 1529704 - protein, 44 aa, Mycobacterium tuberculosis
SGDFLRTIHELLLSDGFWDEVFRELSIPYLPVRWSTDNPDSIVD

SEQ ID NO: 1529705 - protein, 31 aa, Mycobacterium tuberculosis
SGDGRFALVLCRLFWHPPTFRQACEAVAPGG

SEQ ID NO: 1529706 - protein, 31 aa, Mycobacterium tuberculosis
SGDPYRLAAQLGMPPWRVQKAQKQAGRWSRD

SEQ ID NO: 1529707 - protein, 30 aa, Mycobacterium tuberculosis
SGDPYRLAAQLGMPPWRVQKAQKQARRWSR

SEQ ID NO: 1529708 - protein, 24 aa, Mycobacterium tuberculosis
SGEGCVVLLLKRLPDAVRDGDRVL

SEQ ID NO: 1529709 - protein, 32 aa, Mycobacterium tuberculosis
SGEQRLSGFLLWQSAYSEMWFTEAHWPAFRHV

SEQ ID NO: 1529710 - protein, 17 aa, Mycobacterium tuberculosis
SGFANIGSFNAGIANSG

SEQ ID NO: 1529711 - protein, 25 aa, Mycobacterium tuberculosis
SGFERFPAWMWRNTVVRDFVEWLRT

SEQ ID NO: 1529712 - protein, 20 aa, Mycobacterium tuberculosis
SGFKVRPSFSFFAVGPDGNA

SEQ ID NO: 1529713 - protein, 31 aa, Mycobacterium tuberculosis
SGFPFRRVLHHHRWPGWAGLIPGREDGQRRG

SEQ ID NO: 1529714 - protein, 28 aa, Mycobacterium tuberculosis
SGFRYSGRAYLIQIRRAEAGTVLIDPVS

SEQ ID NO: 1529715 - protein, 29 aa, Mycobacterium tuberculosis
SGGAGGTGGLLFGAGGNGGPGGSGGAADI

SEQ ID NO: 1529716 - protein, 23 aa, Mycobacterium tuberculosis
SGGANSPALYLLDGLRAQDDFSG

SEQ ID NO: 1529717 - protein, 30 aa, Mycobacterium tuberculosis
SGGFVVPFLHPDLVWDFRLPRVVSINVSGH

SEQ ID NO: 1529718 - protein, 26 aa, Mycobacterium tuberculosis
SGGGARWLIPRLDLPAKKRDAIVGLA

SEQ ID NO: 1529719 - protein, 17 aa, Mycobacterium tuberculosis
SGGLIGRAGSDGGVGAG

SEQ ID NO: 1529720 - protein, 17 aa, Mycobacterium tuberculosis
SGGLMRLGSAVAPLLQV

SEQ ID NO: 1529721 - protein, 20 aa, Mycobacterium tuberculosis
SGGNGFDSFASGGTGGAGGT

SEQ ID NO: 1529722 - protein, 24 aa, Mycobacterium tuberculosis
SGGNGGVWYGNGGAAGAAGQGGPG

SEQ ID NO: 1529723 - protein, 21 aa, Mycobacterium tuberculosis
SGGTALLLGSGGAGGNGGTGG

SEQ ID NO: 1529724 - protein, 25 aa, Mycobacterium tuberculosis
SGGVGGAGGFGLTTGGPGAAGGDAG

SEQ ID NO: 1529725 - protein, 23 aa, Mycobacterium tuberculosis
SGHDYTWFVLNAKIIEKEFALSG

SEQ ID NO: 1529726 - protein, 20 aa, Mycobacterium tuberculosis
SGHTTFLELAPNPVALMQVA

SEQ ID NO: 1529727 - protein, 22 aa, Mycobacterium tuberculosis
SGKVIYPGRKQVFRKLEHGVFC

SEQ ID NO: 1529728 - protein, 25 aa, Mycobacterium tuberculosis
SGLDSRAYRLRWPAGTIVFEVDQPQ

SEQ ID NO: 1529729 - protein, 25 aa, Mycobacterium tuberculosis
SGLEQRLRALDYPKVVIGVSGGLDS

SEQ ID NO: 1529730 - protein, 17 aa, Mycobacterium tuberculosis
SGLFLPSNTIAPFLGLL

SEQ ID NO: 1529731 - protein, 20 aa, Mycobacterium tuberculosis
SGLLLAELKPRRLVENRPAC

SEQ ID NO: 1529732 - protein, 21 aa, Mycobacterium tuberculosis
SGLMQAPMSAMQPLQSMVGMF

SEQ ID NO: 1529733 - protein, 22 aa, Mycobacterium tuberculosis
SGLTNTGAFNAGSLNTGFGAVG

SEQ ID NO: 1529734 - protein, 18 aa, Mycobacterium tuberculosis
SGLVIPDTAKEKPQEGTV

SEQ ID NO: 1529735 - protein, 19 aa, Mycobacterium tuberculosis
SGLYYVPINTHLTASEAAY

SEQ ID NO: 1529736 - protein, 18 aa, Mycobacterium tuberculosis
SGMAILRALVHRPGGVVS

SEQ ID NO: 1529737 - protein, 21 aa, Mycobacterium tuberculosis
SGMLGGLSVPLSWGVAVPPDD

SEQ ID NO: 1529738 - protein, 19 aa, Mycobacterium tuberculosis
SGMYFWLDYADGIEPYFSV

SEQ ID NO: 1529739 - protein, 21 aa, Mycobacterium tuberculosis
SGNAQAYQALSAQAAAFHQQF

SEQ ID NO: 1529740 - protein, 17 aa, Mycobacterium tuberculosis
SGNLGIYNIGFGNVGDY

SEQ ID NO: 1529741 - protein, 23 aa, Mycobacterium tuberculosis
SGNPYLAFSAMLMAGLDGIKNKI

SEQ ID NO: 1529742 - protein, 22 aa, Mycobacterium tuberculosis
SGNTKAFLGERIGVRRGVVVDA

SEQ ID NO: 1529743 - protein, 24 aa, Mycobacterium tuberculosis
SGNVEYFLWLRTQTDRALSAKGLE

SEQ ID NO: 1529744 - protein, 22 aa, Mycobacterium tuberculosis
SGNYGSLNWGSGNTGTGNAGSG

SEQ ID NO: 1529745 - protein, 19 aa, Mycobacterium tuberculosis
SGPLALVEDLGRAGLAHLG

SEQ ID NO: 1529746 - protein, 18 aa, Mycobacterium tuberculosis
SGPLFMAAAAWEGLAADL

SEQ ID NO: 1529747 - protein, 17 aa, Mycobacterium tuberculosis
SGPRLPSGSRAPPAATA

SEQ ID NO: 1529748 - protein, 33 aa, Mycobacterium tuberculosis
SGPRPFVRLEGPAVFRWVGFKMGDVGRRAMDAA

SEQ ID NO: 1529749 - protein, 22 aa, Mycobacterium tuberculosis
SGPRWPSRWGTCSKSMGMTPAA

SEQ ID NO: 1529750 - protein, 25 aa, Mycobacterium tuberculosis
SGQERPFPLDLVPRVISAPEWTRLE

SEQ ID NO: 1529751 - protein, 17 aa, Mycobacterium tuberculosis
SGRAGFRRWWCGGTGRV

SEQ ID NO: 1529752 - protein, 25 aa, Mycobacterium tuberculosis
SGRAQILNMTLSQQWGRLFVAVCYA

SEQ ID NO: 1529753 - protein, 22 aa, Mycobacterium tuberculosis
SGRIAHTLGLHGPAMTFDTACS

SEQ ID NO: 1529754 - protein, 19 aa, Mycobacterium tuberculosis
SGRNRLKYIDGLTIDRQPS

SEQ ID NO: 1529755 - protein, 22 aa, Mycobacterium tuberculosis
SGRPGPPPPPPPPPKKKKKTKK

SEQ ID NO: 1529756 - protein, 24 aa, Mycobacterium tuberculosis
SGRQYMSWISLEDEVRALQFAIAQ

SEQ ID NO: 1529757 - protein, 23 aa, Mycobacterium tuberculosis
SGRTYPVLYLFHGGGTDQDFRTF

SEQ ID NO: 1529758 - protein, 27 aa, Mycobacterium tuberculosis
SGRVTTHLIIRFWGRPRPMAVLMISSQ

SEQ ID NO: 1529759 - protein, 25 aa, Mycobacterium tuberculosis
SGSGRLGIAIARRPRRHRNEKRFEQ

SEQ ID NO: 1529760 - protein, 19 aa, Mycobacterium tuberculosis
SGTRPHHPRYPISLASQLG

SEQ ID NO: 1529761 - protein, 22 aa, Mycobacterium tuberculosis
SGTVFALDLSWGGAGGNGGAAT

SEQ ID NO: 1529762 - protein, 17 aa, Mycobacterium tuberculosis
SGTVLAPVGPITLHGGD

SEQ ID NO: 1529763 - protein, 18 aa, Mycobacterium tuberculosis
SGTWVDIRFTLPANTVDG

SEQ ID NO: 1529764 - protein, 22 aa, Mycobacterium tuberculosis
SGVDLVPTLLDLLRLEVPADVE

SEQ ID NO: 1529765 - protein, 17 aa, Mycobacterium tuberculosis
SGVGGVGGARWGTAGDG

SEQ ID NO: 1529766 - protein, 18 aa, Mycobacterium tuberculosis
SGVLPRYGVRLTVMAHPP

SEQ ID NO: 1529767 - protein, 23 aa, Mycobacterium tuberculosis
SGVQAWLGPLPDDPAGLPHIPVR

SEQ ID NO: 1529768 - protein, 17 aa, Mycobacterium tuberculosis
SGWWNQAASALAGSGSG

SEQ ID NO: 1529769 - protein, 23 aa, Mycobacterium tuberculosis
SGYAPMIGGLGYVLAPGPAAYTL

SEQ ID NO: 1529770 - protein, 20 aa, Mycobacterium tuberculosis
SHALGWLPIEEIDAAASDDG

SEQ ID NO: 1529771 - protein, 17 aa, Mycobacterium tuberculosis
SHDICFIPSGNTRAFLG

SEQ ID NO: 1529772 - protein, 24 aa, Mycobacterium tuberculosis
SHDIPRFVSLWQSGRLPVESLVTS

SEQ ID NO: 1529773 - protein, 19 aa, Mycobacterium tuberculosis
SHKPGLRRLAPLAFVRFRI

SEQ ID NO: 1529774 - protein, 17 aa, Mycobacterium tuberculosis
SHNLDQVLDGDLDALFD

SEQ ID NO: 1529775 - protein, 23 aa, Mycobacterium tuberculosis
SHQDWQAQWNQAMGGSRAGLPSV

SEQ ID NO: 1529776 - protein, 19 aa, Mycobacterium tuberculosis
SHQILMDGPSYRPRKRPGR

SEQ ID NO: 1529777 - protein, 29 aa, Mycobacterium tuberculosis
SHQLPVWTLRLYLTGKRLWHDPRRRDCAL

SEQ ID NO: 1529778 - protein, 24 aa, Mycobacterium tuberculosis
SHRRAGPLHRPADRRQSWHPARIE

SEQ ID NO: 1529779 - protein, 17 aa, Mycobacterium tuberculosis
SHRYRHLSYLRRAQQHR

SEQ ID NO: 1529780 - protein, 17 aa, Mycobacterium tuberculosis
SHSIASYVGALAFTEQR

SEQ ID NO: 1529781 - protein, 17 aa, Mycobacterium tuberculosis
SHVVNYPPMLLSRDGRD

SEQ ID NO: 1529782 - protein, 18 aa, Mycobacterium tuberculosis
SHVVNYPPMLLSRDGRDD

SEQ ID NO: 1529783 - protein, 24 aa, Mycobacterium tuberculosis
SHYDVYPAFGFRFDLKKSGVSVTF

SEQ ID NO: 1529784 - protein, 19 aa, Mycobacterium tuberculosis
SIDAITLFPGGLTFPANSL

SEQ ID NO: 1529785 - protein, 31 aa, Mycobacterium tuberculosis
SIDLVPEYIGNLLLYFQPDATVTMLDAVELE

SEQ ID NO: 1529786 - protein, 18 aa, Mycobacterium tuberculosis
SIERRWTGSVSDAGGVAA

SEQ ID NO: 1529787 - protein, 20 aa, Mycobacterium tuberculosis
SIGAILAVPGIRAALREATA

SEQ ID NO: 1529788 - protein, 24 aa, Mycobacterium tuberculosis
SIGVRSVCYLPLTYDHRLIDGADA

SEQ ID NO: 1529789 - protein, 21 aa, Mycobacterium tuberculosis
SIGWRTSMPAVGPQASALAEV

SEQ ID NO: 1529790 - protein, 22 aa, Mycobacterium tuberculosis
SIHNTQPWRWRVCPTSLELFSR

SEQ ID NO: 1529791 - protein, 22 aa, Mycobacterium tuberculosis
SIIANRVSYFYDFHGPSVTIDT

SEQ ID NO: 1529792 - protein, 23 aa, Mycobacterium tuberculosis
SIIANRVSYFYDFHGPSVTIDTA

SEQ ID NO: 1529793 - protein, 19 aa, Mycobacterium tuberculosis
SILVPRPGRCPPGFQILPI

SEQ ID NO: 1529794 - protein, 24 aa, Mycobacterium tuberculosis
SIMGIGFPPWTGGSAQFIVGYSGP

SEQ ID NO: 1529795 - protein, 21 aa, Mycobacterium tuberculosis
SIPAITLPRIDASGSVDIGIL

SEQ ID NO: 1529796 - protein, 24 aa, Mycobacterium tuberculosis
SIPNPFAVTYYLIKGSLQAPYGAI

SEQ ID NO: 1529797 - protein, 19 aa, Mycobacterium tuberculosis
SIPVGFAGRAALGLGKRLT

SEQ ID NO: 1529798 - protein, 25 aa, Mycobacterium tuberculosis
SIQAGIINLLLDLQEQFGLSYLFVS

SEQ ID NO: 1529799 - protein, 24 aa, Mycobacterium tuberculosis
SIRCSPGWPGWRPSGGGPQAAGVI

SEQ ID NO: 1529800 - protein, 19 aa, Mycobacterium tuberculosis
SIRDGWWDEWYDGENGWEI

SEQ ID NO: 1529801 - protein, 19 aa, Mycobacterium tuberculosis
SIRHRMASVIFSLEMSKSE

SEQ ID NO: 1529802 - protein, 25 aa, Mycobacterium tuberculosis
SISGDLRVDFPWLGTVVQAYLRRTL

SEQ ID NO: 1529803 - protein, 18 aa, Mycobacterium tuberculosis
SISGIYNTGLGAPANVSG

SEQ ID NO: 1529804 - protein, 20 aa, Mycobacterium tuberculosis
SITWRRFCRIPLEGSVPHPT

SEQ ID NO: 1529805 - protein, 17 aa, Mycobacterium tuberculosis
SIVFAALAVRTGLYTKQ

SEQ ID NO: 1529806 - protein, 22 aa, Mycobacterium tuberculosis
SIWIGPRVVIPSLALRARVREA

SEQ ID NO: 1529807 - protein, 20 aa, Mycobacterium tuberculosis
SIYSSCAVPPLVAYLDTGKL

SEQ ID NO: 1529808 - protein, 26 aa, Mycobacterium tuberculosis
SIYSSCAVPPLVAYLDTGKLPDTDTY

SEQ ID NO: 1529809 - protein, 19 aa, Mycobacterium tuberculosis
SKASATHRAGACGGVGAGT

SEQ ID NO: 1529810 - protein, 18 aa, Mycobacterium tuberculosis
SKAVLPPITGTGPAITVN

SEQ ID NO: 1529811 - protein, 23 aa, Mycobacterium tuberculosis
SKCHRGAAMRLLLIDNGRTAISP

SEQ ID NO: 1529812 - protein, 21 aa, Mycobacterium tuberculosis
SKLGGLWTAVSPHLSPLSNMV

SEQ ID NO: 1529813 - protein, 21 aa, Mycobacterium tuberculosis
SKLGGLWTAVSPHLSPLSNVS

SEQ ID NO: 1529814 - protein, 22 aa, Mycobacterium tuberculosis
SKLHGLHVTDFLLVPPGALPKT

SEQ ID NO: 1529815 - protein, 25 aa, Mycobacterium tuberculosis
SKLPKVFFVNWFRRGDDGRFLWPGF

SEQ ID NO: 1529816 - protein, 24 aa, Mycobacterium tuberculosis
SKMNRFFLRGALVARLLSQSAWKQ

SEQ ID NO: 1529817 - protein, 25 aa, Mycobacterium tuberculosis
SKPCAWLAEGLVRYLPARAQDLLFE

SEQ ID NO: 1529818 - protein, 25 aa, Mycobacterium tuberculosis
SKTTTHLFQPLLYQVATGILSEGDI

SEQ ID NO: 1529819 - protein, 21 aa, Mycobacterium tuberculosis
SKVFPVAPFPGGDLGTASAPV

SEQ ID NO: 1529820 - protein, 18 aa, Mycobacterium tuberculosis
SKVLRPSAWLGARSSIAH

SEQ ID NO: 1529821 - protein, 27 aa, Mycobacterium tuberculosis
SKVVKGGRRFSFTRFGHRGRPVTGWSV

SEQ ID NO: 1529822 - protein, 26 aa, Mycobacterium tuberculosis
SLAAGHLTLVPALRDALAQVGRPDIM

SEQ ID NO: 1529823 - protein, 19 aa, Mycobacterium tuberculosis
SLAEYVLELARKLIKPEER

SEQ ID NO: 1529824 - protein, 17 aa, Mycobacterium tuberculosis
SLAIWMAGVTREINLLA

SEQ ID NO: 1529825 - protein, 30 aa, Mycobacterium tuberculosis
SLAKRYTGRGMAFLDLIQEGNLGLIRGGGG

SEQ ID NO: 1529826 - protein, 19 aa, Mycobacterium tuberculosis
SLDHHQISGRLCWIGPPSG

SEQ ID NO: 1529827 - protein, 26 aa, Mycobacterium tuberculosis
SLDMEIMLDQYWPSVPHVLIEPGVRT

SEQ ID NO: 1529828 - protein, 30 aa, Mycobacterium tuberculosis
SLETLIRRHGPLDWRETLSIGVKLAGALEA

SEQ ID NO: 1529829 - protein, 18 aa, Mycobacterium tuberculosis
SLFDHRAVVVGADRTQLM

SEQ ID NO: 1529830 - protein, 17 aa, Mycobacterium tuberculosis
SLFDPDSALRARTAVVC

SEQ ID NO: 1529831 - protein, 19 aa, Mycobacterium tuberculosis
SLFIHRPDALARRIGRHGL

SEQ ID NO: 1529832 - protein, 21 aa, Mycobacterium tuberculosis
SLFITVNCWGKAGSPGWAQHW

SEQ ID NO: 1529833 - protein, 35 aa, Mycobacterium tuberculosis
SLGGTTTMYMIPSPTLPLLLPLKQIGVPDWIVGGL

SEQ ID NO: 1529834 - protein, 18 aa, Mycobacterium tuberculosis
SLGHFPQSFEFATIGGFA

SEQ ID NO: 1529835 - protein, 27 aa, Mycobacterium tuberculosis
SLGITLPVALVWAYPTISDLATALCER

SEQ ID NO: 1529836 - protein, 18 aa, Mycobacterium tuberculosis
SLGLLDDFPPYDSVFDPV

SEQ ID NO: 1529837 - protein, 20 aa, Mycobacterium tuberculosis
SLGPLVVPDIVIPAFGGGTA

SEQ ID NO: 1529838 - protein, 21 aa, Mycobacterium tuberculosis
SLGRIIFMDEFYSLIERHQDG

SEQ ID NO: 1529839 - protein, 17 aa, Mycobacterium tuberculosis
SLGTPLLDLVQRSLQIS

SEQ ID NO: 1529840 - protein, 19 aa, Mycobacterium tuberculosis
SLHAPPSWRRDIDDYLLNL

SEQ ID NO: 1529841 - protein, 20 aa, Mycobacterium tuberculosis
SLHTALRRSPHSERLFCIPA

SEQ ID NO: 1529842 - protein, 21 aa, Mycobacterium tuberculosis
SLIEAAEPLPYVQPQPGRQVP

SEQ ID NO: 1529843 - protein, 24 aa, Mycobacterium tuberculosis
SLIREVLRLYHRTGEKLIITFAMP

SEQ ID NO: 1529844 - protein, 17 aa, Mycobacterium tuberculosis
SLKLISPAKGRIPCYVP

SEQ ID NO: 1529845 - protein, 24 aa, Mycobacterium tuberculosis
SLLANAIGYPIAASVALVTPATGA

SEQ ID NO: 1529846 - protein, 23 aa, Mycobacterium tuberculosis
SLLARIGDAFLALPNGFTAHPRV

SEQ ID NO: 1529847 - protein, 17 aa, Mycobacterium tuberculosis
SLLEKWARDSKILDIFE

SEQ ID NO: 1529848 - protein, 29 aa, Mycobacterium tuberculosis
SLLNAINAPTQALLGRPLIGDGADGTAPG

SEQ ID NO: 1529849 - protein, 30 aa, Mycobacterium tuberculosis
SLLNAINAPTQALLGRPLIGDGADGTAPGQ

SEQ ID NO: 1529850 - protein, 18 aa, Mycobacterium tuberculosis
SLLPLLHNYREPAKPICG

SEQ ID NO: 1529851 - protein, 20 aa, Mycobacterium tuberculosis
SLLSPLALATNGAAIGIGLV

SEQ ID NO: 1529852 - protein, 20 aa, Mycobacterium tuberculosis
SLMQNICFLYHLVGGGTGVG

SEQ ID NO: 1529853 - protein, 19 aa, Mycobacterium tuberculosis
SLPELLVFGARAGRAAADY

SEQ ID NO: 1529854 - protein, 18 aa, Mycobacterium tuberculosis
SLPIVHAIVPFAEAPEAH

SEQ ID NO: 1529855 - protein, 18 aa, Mycobacterium tuberculosis
SLPPKWFYDTVGSELFDQ

SEQ ID NO: 1529856 - protein, 19 aa, Mycobacterium tuberculosis
SLPTALGSVLRLGLRMLAQ

SEQ ID NO: 1529857 - protein, 23 aa, Mycobacterium tuberculosis
SLPVHDHMAIADVARVVAPFGEG

SEQ ID NO: 1529858 - protein, 21 aa, Mycobacterium tuberculosis
SLPVVPFFDPRMGRPSIPMET

SEQ ID NO: 1529859 - protein, 23 aa, Mycobacterium tuberculosis
SLQAPLDVLVVRKLGVPFQPELA

SEQ ID NO: 1529860 - protein, 29 aa, Mycobacterium tuberculosis
SLQGNRLLAPNEYIITLGVHDFEKLGADP

SEQ ID NO: 1529861 - protein, 21 aa, Mycobacterium tuberculosis
SLRAASLLDKIGEDHIFMTLP

SEQ ID NO: 1529862 - protein, 20 aa, Mycobacterium tuberculosis
SLRFRAPQPAQPWPGVRHCH

SEQ ID NO: 1529863 - protein, 26 aa, Mycobacterium tuberculosis
SLRGQLFPLATLLTPNLDEARLLVDI

SEQ ID NO: 1529864 - protein, 19 aa, Mycobacterium tuberculosis
SLRLLAHEVMPRLNARLAT

SEQ ID NO: 1529865 - protein, 17 aa, Mycobacterium tuberculosis
SLRLLPRGGRFIEMGKT

SEQ ID NO: 1529866 - protein, 18 aa, Mycobacterium tuberculosis
SLRLVVVLVPAALRWHGT

SEQ ID NO: 1529867 - protein, 19 aa, Mycobacterium tuberculosis
SLRQKDPAVTARRRLRMIC

SEQ ID NO: 1529868 - protein, 17 aa, Mycobacterium tuberculosis
SLRRQMALLSEKVSGGP

SEQ ID NO: 1529869 - protein, 17 aa, Mycobacterium tuberculosis
SLRRQMVLLSEKVSGGP

SEQ ID NO: 1529870 - protein, 20 aa, Mycobacterium tuberculosis
SLSLDEACLLMFARRDLTAA

SEQ ID NO: 1529871 - protein, 61 aa, Mycobacterium tuberculosis
SLTARRRGRRHRRRRRLALRLRRRRRERRVQQLWQRRGRRGRRRRGFARRLRRGRRGRRLR

SEQ ID NO: 1529872 - protein, 21 aa, Mycobacterium tuberculosis
SLTFALRFSCAGSHLNRRRRQ

SEQ ID NO: 1529873 - protein, 22 aa, Mycobacterium tuberculosis
SLTIPGFTIPGGTLIPTLPLGL

SEQ ID NO: 1529874 - protein, 17 aa, Mycobacterium tuberculosis
SLTVRPLPVILAESSSS

SEQ ID NO: 1529875 - protein, 18 aa, Mycobacterium tuberculosis
SLVGRWRRKGIAVDFATL

SEQ ID NO: 1529876 - protein, 25 aa, Mycobacterium tuberculosis
SLVKFACAWTYIALDPAVVQSVPVF

SEQ ID NO: 1529877 - protein, 30 aa, Mycobacterium tuberculosis
SLVSRISAFLRPDWTRTVRARRFAAAGLVI

SEQ ID NO: 1529878 - protein, 18 aa, Mycobacterium tuberculosis
SLVTFPVLAGILGGVVPS

SEQ ID NO: 1529879 - protein, 25 aa, Mycobacterium tuberculosis
SLWLDPQMTSPYAWYQYFVNTADAD

SEQ ID NO: 1529880 - protein, 23 aa, Mycobacterium tuberculosis
SLYRFHRRLASFSRVIRLDDRGV

SEQ ID NO: 1529881 - protein, 29 aa, Mycobacterium tuberculosis
SMAMVAAAQPYLAWLTYTAEAAAHAGSQA

SEQ ID NO: 1529882 - protein, 21 aa, Mycobacterium tuberculosis
SMDAIMFPYNNARILRQLATP

SEQ ID NO: 1529883 - protein, 22 aa, Mycobacterium tuberculosis
SMEAAATPYVAWLSQAAARAEQ

SEQ ID NO: 1529884 - protein, 19 aa, Mycobacterium tuberculosis
SMFGPYHLKRLLGRGGMGE

SEQ ID NO: 1529885 - protein, 20 aa, Mycobacterium tuberculosis
SMFGPYHLKRLLGRGGMGEV

SEQ ID NO: 1529886 - protein, 23 aa, Mycobacterium tuberculosis
SMHKPWNPHDYIPWSDGKNYYAL

SEQ ID NO: 1529887 - protein, 17 aa, Mycobacterium tuberculosis
SMIGGKGGTGGNGGVGG

SEQ ID NO: 1529888 - protein, 19 aa, Mycobacterium tuberculosis
SMLAAARAWRSLDVEMTAV

SEQ ID NO: 1529889 - protein, 20 aa, Mycobacterium tuberculosis
SMLHAMLIAGGRRAVLCGNI

SEQ ID NO: 1529890 - protein, 21 aa, Mycobacterium tuberculosis
SMLHAMLIAGGRRAVLCGNIG

SEQ ID NO: 1529891 - protein, 18 aa, Mycobacterium tuberculosis
SMLYAFSENYVLPLSHDE

SEQ ID NO: 1529892 - protein, 17 aa, Mycobacterium tuberculosis
SMLYIEGRLLGKPASID

SEQ ID NO: 1529893 - protein, 18 aa, Mycobacterium tuberculosis
SMRAGLQALAWIAHQPEA

SEQ ID NO: 1529894 - protein, 18 aa, Mycobacterium tuberculosis
SMRINVFSWCEVTVRAFG

SEQ ID NO: 1529895 - protein, 17 aa, Mycobacterium tuberculosis
SMRRRAFRRSVSDAAMG

SEQ ID NO: 1529896 - protein, 22 aa, Mycobacterium tuberculosis
SMRSLAPFRDGCAGRRLPPTSG

SEQ ID NO: 1529897 - protein, 17 aa, Mycobacterium tuberculosis
SMSFVNVAPQLVSTAAA

SEQ ID NO: 1529898 - protein, 17 aa, Mycobacterium tuberculosis
SMVELVPHLFGPNRRPT

SEQ ID NO: 1529899 - protein, 20 aa, Mycobacterium tuberculosis
SMYPRMWEASGVDYPTLLAT

SEQ ID NO: 1529900 - protein, 21 aa, Mycobacterium tuberculosis
SNFNNLYYPLHSSLVGQFVFP

SEQ ID NO: 1529901 - protein, 20 aa, Mycobacterium tuberculosis
SNFPAIVKFLSEQVLSRATE

SEQ ID NO: 1529902 - protein, 28 aa, Mycobacterium tuberculosis
SNGLAAELLRRLPFELTAGQREVLDVLS

SEQ ID NO: 1529903 - protein, 24 aa, Mycobacterium tuberculosis
SNGMLWRGDHEGLFGLSYGITIPQ

SEQ ID NO: 1529904 - protein, 19 aa, Mycobacterium tuberculosis
SNIAYTKKLWQAIRAQDVC

SEQ ID NO: 1529905 - protein, 24 aa, Mycobacterium tuberculosis
SNLTYPYGAYFCVVDIDPGTAVVK

SEQ ID NO: 1529906 - protein, 21 aa, Mycobacterium tuberculosis
SNNISRVAWLTAGLPEHVGAT

SEQ ID NO: 1529907 - protein, 22 aa, Mycobacterium tuberculosis
SNNISRVAWLTAGLPEHVGATT

SEQ ID NO: 1529908 - protein, 24 aa, Mycobacterium tuberculosis
SNQTAIHLVTLLEALPVQETLEAI

SEQ ID NO: 1529909 - protein, 17 aa, Mycobacterium tuberculosis
SNRPAIYVATYFGDPGA

SEQ ID NO: 1529910 - protein, 22 aa, Mycobacterium tuberculosis
SNVPGPPFPLYMAGARLDSLVP

SEQ ID NO: 1529911 - protein, 22 aa, Mycobacterium tuberculosis
SNWFGLNAPLIAAVEGAYEQMW

SEQ ID NO: 1529912 - protein, 22 aa, Mycobacterium tuberculosis
SNYRIDPFGVLASEKIAVLRDY

SEQ ID NO: 1529913 - protein, 17 aa, Mycobacterium tuberculosis
SPALDLYGLLSPRADRH

SEQ ID NO: 1529914 - protein, 27 aa, Mycobacterium tuberculosis
SPASMRKFFEAFAPYGLKQTAVKPSYG

SEQ ID NO: 1529915 - protein, 25 aa, Mycobacterium tuberculosis
SPDGQDGGLLFGNGGAGYNSAATPG

SEQ ID NO: 1529916 - protein, 25 aa, Mycobacterium tuberculosis
SPDSPPRTIALIGDLTFVHDSSGLL

SEQ ID NO: 1529917 - protein, 28 aa, Mycobacterium tuberculosis
SPDSYPTQFLRGGPWTRWGCCPPRGWDR

SEQ ID NO: 1529918 - protein, 42 aa, Mycobacterium tuberculosis
SPDVLTTYILLPSQDLPLLVPLRAIPLLGNPLADLIQPDLRV

SEQ ID NO: 1529919 - protein, 23 aa, Mycobacterium tuberculosis
SPEALAWPLLAVIDASLDEPWCR

SEQ ID NO: 1529920 - protein, 22 aa, Mycobacterium tuberculosis
SPELFCTIRNFYDADPLAKAAS

SEQ ID NO: 1529921 - protein, 23 aa, Mycobacterium tuberculosis
SPERVVWPTWVSCLASHLAPATT

SEQ ID NO: 1529922 - protein, 18 aa, Mycobacterium tuberculosis
SPGKDYGYVILPVAVPEG

SEQ ID NO: 1529923 - protein, 32 aa, Mycobacterium tuberculosis
SPGRAAASPAKPSPWMRIGAGSVHPVTATRTS

SEQ ID NO: 1529924 - protein, 19 aa, Mycobacterium tuberculosis
SPHFLRCLTGFILRSRRPL

SEQ ID NO: 1529925 - protein, 24 aa, Mycobacterium tuberculosis
SPLDSLDWPYYIGQLSVEGSAGAS

SEQ ID NO: 1529926 - protein, 27 aa, Mycobacterium tuberculosis
SPLQARCGWAVGWRKDAFFGRAALLAE

SEQ ID NO: 1529927 - protein, 36 aa, Mycobacterium tuberculosis
SPLQQALNVINAPTQTLLGRPLIGNGTNGAPGTGQA

SEQ ID NO: 1529928 - protein, 22 aa, Mycobacterium tuberculosis
SPNILYLVWDDVGIATWDCFGG

SEQ ID NO: 1529929 - protein, 17 aa, Mycobacterium tuberculosis
SPNPLPLQQLRARPRRR

SEQ ID NO: 1529930 - protein, 21 aa, Mycobacterium tuberculosis
SPPAALSWVEPILQATTTLCV

SEQ ID NO: 1529931 - protein, 28 aa, Mycobacterium tuberculosis
SPPIPIWLLPVRPMPMLLLPVLPKPKLP

SEQ ID NO: 1529932 - protein, 23 aa, Mycobacterium tuberculosis
SPPLPPAPPAPPLPYSRPALPPA

SEQ ID NO: 1529933 - protein, 18 aa, Mycobacterium tuberculosis
SPPRGFTPAPPPQCDDLD

SEQ ID NO: 1529934 - protein, 27 aa, Mycobacterium tuberculosis
SPQAQRMLKFAFNLLDDGLVGQQLFAG

SEQ ID NO: 1529935 - protein, 20 aa, Mycobacterium tuberculosis
SPQFGVVGGFSHGLCPFKQG

SEQ ID NO: 1529936 - protein, 32 aa, Mycobacterium tuberculosis; identical to SEQ ID NO: 163746

SEQ ID NO: 1529937 - protein, 22 aa, Mycobacterium tuberculosis
SPRGLMVATPLRAAAPRLRSPR

SEQ ID NO: 1529938 - protein, 29 aa, Mycobacterium tuberculosis
SPRQAPERPLAPVPPRPAPERRRAAQVAP

SEQ ID NO: 1529939 - protein, 39 aa, Mycobacterium tuberculosis
SPRRPPGQPYLAYRPVCRPAWLPTLRRPWRRSPERPSSW

SEQ ID NO: 1529940 - protein, 28 aa, Mycobacterium tuberculosis
SPSGAPMRWARWPPALIGLPAAAVIPTA

SEQ ID NO: 1529941 - protein, 27 aa, Mycobacterium tuberculosis
SPSPPPIPPIPPIPEIPQLPPGIPQVP

SEQ ID NO: 1529942 - protein, 24 aa, Mycobacterium tuberculosis
SPSSPPRWPTPCSDTSWVAGSCST

SEQ ID NO: 1529943 - protein, 40 aa, Mycobacterium tuberculosis
SPTCPPRWMCPPARPPKPTWPAKPLNIVPTSWPATPSGSW

SEQ ID NO: 1529944 - protein, 26 aa, Mycobacterium tuberculosis
SPTPSSMRFFFFLVVFFSSKECIHPF

SEQ ID NO: 1529945 - protein, 24 aa, Mycobacterium tuberculosis
SPTSMPALRLLLDHLTRGRVMFGT

SEQ ID NO: 1529946 - protein, 23 aa, Mycobacterium tuberculosis
SPVGPGGWFVGQRRPTADRGAPG

SEQ ID NO: 1529947 - protein, 20 aa, Mycobacterium tuberculosis
SPVLAAILHNASSVAVVANS

SEQ ID NO: 1529948 - protein, 29 aa, Mycobacterium tuberculosis
SPVNAAISALVLPSAFRPIPDPNTPTGSR

SEQ ID NO: 1529949 - protein, 22 aa, Mycobacterium tuberculosis
SPVRGPAPMLAAAVAWDGLAAE

SEQ ID NO: 1529950 - protein, 28 aa, Mycobacterium tuberculosis
SPWVGNIDLTFPYLDTPATRAIGVPPGS

SEQ ID NO: 1529951 - protein, 30 aa, Mycobacterium tuberculosis
SPWVGNIDLTFPYLDTPATRAIGVPSGSRG

SEQ ID NO: 1529952 - protein, 21 aa, Mycobacterium tuberculosis
SPYIDFDAMRLKMITTPTDWP

SEQ ID NO: 1529953 - protein, 23 aa, Mycobacterium tuberculosis
SQFGPYQLLRLLGRGGMGEVYEA

SEQ ID NO: 1529954 - protein, 24 aa, Mycobacterium tuberculosis
SQGGGNPGFGGDGGTGGPGGVGVP

SEQ ID NO: 1529955 - protein, 24 aa, Mycobacterium tuberculosis
SQGLFTPEQFWPVTPDLGNLTFNQ

SEQ ID NO: 1529956 - protein, 23 aa, Mycobacterium tuberculosis
SQGRGQLCWPDCGIPSIPPGHGW

SEQ ID NO: 1529957 - protein, 34 aa, Mycobacterium tuberculosis
SQHGGILLITHYTRILRYIHPEYVHVFVGGRIVE

SEQ ID NO: 1529958 - protein, 17 aa, Mycobacterium tuberculosis
SQIATLILPADVCWSDG

SEQ ID NO: 1529959 - protein, 26 aa, Mycobacterium tuberculosis
SQLKPARRFRRRRRNWGLFMTQHRWA

SEQ ID NO: 1529960 - protein, 22 aa, Mycobacterium tuberculosis
SQMSFVIAVPEALTMAASDLAN

SEQ ID NO: 1529961 - protein, 23 aa, Mycobacterium tuberculosis
SQMSFVIAVPEALTMAASDLANI

SEQ ID NO: 1529962 - protein, 20 aa, Mycobacterium tuberculosis
SQQQLIQRFARPLRTFFENA

SEQ ID NO: 1529963 - protein, 23 aa, Mycobacterium tuberculosis
SQSEIWWERPILTPIVIDVLDHA

SEQ ID NO: 1529964 - protein, 22 aa, Mycobacterium tuberculosis
SQTRRRVAVLGGNRIPFARSDG

SEQ ID NO: 1529965 - protein, 20 aa, Mycobacterium tuberculosis
SQVPPQRWQPFEGGPPEVAA

SEQ ID NO: 1529966 - protein, 20 aa, Mycobacterium tuberculosis
SQVVNILWAHRAAVEHPVTC

SEQ ID NO: 1529967 - protein, 24 aa, Mycobacterium tuberculosis
SQVVNILWAHRAAVKHPVTCPVPI

SEQ ID NO: 1529968 - protein, 20 aa, Mycobacterium tuberculosis
SQWLGMGIELLDTAPAFAQQ

SEQ ID NO: 1529969 - protein, 20 aa, Mycobacterium tuberculosis
SRAAHMGRRYGRRLTVMADR

SEQ ID NO: 1529970 - protein, 21 aa, Mycobacterium tuberculosis
SRAAVQIAFALRAGANRYAEA

SEQ ID NO: 1529971 - protein, 27 aa, Mycobacterium tuberculosis
SRAKLNWWESRALYGWTVLVPRTKDQA

SEQ ID NO: 1529972 - protein, 22 aa, Mycobacterium tuberculosis
SRAPWRLLQVYQDPANTTSTLF

SEQ ID NO: 1529973 - protein, 21 aa, Mycobacterium tuberculosis
SRATLRRLYRHPRSGALVAME

SEQ ID NO: 1529974 - protein, 20 aa, Mycobacterium tuberculosis
SRAYQRLPFGQGPDVWLAAL

SEQ ID NO: 1529975 - protein, 21 aa, Mycobacterium tuberculosis
SRAYQRLPFGQGPDVWLAALA

SEQ ID NO: 1529976 - protein, 18 aa, Mycobacterium tuberculosis
SRCIPGCARGPRCLLQRP

SEQ ID NO: 1529977 - protein, 27 aa, Mycobacterium tuberculosis
SRCIVPKHIPVTWWPKTDSVSPQLGWL

SEQ ID NO: 1529978 - protein, 18 aa, Mycobacterium tuberculosis
SRCWLPRTRRWSRGLWSI

SEQ ID NO: 1529979 - protein, 18 aa, Mycobacterium tuberculosis
SRDLGVTEFMLLQAAVAV

SEQ ID NO: 1529980 - protein, 25 aa, Mycobacterium tuberculosis
SRDLQPWLAVPDRLLHYRPGWQVSA

SEQ ID NO: 1529981 - protein, 20 aa, Mycobacterium tuberculosis
SRDTAFFWDGVKAHELRIQR

SEQ ID NO: 1529982 - protein, 29 aa, Mycobacterium tuberculosis
SRERGPAMEYLIAAQDVLVAAAADLEGIG

SEQ ID NO: 1529983 - protein, 27 aa, Mycobacterium tuberculosis
SRESVSTWVFVVWPRSPPRTAHAARSW

SEQ ID NO: 1529984 - protein, 18 aa, Mycobacterium tuberculosis
SRFSALTRDWFTSTFAAP

SEQ ID NO: 1529985 - protein, 20 aa, Mycobacterium tuberculosis
SRFSPQLRSKRPGRGKSYTL

SEQ ID NO: 1529986 - protein, 24 aa, Mycobacterium tuberculosis
SRGAIFHHFRDKDALFFALAREDT

SEQ ID NO: 1529987 - protein, 20 aa, Mycobacterium tuberculosis
SRGERIWVAGYAVRDPSPRA

SEQ ID NO: 1529988 - protein, 20 aa, Mycobacterium tuberculosis
SRGFRLRGAAPDTRIALGAF

SEQ ID NO: 1529989 - protein, 25 aa, Mycobacterium tuberculosis
SRGLGQRLLYPIHERRWRGKWHGQC

SEQ ID NO: 1529990 - protein, 17 aa, Mycobacterium tuberculosis
SRGVWQFIAPTFAAYHE

SEQ ID NO: 1529991 - protein, 19 aa, Mycobacterium tuberculosis
SRHGRQHRYRWRRRRRWGR

SEQ ID NO: 1529992 - protein, 19 aa, Mycobacterium tuberculosis
SRHGSVRIATQKALTWAGT

SEQ ID NO: 1529993 - protein, 23 aa, Mycobacterium tuberculosis
SRHRRRHRGVLGRRSRASGGAYH

SEQ ID NO: 1529994 - protein, 25 aa, Mycobacterium tuberculosis
SRKRSQSHMPPRTPPRGRCLRAPEA

SEQ ID NO: 1529995 - protein, 20 aa, Mycobacterium tuberculosis
SRLAALYGLQLAHESQCCQM

SEQ ID NO: 1529996 - protein, 23 aa, Mycobacterium tuberculosis
SRLNRLLAQQIPPARKVLAGADD

SEQ ID NO: 1529997 - protein, 18 aa, Mycobacterium tuberculosis
SRLRLFEITAGLADKYVP

SEQ ID NO: 1529998 - protein, 27 aa, Mycobacterium tuberculosis
SRNTGARLRRRAVTVATAATVASAAGP

SEQ ID NO: 1529999 - protein, 24 aa, Mycobacterium tuberculosis
SRNTVAIFLGIKDPKHSGLNRPGM

SEQ ID NO: 1530000 - protein, 31 aa, Mycobacterium tuberculosis; identical to SEQ ID NO: 1391169

SEQ ID NO: 1530001 - protein, 18 aa, Mycobacterium tuberculosis
SRQLAALSIFANSGGKTA

SEQ ID NO: 1530002 - protein, 19 aa, Mycobacterium tuberculosis
SRQLAALSIFANSGGKTAE

SEQ ID NO: 1530003 - protein, 37 aa, Mycobacterium tuberculosis
SRRHMWRAPCRFGTRLRWWHCAAGCWCGWAVPAAWSR

SEQ ID NO: 1530004 - protein, 23 aa, Mycobacterium tuberculosis
SRSANPRLLAALLYTEQPTTTTG

SEQ ID NO: 1530005 - protein, 22 aa, Mycobacterium tuberculosis
SRSCARFHARPIRAIQRTCPSL

SEQ ID NO: 1530006 - protein, 29 aa, Mycobacterium tuberculosis
SRSEPPLPPFPPTPPVPPTFKALPLAPES

SEQ ID NO: 1530007 - protein, 24 aa, Mycobacterium tuberculosis
SRSLTRLAGRLLGWLLVCDPERQS

SEQ ID NO: 1530008 - protein, 19 aa, Mycobacterium tuberculosis
SRSTALPVRSTRNCATCWA

SEQ ID NO: 1530009 - protein, 24 aa, Mycobacterium tuberculosis
SRTHWFRSWVSKCWSRSLSGDRER

SEQ ID NO: 1530010 - protein, 30 aa, Mycobacterium tuberculosis
SRTLMDSHPFTWLPLLSRVLGSAQLVSEAV

SEQ ID NO: 1530011 - protein, 17 aa, Mycobacterium tuberculosis
SRTPWRLNQNYLRDIRL

SEQ ID NO: 1530012 - protein, 18 aa, Mycobacterium tuberculosis
SRTWLRRAPTAWPAAASG

SEQ ID NO: 1530013 - protein, 20 aa, Mycobacterium tuberculosis
SRVELPLLSPARARSYCATV

SEQ ID NO: 1530014 - protein, 19 aa, Mycobacterium tuberculosis
SRVFGRIDPIALSGEDYRR

SEQ ID NO: 1530015 - protein, 18 aa, Mycobacterium tuberculosis
SRVFINEARWVRGAVPFE

SEQ ID NO: 1530016 - protein, 17 aa, Mycobacterium tuberculosis
SRWLSSVLPGGAAPEVT

SEQ ID NO: 1530017 - protein, 19 aa, Mycobacterium tuberculosis
SSAARHLAARWAAKEAVIK

SEQ ID NO: 1530018 - protein, 24 aa, Mycobacterium tuberculosis
SSAIPTIRLRPMPTTCPAFSAVSA

SEQ ID NO: 1530019 - protein, 17 aa, Mycobacterium tuberculosis
SSATWPEPISYTALDRG

SEQ ID NO: 1530020 - protein, 24 aa, Mycobacterium tuberculosis
SSCCPKLRLGGLRRAGRHPTCSAR

SEQ ID NO: 1530021 - protein, 39 aa, Mycobacterium tuberculosis
SSDDESIWQLLKNIPIHQLRRTGLLDKVLLLAGQPEESL

SEQ ID NO: 1530022 - protein, 30 aa, Mycobacterium tuberculosis; identical to SEQ ID NO: 223145

SEQ ID NO: 1530023 - protein, 23 aa, Mycobacterium tuberculosis
SSFANGAARRRGRCRRAPLRQWR

SEQ ID NO: 1530024 - protein, 18 aa, Mycobacterium tuberculosis
SSGLMAVHLACRSLHDGE

SEQ ID NO: 1530025 - protein, 17 aa, Mycobacterium tuberculosis
SSGLTAIHLACRSLHDG

SEQ ID NO: 1530026 - protein, 17 aa, Mycobacterium tuberculosis
SSLLADARRLAPGGAIV

SEQ ID NO: 1530027 - protein, 18 aa, Mycobacterium tuberculosis
SSNLARFDAMRYGLRVGD

SEQ ID NO: 1530028 - protein, 26 aa, Mycobacterium tuberculosis
SSPRWDAHSFALLRPQSALGQAPIVM

SEQ ID NO: 1530029 - protein, 23 aa, Mycobacterium tuberculosis
SSPYSHWAFQHVEDFMPTTVIAR

SEQ ID NO: 1530030 - protein, 17 aa, Mycobacterium tuberculosis
SSQAPVMWALSASLGWI

SEQ ID NO: 1530031 - protein, 23 aa, Mycobacterium tuberculosis
SSQMRSWFNYRFDGPNAVNNIPF

SEQ ID NO: 1530032 - protein, 18 aa, Mycobacterium tuberculosis
SSRKLSLASGFALWRRSL

SEQ ID NO: 1530033 - protein, 29 aa, Mycobacterium tuberculosis
SSSLNGPCSARILATAWVASNASATVATL

SEQ ID NO: 1530034 - protein, 29 aa, Mycobacterium tuberculosis
SSSPFACLLIGQPTLRRRMKLGVLAALDQ

SEQ ID NO: 1530035 - protein, 31 aa, Mycobacterium tuberculosis
SSSPFACLLIGQPTLRRRMKLGVLAALDQRI

SEQ ID NO: 1530036 - protein, 23 aa, Mycobacterium tuberculosis
SSTAPADLVRFLDRLYSAFDELV

SEQ ID NO: 1530037 - protein, 20 aa, Mycobacterium tuberculosis
SSTGGYPAGPAIATGTEQDP

SEQ ID NO: 1530038 - protein, 26 aa, Mycobacterium tuberculosis
SSTKPALTCWKPFTATISKAGADAVE

SEQ ID NO: 1530039 - protein, 23 aa, Mycobacterium tuberculosis
SSTQPYPTLRWHSQRGGSAVSHY

SEQ ID NO: 1530040 - protein, 21 aa, Mycobacterium tuberculosis
SSTVLFLGRHVGYPVALEGAL

SEQ ID NO: 1530041 - protein, 23 aa, Mycobacterium tuberculosis
SSWNEITPCNLSLDRLANAVKEG

SEQ ID NO: 1530042 - protein, 17 aa, Mycobacterium tuberculosis
SSWPAGRRAAAPRLGWI

SEQ ID NO: 1530043 - protein, 22 aa, Mycobacterium tuberculosis
STAARRGYLARAVRPARCAAGT

SEQ ID NO: 1530044 - protein, 22 aa, Mycobacterium tuberculosis
STADDYLRFVRMLLGDGTVDGV

SEQ ID NO: 1530045 - protein, 23 aa, Mycobacterium tuberculosis
STAGSLQGQWRGAAGTAAQAAVV

SEQ ID NO: 1530046 - protein, 24 aa, Mycobacterium tuberculosis
STAIATLFGIHAREYQAISMQVAA

SEQ ID NO: 1530047 - protein, 23 aa, Mycobacterium tuberculosis
STALIRFRILAKLLSDKRSRAVS

SEQ ID NO: 1530048 - protein, 24 aa, Mycobacterium tuberculosis
STAWREWAAAPDGWLAIPHGEILC

SEQ ID NO: 1530049 - protein, 22 aa, Mycobacterium tuberculosis
STAWTSTWRRWCIPANAATSST

SEQ ID NO: 1530050 - protein, 26 aa, Mycobacterium tuberculosis
STDPRSRVPALPRLGPTDALPRCRQT

SEQ ID NO: 1530051 - protein, 31 aa, Mycobacterium tuberculosis
STGTPHCAAVGRIAYLLGLRGPAVAVDTACS

SEQ ID NO: 1530052 - protein, 21 aa, Mycobacterium tuberculosis
STHPPGTPLLKLVRELRADRG

SEQ ID NO: 1530053 - protein, 24 aa, Mycobacterium tuberculosis
STIAAALALTLQRRRKVLLVEVEG

SEQ ID NO: 1530054 - protein, 18 aa, Mycobacterium tuberculosis
STIAQQPAAATPGPTGGA

SEQ ID NO: 1530055 - protein, 22 aa, Mycobacterium tuberculosis
STKARPRYIRIAADLPSTATHK

SEQ ID NO: 1530056 - protein, 22 aa, Mycobacterium tuberculosis
STKPAYSIVLPPPNVTGSLHMG

SEQ ID NO: 1530057 - protein, 22 aa, Mycobacterium tuberculosis
STLAAPLVLPASGSVAVQVVVN

SEQ ID NO: 1530058 - protein, 21 aa, Mycobacterium tuberculosis
STLSFFRLALRLRRERNEFDG

SEQ ID NO: 1530059 - protein, 29 aa, Mycobacterium tuberculosis
STLTLRSLPFLPIGIGPWVAARMWQVAAF

SEQ ID NO: 1530060 - protein, 26 aa, Mycobacterium tuberculosis
STLVSAWYLLPKPDDGHPLVVVTAAG

SEQ ID NO: 1530061 - protein, 25 aa, Mycobacterium tuberculosis
STNDWIDRTAQFASGAIVFSIGVLT

SEQ ID NO: 1530062 - protein, 23 aa, Mycobacterium tuberculosis
STNIPFLQAVLDDPDFRAGRVTT

SEQ ID NO: 1530063 - protein, 27 aa, Mycobacterium tuberculosis
STNTFPSWPLAHPFRRIAHNGEINTVT

SEQ ID NO: 1530064 - protein, 25 aa, Mycobacterium tuberculosis
STPGAKGAHGFTPTSGGDGGDGGNG

SEQ ID NO: 1530065 - protein, 17 aa, Mycobacterium tuberculosis
STPTLCPGPTWSTCFPP

SEQ ID NO: 1530066 - protein, 24 aa, Mycobacterium tuberculosis
STQVAAFHDRFAQTLSAAVGSYVS

SEQ ID NO: 1530067 - protein, 22 aa, Mycobacterium tuberculosis
STSWAQRWLAATGSRDYLGAFV

SEQ ID NO: 1530068 - protein, 26 aa, Mycobacterium tuberculosis
STTKLTAPVLPLRCSMPRRPQYGQRL

SEQ ID NO: 1530069 - protein, 25 aa, Mycobacterium tuberculosis
STTSTVLPFTGLNTPLAVAVDSDRT

SEQ ID NO: 1530070 - protein, 23 aa, Mycobacterium tuberculosis
STTWPKLTGMPMLGISVLGEAHD

SEQ ID NO: 1530071 - protein, 20 aa, Mycobacterium tuberculosis
STVLFLGRHVGYPVALEGAL

SEQ ID NO: 1530072 - protein, 23 aa, Mycobacterium tuberculosis
STVPGLMHVRVRPVPRSRRQVRG

SEQ ID NO: 1530073 - protein, 25 aa, Mycobacterium tuberculosis
STVQRLLLDPLQLAHTRYFSDQIIG

SEQ ID NO: 1530074 - protein, 30 aa, Mycobacterium tuberculosis
STVRHLEVIALTPARLLMMVITDSGRVDQR

SEQ ID NO: 1530075 - protein, 17 aa, Mycobacterium tuberculosis
STYFNEQVFPVLTPLAV

SEQ ID NO: 1530076 - protein, 18 aa, Mycobacterium tuberculosis
STYLNDFAQLLAALGRRY

SEQ ID NO: 1530077 - protein, 23 aa, Mycobacterium tuberculosis
SVACQGFITQLGRNFQVIYEQAN

SEQ ID NO: 1530078 - protein, 18 aa, Mycobacterium tuberculosis
SVALDWLRNNGYQDLASR

SEQ ID NO: 1530079 - protein, 18 aa, Mycobacterium tuberculosis
SVASCAAVIIPPGSRIRA

SEQ ID NO: 1530080 - protein, 21 aa, Mycobacterium tuberculosis
SVATAMIPFLEHDDANRALMG

SEQ ID NO: 1530081 - protein, 20 aa, Mycobacterium tuberculosis
SVCWYAPELGPGTGTVFSGD

SEQ ID NO: 1530082 - protein, 25 aa, Mycobacterium tuberculosis
SVEGFQVHLGGHLGLDAGFGRKLRQ

SEQ ID NO: 1530083 - protein, 25 aa, Mycobacterium tuberculosis
SVEHFNWLEGLGFQFERSYFPGKAV

SEQ ID NO: 1530084 - protein, 25 aa, Mycobacterium tuberculosis
SVERATRLRIPAERWVYPQAGTDAH

SEQ ID NO: 1530085 - protein, 19 aa, Mycobacterium tuberculosis
SVERLIAAHLMDPAPQPSQ

SEQ ID NO: 1530086 - protein, 24 aa, Mycobacterium tuberculosis
SVEYLVDAVFNYPTFSEAYKNAAL

SEQ ID NO: 1530087 - protein, 24 aa, Mycobacterium tuberculosis
SVFEHRAVVVGGDRDRLLAGLDEL

SEQ ID NO: 1530088 - protein, 24 aa, Mycobacterium tuberculosis
SVFSVEFLVHAWDYAVAVVSELKA

SEQ ID NO: 1530089 - protein, 18 aa, Mycobacterium tuberculosis
SVGGTLYAAGGNGGDGGL

SEQ ID NO: 1530090 - protein, 27 aa, Mycobacterium tuberculosis
SVGLDAFTLLPDGFTLDTVPATFDGTI

SEQ ID NO: 1530091 - protein, 24 aa, Mycobacterium tuberculosis
SVGLGLELLVSLVADTSLPAARAI

SEQ ID NO: 1530092 - protein, 27 aa, Mycobacterium tuberculosis
SVGNSWTPLAPVVEPPTPPTPASAAEP

SEQ ID NO: 1530093 - protein, 26 aa, Mycobacterium tuberculosis
SVGPITISPITLFPAQNFNTTFPVGP

SEQ ID NO: 1530094 - protein, 21 aa, Mycobacterium tuberculosis
SVGPRRKWFRRKPNYAIQRSI

SEQ ID NO: 1530095 - protein, 23 aa, Mycobacterium tuberculosis
SVHRFDLFVPVFRNHLVELSAEF

SEQ ID NO: 1530096 - protein, 17 aa, Mycobacterium tuberculosis
SVHTLQQAALNVVNEPF

SEQ ID NO: 1530097 - protein, 17 aa, Mycobacterium tuberculosis
SVIAGWPNLAAELQLAF

SEQ ID NO: 1530098 - protein, 18 aa, Mycobacterium tuberculosis
SVLAALRPYVVGDCLVAF

SEQ ID NO: 1530099 - protein, 19 aa, Mycobacterium tuberculosis
SVLFLLLKTIATSRSHRAS

SEQ ID NO: 1530100 - protein, 18 aa, Mycobacterium tuberculosis
SVLLDHVLTGFDGRSAAQ

SEQ ID NO: 1530101 - protein, 17 aa, Mycobacterium tuberculosis
SVLLGRRDGLSRVDEFE

SEQ ID NO: 1530102 - protein, 27 aa, Mycobacterium tuberculosis
SVLMTENRVRHVPVLDGKKLIGIVSIG

SEQ ID NO: 1530103 - protein, 23 aa, Mycobacterium tuberculosis
SVLQAPLFTAYGTLYQQVSAEAA

SEQ ID NO: 1530104 - protein, 31 aa, Mycobacterium tuberculosis
SVLTTLSAPRTAGWRWCSAPAAIVTRASGPR

SEQ ID NO: 1530105 - protein, 20 aa, Mycobacterium tuberculosis
SVMTDPLLKVVNSRLRELGE

SEQ ID NO: 1530106 - protein, 27 aa, Mycobacterium tuberculosis
SVMTQELLEFPGGILGVALNLDEHSVG

SEQ ID NO: 1530107 - protein, 17 aa, Mycobacterium tuberculosis
SVNMDLTFVVDALPRPG

SEQ ID NO: 1530108 - protein, 27 aa, Mycobacterium tuberculosis
SVPGLVRVLPPFLSRKHLPSRLAKLRE

SEQ ID NO: 1530109 - protein, 22 aa, Mycobacterium tuberculosis
SVPLTFLCACGPAYLPERDQRM

SEQ ID NO: 1530110 - protein, 17 aa, Mycobacterium tuberculosis
SVPPAWAAANQAVTPAA

SEQ ID NO: 1530111 - protein, 22 aa, Mycobacterium tuberculosis
SVQDPYPLYERMRAAGSVHRIA

SEQ ID NO: 1530112 - protein, 17 aa, Mycobacterium tuberculosis
SVRAQTLPPGRGLLVGA

SEQ ID NO: 1530113 - protein, 21 aa, Mycobacterium tuberculosis
SVRAYLKQIGKVALLNAEEEV

SEQ ID NO: 1530114 - protein, 24 aa, Mycobacterium tuberculosis
SVRELAVFWTARSIGCSWCVDFGA

SEQ ID NO: 1530115 - protein, 18 aa, Mycobacterium tuberculosis
SVRIATQKALTWAGTCKP

SEQ ID NO: 1530116 - protein, 17 aa, Mycobacterium tuberculosis
SVRMPLTLNIPAGIPLE

SEQ ID NO: 1530117 - protein, 33 aa, Mycobacterium tuberculosis
SVRSPGRWAAIPRWPTWWLTGSATKVVARSGGP

SEQ ID NO: 1530118 - protein, 32 aa, Mycobacterium tuberculosis
SVRYLLAVGDLLIGWRLLVLAGVAHAALADGP

SEQ ID NO: 1530119 - protein, 24 aa, Mycobacterium tuberculosis
SVSDGFQAFVYGPIHATGQQWINS

SEQ ID NO: 1530120 - protein, 21 aa, Mycobacterium tuberculosis
SVSFTPVLIPASRGILATCTA

SEQ ID NO: 1530121 - protein, 20 aa, Mycobacterium tuberculosis
SVSGRRPTPGTAAYGAAKGR

SEQ ID NO: 1530122 - protein, 24 aa, Mycobacterium tuberculosis
SVSIHRDWLLIELRTDWTVGHHQV

SEQ ID NO: 1530123 - protein, 27 aa, Mycobacterium tuberculosis
SVTDMPDRVVWLPLNSAGSTVHRQLRV

SEQ ID NO: 1530124 - protein, 23 aa, Mycobacterium tuberculosis
SVTFREGPFVWWEHLLEGGDTPT

SEQ ID NO: 1530125 - protein, 26 aa, Mycobacterium tuberculosis
SVTRTPIHLMGLDKTFRLFSTLHDAL

SEQ ID NO: 1530126 - protein, 20 aa, Mycobacterium tuberculosis
SVVAPSQFTFSSRSPDFVDE

SEQ ID NO: 1530127 - protein, 25 aa, Mycobacterium tuberculosis
SVVNAAVLYVFRTLVADDIPLNDGC

SEQ ID NO: 1530128 - protein, 26 aa, Mycobacterium tuberculosis
SVVNAAVLYVFRTLVADDIPLNDGCL

SEQ ID NO: 1530129 - protein, 25 aa, Mycobacterium tuberculosis
SVWLCDHFLTISPGEYAKVAGIAAD

SEQ ID NO: 1530130 - protein, 20 aa, Mycobacterium tuberculosis
SVYLAIYPRRDGGSGHHANV

SEQ ID NO: 1530131 - protein, 17 aa, Mycobacterium tuberculosis
SWAAGLRDNGQTTLLVT

SEQ ID NO: 1530132 - protein, 17 aa, Mycobacterium tuberculosis
SWATAWRPQRSCRNYVR

SEQ ID NO: 1530133 - protein, 21 aa, Mycobacterium tuberculosis
SWDPFPEFLGGLRFAGAQVVP

SEQ ID NO: 1530134 - protein, 19 aa, Mycobacterium tuberculosis
SWGGFPLRDRVAAAVPGVP

SEQ ID NO: 1530135 - protein, 20 aa, Mycobacterium tuberculosis
SWIARLLRAPVRRARRRAQA

SEQ ID NO: 1530136 - protein, 17 aa, Mycobacterium tuberculosis
SWLHRIVVNACLDRLRR

SEQ ID NO: 1530137 - protein, 26 aa, Mycobacterium tuberculosis
SWLSSSAWPWQPYLLSHHQGGIAVTD

SEQ ID NO: 1530138 - protein, 19 aa, Mycobacterium tuberculosis
SWNAGNVNTGFGIITDSGL

SEQ ID NO: 1530139 - protein, 18 aa, Mycobacterium tuberculosis
SWPMAGTPAWRQLDDADP

SEQ ID NO: 1530140 - protein, 20 aa, Mycobacterium tuberculosis
SWSFVWRDVLLRLANDFRCV

SEQ ID NO: 1530141 - protein, 26 aa, Mycobacterium tuberculosis
SWSHPNDWWIVRLLGSITPTERTTIV

SEQ ID NO: 1530142 - protein, 22 aa, Mycobacterium tuberculosis
SWTARTWQMLAARGVRIAADVA

SEQ ID NO: 1530143 - protein, 18 aa, Mycobacterium tuberculosis
SWTTPFTEVLDWSGAPFA

SEQ ID NO: 1530144 - protein, 28 aa, Mycobacterium tuberculosis
SYAGRMIDSYLPGCWLDSGPFGCLGSGP

SEQ ID NO: 1530145 - protein, 19 aa, Mycobacterium tuberculosis
SYALYPHMTVRQNIAFPLT

SEQ ID NO: 1530146 - protein, 34 aa, Mycobacterium tuberculosis
SYAQSYQAFGAQLSAFHAQFVQSLTNGARSYVVA

SEQ ID NO: 1530147 - protein, 22 aa, Mycobacterium tuberculosis
SYARQRPGLLAAWLDGDLGELP

SEQ ID NO: 1530148 - protein, 26 aa, Mycobacterium tuberculosis
SYEFLRLLEHRLQLQRLKRTHLLPDP

SEQ ID NO: 1530149 - protein, 22 aa, Mycobacterium tuberculosis
SYGRYWREVFRLPTMNHRKLAR

SEQ ID NO: 1530150 - protein, 21 aa, Mycobacterium tuberculosis
SYGTYFLCADPRPLGYDDSTE

SEQ ID NO: 1530151 - protein, 23 aa, Mycobacterium tuberculosis
SYGTYFLCADPRPLGYDDSTEFC

SEQ ID NO: 1530152 - protein, 20 aa, Mycobacterium tuberculosis
SYLLRIELADRPGSLGSLAV

SEQ ID NO: 1530153 - protein, 20 aa, Mycobacterium tuberculosis
SYLRCLRVLTAGRGYPMVAT

SEQ ID NO: 1530154 - protein, 26 aa, Mycobacterium tuberculosis
SYNTPWIRRSRCWIRWATPPCGRTHC

SEQ ID NO: 1530155 - protein, 26 aa, Mycobacterium tuberculosis
SYPQKPPVGAALWKLMERARQVGLHV

SEQ ID NO: 1530156 - protein, 25 aa, Mycobacterium tuberculosis
SYPTAMLMVFKLHRDFDIAEALKHG

SEQ ID NO: 1530157 - protein, 18 aa, Mycobacterium tuberculosis
SYRLGARTLYHQFGAPLY

SEQ ID NO: 1530158 - protein, 19 aa, Mycobacterium tuberculosis
SYRLGARTLYHQFGAPLYG

SEQ ID NO: 1530159 - protein, 24 aa, Mycobacterium tuberculosis
SYRPGLLCVRQIRFTHMGEYDFLE

SEQ ID NO: 1530160 - protein, 27 aa, Mycobacterium tuberculosis
SYSTFTLQPAAMLALPVCRRPGAKTVT

SEQ ID NO: 1530161 - protein, 18 aa, Mycobacterium tuberculosis
SYTSPLPPLPVVAAVSVV

SEQ ID NO: 1530162 - protein, 19 aa, Mycobacterium tuberculosis
SYVRLGLAAQLARQLGARW

SEQ ID NO: 1530163 - protein, 22 aa, Mycobacterium tuberculosis
TAAALSWTLWELAHAPEIQSQV

SEQ ID NO: 1530164 - protein, 36 aa, Mycobacterium tuberculosis
TAAATPGWLEWFINWYLPISQLFYNTVGLPYFATGI

SEQ ID NO: 1530165 - protein, 33 aa, Mycobacterium tuberculosis
TAALLMQATAGRVATAATAAWVGPGETVAPPVV

SEQ ID NO: 1530166 - protein, 25 aa, Mycobacterium tuberculosis
TAAQPLEWFCLFSSAAALVGSPGQG

SEQ ID NO: 1530167 - protein, 18 aa, Mycobacterium tuberculosis
TAATPGVGRPRKAKARPR

SEQ ID NO: 1530168 - protein, 22 aa, Mycobacterium tuberculosis
TAAWRKLLVNALAGFMVLSGRR

SEQ ID NO: 1530169 - protein, 26 aa, Mycobacterium tuberculosis
TADGALRVAPAVSAAPEAAPSRSGNG

SEQ ID NO: 1530170 - protein, 25 aa, Mycobacterium tuberculosis
TAEPLPRWWRPAGSLFDQFLGAAET

SEQ ID NO: 1530171 - protein, 30 aa, Mycobacterium tuberculosis
TAESRRATLRAPLAVMVANGSDGVAAGSGG

SEQ ID NO: 1530172 - protein, 17 aa, Mycobacterium tuberculosis
TAEVTPHHLLLDDARLA

SEQ ID NO: 1530173 - protein, 19 aa, Mycobacterium tuberculosis
TAEVTPHHLLLDDARLASY

SEQ ID NO: 1530174 - protein, 22 aa, Mycobacterium tuberculosis
TAEYKRHLAGELTVRTLRTAAG

SEQ ID NO: 1530175 - protein, 23 aa, Mycobacterium tuberculosis
TAEYKRHLAGELTVRTLRTAAGR

SEQ ID NO: 1530176 - protein, 25 aa, Mycobacterium tuberculosis
TAFAESVPIWGPRGAALIQAIPEAT

SEQ ID NO: 1530177 - protein, 26 aa, Mycobacterium tuberculosis
TAFAESVPMWGPRGAALIPAIPEATQ

SEQ ID NO: 1530178 - protein, 30 aa, Mycobacterium tuberculosis
TAFPVVPAGVGRTALRRRRQRRCPADSGTR

SEQ ID NO: 1530179 - protein, 29 aa, Mycobacterium tuberculosis
TAGCFFYSKCRYPRRPPARGGDGGVGGTG

SEQ ID NO: 1530180 - protein, 19 aa, Mycobacterium tuberculosis
TAGDLLKRLAVSGAALLST

SEQ ID NO: 1530181 - protein, 27 aa, Mycobacterium tuberculosis
TAGHATAIMWAREQFGLELIWGIEDCR

SEQ ID NO: 1530182 - protein, 28 aa, Mycobacterium tuberculosis
TAGKAGPAGSILHDGRQRAVTGGHGGCQ

SEQ ID NO: 1530183 - protein, 24 aa, Mycobacterium tuberculosis
TAGLCRALARRGVGVAPFKAQNMS

SEQ ID NO: 1530184 - protein, 21 aa, Mycobacterium tuberculosis
TAGLQPIPVPAGTEPGYRPSV

SEQ ID NO: 1530185 - protein, 26 aa, Mycobacterium tuberculosis
TAGNGGARHDQRPASAAFGGAAGGDA

SEQ ID NO: 1530186 - protein, 17 aa, Mycobacterium tuberculosis
TAGRRLSPAATAAPVVP

SEQ ID NO: 1530187 - protein, 24 aa, Mycobacterium tuberculosis
TAGTAGPERTAAPAAPPAGSSASA

SEQ ID NO: 1530188 - protein, 19 aa, Mycobacterium tuberculosis
TAGYGMWVKLLHADGTVTL

SEQ ID NO: 1530189 - protein, 22 aa, Mycobacterium tuberculosis
TAIGLTLPFGEVTLAPEVQGVI

SEQ ID NO: 1530190 - protein, 20 aa, Mycobacterium tuberculosis
TAILPNGWRDRLVSWTVESS

SEQ ID NO: 1530191 - protein, 31 aa, Mycobacterium tuberculosis
TAIRRTVYIDLRADWPAALQAAWPGLVRHRT

SEQ ID NO: 1530192 - protein, 47 aa, Mycobacterium tuberculosis
TAIRSPPCWPGSTWPLIWLTCWRPTTWRWRRTPRPLSRSTRAIGCTT

SEQ ID NO: 1530193 - protein, 18 aa, Mycobacterium tuberculosis
TAKLPYSLKVLAENLLRN

SEQ ID NO: 1530194 - protein, 19 aa, Mycobacterium tuberculosis
TAKLPYSLKVLAENLLRNE

SEQ ID NO: 1530195 - protein, 24 aa, Mycobacterium tuberculosis
TAKMTARYSQWVRSRPLLLAGKSV

SEQ ID NO: 1530196 - protein, 21 aa, Mycobacterium tuberculosis
TAKYLNTWGQRGPAVAQGCCL

SEQ ID NO: 1530197 - protein, 21 aa, Mycobacterium tuberculosis
TALDEGLLPVLPQLSARHHVL

SEQ ID NO: 1530198 - protein, 20 aa, Mycobacterium tuberculosis
TALDLARRYPVGKAVAAIDA

SEQ ID NO: 1530199 - protein, 20 aa, Mycobacterium tuberculosis
TALFNWAYARHTGGTFVFRI

SEQ ID NO: 1530200 - protein, 31 aa, Mycobacterium tuberculosis
TALPVLTMVCGYSRWASALLIPTRTAEDLYA

SEQ ID NO: 1530201 - protein, 20 aa, Mycobacterium tuberculosis
TALRRWPKCSTMSSASSRAD

SEQ ID NO: 1530202 - protein, 21 aa, Mycobacterium tuberculosis
TAMDRFRWLVAAQGGDLSKPL

SEQ ID NO: 1530203 - protein, 18 aa, Mycobacterium tuberculosis
TAMVTKILALQAKPTPAD

SEQ ID NO: 1530204 - protein, 19 aa, Mycobacterium tuberculosis
TANAYLGAWGIVDCFERGA

SEQ ID NO: 1530205 - protein, 20 aa, Mycobacterium tuberculosis
TANFGLFNSGSYNTGIGNSG

SEQ ID NO: 1530206 - protein, 17 aa, Mycobacterium tuberculosis
TANRVLLGALVATNILG

SEQ ID NO: 1530207 - protein, 22 aa, Mycobacterium tuberculosis
TANRYFHTAIVLFGNSLEQDRS

SEQ ID NO: 1530208 - protein, 23 aa, Mycobacterium tuberculosis
TAPARRVRFCVCSPVDFLGAEAT

SEQ ID NO: 1530209 - protein, 34 aa, Mycobacterium tuberculosis
TAPGGASAGLRWGRRRKRGFGWSRWTVVRQRRQR

SEQ ID NO: 1530210 - protein, 20 aa, Mycobacterium tuberculosis
TAPGHMLGGLPLGHSVNAGR

SEQ ID NO: 1530211 - protein, 20 aa, Mycobacterium tuberculosis
TAPGHMLGGLPLGQLTNSGG

SEQ ID NO: 1530212 - protein, 25 aa, Mycobacterium tuberculosis
TAPIVGYSPIIGEKPLRGMADTCLS

SEQ ID NO: 1530213 - protein, 24 aa, Mycobacterium tuberculosis
TAPRLLLEVVCARLLLPSASDAES

SEQ ID NO: 1530214 - protein, 23 aa, Mycobacterium tuberculosis
TAPRPATLYRLSVVDVLLGSQVV

SEQ ID NO: 1530215 - protein, 24 aa, Mycobacterium tuberculosis
TAQFSVVLPRRDGVEYSVEHAVIA

SEQ ID NO: 1530216 - protein, 21 aa, Mycobacterium tuberculosis
TAQIVWGARALGGPVPIPEDV

SEQ ID NO: 1530217 - protein, 27 aa, Mycobacterium tuberculosis
TAQLRSRSWWSGFDVVLLVDDWHMIVG

SEQ ID NO: 1530218 - protein, 20 aa, Mycobacterium tuberculosis
TAQRLLPRPLADTTIHVAVA

SEQ ID NO: 1530219 - protein, 25 aa, Mycobacterium tuberculosis
TARAAWAWFRHLHPLADRTLAPSTA

SEQ ID NO: 1530220 - protein, 19 aa, Mycobacterium tuberculosis
TARLAMPTAPFNVSGNPAI

SEQ ID NO: 1530221 - protein, 24 aa, Mycobacterium tuberculosis
TARPPTFVLFTTGFLEAGYRRFLE

SEQ ID NO: 1530222 - protein, 17 aa, Mycobacterium tuberculosis
TARRLAEGWNRADGLFG

SEQ ID NO: 1530223 - protein, 23 aa, Mycobacterium tuberculosis
TARTDLLAFTRLPQADLAPNLVQ

SEQ ID NO: 1530224 - protein, 23 aa, Mycobacterium tuberculosis
TASLGSRSWRKASSSHRFSKRQA

SEQ ID NO: 1530225 - protein, 23 aa, Mycobacterium tuberculosis
TASRWRRGTWRALPDRLDADGVA

SEQ ID NO: 1530226 - protein, 23 aa, Mycobacterium tuberculosis
TASRWTCTPPFLLAPSRSGGTTS

SEQ ID NO: 1530227 - protein, 17 aa, Mycobacterium tuberculosis
TATDTFSVPARSLLVLR

SEQ ID NO: 1530228 - protein, 27 aa, Mycobacterium tuberculosis
TATGGLLLPLGVRSLRAYGPTRNARYC

SEQ ID NO: 1530229 - protein, 20 aa, Mycobacterium tuberculosis
TATMEPITDSWYLTSIRAGL

SEQ ID NO: 1530230 - protein, 28 aa, Mycobacterium tuberculosis
TATMEPITDSWYLTSIRAGLEHWSDGVG

SEQ ID NO: 1530231 - protein, 24 aa, Mycobacterium tuberculosis
TATMEPITDSWYLTSIRAGLSPER

SEQ ID NO: 1530232 - protein, 25 aa, Mycobacterium tuberculosis
TAVADKQLAVRYHLLNFLDDQSHSK

SEQ ID NO: 1530233 - protein, 23 aa, Mycobacterium tuberculosis
TAVCELMRIAWRTVGAIVARVWA

SEQ ID NO: 1530234 - protein, 19 aa, Mycobacterium tuberculosis
TAVGDWMLLAAIEALIDEQ

SEQ ID NO: 1530235 - protein, 20 aa, Mycobacterium tuberculosis
TAVMGGCHLLAPPTPATAAA

SEQ ID NO: 1530236 - protein, 26 aa, Mycobacterium tuberculosis
TAVPPGSPGFCLPAFGGNGGSGGQPV

SEQ ID NO: 1530237 - protein, 20 aa, Mycobacterium tuberculosis
TAVRFIGRLPRKGPWQQKVI

SEQ ID NO: 1530238 - protein, 19 aa, Mycobacterium tuberculosis
TAVRLRAESARRTLDQLAD

SEQ ID NO: 1530239 - protein, 18 aa, Mycobacterium tuberculosis
TAVRVAARRRGTGGAVAA

SEQ ID NO: 1530240 - protein, 20 aa, Mycobacterium tuberculosis
TAVSAPPRWCQRRRRKIPSR

SEQ ID NO: 1530241 - protein, 18 aa, Mycobacterium tuberculosis
TAWLIERLQRPTLVMAPN

SEQ ID NO: 1530242 - protein, 18 aa, Mycobacterium tuberculosis
TAYLERFGTHVRAMVLDG

SEQ ID NO: 1530243 - protein, 22 aa, Mycobacterium tuberculosis
TAYYRLMDHDLRFYKDFTGTGN

SEQ ID NO: 1530244 - protein, 24 aa, Mycobacterium tuberculosis
TCATTPAELVVFGGAANGINRDAL

SEQ ID NO: 1530245 - protein, 35 aa, Mycobacterium tuberculosis
TCDRSRLTADGLWLHCLYAISGINLREPLRAGATH

SEQ ID NO: 1530246 - protein, 17 aa, Mycobacterium tuberculosis
TCGAWQTGFPRRSKSCW

SEQ ID NO: 1530247 - protein, 24 aa, Mycobacterium tuberculosis
TCGRPFADFELRIADDGEVLLRGP

SEQ ID NO: 1530248 - protein, 29 aa, Mycobacterium tuberculosis
TCLDKYARLFAWLGLWERHTDLAVIPVDA

SEQ ID NO: 1530249 - protein, 22 aa, Mycobacterium tuberculosis
TDAALVGALAWAAFTAARRIGT

SEQ ID NO: 1530250 - protein, 24 aa, Mycobacterium tuberculosis
TDAAQPIWWVVRAIEFSKDFETFV

SEQ ID NO: 1530251 - protein, 22 aa, Mycobacterium tuberculosis
TDAMFPARAFDALAAWVRAAAA

SEQ ID NO: 1530252 - protein, 18 aa, Mycobacterium tuberculosis
TDAYVRLIAMKLVASRAS

SEQ ID NO: 1530253 - protein, 24 aa, Mycobacterium tuberculosis
TDDLLIHGNRFRGALAVDAHMRRH

SEQ ID NO: 1530254 - protein, 26 aa, Mycobacterium tuberculosis
TDEAGAAALWFALDTDLPVLVDADGL

SEQ ID NO: 1530255 - protein, 24 aa, Mycobacterium tuberculosis
TDELGTALLLITHDLALAAQRAEA

SEQ ID NO: 1530256 - protein, 22 aa, Mycobacterium tuberculosis
TDELIDRCWAPKVHGAWNIHRA

SEQ ID NO: 1530257 - protein, 26 aa, Mycobacterium tuberculosis
TDELKLYDTPAMPPPIFVAASGPQSA

SEQ ID NO: 1530258 - protein, 23 aa, Mycobacterium tuberculosis
TDGDGRWDVRLTDTDGDGTADGA

SEQ ID NO: 1530259 - protein, 20 aa, Mycobacterium tuberculosis
TDGEGWLTELSTRDLREVFA

SEQ ID NO: 1530260 - protein, 22 aa, Mycobacterium tuberculosis
TDGEGWLTELSTRDLREVFALS

SEQ ID NO: 1530261 - protein, 18 aa, Mycobacterium tuberculosis
TDGFLRGHGGDGGNAVGL

SEQ ID NO: 1530262 - protein, 23 aa, Mycobacterium tuberculosis
TDGRNILPPNKFPYIPPGADPDP

SEQ ID NO: 1530263 - protein, 30 aa, Mycobacterium tuberculosis
TDHIVDYYNFFLSGGFLAPPGRAPVLVYGP

SEQ ID NO: 1530264 - protein, 17 aa, Mycobacterium tuberculosis
TDHPDLFWALRGGGGGN

SEQ ID NO: 1530265 - protein, 23 aa, Mycobacterium tuberculosis
TDHPVHRYFLAAKQTEFALGRRH

SEQ ID NO: 1530266 - protein, 23 aa, Mycobacterium tuberculosis
TDKRASGVIPRYGVRLTVMSRPP

SEQ ID NO: 1530267 - protein, 17 aa, Mycobacterium tuberculosis
TDLALVTDGLRAEREQG

SEQ ID NO: 1530268 - protein, 22 aa, Mycobacterium tuberculosis
TDLDSVLKRFGPLTPPRAVAII

SEQ ID NO: 1530269 - protein, 26 aa, Mycobacterium tuberculosis
TDLLYKLLRSEWLEPRWMVGIDPESD

SEQ ID NO: 1530270 - protein, 17 aa, Mycobacterium tuberculosis
TDLMRELGADPLPFLRR

SEQ ID NO: 1530271 - protein, 19 aa, Mycobacterium tuberculosis
TDLTFRLLRESFADAVSWV

SEQ ID NO: 1530272 - protein, 17 aa, Mycobacterium tuberculosis
TDNCDYLMFTGSSATGS

SEQ ID NO: 1530273 - protein, 27 aa, Mycobacterium tuberculosis
TDPGEQLYTLDYYLKLAEQIVDAGAHV

SEQ ID NO: 1530274 - protein, 17 aa, Mycobacterium tuberculosis
TDPIDVLRFPRSRPLVC

SEQ ID NO: 1530275 - protein, 23 aa, Mycobacterium tuberculosis
TDPKRKVRFLPYGIAVSVLDDPV

SEQ ID NO: 1530276 - protein, 20 aa, Mycobacterium tuberculosis
TDPTLAVDWPLVDGAAPSLS

SEQ ID NO: 1530277 - protein, 22 aa, Mycobacterium tuberculosis
TDPTLAVDWPLVNGAAPSLSDR

SEQ ID NO: 1530278 - protein, 25 aa, Mycobacterium tuberculosis
TDQSSAILRRRPARPSSRAVLPSAT

SEQ ID NO: 1530279 - protein, 20 aa, Mycobacterium tuberculosis
TDRDDPFWDRLRFPAALDRV

SEQ ID NO: 1530280 - protein, 21 aa, Mycobacterium tuberculosis
TDRDDPFWDRLRFPAALDRVQ

SEQ ID NO: 1530281 - protein, 25 aa, Mycobacterium tuberculosis
TDRMAKMLRLAVDEVFQMQSEARAE

SEQ ID NO: 1530282 - protein, 27 aa, Mycobacterium tuberculosis
TDRRGKYLWLTLNTAGVHRPTDTALVV

SEQ ID NO: 1530283 - protein, 19 aa, Mycobacterium tuberculosis
TDRVFAIVIQDFQDPYTLN

SEQ ID NO: 1530284 - protein, 45 aa, Mycobacterium tuberculosis
TDSPGAEASWVVGITWWSAVVGGFQMSFVIAVPETIAAAATDLAD

SEQ ID NO: 1530285 - protein, 24 aa, Mycobacterium tuberculosis
TDTGSFRWASVRGYRLAARLVEIG

SEQ ID NO: 1530286 - protein, 25 aa, Mycobacterium tuberculosis
TDVSGFFNTPTGPLAVDVSGFFNTA

SEQ ID NO: 1530287 - protein, 28 aa, Mycobacterium tuberculosis
TDVSLLPTLQSFLPPPFDAIPNPIEDLD

SEQ ID NO: 1530288 - protein, 25 aa, Mycobacterium tuberculosis
TDVTPKLFLPTLSGLTQGPGFPNLS

SEQ ID NO: 1530289 - protein, 18 aa, Mycobacterium tuberculosis
TDWPRYGGYALAGVSSFG

SEQ ID NO: 1530290 - protein, 18 aa, Mycobacterium tuberculosis
TDWTATSAEFRKLLADWK

SEQ ID NO: 1530291 - protein, 19 aa, Mycobacterium tuberculosis
TDYVPFTDWVDGRVLLDGR

SEQ ID NO: 1530292 - protein, 19 aa, Mycobacterium tuberculosis
TEAEVVAHLLELVTRRSEA

SEQ ID NO: 1530293 - protein, 37 aa, Mycobacterium tuberculosis
TEAMLHSDYPLQALLYVVVLHRFLRWRQRDYAPARHL

SEQ ID NO: 1530294 - protein, 23 aa, Mycobacterium tuberculosis
TEEVKLLKPLPPLLAGAAGPVRR

SEQ ID NO: 1530295 - protein, 26 aa, Mycobacterium tuberculosis
TEFEAGLRFHPCPRARAGGTTPFFKQ

SEQ ID NO: 1530296 - protein, 18 aa, Mycobacterium tuberculosis
TEFEFATHPFGPVAVAGF

SEQ ID NO: 1530297 - protein, 27 aa, Mycobacterium tuberculosis
TEGRTALRFLPMEELIAAFLPVLFAGM

SEQ ID NO: 1530298 - protein, 33 aa, Mycobacterium tuberculosis
TEGRTALRLLPMEELIAAFLPVLFPGMEIVEHH

SEQ ID NO: 1530299 - protein, 21 aa, Mycobacterium tuberculosis
TEGTVIRWLKKIGDSVQVDEP

SEQ ID NO: 1530300 - protein, 22 aa, Mycobacterium tuberculosis
TEGTVIRWLKKIGDSVQVDEPL

SEQ ID NO: 1530301 - protein, 23 aa, Mycobacterium tuberculosis
TEKFLKDLLAAFADAPVVIGPTA

SEQ ID NO: 1530302 - protein, 20 aa, Mycobacterium tuberculosis
TEKMYANILLRRVPRMLKQQ

SEQ ID NO: 1530303 - protein, 18 aa, Mycobacterium tuberculosis
TELAMYSVMWSEHWSYKS

SEQ ID NO: 1530304 - protein, 25 aa, Mycobacterium tuberculosis
TELAQQILLPRLPPKGLSQEELRAL

SEQ ID NO: 1530305 - protein, 28 aa, Mycobacterium tuberculosis
TELEFIVFDQPYRQAWASGYRGLTPASD

SEQ ID NO: 1530306 - protein, 17 aa, Mycobacterium tuberculosis
TELRRQLKPLGRQAEAA

SEQ ID NO: 1530307 - protein, 26 aa, Mycobacterium tuberculosis
TEPERGWFCAMSRAPKIYRPASVRRI

SEQ ID NO: 1530308 - protein, 23 aa, Mycobacterium tuberculosis
TEPRKIFDLLEHAPVDIAVLTDA

SEQ ID NO: 1530309 - protein, 21 aa, Mycobacterium tuberculosis
TEQILFRRLAPFVGGFDLAAV

SEQ ID NO: 1530310 - protein, 37 aa, Mycobacterium tuberculosis
TERDRTLFRRDQIGIVFQFFNLIPTLTVLKNITLPQE

SEQ ID NO: 1530311 - protein, 23 aa, Mycobacterium tuberculosis
TERQSHYLHVRPADQFDAMIHID

SEQ ID NO: 1530312 - protein, 17 aa, Mycobacterium tuberculosis
TESLLIERIEAEYARYF

SEQ ID NO: 1530313 - protein, 22 aa, Mycobacterium tuberculosis
TESVPLTFPSLVKSGSRTPGLA

SEQ ID NO: 1530314 - protein, 23 aa, Mycobacterium tuberculosis
TETLVSFCTLLSRCPLPAPKSCP

SEQ ID NO: 1530315 - protein, 22 aa, Mycobacterium tuberculosis
TETPRGWRMRCARKCRQTQNPE

SEQ ID NO: 1530316 - protein, 24 aa, Mycobacterium tuberculosis
TETTFSVGLANLGFWNLGSANIGN

SEQ ID NO: 1530317 - protein, 18 aa, Mycobacterium tuberculosis
TETVTWWQVHRRAMIVAE

SEQ ID NO: 1530318 - protein, 19 aa, Mycobacterium tuberculosis
TEVSITRRMFRDGASEYEI

SEQ ID NO: 1530319 - protein, 20 aa, Mycobacterium tuberculosis
TEVSITRRMFRDGASEYEIN

SEQ ID NO: 1530320 - protein, 21 aa, Mycobacterium tuberculosis
TEWPLPLLDLARIASDRGDAE

SEQ ID NO: 1530321 - protein, 18 aa, Mycobacterium tuberculosis
TFAKPYAEWRGMFAGNGM

SEQ ID NO: 1530322 - protein, 18 aa, Mycobacterium tuberculosis
TFCPVGPWIVTDLAPFDP

SEQ ID NO: 1530323 - protein, 19 aa, Mycobacterium tuberculosis
TFCPVGPWIVTDLAPFDPA

SEQ ID NO: 1530324 - protein, 20 aa, Mycobacterium tuberculosis
TFCPVGPWIVTDLAPFDPAD

SEQ ID NO: 1530325 - protein, 17 aa, Mycobacterium tuberculosis
TFDLARNPNPHLGFGGG

SEQ ID NO: 1530326 - protein, 17 aa, Mycobacterium tuberculosis
TFDRFVGLLTEREFIDG

SEQ ID NO: 1530327 - protein, 36 aa, Mycobacterium tuberculosis
TFDRMAAKLAGFGYVVLLPDVYYREGDWAPFDMKTA

SEQ ID NO: 1530328 - protein, 17 aa, Mycobacterium tuberculosis
TFFMLVIKVAEYFCGGL

SEQ ID NO: 1530329 - protein, 18 aa, Mycobacterium tuberculosis
TFGGWLLADLVTVDGSVV

SEQ ID NO: 1530330 - protein, 20 aa, Mycobacterium tuberculosis
TFHDRFVQTLSAAASSYVAA

SEQ ID NO: 1530331 - protein, 28 aa, Mycobacterium tuberculosis
TFHGLLLLRHVADLVMTGWPVLMALSNK

SEQ ID NO: 1530332 - protein, 25 aa, Mycobacterium tuberculosis
TFPANSLLNLDVFVGTPGATIPAIT

SEQ ID NO: 1530333 - protein, 17 aa, Mycobacterium tuberculosis
TFRDPKELRFFTRTDSG

SEQ ID NO: 1530334 - protein, 36 aa, Mycobacterium tuberculosis
TFSNTNPHRQCILIFLTLYPPPHYYEKISFCEICYS

SEQ ID NO: 1530335 - protein, 21 aa, Mycobacterium tuberculosis
TFTLALPALIEAYHDDERPEQ

SEQ ID NO: 1530336 - protein, 23 aa, Mycobacterium tuberculosis
TFVGAICRWQAANPAGLIDITRF

SEQ ID NO: 1530337 - protein, 17 aa, Mycobacterium tuberculosis
TGAAVALMVLRAAVAAL

SEQ ID NO: 1530338 - protein, 17 aa, Mycobacterium tuberculosis
TGAEPIAAAPAAAVSLR

SEQ ID NO: 1530339 - protein, 17 aa, Mycobacterium tuberculosis
TGAFIGGNFSNGAFWQS

SEQ ID NO: 1530340 - protein, 32 aa, Mycobacterium tuberculosis
TGAFWHIDYMFMPEPFAFSMVLPLAVPGHDRG

SEQ ID NO: 1530341 - protein, 22 aa, Mycobacterium tuberculosis
TGALAAQLYGIGGDGGPGGQGG

SEQ ID NO: 1530342 - protein, 24 aa, Mycobacterium tuberculosis
TGAPQFEIVDPRPLTLLPEPNPGD

SEQ ID NO: 1530343 - protein, 24 aa, Mycobacterium tuberculosis
TGAPQFEIVDPRPLTLLPEQTPAT

SEQ ID NO: 1530344 - protein, 17 aa, Mycobacterium tuberculosis
TGAPRALVVVPTRELCL

SEQ ID NO: 1530345 - protein, 30 aa, Mycobacterium tuberculosis
TGARHLRPASRRKIAQFRAELGDFASARRS

SEQ ID NO: 1530346 - protein, 24 aa, Mycobacterium tuberculosis
TGASPRFLLDFSRRFPDAAVVRLE

SEQ ID NO: 1530347 - protein, 19 aa, Mycobacterium tuberculosis
TGCDSWYLNKDGIPEVWPF

SEQ ID NO: 1530348 - protein, 18 aa, Mycobacterium tuberculosis
TGCWRSPINPTWCSRQPV

SEQ ID NO: 1530349 - protein, 26 aa, Mycobacterium tuberculosis
TGDDGGAGGWLFGNGGNGGAGAAGTN

SEQ ID NO: 1530350 - protein, 21 aa, Mycobacterium tuberculosis
TGDFNAGVRNTGWSNSGLTNT

SEQ ID NO: 1530351 - protein, 25 aa, Mycobacterium tuberculosis
TGDFNAGVRNTGWSNSGLTNTGAFN

SEQ ID NO: 1530352 - protein, 18 aa, Mycobacterium tuberculosis
TGDLVLRHRSMAIVTQIV

SEQ ID NO: 1530353 - protein, 20 aa, Mycobacterium tuberculosis
TGDSFFHLAPLGQSGALAGL

SEQ ID NO: 1530354 - protein, 21 aa, Mycobacterium tuberculosis
TGDYLAELTMLILGRDRMKNP

SEQ ID NO: 1530355 - protein, 26 aa, Mycobacterium tuberculosis
TGDYQGLLDFSFPVGPLIPQTHLVHL

SEQ ID NO: 1530356 - protein, 26 aa, Mycobacterium tuberculosis
TGEGPVRRRRTWTSKGHFPMGDGLLG

SEQ ID NO: 1530357 - protein, 20 aa, Mycobacterium tuberculosis
TGEPAGPPFAAGPADTLDSV

SEQ ID NO: 1530358 - protein, 26 aa, Mycobacterium tuberculosis
TGFGNGGAINLGFGNSGQLNAGSFNA

SEQ ID NO: 1530359 - protein, 28 aa, Mycobacterium tuberculosis
TGFLGRYLVLELLRRLDVDGRLICLVRA

SEQ ID NO: 1530360 - protein, 17 aa, Mycobacterium tuberculosis
TGFTGGLNWYRNFDRNW

SEQ ID NO: 1530361 - protein, 27 aa, Mycobacterium tuberculosis
TGGAGGRGGLLIGDGGAAARAGVGGPV

SEQ ID NO: 1530362 - protein, 27 aa, Mycobacterium tuberculosis
TGGAGGRGGLLIGDGGAGGAGGVGGTG

SEQ ID NO: 1530363 - protein, 23 aa, Mycobacterium tuberculosis
TGGAGQITGLRSGFGGAGGAGGA

SEQ ID NO: 1530364 - protein, 17 aa, Mycobacterium tuberculosis
TGGAHRIELAKAGKLTS

SEQ ID NO: 1530365 - protein, 18 aa, Mycobacterium tuberculosis
TGGAYFFRQLTHDGLTEA

SEQ ID NO: 1530366 - protein, 19 aa, Mycobacterium tuberculosis
TGGFAQRLPRWLRRHGNTG

SEQ ID NO: 1530367 - protein, 33 aa, Mycobacterium tuberculosis
TGGKAGTELGCRRAWTAPTASPPTAVTGGNGGN

SEQ ID NO: 1530368 - protein, 22 aa, Mycobacterium tuberculosis
TGGLLLRWVCAACVPTGLPAMP

SEQ ID NO: 1530369 - protein, 20 aa, Mycobacterium tuberculosis
TGGPPLPGQAGMGAAGGAGG

SEQ ID NO: 1530370 - protein, 21 aa, Mycobacterium tuberculosis
TGGPPLPGQAGMGAAGGAGGL

SEQ ID NO: 1530371 - protein, 19 aa, Mycobacterium tuberculosis
TGGQLWGSGGAGGEGGAAL

SEQ ID NO: 1530372 - protein, 31 aa, Mycobacterium tuberculosis
TGGSDSLPPLRYWVLPGKRPTRAPARGWTRW

SEQ ID NO: 1530373 - protein, 23 aa, Mycobacterium tuberculosis
TGGTAGLLYGVGGAGGGGGAGGD

SEQ ID NO: 1530374 - protein, 25 aa, Mycobacterium tuberculosis
TGGTGGYIESLDGKGQAGNGGNGGN

SEQ ID NO: 1530375 - protein, 21 aa, Mycobacterium tuberculosis
TGGTLFGQPGQPGPPGQPGPA

SEQ ID NO: 1530376 - protein, 18 aa, Mycobacterium tuberculosis
TGGVLDVVVGVALTVGGC

SEQ ID NO: 1530377 - protein, 23 aa, Mycobacterium tuberculosis
TGGVLKPILWCPGKATAVQRFAA

SEQ ID NO: 1530378 - protein, 18 aa, Mycobacterium tuberculosis
TGGWLMGNGGMGGAGVVG

SEQ ID NO: 1530379 - protein, 19 aa, Mycobacterium tuberculosis
TGHKWFTSAPMCDIFLVLA

SEQ ID NO: 1530380 - protein, 17 aa, Mycobacterium tuberculosis
TGHPWWTLSQLSDESAI

SEQ ID NO: 1530381 - protein, 24 aa, Mycobacterium tuberculosis
TGHYLGCVHLQRLLRDPPAELVGG

SEQ ID NO: 1530382 - protein, 28 aa, Mycobacterium tuberculosis
TGIIGWPALVMLFAGPRVGEPGKPVRLP

SEQ ID NO: 1530383 - protein, 18 aa, Mycobacterium tuberculosis
TGIPLPPPSMLTPPIRCR

SEQ ID NO: 1530384 - protein, 23 aa, Mycobacterium tuberculosis
TGKFEWLDNDVVQWVPDRFWPAH

SEQ ID NO: 1530385 - protein, 17 aa, Mycobacterium tuberculosis
TGKFVLGGPMGDAGLTG

SEQ ID NO: 1530386 - protein, 29 aa, Mycobacterium tuberculosis
TGLFSGFMSGFGNTGFLQSGFGNLEANPD

SEQ ID NO: 1530387 - protein, 30 aa, Mycobacterium tuberculosis
TGLFSGFMSGFGNTGFLQSGFGNLEANPDN

SEQ ID NO: 1530388 - protein, 22 aa, Mycobacterium tuberculosis
TGLGNIGSWNLGGGNVGLLNLG

SEQ ID NO: 1530389 - protein, 18 aa, Mycobacterium tuberculosis
TGLIYRALGFPTRMFTVL

SEQ ID NO: 1530390 - protein, 23 aa, Mycobacterium tuberculosis
TGLKNFWNCTMPKMVDITVSLAG

SEQ ID NO: 1530391 - protein, 17 aa, Mycobacterium tuberculosis
TGLLAAGADEVSAAIAS

SEQ ID NO: 1530392 - protein, 22 aa, Mycobacterium tuberculosis
TGLLDERALFLGQWGLRGQRGG

SEQ ID NO: 1530393 - protein, 19 aa, Mycobacterium tuberculosis
TGLQVPRPLGGRRRPVRQV

SEQ ID NO: 1530394 - protein, 26 aa, Mycobacterium tuberculosis
TGLTLPPTLIFDYPTAAELAETPRHP

SEQ ID NO: 1530395 - protein, 25 aa, Mycobacterium tuberculosis
TGLTLSPTLIFDYPTPATLAEHLDS

SEQ ID NO: 1530396 - protein, 22 aa, Mycobacterium tuberculosis
TGLVMDSQFLTQNFGPVIGTGT

SEQ ID NO: 1530397 - protein, 18 aa, Mycobacterium tuberculosis
TGLVVVPVMFDRIMDLPA

SEQ ID NO: 1530398 - protein, 24 aa, Mycobacterium tuberculosis
TGMRLHHFGAFYKRSWRANDWMWG

SEQ ID NO: 1530399 - protein, 34 aa, Mycobacterium tuberculosis
TGNFNNGFLWRGDHQGLIFGSPGFFNSTSAPSSG

SEQ ID NO: 1530400 - protein, 22 aa, Mycobacterium tuberculosis
TGPALPTVWPGNAYPLGATYDG

SEQ ID NO: 1530401 - protein, 20 aa, Mycobacterium tuberculosis
TGPLAVDVSGFFNTASGGTV

SEQ ID NO: 1530402 - protein, 19 aa, Mycobacterium tuberculosis
TGPTAPRASTVPPAAKATT

SEQ ID NO: 1530403 - protein, 27 aa, Mycobacterium tuberculosis
TGPTQHRLHLFGAPWPDDCQRFAGRRV

SEQ ID NO: 1530404 - protein, 24 aa, Mycobacterium tuberculosis
TGPYTFPGVLPPSGVPYLLGIQSV

SEQ ID NO: 1530405 - protein, 25 aa, Mycobacterium tuberculosis
TGPYTFPGVLPPSGVPYLLGIQSVL

SEQ ID NO: 1530406 - protein, 25 aa, Mycobacterium tuberculosis
TGQNGGAGGILWGNGGNGGSGAPGQ

SEQ ID NO: 1530407 - protein, 24 aa, Mycobacterium tuberculosis
TGRCPAPPPTWPPPVFACCMPMDP

SEQ ID NO: 1530408 - protein, 22 aa, Mycobacterium tuberculosis
TGRFALYPYIREYVYDLTGRLA

SEQ ID NO: 1530409 - protein, 32 aa, Mycobacterium tuberculosis
TGRFDDEQLFYLRSRGIPEAQARRLVVRGFFG

SEQ ID NO: 1530410 - protein, 20 aa, Mycobacterium tuberculosis
TGRRPFWTYAHVPSGSTLDA

SEQ ID NO: 1530411 - protein, 26 aa, Mycobacterium tuberculosis
TGRRRRCGWFDAVIARYAARVNGITD

SEQ ID NO: 1530412 - protein, 31 aa, Mycobacterium tuberculosis
TGRVGGPVGGHGLLGLGGSHGAGGAGGSGGD

SEQ ID NO: 1530413 - protein, 18 aa, Mycobacterium tuberculosis
TGSAIAQHWMYEGKHVLI

SEQ ID NO: 1530414 - protein, 17 aa, Mycobacterium tuberculosis
TGSGFPFRRVLHHHRWP

SEQ ID NO: 1530415 - protein, 25 aa, Mycobacterium tuberculosis
TGSGKTLAAFLWALDSLAGSEPMSE

SEQ ID NO: 1530416 - protein, 18 aa, Mycobacterium tuberculosis
TGSLLIGGAGRVVEPLRA

SEQ ID NO: 1530417 - protein, 33 aa, Mycobacterium tuberculosis
TGSNMSGFFGGPPVFNLGLANRGVVNILGNANI

SEQ ID NO: 1530418 - protein, 21 aa, Mycobacterium tuberculosis
TGSPLLPRLPALPATPRMPER

SEQ ID NO: 1530419 - protein, 24 aa, Mycobacterium tuberculosis
TGSTGTTVLPFNGLYQPQGLAVDG

SEQ ID NO: 1530420 - protein, 19 aa, Mycobacterium tuberculosis
TGSWRLHVATAARDVDWWL

SEQ ID NO: 1530421 - protein, 21 aa, Mycobacterium tuberculosis
TGSWRLHVATPARDVDWWLTF

SEQ ID NO: 1530422 - protein, 17 aa, Mycobacterium tuberculosis
TGTAKFAYSWAVGPAVG

SEQ ID NO: 1530423 - protein, 26 aa, Mycobacterium tuberculosis
TGTASSPFGIAIAIGGAGAQGGAGTS

SEQ ID NO: 1530424 - protein, 22 aa, Mycobacterium tuberculosis
TGTPLHLLYHVSHHLANIETHP

SEQ ID NO: 1530425 - protein, 34 aa, Mycobacterium tuberculosis
TGTRIFTKSPLFVAPFSYSLFYEYRDVHRCLSHW

SEQ ID NO: 1530426 - protein, 23 aa, Mycobacterium tuberculosis
TGTWGHNLVPAGPVAMAATRAPV

SEQ ID NO: 1530427 - protein, 28 aa, Mycobacterium tuberculosis
TGVARLATRRAAMCPLALRARPSNDRLT

SEQ ID NO: 1530428 - protein, 18 aa, Mycobacterium tuberculosis
TGVFWIQDRLTIGQLREI

SEQ ID NO: 1530429 - protein, 18 aa, Mycobacterium tuberculosis
TGVMTFGLPLAMTLNAVG

SEQ ID NO: 1530430 - protein, 20 aa, Mycobacterium tuberculosis
TGWAAAGAIWALRGAGHPVP

SEQ ID NO: 1530431 - protein, 17 aa, Mycobacterium tuberculosis
TGWLRTRRSTLGHRNPA

SEQ ID NO: 1530432 - protein, 19 aa, Mycobacterium tuberculosis
TGWRLHGRTARWIEIAAEW

SEQ ID NO: 1530433 - protein, 20 aa, Mycobacterium tuberculosis
TGWRLHGRTARWIEIAAEWG

SEQ ID NO: 1530434 - protein, 23 aa, Mycobacterium tuberculosis
TGYAHGELADRVNLAITALRDEV

SEQ ID NO: 1530435 - protein, 21 aa, Mycobacterium tuberculosis
TGYLGPPPVPTSSPPTTPAGA

SEQ ID NO: 1530436 - protein, 25 aa, Mycobacterium tuberculosis
TGYLVLDQPWPSMLRGIWGDPARYW

SEQ ID NO: 1530437 - protein, 24 aa, Mycobacterium tuberculosis
TGYSWGPLSLMLLATAIAQQGHIA

SEQ ID NO: 1530438 - protein, 30 aa, Mycobacterium tuberculosis
THARVGLLPTWGLSVRLPQKVGIGLARRMS

SEQ ID NO: 1530439 - protein, 23 aa, Mycobacterium tuberculosis
THDRVLVIPAPGQPARLPFWRGD

SEQ ID NO: 1530440 - protein, 31 aa, Mycobacterium tuberculosis
THFAGVLTVVLKLLQIVRPDRVFFGERTTSS

SEQ ID NO: 1530441 - protein, 27 aa, Mycobacterium tuberculosis
THGALRSAWIGCWVPSAATGGGVATGA

SEQ ID NO: 1530442 - protein, 27 aa, Mycobacterium tuberculosis
THGFVCAIRAWAYQIADLAGDYRVIAF

SEQ ID NO: 1530443 - protein, 26 aa, Mycobacterium tuberculosis
THGHTEWLPPPHLDHGQPRTNTFHHH

SEQ ID NO: 1530444 - protein, 26 aa, Mycobacterium tuberculosis
THGHTEWLPPPHLDHGQPRTNTFHHP

SEQ ID NO: 1530445 - protein, 29 aa, Mycobacterium tuberculosis
THINTYSMDLFLRIAPELYLKRLCVGGVE

SEQ ID NO: 1530446 - protein, 32 aa, Mycobacterium tuberculosis
THLSRLVPQHLMRRLFFTGGHRGRGHLAALRL

SEQ ID NO: 1530447 - protein, 21 aa, Mycobacterium tuberculosis
THLTHVYAKLGLASRVQLVDE

SEQ ID NO: 1530448 - protein, 24 aa, Mycobacterium tuberculosis
THNATVGVILIRTSSPTSTQIAST

SEQ ID NO: 1530449 - protein, 20 aa, Mycobacterium tuberculosis
THRDLPEETLRWLYEMMVVT

SEQ ID NO: 1530450 - protein, 18 aa, Mycobacterium tuberculosis
THRKALAAFTKSGGRLVE

SEQ ID NO: 1530451 - protein, 19 aa, Mycobacterium tuberculosis
THRLAVLQCFDANLPAGTL

SEQ ID NO: 1530452 - protein, 21 aa, Mycobacterium tuberculosis
THTPPAPIELPSYGLFGLPGF

SEQ ID NO: 1530453 - protein, 24 aa, Mycobacterium tuberculosis
THVVVNRPAWFRCRTRCRPPSLPY

SEQ ID NO: 1530454 - protein, 29 aa, Mycobacterium tuberculosis
TIAEVVNGFGWRGPLGVTYPGVVTHGVVR

SEQ ID NO: 1530455 - protein, 21 aa, Mycobacterium tuberculosis
TIALGLLHRLTAMVAKVGVFR

SEQ ID NO: 1530456 - protein, 23 aa, Mycobacterium tuberculosis
TIASGPSLARWARANGWSAPPGA

SEQ ID NO: 1530457 - protein, 22 aa, Mycobacterium tuberculosis
TICRRAGLSVRYFYESFTDKDE

SEQ ID NO: 1530458 - protein, 21 aa, Mycobacterium tuberculosis
TIDWYRDNESWWRPLKDATEA

SEQ ID NO: 1530459 - protein, 19 aa, Mycobacterium tuberculosis
TIEVVTLQMVRSHNLPGLV

SEQ ID NO: 1530460 - protein, 18 aa, Mycobacterium tuberculosis
TIFGAPNRLPCPEDKALA

SEQ ID NO: 1530461 - protein, 18 aa, Mycobacterium tuberculosis
TIFPNGISIPNNPLALLA

SEQ ID NO: 1530462 - protein, 17 aa, Mycobacterium tuberculosis
TIGLAYASALIIADRHD

SEQ ID NO: 1530463 - protein, 24 aa, Mycobacterium tuberculosis
TIGPVSLPIFGFGGAPGFGNDTTA

SEQ ID NO: 1530464 - protein, 18 aa, Mycobacterium tuberculosis
TIGQLCDAAIRYSDGTAA

SEQ ID NO: 1530465 - protein, 23 aa, Mycobacterium tuberculosis
TIHKHKVNLLFFTGDAMARPLVD

SEQ ID NO: 1530466 - protein, 17 aa, Mycobacterium tuberculosis
TIKPLMTVGSYLSPLPL

SEQ ID NO: 1530467 - protein, 20 aa, Mycobacterium tuberculosis
TILPPLHLQITCDADYSFTV

SEQ ID NO: 1530468 - protein, 18 aa, Mycobacterium tuberculosis
TINYRFAPDRSVAAALQH

SEQ ID NO: 1530469 - protein, 23 aa, Mycobacterium tuberculosis
TIPEFPIHWTSTGGIGPIIIPDT

SEQ ID NO: 1530470 - protein, 24 aa, Mycobacterium tuberculosis
TIPGFAINPFGLDVPLSGGTSPVT

SEQ ID NO: 1530471 - protein, 22 aa, Mycobacterium tuberculosis
TIPGFAINRFGLNVPLSGGTSP

SEQ ID NO: 1530472 - protein, 19 aa, Mycobacterium tuberculosis
TIPGFTIPGGTLIPTLPLG

SEQ ID NO: 1530473 - protein, 20 aa, Mycobacterium tuberculosis
TIPRVRCCCCYLGSANRDDR

SEQ ID NO: 1530474 - protein, 23 aa, Mycobacterium tuberculosis
TIPTGPIHIGLPLSLTIPGFTIP

SEQ ID NO: 1530475 - protein, 21 aa, Mycobacterium tuberculosis
TITAFLANLPFSTPVVTIDEI

SEQ ID NO: 1530476 - protein, 31 aa, Mycobacterium tuberculosis; identical to SEQ ID NO: 207096

SEQ ID NO: 1530477 - protein, 27 aa, Mycobacterium tuberculosis
TIVDLAPATSSPARWCWKCWRDAAPDR

SEQ ID NO: 1530478 - protein, 19 aa, Mycobacterium tuberculosis
TIYNDLRVIDNIRYFAELC

SEQ ID NO: 1530479 - protein, 22 aa, Mycobacterium tuberculosis
TIYNDLRVIDNIRYFAELCGVD

SEQ ID NO: 1530480 - protein, 18 aa, Mycobacterium tuberculosis
TKASLATDSWLSAASFQE

SEQ ID NO: 1530481 - protein, 25 aa, Mycobacterium tuberculosis
TKIDPIPLNFDVLSSAGPINISIID

SEQ ID NO: 1530482 - protein, 22 aa, Mycobacterium tuberculosis
TKIQVHQIVISLPLRSKHVLNV

SEQ ID NO: 1530483 - protein, 23 aa, Mycobacterium tuberculosis
TKLARSPTVTALLQLAAYADALV

SEQ ID NO: 1530484 - protein, 22 aa, Mycobacterium tuberculosis
TKLLETYSVPPLLHNQALAISV

SEQ ID NO: 1530485 - protein, 17 aa, Mycobacterium tuberculosis
TKRRYLGKLSGPLLDRV

SEQ ID NO: 1530486 - protein, 23 aa, Mycobacterium tuberculosis
TKTAIPYRVPFPQSMPTQETAPT

SEQ ID NO: 1530487 - protein, 24 aa, Mycobacterium tuberculosis
TKTFLAQIAANYLLGLALAQARGT

SEQ ID NO: 1530488 - protein, 23 aa, Mycobacterium tuberculosis
TKVDADLDRLLATLAEEQATADR

SEQ ID NO: 1530489 - protein, 22 aa, Mycobacterium tuberculosis
TKVGLFPRPLPREAAITQVADW

SEQ ID NO: 1530490 - protein, 24 aa, Mycobacterium tuberculosis
TKYPDRLTVLHWLESLQGLPSASA

SEQ ID NO: 1530491 - protein, 23 aa, Mycobacterium tuberculosis
TLADLLDFFKDPVKGFFRALDYT

SEQ ID NO: 1530492 - protein, 18 aa, Mycobacterium tuberculosis
TLALIALSAKMRIDQIEE

SEQ ID NO: 1530493 - protein, 41 aa, Mycobacterium tuberculosis
TLASLKWVLANRAYTPWYLVRYWRLLRFKLANPHIITRGMV

SEQ ID NO: 1530494 - protein, 23 aa, Mycobacterium tuberculosis
TLATTRWLVAILENHQRPDGSVR

SEQ ID NO: 1530495 - protein, 19 aa, Mycobacterium tuberculosis
TLAWAFDLLLHHPDALRRV

SEQ ID NO: 1530496 - protein, 32 aa, Mycobacterium tuberculosis
TLCRTGPPQSTSWAQRWLAATGNRDYLGAFVK

SEQ ID NO: 1530497 - protein, 28 aa, Mycobacterium tuberculosis
TLDAIKAVSALDLGLPLAAGNVVSAEGT

SEQ ID NO: 1530498 - protein, 25 aa, Mycobacterium tuberculosis
TLDKSDVLAGLFAVWHSLDALLDGL

SEQ ID NO: 1530499 - protein, 17 aa, Mycobacterium tuberculosis
TLDPVYAAAFNTAADDA

SEQ ID NO: 1530500 - protein, 18 aa, Mycobacterium tuberculosis
TLDPVYAAAFNTAADDAA

SEQ ID NO: 1530501 - protein, 21 aa, Mycobacterium tuberculosis
TLEGRWWRRDIGGVMVRFVVC

SEQ ID NO: 1530502 - protein, 19 aa, Mycobacterium tuberculosis
TLEQGLLGAINAPAAALSG

SEQ ID NO: 1530503 - protein, 17 aa, Mycobacterium tuberculosis
TLFAMQVALAATMKSYG

SEQ ID NO: 1530504 - protein, 30 aa, Mycobacterium tuberculosis
TLFDRFGTELPPLEGIYLAAFAGRPALLSE

SEQ ID NO: 1530505 - protein, 20 aa, Mycobacterium tuberculosis
TLFGRWELCALMQTVAELAE

SEQ ID NO: 1530506 - protein, 20 aa, Mycobacterium tuberculosis
TLFIKPGWGFSFDYQPGQYI

SEQ ID NO: 1530507 - protein, 17 aa, Mycobacterium tuberculosis
TLFPGGLTFPATSLLNL

SEQ ID NO: 1530508 - protein, 20 aa, Mycobacterium tuberculosis
TLFRRLAVFVGCFFVDDAQA

SEQ ID NO: 1530509 - protein, 20 aa, Mycobacterium tuberculosis
TLGCMRGHWPTGPLIDAVAG

SEQ ID NO: 1530510 - protein, 31 aa, Mycobacterium tuberculosis
TLGGITPEQVLESPFLLLGTHEQMAEGSRRA

SEQ ID NO: 1530511 - protein, 23 aa, Mycobacterium tuberculosis
TLGHIEFPYVYLDATYLNVRNGT

SEQ ID NO: 1530512 - protein, 18 aa, Mycobacterium tuberculosis
TLGILEHFPMSDYAPSKV

SEQ ID NO: 1530513 - protein, 17 aa, Mycobacterium tuberculosis
TLGLNLFSRGVDPQIDF

SEQ ID NO: 1530514 - protein, 26 aa, Mycobacterium tuberculosis
TLGQPLDWFCLFSSGAALLGSPGQGA

SEQ ID NO: 1530515 - protein, 27 aa, Mycobacterium tuberculosis
TLGTALARLGMFAPALSYLEEPDGPVA

SEQ ID NO: 1530516 - protein, 21 aa, Mycobacterium tuberculosis
TLGVITALDLRLHPTPSHRVT

SEQ ID NO: 1530517 - protein, 19 aa, Mycobacterium tuberculosis
TLGVPLFQEQLMQLAVDCA

SEQ ID NO: 1530518 - protein, 20 aa, Mycobacterium tuberculosis
TLHFPGFTIPTGPIHIGLPL

SEQ ID NO: 1530519 - protein, 19 aa, Mycobacterium tuberculosis
TLIAMPAMVPPYANARDDY

SEQ ID NO: 1530520 - protein, 17 aa, Mycobacterium tuberculosis
TLIARDLDAAYRSVDVL

SEQ ID NO: 1530521 - protein, 18 aa, Mycobacterium tuberculosis
TLLAIVQKLPTSMVVSRA

SEQ ID NO: 1530522 - protein, 18 aa, Mycobacterium tuberculosis
TLLGLLSEIPRCPPEGPS

SEQ ID NO: 1530523 - protein, 22 aa, Mycobacterium tuberculosis
TLLGRLLVYDALEMSYRTITIR

SEQ ID NO: 1530524 - protein, 30 aa, Mycobacterium tuberculosis
TLLNAINAPTQTLLGRPLIGNGADGGPGQN

SEQ ID NO: 1530525 - protein, 18 aa, Mycobacterium tuberculosis
TLLSILRDDLNIDLTRVT

SEQ ID NO: 1530526 - protein, 20 aa, Mycobacterium tuberculosis
TLNFGFGNTGSGNFGFGNTG

SEQ ID NO: 1530527 - protein, 29 aa, Mycobacterium tuberculosis
TLNLDTTPWTLFPNGFTIPAQTPVTVGME

SEQ ID NO: 1530528 - protein, 19 aa, Mycobacterium tuberculosis
TLNWGSGNIGSYNLGGGNL

SEQ ID NO: 1530529 - protein, 17 aa, Mycobacterium tuberculosis
TLPARTPAYRVPLPELP

SEQ ID NO: 1530530 - protein, 18 aa, Mycobacterium tuberculosis
TLPTPAQLALRRSVIRRA

SEQ ID NO: 1530531 - protein, 17 aa, Mycobacterium tuberculosis
TLPVIDINIGDPGGSSS

SEQ ID NO: 1530532 - protein, 21 aa, Mycobacterium tuberculosis
TLQAFLHWAIIDGNKASFLDQ

SEQ ID NO: 1530533 - protein, 17 aa, Mycobacterium tuberculosis
TLQLDVALLFGNDPYVY

SEQ ID NO: 1530534 - protein, 22 aa, Mycobacterium tuberculosis
TLQSHRAWLFADAARHEMRDRW

SEQ ID NO: 1530535 - protein, 20 aa, Mycobacterium tuberculosis
TLQTVPLFTLHRHDQRRSLA

SEQ ID NO: 1530536 - protein, 24 aa, Mycobacterium tuberculosis
TLRAHACCWLGRRGRPGIAWPVAE

SEQ ID NO: 1530537 - protein, 17 aa, Mycobacterium tuberculosis
TLRKDFTPSELLAAGRR

SEQ ID NO: 1530538 - protein, 18 aa, Mycobacterium tuberculosis
TLRKDFTPSELLAAGRRI

SEQ ID NO: 1530539 - protein, 21 aa, Mycobacterium tuberculosis
TLRSYLLSQRLDVDQLQMVTM

SEQ ID NO: 1530540 - protein, 25 aa, Mycobacterium tuberculosis
TLSALAARFYGDASLYPLIAAVNGI

SEQ ID NO: 1530541 - protein, 23 aa, Mycobacterium tuberculosis
TLSGFGIHPLVLDAALHAMGVVG

SEQ ID NO: 1530542 - protein, 23 aa, Mycobacterium tuberculosis
TLSRTHPNLVRKLFSLEVPEIAD

SEQ ID NO: 1530543 - protein, 25 aa, Mycobacterium tuberculosis
TLTCQYHLWRYGLDGRLRGARHMAA

SEQ ID NO: 1530544 - protein, 27 aa, Mycobacterium tuberculosis
TLTDERGRRFLIHTARIAYVEIDRVAD

SEQ ID NO: 1530545 - protein, 19 aa, Mycobacterium tuberculosis
TLTERRLEFTRSLRRVFHD

SEQ ID NO: 1530546 - protein, 24 aa, Mycobacterium tuberculosis
TLTGPIVIGSFFLPAFNIPGIDVP

SEQ ID NO: 1530547 - protein, 24 aa, Mycobacterium tuberculosis
TLTLTLPRPTVVTGLRLAASRSML

SEQ ID NO: 1530548 - protein, 18 aa, Mycobacterium tuberculosis
TLTQQRLHLVLTGSHRHH

SEQ ID NO: 1530549 - protein, 19 aa, Mycobacterium tuberculosis
TLVEHLRPPESFPGWLHDG

SEQ ID NO: 1530550 - protein, 19 aa, Mycobacterium tuberculosis
TLVFYIWGDNGASMEGTNT

SEQ ID NO: 1530551 - protein, 20 aa, Mycobacterium tuberculosis
TLVRAVCDGRRLVTLDGPEI

SEQ ID NO: 1530552 - protein, 17 aa, Mycobacterium tuberculosis
TLVYMAFYERCGAVFCR

SEQ ID NO: 1530553 - protein, 25 aa, Mycobacterium tuberculosis
TLWGRNIGQFQLIQLKLAKMEVARI

SEQ ID NO: 1530554 - protein, 29 aa, Mycobacterium tuberculosis
TLYGPDGLALPMRLALPGSVNRGNAAQAV

SEQ ID NO: 1530555 - protein, 18 aa, Mycobacterium tuberculosis
TLYQHFPSKSALVEEYLR

SEQ ID NO: 1530556 - protein, 25 aa, Mycobacterium tuberculosis
TMAAAAAPYVAWMSATAALAREAAA

SEQ ID NO: 1530557 - protein, 17 aa, Mycobacterium tuberculosis
TMAALPPPPPQPGIDCR

SEQ ID NO: 1530558 - protein, 20 aa, Mycobacterium tuberculosis
TMDQLFRTVAGLGSKSDSAG

SEQ ID NO: 1530559 - protein, 17 aa, Mycobacterium tuberculosis
TMGQVAEPYLPLRAVRH

SEQ ID NO: 1530560 - protein, 18 aa, Mycobacterium tuberculosis
TMGQVAEPYLPLRAVRHL

SEQ ID NO: 1530561 - protein, 19 aa, Mycobacterium tuberculosis
TMLALPPLPPAPGIPPRTP

SEQ ID NO: 1530562 - protein, 19 aa, Mycobacterium tuberculosis
TMLAQRLPGLLPSLSGSES

SEQ ID NO: 1530563 - protein, 18 aa, Mycobacterium tuberculosis
TMNAFGIALLCHVLLVET

SEQ ID NO: 1530564 - protein, 18 aa, Mycobacterium tuberculosis
TMNGAVLPILALYVVAAE

SEQ ID NO: 1530565 - protein, 20 aa, Mycobacterium tuberculosis
TMRANLERWAPLLPEGATLV

SEQ ID NO: 1530566 - protein, 26 aa, Mycobacterium tuberculosis
TMRRAWTMLALPWPALQRRRTCPLTR

SEQ ID NO: 1530567 - protein, 28 aa, Mycobacterium tuberculosis
TMTSVVINPFFDWAYDRSPRTPYHETVI

SEQ ID NO: 1530568 - protein, 25 aa, Mycobacterium tuberculosis
TMVCGYSRWASALLIPTRTAEDLYA

SEQ ID NO: 1530569 - protein, 17 aa, Mycobacterium tuberculosis
TMVLTAQGPVLRVREDH

SEQ ID NO: 1530570 - protein, 24 aa, Mycobacterium tuberculosis
TMYVNQPWTIRQYAGFSTAADSNA

SEQ ID NO: 1530571 - protein, 28 aa, Mycobacterium tuberculosis
TNARMLIQFGFIERLAVAGDWRTYFRLR

SEQ ID NO: 1530572 - protein, 24 aa, Mycobacterium tuberculosis
TNATFLRDALHKAGIEAQFVARGE

SEQ ID NO: 1530573 - protein, 26 aa, Mycobacterium tuberculosis
TNCPDILDVPLMAEVLRGLGATVELD

SEQ ID NO: 1530574 - protein, 24 aa, Mycobacterium tuberculosis
TNETSIIIGKARNVGWRVAGEPGK

SEQ ID NO: 1530575 - protein, 22 aa, Mycobacterium tuberculosis
TNGSFPDFPLPLGDPSKPSDAD

SEQ ID NO: 1530576 - protein, 24 aa, Mycobacterium tuberculosis
TNIHMPLVATPMIVPSRGSTRCAR

SEQ ID NO: 1530577 - protein, 19 aa, Mycobacterium tuberculosis
TNIHMPLVATPMIVPSRRL

SEQ ID NO: 1530578 - protein, 26 aa, Mycobacterium tuberculosis
TNISPRCWIPFPASWRPSSPWPPPPN

SEQ ID NO: 1530579 - protein, 21 aa, Mycobacterium tuberculosis
TNLAGWLQNGPTETTFSVGLA

SEQ ID NO: 1530580 - protein, 22 aa, Mycobacterium tuberculosis
TNNFAILAGGYRFATASQLASR

SEQ ID NO: 1530581 - protein, 24 aa, Mycobacterium tuberculosis
TNPNLRLLGPLPTLYDSRTTHTRD

SEQ ID NO: 1530582 - protein, 18 aa, Mycobacterium tuberculosis
TNRWTLRPADPVGAVTVV

SEQ ID NO: 1530583 - protein, 21 aa, Mycobacterium tuberculosis
TNSLLDINVFGRRAGIAAASY

SEQ ID NO: 1530584 - protein, 24 aa, Mycobacterium tuberculosis
TNTVYFALLARRRMDLYGATVEDF

SEQ ID NO: 1530585 - protein, 17 aa, Mycobacterium tuberculosis
TNVLTHPGTFGLAGAAI

SEQ ID NO: 1530586 - protein, 24 aa, Mycobacterium tuberculosis
TNVPELMIMPFTESLAFGATRNPW

SEQ ID NO: 1530587 - protein, 20 aa, Mycobacterium tuberculosis
TNVWRNYSYAHPARRPAVSA

SEQ ID NO: 1530588 - protein, 19 aa, Mycobacterium tuberculosis
TNYMHWNRKHLAHAQWTVA

SEQ ID NO: 1530589 - protein, 21 aa, Mycobacterium tuberculosis
TPAAALPPPDPVPAVTSRPVT

SEQ ID NO: 1530590 - protein, 44 aa, Mycobacterium tuberculosis
TPAGPPRRPPGQPYLAYRPVCRPAWLPTLRRPWRRSPERPSSWY

SEQ ID NO: 1530591 - protein, 19 aa, Mycobacterium tuberculosis
TPAPVAPPTRRNRPSGHEL

SEQ ID NO: 1530592 - protein, 26 aa, Mycobacterium tuberculosis
TPAQTGPFFLLDIDSFWTPSGGSIPE

SEQ ID NO: 1530593 - protein, 17 aa, Mycobacterium tuberculosis
TPASFSYAGLSVGVLAG

SEQ ID NO: 1530594 - protein, 19 aa, Mycobacterium tuberculosis
TPATMNKINTALATALGLP

SEQ ID NO: 1530595 - protein, 19 aa, Mycobacterium tuberculosis
TPAWRSPTWPGCRLRCTPT

SEQ ID NO: 1530596 - protein, 20 aa, Mycobacterium tuberculosis
TPDGVWSRMKFEGGVHRVQR

SEQ ID NO: 1530597 - protein, 40 aa, Mycobacterium tuberculosis
TPDLTLPPLQIPGISVPAFSLPAITLPSLNIPAATTPANI

SEQ ID NO: 1530598 - protein, 26 aa, Mycobacterium tuberculosis
TPDNRMTIVRLLGISYFDEGLLQFEA

SEQ ID NO: 1530599 - protein, 18 aa, Mycobacterium tuberculosis
TPEHPFPVWTERGGPATI

SEQ ID NO: 1530600 - protein, 32 aa, Mycobacterium tuberculosis
TPERLRSLERLECLARRLPAVGHTLINQLDTQ

SEQ ID NO: 1530601 - protein, 17 aa, Mycobacterium tuberculosis
TPFPLALRPNPDAEPDR

SEQ ID NO: 1530602 - protein, 19 aa, Mycobacterium tuberculosis
TPGAGGTSGLLIGENGLNG

SEQ ID NO: 1530603 - protein, 26 aa, Mycobacterium tuberculosis
TPGALLGAKPFTFDPAALAAAQAAPG

SEQ ID NO: 1530604 - protein, 24 aa, Mycobacterium tuberculosis
TPGCYSMLPWRPAKRCCWKALKAP

SEQ ID NO: 1530605 - protein, 21 aa, Mycobacterium tuberculosis
TPGDAYWLLRHAIACPDPVMY

SEQ ID NO: 1530606 - protein, 20 aa, Mycobacterium tuberculosis
TPGFERTLLGRALDFWNEEV

SEQ ID NO: 1530607 - protein, 24 aa, Mycobacterium tuberculosis
TPGGGNYRGWRRGCRSRNGLPRPS

SEQ ID NO: 1530608 - protein, 32 aa, Mycobacterium tuberculosis; identical to SEQ ID NO: 225678

SEQ ID NO: 1530609 - protein, 24 aa, Mycobacterium tuberculosis
TPGSALLFPALCTPTGDPPAPEPA

SEQ ID NO: 1530610 - protein, 25 aa, Mycobacterium tuberculosis
TPGSGIPKSNFYPSPDRESAYASPR

SEQ ID NO: 1530611 - protein, 22 aa, Mycobacterium tuberculosis
TPGSWRREPLSGIPAATNTVIV

SEQ ID NO: 1530612 - protein, 23 aa, Mycobacterium tuberculosis
TPGVFVHWVVHVPNPAKKIERET

SEQ ID NO: 1530613 - protein, 17 aa, Mycobacterium tuberculosis
TPGYLTMGGFIPAQDEH

SEQ ID NO: 1530614 - protein, 26 aa, Mycobacterium tuberculosis
TPGYRPMHWLRGPARGWQPSVGDWLM

SEQ ID NO: 1530615 - protein, 17 aa, Mycobacterium tuberculosis
TPILPMIRAAEQRGIDW

SEQ ID NO: 1530616 - protein, 28 aa, Mycobacterium tuberculosis
TPIRDRCAEMFGGTPGRRGVGDRGECIA

SEQ ID NO: 1530617 - protein, 25 aa, Mycobacterium tuberculosis
TPKARLRPPIRREGLGLVFETPTDE

SEQ ID NO: 1530618 - protein, 24 aa, Mycobacterium tuberculosis
TPKPSWPWVRTLLHSIYDQPNAES

SEQ ID NO: 1530619 - protein, 17 aa, Mycobacterium tuberculosis
TPKVPYYSATLFDPREQ

SEQ ID NO: 1530620 - protein, 25 aa, Mycobacterium tuberculosis
TPKYKQVALFSATMPPAIRKLSAKY

SEQ ID NO: 1530621 - protein, 18 aa, Mycobacterium tuberculosis
TPLPVRRSIDPRARRYPT

SEQ ID NO: 1530622 - protein, 21 aa, Mycobacterium tuberculosis
TPLVGLQRLSPRWDDGRDGPH

SEQ ID NO: 1530623 - protein, 19 aa, Mycobacterium tuberculosis
TPLYSMFNRFGSGTANLAF

SEQ ID NO: 1530624 - protein, 24 aa, Mycobacterium tuberculosis
TPMTDWVPEDIFQTALGRAAEPVE

SEQ ID NO: 1530625 - protein, 17 aa, Mycobacterium tuberculosis
TPMVPGSWDPDRDAPGS

SEQ ID NO: 1530626 - protein, 25 aa, Mycobacterium tuberculosis
TPNGRPFFCGTYYPKAAFLQLLSAI

SEQ ID NO: 1530627 - protein, 27 aa, Mycobacterium tuberculosis
TPNSDQSWMILPYDNALNGWKSNGTVA

SEQ ID NO: 1530628 - protein, 17 aa, Mycobacterium tuberculosis
TPPALNTGLGNIGSWNL

SEQ ID NO: 1530629 - protein, 18 aa, Mycobacterium tuberculosis
TPPALNTGLGNIGSWNLG

SEQ ID NO: 1530630 - protein, 17 aa, Mycobacterium tuberculosis
TPPCWISASPSWPTASA

SEQ ID NO: 1530631 - protein, 21 aa, Mycobacterium tuberculosis
TPPKGGAFGGLGGAGGAGGKG

SEQ ID NO: 1530632 - protein, 28 aa, Mycobacterium tuberculosis
TPPTLTLTLPRPTVVTGLRLAASRSMLP

SEQ ID NO: 1530633 - protein, 19 aa, Mycobacterium tuberculosis
TPQEFHVLRRAGTERPFTG

SEQ ID NO: 1530634 - protein, 25 aa, Mycobacterium tuberculosis
TPSANSIAWLLWHSARVQDIQVAHV

SEQ ID NO: 1530635 - protein, 19 aa, Mycobacterium tuberculosis
TPSMCQWVHIVGGPTKDAQ

SEQ ID NO: 1530636 - protein, 25 aa, Mycobacterium tuberculosis
TPSRGVWQFIAPTFAAYHEPGTSTN

SEQ ID NO: 1530637 - protein, 25 aa, Mycobacterium tuberculosis
TPSSKLGGLWKTVSPHRSPISNMVS

SEQ ID NO: 1530638 - protein, 31 aa, Mycobacterium tuberculosis
TPTATPANYQPFQCVTLSAGSRLAGRKSMPC

SEQ ID NO: 1530639 - protein, 20 aa, Mycobacterium tuberculosis
TPTEWGMLEMLARNRGKLVG

SEQ ID NO: 1530640 - protein, 23 aa, Mycobacterium tuberculosis
TPTGTRWLPHPGPLILQATASHL

SEQ ID NO: 1530641 - protein, 30 aa, Mycobacterium tuberculosis
TPTKWDNSFLEILYGYEWELTKSPAGAWQY

SEQ ID NO: 1530642 - protein, 23 aa, Mycobacterium tuberculosis
TPTLKGPLELLPNAVRPAVSATL

SEQ ID NO: 1530643 - protein, 17 aa, Mycobacterium tuberculosis
TPTPGAAQLPLAPAINY

SEQ ID NO: 1530644 - protein, 18 aa, Mycobacterium tuberculosis
TPTRWIASLTVPPQMREQ

SEQ ID NO: 1530645 - protein, 20 aa, Mycobacterium tuberculosis
TPVEHGLVLPSGPLIHGGTG

SEQ ID NO: 1530646 - protein, 23 aa, Mycobacterium tuberculosis
TPVEMELIMGWLGQQRARHPDSK

SEQ ID NO: 1530647 - protein, 18 aa, Mycobacterium tuberculosis
TPVLPPLDVAASAELLLL

SEQ ID NO: 1530648 - protein, 18 aa, Mycobacterium tuberculosis
TPVRKACTVLAVLAATLL

SEQ ID NO: 1530649 - protein, 17 aa, Mycobacterium tuberculosis
TQAAAFHERFIQALSTA

SEQ ID NO: 1530650 - protein, 17 aa, Mycobacterium tuberculosis
TQAAAFHSRFVQALTTA

SEQ ID NO: 1530651 - protein, 18 aa, Mycobacterium tuberculosis
TQALISGFGNHGARLSGI

SEQ ID NO: 1530652 - protein, 23 aa, Mycobacterium tuberculosis
TQAPAIWASPTWAPTTPVATTWA

SEQ ID NO: 1530653 - protein, 21 aa, Mycobacterium tuberculosis
TQELLEFPGGILGVALNLDEH

SEQ ID NO: 1530654 - protein, 23 aa, Mycobacterium tuberculosis
TQIAALFGAHARSYQTLSTQAAA

SEQ ID NO: 1530655 - protein, 36 aa, Mycobacterium tuberculosis
TQKTRIQPLPPKRAGLLIRALYRIAKRRFGEVPEPF

SEQ ID NO: 1530656 - protein, 18 aa, Mycobacterium tuberculosis
TQLGNTVGTLYYMAPERF

SEQ ID NO: 1530657 - protein, 24 aa, Mycobacterium tuberculosis
TQLWLERPLIGDGVHGAPGTGQPG

SEQ ID NO: 1530658 - protein, 24 aa, Mycobacterium tuberculosis
TQNDFVLLPDVDAELVLTAARVAA

SEQ ID NO: 1530659 - protein, 25 aa, Mycobacterium tuberculosis
TQPNRRLQRPPPHPASPAANQLHCG

SEQ ID NO: 1530660 - protein, 22 aa, Mycobacterium tuberculosis
TQPVLLDWAVGLAFPCQQPMLH

SEQ ID NO: 1530661 - protein, 23 aa, Mycobacterium tuberculosis
TQPVLLDWAVGLAFPCQQPMLHA

SEQ ID NO: 1530662 - protein, 18 aa, Mycobacterium tuberculosis
TQPWLADHQIHGAAALPG

SEQ ID NO: 1530663 - protein, 21 aa, Mycobacterium tuberculosis
TQPYPTLRWHSQRGGSAVSHY

SEQ ID NO: 1530664 - protein, 17 aa, Mycobacterium tuberculosis
TQRAWFSGCYWLACFHR

SEQ ID NO: 1530665 - protein, 19 aa, Mycobacterium tuberculosis
TQRGWRFPDRLDRVYVNSR

SEQ ID NO: 1530666 - protein, 29 aa, Mycobacterium tuberculosis
TQRQPLRVQRWVGLVLPAVRGKRLPEVAG

SEQ ID NO: 1530667 - protein, 17 aa, Mycobacterium tuberculosis
TQRVAFFADVKMVALIS

SEQ ID NO: 1530668 - protein, 21 aa, Mycobacterium tuberculosis
TQSATWMALFSGQTTVLAPEF

SEQ ID NO: 1530669 - protein, 26 aa, Mycobacterium tuberculosis
TQSVPPVTLRQALLGKVMTVGDAVSL

SEQ ID NO: 1530670 - protein, 20 aa, Mycobacterium tuberculosis
TQTIADMFDYWRSKSESALM

SEQ ID NO: 1530671 - protein, 23 aa, Mycobacterium tuberculosis
TQVAAFHDRFAQTLSAAVGSYVS

SEQ ID NO: 1530672 - protein, 25 aa, Mycobacterium tuberculosis
TQVVAGIRRWLDSPILMVADMFAAR

SEQ ID NO: 1530673 - protein, 23 aa, Mycobacterium tuberculosis
TQVVAGIRRWLDSPSLMVADMFA

SEQ ID NO: 1530674 - protein, 24 aa, Mycobacterium tuberculosis
TQVVAGIRRWLDSPSLMVADMFAA

SEQ ID NO: 1530675 - protein, 23 aa, Mycobacterium tuberculosis
TQYRDYVLMLAALDLAATVEDEP

SEQ ID NO: 1530676 - protein, 24 aa, Mycobacterium tuberculosis
TRAAICRFATWWVVLERHGNVVRL

SEQ ID NO: 1530677 - protein, 25 aa, Mycobacterium tuberculosis
TRADGERRPGWVGLPLAGVQTRLVD

SEQ ID NO: 1530678 - protein, 24 aa, Mycobacterium tuberculosis
TRAGVLRFLVLDGLAKPGRMVGPD

SEQ ID NO: 1530679 - protein, 22 aa, Mycobacterium tuberculosis
TRAGVLRFVVLDGLAKPGRMVG

SEQ ID NO: 1530680 - protein, 18 aa, Mycobacterium tuberculosis
TRALGLLGVTDVALIDDA

SEQ ID NO: 1530681 - protein, 23 aa, Mycobacterium tuberculosis
TRARRRRDRRRCGPRSSNGSGHS

SEQ ID NO: 1530682 - protein, 36 aa, Mycobacterium tuberculosis
TRASLDAVTKYPWMRGDGLGSQRRKFGFYDDDRESA

SEQ ID NO: 1530683 - protein, 19 aa, Mycobacterium tuberculosis
TRCCLRVHRRRRCRLFRRC

SEQ ID NO: 1530684 - protein, 20 aa, Mycobacterium tuberculosis
TRCPTSRFSPQLRSKRPGRG

SEQ ID NO: 1530685 - protein, 23 aa, Mycobacterium tuberculosis
TRCQMSFVVTIPEALAAVATDLA

SEQ ID NO: 1530686 - protein, 18 aa, Mycobacterium tuberculosis
TRCRALELGLTGYAANHA

SEQ ID NO: 1530687 - protein, 23 aa, Mycobacterium tuberculosis
TRDAIEALAPYGLGTAYVNFTAD

SEQ ID NO: 1530688 - protein, 23 aa, Mycobacterium tuberculosis
TRDFAIGLAGIPPSLQSALQALA

SEQ ID NO: 1530689 - protein, 21 aa, Mycobacterium tuberculosis
TRDRPKKLFRPKVPVTIVVGE

SEQ ID NO: 1530690 - protein, 18 aa, Mycobacterium tuberculosis
TRFFGVRPVSILYRLYRP

SEQ ID NO: 1530691 - protein, 17 aa, Mycobacterium tuberculosis
TRGDIHPVYRRAAHLGR

SEQ ID NO: 1530692 - protein, 21 aa, Mycobacterium tuberculosis
TRGTPPRLEGCRPASRGLTLA

SEQ ID NO: 1530693 - protein, 19 aa, Mycobacterium tuberculosis
TRHNLGFVVADLLAARLGA

SEQ ID NO: 1530694 - protein, 23 aa, Mycobacterium tuberculosis
TRKLAQEYTYRYLAAALTWFVDD

SEQ ID NO: 1530695 - protein, 22 aa, Mycobacterium tuberculosis
TRKRSTSLTILFSRRQTQNPER

SEQ ID NO: 1530696 - protein, 30 aa, Mycobacterium tuberculosis
TRLAVCLDLDWRPQFRVDLIPSYKAHRVAE

SEQ ID NO: 1530697 - protein, 21 aa, Mycobacterium tuberculosis
TRLYHVLHAIADTIRHNEAAL

SEQ ID NO: 1530698 - protein, 23 aa, Mycobacterium tuberculosis
TRMKLARNMLTLVSYAAAAEAQR

SEQ ID NO: 1530699 - protein, 24 aa, Mycobacterium tuberculosis
TRMNELIPLALRLIEEGFALYGDQ

SEQ ID NO: 1530700 - protein, 25 aa, Mycobacterium tuberculosis
TRNLPRLIRPVATVLGPLLFQSPEM

SEQ ID NO: 1530701 - protein, 43 aa, Mycobacterium tuberculosis
TRPAKLPTRIRQTPQVLPLEMGCFLQPIFTGDRGGPGRRDRAV

SEQ ID NO: 1530702 - protein, 24 aa, Mycobacterium tuberculosis
TRPGRRRRRGGTLAGNGGAGGTGG

SEQ ID NO: 1530703 - protein, 33 aa, Mycobacterium tuberculosis
TRPIDPWGGSYYVEWLTHRLARRARAHIAEVAE

SEQ ID NO: 1530704 - protein, 22 aa, Mycobacterium tuberculosis
TRPKRRRRRRRACLLGENGLNG

SEQ ID NO: 1530705 - protein, 21 aa, Mycobacterium tuberculosis
TRPLDAGPYTFLAADALVLKV

SEQ ID NO: 1530706 - protein, 24 aa, Mycobacterium tuberculosis
TRPLDAGPYTFLAADALVLKVREA

SEQ ID NO: 1530707 - protein, 17 aa, Mycobacterium tuberculosis
TRPLSATKRWRLVEILE

SEQ ID NO: 1530708 - protein, 20 aa, Mycobacterium tuberculosis
TRQRAAISTLLETLDDFRSA

SEQ ID NO: 1530709 - protein, 22 aa, Mycobacterium tuberculosis
TRQVRAIWIICVGPSEWPGDGA

SEQ ID NO: 1530710 - protein, 17 aa, Mycobacterium tuberculosis
TRRALALCVPRDAIARD

SEQ ID NO: 1530711 - protein, 18 aa, Mycobacterium tuberculosis
TRRDAVIGDTLRPIEGRT

SEQ ID NO: 1530712 - protein, 20 aa, Mycobacterium tuberculosis
TRRGNWWYYARTFEGKQYGV

SEQ ID NO: 1530713 - protein, 23 aa, Mycobacterium tuberculosis
TRRGRLRAGVRRSIWAGSDEERL

SEQ ID NO: 1530714 - protein, 17 aa, Mycobacterium tuberculosis
TRSATAVRRHNFTAAIA

SEQ ID NO: 1530715 - protein, 18 aa, Mycobacterium tuberculosis
TRSEMIAQLVFAMGGRAA

SEQ ID NO: 1530716 - protein, 25 aa, Mycobacterium tuberculosis
TRSGKIMRRLLRDVAENRELGDTST

SEQ ID NO: 1530717 - protein, 24 aa, Mycobacterium tuberculosis
TRSLAWELSWKDTAAPLWTFPRVA

SEQ ID NO: 1530718 - protein, 28 aa, Mycobacterium tuberculosis
TRTAAPPRILWLDTAAPAKLILEVRAMD

SEQ ID NO: 1530719 - protein, 29 aa, Mycobacterium tuberculosis
TRTVDILERFYGLVLTDCGTGLLHSAMSA

SEQ ID NO: 1530720 - protein, 17 aa, Mycobacterium tuberculosis
TRVFRNLGLANVGEGNV

SEQ ID NO: 1530721 - protein, 22 aa, Mycobacterium tuberculosis
TRVPVGPVVRVGGCTATAAPAA

SEQ ID NO: 1530722 - protein, 25 aa, Mycobacterium tuberculosis
TRVRTRLIELFELFDPADPEVVAGR

SEQ ID NO: 1530723 - protein, 26 aa, Mycobacterium tuberculosis
TRVRTRLIELFELFDPADPEVVAGRR

SEQ ID NO: 1530724 - protein, 17 aa, Mycobacterium tuberculosis
TRYLLDKSAAYRAHLPA

SEQ ID NO: 1530725 - protein, 25 aa, Mycobacterium tuberculosis
TRYNPDYLPGALLPPSIHATADAEE

SEQ ID NO: 1530726 - protein, 22 aa, Mycobacterium tuberculosis
TSALPPFTPPVQGTGPAGPAAA

SEQ ID NO: 1530727 - protein, 23 aa, Mycobacterium tuberculosis
TSALQIVVLNFGLADVGLGNVGL

SEQ ID NO: 1530728 - protein, 29 aa, Mycobacterium tuberculosis
TSATPARALGLTGVGRLAAGYAANLVVLD

SEQ ID NO: 1530729 - protein, 24 aa, Mycobacterium tuberculosis
TSAVKAFTAWAVRRGLLAGDPAAR

SEQ ID NO: 1530730 - protein, 26 aa, Mycobacterium tuberculosis
TSDIKNLLPMLAVFKPTVVVSVPRVF

SEQ ID NO: 1530731 - protein, 20 aa, Mycobacterium tuberculosis
TSDLDLSMFALCSSIAATVG

SEQ ID NO: 1530732 - protein, 22 aa, Mycobacterium tuberculosis
TSEDHCVVNVLYFGAVREACKV

SEQ ID NO: 1530733 - protein, 24 aa, Mycobacterium tuberculosis
TSEIEPFIVWTSSGAIGPTWYSVG

SEQ ID NO: 1530734 - protein, 18 aa, Mycobacterium tuberculosis
TSGWPTPAPATSGSGWWG

SEQ ID NO: 1530735 - protein, 25 aa, Mycobacterium tuberculosis
TSINAIRRLEADGLVRRVPHPTDGR

SEQ ID NO: 1530736 - protein, 17 aa, Mycobacterium tuberculosis
TSIPAPGLGALGAGRGG

SEQ ID NO: 1530737 - protein, 17 aa, Mycobacterium tuberculosis
TSKLCNVLFTYELDRRL

SEQ ID NO: 1530738 - protein, 18 aa, Mycobacterium tuberculosis
TSKLCNVLFTYELDRRLD

SEQ ID NO: 1530739 - protein, 17 aa, Mycobacterium tuberculosis
TSLLRFAGGLHIVGGRV

SEQ ID NO: 1530740 - protein, 19 aa, Mycobacterium tuberculosis
TSLNIVLIDTLRPQLRDPA

SEQ ID NO: 1530741 - protein, 20 aa, Mycobacterium tuberculosis
TSLRALLKQYGPLTPARAVA

SEQ ID NO: 1530742 - protein, 24 aa, Mycobacterium tuberculosis
TSMLAMSAPYVEWLERTAAQTKQT

SEQ ID NO: 1530743 - protein, 27 aa, Mycobacterium tuberculosis
TSPPNVATPFRLFPEVSPVVIADALVA

SEQ ID NO: 1530744 - protein, 18 aa, Mycobacterium tuberculosis
TSPRLLAGGWVDAYARRI

SEQ ID NO: 1530745 - protein, 25 aa, Mycobacterium tuberculosis
TSPVTIPGFTIPGSPLNLTANGGLG

SEQ ID NO: 1530746 - protein, 18 aa, Mycobacterium tuberculosis
TSQMIVAPAFVDAAAKDL

SEQ ID NO: 1530747 - protein, 18 aa, Mycobacterium tuberculosis
TSRRSCFCGYARPLADTA

SEQ ID NO: 1530748 - protein, 30 aa, Mycobacterium tuberculosis
TSRTPTYDGVLGRLWLARGGTYALANIRGG

SEQ ID NO: 1530749 - protein, 17 aa, Mycobacterium tuberculosis
TSSLAAASLLDLGLHRA

SEQ ID NO: 1530750 - protein, 27 aa, Mycobacterium tuberculosis
TSSSRLPVSLPFVARTRTMQATGRDGS

SEQ ID NO: 1530751 - protein, 26 aa, Mycobacterium tuberculosis
TSSYGRGFLTPRNSLRQRCVAHRLTI

SEQ ID NO: 1530752 - protein, 24 aa, Mycobacterium tuberculosis
TSTAELVALLYQAIPAPARRVGGH

SEQ ID NO: 1530753 - protein, 19 aa, Mycobacterium tuberculosis
TSVHTLQQAALNVVNEPFQ

SEQ ID NO: 1530754 - protein, 19 aa, Mycobacterium tuberculosis
TSVLLINHGLHIEILIDPE

SEQ ID NO: 1530755 - protein, 27 aa, Mycobacterium tuberculosis
TSVVNAAVLYVFRTLVADDIPLNDGCL

SEQ ID NO: 1530756 - protein, 23 aa, Mycobacterium tuberculosis
TSWLDPFTEFRFPRIGTAVFDGI

SEQ ID NO: 1530757 - protein, 25 aa, Mycobacterium tuberculosis
TSYTFDRLVRVYPHIVRLRPAPHSR

SEQ ID NO: 1530758 - protein, 23 aa, Mycobacterium tuberculosis
TTAGRPCCLLREPMPRPGPSSPA

SEQ ID NO: 1530759 - protein, 22 aa, Mycobacterium tuberculosis
TTDQRLLDLLPPAPVDVNPPGD

SEQ ID NO: 1530760 - protein, 23 aa, Mycobacterium tuberculosis
TTDQRLLDLLPPAPVDVNPPGDE

SEQ ID NO: 1530761 - protein, 18 aa, Mycobacterium tuberculosis
TTEAFTDGWFKTGDLGAV

SEQ ID NO: 1530762 - protein, 19 aa, Mycobacterium tuberculosis
TTEFYPHHRIDPPSTACCA

SEQ ID NO: 1530763 - protein, 21 aa, Mycobacterium tuberculosis
TTFGRIGVKVWIYKGDIRGRQ

SEQ ID NO: 1530764 - protein, 24 aa, Mycobacterium tuberculosis
TTGLIRQRRQWREPAEPVDDVSAR

SEQ ID NO: 1530765 - protein, 26 aa, Mycobacterium tuberculosis
TTGQDLLMITVLKGAVLFVTDLARAI

SEQ ID NO: 1530766 - protein, 27 aa, Mycobacterium tuberculosis
TTGQDLLMITVLKGAVLFVTDLARAIP

SEQ ID NO: 1530767 - protein, 26 aa, Mycobacterium tuberculosis
TTGRRWRQWAVPAGFASTGLGCPGRR

SEQ ID NO: 1530768 - protein, 17 aa, Mycobacterium tuberculosis
TTGTPLRVQRAAMAATA

SEQ ID NO: 1530769 - protein, 22 aa, Mycobacterium tuberculosis
TTGVLRLYQFAAAGDLAFPAIN

SEQ ID NO: 1530770 - protein, 18 aa, Mycobacterium tuberculosis
TTKHIPAFKLTRSSAAYW

SEQ ID NO: 1530771 - protein, 26 aa, Mycobacterium tuberculosis
TTKRAAVDLALRRLVRSPLSREFLLG

SEQ ID NO: 1530772 - protein, 20 aa, Mycobacterium tuberculosis
TTLLMTLAGLLPPVHGRVLL

SEQ ID NO: 1530773 - protein, 20 aa, Mycobacterium tuberculosis
TTLQTEEWLGPASTLMVEAV

SEQ ID NO: 1530774 - protein, 20 aa, Mycobacterium tuberculosis
TTMFRPKLDALALLHRLSLK

SEQ ID NO: 1530775 - protein, 23 aa, Mycobacterium tuberculosis
TTMSHLLLDLDLLGRCGPGSPMG

SEQ ID NO: 1530776 - protein, 23 aa, Mycobacterium tuberculosis
TTNDIWHLVNTLWPRRGAATDRL

SEQ ID NO: 1530777 - protein, 23 aa, Mycobacterium tuberculosis
TTNPLHVRLGQRPTLMFDNTTMM

SEQ ID NO: 1530778 - protein, 17 aa, Mycobacterium tuberculosis
TTPARRFGPTRLAQTKR

SEQ ID NO: 1530779 - protein, 25 aa, Mycobacterium tuberculosis
TTPATMAVLWITERCVCSQCGTVSG

SEQ ID NO: 1530780 - protein, 23 aa, Mycobacterium tuberculosis
TTPLGARRSWGPPGPLVVATAGA

SEQ ID NO: 1530781 - protein, 22 aa, Mycobacterium tuberculosis
TTPMKPVAMPPAKTRQVRAIWI

SEQ ID NO: 1530782 - protein, 25 aa, Mycobacterium tuberculosis
TTPSSKLGGLWKTVSPRLSPISNMV

SEQ ID NO: 1530783 - protein, 22 aa, Mycobacterium tuberculosis
TTQAICAFVVLRANYAPHDRTA

SEQ ID NO: 1530784 - protein, 42 aa, Mycobacterium tuberculosis; identical to SEQ ID NO: 227037

SEQ ID NO: 1530785 - protein, 95 aa, Mycobacterium tuberculosis; identical to SEQ ID NO: 225691

SEQ ID NO: 1530786 - protein, 34 aa, Mycobacterium tuberculosis
TTRPIDPWGGSYYVEWLTHRLARRARAHIAEVAE

SEQ ID NO: 1530787 - protein, 21 aa, Mycobacterium tuberculosis
TTRYLINDAAVLAGKPYVWGS

SEQ ID NO: 1530788 - protein, 17 aa, Mycobacterium tuberculosis
TTSAHPWFQAALADLPG

SEQ ID NO: 1530789 - protein, 23 aa, Mycobacterium tuberculosis
TTSLAHGPFPKADAAYLVDETVE

SEQ ID NO: 1530790 - protein, 26 aa, Mycobacterium tuberculosis
TTSRASILPVAGTPAAATAACSTLAP

SEQ ID NO: 1530791 - protein, 19 aa, Mycobacterium tuberculosis
TTSTGWFNSGTTNTGWFNS

SEQ ID NO: 1530792 - protein, 19 aa, Mycobacterium tuberculosis
TTTASGLVIPDTAKEKPQE

SEQ ID NO: 1530793 - protein, 32 aa, Mycobacterium tuberculosis
TTTGRERRCWPRWPSWPPAVAAQLVAGGLTII

SEQ ID NO: 1530794 - protein, 23 aa, Mycobacterium tuberculosis
TTVAHKLIVIIWHVLATGRPYQD

SEQ ID NO: 1530795 - protein, 17 aa, Mycobacterium tuberculosis
TTVARWRRCAPQRRVGL

SEQ ID NO: 1530796 - protein, 19 aa, Mycobacterium tuberculosis
TTVMTNIVVLIKQVPDTWS

SEQ ID NO: 1530797 - protein, 19 aa, Mycobacterium tuberculosis
TTWLPFGGGNRRCLGATFA

SEQ ID NO: 1530798 - protein, 21 aa, Mycobacterium tuberculosis
TTWPAHLRPALTTAGFATELR

SEQ ID NO: 1530799 - protein, 21 aa, Mycobacterium tuberculosis
TTYPVWMMNAIGDISFHHATA

SEQ ID NO: 1530800 - protein, 20 aa, Mycobacterium tuberculosis
TVAAFAAIAARPASPGGAAV

SEQ ID NO: 1530801 - protein, 30 aa, Mycobacterium tuberculosis
TVAAVATDLKRIGASLAHENASAAASTTAV

SEQ ID NO: 1530802 - protein, 24 aa, Mycobacterium tuberculosis
TVALVNVVLPMPPVAPVEADVAVV

SEQ ID NO: 1530803 - protein, 26 aa, Mycobacterium tuberculosis
TVARRGGIVILPQDLPIPAVKQTVAF

SEQ ID NO: 1530804 - protein, 29 aa, Mycobacterium tuberculosis
TVASAGPGRPAFPVVPAGSADCSSATAAT

SEQ ID NO: 1530805 - protein, 24 aa, Mycobacterium tuberculosis
TVDAGRRFWPARSAPRSRMSSTPT

SEQ ID NO: 1530806 - protein, 23 aa, Mycobacterium tuberculosis
TVDDLLDHLLPHDWRVDMPELDP

SEQ ID NO: 1530807 - protein, 18 aa, Mycobacterium tuberculosis
TVDGPLRFELIDIATATS

SEQ ID NO: 1530808 - protein, 25 aa, Mycobacterium tuberculosis
TVDKISVLMTENRVRHVPVLDGKKL

SEQ ID NO: 1530809 - protein, 32 aa, Mycobacterium tuberculosis
TVDPLLVAANRHQLVSLVLSNLFGQNAPAIAA

SEQ ID NO: 1530810 - protein, 29 aa, Mycobacterium tuberculosis
TVDPRYMVHSLHGYFLRPGDAKERTVFLV

SEQ ID NO: 1530811 - protein, 30 aa, Mycobacterium tuberculosis
TVDTKVLSPPYSILAIGDPPTLAAAMNIPG

SEQ ID NO: 1530812 - protein, 18 aa, Mycobacterium tuberculosis
TVDWHMPPRARKPQRRVR

SEQ ID NO: 1530813 - protein, 18 aa, Mycobacterium tuberculosis
TVEDTEGGIIWRVSAAWQ

SEQ ID NO: 1530814 - protein, 19 aa, Mycobacterium tuberculosis
TVEDTEGGIIWRVSAAWQR

SEQ ID NO: 1530815 - protein, 35 aa, Mycobacterium tuberculosis; identical to SEQ ID NO: 1389352

SEQ ID NO: 1530816 - protein, 18 aa, Mycobacterium tuberculosis
TVELRRPGGPGVIIGRNV

SEQ ID NO: 1530817 - protein, 20 aa, Mycobacterium tuberculosis
TVERLEPRLSPASRHITVNR

SEQ ID NO: 1530818 - protein, 29 aa, Mycobacterium tuberculosis
TVESLQRLRLPWWHLWRAAEAAGAATPKR

SEQ ID NO: 1530819 - protein, 19 aa, Mycobacterium tuberculosis
TVEVPVGGILAPLQPFQAT

SEQ ID NO: 1530820 - protein, 26 aa, Mycobacterium tuberculosis
TVFEHLGRLLIIDCGVLFPGHDEPGV

SEQ ID NO: 1530821 - protein, 18 aa, Mycobacterium tuberculosis
TVFETRMNELIPLALRLI

SEQ ID NO: 1530822 - protein, 25 aa, Mycobacterium tuberculosis
TVFTQAPRRVVTGVPLWTTRAKRWL

SEQ ID NO: 1530823 - protein, 31 aa, Mycobacterium tuberculosis
TVGAFSLPGLTLPSLTSRPPPHQPTSPWVPS

SEQ ID NO: 1530824 - protein, 18 aa, Mycobacterium tuberculosis
TVGFAGSGGFGGAGGIAQ

SEQ ID NO: 1530825 - protein, 21 aa, Mycobacterium tuberculosis
TVGGLMLPVGVRRLRNYHSTR

SEQ ID NO: 1530826 - protein, 27 aa, Mycobacterium tuberculosis
TVGLGPFTVPPISIPSLPIASITGSVD

SEQ ID NO: 1530827 - protein, 18 aa, Mycobacterium tuberculosis
TVGPVERGNGGPPPMRLE

SEQ ID NO: 1530828 - protein, 18 aa, Mycobacterium tuberculosis
TVGTLYYMAPERFSESHA

SEQ ID NO: 1530829 - protein, 27 aa, Mycobacterium tuberculosis
TVGYLALLEAAFLIHRVPAWSTNLSRK

SEQ ID NO: 1530830 - protein, 18 aa, Mycobacterium tuberculosis
TVHPALVAANRALVAWLA

SEQ ID NO: 1530831 - protein, 26 aa, Mycobacterium tuberculosis
TVHPSGHILVRSCRGGYMHSVPLSEA

SEQ ID NO: 1530832 - protein, 26 aa, Mycobacterium tuberculosis
TVHPTTMRLLDELGLWERFAALPYSE

SEQ ID NO: 1530833 - protein, 22 aa, Mycobacterium tuberculosis
TVIFLQSHPAWIAAQQRDHQLE

SEQ ID NO: 1530834 - protein, 31 aa, Mycobacterium tuberculosis
TVISYGPLASHHLRWLASANGLLDIPEDVVE

SEQ ID NO: 1530835 - protein, 25 aa, Mycobacterium tuberculosis
TVIVAPMFHAWGFSQLVLASSLACT

SEQ ID NO: 1530836 - protein, 27 aa, Mycobacterium tuberculosis
TVIVAPMFHAWGFSQLVLASSLACTIV

SEQ ID NO: 1530837 - protein, 22 aa, Mycobacterium tuberculosis
TVKSMILHEILPIDVSINLEDA

SEQ ID NO: 1530838 - protein, 19 aa, Mycobacterium tuberculosis
TVLPAIPLNVDVTIPVGPI

SEQ ID NO: 1530839 - protein, 25 aa, Mycobacterium tuberculosis
TVMATPAMFIEFSRQRALSADGRCK

SEQ ID NO: 1530840 - protein, 17 aa, Mycobacterium tuberculosis
TVNVCKYNLGWGAIGMC

SEQ ID NO: 1530841 - protein, 24 aa, Mycobacterium tuberculosis
TVPGPLQGINFGFGNIGSLNLGSG

SEQ ID NO: 1530842 - protein, 25 aa, Mycobacterium tuberculosis
TVPGPLQGINFGFGNIGSLNLGSGN

SEQ ID NO: 1530843 - protein, 17 aa, Mycobacterium tuberculosis
TVPKHGAHLRLIPQRRL

SEQ ID NO: 1530844 - protein, 17 aa, Mycobacterium tuberculosis
TVRAQLREWLAEIGADH

SEQ ID NO: 1530845 - protein, 27 aa, Mycobacterium tuberculosis
TVRHLEVIALTPARLLMVVITDSGRVD

SEQ ID NO: 1530846 - protein, 18 aa, Mycobacterium tuberculosis
TVRQRRQLWHFGLDPEEV

SEQ ID NO: 1530847 - protein, 23 aa, Mycobacterium tuberculosis
TVRTDLFRRNGLPVPAPHDDDPL

SEQ ID NO: 1530848 - protein, 25 aa, Mycobacterium tuberculosis
TVSQMLQCIVTLMPLGAAVVDTHRD

SEQ ID NO: 1530849 - protein, 31 aa, Mycobacterium tuberculosis
TVSSIFLMCLPDRVLAYGDCAIIPNPTVEQL

SEQ ID NO: 1530850 - protein, 26 aa, Mycobacterium tuberculosis
TVTFPGFTIPLDPIDIGLPVSLTIPG

SEQ ID NO: 1530851 - protein, 24 aa, Mycobacterium tuberculosis
TVTNRWRHSTSPWLAVPGPVRTRR

SEQ ID NO: 1530852 - protein, 23 aa, Mycobacterium tuberculosis
TVTYDVIIRDGLWFDGTGNAPLT

SEQ ID NO: 1530853 - protein, 22 aa, Mycobacterium tuberculosis
TVVDPQWVWPISPALTELAGRH

SEQ ID NO: 1530854 - protein, 21 aa, Mycobacterium tuberculosis
TVVHNTWRFGLDRILTGVAMS

SEQ ID NO: 1530855 - protein, 24 aa, Mycobacterium tuberculosis
TVVPATVLTLVRTLLRAREGRTMA

SEQ ID NO: 1530856 - protein, 28 aa, Mycobacterium tuberculosis
TVVQFHFIARLVLVLLDETFLPGGPRAQ

SEQ ID NO: 1530857 - protein, 18 aa, Mycobacterium tuberculosis
TVVSPPFAAGPTGTAVAV

SEQ ID NO: 1530858 - protein, 19 aa, Mycobacterium tuberculosis
TVVWPDDAPLPPVGTRLRV

SEQ ID NO: 1530859 - protein, 21 aa, Mycobacterium tuberculosis
TVWHRLQATDEIYFVLSGRGL

SEQ ID NO: 1530860 - protein, 20 aa, Mycobacterium tuberculosis
TVWSVWGVGGAILLGDALHA

SEQ ID NO: 1530861 - protein, 18 aa, Mycobacterium tuberculosis
TVYGVDKFPRMVDYVVPT

SEQ ID NO: 1530862 - protein, 17 aa, Mycobacterium tuberculosis
TVYYRVFGGWLRQRRNI

SEQ ID NO: 1530863 - protein, 23 aa, Mycobacterium tuberculosis
TWDRRPSWFRAVARMATGVKDRA

SEQ ID NO: 1530864 - protein, 21 aa, Mycobacterium tuberculosis
TWILRDLGVYAIRLSDDVPGF

SEQ ID NO: 1530865 - protein, 17 aa, Mycobacterium tuberculosis
TWLLAVSNVFGQNAPAI

SEQ ID NO: 1530866 - protein, 17 aa, Mycobacterium tuberculosis
TWMLQRAVGPQVARAAL

SEQ ID NO: 1530867 - protein, 20 aa, Mycobacterium tuberculosis
TWNCLSRESVSTWVFVVWPR

SEQ ID NO: 1530868 - protein, 17 aa, Mycobacterium tuberculosis
TWNHRRLLLDDTTRRIA

SEQ ID NO: 1530869 - protein, 21 aa, Mycobacterium tuberculosis
TWPKLRDRPRLGVSVLVEGHD

SEQ ID NO: 1530870 - protein, 21 aa, Mycobacterium tuberculosis
TWPVDRPFAMLTVARSLMLDV

SEQ ID NO: 1530871 - protein, 28 aa, Mycobacterium tuberculosis
TWQMSTIQLDFNFPERFGLEYTAADGTR

SEQ ID NO: 1530872 - protein, 17 aa, Mycobacterium tuberculosis
TWQVGAMRELLLAHRDP

SEQ ID NO: 1530873 - protein, 18 aa, Mycobacterium tuberculosis
TWQVGAMRELLLAHRDPG

SEQ ID NO: 1530874 - protein, 17 aa, Mycobacterium tuberculosis
TWQYWLTTRSVNPAEYR

SEQ ID NO: 1530875 - protein, 21 aa, Mycobacterium tuberculosis
TWTQRLVSLLVFDGPDLPGPL

SEQ ID NO: 1530876 - protein, 18 aa, Mycobacterium tuberculosis
TWWQADPSADLILLYLIQ

SEQ ID NO: 1530877 - protein, 17 aa, Mycobacterium tuberculosis
TYAAPLFVTAEFINNNT

SEQ ID NO: 1530878 - protein, 25 aa, Mycobacterium tuberculosis
TYAPGLWRYWAEHLDPDRARRNDPL

SEQ ID NO: 1530879 - protein, 25 aa, Mycobacterium tuberculosis
TYEDIVGLERLYAETLRPATKFSRC

SEQ ID NO: 1530880 - protein, 26 aa, Mycobacterium tuberculosis
TYEQFARMLTLMGPSDLWTVERAARH

SEQ ID NO: 1530881 - protein, 17 aa, Mycobacterium tuberculosis
TYFALMDRLGTDGLLTA

SEQ ID NO: 1530882 - protein, 26 aa, Mycobacterium tuberculosis
TYGDFQNFYLCDLQIKWNGFQAGGPV

SEQ ID NO: 1530883 - protein, 23 aa, Mycobacterium tuberculosis
TYGQDRVEPLWLGRSNRTSVIHR

SEQ ID NO: 1530884 - protein, 27 aa, Mycobacterium tuberculosis
TYGRGVYAWRLVRYYEDSTLATALANP

SEQ ID NO: 1530885 - protein, 33 aa, Mycobacterium tuberculosis
TYHAFAGSLLRDYGLLLPLEPDTRLLSETELWQ

SEQ ID NO: 1530886 - protein, 21 aa, Mycobacterium tuberculosis
TYLYRYDYAPRTLRWSGFGAT

SEQ ID NO: 1530887 - protein, 18 aa, Mycobacterium tuberculosis
TYNFTFKFEKAGQGSVMV

SEQ ID NO: 1530888 - protein, 17 aa, Mycobacterium tuberculosis
TYNLPANHRYLGPVLWS

SEQ ID NO: 1530889 - protein, 20 aa, Mycobacterium tuberculosis
TYNRKLIYLHLLSLDSRDGP

SEQ ID NO: 1530890 - protein, 21 aa, Mycobacterium tuberculosis
TYPLLLHEAYVRLYPAQVIKQ

SEQ ID NO: 1530891 - protein, 18 aa, Mycobacterium tuberculosis
TYPVWMMNAIGDISFHHA

SEQ ID NO: 1530892 - protein, 22 aa, Mycobacterium tuberculosis
TYTRWGAFLDDATGFDAGFFGI

SEQ ID NO: 1530893 - protein, 17 aa, Mycobacterium tuberculosis
TYVALTRAQSQVVAWWA

SEQ ID NO: 1530894 - protein, 27 aa, Mycobacterium tuberculosis
VAAAAIGLVDLLLASGGDLVTVLIGAG

SEQ ID NO: 1530895 - protein, 18 aa, Mycobacterium tuberculosis
VAAAMIDRLVHHAEVVAL

SEQ ID NO: 1530896 - protein, 17 aa, Mycobacterium tuberculosis
VAADGLHSAVRRAVGIK

SEQ ID NO: 1530897 - protein, 24 aa, Mycobacterium tuberculosis
VAAESLIAIDRLPAAIITRLTQTN

SEQ ID NO: 1530898 - protein, 19 aa, Mycobacterium tuberculosis
VAAGCWPPTRPRQRSMRRR

SEQ ID NO: 1530899 - protein, 20 aa, Mycobacterium tuberculosis
VAAGPAGCPAQQALPAGPAD

SEQ ID NO: 1530900 - protein, 21 aa, Mycobacterium tuberculosis
VAAHTPYLAWLVQASANSAAW

SEQ ID NO: 1530901 - protein, 24 aa, Mycobacterium tuberculosis
VAAKRRHLYYVRPLDGHPVARVDR

SEQ ID NO: 1530902 - protein, 34 aa, Mycobacterium tuberculosis
VAALAAHAPPERLLRCIEAVLACREALAVNVKPK

SEQ ID NO: 1530903 - protein, 22 aa, Mycobacterium tuberculosis
VAALRAIWLAWQDGTQLCFEGE

SEQ ID NO: 1530904 - protein, 35 aa, Mycobacterium tuberculosis
VAANREAFLALIRSNWLGLNAPWIAAVESLYEEYW

SEQ ID NO: 1530905 - protein, 20 aa, Mycobacterium tuberculosis
VAARGRLMQALPAGGAMVAV

SEQ ID NO: 1530906 - protein, 24 aa, Mycobacterium tuberculosis
VACYPARFQLVLAANPCPCAPADP

SEQ ID NO: 1530907 - protein, 18 aa, Mycobacterium tuberculosis
VADGDAALALLRAELRPG

SEQ ID NO: 1530908 - protein, 17 aa, Mycobacterium tuberculosis
VADLFAAFGMLPVGYYD

SEQ ID NO: 1530909 - protein, 17 aa, Mycobacterium tuberculosis
VADLLEPIPGQAGIIVP

SEQ ID NO: 1530910 - protein, 18 aa, Mycobacterium tuberculosis
VADLLRLLGPLTEDEIAA

SEQ ID NO: 1530911 - protein, 25 aa, Mycobacterium tuberculosis
VADLQSWLVLITGYDAVSLQPNAGS

SEQ ID NO: 1530912 - protein, 23 aa, Mycobacterium tuberculosis
VADLSFISLATVLPALVGCASRD

SEQ ID NO: 1530913 - protein, 17 aa, Mycobacterium tuberculosis
VADLTYVSTWQGSPTWA

SEQ ID NO: 1530914 - protein, 21 aa, Mycobacterium tuberculosis
VADRVWAWTLPVGGYGFSNAG

SEQ ID NO: 1530915 - protein, 24 aa, Mycobacterium tuberculosis
VADVSRALRLTGRRVMLVPTMGAL

SEQ ID NO: 1530916 - protein, 25 aa, Mycobacterium tuberculosis
VADWIKVVCFPDRWLDLRYVGPASA

SEQ ID NO: 1530917 - protein, 18 aa, Mycobacterium tuberculosis
VAEAIRQLAIRAFAAIDC

SEQ ID NO: 1530918 - protein, 28 aa, Mycobacterium tuberculosis
VAEIPADRRALPAALTILRDITAGSTNA

SEQ ID NO: 1530919 - protein, 23 aa, Mycobacterium tuberculosis
VAEKALLRRLVEAGTRVVQYGYA

SEQ ID NO: 1530920 - protein, 24 aa, Mycobacterium tuberculosis
VAEMNWRILKFKPAGSPSSVPDDL

SEQ ID NO: 1530921 - protein, 21 aa, Mycobacterium tuberculosis
VAEPYLPLRAVRHLEKGRVVI

SEQ ID NO: 1530922 - protein, 27 aa, Mycobacterium tuberculosis
VAEQLAMFSLSQWQEAIYARIVDKVGT

SEQ ID NO: 1530923 - protein, 23 aa, Mycobacterium tuberculosis
VAERHRGVRYRAFDLVEAGPRPH

SEQ ID NO: 1530924 - protein, 24 aa, Mycobacterium tuberculosis
VAETARMHLLRLASEFGLTPAAEQ

SEQ ID NO: 1530925 - protein, 19 aa, Mycobacterium tuberculosis
VAGDWRTYFRLRPNAFAAG

SEQ ID NO: 1530926 - protein, 26 aa, Mycobacterium tuberculosis
VAGGHSLLPMMKLRIANPEYLVDIND

SEQ ID NO: 1530927 - protein, 35 aa, Mycobacterium tuberculosis
VAGHKFGGPPGVGALLLRRDVTCVPLMHGGGQERD

SEQ ID NO: 1530928 - protein, 17 aa, Mycobacterium tuberculosis
VAGLFGDGGNGGNAGVG

SEQ ID NO: 1530929 - protein, 19 aa, Mycobacterium tuberculosis
VAGLGLELSRLIKGSAELA

SEQ ID NO: 1530930 - protein, 17 aa, Mycobacterium tuberculosis
VAGLITLPNDAFGGSPR

SEQ ID NO: 1530931 - protein, 17 aa, Mycobacterium tuberculosis
VAGNPGDPGGFGAAGAD

SEQ ID NO: 1530932 - protein, 17 aa, Mycobacterium tuberculosis
VAGSNWMLIGDAAACVN

SEQ ID NO: 1530933 - protein, 18 aa, Mycobacterium tuberculosis
VAGVLFLENIIVPGLTVS

SEQ ID NO: 1530934 - protein, 17 aa, Mycobacterium tuberculosis
VAGWHGRPWAHHVPVMR

SEQ ID NO: 1530935 - protein, 18 aa, Mycobacterium tuberculosis
VAGWHGRPWAHHVPVMRE

SEQ ID NO: 1530936 - protein, 17 aa, Mycobacterium tuberculosis
VAGWIKRGPTGFIGTNK

SEQ ID NO: 1530937 - protein, 19 aa, Mycobacterium tuberculosis
VAHLARLARLALTETELDS

SEQ ID NO: 1530938 - protein, 19 aa, Mycobacterium tuberculosis
VAILSRQRPELAWFPSLAH

SEQ ID NO: 1530939 - protein, 19 aa, Mycobacterium tuberculosis
VAIPRRRQRRIPAVKPQPD

SEQ ID NO: 1530940 - protein, 22 aa, Mycobacterium tuberculosis
VAITEFVVSPLFGSPPAAELVR

SEQ ID NO: 1530941 - protein, 17 aa, Mycobacterium tuberculosis
VAKIYCGLGLLKRENIR

SEQ ID NO: 1530942 - protein, 24 aa, Mycobacterium tuberculosis
VAKPDLLQLITTDSAPIITRASAR

SEQ ID NO: 1530943 - protein, 17 aa, Mycobacterium tuberculosis
VALAAAIPRRRTDRRAY

SEQ ID NO: 1530944 - protein, 25 aa, Mycobacterium tuberculosis
VALANAGAWRIGCAGSAQVGAWRGC

SEQ ID NO: 1530945 - protein, 33 aa, Mycobacterium tuberculosis
VALARCGPAVRWPWWPRPAILEHMFDLVSLAGV

SEQ ID NO: 1530946 - protein, 25 aa, Mycobacterium tuberculosis
VALATLLQHWGISPDFLIGHSVGEI

SEQ ID NO: 1530947 - protein, 17 aa, Mycobacterium tuberculosis
VALGEHLACGPQAIRAR

SEQ ID NO: 1530948 - protein, 22 aa, Mycobacterium tuberculosis
VALGFGFRCGFLGLLHMEITRE

SEQ ID NO: 1530949 - protein, 23 aa, Mycobacterium tuberculosis
VALGFGFRCGFLGLLHMEITRER

SEQ ID NO: 1530950 - protein, 23 aa, Mycobacterium tuberculosis
VALIVGVPMDFRLGFGGVFGSTT

SEQ ID NO: 1530951 - protein, 18 aa, Mycobacterium tuberculosis
VALLFGNDPYVYPDNLPV

SEQ ID NO: 1530952 - protein, 23 aa, Mycobacterium tuberculosis
VALQAIGRLLFAAGAVEVLTGIP

SEQ ID NO: 1530953 - protein, 17 aa, Mycobacterium tuberculosis
VALQRRISEDNPGVGRH

SEQ ID NO: 1530954 - protein, 19 aa, Mycobacterium tuberculosis
VALRAFRRGAAALAAMIAS

SEQ ID NO: 1530955 - protein, 19 aa, Mycobacterium tuberculosis
VALTIPADWSTQPVVSGPG

SEQ ID NO: 1530956 - protein, 17 aa, Mycobacterium tuberculosis
VALVPRGASPRPAAAPT

SEQ ID NO: 1530957 - protein, 25 aa, Mycobacterium tuberculosis
VAMESRARRFPKGLAAFIGLRDQRC

SEQ ID NO: 1530958 - protein, 18 aa, Mycobacterium tuberculosis
VAMFNQFCYLQLSGKRSC

SEQ ID NO: 1530959 - protein, 33 aa, Mycobacterium tuberculosis; identical to SEQ ID NO: 225704

SEQ ID NO: 1530960 - protein, 18 aa, Mycobacterium tuberculosis
VAMVDPVVVAANRSAFVQ

SEQ ID NO: 1530961 - protein, 27 aa, Mycobacterium tuberculosis
VAMVLRRLLRLCARYSAHPTVIFASAT

SEQ ID NO: 1530962 - protein, 20 aa, Mycobacterium tuberculosis
VANGGQWWQRRAHWRYRLLC

SEQ ID NO: 1530963 - protein, 19 aa, Mycobacterium tuberculosis
VANIRRRPRRRAEDVDKVG

SEQ ID NO: 1530964 - protein, 26 aa, Mycobacterium tuberculosis
VANTPQSYWLAQAFPPATVGGTVARY

SEQ ID NO: 1530965 - protein, 36 aa, Mycobacterium tuberculosis
VANYTAFLQLQRALARSWLISVVRIGPRPARRDGHL

SEQ ID NO: 1530966 - protein, 25 aa, Mycobacterium tuberculosis
VAPAIISLTLLPKLSPRAAARYYLT

SEQ ID NO: 1530967 - protein, 19 aa, Mycobacterium tuberculosis
VAPGLLSWRDIARVMSENP

SEQ ID NO: 1530968 - protein, 27 aa, Mycobacterium tuberculosis
VAPHHRWPRHILDVKTAIAWARANVDK

SEQ ID NO: 1530969 - protein, 21 aa, Mycobacterium tuberculosis
VAPLRPMLPLWPPSRVPSPPV

SEQ ID NO: 1530970 - protein, 17 aa, Mycobacterium tuberculosis
VAPVRTAGMTPYVVRYI

SEQ ID NO: 1530971 - protein, 21 aa, Mycobacterium tuberculosis
VAQARHQRRRPKRQRAGVVDP

SEQ ID NO: 1530972 - protein, 18 aa, Mycobacterium tuberculosis
VAQAWHWVDPARAIPEVA

SEQ ID NO: 1530973 - protein, 29 aa, Mycobacterium tuberculosis
VAQICASFDILWLVIRALSDLAGADSGVD

SEQ ID NO: 1530974 - protein, 21 aa, Mycobacterium tuberculosis
VAQLAPWQQVLRNLGIDIGKN

SEQ ID NO: 1530975 - protein, 23 aa, Mycobacterium tuberculosis
VAQPLIVAATLLAHQELARRCVL

SEQ ID NO: 1530976 - protein, 18 aa, Mycobacterium tuberculosis
VAQRRLPLLIASGADVHV

SEQ ID NO: 1530977 - protein, 19 aa, Mycobacterium tuberculosis
VAQRRLPLLIASGADVHVI

SEQ ID NO: 1530978 - protein, 27 aa, Mycobacterium tuberculosis
VAQSYLRNFLAAPPPQRAAMAAQLQAV

SEQ ID NO: 1530979 - protein, 23 aa, Mycobacterium tuberculosis
VAQVPVLLQRLPQEDVLPAADEQ

SEQ ID NO: 1530980 - protein, 25 aa, Mycobacterium tuberculosis
VAQVRGLLDVKRWVTLIGVGGVGKT

SEQ ID NO: 1530981 - protein, 17 aa, Mycobacterium tuberculosis
VARAFLRQALGVEVLSH

SEQ ID NO: 1530982 - protein, 17 aa, Mycobacterium tuberculosis
VARFLAHWVHQAGPKIL

SEQ ID NO: 1530983 - protein, 18 aa, Mycobacterium tuberculosis
VARGRLMQALPAGGAMVA

SEQ ID NO: 1530984 - protein, 25 aa, Mycobacterium tuberculosis
VARRGGIVILPQDLPIPAVKQTVAF

SEQ ID NO: 1530985 - protein, 28 aa, Mycobacterium tuberculosis
VARVIAYRWLRVGRLPVPARRVGRVILV

SEQ ID NO: 1530986 - protein, 26 aa, Mycobacterium tuberculosis
VARVLTKPRFRGWIHVYSAGTAVFGR

SEQ ID NO: 1530987 - protein, 19 aa, Mycobacterium tuberculosis
VARVMRPAVFVPDSKPLDA

SEQ ID NO: 1530988 - protein, 19 aa, Mycobacterium tuberculosis
VARWRPKPVFLENTGQILA

SEQ ID NO: 1530989 - protein, 29 aa, Mycobacterium tuberculosis
VASRIRSAGAIFVGPWSPVSLGDYCAGSN

SEQ ID NO: 1530990 - protein, 18 aa, Mycobacterium tuberculosis
VATAGWSVTVGPAVMAVT

SEQ ID NO: 1530991 - protein, 18 aa, Mycobacterium tuberculosis
VATELFAELAGCSSSIEM

SEQ ID NO: 1530992 - protein, 17 aa, Mycobacterium tuberculosis
VATIVRRHWPTPSLARV

SEQ ID NO: 1530993 - protein, 17 aa, Mycobacterium tuberculosis
VATMRRLQDLAVAADPG

SEQ ID NO: 1530994 - protein, 28 aa, Mycobacterium tuberculosis
VATPARDVDWWLTFSSAAALLGTPGQGA

SEQ ID NO: 1530995 - protein, 18 aa, Mycobacterium tuberculosis
VATRLCWPDQAKADELQH

SEQ ID NO: 1530996 - protein, 21 aa, Mycobacterium tuberculosis
VATSWPRRLHSKPTAAQGSMS

SEQ ID NO: 1530997 - protein, 20 aa, Mycobacterium tuberculosis
VAVDSLWFDALRSVAVDHRD

SEQ ID NO: 1530998 - protein, 21 aa, Mycobacterium tuberculosis
VAVFDSFVERIVSGGALVVCT

SEQ ID NO: 1530999 - protein, 17 aa, Mycobacterium tuberculosis
VAVIPPFTDLRSVQTLV

SEQ ID NO: 1531000 - protein, 18 aa, Mycobacterium tuberculosis
VAVPCMTIPWQIAQKLHA

SEQ ID NO: 1531001 - protein, 24 aa, Mycobacterium tuberculosis
VAVPGLRTLCWCPATIGGPPGQSR

SEQ ID NO: 1531002 - protein, 19 aa, Mycobacterium tuberculosis
VAVRRISMSLVNVAPQLVS

SEQ ID NO: 1531003 - protein, 32 aa, Mycobacterium tuberculosis
VAVYSTFLHRAFDQLLFDIGLHRLPVTLVLDR

SEQ ID NO: 1531004 - protein, 17 aa, Mycobacterium tuberculosis
VAWLAQRGILVAPGDFY

SEQ ID NO: 1531005 - protein, 26 aa, Mycobacterium tuberculosis
VAWRCRAWLAALPPVLPATPSAAPQA

SEQ ID NO: 1531006 - protein, 26 aa, Mycobacterium tuberculosis
VAWRCRAWLAALPPVLPATPSAAPQH

SEQ ID NO: 1531007 - protein, 20 aa, Mycobacterium tuberculosis
VAWVPIRELPSRLALRRRTS

SEQ ID NO: 1531008 - protein, 19 aa, Mycobacterium tuberculosis
VAWWAPTFDEVNGGLSRLL

SEQ ID NO: 1531009 - protein, 18 aa, Mycobacterium tuberculosis
VAYAINPWMDVTAPVDVQ

SEQ ID NO: 1531010 - protein, 28 aa, Mycobacterium tuberculosis
VCAEWTRRGWLAVRYNLPYRRRRPTGPP

SEQ ID NO: 1531011 - protein, 21 aa, Mycobacterium tuberculosis
VCALLSDWLPATTGDIIYADG

SEQ ID NO: 1531012 - protein, 23 aa, Mycobacterium tuberculosis
VCALPEMPTLPELPPIISRMRCC

SEQ ID NO: 1531013 - protein, 17 aa, Mycobacterium tuberculosis
VCANWRCQHKLLVTLED

SEQ ID NO: 1531014 - protein, 19 aa, Mycobacterium tuberculosis
VCARALSLPSLPCEVAVNE

SEQ ID NO: 1531015 - protein, 20 aa, Mycobacterium tuberculosis
VCELMRIAWRTVGAIVARVW

SEQ ID NO: 1531016 - protein, 27 aa, Mycobacterium tuberculosis
VCGELGLPYLVLARPPWDPGTAIIAVS

SEQ ID NO: 1531017 - protein, 18 aa, Mycobacterium tuberculosis
VCGSPKGLPRWGFSFSDG

SEQ ID NO: 1531018 - protein, 18 aa, Mycobacterium tuberculosis
VCGSPLSAYLVFYGSDQL

SEQ ID NO: 1531019 - protein, 18 aa, Mycobacterium tuberculosis
VCVLLDAPQLVDAPLRAI

SEQ ID NO: 1531020 - protein, 28 aa, Mycobacterium tuberculosis
VCWPTPRPPMRIWPRRFDAPPGTCRASR

SEQ ID NO: 1531021 - protein, 21 aa, Mycobacterium tuberculosis
VDAALGWQRDGAEWIHLVDLD

SEQ ID NO: 1531022 - protein, 24 aa, Mycobacterium tuberculosis
VDAALRPIIDRAYQPGPAPAVNPR

SEQ ID NO: 1531023 - protein, 24 aa, Mycobacterium tuberculosis
VDAALVHHYFGTKQQLFAAAIHIP

SEQ ID NO: 1531024 - protein, 25 aa, Mycobacterium tuberculosis
VDAKGNTIAWLYSQRRFEVPSDKIA

SEQ ID NO: 1531025 - protein, 18 aa, Mycobacterium tuberculosis
VDALLPAAHGPNPVLPPG

SEQ ID NO: 1531026 - protein, 26 aa, Mycobacterium tuberculosis
VDALRKTGLLGLVLPREIGGMGSGPV

SEQ ID NO: 1531027 - protein, 17 aa, Mycobacterium tuberculosis
VDALRVGVLPTPAVAYL

SEQ ID NO: 1531028 - protein, 19 aa, Mycobacterium tuberculosis
VDANALGAALWRGVELVVA

SEQ ID NO: 1531029 - protein, 27 aa, Mycobacterium tuberculosis
VDARLVTMVPAGWSLVEAAAVPVAFLT

SEQ ID NO: 1531030 - protein, 23 aa, Mycobacterium tuberculosis
VDAVSFTLLQDQLQSVLDTLSER

SEQ ID NO: 1531031 - protein, 22 aa, Mycobacterium tuberculosis
VDDALWRRFKAAQDSFFTARNG

SEQ ID NO: 1531032 - protein, 24 aa, Mycobacterium tuberculosis
VDDEFFVIVRPAPSGTRLLLSDAT

SEQ ID NO: 1531033 - protein, 25 aa, Mycobacterium tuberculosis
VDDIRINWVWNPPWGPDKITEDGRE

SEQ ID NO: 1531034 - protein, 34 aa, Mycobacterium tuberculosis
VDDMHDWCISRQLWWGHRIPIWYGPDGEQVCVGP

SEQ ID NO: 1531035 - protein, 18 aa, Mycobacterium tuberculosis
VDEIARCATYPVLAVQAW

SEQ ID NO: 1531036 - protein, 17 aa, Mycobacterium tuberculosis
VDELGGLRTAVRRAKVL

SEQ ID NO: 1531037 - protein, 40 aa, Mycobacterium tuberculosis
VDEPALRELLPLRRADQAEYLRWAVGAFRLATSGVSDATQ

SEQ ID NO: 1531038 - protein, 18 aa, Mycobacterium tuberculosis
VDFLFHKFHKRGFGSFFK

SEQ ID NO: 1531039 - protein, 21 aa, Mycobacterium tuberculosis
VDGAVLPWSLHITTNDAAVMG

SEQ ID NO: 1531040 - protein, 24 aa, Mycobacterium tuberculosis
VDGGIPGFTLFPDGLTFAKIPVHV

SEQ ID NO: 1531041 - protein, 21 aa, Mycobacterium tuberculosis
VDGQMFLEMRLVEGTDLDSVL

SEQ ID NO: 1531042 - protein, 27 aa, Mycobacterium tuberculosis
VDHGLPLTLWLARFLKFIATEIFPGGQ

SEQ ID NO: 1531043 - protein, 20 aa, Mycobacterium tuberculosis
VDHGVWCSPARRCRRSVQSI

SEQ ID NO: 1531044 - protein, 18 aa, Mycobacterium tuberculosis
VDIAVMVHGRSLALFGCC

SEQ ID NO: 1531045 - protein, 26 aa, Mycobacterium tuberculosis
VDKKRPFYFGVLTWYMDRVLELVHDD

SEQ ID NO: 1531046 - protein, 27 aa, Mycobacterium tuberculosis
VDKKRPFYFGVLTWYMDRVLELVHDDL

SEQ ID NO: 1531047 - protein, 21 aa, Mycobacterium tuberculosis
VDLNYHIRPWRLRAPGGRREL

SEQ ID NO: 1531048 - protein, 20 aa, Mycobacterium tuberculosis
VDMEPFFDAYRAIKPYLITS

SEQ ID NO: 1531049 - protein, 25 aa, Mycobacterium tuberculosis
VDNPVSALLFFLASSRIFNRRKGVR

SEQ ID NO: 1531050 - protein, 24 aa, Mycobacterium tuberculosis
VDPAAQLHVLRRPLRGTGQSPRHP

SEQ ID NO: 1531051 - protein, 21 aa, Mycobacterium tuberculosis
VDPAHPFPFVSGLSLNLAVTV

SEQ ID NO: 1531052 - protein, 19 aa, Mycobacterium tuberculosis
VDPIHVELPLSVTIGPFVS

SEQ ID NO: 1531053 - protein, 23 aa, Mycobacterium tuberculosis
VDPLILRQAYPVRQAPYGLAGSR

SEQ ID NO: 1531054 - protein, 22 aa, Mycobacterium tuberculosis
VDPQAFRRVLDVNLLGNFHTVR

SEQ ID NO: 1531055 - protein, 17 aa, Mycobacterium tuberculosis
VDPWFIAQINELVNLRN

SEQ ID NO: 1531056 - protein, 21 aa, Mycobacterium tuberculosis
VDPWISLYRNAFHGRRVGGLQ

SEQ ID NO: 1531057 - protein, 31 aa, Mycobacterium tuberculosis
VDQLEELYRRMWVLRLLDMALEQLRIEGLIN

SEQ ID NO: 1531058 - protein, 20 aa, Mycobacterium tuberculosis
VDQLPLIWQRLVDGGMESGH

SEQ ID NO: 1531059 - protein, 26 aa, Mycobacterium tuberculosis
VDQPAFFEKQLALSAPPWLSRATVAQ

SEQ ID NO: 1531060 - protein, 24 aa, Mycobacterium tuberculosis
VDQRFVFHKPVLAGDKLWARMDIH

SEQ ID NO: 1531061 - protein, 23 aa, Mycobacterium tuberculosis
VDSPLPYLIAPPGTDERQAFCEI

SEQ ID NO: 1531062 - protein, 22 aa, Mycobacterium tuberculosis
VDTLRRVELLHQLRLGDYDVLI

SEQ ID NO: 1531063 - protein, 18 aa, Mycobacterium tuberculosis
VDTVVILGALLADTPHTR

SEQ ID NO: 1531064 - protein, 24 aa, Mycobacterium tuberculosis
VDVDAKLYGLPFGDGAYGAQDISL

SEQ ID NO: 1531065 - protein, 23 aa, Mycobacterium tuberculosis
VDVDAKLYGLPFGDGAYGAQDMS

SEQ ID NO: 1531066 - protein, 30 aa, Mycobacterium tuberculosis
VDVTLRPAQYLPWHPCRCAQVFVGESSVGH

SEQ ID NO: 1531067 - protein, 27 aa, Mycobacterium tuberculosis
VDVTLRPAQYLPWHPGRCAQVFVGESS

SEQ ID NO: 1531068 - protein, 17 aa, Mycobacterium tuberculosis
VDWHMPPRARKPQRRVR

SEQ ID NO: 1531069 - protein, 19 aa, Mycobacterium tuberculosis
VDWLPAALAMHRRRRRMRF

SEQ ID NO: 1531070 - protein, 23 aa, Mycobacterium tuberculosis
VDWLPAALAMHRRRRRMRFMIKA

SEQ ID NO: 1531071 - protein, 25 aa, Mycobacterium tuberculosis
VDYMTVHAGVLLRYVPLTAKRVTGI

SEQ ID NO: 1531072 - protein, 24 aa, Mycobacterium tuberculosis
VDYYNFFLSGGFLAPPRSSAGPGL

SEQ ID NO: 1531073 - protein, 30 aa, Mycobacterium tuberculosis
VEAAGWFGVAMILDFSWLPPEINSARIYAG

SEQ ID NO: 1531074 - protein, 19 aa, Mycobacterium tuberculosis
VEAAKVLRRRHFSAASPVV

SEQ ID NO: 1531075 - protein, 23 aa, Mycobacterium tuberculosis
VEAHLRRHAPWGAQVTVTRGEVG

SEQ ID NO: 1531076 - protein, 18 aa, Mycobacterium tuberculosis
VEALFRPMHDRLASAVVA

SEQ ID NO: 1531077 - protein, 23 aa, Mycobacterium tuberculosis
VEATFPIAAHYFAVFPLAKHMES

SEQ ID NO: 1531078 - protein, 34 aa, Mycobacterium tuberculosis
VEDWKCWARWRLIRARAPWLTRALVAEDFEFYGR

SEQ ID NO: 1531079 - protein, 24 aa, Mycobacterium tuberculosis
VEFKDLTPLFADRRGLAAVTEALA

SEQ ID NO: 1531080 - protein, 17 aa, Mycobacterium tuberculosis
VEFLEAFRFDEQDLRYL

SEQ ID NO: 1531081 - protein, 29 aa, Mycobacterium tuberculosis
VEFRYHGERPLWAWLVLEPGDISVCLHDP

SEQ ID NO: 1531082 - protein, 25 aa, Mycobacterium tuberculosis
VEGAYEQMWAADVAAMVGYHSGASA

SEQ ID NO: 1531083 - protein, 18 aa, Mycobacterium tuberculosis
VEGGLLISFDRMNKVLEV

SEQ ID NO: 1531084 - protein, 19 aa, Mycobacterium tuberculosis
VEHLFAVASGLDSAVIGEQ

SEQ ID NO: 1531085 - protein, 19 aa, Mycobacterium tuberculosis
VEHRDRFCRFGSEYVHAAL

SEQ ID NO: 1531086 - protein, 20 aa, Mycobacterium tuberculosis
VEHRDRFCRFGSEYVHAALA

SEQ ID NO: 1531087 - protein, 34 aa, Mycobacterium tuberculosis; identical to SEQ ID NO: 164012

SEQ ID NO: 1531088 - protein, 23 aa, Mycobacterium tuberculosis
VEIGKRDIYGDTKLGLFPSGATC

SEQ ID NO: 1531089 - protein, 23 aa, Mycobacterium tuberculosis
VEKAVSVVLKRRALRHCEKSCRG

SEQ ID NO: 1531090 - protein, 19 aa, Mycobacterium tuberculosis
VEKWAKVRGDKLAYRFLDF

SEQ ID NO: 1531091 - protein, 19 aa, Mycobacterium tuberculosis
VELCALWAVHLHFDPSPEP

SEQ ID NO: 1531092 - protein, 19 aa, Mycobacterium tuberculosis
VELDLFSFPDEIGSGLAVF

SEQ ID NO: 1531093 - protein, 24 aa, Mycobacterium tuberculosis
VELGVPILDEDGFRRLLADGPASR

SEQ ID NO: 1531094 - protein, 17 aa, Mycobacterium tuberculosis
VELLGLRQPKPGRYKRG

SEQ ID NO: 1531095 - protein, 21 aa, Mycobacterium tuberculosis
VELMPVHQFLHDSRLLDLGLR

SEQ ID NO: 1531096 - protein, 17 aa, Mycobacterium tuberculosis
VELPRLEDIEPGAHTDV

SEQ ID NO: 1531097 - protein, 28 aa, Mycobacterium tuberculosis
VELPTYAFARQRFWLDGLGAVGGDLGGV

SEQ ID NO: 1531098 - protein, 22 aa, Mycobacterium tuberculosis
VELPTYAFQRRRFWLSGDGVAA

SEQ ID NO: 1531099 - protein, 25 aa, Mycobacterium tuberculosis
VELSPSLRRPQPLFSLVNFFDAQVG

SEQ ID NO: 1531100 - protein, 23 aa, Mycobacterium tuberculosis
VELSTIRLLAKLPTIAAYAYKKS

SEQ ID NO: 1531101 - protein, 18 aa, Mycobacterium tuberculosis
VENPDKIRFVLRNIGDDI

SEQ ID NO: 1531102 - protein, 25 aa, Mycobacterium tuberculosis
VENPDKIRFVLRNIGDGRTCRASGS

SEQ ID NO: 1531103 - protein, 25 aa, Mycobacterium tuberculosis
VEPAPTIRALYHKILRQLPMDDLVG

SEQ ID NO: 1531104 - protein, 25 aa, Mycobacterium tuberculosis
VEPPKGPAWRRIRGVAVAHRGVGGS

SEQ ID NO: 1531105 - protein, 21 aa, Mycobacterium tuberculosis
VEPPRGVLLYGPPGCGKTFVV

SEQ ID NO: 1531106 - protein, 22 aa, Mycobacterium tuberculosis
VEPVWTTRLTGPGGATQLAITG

SEQ ID NO: 1531107 - protein, 17 aa, Mycobacterium tuberculosis
VERATAERLPLLASPSS

SEQ ID NO: 1531108 - protein, 25 aa, Mycobacterium tuberculosis
VERGKAARRFLPGATILKASVGPMD

SEQ ID NO: 1531109 - protein, 26 aa, Mycobacterium tuberculosis
VERGKAARRFLPGATILKASVGPMDN

SEQ ID NO: 1531110 - protein, 37 aa, Mycobacterium tuberculosis
VERHLDVDALLNLARPWFARRPLPFSRSGRAMEARPH

SEQ ID NO: 1531111 - protein, 17 aa, Mycobacterium tuberculosis
VERLIAAHLMDPAPQPS

SEQ ID NO: 1531112 - protein, 17 aa, Mycobacterium tuberculosis
VERLPQPALPADAASLA

SEQ ID NO: 1531113 - protein, 22 aa, Mycobacterium tuberculosis
VESFGVRLRKGDIVLPGSCTFA

SEQ ID NO: 1531114 - protein, 23 aa, Mycobacterium tuberculosis
VESFGVRLRKGDIVLPGSCTFAV

SEQ ID NO: 1531115 - protein, 20 aa, Mycobacterium tuberculosis
VESGRLDRHPIKRARTTFTY

SEQ ID NO: 1531116 - protein, 35 aa, Mycobacterium tuberculosis
VEVGKLADLVLWEPAFFGVRPHVVLKGGAIAWAAM

SEQ ID NO: 1531117 - protein, 20 aa, Mycobacterium tuberculosis
VEVLRLSALRGLFSAVIEDA

SEQ ID NO: 1531118 - protein, 21 aa, Mycobacterium tuberculosis
VEVLRLSALRGLFSAVIEDAV

SEQ ID NO: 1531119 - protein, 23 aa, Mycobacterium tuberculosis
VEVRVRRWIEAMPQYGPGHADVV

SEQ ID NO: 1531120 - protein, 19 aa, Mycobacterium tuberculosis
VEYPIPAGMGPFGVDRRVQ

SEQ ID NO: 1531121 - protein, 17 aa, Mycobacterium tuberculosis
VFAAFLGTVALLAAEDQ

SEQ ID NO: 1531122 - protein, 33 aa, Mycobacterium tuberculosis
VFARRVPLAAAVWTQRGWRFPDRLDRVYVNSRA

SEQ ID NO: 1531123 - protein, 19 aa, Mycobacterium tuberculosis
VFARVSPEQKLRLVQALQA

SEQ ID NO: 1531124 - protein, 18 aa, Mycobacterium tuberculosis
VFATAHYALVDLAAARSG

SEQ ID NO: 1531125 - protein, 20 aa, Mycobacterium tuberculosis
VFATAHYALVDLAAARSGQR

SEQ ID NO: 1531126 - protein, 28 aa, Mycobacterium tuberculosis
VFDDVHVAPRVIFLPGPAAALTSDDHGT

SEQ ID NO: 1531127 - protein, 22 aa, Mycobacterium tuberculosis
VFDLTPLTLPTPAQLALRRSVI

SEQ ID NO: 1531128 - protein, 17 aa, Mycobacterium tuberculosis
VFDMLKRYHAGVEQLLV

SEQ ID NO: 1531129 - protein, 30 aa, Mycobacterium tuberculosis
VFDRLVYRKAACGTGWQLPRRRLRRRAAGC

SEQ ID NO: 1531130 - protein, 21 aa, Mycobacterium tuberculosis
VFDTAFFHDLPPAAATYAIDR

SEQ ID NO: 1531131 - protein, 19 aa, Mycobacterium tuberculosis
VFGQPIMPAAGFAEIALAA

SEQ ID NO: 1531132 - protein, 17 aa, Mycobacterium tuberculosis
VFGSPTWRTVTGGSANY

SEQ ID NO: 1531133 - protein, 18 aa, Mycobacterium tuberculosis
VFGSWNLHRATLGQPLDW

SEQ ID NO: 1531134 - protein, 17 aa, Mycobacterium tuberculosis
VFNLLGPLTNPARPRAG

SEQ ID NO: 1531135 - protein, 18 aa, Mycobacterium tuberculosis
VFNLVQYLGQLGIEAEVW

SEQ ID NO: 1531136 - protein, 20 aa, Mycobacterium tuberculosis
VFRRLKLAGMGRRVLSQRGG

SEQ ID NO: 1531137 - protein, 19 aa, Mycobacterium tuberculosis
VFSVEFLVHAWDYAVAVGS

SEQ ID NO: 1531138 - protein, 18 aa, Mycobacterium tuberculosis
VFSWCEVTVRAFGLRGRS

SEQ ID NO: 1531139 - protein, 19 aa, Mycobacterium tuberculosis
VFTLLVVPTSELLALHAEV

SEQ ID NO: 1531140 - protein, 17 aa, Mycobacterium tuberculosis
VFVLAATSNPEGAAVQN

SEQ ID NO: 1531141 - protein, 17 aa, Mycobacterium tuberculosis
VFYASHHPDIFSSYPNI

SEQ ID NO: 1531142 - protein, 20 aa, Mycobacterium tuberculosis
VGAFLTALFASPAKALSLNA

SEQ ID NO: 1531143 - protein, 22 aa, Mycobacterium tuberculosis
VGALTNVLTHPGTFGLAGAAIS

SEQ ID NO: 1531144 - protein, 25 aa, Mycobacterium tuberculosis
VGAPPFPPTAPPPPFLPAAPPPPDP

SEQ ID NO: 1531145 - protein, 23 aa, Mycobacterium tuberculosis
VGASLWINPAFGRYSQTCRTFDR

SEQ ID NO: 1531146 - protein, 17 aa, Mycobacterium tuberculosis
VGAVLGDLSSRRGRVLG

SEQ ID NO: 1531147 - protein, 22 aa, Mycobacterium tuberculosis
VGCALIEELVLAAPLVMHPGVG

SEQ ID NO: 1531148 - protein, 27 aa, Mycobacterium tuberculosis
VGCGFITWSLARQPQLLDLALQYEPVA

SEQ ID NO: 1531149 - protein, 23 aa, Mycobacterium tuberculosis
VGDAQRLLEYRVHVGRPVQVDPQ

SEQ ID NO: 1531150 - protein, 25 aa, Mycobacterium tuberculosis
VGDITLGERLILSSGFVAVTVVVRR

SEQ ID NO: 1531151 - protein, 19 aa, Mycobacterium tuberculosis
VGEFAVHLALAAGSKCFYT

SEQ ID NO: 1531152 - protein, 25 aa, Mycobacterium tuberculosis
VGELFGSGQMQLPFVLQSAEVMKAA

SEQ ID NO: 1531153 - protein, 17 aa, Mycobacterium tuberculosis
VGELIPVYRSQRALLQR

SEQ ID NO: 1531154 - protein, 20 aa, Mycobacterium tuberculosis
VGETAEFLRWTAGQAPDASG

SEQ ID NO: 1531155 - protein, 20 aa, Mycobacterium tuberculosis
VGFGNVHRRGGRPFSCHTHF

SEQ ID NO: 1531156 - protein, 21 aa, Mycobacterium tuberculosis
VGFLMMAHTIAPEKLAAQARI

SEQ ID NO: 1531157 - protein, 25 aa, Mycobacterium tuberculosis
VGGATGLIGSGGFGGAGGAAAGVGT

SEQ ID NO: 1531158 - protein, 26 aa, Mycobacterium tuberculosis
VGGFGHLLILGFDYSDNPGPWKESLR

SEQ ID NO: 1531159 - protein, 26 aa, Mycobacterium tuberculosis
VGGHGRHRRRRRPTGTACTGGSGGTG

SEQ ID NO: 1531160 - protein, 24 aa, Mycobacterium tuberculosis
VGGIGGAGALFGPGGAGGTGGFGA

SEQ ID NO: 1531161 - protein, 20 aa, Mycobacterium tuberculosis
VGGLMLPVGVRRLRNYHSTR

SEQ ID NO: 1531162 - protein, 27 aa, Mycobacterium tuberculosis
VGGNGGAGGLLFGDGGNGGAGGAGGIG

SEQ ID NO: 1531163 - protein, 27 aa, Mycobacterium tuberculosis
VGGNGGRGGWLLGNGGAGGVGGVGGAG

SEQ ID NO: 1531164 - protein, 22 aa, Mycobacterium tuberculosis
VGGNGGWLYGNGGAGGLGGTGV

SEQ ID NO: 1531165 - protein, 31 aa, Mycobacterium tuberculosis
VGGRIRVLTSVYLFGFERPMRGRIGVGAIAV

SEQ ID NO: 1531166 - protein, 23 aa, Mycobacterium tuberculosis
VGGSGGLGSAFGPGGTGGMGGAG

SEQ ID NO: 1531167 - protein, 18 aa, Mycobacterium tuberculosis
VGGVFGNGGFGGAGGLGA

SEQ ID NO: 1531168 - protein, 20 aa, Mycobacterium tuberculosis
VGGVGGARWGTAGDGRCRAG

SEQ ID NO: 1531169 - protein, 17 aa, Mycobacterium tuberculosis
VGGWLYGDGGGGDGGNG

SEQ ID NO: 1531170 - protein, 21 aa, Mycobacterium tuberculosis
VGIMTPFRIVRLLEQTVRQQI

SEQ ID NO: 1531171 - protein, 27 aa, Mycobacterium tuberculosis
VGKGTLFRRFGSRAGLMMVLLDEDERA

SEQ ID NO: 1531172 - protein, 19 aa, Mycobacterium tuberculosis
VGKVVLTMPDAWAAGTVLI

SEQ ID NO: 1531173 - protein, 21 aa, Mycobacterium tuberculosis
VGKVVLTMPDAWAAGTVLITG

SEQ ID NO: 1531174 - protein, 25 aa, Mycobacterium tuberculosis
VGLDALALDIYRIGQTWPGGAGRTS

SEQ ID NO: 1531175 - protein, 17 aa, Mycobacterium tuberculosis
VGLGMPGVGLPVSAAKP

SEQ ID NO: 1531176 - protein, 25 aa, Mycobacterium tuberculosis
VGLHFICRDVWLRVASTSTAWTSRF

SEQ ID NO: 1531177 - protein, 17 aa, Mycobacterium tuberculosis
VGLLNLGSGNFGSLNLG

SEQ ID NO: 1531178 - protein, 17 aa, Mycobacterium tuberculosis
VGLLRAVAGRLWPRRRK

SEQ ID NO: 1531179 - protein, 17 aa, Mycobacterium tuberculosis
VGLRALGDAPPQRSRRL

SEQ ID NO: 1531180 - protein, 21 aa, Mycobacterium tuberculosis
VGLVRALRDRGLQSAAQSVVC

SEQ ID NO: 1531181 - protein, 22 aa, Mycobacterium tuberculosis
VGNFYEAFLQGFRSFFAESAAD

SEQ ID NO: 1531182 - protein, 17 aa, Mycobacterium tuberculosis
VGPCWPAVFAAIGSAVT

SEQ ID NO: 1531183 - protein, 18 aa, Mycobacterium tuberculosis
VGPCWPAVFRGHRIGGHR

SEQ ID NO: 1531184 - protein, 19 aa, Mycobacterium tuberculosis
VGPKDPRIWRAGRGASARP

SEQ ID NO: 1531185 - protein, 27 aa, Mycobacterium tuberculosis
VGPRDLEPFRCFYLSAPFVVPKKKEVA

SEQ ID NO: 1531186 - protein, 19 aa, Mycobacterium tuberculosis
VGPRLAMAALAVHDAPALR

SEQ ID NO: 1531187 - protein, 30 aa, Mycobacterium tuberculosis
VGPVAPVGLQRYLAPVSAVPAAAAAPRCFS

SEQ ID NO: 1531188 - protein, 19 aa, Mycobacterium tuberculosis
VGPVVLFPGTGFVELALRA

SEQ ID NO: 1531189 - protein, 20 aa, Mycobacterium tuberculosis
VGPVVLFPGTGFVELALRAG

SEQ ID NO: 1531190 - protein, 20 aa, Mycobacterium tuberculosis
VGQPGGDGGILWGNGGNGGD

SEQ ID NO: 1531191 - protein, 37 aa, Mycobacterium tuberculosis
VGQSRRERGPAMEYLIAAQDVLVAAAADLEGIGSALA

SEQ ID NO: 1531192 - protein, 18 aa, Mycobacterium tuberculosis
VGQWLFAAHAGQRSRGHV

SEQ ID NO: 1531193 - protein, 18 aa, Mycobacterium tuberculosis
VGRGRPAKRYRADRGRPG

SEQ ID NO: 1531194 - protein, 26 aa, Mycobacterium tuberculosis
VGRQQALPVGAPEQAVVHAAGDERAG

SEQ ID NO: 1531195 - protein, 24 aa, Mycobacterium tuberculosis
VGRRLACGRDRRRPGRTRIAVRLA

SEQ ID NO: 1531196 - protein, 22 aa, Mycobacterium tuberculosis
VGSGRLIAGLDDAVVGLSADES

SEQ ID NO: 1531197 - protein, 27 aa, Mycobacterium tuberculosis
VGSPRRTWPAFSPPSIFYAALGELQVG

SEQ ID NO: 1531198 - protein, 23 aa, Mycobacterium tuberculosis
VGSTHPPGTPLLKLVRELRADRG

SEQ ID NO: 1531199 - protein, 18 aa, Mycobacterium tuberculosis
VGSYLRYGAYPYAIAVRE

SEQ ID NO: 1531200 - protein, 33 aa, Mycobacterium tuberculosis
VGSYLSPLPLPLGFVDFACRVWRPGQGTVRTTI

SEQ ID NO: 1531201 - protein, 26 aa, Mycobacterium tuberculosis
VGTGAGVSGLWLLSGMRDDGVLTTID

SEQ ID NO: 1531202 - protein, 31 aa, Mycobacterium tuberculosis
VGTHLFNAMPPLDHRAPGPVLALLCDPRVTV

SEQ ID NO: 1531203 - protein, 22 aa, Mycobacterium tuberculosis
VGTRLMALRRLAHPDDAQLGPP

SEQ ID NO: 1531204 - protein, 26 aa, Mycobacterium tuberculosis
VGVDAINIPIIHIPATPGFGNSTGGL

SEQ ID NO: 1531205 - protein, 30 aa, Mycobacterium tuberculosis
VGVFTGRRAMWVGRIWVSAMPVAPMSGSAT

SEQ ID NO: 1531206 - protein, 41 aa, Mycobacterium tuberculosis
VGVGRQWRPQPQFGRPWLQVVAFHVGDLRRNAQARGQRPHR

SEQ ID NO: 1531207 - protein, 42 aa, Mycobacterium tuberculosis
VGVGRQWRPQPQFGRPWLQVVAFHVGDLRRNAQARGQRPHRV

SEQ ID NO: 1531208 - protein, 28 aa, Mycobacterium tuberculosis
VGVITAFNFPVAVWAWNTAVALVCGDTV

SEQ ID NO: 1531209 - protein, 29 aa, Mycobacterium tuberculosis
VGVLPVQVFRNRLLRRPLGLRINRGGDHQ

SEQ ID NO: 1531210 - protein, 25 aa, Mycobacterium tuberculosis
VGVNFRDVLVALGMYPGGGELGVDG

SEQ ID NO: 1531211 - protein, 19 aa, Mycobacterium tuberculosis
VGVRLRTGTGRPGVTNLAA

SEQ ID NO: 1531212 - protein, 27 aa, Mycobacterium tuberculosis
VGVRYHRAPRRLGVPARWLAVVINYRA

SEQ ID NO: 1531213 - protein, 25 aa, Mycobacterium tuberculosis
VGVTDAFLRAVERNGLHRLVNPRTG

SEQ ID NO: 1531214 - protein, 29 aa, Mycobacterium tuberculosis
VGYYKGAMQLTHPAFLILDSPDGKNHGTR

SEQ ID NO: 1531215 - protein, 18 aa, Mycobacterium tuberculosis
VHFGLPGLNGSGGDGGDG

SEQ ID NO: 1531216 - protein, 24 aa, Mycobacterium tuberculosis
VHGKHDGLPLFRECLAPGTSISHR

SEQ ID NO: 1531217 - protein, 18 aa, Mycobacterium tuberculosis
VHGPLALAVGRRLRDRYG

SEQ ID NO: 1531218 - protein, 22 aa, Mycobacterium tuberculosis
VHGRGPLSDLLVQALRCSGARI

SEQ ID NO: 1531219 - protein, 25 aa, Mycobacterium tuberculosis
VHHDLHLWLPHPSDELWRALAGFQG

SEQ ID NO: 1531220 - protein, 26 aa, Mycobacterium tuberculosis
VHIQGISPPLFRRPLEPAVQAAVASC

SEQ ID NO: 1531221 - protein, 17 aa, Mycobacterium tuberculosis
VHMGFSDAGAHLRNMAF

SEQ ID NO: 1531222 - protein, 20 aa, Mycobacterium tuberculosis
VHPPFRWQRRYAEGFSDQVA

SEQ ID NO: 1531223 - protein, 24 aa, Mycobacterium tuberculosis
VHPTTMRLLDELGLWERFAALPYS

SEQ ID NO: 1531224 - protein, 27 aa, Mycobacterium tuberculosis
VHRDLAWTYHYPLPVVAPIAGLVAFYN

SEQ ID NO: 1531225 - protein, 46 aa, Mycobacterium tuberculosis
VHRVPSRMFPKVTMLPLGVPTFRMLRALRGFDPDVVHLASPALLGY

SEQ ID NO: 1531226 - protein, 19 aa, Mycobacterium tuberculosis
VHSEAPPFFVLHGEKDPMV

SEQ ID NO: 1531227 - protein, 23 aa, Mycobacterium tuberculosis
VHSEAPPFFVLHGEKDPMVPSAQ

SEQ ID NO: 1531228 - protein, 18 aa, Mycobacterium tuberculosis
VHVLGGCSTALFPAGGST

SEQ ID NO: 1531229 - protein, 22 aa, Mycobacterium tuberculosis
VHVTELVAYLRRLCAVDVHCMG

SEQ ID NO: 1531230 - protein, 19 aa, Mycobacterium tuberculosis
VIAPRIEHPPVPGARVKEP

SEQ ID NO: 1531231 - protein, 32 aa, Mycobacterium tuberculosis
VIAVSDWMRAVPEQIRPWVPGTYLTLGTDGFG

SEQ ID NO: 1531232 - protein, 24 aa, Mycobacterium tuberculosis
VICTHRLLQTGVRWKDLGLVVVDQ

SEQ ID NO: 1531233 - protein, 17 aa, Mycobacterium tuberculosis
VIDAFLAWYVPGLDISD

SEQ ID NO: 1531234 - protein, 23 aa, Mycobacterium tuberculosis
VIDGGVQALRIWGAGATGSRLVT

SEQ ID NO: 1531235 - protein, 23 aa, Mycobacterium tuberculosis
VIDRTALILDIFAQHATSREGKA

SEQ ID NO: 1531236 - protein, 23 aa, Mycobacterium tuberculosis
VIELRPDVDWDKGKTLLWVLDHL

SEQ ID NO: 1531237 - protein, 20 aa, Mycobacterium tuberculosis
VIEPLPNLVFTRDSSIWIGP

SEQ ID NO: 1531238 - protein, 19 aa, Mycobacterium tuberculosis
VIFVKDKPAWLDRAWRRII

SEQ ID NO: 1531239 - protein, 21 aa, Mycobacterium tuberculosis
VIFVKDKPAWLDRAWRRIIEE

SEQ ID NO: 1531240 - protein, 18 aa, Mycobacterium tuberculosis
VIGGLLISFDRMNKVLEV

SEQ ID NO: 1531241 - protein, 20 aa, Mycobacterium tuberculosis
VIGGLPGNGGAGGNAGLIGA

SEQ ID NO: 1531242 - protein, 24 aa, Mycobacterium tuberculosis
VIGKARLIVWPPSRWGVVRSVNPQ

SEQ ID NO: 1531243 - protein, 22 aa, Mycobacterium tuberculosis
VIGKILPVEDMPFLADGTPVDI

SEQ ID NO: 1531244 - protein, 22 aa, Mycobacterium tuberculosis
VIGRGVTVGRPLGLLLTRRSEN

SEQ ID NO: 1531245 - protein, 22 aa, Mycobacterium tuberculosis
VIKMVLAMRHELLPATLHVDVP

SEQ ID NO: 1531246 - protein, 21 aa, Mycobacterium tuberculosis
VILQSPLDISRPLWTATLVEG

SEQ ID NO: 1531247 - protein, 40 aa, Mycobacterium tuberculosis
VILTSPEAFIRKPARWMQLLAKHQAPFSAAPNFAFEWSDT

SEQ ID NO: 1531248 - protein, 33 aa, Mycobacterium tuberculosis
VINDLFDQPLLALRIPWYVTVLDLGSAGAVYTE

SEQ ID NO: 1531249 - protein, 23 aa, Mycobacterium tuberculosis
VIPQWVKIRNVDRFNGSFWHGGV

SEQ ID NO: 1531250 - protein, 27 aa, Mycobacterium tuberculosis
VIQTEFNVALPWRKEVSLSKSSLHPAS

SEQ ID NO: 1531251 - protein, 18 aa, Mycobacterium tuberculosis
VIRPDVVVGIPAVDRRPK

SEQ ID NO: 1531252 - protein, 27 aa, Mycobacterium tuberculosis
VISDGELFIMGRIKDLLIVDGRNHYPD

SEQ ID NO: 1531253 - protein, 24 aa, Mycobacterium tuberculosis
VISEPAELVAVRSALQDAGIDYES

SEQ ID NO: 1531254 - protein, 18 aa, Mycobacterium tuberculosis
VISWAGDNGIYFTRFRPY

SEQ ID NO: 1531255 - protein, 23 aa, Mycobacterium tuberculosis
VITDTYSFPMKKKPNRKCLRITV

SEQ ID NO: 1531256 - protein, 18 aa, Mycobacterium tuberculosis
VITPWRSVLICDLDDATA

SEQ ID NO: 1531257 - protein, 22 aa, Mycobacterium tuberculosis
VIVCTHMQVVYPGVNLTSPSTC

SEQ ID NO: 1531258 - protein, 37 aa, Mycobacterium tuberculosis
VKAIYQRYMGWFDGNLGWLWPHPPEALAPRYVDALGG

SEQ ID NO: 1531259 - protein, 18 aa, Mycobacterium tuberculosis
VKAMMLAEPASWHALMAK

SEQ ID NO: 1531260 - protein, 19 aa, Mycobacterium tuberculosis
VKDIFFLVCDGLKGLPDSV

SEQ ID NO: 1531261 - protein, 23 aa, Mycobacterium tuberculosis
VKDQRRLRKLAELGWIVIRVIAE

SEQ ID NO: 1531262 - protein, 18 aa, Mycobacterium tuberculosis
VKIPVQGGPIGGIAISRD

SEQ ID NO: 1531263 - protein, 22 aa, Mycobacterium tuberculosis
VKPFVLAELVARVKALLRRRGS

SEQ ID NO: 1531264 - protein, 20 aa, Mycobacterium tuberculosis
VKQELFERLATLAPDAVLAT

SEQ ID NO: 1531265 - protein, 18 aa, Mycobacterium tuberculosis
VKRVVTRRASVDEVLLVL

SEQ ID NO: 1531266 - protein, 19 aa, Mycobacterium tuberculosis
VKSLQWIQTLPTERWTAVT

SEQ ID NO: 1531267 - protein, 17 aa, Mycobacterium tuberculosis
VKTIMRANGWRGVPLAA

SEQ ID NO: 1531268 - protein, 22 aa, Mycobacterium tuberculosis
VKTLLEQTLALLPAALPLLAAP

SEQ ID NO: 1531269 - protein, 18 aa, Mycobacterium tuberculosis
VKVPVRWWHGDHDHIVPF

SEQ ID NO: 1531270 - protein, 22 aa, Mycobacterium tuberculosis
VLAALGRIDYWFVTDGRRVHKT

SEQ ID NO: 1531271 - protein, 25 aa, Mycobacterium tuberculosis
VLAEWFLRRFSLLDSLYMVPSVPII

SEQ ID NO: 1531272 - protein, 27 aa, Mycobacterium tuberculosis
VLAHPCPMCYGSLYYCSLDEVVFLTSR

SEQ ID NO: 1531273 - protein, 17 aa, Mycobacterium tuberculosis
VLAIIPYDTEEDAIAIA

SEQ ID NO: 1531274 - protein, 18 aa, Mycobacterium tuberculosis
VLAQARVGSYLRYGAYPY

SEQ ID NO: 1531275 - protein, 22 aa, Mycobacterium tuberculosis
VLARELLPERALMGDASAIVAL

SEQ ID NO: 1531276 - protein, 19 aa, Mycobacterium tuberculosis
VLARGPMVWRPATTGRSAA

SEQ ID NO: 1531277 - protein, 19 aa, Mycobacterium tuberculosis
VLARLADARRLGHPVLALV

SEQ ID NO: 1531278 - protein, 18 aa, Mycobacterium tuberculosis
VLAWHDALNAADIETLVA

SEQ ID NO: 1531279 - protein, 18 aa, Mycobacterium tuberculosis
VLDALHKLNYCDRERANS

SEQ ID NO: 1531280 - protein, 26 aa, Mycobacterium tuberculosis
VLDMLAPWEVLDAVSRLLVAGGVLMV

SEQ ID NO: 1531281 - protein, 19 aa, Mycobacterium tuberculosis
VLDTLAGELLEKETLHRPE

SEQ ID NO: 1531282 - protein, 30 aa, Mycobacterium tuberculosis
VLDVINAPALALLGRLLIGNGANGAPGTGA

SEQ ID NO: 1531283 - protein, 17 aa, Mycobacterium tuberculosis
VLELLTSWRNPPQALRV

SEQ ID NO: 1531284 - protein, 17 aa, Mycobacterium tuberculosis
VLEPLVAVHREIYPKAD

SEQ ID NO: 1531285 - protein, 25 aa, Mycobacterium tuberculosis
VLERFRAIKPWLVGGRIHAPFWEVH

SEQ ID NO: 1531286 - protein, 18 aa, Mycobacterium tuberculosis
VLERHVHDHHPGTELVSY

SEQ ID NO: 1531287 - protein, 19 aa, Mycobacterium tuberculosis
VLEVEFALDPSGRSAPLRY

SEQ ID NO: 1531288 - protein, 21 aa, Mycobacterium tuberculosis
VLFAVMVSLAELWKSVAVHPD

SEQ ID NO: 1531289 - protein, 17 aa, Mycobacterium tuberculosis
VLFLVKLVDPHARLRAD

SEQ ID NO: 1531290 - protein, 17 aa, Mycobacterium tuberculosis
VLGHTKGPKIRIHKFKN

SEQ ID NO: 1531291 - protein, 18 aa, Mycobacterium tuberculosis
VLGIGPAAARRLAAELLN

SEQ ID NO: 1531292 - protein, 27 aa, Mycobacterium tuberculosis
VLGLINAPTQALWGRPLIGNGADGTAA

SEQ ID NO: 1531293 - protein, 31 aa, Mycobacterium tuberculosis
VLGPDRLPGVRLWLYTNFHCNLCCDYCCVSS

SEQ ID NO: 1531294 - protein, 19 aa, Mycobacterium tuberculosis
VLGPLLFQSPEMGALPTLR

SEQ ID NO: 1531295 - protein, 17 aa, Mycobacterium tuberculosis
VLGRGVAPFFGGELAFL

SEQ ID NO: 1531296 - protein, 29 aa, Mycobacterium tuberculosis
VLHEVRIMLDQYWPSVPHVLIEPGVRTGI

SEQ ID NO: 1531297 - protein, 25 aa, Mycobacterium tuberculosis
VLHEVRIMLDQYWPVGAARADRAGS

SEQ ID NO: 1531298 - protein, 17 aa, Mycobacterium tuberculosis
VLHIFPTLAANINQLYH

SEQ ID NO: 1531299 - protein, 17 aa, Mycobacterium tuberculosis
VLHLLAIAHGRPTSHYR

SEQ ID NO: 1531300 - protein, 24 aa, Mycobacterium tuberculosis
VLIDGMDLVVLGLGGRRVTRARAR

SEQ ID NO: 1531301 - protein, 32 aa, Mycobacterium tuberculosis
VLIGKQFLYVERYMKLLAPRWQMMSDPQLTGY

SEQ ID NO: 1531302 - protein, 33 aa, Mycobacterium tuberculosis
VLIGKQFLYVERYMKLLAPRWQMMSDPQLTGYF

SEQ ID NO: 1531303 - protein, 18 aa, Mycobacterium tuberculosis
VLILRPIWAPPTSLSRSV

SEQ ID NO: 1531304 - protein, 20 aa, Mycobacterium tuberculosis
VLITTPESLFLMLTSAARQT

SEQ ID NO: 1531305 - protein, 26 aa, Mycobacterium tuberculosis
VLKLLKITGDWQKFKGLPGAQGRLKV

SEQ ID NO: 1531306 - protein, 17 aa, Mycobacterium tuberculosis
VLLDGASMWFRSFFGVP

SEQ ID NO: 1531307 - protein, 19 aa, Mycobacterium tuberculosis
VLLILLDDVGFGASSAFGG

SEQ ID NO: 1531308 - protein, 21 aa, Mycobacterium tuberculosis
VLLPSWWDRRRKLGLVLSAYT

SEQ ID NO: 1531309 - protein, 18 aa, Mycobacterium tuberculosis
VLLRGHRLRAGVAPPIWD

SEQ ID NO: 1531310 - protein, 18 aa, Mycobacterium tuberculosis
VLLRITEVFGVDATFFAS

SEQ ID NO: 1531311 - protein, 17 aa, Mycobacterium tuberculosis
VLLSPWLDVGTWQISQA

SEQ ID NO: 1531312 - protein, 17 aa, Mycobacterium tuberculosis
VLLVGGWQDIFLRQTLQ

SEQ ID NO: 1531313 - protein, 20 aa, Mycobacterium tuberculosis
VLMTGFGFTPPVATPTWGVL

SEQ ID NO: 1531314 - protein, 21 aa, Mycobacterium tuberculosis
VLMTGFGFTPPVATPTWGVLE

SEQ ID NO: 1531315 - protein, 19 aa, Mycobacterium tuberculosis
VLMTIPWAVISGFLFNVLL

SEQ ID NO: 1531316 - protein, 28 aa, Mycobacterium tuberculosis
VLNVLNAPTQALLGRPLIGDEAAGAPGT

SEQ ID NO: 1531317 - protein, 18 aa, Mycobacterium tuberculosis
VLPADLPLGYHRVNLRSG

SEQ ID NO: 1531318 - protein, 27 aa, Mycobacterium tuberculosis
VLPAKYLNRLSDLLFILSRVANPDGDV

SEQ ID NO: 1531319 - protein, 18 aa, Mycobacterium tuberculosis
VLPAYLNALAGNGVHIVT

SEQ ID NO: 1531320 - protein, 18 aa, Mycobacterium tuberculosis
VLPGAVARARRAALAAAG

SEQ ID NO: 1531321 - protein, 17 aa, Mycobacterium tuberculosis
VLPILALYVVAAEEQGV

SEQ ID NO: 1531322 - protein, 17 aa, Mycobacterium tuberculosis
VLPILQDTTIVAAGPSV

SEQ ID NO: 1531323 - protein, 22 aa, Mycobacterium tuberculosis
VLQAPLFTAYGTLYQQVSAEAA

SEQ ID NO: 1531324 - protein, 18 aa, Mycobacterium tuberculosis
VLQPLGLHKVANPDLCGF

SEQ ID NO: 1531325 - protein, 17 aa, Mycobacterium tuberculosis
VLRDETGGRWQADAVIL

SEQ ID NO: 1531326 - protein, 22 aa, Mycobacterium tuberculosis
VLRKELAWLRRGAPARTCKPKF

SEQ ID NO: 1531327 - protein, 22 aa, Mycobacterium tuberculosis
VLRLRALMESFWSDELDRLVAD

SEQ ID NO: 1531328 - protein, 21 aa, Mycobacterium tuberculosis
VLRRRHFSAASPVVEPQVQVR

SEQ ID NO: 1531329 - protein, 20 aa, Mycobacterium tuberculosis
VLRRRWSPDGKPIVGFVGRL

SEQ ID NO: 1531330 - protein, 18 aa, Mycobacterium tuberculosis
VLRSAGVKVLMALPVGMG

SEQ ID NO: 1531331 - protein, 25 aa, Mycobacterium tuberculosis
VLRSRVFITRFVGALRGGAVAYASA

SEQ ID NO: 1531332 - protein, 30 aa, Mycobacterium tuberculosis
VLSDGFRVPGLPMPSLPVIGGDAAAACIAA

SEQ ID NO: 1531333 - protein, 17 aa, Mycobacterium tuberculosis
VLSIFNHDTAIASAAAR

SEQ ID NO: 1531334 - protein, 19 aa, Mycobacterium tuberculosis
VLSKLLRLGEGRMVKRLKK

SEQ ID NO: 1531335 - protein, 20 aa, Mycobacterium tuberculosis
VLSPAFWALRESCCPDPLRG

SEQ ID NO: 1531336 - protein, 19 aa, Mycobacterium tuberculosis
VLSVRQLMVRPVSAAALSR

SEQ ID NO: 1531337 - protein, 17 aa, Mycobacterium tuberculosis
VLTALDRLRFAAGNFYV

SEQ ID NO: 1531338 - protein, 25 aa, Mycobacterium tuberculosis
VLTATQLALPGGMQPLWGPDQRRVM

SEQ ID NO: 1531339 - protein, 19 aa, Mycobacterium tuberculosis
VLTKLRANGIRRIVMLTGD

SEQ ID NO: 1531340 - protein, 36 aa, Mycobacterium tuberculosis
VLTKPMLTLPRFPMPALRPPWFATPKFSVRLPVLSR

SEQ ID NO: 1531341 - protein, 22 aa, Mycobacterium tuberculosis
VLTMPVRIRTANLHSAMFSVPA

SEQ ID NO: 1531342 - protein, 17 aa, Mycobacterium tuberculosis
VLTQCRPELIERTFQAC

SEQ ID NO: 1531343 - protein, 20 aa, Mycobacterium tuberculosis
VLVAQAWHWVDPRPGDSGGR

SEQ ID NO: 1531344 - protein, 18 aa, Mycobacterium tuberculosis
VLVGRRVGLVPRARRAVV

SEQ ID NO: 1531345 - protein, 19 aa, Mycobacterium tuberculosis
VLVIFIGLSDGFGLRIVDR

SEQ ID NO: 1531346 - protein, 17 aa, Mycobacterium tuberculosis
VLVKLDAPRYQGVTRQR

SEQ ID NO: 1531347 - protein, 19 aa, Mycobacterium tuberculosis
VLVLTAHVLAMDPASWRIV

SEQ ID NO: 1531348 - protein, 33 aa, Mycobacterium tuberculosis
VLVPGMAFSIELGIYFPGRWGARIEDIVIVTED

SEQ ID NO: 1531349 - protein, 26 aa, Mycobacterium tuberculosis
VLVVQRMLASRFTPLALFGTDRRLAE

SEQ ID NO: 1531350 - protein, 18 aa, Mycobacterium tuberculosis
VLVVSDECYLGLGWDAEP

SEQ ID NO: 1531351 - protein, 18 aa, Mycobacterium tuberculosis
VMALRDRGIQAPAALGLI

SEQ ID NO: 1531352 - protein, 26 aa, Mycobacterium tuberculosis
VMARVARLVFGAWEPKTGAVGSLWDV

SEQ ID NO: 1531353 - protein, 24 aa, Mycobacterium tuberculosis
VMAVWVILRAMEALDLLPLTDRRH

SEQ ID NO: 1531354 - protein, 17 aa, Mycobacterium tuberculosis
VMDSQFLTQNFGPVIGT

SEQ ID NO: 1531355 - protein, 19 aa, Mycobacterium tuberculosis
VMEFPVLPPEINSVLMYSG

SEQ ID NO: 1531356 - protein, 19 aa, Mycobacterium tuberculosis
VMGSNIARNFARHGYTVAV

SEQ ID NO: 1531357 - protein, 17 aa, Mycobacterium tuberculosis
VMMNNYGTPPIALASGD

SEQ ID NO: 1531358 - protein, 17 aa, Mycobacterium tuberculosis
VMMPAFDIGDAGRMSFI

SEQ ID NO: 1531359 - protein, 17 aa, Mycobacterium tuberculosis
VMPFYPYARQDKKHRGR

SEQ ID NO: 1531360 - protein, 19 aa, Mycobacterium tuberculosis
VMPLLTAWQGYPETLGKPD

SEQ ID NO: 1531361 - protein, 17 aa, Mycobacterium tuberculosis
VMTATPIPRTVALTVYG

SEQ ID NO: 1531362 - protein, 17 aa, Mycobacterium tuberculosis
VMWPKIGGSQVLHDAFP

SEQ ID NO: 1531363 - protein, 18 aa, Mycobacterium tuberculosis
VMWSEHWSYKSSKVHLRY

SEQ ID NO: 1531364 - protein, 25 aa, Mycobacterium tuberculosis
VNAAAPDVIRLAPPLIIAEAQLDGF

SEQ ID NO: 1531365 - protein, 22 aa, Mycobacterium tuberculosis
VNADIARYNARCGRTFVLPNEQ

SEQ ID NO: 1531366 - protein, 17 aa, Mycobacterium tuberculosis
VNAFPYHELFGPNVAGT

SEQ ID NO: 1531367 - protein, 18 aa, Mycobacterium tuberculosis
VNAIPSKAWFDLADAVTA

SEQ ID NO: 1531368 - protein, 18 aa, Mycobacterium tuberculosis
VNAIVLANLPCGYVGAVV

SEQ ID NO: 1531369 - protein, 27 aa, Mycobacterium tuberculosis
VNAVNPGLATPVTPAANGGNGLNLVGV

SEQ ID NO: 1531370 - protein, 24 aa, Mycobacterium tuberculosis
VNDLRLALGLMLEIGPRGPERLPG

SEQ ID NO: 1531371 - protein, 19 aa, Mycobacterium tuberculosis
VNEPFQTLTGRPLIGNGAN

SEQ ID NO: 1531372 - protein, 20 aa, Mycobacterium tuberculosis
VNEPFQTLTGRPLIGNGANG

SEQ ID NO: 1531373 - protein, 22 aa, Mycobacterium tuberculosis
VNFRDVLVALGIYPGAAELGAE

SEQ ID NO: 1531374 - protein, 25 aa, Mycobacterium tuberculosis
VNFRDVLVALGIYPGAAELGAEGAG

SEQ ID NO: 1531375 - protein, 22 aa, Mycobacterium tuberculosis
VNFRDVLVALGMYPGGGELGVD

SEQ ID NO: 1531376 - protein, 20 aa, Mycobacterium tuberculosis
VNHFPLLRQPCDALFYPEFS

SEQ ID NO: 1531377 - protein, 22 aa, Mycobacterium tuberculosis
VNKLRGRHVPKLRQVIGCVFQD

SEQ ID NO: 1531378 - protein, 24 aa, Mycobacterium tuberculosis
VNLLHDHLVDILLDAAAMGRVHVE

SEQ ID NO: 1531379 - protein, 17 aa, Mycobacterium tuberculosis
VNLNGLDFMGCCAVAVL

SEQ ID NO: 1531380 - protein, 17 aa, Mycobacterium tuberculosis
VNLNGLDFMGCCTVAVL

SEQ ID NO: 1531381 - protein, 31 aa, Mycobacterium tuberculosis
VNNGFLWRGDHQGLIFGSPGFFNSTSAPSSG

SEQ ID NO: 1531382 - protein, 20 aa, Mycobacterium tuberculosis
VNQLIMVKLALNSALLQQGV

SEQ ID NO: 1531383 - protein, 23 aa, Mycobacterium tuberculosis
VNQYLAVAALIAGGLYGIERGLQ

SEQ ID NO: 1531384 - protein, 18 aa, Mycobacterium tuberculosis
VNRLLVRNISVVGVGWGE

SEQ ID NO: 1531385 - protein, 24 aa, Mycobacterium tuberculosis
VNRWLMEQLIMIDALKRGSAKRIT

SEQ ID NO: 1531386 - protein, 18 aa, Mycobacterium tuberculosis
VNSAIIKIAKWAQSQQWT

SEQ ID NO: 1531387 - protein, 19 aa, Mycobacterium tuberculosis
VNSALMYAGPGSGPMLAGA

SEQ ID NO: 1531388 - protein, 28 aa, Mycobacterium tuberculosis
VNTGFGNGGAINLGFGNSGQLNAGSFNA

SEQ ID NO: 1531389 - protein, 29 aa, Mycobacterium tuberculosis
VNTGFGNGGAINLGFGNSGQLNAGSFNAG

SEQ ID NO: 1531390 - protein, 24 aa, Mycobacterium tuberculosis
VNTQRWPSSPIPSPMRWAVRESSC

SEQ ID NO: 1531391 - protein, 32 aa, Mycobacterium tuberculosis
VNTTAWFVMATIPNAVFLGHAFAALNPATVTA

SEQ ID NO: 1531392 - protein, 17 aa, Mycobacterium tuberculosis
VNTTEPVVFISLNGGQM

SEQ ID NO: 1531393 - protein, 23 aa, Mycobacterium tuberculosis
VNVTLIFSVQRYREVMDAYLTGM

SEQ ID NO: 1531394 - protein, 20 aa, Mycobacterium tuberculosis
VPAAWSRWPVASRRPRSWRP

SEQ ID NO: 1531395 - protein, 23 aa, Mycobacterium tuberculosis
VPAFALALMRRSLAGSNIGGIAE

SEQ ID NO: 1531396 - protein, 25 aa, Mycobacterium tuberculosis
VPAGGTIAAARRGAGSASVLDAATI

SEQ ID NO: 1531397 - protein, 28 aa, Mycobacterium tuberculosis
VPAHMIPRHVTLLDRIPFTDSGKIDRAE

SEQ ID NO: 1531398 - protein, 29 aa, Mycobacterium tuberculosis
VPAHMIPRHVTLLDRIPFTDSGKIDRAEV

SEQ ID NO: 1531399 - protein, 18 aa, Mycobacterium tuberculosis
VPAIELIDTRIKDWQIKI

SEQ ID NO: 1531400 - protein, 18 aa, Mycobacterium tuberculosis
VPARHRVDRLITSDPTDA

SEQ ID NO: 1531401 - protein, 18 aa, Mycobacterium tuberculosis
VPATVPVGILCLEFLVHA

SEQ ID NO: 1531402 - protein, 17 aa, Mycobacterium tuberculosis
VPDDFVGAVLGDLSSRR

SEQ ID NO: 1531403 - protein, 25 aa, Mycobacterium tuberculosis
VPEMRQWLRNWVGKAVGKAPDSIDE

SEQ ID NO: 1531404 - protein, 18 aa, Mycobacterium tuberculosis
VPEVISRAPWRLLQVYQD

SEQ ID NO: 1531405 - protein, 17 aa, Mycobacterium tuberculosis
VPFVDPLTTILDPSLPL

SEQ ID NO: 1531406 - protein, 19 aa, Mycobacterium tuberculosis
VPGAYVAGWIKRGPTGFIG

SEQ ID NO: 1531407 - protein, 29 aa, Mycobacterium tuberculosis
VPGCYPTAALLALFPALAADLIEPAVTVV

SEQ ID NO: 1531408 - protein, 36 aa, Mycobacterium tuberculosis
VPGGWRAPMLRLIRRYGPIMTMPILSLGDVAIVSDS

SEQ ID NO: 1531409 - protein, 30 aa, Mycobacterium tuberculosis
VPGMAFSIELGIYFPGRWGARIEDIVIVTE

SEQ ID NO: 1531410 - protein, 22 aa, Mycobacterium tuberculosis
VPGMIRLVRHSIALVAAGLAAA

SEQ ID NO: 1531411 - protein, 24 aa, Mycobacterium tuberculosis
VPGMIRLVRHSIALVAAGLAAGLS

SEQ ID NO: 1531412 - protein, 18 aa, Mycobacterium tuberculosis
VPGPFVPSAIASALIAAH

SEQ ID NO: 1531413 - protein, 20 aa, Mycobacterium tuberculosis
VPGRWRLCVLMTTPPARATR

SEQ ID NO: 1531414 - protein, 20 aa, Mycobacterium tuberculosis
VPGVIGVPGVIGVPGVPGVP

SEQ ID NO: 1531415 - protein, 24 aa, Mycobacterium tuberculosis
VPGYPNFFTVFGPYGYVGSSYFAL

SEQ ID NO: 1531416 - protein, 21 aa, Mycobacterium tuberculosis
VPHRFAVVDRLPRTPNGKLVR

SEQ ID NO: 1531417 - protein, 17 aa, Mycobacterium tuberculosis
VPILGPYEDLIANTVAN

SEQ ID NO: 1531418 - protein, 19 aa, Mycobacterium tuberculosis
VPISGILFGGRRTTTVPLV

SEQ ID NO: 1531419 - protein, 19 aa, Mycobacterium tuberculosis
VPKGHRPPPSPKPGQKWVN

SEQ ID NO: 1531420 - protein, 18 aa, Mycobacterium tuberculosis
VPKSPSGLLLAELKPRRL

SEQ ID NO: 1531421 - protein, 20 aa, Mycobacterium tuberculosis
VPLIAVGLYYRSGYFRQSLT

SEQ ID NO: 1531422 - protein, 18 aa, Mycobacterium tuberculosis
VPLSEMFGYVGDLRSKTQ

SEQ ID NO: 1531423 - protein, 23 aa, Mycobacterium tuberculosis
VPNAIPLAGLLADAPHGSKQANT

SEQ ID NO: 1531424 - protein, 25 aa, Mycobacterium tuberculosis
VPNGPAQQALLAKALTSSKLTAADI

SEQ ID NO: 1531425 - protein, 19 aa, Mycobacterium tuberculosis
VPNSFILATNFSFTGVTPF

SEQ ID NO: 1531426 - protein, 20 aa, Mycobacterium tuberculosis
VPNYRGSCWIPFSIELEGDA

SEQ ID NO: 1531427 - protein, 18 aa, Mycobacterium tuberculosis
VPPAPPLPNSHPPVPPAP

SEQ ID NO: 1531428 - protein, 20 aa, Mycobacterium tuberculosis
VPPDWAARARWANPAAWRLP

SEQ ID NO: 1531429 - protein, 19 aa, Mycobacterium tuberculosis
VPPTPLLPPAPPSPPAPPA

SEQ ID NO: 1531430 - protein, 17 aa, Mycobacterium tuberculosis
VPPVIDGSIWDAIAGCE

SEQ ID NO: 1531431 - protein, 18 aa, Mycobacterium tuberculosis
VPPVPPLPVKMPPSPPVP

SEQ ID NO: 1531432 - protein, 20 aa, Mycobacterium tuberculosis
VPRAPVFALDLSWGGAGGNG

SEQ ID NO: 1531433 - protein, 38 aa, Mycobacterium tuberculosis
VPRCSAITPPRRRWPRSWRLFKRFAAAAAKRAAQLASG

SEQ ID NO: 1531434 - protein, 22 aa, Mycobacterium tuberculosis
VPRREAGWAGPVVPWVVSAKSE

SEQ ID NO: 1531435 - protein, 23 aa, Mycobacterium tuberculosis
VPRREAGWAGPVVPWVVSAKSES

SEQ ID NO: 1531436 - protein, 17 aa, Mycobacterium tuberculosis
VPRRPVIRPIPVDDSGF

SEQ ID NO: 1531437 - protein, 23 aa, Mycobacterium tuberculosis
VPSIILGGIDWFRSMGSEKSPGF

SEQ ID NO: 1531438 - protein, 19 aa, Mycobacterium tuberculosis
VPSRGLIGWRTDFLTETRG

SEQ ID NO: 1531439 - protein, 23 aa, Mycobacterium tuberculosis
VPSSMVLLSPWLDVGTWQISQAW

SEQ ID NO: 1531440 - protein, 22 aa, Mycobacterium tuberculosis
VPSTVRLFPVNGAVSPTITPAI

SEQ ID NO: 1531441 - protein, 21 aa, Mycobacterium tuberculosis
VPTPQRRRPYRPPPRPNSEAL

SEQ ID NO: 1531442 - protein, 18 aa, Mycobacterium tuberculosis
VPVPGFRVWALDSLRRAN

SEQ ID NO: 1531443 - protein, 30 aa, Mycobacterium tuberculosis
VPVQLVRIGRLYLIGIPGEPTIVAGLRLRR

SEQ ID NO: 1531444 - protein, 18 aa, Mycobacterium tuberculosis
VPVVFALGARRPAEATGA

SEQ ID NO: 1531445 - protein, 26 aa, Mycobacterium tuberculosis
VPYARSTPLFYYNKAAWQQAGLPDRG

SEQ ID NO: 1531446 - protein, 18 aa, Mycobacterium tuberculosis
VQAFFDFIEHDSQGYRLI

SEQ ID NO: 1531447 - protein, 25 aa, Mycobacterium tuberculosis
VQAGLRTDYLFRIANQRGGIVLGTG

SEQ ID NO: 1531448 - protein, 18 aa, Mycobacterium tuberculosis
VQALLVALAVRGLGSCWI

SEQ ID NO: 1531449 - protein, 21 aa, Mycobacterium tuberculosis
VQALTFHAAAYRQLRYFWSRV

SEQ ID NO: 1531450 - protein, 42 aa, Mycobacterium tuberculosis
VQALTFHAAAYRQLRYFWSRVIADTGWQLLDSKFAVVARAAS

SEQ ID NO: 1531451 - protein, 21 aa, Mycobacterium tuberculosis
VQCLRGMVRLGRFGRRGVRPD

SEQ ID NO: 1531452 - protein, 17 aa, Mycobacterium tuberculosis
VQDPARLPEALVSARRE

SEQ ID NO: 1531453 - protein, 24 aa, Mycobacterium tuberculosis
VQEDFAHHQFLIKKSKMPSQTPPE

SEQ ID NO: 1531454 - protein, 25 aa, Mycobacterium tuberculosis
VQERRLVFERFYRSASARALPGSGL

SEQ ID NO: 1531455 - protein, 17 aa, Mycobacterium tuberculosis
VQFDPLTRLTNSDIIAC

SEQ ID NO: 1531456 - protein, 25 aa, Mycobacterium tuberculosis
VQLAEIETWPRRLKAATARCTRSCW

SEQ ID NO: 1531457 - protein, 21 aa, Mycobacterium tuberculosis
VQNFPALVANLPAAIDAAVQQ

SEQ ID NO: 1531458 - protein, 21 aa, Mycobacterium tuberculosis
VQNILALRFANQLFDPIWNAH

SEQ ID NO: 1531459 - protein, 19 aa, Mycobacterium tuberculosis
VQPRGRSAGWRPPAAATTW

SEQ ID NO: 1531460 - protein, 19 aa, Mycobacterium tuberculosis
VQQFLAFNAAYYIQQIISS

SEQ ID NO: 1531461 - protein, 28 aa, Mycobacterium tuberculosis
VQRGHIPRNLHFTRWNPAIDASATRLFV

SEQ ID NO: 1531462 - protein, 19 aa, Mycobacterium tuberculosis
VQSTFRRIYRSREAEVTLV

SEQ ID NO: 1531463 - protein, 17 aa, Mycobacterium tuberculosis
VQTDGFLRGHGGDGGNA

SEQ ID NO: 1531464 - protein, 24 aa, Mycobacterium tuberculosis
VQTPQPYWYWALDRESIGGSVSAA

SEQ ID NO: 1531465 - protein, 17 aa, Mycobacterium tuberculosis
VQTVQRSLLGQMLTSRP

SEQ ID NO: 1531466 - protein, 30 aa, Mycobacterium tuberculosis
VQVPGGAWVLGWRRPQAYPLMSHLAARGWV

SEQ ID NO: 1531467 - protein, 21 aa, Mycobacterium tuberculosis
VQVPIPRAGGLGARRIRDVEL

SEQ ID NO: 1531468 - protein, 18 aa, Mycobacterium tuberculosis
VQVPRRGYIPSLACGRCW

SEQ ID NO: 1531469 - protein, 18 aa, Mycobacterium tuberculosis
VRAAPPFGRCRADRSLAG

SEQ ID NO: 1531470 - protein, 25 aa, Mycobacterium tuberculosis
VRAGYPRGWTLRPRRRICLPVGEDD

SEQ ID NO: 1531471 - protein, 17 aa, Mycobacterium tuberculosis
VRAHVPLSEMFGYVGDL

SEQ ID NO: 1531472 - protein, 20 aa, Mycobacterium tuberculosis
VRAKYGWTDVSRFAALGIPA

SEQ ID NO: 1531473 - protein, 19 aa, Mycobacterium tuberculosis
VRALRDGVVWRIAAETFTD

SEQ ID NO: 1531474 - protein, 18 aa, Mycobacterium tuberculosis
VRALSAAAGWYVDAEAAT

SEQ ID NO: 1531475 - protein, 20 aa, Mycobacterium tuberculosis
VRARLRREVLIDDGTDEARV

SEQ ID NO: 1531476 - protein, 21 aa, Mycobacterium tuberculosis
VRARLRREVLIDDGTDEARVS

SEQ ID NO: 1531477 - protein, 23 aa, Mycobacterium tuberculosis
VRARLRREVLIDDGTDEARVSRR

SEQ ID NO: 1531478 - protein, 21 aa, Mycobacterium tuberculosis
VRAWARLWERCAIDLTGNTEE

SEQ ID NO: 1531479 - protein, 19 aa, Mycobacterium tuberculosis
VRAWGPRAPFEVLLGKPRA

SEQ ID NO: 1531480 - protein, 18 aa, Mycobacterium tuberculosis
VRDGYAWVQPRLSPVARA

SEQ ID NO: 1531481 - protein, 17 aa, Mycobacterium tuberculosis
VRDPRLRRALTPDYEPM

SEQ ID NO: 1531482 - protein, 29 aa, Mycobacterium tuberculosis
VRDSLMTLTTLYPPVAVVVSLWTQQCYGE

SEQ ID NO: 1531483 - protein, 19 aa, Mycobacterium tuberculosis
VRDWPKPLGFVWGLDDPVA

SEQ ID NO: 1531484 - protein, 17 aa, Mycobacterium tuberculosis
VRDWYSIRHYALTEDGR

SEQ ID NO: 1531485 - protein, 21 aa, Mycobacterium tuberculosis
VREFPFNLMLWDLDRRMRRGR

SEQ ID NO: 1531486 - protein, 17 aa, Mycobacterium tuberculosis
VREHQFRYYVRDAPIIS

SEQ ID NO: 1531487 - protein, 22 aa, Mycobacterium tuberculosis
VRELMPRTPFIGGLGIVFERYE

SEQ ID NO: 1531488 - protein, 18 aa, Mycobacterium tuberculosis
VRFVDVLPRNAAGKVSKP

SEQ ID NO: 1531489 - protein, 17 aa, Mycobacterium tuberculosis
VRGGILDIFAPTAEHPV

SEQ ID NO: 1531490 - protein, 17 aa, Mycobacterium tuberculosis
VRHLPIVRGATVGGSGA

SEQ ID NO: 1531491 - protein, 20 aa, Mycobacterium tuberculosis
VRHQLPMPSILDTKGRIVDT

SEQ ID NO: 1531492 - protein, 19 aa, Mycobacterium tuberculosis
VRIPRSWRRSAVSTWSAST

SEQ ID NO: 1531493 - protein, 25 aa, Mycobacterium tuberculosis
VRLAVEWPLELFGHITAMPGSGGGQ

SEQ ID NO: 1531494 - protein, 17 aa, Mycobacterium tuberculosis
VRLLDTIGLVSDAEHNM

SEQ ID NO: 1531495 - protein, 19 aa, Mycobacterium tuberculosis
VRLLNMVPYFQANPRITRA

SEQ ID NO: 1531496 - protein, 17 aa, Mycobacterium tuberculosis
VRLMFMQSNGGLAQAGH

SEQ ID NO: 1531497 - protein, 18 aa, Mycobacterium tuberculosis
VRNTGWSNSGLTNTGAFN

SEQ ID NO: 1531498 - protein, 28 aa, Mycobacterium tuberculosis
VRPATPWKPPSKGLLARHPNHWGADAHG

SEQ ID NO: 1531499 - protein, 17 aa, Mycobacterium tuberculosis
VRPGARLILVGDADQLA

SEQ ID NO: 1531500 - protein, 22 aa, Mycobacterium tuberculosis
VRPHAIRVPDAALDAALAGLDC

SEQ ID NO: 1531501 - protein, 20 aa, Mycobacterium tuberculosis
VRPIDGLSLDVAPGSLVILL

SEQ ID NO: 1531502 - protein, 19 aa, Mycobacterium tuberculosis
VRPLSLGRLDRGWVVASET

SEQ ID NO: 1531503 - protein, 22 aa, Mycobacterium tuberculosis
VRPPFARNVRFLPTAAAAQGEG

SEQ ID NO: 1531504 - protein, 20 aa, Mycobacterium tuberculosis
VRPPWSIGEPQPELAALIVQ

SEQ ID NO: 1531505 - protein, 32 aa, Mycobacterium tuberculosis; identical to SEQ ID NO: 224264

SEQ ID NO: 1531506 - protein, 19 aa, Mycobacterium tuberculosis
VRQYFGSKVLRTVIPRSVK

SEQ ID NO: 1531507 - protein, 21 aa, Mycobacterium tuberculosis
VRRAPGNLIRIGEWDPTDHAR

SEQ ID NO: 1531508 - protein, 20 aa, Mycobacterium tuberculosis
VRRFARERSRWLFSNPEMTH

SEQ ID NO: 1531509 - protein, 27 aa, Mycobacterium tuberculosis
VRRFQMACAVHRFGDRPALDVRGQACA

SEQ ID NO: 1531510 - protein, 17 aa, Mycobacterium tuberculosis
VRRGWLQHGPGPSSARG

SEQ ID NO: 1531511 - protein, 23 aa, Mycobacterium tuberculosis
VRRIFEHIPAILVGLEGPDHRFV

SEQ ID NO: 1531512 - protein, 17 aa, Mycobacterium tuberculosis
VRRLEFTEPMTVSTLSG

SEQ ID NO: 1531513 - protein, 17 aa, Mycobacterium tuberculosis
VRRRPSRGLGQRLLYPI

SEQ ID NO: 1531514 - protein, 17 aa, Mycobacterium tuberculosis
VRRRRTGGSGDHGTPAA

SEQ ID NO: 1531515 - protein, 25 aa, Mycobacterium tuberculosis
VRRTPLLLDGVAVTAAALVAERLAP

SEQ ID NO: 1531516 - protein, 28 aa, Mycobacterium tuberculosis
VRSGVAFDILRRWLLARGYDVAFIRNVT

SEQ ID NO: 1531517 - protein, 27 aa, Mycobacterium tuberculosis
VRSLQRWRPFGLPPHRWRLAPLVLARP

SEQ ID NO: 1531518 - protein, 24 aa, Mycobacterium tuberculosis
VRSLVAWFWDQPLRAPLIRHGANL

SEQ ID NO: 1531519 - protein, 18 aa, Mycobacterium tuberculosis
VRSPGRWAAIPRWPDFVA

SEQ ID NO: 1531520 - protein, 30 aa, Mycobacterium tuberculosis
VRTLSKLVRHHLLLPITATRRDLNDPKTIE

SEQ ID NO: 1531521 - protein, 18 aa, Mycobacterium tuberculosis
VRTPAVCAALGEPISARP

SEQ ID NO: 1531522 - protein, 22 aa, Mycobacterium tuberculosis
VRTPPRSPPPRPPPGSAVHQRL

SEQ ID NO: 1531523 - protein, 18 aa, Mycobacterium tuberculosis
VRVDDVWHPVLNLASARL

SEQ ID NO: 1531524 - protein, 21 aa, Mycobacterium tuberculosis
VRVIRTLRRLGIRSVAVYSDP

SEQ ID NO: 1531525 - protein, 21 aa, Mycobacterium tuberculosis
VRVPDGFQLPHPPRDAREFRT

SEQ ID NO: 1531526 - protein, 21 aa, Mycobacterium tuberculosis
VRVRDLLATHLETAGVLAASV

SEQ ID NO: 1531527 - protein, 31 aa, Mycobacterium tuberculosis
VRWVMTGWQRLHFRFGFPAPLLEPLAVERLY

SEQ ID NO: 1531528 - protein, 27 aa, Mycobacterium tuberculosis
VRYLHSEVDTLRRVELLPQLRLGSTTC

SEQ ID NO: 1531529 - protein, 25 aa, Mycobacterium tuberculosis
VSAGAAVAGLVGRAGTAGPAVAKQS

SEQ ID NO: 1531530 - protein, 24 aa, Mycobacterium tuberculosis
VSALTPFGQALPTVAGGGALVSAA

SEQ ID NO: 1531531 - protein, 35 aa, Mycobacterium tuberculosis
VSAPIEQAWSRLCDLEQMIPLMPGAQLIGHEGDEY

SEQ ID NO: 1531532 - protein, 27 aa, Mycobacterium tuberculosis
VSAPPPPPPPPPPPPPTPMPIAAGEPP

SEQ ID NO: 1531533 - protein, 24 aa, Mycobacterium tuberculosis
VSAQMSAFHAQFVQTFTAGDGEYA

SEQ ID NO: 1531534 - protein, 18 aa, Mycobacterium tuberculosis
VSARLPVVALLGPVWIRM

SEQ ID NO: 1531535 - protein, 25 aa, Mycobacterium tuberculosis
VSASLPVFPWDTLADAKALAGAHPD

SEQ ID NO: 1531536 - protein, 26 aa, Mycobacterium tuberculosis
VSATPGWPAPGWSTPAASTPVWQTPG

SEQ ID NO: 1531537 - protein, 30 aa, Mycobacterium tuberculosis
VSDALSKLTPWKAPPPIAHSTVLVAPVSPS

SEQ ID NO: 1531538 - protein, 17 aa, Mycobacterium tuberculosis
VSDGFQAFVYGPIHATG

SEQ ID NO: 1531539 - protein, 28 aa, Mycobacterium tuberculosis
VSDRAGAITPFALLQLADRGQFFVEPGQ

SEQ ID NO: 1531540 - protein, 24 aa, Mycobacterium tuberculosis
VSENLRYVAAWNAAFLPSKDLTEG

SEQ ID NO: 1531541 - protein, 28 aa, Mycobacterium tuberculosis
VSFATYFNAFPASYWRRWTTCKSVVLRV

SEQ ID NO: 1531542 - protein, 23 aa, Mycobacterium tuberculosis
VSFDETFKLVKVNPLAAWTDQDV

SEQ ID NO: 1531543 - protein, 23 aa, Mycobacterium tuberculosis
VSGALLGLVLNAPAPRPLATHRL

SEQ ID NO: 1531544 - protein, 20 aa, Mycobacterium tuberculosis
VSGAPIDDPMRATSGTAVTT

SEQ ID NO: 1531545 - protein, 26 aa, Mycobacterium tuberculosis
VSGRAQILNMTLSQRWGRLFVAVCYA

SEQ ID NO: 1531546 - protein, 21 aa, Mycobacterium tuberculosis
VSGTWVDIRFTLPANTVDGGT

SEQ ID NO: 1531547 - protein, 23 aa, Mycobacterium tuberculosis
VSHELRTFGWQVPATPCRTTPPT

SEQ ID NO: 1531548 - protein, 18 aa, Mycobacterium tuberculosis
VSHGWVRRRPVWPLRPHH

SEQ ID NO: 1531549 - protein, 26 aa, Mycobacterium tuberculosis
VSIDGLIAILTFPPAESVFDQIIDAA

SEQ ID NO: 1531550 - protein, 25 aa, Mycobacterium tuberculosis
VSIDPDYLRRILTAVLDNAITHGDG

SEQ ID NO: 1531551 - protein, 28 aa, Mycobacterium tuberculosis
VSIERFLDTAWWVSDLPSARAFAAVWTP

SEQ ID NO: 1531552 - protein, 17 aa, Mycobacterium tuberculosis
VSIQHFGLARELGLETV

SEQ ID NO: 1531553 - protein, 17 aa, Mycobacterium tuberculosis
VSISVGCNNSCTFCIVP

SEQ ID NO: 1531554 - protein, 20 aa, Mycobacterium tuberculosis
VSKLLWANWHRNLGELAMDV

SEQ ID NO: 1531555 - protein, 21 aa, Mycobacterium tuberculosis
VSKLLWANWHRNLGELAMDVI

SEQ ID NO: 1531556 - protein, 20 aa, Mycobacterium tuberculosis
VSKYWKIDEIRPAFIHVNPV

SEQ ID NO: 1531557 - protein, 18 aa, Mycobacterium tuberculosis
VSLAIWMAGVTREINLLA

SEQ ID NO: 1531558 - protein, 19 aa, Mycobacterium tuberculosis
VSLAIWMAGVTREINLLAQ

SEQ ID NO: 1531559 - protein, 35 aa, Mycobacterium tuberculosis
VSLGIYASPRQTVISGPPLLIDELIDKVRQQNGFA

SEQ ID NO: 1531560 - protein, 18 aa, Mycobacterium tuberculosis
VSLIRSAPAAQAAFATLR

SEQ ID NO: 1531561 - protein, 23 aa, Mycobacterium tuberculosis
VSLPVVRAFIHRIKERAAGPRCQ

SEQ ID NO: 1531562 - protein, 23 aa, Mycobacterium tuberculosis
VSLPVVRAFIHRIKERARGPRCQ

SEQ ID NO: 1531563 - protein, 17 aa, Mycobacterium tuberculosis
VSLRGSGGAGGPRRQRR

SEQ ID NO: 1531564 - protein, 29 aa, Mycobacterium tuberculosis
VSLTSVFRATRAALRYFRDAPHGGVIVNN

SEQ ID NO: 1531565 - protein, 26 aa, Mycobacterium tuberculosis
VSMESRARLFPRGLAAFIELRDQRCR

SEQ ID NO: 1531566 - protein, 18 aa, Mycobacterium tuberculosis
VSMPLFHSNAVLVGWAVA

SEQ ID NO: 1531567 - protein, 18 aa, Mycobacterium tuberculosis
VSNALRMPPRAYVMPRVP

SEQ ID NO: 1531568 - protein, 17 aa, Mycobacterium tuberculosis
VSNLRKLLGGAGIDPRV

SEQ ID NO: 1531569 - protein, 24 aa, Mycobacterium tuberculosis
VSPADFYVLLRQTGQHHGPAFAAL

SEQ ID NO: 1531570 - protein, 18 aa, Mycobacterium tuberculosis
VSPIDFWEHPTINALAAY

SEQ ID NO: 1531571 - protein, 19 aa, Mycobacterium tuberculosis
VSPIDFWEHPTINALAAYL

SEQ ID NO: 1531572 - protein, 24 aa, Mycobacterium tuberculosis
VSPPALVVGWCCRRRRGGAGGRPG

SEQ ID NO: 1531573 - protein, 24 aa, Mycobacterium tuberculosis
VSPPSPLPSPSLSGSISGPSAATS

SEQ ID NO: 1531574 - protein, 17 aa, Mycobacterium tuberculosis
VSQAIARLFSDYATHYQ

SEQ ID NO: 1531575 - protein, 22 aa, Mycobacterium tuberculosis
VSQAIARLFSDYATHYQSLNAQ

SEQ ID NO: 1531576 - protein, 27 aa, Mycobacterium tuberculosis
VSQIVPLLGPMIQDMLFMQLRHMMETE

SEQ ID NO: 1531577 - protein, 17 aa, Mycobacterium tuberculosis
VSQLADHLLRSLAIIGA

SEQ ID NO: 1531578 - protein, 28 aa, Mycobacterium tuberculosis
VSQPPTLEELFLRPLQPGAPRSQPSNRW

SEQ ID NO: 1531579 - protein, 27 aa, Mycobacterium tuberculosis
VSRAELIRLLLNRALTTAGDDLASDLQ

SEQ ID NO: 1531580 - protein, 21 aa, Mycobacterium tuberculosis
VSRARLQLAIAWAKHSAATAG

SEQ ID NO: 1531581 - protein, 22 aa, Mycobacterium tuberculosis
VSRLFGAYGQQFQALNARAATF

SEQ ID NO: 1531582 - protein, 23 aa, Mycobacterium tuberculosis
VSRQTFRLQRYPEYKANRSSTPD

SEQ ID NO: 1531583 - protein, 22 aa, Mycobacterium tuberculosis
VSRRALLALARAEYRILATAIQ

SEQ ID NO: 1531584 - protein, 28 aa, Mycobacterium tuberculosis
VSRRRRWLGGWTIAPAPCGWLATGKTSG

SEQ ID NO: 1531585 - protein, 27 aa, Mycobacterium tuberculosis
VSRSVWWARSWPGTSRCFWPSTRLRRR

SEQ ID NO: 1531586 - protein, 23 aa, Mycobacterium tuberculosis
VSRSYWDQLKWNALANIAGTPAT

SEQ ID NO: 1531587 - protein, 20 aa, Mycobacterium tuberculosis
VSTAVAALFSSHAQAYQAAS

SEQ ID NO: 1531588 - protein, 26 aa, Mycobacterium tuberculosis
VSTQIAALFGAHARSYQTLSTQAAAF

SEQ ID NO: 1531589 - protein, 35 aa, Mycobacterium tuberculosis
VSTYYAFAGSLLRDYGLLLPLEPDTRLLSETELWQ

SEQ ID NO: 1531590 - protein, 24 aa, Mycobacterium tuberculosis
VSVGDYHIPKMIGWTLVGRPVDDA

SEQ ID NO: 1531591 - protein, 29 aa, Mycobacterium tuberculosis
VSVLADLQGPKIRLGRFASGATHWAEGET

SEQ ID NO: 1531592 - protein, 18 aa, Mycobacterium tuberculosis
VSVQTPYRKVGAGPLDTP

SEQ ID NO: 1531593 - protein, 21 aa, Mycobacterium tuberculosis
VSYGHTWIAPRDTNLALLPIG

SEQ ID NO: 1531594 - protein, 39 aa, Mycobacterium tuberculosis; identical to SEQ ID NO: 227114

SEQ ID NO: 1531595 - protein, 19 aa, Mycobacterium tuberculosis
VSYWTVFDEWAGRASAMRD

SEQ ID NO: 1531596 - protein, 34 aa, Mycobacterium tuberculosis
VTAAATPGWLEWFINWYLPISQLFTTPWVCHISP

SEQ ID NO: 1531597 - protein, 19 aa, Mycobacterium tuberculosis
VTAAPEMGPVGVGGVAGGV

SEQ ID NO: 1531598 - protein, 24 aa, Mycobacterium tuberculosis
VTAAPLPGLGFTQPLPPAADDHIA

SEQ ID NO: 1531599 - protein, 17 aa, Mycobacterium tuberculosis
VTAMGRARRRLLVTAVD

SEQ ID NO: 1531600 - protein, 22 aa, Mycobacterium tuberculosis
VTASPYLGFGSLRPLLEVAAAH

SEQ ID NO: 1531601 - protein, 24 aa, Mycobacterium tuberculosis
VTATNHPLVLGDWKQFLIGDRVGS

SEQ ID NO: 1531602 - protein, 26 aa, Mycobacterium tuberculosis
VTCGAAPEPWFGRDGGLGGNGGAGGQ

SEQ ID NO: 1531603 - protein, 25 aa, Mycobacterium tuberculosis
VTDGRNILPPNKFPYIPPGADPDPG

SEQ ID NO: 1531604 - protein, 26 aa, Mycobacterium tuberculosis
VTDGRNILPPNKFPYIPPGADPDPGV

SEQ ID NO: 1531605 - protein, 17 aa, Mycobacterium tuberculosis
VTDLARAIPVPTQFEFM

SEQ ID NO: 1531606 - protein, 19 aa, Mycobacterium tuberculosis
VTDRRVLLTLPISHVYGLP

SEQ ID NO: 1531607 - protein, 24 aa, Mycobacterium tuberculosis
VTDSYLRCLRVLTAGRGYPMVATH

SEQ ID NO: 1531608 - protein, 37 aa, Mycobacterium tuberculosis
VTEASTVFPQTFYLSGLFFFGPVNLSASTLTVPTITL

SEQ ID NO: 1531609 - protein, 26 aa, Mycobacterium tuberculosis
VTEIIPLDGFLDGLALYDELDFAELD

SEQ ID NO: 1531610 - protein, 27 aa, Mycobacterium tuberculosis
VTEIIPLDGFLDGLALYDELDFAELDD

SEQ ID NO: 1531611 - protein, 21 aa, Mycobacterium tuberculosis
VTELLPFGRPQLAGGPLGSVA

SEQ ID NO: 1531612 - protein, 17 aa, Mycobacterium tuberculosis
VTEMLWGNGLQISDIDL

SEQ ID NO: 1531613 - protein, 29 aa, Mycobacterium tuberculosis
VTFAQPYPAWRELFTDILPAHIVKDIPGG

SEQ ID NO: 1531614 - protein, 37 aa, Mycobacterium tuberculosis
VTGENRLKIARLLALIDMLSDRFIGEPASWLEMPIQA

SEQ ID NO: 1531615 - protein, 23 aa, Mycobacterium tuberculosis
VTGFGVHPVLLDAALHAVVLSAE

SEQ ID NO: 1531616 - protein, 34 aa, Mycobacterium tuberculosis
VTHFSVGPIIVPRIAGTLPVIDINIGDPGGSSSI

SEQ ID NO: 1531617 - protein, 29 aa, Mycobacterium tuberculosis
VTHLPAAGRVTWRWCSRTTRLYPNMTVAA

SEQ ID NO: 1531618 - protein, 23 aa, Mycobacterium tuberculosis
VTHVLLPVSALLRRADTAAVIVS

SEQ ID NO: 1531619 - protein, 24 aa, Mycobacterium tuberculosis
VTIPGFAINPFGLDVPLSGGTNAV

SEQ ID NO: 1531620 - protein, 25 aa, Mycobacterium tuberculosis
VTIPGFAINPFGLDVPLSGGTSPVT

SEQ ID NO: 1531621 - protein, 22 aa, Mycobacterium tuberculosis
VTIPGFAINPFGLNVPLSGGTN

SEQ ID NO: 1531622 - protein, 30 aa, Mycobacterium tuberculosis
VTIRPAPDTMTWVTALLPVARGVSVYAALK

SEQ ID NO: 1531623 - protein, 25 aa, Mycobacterium tuberculosis
VTIVNLIRVLLRNPAVWEKTALIIA

SEQ ID NO: 1531624 - protein, 25 aa, Mycobacterium tuberculosis
VTIYYTAPTLIRMFMKWGREIPDSH

SEQ ID NO: 1531625 - protein, 18 aa, Mycobacterium tuberculosis
VTLMEFHLMYAAVVGGHA

SEQ ID NO: 1531626 - protein, 28 aa, Mycobacterium tuberculosis
VTLVDWDELPRWSMIDQALGLGSPDPAE

SEQ ID NO: 1531627 - protein, 31 aa, Mycobacterium tuberculosis
VTNLAPAAWWRQLSWLPQRPVLVPGTVRHNL

SEQ ID NO: 1531628 - protein, 17 aa, Mycobacterium tuberculosis
VTPLLNSINAPVLAATG

SEQ ID NO: 1531629 - protein, 23 aa, Mycobacterium tuberculosis
VTRCPWRRVIGWVTKSRSTWAAD

SEQ ID NO: 1531630 - protein, 31 aa, Mycobacterium tuberculosis
VTSATPARALGLTGVGRLAAGYAANLVVLDR

SEQ ID NO: 1531631 - protein, 25 aa, Mycobacterium tuberculosis
VTSCWPTWTMRVGTPSWLSICLPRC

SEQ ID NO: 1531632 - protein, 28 aa, Mycobacterium tuberculosis
VTSLGLVQLTRKRLGTGLIEAFSTSCPN

SEQ ID NO: 1531633 - protein, 20 aa, Mycobacterium tuberculosis
VTSRALTVLWQREARYLNED

SEQ ID NO: 1531634 - protein, 27 aa, Mycobacterium tuberculosis
VTSVSIPSWWQPYVLSVASLTSAGQPS

SEQ ID NO: 1531635 - protein, 21 aa, Mycobacterium tuberculosis
VTTALGEGCCFRVSLPRVSDV

SEQ ID NO: 1531636 - protein, 21 aa, Mycobacterium tuberculosis
VTTIVVLRHAPPAPWIPVDQR

SEQ ID NO: 1531637 - protein, 30 aa, Mycobacterium tuberculosis
VTTRLRFNFFVLKLPIRPPALVAKQAGSLA

SEQ ID NO: 1531638 - protein, 21 aa, Mycobacterium tuberculosis
VTVARRPVCPVTLTPGDPALA

SEQ ID NO: 1531639 - protein, 21 aa, Mycobacterium tuberculosis
VTVFFDGATLHALITGTPLST

SEQ ID NO: 1531640 - protein, 17 aa, Mycobacterium tuberculosis
VTVLFLVKLVDPHARLR

SEQ ID NO: 1531641 - protein, 25 aa, Mycobacterium tuberculosis
VTVYAPGDWSVFDALAKMAGEVMPV

SEQ ID NO: 1531642 - protein, 29 aa, Mycobacterium tuberculosis
VTYPSIYDPAMRTLIAFGGKYPTSVIPST

SEQ ID NO: 1531643 - protein, 19 aa, Mycobacterium tuberculosis
VTYPTDSPFRGVKKVHYWA

SEQ ID NO: 1531644 - protein, 17 aa, Mycobacterium tuberculosis
VVAADWPLLAAAYRTRG

SEQ ID NO: 1531645 - protein, 28 aa, Mycobacterium tuberculosis
VVAANRGLMQLLAATNWFGQNAPALMDV

SEQ ID NO: 1531646 - protein, 17 aa, Mycobacterium tuberculosis
VVAANRSAFVQLVLSNV

SEQ ID NO: 1531647 - protein, 23 aa, Mycobacterium tuberculosis
VVAARLPFGWSADSGVTADIIEA

SEQ ID NO: 1531648 - protein, 22 aa, Mycobacterium tuberculosis
VVADRRRYYLGSISGKKVIVAM

SEQ ID NO: 1531649 - protein, 18 aa, Mycobacterium tuberculosis
VVADRWFPSLSVEPTVRP

SEQ ID NO: 1531650 - protein, 18 aa, Mycobacterium tuberculosis
VVAGNPGDPGGFGAAGAD

SEQ ID NO: 1531651 - protein, 19 aa, Mycobacterium tuberculosis
VVAKIYCGLGLLKRENIRE

SEQ ID NO: 1531652 - protein, 18 aa, Mycobacterium tuberculosis
VVALRRRGHLDDLEAMRV

SEQ ID NO: 1531653 - protein, 17 aa, Mycobacterium tuberculosis
VVALSWAQRPSPTAELG

SEQ ID NO: 1531654 - protein, 24 aa, Mycobacterium tuberculosis
VVALTREVLGAGIPLFGICFGNQI

SEQ ID NO: 1531655 - protein, 23 aa, Mycobacterium tuberculosis
VVARFLPYFTDVIVGDLRVGKTV

SEQ ID NO: 1531656 - protein, 21 aa, Mycobacterium tuberculosis
VVATVPQLVQLAPHAVQMSQN

SEQ ID NO: 1531657 - protein, 22 aa, Mycobacterium tuberculosis
VVDELVFCGHRWRFRLELTEEQ

SEQ ID NO: 1531658 - protein, 23 aa, Mycobacterium tuberculosis
VVDLLNMIDPLKLNAVLTAVADA

SEQ ID NO: 1531659 - protein, 17 aa, Mycobacterium tuberculosis
VVDLRAAAGWLGFGSDM

SEQ ID NO: 1531660 - protein, 18 aa, Mycobacterium tuberculosis
VVDPQWVWPISPALTELA

SEQ ID NO: 1531661 - protein, 23 aa, Mycobacterium tuberculosis
VVDSGLTLSWLSRNLTSRNPRSL

SEQ ID NO: 1531662 - protein, 26 aa, Mycobacterium tuberculosis
VVDVPVQAWGWLSLAAGLAVLDSVAP

SEQ ID NO: 1531663 - protein, 26 aa, Mycobacterium tuberculosis
VVEEPPPSTVFLLCAPSVDPEDIAVT

SEQ ID NO: 1531664 - protein, 18 aa, Mycobacterium tuberculosis
VVEPLRATDFSLPLARMV

SEQ ID NO: 1531665 - protein, 28 aa, Mycobacterium tuberculosis
VVFSQGVAIMIWTLMNARNSRDSLLTTH

SEQ ID NO: 1531666 - protein, 21 aa, Mycobacterium tuberculosis
VVGIFPDRASIIRLVGAVLAE

SEQ ID NO: 1531667 - protein, 17 aa, Mycobacterium tuberculosis
VVGLLAAGVLARLPVKT

SEQ ID NO: 1531668 - protein, 21 aa, Mycobacterium tuberculosis
VVGLPMRCVFALTAMGFLPQS

SEQ ID NO: 1531669 - protein, 21 aa, Mycobacterium tuberculosis
VVHLASPALLGYGGLHAARRL

SEQ ID NO: 1531670 - protein, 19 aa, Mycobacterium tuberculosis
VVHPIAHLAIPVTFSRRRD

SEQ ID NO: 1531671 - protein, 33 aa, Mycobacterium tuberculosis
VVHRYGMAFHRPGPRLRYLLAVKACFAVFQNRD

SEQ ID NO: 1531672 - protein, 33 aa, Mycobacterium tuberculosis
VVHRYGMAFHRPGPRLRYLLAVKACFAVFQTGT

SEQ ID NO: 1531673 - protein, 17 aa, Mycobacterium tuberculosis
VVITERGIPIARLAALD

SEQ ID NO: 1531674 - protein, 23 aa, Mycobacterium tuberculosis
VVKDVFVPRHRFLSYKAMNDHTA

SEQ ID NO: 1531675 - protein, 17 aa, Mycobacterium tuberculosis
VVKGGRRFSFTALVIVG

SEQ ID NO: 1531676 - protein, 22 aa, Mycobacterium tuberculosis
VVKLLNRFFAIVVNEVDRHHGL

SEQ ID NO: 1531677 - protein, 22 aa, Mycobacterium tuberculosis
VVLARTGVVLSPAGGMLRRMRP

SEQ ID NO: 1531678 - protein, 26 aa, Mycobacterium tuberculosis
VVLAVPTQMWGFTNPLPPGSDEHIAA

SEQ ID NO: 1531679 - protein, 17 aa, Mycobacterium tuberculosis
VVLKGGAIAWAAMGDAN

SEQ ID NO: 1531680 - protein, 20 aa, Mycobacterium tuberculosis
VVLPQRLTDLVGGFLPNLHQ

SEQ ID NO: 1531681 - protein, 24 aa, Mycobacterium tuberculosis
VVLPQRLTDLVGGFLPNLHQRLVA

SEQ ID NO: 1531682 - protein, 17 aa, Mycobacterium tuberculosis
VVLPVRHAHMAHAAMPG

SEQ ID NO: 1531683 - protein, 19 aa, Mycobacterium tuberculosis
VVLPWRRVRWSDTAHTAEA

SEQ ID NO: 1531684 - protein, 22 aa, Mycobacterium tuberculosis
VVLQIPSLHDPSLAPAGKQAAS

SEQ ID NO: 1531685 - protein, 17 aa, Mycobacterium tuberculosis
VVLVPAALRWHGTDFVA

SEQ ID NO: 1531686 - protein, 17 aa, Mycobacterium tuberculosis
VVLYLRPPGPAQACGLF

SEQ ID NO: 1531687 - protein, 18 aa, Mycobacterium tuberculosis
VVMLALPGVVFLYNGQEL

SEQ ID NO: 1531688 - protein, 21 aa, Mycobacterium tuberculosis
VVMNVVPARAAGVDSLVVASP

SEQ ID NO: 1531689 - protein, 17 aa, Mycobacterium tuberculosis
VVNDYYDRSGLWPYLEK

SEQ ID NO: 1531690 - protein, 25 aa, Mycobacterium tuberculosis
VVNLNGLDFMGCCAVAVLAHKAERC

SEQ ID NO: 1531691 - protein, 27 aa, Mycobacterium tuberculosis
VVPAVPAARVPPWARPVRQGRPAAPET

SEQ ID NO: 1531692 - protein, 21 aa, Mycobacterium tuberculosis
VVPDITIPGIPLSLNALGGVG

SEQ ID NO: 1531693 - protein, 29 aa, Mycobacterium tuberculosis
VVPDITIPGIPLSLNALGGVGPITVPGVP

SEQ ID NO: 1531694 - protein, 17 aa, Mycobacterium tuberculosis
VVPHFEKMLYDNALLLR

SEQ ID NO: 1531695 - protein, 17 aa, Mycobacterium tuberculosis
VVPVLPLSDTIKAVDAN

SEQ ID NO: 1531696 - protein, 29 aa, Mycobacterium tuberculosis
VVPWAEFAAAISGFWVPAPPALLAVESVR

SEQ ID NO: 1531697 - protein, 18 aa, Mycobacterium tuberculosis
VVQQWRIRTESEVTADEL

SEQ ID NO: 1531698 - protein, 25 aa, Mycobacterium tuberculosis
VVQTPQPYWYWALDRESIGGSVSAA

SEQ ID NO: 1531699 - protein, 23 aa, Mycobacterium tuberculosis
VVRAFFNVVPFAVRARQSQPTGM

SEQ ID NO: 1531700 - protein, 20 aa, Mycobacterium tuberculosis
VVRDPLSRLPMIPGTSLKGK

SEQ ID NO: 1531701 - protein, 17 aa, Mycobacterium tuberculosis
VVRFQEAANKQKQKLDE

SEQ ID NO: 1531702 - protein, 26 aa, Mycobacterium tuberculosis
VVRTVGQLHPRLGQRRLRILGAGQQR

SEQ ID NO: 1531703 - protein, 26 aa, Mycobacterium tuberculosis
VVSHVTPIKMLLRLALDAGSGVLYRL

SEQ ID NO: 1531704 - protein, 23 aa, Mycobacterium tuberculosis
VVSKPAALVHGMFVALPAATADA

SEQ ID NO: 1531705 - protein, 17 aa, Mycobacterium tuberculosis
VVTEHFLRSVFRDAPHE

SEQ ID NO: 1531706 - protein, 17 aa, Mycobacterium tuberculosis
VVTGEGPVRRRRTWTSK

SEQ ID NO: 1531707 - protein, 18 aa, Mycobacterium tuberculosis
VVTGRRPGQPGELTGVRR

SEQ ID NO: 1531708 - protein, 21 aa, Mycobacterium tuberculosis
VVTHDRWFLDEVATTTWEVHD

SEQ ID NO: 1531709 - protein, 21 aa, Mycobacterium tuberculosis
VVVAADWPLLAAAYRTRGALR

SEQ ID NO: 1531710 - protein, 22 aa, Mycobacterium tuberculosis
VVVAADWPLLAAAYRTRGALRI

SEQ ID NO: 1531711 - protein, 23 aa, Mycobacterium tuberculosis
VVVAADWPLLAAAYRTRGALRIV

SEQ ID NO: 1531712 - protein, 18 aa, Mycobacterium tuberculosis
VVVGADRGALLAGLAALA

SEQ ID NO: 1531713 - protein, 17 aa, Mycobacterium tuberculosis
VVVLHRFLRWRQRDYAP

SEQ ID NO: 1531714 - protein, 22 aa, Mycobacterium tuberculosis
VVVPGGISRFRPSRRLVPDRSV

SEQ ID NO: 1531715 - protein, 26 aa, Mycobacterium tuberculosis
VVVRVRHLVKPTGWPRAWCCAGRSAR

SEQ ID NO: 1531716 - protein, 18 aa, Mycobacterium tuberculosis
VVVVSIFVNPMQFGAGED

SEQ ID NO: 1531717 - protein, 18 aa, Mycobacterium tuberculosis
VVWGLTTGSWIGSSAGLM

SEQ ID NO: 1531718 - protein, 22 aa, Mycobacterium tuberculosis
VVWRGPMLHRALQQFLADVYWG

SEQ ID NO: 1531719 - protein, 17 aa, Mycobacterium tuberculosis
VVWWQVVLQLPLLPGWP

SEQ ID NO: 1531720 - protein, 18 aa, Mycobacterium tuberculosis
VWAMVATVQHNKGCITAA

SEQ ID NO: 1531721 - protein, 18 aa, Mycobacterium tuberculosis
VWAQRWLNPGYAAVGSVD

SEQ ID NO: 1531722 - protein, 17 aa, Mycobacterium tuberculosis
VWELPPHAGAQAGGDVL

SEQ ID NO: 1531723 - protein, 20 aa, Mycobacterium tuberculosis
VWELYYLPDDFSQAKNLAAE

SEQ ID NO: 1531724 - protein, 18 aa, Mycobacterium tuberculosis
VWIPAGVPQKIRALGSVP

SEQ ID NO: 1531725 - protein, 18 aa, Mycobacterium tuberculosis
VWQPQPAAELPMTQRYFL

SEQ ID NO: 1531726 - protein, 22 aa, Mycobacterium tuberculosis
VWRSLNWITVPKVKRFAAKDAT

SEQ ID NO: 1531727 - protein, 17 aa, Mycobacterium tuberculosis
VWRTFGQERLDAMASVA

SEQ ID NO: 1531728 - protein, 19 aa, Mycobacterium tuberculosis
VWSVWGVGGAILLRDALHA

SEQ ID NO: 1531729 - protein, 24 aa, Mycobacterium tuberculosis
VWTRDGWVDRFGLDLPRHDTGYGH

SEQ ID NO: 1531730 - protein, 28 aa, Mycobacterium tuberculosis
VWVASCQQRCPPRQFERARVVVFAGDHG

SEQ ID NO: 1531731 - protein, 21 aa, Mycobacterium tuberculosis
VYALQSALPPRFQASAAFAAN

SEQ ID NO: 1531732 - protein, 17 aa, Mycobacterium tuberculosis
VYATLRAIAASAGVSVG

SEQ ID NO: 1531733 - protein, 25 aa, Mycobacterium tuberculosis
VYDLANRGLLPPTFSLVGFARRDWS

SEQ ID NO: 1531734 - protein, 25 aa, Mycobacterium tuberculosis
VYKRSLAVFFLSEPPEGFDTLRDFR

SEQ ID NO: 1531735 - protein, 18 aa, Mycobacterium tuberculosis
VYMLYAPPAGATTEIPLP

SEQ ID NO: 1531736 - protein, 18 aa, Mycobacterium tuberculosis
VYPGAATAGCFFYSKCRY

SEQ ID NO: 1531737 - protein, 18 aa, Mycobacterium tuberculosis
VYPITTLPDHHSHGYCPV

SEQ ID NO: 1531738 - protein, 17 aa, Mycobacterium tuberculosis
VYRVGQNVAWQRWTEIA

SEQ ID NO: 1531739 - protein, 47 aa, Mycobacterium tuberculosis
VYSGLDLPPNTAVTVIFFGPVDIDPFTVPVIRITGPTPVVMVGGPTT

SEQ ID NO: 1531740 - protein, 26 aa, Mycobacterium tuberculosis
VYSLGCVLYEVLTGEPPFTGDSPVSV

SEQ ID NO: 1531741 - protein, 31 aa, Mycobacterium tuberculosis
VYTGYAPVIGAPWLVAFAERSRFFEVFSSSN

SEQ ID NO: 1531742 - protein, 18 aa, Mycobacterium tuberculosis
VYVRATRVPPIAGGVSGV

SEQ ID NO: 1531743 - protein, 19 aa, Mycobacterium tuberculosis
VYVRSFYFQDPDGITLEFA

SEQ ID NO: 1531744 - protein, 18 aa, Mycobacterium tuberculosis
VYYVEPAKWVAALRHAKT

SEQ ID NO: 1531745 - protein, 17 aa, Mycobacterium tuberculosis
WAAAYPGVWAGPTNSWS

SEQ ID NO: 1531746 - protein, 19 aa, Mycobacterium tuberculosis
WAARLLAMRCGATGLKTSP

SEQ ID NO: 1531747 - protein, 25 aa, Mycobacterium tuberculosis
WADGRTLLLGSPSLLRAEKVRVSKK

SEQ ID NO: 1531748 - protein, 30 aa, Mycobacterium tuberculosis; identical to SEQ ID NO: 237084

SEQ ID NO: 1531749 - protein, 17 aa, Mycobacterium tuberculosis
WAGQQPGFRGERLVNSM

SEQ ID NO: 1531750 - protein, 24 aa, Mycobacterium tuberculosis
WAINPMFIDPLPQHAPYVCGEAFI

SEQ ID NO: 1531751 - protein, 20 aa, Mycobacterium tuberculosis
WAKTWEFQALLKARPVVGDA

SEQ ID NO: 1531752 - protein, 17 aa, Mycobacterium tuberculosis
WALDLVESPPQLVGAMI

SEQ ID NO: 1531753 - protein, 19 aa, Mycobacterium tuberculosis
WANADLISWTFQGPNWAFG

SEQ ID NO: 1531754 - protein, 20 aa, Mycobacterium tuberculosis
WAPDYPVGAQVRRADPFLTV

SEQ ID NO: 1531755 - protein, 17 aa, Mycobacterium tuberculosis
WAPTSPATSAPPPSFRP

SEQ ID NO: 1531756 - protein, 19 aa, Mycobacterium tuberculosis
WAQDVAAMFGYHAGASAAV

SEQ ID NO: 1531757 - protein, 17 aa, Mycobacterium tuberculosis
WARTAVGLARDVAEAFA

SEQ ID NO: 1531758 - protein, 18 aa, Mycobacterium tuberculosis
WAWRRHIARRRWPSPMRK

SEQ ID NO: 1531759 - protein, 17 aa, Mycobacterium tuberculosis
WCGDRLRPVLFDPTQRA

SEQ ID NO: 1531760 - protein, 18 aa, Mycobacterium tuberculosis
WCTPAMTVWAQRWLNPGY

SEQ ID NO: 1531761 - protein, 18 aa, Mycobacterium tuberculosis
WDDLLLPGIEVITPSPLS

SEQ ID NO: 1531762 - protein, 18 aa, Mycobacterium tuberculosis
WDGLADELAVAASWFGSV

SEQ ID NO: 1531763 - protein, 19 aa, Mycobacterium tuberculosis
WDLAGLFDPDPDAAGACYT

SEQ ID NO: 1531764 - protein, 19 aa, Mycobacterium tuberculosis
WDLLRLTRMPTVQVDIGYI

SEQ ID NO: 1531765 - protein, 24 aa, Mycobacterium tuberculosis
WDMLRSNLLQLLIDGTVRPHEPAY

SEQ ID NO: 1531766 - protein, 17 aa, Mycobacterium tuberculosis
WDVPSDLAYLAEGFTAI

SEQ ID NO: 1531767 - protein, 19 aa, Mycobacterium tuberculosis
WDWAVDWDTWVSMSALPPP

SEQ ID NO: 1531768 - protein, 19 aa, Mycobacterium tuberculosis
WEAAVPAVPVALVAPPAPS

SEQ ID NO: 1531769 - protein, 29 aa, Mycobacterium tuberculosis
WEDIGWLRELWGGPFMLKGVMRVDDAKRA

SEQ ID NO: 1531770 - protein, 19 aa, Mycobacterium tuberculosis
WEDKRLGIIIAGFDRRRIP

SEQ ID NO: 1531771 - protein, 24 aa, Mycobacterium tuberculosis
WEDKRLGIIIAGFDRRRIPLVAEI

SEQ ID NO: 1531772 - protein, 34 aa, Mycobacterium tuberculosis
WEEADRREGLARWLARWRPCTPPVESFYSSEGLP

SEQ ID NO: 1531773 - protein, 19 aa, Mycobacterium tuberculosis
WEEFIPFLDYDVEIRRVPC

SEQ ID NO: 1531774 - protein, 17 aa, Mycobacterium tuberculosis
WELETYGALFDRTDDGR

SEQ ID NO: 1531775 - protein, 18 aa, Mycobacterium tuberculosis
WELYYLPDDFSQAKNLAA

SEQ ID NO: 1531776 - protein, 18 aa, Mycobacterium tuberculosis
WFALPPEQLDLARVRPEY

SEQ ID NO: 1531777 - protein, 32 aa, Mycobacterium tuberculosis
WFGENVPISPIWLCPLRLRDHAGWPLYPIRPD

SEQ ID NO: 1531778 - protein, 20 aa, Mycobacterium tuberculosis
WFIRAMGGGRRASGGTGGGP

SEQ ID NO: 1531779 - protein, 19 aa, Mycobacterium tuberculosis
WFPDSYPWVPSINPGLNFY

SEQ ID NO: 1531780 - protein, 21 aa, Mycobacterium tuberculosis
WFRRESQAYGIPFPPVGDRVS

SEQ ID NO: 1531781 - protein, 28 aa, Mycobacterium tuberculosis
WFTSAPMCDIFLVLAQAPDGLSCFLLPR

SEQ ID NO: 1531782 - protein, 17 aa, Mycobacterium tuberculosis
WFTSTFAAPTAAQASAW

SEQ ID NO: 1531783 - protein, 18 aa, Mycobacterium tuberculosis
WFTVGYQTGDPNICDTFS

SEQ ID NO: 1531784 - protein, 20 aa, Mycobacterium tuberculosis
WGDLDVLLLDLPPGTGDVAI

SEQ ID NO: 1531785 - protein, 31 aa, Mycobacterium tuberculosis
WGGCRTARPRRPSAWAWPTSGSGIWVAQTSA

SEQ ID NO: 1531786 - protein, 21 aa, Mycobacterium tuberculosis
WGITIWRARFCLRCSTGVMTS

SEQ ID NO: 1531787 - protein, 18 aa, Mycobacterium tuberculosis
WGLDEILLLSTGPAEIDA

SEQ ID NO: 1531788 - protein, 17 aa, Mycobacterium tuberculosis
WGNFGLGNSGLTPGLMG

SEQ ID NO: 1531789 - protein, 17 aa, Mycobacterium tuberculosis
WGPDWVVWDAAKTAQQH

SEQ ID NO: 1531790 - protein, 23 aa, Mycobacterium tuberculosis
WGQARHNYFLRPSDLARAIAFVA

SEQ ID NO: 1531791 - protein, 22 aa, Mycobacterium tuberculosis
WGSDAYTPLAWWGSSTQRVRLG

SEQ ID NO: 1531792 - protein, 18 aa, Mycobacterium tuberculosis
WGSFLPDIDAFDAEFFEI

SEQ ID NO: 1531793 - protein, 20 aa, Mycobacterium tuberculosis
WGSFLPDIDAFDAEFFEISP

SEQ ID NO: 1531794 - protein, 17 aa, Mycobacterium tuberculosis
WGVLPDFVMGHSVGELA

SEQ ID NO: 1531795 - protein, 17 aa, Mycobacterium tuberculosis
WGYPQPRSGQRARRATG

SEQ ID NO: 1531796 - protein, 31 aa, Mycobacterium tuberculosis
WHAESSWAARVSLAHALIGWTRGTGLMGHND

SEQ ID NO: 1531797 - protein, 25 aa, Mycobacterium tuberculosis
WHGAVGLGWPRCRRFYRPPHRQRRS

SEQ ID NO: 1531798 - protein, 17 aa, Mycobacterium tuberculosis
WHNWRVTWNPSGMYFWL

SEQ ID NO: 1531799 - protein, 18 aa, Mycobacterium tuberculosis
WHPVLNLASARLIAATNA

SEQ ID NO: 1531800 - protein, 17 aa, Mycobacterium tuberculosis
WICKPVIPKPRGWSNVS

SEQ ID NO: 1531801 - protein, 19 aa, Mycobacterium tuberculosis
WIKVVCFPDRWLDLRYVGP

SEQ ID NO: 1531802 - protein, 19 aa, Mycobacterium tuberculosis
WILRDLGVYAIRLSDDVPG

SEQ ID NO: 1531803 - protein, 23 aa, Mycobacterium tuberculosis
WISGPQYQAWKHTQLIIDVVPGR

SEQ ID NO: 1531804 - protein, 24 aa, Mycobacterium tuberculosis
WKASLQGVLATRPDFVFGAEPYNA

SEQ ID NO: 1531805 - protein, 18 aa, Mycobacterium tuberculosis
WKNVRLPERTRYVLSITW

SEQ ID NO: 1531806 - protein, 17 aa, Mycobacterium tuberculosis
WLAALRGSARLVIGTRS

SEQ ID NO: 1531807 - protein, 21 aa, Mycobacterium tuberculosis
WLADHSVAGVTIFPGAGFVEL

SEQ ID NO: 1531808 - protein, 27 aa, Mycobacterium tuberculosis
WLAGQGFSNLLLAYPPTDRAALRALGE

SEQ ID NO: 1531809 - protein, 19 aa, Mycobacterium tuberculosis
WLALLRQFAPDRVGALEVL

SEQ ID NO: 1531810 - protein, 17 aa, Mycobacterium tuberculosis
WLAWQDGTQLCFEGEFY

SEQ ID NO: 1531811 - protein, 19 aa, Mycobacterium tuberculosis
WLEEVLRPALGERLRVLDG

SEQ ID NO: 1531812 - protein, 19 aa, Mycobacterium tuberculosis
WLETRWKKRTTTPDVRAVV

SEQ ID NO: 1531813 - protein, 18 aa, Mycobacterium tuberculosis
WLISWVPGQPTELHDHGG

SEQ ID NO: 1531814 - protein, 19 aa, Mycobacterium tuberculosis
WLMGLASAASRRKITRKPA

SEQ ID NO: 1531815 - protein, 20 aa, Mycobacterium tuberculosis
WLRLYHQRLPLDMATPVIDG

SEQ ID NO: 1531816 - protein, 17 aa, Mycobacterium tuberculosis
WLRSLVMAGARERYGPP

SEQ ID NO: 1531817 - protein, 25 aa, Mycobacterium tuberculosis
WLSSSAWPWQPYLLSHHQGGIAVTD

SEQ ID NO: 1531818 - protein, 18 aa, Mycobacterium tuberculosis
WLVETTLLRRRAVGKLGE

SEQ ID NO: 1531819 - protein, 18 aa, Mycobacterium tuberculosis
WMAAMRRHGYKGAFEMAA

SEQ ID NO: 1531820 - protein, 19 aa, Mycobacterium tuberculosis
WNPDDKTRLIKRLQAILTD

SEQ ID NO: 1531821 - protein, 20 aa, Mycobacterium tuberculosis
WNWTELPSALGVTNHLAFRA

SEQ ID NO: 1531822 - protein, 17 aa, Mycobacterium tuberculosis
WPAGRRAAAPRLGWITR

SEQ ID NO: 1531823 - protein, 17 aa, Mycobacterium tuberculosis
WPATADTSSQLTKKIRL

SEQ ID NO: 1531824 - protein, 18 aa, Mycobacterium tuberculosis
WPAVVFTLVTLLDDPVAA

SEQ ID NO: 1531825 - protein, 21 aa, Mycobacterium tuberculosis
WPFVARLLYGRRSLVLVHHCH

SEQ ID NO: 1531826 - protein, 21 aa, Mycobacterium tuberculosis
WPGAYGTWWQADPSADLILLY

SEQ ID NO: 1531827 - protein, 20 aa, Mycobacterium tuberculosis
WPGCHPKDPTIYRRAASERD

SEQ ID NO: 1531828 - protein, 20 aa, Mycobacterium tuberculosis
WPGRRFEGAGPAGWIRRCAT

SEQ ID NO: 1531829 - protein, 38 aa, Mycobacterium tuberculosis
WPHGRMRYYIAMLAELSRLRPLPFRLVLDGTEEIVADL

SEQ ID NO: 1531830 - protein, 26 aa, Mycobacterium tuberculosis
WPPNIQLKAYYLPSEDRRIKVRVSAQ

SEQ ID NO: 1531831 - protein, 20 aa, Mycobacterium tuberculosis
WPRRMGRIPKQLLSGVPAHV

SEQ ID NO: 1531832 - protein, 17 aa, Mycobacterium tuberculosis
WPRYFAALEQLVRPGGP

SEQ ID NO: 1531833 - protein, 23 aa, Mycobacterium tuberculosis
WPSGLLAVRGRPRLLAGPSGRAG

SEQ ID NO: 1531834 - protein, 19 aa, Mycobacterium tuberculosis
WPWQPYLLSHHQGGIAVTD

SEQ ID NO: 1531835 - protein, 18 aa, Mycobacterium tuberculosis
WQCTIPLGPDPDDEGDIV

SEQ ID NO: 1531836 - protein, 20 aa, Mycobacterium tuberculosis
WQLSLFIPDGVPPPPGDPVP

SEQ ID NO: 1531837 - protein, 26 aa, Mycobacterium tuberculosis
WQTITRELWPAPYLVMDTGASLAPYN

SEQ ID NO: 1531838 - protein, 19 aa, Mycobacterium tuberculosis
WRARCIVSAPWMGLAGVPS

SEQ ID NO: 1531839 - protein, 18 aa, Mycobacterium tuberculosis
WRGDHEGLFGLSYGITIP

SEQ ID NO: 1531840 - protein, 27 aa, Mycobacterium tuberculosis
WRGGARPVFWLSLDGGRPRCARLSPRF

SEQ ID NO: 1531841 - protein, 29 aa, Mycobacterium tuberculosis
WRMYTRARFAPYVEKLLLDGARTKLTRAA

SEQ ID NO: 1531842 - protein, 19 aa, Mycobacterium tuberculosis
WRRRRALWVGVTLGGAVDS

SEQ ID NO: 1531843 - protein, 20 aa, Mycobacterium tuberculosis
WRRWAGGAGGAFLGDGGNGG

SEQ ID NO: 1531844 - protein, 20 aa, Mycobacterium tuberculosis
WRTYFRLRPNAFAAGERERI

SEQ ID NO: 1531845 - protein, 18 aa, Mycobacterium tuberculosis
WRVYRLVPRRRGARLGIG

SEQ ID NO: 1531846 - protein, 19 aa, Mycobacterium tuberculosis
WRWLAHTLTVELLKELLPE

SEQ ID NO: 1531847 - protein, 17 aa, Mycobacterium tuberculosis
WRWLRGSTGLAGRITTA

SEQ ID NO: 1531848 - protein, 19 aa, Mycobacterium tuberculosis
WRWRLSLLEGCTVSSGAFS

SEQ ID NO: 1531849 - protein, 18 aa, Mycobacterium tuberculosis
WRWRQRVGSWKGRMPNLV

SEQ ID NO: 1531850 - protein, 17 aa, Mycobacterium tuberculosis
WRWRVCPTSLELFSRPD

SEQ ID NO: 1531851 - protein, 17 aa, Mycobacterium tuberculosis
WSDFVEVHWSRWGEAYV

SEQ ID NO: 1531852 - protein, 17 aa, Mycobacterium tuberculosis
WSDWYAWATPEGCRAEM

SEQ ID NO: 1531853 - protein, 25 aa, Mycobacterium tuberculosis
WSGARRWWRRPCRPTCPEAPPTSII

SEQ ID NO: 1531854 - protein, 26 aa, Mycobacterium tuberculosis
WSLLSRRRSHHLRGIRPERDQWGRRH

SEQ ID NO: 1531855 - protein, 30 aa, Mycobacterium tuberculosis
WSLVEAAAVPVAFLTAFYGLSVLAEVAAGQ

SEQ ID NO: 1531856 - protein, 20 aa, Mycobacterium tuberculosis
WTAPLIEAALKDALIEGLAL

SEQ ID NO: 1531857 - protein, 27 aa, Mycobacterium tuberculosis
WTGSAHSPQRPPWWARRVRAPTPRPTA

SEQ ID NO: 1531858 - protein, 18 aa, Mycobacterium tuberculosis
WTLAMGHAMIRAGLRLKK

SEQ ID NO: 1531859 - protein, 25 aa, Mycobacterium tuberculosis
WTNNFAILAGDYRFATASQLASRLD

SEQ ID NO: 1531860 - protein, 26 aa, Mycobacterium tuberculosis
WTPPSIRGPWTTRPTGWFGVVLGGGG

SEQ ID NO: 1531861 - protein, 20 aa, Mycobacterium tuberculosis
WTPVPLPEPLGSLRDKRTGL

SEQ ID NO: 1531862 - protein, 20 aa, Mycobacterium tuberculosis
WTPVTLLEGGTPLIAATNLS

SEQ ID NO: 1531863 - protein, 17 aa, Mycobacterium tuberculosis
WTQFGRVLKEGLLSDID

SEQ ID NO: 1531864 - protein, 19 aa, Mycobacterium tuberculosis
WTVGVIPKMLVYRELADHD

SEQ ID NO: 1531865 - protein, 25 aa, Mycobacterium tuberculosis
WTWCARTSPPCWVAPAPKPSTRIGH

SEQ ID NO: 1531866 - protein, 17 aa, Mycobacterium tuberculosis
WVAACDAMIALDAPTVV

SEQ ID NO: 1531867 - protein, 27 aa, Mycobacterium tuberculosis
WVASCQQRCPPRQFERARVVVFAGDHG

SEQ ID NO: 1531868 - protein, 22 aa, Mycobacterium tuberculosis
WVDDYPVMLINANAAPDRKRLT

SEQ ID NO: 1531869 - protein, 17 aa, Mycobacterium tuberculosis
WVDNTLATWKRLCDPMA

SEQ ID NO: 1531870 - protein, 17 aa, Mycobacterium tuberculosis
WVGPPEPPAPPFADQQR

SEQ ID NO: 1531871 - protein, 19 aa, Mycobacterium tuberculosis
WVLMHWRAVSADTPHVPVR

SEQ ID NO: 1531872 - protein, 20 aa, Mycobacterium tuberculosis
WVPNDYGLKIERAIDAYLET

SEQ ID NO: 1531873 - protein, 18 aa, Mycobacterium tuberculosis
WVPSINPGLNFYFGEPQV

SEQ ID NO: 1531874 - protein, 22 aa, Mycobacterium tuberculosis
WVPTAFPVEFLSLGASGVGVPV

SEQ ID NO: 1531875 - protein, 26 aa, Mycobacterium tuberculosis
WVQGDNVGLGYWRNPQQTEATFRARL

SEQ ID NO: 1531876 - protein, 45 aa, Mycobacterium tuberculosis
WVQYGFNLTAWAVGWLPYIGILAPQINFFYYLGEPIVQAVLFNAI

SEQ ID NO: 1531877 - protein, 20 aa, Mycobacterium tuberculosis
WVRLYPNRFAGLAAVDLDRP

SEQ ID NO: 1531878 - protein, 22 aa, Mycobacterium tuberculosis
WVTMDFLGFGLSDKPRPHRYSL

SEQ ID NO: 1531879 - protein, 19 aa, Mycobacterium tuberculosis
WVTVGYLDDDGYLFLTGRR

SEQ ID NO: 1531880 - protein, 20 aa, Mycobacterium tuberculosis
WVVRVVLSLMYWPAENDEAE

SEQ ID NO: 1531881 - protein, 17 aa, Mycobacterium tuberculosis
WWGTKAITKRITVWPQG

SEQ ID NO: 1531882 - protein, 20 aa, Mycobacterium tuberculosis
WWQRRAHWRYRLLCERRQWC

SEQ ID NO: 1531883 - protein, 18 aa, Mycobacterium tuberculosis
WYGSSLVVADRWFPSSKT

SEQ ID NO: 1531884 - protein, 17 aa, Mycobacterium tuberculosis
WYLELAKTQLAQGLTHT

SEQ ID NO: 1531885 - protein, 23 aa, Mycobacterium tuberculosis
  misc_feature (1)..(2): Xaa can be any naturally occurring amino acid
XXAGGLIGWAGAAGGTGAGGTGG

SEQ ID NO: 1531886 - protein, 25 aa, Mycobacterium tuberculosis
YAAPSFLPKRPLVEVLRDLASRIYT

SEQ ID NO: 1531887 - protein, 23 aa, Mycobacterium tuberculosis
YAAYYEQWAQPWEIQALLRAHAV

SEQ ID NO: 1531888 - protein, 17 aa, Mycobacterium tuberculosis
YAELGRRHELLSGLVPQ

SEQ ID NO: 1531889 - protein, 20 aa, Mycobacterium tuberculosis
YAEMLLHDLVLVDAGGAVLH

SEQ ID NO: 1531890 - protein, 17 aa, Mycobacterium tuberculosis
YAFAWGSLSAPMGGMGP

SEQ ID NO: 1531891 - protein, 18 aa, Mycobacterium tuberculosis
YAFEITRMLTTLAAEAAL

SEQ ID NO: 1531892 - protein, 17 aa, Mycobacterium tuberculosis
YAGGEILRLLLGHPAYA

SEQ ID NO: 1531893 - protein, 23 aa, Mycobacterium tuberculosis
YAGWWQHLSTLGAVPRVLVWDGE

SEQ ID NO: 1531894 - protein, 22 aa, Mycobacterium tuberculosis
YAHGWVTWFPPDAPPGTERFGP

SEQ ID NO: 1531895 - protein, 22 aa, Mycobacterium tuberculosis
YAHGWVTWFPPDAPPGTERFGS

SEQ ID NO: 1531896 - protein, 19 aa, Mycobacterium tuberculosis
YAIPLLQTAHRTGARVVLR

SEQ ID NO: 1531897 - protein, 17 aa, Mycobacterium tuberculosis
YAIVPGPGSVVGTAITD

SEQ ID NO: 1531898 - protein, 18 aa, Mycobacterium tuberculosis
YALAHDERFGIWGGLSER

SEQ ID NO: 1531899 - protein, 19 aa, Mycobacterium tuberculosis
YALQSALPPRFQSNSAFAA

SEQ ID NO: 1531900 - protein, 25 aa, Mycobacterium tuberculosis
YAQLPVAPMGFIETRYYVSMNVADK

SEQ ID NO: 1531901 - protein, 21 aa, Mycobacterium tuberculosis
YARIAGRPAAVLLHLGPGLGN

SEQ ID NO: 1531902 - protein, 22 aa, Mycobacterium tuberculosis
YARIAGRPAAVLLHLGPGLGNG

SEQ ID NO: 1531903 - protein, 21 aa, Mycobacterium tuberculosis
YARPADLGAHRHRRTARYAER

SEQ ID NO: 1531904 - protein, 18 aa, Mycobacterium tuberculosis
YARTLSTLTWRVVTNATK

SEQ ID NO: 1531905 - protein, 17 aa, Mycobacterium tuberculosis
YARVFLPGGDRIISAGL

SEQ ID NO: 1531906 - protein, 38 aa, Mycobacterium tuberculosis; identical to SEQ ID NO: 237475

SEQ ID NO: 1531907 - protein, 27 aa, Mycobacterium tuberculosis
YASPRQTVISGPPLLIDELIDKVRQQN

SEQ ID NO: 1531908 - protein, 45 aa, Mycobacterium tuberculosis
YASVEAANASPLQVALDVINAPAQTLLGRPLIGNGADGSTPGQAG

SEQ ID NO: 1531909 - protein, 26 aa, Mycobacterium tuberculosis
YATFAKGAMYWSPVTDAQPITGAIYE

SEQ ID NO: 1531910 - protein, 18 aa, Mycobacterium tuberculosis
YATQLMTELSERGEKLPG

SEQ ID NO: 1531911 - protein, 19 aa, Mycobacterium tuberculosis
YAVLNLYPYNPGHLMVVPY

SEQ ID NO: 1531912 - protein, 18 aa, Mycobacterium tuberculosis
YCALACAELLYRAGLPRA

SEQ ID NO: 1531913 - protein, 18 aa, Mycobacterium tuberculosis
YCIQALAHWQRHSGTSLS

SEQ ID NO: 1531914 - protein, 20 aa, Mycobacterium tuberculosis
YCPLALGRLLDNPTVTSIAS

SEQ ID NO: 1531915 - protein, 30 aa, Mycobacterium tuberculosis
YCRTHHLVKTFWGWRDQQLPDGTLILTSPS

SEQ ID NO: 1531916 - protein, 18 aa, Mycobacterium tuberculosis
YCSMSSDPKPREGTETHR

SEQ ID NO: 1531917 - protein, 27 aa, Mycobacterium tuberculosis
YDAFFSLAHRLLPADGVMLLHTITGLH

SEQ ID NO: 1531918 - protein, 19 aa, Mycobacterium tuberculosis
YDAVWRWIDWPERRGRTDT

SEQ ID NO: 1531919 - protein, 21 aa, Mycobacterium tuberculosis
YDAVWRWIDWPERRGRTGTGI

SEQ ID NO: 1531920 - protein, 28 aa, Mycobacterium tuberculosis
YDESNPLPPPWYPQPASLPAAGATGQPG

SEQ ID NO: 1531921 - protein, 20 aa, Mycobacterium tuberculosis
YDKYALTYLGGVLLACAVIH

SEQ ID NO: 1531922 - protein, 25 aa, Mycobacterium tuberculosis
YDLSDDFFRLFLDPTQTYSCAHFER

SEQ ID NO: 1531923 - protein, 17 aa, Mycobacterium tuberculosis
YDMCKAVDRAMTITDIR

SEQ ID NO: 1531924 - protein, 25 aa, Mycobacterium tuberculosis
YDNAPLQRRFPRRIHRYRPFPGQRG

SEQ ID NO: 1531925 - protein, 19 aa, Mycobacterium tuberculosis
YDPHFFTFLEIPEVLSIVD

SEQ ID NO: 1531926 - protein, 18 aa, Mycobacterium tuberculosis
YDPIWPRHGIRIIPGPSS

SEQ ID NO: 1531927 - protein, 18 aa, Mycobacterium tuberculosis
YDPLPWPDDFEVPPMPAP

SEQ ID NO: 1531928 - protein, 25 aa, Mycobacterium tuberculosis
YDPSRIDALLKGRRLTKPLIAAVEG

SEQ ID NO: 1531929 - protein, 34 aa, Mycobacterium tuberculosis
YDPSVDVAILAVPHLPPPPLVFAAEPAKTGADVV

SEQ ID NO: 1531930 - protein, 36 aa, Mycobacterium tuberculosis
YDPSVDVAILAVPHLPPPPLVFAAEPAKTGADVVVL

SEQ ID NO: 1531931 - protein, 17 aa, Mycobacterium tuberculosis
YDVIIRDGLWFDGTGNA

SEQ ID NO: 1531932 - protein, 18 aa, Mycobacterium tuberculosis
YEADYWKARLAETPVDVA

SEQ ID NO: 1531933 - protein, 29 aa, Mycobacterium tuberculosis
YEDRSFTFTLKTPPAAKLLLKAAGVAKGS

SEQ ID NO: 1531934 - protein, 21 aa, Mycobacterium tuberculosis
YEFNLGQIKFATLNITGDCFL

SEQ ID NO: 1531935 - protein, 29 aa, Mycobacterium tuberculosis
YEKTHLPPGAWPPTSWYADWIRGLDVFTT

SEQ ID NO: 1531936 - protein, 18 aa, Mycobacterium tuberculosis
YELEIAFAEILRLSPSSG

SEQ ID NO: 1531937 - protein, 17 aa, Mycobacterium tuberculosis
YEMPHTLAALEVGRLSE

SEQ ID NO: 1531938 - protein, 24 aa, Mycobacterium tuberculosis
YEQFARMLTLMGPSDLWTVERAAR

SEQ ID NO: 1531939 - protein, 26 aa, Mycobacterium tuberculosis
YEQIKDLLGRELLDQRFAGMKQALAG

SEQ ID NO: 1531940 - protein, 28 aa, Mycobacterium tuberculosis
YEQIKDLLGRELLDQRFAGMKQALAGAT

SEQ ID NO: 1531941 - protein, 18 aa, Mycobacterium tuberculosis
YEQMWFQDALVMENYWEA

SEQ ID NO: 1531942 - protein, 22 aa, Mycobacterium tuberculosis
YERYMKYLTGCAKLFRVGYIDV

SEQ ID NO: 1531943 - protein, 21 aa, Mycobacterium tuberculosis
YETVRPKILSPHYSEYQVLEG

SEQ ID NO: 1531944 - protein, 26 aa, Mycobacterium tuberculosis
YEVFIHRLRKYLGAYLAVLGHTDVVS

SEQ ID NO: 1531945 - protein, 27 aa, Mycobacterium tuberculosis
YEVTALNFMPGWLDMLLEVGGGRLSSL

SEQ ID NO: 1531946 - protein, 18 aa, Mycobacterium tuberculosis
YEWFRIMPTAVDVLDSIG

SEQ ID NO: 1531947 - protein, 21 aa, Mycobacterium tuberculosis
YFDVEPRYLPMERGRYVITPE

SEQ ID NO: 1531948 - protein, 26 aa, Mycobacterium tuberculosis
YFGAVRMVLALLPHWRERRFGHVVNV

SEQ ID NO: 1531949 - protein, 20 aa, Mycobacterium tuberculosis
YFGGGRKWATFSGQRRQRRA

SEQ ID NO: 1531950 - protein, 17 aa, Mycobacterium tuberculosis
YFKLYGHEKVKLLDGAA

SEQ ID NO: 1531951 - protein, 17 aa, Mycobacterium tuberculosis
YFLNFDTIGSPELIMLE

SEQ ID NO: 1531952 - protein, 20 aa, Mycobacterium tuberculosis
YFNLANYRNNWKRLGFTDDE

SEQ ID NO: 1531953 - protein, 18 aa, Mycobacterium tuberculosis
YFPDKRAFFAAVVKDEAD

SEQ ID NO: 1531954 - protein, 20 aa, Mycobacterium tuberculosis
YFTKLRIPGARVIPTIYFLR

SEQ ID NO: 1531955 - protein, 17 aa, Mycobacterium tuberculosis
YFTMVENRWKSADTWPP

SEQ ID NO: 1531956 - protein, 25 aa, Mycobacterium tuberculosis
YGAAKLGLVGLINTLALEGAKYNIH

SEQ ID NO: 1531957 - protein, 17 aa, Mycobacterium tuberculosis
YGAALRFAPPLVITAQE

SEQ ID NO: 1531958 - protein, 25 aa, Mycobacterium tuberculosis
YGCPPTAGWWPHWAPGSWPVRTPQR

SEQ ID NO: 1531959 - protein, 32 aa, Mycobacterium tuberculosis
YGDTKLGLFPFRRNLSFYAVDLGLLSATHPEE

SEQ ID NO: 1531960 - protein, 33 aa, Mycobacterium tuberculosis
YGDTKLGLFPFRRNLSFYAVDLGLLSATHPEEL

SEQ ID NO: 1531961 - protein, 24 aa, Mycobacterium tuberculosis
YGEEQFMAWRRSYDTPPPPIERGS

SEQ ID NO: 1531962 - protein, 24 aa, Mycobacterium tuberculosis
YGELLGALPMLHAAFERAGRDPAT

SEQ ID NO: 1531963 - protein, 32 aa, Mycobacterium tuberculosis
YGFPDGETRDLFLTLLLVSGVGPRLAMAALAV

SEQ ID NO: 1531964 - protein, 29 aa, Mycobacterium tuberculosis
YGGNNNWFAAYAYWYFKLYGHEKVKLLDG

SEQ ID NO: 1531965 - protein, 23 aa, Mycobacterium tuberculosis
YGKTWRTLAKLSLPDKYLRDNAD

SEQ ID NO: 1531966 - protein, 22 aa, Mycobacterium tuberculosis
YGPLFIRMAWHAAGTYRIHDGR

SEQ ID NO: 1531967 - protein, 25 aa, Mycobacterium tuberculosis
YGPLRSLYHFNPAMQPQIGANYYNP

SEQ ID NO: 1531968 - protein, 17 aa, Mycobacterium tuberculosis
YGPVVYLDLRHLGADLI

SEQ ID NO: 1531969 - protein, 24 aa, Mycobacterium tuberculosis
YGQHVALGLRRAYPRPEEVRIGAP

SEQ ID NO: 1531970 - protein, 18 aa, Mycobacterium tuberculosis
YGRLLRRAIDPDPRQRFT

SEQ ID NO: 1531971 - protein, 19 aa, Mycobacterium tuberculosis
YGRLSPWGRLAEWRRQYDT

SEQ ID NO: 1531972 - protein, 24 aa, Mycobacterium tuberculosis
YGRLVRQVVLPGSSPRPYGGYFDD

SEQ ID NO: 1531973 - protein, 18 aa, Mycobacterium tuberculosis
YGSFHAVADVSLAILPRS

SEQ ID NO: 1531974 - protein, 17 aa, Mycobacterium tuberculosis
YGTGWWVCSSRATPTKP

SEQ ID NO: 1531975 - protein, 26 aa, Mycobacterium tuberculosis
YHAGVEQLLVFLPQGAAIAQTVLTPT

SEQ ID NO: 1531976 - protein, 23 aa, Mycobacterium tuberculosis
YHFAWDEFCDWYLELAKTQLAQG

SEQ ID NO: 1531977 - protein, 17 aa, Mycobacterium tuberculosis
YHFGRLVRRWRWTTAED

SEQ ID NO: 1531978 - protein, 27 aa, Mycobacterium tuberculosis
YHNDIEQLLVVFPMAIAAEQAGILANL

SEQ ID NO: 1531979 - protein, 17 aa, Mycobacterium tuberculosis
YHNQFVRALNAGAGSYA

SEQ ID NO: 1531980 - protein, 18 aa, Mycobacterium tuberculosis
YHQQFVQTLRTGAASYML

SEQ ID NO: 1531981 - protein, 18 aa, Mycobacterium tuberculosis
YHRGAFIERFAVATILEH

SEQ ID NO: 1531982 - protein, 27 aa, Mycobacterium tuberculosis
YHRSRRHRRGLLHTRLIGNGGNGGDGG

SEQ ID NO: 1531983 - protein, 27 aa, Mycobacterium tuberculosis
YHRTGEKLIITFAMPAYAKMVMNFGRF

SEQ ID NO: 1531984 - protein, 20 aa, Mycobacterium tuberculosis
YHTFGGWKRSGFGDLNQHGP

SEQ ID NO: 1531985 - protein, 17 aa, Mycobacterium tuberculosis
YHVLRAAWPHFREQSYG

SEQ ID NO: 1531986 - protein, 20 aa, Mycobacterium tuberculosis
YHYAPYEKTALLRLVGRYGI

SEQ ID NO: 1531987 - protein, 18 aa, Mycobacterium tuberculosis
YIAQVRATWVVPSAGPPC

SEQ ID NO: 1531988 - protein, 19 aa, Mycobacterium tuberculosis
YIDFDAMRLKMITTPTDWP

SEQ ID NO: 1531989 - protein, 18 aa, Mycobacterium tuberculosis
YILSLFRSEDAARSFVAA

SEQ ID NO: 1531990 - protein, 17 aa, Mycobacterium tuberculosis
YIMDEVEAALDDVNLRR

SEQ ID NO: 1531991 - protein, 17 aa, Mycobacterium tuberculosis
YIMVIESLQPADDATAR

SEQ ID NO: 1531992 - protein, 19 aa, Mycobacterium tuberculosis
YIPRHLNFHQLTPHASEAA

SEQ ID NO: 1531993 - protein, 18 aa, Mycobacterium tuberculosis
YIPSLACGRCWAIARCRS

SEQ ID NO: 1531994 - protein, 25 aa, Mycobacterium tuberculosis
YISNIIYEGPGADSLFFASGQLREL

SEQ ID NO: 1531995 - protein, 19 aa, Mycobacterium tuberculosis
YITAAGRTLACHKVIGAQR

SEQ ID NO: 1531996 - protein, 18 aa, Mycobacterium tuberculosis
YKIRGVAAVTFYGRGRLV

SEQ ID NO: 1531997 - protein, 20 aa, Mycobacterium tuberculosis
YLAGAKILRQYGNGPLPGVA

SEQ ID NO: 1531998 - protein, 19 aa, Mycobacterium tuberculosis
YLAPVRPLERIRQHVDAAD

SEQ ID NO: 1531999 - protein, 25 aa, Mycobacterium tuberculosis
YLAVAIEYLYTHRPSWPAGIAVGKT

SEQ ID NO: 1532000 - protein, 21 aa, Mycobacterium tuberculosis
YLCSESTMYRLLRERGQTGDR

SEQ ID NO: 1532001 - protein, 19 aa, Mycobacterium tuberculosis
YLDFTFAGLPAYQQGLGRK

SEQ ID NO: 1532002 - protein, 19 aa, Mycobacterium tuberculosis
YLGPVLWSPAGKPPTWWDS

SEQ ID NO: 1532003 - protein, 17 aa, Mycobacterium tuberculosis
YLIFEPKISGSSTSRQA

SEQ ID NO: 1532004 - protein, 35 aa, Mycobacterium tuberculosis
YLIGRKMLTPPARPVARRLFAVRAVVGLSLPGTVA

SEQ ID NO: 1532005 - protein, 17 aa, Mycobacterium tuberculosis
YLIVRAGEFSRISDVLL

SEQ ID NO: 1532006 - protein, 19 aa, Mycobacterium tuberculosis
YLLTLPGHGFYWFQLTTHE

SEQ ID NO: 1532007 - protein, 27 aa, Mycobacterium tuberculosis
YLNKDGIPEVWPFAPAKHRAMLANLHP

SEQ ID NO: 1532008 - protein, 19 aa, Mycobacterium tuberculosis
YLQPRPRGAARKRSRGAGR

SEQ ID NO: 1532009 - protein, 17 aa, Mycobacterium tuberculosis
YLRDIRLIRRGKIDDEG

SEQ ID NO: 1532010 - protein, 20 aa, Mycobacterium tuberculosis
YLRQRATLIDPKRAMPAATG

SEQ ID NO: 1532011 - protein, 20 aa, Mycobacterium tuberculosis
YLSPAPMYHTAPSVWTMSAL

SEQ ID NO: 1532012 - protein, 27 aa, Mycobacterium tuberculosis
YLSWVDFRALALPSEPAEYLLSKAKVA

SEQ ID NO: 1532013 - protein, 22 aa, Mycobacterium tuberculosis
YLTALMPMVWRACEREDFVVEV

SEQ ID NO: 1532014 - protein, 23 aa, Mycobacterium tuberculosis
YLTALMPMVWRACEREDFVVEVQ

SEQ ID NO: 1532015 - protein, 29 aa, Mycobacterium tuberculosis
YLTDPTLQFIMAYYLRPDELAFAEPHLTR

SEQ ID NO: 1532016 - protein, 25 aa, Mycobacterium tuberculosis
YMIPSPTLPLLLPLKQIGVPDWIVG

SEQ ID NO: 1532017 - protein, 17 aa, Mycobacterium tuberculosis
YMRVAAPGDLRCEGAQL

SEQ ID NO: 1532018 - protein, 18 aa, Mycobacterium tuberculosis
YNGGFCGWLYGNGGARGA

SEQ ID NO: 1532019 - protein, 33 aa, Mycobacterium tuberculosis; identical to SEQ ID NO: 879121

SEQ ID NO: 1532020 - protein, 18 aa, Mycobacterium tuberculosis
YNQLDPYLPDLLMCRAEV

SEQ ID NO: 1532021 - protein, 17 aa, Mycobacterium tuberculosis
YPALSAAGKPITGTHAE

SEQ ID NO: 1532022 - protein, 28 aa, Mycobacterium tuberculosis
YPARVKCALLGWMAFKDALAQASEAFEE

SEQ ID NO: 1532023 - protein, 25 aa, Mycobacterium tuberculosis
YPARYLFVFLDHHGMLSVFGSPTWR

SEQ ID NO: 1532024 - protein, 27 aa, Mycobacterium tuberculosis
YPELATTTLLRPVKPPPSEGWRRLLYL

SEQ ID NO: 1532025 - protein, 17 aa, Mycobacterium tuberculosis
YPEVSLGIYASPRQTVI

SEQ ID NO: 1532026 - protein, 21 aa, Mycobacterium tuberculosis
YPHFRRFLAEVVRVLRPGRYF

SEQ ID NO: 1532027 - protein, 18 aa, Mycobacterium tuberculosis
YPHKLLTGRGKDFATLRQ

SEQ ID NO: 1532028 - protein, 22 aa, Mycobacterium tuberculosis
YPHLRPNRGVDYLLHNDTHRRN

SEQ ID NO: 1532029 - protein, 25 aa, Mycobacterium tuberculosis
YPHPAGAYWVPRRLARRARQRWPRR

SEQ ID NO: 1532030 - protein, 29 aa, Mycobacterium tuberculosis
YPHPATVALFRLPRALKYKAKPGRSVDLL

SEQ ID NO: 1532031 - protein, 18 aa, Mycobacterium tuberculosis
YPICRTPGYALGGPGPQH

SEQ ID NO: 1532032 - protein, 21 aa, Mycobacterium tuberculosis
YPKIKQWLSQVLGNFPVYAHM

SEQ ID NO: 1532033 - protein, 25 aa, Mycobacterium tuberculosis
YPLGEALLALYRWRGPLINAGVGGH

SEQ ID NO: 1532034 - protein, 17 aa, Mycobacterium tuberculosis
YPLHSFPGEPPFVRGPY

SEQ ID NO: 1532035 - protein, 18 aa, Mycobacterium tuberculosis
YPLHSFPGEPPFVRGPYP

SEQ ID NO: 1532036 - protein, 17 aa, Mycobacterium tuberculosis
YPLLPDELAEALAGFIA

SEQ ID NO: 1532037 - protein, 27 aa, Mycobacterium tuberculosis
YPNDPLALVLIELRHPRTEPPVPSAIS

SEQ ID NO: 1532038 - protein, 21 aa, Mycobacterium tuberculosis
YPNMLRLRYEKKRNLPRALLA

SEQ ID NO: 1532039 - protein, 19 aa, Mycobacterium tuberculosis
YPPMLLSRDGRDDSGFYPV

SEQ ID NO: 1532040 - protein, 23 aa, Mycobacterium tuberculosis
YPPVNAIPSKAWFDLADAVTAAG

SEQ ID NO: 1532041 - protein, 24 aa, Mycobacterium tuberculosis
YPQDRLDFILADCDAKLVLRTPVR

SEQ ID NO: 1532042 - protein, 18 aa, Mycobacterium tuberculosis
YPRSPYGAAKVYSYWATR

SEQ ID NO: 1532043 - protein, 19 aa, Mycobacterium tuberculosis
YPRVIKRWRRGKPLADAET

SEQ ID NO: 1532044 - protein, 21 aa, Mycobacterium tuberculosis
YPSAGIEQLIFAPQGSLAQSR

SEQ ID NO: 1532045 - protein, 22 aa, Mycobacterium tuberculosis
YPSAGIEQLIFAPQGSLAQSRT

SEQ ID NO: 1532046 - protein, 25 aa, Mycobacterium tuberculosis
YPSSLLATTVFFSPGNEQAAATVAA

SEQ ID NO: 1532047 - protein, 22 aa, Mycobacterium tuberculosis
YPVTGLELRVSVPPGCVCPLQI

SEQ ID NO: 1532048 - protein, 35 aa, Mycobacterium tuberculosis
YQAAAAQVAAFHSRFVQALTAGAGAYAFAEAANAS

SEQ ID NO: 1532049 - protein, 18 aa, Mycobacterium tuberculosis
YQAAIRRAVLPRSSPSKP

SEQ ID NO: 1532050 - protein, 24 aa, Mycobacterium tuberculosis
YQGLIGLPLLGIPVTPGYFNLTGG

SEQ ID NO: 1532051 - protein, 21 aa, Mycobacterium tuberculosis
YQNFDALRTLALPFGIQVETV

SEQ ID NO: 1532052 - protein, 25 aa, Mycobacterium tuberculosis
YQPKGVVGVISPWNYPMTLTVSDSV

SEQ ID NO: 1532053 - protein, 18 aa, Mycobacterium tuberculosis
YQQRFVLALSQASSTYAV

SEQ ID NO: 1532054 - protein, 17 aa, Mycobacterium tuberculosis
YQRFRGAEIAGLTAGLV

SEQ ID NO: 1532055 - protein, 28 aa, Mycobacterium tuberculosis
YRANMWALRALWCAAGLRAVCGRAAWTL

SEQ ID NO: 1532056 - protein, 26 aa, Mycobacterium tuberculosis
YRDSEGWIYLAGRTADWMRVDGENLT

SEQ ID NO: 1532057 - protein, 19 aa, Mycobacterium tuberculosis
YRFHRRLASFSRVIRLDHR

SEQ ID NO: 1532058 - protein, 18 aa, Mycobacterium tuberculosis
YRFSVPDPGTYWAHPHVG

SEQ ID NO: 1532059 - protein, 17 aa, Mycobacterium tuberculosis
YRFVYRKRFHKRCETEL

SEQ ID NO: 1532060 - protein, 19 aa, Mycobacterium tuberculosis
YRILLADLAALYDGREPPA

SEQ ID NO: 1532061 - protein, 18 aa, Mycobacterium tuberculosis
YRPSHEKLAWARRVLAAS

SEQ ID NO: 1532062 - protein, 18 aa, Mycobacterium tuberculosis
YRPSVKLAAFVRARDLTC

SEQ ID NO: 1532063 - protein, 17 aa, Mycobacterium tuberculosis
YRQLLQHILQHVADGKL

SEQ ID NO: 1532064 - protein, 17 aa, Mycobacterium tuberculosis
YRRLAADQVLEAARRGA

SEQ ID NO: 1532065 - protein, 19 aa, Mycobacterium tuberculosis
YRSASARALPGSGLGLAIV

SEQ ID NO: 1532066 - protein, 23 aa, Mycobacterium tuberculosis
YRTEYRVFFVCEGVTQYLTERAV

SEQ ID NO: 1532067 - protein, 23 aa, Mycobacterium tuberculosis
YRTRWEIPIGLRETDLTPAHCHM

SEQ ID NO: 1532068 - protein, 25 aa, Mycobacterium tuberculosis
YRVSTGLYRYSLLDIIDIADIADID

SEQ ID NO: 1532069 - protein, 22 aa, Mycobacterium tuberculosis
YSAVSLRLHPDIRLFTAIPEQR

SEQ ID NO: 1532070 - protein, 22 aa, Mycobacterium tuberculosis
YSDKWTLTLTEPATIAAGNFYR

SEQ ID NO: 1532071 - protein, 30 aa, Mycobacterium tuberculosis
YSDTLSIPGIPLSLNALGGVGPIVVPDITI

SEQ ID NO: 1532072 - protein, 35 aa, Mycobacterium tuberculosis
YSFQRLRFVFERLPEIPQLRWRVTGAPLGLDRPWF

SEQ ID NO: 1532073 - protein, 45 aa, Mycobacterium tuberculosis
YSGLDLPPNTAVTVIFFGPVDIDPFTVPVIRITGPTPVVMVGGPT

SEQ ID NO: 1532074 - protein, 46 aa, Mycobacterium tuberculosis; identical to SEQ ID NO: 224677

SEQ ID NO: 1532075 - protein, 19 aa, Mycobacterium tuberculosis
YSLRYSSTALERAEDPILN

SEQ ID NO: 1532076 - protein, 33 aa, Mycobacterium tuberculosis
YSNGAFWRGDYQGLLDFSFPVGPLIPQTHLVHL

SEQ ID NO: 1532077 - protein, 34 aa, Mycobacterium tuberculosis
YSNGAFWRGDYQGLLDFSFPVGPLIPQTHLVHLR

SEQ ID NO: 1532078 - protein, 17 aa, Mycobacterium tuberculosis
YSNGVLWRGDYQGLLGF

SEQ ID NO: 1532079 - protein, 46 aa, Mycobacterium tuberculosis
YSNGVLWRGDYQGLLGFSYRPAVLPQTPFLDLTLTGGLGSVVIPAI

SEQ ID NO: 1532080 - protein, 30 aa, Mycobacterium tuberculosis
YSNGVLWRGDYQGLLGFSYTSTIIPEFTVA

SEQ ID NO: 1532081 - protein, 25 aa, Mycobacterium tuberculosis
YSNSPHLYAELAIPATAGGTVGPAR

SEQ ID NO: 1532082 - protein, 31 aa, Mycobacterium tuberculosis
YSNTRLELLPFRRNLAFYGLDLGLMSVSHPA

SEQ ID NO: 1532083 - protein, 30 aa, Mycobacterium tuberculosis
YSPLPATHIGGLWWILTCLMHGGLCVTGGE

SEQ ID NO: 1532084 - protein, 19 aa, Mycobacterium tuberculosis
YSQDRLMYAYISTPTDNRV

SEQ ID NO: 1532085 - protein, 19 aa, Mycobacterium tuberculosis
YSQQRLHPLPPQTVVGIPS

SEQ ID NO: 1532086 - protein, 18 aa, Mycobacterium tuberculosis
YSSSWPPHCVSGTPGADF

SEQ ID NO: 1532087 - protein, 26 aa, Mycobacterium tuberculosis
YSSYMHLHTRLTRRFNAVIVPGVTSV

SEQ ID NO: 1532088 - protein, 20 aa, Mycobacterium tuberculosis
YSTEFYALAARALAPGGLMV

SEQ ID NO: 1532089 - protein, 17 aa, Mycobacterium tuberculosis
YSYFVELPRLEDIEPGA

SEQ ID NO: 1532090 - protein, 25 aa, Mycobacterium tuberculosis
YTAWGRIRLRARPGWPRGDRRHEPP

SEQ ID NO: 1532091 - protein, 19 aa, Mycobacterium tuberculosis
YTDRIWEPKTQKVRQLFAD

SEQ ID NO: 1532092 - protein, 31 aa, Mycobacterium tuberculosis
YTGNTHYYMFLTQDLPLLQPIRAIPFVGTPI

SEQ ID NO: 1532093 - protein, 34 aa, Mycobacterium tuberculosis
YTGNTQYYMFLTQDLPLLQPIRDIPYAGPPIADL

SEQ ID NO: 1532094 - protein, 30 aa, Mycobacterium tuberculosis
YTGYAPVIGAPWLVAFAERSRFFEVFSSSN

SEQ ID NO: 1532095 - protein, 38 aa, Mycobacterium tuberculosis
YTIDPIPLQLNLDLTLGPVHILIDLPAVPGFGNTTGAP

SEQ ID NO: 1532096 - protein, 38 aa, Mycobacterium tuberculosis
YTIPLDTPPAPAPPPFRLPLLFVNALGDNWIVGASNST

SEQ ID NO: 1532097 - protein, 30 aa, Mycobacterium tuberculosis
YTIYREPLSLRPFDYLPKPLRRSMGKVSKP

SEQ ID NO: 1532098 - protein, 26 aa, Mycobacterium tuberculosis
YTKGFKFSTYATWWIRQAITRGMADQ

SEQ ID NO: 1532099 - protein, 31 aa, Mycobacterium tuberculosis
YTKGYKFSTYATWWIRQAITRAMADQARTIR

SEQ ID NO: 1532100 - protein, 20 aa, Mycobacterium tuberculosis
YTPLMLCAKMIHALARLPQQ

SEQ ID NO: 1532101 - protein, 24 aa, Mycobacterium tuberculosis
YTQVETLVYMAFYERCGAVFCRNL

SEQ ID NO: 1532102 - protein, 36 aa, Mycobacterium tuberculosis
YTSADIRALYAFKRYAWWPYTLVMRRANVFFTRALR

SEQ ID NO: 1532103 - protein, 17 aa, Mycobacterium tuberculosis
YVAAFNQGRNTGPTEGP

SEQ ID NO: 1532104 - protein, 31 aa, Mycobacterium tuberculosis
YVALRTEIDNWRWAGVPIFVRAGKELPAKVT

SEQ ID NO: 1532105 - protein, 28 aa, Mycobacterium tuberculosis
YVAPRLSRRILHQLYLGYPDSAAAQGIS

SEQ ID NO: 1532106 - protein, 19 aa, Mycobacterium tuberculosis
YVDAWLLRACAKLGVRLVH

SEQ ID NO: 1532107 - protein, 17 aa, Mycobacterium tuberculosis
YVELLPRNAASPPLKNG

SEQ ID NO: 1532108 - protein, 17 aa, Mycobacterium tuberculosis
YVGLERFLAGLRDYFRT

SEQ ID NO: 1532109 - protein, 28 aa, Mycobacterium tuberculosis
YVHNRLLTLLLFDIGSFAGLAALLNSAV

SEQ ID NO: 1532110 - protein, 21 aa, Mycobacterium tuberculosis
YVKEDVAIRRLLSSGLERAGI

SEQ ID NO: 1532111 - protein, 27 aa, Mycobacterium tuberculosis
YVKTPAQVLLRWNLQLGNAVVVRSARP

SEQ ID NO: 1532112 - protein, 17 aa, Mycobacterium tuberculosis
YVLAELGYRVRRFAARV

SEQ ID NO: 1532113 - protein, 17 aa, Mycobacterium tuberculosis
YVLGSMGPGTKLPTLGH

SEQ ID NO: 1532114 - protein, 18 aa, Mycobacterium tuberculosis
YVLPARRDWARSGPISHL

SEQ ID NO: 1532115 - protein, 26 aa, Mycobacterium tuberculosis
YVPKHWQKLCYLIGRPDLVEDQRFAE

SEQ ID NO: 1532116 - protein, 17 aa, Mycobacterium tuberculosis
YVQAQFDSVLHSALSGL

SEQ ID NO: 1532117 - protein, 17 aa, Mycobacterium tuberculosis
YVQYAHARLSALARNAA

SEQ ID NO: 1532118 - protein, 25 aa, Mycobacterium tuberculosis
YVRPSWLRRWVRDGYAWVQPRLSPV

SEQ ID NO: 1532119 - protein, 24 aa, Mycobacterium tuberculosis
YVSMPLFHSNAVLVGWAVAAACQG

SEQ ID NO: 1532120 - protein, 25 aa, Mycobacterium tuberculosis
YVSTWAGFAYVGFVTDAYARRILGW

SEQ ID NO: 1532121 - protein, 17 aa, Mycobacterium tuberculosis
YVTTPGSALLFPALCTP

SEQ ID NO: 1532122 - protein, 27 aa, Mycobacterium tuberculosis
YVTTPGSALLFPALCTPTGDPPAPEPA

SEQ ID NO: 1532123 - protein, 21 aa, Mycobacterium tuberculosis
YWARHIRAVVRFGDSVRSAHC

SEQ ID NO: 1532124 - protein, 17 aa, Mycobacterium tuberculosis
YWQRHPSLSYLFAGRFV

SEQ ID NO: 1532125 - protein, 17 aa, Mycobacterium tuberculosis
YWRLSWRTRFANSSPGR

SEQ ID NO: 1532126 - protein, 22 aa, Mycobacterium tuberculosis
YYADPCALFDLCKRRYSKSVEP

SEQ ID NO: 1532127 - protein, 28 aa, Mycobacterium tuberculosis
YYAMTGWRLGWLLVPTVLRRAVDCLTGN

SEQ ID NO: 1532128 - protein, 17 aa, Mycobacterium tuberculosis
YYPLHSSLVGQFVFPNF

SEQ ID NO: 1532129 - protein, 18 aa, Mycobacterium tuberculosis
YYTTVDAAWRPDTVWRYR

SEQ ID NO: 1532130 - protein, 26 aa, Mycobacterium tuberculosis
GGNNNWFAAYAYWYFKLYGHEKVKLL

SEQ ID NO: 1532131 - protein, 23 aa, Mycobacterium tuberculosis
AAMVVAAAPYAGWLAAAAARAGG

SEQ ID NO: 1532132 - protein, 25 aa, Mycobacterium tuberculosis
LGAIPGGWWLTFGQILGLAQNAPGV

SEQ ID NO: 1532133 - protein, 24 aa, Mycobacterium tuberculosis
NDHNFFVMTTPDDPIRYPARLAPL

SEQ ID NO: 1532134 - protein, 21 aa, Mycobacterium tuberculosis
RGLPMSFTFARFLKFIVTEIF

SEQ ID NO: 1532135 - protein, 24 aa, Mycobacterium tuberculosis
AADWAEMLMRMYIRWAEQHKYPVE

SEQ ID NO: 1532136 - protein, 23 aa, Mycobacterium tuberculosis
AAQFPFDIIPTLLQGLATLSTQY

SEQ ID NO: 1532137 - protein, 23 aa, Mycobacterium tuberculosis
ADDVFITYPLWIGTRQADRLRQL

SEQ ID NO: 1532138 - protein, 21 aa, Mycobacterium tuberculosis
ADYSGFIWFPKLPALDRWLDL

SEQ ID NO: 1532139 - protein, 20 aa, Mycobacterium tuberculosis
AFTASPFRWLSWLSDSGATM

SEQ ID NO: 1532140 - protein, 17 aa, Mycobacterium tuberculosis
AIKALWDTILPFADYAF

SEQ ID NO: 1532141 - protein, 18 aa, Mycobacterium tuberculosis
AILPLYYLRRAGIAESDL

SEQ ID NO: 1532142 - protein, 25 aa, Mycobacterium tuberculosis
AKHPGYVHSFPPMPLQPKGFMTPDE

SEQ ID NO: 1532143 - protein, 27 aa, Mycobacterium tuberculosis
ALDIDLVFSPFFNALPIRRLGLHERAE

SEQ ID NO: 1532144 - protein, 23 aa, Mycobacterium tuberculosis
ALPFGDRLMALPINLLWNGQSVS

SEQ ID NO: 1532145 - protein, 18 aa, Mycobacterium tuberculosis
ALRLGIARALILVSPEDR

SEQ ID NO: 1532146 - protein, 23 aa, Mycobacterium tuberculosis
ANAMSWFWYLMALNPQARDHMLT

SEQ ID NO: 1532147 - protein, 21 aa, Mycobacterium tuberculosis
ANELLLYEALGLCGPGEAPEL

SEQ ID NO: 1532148 - protein, 17 aa, Mycobacterium tuberculosis
APLFKHYRHIYLRPFRY

SEQ ID NO: 1532149 - protein, 18 aa, Mycobacterium tuberculosis
AQPWSLRYPLVDGQGNFG

SEQ ID NO: 1532150 - protein, 22 aa, Mycobacterium tuberculosis
ASLRDFYIAYRAVVRAKVECVR

SEQ ID NO: 1532151 - protein, 25 aa, Mycobacterium tuberculosis
AVALPAFALPLRLPAGLAAGPAAVV

SEQ ID NO: 1532152 - protein, 23 aa, Mycobacterium tuberculosis
DDALNLPWLAMGATGFISVIAHL

SEQ ID NO: 1532153 - protein, 19 aa, Mycobacterium tuberculosis
DDYGPDLRRWLVARLGLTE

SEQ ID NO: 1532154 - protein, 18 aa, Mycobacterium tuberculosis
DECRIFLSMLGIGPAKLE

SEQ ID NO: 1532155 - protein, 25 aa, Mycobacterium tuberculosis
DFLRTIHELLLSDGFWDEVFRELSI

SEQ ID NO: 1532156 - protein, 26 aa, Mycobacterium tuberculosis
DPPFEGMWWLYVPLAFDDFAVVLIIQ

SEQ ID NO: 1532157 - protein, 22 aa, Mycobacterium tuberculosis
DQFMTLAKMRALRQLWARVAEV

SEQ ID NO: 1532158 - protein, 22 aa, Mycobacterium tuberculosis
DRDWLARQFDLAAGAPVGCGFI

SEQ ID NO: 1532159 - protein, 24 aa, Mycobacterium tuberculosis
DRIHQGWILTVLWVIDTGVTAATL

SEQ ID NO: 1532160 - protein, 25 aa, Mycobacterium tuberculosis
DTRVEFWAFDLLYLDGRALLGTRYQ

SEQ ID NO: 1532161 - protein, 23 aa, Mycobacterium tuberculosis
DVANLAMFLLSDAASWITGQVIN

SEQ ID NO: 1532162 - protein, 25 aa, Mycobacterium tuberculosis
DVERPHYMPLFVAPQPIPEPLADDE

SEQ ID NO: 1532163 - protein, 24 aa, Mycobacterium tuberculosis
DVMPEDLIKFGLIPEFIGRLPVVA

SEQ ID NO: 1532164 - protein, 23 aa, Mycobacterium tuberculosis
EAYFAALLGLPFIAVMPAATSAS

SEQ ID NO: 1532165 - protein, 25 aa, Mycobacterium tuberculosis
EERAHLLPVFRLRYLPTPLGLHHPI

SEQ ID NO: 1532166 - protein, 23 aa, Mycobacterium tuberculosis
EERSLWLHRALLSPLLTEPDTVV

SEQ ID NO: 1532167 - protein, 23 aa, Mycobacterium tuberculosis
EFERRFFPIYPASTKVQSWDIFK

SEQ ID NO: 1532168 - protein, 25 aa, Mycobacterium tuberculosis
EHPGKWRVVFFWPKDFTFVCPTEIA

SEQ ID NO: 1532169 - protein, 20 aa, Mycobacterium tuberculosis
EIRAIWRINELLNWQVASAG

SEQ ID NO: 1532170 - protein, 17 aa, Mycobacterium tuberculosis
ELFAAFPSFAGLRPTFD

SEQ ID NO: 1532171 - protein, 20 aa, Mycobacterium tuberculosis
ELRAIFINSVWAPRLRIVES

SEQ ID NO: 1532172 - protein, 20 aa, Mycobacterium tuberculosis
EMQRLGREPLLPALEAELPL

SEQ ID NO: 1532173 - protein, 24 aa, Mycobacterium tuberculosis
EQQRAQWLRPLLDGKIRSAFSMTE

SEQ ID NO: 1532174 - protein, 22 aa, Mycobacterium tuberculosis
ESYEFWREFLASLKARGLTGVH

SEQ ID NO: 1532175 - protein, 24 aa, Mycobacterium tuberculosis
EVGKLADLVLWEPAFFGVRPHVVL

SEQ ID NO: 1532176 - protein, 19 aa, Mycobacterium tuberculosis
FLARRQLFDPALLAQARAI

SEQ ID NO: 1532177 - protein, 21 aa, Mycobacterium tuberculosis
FLSLPVRRWPLKPFTQRAYQL

SEQ ID NO: 1532178 - protein, 21 aa, Mycobacterium tuberculosis
GASGFYAKWLPKLVFGEGQLP

SEQ ID NO: 1532179 - protein, 18 aa, Mycobacterium tuberculosis
GDMGLALPILAPGGVASA

SEQ ID NO: 1532180 - protein, 18 aa, Mycobacterium tuberculosis
GFHTLKLQTFLTAGPKEA

SEQ ID NO: 1532181 - protein, 24 aa, Mycobacterium tuberculosis
GISRPTFYFYFPSKEAVLLTLLDR

SEQ ID NO: 1532182 - protein, 23 aa, Mycobacterium tuberculosis
GLAYGLIYWYFDSKDDLFHALMA

SEQ ID NO: 1532183 - protein, 19 aa, Mycobacterium tuberculosis
GLSLPLLRSLVQRCGLSVA

SEQ ID NO: 1532184 - protein, 18 aa, Mycobacterium tuberculosis
GLTPLRHWRSALATALAA

SEQ ID NO: 1532185 - protein, 17 aa, Mycobacterium tuberculosis
GMPFPLFVKAVAGGGGR

SEQ ID NO: 1532186 - protein, 25 aa, Mycobacterium tuberculosis
GRDAPLLHWIVFEEEYFRAGAPGRA

SEQ ID NO: 1532187 - protein, 23 aa, Mycobacterium tuberculosis
GREDVFFLHVSLVPYLAPSGELK

SEQ ID NO: 1532188 - protein, 19 aa, Mycobacterium tuberculosis
GRYRPFYLRNLLDAVQGRN

SEQ ID NO: 1532189 - protein, 24 aa, Mycobacterium tuberculosis
GVITPWNFPMVIASWAIAPALAAG

SEQ ID NO: 1532190 - protein, 25 aa, Mycobacterium tuberculosis
GVKNYPFYFGFLKSKLRTGGLLLNH

SEQ ID NO: 1532191 - protein, 20 aa, Mycobacterium tuberculosis
HDFYLLDEFTYPLKWGWLDV

SEQ ID NO: 1532192 - protein, 20 aa, Mycobacterium tuberculosis
HFTPFTLIQLEELGFCGKGE

SEQ ID NO: 1532193 - protein, 21 aa, Mycobacterium tuberculosis
HMQGHWLLARLGKRVLRPGGV

SEQ ID NO: 1532194 - protein, 30 aa, Mycobacterium tuberculosis; identical to SEQ ID NO: 227588

SEQ ID NO: 1532195 - protein, 18 aa, Mycobacterium tuberculosis
HPRWAWWLTSVPVLREFL

SEQ ID NO: 1532196 - protein, 19 aa, Mycobacterium tuberculosis
IFMGPLFTLLGRPKVEGLE

SEQ ID NO: 1532197 - protein, 26 aa, Mycobacterium tuberculosis
IGQRSWRMFAPFLRPVFSRGYPLSAA

SEQ ID NO: 1532198 - protein, 17 aa, Mycobacterium tuberculosis
IGWTCRDVWWAATQDPR

SEQ ID NO: 1532199 - protein, 18 aa, Mycobacterium tuberculosis
IHFQEWWVRYRAQVPTHS

SEQ ID NO: 1532200 - protein, 25 aa, Mycobacterium tuberculosis
IHLDVPLYWQCWKLDSPIIARITDT

SEQ ID NO: 1532201 - protein, 18 aa, Mycobacterium tuberculosis
IKWTIVRYKPPEGMTLNG

SEQ ID NO: 1532202 - protein, 19 aa, Mycobacterium tuberculosis
ILTVLALRDQVIPPTLNLV

SEQ ID NO: 1532203 - protein, 17 aa, Mycobacterium tuberculosis
IRCFGFSPLRLPPDLDF

SEQ ID NO: 1532204 - protein, 22 aa, Mycobacterium tuberculosis
IRGPQEVLPFSPRSQYLVGHLA

SEQ ID NO: 1532205 - protein, 26 aa, Mycobacterium tuberculosis
ITPFNFPAMIPLWKAGPALACGNAFV

SEQ ID NO: 1532206 - protein, 24 aa, Mycobacterium tuberculosis
KAVAAFRLALPRTMLRFAGGREIT

SEQ ID NO: 1532207 - protein, 17 aa, Mycobacterium tuberculosis
KETLRLHPPLIILMRVA

SEQ ID NO: 1532208 - protein, 22 aa, Mycobacterium tuberculosis
KNMFALGLLSWMYGRELEHSEA

SEQ ID NO: 1532209 - protein, 26 aa, Mycobacterium tuberculosis
KRLGSFMDSRLWRLLLAPGRGIGRLI

SEQ ID NO: 1532210 - protein, 21 aa, Mycobacterium tuberculosis
KWEKLFRFLALDRLQSRLHRW

SEQ ID NO: 1532211 - protein, 19 aa, Mycobacterium tuberculosis
LDLLPRLLFRNGELDISVV

SEQ ID NO: 1532212 - protein, 26 aa, Mycobacterium tuberculosis
LGMTEFKVFWQPPPAPEIPKSSLGAG

SEQ ID NO: 1532213 - protein, 24 aa, Mycobacterium tuberculosis
LGRGYRWLQLFDAAGLPVRDIEQV

SEQ ID NO: 1532214 - protein, 18 aa, Mycobacterium tuberculosis
LHIHPIRRTIQHADLLVV

SEQ ID NO: 1532215 - protein, 22 aa, Mycobacterium tuberculosis
LLRSDFPVLWPVGTRWADNDMF

SEQ ID NO: 1532216 - protein, 21 aa, Mycobacterium tuberculosis
LPCAPFLHLFVAYGRLTLEGG

SEQ ID NO: 1532217 - protein, 17 aa, Mycobacterium tuberculosis
LPPTFRGDIFWCQLFSE

SEQ ID NO: 1532218 - protein, 17 aa, Mycobacterium tuberculosis
LQEFLFGLDLDEDTRRR

SEQ ID NO: 1532219 - protein, 18 aa, Mycobacterium tuberculosis
LQHRWAQTPWRRFKRRLS

SEQ ID NO: 1532220 - protein, 18 aa, Mycobacterium tuberculosis
LRERLRYRRGQWAHGPKL

SEQ ID NO: 1532221 - protein, 25 aa, Mycobacterium tuberculosis
LSAAIRLIYPREALWRPPVLTMSAV

SEQ ID NO: 1532222 - protein, 23 aa, Mycobacterium tuberculosis
LSDYPYVVPLIDLEMRRPTYVFA

SEQ ID NO: 1532223 - protein, 20 aa, Mycobacterium tuberculosis
LTLPAKFRDALAGGLMVTKS

SEQ ID NO: 1532224 - protein, 17 aa, Mycobacterium tuberculosis
LVHHPLLLRGVDTVAAN

SEQ ID NO: 1532225 - protein, 17 aa, Mycobacterium tuberculosis
LVSYVRGVLYFRTKRWP

SEQ ID NO: 1532226 - protein, 19 aa, Mycobacterium tuberculosis
LWSVWKSYRSAPPLLSCTV

SEQ ID NO: 1532227 - protein, 18 aa, Mycobacterium tuberculosis
MCGVEYFGHPWEFGPRKT

SEQ ID NO: 1532228 - protein, 23 aa, Mycobacterium tuberculosis
MELLDDVILMLRRLHQPVIAAVN

SEQ ID NO: 1532229 - protein, 18 aa, Mycobacterium tuberculosis
MHLLRDKQLWWRVGRKHG

SEQ ID NO: 1532230 - protein, 22 aa, Mycobacterium tuberculosis
MLFESLLPRYLTTRVYAALLES

SEQ ID NO: 1532231 - protein, 18 aa, Mycobacterium tuberculosis
MPRDSWLIDRATLQPGPT

SEQ ID NO: 1532232 - protein, 21 aa, Mycobacterium tuberculosis
MRLDMPLVDFFSHGGALKSSW

SEQ ID NO: 1532233 - protein, 20 aa, Mycobacterium tuberculosis
NAPVLLGLIGLWYSNFFGAQ

SEQ ID NO: 1532234 - protein, 23 aa, Mycobacterium tuberculosis
NGPLSWLWQILFGTPNFPTSISA

SEQ ID NO: 1532235 - protein, 19 aa, Mycobacterium tuberculosis
NLRRRGDRWYWHWDPQFIG

SEQ ID NO: 1532236 - protein, 24 aa, Mycobacterium tuberculosis
NRVKTWLQFPQWFYLNIPVNTMVA

SEQ ID NO: 1532237 - protein, 25 aa, Mycobacterium tuberculosis
NTMLDLFLLILVELFRRHLSSTEQA

SEQ ID NO: 1532238 - protein, 18 aa, Mycobacterium tuberculosis
NVYYRRALMLAACFGRGS

SEQ ID NO: 1532239 - protein, 23 aa, Mycobacterium tuberculosis
PAGPADWALLGAALLGVGGSGAA

SEQ ID NO: 1532240 - protein, 23 aa, Mycobacterium tuberculosis
PDTTIVSWLPFYHDMGLVLGIIA

SEQ ID NO: 1532241 - protein, 24 aa, Mycobacterium tuberculosis
PEVATWLEVPLPPGVLRWQQDHGR

SEQ ID NO: 1532242 - protein, 26 aa, Mycobacterium tuberculosis
PEYRTMPMVWYIPPLSPVVDAVSRDG

SEQ ID NO: 1532243 - protein, 20 aa, Mycobacterium tuberculosis
PFDSPMYWHLFEPALRDAVD

SEQ ID NO: 1532244 - protein, 18 aa, Mycobacterium tuberculosis
PFFGSLLEFITSGPVVAA

SEQ ID NO: 1532245 - protein, 19 aa, Mycobacterium tuberculosis
PHRTVLPLEFARLAGYYLA

SEQ ID NO: 1532246 - protein, 23 aa, Mycobacterium tuberculosis
PKETWLRLLLIDAGLPVPTTQIP

SEQ ID NO: 1532247 - protein, 17 aa, Mycobacterium tuberculosis
PNYFFITGPDTAAQARC

SEQ ID NO: 1532248 - protein, 23 aa, Mycobacterium tuberculosis
PPDLTVVSWLPLYHDMGLLLGAI

SEQ ID NO: 1532249 - protein, 18 aa, Mycobacterium tuberculosis
PPYVVRWLVNGHETTVYP

SEQ ID NO: 1532250 - protein, 20 aa, Mycobacterium tuberculosis
PRLFGALFAPLGWCAKYTPG

SEQ ID NO: 1532251 - protein, 23 aa, Mycobacterium tuberculosis
PSTWPWNLLGWPSINVPAGFTSD

SEQ ID NO: 1532252 - protein, 17 aa, Mycobacterium tuberculosis
PTLIDLYLQGRLPLQRF

SEQ ID NO: 1532253 - protein, 19 aa, Mycobacterium tuberculosis
QFSVTLPRTLPGSGAGIIE

SEQ ID NO: 1532254 - protein, 19 aa, Mycobacterium tuberculosis
QRPITVPVLLLLTERFDLS

SEQ ID NO: 1532255 - protein, 18 aa, Mycobacterium tuberculosis
QVPLLLDEYTRNASTGSF

SEQ ID NO: 1532256 - protein, 20 aa, Mycobacterium tuberculosis
QWSIRQVPLHILLDGLDLRD

SEQ ID NO: 1532257 - protein, 28 aa, Mycobacterium tuberculosis
RAFLADKVVRWWLPERWAFVDEIPRTSV

SEQ ID NO: 1532258 - protein, 19 aa, Mycobacterium tuberculosis
RFHAVYWPAFLMSAGIELP

SEQ ID NO: 1532259 - protein, 17 aa, Mycobacterium tuberculosis
RIVLFRKPIERRAKDTE

SEQ ID NO: 1532260 - protein, 22 aa, Mycobacterium tuberculosis
RLADAWVWDMYRPARFVKQVRV

SEQ ID NO: 1532261 - protein, 29 aa, Mycobacterium tuberculosis
RMYNALLEAVFWFLSRKTPVFVKWLLRRT

SEQ ID NO: 1532262 - protein, 26 aa, Mycobacterium tuberculosis
RPAMFSTFLMWVLADLFTFLPEVGDL

SEQ ID NO: 1532263 - protein, 17 aa, Mycobacterium tuberculosis
RPVARIVPLKRRRQWLP

SEQ ID NO: 1532264 - protein, 20 aa, Mycobacterium tuberculosis
RREIGVPTVFNLLGPLTNPA

SEQ ID NO: 1532265 - protein, 23 aa, Mycobacterium tuberculosis
RREWAFPAWVPLPVSELALGRAH

SEQ ID NO: 1532266 - protein, 19 aa, Mycobacterium tuberculosis
RRRLDDLPVLYELAAEEAG

SEQ ID NO: 1532267 - protein, 24 aa, Mycobacterium tuberculosis
RRVGRPRIRLAYRLTPRRVLGQRR

SEQ ID NO: 1532268 - protein, 18 aa, Mycobacterium tuberculosis
RSEMAWAFPAVPMVARAP

SEQ ID NO: 1532269 - protein, 17 aa, Mycobacterium tuberculosis
RSTGIPVCLWFFAKDKA

SEQ ID NO: 1532270 - protein, 24 aa, Mycobacterium tuberculosis
RTRIRPHFFPFTEPSAEVDVWFAN

SEQ ID NO: 1532271 - protein, 24 aa, Mycobacterium tuberculosis
RVKCALLGWMAFKDALAQASEAFE

SEQ ID NO: 1532272 - protein, 22 aa, Mycobacterium tuberculosis
RVTAYRWFHAGLLPVPARKAGR

SEQ ID NO: 1532273 - protein, 17 aa, Mycobacterium tuberculosis
RVVTIAPGLFDTPLLAS

SEQ ID NO: 1532274 - protein, 21 aa, Mycobacterium tuberculosis
RWNPPLLFPAIYLADSAQACM

SEQ ID NO: 1532275 - protein, 20 aa, Mycobacterium tuberculosis
RYMHHYNFPPFSTGETGRVG

SEQ ID NO: 1532276 - protein, 24 aa, Mycobacterium tuberculosis
SAHAPFAPVPWLADVLRAGVPDGP

SEQ ID NO: 1532277 - protein, 23 aa, Mycobacterium tuberculosis
SDALDILRWAPQAASGPVAKVIA

SEQ ID NO: 1532278 - protein, 23 aa, Mycobacterium tuberculosis
SDFLGPINWMRPLRAIAARHEVL

SEQ ID NO: 1532279 - protein, 21 aa, Mycobacterium tuberculosis
SGCVLLPGLPYLGLEHRAAWV

SEQ ID NO: 1532280 - protein, 17 aa, Mycobacterium tuberculosis
SHRGRALALLLPALRSL

SEQ ID NO: 1532281 - protein, 19 aa, Mycobacterium tuberculosis
SLGWLRDFLRLHTGGLVVI

SEQ ID NO: 1532282 - protein, 27 aa, Mycobacterium tuberculosis
SLLGKPAVLWFWAPWCPTCQGEAPVVG

SEQ ID NO: 1532283 - protein, 18 aa, Mycobacterium tuberculosis
SRRHAFLASLLGIRHLVL

SEQ ID NO: 1532284 - protein, 24 aa, Mycobacterium tuberculosis
SSVLIQMMWAMRATGMWTDTRGAN

SEQ ID NO: 1532285 - protein, 17 aa, Mycobacterium tuberculosis
SVIPHVLVPGLAAALRA

SEQ ID NO: 1532286 - protein, 20 aa, Mycobacterium tuberculosis
TAFVRRPLRWIQALSEGSRT

SEQ ID NO: 1532287 - protein, 23 aa, Mycobacterium tuberculosis
TAKEPWFLDAYQRAWEWADAVHW

SEQ ID NO: 1532288 - protein, 25 aa, Mycobacterium tuberculosis
TERGLLLTTLWYIREVDPTTLLLTG

SEQ ID NO: 1532289 - protein, 21 aa, Mycobacterium tuberculosis
TKAGFDLALLRAVRAAVTVPV

SEQ ID NO: 1532290 - protein, 26 aa, Mycobacterium tuberculosis
TLPHPLAHLRAFVLIPWIAVDPTAQL

SEQ ID NO: 1532291 - protein, 23 aa, Mycobacterium tuberculosis
TPVFVKWLLRRTAIKNLPEGYDI

SEQ ID NO: 1532292 - protein, 23 aa, Mycobacterium tuberculosis
TRFALVLSRLFWDAAIFHRACEA

SEQ ID NO: 1532293 - protein, 18 aa, Mycobacterium tuberculosis
TSVPYFSLAMLPGGRRRA

SEQ ID NO: 1532294 - protein, 25 aa, Mycobacterium tuberculosis
TVARRLLPDPLQIGPIRLLGVGFSG

SEQ ID NO: 1532295 - protein, 18 aa, Mycobacterium tuberculosis
VFLQYPWQVIPDEIIKPL

SEQ ID NO: 1532296 - protein, 17 aa, Mycobacterium tuberculosis
VIGGGMCFTFLAAQGFS

SEQ ID NO: 1532297 - protein, 18 aa, Mycobacterium tuberculosis
VLLIMGLGAQMLLWRTDF

SEQ ID NO: 1532298 - protein, 18 aa, Mycobacterium tuberculosis
VMPRLLNVGPWATLALAN

SEQ ID NO: 1532299 - protein, 23 aa, Mycobacterium tuberculosis
VQAGLAMLAPIWGYAPLLDIDDA

SEQ ID NO: 1532300 - protein, 20 aa, Mycobacterium tuberculosis
VRGVLYFRTKRWPDVLAQFP

SEQ ID NO: 1532301 - protein, 24 aa, Mycobacterium tuberculosis
VSLRSLPLVMLIGRPEAQIPVVSF

SEQ ID NO: 1532302 - protein, 24 aa, Mycobacterium tuberculosis
VTFDLIHRLWLDLGHELHYVQNIT

SEQ ID NO: 1532303 - protein, 23 aa, Mycobacterium tuberculosis
VTLNLAMLTLLQKNIQGTIFGGG

SEQ ID NO: 1532304 - protein, 24 aa, Mycobacterium tuberculosis
WFGDQPFAVWPWAAPKLGGARPAV

SEQ ID NO: 1532305 - protein, 18 aa, Mycobacterium tuberculosis
WMRPMFRGLRHWRVLRLL

SEQ ID NO: 1532306 - protein, 24 aa, Mycobacterium tuberculosis
WPNPNDWWLVRLLGSITPTERTTI

SEQ ID NO: 1532307 - protein, 24 aa, Mycobacterium tuberculosis
WYDHVFFISVWWGWQDHFREIVNV

SEQ ID NO: 1532308 - protein, 27 aa, Mycobacterium tuberculosis
YQHPTRLHWYVPRSIRWIDRLKGVSPE

SEQ ID NO: 1532309 - protein, 23 aa, Mycobacterium tuberculosis
AAAKLAGLVFPQPPAPIAVSGTD

SEQ ID NO: 1532310 - protein, 19 aa, Mycobacterium tuberculosis
AAATPYVGWLAATAALAKE

SEQ ID NO: 1532311 - protein, 21 aa, Mycobacterium tuberculosis
AAHFLEHLLFKSTPTRSAVDI

SEQ ID NO: 1532312 - protein, 23 aa, Mycobacterium tuberculosis
AARDVDWWLTFSSAAALLGTPGQ

SEQ ID NO: 1532313 - protein, 24 aa, Mycobacterium tuberculosis
AAVHRLVTRLGLVTRLGLVERVDA

SEQ ID NO: 1532314 - protein, 24 aa, Mycobacterium tuberculosis
ADMPPPFRSLTPIPVHWVAAAVLD

SEQ ID NO: 1532315 - protein, 20 aa, Mycobacterium tuberculosis
AEALRWAMMRGEPLVVLADA

SEQ ID NO: 1532316 - protein, 22 aa, Mycobacterium tuberculosis
AEVHPHWIVLRTVIDVINPIEL

SEQ ID NO: 1532317 - protein, 24 aa, Mycobacterium tuberculosis
AEYSLDLFALLPLGELWVAAARMR

SEQ ID NO: 1532318 - protein, 18 aa, Mycobacterium tuberculosis
AFPQWFGRSWRRVAMLRY

SEQ ID NO: 1532319 - protein, 23 aa, Mycobacterium tuberculosis
AIDPVLLDLLRLGTYQLLRTRVD

SEQ ID NO: 1532320 - protein, 19 aa, Mycobacterium tuberculosis
ALVNLVRRLATPAWLSYTI

SEQ ID NO: 1532321 - protein, 27 aa, Mycobacterium tuberculosis
APHLVKPLPFLFPLTKRWWERPYIAAG

SEQ ID NO: 1532322 - protein, 20 aa, Mycobacterium tuberculosis
AQLVGWLEGLFHGIQTALFA

SEQ ID NO: 1532323 - protein, 24 aa, Mycobacterium tuberculosis
ASPPVKWPCFYGIDFPSPAELIAN

SEQ ID NO: 1532324 - protein, 20 aa, Mycobacterium tuberculosis
AVRLVRQIPYTLACDLLLTG

SEQ ID NO: 1532325 - protein, 17 aa, Mycobacterium tuberculosis
AVSLLLLSPAALNTLPG

SEQ ID NO: 1532326 - protein, 19 aa, Mycobacterium tuberculosis
AVVMTYWNPVLRYGVDAFA

SEQ ID NO: 1532327 - protein, 19 aa, Mycobacterium tuberculosis
CGALRRYHEALGVPISTLP

SEQ ID NO: 1532328 - protein, 23 aa, Mycobacterium tuberculosis
CGMFGNIIRLLPPLTIGDELLSE

SEQ ID NO: 1532329 - protein, 20 aa, Mycobacterium tuberculosis
DFFALFLDPTWVYTCAYFER

SEQ ID NO: 1532330 - protein, 21 aa, Mycobacterium tuberculosis
DIDGLRYLDWLAAYSAVNLGH

SEQ ID NO: 1532331 - protein, 22 aa, Mycobacterium tuberculosis
DIRINWVWNPPWGPDKITEDGR

SEQ ID NO: 1532332 - protein, 24 aa, Mycobacterium tuberculosis
DKYARLFAWLGLWERHTDLAVIPV

SEQ ID NO: 1532333 - protein, 20 aa, Mycobacterium tuberculosis
DLAWSRITYWRALLTSAVDQ

SEQ ID NO: 1532334 - protein, 24 aa, Mycobacterium tuberculosis
DLSTLRLIPWLPGTALVIADLVWA

SEQ ID NO: 1532335 - protein, 19 aa, Mycobacterium tuberculosis
DNEAKWFWFEGNFGAYEEN

SEQ ID NO: 1532336 - protein, 25 aa, Mycobacterium tuberculosis
DNPLHPLALPLLRPQQVIMLGRPTL

SEQ ID NO: 1532337 - protein, 23 aa, Mycobacterium tuberculosis
DNSTLAHLLKFDSILGRLPCDVG

SEQ ID NO: 1532338 - protein, 27 aa, Mycobacterium tuberculosis
DPWTVPKFYWTVLGLSALISGARALVP

SEQ ID NO: 1532339 - protein, 19 aa, Mycobacterium tuberculosis
DQLGLPTAPFWFVGSLGEL

SEQ ID NO: 1532340 - protein, 19 aa, Mycobacterium tuberculosis
DRLPGVRLWLYTNFHCNLC

SEQ ID NO: 1532341 - protein, 19 aa, Mycobacterium tuberculosis
DVLDTWFSSALWPFSTLGW

SEQ ID NO: 1532342 - protein, 23 aa, Mycobacterium tuberculosis
DVPTGVVVPYFWSDQYDVKIQCL

SEQ ID NO: 1532343 - protein, 17 aa, Mycobacterium tuberculosis
DVTIVEFLPRALPNEDA

SEQ ID NO: 1532344 - protein, 24 aa, Mycobacterium tuberculosis
EAGPDALIVVLLPDGGRGYMSKIF

SEQ ID NO: 1532345 - protein, 19 aa, Mycobacterium tuberculosis
EALARVFDYTLAIGKTPIV

SEQ ID NO: 1532346 - protein, 23 aa, Mycobacterium tuberculosis
EAMALLRLPLVLPAVQIAGRIVG

SEQ ID NO: 1532347 - protein, 18 aa, Mycobacterium tuberculosis
EFAEVYPLLDWAAPYQEM

SEQ ID NO: 1532348 - protein, 21 aa, Mycobacterium tuberculosis
EFKAMFQMKFYAVALFRSRGV

SEQ ID NO: 1532349 - protein, 23 aa, Mycobacterium tuberculosis
EHAVLHLLYSRFWHKVLYDLGHV

SEQ ID NO: 1532350 - protein, 20 aa, Mycobacterium tuberculosis
EKLVPDFLWISTEHTARVSL

SEQ ID NO: 1532351 - protein, 18 aa, Mycobacterium tuberculosis
ELLFLYNGVRPRNVMPVH

SEQ ID NO: 1532352 - protein, 18 aa, Mycobacterium tuberculosis
EVGWSMLPVARSVLRRIG

SEQ ID NO: 1532353 - protein, 21 aa, Mycobacterium tuberculosis
FDDLVSPFLGLYRDDNLRPNS

SEQ ID NO: 1532354 - protein, 22 aa, Mycobacterium tuberculosis
FEHLGRLLIIDCGVLFPGHDEP

SEQ ID NO: 1532355 - protein, 20 aa, Mycobacterium tuberculosis
FETVYLVHRLPAWSRNLTAK

SEQ ID NO: 1532356 - protein, 18 aa, Mycobacterium tuberculosis
FPLDWMLGRLGLAGFRIL

SEQ ID NO: 1532357 - protein, 17 aa, Mycobacterium tuberculosis
FSELFAAFPSFAGLRPT

SEQ ID NO: 1532358 - protein, 20 aa, Mycobacterium tuberculosis
GARVWPGVFLPDGGIRYSSD

SEQ ID NO: 1532359 - protein, 25 aa, Mycobacterium tuberculosis
GAVIYFLRKVIWFLPDFTVEGYHDR

SEQ ID NO: 1532360 - protein, 18 aa, Mycobacterium tuberculosis
GDITLGERLILSSGFVAV

SEQ ID NO: 1532361 - protein, 24 aa, Mycobacterium tuberculosis
GGGKRLRPLFAYWGWHAVASREPD

SEQ ID NO: 1532362 - protein, 23 aa, Mycobacterium tuberculosis
GGPDYLMFLYKTKGPVVFGDSAV

SEQ ID NO: 1532363 - protein, 25 aa, Mycobacterium tuberculosis
GNYSNGFFWRGDYQGLIGLSTTITI

SEQ ID NO: 1532364 - protein, 30 aa, Mycobacterium tuberculosis; identical to SEQ ID NO: 227537

SEQ ID NO: 1532365 - protein, 25 aa, Mycobacterium tuberculosis
GPMDRFHRRLLWPIRTSAGEVVGFG

SEQ ID NO: 1532366 - protein, 17 aa, Mycobacterium tuberculosis
GPRYWLMNAIEKAPQGP

SEQ ID NO: 1532367 - protein, 31 aa, Mycobacterium tuberculosis; identical to SEQ ID NO: 227175

SEQ ID NO: 1532368 - protein, 23 aa, Mycobacterium tuberculosis
GRGPLIRFLLIELPDECWHLVIV

SEQ ID NO: 1532369 - protein, 25 aa, Mycobacterium tuberculosis
GSACRPLYYLEMPPALFAPIVENLA

SEQ ID NO: 1532370 - protein, 21 aa, Mycobacterium tuberculosis
HAVRILARAWLYAIWHCWQDG

SEQ ID NO: 1532371 - protein, 18 aa, Mycobacterium tuberculosis
HLVCDLPDLLVAPAAPLT

SEQ ID NO: 1532372 - protein, 18 aa, Mycobacterium tuberculosis
HQVDPAHLWWIRSQLRSM

SEQ ID NO: 1532373 - protein, 24 aa, Mycobacterium tuberculosis
IAEEYYLSFLLDRANRTYLAMCSV

SEQ ID NO: 1532374 - protein, 25 aa, Mycobacterium tuberculosis
IAEGGWVLPYLPKPWGRAASPVEQI

SEQ ID NO: 1532375 - protein, 17 aa, Mycobacterium tuberculosis
IHLMGLDKTFRLFSTLH

SEQ ID NO: 1532376 - protein, 21 aa, Mycobacterium tuberculosis
INRILAYVAPILLGGPVTAVD

SEQ ID NO: 1532377 - protein, 24 aa, Mycobacterium tuberculosis
IRSAGAIFVGPWSPVSLGDYCAGS

SEQ ID NO: 1532378 - protein, 33 aa, Mycobacterium tuberculosis; identical to SEQ ID NO: 227634

SEQ ID NO: 1532379 - protein, 19 aa, Mycobacterium tuberculosis
KDELASCPPILVLTGRPDD

SEQ ID NO: 1532380 - protein, 24 aa, Mycobacterium tuberculosis
KDGEALFLRCNIWREAAENVAESL

SEQ ID NO: 1532381 - protein, 23 aa, Mycobacterium tuberculosis
KDLLPLLEKVIGAGKPLLIIAED

SEQ ID NO: 1532382 - protein, 18 aa, Mycobacterium tuberculosis
KETLIRYIDRFLIYYIRT

SEQ ID NO: 1532383 - protein, 18 aa, Mycobacterium tuberculosis
KIPLLFLQNIAGFMVGRD

SEQ ID NO: 1532384 - protein, 17 aa, Mycobacterium tuberculosis
KLYLLPGYHGTGAAAAL

SEQ ID NO: 1532385 - protein, 20 aa, Mycobacterium tuberculosis
KPAPLVPLYLRRPDAKPLAV

SEQ ID NO: 1532386 - protein, 17 aa, Mycobacterium tuberculosis
KRKIPLLFLQNIAGFMV

SEQ ID NO: 1532387 - protein, 23 aa, Mycobacterium tuberculosis
LADGRELLFFSLPGPRTSGTAAE

SEQ ID NO: 1532388 - protein, 17 aa, Mycobacterium tuberculosis
LADLSFADYLMWVRRDD

SEQ ID NO: 1532389 - protein, 18 aa, Mycobacterium tuberculosis
LAWLLTMAHRRAVDRVRC

SEQ ID NO: 1532390 - protein, 20 aa, Mycobacterium tuberculosis
LCYAGPFFRYERPQAGRYRQ

SEQ ID NO: 1532391 - protein, 20 aa, Mycobacterium tuberculosis
LDHAMWFMRPFRADEWLLYD

SEQ ID NO: 1532392 - protein, 25 aa, Mycobacterium tuberculosis
LIIGAWNYPFYLTLGPAVGAIAAGN

SEQ ID NO: 1532393 - protein, 24 aa, Mycobacterium tuberculosis
LINPHPLFVPWLVGPLLTGEGIQL

SEQ ID NO: 1532394 - protein, 25 aa, Mycobacterium tuberculosis
LIRYIDRFLIYYIRTADRLQRTAPW

SEQ ID NO: 1532395 - protein, 19 aa, Mycobacterium tuberculosis
LLECGLLRGWLIPPADIKA

SEQ ID NO: 1532396 - protein, 17 aa, Mycobacterium tuberculosis
LLKVRLRQGLPLARLGA

SEQ ID NO: 1532397 - protein, 20 aa, Mycobacterium tuberculosis
LLRFCRYMEALAAYKKYLDP

SEQ ID NO: 1532398 - protein, 20 aa, Mycobacterium tuberculosis
LPEQGAWLQPFRPLSSLLTS

SEQ ID NO: 1532399 - protein, 19 aa, Mycobacterium tuberculosis
LPGRPPLATYFLPNNRGKK

SEQ ID NO: 1532400 - protein, 26 aa, Mycobacterium tuberculosis
LRTEKSVMFVIPWGSHWIIGTTDTDW

SEQ ID NO: 1532401 - protein, 27 aa, Mycobacterium tuberculosis
LSDAELYLFFHLLFSAGAETTRNSIAG

SEQ ID NO: 1532402 - protein, 24 aa, Mycobacterium tuberculosis
LSHPYLDTVLFLLGVTRGEIEAAD

SEQ ID NO: 1532403 - protein, 20 aa, Mycobacterium tuberculosis
LSRNTFHWVLAFADSGLLTS

SEQ ID NO: 1532404 - protein, 17 aa, Mycobacterium tuberculosis
LVLCRLFWHPPTFRQAC

SEQ ID NO: 1532405 - protein, 17 aa, Mycobacterium tuberculosis
LVWRLCQRYPRAARRLI

SEQ ID NO: 1532406 - protein, 24 aa, Mycobacterium tuberculosis
MGHPRWWFDLLTTEPLAFASLDRW

SEQ ID NO: 1532407 - protein, 17 aa, Mycobacterium tuberculosis
MLLERLPRYLVPHHIVV

SEQ ID NO: 1532408 - protein, 19 aa, Mycobacterium tuberculosis
MLLVHFLRDQLRLTGTHWG

SEQ ID NO: 1532409 - protein, 18 aa, Mycobacterium tuberculosis
MMLSLPYQGLGNAAISAV

SEQ ID NO: 1532410 - protein, 20 aa, Mycobacterium tuberculosis
MQTVLPWFNLGNAAVSLGLA

SEQ ID NO: 1532411 - protein, 20 aa, Mycobacterium tuberculosis
MSDLRFLKFLRESIFPGGEL

SEQ ID NO: 1532412 - protein, 20 aa, Mycobacterium tuberculosis
MSLLLLIFPHLALAPYMRGL

SEQ ID NO: 1532413 - protein, 17 aa, Mycobacterium tuberculosis
MWFHGDLSRFNILTAQG

SEQ ID NO: 1532414 - protein, 23 aa, Mycobacterium tuberculosis
NRGSQFYLAMYWAQELAAQTDDQ

SEQ ID NO: 1532415 - protein, 26 aa, Mycobacterium tuberculosis
NSFTIPGFQIRVLLGPAAVLVNEMIG

SEQ ID NO: 1532416 - protein, 19 aa, Mycobacterium tuberculosis
NYDMSMARLLYWGCDVWLN

SEQ ID NO: 1532417 - protein, 19 aa, Mycobacterium tuberculosis
PADRPALPAALTILRDITA

SEQ ID NO: 1532418 - protein, 18 aa, Mycobacterium tuberculosis
PAKLAIPMRVIASVGAIL

SEQ ID NO: 1532419 - protein, 18 aa, Mycobacterium tuberculosis
PDLIYIDLHLVHEVTSPQ

SEQ ID NO: 1532420 - protein, 18 aa, Mycobacterium tuberculosis
PEINSGRMFFGAGSGPML

SEQ ID NO: 1532421 - protein, 24 aa, Mycobacterium tuberculosis
PENVSPLVVWLGSAESRDVTGKVF

SEQ ID NO: 1532422 - protein, 25 aa, Mycobacterium tuberculosis
PGAIIRDLNLLRPIYAPTAAYGHFG

SEQ ID NO: 1532423 - protein, 22 aa, Mycobacterium tuberculosis
PHHTRPTRFVWLQTPAIRARLL

SEQ ID NO: 1532424 - protein, 19 aa, Mycobacterium tuberculosis
PITLLHIVAPVVVGWPVGQ

SEQ ID NO: 1532425 - protein, 17 aa, Mycobacterium tuberculosis
PKGLGVIGLLIEDPKPL

SEQ ID NO: 1532426 - protein, 19 aa, Mycobacterium tuberculosis
PMVFPLWLERLQVKYINRA

SEQ ID NO: 1532427 - protein, 23 aa, Mycobacterium tuberculosis
PPHPAHFLWLNWGPCPPRQDMAY

SEQ ID NO: 1532428 - protein, 24 aa, Mycobacterium tuberculosis
PPNSALVSWLPFYHDMGLVIGICA

SEQ ID NO: 1532429 - protein, 20 aa, Mycobacterium tuberculosis
PPRWSISVPVLYALGALGSL

SEQ ID NO: 1532430 - protein, 23 aa, Mycobacterium tuberculosis
PSFAKELFLGRFPLGLIHPFPKP

SEQ ID NO: 1532431 - protein, 21 aa, Mycobacterium tuberculosis
PVWTFLGPRPAGWWVRRRLHE

SEQ ID NO: 1532432 - protein, 20 aa, Mycobacterium tuberculosis
PWEHPDFWDIWKASLQGVLA

SEQ ID NO: 1532433 - protein, 21 aa, Mycobacterium tuberculosis
PYFSLAMLPGGRRRALLTGTV

SEQ ID NO: 1532434 - protein, 24 aa, Mycobacterium tuberculosis
QEDFIGIHFFSPVDKMPLVEIIKG

SEQ ID NO: 1532435 - protein, 18 aa, Mycobacterium tuberculosis
QETLYWLAQPGIRESIAE

SEQ ID NO: 1532436 - protein, 17 aa, Mycobacterium tuberculosis
QGILTYMRAIWTGSIAF

SEQ ID NO: 1532437 - protein, 20 aa, Mycobacterium tuberculosis
QIGYSLLFRLASGSLLGPDR

SEQ ID NO: 1532438 - protein, 19 aa, Mycobacterium tuberculosis
QVRLPGFRPGKAPAKLLEA

SEQ ID NO: 1532439 - protein, 22 aa, Mycobacterium tuberculosis
QVVPIRVYRWKPAPLGGVFDHL

SEQ ID NO: 1532440 - protein, 24 aa, Mycobacterium tuberculosis
QVVSIPTLILFKDGQPVKRIVGAK

SEQ ID NO: 1532441 - protein, 18 aa, Mycobacterium tuberculosis
RALMAKRAPLYRRVATMR

SEQ ID NO: 1532442 - protein, 24 aa, Mycobacterium tuberculosis
RARISGMPVLFWLDPYRPHENELI

SEQ ID NO: 1532443 - protein, 20 aa, Mycobacterium tuberculosis
RAYKMWLPPLTNPVPLNELI

SEQ ID NO: 1532444 - protein, 25 aa, Mycobacterium tuberculosis
RDTYDAMFDLWFPAALGARAVITTE

SEQ ID NO: 1532445 - protein, 17 aa, Mycobacterium tuberculosis
RFALTHFGLFGFAVMSC

SEQ ID NO: 1532446 - protein, 18 aa, Mycobacterium tuberculosis
RFALVLCRLFWHPPTFRQ

SEQ ID NO: 1532447 - protein, 18 aa, Mycobacterium tuberculosis
RFRRSIQTILLAALGRTI

SEQ ID NO: 1532448 - protein, 24 aa, Mycobacterium tuberculosis
RGAKNVLLVFFPLAFTGICQGELD

SEQ ID NO: 1532449 - protein, 19 aa, Mycobacterium tuberculosis
RGRFRWWGLYTQREQGYDG

SEQ ID NO: 1532450 - protein, 17 aa, Mycobacterium tuberculosis
RHEILQLELLKPKIAIL

SEQ ID NO: 1532451 - protein, 25 aa, Mycobacterium tuberculosis
RIEFKLRDWLFARQRYWGEPFPIVY

SEQ ID NO: 1532452 - protein, 22 aa, Mycobacterium tuberculosis
RIEGWMPFGRVFETLAWGRRHV

SEQ ID NO: 1532453 - protein, 24 aa, Mycobacterium tuberculosis
RKRGHWMWFVFPQLRGLGSSPLAV

SEQ ID NO: 1532454 - protein, 18 aa, Mycobacterium tuberculosis
RLGDEFITGVLFYTGARA

SEQ ID NO: 1532455 - protein, 21 aa, Mycobacterium tuberculosis
RLVRLHLLHLLQTISPHTAEL

SEQ ID NO: 1532456 - protein, 26 aa, Mycobacterium tuberculosis
RQLVDDRWVWLPTLLAGRVFTHRLGA

SEQ ID NO: 1532457 - protein, 19 aa, Mycobacterium tuberculosis
RQLYDLDALPDHLIVVGSG

SEQ ID NO: 1532458 - protein, 21 aa, Mycobacterium tuberculosis
RRRVALCKLLLSKPDLLLLDE

SEQ ID NO: 1532459 - protein, 17 aa, Mycobacterium tuberculosis
RVLFFRWGQHPVALTAF

SEQ ID NO: 1532460 - protein, 17 aa, Mycobacterium tuberculosis
RVWKALLTIPYGETRSY

SEQ ID NO: 1532461 - protein, 26 aa, Mycobacterium tuberculosis
RVYCPGWVALFRWLKPLLSTRVGQRP

SEQ ID NO: 1532462 - protein, 20 aa, Mycobacterium tuberculosis
RVYGTLPWHPDLWLDSEDAL

SEQ ID NO: 1532463 - protein, 21 aa, Mycobacterium tuberculosis
SAELPLFRYVGGPNAHILPVP

SEQ ID NO: 1532464 - protein, 19 aa, Mycobacterium tuberculosis
SEGLLYERRLFHSAFATED

SEQ ID NO: 1532465 - protein, 24 aa, Mycobacterium tuberculosis
SGSGPAYFFLLVEALVDAGVGVGL

SEQ ID NO: 1532466 - protein, 18 aa, Mycobacterium tuberculosis
SMFQAILPLRGKIINVEK

SEQ ID NO: 1532467 - protein, 23 aa, Mycobacterium tuberculosis
SMVAAVLPFVGWLSTTATLAEQA

SEQ ID NO: 1532468 - protein, 25 aa, Mycobacterium tuberculosis
SRERGYAYFLYPPQVPLTETAYDRL

SEQ ID NO: 1532469 - protein, 21 aa, Mycobacterium tuberculosis
STDYLFWRDDDGDYWLAGGRG

SEQ ID NO: 1532470 - protein, 24 aa, Mycobacterium tuberculosis
SVVAPLLSRSLILQLRPLTAEDTR

SEQ ID NO: 1532471 - protein, 20 aa, Mycobacterium tuberculosis
TAAPIERILLRYKAINRVAV

SEQ ID NO: 1532472 - protein, 20 aa, Mycobacterium tuberculosis
TAARNFYYGIRLLPREKRAA

SEQ ID NO: 1532473 - protein, 22 aa, Mycobacterium tuberculosis
TATILAQALIKGGLRLVAAGVN

SEQ ID NO: 1532474 - protein, 22 aa, Mycobacterium tuberculosis
TNPSPYMYLLQVPNSDGAVDFS

SEQ ID NO: 1532475 - protein, 24 aa, Mycobacterium tuberculosis
TPAMWAWWFGWHGSDTRRYKLWHP

SEQ ID NO: 1532476 - protein, 27 aa, Mycobacterium tuberculosis
TPYSRMWGAYLTGMWLYRLSLAKVKWH

SEQ ID NO: 1532477 - protein, 18 aa, Mycobacterium tuberculosis
TTAAAILGLLPAGGRITA

SEQ ID NO: 1532478 - protein, 25 aa, Mycobacterium tuberculosis
TTRLRFNFFVLKLPIRPPALVAKQA

SEQ ID NO: 1532479 - protein, 21 aa, Mycobacterium tuberculosis
VAAKRRHLYYVRPLDGHPVAR

SEQ ID NO: 1532480 - protein, 23 aa, Mycobacterium tuberculosis
VDQTLWGWPQLAGDIWVGAATVA

SEQ ID NO: 1532481 - protein, 24 aa, Mycobacterium tuberculosis
VERDLRVIIHGWLAFTFELCRQRI

SEQ ID NO: 1532482 - protein, 25 aa, Mycobacterium tuberculosis
VPHYGIGYGLLRYVYAPTGRVLGAQ

SEQ ID NO: 1532483 - protein, 19 aa, Mycobacterium tuberculosis
VRALLTGYLLYTLGGDKTY

SEQ ID NO: 1532484 - protein, 25 aa, Mycobacterium tuberculosis
VRSRLMLDIARWRRRRREELAALAD

SEQ ID NO: 1532485 - protein, 19 aa, Mycobacterium tuberculosis
VVGVWRRAPLQALARLHML

SEQ ID NO: 1532486 - protein, 19 aa, Mycobacterium tuberculosis
VVINPFFDWAYDRSPRTPY

SEQ ID NO: 1532487 - protein, 19 aa, Mycobacterium tuberculosis
VVIPFLLPDIPVVAWWPDI

SEQ ID NO: 1532488 - protein, 23 aa, Mycobacterium tuberculosis
VWGHRLAHWLWQRGARLLARAAA

SEQ ID NO: 1532489 - protein, 17 aa, Mycobacterium tuberculosis
WAAAPDGWLAIPHGEIL

SEQ ID NO: 1532490 - protein, 18 aa, Mycobacterium tuberculosis
WALIGYRIPTPIPRIGYA

SEQ ID NO: 1532491 - protein, 18 aa, Mycobacterium tuberculosis
WKYLMALFSSKIDEHADP

SEQ ID NO: 1532492 - protein, 17 aa, Mycobacterium tuberculosis
WPDFPCDGLYKFRVHGA

SEQ ID NO: 1532493 - protein, 23 aa, Mycobacterium tuberculosis
YNDVPFYFHYLGPGAQLDGPEIM

SEQ ID NO: 1532494 - protein, 24 aa, Mycobacterium tuberculosis
YVHPEIEFFLLKPGPEDGSVPVPV

SEQ ID NO: 1532495 - protein, 17 aa, Mycobacterium tuberculosis
AAILGLLPAGGRITAGR

SEQ ID NO: 1532496 - protein, 23 aa, Mycobacterium tuberculosis
AARLDLAAVFLYAGSILPGRAKL

SEQ ID NO: 1532497 - protein, 22 aa, Mycobacterium tuberculosis
ACELYDLPTLWQIAAHNPWLSV

SEQ ID NO: 1532498 - protein, 24 aa, Mycobacterium tuberculosis
ADCELDWWLGFSSAASLLGSPGQA

SEQ ID NO: 1532499 - protein, 22 aa, Mycobacterium tuberculosis
ADLPAFAELLARLPWPLNKTTS

SEQ ID NO: 1532500 - protein, 21 aa, Mycobacterium tuberculosis
ADVIRYLRWFTFLSADELAEL

SEQ ID NO: 1532501 - protein, 19 aa, Mycobacterium tuberculosis
AEGLRALYLYTATFQDAAV

SEQ ID NO: 1532502 - protein, 23 aa, Mycobacterium tuberculosis
AELDRVWGHLPFGAQWYSANELA

SEQ ID NO: 1532503 - protein, 19 aa, Mycobacterium tuberculosis
AFNFPVAVWAWNTAVALVC

SEQ ID NO: 1532504 - protein, 22 aa, Mycobacterium tuberculosis
AHHRLFSHVPWLASQLLGAVEA

SEQ ID NO: 1532505 - protein, 23 aa, Mycobacterium tuberculosis
ARFPGFYIPFLDVPFNGATPANS

SEQ ID NO: 1532506 - protein, 25 aa, Mycobacterium tuberculosis
ARRLALLLTFPRFLPTTGPITMRST

SEQ ID NO: 1532507 - protein, 25 aa, Mycobacterium tuberculosis
ARTVFIELLAWQFASPVRWIETQDL

SEQ ID NO: 1532508 - protein, 20 aa, Mycobacterium tuberculosis
ASATLIWRRPRWARRLQPAP

SEQ ID NO: 1532509 - protein, 21 aa, Mycobacterium tuberculosis
ASIGFPPYHPPMRTFLGVPVR

SEQ ID NO: 1532510 - protein, 20 aa, Mycobacterium tuberculosis
AVFNGFLPAVARMRALDPVT

SEQ ID NO: 1532511 - protein, 22 aa, Mycobacterium tuberculosis
AWLDALVGWRRASGLPAAVINW

SEQ ID NO: 1532512 - protein, 24 aa, Mycobacterium tuberculosis
CAEDLFAGWWRLIEALGAVPRVLV

SEQ ID NO: 1532513 - protein, 21 aa, Mycobacterium tuberculosis
CALPLHRRFGLAATARASFAV

SEQ ID NO: 1532514 - protein, 18 aa, Mycobacterium tuberculosis
CEEAPFYTLGPLATDIAP

SEQ ID NO: 1532515 - protein, 17 aa, Mycobacterium tuberculosis
CSSRFPYYLETYGFHSI

SEQ ID NO: 1532516 - protein, 17 aa, Mycobacterium tuberculosis
DALGRWLLARTAEIVAG

SEQ ID NO: 1532517 - protein, 25 aa, Mycobacterium tuberculosis
DDARWDAVLAVNLLAPLRLTEGLVG

SEQ ID NO: 1532518 - protein, 23 aa, Mycobacterium tuberculosis
DDELFFFAVLLLVAGYESTAHMI

SEQ ID NO: 1532519 - protein, 18 aa, Mycobacterium tuberculosis
DDFAKHPFLVKGYIGPKA

SEQ ID NO: 1532520 - protein, 23 aa, Mycobacterium tuberculosis
DFTNIYFYTVLYHALRASNRIAI

SEQ ID NO: 1532521 - protein, 21 aa, Mycobacterium tuberculosis
DNALGFLYDTGLYLRFRATGP

SEQ ID NO: 1532522 - protein, 22 aa, Mycobacterium tuberculosis
DNPHPLLLLTHPVPNTGAVVVQ

SEQ ID NO: 1532523 - protein, 24 aa, Mycobacterium tuberculosis
DPHKVAMLGLTFDDVLLLPAASDV

SEQ ID NO: 1532524 - protein, 22 aa, Mycobacterium tuberculosis
DPRLWYYRFQTSAIGWNPGVNV

SEQ ID NO: 1532525 - protein, 20 aa, Mycobacterium tuberculosis
DSWIQIEQFRLLVLRTAWLI

SEQ ID NO: 1532526 - protein, 20 aa, Mycobacterium tuberculosis
DVCLWLLRNDVCPDKLTWIM

SEQ ID NO: 1532527 - protein, 19 aa, Mycobacterium tuberculosis
EFITGVLFYTGARALPFGD

SEQ ID NO: 1532528 - protein, 24 aa, Mycobacterium tuberculosis
EGPLPQTRFVLRKALAAHLPVILV

SEQ ID NO: 1532529 - protein, 21 aa, Mycobacterium tuberculosis
EIRHWLQIFVQRFYSFSQFKR

SEQ ID NO: 1532530 - protein, 20 aa, Mycobacterium tuberculosis
ELIRLLLNRALTTAGDDLAS

SEQ ID NO: 1532531 - protein, 18 aa, Mycobacterium tuberculosis
ELLRLLAFSRIGALPITK

SEQ ID NO: 1532532 - protein, 20 aa, Mycobacterium tuberculosis
ELSSFQLHWAPSLRPEAGAV

SEQ ID NO: 1532533 - protein, 20 aa, Mycobacterium tuberculosis
ELVYDGLWYSPLKAALEAFV

SEQ ID NO: 1532534 - protein, 22 aa, Mycobacterium tuberculosis
EQKRFFLPRIAAGDLHFSIGYS

SEQ ID NO: 1532535 - protein, 21 aa, Mycobacterium tuberculosis
ESTLGLIFHWADQRGLPLLDL

SEQ ID NO: 1532536 - protein, 18 aa, Mycobacterium tuberculosis
FAAFPSFAGLRPTFDTRL

SEQ ID NO: 1532537 - protein, 24 aa, Mycobacterium tuberculosis
FDPRLKRPIPYLPNMIGLITGRAS

SEQ ID NO: 1532538 - protein, 17 aa, Mycobacterium tuberculosis
FHDMGMVGFLTIPMFFG

SEQ ID NO: 1532539 - protein, 18 aa, Mycobacterium tuberculosis
FHWVLAFADSGLLTSAVY

SEQ ID NO: 1532540 - protein, 18 aa, Mycobacterium tuberculosis
FIMLIAENHWRVAEEPVE

SEQ ID NO: 1532541 - protein, 24 aa, Mycobacterium tuberculosis
FLDTGAMYRIVTLAVLRAGADPSD

SEQ ID NO: 1532542 - protein, 17 aa, Mycobacterium tuberculosis
FLPFPFDSVIAGGASMA

SEQ ID NO: 1532543 - protein, 23 aa, Mycobacterium tuberculosis
FMVRNTYIYPPKPSMRIISDIFA

SEQ ID NO: 1532544 - protein, 25 aa, Mycobacterium tuberculosis
FYRWTQWIFLQIYNAWFDTTANKAR

SEQ ID NO: 1532545 - protein, 18 aa, Mycobacterium tuberculosis
GDPTLRRLLPDFYRPDDL

SEQ ID NO: 1532546 - protein, 24 aa, Mycobacterium tuberculosis
GETLEEYWWAAEQMLTWPDPDKPA

SEQ ID NO: 1532547 - protein, 21 aa, Mycobacterium tuberculosis
GGAIRIPLISIPAAPGFGNST

SEQ ID NO: 1532548 - protein, 24 aa, Mycobacterium tuberculosis
GGQEILFPALLPRAPYETTNRWTQ

SEQ ID NO: 1532549 - protein, 24 aa, Mycobacterium tuberculosis
GGSYYVEWLTHRLARRARAHIAEV

SEQ ID NO: 1532550 - protein, 23 aa, Mycobacterium tuberculosis
GGVLERYVGLYLPFLDMSFNGAT

SEQ ID NO: 1532551 - protein, 23 aa, Mycobacterium tuberculosis
GIDDALAVIYLLASPDADLVGIA

SEQ ID NO: 1532552 - protein, 27 aa, Mycobacterium tuberculosis
GLRRSLIALRSQRYFRLLDALDALVSE

SEQ ID NO: 1532553 - protein, 23 aa, Mycobacterium tuberculosis
GSDPLLAVPFSYPASLPTPFGPV

SEQ ID NO: 1532554 - protein, 24 aa, Mycobacterium tuberculosis
GTLGYFPLWGYATPPAIELAERLA

SEQ ID NO: 1532555 - protein, 22 aa, Mycobacterium tuberculosis
GVAFDILRRWLLARGYDVAFIR

SEQ ID NO: 1532556 - protein, 27 aa, Mycobacterium tuberculosis
GVILAVMPWNFPLWQAVRFAAPALMAG

SEQ ID NO: 1532557 - protein, 18 aa, Mycobacterium tuberculosis
GWRISLPAMVCYWSELAR

SEQ ID NO: 1532558 - protein, 23 aa, Mycobacterium tuberculosis
HELQRLWLIEATRYNVLPLDDDT

SEQ ID NO: 1532559 - protein, 23 aa, Mycobacterium tuberculosis
HGLPLTLWLARFLKFIATEIFPG

SEQ ID NO: 1532560 - protein, 21 aa, Mycobacterium tuberculosis
HGQVLVFWDCYRPHDVQVRMF

SEQ ID NO: 1532561 - protein, 17 aa, Mycobacterium tuberculosis
HGRDEIWRFTPLRRLRG

SEQ ID NO: 1532562 - protein, 19 aa, Mycobacterium tuberculosis
HIDKWNFTVPFVCGATNLG

SEQ ID NO: 1532563 - protein, 23 aa, Mycobacterium tuberculosis
HSRRGLLLLVGRRRRLIKYISQI

SEQ ID NO: 1532564 - protein, 18 aa, Mycobacterium tuberculosis
HWPAFRHVDFLRALRDYS

SEQ ID NO: 1532565 - protein, 20 aa, Mycobacterium tuberculosis
HYYMFLTQDLPLLQPIRAIP

SEQ ID NO: 1532566 - protein, 20 aa, Mycobacterium tuberculosis
IARRVFATCRRLGLGTVAVY

SEQ ID NO: 1532567 - protein, 26 aa, Mycobacterium tuberculosis
IDHIIGLFRLWWIPDGAPPTQGTYVR

SEQ ID NO: 1532568 - protein, 25 aa, Mycobacterium tuberculosis
IFDVNLWAPLMWTSLVVTAWMGEHG

SEQ ID NO: 1532569 - protein, 28 aa, Mycobacterium tuberculosis
IGIDPAAVSPWWLQRRLLLCGIRATCPA

SEQ ID NO: 1532570 - protein, 17 aa, Mycobacterium tuberculosis
IITGYRLSPRDATVAVM

SEQ ID NO: 1532571 - protein, 18 aa, Mycobacterium tuberculosis
ILGLLPAGGRITAGRVVF

SEQ ID NO: 1532572 - protein, 19 aa, Mycobacterium tuberculosis
INRSLLLDGLRRIGIDRLA

SEQ ID NO: 1532573 - protein, 19 aa, Mycobacterium tuberculosis
IRAFLRRFVVYPSDHELIA

SEQ ID NO: 1532574 - protein, 19 aa, Mycobacterium tuberculosis
IRVLTLAALAPRPGQRLWD

SEQ ID NO: 1532575 - protein, 17 aa, Mycobacterium tuberculosis
IYLAGRTADWMRVDGEN

SEQ ID NO: 1532576 - protein, 17 aa, Mycobacterium tuberculosis
KGGGRLPITLWIVDTNA

SEQ ID NO: 1532577 - protein, 19 aa, Mycobacterium tuberculosis
KGQFYCSISVPLDLYSCAV

SEQ ID NO: 1532578 - protein, 22 aa, Mycobacterium tuberculosis
KLLRLWRPPLRPGEWRTLGLFA

SEQ ID NO: 1532579 - protein, 23 aa, Mycobacterium tuberculosis
LAAMGFKFQFITLAGFHALNYSM

SEQ ID NO: 1532580 - protein, 24 aa, Mycobacterium tuberculosis
LAQEWLRFGWFFLVTRRDPKGLWE

SEQ ID NO: 1532581 - protein, 18 aa, Mycobacterium tuberculosis
LASLRRLIESPSHDVIAV

SEQ ID NO: 1532582 - protein, 18 aa, Mycobacterium tuberculosis
LDRLYVVALPMRVRFRGI

SEQ ID NO: 1532583 - protein, 19 aa, Mycobacterium tuberculosis
LDTLLRLLHPVIPFLTEAL

SEQ ID NO: 1532584 - protein, 17 aa, Mycobacterium tuberculosis
LDVAFAHDIRLIASALG

SEQ ID NO: 1532585 - protein, 23 aa, Mycobacterium tuberculosis
LENPGLLRFLPQLSERLLDESPL

SEQ ID NO: 1532586 - protein, 24 aa, Mycobacterium tuberculosis
LFGSWHYWWQAHLLDCLVDAQLRD

SEQ ID NO: 1532587 - protein, 22 aa, Mycobacterium tuberculosis
LGLVERLPWLSAVPAYFVGVGV

SEQ ID NO: 1532588 - protein, 18 aa, Mycobacterium tuberculosis
LIVIPNDRLLQMGDAAVS

SEQ ID NO: 1532589 - protein, 25 aa, Mycobacterium tuberculosis
LLSDGPVVLFFYPAAMTPGCTKEAC

SEQ ID NO: 1532590 - protein, 24 aa, Mycobacterium tuberculosis
LPATHIGGLWWILTCLMHGGLCVT

SEQ ID NO: 1532591 - protein, 21 aa, Mycobacterium tuberculosis
LPQQALLYRLCGDRNPLHSDP

SEQ ID NO: 1532592 - protein, 18 aa, Mycobacterium tuberculosis
LQLGLLQLALKLAVDNGF

SEQ ID NO: 1532593 - protein, 18 aa, Mycobacterium tuberculosis
LRRRSVRFFGTYDVLLTP

SEQ ID NO: 1532594 - protein, 22 aa, Mycobacterium tuberculosis
LSQVPWLWAKFIGHAQAIAPAP

SEQ ID NO: 1532595 - protein, 20 aa, Mycobacterium tuberculosis
MAHFFYIHFGLPTYFKNVFE

SEQ ID NO: 1532596 - protein, 25 aa, Mycobacterium tuberculosis
MARLLYWGCDVWLNNPLRPLEACGT

SEQ ID NO: 1532597 - protein, 17 aa, Mycobacterium tuberculosis
MIYYPLTTLMMAGIRDI

SEQ ID NO: 1532598 - protein, 18 aa, Mycobacterium tuberculosis
MVGFLTIPMFFGAELVKV

SEQ ID NO: 1532599 - protein, 18 aa, Mycobacterium tuberculosis
NAMPPLDHRAPGPVLALL

SEQ ID NO: 1532600 - protein, 22 aa, Mycobacterium tuberculosis
NLPITLWPGMKIGQLCMLRLTS

SEQ ID NO: 1532601 - protein, 20 aa, Mycobacterium tuberculosis
NPPMIRYPIPPMIHGATQSA

SEQ ID NO: 1532602 - protein, 19 aa, Mycobacterium tuberculosis
NWRPGWFPTMHSRCLSNLI

SEQ ID NO: 1532603 - protein, 19 aa, Mycobacterium tuberculosis
PARWPLPVLPSSRSGPAPQ

SEQ ID NO: 1532604 - protein, 24 aa, Mycobacterium tuberculosis
PDGLPVWIYQFKISPHPTIPLAPT

SEQ ID NO: 1532605 - protein, 22 aa, Mycobacterium tuberculosis
PDLLPLLEKVAGTGKPLLIVAE

SEQ ID NO: 1532606 - protein, 25 aa, Mycobacterium tuberculosis
PEAITRPRWLWKFAKTLRPPDLRVP

SEQ ID NO: 1532607 - protein, 20 aa, Mycobacterium tuberculosis
PEFLPLLRRLGRFLPADVRI

SEQ ID NO: 1532608 - protein, 27 aa, Mycobacterium tuberculosis
PETNSLRMYLGAGSRPLLAAAGAWDGL

SEQ ID NO: 1532609 - protein, 21 aa, Mycobacterium tuberculosis
PEVHRWWTSLTSEERQRLIAE

SEQ ID NO: 1532610 - protein, 18 aa, Mycobacterium tuberculosis
PGMKIGQLCMLRLTSPSE

SEQ ID NO: 1532611 - protein, 17 aa, Mycobacterium tuberculosis
PLTFICVFGYKAQAAFF

SEQ ID NO: 1532612 - protein, 27 aa, Mycobacterium tuberculosis
PPHGWVNLHFSLLPAWRGAAPVQAAIA

SEQ ID NO: 1532613 - protein, 20 aa, Mycobacterium tuberculosis
PPSWAWPKPAVAPPVLFGCR

SEQ ID NO: 1532614 - protein, 20 aa, Mycobacterium tuberculosis
PPTFVLFTTGFLEAGYRRFL

SEQ ID NO: 1532615 - protein, 17 aa, Mycobacterium tuberculosis
PVNPWDPTAWAGVSSSG

SEQ ID NO: 1532616 - protein, 26 aa, Mycobacterium tuberculosis
QFLGRRRFVYPWVAWLVQRGAAPGDV

SEQ ID NO: 1532617 - protein, 23 aa, Mycobacterium tuberculosis
QISKPMLYLYYGSKEDLFGACLN

SEQ ID NO: 1532618 - protein, 19 aa, Mycobacterium tuberculosis
QLGMPPWRVQKAQKQARRW

SEQ ID NO: 1532619 - protein, 24 aa, Mycobacterium tuberculosis
QWHQLARAFLMYVTQRWPDVLSTA

SEQ ID NO: 1532620 - protein, 23 aa, Mycobacterium tuberculosis
RAGKLPVTLFTAGGIATPADAAM

SEQ ID NO: 1532621 - protein, 19 aa, Mycobacterium tuberculosis
RAIGLFRYQLIWEAADAAH

SEQ ID NO: 1532622 - protein, 19 aa, Mycobacterium tuberculosis
RARFNLRYPLAHLRPFLST

SEQ ID NO: 1532623 - protein, 24 aa, Mycobacterium tuberculosis
RDPYHAYTIDWLPEGWFIEVSEVA

SEQ ID NO: 1532624 - protein, 28 aa, Mycobacterium tuberculosis
REAFLALIRSNWLGLNAPWIAAVESLYE

SEQ ID NO: 1532625 - protein, 22 aa, Mycobacterium tuberculosis
REKLFPLICRYAVAYHVVFIPS

SEQ ID NO: 1532626 - protein, 17 aa, Mycobacterium tuberculosis
RGALLQLGLLQLALKLA

SEQ ID NO: 1532627 - protein, 17 aa, Mycobacterium tuberculosis
RNLLRPNQFPYQSKTGW

SEQ ID NO: 1532628 - protein, 19 aa, Mycobacterium tuberculosis
RPLIRLSLGKRHPMRRIVS

SEQ ID NO: 1532629 - protein, 21 aa, Mycobacterium tuberculosis
RQVLLPLWNTYSFLALYAPKV

SEQ ID NO: 1532630 - protein, 20 aa, Mycobacterium tuberculosis
RRRCGWFDAVIARYAARVNG

SEQ ID NO: 1532631 - protein, 23 aa, Mycobacterium tuberculosis
RRVRLMRWGLIPSWIKAGPGGAP

SEQ ID NO: 1532632 - protein, 19 aa, Mycobacterium tuberculosis
RTFDFLGIRDLTAGKPIII

SEQ ID NO: 1532633 - protein, 20 aa, Mycobacterium tuberculosis
RTKLLRLFPTIFKGAHVELD

SEQ ID NO: 1532634 - protein, 20 aa, Mycobacterium tuberculosis
RTSDLIPLCHQLALTGVDVD

SEQ ID NO: 1532635 - protein, 19 aa, Mycobacterium tuberculosis
RYGVRWHYRLPVWSDFVEV

SEQ ID NO: 1532636 - protein, 25 aa, Mycobacterium tuberculosis
SALVVFEVMVRPLIRLSLGKRHPMR

SEQ ID NO: 1532637 - protein, 22 aa, Mycobacterium tuberculosis
SEALAAPLFWIAANAGLDGSVV

SEQ ID NO: 1532638 - protein, 17 aa, Mycobacterium tuberculosis
SHKLLIRAGYIRPVAPG

SEQ ID NO: 1532639 - protein, 17 aa, Mycobacterium tuberculosis
SLTLLPKLSPRAAARYY

SEQ ID NO: 1532640 - protein, 24 aa, Mycobacterium tuberculosis
SPAMNFFPARLTAIGLTLPFGEVT

SEQ ID NO: 1532641 - protein, 20 aa, Mycobacterium tuberculosis
SQLLYWTQVLMISRGLSLDD

SEQ ID NO: 1532642 - protein, 26 aa, Mycobacterium tuberculosis
SSYLLNGLFFSLPWYYRSGYDVLLYT

SEQ ID NO: 1532643 - protein, 21 aa, Mycobacterium tuberculosis
STGVAYIRWLLRARPADYMLA

SEQ ID NO: 1532644 - protein, 21 aa, Mycobacterium tuberculosis
STPLFFAQAIGRFVRSRRPGE

SEQ ID NO: 1532645 - protein, 24 aa, Mycobacterium tuberculosis
SVPMYKLRRYFPPDNRPGQPPVGP

SEQ ID NO: 1532646 - protein, 20 aa, Mycobacterium tuberculosis
TALRFLPMEELIAAFLPVLF

SEQ ID NO: 1532647 - protein, 24 aa, Mycobacterium tuberculosis
TAVFEIFFRKLPPGRSYIMAAGLA

SEQ ID NO: 1532648 - protein, 23 aa, Mycobacterium tuberculosis
TEVRLFLRRVPALAFLPNRRPAE

SEQ ID NO: 1532649 - protein, 18 aa, Mycobacterium tuberculosis
TFHIAQLLPWIEANFRTY

SEQ ID NO: 1532650 - protein, 17 aa, Mycobacterium tuberculosis
TGRRVYGTLPWHPDLWL

SEQ ID NO: 1532651 - protein, 18 aa, Mycobacterium tuberculosis
TGRSWPLADVRLLAPILA

SEQ ID NO: 1532652 - protein, 23 aa, Mycobacterium tuberculosis
TIPSFIPEDFTFLDAIFAGYATV

SEQ ID NO: 1532653 - protein, 18 aa, Mycobacterium tuberculosis
TPMDFLRDTLLWAKLIDK

SEQ ID NO: 1532654 - protein, 20 aa, Mycobacterium tuberculosis
TPWNFPHQINLAKLGPALAA

SEQ ID NO: 1532655 - protein, 20 aa, Mycobacterium tuberculosis
TRMFTVLFALGRLPGWIAHW

SEQ ID NO: 1532656 - protein, 21 aa, Mycobacterium tuberculosis
TVMEDYFYRPFRDLVIRAAER

SEQ ID NO: 1532657 - protein, 20 aa, Mycobacterium tuberculosis
TWRYPAFFHAMLDAGVYPPC

SEQ ID NO: 1532658 - protein, 20 aa, Mycobacterium tuberculosis
VAVLKILALQFIMSDPRHLE

SEQ ID NO: 1532659 - protein, 25 aa, Mycobacterium tuberculosis
VDDDLADLFLPRPLRWLAGATRSAV

SEQ ID NO: 1532660 - protein, 20 aa, Mycobacterium tuberculosis
VGFKWFVDGLIGATLGFGGE

SEQ ID NO: 1532661 - protein, 29 aa, Mycobacterium tuberculosis
VGQIIPWNFPILMAAWKLAPALAAGNTAV

SEQ ID NO: 1532662 - protein, 17 aa, Mycobacterium tuberculosis
VHAGVLLRYVPLTAKRV

SEQ ID NO: 1532663 - protein, 27 aa, Mycobacterium tuberculosis
VMTGWQRLHFRFGFPAPLLEPLAVERL

SEQ ID NO: 1532664 - protein, 21 aa, Mycobacterium tuberculosis
VNGALVHPLMIALISYAVGGP

SEQ ID NO: 1532665 - protein, 25 aa, Mycobacterium tuberculosis
VRAVPLVGGLWFRFLHSVKAGIKDS

SEQ ID NO: 1532666 - protein, 17 aa, Mycobacterium tuberculosis
VTGNYRAWRHFIAMRAS

SEQ ID NO: 1532667 - protein, 25 aa, Mycobacterium tuberculosis
WCISRQLWWGHRIPIWYGPDGEQVC

SEQ ID NO: 1532668 - protein, 17 aa, Mycobacterium tuberculosis
WFLPLAVPLGLGPKNSE

SEQ ID NO: 1532669 - protein, 18 aa, Mycobacterium tuberculosis
WLTQWSRPGLIPVALVVV

SEQ ID NO: 1532670 - protein, 18 aa, Mycobacterium tuberculosis
WPLGWGFDHFWGFPSGAA

SEQ ID NO: 1532671 - protein, 18 aa, Mycobacterium tuberculosis
WPVIDVKLPALAPMVAAF

SEQ ID NO: 1532672 - protein, 25 aa, Mycobacterium tuberculosis
YAMTGWRLGWLLVPTVLRRAVDCLT

SEQ ID NO: 1532673 - protein, 24 aa, Mycobacterium tuberculosis
YGGTYNLFHYSLAKLGIEVSFVDD

SEQ ID NO: 1532674 - protein, 21 aa, Mycobacterium tuberculosis
YGRLRHGQILFTFLHLAASRA

SEQ ID NO: 1532675 - protein, 18 aa, Mycobacterium tuberculosis
YKPVSGERPLWDFPDGTL

SEQ ID NO: 1532676 - protein, 19 aa, Mycobacterium tuberculosis
YPVLVRPSYVLGGRGMEIV

SEQ ID NO: 1532677 - protein, 23 aa, Mycobacterium tuberculosis
YSNGILWRGDYQGLIGYSYALTI

SEQ ID NO: 1532678 - protein, 17 aa, Mycobacterium tuberculosis
AANPPMIRYPIPPMIHG

SEQ ID NO: 1532679 - protein, 20 aa, Mycobacterium tuberculosis
AGAPVLFAAGLFLGADRAAG

SEQ ID NO: 1532680 - protein, 23 aa, Mycobacterium tuberculosis
ALDRALIDLATYFRDALLVAAHA

SEQ ID NO: 1532681 - protein, 21 aa, Mycobacterium tuberculosis
ALFVFRPLLNLALRRFLRNLR

SEQ ID NO: 1532682 - protein, 21 aa, Mycobacterium tuberculosis
ALRDRLIVELLYATGIRVSEL

SEQ ID NO: 1532683 - protein, 18 aa, Mycobacterium tuberculosis
ALTALWRSYGVTPDAVIG

SEQ ID NO: 1532684 - protein, 21 aa, Mycobacterium tuberculosis
APGRWTLIRWGPAGSLVLRIT

SEQ ID NO: 1532685 - protein, 24 aa, Mycobacterium tuberculosis
APVRYRFHFPRQQRGRFLCIADFI

SEQ ID NO: 1532686 - protein, 18 aa, Mycobacterium tuberculosis
ARPQLKKFYGERLERLYT

SEQ ID NO: 1532687 - protein, 28 aa, Mycobacterium tuberculosis
ATPGWLEWFINWYLPISQLFYNTVGLPY

SEQ ID NO: 1532688 - protein, 18 aa, Mycobacterium tuberculosis
AVGQLPLDFGASGLSAMS

SEQ ID NO: 1532689 - protein, 18 aa, Mycobacterium tuberculosis
CAELLYRAGLPRALYAIV

SEQ ID NO: 1532690 - protein, 24 aa, Mycobacterium tuberculosis
CGKYLVVMLELWLPLVAAAGDLDK

SEQ ID NO: 1532691 - protein, 20 aa, Mycobacterium tuberculosis
DDVFRAWWDLAGNRAGPPSM

SEQ ID NO: 1532692 - protein, 21 aa, Mycobacterium tuberculosis
DGVGHPFWFSRTVFGELARLH

SEQ ID NO: 1532693 - protein, 17 aa, Mycobacterium tuberculosis
DMLLLIVAALEQSVLVS

SEQ ID NO: 1532694 - protein, 22 aa, Mycobacterium tuberculosis
DPHRYTFQYALDLQLQSLVRVI

SEQ ID NO: 1532695 - protein, 26 aa, Mycobacterium tuberculosis
DPRNPSPVYLFAYDPMAFGGKGRAAI

SEQ ID NO: 1532696 - protein, 20 aa, Mycobacterium tuberculosis
DVFIGYLRRKLEAGGGPRLL

SEQ ID NO: 1532697 - protein, 20 aa, Mycobacterium tuberculosis
EALLALYRWRGPLINAGVGG

SEQ ID NO: 1532698 - protein, 31 aa, Mycobacterium tuberculosis; identical to SEQ ID NO: 227388

SEQ ID NO: 1532699 - protein, 19 aa, Mycobacterium tuberculosis
EATRPLVICDLGMPRDVDP

SEQ ID NO: 1532700 - protein, 23 aa, Mycobacterium tuberculosis
EEWLYQSWAAAYLPLLQVLAALA

SEQ ID NO: 1532701 - protein, 25 aa, Mycobacterium tuberculosis
EIMGFYGLSYWYPFQVTALGLGPIW

SEQ ID NO: 1532702 - protein, 20 aa, Mycobacterium tuberculosis
EINSALMFAGAGPGPMLAAA

SEQ ID NO: 1532703 - protein, 27 aa, Mycobacterium tuberculosis
EPWVRDYLLLRGLLGTSILWFEQDRDC

SEQ ID NO: 1532704 - protein, 19 aa, Mycobacterium tuberculosis
EQNAWWWDVLKFGRSSAYA

SEQ ID NO: 1532705 - protein, 24 aa, Mycobacterium tuberculosis
ERDIRFVRLWFTDVLGFLKSVAIA

SEQ ID NO: 1532706 - protein, 20 aa, Mycobacterium tuberculosis
ERPLWAWLVLEPGDISVCLH

SEQ ID NO: 1532707 - protein, 21 aa, Mycobacterium tuberculosis
EVRYFIDRLAGWYVITSSDRM

SEQ ID NO: 1532708 - protein, 18 aa, Mycobacterium tuberculosis
EYQPLWEPKIPLGRLGRP

SEQ ID NO: 1532709 - protein, 17 aa, Mycobacterium tuberculosis
FKIPRYLWIVDEFPMTV

SEQ ID NO: 1532710 - protein, 25 aa, Mycobacterium tuberculosis
FLAGPGLVYLLWPVALGYLRVVTHP

SEQ ID NO: 1532711 - protein, 17 aa, Mycobacterium tuberculosis
FVDGLIGATLGFGGEES

SEQ ID NO: 1532712 - protein, 25 aa, Mycobacterium tuberculosis
FVPAFSGLFAPYWRSDARGAIVGLS

SEQ ID NO: 1532713 - protein, 26 aa, Mycobacterium tuberculosis
GGPGSWLLAVPPYHIAGLAVLVRSVI

SEQ ID NO: 1532714 - protein, 21 aa, Mycobacterium tuberculosis
GLNQLVFLGLRPPPPQRYPLS

SEQ ID NO: 1532715 - protein, 23 aa, Mycobacterium tuberculosis
GYCGYLLYNLTTSGFRPATFAAI

SEQ ID NO: 1532716 - protein, 19 aa, Mycobacterium tuberculosis
HFIARLVLVLLDETFLPGG

SEQ ID NO: 1532717 - protein, 17 aa, Mycobacterium tuberculosis
IDAVKFTPALTGPHARL

SEQ ID NO: 1532718 - protein, 20 aa, Mycobacterium tuberculosis
IEPSPYLPTSRRFVNPLYLR

SEQ ID NO: 1532719 - protein, 18 aa, Mycobacterium tuberculosis
IFVYQLYLWDMRFRARHG

SEQ ID NO: 1532720 - protein, 17 aa, Mycobacterium tuberculosis
IGWPVIDVKLPALAPMV

SEQ ID NO: 1532721 - protein, 22 aa, Mycobacterium tuberculosis
KASVMTHHRWLRALAVFGGMGL

SEQ ID NO: 1532722 - protein, 19 aa, Mycobacterium tuberculosis
KLEQWTLLARARALDSMSY

SEQ ID NO: 1532723 - protein, 17 aa, Mycobacterium tuberculosis
KLFNAVGVVFKGTGFYR

SEQ ID NO: 1532724 - protein, 18 aa, Mycobacterium tuberculosis
KLFYQPLLESIGPTGLEI

SEQ ID NO: 1532725 - protein, 19 aa, Mycobacterium tuberculosis
KLRIVKYLAYGWSSLRSRP

SEQ ID NO: 1532726 - protein, 22 aa, Mycobacterium tuberculosis
KNPVLQLFIDILMRLTKRYVQK

SEQ ID NO: 1532727 - protein, 17 aa, Mycobacterium tuberculosis
LAALYRPMLLRTTNRHH

SEQ ID NO: 1532728 - protein, 18 aa, Mycobacterium tuberculosis
LAVELSSFQLHWAPSLRP

SEQ ID NO: 1532729 - protein, 18 aa, Mycobacterium tuberculosis
LDGWPVNFALLGKGNTVN

SEQ ID NO: 1532730 - protein, 17 aa, Mycobacterium tuberculosis
LDMKRYHLLLAGASWMA

SEQ ID NO: 1532731 - protein, 20 aa, Mycobacterium tuberculosis
LGIDCIWLPPFYDSPLRDGG

SEQ ID NO: 1532732 - protein, 28 aa, Mycobacterium tuberculosis
LGLTSPMSLLRFIKFILTEIFPGGRLPR

SEQ ID NO: 1532733 - protein, 24 aa, Mycobacterium tuberculosis
LGQPLDWFCLFSSGAALLGSPGQG

SEQ ID NO: 1532734 - protein, 17 aa, Mycobacterium tuberculosis
LGVPTFRMLRALRGFDP

SEQ ID NO: 1532735 - protein, 18 aa, Mycobacterium tuberculosis
LIAHTLWIAHCWFMEAWD

SEQ ID NO: 1532736 - protein, 24 aa, Mycobacterium tuberculosis
LLARLFGLPYFPITPLFPLAGPVG

SEQ ID NO: 1532737 - protein, 20 aa, Mycobacterium tuberculosis
LLKGLTAHYLLKSVYPVKRG

SEQ ID NO: 1532738 - protein, 17 aa, Mycobacterium tuberculosis
LLRNLEFLPNSPTLMNS

SEQ ID NO: 1532739 - protein, 19 aa, Mycobacterium tuberculosis
LLTLLLFDIGSFAGLAALL

SEQ ID NO: 1532740 - protein, 17 aa, Mycobacterium tuberculosis
LMSPMAFLQRPARWMQL

SEQ ID NO: 1532741 - protein, 24 aa, Mycobacterium tuberculosis
LMVGLFIPLFVGCPVILTSPEAFI

SEQ ID NO: 1532742 - protein, 21 aa, Mycobacterium tuberculosis
LPDLELIFAPAPFYDEALVPP

SEQ ID NO: 1532743 - protein, 17 aa, Mycobacterium tuberculosis
LPETRRYLGWRLSLLDL

SEQ ID NO: 1532744 - protein, 17 aa, Mycobacterium tuberculosis
LPLLIKVVKHPSAWRGW

SEQ ID NO: 1532745 - protein, 19 aa, Mycobacterium tuberculosis
LRDMLPDWPALAHGPLTLK

SEQ ID NO: 1532746 - protein, 20 aa, Mycobacterium tuberculosis
LRRRHLVPQPPYGHGAAAAA

SEQ ID NO: 1532747 - protein, 18 aa, Mycobacterium tuberculosis
LTREVLGAGIPLFGICFG

SEQ ID NO: 1532748 - protein, 21 aa, Mycobacterium tuberculosis
LVPQHLMRRLFFTAATVDAAT

SEQ ID NO: 1532749 - protein, 18 aa, Mycobacterium tuberculosis
LWIAHCWFMEAWDSTPRI

SEQ ID NO: 1532750 - protein, 27 aa, Mycobacterium tuberculosis
MGGPPIVFQLLWYPSTLWDQSLPSLAE

SEQ ID NO: 1532751 - protein, 18 aa, Mycobacterium tuberculosis
MMINLFWLGLKGAPVDRL

SEQ ID NO: 1532752 - protein, 21 aa, Mycobacterium tuberculosis
MSHLLLDLDLLGPLRARLADG

SEQ ID NO: 1532753 - protein, 17 aa, Mycobacterium tuberculosis
MWALSIPVPFTKPVGAG

SEQ ID NO: 1532754 - protein, 23 aa, Mycobacterium tuberculosis
NCEIVPWCRFARKNYFYPDMPKN

SEQ ID NO: 1532755 - protein, 30 aa, Mycobacterium tuberculosis; identical to SEQ ID NO: 227834

SEQ ID NO: 1532756 - protein, 21 aa, Mycobacterium tuberculosis
PDEFGLSRYLAAGLAALQTVD

SEQ ID NO: 1532757 - protein, 20 aa, Mycobacterium tuberculosis
PEINSLRMYLGAGSAPMLQA

SEQ ID NO: 1532758 - protein, 20 aa, Mycobacterium tuberculosis
PGIPVLAWALPQPIADRLNA

SEQ ID NO: 1532759 - protein, 23 aa, Mycobacterium tuberculosis
PKETWLRLLLIRAGFPRPQTQIA

SEQ ID NO: 1532760 - protein, 17 aa, Mycobacterium tuberculosis
PLLAYLRKMVFWSMVTP

SEQ ID NO: 1532761 - protein, 23 aa, Mycobacterium tuberculosis
PLPRWQIALYWRTDGRPLWTNDA

SEQ ID NO: 1532762 - protein, 23 aa, Mycobacterium tuberculosis
PLVLKPWTMPEPLLPIAIAAHAK

SEQ ID NO: 1532763 - protein, 24 aa, Mycobacterium tuberculosis
PTEFTLLRYFVINAGTVLSKPKIL

SEQ ID NO: 1532764 - protein, 20 aa, Mycobacterium tuberculosis
PTSVPAFRPGAQFKAVVSGA

SEQ ID NO: 1532765 - protein, 18 aa, Mycobacterium tuberculosis
PVLLAWVTPIVTALADVV

SEQ ID NO: 1532766 - protein, 27 aa, Mycobacterium tuberculosis
PWPPRVATLPHWPLIYAGALEGLDHLE

SEQ ID NO: 1532767 - protein, 19 aa, Mycobacterium tuberculosis
QILNMTLSQRWGRLFVAVC

SEQ ID NO: 1532768 - protein, 22 aa, Mycobacterium tuberculosis
QQGKFLCLLAGAIQARRVLEIG

SEQ ID NO: 1532769 - protein, 19 aa, Mycobacterium tuberculosis
QRIVLTRNPRWWGARPRLD

SEQ ID NO: 1532770 - protein, 21 aa, Mycobacterium tuberculosis
QRYMGWFDGNPGWLWPHPPEA

SEQ ID NO: 1532771 - protein, 23 aa, Mycobacterium tuberculosis
QTAAVLFGVWWIGAQAILDDSPA

SEQ ID NO: 1532772 - protein, 27 aa, Mycobacterium tuberculosis
REHGVLKRILLIYREGIRRLQADDQSP

SEQ ID NO: 1532773 - protein, 18 aa, Mycobacterium tuberculosis
RFAAPYLRDSLLAAGALC

SEQ ID NO: 1532774 - protein, 17 aa, Mycobacterium tuberculosis
RGLLVLLDALRSTICGQ

SEQ ID NO: 1532775 - protein, 18 aa, Mycobacterium tuberculosis
RIGRLYLIGIPGEPTIVA

SEQ ID NO: 1532776 - protein, 22 aa, Mycobacterium tuberculosis
RIPLPVDWRWPWGEALAVLENT

SEQ ID NO: 1532777 - protein, 18 aa, Mycobacterium tuberculosis
RPLPLYCASLRTAEPRLL

SEQ ID NO: 1532778 - protein, 18 aa, Mycobacterium tuberculosis
RRELLAQMPPFLTGGSMI

SEQ ID NO: 1532779 - protein, 26 aa, Mycobacterium tuberculosis
RSLQRWRPFGLPPHRWRLAPWYWRGL

SEQ ID NO: 1532780 - protein, 26 aa, Mycobacterium tuberculosis
RSRTHHYPFRLLPPRTMRALLARICE

SEQ ID NO: 1532781 - protein, 17 aa, Mycobacterium tuberculosis
RWRLAPWYWRGLQVTLE

SEQ ID NO: 1532782 - protein, 26 aa, Mycobacterium tuberculosis
SEQLAHQIHWLLLRFGVGSTVRDYDP

SEQ ID NO: 1532783 - protein, 22 aa, Mycobacterium tuberculosis
SLPDGALMRRAAFGLATEIGRE

SEQ ID NO: 1532784 - protein, 18 aa, Mycobacterium tuberculosis
SQHPDFLRLFYLLSMERS

SEQ ID NO: 1532785 - protein, 25 aa, Mycobacterium tuberculosis
SRFGENFFYILYFQEPGIADAELNG

SEQ ID NO: 1532786 - protein, 18 aa, Mycobacterium tuberculosis
SRVPALPRLGPTDALPRC

SEQ ID NO: 1532787 - protein, 24 aa, Mycobacterium tuberculosis
TDEAPLLATYAFLPIVRAFAEPAG

SEQ ID NO: 1532788 - protein, 21 aa, Mycobacterium tuberculosis
TFEYQALLFIPSHAPFDLFDR

SEQ ID NO: 1532789 - protein, 25 aa, Mycobacterium tuberculosis
THNEPMIPIYIFYSMFGFQRTGDSF

SEQ ID NO: 1532790 - protein, 17 aa, Mycobacterium tuberculosis
TLLFPFAAPRVVGDLSE

SEQ ID NO: 1532791 - protein, 21 aa, Mycobacterium tuberculosis
TMPRRAPALTAPLLVLHGTDD

SEQ ID NO: 1532792 - protein, 25 aa, Mycobacterium tuberculosis
TPPPPPPLPPVPFPKECPAPGVMQG

SEQ ID NO: 1532793 - protein, 17 aa, Mycobacterium tuberculosis
TRNRALGLLYRWVEHAF

SEQ ID NO: 1532794 - protein, 23 aa, Mycobacterium tuberculosis
VAAELVPVLRPRGLFAHDVDLAG

SEQ ID NO: 1532795 - protein, 25 aa, Mycobacterium tuberculosis
VDDPLAMYLFDLCTLPLNLAGHCGM

SEQ ID NO: 1532796 - protein, 18 aa, Mycobacterium tuberculosis
VHTLPMLYALREQTPDTS

SEQ ID NO: 1532797 - protein, 22 aa, Mycobacterium tuberculosis
VLGVHNFYFWPDPRASLCDIAR

SEQ ID NO: 1532798 - protein, 23 aa, Mycobacterium tuberculosis
VNYNTMYFALARRAALRPGDTVL

SEQ ID NO: 1532799 - protein, 21 aa, Mycobacterium tuberculosis
VRWVRYPYLPSHPQYDLAKRQ

SEQ ID NO: 1532800 - protein, 24 aa, Mycobacterium tuberculosis
VSARVYPALVPLSHPLAAVNGAFN

SEQ ID NO: 1532801 - protein, 23 aa, Mycobacterium tuberculosis
VSEDKFFIIGRIKDLLIVYGRNH

SEQ ID NO: 1532802 - protein, 17 aa, Mycobacterium tuberculosis
VYDLFVKTLGVSAGTYA

SEQ ID NO: 1532803 - protein, 19 aa, Mycobacterium tuberculosis
WANILLQRPAPATGALNRF

SEQ ID NO: 1532804 - protein, 19 aa, Mycobacterium tuberculosis
WWWDVLKFGRSSAYAEFFD

SEQ ID NO: 1532805 - protein, 17 aa, Mycobacterium tuberculosis
WYPLTACLPLAPDHTNP

SEQ ID NO: 1532806 - protein, 17 aa, Mycobacterium tuberculosis
YADGVGHPFWFSRTVFG

SEQ ID NO: 1532807 - protein, 19 aa, Mycobacterium tuberculosis
YDILFFWVARMMMFGTFVG

SEQ ID NO: 1532808 - protein, 26 aa, Mycobacterium tuberculosis
YDRSGLWPYLEKLGFYLVGYGCTTCI

SEQ ID NO: 1532809 - protein, 17 aa, Mycobacterium tuberculosis
YPKLLPIARNWWAKLGR

SEQ ID NO: 1532810 - protein, 17 aa, Mycobacterium tuberculosis
YRAGLPRALYAIVPGPG

SEQ ID NO: 1532811 - protein, 28 aa, Mycobacterium tuberculosis
YYIAMLAELSRLRPLPFRLVLDGTEEIV

SEQ ID NO: 1532812 - protein, 23 aa, Mycobacterium tuberculosis
AEIYVPFSWFEPMWLENLGFARE

SEQ ID NO: 1532813 - protein, 27 aa, Mycobacterium tuberculosis
AESPRETWLRLLLIRAGFPRPQTQIPV

SEQ ID NO: 1532814 - protein, 17 aa, Mycobacterium tuberculosis
AFLQKRPPRWVQPATMR

SEQ ID NO: 1532815 - protein, 29 aa, Mycobacterium tuberculosis
AHYAITVPQIPLLNFSLNIPVNIPIHLDF

SEQ ID NO: 1532816 - protein, 18 aa, Mycobacterium tuberculosis
AMRPLRHTLSQLRLHELL

SEQ ID NO: 1532817 - protein, 22 aa, Mycobacterium tuberculosis
ARQRLMCRLPKRPDPHAWLGDA

SEQ ID NO: 1532818 - protein, 17 aa, Mycobacterium tuberculosis
ASHANHYLALFDGAKPL

SEQ ID NO: 1532819 - protein, 17 aa, Mycobacterium tuberculosis
ATNYDVMFVPQGIGADL

SEQ ID NO: 1532820 - protein, 17 aa, Mycobacterium tuberculosis
DGYRWLRLLGYEPEQIV

SEQ ID NO: 1532821 - protein, 22 aa, Mycobacterium tuberculosis
DQLRFTAPPRLDLSLLASALPE

SEQ ID NO: 1532822 - protein, 17 aa, Mycobacterium tuberculosis
DRFGTELPPLEGIYLAA

SEQ ID NO: 1532823 - protein, 21 aa, Mycobacterium tuberculosis
DSRLPYLIRLPVGAGLVFATS

SEQ ID NO: 1532824 - protein, 21 aa, Mycobacterium tuberculosis
DTFASYIAALLWFGEFSGCGI

SEQ ID NO: 1532825 - protein, 24 aa, Mycobacterium tuberculosis
DTKLGLFPFRRNLSFYAVDLGLLS

SEQ ID NO: 1532826 - protein, 19 aa, Mycobacterium tuberculosis
DVLLPFLVTRQLICGAGKV

SEQ ID NO: 1532827 - protein, 23 aa, Mycobacterium tuberculosis
EGHEVLIFRLFHAPPPSVCSRRR

SEQ ID NO: 1532828 - protein, 22 aa, Mycobacterium tuberculosis
ERLGLWGLMPRTVYDTLIWCIY

SEQ ID NO: 1532829 - protein, 21 aa, Mycobacterium tuberculosis
ESRARLFPRGLAAFIELRDQR

SEQ ID NO: 1532830 - protein, 21 aa, Mycobacterium tuberculosis
ETELMAWAIPRAANRFWMLNE

SEQ ID NO: 1532831 - protein, 20 aa, Mycobacterium tuberculosis
EVYRLRQPVLLIWGREDRVN

SEQ ID NO: 1532832 - protein, 17 aa, Mycobacterium tuberculosis
FAPFLWQEIEEGILPAL

SEQ ID NO: 1532833 - protein, 19 aa, Mycobacterium tuberculosis
FPSYFLIVADLISYARSAG

SEQ ID NO: 1532834 - protein, 19 aa, Mycobacterium tuberculosis
FVDDFVLYWGFLALAQVRS

SEQ ID NO: 1532835 - protein, 23 aa, Mycobacterium tuberculosis
FVRRQRAWLRTRASRQPRETPAT

SEQ ID NO: 1532836 - protein, 17 aa, Mycobacterium tuberculosis
FWFADAPDRVPGLSSPV

SEQ ID NO: 1532837 - protein, 19 aa, Mycobacterium tuberculosis
FYSGFYLPMYWSSRAKLTN

SEQ ID NO: 1532838 - protein, 24 aa, Mycobacterium tuberculosis
GAGPVVIPLLDIPPAPGFGNSTTG

SEQ ID NO: 1532839 - protein, 26 aa, Mycobacterium tuberculosis
GGRDEQLLLLPLTSLRGLRHTLKKLS

SEQ ID NO: 1532840 - protein, 17 aa, Mycobacterium tuberculosis
GLDSRAWRLPWPDGTVV

SEQ ID NO: 1532841 - protein, 19 aa, Mycobacterium tuberculosis
GNSLFITVNCWGRLVTGVG

SEQ ID NO: 1532842 - protein, 17 aa, Mycobacterium tuberculosis
GPWRLDPLPLVISAADW

SEQ ID NO: 1532843 - protein, 26 aa, Mycobacterium tuberculosis
GTGGLLPIKIPLIDIPAAPGFGNSTT

SEQ ID NO: 1532844 - protein, 19 aa, Mycobacterium tuberculosis
GVTAYDYMLTLAGRLRPVD

SEQ ID NO: 1532845 - protein, 22 aa, Mycobacterium tuberculosis
IATPGSWRREPLSGIPAATNTV

SEQ ID NO: 1532846 - protein, 17 aa, Mycobacterium tuberculosis
IPIVYAVSRIVEVPYAE

SEQ ID NO: 1532847 - protein, 23 aa, Mycobacterium tuberculosis
KKRPFYFGVLTWYMDRVLELVHD

SEQ ID NO: 1532848 - protein, 25 aa, Mycobacterium tuberculosis
KTHLPPGAWPPTSWYADWIRGLDVF

SEQ ID NO: 1532849 - protein, 24 aa, Mycobacterium tuberculosis
LAPDRPFFVYFAPGATHAPHHVPR

SEQ ID NO: 1532850 - protein, 18 aa, Mycobacterium tuberculosis
LEWLDRMDLVNGKLICLV

SEQ ID NO: 1532851 - protein, 24 aa, Mycobacterium tuberculosis
LGLAQMIELWPLRPDVRTLLCSSV

SEQ ID NO: 1532852 - protein, 20 aa, Mycobacterium tuberculosis
LGLHFFNPVPVLPLVELVRT

SEQ ID NO: 1532853 - protein, 19 aa, Mycobacterium tuberculosis
LGPRRTLTGQPLPPLLTAT

SEQ ID NO: 1532854 - protein, 25 aa, Mycobacterium tuberculosis
LHSCSPDLPWDLLQRSRISAVSVDA

SEQ ID NO: 1532855 - protein, 18 aa, Mycobacterium tuberculosis
LLGQIPLDPALVAAGDSG

SEQ ID NO: 1532856 - protein, 21 aa, Mycobacterium tuberculosis
LLIRAGYIRPVAPGLYSWLPL

SEQ ID NO: 1532857 - protein, 18 aa, Mycobacterium tuberculosis
LLKLPIPVQRRVAAGVLS

SEQ ID NO: 1532858 - protein, 20 aa, Mycobacterium tuberculosis
LPTPAVAYLTGAYDADFGVM

SEQ ID NO: 1532859 - protein, 19 aa, Mycobacterium tuberculosis
LRHEKLLFKKGIHLLDCGT

SEQ ID NO: 1532860 - protein, 20 aa, Mycobacterium tuberculosis
LRRTGLLDKLLLLAGQPEES

SEQ ID NO: 1532861 - protein, 22 aa, Mycobacterium tuberculosis
LSAVVMAPMYLGLRVWSRATIG

SEQ ID NO: 1532862 - protein, 27 aa, Mycobacterium tuberculosis
NAFAQLVMSNWFGLNAPLIAAVEGAYE

SEQ ID NO: 1532863 - protein, 18 aa, Mycobacterium tuberculosis
PDFATGLMPLRWGTGFML

SEQ ID NO: 1532864 - protein, 17 aa, Mycobacterium tuberculosis
PGIALPEGVRLLAPARR

SEQ ID NO: 1532865 - protein, 29 aa, Mycobacterium tuberculosis
PHILTLSPPILLEKKWLRPTAYMMAKYGM

SEQ ID NO: 1532866 - protein, 17 aa, Mycobacterium tuberculosis
PNLDFPTGPAYYLMGFD

SEQ ID NO: 1532867 - protein, 17 aa, Mycobacterium tuberculosis
PVNNVEFFFLRPKDIAI

SEQ ID NO: 1532868 - protein, 17 aa, Mycobacterium tuberculosis
QEQGLIPGFLMPPSDGS

SEQ ID NO: 1532869 - protein, 24 aa, Mycobacterium tuberculosis
QFNALFLDPYLWKLQVGGKRLVQK

SEQ ID NO: 1532870 - protein, 23 aa, Mycobacterium tuberculosis
QIHDWILLTPWGLLSWPQINQQL

SEQ ID NO: 1532871 - protein, 17 aa, Mycobacterium tuberculosis
QPRLRPPFPAVAGLYGC

SEQ ID NO: 1532872 - protein, 17 aa, Mycobacterium tuberculosis
RAWRLPWPDGTVVYELD

SEQ ID NO: 1532873 - protein, 19 aa, Mycobacterium tuberculosis
RERLGFGELRWALSGAAPI

SEQ ID NO: 1532874 - protein, 18 aa, Mycobacterium tuberculosis
RLVAMLARRGYGQTLACE

SEQ ID NO: 1532875 - protein, 19 aa, Mycobacterium tuberculosis
RPAQYLPWHPGRCAQVFVG

SEQ ID NO: 1532876 - protein, 19 aa, Mycobacterium tuberculosis
RRCRLVTARLWPTLIEPLR

SEQ ID NO: 1532877 - protein, 23 aa, Mycobacterium tuberculosis
SAVTVFIPAFLRYDLRPVTGEWQ

SEQ ID NO: 1532878 - protein, 22 aa, Mycobacterium tuberculosis
SDRLLNLLIYIKGYLDGTLTFR

SEQ ID NO: 1532879 - protein, 17 aa, Mycobacterium tuberculosis
SELFRRYWPADLHMIGK

SEQ ID NO: 1532880 - protein, 24 aa, Mycobacterium tuberculosis
SGQPLDWFCLFSSAAALTGSPGQS

SEQ ID NO: 1532881 - protein, 24 aa, Mycobacterium tuberculosis
SLADPLAFLLRKEGFEATVVTDGP

SEQ ID NO: 1532882 - protein, 21 aa, Mycobacterium tuberculosis
SMNNGLLWRADRQGLLAANYT

SEQ ID NO: 1532883 - protein, 24 aa, Mycobacterium tuberculosis
TGNTQYYMFLTQDLPLLQPIRDIP

SEQ ID NO: 1532884 - protein, 18 aa, Mycobacterium tuberculosis
TLTELWRSYGVQPDLVIG

SEQ ID NO: 1532885 - protein, 22 aa, Mycobacterium tuberculosis
TNPGTLMWWIARSLELLQDFQE

SEQ ID NO: 1532886 - protein, 22 aa, Mycobacterium tuberculosis
TPAQVLLRWNLQLGNAVVVRSA

SEQ ID NO: 1532887 - protein, 22 aa, Mycobacterium tuberculosis
TTSRLWAFQLQSILARLGHYAT

SEQ ID NO: 1532888 - protein, 29 aa, Mycobacterium tuberculosis
VADFWFDPLCPWCWITSRWILEVAKVRDI

SEQ ID NO: 1532889 - protein, 17 aa, Mycobacterium tuberculosis
VAILLPAHWQTAAVLFG

SEQ ID NO: 1532890 - protein, 19 aa, Mycobacterium tuberculosis
VALALLKRGLPGDTALVTG

SEQ ID NO: 1532891 - protein, 21 aa, Mycobacterium tuberculosis
VALPGMLHLAILRSPYAHARI

SEQ ID NO: 1532892 - protein, 19 aa, Mycobacterium tuberculosis
VAWTFAWLHPDRCAGVVGI

SEQ ID NO: 1532893 - protein, 24 aa, Mycobacterium tuberculosis
VFSEEFLLQRPLLTAIRRTEPTVL

SEQ ID NO: 1532894 - protein, 24 aa, Mycobacterium tuberculosis
VNVDGFWMLQALLDIRHVAPELRC

SEQ ID NO: 1532895 - protein, 18 aa, Mycobacterium tuberculosis
VQRTWPELIPLLQSGRLD

SEQ ID NO: 1532896 - protein, 21 aa, Mycobacterium tuberculosis
VVAPDAFFQFPTSKYGLALDN

SEQ ID NO: 1532897 - protein, 21 aa, Mycobacterium tuberculosis
WLRPFRNLVYAMPPYICTPAE

SEQ ID NO: 1532898 - protein, 24 aa, Mycobacterium tuberculosis
WSNPNDWWLVRLLGSITPTERTTI

SEQ ID NO: 1532899 - protein, 21 aa, Mycobacterium tuberculosis
YPPILRLAYRLLSPMLRVLPF

SEQ ID NO: 1532900 - protein, 19 aa, Mycobacterium tuberculosis
AAAAPYAGWLSAAAARAAG

SEQ ID NO: 1532901 - protein, 22 aa, Mycobacterium tuberculosis
AAALAPWQQAVPGLSGLLGGAA

SEQ ID NO: 1532902 - protein, 25 aa, Mycobacterium tuberculosis
AAAVPVVFLTAWYGLADLAEIKAGE

SEQ ID NO: 1532903 - protein, 23 aa, Mycobacterium tuberculosis
AASAFAMWFPIEGGSKYGGYGRA

SEQ ID NO: 1532904 - protein, 21 aa, Mycobacterium tuberculosis
AATVHPLLVAANRNAFAQLVM

SEQ ID NO: 1532905 - protein, 19 aa, Mycobacterium tuberculosis
AAWPATLDRVLAIGGPDAS

SEQ ID NO: 1532906 - protein, 24 aa, Mycobacterium tuberculosis
AKAAPLWRVLVALSIRHVGPTAAR

SEQ ID NO: 1532907 - protein, 18 aa, Mycobacterium tuberculosis
ARLWALVRRQSLSRFERL

SEQ ID NO: 1532908 - protein, 22 aa, Mycobacterium tuberculosis
AVAMLVAIFRARPSPFYIMDEV

SEQ ID NO: 1532909 - protein, 21 aa, Mycobacterium tuberculosis
DHFEFFVFPYADKALTRTMHR

SEQ ID NO: 1532910 - protein, 18 aa, Mycobacterium tuberculosis
DIDLYLRIAPELFLKRCI

SEQ ID NO: 1532911 - protein, 17 aa, Mycobacterium tuberculosis
DIQLAQLGKRLAQRRLQ

SEQ ID NO: 1532912 - protein, 17 aa, Mycobacterium tuberculosis
DKRSLVFPVKRLADLGF

SEQ ID NO: 1532913 - protein, 17 aa, Mycobacterium tuberculosis
DRRKAFLEDLAVVTGGQ

SEQ ID NO: 1532914 - protein, 20 aa, Mycobacterium tuberculosis
DTRAYFRGECLRRFGADIAA

SEQ ID NO: 1532915 - protein, 18 aa, Mycobacterium tuberculosis
DVLLFIDNIFRFTQAGSE

SEQ ID NO: 1532916 - protein, 18 aa, Mycobacterium tuberculosis
ELNSLRMFTGAGSAPMLA

SEQ ID NO: 1532917 - protein, 19 aa, Mycobacterium tuberculosis
EVALFRLLGSWGVRPDFVM

SEQ ID NO: 1532918 - protein, 20 aa, Mycobacterium tuberculosis
FAAFYRRCRLVTARLWPTLI

SEQ ID NO: 1532919 - protein, 17 aa, Mycobacterium tuberculosis
FPNFFMMLGPHSPVGNF

SEQ ID NO: 1532920 - protein, 18 aa, Mycobacterium tuberculosis
FWCQLFSEPGAGSDLASL

SEQ ID NO: 1532921 - protein, 17 aa, Mycobacterium tuberculosis
FYLKLYPRPATCGTSVY

SEQ ID NO: 1532922 - protein, 22 aa, Mycobacterium tuberculosis
GRCRVPLILRLDPKIGLPDIRA

SEQ ID NO: 1532923 - protein, 22 aa, Mycobacterium tuberculosis
GSDAMRWFLMASPILRGGNLIV

SEQ ID NO: 1532924 - protein, 22 aa, Mycobacterium tuberculosis
GSLEIFLTPQLPAPLIQIYGET

SEQ ID NO: 1532925 - protein, 18 aa, Mycobacterium tuberculosis
GVDTFFVATAPRYSFVSS

SEQ ID NO: 1532926 - protein, 19 aa, Mycobacterium tuberculosis
GVMWACVFMRTGARRVHFG

SEQ ID NO: 1532927 - protein, 17 aa, Mycobacterium tuberculosis
HTKLFYQPLLESIGPTG

SEQ ID NO: 1532928 - protein, 19 aa, Mycobacterium tuberculosis
IDGPYYLFGVLAKLAVLPS

SEQ ID NO: 1532929 - protein, 22 aa, Mycobacterium tuberculosis
IDLRKTYLFAFLDDHSRLVPGY

SEQ ID NO: 1532930 - protein, 20 aa, Mycobacterium tuberculosis
IDSPELLWKALLRGDDLITE

SEQ ID NO: 1532931 - protein, 17 aa, Mycobacterium tuberculosis
IPDVNALPPIKHTFAKP

SEQ ID NO: 1532932 - protein, 24 aa, Mycobacterium tuberculosis
IRPVAPGLYSWLPLGLRVLRNIER

SEQ ID NO: 1532933 - protein, 19 aa, Mycobacterium tuberculosis
IYDKWLTLGPLIDQFGMTT

SEQ ID NO: 1532934 - protein, 24 aa, Mycobacterium tuberculosis
KQLFGYLVWRDTKAAILLFIRNKD

SEQ ID NO: 1532935 - protein, 21 aa, Mycobacterium tuberculosis
KVVRFILGLVQRYGPGLFGAN

SEQ ID NO: 1532936 - protein, 23 aa, Mycobacterium tuberculosis
LATRRKIFIPILRVAAIEPHAVT

SEQ ID NO: 1532937 - protein, 18 aa, Mycobacterium tuberculosis
LDPHWLLDTLGLTEAART

SEQ ID NO: 1532938 - protein, 23 aa, Mycobacterium tuberculosis
LESRTITFLKIDPAPGIGNSTTN

SEQ ID NO: 1532939 - protein, 28 aa, Mycobacterium tuberculosis
LFAVEVALYRLLMSWGVRPGLVLGHSVG

SEQ ID NO: 1532940 - protein, 19 aa, Mycobacterium tuberculosis
LFDIDGVLVLSWRAIPGAA

SEQ ID NO: 1532941 - protein, 18 aa, Mycobacterium tuberculosis
LHFLGATLWRSGIQRVLR

SEQ ID NO: 1532942 - protein, 25 aa, Mycobacterium tuberculosis
LHGRSRLWLFRYQGTPIAFFLNVWG

SEQ ID NO: 1532943 - protein, 24 aa, Mycobacterium tuberculosis
LIVVRPIGFEPLQWVRALAAEDPV

SEQ ID NO: 1532944 - protein, 19 aa, Mycobacterium tuberculosis
LLRDYGLLLPLEPDTRLLS

SEQ ID NO: 1532945 - protein, 19 aa, Mycobacterium tuberculosis
LPGYWQCTIPLGPDPDDEG

SEQ ID NO: 1532946 - protein, 19 aa, Mycobacterium tuberculosis
LRRPLFPPLPGTLPEPEIW

SEQ ID NO: 1532947 - protein, 25 aa, Mycobacterium tuberculosis
LRSWYILYFQLPWLPERSASWVVPL

SEQ ID NO: 1532948 - protein, 17 aa, Mycobacterium tuberculosis
LTAFAQHSPFAEKFQSL

SEQ ID NO: 1532949 - protein, 20 aa, Mycobacterium tuberculosis
LYVHSAPWALPALGLENVSH

SEQ ID NO: 1532950 - protein, 20 aa, Mycobacterium tuberculosis
NNVEFFFLRPKDIAIYVGSG

SEQ ID NO: 1532951 - protein, 21 aa, Mycobacterium tuberculosis
PDPLRLIYFADADPVFALCEH

SEQ ID NO: 1532952 - protein, 17 aa, Mycobacterium tuberculosis
PGPLRRLIATLPALEVP

SEQ ID NO: 1532953 - protein, 17 aa, Mycobacterium tuberculosis
PLPGTLPEPEIWARLVR

SEQ ID NO: 1532954 - protein, 18 aa, Mycobacterium tuberculosis
PSGFLRRTPTRRFRDRRD

SEQ ID NO: 1532955 - protein, 22 aa, Mycobacterium tuberculosis
PTIDAVLPMFFEFAGDSVLVAH

SEQ ID NO: 1532956 - protein, 17 aa, Mycobacterium tuberculosis
PTRVWGVPAAGLWAHRL

SEQ ID NO: 1532957 - protein, 17 aa, Mycobacterium tuberculosis
PVARRLFAVRAVVGLSL

SEQ ID NO: 1532958 - protein, 19 aa, Mycobacterium tuberculosis
PVIDQDVRRWWRSDSLWQA

SEQ ID NO: 1532959 - protein, 23 aa, Mycobacterium tuberculosis
PVIGAPWLVAFAERSRFFEVFSS

SEQ ID NO: 1532960 - protein, 18 aa, Mycobacterium tuberculosis
QWVLPWPNPRYSKLARVF

SEQ ID NO: 1532961 - protein, 25 aa, Mycobacterium tuberculosis
RAYSPRFLWMWPNARISVMGGEQAA

SEQ ID NO: 1532962 - protein, 19 aa, Mycobacterium tuberculosis
RDYLTDLFPILELGTSAKM

SEQ ID NO: 1532963 - protein, 17 aa, Mycobacterium tuberculosis
RGRALALLLPALRSLAT

SEQ ID NO: 1532964 - protein, 20 aa, Mycobacterium tuberculosis
RIERGLWLTALLQATLSTVR

SEQ ID NO: 1532965 - protein, 22 aa, Mycobacterium tuberculosis
RVGWRWRLVWYRAVAELLTGDY

SEQ ID NO: 1532966 - protein, 22 aa, Mycobacterium tuberculosis
RVTAYRWFHAGLLPVPARKVGR

SEQ ID NO: 1532967 - protein, 17 aa, Mycobacterium tuberculosis
RVWGVPAAGLWAHRLGD

SEQ ID NO: 1532968 - protein, 20 aa, Mycobacterium tuberculosis
SEGWRRLLYLLSGRLINAGE

SEQ ID NO: 1532969 - protein, 20 aa, Mycobacterium tuberculosis
SFYLRPIVRPVILVAGGTGL

SEQ ID NO: 1532970 - protein, 17 aa, Mycobacterium tuberculosis
SRFLLNLPLFSRQALHP

SEQ ID NO: 1532971 - protein, 21 aa, Mycobacterium tuberculosis
SWINRLYWNLADYAGSPVRII

SEQ ID NO: 1532972 - protein, 19 aa, Mycobacterium tuberculosis
TFFVATAPRYSFVSSSLAK

SEQ ID NO: 1532973 - protein, 20 aa, Mycobacterium tuberculosis
TFPSWPLAHPFRRIAHNGEI

SEQ ID NO: 1532974 - protein, 17 aa, Mycobacterium tuberculosis
TKYFLDPAQIRLLRGLK

SEQ ID NO: 1532975 - protein, 18 aa, Mycobacterium tuberculosis
TPVVAMPLLRRGNKEVHG

SEQ ID NO: 1532976 - protein, 20 aa, Mycobacterium tuberculosis
TPYPPARLEKLWLPGPDRLL

SEQ ID NO: 1532977 - protein, 22 aa, Mycobacterium tuberculosis
TRSGDVWLLNGFKWFASNCAGE

SEQ ID NO: 1532978 - protein, 19 aa, Mycobacterium tuberculosis
TWIQKYIFPGGLLPSTQAI

SEQ ID NO: 1532979 - protein, 17 aa, Mycobacterium tuberculosis
VAVRRISMSFVNVAPQL

SEQ ID NO: 1532980 - protein, 17 aa, Mycobacterium tuberculosis
VPLFLAVNKIAPALLAG

SEQ ID NO: 1532981 - protein, 20 aa, Mycobacterium tuberculosis
VSILYRLYRPLIFALYCLPL

SEQ ID NO: 1532982 - protein, 18 aa, Mycobacterium tuberculosis
VTSIYWYFRKKDDLLNAM

SEQ ID NO: 1532983 - protein, 17 aa, Mycobacterium tuberculosis
YGVPASALLHRAGQRKL

SEQ ID NO: 1532984 - protein, 28 aa, Mycobacterium tuberculosis
YLLAVGDLLIGWRLLVLAGVAHAALADG

SEQ ID NO: 1532985 - protein, 26 aa, Mycobacterium tuberculosis
YNRRSKFPYRWWWVALTDEAFPRLSV

SEQ ID NO: 1532986 - protein, 18 aa, Mycobacterium tuberculosis
YTLGNSLRRTLLSSIPGA

SEQ ID NO: 1532987 - protein, 17 aa, Mycobacterium tuberculosis
AAFLEYLDMFYNLGIAG

SEQ ID NO: 1532988 - protein, 17 aa, Mycobacterium tuberculosis
AAQFIRYEKPRSWLNSG

SEQ ID NO: 1532989 - protein, 23 aa, Mycobacterium tuberculosis
AETWPNPWPMYRALRDHDPVHHV

SEQ ID NO: 1532990 - protein, 20 aa, Mycobacterium tuberculosis
AGGFLIPAALDPAILLSGDG

SEQ ID NO: 1532991 - protein, 23 aa, Mycobacterium tuberculosis
ALAGAMRPPAPPAAPPGAPGMPG

SEQ ID NO: 1532992 - protein, 19 aa, Mycobacterium tuberculosis
ALTAHLLPLLRAAQRARVV

SEQ ID NO: 1532993 - protein, 18 aa, Mycobacterium tuberculosis
APGLWRYWAEHLDPDRAR

SEQ ID NO: 1532994 - protein, 22 aa, Mycobacterium tuberculosis
DIFYYVYGLLHDPAYRTKYAAD

SEQ ID NO: 1532995 - protein, 28 aa, Mycobacterium tuberculosis
DIGPITIQPIPILPTIPLSIHQTVNLGP

SEQ ID NO: 1532996 - protein, 26 aa, Mycobacterium tuberculosis
DWKCWARWRLIRARAPWLTRALVAED

SEQ ID NO: 1532997 - protein, 19 aa, Mycobacterium tuberculosis
DYVYPGHAIWWLARGLEFF

SEQ ID NO: 1532998 - protein, 21 aa, Mycobacterium tuberculosis
EAHIKVIRALFRPPARRGGCV

SEQ ID NO: 1532999 - protein, 17 aa, Mycobacterium tuberculosis
ENLFFKEKRYDLARVGR

SEQ ID NO: 1533000 - protein, 22 aa, Mycobacterium tuberculosis
FAGDLLFIGCTPIVWAGPIANW

SEQ ID NO: 1533001 - protein, 17 aa, Mycobacterium tuberculosis
FLLNLPLFSRQALHPDV

SEQ ID NO: 1533002 - protein, 18 aa, Mycobacterium tuberculosis
FVRLEGPAVFRWAAFKMG

SEQ ID NO: 1533003 - protein, 18 aa, Mycobacterium tuberculosis
GAAALWFALDTDLPVLVD

SEQ ID NO: 1533004 - protein, 22 aa, Mycobacterium tuberculosis
GGNPCLLTPPPWYPILRGTTQQ

SEQ ID NO: 1533005 - protein, 22 aa, Mycobacterium tuberculosis
GLIGLPLLGIPVTPGYFNLTGG

SEQ ID NO: 1533006 - protein, 20 aa, Mycobacterium tuberculosis
GLLRFTVGLAQITSLLLAGD

SEQ ID NO: 1533007 - protein, 22 aa, Mycobacterium tuberculosis
GTRWYGYFLRRLAERPANLAFF

SEQ ID NO: 1533008 - protein, 20 aa, Mycobacterium tuberculosis
HQAYLALRAWGLPVSEHTTL

SEQ ID NO: 1533009 - protein, 17 aa, Mycobacterium tuberculosis
HTLWIAHCWFMEAWDST

SEQ ID NO: 1533010 - protein, 19 aa, Mycobacterium tuberculosis
IAGIPLLAGAISKAVLPPI

SEQ ID NO: 1533011 - protein, 17 aa, Mycobacterium tuberculosis
IGLPYLGFTQWALLHDP

SEQ ID NO: 1533012 - protein, 18 aa, Mycobacterium tuberculosis
IPPLSWFLGNSPPPLLNS

SEQ ID NO: 1533013 - protein, 19 aa, Mycobacterium tuberculosis
KHRLARSLFLYALCNGWIN

SEQ ID NO: 1533014 - protein, 23 aa, Mycobacterium tuberculosis
KSPNAEWYLYTKDWLALLRQFAP

SEQ ID NO: 1533015 - protein, 23 aa, Mycobacterium tuberculosis
KVIAQLRFPGYFLVVHDITRFCR

SEQ ID NO: 1533016 - protein, 19 aa, Mycobacterium tuberculosis
LAEMKLLRPLLSAGDYLVV

SEQ ID NO: 1533017 - protein, 19 aa, Mycobacterium tuberculosis
LARLHTPLPLLAFTAWPEV

SEQ ID NO: 1533018 - protein, 18 aa, Mycobacterium tuberculosis
LELLPFRRNLAFYGLDLG

SEQ ID NO: 1533019 - protein, 25 aa, Mycobacterium tuberculosis
LLRKGERLLVFLPLAHVLARAISMA

SEQ ID NO: 1533020 - protein, 22 aa, Mycobacterium tuberculosis
LQLRWPLRMLLGGKPLQHIAAD

SEQ ID NO: 1533021 - protein, 19 aa, Mycobacterium tuberculosis
LRREAPISFWPTIELPGFV

SEQ ID NO: 1533022 - protein, 27 aa, Mycobacterium tuberculosis
LSFASLVFYSAWFKLHHPAAFCAALLR

SEQ ID NO: 1533023 - protein, 24 aa, Mycobacterium tuberculosis
LTSGLFPFHFTLNGGIGPISIPTT

SEQ ID NO: 1533024 - protein, 19 aa, Mycobacterium tuberculosis
LYKTSWRFAPFLWQEIEEG

SEQ ID NO: 1533025 - protein, 20 aa, Mycobacterium tuberculosis
LYPTGRLINAPLPTWNHRRL

SEQ ID NO: 1533026 - protein, 23 aa, Mycobacterium tuberculosis
MTGAAAPYLGWLSAAAAQAQQAA

SEQ ID NO: 1533027 - protein, 23 aa, Mycobacterium tuberculosis
PKETWLRLLLINAGFPRPSTQIP

SEQ ID NO: 1533028 - protein, 22 aa, Mycobacterium tuberculosis
PPYAGPPMWFHGDLSRFNILTA

SEQ ID NO: 1533029 - protein, 19 aa, Mycobacterium tuberculosis
QNAQWLTPVLVAAGIDLLV

SEQ ID NO: 1533030 - protein, 21 aa, Mycobacterium tuberculosis
QSVLYLRFREWFLPAMHRKYG

SEQ ID NO: 1533031 - protein, 17 aa, Mycobacterium tuberculosis
RDYILELLLAHTSAGLP

SEQ ID NO: 1533032 - protein, 20 aa, Mycobacterium tuberculosis
RIHKLLRIFANPKLPTIGDY

SEQ ID NO: 1533033 - protein, 23 aa, Mycobacterium tuberculosis
RKHIAWYLHGFPAGSALRRALAM

SEQ ID NO: 1533034 - protein, 22 aa, Mycobacterium tuberculosis
RMQRFWISLYFPLTMRSLCNAI

SEQ ID NO: 1533035 - protein, 18 aa, Mycobacterium tuberculosis
RSRWRFTFKRLAAEAQDA

SEQ ID NO: 1533036 - protein, 20 aa, Mycobacterium tuberculosis
SGRPWDRDQLLRALGLRPPG

SEQ ID NO: 1533037 - protein, 23 aa, Mycobacterium tuberculosis
STETRLPFCWRGVSLHAGGAGRV

SEQ ID NO: 1533038 - protein, 26 aa, Mycobacterium tuberculosis
STFLHRAFDQLLFDIGLHRLPVTLVL

SEQ ID NO: 1533039 - protein, 23 aa, Mycobacterium tuberculosis
TARDLHLLLPDPYTFPSNLLIEH

SEQ ID NO: 1533040 - protein, 18 aa, Mycobacterium tuberculosis
TLENGLLTGIRKLARPQL

SEQ ID NO: 1533041 - protein, 24 aa, Mycobacterium tuberculosis
TNLKAWLYRILTNTYINSYRKKQR

SEQ ID NO: 1533042 - protein, 17 aa, Mycobacterium tuberculosis
TRGWFMCWLARAHPELV

SEQ ID NO: 1533043 - protein, 21 aa, Mycobacterium tuberculosis
VAAYMPFLAWLIQASADCVEM

SEQ ID NO: 1533044 - protein, 22 aa, Mycobacterium tuberculosis
VCSYLNKLLWILTGNFAKKGGQ

SEQ ID NO: 1533045 - protein, 18 aa, Mycobacterium tuberculosis
VCYDIRFPALYTELARRG

SEQ ID NO: 1533046 - protein, 24 aa, Mycobacterium tuberculosis
VGGPPLVFQLLWYPTTMADLSLPS

SEQ ID NO: 1533047 - protein, 20 aa, Mycobacterium tuberculosis
VGLRVVPWLWGAPPTDRRYY

SEQ ID NO: 1533048 - protein, 17 aa, Mycobacterium tuberculosis
VMAALREPGIGVIAEVK

SEQ ID NO: 1533049 - protein, 24 aa, Mycobacterium tuberculosis
VPSTPVSWLPFYHDMGLMLGIILP

SEQ ID NO: 1533050 - protein, 19 aa, Mycobacterium tuberculosis
WAGVPFYLRTGKRLGRRVT

SEQ ID NO: 1533051 - protein, 17 aa, Mycobacterium tuberculosis
WFRFHQMFADFLHRRLE

SEQ ID NO: 1533052 - protein, 23 aa, Mycobacterium tuberculosis
AEESAFVLLALQAPVAGDLRAIV

SEQ ID NO: 1533053 - protein, 19 aa, Mycobacterium tuberculosis
ALFRMWLRDAVRRVATGVL

SEQ ID NO: 1533054 - protein, 17 aa, Mycobacterium tuberculosis
ANALYWLQEFHIDGLRV

SEQ ID NO: 1533055 - protein, 20 aa, Mycobacterium tuberculosis
DLAWTYHYPLPAVAPIAGLV

SEQ ID NO: 1533056 - protein, 23 aa, Mycobacterium tuberculosis
DSAFFCPFVPFFDPRMGRPSIPM

SEQ ID NO: 1533057 - protein, 17 aa, Mycobacterium tuberculosis
DWRWRRRGFFGDHGGRW

SEQ ID NO: 1533058 - protein, 20 aa, Mycobacterium tuberculosis
EDRLLRLRWPCPVPGAMPIS

SEQ ID NO: 1533059 - protein, 22 aa, Mycobacterium tuberculosis
EETRYWYYALLGFGLNRYRAGS

SEQ ID NO: 1533060 - protein, 17 aa, Mycobacterium tuberculosis
EILLARSMVKRLPLARA

SEQ ID NO: 1533061 - protein, 20 aa, Mycobacterium tuberculosis
EPITDSWYLTSIRAGLEPWS

SEQ ID NO: 1533062 - protein, 17 aa, Mycobacterium tuberculosis
EWPLPLLDLARIASDRG

SEQ ID NO: 1533063 - protein, 17 aa, Mycobacterium tuberculosis
FLEYLDMFYNLGIAGRA

SEQ ID NO: 1533064 - protein, 17 aa, Mycobacterium tuberculosis
GDKVLPLYLPSGDGLIG

SEQ ID NO: 1533065 - protein, 18 aa, Mycobacterium tuberculosis
GPISIPIIDLRPAPGFFN

SEQ ID NO: 1533066 - protein, 26 aa, Mycobacterium tuberculosis
GSDGSIFLRPFLKYQIITVVAPNSPL

SEQ ID NO: 1533067 - protein, 23 aa, Mycobacterium tuberculosis
GVAWVIAYRWFRAGLLPVPAQRV

SEQ ID NO: 1533068 - protein, 25 aa, Mycobacterium tuberculosis
GVQLFSPAFLLAVPTALGGVGSLAI

SEQ ID NO: 1533069 - protein, 20 aa, Mycobacterium tuberculosis
GYSWGPLSLMLLATAIAQQG

SEQ ID NO: 1533070 - protein, 21 aa, Mycobacterium tuberculosis
HGARRMVIAPWLLAPGILSDR

SEQ ID NO: 1533071 - protein, 18 aa, Mycobacterium tuberculosis
HPLMIALISYAVGGPIRM

SEQ ID NO: 1533072 - protein, 18 aa, Mycobacterium tuberculosis
IADQLARRRLGYGRGARM

SEQ ID NO: 1533073 - protein, 17 aa, Mycobacterium tuberculosis
IAPTWPLGAHPKPLRPG

SEQ ID NO: 1533074 - protein, 17 aa, Mycobacterium tuberculosis
ILPITWAYIRMMGAEGL

SEQ ID NO: 1533075 - protein, 27 aa, Mycobacterium tuberculosis
IPMETYLRLMFLKFRYRLGYESLCREV

SEQ ID NO: 1533076 - protein, 22 aa, Mycobacterium tuberculosis
IREPLWVPSPTDRRLRHACALI

SEQ ID NO: 1533077 - protein, 20 aa, Mycobacterium tuberculosis
ITVLPPIHIPPIPVGFAAVG

SEQ ID NO: 1533078 - protein, 23 aa, Mycobacterium tuberculosis
KRWFPGFMTFRFLECGLLTMVSN

SEQ ID NO: 1533079 - protein, 19 aa, Mycobacterium tuberculosis
KVLPLYLPSGDGLIGLLSQ

SEQ ID NO: 1533080 - protein, 18 aa, Mycobacterium tuberculosis
LCALSWMVYSLPGAPVLE

SEQ ID NO: 1533081 - protein, 20 aa, Mycobacterium tuberculosis
LEHWRWMWDTNVLGTLRVTR

SEQ ID NO: 1533082 - protein, 21 aa, Mycobacterium tuberculosis
LHSDYPLQALLYVVVLHRFLR

SEQ ID NO: 1533083 - protein, 18 aa, Mycobacterium tuberculosis
LPLGLRRLLTDLHNAGAA

SEQ ID NO: 1533084 - protein, 20 aa, Mycobacterium tuberculosis
LTVSRLLAPILTPVIYRAAM

SEQ ID NO: 1533085 - protein, 19 aa, Mycobacterium tuberculosis
LWYCGPWTLWVMAGRGVAS

SEQ ID NO: 1533086 - protein, 17 aa, Mycobacterium tuberculosis
MADWWAYLNGVRKTYPL

SEQ ID NO: 1533087 - protein, 17 aa, Mycobacterium tuberculosis
MGPLLDAMGLTVGWITA

SEQ ID NO: 1533088 - protein, 20 aa, Mycobacterium tuberculosis
NTVGPPLLPPILGGGMPAAP

SEQ ID NO: 1533089 - protein, 17 aa, Mycobacterium tuberculosis
PDVLLLFSALELLHAWA

SEQ ID NO: 1533090 - protein, 22 aa, Mycobacterium tuberculosis
PGGYTIDPLPLHLALNLTVPDS

SEQ ID NO: 1533091 - protein, 18 aa, Mycobacterium tuberculosis
PHLTAMWYAVIDGEIWLE

SEQ ID NO: 1533092 - protein, 18 aa, Mycobacterium tuberculosis
PLLPPILGGGMPAAPGPA

SEQ ID NO: 1533093 - protein, 22 aa, Mycobacterium tuberculosis
QAATMLPFSWQGVSLHAAGASR

SEQ ID NO: 1533094 - protein, 20 aa, Mycobacterium tuberculosis
QRYLDILRPLGFRPALGFSR

SEQ ID NO: 1533095 - protein, 22 aa, Mycobacterium tuberculosis
RERPGRLLGFHWTKVHPDHPGL

SEQ ID NO: 1533096 - protein, 19 aa, Mycobacterium tuberculosis
RGYTLRLPLDVLVVASANP

SEQ ID NO: 1533097 - protein, 20 aa, Mycobacterium tuberculosis
RLRLPWWHLWRAAEAAGAAT

SEQ ID NO: 1533098 - protein, 18 aa, Mycobacterium tuberculosis
RSLVFPVKRLADLGFRVL

SEQ ID NO: 1533099 - protein, 25 aa, Mycobacterium tuberculosis
RWAYYPWRRMVVAILGLRGFRAVRL

SEQ ID NO: 1533100 - protein, 25 aa, Mycobacterium tuberculosis
SGDGPPIFLLSLKAGGTGLNLTAAN

SEQ ID NO: 1533101 - protein, 19 aa, Mycobacterium tuberculosis
SPIVGIWHSGGARLAEGVR

SEQ ID NO: 1533102 - protein, 23 aa, Mycobacterium tuberculosis
SRLTFLAVRRWYGWSAGRILNLD

SEQ ID NO: 1533103 - protein, 19 aa, Mycobacterium tuberculosis
SRWALRLRVPFTVPVEAKS

SEQ ID NO: 1533104 - protein, 17 aa, Mycobacterium tuberculosis
TVLLGKTPRYLTSSAAT

SEQ ID NO: 1533105 - protein, 26 aa, Mycobacterium tuberculosis
TYILLPSQDLPLLVPLRAIPLLGNPL

SEQ ID NO: 1533106 - protein, 17 aa, Mycobacterium tuberculosis
VHGFRLRMRTRAGRSIV

SEQ ID NO: 1533107 - protein, 17 aa, Mycobacterium tuberculosis
VPFLHPDLVWDFRLPRV

SEQ ID NO: 1533108 - protein, 20 aa, Mycobacterium tuberculosis
VVPWASLLQRFPGLGAGATG

SEQ ID NO: 1533109 - protein, 18 aa, Mycobacterium tuberculosis
VVSPGFIGAPLALAALGQ

SEQ ID NO: 1533110 - protein, 17 aa, Mycobacterium tuberculosis
WLDLVRKLGVLAGVLSD

SEQ ID NO: 1533111 - protein, 19 aa, Mycobacterium tuberculosis
YILELLLAHTSAGLPYERC

SEQ ID NO: 1533112 - protein, 20 aa, Mycobacterium tuberculosis
YPGYKPTLPGLVGSALFADG

SEQ ID NO: 1533113 - protein, 19 aa, Mycobacterium tuberculosis
YVAQLHVWARREHPTYEDI

SEQ ID NO: 1533114 - protein, 20 aa, Mycobacterium tuberculosis
AAVPVLVHPAPRGVLGGLAA

SEQ ID NO: 1533115 - protein, 20 aa, Mycobacterium tuberculosis
ADLTWLLSRWACVFGTPACQ

SEQ ID NO: 1533116 - protein, 25 aa, Mycobacterium tuberculosis
DDYLPCLVSIQFRLLPDGKDYVFHT

SEQ ID NO: 1533117 - protein, 25 aa, Mycobacterium tuberculosis
DRHSGWWRAPLRWTLRGSLALRSHL

SEQ ID NO: 1533118 - protein, 22 aa, Mycobacterium tuberculosis
DSMPALHMLPLADALGVLPVLA

SEQ ID NO: 1533119 - protein, 21 aa, Mycobacterium tuberculosis
EQLMPHWMLSLRAADMRRGGT

SEQ ID NO: 1533120 - protein, 25 aa, Mycobacterium tuberculosis
ESSHRALYTFLLDRPLIAEAISVEA

SEQ ID NO: 1533121 - protein, 30 aa, Mycobacterium tuberculosis; identical to SEQ ID NO: 227453

SEQ ID NO: 1533122 - protein, 18 aa, Mycobacterium tuberculosis
FSFPNISIVLPNIGINLG

SEQ ID NO: 1533123 - protein, 22 aa, Mycobacterium tuberculosis
GGILLITHYTRILRYIHPEYVH

SEQ ID NO: 1533124 - protein, 19 aa, Mycobacterium tuberculosis
GRDLLFFSLPGHVPAPVSD

SEQ ID NO: 1533125 - protein, 19 aa, Mycobacterium tuberculosis
IDPYLRPLYDALYDMMDPE

SEQ ID NO: 1533126 - protein, 21 aa, Mycobacterium tuberculosis
LDALALLHRRSLKSPVRHFVL

SEQ ID NO: 1533127 - protein, 17 aa, Mycobacterium tuberculosis
LDALILMNFIQTNSAVY

SEQ ID NO: 1533128 - protein, 23 aa, Mycobacterium tuberculosis
MVAAAQPYLAWLTYTAEAAAHAG

SEQ ID NO: 1533129 - protein, 17 aa, Mycobacterium tuberculosis
PLSLMLLATAIAQQGHI

SEQ ID NO: 1533130 - protein, 23 aa, Mycobacterium tuberculosis
PPEPPTLLWPIGVPFSDGLNTLS

SEQ ID NO: 1533131 - protein, 17 aa, Mycobacterium tuberculosis
PTDTRAYFRGECLRRFG

SEQ ID NO: 1533132 - protein, 17 aa, Mycobacterium tuberculosis
QLARRRLGYGRGARMTF

SEQ ID NO: 1533133 - protein, 24 aa, Mycobacterium tuberculosis
RDQIGIVFQFFNLIPTLTVLENIT

SEQ ID NO: 1533134 - protein, 25 aa, Mycobacterium tuberculosis
REGVNLTFLPFFAKAVIDALKIHPN

SEQ ID NO: 1533135 - protein, 22 aa, Mycobacterium tuberculosis
RWSALLVGAWWPARPDAPMAGV

SEQ ID NO: 1533136 - protein, 17 aa, Mycobacterium tuberculosis
SLLQRFPGLGAGATGAT

SEQ ID NO: 1533137 - protein, 24 aa, Mycobacterium tuberculosis
SMLTYNIAGLPFPLSSAILPRFFY

SEQ ID NO: 1533138 - protein, 31 aa, Mycobacterium tuberculosis; identical to SEQ ID NO: 206766

SEQ ID NO: 1533139 - protein, 20 aa, Mycobacterium tuberculosis
TEIDNWRWAGVPIFVRAGKE

SEQ ID NO: 1533140 - protein, 23 aa, Mycobacterium tuberculosis
TGQRGFFCWFRVGSDVLVDNAFR

SEQ ID NO: 1533141 - protein, 17 aa, Mycobacterium tuberculosis
TIVRLLGISYFDEGLLQ

SEQ ID NO: 1533142 - protein, 20 aa, Mycobacterium tuberculosis
TPFMGMAPLLINYIPQQLAL

SEQ ID NO: 1533143 - protein, 26 aa, Mycobacterium tuberculosis
VAKGLQFPIVYLPFAFNRNVRSDDIL

SEQ ID NO: 1533144 - protein, 22 aa, Mycobacterium tuberculosis
VIIAGFPFLDLGNVTIGGFNLA

SEQ ID NO: 1533145 - protein, 17 aa, Mycobacterium tuberculosis
VVVLPDFGERYLSTPLF

SEQ ID NO: 1533146 - protein, 24 aa, Mycobacterium tuberculosis
WMHIGIDLFWFALPPEQLDLARVR

SEQ ID NO: 1533147 - protein, 21 aa, Mycobacterium tuberculosis
YALRDSIGTPFLLLAGLEPDL

SEQ ID NO: 1533148 - protein, 18 aa, Mycobacterium tuberculosis
YLGFTQWALLHDPPPELA

SEQ ID NO: 1533149 - protein, 18 aa, Mycobacterium tuberculosis
YMAIRGIGFLGWNTRFRG

SEQ ID NO: 1533150 - protein, 19 aa, Mycobacterium tuberculosis
YSNGFFWRGDYQGLGGFAY

SEQ ID NO: 1533151 - protein, 20 aa, Mycobacterium tuberculosis
YVDLYLIHWPAPPVGKYVDA

SEQ ID NO: 1533152 - protein, 24 aa, Mycobacterium tuberculosis
APRKLLARFFVWLTVGLYDPPVRE

SEQ ID NO: 1533153 - protein, 22 aa, Mycobacterium tuberculosis
ASCKYMKMITPAALLRCLVEGA

SEQ ID NO: 1533154 - protein, 17 aa, Mycobacterium tuberculosis
AWRGFSRWLMRAYDVLV

SEQ ID NO: 1533155 - protein, 24 aa, Mycobacterium tuberculosis
CEHDLSLWLLRVQALHSAWGTPQE

SEQ ID NO: 1533156 - protein, 17 aa, Mycobacterium tuberculosis
DELALPFAWQGVSLHAT

SEQ ID NO: 1533157 - protein, 23 aa, Mycobacterium tuberculosis
DGYGRNFLLPRGLAIVASRGAQK

SEQ ID NO: 1533158 - protein, 30 aa, Mycobacterium tuberculosis
DLHTTLSIGPFPFRWDYIPPTPANGPIPAV

SEQ ID NO: 1533159 - protein, 19 aa, Mycobacterium tuberculosis
DLTIGFFLHIPFPPVELFM

SEQ ID NO: 1533160 - protein, 22 aa, Mycobacterium tuberculosis
DRVTLFRAWYSRRNFGQLSGSV

SEQ ID NO: 1533161 - protein, 20 aa, Mycobacterium tuberculosis
DSRAYRLPWPDGTTVFELDR

SEQ ID NO: 1533162 - protein, 25 aa, Mycobacterium tuberculosis
EDHIGAIPFLLKLRPDIPVVGSKFT

SEQ ID NO: 1533163 - protein, 17 aa, Mycobacterium tuberculosis
FPGVLPPSGVPYLLGIQ

SEQ ID NO: 1533164 - protein, 23 aa, Mycobacterium tuberculosis
GPTLIDLLMALFGLSTNADLGGA

SEQ ID NO: 1533165 - protein, 25 aa, Mycobacterium tuberculosis
GYIPILGAPWLADLVRRSPWGEMFA

SEQ ID NO: 1533166 - protein, 19 aa, Mycobacterium tuberculosis
GYVLRRLLRRVIRSAKLLG

SEQ ID NO: 1533167 - protein, 18 aa, Mycobacterium tuberculosis
IRAWAYQIADLAGDYRVI

SEQ ID NO: 1533168 - protein, 18 aa, Mycobacterium tuberculosis
LALWSRRLLGEAITQAQL

SEQ ID NO: 1533169 - protein, 22 aa, Mycobacterium tuberculosis
LASLKWVLANRAYTPWYLVRYW

SEQ ID NO: 1533170 - protein, 18 aa, Mycobacterium tuberculosis
LLAPILTPVIYRAAMAAR

SEQ ID NO: 1533171 - protein, 18 aa, Mycobacterium tuberculosis
LPEVAWSWLVDALTARTD

SEQ ID NO: 1533172 - protein, 26 aa, Mycobacterium tuberculosis
LRPVADRLWYPLWDANIRLDHSVRTV

SEQ ID NO: 1533173 - protein, 23 aa, Mycobacterium tuberculosis
LTVTPVMLLLWIRGVRFMYSVDP

SEQ ID NO: 1533174 - protein, 20 aa, Mycobacterium tuberculosis
LTVVLKLLQIVRPDRVFFGE

SEQ ID NO: 1533175 - protein, 22 aa, Mycobacterium tuberculosis
MDPALYLVWAQANAAAGYRYSV

SEQ ID NO: 1533176 - protein, 22 aa, Mycobacterium tuberculosis
MVQFVPFFLGQRTPPYPTATSI

SEQ ID NO: 1533177 - protein, 21 aa, Mycobacterium tuberculosis
NEEVAPWLDLVRKLGVLAGVL

SEQ ID NO: 1533178 - protein, 27 aa, Mycobacterium tuberculosis
NRAYTPWYLVRYWRLLRFKLANPHIIT

SEQ ID NO: 1533179 - protein, 21 aa, Mycobacterium tuberculosis
PDGLSCFLLPRVLPDGTRNRM

SEQ ID NO: 1533180 - protein, 17 aa, Mycobacterium tuberculosis
PLRRLIATLPALEVPRP

SEQ ID NO: 1533181 - protein, 22 aa, Mycobacterium tuberculosis
PRRVPVWLPYIRGERTPFHEPD

SEQ ID NO: 1533182 - protein, 23 aa, Mycobacterium tuberculosis
PYQQRGLAWLAFLSSLGLGSCLA

SEQ ID NO: 1533183 - protein, 21 aa, Mycobacterium tuberculosis
QGWFTGLIPITVPIAGSAFGD

SEQ ID NO: 1533184 - protein, 30 aa, Mycobacterium tuberculosis
RALDPLAGSIGLFLEPFRLSDPFITIDAFQ

SEQ ID NO: 1533185 - protein, 23 aa, Mycobacterium tuberculosis
RGSTWARQLPWLTLLGAVYTYDA

SEQ ID NO: 1533186 - protein, 31 aa, Mycobacterium tuberculosis; identical to SEQ ID NO: 228003

SEQ ID NO: 1533187 - protein, 18 aa, Mycobacterium tuberculosis
RPGYLRFDFNWQGPLTDD

SEQ ID NO: 1533188 - protein, 19 aa, Mycobacterium tuberculosis
RVPDWLWAAPRKLLARFFV

SEQ ID NO: 1533189 - protein, 20 aa, Mycobacterium tuberculosis
RVPVWFMRQAGRSLPEYRAL

SEQ ID NO: 1533190 - protein, 23 aa, Mycobacterium tuberculosis
TGARWLCETFPTCLERGAGIPAV

SEQ ID NO: 1533191 - protein, 19 aa, Mycobacterium tuberculosis
TGEELELLNRLWPLVSLRC

SEQ ID NO: 1533192 - protein, 27 aa, Mycobacterium tuberculosis
TVFQRTPIWCFPKFDVPLPTAVRWAMR

SEQ ID NO: 1533193 - protein, 17 aa, Mycobacterium tuberculosis
TYATWWIRQAITRAMAD

SEQ ID NO: 1533194 - protein, 22 aa, Mycobacterium tuberculosis
VLAYPRVVWIAGGLLKGASLHA

SEQ ID NO: 1533195 - protein, 18 aa, Mycobacterium tuberculosis
WLTPVLVAAGIDLLVIQG

SEQ ID NO: 1533196 - protein, 20 aa, Mycobacterium tuberculosis
AAGDGFARYWLHNGWVTMGG

SEQ ID NO: 1533197 - protein, 20 aa, Mycobacterium tuberculosis
AFDGGWWVLGIRTPTAAECL

SEQ ID NO: 1533198 - protein, 18 aa, Mycobacterium tuberculosis
AGNRAPLPVLLPSMRRGG

SEQ ID NO: 1533199 - protein, 19 aa, Mycobacterium tuberculosis
AGSLWRLEFLLQSTQDPSL

SEQ ID NO: 1533200 - protein, 17 aa, Mycobacterium tuberculosis
ALGLLRRNKIEKLPVVD

SEQ ID NO: 1533201 - protein, 17 aa, Mycobacterium tuberculosis
ANYFAGAFLLPYREFHR

SEQ ID NO: 1533202 - protein, 23 aa, Mycobacterium tuberculosis
APGTAYRWFRAGLLSVMARRVGR

SEQ ID NO: 1533203 - protein, 24 aa, Mycobacterium tuberculosis
ASRRIKLAWFLLNAARYMGAGVRG

SEQ ID NO: 1533204 - protein, 17 aa, Mycobacterium tuberculosis
ATLLDYFPEDFLLVIDE

SEQ ID NO: 1533205 - protein, 19 aa, Mycobacterium tuberculosis
AVGYLMPALGRPNLTLLAR

SEQ ID NO: 1533206 - protein, 19 aa, Mycobacterium tuberculosis
DAQTPTLLFPFAAPRVVGD

SEQ ID NO: 1533207 - protein, 20 aa, Mycobacterium tuberculosis
EKAIWWQRAVAVWPDYASYQ

SEQ ID NO: 1533208 - protein, 19 aa, Mycobacterium tuberculosis
ELIAWLPTLLGLGGADLVV

SEQ ID NO: 1533209 - protein, 23 aa, Mycobacterium tuberculosis
ELRRLIPPWVTLGSRLAALPKPK

SEQ ID NO: 1533210 - protein, 21 aa, Mycobacterium tuberculosis
GDRWYWHWDPQFIGGIAAFPP

SEQ ID NO: 1533211 - protein, 19 aa, Mycobacterium tuberculosis
GHMPVRRLDLIWISARNAA

SEQ ID NO: 1533212 - protein, 20 aa, Mycobacterium tuberculosis
GPALLLPLRARGTVAGVVVV

SEQ ID NO: 1533213 - protein, 22 aa, Mycobacterium tuberculosis
IDPRTRWLLRELVYALLVKKDH

SEQ ID NO: 1533214 - protein, 18 aa, Mycobacterium tuberculosis
IKNLLPMLAVFKPTVVVS

SEQ ID NO: 1533215 - protein, 18 aa, Mycobacterium tuberculosis
IKVVKHPSAWRGWLTTMR

SEQ ID NO: 1533216 - protein, 21 aa, Mycobacterium tuberculosis
KQLLLKIGWPAEDLAGYVDGE

SEQ ID NO: 1533217 - protein, 21 aa, Mycobacterium tuberculosis
LCRRWYPRIYFGQPPKGLTHR

SEQ ID NO: 1533218 - protein, 17 aa, Mycobacterium tuberculosis
LLLILRRPRAGLSYEAL

SEQ ID NO: 1533219 - protein, 21 aa, Mycobacterium tuberculosis
LRNMWRFWYQIPMSLPVIGPR

SEQ ID NO: 1533220 - protein, 26 aa, Mycobacterium tuberculosis
NPHDIVLFPAWVWRSPLKPSPLDPPH

SEQ ID NO: 1533221 - protein, 18 aa, Mycobacterium tuberculosis
PEITPFALTLRLLVIALK

SEQ ID NO: 1533222 - protein, 20 aa, Mycobacterium tuberculosis
PYGGVWLHSWLDRDLGISGR

SEQ ID NO: 1533223 - protein, 23 aa, Mycobacterium tuberculosis
QSLLVRSLVAWFWDQPLRAPLIR

SEQ ID NO: 1533224 - protein, 23 aa, Mycobacterium tuberculosis
RALYAFKRYAWWPYTLVMRRVNV

SEQ ID NO: 1533225 - protein, 20 aa, Mycobacterium tuberculosis
RAPLPVLLPSMRRGGVAAVS

SEQ ID NO: 1533226 - protein, 20 aa, Mycobacterium tuberculosis
RDLLKFDFYFADSTAFRANI

SEQ ID NO: 1533227 - protein, 18 aa, Mycobacterium tuberculosis
RDTEIMRWLFTPDPSLTI

SEQ ID NO: 1533228 - protein, 20 aa, Mycobacterium tuberculosis
RGDHEGLFSLFYSLDVPRIT

SEQ ID NO: 1533229 - protein, 20 aa, Mycobacterium tuberculosis
TDPVLAWLYVLDAWEGGLPS

SEQ ID NO: 1533230 - protein, 21 aa, Mycobacterium tuberculosis
TNTARPWHIGLYGNAGGLGPT

SEQ ID NO: 1533231 - protein, 19 aa, Mycobacterium tuberculosis
AAAAPYAGWLAAAAARAAG

SEQ ID NO: 1533232 - protein, 18 aa, Mycobacterium tuberculosis
AFVQLVLSNLFGQNAPAI

SEQ ID NO: 1533233 - protein, 18 aa, Mycobacterium tuberculosis
AGPIWPLDTCLFVRDFKG

SEQ ID NO: 1533234 - protein, 17 aa, Mycobacterium tuberculosis
AIDLYLPAGLTSAARLP

SEQ ID NO: 1533235 - protein, 18 aa, Mycobacterium tuberculosis
ALRPIIDRAYQPGPAPAV

SEQ ID NO: 1533236 - protein, 18 aa, Mycobacterium tuberculosis
APPRILWLDTAAPAKLIL

SEQ ID NO: 1533237 - protein, 19 aa, Mycobacterium tuberculosis
APVRRLLRRLLGPTDPVLA

SEQ ID NO: 1533238 - protein, 19 aa, Mycobacterium tuberculosis
DAEWLVHLLECGLLRGWLI

SEQ ID NO: 1533239 - protein, 18 aa, Mycobacterium tuberculosis
DLINVRYLSGFSGSNGAL

SEQ ID NO: 1533240 - protein, 17 aa, Mycobacterium tuberculosis
FLFDFRDGIELNPIVIP

SEQ ID NO: 1533241 - protein, 18 aa, Mycobacterium tuberculosis
FTYWSMRPRGAQLGAWAS

SEQ ID NO: 1533242 - protein, 19 aa, Mycobacterium tuberculosis
GDLIPLCHPLGLDAVSVTI

SEQ ID NO: 1533243 - protein, 17 aa, Mycobacterium tuberculosis
GLLPTWGLSVRLPQKVG

SEQ ID NO: 1533244 - protein, 17 aa, Mycobacterium tuberculosis
GQMPIHMRLPKLKGFRN

SEQ ID NO: 1533245 - protein, 21 aa, Mycobacterium tuberculosis
IHDYFWRWDTDWFWCSRSFGA

SEQ ID NO: 1533246 - protein, 20 aa, Mycobacterium tuberculosis
KRSQSHMPPRTPPRGRCLRA

SEQ ID NO: 1533247 - protein, 18 aa, Mycobacterium tuberculosis
LLNYYPHLLALSASSPWW

SEQ ID NO: 1533248 - protein, 17 aa, Mycobacterium tuberculosis
LLVLLDALRSTICGQAP

SEQ ID NO: 1533249 - protein, 25 aa, Mycobacterium tuberculosis
LRNPERVWGWYLWRHYLVANVEPND

SEQ ID NO: 1533250 - protein, 17 aa, Mycobacterium tuberculosis
LVRHHLLLPITATRRDL

SEQ ID NO: 1533251 - protein, 17 aa, Mycobacterium tuberculosis
LWRWYPGLRAGGKLMHN

SEQ ID NO: 1533252 - protein, 20 aa, Mycobacterium tuberculosis
MPIHMRLPKLKGFRNRFRTE

SEQ ID NO: 1533253 - protein, 22 aa, Mycobacterium tuberculosis
NERYKLVWKNRLGFARLAIQHG

SEQ ID NO: 1533254 - protein, 23 aa, Mycobacterium tuberculosis
PDETWLALQPFLAPAGITGVADV

SEQ ID NO: 1533255 - protein, 18 aa, Mycobacterium tuberculosis
PIPGPLKWDLTRGVATDT

SEQ ID NO: 1533256 - protein, 17 aa, Mycobacterium tuberculosis
PTHFVITLGVRGARYVG

SEQ ID NO: 1533257 - protein, 17 aa, Mycobacterium tuberculosis
PYPVTVGYMYIMKLHHL

SEQ ID NO: 1533258 - protein, 22 aa, Mycobacterium tuberculosis
QEDFAYHQFLIKKSKMPSQTPP

SEQ ID NO: 1533259 - protein, 20 aa, Mycobacterium tuberculosis
QYRELLQEFLFGLDLDEDTR

SEQ ID NO: 1533260 - protein, 19 aa, Mycobacterium tuberculosis
RHLRLPLRDVIWGADADLL

SEQ ID NO: 1533261 - protein, 23 aa, Mycobacterium tuberculosis
RLKARLWFVHRGIEKLFHGRPAT

SEQ ID NO: 1533262 - protein, 24 aa, Mycobacterium tuberculosis
RQKRLMTLIHLWLVHRFKAQAVHY

SEQ ID NO: 1533263 - protein, 18 aa, Mycobacterium tuberculosis
RRPDLLVSLLTYWQRHPS

SEQ ID NO: 1533264 - protein, 20 aa, Mycobacterium tuberculosis
RYTWPRFVCALPKEFFAAVR

SEQ ID NO: 1533265 - protein, 22 aa, Mycobacterium tuberculosis
SYRLRAVSAVGLRFPLNGTANG

SEQ ID NO: 1533266 - protein, 23 aa, Mycobacterium tuberculosis
TATPMYVGLLLILRRPRAGLSYE

SEQ ID NO: 1533267 - protein, 25 aa, Mycobacterium tuberculosis
TAVPVKLHVPIFLDIPVTGTLGTFT

SEQ ID NO: 1533268 - protein, 24 aa, Mycobacterium tuberculosis
TEAEQTFLLRLLGGELRQGAKGGI

SEQ ID NO: 1533269 - protein, 18 aa, Mycobacterium tuberculosis
TGLWGRLLPEWEPIRDLP

SEQ ID NO: 1533270 - protein, 18 aa, Mycobacterium tuberculosis
VAVRRISMSFVNVAPQLV

SEQ ID NO: 1533271 - protein, 18 aa, Mycobacterium tuberculosis
VDPSWFNWPALPVAMADT

SEQ ID NO: 1533272 - protein, 17 aa, Mycobacterium tuberculosis
VVALPMRVRFRGITTRE

SEQ ID NO: 1533273 - protein, 17 aa, Mycobacterium tuberculosis
WRHWVHALTRINLGLSP

SEQ ID NO: 1533274 - protein, 17 aa, Mycobacterium tuberculosis
WYYRRPSPLARRIKNHV

SEQ ID NO: 1533275 - protein, 25 aa, Mycobacterium tuberculosis
YAKKFRFPTFLGAFKYYTSYTLKTF

SEQ ID NO: 1533276 - protein, 18 aa, Mycobacterium tuberculosis
YRRLRAKARLKFLIKDWG

SEQ ID NO: 1533277 - protein, 19 aa, Mycobacterium tuberculosis
AFSWWPTMLLPPGSHQDNM

SEQ ID NO: 1533278 - protein, 25 aa, Mycobacterium tuberculosis
APKGWGWVAPYIGMIWPNGDSTKLR

SEQ ID NO: 1533279 - protein, 18 aa, Mycobacterium tuberculosis
AQIYAWRKGIKTLYYIRL

SEQ ID NO: 1533280 - protein, 17 aa, Mycobacterium tuberculosis
AVDPLLPEVAWSWLVDA

SEQ ID NO: 1533281 - protein, 23 aa, Mycobacterium tuberculosis
DCARLLLQIPAVLGLAFDGGWWV

SEQ ID NO: 1533282 - protein, 18 aa, Mycobacterium tuberculosis
DGRLLTHKLLSDNPARYR

SEQ ID NO: 1533283 - protein, 17 aa, Mycobacterium tuberculosis
DGTPFPTLYYLTHPVLT

SEQ ID NO: 1533284 - protein, 23 aa, Mycobacterium tuberculosis
DIGWLRELWGGPFMLKGVMRVDD

SEQ ID NO: 1533285 - protein, 24 aa, Mycobacterium tuberculosis
DIGWLRELWGGPFMLKGVMRVDDA

SEQ ID NO: 1533286 - protein, 22 aa, Mycobacterium tuberculosis
EAEQTFLLRLLGGELRQGAKGG

SEQ ID NO: 1533287 - protein, 17 aa, Mycobacterium tuberculosis
EIRALFRSSKVGLIAGC

SEQ ID NO: 1533288 - protein, 22 aa, Mycobacterium tuberculosis
EIRTLFGVLFQDGALFGSMNLY

SEQ ID NO: 1533289 - protein, 28 aa, Mycobacterium tuberculosis
ELAAPVTHIWYFKGVPSRLGYLLDLAPK

SEQ ID NO: 1533290 - protein, 20 aa, Mycobacterium tuberculosis
GFALPIALPRRTVVTFTPEH

SEQ ID NO: 1533291 - protein, 18 aa, Mycobacterium tuberculosis
GFGELRWALSGAAPIPKE

SEQ ID NO: 1533292 - protein, 18 aa, Mycobacterium tuberculosis
LAFKITTKLDLLLAQAIV

SEQ ID NO: 1533293 - protein, 17 aa, Mycobacterium tuberculosis
LFSLFYSLDVPRITIVD

SEQ ID NO: 1533294 - protein, 17 aa, Mycobacterium tuberculosis
LFYLRSRGIPEAQARRL

SEQ ID NO: 1533295 - protein, 18 aa, Mycobacterium tuberculosis
LGTDPWPWVLSGGEDHAL

SEQ ID NO: 1533296 - protein, 18 aa, Mycobacterium tuberculosis
LPAELLPADWPGAGLRAA

SEQ ID NO: 1533297 - protein, 17 aa, Mycobacterium tuberculosis
LPLGFVDFACRVWRPGQ

SEQ ID NO: 1533298 - protein, 22 aa, Mycobacterium tuberculosis
MQRVFFGWAQIWRTKSRAAEAI

SEQ ID NO: 1533299 - protein, 20 aa, Mycobacterium tuberculosis
NVGVKVLPWIPTPAKRILSA

SEQ ID NO: 1533300 - protein, 23 aa, Mycobacterium tuberculosis
PEIPAIPPFFPGFPPDYVTVSGQ

SEQ ID NO: 1533301 - protein, 24 aa, Mycobacterium tuberculosis
PEREIHLTLIPFALRPTAEVPTTT

SEQ ID NO: 1533302 - protein, 21 aa, Mycobacterium tuberculosis
PLITNMIRLLKLPIPVQRRVA

SEQ ID NO: 1533303 - protein, 24 aa, Mycobacterium tuberculosis
QPTAWLAEGLLPYLPGDAADRLFD

SEQ ID NO: 1533304 - protein, 20 aa, Mycobacterium tuberculosis
QVALFLRHLWSAGGSVRWDP

SEQ ID NO: 1533305 - protein, 19 aa, Mycobacterium tuberculosis
QYRELLQEFLFGLDLDEDT

SEQ ID NO: 1533306 - protein, 22 aa, Mycobacterium tuberculosis
RGNYLYNFWRDAANPRGLWRRT

SEQ ID NO: 1533307 - protein, 25 aa, Mycobacterium tuberculosis
RQKRLMTLIHLWLVHRFKAQAVHYV

SEQ ID NO: 1533308 - protein, 24 aa, Mycobacterium tuberculosis
RQRHETAILLGWFNAILLGWFNER

SEQ ID NO: 1533309 - protein, 21 aa, Mycobacterium tuberculosis
RVIAYRWLRVGRLPVPARRVG

SEQ ID NO: 1533310 - protein, 21 aa, Mycobacterium tuberculosis
SIGAYLWVPDILECLASVMAD

SEQ ID NO: 1533311 - protein, 25 aa, Mycobacterium tuberculosis
SPAGLLYLVGPIAWTLGFPIVPMLA

SEQ ID NO: 1533312 - protein, 26 aa, Mycobacterium tuberculosis
VPEYIGNLLLYFQPDATVTMLDAVEL

SEQ ID NO: 1533313 - protein, 23 aa, Mycobacterium tuberculosis
VPVNHLPLTLPLRYLGMSDAEVD

SEQ ID NO: 1533314 - protein, 24 aa, Mycobacterium tuberculosis
VSLLPTLQSFLPPPFDAIPNPIED

SEQ ID NO: 1533315 - protein, 17 aa, Mycobacterium tuberculosis
YAPLPWLPDNIYREVVS

SEQ ID NO: 1533316 - protein, 25 aa, Mycobacterium tuberculosis
AAAALAPWQQAVPGLLGLLDSAQSS

SEQ ID NO: 1533317 - protein, 21 aa, Mycobacterium tuberculosis
AAAVAPYLGWLAAAAAQAQRS

SEQ ID NO: 1533318 - protein, 26 aa, Mycobacterium tuberculosis
AAQLSSWSIGLQQALPAAPSALAAAI

SEQ ID NO: 1533319 - protein, 25 aa, Mycobacterium tuberculosis
ASRRIKLAWFLLNAARYMPAQVFAA

SEQ ID NO: 1533320 - protein, 22 aa, Mycobacterium tuberculosis
DCARLLLQIPAVLGLAFDGGWW

SEQ ID NO: 1533321 - protein, 20 aa, Mycobacterium tuberculosis
DRWYWHWDPQFIGGIAAFPP

SEQ ID NO: 1533322 - protein, 19 aa, Mycobacterium tuberculosis
FALPIALPRRTVVTFTPEH

SEQ ID NO: 1533323 - protein, 32 aa, Mycobacterium tuberculosis; identical to SEQ ID NO: 227454

SEQ ID NO: 1533324 - protein, 17 aa, Mycobacterium tuberculosis
FNELLPLGYPFVNKQMH

SEQ ID NO: 1533325 - protein, 19 aa, Mycobacterium tuberculosis
GFGELRWALSGAAPIPKET

SEQ ID NO: 1533326 - protein, 24 aa, Mycobacterium tuberculosis
GNYSNGFWWRGDYQGLAGISQTIT

SEQ ID NO: 1533327 - protein, 20 aa, Mycobacterium tuberculosis
GTVLRFVPPLAALGSVPVTF

SEQ ID NO: 1533328 - protein, 32 aa, Mycobacterium tuberculosis
HGFRFPEITGDIFLIGIPFNAATLDAFSFPNI

SEQ ID NO: 1533329 - protein, 17 aa, Mycobacterium tuberculosis
HYQRYLDILRPLGFRPA

SEQ ID NO: 1533330 - protein, 18 aa, Mycobacterium tuberculosis
ITALLPAGADDVSAAIAA

SEQ ID NO: 1533331 - protein, 17 aa, Mycobacterium tuberculosis
KVVKHPSAWRGWLTTMR

SEQ ID NO: 1533332 - protein, 18 aa, Mycobacterium tuberculosis
LLVAIMPWEGHNYEDAII

SEQ ID NO: 1533333 - protein, 21 aa, Mycobacterium tuberculosis
LRDLLKFDFYFADSTAFRANI

SEQ ID NO: 1533334 - protein, 19 aa, Mycobacterium tuberculosis
LRDWLLMRAWEAGVTPIGA

SEQ ID NO: 1533335 - protein, 19 aa, Mycobacterium tuberculosis
LTGLLIDRLLPVAGSRVVT

SEQ ID NO: 1533336 - protein, 17 aa, Mycobacterium tuberculosis
LYIQLYLGGFGLELSDI

SEQ ID NO: 1533337 - protein, 22 aa, Mycobacterium tuberculosis
NAEALVPITALLPAGADDVSAA

SEQ ID NO: 1533338 - protein, 25 aa, Mycobacterium tuberculosis
NAEALVPITALLPAGADDVSAAIAA

SEQ ID NO: 1533339 - protein, 23 aa, Mycobacterium tuberculosis
NERYKLVWKNRLGFARLAIQHGY

SEQ ID NO: 1533340 - protein, 19 aa, Mycobacterium tuberculosis
PLYLLDFLRQSGNTPIVLL

SEQ ID NO: 1533341 - protein, 20 aa, Mycobacterium tuberculosis
PLYLLDFLRQSGNTPIVLLH

SEQ ID NO: 1533342 - protein, 17 aa, Mycobacterium tuberculosis
PPLRMAMGLPDPYRPHR

SEQ ID NO: 1533343 - protein, 17 aa, Mycobacterium tuberculosis
PWLQLPGAADQIAAWSK

SEQ ID NO: 1533344 - protein, 17 aa, Mycobacterium tuberculosis
QLPFPTFSLGKITIPQI

SEQ ID NO: 1533345 - protein, 21 aa, Mycobacterium tuberculosis
RARLLGLRLRRLRYLRTAAAR

SEQ ID NO: 1533346 - protein, 24 aa, Mycobacterium tuberculosis
SPAGLLYLVGPIAWTLGFPIVPML

SEQ ID NO: 1533347 - protein, 21 aa, Mycobacterium tuberculosis
SYRLRAVSAVGLRFPLNGTAN

SEQ ID NO: 1533348 - protein, 23 aa, Mycobacterium tuberculosis
TEITRLVPFIEWLRGAYPDQLIS

SEQ ID NO: 1533349 - protein, 18 aa, Mycobacterium tuberculosis
TGLLIDRLLPVAGSRVVT

SEQ ID NO: 1533350 - protein, 19 aa, Mycobacterium tuberculosis
TVAYRFSWHLPKDRIWTYD

SEQ ID NO: 1533351 - protein, 23 aa, Mycobacterium tuberculosis
YEIRTLFGVLFQDGALFGSMNLY

SEQ ID NO: 1533352 - protein, 21 aa, Mycobacterium tuberculosis
YLPRFLFGVFLSEQMIAAIAA

SEQ ID NO: 1533353 - protein, 17 aa, Mycobacterium tuberculosis
YRRLRAKARLKFLIKDW

SEQ ID NO: 1533354 - protein, 18 aa, Mycobacterium tuberculosis
AFSWWPTMLLPPGSHQDN

SEQ ID NO: 1533355 - protein, 22 aa, Mycobacterium tuberculosis
ALYAFKRYAWWPYTLVMRRVNV

SEQ ID NO: 1533356 - protein, 19 aa, Mycobacterium tuberculosis
EGMLSPWLQLPGAADQIAA

SEQ ID NO: 1533357 - protein, 26 aa, Mycobacterium tuberculosis
EITGDIFLIGIPFNAATLDAFSFPNI

SEQ ID NO: 1533358 - protein, 17 aa, Mycobacterium tuberculosis
FMRPFRADEWLLYDQSS

SEQ ID NO: 1533359 - protein, 18 aa, Mycobacterium tuberculosis
FTLLPDGFTLDTVPATFD

SEQ ID NO: 1533360 - protein, 18 aa, Mycobacterium tuberculosis
GDLIPLCHPLGLDAVSVT

SEQ ID NO: 1533361 - protein, 18 aa, Mycobacterium tuberculosis
GEELELLNRLWPLVSLRC

SEQ ID NO: 1533362 - protein, 17 aa, Mycobacterium tuberculosis
GTDPWPWVLSGGEDHAL

SEQ ID NO: 1533363 - protein, 18 aa, Mycobacterium tuberculosis
GVKVLPWIPTPAKRILSA

SEQ ID NO: 1533364 - protein, 17 aa, Mycobacterium tuberculosis
HDIATVVDWMLLAAINA

SEQ ID NO: 1533365 - protein, 17 aa, Mycobacterium tuberculosis
IDWLSRPFGDGALKDKP

SEQ ID NO: 1533366 - protein, 19 aa, Mycobacterium tuberculosis
IFTYWSMRPRGAQLGAWAS

SEQ ID NO: 1533367 - protein, 26 aa, Mycobacterium tuberculosis
IVRLKARLWFVHRGIEKLFHGRPATA

SEQ ID NO: 1533368 - protein, 17 aa, Mycobacterium tuberculosis
KLGPLISALLNPGARNA

SEQ ID NO: 1533369 - protein, 19 aa, Mycobacterium tuberculosis
LCRRWYPRIYFGQPPKGLT

SEQ ID NO: 1533370 - protein, 17 aa, Mycobacterium tuberculosis
LPAYLAARGLPLPPRRR

SEQ ID NO: 1533371 - protein, 17 aa, Mycobacterium tuberculosis
LSRRYGAAVLGPHGSKR

SEQ ID NO: 1533372 - protein, 18 aa, Mycobacterium tuberculosis
MFPLGPLLGNAGLNITVM

SEQ ID NO: 1533373 - protein, 17 aa, Mycobacterium tuberculosis
PAPALLALPAAESAWRL

SEQ ID NO: 1533374 - protein, 25 aa, Mycobacterium tuberculosis
PHDIVLFPAWVWRSPLKPSPLDPPH

SEQ ID NO: 1533375 - protein, 17 aa, Mycobacterium tuberculosis
RGQGFLALVDYAHKPEA

SEQ ID NO: 1533376 - protein, 19 aa, Mycobacterium tuberculosis
RLALWSRRLLGEAITQAQL

SEQ ID NO: 1533377 - protein, 20 aa, Mycobacterium tuberculosis
RQDIPIHYLLADAFTVCDRY

SEQ ID NO: 1533378 - protein, 23 aa, Mycobacterium tuberculosis
STLLESFLFYSGFYLPMYWSSRA

SEQ ID NO: 1533379 - protein, 24 aa, Mycobacterium tuberculosis
TFDLGPLVIFPPMNIPATVIESFS

SEQ ID NO: 1533380 - protein, 24 aa, Mycobacterium tuberculosis
VGLNLVIDMPLPISLGVNIPIDIP

SEQ ID NO: 1533381 - protein, 17 aa, Mycobacterium tuberculosis
WYPRIYFGQPPKGLTHR

SEQ ID NO: 1533382 - protein, 27 aa, Mycobacterium tuberculosis
YGDKSNWWAAYALWVFTLFGHADVRLL

SEQ ID NO: 1533383 - protein, 20 aa, Mycobacterium tuberculosis
AAFHQQFVRALSSAAGSYAA

SEQ ID NO: 1533384 - protein, 21 aa, Mycobacterium tuberculosis
AAGDGFARYWLHNGWVTMGGE

SEQ ID NO: 1533385 - protein, 17 aa, Mycobacterium tuberculosis
AALRLRRTHPESFLGGA

SEQ ID NO: 1533386 - protein, 22 aa, Mycobacterium tuberculosis
AAPPRILWLDTAAPAKLILEVR

SEQ ID NO: 1533387 - protein, 21 aa, Mycobacterium tuberculosis
AFHERFIQALSTAAGAYGSAE

SEQ ID NO: 1533388 - protein, 17 aa, Mycobacterium tuberculosis
AFLRPDWTRTVRARRFA

SEQ ID NO: 1533389 - protein, 22 aa, Mycobacterium tuberculosis
ALEDWCHQLAWPIRPAVSADPP

SEQ ID NO: 1533390 - protein, 23 aa, Mycobacterium tuberculosis
APDGLSCFLLPRVLPDGTRNRMF

SEQ ID NO: 1533391 - protein, 20 aa, Mycobacterium tuberculosis
ARLLGLRLRRLRYLRTAAAR

SEQ ID NO: 1533392 - protein, 26 aa, Mycobacterium tuberculosis
AYAKKFRFPTFLGAFKYYTSYTLKTF

SEQ ID NO: 1533393 - protein, 18 aa, Mycobacterium tuberculosis
DGLWLHCLYAISGINLRE

SEQ ID NO: 1533394 - protein, 22 aa, Mycobacterium tuberculosis
DGYGRNFLLPRGLAIVASRGAQ

SEQ ID NO: 1533395 - protein, 24 aa, Mycobacterium tuberculosis
DHIGAIPFLLKLRPDIPVVGSKFT

SEQ ID NO: 1533396 - protein, 18 aa, Mycobacterium tuberculosis
DLCALWPVPATSTPHPAA

SEQ ID NO: 1533397 - protein, 21 aa, Mycobacterium tuberculosis
EITRLVPFIEWLRGAYPDQLI

SEQ ID NO: 1533398 - protein, 26 aa, Mycobacterium tuberculosis
GDKSNWWAAYALWVFTLFGHADVRLL

SEQ ID NO: 1533399 - protein, 19 aa, Mycobacterium tuberculosis
GDPNNLLWRAFRPGTHVPI

SEQ ID NO: 1533400 - protein, 21 aa, Mycobacterium tuberculosis
GEIELLPITKFFPATDVAILF

SEQ ID NO: 1533401 - protein, 20 aa, Mycobacterium tuberculosis
GGAGGLLFGNGGNGGNAGAG

SEQ ID NO: 1533402 - protein, 25 aa, Mycobacterium tuberculosis
GGGTATFHEDPVAGVWAVGGVGGDG

SEQ ID NO: 1533403 - protein, 23 aa, Mycobacterium tuberculosis
IDPRTRWLLRELVYALLVKKDHA

SEQ ID NO: 1533404 - protein, 17 aa, Mycobacterium tuberculosis
ISAFLRPDWTRTVRARR

SEQ ID NO: 1533405 - protein, 18 aa, Mycobacterium tuberculosis
LIAWLPTLLGLGGADLVV

SEQ ID NO: 1533406 - protein, 28 aa, Mycobacterium tuberculosis
LNVINAPTQTLLGRPLIGNGTNGAPGTG

SEQ ID NO: 1533407 - protein, 17 aa, Mycobacterium tuberculosis
LNYYPHLLALSASSPWW

SEQ ID NO: 1533408 - protein, 25 aa, Mycobacterium tuberculosis
LRPVADRLWYPLWDANIRLDHSVRT

SEQ ID NO: 1533409 - protein, 23 aa, Mycobacterium tuberculosis
MQRVFFGWAQIWRTKSRAAEAIR

SEQ ID NO: 1533410 - protein, 23 aa, Mycobacterium tuberculosis
NYSNGFFWRGDYQGLIGFSGTLT

SEQ ID NO: 1533411 - protein, 19 aa, Mycobacterium tuberculosis
PALLLPLRARGTVAGVVVV

SEQ ID NO: 1533412 - protein, 19 aa, Mycobacterium tuberculosis
PDGTPFPTLYYLTHPVLTA

SEQ ID NO: 1533413 - protein, 22 aa, Mycobacterium tuberculosis
PESRYPSLAPGWHPDPEAAMRI

SEQ ID NO: 1533414 - protein, 23 aa, Mycobacterium tuberculosis
PRRVPVWLPYIRGERTPFHEPDR

SEQ ID NO: 1533415 - protein, 21 aa, Mycobacterium tuberculosis
PYGGVWLHSWLDRDLGISGRL

SEQ ID NO: 1533416 - protein, 22 aa, Mycobacterium tuberculosis
QLTPWQQLLSVLPPVVTAAPAG

SEQ ID NO: 1533417 - protein, 19 aa, Mycobacterium tuberculosis
QPILAPLTPAAIFLVATIG

SEQ ID NO: 1533418 - protein, 24 aa, Mycobacterium tuberculosis
RAGNRAPLPVLLPSMRRGGVAAVS

SEQ ID NO: 1533419 - protein, 17 aa, Mycobacterium tuberculosis
REFVGMTLNLPTPEEAA

SEQ ID NO: 1533420 - protein, 17 aa, Mycobacterium tuberculosis
RGKYLWLTLNTAGVHRP

SEQ ID NO: 1533421 - protein, 22 aa, Mycobacterium tuberculosis
RGTAYRWFRAGLLSVMARRVGR

SEQ ID NO: 1533422 - protein, 22 aa, Mycobacterium tuberculosis
RPLITNMIRLLKLPIPVQRRVA

SEQ ID NO: 1533423 - protein, 20 aa, Mycobacterium tuberculosis
RPVIIGPITFLLLSKAVDGA

SEQ ID NO: 1533424 - protein, 17 aa, Mycobacterium tuberculosis
RPWHIGLYGNAGGLGPT

SEQ ID NO: 1533425 - protein, 20 aa, Mycobacterium tuberculosis
RRGKYLWLTLNTAGVHRPTD

SEQ ID NO: 1533426 - protein, 17 aa, Mycobacterium tuberculosis
RRPDLLVSLLTYWQRHP

SEQ ID NO: 1533427 - protein, 18 aa, Mycobacterium tuberculosis
RSLERLECLARRLPAAQH

SEQ ID NO: 1533428 - protein, 25 aa, Mycobacterium tuberculosis
TCEHDLSLWLLRVQALHSAWGTPQE

SEQ ID NO: 1533429 - protein, 22 aa, Mycobacterium tuberculosis
TIHDYFWRWDTDWFWCSRSFGA

SEQ ID NO: 1533430 - protein, 17 aa, Mycobacterium tuberculosis
TIKRWFPGFMTFRFLEC

SEQ ID NO: 1533431 - protein, 19 aa, Mycobacterium tuberculosis
TNTARPWHIGLYGNAGGLG

SEQ ID NO: 1533432 - protein, 20 aa, Mycobacterium tuberculosis
TPWQQLLSVLPPVVTAAPAG

SEQ ID NO: 1533433 - protein, 28 aa, Mycobacterium tuberculosis
VLDVVNGPTQLLLGRPLIGDGANGGPGQ

SEQ ID NO: 1533434 - protein, 17 aa, Mycobacterium tuberculosis
WPATPARLPFTLGAGAH

SEQ ID NO: 1533435 - protein, 18 aa, Mycobacterium tuberculosis
YPGSFWPVTGLNSPTVGS

SEQ ID NO: 1533436 - protein, 23 aa, Mycobacterium tuberculosis
AAALAFPSLSSSVPILGPYEDLI

SEQ ID NO: 1533437 - protein, 20 aa, Mycobacterium tuberculosis
AAVAPYLGWLAAAAAQAQRS

SEQ ID NO: 1533438 - protein, 26 aa, Mycobacterium tuberculosis
ADRHSGWWRAPLRWTLRGSLALRSHL

SEQ ID NO: 1533439 - protein, 19 aa, Mycobacterium tuberculosis
AFDGGWWVLGIRTPTAAEC

SEQ ID NO: 1533440 - protein, 25 aa, Mycobacterium tuberculosis
APAPPPFRLPLLFVNALGDNWIVGA

SEQ ID NO: 1533441 - protein, 18 aa, Mycobacterium tuberculosis
AVTVIFFGPVDIDPFTVP

SEQ ID NO: 1533442 - protein, 20 aa, Mycobacterium tuberculosis
DAQTPTLLFPFAAPRVVGDL

SEQ ID NO: 1533443 - protein, 21 aa, Mycobacterium tuberculosis
DEKAIWWQRAVAVWPDYASYQ

SEQ ID NO: 1533444 - protein, 24 aa, Mycobacterium tuberculosis
DELRRLIPPWVTLGSRLAALPKPK

SEQ ID NO: 1533445 - protein, 17 aa, Mycobacterium tuberculosis
DGRLLTHKLLSDNPARY

SEQ ID NO: 1533446 - protein, 24 aa, Mycobacterium tuberculosis
DLEFIQFHPTMLFAGRAGGRRPLI

SEQ ID NO: 1533447 - protein, 18 aa, Mycobacterium tuberculosis
DLTIGFFLHIPFPPVELF

SEQ ID NO: 1533448 - protein, 20 aa, Mycobacterium tuberculosis
EIELLPITKFFPATDVAILF

SEQ ID NO: 1533449 - protein, 17 aa, Mycobacterium tuberculosis
EINSGRMFFGAGSGPML

SEQ ID NO: 1533450 - protein, 27 aa, Mycobacterium tuberculosis
ELAAPVTHIWYFKGVPSRLGYLLDLAP

SEQ ID NO: 1533451 - protein, 17 aa, Mycobacterium tuberculosis
FTLLPDGFTLDTVPATF

SEQ ID NO: 1533452 - protein, 17 aa, Mycobacterium tuberculosis
FVNQLPFPTFSLGKITI

SEQ ID NO: 1533453 - protein, 23 aa, Mycobacterium tuberculosis
GAGRGLFLGLGGDGGAGGTSNNN

SEQ ID NO: 1533454 - protein, 19 aa, Mycobacterium tuberculosis
GARRMVIAPWLLAPGILSD

SEQ ID NO: 1533455 - protein, 25 aa, Mycobacterium tuberculosis
GNNNWFAAYAYWYFKLYGHEKVKLL

SEQ ID NO: 1533456 - protein, 18 aa, Mycobacterium tuberculosis
GWRRLLLKQILECVLRRF

SEQ ID NO: 1533457 - protein, 17 aa, Mycobacterium tuberculosis
HMPVRRLDLIWISARNA

SEQ ID NO: 1533458 - protein, 17 aa, Mycobacterium tuberculosis
HPFFGKLTYIRVYSGTV

SEQ ID NO: 1533459 - protein, 23 aa, Mycobacterium tuberculosis
IDLTIRWDTPPITLFPNGISAPD

SEQ ID NO: 1533460 - protein, 17 aa, Mycobacterium tuberculosis
ILRDYLTDLFPILELGT

SEQ ID NO: 1533461 - protein, 17 aa, Mycobacterium tuberculosis
IPGPLKWDLTRGVATDT

SEQ ID NO: 1533462 - protein, 20 aa, Mycobacterium tuberculosis
KQLLLKIGWPAEDLAGYVDG

SEQ ID NO: 1533463 - protein, 18 aa, Mycobacterium tuberculosis
KRSQSHMPPRTPPRGRCL

SEQ ID NO: 1533464 - protein, 25 aa, Mycobacterium tuberculosis
LAVINAPAQALFGRPLIGNGANGTA

SEQ ID NO: 1533465 - protein, 22 aa, Mycobacterium tuberculosis
LYLPRFLFGVFLSEQMIAAIAA

SEQ ID NO: 1533466 - protein, 26 aa, Mycobacterium tuberculosis
NRAYTPWYLVRYWRLLRFKLANPHII

SEQ ID NO: 1533467 - protein, 22 aa, Mycobacterium tuberculosis
NYSNGFFWRGDYQGLIGFSGTL

SEQ ID NO: 1533468 - protein, 23 aa, Mycobacterium tuberculosis
NYSNGFWWRGDYQGLAGISQTIT

SEQ ID NO: 1533469 - protein, 25 aa, Mycobacterium tuberculosis
PEETRYWYYALLGFGLNRYRAGSGQ

SEQ ID NO: 1533470 - protein, 23 aa, Mycobacterium tuberculosis
PEREIHLTLIPFALRPTAEVPTT

SEQ ID NO: 1533471 - protein, 19 aa, Mycobacterium tuberculosis
PLAFKITTKLDLLLAQAIV

SEQ ID NO: 1533472 - protein, 23 aa, Mycobacterium tuberculosis
PRKLLARFFVWLTVGLYDPPVRE

SEQ ID NO: 1533473 - protein, 24 aa, Mycobacterium tuberculosis
PTGQRGFFAWFRVGSDVLVRNAFR

SEQ ID NO: 1533474 - protein, 17 aa, Mycobacterium tuberculosis
PTRLALVRRLGSIELDL

SEQ ID NO: 1533475 - protein, 18 aa, Mycobacterium tuberculosis
PTVLLGKTPRYLTSSAAT

SEQ ID NO: 1533476 - protein, 19 aa, Mycobacterium tuberculosis
QPHLTAMWYAVIDGEIWLE

SEQ ID NO: 1533477 - protein, 17 aa, Mycobacterium tuberculosis
QSHMPPRTPPRGRCLRA

SEQ ID NO: 1533478 - protein, 24 aa, Mycobacterium tuberculosis
RALEDWCHQLAWPIRPAVSADPPS

SEQ ID NO: 1533479 - protein, 21 aa, Mycobacterium tuberculosis
RERPGRLLGFHWTKVHPDHPG

SEQ ID NO: 1533480 - protein, 20 aa, Mycobacterium tuberculosis
RHLRLPLRDVIWGADADLLD

SEQ ID NO: 1533481 - protein, 21 aa, Mycobacterium tuberculosis
RTEIDNWRWAGVPIFVRAGKE

SEQ ID NO: 1533482 - protein, 21 aa, Mycobacterium tuberculosis
SCKYMKMITPAALLRCLVEGA

SEQ ID NO: 1533483 - protein, 22 aa, Mycobacterium tuberculosis
SLLVRSLVAWFWDQPLRAPLIR

SEQ ID NO: 1533484 - protein, 24 aa, Mycobacterium tuberculosis
SSHRALYTFLLDRPLIAEAISVEA

SEQ ID NO: 1533485 - protein, 18 aa, Mycobacterium tuberculosis
TESPLWQAFLTRVLPDEG

SEQ ID NO: 1533486 - protein, 18 aa, Mycobacterium tuberculosis
TIARLWDVIGDTGIGFCL

SEQ ID NO: 1533487 - protein, 21 aa, Mycobacterium tuberculosis
TIIPPIHIPSIPLGFAAIGHI

SEQ ID NO: 1533488 - protein, 22 aa, Mycobacterium tuberculosis
TLLESFLFYSGFYLPMYWSSRA

SEQ ID NO: 1533489 - protein, 24 aa, Mycobacterium tuberculosis
TLMDSHPFTWLPLLSRVLGSAQLV

SEQ ID NO: 1533490 - protein, 19 aa, Mycobacterium tuberculosis
TVVLKLLQIVRPDRVFFGE

SEQ ID NO: 1533491 - protein, 17 aa, Mycobacterium tuberculosis
VPDWLWAAPRKLLARFF

SEQ ID NO: 1533492 - protein, 22 aa, Mycobacterium tuberculosis
VVDPSWFNWPALPVAMADTIVP

SEQ ID NO: 1533493 - protein, 17 aa, Mycobacterium tuberculosis
WRRPRWARRLQPAPIAD

SEQ ID NO: 1533494 - protein, 19 aa, Mycobacterium tuberculosis
ADLTWLLSRWACVFGTPAC

SEQ ID NO: 1533495 - protein, 18 aa, Mycobacterium tuberculosis
AEWLVHLLECGLLRGWLI

SEQ ID NO: 1533496 - protein, 19 aa, Mycobacterium tuberculosis
AFHSRFVQALTTAAASYAS

SEQ ID NO: 1533497 - protein, 23 aa, Mycobacterium tuberculosis
ALEDWCHQLAWPIRPAVSADPPS

SEQ ID NO: 1533498 - protein, 21 aa, Mycobacterium tuberculosis
ARPVIIGPITFLLLSKAVDGA

SEQ ID NO: 1533499 - protein, 22 aa, Mycobacterium tuberculosis
ARVIAYRWLRVGRLPVPARRVG

SEQ ID NO: 1533500 - protein, 27 aa, Mycobacterium tuberculosis
ASDLSNILLLGPVGDLFPILSIPGAMS

SEQ ID NO: 1533501 - protein, 18 aa, Mycobacterium tuberculosis
ATGLIGSGGFGGAGGAAA

SEQ ID NO: 1533502 - protein, 17 aa, Mycobacterium tuberculosis
AVTVIFFGPVDIDPFTV

SEQ ID NO: 1533503 - protein, 17 aa, Mycobacterium tuberculosis
AWTTGLIRWEDDPQPGW

SEQ ID NO: 1533504 - protein, 21 aa, Mycobacterium tuberculosis
DLAWTYHYPLPAVAPIAGLVA

SEQ ID NO: 1533505 - protein, 18 aa, Mycobacterium tuberculosis
DRLRWWAGPWPDDERWWD

SEQ ID NO: 1533506 - protein, 17 aa, Mycobacterium tuberculosis
DWLYWQYVTGLLDRALA

SEQ ID NO: 1533507 - protein, 19 aa, Mycobacterium tuberculosis
EIELLPITKFFPATDVAIL

SEQ ID NO: 1533508 - protein, 17 aa, Mycobacterium tuberculosis
ELDGLRLITWRGASRAE

SEQ ID NO: 1533509 - protein, 20 aa, Mycobacterium tuberculosis
EYMAIRGIGFLGWNTRFRGF

SEQ ID NO: 1533510 - protein, 17 aa, Mycobacterium tuberculosis
FLQQYLANQFGYGQLTL

SEQ ID NO: 1533511 - protein, 17 aa, Mycobacterium tuberculosis
FPLGPLLGNAGLNITVM

SEQ ID NO: 1533512 - protein, 24 aa, Mycobacterium tuberculosis
GALAGAMRPPAPPAAPPGAPGMPG

SEQ ID NO: 1533513 - protein, 25 aa, Mycobacterium tuberculosis
GDKSNWWAAYALWVFTLFGHADVRL

SEQ ID NO: 1533514 - protein, 17 aa, Mycobacterium tuberculosis
GGCAPDLIYIDLHLVHE

SEQ ID NO: 1533515 - protein, 20 aa, Mycobacterium tuberculosis
GLGARLFQVGSRGGDGGVGG

SEQ ID NO: 1533516 - protein, 18 aa, Mycobacterium tuberculosis
GLLPTWGLSVRLPQKVGI

SEQ ID NO: 1533517 - protein, 22 aa, Mycobacterium tuberculosis
GPTLIDLLMALFGLSTNADLGG

SEQ ID NO: 1533518 - protein, 17 aa, Mycobacterium tuberculosis
GQITGLRSGFGGAGGAG

SEQ ID NO: 1533519 - protein, 23 aa, Mycobacterium tuberculosis
GQMPIHMRLPKLKGFRNRFRTEY

SEQ ID NO: 1533520 - protein, 25 aa, Mycobacterium tuberculosis
GTNLKAWLYRILTNTYINSYRKKQR

SEQ ID NO: 1533521 - protein, 19 aa, Mycobacterium tuberculosis
GVAIMIWTLMNARNSRDSL

SEQ ID NO: 1533522 - protein, 21 aa, Mycobacterium tuberculosis
HGFRFPEITGDIFLIGIPFNA

SEQ ID NO: 1533523 - protein, 17 aa, Mycobacterium tuberculosis
HGWIHDELRRRCGGPPI

SEQ ID NO: 1533524 - protein, 18 aa, Mycobacterium tuberculosis
IDAMLLVRLPYHLSSVTQ

SEQ ID NO: 1533525 - protein, 18 aa, Mycobacterium tuberculosis
IFFGPVDIDPFTVPVIRI

SEQ ID NO: 1533526 - protein, 17 aa, Mycobacterium tuberculosis
IPLIKIPAAPGFGNSTT

SEQ ID NO: 1533527 - protein, 18 aa, Mycobacterium tuberculosis
KHRLARSLFLYALCNGWI

SEQ ID NO: 1533528 - protein, 19 aa, Mycobacterium tuberculosis
LEHWRWMWDTNVLGTLRVT

SEQ ID NO: 1533529 - protein, 18 aa, Mycobacterium tuberculosis
LGARLFQVGSRGGDGGVG

SEQ ID NO: 1533530 - protein, 26 aa, Mycobacterium tuberculosis
LGVVNAPAQALLGRPLIGNGANGADG

SEQ ID NO: 1533531 - protein, 19 aa, Mycobacterium tuberculosis
LLPEVAWSWLVDALTARTD

SEQ ID NO: 1533532 - protein, 24 aa, Mycobacterium tuberculosis
NGVAWVIAYRWFRAGLLPVPAQRV

SEQ ID NO: 1533533 - protein, 27 aa, Mycobacterium tuberculosis
NTATPMYVGLLLILRRPRAGLSYEALL

SEQ ID NO: 1533534 - protein, 20 aa, Mycobacterium tuberculosis
QGWFTGLIPITVPIAGSAFG

SEQ ID NO: 1533535 - protein, 17 aa, Mycobacterium tuberculosis
RGGLLAGQHANSGNGGG

SEQ ID NO: 1533536 - protein, 20 aa, Mycobacterium tuberculosis
RGWRHWVHALTRINLGLSPD

SEQ ID NO: 1533537 - protein, 22 aa, Mycobacterium tuberculosis
RLTFLAVRRWYGWSAGRILNLD

SEQ ID NO: 1533538 - protein, 18 aa, Mycobacterium tuberculosis
RREAPISFWPTIELPGFV

SEQ ID NO: 1533539 - protein, 25 aa, Mycobacterium tuberculosis
RWSAVLVGPWWPAPSAALRAAAQHW

SEQ ID NO: 1533540 - protein, 19 aa, Mycobacterium tuberculosis
SPPTHFVITLGVRGARYVG

SEQ ID NO: 1533541 - protein, 24 aa, Mycobacterium tuberculosis
SPQRWKYLTSGLLGLQRGSDAGDL

SEQ ID NO: 1533542 - protein, 17 aa, Mycobacterium tuberculosis
STALMDVLLRRPPRTRS

SEQ ID NO: 1533543 - protein, 30 aa, Mycobacterium tuberculosis; identical to SEQ ID NO: 1478232

SEQ ID NO: 1533544 - protein, 24 aa, Mycobacterium tuberculosis
TAETWPNPWPMYRALRDHDPVHHV

SEQ ID NO: 1533545 - protein, 24 aa, Mycobacterium tuberculosis
TAVPVKLHVPIFLDIPVTGTLGTF

SEQ ID NO: 1533546 - protein, 20 aa, Mycobacterium tuberculosis
TIIPPIHIPSIPLGFAAIGH

SEQ ID NO: 1533547 - protein, 19 aa, Mycobacterium tuberculosis
TLYRKWLTVLGPAPAPPTP

SEQ ID NO: 1533548 - protein, 17 aa, Mycobacterium tuberculosis
TQTLLGRPLIGNGADGV

SEQ ID NO: 1533549 - protein, 17 aa, Mycobacterium tuberculosis
WIPPHIRLPAHITLLEP

SEQ ID NO: 1533550 - protein, 17 aa, Mycobacterium tuberculosis
AAKDWLCLLEAFDAPQR

SEQ ID NO: 1533551 - protein, 18 aa, Mycobacterium tuberculosis
AEYLRLLRRHNVAAALSG

SEQ ID NO: 1533552 - protein, 19 aa, Mycobacterium tuberculosis
AFHDRFVQLLNAGGGSYAS

SEQ ID NO: 1533553 - protein, 17 aa, Mycobacterium tuberculosis
AFKITTKLDLLLAQAIV

SEQ ID NO: 1533554 - protein, 23 aa, Mycobacterium tuberculosis
AGGNAGILFGAGGIGGTGGTGLG

SEQ ID NO: 1533555 - protein, 20 aa, Mycobacterium tuberculosis
AHVKVIRALFRPPARRGGCV

SEQ ID NO: 1533556 - protein, 20 aa, Mycobacterium tuberculosis
ALRDSIGTPFLLLAGLEPDL

SEQ ID NO: 1533557 - protein, 33 aa, Mycobacterium tuberculosis; identical to SEQ ID NO: 227267

SEQ ID NO: 1533558 - protein, 20 aa, Mycobacterium tuberculosis
APTQALLGRPLIGDGAAGAP

SEQ ID NO: 1533559 - protein, 19 aa, Mycobacterium tuberculosis
AVERLPQPALPADAASLAD

SEQ ID NO: 1533560 - protein, 17 aa, Mycobacterium tuberculosis
AVGDWMLLAAIEALIDE

SEQ ID NO: 1533561 - protein, 18 aa, Mycobacterium tuberculosis
AWYYRRPSPLARRIKNHV

SEQ ID NO: 1533562 - protein, 17 aa, Mycobacterium tuberculosis
CALSWMVYSLPGAPVLE

SEQ ID NO: 1533563 - protein, 17 aa, Mycobacterium tuberculosis
DVLLFIDNIFRFTQAGS

SEQ ID NO: 1533564 - protein, 24 aa, Mycobacterium tuberculosis
DVQTDSFEWLIGSPRWRESAAERG

SEQ ID NO: 1533565 - protein, 21 aa, Mycobacterium tuberculosis
EIPAIPPFFPGFPPDYVTVSG

SEQ ID NO: 1533566 - protein, 18 aa, Mycobacterium tuberculosis
FFVATAPRYSFVSSSLAK

SEQ ID NO: 1533567 - protein, 25 aa, Mycobacterium tuberculosis
GAGGTAGWFFGFGGNGGAGGIGVAG

SEQ ID NO: 1533568 - protein, 26 aa, Mycobacterium tuberculosis
GAPKGWGWVAPYIGMIWPNGDSTKLR

SEQ ID NO: 1533569 - protein, 18 aa, Mycobacterium tuberculosis
GDHEGLFSLFYSLDVPRI

SEQ ID NO: 1533570 - protein, 27 aa, Mycobacterium tuberculosis
GGAGTLLGLTVFGDNGGAGVLGDSTDP

SEQ ID NO: 1533571 - protein, 23 aa, Mycobacterium tuberculosis
GGFAVAPDFIGFGAAYGGAGGLG

SEQ ID NO: 1533572 - protein, 21 aa, Mycobacterium tuberculosis
GGILLITHYTRILRYIHPEYV

SEQ ID NO: 1533573 - protein, 23 aa, Mycobacterium tuberculosis
GGNPCLLTPPPWYPILRGTTQQA

SEQ ID NO: 1533574 - protein, 20 aa, Mycobacterium tuberculosis
GIANFLGFSVLHGGAGGAGG

SEQ ID NO: 1533575 - protein, 25 aa, Mycobacterium tuberculosis
GKPVRLPIPWRDVGGYRPTGRSIAA

SEQ ID NO: 1533576 - protein, 22 aa, Mycobacterium tuberculosis
GQMPIHMRLPKLKGFRNRFRTE

SEQ ID NO: 1533577 - protein, 23 aa, Mycobacterium tuberculosis
GSNALGLFLGLGGSGGQGGDSAM

SEQ ID NO: 1533578 - protein, 17 aa, Mycobacterium tuberculosis
GVDTFFVATAPRYSFVS

SEQ ID NO: 1533579 - protein, 24 aa, Mycobacterium tuberculosis
GYIPILGAPWLADLVRRSPWGEMF

SEQ ID NO: 1533580 - protein, 17 aa, Mycobacterium tuberculosis
HGGWLFGGGGTGGSGVS

SEQ ID NO: 1533581 - protein, 18 aa, Mycobacterium tuberculosis
IAPTWPLGAHPKPLRPGA

SEQ ID NO: 1533582 - protein, 20 aa, Mycobacterium tuberculosis
IDPYLRPLYDALYDMMDPEL

SEQ ID NO: 1533583 - protein, 17 aa, Mycobacterium tuberculosis
IFFGPVDIDPFTVPVIR

SEQ ID NO: 1533584 - protein, 19 aa, Mycobacterium tuberculosis
KMLYDNALLLRAYAHWARR

SEQ ID NO: 1533585 - protein, 25 aa, Mycobacterium tuberculosis
KMLYDNALLLRAYAHWARRTGDPLA

SEQ ID NO: 1533586 - protein, 20 aa, Mycobacterium tuberculosis
LAGGWIPPHVRLPANVTLLE

SEQ ID NO: 1533587 - protein, 27 aa, Mycobacterium tuberculosis
LDVINAPAQTLLGRPLIGNGADGSTPG

SEQ ID NO: 1533588 - protein, 17 aa, Mycobacterium tuberculosis
LFVWRRYHPSRPSGKAL

SEQ ID NO: 1533589 - protein, 17 aa, Mycobacterium tuberculosis
LLAPGLAGGAGGGGGQG

SEQ ID NO: 1533590 - protein, 25 aa, Mycobacterium tuberculosis
LQAAVSGLVTALFGAPGQPGDTGQP

SEQ ID NO: 1533591 - protein, 19 aa, Mycobacterium tuberculosis
LRVGVTSIYWYFRKKDDLL

SEQ ID NO: 1533592 - protein, 24 aa, Mycobacterium tuberculosis
LSAQAALFHEQFVRALTAGAGSYA

SEQ ID NO: 1533593 - protein, 21 aa, Mycobacterium tuberculosis
LTPWQQLLSVLPPVVTAAPAG

SEQ ID NO: 1533594 - protein, 24 aa, Mycobacterium tuberculosis
NAINAPTQALLGRPLIGDGADGTA

SEQ ID NO: 1533595 - protein, 25 aa, Mycobacterium tuberculosis
NAINAPTQTLLGRPLIGNGADGGPG

SEQ ID NO: 1533596 - protein, 23 aa, Mycobacterium tuberculosis
NEEVAPWLDLVRKLGVLAGVLSD

SEQ ID NO: 1533597 - protein, 20 aa, Mycobacterium tuberculosis
NRPGYLRFDFNWQGPLTDDQ

SEQ ID NO: 1533598 - protein, 17 aa, Mycobacterium tuberculosis
PEITPFALTLRLLVIAL

SEQ ID NO: 1533599 - protein, 20 aa, Mycobacterium tuberculosis
PGGPGGLLWGNGGNGGSGVA

SEQ ID NO: 1533600 - protein, 18 aa, Mycobacterium tuberculosis
PIIIPTINITLPTAAITV

SEQ ID NO: 1533601 - protein, 20 aa, Mycobacterium tuberculosis
PSPPTHFVITLGVRGARYVG

SEQ ID NO: 1533602 - protein, 18 aa, Mycobacterium tuberculosis
PTLALLNRPLIGNGADGT

SEQ ID NO: 1533603 - protein, 19 aa, Mycobacterium tuberculosis
PTQALLGRPLIGDGAAGAP

SEQ ID NO: 1533604 - protein, 18 aa, Mycobacterium tuberculosis
PYPPARLEKLWLPGPDRL

SEQ ID NO: 1533605 - protein, 24 aa, Mycobacterium tuberculosis
QIDLTIRWDTPPITLFPNGISAPD

SEQ ID NO: 1533606 - protein, 22 aa, Mycobacterium tuberculosis
QNAQWLTPVLVAAGIDLLVIQG

SEQ ID NO: 1533607 - protein, 23 aa, Mycobacterium tuberculosis
QPTAWLAEGLLPYLPGDAADRLF

SEQ ID NO: 1533608 - protein, 17 aa, Mycobacterium tuberculosis
RAWAYQIADLAGDYRVI

SEQ ID NO: 1533609 - protein, 21 aa, Mycobacterium tuberculosis
RDLHLLLPDPYTFPSNLLIEH

SEQ ID NO: 1533610 - protein, 17 aa, Mycobacterium tuberculosis
RDWLLMRAWEAGVTPIG

SEQ ID NO: 1533611 - protein, 18 aa, Mycobacterium tuberculosis
RELLPLRRADQAEYLRWA

SEQ ID NO: 1533612 - protein, 18 aa, Mycobacterium tuberculosis
RFWVGLSVYRPGGTAEPA

SEQ ID NO: 1533613 - protein, 23 aa, Mycobacterium tuberculosis
RGYVLRRLLRRVIRSAKLLGIDA

SEQ ID NO: 1533614 - protein, 19 aa, Mycobacterium tuberculosis
RIHKLLRIFANPKLPTIGD

SEQ ID NO: 1533615 - protein, 18 aa, Mycobacterium tuberculosis
RIPDVNALPPIKHTFAKP

SEQ ID NO: 1533616 - protein, 20 aa, Mycobacterium tuberculosis
RNMWRFWYQIPMSLPVIGPR

SEQ ID NO: 1533617 - protein, 21 aa, Mycobacterium tuberculosis
RQDIPIHYLLADTFTICDGYH

SEQ ID NO: 1533618 - protein, 18 aa, Mycobacterium tuberculosis
RRGKYLWLTLNTAGVHRP

SEQ ID NO: 1533619 - protein, 17 aa, Mycobacterium tuberculosis
SARGLIFALGGAGAAGG

SEQ ID NO: 1533620 - protein, 20 aa, Mycobacterium tuberculosis
SGGAGGLIGWAGAAGGTGAG

SEQ ID NO: 1533621 - protein, 17 aa, Mycobacterium tuberculosis
SLPFLPIGIGPWVAARM

SEQ ID NO: 1533622 - protein, 20 aa, Mycobacterium tuberculosis
SWINRLYWNLADYAGSPVRI

SEQ ID NO: 1533623 - protein, 17 aa, Mycobacterium tuberculosis
TGGWLWGSGGAGGAGGS

SEQ ID NO: 1533624 - protein, 26 aa, Mycobacterium tuberculosis
TGIIGWPALVMLFAGPRVGEPGKPVR

SEQ ID NO: 1533625 - protein, 18 aa, Mycobacterium tuberculosis
TIALVPPSDDPVPPGMHA

SEQ ID NO: 1533626 - protein, 25 aa, Mycobacterium tuberculosis
TYILLPSQDLPLLVPLRAIPLLGNP

SEQ ID NO: 1533627 - protein, 22 aa, Mycobacterium tuberculosis
VFEGIAVLGLGFGGAAGAGGAA

SEQ ID NO: 1533628 - protein, 22 aa, Mycobacterium tuberculosis
VGGRGGWLLGNGGTGGAGGAAG

SEQ ID NO: 1533629 - protein, 23 aa, Mycobacterium tuberculosis
VGLNLVIDMPLPISLGVNIPIDI

SEQ ID NO: 1533630 - protein, 21 aa, Mycobacterium tuberculosis
VIIAGFPFLDLGNVTIGGFNL

SEQ ID NO: 1533631 - protein, 26 aa, Mycobacterium tuberculosis
VLDVINAPALALLGRPLIGNGANGAP

SEQ ID NO: 1533632 - protein, 18 aa, Mycobacterium tuberculosis
VMAALREPGIGVIAEVKR

SEQ ID NO: 1533633 - protein, 22 aa, Mycobacterium tuberculosis
VTAAQPYLAWLTYTAEAAAHAG

SEQ ID NO: 1533634 - protein, 28 aa, Mycobacterium tuberculosis
VVGCSMRLPFLYAPLPYGGTLHVDGGVL

SEQ ID NO: 1533635 - protein, 20 aa, Mycobacterium tuberculosis
VVPFLHPDLVWDFRLPRVVS

SEQ ID NO: 1533636 - protein, 21 aa, Mycobacterium tuberculosis
WAYYPWRRMVVAILGPRGFRA

SEQ ID NO: 1533637 - protein, 24 aa, Mycobacterium tuberculosis
WRNGIWYTARLRPGPLRPAERRTA

SEQ ID NO: 1533638 - protein, 17 aa, Mycobacterium tuberculosis
YLGFTQWALLHDPPPEL

SEQ ID NO: 1533639 - protein, 27 aa, Mycobacterium tuberculosis
YLLAVGDLLIGWRLLVLAGVAHAALAD

SEQ ID NO: 1533640 - protein, 20 aa, Mycobacterium tuberculosis
YLPRFLFGVFLSEQMIAAIA

SEQ ID NO: 1533641 - protein, 27 aa, Mycobacterium tuberculosis
YSTFLHRAFDQLLFDIGLHRLPVTLVL

SEQ ID NO: 1533642 - protein, 18 aa, Mycobacterium tuberculosis
AAALAFPSLSSSVPILGP

SEQ ID NO: 1533643 - protein, 19 aa, Mycobacterium tuberculosis
AAFLEYLDMFYNLGIAGRA

SEQ ID NO: 1533644 - protein, 25 aa, Mycobacterium tuberculosis
AAQLSSWSIGLQQALPAAPSALAAA

SEQ ID NO: 1533645 - protein, 29 aa, Mycobacterium tuberculosis
AAQVAAFHSRFVQALTAGAGAYAFAEAAN

SEQ ID NO: 1533646 - protein, 22 aa, Mycobacterium tuberculosis
AASAFAMWFPIEGGSKYGGYGR

SEQ ID NO: 1533647 - protein, 24 aa, Mycobacterium tuberculosis
AASIGAYLWVPDILECLASVMADA

SEQ ID NO: 1533648 - protein, 20 aa, Mycobacterium tuberculosis
AGARGALTSGGLAGGVGAGG

SEQ ID NO: 1533649 - protein, 20 aa, Mycobacterium tuberculosis
AHGTLFSSLAGTGGTGGNGG

SEQ ID NO: 1533650 - protein, 25 aa, Mycobacterium tuberculosis
AKGLQFPIVYLPFAFNRNVRSDDIL

SEQ ID NO: 1533651 - protein, 20 aa, Mycobacterium tuberculosis
APTQTLLGRPLIGNGADGVA

SEQ ID NO: 1533652 - protein, 18 aa, Mycobacterium tuberculosis
AVGYLMPALGRPNLTLLA

SEQ ID NO: 1533653 - protein, 18 aa, Mycobacterium tuberculosis
AWTTGLIRWEDDPQPGWY

SEQ ID NO: 1533654 - protein, 17 aa, Mycobacterium tuberculosis
DAMLLVRLPYHLSSVTQ

SEQ ID NO: 1533655 - protein, 21 aa, Mycobacterium tuberculosis
DAVNVVFMPTEPQAATGTAGS

SEQ ID NO: 1533656 - protein, 18 aa, Mycobacterium tuberculosis
DHFEFFVFPYADKALTRT

SEQ ID NO: 1533657 - protein, 19 aa, Mycobacterium tuberculosis
DLLFIGCTPIVWAGPIANW

SEQ ID NO: 1533658 - protein, 21 aa, Mycobacterium tuberculosis
DNALLLRAYAHWARRTGDPLA

SEQ ID NO: 1533659 - protein, 24 aa, Mycobacterium tuberculosis
EAFQFYFELLLFDYPTHIVQIVEA

SEQ ID NO: 1533660 - protein, 20 aa, Mycobacterium tuberculosis
EEVAPWLDLVRKLGVLAGVL

SEQ ID NO: 1533661 - protein, 18 aa, Mycobacterium tuberculosis
EFFVFPYADKALTRTMHR

SEQ ID NO: 1533662 - protein, 24 aa, Mycobacterium tuberculosis
EIPIKLRVSVCVIYIPFKGCVKHV

SEQ ID NO: 1533663 - protein, 19 aa, Mycobacterium tuberculosis
ERLGLWGLMPRTVYDTLIW

SEQ ID NO: 1533664 - protein, 23 aa, Mycobacterium tuberculosis
ETWERLWPELGLLALPQSPRGTP

SEQ ID NO: 1533665 - protein, 20 aa, Mycobacterium tuberculosis
EVSTAVAALFSQHAQGYQAA

SEQ ID NO: 1533666 - protein, 19 aa, Mycobacterium tuberculosis
EVYRLRQPVLLIWGREDRV

SEQ ID NO: 1533667 - protein, 31 aa, Mycobacterium tuberculosis
FGMVQFQKFFNPVTPFNPDLIPKSALGAGLG

SEQ ID NO: 1533668 - protein, 18 aa, Mycobacterium tuberculosis
FPSYFLIVADLISYARSA

SEQ ID NO: 1533669 - protein, 19 aa, Mycobacterium tuberculosis
FPYAWPRMPILATNVVCTS

SEQ ID NO: 1533670 - protein, 22 aa, Mycobacterium tuberculosis
FVRRQRAWLRTRASRQPRETPA

SEQ ID NO: 1533671 - protein, 17 aa, Mycobacterium tuberculosis
FWCQLFSEPGAGSDLAS

SEQ ID NO: 1533672 - protein, 24 aa, Mycobacterium tuberculosis
GAGAWAMWGWVTPAAAAGGWPTWV

SEQ ID NO: 1533673 - protein, 25 aa, Mycobacterium tuberculosis
GAGTLLGLTVFGDNGGAGVLGDSTD

SEQ ID NO: 1533674 - protein, 24 aa, Mycobacterium tuberculosis
GAGYADMTAIFLGSSGTPGEDGGN

SEQ ID NO: 1533675 - protein, 29 aa, Mycobacterium tuberculosis
GAVSASAQTLLSRPLIGNGANATTPGGNG

SEQ ID NO: 1533676 - protein, 23 aa, Mycobacterium tuberculosis
GGAGGSGFFGGKGGFGGDGGQGG

SEQ ID NO: 1533677 - protein, 22 aa, Mycobacterium tuberculosis
GGDGGWLFGSGGNGAPGAAGQS

SEQ ID NO: 1533678 - protein, 21 aa, Mycobacterium tuberculosis
GGNGALLIGAGGVGGAGGIGG

SEQ ID NO: 1533679 - protein, 19 aa, Mycobacterium tuberculosis
GGRLPITLWIVDTNASTPA

SEQ ID NO: 1533680 - protein, 26 aa, Mycobacterium tuberculosis
GKGADPGGLFPIPGAGGKGGTGGTGG

SEQ ID NO: 1533681 - protein, 23 aa, Mycobacterium tuberculosis
GLAQMIELWPLRPDVRTLLCSSV

SEQ ID NO: 1533682 - protein, 17 aa, Mycobacterium tuberculosis
GLFEVLAAGGAGGTGGL

SEQ ID NO: 1533683 - protein, 17 aa, Mycobacterium tuberculosis
GLLGFSYRPAVLPQTPF

SEQ ID NO: 1533684 - protein, 29 aa, Mycobacterium tuberculosis
GMVQFQKFFNPVTPFNPDLIPKSALGAGL

SEQ ID NO: 1533685 - protein, 24 aa, Mycobacterium tuberculosis
GNGGNGGWLFGAGGTGGIGGTGAP

SEQ ID NO: 1533686 - protein, 18 aa, Mycobacterium tuberculosis
GPGGILYGNGGNGGSGAP

SEQ ID NO: 1533687 - protein, 26 aa, Mycobacterium tuberculosis
GRAYSPRFLWMWPNARISVIGGEQAA

SEQ ID NO: 1533688 - protein, 18 aa, Mycobacterium tuberculosis
GRSGLFEVLAAGGAGGTG

SEQ ID NO: 1533689 - protein, 26 aa, Mycobacterium tuberculosis
GTPGSPMVAPPPPTPITQVQQGGDGG

SEQ ID NO: 1533690 - protein, 19 aa, Mycobacterium tuberculosis
GTRWYGYFLRRLAERPANL

SEQ ID NO: 1533691 - protein, 25 aa, Mycobacterium tuberculosis
GVGPITVLPIQILPTIPLNIHQTFS

SEQ ID NO: 1533692 - protein, 17 aa, Mycobacterium tuberculosis
HFIADPASRFYNLVLAD

SEQ ID NO: 1533693 - protein, 22 aa, Mycobacterium tuberculosis
HGGAGGWLYGNGGAGGFGGAGA

SEQ ID NO: 1533694 - protein, 22 aa, Mycobacterium tuberculosis
IDLTIRWDTPPITLFPNGISAP

SEQ ID NO: 1533695 - protein, 21 aa, Mycobacterium tuberculosis
IVVRPIGFEPLQWVRALAAED

SEQ ID NO: 1533696 - protein, 17 aa, Mycobacterium tuberculosis
KHWQKLCYLIGRPDLVE

SEQ ID NO: 1533697 - protein, 20 aa, Mycobacterium tuberculosis
KLVRHHLLLPITATRRDLND

SEQ ID NO: 1533698 - protein, 17 aa, Mycobacterium tuberculosis
KNLLPMLAVFKPTVVVS

SEQ ID NO: 1533699 - protein, 27 aa, Mycobacterium tuberculosis
LAAVNAPAQALLGRPLIGNGANGAPGT

SEQ ID NO: 1533700 - protein, 24 aa, Mycobacterium tuberculosis
LDALALLHRLSLKSPVRHFVLFSS

SEQ ID NO: 1533701 - protein, 27 aa, Mycobacterium tuberculosis
LDVVNGPTQLLLGRPLIGDGANGGPGQ

SEQ ID NO: 1533702 - protein, 23 aa, Mycobacterium tuberculosis
LEFIQFHPTMLFAGRAGGRRPLI

SEQ ID NO: 1533703 - protein, 17 aa, Mycobacterium tuberculosis
LFIMGRIKDLLIVDGRN

SEQ ID NO: 1533704 - protein, 26 aa, Mycobacterium tuberculosis
LGAINAPTMALLGRPLIGHGADGAPG

SEQ ID NO: 1533705 - protein, 24 aa, Mycobacterium tuberculosis
LGGKGGSGGLIGRAGSDGGVGAGG

SEQ ID NO: 1533706 - protein, 26 aa, Mycobacterium tuberculosis
LGLINGPAQTLLGRPLIGNGADGAPG

SEQ ID NO: 1533707 - protein, 28 aa, Mycobacterium tuberculosis
LLAAVNAPTQALFGRPLIGNGADGSPGT

SEQ ID NO: 1533708 - protein, 19 aa, Mycobacterium tuberculosis
LLKLPIPVQRRVAAGVLSA

SEQ ID NO: 1533709 - protein, 26 aa, Mycobacterium tuberculosis
LLRSWYILYFQLPWLPERSASWVVPL

SEQ ID NO: 1533710 - protein, 17 aa, Mycobacterium tuberculosis
LPADSHLLLLWGAANRD

SEQ ID NO: 1533711 - protein, 23 aa, Mycobacterium tuberculosis
LQSVLYLRFREWFLPAIHRKYGD

SEQ ID NO: 1533712 - protein, 18 aa, Mycobacterium tuberculosis
LRDWLLMRAWEAGVTPIG

SEQ ID NO: 1533713 - protein, 17 aa, Mycobacterium tuberculosis
LTTLFPPVRPRQWLEIR

SEQ ID NO: 1533714 - protein, 23 aa, Mycobacterium tuberculosis
LTVSRLLAPILTPVIYRAAMAAR

SEQ ID NO: 1533715 - protein, 17 aa, Mycobacterium tuberculosis
LVAIMPWEGHNYEDAII

SEQ ID NO: 1533716 - protein, 25 aa, Mycobacterium tuberculosis
LVGLNLVIDMPLPISLGVNIPIDIP

SEQ ID NO: 1533717 - protein, 25 aa, Mycobacterium tuberculosis
LVPVNHLPLTLPLRYLGMSDAEVDQ

SEQ ID NO: 1533718 - protein, 17 aa, Mycobacterium tuberculosis
LWGLMPRTVYDTLIWCI

SEQ ID NO: 1533719 - protein, 17 aa, Mycobacterium tuberculosis
NFTIPIIGFESFAFSFH

SEQ ID NO: 1533720 - protein, 19 aa, Mycobacterium tuberculosis
NGGTGWNGGKGDTGSGGGA

SEQ ID NO: 1533721 - protein, 17 aa, Mycobacterium tuberculosis
NPLQWVPVPPGRLVLQT

SEQ ID NO: 1533722 - protein, 19 aa, Mycobacterium tuberculosis
NRPGYLRFDFNWQGPLTDD

SEQ ID NO: 1533723 - protein, 17 aa, Mycobacterium tuberculosis
PDALLTWATYRAPFLAA

SEQ ID NO: 1533724 - protein, 19 aa, Mycobacterium tuberculosis
PDMTLFLDLKQTPPQPLVS

SEQ ID NO: 1533725 - protein, 22 aa, Mycobacterium tuberculosis
PGGGHGLLGLGGSHGAGGAGGS

SEQ ID NO: 1533726 - protein, 21 aa, Mycobacterium tuberculosis
PGGPGGLLYGNGGHGGAGAAG

SEQ ID NO: 1533727 - protein, 17 aa, Mycobacterium tuberculosis
PLILRLDPKIGLPDIRA

SEQ ID NO: 1533728 - protein, 17 aa, Mycobacterium tuberculosis
PLMIALISYAVGGPIRM

SEQ ID NO: 1533729 - protein, 17 aa, Mycobacterium tuberculosis
PPLSWFLGNSPPPLLNS

SEQ ID NO: 1533730 - protein, 17 aa, Mycobacterium tuberculosis
PRSLHWLRPITPTFRPS

SEQ ID NO: 1533731 - protein, 22 aa, Mycobacterium tuberculosis
PVNNVEFFFLRPKDIAIYVGSG

SEQ ID NO: 1533732 - protein, 25 aa, Mycobacterium tuberculosis
QGSARWRRWLLLLALVGAGDQRRPA

SEQ ID NO: 1533733 - protein, 20 aa, Mycobacterium tuberculosis
QLFGYLVWRDTKAAILLFIR

SEQ ID NO: 1533734 - protein, 21 aa, Mycobacterium tuberculosis
QLRFTAPPRLDLSLLASALPE

SEQ ID NO: 1533735 - protein, 20 aa, Mycobacterium tuberculosis
QPILAPLTPAAIFLVATIGA

SEQ ID NO: 1533736 - protein, 32 aa, Mycobacterium tuberculosis; identical to SEQ ID NO: 227962

SEQ ID NO: 1533737 - protein, 24 aa, Mycobacterium tuberculosis
REGVNLTFLPFFAKAVIDALKIHP

SEQ ID NO: 1533738 - protein, 21 aa, Mycobacterium tuberculosis
REIHLTLIPFALRPTAEVPTT

SEQ ID NO: 1533739 - protein, 21 aa, Mycobacterium tuberculosis
REPLWVPSPTDRRLRHACALI

SEQ ID NO: 1533740 - protein, 18 aa, Mycobacterium tuberculosis
RERLGFGELRWALSGAAP

SEQ ID NO: 1533741 - protein, 21 aa, Mycobacterium tuberculosis
RGYVLRRLLRRVIRSAKLLGI

SEQ ID NO: 1533742 - protein, 17 aa, Mycobacterium tuberculosis
RINALWSLRPVLPMPGR

SEQ ID NO: 1533743 - protein, 19 aa, Mycobacterium tuberculosis
RLRLPWWHLWRAAEAAGAA

SEQ ID NO: 1533744 - protein, 22 aa, Mycobacterium tuberculosis
RPDIPIHYLLADTFTICDQYFS

SEQ ID NO: 1533745 - protein, 21 aa, Mycobacterium tuberculosis
RSGDVWLLNGFKWFASNCAGE

SEQ ID NO: 1533746 - protein, 23 aa, Mycobacterium tuberculosis
RVGWRWRLVWYRAVAELLTGDYD

SEQ ID NO: 1533747 - protein, 20 aa, Mycobacterium tuberculosis
RWAGVPFYLRTGKRLGRRVT

SEQ ID NO: 1533748 - protein, 17 aa, Mycobacterium tuberculosis
SAPRPAPFRLRVVKRHT

SEQ ID NO: 1533749 - protein, 21 aa, Mycobacterium tuberculosis
SKGLPGLGRLGNPGLDGGTGG

SEQ ID NO: 1533750 - protein, 23 aa, Mycobacterium tuberculosis
SLQLRWPLRMLLGGKPLQHIAAD

SEQ ID NO: 1533751 - protein, 18 aa, Mycobacterium tuberculosis
SPAPALLALPAAESAWRL

SEQ ID NO: 1533752 - protein, 20 aa, Mycobacterium tuberculosis
SPIVGIWHSGGARLAEGVRA

SEQ ID NO: 1533753 - protein, 24 aa, Mycobacterium tuberculosis
SRPLITNMIRLLKLPIPVQRRVAA

SEQ ID NO: 1533754 - protein, 27 aa, Mycobacterium tuberculosis
STLLESFLFYSGFYLPMYWSSRAKLTN

SEQ ID NO: 1533755 - protein, 21 aa, Mycobacterium tuberculosis
STWARQLPWLTLLGAVYTYDA

SEQ ID NO: 1533756 - protein, 17 aa, Mycobacterium tuberculosis
TARDLHLLLPDPYTFPS

SEQ ID NO: 1533757 - protein, 19 aa, Mycobacterium tuberculosis
TFVNQLPFPTFSLGKITIP

SEQ ID NO: 1533758 - protein, 22 aa, Mycobacterium tuberculosis
TGARWLCETFPTCLERGAGIPA

SEQ ID NO: 1533759 - protein, 28 aa, Mycobacterium tuberculosis
TGGTAHLGPLAIIGQSGQPGQFGSPGAD

SEQ ID NO: 1533760 - protein, 23 aa, Mycobacterium tuberculosis
TLGFTIPGFTIPAAPLPLTIDID

SEQ ID NO: 1533761 - protein, 19 aa, Mycobacterium tuberculosis
TPFMGMAPLLINYIPQQLA

SEQ ID NO: 1533762 - protein, 20 aa, Mycobacterium tuberculosis
TTNPPVEGAFYWLNNREVRW

SEQ ID NO: 1533763 - protein, 25 aa, Mycobacterium tuberculosis
TVNVDGFWMLQALLDIRHVAPELRC

SEQ ID NO: 1533764 - protein, 21 aa, Mycobacterium tuberculosis
TVTPVMLLLWIRGVRFMYSVD

SEQ ID NO: 1533765 - protein, 18 aa, Mycobacterium tuberculosis
VAAHAPYLAWLMRASETS

SEQ ID NO: 1533766 - protein, 18 aa, Mycobacterium tuberculosis
VATDLKRIGASLAHENAS

SEQ ID NO: 1533767 - protein, 19 aa, Mycobacterium tuberculosis
VIFFGPVDIDPFTVPVIRI

SEQ ID NO: 1533768 - protein, 18 aa, Mycobacterium tuberculosis
VPTRLALVRRLGSIELDL

SEQ ID NO: 1533769 - protein, 20 aa, Mycobacterium tuberculosis
VRSPVYLVLAARRRCVSGCA

SEQ ID NO: 1533770 - protein, 17 aa, Mycobacterium tuberculosis
VTPVMLLLWIRGVRFMY

SEQ ID NO: 1533771 - protein, 25 aa, Mycobacterium tuberculosis
WKCWARWRLIRARAPWLTRALVAED

SEQ ID NO: 1533772 - protein, 25 aa, Mycobacterium tuberculosis
WMHIGIDLFWFALPPEQLDLARVRP

SEQ ID NO: 1533773 - protein, 17 aa, Mycobacterium tuberculosis
YGFFWITAVTTDGSIVV

SEQ ID NO: 1533774 - protein, 18 aa, Mycobacterium tuberculosis
YGYFLRRLAERPANLAFF

SEQ ID NO: 1533775 - protein, 18 aa, Mycobacterium tuberculosis
YVAQLHVWARREHPTYED

SEQ ID NO: 1533776 - protein, 18 aa, Mycobacterium tuberculosis
AAAPYAGWLAAAAARAAG

SEQ ID NO: 1533777 - protein, 25 aa, Mycobacterium tuberculosis
AAINAPTQALLGRPLIGNGADGAPG

SEQ ID NO: 1533778 - protein, 19 aa, Mycobacterium tuberculosis
AAVAPYLGWLAAAAAQAQR

SEQ ID NO: 1533779 - protein, 19 aa, Mycobacterium tuberculosis
AAVSGLVTALFGAPGQPGD

SEQ ID NO: 1533780 - protein, 20 aa, Mycobacterium tuberculosis
AEFLVRWLTTGWPRQVAEAL

SEQ ID NO: 1533781 - protein, 18 aa, Mycobacterium tuberculosis
AFHQQFVRALSSAAGSYA

SEQ ID NO: 1533782 - protein, 19 aa, Mycobacterium tuberculosis
AFHQQFVRALSSAAGSYAA

SEQ ID NO: 1533783 - protein, 19 aa, Mycobacterium tuberculosis
AFVQLVLSNLFGQNAPAIA

SEQ ID NO: 1533784 - protein, 17 aa, Mycobacterium tuberculosis
AGDLLFIGCTPIVWAGP

SEQ ID NO: 1533785 - protein, 20 aa, Mycobacterium tuberculosis
AGGAGGILWGNGGAGGSGAP

SEQ ID NO: 1533786 - protein, 17 aa, Mycobacterium tuberculosis
AGGNGAWLFGNGGAGGG

SEQ ID NO: 1533787 - protein, 17 aa, Mycobacterium tuberculosis
AGGSGGWLLGNGGVGGA

SEQ ID NO: 1533788 - protein, 23 aa, Mycobacterium tuberculosis
AGPPQRWFVVWLGTANNPVDKGA

SEQ ID NO: 1533789 - protein, 17 aa, Mycobacterium tuberculosis
AGQPLDRPFAWALIKLD

SEQ ID NO: 1533790 - protein, 23 aa, Mycobacterium tuberculosis
AKAAPLWRVLVALSIRHVGPTAA

SEQ ID NO: 1533791 - protein, 18 aa, Mycobacterium tuberculosis
ALALLKRGLPGDTALVTG

SEQ ID NO: 1533792 - protein, 19 aa, Mycobacterium tuberculosis
ALDPLAGSIGLFLEPFRLS

SEQ ID NO: 1533793 - protein, 17 aa, Mycobacterium tuberculosis
AMRPLRHTLSQLRLHEL

SEQ ID NO: 1533794 - protein, 19 aa, Mycobacterium tuberculosis
APAQALFGRPLIGNGANGT

SEQ ID NO: 1533795 - protein, 24 aa, Mycobacterium tuberculosis
ASPAGWLFVSRWTAGGNSLHIRAG

SEQ ID NO: 1533796 - protein, 22 aa, Mycobacterium tuberculosis
ATRRKIFIPILRVAAIEPHAVT

SEQ ID NO: 1533797 - protein, 18 aa, Mycobacterium tuberculosis
AVDPLLPEVAWSWLVDAL

SEQ ID NO: 1533798 - protein, 20 aa, Mycobacterium tuberculosis
AVGYLMPALGRPNLTLLART

SEQ ID NO: 1533799 - protein, 24 aa, Mycobacterium tuberculosis
AVRGPNFLGWIHPAATATAPARTE

SEQ ID NO: 1533800 - protein, 20 aa, Mycobacterium tuberculosis
CDYALLAVPYLTLRELAKSA

SEQ ID NO: 1533801 - protein, 17 aa, Mycobacterium tuberculosis
CYDIRFPALYTELARRG

SEQ ID NO: 1533802 - protein, 20 aa, Mycobacterium tuberculosis
DDVFRAWWDLAGNRAGPPSI

SEQ ID NO: 1533803 - protein, 17 aa, Mycobacterium tuberculosis
DFATGLMPLRWGTGFML

SEQ ID NO: 1533804 - protein, 18 aa, Mycobacterium tuberculosis
DFAYHQFLIKKSKMPSQT

SEQ ID NO: 1533805 - protein, 23 aa, Mycobacterium tuberculosis
DGSDAMRWFLMASPILRGGNLIV

SEQ ID NO: 1533806 - protein, 18 aa, Mycobacterium tuberculosis
DLYLIHWPAPPVGKYVDA

SEQ ID NO: 1533807 - protein, 25 aa, Mycobacterium tuberculosis
DLYLNRDCGIGKFIWERVVEELKLE

SEQ ID NO: 1533808 - protein, 18 aa, Mycobacterium tuberculosis
DNFTIPIIGFESFAFSFH

SEQ ID NO: 1533809 - protein, 17 aa, Mycobacterium tuberculosis
DPDVRLLFSLGLRAMER

SEQ ID NO: 1533810 - protein, 20 aa, Mycobacterium tuberculosis
DPLRLIYFADADPVFALCEH

SEQ ID NO: 1533811 - protein, 23 aa, Mycobacterium tuberculosis
DQALTLLDLLGNPALWSNSLHWA

SEQ ID NO: 1533812 - protein, 17 aa, Mycobacterium tuberculosis
DVPLLGQIPLDPALVAA

SEQ ID NO: 1533813 - protein, 19 aa, Mycobacterium tuberculosis
DYALLAVPYLTLRELAKSA

SEQ ID NO: 1533814 - protein, 23 aa, Mycobacterium tuberculosis
EAFQFYFELLLFDYPTHIVQIVE

SEQ ID NO: 1533815 - protein, 22 aa, Mycobacterium tuberculosis
EIYVPFSWFEPMWLENLGFARE

SEQ ID NO: 1533816 - protein, 20 aa, Mycobacterium tuberculosis
ELAWALLTNSLAAGGYGLDP

SEQ ID NO: 1533817 - protein, 18 aa, Mycobacterium tuberculosis
ERADWWWYEPFQPQPPPI

SEQ ID NO: 1533818 - protein, 17 aa, Mycobacterium tuberculosis
FAAPYLRDSLLAAGALC

SEQ ID NO: 1533819 - protein, 19 aa, Mycobacterium tuberculosis
FDVINAPTLALLNRPLIGN

SEQ ID NO: 1533820 - protein, 22 aa, Mycobacterium tuberculosis
FGEKVLPLYLPSGDGLIGLLSQ

SEQ ID NO: 1533821 - protein, 17 aa, Mycobacterium tuberculosis
FLHPDLVWDFRLPRVVS

SEQ ID NO: 1533822 - protein, 22 aa, Mycobacterium tuberculosis
FSNGILWRGNFEGLFGLNVGIT

SEQ ID NO: 1533823 - protein, 18 aa, Mycobacterium tuberculosis
FVNQLPFPTFSLGKITIP

SEQ ID NO: 1533824 - protein, 17 aa, Mycobacterium tuberculosis
FVQLVLSNLFGQNAPAI

SEQ ID NO: 1533825 - protein, 17 aa, Mycobacterium tuberculosis
FYSGFYLPMYWSSRGKL

SEQ ID NO: 1533826 - protein, 18 aa, Mycobacterium tuberculosis
GAGGLLFGNGGNGAAGAV

SEQ ID NO: 1533827 - protein, 21 aa, Mycobacterium tuberculosis
GATGTLTFFGSGGDGGPGGAG

SEQ ID NO: 1533828 - protein, 19 aa, Mycobacterium tuberculosis
GFGAPPPRSIGGGDGGDGG

SEQ ID NO: 1533829 - protein, 20 aa, Mycobacterium tuberculosis
GFRFPEITGDIFLIGIPFNA

SEQ ID NO: 1533830 - protein, 20 aa, Mycobacterium tuberculosis
GGAAGLFGIGGAGGAGGAGA

SEQ ID NO: 1533831 - protein, 22 aa, Mycobacterium tuberculosis
GGIGGLLLGLDGANAPASTNPL

SEQ ID NO: 1533832 - protein, 23 aa, Mycobacterium tuberculosis
GGSAGLLGYVGRAGDGGAGGGGG

SEQ ID NO: 1533833 - protein, 17 aa, Mycobacterium tuberculosis
GGWIPPHVRLPANVTLL

SEQ ID NO: 1533834 - protein, 20 aa, Mycobacterium tuberculosis
GHGGWLWGNGGVGGSGGAGV

SEQ ID NO: 1533835 - protein, 20 aa, Mycobacterium tuberculosis
GITMRPYLVGSLKGPDLANI

SEQ ID NO: 1533836 - protein, 24 aa, Mycobacterium tuberculosis
GKYLVVMLELWLPLEAAAGDLDKP

SEQ ID NO: 1533837 - protein, 19 aa, Mycobacterium tuberculosis
GLRVVPWLWGAPPTDRRYY

SEQ ID NO: 1533838 - protein, 24 aa, Mycobacterium tuberculosis
GNGGRGGWLLGNGGAGGVGGVGGA

SEQ ID NO: 1533839 - protein, 25 aa, Mycobacterium tuberculosis
GNYSNGFFWRGDYQGLIGFSGTLTI

SEQ ID NO: 1533840 - protein, 17 aa, Mycobacterium tuberculosis
GPITIPIIDIPAAPGIG

SEQ ID NO: 1533841 - protein, 22 aa, Mycobacterium tuberculosis
GPRTALWLLLAKCGGDTEVSAQ

SEQ ID NO: 1533842 - protein, 30 aa, Mycobacterium tuberculosis; identical to SEQ ID NO: 237891

SEQ ID NO: 1533843 - protein, 18 aa, Mycobacterium tuberculosis
GQPGGAGGLLFGNGGNGA

SEQ ID NO: 1533844 - protein, 20 aa, Mycobacterium tuberculosis
GRCRVPLILRLDPKIGLPDI

SEQ ID NO: 1533845 - protein, 22 aa, Mycobacterium tuberculosis
GSGGFGAPPPRSIGGGDGGDGG

SEQ ID NO: 1533846 - protein, 26 aa, Mycobacterium tuberculosis
GSSSLVIPFWKIGWQNLGLPTGFDVV

SEQ ID NO: 1533847 - protein, 19 aa, Mycobacterium tuberculosis
GTGGLLFGAGGNGGPGGSG

SEQ ID NO: 1533848 - protein, 18 aa, Mycobacterium tuberculosis
GTGGNGGLLLGFNGTNGL

SEQ ID NO: 1533849 - protein, 18 aa, Mycobacterium tuberculosis
GVMWACVFMRTGARRVHF

SEQ ID NO: 1533850 - protein, 19 aa, Mycobacterium tuberculosis
GWRRLLLKQILECVLRRFP

SEQ ID NO: 1533851 - protein, 19 aa, Mycobacterium tuberculosis
GYSWGPLSLMLLATAIAQQ

SEQ ID NO: 1533852 - protein, 27 aa, Mycobacterium tuberculosis
HILTLSPPILLEKKWLRPTAYMMAKYG

SEQ ID NO: 1533853 - protein, 17 aa, Mycobacterium tuberculosis
HLRVQPGCDAWCLAALA

SEQ ID NO: 1533854 - protein, 20 aa, Mycobacterium tuberculosis
IDAVLPMFFEFAGDSVLVAH

SEQ ID NO: 1533855 - protein, 17 aa, Mycobacterium tuberculosis
IDERLVVVGLDKTVTYK

SEQ ID NO: 1533856 - protein, 26 aa, Mycobacterium tuberculosis
IFVTGVMSSGFFNFGTGNSGLLVSGN

SEQ ID NO: 1533857 - protein, 17 aa, Mycobacterium tuberculosis
IFVYQLYLWDMRFRARH

SEQ ID NO: 1533858 - protein, 17 aa, Mycobacterium tuberculosis
IPEFPIHWTSTGGIGPI

SEQ ID NO: 1533859 - protein, 21 aa, Mycobacterium tuberculosis
IPRVRRRWWHCIWRCSHCASA

SEQ ID NO: 1533860 - protein, 23 aa, Mycobacterium tuberculosis
IREPLWVPSPTDRRLRHACALIA

SEQ ID NO: 1533861 - protein, 25 aa, Mycobacterium tuberculosis
ISTQVAAFHDRFAQTLSAAVGSYVS

SEQ ID NO: 1533862 - protein, 20 aa, Mycobacterium tuberculosis
IYDKWLTLGPLIDQFGMTTK

SEQ ID NO: 1533863 - protein, 19 aa, Mycobacterium tuberculosis
KAQIYAWRKGIKTLYYIRL

SEQ ID NO: 1533864 - protein, 17 aa, Mycobacterium tuberculosis
LAPILTPVIYRAAMAAR

SEQ ID NO: 1533865 - protein, 18 aa, Mycobacterium tuberculosis
LDPHWLLDTLGLTEAARA

SEQ ID NO: 1533866 - protein, 26 aa, Mycobacterium tuberculosis
LDVVNGPTQLLLGRPLIGDGANGGPG

SEQ ID NO: 1533867 - protein, 20 aa, Mycobacterium tuberculosis
LFVFRPLLNLALRRFLRNLR

SEQ ID NO: 1533868 - protein, 29 aa, Mycobacterium tuberculosis
LGAVNAPTQTLLGRPLIGDGAHGTAPGQP

SEQ ID NO: 1533869 - protein, 18 aa, Mycobacterium tuberculosis
LHQVVIGNELPLPPVRSA

SEQ ID NO: 1533870 - protein, 18 aa, Mycobacterium tuberculosis
LLNRLWPLVSLRCNFFTP

SEQ ID NO: 1533871 - protein, 20 aa, Mycobacterium tuberculosis
LMSPMSFLRRPARWMQLLAT

SEQ ID NO: 1533872 - protein, 28 aa, Mycobacterium tuberculosis
LNALNAPTQALLGRPLIGDGAAGAPGTG

SEQ ID NO: 1533873 - protein, 17 aa, Mycobacterium tuberculosis
LTPVLVAAGIDLLVIQG

SEQ ID NO: 1533874 - protein, 19 aa, Mycobacterium tuberculosis
LVDAPLPAWTHARLFIDDD

SEQ ID NO: 1533875 - protein, 19 aa, Mycobacterium tuberculosis
LVIDMPLPISLGVNIPIDI

SEQ ID NO: 1533876 - protein, 29 aa, Mycobacterium tuberculosis
LWHAVPCFPTISELWLRLLESYRDSFYLL

SEQ ID NO: 1533877 - protein, 23 aa, Mycobacterium tuberculosis
MAAAVAPYLGWLAAAAAQAQRSA

SEQ ID NO: 1533878 - protein, 17 aa, Mycobacterium tuberculosis
MFTYRLLQQARSDLMRI

SEQ ID NO: 1533879 - protein, 20 aa, Mycobacterium tuberculosis
NALLLRAYAHWARRTGDPLA

SEQ ID NO: 1533880 - protein, 22 aa, Mycobacterium tuberculosis
NCEIVPWCRFARKNYFYPDMPK

SEQ ID NO: 1533881 - protein, 17 aa, Mycobacterium tuberculosis
NNTGIFVTGVMSSGFFN

SEQ ID NO: 1533882 - protein, 25 aa, Mycobacterium tuberculosis
NRRSKFPYRWWWVALTDEAFPRLSV

SEQ ID NO: 1533883 - protein, 20 aa, Mycobacterium tuberculosis
NYSNGFFWRGDYQGLIGFSG

SEQ ID NO: 1533884 - protein, 22 aa, Mycobacterium tuberculosis
PARPVIIGPITFLLLSKAVDGA

SEQ ID NO: 1533885 - protein, 22 aa, Mycobacterium tuberculosis
PDETWLALQPFLAPAGITRVAD

SEQ ID NO: 1533886 - protein, 18 aa, Mycobacterium tuberculosis
PDGTPFPTLYYLTHPVLT

SEQ ID NO: 1533887 - protein, 21 aa, Mycobacterium tuberculosis
PLLPEVAWSWLVDALTARTDQ

SEQ ID NO: 1533888 - protein, 19 aa, Mycobacterium tuberculosis
PRHTPPHAWYIAFAPAQAP

SEQ ID NO: 1533889 - protein, 22 aa, Mycobacterium tuberculosis
PSDYHLELAWPGRVWYQDYFAV

SEQ ID NO: 1533890 - protein, 23 aa, Mycobacterium tuberculosis
PSTPVSWLPFYHDMGLMLGIILP

SEQ ID NO: 1533891 - protein, 17 aa, Mycobacterium tuberculosis
PTIDAVLPMFFEFAGDS

SEQ ID NO: 1533892 - protein, 17 aa, Mycobacterium tuberculosis
PTSVPAFRPGAQFKAVV

SEQ ID NO: 1533893 - protein, 17 aa, Mycobacterium tuberculosis
PVRRLLRRLLGPTDPVL

SEQ ID NO: 1533894 - protein, 21 aa, Mycobacterium tuberculosis
PYAGPPMWFHGDLSRFNILTA

SEQ ID NO: 1533895 - protein, 23 aa, Mycobacterium tuberculosis
QAAVSGLVTALFGAPGQPGDTGQ

SEQ ID NO: 1533896 - protein, 18 aa, Mycobacterium tuberculosis
QAYLALRAWGLPVSEHTT

SEQ ID NO: 1533897 - protein, 22 aa, Mycobacterium tuberculosis
QGGFLIPAALDPAILLSGDGST

SEQ ID NO: 1533898 - protein, 24 aa, Mycobacterium tuberculosis
QGLIGLPLLGIPVTPGYFNLTGGP

SEQ ID NO: 1533899 - protein, 24 aa, Mycobacterium tuberculosis
QLALTELWCSYGVRPDLVIGHSMG

SEQ ID NO: 1533900 - protein, 21 aa, Mycobacterium tuberculosis
QVRGYTLRLPLDVLVVASANP

SEQ ID NO: 1533901 - protein, 18 aa, Mycobacterium tuberculosis
RASWRRAIWRWYRARYVS

SEQ ID NO: 1533902 - protein, 18 aa, Mycobacterium tuberculosis
RAYRLPWPDGTTVFELDR

SEQ ID NO: 1533903 - protein, 21 aa, Mycobacterium tuberculosis
RDYILELLLAHTSAGLPYERC

SEQ ID NO: 1533904 - protein, 17 aa, Mycobacterium tuberculosis
RMYLARYASSARPRLTP

SEQ ID NO: 1533905 - protein, 17 aa, Mycobacterium tuberculosis
RRLIATLPALEVPRPDW

SEQ ID NO: 1533906 - protein, 25 aa, Mycobacterium tuberculosis
RRVHFDLDPLLPFPRWHEHAAMVEE

SEQ ID NO: 1533907 - protein, 17 aa, Mycobacterium tuberculosis
RTGLLDKLLLLAGQPEE

SEQ ID NO: 1533908 - protein, 17 aa, Mycobacterium tuberculosis
RWWHCIWRCSHCASANA

SEQ ID NO: 1533909 - protein, 22 aa, Mycobacterium tuberculosis
RYTWPRFVCALPKEFFAAVRAE

SEQ ID NO: 1533910 - protein, 36 aa, Mycobacterium tuberculosis; identical to SEQ ID NO: 1519448

SEQ ID NO: 1533911 - protein, 17 aa, Mycobacterium tuberculosis
SCRPAIVVPAFLSRGYH

SEQ ID NO: 1533912 - protein, 20 aa, Mycobacterium tuberculosis
SDVLLPFLVTRQLICGAGKV

SEQ ID NO: 1533913 - protein, 23 aa, Mycobacterium tuberculosis
SFASLVFYSAWFKLHHPAAFCAA

SEQ ID NO: 1533914 - protein, 19 aa, Mycobacterium tuberculosis
SHIWAPWISSPPAITSCFW

SEQ ID NO: 1533915 - protein, 21 aa, Mycobacterium tuberculosis
SLEIFLTPQLPAPLIQIYGET

SEQ ID NO: 1533916 - protein, 36 aa, Mycobacterium tuberculosis
SPGAEASWVVGITWWSAVVGGFQMSFVIAVPETIAA

SEQ ID NO: 1533917 - protein, 18 aa, Mycobacterium tuberculosis
SRRFAYPPNLYVVDGGAP

SEQ ID NO: 1533918 - protein, 18 aa, Mycobacterium tuberculosis
SVPAFRPGAQFKAVVSGA

SEQ ID NO: 1533919 - protein, 23 aa, Mycobacterium tuberculosis
TEFTLLRYFVINAGTVLSKPKIL

SEQ ID NO: 1533920 - protein, 19 aa, Mycobacterium tuberculosis
TFPSWPLAHPFRRIAHNGE

SEQ ID NO: 1533921 - protein, 18 aa, Mycobacterium tuberculosis
TGGRGGWLAGAGGAGGAG

SEQ ID NO: 1533922 - protein, 26 aa, Mycobacterium tuberculosis
TGGSGGAGGLIGWAGAAGGTGAGGTG

SEQ ID NO: 1533923 - protein, 27 aa, Mycobacterium tuberculosis
TGGSGGAGGLIGWAGAAGGTGAGGTGG

SEQ ID NO: 1533924 - protein, 21 aa, Mycobacterium tuberculosis
TLLESFLFYSGFYLPMYWSSR

SEQ ID NO: 1533925 - protein, 20 aa, Mycobacterium tuberculosis
TPTQLLLGRPLIGNGANGAP

SEQ ID NO: 1533926 - protein, 23 aa, Mycobacterium tuberculosis
TQGGFLIPAALDPAILLSGDGST

SEQ ID NO: 1533927 - protein, 17 aa, Mycobacterium tuberculosis
VALFLRHLWSAGGSVRW

SEQ ID NO: 1533928 - protein, 18 aa, Mycobacterium tuberculosis
VARIVPLKRRRQWLPAAE

SEQ ID NO: 1533929 - protein, 23 aa, Mycobacterium tuberculosis
VAVADWLYWQYVTGLLDRALAAA

SEQ ID NO: 1533930 - protein, 18 aa, Mycobacterium tuberculosis
VDDFVLYWGFLALAQVRS

SEQ ID NO: 1533931 - protein, 19 aa, Mycobacterium tuberculosis
VFIGYLRRKLEAGGGPRLL

SEQ ID NO: 1533932 - protein, 17 aa, Mycobacterium tuberculosis
VGQLPLDFGASGLSAMS

SEQ ID NO: 1533933 - protein, 19 aa, Mycobacterium tuberculosis
VIAYRWLRVGRLPVPARRV

SEQ ID NO: 1533934 - protein, 21 aa, Mycobacterium tuberculosis
VIGAPWLVAFAERSRFFEVFS

SEQ ID NO: 1533935 - protein, 21 aa, Mycobacterium tuberculosis
VLAYPRVVWIAGGLLKGASLH

SEQ ID NO: 1533936 - protein, 17 aa, Mycobacterium tuberculosis
VPPSWTAAAPLASPLGS

SEQ ID NO: 1533937 - protein, 20 aa, Mycobacterium tuberculosis
VPVIDQDVRRWWRSDSLWQA

SEQ ID NO: 1533938 - protein, 22 aa, Mycobacterium tuberculosis
VPVNHLPLTLPLRYLGISDAEV

SEQ ID NO: 1533939 - protein, 28 aa, Mycobacterium tuberculosis
VSAQVATFHDRFVQTLSAAASSYVAAEA

SEQ ID NO: 1533940 - protein, 20 aa, Mycobacterium tuberculosis
WLVDAPLPAWTHARLFIDDD

SEQ ID NO: 1533941 - protein, 17 aa, Mycobacterium tuberculosis
YLTDLFPILELGTSAKM

SEQ ID NO: 1533942 - protein, 21 aa, Mycobacterium tuberculosis
YPGYKPTLPGLVGSALFADGA

SEQ ID NO: 1533943 - protein, 19 aa, Mycobacterium tuberculosis
YPTGRLINAPLPTWNHRRL

SEQ ID NO: 1533944 - protein, 23 aa, Mycobacterium tuberculosis
YSALYPAGWLVDAPLPAWTHARL

SEQ ID NO: 1533945 - protein, 21 aa, Mycobacterium tuberculosis
AAALPSWQQALRGLPGLGQVA

SEQ ID NO: 1533946 - protein, 19 aa, Mycobacterium tuberculosis
AAFHDRFAQTLSAAVGSYV

SEQ ID NO: 1533947 - protein, 23 aa, Mycobacterium tuberculosis
AAGGAGGRLFGNGGAGGNGGTAG

SEQ ID NO: 1533948 - protein, 25 aa, Mycobacterium tuberculosis
AAGGWPTWVWAISGWPTPAPATSGS

SEQ ID NO: 1533949 - protein, 24 aa, Mycobacterium tuberculosis
AAINAPTQALLGRPLIGNGADGAP

SEQ ID NO: 1533950 - protein, 18 aa, Mycobacterium tuberculosis
AAMQGLLALPLLAGYDIH

SEQ ID NO: 1533951 - protein, 19 aa, Mycobacterium tuberculosis
AAVPVLVHPAPRGVLGGLA

SEQ ID NO: 1533952 - protein, 22 aa, Mycobacterium tuberculosis
AAVQAPWPLLRTFAAGPALSRD

SEQ ID NO: 1533953 - protein, 17 aa, Mycobacterium tuberculosis
AAVSGLVTALFGAPGQP

SEQ ID NO: 1533954 - protein, 18 aa, Mycobacterium tuberculosis
AAVSGLVTALFGAPGQPG

SEQ ID NO: 1533955 - protein, 23 aa, Mycobacterium tuberculosis
AEASWVVGITWWSAVVGGFQMSF

SEQ ID NO: 1533956 - protein, 17 aa, Mycobacterium tuberculosis
AEGLRALYLYTATFQDA

SEQ ID NO: 1533957 - protein, 18 aa, Mycobacterium tuberculosis
AEIRALFRSSKVGLIAGC

SEQ ID NO: 1533958 - protein, 24 aa, Mycobacterium tuberculosis
AEPGRITVILALHDLINGGHVGHY

SEQ ID NO: 1533959 - protein, 19 aa, Mycobacterium tuberculosis
AFHERFIQALSTAAGAYGS

SEQ ID NO: 1533960 - protein, 19 aa, Mycobacterium tuberculosis
AFPSLSSSVPILGPYEDLI

SEQ ID NO: 1533961 - protein, 21 aa, Mycobacterium tuberculosis
AGAPGLGGRGGLLLGLPGANG

SEQ ID NO: 1533962 - protein, 17 aa, Mycobacterium tuberculosis
AGGAGFSRALIVAGDNG

SEQ ID NO: 1533963 - protein, 18 aa, Mycobacterium tuberculosis
AGGFLIPAALDPAILLSG

SEQ ID NO: 1533964 - protein, 17 aa, Mycobacterium tuberculosis
AGGLLFGAGEDGTTPGG

SEQ ID NO: 1533965 - protein, 18 aa, Mycobacterium tuberculosis
AGGWIPPHVRLPANVTLL

SEQ ID NO: 1533966 - protein, 20 aa, Mycobacterium tuberculosis
AGHLTLVPALRDALAQVGRP

SEQ ID NO: 1533967 - protein, 17 aa, Mycobacterium tuberculosis
AGNRAPLPVLLPSMRRG

SEQ ID NO: 1533968 - protein, 22 aa, Mycobacterium tuberculosis
AGRGLFLGLGGDGGAGGTSNNN

SEQ ID NO: 1533969 - protein, 23 aa, Mycobacterium tuberculosis
AINAPTMALLGRPLIGHGADGAP

SEQ ID NO: 1533970 - protein, 25 aa, Mycobacterium tuberculosis
ALGGKGGSGGLIGRAGSDGGVGAGG

SEQ ID NO: 1533971 - protein, 18 aa, Mycobacterium tuberculosis
ALLLPLRARGTVAGVVVV

SEQ ID NO: 1533972 - protein, 19 aa, Mycobacterium tuberculosis
ALRDSIGTPFLLLAGLEPD

SEQ ID NO: 1533973 - protein, 24 aa, Mycobacterium tuberculosis
APKGWGWVAPYIGMIWPNGDSTKL

SEQ ID NO: 1533974 - protein, 18 aa, Mycobacterium tuberculosis
APPALAPLLPPLPPSPPS

SEQ ID NO: 1533975 - protein, 20 aa, Mycobacterium tuberculosis
APTQALLGRPLIGDGADGTA

SEQ ID NO: 1533976 - protein, 17 aa, Mycobacterium tuberculosis
ARIVPLKRRRQWLPAAE

SEQ ID NO: 1533977 - protein, 19 aa, Mycobacterium tuberculosis
ARLWALVRRQSLSRFERLA

SEQ ID NO: 1533978 - protein, 20 aa, Mycobacterium tuberculosis
ARWLVLYLRRPGGQTQFAAP

SEQ ID NO: 1533979 - protein, 25 aa, Mycobacterium tuberculosis
ASAAKFIWFFRHPNPIRPVVSQRCD

SEQ ID NO: 1533980 - protein, 23 aa, Mycobacterium tuberculosis
ASCKYMKMITPAALLRCLVEGAD

SEQ ID NO: 1533981 - protein, 22 aa, Mycobacterium tuberculosis
ASIGFPPYHPPMRTFLGVPVRV

SEQ ID NO: 1533982 - protein, 22 aa, Mycobacterium tuberculosis
ASTPLFFAQAIGRFVRSRRPGE

SEQ ID NO: 1533983 - protein, 38 aa, Mycobacterium tuberculosis; identical to SEQ ID NO: 227287

SEQ ID NO: 1533984 - protein, 22 aa, Mycobacterium tuberculosis
ATPMYVGLLLILRRPRAGLSYE

SEQ ID NO: 1533985 - protein, 17 aa, Mycobacterium tuberculosis
AVGTLYRYFPSKVHLLV

SEQ ID NO: 1533986 - protein, 23 aa, Mycobacterium tuberculosis
AVNAPTQALFGRPLIGNGADGSP

SEQ ID NO: 1533987 - protein, 26 aa, Mycobacterium tuberculosis
AVNGALVHPLMIALISYAVGGPIRMI

SEQ ID NO: 1533988 - protein, 18 aa, Mycobacterium tuberculosis
AWTFAWLHPDRCAGVVGI

SEQ ID NO: 1533989 - protein, 19 aa, Mycobacterium tuberculosis
AWTTGLIRWEDDPQPGWYD

SEQ ID NO: 1533990 - protein, 19 aa, Mycobacterium tuberculosis
AWVLGWRRPQAYPLMSHLA

SEQ ID NO: 1533991 - protein, 27 aa, Mycobacterium tuberculosis
AYAKKFRFPTFLGAFKYYTSYTLKTFD

SEQ ID NO: 1533992 - protein, 17 aa, Mycobacterium tuberculosis
CEEAPFYTLGPLATDIA

SEQ ID NO: 1533993 - protein, 17 aa, Mycobacterium tuberculosis
CLWLLRNDVCPDKPTWI

SEQ ID NO: 1533994 - protein, 22 aa, Mycobacterium tuberculosis
CNPYLTFAVLLAAGLRGVEKGY

SEQ ID NO: 1533995 - protein, 20 aa, Mycobacterium tuberculosis
CSYLNKLLWILTGNFAKKGG

SEQ ID NO: 1533996 - protein, 17 aa, Mycobacterium tuberculosis
DAFTLLPDGFTLDTVPA

SEQ ID NO: 1533997 - protein, 20 aa, Mycobacterium tuberculosis
DALINRVVPIPGLRSTEAQW

SEQ ID NO: 1533998 - protein, 17 aa, Mycobacterium tuberculosis
DDMLWQVPYLPIDPRDV

SEQ ID NO: 1533999 - protein, 23 aa, Mycobacterium tuberculosis
DEQKRFFLPRIAAGDLHFSIGYS

SEQ ID NO: 1534000 - protein, 19 aa, Mycobacterium tuberculosis
DGTLGLSLLWVLRGWRRPD

SEQ ID NO: 1534001 - protein, 20 aa, Mycobacterium tuberculosis
DIFYYVYGLLHDPAYRTKYA

SEQ ID NO: 1534002 - protein, 21 aa, Mycobacterium tuberculosis
DLRKTYLFAFLDDHSRLVPGY

SEQ ID NO: 1534003 - protein, 29 aa, Mycobacterium tuberculosis
DRRQVLQRLKYLPLAPFRISYAYTNFGVT

SEQ ID NO: 1534004 - protein, 24 aa, Mycobacterium tuberculosis
DSAVTVFIPAFLRYDLRPVTGEWQ

SEQ ID NO: 1534005 - protein, 23 aa, Mycobacterium tuberculosis
DSMPALHMLPLADALGVLPVLAT

SEQ ID NO: 1534006 - protein, 20 aa, Mycobacterium tuberculosis
DTFASYIAALLWFGEFSGCG

SEQ ID NO: 1534007 - protein, 22 aa, Mycobacterium tuberculosis
DTFASYIAALLWFGEFSGCGIK

SEQ ID NO: 1534008 - protein, 24 aa, Mycobacterium tuberculosis
DVNTGFWNGGPFNTGFGNGGNTNF

SEQ ID NO: 1534009 - protein, 25 aa, Mycobacterium tuberculosis
DVSLLPTLQSFLPPPFDAIPNPIED

SEQ ID NO: 1534010 - protein, 17 aa, Mycobacterium tuberculosis
DYALLAVPYLTLRELAK

SEQ ID NO: 1534011 - protein, 30 aa, Mycobacterium tuberculosis
EAAATSPLLAPINEFFLANTGRPLIGNGTN

SEQ ID NO: 1534012 - protein, 31 aa, Mycobacterium tuberculosis
EAAATSPLLAPINEFFLANTGRPLIGNGTNG

SEQ ID NO: 1534013 - protein, 24 aa, Mycobacterium tuberculosis
EAVDKPLWRWIKMGQTAPTSPNNQ

SEQ ID NO: 1534014 - protein, 17 aa, Mycobacterium tuberculosis
EGAFYWLNNREVRWRPE

SEQ ID NO: 1534015 - protein, 18 aa, Mycobacterium tuberculosis
EHRRKFLSLLRDPSVHRI

SEQ ID NO: 1534016 - protein, 24 aa, Mycobacterium tuberculosis
EHYQRYLDILRPLGFRPALGFSRV

SEQ ID NO: 1534017 - protein, 21 aa, Mycobacterium tuberculosis
EIATVLAWHDALNAADIETLV

SEQ ID NO: 1534018 - protein, 18 aa, Mycobacterium tuberculosis
EILLARSMVKRLPLARAL

SEQ ID NO: 1534019 - protein, 17 aa, Mycobacterium tuberculosis
EINSLRMFTGAGSAPML

SEQ ID NO: 1534020 - protein, 22 aa, Mycobacterium tuberculosis
ELRRRHLVPQPPYGHGAAAAAV

SEQ ID NO: 1534021 - protein, 18 aa, Mycobacterium tuberculosis
EMMATAAFDLARIGSQVS

SEQ ID NO: 1534022 - protein, 18 aa, Mycobacterium tuberculosis
EPLLAYLRKMVFWSMVTP

SEQ ID NO: 1534023 - protein, 25 aa, Mycobacterium tuberculosis
EQLAHQIHWLLLRFGVGSTVRDYDP

SEQ ID NO: 1534024 - protein, 26 aa, Mycobacterium tuberculosis
EREGVNLTFLPFFAKAVIDALKIHPN

SEQ ID NO: 1534025 - protein, 26 aa, Mycobacterium tuberculosis
ESPRETWLRLLLIRAGFPRPQTQIPV

SEQ ID NO: 1534026 - protein, 19 aa, Mycobacterium tuberculosis
EYMAIRGIGFLGWNTRFRG

SEQ ID NO: 1534027 - protein, 17 aa, Mycobacterium tuberculosis
FAAFLDLRYWIKTFTRA

SEQ ID NO: 1534028 - protein, 19 aa, Mycobacterium tuberculosis
FAAFPSFAGLRPTFDTRLM

SEQ ID NO: 1534029 - protein, 19 aa, Mycobacterium tuberculosis
FAAFYRRCRLVTARLWPTL

SEQ ID NO: 1534030 - protein, 18 aa, Mycobacterium tuberculosis
FAGDLLFIGCTPIVWAGP

SEQ ID NO: 1534031 - protein, 27 aa, Mycobacterium tuberculosis
FAVEVALYRLLMSWGVRPGLVLGHSVG

SEQ ID NO: 1534032 - protein, 23 aa, Mycobacterium tuberculosis
FDLGPLVIFPPMNIPATVIESFS

SEQ ID NO: 1534033 - protein, 18 aa, Mycobacterium tuberculosis
FDVINAPTLALLNRPLIG

SEQ ID NO: 1534034 - protein, 17 aa, Mycobacterium tuberculosis
FGELRWALSGAAPIPKE

SEQ ID NO: 1534035 - protein, 17 aa, Mycobacterium tuberculosis
FIKFILTEIFPGGRLPR

SEQ ID NO: 1534036 - protein, 17 aa, Mycobacterium tuberculosis
FLDLRYWIKTFTRAAKP

SEQ ID NO: 1534037 - protein, 18 aa, Mycobacterium tuberculosis
FLEPFRLSDPFITIDAFQ

SEQ ID NO: 1534038 - protein, 21 aa, Mycobacterium tuberculosis
FLFYSGFYLPMYWSSRGKLTN

SEQ ID NO: 1534039 - protein, 17 aa, Mycobacterium tuberculosis
FLGWIHPAATATAPART

SEQ ID NO: 1534040 - protein, 22 aa, Mycobacterium tuberculosis
FNALFLDPYLWKLQVGGKRLVQ

SEQ ID NO: 1534041 - protein, 17 aa, Mycobacterium tuberculosis
FPSLSSSVPILGPYEDL

SEQ ID NO: 1534042 - protein, 17 aa, Mycobacterium tuberculosis
FSFPNISIVLPNIGINL

SEQ ID NO: 1534043 - protein, 17 aa, Mycobacterium tuberculosis
FTYWSMRPRGAQLGAWA

SEQ ID NO: 1534044 - protein, 25 aa, Mycobacterium tuberculosis
FVTGVMSSGFFNFGTGNSGLLVSGN

SEQ ID NO: 1534045 - protein, 17 aa, Mycobacterium tuberculosis
GADAVNVVFMPTEPQAA

SEQ ID NO: 1534046 - protein, 17 aa, Mycobacterium tuberculosis
GAGFSRALIVAGDNGGD

SEQ ID NO: 1534047 - protein, 18 aa, Mycobacterium tuberculosis
GAGGLLFGDGGNGGAGGA

SEQ ID NO: 1534048 - protein, 25 aa, Mycobacterium tuberculosis
GAINAPTMALLGRPLIGHGADGAPG

SEQ ID NO: 1534049 - protein, 24 aa, Mycobacterium tuberculosis
GARQRLMCRLPKRPDPHAWLGDAF

SEQ ID NO: 1534050 - protein, 21 aa, Mycobacterium tuberculosis
GERPLWAWLVLEPGDISVCLH

SEQ ID NO: 1534051 - protein, 25 aa, Mycobacterium tuberculosis
GGAGGNGGWLLGNGGIGGAGGTGGG

SEQ ID NO: 1534052 - protein, 26 aa, Mycobacterium tuberculosis
GGAGTLLGLTVFGDNGGAGVLGDSTD

SEQ ID NO: 1534053 - protein, 22 aa, Mycobacterium tuberculosis
GGDGGLLFGSGGNGAPGAPGQA

SEQ ID NO: 1534054 - protein, 19 aa, Mycobacterium tuberculosis
GGGFSILLGLGGLGGLGSP

SEQ ID NO: 1534055 - protein, 17 aa, Mycobacterium tuberculosis
GGHAWLFGHGGTGGIGG

SEQ ID NO: 1534056 - protein, 19 aa, Mycobacterium tuberculosis
GGIGGLLLGLDGANAPAST

SEQ ID NO: 1534057 - protein, 20 aa, Mycobacterium tuberculosis
GGILLITHYTRILRYIHPEY

SEQ ID NO: 1534058 - protein, 17 aa, Mycobacterium tuberculosis
GGNAGLLAPGLAGGAGG

SEQ ID NO: 1534059 - protein, 19 aa, Mycobacterium tuberculosis
GGRLLGLRRRRAQPAQIGG

SEQ ID NO: 1534060 - protein, 24 aa, Mycobacterium tuberculosis
GGSGGAGGLIGWAGAAGGTGAGGT

SEQ ID NO: 1534061 - protein, 26 aa, Mycobacterium tuberculosis
GGSGGAGGLIGWAGAAGGTGAGGTGG

SEQ ID NO: 1534062 - protein, 24 aa, Mycobacterium tuberculosis
GGSGGFGAPPPRSIGGGDGGDGGR

SEQ ID NO: 1534063 - protein, 18 aa, Mycobacterium tuberculosis
GGTLFGQPGQPGPPGQPG

SEQ ID NO: 1534064 - protein, 22 aa, Mycobacterium tuberculosis
GGVLERYVGLYLPFLDMSFNGA

SEQ ID NO: 1534065 - protein, 27 aa, Mycobacterium tuberculosis
GHGGNGGNPGWLLGTAGGGGNGGAGST

SEQ ID NO: 1534066 - protein, 24 aa, Mycobacterium tuberculosis
GHGGNGGWLLGNGGNGGLGGDGDG

SEQ ID NO: 1534067 - protein, 21 aa, Mycobacterium tuberculosis
GIALYLNFDMLASPNPGYFTY

SEQ ID NO: 1534068 - protein, 23 aa, Mycobacterium tuberculosis
GKGGGRLPITLWIVDTNASTPAP

SEQ ID NO: 1534069 - protein, 19 aa, Mycobacterium tuberculosis
GLGARLFQVGSRGGDGGVG

SEQ ID NO: 1534070 - protein, 17 aa, Mycobacterium tuberculosis
GLLIDRLLPVAGSRVVT

SEQ ID NO: 1534071 - protein, 19 aa, Mycobacterium tuberculosis
GLSLLWVLRGWRRPDDVRV

SEQ ID NO: 1534072 - protein, 17 aa, Mycobacterium tuberculosis
GMVFQRPNPFPAMSIRN

SEQ ID NO: 1534073 - protein, 28 aa, Mycobacterium tuberculosis
GMYFVPAFSGLFAPYWRSDARGAIVGLS

SEQ ID NO: 1534074 - protein, 23 aa, Mycobacterium tuberculosis
GNGAIGGHGPLTDDPGGNGGTGG

SEQ ID NO: 1534075 - protein, 21 aa, Mycobacterium tuberculosis
GNYLYNFWRDAANPRGLWRRT

SEQ ID NO: 1534076 - protein, 19 aa, Mycobacterium tuberculosis
GPLQPLFDVINAPTLALLN

SEQ ID NO: 1534077 - protein, 18 aa, Mycobacterium tuberculosis
GPRRTLTGQPLPPLLTAT

SEQ ID NO: 1534078 - protein, 23 aa, Mycobacterium tuberculosis
GQPLDWFCLFSSAAALTGSPGQS

SEQ ID NO: 1534079 - protein, 23 aa, Mycobacterium tuberculosis
GRDEQLLLLPLTSLRGLRHTLKK

SEQ ID NO: 1534080 - protein, 28 aa, Mycobacterium tuberculosis
GSAGVQLFRPAFLLAVPTALGGVGSLAI

SEQ ID NO: 1534081 - protein, 24 aa, Mycobacterium tuberculosis
GTGGNAAWLLGGGGTGGAGGIGGG

SEQ ID NO: 1534082 - protein, 23 aa, Mycobacterium tuberculosis
GVGGAGGLLFGYGGAGGAGGYSN

SEQ ID NO: 1534083 - protein, 24 aa, Mycobacterium tuberculosis
GVGGNGGWLYGNGGAGGLGGTGVA

SEQ ID NO: 1534084 - protein, 24 aa, Mycobacterium tuberculosis
GVQLFSPAFLLAVPTALGGVGSLA

SEQ ID NO: 1534085 - protein, 18 aa, Mycobacterium tuberculosis
GVTAYDYMLTLAGRLRPV

SEQ ID NO: 1534086 - protein, 23 aa, Mycobacterium tuberculosis
GVVSPGFIGAPLALAALGQMARG

SEQ ID NO: 1534087 - protein, 17 aa, Mycobacterium tuberculosis
GWAFGYNTAAIPLAALG

SEQ ID NO: 1534088 - protein, 19 aa, Mycobacterium tuberculosis
GWFTGLIPITVPIAGSAFG

SEQ ID NO: 1534089 - protein, 23 aa, Mycobacterium tuberculosis
GYSWGPLSLMLLATAIAQQGHIA

SEQ ID NO: 1534090 - protein, 20 aa, Mycobacterium tuberculosis
GYTIDPLPLHLALNLTVPDS

SEQ ID NO: 1534091 - protein, 24 aa, Mycobacterium tuberculosis
HELQRLWLIEATRYNVLPLDDDTA

SEQ ID NO: 1534092 - protein, 17 aa, Mycobacterium tuberculosis
HETMVIPPIVFLPSMTI

SEQ ID NO: 1534093 - protein, 18 aa, Mycobacterium tuberculosis
HGGWLWGNGGVGGSGGAG

SEQ ID NO: 1534094 - protein, 21 aa, Mycobacterium tuberculosis
HLTLVHKINVLTFAGGLWLRT

SEQ ID NO: 1534095 - protein, 19 aa, Mycobacterium tuberculosis
HSDYPLQALLYVVVLHRFL

SEQ ID NO: 1534096 - protein, 23 aa, Mycobacterium tuberculosis
HTTSRLWAFQLQSILARLGHYAT

SEQ ID NO: 1534097 - protein, 20 aa, Mycobacterium tuberculosis
IAGIPLLAGAISKAVLPPIT

SEQ ID NO: 1534098 - protein, 17 aa, Mycobacterium tuberculosis
IAIDPQHRLLLETSWEA

SEQ ID NO: 1534099 - protein, 20 aa, Mycobacterium tuberculosis
IATPGSWRREPLSGIPAATN

SEQ ID NO: 1534100 - protein, 18 aa, Mycobacterium tuberculosis
IAYRWLRVGRLPVPARRV

SEQ ID NO: 1534101 - protein, 22 aa, Mycobacterium tuberculosis
IDDALAVIYLLASPDADLVGIA

SEQ ID NO: 1534102 - protein, 18 aa, Mycobacterium tuberculosis
IDPYLRPLYDALYDMMDP

SEQ ID NO: 1534103 - protein, 21 aa, Mycobacterium tuberculosis
IDSPELLWKALLRGDDLITEV

SEQ ID NO: 1534104 - protein, 19 aa, Mycobacterium tuberculosis
IEKKPLNHFLLGSATLSFG

SEQ ID NO: 1534105 - protein, 24 aa, Mycobacterium tuberculosis
IGPITIQPIPILPTIPLSIHQTVN

SEQ ID NO: 1534106 - protein, 18 aa, Mycobacterium tuberculosis
ILNMTLSQRWGRLFVAVC

SEQ ID NO: 1534107 - protein, 21 aa, Mycobacterium tuberculosis
IMGTPWLTAFAQRSRFAEAFH

SEQ ID NO: 1534108 - protein, 26 aa, Mycobacterium tuberculosis
IPMETYLRLMFLKFRYRLGYESLCRE

SEQ ID NO: 1534109 - protein, 17 aa, Mycobacterium tuberculosis
ISDVWLSNLLAWLTRRA

SEQ ID NO: 1534110 - protein, 17 aa, Mycobacterium tuberculosis
IVNTPTQLLLGRPLIGN

SEQ ID NO: 1534111 - protein, 24 aa, Mycobacterium tuberculosis
KEGHEVLIFRLFHAPPPSVCSRRR

SEQ ID NO: 1534112 - protein, 19 aa, Mycobacterium tuberculosis
KEVQTYVPGYRLLNEPQFD

SEQ ID NO: 1534113 - protein, 28 aa, Mycobacterium tuberculosis
KGGAGTLLGLTVFGDNGGAGVLGDSTDP

SEQ ID NO: 1534114 - protein, 20 aa, Mycobacterium tuberculosis
KHRRHVLGPHLLVGGLGGRD

SEQ ID NO: 1534115 - protein, 22 aa, Mycobacterium tuberculosis
KKRPFYFGVLTWYMDRVLELVH

SEQ ID NO: 1534116 - protein, 21 aa, Mycobacterium tuberculosis
KLGLFPFRRNLSFYAVDLGLL

SEQ ID NO: 1534117 - protein, 21 aa, Mycobacterium tuberculosis
KNPVLQLFIDILMRLTKRYVQ

SEQ ID NO: 1534118 - protein, 24 aa, Mycobacterium tuberculosis
KTHLPPGAWPPTSWYADWIRGLDV

SEQ ID NO: 1534119 - protein, 26 aa, Mycobacterium tuberculosis
LAAVNAPAQALLGRPLIGNGANGAPG

SEQ ID NO: 1534120 - protein, 20 aa, Mycobacterium tuberculosis
LAFPSLSSSVPILGPYEDLI

SEQ ID NO: 1534121 - protein, 19 aa, Mycobacterium tuberculosis
LALTALWRSYGVTPDAVIG

SEQ ID NO: 1534122 - protein, 20 aa, Mycobacterium tuberculosis
LARLHTPLPLLAFTAWPEVR

SEQ ID NO: 1534123 - protein, 21 aa, Mycobacterium tuberculosis
LARLHTPLPLLAFTAWPEVRS

SEQ ID NO: 1534124 - protein, 20 aa, Mycobacterium tuberculosis
LAYPRVVWIAGGLLKGASLH

SEQ ID NO: 1534125 - protein, 17 aa, Mycobacterium tuberculosis
LDPHWLLDTLGLTEAAR

SEQ ID NO: 1534126 - protein, 18 aa, Mycobacterium tuberculosis
LEQWTLLARARALDSMSY

SEQ ID NO: 1534127 - protein, 22 aa, Mycobacterium tuberculosis
LESRTITFLKIDPAPGIGNSTT

SEQ ID NO: 1534128 - protein, 17 aa, Mycobacterium tuberculosis
LEWLDRMDLVNGKLICL

SEQ ID NO: 1534129 - protein, 20 aa, Mycobacterium tuberculosis
LFYSGFYLPMYWSSRGKLTN

SEQ ID NO: 1534130 - protein, 26 aa, Mycobacterium tuberculosis
LGLTSPMSLLRFIKFILTEIFPGGRL

SEQ ID NO: 1534131 - protein, 17 aa, Mycobacterium tuberculosis
LGQIPLDPALVAAGDSG

SEQ ID NO: 1534132 - protein, 17 aa, Mycobacterium tuberculosis
LHFLGATLWRSGIQRVL

SEQ ID NO: 1534133 - protein, 29 aa, Mycobacterium tuberculosis
LHTTLSIGPFPFRWDYIPPTPANGPIPAV

SEQ ID NO: 1534134 - protein, 19 aa, Mycobacterium tuberculosis
LIATMRRAGLIAPLRPDRY

SEQ ID NO: 1534135 - protein, 19 aa, Mycobacterium tuberculosis
LKGLTAHYLLKSVYPVKRG

SEQ ID NO: 1534136 - protein, 23 aa, Mycobacterium tuberculosis
LLARLFGLPYFPITPLFPLAGPV

SEQ ID NO: 1534137 - protein, 17 aa, Mycobacterium tuberculosis
LLAYRRLSEALATESWY

SEQ ID NO: 1534138 - protein, 19 aa, Mycobacterium tuberculosis
LLDMKRYHLLLAGASWMAE

SEQ ID NO: 1534139 - protein, 20 aa, Mycobacterium tuberculosis
LLIRAGYIRPVAPGLYSWLP

SEQ ID NO: 1534140 - protein, 26 aa, Mycobacterium tuberculosis
LLNLINAPTQTLLGRPLIGDGANATT

SEQ ID NO: 1534141 - protein, 17 aa, Mycobacterium tuberculosis
LLNRLWPLVSLRCNFFT

SEQ ID NO: 1534142 - protein, 17 aa, Mycobacterium tuberculosis
LLPPILGGGMPAAPGPA

SEQ ID NO: 1534143 - protein, 17 aa, Mycobacterium tuberculosis
LLRFTVGLAQITSLLLA

SEQ ID NO: 1534144 - protein, 18 aa, Mycobacterium tuberculosis
LNHFLLGSATLSFGTAGC

SEQ ID NO: 1534145 - protein, 18 aa, Mycobacterium tuberculosis
LPAYLAARGLPLPPRRRR

SEQ ID NO: 1534146 - protein, 17 aa, Mycobacterium tuberculosis
LPLGLRRLLTDLHNAGA

SEQ ID NO: 1534147 - protein, 19 aa, Mycobacterium tuberculosis
LPSQDLPLLVPLRAIPLLG

SEQ ID NO: 1534148 - protein, 18 aa, Mycobacterium tuberculosis
LRRPLFPPLPGTLPEPEI

SEQ ID NO: 1534149 - protein, 26 aa, Mycobacterium tuberculosis
LRRSLIALRSQRYFRLLDALDALVSE

SEQ ID NO: 1534150 - protein, 19 aa, Mycobacterium tuberculosis
LSPAPALLALPAAESAWRL

SEQ ID NO: 1534151 - protein, 18 aa, Mycobacterium tuberculosis
LSRRYGAAVLGPHGSKRS

SEQ ID NO: 1534152 - protein, 17 aa, Mycobacterium tuberculosis
LTGMHWWGPASTSMLAM

SEQ ID NO: 1534153 - protein, 20 aa, Mycobacterium tuberculosis
LTLTELWRSYGVQPDLVIGH

SEQ ID NO: 1534154 - protein, 17 aa, Mycobacterium tuberculosis
LTQWSRPGLIPVALVVV

SEQ ID NO: 1534155 - protein, 17 aa, Mycobacterium tuberculosis
LTYNIAGLPFPLSSAIL

SEQ ID NO: 1534156 - protein, 22 aa, Mycobacterium tuberculosis
LVDDLLLLARLDAHRPLELCRV

SEQ ID NO: 1534157 - protein, 17 aa, Mycobacterium tuberculosis
LYDNALLLRAYAHWARR

SEQ ID NO: 1534158 - protein, 18 aa, Mycobacterium tuberculosis
LYKTSWRFAPFLWQEIEE

SEQ ID NO: 1534159 - protein, 17 aa, Mycobacterium tuberculosis
LYLLDFLRQSGNTPIVL

SEQ ID NO: 1534160 - protein, 18 aa, Mycobacterium tuberculosis
LYPKLLPIARNWWAKLGR

SEQ ID NO: 1534161 - protein, 22 aa, Mycobacterium tuberculosis
MERAGLLLPLGWDPRLPVMGQK

SEQ ID NO: 1534162 - protein, 22 aa, Mycobacterium tuberculosis
NAGPAMLPGFNSGFANIGSFNA

SEQ ID NO: 1534163 - protein, 21 aa, Mycobacterium tuberculosis
NAPAQALFGRPLIGNGANGTA

SEQ ID NO: 1534164 - protein, 22 aa, Mycobacterium tuberculosis
NAPTQALLGRPLIGDGAAGAPG

SEQ ID NO: 1534165 - protein, 23 aa, Mycobacterium tuberculosis
NGGNAGWLYGRGGVGGAGGIGGG

SEQ ID NO: 1534166 - protein, 24 aa, Mycobacterium tuberculosis
NGSKGLPGLGRLGNPGLDGGTGGN

SEQ ID NO: 1534167 - protein, 24 aa, Mycobacterium tuberculosis
NIVNTPTQLLLGRPLIGNGANGAP

SEQ ID NO: 1534168 - protein, 18 aa, Mycobacterium tuberculosis
NREVRWRPEHFWKPGTAV

SEQ ID NO: 1534169 - protein, 19 aa, Mycobacterium tuberculosis
NTVGPPLLPPILGGGMPAA

SEQ ID NO: 1534170 - protein, 26 aa, Mycobacterium tuberculosis
NVINAPTQTLLGRPLIGNGTNGAPGT

SEQ ID NO: 1534171 - protein, 32 aa, Mycobacterium tuberculosis
NVLNALNAPTQALLGRPLIGDGAAGAPGTGQA

SEQ ID NO: 1534172 - protein, 20 aa, Mycobacterium tuberculosis
NYSNGFFWRGDYQGLGGFAY

SEQ ID NO: 1534173 - protein, 21 aa, Mycobacterium tuberculosis
NYSNGFFWRGDYQGLIGFSGT

SEQ ID NO: 1534174 - protein, 22 aa, Mycobacterium tuberculosis
NYSNGFWWRGDYQGLAGISQTI

SEQ ID NO: 1534175 - protein, 17 aa, Mycobacterium tuberculosis
PAPPRGLSAVPLEPGQQ

SEQ ID NO: 1534176 - protein, 18 aa, Mycobacterium tuberculosis
PDDLLNALIDFLAAVRNG

SEQ ID NO: 1534177 - protein, 20 aa, Mycobacterium tuberculosis
PDEFGLSRYLAAGLAALQTV

SEQ ID NO: 1534178 - protein, 19 aa, Mycobacterium tuberculosis
PDLELIFAPAPFYDEALVP

SEQ ID NO: 1534179 - protein, 22 aa, Mycobacterium tuberculosis
PEIPAIPPFFPGFPPDYVTVSG

SEQ ID NO: 1534180 - protein, 24 aa, Mycobacterium tuberculosis
PEIPAIPPFFPGFPPDYVTVSGQI

SEQ ID NO: 1534181 - protein, 19 aa, Mycobacterium tuberculosis
PEITPFALTLRLLVIALKH

SEQ ID NO: 1534182 - protein, 21 aa, Mycobacterium tuberculosis
PELGWPACPLPPAPPALAPLL

SEQ ID NO: 1534183 - protein, 17 aa, Mycobacterium tuberculosis
PFMGMAPLLINYIPQQL

SEQ ID NO: 1534184 - protein, 27 aa, Mycobacterium tuberculosis
PGAEASWVVGITWWSAVVGGFQMSFVI

SEQ ID NO: 1534185 - protein, 22 aa, Mycobacterium tuberculosis
PIMGTPWLTAFAQRSRFAEAFH

SEQ ID NO: 1534186 - protein, 23 aa, Mycobacterium tuberculosis
PIMGTPWLTAFAQRSRFAEAFHA

SEQ ID NO: 1534187 - protein, 20 aa, Mycobacterium tuberculosis
PIRVLTLAALAPRPGQRLWD

SEQ ID NO: 1534188 - protein, 17 aa, Mycobacterium tuberculosis
PLPLYCASLRTAEPRLL

SEQ ID NO: 1534189 - protein, 18 aa, Mycobacterium tuberculosis
PLPVLLPSMRRGGVAAVS

SEQ ID NO: 1534190 - protein, 17 aa, Mycobacterium tuberculosis
PLQPLFDVINAPTLALL

SEQ ID NO: 1534191 - protein, 22 aa, Mycobacterium tuberculosis
PLVLKPWTMPEPLLPIAIAAHA

SEQ ID NO: 1534192 - protein, 23 aa, Mycobacterium tuberculosis
PMDPALYLVWAQANAAAGYRYSV

SEQ ID NO: 1534193 - protein, 22 aa, Mycobacterium tuberculosis
PNPNDWWLVRLLGSITPTERTT

SEQ ID NO: 1534194 - protein, 22 aa, Mycobacterium tuberculosis
PPHPAHFLWLNWGPCPPRQDMA

SEQ ID NO: 1534195 - protein, 24 aa, Mycobacterium tuberculosis
PPRVATLPHWPLIYAGALEGLDHL

SEQ ID NO: 1534196 - protein, 17 aa, Mycobacterium tuberculosis
PSLLLPIWDSELGAGLI

SEQ ID NO: 1534197 - protein, 19 aa, Mycobacterium tuberculosis
PTPAVAYLTGAYDADFGVM

SEQ ID NO: 1534198 - protein, 18 aa, Mycobacterium tuberculosis
PTQTLFGRPLIGDGANGT

SEQ ID NO: 1534199 - protein, 20 aa, Mycobacterium tuberculosis
PYAGPPMWFHGDLSRFNILT

SEQ ID NO: 1534200 - protein, 24 aa, Mycobacterium tuberculosis
PYQQRGLAWLAFLSSLGLGSCLAD

SEQ ID NO: 1534201 - protein, 23 aa, Mycobacterium tuberculosis
QEDFAYHQFLIKKSKMPSQTPPE

SEQ ID NO: 1534202 - protein, 23 aa, Mycobacterium tuberculosis
QFNALFLDPYLWKLQVGGKRLVQ

SEQ ID NO: 1534203 - protein, 17 aa, Mycobacterium tuberculosis
QFYCSISVPLDLYSCAV

SEQ ID NO: 1534204 - protein, 24 aa, Mycobacterium tuberculosis
QIHDWILLTPWGLLSWLQINQQLG

SEQ ID NO: 1534205 - protein, 20 aa, Mycobacterium tuberculosis
QQGKFLCLLAGAIQARRVLE

SEQ ID NO: 1534206 - protein, 20 aa, Mycobacterium tuberculosis
QRVFFGWAQIWRTKSRAAEA

SEQ ID NO: 1534207 - protein, 20 aa, Mycobacterium tuberculosis
QRYMGWFDGNPGWLWPHPPE

SEQ ID NO: 1534208 - protein, 28 aa, Mycobacterium tuberculosis
QVAAYHQQFVQTLRTGAASYMLAEATNV

SEQ ID NO: 1534209 - protein, 24 aa, Mycobacterium tuberculosis
QVVPWASLLQRFPGLGAGATGATG

SEQ ID NO: 1534210 - protein, 17 aa, Mycobacterium tuberculosis
RDLLFFSLPGHVPAPVS

SEQ ID NO: 1534211 - protein, 17 aa, Mycobacterium tuberculosis
RFTVGLAQITSLLLAGD

SEQ ID NO: 1534212 - protein, 18 aa, Mycobacterium tuberculosis
RGYTLRLPLDVLVVASAN

SEQ ID NO: 1534213 - protein, 22 aa, Mycobacterium tuberculosis
RKHIAWYLHGFPAGSALRRALA

SEQ ID NO: 1534214 - protein, 21 aa, Mycobacterium tuberculosis
RLGLFPFRRNLSLYAVDLALL

SEQ ID NO: 1534215 - protein, 21 aa, Mycobacterium tuberculosis
RPDIPIHYLLADTFTICDQYF

SEQ ID NO: 1534216 - protein, 22 aa, Mycobacterium tuberculosis
RPGLVYLLWPVALGYLRVVTHP

SEQ ID NO: 1534217 - protein, 22 aa, Mycobacterium tuberculosis
RPVAPGLYSWLPLGLRVLRNIE

SEQ ID NO: 1534218 - protein, 19 aa, Mycobacterium tuberculosis
RPVIIGPITFLLLSKAVDG

SEQ ID NO: 1534219 - protein, 20 aa, Mycobacterium tuberculosis
RRDMMWICRDGDRAKNHLLE

SEQ ID NO: 1534220 - protein, 22 aa, Mycobacterium tuberculosis
RRVRLMRWGLIPSWIKAGPGGA

SEQ ID NO: 1534221 - protein, 17 aa, Mycobacterium tuberculosis
RSLVFPVKRLADLGFRV

SEQ ID NO: 1534222 - protein, 19 aa, Mycobacterium tuberculosis
RSLVFPVKRLADLGFRVLA

SEQ ID NO: 1534223 - protein, 21 aa, Mycobacterium tuberculosis
RWFPGFMTFRFLECGLLTMVS

SEQ ID NO: 1534224 - protein, 21 aa, Mycobacterium tuberculosis
RYTWPRFVCALPKEFFAAVRA

SEQ ID NO: 1534225 - protein, 21 aa, Mycobacterium tuberculosis
SAAKFIWFFATRTRFGLWFRN

SEQ ID NO: 1534226 - protein, 27 aa, Mycobacterium tuberculosis
SAGVQLFRPAFLLAVPTALGGVGSLAI

SEQ ID NO: 1534227 - protein, 18 aa, Mycobacterium tuberculosis
SARPATVWIAQDGSHHLV

SEQ ID NO: 1534228 - protein, 19 aa, Mycobacterium tuberculosis
SARPILLHRSIAGSPGLAK

SEQ ID NO: 1534229 - protein, 24 aa, Mycobacterium tuberculosis
SDLSNILLLGPVGDLFPILSIPGA

SEQ ID NO: 1534230 - protein, 25 aa, Mycobacterium tuberculosis
SDLSNILLLGPVGDLFPILSIPGAM

SEQ ID NO: 1534231 - protein, 20 aa, Mycobacterium tuberculosis
SGRPWDGDQLLRALGLRPPG

SEQ ID NO: 1534232 - protein, 17 aa, Mycobacterium tuberculosis
SILYRLYRPLIFALYCL

SEQ ID NO: 1534233 - protein, 24 aa, Mycobacterium tuberculosis
SPDETWLALQPFLAPAGITGVADV

SEQ ID NO: 1534234 - protein, 20 aa, Mycobacterium tuberculosis
SRLPYLIRLPVGAGLVFATS

SEQ ID NO: 1534235 - protein, 23 aa, Mycobacterium tuberculosis
STQVAAFHDRFAQTLSAAVGSYV

SEQ ID NO: 1534236 - protein, 17 aa, Mycobacterium tuberculosis
SWRREPLSGIPAATNTV

SEQ ID NO: 1534237 - protein, 18 aa, Mycobacterium tuberculosis
TGERLVFGPVALGLVPVT

SEQ ID NO: 1534238 - protein, 18 aa, Mycobacterium tuberculosis
TGFFLLNLIQAGVARRGS

SEQ ID NO: 1534239 - protein, 20 aa, Mycobacterium tuberculosis
TGGTLFGQPGQPGPPGQPGP

SEQ ID NO: 1534240 - protein, 23 aa, Mycobacterium tuberculosis
TGNTQYYMFLTQDLPLLQPIRDI

SEQ ID NO: 1534241 - protein, 18 aa, Mycobacterium tuberculosis
TGPWLFGDGGAGGGGGAG

SEQ ID NO: 1534242 - protein, 17 aa, Mycobacterium tuberculosis
TIALVPPSDDPVPPGMH

SEQ ID NO: 1534243 - protein, 23 aa, Mycobacterium tuberculosis
TIHDYFWRWDTDWFWCSRSFGAQ

SEQ ID NO: 1534244 - protein, 17 aa, Mycobacterium tuberculosis
TMLPFSWQGVSLHAAGA

SEQ ID NO: 1534245 - protein, 23 aa, Mycobacterium tuberculosis
TPAMWAWWFGWHGSDTRRYKLWH

SEQ ID NO: 1534246 - protein, 21 aa, Mycobacterium tuberculosis
TPAQVLLRWNLQLGNAVVVRS

SEQ ID NO: 1534247 - protein, 22 aa, Mycobacterium tuberculosis
TPVVSKLPWFALRDPYVTGQVT

SEQ ID NO: 1534248 - protein, 17 aa, Mycobacterium tuberculosis
TPWNFPHQINLAKLGPA

SEQ ID NO: 1534249 - protein, 24 aa, Mycobacterium tuberculosis
TRMQRFWIALYFPLTMRSLCNAIV

SEQ ID NO: 1534250 - protein, 19 aa, Mycobacterium tuberculosis
TSDLIPLCHQLALTGVDVD

SEQ ID NO: 1534251 - protein, 17 aa, Mycobacterium tuberculosis
TSIYWYFRKKDDLLNAM

SEQ ID NO: 1534252 - protein, 21 aa, Mycobacterium tuberculosis
TSRLWAFQLQSILARLGHYAT

SEQ ID NO: 1534253 - protein, 27 aa, Mycobacterium tuberculosis
TYLVPVNHLPLTLPLRYLGMSDAEVDQ

SEQ ID NO: 1534254 - protein, 28 aa, Mycobacterium tuberculosis
VEPWVRDYLLLRGLLGTSILWFEQDRDC

SEQ ID NO: 1534255 - protein, 19 aa, Mycobacterium tuberculosis
VFNGFLPAVARMRALDPVT

SEQ ID NO: 1534256 - protein, 19 aa, Mycobacterium tuberculosis
VGHPFWFSRTVFGELARLH

SEQ ID NO: 1534257 - protein, 18 aa, Mycobacterium tuberculosis
VGLNLVIDMPLPISLGVN

SEQ ID NO: 1534258 - protein, 22 aa, Mycobacterium tuberculosis
VIAQLRFPGYFLVVHDITRFCR

SEQ ID NO: 1534259 - protein, 17 aa, Mycobacterium tuberculosis
VIDQDVRRWWRSDSLWQ

SEQ ID NO: 1534260 - protein, 17 aa, Mycobacterium tuberculosis
VINAPAQALFGRPLIGN

SEQ ID NO: 1534261 - protein, 21 aa, Mycobacterium tuberculosis
VLMSPMSFLRRPARWMQLLAT

SEQ ID NO: 1534262 - protein, 17 aa, Mycobacterium tuberculosis
VLPLYLPSGDGLIGLLS

SEQ ID NO: 1534263 - protein, 24 aa, Mycobacterium tuberculosis
VPVNHLPLTLPLRYLGISDAEVDQ

SEQ ID NO: 1534264 - protein, 18 aa, Mycobacterium tuberculosis
VRAIWVLRALLREYGRRL

SEQ ID NO: 1534265 - protein, 18 aa, Mycobacterium tuberculosis
VRGRNFLGWIHPAATATA

SEQ ID NO: 1534266 - protein, 17 aa, Mycobacterium tuberculosis
VRLEGPAVFRWAAFKMG

SEQ ID NO: 1534267 - protein, 21 aa, Mycobacterium tuberculosis
VVDPSWFNWPALPVAMADTIV

SEQ ID NO: 1534268 - protein, 17 aa, Mycobacterium tuberculosis
VVTTWMKLAIRDRILPD

SEQ ID NO: 1534269 - protein, 25 aa, Mycobacterium tuberculosis
VYGVDPLILRQAYPVRQAPYGLAGS

SEQ ID NO: 1534270 - protein, 17 aa, Mycobacterium tuberculosis
VYQWLTVLQEYLVLVLM

SEQ ID NO: 1534271 - protein, 17 aa, Mycobacterium tuberculosis
WAFVWVVDPPLFEPADE

SEQ ID NO: 1534272 - protein, 25 aa, Mycobacterium tuberculosis
WGGSYYVEWLTHRLARRARAHIAEV

SEQ ID NO: 1534273 - protein, 18 aa, Mycobacterium tuberculosis
WIQKYIFPGGLLPSTQAI

SEQ ID NO: 1534274 - protein, 24 aa, Mycobacterium tuberculosis
WKCWARWRLIRARAPWLTRALVAE

SEQ ID NO: 1534275 - protein, 17 aa, Mycobacterium tuberculosis
WNFPHQINLAKLGPALA

SEQ ID NO: 1534276 - protein, 18 aa, Mycobacterium tuberculosis
WQQALRGLPGLGQVASAI

SEQ ID NO: 1534277 - protein, 21 aa, Mycobacterium tuberculosis
YIPILGAPWLADLVRRSPWGE

SEQ ID NO: 1534278 - protein, 17 aa, Mycobacterium tuberculosis
YKTSWRFAPFLWQEIEE

SEQ ID NO: 1534279 - protein, 20 aa, Mycobacterium tuberculosis
YPPILRLAYRLLSPMLRVLP

SEQ ID NO: 1534280 - protein, 25 aa, Mycobacterium tuberculosis
YSPQRWKYLTSGLLGLQRGSDAGDL

SEQ ID NO: 1534281 - protein, 19 aa, Mycobacterium tuberculosis
YVAAHAPYLAWLMRASETS

SEQ ID NO: 1534282 - protein, 20 aa, Mycobacterium tuberculosis
AAAAAPYAGWLAAAAARAAG

SEQ ID NO: 1534283 - protein, 24 aa, Mycobacterium tuberculosis
AAAALAPWQQAVPGLSGLLGGAAN

SEQ ID NO: 1534284 - protein, 26 aa, Mycobacterium tuberculosis
AAAALPSWQQALRGLPGLGQVASAIS

SEQ ID NO: 1534285 - protein, 26 aa, Mycobacterium tuberculosis
AAAGGWPTWVWAISGWPTPAPATSGS

SEQ ID NO: 1534286 - protein, 23 aa, Mycobacterium tuberculosis
AAALAPWQQAVPGLLGLLDSAQS

SEQ ID NO: 1534287 - protein, 22 aa, Mycobacterium tuberculosis
AAALAPWQQAVPGLSGLLDSAQ

SEQ ID NO: 1534288 - protein, 25 aa, Mycobacterium tuberculosis
AAALPSWQQALRGLPGLGQVASAIS

SEQ ID NO: 1534289 - protein, 18 aa, Mycobacterium tuberculosis
AAAPYAGWLGSVAAAAEA

SEQ ID NO: 1534290 - protein, 27 aa, Mycobacterium tuberculosis
AAAQLSSWSIGLQQALPAAPSALAAAI

SEQ ID NO: 1534291 - protein, 24 aa, Mycobacterium tuberculosis
AAAVPVVFLTAWYGLADLAEIKAG

SEQ ID NO: 1534292 - protein, 19 aa, Mycobacterium tuberculosis
AACLPYLSWLTQASADCAA

SEQ ID NO: 1534293 - protein, 20 aa, Mycobacterium tuberculosis
AAGFGWLSTRRFKPPKAALS

SEQ ID NO: 1534294 - protein, 24 aa, Mycobacterium tuberculosis
AAGGWPTWVWAISGWPTPAPATSG

SEQ ID NO: 1534295 - protein, 21 aa, Mycobacterium tuberculosis
AAGRAPRWGCWPRAPDEVSAA

SEQ ID NO: 1534296 - protein, 17 aa, Mycobacterium tuberculosis
AAHAPYLAWLMRASETS

SEQ ID NO: 1534297 - protein, 23 aa, Mycobacterium tuberculosis
AAILGLGAIWWRSSRARWSSAAR

SEQ ID NO: 1534298 - protein, 19 aa, Mycobacterium tuberculosis
AAIPRWPTWWLTGSATKVV

SEQ ID NO: 1534299 - protein, 17 aa, Mycobacterium tuberculosis
AALAFPSLSSSVPILGP

SEQ ID NO: 1534300 - protein, 20 aa, Mycobacterium tuberculosis
AALAPWQQAVPGLSGLLGGA

SEQ ID NO: 1534301 - protein, 17 aa, Mycobacterium tuberculosis
AALVGLTLAPSSQVPAV

SEQ ID NO: 1534302 - protein, 20 aa, Mycobacterium tuberculosis
AAMLVAYWPTNLRPIAAGTG

SEQ ID NO: 1534303 - protein, 19 aa, Mycobacterium tuberculosis
AAMRPLRHTLSQLRLHELL

SEQ ID NO: 1534304 - protein, 18 aa, Mycobacterium tuberculosis
AAPIERILLRYKAINRVA

SEQ ID NO: 1534305 - protein, 18 aa, Mycobacterium tuberculosis
AAPLWRVLVALSIRHVGP

SEQ ID NO: 1534306 - protein, 21 aa, Mycobacterium tuberculosis
AAPPRILWLDTAAPAKLILEV

SEQ ID NO: 1534307 - protein, 19 aa, Mycobacterium tuberculosis
AAPVPVPRPAAPVATAVTA

SEQ ID NO: 1534308 - protein, 20 aa, Mycobacterium tuberculosis
AASPGRWRPPSRFWPATTRV

SEQ ID NO: 1534309 - protein, 17 aa, Mycobacterium tuberculosis
AATAARLRRCTGASRHL

SEQ ID NO: 1534310 - protein, 24 aa, Mycobacterium tuberculosis
AAVNAPTQALFGRPLIGNGADGSP

SEQ ID NO: 1534311 - protein, 18 aa, Mycobacterium tuberculosis
AAVWQLPVVILVENIRGA

SEQ ID NO: 1534312 - protein, 19 aa, Mycobacterium tuberculosis
AAWYYRRPSPLARRIKNHV

SEQ ID NO: 1534313 - protein, 17 aa, Mycobacterium tuberculosis
AAYMPFLAWLIQASADC

SEQ ID NO: 1534314 - protein, 18 aa, Mycobacterium tuberculosis
AAYMPFLAWLIQASADCV

SEQ ID NO: 1534315 - protein, 19 aa, Mycobacterium tuberculosis
AAYMPFLAWLIQASADCVE

SEQ ID NO: 1534316 - protein, 18 aa, Mycobacterium tuberculosis
ACELYDLPTLWQIAAHNP

SEQ ID NO: 1534317 - protein, 18 aa, Mycobacterium tuberculosis
ACQRWQWHDLEVSRTAIV

SEQ ID NO: 1534318 - protein, 28 aa, Mycobacterium tuberculosis
ADFWFDPLCPWCWITSRWILEVAKVRDI

SEQ ID NO: 1534319 - protein, 20 aa, Mycobacterium tuberculosis
ADLPAFAELLARLPWPLNKT

SEQ ID NO: 1534320 - protein, 24 aa, Mycobacterium tuberculosis
ADRFNWLLMTIRLSISSLAGTART

SEQ ID NO: 1534321 - protein, 20 aa, Mycobacterium tuberculosis
ADVIRYLRWFTFLSADELAE

SEQ ID NO: 1534322 - protein, 22 aa, Mycobacterium tuberculosis
ADVPLLGQIPLDPALVAAGDSG

SEQ ID NO: 1534323 - protein, 23 aa, Mycobacterium tuberculosis
ADVPWVLMHWRAVSADTPHVPVR

SEQ ID NO: 1534324 - protein, 31 aa, Mycobacterium tuberculosis
AEAAAVSPLLDPINEFFLANTGRPLIGNGTN

SEQ ID NO: 1534325 - protein, 18 aa, Mycobacterium tuberculosis
AEALAWMCDRAVDLLLLE

SEQ ID NO: 1534326 - protein, 20 aa, Mycobacterium tuberculosis
AEALVPITALLPAGADDVSA

SEQ ID NO: 1534327 - protein, 20 aa, Mycobacterium tuberculosis
AEEYYLSFLLDRANRTYLAM

SEQ ID NO: 1534328 - protein, 17 aa, Mycobacterium tuberculosis
AEGLLPYLPGDAADRLF

SEQ ID NO: 1534329 - protein, 23 aa, Mycobacterium tuberculosis
AEKPGARRVPAAPVGWYSAGMGS

SEQ ID NO: 1534330 - protein, 20 aa, Mycobacterium tuberculosis
AEKRRWRQASTDVDGAGGYG

SEQ ID NO: 1534331 - protein, 20 aa, Mycobacterium tuberculosis
AELSRLRPLPFRLVLDGTEE

SEQ ID NO: 1534332 - protein, 18 aa, Mycobacterium tuberculosis
AEPYLPLRAVRHLEKGRV

SEQ ID NO: 1534333 - protein, 24 aa, Mycobacterium tuberculosis
AEQLVPFQQALQQLPNLGIGNIGN

SEQ ID NO: 1534334 - protein, 20 aa, Mycobacterium tuberculosis
AFFNIYFCSVTIKINGPAGS

SEQ ID NO: 1534335 - protein, 18 aa, Mycobacterium tuberculosis
AFNFPVAVWAWNTAVALV

SEQ ID NO: 1534336 - protein, 20 aa, Mycobacterium tuberculosis
AFQFYFELLLFDYPTHIVQI

SEQ ID NO: 1534337 - protein, 17 aa, Mycobacterium tuberculosis
AFRYVMMVLRHIPRSIF

SEQ ID NO: 1534338 - protein, 20 aa, Mycobacterium tuberculosis
AFSFPNISIVLPNIGINLGS

SEQ ID NO: 1534339 - protein, 24 aa, Mycobacterium tuberculosis
AGAGIANFLGFSVLHGGAGGAGGT

SEQ ID NO: 1534340 - protein, 26 aa, Mycobacterium tuberculosis
AGAGYADMTAIFLGSSGTPGEDGGNG

SEQ ID NO: 1534341 - protein, 17 aa, Mycobacterium tuberculosis
AGDGFARYWLHNGWVTM

SEQ ID NO: 1534342 - protein, 20 aa, Mycobacterium tuberculosis
AGDPNNLLWRAFRPGTHVPI

SEQ ID NO: 1534343 - protein, 21 aa, Mycobacterium tuberculosis
AGENLLLLPPGSAVRFCTGGT

SEQ ID NO: 1534344 - protein, 17 aa, Mycobacterium tuberculosis
AGGLLFGNGGNGGNAGA

SEQ ID NO: 1534345 - protein, 17 aa, Mycobacterium tuberculosis
AGGMLYGAGGVGGNGGA

SEQ ID NO: 1534346 - protein, 20 aa, Mycobacterium tuberculosis
AGGNALLFGNGGNGGSGASG

SEQ ID NO: 1534347 - protein, 24 aa, Mycobacterium tuberculosis
AGGQAALLFGRGGTGGAGGYGGDG

SEQ ID NO: 1534348 - protein, 22 aa, Mycobacterium tuberculosis
AGGRGGLLIGDGGAGGAGGVGG

SEQ ID NO: 1534349 - protein, 25 aa, Mycobacterium tuberculosis
AGGSAGLLGYVGRAGDGGAGGGGGL

SEQ ID NO: 1534350 - protein, 23 aa, Mycobacterium tuberculosis
AGGTGGLLFGAGGNGGPGGSGGA

SEQ ID NO: 1534351 - protein, 17 aa, Mycobacterium tuberculosis
AGGWLFGVGGAGGVGGA

SEQ ID NO: 1534352 - protein, 19 aa, Mycobacterium tuberculosis
AGGWLIGQSGSTGGGGAGG

SEQ ID NO: 1534353 - protein, 18 aa, Mycobacterium tuberculosis
AGIPLLAGAISKAVLPPI

SEQ ID NO: 1534354 - protein, 17 aa, Mycobacterium tuberculosis
AGIPTLILWVTSDQPIW

SEQ ID NO: 1534355 - protein, 18 aa, Mycobacterium tuberculosis
AGKRLPCFGFWAGAGPGR

SEQ ID NO: 1534356 - protein, 19 aa, Mycobacterium tuberculosis
AGPAFSLLLGTWGPRKRRA

SEQ ID NO: 1534357 - protein, 17 aa, Mycobacterium tuberculosis
AGPDALIVVLLPDGGRG

SEQ ID NO: 1534358 - protein, 23 aa, Mycobacterium tuberculosis
AGPVVIPLLDIPPAPGFGNSTTG

SEQ ID NO: 1534359 - protein, 23 aa, Mycobacterium tuberculosis
AGQFALTYPRRLGFGLGSSVVSL

SEQ ID NO: 1534360 - protein, 18 aa, Mycobacterium tuberculosis
AGQLLPRRAAQKFADFAN

SEQ ID NO: 1534361 - protein, 18 aa, Mycobacterium tuberculosis
AGRGLFLGLGGDGGAGGT

SEQ ID NO: 1534362 - protein, 25 aa, Mycobacterium tuberculosis
AGRRETWLIMRLPVIGNTQALRWRT

SEQ ID NO: 1534363 - protein, 20 aa, Mycobacterium tuberculosis
AGSIGLFLEPFRLSDPFITI

SEQ ID NO: 1534364 - protein, 21 aa, Mycobacterium tuberculosis
AGSIGLFLEPFRLSDPFITID

SEQ ID NO: 1534365 - protein, 22 aa, Mycobacterium tuberculosis
AGTELGCRRAWTAPTASPPTAV

SEQ ID NO: 1534366 - protein, 23 aa, Mycobacterium tuberculosis
AGTLLGLTVFGDNGGAGVLGDST

SEQ ID NO: 1534367 - protein, 23 aa, Mycobacterium tuberculosis
AGVGGPVVSVPPGGGGGAGGDGG

SEQ ID NO: 1534368 - protein, 21 aa, Mycobacterium tuberculosis
AGWFGVAMILDFSWLPPEINS

SEQ ID NO: 1534369 - protein, 26 aa, Mycobacterium tuberculosis
AHGTVGAQFVPATSLPTPNGGAGGNG

SEQ ID NO: 1534370 - protein, 25 aa, Mycobacterium tuberculosis
AHLRHPLFLDIMRPSAPAARSASPT

SEQ ID NO: 1534371 - protein, 27 aa, Mycobacterium tuberculosis
AHRRGWARRVWRRRFSPQALTTGGRPA

SEQ ID NO: 1534372 - protein, 19 aa, Mycobacterium tuberculosis
AIAIDPQHRLLLETSWEAM

SEQ ID NO: 1534373 - protein, 18 aa, Mycobacterium tuberculosis
AIDPVLLDLLRLGTYQLL

SEQ ID NO: 1534374 - protein, 17 aa, Mycobacterium tuberculosis
AIGLFSPALLASAALGA

SEQ ID NO: 1534375 - protein, 17 aa, Mycobacterium tuberculosis
AIGLVDLLLASGGDLVT

SEQ ID NO: 1534376 - protein, 17 aa, Mycobacterium tuberculosis
AITPFALLQLADRGQFF

SEQ ID NO: 1534377 - protein, 22 aa, Mycobacterium tuberculosis
AIYDKWLTLGPLIDQFGMTTKG

SEQ ID NO: 1534378 - protein, 20 aa, Mycobacterium tuberculosis
ALARSWLISVVRIGPRPARR

SEQ ID NO: 1534379 - protein, 18 aa, Mycobacterium tuberculosis
ALDPLAGSIGLFLEPFRL

SEQ ID NO: 1534380 - protein, 17 aa, Mycobacterium tuberculosis
ALEDWCHQLAWPIRPAV

SEQ ID NO: 1534381 - protein, 18 aa, Mycobacterium tuberculosis
ALFHEQFVRALTAGAGSY

SEQ ID NO: 1534382 - protein, 17 aa, Mycobacterium tuberculosis
ALFRMWLRDAVRRVATG

SEQ ID NO: 1534383 - protein, 18 aa, Mycobacterium tuberculosis
ALGLLRRNKIEKLPVVDG

SEQ ID NO: 1534384 - protein, 20 aa, Mycobacterium tuberculosis
ALISGFFNTGSNMSGFFGGP

SEQ ID NO: 1534385 - protein, 17 aa, Mycobacterium tuberculosis
ALLAVPYLTLRELAKSA

SEQ ID NO: 1534386 - protein, 19 aa, Mycobacterium tuberculosis
ALLLRAYAHWARRTGDPLA

SEQ ID NO: 1534387 - protein, 18 aa, Mycobacterium tuberculosis
ALPAPLQSGGNGATGGNG

SEQ ID NO: 1534388 - protein, 21 aa, Mycobacterium tuberculosis
ALPGVGACPPLPPSPAAAAAA

SEQ ID NO: 1534389 - protein, 19 aa, Mycobacterium tuberculosis
ALRALWCAAGLRAVCGRAA

SEQ ID NO: 1534390 - protein, 22 aa, Mycobacterium tuberculosis
ALRCLWVFRGFPARLRPPASWW

SEQ ID NO: 1534391 - protein, 23 aa, Mycobacterium tuberculosis
ALRDRLIVELLYATGIRVSELCG

SEQ ID NO: 1534392 - protein, 18 aa, Mycobacterium tuberculosis
ALRFLPMEELIAAFLPVL

SEQ ID NO: 1534393 - protein, 17 aa, Mycobacterium tuberculosis
ALRPIIDRAYQPGPAPA

SEQ ID NO: 1534394 - protein, 23 aa, Mycobacterium tuberculosis
ALRSAWIGCWVPSAATGGGVATG

SEQ ID NO: 1534395 - protein, 17 aa, Mycobacterium tuberculosis
ALSSWYVWAALGLYPST

SEQ ID NO: 1534396 - protein, 27 aa, Mycobacterium tuberculosis
ALSYTSPLPPLPVVAAVSVVTGLPVPP

SEQ ID NO: 1534397 - protein, 18 aa, Mycobacterium tuberculosis
ALTAHLLPLLRAAQRARV

SEQ ID NO: 1534398 - protein, 20 aa, Mycobacterium tuberculosis
ALTAHLLPLLRAAQRARVVS

SEQ ID NO: 1534399 - protein, 17 aa, Mycobacterium tuberculosis
ALTCWKPFTATISKAGA

SEQ ID NO: 1534400 - protein, 21 aa, Mycobacterium tuberculosis
AMAAAAPYAGWLSAAAARAAG

SEQ ID NO: 1534401 - protein, 19 aa, Mycobacterium tuberculosis
AMLLERLPRYLVPHHIVVL

SEQ ID NO: 1534402 - protein, 19 aa, Mycobacterium tuberculosis
AMLVAIFRARPSPFYIMDE

SEQ ID NO: 1534403 - protein, 18 aa, Mycobacterium tuberculosis
AMSALPPAPPAPPGAPGA

SEQ ID NO: 1534404 - protein, 21 aa, Mycobacterium tuberculosis
AMTGWRLGWLLVPTVLRRAVD

SEQ ID NO: 1534405 - protein, 18 aa, Mycobacterium tuberculosis
ANAFVMSFLGAVSTLNGS

SEQ ID NO: 1534406 - protein, 19 aa, Mycobacterium tuberculosis
ANLFPFQLFLVLYGLPLED

SEQ ID NO: 1534407 - protein, 26 aa, Mycobacterium tuberculosis
APAPPPFRLPLLFVNALGDNWIVGAS

SEQ ID NO: 1534408 - protein, 22 aa, Mycobacterium tuberculosis
APDGLSCFLLPRVLPDGTRNRM

SEQ ID NO: 1534409 - protein, 23 aa, Mycobacterium tuberculosis
APDRPFFAYFAPGATHAPHHVPR

SEQ ID NO: 1534410 - protein, 18 aa, Mycobacterium tuberculosis
APDRPFFVHFAPGATHAP

SEQ ID NO: 1534411 - protein, 20 aa, Mycobacterium tuberculosis
APDRPFFVYFAPGVTHAPHH

SEQ ID NO: 1534412 - protein, 19 aa, Mycobacterium tuberculosis
APGLWRYWAEHLDPDRARR

SEQ ID NO: 1534413 - protein, 22 aa, Mycobacterium tuberculosis
APGRWTLIRWGPAGSLVLRITL

SEQ ID NO: 1534414 - protein, 17 aa, Mycobacterium tuberculosis
APPPLWCGPYNSINASL

SEQ ID NO: 1534415 - protein, 20 aa, Mycobacterium tuberculosis
APTQALLGRPLIGNGADGAP

SEQ ID NO: 1534416 - protein, 20 aa, Mycobacterium tuberculosis
APTQTLFGRPLIGDGANGTA

SEQ ID NO: 1534417 - protein, 20 aa, Mycobacterium tuberculosis
APTQTLLGRPLIGDGAHGTA

SEQ ID NO: 1534418 - protein, 20 aa, Mycobacterium tuberculosis
APTQTLLGRPLIGNGTNGAP

SEQ ID NO: 1534419 - protein, 18 aa, Mycobacterium tuberculosis
APVRRLLRRLLGPTDPVL

SEQ ID NO: 1534420 - protein, 23 aa, Mycobacterium tuberculosis
APVRYRFHFPRQQRGRFLCIADF

SEQ ID NO: 1534421 - protein, 17 aa, Mycobacterium tuberculosis
APWLADLVRRSPWGEMF

SEQ ID NO: 1534422 - protein, 17 aa, Mycobacterium tuberculosis
APWLVAFAERSRFFEVF

SEQ ID NO: 1534423 - protein, 26 aa, Mycobacterium tuberculosis
AQIRPARLQRPIVLEARISHAASGEV

SEQ ID NO: 1534424 - protein, 19 aa, Mycobacterium tuberculosis
AQLVGWLEGLFHGIQTALF

SEQ ID NO: 1534425 - protein, 17 aa, Mycobacterium tuberculosis
AQPGPFRGFRRIVVHRL

SEQ ID NO: 1534426 - protein, 18 aa, Mycobacterium tuberculosis
AQPLEWFCLFSSAAALVG

SEQ ID NO: 1534427 - protein, 21 aa, Mycobacterium tuberculosis
AQPLEWFCLFSSAAALVGSPG

SEQ ID NO: 1534428 - protein, 25 aa, Mycobacterium tuberculosis
AQVATFHDRFVQTLSAAASSYVAAE

SEQ ID NO: 1534429 - protein, 19 aa, Mycobacterium tuberculosis
ARAAMALPARPTGGTGGDG

SEQ ID NO: 1534430 - protein, 17 aa, Mycobacterium tuberculosis
ARAATVDPLLVAANRHQ

SEQ ID NO: 1534431 - protein, 26 aa, Mycobacterium tuberculosis
ARCGPAVRWPWWPRPAILEHMFDLVS

SEQ ID NO: 1534432 - protein, 18 aa, Mycobacterium tuberculosis
ARDPFGIKPLFIATGAGG

SEQ ID NO: 1534433 - protein, 18 aa, Mycobacterium tuberculosis
ARFNLRYPLAHLRPFLST

SEQ ID NO: 1534434 - protein, 17 aa, Mycobacterium tuberculosis
ARFSRPLAFGTAGLRGH

SEQ ID NO: 1534435 - protein, 17 aa, Mycobacterium tuberculosis
ARLFYAYAEILLALGRG

SEQ ID NO: 1534436 - protein, 17 aa, Mycobacterium tuberculosis
ARLHTPLPLLAFTAWPE

SEQ ID NO: 1534437 - protein, 19 aa, Mycobacterium tuberculosis
ARLLLQIPAVLGLAFDGGW

SEQ ID NO: 1534438 - protein, 24 aa, Mycobacterium tuberculosis
ARLLYWGCDVWLNNPLRPLEACGT

SEQ ID NO: 1534439 - protein, 19 aa, Mycobacterium tuberculosis
ARLTGMHWWGPASTSMLAM

SEQ ID NO: 1534440 - protein, 18 aa, Mycobacterium tuberculosis
ARNHRWFVIANYGAARVG

SEQ ID NO: 1534441 - protein, 24 aa, Mycobacterium tuberculosis
ARPPSVRALFRGRGRYRFAHPQPH

SEQ ID NO: 1534442 - protein, 30 aa, Mycobacterium tuberculosis
ARRTRRVRRAWRPAVRPNRHGWRVAVAGRL

SEQ ID NO: 1534443 - protein, 17 aa, Mycobacterium tuberculosis
ARVRAIFYTPRGPHGVH

SEQ ID NO: 1534444 - protein, 17 aa, Mycobacterium tuberculosis
ARVWPGVFLPDGGIRYS

SEQ ID NO: 1534445 - protein, 25 aa, Mycobacterium tuberculosis
ASAAKFIWFFATRTRFGLWFRNVAM

SEQ ID NO: 1534446 - protein, 21 aa, Mycobacterium tuberculosis
ASAFAMWFPIEGGSKYGGYGR

SEQ ID NO: 1534447 - protein, 21 aa, Mycobacterium tuberculosis
ASGGWLARRAADRRRRGWRCR

SEQ ID NO: 1534448 - protein, 22 aa, Mycobacterium tuberculosis
ASIGAYLWVPDILECLASVMAD

SEQ ID NO: 1534449 - protein, 20 aa, Mycobacterium tuberculosis
ASPSGTPFRCSPRWAPTSPA

SEQ ID NO: 1534450 - protein, 24 aa, Mycobacterium tuberculosis
ASRAKWLALFPWAVSKDESTANIP

SEQ ID NO: 1534451 - protein, 18 aa, Mycobacterium tuberculosis
ASRWRHIIPAGVVCALIA

SEQ ID NO: 1534452 - protein, 19 aa, Mycobacterium tuberculosis
ASVATIAWMGYHPPPNPLD

SEQ ID NO: 1534453 - protein, 21 aa, Mycobacterium tuberculosis
ASVMTHHRWLRALAVFGGMGL

SEQ ID NO: 1534454 - protein, 18 aa, Mycobacterium tuberculosis
ASVPFYLRTGKRLGRRVT

SEQ ID NO: 1534455 - protein, 20 aa, Mycobacterium tuberculosis
ATFHEDPVAGVWAVGGVGGD

SEQ ID NO: 1534456 - protein, 21 aa, Mycobacterium tuberculosis
ATHIGGLWWILTCLMHGGLCV

SEQ ID NO: 1534457 - protein, 19 aa, Mycobacterium tuberculosis
ATIPIVYAVSRIVEVPYAE

SEQ ID NO: 1534458 - protein, 27 aa, Mycobacterium tuberculosis
ATPANYQPFQCVTLSAGSRLAGRKSMP

SEQ ID NO: 1534459 - protein, 17 aa, Mycobacterium tuberculosis
ATRRKIFIPILRVAAIE

SEQ ID NO: 1534460 - protein, 20 aa, Mycobacterium tuberculosis
ATRRKIFIPILRVAAIEPHA

SEQ ID NO: 1534461 - protein, 17 aa, Mycobacterium tuberculosis
ATTWRTHWMIWCSAGTI

SEQ ID NO: 1534462 - protein, 18 aa, Mycobacterium tuberculosis
ATTWRTHWMIWCSAGTIT

SEQ ID NO: 1534463 - protein, 21 aa, Mycobacterium tuberculosis
AVADWLYWQYVTGLLDRALAA

SEQ ID NO: 1534464 - protein, 22 aa, Mycobacterium tuberculosis
AVADWLYWQYVTGLLDRALAAA

SEQ ID NO: 1534465 - protein, 18 aa, Mycobacterium tuberculosis
AVATQYLAWLSTAAAQAE

SEQ ID NO: 1534466 - protein, 17 aa, Mycobacterium tuberculosis
AVDFHRWLQWQLDEQLA

SEQ ID NO: 1534467 - protein, 21 aa, Mycobacterium tuberculosis
AVFEIFFRKLPPGRSYIMAAG

SEQ ID NO: 1534468 - protein, 17 aa, Mycobacterium tuberculosis
AVGYLMPALGRPNLTLL

SEQ ID NO: 1534469 - protein, 21 aa, Mycobacterium tuberculosis
AVGYLMPALGRPNLTLLARTR

SEQ ID NO: 1534470 - protein, 20 aa, Mycobacterium tuberculosis
AVHRLVTRLGLVTRLGLVER

SEQ ID NO: 1534471 - protein, 25 aa, Mycobacterium tuberculosis
AVHYPWLPLRRLLLDHYPSIERIAS

SEQ ID NO: 1534472 - protein, 23 aa, Mycobacterium tuberculosis
AVIIAGFPFLDLGNVTIGGFNLA

SEQ ID NO: 1534473 - protein, 24 aa, Mycobacterium tuberculosis
AVINAPAQALFGRPLIGNGANGTA

SEQ ID NO: 1534474 - protein, 19 aa, Mycobacterium tuberculosis
AVISRWLSSVLPGGAAPEV

SEQ ID NO: 1534475 - protein, 23 aa, Mycobacterium tuberculosis
AVIYFLRKVIWFLPDFTVEGYHD

SEQ ID NO: 1534476 - protein, 22 aa, Mycobacterium tuberculosis
AVNAPTQALFGRPLIGNGADGS

SEQ ID NO: 1534477 - protein, 24 aa, Mycobacterium tuberculosis
AVNAPTQTLLGRPLIGNGADGVAG

SEQ ID NO: 1534478 - protein, 19 aa, Mycobacterium tuberculosis
AVRGPNFLGWIHPAATATA

SEQ ID NO: 1534479 - protein, 18 aa, Mycobacterium tuberculosis
AVSALDLGLPLAAGNVVS

SEQ ID NO: 1534480 - protein, 27 aa, Mycobacterium tuberculosis
AVSASAQTLLSRPLIGNGANATTPGGN

SEQ ID NO: 1534481 - protein, 22 aa, Mycobacterium tuberculosis
AVTVIFFGPVDIDPFTVPVIRI

SEQ ID NO: 1534482 - protein, 18 aa, Mycobacterium tuberculosis
AWPATLDRVLAIGGPDAS

SEQ ID NO: 1534483 - protein, 24 aa, Mycobacterium tuberculosis
AYSPRFLWMWPNARISVMGGEQAA

SEQ ID NO: 1534484 - protein, 23 aa, Mycobacterium tuberculosis
CAELLYRAGLPRALYAIVPGPGS

SEQ ID NO: 1534485 - protein, 17 aa, Mycobacterium tuberculosis
CATYPVLAVQAWAAFHD

SEQ ID NO: 1534486 - protein, 26 aa, Mycobacterium tuberculosis
CAVGRTWCVPWWWGPGALPKSSAGHS

SEQ ID NO: 1534487 - protein, 17 aa, Mycobacterium tuberculosis
CAYSRWLLAMLLPSRCA

SEQ ID NO: 1534488 - protein, 23 aa, Mycobacterium tuberculosis
CGPPLVFQLLWYPTTMADLSLPS

SEQ ID NO: 1534489 - protein, 19 aa, Mycobacterium tuberculosis
CGRRRSRRPRRVPLAPTIR

SEQ ID NO: 1534490 - protein, 20 aa, Mycobacterium tuberculosis
CISRQLWWGHRIPIWYGPDG

SEQ ID NO: 1534491 - protein, 17 aa, Mycobacterium tuberculosis
CLCRLHHLLATFCGWRA

SEQ ID NO: 1534492 - protein, 17 aa, Mycobacterium tuberculosis
CLWWRPALRVRGSPIST

SEQ ID NO: 1534493 - protein, 17 aa, Mycobacterium tuberculosis
CMVVFQPHLYSRTKAFA

SEQ ID NO: 1534494 - protein, 18 aa, Mycobacterium tuberculosis
CMVVFQPHLYSRTKAFAA

SEQ ID NO: 1534495 - protein, 24 aa, Mycobacterium tuberculosis
CRTARPRRPSAWAWPTSGSGIWVA

SEQ ID NO: 1534496 - protein, 17 aa, Mycobacterium tuberculosis
CSWLPLYHDMGLAFVLS

SEQ ID NO: 1534497 - protein, 21 aa, Mycobacterium tuberculosis
CSYLNKLLWILTGNFAKKGGQ

SEQ ID NO: 1534498 - protein, 25 aa, Mycobacterium tuberculosis
CTPTVLPVWRRSPWIAPMAAVRELR

SEQ ID NO: 1534499 - protein, 17 aa, Mycobacterium tuberculosis
CWTFPIPSWESRSARWA

SEQ ID NO: 1534500 - protein, 19 aa, Mycobacterium tuberculosis
CYAGPFFRYERPQAGRYRQ

SEQ ID NO: 1534501 - protein, 25 aa, Mycobacterium tuberculosis
CYVHPEIEFFLLKPGPEDGSVPVPV

SEQ ID NO: 1534502 - protein, 21 aa, Mycobacterium tuberculosis
DAAWYYRRPSPLARRIKNHVA

SEQ ID NO: 1534503 - protein, 25 aa, Mycobacterium tuberculosis
DAGPPQRWFVVWLGTANNPVDKGAA

SEQ ID NO: 1534504 - protein, 20 aa, Mycobacterium tuberculosis
DALALLHRLSLKSPVRHFVL

SEQ ID NO: 1534505 - protein, 24 aa, Mycobacterium tuberculosis
DALDRALIDLATYFRDALLVAAHA

SEQ ID NO: 1534506 - protein, 18 aa, Mycobacterium tuberculosis
DALTLSVLRSWLAATAGA

SEQ ID NO: 1534507 - protein, 24 aa, Mycobacterium tuberculosis
DDDDFAKHPFLVKGYIGPKALREN

SEQ ID NO: 1534508 - protein, 23 aa, Mycobacterium tuberculosis
DDDFAKHPFLVKGYIGPKALREN

SEQ ID NO: 1534509 - protein, 24 aa, Mycobacterium tuberculosis
DDELFFFAVLLLVAGYESTAHMIS

SEQ ID NO: 1534510 - protein, 20 aa, Mycobacterium tuberculosis
DDRLRWWAGPWPDDERWWDP

SEQ ID NO: 1534511 - protein, 24 aa, Mycobacterium tuberculosis
DDVHVAPRVIFLPGPAAALTSDDH

SEQ ID NO: 1534512 - protein, 24 aa, Mycobacterium tuberculosis
DDYLPCLVSIQFRLLPDGKDYVFH

SEQ ID NO: 1534513 - protein, 21 aa, Mycobacterium tuberculosis
DERHMLWFALMKPMTSTATGR

SEQ ID NO: 1534514 - protein, 30 aa, Mycobacterium tuberculosis; identical to SEQ ID NO: 228301

SEQ ID NO: 1534515 - protein, 31 aa, Mycobacterium tuberculosis; identical to SEQ ID NO: 228485

SEQ ID NO: 1534516 - protein, 18 aa, Mycobacterium tuberculosis
DEWIYTRTGIKTRRFAAD

SEQ ID NO: 1534517 - protein, 19 aa, Mycobacterium tuberculosis
DFQRAYKELAKQVRLPGFR

SEQ ID NO: 1534518 - protein, 24 aa, Mycobacterium tuberculosis
DFTNIYFYTVLYHALRASNRIAIE

SEQ ID NO: 1534519 - protein, 25 aa, Mycobacterium tuberculosis
DGADAVNVVFMPTEPQAATGTAGSA

SEQ ID NO: 1534520 - protein, 23 aa, Mycobacterium tuberculosis
DGLPVWIYQFKISPHPTIPLAPT

SEQ ID NO: 1534521 - protein, 17 aa, Mycobacterium tuberculosis
DGWPVNFALLGKGNTVN

SEQ ID NO: 1534522 - protein, 23 aa, Mycobacterium tuberculosis
DHIGAIPFLLKLRPDIPVVGSKF

SEQ ID NO: 1534523 - protein, 24 aa, Mycobacterium tuberculosis
DHIIGLFRLWWIPDGAPPTQGTYV

SEQ ID NO: 1534524 - protein, 24 aa, Mycobacterium tuberculosis
DIERLRKLWDVPALAFVGIGNGTQ

SEQ ID NO: 1534525 - protein, 17 aa, Mycobacterium tuberculosis
DILFFWVARMMMFGTFV

SEQ ID NO: 1534526 - protein, 18 aa, Mycobacterium tuberculosis
DILFFWVARMMMFGTFVG

SEQ ID NO: 1534527 - protein, 17 aa, Mycobacterium tuberculosis
DIRLARWMSTGFRQEPN

SEQ ID NO: 1534528 - protein, 20 aa, Mycobacterium tuberculosis
DKVLGVHNFYFWPDPRASLC

SEQ ID NO: 1534529 - protein, 27 aa, Mycobacterium tuberculosis
DKVLGVHNFYFWPDPRASLCDIARALR

SEQ ID NO: 1534530 - protein, 31 aa, Mycobacterium tuberculosis
DLHTTLSIGPFPFRWDYIPPTPANGPIPAVP

SEQ ID NO: 1534531 - protein, 28 aa, Mycobacterium tuberculosis
DLLNLINAPTQALLGRPLIGNGANGLPG

SEQ ID NO: 1534532 - protein, 20 aa, Mycobacterium tuberculosis
DLRKTYLFAFLDDHSRLVPG

SEQ ID NO: 1534533 - protein, 22 aa, Mycobacterium tuberculosis
DLSNILLLGPVGDLFPILSIPG

SEQ ID NO: 1534534 - protein, 21 aa, Mycobacterium tuberculosis
DLTIRWDTPPITLFPNGISAP

SEQ ID NO: 1534535 - protein, 17 aa, Mycobacterium tuberculosis
DLYLIHWPAPPVGKYVD

SEQ ID NO: 1534536 - protein, 23 aa, Mycobacterium tuberculosis
DMPPPFRSLTPIPVHWVAAAVLD

SEQ ID NO: 1534537 - protein, 17 aa, Mycobacterium tuberculosis
DMTLFLDLKQTPPQPLV

SEQ ID NO: 1534538 - protein, 17 aa, Mycobacterium tuberculosis
DNPHPLLLLTHPVPNTG

SEQ ID NO: 1534539 - protein, 23 aa, Mycobacterium tuberculosis
DPDAWAFVWVVDPPLFEPADEAT

SEQ ID NO: 1534540 - protein, 22 aa, Mycobacterium tuberculosis
DPLAMYLFDLCTLPLNLAGHCG

SEQ ID NO: 1534541 - protein, 20 aa, Mycobacterium tuberculosis
DPLTGFIYAFDDMLARHNAS

SEQ ID NO: 1534542 - protein, 18 aa, Mycobacterium tuberculosis
DPRLKRPIPYLPNMIGLI

SEQ ID NO: 1534543 - protein, 23 aa, Mycobacterium tuberculosis
DPRLKRPIPYLPNMIGLITGRAS

SEQ ID NO: 1534544 - protein, 25 aa, Mycobacterium tuberculosis
DPRNPSPVYLFAYDPMAFGGKGRAA

SEQ ID NO: 1534545 - protein, 21 aa, Mycobacterium tuberculosis
DPRTRWLLRELVYALLVKKDH

SEQ ID NO: 1534546 - protein, 17 aa, Mycobacterium tuberculosis
DPTLRRLLPDFYRPDDL

SEQ ID NO: 1534547 - protein, 23 aa, Mycobacterium tuberculosis
DQIGIVFQFFNLIPTLTVLENIT

SEQ ID NO: 1534548 - protein, 18 aa, Mycobacterium tuberculosis
DQVGQLRALPWSHPHHRG

SEQ ID NO: 1534549 - protein, 18 aa, Mycobacterium tuberculosis
DQVGQLRALPWSQPHHRG

SEQ ID NO: 1534550 - protein, 26 aa, Mycobacterium tuberculosis
DRGVSWLPFFHDMGLITVLLASVLGH

SEQ ID NO: 1534551 - protein, 21 aa, Mycobacterium tuberculosis
DRVTLFRAWYSRRNFGQLSGS

SEQ ID NO: 1534552 - protein, 17 aa, Mycobacterium tuberculosis
DSLLAVARPFFAKNREV

SEQ ID NO: 1534553 - protein, 20 aa, Mycobacterium tuberculosis
DSMPALHMLPLADALGVLPV

SEQ ID NO: 1534554 - protein, 22 aa, Mycobacterium tuberculosis
DSRLPYLIRLPVGAGLVFATSD

SEQ ID NO: 1534555 - protein, 23 aa, Mycobacterium tuberculosis
DSVVIPFLLLDIPVVAWWPDIAP

SEQ ID NO: 1534556 - protein, 23 aa, Mycobacterium tuberculosis
DTRLGLFPFRRNLSLYAVDLALL

SEQ ID NO: 1534557 - protein, 17 aa, Mycobacterium tuberculosis
DVFLGWLVRGVVGFPDN

SEQ ID NO: 1534558 - protein, 17 aa, Mycobacterium tuberculosis
DVLRHRLVLTYDALADE

SEQ ID NO: 1534559 - protein, 24 aa, Mycobacterium tuberculosis
DVPTGVVVPYFWSDQYDVKIQCLG

SEQ ID NO: 1534560 - protein, 24 aa, Mycobacterium tuberculosis
DVVNGPTQLLLGRPLIGDGANGGP

SEQ ID NO: 1534561 - protein, 19 aa, Mycobacterium tuberculosis
DWCHQLAWPIRPAVSADPP

SEQ ID NO: 1534562 - protein, 18 aa, Mycobacterium tuberculosis
DYLTDLFPILELGTSAKM

SEQ ID NO: 1534563 - protein, 24 aa, Mycobacterium tuberculosis
DYSALYPAGWLVDAPLPAWTHARL

SEQ ID NO: 1534564 - protein, 19 aa, Mycobacterium tuberculosis
EADRHLWIADERGTWHLRE

SEQ ID NO: 1534565 - protein, 18 aa, Mycobacterium tuberculosis
EAEPAAWLRFWFPDPNGS

SEQ ID NO: 1534566 - protein, 27 aa, Mycobacterium tuberculosis
EAFLALIRSNWLGLNAPWIAAVESLYE

SEQ ID NO: 1534567 - protein, 24 aa, Mycobacterium tuberculosis
EAITRPRWLWKFAKTLRPPDLRVP

SEQ ID NO: 1534568 - protein, 21 aa, Mycobacterium tuberculosis
EALAAPLFWIAANAGLDGSVV

SEQ ID NO: 1534569 - protein, 18 aa, Mycobacterium tuberculosis
EALRWAMMRGEPLVVLAD

SEQ ID NO: 1534570 - protein, 22 aa, Mycobacterium tuberculosis
EAMYEQMWPADVAAMVGYHGGA

SEQ ID NO: 1534571 - protein, 19 aa, Mycobacterium tuberculosis
EAPVARRLRESFGGSKPAP

SEQ ID NO: 1534572 - protein, 22 aa, Mycobacterium tuberculosis
EASVWTRWYAATPVPSCCPGRP

SEQ ID NO: 1534573 - protein, 20 aa, Mycobacterium tuberculosis
EDFAYHQFLIKKSKMPSQTP

SEQ ID NO: 1534574 - protein, 20 aa, Mycobacterium tuberculosis
EFITGVLFYTGARALPFGDR

SEQ ID NO: 1534575 - protein, 17 aa, Mycobacterium tuberculosis
EFLRASLPPFWQTTNAT

SEQ ID NO: 1534576 - protein, 18 aa, Mycobacterium tuberculosis
EGMLSPWLQLPGAADQIA

SEQ ID NO: 1534577 - protein, 21 aa, Mycobacterium tuberculosis
EGVNLTFLPFFAKAVIDALKI

SEQ ID NO: 1534578 - protein, 17 aa, Mycobacterium tuberculosis
EGWRRLLYLLSGRLINA

SEQ ID NO: 1534579 - protein, 22 aa, Mycobacterium tuberculosis
EHLPLLAPLRAIPVIGPWGLGF

SEQ ID NO: 1534580 - protein, 17 aa, Mycobacterium tuberculosis
EHNVLNALNAPTQALLG

SEQ ID NO: 1534581 - protein, 17 aa, Mycobacterium tuberculosis
EHVLLARQVGVPYILVA

SEQ ID NO: 1534582 - protein, 18 aa, Mycobacterium tuberculosis
EHWRWMWDTNVLGTLRVT

SEQ ID NO: 1534583 - protein, 18 aa, Mycobacterium tuberculosis
EIELLPITKFFPATDVAI

SEQ ID NO: 1534584 - protein, 26 aa, Mycobacterium tuberculosis
EIMGFYGLSYWYPFQVTALGLGPIWM

SEQ ID NO: 1534585 - protein, 19 aa, Mycobacterium tuberculosis
EINSLRMFTGAGSAPMLAA

SEQ ID NO: 1534586 - protein, 18 aa, Mycobacterium tuberculosis
EIRTLFGVLFQDGALFGS

SEQ ID NO: 1534587 - protein, 22 aa, Mycobacterium tuberculosis
EITRLVPFIEWLRGAYPDQLIS

SEQ ID NO: 1534588 - protein, 21 aa, Mycobacterium tuberculosis
EIYVPFSWFEPMWLENLGFAR

SEQ ID NO: 1534589 - protein, 17 aa, Mycobacterium tuberculosis
EKAIWWQRAVAVWPDYA

SEQ ID NO: 1534590 - protein, 18 aa, Mycobacterium tuberculosis
EKAIWWQRAVAVWPDYAS

SEQ ID NO: 1534591 - protein, 17 aa, Mycobacterium tuberculosis
ELAWTTGLIRWEDDPQP

SEQ ID NO: 1534592 - protein, 18 aa, Mycobacterium tuberculosis
ELGLPYLVLARPPWDPGT

SEQ ID NO: 1534593 - protein, 20 aa, Mycobacterium tuberculosis
ELIAWLPTLLGLGGADLVVV

SEQ ID NO: 1534594 - protein, 19 aa, Mycobacterium tuberculosis
ELIRLLLNRALTTAGDDLA

SEQ ID NO: 1534595 - protein, 19 aa, Mycobacterium tuberculosis
ELLDWPAKLRLLDGFPAAG

SEQ ID NO: 1534596 - protein, 17 aa, Mycobacterium tuberculosis
ELLPFRRNLAFYGLDLG

SEQ ID NO: 1534597 - protein, 17 aa, Mycobacterium tuberculosis
ELMAWAIPRAANRFWML

SEQ ID NO: 1534598 - protein, 19 aa, Mycobacterium tuberculosis
ELMPLPIALAHRLSRRLTE

SEQ ID NO: 1534599 - protein, 19 aa, Mycobacterium tuberculosis
ELMWGLRGGGGNFGIVTEF

SEQ ID NO: 1534600 - protein, 19 aa, Mycobacterium tuberculosis
ELNSLRMFTGAGSAPMLAA

SEQ ID NO: 1534601 - protein, 17 aa, Mycobacterium tuberculosis
ELPAMMLQFLRTGSGAT

SEQ ID NO: 1534602 - protein, 17 aa, Mycobacterium tuberculosis
ELPLCALLTAWVRGQAR

SEQ ID NO: 1534603 - protein, 23 aa, Mycobacterium tuberculosis
ELRRLIPPWVTLGSRLAALPRPK

SEQ ID NO: 1534604 - protein, 23 aa, Mycobacterium tuberculosis
ELSAVVMAPMYLGLRVWSRATIG

SEQ ID NO: 1534605 - protein, 17 aa, Mycobacterium tuberculosis
ELYEKFFRIGFKKQAEA

SEQ ID NO: 1534606 - protein, 17 aa, Mycobacterium tuberculosis
EMNFLPDVYMPCEVCQG

SEQ ID NO: 1534607 - protein, 21 aa, Mycobacterium tuberculosis
EPGIPAWRRILDDLSYEPVMA

SEQ ID NO: 1534608 - protein, 19 aa, Mycobacterium tuberculosis
EPGLFTQPRHRIGAVGGLV

SEQ ID NO: 1534609 - protein, 17 aa, Mycobacterium tuberculosis
EPHPTIPTTPWQHTHHW

SEQ ID NO: 1534610 - protein, 19 aa, Mycobacterium tuberculosis
EPLLAYLRKMVFWSMVTPR

SEQ ID NO: 1534611 - protein, 19 aa, Mycobacterium tuberculosis
EQARDICRCSQAGVVDARD

SEQ ID NO: 1534612 - protein, 23 aa, Mycobacterium tuberculosis
EQNAWWWDVLKFGRSSAYAEFFD

SEQ ID NO: 1534613 - protein, 20 aa, Mycobacterium tuberculosis
EQVAFLLWRGELPTDAELAL

SEQ ID NO: 1534614 - protein, 19 aa, Mycobacterium tuberculosis
ERADWWWYEPFQPQPPPIS

SEQ ID NO: 1534615 - protein, 22 aa, Mycobacterium tuberculosis
ERDLRVIIHGWLAFTFELCRQR

SEQ ID NO: 1534616 - protein, 22 aa, Mycobacterium tuberculosis
ERDYILELLLAHTSAGLPYERC

SEQ ID NO: 1534617 - protein, 22 aa, Mycobacterium tuberculosis
ERGRKLLTMRLPRALFQPSSDP

SEQ ID NO: 1534618 - protein, 17 aa, Mycobacterium tuberculosis
ERPLWAWLVLEPGDISV

SEQ ID NO: 1534619 - protein, 19 aa, Mycobacterium tuberculosis
ERRGPAAVRPFGQAGGGRA

SEQ ID NO: 1534620 - protein, 21 aa, Mycobacterium tuberculosis
ERYKLVWKNRLGFARLAIQHG

SEQ ID NO: 1534621 - protein, 24 aa, Mycobacterium tuberculosis
ESNPLPPPWYPQPASLPAAGATGQ

SEQ ID NO: 1534622 - protein, 19 aa, Mycobacterium tuberculosis
ETELMAWAIPRAANRFWML

SEQ ID NO: 1534623 - protein, 20 aa, Mycobacterium tuberculosis
ETELMAWAIPRAANRFWMLN

SEQ ID NO: 1534624 - protein, 19 aa, Mycobacterium tuberculosis
ETFHIAQLLPWIEANFRTY

SEQ ID NO: 1534625 - protein, 22 aa, Mycobacterium tuberculosis
ETLEEYWWAAEQMLTWPDPDKP

SEQ ID NO: 1534626 - protein, 17 aa, Mycobacterium tuberculosis
ETVYLVHRLPAWSRNLT

SEQ ID NO: 1534627 - protein, 21 aa, Mycobacterium tuberculosis
EVLEWRYPVLLREFAVRQGSG

SEQ ID NO: 1534628 - protein, 23 aa, Mycobacterium tuberculosis
FAGDLLFIGCTPIVWAGPIANWV

SEQ ID NO: 1534629 - protein, 21 aa, Mycobacterium tuberculosis
FARPSPAPWPTRPAPSASRCT

SEQ ID NO: 1534630 - protein, 19 aa, Mycobacterium tuberculosis
FDCSGLVMWAFQQAGIALP

SEQ ID NO: 1534631 - protein, 18 aa, Mycobacterium tuberculosis
FDGGWWVLGIRTPTAAEC

SEQ ID NO: 1534632 - protein, 18 aa, Mycobacterium tuberculosis
FDLLPTSYLFQPGHRIRI

SEQ ID NO: 1534633 - protein, 24 aa, Mycobacterium tuberculosis
FDQPLLALRIPWYVTVLDLGSAGA

SEQ ID NO: 1534634 - protein, 17 aa, Mycobacterium tuberculosis
FDVNLWAPLMWTSLVVT

SEQ ID NO: 1534635 - protein, 24 aa, Mycobacterium tuberculosis
FDVNLWAPLMWTSLVVTAWMGEHG

SEQ ID NO: 1534636 - protein, 18 aa, Mycobacterium tuberculosis
FEYQALLFIPSHAPFDLF

SEQ ID NO: 1534637 - protein, 18 aa, Mycobacterium tuberculosis
FFVHFAPGATHAPHHVPR

SEQ ID NO: 1534638 - protein, 18 aa, Mycobacterium tuberculosis
FFVYFAPGVTHAPHHVPR

SEQ ID NO: 1534639 - protein, 17 aa, Mycobacterium tuberculosis
FGDVFLGWLVRGVVGFP

SEQ ID NO: 1534640 - protein, 20 aa, Mycobacterium tuberculosis
FGGFGGLLLGADGYNAPEST

SEQ ID NO: 1534641 - protein, 26 aa, Mycobacterium tuberculosis
FGGRLGFRLGFRFLFHHVTRQDLAHH

SEQ ID NO: 1534642 - protein, 19 aa, Mycobacterium tuberculosis
FGLLPLRWALACLLIDIGT

SEQ ID NO: 1534643 - protein, 19 aa, Mycobacterium tuberculosis
FGNGGAINLGFGNSGQLNA

SEQ ID NO: 1534644 - protein, 23 aa, Mycobacterium tuberculosis
FGTRWYGYFLRRLAERPANLAFF

SEQ ID NO: 1534645 - protein, 17 aa, Mycobacterium tuberculosis
FGVGHIWRRIRAANLPI

SEQ ID NO: 1534646 - protein, 17 aa, Mycobacterium tuberculosis
FHDRFVQLLNAGGGSYA

SEQ ID NO: 1534647 - protein, 18 aa, Mycobacterium tuberculosis
FHEQFVQLMSAGAAQYAS

SEQ ID NO: 1534648 - protein, 17 aa, Mycobacterium tuberculosis
FHERFIQALSTAAGAYG

SEQ ID NO: 1534649 - protein, 18 aa, Mycobacterium tuberculosis
FHERFIQALSTAAGAYGS

SEQ ID NO: 1534650 - protein, 17 aa, Mycobacterium tuberculosis
FHWVLAFADSGLLTSAV

SEQ ID NO: 1534651 - protein, 17 aa, Mycobacterium tuberculosis
FIMLIAENHWRVAEEPV

SEQ ID NO: 1534652 - protein, 17 aa, Mycobacterium tuberculosis
FIPAFLRYDLRPVTGEW

SEQ ID NO: 1534653 - protein, 18 aa, Mycobacterium tuberculosis
FIPAFLRYDLRPVTGEWQ

SEQ ID NO: 1534654 - protein, 18 aa, Mycobacterium tuberculosis
FISIFVQPLTAGAGSYAA

SEQ ID NO: 1534655 - protein, 18 aa, Mycobacterium tuberculosis
FITAVRLLAERLGVRQTI

SEQ ID NO: 1534656 - protein, 17 aa, Mycobacterium tuberculosis
FIYLMQNLPQERISIAI

SEQ ID NO: 1534657 - protein, 19 aa, Mycobacterium tuberculosis
FKDHLYIAGRIKDLVIIDG

SEQ ID NO: 1534658 - protein, 23 aa, Mycobacterium tuberculosis
FLALIRSNWLGLNAPWIAAVESL

SEQ ID NO: 1534659 - protein, 17 aa, Mycobacterium tuberculosis
FLDWLVGLAFPCQRPFG

SEQ ID NO: 1534660 - protein, 17 aa, Mycobacterium tuberculosis
FLEPFRLSDPFITIDAF

SEQ ID NO: 1534661 - protein, 18 aa, Mycobacterium tuberculosis
FLHRAFDQLLFDIGLHRL

SEQ ID NO: 1534662 - protein, 18 aa, Mycobacterium tuberculosis
FLPLLRRLGRFLPADVRI

SEQ ID NO: 1534663 - protein, 19 aa, Mycobacterium tuberculosis
FLRRFSLLDSLYMVPSVPI

SEQ ID NO: 1534664 - protein, 17 aa, Mycobacterium tuberculosis
FLTPRNSLRQRCVAHRL

SEQ ID NO: 1534665 - protein, 17 aa, Mycobacterium tuberculosis
FNDAWMSSYGFLRSRLD

SEQ ID NO: 1534666 - protein, 17 aa, Mycobacterium tuberculosis
FQALFGRPLIGDGANGA

SEQ ID NO: 1534667 - protein, 17 aa, Mycobacterium tuberculosis
FQILPISSTLGLGTGPP

SEQ ID NO: 1534668 - protein, 25 aa, Mycobacterium tuberculosis
FQVVSIPTLILFKDGQPVKRIVGAK

SEQ ID NO: 1534669 - protein, 17 aa, Mycobacterium tuberculosis
FRMWLRDAVRRVATGVL

SEQ ID NO: 1534670 - protein, 18 aa, Mycobacterium tuberculosis
FRRLELARFLAALHATVL

SEQ ID NO: 1534671 - protein, 18 aa, Mycobacterium tuberculosis
FSLAMLPGGRRRALLTGT

SEQ ID NO: 1534672 - protein, 18 aa, Mycobacterium tuberculosis
FTFMTPAAFVRRPGRWVR

SEQ ID NO: 1534673 - protein, 20 aa, Mycobacterium tuberculosis
FTIPGFTIPAAPLPLTIDID

SEQ ID NO: 1534674 - protein, 22 aa, Mycobacterium tuberculosis
FTNIYFYTVLYHALRASNRIAI

SEQ ID NO: 1534675 - protein, 18 aa, Mycobacterium tuberculosis
FTYRDVLGFLYAQAKFQL

SEQ ID NO: 1534676 - protein, 28 aa, Mycobacterium tuberculosis
FVAKGLQFPIVYLPFAFNRNVRSDDILL

SEQ ID NO: 1534677 - protein, 22 aa, Mycobacterium tuberculosis
FVVPFLHPDLVWDFRLPRVVSI

SEQ ID NO: 1534678 - protein, 18 aa, Mycobacterium tuberculosis
FWPDFPCDGLYKFRVHGA

SEQ ID NO: 1534679 - protein, 18 aa, Mycobacterium tuberculosis
FYLRPIVRPVILVAGGTG

SEQ ID NO: 1534680 - protein, 24 aa, Mycobacterium tuberculosis
FYRWTQWIFLQIYNAWFDTTANKA

SEQ ID NO: 1534681 - protein, 24 aa, Mycobacterium tuberculosis
GAAGGAGGRLFGNGGAGGNGGTAG

SEQ ID NO: 1534682 - protein, 24 aa, Mycobacterium tuberculosis
GAEASWVVGITWWSAVVGGFQMSF

SEQ ID NO: 1534683 - protein, 19 aa, Mycobacterium tuberculosis
GAGFSRALIVAGDNGGDPG

SEQ ID NO: 1534684 - protein, 19 aa, Mycobacterium tuberculosis
GAGGLLFGDGGNGGAGGAG

SEQ ID NO: 1534685 - protein, 19 aa, Mycobacterium tuberculosis
GAGGLLFGNGGNGGNAGAG

SEQ ID NO: 1534686 - protein, 19 aa, Mycobacterium tuberculosis
GAGGMLYGAGGVGGNGGAA

SEQ ID NO: 1534687 - protein, 23 aa, Mycobacterium tuberculosis
GAGGNGGWLYGNGGLGGNGGAAT

SEQ ID NO: 1534688 - protein, 26 aa, Mycobacterium tuberculosis
GAGGTAGWFFGFGGNGGAGGIGVAGI

SEQ ID NO: 1534689 - protein, 21 aa, Mycobacterium tuberculosis
GAGNPWRQRWPTAACGTATVA

SEQ ID NO: 1534690 - protein, 17 aa, Mycobacterium tuberculosis
GAGPRRNLLRHKQVGFD

SEQ ID NO: 1534691 - protein, 17 aa, Mycobacterium tuberculosis
GAGSIGFNASAPGAAGS

SEQ ID NO: 1534692 - protein, 22 aa, Mycobacterium tuberculosis
GAGVAGGWLYGDGGAGGAGGGG

SEQ ID NO: 1534693 - protein, 22 aa, Mycobacterium tuberculosis
GAHGTLFSSLAGTGGTGGNGGT

SEQ ID NO: 1534694 - protein, 31 aa, Mycobacterium tuberculosis
GAHYAITVPQIPLLNFSLNIPVNIPIHLDFG

SEQ ID NO: 1534695 - protein, 17 aa, Mycobacterium tuberculosis
GAKGAHGFTPTSGGDGG

SEQ ID NO: 1534696 - protein, 21 aa, Mycobacterium tuberculosis
GALNQAGFFGTGGKGGNGGNG

SEQ ID NO: 1534697 - protein, 17 aa, Mycobacterium tuberculosis
GAPPPRSIGGGDGGDGG

SEQ ID NO: 1534698 - protein, 17 aa, Mycobacterium tuberculosis
GARGALTSGGLAGGVGA

SEQ ID NO: 1534699 - protein, 17 aa, Mycobacterium tuberculosis
GARLRRRAVTVATAATV

SEQ ID NO: 1534700 - protein, 23 aa, Mycobacterium tuberculosis
GARQRLMCRLPKRPDPHAWLGDA

SEQ ID NO: 1534701 - protein, 18 aa, Mycobacterium tuberculosis
GASRRWRPIWRVSGRRSA

SEQ ID NO: 1534702 - protein, 22 aa, Mycobacterium tuberculosis
GATGTLTFFGSGGDGGPGGAGA

SEQ ID NO: 1534703 - protein, 27 aa, Mycobacterium tuberculosis
GAVHYPWLPLRRLLLDHYPSIERIASV

SEQ ID NO: 1534704 - protein, 19 aa, Mycobacterium tuberculosis
GCGCYFDDVYWITFAGIAT

SEQ ID NO: 1534705 - protein, 18 aa, Mycobacterium tuberculosis
GCHTMSLDWVAWRGLGLA

SEQ ID NO: 1534706 - protein, 18 aa, Mycobacterium tuberculosis
GCSSRFPYYLETYGFHSI

SEQ ID NO: 1534707 - protein, 28 aa, Mycobacterium tuberculosis
GDGGNGGLPIYWLHQRRQRRQRAAHRQR

SEQ ID NO: 1534708 - protein, 20 aa, Mycobacterium tuberculosis
GDGGWLFGSGGNGAPGAAGQ

SEQ ID NO: 1534709 - protein, 17 aa, Mycobacterium tuberculosis
GDLAWQPPLWRALVTTV

SEQ ID NO: 1534710 - protein, 24 aa, Mycobacterium tuberculosis
GDTKLGLFPFRRNLSLLRRRPGVA

SEQ ID NO: 1534711 - protein, 22 aa, Mycobacterium tuberculosis
GEIELLPITKFFPATDVAILFR

SEQ ID NO: 1534712 - protein, 17 aa, Mycobacterium tuberculosis
GERLVFGPVALGLVPVT

SEQ ID NO: 1534713 - protein, 24 aa, Mycobacterium tuberculosis
GETLEEYWWAAEQMLTWPDPDKSA

SEQ ID NO: 1534714 - protein, 24 aa, Mycobacterium tuberculosis
GETRDLFLTLLLVSGVGPRLAMAA

SEQ ID NO: 1534715 - protein, 22 aa, Mycobacterium tuberculosis
GEVRYFIDRLAGWYVITSSDRM

SEQ ID NO: 1534716 - protein, 17 aa, Mycobacterium tuberculosis
GFEPLQWVRALAAEDPV

SEQ ID NO: 1534717 - protein, 18 aa, Mycobacterium tuberculosis
GFFCWFRVGSDVLVDNAF

SEQ ID NO: 1534718 - protein, 18 aa, Mycobacterium tuberculosis
GFGGSGGRGGLLLGTGGA

SEQ ID NO: 1534719 - protein, 20 aa, Mycobacterium tuberculosis
GFGVPWLYNYIGQPWKTQRT

SEQ ID NO: 1534720 - protein, 17 aa, Mycobacterium tuberculosis
GFPLGWVHDVVWAPRPI

SEQ ID NO: 1534721 - protein, 20 aa, Mycobacterium tuberculosis
GFTIPTVPIHIGLPLSLTIP

SEQ ID NO: 1534722 - protein, 21 aa, Mycobacterium tuberculosis
GFTWARQLPWLTLLGAVYTYD

SEQ ID NO: 1534723 - protein, 23 aa, Mycobacterium tuberculosis
GGAGAWFGNVAPAASAGGGGRGT

SEQ ID NO: 1534724 - protein, 17 aa, Mycobacterium tuberculosis
GGAGGAGGWLIGQSGST

SEQ ID NO: 1534725 - protein, 19 aa, Mycobacterium tuberculosis
GGAGGAGGWLSGHSGAHGA

SEQ ID NO: 1534726 - protein, 21 aa, Mycobacterium tuberculosis
GGAGGLGFGSEAPGRPGGAGG

SEQ ID NO: 1534727 - protein, 20 aa, Mycobacterium tuberculosis
GGAGGLLFGDGGNGGAGGAG

SEQ ID NO: 1534728 - protein, 21 aa, Mycobacterium tuberculosis
GGAGGLLFGDGGNGGAGGAGG

SEQ ID NO: 1534729 - protein, 20 aa, Mycobacterium tuberculosis
GGAGGMLYGAGGVGGNGGAA

SEQ ID NO: 1534730 - protein, 27 aa, Mycobacterium tuberculosis
GGAGGPALTSLLPVTGPTGQRSGHIFL

SEQ ID NO: 1534731 - protein, 17 aa, Mycobacterium tuberculosis
GGAIFNAGTPGAAGTGG

SEQ ID NO: 1534732 - protein, 25 aa, Mycobacterium tuberculosis
GGDAPLIGWAATAGPAVSLLLKTVA

SEQ ID NO: 1534733 - protein, 24 aa, Mycobacterium tuberculosis
GGDGFTYLADFDGEPGGDGGDGGD

SEQ ID NO: 1534734 - protein, 17 aa, Mycobacterium tuberculosis
GGGAGLFYGFGGAGGNG

SEQ ID NO: 1534735 - protein, 27 aa, Mycobacterium tuberculosis
GGGALNQAGFFGTGGKRRVTAGNGGAR

SEQ ID NO: 1534736 - protein, 26 aa, Mycobacterium tuberculosis
GGGGVVYCFFFFFVKERGGSGRAVLC

SEQ ID NO: 1534737 - protein, 20 aa, Mycobacterium tuberculosis
GGGHGLLGLGGSHGAGGAGG

SEQ ID NO: 1534738 - protein, 24 aa, Mycobacterium tuberculosis
GGGKRLRPLFAYWGWHTVASREPD

SEQ ID NO: 1534739 - protein, 20 aa, Mycobacterium tuberculosis
GGGRGIFGQFGAGGAGGAGG

SEQ ID NO: 1534740 - protein, 22 aa, Mycobacterium tuberculosis
GGGRGIFGQFGAGGAGGAGGVG

SEQ ID NO: 1534741 - protein, 17 aa, Mycobacterium tuberculosis
GGGTATFHEDPVAGVWA

SEQ ID NO: 1534742 - protein, 29 aa, Mycobacterium tuberculosis
GGGTGGAGGHAWLFGHGGTGGIGGGPGGN

SEQ ID NO: 1534743 - protein, 27 aa, Mycobacterium tuberculosis
GGKGADPGGLFPIPGAGGKGGTGGTGG

SEQ ID NO: 1534744 - protein, 18 aa, Mycobacterium tuberculosis
GGKGGSGGLIGRAGSDGG

SEQ ID NO: 1534745 - protein, 21 aa, Mycobacterium tuberculosis
GGLTVYSGEWWHFDGPGAGVD

SEQ ID NO: 1534746 - protein, 17 aa, Mycobacterium tuberculosis
GGNAGLLGVGGAGGHGA

SEQ ID NO: 1534747 - protein, 20 aa, Mycobacterium tuberculosis
GGNAGLLIGAAGLGGCGGGA

SEQ ID NO: 1534748 - protein, 24 aa, Mycobacterium tuberculosis
GGNAVIPGDGVGKAPHGDAGGSGG

SEQ ID NO: 1534749 - protein, 19 aa, Mycobacterium tuberculosis
GGNGGHGGLWIGNGGDGGA

SEQ ID NO: 1534750 - protein, 25 aa, Mycobacterium tuberculosis
GGNGGRGGWLLGNGGAGGVGGVGGA

SEQ ID NO: 1534751 - protein, 17 aa, Mycobacterium tuberculosis
GGNGGSWLAAGDGGAGG

SEQ ID NO: 1534752 - protein, 21 aa, Mycobacterium tuberculosis
GGNGGWLLGNGGHGGAGGIGG

SEQ ID NO: 1534753 - protein, 25 aa, Mycobacterium tuberculosis
GGPGGGHGLLGLGGSHGAGGAGGSG

SEQ ID NO: 1534754 - protein, 25 aa, Mycobacterium tuberculosis
GGPGSWLLAVPPYHIAGLAVLVRSV

SEQ ID NO: 1534755 - protein, 26 aa, Mycobacterium tuberculosis
GGPPIVFQLLWYPSTLWDQSLPSLAE

SEQ ID NO: 1534756 - protein, 17 aa, Mycobacterium tuberculosis
GGPSDRRFIWQRGARRH

SEQ ID NO: 1534757 - protein, 24 aa, Mycobacterium tuberculosis
GGPTLIDLLMALFGLSTNADLGGA

SEQ ID NO: 1534758 - protein, 23 aa, Mycobacterium tuberculosis
GGQAALLFGRGGTGGAGGYGGDG

SEQ ID NO: 1534759 - protein, 19 aa, Mycobacterium tuberculosis
GGRGLLVLLDALRSTICGQ

SEQ ID NO: 1534760 - protein, 20 aa, Mycobacterium tuberculosis
GGTGGFAGFGGTAGNGGSGG

SEQ ID NO: 1534761 - protein, 31 aa, Mycobacterium tuberculosis
GGTGGTAHLGPLAIIGQSGQPGQFGSPGADG

SEQ ID NO: 1534762 - protein, 23 aa, Mycobacterium tuberculosis
GGTYNLFHYSLAKLGIEVSFVDD

SEQ ID NO: 1534763 - protein, 19 aa, Mycobacterium tuberculosis
GGVSGLLLGLDGFNAPAST

SEQ ID NO: 1534764 - protein, 31 aa, Mycobacterium tuberculosis
GGYPPPTSNALLFLPARLPATALPATTRAIA

SEQ ID NO: 1534765 - protein, 21 aa, Mycobacterium tuberculosis
GHGGLWIGNGGDGGAGGVGGV

SEQ ID NO: 1534766 - protein, 18 aa, Mycobacterium tuberculosis
GHLAARLATLGPAATLAR

SEQ ID NO: 1534767 - protein, 20 aa, Mycobacterium tuberculosis
GHRRRRGPPGAPGGHRCSGP

SEQ ID NO: 1534768 - protein, 21 aa, Mycobacterium tuberculosis
GHSMFPWLTLALVGNSTSSIL

SEQ ID NO: 1534769 - protein, 24 aa, Mycobacterium tuberculosis
GIDSPELLWKALLRGDDLITEVPP

SEQ ID NO: 1534770 - protein, 17 aa, Mycobacterium tuberculosis
GILTEHYAGAFPAWLAP

SEQ ID NO: 1534771 - protein, 19 aa, Mycobacterium tuberculosis
GIPVLAWALPQPIADRLNA

SEQ ID NO: 1534772 - protein, 19 aa, Mycobacterium tuberculosis
GIVPAVLHYAIHYTSAGAG

SEQ ID NO: 1534773 - protein, 23 aa, Mycobacterium tuberculosis
GKAGPAGSILHDGRQRAVTGGHG

SEQ ID NO: 1534774 - protein, 23 aa, Mycobacterium tuberculosis
GKLLRLWRPPLRPGEWRTLGLFA

SEQ ID NO: 1534775 - protein, 22 aa, Mycobacterium tuberculosis
GKPATAVLLLPSLRSAPRDSPE

SEQ ID NO: 1534776 - protein, 17 aa, Mycobacterium tuberculosis
GLALPMRLALPGSVNRG

SEQ ID NO: 1534777 - protein, 23 aa, Mycobacterium tuberculosis
GLASRYIRLLPRGLVKRVVPKPG

SEQ ID NO: 1534778 - protein, 19 aa, Mycobacterium tuberculosis
GLATPVTPAANGGNGLNLV

SEQ ID NO: 1534779 - protein, 22 aa, Mycobacterium tuberculosis
GLDCRAYRLGWQPGTTVFEIDV

SEQ ID NO: 1534780 - protein, 25 aa, Mycobacterium tuberculosis
GLFGSWHYWWQAHLLDCLVDAQLRD

SEQ ID NO: 1534781 - protein, 18 aa, Mycobacterium tuberculosis
GLFPFRRNLSLYAVDLAL

SEQ ID NO: 1534782 - protein, 23 aa, Mycobacterium tuberculosis
GLIGLPLLGIPVTPGYFNLTGGP

SEQ ID NO: 1534783 - protein, 25 aa, Mycobacterium tuberculosis
GLINGPAQTLLGRPLIGNGADGAPG

SEQ ID NO: 1534784 - protein, 17 aa, Mycobacterium tuberculosis
GLLLGLDGANAPASTNP

SEQ ID NO: 1534785 - protein, 19 aa, Mycobacterium tuberculosis
GLLPTWGLSVRLPQKVGIG

SEQ ID NO: 1534786 - protein, 18 aa, Mycobacterium tuberculosis
GLLRFTVGLAQITSLLLA

SEQ ID NO: 1534787 - protein, 19 aa, Mycobacterium tuberculosis
GLLYRQRRGRRVRGARPGR

SEQ ID NO: 1534788 - protein, 19 aa, Mycobacterium tuberculosis
GLMQLLAATNWFGQNAPAL

SEQ ID NO: 1534789 - protein, 19 aa, Mycobacterium tuberculosis
GLNLVGVPGTAGGGADGAN

SEQ ID NO: 1534790 - protein, 21 aa, Mycobacterium tuberculosis
GLPLTLWLARFLKFIATEIFP

SEQ ID NO: 1534791 - protein, 17 aa, Mycobacterium tuberculosis
GLPTVIYPLGAFDPGQL

SEQ ID NO: 1534792 - protein, 17 aa, Mycobacterium tuberculosis
GLRALYLYTATFQDAAV

SEQ ID NO: 1534793 - protein, 17 aa, Mycobacterium tuberculosis
GLWFRNVAMRTMNFGPL

SEQ ID NO: 1534794 - protein, 17 aa, Mycobacterium tuberculosis
GLWGRLLPEWEPIRDLP

SEQ ID NO: 1534795 - protein, 22 aa, Mycobacterium tuberculosis
GMFGNIIRLLPPLTIGDELLSE

SEQ ID NO: 1534796 - protein, 17 aa, Mycobacterium tuberculosis
GMYFVPAFSGLFAPYWR

SEQ ID NO: 1534797 - protein, 20 aa, Mycobacterium tuberculosis
GNAGLWGNGGAGGAGAAGAA

SEQ ID NO: 1534798 - protein, 23 aa, Mycobacterium tuberculosis
GNGATGTWGHNLGAGGTGGNGGN

SEQ ID NO: 1534799 - protein, 17 aa, Mycobacterium tuberculosis
GNGGAINLGFGNSGQLN

SEQ ID NO: 1534800 - protein, 20 aa, Mycobacterium tuberculosis
GNGGWLLGNGGHGGAGGIGG

SEQ ID NO: 1534801 - protein, 23 aa, Mycobacterium tuberculosis
GNYSNGFFWRGDYQGLGGFAYQS

SEQ ID NO: 1534802 - protein, 24 aa, Mycobacterium tuberculosis
GNYSNGFFWRGDYQGLGGFAYQSA

SEQ ID NO: 1534803 - protein, 29 aa, Mycobacterium tuberculosis
GPAAAPAPAAPNGFGGRPAGPADKGGAGG

SEQ ID NO: 1534804 - protein, 20 aa, Mycobacterium tuberculosis
GPAQTLLGRPLIGNGADGAP

SEQ ID NO: 1534805 - protein, 21 aa, Mycobacterium tuberculosis
GPAVSLLLKTVAGGGQLVLVY

SEQ ID NO: 1534806 - protein, 23 aa, Mycobacterium tuberculosis
GPGSWLLAVPPYHIAGLAVLVRS

SEQ ID NO: 1534807 - protein, 28 aa, Mycobacterium tuberculosis
GPGTPGSPMVAPPPPTPITQVQQGGDGG

SEQ ID NO: 1534808 - protein, 17 aa, Mycobacterium tuberculosis
GPISIPIIDLRPAPGFF

SEQ ID NO: 1534809 - protein, 18 aa, Mycobacterium tuberculosis
GPLPVSPCGVLGPQLQRL

SEQ ID NO: 1534810 - protein, 18 aa, Mycobacterium tuberculosis
GPLQPLFDVINAPTLALL

SEQ ID NO: 1534811 - protein, 24 aa, Mycobacterium tuberculosis
GPMDRFHRRLLWPIRTSAGEVVGF

SEQ ID NO: 1534812 - protein, 18 aa, Mycobacterium tuberculosis
GQCWFWQCRHQQLWLGEH

SEQ ID NO: 1534813 - protein, 22 aa, Mycobacterium tuberculosis
GQDLLMITVLKGAVLFVTDLAR

SEQ ID NO: 1534814 - protein, 25 aa, Mycobacterium tuberculosis
GQGGRFLCTFPFSFEITEGEDRYVV

SEQ ID NO: 1534815 - protein, 21 aa, Mycobacterium tuberculosis
GQPLDWFCLFSSAAALTGSPG

SEQ ID NO: 1534816 - protein, 22 aa, Mycobacterium tuberculosis
GQPLDWFCLFSSAAALTGSPGQ

SEQ ID NO: 1534817 - protein, 22 aa, Mycobacterium tuberculosis
GQPLDWFCLFSSGAALLGSPGQ

SEQ ID NO: 1534818 - protein, 18 aa, Mycobacterium tuberculosis
GQPRLRPPFPAVAGLYGC

SEQ ID NO: 1534819 - protein, 22 aa, Mycobacterium tuberculosis
GQRGFFCWFRVGSDVLVDNAFR

SEQ ID NO: 1534820 - protein, 19 aa, Mycobacterium tuberculosis
GRCPPGFQILPISSTLGLG

SEQ ID NO: 1534821 - protein, 20 aa, Mycobacterium tuberculosis
GRDLLFFSLPGHVPAPVSDR

SEQ ID NO: 1534822 - protein, 19 aa, Mycobacterium tuberculosis
GRFLIGAGPRRNLLRHKQV

SEQ ID NO: 1534823 - protein, 25 aa, Mycobacterium tuberculosis
GRGAHGTLFSSLAGTGGTGGNGGTG

SEQ ID NO: 1534824 - protein, 25 aa, Mycobacterium tuberculosis
GRGGDGVFFSLFLGTFSGNSLSGRG

SEQ ID NO: 1534825 - protein, 20 aa, Mycobacterium tuberculosis
GRGMAFLDLIQEGNLRLIRA

SEQ ID NO: 1534826 - protein, 17 aa, Mycobacterium tuberculosis
GRLLIIDCGVLFPGHDE

SEQ ID NO: 1534827 - protein, 19 aa, Mycobacterium tuberculosis
GRMKFYVFGYPRVPMTAEM

SEQ ID NO: 1534828 - protein, 17 aa, Mycobacterium tuberculosis
GRPAFPVVPAGSADCSS

SEQ ID NO: 1534829 - protein, 24 aa, Mycobacterium tuberculosis
GRQRRRLVAMGPAAAMVRRASAGE

SEQ ID NO: 1534830 - protein, 17 aa, Mycobacterium tuberculosis
GRRARVALLYWQPAAMG

SEQ ID NO: 1534831 - protein, 24 aa, Mycobacterium tuberculosis
GRRRRYGWGWWWRRRGGWQRGPVR

SEQ ID NO: 1534832 - protein, 17 aa, Mycobacterium tuberculosis
GRRWAAAGGVGGDGGRG

SEQ ID NO: 1534833 - protein, 17 aa, Mycobacterium tuberculosis
GRSWPLADVRLLAPILA

SEQ ID NO: 1534834 - protein, 24 aa, Mycobacterium tuberculosis
GRVTTHLIIRFWGRPRPMAVLMIS

SEQ ID NO: 1534835 - protein, 26 aa, Mycobacterium tuberculosis
GRWSAVLVGPWWPAPSAALRAAAQHW

SEQ ID NO: 1534836 - protein, 24 aa, Mycobacterium tuberculosis
GSAHSPQRPPWWARRVRAPTPRPT

SEQ ID NO: 1534837 - protein, 22 aa, Mycobacterium tuberculosis
GSARGLIFALGGAGAAGGDAST

SEQ ID NO: 1534838 - protein, 20 aa, Mycobacterium tuberculosis
GSARLIGAGGHGGDGGAGGN

SEQ ID NO: 1534839 - protein, 23 aa, Mycobacterium tuberculosis
GSDPLLAVPFSYPASLPPFGPVT

SEQ ID NO: 1534840 - protein, 27 aa, Mycobacterium tuberculosis
GSDSLPPLRYWVLPGKRPTRAPARGWT

SEQ ID NO: 1534841 - protein, 18 aa, Mycobacterium tuberculosis
GSGGLIGRAGSDGGVGAG

SEQ ID NO: 1534842 - protein, 18 aa, Mycobacterium tuberculosis
GSGGLLFGSGGAGGIGGA

SEQ ID NO: 1534843 - protein, 17 aa, Mycobacterium tuberculosis
GSLWRLEFLLQSTQDPS

SEQ ID NO: 1534844 - protein, 25 aa, Mycobacterium tuberculosis
GSPGPNMILLVPPASHVFSLGRPPR

SEQ ID NO: 1534845 - protein, 22 aa, Mycobacterium tuberculosis
GSTWARQLPWLTLLGAVYTYDA

SEQ ID NO: 1534846 - protein, 17 aa, Mycobacterium tuberculosis
GTAALVGLTLAPSSQVP

SEQ ID NO: 1534847 - protein, 22 aa, Mycobacterium tuberculosis
GTATFHEDPVAGVWAVGGVGGD

SEQ ID NO: 1534848 - protein, 23 aa, Mycobacterium tuberculosis
GTGGRGGLLMGAGAGGHGGTGGA

SEQ ID NO: 1534849 - protein, 20 aa, Mycobacterium tuberculosis
GTLLGLTVFGDNGGAGVLGD

SEQ ID NO: 1534850 - protein, 21 aa, Mycobacterium tuberculosis
GTPFRPLFTVLAAQLGSDPDG

SEQ ID NO: 1534851 - protein, 17 aa, Mycobacterium tuberculosis
GTYGINWYAFDPGSPFG

SEQ ID NO: 1534852 - protein, 20 aa, Mycobacterium tuberculosis
GVAFDILRRWLLARGYDVAF

SEQ ID NO: 1534853 - protein, 24 aa, Mycobacterium tuberculosis
GVFEGIAVLGLGFGGAAGAGGAAT

SEQ ID NO: 1534854 - protein, 22 aa, Mycobacterium tuberculosis
GVGGAGGLLFGYGGAGGAGGYS

SEQ ID NO: 1534855 - protein, 24 aa, Mycobacterium tuberculosis
GVGPITVLPIQILPTIPLNIHQTF

SEQ ID NO: 1534856 - protein, 17 aa, Mycobacterium tuberculosis
GVIANGSFAPSFVGFGG

SEQ ID NO: 1534857 - protein, 18 aa, Mycobacterium tuberculosis
GVIANGSFAPSFVGFGGN

SEQ ID NO: 1534858 - protein, 17 aa, Mycobacterium tuberculosis
GVKVLPWIPTPAKRILS

SEQ ID NO: 1534859 - protein, 17 aa, Mycobacterium tuberculosis
GVLLLLIPQRTAQVVVQ

SEQ ID NO: 1534860 - protein, 19 aa, Mycobacterium tuberculosis
GVMELLLINHPLDCPMCDK

SEQ ID NO: 1534861 - protein, 25 aa, Mycobacterium tuberculosis
GVPLDAWLRRARSRALIPWASVRAA

SEQ ID NO: 1534862 - protein, 18 aa, Mycobacterium tuberculosis
GVSGLLLGLDGFKLPRAP

SEQ ID NO: 1534863 - protein, 20 aa, Mycobacterium tuberculosis
GVTAYDYMLTLAGRLRPVDL

SEQ ID NO: 1534864 - protein, 22 aa, Mycobacterium tuberculosis
GVWSRLMLDIARWRRRRREELA

SEQ ID NO: 1534865 - protein, 20 aa, Mycobacterium tuberculosis
GWIYLAGRTADWMRVDGENL

SEQ ID NO: 1534866 - protein, 34 aa, Mycobacterium tuberculosis
GWLFHAHWRYSLRQQRWWCLQPWRHTHRIVDGLR

SEQ ID NO: 1534867 - protein, 23 aa, Mycobacterium tuberculosis
GYCGYLPYNLTTSGFRPATFAAI

SEQ ID NO: 1534868 - protein, 18 aa, Mycobacterium tuberculosis
GYHCWVEFFVAGLGWLPA

SEQ ID NO: 1534869 - protein, 25 aa, Mycobacterium tuberculosis
GYIPILGAPWLADLVRRSPWGGMFA

SEQ ID NO: 1534870 - protein, 24 aa, Mycobacterium tuberculosis
GYKFSTYATWWIRQAITPRHGRPG

SEQ ID NO: 1534871 - protein, 19 aa, Mycobacterium tuberculosis
GYTLGNSLRRTLLSSIPGA

SEQ ID NO: 1534872 - protein, 23 aa, Mycobacterium tuberculosis
HARHWRRGWRRWADWPTRGRRRP

SEQ ID NO: 1534873 - protein, 24 aa, Mycobacterium tuberculosis
HASMLFLPVRILTSPITTLASMAR

SEQ ID NO: 1534874 - protein, 17 aa, Mycobacterium tuberculosis
HEKLLFKKGIHLLDCGT

SEQ ID NO: 1534875 - protein, 17 aa, Mycobacterium tuberculosis
HEQFVQLMSAGAAQYAS

SEQ ID NO: 1534876 - protein, 17 aa, Mycobacterium tuberculosis
HFALSGVLTALDDLFGQ

SEQ ID NO: 1534877 - protein, 18 aa, Mycobacterium tuberculosis
HFPGFTIPTVPIHIGLPL

SEQ ID NO: 1534878 - protein, 17 aa, Mycobacterium tuberculosis
HFVWVRDTLRLGGKFPL

SEQ ID NO: 1534879 - protein, 23 aa, Mycobacterium tuberculosis
HGGAGGWLYGNGGAGGFGGAGAV

SEQ ID NO: 1534880 - protein, 23 aa, Mycobacterium tuberculosis
HGGILLITHYTRILRYIHPEYVH

SEQ ID NO: 1534881 - protein, 19 aa, Mycobacterium tuberculosis
HGGLWIGNGGDGGAGGVGG

SEQ ID NO: 1534882 - protein, 19 aa, Mycobacterium tuberculosis
HGGWLWGNGGVGGSGGAGV

SEQ ID NO: 1534883 - protein, 24 aa, Mycobacterium tuberculosis
HGLAILTFWRCRMSFLIASPEALA

SEQ ID NO: 1534884 - protein, 20 aa, Mycobacterium tuberculosis
HGQVLVFWDCYRPHDVQVRM

SEQ ID NO: 1534885 - protein, 23 aa, Mycobacterium tuberculosis
HGRSRLWLFRYQGTPIAFFLNVW

SEQ ID NO: 1534886 - protein, 18 aa, Mycobacterium tuberculosis
HGWIHDELRRRCGGPPIA

SEQ ID NO: 1534887 - protein, 17 aa, Mycobacterium tuberculosis
HHPAALRRAIPGGATSA

SEQ ID NO: 1534888 - protein, 19 aa, Mycobacterium tuberculosis
HHQSGWRRWRRCTDGAWTP

SEQ ID NO: 1534889 - protein, 21 aa, Mycobacterium tuberculosis
HHRLFSHVPWLASQLLGAVEA

SEQ ID NO: 1534890 - protein, 18 aa, Mycobacterium tuberculosis
HIGGPHQLVLGLGGRDRR

SEQ ID NO: 1534891 - protein, 28 aa, Mycobacterium tuberculosis
HILTLSPPILLEKKWLRPTAYMMAKYGM

SEQ ID NO: 1534892 - protein, 27 aa, Mycobacterium tuberculosis
HINTYSMDLFLRIAPELYLKRLCVGGV

SEQ ID NO: 1534893 - protein, 23 aa, Mycobacterium tuberculosis
HLDVPLYWQCWKLDSPIIARITD

SEQ ID NO: 1534894 - protein, 18 aa, Mycobacterium tuberculosis
HLMRRLFFTGGHRGRGHL

SEQ ID NO: 1534895 - protein, 18 aa, Mycobacterium tuberculosis
HLRLPLRDVIWGADADLL

SEQ ID NO: 1534896 - protein, 20 aa, Mycobacterium tuberculosis
HLTLVHKINVLTFAGGLWLR

SEQ ID NO: 1534897 - protein, 21 aa, Mycobacterium tuberculosis
HPAWSRMRPLRSPGPRRGNRV

SEQ ID NO: 1534898 - protein, 18 aa, Mycobacterium tuberculosis
HPVVLALGTRRIPRQPAL

SEQ ID NO: 1534899 - protein, 21 aa, Mycobacterium tuberculosis
HQRACIRGRWFIVAARPGVGK

SEQ ID NO: 1534900 - protein, 18 aa, Mycobacterium tuberculosis
HREEAMARYWRAVPARDY

SEQ ID NO: 1534901 - protein, 18 aa, Mycobacterium tuberculosis
HRFHRRFQWYRGESRPSQ

SEQ ID NO: 1534902 - protein, 17 aa, Mycobacterium tuberculosis
HRGLMNMIFITTIPHHG

SEQ ID NO: 1534903 - protein, 17 aa, Mycobacterium tuberculosis
HRRGLLHTRLIGNGGNG

SEQ ID NO: 1534904 - protein, 22 aa, Mycobacterium tuberculosis
HSRRGLLLLVGRRRRLIKYISQ

SEQ ID NO: 1534905 - protein, 17 aa, Mycobacterium tuberculosis
HTEWLPPPHLDHGQPRT

SEQ ID NO: 1534906 - protein, 21 aa, Mycobacterium tuberculosis
HTKLFYQPLLESIGPTGLEIA

SEQ ID NO: 1534907 - protein, 19 aa, Mycobacterium tuberculosis
HTRKVLDLTIRLAEVMLSS

SEQ ID NO: 1534908 - protein, 18 aa, Mycobacterium tuberculosis
HVFSLGRPPRPLPFSAVS

SEQ ID NO: 1534909 - protein, 17 aa, Mycobacterium tuberculosis
HVLPAWIGLVTLAAQEP

SEQ ID NO: 1534910 - protein, 19 aa, Mycobacterium tuberculosis
HWPAFRHVDFLRALRDYSA

SEQ ID NO: 1534911 - protein, 19 aa, Mycobacterium tuberculosis
HYYMFLTQDLPLLQPIRAI

SEQ ID NO: 1534912 - protein, 17 aa, Mycobacterium tuberculosis
IAAVIPPGSDSVSVCNT

SEQ ID NO: 1534913 - protein, 24 aa, Mycobacterium tuberculosis
IAEGGWVLPYLPKPWGRAASPVEQ

SEQ ID NO: 1534914 - protein, 18 aa, Mycobacterium tuberculosis
IAIDLYLPAGLTSAARLP

SEQ ID NO: 1534915 - protein, 17 aa, Mycobacterium tuberculosis
IARCRSRARYWGCGCAG

SEQ ID NO: 1534916 - protein, 19 aa, Mycobacterium tuberculosis
IARRVFATCRRLGLGTVAV

SEQ ID NO: 1534917 - protein, 25 aa, Mycobacterium tuberculosis
ICASFDILWLVIRALSDLAGADSGV

SEQ ID NO: 1534918 - protein, 22 aa, Mycobacterium tuberculosis
ICSPSPSCRAMFSPTVSAPSTA

SEQ ID NO: 1534919 - protein, 19 aa, Mycobacterium tuberculosis
IDHIIGLFRLWWIPDGAPP

SEQ ID NO: 1534920 - protein, 18 aa, Mycobacterium tuberculosis
IDKWNFTVPFVCGATNLG

SEQ ID NO: 1534921 - protein, 23 aa, Mycobacterium tuberculosis
IDLRKTYLFAFLDDHSRLVPGYR

SEQ ID NO: 1534922 - protein, 17 aa, Mycobacterium tuberculosis
IDPDYLRRILTAVLDNA

SEQ ID NO: 1534923 - protein, 22 aa, Mycobacterium tuberculosis
IDSPELLWKALLRGDDLITEVP

SEQ ID NO: 1534924 - protein, 23 aa, Mycobacterium tuberculosis
IDSPELLWKALLRGDDLITEVPP

SEQ ID NO: 1534925 - protein, 18 aa, Mycobacterium tuberculosis
IEKKPLNHFLLGSATLSF

SEQ ID NO: 1534926 - protein, 23 aa, Mycobacterium tuberculosis
IEPSPYLPTSRRFVNPLYLRVEA

SEQ ID NO: 1534927 - protein, 18 aa, Mycobacterium tuberculosis
IERGLWLTALLQATLSTV

SEQ ID NO: 1534928 - protein, 22 aa, Mycobacterium tuberculosis
IERLRKLWDVPALAFVGIGNGT

SEQ ID NO: 1534929 - protein, 19 aa, Mycobacterium tuberculosis
IFTKSPLFVAPFSYSLFYE

SEQ ID NO: 1534930 - protein, 17 aa, Mycobacterium tuberculosis
IGAPWLVAFAERSRFFE

SEQ ID NO: 1534931 - protein, 30 aa, Mycobacterium tuberculosis; identical to SEQ ID NO: 228543

SEQ ID NO: 1534932 - protein, 19 aa, Mycobacterium tuberculosis
IGLLRWWPAATADIGGLSA

SEQ ID NO: 1534933 - protein, 18 aa, Mycobacterium tuberculosis
IGPLTIIPITLFAQQTFV

SEQ ID NO: 1534934 - protein, 17 aa, Mycobacterium tuberculosis
IGRLYLIGIPGEPTIVA

SEQ ID NO: 1534935 - protein, 17 aa, Mycobacterium tuberculosis
IGWAAINILANAGAGGA

SEQ ID NO: 1534936 - protein, 20 aa, Mycobacterium tuberculosis
IGWPVIDVKLPALAPMVAAF

SEQ ID NO: 1534937 - protein, 17 aa, Mycobacterium tuberculosis
IHAFWVPEFLFKRDVMP

SEQ ID NO: 1534938 - protein, 20 aa, Mycobacterium tuberculosis
IHDYFWRWDTDWFWCSRSFG

SEQ ID NO: 1534939 - protein, 18 aa, Mycobacterium tuberculosis
IHKLLRIFANPKLPTIGD

SEQ ID NO: 1534940 - protein, 17 aa, Mycobacterium tuberculosis
ILGLLPAGGRITAGRVV

SEQ ID NO: 1534941 - protein, 21 aa, Mycobacterium tuberculosis
ILRVLAMHRFAKAPMLVGGQM

SEQ ID NO: 1534942 - protein, 23 aa, Mycobacterium tuberculosis
INAPTQTLLGRPLIGNGTNGAPG

SEQ ID NO: 1534943 - protein, 18 aa, Mycobacterium tuberculosis
IPEFPIHWTSTGGIGPII

SEQ ID NO: 1534944 - protein, 20 aa, Mycobacterium tuberculosis
IPLPVDWRWPWGEALAVLEN

SEQ ID NO: 1534945 - protein, 17 aa, Mycobacterium tuberculosis
IPTLILWVTSDQPIWAA

SEQ ID NO: 1534946 - protein, 27 aa, Mycobacterium tuberculosis
IQPLPPKRAGLLIRALYRIAKRRFGEV

SEQ ID NO: 1534947 - protein, 17 aa, Mycobacterium tuberculosis
IRALYRIAKRRFGEVPE

SEQ ID NO: 1534948 - protein, 19 aa, Mycobacterium tuberculosis
IRDMLPDWPALAHGPLTLK

SEQ ID NO: 1534949 - protein, 24 aa, Mycobacterium tuberculosis
IRLQHIVFRPLPRHLRRDDQFFRL

SEQ ID NO: 1534950 - protein, 23 aa, Mycobacterium tuberculosis
IRPVAPGLYSWLPLGLRVLRNIE

SEQ ID NO: 1534951 - protein, 23 aa, Mycobacterium tuberculosis
IRSAGAIFVGPWSPVSLGDYCAG

SEQ ID NO: 1534952 - protein, 21 aa, Mycobacterium tuberculosis
IRYIDRFLIYYIRTADRLQRT

SEQ ID NO: 1534953 - protein, 18 aa, Mycobacterium tuberculosis
ISGFFNFGSLMSGFANFD

SEQ ID NO: 1534954 - protein, 17 aa, Mycobacterium tuberculosis
ITDSWYLTSIRAGLEPW

SEQ ID NO: 1534955 - protein, 17 aa, Mycobacterium tuberculosis
ITIPAIPLGIDVSGRLG

SEQ ID NO: 1534956 - protein, 21 aa, Mycobacterium tuberculosis
ITVLPPIHIPPIPVGFAAVGG

SEQ ID NO: 1534957 - protein, 20 aa, Mycobacterium tuberculosis
IVEPHRVLTLPLVRARQPVA

SEQ ID NO: 1534958 - protein, 23 aa, Mycobacterium tuberculosis
IVNTPTQLLLGRPLIGNGANGAP

SEQ ID NO: 1534959 - protein, 20 aa, Mycobacterium tuberculosis
IVVRPIGFEPLQWVRALAAE

SEQ ID NO: 1534960 - protein, 17 aa, Mycobacterium tuberculosis
IWLRPPAPRRQNLPPAP

SEQ ID NO: 1534961 - protein, 21 aa, Mycobacterium tuberculosis
IYDKWLTLGPLIDQFGMTTKG

SEQ ID NO: 1534962 - protein, 24 aa, Mycobacterium tuberculosis
IYGDFFNFYLCDISLKVNGLQPGG

SEQ ID NO: 1534963 - protein, 18 aa, Mycobacterium tuberculosis
KAWFPLTKRWLGFEDAHI

SEQ ID NO: 1534964 - protein, 21 aa, Mycobacterium tuberculosis
KDAQTPTLLFPFAAPRVVGDL

SEQ ID NO: 1534965 - protein, 25 aa, Mycobacterium tuberculosis
KEGHEVLIFRLFHAPPPSVCSRRRV

SEQ ID NO: 1534966 - protein, 22 aa, Mycobacterium tuberculosis
KFEPYRLWQPPLTQPVAIDDLV

SEQ ID NO: 1534967 - protein, 17 aa, Mycobacterium tuberculosis
KFLCLLAGAIQARRVLE

SEQ ID NO: 1534968 - protein, 21 aa, Mycobacterium tuberculosis
KFRFPTFLGAFKYYTSYTLKT

SEQ ID NO: 1534969 - protein, 17 aa, Mycobacterium tuberculosis
KGFHWEPTAAYRRASVT

SEQ ID NO: 1534970 - protein, 18 aa, Mycobacterium tuberculosis
KGGAIFNAGTHGAAGTGG

SEQ ID NO: 1534971 - protein, 23 aa, Mycobacterium tuberculosis
KGLQFPIVYLPFAFNRNVRSDDI

SEQ ID NO: 1534972 - protein, 17 aa, Mycobacterium tuberculosis
KGQFYCSISVPLDLYSC

SEQ ID NO: 1534973 - protein, 25 aa, Mycobacterium tuberculosis
KGRRQPPTVWPSIPVFGCNGGDTGN

SEQ ID NO: 1534974 - protein, 23 aa, Mycobacterium tuberculosis
KGSFYLRPIVRPVILVAGGTGLS

SEQ ID NO: 1534975 - protein, 21 aa, Mycobacterium tuberculosis
KHIAWYLHGFPAGSALRRALA

SEQ ID NO: 1534976 - protein, 18 aa, Mycobacterium tuberculosis
KLGGLWKTVSPRLSPISN

SEQ ID NO: 1534977 - protein, 22 aa, Mycobacterium tuberculosis
KLPDLELIFAPAPFYDEALVPP

SEQ ID NO: 1534978 - protein, 18 aa, Mycobacterium tuberculosis
KLVPDFLWISTEHTARVS

SEQ ID NO: 1534979 - protein, 19 aa, Mycobacterium tuberculosis
KLVRHHLLLPITATRRDLN

SEQ ID NO: 1534980 - protein, 26 aa, Mycobacterium tuberculosis
KPEQNAWWWYVLKFGRSSAYAEFFDI

SEQ ID NO: 1534981 - protein, 19 aa, Mycobacterium tuberculosis
KPVRLPIPWRDVGGYRPTG

SEQ ID NO: 1534982 - protein, 19 aa, Mycobacterium tuberculosis
KQWDRCALHWFPGSHLLAC

SEQ ID NO: 1534983 - protein, 17 aa, Mycobacterium tuberculosis
KRPIPYLPNMIGLITGR

SEQ ID NO: 1534984 - protein, 18 aa, Mycobacterium tuberculosis
KRRRRLTRAPSERSRNPA

SEQ ID NO: 1534985 - protein, 23 aa, Mycobacterium tuberculosis
KTHLPPGAWPPTSWYADWIRGLD

SEQ ID NO: 1534986 - protein, 24 aa, Mycobacterium tuberculosis
KTPAQVLLRWNLQLGNAVVVRSAR

SEQ ID NO: 1534987 - protein, 23 aa, Mycobacterium tuberculosis
KTTMEALWWDRPFALAGVDIGAS

SEQ ID NO: 1534988 - protein, 17 aa, Mycobacterium tuberculosis
KVRLRQGLPFARLGAAE

SEQ ID NO: 1534989 - protein, 17 aa, Mycobacterium tuberculosis
KVRVFMVRLPDATSRQA

SEQ ID NO: 1534990 - protein, 18 aa, Mycobacterium tuberculosis
KWPCFYGIDFPSPAELIA

SEQ ID NO: 1534991 - protein, 26 aa, Mycobacterium tuberculosis
LAAINAPTQALLGRPLIGNGADGAPG

SEQ ID NO: 1534992 - protein, 18 aa, Mycobacterium tuberculosis
LAALYRPMLLRTTNRHHG

SEQ ID NO: 1534993 - protein, 25 aa, Mycobacterium tuberculosis
LAAPVTHIWYFKGVPSRLGYLLDLA

SEQ ID NO: 1534994 - protein, 20 aa, Mycobacterium tuberculosis
LAAVARLRLLWRDSPHLPTD

SEQ ID NO: 1534995 - protein, 26 aa, Mycobacterium tuberculosis
LAAVNAPTQALFGRPLIGNGADGSPG

SEQ ID NO: 1534996 - protein, 22 aa, Mycobacterium tuberculosis
LADPLAFLLRKEGFEATVVTDG

SEQ ID NO: 1534997 - protein, 18 aa, Mycobacterium tuberculosis
LAEMKLLRPLLSAGDYLV

SEQ ID NO: 1534998 - protein, 18 aa, Mycobacterium tuberculosis
LAEWFLRRFSLLDSLYMV

SEQ ID NO: 1534999 - protein, 24 aa, Mycobacterium tuberculosis
LAGPGLVYLLWPVALGYLRVVTHP

SEQ ID NO: 1535000 - protein, 22 aa, Mycobacterium tuberculosis
LAGSIGLFLEPFRLSDPFITID

SEQ ID NO: 1535001 - protein, 25 aa, Mycobacterium tuberculosis
LAGSIGLFLEPFRLSDPFITIDAFQ

SEQ ID NO: 1535002 - protein, 23 aa, Mycobacterium tuberculosis
LALTELWCSYGVRPDLVIGHSMG

SEQ ID NO: 1535003 - protein, 22 aa, Mycobacterium tuberculosis
LAPAAWWRQLSWLPQRPVLVPG

SEQ ID NO: 1535004 - protein, 23 aa, Mycobacterium tuberculosis
LARNAEALYWNRSLRRARRRHRA

SEQ ID NO: 1535005 - protein, 19 aa, Mycobacterium tuberculosis
LAWSRITYWRALLTSAVDQ

SEQ ID NO: 1535006 - protein, 17 aa, Mycobacterium tuberculosis
LAWTYHYPLPVVAPIAG

SEQ ID NO: 1535007 - protein, 24 aa, Mycobacterium tuberculosis
LAYRPVCRPAWLPTLRRPWRRSPE

SEQ ID NO: 1535008 - protein, 17 aa, Mycobacterium tuberculosis
LDAFAHWRRAQGLPATS

SEQ ID NO: 1535009 - protein, 22 aa, Mycobacterium tuberculosis
LDAFTLLPDGFTLDTVPATFDG

SEQ ID NO: 1535010 - protein, 18 aa, Mycobacterium tuberculosis
LDARAYRLPWPAGTVVYE

SEQ ID NO: 1535011 - protein, 19 aa, Mycobacterium tuberculosis
LDIARWRRRRREELAALAD

SEQ ID NO: 1535012 - protein, 18 aa, Mycobacterium tuberculosis
LDTLLRLLHPVIPFLTEA

SEQ ID NO: 1535013 - protein, 18 aa, Mycobacterium tuberculosis
LDVINAPALALMGRPLIG

SEQ ID NO: 1535014 - protein, 28 aa, Mycobacterium tuberculosis
LDVINAPAQTLLGRPLIGNGADGSTPGQ

SEQ ID NO: 1535015 - protein, 17 aa, Mycobacterium tuberculosis
LECGLLRGWLIPPADIK

SEQ ID NO: 1535016 - protein, 22 aa, Mycobacterium tuberculosis
LEFIQFHPTMLFAGRAGGRRPL

SEQ ID NO: 1535017 - protein, 17 aa, Mycobacterium tuberculosis
LELLLAHTSAGLPYERC

SEQ ID NO: 1535018 - protein, 17 aa, Mycobacterium tuberculosis
LENFATRLFIATGSVPL

SEQ ID NO: 1535019 - protein, 17 aa, Mycobacterium tuberculosis
LENGLLTGIRKLARPQL

SEQ ID NO: 1535020 - protein, 18 aa, Mycobacterium tuberculosis
LERLQPTVPILLANLVSV

SEQ ID NO: 1535021 - protein, 18 aa, Mycobacterium tuberculosis
LFGHWWYEGPTWLQRVLR

SEQ ID NO: 1535022 - protein, 18 aa, Mycobacterium tuberculosis
LFGVLFQDGALFGSMNLY

SEQ ID NO: 1535023 - protein, 17 aa, Mycobacterium tuberculosis
LFGVWWIGAQAILDDSP

SEQ ID NO: 1535024 - protein, 17 aa, Mycobacterium tuberculosis
LFIGCTPIVWAGPIANW

SEQ ID NO: 1535025 - protein, 18 aa, Mycobacterium tuberculosis
LFLFDFRDGIELNPIVIP

SEQ ID NO: 1535026 - protein, 17 aa, Mycobacterium tuberculosis
LFPFRRNLSLYAVDLAL

SEQ ID NO: 1535027 - protein, 18 aa, Mycobacterium tuberculosis
LFSLFYSLDVPRITIVDA

SEQ ID NO: 1535028 - protein, 20 aa, Mycobacterium tuberculosis
LFVAAYVPYVAWLVQASADS

SEQ ID NO: 1535029 - protein, 19 aa, Mycobacterium tuberculosis
LFVAAYVPYVAWLVQASSD

SEQ ID NO: 1535030 - protein, 20 aa, Mycobacterium tuberculosis
LGGAGGAGGWLIGQSGSTGG

SEQ ID NO: 1535031 - protein, 25 aa, Mycobacterium tuberculosis
LGGDGFTYLADFDGEPGGDGGDGGD

SEQ ID NO: 1535032 - protein, 28 aa, Mycobacterium tuberculosis
LGGFGGAWRLLFRPNRPGWRVAVAGRLA

SEQ ID NO: 1535033 - protein, 20 aa, Mycobacterium tuberculosis
LGGKGGSGGLIGRAGSDGGV

SEQ ID NO: 1535034 - protein, 25 aa, Mycobacterium tuberculosis
LGGTTTMYMIPSPTLPLLLPLKQIG

SEQ ID NO: 1535035 - protein, 23 aa, Mycobacterium tuberculosis
LGQPLDWFCLFSSGAALLGSPGQ

SEQ ID NO: 1535036 - protein, 17 aa, Mycobacterium tuberculosis
LGRKLFQRGFLEPQRLL

SEQ ID NO: 1535037 - protein, 23 aa, Mycobacterium tuberculosis
LGRVMFNELLPLGYPFVNKQMHK

SEQ ID NO: 1535038 - protein, 25 aa, Mycobacterium tuberculosis
LGVVNAPAQALLGRPLIGNGANGAD

SEQ ID NO: 1535039 - protein, 17 aa, Mycobacterium tuberculosis
LHMLPLADALGVLPVLA

SEQ ID NO: 1535040 - protein, 17 aa, Mycobacterium tuberculosis
LHQVVIGNELPLPPVRS

SEQ ID NO: 1535041 - protein, 22 aa, Mycobacterium tuberculosis
LHTKLFYQPLLESIGPTGLEIA

SEQ ID NO: 1535042 - protein, 24 aa, Mycobacterium tuberculosis
LHVCPQLRLWDWCPTPWTPHGGWV

SEQ ID NO: 1535043 - protein, 19 aa, Mycobacterium tuberculosis
LHYRHEVLYFKVLADHLPE

SEQ ID NO: 1535044 - protein, 20 aa, Mycobacterium tuberculosis
LIAHTLWIAHCWFMEAWDST

SEQ ID NO: 1535045 - protein, 20 aa, Mycobacterium tuberculosis
LKALLDRLLAQKLPDGWDAD

SEQ ID NO: 1535046 - protein, 17 aa, Mycobacterium tuberculosis
LKGLTAHYLLKSVYPVK

SEQ ID NO: 1535047 - protein, 26 aa, Mycobacterium tuberculosis
LLARFPGFYIPFLDVPFNGATPANSP

SEQ ID NO: 1535048 - protein, 19 aa, Mycobacterium tuberculosis
LLARQVGVPYILVALNKAD

SEQ ID NO: 1535049 - protein, 18 aa, Mycobacterium tuberculosis
LLDVAFAHDIRLIASALG

SEQ ID NO: 1535050 - protein, 17 aa, Mycobacterium tuberculosis
LLGLRLRRLRYLRTAAA

SEQ ID NO: 1535051 - protein, 17 aa, Mycobacterium tuberculosis
LLGVGGAGGHGASGGAG

SEQ ID NO: 1535052 - protein, 17 aa, Mycobacterium tuberculosis
LLKIGWPAEDLAGYVDG

SEQ ID NO: 1535053 - protein, 19 aa, Mycobacterium tuberculosis
LLLTFPFPNFGIKQAVRGD

SEQ ID NO: 1535054 - protein, 27 aa, Mycobacterium tuberculosis
LLNAINAPTQALLGRPLIGDGADGTAP

SEQ ID NO: 1535055 - protein, 27 aa, Mycobacterium tuberculosis
LLNLARPWFARRPLPFSRSGRAMEARP

SEQ ID NO: 1535056 - protein, 27 aa, Mycobacterium tuberculosis
LLNLINAPTQALLGRPLIGNGANGLPG

SEQ ID NO: 1535057 - protein, 21 aa, Mycobacterium tuberculosis
LLPTLQSFLPPPFDAIPNPIE

SEQ ID NO: 1535058 - protein, 18 aa, Mycobacterium tuberculosis
LLRDYGLLLPLEPDTRLL

SEQ ID NO: 1535059 - protein, 24 aa, Mycobacterium tuberculosis
LLRKGERLLVFLPLAHVLARAISM

SEQ ID NO: 1535060 - protein, 18 aa, Mycobacterium tuberculosis
LLRNLEFLPNSPTLMNSG

SEQ ID NO: 1535061 - protein, 17 aa, Mycobacterium tuberculosis
LMMGLWVNAVPAANTPD

SEQ ID NO: 1535062 - protein, 17 aa, Mycobacterium tuberculosis
LMQLLAATNWFGQNAPA

SEQ ID NO: 1535063 - protein, 18 aa, Mycobacterium tuberculosis
LMSPMAFLQRPARWMQLL

SEQ ID NO: 1535064 - protein, 29 aa, Mycobacterium tuberculosis
LNALNAPTQALLGRPLIGDGAAGAPGTGQ

SEQ ID NO: 1535065 - protein, 18 aa, Mycobacterium tuberculosis
LNRLPRWRRCFWPSILVR

SEQ ID NO: 1535066 - protein, 22 aa, Mycobacterium tuberculosis
LNRPGYLRFDFNWQGPLTDDQR

SEQ ID NO: 1535067 - protein, 17 aa, Mycobacterium tuberculosis
LPAPFWPVMPSAVAPRR

SEQ ID NO: 1535068 - protein, 17 aa, Mycobacterium tuberculosis
LPDGALMRRAAFGLATE

SEQ ID NO: 1535069 - protein, 19 aa, Mycobacterium tuberculosis
LPEQGAWLQPFRPLSSLLT

SEQ ID NO: 1535070 - protein, 18 aa, Mycobacterium tuberculosis
LPEWFRPGDFFPVPCCFP

SEQ ID NO: 1535071 - protein, 18 aa, Mycobacterium tuberculosis
LPPLPLSPPTALPKDTPA

SEQ ID NO: 1535072 - protein, 17 aa, Mycobacterium tuberculosis
LPRFLFGVFLSEQMIAA

SEQ ID NO: 1535073 - protein, 19 aa, Mycobacterium tuberculosis
LPSLLLPIWDSELGAGLIA

SEQ ID NO: 1535074 - protein, 17 aa, Mycobacterium tuberculosis
LPWEVPLIELGLDSLMA

SEQ ID NO: 1535075 - protein, 18 aa, Mycobacterium tuberculosis
LQHYSVFGLLPIAVGQKT

SEQ ID NO: 1535076 - protein, 18 aa, Mycobacterium tuberculosis
LQIPGISVPAFSLPAITL

SEQ ID NO: 1535077 - protein, 21 aa, Mycobacterium tuberculosis
LQNLAGLPAWLASGAPAAAMT

SEQ ID NO: 1535078 - protein, 22 aa, Mycobacterium tuberculosis
LQRLRLPWWHLWRAAEAAGAAT

SEQ ID NO: 1535079 - protein, 24 aa, Mycobacterium tuberculosis
LQRWRPFGLPPHRWRLAPWYWRGL

SEQ ID NO: 1535080 - protein, 20 aa, Mycobacterium tuberculosis
LRELLPLRRADQAEYLRWAV

SEQ ID NO: 1535081 - protein, 18 aa, Mycobacterium tuberculosis
LRELWGGPFMLKGVMRVD

SEQ ID NO: 1535082 - protein, 18 aa, Mycobacterium tuberculosis
LRFCRYMEALAAYKKYLD

SEQ ID NO: 1535083 - protein, 17 aa, Mycobacterium tuberculosis
LRFPGYFLVVHDITRFC

SEQ ID NO: 1535084 - protein, 20 aa, Mycobacterium tuberculosis
LRKLFNAVGVVFKGTGFYRT

SEQ ID NO: 1535085 - protein, 18 aa, Mycobacterium tuberculosis
LRQWRVRRPRRSRHGRQH

SEQ ID NO: 1535086 - protein, 17 aa, Mycobacterium tuberculosis
LRRRSVRFFGTYDVLLT

SEQ ID NO: 1535087 - protein, 25 aa, Mycobacterium tuberculosis
LRTEKSVMFVIPWGSHWIIGTTDTD

SEQ ID NO: 1535088 - protein, 23 aa, Mycobacterium tuberculosis
LSAQAAMFHEQFVRALAAGGNSY

SEQ ID NO: 1535089 - protein, 17 aa, Mycobacterium tuberculosis
LSFAQRRLWFLDQLQRP

SEQ ID NO: 1535090 - protein, 28 aa, Mycobacterium tuberculosis
LSFASLVFYSAWFKLHHPAAFCAALLRA

SEQ ID NO: 1535091 - protein, 20 aa, Mycobacterium tuberculosis
LSNILLLGPVGDLFPILSIP

SEQ ID NO: 1535092 - protein, 18 aa, Mycobacterium tuberculosis
LSRNTFHWVLAFADSGLL

SEQ ID NO: 1535093 - protein, 23 aa, Mycobacterium tuberculosis
LSTLRLIPWLPGTALVIADLVWA

SEQ ID NO: 1535094 - protein, 25 aa, Mycobacterium tuberculosis
LTIPSFIPEDFTFLDAIFAGYATVG

SEQ ID NO: 1535095 - protein, 17 aa, Mycobacterium tuberculosis
LTLLLFDIGSFAGLAAL

SEQ ID NO: 1535096 - protein, 18 aa, Mycobacterium tuberculosis
LTLPPTLIFDYPTAAELA

SEQ ID NO: 1535097 - protein, 19 aa, Mycobacterium tuberculosis
LTPPARPVARRLFAVRAVV

SEQ ID NO: 1535098 - protein, 18 aa, Mycobacterium tuberculosis
LTVSRLLAPILTPVIYRA

SEQ ID NO: 1535099 - protein, 19 aa, Mycobacterium tuberculosis
LTVSRLLAPILTPVIYRAA

SEQ ID NO: 1535100 - protein, 17 aa, Mycobacterium tuberculosis
LVDFWATWCGPCKMVAP

SEQ ID NO: 1535101 - protein, 18 aa, Mycobacterium tuberculosis
LVNLVRRLATPAWLSYTI

SEQ ID NO: 1535102 - protein, 27 aa, Mycobacterium tuberculosis
LVPEYIGNLLLYFQPDATVTMLDAVEL

SEQ ID NO: 1535103 - protein, 21 aa, Mycobacterium tuberculosis
LVPQHLMRRLFFTAATVDAVT

SEQ ID NO: 1535104 - protein, 18 aa, Mycobacterium tuberculosis
LVVLTRFLPPDDPRVRNT

SEQ ID NO: 1535105 - protein, 19 aa, Mycobacterium tuberculosis
LVYDGLWYSPLKAALEAFV

SEQ ID NO: 1535106 - protein, 19 aa, Mycobacterium tuberculosis
LWIAHCWFMEAWDSTPRIA

SEQ ID NO: 1535107 - protein, 18 aa, Mycobacterium tuberculosis
LYFQLPWLPERSASWVVP

SEQ ID NO: 1535108 - protein, 18 aa, Mycobacterium tuberculosis
LYPAGRLVDAPLPAWTHA

SEQ ID NO: 1535109 - protein, 19 aa, Mycobacterium tuberculosis
LYPAGRLVDAPLPAWTHAR

SEQ ID NO: 1535110 - protein, 18 aa, Mycobacterium tuberculosis
LYRRMWVLRLLDMALEQL

SEQ ID NO: 1535111 - protein, 19 aa, Mycobacterium tuberculosis
MAHFFYIHFGLPTYFKNVF

SEQ ID NO: 1535112 - protein, 22 aa, Mycobacterium tuberculosis
MAHFFYIHFGLPTYFKNVFEGH

SEQ ID NO: 1535113 - protein, 17 aa, Mycobacterium tuberculosis
MALPARPTGGTGGDGAT

SEQ ID NO: 1535114 - protein, 26 aa, Mycobacterium tuberculosis
MARTVFIELLAWQFASPVRWIETQDL

SEQ ID NO: 1535115 - protein, 24 aa, Mycobacterium tuberculosis
MASTMLLFFCQFSDGYGTAGRDYE

SEQ ID NO: 1535116 - protein, 18 aa, Mycobacterium tuberculosis
MAVLWITERCVCSQCGTV

SEQ ID NO: 1535117 - protein, 22 aa, Mycobacterium tuberculosis
MGFYGLSYWYPFQVTALGLGPI

SEQ ID NO: 1535118 - protein, 28 aa, Mycobacterium tuberculosis
MGGPPIVFQLLWYPSTLWDQSLPSLAEN

SEQ ID NO: 1535119 - protein, 23 aa, Mycobacterium tuberculosis
MGHPRWWFDLLTTEPLAFSSLDR

SEQ ID NO: 1535120 - protein, 17 aa, Mycobacterium tuberculosis
MILDFSWLPPEINSARI

SEQ ID NO: 1535121 - protein, 18 aa, Mycobacterium tuberculosis
MIYYPLTTLMMAGIRDIQ

SEQ ID NO: 1535122 - protein, 24 aa, Mycobacterium tuberculosis
MLAELSRLRPLPFRLVLDGTEEIV

SEQ ID NO: 1535123 - protein, 18 aa, Mycobacterium tuberculosis
MLTYNIAGLPFPLSSAIL

SEQ ID NO: 1535124 - protein, 18 aa, Mycobacterium tuberculosis
MLYDNALLLRAYAHWARR

SEQ ID NO: 1535125 - protein, 19 aa, Mycobacterium tuberculosis
MMINLFWLGLKGAPVDRLE

SEQ ID NO: 1535126 - protein, 23 aa, Mycobacterium tuberculosis
MMPHKIILQYLRPLHRRRTPPQP

SEQ ID NO: 1535127 - protein, 19 aa, Mycobacterium tuberculosis
MNNGLLWRADRQGLLAANY

SEQ ID NO: 1535128 - protein, 21 aa, Mycobacterium tuberculosis
MQRVFFGWAQIWRTKSRAAEA

SEQ ID NO: 1535129 - protein, 29 aa, Mycobacterium tuberculosis
MRVLTGPRWRLGARDLAALWRRALTLSGE

SEQ ID NO: 1535130 - protein, 19 aa, Mycobacterium tuberculosis
MSSGFFNFGTGNSGLLVSG

SEQ ID NO: 1535131 - protein, 24 aa, Mycobacterium tuberculosis
MTGAAAPYLGWLSAAAAQAQQAAT

SEQ ID NO: 1535132 - protein, 25 aa, Mycobacterium tuberculosis
MTGWQRLHFRFGFPAPLLEPLAVER

SEQ ID NO: 1535133 - protein, 19 aa, Mycobacterium tuberculosis
MTGWRLGWLLVPTVLRRAV

SEQ ID NO: 1535134 - protein, 20 aa, Mycobacterium tuberculosis
MVRAIWVLRALLREYGRRLT

SEQ ID NO: 1535135 - protein, 17 aa, Mycobacterium tuberculosis
MVRNTYIYPPKPSMRII

SEQ ID NO: 1535136 - protein, 23 aa, Mycobacterium tuberculosis
MVVAAQPYLAWLTYTAESAAHAA

SEQ ID NO: 1535137 - protein, 24 aa, Mycobacterium tuberculosis
NAEQYLWWVPHNVAGLVTALGGRT

SEQ ID NO: 1535138 - protein, 17 aa, Mycobacterium tuberculosis
NAGPAMLPGFNSGFANI

SEQ ID NO: 1535139 - protein, 18 aa, Mycobacterium tuberculosis
NAINAPTQALLGRPLIGD

SEQ ID NO: 1535140 - protein, 22 aa, Mycobacterium tuberculosis
NAPAQTLLGRPLIGNGADGSTP

SEQ ID NO: 1535141 - protein, 21 aa, Mycobacterium tuberculosis
NAPTLALLNRPLIGNGADGTA

SEQ ID NO: 1535142 - protein, 20 aa, Mycobacterium tuberculosis
NAPTMALLGRPLIGHGADGA

SEQ ID NO: 1535143 - protein, 21 aa, Mycobacterium tuberculosis
NAPTMALLRRPQIGHGADEAP

SEQ ID NO: 1535144 - protein, 21 aa, Mycobacterium tuberculosis
NAPTQALLGRPLIGDGADGTA

SEQ ID NO: 1535145 - protein, 21 aa, Mycobacterium tuberculosis
NAPTQTLLGRPLIGNGADGGP

SEQ ID NO: 1535146 - protein, 21 aa, Mycobacterium tuberculosis
NAPTQTLLGRPLIGNGTNGAP

SEQ ID NO: 1535147 - protein, 23 aa, Mycobacterium tuberculosis
NCLAPGMWPAWWLSNDDPGRSGE

SEQ ID NO: 1535148 - protein, 18 aa, Mycobacterium tuberculosis
NEAKWFWFEGNFGAYEEN

SEQ ID NO: 1535149 - protein, 22 aa, Mycobacterium tuberculosis
NEGFFNTGMFNNGIYNSGVAST

SEQ ID NO: 1535150 - protein, 17 aa, Mycobacterium tuberculosis
NFPALVANLPAAIDAAV

SEQ ID NO: 1535151 - protein, 23 aa, Mycobacterium tuberculosis
NFSNGILWRGNFEGLFGLNVGIT

SEQ ID NO: 1535152 - protein, 21 aa, Mycobacterium tuberculosis
NGATGTWGHNLGAGGTGGNGG

SEQ ID NO: 1535153 - protein, 23 aa, Mycobacterium tuberculosis
NGGNGGWLFGAGGTGGIGGTGAP

SEQ ID NO: 1535154 - protein, 18 aa, Mycobacterium tuberculosis
NGGNGLNLVGVPGTAGGG

SEQ ID NO: 1535155 - protein, 17 aa, Mycobacterium tuberculosis
NGGWLYGNGGLGGNGGA

SEQ ID NO: 1535156 - protein, 17 aa, Mycobacterium tuberculosis
NGLTAAVLLQRAGLRTA

SEQ ID NO: 1535157 - protein, 23 aa, Mycobacterium tuberculosis
NGQDFSAFRQLARMADRAATAAT

SEQ ID NO: 1535158 - protein, 17 aa, Mycobacterium tuberculosis
NHFLLGSATLSFGTAGC

SEQ ID NO: 1535159 - protein, 17 aa, Mycobacterium tuberculosis
NILLLGPVGDLFPILSI

SEQ ID NO: 1535160 - protein, 19 aa, Mycobacterium tuberculosis
NINTGFWNAGNLNTGFGSA

SEQ ID NO: 1535161 - protein, 17 aa, Mycobacterium tuberculosis
NLLIYIKGYLDGTLTFR

SEQ ID NO: 1535162 - protein, 31 aa, Mycobacterium tuberculosis
NLLNAINAPTQALLGRPLIGDGAVGTASSPD

SEQ ID NO: 1535163 - protein, 25 aa, Mycobacterium tuberculosis
NLPITLWPGMKIGQLCMLRLTSPSE

SEQ ID NO: 1535164 - protein, 24 aa, Mycobacterium tuberculosis
NLRSLPVPFILNQPPPPPGPVPAP

SEQ ID NO: 1535165 - protein, 18 aa, Mycobacterium tuberculosis
NMWALRALWCAAGLRAVC

SEQ ID NO: 1535166 - protein, 18 aa, Mycobacterium tuberculosis
NNGFLWRGDHQGLIFGSP

SEQ ID NO: 1535167 - protein, 23 aa, Mycobacterium tuberculosis
NNGQLKHHLPPDNAVDVALRPCA

SEQ ID NO: 1535168 - protein, 22 aa, Mycobacterium tuberculosis
NNNWFAAYAYWYFKLYGHEKVK

SEQ ID NO: 1535169 - protein, 31 aa, Mycobacterium tuberculosis
NNTTIIWRRLLWPALYFYLCVHRSLYWSLHV

SEQ ID NO: 1535170 - protein, 20 aa, Mycobacterium tuberculosis
NPVLQLFIDILMRLTKRYVQ

SEQ ID NO: 1535171 - protein, 23 aa, Mycobacterium tuberculosis
NQVDQWLRFLTSWRKDRIATVEN

SEQ ID NO: 1535172 - protein, 19 aa, Mycobacterium tuberculosis
NREVRWRPEHFWKPGTAVD

SEQ ID NO: 1535173 - protein, 18 aa, Mycobacterium tuberculosis
NRILAYVAPILLGGPVTA

SEQ ID NO: 1535174 - protein, 17 aa, Mycobacterium tuberculosis
NSDQSWMILPYDNALNG

SEQ ID NO: 1535175 - protein, 18 aa, Mycobacterium tuberculosis
NSLFITVNCWGRLVTGVG

SEQ ID NO: 1535176 - protein, 17 aa, Mycobacterium tuberculosis
NSRYSAATAATAARLRR

SEQ ID NO: 1535177 - protein, 22 aa, Mycobacterium tuberculosis
NSTLAHLLKFDSILGRLPCDVG

SEQ ID NO: 1535178 - protein, 17 aa, Mycobacterium tuberculosis
NTGFWNAGNLNTGFGSA

SEQ ID NO: 1535179 - protein, 18 aa, Mycobacterium tuberculosis
NTGFWNGGPFNTGFGNGG

SEQ ID NO: 1535180 - protein, 20 aa, Mycobacterium tuberculosis
NTLGSWLPPGPAAVADYPTV

SEQ ID NO: 1535181 - protein, 21 aa, Mycobacterium tuberculosis
NTQYYMFLTQDLPLLQPIRDI

SEQ ID NO: 1535182 - protein, 19 aa, Mycobacterium tuberculosis
NVEFFFLRPKDIAIYVGSG

SEQ ID NO: 1535183 - protein, 17 aa, Mycobacterium tuberculosis
NWIRGFLPPLPPISPPG

SEQ ID NO: 1535184 - protein, 17 aa, Mycobacterium tuberculosis
NWPKPPLPPLPPALPLP

SEQ ID NO: 1535185 - protein, 20 aa, Mycobacterium tuberculosis
NYLYNFWRDAANPRGLWRRT

SEQ ID NO: 1535186 - protein, 21 aa, Mycobacterium tuberculosis
NYSNGFFWRGDYQGLGGFAYQ

SEQ ID NO: 1535187 - protein, 19 aa, Mycobacterium tuberculosis
PAAPPVCPVLSTSAARAAS

SEQ ID NO: 1535188 - protein, 19 aa, Mycobacterium tuberculosis
PADRRALPAALTILRDITA

SEQ ID NO: 1535189 - protein, 32 aa, Mycobacterium tuberculosis
PAGPPGAPVPGWPLAPLPISGRPVAAWMGALN

SEQ ID NO: 1535190 - protein, 17 aa, Mycobacterium tuberculosis
PAKLLEARIGREAMLDQ

SEQ ID NO: 1535191 - protein, 26 aa, Mycobacterium tuberculosis
PAKPLPASIPWTALWLSQAWQQRVLE

SEQ ID NO: 1535192 - protein, 23 aa, Mycobacterium tuberculosis
PAMNFFPARLTAIGLTLPFGEVT

SEQ ID NO: 1535193 - protein, 17 aa, Mycobacterium tuberculosis
PAPLVPLYLRRPDAKPL

SEQ ID NO: 1535194 - protein, 18 aa, Mycobacterium tuberculosis
PAPMLPSWWVAASALPPC

SEQ ID NO: 1535195 - protein, 18 aa, Mycobacterium tuberculosis
PAQALLGRPLIGNGANGA

SEQ ID NO: 1535196 - protein, 19 aa, Mycobacterium tuberculosis
PAQTLLGRPLIGNGADGST

SEQ ID NO: 1535197 - protein, 18 aa, Mycobacterium tuberculosis
PAQYLPWHPGRCAQVFVG

SEQ ID NO: 1535198 - protein, 23 aa, Mycobacterium tuberculosis
PARDVDWWLTFSSAAALLGTPGQ

SEQ ID NO: 1535199 - protein, 18 aa, Mycobacterium tuberculosis
PARWPLPVLPSSRSGPAP

SEQ ID NO: 1535200 - protein, 17 aa, Mycobacterium tuberculosis
PAVAGVLGGMPGAGGNG

SEQ ID NO: 1535201 - protein, 24 aa, Mycobacterium tuberculosis
PAVPAARVPPWARPVRQGRPAAPE

SEQ ID NO: 1535202 - protein, 17 aa, Mycobacterium tuberculosis
PDAFFQFPTSKYGLALD

SEQ ID NO: 1535203 - protein, 17 aa, Mycobacterium tuberculosis
PDAWAFVWVVDPPLFEP

SEQ ID NO: 1535204 - protein, 22 aa, Mycobacterium tuberculosis
PDETWLALQPFLAPAGITGVAD

SEQ ID NO: 1535205 - protein, 17 aa, Mycobacterium tuberculosis
PDLIYIDLHLVHEVTSP

SEQ ID NO: 1535206 - protein, 21 aa, Mycobacterium tuberculosis
PDLLPLLEKVAGTGKPLLIVA

SEQ ID NO: 1535207 - protein, 20 aa, Mycobacterium tuberculosis
PDLSEMPFYGLPGPPGGDAH

SEQ ID NO: 1535208 - protein, 26 aa, Mycobacterium tuberculosis
PDQSVHVISWRWVKFVYIGDSAHPLQ

SEQ ID NO: 1535209 - protein, 21 aa, Mycobacterium tuberculosis
PDSDLKGFDGFDGGSGGAGGD

SEQ ID NO: 1535210 - protein, 18 aa, Mycobacterium tuberculosis
PDTMTWVTALLPVARGVS

SEQ ID NO: 1535211 - protein, 18 aa, Mycobacterium tuberculosis
PEDLPWEVPLIELGLDSL

SEQ ID NO: 1535212 - protein, 18 aa, Mycobacterium tuberculosis
PEIDSLRMYLGAGSAPML

SEQ ID NO: 1535213 - protein, 19 aa, Mycobacterium tuberculosis
PEINSLRMFTGAGSAPMLA

SEQ ID NO: 1535214 - protein, 18 aa, Mycobacterium tuberculosis
PEINSLRMYLGAGSAPML

SEQ ID NO: 1535215 - protein, 23 aa, Mycobacterium tuberculosis
PENVSPLVVWLGSAESRDVTGKV

SEQ ID NO: 1535216 - protein, 25 aa, Mycobacterium tuberculosis
PEQNAWWWYVLKFGRSSAYAEFFDI

SEQ ID NO: 1535217 - protein, 22 aa, Mycobacterium tuberculosis
PEVLEWRYPVLLREFAVRQGSG

SEQ ID NO: 1535218 - protein, 17 aa, Mycobacterium tuberculosis
PFATLPRSLFEATLDLL

SEQ ID NO: 1535219 - protein, 17 aa, Mycobacterium tuberculosis
PFPTFSLGKITIPQIQT

SEQ ID NO: 1535220 - protein, 17 aa, Mycobacterium tuberculosis
PGDWLYFVTIDSQGTTL

SEQ ID NO: 1535221 - protein, 23 aa, Mycobacterium tuberculosis
PGGNPFWHPLAPGGPGGVRNSFF

SEQ ID NO: 1535222 - protein, 17 aa, Mycobacterium tuberculosis
PGGYTIDPLPLHLALNL

SEQ ID NO: 1535223 - protein, 17 aa, Mycobacterium tuberculosis
PGKAPAKLLEARIGREA

SEQ ID NO: 1535224 - protein, 19 aa, Mycobacterium tuberculosis
PGPLRRLIATLPALEVPRP

SEQ ID NO: 1535225 - protein, 18 aa, Mycobacterium tuberculosis
PGPWRLDPLPLVISAADW

SEQ ID NO: 1535226 - protein, 17 aa, Mycobacterium tuberculosis
PGRPPLATYFLPNNRGK

SEQ ID NO: 1535227 - protein, 25 aa, Mycobacterium tuberculosis
PHGWVNLHFSLLPAWRGAAPVQAAI

SEQ ID NO: 1535228 - protein, 26 aa, Mycobacterium tuberculosis
PHGWVNLHFSLLPAWRGAAPVQAAIA

SEQ ID NO: 1535229 - protein, 23 aa, Mycobacterium tuberculosis
PHHTRPTRFVWLQTPAIRARLLD

SEQ ID NO: 1535230 - protein, 25 aa, Mycobacterium tuberculosis
PHLVKPLPFLFPLTKRWWERPYIAA

SEQ ID NO: 1535231 - protein, 20 aa, Mycobacterium tuberculosis
PHPLLLLTHPVPNTGAVVVQ

SEQ ID NO: 1535232 - protein, 17 aa, Mycobacterium tuberculosis
PIRLNFAPKLALHKLTV

SEQ ID NO: 1535233 - protein, 18 aa, Mycobacterium tuberculosis
PITDSWYLTSIRAGLEPW

SEQ ID NO: 1535234 - protein, 19 aa, Mycobacterium tuberculosis
PITDSWYLTSIRAGLEPWS

SEQ ID NO: 1535235 - protein, 21 aa, Mycobacterium tuberculosis
PKETWLRLLLINAGFPRPSTQ

SEQ ID NO: 1535236 - protein, 20 aa, Mycobacterium tuberculosis
PLAMYLFDLCTLPLNLAGHC

SEQ ID NO: 1535237 - protein, 32 aa, Mycobacterium tuberculosis; identical to SEQ ID NO: 1519095

SEQ ID NO: 1535238 - protein, 20 aa, Mycobacterium tuberculosis
PLLATYAFLPIVRAFAEPAG

SEQ ID NO: 1535239 - protein, 17 aa, Mycobacterium tuberculosis
PLLDPINEFFLANTGRP

SEQ ID NO: 1535240 - protein, 17 aa, Mycobacterium tuberculosis
PLPVSPCGVLGPQLQRL

SEQ ID NO: 1535241 - protein, 24 aa, Mycobacterium tuberculosis
PLQNLAGLPAWLASGAPAAAMTAA

SEQ ID NO: 1535242 - protein, 18 aa, Mycobacterium tuberculosis
PLRTHPVVLRRFRGCAGV

SEQ ID NO: 1535243 - protein, 18 aa, Mycobacterium tuberculosis
PLWAWLVLEPGDISVCLH

SEQ ID NO: 1535244 - protein, 18 aa, Mycobacterium tuberculosis
PMFLLYDYSFLPEGANSK

SEQ ID NO: 1535245 - protein, 25 aa, Mycobacterium tuberculosis
PNCPTRRWICSPIWLTPASWKLRRE

SEQ ID NO: 1535246 - protein, 20 aa, Mycobacterium tuberculosis
PNFLGWIHPAATATAPARTE

SEQ ID NO: 1535247 - protein, 19 aa, Mycobacterium tuberculosis
PNWPKPPLPPLPPALPLPP

SEQ ID NO: 1535248 - protein, 20 aa, Mycobacterium tuberculosis
PNWPKPPLPPLPPALPLPPC

SEQ ID NO: 1535249 - protein, 26 aa, Mycobacterium tuberculosis
PPCWPGSTWPLIWLTCWRPTTWRWRR

SEQ ID NO: 1535250 - protein, 18 aa, Mycobacterium tuberculosis
PPGTRRFSPPGGGSGGNG

SEQ ID NO: 1535251 - protein, 17 aa, Mycobacterium tuberculosis
PPILRLAYRLLSPMLRV

SEQ ID NO: 1535252 - protein, 18 aa, Mycobacterium tuberculosis
PPILRLAYRLLSPMLRVL

SEQ ID NO: 1535253 - protein, 20 aa, Mycobacterium tuberculosis
PPITIPAIPLGIDVSGRLGP

SEQ ID NO: 1535254 - protein, 18 aa, Mycobacterium tuberculosis
PPMIRYPIPPMIHGATQS

SEQ ID NO: 1535255 - protein, 19 aa, Mycobacterium tuberculosis
PPPPPPFFFFPARSACRGL

SEQ ID NO: 1535256 - protein, 23 aa, Mycobacterium tuberculosis
PPPPPPLPPVPFPKECPAPGVMQ

SEQ ID NO: 1535257 - protein, 26 aa, Mycobacterium tuberculosis
PPRVATLPHWPLICAGALEGLDHLEL

SEQ ID NO: 1535258 - protein, 21 aa, Mycobacterium tuberculosis
PPYAGPPMWFHGDLSRFNILT

SEQ ID NO: 1535259 - protein, 17 aa, Mycobacterium tuberculosis
PQARRGRPAASCTTGGK

SEQ ID NO: 1535260 - protein, 22 aa, Mycobacterium tuberculosis
PQRQRRRPCGNGRQRSVSAACA

SEQ ID NO: 1535261 - protein, 21 aa, Mycobacterium tuberculosis
PQTRWTAWWPACGDPGISLEE

SEQ ID NO: 1535262 - protein, 23 aa, Mycobacterium tuberculosis
PQVLPLEMGCFLQPIFTGDRGGP

SEQ ID NO: 1535263 - protein, 20 aa, Mycobacterium tuberculosis
PRAWRMRITVQRVGDRVKVS

SEQ ID NO: 1535264 - protein, 20 aa, Mycobacterium tuberculosis
PRDHRHPHPLVRHLLGASSP

SEQ ID NO: 1535265 - protein, 17 aa, Mycobacterium tuberculosis
PRGLSAVPLEPGQQTVG

SEQ ID NO: 1535266 - protein, 18 aa, Mycobacterium tuberculosis
PRRHLSYKTGWYGSQLVV

SEQ ID NO: 1535267 - protein, 24 aa, Mycobacterium tuberculosis
PRSRRWLLNLVITRGTPPRLEGCR

SEQ ID NO: 1535268 - protein, 20 aa, Mycobacterium tuberculosis
PRTRWLLRELVYALLVKKDH

SEQ ID NO: 1535269 - protein, 18 aa, Mycobacterium tuberculosis
PSGGLLVVITTRAQSDGG

SEQ ID NO: 1535270 - protein, 22 aa, Mycobacterium tuberculosis
PSHLGLRLVPPTRAARTEIPEA

SEQ ID NO: 1535271 - protein, 20 aa, Mycobacterium tuberculosis
PSIPVLAWALPQPIADRLNA

SEQ ID NO: 1535272 - protein, 22 aa, Mycobacterium tuberculosis
PSPVGWYRWQQCPHRHSLAGGD

SEQ ID NO: 1535273 - protein, 21 aa, Mycobacterium tuberculosis
PSSMRFFFFLVVFFSSKECIH

SEQ ID NO: 1535274 - protein, 22 aa, Mycobacterium tuberculosis
PSTPVSWLPFYHDMGLMLGIIL

SEQ ID NO: 1535275 - protein, 27 aa, Mycobacterium tuberculosis
PSVDVAILAVPHLPPPPLVFAAEPAKT

SEQ ID NO: 1535276 - protein, 17 aa, Mycobacterium tuberculosis
PTGFFEIPCPKFRKAAV

SEQ ID NO: 1535277 - protein, 18 aa, Mycobacterium tuberculosis
PTQALFGRPLIGNGADGS

SEQ ID NO: 1535278 - protein, 18 aa, Mycobacterium tuberculosis
PTQALLGRPLIGDGADGT

SEQ ID NO: 1535279 - protein, 18 aa, Mycobacterium tuberculosis
PTQLLLGRPLIGDGANGG

SEQ ID NO: 1535280 - protein, 18 aa, Mycobacterium tuberculosis
PTQTLLGLPLIGNGADGV

SEQ ID NO: 1535281 - protein, 19 aa, Mycobacterium tuberculosis
PTQTLLGRPLIGDGAHGTA

SEQ ID NO: 1535282 - protein, 18 aa, Mycobacterium tuberculosis
PTQTLLGRPLIGNGADGV

SEQ ID NO: 1535283 - protein, 19 aa, Mycobacterium tuberculosis
PTQTLLGRPLIGNGADGVA

SEQ ID NO: 1535284 - protein, 22 aa, Mycobacterium tuberculosis
PTRMFTVLFALGRLPGWIAHWR

SEQ ID NO: 1535285 - protein, 17 aa, Mycobacterium tuberculosis
PTRWPLPCTARFWASRK

SEQ ID NO: 1535286 - protein, 17 aa, Mycobacterium tuberculosis
PTVYRRWPDTRSIMASM

SEQ ID NO: 1535287 - protein, 17 aa, Mycobacterium tuberculosis
PVFNLGLANRGVVNILG

SEQ ID NO: 1535288 - protein, 18 aa, Mycobacterium tuberculosis
PVGLQRYLAPVSAVPAAA

SEQ ID NO: 1535289 - protein, 24 aa, Mycobacterium tuberculosis
PVGTRQLLLVNLLTDMFPALAVAV

SEQ ID NO: 1535290 - protein, 24 aa, Mycobacterium tuberculosis
PVPASLIPWPLLSVPFAPVLGSQS

SEQ ID NO: 1535291 - protein, 19 aa, Mycobacterium tuberculosis
PVRYRFHFPRQQRGRFLCI

SEQ ID NO: 1535292 - protein, 22 aa, Mycobacterium tuberculosis
PVRYRFHFPRQQRGRFLCIADF

SEQ ID NO: 1535293 - protein, 19 aa, Mycobacterium tuberculosis
PWEHPDFWDIWKASLQGVL

SEQ ID NO: 1535294 - protein, 19 aa, Mycobacterium tuberculosis
PYLGFTQWALLHDPPPELA

SEQ ID NO: 1535295 - protein, 22 aa, Mycobacterium tuberculosis
QAATFHIQFVRALTAGAGSYAT

SEQ ID NO: 1535296 - protein, 20 aa, Mycobacterium tuberculosis
QAAVSGLVTALFGAPGQPGD

SEQ ID NO: 1535297 - protein, 24 aa, Mycobacterium tuberculosis
QAAVSGLVTALFGAPGQPGDTGQP

SEQ ID NO: 1535298 - protein, 22 aa, Mycobacterium tuberculosis
QAEYLRWAVGAFRLATSGVSDA

SEQ ID NO: 1535299 - protein, 24 aa, Mycobacterium tuberculosis
QARLSWACGLPYYSNLYTPNCTSD

SEQ ID NO: 1535300 - protein, 17 aa, Mycobacterium tuberculosis
QAYLALRAWGLPVSEHT

SEQ ID NO: 1535301 - protein, 23 aa, Mycobacterium tuberculosis
QEGMGFIYLMQNLPQERISIAIM

SEQ ID NO: 1535302 - protein, 22 aa, Mycobacterium tuberculosis
QESTLGLIFHWADQRGLPLLDL

SEQ ID NO: 1535303 - protein, 23 aa, Mycobacterium tuberculosis
QESTLGLIFHWADQRGLPLLDLK

SEQ ID NO: 1535304 - protein, 21 aa, Mycobacterium tuberculosis
QGGFLIPAALDPAILLSGDGS

SEQ ID NO: 1535305 - protein, 27 aa, Mycobacterium tuberculosis
QGGGGGFSILLGLGGLGGLGSPGSIAT

SEQ ID NO: 1535306 - protein, 18 aa, Mycobacterium tuberculosis
QGIRLHAPLPAAGKLSVV

SEQ ID NO: 1535307 - protein, 21 aa, Mycobacterium tuberculosis
QGLCGYPGVLLLLIPQRTAQV

SEQ ID NO: 1535308 - protein, 20 aa, Mycobacterium tuberculosis
QGYTGFIYGGERWAKDIHEG

SEQ ID NO: 1535309 - protein, 26 aa, Mycobacterium tuberculosis
QHISTLLLTLLFRFMRPLIENGHVFL

SEQ ID NO: 1535310 - protein, 24 aa, Mycobacterium tuberculosis
QIHDWILLTPWGLLSWPQINQQLG

SEQ ID NO: 1535311 - protein, 17 aa, Mycobacterium tuberculosis
QIRLPAGELAQPGLFAV

SEQ ID NO: 1535312 - protein, 19 aa, Mycobacterium tuberculosis
QLLLKIGWPAEDLAGYVDG

SEQ ID NO: 1535313 - protein, 20 aa, Mycobacterium tuberculosis
QLRDMLPDWPALAHGPLTLK

SEQ ID NO: 1535314 - protein, 21 aa, Mycobacterium tuberculosis
QLSSWSIGLQQALPAAPSALA

SEQ ID NO: 1535315 - protein, 18 aa, Mycobacterium tuberculosis
QMFTYRLLQQARSDLMRI

SEQ ID NO: 1535316 - protein, 18 aa, Mycobacterium tuberculosis
QNFPALVANLPAAIDAAV

SEQ ID NO: 1535317 - protein, 25 aa, Mycobacterium tuberculosis
QNPLNPVQFPKALLLKVTGPIAQQF

SEQ ID NO: 1535318 - protein, 17 aa, Mycobacterium tuberculosis
QPLDWFCLFSSGAALLG

SEQ ID NO: 1535319 - protein, 17 aa, Mycobacterium tuberculosis
QPLEWFCLFSSAAALVG

SEQ ID NO: 1535320 - protein, 20 aa, Mycobacterium tuberculosis
QPLPLGLRRLLTDLHNAGAA

SEQ ID NO: 1535321 - protein, 22 aa, Mycobacterium tuberculosis
QPPTLEELFLRPLQPGAPRSQP

SEQ ID NO: 1535322 - protein, 20 aa, Mycobacterium tuberculosis
QPRLFYMHFWAENDAVALAR

SEQ ID NO: 1535323 - protein, 21 aa, Mycobacterium tuberculosis
QPTAWLAEGLLPYLPGDAADR

SEQ ID NO: 1535324 - protein, 17 aa, Mycobacterium tuberculosis
QQRCPPRQFERARVVVF

SEQ ID NO: 1535325 - protein, 19 aa, Mycobacterium tuberculosis
QRFSRLPPILPISGQQRLS

SEQ ID NO: 1535326 - protein, 18 aa, Mycobacterium tuberculosis
QRFWISLYFPLTMRSLCN

SEQ ID NO: 1535327 - protein, 21 aa, Mycobacterium tuberculosis
QRGFFCWFRVGSDVLVDNAFR

SEQ ID NO: 1535328 - protein, 21 aa, Mycobacterium tuberculosis
QRLRLPWWHLWRAAEAAGAAT

SEQ ID NO: 1535329 - protein, 18 aa, Mycobacterium tuberculosis
QRRRRWCRWGWWWRRRRG

SEQ ID NO: 1535330 - protein, 20 aa, Mycobacterium tuberculosis
QTAAVLFGVWWIGAQAILDD

SEQ ID NO: 1535331 - protein, 21 aa, Mycobacterium tuberculosis
QTFVNQLPFPAFSLGKITIPQ

SEQ ID NO: 1535332 - protein, 23 aa, Mycobacterium tuberculosis
QTQLRHEARIRRATATSERRLLH

SEQ ID NO: 1535333 - protein, 17 aa, Mycobacterium tuberculosis
QVAAFHDRFAQTLSAAV

SEQ ID NO: 1535334 - protein, 27 aa, Mycobacterium tuberculosis
QVAAFHSRFVQALTAGAGAYAFAEAAN

SEQ ID NO: 1535335 - protein, 23 aa, Mycobacterium tuberculosis
QVAALFRMWLPDPVRRVATGVLD

SEQ ID NO: 1535336 - protein, 18 aa, Mycobacterium tuberculosis
QVALFLRHLWSAGGSVRW

SEQ ID NO: 1535337 - protein, 21 aa, Mycobacterium tuberculosis
QVALFLRHLWSAGGSVRWDPT

SEQ ID NO: 1535338 - protein, 18 aa, Mycobacterium tuberculosis
QVPRWCQVAGAGGARSAG

SEQ ID NO: 1535339 - protein, 17 aa, Mycobacterium tuberculosis
QVRFVWLRGRRATSHWL

SEQ ID NO: 1535340 - protein, 20 aa, Mycobacterium tuberculosis
QVRLPGFRPGKAPAKLLEAR

SEQ ID NO: 1535341 - protein, 23 aa, Mycobacterium tuberculosis
QWHQLARAFLMYVTQRWPDVLST

SEQ ID NO: 1535342 - protein, 21 aa, Mycobacterium tuberculosis
QWRPQPQFGRPWLQVVAFHVG

SEQ ID NO: 1535343 - protein, 20 aa, Mycobacterium tuberculosis
RAADLAHAWLRRGALRIGRA

SEQ ID NO: 1535344 - protein, 17 aa, Mycobacterium tuberculosis
RAARRQKAGPAAAPAPA

SEQ ID NO: 1535345 - protein, 23 aa, Mycobacterium tuberculosis
RAATVHPLLVAANRNAFAQLVMS

SEQ ID NO: 1535346 - protein, 19 aa, Mycobacterium tuberculosis
RAEIRALFRSSKVGLIAGC

SEQ ID NO: 1535347 - protein, 17 aa, Mycobacterium tuberculosis
RAGPAVAAVAALGARRG

SEQ ID NO: 1535348 - protein, 26 aa, Mycobacterium tuberculosis
RALYAFKRYAWWPYTLVMRRANVFFT

SEQ ID NO: 1535349 - protein, 17 aa, Mycobacterium tuberculosis
RAPALTAPLLVLHGTDD

SEQ ID NO: 1535350 - protein, 18 aa, Mycobacterium tuberculosis
RARLFPRGLAAFIELRDQ

SEQ ID NO: 1535351 - protein, 21 aa, Mycobacterium tuberculosis
RARVALLYWQPAAMGGVPAGF

SEQ ID NO: 1535352 - protein, 23 aa, Mycobacterium tuberculosis
RAVPLVGGLWFRFLHSVKAGIKD

SEQ ID NO: 1535353 - protein, 17 aa, Mycobacterium tuberculosis
RAYRLPWPDGTTVFELD

SEQ ID NO: 1535354 - protein, 23 aa, Mycobacterium tuberculosis
RAYTPWYLVRYWRLLRFKLANPH

SEQ ID NO: 1535355 - protein, 17 aa, Mycobacterium tuberculosis
RCGWFDAVIARYAARVN

SEQ ID NO: 1535356 - protein, 18 aa, Mycobacterium tuberculosis
RCPPRQFERARVVVFAGD

SEQ ID NO: 1535357 - protein, 17 aa, Mycobacterium tuberculosis
RCRAWLAALPPVLPATP

SEQ ID NO: 1535358 - protein, 18 aa, Mycobacterium tuberculosis
RCRLVTARLWPTLIEPLR

SEQ ID NO: 1535359 - protein, 19 aa, Mycobacterium tuberculosis
RCRVPLILRLDPKIGLPDI

SEQ ID NO: 1535360 - protein, 25 aa, Mycobacterium tuberculosis
RCSPTSIWMCRWTTRVWVRPARCWG

SEQ ID NO: 1535361 - protein, 24 aa, Mycobacterium tuberculosis
RCWSAGRAGWRWLPRSRSPRKPGP

SEQ ID NO: 1535362 - protein, 25 aa, Mycobacterium tuberculosis
RDGHRRLRRRADLQLQHLLNDGGFR

SEQ ID NO: 1535363 - protein, 18 aa, Mycobacterium tuberculosis
RDILPDWPALAHGPLTLK

SEQ ID NO: 1535364 - protein, 23 aa, Mycobacterium tuberculosis
RDIRFVRLWFTDVLGFLKSVAIA

SEQ ID NO: 1535365 - protein, 23 aa, Mycobacterium tuberculosis
RDKRSLVFPVKRLADLGFRVLAT

SEQ ID NO: 1535366 - protein, 23 aa, Mycobacterium tuberculosis
RDLARLWPSLLARPLRSRLLGCA

SEQ ID NO: 1535367 - protein, 23 aa, Mycobacterium tuberculosis
RDPYHAYTIDWLPEGWFIEVSEV

SEQ ID NO: 1535368 - protein, 23 aa, Mycobacterium tuberculosis
RDQIGIVFQFFNLIPTLTVLENI

SEQ ID NO: 1535369 - protein, 25 aa, Mycobacterium tuberculosis
RDQIGIVFQFFNLIPTLTVLKNITL

SEQ ID NO: 1535370 - protein, 20 aa, Mycobacterium tuberculosis
RDSEWMGFVHRFLGLQVGVI

SEQ ID NO: 1535371 - protein, 24 aa, Mycobacterium tuberculosis
RDTYDAMFDLWFPAALGARAVITT

SEQ ID NO: 1535372 - protein, 22 aa, Mycobacterium tuberculosis
REGVNLTFLPFFAKAVIDALKI

SEQ ID NO: 1535373 - protein, 18 aa, Mycobacterium tuberculosis
REHVLLARQVGVPYILVA

SEQ ID NO: 1535374 - protein, 17 aa, Mycobacterium tuberculosis
RELLAQMPPFLTGGSMI

SEQ ID NO: 1535375 - protein, 17 aa, Mycobacterium tuberculosis
REQPLPLGLRRLLTDLH

SEQ ID NO: 1535376 - protein, 23 aa, Mycobacterium tuberculosis
REQPLPLGLRRLLTDLHIAGAAV

SEQ ID NO: 1535377 - protein, 23 aa, Mycobacterium tuberculosis
RERGYAYFLYPPQVPLTETAYDR

SEQ ID NO: 1535378 - protein, 25 aa, Mycobacterium tuberculosis
RESVSTWVFVVWPRSPPRTAHAARS

SEQ ID NO: 1535379 - protein, 23 aa, Mycobacterium tuberculosis
RFALVLCRLFWHPPTFRQACEAV

SEQ ID NO: 1535380 - protein, 19 aa, Mycobacterium tuberculosis
RFCGKAARWSYLGRRRDPA

SEQ ID NO: 1535381 - protein, 17 aa, Mycobacterium tuberculosis
RFGWFFLATRRDPKGLW

SEQ ID NO: 1535382 - protein, 22 aa, Mycobacterium tuberculosis
RFPGFYIPFLDVPFNGATPANS

SEQ ID NO: 1535383 - protein, 18 aa, Mycobacterium tuberculosis
RFVRLWFTDVLGFLKSVA

SEQ ID NO: 1535384 - protein, 24 aa, Mycobacterium tuberculosis
RGDHEGLFSLFYSLDVPRITIVDA

SEQ ID NO: 1535385 - protein, 20 aa, Mycobacterium tuberculosis
RGFFCWFRVGSDVLVDNAFR

SEQ ID NO: 1535386 - protein, 23 aa, Mycobacterium tuberculosis
RGGAGGLGFGSEAPGRPGGAGGT

SEQ ID NO: 1535387 - protein, 24 aa, Mycobacterium tuberculosis
RGGAGGLGFGSEAPGRPGGAGGTG

SEQ ID NO: 1535388 - protein, 18 aa, Mycobacterium tuberculosis
RGGFARPSPAPWPTRPAP

SEQ ID NO: 1535389 - protein, 24 aa, Mycobacterium tuberculosis
RGGPDYLMFLYKTKGPVVFGDSAV

SEQ ID NO: 1535390 - protein, 19 aa, Mycobacterium tuberculosis
RGGWLLGNGGTGGAGGAAG

SEQ ID NO: 1535391 - protein, 17 aa, Mycobacterium tuberculosis
RGKAARRFLPGATILKA

SEQ ID NO: 1535392 - protein, 27 aa, Mycobacterium tuberculosis
RGRKRGWWASWRWGLSQVVRPKTPRGD

SEQ ID NO: 1535393 - protein, 19 aa, Mycobacterium tuberculosis
RGRRRRWRCPAATGAPGGN

SEQ ID NO: 1535394 - protein, 20 aa, Mycobacterium tuberculosis
RGRRWPRRAADRRRRRRRRG

SEQ ID NO: 1535395 - protein, 18 aa, Mycobacterium tuberculosis
RGSYPWLPTDNANWHMIG

SEQ ID NO: 1535396 - protein, 20 aa, Mycobacterium tuberculosis
RGTPVVAMPLLRRGNKEVHG

SEQ ID NO: 1535397 - protein, 17 aa, Mycobacterium tuberculosis
RHCAHRHGFGGFGGLGG

SEQ ID NO: 1535398 - protein, 18 aa, Mycobacterium tuberculosis
RHEILQLELLKPKIAILD

SEQ ID NO: 1535399 - protein, 17 aa, Mycobacterium tuberculosis
RHHLLLPITATRRDLND

SEQ ID NO: 1535400 - protein, 17 aa, Mycobacterium tuberculosis
RHLFPRGTPRDRQRHCR

SEQ ID NO: 1535401 - protein, 18 aa, Mycobacterium tuberculosis
RHRPIRLNFAPKLALHKL

SEQ ID NO: 1535402 - protein, 24 aa, Mycobacterium tuberculosis
RHWNWGWRRYTWPSAFDKVWRGGA

SEQ ID NO: 1535403 - protein, 21 aa, Mycobacterium tuberculosis
RIERGLWLTALLQATLSTVRH

SEQ ID NO: 1535404 - protein, 21 aa, Mycobacterium tuberculosis
RIPLPVDWRWPWGEALAVLEN

SEQ ID NO: 1535405 - protein, 19 aa, Mycobacterium tuberculosis
RLCDLEQMIPLMPGAQLIG

SEQ ID NO: 1535406 - protein, 24 aa, Mycobacterium tuberculosis
RLGLFPFRRGLTFYYLDLALMSVT

SEQ ID NO: 1535407 - protein, 25 aa, Mycobacterium tuberculosis
RLGLFPFRRGLTFYYLDLALMSVTQ

SEQ ID NO: 1535408 - protein, 17 aa, Mycobacterium tuberculosis
RLINAPLPIWNHRRLLL

SEQ ID NO: 1535409 - protein, 17 aa, Mycobacterium tuberculosis
RLLEHRLQLQRLKRTHL

SEQ ID NO: 1535410 - protein, 19 aa, Mycobacterium tuberculosis
RLLGLRLRRLRYLRTAAAR

SEQ ID NO: 1535411 - protein, 20 aa, Mycobacterium tuberculosis
RLLNLLIYIKGYLDGTLTFR

SEQ ID NO: 1535412 - protein, 17 aa, Mycobacterium tuberculosis
RLPITLWIVDTNASTPA

SEQ ID NO: 1535413 - protein, 17 aa, Mycobacterium tuberculosis
RLPSWRILVGRAAPLSA

SEQ ID NO: 1535414 - protein, 17 aa, Mycobacterium tuberculosis
RLRPPFPAVAGLYGCPT

SEQ ID NO: 1535415 - protein, 19 aa, Mycobacterium tuberculosis
RLVAMLARRGYGQTLACEV

SEQ ID NO: 1535416 - protein, 17 aa, Mycobacterium tuberculosis
RMEADWEASYLLSLRAA

SEQ ID NO: 1535417 - protein, 17 aa, Mycobacterium tuberculosis
RMFFGAGSGPMLAAAAW

SEQ ID NO: 1535418 - protein, 18 aa, Mycobacterium tuberculosis
RNFLAAPPPQRAAMAAQL

SEQ ID NO: 1535419 - protein, 20 aa, Mycobacterium tuberculosis
RPAQYLPWHPCRCAQVFVGE

SEQ ID NO: 1535420 - protein, 18 aa, Mycobacterium tuberculosis
RPGCQRRPHRRRGGTVRQ

SEQ ID NO: 1535421 - protein, 18 aa, Mycobacterium tuberculosis
RPLIRLSLGKRHPMRRIV

SEQ ID NO: 1535422 - protein, 19 aa, Mycobacterium tuberculosis
RPNLFIKIPATKAGLPAIS

SEQ ID NO: 1535423 - protein, 18 aa, Mycobacterium tuberculosis
RPPRPLKGWVFAAGAKRP

SEQ ID NO: 1535424 - protein, 17 aa, Mycobacterium tuberculosis
RPQLKKFYGERLERLYT

SEQ ID NO: 1535425 - protein, 21 aa, Mycobacterium tuberculosis
RPRYLCMLAEILRFHRAALAC

SEQ ID NO: 1535426 - protein, 17 aa, Mycobacterium tuberculosis
RPSPSKPPLPRLQRRRV

SEQ ID NO: 1535427 - protein, 19 aa, Mycobacterium tuberculosis
RPSWVWRPPTRGWTGCWRS

SEQ ID NO: 1535428 - protein, 19 aa, Mycobacterium tuberculosis
RPVARRLFAVRAVVGLSLP

SEQ ID NO: 1535429 - protein, 20 aa, Mycobacterium tuberculosis
RQDIPIHYLLADTFTICDGY

SEQ ID NO: 1535430 - protein, 24 aa, Mycobacterium tuberculosis
RRATLRAPLAVMVANGSDGVAAGS

SEQ ID NO: 1535431 - protein, 21 aa, Mycobacterium tuberculosis
RRAWTMLALPWPALQRRRTCP

SEQ ID NO: 1535432 - protein, 25 aa, Mycobacterium tuberculosis
RRDQIGIVFQFFNLIPTLTVLENIT

SEQ ID NO: 1535433 - protein, 17 aa, Mycobacterium tuberculosis
RRFSFTRFGHRGRPVTG

SEQ ID NO: 1535434 - protein, 21 aa, Mycobacterium tuberculosis
RRGYVLIVRPTTCRRRVTSTS

SEQ ID NO: 1535435 - protein, 17 aa, Mycobacterium tuberculosis
RRHLSYKTGWYGSQLVV

SEQ ID NO: 1535436 - protein, 17 aa, Mycobacterium tuberculosis
RRHLSYKTVWYGSALVV

SEQ ID NO: 1535437 - protein, 23 aa, Mycobacterium tuberculosis
RRLALLLTFPRFLPTTGPITMRS

SEQ ID NO: 1535438 - protein, 17 aa, Mycobacterium tuberculosis
RRPWYLAAQAGTGGGQL

SEQ ID NO: 1535439 - protein, 25 aa, Mycobacterium tuberculosis
RRRERRVQQLWQRRGRRGRRRRGFA

SEQ ID NO: 1535440 - protein, 25 aa, Mycobacterium tuberculosis
RRRGSARAVWLMGNGGQRGATAAPA

SEQ ID NO: 1535441 - protein, 18 aa, Mycobacterium tuberculosis
RRRRCGRSRWGGLAGRQR

SEQ ID NO: 1535442 - protein, 24 aa, Mycobacterium tuberculosis
RRSGPACWAPWWPGSAWPPTVAPT

SEQ ID NO: 1535443 - protein, 27 aa, Mycobacterium tuberculosis
RRTRRVRRAWRPAVRPNRHGWRVAVAG

SEQ ID NO: 1535444 - protein, 21 aa, Mycobacterium tuberculosis
RSAGAIFVGPWSPVSLGDYCA

SEQ ID NO: 1535445 - protein, 23 aa, Mycobacterium tuberculosis
RSRARLLGLRLRRLRYLRTAAAR

SEQ ID NO: 1535446 - protein, 24 aa, Mycobacterium tuberculosis
RSRARLLGLRLRRLRYLRTAAARR

SEQ ID NO: 1535447 - protein, 17 aa, Mycobacterium tuberculosis
RSRPLWQVDLIEGLPGG

SEQ ID NO: 1535448 - protein, 17 aa, Mycobacterium tuberculosis
RTALAARLPLAYALGWQ

SEQ ID NO: 1535449 - protein, 18 aa, Mycobacterium tuberculosis
RTAWHPGAIGRRGAGRQG

SEQ ID NO: 1535450 - protein, 20 aa, Mycobacterium tuberculosis
RTAWHPGAIGRRGAGRQGGR

SEQ ID NO: 1535451 - protein, 18 aa, Mycobacterium tuberculosis
RTSPTRWPLPCTARFWAS

SEQ ID NO: 1535452 - protein, 20 aa, Mycobacterium tuberculosis
RTVYGHLPGYALPLFVRVVG

SEQ ID NO: 1535453 - protein, 19 aa, Mycobacterium tuberculosis
RVALCKLLLSKPDLLLLDE

SEQ ID NO: 1535454 - protein, 17 aa, Mycobacterium tuberculosis
RVGLLPTWGLSVRLPQK

SEQ ID NO: 1535455 - protein, 23 aa, Mycobacterium tuberculosis
RVHFDLDPLLPFPRWHEHAAMVE

SEQ ID NO: 1535456 - protein, 21 aa, Mycobacterium tuberculosis
RVIELAWALLTNSLAAGGYGL

SEQ ID NO: 1535457 - protein, 17 aa, Mycobacterium tuberculosis
RVKQLLLKIGWPAEDLA

SEQ ID NO: 1535458 - protein, 22 aa, Mycobacterium tuberculosis
RVLGLHFFNPVPVLPLVELVRT

SEQ ID NO: 1535459 - protein, 18 aa, Mycobacterium tuberculosis
RVLTGPRWRLGARDLAAL

SEQ ID NO: 1535460 - protein, 25 aa, Mycobacterium tuberculosis
RVLTSVYLFGFERPMRGRIGVGAIA

SEQ ID NO: 1535461 - protein, 17 aa, Mycobacterium tuberculosis
RVPALPRLGPTDALPRC

SEQ ID NO: 1535462 - protein, 17 aa, Mycobacterium tuberculosis
RVQRWVGLVLPAVRGKR

SEQ ID NO: 1535463 - protein, 23 aa, Mycobacterium tuberculosis
RVRTPLIELFELFDPADPEVVAR

SEQ ID NO: 1535464 - protein, 25 aa, Mycobacterium tuberculosis
RVSARVYPALVPLSHPLAAVNGAFN

SEQ ID NO: 1535465 - protein, 17 aa, Mycobacterium tuberculosis
RWPLPCTARFWASRKKT

SEQ ID NO: 1535466 - protein, 17 aa, Mycobacterium tuberculosis
RWRRCFWPSILVRGFSR

SEQ ID NO: 1535467 - protein, 24 aa, Mycobacterium tuberculosis
RWSAVLVGAWWPAPSAALRAAAQH

SEQ ID NO: 1535468 - protein, 20 aa, Mycobacterium tuberculosis
RWVRYPYLPSHPQYDLAKRQ

SEQ ID NO: 1535469 - protein, 18 aa, Mycobacterium tuberculosis
RYFIDRLAGWYVITSSDR

SEQ ID NO: 1535470 - protein, 20 aa, Mycobacterium tuberculosis
RYGVRWHYRLPVWSDFVEVH

SEQ ID NO: 1535471 - protein, 18 aa, Mycobacterium tuberculosis
RYTGRGMAFLDLIQEGLP

SEQ ID NO: 1535472 - protein, 23 aa, Mycobacterium tuberculosis
RYTWPRFVCALPKEFFAAVRAEL

SEQ ID NO: 1535473 - protein, 29 aa, Mycobacterium tuberculosis
RYYIAMLAELSRLRPLPFRLVLDGTEEIV

SEQ ID NO: 1535474 - protein, 28 aa, Mycobacterium tuberculosis
RYYRSLQLRWPLRMLLGGKPLQHIAADK

SEQ ID NO: 1535475 - protein, 20 aa, Mycobacterium tuberculosis
SAELPLFRYVGGPNAHILPV

SEQ ID NO: 1535476 - protein, 20 aa, Mycobacterium tuberculosis
SAGLIGIGGTGGAGGAGAVG

SEQ ID NO: 1535477 - protein, 17 aa, Mycobacterium tuberculosis
SALVVFEVMVRPLIRLS

SEQ ID NO: 1535478 - protein, 21 aa, Mycobacterium tuberculosis
SAPLGFLAQTPPALTPHGLIV

SEQ ID NO: 1535479 - protein, 18 aa, Mycobacterium tuberculosis
SAQAALFHEQFVRALTAG

SEQ ID NO: 1535480 - protein, 27 aa, Mycobacterium tuberculosis
SAQVATFHDRFVQTLSATASSYVAAEA

SEQ ID NO: 1535481 - protein, 21 aa, Mycobacterium tuberculosis
SASLLVIAPPWPTADVPGPML

SEQ ID NO: 1535482 - protein, 17 aa, Mycobacterium tuberculosis
SATLIWRRPRWARRLQP

SEQ ID NO: 1535483 - protein, 19 aa, Mycobacterium tuberculosis
SAVTVFIPAFLRYDLRPVT

SEQ ID NO: 1535484 - protein, 20 aa, Mycobacterium tuberculosis
SAVTVFIPAFLRYDLRPVTG

SEQ ID NO: 1535485 - protein, 20 aa, Mycobacterium tuberculosis
SAVVMAPMYLGLRVWSRATI

SEQ ID NO: 1535486 - protein, 23 aa, Mycobacterium tuberculosis
SDGELFIMGRIKDLLIVDGRNHY

SEQ ID NO: 1535487 - protein, 24 aa, Mycobacterium tuberculosis
SDGSIFLRPFLKYQIITVVAPNSP

SEQ ID NO: 1535488 - protein, 17 aa, Mycobacterium tuberculosis
SDRLLNLLIYIKGYLDG

SEQ ID NO: 1535489 - protein, 17 aa, Mycobacterium tuberculosis
SDYPLQALLYVVVLHRF

SEQ ID NO: 1535490 - protein, 21 aa, Mycobacterium tuberculosis
SEGFLIFKQPLLRSLVVVCNV

SEQ ID NO: 1535491 - protein, 18 aa, Mycobacterium tuberculosis
SEGLLYERRLFHSAFATE

SEQ ID NO: 1535492 - protein, 22 aa, Mycobacterium tuberculosis
SFAKELFLGRFPLGLIHPFPKP

SEQ ID NO: 1535493 - protein, 19 aa, Mycobacterium tuberculosis
SFYLRPIVRPVILVAGGTG

SEQ ID NO: 1535494 - protein, 31 aa, Mycobacterium tuberculosis
SGDCGTGGYRRRLWRWWLAARATASPADTGG

SEQ ID NO: 1535495 - protein, 17 aa, Mycobacterium tuberculosis
SGFFGGKGGFGGDGGQG

SEQ ID NO: 1535496 - protein, 26 aa, Mycobacterium tuberculosis
SGFFGGPPVFNLGLANRGVVNILGNA

SEQ ID NO: 1535497 - protein, 25 aa, Mycobacterium tuberculosis
SGGAGGVAWLLYGNGGNGGAGGIGG

SEQ ID NO: 1535498 - protein, 20 aa, Mycobacterium tuberculosis
SGNFGVDGEAGFSGGAGGNG

SEQ ID NO: 1535499 - protein, 22 aa, Mycobacterium tuberculosis
SGRPVAAWMGALNTSIRLCNGD

SEQ ID NO: 1535500 - protein, 21 aa, Mycobacterium tuberculosis
SGWWRAPLRWTLRDHWRCVPT

SEQ ID NO: 1535501 - protein, 19 aa, Mycobacterium tuberculosis
SHLLLDLDLLGPLRARLAD

SEQ ID NO: 1535502 - protein, 26 aa, Mycobacterium tuberculosis
SKKKNLYSLKYWGVRGVWGGGGGGGG

SEQ ID NO: 1535503 - protein, 20 aa, Mycobacterium tuberculosis
SKLYLLPGYHGTGAAAALMH

SEQ ID NO: 1535504 - protein, 19 aa, Mycobacterium tuberculosis
SLAALYRPMLLRTTNRHHG

SEQ ID NO: 1535505 - protein, 17 aa, Mycobacterium tuberculosis
SLERLECLARRLPAAQH

SEQ ID NO: 1535506 - protein, 19 aa, Mycobacterium tuberculosis
SLLITVWLQQKPFISNWLV

SEQ ID NO: 1535507 - protein, 18 aa, Mycobacterium tuberculosis
SLLLGTWGPRKRRAKRFA

SEQ ID NO: 1535508 - protein, 21 aa, Mycobacterium tuberculosis
SLLVRSLVAWFWDQPLRAPLI

SEQ ID NO: 1535509 - protein, 17 aa, Mycobacterium tuberculosis
SMRQRWLSCPWAGWYAT

SEQ ID NO: 1535510 - protein, 23 aa, Mycobacterium tuberculosis
SNEGFFNTGMFNNGIYNSGVAST

SEQ ID NO: 1535511 - protein, 23 aa, Mycobacterium tuberculosis
SNPLPPPWYPQPASLPAAGATGQ

SEQ ID NO: 1535512 - protein, 20 aa, Mycobacterium tuberculosis
SNWFGLNAPLIAAVEGAYEQ

SEQ ID NO: 1535513 - protein, 25 aa, Mycobacterium tuberculosis
SPKETWLRLLLIRAGFPRPQMQIAV

SEQ ID NO: 1535514 - protein, 25 aa, Mycobacterium tuberculosis
SPKETWLRLLLIRAGFPRPQTQIAV

SEQ ID NO: 1535515 - protein, 18 aa, Mycobacterium tuberculosis
SPLGRLPLRIGRSKSNDM

SEQ ID NO: 1535516 - protein, 21 aa, Mycobacterium tuberculosis
SPNAEWYLYTKDWLALLRQFA

SEQ ID NO: 1535517 - protein, 19 aa, Mycobacterium tuberculosis
SQLLYWTQVLMISRGLSLD

SEQ ID NO: 1535518 - protein, 21 aa, Mycobacterium tuberculosis
SQLLYWTQVLMISRGLSLDAV

SEQ ID NO: 1535519 - protein, 18 aa, Mycobacterium tuberculosis
SQNPYLEGFLAPVSTEVT

SEQ ID NO: 1535520 - protein, 21 aa, Mycobacterium tuberculosis
SQVPWLWAKFIGHAQAIAPAP

SEQ ID NO: 1535521 - protein, 20 aa, Mycobacterium tuberculosis
SRASILPVAGTPAAATAACS

SEQ ID NO: 1535522 - protein, 19 aa, Mycobacterium tuberculosis
SRAYRLPWPDGTTVFELDR

SEQ ID NO: 1535523 - protein, 25 aa, Mycobacterium tuberculosis
SRTHHYPFRLLPPRTMRALLARICE

SEQ ID NO: 1535524 - protein, 21 aa, Mycobacterium tuberculosis
SSRFLLNLPLFSRQALHPDVD

SEQ ID NO: 1535525 - protein, 25 aa, Mycobacterium tuberculosis
SSSLVIPFWKIGWQNLGLPTGFDVV

SEQ ID NO: 1535526 - protein, 20 aa, Mycobacterium tuberculosis
STDYLFWRDDDGDYWLAGGR

SEQ ID NO: 1535527 - protein, 21 aa, Mycobacterium tuberculosis
STPVSWLPFYHDMGLMLGIIL

SEQ ID NO: 1535528 - protein, 17 aa, Mycobacterium tuberculosis
STQVAAFHDRFAQTLSA

SEQ ID NO: 1535529 - protein, 20 aa, Mycobacterium tuberculosis
STWARQLPWLTLLGAVYTYD

SEQ ID NO: 1535530 - protein, 25 aa, Mycobacterium tuberculosis
SVAGAVPCFFGHAQAYQTLGTQAAA

SEQ ID NO: 1535531 - protein, 24 aa, Mycobacterium tuberculosis
SVLAYPRVVWIAGGLLKGASLHAE

SEQ ID NO: 1535532 - protein, 24 aa, Mycobacterium tuberculosis
SVTQGGSGFFGGKGGFGGDGGQGG

SEQ ID NO: 1535533 - protein, 17 aa, Mycobacterium tuberculosis
SWSIGLQQALPAAPSAL

SEQ ID NO: 1535534 - protein, 21 aa, Mycobacterium tuberculosis
TAARNFYYGIRLLPREKRAAL

SEQ ID NO: 1535535 - protein, 22 aa, Mycobacterium tuberculosis
TAAVLFGVWWIGAQAILDDSPA

SEQ ID NO: 1535536 - protein, 24 aa, Mycobacterium tuberculosis
TADADVIRYLRWFTFLSADELAEL

SEQ ID NO: 1535537 - protein, 18 aa, Mycobacterium tuberculosis
TAESRRATLRAPLAVMVA

SEQ ID NO: 1535538 - protein, 17 aa, Mycobacterium tuberculosis
TAGWRWCSAPAAIVTRA

SEQ ID NO: 1535539 - protein, 17 aa, Mycobacterium tuberculosis
TALLLCYRQRRWYLEGS

SEQ ID NO: 1535540 - protein, 20 aa, Mycobacterium tuberculosis
TALRLLPMEELIAAFLPVLF

SEQ ID NO: 1535541 - protein, 18 aa, Mycobacterium tuberculosis
TAPVLPLRCSMPRRPQYG

SEQ ID NO: 1535542 - protein, 23 aa, Mycobacterium tuberculosis
TAVFEIFFRKLPPGRSYIMAAGL

SEQ ID NO: 1535543 - protein, 25 aa, Mycobacterium tuberculosis
TAVPVKLHVPIFLDIPVTGTLVHVH

SEQ ID NO: 1535544 - protein, 20 aa, Mycobacterium tuberculosis
TAVRWVMAVPVGPVAAAGPA

SEQ ID NO: 1535545 - protein, 19 aa, Mycobacterium tuberculosis
TDEAPLLATYAFLPIVRAF

SEQ ID NO: 1535546 - protein, 17 aa, Mycobacterium tuberculosis
TDPVPFPSFKNGVGLML

SEQ ID NO: 1535547 - protein, 19 aa, Mycobacterium tuberculosis
TEEVQTVLRWASANQVPVV

SEQ ID NO: 1535548 - protein, 22 aa, Mycobacterium tuberculosis
TETRLPFCWRGVSLHAGGAGRV

SEQ ID NO: 1535549 - protein, 17 aa, Mycobacterium tuberculosis
TFDFLGIRDLTAGKPII

SEQ ID NO: 1535550 - protein, 20 aa, Mycobacterium tuberculosis
TFEYQALLFIPSHAPFDLFD

SEQ ID NO: 1535551 - protein, 23 aa, Mycobacterium tuberculosis
TFEYQALLFIPSHAPFDLFDRDA

SEQ ID NO: 1535552 - protein, 18 aa, Mycobacterium tuberculosis
TFHEDPVAGVWAVGGVGG

SEQ ID NO: 1535553 - protein, 21 aa, Mycobacterium tuberculosis
TGAAAPYLGWLSAAAAQAQQA

SEQ ID NO: 1535554 - protein, 17 aa, Mycobacterium tuberculosis
TGGLLFGAGGNGGPGGS

SEQ ID NO: 1535555 - protein, 22 aa, Mycobacterium tuberculosis
TGGRGGLLMGAGAGGHGGTGGA

SEQ ID NO: 1535556 - protein, 18 aa, Mycobacterium tuberculosis
TGGWLYRNGGAGDQGAIA

SEQ ID NO: 1535557 - protein, 19 aa, Mycobacterium tuberculosis
TGLWGRLLPEWEPIRDLPP

SEQ ID NO: 1535558 - protein, 23 aa, Mycobacterium tuberculosis
TGPRWRLGARDLAALWRRALTLS

SEQ ID NO: 1535559 - protein, 23 aa, Mycobacterium tuberculosis
TGQDLLMITVLKGAVLFVTDLAR

SEQ ID NO: 1535560 - protein, 29 aa, Mycobacterium tuberculosis
TGRERRCWPRWPSWPPAVAAQLVAGGLTI

SEQ ID NO: 1535561 - protein, 17 aa, Mycobacterium tuberculosis
TGRLINAPLPIWNHRRL

SEQ ID NO: 1535562 - protein, 27 aa, Mycobacterium tuberculosis
TGSSSLVIPFWKIGWQNLGLPTGFDVV

SEQ ID NO: 1535563 - protein, 20 aa, Mycobacterium tuberculosis
TGVAYIRWLLRARPADYMLA

SEQ ID NO: 1535564 - protein, 24 aa, Mycobacterium tuberculosis
THNEPMIPIYIFYSMFGFQRTGDS

SEQ ID NO: 1535565 - protein, 21 aa, Mycobacterium tuberculosis
THYYMFLTQDLPLLQPIRAIP

SEQ ID NO: 1535566 - protein, 17 aa, Mycobacterium tuberculosis
TIDPLPLHLALNLTVPD

SEQ ID NO: 1535567 - protein, 18 aa, Mycobacterium tuberculosis
TIGLPYLGFTQWALLHDP

SEQ ID NO: 1535568 - protein, 24 aa, Mycobacterium tuberculosis
TIPSFIPEDFTFLDAIFAGYATVG

SEQ ID NO: 1535569 - protein, 18 aa, Mycobacterium tuberculosis
TKPALTCWKPFTATISKA

SEQ ID NO: 1535570 - protein, 17 aa, Mycobacterium tuberculosis
TKPAPVLIFVPGGAWVH

SEQ ID NO: 1535571 - protein, 25 aa, Mycobacterium tuberculosis
TLGRVMFNELLPLGYPFVNKQMHKK

SEQ ID NO: 1535572 - protein, 17 aa, Mycobacterium tuberculosis
TLIFDYPTAAELAEHLD

SEQ ID NO: 1535573 - protein, 18 aa, Mycobacterium tuberculosis
TLLFPFAAPRVVGDLSEA

SEQ ID NO: 1535574 - protein, 20 aa, Mycobacterium tuberculosis
TLLRNLEFLPNSPTLMNSGT

SEQ ID NO: 1535575 - protein, 20 aa, Mycobacterium tuberculosis
TLMDSHPFTWLPLLSRVLGS

SEQ ID NO: 1535576 - protein, 23 aa, Mycobacterium tuberculosis
TLMDSHPFTWLPLLSRVLGSAQL

SEQ ID NO: 1535577 - protein, 22 aa, Mycobacterium tuberculosis
TLPPLQIPGISVPAFSLPAITL

SEQ ID NO: 1535578 - protein, 17 aa, Mycobacterium tuberculosis
TLRLPLGLVGKGGDGGK

SEQ ID NO: 1535579 - protein, 17 aa, Mycobacterium tuberculosis
TLTFFGSGGRRRPRRGW

SEQ ID NO: 1535580 - protein, 18 aa, Mycobacterium tuberculosis
TMPRRAPALTAPLLVLHG

SEQ ID NO: 1535581 - protein, 19 aa, Mycobacterium tuberculosis
TMPRRAPALTAPLLVLHGT

SEQ ID NO: 1535582 - protein, 18 aa, Mycobacterium tuberculosis
TMTHAWLLTGPPGSGRSV

SEQ ID NO: 1535583 - protein, 17 aa, Mycobacterium tuberculosis
TMVPAGWSLVEAAAVPV

SEQ ID NO: 1535584 - protein, 21 aa, Mycobacterium tuberculosis
TNPGTLMWWIARSLELLQDFQ

SEQ ID NO: 1535585 - protein, 29 aa, Mycobacterium tuberculosis
TNPHRQCILIFLTLYPPPHYYEKISFCEI

SEQ ID NO: 1535586 - protein, 24 aa, Mycobacterium tuberculosis
TNSLRMYLGAGSRPLLAAAGAWDG

SEQ ID NO: 1535587 - protein, 21 aa, Mycobacterium tuberculosis
TNTARPWHIGLYGNAGGLGPM

SEQ ID NO: 1535588 - protein, 24 aa, Mycobacterium tuberculosis
TPAIPAIPPFFPGFPPDYVTVSGQ

SEQ ID NO: 1535589 - protein, 17 aa, Mycobacterium tuberculosis
TPALISGFFNTGSNMSG

SEQ ID NO: 1535590 - protein, 23 aa, Mycobacterium tuberculosis
TPAQVLLRWNLQLGNAVVVRSAR

SEQ ID NO: 1535591 - protein, 25 aa, Mycobacterium tuberculosis
TPEIPAIPPFFPGFPPDYVTVSGQI

SEQ ID NO: 1535592 - protein, 18 aa, Mycobacterium tuberculosis
TPERPIIFNLPATVEMTT

SEQ ID NO: 1535593 - protein, 20 aa, Mycobacterium tuberculosis
TPGSWRREPLSGIPAATNTV

SEQ ID NO: 1535594 - protein, 26 aa, Mycobacterium tuberculosis
TPGWLEWFINWYLPISQLFTTPWVCH

SEQ ID NO: 1535595 - protein, 25 aa, Mycobacterium tuberculosis
TPPRRRWPRSWRLFKRFAAAAAKRA

SEQ ID NO: 1535596 - protein, 17 aa, Mycobacterium tuberculosis
TPVVAMPLLRRGNKEVH

SEQ ID NO: 1535597 - protein, 22 aa, Mycobacterium tuberculosis
TQLWLERPLIGDGVHGAPGTGQ

SEQ ID NO: 1535598 - protein, 20 aa, Mycobacterium tuberculosis
TRAVPGCRWWWLSETTRLTH

SEQ ID NO: 1535599 - protein, 17 aa, Mycobacterium tuberculosis
TRLVPFIEWLRGAYPDQ

SEQ ID NO: 1535600 - protein, 24 aa, Mycobacterium tuberculosis
TRMHRFWISLYFPLTMRSLCNAIV

SEQ ID NO: 1535601 - protein, 18 aa, Mycobacterium tuberculosis
TRNRALGLLYRWVEHAFG

SEQ ID NO: 1535602 - protein, 17 aa, Mycobacterium tuberculosis
TRQLLERLQPTVPILLA

SEQ ID NO: 1535603 - protein, 23 aa, Mycobacterium tuberculosis
TRRWAGVPFYLRTGKRLGRRVTE

SEQ ID NO: 1535604 - protein, 18 aa, Mycobacterium tuberculosis
TRWSRCWVRVWGSLRSTR

SEQ ID NO: 1535605 - protein, 18 aa, Mycobacterium tuberculosis
TSRRYWPAGPPSPGGPWW

SEQ ID NO: 1535606 - protein, 23 aa, Mycobacterium tuberculosis
TTAAAILGLLPAGGRITAGRVVF

SEQ ID NO: 1535607 - protein, 19 aa, Mycobacterium tuberculosis
TTNPPVEGAFYWLNNREVR

SEQ ID NO: 1535608 - protein, 23 aa, Mycobacterium tuberculosis
TTRLRFNFFVLKLPIRPPALVAK

SEQ ID NO: 1535609 - protein, 27 aa, Mycobacterium tuberculosis
TVLLTGATAFWVATWRWNGSTAWTWST

SEQ ID NO: 1535610 - protein, 17 aa, Mycobacterium tuberculosis
TVPDIPIPAINFGLDGN

SEQ ID NO: 1535611 - protein, 20 aa, Mycobacterium tuberculosis
TVTPVMLLLWIRGVRFMYSV

SEQ ID NO: 1535612 - protein, 17 aa, Mycobacterium tuberculosis
TWRWRRTPRPLSRSTRA

SEQ ID NO: 1535613 - protein, 25 aa, Mycobacterium tuberculosis
TYGDFQNFYLCDLQIKWNGFQAGGP

SEQ ID NO: 1535614 - protein, 18 aa, Mycobacterium tuberculosis
TYVQLFVLIAAANDVRCD

SEQ ID NO: 1535615 - protein, 18 aa, Mycobacterium tuberculosis
VAAAPYAGWLAAAAARAG

SEQ ID NO: 1535616 - protein, 20 aa, Mycobacterium tuberculosis
VAAKRRHLYYVRPLDGHPVA

SEQ ID NO: 1535617 - protein, 17 aa, Mycobacterium tuberculosis
VAAVSVVTGLPVPPPAP

SEQ ID NO: 1535618 - protein, 20 aa, Mycobacterium tuberculosis
VAAYMPFLAWLIQASADCVE

SEQ ID NO: 1535619 - protein, 20 aa, Mycobacterium tuberculosis
VADWLYWQYVTGLLDRALAA

SEQ ID NO: 1535620 - protein, 27 aa, Mycobacterium tuberculosis
VAKGLQFPIVYLPFAFNRNVRSDDILL

SEQ ID NO: 1535621 - protein, 17 aa, Mycobacterium tuberculosis
VALFRLLGSWGVRPDFV

SEQ ID NO: 1535622 - protein, 18 aa, Mycobacterium tuberculosis
VALSLTPFTPSPSAAATP

SEQ ID NO: 1535623 - protein, 20 aa, Mycobacterium tuberculosis
VAMLVAIFRARPSPFYIMDE

SEQ ID NO: 1535624 - protein, 21 aa, Mycobacterium tuberculosis
VAMLVAIFRARPSPFYIMDEV

SEQ ID NO: 1535625 - protein, 17 aa, Mycobacterium tuberculosis
VAPDAFFQFPTSKYGLA

SEQ ID NO: 1535626 - protein, 22 aa, Mycobacterium tuberculosis
VAPVGLQRYLAPVSAVPAAAAA

SEQ ID NO: 1535627 - protein, 17 aa, Mycobacterium tuberculosis
VATQYLAWLSTAAAQAE

SEQ ID NO: 1535628 - protein, 25 aa, Mycobacterium tuberculosis
VDDDLADLFLPRPLRWLAGATRSGV

SEQ ID NO: 1535629 - protein, 22 aa, Mycobacterium tuberculosis
VDDMLWQVPYLPIDPRDVGRTY

SEQ ID NO: 1535630 - protein, 26 aa, Mycobacterium tuberculosis
VDDPLAMYLFDLCTLPLNLAGHCGMS

SEQ ID NO: 1535631 - protein, 19 aa, Mycobacterium tuberculosis
VDLYLIHWPAPPVGKYVDA

SEQ ID NO: 1535632 - protein, 23 aa, Mycobacterium tuberculosis
VDQGLSLTLFFKDTGHHPRREQG

SEQ ID NO: 1535633 - protein, 25 aa, Mycobacterium tuberculosis
VDTEITRLVPFIEWLRGAYPDQLIS

SEQ ID NO: 1535634 - protein, 22 aa, Mycobacterium tuberculosis
VDVAILAVPHLPPPPLVFAAEP

SEQ ID NO: 1535635 - protein, 17 aa, Mycobacterium tuberculosis
VECRPRRGQPRQLLTNI

SEQ ID NO: 1535636 - protein, 18 aa, Mycobacterium tuberculosis
VEILPTPFLPAGVFDLWG

SEQ ID NO: 1535637 - protein, 19 aa, Mycobacterium tuberculosis
VENPKCHLAWTTLAGIGRV

SEQ ID NO: 1535638 - protein, 20 aa, Mycobacterium tuberculosis
VENPKCHLAWTTLAGIGRVE

SEQ ID NO: 1535639 - protein, 21 aa, Mycobacterium tuberculosis
VEVALFRLLGSWGVRPDFVMG

SEQ ID NO: 1535640 - protein, 23 aa, Mycobacterium tuberculosis
VEVALYRLVMSWGVRPGLVLGHS

SEQ ID NO: 1535641 - protein, 26 aa, Mycobacterium tuberculosis
VFDNLTKFITWTLPTNLGEGLVILAA

SEQ ID NO: 1535642 - protein, 20 aa, Mycobacterium tuberculosis
VFIELLAWQFASPVRWIETQ

SEQ ID NO: 1535643 - protein, 25 aa, Mycobacterium tuberculosis
VFQRTPIWCFPKFDVPLPTAVRWAM

SEQ ID NO: 1535644 - protein, 24 aa, Mycobacterium tuberculosis
VFSEALAAPLFWIAANAGLDGSVV

SEQ ID NO: 1535645 - protein, 23 aa, Mycobacterium tuberculosis
VFSEEFLLQRPLLTAIRRTEPTV

SEQ ID NO: 1535646 - protein, 17 aa, Mycobacterium tuberculosis
VGAVNFGPISVQGFGLF

SEQ ID NO: 1535647 - protein, 19 aa, Mycobacterium tuberculosis
VGFKWFVDGLIGATLGFGG

SEQ ID NO: 1535648 - protein, 22 aa, Mycobacterium tuberculosis
VGFKWFVDGLIGATLGFGGEES

SEQ ID NO: 1535649 - protein, 25 aa, Mycobacterium tuberculosis
VGGPPLVFQLLWYPTTMADLSLPSF

SEQ ID NO: 1535650 - protein, 26 aa, Mycobacterium tuberculosis
VGGPVGGHGLLGLGGSHGAGGAGGSG

SEQ ID NO: 1535651 - protein, 17 aa, Mycobacterium tuberculosis
VGGRGGWLLGNGGTGGA

SEQ ID NO: 1535652 - protein, 19 aa, Mycobacterium tuberculosis
VGLNLVIDMPLPISLGVNI

SEQ ID NO: 1535653 - protein, 28 aa, Mycobacterium tuberculosis
VGQIIPWNFPILMAAWKLAPALAAGNTA

SEQ ID NO: 1535654 - protein, 35 aa, Mycobacterium tuberculosis
VGSGSTFRCDRLRQQLFTFICGNAGYGRQRRPCPQ

SEQ ID NO: 1535655 - protein, 18 aa, Mycobacterium tuberculosis
VGVKVLPWIPTPAKRILS

SEQ ID NO: 1535656 - protein, 19 aa, Mycobacterium tuberculosis
VGVKVLPWIPTPAKRILSA

SEQ ID NO: 1535657 - protein, 24 aa, Mycobacterium tuberculosis
VHVHRSWLQIPGDHRRYLLDRHTV

SEQ ID NO: 1535658 - protein, 17 aa, Mycobacterium tuberculosis
VIAQLRFPGYFLVVHDI

SEQ ID NO: 1535659 - protein, 17 aa, Mycobacterium tuberculosis
VIDLILPIGKVNAAFIV

SEQ ID NO: 1535660 - protein, 22 aa, Mycobacterium tuberculosis
VIGAPWLVAFAERSRFFEVFSS

SEQ ID NO: 1535661 - protein, 18 aa, Mycobacterium tuberculosis
VIIDYWGIIKADIGIRDG

SEQ ID NO: 1535662 - protein, 26 aa, Mycobacterium tuberculosis
VILAVMPWNFPLWQAVRFAAPALMAG

SEQ ID NO: 1535663 - protein, 24 aa, Mycobacterium tuberculosis
VINAPTQTLLGRPLIGNGTNGAPG

SEQ ID NO: 1535664 - protein, 17 aa, Mycobacterium tuberculosis
VINPFFDWAYDRSPRTP

SEQ ID NO: 1535665 - protein, 25 aa, Mycobacterium tuberculosis
VLAEWFLRRFSLLDSLYMVPSVPII

SEQ ID NO: 1535666 - protein, 18 aa, Mycobacterium tuberculosis
VLEWRYPVLLREFAVRQG

SEQ ID NO: 1535667 - protein, 18 aa, Mycobacterium tuberculosis
VLLDLLRLGTYQLLRTRV

SEQ ID NO: 1535668 - protein, 31 aa, Mycobacterium tuberculosis; identical to SEQ ID NO: 237966

SEQ ID NO: 1535669 - protein, 18 aa, Mycobacterium tuberculosis
VLPLYLPSGDGLIGLLSQ

SEQ ID NO: 1535670 - protein, 17 aa, Mycobacterium tuberculosis
VLPPIHIPPIPVGFAAV

SEQ ID NO: 1535671 - protein, 19 aa, Mycobacterium tuberculosis
VLSPPYSILAIGDPPTLAA

SEQ ID NO: 1535672 - protein, 17 aa, Mycobacterium tuberculosis
VMMVLRHIPRSIFRKLP

SEQ ID NO: 1535673 - protein, 26 aa, Mycobacterium tuberculosis
VMTGWQRLHFRFGFPAPLLEPLAVER

SEQ ID NO: 1535674 - protein, 18 aa, Mycobacterium tuberculosis
VNAEYWYRSIRQPVQFER

SEQ ID NO: 1535675 - protein, 17 aa, Mycobacterium tuberculosis
VNAVNPGLATPVTPAAN

SEQ ID NO: 1535676 - protein, 22 aa, Mycobacterium tuberculosis
VNLWAPLMWTSLVVTAWMGEHG

SEQ ID NO: 1535677 - protein, 17 aa, Mycobacterium tuberculosis
VPFQQALQQLPNLGIGN

SEQ ID NO: 1535678 - protein, 22 aa, Mycobacterium tuberculosis
VPKTLIQHLIRWVISAGEFGEK

SEQ ID NO: 1535679 - protein, 21 aa, Mycobacterium tuberculosis
VPPSWAWPKPAVAPPVLFGCR

SEQ ID NO: 1535680 - protein, 19 aa, Mycobacterium tuberculosis
VPRSLHWLRPITPTFRPSW

SEQ ID NO: 1535681 - protein, 20 aa, Mycobacterium tuberculosis
VPRSLHWLRPITPTFRPSWP

SEQ ID NO: 1535682 - protein, 17 aa, Mycobacterium tuberculosis
VPVWLPYIRGERTPFHE

SEQ ID NO: 1535683 - protein, 17 aa, Mycobacterium tuberculosis
VPWASLLQRFPGLGAGA

SEQ ID NO: 1535684 - protein, 19 aa, Mycobacterium tuberculosis
VQFVPFFLGQRTPPYPTAT

SEQ ID NO: 1535685 - protein, 18 aa, Mycobacterium tuberculosis
VQQNLLNAINAPTQALLG

SEQ ID NO: 1535686 - protein, 21 aa, Mycobacterium tuberculosis
VQQRLALLLRDDAATPLLGCE

SEQ ID NO: 1535687 - protein, 18 aa, Mycobacterium tuberculosis
VRIMLDQYWPSVPHVLIE

SEQ ID NO: 1535688 - protein, 24 aa, Mycobacterium tuberculosis
VRLKARLWFVHRGIEKLFHGRPAT

SEQ ID NO: 1535689 - protein, 19 aa, Mycobacterium tuberculosis
VRLVRQIPYTLACDLLLTG

SEQ ID NO: 1535690 - protein, 22 aa, Mycobacterium tuberculosis
VRRSNALLDWAYGRRFRYSETM

SEQ ID NO: 1535691 - protein, 26 aa, Mycobacterium tuberculosis
VRSGATVDWWWGAWGAWVGVSRAGGS

SEQ ID NO: 1535692 - protein, 18 aa, Mycobacterium tuberculosis
VRSLVAWFWDQPLRAPLI

SEQ ID NO: 1535693 - protein, 20 aa, Mycobacterium tuberculosis
VRTDLFRRNGLPVPAPHDDD

SEQ ID NO: 1535694 - protein, 23 aa, Mycobacterium tuberculosis
VRYHRAPRRLGVPARWLAVVINY

SEQ ID NO: 1535695 - protein, 17 aa, Mycobacterium tuberculosis
VSGWRMLSGDETGWLLG

SEQ ID NO: 1535696 - protein, 17 aa, Mycobacterium tuberculosis
VSLLPTLQSFLPPPFDA

SEQ ID NO: 1535697 - protein, 24 aa, Mycobacterium tuberculosis
VTEVRLFLRRVPALAFLPNRRPAE

SEQ ID NO: 1535698 - protein, 17 aa, Mycobacterium tuberculosis
VTGVMSSGFFNFGTGNS

SEQ ID NO: 1535699 - protein, 23 aa, Mycobacterium tuberculosis
VTNPSPYMYLLQVPNSDGAVDFS

SEQ ID NO: 1535700 - protein, 17 aa, Mycobacterium tuberculosis
VTRLVLVVPFEGHKDIF

SEQ ID NO: 1535701 - protein, 22 aa, Mycobacterium tuberculosis
VTRTPIHLMGLDKTFRLFSTLH

SEQ ID NO: 1535702 - protein, 20 aa, Mycobacterium tuberculosis
VVAAAPYAGWLAAAAARAGG

SEQ ID NO: 1535703 - protein, 21 aa, Mycobacterium tuberculosis
VVAAQPYLAWLTYTAESAAHA

SEQ ID NO: 1535704 - protein, 18 aa, Mycobacterium tuberculosis
VVAARLPFGWSADSGVTA

SEQ ID NO: 1535705 - protein, 22 aa, Mycobacterium tuberculosis
VVAPDAFFQFPTSKYGLALDNW

SEQ ID NO: 1535706 - protein, 22 aa, Mycobacterium tuberculosis
VVAPLLSRSLILQLRPLTAEDT

SEQ ID NO: 1535707 - protein, 19 aa, Mycobacterium tuberculosis
VVDWLYWQYVTGLLDRALA

SEQ ID NO: 1535708 - protein, 22 aa, Mycobacterium tuberculosis
VVFEVMVRPLIRLSLGKRHPMR

SEQ ID NO: 1535709 - protein, 18 aa, Mycobacterium tuberculosis
VVKGGRRFSFTRFGHRGR

SEQ ID NO: 1535710 - protein, 17 aa, Mycobacterium tuberculosis
VVLLPDVYYREGDWAPF

SEQ ID NO: 1535711 - protein, 17 aa, Mycobacterium tuberculosis
VVMAPMYLGLRVWSRAT

SEQ ID NO: 1535712 - protein, 22 aa, Mycobacterium tuberculosis
VVNGPTQLLLGRPLIGDGANGG

SEQ ID NO: 1535713 - protein, 20 aa, Mycobacterium tuberculosis
VVPIRVYRWKPAPLGGVFDH

SEQ ID NO: 1535714 - protein, 17 aa, Mycobacterium tuberculosis
VVPLIVNLYAFGARDFD

SEQ ID NO: 1535715 - protein, 22 aa, Mycobacterium tuberculosis
VVSPVWPAPRALGLRAVAATAT

SEQ ID NO: 1535716 - protein, 22 aa, Mycobacterium tuberculosis
VWLRPFRNLVYVMPPYICTPAE

SEQ ID NO: 1535717 - protein, 23 aa, Mycobacterium tuberculosis
VYCPGWVALFRWLKPLLSTRVGQ

SEQ ID NO: 1535718 - protein, 24 aa, Mycobacterium tuberculosis
VYCPGWVALFRWLKPLLSTRVGQR

SEQ ID NO: 1535719 - protein, 20 aa, Mycobacterium tuberculosis
VYRKAACGTGWQLPRRRLRR

SEQ ID NO: 1535720 - protein, 19 aa, Mycobacterium tuberculosis
WAALRSLPPPAPQPALVAG

SEQ ID NO: 1535721 - protein, 17 aa, Mycobacterium tuberculosis
WANILLQRPAPATGALN

SEQ ID NO: 1535722 - protein, 24 aa, Mycobacterium tuberculosis
WCISRQLWWGHRIPIWYGPDGEQV

SEQ ID NO: 1535723 - protein, 18 aa, Mycobacterium tuberculosis
WCRNLLGRKLFQRGFLEP

SEQ ID NO: 1535724 - protein, 18 aa, Mycobacterium tuberculosis
WELPAMMLQFLRTGSGAT

SEQ ID NO: 1535725 - protein, 17 aa, Mycobacterium tuberculosis
WFALMKPMTSTATGREA

SEQ ID NO: 1535726 - protein, 17 aa, Mycobacterium tuberculosis
WFGVAMILDFSWLPPEI

SEQ ID NO: 1535727 - protein, 20 aa, Mycobacterium tuberculosis
WFPGFMTFRFLECGLLTMVS

SEQ ID NO: 1535728 - protein, 18 aa, Mycobacterium tuberculosis
WFTGLIPITVPIAGSAFG

SEQ ID NO: 1535729 - protein, 27 aa, Mycobacterium tuberculosis
WGTGGTGVHRLHRRPGCQRRPHRRRGG

SEQ ID NO: 1535730 - protein, 22 aa, Mycobacterium tuberculosis
WHQLARAFLMYVTQRWPDVLST

SEQ ID NO: 1535731 - protein, 17 aa, Mycobacterium tuberculosis
WIADERGTWHLREAEEH

SEQ ID NO: 1535732 - protein, 20 aa, Mycobacterium tuberculosis
WIRQHADLGRPGFLWGGGKK

SEQ ID NO: 1535733 - protein, 17 aa, Mycobacterium tuberculosis
WLARWRPCTPPVESFYS

SEQ ID NO: 1535734 - protein, 18 aa, Mycobacterium tuberculosis
WLCLLEAFDAPQRSGLVR

SEQ ID NO: 1535735 - protein, 18 aa, Mycobacterium tuberculosis
WLPGADLRAPCALPVLVI

SEQ ID NO: 1535736 - protein, 17 aa, Mycobacterium tuberculosis
WLRFGWFFLATRRDPKG

SEQ ID NO: 1535737 - protein, 22 aa, Mycobacterium tuberculosis
WLRPFRNLVYAMPPYICTPAEI

SEQ ID NO: 1535738 - protein, 20 aa, Mycobacterium tuberculosis
WLTCWRPTTWRWRRTPRPLS

SEQ ID NO: 1535739 - protein, 19 aa, Mycobacterium tuberculosis
WPLGWGFDHFWGFPSGAAG

SEQ ID NO: 1535740 - protein, 19 aa, Mycobacterium tuberculosis
WRPQPQFGRPWLQVVAFHV

SEQ ID NO: 1535741 - protein, 25 aa, Mycobacterium tuberculosis
WRRRRVRQWWIRRGRWPWRRRRRRR

SEQ ID NO: 1535742 - protein, 18 aa, Mycobacterium tuberculosis
WRRWAGGAGGAFLGDGGN

SEQ ID NO: 1535743 - protein, 17 aa, Mycobacterium tuberculosis
WRRYRRQRWCRRQRRAD

SEQ ID NO: 1535744 - protein, 24 aa, Mycobacterium tuberculosis
WSHPNDWWIVRLLGSITPTERTTI

SEQ ID NO: 1535745 - protein, 18 aa, Mycobacterium tuberculosis
WVIAYRWFRAGLLPVPAQ

SEQ ID NO: 1535746 - protein, 18 aa, Mycobacterium tuberculosis
WVRDYLLLRGLLGTSILW

SEQ ID NO: 1535747 - protein, 17 aa, Mycobacterium tuberculosis
WYRSIRQPVQFERAVRN

SEQ ID NO: 1535748 - protein, 20 aa, Mycobacterium tuberculosis
YARLFAWLGLWERHTDLAVI

SEQ ID NO: 1535749 - protein, 19 aa, Mycobacterium tuberculosis
YDEYPVLPPIGLQAPQVPI

SEQ ID NO: 1535750 - protein, 25 aa, Mycobacterium tuberculosis
YDRSGLWPYLEKLGFYLVGYGCTTC

SEQ ID NO: 1535751 - protein, 18 aa, Mycobacterium tuberculosis
YEGPWWVAVSRAPAGPPF

SEQ ID NO: 1535752 - protein, 26 aa, Mycobacterium tuberculosis
YFVPAFSGLFAPYWRSDARGAIVGLS

SEQ ID NO: 1535753 - protein, 23 aa, Mycobacterium tuberculosis
YGDFQNFYLCDLQIKWNGFQAGG

SEQ ID NO: 1535754 - protein, 19 aa, Mycobacterium tuberculosis
YGGVWLHSWLDRDLGISGR

SEQ ID NO: 1535755 - protein, 17 aa, Mycobacterium tuberculosis
YILYFQLPWLPERSASW

SEQ ID NO: 1535756 - protein, 26 aa, Mycobacterium tuberculosis
YLAYRPVCRPAWLPTLRRPWRRSPER

SEQ ID NO: 1535757 - protein, 19 aa, Mycobacterium tuberculosis
YLLNGLFFSLPWYYRSGYD

SEQ ID NO: 1535758 - protein, 17 aa, Mycobacterium tuberculosis
YLRDLVLALRWVHDNIA

SEQ ID NO: 1535759 - protein, 17 aa, Mycobacterium tuberculosis
YNTMYFALARRAALRRH

SEQ ID NO: 1535760 - protein, 18 aa, Mycobacterium tuberculosis
YPAWRELFTDILPAHIVK

SEQ ID NO: 1535761 - protein, 18 aa, Mycobacterium tuberculosis
YPHLRPNRGVDYLLHNDT

SEQ ID NO: 1535762 - protein, 18 aa, Mycobacterium tuberculosis
YPTQFLRGGPWTRWGCCP

SEQ ID NO: 1535763 - protein, 22 aa, Mycobacterium tuberculosis
YQQRGLAWLAFLSSLGLGSCLA

SEQ ID NO: 1535764 - protein, 26 aa, Mycobacterium tuberculosis
YQRYMGWFDGNLGWLWPHPPEALAPR

SEQ ID NO: 1535765 - protein, 17 aa, Mycobacterium tuberculosis
YRNRWVRTPAVCAALGE

SEQ ID NO: 1535766 - protein, 18 aa, Mycobacterium tuberculosis
YRTLYRDLARYGAALWLV

SEQ ID NO: 1535767 - protein, 22 aa, Mycobacterium tuberculosis
YSNGILWRGDYQGLIGYSYALT

SEQ ID NO: 1535768 - protein, 20 aa, Mycobacterium tuberculosis
YSRWALRLRVPFTVPVEAKS

SEQ ID NO: 1535769 - protein, 17 aa, Mycobacterium tuberculosis
YTLGNSLRRTLLSSIPG

SEQ ID NO: 1535770 - protein, 19 aa, Mycobacterium tuberculosis
YTWPRFVCALPKEFFAAVR

SEQ ID NO: 1535771 - protein, 20 aa, Mycobacterium tuberculosis
YVEPVRPWPGSAAGLIVRLG

SEQ ID NO: 1535772 - protein, 18 aa, Mycobacterium tuberculosis
YVLLPGRRMPIPQLPGAT

SEQ ID NO: 1535773 - protein, 17 aa, Mycobacterium tuberculosis
YVYPGHAIWWLARGLEF

SEQ ID NO: 1535774 - protein, 28 aa, Mycobacterium tuberculosis
YYDRSGLWPYLEKLGFYLVGYGCTTCIG

SEQ ID NO: 1535775 - protein, 19 aa, Mycobacterium tuberculosis
YYIAMLAELSRLRPLPFRL

SEQ ID NO: 1535776 - protein, 5 aa, Mycobacterium tuberculosis
SGTGN

SEQ ID NO: 1535777 - protein, 6 aa, Mycobacterium tuberculosis
GADEVS

SEQ ID NO: 1535778 - protein, 7 aa, Mycobacterium tuberculosis
PSPSMGR

SEQ ID NO: 1535779 - protein, 4 aa, Mycobacterium tuberculosis
DNPN

SEQ ID NO: 1535780 - protein, 6 aa, Mycobacterium tuberculosis
DRSEQV

SEQ ID NO: 1535781 - protein, 5 aa, Mycobacterium tuberculosis
YSQGA

SEQ ID NO: 1535782 - protein, 7 aa, Mycobacterium tuberculosis
PVPIPGA

SEQ ID NO: 1535783 - protein, 4 aa, Mycobacterium tuberculosis
GQSS

SEQ ID NO: 1535784 - protein, 4 aa, Mycobacterium tuberculosis
GNVG

SEQ ID NO: 1535785 - protein, 7 aa, Mycobacterium tuberculosis
GADEVSA

SEQ ID NO: 1535786 - protein, 4 aa, Mycobacterium tuberculosis
IDST

SEQ ID NO: 1535787 - protein, 4 aa, Mycobacterium tuberculosis
SELP

SEQ ID NO: 1535788 - protein, 5 aa, Mycobacterium tuberculosis
PPGTV

SEQ ID NO: 1535789 - protein, 5 aa, Mycobacterium tuberculosis
ADEVS

SEQ ID NO: 1535790 - protein, 4 aa, Mycobacterium tuberculosis
AGCQ

SEQ ID NO: 1535791 - protein, 6 aa, Mycobacterium tuberculosis
NAPTQT

SEQ ID NO: 1535792 - protein, 8 aa, Mycobacterium tuberculosis
ADGSVTRF

SEQ ID NO: 1535793 - protein, 4 aa, Mycobacterium tuberculosis
APED

SEQ ID NO: 1535794 - protein, 7 aa, Mycobacterium tuberculosis
APPGEGV

SEQ ID NO: 1535795 - protein, 7 aa, Mycobacterium tuberculosis
DLRPGGP

SEQ ID NO: 1535796 - protein, 12 aa, Mycobacterium tuberculosis
DRWTSDQSGATY

SEQ ID NO: 1535797 - protein, 14 aa, Mycobacterium tuberculosis
LREPPEADTNVPGP

SEQ ID NO: 1535798 - protein, 6 aa, Mycobacterium tuberculosis
NNAGYS

SEQ ID NO: 1535799 - protein, 7 aa, Mycobacterium tuberculosis
PDPSTAR

SEQ ID NO: 1535800 - protein, 13 aa, Mycobacterium tuberculosis
PLPGTAGHGEGAY

SEQ ID NO: 1535801 - protein, 10 aa, Mycobacterium tuberculosis
QESRGTVSVN

SEQ ID NO: 1535802 - protein, 7 aa, Mycobacterium tuberculosis
RESNNNS

SEQ ID NO: 1535803 - protein, 6 aa, Mycobacterium tuberculosis
RTNAVA

SEQ ID NO: 1535804 - protein, 8 aa, Mycobacterium tuberculosis
SSDRTFGT

SEQ ID NO: 1535805 - protein, 5 aa, Mycobacterium tuberculosis
SSWRT

SEQ ID NO: 1535806 - protein, 17 aa, Mycobacterium tuberculosis
TGDNQTGIGGLNSGAGN

SEQ ID NO: 1535807 - protein, 10 aa, Mycobacterium tuberculosis
THQASGLGDV

SEQ ID NO: 1535808 - protein, 7 aa, Mycobacterium tuberculosis
TLPQNSP

SEQ ID NO: 1535809 - protein, 14 aa, Mycobacterium tuberculosis
VGDTNTGGFNPGSI

SEQ ID NO: 1535810 - protein, 14 aa, Mycobacterium tuberculosis
AAAGNSASKHPDAV

SEQ ID NO: 1535811 - protein, 10 aa, Mycobacterium tuberculosis
AAAGPDQPAL

SEQ ID NO: 1535812 - protein, 9 aa, Mycobacterium tuberculosis
AAAPGTSSL

SEQ ID NO: 1535813 - protein, 5 aa, Mycobacterium tuberculosis
AAATA

SEQ ID NO: 1535814 - protein, 8 aa, Mycobacterium tuberculosis
AADTTEDL

SEQ ID NO: 1535815 - protein, 10 aa, Mycobacterium tuberculosis
AAEAAPTLTE

SEQ ID NO: 1535816 - protein, 13 aa, Mycobacterium tuberculosis
AAEAARPHSGRTV

SEQ ID NO: 1535817 - protein, 7 aa, Mycobacterium tuberculosis
AAEARRR

SEQ ID NO: 1535818 - protein, 12 aa, Mycobacterium tuberculosis
AAELSDAQRTRL

SEQ ID NO: 1535819 - protein, 12 aa, Mycobacterium tuberculosis
AAEVREKTEATL

SEQ ID NO: 1535820 - protein, 5 aa, Mycobacterium tuberculosis
AAGAP

SEQ ID NO: 1535821 - protein, 10 aa, Mycobacterium tuberculosis
AAGEPHGRPR

SEQ ID NO: 1535822 - protein, 7 aa, Mycobacterium tuberculosis
AAGRAGG

SEQ ID NO: 1535823 - protein, 5 aa, Mycobacterium tuberculosis
AAGRE

SEQ ID NO: 1535824 - protein, 7 aa, Mycobacterium tuberculosis
AANDPQA

SEQ ID NO: 1535825 - protein, 19 aa, Mycobacterium tuberculosis
AAPPDPSPVPLKDGDTIPL

SEQ ID NO: 1535826 - protein, 7 aa, Mycobacterium tuberculosis
AAPQPTF

SEQ ID NO: 1535827 - protein, 20 aa, Mycobacterium tuberculosis
AAQRAADQKLADNRTALDAA

SEQ ID NO: 1535828 - protein, 6 aa, Mycobacterium tuberculosis
AATAPD

SEQ ID NO: 1535829 - protein, 16 aa, Mycobacterium tuberculosis
AATGTANAAPTHQPEW

SEQ ID NO: 1535830 - protein, 5 aa, Mycobacterium tuberculosis
AATGW

SEQ ID NO: 1535831 - protein, 6 aa, Mycobacterium tuberculosis
ADAGHR

SEQ ID NO: 1535832 - protein, 7 aa, Mycobacterium tuberculosis
ADEVSTQ

SEQ ID NO: 1535833 - protein, 14 aa, Mycobacterium tuberculosis
ADFPAGRQKLNGPQ

SEQ ID NO: 1535834 - protein, 8 aa, Mycobacterium tuberculosis
ADPADDAL

SEQ ID NO: 1535835 - protein, 5 aa, Mycobacterium tuberculosis
ADPAT

SEQ ID NO: 1535836 - protein, 6 aa, Mycobacterium tuberculosis
ADPPSM

SEQ ID NO: 1535837 - protein, 19 aa, Mycobacterium tuberculosis
ADPTGYAGAAPSRSFPWPP

SEQ ID NO: 1535838 - protein, 9 aa, Mycobacterium tuberculosis
ADREPRPGH

SEQ ID NO: 1535839 - protein, 4 aa, Mycobacterium tuberculosis
ADSG

SEQ ID NO: 1535840 - protein, 4 aa, Mycobacterium tuberculosis
ADSS

SEQ ID NO: 1535841 - protein, 8 aa, Mycobacterium tuberculosis
ADTAQMDS

SEQ ID NO: 1535842 - protein, 7 aa, Mycobacterium tuberculosis
AEDATPR

SEQ ID NO: 1535843 - protein, 10 aa, Mycobacterium tuberculosis
AEDDDEPYYP

SEQ ID NO: 1535844 - protein, 4 aa, Mycobacterium tuberculosis
AEGG

SEQ ID NO: 1535845 - protein, 13 aa, Mycobacterium tuberculosis
AEIDTADAQNLEE

SEQ ID NO: 1535846 - protein, 7 aa, Mycobacterium tuberculosis
AEPRGGK

SEQ ID NO: 1535847 - protein, 6 aa, Mycobacterium tuberculosis
AGAGSY

SEQ ID NO: 1535848 - protein, 13 aa, Mycobacterium tuberculosis
AGAPGDKSRTTMS

SEQ ID NO: 1535849 - protein, 8 aa, Mycobacterium tuberculosis
AGAPGDPL

SEQ ID NO: 1535850 - protein, 18 aa, Mycobacterium tuberculosis
AGASPTEAAAAGTEAGRE

SEQ ID NO: 1535851 - protein, 11 aa, Mycobacterium tuberculosis
AGKQGLSGGNE

SEQ ID NO: 1535852 - protein, 7 aa, Mycobacterium tuberculosis
AGNPKKI

SEQ ID NO: 1535853 - protein, 6 aa, Mycobacterium tuberculosis
AGPAPM

SEQ ID NO: 1535854 - protein, 8 aa, Mycobacterium tuberculosis
AGRPGRNL

SEQ ID NO: 1535855 - protein, 6 aa, Mycobacterium tuberculosis
AGSGPL

SEQ ID NO: 1535856 - protein, 4 aa, Mycobacterium tuberculosis
AGYN

SEQ ID NO: 1535857 - protein, 6 aa, Mycobacterium tuberculosis
AGYTAE

SEQ ID NO: 1535858 - protein, 5 aa, Mycobacterium tuberculosis
AHATA

SEQ ID NO: 1535859 - protein, 4 aa, Mycobacterium tuberculosis
AKGF

SEQ ID NO: 1535860 - protein, 5 aa, Mycobacterium tuberculosis
AKGQA

SEQ ID NO: 1535861 - protein, 4 aa, Mycobacterium tuberculosis
AKQK

SEQ ID NO: 1535862 - protein, 14 aa, Mycobacterium tuberculosis
ALGRSGKLGDNNTA

SEQ ID NO: 1535863 - protein, 26 aa, Mycobacterium tuberculosis
ANGGAGGLGDGVGVDRGTGGAGGRGG

SEQ ID NO: 1535864 - protein, 4 aa, Mycobacterium tuberculosis
ANGS

SEQ ID NO: 1535865 - protein, 5 aa, Mycobacterium tuberculosis
ANQGE

SEQ ID NO: 1535866 - protein, 22 aa, Mycobacterium tuberculosis
ANQGVSDRKELETRGREAARAA

SEQ ID NO: 1535867 - protein, 14 aa, Mycobacterium tuberculosis
ANSRCTGTADGSAR

SEQ ID NO: 1535868 - protein, 4 aa, Mycobacterium tuberculosis
APAR

SEQ ID NO: 1535869 - protein, 6 aa, Mycobacterium tuberculosis
APATAD

SEQ ID NO: 1535870 - protein, 4 aa, Mycobacterium tuberculosis
APHT

SEQ ID NO: 1535871 - protein, 20 aa, Mycobacterium tuberculosis
APPPAAHAKNGDTHVTGQGI

SEQ ID NO: 1535872 - protein, 12 aa, Mycobacterium tuberculosis
APPTDRPPTGRL

SEQ ID NO: 1535873 - protein, 7 aa, Mycobacterium tuberculosis
AQADVEA

SEQ ID NO: 1535874 - protein, 6 aa, Mycobacterium tuberculosis
AQDDYN

SEQ ID NO: 1535875 - protein, 4 aa, Mycobacterium tuberculosis
ARDG

SEQ ID NO: 1535876 - protein, 15 aa, Mycobacterium tuberculosis
ARERGGIYPESDKTG

SEQ ID NO: 1535877 - protein, 8 aa, Mycobacterium tuberculosis
ASGIPKAA

SEQ ID NO: 1535878 - protein, 17 aa, Mycobacterium tuberculosis
ASGITGQTLDVNCGEYH

SEQ ID NO: 1535879 - protein, 7 aa, Mycobacterium tuberculosis
ASGQPLP

SEQ ID NO: 1535880 - protein, 7 aa, Mycobacterium tuberculosis
ASLAGNY

SEQ ID NO: 1535881 - protein, 19 aa, Mycobacterium tuberculosis
ASPADAAAGTMYGDPAAAA

SEQ ID NO: 1535882 - protein, 5 aa, Mycobacterium tuberculosis
ASPEP

SEQ ID NO: 1535883 - protein, 7 aa, Mycobacterium tuberculosis
ASQSTPQ

SEQ ID NO: 1535884 - protein, 19 aa, Mycobacterium tuberculosis
ASTQAKTRAMQATAQAAAY

SEQ ID NO: 1535885 - protein, 8 aa, Mycobacterium tuberculosis
ATDQGPAG

SEQ ID NO: 1535886 - protein, 10 aa, Mycobacterium tuberculosis
ATEPATATAP

SEQ ID NO: 1535887 - protein, 9 aa, Mycobacterium tuberculosis
ATEPATATL

SEQ ID NO: 1535888 - protein, 6 aa, Mycobacterium tuberculosis
ATGDKI

SEQ ID NO: 1535889 - protein, 6 aa, Mycobacterium tuberculosis
ATGRAT

SEQ ID NO: 1535890 - protein, 9 aa, Mycobacterium tuberculosis
ATNGDNPAF

SEQ ID NO: 1535891 - protein, 18 aa, Mycobacterium tuberculosis
ATTPGADPSITRTEEGSA

SEQ ID NO: 1535892 - protein, 8 aa, Mycobacterium tuberculosis
ATTPSLPE

SEQ ID NO: 1535893 - protein, 5 aa, Mycobacterium tuberculosis
ATTRG

SEQ ID NO: 1535894 - protein, 10 aa, Mycobacterium tuberculosis
AVAPGQPAKV

SEQ ID NO: 1535895 - protein, 9 aa, Mycobacterium tuberculosis
AVKPTGSAA

SEQ ID NO: 1535896 - protein, 14 aa, Mycobacterium tuberculosis
AWTGGGSDKALAAA

SEQ ID NO: 1535897 - protein, 7 aa, Mycobacterium tuberculosis
AYLSEGD

SEQ ID NO: 1535898 - protein, 23 aa, Mycobacterium tuberculosis
AYPPAGDGSFGPAPEFRSATADP

SEQ ID NO: 1535899 - protein, 18 aa, Mycobacterium tuberculosis
CESGGNWAANTGNGKYGG

SEQ ID NO: 1535900 - protein, 8 aa, Mycobacterium tuberculosis
CESGGNWS

SEQ ID NO: 1535901 - protein, 5 aa, Mycobacterium tuberculosis
CGDKT

SEQ ID NO: 1535902 - protein, 35 aa, Mycobacterium tuberculosis; identical to SEQ ID NO: 229297

SEQ ID NO: 1535903 - protein, 17 aa, Mycobacterium tuberculosis
CSSGSKPSGGPLPDAKP

SEQ ID NO: 1535904 - protein, 29 aa, Mycobacterium tuberculosis
DAAAAADRLAEASQAHTKALEDAKSEAHR

SEQ ID NO: 1535905 - protein, 5 aa, Mycobacterium tuberculosis
DAAHP

SEQ ID NO: 1535906 - protein, 16 aa, Mycobacterium tuberculosis
DADGRRVTTSTGASYS

SEQ ID NO: 1535907 - protein, 13 aa, Mycobacterium tuberculosis
DADGRTANTPGFD

SEQ ID NO: 1535908 - protein, 18 aa, Mycobacterium tuberculosis
DADNDRLRAEPQVDYSRE

SEQ ID NO: 1535909 - protein, 6 aa, Mycobacterium tuberculosis
DAGGYK

SEQ ID NO: 1535910 - protein, 13 aa, Mycobacterium tuberculosis
DAGVKPPRTEAPD

SEQ ID NO: 1535911 - protein, 7 aa, Mycobacterium tuberculosis
DAHDDDI

SEQ ID NO: 1535912 - protein, 8 aa, Mycobacterium tuberculosis
DAPPPKNE

SEQ ID NO: 1535913 - protein, 18 aa, Mycobacterium tuberculosis
DATTIGPPTPPPARQPPV

SEQ ID NO: 1535914 - protein, 4 aa, Mycobacterium tuberculosis
DDGL

SEQ ID NO: 1535915 - protein, 9 aa, Mycobacterium tuberculosis
DDLESNSKE

SEQ ID NO: 1535916 - protein, 9 aa, Mycobacterium tuberculosis
DDNPSYEQY

SEQ ID NO: 1535917 - protein, 15 aa, Mycobacterium tuberculosis
DDPGAAPPPPAAGGG

SEQ ID NO: 1535918 - protein, 13 aa, Mycobacterium tuberculosis
DDSIDDSKKRDHY

SEQ ID NO: 1535919 - protein, 12 aa, Mycobacterium tuberculosis
DEDHATATGVAT

SEQ ID NO: 1535920 - protein, 8 aa, Mycobacterium tuberculosis
DESSATRL

SEQ ID NO: 1535921 - protein, 16 aa, Mycobacterium tuberculosis
DGAPGTATSPNGGAGG

SEQ ID NO: 1535922 - protein, 7 aa, Mycobacterium tuberculosis
DGAPLED

SEQ ID NO: 1535923 - protein, 11 aa, Mycobacterium tuberculosis
DGGIQTTPSQL

SEQ ID NO: 1535924 - protein, 5 aa, Mycobacterium tuberculosis
DGGLD

SEQ ID NO: 1535925 - protein, 11 aa, Mycobacterium tuberculosis
DGITDEDAAAV

SEQ ID NO: 1535926 - protein, 5 aa, Mycobacterium tuberculosis
DGQAR

SEQ ID NO: 1535927 - protein, 5 aa, Mycobacterium tuberculosis
DGSAV

SEQ ID NO: 1535928 - protein, 11 aa, Mycobacterium tuberculosis
DGSSVKVDDVD

SEQ ID NO: 1535929 - protein, 4 aa, Mycobacterium tuberculosis
DHER

SEQ ID NO: 1535930 - protein, 9 aa, Mycobacterium tuberculosis
DITDDDDVS

SEQ ID NO: 1535931 - protein, 7 aa, Mycobacterium tuberculosis
DKGRRRF

SEQ ID NO: 1535932 - protein, 6 aa, Mycobacterium tuberculosis
DLPRGD

SEQ ID NO: 1535933 - protein, 8 aa, Mycobacterium tuberculosis
DPDAPREP

SEQ ID NO: 1535934 - protein, 7 aa, Mycobacterium tuberculosis
DPGQGAM

SEQ ID NO: 1535935 - protein, 8 aa, Mycobacterium tuberculosis
DPSQGMGP

SEQ ID NO: 1535936 - protein, 7 aa, Mycobacterium tuberculosis
DPTTTPF

SEQ ID NO: 1535937 - protein, 8 aa, Mycobacterium tuberculosis
DQAQQSAT

SEQ ID NO: 1535938 - protein, 6 aa, Mycobacterium tuberculosis
DQTAPH

SEQ ID NO: 1535939 - protein, 8 aa, Mycobacterium tuberculosis
DRDGDKID

SEQ ID NO: 1535940 - protein, 6 aa, Mycobacterium tuberculosis
DRRPGG

SEQ ID NO: 1535941 - protein, 4 aa, Mycobacterium tuberculosis
DRSG

SEQ ID NO: 1535942 - protein, 9 aa, Mycobacterium tuberculosis
DRTIEAEAR

SEQ ID NO: 1535943 - protein, 9 aa, Mycobacterium tuberculosis
DSSANLDQT

SEQ ID NO: 1535944 - protein, 10 aa, Mycobacterium tuberculosis
DTGGINTGDK

SEQ ID NO: 1535945 - protein, 10 aa, Mycobacterium tuberculosis
DTGPHNYTDD

SEQ ID NO: 1535946 - protein, 8 aa, Mycobacterium tuberculosis
DTPAHRAA

SEQ ID NO: 1535947 - protein, 4 aa, Mycobacterium tuberculosis
EAAQ

SEQ ID NO: 1535948 - protein, 10 aa, Mycobacterium tuberculosis
EAGDEQDRER

SEQ ID NO: 1535949 - protein, 10 aa, Mycobacterium tuberculosis
EAGPNGRNAM

SEQ ID NO: 1535950 - protein, 9 aa, Mycobacterium tuberculosis
EARTDAERI

SEQ ID NO: 1535951 - protein, 4 aa, Mycobacterium tuberculosis
EEFP

SEQ ID NO: 1535952 - protein, 10 aa, Mycobacterium tuberculosis
EGQLPDPGPI

SEQ ID NO: 1535953 - protein, 7 aa, Mycobacterium tuberculosis
EGTREAA

SEQ ID NO: 1535954 - protein, 13 aa, Mycobacterium tuberculosis
EIEPRGSEPLKPN

SEQ ID NO: 1535955 - protein, 16 aa, Mycobacterium tuberculosis
EIGETTVELTRAPAEW

SEQ ID NO: 1535956 - protein, 9 aa, Mycobacterium tuberculosis
ELPSPEDVE

SEQ ID NO: 1535957 - protein, 6 aa, Mycobacterium tuberculosis
EPSSGF

SEQ ID NO: 1535958 - protein, 6 aa, Mycobacterium tuberculosis
EQTQAG

SEQ ID NO: 1535959 - protein, 7 aa, Mycobacterium tuberculosis
EREPGRA

SEQ ID NO: 1535960 - protein, 6 aa, Mycobacterium tuberculosis
ERPGTD

SEQ ID NO: 1535961 - protein, 4 aa, Mycobacterium tuberculosis
ESVD

SEQ ID NO: 1535962 - protein, 7 aa, Mycobacterium tuberculosis
ETGTRAA

SEQ ID NO: 1535963 - protein, 8 aa, Mycobacterium tuberculosis
ETLPEGTD

SEQ ID NO: 1535964 - protein, 5 aa, Mycobacterium tuberculosis
FDNPG

SEQ ID NO: 1535965 - protein, 8 aa, Mycobacterium tuberculosis
FGNSGNNN

SEQ ID NO: 1535966 - protein, 9 aa, Mycobacterium tuberculosis
FGNTGTNNL

SEQ ID NO: 1535967 - protein, 7 aa, Mycobacterium tuberculosis
FGPTGQG

SEQ ID NO: 1535968 - protein, 4 aa, Mycobacterium tuberculosis
FPGA

SEQ ID NO: 1535969 - protein, 6 aa, Mycobacterium tuberculosis
FSPCSP

SEQ ID NO: 1535970 - protein, 8 aa, Mycobacterium tuberculosis
GAAQAVAA

SEQ ID NO: 1535971 - protein, 7 aa, Mycobacterium tuberculosis
GAGSGIG

SEQ ID NO: 1535972 - protein, 11 aa, Mycobacterium tuberculosis
GAGSPKGSCDT

SEQ ID NO: 1535973 - protein, 10 aa, Mycobacterium tuberculosis
GARPDSVTCP

SEQ ID NO: 1535974 - protein, 7 aa, Mycobacterium tuberculosis
GASVGQS

SEQ ID NO: 1535975 - protein, 7 aa, Mycobacterium tuberculosis
GDGTNTR

SEQ ID NO: 1535976 - protein, 9 aa, Mycobacterium tuberculosis
GDNRGPLGY

SEQ ID NO: 1535977 - protein, 14 aa, Mycobacterium tuberculosis
GDPTLSAAPPGQDT

SEQ ID NO: 1535978 - protein, 8 aa, Mycobacterium tuberculosis
GDRAPFGQ

SEQ ID NO: 1535979 - protein, 8 aa, Mycobacterium tuberculosis
GDTRNRGR

SEQ ID NO: 1535980 - protein, 17 aa, Mycobacterium tuberculosis
GEAVQSADGHSLSRPSW

SEQ ID NO: 1535981 - protein, 7 aa, Mycobacterium tuberculosis
GEDLPGS

SEQ ID NO: 1535982 - protein, 10 aa, Mycobacterium tuberculosis
GETTTGQPAF

SEQ ID NO: 1535983 - protein, 20 aa, Mycobacterium tuberculosis
GGEPPNPLIPTGTNDSNGGR

SEQ ID NO: 1535984 - protein, 5 aa, Mycobacterium tuberculosis
GGGSS

SEQ ID NO: 1535985 - protein, 4 aa, Mycobacterium tuberculosis
GGLR

SEQ ID NO: 1535986 - protein, 30 aa, Mycobacterium tuberculosis; identical to SEQ ID NO: 229861

SEQ ID NO: 1535987 - protein, 25 aa, Mycobacterium tuberculosis
GGPAASAPSAATTGASRIPRANARQ

SEQ ID NO: 1535988 - protein, 4 aa, Mycobacterium tuberculosis
GGRR

SEQ ID NO: 1535989 - protein, 6 aa, Mycobacterium tuberculosis
GGTPIP

SEQ ID NO: 1535990 - protein, 11 aa, Mycobacterium tuberculosis
GGTRRRGQQEM

SEQ ID NO: 1535991 - protein, 6 aa, Mycobacterium tuberculosis
GIGDTG

SEQ ID NO: 1535992 - protein, 9 aa, Mycobacterium tuberculosis
GKGARLGSG

SEQ ID NO: 1535993 - protein, 8 aa, Mycobacterium tuberculosis
GKGSTADW

SEQ ID NO: 1535994 - protein, 13 aa, Mycobacterium tuberculosis
GLAAADPATRPVD

SEQ ID NO: 1535995 - protein, 18 aa, Mycobacterium tuberculosis
GNAKEGAECKSFPEDHAD

SEQ ID NO: 1535996 - protein, 6 aa, Mycobacterium tuberculosis
GPGLGT

SEQ ID NO: 1535997 - protein, 5 aa, Mycobacterium tuberculosis
GPLPY

SEQ ID NO: 1535998 - protein, 4 aa, Mycobacterium tuberculosis
GPSA

SEQ ID NO: 1535999 - protein, 17 aa, Mycobacterium tuberculosis
GPTGVIGTNKKDAQDTV

SEQ ID NO: 1536000 - protein, 14 aa, Mycobacterium tuberculosis
GQAGQHRCRTFHVT

SEQ ID NO: 1536001 - protein, 16 aa, Mycobacterium tuberculosis
GQANQDKGDSPPAQWM

SEQ ID NO: 1536002 - protein, 17 aa, Mycobacterium tuberculosis
GQKGGSWRSTGCSSPLG

SEQ ID NO: 1536003 - protein, 7 aa, Mycobacterium tuberculosis
GQSAYNA

SEQ ID NO: 1536004 - protein, 9 aa, Mycobacterium tuberculosis
GRINGSPNE

SEQ ID NO: 1536005 - protein, 6 aa, Mycobacterium tuberculosis
GRPGEY

SEQ ID NO: 1536006 - protein, 9 aa, Mycobacterium tuberculosis
GSPKGYTHP

SEQ ID NO: 1536007 - protein, 9 aa, Mycobacterium tuberculosis
GSVLSEDGR

SEQ ID NO: 1536008 - protein, 4 aa, Mycobacterium tuberculosis
GTGN

SEQ ID NO: 1536009 - protein, 6 aa, Mycobacterium tuberculosis
GTGTGA

SEQ ID NO: 1536010 - protein, 7 aa, Mycobacterium tuberculosis
GTLPANT

SEQ ID NO: 1536011 - protein, 7 aa, Mycobacterium tuberculosis
GVDPTQV

SEQ ID NO: 1536012 - protein, 13 aa, Mycobacterium tuberculosis
GVGNPAAASREQQ

SEQ ID NO: 1536013 - protein, 13 aa, Mycobacterium tuberculosis
GVNSDAPSRGLQT

SEQ ID NO: 1536014 - protein, 9 aa, Mycobacterium tuberculosis
GVPTVQPGA

SEQ ID NO: 1536015 - protein, 10 aa, Mycobacterium tuberculosis
GVSRAGRSTP

SEQ ID NO: 1536016 - protein, 12 aa, Mycobacterium tuberculosis
HAGDSDDGGYNT

SEQ ID NO: 1536017 - protein, 8 aa, Mycobacterium tuberculosis
HAGPSPNW

SEQ ID NO: 1536018 - protein, 8 aa, Mycobacterium tuberculosis
HTPGHTRG

SEQ ID NO: 1536019 - protein, 5 aa, Mycobacterium tuberculosis
IADAG

SEQ ID NO: 1536020 - protein, 7 aa, Mycobacterium tuberculosis
IAEPGSA

SEQ ID NO: 1536021 - protein, 4 aa, Mycobacterium tuberculosis
IDGQ

SEQ ID NO: 1536022 - protein, 24 aa, Mycobacterium tuberculosis
IDPESTADELAAQAQKAIDGMGLL

SEQ ID NO: 1536023 - protein, 9 aa, Mycobacterium tuberculosis
IDPPPSIQA

SEQ ID NO: 1536024 - protein, 14 aa, Mycobacterium tuberculosis
IGPAGGAPAAGSTA

SEQ ID NO: 1536025 - protein, 6 aa, Mycobacterium tuberculosis
IGRQEA

SEQ ID NO: 1536026 - protein, 12 aa, Mycobacterium tuberculosis
IPGGPGTGPGSY

SEQ ID NO: 1536027 - protein, 4 aa, Mycobacterium tuberculosis
IPPS

SEQ ID NO: 1536028 - protein, 5 aa, Mycobacterium tuberculosis
ISPWS

SEQ ID NO: 1536029 - protein, 7 aa, Mycobacterium tuberculosis
KAGNPGV

SEQ ID NO: 1536030 - protein, 7 aa, Mycobacterium tuberculosis
KAGRRRY

SEQ ID NO: 1536031 - protein, 8 aa, Mycobacterium tuberculosis
KDDGAWSI

SEQ ID NO: 1536032 - protein, 34 aa, Mycobacterium tuberculosis; identical to SEQ ID NO: 230301

SEQ ID NO: 1536033 - protein, 5 aa, Mycobacterium tuberculosis
KGVEG

SEQ ID NO: 1536034 - protein, 6 aa, Mycobacterium tuberculosis
KPAQGI

SEQ ID NO: 1536035 - protein, 24 aa, Mycobacterium tuberculosis
KPPTTRPSPPNTCKDSDGPTADTV

SEQ ID NO: 1536036 - protein, 15 aa, Mycobacterium tuberculosis
KQDPEGWGKSPGFGT

SEQ ID NO: 1536037 - protein, 10 aa, Mycobacterium tuberculosis
KQFEKTAEDP

SEQ ID NO: 1536038 - protein, 13 aa, Mycobacterium tuberculosis
KQWQTDPKELPAA

SEQ ID NO: 1536039 - protein, 6 aa, Mycobacterium tuberculosis
KVGAPT

SEQ ID NO: 1536040 - protein, 10 aa, Mycobacterium tuberculosis
LADGPAGPAW

SEQ ID NO: 1536041 - protein, 6 aa, Mycobacterium tuberculosis
LAGTQA

SEQ ID NO: 1536042 - protein, 13 aa, Mycobacterium tuberculosis
LDPASAPDVPTAA

SEQ ID NO: 1536043 - protein, 10 aa, Mycobacterium tuberculosis
LGSPTRNPKP

SEQ ID NO: 1536044 - protein, 7 aa, Mycobacterium tuberculosis
LKQSGGK

SEQ ID NO: 1536045 - protein, 7 aa, Mycobacterium tuberculosis
LKSSTAV

SEQ ID NO: 1536046 - protein, 12 aa, Mycobacterium tuberculosis
LPPISPPGFPSL

SEQ ID NO: 1536047 - protein, 7 aa, Mycobacterium tuberculosis
LPQQARK

SEQ ID NO: 1536048 - protein, 9 aa, Mycobacterium tuberculosis
LPRSPNEQR

SEQ ID NO: 1536049 - protein, 18 aa, Mycobacterium tuberculosis
LPTSAEADGERGRVVDIW

SEQ ID NO: 1536050 - protein, 9 aa, Mycobacterium tuberculosis
LRPGSPAAP

SEQ ID NO: 1536051 - protein, 7 aa, Mycobacterium tuberculosis
LRTSDPD

SEQ ID NO: 1536052 - protein, 13 aa, Mycobacterium tuberculosis
LSAANAAAAAPTT

SEQ ID NO: 1536053 - protein, 15 aa, Mycobacterium tuberculosis
LSDTGQAQCPITVVP

SEQ ID NO: 1536054 - protein, 18 aa, Mycobacterium tuberculosis
LSGQAADPFKIPPGTASG

SEQ ID NO: 1536055 - protein, 4 aa, Mycobacterium tuberculosis
LTEE

SEQ ID NO: 1536056 - protein, 12 aa, Mycobacterium tuberculosis
LTPEDPRSSGNN

SEQ ID NO: 1536057 - protein, 7 aa, Mycobacterium tuberculosis
MKADREK

SEQ ID NO: 1536058 - protein, 7 aa, Mycobacterium tuberculosis
MTAKSAS

SEQ ID NO: 1536059 - protein, 15 aa, Mycobacterium tuberculosis
NADPAAPTVEQAQRD

SEQ ID NO: 1536060 - protein, 6 aa, Mycobacterium tuberculosis
NAPTET

SEQ ID NO: 1536061 - protein, 6 aa, Mycobacterium tuberculosis
NDDRKD

SEQ ID NO: 1536062 - protein, 4 aa, Mycobacterium tuberculosis
NGMP

SEQ ID NO: 1536063 - protein, 11 aa, Mycobacterium tuberculosis
NGTPNELGGAN

SEQ ID NO: 1536064 - protein, 5 aa, Mycobacterium tuberculosis
NIAPP

SEQ ID NO: 1536065 - protein, 14 aa, Mycobacterium tuberculosis
NPDYHGNRKPRNKG

SEQ ID NO: 1536066 - protein, 7 aa, Mycobacterium tuberculosis
NPLPAPN

SEQ ID NO: 1536067 - protein, 14 aa, Mycobacterium tuberculosis
NSASGSYAAAEATI

SEQ ID NO: 1536068 - protein, 6 aa, Mycobacterium tuberculosis
NSPPTD

SEQ ID NO: 1536069 - protein, 8 aa, Mycobacterium tuberculosis
NTARQPAT

SEQ ID NO: 1536070 - protein, 18 aa, Mycobacterium tuberculosis
NTDKPDPVAMADALGRLW

SEQ ID NO: 1536071 - protein, 16 aa, Mycobacterium tuberculosis
NTFDPYANPGRGELDR

SEQ ID NO: 1536072 - protein, 9 aa, Mycobacterium tuberculosis
NTGQLAPAA

SEQ ID NO: 1536073 - protein, 6 aa, Mycobacterium tuberculosis
NYTPDN

SEQ ID NO: 1536074 - protein, 10 aa, Mycobacterium tuberculosis
PAATNQEVRR

SEQ ID NO: 1536075 - protein, 12 aa, Mycobacterium tuberculosis
PAFADGAPIPEQ

SEQ ID NO: 1536076 - protein, 11 aa, Mycobacterium tuberculosis
PAGKPLPTGSN

SEQ ID NO: 1536077 - protein, 7 aa, Mycobacterium tuberculosis
PAPTPQQ

SEQ ID NO: 1536078 - protein, 7 aa, Mycobacterium tuberculosis
PATDGAT

SEQ ID NO: 1536079 - protein, 11 aa, Mycobacterium tuberculosis
PCGSATRRIED

SEQ ID NO: 1536080 - protein, 4 aa, Mycobacterium tuberculosis
PEDV

SEQ ID NO: 1536081 - protein, 6 aa, Mycobacterium tuberculosis
PEGTQS

SEQ ID NO: 1536082 - protein, 10 aa, Mycobacterium tuberculosis
PGFDPNLPGN

SEQ ID NO: 1536083 - protein, 8 aa, Mycobacterium tuberculosis
PGVPTDPR

SEQ ID NO: 1536084 - protein, 11 aa, Mycobacterium tuberculosis
PIGAATAARAA

SEQ ID NO: 1536085 - protein, 7 aa, Mycobacterium tuberculosis
PKGSGKM

SEQ ID NO: 1536086 - protein, 8 aa, Mycobacterium tuberculosis
PKSRQDYD

SEQ ID NO: 1536087 - protein, 11 aa, Mycobacterium tuberculosis
PNAVGPGPSIP

SEQ ID NO: 1536088 - protein, 6 aa, Mycobacterium tuberculosis
PPNGTH

SEQ ID NO: 1536089 - protein, 8 aa, Mycobacterium tuberculosis
PRGVASSR

SEQ ID NO: 1536090 - protein, 5 aa, Mycobacterium tuberculosis
PSSPR

SEQ ID NO: 1536091 - protein, 14 aa, Mycobacterium tuberculosis
PVAGGTDGYGQSKA

SEQ ID NO: 1536092 - protein, 5 aa, Mycobacterium tuberculosis
PVTTN

SEQ ID NO: 1536093 - protein, 7 aa, Mycobacterium tuberculosis
QDAGAPV

SEQ ID NO: 1536094 - protein, 6 aa, Mycobacterium tuberculosis
QDDRRR

SEQ ID NO: 1536095 - protein, 20 aa, Mycobacterium tuberculosis
QDQGKTDELAYTPAKTTANV

SEQ ID NO: 1536096 - protein, 8 aa, Mycobacterium tuberculosis
QGQNEAAA

SEQ ID NO: 1536097 - protein, 7 aa, Mycobacterium tuberculosis
QPKYGTY

SEQ ID NO: 1536098 - protein, 4 aa, Mycobacterium tuberculosis
QQTG

SEQ ID NO: 1536099 - protein, 9 aa, Mycobacterium tuberculosis
QSGGNNSPA

SEQ ID NO: 1536100 - protein, 9 aa, Mycobacterium tuberculosis
QTLSSPATL

SEQ ID NO: 1536101 - protein, 13 aa, Mycobacterium tuberculosis
QTPAARASHTDTE

SEQ ID NO: 1536102 - protein, 7 aa, Mycobacterium tuberculosis
QTYPTSG

SEQ ID NO: 1536103 - protein, 10 aa, Mycobacterium tuberculosis
RAAEKAAEEV

SEQ ID NO: 1536104 - protein, 8 aa, Mycobacterium tuberculosis
RADGTLDH

SEQ ID NO: 1536105 - protein, 7 aa, Mycobacterium tuberculosis
RADSTVN

SEQ ID NO: 1536106 - protein, 11 aa, Mycobacterium tuberculosis
RAGAAAAAALP

SEQ ID NO: 1536107 - protein, 9 aa, Mycobacterium tuberculosis
RAKSETASS

SEQ ID NO: 1536108 - protein, 19 aa, Mycobacterium tuberculosis
RASRDEGAAEAPSAAETGA

SEQ ID NO: 1536109 - protein, 7 aa, Mycobacterium tuberculosis
RDGSTVA

SEQ ID NO: 1536110 - protein, 7 aa, Mycobacterium tuberculosis
RDLSGNG

SEQ ID NO: 1536111 - protein, 9 aa, Mycobacterium tuberculosis
RDSLQSHGS

SEQ ID NO: 1536112 - protein, 8 aa, Mycobacterium tuberculosis
RESGATPS

SEQ ID NO: 1536113 - protein, 4 aa, Mycobacterium tuberculosis
RGDL

SEQ ID NO: 1536114 - protein, 4 aa, Mycobacterium tuberculosis
RGPL

SEQ ID NO: 1536115 - protein, 6 aa, Mycobacterium tuberculosis
RGQSHS

SEQ ID NO: 1536116 - protein, 10 aa, Mycobacterium tuberculosis
RGVDGDAYKS

SEQ ID NO: 1536117 - protein, 5 aa, Mycobacterium tuberculosis
RHNTP

SEQ ID NO: 1536118 - protein, 15 aa, Mycobacterium tuberculosis
RIAAPGGAGFAAGQQ

SEQ ID NO: 1536119 - protein, 6 aa, Mycobacterium tuberculosis
RKVGGV

SEQ ID NO: 1536120 - protein, 4 aa, Mycobacterium tuberculosis
RLTP

SEQ ID NO: 1536121 - protein, 10 aa, Mycobacterium tuberculosis
RNPIGNGPYK

SEQ ID NO: 1536122 - protein, 7 aa, Mycobacterium tuberculosis
RPQSFSG

SEQ ID NO: 1536123 - protein, 4 aa, Mycobacterium tuberculosis
RPRG

SEQ ID NO: 1536124 - protein, 6 aa, Mycobacterium tuberculosis
RPRQSG

SEQ ID NO: 1536125 - protein, 7 aa, Mycobacterium tuberculosis
RQDTVRQ

SEQ ID NO: 1536126 - protein, 18 aa, Mycobacterium tuberculosis
RRITDSPPLGSGAGPRYA

SEQ ID NO: 1536127 - protein, 10 aa, Mycobacterium tuberculosis
RSSNPQVKIP

SEQ ID NO: 1536128 - protein, 5 aa, Mycobacterium tuberculosis
RTTEH

SEQ ID NO: 1536129 - protein, 15 aa, Mycobacterium tuberculosis
SADAYATAEASAAQT

SEQ ID NO: 1536130 - protein, 6 aa, Mycobacterium tuberculosis
SAERLD

SEQ ID NO: 1536131 - protein, 23 aa, Mycobacterium tuberculosis
SAFSGPTMAPGWDPADIDNGDIA

SEQ ID NO: 1536132 - protein, 7 aa, Mycobacterium tuberculosis
SANDTVR

SEQ ID NO: 1536133 - protein, 7 aa, Mycobacterium tuberculosis
SAPAGAR

SEQ ID NO: 1536134 - protein, 7 aa, Mycobacterium tuberculosis
SARQRGV

SEQ ID NO: 1536135 - protein, 6 aa, Mycobacterium tuberculosis
SASRRA

SEQ ID NO: 1536136 - protein, 16 aa, Mycobacterium tuberculosis
SDADEALSEATRESLQ

SEQ ID NO: 1536137 - protein, 8 aa, Mycobacterium tuberculosis
SDLPAEVG

SEQ ID NO: 1536138 - protein, 6 aa, Mycobacterium tuberculosis
SDRRTS

SEQ ID NO: 1536139 - protein, 10 aa, Mycobacterium tuberculosis
SDTVGRRGEQ

SEQ ID NO: 1536140 - protein, 6 aa, Mycobacterium tuberculosis
SEGHTY

SEQ ID NO: 1536141 - protein, 8 aa, Mycobacterium tuberculosis
SFGRDPET

SEQ ID NO: 1536142 - protein, 8 aa, Mycobacterium tuberculosis
SGAKITTD

SEQ ID NO: 1536143 - protein, 14 aa, Mycobacterium tuberculosis
SGDLTTNPTAATGN

SEQ ID NO: 1536144 - protein, 4 aa, Mycobacterium tuberculosis
SGIP

SEQ ID NO: 1536145 - protein, 8 aa, Mycobacterium tuberculosis
SGKPTRVF

SEQ ID NO: 1536146 - protein, 6 aa, Mycobacterium tuberculosis
SGNPVD

SEQ ID NO: 1536147 - protein, 18 aa, Mycobacterium tuberculosis
SGTCKGNVDMPVSAKPIV

SEQ ID NO: 1536148 - protein, 8 aa, Mycobacterium tuberculosis
SGVTPTAV

SEQ ID NO: 1536149 - protein, 6 aa, Mycobacterium tuberculosis
SIAPGS

SEQ ID NO: 1536150 - protein, 34 aa, Mycobacterium tuberculosis; identical to SEQ ID NO: 231298

SEQ ID NO: 1536151 - protein, 10 aa, Mycobacterium tuberculosis
SLGHGGDDGA

SEQ ID NO: 1536152 - protein, 8 aa, Mycobacterium tuberculosis
SPDTVDNY

SEQ ID NO: 1536153 - protein, 19 aa, Mycobacterium tuberculosis
SPGNTGQLHDGGPSAARTA

SEQ ID NO: 1536154 - protein, 15 aa, Mycobacterium tuberculosis
SPLRPDGSSDHAEAA

SEQ ID NO: 1536155 - protein, 8 aa, Mycobacterium tuberculosis
SPQVATQQ

SEQ ID NO: 1536156 - protein, 13 aa, Mycobacterium tuberculosis
SPSGIGTTVFDHP

SEQ ID NO: 1536157 - protein, 23 aa, Mycobacterium tuberculosis
SPVEPPRHGQPNPQFRTARHANH

SEQ ID NO: 1536158 - protein, 8 aa, Mycobacterium tuberculosis
SQAAHPPW

SEQ ID NO: 1536159 - protein, 14 aa, Mycobacterium tuberculosis
SQDGGSGVQCSTRP

SEQ ID NO: 1536160 - protein, 7 aa, Mycobacterium tuberculosis
SQRDGLT

SEQ ID NO: 1536161 - protein, 10 aa, Mycobacterium tuberculosis
SRKDQEGNDL

SEQ ID NO: 1536162 - protein, 5 aa, Mycobacterium tuberculosis
SRTVS

SEQ ID NO: 1536163 - protein, 10 aa, Mycobacterium tuberculosis
SSAYPTTEQT

SEQ ID NO: 1536164 - protein, 14 aa, Mycobacterium tuberculosis
SSELATQLTQGATA

SEQ ID NO: 1536165 - protein, 4 aa, Mycobacterium tuberculosis
SSNT

SEQ ID NO: 1536166 - protein, 11 aa, Mycobacterium tuberculosis
SSQVQEGGDGW

SEQ ID NO: 1536167 - protein, 8 aa, Mycobacterium tuberculosis
STEGNSYL

SEQ ID NO: 1536168 - protein, 5 aa, Mycobacterium tuberculosis
STNAQ

SEQ ID NO: 1536169 - protein, 6 aa, Mycobacterium tuberculosis
SVDGSD

SEQ ID NO: 1536170 - protein, 12 aa, Mycobacterium tuberculosis
SVPSTSAPQAIG

SEQ ID NO: 1536171 - protein, 12 aa, Mycobacterium tuberculosis
SWPRPSSVRRLR

SEQ ID NO: 1536172 - protein, 4 aa, Mycobacterium tuberculosis
SWSS

SEQ ID NO: 1536173 - protein, 15 aa, Mycobacterium tuberculosis
SYSGADFPAGRQRLN

SEQ ID NO: 1536174 - protein, 11 aa, Mycobacterium tuberculosis
TAADGKATGLK

SEQ ID NO: 1536175 - protein, 12 aa, Mycobacterium tuberculosis
TAGTAGANTKDE

SEQ ID NO: 1536176 - protein, 7 aa, Mycobacterium tuberculosis
TAPPPLN

SEQ ID NO: 1536177 - protein, 14 aa, Mycobacterium tuberculosis
TAVAADKSGPLHQD

SEQ ID NO: 1536178 - protein, 6 aa, Mycobacterium tuberculosis
TAYDGE

SEQ ID NO: 1536179 - protein, 14 aa, Mycobacterium tuberculosis
TDAAGNKPESVTCP

SEQ ID NO: 1536180 - protein, 7 aa, Mycobacterium tuberculosis
TELGEQG

SEQ ID NO: 1536181 - protein, 7 aa, Mycobacterium tuberculosis
TFTPSDE

SEQ ID NO: 1536182 - protein, 10 aa, Mycobacterium tuberculosis
TGAAAPLGSH

SEQ ID NO: 1536183 - protein, 20 aa, Mycobacterium tuberculosis
TGGSSALGGSAAANAAASGA

SEQ ID NO: 1536184 - protein, 10 aa, Mycobacterium tuberculosis
TGKETSDRQL

SEQ ID NO: 1536185 - protein, 5 aa, Mycobacterium tuberculosis
TGQAD

SEQ ID NO: 1536186 - protein, 16 aa, Mycobacterium tuberculosis
TGSAPRRPPIPGSDAA

SEQ ID NO: 1536187 - protein, 5 aa, Mycobacterium tuberculosis
TGSLT

SEQ ID NO: 1536188 - protein, 11 aa, Mycobacterium tuberculosis
TGTLRDPYTNT

SEQ ID NO: 1536189 - protein, 12 aa, Mycobacterium tuberculosis
TPADAEPGQWDP

SEQ ID NO: 1536190 - protein, 8 aa, Mycobacterium tuberculosis
TPGQDDAA

SEQ ID NO: 1536191 - protein, 19 aa, Mycobacterium tuberculosis
TPNPNDAPGGPLVERGNRQ

SEQ ID NO: 1536192 - protein, 4 aa, Mycobacterium tuberculosis
TRIG

SEQ ID NO: 1536193 - protein, 14 aa, Mycobacterium tuberculosis
TTGQPAARAADGRE

SEQ ID NO: 1536194 - protein, 10 aa, Mycobacterium tuberculosis
TTTPLGSQPW

SEQ ID NO: 1536195 - protein, 6 aa, Mycobacterium tuberculosis
VADPQF

SEQ ID NO: 1536196 - protein, 8 aa, Mycobacterium tuberculosis
VAPDHPKI

SEQ ID NO: 1536197 - protein, 5 aa, Mycobacterium tuberculosis
VDPAG

SEQ ID NO: 1536198 - protein, 7 aa, Mycobacterium tuberculosis
VDPEAGR

SEQ ID NO: 1536199 - protein, 10 aa, Mycobacterium tuberculosis
VDPNADPIEA

SEQ ID NO: 1536200 - protein, 18 aa, Mycobacterium tuberculosis
VDQPSSDVLRQAAATCPT

SEQ ID NO: 1536201 - protein, 11 aa, Mycobacterium tuberculosis
VEEATAQTKAL

SEQ ID NO: 1536202 - protein, 12 aa, Mycobacterium tuberculosis
VEGAHGARSDGF

SEQ ID NO: 1536203 - protein, 6 aa, Mycobacterium tuberculosis
VGPDGT

SEQ ID NO: 1536204 - protein, 8 aa, Mycobacterium tuberculosis
VNGGPTST

SEQ ID NO: 1536205 - protein, 5 aa, Mycobacterium tuberculosis
VNLPG

SEQ ID NO: 1536206 - protein, 10 aa, Mycobacterium tuberculosis
VPAPPSPTAS

SEQ ID NO: 1536207 - protein, 5 aa, Mycobacterium tuberculosis
VPPEC

SEQ ID NO: 1536208 - protein, 9 aa, Mycobacterium tuberculosis
VQPGELSER

SEQ ID NO: 1536209 - protein, 6 aa, Mycobacterium tuberculosis
VRTNGM

SEQ ID NO: 1536210 - protein, 19 aa, Mycobacterium tuberculosis
VSDGSGRVAAKDTGEREEL

SEQ ID NO: 1536211 - protein, 15 aa, Mycobacterium tuberculosis
VTLPKNATAKIGQTS

SEQ ID NO: 1536212 - protein, 5 aa, Mycobacterium tuberculosis
VTPVP

SEQ ID NO: 1536213 - protein, 10 aa, Mycobacterium tuberculosis
VTTADGSRAA

SEQ ID NO: 1536214 - protein, 6 aa, Mycobacterium tuberculosis
VTTNPS

SEQ ID NO: 1536215 - protein, 5 aa, Mycobacterium tuberculosis
VTTTL

SEQ ID NO: 1536216 - protein, 12 aa, Mycobacterium tuberculosis
VYGPRQDPHGEA

SEQ ID NO: 1536217 - protein, 18 aa, Mycobacterium tuberculosis
WGPSSDPAWERNDPTQQI

SEQ ID NO: 1536218 - protein, 6 aa, Mycobacterium tuberculosis
YDPQRA

SEQ ID NO: 1536219 - protein, 8 aa, Mycobacterium tuberculosis
YDRPDGDV

SEQ ID NO: 1536220 - protein, 9 aa, Mycobacterium tuberculosis
YGGAPQGSR

SEQ ID NO: 1536221 - protein, 7 aa, Mycobacterium tuberculosis
YNAAGGH

SEQ ID NO: 1536222 - protein, 10 aa, Mycobacterium tuberculosis
YNGNVDKSEF

SEQ ID NO: 1536223 - protein, 35 aa, Mycobacterium tuberculosis; identical to SEQ ID NO: 231857

SEQ ID NO: 1536224 - protein, 8 aa, Mycobacterium tuberculosis
YTSPGGDR

SEQ ID NO: 1536225 - protein, 34 aa, Mycobacterium tuberculosis; identical to SEQ ID NO: 232531

SEQ ID NO: 1536226 - protein, 6 aa, Mycobacterium tuberculosis
AAAGSA

SEQ ID NO: 1536227 - protein, 9 aa, Mycobacterium tuberculosis
AAAPQAAAG

SEQ ID NO: 1536228 - protein, 6 aa, Mycobacterium tuberculosis
AAATAA

SEQ ID NO: 1536229 - protein, 6 aa, Mycobacterium tuberculosis
AADPYD

SEQ ID NO: 1536230 - protein, 29 aa, Mycobacterium tuberculosis
AAGEQAVKAEQAAAKSAADARSAAEQAAA

SEQ ID NO: 1536231 - protein, 8 aa, Mycobacterium tuberculosis
AAKDRRQQ

SEQ ID NO: 1536232 - protein, 13 aa, Mycobacterium tuberculosis
AAPAQADDYDAPF

SEQ ID NO: 1536233 - protein, 6 aa, Mycobacterium tuberculosis
AASGWD

SEQ ID NO: 1536234 - protein, 9 aa, Mycobacterium tuberculosis
AATENQRGN

SEQ ID NO: 1536235 - protein, 14 aa, Mycobacterium tuberculosis
AAYAASKAGVRSLG

SEQ ID NO: 1536236 - protein, 7 aa, Mycobacterium tuberculosis
ACGADSQ

SEQ ID NO: 1536237 - protein, 16 aa, Mycobacterium tuberculosis
ADAGHAARTRYDSFPR

SEQ ID NO: 1536238 - protein, 6 aa, Mycobacterium tuberculosis
ADGAAA

SEQ ID NO: 1536239 - protein, 5 aa, Mycobacterium tuberculosis
ADGGT

SEQ ID NO: 1536240 - protein, 4 aa, Mycobacterium tuberculosis
ADGS

SEQ ID NO: 1536241 - protein, 10 aa, Mycobacterium tuberculosis
ADPPAPAPRP

SEQ ID NO: 1536242 - protein, 8 aa, Mycobacterium tuberculosis
AEAALGEA

SEQ ID NO: 1536243 - protein, 4 aa, Mycobacterium tuberculosis
AEAQ

SEQ ID NO: 1536244 - protein, 10 aa, Mycobacterium tuberculosis
AERDAAQARL

SEQ ID NO: 1536245 - protein, 15 aa, Mycobacterium tuberculosis
AETKKTDLNANDVDA

SEQ ID NO: 1536246 - protein, 5 aa, Mycobacterium tuberculosis
AETPG

SEQ ID NO: 1536247 - protein, 8 aa, Mycobacterium tuberculosis
AGASSEPY

SEQ ID NO: 1536248 - protein, 10 aa, Mycobacterium tuberculosis
AGDSNSDATF

SEQ ID NO: 1536249 - protein, 12 aa, Mycobacterium tuberculosis
AGFASKTPANQA

SEQ ID NO: 1536250 - protein, 12 aa, Mycobacterium tuberculosis
AGGGAPVGNPAD

SEQ ID NO: 1536251 - protein, 8 aa, Mycobacterium tuberculosis
AGGPLTSA

SEQ ID NO: 1536252 - protein, 8 aa, Mycobacterium tuberculosis
AGKYGTTV

SEQ ID NO: 1536253 - protein, 7 aa, Mycobacterium tuberculosis
AGLGSAS

SEQ ID NO: 1536254 - protein, 7 aa, Mycobacterium tuberculosis
AGPSVQN

SEQ ID NO: 1536255 - protein, 8 aa, Mycobacterium tuberculosis
AGRGPGDV

SEQ ID NO: 1536256 - protein, 7 aa, Mycobacterium tuberculosis
AGRPTPE

SEQ ID NO: 1536257 - protein, 9 aa, Mycobacterium tuberculosis
AGRRESLAD

SEQ ID NO: 1536258 - protein, 8 aa, Mycobacterium tuberculosis
AGTGTGKS

SEQ ID NO: 1536259 - protein, 7 aa, Mycobacterium tuberculosis
AGTTSQT

SEQ ID NO: 1536260 - protein, 15 aa, Mycobacterium tuberculosis
AGYPGAVAPATAACP

SEQ ID NO: 1536261 - protein, 5 aa, Mycobacterium tuberculosis
AKSVA

SEQ ID NO: 1536262 - protein, 5 aa, Mycobacterium tuberculosis
ALDDE

SEQ ID NO: 1536263 - protein, 6 aa, Mycobacterium tuberculosis
ALEPQG

SEQ ID NO: 1536264 - protein, 16 aa, Mycobacterium tuberculosis
ANAAEAGEHPATSPLR

SEQ ID NO: 1536265 - protein, 7 aa, Mycobacterium tuberculosis
ANDPTSV

SEQ ID NO: 1536266 - protein, 5 aa, Mycobacterium tuberculosis
ANPAA

SEQ ID NO: 1536267 - protein, 7 aa, Mycobacterium tuberculosis
APANSEE

SEQ ID NO: 1536268 - protein, 10 aa, Mycobacterium tuberculosis
APKIPQQQRI

SEQ ID NO: 1536269 - protein, 11 aa, Mycobacterium tuberculosis
APNHPDPAVAP

SEQ ID NO: 1536270 - protein, 19 aa, Mycobacterium tuberculosis
APPRTGPASSPTNNGAKAD

SEQ ID NO: 1536271 - protein, 5 aa, Mycobacterium tuberculosis
APSGS

SEQ ID NO: 1536272 - protein, 6 aa, Mycobacterium tuberculosis
APSNLT

SEQ ID NO: 1536273 - protein, 13 aa, Mycobacterium tuberculosis
APYTGQSVDTSPY

SEQ ID NO: 1536274 - protein, 5 aa, Mycobacterium tuberculosis
AQDDF

SEQ ID NO: 1536275 - protein, 5 aa, Mycobacterium tuberculosis
AQLGT

SEQ ID NO: 1536276 - protein, 7 aa, Mycobacterium tuberculosis
AQMNRPK

SEQ ID NO: 1536277 - protein, 13 aa, Mycobacterium tuberculosis
AQNAAAAAPTTAI

SEQ ID NO: 1536278 - protein, 4 aa, Mycobacterium tuberculosis
AQSD

SEQ ID NO: 1536279 - protein, 13 aa, Mycobacterium tuberculosis
AQTAAVKAAGGVP

SEQ ID NO: 1536280 - protein, 5 aa, Mycobacterium tuberculosis
ARAAG

SEQ ID NO: 1536281 - protein, 9 aa, Mycobacterium tuberculosis
ARASSSFDR

SEQ ID NO: 1536282 - protein, 28 aa, Mycobacterium tuberculosis
ARESATRLGPPAGGLAAANTPNPSGAAI

SEQ ID NO: 1536283 - protein, 9 aa, Mycobacterium tuberculosis
ARGDGPLAG

SEQ ID NO: 1536284 - protein, 11 aa, Mycobacterium tuberculosis
ARMAEPKLGQP

SEQ ID NO: 1536285 - protein, 6 aa, Mycobacterium tuberculosis
ARTADG

SEQ ID NO: 1536286 - protein, 6 aa, Mycobacterium tuberculosis
ARTPAY

SEQ ID NO: 1536287 - protein, 5 aa, Mycobacterium tuberculosis
ASDAA

SEQ ID NO: 1536288 - protein, 11 aa, Mycobacterium tuberculosis
ASGNPETGEVG

SEQ ID NO: 1536289 - protein, 15 aa, Mycobacterium tuberculosis
ASGPPTDTVAEANRT

SEQ ID NO: 1536290 - protein, 16 aa, Mycobacterium tuberculosis
ASQRGLGEAQLGNSSG

SEQ ID NO: 1536291 - protein, 12 aa, Mycobacterium tuberculosis
ATANSDTPAIPE

SEQ ID NO: 1536292 - protein, 6 aa, Mycobacterium tuberculosis
ATGMMS

SEQ ID NO: 1536293 - protein, 9 aa, Mycobacterium tuberculosis
ATLTPQPAR

SEQ ID NO: 1536294 - protein, 7 aa, Mycobacterium tuberculosis
ATQGGVG

SEQ ID NO: 1536295 - protein, 10 aa, Mycobacterium tuberculosis
ATRPAQQSGA

SEQ ID NO: 1536296 - protein, 9 aa, Mycobacterium tuberculosis
ATSAQVTAN

SEQ ID NO: 1536297 - protein, 8 aa, Mycobacterium tuberculosis
ATTASAAV

SEQ ID NO: 1536298 - protein, 21 aa, Mycobacterium tuberculosis
ATWDSNGGVGSPAAASPQQQI

SEQ ID NO: 1536299 - protein, 9 aa, Mycobacterium tuberculosis
AVDGTPVGN

SEQ ID NO: 1536300 - protein, 10 aa, Mycobacterium tuberculosis
AVTDGPATDA

SEQ ID NO: 1536301 - protein, 16 aa, Mycobacterium tuberculosis
CEPNSVAPTGGAPGNF

SEQ ID NO: 1536302 - protein, 15 aa, Mycobacterium tuberculosis
CESGGNWAANTGNGL

SEQ ID NO: 1536303 - protein, 8 aa, Mycobacterium tuberculosis
CSNNYGPY

SEQ ID NO: 1536304 - protein, 20 aa, Mycobacterium tuberculosis
CSRGGSSKAGRSSSVAGTLP

SEQ ID NO: 1536305 - protein, 6 aa, Mycobacterium tuberculosis
DAADWE

SEQ ID NO: 1536306 - protein, 18 aa, Mycobacterium tuberculosis
DAAEGAPRHARENAENEL

SEQ ID NO: 1536307 - protein, 9 aa, Mycobacterium tuberculosis
DAEQSGAYP

SEQ ID NO: 1536308 - protein, 8 aa, Mycobacterium tuberculosis
DAGGYKAS

SEQ ID NO: 1536309 - protein, 8 aa, Mycobacterium tuberculosis
DALARTDR

SEQ ID NO: 1536310 - protein, 30 aa, Mycobacterium tuberculosis; identical to SEQ ID NO: 229336

SEQ ID NO: 1536311 - protein, 12 aa, Mycobacterium tuberculosis
DASTGGGSNALS

SEQ ID NO: 1536312 - protein, 5 aa, Mycobacterium tuberculosis
DDLYP

SEQ ID NO: 1536313 - protein, 8 aa, Mycobacterium tuberculosis
DDPSASPL

SEQ ID NO: 1536314 - protein, 5 aa, Mycobacterium tuberculosis
DDRQV

SEQ ID NO: 1536315 - protein, 11 aa, Mycobacterium tuberculosis
DEVQAEQESVN

SEQ ID NO: 1536316 - protein, 6 aa, Mycobacterium tuberculosis
DEYSGD

SEQ ID NO: 1536317 - protein, 10 aa, Mycobacterium tuberculosis
DGIGKSPQQL

SEQ ID NO: 1536318 - protein, 12 aa, Mycobacterium tuberculosis
DGKLEALGSIPH

SEQ ID NO: 1536319 - protein, 8 aa, Mycobacterium tuberculosis
DGNPPEVK

SEQ ID NO: 1536320 - protein, 13 aa, Mycobacterium tuberculosis
DGQGIALNEDLHA

SEQ ID NO: 1536321 - protein, 10 aa, Mycobacterium tuberculosis
DGSDVGGGAS

SEQ ID NO: 1536322 - protein, 17 aa, Mycobacterium tuberculosis
DMDGTEPATANIGPGGD

SEQ ID NO: 1536323 - protein, 14 aa, Mycobacterium tuberculosis
DNGAARDAGVPQPI

SEQ ID NO: 1536324 - protein, 17 aa, Mycobacterium tuberculosis
DNGRCDPVAGTNTGESL

SEQ ID NO: 1536325 - protein, 5 aa, Mycobacterium tuberculosis
DNRGD

SEQ ID NO: 1536326 - protein, 5 aa, Mycobacterium tuberculosis
DPDLG

SEQ ID NO: 1536327 - protein, 11 aa, Mycobacterium tuberculosis
DPGASQSTTNP

SEQ ID NO: 1536328 - protein, 4 aa, Mycobacterium tuberculosis
DPGT

SEQ ID NO: 1536329 - protein, 18 aa, Mycobacterium tuberculosis
DPLIPNPPPIPVPPPAAQ

SEQ ID NO: 1536330 - protein, 12 aa, Mycobacterium tuberculosis
DPNAPDQQWDSV

SEQ ID NO: 1536331 - protein, 8 aa, Mycobacterium tuberculosis
DPTEPGHY

SEQ ID NO: 1536332 - protein, 11 aa, Mycobacterium tuberculosis
DPTGKTVVPDP

SEQ ID NO: 1536333 - protein, 6 aa, Mycobacterium tuberculosis
DPVRSA

SEQ ID NO: 1536334 - protein, 8 aa, Mycobacterium tuberculosis
DQGSQAGD

SEQ ID NO: 1536335 - protein, 13 aa, Mycobacterium tuberculosis
DQPSGTRNMNDYS

SEQ ID NO: 1536336 - protein, 11 aa, Mycobacterium tuberculosis
DRLGAADGRRA

SEQ ID NO: 1536337 - protein, 8 aa, Mycobacterium tuberculosis
DRPESLNS

SEQ ID NO: 1536338 - protein, 33 aa, Mycobacterium tuberculosis; identical to SEQ ID NO: 229507

SEQ ID NO: 1536339 - protein, 12 aa, Mycobacterium tuberculosis
DSDGHADKRTKS

SEQ ID NO: 1536340 - protein, 9 aa, Mycobacterium tuberculosis
DSGGLHKGD

SEQ ID NO: 1536341 - protein, 8 aa, Mycobacterium tuberculosis
DSMTGVPA

SEQ ID NO: 1536342 - protein, 12 aa, Mycobacterium tuberculosis
DTAAGPSAPDYY

SEQ ID NO: 1536343 - protein, 14 aa, Mycobacterium tuberculosis
DTAPAAASRASRVP

SEQ ID NO: 1536344 - protein, 4 aa, Mycobacterium tuberculosis
DTDI

SEQ ID NO: 1536345 - protein, 7 aa, Mycobacterium tuberculosis
DTRRGEE

SEQ ID NO: 1536346 - protein, 5 aa, Mycobacterium tuberculosis
DYRPT

SEQ ID NO: 1536347 - protein, 7 aa, Mycobacterium tuberculosis
EADRQSR

SEQ ID NO: 1536348 - protein, 7 aa, Mycobacterium tuberculosis
EAQRPHG

SEQ ID NO: 1536349 - protein, 5 aa, Mycobacterium tuberculosis
EDDGR

SEQ ID NO: 1536350 - protein, 4 aa, Mycobacterium tuberculosis
EDLA

SEQ ID NO: 1536351 - protein, 9 aa, Mycobacterium tuberculosis
EDSDGVDGR

SEQ ID NO: 1536352 - protein, 6 aa, Mycobacterium tuberculosis
EFTPKT

SEQ ID NO: 1536353 - protein, 8 aa, Mycobacterium tuberculosis
EGAATDPR

SEQ ID NO: 1536354 - protein, 13 aa, Mycobacterium tuberculosis
ELTESGTSATSRL

SEQ ID NO: 1536355 - protein, 7 aa, Mycobacterium tuberculosis
ENAGAAE

SEQ ID NO: 1536356 - protein, 5 aa, Mycobacterium tuberculosis
EPSTG

SEQ ID NO: 1536357 - protein, 8 aa, Mycobacterium tuberculosis
ERARGAAG

SEQ ID NO: 1536358 - protein, 5 aa, Mycobacterium tuberculosis
ERGRA

SEQ ID NO: 1536359 - protein, 6 aa, Mycobacterium tuberculosis
ESSERE

SEQ ID NO: 1536360 - protein, 8 aa, Mycobacterium tuberculosis
ESSRAPYG

SEQ ID NO: 1536361 - protein, 13 aa, Mycobacterium tuberculosis
EVAPNDAPPMPPG

SEQ ID NO: 1536362 - protein, 6 aa, Mycobacterium tuberculosis
FAEGAT

SEQ ID NO: 1536363 - protein, 5 aa, Mycobacterium tuberculosis
FAGQG

SEQ ID NO: 1536364 - protein, 9 aa, Mycobacterium tuberculosis
FANPGLGAS

SEQ ID NO: 1536365 - protein, 19 aa, Mycobacterium tuberculosis
FDAPPRADGVYTRGGGPVQ

SEQ ID NO: 1536366 - protein, 7 aa, Mycobacterium tuberculosis
FEPPGIG

SEQ ID NO: 1536367 - protein, 5 aa, Mycobacterium tuberculosis
FGQRS

SEQ ID NO: 1536368 - protein, 8 aa, Mycobacterium tuberculosis
FKAKPGQR

SEQ ID NO: 1536369 - protein, 20 aa, Mycobacterium tuberculosis
FTPGSPSGGSGGSPGGPGGS

SEQ ID NO: 1536370 - protein, 10 aa, Mycobacterium tuberculosis
GAASADGPVQ

SEQ ID NO: 1536371 - protein, 5 aa, Mycobacterium tuberculosis
GAATG

SEQ ID NO: 1536372 - protein, 10 aa, Mycobacterium tuberculosis
GAGAETDAQN

SEQ ID NO: 1536373 - protein, 12 aa, Mycobacterium tuberculosis
GAGRGFSSGGAI

SEQ ID NO: 1536374 - protein, 6 aa, Mycobacterium tuberculosis
GAHPST

SEQ ID NO: 1536375 - protein, 10 aa, Mycobacterium tuberculosis
GALASTGTAY

SEQ ID NO: 1536376 - protein, 6 aa, Mycobacterium tuberculosis
GAQCPR

SEQ ID NO: 1536377 - protein, 4 aa, Mycobacterium tuberculosis
GAQQ

SEQ ID NO: 1536378 - protein, 14 aa, Mycobacterium tuberculosis
GARANLDAEGGASF

SEQ ID NO: 1536379 - protein, 31 aa, Mycobacterium tuberculosis; identical to SEQ ID NO: 229766

SEQ ID NO: 1536380 - protein, 22 aa, Mycobacterium tuberculosis
GDAPVAAGDPVAAGGPAAAGAC

SEQ ID NO: 1536381 - protein, 5 aa, Mycobacterium tuberculosis
GDIDP

SEQ ID NO: 1536382 - protein, 9 aa, Mycobacterium tuberculosis
GEPYSTTNP

SEQ ID NO: 1536383 - protein, 11 aa, Mycobacterium tuberculosis
GESAPKAPAVE

SEQ ID NO: 1536384 - protein, 10 aa, Mycobacterium tuberculosis
GGAGSAYGGN

SEQ ID NO: 1536385 - protein, 9 aa, Mycobacterium tuberculosis
GGDGANDAI

SEQ ID NO: 1536386 - protein, 6 aa, Mycobacterium tuberculosis
GGDTPT

SEQ ID NO: 1536387 - protein, 7 aa, Mycobacterium tuberculosis
GGGETAA

SEQ ID NO: 1536388 - protein, 12 aa, Mycobacterium tuberculosis
GGGGTGAGQEAL

SEQ ID NO: 1536389 - protein, 19 aa, Mycobacterium tuberculosis
GGGNAAGPSKGIDSGAGTV

SEQ ID NO: 1536390 - protein, 24 aa, Mycobacterium tuberculosis
GGGTTTDPTPDQGAPIDGGGVPCV

SEQ ID NO: 1536391 - protein, 4 aa, Mycobacterium tuberculosis
GGMP

SEQ ID NO: 1536392 - protein, 8 aa, Mycobacterium tuberculosis
GGPDPGTW

SEQ ID NO: 1536393 - protein, 5 aa, Mycobacterium tuberculosis
GGSAA

SEQ ID NO: 1536394 - protein, 18 aa, Mycobacterium tuberculosis
GGSLQGPSKGVDSGANTV

SEQ ID NO: 1536395 - protein, 15 aa, Mycobacterium tuberculosis
GGTGAAGMTSAGEAA

SEQ ID NO: 1536396 - protein, 6 aa, Mycobacterium tuberculosis
GHDRIN

SEQ ID NO: 1536397 - protein, 6 aa, Mycobacterium tuberculosis
GHGAPG

SEQ ID NO: 1536398 - protein, 11 aa, Mycobacterium tuberculosis
GHTGTPASGDL

SEQ ID NO: 1536399 - protein, 27 aa, Mycobacterium tuberculosis
GKASADPLLPPPPIPAPVSAPATVPPV

SEQ ID NO: 1536400 - protein, 8 aa, Mycobacterium tuberculosis
GKDQNVTG

SEQ ID NO: 1536401 - protein, 9 aa, Mycobacterium tuberculosis
GKNKDRDQG

SEQ ID NO: 1536402 - protein, 7 aa, Mycobacterium tuberculosis
GKPGEDG

SEQ ID NO: 1536403 - protein, 11 aa, Mycobacterium tuberculosis
GPELANGDTLS

SEQ ID NO: 1536404 - protein, 14 aa, Mycobacterium tuberculosis
GPGQAEKSLLPGNP

SEQ ID NO: 1536405 - protein, 7 aa, Mycobacterium tuberculosis
GPKNANL

SEQ ID NO: 1536406 - protein, 5 aa, Mycobacterium tuberculosis
GPLTA

SEQ ID NO: 1536407 - protein, 8 aa, Mycobacterium tuberculosis
GPRQLGPG

SEQ ID NO: 1536408 - protein, 7 aa, Mycobacterium tuberculosis
GPSGQAE

SEQ ID NO: 1536409 - protein, 9 aa, Mycobacterium tuberculosis
GQAGGAVTA

SEQ ID NO: 1536410 - protein, 8 aa, Mycobacterium tuberculosis
GRPAPTHR

SEQ ID NO: 1536411 - protein, 4 aa, Mycobacterium tuberculosis
GRPM

SEQ ID NO: 1536412 - protein, 4 aa, Mycobacterium tuberculosis
GRQG

SEQ ID NO: 1536413 - protein, 6 aa, Mycobacterium tuberculosis
GSGADP

SEQ ID NO: 1536414 - protein, 11 aa, Mycobacterium tuberculosis
GSISGLASQVS

SEQ ID NO: 1536415 - protein, 16 aa, Mycobacterium tuberculosis
GSNSPASSPAGPTQGA

SEQ ID NO: 1536416 - protein, 4 aa, Mycobacterium tuberculosis
GSQM

SEQ ID NO: 1536417 - protein, 12 aa, Mycobacterium tuberculosis
GSYSKNGKLRTV

SEQ ID NO: 1536418 - protein, 18 aa, Mycobacterium tuberculosis
GTALPPPDLSSYSPADQQ

SEQ ID NO: 1536419 - protein, 4 aa, Mycobacterium tuberculosis
GTFR

SEQ ID NO: 1536420 - protein, 5 aa, Mycobacterium tuberculosis
GTTPL

SEQ ID NO: 1536421 - protein, 13 aa, Mycobacterium tuberculosis
GVAKGSAEPHKTK

SEQ ID NO: 1536422 - protein, 8 aa, Mycobacterium tuberculosis
GVRDGDDS

SEQ ID NO: 1536423 - protein, 8 aa, Mycobacterium tuberculosis
HADSNQQL

SEQ ID NO: 1536424 - protein, 9 aa, Mycobacterium tuberculosis
HAGSGTATL

SEQ ID NO: 1536425 - protein, 17 aa, Mycobacterium tuberculosis
HASGARPASTTLPAGAD

SEQ ID NO: 1536426 - protein, 4 aa, Mycobacterium tuberculosis
HDST

SEQ ID NO: 1536427 - protein, 7 aa, Mycobacterium tuberculosis
HETEKTI

SEQ ID NO: 1536428 - protein, 9 aa, Mycobacterium tuberculosis
HGDPGSPTI

SEQ ID NO: 1536429 - protein, 5 aa, Mycobacterium tuberculosis
HKQSQ

SEQ ID NO: 1536430 - protein, 6 aa, Mycobacterium tuberculosis
HNPEVQ

SEQ ID NO: 1536431 - protein, 4 aa, Mycobacterium tuberculosis
HPPP

SEQ ID NO: 1536432 - protein, 5 aa, Mycobacterium tuberculosis
HPVDP

SEQ ID NO: 1536433 - protein, 12 aa, Mycobacterium tuberculosis
HQDRTGADPTPS

SEQ ID NO: 1536434 - protein, 5 aa, Mycobacterium tuberculosis
HTDAR

SEQ ID NO: 1536435 - protein, 19 aa, Mycobacterium tuberculosis
HTGDQARCEHNPGARTGEG

SEQ ID NO: 1536436 - protein, 8 aa, Mycobacterium tuberculosis
HVKPTGSA

SEQ ID NO: 1536437 - protein, 8 aa, Mycobacterium tuberculosis
IDEDRRAR

SEQ ID NO: 1536438 - protein, 5 aa, Mycobacterium tuberculosis
IDPQR

SEQ ID NO: 1536439 - protein, 9 aa, Mycobacterium tuberculosis
IEDSGRVEQ

SEQ ID NO: 1536440 - protein, 10 aa, Mycobacterium tuberculosis
IPVSASGQAS

SEQ ID NO: 1536441 - protein, 4 aa, Mycobacterium tuberculosis
IQPG

SEQ ID NO: 1536442 - protein, 7 aa, Mycobacterium tuberculosis
ISKDGEQ

SEQ ID NO: 1536443 - protein, 8 aa, Mycobacterium tuberculosis
ISSKADDI

SEQ ID NO: 1536444 - protein, 7 aa, Mycobacterium tuberculosis
KAAEHGD

SEQ ID NO: 1536445 - protein, 8 aa, Mycobacterium tuberculosis
KAAGQDMP

SEQ ID NO: 1536446 - protein, 7 aa, Mycobacterium tuberculosis
KANQRLQ

SEQ ID NO: 1536447 - protein, 8 aa, Mycobacterium tuberculosis
KGGVGKTS

SEQ ID NO: 1536448 - protein, 4 aa, Mycobacterium tuberculosis
KNEL

SEQ ID NO: 1536449 - protein, 7 aa, Mycobacterium tuberculosis
KNEPPGI

SEQ ID NO: 1536450 - protein, 7 aa, Mycobacterium tuberculosis
KRGIDPE

SEQ ID NO: 1536451 - protein, 7 aa, Mycobacterium tuberculosis
KRGISPE

SEQ ID NO: 1536452 - protein, 26 aa, Mycobacterium tuberculosis
KSISGTAVKAGGAGVPRNNNSQERYP

SEQ ID NO: 1536453 - protein, 8 aa, Mycobacterium tuberculosis
KTLSASSQ

SEQ ID NO: 1536454 - protein, 9 aa, Mycobacterium tuberculosis
KTQGPGAWP

SEQ ID NO: 1536455 - protein, 9 aa, Mycobacterium tuberculosis
LAPQDGDGV

SEQ ID NO: 1536456 - protein, 4 aa, Mycobacterium tuberculosis
LDEA

SEQ ID NO: 1536457 - protein, 5 aa, Mycobacterium tuberculosis
LGAPC

SEQ ID NO: 1536458 - protein, 14 aa, Mycobacterium tuberculosis
LGPPLARADGTSQL

SEQ ID NO: 1536459 - protein, 18 aa, Mycobacterium tuberculosis
LGTIPSSPATTSTGGGGL

SEQ ID NO: 1536460 - protein, 8 aa, Mycobacterium tuberculosis
LGVPPNPV

SEQ ID NO: 1536461 - protein, 20 aa, Mycobacterium tuberculosis
LPAPDEATAAATSTETSTYP

SEQ ID NO: 1536462 - protein, 6 aa, Mycobacterium tuberculosis
LPDNGR

SEQ ID NO: 1536463 - protein, 5 aa, Mycobacterium tuberculosis
LPNQK

SEQ ID NO: 1536464 - protein, 6 aa, Mycobacterium tuberculosis
LPPADL

SEQ ID NO: 1536465 - protein, 8 aa, Mycobacterium tuberculosis
LPTTGEAA

SEQ ID NO: 1536466 - protein, 8 aa, Mycobacterium tuberculosis
LRADPRNQ

SEQ ID NO: 1536467 - protein, 6 aa, Mycobacterium tuberculosis
LSGGGT

SEQ ID NO: 1536468 - protein, 12 aa, Mycobacterium tuberculosis
LSPAAGELQGPL

SEQ ID NO: 1536469 - protein, 22 aa, Mycobacterium tuberculosis
LTDPNKPTMQNTTGMPEGEGVD

SEQ ID NO: 1536470 - protein, 8 aa, Mycobacterium tuberculosis
LTQGPGFP

SEQ ID NO: 1536471 - protein, 6 aa, Mycobacterium tuberculosis
MARGDA

SEQ ID NO: 1536472 - protein, 16 aa, Mycobacterium tuberculosis
MPEQTAAAVSRSGRQV

SEQ ID NO: 1536473 - protein, 6 aa, Mycobacterium tuberculosis
MSAGLG

SEQ ID NO: 1536474 - protein, 5 aa, Mycobacterium tuberculosis
NDGYS

SEQ ID NO: 1536475 - protein, 5 aa, Mycobacterium tuberculosis
NEPGF

SEQ ID NO: 1536476 - protein, 7 aa, Mycobacterium tuberculosis
NEPSLGD

SEQ ID NO: 1536477 - protein, 27 aa, Mycobacterium tuberculosis
NGTPGPDETTLTTGDAGKRVACGVIGS

SEQ ID NO: 1536478 - protein, 6 aa, Mycobacterium tuberculosis
NIPGDP

SEQ ID NO: 1536479 - protein, 12 aa, Mycobacterium tuberculosis
NPPPRPETAYGE

SEQ ID NO: 1536480 - protein, 11 aa, Mycobacterium tuberculosis
NRQKDAATAQT

SEQ ID NO: 1536481 - protein, 5 aa, Mycobacterium tuberculosis
NSSDG

SEQ ID NO: 1536482 - protein, 7 aa, Mycobacterium tuberculosis
NTAADQL

SEQ ID NO: 1536483 - protein, 5 aa, Mycobacterium tuberculosis
NTIPG

SEQ ID NO: 1536484 - protein, 8 aa, Mycobacterium tuberculosis
NTKPGQEV

SEQ ID NO: 1536485 - protein, 7 aa, Mycobacterium tuberculosis
NTNNGAI

SEQ ID NO: 1536486 - protein, 6 aa, Mycobacterium tuberculosis
NVGPNE

SEQ ID NO: 1536487 - protein, 7 aa, Mycobacterium tuberculosis
PAGSQLS

SEQ ID NO: 1536488 - protein, 12 aa, Mycobacterium tuberculosis
PAPFAGSIGSGA

SEQ ID NO: 1536489 - protein, 13 aa, Mycobacterium tuberculosis
PAPPPDGVGVAFG

SEQ ID NO: 1536490 - protein, 6 aa, Mycobacterium tuberculosis
PAQGTL

SEQ ID NO: 1536491 - protein, 7 aa, Mycobacterium tuberculosis
PDGGASA

SEQ ID NO: 1536492 - protein, 8 aa, Mycobacterium tuberculosis
PDGSVAQT

SEQ ID NO: 1536493 - protein, 5 aa, Mycobacterium tuberculosis
PDPGT

SEQ ID NO: 1536494 - protein, 4 aa, Mycobacterium tuberculosis
PDWG

SEQ ID NO: 1536495 - protein, 5 aa, Mycobacterium tuberculosis
PEAQW

SEQ ID NO: 1536496 - protein, 7 aa, Mycobacterium tuberculosis
PEPPEGV

SEQ ID NO: 1536497 - protein, 8 aa, Mycobacterium tuberculosis
PESGEFDP

SEQ ID NO: 1536498 - protein, 7 aa, Mycobacterium tuberculosis
PFSSYGT

SEQ ID NO: 1536499 - protein, 15 aa, Mycobacterium tuberculosis
PGFQGSGDGSAATLG

SEQ ID NO: 1536500 - protein, 5 aa, Mycobacterium tuberculosis
PGGFA

SEQ ID NO: 1536501 - protein, 5 aa, Mycobacterium tuberculosis
PGGGQ

SEQ ID NO: 1536502 - protein, 6 aa, Mycobacterium tuberculosis
PGNEFS

SEQ ID NO: 1536503 - protein, 10 aa, Mycobacterium tuberculosis
PGSGPAGGRA

SEQ ID NO: 1536504 - protein, 13 aa, Mycobacterium tuberculosis
PGSHSMNSSYSGG

SEQ ID NO: 1536505 - protein, 15 aa, Mycobacterium tuberculosis
PGTAPPATGGGPACR

SEQ ID NO: 1536506 - protein, 6 aa, Mycobacterium tuberculosis
PICTGG

SEQ ID NO: 1536507 - protein, 12 aa, Mycobacterium tuberculosis
PIPDPNTPTGSR

SEQ ID NO: 1536508 - protein, 7 aa, Mycobacterium tuberculosis
PLNGSRA

SEQ ID NO: 1536509 - protein, 4 aa, Mycobacterium tuberculosis
PMSP

SEQ ID NO: 1536510 - protein, 7 aa, Mycobacterium tuberculosis
PPAEPSG

SEQ ID NO: 1536511 - protein, 23 aa, Mycobacterium tuberculosis
PPAPGPAPAPPAPGAGPGEHGGG

SEQ ID NO: 1536512 - protein, 10 aa, Mycobacterium tuberculosis
PPFNATQPVP

SEQ ID NO: 1536513 - protein, 6 aa, Mycobacterium tuberculosis
PPLQPI

SEQ ID NO: 1536514 - protein, 5 aa, Mycobacterium tuberculosis
PPPDA

SEQ ID NO: 1536515 - protein, 11 aa, Mycobacterium tuberculosis
PPPNQFPPAET

SEQ ID NO: 1536516 - protein, 7 aa, Mycobacterium tuberculosis
PQPPVAA

SEQ ID NO: 1536517 - protein, 21 aa, Mycobacterium tuberculosis
PRQESNDATGGTTESGISGSR

SEQ ID NO: 1536518 - protein, 5 aa, Mycobacterium tuberculosis
PRSSD

SEQ ID NO: 1536519 - protein, 8 aa, Mycobacterium tuberculosis
PSTGLDPA

SEQ ID NO: 1536520 - protein, 18 aa, Mycobacterium tuberculosis
PTDTGITNAPAGSAQGRI

SEQ ID NO: 1536521 - protein, 16 aa, Mycobacterium tuberculosis
PTKHNDTRRSGEHQSF

SEQ ID NO: 1536522 - protein, 4 aa, Mycobacterium tuberculosis
PTNF

SEQ ID NO: 1536523 - protein, 13 aa, Mycobacterium tuberculosis
QAADTLDGNGDSL

SEQ ID NO: 1536524 - protein, 6 aa, Mycobacterium tuberculosis
QAPRVA

SEQ ID NO: 1536525 - protein, 9 aa, Mycobacterium tuberculosis
QASGGWTDG

SEQ ID NO: 1536526 - protein, 6 aa, Mycobacterium tuberculosis
QGERAA

SEQ ID NO: 1536527 - protein, 6 aa, Mycobacterium tuberculosis
QGRTEL

SEQ ID NO: 1536528 - protein, 24 aa, Mycobacterium tuberculosis
QPAAAGSATADVSVSGPKLSSPVT

SEQ ID NO: 1536529 - protein, 10 aa, Mycobacterium tuberculosis
QPADPNDPPT

SEQ ID NO: 1536530 - protein, 9 aa, Mycobacterium tuberculosis
QSGGANSPA

SEQ ID NO: 1536531 - protein, 6 aa, Mycobacterium tuberculosis
QSPDVS

SEQ ID NO: 1536532 - protein, 4 aa, Mycobacterium tuberculosis
QSVQ

SEQ ID NO: 1536533 - protein, 8 aa, Mycobacterium tuberculosis
QVGPGSVA

SEQ ID NO: 1536534 - protein, 8 aa, Mycobacterium tuberculosis
QVRPGERL

SEQ ID NO: 1536535 - protein, 5 aa, Mycobacterium tuberculosis
RADGT

SEQ ID NO: 1536536 - protein, 6 aa, Mycobacterium tuberculosis
RAPPRR

SEQ ID NO: 1536537 - protein, 8 aa, Mycobacterium tuberculosis
RCSPSDVV

SEQ ID NO: 1536538 - protein, 9 aa, Mycobacterium tuberculosis
RDDDRRTET

SEQ ID NO: 1536539 - protein, 6 aa, Mycobacterium tuberculosis
REHPDD

SEQ ID NO: 1536540 - protein, 34 aa, Mycobacterium tuberculosis; identical to SEQ ID NO: 231031

SEQ ID NO: 1536541 - protein, 10 aa, Mycobacterium tuberculosis
RGTGEPPGIG

SEQ ID NO: 1536542 - protein, 6 aa, Mycobacterium tuberculosis
RHTSGT

SEQ ID NO: 1536543 - protein, 7 aa, Mycobacterium tuberculosis
RIDPRAA

SEQ ID NO: 1536544 - protein, 11 aa, Mycobacterium tuberculosis
RKATAGTPTSM

SEQ ID NO: 1536545 - protein, 9 aa, Mycobacterium tuberculosis
RKENNLPAD

SEQ ID NO: 1536546 - protein, 15 aa, Mycobacterium tuberculosis
RKPVEGSLGTPPRLT

SEQ ID NO: 1536547 - protein, 7 aa, Mycobacterium tuberculosis
RLGDPTS

SEQ ID NO: 1536548 - protein, 6 aa, Mycobacterium tuberculosis
RLGSGR

SEQ ID NO: 1536549 - protein, 5 aa, Mycobacterium tuberculosis
RPDGS

SEQ ID NO: 1536550 - protein, 17 aa, Mycobacterium tuberculosis
RPVNPDQRPSIGCGIKW

SEQ ID NO: 1536551 - protein, 14 aa, Mycobacterium tuberculosis
RQRTGAGLTICDAP

SEQ ID NO: 1536552 - protein, 4 aa, Mycobacterium tuberculosis
RQTG

SEQ ID NO: 1536553 - protein, 11 aa, Mycobacterium tuberculosis
RRQVEERREGL

SEQ ID NO: 1536554 - protein, 9 aa, Mycobacterium tuberculosis
RSATDGRPP

SEQ ID NO: 1536555 - protein, 12 aa, Mycobacterium tuberculosis
RVADGQSLSDTE

SEQ ID NO: 1536556 - protein, 14 aa, Mycobacterium tuberculosis
SAAEHSLPQGDDTS

SEQ ID NO: 1536557 - protein, 5 aa, Mycobacterium tuberculosis
SAEEV

SEQ ID NO: 1536558 - protein, 8 aa, Mycobacterium tuberculosis
SAGQGADE

SEQ ID NO: 1536559 - protein, 6 aa, Mycobacterium tuberculosis
SAMPPA

SEQ ID NO: 1536560 - protein, 15 aa, Mycobacterium tuberculosis
SAPNANYRTTASSWP

SEQ ID NO: 1536561 - protein, 7 aa, Mycobacterium tuberculosis
SAPPPPM

SEQ ID NO: 1536562 - protein, 8 aa, Mycobacterium tuberculosis
SARADPGP

SEQ ID NO: 1536563 - protein, 6 aa, Mycobacterium tuberculosis
SASSGT

SEQ ID NO: 1536564 - protein, 7 aa, Mycobacterium tuberculosis
SASSPDE

SEQ ID NO: 1536565 - protein, 23 aa, Mycobacterium tuberculosis
SAYGISSKKPNTVVSTDFNILAE

SEQ ID NO: 1536566 - protein, 13 aa, Mycobacterium tuberculosis
SDPANPAFRDGAA

SEQ ID NO: 1536567 - protein, 5 aa, Mycobacterium tuberculosis
SDPQF

SEQ ID NO: 1536568 - protein, 4 aa, Mycobacterium tuberculosis
SDPT

SEQ ID NO: 1536569 - protein, 10 aa, Mycobacterium tuberculosis
SDTIGKRDEQ

SEQ ID NO: 1536570 - protein, 7 aa, Mycobacterium tuberculosis
SEASAQV

SEQ ID NO: 1536571 - protein, 7 aa, Mycobacterium tuberculosis
SEGERDN

SEQ ID NO: 1536572 - protein, 6 aa, Mycobacterium tuberculosis
SESDEQ

SEQ ID NO: 1536573 - protein, 5 aa, Mycobacterium tuberculosis
SFRDA

SEQ ID NO: 1536574 - protein, 14 aa, Mycobacterium tuberculosis
SGFGQDGYDEGNAE

SEQ ID NO: 1536575 - protein, 8 aa, Mycobacterium tuberculosis
SGGVTGTI

SEQ ID NO: 1536576 - protein, 5 aa, Mycobacterium tuberculosis
SGLRP

SEQ ID NO: 1536577 - protein, 18 aa, Mycobacterium tuberculosis
SGMTSQAATFAANRLDHA

SEQ ID NO: 1536578 - protein, 12 aa, Mycobacterium tuberculosis
SHGRYNNSGDAR

SEQ ID NO: 1536579 - protein, 6 aa, Mycobacterium tuberculosis
SKVTYN

SEQ ID NO: 1536580 - protein, 7 aa, Mycobacterium tuberculosis
SLEGGKQ

SEQ ID NO: 1536581 - protein, 7 aa, Mycobacterium tuberculosis
SLGDTAT

SEQ ID NO: 1536582 - protein, 11 aa, Mycobacterium tuberculosis
SLGKPSRPTPI

SEQ ID NO: 1536583 - protein, 12 aa, Mycobacterium tuberculosis
SLPGAGGSLTRT

SEQ ID NO: 1536584 - protein, 10 aa, Mycobacterium tuberculosis
SLSNERKVAE

SEQ ID NO: 1536585 - protein, 10 aa, Mycobacterium tuberculosis
SPDAAADPLM

SEQ ID NO: 1536586 - protein, 4 aa, Mycobacterium tuberculosis
SPDN

SEQ ID NO: 1536587 - protein, 8 aa, Mycobacterium tuberculosis
SPLPAAYA

SEQ ID NO: 1536588 - protein, 19 aa, Mycobacterium tuberculosis
SPLSNHPLAGGSGPSAGAG

SEQ ID NO: 1536589 - protein, 7 aa, Mycobacterium tuberculosis
SPSYDPN

SEQ ID NO: 1536590 - protein, 15 aa, Mycobacterium tuberculosis
SQGAPAKTTKQSINT

SEQ ID NO: 1536591 - protein, 4 aa, Mycobacterium tuberculosis
SQPI

SEQ ID NO: 1536592 - protein, 10 aa, Mycobacterium tuberculosis
SRQRGQITAG

SEQ ID NO: 1536593 - protein, 5 aa, Mycobacterium tuberculosis
SSCPN

SEQ ID NO: 1536594 - protein, 10 aa, Mycobacterium tuberculosis
SSEGGQGAPP

SEQ ID NO: 1536595 - protein, 40 aa, Mycobacterium tuberculosis; identical to SEQ ID NO: 231391

SEQ ID NO: 1536596 - protein, 16 aa, Mycobacterium tuberculosis
SSPQHASTVPGTTPSI

SEQ ID NO: 1536597 - protein, 7 aa, Mycobacterium tuberculosis
STGNKRT

SEQ ID NO: 1536598 - protein, 8 aa, Mycobacterium tuberculosis
STPHNTTG

SEQ ID NO: 1536599 - protein, 10 aa, Mycobacterium tuberculosis
STTSTLPGAG

SEQ ID NO: 1536600 - protein, 15 aa, Mycobacterium tuberculosis
SVTASDHDDERPQEE

SEQ ID NO: 1536601 - protein, 8 aa, Mycobacterium tuberculosis
TADPANRH

SEQ ID NO: 1536602 - protein, 6 aa, Mycobacterium tuberculosis
TAKNSV

SEQ ID NO: 1536603 - protein, 14 aa, Mycobacterium tuberculosis
TARDNAAAAEDDLE

SEQ ID NO: 1536604 - protein, 12 aa, Mycobacterium tuberculosis
TARTLTSQQRDL

SEQ ID NO: 1536605 - protein, 12 aa, Mycobacterium tuberculosis
TATLRRSSGGGI

SEQ ID NO: 1536606 - protein, 10 aa, Mycobacterium tuberculosis
TDLAGGSGRD

SEQ ID NO: 1536607 - protein, 8 aa, Mycobacterium tuberculosis
TDNTTDGF

SEQ ID NO: 1536608 - protein, 8 aa, Mycobacterium tuberculosis
TDTDPSIA

SEQ ID NO: 1536609 - protein, 6 aa, Mycobacterium tuberculosis
TENREA

SEQ ID NO: 1536610 - protein, 14 aa, Mycobacterium tuberculosis
TETRRKFDEQREEV

SEQ ID NO: 1536611 - protein, 4 aa, Mycobacterium tuberculosis
TFPG

SEQ ID NO: 1536612 - protein, 13 aa, Mycobacterium tuberculosis
TGAGSPPDPQFRP

SEQ ID NO: 1536613 - protein, 6 aa, Mycobacterium tuberculosis
TGDAPL

SEQ ID NO: 1536614 - protein, 10 aa, Mycobacterium tuberculosis
TGDPNGACGV

SEQ ID NO: 1536615 - protein, 35 aa, Mycobacterium tuberculosis; identical to SEQ ID NO: 231542

SEQ ID NO: 1536616 - protein, 10 aa, Mycobacterium tuberculosis
THDPATPYKA

SEQ ID NO: 1536617 - protein, 16 aa, Mycobacterium tuberculosis
TKPADAEHPNSGMGTS

SEQ ID NO: 1536618 - protein, 9 aa, Mycobacterium tuberculosis
TLSDQSENI

SEQ ID NO: 1536619 - protein, 8 aa, Mycobacterium tuberculosis
TNTIGTES

SEQ ID NO: 1536620 - protein, 5 aa, Mycobacterium tuberculosis
TPAEA

SEQ ID NO: 1536621 - protein, 13 aa, Mycobacterium tuberculosis
TPATEAKSETPVP

SEQ ID NO: 1536622 - protein, 5 aa, Mycobacterium tuberculosis
TPPAA

SEQ ID NO: 1536623 - protein, 15 aa, Mycobacterium tuberculosis
TRRQQWSGRPGAALG

SEQ ID NO: 1536624 - protein, 5 aa, Mycobacterium tuberculosis
TSGAD

SEQ ID NO: 1536625 - protein, 4 aa, Mycobacterium tuberculosis
TSGY

SEQ ID NO: 1536626 - protein, 13 aa, Mycobacterium tuberculosis
TTATQSYCQALPP

SEQ ID NO: 1536627 - protein, 10 aa, Mycobacterium tuberculosis
TTGYISPRSA

SEQ ID NO: 1536628 - protein, 44 aa, Mycobacterium tuberculosis; identical to SEQ ID NO: 231653

SEQ ID NO: 1536629 - protein, 7 aa, Mycobacterium tuberculosis
TVGARGS

SEQ ID NO: 1536630 - protein, 5 aa, Mycobacterium tuberculosis
TVSDV

SEQ ID NO: 1536631 - protein, 10 aa, Mycobacterium tuberculosis
TYPQDGPDQM

SEQ ID NO: 1536632 - protein, 4 aa, Mycobacterium tuberculosis
TYRE

SEQ ID NO: 1536633 - protein, 9 aa, Mycobacterium tuberculosis
VDTNGSDKA

SEQ ID NO: 1536634 - protein, 28 aa, Mycobacterium tuberculosis
VDTNTSVSPAPSVPDSTTTSVSTGPPEV

SEQ ID NO: 1536635 - protein, 8 aa, Mycobacterium tuberculosis
VESRPGWA

SEQ ID NO: 1536636 - protein, 6 aa, Mycobacterium tuberculosis
VGADPL

SEQ ID NO: 1536637 - protein, 9 aa, Mycobacterium tuberculosis
VGATSKGVC

SEQ ID NO: 1536638 - protein, 6 aa, Mycobacterium tuberculosis
VGGPSA

SEQ ID NO: 1536639 - protein, 15 aa, Mycobacterium tuberculosis
VGGTGGGNPADEEAA

SEQ ID NO: 1536640 - protein, 12 aa, Mycobacterium tuberculosis
VGPFGGPDFPAP

SEQ ID NO: 1536641 - protein, 20 aa, Mycobacterium tuberculosis
VKDERSETSPRALTSCQVSS

SEQ ID NO: 1536642 - protein, 8 aa, Mycobacterium tuberculosis
VNSQGYAN

SEQ ID NO: 1536643 - protein, 4 aa, Mycobacterium tuberculosis
VPAA

SEQ ID NO: 1536644 - protein, 7 aa, Mycobacterium tuberculosis
VPDPNVP

SEQ ID NO: 1536645 - protein, 7 aa, Mycobacterium tuberculosis
VPGERTD

SEQ ID NO: 1536646 - protein, 5 aa, Mycobacterium tuberculosis
VPPGR

SEQ ID NO: 1536647 - protein, 100 aa, Mycobacterium tuberculosis; identical to SEQ ID NO: 231772

SEQ ID NO: 1536648 - protein, 17 aa, Mycobacterium tuberculosis
VQPSPPNPDGPPPTPGI

SEQ ID NO: 1536649 - protein, 6 aa, Mycobacterium tuberculosis
VRGDGS

SEQ ID NO: 1536650 - protein, 7 aa, Mycobacterium tuberculosis
VSDQTVT

SEQ ID NO: 1536651 - protein, 14 aa, Mycobacterium tuberculosis
VSPGGVTLSSGERL

SEQ ID NO: 1536652 - protein, 24 aa, Mycobacterium tuberculosis
VSPPPAPQSTDTPRSTPPPPRRPT

SEQ ID NO: 1536653 - protein, 6 aa, Mycobacterium tuberculosis
VTDRRA

SEQ ID NO: 1536654 - protein, 17 aa, Mycobacterium tuberculosis
VTGPDTADQPVPDDKRD

SEQ ID NO: 1536655 - protein, 6 aa, Mycobacterium tuberculosis
WREPTG

SEQ ID NO: 1536656 - protein, 9 aa, Mycobacterium tuberculosis
YDSNDPSSP

SEQ ID NO: 1536657 - protein, 11 aa, Mycobacterium tuberculosis
YEASSDSPPGL

SEQ ID NO: 1536658 - protein, 8 aa, Mycobacterium tuberculosis
YGPQTAEF

SEQ ID NO: 1536659 - protein, 8 aa, Mycobacterium tuberculosis
YHPSAPAY

SEQ ID NO: 1536660 - protein, 8 aa, Mycobacterium tuberculosis
YNAGGGHN

SEQ ID NO: 1536661 - protein, 5 aa, Mycobacterium tuberculosis
YPRRS

SEQ ID NO: 1536662 - protein, 5 aa, Mycobacterium tuberculosis
YYGQF

SEQ ID NO: 1536663 - protein, 5 aa, Mycobacterium tuberculosis
AAAAT

SEQ ID NO: 1536664 - protein, 9 aa, Mycobacterium tuberculosis
AAANDVPRA

SEQ ID NO: 1536665 - protein, 6 aa, Mycobacterium tuberculosis
AADPGY

SEQ ID NO: 1536666 - protein, 23 aa, Mycobacterium tuberculosis
AAGSSGSLVTPDSYQRTDYPSAG

SEQ ID NO: 1536667 - protein, 7 aa, Mycobacterium tuberculosis
AAGTRGL

SEQ ID NO: 1536668 - protein, 5 aa, Mycobacterium tuberculosis
AAGVT

SEQ ID NO: 1536669 - protein, 11 aa, Mycobacterium tuberculosis
AAINPGNSGGA

SEQ ID NO: 1536670 - protein, 10 aa, Mycobacterium tuberculosis
AAPAQANPVD

SEQ ID NO: 1536671 - protein, 9 aa, Mycobacterium tuberculosis
AAPGARAGT

SEQ ID NO: 1536672 - protein, 5 aa, Mycobacterium tuberculosis
AAPGC

SEQ ID NO: 1536673 - protein, 15 aa, Mycobacterium tuberculosis
AAPKVADAVGGNGYS

SEQ ID NO: 1536674 - protein, 5 aa, Mycobacterium tuberculosis
AAPYA

SEQ ID NO: 1536675 - protein, 8 aa, Mycobacterium tuberculosis
AASAGAQA

SEQ ID NO: 1536676 - protein, 6 aa, Mycobacterium tuberculosis
ADAATS

SEQ ID NO: 1536677 - protein, 12 aa, Mycobacterium tuberculosis
ADAVPAAAAAAG

SEQ ID NO: 1536678 - protein, 11 aa, Mycobacterium tuberculosis
ADGANDASDHI

SEQ ID NO: 1536679 - protein, 14 aa, Mycobacterium tuberculosis
ADNLAGKGRQLNET

SEQ ID NO: 1536680 - protein, 12 aa, Mycobacterium tuberculosis
ADPTPPGDSQLP

SEQ ID NO: 1536681 - protein, 6 aa, Mycobacterium tuberculosis
ADPTSD

SEQ ID NO: 1536682 - protein, 22 aa, Mycobacterium tuberculosis
AEAYSAADRISSRPQARPQPQP

SEQ ID NO: 1536683 - protein, 6 aa, Mycobacterium tuberculosis
AECPAD

SEQ ID NO: 1536684 - protein, 10 aa, Mycobacterium tuberculosis
AEPGPRSAKE

SEQ ID NO: 1536685 - protein, 10 aa, Mycobacterium tuberculosis
AETSAEIDPG

SEQ ID NO: 1536686 - protein, 10 aa, Mycobacterium tuberculosis
AGGAGRTSIG

SEQ ID NO: 1536687 - protein, 7 aa, Mycobacterium tuberculosis
AGGLPGD

SEQ ID NO: 1536688 - protein, 5 aa, Mycobacterium tuberculosis
AGGRT

SEQ ID NO: 1536689 - protein, 6 aa, Mycobacterium tuberculosis
AGQAAA

SEQ ID NO: 1536690 - protein, 12 aa, Mycobacterium tuberculosis
AGRDGSANRPAA

SEQ ID NO: 1536691 - protein, 28 aa, Mycobacterium tuberculosis
AGSDDKGEPDDGGDRGASLATTSDADWK

SEQ ID NO: 1536692 - protein, 15 aa, Mycobacterium tuberculosis
AGTDGSVTYDRGSDG

SEQ ID NO: 1536693 - protein, 20 aa, Mycobacterium tuberculosis
AGTPDRPQATKAECGSPASN

SEQ ID NO: 1536694 - protein, 7 aa, Mycobacterium tuberculosis
AGTPNKV

SEQ ID NO: 1536695 - protein, 10 aa, Mycobacterium tuberculosis
AHGGPGGRPG

SEQ ID NO: 1536696 - protein, 18 aa, Mycobacterium tuberculosis
AIAPGESAYDNTHAASDI

SEQ ID NO: 1536697 - protein, 5 aa, Mycobacterium tuberculosis
AIPDR

SEQ ID NO: 1536698 - protein, 4 aa, Mycobacterium tuberculosis
AKGN

SEQ ID NO: 1536699 - protein, 15 aa, Mycobacterium tuberculosis
AKPPLGSPPPKTTVT

SEQ ID NO: 1536700 - protein, 7 aa, Mycobacterium tuberculosis
AKPQRID

SEQ ID NO: 1536701 - protein, 5 aa, Mycobacterium tuberculosis
ALASG

SEQ ID NO: 1536702 - protein, 7 aa, Mycobacterium tuberculosis
ALPPDKR

SEQ ID NO: 1536703 - protein, 11 aa, Mycobacterium tuberculosis
ALSTDAGNQGV

SEQ ID NO: 1536704 - protein, 12 aa, Mycobacterium tuberculosis
ANGGATDARGTA

SEQ ID NO: 1536705 - protein, 8 aa, Mycobacterium tuberculosis
ANSGPALT

SEQ ID NO: 1536706 - protein, 13 aa, Mycobacterium tuberculosis
APAGGRAAHADPC

SEQ ID NO: 1536707 - protein, 9 aa, Mycobacterium tuberculosis
APAPANAAD

SEQ ID NO: 1536708 - protein, 31 aa, Mycobacterium tuberculosis; identical to SEQ ID NO: 229086

SEQ ID NO: 1536709 - protein, 15 aa, Mycobacterium tuberculosis
APGPLPSNQAAKATV

SEQ ID NO: 1536710 - protein, 14 aa, Mycobacterium tuberculosis
APPKGEARQGKLRD

SEQ ID NO: 1536711 - protein, 6 aa, Mycobacterium tuberculosis
AQARAA

SEQ ID NO: 1536712 - protein, 7 aa, Mycobacterium tuberculosis
AQEYQQI

SEQ ID NO: 1536713 - protein, 9 aa, Mycobacterium tuberculosis
AQPGSGESL

SEQ ID NO: 1536714 - protein, 8 aa, Mycobacterium tuberculosis
ARAATEAM

SEQ ID NO: 1536715 - protein, 15 aa, Mycobacterium tuberculosis
ARTAYGAAGQQPMRQ

SEQ ID NO: 1536716 - protein, 6 aa, Mycobacterium tuberculosis
ASATFS

SEQ ID NO: 1536717 - protein, 7 aa, Mycobacterium tuberculosis
ASHDQSL

SEQ ID NO: 1536718 - protein, 15 aa, Mycobacterium tuberculosis
ASPTDPHAPHAKPED

SEQ ID NO: 1536719 - protein, 7 aa, Mycobacterium tuberculosis
ASRPDNV

SEQ ID NO: 1536720 - protein, 8 aa, Mycobacterium tuberculosis
ASSAAAGR

SEQ ID NO: 1536721 - protein, 7 aa, Mycobacterium tuberculosis
ASSTALT

SEQ ID NO: 1536722 - protein, 9 aa, Mycobacterium tuberculosis
ASVPHRQRA

SEQ ID NO: 1536723 - protein, 7 aa, Mycobacterium tuberculosis
ATNTTET

SEQ ID NO: 1536724 - protein, 15 aa, Mycobacterium tuberculosis
ATPQLRGELSESGAA

SEQ ID NO: 1536725 - protein, 5 aa, Mycobacterium tuberculosis
ATQAG

SEQ ID NO: 1536726 - protein, 4 aa, Mycobacterium tuberculosis
ATQQ

SEQ ID NO: 1536727 - protein, 10 aa, Mycobacterium tuberculosis
ATTDPSPFDP

SEQ ID NO: 1536728 - protein, 20 aa, Mycobacterium tuberculosis
AVPGGTAGEVETETGEGAAA

SEQ ID NO: 1536729 - protein, 10 aa, Mycobacterium tuberculosis
AVYSDGRPVT

SEQ ID NO: 1536730 - protein, 6 aa, Mycobacterium tuberculosis
CAEPAG

SEQ ID NO: 1536731 - protein, 5 aa, Mycobacterium tuberculosis
CEAGG

SEQ ID NO: 1536732 - protein, 9 aa, Mycobacterium tuberculosis
CETPEYDRG

SEQ ID NO: 1536733 - protein, 12 aa, Mycobacterium tuberculosis
CQTPQAQGELPV

SEQ ID NO: 1536734 - protein, 7 aa, Mycobacterium tuberculosis
CSSATNV

SEQ ID NO: 1536735 - protein, 22 aa, Mycobacterium tuberculosis
CSTEGDAGKASDTAATASNGDA

SEQ ID NO: 1536736 - protein, 25 aa, Mycobacterium tuberculosis
DAASAARSAIDTGSDTTTASVRAEA

SEQ ID NO: 1536737 - protein, 8 aa, Mycobacterium tuberculosis
DAKPPPTF

SEQ ID NO: 1536738 - protein, 18 aa, Mycobacterium tuberculosis
DAQRDANGRFPRDASPDD

SEQ ID NO: 1536739 - protein, 21 aa, Mycobacterium tuberculosis
DAREQTRQEATKDRDRPPGTA

SEQ ID NO: 1536740 - protein, 6 aa, Mycobacterium tuberculosis
DARLPA

SEQ ID NO: 1536741 - protein, 6 aa, Mycobacterium tuberculosis
DARPGR

SEQ ID NO: 1536742 - protein, 8 aa, Mycobacterium tuberculosis
DDPEPFDP

SEQ ID NO: 1536743 - protein, 8 aa, Mycobacterium tuberculosis
DDPGRSGE

SEQ ID NO: 1536744 - protein, 10 aa, Mycobacterium tuberculosis
DDSSSPTDLC

SEQ ID NO: 1536745 - protein, 9 aa, Mycobacterium tuberculosis
DFDTRDQYQ

SEQ ID NO: 1536746 - protein, 4 aa, Mycobacterium tuberculosis
DGAG

SEQ ID NO: 1536747 - protein, 6 aa, Mycobacterium tuberculosis
DGGSSY

SEQ ID NO: 1536748 - protein, 13 aa, Mycobacterium tuberculosis
DGPAGSVPDPSKW

SEQ ID NO: 1536749 - protein, 9 aa, Mycobacterium tuberculosis
DGPAQEKVY

SEQ ID NO: 1536750 - protein, 6 aa, Mycobacterium tuberculosis
DGQRLP

SEQ ID NO: 1536751 - protein, 9 aa, Mycobacterium tuberculosis
DGSPGARKD

SEQ ID NO: 1536752 - protein, 6 aa, Mycobacterium tuberculosis
DGTLPG

SEQ ID NO: 1536753 - protein, 18 aa, Mycobacterium tuberculosis
DGVACPDGSTAPSSETYA

SEQ ID NO: 1536754 - protein, 10 aa, Mycobacterium tuberculosis
DIQDRVNNRS

SEQ ID NO: 1536755 - protein, 14 aa, Mycobacterium tuberculosis
DLPANATAKIGTTS

SEQ ID NO: 1536756 - protein, 12 aa, Mycobacterium tuberculosis
DNDMHDGSIAQG

SEQ ID NO: 1536757 - protein, 7 aa, Mycobacterium tuberculosis
DNHESAR

SEQ ID NO: 1536758 - protein, 13 aa, Mycobacterium tuberculosis
DPAAARDALGGTP

SEQ ID NO: 1536759 - protein, 8 aa, Mycobacterium tuberculosis
DPANTTST

SEQ ID NO: 1536760 - protein, 8 aa, Mycobacterium tuberculosis
DPAVPGTN

SEQ ID NO: 1536761 - protein, 11 aa, Mycobacterium tuberculosis
DPEPGVPGRSV

SEQ ID NO: 1536762 - protein, 8 aa, Mycobacterium tuberculosis
DPTHNTDP

SEQ ID NO: 1536763 - protein, 13 aa, Mycobacterium tuberculosis
DRAGGGYDAEPRE

SEQ ID NO: 1536764 - protein, 8 aa, Mycobacterium tuberculosis
DRQPSNQT

SEQ ID NO: 1536765 - protein, 5 aa, Mycobacterium tuberculosis
DSPVS

SEQ ID NO: 1536766 - protein, 6 aa, Mycobacterium tuberculosis
DSSGLS

SEQ ID NO: 1536767 - protein, 4 aa, Mycobacterium tuberculosis
DTTD

SEQ ID NO: 1536768 - protein, 10 aa, Mycobacterium tuberculosis
EDDGSSRNQI

SEQ ID NO: 1536769 - protein, 10 aa, Mycobacterium tuberculosis
EDPGVPGTQD

SEQ ID NO: 1536770 - protein, 16 aa, Mycobacterium tuberculosis
EEARKKTSAAPDPQQR

SEQ ID NO: 1536771 - protein, 12 aa, Mycobacterium tuberculosis
ELRGKTRAQPGC

SEQ ID NO: 1536772 - protein, 10 aa, Mycobacterium tuberculosis
ENPEGLGPGL

SEQ ID NO: 1536773 - protein, 17 aa, Mycobacterium tuberculosis
ENVPIDPSPDYDASDEI

SEQ ID NO: 1536774 - protein, 10 aa, Mycobacterium tuberculosis
EPGSNEPTHR

SEQ ID NO: 1536775 - protein, 5 aa, Mycobacterium tuberculosis
ERSAV

SEQ ID NO: 1536776 - protein, 10 aa, Mycobacterium tuberculosis
ESAAHAAAQA

SEQ ID NO: 1536777 - protein, 8 aa, Mycobacterium tuberculosis
ESSPHGKR

SEQ ID NO: 1536778 - protein, 8 aa, Mycobacterium tuberculosis
ETHPSEPN

SEQ ID NO: 1536779 - protein, 6 aa, Mycobacterium tuberculosis
FNGSTN

SEQ ID NO: 1536780 - protein, 6 aa, Mycobacterium tuberculosis
FTRGEP

SEQ ID NO: 1536781 - protein, 10 aa, Mycobacterium tuberculosis
GAAANAGVPK

SEQ ID NO: 1536782 - protein, 6 aa, Mycobacterium tuberculosis
GAGKST

SEQ ID NO: 1536783 - protein, 9 aa, Mycobacterium tuberculosis
GAGTDNTVT

SEQ ID NO: 1536784 - protein, 7 aa, Mycobacterium tuberculosis
GATGTVT

SEQ ID NO: 1536785 - protein, 8 aa, Mycobacterium tuberculosis
GATPENAA

SEQ ID NO: 1536786 - protein, 7 aa, Mycobacterium tuberculosis
GCSGQTT

SEQ ID NO: 1536787 - protein, 8 aa, Mycobacterium tuberculosis
GDDSTSTL

SEQ ID NO: 1536788 - protein, 13 aa, Mycobacterium tuberculosis
GDGSSSDKNNGQA

SEQ ID NO: 1536789 - protein, 10 aa, Mycobacterium tuberculosis
GDNPASPLTN

SEQ ID NO: 1536790 - protein, 14 aa, Mycobacterium tuberculosis
GDPPPDHITGDEEG

SEQ ID NO: 1536791 - protein, 4 aa, Mycobacterium tuberculosis
GDSV

SEQ ID NO: 1536792 - protein, 22 aa, Mycobacterium tuberculosis
GEVKDERTATGVDALTYCFVKS

SEQ ID NO: 1536793 - protein, 7 aa, Mycobacterium tuberculosis
GGIDSPQ

SEQ ID NO: 1536794 - protein, 5 aa, Mycobacterium tuberculosis
GGLGQ

SEQ ID NO: 1536795 - protein, 20 aa, Mycobacterium tuberculosis
GGPSTGTDEAWTKQEAGTDR

SEQ ID NO: 1536796 - protein, 7 aa, Mycobacterium tuberculosis
GGSASAV

SEQ ID NO: 1536797 - protein, 24 aa, Mycobacterium tuberculosis
GGSGGGDPATGSYPQEMLVDWVRV

SEQ ID NO: 1536798 - protein, 23 aa, Mycobacterium tuberculosis
GIPPAPPPPPLPEDGGPPPPVGS

SEQ ID NO: 1536799 - protein, 5 aa, Mycobacterium tuberculosis
GIPPQ

SEQ ID NO: 1536800 - protein, 10 aa, Mycobacterium tuberculosis
GISKEQVATG

SEQ ID NO: 1536801 - protein, 4 aa, Mycobacterium tuberculosis
GKNA

SEQ ID NO: 1536802 - protein, 7 aa, Mycobacterium tuberculosis
GKSSNVG

SEQ ID NO: 1536803 - protein, 10 aa, Mycobacterium tuberculosis
GKVTLSPEDH

SEQ ID NO: 1536804 - protein, 7 aa, Mycobacterium tuberculosis
GLQPGGQ

SEQ ID NO: 1536805 - protein, 15 aa, Mycobacterium tuberculosis
GMGGGGSVKSGSGPI

SEQ ID NO: 1536806 - protein, 8 aa, Mycobacterium tuberculosis
GNAPQGSI

SEQ ID NO: 1536807 - protein, 4 aa, Mycobacterium tuberculosis
GNRV

SEQ ID NO: 1536808 - protein, 7 aa, Mycobacterium tuberculosis
GPAPDGY

SEQ ID NO: 1536809 - protein, 8 aa, Mycobacterium tuberculosis
GPPPSPVQ

SEQ ID NO: 1536810 - protein, 12 aa, Mycobacterium tuberculosis
GPTERQPKGPFG

SEQ ID NO: 1536811 - protein, 14 aa, Mycobacterium tuberculosis
GPTPGGAPGNDDLG

SEQ ID NO: 1536812 - protein, 25 aa, Mycobacterium tuberculosis
GQPDRPSAMPPRGAVTGPPSPVAAQ

SEQ ID NO: 1536813 - protein, 6 aa, Mycobacterium tuberculosis
GQPPAI

SEQ ID NO: 1536814 - protein, 6 aa, Mycobacterium tuberculosis
GRPNAR

SEQ ID NO: 1536815 - protein, 6 aa, Mycobacterium tuberculosis
GSTSSR

SEQ ID NO: 1536816 - protein, 10 aa, Mycobacterium tuberculosis
GTKPGTEVPP

SEQ ID NO: 1536817 - protein, 8 aa, Mycobacterium tuberculosis
GTWEANGG

SEQ ID NO: 1536818 - protein, 13 aa, Mycobacterium tuberculosis
GVNYGDPVDAKAL

SEQ ID NO: 1536819 - protein, 17 aa, Mycobacterium tuberculosis
GYASGDLDTRGGSTLEQ

SEQ ID NO: 1536820 - protein, 19 aa, Mycobacterium tuberculosis
GYDKSWADGRGASPADRRH

SEQ ID NO: 1536821 - protein, 13 aa, Mycobacterium tuberculosis
GYRPATKEQPFGQ

SEQ ID NO: 1536822 - protein, 17 aa, Mycobacterium tuberculosis
GYTAGQVRDRESGDPFT

SEQ ID NO: 1536823 - protein, 20 aa, Mycobacterium tuberculosis
HGGTPTGSSTTSGASPATPV

SEQ ID NO: 1536824 - protein, 6 aa, Mycobacterium tuberculosis
HGPDGQ

SEQ ID NO: 1536825 - protein, 9 aa, Mycobacterium tuberculosis
HGPQQPEIS

SEQ ID NO: 1536826 - protein, 13 aa, Mycobacterium tuberculosis
HPMTGTAHSGWTA

SEQ ID NO: 1536827 - protein, 6 aa, Mycobacterium tuberculosis
HRAPSA

SEQ ID NO: 1536828 - protein, 6 aa, Mycobacterium tuberculosis
HRTPIK

SEQ ID NO: 1536829 - protein, 7 aa, Mycobacterium tuberculosis
IDAEPGR

SEQ ID NO: 1536830 - protein, 7 aa, Mycobacterium tuberculosis
IDREPDP

SEQ ID NO: 1536831 - protein, 11 aa, Mycobacterium tuberculosis
IPPAPTGGDAV

SEQ ID NO: 1536832 - protein, 11 aa, Mycobacterium tuberculosis
ITAPGASGRNR

SEQ ID NO: 1536833 - protein, 6 aa, Mycobacterium tuberculosis
KAGQGS

SEQ ID NO: 1536834 - protein, 13 aa, Mycobacterium tuberculosis
KATGLSAKGAKTF

SEQ ID NO: 1536835 - protein, 7 aa, Mycobacterium tuberculosis
KAYVGGK

SEQ ID NO: 1536836 - protein, 8 aa, Mycobacterium tuberculosis
KDLQPQNS

SEQ ID NO: 1536837 - protein, 5 aa, Mycobacterium tuberculosis
KGKRK

SEQ ID NO: 1536838 - protein, 8 aa, Mycobacterium tuberculosis
KIEPAGDK

SEQ ID NO: 1536839 - protein, 8 aa, Mycobacterium tuberculosis
KIPSSQMR

SEQ ID NO: 1536840 - protein, 5 aa, Mycobacterium tuberculosis
KPDLR

SEQ ID NO: 1536841 - protein, 21 aa, Mycobacterium tuberculosis
KRSSPPAPSLPPVTSSPLEAA

SEQ ID NO: 1536842 - protein, 11 aa, Mycobacterium tuberculosis
KSFPDSSVTRA

SEQ ID NO: 1536843 - protein, 9 aa, Mycobacterium tuberculosis
KSKAVGSSG

SEQ ID NO: 1536844 - protein, 5 aa, Mycobacterium tuberculosis
KTGQP

SEQ ID NO: 1536845 - protein, 11 aa, Mycobacterium tuberculosis
KTGTGDYGRAN

SEQ ID NO: 1536846 - protein, 16 aa, Mycobacterium tuberculosis
KTGYATNAPPITDIWG

SEQ ID NO: 1536847 - protein, 5 aa, Mycobacterium tuberculosis
KVSSA

SEQ ID NO: 1536848 - protein, 8 aa, Mycobacterium tuberculosis
KYASPNLA

SEQ ID NO: 1536849 - protein, 8 aa, Mycobacterium tuberculosis
LAPRGSGT

SEQ ID NO: 1536850 - protein, 22 aa, Mycobacterium tuberculosis
LAPTPALDPAPPAQAAPTMSTG

SEQ ID NO: 1536851 - protein, 8 aa, Mycobacterium tuberculosis
LATSPNTA

SEQ ID NO: 1536852 - protein, 5 aa, Mycobacterium tuberculosis
LGASQ

SEQ ID NO: 1536853 - protein, 13 aa, Mycobacterium tuberculosis
LGATPNTGPAPQG

SEQ ID NO: 1536854 - protein, 23 aa, Mycobacterium tuberculosis
LGATPPLSAPKVAEPAPAAPGIT

SEQ ID NO: 1536855 - protein, 12 aa, Mycobacterium tuberculosis
LGEDARSQHIDP

SEQ ID NO: 1536856 - protein, 11 aa, Mycobacterium tuberculosis
LGGPGGGTAAF

SEQ ID NO: 1536857 - protein, 6 aa, Mycobacterium tuberculosis
LGPART

SEQ ID NO: 1536858 - protein, 6 aa, Mycobacterium tuberculosis
LNEGRG

SEQ ID NO: 1536859 - protein, 8 aa, Mycobacterium tuberculosis
LPGEAEAL

SEQ ID NO: 1536860 - protein, 15 aa, Mycobacterium tuberculosis
LPPPGRDGSGSAEQL

SEQ ID NO: 1536861 - protein, 19 aa, Mycobacterium tuberculosis
LPPTDPRYVDGAPGSRVPS

SEQ ID NO: 1536862 - protein, 12 aa, Mycobacterium tuberculosis
LRTPDGPTGFPP

SEQ ID NO: 1536863 - protein, 5 aa, Mycobacterium tuberculosis
LSKQP

SEQ ID NO: 1536864 - protein, 6 aa, Mycobacterium tuberculosis
LSSPDE

SEQ ID NO: 1536865 - protein, 19 aa, Mycobacterium tuberculosis
MAGRQQGRREAQAVARLLG

SEQ ID NO: 1536866 - protein, 4 aa, Mycobacterium tuberculosis
MSGP

SEQ ID NO: 1536867 - protein, 8 aa, Mycobacterium tuberculosis
NASRSTGW

SEQ ID NO: 1536868 - protein, 4 aa, Mycobacterium tuberculosis
NEET

SEQ ID NO: 1536869 - protein, 7 aa, Mycobacterium tuberculosis
NIQPNSR

SEQ ID NO: 1536870 - protein, 4 aa, Mycobacterium tuberculosis
NLPW

SEQ ID NO: 1536871 - protein, 4 aa, Mycobacterium tuberculosis
NPAG

SEQ ID NO: 1536872 - protein, 7 aa, Mycobacterium tuberculosis
NPGCPRS

SEQ ID NO: 1536873 - protein, 8 aa, Mycobacterium tuberculosis
NPSGRAGG

SEQ ID NO: 1536874 - protein, 5 aa, Mycobacterium tuberculosis
NQSGD

SEQ ID NO: 1536875 - protein, 5 aa, Mycobacterium tuberculosis
NSCPN

SEQ ID NO: 1536876 - protein, 21 aa, Mycobacterium tuberculosis
NSPDSTPSATSPAPAPSPTPP

SEQ ID NO: 1536877 - protein, 30 aa, Mycobacterium tuberculosis; identical to SEQ ID NO: 6024

SEQ ID NO: 1536878 - protein, 8 aa, Mycobacterium tuberculosis
NTTGAKRI

SEQ ID NO: 1536879 - protein, 6 aa, Mycobacterium tuberculosis
PADNQI

SEQ ID NO: 1536880 - protein, 7 aa, Mycobacterium tuberculosis
PADPNTW

SEQ ID NO: 1536881 - protein, 4 aa, Mycobacterium tuberculosis
PAEA

SEQ ID NO: 1536882 - protein, 7 aa, Mycobacterium tuberculosis
PATVTAA

SEQ ID NO: 1536883 - protein, 10 aa, Mycobacterium tuberculosis
PDGAGGDRTA

SEQ ID NO: 1536884 - protein, 20 aa, Mycobacterium tuberculosis
PDPNGTRFPNGAPPPPPPVL

SEQ ID NO: 1536885 - protein, 5 aa, Mycobacterium tuberculosis
PDQQA

SEQ ID NO: 1536886 - protein, 18 aa, Mycobacterium tuberculosis
PEVGAERQDLRQYPGGSL

SEQ ID NO: 1536887 - protein, 9 aa, Mycobacterium tuberculosis
PGADSAAPA

SEQ ID NO: 1536888 - protein, 4 aa, Mycobacterium tuberculosis
PHIS

SEQ ID NO: 1536889 - protein, 15 aa, Mycobacterium tuberculosis
PHPPAGGFSPGGHNG

SEQ ID NO: 1536890 - protein, 5 aa, Mycobacterium tuberculosis
PIPGA

SEQ ID NO: 1536891 - protein, 11 aa, Mycobacterium tuberculosis
PITGPPPPLGD

SEQ ID NO: 1536892 - protein, 9 aa, Mycobacterium tuberculosis
PKPQNYPGL

SEQ ID NO: 1536893 - protein, 13 aa, Mycobacterium tuberculosis
PLPGTQGNGPGSF

SEQ ID NO: 1536894 - protein, 9 aa, Mycobacterium tuberculosis
PLPPGSDEH

SEQ ID NO: 1536895 - protein, 11 aa, Mycobacterium tuberculosis
PLTSAADAAGL

SEQ ID NO: 1536896 - protein, 5 aa, Mycobacterium tuberculosis
PNGSQ

SEQ ID NO: 1536897 - protein, 24 aa, Mycobacterium tuberculosis
PPNAPPGARTQPLEPFPDGTGGSN

SEQ ID NO: 1536898 - protein, 15 aa, Mycobacterium tuberculosis
PPQAPPGTQWTPPTA

SEQ ID NO: 1536899 - protein, 7 aa, Mycobacterium tuberculosis
PQFERRQ

SEQ ID NO: 1536900 - protein, 5 aa, Mycobacterium tuberculosis
PQFGS

SEQ ID NO: 1536901 - protein, 5 aa, Mycobacterium tuberculosis
PRRRP

SEQ ID NO: 1536902 - protein, 14 aa, Mycobacterium tuberculosis
PTAGTGTPTGDYGI

SEQ ID NO: 1536903 - protein, 9 aa, Mycobacterium tuberculosis
PVPTPDSPT

SEQ ID NO: 1536904 - protein, 7 aa, Mycobacterium tuberculosis
PVSPRAR

SEQ ID NO: 1536905 - protein, 23 aa, Mycobacterium tuberculosis
QETERGHAGYTTEGTTGLPAGGE

SEQ ID NO: 1536906 - protein, 7 aa, Mycobacterium tuberculosis
QGDGTSI

SEQ ID NO: 1536907 - protein, 10 aa, Mycobacterium tuberculosis
QGSLAQSRTR

SEQ ID NO: 1536908 - protein, 10 aa, Mycobacterium tuberculosis
QGSPLRDQPY

SEQ ID NO: 1536909 - protein, 21 aa, Mycobacterium tuberculosis
QIRSPSDPGYVPTAPPAMSSA

SEQ ID NO: 1536910 - protein, 12 aa, Mycobacterium tuberculosis
QPADDATARATI

SEQ ID NO: 1536911 - protein, 10 aa, Mycobacterium tuberculosis
QPTGNGRAAI

SEQ ID NO: 1536912 - protein, 10 aa, Mycobacterium tuberculosis
QQAKNLSGAH

SEQ ID NO: 1536913 - protein, 9 aa, Mycobacterium tuberculosis
QRTRPDVSA

SEQ ID NO: 1536914 - protein, 4 aa, Mycobacterium tuberculosis
QSDE

SEQ ID NO: 1536915 - protein, 9 aa, Mycobacterium tuberculosis
QSGNAGPAV

SEQ ID NO: 1536916 - protein, 10 aa, Mycobacterium tuberculosis
QSTPTGIDGY

SEQ ID NO: 1536917 - protein, 17 aa, Mycobacterium tuberculosis
QTDAEKRAAVETTPARK

SEQ ID NO: 1536918 - protein, 8 aa, Mycobacterium tuberculosis
QVPATATA

SEQ ID NO: 1536919 - protein, 30 aa, Mycobacterium tuberculosis; identical to SEQ ID NO: 230997

SEQ ID NO: 1536920 - protein, 8 aa, Mycobacterium tuberculosis
RASGEDAG

SEQ ID NO: 1536921 - protein, 7 aa, Mycobacterium tuberculosis
RDHGPTV

SEQ ID NO: 1536922 - protein, 4 aa, Mycobacterium tuberculosis
RDSR

SEQ ID NO: 1536923 - protein, 8 aa, Mycobacterium tuberculosis
REATAIDP

SEQ ID NO: 1536924 - protein, 8 aa, Mycobacterium tuberculosis
REVDEDEH

SEQ ID NO: 1536925 - protein, 4 aa, Mycobacterium tuberculosis
RGAD

SEQ ID NO: 1536926 - protein, 5 aa, Mycobacterium tuberculosis
RGVAP

SEQ ID NO: 1536927 - protein, 4 aa, Mycobacterium tuberculosis
RLDT

SEQ ID NO: 1536928 - protein, 21 aa, Mycobacterium tuberculosis
RLSPATDDALTDADGAAEARQ

SEQ ID NO: 1536929 - protein, 6 aa, Mycobacterium tuberculosis
RPAEDT

SEQ ID NO: 1536930 - protein, 6 aa, Mycobacterium tuberculosis
RPDGTR

SEQ ID NO: 1536931 - protein, 14 aa, Mycobacterium tuberculosis
RPKTPATPGGRRDP

SEQ ID NO: 1536932 - protein, 18 aa, Mycobacterium tuberculosis
RPPASSHEPSPTPNTQLA

SEQ ID NO: 1536933 - protein, 8 aa, Mycobacterium tuberculosis
RPPGQTQA

SEQ ID NO: 1536934 - protein, 14 aa, Mycobacterium tuberculosis
RPVSTTGEAGNQNT

SEQ ID NO: 1536935 - protein, 11 aa, Mycobacterium tuberculosis
RQQTNKSIGTY

SEQ ID NO: 1536936 - protein, 7 aa, Mycobacterium tuberculosis
RRNAELD

SEQ ID NO: 1536937 - protein, 7 aa, Mycobacterium tuberculosis
RTPDGQT

SEQ ID NO: 1536938 - protein, 9 aa, Mycobacterium tuberculosis
RTSAGEASR

SEQ ID NO: 1536939 - protein, 9 aa, Mycobacterium tuberculosis
SAAKTGADR

SEQ ID NO: 1536940 - protein, 9 aa, Mycobacterium tuberculosis
SAGHHDPAS

SEQ ID NO: 1536941 - protein, 12 aa, Mycobacterium tuberculosis
SAPNTGFRTETH

SEQ ID NO: 1536942 - protein, 4 aa, Mycobacterium tuberculosis
SARH

SEQ ID NO: 1536943 - protein, 23 aa, Mycobacterium tuberculosis
SATSETSSSSPSPTDPAAPPPAV

SEQ ID NO: 1536944 - protein, 9 aa, Mycobacterium tuberculosis
SAYPSTEQT

SEQ ID NO: 1536945 - protein, 7 aa, Mycobacterium tuberculosis
SDGRTAP

SEQ ID NO: 1536946 - protein, 8 aa, Mycobacterium tuberculosis
SDLPSSTQ

SEQ ID NO: 1536947 - protein, 8 aa, Mycobacterium tuberculosis
SDNKPSDV

SEQ ID NO: 1536948 - protein, 5 aa, Mycobacterium tuberculosis
SDTAS

SEQ ID NO: 1536949 - protein, 9 aa, Mycobacterium tuberculosis
SETYPPGST

SEQ ID NO: 1536950 - protein, 9 aa, Mycobacterium tuberculosis
SEVVANGSA

SEQ ID NO: 1536951 - protein, 14 aa, Mycobacterium tuberculosis
SGAAKGAGAYAGPR

SEQ ID NO: 1536952 - protein, 8 aa, Mycobacterium tuberculosis
SGAPRGSA

SEQ ID NO: 1536953 - protein, 6 aa, Mycobacterium tuberculosis
SGGLPL

SEQ ID NO: 1536954 - protein, 15 aa, Mycobacterium tuberculosis
SGNLPALPDMPGLPG

SEQ ID NO: 1536955 - protein, 16 aa, Mycobacterium tuberculosis
SHAGNRSPAQAPTQRT

SEQ ID NO: 1536956 - protein, 7 aa, Mycobacterium tuberculosis
SNDAADR

SEQ ID NO: 1536957 - protein, 5 aa, Mycobacterium tuberculosis
SPFQH

SEQ ID NO: 1536958 - protein, 11 aa, Mycobacterium tuberculosis
SPLDQARHDGA

SEQ ID NO: 1536959 - protein, 9 aa, Mycobacterium tuberculosis
SPPYTGGPV

SEQ ID NO: 1536960 - protein, 10 aa, Mycobacterium tuberculosis
SRFPSSGPYK

SEQ ID NO: 1536961 - protein, 6 aa, Mycobacterium tuberculosis
SRGRPY

SEQ ID NO: 1536962 - protein, 8 aa, Mycobacterium tuberculosis
SSDDGAAE

SEQ ID NO: 1536963 - protein, 9 aa, Mycobacterium tuberculosis
STAAPMSTT

SEQ ID NO: 1536964 - protein, 9 aa, Mycobacterium tuberculosis
STAPPSDGR

SEQ ID NO: 1536965 - protein, 10 aa, Mycobacterium tuberculosis
STASSSIPMP

SEQ ID NO: 1536966 - protein, 9 aa, Mycobacterium tuberculosis
STGKASHAS

SEQ ID NO: 1536967 - protein, 16 aa, Mycobacterium tuberculosis
STSTLNPYTNPDGALA

SEQ ID NO: 1536968 - protein, 7 aa, Mycobacterium tuberculosis
STTASSV

SEQ ID NO: 1536969 - protein, 14 aa, Mycobacterium tuberculosis
SVAPGSFDGPDDWS

SEQ ID NO: 1536970 - protein, 6 aa, Mycobacterium tuberculosis
SVQTKG

SEQ ID NO: 1536971 - protein, 18 aa, Mycobacterium tuberculosis
SYTTGTDEGGLGSKSWTA

SEQ ID NO: 1536972 - protein, 6 aa, Mycobacterium tuberculosis
TAAATT

SEQ ID NO: 1536973 - protein, 5 aa, Mycobacterium tuberculosis
TADGP

SEQ ID NO: 1536974 - protein, 12 aa, Mycobacterium tuberculosis
TAGSNDYSPLES

SEQ ID NO: 1536975 - protein, 5 aa, Mycobacterium tuberculosis
TASLA

SEQ ID NO: 1536976 - protein, 4 aa, Mycobacterium tuberculosis
TDAM

SEQ ID NO: 1536977 - protein, 34 aa, Mycobacterium tuberculosis; identical to SEQ ID NO: 231492

SEQ ID NO: 1536978 - protein, 6 aa, Mycobacterium tuberculosis
TGNGYY

SEQ ID NO: 1536979 - protein, 14 aa, Mycobacterium tuberculosis
TLGADSADAQSGSI

SEQ ID NO: 1536980 - protein, 7 aa, Mycobacterium tuberculosis
TLPPDAI

SEQ ID NO: 1536981 - protein, 18 aa, Mycobacterium tuberculosis
TLTPRAPGGYDPDGAGMQ

SEQ ID NO: 1536982 - protein, 5 aa, Mycobacterium tuberculosis
TPARQ

SEQ ID NO: 1536983 - protein, 15 aa, Mycobacterium tuberculosis
TPEERTALADPGPVP

SEQ ID NO: 1536984 - protein, 8 aa, Mycobacterium tuberculosis
TPESFTDR

SEQ ID NO: 1536985 - protein, 6 aa, Mycobacterium tuberculosis
TPLPAP

SEQ ID NO: 1536986 - protein, 13 aa, Mycobacterium tuberculosis
TPPRAPAASPNVG

SEQ ID NO: 1536987 - protein, 8 aa, Mycobacterium tuberculosis
TSAGATVA

SEQ ID NO: 1536988 - protein, 8 aa, Mycobacterium tuberculosis
TSAGDSAR

SEQ ID NO: 1536989 - protein, 7 aa, Mycobacterium tuberculosis
TTEIRST

SEQ ID NO: 1536990 - protein, 6 aa, Mycobacterium tuberculosis
TTSGYR

SEQ ID NO: 1536991 - protein, 4 aa, Mycobacterium tuberculosis
TVTP

SEQ ID NO: 1536992 - protein, 5 aa, Mycobacterium tuberculosis
TYTTQ

SEQ ID NO: 1536993 - protein, 8 aa, Mycobacterium tuberculosis
VADQSGKL

SEQ ID NO: 1536994 - protein, 15 aa, Mycobacterium tuberculosis
VAPDGSRTEEPRPDD

SEQ ID NO: 1536995 - protein, 13 aa, Mycobacterium tuberculosis
VDGSGGASGTAPL

SEQ ID NO: 1536996 - protein, 11 aa, Mycobacterium tuberculosis
VDPATLAESQT

SEQ ID NO: 1536997 - protein, 9 aa, Mycobacterium tuberculosis
VDPPPGFGY

SEQ ID NO: 1536998 - protein, 9 aa, Mycobacterium tuberculosis
VIGPDDDPE

SEQ ID NO: 1536999 - protein, 7 aa, Mycobacterium tuberculosis
VNKTTAN

SEQ ID NO: 1537000 - protein, 5 aa, Mycobacterium tuberculosis
VPESV

SEQ ID NO: 1537001 - protein, 5 aa, Mycobacterium tuberculosis
VPGPS

SEQ ID NO: 1537002 - protein, 6 aa, Mycobacterium tuberculosis
VPPHAR

SEQ ID NO: 1537003 - protein, 8 aa, Mycobacterium tuberculosis
VQAGGLQQ

SEQ ID NO: 1537004 - protein, 7 aa, Mycobacterium tuberculosis
VSGSGSY

SEQ ID NO: 1537005 - protein, 12 aa, Mycobacterium tuberculosis
VTSSGRTEYSHS

SEQ ID NO: 1537006 - protein, 7 aa, Mycobacterium tuberculosis
WKTQRTV

SEQ ID NO: 1537007 - protein, 8 aa, Mycobacterium tuberculosis
WPTADVPG

SEQ ID NO: 1537008 - protein, 18 aa, Mycobacterium tuberculosis
YANPGTARDYNPDSNESL

SEQ ID NO: 1537009 - protein, 16 aa, Mycobacterium tuberculosis
YETEPRDPAGTDGSVE

SEQ ID NO: 1537010 - protein, 8 aa, Mycobacterium tuberculosis
YKPRPCDA

SEQ ID NO: 1537011 - protein, 5 aa, Mycobacterium tuberculosis
YPANG

SEQ ID NO: 1537012 - protein, 7 aa, Mycobacterium tuberculosis
YSDGTAA

SEQ ID NO: 1537013 - protein, 9 aa, Mycobacterium tuberculosis
YSGNGSWGR

SEQ ID NO: 1537014 - protein, 4 aa, Mycobacterium tuberculosis
YSQG

SEQ ID NO: 1537015 - protein, 14 aa, Mycobacterium tuberculosis
YVTRQRRRFNGGLV

SEQ ID NO: 1537016 - protein, 7 aa, Mycobacterium tuberculosis
AAARSGD

SEQ ID NO: 1537017 - protein, 11 aa, Mycobacterium tuberculosis
AAEPTAKAAPY

SEQ ID NO: 1537018 - protein, 7 aa, Mycobacterium tuberculosis
AAESNPI

SEQ ID NO: 1537019 - protein, 7 aa, Mycobacterium tuberculosis
AANAPQI

SEQ ID NO: 1537020 - protein, 7 aa, Mycobacterium tuberculosis
AAPSAQA

SEQ ID NO: 1537021 - protein, 7 aa, Mycobacterium tuberculosis
AATRPNL

SEQ ID NO: 1537022 - protein, 4 aa, Mycobacterium tuberculosis
AAVD

SEQ ID NO: 1537023 - protein, 13 aa, Mycobacterium tuberculosis
AAVPPTDPITVPV

SEQ ID NO: 1537024 - protein, 13 aa, Mycobacterium tuberculosis
ADAENDDEHGSAL

SEQ ID NO: 1537025 - protein, 10 aa, Mycobacterium tuberculosis
ADTTRDTDGQ

SEQ ID NO: 1537026 - protein, 13 aa, Mycobacterium tuberculosis
AEEEPSGRAPVGA

SEQ ID NO: 1537027 - protein, 5 aa, Mycobacterium tuberculosis
AETDP

SEQ ID NO: 1537028 - protein, 16 aa, Mycobacterium tuberculosis
AGAAGPEGADAASAIA

SEQ ID NO: 1537029 - protein, 5 aa, Mycobacterium tuberculosis
AGGHP

SEQ ID NO: 1537030 - protein, 24 aa, Mycobacterium tuberculosis
AGGLGGGCSTRSGPTPTPEPASRG

SEQ ID NO: 1537031 - protein, 11 aa, Mycobacterium tuberculosis
AGGLPSAAIGG

SEQ ID NO: 1537032 - protein, 15 aa, Mycobacterium tuberculosis
AGGPDGGWNKPPTPL

SEQ ID NO: 1537033 - protein, 13 aa, Mycobacterium tuberculosis
AGNRPKGEVSEGW

SEQ ID NO: 1537034 - protein, 14 aa, Mycobacterium tuberculosis
AGPAGGAWVHYLLP

SEQ ID NO: 1537035 - protein, 8 aa, Mycobacterium tuberculosis
AGRSAHGW

SEQ ID NO: 1537036 - protein, 9 aa, Mycobacterium tuberculosis
AGTPPGERP

SEQ ID NO: 1537037 - protein, 6 aa, Mycobacterium tuberculosis
AHPDNR

SEQ ID NO: 1537038 - protein, 14 aa, Mycobacterium tuberculosis
ANDRAYQGGVGPTL

SEQ ID NO: 1537039 - protein, 7 aa, Mycobacterium tuberculosis
ANPKVAS

SEQ ID NO: 1537040 - protein, 5 aa, Mycobacterium tuberculosis
ANPLA

SEQ ID NO: 1537041 - protein, 14 aa, Mycobacterium tuberculosis
APADDSPGCSPSDY

SEQ ID NO: 1537042 - protein, 35 aa, Mycobacterium tuberculosis; identical to SEQ ID NO: 229079

SEQ ID NO: 1537043 - protein, 12 aa, Mycobacterium tuberculosis
APGKADPTGDDA

SEQ ID NO: 1537044 - protein, 9 aa, Mycobacterium tuberculosis
APNAPTRQV

SEQ ID NO: 1537045 - protein, 66 aa, Mycobacterium tuberculosis; identical to SEQ ID NO: 229109

SEQ ID NO: 1537046 - protein, 13 aa, Mycobacterium tuberculosis
APTAYDGDSPDEV

SEQ ID NO: 1537047 - protein, 5 aa, Mycobacterium tuberculosis
AQAPK

SEQ ID NO: 1537048 - protein, 4 aa, Mycobacterium tuberculosis
AQPI

SEQ ID NO: 1537049 - protein, 11 aa, Mycobacterium tuberculosis
ARGDVRSATDV

SEQ ID NO: 1537050 - protein, 8 aa, Mycobacterium tuberculosis
ARNSAMKG

SEQ ID NO: 1537051 - protein, 14 aa, Mycobacterium tuberculosis
ASAARNSAGFGAPR

SEQ ID NO: 1537052 - protein, 5 aa, Mycobacterium tuberculosis
ASLAP

SEQ ID NO: 1537053 - protein, 8 aa, Mycobacterium tuberculosis
ASNNPELT

SEQ ID NO: 1537054 - protein, 7 aa, Mycobacterium tuberculosis
ASTQSFK

SEQ ID NO: 1537055 - protein, 8 aa, Mycobacterium tuberculosis
ASVSTSAD

SEQ ID NO: 1537056 - protein, 8 aa, Mycobacterium tuberculosis
ATDGDGEA

SEQ ID NO: 1537057 - protein, 6 aa, Mycobacterium tuberculosis
ATDSRA

SEQ ID NO: 1537058 - protein, 10 aa, Mycobacterium tuberculosis
ATGAGNTGED

SEQ ID NO: 1537059 - protein, 6 aa, Mycobacterium tuberculosis
ATRGAG

SEQ ID NO: 1537060 - protein, 6 aa, Mycobacterium tuberculosis
ATSAEQ

SEQ ID NO: 1537061 - protein, 13 aa, Mycobacterium tuberculosis
AWPPSARAQPHTH

SEQ ID NO: 1537062 - protein, 8 aa, Mycobacterium tuberculosis
CGDPHPAA

SEQ ID NO: 1537063 - protein, 6 aa, Mycobacterium tuberculosis
DAQPHE

SEQ ID NO: 1537064 - protein, 6 aa, Mycobacterium tuberculosis
DAVRDG

SEQ ID NO: 1537065 - protein, 14 aa, Mycobacterium tuberculosis
DEQAMGGTLGANTD

SEQ ID NO: 1537066 - protein, 6 aa, Mycobacterium tuberculosis
DGASGG

SEQ ID NO: 1537067 - protein, 12 aa, Mycobacterium tuberculosis
DGITPPSAARAI

SEQ ID NO: 1537068 - protein, 4 aa, Mycobacterium tuberculosis
DGTT

SEQ ID NO: 1537069 - protein, 4 aa, Mycobacterium tuberculosis
DIND

SEQ ID NO: 1537070 - protein, 7 aa, Mycobacterium tuberculosis
DKAAARA

SEQ ID NO: 1537071 - protein, 9 aa, Mycobacterium tuberculosis
DNNGNGARV

SEQ ID NO: 1537072 - protein, 9 aa, Mycobacterium tuberculosis
DNNRQAPQD

SEQ ID NO: 1537073 - protein, 10 aa, Mycobacterium tuberculosis
DPGAKSARPA

SEQ ID NO: 1537074 - protein, 7 aa, Mycobacterium tuberculosis
DPSAPMP

SEQ ID NO: 1537075 - protein, 9 aa, Mycobacterium tuberculosis
DPSGRSAPL

SEQ ID NO: 1537076 - protein, 21 aa, Mycobacterium tuberculosis
DQSLPLDARGQPVVPEGSAGI

SEQ ID NO: 1537077 - protein, 4 aa, Mycobacterium tuberculosis
DRTQ

SEQ ID NO: 1537078 - protein, 9 aa, Mycobacterium tuberculosis
DSPPRPTPL

SEQ ID NO: 1537079 - protein, 11 aa, Mycobacterium tuberculosis
DTVTGTASDAQ

SEQ ID NO: 1537080 - protein, 21 aa, Mycobacterium tuberculosis
EAGDEQFGRATAQQLADTATA

SEQ ID NO: 1537081 - protein, 7 aa, Mycobacterium tuberculosis
EAGGDWN

SEQ ID NO: 1537082 - protein, 4 aa, Mycobacterium tuberculosis
EDGR

SEQ ID NO: 1537083 - protein, 8 aa, Mycobacterium tuberculosis
EEIRASGA

SEQ ID NO: 1537084 - protein, 30 aa, Mycobacterium tuberculosis; identical to SEQ ID NO: 229607

SEQ ID NO: 1537085 - protein, 11 aa, Mycobacterium tuberculosis
EPDVDCPSTNL

SEQ ID NO: 1537086 - protein, 8 aa, Mycobacterium tuberculosis
EQDGSKQW

SEQ ID NO: 1537087 - protein, 15 aa, Mycobacterium tuberculosis
ERLRPPPGYKDTTVP

SEQ ID NO: 1537088 - protein, 8 aa, Mycobacterium tuberculosis
ESARSRLT

SEQ ID NO: 1537089 - protein, 8 aa, Mycobacterium tuberculosis
ETQAPSIA

SEQ ID NO: 1537090 - protein, 13 aa, Mycobacterium tuberculosis
FPDSGRVDSTTKL

SEQ ID NO: 1537091 - protein, 8 aa, Mycobacterium tuberculosis
FPRPDDPL

SEQ ID NO: 1537092 - protein, 4 aa, Mycobacterium tuberculosis
GADG

SEQ ID NO: 1537093 - protein, 15 aa, Mycobacterium tuberculosis
GADRLSATGGALAAP

SEQ ID NO: 1537094 - protein, 10 aa, Mycobacterium tuberculosis
GAGGTAVASE

SEQ ID NO: 1537095 - protein, 6 aa, Mycobacterium tuberculosis
GAGSGI

SEQ ID NO: 1537096 - protein, 14 aa, Mycobacterium tuberculosis
GAQAAGRDPTTLGK

SEQ ID NO: 1537097 - protein, 7 aa, Mycobacterium tuberculosis
GAQQKQI

SEQ ID NO: 1537098 - protein, 16 aa, Mycobacterium tuberculosis
GCQGDPSAAELPDVGD

SEQ ID NO: 1537099 - protein, 20 aa, Mycobacterium tuberculosis
GDAATRKDGPVPHYPAPDGV

SEQ ID NO: 1537100 - protein, 14 aa, Mycobacterium tuberculosis
GDISNTPQTVATGS

SEQ ID NO: 1537101 - protein, 15 aa, Mycobacterium tuberculosis
GGSADGSADSTGRVP

SEQ ID NO: 1537102 - protein, 7 aa, Mycobacterium tuberculosis
GGSVTTA

SEQ ID NO: 1537103 - protein, 16 aa, Mycobacterium tuberculosis
GGTGPSARELAQTRTV

SEQ ID NO: 1537104 - protein, 6 aa, Mycobacterium tuberculosis
GIGGAA

SEQ ID NO: 1537105 - protein, 11 aa, Mycobacterium tuberculosis
GKDAPTTAASS

SEQ ID NO: 1537106 - protein, 10 aa, Mycobacterium tuberculosis
GKPEPPPVDS

SEQ ID NO: 1537107 - protein, 7 aa, Mycobacterium tuberculosis
GKPQLGD

SEQ ID NO: 1537108 - protein, 14 aa, Mycobacterium tuberculosis
GKQSPANPAPSRPL

SEQ ID NO: 1537109 - protein, 9 aa, Mycobacterium tuberculosis
GLAPGGHAA

SEQ ID NO: 1537110 - protein, 12 aa, Mycobacterium tuberculosis
GLTGSEPASLSK

SEQ ID NO: 1537111 - protein, 14 aa, Mycobacterium tuberculosis
GNSGGQGGTPRAVP

SEQ ID NO: 1537112 - protein, 7 aa, Mycobacterium tuberculosis
GNSPHVS

SEQ ID NO: 1537113 - protein, 5 aa, Mycobacterium tuberculosis
GNSTS

SEQ ID NO: 1537114 - protein, 6 aa, Mycobacterium tuberculosis
GPKNQT

SEQ ID NO: 1537115 - protein, 7 aa, Mycobacterium tuberculosis
GPPEAPD

SEQ ID NO: 1537116 - protein, 8 aa, Mycobacterium tuberculosis
GQSGPTTV

SEQ ID NO: 1537117 - protein, 9 aa, Mycobacterium tuberculosis
GQTSPANVV

SEQ ID NO: 1537118 - protein, 9 aa, Mycobacterium tuberculosis
GRQSEEGSG

SEQ ID NO: 1537119 - protein, 9 aa, Mycobacterium tuberculosis
GRVPNPALP

SEQ ID NO: 1537120 - protein, 9 aa, Mycobacterium tuberculosis
GSAGGLTKP

SEQ ID NO: 1537121 - protein, 7 aa, Mycobacterium tuberculosis
GSGAGGA

SEQ ID NO: 1537122 - protein, 15 aa, Mycobacterium tuberculosis
GSGAGVQVIEHAAGT

SEQ ID NO: 1537123 - protein, 6 aa, Mycobacterium tuberculosis
GSGQTY

SEQ ID NO: 1537124 - protein, 9 aa, Mycobacterium tuberculosis
GSRLGYQES

SEQ ID NO: 1537125 - protein, 6 aa, Mycobacterium tuberculosis
GTDPGV

SEQ ID NO: 1537126 - protein, 4 aa, Mycobacterium tuberculosis
GTGA

SEQ ID NO: 1537127 - protein, 10 aa, Mycobacterium tuberculosis
GVHPNDAGHE

SEQ ID NO: 1537128 - protein, 11 aa, Mycobacterium tuberculosis
HDDAGNPVDSW

SEQ ID NO: 1537129 - protein, 14 aa, Mycobacterium tuberculosis
HGAPVRRSAGAEAA

SEQ ID NO: 1537130 - protein, 19 aa, Mycobacterium tuberculosis
HGPPVGAPPFPPTAPPPPF

SEQ ID NO: 1537131 - protein, 11 aa, Mycobacterium tuberculosis
HGTGTPVGDPV

SEQ ID NO: 1537132 - protein, 13 aa, Mycobacterium tuberculosis
HSGNGNNLSGYAN

SEQ ID NO: 1537133 - protein, 11 aa, Mycobacterium tuberculosis
IQPGDSGGPVV

SEQ ID NO: 1537134 - protein, 11 aa, Mycobacterium tuberculosis
IRSGGGSPTVH

SEQ ID NO: 1537135 - protein, 10 aa, Mycobacterium tuberculosis
ISNTATTDCT

SEQ ID NO: 1537136 - protein, 8 aa, Mycobacterium tuberculosis
KARQAGHS

SEQ ID NO: 1537137 - protein, 7 aa, Mycobacterium tuberculosis
KATFAGD

SEQ ID NO: 1537138 - protein, 9 aa, Mycobacterium tuberculosis
KEDAAAQRG

SEQ ID NO: 1537139 - protein, 6 aa, Mycobacterium tuberculosis
KGPDLA

SEQ ID NO: 1537140 - protein, 11 aa, Mycobacterium tuberculosis
KVAQQKGAIPG

SEQ ID NO: 1537141 - protein, 6 aa, Mycobacterium tuberculosis
KYPTSV

SEQ ID NO: 1537142 - protein, 11 aa, Mycobacterium tuberculosis
LAPPASAGCPD

SEQ ID NO: 1537143 - protein, 8 aa, Mycobacterium tuberculosis
LDATKGLT

SEQ ID NO: 1537144 - protein, 9 aa, Mycobacterium tuberculosis
LDSDPGNPA

SEQ ID NO: 1537145 - protein, 12 aa, Mycobacterium tuberculosis
LESGSNSGYRPY

SEQ ID NO: 1537146 - protein, 6 aa, Mycobacterium tuberculosis
LGSGSI

SEQ ID NO: 1537147 - protein, 10 aa, Mycobacterium tuberculosis
LGTPPDGVTG

SEQ ID NO: 1537148 - protein, 9 aa, Mycobacterium tuberculosis
LNRATAKTT

SEQ ID NO: 1537149 - protein, 6 aa, Mycobacterium tuberculosis
LPAAGD

SEQ ID NO: 1537150 - protein, 11 aa, Mycobacterium tuberculosis
LPPQAGRPRGW

SEQ ID NO: 1537151 - protein, 5 aa, Mycobacterium tuberculosis
NATQV

SEQ ID NO: 1537152 - protein, 7 aa, Mycobacterium tuberculosis
NAVGAGT

SEQ ID NO: 1537153 - protein, 4 aa, Mycobacterium tuberculosis
NDTL

SEQ ID NO: 1537154 - protein, 46 aa, Mycobacterium tuberculosis; identical to SEQ ID NO: 228690

SEQ ID NO: 1537155 - protein, 17 aa, Mycobacterium tuberculosis
NMPTGNQDVQASNPVFG

SEQ ID NO: 1537156 - protein, 15 aa, Mycobacterium tuberculosis
NPAVDPASGAATVAS

SEQ ID NO: 1537157 - protein, 4 aa, Mycobacterium tuberculosis
PAAG

SEQ ID NO: 1537158 - protein, 7 aa, Mycobacterium tuberculosis
PAATPGA

SEQ ID NO: 1537159 - protein, 12 aa, Mycobacterium tuberculosis
PANATAKIGQTS

SEQ ID NO: 1537160 - protein, 11 aa, Mycobacterium tuberculosis
PARPNRPEADR

SEQ ID NO: 1537161 - protein, 10 aa, Mycobacterium tuberculosis
PASGDNGWGS

SEQ ID NO: 1537162 - protein, 9 aa, Mycobacterium tuberculosis
PDEPRAGAG

SEQ ID NO: 1537163 - protein, 4 aa, Mycobacterium tuberculosis
PDTV

SEQ ID NO: 1537164 - protein, 7 aa, Mycobacterium tuberculosis
PELGGPL

SEQ ID NO: 1537165 - protein, 7 aa, Mycobacterium tuberculosis
PHTRTQD

SEQ ID NO: 1537166 - protein, 25 aa, Mycobacterium tuberculosis
PIPGITPAAPALPVTAPAAAPTIPG

SEQ ID NO: 1537167 - protein, 8 aa, Mycobacterium tuberculosis
PIPRNAPG

SEQ ID NO: 1537168 - protein, 4 aa, Mycobacterium tuberculosis
PNKG

SEQ ID NO: 1537169 - protein, 10 aa, Mycobacterium tuberculosis
PNPARRATNG

SEQ ID NO: 1537170 - protein, 23 aa, Mycobacterium tuberculosis
PPASRGRPGPLSGPELADPARSV

SEQ ID NO: 1537171 - protein, 9 aa, Mycobacterium tuberculosis
PRKSVSGSL

SEQ ID NO: 1537172 - protein, 11 aa, Mycobacterium tuberculosis
PSAPGNPGRWG

SEQ ID NO: 1537173 - protein, 4 aa, Mycobacterium tuberculosis
PSGG

SEQ ID NO: 1537174 - protein, 9 aa, Mycobacterium tuberculosis
PTSLGAAPV

SEQ ID NO: 1537175 - protein, 8 aa, Mycobacterium tuberculosis
PTVQQPNS

SEQ ID NO: 1537176 - protein, 17 aa, Mycobacterium tuberculosis
PVSEPAASGPELTPEAG

SEQ ID NO: 1537177 - protein, 6 aa, Mycobacterium tuberculosis
QAAEQA

SEQ ID NO: 1537178 - protein, 7 aa, Mycobacterium tuberculosis
QARPEAR

SEQ ID NO: 1537179 - protein, 6 aa, Mycobacterium tuberculosis
QARQRA

SEQ ID NO: 1537180 - protein, 7 aa, Mycobacterium tuberculosis
QDGGNAV

SEQ ID NO: 1537181 - protein, 18 aa, Mycobacterium tuberculosis
QDPSGGSRTVQVTLGKAE

SEQ ID NO: 1537182 - protein, 11 aa, Mycobacterium tuberculosis
QEHDAARPDAE

SEQ ID NO: 1537183 - protein, 9 aa, Mycobacterium tuberculosis
QHAPDTGNL

SEQ ID NO: 1537184 - protein, 6 aa, Mycobacterium tuberculosis
QNAPEA

SEQ ID NO: 1537185 - protein, 18 aa, Mycobacterium tuberculosis
QNGGAAAPAASPPVPPIP

SEQ ID NO: 1537186 - protein, 13 aa, Mycobacterium tuberculosis
QQAGLPDRGPQSW

SEQ ID NO: 1537187 - protein, 9 aa, Mycobacterium tuberculosis
QTKTGSSAN

SEQ ID NO: 1537188 - protein, 15 aa, Mycobacterium tuberculosis
RDSDGPDHSRDYPGP

SEQ ID NO: 1537189 - protein, 7 aa, Mycobacterium tuberculosis
RDYPTDK

SEQ ID NO: 1537190 - protein, 8 aa, Mycobacterium tuberculosis
RGPDESGT

SEQ ID NO: 1537191 - protein, 6 aa, Mycobacterium tuberculosis
RNPTRW

SEQ ID NO: 1537192 - protein, 7 aa, Mycobacterium tuberculosis
RPGTYNE

SEQ ID NO: 1537193 - protein, 8 aa, Mycobacterium tuberculosis
RPPTDDEP

SEQ ID NO: 1537194 - protein, 7 aa, Mycobacterium tuberculosis
RPTAADE

SEQ ID NO: 1537195 - protein, 12 aa, Mycobacterium tuberculosis
RSFGSDPATVTA

SEQ ID NO: 1537196 - protein, 10 aa, Mycobacterium tuberculosis
RSNQTPSDAG

SEQ ID NO: 1537197 - protein, 13 aa, Mycobacterium tuberculosis
RSPYTSARLGQPV

SEQ ID NO: 1537198 - protein, 4 aa, Mycobacterium tuberculosis
RTAG

SEQ ID NO: 1537199 - protein, 27 aa, Mycobacterium tuberculosis
RTNNPWDAARTSGGSAGGGAAATAAGL

SEQ ID NO: 1537200 - protein, 8 aa, Mycobacterium tuberculosis
SADPAERA

SEQ ID NO: 1537201 - protein, 10 aa, Mycobacterium tuberculosis
SAPAASLGIS

SEQ ID NO: 1537202 - protein, 6 aa, Mycobacterium tuberculosis
SASGPL

SEQ ID NO: 1537203 - protein, 23 aa, Mycobacterium tuberculosis
SASSTISQRPAPREHRDGDTPEA

SEQ ID NO: 1537204 - protein, 9 aa, Mycobacterium tuberculosis
SAVDDASER

SEQ ID NO: 1537205 - protein, 6 aa, Mycobacterium tuberculosis
SCAAGT

SEQ ID NO: 1537206 - protein, 4 aa, Mycobacterium tuberculosis
SDSV

SEQ ID NO: 1537207 - protein, 12 aa, Mycobacterium tuberculosis
SGPQSATLAGRY

SEQ ID NO: 1537208 - protein, 6 aa, Mycobacterium tuberculosis
SGQLNP

SEQ ID NO: 1537209 - protein, 10 aa, Mycobacterium tuberculosis
SGRDAVAQGG

SEQ ID NO: 1537210 - protein, 5 aa, Mycobacterium tuberculosis
SGTGI

SEQ ID NO: 1537211 - protein, 18 aa, Mycobacterium tuberculosis
SKDAVGSGTAAGSAGAAG

SEQ ID NO: 1537212 - protein, 10 aa, Mycobacterium tuberculosis
SLGSSSDLRV

SEQ ID NO: 1537213 - protein, 13 aa, Mycobacterium tuberculosis
SNPFSSAATLPKE

SEQ ID NO: 1537214 - protein, 6 aa, Mycobacterium tuberculosis
SPGGKT

SEQ ID NO: 1537215 - protein, 13 aa, Mycobacterium tuberculosis
SPITNDNDQARYD

SEQ ID NO: 1537216 - protein, 6 aa, Mycobacterium tuberculosis
SPNPGY

SEQ ID NO: 1537217 - protein, 9 aa, Mycobacterium tuberculosis
SPPAAAGDL

SEQ ID NO: 1537218 - protein, 6 aa, Mycobacterium tuberculosis
SPSMGR

SEQ ID NO: 1537219 - protein, 12 aa, Mycobacterium tuberculosis
SRLTSEDVKTVP

SEQ ID NO: 1537220 - protein, 22 aa, Mycobacterium tuberculosis
SSPKPDAEEQGVPVSPTASDPA

SEQ ID NO: 1537221 - protein, 10 aa, Mycobacterium tuberculosis
SSSPPQPPKD

SEQ ID NO: 1537222 - protein, 5 aa, Mycobacterium tuberculosis
STGNM

SEQ ID NO: 1537223 - protein, 15 aa, Mycobacterium tuberculosis
SVPEGPGINDNGSGV

SEQ ID NO: 1537224 - protein, 7 aa, Mycobacterium tuberculosis
TAASDNF

SEQ ID NO: 1537225 - protein, 8 aa, Mycobacterium tuberculosis
TADPQTDT

SEQ ID NO: 1537226 - protein, 7 aa, Mycobacterium tuberculosis
TAHPHPT

SEQ ID NO: 1537227 - protein, 13 aa, Mycobacterium tuberculosis
TAPAQAAPPALSQ

SEQ ID NO: 1537228 - protein, 5 aa, Mycobacterium tuberculosis
TASNT

SEQ ID NO: 1537229 - protein, 7 aa, Mycobacterium tuberculosis
TDSTGWT

SEQ ID NO: 1537230 - protein, 10 aa, Mycobacterium tuberculosis
TEDGSPRGAR

SEQ ID NO: 1537231 - protein, 5 aa, Mycobacterium tuberculosis
TESLG

SEQ ID NO: 1537232 - protein, 12 aa, Mycobacterium tuberculosis
TGKLPDTDTYCP

SEQ ID NO: 1537233 - protein, 9 aa, Mycobacterium tuberculosis
TGPASGKSL

SEQ ID NO: 1537234 - protein, 6 aa, Mycobacterium tuberculosis
TGPSPT

SEQ ID NO: 1537235 - protein, 10 aa, Mycobacterium tuberculosis
TGVKNPDYSD

SEQ ID NO: 1537236 - protein, 4 aa, Mycobacterium tuberculosis
TNSR

SEQ ID NO: 1537237 - protein, 6 aa, Mycobacterium tuberculosis
TPAMPP

SEQ ID NO: 1537238 - protein, 10 aa, Mycobacterium tuberculosis
TPFSHGNHEP

SEQ ID NO: 1537239 - protein, 5 aa, Mycobacterium tuberculosis
TQGNT

SEQ ID NO: 1537240 - protein, 4 aa, Mycobacterium tuberculosis
TRGG

SEQ ID NO: 1537241 - protein, 6 aa, Mycobacterium tuberculosis
TSGGGW

SEQ ID NO: 1537242 - protein, 5 aa, Mycobacterium tuberculosis
TTCGR

SEQ ID NO: 1537243 - protein, 5 aa, Mycobacterium tuberculosis
TTGKV

SEQ ID NO: 1537244 - protein, 14 aa, Mycobacterium tuberculosis
TVQASDSLTGAEET

SEQ ID NO: 1537245 - protein, 9 aa, Mycobacterium tuberculosis
TYADPGHAI

SEQ ID NO: 1537246 - protein, 6 aa, Mycobacterium tuberculosis
TYSPPY

SEQ ID NO: 1537247 - protein, 6 aa, Mycobacterium tuberculosis
VAADTR

SEQ ID NO: 1537248 - protein, 11 aa, Mycobacterium tuberculosis
VASTGSLAGIT

SEQ ID NO: 1537249 - protein, 7 aa, Mycobacterium tuberculosis
VDQPNPV

SEQ ID NO: 1537250 - protein, 6 aa, Mycobacterium tuberculosis
VGGSTA

SEQ ID NO: 1537251 - protein, 4 aa, Mycobacterium tuberculosis
VPGA

SEQ ID NO: 1537252 - protein, 6 aa, Mycobacterium tuberculosis
VPPAPI

SEQ ID NO: 1537253 - protein, 6 aa, Mycobacterium tuberculosis
VSTANA

SEQ ID NO: 1537254 - protein, 8 aa, Mycobacterium tuberculosis
WGRDPDTM

SEQ ID NO: 1537255 - protein, 15 aa, Mycobacterium tuberculosis
YATDGDDDGVADPQN

SEQ ID NO: 1537256 - protein, 13 aa, Mycobacterium tuberculosis
YGTGHGAMSVTVS

SEQ ID NO: 1537257 - protein, 7 aa, Mycobacterium tuberculosis
YNDEQGV

SEQ ID NO: 1537258 - protein, 6 aa, Mycobacterium tuberculosis
YNPGLT

SEQ ID NO: 1537259 - protein, 4 aa, Mycobacterium tuberculosis
YQRA

SEQ ID NO: 1537260 - protein, 18 aa, Mycobacterium tuberculosis
YQRDPDAQSPAGGVSSSL

SEQ ID NO: 1537261 - protein, 17 aa, Mycobacterium tuberculosis
YTPNPNDAPGGPLVERA

SEQ ID NO: 1537262 - protein, 6 aa, Mycobacterium tuberculosis
AADNAD

SEQ ID NO: 1537263 - protein, 11 aa, Mycobacterium tuberculosis
AAERARNDRRA

SEQ ID NO: 1537264 - protein, 9 aa, Mycobacterium tuberculosis
AAGADPAAV

SEQ ID NO: 1537265 - protein, 9 aa, Mycobacterium tuberculosis
AAGRSDAAA

SEQ ID NO: 1537266 - protein, 23 aa, Mycobacterium tuberculosis
AANAAAAASTTALAAAGADEVSA

SEQ ID NO: 1537267 - protein, 26 aa, Mycobacterium tuberculosis
AAPPPPDPLAGPPGDAGLAPPAPAPA

SEQ ID NO: 1537268 - protein, 11 aa, Mycobacterium tuberculosis
AAQARQTATQI

SEQ ID NO: 1537269 - protein, 9 aa, Mycobacterium tuberculosis
ADGKKMENA

SEQ ID NO: 1537270 - protein, 5 aa, Mycobacterium tuberculosis
AEADR

SEQ ID NO: 1537271 - protein, 4 aa, Mycobacterium tuberculosis
AEAI

SEQ ID NO: 1537272 - protein, 9 aa, Mycobacterium tuberculosis
AERADMPRT

SEQ ID NO: 1537273 - protein, 11 aa, Mycobacterium tuberculosis
AETAADPVAKL

SEQ ID NO: 1537274 - protein, 7 aa, Mycobacterium tuberculosis
AETANAT

SEQ ID NO: 1537275 - protein, 4 aa, Mycobacterium tuberculosis
AGAE

SEQ ID NO: 1537276 - protein, 5 aa, Mycobacterium tuberculosis
AGGDE

SEQ ID NO: 1537277 - protein, 20 aa, Mycobacterium tuberculosis
AGPDTISGATIPQGEQSTGK

SEQ ID NO: 1537278 - protein, 7 aa, Mycobacterium tuberculosis
AGPIGVP

SEQ ID NO: 1537279 - protein, 10 aa, Mycobacterium tuberculosis
AGRQSSQSVP

SEQ ID NO: 1537280 - protein, 10 aa, Mycobacterium tuberculosis
AGRSGRRGQG

SEQ ID NO: 1537281 - protein, 6 aa, Mycobacterium tuberculosis
AGTSAG

SEQ ID NO: 1537282 - protein, 13 aa, Mycobacterium tuberculosis
AIPTTTSGKLKRR

SEQ ID NO: 1537283 - protein, 15 aa, Mycobacterium tuberculosis
AKNAGCPLGADPAKA

SEQ ID NO: 1537284 - protein, 4 aa, Mycobacterium tuberculosis
ALPG

SEQ ID NO: 1537285 - protein, 19 aa, Mycobacterium tuberculosis
ANAKTGTSMAANRPEYPHK

SEQ ID NO: 1537286 - protein, 17 aa, Mycobacterium tuberculosis
ANLPPCPAAGNGPGAAA

SEQ ID NO: 1537287 - protein, 5 aa, Mycobacterium tuberculosis
APGMT

SEQ ID NO: 1537288 - protein, 9 aa, Mycobacterium tuberculosis
APPAEIAPG

SEQ ID NO: 1537289 - protein, 7 aa, Mycobacterium tuberculosis
APPRAGA

SEQ ID NO: 1537290 - protein, 5 aa, Mycobacterium tuberculosis
APTPI

SEQ ID NO: 1537291 - protein, 8 aa, Mycobacterium tuberculosis
ARRPDGTT

SEQ ID NO: 1537292 - protein, 9 aa, Mycobacterium tuberculosis
ASNDEADEL

SEQ ID NO: 1537293 - protein, 4 aa, Mycobacterium tuberculosis
ASQA

SEQ ID NO: 1537294 - protein, 17 aa, Mycobacterium tuberculosis
ATAANSDLKRLPTEDEV

SEQ ID NO: 1537295 - protein, 10 aa, Mycobacterium tuberculosis
ATSAAARTLT

SEQ ID NO: 1537296 - protein, 17 aa, Mycobacterium tuberculosis
ATSPPNPDGPPPAPGLP

SEQ ID NO: 1537297 - protein, 7 aa, Mycobacterium tuberculosis
ATTRTGV

SEQ ID NO: 1537298 - protein, 14 aa, Mycobacterium tuberculosis
AVGGPDDPEFHPPR

SEQ ID NO: 1537299 - protein, 4 aa, Mycobacterium tuberculosis
CATY

SEQ ID NO: 1537300 - protein, 22 aa, Mycobacterium tuberculosis
CRNTTDHHHDDETTNITNQLVQ

SEQ ID NO: 1537301 - protein, 18 aa, Mycobacterium tuberculosis
CTTTTTGKAGLAPNAVPR

SEQ ID NO: 1537302 - protein, 6 aa, Mycobacterium tuberculosis
DAAART

SEQ ID NO: 1537303 - protein, 15 aa, Mycobacterium tuberculosis
DAKAEGRDTINGQNT

SEQ ID NO: 1537304 - protein, 6 aa, Mycobacterium tuberculosis
DAQPIT

SEQ ID NO: 1537305 - protein, 6 aa, Mycobacterium tuberculosis
DDAEQT

SEQ ID NO: 1537306 - protein, 7 aa, Mycobacterium tuberculosis
DGPPPGQ

SEQ ID NO: 1537307 - protein, 5 aa, Mycobacterium tuberculosis
DGSSH

SEQ ID NO: 1537308 - protein, 7 aa, Mycobacterium tuberculosis
DGTSEPF

SEQ ID NO: 1537309 - protein, 4 aa, Mycobacterium tuberculosis
DHGP

SEQ ID NO: 1537310 - protein, 13 aa, Mycobacterium tuberculosis
DKARSRATGGSGL

SEQ ID NO: 1537311 - protein, 7 aa, Mycobacterium tuberculosis
DKDNLGR

SEQ ID NO: 1537312 - protein, 21 aa, Mycobacterium tuberculosis
DPDNPRISRPARTKDPRGLSY

SEQ ID NO: 1537313 - protein, 8 aa, Mycobacterium tuberculosis
DPDQLGRR

SEQ ID NO: 1537314 - protein, 4 aa, Mycobacterium tuberculosis
DPRV

SEQ ID NO: 1537315 - protein, 17 aa, Mycobacterium tuberculosis
DRNDAPGGHNGCDTRDD

SEQ ID NO: 1537316 - protein, 7 aa, Mycobacterium tuberculosis
DRYATGT

SEQ ID NO: 1537317 - protein, 11 aa, Mycobacterium tuberculosis
DSGTPTGRDEQ

SEQ ID NO: 1537318 - protein, 8 aa, Mycobacterium tuberculosis
DSNPQAAR

SEQ ID NO: 1537319 - protein, 4 aa, Mycobacterium tuberculosis
DSSV

SEQ ID NO: 1537320 - protein, 8 aa, Mycobacterium tuberculosis
DVAGGSAD

SEQ ID NO: 1537321 - protein, 4 aa, Mycobacterium tuberculosis
EGRA

SEQ ID NO: 1537322 - protein, 5 aa, Mycobacterium tuberculosis
EKRAK

SEQ ID NO: 1537323 - protein, 9 aa, Mycobacterium tuberculosis
ELQSAAETY

SEQ ID NO: 1537324 - protein, 11 aa, Mycobacterium tuberculosis
ENAAPAGTPVR

SEQ ID NO: 1537325 - protein, 4 aa, Mycobacterium tuberculosis
EPEH

SEQ ID NO: 1537326 - protein, 7 aa, Mycobacterium tuberculosis
ESEQHRT

SEQ ID NO: 1537327 - protein, 15 aa, Mycobacterium tuberculosis
EWPEPAESLPPPYDN

SEQ ID NO: 1537328 - protein, 6 aa, Mycobacterium tuberculosis
FDETSD

SEQ ID NO: 1537329 - protein, 9 aa, Mycobacterium tuberculosis
GAGGVGKTR

SEQ ID NO: 1537330 - protein, 9 aa, Mycobacterium tuberculosis
GARTAAHRQ

SEQ ID NO: 1537331 - protein, 8 aa, Mycobacterium tuberculosis
GATETPGL

SEQ ID NO: 1537332 - protein, 14 aa, Mycobacterium tuberculosis
GDHATSGPAAINQT

SEQ ID NO: 1537333 - protein, 13 aa, Mycobacterium tuberculosis
GDRADPTDDSGTD

SEQ ID NO: 1537334 - protein, 9 aa, Mycobacterium tuberculosis
GDSEFDPQR

SEQ ID NO: 1537335 - protein, 5 aa, Mycobacterium tuberculosis
GEEGR

SEQ ID NO: 1537336 - protein, 14 aa, Mycobacterium tuberculosis
GGAATAGAFSRPGL

SEQ ID NO: 1537337 - protein, 5 aa, Mycobacterium tuberculosis
GGGPL

SEQ ID NO: 1537338 - protein, 4 aa, Mycobacterium tuberculosis
GGHG

SEQ ID NO: 1537339 - protein, 10 aa, Mycobacterium tuberculosis
GHAKREYREN

SEQ ID NO: 1537340 - protein, 5 aa, Mycobacterium tuberculosis
GHHPG

SEQ ID NO: 1537341 - protein, 37 aa, Mycobacterium tuberculosis; identical to SEQ ID NO: 229912

SEQ ID NO: 1537342 - protein, 13 aa, Mycobacterium tuberculosis
GKGYPDAGAAPCR

SEQ ID NO: 1537343 - protein, 24 aa, Mycobacterium tuberculosis
GKVPNKAVSYEKGTGGNRSEYRVG

SEQ ID NO: 1537344 - protein, 24 aa, Mycobacterium tuberculosis
GLTGDGIPTAQPLTAEAAAGLPGQ

SEQ ID NO: 1537345 - protein, 9 aa, Mycobacterium tuberculosis
GNTDCPGNA

SEQ ID NO: 1537346 - protein, 15 aa, Mycobacterium tuberculosis
GPETTPAAPARTAEL

SEQ ID NO: 1537347 - protein, 5 aa, Mycobacterium tuberculosis
GPEVG

SEQ ID NO: 1537348 - protein, 6 aa, Mycobacterium tuberculosis
GQAGVA

SEQ ID NO: 1537349 - protein, 9 aa, Mycobacterium tuberculosis
GQPASGPRR

SEQ ID NO: 1537350 - protein, 8 aa, Mycobacterium tuberculosis
GRRITSPE

SEQ ID NO: 1537351 - protein, 16 aa, Mycobacterium tuberculosis
GSQVSAANAAAAMPTT

SEQ ID NO: 1537352 - protein, 7 aa, Mycobacterium tuberculosis
GSQWPGM

SEQ ID NO: 1537353 - protein, 6 aa, Mycobacterium tuberculosis
GSSGHL

SEQ ID NO: 1537354 - protein, 5 aa, Mycobacterium tuberculosis
GVPGV

SEQ ID NO: 1537355 - protein, 8 aa, Mycobacterium tuberculosis
GWDSDPPD

SEQ ID NO: 1537356 - protein, 11 aa, Mycobacterium tuberculosis
GYDYDNPHSTG

SEQ ID NO: 1537357 - protein, 7 aa, Mycobacterium tuberculosis
GYPGDRA

SEQ ID NO: 1537358 - protein, 6 aa, Mycobacterium tuberculosis
GYTPGD

SEQ ID NO: 1537359 - protein, 10 aa, Mycobacterium tuberculosis
HQRTPARAEQ

SEQ ID NO: 1537360 - protein, 7 aa, Mycobacterium tuberculosis
IAPEDQE

SEQ ID NO: 1537361 - protein, 7 aa, Mycobacterium tuberculosis
ISPGSTI

SEQ ID NO: 1537362 - protein, 5 aa, Mycobacterium tuberculosis
KAGCQ

SEQ ID NO: 1537363 - protein, 17 aa, Mycobacterium tuberculosis
KATDEALERAQKSNHVF

SEQ ID NO: 1537364 - protein, 5 aa, Mycobacterium tuberculosis
LAADP

SEQ ID NO: 1537365 - protein, 6 aa, Mycobacterium tuberculosis
LETADG

SEQ ID NO: 1537366 - protein, 31 aa, Mycobacterium tuberculosis; identical to SEQ ID NO: 230428

SEQ ID NO: 1537367 - protein, 4 aa, Mycobacterium tuberculosis
LQPG

SEQ ID NO: 1537368 - protein, 4 aa, Mycobacterium tuberculosis
LRRG

SEQ ID NO: 1537369 - protein, 7 aa, Mycobacterium tuberculosis
LSAPGSR

SEQ ID NO: 1537370 - protein, 7 aa, Mycobacterium tuberculosis
LSGAGPT

SEQ ID NO: 1537371 - protein, 5 aa, Mycobacterium tuberculosis
LSQRY

SEQ ID NO: 1537372 - protein, 5 aa, Mycobacterium tuberculosis
MPPCP

SEQ ID NO: 1537373 - protein, 9 aa, Mycobacterium tuberculosis
MYSGPGAGS

SEQ ID NO: 1537374 - protein, 14 aa, Mycobacterium tuberculosis
NGADGLPGQNGGAG

SEQ ID NO: 1537375 - protein, 7 aa, Mycobacterium tuberculosis
NGKPLPK

SEQ ID NO: 1537376 - protein, 8 aa, Mycobacterium tuberculosis
NGRPDLET

SEQ ID NO: 1537377 - protein, 9 aa, Mycobacterium tuberculosis
NRGGATAED

SEQ ID NO: 1537378 - protein, 6 aa, Mycobacterium tuberculosis
NSLPES

SEQ ID NO: 1537379 - protein, 6 aa, Mycobacterium tuberculosis
NVDTSE

SEQ ID NO: 1537380 - protein, 13 aa, Mycobacterium tuberculosis
PARNSDGAPGHSA

SEQ ID NO: 1537381 - protein, 7 aa, Mycobacterium tuberculosis
PDASTVR

SEQ ID NO: 1537382 - protein, 4 aa, Mycobacterium tuberculosis
PDDM

SEQ ID NO: 1537383 - protein, 30 aa, Mycobacterium tuberculosis; identical to SEQ ID NO: 1436836

SEQ ID NO: 1537384 - protein, 4 aa, Mycobacterium tuberculosis
PDPL

SEQ ID NO: 1537385 - protein, 4 aa, Mycobacterium tuberculosis
PERD

SEQ ID NO: 1537386 - protein, 34 aa, Mycobacterium tuberculosis; identical to SEQ ID NO: 230747

SEQ ID NO: 1537387 - protein, 18 aa, Mycobacterium tuberculosis
PGQRVDPTGPMRLHPWWR

SEQ ID NO: 1537388 - protein, 25 aa, Mycobacterium tuberculosis
PIAPTPPAPGAPALPPGPPSLLAAL

SEQ ID NO: 1537389 - protein, 25 aa, Mycobacterium tuberculosis
PIPGITAPAPAAAAVPASVPGVPSA

SEQ ID NO: 1537390 - protein, 8 aa, Mycobacterium tuberculosis
PKNARTQD

SEQ ID NO: 1537391 - protein, 18 aa, Mycobacterium tuberculosis
PQPASLPAAGATGQPGPG

SEQ ID NO: 1537392 - protein, 5 aa, Mycobacterium tuberculosis
PREFR

SEQ ID NO: 1537393 - protein, 7 aa, Mycobacterium tuberculosis
PTKDTSV

SEQ ID NO: 1537394 - protein, 4 aa, Mycobacterium tuberculosis
PTQA

SEQ ID NO: 1537395 - protein, 8 aa, Mycobacterium tuberculosis
PTRPGGVS

SEQ ID NO: 1537396 - protein, 7 aa, Mycobacterium tuberculosis
QALGGED

SEQ ID NO: 1537397 - protein, 9 aa, Mycobacterium tuberculosis
QNGNAGSRV

SEQ ID NO: 1537398 - protein, 10 aa, Mycobacterium tuberculosis
QPDASVRSDA

SEQ ID NO: 1537399 - protein, 4 aa, Mycobacterium tuberculosis
QRSQ

SEQ ID NO: 1537400 - protein, 7 aa, Mycobacterium tuberculosis
QSTPSVV

SEQ ID NO: 1537401 - protein, 17 aa, Mycobacterium tuberculosis
QSYERGPLGLPTSAEIQ

SEQ ID NO: 1537402 - protein, 6 aa, Mycobacterium tuberculosis
QTTTPY

SEQ ID NO: 1537403 - protein, 6 aa, Mycobacterium tuberculosis
RAGPPE

SEQ ID NO: 1537404 - protein, 8 aa, Mycobacterium tuberculosis
RAGQVDEV

SEQ ID NO: 1537405 - protein, 7 aa, Mycobacterium tuberculosis
RAPRGDE

SEQ ID NO: 1537406 - protein, 7 aa, Mycobacterium tuberculosis
RAVSPQV

SEQ ID NO: 1537407 - protein, 13 aa, Mycobacterium tuberculosis
RDEGNYAGPTINR

SEQ ID NO: 1537408 - protein, 4 aa, Mycobacterium tuberculosis
RPEL

SEQ ID NO: 1537409 - protein, 23 aa, Mycobacterium tuberculosis
RQRYRTSGVPKAADLRSALKPLL

SEQ ID NO: 1537410 - protein, 7 aa, Mycobacterium tuberculosis
RRREAAA

SEQ ID NO: 1537411 - protein, 7 aa, Mycobacterium tuberculosis
RTSQPAL

SEQ ID NO: 1537412 - protein, 6 aa, Mycobacterium tuberculosis
RVTDRY

SEQ ID NO: 1537413 - protein, 4 aa, Mycobacterium tuberculosis
SAAD

SEQ ID NO: 1537414 - protein, 9 aa, Mycobacterium tuberculosis
SADDSETVR

SEQ ID NO: 1537415 - protein, 11 aa, Mycobacterium tuberculosis
SAGSSYTTFPG

SEQ ID NO: 1537416 - protein, 4 aa, Mycobacterium tuberculosis
SARR

SEQ ID NO: 1537417 - protein, 10 aa, Mycobacterium tuberculosis
SASNAWDDAG

SEQ ID NO: 1537418 - protein, 13 aa, Mycobacterium tuberculosis
SDLGAEPATERRT

SEQ ID NO: 1537419 - protein, 9 aa, Mycobacterium tuberculosis
SDRDSVREA

SEQ ID NO: 1537420 - protein, 7 aa, Mycobacterium tuberculosis
SGEGADE

SEQ ID NO: 1537421 - protein, 12 aa, Mycobacterium tuberculosis
SGKTGTTEAHRS

SEQ ID NO: 1537422 - protein, 13 aa, Mycobacterium tuberculosis
SHSHSVSKAEVAR

SEQ ID NO: 1537423 - protein, 7 aa, Mycobacterium tuberculosis
SKAPGAT

SEQ ID NO: 1537424 - protein, 9 aa, Mycobacterium tuberculosis
SKPLPEGMR

SEQ ID NO: 1537425 - protein, 6 aa, Mycobacterium tuberculosis
SKSVGA

SEQ ID NO: 1537426 - protein, 7 aa, Mycobacterium tuberculosis
SKTGARY

SEQ ID NO: 1537427 - protein, 13 aa, Mycobacterium tuberculosis
SLQATAQATQTTL

SEQ ID NO: 1537428 - protein, 7 aa, Mycobacterium tuberculosis
SPDLSGA

SEQ ID NO: 1537429 - protein, 15 aa, Mycobacterium tuberculosis
SPKCGNGNDPLDKAG

SEQ ID NO: 1537430 - protein, 13 aa, Mycobacterium tuberculosis
SPRKRSATGRSGL

SEQ ID NO: 1537431 - protein, 7 aa, Mycobacterium tuberculosis
SQQNSIR

SEQ ID NO: 1537432 - protein, 5 aa, Mycobacterium tuberculosis
SRAGD

SEQ ID NO: 1537433 - protein, 9 aa, Mycobacterium tuberculosis
SRGDDDTLR

SEQ ID NO: 1537434 - protein, 15 aa, Mycobacterium tuberculosis
SRITEANTDRFPTTE

SEQ ID NO: 1537435 - protein, 4 aa, Mycobacterium tuberculosis
SRPE

SEQ ID NO: 1537436 - protein, 7 aa, Mycobacterium tuberculosis
SRSRCTP

SEQ ID NO: 1537437 - protein, 13 aa, Mycobacterium tuberculosis
SRTDAHGNPLSAE

SEQ ID NO: 1537438 - protein, 29 aa, Mycobacterium tuberculosis
SSGSKGGAGSGHAGKARSAVTTTDADWKP

SEQ ID NO: 1537439 - protein, 8 aa, Mycobacterium tuberculosis
SSPTTSAA

SEQ ID NO: 1537440 - protein, 22 aa, Mycobacterium tuberculosis
STHQALGPPSGLPDASPNERSA

SEQ ID NO: 1537441 - protein, 7 aa, Mycobacterium tuberculosis
STQDRRV

SEQ ID NO: 1537442 - protein, 17 aa, Mycobacterium tuberculosis
SVGSYAAAEAANASPLQ

SEQ ID NO: 1537443 - protein, 6 aa, Mycobacterium tuberculosis
TADNPR

SEQ ID NO: 1537444 - protein, 18 aa, Mycobacterium tuberculosis
TADPDSAPKTTRSSLEGA

SEQ ID NO: 1537445 - protein, 10 aa, Mycobacterium tuberculosis
TAKAWGGGDL

SEQ ID NO: 1537446 - protein, 8 aa, Mycobacterium tuberculosis
TDAPDDTV

SEQ ID NO: 1537447 - protein, 5 aa, Mycobacterium tuberculosis
TPEQA

SEQ ID NO: 1537448 - protein, 25 aa, Mycobacterium tuberculosis
TPLATRPPSGPTVPPEHFTLPTHPI

SEQ ID NO: 1537449 - protein, 12 aa, Mycobacterium tuberculosis
TPPYAGGPTMAD

SEQ ID NO: 1537450 - protein, 4 aa, Mycobacterium tuberculosis
TQGE

SEQ ID NO: 1537451 - protein, 61 aa, Mycobacterium tuberculosis; identical to SEQ ID NO: 231601

SEQ ID NO: 1537452 - protein, 9 aa, Mycobacterium tuberculosis
TRARQNGPY

SEQ ID NO: 1537453 - protein, 8 aa, Mycobacterium tuberculosis
TTADPDIP

SEQ ID NO: 1537454 - protein, 5 aa, Mycobacterium tuberculosis
TVTAT

SEQ ID NO: 1537455 - protein, 5 aa, Mycobacterium tuberculosis
VAATT

SEQ ID NO: 1537456 - protein, 4 aa, Mycobacterium tuberculosis
VADK

SEQ ID NO: 1537457 - protein, 16 aa, Mycobacterium tuberculosis
VAPPASDTNDNGDFSR

SEQ ID NO: 1537458 - protein, 7 aa, Mycobacterium tuberculosis
VASADPV

SEQ ID NO: 1537459 - protein, 4 aa, Mycobacterium tuberculosis
VDPR

SEQ ID NO: 1537460 - protein, 11 aa, Mycobacterium tuberculosis
VGQAPAAAHPG

SEQ ID NO: 1537461 - protein, 4 aa, Mycobacterium tuberculosis
VPAD

SEQ ID NO: 1537462 - protein, 9 aa, Mycobacterium tuberculosis
VRPTAASLP

SEQ ID NO: 1537463 - protein, 11 aa, Mycobacterium tuberculosis
VRQATDEAAAM

SEQ ID NO: 1537464 - protein, 7 aa, Mycobacterium tuberculosis
VRRGDQR

SEQ ID NO: 1537465 - protein, 6 aa, Mycobacterium tuberculosis
VSAQAV

SEQ ID NO: 1537466 - protein, 5 aa, Mycobacterium tuberculosis
VSDTF

SEQ ID NO: 1537467 - protein, 7 aa, Mycobacterium tuberculosis
VTDSGSG

SEQ ID NO: 1537468 - protein, 5 aa, Mycobacterium tuberculosis
VTGTG

SEQ ID NO: 1537469 - protein, 6 aa, Mycobacterium tuberculosis
AAAAEL

SEQ ID NO: 1537470 - protein, 8 aa, Mycobacterium tuberculosis
AAAEPSWN

SEQ ID NO: 1537471 - protein, 11 aa, Mycobacterium tuberculosis
AAAGGPTSAPI

SEQ ID NO: 1537472 - protein, 6 aa, Mycobacterium tuberculosis
AAEGNA

SEQ ID NO: 1537473 - protein, 6 aa, Mycobacterium tuberculosis
AAGEPS

SEQ ID NO: 1537474 - protein, 23 aa, Mycobacterium tuberculosis
AAIGGAPVAGADPQRYDGDVPGM

SEQ ID NO: 1537475 - protein, 8 aa, Mycobacterium tuberculosis
AAKATGVL

SEQ ID NO: 1537476 - protein, 6 aa, Mycobacterium tuberculosis
AANPST

SEQ ID NO: 1537477 - protein, 5 aa, Mycobacterium tuberculosis
AAQGR

SEQ ID NO: 1537478 - protein, 10 aa, Mycobacterium tuberculosis
AARELAEETG

SEQ ID NO: 1537479 - protein, 11 aa, Mycobacterium tuberculosis
AATSSTPREAP

SEQ ID NO: 1537480 - protein, 9 aa, Mycobacterium tuberculosis
ADAKSPYEY

SEQ ID NO: 1537481 - protein, 10 aa, Mycobacterium tuberculosis
ADGGPASGRG

SEQ ID NO: 1537482 - protein, 13 aa, Mycobacterium tuberculosis
ADGPDKIGQAAED

SEQ ID NO: 1537483 - protein, 5 aa, Mycobacterium tuberculosis
ADPVG

SEQ ID NO: 1537484 - protein, 17 aa, Mycobacterium tuberculosis
ADTAGPDENISRGPDPL

SEQ ID NO: 1537485 - protein, 5 aa, Mycobacterium tuberculosis
ADTAT

SEQ ID NO: 1537486 - protein, 10 aa, Mycobacterium tuberculosis
ADTPPDPAAA

SEQ ID NO: 1537487 - protein, 7 aa, Mycobacterium tuberculosis
AEDTRRV

SEQ ID NO: 1537488 - protein, 29 aa, Mycobacterium tuberculosis
AEGPPLGRNPQGAPAPVGGTVIVAPMHSG

SEQ ID NO: 1537489 - protein, 16 aa, Mycobacterium tuberculosis
AEIPATAKSAALGRQL

SEQ ID NO: 1537490 - protein, 7 aa, Mycobacterium tuberculosis
AENRDTA

SEQ ID NO: 1537491 - protein, 8 aa, Mycobacterium tuberculosis
AEQTGKRI

SEQ ID NO: 1537492 - protein, 6 aa, Mycobacterium tuberculosis
AETEID

SEQ ID NO: 1537493 - protein, 9 aa, Mycobacterium tuberculosis
AGAGSNDVG

SEQ ID NO: 1537494 - protein, 8 aa, Mycobacterium tuberculosis
AGAPGDGV

SEQ ID NO: 1537495 - protein, 6 aa, Mycobacterium tuberculosis
AGDDTV

SEQ ID NO: 1537496 - protein, 10 aa, Mycobacterium tuberculosis
AGDEEATNTD

SEQ ID NO: 1537497 - protein, 9 aa, Mycobacterium tuberculosis
AGGQNPQGP

SEQ ID NO: 1537498 - protein, 8 aa, Mycobacterium tuberculosis
AGGSGTLG

SEQ ID NO: 1537499 - protein, 15 aa, Mycobacterium tuberculosis
AGLSVKGAQPGNASN

SEQ ID NO: 1537500 - protein, 29 aa, Mycobacterium tuberculosis
AGRPGEVPPNVPGTPVPIPQEAPPGARTL

SEQ ID NO: 1537501 - protein, 26 aa, Mycobacterium tuberculosis
AGTYGVTESLNSSAAASPLSGITGEA

SEQ ID NO: 1537502 - protein, 8 aa, Mycobacterium tuberculosis
AGWSDDGM

SEQ ID NO: 1537503 - protein, 11 aa, Mycobacterium tuberculosis
AHPEFQPRAGS

SEQ ID NO: 1537504 - protein, 8 aa, Mycobacterium tuberculosis
AHQTGPAA

SEQ ID NO: 1537505 - protein, 18 aa, Mycobacterium tuberculosis
AKGGPGGRPGCGPLPDAT

SEQ ID NO: 1537506 - protein, 7 aa, Mycobacterium tuberculosis
AKPNVEL

SEQ ID NO: 1537507 - protein, 8 aa, Mycobacterium tuberculosis
ALNGTKNI

SEQ ID NO: 1537508 - protein, 9 aa, Mycobacterium tuberculosis
ANGALTGAL

SEQ ID NO: 1537509 - protein, 7 aa, Mycobacterium tuberculosis
ANKGSLV

SEQ ID NO: 1537510 - protein, 7 aa, Mycobacterium tuberculosis
ANKPDSH

SEQ ID NO: 1537511 - protein, 6 aa, Mycobacterium tuberculosis
ANLRPS

SEQ ID NO: 1537512 - protein, 5 aa, Mycobacterium tuberculosis
ANPRS

SEQ ID NO: 1537513 - protein, 8 aa, Mycobacterium tuberculosis
ANSAEKLR

SEQ ID NO: 1537514 - protein, 7 aa, Mycobacterium tuberculosis
APAGGAY

SEQ ID NO: 1537515 - protein, 5 aa, Mycobacterium tuberculosis
APHAE

SEQ ID NO: 1537516 - protein, 5 aa, Mycobacterium tuberculosis
APPLN

SEQ ID NO: 1537517 - protein, 8 aa, Mycobacterium tuberculosis
APPPQRAA

SEQ ID NO: 1537518 - protein, 29 aa, Mycobacterium tuberculosis
APTAGAEPTGALPPMTSSGSGPVIGDGDA

SEQ ID NO: 1537519 - protein, 9 aa, Mycobacterium tuberculosis
AQSQANADG

SEQ ID NO: 1537520 - protein, 7 aa, Mycobacterium tuberculosis
ARGADVD

SEQ ID NO: 1537521 - protein, 9 aa, Mycobacterium tuberculosis
ARGDTIGGN

SEQ ID NO: 1537522 - protein, 5 aa, Mycobacterium tuberculosis
ARLKT

SEQ ID NO: 1537523 - protein, 14 aa, Mycobacterium tuberculosis
ASAGVQHARRGSEL

SEQ ID NO: 1537524 - protein, 7 aa, Mycobacterium tuberculosis
ASTTSAT

SEQ ID NO: 1537525 - protein, 7 aa, Mycobacterium tuberculosis
ASVTDGA

SEQ ID NO: 1537526 - protein, 9 aa, Mycobacterium tuberculosis
ATDPRETSR

SEQ ID NO: 1537527 - protein, 4 aa, Mycobacterium tuberculosis
ATGR

SEQ ID NO: 1537528 - protein, 8 aa, Mycobacterium tuberculosis
ATLAPNAV

SEQ ID NO: 1537529 - protein, 6 aa, Mycobacterium tuberculosis
ATNNDK

SEQ ID NO: 1537530 - protein, 7 aa, Mycobacterium tuberculosis
ATTAPVD

SEQ ID NO: 1537531 - protein, 12 aa, Mycobacterium tuberculosis
AVGRLSQSADQY

SEQ ID NO: 1537532 - protein, 21 aa, Mycobacterium tuberculosis
AVNGEPAPLAPPPADPAPPVE

SEQ ID NO: 1537533 - protein, 16 aa, Mycobacterium tuberculosis
AVRGQGERIGQATTDL

SEQ ID NO: 1537534 - protein, 8 aa, Mycobacterium tuberculosis
AVRPATPV

SEQ ID NO: 1537535 - protein, 6 aa, Mycobacterium tuberculosis
AVSAQA

SEQ ID NO: 1537536 - protein, 8 aa, Mycobacterium tuberculosis
CGSSDHSR

SEQ ID NO: 1537537 - protein, 5 aa, Mycobacterium tuberculosis
CNDPF

SEQ ID NO: 1537538 - protein, 25 aa, Mycobacterium tuberculosis
CSDSGDNKPGATIPSTPANAEGRHG

SEQ ID NO: 1537539 - protein, 25 aa, Mycobacterium tuberculosis
DDERPEQAREPELRSNRSQREEELS

SEQ ID NO: 1537540 - protein, 7 aa, Mycobacterium tuberculosis
DDNSGRT

SEQ ID NO: 1537541 - protein, 7 aa, Mycobacterium tuberculosis
DGSKTYG

SEQ ID NO: 1537542 - protein, 10 aa, Mycobacterium tuberculosis
DHSGDRPNYS

SEQ ID NO: 1537543 - protein, 6 aa, Mycobacterium tuberculosis
DKGTPF

SEQ ID NO: 1537544 - protein, 34 aa, Mycobacterium tuberculosis; identical to SEQ ID NO: 232019

SEQ ID NO: 1537545 - protein, 18 aa, Mycobacterium tuberculosis
DMPGSGLSADGKAEAQQV

SEQ ID NO: 1537546 - protein, 14 aa, Mycobacterium tuberculosis
DNGRPVAGRLSPDG

SEQ ID NO: 1537547 - protein, 14 aa, Mycobacterium tuberculosis
DPGPSVDKLQAGDA

SEQ ID NO: 1537548 - protein, 7 aa, Mycobacterium tuberculosis
DPNDPTP

SEQ ID NO: 1537549 - protein, 6 aa, Mycobacterium tuberculosis
DQIPYQ

SEQ ID NO: 1537550 - protein, 15 aa, Mycobacterium tuberculosis
DQTNSVNSSAKYGEV

SEQ ID NO: 1537551 - protein, 6 aa, Mycobacterium tuberculosis
DRDQLA

SEQ ID NO: 1537552 - protein, 15 aa, Mycobacterium tuberculosis
DRRAEQVRAGGPDIL

SEQ ID NO: 1537553 - protein, 7 aa, Mycobacterium tuberculosis
DSELPTD

SEQ ID NO: 1537554 - protein, 7 aa, Mycobacterium tuberculosis
DSRPSRY

SEQ ID NO: 1537555 - protein, 12 aa, Mycobacterium tuberculosis
DTAATPSAAGVT

SEQ ID NO: 1537556 - protein, 4 aa, Mycobacterium tuberculosis
DTDP

SEQ ID NO: 1537557 - protein, 5 aa, Mycobacterium tuberculosis
DVGGG

SEQ ID NO: 1537558 - protein, 7 aa, Mycobacterium tuberculosis
EAEASQE

SEQ ID NO: 1537559 - protein, 6 aa, Mycobacterium tuberculosis
EDIGPE

SEQ ID NO: 1537560 - protein, 10 aa, Mycobacterium tuberculosis
EGGIGGTEAR

SEQ ID NO: 1537561 - protein, 9 aa, Mycobacterium tuberculosis
EKRPPSGSA

SEQ ID NO: 1537562 - protein, 9 aa, Mycobacterium tuberculosis
ELNQQRDDI

SEQ ID NO: 1537563 - protein, 8 aa, Mycobacterium tuberculosis
ENSDTEGA

SEQ ID NO: 1537564 - protein, 7 aa, Mycobacterium tuberculosis
ENSPDRT

SEQ ID NO: 1537565 - protein, 15 aa, Mycobacterium tuberculosis
EPSATGASDPCAASE

SEQ ID NO: 1537566 - protein, 9 aa, Mycobacterium tuberculosis
EQRSSTAET

SEQ ID NO: 1537567 - protein, 5 aa, Mycobacterium tuberculosis
ESIGN

SEQ ID NO: 1537568 - protein, 25 aa, Mycobacterium tuberculosis
FADQAKKQNLAADVGATQQVGTQQV

SEQ ID NO: 1537569 - protein, 9 aa, Mycobacterium tuberculosis
FPAPGVKPH

SEQ ID NO: 1537570 - protein, 26 aa, Mycobacterium tuberculosis
FRPNNSVPGDPPQPLGAPNYSQIRDD

SEQ ID NO: 1537571 - protein, 8 aa, Mycobacterium tuberculosis
GAAPSGPV

SEQ ID NO: 1537572 - protein, 5 aa, Mycobacterium tuberculosis
GAHAR

SEQ ID NO: 1537573 - protein, 17 aa, Mycobacterium tuberculosis
GAPAALADSVRNGDTQV

SEQ ID NO: 1537574 - protein, 17 aa, Mycobacterium tuberculosis
GAPCPKPQAAAQSPDGL

SEQ ID NO: 1537575 - protein, 5 aa, Mycobacterium tuberculosis
GCPDA

SEQ ID NO: 1537576 - protein, 9 aa, Mycobacterium tuberculosis
GGHDVPETK

SEQ ID NO: 1537577 - protein, 26 aa, Mycobacterium tuberculosis
GGIGGPGGASSIPGMSGGAGGTGGAA

SEQ ID NO: 1537578 - protein, 7 aa, Mycobacterium tuberculosis
GGLTTAD

SEQ ID NO: 1537579 - protein, 8 aa, Mycobacterium tuberculosis
GGPTQPRS

SEQ ID NO: 1537580 - protein, 20 aa, Mycobacterium tuberculosis
GHGRGSGDSHNGGVTTPPLD

SEQ ID NO: 1537581 - protein, 8 aa, Mycobacterium tuberculosis
GKPESMAN

SEQ ID NO: 1537582 - protein, 12 aa, Mycobacterium tuberculosis
GLDNGDLDRTHR

SEQ ID NO: 1537583 - protein, 5 aa, Mycobacterium tuberculosis
GMEQA

SEQ ID NO: 1537584 - protein, 6 aa, Mycobacterium tuberculosis
GMTPRA

SEQ ID NO: 1537585 - protein, 4 aa, Mycobacterium tuberculosis
GNNM

SEQ ID NO: 1537586 - protein, 13 aa, Mycobacterium tuberculosis
GPAIGPNPAAGEQ

SEQ ID NO: 1537587 - protein, 6 aa, Mycobacterium tuberculosis
GQGMSS

SEQ ID NO: 1537588 - protein, 5 aa, Mycobacterium tuberculosis
GQNTP

SEQ ID NO: 1537589 - protein, 8 aa, Mycobacterium tuberculosis
GQNTPAIA

SEQ ID NO: 1537590 - protein, 8 aa, Mycobacterium tuberculosis
GQSTTPYQ

SEQ ID NO: 1537591 - protein, 7 aa, Mycobacterium tuberculosis
GRAGLGA

SEQ ID NO: 1537592 - protein, 9 aa, Mycobacterium tuberculosis
GRGAPDEAA

SEQ ID NO: 1537593 - protein, 7 aa, Mycobacterium tuberculosis
GRGRAAI

SEQ ID NO: 1537594 - protein, 4 aa, Mycobacterium tuberculosis
GRLR

SEQ ID NO: 1537595 - protein, 5 aa, Mycobacterium tuberculosis
GRSVD

SEQ ID NO: 1537596 - protein, 24 aa, Mycobacterium tuberculosis
GSADDTTPPPSPILTAGSDAPECI

SEQ ID NO: 1537597 - protein, 16 aa, Mycobacterium tuberculosis
GSDSLGDSDVSARPAD

SEQ ID NO: 1537598 - protein, 8 aa, Mycobacterium tuberculosis
GSPKQVAT

SEQ ID NO: 1537599 - protein, 7 aa, Mycobacterium tuberculosis
GSVTPAV

SEQ ID NO: 1537600 - protein, 11 aa, Mycobacterium tuberculosis
GTRALGRGPAI

SEQ ID NO: 1537601 - protein, 4 aa, Mycobacterium tuberculosis
GVSA

SEQ ID NO: 1537602 - protein, 11 aa, Mycobacterium tuberculosis
GVSGPGGDGRT

SEQ ID NO: 1537603 - protein, 16 aa, Mycobacterium tuberculosis
HIGGNAYSEAEPQTGI

SEQ ID NO: 1537604 - protein, 6 aa, Mycobacterium tuberculosis
HPGGPK

SEQ ID NO: 1537605 - protein, 13 aa, Mycobacterium tuberculosis
HPSDQGSADISTS

SEQ ID NO: 1537606 - protein, 10 aa, Mycobacterium tuberculosis
HSRGLGSSAA

SEQ ID NO: 1537607 - protein, 5 aa, Mycobacterium tuberculosis
IAGGQ

SEQ ID NO: 1537608 - protein, 11 aa, Mycobacterium tuberculosis
IAGPGPNGRPR

SEQ ID NO: 1537609 - protein, 10 aa, Mycobacterium tuberculosis
IERTTSPYQL

SEQ ID NO: 1537610 - protein, 17 aa, Mycobacterium tuberculosis
IGDTPKRQIRAEAARRG

SEQ ID NO: 1537611 - protein, 7 aa, Mycobacterium tuberculosis
IVEPGGD

SEQ ID NO: 1537612 - protein, 10 aa, Mycobacterium tuberculosis
KGEYTGGEDP

SEQ ID NO: 1537613 - protein, 7 aa, Mycobacterium tuberculosis
KNASAYE

SEQ ID NO: 1537614 - protein, 4 aa, Mycobacterium tuberculosis
KQFT

SEQ ID NO: 1537615 - protein, 6 aa, Mycobacterium tuberculosis
KQPAVA

SEQ ID NO: 1537616 - protein, 6 aa, Mycobacterium tuberculosis
KRGRRI

SEQ ID NO: 1537617 - protein, 5 aa, Mycobacterium tuberculosis
KTIGM

SEQ ID NO: 1537618 - protein, 8 aa, Mycobacterium tuberculosis
KTTRHRAE

SEQ ID NO: 1537619 - protein, 4 aa, Mycobacterium tuberculosis
LAAA

SEQ ID NO: 1537620 - protein, 6 aa, Mycobacterium tuberculosis
LAGAKA

SEQ ID NO: 1537621 - protein, 5 aa, Mycobacterium tuberculosis
LANPS

SEQ ID NO: 1537622 - protein, 5 aa, Mycobacterium tuberculosis
LDRSA

SEQ ID NO: 1537623 - protein, 6 aa, Mycobacterium tuberculosis
LGGSDI

SEQ ID NO: 1537624 - protein, 7 aa, Mycobacterium tuberculosis
LNPDTGL

SEQ ID NO: 1537625 - protein, 5 aa, Mycobacterium tuberculosis
LPKVT

SEQ ID NO: 1537626 - protein, 10 aa, Mycobacterium tuberculosis
LPQPATGATV

SEQ ID NO: 1537627 - protein, 9 aa, Mycobacterium tuberculosis
LPRGTTQGQ

SEQ ID NO: 1537628 - protein, 8 aa, Mycobacterium tuberculosis
LPRSSGQM

SEQ ID NO: 1537629 - protein, 12 aa, Mycobacterium tuberculosis
LQPTGGASGLSA

SEQ ID NO: 1537630 - protein, 8 aa, Mycobacterium tuberculosis
LRSEKRDL

SEQ ID NO: 1537631 - protein, 9 aa, Mycobacterium tuberculosis
LSNATPREV

SEQ ID NO: 1537632 - protein, 12 aa, Mycobacterium tuberculosis
LSRQAEQTTEAL

SEQ ID NO: 1537633 - protein, 9 aa, Mycobacterium tuberculosis
LSTTDPHSR

SEQ ID NO: 1537634 - protein, 15 aa, Mycobacterium tuberculosis
LTDPPTGQPGTPPLP

SEQ ID NO: 1537635 - protein, 7 aa, Mycobacterium tuberculosis
LTGNDRT

SEQ ID NO: 1537636 - protein, 10 aa, Mycobacterium tuberculosis
LTPPADQPAA

SEQ ID NO: 1537637 - protein, 5 aa, Mycobacterium tuberculosis
MDAPL

SEQ ID NO: 1537638 - protein, 8 aa, Mycobacterium tuberculosis
MKNPADSA

SEQ ID NO: 1537639 - protein, 5 aa, Mycobacterium tuberculosis
MNGPS

SEQ ID NO: 1537640 - protein, 14 aa, Mycobacterium tuberculosis
MPTSMGKDSTPTAN

SEQ ID NO: 1537641 - protein, 12 aa, Mycobacterium tuberculosis
MWGPKEDPAWQR

SEQ ID NO: 1537642 - protein, 10 aa, Mycobacterium tuberculosis
NAGGTHPTTT

SEQ ID NO: 1537643 - protein, 6 aa, Mycobacterium tuberculosis
NAPTEA

SEQ ID NO: 1537644 - protein, 6 aa, Mycobacterium tuberculosis
NDPPEE

SEQ ID NO: 1537645 - protein, 10 aa, Mycobacterium tuberculosis
NEGAPGRGPL

SEQ ID NO: 1537646 - protein, 9 aa, Mycobacterium tuberculosis
NFGAGSSGW

SEQ ID NO: 1537647 - protein, 16 aa, Mycobacterium tuberculosis
NGADGTAANPNGGAGG

SEQ ID NO: 1537648 - protein, 15 aa, Mycobacterium tuberculosis
NGADGTAPGQPGAAG

SEQ ID NO: 1537649 - protein, 10 aa, Mycobacterium tuberculosis
NGGHTWPGGR

SEQ ID NO: 1537650 - protein, 12 aa, Mycobacterium tuberculosis
NGKPSDLGGNNL

SEQ ID NO: 1537651 - protein, 11 aa, Mycobacterium tuberculosis
NNGKSATAISI

SEQ ID NO: 1537652 - protein, 11 aa, Mycobacterium tuberculosis
NPGGPGESGIE

SEQ ID NO: 1537653 - protein, 7 aa, Mycobacterium tuberculosis
NRISPDA

SEQ ID NO: 1537654 - protein, 15 aa, Mycobacterium tuberculosis
NTRGQGRANQAVTGT

SEQ ID NO: 1537655 - protein, 7 aa, Mycobacterium tuberculosis
NWASATS

SEQ ID NO: 1537656 - protein, 8 aa, Mycobacterium tuberculosis
NYRTGSVG

SEQ ID NO: 1537657 - protein, 4 aa, Mycobacterium tuberculosis
PAEP

SEQ ID NO: 1537658 - protein, 5 aa, Mycobacterium tuberculosis
PAEVA

SEQ ID NO: 1537659 - protein, 7 aa, Mycobacterium tuberculosis
PAGLTQA

SEQ ID NO: 1537660 - protein, 5 aa, Mycobacterium tuberculosis
PAKTA

SEQ ID NO: 1537661 - protein, 5 aa, Mycobacterium tuberculosis
PAWAG

SEQ ID NO: 1537662 - protein, 5 aa, Mycobacterium tuberculosis
PDGQI

SEQ ID NO: 1537663 - protein, 8 aa, Mycobacterium tuberculosis
PDPAGDEV

SEQ ID NO: 1537664 - protein, 13 aa, Mycobacterium tuberculosis
PDRYRDDSAARGG

SEQ ID NO: 1537665 - protein, 8 aa, Mycobacterium tuberculosis
PEAAGPTQ

SEQ ID NO: 1537666 - protein, 39 aa, Mycobacterium tuberculosis
PGAGSTADGETPGGGISLPNSSGQPAYTGPCPPAGTGTH

SEQ ID NO: 1537667 - protein, 7 aa, Mycobacterium tuberculosis
PGAPPMR

SEQ ID NO: 1537668 - protein, 6 aa, Mycobacterium tuberculosis
PGPSAV

SEQ ID NO: 1537669 - protein, 6 aa, Mycobacterium tuberculosis
PGPTFD

SEQ ID NO: 1537670 - protein, 7 aa, Mycobacterium tuberculosis
PGTRFDY

SEQ ID NO: 1537671 - protein, 10 aa, Mycobacterium tuberculosis
PHRYSQSEIT

SEQ ID NO: 1537672 - protein, 12 aa, Mycobacterium tuberculosis
PLGQPSDASPRL

SEQ ID NO: 1537673 - protein, 4 aa, Mycobacterium tuberculosis
PPPP

SEQ ID NO: 1537674 - protein, 7 aa, Mycobacterium tuberculosis
PRKGAAR

SEQ ID NO: 1537675 - protein, 7 aa, Mycobacterium tuberculosis
PSAPSVT

SEQ ID NO: 1537676 - protein, 12 aa, Mycobacterium tuberculosis
PTGTAAAGADEQ

SEQ ID NO: 1537677 - protein, 14 aa, Mycobacterium tuberculosis
PVGDQFGEAGEGVR

SEQ ID NO: 1537678 - protein, 7 aa, Mycobacterium tuberculosis
PYDRPPL

SEQ ID NO: 1537679 - protein, 5 aa, Mycobacterium tuberculosis
QAGPS

SEQ ID NO: 1537680 - protein, 12 aa, Mycobacterium tuberculosis
QALGRKGTQDGG

SEQ ID NO: 1537681 - protein, 6 aa, Mycobacterium tuberculosis
QAPGID

SEQ ID NO: 1537682 - protein, 8 aa, Mycobacterium tuberculosis
QARPNEVT

SEQ ID NO: 1537683 - protein, 7 aa, Mycobacterium tuberculosis
QDSGTFT

SEQ ID NO: 1537684 - protein, 6 aa, Mycobacterium tuberculosis
QECCPT

SEQ ID NO: 1537685 - protein, 6 aa, Mycobacterium tuberculosis
QGGTAG

SEQ ID NO: 1537686 - protein, 7 aa, Mycobacterium tuberculosis
QLGGARP

SEQ ID NO: 1537687 - protein, 9 aa, Mycobacterium tuberculosis
QNPSRARLS

SEQ ID NO: 1537688 - protein, 4 aa, Mycobacterium tuberculosis
QPKL

SEQ ID NO: 1537689 - protein, 5 aa, Mycobacterium tuberculosis
QQLRP

SEQ ID NO: 1537690 - protein, 4 aa, Mycobacterium tuberculosis
QRGS

SEQ ID NO: 1537691 - protein, 8 aa, Mycobacterium tuberculosis
RAAKAEPL

SEQ ID NO: 1537692 - protein, 11 aa, Mycobacterium tuberculosis
RAAPASAGSLG

SEQ ID NO: 1537693 - protein, 25 aa, Mycobacterium tuberculosis
RAELATRDARAKDTYEKIGVHVVVA

SEQ ID NO: 1537694 - protein, 19 aa, Mycobacterium tuberculosis
REVPQSRSVDVSDDPSGFR

SEQ ID NO: 1537695 - protein, 6 aa, Mycobacterium tuberculosis
RGAPDD

SEQ ID NO: 1537696 - protein, 6 aa, Mycobacterium tuberculosis
RGMGPD

SEQ ID NO: 1537697 - protein, 22 aa, Mycobacterium tuberculosis
RIQPTTVNSRRSRTPALDAGRE

SEQ ID NO: 1537698 - protein, 5 aa, Mycobacterium tuberculosis
RKERV

SEQ ID NO: 1537699 - protein, 5 aa, Mycobacterium tuberculosis
RKKSS

SEQ ID NO: 1537700 - protein, 4 aa, Mycobacterium tuberculosis
RLAQ

SEQ ID NO: 1537701 - protein, 9 aa, Mycobacterium tuberculosis
RLDPSSDRM

SEQ ID NO: 1537702 - protein, 12 aa, Mycobacterium tuberculosis
RLGTSPEKDVGF

SEQ ID NO: 1537703 - protein, 13 aa, Mycobacterium tuberculosis
RNATVADGEDQQT

SEQ ID NO: 1537704 - protein, 8 aa, Mycobacterium tuberculosis
RPANDPDV

SEQ ID NO: 1537705 - protein, 6 aa, Mycobacterium tuberculosis
RPNPGI

SEQ ID NO: 1537706 - protein, 9 aa, Mycobacterium tuberculosis
RQAALNPPP

SEQ ID NO: 1537707 - protein, 10 aa, Mycobacterium tuberculosis
RQESRDVNGT

SEQ ID NO: 1537708 - protein, 4 aa, Mycobacterium tuberculosis
RRFR

SEQ ID NO: 1537709 - protein, 6 aa, Mycobacterium tuberculosis
RRRRGA

SEQ ID NO: 1537710 - protein, 8 aa, Mycobacterium tuberculosis
RSDGSGDT

SEQ ID NO: 1537711 - protein, 6 aa, Mycobacterium tuberculosis
RWSANS

SEQ ID NO: 1537712 - protein, 13 aa, Mycobacterium tuberculosis
SAAAAAAPPPADI

SEQ ID NO: 1537713 - protein, 12 aa, Mycobacterium tuberculosis
SAGQGGPSRTLP

SEQ ID NO: 1537714 - protein, 5 aa, Mycobacterium tuberculosis
SAGWD

SEQ ID NO: 1537715 - protein, 4 aa, Mycobacterium tuberculosis
SAQV

SEQ ID NO: 1537716 - protein, 5 aa, Mycobacterium tuberculosis
SATTM

SEQ ID NO: 1537717 - protein, 24 aa, Mycobacterium tuberculosis
SDDPAGLAENDAVADTLPGPLATA

SEQ ID NO: 1537718 - protein, 6 aa, Mycobacterium tuberculosis
SEAGEV

SEQ ID NO: 1537719 - protein, 12 aa, Mycobacterium tuberculosis
SGRGPRRYTAGG

SEQ ID NO: 1537720 - protein, 7 aa, Mycobacterium tuberculosis
SIESADN

SEQ ID NO: 1537721 - protein, 12 aa, Mycobacterium tuberculosis
SKPTASGAAGMT

SEQ ID NO: 1537722 - protein, 5 aa, Mycobacterium tuberculosis
SLGDP

SEQ ID NO: 1537723 - protein, 6 aa, Mycobacterium tuberculosis
SLPTIG

SEQ ID NO: 1537724 - protein, 15 aa, Mycobacterium tuberculosis
SNAGTNLLGSSRDNL

SEQ ID NO: 1537725 - protein, 20 aa, Mycobacterium tuberculosis
SPAGVTTRVDAPAESTEEEY

SEQ ID NO: 1537726 - protein, 5 aa, Mycobacterium tuberculosis
SQRLS

SEQ ID NO: 1537727 - protein, 5 aa, Mycobacterium tuberculosis
SRFPG

SEQ ID NO: 1537728 - protein, 8 aa, Mycobacterium tuberculosis
SRLGGEQA

SEQ ID NO: 1537729 - protein, 7 aa, Mycobacterium tuberculosis
SSGHTAR

SEQ ID NO: 1537730 - protein, 7 aa, Mycobacterium tuberculosis
SSGLGAG

SEQ ID NO: 1537731 - protein, 5 aa, Mycobacterium tuberculosis
SSLYP

SEQ ID NO: 1537732 - protein, 4 aa, Mycobacterium tuberculosis
SVRQ

SEQ ID NO: 1537733 - protein, 9 aa, Mycobacterium tuberculosis
SYYPDQKSL

SEQ ID NO: 1537734 - protein, 24 aa, Mycobacterium tuberculosis
TAPGTLRTGSRGCCSKEDAADARR

SEQ ID NO: 1537735 - protein, 22 aa, Mycobacterium tuberculosis
TAQGTGSGAGIAQAAAGTVNIG

SEQ ID NO: 1537736 - protein, 10 aa, Mycobacterium tuberculosis
TDSSPSSDAE

SEQ ID NO: 1537737 - protein, 4 aa, Mycobacterium tuberculosis
TEAD

SEQ ID NO: 1537738 - protein, 13 aa, Mycobacterium tuberculosis
TEPSLSGPGRDDL

SEQ ID NO: 1537739 - protein, 15 aa, Mycobacterium tuberculosis
TFPQSAAADSTEDFP

SEQ ID NO: 1537740 - protein, 13 aa, Mycobacterium tuberculosis
TGDHQAAKGDGDF

SEQ ID NO: 1537741 - protein, 4 aa, Mycobacterium tuberculosis
TGDM

SEQ ID NO: 1537742 - protein, 6 aa, Mycobacterium tuberculosis
TGEGRA

SEQ ID NO: 1537743 - protein, 9 aa, Mycobacterium tuberculosis
TGPWTGPAS

SEQ ID NO: 1537744 - protein, 17 aa, Mycobacterium tuberculosis
TGQHTTRTAASTTYTPH

SEQ ID NO: 1537745 - protein, 12 aa, Mycobacterium tuberculosis
TGRADDVVRPTD

SEQ ID NO: 1537746 - protein, 4 aa, Mycobacterium tuberculosis
TGSA

SEQ ID NO: 1537747 - protein, 4 aa, Mycobacterium tuberculosis
TGWG

SEQ ID NO: 1537748 - protein, 4 aa, Mycobacterium tuberculosis
TIET

SEQ ID NO: 1537749 - protein, 12 aa, Mycobacterium tuberculosis
TIPGSISGTEFN

SEQ ID NO: 1537750 - protein, 18 aa, Mycobacterium tuberculosis
TKSGGTRTGNVTLAEGPP

SEQ ID NO: 1537751 - protein, 10 aa, Mycobacterium tuberculosis
TNDKDTPGAK

SEQ ID NO: 1537752 - protein, 7 aa, Mycobacterium tuberculosis
TNLTTKQ

SEQ ID NO: 1537753 - protein, 12 aa, Mycobacterium tuberculosis
TPRGDGRLDSPI

SEQ ID NO: 1537754 - protein, 5 aa, Mycobacterium tuberculosis
TPRPP

SEQ ID NO: 1537755 - protein, 6 aa, Mycobacterium tuberculosis
TQAARD

SEQ ID NO: 1537756 - protein, 4 aa, Mycobacterium tuberculosis
TQSA

SEQ ID NO: 1537757 - protein, 8 aa, Mycobacterium tuberculosis
TQSRVGDS

SEQ ID NO: 1537758 - protein, 6 aa, Mycobacterium tuberculosis
TRAFDG

SEQ ID NO: 1537759 - protein, 32 aa, Mycobacterium tuberculosis
TSSGGSIYGTPPEYPTPETAPTDPASPYAAGK

SEQ ID NO: 1537760 - protein, 7 aa, Mycobacterium tuberculosis
TTNPPVE

SEQ ID NO: 1537761 - protein, 4 aa, Mycobacterium tuberculosis
TTTS

SEQ ID NO: 1537762 - protein, 5 aa, Mycobacterium tuberculosis
TTYAA

SEQ ID NO: 1537763 - protein, 11 aa, Mycobacterium tuberculosis
TVQEVDGSDAA

SEQ ID NO: 1537764 - protein, 6 aa, Mycobacterium tuberculosis
VAANGS

SEQ ID NO: 1537765 - protein, 12 aa, Mycobacterium tuberculosis
VDGEGGDQVPLG

SEQ ID NO: 1537766 - protein, 6 aa, Mycobacterium tuberculosis
VDPATG

SEQ ID NO: 1537767 - protein, 8 aa, Mycobacterium tuberculosis
VDRDKDQS

SEQ ID NO: 1537768 - protein, 5 aa, Mycobacterium tuberculosis
VDTEN

SEQ ID NO: 1537769 - protein, 12 aa, Mycobacterium tuberculosis
VGAQSAAQTAPV

SEQ ID NO: 1537770 - protein, 14 aa, Mycobacterium tuberculosis
VGKGGGPDNKVDAD

SEQ ID NO: 1537771 - protein, 7 aa, Mycobacterium tuberculosis
VGSSQAG

SEQ ID NO: 1537772 - protein, 6 aa, Mycobacterium tuberculosis
VPEPPS

SEQ ID NO: 1537773 - protein, 13 aa, Mycobacterium tuberculosis
VSQRAVKDANAAI

SEQ ID NO: 1537774 - protein, 4 aa, Mycobacterium tuberculosis
WDDP

SEQ ID NO: 1537775 - protein, 12 aa, Mycobacterium tuberculosis
YAAWGGADGRTL

SEQ ID NO: 1537776 - protein, 11 aa, Mycobacterium tuberculosis
YAPSGASGKAW

SEQ ID NO: 1537777 - protein, 9 aa, Mycobacterium tuberculosis
YARGETPNP

SEQ ID NO: 1537778 - protein, 13 aa, Mycobacterium tuberculosis
YGVPVNSPNGYRT

SEQ ID NO: 1537779 - protein, 22 aa, Mycobacterium tuberculosis
YPASDDYRASASNGSDDASAHI

SEQ ID NO: 1537780 - protein, 10 aa, Mycobacterium tuberculosis
YPEGIPPTDS

SEQ ID NO: 1537781 - protein, 12 aa, Mycobacterium tuberculosis
YPRTGQGGEPRL

SEQ ID NO: 1537782 - protein, 33 aa, Mycobacterium tuberculosis
AAADPALDAKHRDAARASDRLPHNDRNGEWWHS

SEQ ID NO: 1537783 - protein, 13 aa, Mycobacterium tuberculosis
AAAITSGAAITND

SEQ ID NO: 1537784 - protein, 11 aa, Mycobacterium tuberculosis
AAALTSDDHGT

SEQ ID NO: 1537785 - protein, 6 aa, Mycobacterium tuberculosis
AADDDD

SEQ ID NO: 1537786 - protein, 39 aa, Mycobacterium tuberculosis; identical to SEQ ID NO: 1439854

SEQ ID NO: 1537787 - protein, 12 aa, Mycobacterium tuberculosis
AAGRYASTEAAV

SEQ ID NO: 1537788 - protein, 11 aa, Mycobacterium tuberculosis
AAHESSMSGEE

SEQ ID NO: 1537789 - protein, 6 aa, Mycobacterium tuberculosis
AARQRL

SEQ ID NO: 1537790 - protein, 7 aa, Mycobacterium tuberculosis
AARQTGV

SEQ ID NO: 1537791 - protein, 17 aa, Mycobacterium tuberculosis
AASTRSAVNSGSDLRAS

SEQ ID NO: 1537792 - protein, 12 aa, Mycobacterium tuberculosis
AAYRDAGTARRA

SEQ ID NO: 1537793 - protein, 8 aa, Mycobacterium tuberculosis
ADESPAAA

SEQ ID NO: 1537794 - protein, 4 aa, Mycobacterium tuberculosis
ADQG

SEQ ID NO: 1537795 - protein, 10 aa, Mycobacterium tuberculosis
ADVNPEEGKT

SEQ ID NO: 1537796 - protein, 8 aa, Mycobacterium tuberculosis
AEQGKATA

SEQ ID NO: 1537797 - protein, 33 aa, Mycobacterium tuberculosis; identical to SEQ ID NO: 228901

SEQ ID NO: 1537798 - protein, 6 aa, Mycobacterium tuberculosis
AEVQSI

SEQ ID NO: 1537799 - protein, 8 aa, Mycobacterium tuberculosis
AGETMRPQ

SEQ ID NO: 1537800 - protein, 8 aa, Mycobacterium tuberculosis
AGIPAAPG

SEQ ID NO: 1537801 - protein, 5 aa, Mycobacterium tuberculosis
AGPER

SEQ ID NO: 1537802 - protein, 7 aa, Mycobacterium tuberculosis
AGPQEGW

SEQ ID NO: 1537803 - protein, 14 aa, Mycobacterium tuberculosis
AGPVPSASSVLPAG

SEQ ID NO: 1537804 - protein, 13 aa, Mycobacterium tuberculosis
AGRPGEPAPAVPG

SEQ ID NO: 1537805 - protein, 7 aa, Mycobacterium tuberculosis
AGVEAST

SEQ ID NO: 1537806 - protein, 11 aa, Mycobacterium tuberculosis
AHQPPTPASGC

SEQ ID NO: 1537807 - protein, 5 aa, Mycobacterium tuberculosis
ALPNL

SEQ ID NO: 1537808 - protein, 9 aa, Mycobacterium tuberculosis
ALSGKLNPD

SEQ ID NO: 1537809 - protein, 13 aa, Mycobacterium tuberculosis
ALTKQGRSGRDRQ

SEQ ID NO: 1537810 - protein, 21 aa, Mycobacterium tuberculosis
AMRATDRSSGLPTSAKPARAR

SEQ ID NO: 1537811 - protein, 10 aa, Mycobacterium tuberculosis
ANGVSGSASY

SEQ ID NO: 1537812 - protein, 6 aa, Mycobacterium tuberculosis
ANIPPE

SEQ ID NO: 1537813 - protein, 14 aa, Mycobacterium tuberculosis
ANNPVDKGAAKALA

SEQ ID NO: 1537814 - protein, 25 aa, Mycobacterium tuberculosis
ANSPHTNLGGENPEINTSDDGDHDP

SEQ ID NO: 1537815 - protein, 6 aa, Mycobacterium tuberculosis
APGHTE

SEQ ID NO: 1537816 - protein, 16 aa, Mycobacterium tuberculosis
APGPIDTEATRTVTPA

SEQ ID NO: 1537817 - protein, 4 aa, Mycobacterium tuberculosis
APGT

SEQ ID NO: 1537818 - protein, 20 aa, Mycobacterium tuberculosis
APLAQEREEDDEDDWDEEDD

SEQ ID NO: 1537819 - protein, 11 aa, Mycobacterium tuberculosis
APPDPSPPNLD

SEQ ID NO: 1537820 - protein, 37 aa, Mycobacterium tuberculosis; identical to SEQ ID NO: 229107

SEQ ID NO: 1537821 - protein, 9 aa, Mycobacterium tuberculosis
APPSGQPRV

SEQ ID NO: 1537822 - protein, 7 aa, Mycobacterium tuberculosis
AQGIGQA

SEQ ID NO: 1537823 - protein, 6 aa, Mycobacterium tuberculosis
AQVGTQ

SEQ ID NO: 1537824 - protein, 9 aa, Mycobacterium tuberculosis
AQVKSDRLD

SEQ ID NO: 1537825 - protein, 10 aa, Mycobacterium tuberculosis
ARGASTSKEV

SEQ ID NO: 1537826 - protein, 5 aa, Mycobacterium tuberculosis
ARGDV

SEQ ID NO: 1537827 - protein, 7 aa, Mycobacterium tuberculosis
ARSFSGA

SEQ ID NO: 1537828 - protein, 16 aa, Mycobacterium tuberculosis
ASAEATDSKAAARLGS

SEQ ID NO: 1537829 - protein, 8 aa, Mycobacterium tuberculosis
ASDAGTHH

SEQ ID NO: 1537830 - protein, 6 aa, Mycobacterium tuberculosis
ASDDRA

SEQ ID NO: 1537831 - protein, 11 aa, Mycobacterium tuberculosis
ASDTSNGRTPG

SEQ ID NO: 1537832 - protein, 4 aa, Mycobacterium tuberculosis
ASPY

SEQ ID NO: 1537833 - protein, 69 aa, Mycobacterium tuberculosis; identical to SEQ ID NO: 229220

SEQ ID NO: 1537834 - protein, 4 aa, Mycobacterium tuberculosis
ATFR

SEQ ID NO: 1537835 - protein, 5 aa, Mycobacterium tuberculosis
ATIAA

SEQ ID NO: 1537836 - protein, 8 aa, Mycobacterium tuberculosis
ATSRRKDQ

SEQ ID NO: 1537837 - protein, 11 aa, Mycobacterium tuberculosis
AVSEQSPNYRD

SEQ ID NO: 1537838 - protein, 14 aa, Mycobacterium tuberculosis
CNGYPAGDMSVWNW

SEQ ID NO: 1537839 - protein, 6 aa, Mycobacterium tuberculosis
CNPSRP

SEQ ID NO: 1537840 - protein, 5 aa, Mycobacterium tuberculosis
DAGGE

SEQ ID NO: 1537841 - protein, 16 aa, Mycobacterium tuberculosis
DAPPGTCRASRSMPNS

SEQ ID NO: 1537842 - protein, 5 aa, Mycobacterium tuberculosis
DCGRD

SEQ ID NO: 1537843 - protein, 7 aa, Mycobacterium tuberculosis
DEGHSAK

SEQ ID NO: 1537844 - protein, 4 aa, Mycobacterium tuberculosis
DEHR

SEQ ID NO: 1537845 - protein, 17 aa, Mycobacterium tuberculosis
DENGRMTGYDLKYPDGG

SEQ ID NO: 1537846 - protein, 12 aa, Mycobacterium tuberculosis
DGPAAADPNQDD

SEQ ID NO: 1537847 - protein, 6 aa, Mycobacterium tuberculosis
DGTGGT

SEQ ID NO: 1537848 - protein, 5 aa, Mycobacterium tuberculosis
DGVTP

SEQ ID NO: 1537849 - protein, 6 aa, Mycobacterium tuberculosis
DHDRLG

SEQ ID NO: 1537850 - protein, 19 aa, Mycobacterium tuberculosis
DLAGTSARVRAKRPDGDWG

SEQ ID NO: 1537851 - protein, 11 aa, Mycobacterium tuberculosis
DLYGGNEPSRT

SEQ ID NO: 1537852 - protein, 4 aa, Mycobacterium tuberculosis
DNGS

SEQ ID NO: 1537853 - protein, 15 aa, Mycobacterium tuberculosis
DNTTITGSATSGGFC

SEQ ID NO: 1537854 - protein, 4 aa, Mycobacterium tuberculosis
DPAV

SEQ ID NO: 1537855 - protein, 6 aa, Mycobacterium tuberculosis
DPFRRP

SEQ ID NO: 1537856 - protein, 8 aa, Mycobacterium tuberculosis
DPSANPYL

SEQ ID NO: 1537857 - protein, 8 aa, Mycobacterium tuberculosis
DPTAPEIP

SEQ ID NO: 1537858 - protein, 31 aa, Mycobacterium tuberculosis; identical to SEQ ID NO: 1370469

SEQ ID NO: 1537859 - protein, 4 aa, Mycobacterium tuberculosis
DPVP

SEQ ID NO: 1537860 - protein, 5 aa, Mycobacterium tuberculosis
DQTYP

SEQ ID NO: 1537861 - protein, 17 aa, Mycobacterium tuberculosis
DRSAPRPNARASGRSIG

SEQ ID NO: 1537862 - protein, 9 aa, Mycobacterium tuberculosis
DSGAHARSA

SEQ ID NO: 1537863 - protein, 6 aa, Mycobacterium tuberculosis
DSGHNT

SEQ ID NO: 1537864 - protein, 8 aa, Mycobacterium tuberculosis
DSHPETNQ

SEQ ID NO: 1537865 - protein, 5 aa, Mycobacterium tuberculosis
DTPWR

SEQ ID NO: 1537866 - protein, 5 aa, Mycobacterium tuberculosis
DTSPV

SEQ ID NO: 1537867 - protein, 10 aa, Mycobacterium tuberculosis
DVDDVRDGAV

SEQ ID NO: 1537868 - protein, 7 aa, Mycobacterium tuberculosis
EDEVSAA

SEQ ID NO: 1537869 - protein, 10 aa, Mycobacterium tuberculosis
EDSHRSHTGA

SEQ ID NO: 1537870 - protein, 6 aa, Mycobacterium tuberculosis
EGFETG

SEQ ID NO: 1537871 - protein, 12 aa, Mycobacterium tuberculosis
EGKREEAERDAH

SEQ ID NO: 1537872 - protein, 10 aa, Mycobacterium tuberculosis
EIERDGRPAA

SEQ ID NO: 1537873 - protein, 4 aa, Mycobacterium tuberculosis
EIPA

SEQ ID NO: 1537874 - protein, 7 aa, Mycobacterium tuberculosis
ELPGEPP

SEQ ID NO: 1537875 - protein, 9 aa, Mycobacterium tuberculosis
ELSGPPADG

SEQ ID NO: 1537876 - protein, 9 aa, Mycobacterium tuberculosis
ENALPGSIS

SEQ ID NO: 1537877 - protein, 7 aa, Mycobacterium tuberculosis
ENRSQAA

SEQ ID NO: 1537878 - protein, 7 aa, Mycobacterium tuberculosis
EPGGSFN

SEQ ID NO: 1537879 - protein, 17 aa, Mycobacterium tuberculosis
ERPVPSNLPKPSPGMDP

SEQ ID NO: 1537880 - protein, 8 aa, Mycobacterium tuberculosis
ETANATPL

SEQ ID NO: 1537881 - protein, 4 aa, Mycobacterium tuberculosis
EVEN

SEQ ID NO: 1537882 - protein, 18 aa, Mycobacterium tuberculosis
FDGEDEVTGPDADRARAA

SEQ ID NO: 1537883 - protein, 10 aa, Mycobacterium tuberculosis
FQDRPDGSLI

SEQ ID NO: 1537884 - protein, 5 aa, Mycobacterium tuberculosis
GAARR

SEQ ID NO: 1537885 - protein, 7 aa, Mycobacterium tuberculosis
GAEVSDT

SEQ ID NO: 1537886 - protein, 9 aa, Mycobacterium tuberculosis
GAGAGMPGG

SEQ ID NO: 1537887 - protein, 8 aa, Mycobacterium tuberculosis
GAHTPAAV

SEQ ID NO: 1537888 - protein, 4 aa, Mycobacterium tuberculosis
GALT

SEQ ID NO: 1537889 - protein, 21 aa, Mycobacterium tuberculosis
GCGAGQISQTANQKPAVNGNR

SEQ ID NO: 1537890 - protein, 6 aa, Mycobacterium tuberculosis
GDNPQT

SEQ ID NO: 1537891 - protein, 9 aa, Mycobacterium tuberculosis
GDPICSDGN

SEQ ID NO: 1537892 - protein, 18 aa, Mycobacterium tuberculosis
GDQYNAGRHVPPAEAKRG

SEQ ID NO: 1537893 - protein, 6 aa, Mycobacterium tuberculosis
GEGTGL

SEQ ID NO: 1537894 - protein, 13 aa, Mycobacterium tuberculosis
GGTASATFGGDRQ

SEQ ID NO: 1537895 - protein, 4 aa, Mycobacterium tuberculosis
GHDA

SEQ ID NO: 1537896 - protein, 11 aa, Mycobacterium tuberculosis
GHGNSTTIGAE

SEQ ID NO: 1537897 - protein, 4 aa, Mycobacterium tuberculosis
GIDL

SEQ ID NO: 1537898 - protein, 8 aa, Mycobacterium tuberculosis
GIGPSAQR

SEQ ID NO: 1537899 - protein, 8 aa, Mycobacterium tuberculosis
GKKSLSDF

SEQ ID NO: 1537900 - protein, 11 aa, Mycobacterium tuberculosis
GKLNNKPDAAA

SEQ ID NO: 1537901 - protein, 22 aa, Mycobacterium tuberculosis
GLTPAAPAAAAAPALTPSIPGV

SEQ ID NO: 1537902 - protein, 9 aa, Mycobacterium tuberculosis
GNAGDRSMR

SEQ ID NO: 1537903 - protein, 47 aa, Mycobacterium tuberculosis
GNGGNGYSATASGVGGGAGGSAGLIGNGGAGGAGGPNAPGGAGGNGG

SEQ ID NO: 1537904 - protein, 5 aa, Mycobacterium tuberculosis
GNSTF

SEQ ID NO: 1537905 - protein, 9 aa, Mycobacterium tuberculosis
GPAGGDRTT

SEQ ID NO: 1537906 - protein, 5 aa, Mycobacterium tuberculosis
GPNLA

SEQ ID NO: 1537907 - protein, 15 aa, Mycobacterium tuberculosis
GQRTGVGLPGESAGL

SEQ ID NO: 1537908 - protein, 8 aa, Mycobacterium tuberculosis
GQSDVDPA

SEQ ID NO: 1537909 - protein, 16 aa, Mycobacterium tuberculosis
GRDPRGGNVDTTINPR

SEQ ID NO: 1537910 - protein, 6 aa, Mycobacterium tuberculosis
GSDDIV

SEQ ID NO: 1537911 - protein, 4 aa, Mycobacterium tuberculosis
GSGA

SEQ ID NO: 1537912 - protein, 5 aa, Mycobacterium tuberculosis
GSPGG

SEQ ID NO: 1537913 - protein, 10 aa, Mycobacterium tuberculosis
GSRPATSLTG

SEQ ID NO: 1537914 - protein, 7 aa, Mycobacterium tuberculosis
GSTPDSE

SEQ ID NO: 1537915 - protein, 13 aa, Mycobacterium tuberculosis
GTPAALGADAASI

SEQ ID NO: 1537916 - protein, 18 aa, Mycobacterium tuberculosis
GTWPSGTTVHANPDGTAF

SEQ ID NO: 1537917 - protein, 8 aa, Mycobacterium tuberculosis
GVETRTGV

SEQ ID NO: 1537918 - protein, 8 aa, Mycobacterium tuberculosis
GVNKPSMP

SEQ ID NO: 1537919 - protein, 7 aa, Mycobacterium tuberculosis
GVNPADL

SEQ ID NO: 1537920 - protein, 4 aa, Mycobacterium tuberculosis
GVTA

SEQ ID NO: 1537921 - protein, 4 aa, Mycobacterium tuberculosis
GWAP

SEQ ID NO: 1537922 - protein, 13 aa, Mycobacterium tuberculosis
GWNPETQALDPTG

SEQ ID NO: 1537923 - protein, 20 aa, Mycobacterium tuberculosis
GWTTSDVAATDPGVADGAAA

SEQ ID NO: 1537924 - protein, 9 aa, Mycobacterium tuberculosis
HAAAASTVQ

SEQ ID NO: 1537925 - protein, 5 aa, Mycobacterium tuberculosis
HGRTP

SEQ ID NO: 1537926 - protein, 5 aa, Mycobacterium tuberculosis
HGTAD

SEQ ID NO: 1537927 - protein, 6 aa, Mycobacterium tuberculosis
HHGTYR

SEQ ID NO: 1537928 - protein, 14 aa, Mycobacterium tuberculosis
HKVAPSAAEQQSMS

SEQ ID NO: 1537929 - protein, 24 aa, Mycobacterium tuberculosis
HPAWQSAANDVNAKDARMKAICGG

SEQ ID NO: 1537930 - protein, 4 aa, Mycobacterium tuberculosis
HPHL

SEQ ID NO: 1537931 - protein, 26 aa, Mycobacterium tuberculosis
HPRPSSAGDGYDAAASSGSNLGPTNE

SEQ ID NO: 1537932 - protein, 6 aa, Mycobacterium tuberculosis
HSGVPG

SEQ ID NO: 1537933 - protein, 4 aa, Mycobacterium tuberculosis
HSTR

SEQ ID NO: 1537934 - protein, 9 aa, Mycobacterium tuberculosis
IASAGANAF

SEQ ID NO: 1537935 - protein, 13 aa, Mycobacterium tuberculosis
IEPRGAQALPPGG

SEQ ID NO: 1537936 - protein, 8 aa, Mycobacterium tuberculosis
INTGNGYY

SEQ ID NO: 1537937 - protein, 5 aa, Mycobacterium tuberculosis
ISGYS

SEQ ID NO: 1537938 - protein, 8 aa, Mycobacterium tuberculosis
ITDARSST

SEQ ID NO: 1537939 - protein, 4 aa, Mycobacterium tuberculosis
KATV

SEQ ID NO: 1537940 - protein, 5 aa, Mycobacterium tuberculosis
KFRTG

SEQ ID NO: 1537941 - protein, 13 aa, Mycobacterium tuberculosis
KGLGSGGAKGCPK

SEQ ID NO: 1537942 - protein, 8 aa, Mycobacterium tuberculosis
KGTDTGQA

SEQ ID NO: 1537943 - protein, 4 aa, Mycobacterium tuberculosis
KIAN

SEQ ID NO: 1537944 - protein, 6 aa, Mycobacterium tuberculosis
KLADTQ

SEQ ID NO: 1537945 - protein, 14 aa, Mycobacterium tuberculosis
KRGGGAIVNQSSTA

SEQ ID NO: 1537946 - protein, 11 aa, Mycobacterium tuberculosis
KVDGSGGIRGP

SEQ ID NO: 1537947 - protein, 5 aa, Mycobacterium tuberculosis
KVNKN

SEQ ID NO: 1537948 - protein, 6 aa, Mycobacterium tuberculosis
KVSQTS

SEQ ID NO: 1537949 - protein, 9 aa, Mycobacterium tuberculosis
LAQADREHA

SEQ ID NO: 1537950 - protein, 11 aa, Mycobacterium tuberculosis
LAQSGPPAEAV

SEQ ID NO: 1537951 - protein, 6 aa, Mycobacterium tuberculosis
LAQTGY

SEQ ID NO: 1537952 - protein, 6 aa, Mycobacterium tuberculosis
LAREGA

SEQ ID NO: 1537953 - protein, 5 aa, Mycobacterium tuberculosis
LATPR

SEQ ID NO: 1537954 - protein, 10 aa, Mycobacterium tuberculosis
LDPGADGTYP

SEQ ID NO: 1537955 - protein, 8 aa, Mycobacterium tuberculosis
LGANGATL

SEQ ID NO: 1537956 - protein, 5 aa, Mycobacterium tuberculosis
LGDGE

SEQ ID NO: 1537957 - protein, 9 aa, Mycobacterium tuberculosis
LGGRELGAG

SEQ ID NO: 1537958 - protein, 27 aa, Mycobacterium tuberculosis
LGPAPGPAPPPAAPGPPAPPGPGPQLP

SEQ ID NO: 1537959 - protein, 6 aa, Mycobacterium tuberculosis
LGRNSA

SEQ ID NO: 1537960 - protein, 11 aa, Mycobacterium tuberculosis
LGSSAGRHADE

SEQ ID NO: 1537961 - protein, 9 aa, Mycobacterium tuberculosis
LLGGDGGDI

SEQ ID NO: 1537962 - protein, 22 aa, Mycobacterium tuberculosis
LPATNGPSGARPDAPAASGTVI

SEQ ID NO: 1537963 - protein, 5 aa, Mycobacterium tuberculosis
LPGGS

SEQ ID NO: 1537964 - protein, 9 aa, Mycobacterium tuberculosis
LSKSSLHPA

SEQ ID NO: 1537965 - protein, 7 aa, Mycobacterium tuberculosis
LTSRDQI

SEQ ID NO: 1537966 - protein, 5 aa, Mycobacterium tuberculosis
LTTGR

SEQ ID NO: 1537967 - protein, 5 aa, Mycobacterium tuberculosis
MADPA

SEQ ID NO: 1537968 - protein, 18 aa, Mycobacterium tuberculosis
MDATSEQHSSGQPPQATR

SEQ ID NO: 1537969 - protein, 5 aa, Mycobacterium tuberculosis
MGEKD

SEQ ID NO: 1537970 - protein, 5 aa, Mycobacterium tuberculosis
NAGAK

SEQ ID NO: 1537971 - protein, 6 aa, Mycobacterium tuberculosis
NALPRR

SEQ ID NO: 1537972 - protein, 18 aa, Mycobacterium tuberculosis
NATDPGAAAQFNASPVAQ

SEQ ID NO: 1537973 - protein, 10 aa, Mycobacterium tuberculosis
NDTSLSRNGY

SEQ ID NO: 1537974 - protein, 17 aa, Mycobacterium tuberculosis
NGANGLPNTGQDGGPGG

SEQ ID NO: 1537975 - protein, 8 aa, Mycobacterium tuberculosis
NGGANDGW

SEQ ID NO: 1537976 - protein, 4 aa, Mycobacterium tuberculosis
NGGE

SEQ ID NO: 1537977 - protein, 23 aa, Mycobacterium tuberculosis
NGGNGGAGDAAHPNGGNGGDAGM

SEQ ID NO: 1537978 - protein, 25 aa, Mycobacterium tuberculosis
NGGPGGAGGIGTTGDGGPGGAGGNA

SEQ ID NO: 1537979 - protein, 5 aa, Mycobacterium tuberculosis
NGRFT

SEQ ID NO: 1537980 - protein, 8 aa, Mycobacterium tuberculosis
NGTSGPLR

SEQ ID NO: 1537981 - protein, 14 aa, Mycobacterium tuberculosis
NGVYGQTRETKRAG

SEQ ID NO: 1537982 - protein, 5 aa, Mycobacterium tuberculosis
NNNVD

SEQ ID NO: 1537983 - protein, 8 aa, Mycobacterium tuberculosis
NNQRGDLT

SEQ ID NO: 1537984 - protein, 21 aa, Mycobacterium tuberculosis
NPASAPPEPPDLSASRSAIDS

SEQ ID NO: 1537985 - protein, 24 aa, Mycobacterium tuberculosis
NPDGSKQPVLRNDGTPIPDQVDSV

SEQ ID NO: 1537986 - protein, 15 aa, Mycobacterium tuberculosis
NPGGTGGSGVTGGSE

SEQ ID NO: 1537987 - protein, 6 aa, Mycobacterium tuberculosis
NSDPFY

SEQ ID NO: 1537988 - protein, 11 aa, Mycobacterium tuberculosis
NTGGLPPGTPA

SEQ ID NO: 1537989 - protein, 6 aa, Mycobacterium tuberculosis
NYRGSM

SEQ ID NO: 1537990 - protein, 24 aa, Mycobacterium tuberculosis
PAAIPTGPDSAPANAPRIASPTEA

SEQ ID NO: 1537991 - protein, 7 aa, Mycobacterium tuberculosis
PAERRDY

SEQ ID NO: 1537992 - protein, 5 aa, Mycobacterium tuberculosis
PDELR

SEQ ID NO: 1537993 - protein, 20 aa, Mycobacterium tuberculosis
PDGSPKPAGTRLTNPAYSKT

SEQ ID NO: 1537994 - protein, 7 aa, Mycobacterium tuberculosis
PDSGTHS

SEQ ID NO: 1537995 - protein, 4 aa, Mycobacterium tuberculosis
PDVN

SEQ ID NO: 1537996 - protein, 4 aa, Mycobacterium tuberculosis
PDWQ

SEQ ID NO: 1537997 - protein, 13 aa, Mycobacterium tuberculosis
PEAFDDQGNYRNQ

SEQ ID NO: 1537998 - protein, 6 aa, Mycobacterium tuberculosis
PELSGG

SEQ ID NO: 1537999 - protein, 6 aa, Mycobacterium tuberculosis
PGFHGQ

SEQ ID NO: 1538000 - protein, 12 aa, Mycobacterium tuberculosis
PGPVPAAAPVPI

SEQ ID NO: 1538001 - protein, 4 aa, Mycobacterium tuberculosis
PLPG

SEQ ID NO: 1538002 - protein, 14 aa, Mycobacterium tuberculosis
PLSPDPGPPLVLQA

SEQ ID NO: 1538003 - protein, 8 aa, Mycobacterium tuberculosis
PNAPQPVR

SEQ ID NO: 1538004 - protein, 18 aa, Mycobacterium tuberculosis
PNLSGPVNLTGPAPVTNA

SEQ ID NO: 1538005 - protein, 25 aa, Mycobacterium tuberculosis
PPVEPVSPTNPRSSASPGSPDRSGL

SEQ ID NO: 1538006 - protein, 4 aa, Mycobacterium tuberculosis
PQAF

SEQ ID NO: 1538007 - protein, 9 aa, Mycobacterium tuberculosis
PQSSGIGGG

SEQ ID NO: 1538008 - protein, 8 aa, Mycobacterium tuberculosis
PRERPSFT

SEQ ID NO: 1538009 - protein, 7 aa, Mycobacterium tuberculosis
PSAAAAD

SEQ ID NO: 1538010 - protein, 21 aa, Mycobacterium tuberculosis
PSPGSSTPVGQLPPAATQTLG

SEQ ID NO: 1538011 - protein, 7 aa, Mycobacterium tuberculosis
PSQAMGP

SEQ ID NO: 1538012 - protein, 19 aa, Mycobacterium tuberculosis
PVPIPGGPVPIPGAPVPVP

SEQ ID NO: 1538013 - protein, 9 aa, Mycobacterium tuberculosis
QAADPRSDL

SEQ ID NO: 1538014 - protein, 12 aa, Mycobacterium tuberculosis
QANPAPPVGPAL

SEQ ID NO: 1538015 - protein, 9 aa, Mycobacterium tuberculosis
QAQGQAKAI

SEQ ID NO: 1538016 - protein, 9 aa, Mycobacterium tuberculosis
QARTRSVAN

SEQ ID NO: 1538017 - protein, 15 aa, Mycobacterium tuberculosis
QASPSRIDGTHQTLQ

SEQ ID NO: 1538018 - protein, 14 aa, Mycobacterium tuberculosis
QDGTPVPACSRGTL

SEQ ID NO: 1538019 - protein, 13 aa, Mycobacterium tuberculosis
QDPVATAASNNPM

SEQ ID NO: 1538020 - protein, 21 aa, Mycobacterium tuberculosis
QLDNAAPDDVEITDSSAAAEY

SEQ ID NO: 1538021 - protein, 4 aa, Mycobacterium tuberculosis
QQAT

SEQ ID NO: 1538022 - protein, 12 aa, Mycobacterium tuberculosis
QQNTAGSGAGFG

SEQ ID NO: 1538023 - protein, 5 aa, Mycobacterium tuberculosis
QRPPA

SEQ ID NO: 1538024 - protein, 6 aa, Mycobacterium tuberculosis
QSIQAA

SEQ ID NO: 1538025 - protein, 4 aa, Mycobacterium tuberculosis
RAKR

SEQ ID NO: 1538026 - protein, 18 aa, Mycobacterium tuberculosis
RANGGSGSAANASREEQI

SEQ ID NO: 1538027 - protein, 34 aa, Mycobacterium tuberculosis
RARTERVNTESAARLAKQKADKAAADAKASQDAA

SEQ ID NO: 1538028 - protein, 6 aa, Mycobacterium tuberculosis
RAVQPD

SEQ ID NO: 1538029 - protein, 11 aa, Mycobacterium tuberculosis
RDADARQARNQ

SEQ ID NO: 1538030 - protein, 11 aa, Mycobacterium tuberculosis
RDGGGLDGDAA

SEQ ID NO: 1538031 - protein, 6 aa, Mycobacterium tuberculosis
RDPDDF

SEQ ID NO: 1538032 - protein, 8 aa, Mycobacterium tuberculosis
RDRIGTAN

SEQ ID NO: 1538033 - protein, 9 aa, Mycobacterium tuberculosis
RDSRITPTE

SEQ ID NO: 1538034 - protein, 12 aa, Mycobacterium tuberculosis
RNGNEVAVTTET

SEQ ID NO: 1538035 - protein, 6 aa, Mycobacterium tuberculosis
RNSRDS

SEQ ID NO: 1538036 - protein, 11 aa, Mycobacterium tuberculosis
RPGPLRPAERR

SEQ ID NO: 1538037 - protein, 6 aa, Mycobacterium tuberculosis
RPPTSF

SEQ ID NO: 1538038 - protein, 4 aa, Mycobacterium tuberculosis
RRGP

SEQ ID NO: 1538039 - protein, 12 aa, Mycobacterium tuberculosis
RRPRPARAVPTG

SEQ ID NO: 1538040 - protein, 8 aa, Mycobacterium tuberculosis
RSGLPDHA

SEQ ID NO: 1538041 - protein, 4 aa, Mycobacterium tuberculosis
RTGG

SEQ ID NO: 1538042 - protein, 9 aa, Mycobacterium tuberculosis
RTGKLNDGS

SEQ ID NO: 1538043 - protein, 5 aa, Mycobacterium tuberculosis
RTTLG

SEQ ID NO: 1538044 - protein, 19 aa, Mycobacterium tuberculosis
RYGDLDPAQLADKFRMAWS

SEQ ID NO: 1538045 - protein, 13 aa, Mycobacterium tuberculosis
SAANGAAAPTTAG

SEQ ID NO: 1538046 - protein, 23 aa, Mycobacterium tuberculosis
SAEPDGANRPPPPIAGPRTPVAG

SEQ ID NO: 1538047 - protein, 7 aa, Mycobacterium tuberculosis
SAPAGVT

SEQ ID NO: 1538048 - protein, 6 aa, Mycobacterium tuberculosis
SAPVAA

SEQ ID NO: 1538049 - protein, 9 aa, Mycobacterium tuberculosis
SDADGVSVP

SEQ ID NO: 1538050 - protein, 9 aa, Mycobacterium tuberculosis
SDPSKPNGQ

SEQ ID NO: 1538051 - protein, 6 aa, Mycobacterium tuberculosis
SDSGRA

SEQ ID NO: 1538052 - protein, 8 aa, Mycobacterium tuberculosis
SEADPLTA

SEQ ID NO: 1538053 - protein, 6 aa, Mycobacterium tuberculosis
SEHERA

SEQ ID NO: 1538054 - protein, 4 aa, Mycobacterium tuberculosis
SERR

SEQ ID NO: 1538055 - protein, 18 aa, Mycobacterium tuberculosis
SGDPARALGPPPDGSYSF

SEQ ID NO: 1538056 - protein, 29 aa, Mycobacterium tuberculosis
SGGTGGMGGVGGMGGVGNGGNAGNGGTAG

SEQ ID NO: 1538057 - protein, 5 aa, Mycobacterium tuberculosis
SGLGI

SEQ ID NO: 1538058 - protein, 5 aa, Mycobacterium tuberculosis
SHPEF

SEQ ID NO: 1538059 - protein, 11 aa, Mycobacterium tuberculosis
SHQEGEPARRA

SEQ ID NO: 1538060 - protein, 6 aa, Mycobacterium tuberculosis
SHTPQV

SEQ ID NO: 1538061 - protein, 13 aa, Mycobacterium tuberculosis
SPAANAPDAGPPQ

SEQ ID NO: 1538062 - protein, 16 aa, Mycobacterium tuberculosis
SPIGRERKTEELSRAS

SEQ ID NO: 1538063 - protein, 11 aa, Mycobacterium tuberculosis
SPPAEEAPPVP

SEQ ID NO: 1538064 - protein, 14 aa, Mycobacterium tuberculosis
SPTSTVVGGATQSI

SEQ ID NO: 1538065 - protein, 18 aa, Mycobacterium tuberculosis
SPVEDQPKHAADGDDAEV

SEQ ID NO: 1538066 - protein, 7 aa, Mycobacterium tuberculosis
SSAGRGA

SEQ ID NO: 1538067 - protein, 18 aa, Mycobacterium tuberculosis
SSPMAADQQTAGPLAGEL

SEQ ID NO: 1538068 - protein, 24 aa, Mycobacterium tuberculosis
SSTKPVSQDTSPKPATSPAAPVTT

SEQ ID NO: 1538069 - protein, 10 aa, Mycobacterium tuberculosis
STETTERPEH

SEQ ID NO: 1538070 - protein, 10 aa, Mycobacterium tuberculosis
STLSPASAAA

SEQ ID NO: 1538071 - protein, 9 aa, Mycobacterium tuberculosis
STNRGSENF

SEQ ID NO: 1538072 - protein, 17 aa, Mycobacterium tuberculosis
STPERVAGGTCSAGQQC

SEQ ID NO: 1538073 - protein, 10 aa, Mycobacterium tuberculosis
STTPQQITRT

SEQ ID NO: 1538074 - protein, 4 aa, Mycobacterium tuberculosis
SVLP

SEQ ID NO: 1538075 - protein, 7 aa, Mycobacterium tuberculosis
TADDNTK

SEQ ID NO: 1538076 - protein, 4 aa, Mycobacterium tuberculosis
TAFG

SEQ ID NO: 1538077 - protein, 12 aa, Mycobacterium tuberculosis
TANLGRPEPTHD

SEQ ID NO: 1538078 - protein, 7 aa, Mycobacterium tuberculosis
TDNAPIA

SEQ ID NO: 1538079 - protein, 8 aa, Mycobacterium tuberculosis
TDQRDALR

SEQ ID NO: 1538080 - protein, 4 aa, Mycobacterium tuberculosis
TEIG

SEQ ID NO: 1538081 - protein, 4 aa, Mycobacterium tuberculosis
TEPV

SEQ ID NO: 1538082 - protein, 10 aa, Mycobacterium tuberculosis
TGAGGAYAAA

SEQ ID NO: 1538083 - protein, 4 aa, Mycobacterium tuberculosis
TGIP

SEQ ID NO: 1538084 - protein, 5 aa, Mycobacterium tuberculosis
TGPVG

SEQ ID NO: 1538085 - protein, 19 aa, Mycobacterium tuberculosis
TGSVQAYDGREVAPAAATE

SEQ ID NO: 1538086 - protein, 13 aa, Mycobacterium tuberculosis
TIAPNGDVSPPIR

SEQ ID NO: 1538087 - protein, 7 aa, Mycobacterium tuberculosis
TKASSED

SEQ ID NO: 1538088 - protein, 7 aa, Mycobacterium tuberculosis
TKNAINA

SEQ ID NO: 1538089 - protein, 8 aa, Mycobacterium tuberculosis
TNATSEAV

SEQ ID NO: 1538090 - protein, 5 aa, Mycobacterium tuberculosis
TNNHP

SEQ ID NO: 1538091 - protein, 14 aa, Mycobacterium tuberculosis
TPAAGERPESRRQA

SEQ ID NO: 1538092 - protein, 8 aa, Mycobacterium tuberculosis
TPSQTANM

SEQ ID NO: 1538093 - protein, 5 aa, Mycobacterium tuberculosis
TQDTP

SEQ ID NO: 1538094 - protein, 4 aa, Mycobacterium tuberculosis
TQRL

SEQ ID NO: 1538095 - protein, 8 aa, Mycobacterium tuberculosis
TSGGSGPA

SEQ ID NO: 1538096 - protein, 10 aa, Mycobacterium tuberculosis
TSSSRAGECE

SEQ ID NO: 1538097 - protein, 7 aa, Mycobacterium tuberculosis
TSTPPGM

SEQ ID NO: 1538098 - protein, 5 aa, Mycobacterium tuberculosis
TTATG

SEQ ID NO: 1538099 - protein, 19 aa, Mycobacterium tuberculosis
VAAPATAELAPAAADEVSA

SEQ ID NO: 1538100 - protein, 5 aa, Mycobacterium tuberculosis
VAKGT

SEQ ID NO: 1538101 - protein, 7 aa, Mycobacterium tuberculosis
VDNDETV

SEQ ID NO: 1538102 - protein, 9 aa, Mycobacterium tuberculosis
VDNPGPSDY

SEQ ID NO: 1538103 - protein, 4 aa, Mycobacterium tuberculosis
VGAN

SEQ ID NO: 1538104 - protein, 14 aa, Mycobacterium tuberculosis
VGAQSTSVASASDV

SEQ ID NO: 1538105 - protein, 19 aa, Mycobacterium tuberculosis
VGGASLTASLGEASSVGGL

SEQ ID NO: 1538106 - protein, 7 aa, Mycobacterium tuberculosis
VGKPSLE

SEQ ID NO: 1538107 - protein, 5 aa, Mycobacterium tuberculosis
VGQIG

SEQ ID NO: 1538108 - protein, 12 aa, Mycobacterium tuberculosis
VGTSPSGQTIPG

SEQ ID NO: 1538109 - protein, 21 aa, Mycobacterium tuberculosis
VLPSETTVDPTQLSDVDRDRA

SEQ ID NO: 1538110 - protein, 12 aa, Mycobacterium tuberculosis
VNPDGDQGGPQI

SEQ ID NO: 1538111 - protein, 6 aa, Mycobacterium tuberculosis
VNPGAR

SEQ ID NO: 1538112 - protein, 5 aa, Mycobacterium tuberculosis
VNRPT

SEQ ID NO: 1538113 - protein, 5 aa, Mycobacterium tuberculosis
VPAEG

SEQ ID NO: 1538114 - protein, 5 aa, Mycobacterium tuberculosis
VPPTW

SEQ ID NO: 1538115 - protein, 11 aa, Mycobacterium tuberculosis
VTGSGSGLDPA

SEQ ID NO: 1538116 - protein, 18 aa, Mycobacterium tuberculosis
VTMPDSNSVKARELSGSS

SEQ ID NO: 1538117 - protein, 5 aa, Mycobacterium tuberculosis
VTPIP

SEQ ID NO: 1538118 - protein, 14 aa, Mycobacterium tuberculosis
YAPSKVDLNGGRPT

SEQ ID NO: 1538119 - protein, 8 aa, Mycobacterium tuberculosis
YGAGPCSG

SEQ ID NO: 1538120 - protein, 14 aa, Mycobacterium tuberculosis
YGNAATLTTTVESS

SEQ ID NO: 1538121 - protein, 4 aa, Mycobacterium tuberculosis
YGQA

SEQ ID NO: 1538122 - protein, 5 aa, Mycobacterium tuberculosis
YGVRP

SEQ ID NO: 1538123 - protein, 5 aa, Mycobacterium tuberculosis
YNYPP

SEQ ID NO: 1538124 - protein, 4 aa, Mycobacterium tuberculosis
YPGD

SEQ ID NO: 1538125 - protein, 27 aa, Mycobacterium tuberculosis
YPPGKSREEIENDNAADFKRSEAAAEY

SEQ ID NO: 1538126 - protein, 20 aa, Mycobacterium tuberculosis
YPQTTPVQESGPARPIPSGI

SEQ ID NO: 1538127 - protein, 12 aa, Mycobacterium tuberculosis
YPTRAAAEATAV

SEQ ID NO: 1538128 - protein, 7 aa, Mycobacterium tuberculosis
YRPRDER

SEQ ID NO: 1538129 - protein, 8 aa, Mycobacterium tuberculosis
YRRTDGQW

SEQ ID NO: 1538130 - protein, 7 aa, Mycobacterium tuberculosis
YSGSQYN

SEQ ID NO: 1538131 - protein, 28 aa, Mycobacterium tuberculosis
YTSGTGQGNASATKDGSHYKITGTATGV

SEQ ID NO: 1538132 - protein, 9 aa, Mycobacterium tuberculosis
YWGPPSKPG

SEQ ID NO: 1538133 - protein, 8 aa, Mycobacterium tuberculosis
AAAVTTPG

SEQ ID NO: 1538134 - protein, 8 aa, Mycobacterium tuberculosis
AAFGPNPL

SEQ ID NO: 1538135 - protein, 7 aa, Mycobacterium tuberculosis
AAGRGTR

SEQ ID NO: 1538136 - protein, 7 aa, Mycobacterium tuberculosis
AANLRSD

SEQ ID NO: 1538137 - protein, 4 aa, Mycobacterium tuberculosis
ADHS

SEQ ID NO: 1538138 - protein, 7 aa, Mycobacterium tuberculosis
ADPNVSF

SEQ ID NO: 1538139 - protein, 10 aa, Mycobacterium tuberculosis
AEPDSSDRDI

SEQ ID NO: 1538140 - protein, 4 aa, Mycobacterium tuberculosis
AEQG

SEQ ID NO: 1538141 - protein, 9 aa, Mycobacterium tuberculosis
AGGARPIGT

SEQ ID NO: 1538142 - protein, 8 aa, Mycobacterium tuberculosis
AGGDCGRC

SEQ ID NO: 1538143 - protein, 7 aa, Mycobacterium tuberculosis
AGGDEVS

SEQ ID NO: 1538144 - protein, 6 aa, Mycobacterium tuberculosis
AGGSDV

SEQ ID NO: 1538145 - protein, 8 aa, Mycobacterium tuberculosis
AGPRPEMA

SEQ ID NO: 1538146 - protein, 7 aa, Mycobacterium tuberculosis
AGSAQRR

SEQ ID NO: 1538147 - protein, 8 aa, Mycobacterium tuberculosis
AGSGPTLA

SEQ ID NO: 1538148 - protein, 5 aa, Mycobacterium tuberculosis
AIDST

SEQ ID NO: 1538149 - protein, 7 aa, Mycobacterium tuberculosis
ANGEERS

SEQ ID NO: 1538150 - protein, 4 aa, Mycobacterium tuberculosis
ANQD

SEQ ID NO: 1538151 - protein, 8 aa, Mycobacterium tuberculosis
ANTGSNNI

SEQ ID NO: 1538152 - protein, 9 aa, Mycobacterium tuberculosis
APDGTALPR

SEQ ID NO: 1538153 - protein, 6 aa, Mycobacterium tuberculosis
APGPGE

SEQ ID NO: 1538154 - protein, 13 aa, Mycobacterium tuberculosis
APTSAAGSNTATT

SEQ ID NO: 1538155 - protein, 7 aa, Mycobacterium tuberculosis
AQTAQTV

SEQ ID NO: 1538156 - protein, 15 aa, Mycobacterium tuberculosis
ARAFQDAKNRADQYA

SEQ ID NO: 1538157 - protein, 9 aa, Mycobacterium tuberculosis
ARAGGDHRR

SEQ ID NO: 1538158 - protein, 6 aa, Mycobacterium tuberculosis
ARAGKM

SEQ ID NO: 1538159 - protein, 24 aa, Mycobacterium tuberculosis
ARPAATPATTSVPTYTAAQTAAAQ

SEQ ID NO: 1538160 - protein, 11 aa, Mycobacterium tuberculosis
ASEAGGKAKSL

SEQ ID NO: 1538161 - protein, 5 aa, Mycobacterium tuberculosis
ASGLP

SEQ ID NO: 1538162 - protein, 6 aa, Mycobacterium tuberculosis
ASTVDE

SEQ ID NO: 1538163 - protein, 7 aa, Mycobacterium tuberculosis
ATDNPVG

SEQ ID NO: 1538164 - protein, 8 aa, Mycobacterium tuberculosis
ATEREALT

SEQ ID NO: 1538165 - protein, 7 aa, Mycobacterium tuberculosis
ATGTTAA

SEQ ID NO: 1538166 - protein, 8 aa, Mycobacterium tuberculosis
ATKAGLPA

SEQ ID NO: 1538167 - protein, 12 aa, Mycobacterium tuberculosis
AVAAAAGQSWED

SEQ ID NO: 1538168 - protein, 9 aa, Mycobacterium tuberculosis
AVAARGGNG

SEQ ID NO: 1538169 - protein, 13 aa, Mycobacterium tuberculosis
AVETEPGGGDRYG

SEQ ID NO: 1538170 - protein, 12 aa, Mycobacterium tuberculosis
CNDQGDPPYQGT

SEQ ID NO: 1538171 - protein, 25 aa, Mycobacterium tuberculosis
CTSPRSRNRSFGERLGRGETLQSAG

SEQ ID NO: 1538172 - protein, 7 aa, Mycobacterium tuberculosis
DAADAQA

SEQ ID NO: 1538173 - protein, 5 aa, Mycobacterium tuberculosis
DAATA

SEQ ID NO: 1538174 - protein, 5 aa, Mycobacterium tuberculosis
DDPDL

SEQ ID NO: 1538175 - protein, 8 aa, Mycobacterium tuberculosis
DEEGGRVS

SEQ ID NO: 1538176 - protein, 11 aa, Mycobacterium tuberculosis
DEIRAAASTDC

SEQ ID NO: 1538177 - protein, 7 aa, Mycobacterium tuberculosis
DGHPTEH

SEQ ID NO: 1538178 - protein, 9 aa, Mycobacterium tuberculosis
DKSGTSDNF

SEQ ID NO: 1538179 - protein, 5 aa, Mycobacterium tuberculosis
DLAGI

SEQ ID NO: 1538180 - protein, 4 aa, Mycobacterium tuberculosis
DPAG

SEQ ID NO: 1538181 - protein, 8 aa, Mycobacterium tuberculosis
DPDRPLSD

SEQ ID NO: 1538182 - protein, 5 aa, Mycobacterium tuberculosis
DQQPV

SEQ ID NO: 1538183 - protein, 8 aa, Mycobacterium tuberculosis
DSPSVTRA

SEQ ID NO: 1538184 - protein, 19 aa, Mycobacterium tuberculosis
DYSGPGSGLGGSDPNGVVS

SEQ ID NO: 1538185 - protein, 28 aa, Mycobacterium tuberculosis
EAARGGWQTVSGSRRNAAYQDGRQTQIS

SEQ ID NO: 1538186 - protein, 7 aa, Mycobacterium tuberculosis
EAVGSGP

SEQ ID NO: 1538187 - protein, 13 aa, Mycobacterium tuberculosis
EGERATADAVGRT

SEQ ID NO: 1538188 - protein, 18 aa, Mycobacterium tuberculosis
EGVAATAATAINANAASK

SEQ ID NO: 1538189 - protein, 4 aa, Mycobacterium tuberculosis
ELGS

SEQ ID NO: 1538190 - protein, 15 aa, Mycobacterium tuberculosis
ELPEAPANRATVPQD

SEQ ID NO: 1538191 - protein, 6 aa, Mycobacterium tuberculosis
ELSDTV

SEQ ID NO: 1538192 - protein, 4 aa, Mycobacterium tuberculosis
EPPR

SEQ ID NO: 1538193 - protein, 5 aa, Mycobacterium tuberculosis
ETETG

SEQ ID NO: 1538194 - protein, 9 aa, Mycobacterium tuberculosis
ETLTGTHTT

SEQ ID NO: 1538195 - protein, 4 aa, Mycobacterium tuberculosis
FGSA

SEQ ID NO: 1538196 - protein, 14 aa, Mycobacterium tuberculosis
FNGATTQTSATDQT

SEQ ID NO: 1538197 - protein, 28 aa, Mycobacterium tuberculosis
FSAEPHATDGSPVANRVEPGKRPRSSMA

SEQ ID NO: 1538198 - protein, 6 aa, Mycobacterium tuberculosis
FSTPPI

SEQ ID NO: 1538199 - protein, 17 aa, Mycobacterium tuberculosis
GADAPSPFGGGAAAEIA

SEQ ID NO: 1538200 - protein, 6 aa, Mycobacterium tuberculosis
GAEPAQ

SEQ ID NO: 1538201 - protein, 14 aa, Mycobacterium tuberculosis
GAGAYAGAEAADAA

SEQ ID NO: 1538202 - protein, 11 aa, Mycobacterium tuberculosis
GALGENGNGGM

SEQ ID NO: 1538203 - protein, 4 aa, Mycobacterium tuberculosis
GAVR

SEQ ID NO: 1538204 - protein, 11 aa, Mycobacterium tuberculosis
GCSADTGDRHP

SEQ ID NO: 1538205 - protein, 16 aa, Mycobacterium tuberculosis
GDGADGTAASPIGEPG

SEQ ID NO: 1538206 - protein, 5 aa, Mycobacterium tuberculosis
GDPGT

SEQ ID NO: 1538207 - protein, 4 aa, Mycobacterium tuberculosis
GELR

SEQ ID NO: 1538208 - protein, 8 aa, Mycobacterium tuberculosis
GGHGPAER

SEQ ID NO: 1538209 - protein, 15 aa, Mycobacterium tuberculosis
GGISGPTRGTGTGIN

SEQ ID NO: 1538210 - protein, 8 aa, Mycobacterium tuberculosis
GGSTDETL

SEQ ID NO: 1538211 - protein, 7 aa, Mycobacterium tuberculosis
GGVEQGL

SEQ ID NO: 1538212 - protein, 4 aa, Mycobacterium tuberculosis
GIGP

SEQ ID NO: 1538213 - protein, 13 aa, Mycobacterium tuberculosis
GINDDTIEQAAEA

SEQ ID NO: 1538214 - protein, 7 aa, Mycobacterium tuberculosis
GIPPDRA

SEQ ID NO: 1538215 - protein, 11 aa, Mycobacterium tuberculosis
GLNPGPRSTDP

SEQ ID NO: 1538216 - protein, 5 aa, Mycobacterium tuberculosis
GPYGY

SEQ ID NO: 1538217 - protein, 30 aa, Mycobacterium tuberculosis; identical to SEQ ID NO: 1438273

SEQ ID NO: 1538218 - protein, 5 aa, Mycobacterium tuberculosis
GSVGN

SEQ ID NO: 1538219 - protein, 10 aa, Mycobacterium tuberculosis
GTASASSTDE

SEQ ID NO: 1538220 - protein, 10 aa, Mycobacterium tuberculosis
GTGEPPGIGS

SEQ ID NO: 1538221 - protein, 10 aa, Mycobacterium tuberculosis
GTGEPPGLGR

SEQ ID NO: 1538222 - protein, 7 aa, Mycobacterium tuberculosis
GTGGVGQ

SEQ ID NO: 1538223 - protein, 20 aa, Mycobacterium tuberculosis
GYYGNTKDRVVDENDSAGTG

SEQ ID NO: 1538224 - protein, 11 aa, Mycobacterium tuberculosis
HPGQSSAAERE

SEQ ID NO: 1538225 - protein, 11 aa, Mycobacterium tuberculosis
HRAKRRSCAAQ

SEQ ID NO: 1538226 - protein, 11 aa, Mycobacterium tuberculosis
HSGASAAAAAL

SEQ ID NO: 1538227 - protein, 11 aa, Mycobacterium tuberculosis
IGAANAAAAVP

SEQ ID NO: 1538228 - protein, 9 aa, Mycobacterium tuberculosis
IRGDTDGYG

SEQ ID NO: 1538229 - protein, 36 aa, Mycobacterium tuberculosis; identical to SEQ ID NO: 1445913

SEQ ID NO: 1538230 - protein, 7 aa, Mycobacterium tuberculosis
IYRGDAS

SEQ ID NO: 1538231 - protein, 4 aa, Mycobacterium tuberculosis
KAFE

SEQ ID NO: 1538232 - protein, 9 aa, Mycobacterium tuberculosis
KSDEHDAAA

SEQ ID NO: 1538233 - protein, 16 aa, Mycobacterium tuberculosis
LAEGTGAAIAPAEGAR

SEQ ID NO: 1538234 - protein, 7 aa, Mycobacterium tuberculosis
LDGPTTA

SEQ ID NO: 1538235 - protein, 10 aa, Mycobacterium tuberculosis
LGNAGSGNVG

SEQ ID NO: 1538236 - protein, 10 aa, Mycobacterium tuberculosis
LKPGRSHDEV

SEQ ID NO: 1538237 - protein, 21 aa, Mycobacterium tuberculosis
LNDDTGSDGSTPQDRAHAAGF

SEQ ID NO: 1538238 - protein, 16 aa, Mycobacterium tuberculosis
LNPTQLDPAGRTSDAV

SEQ ID NO: 1538239 - protein, 18 aa, Mycobacterium tuberculosis
LPAEEAAEAASALGGEAA

SEQ ID NO: 1538240 - protein, 5 aa, Mycobacterium tuberculosis
LPAGL

SEQ ID NO: 1538241 - protein, 8 aa, Mycobacterium tuberculosis
LPGAAQRA

SEQ ID NO: 1538242 - protein, 4 aa, Mycobacterium tuberculosis
LPVG

SEQ ID NO: 1538243 - protein, 6 aa, Mycobacterium tuberculosis
LPVPQT

SEQ ID NO: 1538244 - protein, 13 aa, Mycobacterium tuberculosis
LSDQPPGVIVVVT

SEQ ID NO: 1538245 - protein, 9 aa, Mycobacterium tuberculosis
LTEDATADR

SEQ ID NO: 1538246 - protein, 6 aa, Mycobacterium tuberculosis
LTGSPV

SEQ ID NO: 1538247 - protein, 12 aa, Mycobacterium tuberculosis
LVGSPGQGAYAA

SEQ ID NO: 1538248 - protein, 6 aa, Mycobacterium tuberculosis
MGTPED

SEQ ID NO: 1538249 - protein, 7 aa, Mycobacterium tuberculosis
NALDNPE

SEQ ID NO: 1538250 - protein, 9 aa, Mycobacterium tuberculosis
NANGSGAGV

SEQ ID NO: 1538251 - protein, 47 aa, Mycobacterium tuberculosis; identical to SEQ ID NO: 230582

SEQ ID NO: 1538252 - protein, 7 aa, Mycobacterium tuberculosis
NGVETGR

SEQ ID NO: 1538253 - protein, 4 aa, Mycobacterium tuberculosis
NHDG

SEQ ID NO: 1538254 - protein, 7 aa, Mycobacterium tuberculosis
NHPLTTS

SEQ ID NO: 1538255 - protein, 4 aa, Mycobacterium tuberculosis
NPTF

SEQ ID NO: 1538256 - protein, 4 aa, Mycobacterium tuberculosis
NSGQ

SEQ ID NO: 1538257 - protein, 10 aa, Mycobacterium tuberculosis
NSGTDLPPTP

SEQ ID NO: 1538258 - protein, 7 aa, Mycobacterium tuberculosis
NSVYTSN

SEQ ID NO: 1538259 - protein, 14 aa, Mycobacterium tuberculosis
NTGVANPGSYNTGS

SEQ ID NO: 1538260 - protein, 6 aa, Mycobacterium tuberculosis
NTTPAL

SEQ ID NO: 1538261 - protein, 7 aa, Mycobacterium tuberculosis
NVGGGNV

SEQ ID NO: 1538262 - protein, 13 aa, Mycobacterium tuberculosis
PAARADDKRLNDG

SEQ ID NO: 1538263 - protein, 10 aa, Mycobacterium tuberculosis
PDRASGRTAR

SEQ ID NO: 1538264 - protein, 23 aa, Mycobacterium tuberculosis
PEPVPQADPGQPWPGRLPDPSPA

SEQ ID NO: 1538265 - protein, 13 aa, Mycobacterium tuberculosis
PGARAETGEQFPG

SEQ ID NO: 1538266 - protein, 8 aa, Mycobacterium tuberculosis
PLEPGQQT

SEQ ID NO: 1538267 - protein, 6 aa, Mycobacterium tuberculosis
PPWDPG

SEQ ID NO: 1538268 - protein, 6 aa, Mycobacterium tuberculosis
PRTGEG

SEQ ID NO: 1538269 - protein, 25 aa, Mycobacterium tuberculosis
PSPCTAGYRGTPGNPLTIAYRWDQG

SEQ ID NO: 1538270 - protein, 5 aa, Mycobacterium tuberculosis
PTDAA

SEQ ID NO: 1538271 - protein, 4 aa, Mycobacterium tuberculosis
PTGK

SEQ ID NO: 1538272 - protein, 4 aa, Mycobacterium tuberculosis
PTKI

SEQ ID NO: 1538273 - protein, 7 aa, Mycobacterium tuberculosis
QAADREI

SEQ ID NO: 1538274 - protein, 9 aa, Mycobacterium tuberculosis
QAAGAAGGG

SEQ ID NO: 1538275 - protein, 11 aa, Mycobacterium tuberculosis
QAEGTDNPHEA

SEQ ID NO: 1538276 - protein, 6 aa, Mycobacterium tuberculosis
QGMSQD

SEQ ID NO: 1538277 - protein, 12 aa, Mycobacterium tuberculosis
QGPFGGPDFPAP

SEQ ID NO: 1538278 - protein, 4 aa, Mycobacterium tuberculosis
QLND

SEQ ID NO: 1538279 - protein, 5 aa, Mycobacterium tuberculosis
QPKDE

SEQ ID NO: 1538280 - protein, 6 aa, Mycobacterium tuberculosis
QPNELP

SEQ ID NO: 1538281 - protein, 13 aa, Mycobacterium tuberculosis
QRERRQPVTTRRS

SEQ ID NO: 1538282 - protein, 7 aa, Mycobacterium tuberculosis
QRTSHAR

SEQ ID NO: 1538283 - protein, 5 aa, Mycobacterium tuberculosis
QTATQ

SEQ ID NO: 1538284 - protein, 8 aa, Mycobacterium tuberculosis
QTTDGSIT

SEQ ID NO: 1538285 - protein, 18 aa, Mycobacterium tuberculosis
RAAGAKAGISVKPGTPLE

SEQ ID NO: 1538286 - protein, 8 aa, Mycobacterium tuberculosis
RDGVTTQL

SEQ ID NO: 1538287 - protein, 5 aa, Mycobacterium tuberculosis
REAAR

SEQ ID NO: 1538288 - protein, 5 aa, Mycobacterium tuberculosis
RGVPA

SEQ ID NO: 1538289 - protein, 9 aa, Mycobacterium tuberculosis
RNARDRPTA

SEQ ID NO: 1538290 - protein, 12 aa, Mycobacterium tuberculosis
RNDQGMDPEDPE

SEQ ID NO: 1538291 - protein, 6 aa, Mycobacterium tuberculosis
RSAEKV

SEQ ID NO: 1538292 - protein, 4 aa, Mycobacterium tuberculosis
RSGV

SEQ ID NO: 1538293 - protein, 49 aa, Mycobacterium tuberculosis; identical to SEQ ID NO: 1450215

SEQ ID NO: 1538294 - protein, 7 aa, Mycobacterium tuberculosis
RTSAEAA

SEQ ID NO: 1538295 - protein, 15 aa, Mycobacterium tuberculosis
SAAASYQTAEATGAS

SEQ ID NO: 1538296 - protein, 6 aa, Mycobacterium tuberculosis
SAGKYA

SEQ ID NO: 1538297 - protein, 8 aa, Mycobacterium tuberculosis
SAGPDPVA

SEQ ID NO: 1538298 - protein, 4 aa, Mycobacterium tuberculosis
SAPF

SEQ ID NO: 1538299 - protein, 5 aa, Mycobacterium tuberculosis
SAQAQ

SEQ ID NO: 1538300 - protein, 14 aa, Mycobacterium tuberculosis
SDHGSDAAVARGRQ

SEQ ID NO: 1538301 - protein, 19 aa, Mycobacterium tuberculosis
SEASGAAPTHEAPAPPRGL

SEQ ID NO: 1538302 - protein, 7 aa, Mycobacterium tuberculosis
SGDHPGI

SEQ ID NO: 1538303 - protein, 4 aa, Mycobacterium tuberculosis
SGRA

SEQ ID NO: 1538304 - protein, 6 aa, Mycobacterium tuberculosis
SGRFPG

SEQ ID NO: 1538305 - protein, 4 aa, Mycobacterium tuberculosis
SHDW

SEQ ID NO: 1538306 - protein, 19 aa, Mycobacterium tuberculosis
SKTTGDPPFPGQPPPVAND

SEQ ID NO: 1538307 - protein, 9 aa, Mycobacterium tuberculosis
SNTTTNGAI

SEQ ID NO: 1538308 - protein, 12 aa, Mycobacterium tuberculosis
SPGSGQDREREE

SEQ ID NO: 1538309 - protein, 10 aa, Mycobacterium tuberculosis
SPKNPPTLSY

SEQ ID NO: 1538310 - protein, 4 aa, Mycobacterium tuberculosis
SPML

SEQ ID NO: 1538311 - protein, 5 aa, Mycobacterium tuberculosis
SPRDK

SEQ ID NO: 1538312 - protein, 10 aa, Mycobacterium tuberculosis
SRSTPSPHAT

SEQ ID NO: 1538313 - protein, 12 aa, Mycobacterium tuberculosis
SSCSQGDAPLGS

SEQ ID NO: 1538314 - protein, 6 aa, Mycobacterium tuberculosis
SSGATH

SEQ ID NO: 1538315 - protein, 8 aa, Mycobacterium tuberculosis
STATGYGC

SEQ ID NO: 1538316 - protein, 6 aa, Mycobacterium tuberculosis
SVGGHN

SEQ ID NO: 1538317 - protein, 5 aa, Mycobacterium tuberculosis
SVPSG

SEQ ID NO: 1538318 - protein, 4 aa, Mycobacterium tuberculosis
TAAQ

SEQ ID NO: 1538319 - protein, 17 aa, Mycobacterium tuberculosis
TAASAAPPSFGAGSSAV

SEQ ID NO: 1538320 - protein, 6 aa, Mycobacterium tuberculosis
TCPVNG

SEQ ID NO: 1538321 - protein, 11 aa, Mycobacterium tuberculosis
TDGGGYPTGRE

SEQ ID NO: 1538322 - protein, 4 aa, Mycobacterium tuberculosis
TDRL

SEQ ID NO: 1538323 - protein, 4 aa, Mycobacterium tuberculosis
TEHD

SEQ ID NO: 1538324 - protein, 23 aa, Mycobacterium tuberculosis
TGCSGSSHSGRTYGAQSARTGES

SEQ ID NO: 1538325 - protein, 6 aa, Mycobacterium tuberculosis
TGDHQL

SEQ ID NO: 1538326 - protein, 9 aa, Mycobacterium tuberculosis
TGGDATRIS

SEQ ID NO: 1538327 - protein, 17 aa, Mycobacterium tuberculosis
TGNTNTGIANSGNVNTG

SEQ ID NO: 1538328 - protein, 11 aa, Mycobacterium tuberculosis
TGQLVSNGNTQ

SEQ ID NO: 1538329 - protein, 10 aa, Mycobacterium tuberculosis
TKNSGGKMTR

SEQ ID NO: 1538330 - protein, 10 aa, Mycobacterium tuberculosis
TNWSTGQPMT

SEQ ID NO: 1538331 - protein, 5 aa, Mycobacterium tuberculosis
TPGDL

SEQ ID NO: 1538332 - protein, 4 aa, Mycobacterium tuberculosis
TPKA

SEQ ID NO: 1538333 - protein, 5 aa, Mycobacterium tuberculosis
TQDVA

SEQ ID NO: 1538334 - protein, 7 aa, Mycobacterium tuberculosis
TRINQET

SEQ ID NO: 1538335 - protein, 4 aa, Mycobacterium tuberculosis
TRPG

SEQ ID NO: 1538336 - protein, 9 aa, Mycobacterium tuberculosis
TTGGPNGVG

SEQ ID NO: 1538337 - protein, 8 aa, Mycobacterium tuberculosis
VDPQRGRL

SEQ ID NO: 1538338 - protein, 5 aa, Mycobacterium tuberculosis
VDRNN

SEQ ID NO: 1538339 - protein, 12 aa, Mycobacterium tuberculosis
VDTPGPQALRDG

SEQ ID NO: 1538340 - protein, 9 aa, Mycobacterium tuberculosis
VGAAQGGYG

SEQ ID NO: 1538341 - protein, 8 aa, Mycobacterium tuberculosis
VPTQDAEA

SEQ ID NO: 1538342 - protein, 9 aa, Mycobacterium tuberculosis
VQPEPRDGL

SEQ ID NO: 1538343 - protein, 4 aa, Mycobacterium tuberculosis
VRAG

SEQ ID NO: 1538344 - protein, 10 aa, Mycobacterium tuberculosis
VYGADDPAAA

SEQ ID NO: 1538345 - protein, 6 aa, Mycobacterium tuberculosis
WAKTNN

SEQ ID NO: 1538346 - protein, 4 aa, Mycobacterium tuberculosis
WPDD

SEQ ID NO: 1538347 - protein, 4 aa, Mycobacterium tuberculosis
YDTD

SEQ ID NO: 1538348 - protein, 9 aa, Mycobacterium tuberculosis
YPDATTGTA

SEQ ID NO: 1538349 - protein, 8 aa, Mycobacterium tuberculosis
YPSTPGTT

SEQ ID NO: 1538350 - protein, 4 aa, Mycobacterium tuberculosis
YRNR

SEQ ID NO: 1538351 - protein, 9 aa, Mycobacterium tuberculosis
YRPTQPGSY

SEQ ID NO: 1538352 - protein, 7 aa, Mycobacterium tuberculosis
AAAQGIP

SEQ ID NO: 1538353 - protein, 7 aa, Mycobacterium tuberculosis
AAASARR

SEQ ID NO: 1538354 - protein, 5 aa, Mycobacterium tuberculosis
AAEPK

SEQ ID NO: 1538355 - protein, 10 aa, Mycobacterium tuberculosis
AAPGQVDTVK

SEQ ID NO: 1538356 - protein, 14 aa, Mycobacterium tuberculosis
AAQNPTGPGSVAGM

SEQ ID NO: 1538357 - protein, 9 aa, Mycobacterium tuberculosis
ACSGSAAAQ

SEQ ID NO: 1538358 - protein, 8 aa, Mycobacterium tuberculosis
ADEPFDQF

SEQ ID NO: 1538359 - protein, 13 aa, Mycobacterium tuberculosis
ADITAAASRQEGL

SEQ ID NO: 1538360 - protein, 8 aa, Mycobacterium tuberculosis
ADYSPAGV

SEQ ID NO: 1538361 - protein, 15 aa, Mycobacterium tuberculosis
AEAAAEQQVQGQQAA

SEQ ID NO: 1538362 - protein, 23 aa, Mycobacterium tuberculosis
AEEMTGRHATTATSFSITDQSCA

SEQ ID NO: 1538363 - protein, 7 aa, Mycobacterium tuberculosis
AEGAKQA

SEQ ID NO: 1538364 - protein, 18 aa, Mycobacterium tuberculosis
AFAGNPAVPTESKNVASS

SEQ ID NO: 1538365 - protein, 4 aa, Mycobacterium tuberculosis
AGAD

SEQ ID NO: 1538366 - protein, 6 aa, Mycobacterium tuberculosis
AGDEVS

SEQ ID NO: 1538367 - protein, 16 aa, Mycobacterium tuberculosis
AGGLPPGLPALPGVDP

SEQ ID NO: 1538368 - protein, 7 aa, Mycobacterium tuberculosis
AGGNSYA

SEQ ID NO: 1538369 - protein, 8 aa, Mycobacterium tuberculosis
AGLPTSLP

SEQ ID NO: 1538370 - protein, 11 aa, Mycobacterium tuberculosis
AGVPPPPGSWE

SEQ ID NO: 1538371 - protein, 8 aa, Mycobacterium tuberculosis
AHPSEPGV

SEQ ID NO: 1538372 - protein, 16 aa, Mycobacterium tuberculosis
ANTSWPDNTGQPRRAA

SEQ ID NO: 1538373 - protein, 6 aa, Mycobacterium tuberculosis
APARGQ

SEQ ID NO: 1538374 - protein, 8 aa, Mycobacterium tuberculosis
APTPADPA

SEQ ID NO: 1538375 - protein, 6 aa, Mycobacterium tuberculosis
AQPYGG

SEQ ID NO: 1538376 - protein, 7 aa, Mycobacterium tuberculosis
AQRAPQL

SEQ ID NO: 1538377 - protein, 12 aa, Mycobacterium tuberculosis
ARPGNSGGPIVA

SEQ ID NO: 1538378 - protein, 12 aa, Mycobacterium tuberculosis
ARSGDGPGGASV

SEQ ID NO: 1538379 - protein, 18 aa, Mycobacterium tuberculosis
ASKTGTAEHGTDPRHTPP

SEQ ID NO: 1538380 - protein, 5 aa, Mycobacterium tuberculosis
ATGQR

SEQ ID NO: 1538381 - protein, 14 aa, Mycobacterium tuberculosis
ATSTPHPAAPAGAG

SEQ ID NO: 1538382 - protein, 11 aa, Mycobacterium tuberculosis
ATTASPGATAA

SEQ ID NO: 1538383 - protein, 4 aa, Mycobacterium tuberculosis
ATYG

SEQ ID NO: 1538384 - protein, 18 aa, Mycobacterium tuberculosis
CGGPGAQIAAEGAENAGP

SEQ ID NO: 1538385 - protein, 11 aa, Mycobacterium tuberculosis
CRGGGAVTSRD

SEQ ID NO: 1538386 - protein, 28 aa, Mycobacterium tuberculosis
DASVAGSQQADGVATTKITGNSSADDIA

SEQ ID NO: 1538387 - protein, 15 aa, Mycobacterium tuberculosis
DGANGAPGQPGGPGG

SEQ ID NO: 1538388 - protein, 8 aa, Mycobacterium tuberculosis
DGLGGKFG

SEQ ID NO: 1538389 - protein, 11 aa, Mycobacterium tuberculosis
DGRSQDNIKAN

SEQ ID NO: 1538390 - protein, 8 aa, Mycobacterium tuberculosis
DLGGPNGV

SEQ ID NO: 1538391 - protein, 6 aa, Mycobacterium tuberculosis
DNPRAR

SEQ ID NO: 1538392 - protein, 10 aa, Mycobacterium tuberculosis
DNTPSGSTVA

SEQ ID NO: 1538393 - protein, 7 aa, Mycobacterium tuberculosis
DPEVQAP

SEQ ID NO: 1538394 - protein, 9 aa, Mycobacterium tuberculosis
DPQPDPGKW

SEQ ID NO: 1538395 - protein, 4 aa, Mycobacterium tuberculosis
DRLP

SEQ ID NO: 1538396 - protein, 8 aa, Mycobacterium tuberculosis
DSYETAGM

SEQ ID NO: 1538397 - protein, 13 aa, Mycobacterium tuberculosis
DTATPSGPAAAEH

SEQ ID NO: 1538398 - protein, 16 aa, Mycobacterium tuberculosis
DYRAQESTRHGASRHG

SEQ ID NO: 1538399 - protein, 11 aa, Mycobacterium tuberculosis
EAGSRDTHAPN

SEQ ID NO: 1538400 - protein, 8 aa, Mycobacterium tuberculosis
ECDGTTLT

SEQ ID NO: 1538401 - protein, 9 aa, Mycobacterium tuberculosis
EGPAYSEGL

SEQ ID NO: 1538402 - protein, 12 aa, Mycobacterium tuberculosis
EGPPDKYQTTGV

SEQ ID NO: 1538403 - protein, 7 aa, Mycobacterium tuberculosis
EQSGTAL

SEQ ID NO: 1538404 - protein, 10 aa, Mycobacterium tuberculosis
EVKKSAEQAE

SEQ ID NO: 1538405 - protein, 15 aa, Mycobacterium tuberculosis
EYAPAKSITAYTPGQ

SEQ ID NO: 1538406 - protein, 9 aa, Mycobacterium tuberculosis
FSPATASAD

SEQ ID NO: 1538407 - protein, 6 aa, Mycobacterium tuberculosis
FSVDDR

SEQ ID NO: 1538408 - protein, 5 aa, Mycobacterium tuberculosis
GADTY

SEQ ID NO: 1538409 - protein, 6 aa, Mycobacterium tuberculosis
GATPPD

SEQ ID NO: 1538410 - protein, 11 aa, Mycobacterium tuberculosis
GGAAPVFPGRT

SEQ ID NO: 1538411 - protein, 5 aa, Mycobacterium tuberculosis
GGALP

SEQ ID NO: 1538412 - protein, 13 aa, Mycobacterium tuberculosis
GIPGSAGATPVQN

SEQ ID NO: 1538413 - protein, 17 aa, Mycobacterium tuberculosis
GKTAQDTSFDGRSDYDG

SEQ ID NO: 1538414 - protein, 8 aa, Mycobacterium tuberculosis
GLNSGTGN

SEQ ID NO: 1538415 - protein, 33 aa, Mycobacterium tuberculosis; identical to SEQ ID NO: 229981

SEQ ID NO: 1538416 - protein, 6 aa, Mycobacterium tuberculosis
GNTVEA

SEQ ID NO: 1538417 - protein, 6 aa, Mycobacterium tuberculosis
GQYQQL

SEQ ID NO: 1538418 - protein, 16 aa, Mycobacterium tuberculosis
GSYNTGVGNAGTASTG

SEQ ID NO: 1538419 - protein, 18 aa, Mycobacterium tuberculosis
GTADEPFDPNYHQKTDTL

SEQ ID NO: 1538420 - protein, 21 aa, Mycobacterium tuberculosis
GTEDQPVAAETLQDHDCSITK

SEQ ID NO: 1538421 - protein, 7 aa, Mycobacterium tuberculosis
GTRDFPE

SEQ ID NO: 1538422 - protein, 12 aa, Mycobacterium tuberculosis
GVPGQNTTNHIA

SEQ ID NO: 1538423 - protein, 10 aa, Mycobacterium tuberculosis
HASDTDTIRG

SEQ ID NO: 1538424 - protein, 7 aa, Mycobacterium tuberculosis
HGDAADL

SEQ ID NO: 1538425 - protein, 7 aa, Mycobacterium tuberculosis
HGKASGQ

SEQ ID NO: 1538426 - protein, 8 aa, Mycobacterium tuberculosis
HRGREGGY

SEQ ID NO: 1538427 - protein, 15 aa, Mycobacterium tuberculosis
HVPSAAARSAGLSES

SEQ ID NO: 1538428 - protein, 12 aa, Mycobacterium tuberculosis
ISAANAAALAPT

SEQ ID NO: 1538429 - protein, 4 aa, Mycobacterium tuberculosis
KGID

SEQ ID NO: 1538430 - protein, 12 aa, Mycobacterium tuberculosis
KLGGGYIDTWAC

SEQ ID NO: 1538431 - protein, 14 aa, Mycobacterium tuberculosis
KQRWPDDPTSHAYQ

SEQ ID NO: 1538432 - protein, 4 aa, Mycobacterium tuberculosis
KRRN

SEQ ID NO: 1538433 - protein, 6 aa, Mycobacterium tuberculosis
KSTRFT

SEQ ID NO: 1538434 - protein, 7 aa, Mycobacterium tuberculosis
LADATTT

SEQ ID NO: 1538435 - protein, 7 aa, Mycobacterium tuberculosis
LGAEPGV

SEQ ID NO: 1538436 - protein, 26 aa, Mycobacterium tuberculosis
LGNGNTGNANLGSGNTGQANLGSGNT

SEQ ID NO: 1538437 - protein, 10 aa, Mycobacterium tuberculosis
LKGDKGEPCW

SEQ ID NO: 1538438 - protein, 6 aa, Mycobacterium tuberculosis
LKTNSS

SEQ ID NO: 1538439 - protein, 40 aa, Mycobacterium tuberculosis; identical to SEQ ID NO: 230445

SEQ ID NO: 1538440 - protein, 9 aa, Mycobacterium tuberculosis
LPRTGNQNA

SEQ ID NO: 1538441 - protein, 7 aa, Mycobacterium tuberculosis
LQAQGTE

SEQ ID NO: 1538442 - protein, 7 aa, Mycobacterium tuberculosis
LSEERKV

SEQ ID NO: 1538443 - protein, 6 aa, Mycobacterium tuberculosis
MNPAQA

SEQ ID NO: 1538444 - protein, 9 aa, Mycobacterium tuberculosis
MSAPQTVSG

SEQ ID NO: 1538445 - protein, 9 aa, Mycobacterium tuberculosis
NAPAIAATE

SEQ ID NO: 1538446 - protein, 13 aa, Mycobacterium tuberculosis
NATSGERADPQAV

SEQ ID NO: 1538447 - protein, 10 aa, Mycobacterium tuberculosis
NGAAGTGDPV

SEQ ID NO: 1538448 - protein, 17 aa, Mycobacterium tuberculosis
NGANGLPGTGQNGGDGG

SEQ ID NO: 1538449 - protein, 22 aa, Mycobacterium tuberculosis
NGGPGGLGGPGTSAGNGGMGGN

SEQ ID NO: 1538450 - protein, 7 aa, Mycobacterium tuberculosis
NKSEDAK

SEQ ID NO: 1538451 - protein, 9 aa, Mycobacterium tuberculosis
NPGGPGASA

SEQ ID NO: 1538452 - protein, 5 aa, Mycobacterium tuberculosis
NTTVA

SEQ ID NO: 1538453 - protein, 17 aa, Mycobacterium tuberculosis
NVGAQNLGAANAGSGNF

SEQ ID NO: 1538454 - protein, 16 aa, Mycobacterium tuberculosis
NVGEQLSGLSSAGTAL

SEQ ID NO: 1538455 - protein, 5 aa, Mycobacterium tuberculosis
NVSTE

SEQ ID NO: 1538456 - protein, 9 aa, Mycobacterium tuberculosis
PALRESAGR

SEQ ID NO: 1538457 - protein, 21 aa, Mycobacterium tuberculosis
PHSAGSSNPWDDSAHPLTDDQ

SEQ ID NO: 1538458 - protein, 9 aa, Mycobacterium tuberculosis
PIGPRGRAA

SEQ ID NO: 1538459 - protein, 10 aa, Mycobacterium tuberculosis
PIPPREALKT

SEQ ID NO: 1538460 - protein, 7 aa, Mycobacterium tuberculosis
PLGQTDD

SEQ ID NO: 1538461 - protein, 10 aa, Mycobacterium tuberculosis
PLSAPAGRLT

SEQ ID NO: 1538462 - protein, 12 aa, Mycobacterium tuberculosis
PPTSQPHAVSAP

SEQ ID NO: 1538463 - protein, 22 aa, Mycobacterium tuberculosis
PQYSNPEPAGTATITGYRADND

SEQ ID NO: 1538464 - protein, 33 aa, Mycobacterium tuberculosis
PRFATYSGAGPQGAATTTPPPAGPPPLAAPKND

SEQ ID NO: 1538465 - protein, 11 aa, Mycobacterium tuberculosis
PTNPGASDPAA

SEQ ID NO: 1538466 - protein, 7 aa, Mycobacterium tuberculosis
PTNQNDA

SEQ ID NO: 1538467 - protein, 5 aa, Mycobacterium tuberculosis
PTSER

SEQ ID NO: 1538468 - protein, 7 aa, Mycobacterium tuberculosis
PWQDNEG

SEQ ID NO: 1538469 - protein, 8 aa, Mycobacterium tuberculosis
PYSGPTTA

SEQ ID NO: 1538470 - protein, 13 aa, Mycobacterium tuberculosis
QKPGKTSDPRGLS

SEQ ID NO: 1538471 - protein, 4 aa, Mycobacterium tuberculosis
QLRT

SEQ ID NO: 1538472 - protein, 8 aa, Mycobacterium tuberculosis
QLSQGGQG

SEQ ID NO: 1538473 - protein, 8 aa, Mycobacterium tuberculosis
QPPVTDRD

SEQ ID NO: 1538474 - protein, 12 aa, Mycobacterium tuberculosis
QSRPVVNGPAAA

SEQ ID NO: 1538475 - protein, 5 aa, Mycobacterium tuberculosis
QTPEF

SEQ ID NO: 1538476 - protein, 7 aa, Mycobacterium tuberculosis
QTPPQPL

SEQ ID NO: 1538477 - protein, 5 aa, Mycobacterium tuberculosis
RAATV

SEQ ID NO: 1538478 - protein, 6 aa, Mycobacterium tuberculosis
RAIDST

SEQ ID NO: 1538479 - protein, 5 aa, Mycobacterium tuberculosis
RARRD

SEQ ID NO: 1538480 - protein, 13 aa, Mycobacterium tuberculosis
RGISSPWSHQAEA

SEQ ID NO: 1538481 - protein, 7 aa, Mycobacterium tuberculosis
RHRSPGI

SEQ ID NO: 1538482 - protein, 5 aa, Mycobacterium tuberculosis
RIGSR

SEQ ID NO: 1538483 - protein, 5 aa, Mycobacterium tuberculosis
RLAGP

SEQ ID NO: 1538484 - protein, 10 aa, Mycobacterium tuberculosis
RQAPYGLAGS

SEQ ID NO: 1538485 - protein, 29 aa, Mycobacterium tuberculosis
RRPPDRSTFATPPTAMPAPSHLTDVDRSA

SEQ ID NO: 1538486 - protein, 5 aa, Mycobacterium tuberculosis
RSDDG

SEQ ID NO: 1538487 - protein, 10 aa, Mycobacterium tuberculosis
RWAPPYAEAG

SEQ ID NO: 1538488 - protein, 14 aa, Mycobacterium tuberculosis
SDAAPQLRDDPEAR

SEQ ID NO: 1538489 - protein, 13 aa, Mycobacterium tuberculosis
SDPPGLTPLPEEA

SEQ ID NO: 1538490 - protein, 4 aa, Mycobacterium tuberculosis
SEIR

SEQ ID NO: 1538491 - protein, 6 aa, Mycobacterium tuberculosis
SGASAV

SEQ ID NO: 1538492 - protein, 13 aa, Mycobacterium tuberculosis
SGTEGAAARTADR

SEQ ID NO: 1538493 - protein, 8 aa, Mycobacterium tuberculosis
SIGDDSQL

SEQ ID NO: 1538494 - protein, 9 aa, Mycobacterium tuberculosis
SLDDGESDL

SEQ ID NO: 1538495 - protein, 4 aa, Mycobacterium tuberculosis
SLYE

SEQ ID NO: 1538496 - protein, 14 aa, Mycobacterium tuberculosis
SPRDRIPGTAAAYP

SEQ ID NO: 1538497 - protein, 5 aa, Mycobacterium tuberculosis
SSGLI

SEQ ID NO: 1538498 - protein, 17 aa, Mycobacterium tuberculosis
STGGATGSGSSGSSAMD

SEQ ID NO: 1538499 - protein, 4 aa, Mycobacterium tuberculosis
STHP

SEQ ID NO: 1538500 - protein, 12 aa, Mycobacterium tuberculosis
STTKITGTIPAS

SEQ ID NO: 1538501 - protein, 10 aa, Mycobacterium tuberculosis
STVGPIPDSA

SEQ ID NO: 1538502 - protein, 8 aa, Mycobacterium tuberculosis
SVSPANGA

SEQ ID NO: 1538503 - protein, 7 aa, Mycobacterium tuberculosis
SYGMSGT

SEQ ID NO: 1538504 - protein, 10 aa, Mycobacterium tuberculosis
TAANQDGRTV

SEQ ID NO: 1538505 - protein, 4 aa, Mycobacterium tuberculosis
TASV

SEQ ID NO: 1538506 - protein, 11 aa, Mycobacterium tuberculosis
TGRRTGADQRA

SEQ ID NO: 1538507 - protein, 6 aa, Mycobacterium tuberculosis
TGSAPR

SEQ ID NO: 1538508 - protein, 12 aa, Mycobacterium tuberculosis
TGTGYGAPPFDG

SEQ ID NO: 1538509 - protein, 11 aa, Mycobacterium tuberculosis
THDPATPYQSG

SEQ ID NO: 1538510 - protein, 14 aa, Mycobacterium tuberculosis
THTTRPATCSQEHS

SEQ ID NO: 1538511 - protein, 6 aa, Mycobacterium tuberculosis
TKALGH

SEQ ID NO: 1538512 - protein, 6 aa, Mycobacterium tuberculosis
TMPEKT

SEQ ID NO: 1538513 - protein, 8 aa, Mycobacterium tuberculosis
TRAYPPGV

SEQ ID NO: 1538514 - protein, 6 aa, Mycobacterium tuberculosis
TTPFTR

SEQ ID NO: 1538515 - protein, 12 aa, Mycobacterium tuberculosis
TVTGQGNSLKVG

SEQ ID NO: 1538516 - protein, 5 aa, Mycobacterium tuberculosis
VADRD

SEQ ID NO: 1538517 - protein, 6 aa, Mycobacterium tuberculosis
VDSTYS

SEQ ID NO: 1538518 - protein, 7 aa, Mycobacterium tuberculosis
VETPGPV

SEQ ID NO: 1538519 - protein, 25 aa, Mycobacterium tuberculosis
VGSYNTGSFNAGNTNTGGFNPGNVN

SEQ ID NO: 1538520 - protein, 6 aa, Mycobacterium tuberculosis
VGTGAH

SEQ ID NO: 1538521 - protein, 30 aa, Mycobacterium tuberculosis; identical to SEQ ID NO: 231769

SEQ ID NO: 1538522 - protein, 5 aa, Mycobacterium tuberculosis
YAQGL

SEQ ID NO: 1538523 - protein, 16 aa, Mycobacterium tuberculosis
YDGRDADGHYSNDQDA

SEQ ID NO: 1538524 - protein, 9 aa, Mycobacterium tuberculosis
YDQPGGTQA

SEQ ID NO: 1538525 - protein, 6 aa, Mycobacterium tuberculosis
YGTEGP

SEQ ID NO: 1538526 - protein, 11 aa, Mycobacterium tuberculosis
YTSGSTAAPRG

SEQ ID NO: 1538527 - protein, 11 aa, Mycobacterium tuberculosis
AAAAGLSATAP

SEQ ID NO: 1538528 - protein, 7 aa, Mycobacterium tuberculosis
AAGQRQQ

SEQ ID NO: 1538529 - protein, 17 aa, Mycobacterium tuberculosis
AANPTGPASVQGMSQDP

SEQ ID NO: 1538530 - protein, 6 aa, Mycobacterium tuberculosis
AARGGR

SEQ ID NO: 1538531 - protein, 8 aa, Mycobacterium tuberculosis
AATANPLA

SEQ ID NO: 1538532 - protein, 7 aa, Mycobacterium tuberculosis
ADADRDA

SEQ ID NO: 1538533 - protein, 11 aa, Mycobacterium tuberculosis
ADNLRGQGATI

SEQ ID NO: 1538534 - protein, 6 aa, Mycobacterium tuberculosis
ADTALD

SEQ ID NO: 1538535 - protein, 6 aa, Mycobacterium tuberculosis
ADTQAE

SEQ ID NO: 1538536 - protein, 4 aa, Mycobacterium tuberculosis
AEAR

SEQ ID NO: 1538537 - protein, 8 aa, Mycobacterium tuberculosis
AGFDPKVP

SEQ ID NO: 1538538 - protein, 5 aa, Mycobacterium tuberculosis
AGGNL

SEQ ID NO: 1538539 - protein, 9 aa, Mycobacterium tuberculosis
AGPAGRVSV

SEQ ID NO: 1538540 - protein, 5 aa, Mycobacterium tuberculosis
AGPDV

SEQ ID NO: 1538541 - protein, 14 aa, Mycobacterium tuberculosis
AGRDQNVAHPPAST

SEQ ID NO: 1538542 - protein, 19 aa, Mycobacterium tuberculosis
AKAAKPALRPVKPPPRRPA

SEQ ID NO: 1538543 - protein, 19 aa, Mycobacterium tuberculosis
ALGAPTSPEADAADGARYA

SEQ ID NO: 1538544 - protein, 8 aa, Mycobacterium tuberculosis
ALSGAGPS

SEQ ID NO: 1538545 - protein, 8 aa, Mycobacterium tuberculosis
APDGGPAQ

SEQ ID NO: 1538546 - protein, 5 aa, Mycobacterium tuberculosis
APGFQ

SEQ ID NO: 1538547 - protein, 35 aa, Mycobacterium tuberculosis
APGYPPTIEPAQPAVSPPTSQDPAGAVRPLSGHPR

SEQ ID NO: 1538548 - protein, 4 aa, Mycobacterium tuberculosis
APLA

SEQ ID NO: 1538549 - protein, 7 aa, Mycobacterium tuberculosis
APSVPGV

SEQ ID NO: 1538550 - protein, 6 aa, Mycobacterium tuberculosis
AQGYQQ

SEQ ID NO: 1538551 - protein, 8 aa, Mycobacterium tuberculosis
ARDRGRQM

SEQ ID NO: 1538552 - protein, 22 aa, Mycobacterium tuberculosis
ARFTESTPYNPSSPYSATKAGA

SEQ ID NO: 1538553 - protein, 4 aa, Mycobacterium tuberculosis
ASPA

SEQ ID NO: 1538554 - protein, 10 aa, Mycobacterium tuberculosis
ASSANLGPGF

SEQ ID NO: 1538555 - protein, 12 aa, Mycobacterium tuberculosis
ATADAEEALGGA

SEQ ID NO: 1538556 - protein, 9 aa, Mycobacterium tuberculosis
ATKAEADAA

SEQ ID NO: 1538557 - protein, 7 aa, Mycobacterium tuberculosis
ATQPNTH

SEQ ID NO: 1538558 - protein, 16 aa, Mycobacterium tuberculosis
AYAHSSYHRGVFAPAR

SEQ ID NO: 1538559 - protein, 6 aa, Mycobacterium tuberculosis
AYPDDE

SEQ ID NO: 1538560 - protein, 8 aa, Mycobacterium tuberculosis
AYRDGTLP

SEQ ID NO: 1538561 - protein, 20 aa, Mycobacterium tuberculosis
CGAAEGPYGFTGTSNSFASG

SEQ ID NO: 1538562 - protein, 9 aa, Mycobacterium tuberculosis
DAVGPASPV

SEQ ID NO: 1538563 - protein, 10 aa, Mycobacterium tuberculosis
DDQSGTIPNV

SEQ ID NO: 1538564 - protein, 6 aa, Mycobacterium tuberculosis
DDVRAA

SEQ ID NO: 1538565 - protein, 4 aa, Mycobacterium tuberculosis
DFEE

SEQ ID NO: 1538566 - protein, 8 aa, Mycobacterium tuberculosis
DGGTAADA

SEQ ID NO: 1538567 - protein, 5 aa, Mycobacterium tuberculosis
DGWQT

SEQ ID NO: 1538568 - protein, 12 aa, Mycobacterium tuberculosis
DQINTTRYNPDY

SEQ ID NO: 1538569 - protein, 4 aa, Mycobacterium tuberculosis
DTPA

SEQ ID NO: 1538570 - protein, 10 aa, Mycobacterium tuberculosis
DTRTPPGLRA

SEQ ID NO: 1538571 - protein, 8 aa, Mycobacterium tuberculosis
DVDTDGLA

SEQ ID NO: 1538572 - protein, 9 aa, Mycobacterium tuberculosis
EAPAPLQNT

SEQ ID NO: 1538573 - protein, 10 aa, Mycobacterium tuberculosis
EATPTLPLPT

SEQ ID NO: 1538574 - protein, 6 aa, Mycobacterium tuberculosis
EDPGYA

SEQ ID NO: 1538575 - protein, 7 aa, Mycobacterium tuberculosis
EGGPTYW

SEQ ID NO: 1538576 - protein, 7 aa, Mycobacterium tuberculosis
EGLPTDG

SEQ ID NO: 1538577 - protein, 5 aa, Mycobacterium tuberculosis
EPQPL

SEQ ID NO: 1538578 - protein, 9 aa, Mycobacterium tuberculosis
ESAEGRQKY

SEQ ID NO: 1538579 - protein, 16 aa, Mycobacterium tuberculosis
ETPSRPGTATLEPGHT

SEQ ID NO: 1538580 - protein, 9 aa, Mycobacterium tuberculosis
EVRTDAPSN

SEQ ID NO: 1538581 - protein, 9 aa, Mycobacterium tuberculosis
FEGHPDNAA

SEQ ID NO: 1538582 - protein, 4 aa, Mycobacterium tuberculosis
GAAS

SEQ ID NO: 1538583 - protein, 5 aa, Mycobacterium tuberculosis
GAATD

SEQ ID NO: 1538584 - protein, 13 aa, Mycobacterium tuberculosis
GAIGGKTGYTNAA

SEQ ID NO: 1538585 - protein, 9 aa, Mycobacterium tuberculosis
GAPINSATA

SEQ ID NO: 1538586 - protein, 8 aa, Mycobacterium tuberculosis
GAPSTAGP

SEQ ID NO: 1538587 - protein, 15 aa, Mycobacterium tuberculosis
GDPVAARPAAQEARE

SEQ ID NO: 1538588 - protein, 5 aa, Mycobacterium tuberculosis
GENTA

SEQ ID NO: 1538589 - protein, 9 aa, Mycobacterium tuberculosis
GGAATTPTS

SEQ ID NO: 1538590 - protein, 11 aa, Mycobacterium tuberculosis
GGPGDSGAPVT

SEQ ID NO: 1538591 - protein, 13 aa, Mycobacterium tuberculosis
GGQPEFRQHSEHR

SEQ ID NO: 1538592 - protein, 4 aa, Mycobacterium tuberculosis
GGSL

SEQ ID NO: 1538593 - protein, 5 aa, Mycobacterium tuberculosis
GGTVQ

SEQ ID NO: 1538594 - protein, 6 aa, Mycobacterium tuberculosis
GHTSGH

SEQ ID NO: 1538595 - protein, 4 aa, Mycobacterium tuberculosis
GKQR

SEQ ID NO: 1538596 - protein, 5 aa, Mycobacterium tuberculosis
GNTKA

SEQ ID NO: 1538597 - protein, 6 aa, Mycobacterium tuberculosis
GSDEQF

SEQ ID NO: 1538598 - protein, 11 aa, Mycobacterium tuberculosis
GSQPLADDAEE

SEQ ID NO: 1538599 - protein, 5 aa, Mycobacterium tuberculosis
GTTSL

SEQ ID NO: 1538600 - protein, 8 aa, Mycobacterium tuberculosis
GTYDPRRI

SEQ ID NO: 1538601 - protein, 13 aa, Mycobacterium tuberculosis
GVDPTAADPAGWP

SEQ ID NO: 1538602 - protein, 4 aa, Mycobacterium tuberculosis
GVGT

SEQ ID NO: 1538603 - protein, 10 aa, Mycobacterium tuberculosis
GVPAGKSDRL

SEQ ID NO: 1538604 - protein, 10 aa, Mycobacterium tuberculosis
HDQPGRSTTD

SEQ ID NO: 1538605 - protein, 5 aa, Mycobacterium tuberculosis
HGGQT

SEQ ID NO: 1538606 - protein, 20 aa, Mycobacterium tuberculosis
HRAAGAGRRQRRRRSGDGQW

SEQ ID NO: 1538607 - protein, 27 aa, Mycobacterium tuberculosis
HSMGSARPGDFGAPTAVAPPVPEHGTS

SEQ ID NO: 1538608 - protein, 12 aa, Mycobacterium tuberculosis
IGDGNRGSGNVG

SEQ ID NO: 1538609 - protein, 7 aa, Mycobacterium tuberculosis
IGPDPSF

SEQ ID NO: 1538610 - protein, 6 aa, Mycobacterium tuberculosis
ISLDGP

SEQ ID NO: 1538611 - protein, 4 aa, Mycobacterium tuberculosis
ITDP

SEQ ID NO: 1538612 - protein, 6 aa, Mycobacterium tuberculosis
KLDAGP

SEQ ID NO: 1538613 - protein, 6 aa, Mycobacterium tuberculosis
KNGRHS

SEQ ID NO: 1538614 - protein, 7 aa, Mycobacterium tuberculosis
KPGKDAH

SEQ ID NO: 1538615 - protein, 8 aa, Mycobacterium tuberculosis
KPGRSYTA

SEQ ID NO: 1538616 - protein, 4 aa, Mycobacterium tuberculosis
KTQT

SEQ ID NO: 1538617 - protein, 8 aa, Mycobacterium tuberculosis
LAHGGQPV

SEQ ID NO: 1538618 - protein, 5 aa, Mycobacterium tuberculosis
LARDG

SEQ ID NO: 1538619 - protein, 4 aa, Mycobacterium tuberculosis
LDDQ

SEQ ID NO: 1538620 - protein, 15 aa, Mycobacterium tuberculosis
LDDSRPGNGRPVTAA

SEQ ID NO: 1538621 - protein, 7 aa, Mycobacterium tuberculosis
LGGAATR

SEQ ID NO: 1538622 - protein, 5 aa, Mycobacterium tuberculosis
LGNRT

SEQ ID NO: 1538623 - protein, 11 aa, Mycobacterium tuberculosis
LGSGNDGNGNF

SEQ ID NO: 1538624 - protein, 4 aa, Mycobacterium tuberculosis
LPPE

SEQ ID NO: 1538625 - protein, 15 aa, Mycobacterium tuberculosis
LPRPGRQRAPRAGVH

SEQ ID NO: 1538626 - protein, 16 aa, Mycobacterium tuberculosis
LPSDTDLDTPGPQRSL

SEQ ID NO: 1538627 - protein, 16 aa, Mycobacterium tuberculosis
LSGNPVRDGPAAPAQV

SEQ ID NO: 1538628 - protein, 7 aa, Mycobacterium tuberculosis
MPSSGGV

SEQ ID NO: 1538629 - protein, 14 aa, Mycobacterium tuberculosis
NAKNRPGAGFVPVP

SEQ ID NO: 1538630 - protein, 6 aa, Mycobacterium tuberculosis
NDAANT

SEQ ID NO: 1538631 - protein, 16 aa, Mycobacterium tuberculosis
NGGAGGAGGNGGPAPL

SEQ ID NO: 1538632 - protein, 10 aa, Mycobacterium tuberculosis
NGRPYRDGEV

SEQ ID NO: 1538633 - protein, 4 aa, Mycobacterium tuberculosis
NPAR

SEQ ID NO: 1538634 - protein, 6 aa, Mycobacterium tuberculosis
NPTNTA

SEQ ID NO: 1538635 - protein, 10 aa, Mycobacterium tuberculosis
NSGDGGVSGF

SEQ ID NO: 1538636 - protein, 5 aa, Mycobacterium tuberculosis
PAAVA

SEQ ID NO: 1538637 - protein, 17 aa, Mycobacterium tuberculosis
PATPGFGNTTTAPSSGF

SEQ ID NO: 1538638 - protein, 5 aa, Mycobacterium tuberculosis
PEPET

SEQ ID NO: 1538639 - protein, 4 aa, Mycobacterium tuberculosis
PEPW

SEQ ID NO: 1538640 - protein, 5 aa, Mycobacterium tuberculosis
PGFGG

SEQ ID NO: 1538641 - protein, 13 aa, Mycobacterium tuberculosis
PGTAAPAPESLHG

SEQ ID NO: 1538642 - protein, 14 aa, Mycobacterium tuberculosis
PITQPPAGRPPNDL

SEQ ID NO: 1538643 - protein, 19 aa, Mycobacterium tuberculosis
PLPTGPDAAPACPTGGAGL

SEQ ID NO: 1538644 - protein, 30 aa, Mycobacterium tuberculosis
PNGTPAPKTPPATVPSSRNLATNPEIATGY

SEQ ID NO: 1538645 - protein, 32 aa, Mycobacterium tuberculosis; identical to SEQ ID NO: 1435073

SEQ ID NO: 1538646 - protein, 19 aa, Mycobacterium tuberculosis
PQPPLPPDSSSQDCDPTAS

SEQ ID NO: 1538647 - protein, 8 aa, Mycobacterium tuberculosis
PRDSPITK

SEQ ID NO: 1538648 - protein, 8 aa, Mycobacterium tuberculosis
PRPGVPAA

SEQ ID NO: 1538649 - protein, 5 aa, Mycobacterium tuberculosis
PRSAT

SEQ ID NO: 1538650 - protein, 5 aa, Mycobacterium tuberculosis
PSREF

SEQ ID NO: 1538651 - protein, 5 aa, Mycobacterium tuberculosis
PVQPL

SEQ ID NO: 1538652 - protein, 5 aa, Mycobacterium tuberculosis
PYRAP

SEQ ID NO: 1538653 - protein, 13 aa, Mycobacterium tuberculosis
QAAGGAVDGADTV

SEQ ID NO: 1538654 - protein, 10 aa, Mycobacterium tuberculosis
QATAATDGEW

SEQ ID NO: 1538655 - protein, 16 aa, Mycobacterium tuberculosis
QATSTQPSTAPPTSRV

SEQ ID NO: 1538656 - protein, 7 aa, Mycobacterium tuberculosis
QAVAGRQ

SEQ ID NO: 1538657 - protein, 56 aa, Mycobacterium tuberculosis; identical to SEQ ID NO: 230912

SEQ ID NO: 1538658 - protein, 6 aa, Mycobacterium tuberculosis
QGTEFD

SEQ ID NO: 1538659 - protein, 7 aa, Mycobacterium tuberculosis
QQIGYER

SEQ ID NO: 1538660 - protein, 11 aa, Mycobacterium tuberculosis
QTEVAGAGSGF

SEQ ID NO: 1538661 - protein, 7 aa, Mycobacterium tuberculosis
QTTTGRA

SEQ ID NO: 1538662 - protein, 5 aa, Mycobacterium tuberculosis
RADAD

SEQ ID NO: 1538663 - protein, 10 aa, Mycobacterium tuberculosis
RPKTPPPADA

SEQ ID NO: 1538664 - protein, 7 aa, Mycobacterium tuberculosis
RSQGSTV

SEQ ID NO: 1538665 - protein, 8 aa, Mycobacterium tuberculosis
RTLSTSAD

SEQ ID NO: 1538666 - protein, 16 aa, Mycobacterium tuberculosis
SADSYAATEAANIIAV

SEQ ID NO: 1538667 - protein, 5 aa, Mycobacterium tuberculosis
SATTA

SEQ ID NO: 1538668 - protein, 5 aa, Mycobacterium tuberculosis
SDLSG

SEQ ID NO: 1538669 - protein, 4 aa, Mycobacterium tuberculosis
SDNM

SEQ ID NO: 1538670 - protein, 10 aa, Mycobacterium tuberculosis
SEKGDSGGPV

SEQ ID NO: 1538671 - protein, 5 aa, Mycobacterium tuberculosis
SEPHD

SEQ ID NO: 1538672 - protein, 14 aa, Mycobacterium tuberculosis
SGNTANTNFGSGNL

SEQ ID NO: 1538673 - protein, 5 aa, Mycobacterium tuberculosis
SGYPV

SEQ ID NO: 1538674 - protein, 9 aa, Mycobacterium tuberculosis
SPVAAAKTT

SEQ ID NO: 1538675 - protein, 10 aa, Mycobacterium tuberculosis
SSASATPANI

SEQ ID NO: 1538676 - protein, 4 aa, Mycobacterium tuberculosis
TAQG

SEQ ID NO: 1538677 - protein, 8 aa, Mycobacterium tuberculosis
TARAAGVR

SEQ ID NO: 1538678 - protein, 8 aa, Mycobacterium tuberculosis
TDDNSAAV

SEQ ID NO: 1538679 - protein, 4 aa, Mycobacterium tuberculosis
TGES

SEQ ID NO: 1538680 - protein, 9 aa, Mycobacterium tuberculosis
TLPGRGLSP

SEQ ID NO: 1538681 - protein, 7 aa, Mycobacterium tuberculosis
TREGNRY

SEQ ID NO: 1538682 - protein, 8 aa, Mycobacterium tuberculosis
TSQVGGRS

SEQ ID NO: 1538683 - protein, 10 aa, Mycobacterium tuberculosis
TTAPSAAPNI

SEQ ID NO: 1538684 - protein, 4 aa, Mycobacterium tuberculosis
VADP

SEQ ID NO: 1538685 - protein, 14 aa, Mycobacterium tuberculosis
VEETDSAGNPRSDH

SEQ ID NO: 1538686 - protein, 4 aa, Mycobacterium tuberculosis
VGAT

SEQ ID NO: 1538687 - protein, 7 aa, Mycobacterium tuberculosis
VGGTTVV

SEQ ID NO: 1538688 - protein, 4 aa, Mycobacterium tuberculosis
VGPE

SEQ ID NO: 1538689 - protein, 4 aa, Mycobacterium tuberculosis
VRGE

SEQ ID NO: 1538690 - protein, 10 aa, Mycobacterium tuberculosis
VRPVEQGEGD

SEQ ID NO: 1538691 - protein, 9 aa, Mycobacterium tuberculosis
VTGREPSER

SEQ ID NO: 1538692 - protein, 13 aa, Mycobacterium tuberculosis
VTSAMNQTNDRQQ

SEQ ID NO: 1538693 - protein, 9 aa, Mycobacterium tuberculosis
WGPGESPGT

SEQ ID NO: 1538694 - protein, 10 aa, Mycobacterium tuberculosis
WGPLSAPKLE

SEQ ID NO: 1538695 - protein, 4 aa, Mycobacterium tuberculosis
YPAD

SEQ ID NO: 1538696 - protein, 8 aa, Mycobacterium tuberculosis
YPGGAGFA

SEQ ID NO: 1538697 - protein, 6 aa, Mycobacterium tuberculosis
YSPRGS

SEQ ID NO: 1538698 - protein, 7 aa, Mycobacterium tuberculosis
AAAASPL

SEQ ID NO: 1538699 - protein, 8 aa, Mycobacterium tuberculosis
AAGKTPVP

SEQ ID NO: 1538700 - protein, 18 aa, Mycobacterium tuberculosis
AAGSAYATAEAANASPLQ

SEQ ID NO: 1538701 - protein, 15 aa, Mycobacterium tuberculosis
AASAAAVDTNCGATL

SEQ ID NO: 1538702 - protein, 8 aa, Mycobacterium tuberculosis
AATAQSVQ

SEQ ID NO: 1538703 - protein, 7 aa, Mycobacterium tuberculosis
AATSSEW

SEQ ID NO: 1538704 - protein, 8 aa, Mycobacterium tuberculosis
AAVPTASA

SEQ ID NO: 1538705 - protein, 6 aa, Mycobacterium tuberculosis
ADAAAS

SEQ ID NO: 1538706 - protein, 8 aa, Mycobacterium tuberculosis
ADGSNSIA

SEQ ID NO: 1538707 - protein, 15 aa, Mycobacterium tuberculosis
ADPPRRASVNEVGGT

SEQ ID NO: 1538708 - protein, 9 aa, Mycobacterium tuberculosis
ADRGAAEKA

SEQ ID NO: 1538709 - protein, 6 aa, Mycobacterium tuberculosis
ADTIGA

SEQ ID NO: 1538710 - protein, 9 aa, Mycobacterium tuberculosis
ADVENIGST

SEQ ID NO: 1538711 - protein, 4 aa, Mycobacterium tuberculosis
AGGN

SEQ ID NO: 1538712 - protein, 11 aa, Mycobacterium tuberculosis
AGKTGTAQQIN

SEQ ID NO: 1538713 - protein, 16 aa, Mycobacterium tuberculosis
AGPAKIPLPGPGPGQT

SEQ ID NO: 1538714 - protein, 7 aa, Mycobacterium tuberculosis
AGQAGRE

SEQ ID NO: 1538715 - protein, 10 aa, Mycobacterium tuberculosis
AGTPVISDPG

SEQ ID NO: 1538716 - protein, 13 aa, Mycobacterium tuberculosis
AIRSQQSAYASHP

SEQ ID NO: 1538717 - protein, 7 aa, Mycobacterium tuberculosis
AKSAAES

SEQ ID NO: 1538718 - protein, 6 aa, Mycobacterium tuberculosis
ALGDHS

SEQ ID NO: 1538719 - protein, 12 aa, Mycobacterium tuberculosis
APASGSGKTTIA

SEQ ID NO: 1538720 - protein, 8 aa, Mycobacterium tuberculosis
APPHGNAL

SEQ ID NO: 1538721 - protein, 8 aa, Mycobacterium tuberculosis
APSPASSV

SEQ ID NO: 1538722 - protein, 17 aa, Mycobacterium tuberculosis
APVTAGPVGGTAEVPTP

SEQ ID NO: 1538723 - protein, 6 aa, Mycobacterium tuberculosis
ARLPSG

SEQ ID NO: 1538724 - protein, 8 aa, Mycobacterium tuberculosis
ARRDGAPP

SEQ ID NO: 1538725 - protein, 10 aa, Mycobacterium tuberculosis
ASGETGTEIA

SEQ ID NO: 1538726 - protein, 8 aa, Mycobacterium tuberculosis
ATAAPKTY

SEQ ID NO: 1538727 - protein, 6 aa, Mycobacterium tuberculosis
ATDTGS

SEQ ID NO: 1538728 - protein, 10 aa, Mycobacterium tuberculosis
ATGQNQPATG

SEQ ID NO: 1538729 - protein, 8 aa, Mycobacterium tuberculosis
ATGSGKSE

SEQ ID NO: 1538730 - protein, 16 aa, Mycobacterium tuberculosis
ATLTDGAGPVNSKTVQ

SEQ ID NO: 1538731 - protein, 6 aa, Mycobacterium tuberculosis
ATRIPG

SEQ ID NO: 1538732 - protein, 4 aa, Mycobacterium tuberculosis
AVGG

SEQ ID NO: 1538733 - protein, 10 aa, Mycobacterium tuberculosis
AVNRPTPDRV

SEQ ID NO: 1538734 - protein, 8 aa, Mycobacterium tuberculosis
AVNTRGGK

SEQ ID NO: 1538735 - protein, 15 aa, Mycobacterium tuberculosis
CESGGNWSINTGNGY

SEQ ID NO: 1538736 - protein, 13 aa, Mycobacterium tuberculosis
CTPRPQGPGPAAE

SEQ ID NO: 1538737 - protein, 8 aa, Mycobacterium tuberculosis
DAEPAQAE

SEQ ID NO: 1538738 - protein, 6 aa, Mycobacterium tuberculosis
DDSNRV

SEQ ID NO: 1538739 - protein, 7 aa, Mycobacterium tuberculosis
DDTEVGV

SEQ ID NO: 1538740 - protein, 6 aa, Mycobacterium tuberculosis
DEMRDQ

SEQ ID NO: 1538741 - protein, 4 aa, Mycobacterium tuberculosis
DEPP

SEQ ID NO: 1538742 - protein, 6 aa, Mycobacterium tuberculosis
DGNKAS

SEQ ID NO: 1538743 - protein, 7 aa, Mycobacterium tuberculosis
DLTDSGR

SEQ ID NO: 1538744 - protein, 9 aa, Mycobacterium tuberculosis
DPSADSTTT

SEQ ID NO: 1538745 - protein, 6 aa, Mycobacterium tuberculosis
DRLRSG

SEQ ID NO: 1538746 - protein, 4 aa, Mycobacterium tuberculosis
DRNR

SEQ ID NO: 1538747 - protein, 7 aa, Mycobacterium tuberculosis
DTGSGSI

SEQ ID NO: 1538748 - protein, 10 aa, Mycobacterium tuberculosis
DVQPAARGSI

SEQ ID NO: 1538749 - protein, 13 aa, Mycobacterium tuberculosis
EAIGTASDKLASI

SEQ ID NO: 1538750 - protein, 5 aa, Mycobacterium tuberculosis
EAMGN

SEQ ID NO: 1538751 - protein, 14 aa, Mycobacterium tuberculosis
EASGSAGKVTVSPV

SEQ ID NO: 1538752 - protein, 5 aa, Mycobacterium tuberculosis
ECTPD

SEQ ID NO: 1538753 - protein, 13 aa, Mycobacterium tuberculosis
EDEVERRRGDLPT

SEQ ID NO: 1538754 - protein, 5 aa, Mycobacterium tuberculosis
EISDN

SEQ ID NO: 1538755 - protein, 5 aa, Mycobacterium tuberculosis
ELTSA

SEQ ID NO: 1538756 - protein, 10 aa, Mycobacterium tuberculosis
EQASSSTQPL

SEQ ID NO: 1538757 - protein, 6 aa, Mycobacterium tuberculosis
ERRGQP

SEQ ID NO: 1538758 - protein, 7 aa, Mycobacterium tuberculosis
ESLSSGP

SEQ ID NO: 1538759 - protein, 7 aa, Mycobacterium tuberculosis
ESRDVTR

SEQ ID NO: 1538760 - protein, 11 aa, Mycobacterium tuberculosis
ETAGNQIRDAK

SEQ ID NO: 1538761 - protein, 6 aa, Mycobacterium tuberculosis
FDPAWG

SEQ ID NO: 1538762 - protein, 28 aa, Mycobacterium tuberculosis
FVGNGGAGGNGQLGSGAVSSAGGMGGNG

SEQ ID NO: 1538763 - protein, 5 aa, Mycobacterium tuberculosis
GAAGN

SEQ ID NO: 1538764 - protein, 7 aa, Mycobacterium tuberculosis
GADEVST

SEQ ID NO: 1538765 - protein, 7 aa, Mycobacterium tuberculosis
GAERLPN

SEQ ID NO: 1538766 - protein, 8 aa, Mycobacterium tuberculosis
GAFGPNGN

SEQ ID NO: 1538767 - protein, 19 aa, Mycobacterium tuberculosis
GAGGNGGMGGVAPSTGPSM

SEQ ID NO: 1538768 - protein, 6 aa, Mycobacterium tuberculosis
GAGHTG

SEQ ID NO: 1538769 - protein, 4 aa, Mycobacterium tuberculosis
GAPI

SEQ ID NO: 1538770 - protein, 10 aa, Mycobacterium tuberculosis
GAPQTGKSTA

SEQ ID NO: 1538771 - protein, 23 aa, Mycobacterium tuberculosis
GDLTNLGSSISAANASAASATTQ

SEQ ID NO: 1538772 - protein, 19 aa, Mycobacterium tuberculosis
GDTASAAQLSDNPNEAREA

SEQ ID NO: 1538773 - protein, 5 aa, Mycobacterium tuberculosis
GEMSR

SEQ ID NO: 1538774 - protein, 14 aa, Mycobacterium tuberculosis
GGFGGQGGNGGQSG

SEQ ID NO: 1538775 - protein, 8 aa, Mycobacterium tuberculosis
GGSPAPRC

SEQ ID NO: 1538776 - protein, 7 aa, Mycobacterium tuberculosis
GGSSEYA

SEQ ID NO: 1538777 - protein, 8 aa, Mycobacterium tuberculosis
GGTLPGID

SEQ ID NO: 1538778 - protein, 14 aa, Mycobacterium tuberculosis
GGVGGPGGSGGASA

SEQ ID NO: 1538779 - protein, 7 aa, Mycobacterium tuberculosis
GHNDPEL

SEQ ID NO: 1538780 - protein, 15 aa, Mycobacterium tuberculosis
GIGPARLDKRRNLVR

SEQ ID NO: 1538781 - protein, 4 aa, Mycobacterium tuberculosis
GKGY

SEQ ID NO: 1538782 - protein, 5 aa, Mycobacterium tuberculosis
GLPAT

SEQ ID NO: 1538783 - protein, 7 aa, Mycobacterium tuberculosis
GRAQPQL

SEQ ID NO: 1538784 - protein, 19 aa, Mycobacterium tuberculosis
GSAPPTSQTAAAAKPNPST

SEQ ID NO: 1538785 - protein, 9 aa, Mycobacterium tuberculosis
GSGRGPAPI

SEQ ID NO: 1538786 - protein, 36 aa, Mycobacterium tuberculosis; identical to SEQ ID NO: 1368830

SEQ ID NO: 1538787 - protein, 7 aa, Mycobacterium tuberculosis
GTDEVST

SEQ ID NO: 1538788 - protein, 8 aa, Mycobacterium tuberculosis
GTPGPADV

SEQ ID NO: 1538789 - protein, 9 aa, Mycobacterium tuberculosis
GTRSPARDF

SEQ ID NO: 1538790 - protein, 9 aa, Mycobacterium tuberculosis
GVPTPGLPF

SEQ ID NO: 1538791 - protein, 6 aa, Mycobacterium tuberculosis
GVYANS

SEQ ID NO: 1538792 - protein, 19 aa, Mycobacterium tuberculosis
GYTTTGSIDDAVASLRAAL

SEQ ID NO: 1538793 - protein, 15 aa, Mycobacterium tuberculosis
HADPAPAPAPAPNIP

SEQ ID NO: 1538794 - protein, 4 aa, Mycobacterium tuberculosis
HDAG

SEQ ID NO: 1538795 - protein, 5 aa, Mycobacterium tuberculosis
HGETV

SEQ ID NO: 1538796 - protein, 4 aa, Mycobacterium tuberculosis
HGPA

SEQ ID NO: 1538797 - protein, 9 aa, Mycobacterium tuberculosis
IAPNAGLDP

SEQ ID NO: 1538798 - protein, 7 aa, Mycobacterium tuberculosis
KASSQDV

SEQ ID NO: 1538799 - protein, 11 aa, Mycobacterium tuberculosis
KNTPNSRGTIG

SEQ ID NO: 1538800 - protein, 8 aa, Mycobacterium tuberculosis
KPGTGSTF

SEQ ID NO: 1538801 - protein, 7 aa, Mycobacterium tuberculosis
KSAPGCP

SEQ ID NO: 1538802 - protein, 5 aa, Mycobacterium tuberculosis
KSDSI

SEQ ID NO: 1538803 - protein, 28 aa, Mycobacterium tuberculosis
LGLPTDPKKLASVAPSSNALLAAALVRV

SEQ ID NO: 1538804 - protein, 11 aa, Mycobacterium tuberculosis
LGQPGTYTDFG

SEQ ID NO: 1538805 - protein, 13 aa, Mycobacterium tuberculosis
LPAGAKITRTTTK

SEQ ID NO: 1538806 - protein, 4 aa, Mycobacterium tuberculosis
LPGQ

SEQ ID NO: 1538807 - protein, 11 aa, Mycobacterium tuberculosis
LPPAQRADPVT

SEQ ID NO: 1538808 - protein, 7 aa, Mycobacterium tuberculosis
LPREEWP

SEQ ID NO: 1538809 - protein, 12 aa, Mycobacterium tuberculosis
LQSGSQEDETAW

SEQ ID NO: 1538810 - protein, 9 aa, Mycobacterium tuberculosis
LRRASPSAV

SEQ ID NO: 1538811 - protein, 7 aa, Mycobacterium tuberculosis
LSRDGTR

SEQ ID NO: 1538812 - protein, 11 aa, Mycobacterium tuberculosis
LSRGNDNALGP

SEQ ID NO: 1538813 - protein, 11 aa, Mycobacterium tuberculosis
LTAPEGTPGEW

SEQ ID NO: 1538814 - protein, 7 aa, Mycobacterium tuberculosis
LTQGGRT

SEQ ID NO: 1538815 - protein, 11 aa, Mycobacterium tuberculosis
MPQPPGYDTNA

SEQ ID NO: 1538816 - protein, 9 aa, Mycobacterium tuberculosis
NADEPGCSA

SEQ ID NO: 1538817 - protein, 4 aa, Mycobacterium tuberculosis
NDPD

SEQ ID NO: 1538818 - protein, 4 aa, Mycobacterium tuberculosis
NDPE

SEQ ID NO: 1538819 - protein, 6 aa, Mycobacterium tuberculosis
NGRIAG

SEQ ID NO: 1538820 - protein, 4 aa, Mycobacterium tuberculosis
NSPE

SEQ ID NO: 1538821 - protein, 4 aa, Mycobacterium tuberculosis
PAST

SEQ ID NO: 1538822 - protein, 7 aa, Mycobacterium tuberculosis
PATLPES

SEQ ID NO: 1538823 - protein, 7 aa, Mycobacterium tuberculosis
PDTIDES

SEQ ID NO: 1538824 - protein, 4 aa, Mycobacterium tuberculosis
PGVV

SEQ ID NO: 1538825 - protein, 13 aa, Mycobacterium tuberculosis
PPEQVRTSRPDGA

SEQ ID NO: 1538826 - protein, 6 aa, Mycobacterium tuberculosis
QATASF

SEQ ID NO: 1538827 - protein, 5 aa, Mycobacterium tuberculosis
QLEPQ

SEQ ID NO: 1538828 - protein, 9 aa, Mycobacterium tuberculosis
QLPNTPGAG

SEQ ID NO: 1538829 - protein, 4 aa, Mycobacterium tuberculosis
QNGV

SEQ ID NO: 1538830 - protein, 11 aa, Mycobacterium tuberculosis
QPQRAAAMTAS

SEQ ID NO: 1538831 - protein, 7 aa, Mycobacterium tuberculosis
QTSSPAH

SEQ ID NO: 1538832 - protein, 5 aa, Mycobacterium tuberculosis
QVTST

SEQ ID NO: 1538833 - protein, 7 aa, Mycobacterium tuberculosis
RATAAAK

SEQ ID NO: 1538834 - protein, 6 aa, Mycobacterium tuberculosis
RGAGTI

SEQ ID NO: 1538835 - protein, 18 aa, Mycobacterium tuberculosis
RGEPERAPCGREPPPDLA

SEQ ID NO: 1538836 - protein, 8 aa, Mycobacterium tuberculosis
RKDPTIVR

SEQ ID NO: 1538837 - protein, 6 aa, Mycobacterium tuberculosis
RLDEGR

SEQ ID NO: 1538838 - protein, 6 aa, Mycobacterium tuberculosis
RNDGIA

SEQ ID NO: 1538839 - protein, 28 aa, Mycobacterium tuberculosis
RPTNSGPATAAGTTAEPTYTAAETAAAH

SEQ ID NO: 1538840 - protein, 19 aa, Mycobacterium tuberculosis
RSGLAGRGRIPAHSARRRG

SEQ ID NO: 1538841 - protein, 16 aa, Mycobacterium tuberculosis
RSTSEQVHADLGVTPL

SEQ ID NO: 1538842 - protein, 5 aa, Mycobacterium tuberculosis
RTAPR

SEQ ID NO: 1538843 - protein, 5 aa, Mycobacterium tuberculosis
RTGKL

SEQ ID NO: 1538844 - protein, 13 aa, Mycobacterium tuberculosis
RTSHAAPAAAIGT

SEQ ID NO: 1538845 - protein, 15 aa, Mycobacterium tuberculosis
SAEAPSTGTGPNAAP

SEQ ID NO: 1538846 - protein, 4 aa, Mycobacterium tuberculosis
SAPL

SEQ ID NO: 1538847 - protein, 14 aa, Mycobacterium tuberculosis
SATYQSAIPPRGTQ

SEQ ID NO: 1538848 - protein, 8 aa, Mycobacterium tuberculosis
SDEDSAKA

SEQ ID NO: 1538849 - protein, 6 aa, Mycobacterium tuberculosis
SEHPSF

SEQ ID NO: 1538850 - protein, 8 aa, Mycobacterium tuberculosis
SGFGGGGH

SEQ ID NO: 1538851 - protein, 6 aa, Mycobacterium tuberculosis
SGTGNV

SEQ ID NO: 1538852 - protein, 4 aa, Mycobacterium tuberculosis
SIAP

SEQ ID NO: 1538853 - protein, 7 aa, Mycobacterium tuberculosis
SRSTEFA

SEQ ID NO: 1538854 - protein, 4 aa, Mycobacterium tuberculosis
SSDG

SEQ ID NO: 1538855 - protein, 13 aa, Mycobacterium tuberculosis
SSTNGFNAASPAF

SEQ ID NO: 1538856 - protein, 20 aa, Mycobacterium tuberculosis
STTVSGDRDDLKPGVGDRSW

SEQ ID NO: 1538857 - protein, 10 aa, Mycobacterium tuberculosis
SVGCSRQDVE

SEQ ID NO: 1538858 - protein, 9 aa, Mycobacterium tuberculosis
TAERGNGAI

SEQ ID NO: 1538859 - protein, 7 aa, Mycobacterium tuberculosis
TAGQKKA

SEQ ID NO: 1538860 - protein, 15 aa, Mycobacterium tuberculosis
TATARAGPAKVPTTP

SEQ ID NO: 1538861 - protein, 9 aa, Mycobacterium tuberculosis
TDAVPGLSD

SEQ ID NO: 1538862 - protein, 4 aa, Mycobacterium tuberculosis
TDFG

SEQ ID NO: 1538863 - protein, 8 aa, Mycobacterium tuberculosis
TDGSPVTA

SEQ ID NO: 1538864 - protein, 5 aa, Mycobacterium tuberculosis
TDHDT

SEQ ID NO: 1538865 - protein, 22 aa, Mycobacterium tuberculosis
TGKSGSATLRPRSDINPDGPTT

SEQ ID NO: 1538866 - protein, 9 aa, Mycobacterium tuberculosis
TGPPTGGLT

SEQ ID NO: 1538867 - protein, 6 aa, Mycobacterium tuberculosis
TGRGRR

SEQ ID NO: 1538868 - protein, 4 aa, Mycobacterium tuberculosis
TKDD

SEQ ID NO: 1538869 - protein, 8 aa, Mycobacterium tuberculosis
TLDERDNQ

SEQ ID NO: 1538870 - protein, 7 aa, Mycobacterium tuberculosis
TPAPSFT

SEQ ID NO: 1538871 - protein, 6 aa, Mycobacterium tuberculosis
TQGRGA

SEQ ID NO: 1538872 - protein, 6 aa, Mycobacterium tuberculosis
TRAAAT

SEQ ID NO: 1538873 - protein, 6 aa, Mycobacterium tuberculosis
TTEQLG

SEQ ID NO: 1538874 - protein, 5 aa, Mycobacterium tuberculosis
TTKDR

SEQ ID NO: 1538875 - protein, 6 aa, Mycobacterium tuberculosis
TTQQAE

SEQ ID NO: 1538876 - protein, 8 aa, Mycobacterium tuberculosis
VAAAPTTE

SEQ ID NO: 1538877 - protein, 14 aa, Mycobacterium tuberculosis
VGTTGGAGGNGGGA

SEQ ID NO: 1538878 - protein, 6 aa, Mycobacterium tuberculosis
VKPTVS

SEQ ID NO: 1538879 - protein, 8 aa, Mycobacterium tuberculosis
VPEEAGPV

SEQ ID NO: 1538880 - protein, 4 aa, Mycobacterium tuberculosis
VRVP

SEQ ID NO: 1538881 - protein, 4 aa, Mycobacterium tuberculosis
VSVT

SEQ ID NO: 1538882 - protein, 7 aa, Mycobacterium tuberculosis
VTPDGTA

SEQ ID NO: 1538883 - protein, 7 aa, Mycobacterium tuberculosis
YAEDTGT

SEQ ID NO: 1538884 - protein, 21 aa, Mycobacterium tuberculosis
YGGNPGRPSEQGLAADARAAQ

SEQ ID NO: 1538885 - protein, 8 aa, Mycobacterium tuberculosis
YSPQTRFS

SEQ ID NO: 1538886 - protein, 6 aa, Mycobacterium tuberculosis
AAAPYA

SEQ ID NO: 1538887 - protein, 9 aa, Mycobacterium tuberculosis
AAASDVANI

SEQ ID NO: 1538888 - protein, 8 aa, Mycobacterium tuberculosis
AADPRSNL

SEQ ID NO: 1538889 - protein, 15 aa, Mycobacterium tuberculosis
AAEGRAGYGVPGDHG

SEQ ID NO: 1538890 - protein, 14 aa, Mycobacterium tuberculosis
AAGDYTTAAEDKPA

SEQ ID NO: 1538891 - protein, 9 aa, Mycobacterium tuberculosis
AALAGGDLS

SEQ ID NO: 1538892 - protein, 10 aa, Mycobacterium tuberculosis
AAPGLGKTKI

SEQ ID NO: 1538893 - protein, 19 aa, Mycobacterium tuberculosis
AAQGRGASTISGALRSRDT

SEQ ID NO: 1538894 - protein, 14 aa, Mycobacterium tuberculosis
AARAAGASAQAKAV

SEQ ID NO: 1538895 - protein, 14 aa, Mycobacterium tuberculosis
AARSPTSVLPGLSA

SEQ ID NO: 1538896 - protein, 5 aa, Mycobacterium tuberculosis
ACSSG

SEQ ID NO: 1538897 - protein, 8 aa, Mycobacterium tuberculosis
ADPTETNN

SEQ ID NO: 1538898 - protein, 11 aa, Mycobacterium tuberculosis
ADVDSQPGPVR

SEQ ID NO: 1538899 - protein, 9 aa, Mycobacterium tuberculosis
AEPHYRPSA

SEQ ID NO: 1538900 - protein, 10 aa, Mycobacterium tuberculosis
AGDDSTQGVA

SEQ ID NO: 1538901 - protein, 5 aa, Mycobacterium tuberculosis
AGGNS

SEQ ID NO: 1538902 - protein, 12 aa, Mycobacterium tuberculosis
AKRRDATQLLEV

SEQ ID NO: 1538903 - protein, 14 aa, Mycobacterium tuberculosis
ALSAANAAAAAPTT

SEQ ID NO: 1538904 - protein, 16 aa, Mycobacterium tuberculosis
ANGGGCCGRPAREGVD

SEQ ID NO: 1538905 - protein, 8 aa, Mycobacterium tuberculosis
APDTENAA

SEQ ID NO: 1538906 - protein, 7 aa, Mycobacterium tuberculosis
APRPQRE

SEQ ID NO: 1538907 - protein, 6 aa, Mycobacterium tuberculosis
AQAAAD

SEQ ID NO: 1538908 - protein, 5 aa, Mycobacterium tuberculosis
ARRDE

SEQ ID NO: 1538909 - protein, 6 aa, Mycobacterium tuberculosis
ARRSDG

SEQ ID NO: 1538910 - protein, 7 aa, Mycobacterium tuberculosis
ASPSGVA

SEQ ID NO: 1538911 - protein, 6 aa, Mycobacterium tuberculosis
ASSPMV

SEQ ID NO: 1538912 - protein, 11 aa, Mycobacterium tuberculosis
AVPGSGGIRGP

SEQ ID NO: 1538913 - protein, 9 aa, Mycobacterium tuberculosis
AVRGRGGLS

SEQ ID NO: 1538914 - protein, 6 aa, Mycobacterium tuberculosis
CPSALN

SEQ ID NO: 1538915 - protein, 22 aa, Mycobacterium tuberculosis
DAEEPELNRDPPGDERDTTTPH

SEQ ID NO: 1538916 - protein, 8 aa, Mycobacterium tuberculosis
DATPQVRG

SEQ ID NO: 1538917 - protein, 10 aa, Mycobacterium tuberculosis
DGAGERARTA

SEQ ID NO: 1538918 - protein, 7 aa, Mycobacterium tuberculosis
DGAGRSY

SEQ ID NO: 1538919 - protein, 11 aa, Mycobacterium tuberculosis
DGDQQARGRPI

SEQ ID NO: 1538920 - protein, 7 aa, Mycobacterium tuberculosis
DGPPVPD

SEQ ID NO: 1538921 - protein, 4 aa, Mycobacterium tuberculosis
DSLP

SEQ ID NO: 1538922 - protein, 7 aa, Mycobacterium tuberculosis
EAEYEKV

SEQ ID NO: 1538923 - protein, 4 aa, Mycobacterium tuberculosis
EGVS

SEQ ID NO: 1538924 - protein, 7 aa, Mycobacterium tuberculosis
ELPEVPQ

SEQ ID NO: 1538925 - protein, 13 aa, Mycobacterium tuberculosis
ELSAARAAADAAL

SEQ ID NO: 1538926 - protein, 4 aa, Mycobacterium tuberculosis
ENGG

SEQ ID NO: 1538927 - protein, 4 aa, Mycobacterium tuberculosis
EPCP

SEQ ID NO: 1538928 - protein, 14 aa, Mycobacterium tuberculosis
EPLSGQFDDDGAVS

SEQ ID NO: 1538929 - protein, 5 aa, Mycobacterium tuberculosis
ERAEQ

SEQ ID NO: 1538930 - protein, 10 aa, Mycobacterium tuberculosis
ERTEDGFGQG

SEQ ID NO: 1538931 - protein, 10 aa, Mycobacterium tuberculosis
ESIDDPAGVR

SEQ ID NO: 1538932 - protein, 5 aa, Mycobacterium tuberculosis
ESPAG

SEQ ID NO: 1538933 - protein, 4 aa, Mycobacterium tuberculosis
GAAW

SEQ ID NO: 1538934 - protein, 15 aa, Mycobacterium tuberculosis
GAGDEQLVQVAWSPP

SEQ ID NO: 1538935 - protein, 16 aa, Mycobacterium tuberculosis
GATAGAVSARAAEQQR

SEQ ID NO: 1538936 - protein, 16 aa, Mycobacterium tuberculosis
GCDSHNSGSLGADPRQ

SEQ ID NO: 1538937 - protein, 17 aa, Mycobacterium tuberculosis
GCSSAPTPSANAANHGH

SEQ ID NO: 1538938 - protein, 16 aa, Mycobacterium tuberculosis
GDGGAGGTGGLGDVNG

SEQ ID NO: 1538939 - protein, 12 aa, Mycobacterium tuberculosis
GDQGASGRRTSA

SEQ ID NO: 1538940 - protein, 17 aa, Mycobacterium tuberculosis
GERLNEQAATDTFGNYR

SEQ ID NO: 1538941 - protein, 6 aa, Mycobacterium tuberculosis
GGANDN

SEQ ID NO: 1538942 - protein, 8 aa, Mycobacterium tuberculosis
GGITPGNS

SEQ ID NO: 1538943 - protein, 9 aa, Mycobacterium tuberculosis
GGLRTGNTV

SEQ ID NO: 1538944 - protein, 7 aa, Mycobacterium tuberculosis
GGTAAGV

SEQ ID NO: 1538945 - protein, 7 aa, Mycobacterium tuberculosis
GKLPDSL

SEQ ID NO: 1538946 - protein, 12 aa, Mycobacterium tuberculosis
GKTGEAEFPGGS

SEQ ID NO: 1538947 - protein, 6 aa, Mycobacterium tuberculosis
GLPSSA

SEQ ID NO: 1538948 - protein, 13 aa, Mycobacterium tuberculosis
GNARADRARNTYT

SEQ ID NO: 1538949 - protein, 11 aa, Mycobacterium tuberculosis
GPNTGTPITSV

SEQ ID NO: 1538950 - protein, 4 aa, Mycobacterium tuberculosis
GQAN

SEQ ID NO: 1538951 - protein, 12 aa, Mycobacterium tuberculosis
GRNANDLNRPQF

SEQ ID NO: 1538952 - protein, 8 aa, Mycobacterium tuberculosis
GRPDEGAL

SEQ ID NO: 1538953 - protein, 4 aa, Mycobacterium tuberculosis
GSEL

SEQ ID NO: 1538954 - protein, 6 aa, Mycobacterium tuberculosis
GSGPGF

SEQ ID NO: 1538955 - protein, 8 aa, Mycobacterium tuberculosis
GSHPKGAV

SEQ ID NO: 1538956 - protein, 8 aa, Mycobacterium tuberculosis
GTDARTRA

SEQ ID NO: 1538957 - protein, 8 aa, Mycobacterium tuberculosis
GVASEEGL

SEQ ID NO: 1538958 - protein, 12 aa, Mycobacterium tuberculosis
GVGASGNNGTSA

SEQ ID NO: 1538959 - protein, 8 aa, Mycobacterium tuberculosis
GYDPNGGY

SEQ ID NO: 1538960 - protein, 13 aa, Mycobacterium tuberculosis
HPRGEAANALGAT

SEQ ID NO: 1538961 - protein, 10 aa, Mycobacterium tuberculosis
HTGSSLPSAP

SEQ ID NO: 1538962 - protein, 18 aa, Mycobacterium tuberculosis
IANANDGTRAVGTPGYQA

SEQ ID NO: 1538963 - protein, 13 aa, Mycobacterium tuberculosis
IAPGTYRTEGPSN

SEQ ID NO: 1538964 - protein, 8 aa, Mycobacterium tuberculosis
IDDSTPNR

SEQ ID NO: 1538965 - protein, 12 aa, Mycobacterium tuberculosis
IDPAGTDGGPQL

SEQ ID NO: 1538966 - protein, 4 aa, Mycobacterium tuberculosis
ISNN

SEQ ID NO: 1538967 - protein, 15 aa, Mycobacterium tuberculosis
KKELHSSGSTAQENA

SEQ ID NO: 1538968 - protein, 19 aa, Mycobacterium tuberculosis
KTPTGRSAIAADRGIDEHC

SEQ ID NO: 1538969 - protein, 12 aa, Mycobacterium tuberculosis
KVTSERATGQRE

SEQ ID NO: 1538970 - protein, 8 aa, Mycobacterium tuberculosis
LARPGTEI

SEQ ID NO: 1538971 - protein, 19 aa, Mycobacterium tuberculosis
LDTTTEGPVTTSGATCADN

SEQ ID NO: 1538972 - protein, 7 aa, Mycobacterium tuberculosis
LGLPPGM

SEQ ID NO: 1538973 - protein, 10 aa, Mycobacterium tuberculosis
LGNAGSSNYG

SEQ ID NO: 1538974 - protein, 9 aa, Mycobacterium tuberculosis
LNSGGGQHV

SEQ ID NO: 1538975 - protein, 15 aa, Mycobacterium tuberculosis
LPLPPNARRVEDPEM

SEQ ID NO: 1538976 - protein, 4 aa, Mycobacterium tuberculosis
LRTQ

SEQ ID NO: 1538977 - protein, 10 aa, Mycobacterium tuberculosis
LSKQTGQQVS

SEQ ID NO: 1538978 - protein, 20 aa, Mycobacterium tuberculosis
NAGADADGPVATTGLYPPGS

SEQ ID NO: 1538979 - protein, 7 aa, Mycobacterium tuberculosis
NECGKTA

SEQ ID NO: 1538980 - protein, 7 aa, Mycobacterium tuberculosis
NEFPDPT

SEQ ID NO: 1538981 - protein, 25 aa, Mycobacterium tuberculosis
NGGVGGAGGYGASGDGGNAGNGGLG

SEQ ID NO: 1538982 - protein, 10 aa, Mycobacterium tuberculosis
NGHTYTTHPG

SEQ ID NO: 1538983 - protein, 8 aa, Mycobacterium tuberculosis
NGSLAGGT

SEQ ID NO: 1538984 - protein, 15 aa, Mycobacterium tuberculosis
NNPSGVGTVVFNYPP

SEQ ID NO: 1538985 - protein, 12 aa, Mycobacterium tuberculosis
NPSNRAGGSLSS

SEQ ID NO: 1538986 - protein, 10 aa, Mycobacterium tuberculosis
NTGFGSPVDQ

SEQ ID NO: 1538987 - protein, 11 aa, Mycobacterium tuberculosis
NTGGGGGSGIA

SEQ ID NO: 1538988 - protein, 13 aa, Mycobacterium tuberculosis
PAFSPPAQALGGG

SEQ ID NO: 1538989 - protein, 9 aa, Mycobacterium tuberculosis
PAPDVSQAQ

SEQ ID NO: 1538990 - protein, 77 aa, Mycobacterium tuberculosis; identical to SEQ ID NO: 230694

SEQ ID NO: 1538991 - protein, 55 aa, Mycobacterium tuberculosis; identical to SEQ ID NO: 1447554

SEQ ID NO: 1538992 - protein, 6 aa, Mycobacterium tuberculosis
PDPTEL

SEQ ID NO: 1538993 - protein, 7 aa, Mycobacterium tuberculosis
PDTPEVR

SEQ ID NO: 1538994 - protein, 12 aa, Mycobacterium tuberculosis
PGFGNSTELPSS

SEQ ID NO: 1538995 - protein, 5 aa, Mycobacterium tuberculosis
PIVGN

SEQ ID NO: 1538996 - protein, 8 aa, Mycobacterium tuberculosis
PLCTPSRG

SEQ ID NO: 1538997 - protein, 8 aa, Mycobacterium tuberculosis
PLPPAADD

SEQ ID NO: 1538998 - protein, 8 aa, Mycobacterium tuberculosis
PTARRRDA

SEQ ID NO: 1538999 - protein, 4 aa, Mycobacterium tuberculosis
PTRR

SEQ ID NO: 1539000 - protein, 6 aa, Mycobacterium tuberculosis
PTYPGD

SEQ ID NO: 1539001 - protein, 12 aa, Mycobacterium tuberculosis
QRRQDEAMRPRT

SEQ ID NO: 1539002 - protein, 7 aa, Mycobacterium tuberculosis
RAQAAGQ

SEQ ID NO: 1539003 - protein, 8 aa, Mycobacterium tuberculosis
RDEAPADL

SEQ ID NO: 1539004 - protein, 8 aa, Mycobacterium tuberculosis
RDSISEPT

SEQ ID NO: 1539005 - protein, 7 aa, Mycobacterium tuberculosis
RKDIRTT

SEQ ID NO: 1539006 - protein, 7 aa, Mycobacterium tuberculosis
RKEFGPA

SEQ ID NO: 1539007 - protein, 8 aa, Mycobacterium tuberculosis
RKRPATGW

SEQ ID NO: 1539008 - protein, 8 aa, Mycobacterium tuberculosis
RPMPLPPG

SEQ ID NO: 1539009 - protein, 5 aa, Mycobacterium tuberculosis
RQEPR

SEQ ID NO: 1539010 - protein, 4 aa, Mycobacterium tuberculosis
RRAT

SEQ ID NO: 1539011 - protein, 10 aa, Mycobacterium tuberculosis
RRSGDPVAPP

SEQ ID NO: 1539012 - protein, 7 aa, Mycobacterium tuberculosis
RSGGAAR

SEQ ID NO: 1539013 - protein, 4 aa, Mycobacterium tuberculosis
RTPA

SEQ ID NO: 1539014 - protein, 7 aa, Mycobacterium tuberculosis
RTTTPYT

SEQ ID NO: 1539015 - protein, 7 aa, Mycobacterium tuberculosis
RYPQSNG

SEQ ID NO: 1539016 - protein, 9 aa, Mycobacterium tuberculosis
RYRPADSAA

SEQ ID NO: 1539017 - protein, 19 aa, Mycobacterium tuberculosis
SAAAADNIPGTTITFDIAA

SEQ ID NO: 1539018 - protein, 6 aa, Mycobacterium tuberculosis
SADGYR

SEQ ID NO: 1539019 - protein, 5 aa, Mycobacterium tuberculosis
SAGPI

SEQ ID NO: 1539020 - protein, 25 aa, Mycobacterium tuberculosis
SALDAQPDPHLSGDEPPSRPLTPET

SEQ ID NO: 1539021 - protein, 11 aa, Mycobacterium tuberculosis
SASESRNVLGT

SEQ ID NO: 1539022 - protein, 11 aa, Mycobacterium tuberculosis
SASRPAAPIPL

SEQ ID NO: 1539023 - protein, 6 aa, Mycobacterium tuberculosis
SDEGIQ

SEQ ID NO: 1539024 - protein, 5 aa, Mycobacterium tuberculosis
SELST

SEQ ID NO: 1539025 - protein, 10 aa, Mycobacterium tuberculosis
SGAHRPTPTI

SEQ ID NO: 1539026 - protein, 12 aa, Mycobacterium tuberculosis
SGGSGGSGQPSI

SEQ ID NO: 1539027 - protein, 5 aa, Mycobacterium tuberculosis
SPAAA

SEQ ID NO: 1539028 - protein, 10 aa, Mycobacterium tuberculosis
SPDTQDTRAV

SEQ ID NO: 1539029 - protein, 5 aa, Mycobacterium tuberculosis
SPSNA

SEQ ID NO: 1539030 - protein, 7 aa, Mycobacterium tuberculosis
SSASRRI

SEQ ID NO: 1539031 - protein, 5 aa, Mycobacterium tuberculosis
SSNPL

SEQ ID NO: 1539032 - protein, 9 aa, Mycobacterium tuberculosis
SSPAALGAK

SEQ ID NO: 1539033 - protein, 5 aa, Mycobacterium tuberculosis
TADEA

SEQ ID NO: 1539034 - protein, 9 aa, Mycobacterium tuberculosis
TANAGSFNV

SEQ ID NO: 1539035 - protein, 28 aa, Mycobacterium tuberculosis
TDFAGSDVPLNPSTGQPDRSAERCGSPA

SEQ ID NO: 1539036 - protein, 5 aa, Mycobacterium tuberculosis
TGAGA

SEQ ID NO: 1539037 - protein, 4 aa, Mycobacterium tuberculosis
TGGG

SEQ ID NO: 1539038 - protein, 4 aa, Mycobacterium tuberculosis
TGGI

SEQ ID NO: 1539039 - protein, 12 aa, Mycobacterium tuberculosis
TGQTTGYAPPGT

SEQ ID NO: 1539040 - protein, 11 aa, Mycobacterium tuberculosis
THSAPEVSNEN

SEQ ID NO: 1539041 - protein, 9 aa, Mycobacterium tuberculosis
TKDTGTSRR

SEQ ID NO: 1539042 - protein, 6 aa, Mycobacterium tuberculosis
TLYDAG

SEQ ID NO: 1539043 - protein, 18 aa, Mycobacterium tuberculosis
TPGVEGHPYRQRATPIPT

SEQ ID NO: 1539044 - protein, 12 aa, Mycobacterium tuberculosis
TPPTAPPGTPGE

SEQ ID NO: 1539045 - protein, 4 aa, Mycobacterium tuberculosis
TPTE

SEQ ID NO: 1539046 - protein, 8 aa, Mycobacterium tuberculosis
TPTPAPLH

SEQ ID NO: 1539047 - protein, 15 aa, Mycobacterium tuberculosis
TQETTPVRGTPSGLC

SEQ ID NO: 1539048 - protein, 8 aa, Mycobacterium tuberculosis
TTDGALPS

SEQ ID NO: 1539049 - protein, 22 aa, Mycobacterium tuberculosis
TTGGHRAGVRAPAPPPRPPTVK

SEQ ID NO: 1539050 - protein, 26 aa, Mycobacterium tuberculosis
TTSPAGIANADDAGLDPNAAAGPDAV

SEQ ID NO: 1539051 - protein, 10 aa, Mycobacterium tuberculosis
VETAQRRGEI

SEQ ID NO: 1539052 - protein, 7 aa, Mycobacterium tuberculosis
VGHDDRG

SEQ ID NO: 1539053 - protein, 9 aa, Mycobacterium tuberculosis
VGPTGKVKA

SEQ ID NO: 1539054 - protein, 10 aa, Mycobacterium tuberculosis
VGSGPTIGGV

SEQ ID NO: 1539055 - protein, 15 aa, Mycobacterium tuberculosis
VSPAGSGKSTTIPLS

SEQ ID NO: 1539056 - protein, 13 aa, Mycobacterium tuberculosis
VTPGRQDTTRLRR

SEQ ID NO: 1539057 - protein, 18 aa, Mycobacterium tuberculosis
VTRADGGKSGIGRGYGGA

SEQ ID NO: 1539058 - protein, 11 aa, Mycobacterium tuberculosis
WADGASAAANT

SEQ ID NO: 1539059 - protein, 5 aa, Mycobacterium tuberculosis
WPGAG

SEQ ID NO: 1539060 - protein, 9 aa, Mycobacterium tuberculosis
WPLGPTHPS

SEQ ID NO: 1539061 - protein, 18 aa, Mycobacterium tuberculosis
AAADPATPQPNPTQQLPG

SEQ ID NO: 1539062 - protein, 8 aa, Mycobacterium tuberculosis
AAEQGMGP

SEQ ID NO: 1539063 - protein, 7 aa, Mycobacterium tuberculosis
AAGAGAA

SEQ ID NO: 1539064 - protein, 13 aa, Mycobacterium tuberculosis
AALTAAATDIDGI

SEQ ID NO: 1539065 - protein, 9 aa, Mycobacterium tuberculosis
ADLATREEQ

SEQ ID NO: 1539066 - protein, 4 aa, Mycobacterium tuberculosis
AEPH

SEQ ID NO: 1539067 - protein, 5 aa, Mycobacterium tuberculosis
AEPSA

SEQ ID NO: 1539068 - protein, 6 aa, Mycobacterium tuberculosis
AFPHDS

SEQ ID NO: 1539069 - protein, 8 aa, Mycobacterium tuberculosis
AGADEVSA

SEQ ID NO: 1539070 - protein, 6 aa, Mycobacterium tuberculosis
AGCTND

SEQ ID NO: 1539071 - protein, 14 aa, Mycobacterium tuberculosis
AGDVQTAQHASEAA

SEQ ID NO: 1539072 - protein, 15 aa, Mycobacterium tuberculosis
AGGAGGNGGAGGAAG

SEQ ID NO: 1539073 - protein, 4 aa, Mycobacterium tuberculosis
AGIG

SEQ ID NO: 1539074 - protein, 9 aa, Mycobacterium tuberculosis
AGKDYDEVA

SEQ ID NO: 1539075 - protein, 8 aa, Mycobacterium tuberculosis
AGSADGAG

SEQ ID NO: 1539076 - protein, 8 aa, Mycobacterium tuberculosis
AITGSGDD

SEQ ID NO: 1539077 - protein, 7 aa, Mycobacterium tuberculosis
AKLPQDR

SEQ ID NO: 1539078 - protein, 9 aa, Mycobacterium tuberculosis
ALPAGLPPL

SEQ ID NO: 1539079 - protein, 46 aa, Mycobacterium tuberculosis
ALPGGSSNRFSPAPAPAPIASPIPVGAPGSTAVPPLPPPVTPAISG

SEQ ID NO: 1539080 - protein, 18 aa, Mycobacterium tuberculosis
APPIPSPQPLKSGDTIGL

SEQ ID NO: 1539081 - protein, 14 aa, Mycobacterium tuberculosis
ARAESVRAATDGTT

SEQ ID NO: 1539082 - protein, 8 aa, Mycobacterium tuberculosis
ARGQSVHT

SEQ ID NO: 1539083 - protein, 14 aa, Mycobacterium tuberculosis
ASAAAVDTNCGATL

SEQ ID NO: 1539084 - protein, 7 aa, Mycobacterium tuberculosis
ASEQGRG

SEQ ID NO: 1539085 - protein, 10 aa, Mycobacterium tuberculosis
ATESNPTAAS

SEQ ID NO: 1539086 - protein, 14 aa, Mycobacterium tuberculosis
DAAQAAKGSTITPR

SEQ ID NO: 1539087 - protein, 4 aa, Mycobacterium tuberculosis
DALD

SEQ ID NO: 1539088 - protein, 8 aa, Mycobacterium tuberculosis
DASASSQF

SEQ ID NO: 1539089 - protein, 7 aa, Mycobacterium tuberculosis
DAVSTDD

SEQ ID NO: 1539090 - protein, 10 aa, Mycobacterium tuberculosis
DDNAKPANSH

SEQ ID NO: 1539091 - protein, 6 aa, Mycobacterium tuberculosis
DGGGAV

SEQ ID NO: 1539092 - protein, 26 aa, Mycobacterium tuberculosis
DPADSELDRRQAQRVPVDRPGRGLSR

SEQ ID NO: 1539093 - protein, 5 aa, Mycobacterium tuberculosis
DRDAM

SEQ ID NO: 1539094 - protein, 7 aa, Mycobacterium tuberculosis
DRPINSA

SEQ ID NO: 1539095 - protein, 6 aa, Mycobacterium tuberculosis
DSDRYR

SEQ ID NO: 1539096 - protein, 8 aa, Mycobacterium tuberculosis
DTARGGQI

SEQ ID NO: 1539097 - protein, 7 aa, Mycobacterium tuberculosis
DTNTSMG

SEQ ID NO: 1539098 - protein, 4 aa, Mycobacterium tuberculosis
DVAS

SEQ ID NO: 1539099 - protein, 4 aa, Mycobacterium tuberculosis
DYAR

SEQ ID NO: 1539100 - protein, 6 aa, Mycobacterium tuberculosis
EHEPSD

SEQ ID NO: 1539101 - protein, 4 aa, Mycobacterium tuberculosis
FAGR

SEQ ID NO: 1539102 - protein, 5 aa, Mycobacterium tuberculosis
FGNSG

SEQ ID NO: 1539103 - protein, 14 aa, Mycobacterium tuberculosis
GAVGTASSPDGQDG

SEQ ID NO: 1539104 - protein, 6 aa, Mycobacterium tuberculosis
GDFPES

SEQ ID NO: 1539105 - protein, 8 aa, Mycobacterium tuberculosis
GDTGYTKS

SEQ ID NO: 1539106 - protein, 4 aa, Mycobacterium tuberculosis
GEGN

SEQ ID NO: 1539107 - protein, 7 aa, Mycobacterium tuberculosis
GEQDRLR

SEQ ID NO: 1539108 - protein, 9 aa, Mycobacterium tuberculosis
GGGNLGGQN

SEQ ID NO: 1539109 - protein, 7 aa, Mycobacterium tuberculosis
GGPGAGF

SEQ ID NO: 1539110 - protein, 17 aa, Mycobacterium tuberculosis
GGYNTGIGNGGTGSTGL

SEQ ID NO: 1539111 - protein, 16 aa, Mycobacterium tuberculosis
GKVDKDWDADATKGIP

SEQ ID NO: 1539112 - protein, 7 aa, Mycobacterium tuberculosis
GLGGHPR

SEQ ID NO: 1539113 - protein, 10 aa, Mycobacterium tuberculosis
GLGNAGSLAS

SEQ ID NO: 1539114 - protein, 6 aa, Mycobacterium tuberculosis
GMSPAE

SEQ ID NO: 1539115 - protein, 9 aa, Mycobacterium tuberculosis
GNAGSNNVG

SEQ ID NO: 1539116 - protein, 15 aa, Mycobacterium tuberculosis
GNANTGVANSGTVNT

SEQ ID NO: 1539117 - protein, 7 aa, Mycobacterium tuberculosis
GNPKNIR

SEQ ID NO: 1539118 - protein, 4 aa, Mycobacterium tuberculosis
GNTG

SEQ ID NO: 1539119 - protein, 11 aa, Mycobacterium tuberculosis
GPRHTAPATPG

SEQ ID NO: 1539120 - protein, 6 aa, Mycobacterium tuberculosis
GPRPTE

SEQ ID NO: 1539121 - protein, 4 aa, Mycobacterium tuberculosis
GQAR

SEQ ID NO: 1539122 - protein, 10 aa, Mycobacterium tuberculosis
GRIEPGPGAR

SEQ ID NO: 1539123 - protein, 4 aa, Mycobacterium tuberculosis
GRSG

SEQ ID NO: 1539124 - protein, 10 aa, Mycobacterium tuberculosis
GSAKQAERSY

SEQ ID NO: 1539125 - protein, 10 aa, Mycobacterium tuberculosis
GSANHGSPNV

SEQ ID NO: 1539126 - protein, 5 aa, Mycobacterium tuberculosis
GSAPM

SEQ ID NO: 1539127 - protein, 5 aa, Mycobacterium tuberculosis
GTATA

SEQ ID NO: 1539128 - protein, 9 aa, Mycobacterium tuberculosis
GTENPSGPI

SEQ ID NO: 1539129 - protein, 6 aa, Mycobacterium tuberculosis
GVDPAT

SEQ ID NO: 1539130 - protein, 15 aa, Mycobacterium tuberculosis
HDNPGVAPKDELRDQ

SEQ ID NO: 1539131 - protein, 28 aa, Mycobacterium tuberculosis
HESNTYVAEPGPDAPALTGDRSARSAIP

SEQ ID NO: 1539132 - protein, 13 aa, Mycobacterium tuberculosis
HGAPGTGQPGGAG

SEQ ID NO: 1539133 - protein, 18 aa, Mycobacterium tuberculosis
HGGPSDVVGRAGPDRAHT

SEQ ID NO: 1539134 - protein, 16 aa, Mycobacterium tuberculosis
HGVSGGTEIRRSDAPR

SEQ ID NO: 1539135 - protein, 5 aa, Mycobacterium tuberculosis
HPDPA

SEQ ID NO: 1539136 - protein, 7 aa, Mycobacterium tuberculosis
HVTPPQT

SEQ ID NO: 1539137 - protein, 9 aa, Mycobacterium tuberculosis
IDGDPTKVR

SEQ ID NO: 1539138 - protein, 7 aa, Mycobacterium tuberculosis
IETATAA

SEQ ID NO: 1539139 - protein, 8 aa, Mycobacterium tuberculosis
IETATAAS

SEQ ID NO: 1539140 - protein, 10 aa, Mycobacterium tuberculosis
IKQAEGQKQA

SEQ ID NO: 1539141 - protein, 4 aa, Mycobacterium tuberculosis
IPNN

SEQ ID NO: 1539142 - protein, 5 aa, Mycobacterium tuberculosis
KAGFS

SEQ ID NO: 1539143 - protein, 9 aa, Mycobacterium tuberculosis
KQAEGQKQA

SEQ ID NO: 1539144 - protein, 6 aa, Mycobacterium tuberculosis
LPEEPW

SEQ ID NO: 1539145 - protein, 16 aa, Mycobacterium tuberculosis
LPNPTAPALASGPAAL

SEQ ID NO: 1539146 - protein, 11 aa, Mycobacterium tuberculosis
LPSGRALESRP

SEQ ID NO: 1539147 - protein, 8 aa, Mycobacterium tuberculosis
LRDDGTTT

SEQ ID NO: 1539148 - protein, 4 aa, Mycobacterium tuberculosis
MGQG

SEQ ID NO: 1539149 - protein, 30 aa, Mycobacterium tuberculosis; identical to SEQ ID NO: 1431078

SEQ ID NO: 1539150 - protein, 12 aa, Mycobacterium tuberculosis
NADPLGSATGSV

SEQ ID NO: 1539151 - protein, 6 aa, Mycobacterium tuberculosis
NAPTQA

SEQ ID NO: 1539152 - protein, 21 aa, Mycobacterium tuberculosis
NGGAGGSGAPGGIGAGGNGGN

SEQ ID NO: 1539153 - protein, 31 aa, Mycobacterium tuberculosis; identical to SEQ ID NO: 232262

SEQ ID NO: 1539154 - protein, 8 aa, Mycobacterium tuberculosis
NGTAKEIA

SEQ ID NO: 1539155 - protein, 7 aa, Mycobacterium tuberculosis
NLGDGNV

SEQ ID NO: 1539156 - protein, 12 aa, Mycobacterium tuberculosis
NPEPTPLSGSAT

SEQ ID NO: 1539157 - protein, 6 aa, Mycobacterium tuberculosis
NQHPNA

SEQ ID NO: 1539158 - protein, 6 aa, Mycobacterium tuberculosis
NRRDEA

SEQ ID NO: 1539159 - protein, 5 aa, Mycobacterium tuberculosis
NSGEG

SEQ ID NO: 1539160 - protein, 41 aa, Mycobacterium tuberculosis; identical to SEQ ID NO: 230652

SEQ ID NO: 1539161 - protein, 10 aa, Mycobacterium tuberculosis
NWGDPGRRST

SEQ ID NO: 1539162 - protein, 6 aa, Mycobacterium tuberculosis
PADGRR

SEQ ID NO: 1539163 - protein, 5 aa, Mycobacterium tuberculosis
PAEFE

SEQ ID NO: 1539164 - protein, 48 aa, Mycobacterium tuberculosis; identical to SEQ ID NO: 1438742

SEQ ID NO: 1539165 - protein, 5 aa, Mycobacterium tuberculosis
PDGLG

SEQ ID NO: 1539166 - protein, 5 aa, Mycobacterium tuberculosis
PEMPE

SEQ ID NO: 1539167 - protein, 4 aa, Mycobacterium tuberculosis
PEPG

SEQ ID NO: 1539168 - protein, 5 aa, Mycobacterium tuberculosis
PGPVA

SEQ ID NO: 1539169 - protein, 6 aa, Mycobacterium tuberculosis
PHSGRW

SEQ ID NO: 1539170 - protein, 4 aa, Mycobacterium tuberculosis
PKLG

SEQ ID NO: 1539171 - protein, 14 aa, Mycobacterium tuberculosis
PLQSPSVTDDEPTR

SEQ ID NO: 1539172 - protein, 5 aa, Mycobacterium tuberculosis
PLRSP

SEQ ID NO: 1539173 - protein, 13 aa, Mycobacterium tuberculosis
PSAFQTRPSGLPG

SEQ ID NO: 1539174 - protein, 11 aa, Mycobacterium tuberculosis
PSAQAEPETCP

SEQ ID NO: 1539175 - protein, 10 aa, Mycobacterium tuberculosis
PSPLSSGSAK

SEQ ID NO: 1539176 - protein, 10 aa, Mycobacterium tuberculosis
PTALGSGYGL

SEQ ID NO: 1539177 - protein, 10 aa, Mycobacterium tuberculosis
PTARGTASTV

SEQ ID NO: 1539178 - protein, 7 aa, Mycobacterium tuberculosis
QGNPIRV

SEQ ID NO: 1539179 - protein, 11 aa, Mycobacterium tuberculosis
QLDSTGPGQAI

SEQ ID NO: 1539180 - protein, 16 aa, Mycobacterium tuberculosis
QPAGCPDAKPSPPAAY

SEQ ID NO: 1539181 - protein, 9 aa, Mycobacterium tuberculosis
QRARQTGAQ

SEQ ID NO: 1539182 - protein, 6 aa, Mycobacterium tuberculosis
RAGDEL

SEQ ID NO: 1539183 - protein, 4 aa, Mycobacterium tuberculosis
RATP

SEQ ID NO: 1539184 - protein, 7 aa, Mycobacterium tuberculosis
RDLATPE

SEQ ID NO: 1539185 - protein, 16 aa, Mycobacterium tuberculosis
RGDIGGMSTATGPEGL

SEQ ID NO: 1539186 - protein, 4 aa, Mycobacterium tuberculosis
RGRD

SEQ ID NO: 1539187 - protein, 9 aa, Mycobacterium tuberculosis
RLGDSRGDI

SEQ ID NO: 1539188 - protein, 9 aa, Mycobacterium tuberculosis
RPGSGREAT

SEQ ID NO: 1539189 - protein, 9 aa, Mycobacterium tuberculosis
RSGMQRQEA

SEQ ID NO: 1539190 - protein, 13 aa, Mycobacterium tuberculosis
SAESGVPTFRDDK

SEQ ID NO: 1539191 - protein, 7 aa, Mycobacterium tuberculosis
SGGSTIP

SEQ ID NO: 1539192 - protein, 5 aa, Mycobacterium tuberculosis
SGGTR

SEQ ID NO: 1539193 - protein, 8 aa, Mycobacterium tuberculosis
SGPPQVPW

SEQ ID NO: 1539194 - protein, 6 aa, Mycobacterium tuberculosis
SGVHER

SEQ ID NO: 1539195 - protein, 6 aa, Mycobacterium tuberculosis
SKSALR

SEQ ID NO: 1539196 - protein, 13 aa, Mycobacterium tuberculosis
SQGAISKGQRGGN

SEQ ID NO: 1539197 - protein, 10 aa, Mycobacterium tuberculosis
SRLPPRGLTQ

SEQ ID NO: 1539198 - protein, 15 aa, Mycobacterium tuberculosis
SSAGAYASAEATNVE

SEQ ID NO: 1539199 - protein, 4 aa, Mycobacterium tuberculosis
SSTI

SEQ ID NO: 1539200 - protein, 15 aa, Mycobacterium tuberculosis
STALERAEDPILNGS

SEQ ID NO: 1539201 - protein, 15 aa, Mycobacterium tuberculosis
STGAGAYASAEAAAA

SEQ ID NO: 1539202 - protein, 10 aa, Mycobacterium tuberculosis
STLSGPPLTT

SEQ ID NO: 1539203 - protein, 8 aa, Mycobacterium tuberculosis
TDRGSQYT

SEQ ID NO: 1539204 - protein, 7 aa, Mycobacterium tuberculosis
TDTYDAA

SEQ ID NO: 1539205 - protein, 9 aa, Mycobacterium tuberculosis
TESVGKTIA

SEQ ID NO: 1539206 - protein, 6 aa, Mycobacterium tuberculosis
TGADAL

SEQ ID NO: 1539207 - protein, 9 aa, Mycobacterium tuberculosis
TGAGGSYAL

SEQ ID NO: 1539208 - protein, 9 aa, Mycobacterium tuberculosis
TGETCGTVE

SEQ ID NO: 1539209 - protein, 7 aa, Mycobacterium tuberculosis
TGHTPTV

SEQ ID NO: 1539210 - protein, 86 aa, Mycobacterium tuberculosis; identical to SEQ ID NO: 232992

SEQ ID NO: 1539211 - protein, 10 aa, Mycobacterium tuberculosis
TKVPPPAADY

SEQ ID NO: 1539212 - protein, 5 aa, Mycobacterium tuberculosis
TLAGK

SEQ ID NO: 1539213 - protein, 22 aa, Mycobacterium tuberculosis
TNSTPYQPDPTRAHTPASNYGA

SEQ ID NO: 1539214 - protein, 14 aa, Mycobacterium tuberculosis
TPDPEPDPPATHAP

SEQ ID NO: 1539215 - protein, 11 aa, Mycobacterium tuberculosis
TQLDPCQSPRP

SEQ ID NO: 1539216 - protein, 4 aa, Mycobacterium tuberculosis
TRGP

SEQ ID NO: 1539217 - protein, 17 aa, Mycobacterium tuberculosis
TTASNSPVVTADPRLNT

SEQ ID NO: 1539218 - protein, 7 aa, Mycobacterium tuberculosis
TTDSGLT

SEQ ID NO: 1539219 - protein, 10 aa, Mycobacterium tuberculosis
TTIGDEDRNF

SEQ ID NO: 1539220 - protein, 5 aa, Mycobacterium tuberculosis
TVDPA

SEQ ID NO: 1539221 - protein, 7 aa, Mycobacterium tuberculosis
TVSASEG

SEQ ID NO: 1539222 - protein, 10 aa, Mycobacterium tuberculosis
TVTGSVPPTV

SEQ ID NO: 1539223 - protein, 7 aa, Mycobacterium tuberculosis
VEATGSA

SEQ ID NO: 1539224 - protein, 15 aa, Mycobacterium tuberculosis
VGGTATAGAFSRPGL

SEQ ID NO: 1539225 - protein, 11 aa, Mycobacterium tuberculosis
VGRSKAQSARD

SEQ ID NO: 1539226 - protein, 19 aa, Mycobacterium tuberculosis
VTRADGGKSGIGRGYGGAR

SEQ ID NO: 1539227 - protein, 7 aa, Mycobacterium tuberculosis
VTTDDVR

SEQ ID NO: 1539228 - protein, 5 aa, Mycobacterium tuberculosis
WGADE

SEQ ID NO: 1539229 - protein, 9 aa, Mycobacterium tuberculosis
YPEPPPPGM

SEQ ID NO: 1539230 - protein, 8 aa, Mycobacterium tuberculosis
YTPPEAEE

SEQ ID NO: 1539231 - protein, 17 aa, Mycobacterium tuberculosis
AAAQTSAVQAAAADEVS

SEQ ID NO: 1539232 - protein, 5 aa, Mycobacterium tuberculosis
AAAVN

SEQ ID NO: 1539233 - protein, 10 aa, Mycobacterium tuberculosis
AAGAPPSCAG

SEQ ID NO: 1539234 - protein, 8 aa, Mycobacterium tuberculosis
AAGGGLAS

SEQ ID NO: 1539235 - protein, 4 aa, Mycobacterium tuberculosis
AAIP

SEQ ID NO: 1539236 - protein, 9 aa, Mycobacterium tuberculosis
AAPGLGKTK

SEQ ID NO: 1539237 - protein, 17 aa, Mycobacterium tuberculosis
AATRALSAAAQAKAAAA

SEQ ID NO: 1539238 - protein, 8 aa, Mycobacterium tuberculosis
AATTKTLP

SEQ ID NO: 1539239 - protein, 8 aa, Mycobacterium tuberculosis
ADATTGTI

SEQ ID NO: 1539240 - protein, 15 aa, Mycobacterium tuberculosis
ADDANAVCVQALVAV

SEQ ID NO: 1539241 - protein, 8 aa, Mycobacterium tuberculosis
ADLATREE

SEQ ID NO: 1539242 - protein, 6 aa, Mycobacterium tuberculosis
ADPKLA

SEQ ID NO: 1539243 - protein, 7 aa, Mycobacterium tuberculosis
ADTGLDA

SEQ ID NO: 1539244 - protein, 6 aa, Mycobacterium tuberculosis
AESGAH

SEQ ID NO: 1539245 - protein, 9 aa, Mycobacterium tuberculosis
AGGNGGDGG

SEQ ID NO: 1539246 - protein, 17 aa, Mycobacterium tuberculosis
AGIQPSVGAVGSSYDNA

SEQ ID NO: 1539247 - protein, 5 aa, Mycobacterium tuberculosis
AGLPG

SEQ ID NO: 1539248 - protein, 10 aa, Mycobacterium tuberculosis
AGTPATTMPI

SEQ ID NO: 1539249 - protein, 22 aa, Mycobacterium tuberculosis
ALPGGSSNRFSPAPAPAPIASP

SEQ ID NO: 1539250 - protein, 15 aa, Mycobacterium tuberculosis
ALSTANAAAAAPTTA

SEQ ID NO: 1539251 - protein, 21 aa, Mycobacterium tuberculosis
APPLAGATEEPGAGQTPGAPV

SEQ ID NO: 1539252 - protein, 22 aa, Mycobacterium tuberculosis
APVTPSDAPTPSGTPTTTNGPG

SEQ ID NO: 1539253 - protein, 5 aa, Mycobacterium tuberculosis
AQTHV

SEQ ID NO: 1539254 - protein, 8 aa, Mycobacterium tuberculosis
ARLDESVP

SEQ ID NO: 1539255 - protein, 24 aa, Mycobacterium tuberculosis
ARRSPNASTKARRTHGPAAKRFRA

SEQ ID NO: 1539256 - protein, 8 aa, Mycobacterium tuberculosis
ARTESRGC

SEQ ID NO: 1539257 - protein, 9 aa, Mycobacterium tuberculosis
ASGETGTEI

SEQ ID NO: 1539258 - protein, 4 aa, Mycobacterium tuberculosis
ASPL

SEQ ID NO: 1539259 - protein, 5 aa, Mycobacterium tuberculosis
ATDMP

SEQ ID NO: 1539260 - protein, 4 aa, Mycobacterium tuberculosis
ATGF

SEQ ID NO: 1539261 - protein, 11 aa, Mycobacterium tuberculosis
ATPPNSTRPNL

SEQ ID NO: 1539262 - protein, 15 aa, Mycobacterium tuberculosis
ATSTQPSTAPPTSRV

SEQ ID NO: 1539263 - protein, 12 aa, Mycobacterium tuberculosis
ATTNPAGSTGDG

SEQ ID NO: 1539264 - protein, 7 aa, Mycobacterium tuberculosis
AVETTRS

SEQ ID NO: 1539265 - protein, 11 aa, Mycobacterium tuberculosis
AVGHDGKAVPV

SEQ ID NO: 1539266 - protein, 15 aa, Mycobacterium tuberculosis
AVSGNSGVDPDQAAR

SEQ ID NO: 1539267 - protein, 14 aa, Mycobacterium tuberculosis
CARSPACPLGTDSA

SEQ ID NO: 1539268 - protein, 16 aa, Mycobacterium tuberculosis
CSSAPTPSANAANHGH

SEQ ID NO: 1539269 - protein, 5 aa, Mycobacterium tuberculosis
DALDE

SEQ ID NO: 1539270 - protein, 8 aa, Mycobacterium tuberculosis
DDDGTERK

SEQ ID NO: 1539271 - protein, 8 aa, Mycobacterium tuberculosis
DDTEVGVP

SEQ ID NO: 1539272 - protein, 6 aa, Mycobacterium tuberculosis
DEAQGA

SEQ ID NO: 1539273 - protein, 7 aa, Mycobacterium tuberculosis
DGAYGAQ

SEQ ID NO: 1539274 - protein, 7 aa, Mycobacterium tuberculosis
DGSPVTA

SEQ ID NO: 1539275 - protein, 7 aa, Mycobacterium tuberculosis
DHDLADT

SEQ ID NO: 1539276 - protein, 15 aa, Mycobacterium tuberculosis
DISHPPNPSCDTCHA

SEQ ID NO: 1539277 - protein, 5 aa, Mycobacterium tuberculosis
DIYGD

SEQ ID NO: 1539278 - protein, 8 aa, Mycobacterium tuberculosis
DNDDSVDA

SEQ ID NO: 1539279 - protein, 8 aa, Mycobacterium tuberculosis
DPAGNTDR

SEQ ID NO: 1539280 - protein, 6 aa, Mycobacterium tuberculosis
DPARRT

SEQ ID NO: 1539281 - protein, 8 aa, Mycobacterium tuberculosis
DPVEVTGS

SEQ ID NO: 1539282 - protein, 16 aa, Mycobacterium tuberculosis
DVQPAGSVPIPDGPAQ

SEQ ID NO: 1539283 - protein, 11 aa, Mycobacterium tuberculosis
EALGRSGTIAG

SEQ ID NO: 1539284 - protein, 7 aa, Mycobacterium tuberculosis
EGIKESV

SEQ ID NO: 1539285 - protein, 28 aa, Mycobacterium tuberculosis
ELGQAANSFSSATAALADTAWQGPAATA

SEQ ID NO: 1539286 - protein, 4 aa, Mycobacterium tuberculosis
ENAR

SEQ ID NO: 1539287 - protein, 15 aa, Mycobacterium tuberculosis
EPTNPDSAALGVPAP

SEQ ID NO: 1539288 - protein, 10 aa, Mycobacterium tuberculosis
EVRGPTGYDG

SEQ ID NO: 1539289 - protein, 4 aa, Mycobacterium tuberculosis
FDEQ

SEQ ID NO: 1539290 - protein, 4 aa, Mycobacterium tuberculosis
FDPA

SEQ ID NO: 1539291 - protein, 7 aa, Mycobacterium tuberculosis
GAYSRDR

SEQ ID NO: 1539292 - protein, 11 aa, Mycobacterium tuberculosis
GDQGASGRRTS

SEQ ID NO: 1539293 - protein, 4 aa, Mycobacterium tuberculosis
GDSN

SEQ ID NO: 1539294 - protein, 8 aa, Mycobacterium tuberculosis
GFGNGNSV

SEQ ID NO: 1539295 - protein, 46 aa, Mycobacterium tuberculosis; identical to SEQ ID NO: 229834

SEQ ID NO: 1539296 - protein, 22 aa, Mycobacterium tuberculosis
GGGTNSSSSGAGGTSGSVHCGG

SEQ ID NO: 1539297 - protein, 7 aa, Mycobacterium tuberculosis
GHDKNGD

SEQ ID NO: 1539298 - protein, 13 aa, Mycobacterium tuberculosis
GHPDPSSGTIDAP

SEQ ID NO: 1539299 - protein, 6 aa, Mycobacterium tuberculosis
GKGEYG

SEQ ID NO: 1539300 - protein, 7 aa, Mycobacterium tuberculosis
GLYGRSD

SEQ ID NO: 1539301 - protein, 13 aa, Mycobacterium tuberculosis
GMGGNGGATSVGG

SEQ ID NO: 1539302 - protein, 14 aa, Mycobacterium tuberculosis
GNARADRARNTYTV

SEQ ID NO: 1539303 - protein, 13 aa, Mycobacterium tuberculosis
GNPSNRAGGSLSS

SEQ ID NO: 1539304 - protein, 6 aa, Mycobacterium tuberculosis
GPDVTE

SEQ ID NO: 1539305 - protein, 26 aa, Mycobacterium tuberculosis
GPGQGWGYPQPRSGQRARRATGQGSG

SEQ ID NO: 1539306 - protein, 15 aa, Mycobacterium tuberculosis
GQAPRAAAEEPGRWS

SEQ ID NO: 1539307 - protein, 9 aa, Mycobacterium tuberculosis
GQAQTVPRK

SEQ ID NO: 1539308 - protein, 10 aa, Mycobacterium tuberculosis
GSEIGGSTRI

SEQ ID NO: 1539309 - protein, 24 aa, Mycobacterium tuberculosis
GSGGNGGSGLAGSGQKGGNGGAAG

SEQ ID NO: 1539310 - protein, 15 aa, Mycobacterium tuberculosis
GSTVSAASAAASAPT

SEQ ID NO: 1539311 - protein, 11 aa, Mycobacterium tuberculosis
GSVKKQTAIEP

SEQ ID NO: 1539312 - protein, 17 aa, Mycobacterium tuberculosis
GSYNTGIGNSGTGSTGL

SEQ ID NO: 1539313 - protein, 4 aa, Mycobacterium tuberculosis
GWTG

SEQ ID NO: 1539314 - protein, 26 aa, Mycobacterium tuberculosis
HGGAGGAGGIGSADGGLGGGGGNGRF

SEQ ID NO: 1539315 - protein, 6 aa, Mycobacterium tuberculosis
KLTTAG

SEQ ID NO: 1539316 - protein, 8 aa, Mycobacterium tuberculosis
KPGKPWRS

SEQ ID NO: 1539317 - protein, 21 aa, Mycobacterium tuberculosis
KPHRAGDSADRSAGDFDGTAH

SEQ ID NO: 1539318 - protein, 10 aa, Mycobacterium tuberculosis
KQGRTTGNSC

SEQ ID NO: 1539319 - protein, 11 aa, Mycobacterium tuberculosis
LAEKRPPPAPR

SEQ ID NO: 1539320 - protein, 9 aa, Mycobacterium tuberculosis
LASPGSVSR

SEQ ID NO: 1539321 - protein, 9 aa, Mycobacterium tuberculosis
LDRGSGNSV

SEQ ID NO: 1539322 - protein, 4 aa, Mycobacterium tuberculosis
LNDP

SEQ ID NO: 1539323 - protein, 5 aa, Mycobacterium tuberculosis
LPEGT

SEQ ID NO: 1539324 - protein, 27 aa, Mycobacterium tuberculosis
LPEPDPQPADAPPPGDVTEAPAETPQV

SEQ ID NO: 1539325 - protein, 13 aa, Mycobacterium tuberculosis
LPPPAAKPAATQI

SEQ ID NO: 1539326 - protein, 6 aa, Mycobacterium tuberculosis
LQTGTG

SEQ ID NO: 1539327 - protein, 5 aa, Mycobacterium tuberculosis
LRDGG

SEQ ID NO: 1539328 - protein, 13 aa, Mycobacterium tuberculosis
MSAGAQGNSNVTN

SEQ ID NO: 1539329 - protein, 8 aa, Mycobacterium tuberculosis
NADEPGCS

SEQ ID NO: 1539330 - protein, 6 aa, Mycobacterium tuberculosis
NAPAIA

SEQ ID NO: 1539331 - protein, 17 aa, Mycobacterium tuberculosis
NGANGKPGTGQDGGAGG

SEQ ID NO: 1539332 - protein, 21 aa, Mycobacterium tuberculosis
NGGAGGAGGAGGIGAGGAGGF

SEQ ID NO: 1539333 - protein, 9 aa, Mycobacterium tuberculosis
NGGNGGIGG

SEQ ID NO: 1539334 - protein, 25 aa, Mycobacterium tuberculosis
NGGTGGSGGAGGAGSVGNGGAGGNA

SEQ ID NO: 1539335 - protein, 10 aa, Mycobacterium tuberculosis
NPAATTIPGR

SEQ ID NO: 1539336 - protein, 5 aa, Mycobacterium tuberculosis
PAAGY

SEQ ID NO: 1539337 - protein, 7 aa, Mycobacterium tuberculosis
PADSAAD

SEQ ID NO: 1539338 - protein, 4 aa, Mycobacterium tuberculosis
PATI

SEQ ID NO: 1539339 - protein, 9 aa, Mycobacterium tuberculosis
PAVSPIEES

SEQ ID NO: 1539340 - protein, 23 aa, Mycobacterium tuberculosis
PDAARRVAKRSDAARARGDELGP

SEQ ID NO: 1539341 - protein, 5 aa, Mycobacterium tuberculosis
PGALG

SEQ ID NO: 1539342 - protein, 8 aa, Mycobacterium tuberculosis
PISDKAAV

SEQ ID NO: 1539343 - protein, 16 aa, Mycobacterium tuberculosis
PMGYQQGTGPTAGVPG

SEQ ID NO: 1539344 - protein, 9 aa, Mycobacterium tuberculosis
PRGVGHSTP

SEQ ID NO: 1539345 - protein, 12 aa, Mycobacterium tuberculosis
PWADGASAAANT

SEQ ID NO: 1539346 - protein, 9 aa, Mycobacterium tuberculosis
QAATGRPLI

SEQ ID NO: 1539347 - protein, 6 aa, Mycobacterium tuberculosis
QGNSIT

SEQ ID NO: 1539348 - protein, 5 aa, Mycobacterium tuberculosis
QNAAS

SEQ ID NO: 1539349 - protein, 7 aa, Mycobacterium tuberculosis
QRGSDAG

SEQ ID NO: 1539350 - protein, 7 aa, Mycobacterium tuberculosis
RAGGRRP

SEQ ID NO: 1539351 - protein, 8 aa, Mycobacterium tuberculosis
RATAAAKQ

SEQ ID NO: 1539352 - protein, 18 aa, Mycobacterium tuberculosis
RDPRDTVADTVTALRGLG

SEQ ID NO: 1539353 - protein, 6 aa, Mycobacterium tuberculosis
RGDGAS

SEQ ID NO: 1539354 - protein, 10 aa, Mycobacterium tuberculosis
RGVPTPGLPF

SEQ ID NO: 1539355 - protein, 7 aa, Mycobacterium tuberculosis
RKKSDHL

SEQ ID NO: 1539356 - protein, 4 aa, Mycobacterium tuberculosis
RNVT

SEQ ID NO: 1539357 - protein, 13 aa, Mycobacterium tuberculosis
RPTAVEGDATPIS

SEQ ID NO: 1539358 - protein, 27 aa, Mycobacterium tuberculosis
RPTNSGPATAAGTTAEPTYTAAETAAA

SEQ ID NO: 1539359 - protein, 7 aa, Mycobacterium tuberculosis
RTAGGDL

SEQ ID NO: 1539360 - protein, 6 aa, Mycobacterium tuberculosis
RTPTVT

SEQ ID NO: 1539361 - protein, 13 aa, Mycobacterium tuberculosis
SAANAAAAGPTTQ

SEQ ID NO: 1539362 - protein, 6 aa, Mycobacterium tuberculosis
SAPGCP

SEQ ID NO: 1539363 - protein, 10 aa, Mycobacterium tuberculosis
SASRPAAPIP

SEQ ID NO: 1539364 - protein, 5 aa, Mycobacterium tuberculosis
SDGRR

SEQ ID NO: 1539365 - protein, 5 aa, Mycobacterium tuberculosis
SGAAV

SEQ ID NO: 1539366 - protein, 4 aa, Mycobacterium tuberculosis
SGGT

SEQ ID NO: 1539367 - protein, 8 aa, Mycobacterium tuberculosis
SLPGVSPT

SEQ ID NO: 1539368 - protein, 7 aa, Mycobacterium tuberculosis
SPQTRFS

SEQ ID NO: 1539369 - protein, 7 aa, Mycobacterium tuberculosis
SQVGGRS

SEQ ID NO: 1539370 - protein, 6 aa, Mycobacterium tuberculosis
SRDGTR

SEQ ID NO: 1539371 - protein, 28 aa, Mycobacterium tuberculosis
SVGAGTPGPAGTSGTATTGPKTAPKTAE

SEQ ID NO: 1539372 - protein, 11 aa, Mycobacterium tuberculosis
TAAAALAEEGA

SEQ ID NO: 1539373 - protein, 7 aa, Mycobacterium tuberculosis
TCRETPD

SEQ ID NO: 1539374 - protein, 5 aa, Mycobacterium tuberculosis
TDQGV

SEQ ID NO: 1539375 - protein, 17 aa, Mycobacterium tuberculosis
TGDNQTGFGGLNSGAGN

SEQ ID NO: 1539376 - protein, 7 aa, Mycobacterium tuberculosis
TGNDSNG

SEQ ID NO: 1539377 - protein, 4 aa, Mycobacterium tuberculosis
TGRT

SEQ ID NO: 1539378 - protein, 4 aa, Mycobacterium tuberculosis
TGSS

SEQ ID NO: 1539379 - protein, 15 aa, Mycobacterium tuberculosis
TIAGASGLSTGGNPG

SEQ ID NO: 1539380 - protein, 21 aa, Mycobacterium tuberculosis
TNSTPYQPDPTRAHTPASNYG

SEQ ID NO: 1539381 - protein, 12 aa, Mycobacterium tuberculosis
TPERGLIALPCG

SEQ ID NO: 1539382 - protein, 12 aa, Mycobacterium tuberculosis
TPPTAAAAESGM

SEQ ID NO: 1539383 - protein, 4 aa, Mycobacterium tuberculosis
TQPA

SEQ ID NO: 1539384 - protein, 5 aa, Mycobacterium tuberculosis
TRAAA

SEQ ID NO: 1539385 - protein, 8 aa, Mycobacterium tuberculosis
TTDPPVEG

SEQ ID NO: 1539386 - protein, 6 aa, Mycobacterium tuberculosis
VARTGL

SEQ ID NO: 1539387 - protein, 8 aa, Mycobacterium tuberculosis
VGGEPGSI

SEQ ID NO: 1539388 - protein, 9 aa, Mycobacterium tuberculosis
VGPMRADGG

SEQ ID NO: 1539389 - protein, 4 aa, Mycobacterium tuberculosis
VPPR

SEQ ID NO: 1539390 - protein, 9 aa, Mycobacterium tuberculosis
VYPSSNHAE

SEQ ID NO: 1539391 - protein, 4 aa, Mycobacterium tuberculosis
WGAD

SEQ ID NO: 1539392 - protein, 43 aa, Mycobacterium tuberculosis; identical to SEQ ID NO: 231822

SEQ ID NO: 1539393 - protein, 4 aa, Mycobacterium tuberculosis
WQST

SEQ ID NO: 1539394 - protein, 8 aa, Mycobacterium tuberculosis
YPAGTTVD

SEQ ID NO: 1539395 - protein, 9 aa, Mycobacterium tuberculosis
YTPPEAEEG

SEQ ID NO: 1539396 - protein, 11 aa, Mycobacterium tuberculosis
AADAGFTAPAT

SEQ ID NO: 1539397 - protein, 14 aa, Mycobacterium tuberculosis
AAEGRAGYGVPGDH

SEQ ID NO: 1539398 - protein, 13 aa, Mycobacterium tuberculosis
AAKSDGGRNNQAG

SEQ ID NO: 1539399 - protein, 5 aa, Mycobacterium tuberculosis
AATGF

SEQ ID NO: 1539400 - protein, 14 aa, Mycobacterium tuberculosis
AATRTTPARLASKV

SEQ ID NO: 1539401 - protein, 8 aa, Mycobacterium tuberculosis
AATSSEWN

SEQ ID NO: 1539402 - protein, 12 aa, Mycobacterium tuberculosis
ADATDKDRTRVE

SEQ ID NO: 1539403 - protein, 4 aa, Mycobacterium tuberculosis
ADEV

SEQ ID NO: 1539404 - protein, 6 aa, Mycobacterium tuberculosis
ADLTGI

SEQ ID NO: 1539405 - protein, 14 aa, Mycobacterium tuberculosis
ADPAPAPAPAPNIP

SEQ ID NO: 1539406 - protein, 5 aa, Mycobacterium tuberculosis
ADQPY

SEQ ID NO: 1539407 - protein, 17 aa, Mycobacterium tuberculosis
ADRKRGASAGRGGSAPS

SEQ ID NO: 1539408 - protein, 7 aa, Mycobacterium tuberculosis
AEYAQGP

SEQ ID NO: 1539409 - protein, 6 aa, Mycobacterium tuberculosis
AGADEV

SEQ ID NO: 1539410 - protein, 8 aa, Mycobacterium tuberculosis
AGPAGRVS

SEQ ID NO: 1539411 - protein, 9 aa, Mycobacterium tuberculosis
AGSLGGAAR

SEQ ID NO: 1539412 - protein, 6 aa, Mycobacterium tuberculosis
AHPGVR

SEQ ID NO: 1539413 - protein, 6 aa, Mycobacterium tuberculosis
ANNAAR

SEQ ID NO: 1539414 - protein, 8 aa, Mycobacterium tuberculosis
ASPSGVAG

SEQ ID NO: 1539415 - protein, 5 aa, Mycobacterium tuberculosis
ASSIG

SEQ ID NO: 1539416 - protein, 8 aa, Mycobacterium tuberculosis
ASYPDGTN

SEQ ID NO: 1539417 - protein, 7 aa, Mycobacterium tuberculosis
ATPGDGW

SEQ ID NO: 1539418 - protein, 12 aa, Mycobacterium tuberculosis
ATTRASVARPAP

SEQ ID NO: 1539419 - protein, 4 aa, Mycobacterium tuberculosis
ATVS

SEQ ID NO: 1539420 - protein, 6 aa, Mycobacterium tuberculosis
AVAGRQ

SEQ ID NO: 1539421 - protein, 8 aa, Mycobacterium tuberculosis
AVRGRGGL

SEQ ID NO: 1539422 - protein, 4 aa, Mycobacterium tuberculosis
CSSG

SEQ ID NO: 1539423 - protein, 19 aa, Mycobacterium tuberculosis
DAPLDAAATGESDERGPNA

SEQ ID NO: 1539424 - protein, 11 aa, Mycobacterium tuberculosis
DDQSGTIPNVG

SEQ ID NO: 1539425 - protein, 8 aa, Mycobacterium tuberculosis
DDRPINSA

SEQ ID NO: 1539426 - protein, 6 aa, Mycobacterium tuberculosis
DETASV

SEQ ID NO: 1539427 - protein, 15 aa, Mycobacterium tuberculosis
DGANATTPGGAGGAG

SEQ ID NO: 1539428 - protein, 44 aa, Mycobacterium tuberculosis
DGGNGYSQTTPGAVGGAGGSAGFIGNGGAGGAGGPGAGGGTGGL

SEQ ID NO: 1539429 - protein, 6 aa, Mycobacterium tuberculosis
DGPARI

SEQ ID NO: 1539430 - protein, 21 aa, Mycobacterium tuberculosis
DLASLGSSISAANAAAAANTT

SEQ ID NO: 1539431 - protein, 8 aa, Mycobacterium tuberculosis
DLPPPAAL

SEQ ID NO: 1539432 - protein, 10 aa, Mycobacterium tuberculosis
DQETAAAQAV

SEQ ID NO: 1539433 - protein, 11 aa, Mycobacterium tuberculosis
DTPPAPAPPPF

SEQ ID NO: 1539434 - protein, 14 aa, Mycobacterium tuberculosis
EDEVERRRGDLPTT

SEQ ID NO: 1539435 - protein, 8 aa, Mycobacterium tuberculosis
EGLPTDGY

SEQ ID NO: 1539436 - protein, 5 aa, Mycobacterium tuberculosis
ELTPS

SEQ ID NO: 1539437 - protein, 8 aa, Mycobacterium tuberculosis
EPDNPARV

SEQ ID NO: 1539438 - protein, 4 aa, Mycobacterium tuberculosis
ESHT

SEQ ID NO: 1539439 - protein, 7 aa, Mycobacterium tuberculosis
GAAAAGV

SEQ ID NO: 1539440 - protein, 15 aa, Mycobacterium tuberculosis
GAASAYASAEATNVE

SEQ ID NO: 1539441 - protein, 20 aa, Mycobacterium tuberculosis
GAGGVGGAGGGTGGAGGPGG

SEQ ID NO: 1539442 - protein, 7 aa, Mycobacterium tuberculosis
GAGPCPG

SEQ ID NO: 1539443 - protein, 6 aa, Mycobacterium tuberculosis
GAPATS

SEQ ID NO: 1539444 - protein, 9 aa, Mycobacterium tuberculosis
GAQSAAAAL

SEQ ID NO: 1539445 - protein, 18 aa, Mycobacterium tuberculosis
GASNGAWGKGASETFNGG

SEQ ID NO: 1539446 - protein, 8 aa, Mycobacterium tuberculosis
GFDTPTPL

SEQ ID NO: 1539447 - protein, 26 aa, Mycobacterium tuberculosis
GGAGGAGGLGKAGFAGGAGGTGGTGG

SEQ ID NO: 1539448 - protein, 20 aa, Mycobacterium tuberculosis
GGAGGVGGAGGGTGGAGGRA

SEQ ID NO: 1539449 - protein, 7 aa, Mycobacterium tuberculosis
GGYRSAN

SEQ ID NO: 1539450 - protein, 22 aa, Mycobacterium tuberculosis
GNGGPGGAGGSGGGTGGAGGAG

SEQ ID NO: 1539451 - protein, 42 aa, Mycobacterium tuberculosis; identical to SEQ ID NO: 1427758

SEQ ID NO: 1539452 - protein, 9 aa, Mycobacterium tuberculosis
GPAFPRAKS

SEQ ID NO: 1539453 - protein, 8 aa, Mycobacterium tuberculosis
GPMRADGG

SEQ ID NO: 1539454 - protein, 9 aa, Mycobacterium tuberculosis
GPSSATTGS

SEQ ID NO: 1539455 - protein, 7 aa, Mycobacterium tuberculosis
GQVQGVP

SEQ ID NO: 1539456 - protein, 7 aa, Mycobacterium tuberculosis
GRAFTSG

SEQ ID NO: 1539457 - protein, 5 aa, Mycobacterium tuberculosis
GSAPA

SEQ ID NO: 1539458 - protein, 20 aa, Mycobacterium tuberculosis
GSAPPTSQTAAAAKPNPSTV

SEQ ID NO: 1539459 - protein, 22 aa, Mycobacterium tuberculosis
GSGGVGGAGGLGGPTDGTVQGV

SEQ ID NO: 1539460 - protein, 19 aa, Mycobacterium tuberculosis
GSPAIPSTAQEIPNPLRGQ

SEQ ID NO: 1539461 - protein, 13 aa, Mycobacterium tuberculosis
GTPPTAAAAESGM

SEQ ID NO: 1539462 - protein, 9 aa, Mycobacterium tuberculosis
GVPDPITGV

SEQ ID NO: 1539463 - protein, 5 aa, Mycobacterium tuberculosis
HPGVR

SEQ ID NO: 1539464 - protein, 5 aa, Mycobacterium tuberculosis
HPSLE

SEQ ID NO: 1539465 - protein, 4 aa, Mycobacterium tuberculosis
HSET

SEQ ID NO: 1539466 - protein, 23 aa, Mycobacterium tuberculosis
HTNTGGFNTGNVNTGAFNSGSFN

SEQ ID NO: 1539467 - protein, 4 aa, Mycobacterium tuberculosis
IGST

SEQ ID NO: 1539468 - protein, 9 aa, Mycobacterium tuberculosis
ISNSGTGFN

SEQ ID NO: 1539469 - protein, 7 aa, Mycobacterium tuberculosis
KDPTIVR

SEQ ID NO: 1539470 - protein, 7 aa, Mycobacterium tuberculosis
KETVQST

SEQ ID NO: 1539471 - protein, 9 aa, Mycobacterium tuberculosis
KLPASTIDE

SEQ ID NO: 1539472 - protein, 5 aa, Mycobacterium tuberculosis
KPIDP

SEQ ID NO: 1539473 - protein, 5 aa, Mycobacterium tuberculosis
KQASA

SEQ ID NO: 1539474 - protein, 7 aa, Mycobacterium tuberculosis
LAGAGSG

SEQ ID NO: 1539475 - protein, 4 aa, Mycobacterium tuberculosis
LAGT

SEQ ID NO: 1539476 - protein, 5 aa, Mycobacterium tuberculosis
LANKD

SEQ ID NO: 1539477 - protein, 23 aa, Mycobacterium tuberculosis
LDAEEPELNRDPPGDERDTTTPH

SEQ ID NO: 1539478 - protein, 20 aa, Mycobacterium tuberculosis
LDATDTPPPASATSGQTSLD

SEQ ID NO: 1539479 - protein, 5 aa, Mycobacterium tuberculosis
LGGAP

SEQ ID NO: 1539480 - protein, 13 aa, Mycobacterium tuberculosis
LPDGFPARAVRTR

SEQ ID NO: 1539481 - protein, 6 aa, Mycobacterium tuberculosis
LPGVTP

SEQ ID NO: 1539482 - protein, 8 aa, Mycobacterium tuberculosis
LRAQAAGQ

SEQ ID NO: 1539483 - protein, 15 aa, Mycobacterium tuberculosis
LSGPPSTSAKHTTTP

SEQ ID NO: 1539484 - protein, 8 aa, Mycobacterium tuberculosis
LTQGGRTA

SEQ ID NO: 1539485 - protein, 9 aa, Mycobacterium tuberculosis
MSDGPGDPL

SEQ ID NO: 1539486 - protein, 22 aa, Mycobacterium tuberculosis
NGGAGAAGAPGQAGGPGGPAGL

SEQ ID NO: 1539487 - protein, 45 aa, Mycobacterium tuberculosis
NGGNGAAGGFGQTGGSGGAAGLIGNGGNGGAGGTGAAGGAGGNGG

SEQ ID NO: 1539488 - protein, 21 aa, Mycobacterium tuberculosis
NGGNGGSGAAGQVGGPGGAAG

SEQ ID NO: 1539489 - protein, 27 aa, Mycobacterium tuberculosis
NPAYPYESEAERSAARARRNARQQRSA

SEQ ID NO: 1539490 - protein, 14 aa, Mycobacterium tuberculosis
NTAAADDKLPLGGG

SEQ ID NO: 1539491 - protein, 9 aa, Mycobacterium tuberculosis
PAATTIPGR

SEQ ID NO: 1539492 - protein, 9 aa, Mycobacterium tuberculosis
PAATTPANI

SEQ ID NO: 1539493 - protein, 11 aa, Mycobacterium tuberculosis
PASGSGKTTIA

SEQ ID NO: 1539494 - protein, 19 aa, Mycobacterium tuberculosis
PIPAKSAAAATTSSGETIT

SEQ ID NO: 1539495 - protein, 7 aa, Mycobacterium tuberculosis
PLPPAAD

SEQ ID NO: 1539496 - protein, 11 aa, Mycobacterium tuberculosis
PPASVTGTPKL

SEQ ID NO: 1539497 - protein, 8 aa, Mycobacterium tuberculosis
PPSEATTV

SEQ ID NO: 1539498 - protein, 23 aa, Mycobacterium tuberculosis
PRLPGPAEQVDGRSLRPRGFSDE

SEQ ID NO: 1539499 - protein, 8 aa, Mycobacterium tuberculosis
QAQTVPRK

SEQ ID NO: 1539500 - protein, 14 aa, Mycobacterium tuberculosis
QDPASGQPARIPVD

SEQ ID NO: 1539501 - protein, 15 aa, Mycobacterium tuberculosis
QDPASGQPARIPVDS

SEQ ID NO: 1539502 - protein, 12 aa, Mycobacterium tuberculosis
QGAISKGQRGGN

SEQ ID NO: 1539503 - protein, 6 aa, Mycobacterium tuberculosis
QQTRQR

SEQ ID NO: 1539504 - protein, 7 aa, Mycobacterium tuberculosis
RGDGASL

SEQ ID NO: 1539505 - protein, 10 aa, Mycobacterium tuberculosis
RRPKLYGAGA

SEQ ID NO: 1539506 - protein, 5 aa, Mycobacterium tuberculosis
RRSDG

SEQ ID NO: 1539507 - protein, 8 aa, Mycobacterium tuberculosis
RTGAAGRS

SEQ ID NO: 1539508 - protein, 12 aa, Mycobacterium tuberculosis
SAATAAAAAPTI

SEQ ID NO: 1539509 - protein, 4 aa, Mycobacterium tuberculosis
SAQA

SEQ ID NO: 1539510 - protein, 9 aa, Mycobacterium tuberculosis
SDEDSAKAM

SEQ ID NO: 1539511 - protein, 5 aa, Mycobacterium tuberculosis
SDRYR

SEQ ID NO: 1539512 - protein, 5 aa, Mycobacterium tuberculosis
SGLNP

SEQ ID NO: 1539513 - protein, 8 aa, Mycobacterium tuberculosis
SNSTGMSG

SEQ ID NO: 1539514 - protein, 7 aa, Mycobacterium tuberculosis
SPAYNDR

SEQ ID NO: 1539515 - protein, 4 aa, Mycobacterium tuberculosis
SSGN

SEQ ID NO: 1539516 - protein, 9 aa, Mycobacterium tuberculosis
STLSGPPLT

SEQ ID NO: 1539517 - protein, 19 aa, Mycobacterium tuberculosis
STTVSGDRDDLKPGVGDRS

SEQ ID NO: 1539518 - protein, 10 aa, Mycobacterium tuberculosis
SYAVSGPGNV

SEQ ID NO: 1539519 - protein, 7 aa, Mycobacterium tuberculosis
TALPGAN

SEQ ID NO: 1539520 - protein, 6 aa, Mycobacterium tuberculosis
TALTQS

SEQ ID NO: 1539521 - protein, 8 aa, Mycobacterium tuberculosis
TGMGRSTA

SEQ ID NO: 1539522 - protein, 8 aa, Mycobacterium tuberculosis
TGREPSER

SEQ ID NO: 1539523 - protein, 8 aa, Mycobacterium tuberculosis
THPADGTV

SEQ ID NO: 1539524 - protein, 15 aa, Mycobacterium tuberculosis
TPGFGNATATPSSGF

SEQ ID NO: 1539525 - protein, 12 aa, Mycobacterium tuberculosis
TPSPASDTDTVT

SEQ ID NO: 1539526 - protein, 8 aa, Mycobacterium tuberculosis
TRSDPSRP

SEQ ID NO: 1539527 - protein, 8 aa, Mycobacterium tuberculosis
TRSPARDF

SEQ ID NO: 1539528 - protein, 9 aa, Mycobacterium tuberculosis
TRTKSPRSH

SEQ ID NO: 1539529 - protein, 6 aa, Mycobacterium tuberculosis
TSAVTG

SEQ ID NO: 1539530 - protein, 6 aa, Mycobacterium tuberculosis
TSGGNL

SEQ ID NO: 1539531 - protein, 6 aa, Mycobacterium tuberculosis
TSLPRG

SEQ ID NO: 1539532 - protein, 7 aa, Mycobacterium tuberculosis
VDTDGLA

SEQ ID NO: 1539533 - protein, 13 aa, Mycobacterium tuberculosis
VEETDSAGNPRSD

SEQ ID NO: 1539534 - protein, 6 aa, Mycobacterium tuberculosis
VEPGGA

SEQ ID NO: 1539535 - protein, 10 aa, Mycobacterium tuberculosis
VKNERTVTTE

SEQ ID NO: 1539536 - protein, 5 aa, Mycobacterium tuberculosis
VPDSS

SEQ ID NO: 1539537 - protein, 12 aa, Mycobacterium tuberculosis
VPHLPGSVPQLP

SEQ ID NO: 1539538 - protein, 24 aa, Mycobacterium tuberculosis
VPPPPGDPVPPVDTHAGGRPADQL

SEQ ID NO: 1539539 - protein, 17 aa, Mycobacterium tuberculosis
VSPSTVPPAALPNTSRA

SEQ ID NO: 1539540 - protein, 4 aa, Mycobacterium tuberculosis
YAQR

SEQ ID NO: 1539541 - protein, 8 aa, Mycobacterium tuberculosis
YDQPATTV

SEQ ID NO: 1539542 - protein, 7 aa, Mycobacterium tuberculosis
AAAATEK

SEQ ID NO: 1539543 - protein, 7 aa, Mycobacterium tuberculosis
AADRAGR

SEQ ID NO: 1539544 - protein, 16 aa, Mycobacterium tuberculosis
AAGAPPSCAGLGGTVQ

SEQ ID NO: 1539545 - protein, 8 aa, Mycobacterium tuberculosis
AAGPGASA

SEQ ID NO: 1539546 - protein, 6 aa, Mycobacterium tuberculosis
AAGRHH

SEQ ID NO: 1539547 - protein, 21 aa, Mycobacterium tuberculosis
AAHGGGEFAPSAQLASREQQI

SEQ ID NO: 1539548 - protein, 45 aa, Mycobacterium tuberculosis; identical to SEQ ID NO: 228802

SEQ ID NO: 1539549 - protein, 14 aa, Mycobacterium tuberculosis
AAPSISGCANKNDM

SEQ ID NO: 1539550 - protein, 4 aa, Mycobacterium tuberculosis
AAST

SEQ ID NO: 1539551 - protein, 7 aa, Mycobacterium tuberculosis
AATGRAG

SEQ ID NO: 1539552 - protein, 6 aa, Mycobacterium tuberculosis
ADEVST

SEQ ID NO: 1539553 - protein, 15 aa, Mycobacterium tuberculosis
ADGDGGNRGRQSRVR

SEQ ID NO: 1539554 - protein, 27 aa, Mycobacterium tuberculosis
AFGGDGGNGSDGVAAGSGGGSGGAGGG

SEQ ID NO: 1539555 - protein, 30 aa, Mycobacterium tuberculosis; identical to SEQ ID NO: 228980

SEQ ID NO: 1539556 - protein, 18 aa, Mycobacterium tuberculosis
AGWSTAAPAMTSGTTALE

SEQ ID NO: 1539557 - protein, 21 aa, Mycobacterium tuberculosis
AGWSTAAPAMTSGTTALEGSG

SEQ ID NO: 1539558 - protein, 9 aa, Mycobacterium tuberculosis
AHAGPSGDD

SEQ ID NO: 1539559 - protein, 12 aa, Mycobacterium tuberculosis
AIATERAGKPVQ

SEQ ID NO: 1539560 - protein, 30 aa, Mycobacterium tuberculosis; identical to SEQ ID NO: 1428748

SEQ ID NO: 1539561 - protein, 6 aa, Mycobacterium tuberculosis
AMKPPV

SEQ ID NO: 1539562 - protein, 17 aa, Mycobacterium tuberculosis
ANANDGTRAVGTPGYQA

SEQ ID NO: 1539563 - protein, 8 aa, Mycobacterium tuberculosis
ANPAQSVQ

SEQ ID NO: 1539564 - protein, 8 aa, Mycobacterium tuberculosis
ANPQHHRR

SEQ ID NO: 1539565 - protein, 4 aa, Mycobacterium tuberculosis
APGV

SEQ ID NO: 1539566 - protein, 11 aa, Mycobacterium tuberculosis
APPANQARAAA

SEQ ID NO: 1539567 - protein, 28 aa, Mycobacterium tuberculosis
APPIPSPQPLKSGDTIGLKNSSAYPTVE

SEQ ID NO: 1539568 - protein, 12 aa, Mycobacterium tuberculosis
AQFQAGDDPVAN

SEQ ID NO: 1539569 - protein, 9 aa, Mycobacterium tuberculosis
AQGHTNTSH

SEQ ID NO: 1539570 - protein, 9 aa, Mycobacterium tuberculosis
AQSVPGSQF

SEQ ID NO: 1539571 - protein, 6 aa, Mycobacterium tuberculosis
ARAPRV

SEQ ID NO: 1539572 - protein, 18 aa, Mycobacterium tuberculosis
ARDTATVGGMASTNAGGL

SEQ ID NO: 1539573 - protein, 9 aa, Mycobacterium tuberculosis
ARPRPGSHA

SEQ ID NO: 1539574 - protein, 8 aa, Mycobacterium tuberculosis
ARRTGATR

SEQ ID NO: 1539575 - protein, 17 aa, Mycobacterium tuberculosis
ASTNTSYPGPATDPSTG

SEQ ID NO: 1539576 - protein, 10 aa, Mycobacterium tuberculosis
ATSPAPGTAN

SEQ ID NO: 1539577 - protein, 36 aa, Mycobacterium tuberculosis; identical to SEQ ID NO: 231986

SEQ ID NO: 1539578 - protein, 14 aa, Mycobacterium tuberculosis
ATTDGTRFTNNRTG

SEQ ID NO: 1539579 - protein, 5 aa, Mycobacterium tuberculosis
ATVYD

SEQ ID NO: 1539580 - protein, 21 aa, Mycobacterium tuberculosis
CGPSGHGTRAGEEGPLSPEKV

SEQ ID NO: 1539581 - protein, 7 aa, Mycobacterium tuberculosis
CRSQARR

SEQ ID NO: 1539582 - protein, 10 aa, Mycobacterium tuberculosis
CSAPDRSLGY

SEQ ID NO: 1539583 - protein, 13 aa, Mycobacterium tuberculosis
CSAVDHSSRTPYR

SEQ ID NO: 1539584 - protein, 8 aa, Mycobacterium tuberculosis
CTAGQKKA

SEQ ID NO: 1539585 - protein, 15 aa, Mycobacterium tuberculosis
DAPHGSKQANTGGSI

SEQ ID NO: 1539586 - protein, 9 aa, Mycobacterium tuberculosis
DARGANPRL

SEQ ID NO: 1539587 - protein, 18 aa, Mycobacterium tuberculosis
DEMRDQAQFQAGDDPVAN

SEQ ID NO: 1539588 - protein, 7 aa, Mycobacterium tuberculosis
DETTELS

SEQ ID NO: 1539589 - protein, 15 aa, Mycobacterium tuberculosis
DGANGGPGQDGGPGG

SEQ ID NO: 1539590 - protein, 5 aa, Mycobacterium tuberculosis
DGFVS

SEQ ID NO: 1539591 - protein, 6 aa, Mycobacterium tuberculosis
DGFVSG

SEQ ID NO: 1539592 - protein, 23 aa, Mycobacterium tuberculosis
DGGSGGSTLQGFSDGGTGGNAGM

SEQ ID NO: 1539593 - protein, 7 aa, Mycobacterium tuberculosis
DKNAAAQ

SEQ ID NO: 1539594 - protein, 7 aa, Mycobacterium tuberculosis
DNLTGIG

SEQ ID NO: 1539595 - protein, 6 aa, Mycobacterium tuberculosis
DPGALR

SEQ ID NO: 1539596 - protein, 6 aa, Mycobacterium tuberculosis
DPIVGN

SEQ ID NO: 1539597 - protein, 18 aa, Mycobacterium tuberculosis
DPMGYQQGTGPTAGVPGY

SEQ ID NO: 1539598 - protein, 14 aa, Mycobacterium tuberculosis
DQGERKVRDHPDFP

SEQ ID NO: 1539599 - protein, 12 aa, Mycobacterium tuberculosis
DQPNLGGSGGYS

SEQ ID NO: 1539600 - protein, 17 aa, Mycobacterium tuberculosis
DRGDIGGMSTATGPEGL

SEQ ID NO: 1539601 - protein, 7 aa, Mycobacterium tuberculosis
DRLRSGN

SEQ ID NO: 1539602 - protein, 5 aa, Mycobacterium tuberculosis
DSIPT

SEQ ID NO: 1539603 - protein, 10 aa, Mycobacterium tuberculosis
DSRPTAGPQR

SEQ ID NO: 1539604 - protein, 11 aa, Mycobacterium tuberculosis
DTRTPPGLRAQ

SEQ ID NO: 1539605 - protein, 5 aa, Mycobacterium tuberculosis
DYARM

SEQ ID NO: 1539606 - protein, 4 aa, Mycobacterium tuberculosis
EAQD

SEQ ID NO: 1539607 - protein, 10 aa, Mycobacterium tuberculosis
EAQPGSQALA

SEQ ID NO: 1539608 - protein, 8 aa, Mycobacterium tuberculosis
EAVAPTAT

SEQ ID NO: 1539609 - protein, 13 aa, Mycobacterium tuberculosis
EDDPRTLAQRRAD

SEQ ID NO: 1539610 - protein, 6 aa, Mycobacterium tuberculosis
EEAGPV

SEQ ID NO: 1539611 - protein, 16 aa, Mycobacterium tuberculosis
ESTTNARRAHAPTRTS

SEQ ID NO: 1539612 - protein, 8 aa, Mycobacterium tuberculosis
ESVPLPDD

SEQ ID NO: 1539613 - protein, 7 aa, Mycobacterium tuberculosis
ETSYPKR

SEQ ID NO: 1539614 - protein, 14 aa, Mycobacterium tuberculosis
FAPGGGSGGNGGNG

SEQ ID NO: 1539615 - protein, 8 aa, Mycobacterium tuberculosis
FGDGGNGG

SEQ ID NO: 1539616 - protein, 7 aa, Mycobacterium tuberculosis
FHPGGAT

SEQ ID NO: 1539617 - protein, 6 aa, Mycobacterium tuberculosis
FNKPGT

SEQ ID NO: 1539618 - protein, 18 aa, Mycobacterium tuberculosis
FSGPPGTGGPDATGAVGG

SEQ ID NO: 1539619 - protein, 12 aa, Mycobacterium tuberculosis
FTGTEDQPAAVE

SEQ ID NO: 1539620 - protein, 8 aa, Mycobacterium tuberculosis
GADGEATV

SEQ ID NO: 1539621 - protein, 8 aa, Mycobacterium tuberculosis
GAGGGCGS

SEQ ID NO: 1539622 - protein, 4 aa, Mycobacterium tuberculosis
GAGN

SEQ ID NO: 1539623 - protein, 7 aa, Mycobacterium tuberculosis
GAGPAAM

SEQ ID NO: 1539624 - protein, 5 aa, Mycobacterium tuberculosis
GALPG

SEQ ID NO: 1539625 - protein, 10 aa, Mycobacterium tuberculosis
GAQGHTNTSH

SEQ ID NO: 1539626 - protein, 32 aa, Mycobacterium tuberculosis; identical to SEQ ID NO: 192533

SEQ ID NO: 1539627 - protein, 6 aa, Mycobacterium tuberculosis
GDGVGG

SEQ ID NO: 1539628 - protein, 10 aa, Mycobacterium tuberculosis
GDVPLRPTTT

SEQ ID NO: 1539629 - protein, 16 aa, Mycobacterium tuberculosis
GELDPDELAEDEANGL

SEQ ID NO: 1539630 - protein, 7 aa, Mycobacterium tuberculosis
GFDTPTP

SEQ ID NO: 1539631 - protein, 9 aa, Mycobacterium tuberculosis
GGAAPGGFD

SEQ ID NO: 1539632 - protein, 29 aa, Mycobacterium tuberculosis
GGAGGAGTDGGPGATGGTGGHGGVGGDGG

SEQ ID NO: 1539633 - protein, 103 aa, Mycobacterium tuberculosis; identical to SEQ ID NO: 194128

SEQ ID NO: 1539634 - protein, 9 aa, Mycobacterium tuberculosis
GGDTGYTKS

SEQ ID NO: 1539635 - protein, 5 aa, Mycobacterium tuberculosis
GGTFE

SEQ ID NO: 1539636 - protein, 10 aa, Mycobacterium tuberculosis
GGVGGNGGAA

SEQ ID NO: 1539637 - protein, 16 aa, Mycobacterium tuberculosis
GKPDCPSGAGNDERAA

SEQ ID NO: 1539638 - protein, 9 aa, Mycobacterium tuberculosis
GLAGIGGNA

SEQ ID NO: 1539639 - protein, 6 aa, Mycobacterium tuberculosis
GLYGRS

SEQ ID NO: 1539640 - protein, 8 aa, Mycobacterium tuberculosis
GNAGSTNV

SEQ ID NO: 1539641 - protein, 16 aa, Mycobacterium tuberculosis
GNANTGIANSGNVDTG

SEQ ID NO: 1539642 - protein, 47 aa, Mycobacterium tuberculosis
GNGGNGGNGGIGQPGGAGGDAGLIGNGGNGGIGGPGATGLAGGAGGV

SEQ ID NO: 1539643 - protein, 23 aa, Mycobacterium tuberculosis
GNGGNGGNVPSGAADGGAGGDAR

SEQ ID NO: 1539644 - protein, 53 aa, Mycobacterium tuberculosis; identical to SEQ ID NO: 1444539

SEQ ID NO: 1539645 - protein, 25 aa, Mycobacterium tuberculosis
GNIGTGNSGFNNSGDANSGFQNTNT

SEQ ID NO: 1539646 - protein, 9 aa, Mycobacterium tuberculosis
GPGQEGLDQ

SEQ ID NO: 1539647 - protein, 28 aa, Mycobacterium tuberculosis
GRAGKAAAAHAAAAGRSRATSSATWPEP

SEQ ID NO: 1539648 - protein, 13 aa, Mycobacterium tuberculosis
GRSAPPSATIAFG

SEQ ID NO: 1539649 - protein, 7 aa, Mycobacterium tuberculosis
GSVPQLP

SEQ ID NO: 1539650 - protein, 5 aa, Mycobacterium tuberculosis
GVYAN

SEQ ID NO: 1539651 - protein, 4 aa, Mycobacterium tuberculosis
HAEY

SEQ ID NO: 1539652 - protein, 8 aa, Mycobacterium tuberculosis
HERAGSGA

SEQ ID NO: 1539653 - protein, 5 aa, Mycobacterium tuberculosis
HGEGY

SEQ ID NO: 1539654 - protein, 14 aa, Mycobacterium tuberculosis
IAGASGLSTGGNPG

SEQ ID NO: 1539655 - protein, 11 aa, Mycobacterium tuberculosis
IEESEPEREFE

SEQ ID NO: 1539656 - protein, 15 aa, Mycobacterium tuberculosis
IGAPSWTADYGSETL

SEQ ID NO: 1539657 - protein, 54 aa, Mycobacterium tuberculosis; identical to SEQ ID NO: 1427848

SEQ ID NO: 1539658 - protein, 10 aa, Mycobacterium tuberculosis
IGPGQEGLDQ

SEQ ID NO: 1539659 - protein, 18 aa, Mycobacterium tuberculosis
IGSSISAANAAAAAPTTA

SEQ ID NO: 1539660 - protein, 14 aa, Mycobacterium tuberculosis
ITPTAVATTDGASH

SEQ ID NO: 1539661 - protein, 5 aa, Mycobacterium tuberculosis
KDDAI

SEQ ID NO: 1539662 - protein, 10 aa, Mycobacterium tuberculosis
KNSSAYPTVE

SEQ ID NO: 1539663 - protein, 4 aa, Mycobacterium tuberculosis
KSYP

SEQ ID NO: 1539664 - protein, 7 aa, Mycobacterium tuberculosis
LAGNSAK

SEQ ID NO: 1539665 - protein, 9 aa, Mycobacterium tuberculosis
LAGPTRGAP

SEQ ID NO: 1539666 - protein, 20 aa, Mycobacterium tuberculosis
LANPTRPPANPQALTPPKVP

SEQ ID NO: 1539667 - protein, 10 aa, Mycobacterium tuberculosis
LAPAAADEVS

SEQ ID NO: 1539668 - protein, 44 aa, Mycobacterium tuberculosis; identical to SEQ ID NO: 228687

SEQ ID NO: 1539669 - protein, 19 aa, Mycobacterium tuberculosis
LDATDTPPPASATSGQTSL

SEQ ID NO: 1539670 - protein, 14 aa, Mycobacterium tuberculosis
LDDSRPGNGRPVTA

SEQ ID NO: 1539671 - protein, 6 aa, Mycobacterium tuberculosis
LDGKAG

SEQ ID NO: 1539672 - protein, 12 aa, Mycobacterium tuberculosis
LGAPGPGPDESV

SEQ ID NO: 1539673 - protein, 7 aa, Mycobacterium tuberculosis
LKATGDP

SEQ ID NO: 1539674 - protein, 9 aa, Mycobacterium tuberculosis
LNDNNSRSK

SEQ ID NO: 1539675 - protein, 11 aa, Mycobacterium tuberculosis
LPPIDGDDAPF

SEQ ID NO: 1539676 - protein, 10 aa, Mycobacterium tuberculosis
LRSTGDPRRV

SEQ ID NO: 1539677 - protein, 14 aa, Mycobacterium tuberculosis
LSAANAAAAAGTTG

SEQ ID NO: 1539678 - protein, 9 aa, Mycobacterium tuberculosis
LSAGGADAA

SEQ ID NO: 1539679 - protein, 13 aa, Mycobacterium tuberculosis
MPESDDSPSEKEL

SEQ ID NO: 1539680 - protein, 6 aa, Mycobacterium tuberculosis
NAAAGY

SEQ ID NO: 1539681 - protein, 8 aa, Mycobacterium tuberculosis
NAPGTQSQ

SEQ ID NO: 1539682 - protein, 12 aa, Mycobacterium tuberculosis
NFPDQTATSPMD

SEQ ID NO: 1539683 - protein, 16 aa, Mycobacterium tuberculosis
NGANGTPGTGADGGAG

SEQ ID NO: 1539684 - protein, 14 aa, Mycobacterium tuberculosis
NGCSSSASHRGPLN

SEQ ID NO: 1539685 - protein, 14 aa, Mycobacterium tuberculosis
NGGAGGSGGPTQIP

SEQ ID NO: 1539686 - protein, 13 aa, Mycobacterium tuberculosis
PGTAAPAPESRHG

SEQ ID NO: 1539687 - protein, 4 aa, Mycobacterium tuberculosis
PLAA

SEQ ID NO: 1539688 - protein, 15 aa, Mycobacterium tuberculosis
PPPLPQAATPTLAAG

SEQ ID NO: 1539689 - protein, 4 aa, Mycobacterium tuberculosis
PSHE

SEQ ID NO: 1539690 - protein, 5 aa, Mycobacterium tuberculosis
PSTGE

SEQ ID NO: 1539691 - protein, 9 aa, Mycobacterium tuberculosis
PTALGSGYG

SEQ ID NO: 1539692 - protein, 10 aa, Mycobacterium tuberculosis
PTGSSPRAYY

SEQ ID NO: 1539693 - protein, 5 aa, Mycobacterium tuberculosis
PTPSH

SEQ ID NO: 1539694 - protein, 9 aa, Mycobacterium tuberculosis
PVAPPSVRP

SEQ ID NO: 1539695 - protein, 6 aa, Mycobacterium tuberculosis
QAAGSR

SEQ ID NO: 1539696 - protein, 5 aa, Mycobacterium tuberculosis
QARPV

SEQ ID NO: 1539697 - protein, 9 aa, Mycobacterium tuberculosis
QATTRAGPY

SEQ ID NO: 1539698 - protein, 5 aa, Mycobacterium tuberculosis
QDEVS

SEQ ID NO: 1539699 - protein, 6 aa, Mycobacterium tuberculosis
QGGRTS

SEQ ID NO: 1539700 - protein, 7 aa, Mycobacterium tuberculosis
QGNSDSI

SEQ ID NO: 1539701 - protein, 11 aa, Mycobacterium tuberculosis
QLDRGSGNSVQ

SEQ ID NO: 1539702 - protein, 6 aa, Mycobacterium tuberculosis
QQIGYE

SEQ ID NO: 1539703 - protein, 13 aa, Mycobacterium tuberculosis
QSPGAERLDDRRY

SEQ ID NO: 1539704 - protein, 15 aa, Mycobacterium tuberculosis
RAKPPLEDAKDQYRA

SEQ ID NO: 1539705 - protein, 6 aa, Mycobacterium tuberculosis
RDGCPS

SEQ ID NO: 1539706 - protein, 8 aa, Mycobacterium tuberculosis
REGGHSRR

SEQ ID NO: 1539707 - protein, 21 aa, Mycobacterium tuberculosis
RFTESTPYNPSSPYSATKAGA

SEQ ID NO: 1539708 - protein, 15 aa, Mycobacterium tuberculosis
RFTQPTGNRCFHRRR

SEQ ID NO: 1539709 - protein, 6 aa, Mycobacterium tuberculosis
RHPGDL

SEQ ID NO: 1539710 - protein, 6 aa, Mycobacterium tuberculosis
RISART

SEQ ID NO: 1539711 - protein, 6 aa, Mycobacterium tuberculosis
RPGEPL

SEQ ID NO: 1539712 - protein, 4 aa, Mycobacterium tuberculosis
RPLI

SEQ ID NO: 1539713 - protein, 6 aa, Mycobacterium tuberculosis
RRPGAA

SEQ ID NO: 1539714 - protein, 6 aa, Mycobacterium tuberculosis
RRTRAA

SEQ ID NO: 1539715 - protein, 6 aa, Mycobacterium tuberculosis
RSEEVE

SEQ ID NO: 1539716 - protein, 11 aa, Mycobacterium tuberculosis
RSGASGRQPLA

SEQ ID NO: 1539717 - protein, 7 aa, Mycobacterium tuberculosis
RTAPSRS

SEQ ID NO: 1539718 - protein, 6 aa, Mycobacterium tuberculosis
RTDART

SEQ ID NO: 1539719 - protein, 7 aa, Mycobacterium tuberculosis
RTPPAGA

SEQ ID NO: 1539720 - protein, 12 aa, Mycobacterium tuberculosis
RTSHAAPAAAIG

SEQ ID NO: 1539721 - protein, 25 aa, Mycobacterium tuberculosis
SAAGDLASIGSSINASTRAAAAATT

SEQ ID NO: 1539722 - protein, 8 aa, Mycobacterium tuberculosis
SELPPPLH

SEQ ID NO: 1539723 - protein, 7 aa, Mycobacterium tuberculosis
SEPQRVD

SEQ ID NO: 1539724 - protein, 9 aa, Mycobacterium tuberculosis
SGAGGVSGF

SEQ ID NO: 1539725 - protein, 5 aa, Mycobacterium tuberculosis
SGAQV

SEQ ID NO: 1539726 - protein, 6 aa, Mycobacterium tuberculosis
SGESGL

SEQ ID NO: 1539727 - protein, 33 aa, Mycobacterium tuberculosis; identical to SEQ ID NO: 231262

SEQ ID NO: 1539728 - protein, 8 aa, Mycobacterium tuberculosis
SGGNHGTL

SEQ ID NO: 1539729 - protein, 8 aa, Mycobacterium tuberculosis
SGHQPDGY

SEQ ID NO: 1539730 - protein, 6 aa, Mycobacterium tuberculosis
SGTVVK

SEQ ID NO: 1539731 - protein, 21 aa, Mycobacterium tuberculosis
SIRESASQALPGLLERLPALL

SEQ ID NO: 1539732 - protein, 8 aa, Mycobacterium tuberculosis
SLRTEGRQ

SEQ ID NO: 1539733 - protein, 7 aa, Mycobacterium tuberculosis
SRKTTSV

SEQ ID NO: 1539734 - protein, 5 aa, Mycobacterium tuberculosis
STGAF

SEQ ID NO: 1539735 - protein, 5 aa, Mycobacterium tuberculosis
SYGRT

SEQ ID NO: 1539736 - protein, 5 aa, Mycobacterium tuberculosis
TDLAN

SEQ ID NO: 1539737 - protein, 7 aa, Mycobacterium tuberculosis
TDPGGEI

SEQ ID NO: 1539738 - protein, 11 aa, Mycobacterium tuberculosis
TDVAAGQALQA

SEQ ID NO: 1539739 - protein, 6 aa, Mycobacterium tuberculosis
TNSAGK

SEQ ID NO: 1539740 - protein, 5 aa, Mycobacterium tuberculosis
TNSEH

SEQ ID NO: 1539741 - protein, 15 aa, Mycobacterium tuberculosis
TPSRPGTATLEPGHT

SEQ ID NO: 1539742 - protein, 10 aa, Mycobacterium tuberculosis
TRADGKRDRD

SEQ ID NO: 1539743 - protein, 10 aa, Mycobacterium tuberculosis
TREPNSGIRD

SEQ ID NO: 1539744 - protein, 6 aa, Mycobacterium tuberculosis
TRNPGF

SEQ ID NO: 1539745 - protein, 7 aa, Mycobacterium tuberculosis
TRNRPGH

SEQ ID NO: 1539746 - protein, 14 aa, Mycobacterium tuberculosis
TSGGGAYAAAEAAA

SEQ ID NO: 1539747 - protein, 7 aa, Mycobacterium tuberculosis
TSPANPE

SEQ ID NO: 1539748 - protein, 58 aa, Mycobacterium tuberculosis
TTIDGRPVASPGSGPTEPTFPTPRPTTAPPGTTAPTLPTTPVSPTAPAGAIPLPPDSN

SEQ ID NO: 1539749 - protein, 9 aa, Mycobacterium tuberculosis
TTRGSQLTP

SEQ ID NO: 1539750 - protein, 4 aa, Mycobacterium tuberculosis
TVTD

SEQ ID NO: 1539751 - protein, 5 aa, Mycobacterium tuberculosis
TVTGS

SEQ ID NO: 1539752 - protein, 7 aa, Mycobacterium tuberculosis
VEPGGAV

SEQ ID NO: 1539753 - protein, 10 aa, Mycobacterium tuberculosis
VGDGGLPAEL

SEQ ID NO: 1539754 - protein, 23 aa, Mycobacterium tuberculosis
VGRQSPRPATMDGAGFEAPCMPY

SEQ ID NO: 1539755 - protein, 17 aa, Mycobacterium tuberculosis
VGTASAGRTGPAPGSWR

SEQ ID NO: 1539756 - protein, 7 aa, Mycobacterium tuberculosis
VKSATTN

SEQ ID NO: 1539757 - protein, 5 aa, Mycobacterium tuberculosis
VPHLP

SEQ ID NO: 1539758 - protein, 4 aa, Mycobacterium tuberculosis
VPTQ

SEQ ID NO: 1539759 - protein, 9 aa, Mycobacterium tuberculosis
VQPAARGSI

SEQ ID NO: 1539760 - protein, 4 aa, Mycobacterium tuberculosis
VQTG

SEQ ID NO: 1539761 - protein, 9 aa, Mycobacterium tuberculosis
VRAERVSNE

SEQ ID NO: 1539762 - protein, 9 aa, Mycobacterium tuberculosis
VRPGSAEEV

SEQ ID NO: 1539763 - protein, 9 aa, Mycobacterium tuberculosis
VRRDNTGYD

SEQ ID NO: 1539764 - protein, 13 aa, Mycobacterium tuberculosis
VSNRNSPTPQIDR

SEQ ID NO: 1539765 - protein, 8 aa, Mycobacterium tuberculosis
VSTVTGAA

SEQ ID NO: 1539766 - protein, 6 aa, Mycobacterium tuberculosis
VTTDPD

SEQ ID NO: 1539767 - protein, 14 aa, Mycobacterium tuberculosis
WESSPTPPADPTPI

SEQ ID NO: 1539768 - protein, 6 aa, Mycobacterium tuberculosis
YAPGHE

SEQ ID NO: 1539769 - protein, 8 aa, Mycobacterium tuberculosis
YGAGPCPG

SEQ ID NO: 1539770 - protein, 4 aa, Mycobacterium tuberculosis
YGTA

SEQ ID NO: 1539771 - protein, 9 aa, Mycobacterium tuberculosis
AAITSGAAI

SEQ ID NO: 1539772 - protein, 6 aa, Mycobacterium tuberculosis
AARGTA

SEQ ID NO: 1539773 - protein, 10 aa, Mycobacterium tuberculosis
AATTISGATL

SEQ ID NO: 1539774 - protein, 4 aa, Mycobacterium tuberculosis
ADAD

SEQ ID NO: 1539775 - protein, 10 aa, Mycobacterium tuberculosis
ADDSALTAEA

SEQ ID NO: 1539776 - protein, 15 aa, Mycobacterium tuberculosis
ADSYAATEAANIIAV

SEQ ID NO: 1539777 - protein, 5 aa, Mycobacterium tuberculosis
AEGEP

SEQ ID NO: 1539778 - protein, 14 aa, Mycobacterium tuberculosis
AGAGAYASAEAAGA

SEQ ID NO: 1539779 - protein, 13 aa, Mycobacterium tuberculosis
AGGAGGAGGAGGL

SEQ ID NO: 1539780 - protein, 12 aa, Mycobacterium tuberculosis
AGKTGTAQQINP

SEQ ID NO: 1539781 - protein, 6 aa, Mycobacterium tuberculosis
AGNGRY

SEQ ID NO: 1539782 - protein, 10 aa, Mycobacterium tuberculosis
AGSRDTHAPN

SEQ ID NO: 1539783 - protein, 9 aa, Mycobacterium tuberculosis
AGTGGNGGF

SEQ ID NO: 1539784 - protein, 8 aa, Mycobacterium tuberculosis
AGTPATTM

SEQ ID NO: 1539785 - protein, 10 aa, Mycobacterium tuberculosis
AKSDEHDAAA

SEQ ID NO: 1539786 - protein, 16 aa, Mycobacterium tuberculosis
ALPAPPPLPGPPPLPA

SEQ ID NO: 1539787 - protein, 16 aa, Mycobacterium tuberculosis
ALSTANAAAAAPTTAL

SEQ ID NO: 1539788 - protein, 7 aa, Mycobacterium tuberculosis
ALTGSPV

SEQ ID NO: 1539789 - protein, 4 aa, Mycobacterium tuberculosis
ANKD

SEQ ID NO: 1539790 - protein, 5 aa, Mycobacterium tuberculosis
APHSA

SEQ ID NO: 1539791 - protein, 15 aa, Mycobacterium tuberculosis
APITQPPAGRPPNDL

SEQ ID NO: 1539792 - protein, 6 aa, Mycobacterium tuberculosis
APVAGS

SEQ ID NO: 1539793 - protein, 5 aa, Mycobacterium tuberculosis
AQDPV

SEQ ID NO: 1539794 - protein, 9 aa, Mycobacterium tuberculosis
AQDTDPRTC

SEQ ID NO: 1539795 - protein, 15 aa, Mycobacterium tuberculosis
ARIGPGAAAKRDPQL

SEQ ID NO: 1539796 - protein, 6 aa, Mycobacterium tuberculosis
ARRARQ

SEQ ID NO: 1539797 - protein, 11 aa, Mycobacterium tuberculosis
ATAGAFSRPGL

SEQ ID NO: 1539798 - protein, 13 aa, Mycobacterium tuberculosis
ATGSITKIYLRAT

SEQ ID NO: 1539799 - protein, 7 aa, Mycobacterium tuberculosis
ATVTTAD

SEQ ID NO: 1539800 - protein, 4 aa, Mycobacterium tuberculosis
ATVY

SEQ ID NO: 1539801 - protein, 8 aa, Mycobacterium tuberculosis
AVGPASPV

SEQ ID NO: 1539802 - protein, 9 aa, Mycobacterium tuberculosis
AVNRPTPDR

SEQ ID NO: 1539803 - protein, 19 aa, Mycobacterium tuberculosis
DGASNGAWGKGASETFNGG

SEQ ID NO: 1539804 - protein, 28 aa, Mycobacterium tuberculosis
DGGNGGAGGLGTGPVGATGGIGGPGGAA

SEQ ID NO: 1539805 - protein, 7 aa, Mycobacterium tuberculosis
DHDQTDR

SEQ ID NO: 1539806 - protein, 8 aa, Mycobacterium tuberculosis
DLPGQLNE

SEQ ID NO: 1539807 - protein, 8 aa, Mycobacterium tuberculosis
DPATATPP

SEQ ID NO: 1539808 - protein, 20 aa, Mycobacterium tuberculosis
DYSGPGSGLGGSDPNGVVSP

SEQ ID NO: 1539809 - protein, 10 aa, Mycobacterium tuberculosis
EESEPEREFE

SEQ ID NO: 1539810 - protein, 6 aa, Mycobacterium tuberculosis
EGAKQA

SEQ ID NO: 1539811 - protein, 4 aa, Mycobacterium tuberculosis
ENPL

SEQ ID NO: 1539812 - protein, 6 aa, Mycobacterium tuberculosis
EQSVDA

SEQ ID NO: 1539813 - protein, 5 aa, Mycobacterium tuberculosis
ESAGR

SEQ ID NO: 1539814 - protein, 6 aa, Mycobacterium tuberculosis
FGNSGL

SEQ ID NO: 1539815 - protein, 7 aa, Mycobacterium tuberculosis
FPSDNGE

SEQ ID NO: 1539816 - protein, 8 aa, Mycobacterium tuberculosis
FPSDNGEQ

SEQ ID NO: 1539817 - protein, 4 aa, Mycobacterium tuberculosis
FSVD

SEQ ID NO: 1539818 - protein, 15 aa, Mycobacterium tuberculosis
FTNPRPATPSAGLSI

SEQ ID NO: 1539819 - protein, 5 aa, Mycobacterium tuberculosis
GAAAA

SEQ ID NO: 1539820 - protein, 19 aa, Mycobacterium tuberculosis
GAAEGPYGFTGTSNSFASG

SEQ ID NO: 1539821 - protein, 6 aa, Mycobacterium tuberculosis
GAQDPV

SEQ ID NO: 1539822 - protein, 5 aa, Mycobacterium tuberculosis
GEPTI

SEQ ID NO: 1539823 - protein, 12 aa, Mycobacterium tuberculosis
GGASAAAAALPS

SEQ ID NO: 1539824 - protein, 36 aa, Mycobacterium tuberculosis; identical to SEQ ID NO: 175642

SEQ ID NO: 1539825 - protein, 4 aa, Mycobacterium tuberculosis
GGGN

SEQ ID NO: 1539826 - protein, 14 aa, Mycobacterium tuberculosis
GGISGPTRGTGTGI

SEQ ID NO: 1539827 - protein, 21 aa, Mycobacterium tuberculosis
GGMGGSGGGIGAGTTTVVPPD

SEQ ID NO: 1539828 - protein, 23 aa, Mycobacterium tuberculosis
GGQGGLGGAGGQGGTGGAGGDGV

SEQ ID NO: 1539829 - protein, 10 aa, Mycobacterium tuberculosis
GGVGGAGGNA

SEQ ID NO: 1539830 - protein, 6 aa, Mycobacterium tuberculosis
GHDDRG

SEQ ID NO: 1539831 - protein, 8 aa, Mycobacterium tuberculosis
GLGGHPRL

SEQ ID NO: 1539832 - protein, 16 aa, Mycobacterium tuberculosis
GNANTGVANAGNVNTG

SEQ ID NO: 1539833 - protein, 18 aa, Mycobacterium tuberculosis
GNGANGAPGTGANGAPGG

SEQ ID NO: 1539834 - protein, 5 aa, Mycobacterium tuberculosis
GNSAQ

SEQ ID NO: 1539835 - protein, 9 aa, Mycobacterium tuberculosis
GPPGTGKTT

SEQ ID NO: 1539836 - protein, 7 aa, Mycobacterium tuberculosis
GPRPEMA

SEQ ID NO: 1539837 - protein, 7 aa, Mycobacterium tuberculosis
GQISGSV

SEQ ID NO: 1539838 - protein, 11 aa, Mycobacterium tuberculosis
GRRPKLYGAGA

SEQ ID NO: 1539839 - protein, 29 aa, Mycobacterium tuberculosis
GRSAGKTSEPTCPTEPIDAADSSTTPDPS

SEQ ID NO: 1539840 - protein, 10 aa, Mycobacterium tuberculosis
GSAGSGHQQA

SEQ ID NO: 1539841 - protein, 8 aa, Mycobacterium tuberculosis
GSDPKGAV

SEQ ID NO: 1539842 - protein, 9 aa, Mycobacterium tuberculosis
GSGARYGRQ

SEQ ID NO: 1539843 - protein, 17 aa, Mycobacterium tuberculosis
GSSISAANAAAAAPTTA

SEQ ID NO: 1539844 - protein, 51 aa, Mycobacterium tuberculosis
GSVKKQTAIEPLPPMPGPSPTRPTTTTPTPPSPSAAPAPTTTTGTPSETVA

SEQ ID NO: 1539845 - protein, 15 aa, Mycobacterium tuberculosis
GTHERRAAATRRSAL

SEQ ID NO: 1539846 - protein, 9 aa, Mycobacterium tuberculosis
GTRQTLQGA

SEQ ID NO: 1539847 - protein, 14 aa, Mycobacterium tuberculosis
GVGGTGGKGGVGGV

SEQ ID NO: 1539848 - protein, 4 aa, Mycobacterium tuberculosis
GWGS

SEQ ID NO: 1539849 - protein, 16 aa, Mycobacterium tuberculosis
HDPEKAAQIREEDDAM

SEQ ID NO: 1539850 - protein, 12 aa, Mycobacterium tuberculosis
IEESEPEREFEE

SEQ ID NO: 1539851 - protein, 71 aa, Mycobacterium tuberculosis; identical to SEQ ID NO: 178523

SEQ ID NO: 1539852 - protein, 8 aa, Mycobacterium tuberculosis
IGAAAAGV

SEQ ID NO: 1539853 - protein, 6 aa, Mycobacterium tuberculosis
IPPDRA

SEQ ID NO: 1539854 - protein, 24 aa, Mycobacterium tuberculosis
IPVGAPGSTAVPPLPPPVTPAISG

SEQ ID NO: 1539855 - protein, 13 aa, Mycobacterium tuberculosis
ISAEPADETRTDY

SEQ ID NO: 1539856 - protein, 15 aa, Mycobacterium tuberculosis
KAAEAAAPSSSFPSL

SEQ ID NO: 1539857 - protein, 4 aa, Mycobacterium tuberculosis
KPAL

SEQ ID NO: 1539858 - protein, 6 aa, Mycobacterium tuberculosis
KQASAA

SEQ ID NO: 1539859 - protein, 7 aa, Mycobacterium tuberculosis
KSAGKWP

SEQ ID NO: 1539860 - protein, 15 aa, Mycobacterium tuberculosis
KSLSDGALRGPGEVS

SEQ ID NO: 1539861 - protein, 5 aa, Mycobacterium tuberculosis
KSTRF

SEQ ID NO: 1539862 - protein, 6 aa, Mycobacterium tuberculosis
KVAQPS

SEQ ID NO: 1539863 - protein, 9 aa, Mycobacterium tuberculosis
LAGAGSGIA

SEQ ID NO: 1539864 - protein, 19 aa, Mycobacterium tuberculosis
LANPTRPPANPQALTPPKV

SEQ ID NO: 1539865 - protein, 6 aa, Mycobacterium tuberculosis
LEAAQS

SEQ ID NO: 1539866 - protein, 7 aa, Mycobacterium tuberculosis
LNRSERD

SEQ ID NO: 1539867 - protein, 5 aa, Mycobacterium tuberculosis
LPLGT

SEQ ID NO: 1539868 - protein, 7 aa, Mycobacterium tuberculosis
MRRGGTV

SEQ ID NO: 1539869 - protein, 34 aa, Mycobacterium tuberculosis; identical to SEQ ID NO: 1424350

SEQ ID NO: 1539870 - protein, 26 aa, Mycobacterium tuberculosis
NGGTGGASDLAGTGRGGVGGAGGAGG

SEQ ID NO: 1539871 - protein, 6 aa, Mycobacterium tuberculosis
NKPADH

SEQ ID NO: 1539872 - protein, 7 aa, Mycobacterium tuberculosis
NPNVTGS

SEQ ID NO: 1539873 - protein, 18 aa, Mycobacterium tuberculosis
NTGGGGGSGFSNSGSGMS

SEQ ID NO: 1539874 - protein, 6 aa, Mycobacterium tuberculosis
NVGQNP

SEQ ID NO: 1539875 - protein, 18 aa, Mycobacterium tuberculosis
PAASADPPDPTVSDGACP

SEQ ID NO: 1539876 - protein, 6 aa, Mycobacterium tuberculosis
PANADG

SEQ ID NO: 1539877 - protein, 8 aa, Mycobacterium tuberculosis
PDGMPGGE

SEQ ID NO: 1539878 - protein, 6 aa, Mycobacterium tuberculosis
PDSPEA

SEQ ID NO: 1539879 - protein, 6 aa, Mycobacterium tuberculosis
PIPARS

SEQ ID NO: 1539880 - protein, 5 aa, Mycobacterium tuberculosis
PIPDD

SEQ ID NO: 1539881 - protein, 17 aa, Mycobacterium tuberculosis
PNPPAPPPANTLVGGRH

SEQ ID NO: 1539882 - protein, 11 aa, Mycobacterium tuberculosis
PPTSQPHAVSA

SEQ ID NO: 1539883 - protein, 7 aa, Mycobacterium tuberculosis
PSSPVSL

SEQ ID NO: 1539884 - protein, 6 aa, Mycobacterium tuberculosis
PTDHDT

SEQ ID NO: 1539885 - protein, 9 aa, Mycobacterium tuberculosis
PTLSSKQKW

SEQ ID NO: 1539886 - protein, 10 aa, Mycobacterium tuberculosis
QASGIPKANY

SEQ ID NO: 1539887 - protein, 16 aa, Mycobacterium tuberculosis
QGNPAQQRYPPWPASY

SEQ ID NO: 1539888 - protein, 4 aa, Mycobacterium tuberculosis
QGYQ

SEQ ID NO: 1539889 - protein, 4 aa, Mycobacterium tuberculosis
QNAA

SEQ ID NO: 1539890 - protein, 4 aa, Mycobacterium tuberculosis
QNGA

SEQ ID NO: 1539891 - protein, 7 aa, Mycobacterium tuberculosis
QPPVTDR

SEQ ID NO: 1539892 - protein, 18 aa, Mycobacterium tuberculosis
QPTDPRTLPPDAPDDRKY

SEQ ID NO: 1539893 - protein, 6 aa, Mycobacterium tuberculosis
QTYGAE

SEQ ID NO: 1539894 - protein, 8 aa, Mycobacterium tuberculosis
QVGRTASR

SEQ ID NO: 1539895 - protein, 6 aa, Mycobacterium tuberculosis
QVQGVP

SEQ ID NO: 1539896 - protein, 16 aa, Mycobacterium tuberculosis
RALGSNKSYPASQTAE

SEQ ID NO: 1539897 - protein, 4 aa, Mycobacterium tuberculosis
RATS

SEQ ID NO: 1539898 - protein, 4 aa, Mycobacterium tuberculosis
RDGG

SEQ ID NO: 1539899 - protein, 9 aa, Mycobacterium tuberculosis
RDGRDDSGF

SEQ ID NO: 1539900 - protein, 4 aa, Mycobacterium tuberculosis
RGNG

SEQ ID NO: 1539901 - protein, 13 aa, Mycobacterium tuberculosis
RISRTDTPKPSPT

SEQ ID NO: 1539902 - protein, 5 aa, Mycobacterium tuberculosis
RNDGT

SEQ ID NO: 1539903 - protein, 6 aa, Mycobacterium tuberculosis
RNDGTW

SEQ ID NO: 1539904 - protein, 14 aa, Mycobacterium tuberculosis
RNSPDGDEPLPADG

SEQ ID NO: 1539905 - protein, 4 aa, Mycobacterium tuberculosis
RPPV

SEQ ID NO: 1539906 - protein, 14 aa, Mycobacterium tuberculosis
RRLTEANDSPAGEA

SEQ ID NO: 1539907 - protein, 7 aa, Mycobacterium tuberculosis
RSAEKVS

SEQ ID NO: 1539908 - protein, 10 aa, Mycobacterium tuberculosis
RSGMQRQEAQ

SEQ ID NO: 1539909 - protein, 5 aa, Mycobacterium tuberculosis
RSIAP

SEQ ID NO: 1539910 - protein, 8 aa, Mycobacterium tuberculosis
RSQGNESA

SEQ ID NO: 1539911 - protein, 4 aa, Mycobacterium tuberculosis
RTDV

SEQ ID NO: 1539912 - protein, 26 aa, Mycobacterium tuberculosis
SAQADPEADPGAGEANYGGPPSSPRL

SEQ ID NO: 1539913 - protein, 7 aa, Mycobacterium tuberculosis
SARAEES

SEQ ID NO: 1539914 - protein, 18 aa, Mycobacterium tuberculosis
SDQRGDRSSDQPTPASVA

SEQ ID NO: 1539915 - protein, 4 aa, Mycobacterium tuberculosis
SEQC

SEQ ID NO: 1539916 - protein, 6 aa, Mycobacterium tuberculosis
SESGAE

SEQ ID NO: 1539917 - protein, 8 aa, Mycobacterium tuberculosis
SGGTPPFD

SEQ ID NO: 1539918 - protein, 4 aa, Mycobacterium tuberculosis
SGLP

SEQ ID NO: 1539919 - protein, 8 aa, Mycobacterium tuberculosis
SGLPNQTD

SEQ ID NO: 1539920 - protein, 6 aa, Mycobacterium tuberculosis
SPAYND

SEQ ID NO: 1539921 - protein, 8 aa, Mycobacterium tuberculosis
STENAEQY

SEQ ID NO: 1539922 - protein, 27 aa, Mycobacterium tuberculosis
SVGAGTPGPAGTSGTATTGPKTAPKTA

SEQ ID NO: 1539923 - protein, 12 aa, Mycobacterium tuberculosis
TAELPQTSTAAV

SEQ ID NO: 1539924 - protein, 4 aa, Mycobacterium tuberculosis
TAPT

SEQ ID NO: 1539925 - protein, 7 aa, Mycobacterium tuberculosis
TATAHPA

SEQ ID NO: 1539926 - protein, 6 aa, Mycobacterium tuberculosis
TDIDGI

SEQ ID NO: 1539927 - protein, 8 aa, Mycobacterium tuberculosis
TDTYDAAA

SEQ ID NO: 1539928 - protein, 11 aa, Mycobacterium tuberculosis
TGAGGGSGFGN

SEQ ID NO: 1539929 - protein, 17 aa, Mycobacterium tuberculosis
TGDNQSGIGGLNSGTGN

SEQ ID NO: 1539930 - protein, 7 aa, Mycobacterium tuberculosis
THPEPKV

SEQ ID NO: 1539931 - protein, 6 aa, Mycobacterium tuberculosis
TPGATI

SEQ ID NO: 1539932 - protein, 7 aa, Mycobacterium tuberculosis
TQDGPLT

SEQ ID NO: 1539933 - protein, 6 aa, Mycobacterium tuberculosis
TREGNR

SEQ ID NO: 1539934 - protein, 8 aa, Mycobacterium tuberculosis
TRQTLQGA

SEQ ID NO: 1539935 - protein, 5 aa, Mycobacterium tuberculosis
TSDNM

SEQ ID NO: 1539936 - protein, 12 aa, Mycobacterium tuberculosis
TTADGRDPSSTY

SEQ ID NO: 1539937 - protein, 9 aa, Mycobacterium tuberculosis
TTAPSAAPN

SEQ ID NO: 1539938 - protein, 6 aa, Mycobacterium tuberculosis
TTDSGL

SEQ ID NO: 1539939 - protein, 4 aa, Mycobacterium tuberculosis
TTIG

SEQ ID NO: 1539940 - protein, 9 aa, Mycobacterium tuberculosis
TVKSSQPPV

SEQ ID NO: 1539941 - protein, 5 aa, Mycobacterium tuberculosis
TVPEH

SEQ ID NO: 1539942 - protein, 8 aa, Mycobacterium tuberculosis
TVTTDDVR

SEQ ID NO: 1539943 - protein, 4 aa, Mycobacterium tuberculosis
VADR

SEQ ID NO: 1539944 - protein, 12 aa, Mycobacterium tuberculosis
VETEPGGGDRYG

SEQ ID NO: 1539945 - protein, 5 aa, Mycobacterium tuberculosis
VETSR

SEQ ID NO: 1539946 - protein, 6 aa, Mycobacterium tuberculosis
VGATSE

SEQ ID NO: 1539947 - protein, 7 aa, Mycobacterium tuberculosis
VGNGNVG

SEQ ID NO: 1539948 - protein, 5 aa, Mycobacterium tuberculosis
VGPER

SEQ ID NO: 1539949 - protein, 6 aa, Mycobacterium tuberculosis
VRPPSM

SEQ ID NO: 1539950 - protein, 6 aa, Mycobacterium tuberculosis
VRSAEA

SEQ ID NO: 1539951 - protein, 7 aa, Mycobacterium tuberculosis
VSPANGA

SEQ ID NO: 1539952 - protein, 7 aa, Mycobacterium tuberculosis
VTEEANA

SEQ ID NO: 1539953 - protein, 7 aa, Mycobacterium tuberculosis
VTQTAAA

SEQ ID NO: 1539954 - protein, 10 aa, Mycobacterium tuberculosis
VYPSSNHAEA

SEQ ID NO: 1539955 - protein, 10 aa, Mycobacterium tuberculosis
WGGAAPGGFD

SEQ ID NO: 1539956 - protein, 5 aa, Mycobacterium tuberculosis
WQSTR

SEQ ID NO: 1539957 - protein, 12 aa, Mycobacterium tuberculosis
YDAAATQSGGVC

SEQ ID NO: 1539958 - protein, 4 aa, Mycobacterium tuberculosis
YDES

SEQ ID NO: 1539959 - protein, 18 aa, Mycobacterium tuberculosis
YGASADQSRGVADGKPAD

SEQ ID NO: 1539960 - protein, 6 aa, Mycobacterium tuberculosis
AAAIGG

SEQ ID NO: 1539961 - protein, 8 aa, Mycobacterium tuberculosis
AAGAAGGG

SEQ ID NO: 1539962 - protein, 10 aa, Mycobacterium tuberculosis
AAKAPLRQTA

SEQ ID NO: 1539963 - protein, 18 aa, Mycobacterium tuberculosis
AANPTGPASVQGMSQDPV

SEQ ID NO: 1539964 - protein, 4 aa, Mycobacterium tuberculosis
AAPY

SEQ ID NO: 1539965 - protein, 6 aa, Mycobacterium tuberculosis
AARQTG

SEQ ID NO: 1539966 - protein, 11 aa, Mycobacterium tuberculosis
ADAAAAATTTG

SEQ ID NO: 1539967 - protein, 5 aa, Mycobacterium tuberculosis
AESGA

SEQ ID NO: 1539968 - protein, 32 aa, Mycobacterium tuberculosis; identical to SEQ ID NO: 231923

SEQ ID NO: 1539969 - protein, 33 aa, Mycobacterium tuberculosis; identical to SEQ ID NO: 1433296

SEQ ID NO: 1539970 - protein, 14 aa, Mycobacterium tuberculosis
AGEDQPPAPDEPVT

SEQ ID NO: 1539971 - protein, 29 aa, Mycobacterium tuberculosis
AGGAGGVGGAALGGGAQAAGGNGGAGGVG

SEQ ID NO: 1539972 - protein, 8 aa, Mycobacterium tuberculosis
AGLSATAP

SEQ ID NO: 1539973 - protein, 10 aa, Mycobacterium tuberculosis
AGPPPTPSRV

SEQ ID NO: 1539974 - protein, 7 aa, Mycobacterium tuberculosis
AHPSEPG

SEQ ID NO: 1539975 - protein, 8 aa, Mycobacterium tuberculosis
AKPAAAAS

SEQ ID NO: 1539976 - protein, 10 aa, Mycobacterium tuberculosis
ALGENGNGGM

SEQ ID NO: 1539977 - protein, 9 aa, Mycobacterium tuberculosis
ALGRSGTIA

SEQ ID NO: 1539978 - protein, 6 aa, Mycobacterium tuberculosis
APPGRA

SEQ ID NO: 1539979 - protein, 4 aa, Mycobacterium tuberculosis
APVG

SEQ ID NO: 1539980 - protein, 12 aa, Mycobacterium tuberculosis
APVPPPRPPTVK

SEQ ID NO: 1539981 - protein, 8 aa, Mycobacterium tuberculosis
AQVKSDRL

SEQ ID NO: 1539982 - protein, 9 aa, Mycobacterium tuberculosis
ASGIPKANY

SEQ ID NO: 1539983 - protein, 28 aa, Mycobacterium tuberculosis
ASSEDAEAESDASNPSRGETVVHYRSDP

SEQ ID NO: 1539984 - protein, 9 aa, Mycobacterium tuberculosis
ATADDATHQ

SEQ ID NO: 1539985 - protein, 10 aa, Mycobacterium tuberculosis
ATADPAASGW

SEQ ID NO: 1539986 - protein, 7 aa, Mycobacterium tuberculosis
ATEREAL

SEQ ID NO: 1539987 - protein, 10 aa, Mycobacterium tuberculosis
ATNGSETGRR

SEQ ID NO: 1539988 - protein, 4 aa, Mycobacterium tuberculosis
ATPG

SEQ ID NO: 1539989 - protein, 4 aa, Mycobacterium tuberculosis
ATQR

SEQ ID NO: 1539990 - protein, 5 aa, Mycobacterium tuberculosis
ATRIP

SEQ ID NO: 1539991 - protein, 6 aa, Mycobacterium tuberculosis
CTKPAT

SEQ ID NO: 1539992 - protein, 6 aa, Mycobacterium tuberculosis
DAAGDL

SEQ ID NO: 1539993 - protein, 15 aa, Mycobacterium tuberculosis
DAAIPTGIQNPCFSH

SEQ ID NO: 1539994 - protein, 5 aa, Mycobacterium tuberculosis
DAALS

SEQ ID NO: 1539995 - protein, 6 aa, Mycobacterium tuberculosis
DAALSA

SEQ ID NO: 1539996 - protein, 15 aa, Mycobacterium tuberculosis
DGANGTAENPDGQNG

SEQ ID NO: 1539997 - protein, 10 aa, Mycobacterium tuberculosis
DGGAGGVGGV

SEQ ID NO: 1539998 - protein, 31 aa, Mycobacterium tuberculosis; identical to SEQ ID NO: 1427555

SEQ ID NO: 1539999 - protein, 5 aa, Mycobacterium tuberculosis
DGQTV

SEQ ID NO: 1540000 - protein, 16 aa, Mycobacterium tuberculosis
DGTHGAPGTGQNGGAG

SEQ ID NO: 1540001 - protein, 7 aa, Mycobacterium tuberculosis
DGVTTQL

SEQ ID NO: 1540002 - protein, 4 aa, Mycobacterium tuberculosis
DLTG

SEQ ID NO: 1540003 - protein, 8 aa, Mycobacterium tuberculosis
DNGDPANR

SEQ ID NO: 1540004 - protein, 9 aa, Mycobacterium tuberculosis
DPDEDAGTA

SEQ ID NO: 1540005 - protein, 5 aa, Mycobacterium tuberculosis
DPGAL

SEQ ID NO: 1540006 - protein, 22 aa, Mycobacterium tuberculosis
DPMPARSEAAAANTSGATTTND

SEQ ID NO: 1540007 - protein, 5 aa, Mycobacterium tuberculosis
DSEGC

SEQ ID NO: 1540008 - protein, 21 aa, Mycobacterium tuberculosis
DSNSWVPNKPDAATPVIPGPV

SEQ ID NO: 1540009 - protein, 5 aa, Mycobacterium tuberculosis
DSTYS

SEQ ID NO: 1540010 - protein, 6 aa, Mycobacterium tuberculosis
EAAAVN

SEQ ID NO: 1540011 - protein, 6 aa, Mycobacterium tuberculosis
EAVGSG

SEQ ID NO: 1540012 - protein, 7 aa, Mycobacterium tuberculosis
EGAMTPG

SEQ ID NO: 1540013 - protein, 11 aa, Mycobacterium tuberculosis
EGPPDKYQTTG

SEQ ID NO: 1540014 - protein, 5 aa, Mycobacterium tuberculosis
EHRRT

SEQ ID NO: 1540015 - protein, 5 aa, Mycobacterium tuberculosis
EPAEP

SEQ ID NO: 1540016 - protein, 4 aa, Mycobacterium tuberculosis
EPET

SEQ ID NO: 1540017 - protein, 6 aa, Mycobacterium tuberculosis
ERKDKL

SEQ ID NO: 1540018 - protein, 7 aa, Mycobacterium tuberculosis
ERKDKLE

SEQ ID NO: 1540019 - protein, 69 aa, Mycobacterium tuberculosis
FDGGQGGQGGAGGSAGAGGINGAGGAGGNGGDGGDGATGAAGLGDNGGVGGDGGAGGAAGNGGNAGVGL

SEQ ID NO: 1540020 - protein, 15 aa, Mycobacterium tuberculosis
FGAAGGAAGAGGAGG

SEQ ID NO: 1540021 - protein, 10 aa, Mycobacterium tuberculosis
FGNAGNNNFG

SEQ ID NO: 1540022 - protein, 6 aa, Mycobacterium tuberculosis
FGRGSN

SEQ ID NO: 1540023 - protein, 14 aa, Mycobacterium tuberculosis
FTSTDTVTVSSPRA

SEQ ID NO: 1540024 - protein, 11 aa, Mycobacterium tuberculosis
GAANAAAGAPT

SEQ ID NO: 1540025 - protein, 10 aa, Mycobacterium tuberculosis
GAAPTTDRRT

SEQ ID NO: 1540026 - protein, 5 aa, Mycobacterium tuberculosis
GAGAA

SEQ ID NO: 1540027 - protein, 8 aa, Mycobacterium tuberculosis
GAPINSAT

SEQ ID NO: 1540028 - protein, 10 aa, Mycobacterium tuberculosis
GDAASTGGLT

SEQ ID NO: 1540029 - protein, 9 aa, Mycobacterium tuberculosis
GDGGWGGRG

SEQ ID NO: 1540030 - protein, 5 aa, Mycobacterium tuberculosis
GDHQL

SEQ ID NO: 1540031 - protein, 6 aa, Mycobacterium tuberculosis
GDLDKP

SEQ ID NO: 1540032 - protein, 10 aa, Mycobacterium tuberculosis
GDPDEDAGTA

SEQ ID NO: 1540033 - protein, 26 aa, Mycobacterium tuberculosis
GDTNTGFGNAGFTNTGFGNAGSGNFG

SEQ ID NO: 1540034 - protein, 16 aa, Mycobacterium tuberculosis
GERLNEQAATDTFGNY

SEQ ID NO: 1540035 - protein, 9 aa, Mycobacterium tuberculosis
GFQQGTAPN

SEQ ID NO: 1540036 - protein, 9 aa, Mycobacterium tuberculosis
GGDATGAEV

SEQ ID NO: 1540037 - protein, 23 aa, Mycobacterium tuberculosis
GGGSWGDDCRPAGIGGLGGRGSR

SEQ ID NO: 1540038 - protein, 9 aa, Mycobacterium tuberculosis
GGHQTPNGT

SEQ ID NO: 1540039 - protein, 9 aa, Mycobacterium tuberculosis
GGIRDDESL

SEQ ID NO: 1540040 - protein, 10 aa, Mycobacterium tuberculosis
GGLRTGNTVE

SEQ ID NO: 1540041 - protein, 26 aa, Mycobacterium tuberculosis
GGNGGVGGTSVAAGIGGAGGNGGNAG

SEQ ID NO: 1540042 - protein, 14 aa, Mycobacterium tuberculosis
GGNVSSEHGVGSRK

SEQ ID NO: 1540043 - protein, 9 aa, Mycobacterium tuberculosis
GHGGHGGNA

SEQ ID NO: 1540044 - protein, 5 aa, Mycobacterium tuberculosis
GIGST

SEQ ID NO: 1540045 - protein, 12 aa, Mycobacterium tuberculosis
GKAGSQTEYGSA

SEQ ID NO: 1540046 - protein, 6 aa, Mycobacterium tuberculosis
GKPSLE

SEQ ID NO: 1540047 - protein, 8 aa, Mycobacterium tuberculosis
GLRGHGDD

SEQ ID NO: 1540048 - protein, 14 aa, Mycobacterium tuberculosis
GLSVKGAQPGNASN

SEQ ID NO: 1540049 - protein, 18 aa, Mycobacterium tuberculosis
GNGADGAAGTGQAGGAGG

SEQ ID NO: 1540050 - protein, 26 aa, Mycobacterium tuberculosis
GNGGAGGAGASNQAGNGGAGGNGGAG

SEQ ID NO: 1540051 - protein, 12 aa, Mycobacterium tuberculosis
GNGGDGGTGGTL

SEQ ID NO: 1540052 - protein, 23 aa, Mycobacterium tuberculosis
GNGGSGGSGGAGAAGGVGGSGGW

SEQ ID NO: 1540053 - protein, 5 aa, Mycobacterium tuberculosis
GPDVT

SEQ ID NO: 1540054 - protein, 10 aa, Mycobacterium tuberculosis
GPPPFRPPTF

SEQ ID NO: 1540055 - protein, 12 aa, Mycobacterium tuberculosis
GPVAGQDPTPFV

SEQ ID NO: 1540056 - protein, 10 aa, Mycobacterium tuberculosis
GRLGDSRGDI

SEQ ID NO: 1540057 - protein, 26 aa, Mycobacterium tuberculosis
GSGGVGGAGGFGETGDGGVGGAGGKA

SEQ ID NO: 1540058 - protein, 16 aa, Mycobacterium tuberculosis
GSYNTGIGNSGVASTG

SEQ ID NO: 1540059 - protein, 27 aa, Mycobacterium tuberculosis
GTGGAGGAGGSSTVGDGGAGGAGGSGG

SEQ ID NO: 1540060 - protein, 10 aa, Mycobacterium tuberculosis
GTPPGRGGSA

SEQ ID NO: 1540061 - protein, 4 aa, Mycobacterium tuberculosis
GWTT

SEQ ID NO: 1540062 - protein, 8 aa, Mycobacterium tuberculosis
HGDAADLA

SEQ ID NO: 1540063 - protein, 16 aa, Mycobacterium tuberculosis
HGVSGGTEIRRSNAPR

SEQ ID NO: 1540064 - protein, 13 aa, Mycobacterium tuberculosis
HTTRPATCSQEHS

SEQ ID NO: 1540065 - protein, 4 aa, Mycobacterium tuberculosis
IDNS

SEQ ID NO: 1540066 - protein, 4 aa, Mycobacterium tuberculosis
IDPV

SEQ ID NO: 1540067 - protein, 75 aa, Mycobacterium tuberculosis; identical to SEQ ID NO: 232184

SEQ ID NO: 1540068 - protein, 14 aa, Mycobacterium tuberculosis
IGNGGDGGNSVQTD

SEQ ID NO: 1540069 - protein, 7 aa, Mycobacterium tuberculosis
INTGNGY

SEQ ID NO: 1540070 - protein, 5 aa, Mycobacterium tuberculosis
IPPVP

SEQ ID NO: 1540071 - protein, 8 aa, Mycobacterium tuberculosis
ISYSGNQA

SEQ ID NO: 1540072 - protein, 9 aa, Mycobacterium tuberculosis
ITDARSSTF

SEQ ID NO: 1540073 - protein, 4 aa, Mycobacterium tuberculosis
IYGD

SEQ ID NO: 1540074 - protein, 29 aa, Mycobacterium tuberculosis
KAATLGATSTHATTPSGLDGPGGSGASTA

SEQ ID NO: 1540075 - protein, 7 aa, Mycobacterium tuberculosis
KKSLSDF

SEQ ID NO: 1540076 - protein, 7 aa, Mycobacterium tuberculosis
KLPASTI

SEQ ID NO: 1540077 - protein, 6 aa, Mycobacterium tuberculosis
KNYSGM

SEQ ID NO: 1540078 - protein, 7 aa, Mycobacterium tuberculosis
KPGTGST

SEQ ID NO: 1540079 - protein, 5 aa, Mycobacterium tuberculosis
KRGRD

SEQ ID NO: 1540080 - protein, 7 aa, Mycobacterium tuberculosis
LAHGGQP

SEQ ID NO: 1540081 - protein, 13 aa, Mycobacterium tuberculosis
LDPTGYLNAAVLF

SEQ ID NO: 1540082 - protein, 19 aa, Mycobacterium tuberculosis
LGLPTDPKKLASVAPSSNA

SEQ ID NO: 1540083 - protein, 14 aa, Mycobacterium tuberculosis
LGQPGTYTDFGNGA

SEQ ID NO: 1540084 - protein, 10 aa, Mycobacterium tuberculosis
LGSSAGRHAD

SEQ ID NO: 1540085 - protein, 4 aa, Mycobacterium tuberculosis
LPPQ

SEQ ID NO: 1540086 - protein, 10 aa, Mycobacterium tuberculosis
LQPDDGPQFA

SEQ ID NO: 1540087 - protein, 15 aa, Mycobacterium tuberculosis
LRGTRKAEEAAESAR

SEQ ID NO: 1540088 - protein, 9 aa, Mycobacterium tuberculosis
LSKQTGQQV

SEQ ID NO: 1540089 - protein, 5 aa, Mycobacterium tuberculosis
MGTPE

SEQ ID NO: 1540090 - protein, 20 aa, Mycobacterium tuberculosis
MRATDRSSGLPTSAKPARAR

SEQ ID NO: 1540091 - protein, 6 aa, Mycobacterium tuberculosis
NAGPDV

SEQ ID NO: 1540092 - protein, 24 aa, Mycobacterium tuberculosis
NGGAGGAGGQGAVTGGTGGAGGDG

SEQ ID NO: 1540093 - protein, 32 aa, Mycobacterium tuberculosis
NGGAGGTGSPGAVVGGNGGVGGLGGAGSPGGL

SEQ ID NO: 1540094 - protein, 22 aa, Mycobacterium tuberculosis
NGGNAGIGGTGPTAGDTGAGGI

SEQ ID NO: 1540095 - protein, 21 aa, Mycobacterium tuberculosis
NGGNGGSGAPGQPGGRGGDAG

SEQ ID NO: 1540096 - protein, 75 aa, Mycobacterium tuberculosis; identical to SEQ ID NO: 181337

SEQ ID NO: 1540097 - protein, 21 aa, Mycobacterium tuberculosis
NGNGGAGGAGGTGANGGAGGN

SEQ ID NO: 1540098 - protein, 5 aa, Mycobacterium tuberculosis
NLTGI

SEQ ID NO: 1540099 - protein, 7 aa, Mycobacterium tuberculosis
NPTNTAY

SEQ ID NO: 1540100 - protein, 6 aa, Mycobacterium tuberculosis
NSVYTS

SEQ ID NO: 1540101 - protein, 31 aa, Mycobacterium tuberculosis; identical to SEQ ID NO: 1427982

SEQ ID NO: 1540102 - protein, 8 aa, Mycobacterium tuberculosis
NTGNEEAA

SEQ ID NO: 1540103 - protein, 12 aa, Mycobacterium tuberculosis
PAWAESSTSHYV

SEQ ID NO: 1540104 - protein, 7 aa, Mycobacterium tuberculosis
PCPPTGL

SEQ ID NO: 1540105 - protein, 22 aa, Mycobacterium tuberculosis
PDAARRVAKRSDAARARGDELG

SEQ ID NO: 1540106 - protein, 12 aa, Mycobacterium tuberculosis
PDIPTKQTGGSF

SEQ ID NO: 1540107 - protein, 55 aa, Mycobacterium tuberculosis; identical to SEQ ID NO: 230724

SEQ ID NO: 1540108 - protein, 6 aa, Mycobacterium tuberculosis
PEVQAP

SEQ ID NO: 1540109 - protein, 4 aa, Mycobacterium tuberculosis
PGAL

SEQ ID NO: 1540110 - protein, 10 aa, Mycobacterium tuberculosis
PGARNAAPLQ

SEQ ID NO: 1540111 - protein, 6 aa, Mycobacterium tuberculosis
PGKDAH

SEQ ID NO: 1540112 - protein, 4 aa, Mycobacterium tuberculosis
PGTN

SEQ ID NO: 1540113 - protein, 5 aa, Mycobacterium tuberculosis
PGVTP

SEQ ID NO: 1540114 - protein, 6 aa, Mycobacterium tuberculosis
PHPIDG

SEQ ID NO: 1540115 - protein, 6 aa, Mycobacterium tuberculosis
PHPTSR

SEQ ID NO: 1540116 - protein, 18 aa, Mycobacterium tuberculosis
PLAPPPPDPLAPPPPDPL

SEQ ID NO: 1540117 - protein, 18 aa, Mycobacterium tuberculosis
PLPTGPDAAPACPTGGAG

SEQ ID NO: 1540118 - protein, 6 aa, Mycobacterium tuberculosis
PLRSPV

SEQ ID NO: 1540119 - protein, 7 aa, Mycobacterium tuberculosis
PPDREPA

SEQ ID NO: 1540120 - protein, 14 aa, Mycobacterium tuberculosis
PPKTPSPKPLSPNA

SEQ ID NO: 1540121 - protein, 54 aa, Mycobacterium tuberculosis; identical to SEQ ID NO: 155741

SEQ ID NO: 1540122 - protein, 4 aa, Mycobacterium tuberculosis
PTQT

SEQ ID NO: 1540123 - protein, 15 aa, Mycobacterium tuberculosis
PYIPGGDSPAGTDCS

SEQ ID NO: 1540124 - protein, 7 aa, Mycobacterium tuberculosis
QAGCTND

SEQ ID NO: 1540125 - protein, 4 aa, Mycobacterium tuberculosis
QAND

SEQ ID NO: 1540126 - protein, 11 aa, Mycobacterium tuberculosis
QATAATDGEWD

SEQ ID NO: 1540127 - protein, 7 aa, Mycobacterium tuberculosis
QDRDLGN

SEQ ID NO: 1540128 - protein, 14 aa, Mycobacterium tuberculosis
QLPPLPRATTATTL

SEQ ID NO: 1540129 - protein, 7 aa, Mycobacterium tuberculosis
QNTPAIA

SEQ ID NO: 1540130 - protein, 7 aa, Mycobacterium tuberculosis
QPSATGR

SEQ ID NO: 1540131 - protein, 4 aa, Mycobacterium tuberculosis
QQYQ

SEQ ID NO: 1540132 - protein, 15 aa, Mycobacterium tuberculosis
RASGPDSGGKARFVP

SEQ ID NO: 1540133 - protein, 8 aa, Mycobacterium tuberculosis
RDGEWTTN

SEQ ID NO: 1540134 - protein, 8 aa, Mycobacterium tuberculosis
RGWETDGG

SEQ ID NO: 1540135 - protein, 9 aa, Mycobacterium tuberculosis
RKDPSTPKI

SEQ ID NO: 1540136 - protein, 16 aa, Mycobacterium tuberculosis
RPVPSNLPKPSPGMDP

SEQ ID NO: 1540137 - protein, 9 aa, Mycobacterium tuberculosis
RRPKLYGAG

SEQ ID NO: 1540138 - protein, 5 aa, Mycobacterium tuberculosis
RRSKG

SEQ ID NO: 1540139 - protein, 7 aa, Mycobacterium tuberculosis
RTGAAGR

SEQ ID NO: 1540140 - protein, 14 aa, Mycobacterium tuberculosis
SAEAPSTGTGPNAA

SEQ ID NO: 1540141 - protein, 7 aa, Mycobacterium tuberculosis
SDDNVSV

SEQ ID NO: 1540142 - protein, 16 aa, Mycobacterium tuberculosis
SDVAATDPGVADGAAA

SEQ ID NO: 1540143 - protein, 9 aa, Mycobacterium tuberculosis
SEIGGSTRI

SEQ ID NO: 1540144 - protein, 21 aa, Mycobacterium tuberculosis
SENRPSYSDTNLENSKPFNPK

SEQ ID NO: 1540145 - protein, 9 aa, Mycobacterium tuberculosis
SGDTTKSDN

SEQ ID NO: 1540146 - protein, 4 aa, Mycobacterium tuberculosis
SGGW

SEQ ID NO: 1540147 - protein, 4 aa, Mycobacterium tuberculosis
SGMT

SEQ ID NO: 1540148 - protein, 4 aa, Mycobacterium tuberculosis
SGNF

SEQ ID NO: 1540149 - protein, 4 aa, Mycobacterium tuberculosis
SGNN

SEQ ID NO: 1540150 - protein, 4 aa, Mycobacterium tuberculosis
SGYS

SEQ ID NO: 1540151 - protein, 4 aa, Mycobacterium tuberculosis
SNDG

SEQ ID NO: 1540152 - protein, 8 aa, Mycobacterium tuberculosis
SNVPSACR

SEQ ID NO: 1540153 - protein, 26 aa, Mycobacterium tuberculosis
SPKNPPTLSYQPAGCPDAKPSPPAAY

SEQ ID NO: 1540154 - protein, 19 aa, Mycobacterium tuberculosis
SSFGSVTSGLAGQSWQGAA

SEQ ID NO: 1540155 - protein, 4 aa, Mycobacterium tuberculosis
SSGC

SEQ ID NO: 1540156 - protein, 7 aa, Mycobacterium tuberculosis
STATGYG

SEQ ID NO: 1540157 - protein, 4 aa, Mycobacterium tuberculosis
STVS

SEQ ID NO: 1540158 - protein, 8 aa, Mycobacterium tuberculosis
SVTQTAAA

SEQ ID NO: 1540159 - protein, 5 aa, Mycobacterium tuberculosis
SYTYP

SEQ ID NO: 1540160 - protein, 13 aa, Mycobacterium tuberculosis
TAAADDKLPLGGG

SEQ ID NO: 1540161 - protein, 14 aa, Mycobacterium tuberculosis
TALERAEDPILNGS

SEQ ID NO: 1540162 - protein, 10 aa, Mycobacterium tuberculosis
TAPAPQGPWS

SEQ ID NO: 1540163 - protein, 35 aa, Mycobacterium tuberculosis; identical to SEQ ID NO: 155857

SEQ ID NO: 1540164 - protein, 6 aa, Mycobacterium tuberculosis
TDQGVY

SEQ ID NO: 1540165 - protein, 7 aa, Mycobacterium tuberculosis
TDQRDAL

SEQ ID NO: 1540166 - protein, 13 aa, Mycobacterium tuberculosis
TEAGGEPDARYEI

SEQ ID NO: 1540167 - protein, 5 aa, Mycobacterium tuberculosis
TGESL

SEQ ID NO: 1540168 - protein, 10 aa, Mycobacterium tuberculosis
TGPDSPNKTL

SEQ ID NO: 1540169 - protein, 8 aa, Mycobacterium tuberculosis
TGTGGASL

SEQ ID NO: 1540170 - protein, 5 aa, Mycobacterium tuberculosis
TKATG

SEQ ID NO: 1540171 - protein, 8 aa, Mycobacterium tuberculosis
TLTSRDQI

SEQ ID NO: 1540172 - protein, 4 aa, Mycobacterium tuberculosis
TQDV

SEQ ID NO: 1540173 - protein, 11 aa, Mycobacterium tuberculosis
TQISAAGSFGR

SEQ ID NO: 1540174 - protein, 4 aa, Mycobacterium tuberculosis
TSQL

SEQ ID NO: 1540175 - protein, 8 aa, Mycobacterium tuberculosis
TTGGHRAG

SEQ ID NO: 1540176 - protein, 10 aa, Mycobacterium tuberculosis
VADQGKRNVT

SEQ ID NO: 1540177 - protein, 8 aa, Mycobacterium tuberculosis
VAGRAPGA

SEQ ID NO: 1540178 - protein, 7 aa, Mycobacterium tuberculosis
VAPQQSW

SEQ ID NO: 1540179 - protein, 14 aa, Mycobacterium tuberculosis
VAPVGGTGGNGGRA

SEQ ID NO: 1540180 - protein, 18 aa, Mycobacterium tuberculosis
VEPEMPAPCPTQRPPVTP

SEQ ID NO: 1540181 - protein, 6 aa, Mycobacterium tuberculosis
VGYQQR

SEQ ID NO: 1540182 - protein, 6 aa, Mycobacterium tuberculosis
VNPADL

SEQ ID NO: 1540183 - protein, 14 aa, Mycobacterium tuberculosis
VQSPGAERLDDRRY

SEQ ID NO: 1540184 - protein, 10 aa, Mycobacterium tuberculosis
VSGAGNVGQQ

SEQ ID NO: 1540185 - protein, 8 aa, Mycobacterium tuberculosis
VSKDNGQT

SEQ ID NO: 1540186 - protein, 5 aa, Mycobacterium tuberculosis
VSQTS

SEQ ID NO: 1540187 - protein, 5 aa, Mycobacterium tuberculosis
VTEQE

SEQ ID NO: 1540188 - protein, 20 aa, Mycobacterium tuberculosis
VTSGDASNRYSGSPVRQPGF

SEQ ID NO: 1540189 - protein, 30 aa, Mycobacterium tuberculosis; identical to SEQ ID NO: 232515

SEQ ID NO: 1540190 - protein, 4 aa, Mycobacterium tuberculosis
YKTS

SEQ ID NO: 1540191 - protein, 11 aa, Mycobacterium tuberculosis
YSHPDQAIASG

SEQ ID NO: 1540192 - protein, 12 aa, Mycobacterium tuberculosis
YSYASAEAAAVT

SEQ ID NO: 1540193 - protein, 8 aa, Mycobacterium tuberculosis
AAAAKPKQ

SEQ ID NO: 1540194 - protein, 5 aa, Mycobacterium tuberculosis
AADAQ

SEQ ID NO: 1540195 - protein, 32 aa, Mycobacterium tuberculosis; identical to SEQ ID NO: 232535

SEQ ID NO: 1540196 - protein, 6 aa, Mycobacterium tuberculosis
AADREI

SEQ ID NO: 1540197 - protein, 7 aa, Mycobacterium tuberculosis
AAEPSWN

SEQ ID NO: 1540198 - protein, 7 aa, Mycobacterium tuberculosis
AAFGPNP

SEQ ID NO: 1540199 - protein, 11 aa, Mycobacterium tuberculosis
AAGAPPSCAGL

SEQ ID NO: 1540200 - protein, 5 aa, Mycobacterium tuberculosis
AAGEP

SEQ ID NO: 1540201 - protein, 10 aa, Mycobacterium tuberculosis
AAGGPTSAPI

SEQ ID NO: 1540202 - protein, 5 aa, Mycobacterium tuberculosis
AAGPV

SEQ ID NO: 1540203 - protein, 20 aa, Mycobacterium tuberculosis
AAHGGGEFAPSAQLASREQQ

SEQ ID NO: 1540204 - protein, 4 aa, Mycobacterium tuberculosis
AALS

SEQ ID NO: 1540205 - protein, 6 aa, Mycobacterium tuberculosis
AANTTT

SEQ ID NO: 1540206 - protein, 11 aa, Mycobacterium tuberculosis
AAPARPARTAD

SEQ ID NO: 1540207 - protein, 7 aa, Mycobacterium tuberculosis
AAPGQVD

SEQ ID NO: 1540208 - protein, 4 aa, Mycobacterium tuberculosis
AAQG

SEQ ID NO: 1540209 - protein, 6 aa, Mycobacterium tuberculosis
AAQSVE

SEQ ID NO: 1540210 - protein, 27 aa, Mycobacterium tuberculosis
AARGGWQTVSGSRRNAAYQDGRQTQIS

SEQ ID NO: 1540211 - protein, 5 aa, Mycobacterium tuberculosis
AARLG

SEQ ID NO: 1540212 - protein, 13 aa, Mycobacterium tuberculosis
AARSGDGPGGASV

SEQ ID NO: 1540213 - protein, 16 aa, Mycobacterium tuberculosis
AASAAPPSFGAGSSAV

SEQ ID NO: 1540214 - protein, 16 aa, Mycobacterium tuberculosis
AATRALSAAAQAKAAA

SEQ ID NO: 1540215 - protein, 8 aa, Mycobacterium tuberculosis
AAVTNTLA

SEQ ID NO: 1540216 - protein, 8 aa, Mycobacterium tuberculosis
ACSGSAAA

SEQ ID NO: 1540217 - protein, 5 aa, Mycobacterium tuberculosis
ADAAA

SEQ ID NO: 1540218 - protein, 27 aa, Mycobacterium tuberculosis
ADPDAAPGDPGGPGGPGGTAGPVDPPA

SEQ ID NO: 1540219 - protein, 6 aa, Mycobacterium tuberculosis
ADPNVS

SEQ ID NO: 1540220 - protein, 6 aa, Mycobacterium tuberculosis
ADQPYG

SEQ ID NO: 1540221 - protein, 8 aa, Mycobacterium tuberculosis
ADRAAHRD

SEQ ID NO: 1540222 - protein, 8 aa, Mycobacterium tuberculosis
ADRGAAEK

SEQ ID NO: 1540223 - protein, 8 aa, Mycobacterium tuberculosis
ADRTDAPV

SEQ ID NO: 1540224 - protein, 16 aa, Mycobacterium tuberculosis
ADTAGPDENISRGPDP

SEQ ID NO: 1540225 - protein, 11 aa, Mycobacterium tuberculosis
ADTLPGPLATA

SEQ ID NO: 1540226 - protein, 4 aa, Mycobacterium tuberculosis
ADTY

SEQ ID NO: 1540227 - protein, 7 aa, Mycobacterium tuberculosis
ADVENIG

SEQ ID NO: 1540228 - protein, 8 aa, Mycobacterium tuberculosis
ADVENIGS

SEQ ID NO: 1540229 - protein, 17 aa, Mycobacterium tuberculosis
ADVQPAGSVPIPDGPAQ

SEQ ID NO: 1540230 - protein, 5 aa, Mycobacterium tuberculosis
AEEFY

SEQ ID NO: 1540231 - protein, 10 aa, Mycobacterium tuberculosis
AEGTDNPHEA

SEQ ID NO: 1540232 - protein, 10 aa, Mycobacterium tuberculosis
AELPQTSTAA

SEQ ID NO: 1540233 - protein, 6 aa, Mycobacterium tuberculosis
AERRDY

SEQ ID NO: 1540234 - protein, 4 aa, Mycobacterium tuberculosis
AGAA

SEQ ID NO: 1540235 - protein, 8 aa, Mycobacterium tuberculosis
AGAGSNDV

SEQ ID NO: 1540236 - protein, 4 aa, Mycobacterium tuberculosis
AGAK

SEQ ID NO: 1540237 - protein, 4 aa, Mycobacterium tuberculosis
AGAP

SEQ ID NO: 1540238 - protein, 5 aa, Mycobacterium tuberculosis
AGDDV

SEQ ID NO: 1540239 - protein, 9 aa, Mycobacterium tuberculosis
AGDGPSRRF

SEQ ID NO: 1540240 - protein, 13 aa, Mycobacterium tuberculosis
AGDVQTAQHASEA

SEQ ID NO: 1540241 - protein, 27 aa, Mycobacterium tuberculosis
AGGAGGAGGTGLVGGDGGAGGAGGTGG

SEQ ID NO: 1540242 - protein, 27 aa, Mycobacterium tuberculosis
AGGGHGGTGGLSTNGDGGVGGAGGNAG

SEQ ID NO: 1540243 - protein, 14 aa, Mycobacterium tuberculosis
AGIGGAGGNGGNAG

SEQ ID NO: 1540244 - protein, 8 aa, Mycobacterium tuberculosis
AGKDYDEV

SEQ ID NO: 1540245 - protein, 5 aa, Mycobacterium tuberculosis
AGKYA

SEQ ID NO: 1540246 - protein, 6 aa, Mycobacterium tuberculosis
AGLPPL

SEQ ID NO: 1540247 - protein, 6 aa, Mycobacterium tuberculosis
AGLTQA

SEQ ID NO: 1540248 - protein, 28 aa, Mycobacterium tuberculosis
AGPGGAGGAGGDGENLDTGGDGGAGGSA

SEQ ID NO: 1540249 - protein, 13 aa, Mycobacterium tuberculosis
AGPGGAGGTGGRG

SEQ ID NO: 1540250 - protein, 6 aa, Mycobacterium tuberculosis
AGQRQQ

SEQ ID NO: 1540251 - protein, 6 aa, Mycobacterium tuberculosis
AGRGTR

SEQ ID NO: 1540252 - protein, 12 aa, Mycobacterium tuberculosis
AGRPGEPAPAVP

SEQ ID NO: 1540253 - protein, 10 aa, Mycobacterium tuberculosis
AGSGGFGGAG

SEQ ID NO: 1540254 - protein, 11 aa, Mycobacterium tuberculosis
AGSGGFGGAGG

SEQ ID NO: 1540255 - protein, 11 aa, Mycobacterium tuberculosis
AGTASASSTDE

SEQ ID NO: 1540256 - protein, 9 aa, Mycobacterium tuberculosis
AGTPVISDP

SEQ ID NO: 1540257 - protein, 20 aa, Mycobacterium tuberculosis
AGWSTAAPAMTSGTTALEGS

SEQ ID NO: 1540258 - protein, 20 aa, Mycobacterium tuberculosis
AGYRGTPGNPLTIAYRWDQG

SEQ ID NO: 1540259 - protein, 4 aa, Mycobacterium tuberculosis
AHAR

SEQ ID NO: 1540260 - protein, 19 aa, Mycobacterium tuberculosis
AHGGGEFAPSAQLASREQQ

SEQ ID NO: 1540261 - protein, 8 aa, Mycobacterium tuberculosis
AKNRDPIA

SEQ ID NO: 1540262 - protein, 9 aa, Mycobacterium tuberculosis
AKSAQFSAS

SEQ ID NO: 1540263 - protein, 5 aa, Mycobacterium tuberculosis
AKTNN

SEQ ID NO: 1540264 - protein, 8 aa, Mycobacterium tuberculosis
ALAGGDLS

SEQ ID NO: 1540265 - protein, 6 aa, Mycobacterium tuberculosis
ALDNPE

SEQ ID NO: 1540266 - protein, 4 aa, Mycobacterium tuberculosis
ALEN

SEQ ID NO: 1540267 - protein, 17 aa, Mycobacterium tuberculosis
ALPAPPPLPGPPPLPAL

SEQ ID NO: 1540268 - protein, 5 aa, Mycobacterium tuberculosis
ALPRR

SEQ ID NO: 1540269 - protein, 11 aa, Mycobacterium tuberculosis
ANAGSYNTGSF

SEQ ID NO: 1540270 - protein, 6 aa, Mycobacterium tuberculosis
ANLRSD

SEQ ID NO: 1540271 - protein, 4 aa, Mycobacterium tuberculosis
ANPS

SEQ ID NO: 1540272 - protein, 5 aa, Mycobacterium tuberculosis
ANPST

SEQ ID NO: 1540273 - protein, 7 aa, Mycobacterium tuberculosis
ANSAEKL

SEQ ID NO: 1540274 - protein, 8 aa, Mycobacterium tuberculosis
ANTGTNNL

SEQ ID NO: 1540275 - protein, 15 aa, Mycobacterium tuberculosis
APGFGNDTTAPSSGF

SEQ ID NO: 1540276 - protein, 4 aa, Mycobacterium tuberculosis
APMA

SEQ ID NO: 1540277 - protein, 8 aa, Mycobacterium tuberculosis
APNAGLDP

SEQ ID NO: 1540278 - protein, 4 aa, Mycobacterium tuberculosis
APPI

SEQ ID NO: 1540279 - protein, 28 aa, Mycobacterium tuberculosis
APPLAGATEEPGAGQTPGAPVVAPQQSW

SEQ ID NO: 1540280 - protein, 7 aa, Mycobacterium tuberculosis
APPPDPL

SEQ ID NO: 1540281 - protein, 10 aa, Mycobacterium tuberculosis
APSGASGKAW

SEQ ID NO: 1540282 - protein, 5 aa, Mycobacterium tuberculosis
APTQT

SEQ ID NO: 1540283 - protein, 12 aa, Mycobacterium tuberculosis
APTSAAGSNTAT

SEQ ID NO: 1540284 - protein, 13 aa, Mycobacterium tuberculosis
APVGGTGGNGGRA

SEQ ID NO: 1540285 - protein, 11 aa, Mycobacterium tuberculosis
AQAAVAQTGLT

SEQ ID NO: 1540286 - protein, 6 aa, Mycobacterium tuberculosis
AQGIGQ

SEQ ID NO: 1540287 - protein, 4 aa, Mycobacterium tuberculosis
AQGL

SEQ ID NO: 1540288 - protein, 8 aa, Mycobacterium tuberculosis
AQGQAKAI

SEQ ID NO: 1540289 - protein, 4 aa, Mycobacterium tuberculosis
ARAP

SEQ ID NO: 1540290 - protein, 4 aa, Mycobacterium tuberculosis
ARDL

SEQ ID NO: 1540291 - protein, 5 aa, Mycobacterium tuberculosis
AREGA

SEQ ID NO: 1540292 - protein, 6 aa, Mycobacterium tuberculosis
ARGADV

SEQ ID NO: 1540293 - protein, 4 aa, Mycobacterium tuberculosis
ARLK

SEQ ID NO: 1540294 - protein, 25 aa, Mycobacterium tuberculosis
ARPAATPATTSVPTYTAAQTAAAQR

SEQ ID NO: 1540295 - protein, 33 aa, Mycobacterium tuberculosis; identical to SEQ ID NO: 229178

SEQ ID NO: 1540296 - protein, 13 aa, Mycobacterium tuberculosis
ASAGVQHARRGSE

SEQ ID NO: 1540297 - protein, 5 aa, Mycobacterium tuberculosis
ASDDR

SEQ ID NO: 1540298 - protein, 6 aa, Mycobacterium tuberculosis
ASDLGG

SEQ ID NO: 1540299 - protein, 11 aa, Mycobacterium tuberculosis
ASGAHRPTPTI

SEQ ID NO: 1540300 - protein, 7 aa, Mycobacterium tuberculosis
ASGTAIT

SEQ ID NO: 1540301 - protein, 7 aa, Mycobacterium tuberculosis
ASKFGRE

SEQ ID NO: 1540302 - protein, 40 aa, Mycobacterium tuberculosis; identical to SEQ ID NO: 170076

SEQ ID NO: 1540303 - protein, 16 aa, Mycobacterium tuberculosis
ASQSDAPVGAPRQFRS

SEQ ID NO: 1540304 - protein, 8 aa, Mycobacterium tuberculosis
ASSGLGAG

SEQ ID NO: 1540305 - protein, 6 aa, Mycobacterium tuberculosis
ASSQDV

SEQ ID NO: 1540306 - protein, 16 aa, Mycobacterium tuberculosis
ASTRSAVNSGSDLRAS

SEQ ID NO: 1540307 - protein, 27 aa, Mycobacterium tuberculosis
ASVAGSQQADGVATTKITGNSSADDIA

SEQ ID NO: 1540308 - protein, 7 aa, Mycobacterium tuberculosis
ATAAPKT

SEQ ID NO: 1540309 - protein, 6 aa, Mycobacterium tuberculosis
ATAATE

SEQ ID NO: 1540310 - protein, 12 aa, Mycobacterium tuberculosis
ATGGLGGDGGDA

SEQ ID NO: 1540311 - protein, 6 aa, Mycobacterium tuberculosis
ATGTTA

SEQ ID NO: 1540312 - protein, 7 aa, Mycobacterium tuberculosis
ATLAPNA

SEQ ID NO: 1540313 - protein, 7 aa, Mycobacterium tuberculosis
ATQESEM

SEQ ID NO: 1540314 - protein, 12 aa, Mycobacterium tuberculosis
ATSGERADPQAV

SEQ ID NO: 1540315 - protein, 17 aa, Mycobacterium tuberculosis
ATSRSHRASTSRGQRET

SEQ ID NO: 1540316 - protein, 5 aa, Mycobacterium tuberculosis
ATYGR

SEQ ID NO: 1540317 - protein, 7 aa, Mycobacterium tuberculosis
AWNDDGS

SEQ ID NO: 1540318 - protein, 5 aa, Mycobacterium tuberculosis
AYPDD

SEQ ID NO: 1540319 - protein, 7 aa, Mycobacterium tuberculosis
AYRDGTL

SEQ ID NO: 1540320 - protein, 4 aa, Mycobacterium tuberculosis
CNDP

SEQ ID NO: 1540321 - protein, 40 aa, Mycobacterium tuberculosis; identical to SEQ ID NO: 1437698

SEQ ID NO: 1540322 - protein, 24 aa, Mycobacterium tuberculosis
CSDSGDNKPGATIPSTPANAEGRH

SEQ ID NO: 1540323 - protein, 13 aa, Mycobacterium tuberculosis
DAAGTKSSFRTGD

SEQ ID NO: 1540324 - protein, 8 aa, Mycobacterium tuberculosis
DADGVSVP

SEQ ID NO: 1540325 - protein, 6 aa, Mycobacterium tuberculosis
DADRDA

SEQ ID NO: 1540326 - protein, 5 aa, Mycobacterium tuberculosis
DAGSH

SEQ ID NO: 1540327 - protein, 8 aa, Mycobacterium tuberculosis
DAKSPYEY

SEQ ID NO: 1540328 - protein, 4 aa, Mycobacterium tuberculosis
DAPI

SEQ ID NO: 1540329 - protein, 4 aa, Mycobacterium tuberculosis
DAPS

SEQ ID NO: 1540330 - protein, 4 aa, Mycobacterium tuberculosis
DARD

SEQ ID NO: 1540331 - protein, 7 aa, Mycobacterium tuberculosis
DATTGTI

SEQ ID NO: 1540332 - protein, 7 aa, Mycobacterium tuberculosis
DDNSAAV

SEQ ID NO: 1540333 - protein, 7 aa, Mycobacterium tuberculosis
DDPLSEE

SEQ ID NO: 1540334 - protein, 9 aa, Mycobacterium tuberculosis
DDVAGSDSA

SEQ ID NO: 1540335 - protein, 7 aa, Mycobacterium tuberculosis
DEPFDQF

SEQ ID NO: 1540336 - protein, 8 aa, Mycobacterium tuberculosis
DESGTTDN

SEQ ID NO: 1540337 - protein, 5 aa, Mycobacterium tuberculosis
DFGPA

SEQ ID NO: 1540338 - protein, 33 aa, Mycobacterium tuberculosis; identical to SEQ ID NO: 229388

SEQ ID NO: 1540339 - protein, 23 aa, Mycobacterium tuberculosis
DGGAGGSGAAGSGAPGGAGGAAG

SEQ ID NO: 1540340 - protein, 4 aa, Mycobacterium tuberculosis
DGKT

SEQ ID NO: 1540341 - protein, 6 aa, Mycobacterium tuberculosis
DGSKTY

SEQ ID NO: 1540342 - protein, 5 aa, Mycobacterium tuberculosis
DGTTL

SEQ ID NO: 1540343 - protein, 4 aa, Mycobacterium tuberculosis
DGVT

SEQ ID NO: 1540344 - protein, 6 aa, Mycobacterium tuberculosis
DHDLAD

SEQ ID NO: 1540345 - protein, 5 aa, Mycobacterium tuberculosis
DIGPE

SEQ ID NO: 1540346 - protein, 6 aa, Mycobacterium tuberculosis
DNAPIA

SEQ ID NO: 1540347 - protein, 10 aa, Mycobacterium tuberculosis
DNLRGQGATI

SEQ ID NO: 1540348 - protein, 14 aa, Mycobacterium tuberculosis
DNTTITGSATSGGF

SEQ ID NO: 1540349 - protein, 13 aa, Mycobacterium tuberculosis
DPASGQPARIPVD

SEQ ID NO: 1540350 - protein, 24 aa, Mycobacterium tuberculosis
DPDAARRVAKRSDAARARGDELGP

SEQ ID NO: 1540351 - protein, 5 aa, Mycobacterium tuberculosis
DPDDF

SEQ ID NO: 1540352 - protein, 5 aa, Mycobacterium tuberculosis
DPGYA

SEQ ID NO: 1540353 - protein, 7 aa, Mycobacterium tuberculosis
DPSANPY

SEQ ID NO: 1540354 - protein, 4 aa, Mycobacterium tuberculosis
DPVG

SEQ ID NO: 1540355 - protein, 8 aa, Mycobacterium tuberculosis
DQKDNLND

SEQ ID NO: 1540356 - protein, 9 aa, Mycobacterium tuberculosis
DQPGRSTTD

SEQ ID NO: 1540357 - protein, 4 aa, Mycobacterium tuberculosis
DQQP

SEQ ID NO: 1540358 - protein, 4 aa, Mycobacterium tuberculosis
DQTY

SEQ ID NO: 1540359 - protein, 4 aa, Mycobacterium tuberculosis
DRNN

SEQ ID NO: 1540360 - protein, 4 aa, Mycobacterium tuberculosis
DRSA

SEQ ID NO: 1540361 - protein, 6 aa, Mycobacterium tuberculosis
DSGTFT

SEQ ID NO: 1540362 - protein, 12 aa, Mycobacterium tuberculosis
DSICGDGNSPVA

SEQ ID NO: 1540363 - protein, 9 aa, Mycobacterium tuberculosis
DSTSGFQNI

SEQ ID NO: 1540364 - protein, 7 aa, Mycobacterium tuberculosis
DSYETAG

SEQ ID NO: 1540365 - protein, 11 aa, Mycobacterium tuberculosis
DTAATPSAAGV

SEQ ID NO: 1540366 - protein, 11 aa, Mycobacterium tuberculosis
DTAWQGPAATA

SEQ ID NO: 1540367 - protein, 4 aa, Mycobacterium tuberculosis
DTEN

SEQ ID NO: 1540368 - protein, 4 aa, Mycobacterium tuberculosis
DTSP

SEQ ID NO: 1540369 - protein, 9 aa, Mycobacterium tuberculosis
DVDDVRDGA

SEQ ID NO: 1540370 - protein, 4 aa, Mycobacterium tuberculosis
DVGG

SEQ ID NO: 1540371 - protein, 8 aa, Mycobacterium tuberculosis
DVTGDIGP

SEQ ID NO: 1540372 - protein, 13 aa, Mycobacterium tuberculosis
EAAAEQQVQGQQA

SEQ ID NO: 1540373 - protein, 12 aa, Mycobacterium tuberculosis
EAFDDQGNYRNQ

SEQ ID NO: 1540374 - protein, 12 aa, Mycobacterium tuberculosis
EAIGTASDKLAS

SEQ ID NO: 1540375 - protein, 10 aa, Mycobacterium tuberculosis
EALGRSGTIA

SEQ ID NO: 1540376 - protein, 4 aa, Mycobacterium tuberculosis
EAMG

SEQ ID NO: 1540377 - protein, 13 aa, Mycobacterium tuberculosis
EASGSAGKVTVSP

SEQ ID NO: 1540378 - protein, 5 aa, Mycobacterium tuberculosis
EATGR

SEQ ID NO: 1540379 - protein, 6 aa, Mycobacterium tuberculosis
EATHRR

SEQ ID NO: 1540380 - protein, 13 aa, Mycobacterium tuberculosis
EETDNAEDKPETL

SEQ ID NO: 1540381 - protein, 5 aa, Mycobacterium tuberculosis
EGFET

SEQ ID NO: 1540382 - protein, 28 aa, Mycobacterium tuberculosis
EGPPLGRNPQGAPAPVGGTVIVAPMHSG

SEQ ID NO: 1540383 - protein, 7 aa, Mycobacterium tuberculosis
ENQATDR

SEQ ID NO: 1540384 - protein, 9 aa, Mycobacterium tuberculosis
ENTEGIERR

SEQ ID NO: 1540385 - protein, 7 aa, Mycobacterium tuberculosis
EPDNPAR

SEQ ID NO: 1540386 - protein, 15 aa, Mycobacterium tuberculosis
EPLSGQFDDDGAVSA

SEQ ID NO: 1540387 - protein, 12 aa, Mycobacterium tuberculosis
EPRGAQALPPGG

SEQ ID NO: 1540388 - protein, 7 aa, Mycobacterium tuberculosis
EPTPAER

SEQ ID NO: 1540389 - protein, 5 aa, Mycobacterium tuberculosis
EQDRL

SEQ ID NO: 1540390 - protein, 6 aa, Mycobacterium tuberculosis
EQSGTA

SEQ ID NO: 1540391 - protein, 9 aa, Mycobacterium tuberculosis
ESIDDPAGV

SEQ ID NO: 1540392 - protein, 4 aa, Mycobacterium tuberculosis
ESIG

SEQ ID NO: 1540393 - protein, 8 aa, Mycobacterium tuberculosis
ETLTGTHT

SEQ ID NO: 1540394 - protein, 18 aa, Mycobacterium tuberculosis
EVPQSRSVDVSDDPSGFR

SEQ ID NO: 1540395 - protein, 8 aa, Mycobacterium tuberculosis
EVSTRTPV

SEQ ID NO: 1540396 - protein, 5 aa, Mycobacterium tuberculosis
EYAPA

SEQ ID NO: 1540397 - protein, 8 aa, Mycobacterium tuberculosis
FGAGSSGW

SEQ ID NO: 1540398 - protein, 32 aa, Mycobacterium tuberculosis
FGNGGAGGAGYSPAAGTGAAGGAGGAGGAGGW

SEQ ID NO: 1540399 - protein, 10 aa, Mycobacterium tuberculosis
FNAPASASPL

SEQ ID NO: 1540400 - protein, 10 aa, Mycobacterium tuberculosis
FQAGDDPVAN

SEQ ID NO: 1540401 - protein, 25 aa, Mycobacterium tuberculosis
FRPNNSVPGDPPQPLGAPNYSQIRD

SEQ ID NO: 1540402 - protein, 4 aa, Mycobacterium tuberculosis
GADA

SEQ ID NO: 1540403 - protein, 18 aa, Mycobacterium tuberculosis
GADAPSPFGGGAAAEIAA

SEQ ID NO: 1540404 - protein, 5 aa, Mycobacterium tuberculosis
GAERL

SEQ ID NO: 1540405 - protein, 5 aa, Mycobacterium tuberculosis
GAESE

SEQ ID NO: 1540406 - protein, 8 aa, Mycobacterium tuberculosis
GAGAGMPG

SEQ ID NO: 1540407 - protein, 38 aa, Mycobacterium tuberculosis; identical to SEQ ID NO: 229723

SEQ ID NO: 1540408 - protein, 6 aa, Mycobacterium tuberculosis
GAIGPT

SEQ ID NO: 1540409 - protein, 4 aa, Mycobacterium tuberculosis
GALA

SEQ ID NO: 1540410 - protein, 14 aa, Mycobacterium tuberculosis
GAPSWTADYGSETL

SEQ ID NO: 1540411 - protein, 10 aa, Mycobacterium tuberculosis
GAQSAAAALP

SEQ ID NO: 1540412 - protein, 11 aa, Mycobacterium tuberculosis
GAQSAAQTAPV

SEQ ID NO: 1540413 - protein, 7 aa, Mycobacterium tuberculosis
GAREDLP

SEQ ID NO: 1540414 - protein, 20 aa, Mycobacterium tuberculosis
GCGAGQISQTANQKPAVNGN

SEQ ID NO: 1540415 - protein, 4 aa, Mycobacterium tuberculosis
GCPD

SEQ ID NO: 1540416 - protein, 22 aa, Mycobacterium tuberculosis
GCSGSSHSGRTYGAQSARTGES

SEQ ID NO: 1540417 - protein, 6 aa, Mycobacterium tuberculosis
GDDPYG

SEQ ID NO: 1540418 - protein, 5 aa, Mycobacterium tuberculosis
GDDTV

SEQ ID NO: 1540419 - protein, 9 aa, Mycobacterium tuberculosis
GDEEATNTD

SEQ ID NO: 1540420 - protein, 9 aa, Mycobacterium tuberculosis
GDGGAGGNA

SEQ ID NO: 1540421 - protein, 20 aa, Mycobacterium tuberculosis
GDGNLGSGNVGSTNLGSGNF

SEQ ID NO: 1540422 - protein, 17 aa, Mycobacterium tuberculosis
GDQYNAGRHVPPAEAKR

SEQ ID NO: 1540423 - protein, 41 aa, Mycobacterium tuberculosis; identical to SEQ ID NO: 194109

SEQ ID NO: 1540424 - protein, 4 aa, Mycobacterium tuberculosis
GETV

SEQ ID NO: 1540425 - protein, 7 aa, Mycobacterium tuberculosis
GFDNAQR

SEQ ID NO: 1540426 - protein, 6 aa, Mycobacterium tuberculosis
GFDPKV

SEQ ID NO: 1540427 - protein, 8 aa, Mycobacterium tuberculosis
GGAAPGGF

SEQ ID NO: 1540428 - protein, 11 aa, Mycobacterium tuberculosis
GGAGGAGGDGG

SEQ ID NO: 1540429 - protein, 25 aa, Mycobacterium tuberculosis
GGAGGAGGIGSADGGLGGGGGNGRF

SEQ ID NO: 1540430 - protein, 10 aa, Mycobacterium tuberculosis
GGAGGIGGAS

SEQ ID NO: 1540431 - protein, 17 aa, Mycobacterium tuberculosis
GGAGGTGGNGGSGFNSL

SEQ ID NO: 1540432 - protein, 53 aa, Mycobacterium tuberculosis; identical to SEQ ID NO: 232723

SEQ ID NO: 1540433 - protein, 12 aa, Mycobacterium tuberculosis
GGITADSDPDAE

SEQ ID NO: 1540434 - protein, 44 aa, Mycobacterium tuberculosis; identical to SEQ ID NO: 1444122

SEQ ID NO: 1540435 - protein, 12 aa, Mycobacterium tuberculosis
GGNGGVGGTSVA

SEQ ID NO: 1540436 - protein, 8 aa, Mycobacterium tuberculosis
GGQNPQGP

SEQ ID NO: 1540437 - protein, 14 aa, Mycobacterium tuberculosis
GGQPDPSKGRCAFA

SEQ ID NO: 1540438 - protein, 4 aa, Mycobacterium tuberculosis
GGQT

SEQ ID NO: 1540439 - protein, 5 aa, Mycobacterium tuberculosis
GGSDI

SEQ ID NO: 1540440 - protein, 5 aa, Mycobacterium tuberculosis
GGSDV

SEQ ID NO: 1540441 - protein, 17 aa, Mycobacterium tuberculosis
GGSGGAGTNGGVGGSGG

SEQ ID NO: 1540442 - protein, 7 aa, Mycobacterium tuberculosis
GGSGTLG

SEQ ID NO: 1540443 - protein, 24 aa, Mycobacterium tuberculosis
GGTGGSGGAGLGGDGGAGGAGGNA

SEQ ID NO: 1540444 - protein, 9 aa, Mycobacterium tuberculosis
GGTPRKRRD

SEQ ID NO: 1540445 - protein, 5 aa, Mycobacterium tuberculosis
GGTTV

SEQ ID NO: 1540446 - protein, 24 aa, Mycobacterium tuberculosis
GGVGGFSNGGATGGAGGAGGAGGL

SEQ ID NO: 1540447 - protein, 43 aa, Mycobacterium tuberculosis; identical to SEQ ID NO: 229908

SEQ ID NO: 1540448 - protein, 10 aa, Mycobacterium tuberculosis
GHGNSTTIGA

SEQ ID NO: 1540449 - protein, 5 aa, Mycobacterium tuberculosis
GHTSG

SEQ ID NO: 1540450 - protein, 25 aa, Mycobacterium tuberculosis
GIGGPGGASSIPGMSGGAGGTGGAA

SEQ ID NO: 1540451 - protein, 6 aa, Mycobacterium tuberculosis
GKADTV

SEQ ID NO: 1540452 - protein, 7 aa, Mycobacterium tuberculosis
GKDYDEV

SEQ ID NO: 1540453 - protein, 16 aa, Mycobacterium tuberculosis
GKTAQDTSFDGRSDYD

SEQ ID NO: 1540454 - protein, 8 aa, Mycobacterium tuberculosis
GLASGNCY

SEQ ID NO: 1540455 - protein, 11 aa, Mycobacterium tuberculosis
GLDPGADGTYP

SEQ ID NO: 1540456 - protein, 11 aa, Mycobacterium tuberculosis
GLGGAGGAAGQ

SEQ ID NO: 1540457 - protein, 6 aa, Mycobacterium tuberculosis
GLGGKF

SEQ ID NO: 1540458 - protein, 4 aa, Mycobacterium tuberculosis
GLPG

SEQ ID NO: 1540459 - protein, 17 aa, Mycobacterium tuberculosis
GLPPGSDYRNRAPKMSP

SEQ ID NO: 1540460 - protein, 9 aa, Mycobacterium tuberculosis
GNAGSGNVG

SEQ ID NO: 1540461 - protein, 16 aa, Mycobacterium tuberculosis
GNANTGVANSGNVDTG

SEQ ID NO: 1540462 - protein, 14 aa, Mycobacterium tuberculosis
GNDALDSLAQPYVI

SEQ ID NO: 1540463 - protein, 39 aa, Mycobacterium tuberculosis; identical to SEQ ID NO: 1444473

SEQ ID NO: 1540464 - protein, 21 aa, Mycobacterium tuberculosis
GNGGNGGSGAAGQAGGAGGAA

SEQ ID NO: 1540465 - protein, 18 aa, Mycobacterium tuberculosis
GNGTPGAVGSGATGAPGG

SEQ ID NO: 1540466 - protein, 5 aa, Mycobacterium tuberculosis
GNKAS

SEQ ID NO: 1540467 - protein, 7 aa, Mycobacterium tuberculosis
GNTGTNN

SEQ ID NO: 1540468 - protein, 5 aa, Mycobacterium tuberculosis
GNTVE

SEQ ID NO: 1540469 - protein, 11 aa, Mycobacterium tuberculosis
GPAAADPNQDD

SEQ ID NO: 1540470 - protein, 32 aa, Mycobacterium tuberculosis; identical to SEQ ID NO: 1423575

SEQ ID NO: 1540471 - protein, 5 aa, Mycobacterium tuberculosis
GPTQA

SEQ ID NO: 1540472 - protein, 11 aa, Mycobacterium tuberculosis
GPVPAAAPVPI

SEQ ID NO: 1540473 - protein, 6 aa, Mycobacterium tuberculosis
GQGGPL

SEQ ID NO: 1540474 - protein, 6 aa, Mycobacterium tuberculosis
GQGPTI

SEQ ID NO: 1540475 - protein, 5 aa, Mycobacterium tuberculosis
GQHGH

SEQ ID NO: 1540476 - protein, 15 aa, Mycobacterium tuberculosis
GQHTTRTAASTTYTP

SEQ ID NO: 1540477 - protein, 10 aa, Mycobacterium tuberculosis
GQLVSNGNTQ

SEQ ID NO: 1540478 - protein, 12 aa, Mycobacterium tuberculosis
GQPEFRQHSEHR

SEQ ID NO: 1540479 - protein, 15 aa, Mycobacterium tuberculosis
GRDPRGGNVDTTINP

SEQ ID NO: 1540480 - protein, 5 aa, Mycobacterium tuberculosis
GRPLI

SEQ ID NO: 1540481 - protein, 15 aa, Mycobacterium tuberculosis
GSDSLGDSDVSARPA

SEQ ID NO: 1540482 - protein, 5 aa, Mycobacterium tuberculosis
GSGDP

SEQ ID NO: 1540483 - protein, 84 aa, Mycobacterium tuberculosis; identical to SEQ ID NO: 232768

SEQ ID NO: 1540484 - protein, 21 aa, Mycobacterium tuberculosis
GSGGVGGAGGLGGPTDGTVQG

SEQ ID NO: 1540485 - protein, 8 aa, Mycobacterium tuberculosis
GSGRGPAP

SEQ ID NO: 1540486 - protein, 7 aa, Mycobacterium tuberculosis
GSPKQVA

SEQ ID NO: 1540487 - protein, 16 aa, Mycobacterium tuberculosis
GSTGEFKDKYGKSSAH

SEQ ID NO: 1540488 - protein, 6 aa, Mycobacterium tuberculosis
GSVTPA

SEQ ID NO: 1540489 - protein, 5 aa, Mycobacterium tuberculosis
GTEGP

SEQ ID NO: 1540490 - protein, 9 aa, Mycobacterium tuberculosis
GTGEPPGLG

SEQ ID NO: 1540491 - protein, 25 aa, Mycobacterium tuberculosis
GTGGAGGAGGSSAGGGGAGGAGGAG

SEQ ID NO: 1540492 - protein, 11 aa, Mycobacterium tuberculosis
GTGYGAPPFDG

SEQ ID NO: 1540493 - protein, 11 aa, Mycobacterium tuberculosis
GTPAALGADAA

SEQ ID NO: 1540494 - protein, 5 aa, Mycobacterium tuberculosis
GTPME

SEQ ID NO: 1540495 - protein, 10 aa, Mycobacterium tuberculosis
GTRALGRGPA

SEQ ID NO: 1540496 - protein, 6 aa, Mycobacterium tuberculosis
GTTYAA

SEQ ID NO: 1540497 - protein, 6 aa, Mycobacterium tuberculosis
GVETGR

SEQ ID NO: 1540498 - protein, 13 aa, Mycobacterium tuberculosis
GVETHPPNRHESA

SEQ ID NO: 1540499 - protein, 7 aa, Mycobacterium tuberculosis
GVETRTG

SEQ ID NO: 1540500 - protein, 25 aa, Mycobacterium tuberculosis
GVGGAGGFTNGSALGGAGGAGGAGG

SEQ ID NO: 1540501 - protein, 12 aa, Mycobacterium tuberculosis
GVSGPGGDGRTV

SEQ ID NO: 1540502 - protein, 7 aa, Mycobacterium tuberculosis
GWSDDGM

SEQ ID NO: 1540503 - protein, 7 aa, Mycobacterium tuberculosis
GYSQGAA

SEQ ID NO: 1540504 - protein, 6 aa, Mycobacterium tuberculosis
HDKNGD

SEQ ID NO: 1540505 - protein, 5 aa, Mycobacterium tuberculosis
HDLAD

SEQ ID NO: 1540506 - protein, 5 aa, Mycobacterium tuberculosis
HEPSD

SEQ ID NO: 1540507 - protein, 4 aa, Mycobacterium tuberculosis
HETD

SEQ ID NO: 1540508 - protein, 5 aa, Mycobacterium tuberculosis
HETDR

SEQ ID NO: 1540509 - protein, 41 aa, Mycobacterium tuberculosis; identical to SEQ ID NO: 232169

SEQ ID NO: 1540510 - protein, 26 aa, Mycobacterium tuberculosis
HGNAGGVNVGSGNAGLANTGDFNSGG

SEQ ID NO: 1540511 - protein, 15 aa, Mycobacterium tuberculosis
HIGGNAYSEAEPQTG

SEQ ID NO: 1540512 - protein, 10 aa, Mycobacterium tuberculosis
HPGQSSAAER

SEQ ID NO: 1540513 - protein, 12 aa, Mycobacterium tuberculosis
HPRGEAANALGA

SEQ ID NO: 1540514 - protein, 10 aa, Mycobacterium tuberculosis
HQPPTPASGC

SEQ ID NO: 1540515 - protein, 7 aa, Mycobacterium tuberculosis
HQTGPAA

SEQ ID NO: 1540516 - protein, 19 aa, Mycobacterium tuberculosis
HRAAGAGRRQRRRRSGDGQ

SEQ ID NO: 1540517 - protein, 5 aa, Mycobacterium tuberculosis
HRKGD

SEQ ID NO: 1540518 - protein, 5 aa, Mycobacterium tuberculosis
HSETL

SEQ ID NO: 1540519 - protein, 6 aa, Mycobacterium tuberculosis
IESADN

SEQ ID NO: 1540520 - protein, 12 aa, Mycobacterium tuberculosis
IGAGQSGLGDNG

SEQ ID NO: 1540521 - protein, 7 aa, Mycobacterium tuberculosis
IGPSAQR

SEQ ID NO: 1540522 - protein, 6 aa, Mycobacterium tuberculosis
IKDPDE

SEQ ID NO: 1540523 - protein, 4 aa, Mycobacterium tuberculosis
INTI

SEQ ID NO: 1540524 - protein, 12 aa, Mycobacterium tuberculosis
IPGSAGATPVQN

SEQ ID NO: 1540525 - protein, 21 aa, Mycobacterium tuberculosis
IQPTTVNSRRSRTPALDAGRE

SEQ ID NO: 1540526 - protein, 6 aa, Mycobacterium tuberculosis
IQPVSG

SEQ ID NO: 1540527 - protein, 7 aa, Mycobacterium tuberculosis
ITGSGDD

SEQ ID NO: 1540528 - protein, 5 aa, Mycobacterium tuberculosis
KALGH

SEQ ID NO: 1540529 - protein, 7 aa, Mycobacterium tuberculosis
KARKTSL

SEQ ID NO: 1540530 - protein, 8 aa, Mycobacterium tuberculosis
KASSQDVL

SEQ ID NO: 1540531 - protein, 16 aa, Mycobacterium tuberculosis
KEDTAARRGRPSTDHS

SEQ ID NO: 1540532 - protein, 9 aa, Mycobacterium tuberculosis
KGDKGEPCW

SEQ ID NO: 1540533 - protein, 7 aa, Mycobacterium tuberculosis
KLPPGGT

SEQ ID NO: 1540534 - protein, 8 aa, Mycobacterium tuberculosis
KLSEERKV

SEQ ID NO: 1540535 - protein, 6 aa, Mycobacterium tuberculosis
KNAINA

SEQ ID NO: 1540536 - protein, 9 aa, Mycobacterium tuberculosis
KPGRSHDEV

SEQ ID NO: 1540537 - protein, 6 aa, Mycobacterium tuberculosis
KPNVEL

SEQ ID NO: 1540538 - protein, 5 aa, Mycobacterium tuberculosis
KPTVS

SEQ ID NO: 1540539 - protein, 7 aa, Mycobacterium tuberculosis
KRGGGAI

SEQ ID NO: 1540540 - protein, 7 aa, Mycobacterium tuberculosis
KRPATGW

SEQ ID NO: 1540541 - protein, 10 aa, Mycobacterium tuberculosis
KSITAYTPGQ

SEQ ID NO: 1540542 - protein, 16 aa, Mycobacterium tuberculosis
KSLSDGALRGPGEVSA

SEQ ID NO: 1540543 - protein, 7 aa, Mycobacterium tuberculosis
KSTPAMT

SEQ ID NO: 1540544 - protein, 4 aa, Mycobacterium tuberculosis
KTIG

SEQ ID NO: 1540545 - protein, 5 aa, Mycobacterium tuberculosis
KTNSS

SEQ ID NO: 1540546 - protein, 6 aa, Mycobacterium tuberculosis
KTPPEL

SEQ ID NO: 1540547 - protein, 7 aa, Mycobacterium tuberculosis
KTTRHRA

SEQ ID NO: 1540548 - protein, 6 aa, Mycobacterium tuberculosis
LADATT

SEQ ID NO: 1540549 - protein, 7 aa, Mycobacterium tuberculosis
LAGIGGN

SEQ ID NO: 1540550 - protein, 22 aa, Mycobacterium tuberculosis
LATRDARAKDTYEKIGVHVVVA

SEQ ID NO: 1540551 - protein, 16 aa, Mycobacterium tuberculosis
LDAPPSALRASAKEVA

SEQ ID NO: 1540552 - protein, 8 aa, Mycobacterium tuberculosis
LDDGESDL

SEQ ID NO: 1540553 - protein, 7 aa, Mycobacterium tuberculosis
LDERDNQ

SEQ ID NO: 1540554 - protein, 5 aa, Mycobacterium tuberculosis
LDGPT

SEQ ID NO: 1540555 - protein, 11 aa, Mycobacterium tuberculosis
LDNGDLDRTHR

SEQ ID NO: 1540556 - protein, 8 aa, Mycobacterium tuberculosis
LDPSSDRM

SEQ ID NO: 1540557 - protein, 12 aa, Mycobacterium tuberculosis
LEGQNGENGLLP

SEQ ID NO: 1540558 - protein, 5 aa, Mycobacterium tuberculosis
LETAD

SEQ ID NO: 1540559 - protein, 18 aa, Mycobacterium tuberculosis
LGAPTSPEADAADGARYA

SEQ ID NO: 1540560 - protein, 4 aa, Mycobacterium tuberculosis
LGDH

SEQ ID NO: 1540561 - protein, 8 aa, Mycobacterium tuberculosis
LGGDGGDI

SEQ ID NO: 1540562 - protein, 15 aa, Mycobacterium tuberculosis
LGGGNTGNANLGGGN

SEQ ID NO: 1540563 - protein, 7 aa, Mycobacterium tuberculosis
LGGPNGV

SEQ ID NO: 1540564 - protein, 7 aa, Mycobacterium tuberculosis
LGGRELG

SEQ ID NO: 1540565 - protein, 31 aa, Mycobacterium tuberculosis
LGNGGDGGAGGAGGPAGLALPPGPARPAGAA

SEQ ID NO: 1540566 - protein, 10 aa, Mycobacterium tuberculosis
LGRKGTQDGG

SEQ ID NO: 1540567 - protein, 5 aa, Mycobacterium tuberculosis
LGRNS

SEQ ID NO: 1540568 - protein, 5 aa, Mycobacterium tuberculosis
LNPDH

SEQ ID NO: 1540569 - protein, 10 aa, Mycobacterium tuberculosis
LNPGPRSTDP

SEQ ID NO: 1540570 - protein, 12 aa, Mycobacterium tuberculosis
LPAGAKITRTTT

SEQ ID NO: 1540571 - protein, 15 aa, Mycobacterium tuberculosis
LPAPPPLPGPPPLPA

SEQ ID NO: 1540572 - protein, 10 aa, Mycobacterium tuberculosis
LPASQDVPAD

SEQ ID NO: 1540573 - protein, 6 aa, Mycobacterium tuberculosis
LPASTI

SEQ ID NO: 1540574 - protein, 21 aa, Mycobacterium tuberculosis
LPATNGPSGARPDAPAASGTV

SEQ ID NO: 1540575 - protein, 26 aa, Mycobacterium tuberculosis
LPDGTPVSSGEGGGVRVGGGGAYQPK

SEQ ID NO: 1540576 - protein, 14 aa, Mycobacterium tuberculosis
LPEAPANRATVPQD

SEQ ID NO: 1540577 - protein, 6 aa, Mycobacterium tuberculosis
LPGQLN

SEQ ID NO: 1540578 - protein, 7 aa, Mycobacterium tuberculosis
LPGVSPT

SEQ ID NO: 1540579 - protein, 7 aa, Mycobacterium tuberculosis
LPRSSGQ

SEQ ID NO: 1540580 - protein, 11 aa, Mycobacterium tuberculosis
LQPTGGASGLS

SEQ ID NO: 1540581 - protein, 7 aa, Mycobacterium tuberculosis
LRSEKRD

SEQ ID NO: 1540582 - protein, 12 aa, Mycobacterium tuberculosis
LSAANAAAAAPT

SEQ ID NO: 1540583 - protein, 8 aa, Mycobacterium tuberculosis
LSAPAGRL

SEQ ID NO: 1540584 - protein, 7 aa, Mycobacterium tuberculosis
LSQGGQG

SEQ ID NO: 1540585 - protein, 10 aa, Mycobacterium tuberculosis
LSRGNDNALG

SEQ ID NO: 1540586 - protein, 4 aa, Mycobacterium tuberculosis
LSST

SEQ ID NO: 1540587 - protein, 10 aa, Mycobacterium tuberculosis
LTGPAPVTNA

SEQ ID NO: 1540588 - protein, 5 aa, Mycobacterium tuberculosis
MSPAE

SEQ ID NO: 1540589 - protein, 5 aa, Mycobacterium tuberculosis
MTPRA

SEQ ID NO: 1540590 - protein, 10 aa, Mycobacterium tuberculosis
MTSGSSSGFK

SEQ ID NO: 1540591 - protein, 29 aa, Mycobacterium tuberculosis
MTTLPGGDAPAAGVPGLPGMPASGAGRAG

SEQ ID NO: 1540592 - protein, 26 aa, Mycobacterium tuberculosis
NAGSGGTGGFGDTDGGAGGAGGDAGW

SEQ ID NO: 1540593 - protein, 9 aa, Mycobacterium tuberculosis
NAPTQTLTG

SEQ ID NO: 1540594 - protein, 11 aa, Mycobacterium tuberculosis
NATDPGAAAQF

SEQ ID NO: 1540595 - protein, 12 aa, Mycobacterium tuberculosis
NATVADGEDQQT

SEQ ID NO: 1540596 - protein, 11 aa, Mycobacterium tuberculosis
NDQGMDPEDPE

SEQ ID NO: 1540597 - protein, 9 aa, Mycobacterium tuberculosis
NEGAPGRGP

SEQ ID NO: 1540598 - protein, 4 aa, Mycobacterium tuberculosis
NGAL

SEQ ID NO: 1540599 - protein, 17 aa, Mycobacterium tuberculosis
NGANGQPGTGAPGGPAG

SEQ ID NO: 1540600 - protein, 13 aa, Mycobacterium tuberculosis
NGATTQTSATDQT

SEQ ID NO: 1540601 - protein, 12 aa, Mycobacterium tuberculosis
NGGAGGAGGAAS

SEQ ID NO: 1540602 - protein, 14 aa, Mycobacterium tuberculosis
NGGAGGAGSAGTGV

SEQ ID NO: 1540603 - protein, 26 aa, Mycobacterium tuberculosis
NGGAGGIGGAGTGTGGHGGAGGAGGR

SEQ ID NO: 1540604 - protein, 34 aa, Mycobacterium tuberculosis; identical to SEQ ID NO: 230569

SEQ ID NO: 1540605 - protein, 46 aa, Mycobacterium tuberculosis
NGGNGGNGGIGQPGGAGGDAGLIGNGGNGGIGGPGATGLAGGAGGV

SEQ ID NO: 1540606 - protein, 46 aa, Mycobacterium tuberculosis; identical to SEQ ID NO: 232265

SEQ ID NO: 1540607 - protein, 40 aa, Mycobacterium tuberculosis; identical to SEQ ID NO: 230589

SEQ ID NO: 1540608 - protein, 7 aa, Mycobacterium tuberculosis
NGKGGQP

SEQ ID NO: 1540609 - protein, 6 aa, Mycobacterium tuberculosis
NGPAGS

SEQ ID NO: 1540610 - protein, 4 aa, Mycobacterium tuberculosis
NGTQ

SEQ ID NO: 1540611 - protein, 13 aa, Mycobacterium tuberculosis
NGYPAGDMSVWNW

SEQ ID NO: 1540612 - protein, 5 aa, Mycobacterium tuberculosis
NIPPE

SEQ ID NO: 1540613 - protein, 6 aa, Mycobacterium tuberculosis
NKSEDA

SEQ ID NO: 1540614 - protein, 10 aa, Mycobacterium tuberculosis
NNGKSATAIS

SEQ ID NO: 1540615 - protein, 10 aa, Mycobacterium tuberculosis
NPDGSKQPVL

SEQ ID NO: 1540616 - protein, 5 aa, Mycobacterium tuberculosis
NPRAR

SEQ ID NO: 1540617 - protein, 6 aa, Mycobacterium tuberculosis
NRISPD

SEQ ID NO: 1540618 - protein, 4 aa, Mycobacterium tuberculosis
NRPT

SEQ ID NO: 1540619 - protein, 6 aa, Mycobacterium tuberculosis
NSAQGY

SEQ ID NO: 1540620 - protein, 14 aa, Mycobacterium tuberculosis
NTRGQGRANQAVTG

SEQ ID NO: 1540621 - protein, 15 aa, Mycobacterium tuberculosis
NTSWPDNTGQPRRAA

SEQ ID NO: 1540622 - protein, 5 aa, Mycobacterium tuberculosis
NTTPA

SEQ ID NO: 1540623 - protein, 12 aa, Mycobacterium tuberculosis
PAARADDKRLND

SEQ ID NO: 1540624 - protein, 17 aa, Mycobacterium tuberculosis
PAEEAAEAASALGGEAA

SEQ ID NO: 1540625 - protein, 15 aa, Mycobacterium tuberculosis
PAGCPDAKPSPPAAY

SEQ ID NO: 1540626 - protein, 7 aa, Mycobacterium tuberculosis
PANDPDV

SEQ ID NO: 1540627 - protein, 19 aa, Mycobacterium tuberculosis
PASAPPEPPDLSASRSAID

SEQ ID NO: 1540628 - protein, 21 aa, Mycobacterium tuberculosis
PASDDYRASASNGSDDASAHI

SEQ ID NO: 1540629 - protein, 12 aa, Mycobacterium tuberculosis
PASNDFASSDFP

SEQ ID NO: 1540630 - protein, 8 aa, Mycobacterium tuberculosis
PAVSPIEE

SEQ ID NO: 1540631 - protein, 23 aa, Mycobacterium tuberculosis
PAWQSAANDVNAKDARMKAICGG

SEQ ID NO: 1540632 - protein, 18 aa, Mycobacterium tuberculosis
PDAGADGRPHRIPEAAGG

SEQ ID NO: 1540633 - protein, 6 aa, Mycobacterium tuberculosis
PDASTV

SEQ ID NO: 1540634 - protein, 7 aa, Mycobacterium tuberculosis
PDDLPDS

SEQ ID NO: 1540635 - protein, 4 aa, Mycobacterium tuberculosis
PELS

SEQ ID NO: 1540636 - protein, 5 aa, Mycobacterium tuberculosis
PEQVN

SEQ ID NO: 1540637 - protein, 38 aa, Mycobacterium tuberculosis; identical to SEQ ID NO: 230749

SEQ ID NO: 1540638 - protein, 10 aa, Mycobacterium tuberculosis
PGGPGESGIE

SEQ ID NO: 1540639 - protein, 15 aa, Mycobacterium tuberculosis
PGPIDTEATRTVTPA
